United States Patent 7,777,022 (BIOINFORMATICALLY DETECTABLE GROUP OF NOVEL REGULATORY VIRAL AND VIRAL ASSOCIATED OLIGONUCLEOTIDES AND USES THEREOF) - sequence listing, part 14

SEQ ID NO: 585110 - RNA, 22 nt, Human
acagaacauggauuuuugaagu

SEQ ID NO: 585111 - RNA, 22 nt, Human
uagugauucccuaucaacccug

SEQ ID NO: 585112 - RNA, 22 nt, Human
accaggaguaacagugaguggu

SEQ ID NO: 585113 - RNA, 22 nt, Human
agccaggcugcaguuggcuggc

SEQ ID NO: 585114 - RNA, 22 nt, Human
aucuauuucugcuaauaacaau

SEQ ID NO: 585115 - RNA, 22 nt, Human
ugagcugugaucuaugauaaau

SEQ ID NO: 585116 - RNA, 23 nt, Human
cagugugacgaggugaggcaggc

SEQ ID NO: 585117 - RNA, 22 nt, Human
gcuggcucgggaagcaggggau

SEQ ID NO: 585118 - RNA, 22 nt, Human
caggcuguguuccuggaacccc

SEQ ID NO: 585119 - RNA, 20 nt, Human
uccugagauuuaagggguuc

SEQ ID NO: 585120 - RNA, 22 nt, Human
cuugaaccaaucacuguagcca

SEQ ID NO: 585121 - RNA, 22 nt, Human
uauuauugcaaguauauaaagu

SEQ ID NO: 585122 - RNA, 22 nt, Human
guuucacagauggggagacacg

SEQ ID NO: 585123 - RNA, 22 nt, Human
uguuuaugugugugcauauaua

SEQ ID NO: 585124 - RNA, 22 nt, Human
ugcagcagacugaguaugagaa

SEQ ID NO: 585125 - RNA, 22 nt, Human
aaacuugaggcaaugaaggugu

SEQ ID NO: 585126 - RNA, 22 nt, Human
ugacagaacagguugggagcaa

SEQ ID NO: 585127 - RNA, 22 nt, Human
cugggccaugggccagcgaggc

SEQ ID NO: 585128 - RNA, 22 nt, Human
guaaaacugucuaaugguauau

SEQ ID NO: 585129 - RNA, 22 nt, Human
ucaagcaaaguuuagcugguua

SEQ ID NO: 585130 - RNA, 22 nt, Human
acacauuaucucauuaaauacu

SEQ ID NO: 585131 - RNA, 22 nt, Human
cugccuggcccagggaugggcc

SEQ ID NO: 585132 - RNA, 22 nt, Human
aguuucuuauucuuaguuaugu

SEQ ID NO: 585133 - RNA, 22 nt, Human
uugauauucugagaagcugaag

SEQ ID NO: 585134 - RNA, 22 nt, Human
uucacaugacagggugaagcau

SEQ ID NO: 585135 - RNA, 22 nt, Human
caucacagggggcuagaagucu

SEQ ID NO: 585136 - RNA, 22 nt, Human
guuuccuaggcuuauacagcug

SEQ ID NO: 585137 - RNA, 22 nt, Human
ucugaagauucuuuccacuauu

SEQ ID NO: 585138 - RNA, 22 nt, Human
uucucuucccacuuucuguauu

SEQ ID NO: 585139 - RNA, 22 nt, Human
uguuuuccuccugguuucugcc

SEQ ID NO: 585140 - RNA, 22 nt, Human
cuguggagugcuuggcucagug

SEQ ID NO: 585141 - RNA, 18 nt, Human
agcugcagaccaggaggu

SEQ ID NO: 585142 - RNA, 22 nt, Human
caggccaagucccaagugcggg

SEQ ID NO: 585143 - RNA, 22 nt, Human
uguauaaacuuaagcaggaacc

SEQ ID NO: 585144 - RNA, 22 nt, Human
cagcugagcaucacuagucugg

SEQ ID NO: 585145 - RNA, 22 nt, Human
gcaaaguuccuacuuuacugga

SEQ ID NO: 585146 - RNA, 22 nt, Human
ugagccugaguucaaggcugca

SEQ ID NO: 585147 - RNA, 22 nt, Human
ucccuagguccuagucacagua

SEQ ID NO: 585148 - RNA, 22 nt, Human
accugcagcugagaaaaugacu

SEQ ID NO: 585149 - RNA, 22 nt, Human
augucucucagguuuaacuuua

SEQ ID NO: 585150 - RNA, 22 nt, Human
uacauauucuaccccuuuuucu

SEQ ID NO: 585151 - RNA, 22 nt, Human
uuaaaagaauccuguuauccuc

SEQ ID NO: 585152 - RNA, 22 nt, Human
ggacaagccugugaguggguuu

SEQ ID NO: 585153 - RNA, 23 nt, Human
uccuggugacaugccugagcauc

SEQ ID NO: 585154 - RNA, 22 nt, Human
gucaaaaaguagucauuucugu

SEQ ID NO: 585155 - RNA, 22 nt, Human
gccuguuuguuaugucauggua

SEQ ID NO: 585156 - RNA, 22 nt, Human
cggaucaugugaccuuugagug

SEQ ID NO: 585157 - RNA, 22 nt, Human
aaaguuuuagaacuaggaagca

SEQ ID NO: 585158 - RNA, 22 nt, Human
auugcuuacuaaucaucuucag

SEQ ID NO: 585159 - RNA, 22 nt, Human
ucagcaaguggaccauccuggg

SEQ ID NO: 585160 - RNA, 22 nt, Human
acugagguggggucugcuugga

SEQ ID NO: 585161 - RNA, 23 nt, Human
ucucugugugccucaguuucuuc

SEQ ID NO: 585162 - RNA, 22 nt, Human
auucuuaauuccaaagacugag

SEQ ID NO: 585163 - RNA, 22 nt, Human
gcagucccauaucuuuaacaua

SEQ ID NO: 585164 - RNA, 22 nt, Human
agauaauaagucugguaauaau

SEQ ID NO: 585165 - RNA, 22 nt, Human
cucugaaaguuagagaaaauag

SEQ ID NO: 585166 - RNA, 22 nt, Human
uucaguaugauuccuccaguag

SEQ ID NO: 585167 - RNA, 22 nt, Human
caagaugaucccugaaggcagc

SEQ ID NO: 585168 - RNA, 22 nt, Human
cugggcacaaguggcccuggau

SEQ ID NO: 585169 - RNA, 22 nt, Human
uccuucagauuccugcuucugg

SEQ ID NO: 585170 - RNA, 22 nt, Human
ugcacacacucugcauauacuu

SEQ ID NO: 585171 - RNA, 22 nt, Human
ucuggcaggguguguauuuaca

SEQ ID NO: 585172 - RNA, 22 nt, Human
ucuuagcauuuguuaauaccca

SEQ ID NO: 585173 - RNA, 22 nt, Human
acacccaggaauaaggacuggg

SEQ ID NO: 585174 - RNA, 22 nt, Human
uguauguaaaguuuguaauaga

SEQ ID NO: 585175 - RNA, 22 nt, Human
auguauuugcguauggacauac

SEQ ID NO: 585176 - RNA, 22 nt, Human
gcauaaaugugcacacacaugu

SEQ ID NO: 585177 - RNA, 22 nt, Human
auaucaaagcuaguggaaauuu

SEQ ID NO: 585178 - RNA, 22 nt, Human
cagggcugcuggccgugcccuc

SEQ ID NO: 585179 - RNA, 22 nt, Human
aagcacagaaaaggagcaugga

SEQ ID NO: 585180 - RNA, 22 nt, Human
acagagagggagugauaaaucc

SEQ ID NO: 585181 - RNA, 22 nt, Human
cagaagaaaguggggagacaag

SEQ ID NO: 585182 - RNA, 22 nt, Human
agauguggccuuugggagauua

SEQ ID NO: 585183 - RNA, 22 nt, Human
acuuuguauaagacaauaaaga

SEQ ID NO: 585184 - RNA, 18 nt, Human
aggaaagaaaggcaggug

SEQ ID NO: 585185 - RNA, 22 nt, Human
caggccuggcccccggcacacc

SEQ ID NO: 585186 - RNA, 22 nt, Human
ucaucuucuauuaauagggaga

SEQ ID NO: 585187 - RNA, 22 nt, Human
cagaaagaccugggcucaagag

SEQ ID NO: 585188 - RNA, 22 nt, Human
auucagugccaaggagaacuug

SEQ ID NO: 585189 - RNA, 18 nt, Human
acugugugaauuagcucc

SEQ ID NO: 585190 - RNA, 22 nt, Human
augcaggggccgccuggccagg

SEQ ID NO: 585191 - RNA, 21 nt, Human
cucuccagugguuccugauuc

SEQ ID NO: 585192 - RNA, 22 nt, Human
ggcuggucacaccacugcaggg

SEQ ID NO: 585193 - RNA, 22 nt, Human
uacauuaacuuacguccacaug

SEQ ID NO: 585194 - RNA, 22 nt, Human
ugagccaagaucaugccguugu

SEQ ID NO: 585195 - RNA, 22 nt, Human
uucuuucagaacacaagugauu

SEQ ID NO: 585196 - RNA, 18 nt, Human
cauuguacaaugcuuuau

SEQ ID NO: 585197 - RNA, 22 nt, Human
cucuggaagaauacacuuagaa

SEQ ID NO: 585198 - RNA, 22 nt, Human
augugagcuccggcagguggaa

SEQ ID NO: 585199 - RNA, 22 nt, Human
ucaguuacucaacagaggugga

SEQ ID NO: 585200 - RNA, 22 nt, Human
ugugcuucaucacuucucaguu

SEQ ID NO: 585201 - RNA, 19 nt, Human
aggcucugagcuccuggag

SEQ ID NO: 585202 - RNA, 22 nt, Human
gugaggugaguagugagaagcc

SEQ ID NO: 585203 - RNA, 22 nt, Human
acagcaagccagcuugucacug

SEQ ID NO: 585204 - RNA, 19 nt, Human
aaugccucaaauugggaga

SEQ ID NO: 585205 - RNA, 22 nt, Human
uucucagauauuuacugagcau

SEQ ID NO: 585206 - RNA, 22 nt, Human
ugcaauaaguuguguuaucacu

SEQ ID NO: 585207 - RNA, 22 nt, Human
uucuccaggcuugggccagguc

SEQ ID NO: 585208 - RNA, 22 nt, Human
uagaaaacuaauacaugcuuga

SEQ ID NO: 585209 - RNA, 18 nt, Human
augagaggugucagaaga

SEQ ID NO: 585210 - RNA, 22 nt, Human
uugggcagaggcugugcagagg

SEQ ID NO: 585211 - RNA, 22 nt, Human
aaguuucuggaccuuaccugcu

SEQ ID NO: 585212 - RNA, 19 nt, Human
gacucacaccuuccgcugu

SEQ ID NO: 585213 - RNA, 19 nt, Human
cagagagaccaaggcgcca

SEQ ID NO: 585214 - RNA, 22 nt, Human
agcuccugcacccagccuugag

SEQ ID NO: 585215 - RNA, 23 nt, Human
agacuggggcauaagaagauggc

SEQ ID NO: 585216 - RNA, 22 nt, Human
agaauucugacaauagaauugg

SEQ ID NO: 585217 - RNA, 22 nt, Human
agggcugcccagugugagagcu

SEQ ID NO: 585218 - RNA, 22 nt, Human
ugggaaauauucuaaaagucuu

SEQ ID NO: 585219 - RNA, 22 nt, Human
uuagccagugaaauggagaaau

SEQ ID NO: 585220 - RNA, 22 nt, Human
aucugaaaagccucuuacuccu

SEQ ID NO: 585221 - RNA, 23 nt, Human
cugggcugcuugagucccuggcu

SEQ ID NO: 585222 - RNA, 22 nt, Human
ccagggcugagcugugaccaug

SEQ ID NO: 585223 - RNA, 22 nt, Human
guacaauagucccuguuuggau

SEQ ID NO: 585224 - RNA, 22 nt, Human
ggaggcugagaaguccaagauc

SEQ ID NO: 585225 - RNA, 22 nt, Human
ucuggcucagggcucugaggga

SEQ ID NO: 585226 - RNA, 20 nt, Human
ugaggcccagcagagucggg

SEQ ID NO: 585227 - RNA, 22 nt, Human
cacaggcaccccugacugcuca

SEQ ID NO: 585228 - RNA, 22 nt, Human
aauaauuagugggacagagaac

SEQ ID NO: 585229 - RNA, 22 nt, Human
gaggccuggcucugcccuccug

SEQ ID NO: 585230 - RNA, 22 nt, Human
cugucuuuucuucucauugaug

SEQ ID NO: 585231 - RNA, 22 nt, Human
cauacauuuauacacaucuaug

SEQ ID NO: 585232 - RNA, 22 nt, Human
ccuggagaggagaaagggccca

SEQ ID NO: 585233 - RNA, 22 nt, Human
cuguuauucaagacaaaggcag

SEQ ID NO: 585234 - RNA, 22 nt, Human
ugcgcgcuggcgucacuuagca

SEQ ID NO: 585235 - RNA, 20 nt, Human
ucuccagaugcagaugacau

SEQ ID NO: 585236 - RNA, 22 nt, Human
ucuggaguaacucuguuucugg

SEQ ID NO: 585237 - RNA, 22 nt, Human
aaauuagaucaguggauuuucu

SEQ ID NO: 585238 - RNA, 22 nt, Human
cagaaaaccugacucuagaacu

SEQ ID NO: 585239 - RNA, 22 nt, Human
uccaguuuccuguggcugccua

SEQ ID NO: 585240 - RNA, 19 nt, Human
uggcucugucgaaggcaca

SEQ ID NO: 585241 - RNA, 22 nt, Human
cagcagcagcuuaguggucccc

SEQ ID NO: 585242 - RNA, 17 nt, Human
uagcacagugccuggua

SEQ ID NO: 585243 - RNA, 17 nt, Human
ucugucugugguccacu

SEQ ID NO: 585244 - RNA, 22 nt, Human
aacaggaugucauuucucaugu

SEQ ID NO: 585245 - RNA, 22 nt, Human
gcaggagaacaaagcaagcugc

SEQ ID NO: 585246 - RNA, 22 nt, Human
ccugagggcucagcccccagcc

SEQ ID NO: 585247 - RNA, 22 nt, Human
gcugcuuugucuguaaaaugga

SEQ ID NO: 585248 - RNA, 22 nt, Human
ccaggucuaucaaguugggcuc

SEQ ID NO: 585249 - RNA, 22 nt, Human
aacauuuauucuaauucuggga

SEQ ID NO: 585250 - RNA, 22 nt, Human
uuacaagacacagugcugaagg

SEQ ID NO: 585251 - RNA, 22 nt, Human
uggcacugagcagccgcggcag

SEQ ID NO: 585252 - RNA, 22 nt, Human
cucugggcaccaaagagcagcu

SEQ ID NO: 585253 - RNA, 22 nt, Human
uuggucaagucuuaaagaaaaa

SEQ ID NO: 585254 - RNA, 22 nt, Human
uggcacuggaaucguagccuug

SEQ ID NO: 585255 - RNA, 20 nt, Human
gaagccagaggggaaaggag

SEQ ID NO: 585256 - RNA, 22 nt, Human
cagcagugaugugugaggguuc

SEQ ID NO: 585257 - RNA, 22 nt, Human
cagaggguugucaggcgccuug

SEQ ID NO: 585258 - RNA, 22 nt, Human
uccucaggagagcuccuaugcc

SEQ ID NO: 585259 - RNA, 22 nt, Human
cagugcuaggucgugugcuggg

SEQ ID NO: 585260 - RNA, 22 nt, Human
acauuuauauaacucacuagga

SEQ ID NO: 585261 - RNA, 22 nt, Human
cuuccuggccauugccauggca

SEQ ID NO: 585262 - RNA, 22 nt, Human
aagaggggugugugucaaccca

SEQ ID NO: 585263 - RNA, 22 nt, Human
gcucucuuuaaacugcauggcu

SEQ ID NO: 585264 - RNA, 22 nt, Human
gggcacugggucuucuccacgc

SEQ ID NO: 585265 - RNA, 22 nt, Human
cacagcuguauccaggagaucc

SEQ ID NO: 585266 - RNA, 22 nt, Human
agugggagggccauauggugaa

SEQ ID NO: 585267 - RNA, 22 nt, Human
aacacuuucuuccuugcucagg

SEQ ID NO: 585268 - RNA, 19 nt, Human
agcucaggcccaucguccc

SEQ ID NO: 585269 - RNA, 22 nt, Human
uugcaaaaccauccuaaguaaa

SEQ ID NO: 585270 - RNA, 22 nt, Human
cuggccagugacugcucacccg

SEQ ID NO: 585271 - RNA, 22 nt, Human
agguggcauuuacaccauggga

SEQ ID NO: 585272 - RNA, 22 nt, Human
ugugaaggcagagccagugaaa

SEQ ID NO: 585273 - RNA, 22 nt, Human
aggcugagccugggcguggugg

SEQ ID NO: 585274 - RNA, 22 nt, Human
aggaggcaacugagauuuagaa

SEQ ID NO: 585275 - RNA, 22 nt, Human
ucugaggccuucagcaugaauc

SEQ ID NO: 585276 - RNA, 22 nt, Human
aucguaaagcccuauggcuuca

SEQ ID NO: 585277 - RNA, 22 nt, Human
auaaccugguaguauuaaaugu

SEQ ID NO: 585278 - RNA, 22 nt, Human
aaaaugaagcaaaggcauucag

SEQ ID NO: 585279 - RNA, 21 nt, Human
auuauuauaaagaccacaggg

SEQ ID NO: 585280 - RNA, 21 nt, Human
ucuaagccuugcagauggguu

SEQ ID NO: 585281 - RNA, 22 nt, Human
gugcaaaaguaauugcuguuuu

SEQ ID NO: 585282 - RNA, 22 nt, Human
agugaagccccgaugcguuuug

SEQ ID NO: 585283 - RNA, 22 nt, Human
cugggacuuuguaggccaguug

SEQ ID NO: 585284 - RNA, 19 nt, Human
ugggccucacaaugcuccc

SEQ ID NO: 585285 - RNA, 22 nt, Human
cagaagcagugagagaugugca

SEQ ID NO: 585286 - RNA, 23 nt, Human
ugaaugauggugcuccucaucuu

SEQ ID NO: 585287 - RNA, 22 nt, Human
ccagguguaggacaccaaggga

SEQ ID NO: 585288 - RNA, 22 nt, Human
uccuggccuugcgucuugggag

SEQ ID NO: 585289 - RNA, 22 nt, Human
ggaggccaccauggagucacuu

SEQ ID NO: 585290 - RNA, 22 nt, Human
auuucauugaaguuaauucuuc

SEQ ID NO: 585291 - RNA, 22 nt, Human
gaaaaggaaauuuauagagauc

SEQ ID NO: 585292 - RNA, 22 nt, Human
uuauugaaggaacugaaauaaa

SEQ ID NO: 585293 - RNA, 22 nt, Human
uucuccuggggccgugauguga

SEQ ID NO: 585294 - RNA, 22 nt, Human
agagcucaagacgcucacagua

SEQ ID NO: 585295 - RNA, 22 nt, Human
aaagacagauggcaaggaugau

SEQ ID NO: 585296 - RNA, 22 nt, Human
cagcugugcugauugcucagua

SEQ ID NO: 585297 - RNA, 22 nt, Human
ucugggguugagucugggucag

SEQ ID NO: 585298 - RNA, 22 nt, Human
acaugauuugcaugauuuguaa

SEQ ID NO: 585299 - RNA, 22 nt, Human
ggcuuccuuucacuacccucag

SEQ ID NO: 585300 - RNA, 22 nt, Human
uggcuuggcuaagaucuaagcu

SEQ ID NO: 585301 - RNA, 22 nt, Human
accugcucaacuggcuucucgc

SEQ ID NO: 585302 - RNA, 22 nt, Human
cccagaggugacaucccauucu

SEQ ID NO: 585303 - RNA, 22 nt, Human
uuuuacaccuguuaacucuaag

SEQ ID NO: 585304 - RNA, 22 nt, Human
auuuccuauagauauggugagu

SEQ ID NO: 585305 - RNA, 22 nt, Human
ucugaaagaagggcagucuuuu

SEQ ID NO: 585306 - RNA, 21 nt, Human
aaguggagaagaaaagcugga

SEQ ID NO: 585307 - RNA, 21 nt, Human
aggagaccggcuuguuugugc

SEQ ID NO: 585308 - RNA, 22 nt, Human
uagugaaagucaaagacagcua

SEQ ID NO: 585309 - RNA, 22 nt, Human
uagcauuccaucacucagcacc

SEQ ID NO: 585310 - RNA, 22 nt, Human
uggcaucuccgacagucuugau

SEQ ID NO: 585311 - RNA, 22 nt, Human
uccugguggcucuuugggaagg

SEQ ID NO: 585312 - RNA, 22 nt, Human
acaggcaacuucaaaucucacu

SEQ ID NO: 585313 - RNA, 22 nt, Human
cugccugugcaugcagucagaa

SEQ ID NO: 585314 - RNA, 22 nt, Human
gaggaucauuugagccuaggag

SEQ ID NO: 585315 - RNA, 22 nt, Human
gaggccacggaagggagcugug

SEQ ID NO: 585316 - RNA, 22 nt, Human
ccaggccuucugaggacacucu

SEQ ID NO: 585317 - RNA, 22 nt, Human
uaguacaguuuuggcacaugga

SEQ ID NO: 585318 - RNA, 22 nt, Human
aagcagaugcguuggagcaguu

SEQ ID NO: 585319 - RNA, 21 nt, Human
cauuucuaagccuggcuauag

SEQ ID NO: 585320 - RNA, 22 nt, Human
uuuucagaggccuaagagguuu

SEQ ID NO: 585321 - RNA, 18 nt, Human
uccuucacagcaggaagg

SEQ ID NO: 585322 - RNA, 22 nt, Human
uguuucaugaaacauguuuagg

SEQ ID NO: 585323 - RNA, 22 nt, Human
cccucaggugaaaggaaaaauu

SEQ ID NO: 585324 - RNA, 22 nt, Human
ugucuuucugacccaagguagu

SEQ ID NO: 585325 - RNA, 22 nt, Human
ucuguggaguugaggaagguug

SEQ ID NO: 585326 - RNA, 22 nt, Human
uccagaaaugcaagccaggugu

SEQ ID NO: 585327 - RNA, 22 nt, Human
aguucuauuggguagguucugu

SEQ ID NO: 585328 - RNA, 22 nt, Human
cagcuauuuucucauuaaggau

SEQ ID NO: 585329 - RNA, 22 nt, Human
agcagcucaacagugucucuau

SEQ ID NO: 585330 - RNA, 22 nt, Human
uguggaagaaacaagacacuuu

SEQ ID NO: 585331 - RNA, 22 nt, Human
cccuguuaaugucaaccugccu

SEQ ID NO: 585332 - RNA, 22 nt, Human
uuagagaauuccaaaugacuac

SEQ ID NO: 585333 - RNA, 22 nt, Human
uuuagagucauuuuauauugac

SEQ ID NO: 585334 - RNA, 22 nt, Human
acagagcuguacaugugccaug

SEQ ID NO: 585335 - RNA, 22 nt, Human
cugcugccaagggugccacagg

SEQ ID NO: 585336 - RNA, 22 nt, Human
acugccucuuggugcugagaga

SEQ ID NO: 585337 - RNA, 22 nt, Human
aaguuucuguucauaucucuga

SEQ ID NO: 585338 - RNA, 17 nt, Human
aggggagagugggaaga

SEQ ID NO: 585339 - RNA, 21 nt, Human
cugcaggugcugccaucaggg

SEQ ID NO: 585340 - RNA, 23 nt, Human
agagccugaaagacuucuggcac

SEQ ID NO: 585341 - RNA, 20 nt, Human
gucagugucuucaguaguga

SEQ ID NO: 585342 - RNA, 22 nt, Human
uucuuucugggguccuucggcu

SEQ ID NO: 585343 - RNA, 22 nt, Human
uagcuuuaaugaguugguaaga

SEQ ID NO: 585344 - RNA, 22 nt, Human
uguugcuaaggggaaugagagc

SEQ ID NO: 585345 - RNA, 22 nt, Human
auuucucauguacaaaaacacu

SEQ ID NO: 585346 - RNA, 22 nt, Human
uccuggaguugugcagugcaca

SEQ ID NO: 585347 - RNA, 22 nt, Human
ccuacauucucugaguuuuccu

SEQ ID NO: 585348 - RNA, 22 nt, Human
agcagagccagaauuggaccag

SEQ ID NO: 585349 - RNA, 22 nt, Human
ggucugcuuuccuugccacugu

SEQ ID NO: 585350 - RNA, 22 nt, Human
aucaucugcacagauccuauuu

SEQ ID NO: 585351 - RNA, 22 nt, Human
cacugccugcuggcugucacuu

SEQ ID NO: 585352 - RNA, 22 nt, Human
cuugggagacacaagaagacau

SEQ ID NO: 585353 - RNA, 22 nt, Human
gcugccugguuucucagcugca

SEQ ID NO: 585354 - RNA, 22 nt, Human
ugcugaauucucauucccugga

SEQ ID NO: 585355 - RNA, 22 nt, Human
acugagaacucaagagaaaagg

SEQ ID NO: 585356 - RNA, 22 nt, Human
uccuugagagccacugucuugg

SEQ ID NO: 585357 - RNA, 22 nt, Human
auauaguuuaagaaaguacagu

SEQ ID NO: 585358 - RNA, 22 nt, Human
ugaagauuuucggguacuugau

SEQ ID NO: 585359 - RNA, 23 nt, Human
aaugacaccucauagguaacuuc

SEQ ID NO: 585360 - RNA, 22 nt, Human
ucagcacuuacuaguggccuuu

SEQ ID NO: 585361 - RNA, 22 nt, Human
ucaguguguacacugagcauuu

SEQ ID NO: 585362 - RNA, 22 nt, Human
uggcauggcuacuggaauggcg

SEQ ID NO: 585363 - RNA, 18 nt, Human
agaggcuggacaggggau

SEQ ID NO: 585364 - RNA, 22 nt, Human
gcaagcagaucuccggagggaa

SEQ ID NO: 585365 - RNA, 21 nt, Human
ucugaugguagaugagaugug

SEQ ID NO: 585366 - RNA, 22 nt, Human
aggacacagcucuucaguaaga

SEQ ID NO: 585367 - RNA, 22 nt, Human
gacacauagaucuaucucacuc

SEQ ID NO: 585368 - RNA, 22 nt, Human
gggucagggcugccugggcuca

SEQ ID NO: 585369 - RNA, 22 nt, Human
uucucuggaaggcucuacggga

SEQ ID NO: 585370 - RNA, 22 nt, Human
ucagugcagggugggagagaga

SEQ ID NO: 585371 - RNA, 22 nt, Human
ccugggcaggaugggcccggug

SEQ ID NO: 585372 - RNA, 19 nt, Human
agaaauagccuuccuuguc

SEQ ID NO: 585373 - RNA, 22 nt, Human
aaaauguaaagcuugaguguag

SEQ ID NO: 585374 - RNA, 22 nt, Human
ugucuccucuguccugucagga

SEQ ID NO: 585375 - RNA, 22 nt, Human
cugaggccuggccccaccacag

SEQ ID NO: 585376 - RNA, 22 nt, Human
uauguacacacacaugcaugua

SEQ ID NO: 585377 - RNA, 22 nt, Human
agcagggcugcagugugucuuu

SEQ ID NO: 585378 - RNA, 22 nt, Human
cacugugcuccuaacuagcugu

SEQ ID NO: 585379 - RNA, 22 nt, Human
ugguggagccuaggcuaagucu

SEQ ID NO: 585380 - RNA, 22 nt, Human
ugcuggcuuugcgagaugcauu

SEQ ID NO: 585381 - RNA, 22 nt, Human
uaucauuuuacugugacauuuu

SEQ ID NO: 585382 - RNA, 22 nt, Human
uuacagaaggaacacuacucag

SEQ ID NO: 585383 - RNA, 22 nt, Human
cuggccugaucucaugcugucc

SEQ ID NO: 585384 - RNA, 23 nt, Human
agguuaugauuauagagcgagga

SEQ ID NO: 585385 - RNA, 22 nt, Human
agcugcccuguggggaggguug

SEQ ID NO: 585386 - RNA, 22 nt, Human
agcaccagagcuaugggccugc

SEQ ID NO: 585387 - RNA, 22 nt, Human
uccaacuucugcaaucaguuug

SEQ ID NO: 585388 - RNA, 22 nt, Human
ugccuuuuauggcuagccucag

SEQ ID NO: 585389 - RNA, 22 nt, Human
cuuuuuaucucuuaaugauguu

SEQ ID NO: 585390 - RNA, 22 nt, Human
ggccugaggcaauagucagaca

SEQ ID NO: 585391 - RNA, 22 nt, Human
caaacauuuucuacuuccagga

SEQ ID NO: 585392 - RNA, 22 nt, Human
ucauguguccuaguucauauaa

SEQ ID NO: 585393 - RNA, 22 nt, Human
acacauaugguugcugcaguga

SEQ ID NO: 585394 - RNA, 22 nt, Human
aacauucuuuagcucuuccugc

SEQ ID NO: 585395 - RNA, 21 nt, Human
ugguacaccuugccugucaga

SEQ ID NO: 585396 - RNA, 16 nt, Human
agcaccagaucauauc

SEQ ID NO: 585397 - RNA, 23 nt, Human
ucccagccucuucucuugcauac

SEQ ID NO: 585398 - RNA, 22 nt, Human
gcuuucugguuugugcuacagg

SEQ ID NO: 585399 - RNA, 22 nt, Human
caguaacaugucuguuaagaaa

SEQ ID NO: 585400 - RNA, 22 nt, Human
cacguccacccaggcugcccag

SEQ ID NO: 585401 - RNA, 22 nt, Human
ccuuggcuuccuucccucuaga

SEQ ID NO: 585402 - RNA, 22 nt, Human
cagcuccagccaccggggggug

SEQ ID NO: 585403 - RNA, 18 nt, Human
uggaagcuggugagcaga

SEQ ID NO: 585404 - RNA, 22 nt, Human
uucugucuguaaacuucucaau

SEQ ID NO: 585405 - RNA, 22 nt, Human
uuuauuucuuaguuugccacag

SEQ ID NO: 585406 - RNA, 22 nt, Human
ugcuuuaaccaucuuguuugga

SEQ ID NO: 585407 - RNA, 22 nt, Human
ugcuguguuaaauacaagcaug

SEQ ID NO: 585408 - RNA, 22 nt, Human
gacccuggcagguagccucaca

SEQ ID NO: 585409 - RNA, 22 nt, Human
ggcucccucaccaccaucacau

SEQ ID NO: 585410 - RNA, 22 nt, Human
ucacccagcagcugcuucugcu

SEQ ID NO: 585411 - RNA, 22 nt, Human
aacaugcucuuccuggcuaguc

SEQ ID NO: 585412 - RNA, 22 nt, Human
augcaguacauacaaacacuga

SEQ ID NO: 585413 - RNA, 17 nt, Human
uguuuucugcuaccuuu

SEQ ID NO: 585414 - RNA, 22 nt, Human
gcuggagcugcagccugggccu

SEQ ID NO: 585415 - RNA, 22 nt, Human
cugggcaguuuauucaguucug

SEQ ID NO: 585416 - RNA, 22 nt, Human
auccacuugccacuguauaguu

SEQ ID NO: 585417 - RNA, 22 nt, Human
agcacaggugaaacagucaggu

SEQ ID NO: 585418 - RNA, 22 nt, Human
ugcugccauggucgcugguguc

SEQ ID NO: 585419 - RNA, 22 nt, Human
uaugacagugaaaaaaaucaga

SEQ ID NO: 585420 - RNA, 22 nt, Human
ggccugaggccaccagcagccc

SEQ ID NO: 585421 - RNA, 22 nt, Human
ucccuaaacucugaacugauuc

SEQ ID NO: 585422 - RNA, 22 nt, Human
cugcucuguuucuuagcugggu

SEQ ID NO: 585423 - RNA, 22 nt, Human
ugaaaaugcccucuaugucuca

SEQ ID NO: 585424 - RNA, 22 nt, Human
uucugauacuggaaucgaugcc

SEQ ID NO: 585425 - RNA, 22 nt, Human
uggugaggucauagagaacugu

SEQ ID NO: 585426 - RNA, 22 nt, Human
ggaggagcacuugacggggucu

SEQ ID NO: 585427 - RNA, 22 nt, Human
ucuauaaagggccagauaguag

SEQ ID NO: 585428 - RNA, 22 nt, Human
acacauuccugcagacaugaug

SEQ ID NO: 585429 - RNA, 19 nt, Human
ggagccuggagcacgugcc

SEQ ID NO: 585430 - RNA, 16 nt, Human
ccagguggggcuguga

SEQ ID NO: 585431 - RNA, 22 nt, Human
ggcaccuggauguagcagugaa

SEQ ID NO: 585432 - RNA, 22 nt, Human
uagcucugaggccaucuccggu

SEQ ID NO: 585433 - RNA, 22 nt, Human
ugcugaggacuaaaggagauga

SEQ ID NO: 585434 - RNA, 22 nt, Human
cuugauuuauuacccacuauau

SEQ ID NO: 585435 - RNA, 22 nt, Human
ugugagacaauugcaucagggc

SEQ ID NO: 585436 - RNA, 22 nt, Human
auugcugaaaugaaaggauaug

SEQ ID NO: 585437 - RNA, 22 nt, Human
acauggaagcaaaguucuauuu

SEQ ID NO: 585438 - RNA, 22 nt, Human
ugucaccaguuccaggaaauaa

SEQ ID NO: 585439 - RNA, 22 nt, Human
auacaguaaccacauucuauag

SEQ ID NO: 585440 - RNA, 22 nt, Human
ugaccuuucucugggugcuugg

SEQ ID NO: 585441 - RNA, 22 nt, Human
gugaaggauuggagggcaucuu

SEQ ID NO: 585442 - RNA, 22 nt, Human
auugcuaaugugcgaaugugua

SEQ ID NO: 585443 - RNA, 22 nt, Human
gcauacauugcacccugguagu

SEQ ID NO: 585444 - RNA, 22 nt, Human
ucccagagugugggcaucaagg

SEQ ID NO: 585445 - RNA, 22 nt, Human
ugcaauaaagugcuauaaaucc

SEQ ID NO: 585446 - RNA, 19 nt, Human
agaaucuaaauuauuucug

SEQ ID NO: 585447 - RNA, 22 nt, Human
acagaauaagguuuaucucucc

SEQ ID NO: 585448 - RNA, 21 nt, Human
acucugcugcgggcuuggccu

SEQ ID NO: 585449 - RNA, 19 nt, Human
aucuccuuucuucaagcuu

SEQ ID NO: 585450 - RNA, 22 nt, Human
uacagcuucagugugccccagu

SEQ ID NO: 585451 - RNA, 22 nt, Human
uugagguauugauauuuuauga

SEQ ID NO: 585452 - RNA, 22 nt, Human
gucaauaauuuuauggagagaa

SEQ ID NO: 585453 - RNA, 22 nt, Human
acaaacagaguugaaaaauagg

SEQ ID NO: 585454 - RNA, 22 nt, Human
aggaaugauucaagacuuggcu

SEQ ID NO: 585455 - RNA, 22 nt, Human
ggggaaggauugaguugaccca

SEQ ID NO: 585456 - RNA, 22 nt, Human
uucugucuggaaaaggacauag

SEQ ID NO: 585457 - RNA, 22 nt, Human
uauaaaucuuuguuccuagaau

SEQ ID NO: 585458 - RNA, 22 nt, Human
ccaguguuuuccaguuugccca

SEQ ID NO: 585459 - RNA, 22 nt, Human
acauuguuaguagaccaguggc

SEQ ID NO: 585460 - RNA, 22 nt, Human
aggaauuuggaauuuuuccugu

SEQ ID NO: 585461 - RNA, 22 nt, Human
uuggccuuuaaacuggacuuuc

SEQ ID NO: 585462 - RNA, 22 nt, Human
cuuguauucagaguggacauga

SEQ ID NO: 585463 - RNA, 22 nt, Human
gagaaagauguaggcugggagg

SEQ ID NO: 585464 - RNA, 22 nt, Human
uuaagagguggucgugucugug

SEQ ID NO: 585465 - RNA, 22 nt, Human
ugggagaagcagcagccaagug

SEQ ID NO: 585466 - RNA, 22 nt, Human
cugcagugcaagcccagaugga

SEQ ID NO: 585467 - RNA, 18 nt, Human
uaagcaaugacauugcaa

SEQ ID NO: 585468 - RNA, 22 nt, Human
agggccaggcucccaugucagg

SEQ ID NO: 585469 - RNA, 22 nt, Human
cuccagggaaaggggcguccgc

SEQ ID NO: 585470 - RNA, 22 nt, Human
gauuauauaauggaagcucuug

SEQ ID NO: 585471 - RNA, 22 nt, Human
uuccugguuuauaccuguauca

SEQ ID NO: 585472 - RNA, 22 nt, Human
gcucuggcuacuguggcuaccg

SEQ ID NO: 585473 - RNA, 22 nt, Human
agggugcugccggacagguggg

SEQ ID NO: 585474 - RNA, 22 nt, Human
ccagcugcucucuucuccgcca

SEQ ID NO: 585475 - RNA, 22 nt, Human
aggcaucuaacagagaucuuua

SEQ ID NO: 585476 - RNA, 22 nt, Human
guggcccacuuacgucaugugu

SEQ ID NO: 585477 - RNA, 20 nt, Human
caagcccucuuuagccugcc

SEQ ID NO: 585478 - RNA, 22 nt, Human
ccaggugcucuugccagggcug

SEQ ID NO: 585479 - RNA, 18 nt, Human
gugggguguugugaggau

SEQ ID NO: 585480 - RNA, 22 nt, Human
aaggcugagggcuguaccuggc

SEQ ID NO: 585481 - RNA, 22 nt, Human
uuccucagggcggaugggcagg

SEQ ID NO: 585482 - RNA, 22 nt, Human
gccccuccauccaucaccgggg

SEQ ID NO: 585483 - RNA, 22 nt, Human
cuuuaugagccuugugaaggag

SEQ ID NO: 585484 - RNA, 22 nt, Human
aaauucaguuccucagccacau

SEQ ID NO: 585485 - RNA, 22 nt, Human
acagaguaggugcugucgacug

SEQ ID NO: 585486 - RNA, 22 nt, Human
ucuuuucacagacaaauggaga

SEQ ID NO: 585487 - RNA, 22 nt, Human
uuugucaauaacuaccaacagg

SEQ ID NO: 585488 - RNA, 22 nt, Human
uuucccaagaaaaauaauugga

SEQ ID NO: 585489 - RNA, 22 nt, Human
uauuuggaaaugauaaaguacu

SEQ ID NO: 585490 - RNA, 22 nt, Human
gaaauauuacaguggaggggau

SEQ ID NO: 585491 - RNA, 22 nt, Human
aaaugcauugguuucuacuugu

SEQ ID NO: 585492 - RNA, 22 nt, Human
uagaauaaguugaugauauaug

SEQ ID NO: 585493 - RNA, 21 nt, Human
uggagcugaauuuuuggcauc

SEQ ID NO: 585494 - RNA, 22 nt, Human
cuggccuuuagccccagugucu

SEQ ID NO: 585495 - RNA, 22 nt, Human
ugaggcagguggauuacaaggu

SEQ ID NO: 585496 - RNA, 22 nt, Human
uuucucaaaagacagaagugaa

SEQ ID NO: 585497 - RNA, 22 nt, Human
gccuccuaccacacccucaguc

SEQ ID NO: 585498 - RNA, 22 nt, Human
guugugcagggcgaggaccuga

SEQ ID NO: 585499 - RNA, 22 nt, Human
aaggcugguggauuaugagguc

SEQ ID NO: 585500 - RNA, 22 nt, Human
ugcugguccccugcagccugug

SEQ ID NO: 585501 - RNA, 22 nt, Human
auuaagaugugggaaaauuuaa

SEQ ID NO: 585502 - RNA, 22 nt, Human
aaugcuuauaacguuagaaugu

SEQ ID NO: 585503 - RNA, 22 nt, Human
uuauuuaaaagugguaagauuc

SEQ ID NO: 585504 - RNA, 22 nt, Human
gagggccaauggauuucaacug

SEQ ID NO: 585505 - RNA, 22 nt, Human
gaagccagccuugucugccucu

SEQ ID NO: 585506 - RNA, 22 nt, Human
ccacccuguguuuuugccauug

SEQ ID NO: 585507 - RNA, 22 nt, Human
ugcaaagaagcaacauccuugu

SEQ ID NO: 585508 - RNA, 21 nt, Human
uccucagggccccagagcacu

SEQ ID NO: 585509 - RNA, 22 nt, Human
acauuucucagguaagucauuu

SEQ ID NO: 585510 - RNA, 22 nt, Human
agccuagguuuccgauucucuu

SEQ ID NO: 585511 - RNA, 23 nt, Human
ugcagggcaaguuagagacccca

SEQ ID NO: 585512 - RNA, 22 nt, Human
cccaggagcuucucucugccuc

SEQ ID NO: 585513 - RNA, 22 nt, Human
uccugcagaucaaagccuuuga

SEQ ID NO: 585514 - RNA, 22 nt, Human
ugacaaaacugcaauuacuuuu

SEQ ID NO: 585515 - RNA, 22 nt, Human
ccacagagacagagcccagggu

SEQ ID NO: 585516 - RNA, 22 nt, Human
uuugugcagguauaggcggaga

SEQ ID NO: 585517 - RNA, 22 nt, Human
ugcagggauccuagcugaagag

SEQ ID NO: 585518 - RNA, 22 nt, Human
cuggccagagguuccucugccc

SEQ ID NO: 585519 - RNA, 22 nt, Human
ggccaugguuggggaagacaug

SEQ ID NO: 585520 - RNA, 22 nt, Human
uaguuuuauaauguuaacaucu

SEQ ID NO: 585521 - RNA, 22 nt, Human
ccaggcagagggauccccaucc

SEQ ID NO: 585522 - RNA, 22 nt, Human
ugcuuaaaggauaguuuaaacu

SEQ ID NO: 585523 - RNA, 22 nt, Human
ucuaauccuugcuaccugggug

SEQ ID NO: 585524 - RNA, 22 nt, Human
acacaguaugcaucuagaaauu

SEQ ID NO: 585525 - RNA, 21 nt, Human
uaucuacuggugucuuucaga

SEQ ID NO: 585526 - RNA, 19 nt, Human
uguggggagucagggggcu

SEQ ID NO: 585527 - RNA, 22 nt, Human
caaggcugucuccagcuuccaa

SEQ ID NO: 585528 - RNA, 22 nt, Human
ugacagggcuagaggcaaugca

SEQ ID NO: 585529 - RNA, 22 nt, Human
uugaagcaaauucugugcagua

SEQ ID NO: 585530 - RNA, 22 nt, Human
gcuuaaaauccaugauuuuuac

SEQ ID NO: 585531 - RNA, 22 nt, Human
guuuccuaccagugguuccaga

SEQ ID NO: 585532 - RNA, 22 nt, Human
aagagcagauuccuaguggagc

SEQ ID NO: 585533 - RNA, 22 nt, Human
gacaagugcugauuuaucuccc

SEQ ID NO: 585534 - RNA, 22 nt, Human
cugggugcuuacuuugugcuag

SEQ ID NO: 585535 - RNA, 22 nt, Human
acagaagcagccgucacagaua

SEQ ID NO: 585536 - RNA, 22 nt, Human
cugcuuuagacaacugcuggga

SEQ ID NO: 585537 - RNA, 22 nt, Human
cuuccccaaccccgacugugug

SEQ ID NO: 585538 - RNA, 22 nt, Human
ucccaggaugaagacaguguug

SEQ ID NO: 585539 - RNA, 22 nt, Human
gggcuccaguuuggccaggaag

SEQ ID NO: 585540 - RNA, 22 nt, Human
guuuuucuaggaccaugugauu

SEQ ID NO: 585541 - RNA, 22 nt, Human
cugcauaucaaauuacuccugg

SEQ ID NO: 585542 - RNA, 22 nt, Human
agcaccuauagaaguuguguuc

SEQ ID NO: 585543 - RNA, 22 nt, Human
cccucgccgcagcugcuucccg

SEQ ID NO: 585544 - RNA, 22 nt, Human
ugcaauuaauuuacaugcuuaa

SEQ ID NO: 585545 - RNA, 22 nt, Human
gauaacaauaugaaguagauau

SEQ ID NO: 585546 - RNA, 22 nt, Human
uacaugcuggugacuguagaca

SEQ ID NO: 585547 - RNA, 22 nt, Human
agaggcaggaagagcugauuuu

SEQ ID NO: 585548 - RNA, 22 nt, Human
ugagagaguaauugagugguaa

SEQ ID NO: 585549 - RNA, 22 nt, Human
cuguuauuuuauaauucaagaa

SEQ ID NO: 585550 - RNA, 22 nt, Human
ggaggccaggaugggaacucaa

SEQ ID NO: 585551 - RNA, 22 nt, Human
uauauuaaaugaccaguuuuaa

SEQ ID NO: 585552 - RNA, 22 nt, Human
cagccccucacagagcuguccu

SEQ ID NO: 585553 - RNA, 22 nt, Human
aagacauuuaugaaaagugcug

SEQ ID NO: 585554 - RNA, 20 nt, Human
uggagccacagucagguucc

SEQ ID NO: 585555 - RNA, 22 nt, Human
gagggcugcaaugagacagaga

SEQ ID NO: 585556 - RNA, 20 nt, Human
cagcucugggcaggucgagg

SEQ ID NO: 585557 - RNA, 22 nt, Human
uugcugaaaucuaugacauccu

SEQ ID NO: 585558 - RNA, 22 nt, Human
cuggcuuugcuggacugggagu

SEQ ID NO: 585559 - RNA, 21 nt, Human
agaugcaguuaugagaugcag

SEQ ID NO: 585560 - RNA, 22 nt, Human
uguaagugcucagcugaugguu

SEQ ID NO: 585561 - RNA, 22 nt, Human
guauuuucaugauuucagacca

SEQ ID NO: 585562 - RNA, 18 nt, Human
uggcagagugucuguucu

SEQ ID NO: 585563 - RNA, 22 nt, Human
guuuacaugcaugcaagaauga

SEQ ID NO: 585564 - RNA, 23 nt, Human
gggagaauaugaggaugauggug

SEQ ID NO: 585565 - RNA, 22 nt, Human
cacuggcccauuccugucuggc

SEQ ID NO: 585566 - RNA, 20 nt, Human
uagaacuuuucaguauggau

SEQ ID NO: 585567 - RNA, 19 nt, Human
ggagaagcccaggaauccu

SEQ ID NO: 585568 - RNA, 22 nt, Human
gcagaaauaugaugcauaaagg

SEQ ID NO: 585569 - RNA, 22 nt, Human
ggcuccagguacguaugggagg

SEQ ID NO: 585570 - RNA, 21 nt, Human
ccagcccagcugugucccagc

SEQ ID NO: 585571 - RNA, 22 nt, Human
ugugggaggaacacagccagaa

SEQ ID NO: 585572 - RNA, 20 nt, Human
cucuuaauugcucacauuag

SEQ ID NO: 585573 - RNA, 22 nt, Human
ccuuccuuugcaggucagguca

SEQ ID NO: 585574 - RNA, 22 nt, Human
aguggucugccugccucagccu

SEQ ID NO: 585575 - RNA, 21 nt, Human
ugaaugcuucgucauccuggc

SEQ ID NO: 585576 - RNA, 22 nt, Human
ggcugcuguacugaugucaguu

SEQ ID NO: 585577 - RNA, 22 nt, Human
ugcaguuuuccuucaacauugu

SEQ ID NO: 585578 - RNA, 23 nt, Human
acacuucacccauugugauagga

SEQ ID NO: 585579 - RNA, 22 nt, Human
ucuauguccuuucucccauucc

SEQ ID NO: 585580 - RNA, 18 nt, Human
auggucucauacugggag

SEQ ID NO: 585581 - RNA, 22 nt, Human
cugggccacaagccugugugau

SEQ ID NO: 585582 - RNA, 22 nt, Human
gguuuauuguuaauaaguuuga

SEQ ID NO: 585583 - RNA, 22 nt, Human
acaugcuaauggagaugccaag

SEQ ID NO: 585584 - RNA, 21 nt, Human
acacugugucauaaugcuuaa

SEQ ID NO: 585585 - RNA, 22 nt, Human
ccaggcuguuuucaaacuuggg

SEQ ID NO: 585586 - RNA, 22 nt, Human
augaaaauguacauguguauaa

SEQ ID NO: 585587 - RNA, 20 nt, Human
ggguggaguugcggucugug

SEQ ID NO: 585588 - RNA, 22 nt, Human
guggccugccgugugguauggg

SEQ ID NO: 585589 - RNA, 21 nt, Human
gcucuccagggccagcccagg

SEQ ID NO: 585590 - RNA, 22 nt, Human
gcagagugaagcaguauggaaa

SEQ ID NO: 585591 - RNA, 22 nt, Human
gggauagguuuggaagaggugg

SEQ ID NO: 585592 - RNA, 22 nt, Human
gcuucagacuggagcagaggaa

SEQ ID NO: 585593 - RNA, 22 nt, Human
aucuacaggcugaggugggagg

SEQ ID NO: 585594 - RNA, 22 nt, Human
ugggacaggaugaccagaaggu

SEQ ID NO: 585595 - RNA, 22 nt, Human
cggucaggugcagcguuggcac

SEQ ID NO: 585596 - RNA, 22 nt, Human
ggaaaggagauauuggagagug

SEQ ID NO: 585597 - RNA, 22 nt, Human
uggacucuaugaugcgccagca

SEQ ID NO: 585598 - RNA, 22 nt, Human
ucagggaaauucaagggagauu

SEQ ID NO: 585599 - RNA, 21 nt, Human
uuacagguaacacuuccuuuc

SEQ ID NO: 585600 - RNA, 22 nt, Human
agcucaagaguaguucgagggg

SEQ ID NO: 585601 - RNA, 22 nt, Human
ucucagaaaagagcuucagaaa

SEQ ID NO: 585602 - RNA, 21 nt, Human
acacagaggcaucaucacuuu

SEQ ID NO: 585603 - RNA, 22 nt, Human
uccaggcuagccugguagagaa

SEQ ID NO: 585604 - RNA, 22 nt, Human
cugugccuucuacuucacucua

SEQ ID NO: 585605 - RNA, 22 nt, Human
ccuuucucuggcagcaggacag

SEQ ID NO: 585606 - RNA, 22 nt, Human
gcugggacaacaggugagcacc

SEQ ID NO: 585607 - RNA, 21 nt, Human
aaguaaaucagagaaauaacc

SEQ ID NO: 585608 - RNA, 22 nt, Human
aaagcagcagcaccugcauuuc

SEQ ID NO: 585609 - RNA, 22 nt, Human
aucucuccuuaugaagcauuau

SEQ ID NO: 585610 - RNA, 22 nt, Human
caauagaaggcacagauaggua

SEQ ID NO: 585611 - RNA, 22 nt, Human
aauacuauguagccaaaauaau

SEQ ID NO: 585612 - RNA, 22 nt, Human
uacagugcaaugugauguagau

SEQ ID NO: 585613 - RNA, 22 nt, Human
gagggcugaagauuguggcccc

SEQ ID NO: 585614 - RNA, 22 nt, Human
gccucacugcagccccaggaag

SEQ ID NO: 585615 - RNA, 22 nt, Human
ccagaagggcuauugcagugac

SEQ ID NO: 585616 - RNA, 22 nt, Human
cccaccucucagagagccuugc

SEQ ID NO: 585617 - RNA, 22 nt, Human
gaagccuggagaccagauguug

SEQ ID NO: 585618 - RNA, 22 nt, Human
acuuccugcuaugagcuucugu

SEQ ID NO: 585619 - RNA, 22 nt, Human
gaggcagcaggcugaggaggau

SEQ ID NO: 585620 - RNA, 22 nt, Human
cuggcucagacagcugugcagu

SEQ ID NO: 585621 - RNA, 22 nt, Human
aaggugucggcagagccgcuuc

SEQ ID NO: 585622 - RNA, 22 nt, Human
cacccaggcuggaaugcaaugg

SEQ ID NO: 585623 - RNA, 22 nt, Human
uaguuacaauggguucugugac

SEQ ID NO: 585624 - RNA, 22 nt, Human
gccagcagguugucaaggagcu

SEQ ID NO: 585625 - RNA, 22 nt, Human
acacuuugaagauggaaacuug

SEQ ID NO: 585626 - RNA, 22 nt, Human
ucagaaggaaacgaugccagcu

SEQ ID NO: 585627 - RNA, 22 nt, Human
aaugcauaccaugucaucuuug

SEQ ID NO: 585628 - RNA, 22 nt, Human
uuuuuguguauccugcuccaug

SEQ ID NO: 585629 - RNA, 22 nt, Human
uggguggaauaaaucaguucug

SEQ ID NO: 585630 - RNA, 22 nt, Human
gccaggguucgaauccguaugg

SEQ ID NO: 585631 - RNA, 22 nt, Human
acaaaugaaucauacauaaugu

SEQ ID NO: 585632 - RNA, 22 nt, Human
gaggacacaaaguggcugagau

SEQ ID NO: 585633 - RNA, 22 nt, Human
aggcccaguuauccuacuuguu

SEQ ID NO: 585634 - RNA, 22 nt, Human
augaaguuccaguauaugcagu

SEQ ID NO: 585635 - RNA, 22 nt, Human
cucucccuggccagcugugcag

SEQ ID NO: 585636 - RNA, 22 nt, Human
cagaaacacuuguagagaaguu

SEQ ID NO: 585637 - RNA, 22 nt, Human
agagcugagaauguggcuuccu

SEQ ID NO: 585638 - RNA, 22 nt, Human
uaaccagacagaaacagcuaga

SEQ ID NO: 585639 - RNA, 22 nt, Human
ugaggcaguauucuccauucca

SEQ ID NO: 585640 - RNA, 22 nt, Human
agcagcuggggccugugacgau

SEQ ID NO: 585641 - RNA, 22 nt, Human
aggggaaaugccuuggugguac

SEQ ID NO: 585642 - RNA, 20 nt, Human
ugcugcaguuucaugggacu

SEQ ID NO: 585643 - RNA, 22 nt, Human
aaaaugaacagaacaaugggga

SEQ ID NO: 585644 - RNA, 22 nt, Human
ucugaacaugaugucaucugga

SEQ ID NO: 585645 - RNA, 22 nt, Human
cuggcucaauuuguacugcugu

SEQ ID NO: 585646 - RNA, 22 nt, Human
aaugaacuggagaacaaugacc

SEQ ID NO: 585647 - RNA, 22 nt, Human
agucccagugagaugagccacg

SEQ ID NO: 585648 - RNA, 22 nt, Human
agggucaccaguucauaggcac

SEQ ID NO: 585649 - RNA, 23 nt, Human
uaucuuuuucaauguuggaaaua

SEQ ID NO: 585650 - RNA, 22 nt, Human
uggcucaugcaucuuuucuaca

SEQ ID NO: 585651 - RNA, 22 nt, Human
cccaggaaaugggcucuugccu

SEQ ID NO: 585652 - RNA, 22 nt, Human
aaguuguaugucuuagaaagua

SEQ ID NO: 585653 - RNA, 22 nt, Human
auccagcuuugucuggucuucg

SEQ ID NO: 585654 - RNA, 23 nt, Human
ugagcugggccugcaggggucuc

SEQ ID NO: 585655 - RNA, 22 nt, Human
ggaagcugaggcccagugaagg

SEQ ID NO: 585656 - RNA, 22 nt, Human
uuaacacagggggagacaaagu

SEQ ID NO: 585657 - RNA, 22 nt, Human
ugcccagguuugagugcccaag

SEQ ID NO: 585658 - RNA, 22 nt, Human
cauuuuauguuuauggagugcu

SEQ ID NO: 585659 - RNA, 22 nt, Human
uugaacaauuugguauacaaac

SEQ ID NO: 585660 - RNA, 22 nt, Human
auacaauaguguuuguuuugag

SEQ ID NO: 585661 - RNA, 22 nt, Human
uacaaaugccugacacacagau

SEQ ID NO: 585662 - RNA, 22 nt, Human
cugaaggaagcagaagcgaggu

SEQ ID NO: 585663 - RNA, 22 nt, Human
ucugagaacaugcuuugaucau

SEQ ID NO: 585664 - RNA, 22 nt, Human
uugucuuaaauggauggacaau

SEQ ID NO: 585665 - RNA, 22 nt, Human
ucugggaugcaaacagaaucug

SEQ ID NO: 585666 - RNA, 22 nt, Human
ugcagggaaugcuugcagcaug

SEQ ID NO: 585667 - RNA, 21 nt, Human
augcauauuuuaaguuguguc

SEQ ID NO: 585668 - RNA, 22 nt, Human
cuggcuuuucaaacuguucagu

SEQ ID NO: 585669 - RNA, 22 nt, Human
gaaaauagcagauagaccaaug

SEQ ID NO: 585670 - RNA, 19 nt, Human
uuugauaucugaauuaugc

SEQ ID NO: 585671 - RNA, 22 nt, Human
gggcuggugaggcugcccugca

SEQ ID NO: 585672 - RNA, 22 nt, Human
uuacacaguugguaggggcaga

SEQ ID NO: 585673 - RNA, 22 nt, Human
uucacuguuucauccuacuucu

SEQ ID NO: 585674 - RNA, 22 nt, Human
cuugucugggcagcuugggagu

SEQ ID NO: 585675 - RNA, 22 nt, Human
agcuggucugcugcauggagug

SEQ ID NO: 585676 - RNA, 22 nt, Human
gaggaggaaguucucuguaggc

SEQ ID NO: 585677 - RNA, 22 nt, Human
gcaggcauggucgcugccaggu

SEQ ID NO: 585678 - RNA, 22 nt, Human
cuguuaucuguuauugccaguu

SEQ ID NO: 585679 - RNA, 19 nt, Human
guggccagggcaggggcug

SEQ ID NO: 585680 - RNA, 22 nt, Human
cuuccugaagagguuggucagg

SEQ ID NO: 585681 - RNA, 20 nt, Human
auacacuugcccagcuugug

SEQ ID NO: 585682 - RNA, 22 nt, Human
ccuagccccagauaucucacac

SEQ ID NO: 585683 - RNA, 22 nt, Human
uuacacuugaaaacaggauuua

SEQ ID NO: 585684 - RNA, 22 nt, Human
auuuacauaauagacuuuaggu

SEQ ID NO: 585685 - RNA, 22 nt, Human
ggaaaagacagguuaacuguga

SEQ ID NO: 585686 - RNA, 22 nt, Human
uggaccugcuggaugggcaggu

SEQ ID NO: 585687 - RNA, 23 nt, Human
auguggcuagugagaccaagaaa

SEQ ID NO: 585688 - RNA, 22 nt, Human
uguuuuaaucucccauugcucu

SEQ ID NO: 585689 - RNA, 22 nt, Human
ucccagagaagagcuggaugga

SEQ ID NO: 585690 - RNA, 22 nt, Human
cuggcugaguuacuccacugag

SEQ ID NO: 585691 - RNA, 22 nt, Human
caggacuggcucgcagugggug

SEQ ID NO: 585692 - RNA, 20 nt, Human
cugcucugcuuugcaggugg

SEQ ID NO: 585693 - RNA, 22 nt, Human
uccacagaccaguaucugcagc

SEQ ID NO: 585694 - RNA, 22 nt, Human
aaauacaguggcagcagauaau

SEQ ID NO: 585695 - RNA, 22 nt, Human
auuucucaaccaggucaaaaag

SEQ ID NO: 585696 - RNA, 22 nt, Human
ggaauguucuggucugguucau

SEQ ID NO: 585697 - RNA, 22 nt, Human
uacucaaacucacuaagacaga

SEQ ID NO: 585698 - RNA, 22 nt, Human
cucagagcaaugaacaugcaaa

SEQ ID NO: 585699 - RNA, 22 nt, Human
acacaguaguuugucauugcua

SEQ ID NO: 585700 - RNA, 22 nt, Human
uggcauugcuucugaaguggag

SEQ ID NO: 585701 - RNA, 22 nt, Human
cuggcaaguacugggccagcuc

SEQ ID NO: 585702 - RNA, 22 nt, Human
cucuguggcuugccuuucuguc

SEQ ID NO: 585703 - RNA, 22 nt, Human
gaaacagccccugugugaagca

SEQ ID NO: 585704 - RNA, 22 nt, Human
gagcugguccacaaucugcagg

SEQ ID NO: 585705 - RNA, 22 nt, Human
agcaaagacagggacgaccaag

SEQ ID NO: 585706 - RNA, 22 nt, Human
ucacagaaggcaucacagaaga

SEQ ID NO: 585707 - RNA, 23 nt, Human
auuagaaaggcuuucuggugaaa

SEQ ID NO: 585708 - RNA, 22 nt, Human
uaauaguuaugguugguucuca

SEQ ID NO: 585709 - RNA, 22 nt, Human
gucuucaggaccuggaauuuug

SEQ ID NO: 585710 - RNA, 22 nt, Human
gucuccuccauggagaugguau

SEQ ID NO: 585711 - RNA, 20 nt, Human
ugcugcugugagcgucccug

SEQ ID NO: 585712 - RNA, 22 nt, Human
uaguuucuugauuagccacuuu

SEQ ID NO: 585713 - RNA, 22 nt, Human
gcagccaagaccccaagaacug

SEQ ID NO: 585714 - RNA, 22 nt, Human
gaggccacagcuaucagggaca

SEQ ID NO: 585715 - RNA, 22 nt, Human
gcuuccugaguacacccucauc

SEQ ID NO: 585716 - RNA, 22 nt, Human
caacagagagaccagaaacagg

SEQ ID NO: 585717 - RNA, 22 nt, Human
uggccucagauuauugcacagu

SEQ ID NO: 585718 - RNA, 22 nt, Human
cagcugagaguagaaauggagg

SEQ ID NO: 585719 - RNA, 22 nt, Human
uuucaacagcucucaaaugauc

SEQ ID NO: 585720 - RNA, 22 nt, Human
uucacagggcagcagcugagcc

SEQ ID NO: 585721 - RNA, 22 nt, Human
guucuccacugcagagucucuc

SEQ ID NO: 585722 - RNA, 22 nt, Human
gugacaggcccagugggaugca

SEQ ID NO: 585723 - RNA, 22 nt, Human
ccagggcacuuaggcccagccc

SEQ ID NO: 585724 - RNA, 22 nt, Human
aauuccauaucugugauuauua

SEQ ID NO: 585725 - RNA, 22 nt, Human
acacuuuaagcauuucacacug

SEQ ID NO: 585726 - RNA, 22 nt, Human
auaacuugauguuauuugucca

SEQ ID NO: 585727 - RNA, 20 nt, Human
ugucuccagggcugagugga

SEQ ID NO: 585728 - RNA, 20 nt, Human
aacacagauaccaaagguug

SEQ ID NO: 585729 - RNA, 22 nt, Human
gggacccucaacaucugcuucu

SEQ ID NO: 585730 - RNA, 22 nt, Human
gagccacagugguggcccacgu

SEQ ID NO: 585731 - RNA, 19 nt, Human
uccagguggagagacaccc

SEQ ID NO: 585732 - RNA, 22 nt, Human
ucaggcagguuggcugcagguc

SEQ ID NO: 585733 - RNA, 22 nt, Human
ccuuccagaggcgugacacccu

SEQ ID NO: 585734 - RNA, 22 nt, Human
cagucugauguucgcaggugaa

SEQ ID NO: 585735 - RNA, 22 nt, Human
acauuccugccauaaauuuuuu

SEQ ID NO: 585736 - RNA, 22 nt, Human
uuugccucucagagucuacaca

SEQ ID NO: 585737 - RNA, 22 nt, Human
caggugaagaggauaaaaaguu

SEQ ID NO: 585738 - RNA, 22 nt, Human
gcuggagcugaguucccugggc

SEQ ID NO: 585739 - RNA, 22 nt, Human
gcugaaguuuugcagagaguaa

SEQ ID NO: 585740 - RNA, 22 nt, Human
aggaaauaagggcacuucagau

SEQ ID NO: 585741 - RNA, 22 nt, Human
agggaaggcuuuugacauuucc

SEQ ID NO: 585742 - RNA, 17 nt, Human
agcuucaguugcaaaac

SEQ ID NO: 585743 - RNA, 17 nt, Human
cacuuuguugcuguggg

SEQ ID NO: 585744 - RNA, 22 nt, Human
auagcuuucuuaaauauauaaa

SEQ ID NO: 585745 - RNA, 22 nt, Human
agccuguccagaggacagggcu

SEQ ID NO: 585746 - RNA, 22 nt, Human
aaggcagccgugugacugcaug

SEQ ID NO: 585747 - RNA, 22 nt, Human
gaacagaguugaaacaaggcug

SEQ ID NO: 585748 - RNA, 19 nt, Human
uaaggcagcagugacaggc

SEQ ID NO: 585749 - RNA, 22 nt, Human
uacaguagacaauguuaguaug

SEQ ID NO: 585750 - RNA, 22 nt, Human
guuccuaagcacugugcauucu

SEQ ID NO: 585751 - RNA, 22 nt, Human
gugcccaguaaaugaaagcuuu

SEQ ID NO: 585752 - RNA, 20 nt, Human
cuucuucagccuaugcuuca

SEQ ID NO: 585753 - RNA, 22 nt, Human
uuuaggaagaucugaaggaaga

SEQ ID NO: 585754 - RNA, 16 nt, Human
gcacugggaugucuuc

SEQ ID NO: 585755 - RNA, 22 nt, Human
cugugugugaacacagcccagc

SEQ ID NO: 585756 - RNA, 22 nt, Human
augcaguuuaucuccaaaucau

SEQ ID NO: 585757 - RNA, 22 nt, Human
cauucauuugcccaguaaguca

SEQ ID NO: 585758 - RNA, 22 nt, Human
gugugcagggggccagcgcagc

SEQ ID NO: 585759 - RNA, 22 nt, Human
cucucuggcuuggcacggagau

SEQ ID NO: 585760 - RNA, 22 nt, Human
uggcaggaaaguaacagagcac

SEQ ID NO: 585761 - RNA, 17 nt, Human
agguauaaaaugguagc

SEQ ID NO: 585762 - RNA, 22 nt, Human
uuucuaagucugagggaguaua

SEQ ID NO: 585763 - RNA, 22 nt, Human
cguuuucauggguagagguucu

SEQ ID NO: 585764 - RNA, 22 nt, Human
acuuuacaauauccugugacuu

SEQ ID NO: 585765 - RNA, 22 nt, Human
ucugccucuuucaggccuggca

SEQ ID NO: 585766 - RNA, 22 nt, Human
gaaguuauuugcuaucuacuga

SEQ ID NO: 585767 - RNA, 23 nt, Human
uuucacagcuuuuauucugcauc

SEQ ID NO: 585768 - RNA, 22 nt, Human
ggcugccaggagaagcucagug

SEQ ID NO: 585769 - RNA, 22 nt, Human
ucugcucugagagggccaucag

SEQ ID NO: 585770 - RNA, 22 nt, Human
aucugucuugccuugcauauuu

SEQ ID NO: 585771 - RNA, 22 nt, Human
uaaacucuucuguagaaucaga

SEQ ID NO: 585772 - RNA, 22 nt, Human
gcccaggauggcuggaggugcu

SEQ ID NO: 585773 - RNA, 22 nt, Human
gaugcugaagugaagugaucuu

SEQ ID NO: 585774 - RNA, 22 nt, Human
gaggaagaagggauuagaacuc

SEQ ID NO: 585775 - RNA, 22 nt, Human
uuucucauggcccuuggcuuuu

SEQ ID NO: 585776 - RNA, 22 nt, Human
uauuaagauacguaguuguaaa

SEQ ID NO: 585777 - RNA, 22 nt, Human
uccagcucaggguuggcucaag

SEQ ID NO: 585778 - RNA, 22 nt, Human
uacauguaggugacauuuuaau

SEQ ID NO: 585779 - RNA, 22 nt, Human
uucuucugugaggugugugccu

SEQ ID NO: 585780 - RNA, 22 nt, Human
cauuuccacuucugaaaacugg

SEQ ID NO: 585781 - RNA, 22 nt, Human
uaagguuugaagaagacugagc

SEQ ID NO: 585782 - RNA, 22 nt, Human
ugguuucucugaacucuacgac

SEQ ID NO: 585783 - RNA, 22 nt, Human
ugugacagaucucuauacauga

SEQ ID NO: 585784 - RNA, 22 nt, Human
uuuagacacacuuuguauauuu

SEQ ID NO: 585785 - RNA, 22 nt, Human
gagaaagggauaauuugaagag

SEQ ID NO: 585786 - RNA, 22 nt, Human
uauuucacagcagcucauuuaa

SEQ ID NO: 585787 - RNA, 23 nt, Human
agcauggaauaggaaagaggcag

SEQ ID NO: 585788 - RNA, 22 nt, Human
gaaagguuucaucuacuuuuca

SEQ ID NO: 585789 - RNA, 22 nt, Human
auugguuaagacgcaucaugcu

SEQ ID NO: 585790 - RNA, 19 nt, Human
gcaggcaguggcauucgga

SEQ ID NO: 585791 - RNA, 22 nt, Human
auaucaaacgaaguuauuuuaa

SEQ ID NO: 585792 - RNA, 22 nt, Human
agguccacaguucagcugccca

SEQ ID NO: 585793 - RNA, 22 nt, Human
ggucuggaguagaugagucaug

SEQ ID NO: 585794 - RNA, 22 nt, Human
agugaaaugauucugagcaaga

SEQ ID NO: 585795 - RNA, 22 nt, Human
auaagcuugauguaacuaacca

SEQ ID NO: 585796 - RNA, 22 nt, Human
ccucccuggccagagcagcagc

SEQ ID NO: 585797 - RNA, 20 nt, Human
ccuguguggccagcugaggc

SEQ ID NO: 585798 - RNA, 22 nt, Human
cagugguggaaugaggaauugu

SEQ ID NO: 585799 - RNA, 22 nt, Human
aggaaugaacucgagugaucug

SEQ ID NO: 585800 - RNA, 22 nt, Human
gcuuccuagaucugugguacuc

SEQ ID NO: 585801 - RNA, 22 nt, Human
agccucugaugaucacaggggg

SEQ ID NO: 585802 - RNA, 22 nt, Human
gauaaaagaggaaauuuguuca

SEQ ID NO: 585803 - RNA, 22 nt, Human
ucaauaaggcaacauuaaguua

SEQ ID NO: 585804 - RNA, 22 nt, Human
auaaagacaugcuuacuugccc

SEQ ID NO: 585805 - RNA, 22 nt, Human
ucacuagucgcggggggaggua

SEQ ID NO: 585806 - RNA, 22 nt, Human
cacuguaucuuuuccaaagucu

SEQ ID NO: 585807 - RNA, 22 nt, Human
cugcccuggucccauggcugau

SEQ ID NO: 585808 - RNA, 22 nt, Human
agccagagcugaugucauucuc

SEQ ID NO: 585809 - RNA, 22 nt, Human
ucuuucuacaucauuugcuucu

SEQ ID NO: 585810 - RNA, 22 nt, Human
uuuccucuaaacgcauuugcuu

SEQ ID NO: 585811 - RNA, 22 nt, Human
aguuuguaugccaacagcaaag

SEQ ID NO: 585812 - RNA, 22 nt, Human
aaugaacaagaaagacuuugag

SEQ ID NO: 585813 - RNA, 22 nt, Human
guaaaacauguuuuaacuagga

SEQ ID NO: 585814 - RNA, 22 nt, Human
gcugggaagaacaggagagaau

SEQ ID NO: 585815 - RNA, 22 nt, Human
aggcccugcccagugccacaag

SEQ ID NO: 585816 - RNA, 22 nt, Human
uggaagagaaaggaguggaucu

SEQ ID NO: 585817 - RNA, 22 nt, Human
guuuuccacuggauuguuugga

SEQ ID NO: 585818 - RNA, 22 nt, Human
cacacaggaaaauuggaauuaa

SEQ ID NO: 585819 - RNA, 22 nt, Human
gucuuauuuaaagagaucauac

SEQ ID NO: 585820 - RNA, 22 nt, Human
uuguuacacauaauaacauuuu

SEQ ID NO: 585821 - RNA, 22 nt, Human
cuggaguuuguggcuugcucaa

SEQ ID NO: 585822 - RNA, 22 nt, Human
caaagcucaugcucuuagccau

SEQ ID NO: 585823 - RNA, 22 nt, Human
agggcugaggcgagggagaugc

SEQ ID NO: 585824 - RNA, 22 nt, Human
ucugccuguaccucuuuuuugc

SEQ ID NO: 585825 - RNA, 22 nt, Human
gaagguuuugauuccacugaau

SEQ ID NO: 585826 - RNA, 22 nt, Human
ucacagcauuuuuagaaagauu

SEQ ID NO: 585827 - RNA, 22 nt, Human
aggagggauagaaaaauacuug

SEQ ID NO: 585828 - RNA, 22 nt, Human
gggucaaaugauaauugcuucu

SEQ ID NO: 585829 - RNA, 22 nt, Human
uagggcuggguacacucuugcc

SEQ ID NO: 585830 - RNA, 22 nt, Human
ccucaggcaggaaacugucccg

SEQ ID NO: 585831 - RNA, 22 nt, Human
gaugaaauuguuuugauacuuu

SEQ ID NO: 585832 - RNA, 22 nt, Human
cauguuaacuaagauuaacuau

SEQ ID NO: 585833 - RNA, 22 nt, Human
gaugcugaccagcuguuuccuu

SEQ ID NO: 585834 - RNA, 22 nt, Human
gccaguggcuugccaggcagga

SEQ ID NO: 585835 - RNA, 22 nt, Human
gggaaacuggggacugaaucug

SEQ ID NO: 585836 - RNA, 22 nt, Human
uagauucauuuuagcaaaaguu

SEQ ID NO: 585837 - RNA, 22 nt, Human
gugucccaggagaggagacaau

SEQ ID NO: 585838 - RNA, 22 nt, Human
uacaaugcauucguugucucgg

SEQ ID NO: 585839 - RNA, 22 nt, Human
ccugggucuugguucaugcucu

SEQ ID NO: 585840 - RNA, 22 nt, Human
gagugcaguaugagaggcugcu

SEQ ID NO: 585841 - RNA, 22 nt, Human
cucuggccugcagauccaugcu

SEQ ID NO: 585842 - RNA, 22 nt, Human
agccaaggacucagugguaggc

SEQ ID NO: 585843 - RNA, 22 nt, Human
uaagacauaaauaggcuuuuua

SEQ ID NO: 585844 - RNA, 22 nt, Human
ugcaguggcgccaucucagcuc

SEQ ID NO: 585845 - RNA, 21 nt, Human
accaggcuugugggagggagc

SEQ ID NO: 585846 - RNA, 22 nt, Human
uccuucuaccagcuggauaccu

SEQ ID NO: 585847 - RNA, 22 nt, Human
cucaggcuccagacuuccgucc

SEQ ID NO: 585848 - RNA, 22 nt, Human
ucugccuggauuccauucucca

SEQ ID NO: 585849 - RNA, 19 nt, Human
cucucuccaguggcuggcu

SEQ ID NO: 585850 - RNA, 22 nt, Human
cuuguuuugaaagcaguggcca

SEQ ID NO: 585851 - RNA, 22 nt, Human
cacauuuaagcagauguggacc

SEQ ID NO: 585852 - RNA, 22 nt, Human
augugaaaccugugaguagagu

SEQ ID NO: 585853 - RNA, 22 nt, Human
uaaaggcagccuaggaaguguu

SEQ ID NO: 585854 - RNA, 22 nt, Human
agugaggggauucaggcaaggu

SEQ ID NO: 585855 - RNA, 22 nt, Human
caguuuucuaugguagaagcau

SEQ ID NO: 585856 - RNA, 22 nt, Human
caaugauaauggcuguauuuau

SEQ ID NO: 585857 - RNA, 22 nt, Human
ggagccugggcauuaguaauuu

SEQ ID NO: 585858 - RNA, 22 nt, Human
ugggagcagccaacauggccuu

SEQ ID NO: 585859 - RNA, 22 nt, Human
gaagccacagggaaggagaaca

SEQ ID NO: 585860 - RNA, 22 nt, Human
gugugucugaaguugaguagac

SEQ ID NO: 585861 - RNA, 22 nt, Human
cauuucuagggaucauaaagua

SEQ ID NO: 585862 - RNA, 22 nt, Human
aagacaagcaucaaaucaggca

SEQ ID NO: 585863 - RNA, 22 nt, Human
gaggaggaggaaguggaaccca

SEQ ID NO: 585864 - RNA, 22 nt, Human
uuuaaggaaaaaauguacuuag

SEQ ID NO: 585865 - RNA, 22 nt, Human
cugcuggcaagcccaguuggag

SEQ ID NO: 585866 - RNA, 21 nt, Human
uccagcucucauaguguucca

SEQ ID NO: 585867 - RNA, 22 nt, Human
gacuguccagaauuccuaggug

SEQ ID NO: 585868 - RNA, 22 nt, Human
guaugucaugagccuugugcgu

SEQ ID NO: 585869 - RNA, 22 nt, Human
agaggcugugcagagggagugc

SEQ ID NO: 585870 - RNA, 22 nt, Human
cagggucauggcaccugcacgg

SEQ ID NO: 585871 - RNA, 22 nt, Human
ccaggagagcagaagcccaggc

SEQ ID NO: 585872 - RNA, 22 nt, Human
gccugccuuuuggaggcacauu

SEQ ID NO: 585873 - RNA, 22 nt, Human
gcaggcccuuagccuugguggg

SEQ ID NO: 585874 - RNA, 22 nt, Human
cagcuacaguuccacugagcau

SEQ ID NO: 585875 - RNA, 22 nt, Human
aagcucagcaugucuccuagaa

SEQ ID NO: 585876 - RNA, 22 nt, Human
ucugaaauaggaaagcaaaugg

SEQ ID NO: 585877 - RNA, 22 nt, Human
ccaggagcagaguagguguuca

SEQ ID NO: 585878 - RNA, 22 nt, Human
uuaaaguucauuaaaugagcca

SEQ ID NO: 585879 - RNA, 19 nt, Human
cauggcugcugcuugggag

SEQ ID NO: 585880 - RNA, 22 nt, Human
guacuaaacagagaaccaauau

SEQ ID NO: 585881 - RNA, 22 nt, Human
uacaaaggcuuaaagagauuuc

SEQ ID NO: 585882 - RNA, 22 nt, Human
aggcauucuagaaguagaagua

SEQ ID NO: 585883 - RNA, 22 nt, Human
ugauggaaauguucuguaucug

SEQ ID NO: 585884 - RNA, 22 nt, Human
aacuggaagagugaauauaacu

SEQ ID NO: 585885 - RNA, 22 nt, Human
aaacaaugaaauauuuuuaugg

SEQ ID NO: 585886 - RNA, 22 nt, Human
uauuuucaccauguaucccugu

SEQ ID NO: 585887 - RNA, 22 nt, Human
ucacaugccacagaugaggcaa

SEQ ID NO: 585888 - RNA, 22 nt, Human
gcugccugaucauacaccaggg

SEQ ID NO: 585889 - RNA, 22 nt, Human
aaacccaggguuuugucuuccc

SEQ ID NO: 585890 - RNA, 22 nt, Human
cugcugccugauugcagaccuc

SEQ ID NO: 585891 - RNA, 22 nt, Human
cugggguggagauuggcaaucu

SEQ ID NO: 585892 - RNA, 22 nt, Human
acugaacacuuuugaaagauua

SEQ ID NO: 585893 - RNA, 22 nt, Human
uggagaaagcugcauauggaaa

SEQ ID NO: 585894 - RNA, 22 nt, Human
ucccagggauuaggacauggau

SEQ ID NO: 585895 - RNA, 22 nt, Human
aagauucuacaaacucugguaa

SEQ ID NO: 585896 - RNA, 22 nt, Human
aggagacugugaauugacuguc

SEQ ID NO: 585897 - RNA, 22 nt, Human
uugugcaaugguguuuagguuu

SEQ ID NO: 585898 - RNA, 18 nt, Human
gucuggaggucaggagcu

SEQ ID NO: 585899 - RNA, 23 nt, Human
agcuuugaggacuuuaaaagaua

SEQ ID NO: 585900 - RNA, 22 nt, Human
aaaugugacagaugcaguacag

SEQ ID NO: 585901 - RNA, 22 nt, Human
agggggugggaagucuagaauc

SEQ ID NO: 585902 - RNA, 22 nt, Human
uuccagaggcuugaggaaaauu

SEQ ID NO: 585903 - RNA, 22 nt, Human
gcuugaguuuugggacaaagcc

SEQ ID NO: 585904 - RNA, 22 nt, Human
gcugccuuuugcuccucccacc

SEQ ID NO: 585905 - RNA, 22 nt, Human
aagacaaagggguccuuggaug

SEQ ID NO: 585906 - RNA, 22 nt, Human
cuggugcaagauucccugcuuc

SEQ ID NO: 585907 - RNA, 22 nt, Human
cagagguaccagcagccucugg

SEQ ID NO: 585908 - RNA, 22 nt, Human
uuaauauguugaaauuuauuag

SEQ ID NO: 585909 - RNA, 22 nt, Human
aggcuccacggucacuggcucu

SEQ ID NO: 585910 - RNA, 22 nt, Human
ucugaggccuugggacagaagu

SEQ ID NO: 585911 - RNA, 22 nt, Human
gcucugagacaguagagauggc

SEQ ID NO: 585912 - RNA, 22 nt, Human
caggccugagacaucugagaua

SEQ ID NO: 585913 - RNA, 19 nt, Human
ucauggaucagguaguuua

SEQ ID NO: 585914 - RNA, 22 nt, Human
uaggacuuuggcgucagaacug

SEQ ID NO: 585915 - RNA, 22 nt, Human
uggagcagccuuuucuaagcaa

SEQ ID NO: 585916 - RNA, 22 nt, Human
ucucaucucggaucagaaguga

SEQ ID NO: 585917 - RNA, 22 nt, Human
ugacauuuaagccucugauuuc

SEQ ID NO: 585918 - RNA, 22 nt, Human
aaaacuguaggaauugggugcc

SEQ ID NO: 585919 - RNA, 22 nt, Human
gagguuucacuguguuguccag

SEQ ID NO: 585920 - RNA, 22 nt, Human
agagcaaagggacauggaagag

SEQ ID NO: 585921 - RNA, 22 nt, Human
ggguccaguuucaucugagguu

SEQ ID NO: 585922 - RNA, 22 nt, Human
cugucccaggagcuguaagaca

SEQ ID NO: 585923 - RNA, 22 nt, Human
ggucccugcccaaagcccuugg

SEQ ID NO: 585924 - RNA, 22 nt, Human
uggcagucuuguaggcaucucc

SEQ ID NO: 585925 - RNA, 22 nt, Human
uaagauagaacucugaggcuac

SEQ ID NO: 585926 - RNA, 22 nt, Human
gauggccuggguccccuuccgg

SEQ ID NO: 585927 - RNA, 22 nt, Human
caggcagagucagauuagacuu

SEQ ID NO: 585928 - RNA, 22 nt, Human
gauaauuauaggcuaagccacu

SEQ ID NO: 585929 - RNA, 23 nt, Human
agcuccagcugacgugggcagcc

SEQ ID NO: 585930 - RNA, 22 nt, Human
auauuaugcuaagggaaauaag

SEQ ID NO: 585931 - RNA, 19 nt, Human
ugcagaagacacaguggug

SEQ ID NO: 585932 - RNA, 22 nt, Human
acucugccaucccaggugcugu

SEQ ID NO: 585933 - RNA, 22 nt, Human
gcuggcuugacagaggccuggg

SEQ ID NO: 585934 - RNA, 22 nt, Human
gacauaaaauggaauucuguug

SEQ ID NO: 585935 - RNA, 22 nt, Human
aagcacaugaaaaugugaagcu

SEQ ID NO: 585936 - RNA, 22 nt, Human
agggaagccaagccuuagagaa

SEQ ID NO: 585937 - RNA, 22 nt, Human
caggcugccgugaagcaggccu

SEQ ID NO: 585938 - RNA, 19 nt, Human
ucuuauugagcagcugagg

SEQ ID NO: 585939 - RNA, 22 nt, Human
agcagagcugggauccuggguc

SEQ ID NO: 585940 - RNA, 22 nt, Human
auccaggcugcgggucucaagu

SEQ ID NO: 585941 - RNA, 23 nt, Human
gggccuuggauuuguggaguuca

SEQ ID NO: 585942 - RNA, 19 nt, Human
ugcuucuggaaugcaaggc

SEQ ID NO: 585943 - RNA, 22 nt, Human
auucaguuagccacagcuauuc

SEQ ID NO: 585944 - RNA, 22 nt, Human
aaacccagagacuagaaagacc

SEQ ID NO: 585945 - RNA, 22 nt, Human
aagguauuuucuaauguauacu

SEQ ID NO: 585946 - RNA, 22 nt, Human
aaauucauauguugaaaugcua

SEQ ID NO: 585947 - RNA, 22 nt, Human
cucagagcccaggguacacccg

SEQ ID NO: 585948 - RNA, 22 nt, Human
ccaggcuggaaucaauauucug

SEQ ID NO: 585949 - RNA, 22 nt, Human
guucucucagcgauagugaugg

SEQ ID NO: 585950 - RNA, 22 nt, Human
ucuccucccaggcucuuccagg

SEQ ID NO: 585951 - RNA, 22 nt, Human
auuuuuucccaguuagccagga

SEQ ID NO: 585952 - RNA, 22 nt, Human
gugggcagaacauuuguaggcu

SEQ ID NO: 585953 - RNA, 22 nt, Human
aaagguuuccgagcuuuaauuu

SEQ ID NO: 585954 - RNA, 22 nt, Human
uguagaaauuaguaagaucaac

SEQ ID NO: 585955 - RNA, 22 nt, Human
ugguaugaccguggugcaagca

SEQ ID NO: 585956 - RNA, 22 nt, Human
ugacauuuaucuucuacaauga

SEQ ID NO: 585957 - RNA, 22 nt, Human
ggcccagcuguauauuacaguu

SEQ ID NO: 585958 - RNA, 22 nt, Human
ccugagagugguguacaggaga

SEQ ID NO: 585959 - RNA, 22 nt, Human
ucucugggaguugagcagcagc

SEQ ID NO: 585960 - RNA, 22 nt, Human
gcucugugguggggcagaguuu

SEQ ID NO: 585961 - RNA, 22 nt, Human
uggggcuaaacacgccuggccu

SEQ ID NO: 585962 - RNA, 22 nt, Human
accugggaggcggagguugcag

SEQ ID NO: 585963 - RNA, 22 nt, Human
agugaagcuaaccugcugauuu

SEQ ID NO: 585964 - RNA, 22 nt, Human
ccacagaguccgcauuugaggc

SEQ ID NO: 585965 - RNA, 22 nt, Human
ggcugcugugaccucaggugau

SEQ ID NO: 585966 - RNA, 22 nt, Human
uugaaagaacucuucagagaua

SEQ ID NO: 585967 - RNA, 21 nt, Human
guuuaugaaucuuguccugcu

SEQ ID NO: 585968 - RNA, 20 nt, Human
agcagauagcgggagaguuu

SEQ ID NO: 585969 - RNA, 22 nt, Human
uccaagaagcucagcaaacauc

SEQ ID NO: 585970 - RNA, 22 nt, Human
agcaaaauaagguaauuuauug

SEQ ID NO: 585971 - RNA, 22 nt, Human
aggucccaggcauagcuggucu

SEQ ID NO: 585972 - RNA, 20 nt, Human
agagguucagucuggagaag

SEQ ID NO: 585973 - RNA, 22 nt, Human
uagcacaguuccugacucuuug

SEQ ID NO: 585974 - RNA, 22 nt, Human
cagcuguugacugguacaugaa

SEQ ID NO: 585975 - RNA, 22 nt, Human
guucugcuguaauaucucugcu

SEQ ID NO: 585976 - RNA, 22 nt, Human
cugugccagccugucccaggag

SEQ ID NO: 585977 - RNA, 22 nt, Human
ggagccuguggcugcuugaagc

SEQ ID NO: 585978 - RNA, 23 nt, Human
gugauuucagggaacagaaucag

SEQ ID NO: 585979 - RNA, 22 nt, Human
ggugucuguugccuccugguua

SEQ ID NO: 585980 - RNA, 22 nt, Human
agggucuguggaugcaucuggg

SEQ ID NO: 585981 - RNA, 22 nt, Human
cagggcucaucugugugaccag

SEQ ID NO: 585982 - RNA, 22 nt, Human
ucugggcucugucagcaccucu

SEQ ID NO: 585983 - RNA, 22 nt, Human
ucuuggcuauccaaguuaucca

SEQ ID NO: 585984 - RNA, 20 nt, Human
cuccucaguuccaugggagg

SEQ ID NO: 585985 - RNA, 22 nt, Human
ugcugagggagggguuuuccag

SEQ ID NO: 585986 - RNA, 22 nt, Human
aauuagcuuuaccuaggauugu

SEQ ID NO: 585987 - RNA, 22 nt, Human
cuccuaggugcucacugggguc

SEQ ID NO: 585988 - RNA, 22 nt, Human
accugcccacacuuccuuccca

SEQ ID NO: 585989 - RNA, 23 nt, Human
ggcagagagcauggcuggggccc

SEQ ID NO: 585990 - RNA, 22 nt, Human
uucucaaggacaaaaugacaug

SEQ ID NO: 585991 - RNA, 22 nt, Human
aaggauacuuuuagagccugag

SEQ ID NO: 585992 - RNA, 22 nt, Human
gaaacauuuguugaguacuugc

SEQ ID NO: 585993 - RNA, 22 nt, Human
caggcuugguuggggcgaggga

SEQ ID NO: 585994 - RNA, 22 nt, Human
ugccugcuccaguccuguccac

SEQ ID NO: 585995 - RNA, 22 nt, Human
aaaauugugaagguuucugaaa

SEQ ID NO: 585996 - RNA, 22 nt, Human
auauucaaauuacauuuacuaa

SEQ ID NO: 585997 - RNA, 22 nt, Human
gagagaagaauguuccgaggcc

SEQ ID NO: 585998 - RNA, 20 nt, Human
gcaguguguaugaauagcug

SEQ ID NO: 585999 - RNA, 22 nt, Human
cagaggcuaaggguagcuuggg

SEQ ID NO: 586000 - RNA, 22 nt, Human
ggagagcugguauaugaagaca

SEQ ID NO: 586001 - RNA, 22 nt, Human
uuugugcaauuuauguacuaua

SEQ ID NO: 586002 - RNA, 22 nt, Human
uuaaaucuguucucaugucugu

SEQ ID NO: 586003 - RNA, 22 nt, Human
cagauggggcaaggccaucugu

SEQ ID NO: 586004 - RNA, 22 nt, Human
caggugcagggaguucaggaug

SEQ ID NO: 586005 - RNA, 22 nt, Human
acugaucacagauauguauauu

SEQ ID NO: 586006 - RNA, 22 nt, Human
ggagccagaggcugcugcugug

SEQ ID NO: 586007 - RNA, 22 nt, Human
cuggccugaggccgccuucaga

SEQ ID NO: 586008 - RNA, 22 nt, Human
guagcugauauuagcaaugagu

SEQ ID NO: 586009 - RNA, 22 nt, Human
ccaggagguggcaggacuugcc

SEQ ID NO: 586010 - RNA, 23 nt, Human
gguuauuugcauccuguaauuau

SEQ ID NO: 586011 - RNA, 22 nt, Human
augcaagauucagcaggaagau

SEQ ID NO: 586012 - RNA, 22 nt, Human
ucagagcacuggugcuaccuug

SEQ ID NO: 586013 - RNA, 22 nt, Human
acagcagauuucccugggcucc

SEQ ID NO: 586014 - RNA, 22 nt, Human
aaucacauuugcccccauauuc

SEQ ID NO: 586015 - RNA, 22 nt, Human
gaauuaauugugugguuugaau

SEQ ID NO: 586016 - RNA, 17 nt, Human
ugagauggaagaagacu

SEQ ID NO: 586017 - RNA, 22 nt, Human
uguucucacuggaugcuucaca

SEQ ID NO: 586018 - RNA, 22 nt, Human
ucugcccuaauucagugcuuag

SEQ ID NO: 586019 - RNA, 22 nt, Human
uaaagcuuguauugcaauauuu

SEQ ID NO: 586020 - RNA, 22 nt, Human
cuuuucaugagucuguuauggg

SEQ ID NO: 586021 - RNA, 22 nt, Human
uccucaggauguggaguagaau

SEQ ID NO: 586022 - RNA, 22 nt, Human
augcagucauggaaugcucuca

SEQ ID NO: 586023 - RNA, 22 nt, Human
ugcugaauuaaacucuaugugg

SEQ ID NO: 586024 - RNA, 22 nt, Human
caacugggauaaagagcuaaag

SEQ ID NO: 586025 - RNA, 22 nt, Human
aaccagcuccucaccccauugu

SEQ ID NO: 586026 - RNA, 22 nt, Human
aauugcuuaguugcaacuaugc

SEQ ID NO: 586027 - RNA, 22 nt, Human
agagccaguuguuaagcacuua

SEQ ID NO: 586028 - RNA, 22 nt, Human
acgucaucguugucaucgucau

SEQ ID NO: 586029 - RNA, 22 nt, Human
acaggcuggugguccuggccau

SEQ ID NO: 586030 - RNA, 22 nt, Human
aaagacauuagcuuagauguca

SEQ ID NO: 586031 - RNA, 22 nt, Human
ccaggguuuaaauucugacuau

SEQ ID NO: 586032 - RNA, 22 nt, Human
aaguuugucucauuugaucuuc

SEQ ID NO: 586033 - RNA, 20 nt, Human
ucagcaugcuccucagacau

SEQ ID NO: 586034 - RNA, 18 nt, Human
agugucuggauauuuggg

SEQ ID NO: 586035 - RNA, 22 nt, Human
aguguucagugauugucaaccg

SEQ ID NO: 586036 - RNA, 22 nt, Human
agagaugguagaacagucauaa

SEQ ID NO: 586037 - RNA, 22 nt, Human
ugggagcaagcuacuuagggaa

SEQ ID NO: 586038 - RNA, 18 nt, Human
acugucucugagaguggu

SEQ ID NO: 586039 - RNA, 22 nt, Human
ucuggaauagguccugaguauu

SEQ ID NO: 586040 - RNA, 22 nt, Human
ccaugcacaccagcaggcagac

SEQ ID NO: 586041 - RNA, 22 nt, Human
ccagcugcugugaggaccacag

SEQ ID NO: 586042 - RNA, 22 nt, Human
ugagguaggugguggcagccau

SEQ ID NO: 586043 - RNA, 20 nt, Human
agugggagagggcagacugc

SEQ ID NO: 586044 - RNA, 22 nt, Human
cucaucugauaaaucacucuua

SEQ ID NO: 586045 - RNA, 22 nt, Human
caggcugacaacugagcauuuu

SEQ ID NO: 586046 - RNA, 22 nt, Human
cagaggcacagcuucuuuuaau

SEQ ID NO: 586047 - RNA, 22 nt, Human
ucucuggcugauauuccucugc

SEQ ID NO: 586048 - RNA, 22 nt, Human
aggaccuggaucacagagaucu

SEQ ID NO: 586049 - RNA, 23 nt, Human
guaaugaugggaauuuacuuaga

SEQ ID NO: 586050 - RNA, 22 nt, Human
cugugucuaaucaggucaguca

SEQ ID NO: 586051 - RNA, 22 nt, Human
gagcucauucauucauugccug

SEQ ID NO: 586052 - RNA, 22 nt, Human
uccaggagguuuggaggaagca

SEQ ID NO: 586053 - RNA, 22 nt, Human
uuguggggcaacagcaggugaa

SEQ ID NO: 586054 - RNA, 22 nt, Human
guuauuuuaucucugagagguu

SEQ ID NO: 586055 - RNA, 22 nt, Human
ucaaagagcuauucaguugugg

SEQ ID NO: 586056 - RNA, 22 nt, Human
ccucuccaguuuuaacgugacc

SEQ ID NO: 586057 - RNA, 22 nt, Human
uccagcuugacaaaugauuuua

SEQ ID NO: 586058 - RNA, 22 nt, Human
cauaauuagucauguuaugcau

SEQ ID NO: 586059 - RNA, 22 nt, Human
ccugggagccgacugacugugc

SEQ ID NO: 586060 - RNA, 19 nt, Human
ggugugccaaaugggaaug

SEQ ID NO: 586061 - RNA, 22 nt, Human
ccauggcauuuuaugugucuua

SEQ ID NO: 586062 - RNA, 22 nt, Human
uggggaggaagucagauuucag

SEQ ID NO: 586063 - RNA, 22 nt, Human
aauucuuaaucccauaaaguga

SEQ ID NO: 586064 - RNA, 22 nt, Human
cugggcugagccugggcugugu

SEQ ID NO: 586065 - RNA, 22 nt, Human
uccuugaauggacauuacacug

SEQ ID NO: 586066 - RNA, 22 nt, Human
auguuuuucauaccaguguugg

SEQ ID NO: 586067 - RNA, 22 nt, Human
ugaagaaucccagggaauuugg

SEQ ID NO: 586068 - RNA, 22 nt, Human
acugagaacuuggggacagagg

SEQ ID NO: 586069 - RNA, 22 nt, Human
ucaggcugguccccacagugga

SEQ ID NO: 586070 - RNA, 22 nt, Human
cagcuggggcagccacgugcgg

SEQ ID NO: 586071 - RNA, 22 nt, Human
cuggcuuuuagugugaagacuu

SEQ ID NO: 586072 - RNA, 22 nt, Human
aggaauguaacaggaguaaaaa

SEQ ID NO: 586073 - RNA, 22 nt, Human
gcugggcugagaaguuaagcaa

SEQ ID NO: 586074 - RNA, 22 nt, Human
cugaggaggcuaauuugaggau

SEQ ID NO: 586075 - RNA, 22 nt, Human
uguccuggguggaugcuucauu

SEQ ID NO: 586076 - RNA, 22 nt, Human
ucuggaguagggucugggaauu

SEQ ID NO: 586077 - RNA, 22 nt, Human
gagggagccgccacagacuggg

SEQ ID NO: 586078 - RNA, 19 nt, Human
ugcccaggccagguugggc

SEQ ID NO: 586079 - RNA, 22 nt, Human
aauauaguucuagaaauauuuu

SEQ ID NO: 586080 - RNA, 22 nt, Human
aacaaucaaguuucuaaaugac

SEQ ID NO: 586081 - RNA, 22 nt, Human
uuuagugauucauuuagaaaaa

SEQ ID NO: 586082 - RNA, 18 nt, Human
aacaggauccuccacuuc

SEQ ID NO: 586083 - RNA, 22 nt, Human
ccuucuccccucugcagggugu

SEQ ID NO: 586084 - RNA, 22 nt, Human
uggcugggccgggccuugugcc

SEQ ID NO: 586085 - RNA, 22 nt, Human
ucugaacagcauggaaucauuu

SEQ ID NO: 586086 - RNA, 18 nt, Human
aggauauuaagaguacag

SEQ ID NO: 586087 - RNA, 22 nt, Human
agcacauugauuuauuuuggag

SEQ ID NO: 586088 - RNA, 22 nt, Human
ggggcaccuccucuuggcaauu

SEQ ID NO: 586089 - RNA, 22 nt, Human
cccugccuugggguccacaccg

SEQ ID NO: 586090 - RNA, 22 nt, Human
ucucagaaauacuauguuguca

SEQ ID NO: 586091 - RNA, 22 nt, Human
ugcuggagaccugcuugcacca

SEQ ID NO: 586092 - RNA, 22 nt, Human
ccaugggcacuggguggaggua

SEQ ID NO: 586093 - RNA, 22 nt, Human
gcccugcccugagccguagacc

SEQ ID NO: 586094 - RNA, 22 nt, Human
uccagcucuucaguucugcaaa

SEQ ID NO: 586095 - RNA, 22 nt, Human
auuugcuucauagaucugugga

SEQ ID NO: 586096 - RNA, 18 nt, Human
uccuuagcugagcuuguc

SEQ ID NO: 586097 - RNA, 22 nt, Human
ucuugaaguccuuacauuugau

SEQ ID NO: 586098 - RNA, 22 nt, Human
gcagugaaucuggcaagaauuu

SEQ ID NO: 586099 - RNA, 22 nt, Human
aggcucugacccaugggaccca

SEQ ID NO: 586100 - RNA, 22 nt, Human
auaaaagucugcuuauuugggc

SEQ ID NO: 586101 - RNA, 22 nt, Human
cucuuuaaaguaaaauuugucu

SEQ ID NO: 586102 - RNA, 22 nt, Human
gagagcuggauucuggauaggu

SEQ ID NO: 586103 - RNA, 22 nt, Human
uaugacauugcuuuuuagaacu

SEQ ID NO: 586104 - RNA, 22 nt, Human
cugcuucacuucgguugcauag

SEQ ID NO: 586105 - RNA, 22 nt, Human
gugaauaugaucuuauuuggaa

SEQ ID NO: 586106 - RNA, 22 nt, Human
cgccuucaggcccuuuuuguug

SEQ ID NO: 586107 - RNA, 22 nt, Human
ucuucaaagaauuuuaguaauu

SEQ ID NO: 586108 - RNA, 22 nt, Human
caguaguggucuaucacuggag

SEQ ID NO: 586109 - RNA, 22 nt, Human
agaggccacuuugccugugaug

SEQ ID NO: 586110 - RNA, 22 nt, Human
ccuucugagcuucaauuucagu

SEQ ID NO: 586111 - RNA, 22 nt, Human
acccagggaccccgcugacgcc

SEQ ID NO: 586112 - RNA, 22 nt, Human
ugcaaagaugaaauauuaaagg

SEQ ID NO: 586113 - RNA, 22 nt, Human
gguggccauggucagguagcgg

SEQ ID NO: 586114 - RNA, 22 nt, Human
cucacagcugcuucaggaucca

SEQ ID NO: 586115 - RNA, 22 nt, Human
acugggcuguggacacccagcg

SEQ ID NO: 586116 - RNA, 22 nt, Human
gagacacuugcugugaggucgc

SEQ ID NO: 586117 - RNA, 22 nt, Human
ugcaggcuggggaggcagacuu

SEQ ID NO: 586118 - RNA, 22 nt, Human
gcucuggcuuggggcacucguc

SEQ ID NO: 586119 - RNA, 22 nt, Human
aucccagagaauaaugaucagg

SEQ ID NO: 586120 - RNA, 22 nt, Human
ggcuggguacagggcagugugc

SEQ ID NO: 586121 - RNA, 22 nt, Human
cagugccauauugaaagacauu

SEQ ID NO: 586122 - RNA, 22 nt, Human
ggcagucacuuuugcuugugcc

SEQ ID NO: 586123 - RNA, 22 nt, Human
acuggggaauggaacugggaau

SEQ ID NO: 586124 - RNA, 22 nt, Human
uagcucugugcucuggaucugu

SEQ ID NO: 586125 - RNA, 22 nt, Human
ccagguggacggcgaguacagg

SEQ ID NO: 586126 - RNA, 22 nt, Human
caugaacauucagaaauacagc

SEQ ID NO: 586127 - RNA, 22 nt, Human
agggagacacaugaggaaguca

SEQ ID NO: 586128 - RNA, 19 nt, Human
ccaggagcaguggugagcu

SEQ ID NO: 586129 - RNA, 22 nt, Human
cuuccucugcggcgccgggcgc

SEQ ID NO: 586130 - RNA, 22 nt, Human
uccagcagggaauuaguagucu

SEQ ID NO: 586131 - RNA, 22 nt, Human
auuauuguugcggcuguuaccg

SEQ ID NO: 586132 - RNA, 22 nt, Human
cuugagaaucuucucugaagag

SEQ ID NO: 586133 - RNA, 22 nt, Human
cagagcaguccuugucaaucag

SEQ ID NO: 586134 - RNA, 22 nt, Human
aggagcuggaguccaggcaagu

SEQ ID NO: 586135 - RNA, 22 nt, Human
uguggcagaggaggcagcgucc

SEQ ID NO: 586136 - RNA, 22 nt, Human
auuuguaaagugcuuaaaagua

SEQ ID NO: 586137 - RNA, 22 nt, Human
acuuuguuccuuucacaaagaa

SEQ ID NO: 586138 - RNA, 22 nt, Human
aauguugccccaggacaaagga

SEQ ID NO: 586139 - RNA, 22 nt, Human
ugcccagcugucaaaguagaua

SEQ ID NO: 586140 - RNA, 22 nt, Human
ugggcaucauggacagcagagg

SEQ ID NO: 586141 - RNA, 22 nt, Human
auacaguagacaaucucaugaa

SEQ ID NO: 586142 - RNA, 22 nt, Human
cugcugggaaggucugcucagu

SEQ ID NO: 586143 - RNA, 22 nt, Human
gaggcacaucacuuggugcauu

SEQ ID NO: 586144 - RNA, 22 nt, Human
ucuugcuucugcucaaggggag

SEQ ID NO: 586145 - RNA, 22 nt, Human
acugugaaucacuacuaguaga

SEQ ID NO: 586146 - RNA, 22 nt, Human
uggcaguggauaggggagcggu

SEQ ID NO: 586147 - RNA, 22 nt, Human
uugaagaugcugucucuuccag

SEQ ID NO: 586148 - RNA, 22 nt, Human
cugacaguguacacugacagcu

SEQ ID NO: 586149 - RNA, 22 nt, Human
uggcagagucaucacaucugga

SEQ ID NO: 586150 - RNA, 22 nt, Human
auggagugggccaauuuuagug

SEQ ID NO: 586151 - RNA, 22 nt, Human
gcccugagaggcaaugacucuu

SEQ ID NO: 586152 - RNA, 18 nt, Human
ccucaggggaccuggcag

SEQ ID NO: 586153 - RNA, 22 nt, Human
uaagauaaggagagugcuagua

SEQ ID NO: 586154 - RNA, 22 nt, Human
agcagggcuuugcagacuuggg

SEQ ID NO: 586155 - RNA, 22 nt, Human
gcugcaggagcuggagcugugg

SEQ ID NO: 586156 - RNA, 22 nt, Human
cugcagaccucugagguccaug

SEQ ID NO: 586157 - RNA, 17 nt, Human
gcugcagcgguaggcag

SEQ ID NO: 586158 - RNA, 22 nt, Human
cacaauuuccaagucauguuau

SEQ ID NO: 586159 - RNA, 22 nt, Human
gagagguagaggcucugcuuaa

SEQ ID NO: 586160 - RNA, 22 nt, Human
cagaggcugaugugggaugggc

SEQ ID NO: 586161 - RNA, 22 nt, Human
acauguacauacacauauguaa

SEQ ID NO: 586162 - RNA, 22 nt, Human
acugaggcgcaguccggcuguc

SEQ ID NO: 586163 - RNA, 22 nt, Human
uccugggucucuuccuuaguuc

SEQ ID NO: 586164 - RNA, 22 nt, Human
gaaaauuauugaaaauggcucu

SEQ ID NO: 586165 - RNA, 22 nt, Human
uucaacacaggaacaugauaua

SEQ ID NO: 586166 - RNA, 22 nt, Human
agcugaaguccucgcggugcua

SEQ ID NO: 586167 - RNA, 17 nt, Human
ucugaggugaggaugca

SEQ ID NO: 586168 - RNA, 22 nt, Human
cagguggguacaucacagagac

SEQ ID NO: 586169 - RNA, 22 nt, Human
gagccugaugaaacaggcagac

SEQ ID NO: 586170 - RNA, 22 nt, Human
caggcugcguuugugaaaggua

SEQ ID NO: 586171 - RNA, 22 nt, Human
cauaauuucccaagagauugaa

SEQ ID NO: 586172 - RNA, 22 nt, Human
agaagccauucccuguaggcuc

SEQ ID NO: 586173 - RNA, 22 nt, Human
uaugcaaaucauuagauuuccu

SEQ ID NO: 586174 - RNA, 22 nt, Human
gcacacacuguuuuccucacau

SEQ ID NO: 586175 - RNA, 22 nt, Human
ugagagguaggaaaugaacaag

SEQ ID NO: 586176 - RNA, 22 nt, Human
caguaacagugaucaccugugg

SEQ ID NO: 586177 - RNA, 22 nt, Human
agcugcuguggggcucggccug

SEQ ID NO: 586178 - RNA, 22 nt, Human
agccucagggcucugcgcagac

SEQ ID NO: 586179 - RNA, 22 nt, Human
agauauuuaaaucagacaaaga

SEQ ID NO: 586180 - RNA, 22 nt, Human
gagcugagaagcagcgcuugau

SEQ ID NO: 586181 - RNA, 22 nt, Human
acugagguuauugcaauaaaau

SEQ ID NO: 586182 - RNA, 19 nt, Human
gguuaauguuaggauacuu

SEQ ID NO: 586183 - RNA, 22 nt, Human
aaggugaagcucccgaugagaa

SEQ ID NO: 586184 - RNA, 22 nt, Human
aauaagaacuugucucuggcag

SEQ ID NO: 586185 - RNA, 20 nt, Human
gcucugugguuugagucucc

SEQ ID NO: 586186 - RNA, 20 nt, Human
auacacauauucuugcaacu

SEQ ID NO: 586187 - RNA, 22 nt, Human
ccugggcugggcgucucauggg

SEQ ID NO: 586188 - RNA, 22 nt, Human
gcuccaggcagcauaguggaug

SEQ ID NO: 586189 - RNA, 22 nt, Human
uggggacagggcucagcaauuu

SEQ ID NO: 586190 - RNA, 23 nt, Human
ggcugagacuacaggcgcuugcc

SEQ ID NO: 586191 - RNA, 22 nt, Human
aaucagaauuuauugaaucuuu

SEQ ID NO: 586192 - RNA, 22 nt, Human
ggagauuuauagcacacuucag

SEQ ID NO: 586193 - RNA, 22 nt, Human
aggucugagucccagggguacc

SEQ ID NO: 586194 - RNA, 22 nt, Human
augacauugacagaccugcugc

SEQ ID NO: 586195 - RNA, 22 nt, Human
uaaagcauguuucaguaagguu

SEQ ID NO: 586196 - RNA, 19 nt, Human
uccucagugacaaccucag

SEQ ID NO: 586197 - RNA, 22 nt, Human
ccugccccucaaggccuggugc

SEQ ID NO: 586198 - RNA, 22 nt, Human
uauuuaauuagugauuguagag

SEQ ID NO: 586199 - RNA, 22 nt, Human
ccacaugcucucucuccagguu

SEQ ID NO: 586200 - RNA, 22 nt, Human
aggcagcauuucugcuuaucca

SEQ ID NO: 586201 - RNA, 20 nt, Human
gaggcccagagaggugaagc

SEQ ID NO: 586202 - RNA, 22 nt, Human
gcagaaggauccgcaggugcaa

SEQ ID NO: 586203 - RNA, 22 nt, Human
uccagcagaaaagagguaggga

SEQ ID NO: 586204 - RNA, 22 nt, Human
cugcaguuugaccuuguuuucu

SEQ ID NO: 586205 - RNA, 22 nt, Human
agcaggugagcacagccaggcu

SEQ ID NO: 586206 - RNA, 22 nt, Human
augcauauugauuauagauuca

SEQ ID NO: 586207 - RNA, 22 nt, Human
cagcagguauguuuguucagca

SEQ ID NO: 586208 - RNA, 22 nt, Human
cugaggcacagugaacuucucc

SEQ ID NO: 586209 - RNA, 22 nt, Human
caggagauaaaagagaugcuuu

SEQ ID NO: 586210 - RNA, 22 nt, Human
aguuacuugagacguuuaugaa

SEQ ID NO: 586211 - RNA, 22 nt, Human
acccaggagguggaggcugcag

SEQ ID NO: 586212 - RNA, 22 nt, Human
caguuuuucaaaauuacaugau

SEQ ID NO: 586213 - RNA, 22 nt, Human
aguuagaaaguaaaucauuuga

SEQ ID NO: 586214 - RNA, 22 nt, Human
ugcuugacuuaguuucucauuu

SEQ ID NO: 586215 - RNA, 22 nt, Human
aaauuauuaaacagugggaugc

SEQ ID NO: 586216 - RNA, 22 nt, Human
uuccacuuaguggaagggcaug

SEQ ID NO: 586217 - RNA, 22 nt, Human
auagcagaaaccaagcuucuuc

SEQ ID NO: 586218 - RNA, 20 nt, Human
cuccugugccucucugggcc

SEQ ID NO: 586219 - RNA, 22 nt, Human
uccugcagccacugcaggcaga

SEQ ID NO: 586220 - RNA, 22 nt, Human
ugacaagaagaccugguaauga

SEQ ID NO: 586221 - RNA, 22 nt, Human
aaaaugcaaaccuaccuacaua

SEQ ID NO: 586222 - RNA, 22 nt, Human
acauuuuuauccugagugccag

SEQ ID NO: 586223 - RNA, 22 nt, Human
augagguaggacaucaggaaau

SEQ ID NO: 586224 - RNA, 22 nt, Human
caagauucauuuuguccuuguc

SEQ ID NO: 586225 - RNA, 22 nt, Human
ugcaaggguguuugagcugccc

SEQ ID NO: 586226 - RNA, 22 nt, Human
aaugucuuuucccuuacuuucc

SEQ ID NO: 586227 - RNA, 22 nt, Human
agcagagguguuuauuauggga

SEQ ID NO: 586228 - RNA, 17 nt, Human
aggcugcugggccaggg

SEQ ID NO: 586229 - RNA, 22 nt, Human
cuucccuccuggauuccagacu

SEQ ID NO: 586230 - RNA, 22 nt, Human
uuucauugucuacauaugacau

SEQ ID NO: 586231 - RNA, 22 nt, Human
ucuuguuucuucuaagcagcag

SEQ ID NO: 586232 - RNA, 22 nt, Human
gacuauuuauuuacagaaagcu

SEQ ID NO: 586233 - RNA, 22 nt, Human
agugcuuugguauagaacuauu

SEQ ID NO: 586234 - RNA, 22 nt, Human
ggagagugggagcaacuguugc

SEQ ID NO: 586235 - RNA, 22 nt, Human
cugaaagaauaagauguuuaca

SEQ ID NO: 586236 - RNA, 19 nt, Human
ggugugaagugaggaguua

SEQ ID NO: 586237 - RNA, 22 nt, Human
uucugcucuuggcuuugcuggu

SEQ ID NO: 586238 - RNA, 22 nt, Human
uacaaugcaaaauacugucugc

SEQ ID NO: 586239 - RNA, 22 nt, Human
cagcugaggaauacuagaugua

SEQ ID NO: 586240 - RNA, 22 nt, Human
uaauguuuccagucuaugaugg

SEQ ID NO: 586241 - RNA, 22 nt, Human
gugacauuuauuagaugcuuac

SEQ ID NO: 586242 - RNA, 22 nt, Human
uauauuaucauaaaaccauuca

SEQ ID NO: 586243 - RNA, 22 nt, Human
aagcuguucugaaucaguaagu

SEQ ID NO: 586244 - RNA, 20 nt, Human
uaugaagauaugugaacagc

SEQ ID NO: 586245 - RNA, 22 nt, Human
uggcugccuagucccucagccu

SEQ ID NO: 586246 - RNA, 22 nt, Human
caguguuuguggaauucaggug

SEQ ID NO: 586247 - RNA, 22 nt, Human
agccuauuccaggaugagcuca

SEQ ID NO: 586248 - RNA, 22 nt, Human
ucaggcugggagacaaucacug

SEQ ID NO: 586249 - RNA, 22 nt, Human
ucauggcacaugcccuccaggg

SEQ ID NO: 586250 - RNA, 22 nt, Human
aaugguuuggacuauucaauag

SEQ ID NO: 586251 - RNA, 22 nt, Human
caguaucuccacauguaaagug

SEQ ID NO: 586252 - RNA, 22 nt, Human
agcugccaaguuggaguagcaa

SEQ ID NO: 586253 - RNA, 22 nt, Human
gugcugaggugggugggcagcc

SEQ ID NO: 586254 - RNA, 22 nt, Human
ugcauuuuugagguuaacucaa

SEQ ID NO: 586255 - RNA, 22 nt, Human
cuuuuucuaaucauaauugucu

SEQ ID NO: 586256 - RNA, 22 nt, Human
ggaggcauuauggggaagacuu

SEQ ID NO: 586257 - RNA, 22 nt, Human
guuucucuuugaagccuggcug

SEQ ID NO: 586258 - RNA, 22 nt, Human
uuauggcuucugugaagaauuu

SEQ ID NO: 586259 - RNA, 22 nt, Human
gcuccuggcaggcagugugugu

SEQ ID NO: 586260 - RNA, 22 nt, Human
aggaagagguagcugucaaggg

SEQ ID NO: 586261 - RNA, 22 nt, Human
auuuaaauuuucugauggagag

SEQ ID NO: 586262 - RNA, 22 nt, Human
ccugugggcuugaguguagggu

SEQ ID NO: 586263 - RNA, 22 nt, Human
auuuuguuauaggagcugaaau

SEQ ID NO: 586264 - RNA, 22 nt, Human
cccagagcugagggggcacguu

SEQ ID NO: 586265 - RNA, 22 nt, Human
ccagaggcuggguucaccucag

SEQ ID NO: 586266 - RNA, 22 nt, Human
agcaggaggagagccuggcggu

SEQ ID NO: 586267 - RNA, 22 nt, Human
cuggacagaaaccaguccuggg

SEQ ID NO: 586268 - RNA, 21 nt, Human
ucucuguggccuacccucuac

SEQ ID NO: 586269 - RNA, 22 nt, Human
gccuccuggaagucacauguuu

SEQ ID NO: 586270 - RNA, 22 nt, Human
gccaccagguuagauccagccu

SEQ ID NO: 586271 - RNA, 22 nt, Human
caaaacauucucugcagcaggg

SEQ ID NO: 586272 - RNA, 20 nt, Human
gcccaggaauuugcauuucu

SEQ ID NO: 586273 - RNA, 22 nt, Human
uaaguccuauuccaggucucuc

SEQ ID NO: 586274 - RNA, 22 nt, Human
cccaggcugggaacgauucuag

SEQ ID NO: 586275 - RNA, 22 nt, Human
agggggugucucugauuggguu

SEQ ID NO: 586276 - RNA, 22 nt, Human
cgccugggaguccacaccugcu

SEQ ID NO: 586277 - RNA, 22 nt, Human
cugaaagguauaaauaagacuu

SEQ ID NO: 586278 - RNA, 22 nt, Human
aagggcugcaauccaaaacacu

SEQ ID NO: 586279 - RNA, 22 nt, Human
uuaacacuugaacucuacaugu

SEQ ID NO: 586280 - RNA, 22 nt, Human
ccuugcucaucccccagugccu

SEQ ID NO: 586281 - RNA, 22 nt, Human
ggaggugggaguuuaguucuug

SEQ ID NO: 586282 - RNA, 22 nt, Human
acagugaaaaguagcuaacaca

SEQ ID NO: 586283 - RNA, 22 nt, Human
aaacacugguaugauguauagu

SEQ ID NO: 586284 - RNA, 22 nt, Human
aaugcuaucggcucuaagcaug

SEQ ID NO: 586285 - RNA, 22 nt, Human
auccugggcaguuuugagugcu

SEQ ID NO: 586286 - RNA, 22 nt, Human
ccagcuccacugucagaugaga

SEQ ID NO: 586287 - RNA, 22 nt, Human
gcugaggacauacacauugugc

SEQ ID NO: 586288 - RNA, 22 nt, Human
uaaugccaauuuaaugauccau

SEQ ID NO: 586289 - RNA, 22 nt, Human
ugggaaggacagaacauaauug

SEQ ID NO: 586290 - RNA, 22 nt, Human
gggcagugguuacacagcugag

SEQ ID NO: 586291 - RNA, 22 nt, Human
ucugagaauaaaaauugcauuu

SEQ ID NO: 586292 - RNA, 22 nt, Human
uggcagcucccagagcuuccaa

SEQ ID NO: 586293 - RNA, 22 nt, Human
aacauugaguucuacuuccauu

SEQ ID NO: 586294 - RNA, 22 nt, Human
ggcugagaguuuccucuggggc

SEQ ID NO: 586295 - RNA, 22 nt, Human
auuaugcugguuuacacauuuu

SEQ ID NO: 586296 - RNA, 22 nt, Human
gugccgcgacgcagucggugcc

SEQ ID NO: 586297 - RNA, 22 nt, Human
ucaaugucugucuaucuauuua

SEQ ID NO: 586298 - RNA, 22 nt, Human
acagaauugaagcugaguaaau

SEQ ID NO: 586299 - RNA, 22 nt, Human
ucuggcuuuauuccuucacuga

SEQ ID NO: 586300 - RNA, 18 nt, Human
uaaaucucucuuuaguca

SEQ ID NO: 586301 - RNA, 22 nt, Human
ugaggcagcaauuguauuguau

SEQ ID NO: 586302 - RNA, 22 nt, Human
auauaaugauuuucuggugagu

SEQ ID NO: 586303 - RNA, 22 nt, Human
aggcuccuugcucacaggcuca

SEQ ID NO: 586304 - RNA, 22 nt, Human
agaguggguuauaggcagacuu

SEQ ID NO: 586305 - RNA, 22 nt, Human
uccagggagcaagucaggccgg

SEQ ID NO: 586306 - RNA, 20 nt, Human
ccagaggguagggccgcccc

SEQ ID NO: 586307 - RNA, 22 nt, Human
cccagcccagcguucgaggggu

SEQ ID NO: 586308 - RNA, 22 nt, Human
aauguacacugaaagccuauca

SEQ ID NO: 586309 - RNA, 22 nt, Human
cacuguuuuuauguaaucagug

SEQ ID NO: 586310 - RNA, 22 nt, Human
ucaggcuguggcuucaguucuu

SEQ ID NO: 586311 - RNA, 18 nt, Human
cugcccagagcauuucau

SEQ ID NO: 586312 - RNA, 22 nt, Human
aggucacaggguugaaguacuu

SEQ ID NO: 586313 - RNA, 19 nt, Human
caucuuuggucaccuaguc

SEQ ID NO: 586314 - RNA, 22 nt, Human
auccaugauugcccagaggugu

SEQ ID NO: 586315 - RNA, 17 nt, Human
ggcagccucaggcguuu

SEQ ID NO: 586316 - RNA, 22 nt, Human
acacauuugggcuccuacauaa

SEQ ID NO: 586317 - RNA, 22 nt, Human
ugauuuuacuuagcaugauguu

SEQ ID NO: 586318 - RNA, 22 nt, Human
aaguugauagcauguuaagcuc

SEQ ID NO: 586319 - RNA, 22 nt, Human
uccaucuggagacuuccugguc

SEQ ID NO: 586320 - RNA, 22 nt, Human
uucauuuucuuucacgcugcug

SEQ ID NO: 586321 - RNA, 22 nt, Human
aggagacucagagaccuggccg

SEQ ID NO: 586322 - RNA, 22 nt, Human
cuuggccugcccagccagaagg

SEQ ID NO: 586323 - RNA, 22 nt, Human
uggagcaggugccaggugugug

SEQ ID NO: 586324 - RNA, 22 nt, Human
gggcaggggucaguggccccaa

SEQ ID NO: 586325 - RNA, 22 nt, Human
accuuuaugaaacagcugucgu

SEQ ID NO: 586326 - RNA, 23 nt, Human
cagcugguugugggaguggcugc

SEQ ID NO: 586327 - RNA, 22 nt, Human
aacaggaaaacagcacaauagc

SEQ ID NO: 586328 - RNA, 22 nt, Human
ccugcucuaaaucucauggaac

SEQ ID NO: 586329 - RNA, 22 nt, Human
gcuggucagagagaaaggaggc

SEQ ID NO: 586330 - RNA, 22 nt, Human
gggggugacgauggcagcuggu

SEQ ID NO: 586331 - RNA, 22 nt, Human
acaucugagcaacagaacacua

SEQ ID NO: 586332 - RNA, 22 nt, Human
aaagaaaccuaucagccacaug

SEQ ID NO: 586333 - RNA, 22 nt, Human
ggagcuggagagcuagccuagg

SEQ ID NO: 586334 - RNA, 22 nt, Human
ugaaaauggccugaagaagcaa

SEQ ID NO: 586335 - RNA, 22 nt, Human
ggccccugcggacugccuagag

SEQ ID NO: 586336 - RNA, 22 nt, Human
ugguggggcuuuccuucugcuu

SEQ ID NO: 586337 - RNA, 22 nt, Human
ucccagggacaccaagcuguuu

SEQ ID NO: 586338 - RNA, 22 nt, Human
aggcugugcaauuaggguaaga

SEQ ID NO: 586339 - RNA, 22 nt, Human
acugucacuccaacugagucgu

SEQ ID NO: 586340 - RNA, 19 nt, Human
aggugcaggucacagggga

SEQ ID NO: 586341 - RNA, 22 nt, Human
auaguuauuagagaagcuggua

SEQ ID NO: 586342 - RNA, 22 nt, Human
uguaucaaggguuuauguaagc

SEQ ID NO: 586343 - RNA, 22 nt, Human
aggaaggguggauaguaacgug

SEQ ID NO: 586344 - RNA, 22 nt, Human
acacagcaaggucugacuuugg

SEQ ID NO: 586345 - RNA, 22 nt, Human
guuguuuuugaacggugguggc

SEQ ID NO: 586346 - RNA, 20 nt, Human
ggguccugacuuggucuccu

SEQ ID NO: 586347 - RNA, 23 nt, Human
ggcacagaugcugagcaugugca

SEQ ID NO: 586348 - RNA, 22 nt, Human
cucugaaagaguuuaguauuau

SEQ ID NO: 586349 - RNA, 22 nt, Human
acuguuaugggugucagcuuaa

SEQ ID NO: 586350 - RNA, 22 nt, Human
caguaugacuacaaacagcuuu

SEQ ID NO: 586351 - RNA, 22 nt, Human
auugaaagauauacuguucuca

SEQ ID NO: 586352 - RNA, 22 nt, Human
gcacugggaagaaugagccugu

SEQ ID NO: 586353 - RNA, 22 nt, Human
uucucucugagagcaucuggaa

SEQ ID NO: 586354 - RNA, 22 nt, Human
ugucaacagaucucaaagcugg

SEQ ID NO: 586355 - RNA, 22 nt, Human
auguguuuguaccuuuaaauau

SEQ ID NO: 586356 - RNA, 22 nt, Human
aaaccauggaguaaguucacau

SEQ ID NO: 586357 - RNA, 22 nt, Human
uuuucuguauuauugugcuuca

SEQ ID NO: 586358 - RNA, 22 nt, Human
gcccugucggaacugcgaccuc

SEQ ID NO: 586359 - RNA, 22 nt, Human
cugagcugggaguagagacucu

SEQ ID NO: 586360 - RNA, 22 nt, Human
gcagcuuggugaaaggugaugg

SEQ ID NO: 586361 - RNA, 22 nt, Human
gaggccucugucccaccaggga

SEQ ID NO: 586362 - RNA, 22 nt, Human
accugccuucucaaggacauga

SEQ ID NO: 586363 - RNA, 22 nt, Human
caggagaugacagggaagaacc

SEQ ID NO: 586364 - RNA, 22 nt, Human
ugggauggcauccugggccuug

SEQ ID NO: 586365 - RNA, 22 nt, Human
gcugugagcugccugugucaca

SEQ ID NO: 586366 - RNA, 22 nt, Human
agcuggcagucauccuagugag

SEQ ID NO: 586367 - RNA, 22 nt, Human
ucugggaaccagugcggcuggg

SEQ ID NO: 586368 - RNA, 22 nt, Human
ugugaaggagaugaagggagug

SEQ ID NO: 586369 - RNA, 22 nt, Human
uugggcugaaguagagggcaga

SEQ ID NO: 586370 - RNA, 18 nt, Human
gcugccugcauuccucac

SEQ ID NO: 586371 - RNA, 22 nt, Human
gagcuagggguagucaggagac

SEQ ID NO: 586372 - RNA, 20 nt, Human
augauuuugcacuaacuuca

SEQ ID NO: 586373 - RNA, 22 nt, Human
gcuggcuccucuguccucacgg

SEQ ID NO: 586374 - RNA, 22 nt, Human
ccagaggcuggcagccagcuga

SEQ ID NO: 586375 - RNA, 17 nt, Human
aggccagaugaggcaag

SEQ ID NO: 586376 - RNA, 22 nt, Human
agggccaggaacaccugaaggg

SEQ ID NO: 586377 - RNA, 20 nt, Human
cucagcuaaacaacacugac

SEQ ID NO: 586378 - RNA, 22 nt, Human
uuguuaaaaauagauuuccagg

SEQ ID NO: 586379 - RNA, 22 nt, Human
agggcaucucuaacagucuccu

SEQ ID NO: 586380 - RNA, 22 nt, Human
uucauuguacuuuaagagaugc

SEQ ID NO: 586381 - RNA, 22 nt, Human
uguuuucuagaaacaaugccua

SEQ ID NO: 586382 - RNA, 22 nt, Human
ugcuccaggccgccuggggcug

SEQ ID NO: 586383 - RNA, 22 nt, Human
gcugaguguaaugauggcagag

SEQ ID NO: 586384 - RNA, 22 nt, Human
ccugugugauuggaagcugaga

SEQ ID NO: 586385 - RNA, 22 nt, Human
gccaggcuccaggcccuccuga

SEQ ID NO: 586386 - RNA, 22 nt, Human
cugccuguggucugugaucuaa

SEQ ID NO: 586387 - RNA, 22 nt, Human
ugcugucccuaagucucuucaa

SEQ ID NO: 586388 - RNA, 22 nt, Human
agagagggcauagaaaaaggga

SEQ ID NO: 586389 - RNA, 22 nt, Human
agcauauaggaaauguugaauc

SEQ ID NO: 586390 - RNA, 22 nt, Human
cuggggcccaucgagggcugag

SEQ ID NO: 586391 - RNA, 22 nt, Human
aggcucugcagugcuggaggac

SEQ ID NO: 586392 - RNA, 22 nt, Human
ugauucagucucuucaggagaa

SEQ ID NO: 586393 - RNA, 22 nt, Human
caccaggugcuggaggacauca

SEQ ID NO: 586394 - RNA, 22 nt, Human
aagccaggguuuguggaucuau

SEQ ID NO: 586395 - RNA, 21 nt, Human
ucagggcagcugcucuucaga

SEQ ID NO: 586396 - RNA, 22 nt, Human
acacaugcacaacaguucuuuc

SEQ ID NO: 586397 - RNA, 22 nt, Human
gccuuccugcagcucugagcgu

SEQ ID NO: 586398 - RNA, 22 nt, Human
ccugagcugcggggcagugcuc

SEQ ID NO: 586399 - RNA, 22 nt, Human
ucugaggcccuacccugagccu

SEQ ID NO: 586400 - RNA, 22 nt, Human
uuuuaagaugcuaguauuucag

SEQ ID NO: 586401 - RNA, 18 nt, Human
uccaggcuggauugauga

SEQ ID NO: 586402 - RNA, 22 nt, Human
uaggaagcucuuuguuuuguga

SEQ ID NO: 586403 - RNA, 22 nt, Human
cagaggcuaagaugagugggug

SEQ ID NO: 586404 - RNA, 22 nt, Human
augaggcagguggaggcugcca

SEQ ID NO: 586405 - RNA, 22 nt, Human
ggggcagagagaaggaagcuug

SEQ ID NO: 586406 - RNA, 22 nt, Human
ccaggggcugcagauccauggu

SEQ ID NO: 586407 - RNA, 22 nt, Human
ugugccagccucuggcuguguc

SEQ ID NO: 586408 - RNA, 22 nt, Human
ggcugagcguggcugccguggg

SEQ ID NO: 586409 - RNA, 22 nt, Human
uauuuuaaagacugccagccua

SEQ ID NO: 586410 - RNA, 22 nt, Human
ugaaaguauuugauuucuauua

SEQ ID NO: 586411 - RNA, 22 nt, Human
ggcaguguccuugcagcucuac

SEQ ID NO: 586412 - RNA, 22 nt, Human
aggaccuuggaauaacaaauuc

SEQ ID NO: 586413 - RNA, 22 nt, Human
ucccaggagcaccuuuugagcc

SEQ ID NO: 586414 - RNA, 22 nt, Human
gaaaaaugcuccaaaucugugg

SEQ ID NO: 586415 - RNA, 22 nt, Human
ugagguagcugcuauuuguagu

SEQ ID NO: 586416 - RNA, 19 nt, Human
ggaaacaggggccagagga

SEQ ID NO: 586417 - RNA, 22 nt, Human
ccagucugcagccccuggggac

SEQ ID NO: 586418 - RNA, 22 nt, Human
guccugacggcugauuggccug

SEQ ID NO: 586419 - RNA, 22 nt, Human
acuuuacuacauccacagaugg

SEQ ID NO: 586420 - RNA, 22 nt, Human
gcccccaggcucuggagaaccu

SEQ ID NO: 586421 - RNA, 22 nt, Human
aagaaggcggaccagaagggag

SEQ ID NO: 586422 - RNA, 22 nt, Human
aagucuuaggcauuuuauuucu

SEQ ID NO: 586423 - RNA, 22 nt, Human
ugcagaagcugcaggucagugg

SEQ ID NO: 586424 - RNA, 22 nt, Human
uucacagagcacugccaaguac

SEQ ID NO: 586425 - RNA, 22 nt, Human
cugcuucacccugccugagaac

SEQ ID NO: 586426 - RNA, 22 nt, Human
uuacauauuauccaaaacugcu

SEQ ID NO: 586427 - RNA, 22 nt, Human
caggcucccugggcaguggcag

SEQ ID NO: 586428 - RNA, 22 nt, Human
ucauggauaaaauauugguuaa

SEQ ID NO: 586429 - RNA, 22 nt, Human
uaagguuugcuuaucuucgccu

SEQ ID NO: 586430 - RNA, 22 nt, Human
aaauggcaggcucuuugcuagu

SEQ ID NO: 586431 - RNA, 22 nt, Human
cuagugaacgugguacuaugga

SEQ ID NO: 586432 - RNA, 22 nt, Human
agcugguuagcaaucuaaguga

SEQ ID NO: 586433 - RNA, 22 nt, Human
guguguucccguuuccuucacu

SEQ ID NO: 586434 - RNA, 22 nt, Human
ucuggaguaugucccuggugaa

SEQ ID NO: 586435 - RNA, 22 nt, Human
gcugugagugagcugccuaggc

SEQ ID NO: 586436 - RNA, 17 nt, Human
cuggagaagccugugga

SEQ ID NO: 586437 - RNA, 22 nt, Human
gagguccaacacaauggguguu

SEQ ID NO: 586438 - RNA, 22 nt, Human
cuaggcaguccugacgguacua

SEQ ID NO: 586439 - RNA, 22 nt, Human
ccacagaaugaugacacuucag

SEQ ID NO: 586440 - RNA, 22 nt, Human
aaugaacuggaucaggguuucu

SEQ ID NO: 586441 - RNA, 22 nt, Human
uugacaaaggaccuugcuauuu

SEQ ID NO: 586442 - RNA, 22 nt, Human
gagccuggauugaagugggugg

SEQ ID NO: 586443 - RNA, 22 nt, Human
ggcagcaacucggagagaagag

SEQ ID NO: 586444 - RNA, 22 nt, Human
ucccagccuuccagucugguuu

SEQ ID NO: 586445 - RNA, 22 nt, Human
ugcuccaggugugccucucaug

SEQ ID NO: 586446 - RNA, 22 nt, Human
ugcuucagcacuuugagagccu

SEQ ID NO: 586447 - RNA, 22 nt, Human
agugagggaugaagaacugcgg

SEQ ID NO: 586448 - RNA, 22 nt, Human
cccugccaaucccgucucucug

SEQ ID NO: 586449 - RNA, 22 nt, Human
caggacaggaguggggucaaag

SEQ ID NO: 586450 - RNA, 22 nt, Human
cugcaguuuguaaacauuuuaa

SEQ ID NO: 586451 - RNA, 22 nt, Human
uaggcagaaaggaaggcaaguu

SEQ ID NO: 586452 - RNA, 22 nt, Human
caggauggagagugagggguca

SEQ ID NO: 586453 - RNA, 22 nt, Human
ugcaauuuggcuuccauuuucu

SEQ ID NO: 586454 - RNA, 21 nt, Human
aggcagaaagagcccaggcug

SEQ ID NO: 586455 - RNA, 22 nt, Human
gguugcaaacuccugggaucaa

SEQ ID NO: 586456 - RNA, 22 nt, Human
ggucugaggcuccaaggaggug

SEQ ID NO: 586457 - RNA, 22 nt, Human
ggagugacucacagcugggaca

SEQ ID NO: 586458 - RNA, 22 nt, Human
gcagaugguggggcaggaaaau

SEQ ID NO: 586459 - RNA, 22 nt, Human
gagccccagcccugcuucuaua

SEQ ID NO: 586460 - RNA, 22 nt, Human
agcugcaggaaguagaagcgga

SEQ ID NO: 586461 - RNA, 22 nt, Human
uggcccucguccgacagguggg

SEQ ID NO: 586462 - RNA, 22 nt, Human
uuuauuucacucuccggauacu

SEQ ID NO: 586463 - RNA, 22 nt, Human
uccagccaagccuugguagcug

SEQ ID NO: 586464 - RNA, 22 nt, Human
ucacauuuguucuugaaucuaa

SEQ ID NO: 586465 - RNA, 22 nt, Human
ugaggcucagaaauguaaguuu

SEQ ID NO: 586466 - RNA, 22 nt, Human
ucugagaagcuagaggacaaag

SEQ ID NO: 586467 - RNA, 21 nt, Human
uccaaaaaggagcguccuucu

SEQ ID NO: 586468 - RNA, 22 nt, Human
cugauauuauugaagcuggagu

SEQ ID NO: 586469 - RNA, 22 nt, Human
auuccuuggaacagaugcgaag

SEQ ID NO: 586470 - RNA, 22 nt, Human
uugaaacauaaaauauuuccug

SEQ ID NO: 586471 - RNA, 22 nt, Human
uggggugggguuacucauucug

SEQ ID NO: 586472 - RNA, 22 nt, Human
gagcacagauugauuuaaaaua

SEQ ID NO: 586473 - RNA, 22 nt, Human
cauuugaucuccugaauaaaca

SEQ ID NO: 586474 - RNA, 22 nt, Human
caggugaacccagucuaaucau

SEQ ID NO: 586475 - RNA, 22 nt, Human
gggggaugcucaggaggcugcu

SEQ ID NO: 586476 - RNA, 22 nt, Human
ugagaugcugcuguaacaaaua

SEQ ID NO: 586477 - RNA, 22 nt, Human
auaaggaaccugggcuuaagag

SEQ ID NO: 586478 - RNA, 22 nt, Human
cagugcucauagcuguuccucc

SEQ ID NO: 586479 - RNA, 22 nt, Human
uggugggaguccgcugugcugc

SEQ ID NO: 586480 - RNA, 22 nt, Human
caagauuugggggcacggaauc

SEQ ID NO: 586481 - RNA, 22 nt, Human
uuaauuuaagaaacggcaggcc

SEQ ID NO: 586482 - RNA, 22 nt, Human
caggguagacaguaggugucug

SEQ ID NO: 586483 - RNA, 22 nt, Human
aaggcugggaaacaugcaggcc

SEQ ID NO: 586484 - RNA, 22 nt, Human
uccacgugagcuucgugugcag

SEQ ID NO: 586485 - RNA, 22 nt, Human
cagggcucccugcagccucugu

SEQ ID NO: 586486 - RNA, 22 nt, Human
ucagcugcugugguauguacau

SEQ ID NO: 586487 - RNA, 22 nt, Human
ccucacagagcccagaugucua

SEQ ID NO: 586488 - RNA, 22 nt, Human
cacuugguuugggaguacauaa

SEQ ID NO: 586489 - RNA, 22 nt, Human
agaaaacauuacauaggugugu

SEQ ID NO: 586490 - RNA, 22 nt, Human
aaguaugacauuuaagacaauu

SEQ ID NO: 586491 - RNA, 20 nt, Human
uccuugaaagugggguauau

SEQ ID NO: 586492 - RNA, 22 nt, Human
agggagccagaguugggagcuc

SEQ ID NO: 586493 - RNA, 22 nt, Human
ugaaagauaaguuauuauguac

SEQ ID NO: 586494 - RNA, 22 nt, Human
agcugcaguaugaggcuggugg

SEQ ID NO: 586495 - RNA, 17 nt, Human
aggcaggagauuggaga

SEQ ID NO: 586496 - RNA, 22 nt, Human
ugagcccaggaguuggagaccg

SEQ ID NO: 586497 - RNA, 22 nt, Human
gccaggcuggggggagaugucu

SEQ ID NO: 586498 - RNA, 22 nt, Human
acucucugugauggaggccagc

SEQ ID NO: 586499 - RNA, 22 nt, Human
agguaaggcuguaagcuaagcc

SEQ ID NO: 586500 - RNA, 22 nt, Human
uucacccuggaccagaaauugg

SEQ ID NO: 586501 - RNA, 22 nt, Human
ucugggaaguuggcagccagcu

SEQ ID NO: 586502 - RNA, 22 nt, Human
aacaugaaacccaaacagaaua

SEQ ID NO: 586503 - RNA, 22 nt, Human
gauuagaauaugucagucauaa

SEQ ID NO: 586504 - RNA, 22 nt, Human
cacccuggcuggaggugcagug

SEQ ID NO: 586505 - RNA, 19 nt, Human
auuagcagacuuccuuuca

SEQ ID NO: 586506 - RNA, 22 nt, Human
uuaaagcaaguagaagccugag

SEQ ID NO: 586507 - RNA, 22 nt, Human
uuugcuuucuguugaacagagu

SEQ ID NO: 586508 - RNA, 22 nt, Human
uuacauaacuuuaaaaugccgu

SEQ ID NO: 586509 - RNA, 22 nt, Human
ugcuuucuuuagcuccugaguc

SEQ ID NO: 586510 - RNA, 22 nt, Human
ccacagucuagcuagaaggcau

SEQ ID NO: 586511 - RNA, 22 nt, Human
ccaaugaaaggucaauucuaua

SEQ ID NO: 586512 - RNA, 22 nt, Human
aaggaagacacagaugaaguga

SEQ ID NO: 586513 - RNA, 21 nt, Human
acacauuaugagcauagacuc

SEQ ID NO: 586514 - RNA, 22 nt, Human
uaagacauuugacaaaccauuu

SEQ ID NO: 586515 - RNA, 22 nt, Human
ucugacauuagauuaauuggaa

SEQ ID NO: 586516 - RNA, 22 nt, Human
acuuuggaauaagcuauauaac

SEQ ID NO: 586517 - RNA, 22 nt, Human
ugcaggugcguuuucaagccuc

SEQ ID NO: 586518 - RNA, 22 nt, Human
cagggaaacuaggaaauaagcu

SEQ ID NO: 586519 - RNA, 21 nt, Human
agacaaugcuguaaaauucag

SEQ ID NO: 586520 - RNA, 22 nt, Human
aaaggcaugccuccauuucuau

SEQ ID NO: 586521 - RNA, 22 nt, Human
uuuacuuugugucaagucaaga

SEQ ID NO: 586522 - RNA, 22 nt, Human
ucagcacugauguuucagaaga

SEQ ID NO: 586523 - RNA, 22 nt, Human
uccuuuuuaagucguuguggua

SEQ ID NO: 586524 - RNA, 22 nt, Human
ccagggugggaggcugaaggcg

SEQ ID NO: 586525 - RNA, 22 nt, Human
cccagcaucuccaggcauggcc

SEQ ID NO: 586526 - RNA, 22 nt, Human
auaugcuugggacugauacagu

SEQ ID NO: 586527 - RNA, 23 nt, Human
auacauacagucuuacugacuuu

SEQ ID NO: 586528 - RNA, 19 nt, Human
uggcagaggcaguuuguac

SEQ ID NO: 586529 - RNA, 22 nt, Human
uacaccauucccagguggauuu

SEQ ID NO: 586530 - RNA, 22 nt, Human
acacugauuguagucuguggug

SEQ ID NO: 586531 - RNA, 22 nt, Human
ggcagugguuagaaacaugagc

SEQ ID NO: 586532 - RNA, 22 nt, Human
gaacaacuuugaaacaugaaga

SEQ ID NO: 586533 - RNA, 22 nt, Human
uuuuucaucugauugauaacuc

SEQ ID NO: 586534 - RNA, 22 nt, Human
uucacacagcaacuguaugaau

SEQ ID NO: 586535 - RNA, 22 nt, Human
ccagcagagggucuuggccauu

SEQ ID NO: 586536 - RNA, 22 nt, Human
ccugugucuuccccacuggugu

SEQ ID NO: 586537 - RNA, 19 nt, Human
cugucaggggcuggauguu

SEQ ID NO: 586538 - RNA, 22 nt, Human
aagaggcuggcauugaugguag

SEQ ID NO: 586539 - RNA, 22 nt, Human
agagccugggcagcuccucugg

SEQ ID NO: 586540 - RNA, 22 nt, Human
aagcacagagagguaaaguaac

SEQ ID NO: 586541 - RNA, 22 nt, Human
ggaugcaggacggcauggaugu

SEQ ID NO: 586542 - RNA, 22 nt, Human
uugagcaaugucacugaggcuu

SEQ ID NO: 586543 - RNA, 22 nt, Human
guccugggaaggaagccaggga

SEQ ID NO: 586544 - RNA, 22 nt, Human
cuguggaguuccaucaggggag

SEQ ID NO: 586545 - RNA, 22 nt, Human
gggggaagaggcaugaaguccu

SEQ ID NO: 586546 - RNA, 22 nt, Human
ucaagcaaguguuugguguaaa

SEQ ID NO: 586547 - RNA, 22 nt, Human
uccuuccugcaggccaaguccu

SEQ ID NO: 586548 - RNA, 22 nt, Human
agaccucuggauagaugugagg

SEQ ID NO: 586549 - RNA, 22 nt, Human
ccugaggcucuccugaauaaug

SEQ ID NO: 586550 - RNA, 22 nt, Human
uaagccugcaugaaccaugaga

SEQ ID NO: 586551 - RNA, 22 nt, Human
ugugugcacaugauuugaaaug

SEQ ID NO: 586552 - RNA, 22 nt, Human
ucuacaugauguaccaucuaag

SEQ ID NO: 586553 - RNA, 22 nt, Human
ggcaccaggaucagucugucau

SEQ ID NO: 586554 - RNA, 21 nt, Human
aggaaguggccagauugggaa

SEQ ID NO: 586555 - RNA, 22 nt, Human
acaaggcugaacagugaagccg

SEQ ID NO: 586556 - RNA, 19 nt, Human
ugcauguguucucccauug

SEQ ID NO: 586557 - RNA, 22 nt, Human
aacaggcuuccaggagggacga

SEQ ID NO: 586558 - RNA, 22 nt, Human
agguugaagagacuuuaaauua

SEQ ID NO: 586559 - RNA, 22 nt, Human
ggaggggucucuagcgaggaga

SEQ ID NO: 586560 - RNA, 22 nt, Human
ucuuuucauugagaacacacug

SEQ ID NO: 586561 - RNA, 22 nt, Human
uaugaguucaguuaucuuaagu

SEQ ID NO: 586562 - RNA, 20 nt, Human
aaaauauguauaacucuucu

SEQ ID NO: 586563 - RNA, 22 nt, Human
cagagcugggcauggugaaagg

SEQ ID NO: 586564 - RNA, 22 nt, Human
uggugacugggacuggauauga

SEQ ID NO: 586565 - RNA, 22 nt, Human
aucuaggauuugaaugcacagu

SEQ ID NO: 586566 - RNA, 23 nt, Human
ggccauggagacuuagaaugggc

SEQ ID NO: 586567 - RNA, 22 nt, Human
cagagcuuaaaacuccauggaa

SEQ ID NO: 586568 - RNA, 22 nt, Human
cagcacagugaccagacccacu

SEQ ID NO: 586569 - RNA, 22 nt, Human
accaccucaucaagcuggauug

SEQ ID NO: 586570 - RNA, 20 nt, Human
uucuuaaagaccucacuuug

SEQ ID NO: 586571 - RNA, 22 nt, Human
ggugucucagcugcuggcaggg

SEQ ID NO: 586572 - RNA, 22 nt, Human
cagcagagcauuugguaggagg

SEQ ID NO: 586573 - RNA, 22 nt, Human
cuagggcuccaaagcugagaag

SEQ ID NO: 586574 - RNA, 22 nt, Human
agagugggccucugagucccag

SEQ ID NO: 586575 - RNA, 22 nt, Human
agagaagggguaaagaguccug

SEQ ID NO: 586576 - RNA, 22 nt, Human
agagcagcacguuguccccaca

SEQ ID NO: 586577 - RNA, 22 nt, Human
guuggcucauuuuauagacagc

SEQ ID NO: 586578 - RNA, 22 nt, Human
cacugagagaugugucacagca

SEQ ID NO: 586579 - RNA, 22 nt, Human
cccucgcucuaggcagcccugu

SEQ ID NO: 586580 - RNA, 22 nt, Human
auaauguuuuuguauaagcaug

SEQ ID NO: 586581 - RNA, 22 nt, Human
gaagccccaaacccucgccauc

SEQ ID NO: 586582 - RNA, 22 nt, Human
agguggagugugcagggagagc

SEQ ID NO: 586583 - RNA, 22 nt, Human
gucccaggcagagucaggaggg

SEQ ID NO: 586584 - RNA, 22 nt, Human
uggaaugagcuggcuaauaacc

SEQ ID NO: 586585 - RNA, 22 nt, Human
ggugugggaacuacagguuuuu

SEQ ID NO: 586586 - RNA, 22 nt, Human
auccagggauaaaaguaagguu

SEQ ID NO: 586587 - RNA, 20 nt, Human
ugagugcuccauucugccca

SEQ ID NO: 586588 - RNA, 22 nt, Human
acagcagcagaccagcauaugu

SEQ ID NO: 586589 - RNA, 22 nt, Human
caggugggauuuugcugcuuga

SEQ ID NO: 586590 - RNA, 22 nt, Human
cucagggauggugaagcaccca

SEQ ID NO: 586591 - RNA, 22 nt, Human
aucauaaaauugcaccauuucu

SEQ ID NO: 586592 - RNA, 22 nt, Human
caaagguuguugagagugcagg

SEQ ID NO: 586593 - RNA, 22 nt, Human
agguuucugcaauguguguaca

SEQ ID NO: 586594 - RNA, 22 nt, Human
cagaaguggccucagagggagu

SEQ ID NO: 586595 - RNA, 22 nt, Human
uggagcagcacaagaaagggga

SEQ ID NO: 586596 - RNA, 22 nt, Human
uguggccucuaagcucacgaag

SEQ ID NO: 586597 - RNA, 22 nt, Human
cugcccugagucaugccagaug

SEQ ID NO: 586598 - RNA, 22 nt, Human
gaggagagagggacugucugca

SEQ ID NO: 586599 - RNA, 22 nt, Human
uuaacacuaucugucauaauua

SEQ ID NO: 586600 - RNA, 22 nt, Human
ggcucuggguucugcaaugcgu

SEQ ID NO: 586601 - RNA, 22 nt, Human
auuguauuuccagcuugaaugu

SEQ ID NO: 586602 - RNA, 23 nt, Human
uuauuuugucagaagggacuuuu

SEQ ID NO: 586603 - RNA, 22 nt, Human
ucagugaaccuucuguggcagg

SEQ ID NO: 586604 - RNA, 22 nt, Human
agccaggauuggcugagccuua

SEQ ID NO: 586605 - RNA, 21 nt, Human
aguaucauaaugaauaguucu

SEQ ID NO: 586606 - RNA, 22 nt, Human
gggggcuggaauauccaucaac

SEQ ID NO: 586607 - RNA, 22 nt, Human
acagaacaggcugagaaaaaca

SEQ ID NO: 586608 - RNA, 22 nt, Human
uauccauaguuuauagaucaag

SEQ ID NO: 586609 - RNA, 22 nt, Human
agcagagccaggucucucugua

SEQ ID NO: 586610 - RNA, 22 nt, Human
caccagagugaguggacugucg

SEQ ID NO: 586611 - RNA, 22 nt, Human
ccugccuggcugucagcagagc

SEQ ID NO: 586612 - RNA, 22 nt, Human
ugggcagaucuuugguggcuag

SEQ ID NO: 586613 - RNA, 22 nt, Human
uccugcccagagcucuccacuc

SEQ ID NO: 586614 - RNA, 22 nt, Human
gggagaugacucagugaccucg

SEQ ID NO: 586615 - RNA, 22 nt, Human
ggcaagagggcagauggagugc

SEQ ID NO: 586616 - RNA, 22 nt, Human
uaaucuuagcaaccuccagugu

SEQ ID NO: 586617 - RNA, 22 nt, Human
ggagcagagcucuucaucugca

SEQ ID NO: 586618 - RNA, 22 nt, Human
augaagauaagaccaggcugga

SEQ ID NO: 586619 - RNA, 22 nt, Human
uaaagacaugguguaggugaac

SEQ ID NO: 586620 - RNA, 22 nt, Human
ggcagcugggucacaccgaucu

SEQ ID NO: 586621 - RNA, 22 nt, Human
ccacccuggacaggccucugag

SEQ ID NO: 586622 - RNA, 22 nt, Human
ggaggggcagccauggaacucc

SEQ ID NO: 586623 - RNA, 22 nt, Human
cucccagaaaauucucagacaa

SEQ ID NO: 586624 - RNA, 22 nt, Human
cagucacauagguauacacaua

SEQ ID NO: 586625 - RNA, 22 nt, Human
ucucuuucuuuguaugucuauu

SEQ ID NO: 586626 - RNA, 22 nt, Human
cacauucagguggcauguuaga

SEQ ID NO: 586627 - RNA, 22 nt, Human
acaggaucgcccuguugcccag

SEQ ID NO: 586628 - RNA, 22 nt, Human
agugacugggcagggcagggcc

SEQ ID NO: 586629 - RNA, 22 nt, Human
gagagaaaggcuugcaggcugu

SEQ ID NO: 586630 - RNA, 22 nt, Human
uuucuacagcuggugcaacuuu

SEQ ID NO: 586631 - RNA, 22 nt, Human
auagccuugacucacagcucuu

SEQ ID NO: 586632 - RNA, 22 nt, Human
aagaauugguuuccucugucau

SEQ ID NO: 586633 - RNA, 22 nt, Human
uccagggccccccaguugcacg

SEQ ID NO: 586634 - RNA, 22 nt, Human
gcaguggcccagcuugcaggcu

SEQ ID NO: 586635 - RNA, 22 nt, Human
ucugaaggugcuagagaaagcu

SEQ ID NO: 586636 - RNA, 22 nt, Human
aggcuucagcagcccucucuug

SEQ ID NO: 586637 - RNA, 22 nt, Human
caggugcugcguggcggagcug

SEQ ID NO: 586638 - RNA, 22 nt, Human
agggagaagguuuagcugugag

SEQ ID NO: 586639 - RNA, 22 nt, Human
gaguagacauuaaauuacacug

SEQ ID NO: 586640 - RNA, 22 nt, Human
agauucuaccagagcuaguuug

SEQ ID NO: 586641 - RNA, 22 nt, Human
aggcagcaugcucugcuucuac

SEQ ID NO: 586642 - RNA, 22 nt, Human
ggaaagagaaguugggaggaau

SEQ ID NO: 586643 - RNA, 22 nt, Human
cgucccaguuccagccgcgcug

SEQ ID NO: 586644 - RNA, 22 nt, Human
cccagguguuuguggcagaggu

SEQ ID NO: 586645 - RNA, 22 nt, Human
agggaaggaaaagcugucgcuu

SEQ ID NO: 586646 - RNA, 22 nt, Human
cuccaggacagauucagggcca

SEQ ID NO: 586647 - RNA, 22 nt, Human
caggcagcugcgacaagagagc

SEQ ID NO: 586648 - RNA, 20 nt, Human
guuuagcauggcagugaaag

SEQ ID NO: 586649 - RNA, 22 nt, Human
ugcugggccuuuaccuccaggg

SEQ ID NO: 586650 - RNA, 18 nt, Human
guuuacauuacugaauag

SEQ ID NO: 586651 - RNA, 22 nt, Human
auucauuuagagggauuaagca

SEQ ID NO: 586652 - RNA, 22 nt, Human
cuaagaaggaggaaaagugcca

SEQ ID NO: 586653 - RNA, 22 nt, Human
uggcucucccaauaccuuucug

SEQ ID NO: 586654 - RNA, 22 nt, Human
cagauuuaggucacuagaauuu

SEQ ID NO: 586655 - RNA, 22 nt, Human
gcccccaggcacuacaugugaa

SEQ ID NO: 586656 - RNA, 22 nt, Human
uagaaagacaugggccagcagc

SEQ ID NO: 586657 - RNA, 22 nt, Human
auuguggugucaguuauaggca

SEQ ID NO: 586658 - RNA, 22 nt, Human
aguguuucuggaaucaguguuu

SEQ ID NO: 586659 - RNA, 22 nt, Human
agcuccugggccaagcccaugc

SEQ ID NO: 586660 - RNA, 22 nt, Human
gaaagaaugagcaucaugacuu

SEQ ID NO: 586661 - RNA, 22 nt, Human
ugucugggauguuggcagccac

SEQ ID NO: 586662 - RNA, 19 nt, Human
cauaaauguacaagauaca

SEQ ID NO: 586663 - RNA, 22 nt, Human
ccuggguggcagagguugcagu

SEQ ID NO: 586664 - RNA, 22 nt, Human
ugugggaggauucagaauuggg

SEQ ID NO: 586665 - RNA, 22 nt, Human
acagggugacuuugugacagau

SEQ ID NO: 586666 - RNA, 22 nt, Human
uuuuccuuagcuucucugcgag

SEQ ID NO: 586667 - RNA, 22 nt, Human
ggugaggggcaccucugcccgg

SEQ ID NO: 586668 - RNA, 22 nt, Human
auaaugugauauuucauuuaca

SEQ ID NO: 586669 - RNA, 22 nt, Human
aagcacagggacuuuaggaaua

SEQ ID NO: 586670 - RNA, 20 nt, Human
agcugggcaauuaugacuau

SEQ ID NO: 586671 - RNA, 22 nt, Human
agagacaggguuuugccauguu

SEQ ID NO: 586672 - RNA, 21 nt, Human
acaugcauagagagauuucug

SEQ ID NO: 586673 - RNA, 22 nt, Human
aucacagcacaccugacaugua

SEQ ID NO: 586674 - RNA, 22 nt, Human
cugcagagguugguucuaagau

SEQ ID NO: 586675 - RNA, 22 nt, Human
aauccauuaaaaacaagcgcau

SEQ ID NO: 586676 - RNA, 22 nt, Human
ugugacaagcauuguauauugg

SEQ ID NO: 586677 - RNA, 22 nt, Human
uucugcucugacuugcaaggaa

SEQ ID NO: 586678 - RNA, 22 nt, Human
agaaguuugguccuuuucaagg

SEQ ID NO: 586679 - RNA, 22 nt, Human
uugcaucaguccucaauaaaau

SEQ ID NO: 586680 - RNA, 22 nt, Human
cccaggagguggagguugcagu

SEQ ID NO: 586681 - RNA, 22 nt, Human
gaggaagcugcguggcauuuca

SEQ ID NO: 586682 - RNA, 19 nt, Human
uccaaggcauggcccagug

SEQ ID NO: 586683 - RNA, 20 nt, Human
gcuguggcaaagcuuugugu

SEQ ID NO: 586684 - RNA, 22 nt, Human
gucuccuguccugcaggaugga

SEQ ID NO: 586685 - RNA, 22 nt, Human
aggucaccauggcaugcuccac

SEQ ID NO: 586686 - RNA, 22 nt, Human
uucaguuuuauuguacugcuau

SEQ ID NO: 586687 - RNA, 22 nt, Human
gccuuggcugaugugcgaauga

SEQ ID NO: 586688 - RNA, 22 nt, Human
auuucuuaucugaggucuacau

SEQ ID NO: 586689 - RNA, 22 nt, Human
cauuccagcucucauacucugg

SEQ ID NO: 586690 - RNA, 23 nt, Human
gugagcagcaccaugaggcuaga

SEQ ID NO: 586691 - RNA, 22 nt, Human
ggcaggcaacggaccacuaguc

SEQ ID NO: 586692 - RNA, 22 nt, Human
uggagguggcaucugacagcug

SEQ ID NO: 586693 - RNA, 22 nt, Human
cucauguaagagagcauuaguu

SEQ ID NO: 586694 - RNA, 22 nt, Human
cccaggagguggaguucacagu

SEQ ID NO: 586695 - RNA, 23 nt, Human
acugaagaugucuuaguggcccu

SEQ ID NO: 586696 - RNA, 22 nt, Human
gauaaauggcugaagaaauagu

SEQ ID NO: 586697 - RNA, 22 nt, Human
ugccaggcuguccugggccugg

SEQ ID NO: 586698 - RNA, 22 nt, Human
gggauuacagaugugagccauu

SEQ ID NO: 586699 - RNA, 22 nt, Human
agcugggagcagagccacagcc

SEQ ID NO: 586700 - RNA, 16 nt, Human
guggcagccccuucuc

SEQ ID NO: 586701 - RNA, 22 nt, Human
agaagcagaaggaagcagggcc

SEQ ID NO: 586702 - RNA, 22 nt, Human
gggcccugggauucagagcaag

SEQ ID NO: 586703 - RNA, 22 nt, Human
gcuggagaaacaggaggaggaa

SEQ ID NO: 586704 - RNA, 22 nt, Human
aaugaacauauaaagagaucuu

SEQ ID NO: 586705 - RNA, 22 nt, Human
agcccuuaguacauuucucaag

SEQ ID NO: 586706 - RNA, 22 nt, Human
auuuguuuaucgucgauuguag

SEQ ID NO: 586707 - RNA, 22 nt, Human
auggcaagcaagcugaagagau

SEQ ID NO: 586708 - RNA, 22 nt, Human
aggcugagucgggaggaucacu

SEQ ID NO: 586709 - RNA, 22 nt, Human
gggcugugugcccacuucccau

SEQ ID NO: 586710 - RNA, 22 nt, Human
augaggcagauguugcaugagg

SEQ ID NO: 586711 - RNA, 22 nt, Human
uggcuucagagucugaguucuu

SEQ ID NO: 586712 - RNA, 22 nt, Human
gagagugucuggaggaagcuaa

SEQ ID NO: 586713 - RNA, 22 nt, Human
cccagacugcagagcgggcaga

SEQ ID NO: 586714 - RNA, 22 nt, Human
auauugaacccuacagacugua

SEQ ID NO: 586715 - RNA, 22 nt, Human
cagacugggcugguggaaagcu

SEQ ID NO: 586716 - RNA, 22 nt, Human
cuggcuuuccuugucugcaucc

SEQ ID NO: 586717 - RNA, 22 nt, Human
uccugagagccuuggcuucaga

SEQ ID NO: 586718 - RNA, 22 nt, Human
aacagcuguucgcagauguagg

SEQ ID NO: 586719 - RNA, 22 nt, Human
gguggguauaguuagggccucu

SEQ ID NO: 586720 - RNA, 22 nt, Human
uaccacagcaaaugaggccaac

SEQ ID NO: 586721 - RNA, 22 nt, Human
gcugagguuucaggaguggcag

SEQ ID NO: 586722 - RNA, 22 nt, Human
uucuuguauguaugcaaaauca

SEQ ID NO: 586723 - RNA, 22 nt, Human
ucucacacuucuguguugcaca

SEQ ID NO: 586724 - RNA, 22 nt, Human
acuguauuuuggguguauuuuc

SEQ ID NO: 586725 - RNA, 22 nt, Human
caagagggaaccuaagauguau

SEQ ID NO: 586726 - RNA, 22 nt, Human
guaugucaccucuccuaagcac

SEQ ID NO: 586727 - RNA, 22 nt, Human
agcugguugcuuaaccucucug

SEQ ID NO: 586728 - RNA, 22 nt, Human
gcagagauuggugcacugauga

SEQ ID NO: 586729 - RNA, 22 nt, Human
gagucccaugaugauagccaca

SEQ ID NO: 586730 - RNA, 19 nt, Human
cguaccugacacagaacag

SEQ ID NO: 586731 - RNA, 22 nt, Human
ucccaagagcucugggauaagg

SEQ ID NO: 586732 - RNA, 22 nt, Human
acuggaaauugagaggucacug

SEQ ID NO: 586733 - RNA, 22 nt, Human
uuugcagaugagaaaacugugg

SEQ ID NO: 586734 - RNA, 22 nt, Human
ucagaccucugaccuugccaaa

SEQ ID NO: 586735 - RNA, 22 nt, Human
ggcgcaggccuuggauccuggu

SEQ ID NO: 586736 - RNA, 22 nt, Human
aguaaacauuucagauuuauuu

SEQ ID NO: 586737 - RNA, 22 nt, Human
uaaauugaaaaucuacagaaca

SEQ ID NO: 586738 - RNA, 21 nt, Human
agcacagcuuuaagccaugug

SEQ ID NO: 586739 - RNA, 22 nt, Human
acacaagugaauauuuuaagga

SEQ ID NO: 586740 - RNA, 22 nt, Human
guagcagaaucagugcuacaga

SEQ ID NO: 586741 - RNA, 22 nt, Human
guggcagccgcaggcccugugu

SEQ ID NO: 586742 - RNA, 22 nt, Human
agggcugcuuaccuggaauggc

SEQ ID NO: 586743 - RNA, 22 nt, Human
guguuuguuuggguagcuagac

SEQ ID NO: 586744 - RNA, 22 nt, Human
cuauuuucauucuuacauuguc

SEQ ID NO: 586745 - RNA, 22 nt, Human
gaaagguucuugggaguucaca

SEQ ID NO: 586746 - RNA, 22 nt, Human
aaaauucauagaacuguacgcu

SEQ ID NO: 586747 - RNA, 22 nt, Human
aaguuccugggccaaguccagg

SEQ ID NO: 586748 - RNA, 22 nt, Human
agaguguggaaauguucagagu

SEQ ID NO: 586749 - RNA, 22 nt, Human
gcccuuagggccacugucacug

SEQ ID NO: 586750 - RNA, 19 nt, Human
ggggagaacuagagacagc

SEQ ID NO: 586751 - RNA, 22 nt, Human
aaguucuagagguugauuuggu

SEQ ID NO: 586752 - RNA, 21 nt, Human
uuugccuucacgaagcauccu

SEQ ID NO: 586753 - RNA, 22 nt, Human
gggacuggaguagaggccggug

SEQ ID NO: 586754 - RNA, 22 nt, Human
guucacagguucucuuucuaag

SEQ ID NO: 586755 - RNA, 22 nt, Human
gcugaagcccacguggcuugua

SEQ ID NO: 586756 - RNA, 22 nt, Human
auguguaaaaggcauguuuuau

SEQ ID NO: 586757 - RNA, 22 nt, Human
uugcugaaguugcucagcucca

SEQ ID NO: 586758 - RNA, 22 nt, Human
gagagugagauccuccugggga

SEQ ID NO: 586759 - RNA, 21 nt, Human
uguguucuucuaggucagcua

SEQ ID NO: 586760 - RNA, 22 nt, Human
auagucuuuacugcugaauuga

SEQ ID NO: 586761 - RNA, 21 nt, Human
gcacagcaugaguguuggcau

SEQ ID NO: 586762 - RNA, 22 nt, Human
aagugcucccauauccugcccu

SEQ ID NO: 586763 - RNA, 22 nt, Human
uggcagaaguacacaagcaugc

SEQ ID NO: 586764 - RNA, 22 nt, Human
auauauaagcugaugagccaca

SEQ ID NO: 586765 - RNA, 23 nt, Human
uuauaagaagcaucacaggaaga

SEQ ID NO: 586766 - RNA, 18 nt, Human
agcuggcccuggcugccg

SEQ ID NO: 586767 - RNA, 22 nt, Human
uggguccacuucugcacugugg

SEQ ID NO: 586768 - RNA, 22 nt, Human
ccacugccuauuugcagggccc

SEQ ID NO: 586769 - RNA, 22 nt, Human
caggcagcauuuacucugauga

SEQ ID NO: 586770 - RNA, 22 nt, Human
ugccucagcugaggccgcucca

SEQ ID NO: 586771 - RNA, 22 nt, Human
uaguccauuuucacacugcuga

SEQ ID NO: 586772 - RNA, 19 nt, Human
agcacagacaagaccagca

SEQ ID NO: 586773 - RNA, 22 nt, Human
uguugacucaacacugugggca

SEQ ID NO: 586774 - RNA, 19 nt, Human
gguagaagggaaguguuuu

SEQ ID NO: 586775 - RNA, 22 nt, Human
cacgcacgcuggguggaggcgc

SEQ ID NO: 586776 - RNA, 22 nt, Human
gcccaggagguugggcugugca

SEQ ID NO: 586777 - RNA, 22 nt, Human
uggcagaaagaaccaugugcaa

SEQ ID NO: 586778 - RNA, 22 nt, Human
uucugggcccacuguagcaucc

SEQ ID NO: 586779 - RNA, 20 nt, Human
acccagcucugugcccuggg

SEQ ID NO: 586780 - RNA, 22 nt, Human
uucccuggggaaggugaccuuu

SEQ ID NO: 586781 - RNA, 22 nt, Human
agauggccccaggugcccaggg

SEQ ID NO: 586782 - RNA, 20 nt, Human
gacagcuuggggugucaccu

SEQ ID NO: 586783 - RNA, 21 nt, Human
acaaacugaaaugaguuuccu

SEQ ID NO: 586784 - RNA, 22 nt, Human
augaaaaguucgaucuagaagg

SEQ ID NO: 586785 - RNA, 22 nt, Human
uuuaauuuuccugguaggccug

SEQ ID NO: 586786 - RNA, 21 nt, Human
acagaguaguugaaacagaga

SEQ ID NO: 586787 - RNA, 20 nt, Human
uuucacaaugaacaugucuc

SEQ ID NO: 586788 - RNA, 22 nt, Human
gacccaggagugcagagagugg

SEQ ID NO: 586789 - RNA, 22 nt, Human
augaagauuucccagagacaug

SEQ ID NO: 586790 - RNA, 22 nt, Human
caggaagaggacaggcuucccc

SEQ ID NO: 586791 - RNA, 22 nt, Human
cagcagggggcagcgcagauca

SEQ ID NO: 586792 - RNA, 23 nt, Human
acuacagauacuccugcuguuug

SEQ ID NO: 586793 - RNA, 22 nt, Human
uaggagggcccugaaaauggca

SEQ ID NO: 586794 - RNA, 22 nt, Human
cuggaggggccauccacagucu

SEQ ID NO: 586795 - RNA, 22 nt, Human
uuccuucuaauauucugccugu

SEQ ID NO: 586796 - RNA, 22 nt, Human
uuucagaugcaauuaauuuuca

SEQ ID NO: 586797 - RNA, 19 nt, Human
acauuggacauggaucuug

SEQ ID NO: 586798 - RNA, 22 nt, Human
ggcucaggaugagccuucucau

SEQ ID NO: 586799 - RNA, 22 nt, Human
uuuuauuaucuuugaaugggac

SEQ ID NO: 586800 - RNA, 22 nt, Human
agccuggacagcuacggagaac

SEQ ID NO: 586801 - RNA, 22 nt, Human
acuuucaagaacuucuuuaaug

SEQ ID NO: 586802 - RNA, 22 nt, Human
uuacaagggucaguguguuugu

SEQ ID NO: 586803 - RNA, 22 nt, Human
ugaaaggaagagggcuacuccu

SEQ ID NO: 586804 - RNA, 22 nt, Human
aaggcccuucggcuuccucagc

SEQ ID NO: 586805 - RNA, 22 nt, Human
gagaggggcccaagccacauag

SEQ ID NO: 586806 - RNA, 22 nt, Human
ugcauaauggaugauuucacaa

SEQ ID NO: 586807 - RNA, 22 nt, Human
auguguauauuuauuguaguuu

SEQ ID NO: 586808 - RNA, 22 nt, Human
uaggaaacaaaguggaugaaau

SEQ ID NO: 586809 - RNA, 22 nt, Human
gcuacaggggucaguccuuugc

SEQ ID NO: 586810 - RNA, 22 nt, Human
ggcucuggcguccaauggagcg

SEQ ID NO: 586811 - RNA, 19 nt, Human
ggggagguauuguuuucau

SEQ ID NO: 586812 - RNA, 22 nt, Human
ggcuuuggggugugcagagaug

SEQ ID NO: 586813 - RNA, 22 nt, Human
aaaguugcagugaaauaaggcu

SEQ ID NO: 586814 - RNA, 22 nt, Human
uuucuuauauucugucauuguu

SEQ ID NO: 586815 - RNA, 21 nt, Human
uuugaaagcuacaucuauagc

SEQ ID NO: 586816 - RNA, 22 nt, Human
ugaaaugucuuugcaauugaaa

SEQ ID NO: 586817 - RNA, 22 nt, Human
agugaggcuaauaggcaauggu

SEQ ID NO: 586818 - RNA, 22 nt, Human
cugacaaaccacugcuccagcu

SEQ ID NO: 586819 - RNA, 22 nt, Human
cacugucacguucugaaacugu

SEQ ID NO: 586820 - RNA, 22 nt, Human
cuccuggcucgcccccagcuga

SEQ ID NO: 586821 - RNA, 22 nt, Human
cugggaggugaacagaaaaacu

SEQ ID NO: 586822 - RNA, 22 nt, Human
uagaugauagggccagaauuug

SEQ ID NO: 586823 - RNA, 22 nt, Human
gauuuauuuuuaaucagcaggg

SEQ ID NO: 586824 - RNA, 22 nt, Human
uugaaaugcucuuuggaaucua

SEQ ID NO: 586825 - RNA, 19 nt, Human
ccucugccagcccgccucu

SEQ ID NO: 586826 - RNA, 22 nt, Human
uucacaaucuggcuuagcauug

SEQ ID NO: 586827 - RNA, 22 nt, Human
gugcugaauccacucuuaggaa

SEQ ID NO: 586828 - RNA, 22 nt, Human
ucauuuauaaggaugcaauuaa

SEQ ID NO: 586829 - RNA, 22 nt, Human
uggguagagcaggcuggggcuu

SEQ ID NO: 586830 - RNA, 22 nt, Human
agacauuuggagccaacuuucc

SEQ ID NO: 586831 - RNA, 22 nt, Human
gggagccagcagggcauggagc

SEQ ID NO: 586832 - RNA, 22 nt, Human
uuucugaaaucucuuuugagga

SEQ ID NO: 586833 - RNA, 22 nt, Human
uucacauuauaaucaguucugc

SEQ ID NO: 586834 - RNA, 22 nt, Human
aaacauugcuaaauaaugcugc

SEQ ID NO: 586835 - RNA, 22 nt, Human
cagcacaggaagugggccuuca

SEQ ID NO: 586836 - RNA, 22 nt, Human
gacaugcaugaaugcaggucuc

SEQ ID NO: 586837 - RNA, 22 nt, Human
uauauaacuacuauuuugcuca

SEQ ID NO: 586838 - RNA, 22 nt, Human
ucacugcuuugagccacugagc

SEQ ID NO: 586839 - RNA, 22 nt, Human
agccagggaugcagcacaguga

SEQ ID NO: 586840 - RNA, 22 nt, Human
aaggccacacuugcuggccagc

SEQ ID NO: 586841 - RNA, 22 nt, Human
ugccuucuucucccuggcucag

SEQ ID NO: 586842 - RNA, 22 nt, Human
agcagccauagauagcaugcaa

SEQ ID NO: 586843 - RNA, 23 nt, Human
ggugguggugagucacgggcuca

SEQ ID NO: 586844 - RNA, 22 nt, Human
gucuccagaagccuagacagcc

SEQ ID NO: 586845 - RNA, 22 nt, Human
uggccucugcacugggcucccc

SEQ ID NO: 586846 - RNA, 22 nt, Human
ggugugccacuucacugagcag

SEQ ID NO: 586847 - RNA, 22 nt, Human
gacacaguuuuucucacggugg

SEQ ID NO: 586848 - RNA, 21 nt, Human
gcagcaugagaaagccccaaa

SEQ ID NO: 586849 - RNA, 22 nt, Human
ccuuagcagggagucuguccag

SEQ ID NO: 586850 - RNA, 17 nt, Human
caggucccagggucucu

SEQ ID NO: 586851 - RNA, 22 nt, Human
caguuuuaugaaugcuuauuag

SEQ ID NO: 586852 - RNA, 20 nt, Human
ucugaagaaagacagggacu

SEQ ID NO: 586853 - RNA, 22 nt, Human
uggggcaagaagugcccugaag

SEQ ID NO: 586854 - RNA, 22 nt, Human
gaagaugggaaugaugaguggg

SEQ ID NO: 586855 - RNA, 22 nt, Human
cucaggaaaggccaugcaaggg

SEQ ID NO: 586856 - RNA, 22 nt, Human
uucaguuccuuaucauaggguu

SEQ ID NO: 586857 - RNA, 19 nt, Human
ccccaaaguuuagauguug

SEQ ID NO: 586858 - RNA, 22 nt, Human
ucagagcuuaucucuugcugga

SEQ ID NO: 586859 - RNA, 17 nt, Human
ggcucugggugucacau

SEQ ID NO: 586860 - RNA, 22 nt, Human
ucucugugcaggaugcugaguu

SEQ ID NO: 586861 - RNA, 22 nt, Human
uaagauaugguaggaaguuugg

SEQ ID NO: 586862 - RNA, 22 nt, Human
cuuccuugcggccccugccuag

SEQ ID NO: 586863 - RNA, 22 nt, Human
cucucucaguguaauacaggau

SEQ ID NO: 586864 - RNA, 22 nt, Human
ugcagaguaaaagcagaugcua

SEQ ID NO: 586865 - RNA, 22 nt, Human
caggagcagaggguggucagca

SEQ ID NO: 586866 - RNA, 22 nt, Human
cagaaguggcaucauucaagag

SEQ ID NO: 586867 - RNA, 18 nt, Human
ggaaggugcuggagugca

SEQ ID NO: 586868 - RNA, 22 nt, Human
uaucuuagggaauuaacuaaaa

SEQ ID NO: 586869 - RNA, 22 nt, Human
aaacagucugaugccaucugcc

SEQ ID NO: 586870 - RNA, 22 nt, Human
cugggugguucuaacuguugau

SEQ ID NO: 586871 - RNA, 22 nt, Human
ccucuggguaucuguggaagua

SEQ ID NO: 586872 - RNA, 22 nt, Human
cagauggcugccuucuugcugu

SEQ ID NO: 586873 - RNA, 22 nt, Human
augggggaaaguacgagcaugg

SEQ ID NO: 586874 - RNA, 22 nt, Human
aggagcugagggagcgcccuug

SEQ ID NO: 586875 - RNA, 23 nt, Human
gcaguuaguccacuuugcagaga

SEQ ID NO: 586876 - RNA, 22 nt, Human
uggaugaguucaaugaggcaga

SEQ ID NO: 586877 - RNA, 22 nt, Human
ggcaccagggaaggaaggcugg

SEQ ID NO: 586878 - RNA, 22 nt, Human
accaggcuuaauccuuugcuau

SEQ ID NO: 586879 - RNA, 22 nt, Human
ccaggucugucuucuuagcuca

SEQ ID NO: 586880 - RNA, 22 nt, Human
ggcaguggugggaggcucgcuc

SEQ ID NO: 586881 - RNA, 22 nt, Human
gcaaggcugagcacauuugcau

SEQ ID NO: 586882 - RNA, 22 nt, Human
acaguacugaguacugaguugg

SEQ ID NO: 586883 - RNA, 22 nt, Human
agaagcauuauuuaauuuuacu

SEQ ID NO: 586884 - RNA, 22 nt, Human
aauuuuaaucaguggugcugag

SEQ ID NO: 586885 - RNA, 22 nt, Human
ugugcaaucauauuuuaaaaug

SEQ ID NO: 586886 - RNA, 22 nt, Human
uguaacauauagcauguucuug

SEQ ID NO: 586887 - RNA, 18 nt, Human
ugaacacaguacaauucc

SEQ ID NO: 586888 - RNA, 22 nt, Human
aggaggcugcaacccugaggcc

SEQ ID NO: 586889 - RNA, 22 nt, Human
aggcuuguggauuggagcgagu

SEQ ID NO: 586890 - RNA, 22 nt, Human
auuuggaaacaauuauauucuu

SEQ ID NO: 586891 - RNA, 22 nt, Human
caggaccuggaaugcuugugaa

SEQ ID NO: 586892 - RNA, 22 nt, Human
caggcugcggucggcucugguc

SEQ ID NO: 586893 - RNA, 22 nt, Human
uaguggaggggaugcaaagcuu

SEQ ID NO: 586894 - RNA, 22 nt, Human
ccagguguagcacugcucacag

SEQ ID NO: 586895 - RNA, 19 nt, Human
uggagggguuugaaugugg

SEQ ID NO: 586896 - RNA, 22 nt, Human
agaggccagcuagcgggccauc

SEQ ID NO: 586897 - RNA, 22 nt, Human
aagcuucauauaugugugaguc

SEQ ID NO: 586898 - RNA, 22 nt, Human
agggccugacacccuugccagc

SEQ ID NO: 586899 - RNA, 22 nt, Human
uagagaaacagaaccaacaggg

SEQ ID NO: 586900 - RNA, 22 nt, Human
acugaggcuuacaaagguaaag

SEQ ID NO: 586901 - RNA, 22 nt, Human
ugggucagacagccagugggcc

SEQ ID NO: 586902 - RNA, 22 nt, Human
gaaauacuguaaaguuauuauu

SEQ ID NO: 586903 - RNA, 22 nt, Human
ugaagggguucagcaugggggu

SEQ ID NO: 586904 - RNA, 22 nt, Human
ccagugcccagcugcccaggca

SEQ ID NO: 586905 - RNA, 20 nt, Human
ucccucagcacuucuaccuc

SEQ ID NO: 586906 - RNA, 22 nt, Human
uaauugaacuaacaugcaaaca

SEQ ID NO: 586907 - RNA, 22 nt, Human
uaaugcuuaauuuucacaagcc

SEQ ID NO: 586908 - RNA, 22 nt, Human
ucauuuuucacacagggucacc

SEQ ID NO: 586909 - RNA, 22 nt, Human
ccugcucagagcgucuugugug

SEQ ID NO: 586910 - RNA, 17 nt, Human
gcagccagugcagcagg

SEQ ID NO: 586911 - RNA, 22 nt, Human
gucagaucuuuggggaugcugu

SEQ ID NO: 586912 - RNA, 22 nt, Human
ccagggcucugcuucugccaug

SEQ ID NO: 586913 - RNA, 22 nt, Human
ugagaagcugcugacuuagccu

SEQ ID NO: 586914 - RNA, 22 nt, Human
uggcagcuagauaguguguuua

SEQ ID NO: 586915 - RNA, 22 nt, Human
aaauaaagguccacuuuagggc

SEQ ID NO: 586916 - RNA, 20 nt, Human
ggaagcuguggguccccagg

SEQ ID NO: 586917 - RNA, 22 nt, Human
uccuggagaauccugccaccug

SEQ ID NO: 586918 - RNA, 22 nt, Human
acuguacacagugguguacugu

SEQ ID NO: 586919 - RNA, 22 nt, Human
uuggccagguccauuucuccau

SEQ ID NO: 586920 - RNA, 22 nt, Human
cagcuauugguccacagguaug

SEQ ID NO: 586921 - RNA, 22 nt, Human
gguuugguuuuggccaucuucc

SEQ ID NO: 586922 - RNA, 22 nt, Human
uggcccugcugggucagagcug

SEQ ID NO: 586923 - RNA, 22 nt, Human
gcacagaggaugaggcagcucu

SEQ ID NO: 586924 - RNA, 22 nt, Human
cagagcuggcucugcauguaca

SEQ ID NO: 586925 - RNA, 22 nt, Human
cugugugugucugcagcauacu

SEQ ID NO: 586926 - RNA, 18 nt, Human
uggguggcuagggaguuu

SEQ ID NO: 586927 - RNA, 18 nt, Human
cuuucaguaauuucagcc

SEQ ID NO: 586928 - RNA, 22 nt, Human
uccaacuuucuccuccggcuug

SEQ ID NO: 586929 - RNA, 21 nt, Human
acagcagcaaucugucuuucc

SEQ ID NO: 586930 - RNA, 22 nt, Human
gugagugucagucaaagguuuu

SEQ ID NO: 586931 - RNA, 22 nt, Human
agguggggcccaccaauuugca

SEQ ID NO: 586932 - RNA, 22 nt, Human
aaagcaaugggucuaagguaaa

SEQ ID NO: 586933 - RNA, 18 nt, Human
acauuucuaggugaaagc

SEQ ID NO: 586934 - RNA, 22 nt, Human
gcagcugccgugagcucacgcc

SEQ ID NO: 586935 - RNA, 22 nt, Human
gugggcaggccccaaagcaggg

SEQ ID NO: 586936 - RNA, 22 nt, Human
uccugaauugaacucaguuaau

SEQ ID NO: 586937 - RNA, 22 nt, Human
uuuacagagaauguacauaaag

SEQ ID NO: 586938 - RNA, 22 nt, Human
aacaaaccuucccuauacgucu

SEQ ID NO: 586939 - RNA, 22 nt, Human
aguguuuaaacugaagugauga

SEQ ID NO: 586940 - RNA, 22 nt, Human
uuaauugagccagaaaguaucu

SEQ ID NO: 586941 - RNA, 22 nt, Human
uuguaacacuuuucuauuaaua

SEQ ID NO: 586942 - RNA, 22 nt, Human
cugagccuuauucaccagcccu

SEQ ID NO: 586943 - RNA, 22 nt, Human
gaggacagagccgccuggcaag

SEQ ID NO: 586944 - RNA, 22 nt, Human
cuguuuuucagaagguaaggga

SEQ ID NO: 586945 - RNA, 18 nt, Human
ggagcccagaggacagga

SEQ ID NO: 586946 - RNA, 22 nt, Human
acaugacagugacuuuauaaga

SEQ ID NO: 586947 - RNA, 22 nt, Human
agagggugggcacgugauggau

SEQ ID NO: 586948 - RNA, 22 nt, Human
aguggcucuccaagaagucaca

SEQ ID NO: 586949 - RNA, 23 nt, Human
aacaggaugugcuucaucuuuug

SEQ ID NO: 586950 - RNA, 22 nt, Human
gcuuccuguccaggccccacau

SEQ ID NO: 586951 - RNA, 22 nt, Human
agguaaaugucagagccuuuaa

SEQ ID NO: 586952 - RNA, 22 nt, Human
augauucagcaauuuuauaucu

SEQ ID NO: 586953 - RNA, 22 nt, Human
gcugggcuccaggccaggguga

SEQ ID NO: 586954 - RNA, 22 nt, Human
uguacuaaugcauuuaacuaac

SEQ ID NO: 586955 - RNA, 22 nt, Human
uugggacagaaaaggagaagau

SEQ ID NO: 586956 - RNA, 22 nt, Human
auggaaagggaagcaaggaaca

SEQ ID NO: 586957 - RNA, 23 nt, Human
uccucccaaauuucagccucauu

SEQ ID NO: 586958 - RNA, 22 nt, Human
guggagcaaucagagggucagu

SEQ ID NO: 586959 - RNA, 17 nt, Human
aguuuauuuagccuucu

SEQ ID NO: 586960 - RNA, 18 nt, Human
ugagagaauguucaugcu

SEQ ID NO: 586961 - RNA, 22 nt, Human
auacacgugccauguuggugug

SEQ ID NO: 586962 - RNA, 22 nt, Human
ucugugucugcagaaguucagc

SEQ ID NO: 586963 - RNA, 22 nt, Human
augcaguacagauaauucuaca

SEQ ID NO: 586964 - RNA, 22 nt, Human
ggcagcuguuggcucucuagga

SEQ ID NO: 586965 - RNA, 22 nt, Human
cucaggaaggaagcagggagcc

SEQ ID NO: 586966 - RNA, 21 nt, Human
acauuauaauucauauuccac

SEQ ID NO: 586967 - RNA, 22 nt, Human
ccuucagaaugaaauucuaaug

SEQ ID NO: 586968 - RNA, 22 nt, Human
ucaugucaguuucuucuauaaa

SEQ ID NO: 586969 - RNA, 22 nt, Human
ugugggcucccccucacucugu

SEQ ID NO: 586970 - RNA, 22 nt, Human
ucccucagaugagcuccuagca

SEQ ID NO: 586971 - RNA, 22 nt, Human
uacuguguggugagcugucucc

SEQ ID NO: 586972 - RNA, 22 nt, Human
acaccaaaguagaauuaaugua

SEQ ID NO: 586973 - RNA, 22 nt, Human
aagucauucuauuucucuaugu

SEQ ID NO: 586974 - RNA, 22 nt, Human
uggggauggaugaaucuuugcu

SEQ ID NO: 586975 - RNA, 22 nt, Human
agccuggagguaaugaggaaac

SEQ ID NO: 586976 - RNA, 22 nt, Human
ugcuuuaagagauuguuaguac

SEQ ID NO: 586977 - RNA, 22 nt, Human
cuccaggacucaggccccuggg

SEQ ID NO: 586978 - RNA, 22 nt, Human
gcaccagcugccuucugugccc

SEQ ID NO: 586979 - RNA, 22 nt, Human
uaccuuuugcuuauuaugacac

SEQ ID NO: 586980 - RNA, 22 nt, Human
gugccuguuucuuuugaauuca

SEQ ID NO: 586981 - RNA, 22 nt, Human
aacaaaucuuaaaguaauucaa

SEQ ID NO: 586982 - RNA, 22 nt, Human
cucuuucucauugucagcagaa

SEQ ID NO: 586983 - RNA, 22 nt, Human
ggugaggggcgccucugcccag

SEQ ID NO: 586984 - RNA, 22 nt, Human
aauuccagcugauugacuuucc

SEQ ID NO: 586985 - RNA, 22 nt, Human
acauuuuuuagagucccacauu

SEQ ID NO: 586986 - RNA, 22 nt, Human
ggagagggggcucccugcuugg

SEQ ID NO: 586987 - RNA, 22 nt, Human
uggcugagaaguucugguggga

SEQ ID NO: 586988 - RNA, 20 nt, Human
ugagacccgcugacaaguuc

SEQ ID NO: 586989 - RNA, 20 nt, Human
aggccccaggaaacucucag

SEQ ID NO: 586990 - RNA, 21 nt, Human
ucaggaagagccaguucaugc

SEQ ID NO: 586991 - RNA, 19 nt, Human
ccucacccugcagaggagg

SEQ ID NO: 586992 - RNA, 22 nt, Human
agaaauaugcugauuagaugaa

SEQ ID NO: 586993 - RNA, 22 nt, Human
ggaagaaagguggacaacaggu

SEQ ID NO: 586994 - RNA, 22 nt, Human
aguagaaaguugcaggaggaau

SEQ ID NO: 586995 - RNA, 22 nt, Human
ucaggaaagaagaugcucagug

SEQ ID NO: 586996 - RNA, 22 nt, Human
cuggccaacuugcuuguuggca

SEQ ID NO: 586997 - RNA, 22 nt, Human
cugggugacagagugagauggu

SEQ ID NO: 586998 - RNA, 22 nt, Human
cagcaccccuccuggcuaugaa

SEQ ID NO: 586999 - RNA, 22 nt, Human
uggccagcccuucagccaugcc

SEQ ID NO: 587000 - RNA, 22 nt, Human
ugggcagagaucuggaucaaac

SEQ ID NO: 587001 - RNA, 22 nt, Human
aauaauguugacgauagucuua

SEQ ID NO: 587002 - RNA, 22 nt, Human
ggguccagauggugagaguuaa

SEQ ID NO: 587003 - RNA, 22 nt, Human
uuucaucuuauuugucuacauc

SEQ ID NO: 587004 - RNA, 22 nt, Human
auagucuucagcacuuugauca

SEQ ID NO: 587005 - RNA, 22 nt, Human
ucuggaguguuucuaauuacug

SEQ ID NO: 587006 - RNA, 20 nt, Human
cugccaugauugauagagug

SEQ ID NO: 587007 - RNA, 22 nt, Human
gcucugggccgggcaccagccu

SEQ ID NO: 587008 - RNA, 22 nt, Human
cuugccugccacuacagcugaa

SEQ ID NO: 587009 - RNA, 22 nt, Human
uacaugcuucuauaugugaagu

SEQ ID NO: 587010 - RNA, 22 nt, Human
aggccaggaccauuagcccaga

SEQ ID NO: 587011 - RNA, 22 nt, Human
ucauggagacuuugagccuguu

SEQ ID NO: 587012 - RNA, 20 nt, Human
gaagauggguagaggcacag

SEQ ID NO: 587013 - RNA, 23 nt, Human
gagaaaccucgguaagcaggagg

SEQ ID NO: 587014 - RNA, 22 nt, Human
aagcugcccaagacugaagcau

SEQ ID NO: 587015 - RNA, 22 nt, Human
gcuggcagcauuagacccuggg

SEQ ID NO: 587016 - RNA, 20 nt, Human
augguucaggccagcugucu

SEQ ID NO: 587017 - RNA, 21 nt, Human
uuacuuuugcagcaaccuaau

SEQ ID NO: 587018 - RNA, 22 nt, Human
uuuaaucuucaaaauagucuua

SEQ ID NO: 587019 - RNA, 22 nt, Human
ugggugaggaugaugaggcagc

SEQ ID NO: 587020 - RNA, 22 nt, Human
auaccauggcaguuuauucacg

SEQ ID NO: 587021 - RNA, 21 nt, Human
ugacauuuccaauauaaagcc

SEQ ID NO: 587022 - RNA, 22 nt, Human
aaucuguuuccauguuuuauug

SEQ ID NO: 587023 - RNA, 22 nt, Human
uucuccuuccugguuuucaggc

SEQ ID NO: 587024 - RNA, 22 nt, Human
ccugccugucccucaguccaca

SEQ ID NO: 587025 - RNA, 22 nt, Human
aaagccaggcagccaagccagu

SEQ ID NO: 587026 - RNA, 22 nt, Human
caucucugagaccucagcuggg

SEQ ID NO: 587027 - RNA, 22 nt, Human
gcuuuucuagcuagaacauccg

SEQ ID NO: 587028 - RNA, 22 nt, Human
uacaugaaccuuuaugugugau

SEQ ID NO: 587029 - RNA, 22 nt, Human
acuuccugacuucuggguugga

SEQ ID NO: 587030 - RNA, 22 nt, Human
ugggacaggaggccucuggaga

SEQ ID NO: 587031 - RNA, 22 nt, Human
ggcaagagguccaagaggucuc

SEQ ID NO: 587032 - RNA, 20 nt, Human
ggauucugacugugaagagg

SEQ ID NO: 587033 - RNA, 22 nt, Human
aagagauguugaaguuuauuag

SEQ ID NO: 587034 - RNA, 22 nt, Human
ugaguaggauaggguggggcuu

SEQ ID NO: 587035 - RNA, 22 nt, Human
acauucacuauguccaaacucu

SEQ ID NO: 587036 - RNA, 22 nt, Human
ucuaagaaagauuaagaaauuu

SEQ ID NO: 587037 - RNA, 22 nt, Human
gggcuggagccuggcggugguu

SEQ ID NO: 587038 - RNA, 22 nt, Human
uucuucaauuuuccauauacug

SEQ ID NO: 587039 - RNA, 22 nt, Human
gccucugcggagcuguacauca

SEQ ID NO: 587040 - RNA, 22 nt, Human
acaguccuaagauaauugucuc

SEQ ID NO: 587041 - RNA, 22 nt, Human
ugcugcauagcagcuccugaaa

SEQ ID NO: 587042 - RNA, 22 nt, Human
uaauguuaguauguaaucuuau

SEQ ID NO: 587043 - RNA, 22 nt, Human
uuggcucaccuggagccuguug

SEQ ID NO: 587044 - RNA, 22 nt, Human
gccaggagaaaaggcgaaugau

SEQ ID NO: 587045 - RNA, 22 nt, Human
agcaguggaccucagugcuauu

SEQ ID NO: 587046 - RNA, 22 nt, Human
accugcccacuucccaugacau

SEQ ID NO: 587047 - RNA, 22 nt, Human
ucuggcucucaacaaauauuua

SEQ ID NO: 587048 - RNA, 22 nt, Human
gcaaaugaguuguaacauaaaa

SEQ ID NO: 587049 - RNA, 22 nt, Human
gcaggugguggggcuaugaucu

SEQ ID NO: 587050 - RNA, 22 nt, Human
agccccuccaguggcauaaaau

SEQ ID NO: 587051 - RNA, 22 nt, Human
gaacacugggguaucauugagc

SEQ ID NO: 587052 - RNA, 22 nt, Human
cugccccauggucccugguggg

SEQ ID NO: 587053 - RNA, 22 nt, Human
aaaagagugacugauaaguaua

SEQ ID NO: 587054 - RNA, 22 nt, Human
ucucaucugcgagcucugccag

SEQ ID NO: 587055 - RNA, 22 nt, Human
cugaugcucuggauguagucaa

SEQ ID NO: 587056 - RNA, 22 nt, Human
cuggguguuggguacugaccgu

SEQ ID NO: 587057 - RNA, 19 nt, Human
gggcuuggggcugaagccu

SEQ ID NO: 587058 - RNA, 21 nt, Human
uggagcugccacuugagcugc

SEQ ID NO: 587059 - RNA, 22 nt, Human
agaagacagagucuacauucua

SEQ ID NO: 587060 - RNA, 22 nt, Human
guuuacauuaaguauuagcauc

SEQ ID NO: 587061 - RNA, 22 nt, Human
ucaugcaaacucuaguccuuua

SEQ ID NO: 587062 - RNA, 22 nt, Human
uccuuaaaugugaucuagauuu

SEQ ID NO: 587063 - RNA, 22 nt, Human
uuccucaggcugcuuucacaua

SEQ ID NO: 587064 - RNA, 22 nt, Human
uggcuugucauguaucugaggc

SEQ ID NO: 587065 - RNA, 20 nt, Human
agaguuuggggucauuuugg

SEQ ID NO: 587066 - RNA, 22 nt, Human
caagaugacaaggcuggaggcu

SEQ ID NO: 587067 - RNA, 23 nt, Human
uguagcuuuauacaagaucuguu

SEQ ID NO: 587068 - RNA, 22 nt, Human
cucacagagccucugugucuuc

SEQ ID NO: 587069 - RNA, 22 nt, Human
aagagcugauuaagucaugagg

SEQ ID NO: 587070 - RNA, 22 nt, Human
uuagagagaaccaucaggaucu

SEQ ID NO: 587071 - RNA, 22 nt, Human
acuuccagguuccacccaagac

SEQ ID NO: 587072 - RNA, 22 nt, Human
guugcugaaagcccugacuggc

SEQ ID NO: 587073 - RNA, 21 nt, Human
aaugucauugaauggugagac

SEQ ID NO: 587074 - RNA, 22 nt, Human
ugcucuggaauaguccuaggca

SEQ ID NO: 587075 - RNA, 19 nt, Human
agacuuuuguaaguugaga

SEQ ID NO: 587076 - RNA, 22 nt, Human
uucuuacaaguaugacguagca

SEQ ID NO: 587077 - RNA, 21 nt, Human
gcugcucgagauccagugcuu

SEQ ID NO: 587078 - RNA, 22 nt, Human
uacacagacucuucaauucaga

SEQ ID NO: 587079 - RNA, 21 nt, Human
uccaaaggagacugagugugu

SEQ ID NO: 587080 - RNA, 22 nt, Human
gagccagugaucagacagggag

SEQ ID NO: 587081 - RNA, 22 nt, Human
agaaguuuugggaaauacugau

SEQ ID NO: 587082 - RNA, 22 nt, Human
guggccagaggucccauguguc

SEQ ID NO: 587083 - RNA, 22 nt, Human
gaguaggguuuccagguuagag

SEQ ID NO: 587084 - RNA, 22 nt, Human
cugccucuguugggcauggucu

SEQ ID NO: 587085 - RNA, 22 nt, Human
cugcacagcuggccagggagag

SEQ ID NO: 587086 - RNA, 22 nt, Human
ugcccugggaacacagaugcca

SEQ ID NO: 587087 - RNA, 22 nt, Human
ggcagggcccugauuccugggg

SEQ ID NO: 587088 - RNA, 23 nt, Human
uuguuuuuagagguggcaugaga

SEQ ID NO: 587089 - RNA, 22 nt, Human
uugccuuuaaguauaacugcug

SEQ ID NO: 587090 - RNA, 22 nt, Human
uaaaacuuaacuauccagauua

SEQ ID NO: 587091 - RNA, 22 nt, Human
ccucagucauuggccuacacuu

SEQ ID NO: 587092 - RNA, 22 nt, Human
ucagccugcuccaagugcugcc

SEQ ID NO: 587093 - RNA, 18 nt, Human
ucuccuuccaaaucuuca

SEQ ID NO: 587094 - RNA, 22 nt, Human
aacuuaaacccacucauguaga

SEQ ID NO: 587095 - RNA, 22 nt, Human
gauaaaauauguggccuuuagu

SEQ ID NO: 587096 - RNA, 22 nt, Human
uguuuucaucacagaauguaac

SEQ ID NO: 587097 - RNA, 22 nt, Human
uggaagcaucacuucuugccug

SEQ ID NO: 587098 - RNA, 22 nt, Human
ugagcuggucuugaguguagcu

SEQ ID NO: 587099 - RNA, 22 nt, Human
uugaaaggugcugugugcugau

SEQ ID NO: 587100 - RNA, 22 nt, Human
aggugggaacccagcagggccc

SEQ ID NO: 587101 - RNA, 22 nt, Human
ugccagagaagacccagucacu

SEQ ID NO: 587102 - RNA, 22 nt, Human
gcaguguuucaaaucaaaggca

SEQ ID NO: 587103 - RNA, 22 nt, Human
cagccacuugugaugcugggga

SEQ ID NO: 587104 - RNA, 22 nt, Human
ccaccugugcuugguacuccau

SEQ ID NO: 587105 - RNA, 22 nt, Human
gcaguguugagugguggcugaa

SEQ ID NO: 587106 - RNA, 23 nt, Human
aacuuuuagaguuuaacaguguu

SEQ ID NO: 587107 - RNA, 22 nt, Human
uaugaaaauuuagcugaagcau

SEQ ID NO: 587108 - RNA, 19 nt, Human
uggccagguacugucugcu

SEQ ID NO: 587109 - RNA, 22 nt, Human
uguuuauuuucaggauggauug

SEQ ID NO: 587110 - RNA, 22 nt, Human
ucacuuauugcucaucucaugc

SEQ ID NO: 587111 - RNA, 22 nt, Human
gaguccuuaauacacuggugga

SEQ ID NO: 587112 - RNA, 21 nt, Human
cugcucugacagugaggccag

SEQ ID NO: 587113 - RNA, 17 nt, Human
ucacaucacacaagcaa

SEQ ID NO: 587114 - RNA, 22 nt, Human
ugugacguuccugcuggcgacc

SEQ ID NO: 587115 - RNA, 21 nt, Human
cagagcagcguucugcugugg

SEQ ID NO: 587116 - RNA, 22 nt, Human
uaauagucauuguauaccuugg

SEQ ID NO: 587117 - RNA, 22 nt, Human
cagccacugaacuccuggcuau

SEQ ID NO: 587118 - RNA, 22 nt, Human
gcaggagucacugacuuggucc

SEQ ID NO: 587119 - RNA, 22 nt, Human
gaaguuuagaguguuguaauuu

SEQ ID NO: 587120 - RNA, 22 nt, Human
caggacagguguucuagaucag

SEQ ID NO: 587121 - RNA, 22 nt, Human
cugggguggauggguccaaguu

SEQ ID NO: 587122 - RNA, 22 nt, Human
ucacuggggccaugugagggac

SEQ ID NO: 587123 - RNA, 22 nt, Human
ccagucugaggccuggugaggg

SEQ ID NO: 587124 - RNA, 22 nt, Human
ugcagaguugcuuugauagucc

SEQ ID NO: 587125 - RNA, 18 nt, Human
uguuuauucuccugacag

SEQ ID NO: 587126 - RNA, 22 nt, Human
cucccaggguagggagagacua

SEQ ID NO: 587127 - RNA, 22 nt, Human
ugugggaggaauuagaauggga

SEQ ID NO: 587128 - RNA, 21 nt, Human
agcuuccugcagugggagguc

SEQ ID NO: 587129 - RNA, 22 nt, Human
ucuggggagcagcccuggugag

SEQ ID NO: 587130 - RNA, 22 nt, Human
acacacaacucauuguguaaua

SEQ ID NO: 587131 - RNA, 22 nt, Human
ugagaauagcagacugguaacu

SEQ ID NO: 587132 - RNA, 22 nt, Human
acauuucuccuacuuguuauuu

SEQ ID NO: 587133 - RNA, 22 nt, Human
cucuuuaguuugaaauccacau

SEQ ID NO: 587134 - RNA, 22 nt, Human
uuuaagacuuagauuuauuggg

SEQ ID NO: 587135 - RNA, 22 nt, Human
ccuuccaggugcaggcaagccu

SEQ ID NO: 587136 - RNA, 22 nt, Human
uucuaguucccacauaguugcc

SEQ ID NO: 587137 - RNA, 22 nt, Human
aaaguuuuagcuguccaguucc

SEQ ID NO: 587138 - RNA, 22 nt, Human
uugcagaaaacaguuuucuugu

SEQ ID NO: 587139 - RNA, 22 nt, Human
uucaaugucuauguacauuuua

SEQ ID NO: 587140 - RNA, 22 nt, Human
gaaggcuggcuuucugagagca

SEQ ID NO: 587141 - RNA, 22 nt, Human
cuuccuugcugucugcuccagg

SEQ ID NO: 587142 - RNA, 22 nt, Human
aacuguaagaaauaaaauucug

SEQ ID NO: 587143 - RNA, 21 nt, Human
uccugcugcuccugucguguu

SEQ ID NO: 587144 - RNA, 22 nt, Human
cugcaaaauuguucuuugcucc

SEQ ID NO: 587145 - RNA, 22 nt, Human
gcacacauucuagccuuuugug

SEQ ID NO: 587146 - RNA, 22 nt, Human
uuguuuucacagcuuugcccgg

SEQ ID NO: 587147 - RNA, 22 nt, Human
aaggcugauuagacugauagcu

SEQ ID NO: 587148 - RNA, 22 nt, Human
gauauguaugaggaguauguau

SEQ ID NO: 587149 - RNA, 22 nt, Human
cugaggugagcuucccugggcu

SEQ ID NO: 587150 - RNA, 22 nt, Human
ucuccagguagauaugucagga

SEQ ID NO: 587151 - RNA, 20 nt, Human
gagcuucaacucagcaaaca

SEQ ID NO: 587152 - RNA, 22 nt, Human
aagacagagggaagcaaugaug

SEQ ID NO: 587153 - RNA, 22 nt, Human
aacuguauacaauugucagaca

SEQ ID NO: 587154 - RNA, 22 nt, Human
gcccaaggucccauggcagcac

SEQ ID NO: 587155 - RNA, 20 nt, Human
agccuggggaauuccacccc

SEQ ID NO: 587156 - RNA, 22 nt, Human
ucucagaaucaggaccuacuuc

SEQ ID NO: 587157 - RNA, 23 nt, Human
ugcauuccucacagggcagaaga

SEQ ID NO: 587158 - RNA, 22 nt, Human
ucugagccagacaagacagcca

SEQ ID NO: 587159 - RNA, 22 nt, Human
guuacauggagcaaugaugcau

SEQ ID NO: 587160 - RNA, 22 nt, Human
ggcagcugauuagcaucaagga

SEQ ID NO: 587161 - RNA, 22 nt, Human
cuucuucuucccccuucagggg

SEQ ID NO: 587162 - RNA, 22 nt, Human
ugacauuugagcauacauguaa

SEQ ID NO: 587163 - RNA, 18 nt, Human
aggaaagacgaagagggc

SEQ ID NO: 587164 - RNA, 22 nt, Human
cugccacuuucacccagugcuc

SEQ ID NO: 587165 - RNA, 22 nt, Human
agaggccagaaggcgcaccccg

SEQ ID NO: 587166 - RNA, 22 nt, Human
uuaggaguccagaugucuuggg

SEQ ID NO: 587167 - RNA, 22 nt, Human
augaguugaagcuacaagaggc

SEQ ID NO: 587168 - RNA, 20 nt, Human
accugggguugccugugcuc

SEQ ID NO: 587169 - RNA, 22 nt, Human
ugaggccugggcacauaaccuc

SEQ ID NO: 587170 - RNA, 22 nt, Human
uucucuggacagugaagagagg

SEQ ID NO: 587171 - RNA, 22 nt, Human
acugggccuugccauggcagcc

SEQ ID NO: 587172 - RNA, 22 nt, Human
acugagagaacgggcugcuccc

SEQ ID NO: 587173 - RNA, 22 nt, Human
uagcuuugccugaaguaaucag

SEQ ID NO: 587174 - RNA, 22 nt, Human
ucucuggccccauggcugagcu

SEQ ID NO: 587175 - RNA, 19 nt, Human
gugggccaggcagaaggcu

SEQ ID NO: 587176 - RNA, 22 nt, Human
uucuaccucaguuucccacuua

SEQ ID NO: 587177 - RNA, 22 nt, Human
cuugcaguguggccuugaagag

SEQ ID NO: 587178 - RNA, 22 nt, Human
ccaggagaaugggauuacccua

SEQ ID NO: 587179 - RNA, 17 nt, Human
aggugcuggagcaucag

SEQ ID NO: 587180 - RNA, 22 nt, Human
ugugaauggacaauuaaaucua

SEQ ID NO: 587181 - RNA, 22 nt, Human
ucugggaaauggcuacuuguca

SEQ ID NO: 587182 - RNA, 22 nt, Human
gccuguccacuaaacagccaag

SEQ ID NO: 587183 - RNA, 22 nt, Human
gcaagauuguguggcugaagua

SEQ ID NO: 587184 - RNA, 18 nt, Human
caguggugcugggaugug

SEQ ID NO: 587185 - RNA, 22 nt, Human
aaaucagaggcaacaacuacuu

SEQ ID NO: 587186 - RNA, 22 nt, Human
uacaucauuuuggagaugagca

SEQ ID NO: 587187 - RNA, 22 nt, Human
augccaggaacaaacaguggug

SEQ ID NO: 587188 - RNA, 22 nt, Human
aucacaaucuucaaaucgauuc

SEQ ID NO: 587189 - RNA, 22 nt, Human
agaagcaaggucugucaguaua

SEQ ID NO: 587190 - RNA, 22 nt, Human
guggggcaguggccugggagca

SEQ ID NO: 587191 - RNA, 22 nt, Human
agggccccaguaagauuacaug

SEQ ID NO: 587192 - RNA, 22 nt, Human
ggcucuucuacuucagaugggg

SEQ ID NO: 587193 - RNA, 17 nt, Human
acaagcaguggccaugg

SEQ ID NO: 587194 - RNA, 22 nt, Human
ugcugacuccuggcugugacac

SEQ ID NO: 587195 - RNA, 22 nt, Human
gagauggcuugcucucacgugg

SEQ ID NO: 587196 - RNA, 22 nt, Human
gagagcugcauucucagacaca

SEQ ID NO: 587197 - RNA, 22 nt, Human
cagucccagacauaguaaggga

SEQ ID NO: 587198 - RNA, 21 nt, Human
aaacugaagagacaggaacuu

SEQ ID NO: 587199 - RNA, 22 nt, Human
gaguguaguucauuccguccua

SEQ ID NO: 587200 - RNA, 22 nt, Human
caaauaauuacuauccucacuu

SEQ ID NO: 587201 - RNA, 22 nt, Human
uuuugugagcugagaaauguau

SEQ ID NO: 587202 - RNA, 22 nt, Human
ggccuuccuggcggcucagggu

SEQ ID NO: 587203 - RNA, 19 nt, Human
agcauggaagcuggugcca

SEQ ID NO: 587204 - RNA, 22 nt, Human
cagcauuguaagaaugaagacc

SEQ ID NO: 587205 - RNA, 22 nt, Human
gagucugaugucccccaggcca

SEQ ID NO: 587206 - RNA, 22 nt, Human
cuucagcuguggucuccaaggc

SEQ ID NO: 587207 - RNA, 22 nt, Human
cuggggcccgagccuugggcca

SEQ ID NO: 587208 - RNA, 22 nt, Human
ccauuuuugacagaaggccuaa

SEQ ID NO: 587209 - RNA, 18 nt, Human
ccagguggugacagagau

SEQ ID NO: 587210 - RNA, 22 nt, Human
caagcagucagccugaagacug

SEQ ID NO: 587211 - RNA, 22 nt, Human
aggcucauucuugccucugagc

SEQ ID NO: 587212 - RNA, 22 nt, Human
agaugauuaugauagcacuguu

SEQ ID NO: 587213 - RNA, 22 nt, Human
uaaaggaggaguuaaugagacu

SEQ ID NO: 587214 - RNA, 19 nt, Human
agcccccagacagcaggcc

SEQ ID NO: 587215 - RNA, 22 nt, Human
ucucaguuuccucauauguaaa

SEQ ID NO: 587216 - RNA, 22 nt, Human
cugcccugaccugccucagagu

SEQ ID NO: 587217 - RNA, 22 nt, Human
guggcagggugcucaucaugca

SEQ ID NO: 587218 - RNA, 21 nt, Human
aaacugaggcuucaagcagug

SEQ ID NO: 587219 - RNA, 22 nt, Human
gugcaggagccagggguaggaa

SEQ ID NO: 587220 - RNA, 22 nt, Human
gcccaguaguucaagguugcag

SEQ ID NO: 587221 - RNA, 22 nt, Human
gcauguguggaggagaugugcu

SEQ ID NO: 587222 - RNA, 22 nt, Human
ccugacaggagaagcgcagcau

SEQ ID NO: 587223 - RNA, 22 nt, Human
cagccccuuccuggcaucugga

SEQ ID NO: 587224 - RNA, 21 nt, Human
cgcagagcgaacuugcggcgc

SEQ ID NO: 587225 - RNA, 22 nt, Human
acugggcaccaucaugagauag

SEQ ID NO: 587226 - RNA, 22 nt, Human
caggcugauaggguccaaaguu

SEQ ID NO: 587227 - RNA, 22 nt, Human
gcccccagaccucagugggcug

SEQ ID NO: 587228 - RNA, 22 nt, Human
ucuugaagucuuaugguuuaaa

SEQ ID NO: 587229 - RNA, 22 nt, Human
gagcugaggcucaggcuggcgu

SEQ ID NO: 587230 - RNA, 22 nt, Human
auuucuacaguacacaugcauu

SEQ ID NO: 587231 - RNA, 20 nt, Human
aagauucauuguaauuaggg

SEQ ID NO: 587232 - RNA, 22 nt, Human
agcaaugcuaccgggugauucg

SEQ ID NO: 587233 - RNA, 22 nt, Human
uggggcucuccacagugucuca

SEQ ID NO: 587234 - RNA, 22 nt, Human
augaaacaugagaaauggagag

SEQ ID NO: 587235 - RNA, 22 nt, Human
uggcacuggcgcaggauggcgg

SEQ ID NO: 587236 - RNA, 22 nt, Human
uagccacaugcagacuuucaug

SEQ ID NO: 587237 - RNA, 22 nt, Human
caugcacacacaguucuaauua

SEQ ID NO: 587238 - RNA, 22 nt, Human
uggaauguuugacuuauucagu

SEQ ID NO: 587239 - RNA, 22 nt, Human
agucccagccuaggcugugcug

SEQ ID NO: 587240 - RNA, 22 nt, Human
ggucagccuuggauuugguagc

SEQ ID NO: 587241 - RNA, 22 nt, Human
agaaaagggcaggagggauaca

SEQ ID NO: 587242 - RNA, 23 nt, Human
cauaaaauauuaguaugguagca

SEQ ID NO: 587243 - RNA, 22 nt, Human
cagccaggccuggugaccaaag

SEQ ID NO: 587244 - RNA, 22 nt, Human
auacagugaauacuuacagugu

SEQ ID NO: 587245 - RNA, 22 nt, Human
ggaggcacuucccgucucagcc

SEQ ID NO: 587246 - RNA, 22 nt, Human
aaaguguugggauuacaggugu

SEQ ID NO: 587247 - RNA, 22 nt, Human
agcugguauuuguuagggaguu

SEQ ID NO: 587248 - RNA, 22 nt, Human
gggccagugaacaaugagggaa

SEQ ID NO: 587249 - RNA, 22 nt, Human
uaccaguugauguuuuaaauag

SEQ ID NO: 587250 - RNA, 22 nt, Human
gcugaaggucucuggagagguc

SEQ ID NO: 587251 - RNA, 22 nt, Human
cagcucuuauuuucucuccuaa

SEQ ID NO: 587252 - RNA, 22 nt, Human
ugggccugaaggagcugcgccc

SEQ ID NO: 587253 - RNA, 22 nt, Human
agcauaaguugguacagccacu

SEQ ID NO: 587254 - RNA, 22 nt, Human
uaguuacagcaggcaggauaua

SEQ ID NO: 587255 - RNA, 22 nt, Human
gggcucagcugggcgugcuggu

SEQ ID NO: 587256 - RNA, 19 nt, Human
agggccugcagcucaagcu

SEQ ID NO: 587257 - RNA, 21 nt, Human
ucugggcagcccaguccugag

SEQ ID NO: 587258 - RNA, 22 nt, Human
uggaagagguggaaguggcuuc

SEQ ID NO: 587259 - RNA, 22 nt, Human
caguuuauuuccaagaugacaa

SEQ ID NO: 587260 - RNA, 22 nt, Human
gagucacauuaauuuaauuuua

SEQ ID NO: 587261 - RNA, 22 nt, Human
ggccuuggugccauggccaguu

SEQ ID NO: 587262 - RNA, 22 nt, Human
aucuacagcagugccagguagc

SEQ ID NO: 587263 - RNA, 22 nt, Human
aaguucuacagcuucgcaggca

SEQ ID NO: 587264 - RNA, 22 nt, Human
aguuuugaaaugaaauguaguu

SEQ ID NO: 587265 - RNA, 22 nt, Human
gagaaaccuguaaggaaggaag

SEQ ID NO: 587266 - RNA, 22 nt, Human
caggugccgggaaugcagcaau

SEQ ID NO: 587267 - RNA, 22 nt, Human
ggagggugcauuuuacccugug

SEQ ID NO: 587268 - RNA, 22 nt, Human
cagcuggaugggagaccauguu

SEQ ID NO: 587269 - RNA, 23 nt, Human
ggcugcucuuuucaugcuguuuc

SEQ ID NO: 587270 - RNA, 22 nt, Human
uuccucuuccaucuucccaggg

SEQ ID NO: 587271 - RNA, 22 nt, Human
ucuuggaacccuaugugauuuc

SEQ ID NO: 587272 - RNA, 22 nt, Human
aaucacaucacugagaaugagg

SEQ ID NO: 587273 - RNA, 22 nt, Human
uaugauuuguagacauuugauu

SEQ ID NO: 587274 - RNA, 21 nt, Human
ccagagguucugggccucccu

SEQ ID NO: 587275 - RNA, 22 nt, Human
uguguguguuucugcucauaca

SEQ ID NO: 587276 - RNA, 22 nt, Human
ccuggugcaccaaguaagggug

SEQ ID NO: 587277 - RNA, 19 nt, Human
ggaagagaggaaaggugga

SEQ ID NO: 587278 - RNA, 22 nt, Human
agaaaucuauuauuucagaguu

SEQ ID NO: 587279 - RNA, 22 nt, Human
aggcugaggcagguggaucacu

SEQ ID NO: 587280 - RNA, 22 nt, Human
ccugaaaaucaagguaguuugg

SEQ ID NO: 587281 - RNA, 22 nt, Human
uggcugugauuugcacgagaug

SEQ ID NO: 587282 - RNA, 22 nt, Human
cagaaucagugacacauguaua

SEQ ID NO: 587283 - RNA, 22 nt, Human
uugcuuuuaauuaaucauugcu

SEQ ID NO: 587284 - RNA, 21 nt, Human
guuuuucagcccugaggugag

SEQ ID NO: 587285 - RNA, 22 nt, Human
gcagagccugugucugagcaaa

SEQ ID NO: 587286 - RNA, 22 nt, Human
gccugcagggugaugggcugcc

SEQ ID NO: 587287 - RNA, 22 nt, Human
auuagcuuaucccauuucugaa

SEQ ID NO: 587288 - RNA, 22 nt, Human
gcagggacgcagcacucuccgu

SEQ ID NO: 587289 - RNA, 18 nt, Human
ggccagccccaggccagc

SEQ ID NO: 587290 - RNA, 22 nt, Human
gcagggcugauggcuucccuca

SEQ ID NO: 587291 - RNA, 22 nt, Human
gaguggggaaagccaggacaga

SEQ ID NO: 587292 - RNA, 22 nt, Human
ugcagccuagacauucugguca

SEQ ID NO: 587293 - RNA, 22 nt, Human
agaaucugcuuuuuaacaagau

SEQ ID NO: 587294 - RNA, 22 nt, Human
ggagagccugugcagccggguu

SEQ ID NO: 587295 - RNA, 22 nt, Human
uguauuucgcuagguacucccu

SEQ ID NO: 587296 - RNA, 22 nt, Human
uagcaccuggucaauucaguca

SEQ ID NO: 587297 - RNA, 22 nt, Human
gugauaaaauagaaacaguggu

SEQ ID NO: 587298 - RNA, 22 nt, Human
ucucccaacauguggaggucag

SEQ ID NO: 587299 - RNA, 23 nt, Human
aggagaagagauuuccacaugca

SEQ ID NO: 587300 - RNA, 22 nt, Human
ccagagcuucggggcggcugua

SEQ ID NO: 587301 - RNA, 20 nt, Human
ccucucugaagaggucaucu

SEQ ID NO: 587302 - RNA, 22 nt, Human
augucuauauagucaauaauca

SEQ ID NO: 587303 - RNA, 22 nt, Human
agauacaaaagauaagauuuag

SEQ ID NO: 587304 - RNA, 22 nt, Human
augcugguugcuaagcagcgau

SEQ ID NO: 587305 - RNA, 22 nt, Human
ugugacuuugucaaguugcaua

SEQ ID NO: 587306 - RNA, 22 nt, Human
cacagcuuugcuuuccuuaaua

SEQ ID NO: 587307 - RNA, 22 nt, Human
guacccagugauuccuucuuca

SEQ ID NO: 587308 - RNA, 22 nt, Human
gaagcaauguguuuucaacauu

SEQ ID NO: 587309 - RNA, 22 nt, Human
gccuuuuuuguugcucugucac

SEQ ID NO: 587310 - RNA, 22 nt, Human
gcugccuguugaagggucugug

SEQ ID NO: 587311 - RNA, 23 nt, Human
ugaauuuggaacucagagaauua

SEQ ID NO: 587312 - RNA, 22 nt, Human
ugaguagcggcuauguguaacu

SEQ ID NO: 587313 - RNA, 22 nt, Human
augcugaaaauuggauuugaau

SEQ ID NO: 587314 - RNA, 22 nt, Human
gcagccuccgcacugcgagucc

SEQ ID NO: 587315 - RNA, 22 nt, Human
gugucucuuccuuucaaguggg

SEQ ID NO: 587316 - RNA, 21 nt, Human
cccuucugcuccagcuuugcc

SEQ ID NO: 587317 - RNA, 22 nt, Human
ugaggcaggaauggggaaaagu

SEQ ID NO: 587318 - RNA, 22 nt, Human
ggaggucauagcugugcaggua

SEQ ID NO: 587319 - RNA, 22 nt, Human
ucuccuggcucuaaaaggcugu

SEQ ID NO: 587320 - RNA, 22 nt, Human
cugggucuggaggccaagggug

SEQ ID NO: 587321 - RNA, 22 nt, Human
ggaggugguggcagugacaauu

SEQ ID NO: 587322 - RNA, 22 nt, Human
cacugcaguaacucuaggacug

SEQ ID NO: 587323 - RNA, 22 nt, Human
cuguggugggcccugggcuuca

SEQ ID NO: 587324 - RNA, 22 nt, Human
guccucuggugaaagcauuccc

SEQ ID NO: 587325 - RNA, 22 nt, Human
ggggucggggcauagccacuua

SEQ ID NO: 587326 - RNA, 23 nt, Human
gcugccucuguuggucuucaguu

SEQ ID NO: 587327 - RNA, 22 nt, Human
auuuguaacacgugacagguug

SEQ ID NO: 587328 - RNA, 22 nt, Human
uaggaaaagucuagauugauga

SEQ ID NO: 587329 - RNA, 22 nt, Human
ggaagccaggcugggggaucug

SEQ ID NO: 587330 - RNA, 22 nt, Human
aauuuaaucaaguucugcucug

SEQ ID NO: 587331 - RNA, 22 nt, Human
caagcaauauuuuagaaaggua

SEQ ID NO: 587332 - RNA, 22 nt, Human
caguggucccugagguugcugg

SEQ ID NO: 587333 - RNA, 22 nt, Human
uggagcugucacucagaaccaa

SEQ ID NO: 587334 - RNA, 19 nt, Human
uacaggcaguuucuacaau

SEQ ID NO: 587335 - RNA, 21 nt, Human
ugcucacagaugugcucagug

SEQ ID NO: 587336 - RNA, 22 nt, Human
uccauggagauggaugacugua

SEQ ID NO: 587337 - RNA, 22 nt, Human
caauuucaugccauguauugcu

SEQ ID NO: 587338 - RNA, 22 nt, Human
auaacagugaccucucagcacc

SEQ ID NO: 587339 - RNA, 22 nt, Human
aacauauuuggcugauauuccc

SEQ ID NO: 587340 - RNA, 22 nt, Human
aggcgcugugcuuggggcugga

SEQ ID NO: 587341 - RNA, 22 nt, Human
gcagcuuuguggagaggcccau

SEQ ID NO: 587342 - RNA, 22 nt, Human
agcauuagguguguuucagagg

SEQ ID NO: 587343 - RNA, 22 nt, Human
acaggacaacucagcagccagc

SEQ ID NO: 587344 - RNA, 22 nt, Human
ugggcugcuguuacaggggcug

SEQ ID NO: 587345 - RNA, 22 nt, Human
ucaugcagcaauaugcauuagg

SEQ ID NO: 587346 - RNA, 19 nt, Human
gcacacauacacccuuugg

SEQ ID NO: 587347 - RNA, 22 nt, Human
uugggaaguuuaaugacagacu

SEQ ID NO: 587348 - RNA, 22 nt, Human
acucacucuuucaauugaaaga

SEQ ID NO: 587349 - RNA, 22 nt, Human
agcuuccugucuucugcacaaa

SEQ ID NO: 587350 - RNA, 23 nt, Human
ucauaaauauuagcacaguagga

SEQ ID NO: 587351 - RNA, 22 nt, Human
auuaagacuauugauauuuaca

SEQ ID NO: 587352 - RNA, 22 nt, Human
acacacucaauugcauaagcac

SEQ ID NO: 587353 - RNA, 19 nt, Human
auuagcaugcuugaggaug

SEQ ID NO: 587354 - RNA, 22 nt, Human
aagaacaugcuauaauuaucuu

SEQ ID NO: 587355 - RNA, 22 nt, Human
gaggcuggugguuaguuccauu

SEQ ID NO: 587356 - RNA, 22 nt, Human
cugcagugaaaucaggaagcaa

SEQ ID NO: 587357 - RNA, 22 nt, Human
guuaauuuaguagaguccagau

SEQ ID NO: 587358 - RNA, 22 nt, Human
uaaggcagaaauaugagcaggg

SEQ ID NO: 587359 - RNA, 22 nt, Human
gcaugggaggacagucugggcu

SEQ ID NO: 587360 - RNA, 22 nt, Human
aggucuggaaacagcagggaga

SEQ ID NO: 587361 - RNA, 22 nt, Human
cugggugaguugaugaaggaga

SEQ ID NO: 587362 - RNA, 22 nt, Human
agacagcacuuuuguauggggg

SEQ ID NO: 587363 - RNA, 22 nt, Human
uacacagagacucaaaagggca

SEQ ID NO: 587364 - RNA, 22 nt, Human
agauuucucuuucccuggcuga

SEQ ID NO: 587365 - RNA, 22 nt, Human
acugaugaaaacuaauaaauua

SEQ ID NO: 587366 - RNA, 22 nt, Human
gcaggagcucguuuccaggcug

SEQ ID NO: 587367 - RNA, 22 nt, Human
caucaguguucacuauuccuuc

SEQ ID NO: 587368 - RNA, 22 nt, Human
cagaggcuuugcccuggaaacc

SEQ ID NO: 587369 - RNA, 22 nt, Human
ucccagcauuaaugccugucag

SEQ ID NO: 587370 - RNA, 22 nt, Human
uggcagagaugaagaguuguuu

SEQ ID NO: 587371 - RNA, 19 nt, Human
ggagaggcuggagggaugc

SEQ ID NO: 587372 - RNA, 20 nt, Human
gaaauucucguauuaguuua

SEQ ID NO: 587373 - RNA, 19 nt, Human
gccaggagggcucuggcug

SEQ ID NO: 587374 - RNA, 18 nt, Human
uucuaaauucuguuuuua

SEQ ID NO: 587375 - RNA, 22 nt, Human
caucaaaguugguauauuugca

SEQ ID NO: 587376 - RNA, 22 nt, Human
ucauuuaauaauuuuugaguag

SEQ ID NO: 587377 - RNA, 18 nt, Human
auuuacccagcaacgugg

SEQ ID NO: 587378 - RNA, 22 nt, Human
ucuaugucuccaccuucgcaga

SEQ ID NO: 587379 - RNA, 22 nt, Human
uucuccgcuaaguucucugcag

SEQ ID NO: 587380 - RNA, 22 nt, Human
ugagccaugggacuccaaggga

SEQ ID NO: 587381 - RNA, 22 nt, Human
cugccuggguucaaguccuguu

SEQ ID NO: 587382 - RNA, 22 nt, Human
uuuauuauccaguguugucaug

SEQ ID NO: 587383 - RNA, 22 nt, Human
gggugggaacaggaugccagga

SEQ ID NO: 587384 - RNA, 22 nt, Human
gccaccagugggggccugggca

SEQ ID NO: 587385 - RNA, 22 nt, Human
cagguaggggagagcuccaaca

SEQ ID NO: 587386 - RNA, 22 nt, Human
ugccaaaauggccaaaagcuag

SEQ ID NO: 587387 - RNA, 22 nt, Human
ucucugaagagucagacauaac

SEQ ID NO: 587388 - RNA, 22 nt, Human
aaagucaucuaggagcagauuu

SEQ ID NO: 587389 - RNA, 22 nt, Human
aaagucaaaaugcucuccuguc

SEQ ID NO: 587390 - RNA, 20 nt, Human
uuguuagaggaaugccauag

SEQ ID NO: 587391 - RNA, 22 nt, Human
acauuuuuacugggcaucugca

SEQ ID NO: 587392 - RNA, 22 nt, Human
ugucccaguuuaucugggacug

SEQ ID NO: 587393 - RNA, 19 nt, Human
cugcugaauuagcucugga

SEQ ID NO: 587394 - RNA, 21 nt, Human
gauaaaaugggccuugguccu

SEQ ID NO: 587395 - RNA, 22 nt, Human
uggcaguugugagguucauauu

SEQ ID NO: 587396 - RNA, 22 nt, Human
uacaucucaucugugcucuccg

SEQ ID NO: 587397 - RNA, 22 nt, Human
uuccugguuggauucugauuaa

SEQ ID NO: 587398 - RNA, 22 nt, Human
aaggcuggagaugguuggaaug

SEQ ID NO: 587399 - RNA, 19 nt, Human
ggcagucucaagcagcaca

SEQ ID NO: 587400 - RNA, 22 nt, Human
aaaaugacauuccagugauauu

SEQ ID NO: 587401 - RNA, 23 nt, Human
ucauuucauccagccuugagagu

SEQ ID NO: 587402 - RNA, 22 nt, Human
acuuucuuauccaugaucucac

SEQ ID NO: 587403 - RNA, 22 nt, Human
uugagcuguaaggugggaugug

SEQ ID NO: 587404 - RNA, 22 nt, Human
aggccagaagccagaaaugcuu

SEQ ID NO: 587405 - RNA, 22 nt, Human
uccuguccugaggcuccaggcc

SEQ ID NO: 587406 - RNA, 22 nt, Human
uuuaaagugguccauuucagaa

SEQ ID NO: 587407 - RNA, 22 nt, Human
ucccagccugacagugcaucaa

SEQ ID NO: 587408 - RNA, 20 nt, Human
aggaaggaaguuugcaugga

SEQ ID NO: 587409 - RNA, 22 nt, Human
ucccaggacuuccaguuggagg

SEQ ID NO: 587410 - RNA, 22 nt, Human
ugccugccaggugcuucuucau

SEQ ID NO: 587411 - RNA, 22 nt, Human
ugaacccaggagguugcaguga

SEQ ID NO: 587412 - RNA, 22 nt, Human
ucccaggugaugcugaggccac

SEQ ID NO: 587413 - RNA, 22 nt, Human
cacaaugcagcauguaaaugca

SEQ ID NO: 587414 - RNA, 22 nt, Human
auucuauagacagaaggucaau

SEQ ID NO: 587415 - RNA, 22 nt, Human
aauuuuauuagaaggcaagggg

SEQ ID NO: 587416 - RNA, 22 nt, Human
cacauguaguaagcaggcaaug

SEQ ID NO: 587417 - RNA, 22 nt, Human
uuuguccuugaaucaauucaca

SEQ ID NO: 587418 - RNA, 22 nt, Human
uggcuuccaaauuaucccuaga

SEQ ID NO: 587419 - RNA, 19 nt, Human
ugcucacucucagucccuc

SEQ ID NO: 587420 - RNA, 20 nt, Human
gugcaauggcucagucucag

SEQ ID NO: 587421 - RNA, 22 nt, Human
caggcagcugaggacuuugcua

SEQ ID NO: 587422 - RNA, 20 nt, Human
acguggccaccaguggcuua

SEQ ID NO: 587423 - RNA, 22 nt, Human
ucugugccaagcuuauaucugu

SEQ ID NO: 587424 - RNA, 22 nt, Human
agucuuuauacagaaauauaug

SEQ ID NO: 587425 - RNA, 22 nt, Human
aagguguucagguuuucccauu

SEQ ID NO: 587426 - RNA, 22 nt, Human
aagcugccacacggugaguacu

SEQ ID NO: 587427 - RNA, 22 nt, Human
uauagaagagacaugugcauag

SEQ ID NO: 587428 - RNA, 22 nt, Human
uuuuucugucucuuacauugca

SEQ ID NO: 587429 - RNA, 22 nt, Human
ucugcaaaaguguucauaaaga

SEQ ID NO: 587430 - RNA, 22 nt, Human
uagggcuguggucaguccucua

SEQ ID NO: 587431 - RNA, 21 nt, Human
cccaggcugaauuaaaaauau

SEQ ID NO: 587432 - RNA, 22 nt, Human
acaguguagugugaugucaaaa

SEQ ID NO: 587433 - RNA, 22 nt, Human
gguagggaugggauuuggaagu

SEQ ID NO: 587434 - RNA, 22 nt, Human
uauguacaguccuuaacuuaaa

SEQ ID NO: 587435 - RNA, 22 nt, Human
cccagggcuguagaauguccaa

SEQ ID NO: 587436 - RNA, 22 nt, Human
aaagagcuggcauuuauagucu

SEQ ID NO: 587437 - RNA, 22 nt, Human
acuggaguccagacccaagagg

SEQ ID NO: 587438 - RNA, 22 nt, Human
uuaaagaggcagguuaaauaau

SEQ ID NO: 587439 - RNA, 22 nt, Human
cuguuaaaauguggucuuaaaa

SEQ ID NO: 587440 - RNA, 23 nt, Human
cugaagagccaacaaaaagcuug

SEQ ID NO: 587441 - RNA, 22 nt, Human
aggaaagcucccaguagggcuc

SEQ ID NO: 587442 - RNA, 22 nt, Human
gugagguccauguuaauggguu

SEQ ID NO: 587443 - RNA, 22 nt, Human
cugggcuacguguugacagcau

SEQ ID NO: 587444 - RNA, 22 nt, Human
gugcaaaaguaaaugugguuuu

SEQ ID NO: 587445 - RNA, 21 nt, Human
ggaaaauucagagugcaauuu

SEQ ID NO: 587446 - RNA, 22 nt, Human
uaacacagugucuaccauuauu

SEQ ID NO: 587447 - RNA, 22 nt, Human
aauuuuaagcauaugacugguu

SEQ ID NO: 587448 - RNA, 22 nt, Human
cuagaaaaauacuuuauuguga

SEQ ID NO: 587449 - RNA, 21 nt, Human
cugucccucuuugcuucccuc

SEQ ID NO: 587450 - RNA, 22 nt, Human
agaaauacuaggaauauucaua

SEQ ID NO: 587451 - RNA, 22 nt, Human
ucacaugcuguguguggagauc

SEQ ID NO: 587452 - RNA, 22 nt, Human
gugugcagaagacacaagacau

SEQ ID NO: 587453 - RNA, 22 nt, Human
ucuuucuugguauucugagcua

SEQ ID NO: 587454 - RNA, 17 nt, Human
ugguggcuggagucagg

SEQ ID NO: 587455 - RNA, 22 nt, Human
agggccaggaucacagccaaga

SEQ ID NO: 587456 - RNA, 19 nt, Human
cacuucacauggugaaagc

SEQ ID NO: 587457 - RNA, 22 nt, Human
gaggcuccucauucaguaugcu

SEQ ID NO: 587458 - RNA, 22 nt, Human
augcagaugggugccaaagucu

SEQ ID NO: 587459 - RNA, 22 nt, Human
cugccucuggccucaggcccag

SEQ ID NO: 587460 - RNA, 22 nt, Human
uagcuaguagauggggaagcug

SEQ ID NO: 587461 - RNA, 23 nt, Human
aaauggccaagguuaaaaauaca

SEQ ID NO: 587462 - RNA, 22 nt, Human
ucagucuuuugcccugaggagu

SEQ ID NO: 587463 - RNA, 22 nt, Human
ccagcuggaacggcagcccagc

SEQ ID NO: 587464 - RNA, 20 nt, Human
aggcaagguagaugucugcu

SEQ ID NO: 587465 - RNA, 22 nt, Human
ucccagaaguccagccaugggc

SEQ ID NO: 587466 - RNA, 22 nt, Human
gcagaggguccugugccagcag

SEQ ID NO: 587467 - RNA, 22 nt, Human
ggugccaggcuguagucagggu

SEQ ID NO: 587468 - RNA, 22 nt, Human
ucugauguugcuucugcagaac

SEQ ID NO: 587469 - RNA, 22 nt, Human
auaguaaauuaucguggagaga

SEQ ID NO: 587470 - RNA, 22 nt, Human
gaccagcugguccuguccuggg

SEQ ID NO: 587471 - RNA, 22 nt, Human
uuuccucagaagugucuacuau

SEQ ID NO: 587472 - RNA, 22 nt, Human
aggaagcucauuuugacauauc

SEQ ID NO: 587473 - RNA, 21 nt, Human
ugaauaaagcugcugucgaua

SEQ ID NO: 587474 - RNA, 22 nt, Human
gcagcucugauugguucagccu

SEQ ID NO: 587475 - RNA, 22 nt, Human
auguguauccaucugucuauuu

SEQ ID NO: 587476 - RNA, 22 nt, Human
aaucacauagccaucucuuuga

SEQ ID NO: 587477 - RNA, 22 nt, Human
acagggcauuuccucuaugugu

SEQ ID NO: 587478 - RNA, 22 nt, Human
uuaaauuauuucuagugaggug

SEQ ID NO: 587479 - RNA, 21 nt, Human
ugcuucucuagaucaacuacu

SEQ ID NO: 587480 - RNA, 22 nt, Human
guucuucagaggggaaagaacc

SEQ ID NO: 587481 - RNA, 22 nt, Human
aaacacagauuucuuuguccca

SEQ ID NO: 587482 - RNA, 22 nt, Human
aaagguaugauacugugacaug

SEQ ID NO: 587483 - RNA, 22 nt, Human
uggaagcacuuggguuuuguug

SEQ ID NO: 587484 - RNA, 22 nt, Human
auauguuucaguauucaaguca

SEQ ID NO: 587485 - RNA, 22 nt, Human
auuuccaaaaccacuuauugcc

SEQ ID NO: 587486 - RNA, 22 nt, Human
ucaagucuugaugagacaaacc

SEQ ID NO: 587487 - RNA, 22 nt, Human
uuuaagacccacagggaaguug

SEQ ID NO: 587488 - RNA, 22 nt, Human
uugagucucugccaaaacacaa

SEQ ID NO: 587489 - RNA, 22 nt, Human
uggggcaguggcuuuucacccu

SEQ ID NO: 587490 - RNA, 22 nt, Human
ucuuuacaucacaauuguaugg

SEQ ID NO: 587491 - RNA, 22 nt, Human
ugggccucaucuucaaugaguc

SEQ ID NO: 587492 - RNA, 22 nt, Human
cuggagugauacucagaaugug

SEQ ID NO: 587493 - RNA, 22 nt, Human
uugaaaacagcguagauucaca

SEQ ID NO: 587494 - RNA, 22 nt, Human
gagugcucgggccucugccugc

SEQ ID NO: 587495 - RNA, 22 nt, Human
ucauugaguugcacuuuuacua

SEQ ID NO: 587496 - RNA, 22 nt, Human
acuuagcauuauguaauuacua

SEQ ID NO: 587497 - RNA, 22 nt, Human
aggcacugcagauuacaggcgc

SEQ ID NO: 587498 - RNA, 22 nt, Human
cuuaaacugggcauucagagaa

SEQ ID NO: 587499 - RNA, 22 nt, Human
cagcuguccaaacacauuaacu

SEQ ID NO: 587500 - RNA, 22 nt, Human
aguuauugaguaucuauaaugu

SEQ ID NO: 587501 - RNA, 22 nt, Human
aauacagaggggucacaauuca

SEQ ID NO: 587502 - RNA, 22 nt, Human
uggugggggaggcugucuagca

SEQ ID NO: 587503 - RNA, 23 nt, Human
agccucagccgguggcagaagug

SEQ ID NO: 587504 - RNA, 22 nt, Human
gagggucuuaccuaagcagggu

SEQ ID NO: 587505 - RNA, 22 nt, Human
acagagacucaugaaagaugac

SEQ ID NO: 587506 - RNA, 22 nt, Human
uuagagauuugucugauaguag

SEQ ID NO: 587507 - RNA, 22 nt, Human
gaacaaacugggucccaaugau

SEQ ID NO: 587508 - RNA, 18 nt, Human
gggcacuggggacuggag

SEQ ID NO: 587509 - RNA, 22 nt, Human
agccuggugauaucagugguuu

SEQ ID NO: 587510 - RNA, 22 nt, Human
guggccagaaucuugaggccuu

SEQ ID NO: 587511 - RNA, 22 nt, Human
auacaaauuauaggccccaucc

SEQ ID NO: 587512 - RNA, 22 nt, Human
ggcuucccaggcgguccccaca

SEQ ID NO: 587513 - RNA, 22 nt, Human
uaagagcugaggcauugggaca

SEQ ID NO: 587514 - RNA, 21 nt, Human
auucagaguaauucaucuuua

SEQ ID NO: 587515 - RNA, 23 nt, Human
agccccucauaucugcuuucucu

SEQ ID NO: 587516 - RNA, 22 nt, Human
gcccagccagagcugugugaug

SEQ ID NO: 587517 - RNA, 22 nt, Human
uugaggccccauggaugagaac

SEQ ID NO: 587518 - RNA, 22 nt, Human
uauuccuaauuugcagggcaug

SEQ ID NO: 587519 - RNA, 18 nt, Human
gucagaggauggggaaau

SEQ ID NO: 587520 - RNA, 22 nt, Human
ugcuuaaaaacaguaugguagu

SEQ ID NO: 587521 - RNA, 22 nt, Human
aauaacaggguugauuugcaau

SEQ ID NO: 587522 - RNA, 22 nt, Human
agccacagcuccuugguggaga

SEQ ID NO: 587523 - RNA, 22 nt, Human
acugaacauccauaagauuuuu

SEQ ID NO: 587524 - RNA, 22 nt, Human
acucagcuuccuacagcuagaa

SEQ ID NO: 587525 - RNA, 23 nt, Human
aaacuacaacgccaggcacugag

SEQ ID NO: 587526 - RNA, 22 nt, Human
cagggugccuguccucagcaaa

SEQ ID NO: 587527 - RNA, 22 nt, Human
ggcugcuggcauugagguaggu

SEQ ID NO: 587528 - RNA, 22 nt, Human
cugggacuugcagagcaggagg

SEQ ID NO: 587529 - RNA, 22 nt, Human
aacccaggaguuggaggcugug

SEQ ID NO: 587530 - RNA, 22 nt, Human
agaucacugguuacuuaaugaa

SEQ ID NO: 587531 - RNA, 22 nt, Human
uuucaagaagcaaauuaaaguc

SEQ ID NO: 587532 - RNA, 16 nt, Human
gcuggaguccuggagc

SEQ ID NO: 587533 - RNA, 22 nt, Human
ugagacagccucugcacucaug

SEQ ID NO: 587534 - RNA, 22 nt, Human
gccacugcacuccagcccaggc

SEQ ID NO: 587535 - RNA, 22 nt, Human
aauaagacacacaacugucaag

SEQ ID NO: 587536 - RNA, 22 nt, Human
ccagccaguauauuccaaagcc

SEQ ID NO: 587537 - RNA, 22 nt, Human
agagucuuccaggcagccugag

SEQ ID NO: 587538 - RNA, 22 nt, Human
uuccaguugucauaaagcuagg

SEQ ID NO: 587539 - RNA, 22 nt, Human
cagauuccggucaucucuccuu

SEQ ID NO: 587540 - RNA, 22 nt, Human
aguguuucaccguauguucuca

SEQ ID NO: 587541 - RNA, 22 nt, Human
ugcucaguccuaccuuggcucc

SEQ ID NO: 587542 - RNA, 22 nt, Human
cucagggaggagcuucugggcc

SEQ ID NO: 587543 - RNA, 22 nt, Human
uaggagcuaaaauauuuuauau

SEQ ID NO: 587544 - RNA, 22 nt, Human
aauucacauccgaccaggucaa

SEQ ID NO: 587545 - RNA, 22 nt, Human
acagugauuauuaguugguggu

SEQ ID NO: 587546 - RNA, 22 nt, Human
aaggcccagcgugaccucagug

SEQ ID NO: 587547 - RNA, 22 nt, Human
cugacucccugauucuggguuu

SEQ ID NO: 587548 - RNA, 22 nt, Human
ucagcucugguucauguggucu

SEQ ID NO: 587549 - RNA, 22 nt, Human
uaaauguuuagucuuauuuggg

SEQ ID NO: 587550 - RNA, 22 nt, Human
gugugcagaacagggagugggu

SEQ ID NO: 587551 - RNA, 22 nt, Human
agcaauaaauguaaagguuaag

SEQ ID NO: 587552 - RNA, 22 nt, Human
uggccagacagagaggcuuugu

SEQ ID NO: 587553 - RNA, 22 nt, Human
ccugccaggagcuggugcugca

SEQ ID NO: 587554 - RNA, 22 nt, Human
gaagagcuauguccagggagca

SEQ ID NO: 587555 - RNA, 22 nt, Human
acaggagcccaggaugggcgga

SEQ ID NO: 587556 - RNA, 22 nt, Human
augcauuuuugaguaugaauga

SEQ ID NO: 587557 - RNA, 22 nt, Human
ugagaaaacucaaagacagauc

SEQ ID NO: 587558 - RNA, 22 nt, Human
aaacugcagccuugaguucagg

SEQ ID NO: 587559 - RNA, 20 nt, Human
caucagaaauccugacccac

SEQ ID NO: 587560 - RNA, 22 nt, Human
ucaaggaggugcuuggcuucac

SEQ ID NO: 587561 - RNA, 22 nt, Human
cagcuuugagaguugcauuuua

SEQ ID NO: 587562 - RNA, 22 nt, Human
ucagaauucuacaauagaucag

SEQ ID NO: 587563 - RNA, 22 nt, Human
gcagagcugggucuguauccaa

SEQ ID NO: 587564 - RNA, 19 nt, Human
agaaucaucuugaagugau

SEQ ID NO: 587565 - RNA, 22 nt, Human
aacaaaacauuugucuuguuuc

SEQ ID NO: 587566 - RNA, 22 nt, Human
ucugcagaaacugugacuaugu

SEQ ID NO: 587567 - RNA, 22 nt, Human
aagcuuuggaagggcaggguug

SEQ ID NO: 587568 - RNA, 22 nt, Human
ucucuggguuuuuguccuguac

SEQ ID NO: 587569 - RNA, 22 nt, Human
ccagagagucgaugggggacac

SEQ ID NO: 587570 - RNA, 22 nt, Human
cuugcaggcagggccuccugga

SEQ ID NO: 587571 - RNA, 23 nt, Human
aaagacugcugagaauuuuagga

SEQ ID NO: 587572 - RNA, 22 nt, Human
ggaggggcugagcaacuuucag

SEQ ID NO: 587573 - RNA, 22 nt, Human
uuuagugauaagaauuaugaaa

SEQ ID NO: 587574 - RNA, 22 nt, Human
aacugcuuuuugaucucaggag

SEQ ID NO: 587575 - RNA, 22 nt, Human
aucacuggagugaaaggcaaac

SEQ ID NO: 587576 - RNA, 22 nt, Human
caaaguuuuaguaaacauauau

SEQ ID NO: 587577 - RNA, 22 nt, Human
ucaagcaggguagcaagcuggu

SEQ ID NO: 587578 - RNA, 22 nt, Human
aagagagaacacagcuugggca

SEQ ID NO: 587579 - RNA, 22 nt, Human
aaagaucuccccuucaaagagu

SEQ ID NO: 587580 - RNA, 18 nt, Human
gggaagccgggaagccgg

SEQ ID NO: 587581 - RNA, 22 nt, Human
augcacauguggcuuuauguau

SEQ ID NO: 587582 - RNA, 22 nt, Human
aggaaagaaguacauucucaug

SEQ ID NO: 587583 - RNA, 22 nt, Human
cacagcugccaugcagucagug

SEQ ID NO: 587584 - RNA, 22 nt, Human
caagcaugucuucuuaagcaau

SEQ ID NO: 587585 - RNA, 22 nt, Human
uugggcuccuguugauccuguc

SEQ ID NO: 587586 - RNA, 22 nt, Human
uaaaaucagccgaccauggugg

SEQ ID NO: 587587 - RNA, 22 nt, Human
ccaggaguuggagguugcagug

SEQ ID NO: 587588 - RNA, 22 nt, Human
aaggggaaguagcaccagaggu

SEQ ID NO: 587589 - RNA, 22 nt, Human
gcugggcaccggagagacccca

SEQ ID NO: 587590 - RNA, 22 nt, Human
gauaucaugggaagguguacuu

SEQ ID NO: 587591 - RNA, 22 nt, Human
uguggcccagaugagugugcua

SEQ ID NO: 587592 - RNA, 22 nt, Human
uggaaagaugaagauguuuaag

SEQ ID NO: 587593 - RNA, 22 nt, Human
uuucuugagcuaggaaccuggg

SEQ ID NO: 587594 - RNA, 22 nt, Human
augccuuugccacagauuagga

SEQ ID NO: 587595 - RNA, 22 nt, Human
cuuauaaaguccaucugaacaa

SEQ ID NO: 587596 - RNA, 22 nt, Human
ggaagaaaugcucuucuaugcg

SEQ ID NO: 587597 - RNA, 19 nt, Human
ugucccagacuccgugucu

SEQ ID NO: 587598 - RNA, 22 nt, Human
uuucuaagaauauugcucuuaa

SEQ ID NO: 587599 - RNA, 22 nt, Human
gaagaaggugcuacacagggca

SEQ ID NO: 587600 - RNA, 22 nt, Human
uugaggucucuacagaagagug

SEQ ID NO: 587601 - RNA, 22 nt, Human
uccuccuccucacagucaccug

SEQ ID NO: 587602 - RNA, 22 nt, Human
ccagagcugcauccagcagguu

SEQ ID NO: 587603 - RNA, 22 nt, Human
caggcccugccuuggcaugugu

SEQ ID NO: 587604 - RNA, 22 nt, Human
ggcacacagcuuggcaggagau

SEQ ID NO: 587605 - RNA, 22 nt, Human
gaguggggucugggcaucaguc

SEQ ID NO: 587606 - RNA, 23 nt, Human
uauuuuccaaaugaugacuacau

SEQ ID NO: 587607 - RNA, 22 nt, Human
cacagaagaaucaugcuguguu

SEQ ID NO: 587608 - RNA, 22 nt, Human
uauaguacauggaaucuucaua

SEQ ID NO: 587609 - RNA, 22 nt, Human
ucucuucuuguguuuuccugcc

SEQ ID NO: 587610 - RNA, 22 nt, Human
ugggccuggaguuuguccagag

SEQ ID NO: 587611 - RNA, 22 nt, Human
uacaggugguaaaaauauuguu

SEQ ID NO: 587612 - RNA, 22 nt, Human
accugaggcuguuagucuaggu

SEQ ID NO: 587613 - RNA, 22 nt, Human
ucagcccuuccuggagcuuuua

SEQ ID NO: 587614 - RNA, 22 nt, Human
gcacccaguuugucucaggguu

SEQ ID NO: 587615 - RNA, 22 nt, Human
augaaugaaugagaguagguca

SEQ ID NO: 587616 - RNA, 22 nt, Human
guagucacaaaccauucauaug

SEQ ID NO: 587617 - RNA, 22 nt, Human
cuagggaaauaaacugaguggu

SEQ ID NO: 587618 - RNA, 22 nt, Human
gggagggccagugcucucuaga

SEQ ID NO: 587619 - RNA, 22 nt, Human
gaggagguggagucaugcagag

SEQ ID NO: 587620 - RNA, 22 nt, Human
agagccuggagguucugcugaa

SEQ ID NO: 587621 - RNA, 22 nt, Human
agagccugggaauuugcauguu

SEQ ID NO: 587622 - RNA, 19 nt, Human
uccugggcugggccagguc

SEQ ID NO: 587623 - RNA, 22 nt, Human
uaagaacauaaauucauacggg

SEQ ID NO: 587624 - RNA, 22 nt, Human
gaggcacugaauacuugagggu

SEQ ID NO: 587625 - RNA, 22 nt, Human
augggaggaagagaagaugucu

SEQ ID NO: 587626 - RNA, 22 nt, Human
uguuauuugggaaaguuguaca

SEQ ID NO: 587627 - RNA, 22 nt, Human
ugugcagcucuagagccaagcc

SEQ ID NO: 587628 - RNA, 22 nt, Human
ccuccagcauuacuggcccaug

SEQ ID NO: 587629 - RNA, 22 nt, Human
uacuagcuaacauucucaccaa

SEQ ID NO: 587630 - RNA, 21 nt, Human
agugggauacuggaagguaga

SEQ ID NO: 587631 - RNA, 22 nt, Human
aggcacugauucucagaguuac

SEQ ID NO: 587632 - RNA, 20 nt, Human
aggaagccaaaggcugucuu

SEQ ID NO: 587633 - RNA, 22 nt, Human
agcugugugcccaugguggagg

SEQ ID NO: 587634 - RNA, 22 nt, Human
ggccuagggcuuggucauggca

SEQ ID NO: 587635 - RNA, 22 nt, Human
cugcuuuaucugagacaaguca

SEQ ID NO: 587636 - RNA, 22 nt, Human
uuacaaagauuauauucaguua

SEQ ID NO: 587637 - RNA, 22 nt, Human
uucagagguuagagcaguggga

SEQ ID NO: 587638 - RNA, 22 nt, Human
cugggcucuucccagauccaga

SEQ ID NO: 587639 - RNA, 22 nt, Human
caguguccucagccagcagcua

SEQ ID NO: 587640 - RNA, 22 nt, Human
auuuccuauggauacaggcaga

SEQ ID NO: 587641 - RNA, 22 nt, Human
uggcuuccagagcugcuccacc

SEQ ID NO: 587642 - RNA, 22 nt, Human
acagccaguaaucuaccccugu

SEQ ID NO: 587643 - RNA, 22 nt, Human
gggcaggugauuuuggcuccau

SEQ ID NO: 587644 - RNA, 22 nt, Human
augaagaaacuguucugggugg

SEQ ID NO: 587645 - RNA, 22 nt, Human
aaguucuauagucuuucuacua

SEQ ID NO: 587646 - RNA, 22 nt, Human
uuuaucugaggaaagcagacaa

SEQ ID NO: 587647 - RNA, 22 nt, Human
aggcucuggaguguggugcugg

SEQ ID NO: 587648 - RNA, 22 nt, Human
acucuggcaagcuuccacuucc

SEQ ID NO: 587649 - RNA, 22 nt, Human
ggcaugggccgaggugccuccu

SEQ ID NO: 587650 - RNA, 22 nt, Human
gccucccuguucuuccacaaua

SEQ ID NO: 587651 - RNA, 22 nt, Human
uggcugagagucauccugugug

SEQ ID NO: 587652 - RNA, 22 nt, Human
ccuggcuguggcggugcucuca

SEQ ID NO: 587653 - RNA, 20 nt, Human
augugaaguaggaagggugu

SEQ ID NO: 587654 - RNA, 22 nt, Human
ucacugauuaugaaaaugaagg

SEQ ID NO: 587655 - RNA, 22 nt, Human
gcacuagucuaggugcuaagau

SEQ ID NO: 587656 - RNA, 22 nt, Human
uaagagaugcuuuucuaaauaa

SEQ ID NO: 587657 - RNA, 22 nt, Human
aggagguggccugagcgugccc

SEQ ID NO: 587658 - RNA, 21 nt, Human
ggaagggguccucccaacagu

SEQ ID NO: 587659 - RNA, 22 nt, Human
cuggaggaccacagaagcuggu

SEQ ID NO: 587660 - RNA, 22 nt, Human
ugggguccucucacuuggaggg

SEQ ID NO: 587661 - RNA, 22 nt, Human
aguguuuaaugccuuuuccagc

SEQ ID NO: 587662 - RNA, 23 nt, Human
gcccugcugggaccuccugcuac

SEQ ID NO: 587663 - RNA, 20 nt, Human
uguuucauaagcuguccuau

SEQ ID NO: 587664 - RNA, 22 nt, Human
ugaggcccucugggcugguccu

SEQ ID NO: 587665 - RNA, 22 nt, Human
cucuggccccaguggccccuug

SEQ ID NO: 587666 - RNA, 22 nt, Human
ugcugggcaucguaggagguac

SEQ ID NO: 587667 - RNA, 22 nt, Human
uucaaacacuggcuuagccaau

SEQ ID NO: 587668 - RNA, 22 nt, Human
ccugggcugcaugauggcauuu

SEQ ID NO: 587669 - RNA, 22 nt, Human
ugggccuccuggaagaaugugg

SEQ ID NO: 587670 - RNA, 22 nt, Human
aagggaaaauaguugaugacca

SEQ ID NO: 587671 - RNA, 22 nt, Human
augcuaaaugcuggggguacau

SEQ ID NO: 587672 - RNA, 22 nt, Human
gagcauggauagaaggugggau

SEQ ID NO: 587673 - RNA, 18 nt, Human
cacauuuaccuggcuccc

SEQ ID NO: 587674 - RNA, 22 nt, Human
acugcucacgcauuacuugagc

SEQ ID NO: 587675 - RNA, 22 nt, Human
uguggcuuuugcuagcuuugca

SEQ ID NO: 587676 - RNA, 22 nt, Human
uagcaaauacaugauguaauuu

SEQ ID NO: 587677 - RNA, 22 nt, Human
acugcaggccuuggugccagca

SEQ ID NO: 587678 - RNA, 22 nt, Human
cugggcuuaggaccuggugcgg

SEQ ID NO: 587679 - RNA, 22 nt, Human
ccaguguuagagacugauacag

SEQ ID NO: 587680 - RNA, 22 nt, Human
agcuuuaaaucaauccagugag

SEQ ID NO: 587681 - RNA, 22 nt, Human
agcuucugcaucuuuucuuccc

SEQ ID NO: 587682 - RNA, 21 nt, Human
aaagcaucacgaacauuuggg

SEQ ID NO: 587683 - RNA, 22 nt, Human
agcugaggaauaauaacaaggu

SEQ ID NO: 587684 - RNA, 22 nt, Human
ccugggugacagagugagaccu

SEQ ID NO: 587685 - RNA, 22 nt, Human
gcaggcaccucguggaguggaa

SEQ ID NO: 587686 - RNA, 22 nt, Human
gaaaggaaauugagggacgcau

SEQ ID NO: 587687 - RNA, 22 nt, Human
uggcuucaguuccuguguuguu

SEQ ID NO: 587688 - RNA, 22 nt, Human
cacugucuucaguuucacugca

SEQ ID NO: 587689 - RNA, 20 nt, Human
gcaagcaugaagaguagaga

SEQ ID NO: 587690 - RNA, 22 nt, Human
aagaauaaguagaugggagaag

SEQ ID NO: 587691 - RNA, 22 nt, Human
auggucugaaugugugcuccaa

SEQ ID NO: 587692 - RNA, 22 nt, Human
uaaaugcuuagauucauagaaa

SEQ ID NO: 587693 - RNA, 22 nt, Human
aacauuucagcaaauaagaaca

SEQ ID NO: 587694 - RNA, 20 nt, Human
ucugaggcugagcccagcgu

SEQ ID NO: 587695 - RNA, 22 nt, Human
gaaagcacaguucaugagacaa

SEQ ID NO: 587696 - RNA, 22 nt, Human
cccugaggauagggcaggaccc

SEQ ID NO: 587697 - RNA, 23 nt, Human
ggcaccaggccauggagcgggag

SEQ ID NO: 587698 - RNA, 22 nt, Human
gggacagaaggaagugagcaca

SEQ ID NO: 587699 - RNA, 22 nt, Human
ucugagaaguccuguauuucua

SEQ ID NO: 587700 - RNA, 22 nt, Human
uguacaguguagucaugagguu

SEQ ID NO: 587701 - RNA, 22 nt, Human
ugguccauguucccagaagaca

SEQ ID NO: 587702 - RNA, 22 nt, Human
ucuggcuuucauuuguuuaaag

SEQ ID NO: 587703 - RNA, 22 nt, Human
ucugaaagucugaaacaguguc

SEQ ID NO: 587704 - RNA, 22 nt, Human
uuuaacaugugaauuuuggaag

SEQ ID NO: 587705 - RNA, 22 nt, Human
gguuuuauuaacuuuaacauca

SEQ ID NO: 587706 - RNA, 22 nt, Human
ccagugcccagucucccugguc

SEQ ID NO: 587707 - RNA, 22 nt, Human
aagauccugcuuuugcuucugu

SEQ ID NO: 587708 - RNA, 22 nt, Human
aauuuuacuaaucugaguguga

SEQ ID NO: 587709 - RNA, 20 nt, Human
gccugggauuauccacuggu

SEQ ID NO: 587710 - RNA, 22 nt, Human
gcuguuucugguucuguuccua

SEQ ID NO: 587711 - RNA, 22 nt, Human
auaguuuucuaugcacuguuau

SEQ ID NO: 587712 - RNA, 22 nt, Human
cugaggccugggggcguggacg

SEQ ID NO: 587713 - RNA, 23 nt, Human
uauugcacacauagaaacauaga

SEQ ID NO: 587714 - RNA, 22 nt, Human
ccagccuucugagcugccugga

SEQ ID NO: 587715 - RNA, 18 nt, Human
ucuguccacccugugcug

SEQ ID NO: 587716 - RNA, 22 nt, Human
cagaggcuaagaguguccaaag

SEQ ID NO: 587717 - RNA, 22 nt, Human
agcaggaggguuuuguagaguc

SEQ ID NO: 587718 - RNA, 20 nt, Human
aggucugauuccagaaucag

SEQ ID NO: 587719 - RNA, 22 nt, Human
cuucaguauccuccacauguua

SEQ ID NO: 587720 - RNA, 22 nt, Human
acagucuggaagcagggggcaa

SEQ ID NO: 587721 - RNA, 22 nt, Human
ucauucucugggaugcaguuug

SEQ ID NO: 587722 - RNA, 22 nt, Human
cuggaaaguacagugugucaca

SEQ ID NO: 587723 - RNA, 22 nt, Human
gaucagaauuuacuuauaauug

SEQ ID NO: 587724 - RNA, 22 nt, Human
acaugucaauuuaguacucuua

SEQ ID NO: 587725 - RNA, 22 nt, Human
uuucuugccagagaaaaagagu

SEQ ID NO: 587726 - RNA, 22 nt, Human
aggggugacacauaucagugca

SEQ ID NO: 587727 - RNA, 22 nt, Human
cuacccuuaaguuucugugggg

SEQ ID NO: 587728 - RNA, 22 nt, Human
aaacagacugaagaguugaagc

SEQ ID NO: 587729 - RNA, 22 nt, Human
cucucuuugauguauaaauaau

SEQ ID NO: 587730 - RNA, 22 nt, Human
cagaggagaauugcgggaucau

SEQ ID NO: 587731 - RNA, 22 nt, Human
uauuguauuaaggauucaagua

SEQ ID NO: 587732 - RNA, 22 nt, Human
ugcuccaggagcacuuuccauu

SEQ ID NO: 587733 - RNA, 23 nt, Human
uggacaggguaacuggugguuuu

SEQ ID NO: 587734 - RNA, 22 nt, Human
uuccugugcuuaauucucacug

SEQ ID NO: 587735 - RNA, 22 nt, Human
cuccugggggacagcggcaggg

SEQ ID NO: 587736 - RNA, 22 nt, Human
ugcaggcaguaggccagcucca

SEQ ID NO: 587737 - RNA, 18 nt, Human
acuccccacaggcucugu

SEQ ID NO: 587738 - RNA, 22 nt, Human
uuguauuuggguaguauagaga

SEQ ID NO: 587739 - RNA, 22 nt, Human
gaggcagcaaaauauaucauaa

SEQ ID NO: 587740 - RNA, 22 nt, Human
guggcuucaccccaguugucuc

SEQ ID NO: 587741 - RNA, 22 nt, Human
acccagucuggagugcagugac

SEQ ID NO: 587742 - RNA, 23 nt, Human
ccagcucccaggucugaggacug

SEQ ID NO: 587743 - RNA, 22 nt, Human
ggacaggccgccucgguggggg

SEQ ID NO: 587744 - RNA, 22 nt, Human
gagagaaaugugcaguuugggc

SEQ ID NO: 587745 - RNA, 22 nt, Human
ucacuuugcccuguaccuuggg

SEQ ID NO: 587746 - RNA, 22 nt, Human
gcaagcuguccuuuugcauggc

SEQ ID NO: 587747 - RNA, 21 nt, Human
uuaaaaugaggaagugguggc

SEQ ID NO: 587748 - RNA, 22 nt, Human
ucagagaauccguaagucacaa

SEQ ID NO: 587749 - RNA, 22 nt, Human
aaggaggacacccaggacuggg

SEQ ID NO: 587750 - RNA, 20 nt, Human
acacauagauaagaagcuga

SEQ ID NO: 587751 - RNA, 22 nt, Human
cugaagaggacgcagcagcaag

SEQ ID NO: 587752 - RNA, 22 nt, Human
ugccuuggugcuucuucaugug

SEQ ID NO: 587753 - RNA, 22 nt, Human
caggcugcagcagcaguggccc

SEQ ID NO: 587754 - RNA, 22 nt, Human
cuguauauggcuuacuuuauau

SEQ ID NO: 587755 - RNA, 22 nt, Human
cagagcaccagugggagacaag

SEQ ID NO: 587756 - RNA, 22 nt, Human
cugccugccuuggccuccagga

SEQ ID NO: 587757 - RNA, 19 nt, Human
acaggggcuagcggaagca

SEQ ID NO: 587758 - RNA, 22 nt, Human
auuuuccuucuaagaggaaggu

SEQ ID NO: 587759 - RNA, 22 nt, Human
ugggcacagggguaggaaugag

SEQ ID NO: 587760 - RNA, 22 nt, Human
uacacugugguaaacucaaagu

SEQ ID NO: 587761 - RNA, 22 nt, Human
gcugaggaagucagguggccca

SEQ ID NO: 587762 - RNA, 22 nt, Human
uuaaauauuuucagcaggguca

SEQ ID NO: 587763 - RNA, 22 nt, Human
uugcucagcacuggagccagcu

SEQ ID NO: 587764 - RNA, 22 nt, Human
aagcagccuggacuugggcugg

SEQ ID NO: 587765 - RNA, 22 nt, Human
acuggaguguuuggaggaugca

SEQ ID NO: 587766 - RNA, 22 nt, Human
uuagcucagaaaauuuaaacuu

SEQ ID NO: 587767 - RNA, 21 nt, Human
cuacccucacucccauuccuc

SEQ ID NO: 587768 - RNA, 22 nt, Human
ugcuggaugcuugauuuugagg

SEQ ID NO: 587769 - RNA, 22 nt, Human
caagucaagcaugcccuuauuu

SEQ ID NO: 587770 - RNA, 22 nt, Human
gcgagaaacuaagugcccuuug

SEQ ID NO: 587771 - RNA, 22 nt, Human
aaagaguucuaugaucuuucca

SEQ ID NO: 587772 - RNA, 22 nt, Human
uugcacuccagcccgagcaaca

SEQ ID NO: 587773 - RNA, 22 nt, Human
cccaggagguagagguugcagu

SEQ ID NO: 587774 - RNA, 22 nt, Human
agagacugcaaugagugguagg

SEQ ID NO: 587775 - RNA, 22 nt, Human
auuaagacugcccauguuuuua

SEQ ID NO: 587776 - RNA, 22 nt, Human
gaacacaagcguaugucuuugu

SEQ ID NO: 587777 - RNA, 22 nt, Human
aacaaugcaguuaaugggaaga

SEQ ID NO: 587778 - RNA, 22 nt, Human
caauguaaauauuuucuaauca

SEQ ID NO: 587779 - RNA, 22 nt, Human
aacagcuuugagcaguucugua

SEQ ID NO: 587780 - RNA, 22 nt, Human
uuacagagggcuucucugaacu

SEQ ID NO: 587781 - RNA, 21 nt, Human
uuccucugcaacugaugcuca

SEQ ID NO: 587782 - RNA, 22 nt, Human
gagaaacacuguuaguuuauua

SEQ ID NO: 587783 - RNA, 22 nt, Human
uagggcuauucugaguaauaau

SEQ ID NO: 587784 - RNA, 22 nt, Human
gcuugguuacugauggaaagga

SEQ ID NO: 587785 - RNA, 22 nt, Human
aggugaguuacaggaggagguc

SEQ ID NO: 587786 - RNA, 20 nt, Human
cacaggccuugugagcagac

SEQ ID NO: 587787 - RNA, 22 nt, Human
guuucgucaggcuuauucuauc

SEQ ID NO: 587788 - RNA, 22 nt, Human
cugccuggggcaucagucaagg

SEQ ID NO: 587789 - RNA, 22 nt, Human
uggcccugcagaacuagccugg

SEQ ID NO: 587790 - RNA, 22 nt, Human
uccuggugucgccuggucaguu

SEQ ID NO: 587791 - RNA, 22 nt, Human
ucucccacgguacaggauaaac

SEQ ID NO: 587792 - RNA, 19 nt, Human
ggaccagguccugggcagc

SEQ ID NO: 587793 - RNA, 22 nt, Human
gcagggaggaagagaugcuucc

SEQ ID NO: 587794 - RNA, 22 nt, Human
acagauauaugauuguguaaau

SEQ ID NO: 587795 - RNA, 22 nt, Human
caggguggaauggaaugcuggc

SEQ ID NO: 587796 - RNA, 22 nt, Human
gaaggccuaggaaggaagccuu

SEQ ID NO: 587797 - RNA, 22 nt, Human
gcccugagccuaugagccucuc

SEQ ID NO: 587798 - RNA, 22 nt, Human
gaugucuucccauguucaugug

SEQ ID NO: 587799 - RNA, 18 nt, Human
ugagaacuaggcauugca

SEQ ID NO: 587800 - RNA, 22 nt, Human
ucugauucauucaugugcacca

SEQ ID NO: 587801 - RNA, 22 nt, Human
ggaggcaucucuguggcugucu

SEQ ID NO: 587802 - RNA, 22 nt, Human
ugggaaauauaauuuagcugug

SEQ ID NO: 587803 - RNA, 22 nt, Human
gcucccagggcagcgcagaaga

SEQ ID NO: 587804 - RNA, 22 nt, Human
ggccaccaguccucuggcaggg

SEQ ID NO: 587805 - RNA, 22 nt, Human
uucauuuguccaaauacuaugu

SEQ ID NO: 587806 - RNA, 22 nt, Human
ggaagggcaaaagagaugaacu

SEQ ID NO: 587807 - RNA, 22 nt, Human
agcaagcagaauucuguccucu

SEQ ID NO: 587808 - RNA, 22 nt, Human
uuuaugauuauuuuaaagcagc

SEQ ID NO: 587809 - RNA, 22 nt, Human
ugucucuuuggguuccucuugg

SEQ ID NO: 587810 - RNA, 22 nt, Human
ccaggcaccaaaguaugcuuua

SEQ ID NO: 587811 - RNA, 22 nt, Human
gcaguccuagggugcucugcag

SEQ ID NO: 587812 - RNA, 22 nt, Human
ugcuggcacgugacugggaagu

SEQ ID NO: 587813 - RNA, 22 nt, Human
auuauuauauagggaaaguccc

SEQ ID NO: 587814 - RNA, 22 nt, Human
agguuucuaugcuguuuaucuu

SEQ ID NO: 587815 - RNA, 22 nt, Human
gauugcuguaguuaaaaugaug

SEQ ID NO: 587816 - RNA, 20 nt, Human
uucucuggauagccagaugu

SEQ ID NO: 587817 - RNA, 22 nt, Human
gugacgugcagguguggccagc

SEQ ID NO: 587818 - RNA, 22 nt, Human
ggagccuggaguuucugauggg

SEQ ID NO: 587819 - RNA, 22 nt, Human
ugggaguggggcauagaaggua

SEQ ID NO: 587820 - RNA, 22 nt, Human
cucuugggagugcucuggagaa

SEQ ID NO: 587821 - RNA, 22 nt, Human
gacuuucucuccucccaggugu

SEQ ID NO: 587822 - RNA, 22 nt, Human
guacauuuaggauucauugaaa

SEQ ID NO: 587823 - RNA, 22 nt, Human
caggguggcacucagcgcaucu

SEQ ID NO: 587824 - RNA, 22 nt, Human
uuagaauuauuguuuccuucua

SEQ ID NO: 587825 - RNA, 19 nt, Human
uggcagggagaguuugaag

SEQ ID NO: 587826 - RNA, 22 nt, Human
ucagaggacagcagcuaaauaa

SEQ ID NO: 587827 - RNA, 22 nt, Human
cugggcugccagguaggcacac

SEQ ID NO: 587828 - RNA, 23 nt, Human
cugaagcaauauccccucacuuc

SEQ ID NO: 587829 - RNA, 22 nt, Human
gggggaaguaauuauaaaccaa

SEQ ID NO: 587830 - RNA, 22 nt, Human
uaacuuuaguguaugagguaag

SEQ ID NO: 587831 - RNA, 22 nt, Human
aggaacaauugauaaacucaca

SEQ ID NO: 587832 - RNA, 22 nt, Human
cugaauaauacagacuagcuuc

SEQ ID NO: 587833 - RNA, 22 nt, Human
augacagaggagugcaggugau

SEQ ID NO: 587834 - RNA, 22 nt, Human
aagcaaggccggaaggaaacuc

SEQ ID NO: 587835 - RNA, 22 nt, Human
ccagagcagggcagcagggcuc

SEQ ID NO: 587836 - RNA, 22 nt, Human
gauacauuuuaucuccuaacag

SEQ ID NO: 587837 - RNA, 22 nt, Human
auuuacagaagcauguaauagc

SEQ ID NO: 587838 - RNA, 22 nt, Human
accuucuggucugccugacagc

SEQ ID NO: 587839 - RNA, 22 nt, Human
ccaauguuuuauacagaaguac

SEQ ID NO: 587840 - RNA, 22 nt, Human
cagagcugcagauugaaggcau

SEQ ID NO: 587841 - RNA, 22 nt, Human
augaaauuugcugcuaaguucc

SEQ ID NO: 587842 - RNA, 17 nt, Human
agugaaauuuacauugc

SEQ ID NO: 587843 - RNA, 22 nt, Human
uggcaguuucaugugauucaac

SEQ ID NO: 587844 - RNA, 22 nt, Human
agauuaacucucagaaaagagg

SEQ ID NO: 587845 - RNA, 22 nt, Human
uggcagcaguagccaccccagc

SEQ ID NO: 587846 - RNA, 22 nt, Human
aaugcuuauaccuaaugaucuu

SEQ ID NO: 587847 - RNA, 22 nt, Human
ugagguggccgaggagcaggac

SEQ ID NO: 587848 - RNA, 22 nt, Human
ggcuccagcccuggcucuucac

SEQ ID NO: 587849 - RNA, 22 nt, Human
auauauuuugaauagccucugu

SEQ ID NO: 587850 - RNA, 22 nt, Human
ugaagagauagaaguacaugcu

SEQ ID NO: 587851 - RNA, 22 nt, Human
agccacagggggugagggacaa

SEQ ID NO: 587852 - RNA, 21 nt, Human
gagcauggcuuacaucagcag

SEQ ID NO: 587853 - RNA, 22 nt, Human
cugagcaggauauucacagcag

SEQ ID NO: 587854 - RNA, 22 nt, Human
ucugagacacucuugugauggg

SEQ ID NO: 587855 - RNA, 22 nt, Human
aggcugaggcuuuccuuggaga

SEQ ID NO: 587856 - RNA, 22 nt, Human
auauuaaugggauuuagucagg

SEQ ID NO: 587857 - RNA, 22 nt, Human
aaaguauuugugauuuuuacca

SEQ ID NO: 587858 - RNA, 22 nt, Human
aggccugggacgggagccguga

SEQ ID NO: 587859 - RNA, 22 nt, Human
aagaaauacaugguuuuugagu

SEQ ID NO: 587860 - RNA, 22 nt, Human
aauguuacaggaccuaagauga

SEQ ID NO: 587861 - RNA, 22 nt, Human
ugggaaggacgugucaguggca

SEQ ID NO: 587862 - RNA, 22 nt, Human
gcaggugguccccguggagugg

SEQ ID NO: 587863 - RNA, 22 nt, Human
cacacagguauauauauguaca

SEQ ID NO: 587864 - RNA, 22 nt, Human
guggaggucccgggcaggagca

SEQ ID NO: 587865 - RNA, 22 nt, Human
uugguaaauuauuucuuccaau

SEQ ID NO: 587866 - RNA, 22 nt, Human
cugccugaguggaggucgaggg

SEQ ID NO: 587867 - RNA, 22 nt, Human
gcuuccugagaaacaaucugau

SEQ ID NO: 587868 - RNA, 22 nt, Human
ucauugccauggcauuugcaga

SEQ ID NO: 587869 - RNA, 22 nt, Human
ucagaagcagauauuucaaaau

SEQ ID NO: 587870 - RNA, 22 nt, Human
ggaaagggaguuuugcuuauga

SEQ ID NO: 587871 - RNA, 19 nt, Human
ggcugagcgccuuggcugc

SEQ ID NO: 587872 - RNA, 22 nt, Human
ggccacugcccuggcuacaccg

SEQ ID NO: 587873 - RNA, 22 nt, Human
uuacaagguaaguuguuaaguc

SEQ ID NO: 587874 - RNA, 22 nt, Human
gaauacaugauacaugaacugc

SEQ ID NO: 587875 - RNA, 22 nt, Human
agcucccagagcucgagaguaa

SEQ ID NO: 587876 - RNA, 23 nt, Human
ugggcccuggagucgccagucug

SEQ ID NO: 587877 - RNA, 22 nt, Human
guuuaugaaugugucagacaua

SEQ ID NO: 587878 - RNA, 22 nt, Human
ucaggguugugguggaauucag

SEQ ID NO: 587879 - RNA, 22 nt, Human
accagcuguuaggcuuggugcu

SEQ ID NO: 587880 - RNA, 22 nt, Human
ucagaagcaagcuucuacuucu

SEQ ID NO: 587881 - RNA, 22 nt, Human
ucuucccccgugcuccagugca

SEQ ID NO: 587882 - RNA, 22 nt, Human
gugaggggccaagaguagggca

SEQ ID NO: 587883 - RNA, 22 nt, Human
auuuaauuaaucauggugaauu

SEQ ID NO: 587884 - RNA, 22 nt, Human
aauagaaaggaggggcucuugu

SEQ ID NO: 587885 - RNA, 22 nt, Human
ggggcagagcauagcuccaauu

SEQ ID NO: 587886 - RNA, 22 nt, Human
ugaaaaacuuuaauccauaaag

SEQ ID NO: 587887 - RNA, 22 nt, Human
ucugagaacaucauuuccuaca

SEQ ID NO: 587888 - RNA, 22 nt, Human
ugcccuggcacacacacagcug

SEQ ID NO: 587889 - RNA, 22 nt, Human
ugcaucagaguuugcugcugcu

SEQ ID NO: 587890 - RNA, 22 nt, Human
ugaggaaacuuacaaggcagaa

SEQ ID NO: 587891 - RNA, 22 nt, Human
aauaugugggugcuaaucaaaa

SEQ ID NO: 587892 - RNA, 22 nt, Human
ggaggggagauguuugggcuca

SEQ ID NO: 587893 - RNA, 22 nt, Human
ucuagaaaaccaauauuacaug

SEQ ID NO: 587894 - RNA, 22 nt, Human
uccacagauuaaaaacauacuu

SEQ ID NO: 587895 - RNA, 22 nt, Human
uucacaagucauuagcugcaua

SEQ ID NO: 587896 - RNA, 22 nt, Human
agccacagucaaccuguccaua

SEQ ID NO: 587897 - RNA, 19 nt, Human
uacccucagggccucauuu

SEQ ID NO: 587898 - RNA, 22 nt, Human
uagcauuauuuccucuuuuugu

SEQ ID NO: 587899 - RNA, 22 nt, Human
ucugugugcccuaaagccugcu

SEQ ID NO: 587900 - RNA, 22 nt, Human
cucccacuccuggcucaccaca

SEQ ID NO: 587901 - RNA, 22 nt, Human
ccagcuccuucugucuguggag

SEQ ID NO: 587902 - RNA, 22 nt, Human
cagccacuucgagcuuccugau

SEQ ID NO: 587903 - RNA, 22 nt, Human
acauucacgcucucaaagcuga

SEQ ID NO: 587904 - RNA, 22 nt, Human
aaaguccugacugcaggggaug

SEQ ID NO: 587905 - RNA, 22 nt, Human
ugaggccagagaguuugcauuu

SEQ ID NO: 587906 - RNA, 22 nt, Human
uucauauuuucugcuugcucac

SEQ ID NO: 587907 - RNA, 22 nt, Human
gaggcaccucgcgggaggaggc

SEQ ID NO: 587908 - RNA, 22 nt, Human
gcugccagggaggugguggagg

SEQ ID NO: 587909 - RNA, 22 nt, Human
uuccuuucucuggacugcagcc

SEQ ID NO: 587910 - RNA, 22 nt, Human
ugcccaccuuuacugugauuua

SEQ ID NO: 587911 - RNA, 22 nt, Human
gcacacagauuaggaaacagaa

SEQ ID NO: 587912 - RNA, 22 nt, Human
aaauccuaaaaguuugacuuaa

SEQ ID NO: 587913 - RNA, 23 nt, Human
aggagacagggaagugccuggcu

SEQ ID NO: 587914 - RNA, 22 nt, Human
ccaggguugcuguauggcacuu

SEQ ID NO: 587915 - RNA, 22 nt, Human
uacuuucaugucuauacauauu

SEQ ID NO: 587916 - RNA, 23 nt, Human
gccagaggaacgcagagcuuucu

SEQ ID NO: 587917 - RNA, 22 nt, Human
ugagauggagccacugcacucu

SEQ ID NO: 587918 - RNA, 22 nt, Human
gcaagcagacauucagguaggu

SEQ ID NO: 587919 - RNA, 18 nt, Human
agcaaauauuaagugcau

SEQ ID NO: 587920 - RNA, 22 nt, Human
caggcugggcugguguuagagu

SEQ ID NO: 587921 - RNA, 19 nt, Human
ggccuggauuuagggcucc

SEQ ID NO: 587922 - RNA, 22 nt, Human
ugucauuuucauccuaaggagc

SEQ ID NO: 587923 - RNA, 22 nt, Human
ucacagaaucucugauaagucu

SEQ ID NO: 587924 - RNA, 22 nt, Human
cccuggcuggaaauuaaguagu

SEQ ID NO: 587925 - RNA, 22 nt, Human
ccugccagggccuuggaagaaa

SEQ ID NO: 587926 - RNA, 22 nt, Human
ugcaggcaggggaugagcagcc

SEQ ID NO: 587927 - RNA, 22 nt, Human
gaggcccaguccugcaagcacg

SEQ ID NO: 587928 - RNA, 22 nt, Human
guccaggucuggacccugagcc

SEQ ID NO: 587929 - RNA, 22 nt, Human
uuauuuauuguguaccuacugu

SEQ ID NO: 587930 - RNA, 22 nt, Human
ugggccaguucuuuacucgucc

SEQ ID NO: 587931 - RNA, 22 nt, Human
auguucaaacuuuuuacacacc

SEQ ID NO: 587932 - RNA, 21 nt, Human
auauuuuuguuuggacuguca

SEQ ID NO: 587933 - RNA, 22 nt, Human
gcaugcaggauagguugagcuc

SEQ ID NO: 587934 - RNA, 22 nt, Human
ugcaguuugcccuuugcucacu

SEQ ID NO: 587935 - RNA, 22 nt, Human
guuuuucuuugugugaagacaa

SEQ ID NO: 587936 - RNA, 21 nt, Human
gccagcugggucuugcaggag

SEQ ID NO: 587937 - RNA, 22 nt, Human
agcagugaugcaugacagccua

SEQ ID NO: 587938 - RNA, 22 nt, Human
cagcacaucuucugaucuuuug

SEQ ID NO: 587939 - RNA, 22 nt, Human
caguuuuauacacugcagcucc

SEQ ID NO: 587940 - RNA, 22 nt, Human
uuccugggcuuuccccucuggu

SEQ ID NO: 587941 - RNA, 22 nt, Human
gccucugggcucugccccuggc

SEQ ID NO: 587942 - RNA, 22 nt, Human
ggggcccagcaccccuccucgc

SEQ ID NO: 587943 - RNA, 22 nt, Human
gccaggcuggcaaaaggaaacc

SEQ ID NO: 587944 - RNA, 22 nt, Human
uauguccugcuacucucucaug

SEQ ID NO: 587945 - RNA, 22 nt, Human
guuuuacaaaugacggcauuca

SEQ ID NO: 587946 - RNA, 22 nt, Human
uccccaggggccugggcacagu

SEQ ID NO: 587947 - RNA, 22 nt, Human
gucagugugagauaaucuugga

SEQ ID NO: 587948 - RNA, 22 nt, Human
gugcaaaagcaguuggauuuuu

SEQ ID NO: 587949 - RNA, 22 nt, Human
uguucaaaucuuuugcuuauuu

SEQ ID NO: 587950 - RNA, 22 nt, Human
caauuucuaacauuccauggau

SEQ ID NO: 587951 - RNA, 22 nt, Human
ggaagaggcugagccagguccc

SEQ ID NO: 587952 - RNA, 22 nt, Human
acuuggccuuauuuccacagaa

SEQ ID NO: 587953 - RNA, 22 nt, Human
ccuuucugguauuuaaccaaag

SEQ ID NO: 587954 - RNA, 22 nt, Human
gguguggggagguucugcuucu

SEQ ID NO: 587955 - RNA, 22 nt, Human
gccuggcccagggcucuuguug

SEQ ID NO: 587956 - RNA, 22 nt, Human
gugcaaaagcaguugugguuuu

SEQ ID NO: 587957 - RNA, 22 nt, Human
guccugguagcuggcuugguca

SEQ ID NO: 587958 - RNA, 22 nt, Human
auuauuguguaaaaugaggcuu

SEQ ID NO: 587959 - RNA, 22 nt, Human
ccaguguucaguaugcauuaag

SEQ ID NO: 587960 - RNA, 22 nt, Human
cuggaagaggggaaaugccaug

SEQ ID NO: 587961 - RNA, 22 nt, Human
uuuccuaagggaugcggcucaa

SEQ ID NO: 587962 - RNA, 22 nt, Human
gcagcccaauggacugagacag

SEQ ID NO: 587963 - RNA, 22 nt, Human
uggagcugggguuugaaucugg

SEQ ID NO: 587964 - RNA, 22 nt, Human
ucauuuaugcaggaauggcaua

SEQ ID NO: 587965 - RNA, 22 nt, Human
ucuuggaaguagaacacagucu

SEQ ID NO: 587966 - RNA, 23 nt, Human
ccagugugguagguccacaggug

SEQ ID NO: 587967 - RNA, 22 nt, Human
aaguuuuucacauugcuguugu

SEQ ID NO: 587968 - RNA, 22 nt, Human
uucaguuuccacuuacauuuaa

SEQ ID NO: 587969 - RNA, 22 nt, Human
acccugagucagacagccugac

SEQ ID NO: 587970 - RNA, 22 nt, Human
uguggcagagagagcuuccuug

SEQ ID NO: 587971 - RNA, 22 nt, Human
cuauuaaauacucuucaaauug

SEQ ID NO: 587972 - RNA, 17 nt, Human
uuauuuuuugggcugag

SEQ ID NO: 587973 - RNA, 22 nt, Human
uauaaguaguuguugaagacuu

SEQ ID NO: 587974 - RNA, 22 nt, Human
ugccugugucacagugauguuu

SEQ ID NO: 587975 - RNA, 22 nt, Human
aaacagcuuucagaaucucuca

SEQ ID NO: 587976 - RNA, 22 nt, Human
agacacauaggaccacacugug

SEQ ID NO: 587977 - RNA, 22 nt, Human
agguccaguuuucaguucucau

SEQ ID NO: 587978 - RNA, 22 nt, Human
uuuuccuggggcuucuggacuc

SEQ ID NO: 587979 - RNA, 22 nt, Human
acauuucugcauguaggguaau

SEQ ID NO: 587980 - RNA, 20 nt, Human
uguugcucucuccugaguuu

SEQ ID NO: 587981 - RNA, 22 nt, Human
cucacaugauggccuuuuucau

SEQ ID NO: 587982 - RNA, 22 nt, Human
uacuaguuucuaccuuacagaa

SEQ ID NO: 587983 - RNA, 22 nt, Human
ugccugucuuaauaucuggaaa

SEQ ID NO: 587984 - RNA, 22 nt, Human
ugugugaaucuauugaauauau

SEQ ID NO: 587985 - RNA, 22 nt, Human
ucaguguuugaacccaggguua

SEQ ID NO: 587986 - RNA, 22 nt, Human
caccaggguacaauuucgcaga

SEQ ID NO: 587987 - RNA, 22 nt, Human
uguauauaagcauuuacuuguu

SEQ ID NO: 587988 - RNA, 21 nt, Human
cugggcucaagcaauccuuuc

SEQ ID NO: 587989 - RNA, 22 nt, Human
gcagggcuguucaggagggugg

SEQ ID NO: 587990 - RNA, 22 nt, Human
uccugcagccauuagaggucaa

SEQ ID NO: 587991 - RNA, 22 nt, Human
gaauuuaagaggaugaaucugu

SEQ ID NO: 587992 - RNA, 22 nt, Human
aguagaaagaaggcacugggcc

SEQ ID NO: 587993 - RNA, 22 nt, Human
cuucagcagaugcaaaaccccu

SEQ ID NO: 587994 - RNA, 22 nt, Human
ucuggagugaaugaaguagugu

SEQ ID NO: 587995 - RNA, 22 nt, Human
ccaggguuggcaagcaaggcuu

SEQ ID NO: 587996 - RNA, 22 nt, Human
augcuuuauacaaaacacuuaa

SEQ ID NO: 587997 - RNA, 22 nt, Human
aaauugcaaaaguacuuuuagg

SEQ ID NO: 587998 - RNA, 19 nt, Human
uggcuucuguuuucauguu

SEQ ID NO: 587999 - RNA, 22 nt, Human
cagucccaucucccagguggcu

SEQ ID NO: 588000 - RNA, 22 nt, Human
guucagcagcagugauuuugug

SEQ ID NO: 588001 - RNA, 22 nt, Human
guuauuguguuuguucagggca

SEQ ID NO: 588002 - RNA, 22 nt, Human
agcuccugaaaauccagacugg

SEQ ID NO: 588003 - RNA, 22 nt, Human
agaauuuguaaaagauaagaca

SEQ ID NO: 588004 - RNA, 22 nt, Human
aucugacaucuacuagaacaga

SEQ ID NO: 588005 - RNA, 19 nt, Human
agguaggcaguggcaugga

SEQ ID NO: 588006 - RNA, 22 nt, Human
agucuccagaaauauagcagug

SEQ ID NO: 588007 - RNA, 22 nt, Human
gcagagguccuagccaggaguc

SEQ ID NO: 588008 - RNA, 22 nt, Human
ccagaggaucaguacuggcugg

SEQ ID NO: 588009 - RNA, 21 nt, Human
gcugccaccgcgugcuccagg

SEQ ID NO: 588010 - RNA, 22 nt, Human
gagagugaggcaucaggggcag

SEQ ID NO: 588011 - RNA, 22 nt, Human
ucauaagugguuuauaugcuug

SEQ ID NO: 588012 - RNA, 22 nt, Human
aaauguguauaugaaacaugau

SEQ ID NO: 588013 - RNA, 22 nt, Human
cccagacucaucccugggagcu

SEQ ID NO: 588014 - RNA, 22 nt, Human
acugauguuaacccucucuucu

SEQ ID NO: 588015 - RNA, 22 nt, Human
acauacuuauguguauaugugu

SEQ ID NO: 588016 - RNA, 21 nt, Human
agacaguaacucuucuacucc

SEQ ID NO: 588017 - RNA, 22 nt, Human
uugcuggcuugaagauagagga

SEQ ID NO: 588018 - RNA, 22 nt, Human
uggugcagagagggaucuaggg

SEQ ID NO: 588019 - RNA, 20 nt, Human
agacaugguagugauucagg

SEQ ID NO: 588020 - RNA, 22 nt, Human
agggcugacaaauggcagugac

SEQ ID NO: 588021 - RNA, 22 nt, Human
gcuuuaaaccucuacucugucc

SEQ ID NO: 588022 - RNA, 22 nt, Human
ugagcuguagcagaugcuguug

SEQ ID NO: 588023 - RNA, 22 nt, Human
ucuuugcaguggugaauaaaga

SEQ ID NO: 588024 - RNA, 22 nt, Human
agagcuuugggacauuugcuag

SEQ ID NO: 588025 - RNA, 22 nt, Human
aguuuauguaaaauuaguaaug

SEQ ID NO: 588026 - RNA, 22 nt, Human
augcugagauaaggcuuuaguc

SEQ ID NO: 588027 - RNA, 20 nt, Human
cuggaugcuaaaacacacac

SEQ ID NO: 588028 - RNA, 22 nt, Human
augugcuuucuuuccaaggggc

SEQ ID NO: 588029 - RNA, 22 nt, Human
cugaaggauuuaguucuuugcu

SEQ ID NO: 588030 - RNA, 22 nt, Human
ucuggccagugaaaugcagaau

SEQ ID NO: 588031 - RNA, 22 nt, Human
uggaggcaucagagugcuuggc

SEQ ID NO: 588032 - RNA, 22 nt, Human
auggauaacccaguucauuucu

SEQ ID NO: 588033 - RNA, 19 nt, Human
gccagugugugguacagug

SEQ ID NO: 588034 - RNA, 22 nt, Human
gaugucuuggucaacuugggcu

SEQ ID NO: 588035 - RNA, 22 nt, Human
ccugggaaguuguggcugcagu

SEQ ID NO: 588036 - RNA, 22 nt, Human
agcaucugcauaaugccuuccc

SEQ ID NO: 588037 - RNA, 22 nt, Human
ugagcagaagcccuccuggacu

SEQ ID NO: 588038 - RNA, 22 nt, Human
accugcaggggugcucucuggg

SEQ ID NO: 588039 - RNA, 22 nt, Human
aauucauccaugaacaauucca

SEQ ID NO: 588040 - RNA, 22 nt, Human
cagugucucaaaacaaguugcu

SEQ ID NO: 588041 - RNA, 22 nt, Human
cuggcagucugguggaaggccu

SEQ ID NO: 588042 - RNA, 22 nt, Human
uguguguguuuauaaaucuaaa

SEQ ID NO: 588043 - RNA, 22 nt, Human
uacauugacuuggauuguuaga

SEQ ID NO: 588044 - RNA, 22 nt, Human
agcugugggauuugggugugcc

SEQ ID NO: 588045 - RNA, 22 nt, Human
aggaaugugaccacuagacucu

SEQ ID NO: 588046 - RNA, 22 nt, Human
agcuaagacuuagugacuuagu

SEQ ID NO: 588047 - RNA, 22 nt, Human
uagagguagauggucagccaau

SEQ ID NO: 588048 - RNA, 22 nt, Human
gcuucugugguugucacgacua

SEQ ID NO: 588049 - RNA, 22 nt, Human
cugccucuccccagaguggccc

SEQ ID NO: 588050 - RNA, 22 nt, Human
uccugggaggcaggaccccuuu

SEQ ID NO: 588051 - RNA, 22 nt, Human
acauucauugagcaacaacaau

SEQ ID NO: 588052 - RNA, 22 nt, Human
gcugaggacaucauggaaggaa

SEQ ID NO: 588053 - RNA, 22 nt, Human
uuaacauacaucaugaacaaug

SEQ ID NO: 588054 - RNA, 22 nt, Human
ggagcugcauuuagggagccuu

SEQ ID NO: 588055 - RNA, 22 nt, Human
cccuuucuccagaacugucuga

SEQ ID NO: 588056 - RNA, 22 nt, Human
gguaaaaugcagauucuuagcc

SEQ ID NO: 588057 - RNA, 22 nt, Human
caccuuugaccuugcagcgcac

SEQ ID NO: 588058 - RNA, 22 nt, Human
agcccagccggauucccaguuc

SEQ ID NO: 588059 - RNA, 22 nt, Human
cuagagaaacagugcucugaac

SEQ ID NO: 588060 - RNA, 22 nt, Human
ucuccuggauggaccuucucuu

SEQ ID NO: 588061 - RNA, 22 nt, Human
gaugcuuaagauguugguggca

SEQ ID NO: 588062 - RNA, 22 nt, Human
ugaggcuggaugggaugccucc

SEQ ID NO: 588063 - RNA, 22 nt, Human
aguucuuuucuagauucuggau

SEQ ID NO: 588064 - RNA, 22 nt, Human
ugagcagaugugccaaacugua

SEQ ID NO: 588065 - RNA, 22 nt, Human
uugcaguuuucugccucauuuc

SEQ ID NO: 588066 - RNA, 22 nt, Human
agccagcugugggcucaggcgg

SEQ ID NO: 588067 - RNA, 22 nt, Human
guuguuuguaaugacaggagac

SEQ ID NO: 588068 - RNA, 22 nt, Human
uuuaauguagcgugaaaugauu

SEQ ID NO: 588069 - RNA, 22 nt, Human
uuuuggaacacagacauuagaa

SEQ ID NO: 588070 - RNA, 22 nt, Human
uaaggaggcgagguggugagca

SEQ ID NO: 588071 - RNA, 22 nt, Human
uucuuuuccuguggcucaucca

SEQ ID NO: 588072 - RNA, 22 nt, Human
cuguuaauggaggacuacagga

SEQ ID NO: 588073 - RNA, 22 nt, Human
uuuugcuuuaagauggagagga

SEQ ID NO: 588074 - RNA, 22 nt, Human
uggcauggccagugcugggagu

SEQ ID NO: 588075 - RNA, 22 nt, Human
gaguaacauaccaaaauucaca

SEQ ID NO: 588076 - RNA, 22 nt, Human
aagaaaacguuuugaggaguuu

SEQ ID NO: 588077 - RNA, 22 nt, Human
gcugggcagugagugaguccuu

SEQ ID NO: 588078 - RNA, 22 nt, Human
gcagcagaguuugggagauggu

SEQ ID NO: 588079 - RNA, 22 nt, Human
ugggggugcccuaugaggaagc

SEQ ID NO: 588080 - RNA, 22 nt, Human
agggccagccgacuuccagccu

SEQ ID NO: 588081 - RNA, 22 nt, Human
cagaagcugaggagugaggcaa

SEQ ID NO: 588082 - RNA, 22 nt, Human
ccaaagaaacccaagcucaggg

SEQ ID NO: 588083 - RNA, 22 nt, Human
cucccuggcacagcgagagguu

SEQ ID NO: 588084 - RNA, 22 nt, Human
aaacugguaaucggcaagugag

SEQ ID NO: 588085 - RNA, 22 nt, Human
cugcagagaccuaggucagguu

SEQ ID NO: 588086 - RNA, 22 nt, Human
caaggaaaacagaugaucaaca

SEQ ID NO: 588087 - RNA, 22 nt, Human
uguguccauucaggcacugacc

SEQ ID NO: 588088 - RNA, 22 nt, Human
gucuccuggaaauaugcccaua

SEQ ID NO: 588089 - RNA, 22 nt, Human
acaaauggaacaaugaagacug

SEQ ID NO: 588090 - RNA, 22 nt, Human
ccacccugugcaggcgugggua

SEQ ID NO: 588091 - RNA, 22 nt, Human
cuguuaagcaacaugaguaagu

SEQ ID NO: 588092 - RNA, 22 nt, Human
ucuauuuaccaaauguaguucc

SEQ ID NO: 588093 - RNA, 22 nt, Human
gauggagucugaagcugggaac

SEQ ID NO: 588094 - RNA, 17 nt, Human
ccugaaggcacuuccag

SEQ ID NO: 588095 - RNA, 22 nt, Human
aaugaagaaauggacaucuuua

SEQ ID NO: 588096 - RNA, 22 nt, Human
ugaucuuuuuggucauuugggu

SEQ ID NO: 588097 - RNA, 18 nt, Human
aggcacagagcauacaua

SEQ ID NO: 588098 - RNA, 22 nt, Human
agcaccagcucaaggugcaccu

SEQ ID NO: 588099 - RNA, 22 nt, Human
uucaguuucguuaucuaugaga

SEQ ID NO: 588100 - RNA, 21 nt, Human
gggagcuggaaacugggugac

SEQ ID NO: 588101 - RNA, 22 nt, Human
aucuggaaaacacaguguagac

SEQ ID NO: 588102 - RNA, 22 nt, Human
acaaauuggguaugagcuaaga

SEQ ID NO: 588103 - RNA, 22 nt, Human
uucucugggaucuggcaaaagg

SEQ ID NO: 588104 - RNA, 22 nt, Human
cugauacauaguagcaugucau

SEQ ID NO: 588105 - RNA, 22 nt, Human
cagagcuggguuugggaaaccu

SEQ ID NO: 588106 - RNA, 22 nt, Human
ggcuccugggcagcugcucccu

SEQ ID NO: 588107 - RNA, 22 nt, Human
auggcacagugggaaaugaccu

SEQ ID NO: 588108 - RNA, 22 nt, Human
ggagugggaacaaugacauggu

SEQ ID NO: 588109 - RNA, 22 nt, Human
ugcugcagaucagcugaguccu

SEQ ID NO: 588110 - RNA, 22 nt, Human
gggggcagaauguacucuuguc

SEQ ID NO: 588111 - RNA, 22 nt, Human
agcuucagauuuaucuuucugu

SEQ ID NO: 588112 - RNA, 19 nt, Human
gccucugcuggggacaggc

SEQ ID NO: 588113 - RNA, 22 nt, Human
gcaaacauucaggaguacagga

SEQ ID NO: 588114 - RNA, 21 nt, Human
uuucuggguggcugcauagug

SEQ ID NO: 588115 - RNA, 22 nt, Human
cagagcuguauuuaucuuucca

SEQ ID NO: 588116 - RNA, 22 nt, Human
ucugcugaauggagccaaccuc

SEQ ID NO: 588117 - RNA, 22 nt, Human
gcaggugggggucggugcaucu

SEQ ID NO: 588118 - RNA, 22 nt, Human
augaguuaggggccugagugga

SEQ ID NO: 588119 - RNA, 22 nt, Human
aggcccuguuaugagccacugu

SEQ ID NO: 588120 - RNA, 22 nt, Human
uuuagcaucgaaguaaauuuag

SEQ ID NO: 588121 - RNA, 22 nt, Human
caaaggcaguuacugaaugaag

SEQ ID NO: 588122 - RNA, 22 nt, Human
gaaaucuacgauuagugaaaau

SEQ ID NO: 588123 - RNA, 22 nt, Human
gagggguggcccuggcguguac

SEQ ID NO: 588124 - RNA, 22 nt, Human
aaccagcugagaaugcuucugc

SEQ ID NO: 588125 - RNA, 22 nt, Human
aauucugaugagucagagaaag

SEQ ID NO: 588126 - RNA, 22 nt, Human
cugcacaggggaugagggcagu

SEQ ID NO: 588127 - RNA, 22 nt, Human
uuaauaaaguaugaauuggaaa

SEQ ID NO: 588128 - RNA, 23 nt, Human
aaaugugagggaaaaucuuucug

SEQ ID NO: 588129 - RNA, 22 nt, Human
augcaaaaguaguugcaguuuu

SEQ ID NO: 588130 - RNA, 22 nt, Human
augcacuacuuggcuuuacuga

SEQ ID NO: 588131 - RNA, 22 nt, Human
agcucaagcuacacacagaguc

SEQ ID NO: 588132 - RNA, 22 nt, Human
gggagcuuaagacaguuccaau

SEQ ID NO: 588133 - RNA, 22 nt, Human
uauuguacaugguuaugcagga

SEQ ID NO: 588134 - RNA, 22 nt, Human
cuuucucugugugguaaagggc

SEQ ID NO: 588135 - RNA, 22 nt, Human
ucaugggguuuggcuggauguc

SEQ ID NO: 588136 - RNA, 22 nt, Human
gagcaguaggagaacccugagc

SEQ ID NO: 588137 - RNA, 22 nt, Human
agcacagauaacauggagugga

SEQ ID NO: 588138 - RNA, 22 nt, Human
ucccucagagaccguggugcag

SEQ ID NO: 588139 - RNA, 22 nt, Human
ugccacaguuucauggauucug

SEQ ID NO: 588140 - RNA, 22 nt, Human
cgaggccacaccugcuucuggg

SEQ ID NO: 588141 - RNA, 22 nt, Human
cuguguagucagguggucccac

SEQ ID NO: 588142 - RNA, 22 nt, Human
uuggcucagugugagggagaug

SEQ ID NO: 588143 - RNA, 22 nt, Human
guagcugucucggucaggaguu

SEQ ID NO: 588144 - RNA, 22 nt, Human
acacuaagguuggagucacagu

SEQ ID NO: 588145 - RNA, 22 nt, Human
gcuggagugcuggagugcagug

SEQ ID NO: 588146 - RNA, 22 nt, Human
uuuucuaucuccuagaacugcc

SEQ ID NO: 588147 - RNA, 22 nt, Human
uuagcaaaguuugccaucuagu

SEQ ID NO: 588148 - RNA, 18 nt, Human
gaggaaacaggcucugug

SEQ ID NO: 588149 - RNA, 21 nt, Human
agagcacagguggacaaugcu

SEQ ID NO: 588150 - RNA, 22 nt, Human
aggcagcuuaagcccuggccca

SEQ ID NO: 588151 - RNA, 22 nt, Human
ugagcuguauauuguuuuaaua

SEQ ID NO: 588152 - RNA, 19 nt, Human
uggcugagcuggacugagg

SEQ ID NO: 588153 - RNA, 22 nt, Human
guuuucuaggauccccuccaag

SEQ ID NO: 588154 - RNA, 22 nt, Human
agcugcccuuuaugaugcugaa

SEQ ID NO: 588155 - RNA, 19 nt, Human
gaacaaacuuaaacuuuuc

SEQ ID NO: 588156 - RNA, 22 nt, Human
aguucuuuugugaacauaugcu

SEQ ID NO: 588157 - RNA, 22 nt, Human
gaggcagagguuguugcaguga

SEQ ID NO: 588158 - RNA, 22 nt, Human
caggacagaccaagaucgugcu

SEQ ID NO: 588159 - RNA, 22 nt, Human
agucucuuaauuuuuucuaagu

SEQ ID NO: 588160 - RNA, 22 nt, Human
aggcuuagaaauucagcugagu

SEQ ID NO: 588161 - RNA, 22 nt, Human
gggcggggggagcuggaaugaa

SEQ ID NO: 588162 - RNA, 22 nt, Human
gacaggcaguuuuccagaucag

SEQ ID NO: 588163 - RNA, 22 nt, Human
auugagaauccauuugagauga

SEQ ID NO: 588164 - RNA, 22 nt, Human
aagaugaaaauuuacugugaug

SEQ ID NO: 588165 - RNA, 22 nt, Human
ccagagcugaugggcccagggu

SEQ ID NO: 588166 - RNA, 22 nt, Human
ugcucugggauucagcagccug

SEQ ID NO: 588167 - RNA, 22 nt, Human
cugggaggacaacuuggagcuc

SEQ ID NO: 588168 - RNA, 22 nt, Human
agcuucugcccguguuugcucu

SEQ ID NO: 588169 - RNA, 22 nt, Human
uucuucaaugugcccuguuuuc

SEQ ID NO: 588170 - RNA, 21 nt, Human
ugaggccucuccugggcuggc

SEQ ID NO: 588171 - RNA, 22 nt, Human
cauggccuugagugacugcacu

SEQ ID NO: 588172 - RNA, 22 nt, Human
aacacuuucuauuauuaugguu

SEQ ID NO: 588173 - RNA, 22 nt, Human
uuagugaaaagaaaaugagugg

SEQ ID NO: 588174 - RNA, 22 nt, Human
cuucacagcaugagcuuuggag

SEQ ID NO: 588175 - RNA, 22 nt, Human
gaagcagcaaguauaggacagg

SEQ ID NO: 588176 - RNA, 22 nt, Human
aaauuucuaagucaagaagaac

SEQ ID NO: 588177 - RNA, 23 nt, Human
ucugagcugucuuuucagcagaa

SEQ ID NO: 588178 - RNA, 22 nt, Human
cucuaaauccacgguauaguug

SEQ ID NO: 588179 - RNA, 22 nt, Human
caggccuggagugcaauggcac

SEQ ID NO: 588180 - RNA, 18 nt, Human
uuggaccugugucagggc

SEQ ID NO: 588181 - RNA, 22 nt, Human
uccuuucccuuuccauccuggc

SEQ ID NO: 588182 - RNA, 22 nt, Human
cuggcucucugagauauugagu

SEQ ID NO: 588183 - RNA, 22 nt, Human
ugggugugcccagauggugucc

SEQ ID NO: 588184 - RNA, 22 nt, Human
ugcaaacaccacagagacaauu

SEQ ID NO: 588185 - RNA, 22 nt, Human
gagcgcgccacaaggagcggcg

SEQ ID NO: 588186 - RNA, 22 nt, Human
cucagggacaaggggagacccc

SEQ ID NO: 588187 - RNA, 23 nt, Human
cagggcccugcucaauuucucca

SEQ ID NO: 588188 - RNA, 22 nt, Human
cccccaaaguuugcacggauaa

SEQ ID NO: 588189 - RNA, 22 nt, Human
gcccaaagccagugugcucucc

SEQ ID NO: 588190 - RNA, 22 nt, Human
augugaaacgcaaugggaucau

SEQ ID NO: 588191 - RNA, 22 nt, Human
uuucaaagggaaguuaugaagu

SEQ ID NO: 588192 - RNA, 22 nt, Human
ugggccucaccuucuuggcagc

SEQ ID NO: 588193 - RNA, 23 nt, Human
ucugagguggcucuugcuuugaa

SEQ ID NO: 588194 - RNA, 22 nt, Human
uugaugagaccauugccgcguc

SEQ ID NO: 588195 - RNA, 22 nt, Human
acaggaauuuccuaauauucga

SEQ ID NO: 588196 - RNA, 22 nt, Human
ggucagccccugcucaaggccg

SEQ ID NO: 588197 - RNA, 22 nt, Human
uaacacuuuggauuaaaauucu

SEQ ID NO: 588198 - RNA, 22 nt, Human
cugagcccaggcgggagcugag

SEQ ID NO: 588199 - RNA, 22 nt, Human
agguaggcccugagugcuguug

SEQ ID NO: 588200 - RNA, 22 nt, Human
agaucacuuugaugcuaccugg

SEQ ID NO: 588201 - RNA, 22 nt, Human
cugagaaacauauuuccaucua

SEQ ID NO: 588202 - RNA, 22 nt, Human
uuacaguacagaaaauaacaga

SEQ ID NO: 588203 - RNA, 22 nt, Human
uauuugcaacauaaaacucuga

SEQ ID NO: 588204 - RNA, 20 nt, Human
gagugggccauggagugaga

SEQ ID NO: 588205 - RNA, 22 nt, Human
uaacagaagaugaaacuucuuu

SEQ ID NO: 588206 - RNA, 22 nt, Human
cagcagcugauggggaagugau

SEQ ID NO: 588207 - RNA, 22 nt, Human
gcggguggaucaugaggucagg

SEQ ID NO: 588208 - RNA, 22 nt, Human
ccuccuggagcauuggugagga

SEQ ID NO: 588209 - RNA, 21 nt, Human
ucaggcaggucccacugaaca

SEQ ID NO: 588210 - RNA, 22 nt, Human
gcuguugcaaucaaggccaugg

SEQ ID NO: 588211 - RNA, 22 nt, Human
ggggccgaccgcgguucaggcc

SEQ ID NO: 588212 - RNA, 22 nt, Human
uauuguccaauaggauguuccu

SEQ ID NO: 588213 - RNA, 22 nt, Human
ccaauauuaugaaagugugaca

SEQ ID NO: 588214 - RNA, 22 nt, Human
auuuucauggcuucugcucagu

SEQ ID NO: 588215 - RNA, 18 nt, Human
uguggcaggggugggaga

SEQ ID NO: 588216 - RNA, 22 nt, Human
caccagcaccagcucugugccu

SEQ ID NO: 588217 - RNA, 21 nt, Human
ccugggagaucagcugccuuc

SEQ ID NO: 588218 - RNA, 16 nt, Human
ggcaccagugaacaca

SEQ ID NO: 588219 - RNA, 22 nt, Human
uaaggaaaguacauguuuugac

SEQ ID NO: 588220 - RNA, 22 nt, Human
ccugcagaaaggguccccagga

SEQ ID NO: 588221 - RNA, 22 nt, Human
ucuuggccacuaccaccuggag

SEQ ID NO: 588222 - RNA, 22 nt, Human
cuggccagcugacagcagggcu

SEQ ID NO: 588223 - RNA, 21 nt, Human
cacagaauauacauuuuaguu

SEQ ID NO: 588224 - RNA, 22 nt, Human
uaccaugucuucaauaagucua

SEQ ID NO: 588225 - RNA, 22 nt, Human
cuggcuuuagguuggagagcug

SEQ ID NO: 588226 - RNA, 22 nt, Human
gcucucugccuuucucaaugac

SEQ ID NO: 588227 - RNA, 22 nt, Human
cugcugucaaaaaucacuccau

SEQ ID NO: 588228 - RNA, 22 nt, Human
ggugacauuaucauuauuuuaa

SEQ ID NO: 588229 - RNA, 22 nt, Human
uccugacucugguguccucuac

SEQ ID NO: 588230 - RNA, 22 nt, Human
aggaaacuucagaguuuugguc

SEQ ID NO: 588231 - RNA, 22 nt, Human
uccuguggaagacaguguuggg

SEQ ID NO: 588232 - RNA, 22 nt, Human
agcuuuggagcugggugaaaga

SEQ ID NO: 588233 - RNA, 22 nt, Human
aaucgguugaacccaggaagug

SEQ ID NO: 588234 - RNA, 22 nt, Human
aacaugaaaaccuccacagcaa

SEQ ID NO: 588235 - RNA, 22 nt, Human
gcuggcuuuguggucucuccuc

SEQ ID NO: 588236 - RNA, 22 nt, Human
gaugucuuacuaacuagccuuu

SEQ ID NO: 588237 - RNA, 22 nt, Human
cugggcuucucccccuggcaga

SEQ ID NO: 588238 - RNA, 22 nt, Human
acuugguguauuagcucucacu

SEQ ID NO: 588239 - RNA, 22 nt, Human
agauggaguuaguaccagaguc

SEQ ID NO: 588240 - RNA, 22 nt, Human
gcccagagggaagaggugucau

SEQ ID NO: 588241 - RNA, 22 nt, Human
cugcuuuaccaaacucuuggau

SEQ ID NO: 588242 - RNA, 22 nt, Human
uuucaaagguuuugucaugucu

SEQ ID NO: 588243 - RNA, 22 nt, Human
uugguacauguuaaggaagagu

SEQ ID NO: 588244 - RNA, 22 nt, Human
cuggguguagcccaguaugagg

SEQ ID NO: 588245 - RNA, 22 nt, Human
uccuggagauaauugcagugaa

SEQ ID NO: 588246 - RNA, 22 nt, Human
cuggagauacugcucuccauau

SEQ ID NO: 588247 - RNA, 22 nt, Human
uuuauauccaucuuugaaguaa

SEQ ID NO: 588248 - RNA, 22 nt, Human
aggacugggugcagagggcauc

SEQ ID NO: 588249 - RNA, 22 nt, Human
ucauuucucccggccaaaaacu

SEQ ID NO: 588250 - RNA, 18 nt, Human
acuucucauuucucugca

SEQ ID NO: 588251 - RNA, 22 nt, Human
cuggagucggcgccccaacaga

SEQ ID NO: 588252 - RNA, 22 nt, Human
guucugucugagcaccacagga

SEQ ID NO: 588253 - RNA, 22 nt, Human
uagccggguguugugucaugca

SEQ ID NO: 588254 - RNA, 22 nt, Human
cugggcuaauuaagcacagcug

SEQ ID NO: 588255 - RNA, 22 nt, Human
aagaguuaaaugaaugaguggg

SEQ ID NO: 588256 - RNA, 22 nt, Human
uaacacauauuucaagaguagu

SEQ ID NO: 588257 - RNA, 22 nt, Human
uugcugauaaaauaaaccaaga

SEQ ID NO: 588258 - RNA, 20 nt, Human
agcccuguuuccuggagaga

SEQ ID NO: 588259 - RNA, 22 nt, Human
uguccccuuuaccuccgcagcc

SEQ ID NO: 588260 - RNA, 21 nt, Human
cacaccaaacaggaacaggga

SEQ ID NO: 588261 - RNA, 22 nt, Human
ggccuuggggaggauggugucc

SEQ ID NO: 588262 - RNA, 22 nt, Human
acccugggaccuggagguggau

SEQ ID NO: 588263 - RNA, 22 nt, Human
ucucuggcuccugccgggucca

SEQ ID NO: 588264 - RNA, 22 nt, Human
guguccuuauaagaagagaugc

SEQ ID NO: 588265 - RNA, 22 nt, Human
auaauuuacaacugcuuuuaau

SEQ ID NO: 588266 - RNA, 22 nt, Human
aacacugaaaugucuuaagauu

SEQ ID NO: 588267 - RNA, 22 nt, Human
cagucacacaaguggacuuggg

SEQ ID NO: 588268 - RNA, 19 nt, Human
uucuccaggcugcagaggg

SEQ ID NO: 588269 - RNA, 22 nt, Human
ccagccuugcaccgagccagcc

SEQ ID NO: 588270 - RNA, 22 nt, Human
cucaggagacaguguccacaug

SEQ ID NO: 588271 - RNA, 22 nt, Human
gcagaggaucaggcucuggaaa

SEQ ID NO: 588272 - RNA, 22 nt, Human
cuuugcagaaauaaacuugaug

SEQ ID NO: 588273 - RNA, 22 nt, Human
cugaacauucuugaacaucugu

SEQ ID NO: 588274 - RNA, 22 nt, Human
cccucaggagaugucagcugga

SEQ ID NO: 588275 - RNA, 22 nt, Human
uuaucacuuaugagcuuuuugc

SEQ ID NO: 588276 - RNA, 22 nt, Human
uccauuuuagaagaaaauccac

SEQ ID NO: 588277 - RNA, 22 nt, Human
ugugggaagauguugcaggaga

SEQ ID NO: 588278 - RNA, 22 nt, Human
guggaguggccuggcccugaga

SEQ ID NO: 588279 - RNA, 22 nt, Human
ugcccagccaguuuaugguaau

SEQ ID NO: 588280 - RNA, 22 nt, Human
uccaggaggugaggggaccaaa

SEQ ID NO: 588281 - RNA, 22 nt, Human
gggcuguaggagcuggaauggg

SEQ ID NO: 588282 - RNA, 17 nt, Human
uggaagcuucauguugg

SEQ ID NO: 588283 - RNA, 22 nt, Human
aagucaauuaguaaacuuggaa

SEQ ID NO: 588284 - RNA, 22 nt, Human
aaacacugauggauauuuuucc

SEQ ID NO: 588285 - RNA, 22 nt, Human
uaccuuugaucuggaauuuuaa

SEQ ID NO: 588286 - RNA, 22 nt, Human
agcugggacucaacugucuggg

SEQ ID NO: 588287 - RNA, 22 nt, Human
ggcaggugugagcuguaaagga

SEQ ID NO: 588288 - RNA, 22 nt, Human
ggguggugagauguagcugaug

SEQ ID NO: 588289 - RNA, 22 nt, Human
uuacuuuaugugauggauuagu

SEQ ID NO: 588290 - RNA, 22 nt, Human
aucuacagcugucugcacagua

SEQ ID NO: 588291 - RNA, 20 nt, Human
uccaaagaaguucacauuua

SEQ ID NO: 588292 - RNA, 22 nt, Human
agggccuggaacuggagaccac

SEQ ID NO: 588293 - RNA, 22 nt, Human
uauaggaaggcagauuuuagcu

SEQ ID NO: 588294 - RNA, 22 nt, Human
gcuggcccagugacccacagug

SEQ ID NO: 588295 - RNA, 22 nt, Human
cauggaucauaaaugugcuaaa

SEQ ID NO: 588296 - RNA, 22 nt, Human
aggcugcuggcaggcguggacg

SEQ ID NO: 588297 - RNA, 22 nt, Human
auggaagaguccccauggauga

SEQ ID NO: 588298 - RNA, 22 nt, Human
cuggagucuccccaggagcgug

SEQ ID NO: 588299 - RNA, 22 nt, Human
ucagaaauaaugaaugaugggg

SEQ ID NO: 588300 - RNA, 22 nt, Human
uaugagguagguauuauacuua

SEQ ID NO: 588301 - RNA, 22 nt, Human
uucuaugucagugugcucugug

SEQ ID NO: 588302 - RNA, 22 nt, Human
aaguuacagucagagguuaaca

SEQ ID NO: 588303 - RNA, 22 nt, Human
ugaaaucuccucuuuauauauc

SEQ ID NO: 588304 - RNA, 21 nt, Human
uucuccaggcaaccauuucag

SEQ ID NO: 588305 - RNA, 22 nt, Human
agccuguggaucccugcacugg

SEQ ID NO: 588306 - RNA, 22 nt, Human
acacugugcuuagaugcugaac

SEQ ID NO: 588307 - RNA, 17 nt, Human
ucugggcuucagugguc

SEQ ID NO: 588308 - RNA, 22 nt, Human
uguucccaagauaagauuauga

SEQ ID NO: 588309 - RNA, 22 nt, Human
ccugccagauccccugagcuga

SEQ ID NO: 588310 - RNA, 22 nt, Human
cuaauuuaaugaaugagucuua

SEQ ID NO: 588311 - RNA, 22 nt, Human
uccuccagagauuugaguuauu

SEQ ID NO: 588312 - RNA, 22 nt, Human
gccagucugcucccacaaguuc

SEQ ID NO: 588313 - RNA, 22 nt, Human
ucugggugcccuuugcucuguu

SEQ ID NO: 588314 - RNA, 22 nt, Human
ugaggcaggaguucaggcugcg

SEQ ID NO: 588315 - RNA, 22 nt, Human
caaguagaacagagcuaccuug

SEQ ID NO: 588316 - RNA, 22 nt, Human
gcagucuccauauacauuuaca

SEQ ID NO: 588317 - RNA, 18 nt, Human
ugaggccagagugggcau

SEQ ID NO: 588318 - RNA, 22 nt, Human
uuuauuugucuugccauuuagu

SEQ ID NO: 588319 - RNA, 22 nt, Human
aacagcagggacuugaauggaa

SEQ ID NO: 588320 - RNA, 22 nt, Human
caucacaguuugucagaaauca

SEQ ID NO: 588321 - RNA, 22 nt, Human
auuaggauuugguauggucaua

SEQ ID NO: 588322 - RNA, 22 nt, Human
ccuuagcaacacuuagcaacug

SEQ ID NO: 588323 - RNA, 22 nt, Human
gagcuucagaauuuaacagacu

SEQ ID NO: 588324 - RNA, 22 nt, Human
aggugggguguuggauguuuau

SEQ ID NO: 588325 - RNA, 22 nt, Human
agauacugaaauccaauggcca

SEQ ID NO: 588326 - RNA, 22 nt, Human
cuggagcucuccagagccccgu

SEQ ID NO: 588327 - RNA, 19 nt, Human
ugccccuuaagaguuucuc

SEQ ID NO: 588328 - RNA, 22 nt, Human
uucacaauuucccuucaucagg

SEQ ID NO: 588329 - RNA, 22 nt, Human
cugcacagggauauggggagcu

SEQ ID NO: 588330 - RNA, 22 nt, Human
aauguggggaagccauggcuga

SEQ ID NO: 588331 - RNA, 22 nt, Human
aaagcagugcugugagaacacu

SEQ ID NO: 588332 - RNA, 22 nt, Human
uggcaagagggaugcaagguuu

SEQ ID NO: 588333 - RNA, 22 nt, Human
gugugcagaggcaggaggugcu

SEQ ID NO: 588334 - RNA, 22 nt, Human
agaggcacccgcgcgcggccau

SEQ ID NO: 588335 - RNA, 22 nt, Human
aaauuugauaagccauuguuac

SEQ ID NO: 588336 - RNA, 22 nt, Human
cuacuuguucacuguaggucgc

SEQ ID NO: 588337 - RNA, 22 nt, Human
aucuacucaguaacugcuuagg

SEQ ID NO: 588338 - RNA, 22 nt, Human
ucugccuggguguggagcagag

SEQ ID NO: 588339 - RNA, 22 nt, Human
cugcuuuaacaaggcugaucag

SEQ ID NO: 588340 - RNA, 22 nt, Human
guacauuuacugaugaaaagua

SEQ ID NO: 588341 - RNA, 22 nt, Human
gaaggcccgcccugagcaaggg

SEQ ID NO: 588342 - RNA, 22 nt, Human
gggcauggcgugugcuggauuc

SEQ ID NO: 588343 - RNA, 22 nt, Human
gaaucuuauuuuuaaaucuucc

SEQ ID NO: 588344 - RNA, 18 nt, Human
cugugcagcaaacugagc

SEQ ID NO: 588345 - RNA, 22 nt, Human
cuguguguuuauaucauuuccu

SEQ ID NO: 588346 - RNA, 22 nt, Human
uacaugaacaaaauagcagaaa

SEQ ID NO: 588347 - RNA, 22 nt, Human
uaauuuugucacagugacaugc

SEQ ID NO: 588348 - RNA, 22 nt, Human
acaggccugugugcacacgagg

SEQ ID NO: 588349 - RNA, 22 nt, Human
acagcagcaauagcagugacau

SEQ ID NO: 588350 - RNA, 22 nt, Human
auugugaauugagaguacuucu

SEQ ID NO: 588351 - RNA, 20 nt, Human
gggggccagcagcagacgcc

SEQ ID NO: 588352 - RNA, 22 nt, Human
agcugguggaagggagcccaaa

SEQ ID NO: 588353 - RNA, 22 nt, Human
uggacacaauguugccuuaggg

SEQ ID NO: 588354 - RNA, 22 nt, Human
ccauuuaacacagaguuuucca

SEQ ID NO: 588355 - RNA, 22 nt, Human
gccaggcucaguagcgauuccu

SEQ ID NO: 588356 - RNA, 22 nt, Human
aaggagaaaugguagaugugca

SEQ ID NO: 588357 - RNA, 22 nt, Human
caggcaccugugugucucaggg

SEQ ID NO: 588358 - RNA, 22 nt, Human
uucagcauagcagcuucaggac

SEQ ID NO: 588359 - RNA, 21 nt, Human
aguugcugcugcugcagguga

SEQ ID NO: 588360 - RNA, 22 nt, Human
auaaagcaagcauaccauuaag

SEQ ID NO: 588361 - RNA, 22 nt, Human
cagggcuucgcuccuggugcac

SEQ ID NO: 588362 - RNA, 22 nt, Human
guggggguuucauuaagacaau

SEQ ID NO: 588363 - RNA, 22 nt, Human
uggcccaggggcucuugguguu

SEQ ID NO: 588364 - RNA, 22 nt, Human
cucugggcaggacgccaggccu

SEQ ID NO: 588365 - RNA, 22 nt, Human
gccagccacaagggaggcuugu

SEQ ID NO: 588366 - RNA, 22 nt, Human
agcccagguugaggcugcagug

SEQ ID NO: 588367 - RNA, 22 nt, Human
acagaauugauggaaaucucag

SEQ ID NO: 588368 - RNA, 22 nt, Human
cugggcauauacgugcaaguca

SEQ ID NO: 588369 - RNA, 22 nt, Human
acugauuucagggaugagaaga

SEQ ID NO: 588370 - RNA, 22 nt, Human
ccaggcuggagugcaauggugc

SEQ ID NO: 588371 - RNA, 22 nt, Human
aggcccuggcacugccugggag

SEQ ID NO: 588372 - RNA, 22 nt, Human
cacugcuuaguugguaaaugug

SEQ ID NO: 588373 - RNA, 22 nt, Human
uuaccauuccaugacaucagga

SEQ ID NO: 588374 - RNA, 20 nt, Human
gucuacacgggcaguguaga

SEQ ID NO: 588375 - RNA, 22 nt, Human
ugggugggagcacccugucugg

SEQ ID NO: 588376 - RNA, 22 nt, Human
uaguuacagugcauagcaagau

SEQ ID NO: 588377 - RNA, 22 nt, Human
caucuaaauuugacuccaagga

SEQ ID NO: 588378 - RNA, 22 nt, Human
aaggaaagaguaugcaccuugu

SEQ ID NO: 588379 - RNA, 22 nt, Human
ugggagagauaggcuucuggac

SEQ ID NO: 588380 - RNA, 22 nt, Human
gagggcugccacguugggcgag

SEQ ID NO: 588381 - RNA, 22 nt, Human
caauaaguaauaggcaucuaau

SEQ ID NO: 588382 - RNA, 22 nt, Human
agcaguuauauuacucucaggu

SEQ ID NO: 588383 - RNA, 22 nt, Human
acagcaggaagcuggagggaaa

SEQ ID NO: 588384 - RNA, 22 nt, Human
agguggguaucaugagagauua

SEQ ID NO: 588385 - RNA, 22 nt, Human
guaguggagucuccuguccugg

SEQ ID NO: 588386 - RNA, 22 nt, Human
ugcugcccacuguauuucucca

SEQ ID NO: 588387 - RNA, 22 nt, Human
aaggcacugaaaaauugugugu

SEQ ID NO: 588388 - RNA, 22 nt, Human
acauaugugucugcacaugccc

SEQ ID NO: 588389 - RNA, 22 nt, Human
ggggcagagaauaaaaaccuaa

SEQ ID NO: 588390 - RNA, 22 nt, Human
cugagcagcaacccagagccuc

SEQ ID NO: 588391 - RNA, 22 nt, Human
gcuggcuccaaaagcaggggcu

SEQ ID NO: 588392 - RNA, 22 nt, Human
gaauuauaggcaaagcagucau

SEQ ID NO: 588393 - RNA, 22 nt, Human
cuggcucuugcgacucagcuug

SEQ ID NO: 588394 - RNA, 22 nt, Human
ccugacaguccuuuucuagugu

SEQ ID NO: 588395 - RNA, 22 nt, Human
gugagcagccucaccugagggu

SEQ ID NO: 588396 - RNA, 22 nt, Human
uauaauuuggggaaaguggugu

SEQ ID NO: 588397 - RNA, 22 nt, Human
gugaaugacuguuuucagcauu

SEQ ID NO: 588398 - RNA, 22 nt, Human
agcuugaguuuuggaugaagug

SEQ ID NO: 588399 - RNA, 21 nt, Human
auggauuuaaacaggccacaa

SEQ ID NO: 588400 - RNA, 22 nt, Human
cuugggcaggggaaacagcugc

SEQ ID NO: 588401 - RNA, 22 nt, Human
gcugagacuggcagcaggaagu

SEQ ID NO: 588402 - RNA, 22 nt, Human
agaucaguaagaggaagaaugg

SEQ ID NO: 588403 - RNA, 22 nt, Human
uagcugacagauacaaucagau

SEQ ID NO: 588404 - RNA, 22 nt, Human
uccaggcugccacagugcaacg

SEQ ID NO: 588405 - RNA, 22 nt, Human
gcaccaggugcagccgggcccc

SEQ ID NO: 588406 - RNA, 22 nt, Human
aauacugagaucccacaaagca

SEQ ID NO: 588407 - RNA, 22 nt, Human
agcugcugggaccccagaucca

SEQ ID NO: 588408 - RNA, 22 nt, Human
ggccccagccucaguccccuga

SEQ ID NO: 588409 - RNA, 22 nt, Human
gugccuggcacacagaaggcaa

SEQ ID NO: 588410 - RNA, 22 nt, Human
uucucuugugccaaguuguugc

SEQ ID NO: 588411 - RNA, 22 nt, Human
acgugcaggaucugguuggcga

SEQ ID NO: 588412 - RNA, 22 nt, Human
cugggcagccucacacaauguu

SEQ ID NO: 588413 - RNA, 22 nt, Human
uccagagggcgauggcuggggg

SEQ ID NO: 588414 - RNA, 22 nt, Human
aguccuuacaccuggaaccuau

SEQ ID NO: 588415 - RNA, 20 nt, Human
ccugucuccucuuaccuggc

SEQ ID NO: 588416 - RNA, 22 nt, Human
uaucuucaauuuauucaaggag

SEQ ID NO: 588417 - RNA, 22 nt, Human
ccugagcugacucuccuuucag

SEQ ID NO: 588418 - RNA, 22 nt, Human
augaggcauagcagggaucgga

SEQ ID NO: 588419 - RNA, 22 nt, Human
ugcuccagcgcugccaccaguu

SEQ ID NO: 588420 - RNA, 16 nt, Human
auuguuuucaauuaga

SEQ ID NO: 588421 - RNA, 22 nt, Human
auuaaauacugcaggcuaagca

SEQ ID NO: 588422 - RNA, 22 nt, Human
aggcccuucuugguggcucagg

SEQ ID NO: 588423 - RNA, 22 nt, Human
ggcucuggaauguguagucagg

SEQ ID NO: 588424 - RNA, 22 nt, Human
cagaagcacuaggaggaaacgu

SEQ ID NO: 588425 - RNA, 22 nt, Human
cauuagguauuuaagcacacag

SEQ ID NO: 588426 - RNA, 22 nt, Human
cagcucccuauggugaggcgac

SEQ ID NO: 588427 - RNA, 22 nt, Human
uacuauaaagucuuaaugaguc

SEQ ID NO: 588428 - RNA, 22 nt, Human
uauugaggugcuuagcuggggg

SEQ ID NO: 588429 - RNA, 22 nt, Human
gaaggccacaagagaaguuaag

SEQ ID NO: 588430 - RNA, 22 nt, Human
ggggccagagaggacccaggug

SEQ ID NO: 588431 - RNA, 22 nt, Human
cagugucuccagaugcuccaau

SEQ ID NO: 588432 - RNA, 22 nt, Human
agggccugcaucaggagcuugg

SEQ ID NO: 588433 - RNA, 22 nt, Human
agacaauuuuugguuuugcaag

SEQ ID NO: 588434 - RNA, 23 nt, Human
ucucccucaugccuaggccuggg

SEQ ID NO: 588435 - RNA, 22 nt, Human
ugaguuaucuaaaauagucaaa

SEQ ID NO: 588436 - RNA, 22 nt, Human
caggccugugaguugaggcccc

SEQ ID NO: 588437 - RNA, 22 nt, Human
caccuuuaaugagcaccagccg

SEQ ID NO: 588438 - RNA, 19 nt, Human
aggcugugaggggaaggaa

SEQ ID NO: 588439 - RNA, 22 nt, Human
uggcuuccacugugugcccccu

SEQ ID NO: 588440 - RNA, 22 nt, Human
aggcuggugauuagaagcagcc

SEQ ID NO: 588441 - RNA, 22 nt, Human
ugaaugaggauccuugaccuua

SEQ ID NO: 588442 - RNA, 22 nt, Human
agacaugccaagaaacccagug

SEQ ID NO: 588443 - RNA, 22 nt, Human
cacuuuauaaaauuggugugag

SEQ ID NO: 588444 - RNA, 22 nt, Human
gaggccugguuugcaugagaau

SEQ ID NO: 588445 - RNA, 22 nt, Human
aaaagcucuuucugcuguagau

SEQ ID NO: 588446 - RNA, 19 nt, Human
cugagcagcggcagcacuu

SEQ ID NO: 588447 - RNA, 22 nt, Human
uauugacagaugcauuauguug

SEQ ID NO: 588448 - RNA, 22 nt, Human
ucaguugcuguguaauguuuuc

SEQ ID NO: 588449 - RNA, 17 nt, Human
aggaaacauuuucuuuc

SEQ ID NO: 588450 - RNA, 17 nt, Human
uucagcaguguuucucc

SEQ ID NO: 588451 - RNA, 22 nt, Human
uggcucuguugugcugagccag

SEQ ID NO: 588452 - RNA, 22 nt, Human
ggugcaggcgguggggcaagua

SEQ ID NO: 588453 - RNA, 22 nt, Human
agagggguuaagugcuaguccg

SEQ ID NO: 588454 - RNA, 22 nt, Human
ugcauuguaggauguuuagcag

SEQ ID NO: 588455 - RNA, 22 nt, Human
guucgcaucuugaucauggacu

SEQ ID NO: 588456 - RNA, 22 nt, Human
agggcugaaguuauggcugagc

SEQ ID NO: 588457 - RNA, 22 nt, Human
cccugcugucaggugcugggag

SEQ ID NO: 588458 - RNA, 22 nt, Human
gguuccccaggcggcccuugga

SEQ ID NO: 588459 - RNA, 22 nt, Human
uggaggugggagggacuguccu

SEQ ID NO: 588460 - RNA, 22 nt, Human
gacauggcuucuaggaagcuuu

SEQ ID NO: 588461 - RNA, 20 nt, Human
agugccagggcaggugagag

SEQ ID NO: 588462 - RNA, 21 nt, Human
gcaggcuggucaaaccucagu

SEQ ID NO: 588463 - RNA, 22 nt, Human
gaucacaugaauggaauagaag

SEQ ID NO: 588464 - RNA, 22 nt, Human
uacugucucugcccuggccagg

SEQ ID NO: 588465 - RNA, 22 nt, Human
cuuuaugaaccuguucagcuug

SEQ ID NO: 588466 - RNA, 22 nt, Human
cuucuuaaauauuuggcugacu

SEQ ID NO: 588467 - RNA, 19 nt, Human
ucaguggagaaaggggaag

SEQ ID NO: 588468 - RNA, 22 nt, Human
gacuguacuugagagaggaacu

SEQ ID NO: 588469 - RNA, 22 nt, Human
cauuuucucaaugaacccucuu

SEQ ID NO: 588470 - RNA, 22 nt, Human
uuguuucagcuguaugcuaugu

SEQ ID NO: 588471 - RNA, 22 nt, Human
caggcugcggccgugugagcau

SEQ ID NO: 588472 - RNA, 22 nt, Human
cagcugaauucuucagacucca

SEQ ID NO: 588473 - RNA, 22 nt, Human
aucuucaucaaguucacagugg

SEQ ID NO: 588474 - RNA, 22 nt, Human
agaggaggccaggcccacaccu

SEQ ID NO: 588475 - RNA, 22 nt, Human
aaggcugaguaaaacagagaac

SEQ ID NO: 588476 - RNA, 22 nt, Human
cacagaggaugcccaagcgauc

SEQ ID NO: 588477 - RNA, 22 nt, Human
gaaaggaacuugugagugggag

SEQ ID NO: 588478 - RNA, 22 nt, Human
gacagagaggcugagcaguaca

SEQ ID NO: 588479 - RNA, 22 nt, Human
ugggcuggugagggaucauuua

SEQ ID NO: 588480 - RNA, 22 nt, Human
aucuuucaguuucauaccaauu

SEQ ID NO: 588481 - RNA, 22 nt, Human
uguuuaaugaagaugguuuuuc

SEQ ID NO: 588482 - RNA, 22 nt, Human
gggccacacagaaccuccuggu

SEQ ID NO: 588483 - RNA, 22 nt, Human
aaggaaaucuuuguaacaucuu

SEQ ID NO: 588484 - RNA, 22 nt, Human
ucuagaaaaacaaaguaucuga

SEQ ID NO: 588485 - RNA, 22 nt, Human
ucagucuccuuuccucuagaca

SEQ ID NO: 588486 - RNA, 22 nt, Human
acuuuggguaagccaggugcua

SEQ ID NO: 588487 - RNA, 22 nt, Human
auccuucuccaaaacuggcucc

SEQ ID NO: 588488 - RNA, 22 nt, Human
gaggccagaaugagucucuggg

SEQ ID NO: 588489 - RNA, 22 nt, Human
uggcauggguggagagagcaca

SEQ ID NO: 588490 - RNA, 22 nt, Human
uuaccacagugccugucuaaug

SEQ ID NO: 588491 - RNA, 22 nt, Human
cauacuuucuuuuucacgcaua

SEQ ID NO: 588492 - RNA, 22 nt, Human
gcagcaguggucuguagaagga

SEQ ID NO: 588493 - RNA, 22 nt, Human
gcagguggggcugcuaccagaa

SEQ ID NO: 588494 - RNA, 22 nt, Human
uuaaggugcuuuauuuagcucu

SEQ ID NO: 588495 - RNA, 19 nt, Human
ccugucugucuucagcuag

SEQ ID NO: 588496 - RNA, 22 nt, Human
cagguugaaaguggaggagcua

SEQ ID NO: 588497 - RNA, 22 nt, Human
uaggccaaaugacuugauguuu

SEQ ID NO: 588498 - RNA, 22 nt, Human
auucucauuugcuggcuauaug

SEQ ID NO: 588499 - RNA, 22 nt, Human
aaagaaggaccuggaggaggau

SEQ ID NO: 588500 - RNA, 22 nt, Human
uacauccaaaugaauuagaauu

SEQ ID NO: 588501 - RNA, 22 nt, Human
aggacuggcccugaggggaggc

SEQ ID NO: 588502 - RNA, 22 nt, Human
guccugguauaauuguuuaaaa

SEQ ID NO: 588503 - RNA, 22 nt, Human
aggguaggaacugaguggaagg

SEQ ID NO: 588504 - RNA, 22 nt, Human
caaagcaaggcucaguuugaac

SEQ ID NO: 588505 - RNA, 22 nt, Human
caguguggugagauuccaggug

SEQ ID NO: 588506 - RNA, 22 nt, Human
uacacaugcucagauuccugug

SEQ ID NO: 588507 - RNA, 22 nt, Human
uuggaaaagugaaacuagaugc

SEQ ID NO: 588508 - RNA, 22 nt, Human
ucugacagggccaaacaugaca

SEQ ID NO: 588509 - RNA, 22 nt, Human
gauguguaacaugcugugacau

SEQ ID NO: 588510 - RNA, 22 nt, Human
ucuguaaucaagauauuugaga

SEQ ID NO: 588511 - RNA, 22 nt, Human
uucauucaucucuaaaaugccu

SEQ ID NO: 588512 - RNA, 22 nt, Human
ccaggcugugguuuagauagag

SEQ ID NO: 588513 - RNA, 22 nt, Human
augaucagcaguuuucaguguu

SEQ ID NO: 588514 - RNA, 22 nt, Human
aagaagcuguagggauuaacuc

SEQ ID NO: 588515 - RNA, 22 nt, Human
caugucagggaagagagucagu

SEQ ID NO: 588516 - RNA, 22 nt, Human
gggaggaaagagaaguggucca

SEQ ID NO: 588517 - RNA, 22 nt, Human
guuaugauugaaauuccaguuu

SEQ ID NO: 588518 - RNA, 22 nt, Human
aaaauaguuaacguucagagua

SEQ ID NO: 588519 - RNA, 22 nt, Human
ggcuuuaaggaguaaaaaugcc

SEQ ID NO: 588520 - RNA, 22 nt, Human
uggaaacugugguauuucuuua

SEQ ID NO: 588521 - RNA, 22 nt, Human
ccucuggcaacuucacagccca

SEQ ID NO: 588522 - RNA, 22 nt, Human
agagcugcaauuucauguggug

SEQ ID NO: 588523 - RNA, 22 nt, Human
accuugaaggcagaggacaccu

SEQ ID NO: 588524 - RNA, 23 nt, Human
gguccacccgagccugcagcuuc

SEQ ID NO: 588525 - RNA, 22 nt, Human
cugggcucaaauccuaucucca

SEQ ID NO: 588526 - RNA, 22 nt, Human
acaagaauuauuucuaguuaac

SEQ ID NO: 588527 - RNA, 18 nt, Human
caaauucucauugauuuc

SEQ ID NO: 588528 - RNA, 22 nt, Human
agcugcuguccuaggcacugua

SEQ ID NO: 588529 - RNA, 22 nt, Human
cacugcagccucgcucuccuga

SEQ ID NO: 588530 - RNA, 22 nt, Human
ggcuccagaaaucauagagcag

SEQ ID NO: 588531 - RNA, 22 nt, Human
uaagaacuuggcagcaagaaau

SEQ ID NO: 588532 - RNA, 22 nt, Human
cuggcuuucugcaaaucuccau

SEQ ID NO: 588533 - RNA, 22 nt, Human
agguuauuaaaguguauuuuug

SEQ ID NO: 588534 - RNA, 22 nt, Human
aagagauguggaaucauuuaca

SEQ ID NO: 588535 - RNA, 22 nt, Human
cuuacauugucuuaguuuucaa

SEQ ID NO: 588536 - RNA, 19 nt, Human
acccagagcccuuugcagg

SEQ ID NO: 588537 - RNA, 22 nt, Human
cucucuggaagggggagcugau

SEQ ID NO: 588538 - RNA, 22 nt, Human
ccaggccugcaucugcugcgca

SEQ ID NO: 588539 - RNA, 22 nt, Human
cccagggguaaggcgcagcgug

SEQ ID NO: 588540 - RNA, 22 nt, Human
auuugcuuguaaauguaugccu

SEQ ID NO: 588541 - RNA, 22 nt, Human
uagggcugccuauggcuagaua

SEQ ID NO: 588542 - RNA, 22 nt, Human
cccugggagaaguugagggcug

SEQ ID NO: 588543 - RNA, 22 nt, Human
uggaaggggccaggcgcggagu

SEQ ID NO: 588544 - RNA, 22 nt, Human
ugcucuggaguggcuugugcac

SEQ ID NO: 588545 - RNA, 22 nt, Human
auuccagauguuacugaaaggc

SEQ ID NO: 588546 - RNA, 21 nt, Human
gccugggauaguggccuccgg

SEQ ID NO: 588547 - RNA, 22 nt, Human
uaucagaaggaagugccuuuaa

SEQ ID NO: 588548 - RNA, 22 nt, Human
aauaauuuuagcucagaguugu

SEQ ID NO: 588549 - RNA, 22 nt, Human
ggaugagguagaugaacaaggg

SEQ ID NO: 588550 - RNA, 22 nt, Human
ugaggucugcagggcugugcau

SEQ ID NO: 588551 - RNA, 22 nt, Human
ucugggcugcugugcagugacc

SEQ ID NO: 588552 - RNA, 22 nt, Human
uuuuccuguuaaaucugggcac

SEQ ID NO: 588553 - RNA, 22 nt, Human
gaaauguaggcauaauuauuuu

SEQ ID NO: 588554 - RNA, 22 nt, Human
aaaaaccuuucccauacuaaga

SEQ ID NO: 588555 - RNA, 22 nt, Human
caguuuauauauaagcacauug

SEQ ID NO: 588556 - RNA, 22 nt, Human
uacauucucuucccauugucuc

SEQ ID NO: 588557 - RNA, 22 nt, Human
ucucccacagccgugcuucaag

SEQ ID NO: 588558 - RNA, 22 nt, Human
acagagacaauauuuguaaagu

SEQ ID NO: 588559 - RNA, 22 nt, Human
caaauagauuguucaauccuga

SEQ ID NO: 588560 - RNA, 22 nt, Human
cucagugguugagagccugggc

SEQ ID NO: 588561 - RNA, 22 nt, Human
acauaguaagugcucaguaaau

SEQ ID NO: 588562 - RNA, 22 nt, Human
ucuaccacuuauuagcucugug

SEQ ID NO: 588563 - RNA, 22 nt, Human
uggugcugccucagaugccuua

SEQ ID NO: 588564 - RNA, 22 nt, Human
aguuagaauagucagauuguag

SEQ ID NO: 588565 - RNA, 22 nt, Human
ucuuggaaucuccauagaguga

SEQ ID NO: 588566 - RNA, 18 nt, Human
cucucuggucuggauccc

SEQ ID NO: 588567 - RNA, 22 nt, Human
uauuucacucaguauaccauag

SEQ ID NO: 588568 - RNA, 22 nt, Human
uauggcagaggagaggcacuag

SEQ ID NO: 588569 - RNA, 22 nt, Human
auggaaaggcuguggaaacuua

SEQ ID NO: 588570 - RNA, 22 nt, Human
gucuggaggaaaagguuaaaug

SEQ ID NO: 588571 - RNA, 22 nt, Human
cacuggugacuucugagcugga

SEQ ID NO: 588572 - RNA, 22 nt, Human
caggcuggacauuagauacaua

SEQ ID NO: 588573 - RNA, 22 nt, Human
ucugcucagguuaccuagcuag

SEQ ID NO: 588574 - RNA, 22 nt, Human
gaagccugguucgcuggccacc

SEQ ID NO: 588575 - RNA, 22 nt, Human
agcugaguuaauucaucacuua

SEQ ID NO: 588576 - RNA, 23 nt, Human
uccugaggguuucccagccuugg

SEQ ID NO: 588577 - RNA, 22 nt, Human
caguccuugauccaauaguggg

SEQ ID NO: 588578 - RNA, 22 nt, Human
agguggagaucagggacuaagg

SEQ ID NO: 588579 - RNA, 22 nt, Human
uccuugaagcuuguaucuaaua

SEQ ID NO: 588580 - RNA, 22 nt, Human
auugaaaauauaauucuaggag

SEQ ID NO: 588581 - RNA, 22 nt, Human
aauuaggcaaauuaauuucucu

SEQ ID NO: 588582 - RNA, 22 nt, Human
cuggggcucucuggaaugcuug

SEQ ID NO: 588583 - RNA, 22 nt, Human
aggcugaggggcgagggacccu

SEQ ID NO: 588584 - RNA, 22 nt, Human
uauuauugaaucaguucuuuga

SEQ ID NO: 588585 - RNA, 22 nt, Human
uagacauuuaucuccaugugga

SEQ ID NO: 588586 - RNA, 22 nt, Human
ugugcaauagaaaguggcaugg

SEQ ID NO: 588587 - RNA, 22 nt, Human
caagguuucgaguucccaacca

SEQ ID NO: 588588 - RNA, 22 nt, Human
agcaugaaaggcgugccaacuu

SEQ ID NO: 588589 - RNA, 22 nt, Human
auacaaauuuauagaugcauuu

SEQ ID NO: 588590 - RNA, 22 nt, Human
ugagcccuaagggucaagcagg

SEQ ID NO: 588591 - RNA, 22 nt, Human
cugaaaggcaguggguagugug

SEQ ID NO: 588592 - RNA, 22 nt, Human
ggggugggcgugcagggacacc

SEQ ID NO: 588593 - RNA, 22 nt, Human
ugacauguuagggaaaugugau

SEQ ID NO: 588594 - RNA, 22 nt, Human
cgcugccuucaucccacgccua

SEQ ID NO: 588595 - RNA, 22 nt, Human
ugcugccagggcucugcccaca

SEQ ID NO: 588596 - RNA, 22 nt, Human
auauauagagcuagauguuaaa

SEQ ID NO: 588597 - RNA, 23 nt, Human
ucggugggcguggaggccgaggc

SEQ ID NO: 588598 - RNA, 22 nt, Human
aaauguauccuacuuccugagu

SEQ ID NO: 588599 - RNA, 22 nt, Human
ggaggcuccuaagcugacuuga

SEQ ID NO: 588600 - RNA, 19 nt, Human
aagcuccagcagauccuuu

SEQ ID NO: 588601 - RNA, 22 nt, Human
aacaugcucuguuucuuggaug

SEQ ID NO: 588602 - RNA, 22 nt, Human
caucauuuuauuaaccaagaaa

SEQ ID NO: 588603 - RNA, 22 nt, Human
ccccagaaguuugcacaagaga

SEQ ID NO: 588604 - RNA, 22 nt, Human
aauguauuuugggaguuucuuu

SEQ ID NO: 588605 - RNA, 22 nt, Human
gaauaacauuuuuuccuuuaca

SEQ ID NO: 588606 - RNA, 22 nt, Human
augacaccauauuagccuagag

SEQ ID NO: 588607 - RNA, 22 nt, Human
auuuuguugagguaauugucaa

SEQ ID NO: 588608 - RNA, 22 nt, Human
gauuucuugauaaguaguguga

SEQ ID NO: 588609 - RNA, 22 nt, Human
agugccuuggguauuuugagua

SEQ ID NO: 588610 - RNA, 22 nt, Human
agagaugucgccuugcccaggg

SEQ ID NO: 588611 - RNA, 22 nt, Human
uagaaagcaaaauccuaccaag

SEQ ID NO: 588612 - RNA, 22 nt, Human
caagcagagacuagauagcugu

SEQ ID NO: 588613 - RNA, 22 nt, Human
ugaaacauugcacuguaugaau

SEQ ID NO: 588614 - RNA, 22 nt, Human
ccugaccagagugagggcuuag

SEQ ID NO: 588615 - RNA, 19 nt, Human
agcuggagauuggagggca

SEQ ID NO: 588616 - RNA, 22 nt, Human
acaagaauaaggauaagagauu

SEQ ID NO: 588617 - RNA, 22 nt, Human
uacagugcgggugcgggccucu

SEQ ID NO: 588618 - RNA, 22 nt, Human
uggugcagucauuggcccaggg

SEQ ID NO: 588619 - RNA, 22 nt, Human
caaagaaggaacuauaauccca

SEQ ID NO: 588620 - RNA, 22 nt, Human
uuuccugccuggaccucugcuu

SEQ ID NO: 588621 - RNA, 22 nt, Human
aaaaauaggucaaccguguaug

SEQ ID NO: 588622 - RNA, 22 nt, Human
uuuguuuacaaaaauaagcagu

SEQ ID NO: 588623 - RNA, 22 nt, Human
cacuaguucacaaaauaggaaa

SEQ ID NO: 588624 - RNA, 22 nt, Human
agcauacaggucugaaacagcu

SEQ ID NO: 588625 - RNA, 22 nt, Human
aagccgggccugagaaaugaca

SEQ ID NO: 588626 - RNA, 22 nt, Human
agcccagggcuaauaggaacca

SEQ ID NO: 588627 - RNA, 22 nt, Human
ccagugugaaaggucauuuauc

SEQ ID NO: 588628 - RNA, 22 nt, Human
uccugggagagugggacuguau

SEQ ID NO: 588629 - RNA, 21 nt, Human
aggcucccagaaaugggcauc

SEQ ID NO: 588630 - RNA, 22 nt, Human
ggagaccaggucagagauggug

SEQ ID NO: 588631 - RNA, 22 nt, Human
guggcccaggcuuggcgcuggc

SEQ ID NO: 588632 - RNA, 22 nt, Human
gaagauuaccugagaccacuug

SEQ ID NO: 588633 - RNA, 22 nt, Human
cccaggaguaagugacauuguu

SEQ ID NO: 588634 - RNA, 22 nt, Human
gggauggcucaaaggagucagg

SEQ ID NO: 588635 - RNA, 22 nt, Human
uagcauuucacugaucuucacu

SEQ ID NO: 588636 - RNA, 18 nt, Human
ugugcaauauuaaccacc

SEQ ID NO: 588637 - RNA, 22 nt, Human
aaaacauguccauacagaaacu

SEQ ID NO: 588638 - RNA, 22 nt, Human
agcaggugguaggcagucagca

SEQ ID NO: 588639 - RNA, 22 nt, Human
uccuuucugugcugucaggucc

SEQ ID NO: 588640 - RNA, 21 nt, Human
aauuugcuaagcaaaggagca

SEQ ID NO: 588641 - RNA, 22 nt, Human
ugagauggaguuuuggggauau

SEQ ID NO: 588642 - RNA, 22 nt, Human
ucuggcuuuuauucaguuggca

SEQ ID NO: 588643 - RNA, 22 nt, Human
ucuccacucugagugccuuuca

SEQ ID NO: 588644 - RNA, 22 nt, Human
ugaauacuauuucauaaugugg

SEQ ID NO: 588645 - RNA, 22 nt, Human
uuugcauuuuagauuuaggccu

SEQ ID NO: 588646 - RNA, 22 nt, Human
ugcugcuguugacggcugucca

SEQ ID NO: 588647 - RNA, 22 nt, Human
uccuccaggauaaaauguguug

SEQ ID NO: 588648 - RNA, 22 nt, Human
cagcugggagcuccauuagaua

SEQ ID NO: 588649 - RNA, 22 nt, Human
cugggaagccacaggguguggg

SEQ ID NO: 588650 - RNA, 23 nt, Human
uuaaaaguggagagagaagcugg

SEQ ID NO: 588651 - RNA, 22 nt, Human
uuucauugucaauaaacuguau

SEQ ID NO: 588652 - RNA, 22 nt, Human
uucucuagguuuuagaugaaga

SEQ ID NO: 588653 - RNA, 22 nt, Human
gagcuguccaagauggucguaa

SEQ ID NO: 588654 - RNA, 22 nt, Human
uagucucuggagacucuagggg

SEQ ID NO: 588655 - RNA, 22 nt, Human
ucacaggacccugaggguggcg

SEQ ID NO: 588656 - RNA, 22 nt, Human
ugcagaguagcuauaccauuuu

SEQ ID NO: 588657 - RNA, 22 nt, Human
cagcccagugcauuuguguacu

SEQ ID NO: 588658 - RNA, 22 nt, Human
cuacugaguccuucagcugcca

SEQ ID NO: 588659 - RNA, 22 nt, Human
gaacacauuucucugacuguag

SEQ ID NO: 588660 - RNA, 22 nt, Human
aacuacagaaucauagaaaaua

SEQ ID NO: 588661 - RNA, 22 nt, Human
uaacugugugaacgugaucauu

SEQ ID NO: 588662 - RNA, 22 nt, Human
gcuuuauuuugugagggauuac

SEQ ID NO: 588663 - RNA, 22 nt, Human
gccuucccucucauccugcugg

SEQ ID NO: 588664 - RNA, 22 nt, Human
uuaauaaguaguaguuauuguu

SEQ ID NO: 588665 - RNA, 22 nt, Human
agaggaaaaugaguuccagaau

SEQ ID NO: 588666 - RNA, 22 nt, Human
cuccagauuccugcuggcagaa

SEQ ID NO: 588667 - RNA, 22 nt, Human
ccaguaaaccaaguguuuacua

SEQ ID NO: 588668 - RNA, 22 nt, Human
caggcacuucugcugcuugucu

SEQ ID NO: 588669 - RNA, 22 nt, Human
uacuuucuuguuccuuucauaa

SEQ ID NO: 588670 - RNA, 22 nt, Human
ugaaaauucucaggcucacccc

SEQ ID NO: 588671 - RNA, 19 nt, Human
uugugugucagucagaguu

SEQ ID NO: 588672 - RNA, 22 nt, Human
cuggagcucuucugagugugcu

SEQ ID NO: 588673 - RNA, 22 nt, Human
cagcccaccuggcacguguguu

SEQ ID NO: 588674 - RNA, 22 nt, Human
auaguuguguggggauucuggu

SEQ ID NO: 588675 - RNA, 22 nt, Human
uuucuugucuuuaguaucuggc

SEQ ID NO: 588676 - RNA, 22 nt, Human
ggcuccagguuuaaggguaugu

SEQ ID NO: 588677 - RNA, 17 nt, Human
gcaguuaaauuaagaug

SEQ ID NO: 588678 - RNA, 22 nt, Human
uacacccacaugccuaggaggg

SEQ ID NO: 588679 - RNA, 22 nt, Human
gaguguaaaaacuuagugagau

SEQ ID NO: 588680 - RNA, 22 nt, Human
cuggagcauccaugcccagggu

SEQ ID NO: 588681 - RNA, 22 nt, Human
gaaucuuagucuccuaacggcu

SEQ ID NO: 588682 - RNA, 22 nt, Human
auugaaagauuuugggcucaug

SEQ ID NO: 588683 - RNA, 22 nt, Human
ccuggcugugcauugccggccc

SEQ ID NO: 588684 - RNA, 22 nt, Human
gucuggaggagggcucugcggc

SEQ ID NO: 588685 - RNA, 22 nt, Human
cuuuucauuguuuguacaugca

SEQ ID NO: 588686 - RNA, 22 nt, Human
ucacauguguggcagugcaagu

SEQ ID NO: 588687 - RNA, 22 nt, Human
ccugagaucagugcauuuggug

SEQ ID NO: 588688 - RNA, 22 nt, Human
gcuucuggaagcugcuucugcc

SEQ ID NO: 588689 - RNA, 19 nt, Human
uaugacaaguacuaguucu

SEQ ID NO: 588690 - RNA, 22 nt, Human
ugagccuggguggucgaggcug

SEQ ID NO: 588691 - RNA, 22 nt, Human
uaacacugauuuguucucaggg

SEQ ID NO: 588692 - RNA, 22 nt, Human
agcugccauccuguucagcacc

SEQ ID NO: 588693 - RNA, 23 nt, Human
uaagaacagacaagcauuuacau

SEQ ID NO: 588694 - RNA, 22 nt, Human
uggcaugggccagggagagcug

SEQ ID NO: 588695 - RNA, 22 nt, Human
uggugaucagucaacugucuuc

SEQ ID NO: 588696 - RNA, 22 nt, Human
ugcaguuuuaucacauauauag

SEQ ID NO: 588697 - RNA, 22 nt, Human
acaucagagggcucacaugauc

SEQ ID NO: 588698 - RNA, 22 nt, Human
gccuugcuaauuucuccucaac

SEQ ID NO: 588699 - RNA, 22 nt, Human
uucaauuuagugauguuguugg

SEQ ID NO: 588700 - RNA, 22 nt, Human
ggaauacuaaaggaagcaauug

SEQ ID NO: 588701 - RNA, 22 nt, Human
cagcucaguuucaauaccaggu

SEQ ID NO: 588702 - RNA, 22 nt, Human
ugaauccuaguugaagauaagg

SEQ ID NO: 588703 - RNA, 22 nt, Human
gcagcccucgcuagcucucccc

SEQ ID NO: 588704 - RNA, 22 nt, Human
uuuauuagugcuuguaucacug

SEQ ID NO: 588705 - RNA, 22 nt, Human
ucauuacagagauauaaucuac

SEQ ID NO: 588706 - RNA, 22 nt, Human
gugauggagucaaggcuagaac

SEQ ID NO: 588707 - RNA, 22 nt, Human
cagucccacaagaucuccacaa

SEQ ID NO: 588708 - RNA, 22 nt, Human
aggcccucacagucuauuguga

SEQ ID NO: 588709 - RNA, 22 nt, Human
cugaagucauacacuguucuga

SEQ ID NO: 588710 - RNA, 22 nt, Human
gugagguccuaauagacaucga

SEQ ID NO: 588711 - RNA, 22 nt, Human
acacagugucagggcaggggcc

SEQ ID NO: 588712 - RNA, 22 nt, Human
agagguauuagauuugcauagg

SEQ ID NO: 588713 - RNA, 22 nt, Human
gcagagcugagcggcugcccgg

SEQ ID NO: 588714 - RNA, 22 nt, Human
ucaggagagaaagaauacaauu

SEQ ID NO: 588715 - RNA, 22 nt, Human
agguagggcuaggcugcgucug

SEQ ID NO: 588716 - RNA, 22 nt, Human
uuucugauauucauuuagaaga

SEQ ID NO: 588717 - RNA, 22 nt, Human
caguucuggaggcuccacaucu

SEQ ID NO: 588718 - RNA, 22 nt, Human
ucaugaguggauuaauauggcu

SEQ ID NO: 588719 - RNA, 22 nt, Human
cugcuuccaugcaauggcaguc

SEQ ID NO: 588720 - RNA, 22 nt, Human
uuccacugauuuugguugaccu

SEQ ID NO: 588721 - RNA, 17 nt, Human
uucaaagcuuaucaagg

SEQ ID NO: 588722 - RNA, 22 nt, Human
ucccagaggcaguugguaacuu

SEQ ID NO: 588723 - RNA, 22 nt, Human
acugagguuucauuuuaucgcu

SEQ ID NO: 588724 - RNA, 22 nt, Human
cuggccagcauuuuugcuuuag

SEQ ID NO: 588725 - RNA, 22 nt, Human
agacucugugcuccuugcuuuc

SEQ ID NO: 588726 - RNA, 22 nt, Human
agucugggugugaaugaacuug

SEQ ID NO: 588727 - RNA, 22 nt, Human
uuugucuuuccccuccucauug

SEQ ID NO: 588728 - RNA, 22 nt, Human
ugacacagaaauuaagcuguca

SEQ ID NO: 588729 - RNA, 22 nt, Human
uucacaggcuuggagguggggg

SEQ ID NO: 588730 - RNA, 22 nt, Human
cucagaaaggguugcugagggc

SEQ ID NO: 588731 - RNA, 22 nt, Human
cacaggagugcugcuauuguug

SEQ ID NO: 588732 - RNA, 22 nt, Human
ccugaaaauauccucuccuuug

SEQ ID NO: 588733 - RNA, 22 nt, Human
guagaacuaggacuucagguau

SEQ ID NO: 588734 - RNA, 21 nt, Human
ucucuacacuuucacuaggcu

SEQ ID NO: 588735 - RNA, 22 nt, Human
acucccagaacaugcucuucuu

SEQ ID NO: 588736 - RNA, 22 nt, Human
gagcccaggaaguggaggcuga

SEQ ID NO: 588737 - RNA, 22 nt, Human
agaaggaagccaggagggugca

SEQ ID NO: 588738 - RNA, 22 nt, Human
ucuacacaagugaguggcacaa

SEQ ID NO: 588739 - RNA, 22 nt, Human
cucuguguucagccuagcagaa

SEQ ID NO: 588740 - RNA, 22 nt, Human
ucccaagugucuuggaccaggg

SEQ ID NO: 588741 - RNA, 22 nt, Human
aggaaacaugaaucugccuuga

SEQ ID NO: 588742 - RNA, 22 nt, Human
ucacuguaugucuuuuuuugau

SEQ ID NO: 588743 - RNA, 22 nt, Human
gcucccacugcagcccugagcc

SEQ ID NO: 588744 - RNA, 22 nt, Human
aaagcaguaguuuucaaauagu

SEQ ID NO: 588745 - RNA, 22 nt, Human
acagcuggaggccccauugucc

SEQ ID NO: 588746 - RNA, 22 nt, Human
agucagagaauguuuucaugga

SEQ ID NO: 588747 - RNA, 22 nt, Human
gaggggcacagcagcuguugca

SEQ ID NO: 588748 - RNA, 22 nt, Human
agggcugagcccaggcauguag

SEQ ID NO: 588749 - RNA, 22 nt, Human
gaggccacagugucugggggcc

SEQ ID NO: 588750 - RNA, 22 nt, Human
acaaugaaagguauucugaacu

SEQ ID NO: 588751 - RNA, 17 nt, Human
agcagggagucaaggga

SEQ ID NO: 588752 - RNA, 22 nt, Human
ucugucacugagcucaggauuc

SEQ ID NO: 588753 - RNA, 22 nt, Human
augaaggauggcuggcugcccu

SEQ ID NO: 588754 - RNA, 22 nt, Human
ugaaaugcaacaguuauuuuug

SEQ ID NO: 588755 - RNA, 22 nt, Human
aagcacagggacucaggaccgg

SEQ ID NO: 588756 - RNA, 22 nt, Human
uguuuacaaggaguuuauauug

SEQ ID NO: 588757 - RNA, 22 nt, Human
cugggacuggaccucugccugg

SEQ ID NO: 588758 - RNA, 22 nt, Human
gucuggagccacccuaagcauu

SEQ ID NO: 588759 - RNA, 22 nt, Human
uuuagcuuugaaggauaugguu

SEQ ID NO: 588760 - RNA, 22 nt, Human
aggaaacuggguaugguuauac

SEQ ID NO: 588761 - RNA, 22 nt, Human
ccugggcuguaccugugcgcgg

SEQ ID NO: 588762 - RNA, 22 nt, Human
ggauggagaugaccauggugac

SEQ ID NO: 588763 - RNA, 20 nt, Human
aaacacagccucucuuuaca

SEQ ID NO: 588764 - RNA, 22 nt, Human
uucaacaaugcacuugaguaua

SEQ ID NO: 588765 - RNA, 22 nt, Human
cagacaggaauucuggcguggu

SEQ ID NO: 588766 - RNA, 22 nt, Human
agcugccagcaucccggaaggg

SEQ ID NO: 588767 - RNA, 21 nt, Human
agcaucugaggcaguuuccua

SEQ ID NO: 588768 - RNA, 22 nt, Human
ccugggagugucagacuugcuu

SEQ ID NO: 588769 - RNA, 22 nt, Human
uaaagcaaugaaaguuuugcag

SEQ ID NO: 588770 - RNA, 23 nt, Human
ggaagcucacguaguccugcacu

SEQ ID NO: 588771 - RNA, 22 nt, Human
uggcugaggagagggcggaagu

SEQ ID NO: 588772 - RNA, 22 nt, Human
augcugacuucucucugcagug

SEQ ID NO: 588773 - RNA, 22 nt, Human
ccucucauagucuguauccuuu

SEQ ID NO: 588774 - RNA, 22 nt, Human
ugggccauuuuuggaagacugg

SEQ ID NO: 588775 - RNA, 22 nt, Human
uaauaaaugaaagugcuggcau

SEQ ID NO: 588776 - RNA, 22 nt, Human
caaagguauucucauuuuggaa

SEQ ID NO: 588777 - RNA, 22 nt, Human
ugcaggagcuuggcucuguccc

SEQ ID NO: 588778 - RNA, 23 nt, Human
uccuaacucaauucagggguguc

SEQ ID NO: 588779 - RNA, 19 nt, Human
cugggacuccugauaccuu

SEQ ID NO: 588780 - RNA, 22 nt, Human
agaaucaacugaaaauugguga

SEQ ID NO: 588781 - RNA, 22 nt, Human
aaucuucauaaaaaucuaguag

SEQ ID NO: 588782 - RNA, 23 nt, Human
acaaugcacuuuaaaugguuccc

SEQ ID NO: 588783 - RNA, 22 nt, Human
cagcgcugggguaggagcaccu

SEQ ID NO: 588784 - RNA, 22 nt, Human
uucagcaccacuuccagagaag

SEQ ID NO: 588785 - RNA, 22 nt, Human
aggccucacauugggcuucaag

SEQ ID NO: 588786 - RNA, 22 nt, Human
ccagcccuucccaacuggccag

SEQ ID NO: 588787 - RNA, 22 nt, Human
guggugaguucaggcuggggug

SEQ ID NO: 588788 - RNA, 22 nt, Human
caggccaauaucacaugcuaug

SEQ ID NO: 588789 - RNA, 22 nt, Human
ucucuguguguuggcuguauau

SEQ ID NO: 588790 - RNA, 22 nt, Human
caggcacacauccgugagagau

SEQ ID NO: 588791 - RNA, 22 nt, Human
aauguacaaaccuucuuuguag

SEQ ID NO: 588792 - RNA, 22 nt, Human
aagcugccagcugagcugaggc

SEQ ID NO: 588793 - RNA, 23 nt, Human
uuucaacaaugcuuagagaaaac

SEQ ID NO: 588794 - RNA, 20 nt, Human
uccugcaguuccuaggaggg

SEQ ID NO: 588795 - RNA, 18 nt, Human
gugagcagagagcaucac

SEQ ID NO: 588796 - RNA, 22 nt, Human
gagauaaugaugcuaacccagu

SEQ ID NO: 588797 - RNA, 22 nt, Human
ugcucagaaacgaggugcagcc

SEQ ID NO: 588798 - RNA, 22 nt, Human
ugcugucccccgugucugggcu

SEQ ID NO: 588799 - RNA, 22 nt, Human
gugaauggggcaggaaggaugg

SEQ ID NO: 588800 - RNA, 22 nt, Human
ccaggcuucccugagaggcugc

SEQ ID NO: 588801 - RNA, 22 nt, Human
uguuucuaucuggaucaauaga

SEQ ID NO: 588802 - RNA, 22 nt, Human
ccagacuguggaguuccuggug

SEQ ID NO: 588803 - RNA, 22 nt, Human
cacaacuuagcagcuugaaaca

SEQ ID NO: 588804 - RNA, 22 nt, Human
ugcucuggggcuccccaccaga

SEQ ID NO: 588805 - RNA, 22 nt, Human
ggcugcugguggaaugguaggc

SEQ ID NO: 588806 - RNA, 22 nt, Human
gccuccugagaagccacaggcu

SEQ ID NO: 588807 - RNA, 22 nt, Human
agacaugcaauaaugugcacuc

SEQ ID NO: 588808 - RNA, 22 nt, Human
uggcauguuucauggcugcaaa

SEQ ID NO: 588809 - RNA, 22 nt, Human
ggaggccaagucacugaccugg

SEQ ID NO: 588810 - RNA, 19 nt, Human
ccugugugggguagagauc

SEQ ID NO: 588811 - RNA, 22 nt, Human
uucuaaaaccaauucugcuucu

SEQ ID NO: 588812 - RNA, 22 nt, Human
aggcuccaccagucaggugcau

SEQ ID NO: 588813 - RNA, 22 nt, Human
cagcuguugucaccucacaucc

SEQ ID NO: 588814 - RNA, 19 nt, Human
ccucuccgcccaccagccc

SEQ ID NO: 588815 - RNA, 22 nt, Human
gacuggagauaaaaccaugagu

SEQ ID NO: 588816 - RNA, 22 nt, Human
auuuuacuaaguggauaucugu

SEQ ID NO: 588817 - RNA, 22 nt, Human
gcuaggagauugagcucugaag

SEQ ID NO: 588818 - RNA, 22 nt, Human
caacuucacugugccucuaguu

SEQ ID NO: 588819 - RNA, 22 nt, Human
ucaugagucugcaaauuaugga

SEQ ID NO: 588820 - RNA, 22 nt, Human
cuuuccuagauggccaucuuuc

SEQ ID NO: 588821 - RNA, 20 nt, Human
cagcaguggaugagaguuuu

SEQ ID NO: 588822 - RNA, 22 nt, Human
aggaaaauuaucaugagagcca

SEQ ID NO: 588823 - RNA, 22 nt, Human
gaacuacaggugcagcaaguga

SEQ ID NO: 588824 - RNA, 22 nt, Human
auugguggugaggacaugccag

SEQ ID NO: 588825 - RNA, 22 nt, Human
ggagagaggcuggccgugauga

SEQ ID NO: 588826 - RNA, 22 nt, Human
gcugccucugcacagcucacuc

SEQ ID NO: 588827 - RNA, 22 nt, Human
caaacauuuguuggaaccccug

SEQ ID NO: 588828 - RNA, 22 nt, Human
aggcugagacugugcauuagug

SEQ ID NO: 588829 - RNA, 23 nt, Human
uaugugcauauguguaagaauac

SEQ ID NO: 588830 - RNA, 19 nt, Human
acauuuagaauguacuugc

SEQ ID NO: 588831 - RNA, 22 nt, Human
uaacauuugcugucuccuaugu

SEQ ID NO: 588832 - RNA, 22 nt, Human
ugguuccucagggcagcuguac

SEQ ID NO: 588833 - RNA, 22 nt, Human
agcugcugcggaaagaugccac

SEQ ID NO: 588834 - RNA, 22 nt, Human
agaacuuuuggagacuuuuagu

SEQ ID NO: 588835 - RNA, 22 nt, Human
ucaggaggcggugcugccuuug

SEQ ID NO: 588836 - RNA, 22 nt, Human
cuucucuaugauguucuaaggu

SEQ ID NO: 588837 - RNA, 22 nt, Human
guggcucacagcaauguuuccu

SEQ ID NO: 588838 - RNA, 22 nt, Human
ucagcacuuuuuaaagcagcau

SEQ ID NO: 588839 - RNA, 20 nt, Human
agaaauauugaguucagagg

SEQ ID NO: 588840 - RNA, 22 nt, Human
cucucccccacagcagccuucu

SEQ ID NO: 588841 - RNA, 22 nt, Human
cacagcuugggcucugacaaua

SEQ ID NO: 588842 - RNA, 23 nt, Human
agacaguggccgagagguacuag

SEQ ID NO: 588843 - RNA, 22 nt, Human
ggcucuggugcccuggcuccca

SEQ ID NO: 588844 - RNA, 22 nt, Human
gugaacaggagaaagugaugga

SEQ ID NO: 588845 - RNA, 22 nt, Human
gaacaaacauuuuuggcaguau

SEQ ID NO: 588846 - RNA, 22 nt, Human
aauaggaaaauauuuaacaaga

SEQ ID NO: 588847 - RNA, 22 nt, Human
acauuaccuggcauuugaucuu

SEQ ID NO: 588848 - RNA, 22 nt, Human
aaguauauacuaaauguuaauc

SEQ ID NO: 588849 - RNA, 22 nt, Human
auguaacaaaugguauacaugu

SEQ ID NO: 588850 - RNA, 22 nt, Human
uauuuaaaaagaggccagcugg

SEQ ID NO: 588851 - RNA, 22 nt, Human
uaucuuuaacuugcaguauuua

SEQ ID NO: 588852 - RNA, 22 nt, Human
aucuugaaugaaugacucuuua

SEQ ID NO: 588853 - RNA, 22 nt, Human
accuguuuaccugcaccuguuu

SEQ ID NO: 588854 - RNA, 22 nt, Human
ugccacuggacccagaacucuu

SEQ ID NO: 588855 - RNA, 19 nt, Human
gaaggcugaaaugaagcac

SEQ ID NO: 588856 - RNA, 19 nt, Human
cccagcuugaccaccugcu

SEQ ID NO: 588857 - RNA, 22 nt, Human
cuuauucagcacuugcucugua

SEQ ID NO: 588858 - RNA, 22 nt, Human
ggcagagacuggguuggcagag

SEQ ID NO: 588859 - RNA, 22 nt, Human
cagugcagguuuagggcugggg

SEQ ID NO: 588860 - RNA, 22 nt, Human
gcugcuuugacagugggaacag

SEQ ID NO: 588861 - RNA, 22 nt, Human
ggagccaguuuagaccucaguu

SEQ ID NO: 588862 - RNA, 22 nt, Human
caaagguuggaaauguuuacca

SEQ ID NO: 588863 - RNA, 22 nt, Human
cucuuucaguucugauagucuc

SEQ ID NO: 588864 - RNA, 22 nt, Human
cugagcagugguucuugagcgc

SEQ ID NO: 588865 - RNA, 22 nt, Human
uccagauagaguccuguuagua

SEQ ID NO: 588866 - RNA, 22 nt, Human
agagcugguuuacucaggaauu

SEQ ID NO: 588867 - RNA, 22 nt, Human
aaaauagcuauggaaugucacu

SEQ ID NO: 588868 - RNA, 22 nt, Human
aucuguuguuuuucaccaccca

SEQ ID NO: 588869 - RNA, 19 nt, Human
auggaaaaugccagacuga

SEQ ID NO: 588870 - RNA, 22 nt, Human
ccaggcuuucccagccucucca

SEQ ID NO: 588871 - RNA, 22 nt, Human
acaugcuacacagagcuccucg

SEQ ID NO: 588872 - RNA, 22 nt, Human
uucaacaugcuuuauuucuaaa

SEQ ID NO: 588873 - RNA, 22 nt, Human
cagacaggaaguucagaagaaa

SEQ ID NO: 588874 - RNA, 22 nt, Human
ugguccugagaauccuguccuc

SEQ ID NO: 588875 - RNA, 22 nt, Human
cuccaggccagggaaguggaca

SEQ ID NO: 588876 - RNA, 22 nt, Human
uccucagcuuuuauuucacuug

SEQ ID NO: 588877 - RNA, 22 nt, Human
ugcugaaaaugcguaucuucca

SEQ ID NO: 588878 - RNA, 22 nt, Human
cugcagggaugugaggcccguu

SEQ ID NO: 588879 - RNA, 22 nt, Human
ugucauuuugucucacugcuau

SEQ ID NO: 588880 - RNA, 22 nt, Human
aggccuggccugggcggcauug

SEQ ID NO: 588881 - RNA, 22 nt, Human
guccuguuuguauuugcuggaa

SEQ ID NO: 588882 - RNA, 22 nt, Human
acacaguaugaaaagucuaguu

SEQ ID NO: 588883 - RNA, 22 nt, Human
ucagaugccaacugaacaacag

SEQ ID NO: 588884 - RNA, 22 nt, Human
cucuuucugauucgcugggacc

SEQ ID NO: 588885 - RNA, 22 nt, Human
aucccagauggaggcuggucac

SEQ ID NO: 588886 - RNA, 22 nt, Human
gagcucagaggcgucuuugucc

SEQ ID NO: 588887 - RNA, 22 nt, Human
ucauaaaacacaccagguaguu

SEQ ID NO: 588888 - RNA, 22 nt, Human
augcuguuaagauaauggguuc

SEQ ID NO: 588889 - RNA, 22 nt, Human
ccagggcuggguuugucggugu

SEQ ID NO: 588890 - RNA, 22 nt, Human
gaggcaccagacauggccucau

SEQ ID NO: 588891 - RNA, 22 nt, Human
agcacauauucaguucauacaa

SEQ ID NO: 588892 - RNA, 22 nt, Human
ugucaguguauacauacaguau

SEQ ID NO: 588893 - RNA, 22 nt, Human
uaauacuugucauaaaggcauu

SEQ ID NO: 588894 - RNA, 22 nt, Human
agcacacaucacuucugcucau

SEQ ID NO: 588895 - RNA, 22 nt, Human
caccugccugcaggggcuccac

SEQ ID NO: 588896 - RNA, 22 nt, Human
caaaggaaauacuaaucuggaa

SEQ ID NO: 588897 - RNA, 22 nt, Human
acacagggcugcgccugacccc

SEQ ID NO: 588898 - RNA, 22 nt, Human
caucuacaugcuugccacugcu

SEQ ID NO: 588899 - RNA, 22 nt, Human
gcacugggaaugagggcagcuu

SEQ ID NO: 588900 - RNA, 22 nt, Human
aggguggcugaguagauggaag

SEQ ID NO: 588901 - RNA, 20 nt, Human
agggucugcuggguaggaca

SEQ ID NO: 588902 - RNA, 22 nt, Human
ugcauuuaagaaaacaugaguc

SEQ ID NO: 588903 - RNA, 22 nt, Human
ucugggaacucugucauuuccc

SEQ ID NO: 588904 - RNA, 18 nt, Human
cagugaggaugaaggguu

SEQ ID NO: 588905 - RNA, 22 nt, Human
cagggccaugaggcacaggguc

SEQ ID NO: 588906 - RNA, 22 nt, Human
cccugcucuuagugccugugug

SEQ ID NO: 588907 - RNA, 20 nt, Human
aaagagaagccucaccuugu

SEQ ID NO: 588908 - RNA, 22 nt, Human
uauugacagagggucagaagag

SEQ ID NO: 588909 - RNA, 22 nt, Human
acacuguaugaaaacaggaaau

SEQ ID NO: 588910 - RNA, 22 nt, Human
aacugucuaaggagaauaugaa

SEQ ID NO: 588911 - RNA, 22 nt, Human
uagauacuuauaaucuuccaag

SEQ ID NO: 588912 - RNA, 22 nt, Human
gccaggcauguccucugcagaa

SEQ ID NO: 588913 - RNA, 22 nt, Human
ggcacacagauggagcacuagc

SEQ ID NO: 588914 - RNA, 22 nt, Human
aaacagcugggagguagaggcg

SEQ ID NO: 588915 - RNA, 18 nt, Human
ucuugccugcacccucuc

SEQ ID NO: 588916 - RNA, 22 nt, Human
gagugugguaugcucugaggcu

SEQ ID NO: 588917 - RNA, 22 nt, Human
cagucccagaagagccugggag

SEQ ID NO: 588918 - RNA, 22 nt, Human
acugcuuuuagaaaucuauaga

SEQ ID NO: 588919 - RNA, 22 nt, Human
uggcucaugccuguaaucuuag

SEQ ID NO: 588920 - RNA, 22 nt, Human
ugggcacauaguuuuaugguca

SEQ ID NO: 588921 - RNA, 22 nt, Human
augcaguaaauguuaagaaaaa

SEQ ID NO: 588922 - RNA, 22 nt, Human
acaggugguagaguggaaagag

SEQ ID NO: 588923 - RNA, 22 nt, Human
ugcccugugugugcaagcacug

SEQ ID NO: 588924 - RNA, 22 nt, Human
uggcugccuucccugcuggagg

SEQ ID NO: 588925 - RNA, 22 nt, Human
aggcugucucagccugcuugca

SEQ ID NO: 588926 - RNA, 22 nt, Human
uggccuggcagagcaaggccug

SEQ ID NO: 588927 - RNA, 22 nt, Human
aaugcuuucaaaaaugugcagu

SEQ ID NO: 588928 - RNA, 22 nt, Human
cauaacauuauuuucugaagau

SEQ ID NO: 588929 - RNA, 22 nt, Human
gccacagguacuaugggagaga

SEQ ID NO: 588930 - RNA, 22 nt, Human
uuuccuucucagggagcuucaa

SEQ ID NO: 588931 - RNA, 22 nt, Human
agccagaggccagccugccuca

SEQ ID NO: 588932 - RNA, 22 nt, Human
uggcucaggggucuggcucugu

SEQ ID NO: 588933 - RNA, 19 nt, Human
cauuuuaagcauccccagu

SEQ ID NO: 588934 - RNA, 23 nt, Human
agaggccaacuucuugccccucc

SEQ ID NO: 588935 - RNA, 22 nt, Human
aguccucugcugugcgucuuug

SEQ ID NO: 588936 - RNA, 22 nt, Human
ggagggggaauucagccccagc

SEQ ID NO: 588937 - RNA, 22 nt, Human
uuauugcacuauugauuuucua

SEQ ID NO: 588938 - RNA, 22 nt, Human
uuaauuuauacauaaucacagg

SEQ ID NO: 588939 - RNA, 22 nt, Human
aauuuuccauccaaaguaacau

SEQ ID NO: 588940 - RNA, 22 nt, Human
ugggauagaaauuuagaacaag

SEQ ID NO: 588941 - RNA, 22 nt, Human
acaauucaagaugagauucagg

SEQ ID NO: 588942 - RNA, 22 nt, Human
auguaauuuauguuauccauaa

SEQ ID NO: 588943 - RNA, 22 nt, Human
aagcuauacaaugcacaaauga

SEQ ID NO: 588944 - RNA, 22 nt, Human
uaggggagcucgggugcaaucg

SEQ ID NO: 588945 - RNA, 22 nt, Human
aggcgugggaggaucugaggcc

SEQ ID NO: 588946 - RNA, 23 nt, Human
agcugggcaaggauccgggcucc

SEQ ID NO: 588947 - RNA, 22 nt, Human
agugccaggagcaaggagcucc

SEQ ID NO: 588948 - RNA, 22 nt, Human
ccagggggcuuggugaggccau

SEQ ID NO: 588949 - RNA, 22 nt, Human
cuuuaaugagucuuucugcugu

SEQ ID NO: 588950 - RNA, 22 nt, Human
aagaugauagaucugucaaugu

SEQ ID NO: 588951 - RNA, 22 nt, Human
aagacagcucaggacagauuca

SEQ ID NO: 588952 - RNA, 22 nt, Human
ggcaggugccuucugugcuagc

SEQ ID NO: 588953 - RNA, 22 nt, Human
ccacuuugagaagcugaugaaa

SEQ ID NO: 588954 - RNA, 21 nt, Human
cuggaagaagcagcaggauuc

SEQ ID NO: 588955 - RNA, 19 nt, Human
uugucuuagcugcauaaga

SEQ ID NO: 588956 - RNA, 22 nt, Human
ucaggacauuugucagcaggag

SEQ ID NO: 588957 - RNA, 22 nt, Human
uugaaugaguguuuuacucaug

SEQ ID NO: 588958 - RNA, 22 nt, Human
cugcccugcuugaugacagcga

SEQ ID NO: 588959 - RNA, 17 nt, Human
aguggcaggcagauggg

SEQ ID NO: 588960 - RNA, 22 nt, Human
guuauugagacauagaguuaug

SEQ ID NO: 588961 - RNA, 19 nt, Human
aggagaagacucucucccc

SEQ ID NO: 588962 - RNA, 22 nt, Human
ccacucaggccuccugcucucc

SEQ ID NO: 588963 - RNA, 22 nt, Human
uagguagguaaacaggacuaau

SEQ ID NO: 588964 - RNA, 22 nt, Human
agacuguaauuuguggccuccu

SEQ ID NO: 588965 - RNA, 22 nt, Human
agaaaacucuacaucuguaugu

SEQ ID NO: 588966 - RNA, 22 nt, Human
acagcuuuuuacuaauagauug

SEQ ID NO: 588967 - RNA, 22 nt, Human
gcugcagggggugggcgucucc

SEQ ID NO: 588968 - RNA, 17 nt, Human
uagagcugguucaggag

SEQ ID NO: 588969 - RNA, 22 nt, Human
ucugccuguugcuagaauguca

SEQ ID NO: 588970 - RNA, 22 nt, Human
aaauagcauuguauuuagcuga

SEQ ID NO: 588971 - RNA, 22 nt, Human
gcuggguggaucggaggcucug

SEQ ID NO: 588972 - RNA, 22 nt, Human
gucagucauauuguacagauau

SEQ ID NO: 588973 - RNA, 22 nt, Human
aaguuacuaugacucuucuuuu

SEQ ID NO: 588974 - RNA, 22 nt, Human
acaggugagggagcuuugugcc

SEQ ID NO: 588975 - RNA, 22 nt, Human
cugggucccacagccugcuggg

SEQ ID NO: 588976 - RNA, 22 nt, Human
cucucccagucaggcucaggau

SEQ ID NO: 588977 - RNA, 22 nt, Human
ucuuccuggcauugaugcugca

SEQ ID NO: 588978 - RNA, 22 nt, Human
cagcagccuaggguuccaucau

SEQ ID NO: 588979 - RNA, 22 nt, Human
guggauggacaugggcaagagg

SEQ ID NO: 588980 - RNA, 22 nt, Human
aagaugcacaauguggcaauua

SEQ ID NO: 588981 - RNA, 22 nt, Human
uuggcaauuaguuauaucugca

SEQ ID NO: 588982 - RNA, 22 nt, Human
uuucaaagacagccauauuugu

SEQ ID NO: 588983 - RNA, 23 nt, Human
cucccuggaguuucuggaagaug

SEQ ID NO: 588984 - RNA, 22 nt, Human
aggagcuggccacuaggaugca

SEQ ID NO: 588985 - RNA, 22 nt, Human
uccuuauaaaugaggcccuggg

SEQ ID NO: 588986 - RNA, 22 nt, Human
auggaaaaggcugauuucauua

SEQ ID NO: 588987 - RNA, 22 nt, Human
acauaagugcacaauaaauauu

SEQ ID NO: 588988 - RNA, 22 nt, Human
aaugucauugagcuccaauccu

SEQ ID NO: 588989 - RNA, 22 nt, Human
uuauaacacugccuugucacca

SEQ ID NO: 588990 - RNA, 22 nt, Human
uguuugcuuacuuguaugcugc

SEQ ID NO: 588991 - RNA, 22 nt, Human
acugucaucuuguaagcaaugu

SEQ ID NO: 588992 - RNA, 22 nt, Human
aguguggucgggagcgcggggc

SEQ ID NO: 588993 - RNA, 22 nt, Human
cacugggcuuuguaguuagcau

SEQ ID NO: 588994 - RNA, 22 nt, Human
accaggagccauagagucaggc

SEQ ID NO: 588995 - RNA, 22 nt, Human
gugaaauauuuaacguccaggu

SEQ ID NO: 588996 - RNA, 20 nt, Human
agaaauacaugcaugcauga

SEQ ID NO: 588997 - RNA, 22 nt, Human
uuugaaaauuuaagugcuacac

SEQ ID NO: 588998 - RNA, 22 nt, Human
uuccucagccagcacuuagggg

SEQ ID NO: 588999 - RNA, 23 nt, Human
guuuucaacacaauaaauguaac

SEQ ID NO: 589000 - RNA, 18 nt, Human
aggcaggcuggagugacu

SEQ ID NO: 589001 - RNA, 22 nt, Human
uggggcugucccgguuuggcga

SEQ ID NO: 589002 - RNA, 21 nt, Human
ugaaugagcaucuggacuuuu

SEQ ID NO: 589003 - RNA, 22 nt, Human
ccuuuuucugaguuguagcuuc

SEQ ID NO: 589004 - RNA, 22 nt, Human
gacaauaagaacagauacugug

SEQ ID NO: 589005 - RNA, 23 nt, Human
agccuggcaccugcagaucggag

SEQ ID NO: 589006 - RNA, 22 nt, Human
uuucaagagcaggaaaaagguc

SEQ ID NO: 589007 - RNA, 22 nt, Human
ggcagugaaugaaacagaggcu

SEQ ID NO: 589008 - RNA, 22 nt, Human
uuuuucaagacaaccugcaugu

SEQ ID NO: 589009 - RNA, 22 nt, Human
agaagccacaggccucgucugg

SEQ ID NO: 589010 - RNA, 22 nt, Human
caguccuggggaccaggcugag

SEQ ID NO: 589011 - RNA, 22 nt, Human
cccuggagucagguuggccugg

SEQ ID NO: 589012 - RNA, 22 nt, Human
ccaggcuggagugcaguagugu

SEQ ID NO: 589013 - RNA, 22 nt, Human
ccagcacugcucucagacugag

SEQ ID NO: 589014 - RNA, 22 nt, Human
ggggaagagcauugcacggugu

SEQ ID NO: 589015 - RNA, 22 nt, Human
uauuuccacccucaguaaggaa

SEQ ID NO: 589016 - RNA, 22 nt, Human
ugaggcagcaauugauuauuca

SEQ ID NO: 589017 - RNA, 22 nt, Human
aaacagcuuguuucaggaaagu

SEQ ID NO: 589018 - RNA, 22 nt, Human
gugggcaaggucccugccagcu

SEQ ID NO: 589019 - RNA, 22 nt, Human
caaguuaaauuugcauuucaga

SEQ ID NO: 589020 - RNA, 22 nt, Human
ggagaaagcuguaguggaaugu

SEQ ID NO: 589021 - RNA, 22 nt, Human
cuggcccagagagcagagcuua

SEQ ID NO: 589022 - RNA, 22 nt, Human
cagugaaauaguggacaucaaa

SEQ ID NO: 589023 - RNA, 22 nt, Human
uccaggcacagaguuggucagu

SEQ ID NO: 589024 - RNA, 22 nt, Human
auagugaaaaugcugucagcau

SEQ ID NO: 589025 - RNA, 22 nt, Human
gccuucaguaguauccucauga

SEQ ID NO: 589026 - RNA, 22 nt, Human
aaagaguugaggcaguuaucca

SEQ ID NO: 589027 - RNA, 22 nt, Human
ggagcaggcucugugguuucca

SEQ ID NO: 589028 - RNA, 22 nt, Human
aaggcugacguuuguguuuauu

SEQ ID NO: 589029 - RNA, 22 nt, Human
augaggagaccaaggccugaug

SEQ ID NO: 589030 - RNA, 19 nt, Human
ucccucagucugccaggcc

SEQ ID NO: 589031 - RNA, 22 nt, Human
ggugggaaggggccagugugcg

SEQ ID NO: 589032 - RNA, 22 nt, Human
aguacaaaggcccuugauuacu

SEQ ID NO: 589033 - RNA, 22 nt, Human
acagaugcucugaugucugggu

SEQ ID NO: 589034 - RNA, 22 nt, Human
ugccauagcaaugguaagcuga

SEQ ID NO: 589035 - RNA, 22 nt, Human
ugccuggguguaaagggccaac

SEQ ID NO: 589036 - RNA, 22 nt, Human
ccuuugcauucuagauguuuag

SEQ ID NO: 589037 - RNA, 22 nt, Human
cagcuggcugcaugaugccaaa

SEQ ID NO: 589038 - RNA, 22 nt, Human
aauagucucucccacaccaucc

SEQ ID NO: 589039 - RNA, 22 nt, Human
uuucauguuacauuuaaaaugu

SEQ ID NO: 589040 - RNA, 22 nt, Human
agaggccaccacugucagggac

SEQ ID NO: 589041 - RNA, 22 nt, Human
gcucagaaauggcagauggaga

SEQ ID NO: 589042 - RNA, 22 nt, Human
acauaaaggugacuaacaucuu

SEQ ID NO: 589043 - RNA, 22 nt, Human
guccuuggagguguggaaucug

SEQ ID NO: 589044 - RNA, 22 nt, Human
cuucucuggcagaugugugucc

SEQ ID NO: 589045 - RNA, 18 nt, Human
ucacagugcucuugccua

SEQ ID NO: 589046 - RNA, 22 nt, Human
acacugugcaugcauauacaca

SEQ ID NO: 589047 - RNA, 20 nt, Human
cuuuuucuccagcucugagc

SEQ ID NO: 589048 - RNA, 22 nt, Human
cacaugcuccauacagaauggg

SEQ ID NO: 589049 - RNA, 22 nt, Human
cucuuaaagaauguuccagcug

SEQ ID NO: 589050 - RNA, 22 nt, Human
ugugcucuugucugugacuaac

SEQ ID NO: 589051 - RNA, 20 nt, Human
aggagcugaauuagaggguu

SEQ ID NO: 589052 - RNA, 22 nt, Human
aggaccugacuggcuccugcuu

SEQ ID NO: 589053 - RNA, 22 nt, Human
acccugccgugggcugcuugug

SEQ ID NO: 589054 - RNA, 22 nt, Human
uaugcaguguacgauguuuagu

SEQ ID NO: 589055 - RNA, 22 nt, Human
gguuuuauuaccccuuaaacac

SEQ ID NO: 589056 - RNA, 22 nt, Human
ccagccuggguguuagaagaca

SEQ ID NO: 589057 - RNA, 19 nt, Human
acccucucagugccugagg

SEQ ID NO: 589058 - RNA, 22 nt, Human
acugaugaaagguaagacucca

SEQ ID NO: 589059 - RNA, 22 nt, Human
ucagccagcauuaccccugacu

SEQ ID NO: 589060 - RNA, 22 nt, Human
gcacacaggggaguucucagaa

SEQ ID NO: 589061 - RNA, 22 nt, Human
gccaggugagaggacugaggcu

SEQ ID NO: 589062 - RNA, 22 nt, Human
auauuuaacuggucccaauaua

SEQ ID NO: 589063 - RNA, 22 nt, Human
ucccugggucauucucuggcac

SEQ ID NO: 589064 - RNA, 20 nt, Human
ucuguuauugcauguacaua

SEQ ID NO: 589065 - RNA, 16 nt, Human
ggagagugucugcaaa

SEQ ID NO: 589066 - RNA, 22 nt, Human
ugccugccaugcagaaagcuga

SEQ ID NO: 589067 - RNA, 19 nt, Human
uuugucucugaauaauauu

SEQ ID NO: 589068 - RNA, 22 nt, Human
ucagaaucugaaaagcgcuugg

SEQ ID NO: 589069 - RNA, 22 nt, Human
auuagcuuuaaaccacagcagu

SEQ ID NO: 589070 - RNA, 23 nt, Human
cauggggagcagugcuccugacc

SEQ ID NO: 589071 - RNA, 22 nt, Human
ggcagugagucccggagaggcc

SEQ ID NO: 589072 - RNA, 22 nt, Human
uggcucagaacuacuucuaguu

SEQ ID NO: 589073 - RNA, 22 nt, Human
auguguucugaggcagaugacu

SEQ ID NO: 589074 - RNA, 22 nt, Human
ccacacagauaaguguuuucua

SEQ ID NO: 589075 - RNA, 22 nt, Human
caguuucugggaggaaaggaag

SEQ ID NO: 589076 - RNA, 22 nt, Human
ucaggcugcuguacugugaaug

SEQ ID NO: 589077 - RNA, 22 nt, Human
ggcaccagggcaagggucuuuc

SEQ ID NO: 589078 - RNA, 22 nt, Human
cccuccaggcacugcccucuuc

SEQ ID NO: 589079 - RNA, 22 nt, Human
ccuggucagguaacugggcuga

SEQ ID NO: 589080 - RNA, 22 nt, Human
gugcugccggcauagcagugaa

SEQ ID NO: 589081 - RNA, 22 nt, Human
uggcuuccuggacagaugcggu

SEQ ID NO: 589082 - RNA, 22 nt, Human
gucugcugcagucguggcucua

SEQ ID NO: 589083 - RNA, 22 nt, Human
uccaguuuugaauccugcuucu

SEQ ID NO: 589084 - RNA, 22 nt, Human
ccccaugaaguagggucucuga

SEQ ID NO: 589085 - RNA, 22 nt, Human
gcagaggaggacccaggaauua

SEQ ID NO: 589086 - RNA, 22 nt, Human
guggggggagcugcaagcugga

SEQ ID NO: 589087 - RNA, 20 nt, Human
cagcauagcggcucacaucc

SEQ ID NO: 589088 - RNA, 18 nt, Human
ggucaggggcggagagaa

SEQ ID NO: 589089 - RNA, 22 nt, Human
ugaugaccgccaacguuuaggu

SEQ ID NO: 589090 - RNA, 22 nt, Human
auucagcauaaucaguagcuug

SEQ ID NO: 589091 - RNA, 22 nt, Human
uccagcagguuggucaggugca

SEQ ID NO: 589092 - RNA, 22 nt, Human
ugccaggcuuuggucaaaggcu

SEQ ID NO: 589093 - RNA, 22 nt, Human
aggggaggagcuuuucuugccu

SEQ ID NO: 589094 - RNA, 22 nt, Human
ugcagaaguauuccaggcccca

SEQ ID NO: 589095 - RNA, 22 nt, Human
agaagugagugugacucagcag

SEQ ID NO: 589096 - RNA, 22 nt, Human
ucugaaaugaacucuugaacuu

SEQ ID NO: 589097 - RNA, 22 nt, Human
gauugcugcaaucaacaaguau

SEQ ID NO: 589098 - RNA, 22 nt, Human
ucuauguagugccagcuaguau

SEQ ID NO: 589099 - RNA, 20 nt, Human
ccuaguuuucugagcgugac

SEQ ID NO: 589100 - RNA, 18 nt, Human
ucuccuggguaggggccu

SEQ ID NO: 589101 - RNA, 22 nt, Human
agaauaaacugcuuuagggcag

SEQ ID NO: 589102 - RNA, 22 nt, Human
agcagagugugaaggcagggcu

SEQ ID NO: 589103 - RNA, 22 nt, Human
uggcuuucucccccagcuucuc

SEQ ID NO: 589104 - RNA, 17 nt, Human
uugggagagaaagguau

SEQ ID NO: 589105 - RNA, 22 nt, Human
aaacaugaauagauauuaaaca

SEQ ID NO: 589106 - RNA, 22 nt, Human
ucagucccaagguccugaggug

SEQ ID NO: 589107 - RNA, 22 nt, Human
ucuccaggacugagcuccagcc

SEQ ID NO: 589108 - RNA, 22 nt, Human
ucuacauaaaaauucagaaggc

SEQ ID NO: 589109 - RNA, 22 nt, Human
gagaggaguagacacuuugguu

SEQ ID NO: 589110 - RNA, 22 nt, Human
agucaggauaugccuugugggc

SEQ ID NO: 589111 - RNA, 22 nt, Human
uuuccuaagguagugauaauuu

SEQ ID NO: 589112 - RNA, 22 nt, Human
gccaacuggcugaucucaaagc

SEQ ID NO: 589113 - RNA, 22 nt, Human
cagaaguaagauuacugugagu

SEQ ID NO: 589114 - RNA, 22 nt, Human
ucagggaacaauguuauggcuu

SEQ ID NO: 589115 - RNA, 22 nt, Human
cagcuguggcugccacugcucc

SEQ ID NO: 589116 - RNA, 22 nt, Human
agcuggugauguggucccucac

SEQ ID NO: 589117 - RNA, 22 nt, Human
uauuuccugcauggugauguaa

SEQ ID NO: 589118 - RNA, 22 nt, Human
ucucuucuagcuucuugugguu

SEQ ID NO: 589119 - RNA, 22 nt, Human
uugguaaauccccuuacacaaa

SEQ ID NO: 589120 - RNA, 22 nt, Human
cagaggcugggaccucaggcau

SEQ ID NO: 589121 - RNA, 17 nt, Human
ugggggcgccagggucu

SEQ ID NO: 589122 - RNA, 20 nt, Human
ucccucaguccuggcuuugu

SEQ ID NO: 589123 - RNA, 22 nt, Human
gcugagaggcagccagacccuc

SEQ ID NO: 589124 - RNA, 22 nt, Human
agggcccuaaggaaggcacaca

SEQ ID NO: 589125 - RNA, 22 nt, Human
ugaggauuggcaaaacucaggg

SEQ ID NO: 589126 - RNA, 22 nt, Human
aguugucccggucuagccacuu

SEQ ID NO: 589127 - RNA, 22 nt, Human
uaauuauucuagucacauagca

SEQ ID NO: 589128 - RNA, 22 nt, Human
ucuuauaugcacauacauuggg

SEQ ID NO: 589129 - RNA, 22 nt, Human
ggagggcccugggugcagcucu

SEQ ID NO: 589130 - RNA, 22 nt, Human
aacaaugccacauuaaguguau

SEQ ID NO: 589131 - RNA, 22 nt, Human
gagcuguccuaccaggaguccu

SEQ ID NO: 589132 - RNA, 22 nt, Human
cugagcugcucccgcugcagcg

SEQ ID NO: 589133 - RNA, 22 nt, Human
caccucuuugauuugaggcaag

SEQ ID NO: 589134 - RNA, 22 nt, Human
aauuaguaaccuaauuccaucu

SEQ ID NO: 589135 - RNA, 20 nt, Human
guaaaauauggucuuugggu

SEQ ID NO: 589136 - RNA, 22 nt, Human
guccugugucccagagaaagag

SEQ ID NO: 589137 - RNA, 22 nt, Human
ucaguguuauuagaugagguuu

SEQ ID NO: 589138 - RNA, 22 nt, Human
uggagcugguaaacagugacau

SEQ ID NO: 589139 - RNA, 22 nt, Human
auagucuuagaucagauaaagu

SEQ ID NO: 589140 - RNA, 22 nt, Human
cagacagagcucacaagucuuu

SEQ ID NO: 589141 - RNA, 22 nt, Human
cacugcaggucugagauggggg

SEQ ID NO: 589142 - RNA, 22 nt, Human
uuucuuggagcucuuagggucg

SEQ ID NO: 589143 - RNA, 18 nt, Human
ucugggcaaucucaguau

SEQ ID NO: 589144 - RNA, 23 nt, Human
cugcuuccuugcuucauugcugg

SEQ ID NO: 589145 - RNA, 22 nt, Human
aacagaacccgagugugaaucu

SEQ ID NO: 589146 - RNA, 20 nt, Human
uuggcucaugcaacaccuac

SEQ ID NO: 589147 - RNA, 22 nt, Human
aguccaaagcagaugagggcca

SEQ ID NO: 589148 - RNA, 22 nt, Human
aacaagauguuuugauauaugu

SEQ ID NO: 589149 - RNA, 22 nt, Human
aggaaagacuggggccccagaa

SEQ ID NO: 589150 - RNA, 19 nt, Human
uggcugggugccaauggcc

SEQ ID NO: 589151 - RNA, 22 nt, Human
cacaggcaggagguucuccagu

SEQ ID NO: 589152 - RNA, 22 nt, Human
gcccacuccagcuucucccaca

SEQ ID NO: 589153 - RNA, 22 nt, Human
cugagcauuugugcagcuucuc

SEQ ID NO: 589154 - RNA, 22 nt, Human
ggcuccaggugcaugccaggcu

SEQ ID NO: 589155 - RNA, 22 nt, Human
gugcccuggcucacagugucuc

SEQ ID NO: 589156 - RNA, 22 nt, Human
aagauuuaccacuuuauucaag

SEQ ID NO: 589157 - RNA, 22 nt, Human
acacagaaccucauagccucuc

SEQ ID NO: 589158 - RNA, 22 nt, Human
gaggggcuggcuguggucccau

SEQ ID NO: 589159 - RNA, 22 nt, Human
cagucucucuccuugcaggcgu

SEQ ID NO: 589160 - RNA, 22 nt, Human
ccagagggaagaggaagcgcug

SEQ ID NO: 589161 - RNA, 22 nt, Human
ccacagggcacagacaggaagc

SEQ ID NO: 589162 - RNA, 22 nt, Human
gccugggaaaugguggggucag

SEQ ID NO: 589163 - RNA, 22 nt, Human
uccuuauauggcagacagcaga

SEQ ID NO: 589164 - RNA, 19 nt, Human
aucuuacagagcagaguac

SEQ ID NO: 589165 - RNA, 22 nt, Human
cuggagaccucuccugagagug

SEQ ID NO: 589166 - RNA, 22 nt, Human
agagauucugugucaaaacgaa

SEQ ID NO: 589167 - RNA, 22 nt, Human
cagccacuacaauugguuccau

SEQ ID NO: 589168 - RNA, 22 nt, Human
uacaugaaguugucuaaacugg

SEQ ID NO: 589169 - RNA, 22 nt, Human
cucucugggguuccagacgugg

SEQ ID NO: 589170 - RNA, 22 nt, Human
uccuaacuaauuuguagcaaaa

SEQ ID NO: 589171 - RNA, 22 nt, Human
ggcuggacuuucugcugggcuc

SEQ ID NO: 589172 - RNA, 22 nt, Human
acaauuagcugugugucuaucu

SEQ ID NO: 589173 - RNA, 22 nt, Human
ggaagaggcucucauugagggc

SEQ ID NO: 589174 - RNA, 18 nt, Human
cagcugccagcucaugga

SEQ ID NO: 589175 - RNA, 22 nt, Human
cuuuuguugcccuugucgcagg

SEQ ID NO: 589176 - RNA, 22 nt, Human
ucccugcucagcucaccuggca

SEQ ID NO: 589177 - RNA, 22 nt, Human
cugccucucagccugaccgcca

SEQ ID NO: 589178 - RNA, 22 nt, Human
cugggcagaguccggaagaugg

SEQ ID NO: 589179 - RNA, 22 nt, Human
ugccaguugggaaaacagacau

SEQ ID NO: 589180 - RNA, 22 nt, Human
gcucaccuucguccagcagccg

SEQ ID NO: 589181 - RNA, 22 nt, Human
caugugugucuccaccagcugc

SEQ ID NO: 589182 - RNA, 22 nt, Human
caggcagagaggagcauuuaau

SEQ ID NO: 589183 - RNA, 22 nt, Human
aggagaguucacacuggucaga

SEQ ID NO: 589184 - RNA, 22 nt, Human
cuuucucaguguuaauuacuuu

SEQ ID NO: 589185 - RNA, 22 nt, Human
ucccaaggauaagagagucuga

SEQ ID NO: 589186 - RNA, 20 nt, Human
aagauacuccagaaauuaaa

SEQ ID NO: 589187 - RNA, 22 nt, Human
cuuuccuccacucccuaggcuu

SEQ ID NO: 589188 - RNA, 22 nt, Human
ucuggguaugaccuauuuuucc

SEQ ID NO: 589189 - RNA, 22 nt, Human
uuacuuuagaaauagucaucaa

SEQ ID NO: 589190 - RNA, 22 nt, Human
uucuuucucagugggcagauac

SEQ ID NO: 589191 - RNA, 22 nt, Human
ugaguucuucacauuaccuacg

SEQ ID NO: 589192 - RNA, 22 nt, Human
gcucccucugcucaggcacuug

SEQ ID NO: 589193 - RNA, 22 nt, Human
caguucuggaggauagaagucu

SEQ ID NO: 589194 - RNA, 22 nt, Human
uuuccugagccagaguuucauu

SEQ ID NO: 589195 - RNA, 22 nt, Human
cauuagcucagauaccucugag

SEQ ID NO: 589196 - RNA, 22 nt, Human
gcaggagcuuugcuuacugcug

SEQ ID NO: 589197 - RNA, 22 nt, Human
ucccagaagagaugccacuuga

SEQ ID NO: 589198 - RNA, 22 nt, Human
uggcucauucuggggaagucag

SEQ ID NO: 589199 - RNA, 22 nt, Human
cuuaaauuggaugaguuaaguu

SEQ ID NO: 589200 - RNA, 20 nt, Human
agucccagaucaaauuucug

SEQ ID NO: 589201 - RNA, 22 nt, Human
gaagaggaugacaggagccggu

SEQ ID NO: 589202 - RNA, 22 nt, Human
gccaccuggacagcugugcccu

SEQ ID NO: 589203 - RNA, 18 nt, Human
cagaaaguuauuuacucu

SEQ ID NO: 589204 - RNA, 22 nt, Human
augcauaugcaucuguguacau

SEQ ID NO: 589205 - RNA, 22 nt, Human
gacccagcuaaccaggugggga

SEQ ID NO: 589206 - RNA, 22 nt, Human
agaguguguggggcugagguca

SEQ ID NO: 589207 - RNA, 22 nt, Human
ccucagggaggccucuguggcu

SEQ ID NO: 589208 - RNA, 22 nt, Human
uuagcauucucugugugcauaa

SEQ ID NO: 589209 - RNA, 20 nt, Human
caaguguagaaacuaauaag

SEQ ID NO: 589210 - RNA, 23 nt, Human
uugcaaaaugcaauugaguuaga

SEQ ID NO: 589211 - RNA, 23 nt, Human
ccaguggcguaaacuagaggaua

SEQ ID NO: 589212 - RNA, 22 nt, Human
ggagggcaacuuuucaguaggu

SEQ ID NO: 589213 - RNA, 22 nt, Human
gaaaauaggcagaugcauugua

SEQ ID NO: 589214 - RNA, 22 nt, Human
agguaaaauagauaguauuucu

SEQ ID NO: 589215 - RNA, 22 nt, Human
uucacaagugugaaggcagagc

SEQ ID NO: 589216 - RNA, 22 nt, Human
gccucugggggcucagaccugu

SEQ ID NO: 589217 - RNA, 19 nt, Human
ggaaggugacaguggugaa

SEQ ID NO: 589218 - RNA, 22 nt, Human
ucuaguuuucucaaaugacuug

SEQ ID NO: 589219 - RNA, 22 nt, Human
acaucuuuuuucucuaauugug

SEQ ID NO: 589220 - RNA, 18 nt, Human
uaggcugggggcuguagu

SEQ ID NO: 589221 - RNA, 22 nt, Human
gacucagagaucccuggagguc

SEQ ID NO: 589222 - RNA, 22 nt, Human
caaaguuuaaaguagauuucag

SEQ ID NO: 589223 - RNA, 22 nt, Human
accugaggccuccccagcagac

SEQ ID NO: 589224 - RNA, 22 nt, Human
aggagcugcuuuggugcgguuu

SEQ ID NO: 589225 - RNA, 20 nt, Human
accagaggaaagagcaguga

SEQ ID NO: 589226 - RNA, 22 nt, Human
ccaggugugauuuggcaguguc

SEQ ID NO: 589227 - RNA, 22 nt, Human
acauguguggacaugaaucuac

SEQ ID NO: 589228 - RNA, 22 nt, Human
ugggaggacuugugggcuucau

SEQ ID NO: 589229 - RNA, 22 nt, Human
cuacauuaaauuggcuuacuua

SEQ ID NO: 589230 - RNA, 22 nt, Human
gaaggcugucagagaggagggc

SEQ ID NO: 589231 - RNA, 20 nt, Human
cagcaggcuauggggcaccc

SEQ ID NO: 589232 - RNA, 22 nt, Human
ggagugaguacuggaguagcug

SEQ ID NO: 589233 - RNA, 22 nt, Human
gggggaagaaagaacauggcau

SEQ ID NO: 589234 - RNA, 17 nt, Human
ucauuucuaggcacucc

SEQ ID NO: 589235 - RNA, 22 nt, Human
uacuuaaaacugauagaaucuc

SEQ ID NO: 589236 - RNA, 22 nt, Human
ccugggagaacugcuggguugg

SEQ ID NO: 589237 - RNA, 22 nt, Human
gugaaaugaaucuggaaauauu

SEQ ID NO: 589238 - RNA, 22 nt, Human
uuguguuucccuugcauauucc

SEQ ID NO: 589239 - RNA, 22 nt, Human
agcaggaacgaguucaugggga

SEQ ID NO: 589240 - RNA, 22 nt, Human
gcagggcuguaauuugagccug

SEQ ID NO: 589241 - RNA, 22 nt, Human
ucccaggauguuuauggcuggu

SEQ ID NO: 589242 - RNA, 22 nt, Human
cuacaggaaggaucuugcucaa

SEQ ID NO: 589243 - RNA, 22 nt, Human
ccaggugugcucugcaguggau

SEQ ID NO: 589244 - RNA, 22 nt, Human
cuucugugacguaugugaggac

SEQ ID NO: 589245 - RNA, 22 nt, Human
gaugauuuuaguugacuaaacu

SEQ ID NO: 589246 - RNA, 22 nt, Human
gaggagaagcuaagaaacacag

SEQ ID NO: 589247 - RNA, 22 nt, Human
gccugggauuguguaagugaau

SEQ ID NO: 589248 - RNA, 22 nt, Human
caguuuuagcuagagcaaacca

SEQ ID NO: 589249 - RNA, 22 nt, Human
cuuauuuccugacauggaaaga

SEQ ID NO: 589250 - RNA, 22 nt, Human
uggaggccagugaaaguagauu

SEQ ID NO: 589251 - RNA, 22 nt, Human
gugggcaguucaauucugggag

SEQ ID NO: 589252 - RNA, 22 nt, Human
aaaaugagauacaguuugaaag

SEQ ID NO: 589253 - RNA, 22 nt, Human
gaaagcugaaccaggaaccaug

SEQ ID NO: 589254 - RNA, 22 nt, Human
caaaugaaguccaaagggcuua

SEQ ID NO: 589255 - RNA, 22 nt, Human
uacacuguacgcucugcuucaa

SEQ ID NO: 589256 - RNA, 22 nt, Human
aagggcugaaagaccuugggca

SEQ ID NO: 589257 - RNA, 22 nt, Human
uauuugaaaguguacaaaaacu

SEQ ID NO: 589258 - RNA, 22 nt, Human
ucucuaguauaauauagcaaaa

SEQ ID NO: 589259 - RNA, 22 nt, Human
uuucaaaguugggaauuguaau

SEQ ID NO: 589260 - RNA, 22 nt, Human
uuguuuuauucugcaauuuccc

SEQ ID NO: 589261 - RNA, 22 nt, Human
ccagcgacugugaccucagcua

SEQ ID NO: 589262 - RNA, 22 nt, Human
uggccugguuguugcugccguu

SEQ ID NO: 589263 - RNA, 23 nt, Human
ggcugggagcuccgggugcacgu

SEQ ID NO: 589264 - RNA, 22 nt, Human
aggaagcuuggggcagggcuac

SEQ ID NO: 589265 - RNA, 22 nt, Human
uauggaaagggaguuuaauuug

SEQ ID NO: 589266 - RNA, 22 nt, Human
uaauuuuaacugugcuguuugg

SEQ ID NO: 589267 - RNA, 22 nt, Human
agaacagcaguuaugguucauu

SEQ ID NO: 589268 - RNA, 22 nt, Human
uccuugaauugugccacuuacc

SEQ ID NO: 589269 - RNA, 18 nt, Human
cccagcuggugggucagu

SEQ ID NO: 589270 - RNA, 22 nt, Human
aggaauucaagaccagcugggc

SEQ ID NO: 589271 - RNA, 23 nt, Human
cuugggcuagagacuuagcagug

SEQ ID NO: 589272 - RNA, 22 nt, Human
ugcccugguuacacuggagucc

SEQ ID NO: 589273 - RNA, 22 nt, Human
uugagcaaugcugcaaagagau

SEQ ID NO: 589274 - RNA, 22 nt, Human
ucugaaaugcaggcaauuugcu

SEQ ID NO: 589275 - RNA, 22 nt, Human
auucugaaguugcaggagaagc

SEQ ID NO: 589276 - RNA, 22 nt, Human
uuaauuuucucaucugugaaau

SEQ ID NO: 589277 - RNA, 22 nt, Human
ccuggccuggcacucccucugc

SEQ ID NO: 589278 - RNA, 22 nt, Human
agagucuggugcaugauaagca

SEQ ID NO: 589279 - RNA, 22 nt, Human
agucccagccuguaggauuggg

SEQ ID NO: 589280 - RNA, 22 nt, Human
ucaguuucuaaaucuuaccaau

SEQ ID NO: 589281 - RNA, 21 nt, Human
uucaacaaagggaauaaguuu

SEQ ID NO: 589282 - RNA, 22 nt, Human
cugcagcuauauuuucccacag

SEQ ID NO: 589283 - RNA, 22 nt, Human
ucugcucuccauacuuccgcac

SEQ ID NO: 589284 - RNA, 22 nt, Human
uguuucaaagguuauacaguca

SEQ ID NO: 589285 - RNA, 22 nt, Human
ccugagagcauuccacacugaa

SEQ ID NO: 589286 - RNA, 22 nt, Human
gaggcugguuugccuuuuggca

SEQ ID NO: 589287 - RNA, 22 nt, Human
aucaguuauuuuuaagcuauaa

SEQ ID NO: 589288 - RNA, 22 nt, Human
uucaacauuuaucaguuuauca

SEQ ID NO: 589289 - RNA, 22 nt, Human
guucucauaguggaaaauaggu

SEQ ID NO: 589290 - RNA, 22 nt, Human
cauuucauaguugucacaauaa

SEQ ID NO: 589291 - RNA, 19 nt, Human
uaacaaagucugaagucag

SEQ ID NO: 589292 - RNA, 22 nt, Human
cagcagcugcgugcccaggccg

SEQ ID NO: 589293 - RNA, 22 nt, Human
gccuggcucccucugcagcucc

SEQ ID NO: 589294 - RNA, 22 nt, Human
acaggauuacuggauuaugaca

SEQ ID NO: 589295 - RNA, 22 nt, Human
ucagaagcaggagugugcacaa

SEQ ID NO: 589296 - RNA, 22 nt, Human
gcagagcagugcuugcccagcg

SEQ ID NO: 589297 - RNA, 22 nt, Human
auauuucagguuuugcaggccg

SEQ ID NO: 589298 - RNA, 22 nt, Human
ucauugucgcucugcgguguuc

SEQ ID NO: 589299 - RNA, 22 nt, Human
cagcagacuggaguaggcagug

SEQ ID NO: 589300 - RNA, 18 nt, Human
ucagcuggggcugcagcc

SEQ ID NO: 589301 - RNA, 22 nt, Human
aagagguuucaugauuuucuua

SEQ ID NO: 589302 - RNA, 22 nt, Human
uacaaguauggaaugauucuca

SEQ ID NO: 589303 - RNA, 22 nt, Human
gucccucacccagaugcuccca

SEQ ID NO: 589304 - RNA, 22 nt, Human
acacagcuaugggguaggaaac

SEQ ID NO: 589305 - RNA, 22 nt, Human
gugggcagagcaagggaacuca

SEQ ID NO: 589306 - RNA, 22 nt, Human
gugaagcaguugcguggguucc

SEQ ID NO: 589307 - RNA, 20 nt, Human
gugggcagcaggcauacugg

SEQ ID NO: 589308 - RNA, 21 nt, Human
gaguggaacgcucuucacacc

SEQ ID NO: 589309 - RNA, 22 nt, Human
uuuauuuaaagucguguguuaa

SEQ ID NO: 589310 - RNA, 19 nt, Human
ccagagcccgccagauggg

SEQ ID NO: 589311 - RNA, 22 nt, Human
caguuuuaugucgaauguauac

SEQ ID NO: 589312 - RNA, 23 nt, Human
ucuacaaagcugugucaggaccc

SEQ ID NO: 589313 - RNA, 22 nt, Human
uucuuuauguuaaugaaucuau

SEQ ID NO: 589314 - RNA, 22 nt, Human
uguaccaaaaaugugucagacu

SEQ ID NO: 589315 - RNA, 22 nt, Human
ugaagacaguuuuacucaugag

SEQ ID NO: 589316 - RNA, 22 nt, Human
gggcugggcaugguguucccuc

SEQ ID NO: 589317 - RNA, 22 nt, Human
ggagcuguuauggcauaagcau

SEQ ID NO: 589318 - RNA, 22 nt, Human
acugcuuuugaucucuucugua

SEQ ID NO: 589319 - RNA, 18 nt, Human
uuacacuagccuugguuc

SEQ ID NO: 589320 - RNA, 23 nt, Human
uuucucugagaagcaguucucua

SEQ ID NO: 589321 - RNA, 22 nt, Human
auguauaaugcuaauuagcuag

SEQ ID NO: 589322 - RNA, 22 nt, Human
acauuguagacuuuucauaugu

SEQ ID NO: 589323 - RNA, 22 nt, Human
cccagcacaggcaauuccauac

SEQ ID NO: 589324 - RNA, 22 nt, Human
ccuccacucuggccucucaggu

SEQ ID NO: 589325 - RNA, 22 nt, Human
cagaggggauaacagguguaga

SEQ ID NO: 589326 - RNA, 22 nt, Human
cuccaggcccacggccgcggcc

SEQ ID NO: 589327 - RNA, 22 nt, Human
ucuugcuagaaucauuuggaga

SEQ ID NO: 589328 - RNA, 22 nt, Human
uccacaugacuucuaauaacug

SEQ ID NO: 589329 - RNA, 22 nt, Human
aguggcugccaagagcaaugcu

SEQ ID NO: 589330 - RNA, 22 nt, Human
ugcugccacugguagucucauu

SEQ ID NO: 589331 - RNA, 22 nt, Human
ggacacagaccuuucuguucua

SEQ ID NO: 589332 - RNA, 23 nt, Human
ugguggggucuuggagacagcac

SEQ ID NO: 589333 - RNA, 18 nt, Human
ugguuugucaugagaauu

SEQ ID NO: 589334 - RNA, 22 nt, Human
uaagaugacuacuuaccacuga

SEQ ID NO: 589335 - RNA, 22 nt, Human
agcuggugcugaagcucuugag

SEQ ID NO: 589336 - RNA, 22 nt, Human
uuggucaaggacauuacaguuu

SEQ ID NO: 589337 - RNA, 22 nt, Human
ccacccugagccgcaagagcag

SEQ ID NO: 589338 - RNA, 20 nt, Human
cagcaggaaaagugccucag

SEQ ID NO: 589339 - RNA, 22 nt, Human
ucuuucagccacuuaccugucu

SEQ ID NO: 589340 - RNA, 22 nt, Human
aauguuuuauagcucaagcaau

SEQ ID NO: 589341 - RNA, 23 nt, Human
uagagcagggaaaucugucagag

SEQ ID NO: 589342 - RNA, 22 nt, Human
ucuuucugcacuuaguggggcu

SEQ ID NO: 589343 - RNA, 22 nt, Human
guguggccucaacgggaugcaa

SEQ ID NO: 589344 - RNA, 22 nt, Human
acccaggagcaggcugggcagu

SEQ ID NO: 589345 - RNA, 22 nt, Human
acaaugucaccucucauguuuu

SEQ ID NO: 589346 - RNA, 22 nt, Human
gcucaaggcaggcagacaugag

SEQ ID NO: 589347 - RNA, 21 nt, Human
agcugagcccagaagacuggu

SEQ ID NO: 589348 - RNA, 22 nt, Human
agacaggcugcugucugcuagg

SEQ ID NO: 589349 - RNA, 20 nt, Human
acuaugaaguuagcccucca

SEQ ID NO: 589350 - RNA, 22 nt, Human
aauguuuuuuggucugaugaau

SEQ ID NO: 589351 - RNA, 22 nt, Human
uuccacagcccaagcugguggc

SEQ ID NO: 589352 - RNA, 19 nt, Human
gcccaggggcccgaugcug

SEQ ID NO: 589353 - RNA, 22 nt, Human
aucuguuccccuaugcucucua

SEQ ID NO: 589354 - RNA, 22 nt, Human
ggaaaguccuucuaaagccaga

SEQ ID NO: 589355 - RNA, 22 nt, Human
ucacccagauagugagcauagu

SEQ ID NO: 589356 - RNA, 22 nt, Human
gauggccucagugcccaaagga

SEQ ID NO: 589357 - RNA, 22 nt, Human
ccuggcugcauuuugcuggaug

SEQ ID NO: 589358 - RNA, 22 nt, Human
cgcccagggcaggaggccgcuc

SEQ ID NO: 589359 - RNA, 22 nt, Human
cagagguuugaucgaguagguc

SEQ ID NO: 589360 - RNA, 22 nt, Human
cugagcugagccaaaucugucu

SEQ ID NO: 589361 - RNA, 22 nt, Human
gucugaaaguagggcugaucua

SEQ ID NO: 589362 - RNA, 21 nt, Human
cagggcacacagaggauggua

SEQ ID NO: 589363 - RNA, 22 nt, Human
gaguuauauccugagucauauu

SEQ ID NO: 589364 - RNA, 22 nt, Human
ccugucuguccucucaugagcc

SEQ ID NO: 589365 - RNA, 22 nt, Human
aggauucauggugcagacaaag

SEQ ID NO: 589366 - RNA, 22 nt, Human
caguagcacuagauaugugugg

SEQ ID NO: 589367 - RNA, 22 nt, Human
uggcacagagggacccagcagc

SEQ ID NO: 589368 - RNA, 22 nt, Human
auaaaaucuuuaugugcucugc

SEQ ID NO: 589369 - RNA, 22 nt, Human
gcaguccucucauuggccuccu

SEQ ID NO: 589370 - RNA, 22 nt, Human
cacugcuuuaaggcugaguaac

SEQ ID NO: 589371 - RNA, 22 nt, Human
cugucuguacugagaguucugu

SEQ ID NO: 589372 - RNA, 22 nt, Human
uuuuuguucccagagaauuugu

SEQ ID NO: 589373 - RNA, 22 nt, Human
acucacaagugaugugaauggc

SEQ ID NO: 589374 - RNA, 22 nt, Human
agcuccagcggauggucuuaua

SEQ ID NO: 589375 - RNA, 22 nt, Human
uggccugggccggcagauauac

SEQ ID NO: 589376 - RNA, 22 nt, Human
ugcugugagguugagaaggaag

SEQ ID NO: 589377 - RNA, 22 nt, Human
agugugagccuacaggccaaag

SEQ ID NO: 589378 - RNA, 22 nt, Human
gagccuggccuccugccucagc

SEQ ID NO: 589379 - RNA, 22 nt, Human
gccaggcauuauuccgaucccu

SEQ ID NO: 589380 - RNA, 22 nt, Human
aagggcagaauagagaagaugg

SEQ ID NO: 589381 - RNA, 22 nt, Human
agggcugacaguaaaaguauga

SEQ ID NO: 589382 - RNA, 22 nt, Human
aaauagauugcugaggcauuac

SEQ ID NO: 589383 - RNA, 22 nt, Human
aaacauuguaauuuuagcaugg

SEQ ID NO: 589384 - RNA, 22 nt, Human
augucacauggucaccucuagc

SEQ ID NO: 589385 - RNA, 22 nt, Human
aggaaauugggacacagagaaa

SEQ ID NO: 589386 - RNA, 22 nt, Human
ugaacagaucaauagaacugac

SEQ ID NO: 589387 - RNA, 22 nt, Human
acaggugggcuuaagagucggc

SEQ ID NO: 589388 - RNA, 22 nt, Human
cuggaagagcauuugcauaggg

SEQ ID NO: 589389 - RNA, 22 nt, Human
caguccauaugccauaauucuu

SEQ ID NO: 589390 - RNA, 22 nt, Human
uguacagugccaugcaguuugc

SEQ ID NO: 589391 - RNA, 22 nt, Human
auacaguguacuauuuagcagu

SEQ ID NO: 589392 - RNA, 22 nt, Human
gauuucuucucucccaagagga

SEQ ID NO: 589393 - RNA, 22 nt, Human
ucugggcugggcuuaggaaccc

SEQ ID NO: 589394 - RNA, 22 nt, Human
gugugucccuacaacagcuuca

SEQ ID NO: 589395 - RNA, 20 nt, Human
uuuacauuuugaaacaguga

SEQ ID NO: 589396 - RNA, 22 nt, Human
uaaacaaggguuacugagcaug

SEQ ID NO: 589397 - RNA, 22 nt, Human
ggaguagcugcauuccgagcac

SEQ ID NO: 589398 - RNA, 16 nt, Human
uuuuauugugacagcc

SEQ ID NO: 589399 - RNA, 22 nt, Human
agggcucugggguggcagagau

SEQ ID NO: 589400 - RNA, 22 nt, Human
agacacugaauguuuggugguc

SEQ ID NO: 589401 - RNA, 22 nt, Human
aauguacaauaagacaaagagg

SEQ ID NO: 589402 - RNA, 17 nt, Human
ggcaggugacagacacc

SEQ ID NO: 589403 - RNA, 22 nt, Human
gcaaaggcuagagacacaggga

SEQ ID NO: 589404 - RNA, 22 nt, Human
gccuaggaguacagaaugguuu

SEQ ID NO: 589405 - RNA, 22 nt, Human
uucaguuuucuuuagaauguag

SEQ ID NO: 589406 - RNA, 22 nt, Human
cauucuuacacaauauuuuaau

SEQ ID NO: 589407 - RNA, 22 nt, Human
auugacagcaggggcugucacu

SEQ ID NO: 589408 - RNA, 22 nt, Human
gagaggcucugaggacuggggu

SEQ ID NO: 589409 - RNA, 22 nt, Human
uggcaguucuaauugaccauuu

SEQ ID NO: 589410 - RNA, 22 nt, Human
cagcuguugaucucuuaagccu

SEQ ID NO: 589411 - RNA, 22 nt, Human
ggcugagcccccucugcguagg

SEQ ID NO: 589412 - RNA, 22 nt, Human
gagagggagccagccaggaacc

SEQ ID NO: 589413 - RNA, 22 nt, Human
aaaugcauucuguuuucacuag

SEQ ID NO: 589414 - RNA, 22 nt, Human
gggccagguaucgucuuuagua

SEQ ID NO: 589415 - RNA, 22 nt, Human
ugcuggaguggcacuguguggc

SEQ ID NO: 589416 - RNA, 22 nt, Human
ucugaguuuucugagaagcuua

SEQ ID NO: 589417 - RNA, 22 nt, Human
cccagagaagugaagugacuug

SEQ ID NO: 589418 - RNA, 22 nt, Human
gaauguuauguauccagucaca

SEQ ID NO: 589419 - RNA, 22 nt, Human
ucugccuuggcaaccacagcuu

SEQ ID NO: 589420 - RNA, 22 nt, Human
acuuucuaggucucaguccuuu

SEQ ID NO: 589421 - RNA, 22 nt, Human
ucccagcucacauaugguaacu

SEQ ID NO: 589422 - RNA, 22 nt, Human
gguaggggaagacaagugaaaa

SEQ ID NO: 589423 - RNA, 20 nt, Human
caguagcaauaauuagaagc

SEQ ID NO: 589424 - RNA, 22 nt, Human
uacaaagaggcagcuccauuuu

SEQ ID NO: 589425 - RNA, 22 nt, Human
uguccccagagccuguuccugc

SEQ ID NO: 589426 - RNA, 22 nt, Human
cugcagcugucucuacugggca

SEQ ID NO: 589427 - RNA, 22 nt, Human
ugggccugugaugcugggcuau

SEQ ID NO: 589428 - RNA, 21 nt, Human
ugaaagaggauguggucauuc

SEQ ID NO: 589429 - RNA, 22 nt, Human
cauggcauugcauaacggggcu

SEQ ID NO: 589430 - RNA, 22 nt, Human
ccagcuuucauaucaugaggua

SEQ ID NO: 589431 - RNA, 22 nt, Human
gcuuccagaccccagucccuca

SEQ ID NO: 589432 - RNA, 22 nt, Human
ucuucucuccugcuuggcagaa

SEQ ID NO: 589433 - RNA, 22 nt, Human
caguggggaggccaggauagaa

SEQ ID NO: 589434 - RNA, 22 nt, Human
aagguacagaaauuaacaagga

SEQ ID NO: 589435 - RNA, 22 nt, Human
acuaagaccuagauacuagggg

SEQ ID NO: 589436 - RNA, 22 nt, Human
agucucugagguucagaugccu

SEQ ID NO: 589437 - RNA, 22 nt, Human
acagcuggaguguuggugaggu

SEQ ID NO: 589438 - RNA, 17 nt, Human
uuuauaauuggccucuu

SEQ ID NO: 589439 - RNA, 22 nt, Human
ucugauaauggacuucucaucu

SEQ ID NO: 589440 - RNA, 22 nt, Human
cagaggaggcgguauacacugc

SEQ ID NO: 589441 - RNA, 22 nt, Human
auuuuaauaagauucccaagua

SEQ ID NO: 589442 - RNA, 22 nt, Human
gcacaggcacagagggccacug

SEQ ID NO: 589443 - RNA, 22 nt, Human
agcccagugggccgaggcgggg

SEQ ID NO: 589444 - RNA, 22 nt, Human
ggcagacuuuuucucugaaggg

SEQ ID NO: 589445 - RNA, 22 nt, Human
guccugggcccaggggcugccu

SEQ ID NO: 589446 - RNA, 22 nt, Human
agccaggccagacucacacccu

SEQ ID NO: 589447 - RNA, 22 nt, Human
ucacuuuggauuauguaauuuc

SEQ ID NO: 589448 - RNA, 22 nt, Human
aaauuuuagacuccugggucua

SEQ ID NO: 589449 - RNA, 22 nt, Human
ggcagcaguaggagcuaaucuu

SEQ ID NO: 589450 - RNA, 22 nt, Human
ucaguaaaucucuaauuggcau

SEQ ID NO: 589451 - RNA, 22 nt, Human
ugcuuccuugaucauucccaaa

SEQ ID NO: 589452 - RNA, 22 nt, Human
augacaaaauaaauggucucug

SEQ ID NO: 589453 - RNA, 22 nt, Human
acuucuaagcucaaauugguau

SEQ ID NO: 589454 - RNA, 22 nt, Human
uuauagaacgguucugugcaaa

SEQ ID NO: 589455 - RNA, 22 nt, Human
uggcagcuggagggcaauggcc

SEQ ID NO: 589456 - RNA, 22 nt, Human
augaagcagauuuauuacucac

SEQ ID NO: 589457 - RNA, 22 nt, Human
agcagccuugcaggggucgcac

SEQ ID NO: 589458 - RNA, 22 nt, Human
gaggcugacggcaccaucuucu

SEQ ID NO: 589459 - RNA, 21 nt, Human
gggcuccagagauguagcuuc

SEQ ID NO: 589460 - RNA, 22 nt, Human
acagauaauuagcauaaaugcu

SEQ ID NO: 589461 - RNA, 22 nt, Human
ucagcacugauagaagucaaua

SEQ ID NO: 589462 - RNA, 22 nt, Human
agaguuugggugggacagcuug

SEQ ID NO: 589463 - RNA, 22 nt, Human
aggagggugauccgggcugguc

SEQ ID NO: 589464 - RNA, 22 nt, Human
uuuacaagucuguugaucccaa

SEQ ID NO: 589465 - RNA, 22 nt, Human
ccaggcccugccugugguuccu

SEQ ID NO: 589466 - RNA, 22 nt, Human
agaaacuaaagccaagggcucu

SEQ ID NO: 589467 - RNA, 22 nt, Human
auuauuugcuuggcucaucuaa

SEQ ID NO: 589468 - RNA, 22 nt, Human
agacacagaaguugcuguuggg

SEQ ID NO: 589469 - RNA, 22 nt, Human
caggaaccugugcguagggaug

SEQ ID NO: 589470 - RNA, 22 nt, Human
aaaaugauauccugacuuuuau

SEQ ID NO: 589471 - RNA, 22 nt, Human
ggcuucauuucuguccuugauu

SEQ ID NO: 589472 - RNA, 22 nt, Human
gggaggugauggcaagcagcgg

SEQ ID NO: 589473 - RNA, 22 nt, Human
cucuccagccacagaagcugcu

SEQ ID NO: 589474 - RNA, 22 nt, Human
aacaagucuuugguuuuggcua

SEQ ID NO: 589475 - RNA, 18 nt, Human
caagagcugcuccuggcc

SEQ ID NO: 589476 - RNA, 21 nt, Human
gcuggagagccaggcaggggc

SEQ ID NO: 589477 - RNA, 19 nt, Human
gcgaggaagucacuguggc

SEQ ID NO: 589478 - RNA, 22 nt, Human
gauaaaauaacuauggaauacu

SEQ ID NO: 589479 - RNA, 22 nt, Human
ugaucaaagugcuggaauuaca

SEQ ID NO: 589480 - RNA, 22 nt, Human
aacuuccuucuaguucauaugu

SEQ ID NO: 589481 - RNA, 22 nt, Human
gaggagaagcuauuggaaggac

SEQ ID NO: 589482 - RNA, 22 nt, Human
guaaguaauaagugcucaauaa

SEQ ID NO: 589483 - RNA, 22 nt, Human
uuauuguaggccuauuguagaa

SEQ ID NO: 589484 - RNA, 20 nt, Human
acugcuucuuucucugaccu

SEQ ID NO: 589485 - RNA, 22 nt, Human
uuaagagaagaguaucuagaac

SEQ ID NO: 589486 - RNA, 22 nt, Human
acccuccacuuuaucugucuuu

SEQ ID NO: 589487 - RNA, 22 nt, Human
aagacacuggguuaggcacgug

SEQ ID NO: 589488 - RNA, 22 nt, Human
uauuucaacguaugaaaagcug

SEQ ID NO: 589489 - RNA, 22 nt, Human
gugcaccagucacaugggcaga

SEQ ID NO: 589490 - RNA, 17 nt, Human
ugcacaagagacaauag

SEQ ID NO: 589491 - RNA, 22 nt, Human
agcugcaggccucuccugggga

SEQ ID NO: 589492 - RNA, 22 nt, Human
uguggggaggcugcagugcugc

SEQ ID NO: 589493 - RNA, 22 nt, Human
ccuggcagcgugccgagcugcg

SEQ ID NO: 589494 - RNA, 22 nt, Human
gccugagaaggacacagcaggu

SEQ ID NO: 589495 - RNA, 22 nt, Human
agugcaggccccaggccaggcc

SEQ ID NO: 589496 - RNA, 22 nt, Human
uaaaugaaaggguuuaauuuau

SEQ ID NO: 589497 - RNA, 20 nt, Human
uggcaggacuggcuccaccc

SEQ ID NO: 589498 - RNA, 22 nt, Human
caaacugagcaucagaaaguuu

SEQ ID NO: 589499 - RNA, 22 nt, Human
ggccccaguucacuccuggccg

SEQ ID NO: 589500 - RNA, 22 nt, Human
cucuggcuaucuguuucuaugu

SEQ ID NO: 589501 - RNA, 22 nt, Human
uagaaacccaggauuuguauuu

SEQ ID NO: 589502 - RNA, 22 nt, Human
acauguaucugaucugcaauug

SEQ ID NO: 589503 - RNA, 22 nt, Human
uaauguaaagaagauguaggaa

SEQ ID NO: 589504 - RNA, 22 nt, Human
cccagcagccuggauguucuuu

SEQ ID NO: 589505 - RNA, 22 nt, Human
uaaaaguaggaaugaaacgcau

SEQ ID NO: 589506 - RNA, 22 nt, Human
uaaagguuaguagcagggaaac

SEQ ID NO: 589507 - RNA, 17 nt, Human
uccuuggcaaccaguuc

SEQ ID NO: 589508 - RNA, 22 nt, Human
uugugggaucucccuguugcuc

SEQ ID NO: 589509 - RNA, 22 nt, Human
gauaacaugguuaguguuuuua

SEQ ID NO: 589510 - RNA, 21 nt, Human
cugugggaccaagcacuggga

SEQ ID NO: 589511 - RNA, 22 nt, Human
cuguuuucuagggcugagguga

SEQ ID NO: 589512 - RNA, 21 nt, Human
ccaggguccagcugccauggu

SEQ ID NO: 589513 - RNA, 22 nt, Human
acugccugugcacuggucuuuu

SEQ ID NO: 589514 - RNA, 22 nt, Human
aggaagagcuggaccagaggac

SEQ ID NO: 589515 - RNA, 22 nt, Human
gcuuugcuuccuguucuagccu

SEQ ID NO: 589516 - RNA, 22 nt, Human
ggcuggagacaacguccugccc

SEQ ID NO: 589517 - RNA, 23 nt, Human
agguagguuauugcugcuaccug

SEQ ID NO: 589518 - RNA, 22 nt, Human
ggucccaggcucccucuugucc

SEQ ID NO: 589519 - RNA, 22 nt, Human
aagggcaggagaagacggauau

SEQ ID NO: 589520 - RNA, 19 nt, Human
auaaauaaaaagugggaga

SEQ ID NO: 589521 - RNA, 20 nt, Human
uccugguggauacugcuuaa

SEQ ID NO: 589522 - RNA, 22 nt, Human
uagcaaagguagaguuuugaga

SEQ ID NO: 589523 - RNA, 22 nt, Human
ccuguacauuagcugugaauug

SEQ ID NO: 589524 - RNA, 22 nt, Human
gcaguaagauguaagugcuaua

SEQ ID NO: 589525 - RNA, 22 nt, Human
ccaauguuuauuuuccugcugc

SEQ ID NO: 589526 - RNA, 22 nt, Human
cugugacugcagcaccaaguaa

SEQ ID NO: 589527 - RNA, 22 nt, Human
uuucuaagacauuugucaucuu

SEQ ID NO: 589528 - RNA, 22 nt, Human
cccaaccagaaauugacagaca

SEQ ID NO: 589529 - RNA, 22 nt, Human
cccaguaccucuguucccugcu

SEQ ID NO: 589530 - RNA, 22 nt, Human
uuucagaaagcaucaucaaagu

SEQ ID NO: 589531 - RNA, 22 nt, Human
augcuuaacucuguacauaguu

SEQ ID NO: 589532 - RNA, 22 nt, Human
gugacagucaaagacaugacuu

SEQ ID NO: 589533 - RNA, 22 nt, Human
ucugccaugcuaacuucaguau

SEQ ID NO: 589534 - RNA, 22 nt, Human
gaugucuuuuuccaggcucuuu

SEQ ID NO: 589535 - RNA, 22 nt, Human
uuggcucacaaggacgguugcu

SEQ ID NO: 589536 - RNA, 22 nt, Human
aacaugucuuuagagaaacauu

SEQ ID NO: 589537 - RNA, 22 nt, Human
uagccagggagacacuguggag

SEQ ID NO: 589538 - RNA, 22 nt, Human
uggcucuguugagguauggauu

SEQ ID NO: 589539 - RNA, 22 nt, Human
uugcccugucaguagaagugca

SEQ ID NO: 589540 - RNA, 22 nt, Human
gcaguuuuagagcuuuaagaug

SEQ ID NO: 589541 - RNA, 22 nt, Human
uuauagaugccuugaguaaaug

SEQ ID NO: 589542 - RNA, 22 nt, Human
ucaucuguucauacacaugcgu

SEQ ID NO: 589543 - RNA, 22 nt, Human
ggcacacauagaucugcacugg

SEQ ID NO: 589544 - RNA, 22 nt, Human
aguggcagagccaaguagagcc

SEQ ID NO: 589545 - RNA, 22 nt, Human
ugugccuggcauucugggcuuc

SEQ ID NO: 589546 - RNA, 22 nt, Human
uacagcuuuugcagcuguuuug

SEQ ID NO: 589547 - RNA, 22 nt, Human
gagcuuccauccuuacugugug

SEQ ID NO: 589548 - RNA, 19 nt, Human
caggacaguuugccaagaa

SEQ ID NO: 589549 - RNA, 22 nt, Human
gaggcagagacuccaccuucag

SEQ ID NO: 589550 - RNA, 21 nt, Human
ugcuucccugggccacacuga

SEQ ID NO: 589551 - RNA, 21 nt, Human
auaaauucugagaggcucugc

SEQ ID NO: 589552 - RNA, 22 nt, Human
aagcuggcaauuaucaaaacug

SEQ ID NO: 589553 - RNA, 22 nt, Human
caguccuuaaggaaacauuugu

SEQ ID NO: 589554 - RNA, 22 nt, Human
uuagcaauuccagguaaguuau

SEQ ID NO: 589555 - RNA, 17 nt, Human
gguggaaguuucuaguu

SEQ ID NO: 589556 - RNA, 22 nt, Human
uuuacacugugaaacagguauc

SEQ ID NO: 589557 - RNA, 22 nt, Human
ggagacaggguugaaccacgca

SEQ ID NO: 589558 - RNA, 22 nt, Human
aggcuccuuguucaucauccau

SEQ ID NO: 589559 - RNA, 22 nt, Human
uggguccagugcagcugcgcgu

SEQ ID NO: 589560 - RNA, 23 nt, Human
caacuuuuggcuacaugcuuagc

SEQ ID NO: 589561 - RNA, 17 nt, Human
acacaguacuuuuuugc

SEQ ID NO: 589562 - RNA, 22 nt, Human
cucugcaggcacccaggguggg

SEQ ID NO: 589563 - RNA, 22 nt, Human
aguuuuuccguggcuacgauaa

SEQ ID NO: 589564 - RNA, 22 nt, Human
augagguaguauuagaaggaga

SEQ ID NO: 589565 - RNA, 22 nt, Human
aaaugcacugaacacauguugu

SEQ ID NO: 589566 - RNA, 22 nt, Human
auuucauguuaacugaacagaa

SEQ ID NO: 589567 - RNA, 20 nt, Human
uccccagggcaucaggagca

SEQ ID NO: 589568 - RNA, 17 nt, Human
agaguuuuaagaaauuu

SEQ ID NO: 589569 - RNA, 22 nt, Human
aaagcaauagaggguaagacug

SEQ ID NO: 589570 - RNA, 22 nt, Human
gcaggagccacuucagggaugc

SEQ ID NO: 589571 - RNA, 22 nt, Human
caugucuuccuugcacacacac

SEQ ID NO: 589572 - RNA, 22 nt, Human
ucugccucgcuaacagcagcca

SEQ ID NO: 589573 - RNA, 22 nt, Human
gggaaacugcaacucagagagg

SEQ ID NO: 589574 - RNA, 22 nt, Human
aauaaaaugaacugguagaguu

SEQ ID NO: 589575 - RNA, 22 nt, Human
acaggcugaaaguuaaguucug

SEQ ID NO: 589576 - RNA, 22 nt, Human
cagugagggcccccuuccaggu

SEQ ID NO: 589577 - RNA, 22 nt, Human
uuucaauuuccaggcuagaauu

SEQ ID NO: 589578 - RNA, 22 nt, Human
ggcaccaggacaugacucccag

SEQ ID NO: 589579 - RNA, 22 nt, Human
uguuaugaguccucauauacua

SEQ ID NO: 589580 - RNA, 22 nt, Human
gcuuagucaauuauaaauaggc

SEQ ID NO: 589581 - RNA, 22 nt, Human
aaucacauuagugaaacacuga

SEQ ID NO: 589582 - RNA, 22 nt, Human
auuucaugaguuauuauagugg

SEQ ID NO: 589583 - RNA, 20 nt, Human
aggcaguguagagaugagua

SEQ ID NO: 589584 - RNA, 22 nt, Human
cugaggacauugaugaggcaau

SEQ ID NO: 589585 - RNA, 22 nt, Human
uucccagaauuguugggaacug

SEQ ID NO: 589586 - RNA, 22 nt, Human
cuguuuauugagcaaucugcca

SEQ ID NO: 589587 - RNA, 22 nt, Human
agacacaguauaagcacaacaa

SEQ ID NO: 589588 - RNA, 22 nt, Human
caugcuuuuuucuaguauaaau

SEQ ID NO: 589589 - RNA, 22 nt, Human
auacacauguguaugugcaugc

SEQ ID NO: 589590 - RNA, 22 nt, Human
gaucuuggggggaucaccaugg

SEQ ID NO: 589591 - RNA, 22 nt, Human
ugcagugccucggcagugcagc

SEQ ID NO: 589592 - RNA, 22 nt, Human
cgcugggggaacagcgagggug

SEQ ID NO: 589593 - RNA, 22 nt, Human
aauaacagagucuucaagauag

SEQ ID NO: 589594 - RNA, 22 nt, Human
gacagggacgaggcuucaggca

SEQ ID NO: 589595 - RNA, 22 nt, Human
acauuucucuugaugucucuau

SEQ ID NO: 589596 - RNA, 22 nt, Human
cugaggccucuccuuggcuugu

SEQ ID NO: 589597 - RNA, 22 nt, Human
agcugccaggccccugagaacc

SEQ ID NO: 589598 - RNA, 22 nt, Human
guucuucucuuguaauggaauc

SEQ ID NO: 589599 - RNA, 22 nt, Human
agauuucaaugugagcauuagu

SEQ ID NO: 589600 - RNA, 22 nt, Human
cuuguauucuuccacuuaagau

SEQ ID NO: 589601 - RNA, 21 nt, Human
uuaaagcuaugguagugggcu

SEQ ID NO: 589602 - RNA, 22 nt, Human
gagagguagcaguaagaacagg

SEQ ID NO: 589603 - RNA, 22 nt, Human
gcucccugguauugcugccacu

SEQ ID NO: 589604 - RNA, 22 nt, Human
cugagggcaugaacauuccaua

SEQ ID NO: 589605 - RNA, 22 nt, Human
gcuguacauucugcacaggccc

SEQ ID NO: 589606 - RNA, 22 nt, Human
ccagggcugguggcugcagagg

SEQ ID NO: 589607 - RNA, 22 nt, Human
agaauuguaagcaauuugauua

SEQ ID NO: 589608 - RNA, 22 nt, Human
guuacacaggaaaacauuagca

SEQ ID NO: 589609 - RNA, 22 nt, Human
cucccaggggagucaucugcuu

SEQ ID NO: 589610 - RNA, 22 nt, Human
agacacugaaauguauugaaga

SEQ ID NO: 589611 - RNA, 22 nt, Human
ccuuggcuggaauuacucuggg

SEQ ID NO: 589612 - RNA, 19 nt, Human
ucuuuggcuucuggaucag

SEQ ID NO: 589613 - RNA, 22 nt, Human
uaucuaaaggauuuaauuuagu

SEQ ID NO: 589614 - RNA, 22 nt, Human
augcuauuuaccacacaucauu

SEQ ID NO: 589615 - RNA, 22 nt, Human
caugcagggacuagagaacagg

SEQ ID NO: 589616 - RNA, 22 nt, Human
uaauuuuaugacaguguauuuu

SEQ ID NO: 589617 - RNA, 22 nt, Human
uuccugggugguccugguagag

SEQ ID NO: 589618 - RNA, 22 nt, Human
ucugauguaggcuuuucuggga

SEQ ID NO: 589619 - RNA, 22 nt, Human
uggccaggccucuuggugccca

SEQ ID NO: 589620 - RNA, 22 nt, Human
ccaguggaguuuuuauacccag

SEQ ID NO: 589621 - RNA, 22 nt, Human
auaugaagucagacaaacuggg

SEQ ID NO: 589622 - RNA, 22 nt, Human
agaaagggucacugaaagagga

SEQ ID NO: 589623 - RNA, 22 nt, Human
uuugcuuguucaagauuucugu

SEQ ID NO: 589624 - RNA, 21 nt, Human
uguuccuguucucuaggaucc

SEQ ID NO: 589625 - RNA, 22 nt, Human
ccucugccaccucccacgaggc

SEQ ID NO: 589626 - RNA, 22 nt, Human
cuucuucuuuuaauaaaugucu

SEQ ID NO: 589627 - RNA, 22 nt, Human
ugcagcugcuggcccaggugcu

SEQ ID NO: 589628 - RNA, 22 nt, Human
ugacacaaaggaaagcauaauc

SEQ ID NO: 589629 - RNA, 22 nt, Human
cauguaaaacacucagaacagu

SEQ ID NO: 589630 - RNA, 22 nt, Human
gcacaggcaauagauacagcua

SEQ ID NO: 589631 - RNA, 22 nt, Human
ucaaagauagauguugagaaau

SEQ ID NO: 589632 - RNA, 22 nt, Human
uacauucugaaauaaaugguuu

SEQ ID NO: 589633 - RNA, 22 nt, Human
acagggcuggcguugggacaga

SEQ ID NO: 589634 - RNA, 21 nt, Human
gccuggcagguggaagggcuc

SEQ ID NO: 589635 - RNA, 22 nt, Human
cucucuuuuucgugugccgaag

SEQ ID NO: 589636 - RNA, 22 nt, Human
ugcuguagcccugcacagugca

SEQ ID NO: 589637 - RNA, 20 nt, Human
aggcagagcgcacuuuuaga

SEQ ID NO: 589638 - RNA, 22 nt, Human
uucagaguuagacgaaaagcaa

SEQ ID NO: 589639 - RNA, 22 nt, Human
uaaagaacacagggaauagcac

SEQ ID NO: 589640 - RNA, 22 nt, Human
uagccgcuuaauuauuugguga

SEQ ID NO: 589641 - RNA, 22 nt, Human
ugcaggguagaugcaggcugug

SEQ ID NO: 589642 - RNA, 22 nt, Human
cuuccaaguugcucugcugacc

SEQ ID NO: 589643 - RNA, 22 nt, Human
uucuauguguugacaagccuga

SEQ ID NO: 589644 - RNA, 22 nt, Human
caguauuugguaauuggcuacc

SEQ ID NO: 589645 - RNA, 22 nt, Human
caguuuuagggcaaugugaaga

SEQ ID NO: 589646 - RNA, 22 nt, Human
gcugggcuuguggccagcuggg

SEQ ID NO: 589647 - RNA, 22 nt, Human
uccagggcucauucccucugca

SEQ ID NO: 589648 - RNA, 22 nt, Human
aaacuugagccaagggcuuggg

SEQ ID NO: 589649 - RNA, 20 nt, Human
uucagaaauaaggaaugagg

SEQ ID NO: 589650 - RNA, 22 nt, Human
cgggcagcggcguggccauggu

SEQ ID NO: 589651 - RNA, 22 nt, Human
gcacaggcuguuggccuucaga

SEQ ID NO: 589652 - RNA, 22 nt, Human
ugaggcaggagguugagaacug

SEQ ID NO: 589653 - RNA, 22 nt, Human
uccucccaacuuuuccaucuca

SEQ ID NO: 589654 - RNA, 22 nt, Human
uccugucuaaagaccugcaggc

SEQ ID NO: 589655 - RNA, 22 nt, Human
aaauucuuucauggcuaauaag

SEQ ID NO: 589656 - RNA, 22 nt, Human
uagacaggagucaggcuagaau

SEQ ID NO: 589657 - RNA, 22 nt, Human
auuuccuucaguguuuaauacu

SEQ ID NO: 589658 - RNA, 22 nt, Human
cccagcacucagcaggcucaua

SEQ ID NO: 589659 - RNA, 22 nt, Human
uaaauuuuuguuaacagccucu

SEQ ID NO: 589660 - RNA, 22 nt, Human
ugcuuuaaaccauggaugugag

SEQ ID NO: 589661 - RNA, 22 nt, Human
auuguacagguuggaggaagug

SEQ ID NO: 589662 - RNA, 22 nt, Human
aaaaaugugaccacaggguguu

SEQ ID NO: 589663 - RNA, 22 nt, Human
aguguuucucagaagggccuau

SEQ ID NO: 589664 - RNA, 23 nt, Human
aagguguucuguauuuaacucag

SEQ ID NO: 589665 - RNA, 21 nt, Human
ugagaugcuagaaggcaggga

SEQ ID NO: 589666 - RNA, 22 nt, Human
ugacagaaauaguucuuaauuu

SEQ ID NO: 589667 - RNA, 23 nt, Human
cugcauauggagguuagcaacuc

SEQ ID NO: 589668 - RNA, 22 nt, Human
gaggugaguggaucacgagguc

SEQ ID NO: 589669 - RNA, 22 nt, Human
gcugucacucaccaggccugca

SEQ ID NO: 589670 - RNA, 22 nt, Human
aagggugguguaggagaucaaa

SEQ ID NO: 589671 - RNA, 17 nt, Human
ccuuucucuuucaucuc

SEQ ID NO: 589672 - RNA, 22 nt, Human
gcagcuggggccacacuuaggc

SEQ ID NO: 589673 - RNA, 22 nt, Human
uucuucugagagaaaaagcuca

SEQ ID NO: 589674 - RNA, 22 nt, Human
ucaguucuuaguaaugcagucu

SEQ ID NO: 589675 - RNA, 20 nt, Human
ggccauggguugccugaggu

SEQ ID NO: 589676 - RNA, 22 nt, Human
uuugacauugaaagcagaaucg

SEQ ID NO: 589677 - RNA, 22 nt, Human
ugcauagaggauccaguguggu

SEQ ID NO: 589678 - RNA, 22 nt, Human
acaguucaagacaucaguauga

SEQ ID NO: 589679 - RNA, 23 nt, Human
agccucuuuucuccugcccugca

SEQ ID NO: 589680 - RNA, 22 nt, Human
cauuguucaacacugacuugca

SEQ ID NO: 589681 - RNA, 22 nt, Human
aaacacagcauguccuugggga

SEQ ID NO: 589682 - RNA, 22 nt, Human
gcuggcagaagagcugguucaa

SEQ ID NO: 589683 - RNA, 21 nt, Human
cuuguuuugaaaggacuggcc

SEQ ID NO: 589684 - RNA, 22 nt, Human
agggacuauuuacccaucucac

SEQ ID NO: 589685 - RNA, 22 nt, Human
aacuuuguuuuauucacugcug

SEQ ID NO: 589686 - RNA, 22 nt, Human
gggagggccaggcucacccagg

SEQ ID NO: 589687 - RNA, 22 nt, Human
cuucagaagaaaagcagugugu

SEQ ID NO: 589688 - RNA, 22 nt, Human
gauacauuucaaggaggacugg

SEQ ID NO: 589689 - RNA, 22 nt, Human
uuccuuuagugucauauacuuu

SEQ ID NO: 589690 - RNA, 22 nt, Human
uucccauuugugguagugaauu

SEQ ID NO: 589691 - RNA, 22 nt, Human
uacauagaacauguuuaauguc

SEQ ID NO: 589692 - RNA, 22 nt, Human
auagcauuuacuuuucagaaau

SEQ ID NO: 589693 - RNA, 22 nt, Human
cucucccuagguuagcggucag

SEQ ID NO: 589694 - RNA, 22 nt, Human
guggcagcucauguuguuuuaa

SEQ ID NO: 589695 - RNA, 22 nt, Human
agaggccagcagugccuaucug

SEQ ID NO: 589696 - RNA, 22 nt, Human
aagaaacaaccacugcucuccu

SEQ ID NO: 589697 - RNA, 22 nt, Human
aggcugugcacagggcaccugc

SEQ ID NO: 589698 - RNA, 22 nt, Human
gggugccacagagcuuccacuu

SEQ ID NO: 589699 - RNA, 22 nt, Human
ggugaagggugucauggcauuu

SEQ ID NO: 589700 - RNA, 22 nt, Human
aaaccuauuggcaagaauaaua

SEQ ID NO: 589701 - RNA, 22 nt, Human
cagugcuguugggcccagagag

SEQ ID NO: 589702 - RNA, 22 nt, Human
gacacagagauaggccuguguu

SEQ ID NO: 589703 - RNA, 22 nt, Human
caugcuuacuugucucagcaga

SEQ ID NO: 589704 - RNA, 22 nt, Human
gacagcagagcagacuaaugga

SEQ ID NO: 589705 - RNA, 22 nt, Human
gcuucaugaaaaucacugguca

SEQ ID NO: 589706 - RNA, 22 nt, Human
ggaggugcagaguaggguuggu

SEQ ID NO: 589707 - RNA, 22 nt, Human
caagucaaagacuagaacuagu

SEQ ID NO: 589708 - RNA, 22 nt, Human
uaugaagaaguucugugaaaug

SEQ ID NO: 589709 - RNA, 22 nt, Human
ucagagagugcaaaauauagcu

SEQ ID NO: 589710 - RNA, 22 nt, Human
auuagcuuuaaagacuuugauu

SEQ ID NO: 589711 - RNA, 23 nt, Human
ucagcuucauugucuucuauggc

SEQ ID NO: 589712 - RNA, 22 nt, Human
uuuuugugguauauugcaacaa

SEQ ID NO: 589713 - RNA, 21 nt, Human
ucuacauaucaauauguaauu

SEQ ID NO: 589714 - RNA, 22 nt, Human
agcagcugcagagggcuccccc

SEQ ID NO: 589715 - RNA, 22 nt, Human
gggcuccagcagaggcagccgg

SEQ ID NO: 589716 - RNA, 23 nt, Human
aaagcuuaacuggguaauaaagc

SEQ ID NO: 589717 - RNA, 22 nt, Human
gaggugcuuccuuugggcucug

SEQ ID NO: 589718 - RNA, 22 nt, Human
aguucuucccuuuucuauggag

SEQ ID NO: 589719 - RNA, 23 nt, Human
ugggccucuccacccuuuucugu

SEQ ID NO: 589720 - RNA, 22 nt, Human
gguagucauggauagcuaugag

SEQ ID NO: 589721 - RNA, 22 nt, Human
augcaugauccugagcaaccca

SEQ ID NO: 589722 - RNA, 22 nt, Human
gucacacacauuucuuuggugc

SEQ ID NO: 589723 - RNA, 22 nt, Human
gaaauagacacuuucuaugaau

SEQ ID NO: 589724 - RNA, 22 nt, Human
cagcugccccuccagggcuggg

SEQ ID NO: 589725 - RNA, 22 nt, Human
uagaaacagaaaacuguaauag

SEQ ID NO: 589726 - RNA, 22 nt, Human
uagcugccuagacagcuauagc

SEQ ID NO: 589727 - RNA, 22 nt, Human
aauguauaaccauaggaaauuu

SEQ ID NO: 589728 - RNA, 22 nt, Human
ucuuaagcagagaagaaguuga

SEQ ID NO: 589729 - RNA, 22 nt, Human
ugagacaguaucgccccaaggc

SEQ ID NO: 589730 - RNA, 22 nt, Human
uuacaucaugcuuaucccuuuc

SEQ ID NO: 589731 - RNA, 22 nt, Human
gacaguuuaagcaccuaauauu

SEQ ID NO: 589732 - RNA, 22 nt, Human
gcaguggggcaaucauagcuca

SEQ ID NO: 589733 - RNA, 21 nt, Human
cuguccuggucuagaggcaca

SEQ ID NO: 589734 - RNA, 22 nt, Human
agaguuuuauggcuuuaauucu

SEQ ID NO: 589735 - RNA, 21 nt, Human
uuacaaagcuacagauguugc

SEQ ID NO: 589736 - RNA, 19 nt, Human
cuuccuugcuccccaugug

SEQ ID NO: 589737 - RNA, 22 nt, Human
ccagcuccucuugucucuagca

SEQ ID NO: 589738 - RNA, 22 nt, Human
cagcagagaugagauuccuaua

SEQ ID NO: 589739 - RNA, 22 nt, Human
augcuguggaaguuccugaagc

SEQ ID NO: 589740 - RNA, 22 nt, Human
cucuguauagaaaggaaacauu

SEQ ID NO: 589741 - RNA, 21 nt, Human
uuggccugauaucuuggagca

SEQ ID NO: 589742 - RNA, 22 nt, Human
uggugcagauagugguguagua

SEQ ID NO: 589743 - RNA, 22 nt, Human
gagcccagcuugcacauggagc

SEQ ID NO: 589744 - RNA, 23 nt, Human
uagccaggcccagcauggacacc

SEQ ID NO: 589745 - RNA, 22 nt, Human
ugugugccagccuacgaggagc

SEQ ID NO: 589746 - RNA, 22 nt, Human
agaacacugcuaguauaaucac

SEQ ID NO: 589747 - RNA, 22 nt, Human
uguuuucugaugguuaaugagu

SEQ ID NO: 589748 - RNA, 22 nt, Human
cagcugcccugccuugcccuua

SEQ ID NO: 589749 - RNA, 22 nt, Human
agcugcagccgcagcuguggcc

SEQ ID NO: 589750 - RNA, 16 nt, Human
ggguggucuuggagac

SEQ ID NO: 589751 - RNA, 22 nt, Human
ugugaaauucuugaaaugcaca

SEQ ID NO: 589752 - RNA, 20 nt, Human
cugggcucaagugagccucc

SEQ ID NO: 589753 - RNA, 22 nt, Human
cugagcagcaccuucaagaaac

SEQ ID NO: 589754 - RNA, 22 nt, Human
guggccuggaugagcuucgaca

SEQ ID NO: 589755 - RNA, 22 nt, Human
uuauuucauauaauguuaucaa

SEQ ID NO: 589756 - RNA, 22 nt, Human
ccugaagcaaggguaggcaggu

SEQ ID NO: 589757 - RNA, 22 nt, Human
gagcccugagaguugugaggcc

SEQ ID NO: 589758 - RNA, 22 nt, Human
ggcagggguccugguguugacu

SEQ ID NO: 589759 - RNA, 22 nt, Human
gaaaucaaggcuacauucaggu

SEQ ID NO: 589760 - RNA, 22 nt, Human
cagcccugcacgcugccuccgc

SEQ ID NO: 589761 - RNA, 22 nt, Human
aagcacauugccuggcacauag

SEQ ID NO: 589762 - RNA, 22 nt, Human
gcuucugaugucagacuucugg

SEQ ID NO: 589763 - RNA, 22 nt, Human
gcuuucugcucuguaaaauggg

SEQ ID NO: 589764 - RNA, 21 nt, Human
aaaguugauuuagauugguga

SEQ ID NO: 589765 - RNA, 21 nt, Human
uuucaauuugccuugagucau

SEQ ID NO: 589766 - RNA, 22 nt, Human
ucaaauugucaucuugauaaug

SEQ ID NO: 589767 - RNA, 19 nt, Human
ugucuccucaugcaagugu

SEQ ID NO: 589768 - RNA, 22 nt, Human
caggcugcuccaggguaggaaa

SEQ ID NO: 589769 - RNA, 22 nt, Human
aaucgcuugguaauuuuaaaag

SEQ ID NO: 589770 - RNA, 22 nt, Human
auucuaauuaguucuacauguu

SEQ ID NO: 589771 - RNA, 22 nt, Human
agcuaauuagaaauagauuauu

SEQ ID NO: 589772 - RNA, 18 nt, Human
acagugcugucacugcuu

SEQ ID NO: 589773 - RNA, 21 nt, Human
ggcuggacaucccaggagacu

SEQ ID NO: 589774 - RNA, 22 nt, Human
aaguagcaaucucauuaguugg

SEQ ID NO: 589775 - RNA, 21 nt, Human
uucagcaagcacucuggacac

SEQ ID NO: 589776 - RNA, 17 nt, Human
aggaagggcaaguuucu

SEQ ID NO: 589777 - RNA, 22 nt, Human
ucuuuuuauauugacaaaaggu

SEQ ID NO: 589778 - RNA, 22 nt, Human
cuggagccaugucuugacugcu

SEQ ID NO: 589779 - RNA, 22 nt, Human
gggcagcaucaggaggggcuuu

SEQ ID NO: 589780 - RNA, 22 nt, Human
aagacacugggggcugcagcca

SEQ ID NO: 589781 - RNA, 22 nt, Human
cugggcugucccaaccccaucc

SEQ ID NO: 589782 - RNA, 22 nt, Human
uccucuucugccuauaucugcc

SEQ ID NO: 589783 - RNA, 22 nt, Human
aaaugcagcagcuaauugaaaa

SEQ ID NO: 589784 - RNA, 22 nt, Human
gaggagguuccggguggagaag

SEQ ID NO: 589785 - RNA, 22 nt, Human
uaguacuuaucucugucauugu

SEQ ID NO: 589786 - RNA, 19 nt, Human
auauccuugagaaagggaa

SEQ ID NO: 589787 - RNA, 22 nt, Human
acagcagacacaggcacgcugu

SEQ ID NO: 589788 - RNA, 22 nt, Human
ugagaguauuuuggcauuauca

SEQ ID NO: 589789 - RNA, 22 nt, Human
gugcucacugugagacguccug

SEQ ID NO: 589790 - RNA, 22 nt, Human
uagauuuguuuccuucucucca

SEQ ID NO: 589791 - RNA, 22 nt, Human
agaggcugucucauauuuugua

SEQ ID NO: 589792 - RNA, 22 nt, Human
ucauauuuaggccuuuaauuca

SEQ ID NO: 589793 - RNA, 22 nt, Human
agaguguuauuugcucuguauu

SEQ ID NO: 589794 - RNA, 22 nt, Human
ucacaauauuuaucuuccaauu

SEQ ID NO: 589795 - RNA, 22 nt, Human
aggcuguggcaucacaucagga

SEQ ID NO: 589796 - RNA, 22 nt, Human
ccugggaccucgcgggaagcgg

SEQ ID NO: 589797 - RNA, 22 nt, Human
ucuuucugaugggaagggucaa

SEQ ID NO: 589798 - RNA, 22 nt, Human
ucuccuggaagugauuccccug

SEQ ID NO: 589799 - RNA, 22 nt, Human
aggcagcagagguugaggaaag

SEQ ID NO: 589800 - RNA, 22 nt, Human
acagaacugagaauucucuauc

SEQ ID NO: 589801 - RNA, 22 nt, Human
cuugagcacagcggcuucagga

SEQ ID NO: 589802 - RNA, 22 nt, Human
uuucauaaccucaagcuacagu

SEQ ID NO: 589803 - RNA, 22 nt, Human
gcugaggugucaccuugcuggg

SEQ ID NO: 589804 - RNA, 20 nt, Human
uagcaaugaguguuccauuu

SEQ ID NO: 589805 - RNA, 22 nt, Human
aggaggcugaacuagggucugg

SEQ ID NO: 589806 - RNA, 22 nt, Human
uuuucaugugaugugacauuuc

SEQ ID NO: 589807 - RNA, 22 nt, Human
ucugcaacagugcccuguaaau

SEQ ID NO: 589808 - RNA, 22 nt, Human
accaggggugucaacagcauuu

SEQ ID NO: 589809 - RNA, 22 nt, Human
ccaggcugaauauguuccaggg

SEQ ID NO: 589810 - RNA, 22 nt, Human
cuuggaggaugugcggcugccc

SEQ ID NO: 589811 - RNA, 22 nt, Human
uguuuauugcagugcugggcug

SEQ ID NO: 589812 - RNA, 20 nt, Human
cagcagagacccauggggag

SEQ ID NO: 589813 - RNA, 19 nt, Human
uuaggaaaccacuuuccuu

SEQ ID NO: 589814 - RNA, 22 nt, Human
cugagaguauuggcaggcuugg

SEQ ID NO: 589815 - RNA, 22 nt, Human
uggcucugugucucccagcagc

SEQ ID NO: 589816 - RNA, 22 nt, Human
ggaagccaagguggccucuauu

SEQ ID NO: 589817 - RNA, 22 nt, Human
aacuaaaagugugucucuugua

SEQ ID NO: 589818 - RNA, 21 nt, Human
caggaugaugggaagguggug

SEQ ID NO: 589819 - RNA, 22 nt, Human
aggaggaggugggacacaguga

SEQ ID NO: 589820 - RNA, 22 nt, Human
ccagagaggcaaaacuccuucc

SEQ ID NO: 589821 - RNA, 22 nt, Human
uccuggcccacuaugccagcau

SEQ ID NO: 589822 - RNA, 22 nt, Human
uuguguguagacucagccauug

SEQ ID NO: 589823 - RNA, 19 nt, Human
agcaaccugucagagaugc

SEQ ID NO: 589824 - RNA, 22 nt, Human
gggcacuggugcugccaucuug

SEQ ID NO: 589825 - RNA, 22 nt, Human
cugaggccucucuccuuggcuu

SEQ ID NO: 589826 - RNA, 22 nt, Human
aaagccauuacaaaauuucaua

SEQ ID NO: 589827 - RNA, 22 nt, Human
aagcauaacuugcugcacauag

SEQ ID NO: 589828 - RNA, 22 nt, Human
uagaggugacacugagaccaua

SEQ ID NO: 589829 - RNA, 22 nt, Human
caugucuuuguuaugcucacca

SEQ ID NO: 589830 - RNA, 22 nt, Human
aauuagaaucuuauuuggggaa

SEQ ID NO: 589831 - RNA, 21 nt, Human
ccuuggcuggcaucuagcacc

SEQ ID NO: 589832 - RNA, 22 nt, Human
augcauauauacauacacaguc

SEQ ID NO: 589833 - RNA, 22 nt, Human
gaagccacaacuuuuucuuagc

SEQ ID NO: 589834 - RNA, 22 nt, Human
gcugcuuuggggaugaaugaga

SEQ ID NO: 589835 - RNA, 22 nt, Human
ucacuagucaucaacuuccauu

SEQ ID NO: 589836 - RNA, 22 nt, Human
ugcugggauauagcuucuaggg

SEQ ID NO: 589837 - RNA, 22 nt, Human
uagcuuuaaaaaucaucaaagc

SEQ ID NO: 589838 - RNA, 22 nt, Human
uuuucauuguuacuaugagcua

SEQ ID NO: 589839 - RNA, 22 nt, Human
agacacugauguucagcucaau

SEQ ID NO: 589840 - RNA, 22 nt, Human
uguuauuucuuugccauaucuu

SEQ ID NO: 589841 - RNA, 20 nt, Human
agcuccucaucacuggaggu

SEQ ID NO: 589842 - RNA, 22 nt, Human
augaggcagcugacagcuguuc

SEQ ID NO: 589843 - RNA, 22 nt, Human
uggaugcuguaggacacgcucu

SEQ ID NO: 589844 - RNA, 22 nt, Human
accaggaguugggggugggacc

SEQ ID NO: 589845 - RNA, 22 nt, Human
ugagaaaacaguuuguaauaau

SEQ ID NO: 589846 - RNA, 22 nt, Human
ugucagaacucuauugaugucc

SEQ ID NO: 589847 - RNA, 22 nt, Human
cagaaacagacaugacgcagua

SEQ ID NO: 589848 - RNA, 22 nt, Human
aaauucaguuuuaauaaucacu

SEQ ID NO: 589849 - RNA, 22 nt, Human
agagaugggcgggggcuucugc

SEQ ID NO: 589850 - RNA, 22 nt, Human
ggcagagccuucuggagcucgc

SEQ ID NO: 589851 - RNA, 22 nt, Human
acuuguucauugaguacauaug

SEQ ID NO: 589852 - RNA, 22 nt, Human
cuuggaauggggcagaaaaugg

SEQ ID NO: 589853 - RNA, 22 nt, Human
acccuggguauuucccaaacuu

SEQ ID NO: 589854 - RNA, 22 nt, Human
uuauuauagauuaugcaagauu

SEQ ID NO: 589855 - RNA, 22 nt, Human
aacucuuuguggacauuaaauu

SEQ ID NO: 589856 - RNA, 22 nt, Human
uugcagggauuaccuuauuuuu

SEQ ID NO: 589857 - RNA, 22 nt, Human
uuacuuuaagggugucuuauua

SEQ ID NO: 589858 - RNA, 22 nt, Human
uaggcucacauagcacuaagug

SEQ ID NO: 589859 - RNA, 22 nt, Human
cugcaggucucugugugcauuc

SEQ ID NO: 589860 - RNA, 18 nt, Human
gcugcccuagcuccccuc

SEQ ID NO: 589861 - RNA, 22 nt, Human
uacauucaacaugucacuaugu

SEQ ID NO: 589862 - RNA, 22 nt, Human
uugcucugauuagguggaaaca

SEQ ID NO: 589863 - RNA, 22 nt, Human
ugcuucuguucuuucaccuacg

SEQ ID NO: 589864 - RNA, 22 nt, Human
cugggccuagaggaagcugaca

SEQ ID NO: 589865 - RNA, 22 nt, Human
auauacuguagugguuuagagc

SEQ ID NO: 589866 - RNA, 22 nt, Human
aguuauuuaaaaugauuguccu

SEQ ID NO: 589867 - RNA, 22 nt, Human
ccagggcucaggcucccagugg

SEQ ID NO: 589868 - RNA, 22 nt, Human
aauggcagaggcaaagauggua

SEQ ID NO: 589869 - RNA, 21 nt, Human
acaggcucuggggaugcuggg

SEQ ID NO: 589870 - RNA, 18 nt, Human
uggagggcuugcugcagc

SEQ ID NO: 589871 - RNA, 22 nt, Human
agagccagcaacucuagcccug

SEQ ID NO: 589872 - RNA, 22 nt, Human
aaaguucacugaccagcacugg

SEQ ID NO: 589873 - RNA, 22 nt, Human
agagccugcuguguaagucaca

SEQ ID NO: 589874 - RNA, 22 nt, Human
auacacugguuuaugauauugu

SEQ ID NO: 589875 - RNA, 23 nt, Human
gacaaagcacuugaaauguguac

SEQ ID NO: 589876 - RNA, 22 nt, Human
gggaaggaaaguuauuagcaga

SEQ ID NO: 589877 - RNA, 22 nt, Human
ggcguggcagucaggaaaaggu

SEQ ID NO: 589878 - RNA, 21 nt, Human
ucgugcagcagcugaggcuug

SEQ ID NO: 589879 - RNA, 22 nt, Human
cuggucagggcucuuugggagc

SEQ ID NO: 589880 - RNA, 22 nt, Human
ccuucagagguguagauugcgu

SEQ ID NO: 589881 - RNA, 22 nt, Human
uguguuuuacaaauucucuuaa

SEQ ID NO: 589882 - RNA, 22 nt, Human
cuucucuuccuuugucaacuga

SEQ ID NO: 589883 - RNA, 21 nt, Human
cccagagccuagggagggcac

SEQ ID NO: 589884 - RNA, 22 nt, Human
ucuccugaugaugguacuggca

SEQ ID NO: 589885 - RNA, 23 nt, Human
gccaucacguucaaccaaagccu

SEQ ID NO: 589886 - RNA, 22 nt, Human
auauucaucguguagaaauacu

SEQ ID NO: 589887 - RNA, 22 nt, Human
cugcugucuaguaucuuaaaaa

SEQ ID NO: 589888 - RNA, 22 nt, Human
cugcugugaguuuggaggucua

SEQ ID NO: 589889 - RNA, 22 nt, Human
uaggggugaggccaggcaucag

SEQ ID NO: 589890 - RNA, 18 nt, Human
agcagcugucagaaugcc

SEQ ID NO: 589891 - RNA, 22 nt, Human
gguggcaguuacaggggcaaau

SEQ ID NO: 589892 - RNA, 22 nt, Human
aaagccaucaguaaaaugauuu

SEQ ID NO: 589893 - RNA, 22 nt, Human
gagcuuugucccuugggggcuc

SEQ ID NO: 589894 - RNA, 22 nt, Human
agcagcugauggggaaggaguu

SEQ ID NO: 589895 - RNA, 22 nt, Human
cagucuuugaugcauccuagcc

SEQ ID NO: 589896 - RNA, 22 nt, Human
aagaguuaagcaacagauacca

SEQ ID NO: 589897 - RNA, 22 nt, Human
aguggagaauaugcagaaagcc

SEQ ID NO: 589898 - RNA, 21 nt, Human
ugcaagaaucaggaagcugcc

SEQ ID NO: 589899 - RNA, 22 nt, Human
ucugaagauaugagcuuuauga

SEQ ID NO: 589900 - RNA, 22 nt, Human
cacugcccacuccuucguccaa

SEQ ID NO: 589901 - RNA, 22 nt, Human
acuguugaagugccagcuugau

SEQ ID NO: 589902 - RNA, 22 nt, Human
guacauucaugguuccaccagg

SEQ ID NO: 589903 - RNA, 22 nt, Human
ucuacagguggggccuggcaau

SEQ ID NO: 589904 - RNA, 22 nt, Human
uccuccccucagggcaacggau

SEQ ID NO: 589905 - RNA, 22 nt, Human
uuaugaaguuccuguuacagug

SEQ ID NO: 589906 - RNA, 22 nt, Human
uagaaagcuugggguguuuaaa

SEQ ID NO: 589907 - RNA, 22 nt, Human
uccacauuauguuucuccuuuc

SEQ ID NO: 589908 - RNA, 22 nt, Human
uucauucuuugaaucugaggua

SEQ ID NO: 589909 - RNA, 22 nt, Human
gggccccacuggggcugccugc

SEQ ID NO: 589910 - RNA, 22 nt, Human
ucagccuggcaggauggccugg

SEQ ID NO: 589911 - RNA, 22 nt, Human
cugauauucuauuuugcuugcu

SEQ ID NO: 589912 - RNA, 22 nt, Human
guggguggaucaccugagguca

SEQ ID NO: 589913 - RNA, 22 nt, Human
acaggguggggauggugagcuu

SEQ ID NO: 589914 - RNA, 22 nt, Human
caucagcugagggugagcagaa

SEQ ID NO: 589915 - RNA, 22 nt, Human
uuacaucagaaucacccaggaa

SEQ ID NO: 589916 - RNA, 22 nt, Human
uuccugguaguaagacaucugg

SEQ ID NO: 589917 - RNA, 22 nt, Human
gugugccaggaacuggcugcug

SEQ ID NO: 589918 - RNA, 22 nt, Human
ugauuuaaaagaaacauugucu

SEQ ID NO: 589919 - RNA, 22 nt, Human
ucccuccuggccgucaccgcug

SEQ ID NO: 589920 - RNA, 22 nt, Human
cugaauaauuuuauaguugcug

SEQ ID NO: 589921 - RNA, 22 nt, Human
aggcuggguaccugucauaugc

SEQ ID NO: 589922 - RNA, 22 nt, Human
ggagugaguggccuugucacug

SEQ ID NO: 589923 - RNA, 22 nt, Human
cacaguccugccagagggccuu

SEQ ID NO: 589924 - RNA, 22 nt, Human
acuguacacauucgucaagacu

SEQ ID NO: 589925 - RNA, 17 nt, Human
uccuggcucugccacug

SEQ ID NO: 589926 - RNA, 22 nt, Human
ucugucaucucuaaaauagaaa

SEQ ID NO: 589927 - RNA, 22 nt, Human
uaaggcagugagaagaaacagg

SEQ ID NO: 589928 - RNA, 23 nt, Human
aggagcccaaggagagguaacuu

SEQ ID NO: 589929 - RNA, 22 nt, Human
gcaaaauuaaacuuagcaucau

SEQ ID NO: 589930 - RNA, 19 nt, Human
cuggccaggccaggggccc

SEQ ID NO: 589931 - RNA, 22 nt, Human
cugccucagccuucugggugac

SEQ ID NO: 589932 - RNA, 22 nt, Human
acaggcuuuauuauugguuagu

SEQ ID NO: 589933 - RNA, 22 nt, Human
cagcugagcugccagacuacug

SEQ ID NO: 589934 - RNA, 22 nt, Human
gcugggaaguggcagagcugga

SEQ ID NO: 589935 - RNA, 22 nt, Human
ucaauuuaagguacuacuuugg

SEQ ID NO: 589936 - RNA, 22 nt, Human
aguguuucccaguaggaugaaa

SEQ ID NO: 589937 - RNA, 22 nt, Human
ggcuucugaaacuguauugaga

SEQ ID NO: 589938 - RNA, 22 nt, Human
ccagucccaucucugucgcuua

SEQ ID NO: 589939 - RNA, 22 nt, Human
ugugugaacauguuuucauuuc

SEQ ID NO: 589940 - RNA, 22 nt, Human
cucugccugugucgccaccaca

SEQ ID NO: 589941 - RNA, 22 nt, Human
aucugucuaugauauagucugu

SEQ ID NO: 589942 - RNA, 22 nt, Human
uaauaagcguagaagguauauc

SEQ ID NO: 589943 - RNA, 22 nt, Human
gcugagugagguccagagcuug

SEQ ID NO: 589944 - RNA, 22 nt, Human
uagaauugggccuaacuuccau

SEQ ID NO: 589945 - RNA, 22 nt, Human
acccaggcuagagugcaguggu

SEQ ID NO: 589946 - RNA, 22 nt, Human
caugcuuuuugacaacaagcug

SEQ ID NO: 589947 - RNA, 21 nt, Human
ccuauugaauauaggaagauu

SEQ ID NO: 589948 - RNA, 22 nt, Human
agguuucuucuuaggaauaugu

SEQ ID NO: 589949 - RNA, 22 nt, Human
agguaggguuaauggagauaua

SEQ ID NO: 589950 - RNA, 22 nt, Human
aaagaucauucucugguccaga

SEQ ID NO: 589951 - RNA, 22 nt, Human
uaugauaugcacuuuaucagaa

SEQ ID NO: 589952 - RNA, 22 nt, Human
uuggggagaaaugaaaugaagu

SEQ ID NO: 589953 - RNA, 22 nt, Human
ccuggcagcauugguagagauu

SEQ ID NO: 589954 - RNA, 22 nt, Human
agggccuggugaccuggguccu

SEQ ID NO: 589955 - RNA, 22 nt, Human
ucucccacugcaagcccaggcu

SEQ ID NO: 589956 - RNA, 22 nt, Human
auggcccaaaaccuccucccuc

SEQ ID NO: 589957 - RNA, 22 nt, Human
ucaggugggcguuccggugcgg

SEQ ID NO: 589958 - RNA, 22 nt, Human
agugaaauuuguuuagauaggu

SEQ ID NO: 589959 - RNA, 23 nt, Human
gggagccauggguggucauggag

SEQ ID NO: 589960 - RNA, 22 nt, Human
uauauucaaugauuaguaucag

SEQ ID NO: 589961 - RNA, 22 nt, Human
cagucacuggaauagcugagga

SEQ ID NO: 589962 - RNA, 22 nt, Human
cugccagguuggcgcucgcucu

SEQ ID NO: 589963 - RNA, 22 nt, Human
uaaauguaccuucugccuuacu

SEQ ID NO: 589964 - RNA, 22 nt, Human
ggcaggugugagaucgaggcca

SEQ ID NO: 589965 - RNA, 19 nt, Human
uccuccuuacuuccucuug

SEQ ID NO: 589966 - RNA, 22 nt, Human
uggcacagcccagagcucuuga

SEQ ID NO: 589967 - RNA, 22 nt, Human
uggcucugagacacaggcucuc

SEQ ID NO: 589968 - RNA, 22 nt, Human
ggagcuguuaaaugcagaauuu

SEQ ID NO: 589969 - RNA, 22 nt, Human
aauuaugguauguucaacaacu

SEQ ID NO: 589970 - RNA, 22 nt, Human
caagaauaaaauacauguugau

SEQ ID NO: 589971 - RNA, 22 nt, Human
gcuccuggcuccaggcagccaa

SEQ ID NO: 589972 - RNA, 22 nt, Human
cugcugugccucuuuucacgug

SEQ ID NO: 589973 - RNA, 22 nt, Human
uagggaaauauagauuuagggc

SEQ ID NO: 589974 - RNA, 22 nt, Human
gugcaugucggggugcauguca

SEQ ID NO: 589975 - RNA, 22 nt, Human
gccugucugcagggcugucauu

SEQ ID NO: 589976 - RNA, 22 nt, Human
cuacaccuugaucuaacauuuu

SEQ ID NO: 589977 - RNA, 19 nt, Human
cagcugccuuuucuuugca

SEQ ID NO: 589978 - RNA, 15 nt, Human
ccaggcugggugagc

SEQ ID NO: 589979 - RNA, 22 nt, Human
ucaaggagacagaaagcaaugg

SEQ ID NO: 589980 - RNA, 22 nt, Human
gggaaggagguggaccugcccc

SEQ ID NO: 589981 - RNA, 22 nt, Human
cccagaggugaaggagguggga

SEQ ID NO: 589982 - RNA, 21 nt, Human
uuucucauaaaauacucauua

SEQ ID NO: 589983 - RNA, 22 nt, Human
ucagcucuuaacccucuggccu

SEQ ID NO: 589984 - RNA, 22 nt, Human
ugguauaaaagaguaaacuaug

SEQ ID NO: 589985 - RNA, 22 nt, Human
aacuguucuucauuuucaguau

SEQ ID NO: 589986 - RNA, 22 nt, Human
ugccagagaguggcuggguguc

SEQ ID NO: 589987 - RNA, 22 nt, Human
ucccaggaauugaagccagugu

SEQ ID NO: 589988 - RNA, 22 nt, Human
agacagugauguaagcaggagu

SEQ ID NO: 589989 - RNA, 22 nt, Human
gggaggagugaagauucaccug

SEQ ID NO: 589990 - RNA, 23 nt, Human
uggucucacuugguaagaugaag

SEQ ID NO: 589991 - RNA, 22 nt, Human
uuuuugcaccaaccuaauagaa

SEQ ID NO: 589992 - RNA, 22 nt, Human
ccagugcaggugagcaccaggu

SEQ ID NO: 589993 - RNA, 22 nt, Human
agcagagaccugguuuuguuga

SEQ ID NO: 589994 - RNA, 22 nt, Human
ugggggcuagaacccagggauu

SEQ ID NO: 589995 - RNA, 22 nt, Human
ccagcauggcaccugagaugag

SEQ ID NO: 589996 - RNA, 22 nt, Human
gagauuggccuggcuugccaac

SEQ ID NO: 589997 - RNA, 22 nt, Human
uuaagacuaaaugaggucauaa

SEQ ID NO: 589998 - RNA, 22 nt, Human
acaguguuuaaaaaucagaucu

SEQ ID NO: 589999 - RNA, 22 nt, Human
uuucaagacucauugaguauug

SEQ ID NO: 590000 - RNA, 22 nt, Human
ugauuuuuggaucugagcugca

SEQ ID NO: 590001 - RNA, 22 nt, Human
cagagcuguuacuauucaugaa

SEQ ID NO: 590002 - RNA, 22 nt, Human
ugagccugcugucgcuggaccc

SEQ ID NO: 590003 - RNA, 22 nt, Human
uuauugccauccuggaaccuag

SEQ ID NO: 590004 - RNA, 22 nt, Human
gugcugagcacagcugcccagg

SEQ ID NO: 590005 - RNA, 22 nt, Human
uuucuuucucguaaacuuaguu

SEQ ID NO: 590006 - RNA, 22 nt, Human
cucauaaacaauucuuugaggu

SEQ ID NO: 590007 - RNA, 22 nt, Human
gaaaaguucaucauauauucag

SEQ ID NO: 590008 - RNA, 22 nt, Human
cacggguggaaucagggacucc

SEQ ID NO: 590009 - RNA, 22 nt, Human
aguugaauuaugagugucuuug

SEQ ID NO: 590010 - RNA, 21 nt, Human
ccugucuuggacugaggcacc

SEQ ID NO: 590011 - RNA, 22 nt, Human
gccuucagcccugacuggccag

SEQ ID NO: 590012 - RNA, 22 nt, Human
uacuuuguccauuugcaggcag

SEQ ID NO: 590013 - RNA, 22 nt, Human
auacauuagcucauaugauuaa

SEQ ID NO: 590014 - RNA, 17 nt, Human
ccagagcuacugagacu

SEQ ID NO: 590015 - RNA, 22 nt, Human
uuccuaaucacgaacauuauuu

SEQ ID NO: 590016 - RNA, 22 nt, Human
uccucccuaaauccuagacugu

SEQ ID NO: 590017 - RNA, 22 nt, Human
aggccuuaagaacaaaacuauu

SEQ ID NO: 590018 - RNA, 22 nt, Human
ccuggggagagaaagcccagcc

SEQ ID NO: 590019 - RNA, 22 nt, Human
auuuccuaacagaggcaacagu

SEQ ID NO: 590020 - RNA, 22 nt, Human
uugcaagacacuuggaagcaca

SEQ ID NO: 590021 - RNA, 22 nt, Human
uucucugggacaggaacaguuu

SEQ ID NO: 590022 - RNA, 22 nt, Human
agauucaugggucuaaccagug

SEQ ID NO: 590023 - RNA, 22 nt, Human
uagcaaaauguggauguaguug

SEQ ID NO: 590024 - RNA, 22 nt, Human
ugguggcuguugcagaacugag

SEQ ID NO: 590025 - RNA, 21 nt, Human
ccuucucuugcuucagcuuca

SEQ ID NO: 590026 - RNA, 22 nt, Human
auauacuuggagacuaucauug

SEQ ID NO: 590027 - RNA, 22 nt, Human
auguaaguauucaaaauauuuc

SEQ ID NO: 590028 - RNA, 22 nt, Human
cacccagccuucacacaggagu

SEQ ID NO: 590029 - RNA, 22 nt, Human
ggcccagcacagugcuuggggg

SEQ ID NO: 590030 - RNA, 22 nt, Human
ccuggccagcgccggcugcucg

SEQ ID NO: 590031 - RNA, 22 nt, Human
uuauccaacaugacuuaugucc

SEQ ID NO: 590032 - RNA, 22 nt, Human
gugugccucccauuagggugua

SEQ ID NO: 590033 - RNA, 22 nt, Human
uguauugaauuguguuauaucu

SEQ ID NO: 590034 - RNA, 22 nt, Human
cuugcagaggcuguuccagaug

SEQ ID NO: 590035 - RNA, 21 nt, Human
ccagggaagaaaugagggcag

SEQ ID NO: 590036 - RNA, 22 nt, Human
aacacagggacucccaggagaa

SEQ ID NO: 590037 - RNA, 22 nt, Human
cagagccaucccagccuguggu

SEQ ID NO: 590038 - RNA, 22 nt, Human
aagggagacccaccguccugga

SEQ ID NO: 590039 - RNA, 22 nt, Human
uagcuuuguauuaucagcauug

SEQ ID NO: 590040 - RNA, 22 nt, Human
uguguacauauacacaaauaca

SEQ ID NO: 590041 - RNA, 22 nt, Human
auuuuagcaaaugcaagaugga

SEQ ID NO: 590042 - RNA, 22 nt, Human
gcugggcuucaccuccagaguu

SEQ ID NO: 590043 - RNA, 22 nt, Human
ugguaggaaugauuacgacuuu

SEQ ID NO: 590044 - RNA, 22 nt, Human
ucuccaggagaaauaugaagga

SEQ ID NO: 590045 - RNA, 22 nt, Human
gcgcgccucugcccgguguucc

SEQ ID NO: 590046 - RNA, 22 nt, Human
uacaaaugaaccaacuuugaug

SEQ ID NO: 590047 - RNA, 22 nt, Human
uauacaaugaguacauucuggg

SEQ ID NO: 590048 - RNA, 22 nt, Human
agcugagguuaguauaaaugug

SEQ ID NO: 590049 - RNA, 22 nt, Human
uuguaugaucaaaagaaaugua

SEQ ID NO: 590050 - RNA, 22 nt, Human
agguaaggggcucccaaguacc

SEQ ID NO: 590051 - RNA, 22 nt, Human
gauggguggguucugugagagg

SEQ ID NO: 590052 - RNA, 22 nt, Human
gcugucagaaggugaaggguaa

SEQ ID NO: 590053 - RNA, 22 nt, Human
caaaauucugcauuucuaauaa

SEQ ID NO: 590054 - RNA, 22 nt, Human
uucucuggguuaggggaacuau

SEQ ID NO: 590055 - RNA, 22 nt, Human
gcccagcacauugcugaggacc

SEQ ID NO: 590056 - RNA, 22 nt, Human
aaauuguggcgucuguaagagu

SEQ ID NO: 590057 - RNA, 22 nt, Human
ucagggaaauagcagggcugaa

SEQ ID NO: 590058 - RNA, 22 nt, Human
aauuagcagcauauucugcgau

SEQ ID NO: 590059 - RNA, 22 nt, Human
ucuuccaaaugcagcuaaagcu

SEQ ID NO: 590060 - RNA, 22 nt, Human
gauacauugaggguggaggacc

SEQ ID NO: 590061 - RNA, 22 nt, Human
agagccagcauuugacacuggc

SEQ ID NO: 590062 - RNA, 22 nt, Human
uagacacaucuucauccacaau

SEQ ID NO: 590063 - RNA, 20 nt, Human
uccagggcaaacucaucacc

SEQ ID NO: 590064 - RNA, 21 nt, Human
agcaggugcuguuggaggaaa

SEQ ID NO: 590065 - RNA, 22 nt, Human
uggccuggcucacagugagauu

SEQ ID NO: 590066 - RNA, 22 nt, Human
aggcauggauggauccagggcu

SEQ ID NO: 590067 - RNA, 22 nt, Human
ucuggcuuggcuggcaucucug

SEQ ID NO: 590068 - RNA, 17 nt, Human
ugcauuguaggcuagcc

SEQ ID NO: 590069 - RNA, 22 nt, Human
uuuuguguugccauguuaagca

SEQ ID NO: 590070 - RNA, 22 nt, Human
uuuguaugaacugguauguagg

SEQ ID NO: 590071 - RNA, 22 nt, Human
agauaacuuuuggguauucaug

SEQ ID NO: 590072 - RNA, 22 nt, Human
agaugcugugucuguucccuug

SEQ ID NO: 590073 - RNA, 22 nt, Human
gcuuccuggaacaacuguugcu

SEQ ID NO: 590074 - RNA, 22 nt, Human
uucauacuguguuuccaaguuu

SEQ ID NO: 590075 - RNA, 22 nt, Human
ugcaaaaacugcaauugcuuuu

SEQ ID NO: 590076 - RNA, 22 nt, Human
cugcugagaaaagacugaggga

SEQ ID NO: 590077 - RNA, 22 nt, Human
gagaaaugagugauucacuuuu

SEQ ID NO: 590078 - RNA, 21 nt, Human
cuucuuggggagcagcuagac

SEQ ID NO: 590079 - RNA, 22 nt, Human
ugggcuagcagggaagagagac

SEQ ID NO: 590080 - RNA, 22 nt, Human
agucacagggggccccugcaac

SEQ ID NO: 590081 - RNA, 22 nt, Human
aguuauuuuggaaaaugaguca

SEQ ID NO: 590082 - RNA, 19 nt, Human
acagccuguugguggggcu

SEQ ID NO: 590083 - RNA, 22 nt, Human
uuacagguuaagugacacuuaa

SEQ ID NO: 590084 - RNA, 19 nt, Human
cucucuggcggugucugcg

SEQ ID NO: 590085 - RNA, 22 nt, Human
accagcccucaggucagauacu

SEQ ID NO: 590086 - RNA, 22 nt, Human
aaaugcaccuugcugugagacu

SEQ ID NO: 590087 - RNA, 23 nt, Human
aggugccaacugagagcugagag

SEQ ID NO: 590088 - RNA, 22 nt, Human
augcauauaauggccagaacaa

SEQ ID NO: 590089 - RNA, 22 nt, Human
acuguuggcuucugguagugac

SEQ ID NO: 590090 - RNA, 22 nt, Human
uucauucagugagacuaggacg

SEQ ID NO: 590091 - RNA, 23 nt, Human
ugagccuguuaauacuggcucug

SEQ ID NO: 590092 - RNA, 22 nt, Human
gggcugagagcuggaaucugag

SEQ ID NO: 590093 - RNA, 17 nt, Human
acaggcagaucaccuga

SEQ ID NO: 590094 - RNA, 22 nt, Human
cauguaaaccauugugagcauc

SEQ ID NO: 590095 - RNA, 22 nt, Human
cuugaaagaagggucuuuuaau

SEQ ID NO: 590096 - RNA, 20 nt, Human
agagauuuuaguagccacag

SEQ ID NO: 590097 - RNA, 20 nt, Human
uuuuauauguaggguauaug

SEQ ID NO: 590098 - RNA, 22 nt, Human
agugcuguuagguuaauauagu

SEQ ID NO: 590099 - RNA, 22 nt, Human
aauggcugccagggcaggaggu

SEQ ID NO: 590100 - RNA, 22 nt, Human
auguuuuaaauauguguguaaa

SEQ ID NO: 590101 - RNA, 22 nt, Human
caggcaggagccagggauucca

SEQ ID NO: 590102 - RNA, 22 nt, Human
uccuggaggaauaaguuuucca

SEQ ID NO: 590103 - RNA, 23 nt, Human
cccugcaucugucccucaccagu

SEQ ID NO: 590104 - RNA, 19 nt, Human
caguuacagcagcuaagac

SEQ ID NO: 590105 - RNA, 22 nt, Human
agcagcaaggaacagaauggac

SEQ ID NO: 590106 - RNA, 22 nt, Human
gggaaggcagugucugguugaa

SEQ ID NO: 590107 - RNA, 22 nt, Human
ccagggcuuugccaaaguccag

SEQ ID NO: 590108 - RNA, 22 nt, Human
auacagaugcuugcucgugacu

SEQ ID NO: 590109 - RNA, 22 nt, Human
caggcuuuuucugcuguccucu

SEQ ID NO: 590110 - RNA, 22 nt, Human
aguagacagacagaacacagcc

SEQ ID NO: 590111 - RNA, 22 nt, Human
uugguuaaaaucaaauuaauca

SEQ ID NO: 590112 - RNA, 22 nt, Human
ucagugaaaugcauauucuucg

SEQ ID NO: 590113 - RNA, 22 nt, Human
uuuguuaaauauuuauugagug

SEQ ID NO: 590114 - RNA, 22 nt, Human
ugccaggggaccuagggauguc

SEQ ID NO: 590115 - RNA, 22 nt, Human
agugagcauccagagagguggg

SEQ ID NO: 590116 - RNA, 22 nt, Human
acagagcaauucuuggguguuu

SEQ ID NO: 590117 - RNA, 22 nt, Human
ucuuggcugucuuugaaguuag

SEQ ID NO: 590118 - RNA, 22 nt, Human
cagggcuguggcuuugugcugu

SEQ ID NO: 590119 - RNA, 22 nt, Human
cacagcagagggagccauugaa

SEQ ID NO: 590120 - RNA, 22 nt, Human
ucaguguaaguuauguagaugu

SEQ ID NO: 590121 - RNA, 22 nt, Human
acagccagaggagccaggcugg

SEQ ID NO: 590122 - RNA, 22 nt, Human
gggugcaggcagcccaggcagg

SEQ ID NO: 590123 - RNA, 22 nt, Human
acacaguaggccaccaugucau

SEQ ID NO: 590124 - RNA, 22 nt, Human
auguagaaaguuauugucacug

SEQ ID NO: 590125 - RNA, 22 nt, Human
gcccuuaggcaagcagaagccc

SEQ ID NO: 590126 - RNA, 22 nt, Human
ggcugaguucucuugcugaauc

SEQ ID NO: 590127 - RNA, 22 nt, Human
aucucuaauuuaaaaaguaaca

SEQ ID NO: 590128 - RNA, 22 nt, Human
acauuuaaccuuugaggaacug

SEQ ID NO: 590129 - RNA, 21 nt, Human
agcugccuccacuucugaggc

SEQ ID NO: 590130 - RNA, 22 nt, Human
ucuaugucacucuuuggaaaga

SEQ ID NO: 590131 - RNA, 18 nt, Human
cccaggcuuugugggucu

SEQ ID NO: 590132 - RNA, 22 nt, Human
cagaccagaaggaagccgacaa

SEQ ID NO: 590133 - RNA, 22 nt, Human
uggcucugccacuaacuuggua

SEQ ID NO: 590134 - RNA, 22 nt, Human
uuuaauuuguauuucuagaggg

SEQ ID NO: 590135 - RNA, 22 nt, Human
ugccuaacuccaccaggcaggu

SEQ ID NO: 590136 - RNA, 22 nt, Human
gcugagccuagcugucuccugu

SEQ ID NO: 590137 - RNA, 22 nt, Human
uuccucaguuagugccugaggc

SEQ ID NO: 590138 - RNA, 22 nt, Human
aaaguucaugguguuauagaaa

SEQ ID NO: 590139 - RNA, 22 nt, Human
uucagaaugcuauuucugaaau

SEQ ID NO: 590140 - RNA, 22 nt, Human
uauuuauuggacaguguugcug

SEQ ID NO: 590141 - RNA, 22 nt, Human
uccuugaaugaagagaggugac

SEQ ID NO: 590142 - RNA, 22 nt, Human
cucacagauacggcuauuccug

SEQ ID NO: 590143 - RNA, 22 nt, Human
aggauuugaaccuaggcaauca

SEQ ID NO: 590144 - RNA, 22 nt, Human
ggagaugccagaauugcaaauu

SEQ ID NO: 590145 - RNA, 22 nt, Human
gucugucuguuguugagaagca

SEQ ID NO: 590146 - RNA, 22 nt, Human
caaaugcuaacuucuuuccaaa

SEQ ID NO: 590147 - RNA, 22 nt, Human
cucuccuccaggaacucacagu

SEQ ID NO: 590148 - RNA, 21 nt, Human
aacauugauucauuuggcuau

SEQ ID NO: 590149 - RNA, 22 nt, Human
gugcaggaucucagaacaagug

SEQ ID NO: 590150 - RNA, 22 nt, Human
ccugaggaccagcacccaucug

SEQ ID NO: 590151 - RNA, 22 nt, Human
acacaucuauauugcaucugca

SEQ ID NO: 590152 - RNA, 22 nt, Human
uuuacaauugguuuucucuaau

SEQ ID NO: 590153 - RNA, 22 nt, Human
gacacuguuauggugagguaag

SEQ ID NO: 590154 - RNA, 22 nt, Human
gagguaggagguagguauugug

SEQ ID NO: 590155 - RNA, 22 nt, Human
caggucagaggcgcagccccca

SEQ ID NO: 590156 - RNA, 18 nt, Human
gauucugauucuggaggc

SEQ ID NO: 590157 - RNA, 22 nt, Human
caaguuuguguucuaucauucu

SEQ ID NO: 590158 - RNA, 22 nt, Human
cagaagaguagcugaacaaguu

SEQ ID NO: 590159 - RNA, 22 nt, Human
gcucucugccauaugaggauac

SEQ ID NO: 590160 - RNA, 22 nt, Human
uagcuccuccccauccagguuc

SEQ ID NO: 590161 - RNA, 22 nt, Human
auuucaacagaguuugaaggca

SEQ ID NO: 590162 - RNA, 22 nt, Human
auaaaaucagaguuggauugga

SEQ ID NO: 590163 - RNA, 22 nt, Human
aaguucccgaggaccacaguug

SEQ ID NO: 590164 - RNA, 22 nt, Human
aagcagaaguugaucuaccaua

SEQ ID NO: 590165 - RNA, 22 nt, Human
agcagagaggagguggcccugu

SEQ ID NO: 590166 - RNA, 22 nt, Human
cugcacagaggucggucugcca

SEQ ID NO: 590167 - RNA, 22 nt, Human
uccagggagauggcagaggcug

SEQ ID NO: 590168 - RNA, 19 nt, Human
ucguggggaggugggcagc

SEQ ID NO: 590169 - RNA, 22 nt, Human
uggccagaacucagacaugugg

SEQ ID NO: 590170 - RNA, 22 nt, Human
ugaaggugaaugucuaugggga

SEQ ID NO: 590171 - RNA, 22 nt, Human
gaguggggcguggauccagcgu

SEQ ID NO: 590172 - RNA, 22 nt, Human
auuuguaucuucuaauauuauc

SEQ ID NO: 590173 - RNA, 22 nt, Human
ugaagguaaaggaaggaggcuu

SEQ ID NO: 590174 - RNA, 22 nt, Human
caagaauuguacaaacugggug

SEQ ID NO: 590175 - RNA, 22 nt, Human
uuaacaaaaauaucaggcauca

SEQ ID NO: 590176 - RNA, 22 nt, Human
gaguccagcucauugucuggga

SEQ ID NO: 590177 - RNA, 22 nt, Human
ucugccugccgagaacaccuac

SEQ ID NO: 590178 - RNA, 22 nt, Human
augcaguauaaaucauuucugg

SEQ ID NO: 590179 - RNA, 22 nt, Human
ugucauuuucagcuuaugcuuc

SEQ ID NO: 590180 - RNA, 22 nt, Human
gguggcaggcuggcauuggcaa

SEQ ID NO: 590181 - RNA, 22 nt, Human
caggcugucugaauggaggccc

SEQ ID NO: 590182 - RNA, 22 nt, Human
uaguuacacauggguagggaau

SEQ ID NO: 590183 - RNA, 22 nt, Human
aggcuucaggaagucuccuggg

SEQ ID NO: 590184 - RNA, 22 nt, Human
uuuaaacuaacaguacacguug

SEQ ID NO: 590185 - RNA, 22 nt, Human
uccaggaguuugagacugcagu

SEQ ID NO: 590186 - RNA, 22 nt, Human
cuggcucacuagcccugcccug

SEQ ID NO: 590187 - RNA, 22 nt, Human
aaggcacuagcaagcugccugg

SEQ ID NO: 590188 - RNA, 22 nt, Human
auuccuugcacaucagauaguu

SEQ ID NO: 590189 - RNA, 21 nt, Human
agagaagggauuccaggcccu

SEQ ID NO: 590190 - RNA, 20 nt, Human
cccaggcagagcuagcggca

SEQ ID NO: 590191 - RNA, 22 nt, Human
uggcagucuggguuggcaguua

SEQ ID NO: 590192 - RNA, 22 nt, Human
ggaggccaccugaccugcuguu

SEQ ID NO: 590193 - RNA, 22 nt, Human
ucugccagcaccaugauccuuc

SEQ ID NO: 590194 - RNA, 18 nt, Human
uggagcugagggcaaugc

SEQ ID NO: 590195 - RNA, 22 nt, Human
ggggcugagucagugggaagag

SEQ ID NO: 590196 - RNA, 22 nt, Human
uaaacagccuccccuuucacuc

SEQ ID NO: 590197 - RNA, 22 nt, Human
uggcugagugauauuugcaaag

SEQ ID NO: 590198 - RNA, 22 nt, Human
ccuccuggugggcgcuucuggc

SEQ ID NO: 590199 - RNA, 22 nt, Human
cugugcccuuucgcugcacugu

SEQ ID NO: 590200 - RNA, 22 nt, Human
ggcugggagccccacagaguca

SEQ ID NO: 590201 - RNA, 22 nt, Human
uucauucacccaggaaacaucu

SEQ ID NO: 590202 - RNA, 22 nt, Human
acaggagaaaucuggucaaaag

SEQ ID NO: 590203 - RNA, 22 nt, Human
gcagagaguugggcugcgccag

SEQ ID NO: 590204 - RNA, 22 nt, Human
aaucuguuuucugccucuauga

SEQ ID NO: 590205 - RNA, 22 nt, Human
aaaguuucccaaaguaauguga

SEQ ID NO: 590206 - RNA, 22 nt, Human
agggaggucuggcugcccugag

SEQ ID NO: 590207 - RNA, 22 nt, Human
agcucuggagccggaggauuuc

SEQ ID NO: 590208 - RNA, 22 nt, Human
ucauucagagagaauguuccag

SEQ ID NO: 590209 - RNA, 22 nt, Human
gugcugaggauacagcugugaa

SEQ ID NO: 590210 - RNA, 22 nt, Human
agcaggcauagaguagcacuca

SEQ ID NO: 590211 - RNA, 22 nt, Human
acacagagcaaaucaugacaga

SEQ ID NO: 590212 - RNA, 22 nt, Human
uucugaugauggcggcuggagc

SEQ ID NO: 590213 - RNA, 22 nt, Human
cagcagcucagucucucaguag

SEQ ID NO: 590214 - RNA, 21 nt, Human
uuaaugcuaugcagaaaaucu

SEQ ID NO: 590215 - RNA, 22 nt, Human
gcuggucacucugggagcugcu

SEQ ID NO: 590216 - RNA, 19 nt, Human
gcgaggaagucacuguggu

SEQ ID NO: 590217 - RNA, 19 nt, Human
ucucagaauuggcaaucau

SEQ ID NO: 590218 - RNA, 22 nt, Human
ucucacacuauuuauucugcuu

SEQ ID NO: 590219 - RNA, 22 nt, Human
aagaauucacugguagagucaa

SEQ ID NO: 590220 - RNA, 22 nt, Human
gcagggcugacucagccacccu

SEQ ID NO: 590221 - RNA, 22 nt, Human
cugggucuggugucaggcgacg

SEQ ID NO: 590222 - RNA, 22 nt, Human
gugcucuccuggcugcccugac

SEQ ID NO: 590223 - RNA, 20 nt, Human
agaagcugauacugauggaa

SEQ ID NO: 590224 - RNA, 22 nt, Human
uauuucuuuucgugacuuauug

SEQ ID NO: 590225 - RNA, 22 nt, Human
caacagaagguguacuacugaa

SEQ ID NO: 590226 - RNA, 22 nt, Human
agccugggaauuuagaguucgg

SEQ ID NO: 590227 - RNA, 22 nt, Human
cuucacagucacccugcugugu

SEQ ID NO: 590228 - RNA, 22 nt, Human
uauugacaggugccugcagaca

SEQ ID NO: 590229 - RNA, 22 nt, Human
cugagcugcggcaggcaccugg

SEQ ID NO: 590230 - RNA, 20 nt, Human
aauuuuaucuccauccuuug

SEQ ID NO: 590231 - RNA, 22 nt, Human
ggcaggugcuugucgaaggccu

SEQ ID NO: 590232 - RNA, 22 nt, Human
uccagcucaaauucagcuucca

SEQ ID NO: 590233 - RNA, 22 nt, Human
ccagcucaucucagugaaaugc

SEQ ID NO: 590234 - RNA, 22 nt, Human
ggcuggaagguagaagaugagg

SEQ ID NO: 590235 - RNA, 19 nt, Human
ggccauggcgggggucaca

SEQ ID NO: 590236 - RNA, 22 nt, Human
uucugcuuuuauugccagaguu

SEQ ID NO: 590237 - RNA, 22 nt, Human
cugucugccaauaaucuauggc

SEQ ID NO: 590238 - RNA, 21 nt, Human
ccugagggugguugugaagau

SEQ ID NO: 590239 - RNA, 22 nt, Human
aggugggcacagauggagaagu

SEQ ID NO: 590240 - RNA, 22 nt, Human
augaagacuauuugaaggugcc

SEQ ID NO: 590241 - RNA, 22 nt, Human
auuaugcuuaggaaaauaugaa

SEQ ID NO: 590242 - RNA, 22 nt, Human
uugguaaauacuauaaucaaau

SEQ ID NO: 590243 - RNA, 22 nt, Human
gaguuaauucgaauauucuagc

SEQ ID NO: 590244 - RNA, 22 nt, Human
cugugcccuuuguccucgucuc

SEQ ID NO: 590245 - RNA, 22 nt, Human
ggccuggaaggacagcgugaug

SEQ ID NO: 590246 - RNA, 22 nt, Human
ccugugguuuacucuguggcua

SEQ ID NO: 590247 - RNA, 22 nt, Human
aaauuccauuaggaaacuucca

SEQ ID NO: 590248 - RNA, 22 nt, Human
ugcauuucacagacugagaaau

SEQ ID NO: 590249 - RNA, 22 nt, Human
aggcggugcuguggacagugac

SEQ ID NO: 590250 - RNA, 22 nt, Human
ugggccacgucaucucccacaa

SEQ ID NO: 590251 - RNA, 22 nt, Human
cauuuuaagaugaccugguuuc

SEQ ID NO: 590252 - RNA, 22 nt, Human
gcaagauuccgcucuagagccu

SEQ ID NO: 590253 - RNA, 22 nt, Human
auauucauugaacaccuacuac

SEQ ID NO: 590254 - RNA, 22 nt, Human
gcauggaauucccuuaugggcc

SEQ ID NO: 590255 - RNA, 22 nt, Human
aggaucauguggucauuccuga

SEQ ID NO: 590256 - RNA, 22 nt, Human
uuucuagugguuaagauuuaca

SEQ ID NO: 590257 - RNA, 22 nt, Human
aaucaagagcugacuauauuuu

SEQ ID NO: 590258 - RNA, 22 nt, Human
ugcugccuccuuccugccagga

SEQ ID NO: 590259 - RNA, 22 nt, Human
cuuccaguaguaucauucucau

SEQ ID NO: 590260 - RNA, 22 nt, Human
uccaucaggcucgugggcucuc

SEQ ID NO: 590261 - RNA, 22 nt, Human
aucuggaagccagauacucagu

SEQ ID NO: 590262 - RNA, 22 nt, Human
agucagauuuagauguagcaag

SEQ ID NO: 590263 - RNA, 22 nt, Human
ggggagcaggcugggcugucug

SEQ ID NO: 590264 - RNA, 22 nt, Human
uuagaaucuuuagagucucacu

SEQ ID NO: 590265 - RNA, 22 nt, Human
aagcagcuuuugaagagugagg

SEQ ID NO: 590266 - RNA, 22 nt, Human
ugcaggaggauuuuguggagcu

SEQ ID NO: 590267 - RNA, 22 nt, Human
cagugagguggauggauggccu

SEQ ID NO: 590268 - RNA, 22 nt, Human
cccugugggaacuccugaguug

SEQ ID NO: 590269 - RNA, 22 nt, Human
uguguguuaucuuaguucaucu

SEQ ID NO: 590270 - RNA, 22 nt, Human
aaacacaagaggcaggguacag

SEQ ID NO: 590271 - RNA, 22 nt, Human
uucuccaguuucucccuucagu

SEQ ID NO: 590272 - RNA, 22 nt, Human
gcaggcugaguauuacccuagu

SEQ ID NO: 590273 - RNA, 22 nt, Human
gaaggaggugucaguuggacug

SEQ ID NO: 590274 - RNA, 22 nt, Human
ggaaggaaauuggggcaguugu

SEQ ID NO: 590275 - RNA, 22 nt, Human
uaauaucuacuucauagaguuu

SEQ ID NO: 590276 - RNA, 22 nt, Human
agcugccauccgaggugucaga

SEQ ID NO: 590277 - RNA, 22 nt, Human
uucuaccagcuacucacugaua

SEQ ID NO: 590278 - RNA, 22 nt, Human
uauucucagugcuauaaguaga

SEQ ID NO: 590279 - RNA, 23 nt, Human
auauuuccagguuagugagguaa

SEQ ID NO: 590280 - RNA, 21 nt, Human
acuggaagugggucaggaagu

SEQ ID NO: 590281 - RNA, 22 nt, Human
acuuucugccuuacaggagucc

SEQ ID NO: 590282 - RNA, 22 nt, Human
gcugucaccaaagcaggcacug

SEQ ID NO: 590283 - RNA, 22 nt, Human
cuuggcaguuucggaaggauga

SEQ ID NO: 590284 - RNA, 19 nt, Human
agaggcugucaccuguagc

SEQ ID NO: 590285 - RNA, 22 nt, Human
cauuggcacaaguagcuucauc

SEQ ID NO: 590286 - RNA, 22 nt, Human
guacauauggcacaugcuauuu

SEQ ID NO: 590287 - RNA, 22 nt, Human
auacacuugaccuggagugaag

SEQ ID NO: 590288 - RNA, 22 nt, Human
uaaagccacgcuggaaaucagg

SEQ ID NO: 590289 - RNA, 22 nt, Human
uccuucagaggauaaggaagaa

SEQ ID NO: 590290 - RNA, 22 nt, Human
auucucagcuuucaaauagaca

SEQ ID NO: 590291 - RNA, 22 nt, Human
agagaacaugacguaauagugg

SEQ ID NO: 590292 - RNA, 22 nt, Human
uggucagguaccucuggcuguc

SEQ ID NO: 590293 - RNA, 22 nt, Human
uaggcuggaggaagcagugccu

SEQ ID NO: 590294 - RNA, 22 nt, Human
acugcccuuguccuggcacacc

SEQ ID NO: 590295 - RNA, 22 nt, Human
ggccucugguucguggugaccu

SEQ ID NO: 590296 - RNA, 20 nt, Human
ccaauguuuacagauuacuu

SEQ ID NO: 590297 - RNA, 22 nt, Human
uccagcagccugacuucccucu

SEQ ID NO: 590298 - RNA, 22 nt, Human
gcagcagcaggcgcucggccgu

SEQ ID NO: 590299 - RNA, 22 nt, Human
uaguagcaggggguaccucuca

SEQ ID NO: 590300 - RNA, 22 nt, Human
cuccuggcaggcugagugaaau

SEQ ID NO: 590301 - RNA, 22 nt, Human
uucccucccuggcugccauuuc

SEQ ID NO: 590302 - RNA, 22 nt, Human
cuggccaggagguaaccagaug

SEQ ID NO: 590303 - RNA, 18 nt, Human
uucacagauccacaggaa

SEQ ID NO: 590304 - RNA, 22 nt, Human
caggcugccgugggguccaggc

SEQ ID NO: 590305 - RNA, 22 nt, Human
uugaagauucuuuuuguuagua

SEQ ID NO: 590306 - RNA, 22 nt, Human
agcuuacaccccccaagauucu

SEQ ID NO: 590307 - RNA, 22 nt, Human
acugaucuguuuucagauucug

SEQ ID NO: 590308 - RNA, 22 nt, Human
agaggcugucccuugcuauucc

SEQ ID NO: 590309 - RNA, 22 nt, Human
aggcucuguuauucuagagggc

SEQ ID NO: 590310 - RNA, 22 nt, Human
uccaucugcauuugguuucugu

SEQ ID NO: 590311 - RNA, 22 nt, Human
aggaauguggcaaucuucaagu

SEQ ID NO: 590312 - RNA, 22 nt, Human
ugguagggacacuaugcagaaa

SEQ ID NO: 590313 - RNA, 22 nt, Human
acagcacuuggguuuuccuguu

SEQ ID NO: 590314 - RNA, 22 nt, Human
uuagaguuaggauuugucuuua

SEQ ID NO: 590315 - RNA, 22 nt, Human
ugccauuucuuucaauauucuu

SEQ ID NO: 590316 - RNA, 22 nt, Human
cucccagguuccgacgccucuu

SEQ ID NO: 590317 - RNA, 22 nt, Human
gccaaagcuggagguggaggug

SEQ ID NO: 590318 - RNA, 22 nt, Human
aaagguuuuauucugagcucug

SEQ ID NO: 590319 - RNA, 22 nt, Human
aaaaggaggcaaacagccuaga

SEQ ID NO: 590320 - RNA, 23 nt, Human
ucucauuucccuugaucuaucuu

SEQ ID NO: 590321 - RNA, 20 nt, Human
ccucucugcccugcaaggcc

SEQ ID NO: 590322 - RNA, 22 nt, Human
gacuggaaagccuguccucaga

SEQ ID NO: 590323 - RNA, 22 nt, Human
aagagcuggagcugcuacagga

SEQ ID NO: 590324 - RNA, 22 nt, Human
ugaagcagauggucuggucauu

SEQ ID NO: 590325 - RNA, 21 nt, Human
uucugcugugccaugccucug

SEQ ID NO: 590326 - RNA, 18 nt, Human
acauugauggcuuuaagc

SEQ ID NO: 590327 - RNA, 22 nt, Human
agcuucuucugauuugucaguc

SEQ ID NO: 590328 - RNA, 22 nt, Human
aaguaacuuauuugcaaacagg

SEQ ID NO: 590329 - RNA, 22 nt, Human
agggccaguaaauguuuccuca

SEQ ID NO: 590330 - RNA, 22 nt, Human
aaggcugagagucacaguccua

SEQ ID NO: 590331 - RNA, 22 nt, Human
uagcuccuggcugcagggccuc

SEQ ID NO: 590332 - RNA, 22 nt, Human
uaaaaguuuuaguuguacauaa

SEQ ID NO: 590333 - RNA, 22 nt, Human
cacuguacuggguugaaggacg

SEQ ID NO: 590334 - RNA, 23 nt, Human
aaagaccuaggaugagggagacg

SEQ ID NO: 590335 - RNA, 22 nt, Human
ucagaaucucuggaggcuuggc

SEQ ID NO: 590336 - RNA, 22 nt, Human
aagcuuccugcaugggacugcu

SEQ ID NO: 590337 - RNA, 22 nt, Human
acugugugggccgcucacuggg

SEQ ID NO: 590338 - RNA, 22 nt, Human
aauguuuuguaugccucugagc

SEQ ID NO: 590339 - RNA, 22 nt, Human
uauuuucaccuucucuggauau

SEQ ID NO: 590340 - RNA, 22 nt, Human
ccagcccuugcugaaggguggc

SEQ ID NO: 590341 - RNA, 22 nt, Human
ucagccagagggggcaaaggaa

SEQ ID NO: 590342 - RNA, 22 nt, Human
aaaugugcucauuuauaaaagu

SEQ ID NO: 590343 - RNA, 22 nt, Human
uacacuggauuagcuguccuac

SEQ ID NO: 590344 - RNA, 22 nt, Human
uaggccacgaaggagaugauag

SEQ ID NO: 590345 - RNA, 22 nt, Human
aggaccagaggccagagucagc

SEQ ID NO: 590346 - RNA, 22 nt, Human
acuuaaaaccagacagcgucau

SEQ ID NO: 590347 - RNA, 19 nt, Human
agcacagagagucuauagc

SEQ ID NO: 590348 - RNA, 22 nt, Human
ucagguguuagaagaaauuuca

SEQ ID NO: 590349 - RNA, 22 nt, Human
acuuuauuuccuauugcaucca

SEQ ID NO: 590350 - RNA, 22 nt, Human
gggcagcauucugugggcaggu

SEQ ID NO: 590351 - RNA, 20 nt, Human
augucugaaguaauccauuu

SEQ ID NO: 590352 - RNA, 22 nt, Human
cgccaggcuugguagcucaugc

SEQ ID NO: 590353 - RNA, 22 nt, Human
ggcaguguuccagaccuucacc

SEQ ID NO: 590354 - RNA, 21 nt, Human
ugggaugggucugggaccagc

SEQ ID NO: 590355 - RNA, 22 nt, Human
uaauuucaauagcuugcauaau

SEQ ID NO: 590356 - RNA, 22 nt, Human
uccuggguaaacacugaccuuu

SEQ ID NO: 590357 - RNA, 22 nt, Human
augaggccagaccacucugcau

SEQ ID NO: 590358 - RNA, 22 nt, Human
aggagaaguaaggcuagaugau

SEQ ID NO: 590359 - RNA, 22 nt, Human
cugauucuguugaacaccuucc

SEQ ID NO: 590360 - RNA, 22 nt, Human
ugggccacuugaaaguggaugu

SEQ ID NO: 590361 - RNA, 22 nt, Human
cagcacaauuuucaggagucca

SEQ ID NO: 590362 - RNA, 22 nt, Human
ugggaguguucuuggcuugcuu

SEQ ID NO: 590363 - RNA, 22 nt, Human
cuucuuaaugacagauuaaaau

SEQ ID NO: 590364 - RNA, 22 nt, Human
ucagggcaaaagggaaaccauu

SEQ ID NO: 590365 - RNA, 22 nt, Human
gggacagcagaaagaaggcaag

SEQ ID NO: 590366 - RNA, 22 nt, Human
ugugcaucaagagaaaacagug

SEQ ID NO: 590367 - RNA, 22 nt, Human
uccagucuucuugcagcuacau

SEQ ID NO: 590368 - RNA, 22 nt, Human
agcugcccagauaggaggaggc

SEQ ID NO: 590369 - RNA, 22 nt, Human
uugcaaauguuucauaacagua

SEQ ID NO: 590370 - RNA, 22 nt, Human
auacaucucauguaagagauaa

SEQ ID NO: 590371 - RNA, 22 nt, Human
cuggugcacuacagccuggaac

SEQ ID NO: 590372 - RNA, 22 nt, Human
acagagcuucccagccugagca

SEQ ID NO: 590373 - RNA, 22 nt, Human
aacucuauuuacccuacuaaac

SEQ ID NO: 590374 - RNA, 22 nt, Human
ugguggggucaucgucagaugc

SEQ ID NO: 590375 - RNA, 22 nt, Human
ccugggauuugcgccagaccuu

SEQ ID NO: 590376 - RNA, 22 nt, Human
cacugucuauuaauauaacuua

SEQ ID NO: 590377 - RNA, 22 nt, Human
auggcucagcgccuuucugugg

SEQ ID NO: 590378 - RNA, 21 nt, Human
ucagaggcacugagagcaaug

SEQ ID NO: 590379 - RNA, 22 nt, Human
acagugcugucuaucucacuaa

SEQ ID NO: 590380 - RNA, 22 nt, Human
gagcacugauuuauuuuugucu

SEQ ID NO: 590381 - RNA, 22 nt, Human
caaaugcaugagaaauaagagg

SEQ ID NO: 590382 - RNA, 22 nt, Human
gcuuccuucuaccacaucaugc

SEQ ID NO: 590383 - RNA, 22 nt, Human
ccuuagcauggcugugcugugu

SEQ ID NO: 590384 - RNA, 22 nt, Human
cucccucccuacgugagcucac

SEQ ID NO: 590385 - RNA, 22 nt, Human
uucaaacaguguagaauauaug

SEQ ID NO: 590386 - RNA, 22 nt, Human
augucuuuauaaauguauaaug

SEQ ID NO: 590387 - RNA, 22 nt, Human
aucuuauguuguauucaaaauc

SEQ ID NO: 590388 - RNA, 22 nt, Human
uguauaaaccauggacagcuuu

SEQ ID NO: 590389 - RNA, 22 nt, Human
gagggcucuaccaaguaacucu

SEQ ID NO: 590390 - RNA, 22 nt, Human
aagagagggacuuauuaaaguc

SEQ ID NO: 590391 - RNA, 22 nt, Human
cacagcuucaguuucugacuug

SEQ ID NO: 590392 - RNA, 22 nt, Human
acacaaugcauauuuuuccaga

SEQ ID NO: 590393 - RNA, 22 nt, Human
uccucagggcggccuccgucuu

SEQ ID NO: 590394 - RNA, 22 nt, Human
auuuuuccaauuaggauaaaga

SEQ ID NO: 590395 - RNA, 17 nt, Human
ucccaggaacagggaau

SEQ ID NO: 590396 - RNA, 22 nt, Human
cagagggguguagagaucacug

SEQ ID NO: 590397 - RNA, 22 nt, Human
uggcugcugcuuggucuucuuc

SEQ ID NO: 590398 - RNA, 22 nt, Human
ccagagguccccugccaggagg

SEQ ID NO: 590399 - RNA, 22 nt, Human
agggggcccuugcaggugagcg

SEQ ID NO: 590400 - RNA, 22 nt, Human
cccaagcagggugcagaggcau

SEQ ID NO: 590401 - RNA, 15 nt, Human
caggagaggaagguu

SEQ ID NO: 590402 - RNA, 22 nt, Human
caguggagugggacuggucuga

SEQ ID NO: 590403 - RNA, 22 nt, Human
ccucugugccucaguuucaugu

SEQ ID NO: 590404 - RNA, 22 nt, Human
aaucacaucucauucaacagcc

SEQ ID NO: 590405 - RNA, 22 nt, Human
ggcacagggagccgcaguugca

SEQ ID NO: 590406 - RNA, 22 nt, Human
gugagcagcucaggguggucuc

SEQ ID NO: 590407 - RNA, 22 nt, Human
gcugucccgcugacuuccagcu

SEQ ID NO: 590408 - RNA, 22 nt, Human
ccuggguuggagagcaauggug

SEQ ID NO: 590409 - RNA, 22 nt, Human
aauguuuuaaaagagauugaga

SEQ ID NO: 590410 - RNA, 22 nt, Human
aaaguaagaccaagugaucauu

SEQ ID NO: 590411 - RNA, 22 nt, Human
agcaccuguugcacuucauaau

SEQ ID NO: 590412 - RNA, 22 nt, Human
gggcaguggguggcugcagccu

SEQ ID NO: 590413 - RNA, 22 nt, Human
caugcagguuauaugugcuucu

SEQ ID NO: 590414 - RNA, 22 nt, Human
aaguuuacuggggagaucaccu

SEQ ID NO: 590415 - RNA, 22 nt, Human
cauauuguaaaagguugaaucc

SEQ ID NO: 590416 - RNA, 22 nt, Human
cagaaagcuugguacaauaugc

SEQ ID NO: 590417 - RNA, 20 nt, Human
ugagucagcugcaugggugg

SEQ ID NO: 590418 - RNA, 22 nt, Human
ucucugaagagcucagacuagu

SEQ ID NO: 590419 - RNA, 22 nt, Human
cuucuguguuaaaugagucuuu

SEQ ID NO: 590420 - RNA, 22 nt, Human
uguuucauuaguacugacaaua

SEQ ID NO: 590421 - RNA, 18 nt, Human
gugcagauugcggagccc

SEQ ID NO: 590422 - RNA, 22 nt, Human
cugggacuggguccucaggaca

SEQ ID NO: 590423 - RNA, 22 nt, Human
agcugcuaugacaacaccagcc

SEQ ID NO: 590424 - RNA, 22 nt, Human
agguggggaggagugucucuuu

SEQ ID NO: 590425 - RNA, 22 nt, Human
agcaugaaagcauaggacaguc

SEQ ID NO: 590426 - RNA, 22 nt, Human
aauagcauguaaguuuaaaaga

SEQ ID NO: 590427 - RNA, 22 nt, Human
ggugucauccaacaggacaggg

SEQ ID NO: 590428 - RNA, 22 nt, Human
ugcuggaggggguaccacucaa

SEQ ID NO: 590429 - RNA, 22 nt, Human
ugcucccacacuacucggaggc

SEQ ID NO: 590430 - RNA, 22 nt, Human
aaacacaucauucaugucguca

SEQ ID NO: 590431 - RNA, 22 nt, Human
agcagcaggcuuaaggaaaagu

SEQ ID NO: 590432 - RNA, 22 nt, Human
uguacaaggccaucuacaugcu

SEQ ID NO: 590433 - RNA, 22 nt, Human
uauguacauaacaugaaaugca

SEQ ID NO: 590434 - RNA, 22 nt, Human
uuaacaauagaguuucuucagg

SEQ ID NO: 590435 - RNA, 22 nt, Human
aagaauauagauuuuuugaagu

SEQ ID NO: 590436 - RNA, 22 nt, Human
gaggccaggggccuggagauga

SEQ ID NO: 590437 - RNA, 22 nt, Human
aaauuucuugaggcucucuagc

SEQ ID NO: 590438 - RNA, 22 nt, Human
acaguguucacuaagguuagcu

SEQ ID NO: 590439 - RNA, 22 nt, Human
gcaguguucuaaauugggugug

SEQ ID NO: 590440 - RNA, 22 nt, Human
gcugcagggcucucacaggggg

SEQ ID NO: 590441 - RNA, 22 nt, Human
ugaaagacaagguuuuuucaga

SEQ ID NO: 590442 - RNA, 22 nt, Human
uaugucaugggucaaaaugaag

SEQ ID NO: 590443 - RNA, 22 nt, Human
uggaagggagugacagucagag

SEQ ID NO: 590444 - RNA, 22 nt, Human
aggaagcucaaagccaugaugu

SEQ ID NO: 590445 - RNA, 17 nt, Human
gacagcugguuccuggc

SEQ ID NO: 590446 - RNA, 22 nt, Human
ccugccuggagcugagugugga

SEQ ID NO: 590447 - RNA, 19 nt, Human
augauacaggugaaaauug

SEQ ID NO: 590448 - RNA, 22 nt, Human
ugucugaaggccugaccuacau

SEQ ID NO: 590449 - RNA, 22 nt, Human
ggaggacaggggcugcagcaca

SEQ ID NO: 590450 - RNA, 22 nt, Human
aggcuggaaagggaccagagug

SEQ ID NO: 590451 - RNA, 22 nt, Human
aagucuuauuugucauguaugu

SEQ ID NO: 590452 - RNA, 22 nt, Human
uuucucaaauacuguuccagga

SEQ ID NO: 590453 - RNA, 22 nt, Human
acagucugcauaugaccuguag

SEQ ID NO: 590454 - RNA, 22 nt, Human
uaagcaaauaaugcaucaaggg

SEQ ID NO: 590455 - RNA, 22 nt, Human
ugugaagaguagacauguggug

SEQ ID NO: 590456 - RNA, 22 nt, Human
guccugugugacuucccaaaug

SEQ ID NO: 590457 - RNA, 22 nt, Human
ggacaggcugcaucugagcaug

SEQ ID NO: 590458 - RNA, 22 nt, Human
auaaagcaucuagucugucacu

SEQ ID NO: 590459 - RNA, 22 nt, Human
uaaugucuagaucagaccucga

SEQ ID NO: 590460 - RNA, 22 nt, Human
acagcagcacuauugacauuuu

SEQ ID NO: 590461 - RNA, 22 nt, Human
auuuaauuuggagagagaaacc

SEQ ID NO: 590462 - RNA, 22 nt, Human
uucugcagcaugaggcuggagc

SEQ ID NO: 590463 - RNA, 22 nt, Human
cagcaggguagguuguaucagu

SEQ ID NO: 590464 - RNA, 22 nt, Human
gugaggccgcacgccccggagu

SEQ ID NO: 590465 - RNA, 22 nt, Human
augaaacagaguacuuaauaua

SEQ ID NO: 590466 - RNA, 22 nt, Human
agccuuuaacacuucacauuga

SEQ ID NO: 590467 - RNA, 19 nt, Human
gccaggacauccuccugcu

SEQ ID NO: 590468 - RNA, 22 nt, Human
ugagaagcccacacucuuuccu

SEQ ID NO: 590469 - RNA, 22 nt, Human
gguugaauaucuuuauguuggu

SEQ ID NO: 590470 - RNA, 22 nt, Human
acagacugauucauugcucagg

SEQ ID NO: 590471 - RNA, 22 nt, Human
agcuucagcuugcagcugugau

SEQ ID NO: 590472 - RNA, 22 nt, Human
gcucugagugaucagcugggaa

SEQ ID NO: 590473 - RNA, 20 nt, Human
guuuuucucucuugccacua

SEQ ID NO: 590474 - RNA, 22 nt, Human
agaauccugaugaaaaggagag

SEQ ID NO: 590475 - RNA, 22 nt, Human
cuuaggaaaguuucugcuuaug

SEQ ID NO: 590476 - RNA, 22 nt, Human
gcagugcuaaggauucugccuu

SEQ ID NO: 590477 - RNA, 22 nt, Human
ugaguagagaauucagcuaagg

SEQ ID NO: 590478 - RNA, 17 nt, Human
ugcaaacaaucacauau

SEQ ID NO: 590479 - RNA, 22 nt, Human
cagaggaaguuccuugaugaga

SEQ ID NO: 590480 - RNA, 18 nt, Human
auauggaaugccuggcua

SEQ ID NO: 590481 - RNA, 22 nt, Human
aucuacagugcacaggacagcc

SEQ ID NO: 590482 - RNA, 22 nt, Human
aaggagcgcuuagggggcagaa

SEQ ID NO: 590483 - RNA, 21 nt, Human
gcccagagggagccaagccca

SEQ ID NO: 590484 - RNA, 22 nt, Human
aauuuguuacacagcaauauaa

SEQ ID NO: 590485 - RNA, 22 nt, Human
uggcugaggucuggggcuucug

SEQ ID NO: 590486 - RNA, 22 nt, Human
uggaagauaagagauugggaag

SEQ ID NO: 590487 - RNA, 22 nt, Human
agaaaauauucauugagaggcu

SEQ ID NO: 590488 - RNA, 22 nt, Human
agguggggcugggaaagauucc

SEQ ID NO: 590489 - RNA, 22 nt, Human
cuugagaagagauuuauauuug

SEQ ID NO: 590490 - RNA, 22 nt, Human
gagccaggcccguacuugcugu

SEQ ID NO: 590491 - RNA, 22 nt, Human
cccaguccuaaagcagacgcca

SEQ ID NO: 590492 - RNA, 22 nt, Human
uuccuucuuguaaugaucugcc

SEQ ID NO: 590493 - RNA, 21 nt, Human
ccugagugagaccuggcccgu

SEQ ID NO: 590494 - RNA, 18 nt, Human
cacaggcaggugauaggu

SEQ ID NO: 590495 - RNA, 22 nt, Human
gcacccagggcaggaagugagg

SEQ ID NO: 590496 - RNA, 22 nt, Human
aucuaaaaugugguuaguuggu

SEQ ID NO: 590497 - RNA, 22 nt, Human
gaggcagccagagguucucauu

SEQ ID NO: 590498 - RNA, 22 nt, Human
gcccugggcucccugcuccaca

SEQ ID NO: 590499 - RNA, 22 nt, Human
ggcuccaggagaugcugggcag

SEQ ID NO: 590500 - RNA, 21 nt, Human
ugcaguauguauuuguaucca

SEQ ID NO: 590501 - RNA, 22 nt, Human
cuucugggauuuuugaagacuc

SEQ ID NO: 590502 - RNA, 22 nt, Human
acauauguauauguacacaguc

SEQ ID NO: 590503 - RNA, 22 nt, Human
aauacagcagauggagacaaau

SEQ ID NO: 590504 - RNA, 22 nt, Human
gacagggacucccugguuagaa

SEQ ID NO: 590505 - RNA, 22 nt, Human
aagcccagcaucccugcaccag

SEQ ID NO: 590506 - RNA, 22 nt, Human
gcaggcaccgcggcggcagguu

SEQ ID NO: 590507 - RNA, 22 nt, Human
ggugucccaggccagcugugug

SEQ ID NO: 590508 - RNA, 22 nt, Human
agagcagaguggcuguagcuug

SEQ ID NO: 590509 - RNA, 22 nt, Human
auuugcuuaucuccacaguugu

SEQ ID NO: 590510 - RNA, 22 nt, Human
ugccuggcaccccagucugcac

SEQ ID NO: 590511 - RNA, 22 nt, Human
uccagucaagcuugagaauuuc

SEQ ID NO: 590512 - RNA, 22 nt, Human
ccucagaagcucaaggacauug

SEQ ID NO: 590513 - RNA, 23 nt, Human
ugugaaauuugaggucagugcuu

SEQ ID NO: 590514 - RNA, 17 nt, Human
ugcaagaagauuaggaa

SEQ ID NO: 590515 - RNA, 22 nt, Human
uggcuggaauggagcugagccu

SEQ ID NO: 590516 - RNA, 22 nt, Human
uccuggcuccacugagcaggcc

SEQ ID NO: 590517 - RNA, 22 nt, Human
cuguacaaaguagcugcuggga

SEQ ID NO: 590518 - RNA, 22 nt, Human
ucuuucugcagcacaggggcag

SEQ ID NO: 590519 - RNA, 22 nt, Human
cuggccuuguuccuccccaagu

SEQ ID NO: 590520 - RNA, 22 nt, Human
aucucauuuugguuucuacuua

SEQ ID NO: 590521 - RNA, 22 nt, Human
uucuuguauauaaaaaucauuu

SEQ ID NO: 590522 - RNA, 22 nt, Human
ggauaggaauugagaugcuauu

SEQ ID NO: 590523 - RNA, 23 nt, Human
uucuuacaaggcuggcccacuug

SEQ ID NO: 590524 - RNA, 22 nt, Human
gggcuggcucugucuagaaagg

SEQ ID NO: 590525 - RNA, 22 nt, Human
uucacaaugccuuguugauggu

SEQ ID NO: 590526 - RNA, 22 nt, Human
uacauguguucuguuucaaguu

SEQ ID NO: 590527 - RNA, 22 nt, Human
gcuggcuuaauagggaugggcu

SEQ ID NO: 590528 - RNA, 22 nt, Human
uccucugguccugcagcagauc

SEQ ID NO: 590529 - RNA, 22 nt, Human
caguuauuaugaggucauuagg

SEQ ID NO: 590530 - RNA, 22 nt, Human
ugaggcaggaugcuugcacagg

SEQ ID NO: 590531 - RNA, 22 nt, Human
ucauggcuggaagcucaguuag

SEQ ID NO: 590532 - RNA, 23 nt, Human
aaguacauauauuuagauaguga

SEQ ID NO: 590533 - RNA, 22 nt, Human
cacaggaauuagcagccuaaaa

SEQ ID NO: 590534 - RNA, 22 nt, Human
gaaagccauagcccagcuuuac

SEQ ID NO: 590535 - RNA, 22 nt, Human
accucccucgccguccacucug

SEQ ID NO: 590536 - RNA, 22 nt, Human
uagaaagagcauaguauuauaa

SEQ ID NO: 590537 - RNA, 17 nt, Human
gugagggcagaggaugg

SEQ ID NO: 590538 - RNA, 22 nt, Human
cauucacaaagcugauugaugg

SEQ ID NO: 590539 - RNA, 22 nt, Human
agucccagagaggucggggcca

SEQ ID NO: 590540 - RNA, 22 nt, Human
gagcuuuguagcaggaaggaag

SEQ ID NO: 590541 - RNA, 22 nt, Human
gaugacaguucuagcaucugaa

SEQ ID NO: 590542 - RNA, 21 nt, Human
cagaggccucaugcucugugc

SEQ ID NO: 590543 - RNA, 18 nt, Human
ucacugggagaagauauu

SEQ ID NO: 590544 - RNA, 22 nt, Human
agucacagguucuugggauuag

SEQ ID NO: 590545 - RNA, 22 nt, Human
cguaggauacucagugcucauu

SEQ ID NO: 590546 - RNA, 22 nt, Human
uuuccuuccaaaugcccgggag

SEQ ID NO: 590547 - RNA, 22 nt, Human
augaaugagaaagcugaaaucu

SEQ ID NO: 590548 - RNA, 22 nt, Human
ucccagggcagcuguccagaag

SEQ ID NO: 590549 - RNA, 22 nt, Human
acugugugaggcugggugaguc

SEQ ID NO: 590550 - RNA, 20 nt, Human
cugcugugugugccucagcc

SEQ ID NO: 590551 - RNA, 22 nt, Human
uacauucugguggagaaaguaa

SEQ ID NO: 590552 - RNA, 22 nt, Human
ggcaggcaggagcucugucucc

SEQ ID NO: 590553 - RNA, 22 nt, Human
cucugcaaucugagcacuugua

SEQ ID NO: 590554 - RNA, 18 nt, Human
gagaggagccagaauuuu

SEQ ID NO: 590555 - RNA, 22 nt, Human
aauggcaagcugaacucagaag

SEQ ID NO: 590556 - RNA, 22 nt, Human
ccuggagauuauuugguccaau

SEQ ID NO: 590557 - RNA, 22 nt, Human
guaaagcaaaauguagagauug

SEQ ID NO: 590558 - RNA, 22 nt, Human
ggcuggacaugagcuuggcagu

SEQ ID NO: 590559 - RNA, 22 nt, Human
cugaggcacuaacaaggacaag

SEQ ID NO: 590560 - RNA, 22 nt, Human
uaaacagcuacugugucaaagg

SEQ ID NO: 590561 - RNA, 19 nt, Human
aauguuuaagagaaaaagg

SEQ ID NO: 590562 - RNA, 22 nt, Human
ugggccaguuauuucaccucug

SEQ ID NO: 590563 - RNA, 21 nt, Human
ucugcauuuuagcaagaucuc

SEQ ID NO: 590564 - RNA, 22 nt, Human
ccuccugggacucauuagcacc

SEQ ID NO: 590565 - RNA, 22 nt, Human
guggagggugauugccggcugu

SEQ ID NO: 590566 - RNA, 20 nt, Human
ugcagagcuggcuggcuccu

SEQ ID NO: 590567 - RNA, 22 nt, Human
ccaggccagcgcuggcuggagg

SEQ ID NO: 590568 - RNA, 22 nt, Human
uugggcagugauuaguucauga

SEQ ID NO: 590569 - RNA, 22 nt, Human
acaggaacuguuaucucagaug

SEQ ID NO: 590570 - RNA, 22 nt, Human
ggcaguggguggaucucaggga

SEQ ID NO: 590571 - RNA, 22 nt, Human
ucagaagccggaagugcuccuc

SEQ ID NO: 590572 - RNA, 22 nt, Human
cugcuuuauauugagcuugaaa

SEQ ID NO: 590573 - RNA, 22 nt, Human
ucccagcugcugagauagugcu

SEQ ID NO: 590574 - RNA, 22 nt, Human
gaaagguuuaaguaggauuugu

SEQ ID NO: 590575 - RNA, 22 nt, Human
agaaagcacagcggguccauuu

SEQ ID NO: 590576 - RNA, 22 nt, Human
ucugcuuucaaauucacuuagu

SEQ ID NO: 590577 - RNA, 22 nt, Human
cagaaugagauaacccagauug

SEQ ID NO: 590578 - RNA, 22 nt, Human
ccagggcuucaguuagugguga

SEQ ID NO: 590579 - RNA, 22 nt, Human
ugcacuagccacauuucaaaug

SEQ ID NO: 590580 - RNA, 22 nt, Human
gugcaggguagcgacggcagga

SEQ ID NO: 590581 - RNA, 22 nt, Human
caaauagacuuaagcaucugua

SEQ ID NO: 590582 - RNA, 22 nt, Human
ucacccagggacugugauggaa

SEQ ID NO: 590583 - RNA, 22 nt, Human
cacagcuggugacagagcccag

SEQ ID NO: 590584 - RNA, 22 nt, Human
gugugccaccagucaaggugaa

SEQ ID NO: 590585 - RNA, 18 nt, Human
uccaggacucugcguggc

SEQ ID NO: 590586 - RNA, 22 nt, Human
uccuggagagugggcgagcaca

SEQ ID NO: 590587 - RNA, 22 nt, Human
uuguccauuuuauuggauggug

SEQ ID NO: 590588 - RNA, 22 nt, Human
ugaaugaucuccgauuaguccu

SEQ ID NO: 590589 - RNA, 22 nt, Human
gucagcaccucuuuggggagcu

SEQ ID NO: 590590 - RNA, 22 nt, Human
gugauacagguguucuggauau

SEQ ID NO: 590591 - RNA, 22 nt, Human
aggccuggugugccggaugcag

SEQ ID NO: 590592 - RNA, 22 nt, Human
aaaacauucugugaacucucaa

SEQ ID NO: 590593 - RNA, 22 nt, Human
cagggccugccugguuccugga

SEQ ID NO: 590594 - RNA, 22 nt, Human
aagcugaggcuccccugaggga

SEQ ID NO: 590595 - RNA, 22 nt, Human
aaaucagauuauuugauuggca

SEQ ID NO: 590596 - RNA, 22 nt, Human
gaaagagaaccugggccuagau

SEQ ID NO: 590597 - RNA, 22 nt, Human
agggcugagaaugacagggccg

SEQ ID NO: 590598 - RNA, 22 nt, Human
acagugauuggcacugauucag

SEQ ID NO: 590599 - RNA, 22 nt, Human
agcacuagccuguuuugcugug

SEQ ID NO: 590600 - RNA, 23 nt, Human
cacaccaggagccgucugggcca

SEQ ID NO: 590601 - RNA, 22 nt, Human
aacacuaaugggagaacaaccc

SEQ ID NO: 590602 - RNA, 22 nt, Human
uucuugggugugaccagucuga

SEQ ID NO: 590603 - RNA, 22 nt, Human
aaaaucaguacacuuuauuuug

SEQ ID NO: 590604 - RNA, 22 nt, Human
cagugugggugaaauacaaagu

SEQ ID NO: 590605 - RNA, 22 nt, Human
caggagcuggauaggaccacaa

SEQ ID NO: 590606 - RNA, 22 nt, Human
gcugggagccccgagccagcgc

SEQ ID NO: 590607 - RNA, 22 nt, Human
augggcaguuaggaggccagga

SEQ ID NO: 590608 - RNA, 19 nt, Human
acagggcagcaauaggaua

SEQ ID NO: 590609 - RNA, 22 nt, Human
agcaaaguccagucuguguaca

SEQ ID NO: 590610 - RNA, 22 nt, Human
cagggagaaaucuccaggaggu

SEQ ID NO: 590611 - RNA, 21 nt, Human
ugucagcaacaauacuuucuc

SEQ ID NO: 590612 - RNA, 22 nt, Human
acugggccagaucagagcaacu

SEQ ID NO: 590613 - RNA, 22 nt, Human
cagcuucuccagaugacccuca

SEQ ID NO: 590614 - RNA, 22 nt, Human
agaggcuccaccuucucugucc

SEQ ID NO: 590615 - RNA, 22 nt, Human
acagauacucagcucuaugcuu

SEQ ID NO: 590616 - RNA, 22 nt, Human
uuugguaacaguuuuuggcacu

SEQ ID NO: 590617 - RNA, 22 nt, Human
gacacuuuaggauuuaaaaguc

SEQ ID NO: 590618 - RNA, 22 nt, Human
gacagguggggaaacuaaggua

SEQ ID NO: 590619 - RNA, 22 nt, Human
agaaaaguuuucugagacugac

SEQ ID NO: 590620 - RNA, 22 nt, Human
ucacaggcuaaauuuaugcagg

SEQ ID NO: 590621 - RNA, 22 nt, Human
agaaaauuuaaagagacacaca

SEQ ID NO: 590622 - RNA, 20 nt, Human
agcugguccccaagccucuc

SEQ ID NO: 590623 - RNA, 22 nt, Human
ugagcagauuuguucuaggggu

SEQ ID NO: 590624 - RNA, 22 nt, Human
uggcccugcacccagagcaguu

SEQ ID NO: 590625 - RNA, 22 nt, Human
gcuggggagcaagaguagugag

SEQ ID NO: 590626 - RNA, 20 nt, Human
aaaagcagccagagauggua

SEQ ID NO: 590627 - RNA, 22 nt, Human
ucugccuccugcuugucccgac

SEQ ID NO: 590628 - RNA, 22 nt, Human
gugaggauugcucuggagaauu

SEQ ID NO: 590629 - RNA, 22 nt, Human
uuuaugaacuacagauauaacu

SEQ ID NO: 590630 - RNA, 23 nt, Human
ucuuuagaagaacaucagaaaug

SEQ ID NO: 590631 - RNA, 22 nt, Human
uguuuuauuucuccaagaggga

SEQ ID NO: 590632 - RNA, 22 nt, Human
gaauuuaaggaccaagcauuuu

SEQ ID NO: 590633 - RNA, 22 nt, Human
gucuuuagagcuccuggcaucu

SEQ ID NO: 590634 - RNA, 22 nt, Human
acucagcucaggagcuggcugg

SEQ ID NO: 590635 - RNA, 22 nt, Human
agugauggagcuuccucugcua

SEQ ID NO: 590636 - RNA, 21 nt, Human
uaggccacauggguuggagau

SEQ ID NO: 590637 - RNA, 22 nt, Human
gggcccagcgugguuccaucug

SEQ ID NO: 590638 - RNA, 21 nt, Human
ucucccaaggagguccugagg

SEQ ID NO: 590639 - RNA, 22 nt, Human
aggcuccagccaaugggucugu

SEQ ID NO: 590640 - RNA, 22 nt, Human
gcaggagcccuggcauguucuu

SEQ ID NO: 590641 - RNA, 22 nt, Human
cuuggggaugcaaagccagugu

SEQ ID NO: 590642 - RNA, 22 nt, Human
uaagcauggugguaaaagaggu

SEQ ID NO: 590643 - RNA, 22 nt, Human
ugaggugccacccaagagccuu

SEQ ID NO: 590644 - RNA, 21 nt, Human
ucugggaaauugggaaagaag

SEQ ID NO: 590645 - RNA, 22 nt, Human
ggagcaucugaacagggagaag

SEQ ID NO: 590646 - RNA, 22 nt, Human
cuaggaggcgggggcugcagua

SEQ ID NO: 590647 - RNA, 22 nt, Human
augaaacaaggguauuuucucu

SEQ ID NO: 590648 - RNA, 22 nt, Human
auguuaaaugguuuauuauuaa

SEQ ID NO: 590649 - RNA, 22 nt, Human
ggagaaaauugaugaaguuggc

SEQ ID NO: 590650 - RNA, 22 nt, Human
gaguucuauuaugguuagaagu

SEQ ID NO: 590651 - RNA, 22 nt, Human
guaaagcucucauuuaauauca

SEQ ID NO: 590652 - RNA, 22 nt, Human
agaagcaguuauuuuuugcaca

SEQ ID NO: 590653 - RNA, 22 nt, Human
guuuccaggcuuugguaugguu

SEQ ID NO: 590654 - RNA, 22 nt, Human
uggaggcaugacagugucugga

SEQ ID NO: 590655 - RNA, 22 nt, Human
cuuggggaggacgcaguguccu

SEQ ID NO: 590656 - RNA, 22 nt, Human
gaacuuaguagucuacuucuua

SEQ ID NO: 590657 - RNA, 22 nt, Human
uaaggaaggggaaagacauguc

SEQ ID NO: 590658 - RNA, 22 nt, Human
uccuuauaacaacaggagugga

SEQ ID NO: 590659 - RNA, 22 nt, Human
gcgccuauuuucauuaucaagg

SEQ ID NO: 590660 - RNA, 22 nt, Human
cuccauggggaaaugaaggugg

SEQ ID NO: 590661 - RNA, 22 nt, Human
ugccaggcauauggccucuuug

SEQ ID NO: 590662 - RNA, 23 nt, Human
agggccacugggaaggauuacug

SEQ ID NO: 590663 - RNA, 20 nt, Human
gagauggacagaugaagggg

SEQ ID NO: 590664 - RNA, 22 nt, Human
uaaaauuugucccugaguguug

SEQ ID NO: 590665 - RNA, 22 nt, Human
uauuucaugugcaccauaauuc

SEQ ID NO: 590666 - RNA, 22 nt, Human
auuuccaaucucugcauauggg

SEQ ID NO: 590667 - RNA, 22 nt, Human
gagagccaugguggagaugggg

SEQ ID NO: 590668 - RNA, 22 nt, Human
agacuaaaagaaggaagcuacc

SEQ ID NO: 590669 - RNA, 22 nt, Human
acuuccuuuucaaccauacagc

SEQ ID NO: 590670 - RNA, 22 nt, Human
acaaugucaaaauaggaaacau

SEQ ID NO: 590671 - RNA, 22 nt, Human
cagguccugcagggagaguaaa

SEQ ID NO: 590672 - RNA, 23 nt, Human
ucuguacacaucagcaucuccca

SEQ ID NO: 590673 - RNA, 22 nt, Human
gagcuuccauggacgccaucug

SEQ ID NO: 590674 - RNA, 22 nt, Human
aaaguuacccaaucucuaugaa

SEQ ID NO: 590675 - RNA, 22 nt, Human
ccuuagcauuagaagcuguggg

SEQ ID NO: 590676 - RNA, 22 nt, Human
gagauaaagcuaccauguugau

SEQ ID NO: 590677 - RNA, 22 nt, Human
uucuauguggauauagaacugc

SEQ ID NO: 590678 - RNA, 22 nt, Human
cugguugggagguuggcuuuca

SEQ ID NO: 590679 - RNA, 21 nt, Human
cccguggagaaaaggaaugag

SEQ ID NO: 590680 - RNA, 22 nt, Human
acugcuuacaaaaggaaagaau

SEQ ID NO: 590681 - RNA, 22 nt, Human
gaggaggggacaguacuugugc

SEQ ID NO: 590682 - RNA, 20 nt, Human
cagcagccauucuaguagua

SEQ ID NO: 590683 - RNA, 22 nt, Human
ucucugggccucccuuuccaag

SEQ ID NO: 590684 - RNA, 22 nt, Human
cauuccuuaacguggggagucu

SEQ ID NO: 590685 - RNA, 22 nt, Human
ucaguguucuggauuuggggca

SEQ ID NO: 590686 - RNA, 20 nt, Human
ugugucuuccuuucuuuaug

SEQ ID NO: 590687 - RNA, 22 nt, Human
gaggaggggcacuugucuccua

SEQ ID NO: 590688 - RNA, 22 nt, Human
uaguuucuucaccuguaaaaug

SEQ ID NO: 590689 - RNA, 19 nt, Human
ggccagcacagggcucugu

SEQ ID NO: 590690 - RNA, 22 nt, Human
aacaguuuaugagauaugcuau

SEQ ID NO: 590691 - RNA, 22 nt, Human
cuguccugaaagggagauuggg

SEQ ID NO: 590692 - RNA, 22 nt, Human
ugucaucauuugagagaagaaa

SEQ ID NO: 590693 - RNA, 22 nt, Human
acagcagagacacucaggaggc

SEQ ID NO: 590694 - RNA, 22 nt, Human
acaaugaacgcuuuuuaacugu

SEQ ID NO: 590695 - RNA, 18 nt, Human
gaguguggcacugggccc

SEQ ID NO: 590696 - RNA, 22 nt, Human
uggaagaggccagaaaguggga

SEQ ID NO: 590697 - RNA, 22 nt, Human
ucguggagaggccauguggagg

SEQ ID NO: 590698 - RNA, 22 nt, Human
gaccuugugauccagccaccuu

SEQ ID NO: 590699 - RNA, 22 nt, Human
agaauauaguuaccaaauucug

SEQ ID NO: 590700 - RNA, 22 nt, Human
gcagggaagacccggagcagcg

SEQ ID NO: 590701 - RNA, 20 nt, Human
uugagcaaucaguaaaggau

SEQ ID NO: 590702 - RNA, 22 nt, Human
ccugagcaucagcgccuccuua

SEQ ID NO: 590703 - RNA, 20 nt, Human
uuuuccuucugaguauguug

SEQ ID NO: 590704 - RNA, 22 nt, Human
aggcccugcuuuccagagcuca

SEQ ID NO: 590705 - RNA, 22 nt, Human
agggcuuguggucguggcugug

SEQ ID NO: 590706 - RNA, 23 nt, Human
cagggcugggcuugguguuaggc

SEQ ID NO: 590707 - RNA, 22 nt, Human
guguuuguuuagugcagagaga

SEQ ID NO: 590708 - RNA, 22 nt, Human
agcugcagagaaaagaggcugg

SEQ ID NO: 590709 - RNA, 22 nt, Human
agccagggggacgcuuucuggc

SEQ ID NO: 590710 - RNA, 22 nt, Human
gccuuucacagagauuuaaaaa

SEQ ID NO: 590711 - RNA, 22 nt, Human
ucuguucuuaaagcauucuugc

SEQ ID NO: 590712 - RNA, 19 nt, Human
gggcuggagggauagagcc

SEQ ID NO: 590713 - RNA, 22 nt, Human
acugcuagugagaaaauaacca

SEQ ID NO: 590714 - RNA, 22 nt, Human
ccuuucuaagauacugcaacuu

SEQ ID NO: 590715 - RNA, 22 nt, Human
acaaauuucauaggcaaauuuu

SEQ ID NO: 590716 - RNA, 19 nt, Human
acauauguggauauacaug

SEQ ID NO: 590717 - RNA, 23 nt, Human
ucaauaacucggguuaaaauaga

SEQ ID NO: 590718 - RNA, 22 nt, Human
guccaagagucaagaagggggc

SEQ ID NO: 590719 - RNA, 22 nt, Human
gaacacagcagggauaaccacu

SEQ ID NO: 590720 - RNA, 22 nt, Human
ucuggggagggagccacagguc

SEQ ID NO: 590721 - RNA, 22 nt, Human
ugagaugggucaucagguuugg

SEQ ID NO: 590722 - RNA, 22 nt, Human
uuucucugggcacucuccaaac

SEQ ID NO: 590723 - RNA, 22 nt, Human
acauauuggcaaacuggaggca

SEQ ID NO: 590724 - RNA, 22 nt, Human
acagccagggacauacaauggu

SEQ ID NO: 590725 - RNA, 22 nt, Human
caggaaugauauucgaggagau

SEQ ID NO: 590726 - RNA, 22 nt, Human
caugcauuuucuauucacucag

SEQ ID NO: 590727 - RNA, 22 nt, Human
caauguaucaagaagcaucagu

SEQ ID NO: 590728 - RNA, 22 nt, Human
ucuggaaguuagaggaggaaag

SEQ ID NO: 590729 - RNA, 22 nt, Human
auuaggcauauaugcuuuuaau

SEQ ID NO: 590730 - RNA, 16 nt, Human
agaggccacagacaga

SEQ ID NO: 590731 - RNA, 22 nt, Human
uaacuuguguuacauuacucuu

SEQ ID NO: 590732 - RNA, 23 nt, Human
uagacacuccuuugucuguccuu

SEQ ID NO: 590733 - RNA, 22 nt, Human
ccuggaguaccguggccaucca

SEQ ID NO: 590734 - RNA, 22 nt, Human
ucugccuggagaguucuucucu

SEQ ID NO: 590735 - RNA, 22 nt, Human
agggcuggcaagggauugaaau

SEQ ID NO: 590736 - RNA, 22 nt, Human
auucuugggaugggugucacaa

SEQ ID NO: 590737 - RNA, 22 nt, Human
ccacagaguugaugcaauaaga

SEQ ID NO: 590738 - RNA, 22 nt, Human
ucugcaagauggucuuagaggu

SEQ ID NO: 590739 - RNA, 22 nt, Human
ggaaggaggggcaaagcaguuc

SEQ ID NO: 590740 - RNA, 22 nt, Human
uuuugugagcccauaaaugcca

SEQ ID NO: 590741 - RNA, 22 nt, Human
cugaggcuaaccucgagagaca

SEQ ID NO: 590742 - RNA, 22 nt, Human
acaucugacaugaucuucagua

SEQ ID NO: 590743 - RNA, 22 nt, Human
uguggaaaguggucuaagcaca

SEQ ID NO: 590744 - RNA, 22 nt, Human
uacacuauuuuacugauacaaa

SEQ ID NO: 590745 - RNA, 22 nt, Human
gacagcugugcaggagaagggg

SEQ ID NO: 590746 - RNA, 22 nt, Human
ucugcuuucuugcgcagaugug

SEQ ID NO: 590747 - RNA, 22 nt, Human
cuuccuguugucacagucugcg

SEQ ID NO: 590748 - RNA, 22 nt, Human
ugucaaaaccagcaauuuuguu

SEQ ID NO: 590749 - RNA, 22 nt, Human
aagaggcuuauagucuuccugu

SEQ ID NO: 590750 - RNA, 22 nt, Human
uaugagaauaaucugguaaaua

SEQ ID NO: 590751 - RNA, 22 nt, Human
ugggcacuauggcucugugcac

SEQ ID NO: 590752 - RNA, 22 nt, Human
uggagcaggcaucuuucucucu

SEQ ID NO: 590753 - RNA, 22 nt, Human
aguccucuggaguaugccuuau

SEQ ID NO: 590754 - RNA, 22 nt, Human
gagggugggcuccuaucugggu

SEQ ID NO: 590755 - RNA, 22 nt, Human
aauuccaaauguuuucaaucca

SEQ ID NO: 590756 - RNA, 22 nt, Human
gcagggcacacaagaaugauaa

SEQ ID NO: 590757 - RNA, 22 nt, Human
uauuacaagaaagggcaugaau

SEQ ID NO: 590758 - RNA, 22 nt, Human
agaccugggugcccugugcuuu

SEQ ID NO: 590759 - RNA, 22 nt, Human
ggagcuguagaucagcuaaucu

SEQ ID NO: 590760 - RNA, 19 nt, Human
ccaggccaucccaguuccc

SEQ ID NO: 590761 - RNA, 22 nt, Human
uggugcaggaguuggcagggac

SEQ ID NO: 590762 - RNA, 22 nt, Human
agguggagacccagagaaggcg

SEQ ID NO: 590763 - RNA, 22 nt, Human
uuucacauuuguuuuaagaagu

SEQ ID NO: 590764 - RNA, 19 nt, Human
gcuggccacgccccaguug

SEQ ID NO: 590765 - RNA, 22 nt, Human
uaaagcagugguucucaaacuu

SEQ ID NO: 590766 - RNA, 20 nt, Human
cagucccaauccagggccag

SEQ ID NO: 590767 - RNA, 22 nt, Human
uaauuauacaaaaaggcaugca

SEQ ID NO: 590768 - RNA, 22 nt, Human
ucucugugaagcucccguuagg

SEQ ID NO: 590769 - RNA, 22 nt, Human
uuguaugaguaugguguauagg

SEQ ID NO: 590770 - RNA, 22 nt, Human
ccacugucuuuuccaggcugaa

SEQ ID NO: 590771 - RNA, 23 nt, Human
uuuagcuuauaaaugcuuuugaa

SEQ ID NO: 590772 - RNA, 22 nt, Human
acacagaugcauuacacaucua

SEQ ID NO: 590773 - RNA, 20 nt, Human
cagcccuuuauccuccuaug

SEQ ID NO: 590774 - RNA, 22 nt, Human
ucucagcugacugcuuuccucg

SEQ ID NO: 590775 - RNA, 22 nt, Human
ggaggggaugguuugacccugg

SEQ ID NO: 590776 - RNA, 22 nt, Human
uggggcaguuaauaaacauucu

SEQ ID NO: 590777 - RNA, 22 nt, Human
ugaggccaagaaaagcugggug

SEQ ID NO: 590778 - RNA, 22 nt, Human
ucuaguuuugguaugagaugca

SEQ ID NO: 590779 - RNA, 22 nt, Human
uuccuucuuuuacaccauaaau

SEQ ID NO: 590780 - RNA, 22 nt, Human
caggugaaucacuugaguccag

SEQ ID NO: 590781 - RNA, 22 nt, Human
cuagagaacaacauucauaugg

SEQ ID NO: 590782 - RNA, 22 nt, Human
ucagaagacuacuaggacacau

SEQ ID NO: 590783 - RNA, 22 nt, Human
uaagguuuggcugucucuuggu

SEQ ID NO: 590784 - RNA, 22 nt, Human
uagggagaggaagcaggccgcu

SEQ ID NO: 590785 - RNA, 18 nt, Human
ugcugggguagaauccac

SEQ ID NO: 590786 - RNA, 22 nt, Human
cugcauaugagaauaggagaaa

SEQ ID NO: 590787 - RNA, 22 nt, Human
gcuguggccuggcgcagagcug

SEQ ID NO: 590788 - RNA, 20 nt, Human
gcaaggcacagugaggaggg

SEQ ID NO: 590789 - RNA, 22 nt, Human
uuaaagcaaccaucaauuugga

SEQ ID NO: 590790 - RNA, 22 nt, Human
aucuacuccugaauauaucuag

SEQ ID NO: 590791 - RNA, 22 nt, Human
cuuaggaugaguuuuugcguuu

SEQ ID NO: 590792 - RNA, 22 nt, Human
agaagccauguuuaguaggaug

SEQ ID NO: 590793 - RNA, 22 nt, Human
uuuaagaaguuauguuauaaau

SEQ ID NO: 590794 - RNA, 22 nt, Human
cugguccauucucucccugaag

SEQ ID NO: 590795 - RNA, 22 nt, Human
caacauauaauauuugaguucu

SEQ ID NO: 590796 - RNA, 22 nt, Human
gaauauauuucucuuaccuuua

SEQ ID NO: 590797 - RNA, 23 nt, Human
cccuaacuaauucuagggccuaa

SEQ ID NO: 590798 - RNA, 22 nt, Human
gguuggugagugcaggguguua

SEQ ID NO: 590799 - RNA, 22 nt, Human
cuuagcuucacugggucucagu

SEQ ID NO: 590800 - RNA, 22 nt, Human
ugagcuugcuacauagaucaga

SEQ ID NO: 590801 - RNA, 22 nt, Human
acaaugaauuuaauaccuuauu

SEQ ID NO: 590802 - RNA, 22 nt, Human
gcaugugggaacacuuaggcac

SEQ ID NO: 590803 - RNA, 17 nt, Human
ccucacagggaccagac

SEQ ID NO: 590804 - RNA, 22 nt, Human
agcaaauucagaagcagaaugg

SEQ ID NO: 590805 - RNA, 22 nt, Human
acugguggcuuucagacagaaa

SEQ ID NO: 590806 - RNA, 21 nt, Human
agaauucuuaaguauucuaau

SEQ ID NO: 590807 - RNA, 22 nt, Human
guugggaagcagauggaugagc

SEQ ID NO: 590808 - RNA, 22 nt, Human
gagucuccuacuggcuguccuu

SEQ ID NO: 590809 - RNA, 22 nt, Human
uccugccagcccacagacucau

SEQ ID NO: 590810 - RNA, 22 nt, Human
uggggagguucgggaaucuugu

SEQ ID NO: 590811 - RNA, 22 nt, Human
aacaaagaagacugguuauuuu

SEQ ID NO: 590812 - RNA, 22 nt, Human
aauguuacacagguauaaucag

SEQ ID NO: 590813 - RNA, 22 nt, Human
ccagcucucuuugaagcauaaa

SEQ ID NO: 590814 - RNA, 21 nt, Human
agaaaaacacgauauaagccc

SEQ ID NO: 590815 - RNA, 23 nt, Human
gaggagggucgugcuguguuccu

SEQ ID NO: 590816 - RNA, 22 nt, Human
agccuggccacucagggccuga

SEQ ID NO: 590817 - RNA, 22 nt, Human
gccugguggacacugggcauca

SEQ ID NO: 590818 - RNA, 22 nt, Human
auggggagcucaccaccuguuu

SEQ ID NO: 590819 - RNA, 22 nt, Human
acccaggcuagggugcaguggc

SEQ ID NO: 590820 - RNA, 20 nt, Human
gcugcucgcugcagucacuc

SEQ ID NO: 590821 - RNA, 22 nt, Human
uccugaagcucucuuaaggaaa

SEQ ID NO: 590822 - RNA, 22 nt, Human
cuggacagcccucacugugugc

SEQ ID NO: 590823 - RNA, 22 nt, Human
ucggccacgggguuuccuccaa

SEQ ID NO: 590824 - RNA, 22 nt, Human
aaaauacuacugucuucuuccc

SEQ ID NO: 590825 - RNA, 18 nt, Human
cagagcagagguggagcg

SEQ ID NO: 590826 - RNA, 23 nt, Human
uggccuggagagaaaagaugagu

SEQ ID NO: 590827 - RNA, 22 nt, Human
ucucugaaggcuguguugaugg

SEQ ID NO: 590828 - RNA, 22 nt, Human
uucagggacuuagugucaguuu

SEQ ID NO: 590829 - RNA, 22 nt, Human
uagggcagauucgguggaguuu

SEQ ID NO: 590830 - RNA, 22 nt, Human
acaguggaugugauguccaggu

SEQ ID NO: 590831 - RNA, 22 nt, Human
ugcacagcuggcucuccuuuuc

SEQ ID NO: 590832 - RNA, 22 nt, Human
aggcagguuggugagaagacug

SEQ ID NO: 590833 - RNA, 22 nt, Human
cauuucauuccuuugaaagugg

SEQ ID NO: 590834 - RNA, 22 nt, Human
uucugcucaguaguaagagugc

SEQ ID NO: 590835 - RNA, 22 nt, Human
guggcagguuccguagacagca

SEQ ID NO: 590836 - RNA, 22 nt, Human
gaaacauucagucaacaguguu

SEQ ID NO: 590837 - RNA, 22 nt, Human
acucuccuuuugaucuucagaa

SEQ ID NO: 590838 - RNA, 22 nt, Human
acaggccauaaaggcaggcccu

SEQ ID NO: 590839 - RNA, 22 nt, Human
ugugaaacggagucagggaagg

SEQ ID NO: 590840 - RNA, 22 nt, Human
cauguuauuuauccauuaaaca

SEQ ID NO: 590841 - RNA, 22 nt, Human
uuauuaaaaugcggauuuggcu

SEQ ID NO: 590842 - RNA, 22 nt, Human
cuggcuuccaccauggccccug

SEQ ID NO: 590843 - RNA, 22 nt, Human
ucagaggacuaccuucuccagu

SEQ ID NO: 590844 - RNA, 22 nt, Human
cugggcugcuugcugaaggggu

SEQ ID NO: 590845 - RNA, 22 nt, Human
uguuagaagacucuuuuaccua

SEQ ID NO: 590846 - RNA, 22 nt, Human
gcccuccaugagacacagugua

SEQ ID NO: 590847 - RNA, 22 nt, Human
agcucccagaaggcccugcgcc

SEQ ID NO: 590848 - RNA, 22 nt, Human
uccccugcagcgccugcuucua

SEQ ID NO: 590849 - RNA, 22 nt, Human
aggcugaggugugcugugaucg

SEQ ID NO: 590850 - RNA, 22 nt, Human
gaaagccaucuggcugcuggga

SEQ ID NO: 590851 - RNA, 22 nt, Human
caauaauuuacauuggauacca

SEQ ID NO: 590852 - RNA, 22 nt, Human
guagcauucugaguucgcagag

SEQ ID NO: 590853 - RNA, 22 nt, Human
ggcucuggagcacagacgucug

SEQ ID NO: 590854 - RNA, 22 nt, Human
cuguacagaguucugaguguac

SEQ ID NO: 590855 - RNA, 22 nt, Human
caucauuaccaucauuaguagu

SEQ ID NO: 590856 - RNA, 22 nt, Human
caaagaauagugagaagaugua

SEQ ID NO: 590857 - RNA, 22 nt, Human
augggcaggcaagguggcgagu

SEQ ID NO: 590858 - RNA, 22 nt, Human
cauuacaaacauguuaagauuu

SEQ ID NO: 590859 - RNA, 20 nt, Human
ucagugcucaggcaccaggu

SEQ ID NO: 590860 - RNA, 22 nt, Human
ugcuuucugcucuuguccacac

SEQ ID NO: 590861 - RNA, 22 nt, Human
uugcuuuagguauagaauccau

SEQ ID NO: 590862 - RNA, 22 nt, Human
ccuaguuuucauucagcagccu

SEQ ID NO: 590863 - RNA, 22 nt, Human
ugagaagcagcuuacagguguc

SEQ ID NO: 590864 - RNA, 22 nt, Human
agucaggacacagcaugaacau

SEQ ID NO: 590865 - RNA, 22 nt, Human
gggaugguggcuugcaucugua

SEQ ID NO: 590866 - RNA, 22 nt, Human
acccugauauagguccaagagc

SEQ ID NO: 590867 - RNA, 22 nt, Human
ccaggaggcucuugucccuggu

SEQ ID NO: 590868 - RNA, 22 nt, Human
ugcuggagcaucugagagcauc

SEQ ID NO: 590869 - RNA, 22 nt, Human
aggugucuggauggguguccuu

SEQ ID NO: 590870 - RNA, 22 nt, Human
cacaauuuguuuuaucaguauu

SEQ ID NO: 590871 - RNA, 22 nt, Human
ugugaagcuggauccuggagcu

SEQ ID NO: 590872 - RNA, 22 nt, Human
gggccaguagcaccugugugga

SEQ ID NO: 590873 - RNA, 22 nt, Human
aacauauaaacucuuaaguuca

SEQ ID NO: 590874 - RNA, 22 nt, Human
ugaaugaugguguguucuugcc

SEQ ID NO: 590875 - RNA, 20 nt, Human
uuuuuccuucucuacaggca

SEQ ID NO: 590876 - RNA, 22 nt, Human
ugucuucaguaaaauacacuau

SEQ ID NO: 590877 - RNA, 22 nt, Human
ucauuuucaaguuugaacagga

SEQ ID NO: 590878 - RNA, 22 nt, Human
cuugcugucccuugguaugaac

SEQ ID NO: 590879 - RNA, 22 nt, Human
agcuccaggugcaagucauggu

SEQ ID NO: 590880 - RNA, 22 nt, Human
guuuauuauucaacuucauguu

SEQ ID NO: 590881 - RNA, 22 nt, Human
caggcccuggcagggcugaguc

SEQ ID NO: 590882 - RNA, 22 nt, Human
uggaggcaggagacagggcaaa

SEQ ID NO: 590883 - RNA, 19 nt, Human
cuucugcagggugacagug

SEQ ID NO: 590884 - RNA, 22 nt, Human
ugucuuaauuuggaugauguuu

SEQ ID NO: 590885 - RNA, 22 nt, Human
agccuggcccugcugaacucug

SEQ ID NO: 590886 - RNA, 22 nt, Human
ugcugggcuaggguggagcucu

SEQ ID NO: 590887 - RNA, 22 nt, Human
gaggcacaccagggagucuugu

SEQ ID NO: 590888 - RNA, 22 nt, Human
ggugggcaggcgaggcccaggu

SEQ ID NO: 590889 - RNA, 22 nt, Human
uccuucagaggacggcagccag

SEQ ID NO: 590890 - RNA, 22 nt, Human
ucucugugugccuucaucugcc

SEQ ID NO: 590891 - RNA, 22 nt, Human
gauuucuuuagguguaauagug

SEQ ID NO: 590892 - RNA, 22 nt, Human
caggaaggcccaccuguccugu

SEQ ID NO: 590893 - RNA, 22 nt, Human
cugagccaaccacagcaggagc

SEQ ID NO: 590894 - RNA, 22 nt, Human
caaguuuuagcaaguggaaagg

SEQ ID NO: 590895 - RNA, 22 nt, Human
uguggugguaaugagccagaug

SEQ ID NO: 590896 - RNA, 22 nt, Human
gaauuuaaauuuaaaucuacca

SEQ ID NO: 590897 - RNA, 22 nt, Human
cuucccugguguuagcccaaug

SEQ ID NO: 590898 - RNA, 22 nt, Human
gcgagggcacgcgguugaaggc

SEQ ID NO: 590899 - RNA, 22 nt, Human
caugcaggccuauggagcagug

SEQ ID NO: 590900 - RNA, 22 nt, Human
gggacaugaagcaucggaggca

SEQ ID NO: 590901 - RNA, 22 nt, Human
cuaagaaauguugugaaugcca

SEQ ID NO: 590902 - RNA, 22 nt, Human
aggacacagguaagccagugga

SEQ ID NO: 590903 - RNA, 22 nt, Human
uagucacaggaaguuucaaugu

SEQ ID NO: 590904 - RNA, 22 nt, Human
gcagagcugcagcgaggccugg

SEQ ID NO: 590905 - RNA, 22 nt, Human
uuuuaugcaaguuaugauuaaa

SEQ ID NO: 590906 - RNA, 22 nt, Human
ugaagaaaggugugggauacuc

SEQ ID NO: 590907 - RNA, 22 nt, Human
ccagcugugccuaggagcaggg

SEQ ID NO: 590908 - RNA, 22 nt, Human
aguuucuguuaccauauuugac

SEQ ID NO: 590909 - RNA, 22 nt, Human
auuauuaggugcucucugacaa

SEQ ID NO: 590910 - RNA, 22 nt, Human
auagugucagaaaaucauaaga

SEQ ID NO: 590911 - RNA, 22 nt, Human
cucaguuucugacauuaaaauc

SEQ ID NO: 590912 - RNA, 22 nt, Human
ugaccuauuagauuuccuugcc

SEQ ID NO: 590913 - RNA, 22 nt, Human
uagaagaacaugucaaacuaua

SEQ ID NO: 590914 - RNA, 23 nt, Human
cccugcccauugagcaggacguc

SEQ ID NO: 590915 - RNA, 22 nt, Human
ugucuucuaccuugacagcauu

SEQ ID NO: 590916 - RNA, 22 nt, Human
cagucccaaggaggaagcaguc

SEQ ID NO: 590917 - RNA, 22 nt, Human
acagcagcugccuucaggcucu

SEQ ID NO: 590918 - RNA, 22 nt, Human
ccuggcugugugaccuuggcaa

SEQ ID NO: 590919 - RNA, 22 nt, Human
uagaacuaaagaacaacuuuga

SEQ ID NO: 590920 - RNA, 22 nt, Human
uguuuucuauuaccugagauug

SEQ ID NO: 590921 - RNA, 22 nt, Human
gguguccaucaggcugugcuuc

SEQ ID NO: 590922 - RNA, 22 nt, Human
uauugacaauaggcaacugagg

SEQ ID NO: 590923 - RNA, 22 nt, Human
uccagccacucagcagggauug

SEQ ID NO: 590924 - RNA, 21 nt, Human
gucuuuuaagugaagagaggc

SEQ ID NO: 590925 - RNA, 22 nt, Human
agccauuuuccugaaauauaac

SEQ ID NO: 590926 - RNA, 22 nt, Human
auuccaaacuuaccccagagga

SEQ ID NO: 590927 - RNA, 22 nt, Human
gcaacaggcaguuugcucaugu

SEQ ID NO: 590928 - RNA, 22 nt, Human
gugcugagcacaaggcccagag

SEQ ID NO: 590929 - RNA, 22 nt, Human
ggcagagugcucugggcagggg

SEQ ID NO: 590930 - RNA, 22 nt, Human
gcagcagugcgggcagcuacag

SEQ ID NO: 590931 - RNA, 22 nt, Human
ugcugaaagaccguauuuaucu

SEQ ID NO: 590932 - RNA, 22 nt, Human
acagagacaggcagacagucuu

SEQ ID NO: 590933 - RNA, 20 nt, Human
agucuggcaccuauuccugu

SEQ ID NO: 590934 - RNA, 22 nt, Human
agaagccucauccucucuagug

SEQ ID NO: 590935 - RNA, 21 nt, Human
ugggagagggcucagcuaccc

SEQ ID NO: 590936 - RNA, 22 nt, Human
gcuguacaaauuccacaagaga

SEQ ID NO: 590937 - RNA, 22 nt, Human
gcccagcugcacccuggugggu

SEQ ID NO: 590938 - RNA, 19 nt, Human
cagaggcacuuucucuuag

SEQ ID NO: 590939 - RNA, 22 nt, Human
ugcauauugugaaaauguagau

SEQ ID NO: 590940 - RNA, 22 nt, Human
cagcuauugauaaauguugggg

SEQ ID NO: 590941 - RNA, 22 nt, Human
gaccucagcuguggggaugcug

SEQ ID NO: 590942 - RNA, 22 nt, Human
uuccuugaaugagucauggaaa

SEQ ID NO: 590943 - RNA, 21 nt, Human
uaggggcuggggcuccagcug

SEQ ID NO: 590944 - RNA, 20 nt, Human
aaggcagaguggguuggagc

SEQ ID NO: 590945 - RNA, 22 nt, Human
ucugggugacccugggcaaggc

SEQ ID NO: 590946 - RNA, 22 nt, Human
ccugggcauaaaucacuccaag

SEQ ID NO: 590947 - RNA, 22 nt, Human
uggcucaguggcagccgcagcu

SEQ ID NO: 590948 - RNA, 18 nt, Human
uauauuucacacauauuc

SEQ ID NO: 590949 - RNA, 21 nt, Human
ccagcccagccuccuucucuu

SEQ ID NO: 590950 - RNA, 22 nt, Human
cagagcugugauaaauagauau

SEQ ID NO: 590951 - RNA, 22 nt, Human
ucauuucuaucuaugcagcuuc

SEQ ID NO: 590952 - RNA, 22 nt, Human
cugccugcucaccagggcucug

SEQ ID NO: 590953 - RNA, 22 nt, Human
uucuccugcccuuggacuucca

SEQ ID NO: 590954 - RNA, 22 nt, Human
ccacugcuagagaugcaucccc

SEQ ID NO: 590955 - RNA, 22 nt, Human
gaggcaguaauugugggcaaua

SEQ ID NO: 590956 - RNA, 22 nt, Human
ugcuucugaaaugcaggucuuc

SEQ ID NO: 590957 - RNA, 22 nt, Human
ugcuggaguucgacauugcaaa

SEQ ID NO: 590958 - RNA, 22 nt, Human
ccaggguugcagggagccagca

SEQ ID NO: 590959 - RNA, 22 nt, Human
aagaguauagcuuuaggauuga

SEQ ID NO: 590960 - RNA, 22 nt, Human
ccaggggaaacagggagcacuc

SEQ ID NO: 590961 - RNA, 22 nt, Human
gggauccauccgugcagcagag

SEQ ID NO: 590962 - RNA, 22 nt, Human
gucuucaggacccggaauuuug

SEQ ID NO: 590963 - RNA, 21 nt, Human
agguggucugcagcagcugaa

SEQ ID NO: 590964 - RNA, 22 nt, Human
uucccagauuggagggcagggg

SEQ ID NO: 590965 - RNA, 22 nt, Human
guguauaacuaucuaucuagua

SEQ ID NO: 590966 - RNA, 22 nt, Human
cugcauccuaaccuccaugcag

SEQ ID NO: 590967 - RNA, 22 nt, Human
agaaggcacucacacuggcacg

SEQ ID NO: 590968 - RNA, 22 nt, Human
ggagggggaaacuuuggcugcc

SEQ ID NO: 590969 - RNA, 22 nt, Human
aaaguuuacagugcacaugggu

SEQ ID NO: 590970 - RNA, 22 nt, Human
guuccacaaaauguacccaguu

SEQ ID NO: 590971 - RNA, 22 nt, Human
gcugugagggucuagugaggug

SEQ ID NO: 590972 - RNA, 22 nt, Human
aguuucauguagccauauuuac

SEQ ID NO: 590973 - RNA, 22 nt, Human
gaggcugaguagcuuugugcuc

SEQ ID NO: 590974 - RNA, 22 nt, Human
agugggcaugaucuggugucug

SEQ ID NO: 590975 - RNA, 22 nt, Human
ugcuuuaagacacuaaguuuga

SEQ ID NO: 590976 - RNA, 22 nt, Human
uuuacugagugaccuagaauaa

SEQ ID NO: 590977 - RNA, 22 nt, Human
ucaggagagagaaauuggggcu

SEQ ID NO: 590978 - RNA, 22 nt, Human
gcuucagaaguugggcucugac

SEQ ID NO: 590979 - RNA, 22 nt, Human
caggucuguauuaacagagggu

SEQ ID NO: 590980 - RNA, 22 nt, Human
uacauugugauguuucaauaca

SEQ ID NO: 590981 - RNA, 20 nt, Human
agcaagaguguaccuggcca

SEQ ID NO: 590982 - RNA, 22 nt, Human
ucugggagagucacaggcauug

SEQ ID NO: 590983 - RNA, 22 nt, Human
gaaauucaggacaaagacucuu

SEQ ID NO: 590984 - RNA, 22 nt, Human
guggccaggccgacugccaggc

SEQ ID NO: 590985 - RNA, 22 nt, Human
agccacagucuguagccagcuu

SEQ ID NO: 590986 - RNA, 22 nt, Human
gcagcuuuuuggaugucaguua

SEQ ID NO: 590987 - RNA, 22 nt, Human
aaggcacugacugugcagggga

SEQ ID NO: 590988 - RNA, 22 nt, Human
ucccagggacccagccugauac

SEQ ID NO: 590989 - RNA, 17 nt, Human
gcuggcugacccaugcc

SEQ ID NO: 590990 - RNA, 22 nt, Human
uuggcugguaagccaaaugaaa

SEQ ID NO: 590991 - RNA, 22 nt, Human
gcucucuugacagcuugcuguu

SEQ ID NO: 590992 - RNA, 22 nt, Human
aguggcagacacaaugugggca

SEQ ID NO: 590993 - RNA, 22 nt, Human
uggagcaggaagucuauggcug

SEQ ID NO: 590994 - RNA, 22 nt, Human
aagcaaagagauaaccuuuugg

SEQ ID NO: 590995 - RNA, 22 nt, Human
cuuuacaccaagcagaucuuuc

SEQ ID NO: 590996 - RNA, 17 nt, Human
uccagcuccucauuguu

SEQ ID NO: 590997 - RNA, 22 nt, Human
uugggguaaggaaauauggcuu

SEQ ID NO: 590998 - RNA, 22 nt, Human
uugcccugccucccugagguga

SEQ ID NO: 590999 - RNA, 22 nt, Human
gacagggacacagccagugagg

SEQ ID NO: 591000 - RNA, 22 nt, Human
ucuccaggcacuuggcugcuac

SEQ ID NO: 591001 - RNA, 19 nt, Human
uccagcagugcuugaaauc

SEQ ID NO: 591002 - RNA, 22 nt, Human
cuggcucaguucuugguuuuca

SEQ ID NO: 591003 - RNA, 22 nt, Human
ggaaagcucagaucuuguugga

SEQ ID NO: 591004 - RNA, 22 nt, Human
acaguucuaaaucuuggauaau

SEQ ID NO: 591005 - RNA, 22 nt, Human
gaggccugguuuccagcauccu

SEQ ID NO: 591006 - RNA, 22 nt, Human
acccugagggguauagcagaag

SEQ ID NO: 591007 - RNA, 22 nt, Human
uauuagcaguuguaugugucug

SEQ ID NO: 591008 - RNA, 22 nt, Human
gugaggagucugaagcacauaa

SEQ ID NO: 591009 - RNA, 22 nt, Human
ggaggaaauccuuaguaaggca

SEQ ID NO: 591010 - RNA, 22 nt, Human
agagaaaacucauugagguguc

SEQ ID NO: 591011 - RNA, 22 nt, Human
acaaaaagcuccauuacugucc

SEQ ID NO: 591012 - RNA, 22 nt, Human
ucuuugcacacagcgauucuuc

SEQ ID NO: 591013 - RNA, 22 nt, Human
uagugcuuaacacaaagugauu

SEQ ID NO: 591014 - RNA, 22 nt, Human
uuuauauagagauuugugcaug

SEQ ID NO: 591015 - RNA, 23 nt, Human
cagugggcuucuaacugcuccug

SEQ ID NO: 591016 - RNA, 22 nt, Human
gcuguggcugaagaugcaggga

SEQ ID NO: 591017 - RNA, 22 nt, Human
acagcucagacaucacugcucu

SEQ ID NO: 591018 - RNA, 22 nt, Human
gcccagggucuacaaaaauauu

SEQ ID NO: 591019 - RNA, 22 nt, Human
agacagacugguuugaauuggu

SEQ ID NO: 591020 - RNA, 22 nt, Human
guuuaugaaauuucaggcauuu

SEQ ID NO: 591021 - RNA, 22 nt, Human
ucugggaugaagccagaaacuu

SEQ ID NO: 591022 - RNA, 22 nt, Human
uagggcaauauuucccagaaaa

SEQ ID NO: 591023 - RNA, 22 nt, Human
ggagcugugcagugacuacaga

SEQ ID NO: 591024 - RNA, 22 nt, Human
ugagaguuuugacgcuuguaac

SEQ ID NO: 591025 - RNA, 22 nt, Human
ggucugagauauuuguucagcu

SEQ ID NO: 591026 - RNA, 22 nt, Human
cagugcauagauccugaggccu

SEQ ID NO: 591027 - RNA, 23 nt, Human
uucuccugaggaagcagggacug

SEQ ID NO: 591028 - RNA, 22 nt, Human
gcagcaggauggccaauugcca

SEQ ID NO: 591029 - RNA, 22 nt, Human
cucccuggaggcccagaccugg

SEQ ID NO: 591030 - RNA, 22 nt, Human
gcugccacgaucucugcuguag

SEQ ID NO: 591031 - RNA, 22 nt, Human
acuuuuuacaggguguauacca

SEQ ID NO: 591032 - RNA, 22 nt, Human
acugucgauuaugaugagucag

SEQ ID NO: 591033 - RNA, 19 nt, Human
ggccuggcuaucccugcug

SEQ ID NO: 591034 - RNA, 20 nt, Human
gccugcagagaaggucagag

SEQ ID NO: 591035 - RNA, 22 nt, Human
ccuccuggaggcucuagggaaa

SEQ ID NO: 591036 - RNA, 22 nt, Human
ucuauaaaugcagauaugugug

SEQ ID NO: 591037 - RNA, 22 nt, Human
ugcccuggcuccucccacgcug

SEQ ID NO: 591038 - RNA, 22 nt, Human
auuuacaguuuagcauuucaag

SEQ ID NO: 591039 - RNA, 22 nt, Human
agagaaaagaguucaggcuuug

SEQ ID NO: 591040 - RNA, 22 nt, Human
cacaguccuacagagaucagag

SEQ ID NO: 591041 - RNA, 22 nt, Human
ugucuacugcugacacuaacag

SEQ ID NO: 591042 - RNA, 22 nt, Human
ugagauggaaggugaggcagua

SEQ ID NO: 591043 - RNA, 22 nt, Human
gcccaagccggagcugggagag

SEQ ID NO: 591044 - RNA, 16 nt, Human
ucccugggaguggugg

SEQ ID NO: 591045 - RNA, 22 nt, Human
guacaguagagccagguucagu

SEQ ID NO: 591046 - RNA, 22 nt, Human
uugacaaaggaauugaaucucu

SEQ ID NO: 591047 - RNA, 22 nt, Human
uccugugguaugggagugaugu

SEQ ID NO: 591048 - RNA, 22 nt, Human
uuuuugucuauucacugauuca

SEQ ID NO: 591049 - RNA, 22 nt, Human
auaaucaaaguccuaugacauc

SEQ ID NO: 591050 - RNA, 23 nt, Human
gagauggcugguuguccucugaa

SEQ ID NO: 591051 - RNA, 22 nt, Human
gcagacaauuuauuagcagauu

SEQ ID NO: 591052 - RNA, 21 nt, Human
uucagaaguugagggcagguu

SEQ ID NO: 591053 - RNA, 22 nt, Human
aaugcaaugcagcaccuccuug

SEQ ID NO: 591054 - RNA, 22 nt, Human
agagacuuugucuauuuuguuc

SEQ ID NO: 591055 - RNA, 22 nt, Human
gaauaacugcuaucuuucuggc

SEQ ID NO: 591056 - RNA, 22 nt, Human
uucuaguucugaaagccugaca

SEQ ID NO: 591057 - RNA, 22 nt, Human
ucugggaacuauaucugguggu

SEQ ID NO: 591058 - RNA, 22 nt, Human
ccaguucugacacaagcacagu

SEQ ID NO: 591059 - RNA, 22 nt, Human
agaagccaauccuugucucucu

SEQ ID NO: 591060 - RNA, 22 nt, Human
uagcuuuguuagaaugucuuca

SEQ ID NO: 591061 - RNA, 22 nt, Human
cugaaacuauggggaggggagc

SEQ ID NO: 591062 - RNA, 22 nt, Human
acagcacuggucccgcaagccu

SEQ ID NO: 591063 - RNA, 22 nt, Human
ucaaaucuuuaacaugugcaaa

SEQ ID NO: 591064 - RNA, 22 nt, Human
ucuucaugaaugaaucuuugac

SEQ ID NO: 591065 - RNA, 22 nt, Human
uuuaccaaauagauuaugucag

SEQ ID NO: 591066 - RNA, 22 nt, Human
cuuccucugccucccgugcuca

SEQ ID NO: 591067 - RNA, 22 nt, Human
uaaguuuaccacuuucagaauu

SEQ ID NO: 591068 - RNA, 22 nt, Human
gagcaggcucugccuguguguc

SEQ ID NO: 591069 - RNA, 22 nt, Human
gagaaaauagcauguguaguau

SEQ ID NO: 591070 - RNA, 22 nt, Human
ccucuguggucugucuaaugca

SEQ ID NO: 591071 - RNA, 22 nt, Human
ucuccugcuucaacugauggac

SEQ ID NO: 591072 - RNA, 22 nt, Human
uucaagaagcccaaagacuagc

SEQ ID NO: 591073 - RNA, 22 nt, Human
ccuggccagccagggcuggggu

SEQ ID NO: 591074 - RNA, 22 nt, Human
agggaaaucuuucaacacuuca

SEQ ID NO: 591075 - RNA, 22 nt, Human
aaucaucuucaucuuacacaga

SEQ ID NO: 591076 - RNA, 22 nt, Human
uuucauugcagagucugugugc

SEQ ID NO: 591077 - RNA, 22 nt, Human
auuuguacaaauuuauguuagu

SEQ ID NO: 591078 - RNA, 22 nt, Human
uuacaauugagucuauuguaug

SEQ ID NO: 591079 - RNA, 23 nt, Human
ugcuggagacaagugugagaagg

SEQ ID NO: 591080 - RNA, 22 nt, Human
aaacauguaauucugcuuaaga

SEQ ID NO: 591081 - RNA, 22 nt, Human
aaggaagacuugagaagguucc

SEQ ID NO: 591082 - RNA, 22 nt, Human
aguucucuaugaagucuauugu

SEQ ID NO: 591083 - RNA, 22 nt, Human
ucuggcagcucaguucaggucu

SEQ ID NO: 591084 - RNA, 22 nt, Human
ucaguaauuaccuaugacucga

SEQ ID NO: 591085 - RNA, 22 nt, Human
uaucacuacacuucagcuuuaa

SEQ ID NO: 591086 - RNA, 21 nt, Human
uggccaaacuggagcauuuga

SEQ ID NO: 591087 - RNA, 22 nt, Human
ggagccugguauaguguugcau

SEQ ID NO: 591088 - RNA, 22 nt, Human
gaaggaaaacagaucugccuga

SEQ ID NO: 591089 - RNA, 19 nt, Human
ucuucugacuucaagaaac

SEQ ID NO: 591090 - RNA, 22 nt, Human
aaucuuacuuaugauuuuucgg

SEQ ID NO: 591091 - RNA, 22 nt, Human
uugugaaauguuucaaaauagu

SEQ ID NO: 591092 - RNA, 22 nt, Human
uuugacuucuaucuaguaagaa

SEQ ID NO: 591093 - RNA, 22 nt, Human
ccacagcugacaauggauagac

SEQ ID NO: 591094 - RNA, 22 nt, Human
guuacacucuccaggcacuugg

SEQ ID NO: 591095 - RNA, 23 nt, Human
uugcuucugugcaauucaguacu

SEQ ID NO: 591096 - RNA, 21 nt, Human
uucaggugagaucauguugac

SEQ ID NO: 591097 - RNA, 22 nt, Human
guauuuuacuuacgcaugacuu

SEQ ID NO: 591098 - RNA, 22 nt, Human
gagugcagaugccagccccagu

SEQ ID NO: 591099 - RNA, 22 nt, Human
gugucacaugguuuacugcagc

SEQ ID NO: 591100 - RNA, 22 nt, Human
cuuaggaaaguuggcugauuuc

SEQ ID NO: 591101 - RNA, 22 nt, Human
cuggaguucaguggcgugaaca

SEQ ID NO: 591102 - RNA, 22 nt, Human
gcugaggauauagcaggaacaa

SEQ ID NO: 591103 - RNA, 22 nt, Human
ugagcagagcaguaacaggagc

SEQ ID NO: 591104 - RNA, 20 nt, Human
auguuguuuacucauagcau

SEQ ID NO: 591105 - RNA, 18 nt, Human
cucugaaagacacaccag

SEQ ID NO: 591106 - RNA, 22 nt, Human
cacuuaaauguuccuacagcag

SEQ ID NO: 591107 - RNA, 22 nt, Human
cuccucccucuuugccacacau

SEQ ID NO: 591108 - RNA, 19 nt, Human
uugaggggccaggggagau

SEQ ID NO: 591109 - RNA, 22 nt, Human
uauuuauaaucugccaaagaga

SEQ ID NO: 591110 - RNA, 22 nt, Human
acacacugagugccauaggacc

SEQ ID NO: 591111 - RNA, 22 nt, Human
uggagguggugcccagcaauuu

SEQ ID NO: 591112 - RNA, 22 nt, Human
ccuccugggagagcacggaggg

SEQ ID NO: 591113 - RNA, 22 nt, Human
cuggagcucuguguguuccuga

SEQ ID NO: 591114 - RNA, 22 nt, Human
uucacuguacugacugucuuau

SEQ ID NO: 591115 - RNA, 22 nt, Human
gcaggggaguggcaggcccgga

SEQ ID NO: 591116 - RNA, 22 nt, Human
aaauagcuacaugaucucuagg

SEQ ID NO: 591117 - RNA, 22 nt, Human
cugggaagaauccaagggcccu

SEQ ID NO: 591118 - RNA, 22 nt, Human
gaguuacauggacauucucucc

SEQ ID NO: 591119 - RNA, 22 nt, Human
uccuugaagaaugauucuugga

SEQ ID NO: 591120 - RNA, 22 nt, Human
cugagcugugugguccugggca

SEQ ID NO: 591121 - RNA, 22 nt, Human
ugaaugugaugcuaaacauaug

SEQ ID NO: 591122 - RNA, 22 nt, Human
uacagauauagagauuuauaga

SEQ ID NO: 591123 - RNA, 22 nt, Human
gaaugcagauggcugguguaug

SEQ ID NO: 591124 - RNA, 22 nt, Human
aauguugaggauaucagaaaau

SEQ ID NO: 591125 - RNA, 22 nt, Human
gggaagcugcguggucuagggc

SEQ ID NO: 591126 - RNA, 22 nt, Human
gacuaacagucuccgcuugaaa

SEQ ID NO: 591127 - RNA, 17 nt, Human
ugaggcucggugaggag

SEQ ID NO: 591128 - RNA, 22 nt, Human
aggagacaucuaacuguagguu

SEQ ID NO: 591129 - RNA, 22 nt, Human
agcaaggcagucagcuggcugg

SEQ ID NO: 591130 - RNA, 22 nt, Human
auuuacagugugccuacuauau

SEQ ID NO: 591131 - RNA, 22 nt, Human
cccaaggaagacgcuugugaua

SEQ ID NO: 591132 - RNA, 22 nt, Human
accuuucacgguaucagacauc

SEQ ID NO: 591133 - RNA, 22 nt, Human
ugaaauaacuuuugggugaguu

SEQ ID NO: 591134 - RNA, 22 nt, Human
ccugcuuugcugguaccaucag

SEQ ID NO: 591135 - RNA, 22 nt, Human
cuauugaauagcccaaaucauu

SEQ ID NO: 591136 - RNA, 22 nt, Human
gucugaggguugugcuggagga

SEQ ID NO: 591137 - RNA, 22 nt, Human
cagucaaacuuauaggcacauu

SEQ ID NO: 591138 - RNA, 22 nt, Human
ucuugcuaggagcuauggaaga

SEQ ID NO: 591139 - RNA, 22 nt, Human
uuacagaaaagggguuguccuu

SEQ ID NO: 591140 - RNA, 22 nt, Human
cuggcucugucacccuuucucc

SEQ ID NO: 591141 - RNA, 22 nt, Human
cuccuggggcacuuagaagcaa

SEQ ID NO: 591142 - RNA, 22 nt, Human
uucugcauggagaaacugaguc

SEQ ID NO: 591143 - RNA, 22 nt, Human
auuucuugauuccaccagugaa

SEQ ID NO: 591144 - RNA, 22 nt, Human
gugcuuuccauccucccugcug

SEQ ID NO: 591145 - RNA, 22 nt, Human
aaaauucauggcuugggaaaag

SEQ ID NO: 591146 - RNA, 22 nt, Human
uucagcaccuggaauagcaccu

SEQ ID NO: 591147 - RNA, 22 nt, Human
agaauauucaucuguauucuua

SEQ ID NO: 591148 - RNA, 22 nt, Human
agcuguuuccauaaaugagaca

SEQ ID NO: 591149 - RNA, 22 nt, Human
agccaacuuagaagaaauuuga

SEQ ID NO: 591150 - RNA, 22 nt, Human
ugcacacaaaugugaacgugcc

SEQ ID NO: 591151 - RNA, 22 nt, Human
augggcugcuuggcuuccaccc

SEQ ID NO: 591152 - RNA, 22 nt, Human
uccuucuacacugccucugaga

SEQ ID NO: 591153 - RNA, 22 nt, Human
uuucaagucaguagcuaaucau

SEQ ID NO: 591154 - RNA, 22 nt, Human
cuggggaacgcagcgagcagcg

SEQ ID NO: 591155 - RNA, 22 nt, Human
aaggccaacuaggaugagcuag

SEQ ID NO: 591156 - RNA, 22 nt, Human
aggagugggggcgagaaguuaa

SEQ ID NO: 591157 - RNA, 22 nt, Human
uccaauaacaucuaaaaacuua

SEQ ID NO: 591158 - RNA, 22 nt, Human
agcugugugacucuaagcaagu

SEQ ID NO: 591159 - RNA, 22 nt, Human
uccaggacagcggcaggcagau

SEQ ID NO: 591160 - RNA, 22 nt, Human
uucagcuccuuucuuccaccag

SEQ ID NO: 591161 - RNA, 21 nt, Human
ugcugaaucugccauauuuuc

SEQ ID NO: 591162 - RNA, 20 nt, Human
cugcccugcccuggguccug

SEQ ID NO: 591163 - RNA, 22 nt, Human
ggcaggcugcuugggucauguc

SEQ ID NO: 591164 - RNA, 22 nt, Human
augaagauaauagcauugguug

SEQ ID NO: 591165 - RNA, 19 nt, Human
ucccagagucuagagguug

SEQ ID NO: 591166 - RNA, 22 nt, Human
uauccaugccuuugugccuuag

SEQ ID NO: 591167 - RNA, 22 nt, Human
cugaaccaucucuguucuguau

SEQ ID NO: 591168 - RNA, 22 nt, Human
cauaccuuucucaagcacaugu

SEQ ID NO: 591169 - RNA, 22 nt, Human
gcuuccucccugcugcucacua

SEQ ID NO: 591170 - RNA, 22 nt, Human
cacacugacuggaaucaaggau

SEQ ID NO: 591171 - RNA, 22 nt, Human
uucaucaauguguuuaauaaug

SEQ ID NO: 591172 - RNA, 22 nt, Human
agaagugguguguggccgagcu

SEQ ID NO: 591173 - RNA, 22 nt, Human
ccugggagccaagccucugugu

SEQ ID NO: 591174 - RNA, 22 nt, Human
agcaggagauggggcgugaugu

SEQ ID NO: 591175 - RNA, 22 nt, Human
cccuugaauuuucagagagggg

SEQ ID NO: 591176 - RNA, 22 nt, Human
uuguccugugauuucagggccu

SEQ ID NO: 591177 - RNA, 22 nt, Human
uuuaaaaucagaugggaguugg

SEQ ID NO: 591178 - RNA, 22 nt, Human
gacuuuaaaaugcuagaacagg

SEQ ID NO: 591179 - RNA, 22 nt, Human
ucagggagauuuggggacucaa

SEQ ID NO: 591180 - RNA, 18 nt, Human
aaaaugcaggcgacaugg

SEQ ID NO: 591181 - RNA, 17 nt, Human
ccucagcuucuuuccuc

SEQ ID NO: 591182 - RNA, 22 nt, Human
uacuuucuuucugauccuuaug

SEQ ID NO: 591183 - RNA, 22 nt, Human
gccuggaguagcauggcaagcc

SEQ ID NO: 591184 - RNA, 22 nt, Human
gaguagggaugcuggugacucc

SEQ ID NO: 591185 - RNA, 22 nt, Human
auaacgaaggcugaugcgggau

SEQ ID NO: 591186 - RNA, 22 nt, Human
guauuagaagaaauuauaggua

SEQ ID NO: 591187 - RNA, 22 nt, Human
gcagcagggagcagggguguca

SEQ ID NO: 591188 - RNA, 22 nt, Human
acugaggucuaucaugagccag

SEQ ID NO: 591189 - RNA, 22 nt, Human
aagauaauauucauuaacuaga

SEQ ID NO: 591190 - RNA, 22 nt, Human
acagccugacuuuuguugucac

SEQ ID NO: 591191 - RNA, 23 nt, Human
guuuuacaggugagaaaauggag

SEQ ID NO: 591192 - RNA, 22 nt, Human
uuucaaauagaaucuuuccaaa

SEQ ID NO: 591193 - RNA, 22 nt, Human
cucuggguucacugaggcucug

SEQ ID NO: 591194 - RNA, 22 nt, Human
gaggggccuggcacugagcugg

SEQ ID NO: 591195 - RNA, 22 nt, Human
uaaauagagaaucagcuuggag

SEQ ID NO: 591196 - RNA, 22 nt, Human
acaguguuguauuuaguuugau

SEQ ID NO: 591197 - RNA, 22 nt, Human
cauuucaaugccuucaacauag

SEQ ID NO: 591198 - RNA, 22 nt, Human
aaagcaagucucuacaaaguac

SEQ ID NO: 591199 - RNA, 22 nt, Human
cugugaauuuaaagcacacauc

SEQ ID NO: 591200 - RNA, 22 nt, Human
cccagcuccuuggaugggcagg

SEQ ID NO: 591201 - RNA, 22 nt, Human
cccagcaggugccaucacucug

SEQ ID NO: 591202 - RNA, 22 nt, Human
auuucucuuagcaagacauuac

SEQ ID NO: 591203 - RNA, 22 nt, Human
uucucuggagggcugcccggcc

SEQ ID NO: 591204 - RNA, 22 nt, Human
gaaacacauaugaacaguugau

SEQ ID NO: 591205 - RNA, 18 nt, Human
cagaagcaggcagugcag

SEQ ID NO: 591206 - RNA, 22 nt, Human
uggggccugcacaggcugaaug

SEQ ID NO: 591207 - RNA, 22 nt, Human
gcacugggugggagaucugaau

SEQ ID NO: 591208 - RNA, 22 nt, Human
ucuggggaugagugaugucgua

SEQ ID NO: 591209 - RNA, 22 nt, Human
uaguuuaauggucaacuaauga

SEQ ID NO: 591210 - RNA, 22 nt, Human
agugcaaagggaucagauuggg

SEQ ID NO: 591211 - RNA, 22 nt, Human
ucaggagacuuaugucacagug

SEQ ID NO: 591212 - RNA, 22 nt, Human
gcuggagccaagcugcucuugg

SEQ ID NO: 591213 - RNA, 22 nt, Human
agguauaagucucauuucuguu

SEQ ID NO: 591214 - RNA, 22 nt, Human
uccuggagggcucacaggcggc

SEQ ID NO: 591215 - RNA, 22 nt, Human
cccugucucauugaucacuugu

SEQ ID NO: 591216 - RNA, 22 nt, Human
aguugucaccucuauucaaauc

SEQ ID NO: 591217 - RNA, 22 nt, Human
uucagauuuuuuaauagguaau

SEQ ID NO: 591218 - RNA, 22 nt, Human
aggaaaaaagucugugauuaua

SEQ ID NO: 591219 - RNA, 22 nt, Human
cuggcuggguuccaggauucca

SEQ ID NO: 591220 - RNA, 22 nt, Human
caguuuuuagauuaguuggugg

SEQ ID NO: 591221 - RNA, 22 nt, Human
uaugucuuaauccuuccuuagg

SEQ ID NO: 591222 - RNA, 22 nt, Human
ugaaagcaugcuugccaagcuu

SEQ ID NO: 591223 - RNA, 22 nt, Human
ccugagccuggcucaugcacuc

SEQ ID NO: 591224 - RNA, 22 nt, Human
ucucagaaggcaagggcugggg

SEQ ID NO: 591225 - RNA, 22 nt, Human
gagcagugggaaggaacagggu

SEQ ID NO: 591226 - RNA, 22 nt, Human
uuuuccucugagcuuugaauaa

SEQ ID NO: 591227 - RNA, 22 nt, Human
acacagagcuucucaacuggga

SEQ ID NO: 591228 - RNA, 22 nt, Human
cauagagugauguaagguaugu

SEQ ID NO: 591229 - RNA, 22 nt, Human
ggcugcagauuguagucuguua

SEQ ID NO: 591230 - RNA, 22 nt, Human
agcaggcuuucaagagucuucu

SEQ ID NO: 591231 - RNA, 17 nt, Human
uuccuccucaccauguu

SEQ ID NO: 591232 - RNA, 22 nt, Human
guaaaauucuagcaucugaaag

SEQ ID NO: 591233 - RNA, 22 nt, Human
ugggggcugugcacaggcucac

SEQ ID NO: 591234 - RNA, 22 nt, Human
aaaugucuuugaguauuucugc

SEQ ID NO: 591235 - RNA, 22 nt, Human
aagcugagccaguggcaagugc

SEQ ID NO: 591236 - RNA, 22 nt, Human
gccuggagacaaggacaaaggg

SEQ ID NO: 591237 - RNA, 22 nt, Human
uggcugaguuacgaacagagca

SEQ ID NO: 591238 - RNA, 20 nt, Human
gugcaauggcgcaaucucgg

SEQ ID NO: 591239 - RNA, 22 nt, Human
cccauuuguccaaaguauaaaa

SEQ ID NO: 591240 - RNA, 20 nt, Human
ugacucugcaaccgucucuc

SEQ ID NO: 591241 - RNA, 22 nt, Human
auaaaucuauuggacaugugug

SEQ ID NO: 591242 - RNA, 22 nt, Human
ggcugcaggcuucccuccagca

SEQ ID NO: 591243 - RNA, 22 nt, Human
cugagggagggacuuugagacu

SEQ ID NO: 591244 - RNA, 22 nt, Human
accuuaaaggccgaaguaaaga

SEQ ID NO: 591245 - RNA, 22 nt, Human
ucacauuucucagcacugauga

SEQ ID NO: 591246 - RNA, 22 nt, Human
auguagaauuccuucuacuuug

SEQ ID NO: 591247 - RNA, 22 nt, Human
auguacauacugcauuuucaaa

SEQ ID NO: 591248 - RNA, 22 nt, Human
caguuauuuugaggauuaaaug

SEQ ID NO: 591249 - RNA, 19 nt, Human
cccagcucucguggugugc

SEQ ID NO: 591250 - RNA, 22 nt, Human
uuuaagacuuaggaaagaggau

SEQ ID NO: 591251 - RNA, 22 nt, Human
agaagccauugaagcagaccuc

SEQ ID NO: 591252 - RNA, 21 nt, Human
ggggcagagcuaggcccugca

SEQ ID NO: 591253 - RNA, 22 nt, Human
ggggagcagaagcagcaacaac

SEQ ID NO: 591254 - RNA, 22 nt, Human
auggcuggugauacuggaguga

SEQ ID NO: 591255 - RNA, 22 nt, Human
ugucucucugcccccauugcuc

SEQ ID NO: 591256 - RNA, 22 nt, Human
uaggcagagguaugguaaggac

SEQ ID NO: 591257 - RNA, 22 nt, Human
gaagccugguccagagcuccca

SEQ ID NO: 591258 - RNA, 22 nt, Human
aggagauggagcucagugggca

SEQ ID NO: 591259 - RNA, 22 nt, Human
gauauagguucauaguguuaca

SEQ ID NO: 591260 - RNA, 22 nt, Human
aacaaugaggaucuguucugag

SEQ ID NO: 591261 - RNA, 22 nt, Human
uggcuucauggcaagucuuagu

SEQ ID NO: 591262 - RNA, 22 nt, Human
aggcacuguggguguggccgga

SEQ ID NO: 591263 - RNA, 23 nt, Human
ugggccagggaguccgguuucuu

SEQ ID NO: 591264 - RNA, 22 nt, Human
cugagaaaccaggugcucugau

SEQ ID NO: 591265 - RNA, 22 nt, Human
cuggggagugaaauucuuaaau

SEQ ID NO: 591266 - RNA, 22 nt, Human
ugccaggcauuugacagacacu

SEQ ID NO: 591267 - RNA, 22 nt, Human
uuccuucccucaguggcugaag

SEQ ID NO: 591268 - RNA, 22 nt, Human
ccagggugcucuguggcgucgc

SEQ ID NO: 591269 - RNA, 22 nt, Human
gucacacagguugaaaugcagu

SEQ ID NO: 591270 - RNA, 16 nt, Human
cuucacagaggagagu

SEQ ID NO: 591271 - RNA, 23 nt, Human
uagaaugucauucaaugauaugg

SEQ ID NO: 591272 - RNA, 22 nt, Human
ggaaaguggugguggaaagagg

SEQ ID NO: 591273 - RNA, 22 nt, Human
uuacauaccucauagacucagg

SEQ ID NO: 591274 - RNA, 22 nt, Human
agagugcuuaaagcuggcuuug

SEQ ID NO: 591275 - RNA, 22 nt, Human
uauagacuagcagcagaauuua

SEQ ID NO: 591276 - RNA, 22 nt, Human
agaugcugccaggccccucagu

SEQ ID NO: 591277 - RNA, 22 nt, Human
uucuucaauuauuggaaagaaa

SEQ ID NO: 591278 - RNA, 22 nt, Human
cugcuuggguccuggcaugggu

SEQ ID NO: 591279 - RNA, 22 nt, Human
gaugggguuuugccaggcuggu

SEQ ID NO: 591280 - RNA, 22 nt, Human
auagcacaucacuccagugagu

SEQ ID NO: 591281 - RNA, 23 nt, Human
uggcugagauccuacuguuugcu

SEQ ID NO: 591282 - RNA, 22 nt, Human
acccagaggcggagguugcagu

SEQ ID NO: 591283 - RNA, 22 nt, Human
gugcagcaaacuagugcgaggg

SEQ ID NO: 591284 - RNA, 22 nt, Human
agaggcugauggaguagugucu

SEQ ID NO: 591285 - RNA, 22 nt, Human
aagcuucaggcccacccauguc

SEQ ID NO: 591286 - RNA, 22 nt, Human
aaaguacaauauugagauugau

SEQ ID NO: 591287 - RNA, 22 nt, Human
uucaagauggcugcaaauacuu

SEQ ID NO: 591288 - RNA, 21 nt, Human
ggccucagccaccuggcucug

SEQ ID NO: 591289 - RNA, 22 nt, Human
ugucuccugcaggggugugggc

SEQ ID NO: 591290 - RNA, 20 nt, Human
aaguuuucuccaaauacagu

SEQ ID NO: 591291 - RNA, 20 nt, Human
ucuguccaccagccucgccu

SEQ ID NO: 591292 - RNA, 22 nt, Human
uuuuuguucugauuauacuggu

SEQ ID NO: 591293 - RNA, 22 nt, Human
ggcucucuccuuggcuuucaga

SEQ ID NO: 591294 - RNA, 22 nt, Human
augacuuauuacaagucauauu

SEQ ID NO: 591295 - RNA, 17 nt, Human
cccagggaccacugcuu

SEQ ID NO: 591296 - RNA, 22 nt, Human
aaagcagucucagacuuaagca

SEQ ID NO: 591297 - RNA, 22 nt, Human
gcugggagugggcaagaugaga

SEQ ID NO: 591298 - RNA, 18 nt, Human
ucuagaaacccagacucu

SEQ ID NO: 591299 - RNA, 22 nt, Human
uacaagcugacccugaagauga

SEQ ID NO: 591300 - RNA, 22 nt, Human
ucuccuugcuacccaguauguc

SEQ ID NO: 591301 - RNA, 22 nt, Human
uuucuuguaagauguuuauuaa

SEQ ID NO: 591302 - RNA, 22 nt, Human
gcaaauaauauacuuugaucuc

SEQ ID NO: 591303 - RNA, 22 nt, Human
agugcagggccugcccagcagg

SEQ ID NO: 591304 - RNA, 22 nt, Human
ucccaggcgccugguggggagc

SEQ ID NO: 591305 - RNA, 23 nt, Human
gcugaagagcaaaccaggcaaaa

SEQ ID NO: 591306 - RNA, 22 nt, Human
ugcaggugguccuuccucugcu

SEQ ID NO: 591307 - RNA, 19 nt, Human
ugaagguguaugugcuggg

SEQ ID NO: 591308 - RNA, 22 nt, Human
cccagaggaggcaaagcucugu

SEQ ID NO: 591309 - RNA, 22 nt, Human
acauuucuccuugcaggaguca

SEQ ID NO: 591310 - RNA, 22 nt, Human
ucugagccaauuucugugucca

SEQ ID NO: 591311 - RNA, 22 nt, Human
augucccuugucugugaugucu

SEQ ID NO: 591312 - RNA, 22 nt, Human
gaaacagcuagaaagccauugg

SEQ ID NO: 591313 - RNA, 22 nt, Human
gccugccuguuggcugaggugc

SEQ ID NO: 591314 - RNA, 22 nt, Human
agggucugacuccucuggcaag

SEQ ID NO: 591315 - RNA, 22 nt, Human
uuagccaggggagcagcuuguc

SEQ ID NO: 591316 - RNA, 22 nt, Human
cuuguuugauuauugccugagg

SEQ ID NO: 591317 - RNA, 22 nt, Human
cggcagagcuuccugcucagcg

SEQ ID NO: 591318 - RNA, 22 nt, Human
cacauacuuguguguacauaug

SEQ ID NO: 591319 - RNA, 22 nt, Human
agugcugaagacuggcuaggga

SEQ ID NO: 591320 - RNA, 22 nt, Human
gcagaagcugggagaagggauu

SEQ ID NO: 591321 - RNA, 22 nt, Human
agaaaaagucaaggaauuggac

SEQ ID NO: 591322 - RNA, 22 nt, Human
ugacucaguacaucuggaguug

SEQ ID NO: 591323 - RNA, 22 nt, Human
ucugaaauggcagcgggaauga

SEQ ID NO: 591324 - RNA, 22 nt, Human
gcaguaaaaaaggauaugugca

SEQ ID NO: 591325 - RNA, 22 nt, Human
cugaaggagcauagucaguuuu

SEQ ID NO: 591326 - RNA, 22 nt, Human
uccaucucaccugcacucugcg

SEQ ID NO: 591327 - RNA, 22 nt, Human
uggcauuucaguauuuucauaa

SEQ ID NO: 591328 - RNA, 22 nt, Human
uagaaacccugccuuaguagcu

SEQ ID NO: 591329 - RNA, 22 nt, Human
cagcuccuaugaguaugauucc

SEQ ID NO: 591330 - RNA, 22 nt, Human
ucagguggcuuggagggggacg

SEQ ID NO: 591331 - RNA, 22 nt, Human
ugucuggaugucuggagcaucg

SEQ ID NO: 591332 - RNA, 22 nt, Human
cagcugccacuugcucucggcu

SEQ ID NO: 591333 - RNA, 22 nt, Human
cccuccaggccugucauguucc

SEQ ID NO: 591334 - RNA, 22 nt, Human
agaagccaaaggggccagauau

SEQ ID NO: 591335 - RNA, 22 nt, Human
ucaccagggagcuuguccucug

SEQ ID NO: 591336 - RNA, 22 nt, Human
ccagcugugccguguggauagc

SEQ ID NO: 591337 - RNA, 22 nt, Human
ucuugagaaauaauuaaacaug

SEQ ID NO: 591338 - RNA, 22 nt, Human
ccugggagagucuguggucucc

SEQ ID NO: 591339 - RNA, 22 nt, Human
cuggcucauccagguguugcuc

SEQ ID NO: 591340 - RNA, 22 nt, Human
aucugucaggagcaaggacuac

SEQ ID NO: 591341 - RNA, 22 nt, Human
ucugccuucgcugcucccugaa

SEQ ID NO: 591342 - RNA, 22 nt, Human
cacacaggaugaagcagcagaa

SEQ ID NO: 591343 - RNA, 22 nt, Human
uguacauuuagagcucaauaga

SEQ ID NO: 591344 - RNA, 22 nt, Human
gcuucauuacugacagucugug

SEQ ID NO: 591345 - RNA, 22 nt, Human
gagaaagauggaaucuuacagg

SEQ ID NO: 591346 - RNA, 22 nt, Human
agcagccucuguagaggucucc

SEQ ID NO: 591347 - RNA, 22 nt, Human
cugccucuauucacugaggcag

SEQ ID NO: 591348 - RNA, 22 nt, Human
guuuuugucgaguuccuugacc

SEQ ID NO: 591349 - RNA, 22 nt, Human
aaagguuuugguaaggcuuuaa

SEQ ID NO: 591350 - RNA, 22 nt, Human
acaggacuguggaaggaucucu

SEQ ID NO: 591351 - RNA, 22 nt, Human
uuucagaaccaagagagacauc

SEQ ID NO: 591352 - RNA, 22 nt, Human
gcagguggauauugcuacuuga

SEQ ID NO: 591353 - RNA, 22 nt, Human
aggccucuugucuuccucacau

SEQ ID NO: 591354 - RNA, 22 nt, Human
ggucagaggucacaagcuggca

SEQ ID NO: 591355 - RNA, 22 nt, Human
ucccagcugagauugagcaagg

SEQ ID NO: 591356 - RNA, 22 nt, Human
uccuuauaccuuugcuccgcuu

SEQ ID NO: 591357 - RNA, 22 nt, Human
ucagcacucgcuaccuaguaaa

SEQ ID NO: 591358 - RNA, 22 nt, Human
uacacuguguaaaaugcacuuu

SEQ ID NO: 591359 - RNA, 22 nt, Human
aacuuucuccagugccaacuau

SEQ ID NO: 591360 - RNA, 22 nt, Human
ugccacacuccccugcugcagu

SEQ ID NO: 591361 - RNA, 22 nt, Human
cuuuaauuaggaaguauaauga

SEQ ID NO: 591362 - RNA, 22 nt, Human
uguuuuucaaauauugcucugu

SEQ ID NO: 591363 - RNA, 22 nt, Human
acaauagaaggaaacugacaua

SEQ ID NO: 591364 - RNA, 22 nt, Human
auugugcagauaguaauuagga

SEQ ID NO: 591365 - RNA, 18 nt, Human
ggagagugacagagucgu

SEQ ID NO: 591366 - RNA, 22 nt, Human
aagcuaugggggaguuucaacc

SEQ ID NO: 591367 - RNA, 22 nt, Human
ugaaagggaaccugcuggacug

SEQ ID NO: 591368 - RNA, 22 nt, Human
auagccagcauauagcagggag

SEQ ID NO: 591369 - RNA, 22 nt, Human
uggauaaacucacuguaaguug

SEQ ID NO: 591370 - RNA, 18 nt, Human
gaguccaggcucuucacc

SEQ ID NO: 591371 - RNA, 22 nt, Human
aaaacugaaccuugagaucuuu

SEQ ID NO: 591372 - RNA, 22 nt, Human
ggaagaaagacauuuauuuuga

SEQ ID NO: 591373 - RNA, 22 nt, Human
ucucucuuuuuaaucauguaau

SEQ ID NO: 591374 - RNA, 22 nt, Human
acacagagugguuuguagaaua

SEQ ID NO: 591375 - RNA, 22 nt, Human
uccuggcuccagcagcucuucc

SEQ ID NO: 591376 - RNA, 22 nt, Human
uaagaaucaguagauauagauu

SEQ ID NO: 591377 - RNA, 22 nt, Human
agguggcuaugaggaugcaguc

SEQ ID NO: 591378 - RNA, 23 nt, Human
uuugcaaauuggacacaaccaca

SEQ ID NO: 591379 - RNA, 22 nt, Human
acugggauuacaggugggaguc

SEQ ID NO: 591380 - RNA, 22 nt, Human
aucuguacuaauuaauuaaugu

SEQ ID NO: 591381 - RNA, 22 nt, Human
uacauauacugagugauuugcu

SEQ ID NO: 591382 - RNA, 22 nt, Human
uuauuaagugccuacaauaaag

SEQ ID NO: 591383 - RNA, 22 nt, Human
ugcugcauucaggagcacaguu

SEQ ID NO: 591384 - RNA, 22 nt, Human
ugcuauaaguagacauucaaca

SEQ ID NO: 591385 - RNA, 22 nt, Human
cuuggccagacagggagcucca

SEQ ID NO: 591386 - RNA, 22 nt, Human
uucuugaaggggauauaaauag

SEQ ID NO: 591387 - RNA, 22 nt, Human
caggaacaaggccuaugggacu

SEQ ID NO: 591388 - RNA, 22 nt, Human
ucucuguucauggcacuauguc

SEQ ID NO: 591389 - RNA, 22 nt, Human
uauguauauguauacacacaca

SEQ ID NO: 591390 - RNA, 22 nt, Human
cagaguggcgacccccucagcu

SEQ ID NO: 591391 - RNA, 22 nt, Human
acggggcuagagaagguuucuu

SEQ ID NO: 591392 - RNA, 22 nt, Human
uggaugagauuaaagugagguu

SEQ ID NO: 591393 - RNA, 22 nt, Human
gaggcugcuguuagcccugggc

SEQ ID NO: 591394 - RNA, 22 nt, Human
cucaggcugugaugugauggca

SEQ ID NO: 591395 - RNA, 22 nt, Human
aguaguuugggcagugacagau

SEQ ID NO: 591396 - RNA, 22 nt, Human
cagugcugcucucuguaagaga

SEQ ID NO: 591397 - RNA, 22 nt, Human
uuuccuugcacauugguuucca

SEQ ID NO: 591398 - RNA, 22 nt, Human
uaggaaauuggaaacucuucac

SEQ ID NO: 591399 - RNA, 21 nt, Human
acauacauaccuuaccaccuu

SEQ ID NO: 591400 - RNA, 22 nt, Human
auuuacagacccucccacuaag

SEQ ID NO: 591401 - RNA, 22 nt, Human
aggcugugaacucuaugcugaa

SEQ ID NO: 591402 - RNA, 22 nt, Human
caaaguucucggcucaaguccu

SEQ ID NO: 591403 - RNA, 22 nt, Human
ggcuguggggaccaacaggacu

SEQ ID NO: 591404 - RNA, 22 nt, Human
aacacagacauagugauuacag

SEQ ID NO: 591405 - RNA, 22 nt, Human
aagaugcuuauugcuccugcag

SEQ ID NO: 591406 - RNA, 20 nt, Human
ucuggggugaagcccaggaa

SEQ ID NO: 591407 - RNA, 19 nt, Human
gggcucuggccucaguggg

SEQ ID NO: 591408 - RNA, 22 nt, Human
ugaggaguuuuucuagagcuaa

SEQ ID NO: 591409 - RNA, 22 nt, Human
caggccugacccugagcuucac

SEQ ID NO: 591410 - RNA, 23 nt, Human
gggugggccaaauuagguagccu

SEQ ID NO: 591411 - RNA, 22 nt, Human
caggagcccagaguccucagcu

SEQ ID NO: 591412 - RNA, 22 nt, Human
cuuuagaaggguaacggaauua

SEQ ID NO: 591413 - RNA, 22 nt, Human
aggucaagaguaaauuugggua

SEQ ID NO: 591414 - RNA, 22 nt, Human
cugccuggccacaacccagggu

SEQ ID NO: 591415 - RNA, 22 nt, Human
agggcuggcaucucuaaugcug

SEQ ID NO: 591416 - RNA, 20 nt, Human
aggggugaucgggugacacu

SEQ ID NO: 591417 - RNA, 20 nt, Human
cuugaguucagagcugucau

SEQ ID NO: 591418 - RNA, 22 nt, Human
uuguuucaaauauuucagaaua

SEQ ID NO: 591419 - RNA, 17 nt, Human
agcaggcacgucagcac

SEQ ID NO: 591420 - RNA, 22 nt, Human
ccucacagccucaugcccagcc

SEQ ID NO: 591421 - RNA, 22 nt, Human
uuugaauaaacgguuaauguuc

SEQ ID NO: 591422 - RNA, 22 nt, Human
ucagaacagaagcuggcuauaa

SEQ ID NO: 591423 - RNA, 22 nt, Human
cauuugaaauucuuagaacaaa

SEQ ID NO: 591424 - RNA, 22 nt, Human
acuaugauguauuuugcaucua

SEQ ID NO: 591425 - RNA, 22 nt, Human
gggcugggauggcuugaagauu

SEQ ID NO: 591426 - RNA, 22 nt, Human
ugucugcaaaguccagcacagg

SEQ ID NO: 591427 - RNA, 22 nt, Human
ucagucauuguccuuaaaacac

SEQ ID NO: 591428 - RNA, 17 nt, Human
gcaaucucagucuccuu

SEQ ID NO: 591429 - RNA, 22 nt, Human
agucaaaugaguaaauauauaa

SEQ ID NO: 591430 - RNA, 22 nt, Human
uacuuccaggcggacaaagccc

SEQ ID NO: 591431 - RNA, 22 nt, Human
gucuggagagcugagcagaguu

SEQ ID NO: 591432 - RNA, 20 nt, Human
caccucugaaaguuuccagc

SEQ ID NO: 591433 - RNA, 22 nt, Human
aacuuccaacccagaagccuaa

SEQ ID NO: 591434 - RNA, 22 nt, Human
cagagcacugcuuggaggauuu

SEQ ID NO: 591435 - RNA, 22 nt, Human
gcucucugggugugucuagaua

SEQ ID NO: 591436 - RNA, 22 nt, Human
uauuaucauguuaauuaguggg

SEQ ID NO: 591437 - RNA, 22 nt, Human
aagucacaagcauauaugcauu

SEQ ID NO: 591438 - RNA, 22 nt, Human
aagaacauuuuguagaaugaca

SEQ ID NO: 591439 - RNA, 22 nt, Human
ccugagccugcagccgagcaga

SEQ ID NO: 591440 - RNA, 22 nt, Human
aaaggagaaaacauacaggacu

SEQ ID NO: 591441 - RNA, 22 nt, Human
gcuguguccucacacagccuuu

SEQ ID NO: 591442 - RNA, 22 nt, Human
aaggguuggggaagagcaaauu

SEQ ID NO: 591443 - RNA, 22 nt, Human
uucuauugcacacaaauaauua

SEQ ID NO: 591444 - RNA, 22 nt, Human
auaugcuuccaaguuauuccac

SEQ ID NO: 591445 - RNA, 22 nt, Human
acuaguuuuccauaauauagga

SEQ ID NO: 591446 - RNA, 22 nt, Human
uguguccaucugacaggagagg

SEQ ID NO: 591447 - RNA, 22 nt, Human
uccuggcuggaauuucucacuc

SEQ ID NO: 591448 - RNA, 22 nt, Human
uggaacaaucccgguuuagcuc

SEQ ID NO: 591449 - RNA, 22 nt, Human
gaaaucuuuauggaaauaacaa

SEQ ID NO: 591450 - RNA, 19 nt, Human
ugguggaggugcaccugac

SEQ ID NO: 591451 - RNA, 22 nt, Human
uaggccacaaauaagauccugu

SEQ ID NO: 591452 - RNA, 22 nt, Human
cuggaagaacuccaguucugug

SEQ ID NO: 591453 - RNA, 22 nt, Human
guugugcaaccaucaccaccau

SEQ ID NO: 591454 - RNA, 22 nt, Human
accaaaaccugcuacuaaagga

SEQ ID NO: 591455 - RNA, 21 nt, Human
uaagacaguaugaauacuuuc

SEQ ID NO: 591456 - RNA, 20 nt, Human
cagaacaugagcaucgagcc

SEQ ID NO: 591457 - RNA, 22 nt, Human
acagguggccccgagggagugg

SEQ ID NO: 591458 - RNA, 22 nt, Human
cucccugguguccccuccagga

SEQ ID NO: 591459 - RNA, 22 nt, Human
agaugugguaguugaagggaag

SEQ ID NO: 591460 - RNA, 22 nt, Human
cuugccagggacucagucaggg

SEQ ID NO: 591461 - RNA, 22 nt, Human
uccuggguagagaccugaugaa

SEQ ID NO: 591462 - RNA, 21 nt, Human
ugcugcugaucgggguuggcu

SEQ ID NO: 591463 - RNA, 22 nt, Human
ccacagaaaguugucuagagua

SEQ ID NO: 591464 - RNA, 22 nt, Human
ucccuccccacuucugagcuuu

SEQ ID NO: 591465 - RNA, 22 nt, Human
gugcccugguccccagcauaua

SEQ ID NO: 591466 - RNA, 22 nt, Human
caaaugaauuucccugcaaaug

SEQ ID NO: 591467 - RNA, 22 nt, Human
gugagcaauucaaaggcaggaa

SEQ ID NO: 591468 - RNA, 23 nt, Human
cauuucugggagauuuauaaaau

SEQ ID NO: 591469 - RNA, 22 nt, Human
ugagcagagaugacugggcauu

SEQ ID NO: 591470 - RNA, 17 nt, Human
uaaagaucagccaugua

SEQ ID NO: 591471 - RNA, 22 nt, Human
cccuccagagcuugaccugcug

SEQ ID NO: 591472 - RNA, 22 nt, Human
agauuugaaacuugcuucauaa

SEQ ID NO: 591473 - RNA, 22 nt, Human
cuguggcucauaucuguaaucu

SEQ ID NO: 591474 - RNA, 18 nt, Human
accaggaagcuucuuguc

SEQ ID NO: 591475 - RNA, 22 nt, Human
ggcugcaguugugugaaggccg

SEQ ID NO: 591476 - RNA, 22 nt, Human
aaugaagcaagcugcuguguuu

SEQ ID NO: 591477 - RNA, 22 nt, Human
uaauuauuaugacaacaauugc

SEQ ID NO: 591478 - RNA, 22 nt, Human
guucauucaucaaauauuuacu

SEQ ID NO: 591479 - RNA, 22 nt, Human
agacaggcagaggcugcagagg

SEQ ID NO: 591480 - RNA, 22 nt, Human
agaaaucaugucuuauuucuau

SEQ ID NO: 591481 - RNA, 22 nt, Human
agaagcauuauaacaugcaagg

SEQ ID NO: 591482 - RNA, 22 nt, Human
uggaacacugaucauugccuuu

SEQ ID NO: 591483 - RNA, 22 nt, Human
augcuucagugcuaccuucaaa

SEQ ID NO: 591484 - RNA, 22 nt, Human
gugaagaccagggaacgcuggc

SEQ ID NO: 591485 - RNA, 21 nt, Human
ggcugcuggggguuggcacag

SEQ ID NO: 591486 - RNA, 20 nt, Human
gccaugaggggaggugacug

SEQ ID NO: 591487 - RNA, 22 nt, Human
aguggguguagucuuccuccug

SEQ ID NO: 591488 - RNA, 22 nt, Human
auugguaagcaagauggcaaua

SEQ ID NO: 591489 - RNA, 22 nt, Human
cauuuuacugacucuugaauua

SEQ ID NO: 591490 - RNA, 22 nt, Human
aagcucagaguagcucagcguc

SEQ ID NO: 591491 - RNA, 18 nt, Human
cagugucuugguaaaaua

SEQ ID NO: 591492 - RNA, 22 nt, Human
cagagaaagacuugcccuuagu

SEQ ID NO: 591493 - RNA, 22 nt, Human
ccugugucagccccugccucca

SEQ ID NO: 591494 - RNA, 22 nt, Human
ggcaggugacggggaugaguau

SEQ ID NO: 591495 - RNA, 22 nt, Human
caggagagcccggguccgggcu

SEQ ID NO: 591496 - RNA, 20 nt, Human
aggcaguuagaaggagauga

SEQ ID NO: 591497 - RNA, 22 nt, Human
ccucacaguguucgugucagau

SEQ ID NO: 591498 - RNA, 22 nt, Human
acuagggaaaguuauguucaca

SEQ ID NO: 591499 - RNA, 22 nt, Human
caaacauuccgcuucucccagg

SEQ ID NO: 591500 - RNA, 22 nt, Human
ccacaugguccucauuuacucu

SEQ ID NO: 591501 - RNA, 22 nt, Human
aauuagcuucagcuuguggggc

SEQ ID NO: 591502 - RNA, 22 nt, Human
acauuugucuucuuucagauua

SEQ ID NO: 591503 - RNA, 22 nt, Human
uccucccuaacucaugaugagu

SEQ ID NO: 591504 - RNA, 22 nt, Human
cccaggcugguccugaacuccu

SEQ ID NO: 591505 - RNA, 22 nt, Human
gaguccagcucugccucuuacu

SEQ ID NO: 591506 - RNA, 22 nt, Human
acagucugcuugucuccauggu

SEQ ID NO: 591507 - RNA, 22 nt, Human
augaagggugucccugugagca

SEQ ID NO: 591508 - RNA, 22 nt, Human
ugcagaagauggucugagcacc

SEQ ID NO: 591509 - RNA, 22 nt, Human
cucugggcuccuucagcccuuu

SEQ ID NO: 591510 - RNA, 22 nt, Human
uagacauuggccauuccugugg

SEQ ID NO: 591511 - RNA, 22 nt, Human
guguggggagcugcagccacau

SEQ ID NO: 591512 - RNA, 22 nt, Human
guuagaauaaaaggucagagag

SEQ ID NO: 591513 - RNA, 22 nt, Human
agaaggcagaugggacggagca

SEQ ID NO: 591514 - RNA, 22 nt, Human
ggacaggcgcagggccaaggaa

SEQ ID NO: 591515 - RNA, 22 nt, Human
gcagacaggcccaguggaggga

SEQ ID NO: 591516 - RNA, 22 nt, Human
uucuccuuguucccuucaauug

SEQ ID NO: 591517 - RNA, 22 nt, Human
ucuuaucuuauaccuaacagcc

SEQ ID NO: 591518 - RNA, 22 nt, Human
aauucacaauguguagucaugc

SEQ ID NO: 591519 - RNA, 22 nt, Human
cugugcccauaaucugguauuu

SEQ ID NO: 591520 - RNA, 22 nt, Human
gugggcuggacccuccugcucc

SEQ ID NO: 591521 - RNA, 22 nt, Human
cuugccaguguugcagaagcuc

SEQ ID NO: 591522 - RNA, 20 nt, Human
auguaaaauuauaaggcuga

SEQ ID NO: 591523 - RNA, 23 nt, Human
cuuuucauugccuuagcgcagag

SEQ ID NO: 591524 - RNA, 22 nt, Human
gcaguguugagccagcuggggg

SEQ ID NO: 591525 - RNA, 22 nt, Human
uuuuccugccuuugcucaggga

SEQ ID NO: 591526 - RNA, 22 nt, Human
aaaugaacaucaagaauagccu

SEQ ID NO: 591527 - RNA, 18 nt, Human
gauguaaaauaguagcuu

SEQ ID NO: 591528 - RNA, 20 nt, Human
uuacaaagaggcaucgcuuu

SEQ ID NO: 591529 - RNA, 22 nt, Human
augugaaauagcuggauaugaa

SEQ ID NO: 591530 - RNA, 22 nt, Human
agggaggaccaaugugugguua

SEQ ID NO: 591531 - RNA, 22 nt, Human
gcugccugccuugccuggagga

SEQ ID NO: 591532 - RNA, 22 nt, Human
caaaauagauguuaaccuggaa

SEQ ID NO: 591533 - RNA, 23 nt, Human
uuucaaagacuuucccuuagagu

SEQ ID NO: 591534 - RNA, 22 nt, Human
ggcagcaaagucacauggaaaa

SEQ ID NO: 591535 - RNA, 22 nt, Human
acagccagaggugguccugggu

SEQ ID NO: 591536 - RNA, 20 nt, Human
ggcucuggaaucuggugggc

SEQ ID NO: 591537 - RNA, 22 nt, Human
acacagaggcaugacaguggcu

SEQ ID NO: 591538 - RNA, 23 nt, Human
auccccugccuugggugaguccc

SEQ ID NO: 591539 - RNA, 22 nt, Human
ucugaaauacugcagguucucu

SEQ ID NO: 591540 - RNA, 20 nt, Human
ggaaaaaugcaugcucaaga

SEQ ID NO: 591541 - RNA, 22 nt, Human
cagguaggcagccggucucugg

SEQ ID NO: 591542 - RNA, 22 nt, Human
uauauuuaaauccagguugaaa

SEQ ID NO: 591543 - RNA, 22 nt, Human
ugcccuugggauuuagguaagg

SEQ ID NO: 591544 - RNA, 22 nt, Human
ccagaugucccucucagguuug

SEQ ID NO: 591545 - RNA, 22 nt, Human
ugugaaauauuuauauacucaa

SEQ ID NO: 591546 - RNA, 22 nt, Human
uuaaauauuauguugucugcaa

SEQ ID NO: 591547 - RNA, 22 nt, Human
cuacuguccauaaaguauaacu

SEQ ID NO: 591548 - RNA, 22 nt, Human
uagcaauguaagauguuaacac

SEQ ID NO: 591549 - RNA, 22 nt, Human
aagagcugugggugguaguccu

SEQ ID NO: 591550 - RNA, 22 nt, Human
augucacugugaggcagcuguc

SEQ ID NO: 591551 - RNA, 22 nt, Human
auccuucuccagucguauuuuu

SEQ ID NO: 591552 - RNA, 22 nt, Human
ucuccuggcaugugggucaucu

SEQ ID NO: 591553 - RNA, 22 nt, Human
caggggcucugagauugucuaa

SEQ ID NO: 591554 - RNA, 22 nt, Human
aaaugucuaucuggcauauucc

SEQ ID NO: 591555 - RNA, 22 nt, Human
uauguugcaccaaccuaauaau

SEQ ID NO: 591556 - RNA, 22 nt, Human
cugccuuugcccuugacacugu

SEQ ID NO: 591557 - RNA, 22 nt, Human
cagagcagguaucuuuggugaa

SEQ ID NO: 591558 - RNA, 22 nt, Human
guggggugggcugaguuaggcc

SEQ ID NO: 591559 - RNA, 21 nt, Human
uuucugucucugccacuaguu

SEQ ID NO: 591560 - RNA, 22 nt, Human
aaauaagcacuuaacuguauca

SEQ ID NO: 591561 - RNA, 22 nt, Human
acacuaguggaaauugauuugu

SEQ ID NO: 591562 - RNA, 22 nt, Human
uagaaacuagauugauagcgga

SEQ ID NO: 591563 - RNA, 22 nt, Human
gagcacuguacucauuugcacu

SEQ ID NO: 591564 - RNA, 20 nt, Human
ugcccacaucacucaggagu

SEQ ID NO: 591565 - RNA, 22 nt, Human
uuuagaguaaaaacugugaccu

SEQ ID NO: 591566 - RNA, 22 nt, Human
uugcaggguacauucuuagaau

SEQ ID NO: 591567 - RNA, 22 nt, Human
aaauggcugacuaaauuaaauu

SEQ ID NO: 591568 - RNA, 22 nt, Human
cauugcaguaaucuggugaaau

SEQ ID NO: 591569 - RNA, 22 nt, Human
guugggaaggcaagaaguagaa

SEQ ID NO: 591570 - RNA, 22 nt, Human
cuuucccuuagccccauucuau

SEQ ID NO: 591571 - RNA, 19 nt, Human
ggcucucccuugagagagc

SEQ ID NO: 591572 - RNA, 22 nt, Human
aaaagcuuuguuaauagguuug

SEQ ID NO: 591573 - RNA, 22 nt, Human
aggagaaaacaguguuuugccu

SEQ ID NO: 591574 - RNA, 22 nt, Human
ucugggcugugguuccacuccg

SEQ ID NO: 591575 - RNA, 20 nt, Human
gggagaagggcugaugagag

SEQ ID NO: 591576 - RNA, 22 nt, Human
acagcagcuggguucccaccau

SEQ ID NO: 591577 - RNA, 22 nt, Human
gagggccucugcugcuccacau

SEQ ID NO: 591578 - RNA, 22 nt, Human
uuagggaaagcagcauucccuu

SEQ ID NO: 591579 - RNA, 22 nt, Human
aagaagcaggucacagacaggg

SEQ ID NO: 591580 - RNA, 22 nt, Human
uccaggcuggccucgcgugaca

SEQ ID NO: 591581 - RNA, 22 nt, Human
agauggaguggagaugaguaaa

SEQ ID NO: 591582 - RNA, 22 nt, Human
guuucucaacaugcuuucuaac

SEQ ID NO: 591583 - RNA, 18 nt, Human
cuuccugacuagcucugg

SEQ ID NO: 591584 - RNA, 22 nt, Human
ugucugggagggacagggcuac

SEQ ID NO: 591585 - RNA, 22 nt, Human
ucuauuacuacaucagccaggu

SEQ ID NO: 591586 - RNA, 22 nt, Human
ugaaacuuuugagguucuucca

SEQ ID NO: 591587 - RNA, 22 nt, Human
gcacagaggaagcacagacucu

SEQ ID NO: 591588 - RNA, 22 nt, Human
uugaagcauuguggcuuguauu

SEQ ID NO: 591589 - RNA, 22 nt, Human
ucccucuguguugggcaugccu

SEQ ID NO: 591590 - RNA, 19 nt, Human
uggcaucugggcccuccag

SEQ ID NO: 591591 - RNA, 22 nt, Human
uugcugaaagguagcugugugg

SEQ ID NO: 591592 - RNA, 22 nt, Human
uacaaaguuugagaaugcuuuc

SEQ ID NO: 591593 - RNA, 22 nt, Human
cauucagucaugcugguuuuga

SEQ ID NO: 591594 - RNA, 22 nt, Human
aaaagacaggugucugcggccc

SEQ ID NO: 591595 - RNA, 22 nt, Human
uuuuucugccauucaaagagga

SEQ ID NO: 591596 - RNA, 22 nt, Human
augcaguguuuggaagcuuaag

SEQ ID NO: 591597 - RNA, 22 nt, Human
cugugagcuggguggccaggac

SEQ ID NO: 591598 - RNA, 22 nt, Human
ucuugcagaaaauaguauagau

SEQ ID NO: 591599 - RNA, 22 nt, Human
uuugcuuugacugucagcaagu

SEQ ID NO: 591600 - RNA, 22 nt, Human
aaagcuuuuguuuucguaacug

SEQ ID NO: 591601 - RNA, 20 nt, Human
aggccaggaaauguaguucu

SEQ ID NO: 591602 - RNA, 22 nt, Human
guucauaauuugaaggaauagg

SEQ ID NO: 591603 - RNA, 20 nt, Human
gcccaggaucucugaggcau

SEQ ID NO: 591604 - RNA, 22 nt, Human
ccaggccuguguuguguggagg

SEQ ID NO: 591605 - RNA, 22 nt, Human
aagaaugucguugguauuuuaa

SEQ ID NO: 591606 - RNA, 22 nt, Human
ccccagguggauggcucgcaua

SEQ ID NO: 591607 - RNA, 20 nt, Human
aggcugccaggucucacauc

SEQ ID NO: 591608 - RNA, 22 nt, Human
augaggcaugugaggagaaggg

SEQ ID NO: 591609 - RNA, 22 nt, Human
agccacuccuucagcgucugcu

SEQ ID NO: 591610 - RNA, 22 nt, Human
ucccuggguuaccuuucaaggu

SEQ ID NO: 591611 - RNA, 22 nt, Human
uuaucauugucgcagucuaauu

SEQ ID NO: 591612 - RNA, 22 nt, Human
uaggauacaaauucuguaauuu

SEQ ID NO: 591613 - RNA, 22 nt, Human
cagugccagagguacuagugga

SEQ ID NO: 591614 - RNA, 22 nt, Human
cuggcagcauggagccugugcu

SEQ ID NO: 591615 - RNA, 22 nt, Human
uguauuuaagcuuuaccuaaaa

SEQ ID NO: 591616 - RNA, 22 nt, Human
guaaagaaguuuuugaaugcau

SEQ ID NO: 591617 - RNA, 22 nt, Human
caacuacauccacacuuuguua

SEQ ID NO: 591618 - RNA, 22 nt, Human
cagacuugacggcagcugcuuu

SEQ ID NO: 591619 - RNA, 22 nt, Human
cuuauuguguguauuuucuagu

SEQ ID NO: 591620 - RNA, 22 nt, Human
cugucauucuuacauaauguga

SEQ ID NO: 591621 - RNA, 22 nt, Human
gggcaaaggcagaaagcggugu

SEQ ID NO: 591622 - RNA, 22 nt, Human
uggcugugggaugagagccuca

SEQ ID NO: 591623 - RNA, 23 nt, Human
uggaagacuccucucuuggcugc

SEQ ID NO: 591624 - RNA, 22 nt, Human
ugcuucugcaggagcuccugau

SEQ ID NO: 591625 - RNA, 22 nt, Human
ugcucugggcucaauggcagcu

SEQ ID NO: 591626 - RNA, 22 nt, Human
uuaaaaugaauauugauuagca

SEQ ID NO: 591627 - RNA, 21 nt, Human
ggacaccagucacacuggauu

SEQ ID NO: 591628 - RNA, 19 nt, Human
ccaguagagacagcugcag

SEQ ID NO: 591629 - RNA, 22 nt, Human
acuucuguauguccugcauuca

SEQ ID NO: 591630 - RNA, 22 nt, Human
gcagaggugucaccuuccagga

SEQ ID NO: 591631 - RNA, 22 nt, Human
ugcuguggauucagagaugaaa

SEQ ID NO: 591632 - RNA, 22 nt, Human
ucacaguucaacuaguucagau

SEQ ID NO: 591633 - RNA, 20 nt, Human
aucacuggagaaggaaaccu

SEQ ID NO: 591634 - RNA, 22 nt, Human
ugggcaaaugucacuuucuuuu

SEQ ID NO: 591635 - RNA, 22 nt, Human
aucaauguugggccaaagcaaa

SEQ ID NO: 591636 - RNA, 22 nt, Human
augcaaaaguaauugcaauuuu

SEQ ID NO: 591637 - RNA, 22 nt, Human
ggcaggugaggcaugugccugg

SEQ ID NO: 591638 - RNA, 22 nt, Human
ggccugaaauagcucugagguu

SEQ ID NO: 591639 - RNA, 20 nt, Human
caugccugcugguaucuggc

SEQ ID NO: 591640 - RNA, 22 nt, Human
cugaggccccucuugugagcau

SEQ ID NO: 591641 - RNA, 17 nt, Human
gaagguuucucuuaggu

SEQ ID NO: 591642 - RNA, 22 nt, Human
acuuuauguuugauaucuaugg

SEQ ID NO: 591643 - RNA, 22 nt, Human
cacagcugucagcugaccuagg

SEQ ID NO: 591644 - RNA, 22 nt, Human
accccagaggcggaggcugcag

SEQ ID NO: 591645 - RNA, 22 nt, Human
ccugggugaaaucucuccugca

SEQ ID NO: 591646 - RNA, 22 nt, Human
cuucauuaaugucuauaaguuu

SEQ ID NO: 591647 - RNA, 22 nt, Human
cuuaauuuuuguaguagaugga

SEQ ID NO: 591648 - RNA, 22 nt, Human
aagaauguggcauuuauuuaua

SEQ ID NO: 591649 - RNA, 22 nt, Human
gccucaaauguggagcacuauu

SEQ ID NO: 591650 - RNA, 22 nt, Human
caggaccccauauucacugaac

SEQ ID NO: 591651 - RNA, 22 nt, Human
acagaucuacauugucugaccc

SEQ ID NO: 591652 - RNA, 22 nt, Human
uggucaguugugacuagaacac

SEQ ID NO: 591653 - RNA, 22 nt, Human
uggaagaauaggauagaagaac

SEQ ID NO: 591654 - RNA, 22 nt, Human
ggcuccagaggccuuaccugca

SEQ ID NO: 591655 - RNA, 22 nt, Human
gcccacuggcuggagugcuggu

SEQ ID NO: 591656 - RNA, 22 nt, Human
uuaaaacagcgugaaucuggca

SEQ ID NO: 591657 - RNA, 22 nt, Human
uuuccuggaccaacugagauug

SEQ ID NO: 591658 - RNA, 21 nt, Human
gcauggcaggucacuggggca

SEQ ID NO: 591659 - RNA, 22 nt, Human
aggccugccuggagccuggcug

SEQ ID NO: 591660 - RNA, 22 nt, Human
ccugcuggacguggaggagggg

SEQ ID NO: 591661 - RNA, 22 nt, Human
gcauugaucuuuauucugcuuu

SEQ ID NO: 591662 - RNA, 22 nt, Human
cugucuggccggcccagcuucc

SEQ ID NO: 591663 - RNA, 19 nt, Human
gcuguacaguaaggagaca

SEQ ID NO: 591664 - RNA, 22 nt, Human
ugcaaacaacuguuuaaugcug

SEQ ID NO: 591665 - RNA, 22 nt, Human
aggcacugaccugcuuccuuga

SEQ ID NO: 591666 - RNA, 23 nt, Human
agguggagcugugcagccggggc

SEQ ID NO: 591667 - RNA, 22 nt, Human
gagaugggcgagaagguggacu

SEQ ID NO: 591668 - RNA, 22 nt, Human
uuauaaagauuguuauguaucu

SEQ ID NO: 591669 - RNA, 22 nt, Human
ugugaaauuacuuaaaggaaau

SEQ ID NO: 591670 - RNA, 22 nt, Human
gcagguggagcaguagucuggu

SEQ ID NO: 591671 - RNA, 22 nt, Human
ucaggaugacuucaaggaggaa

SEQ ID NO: 591672 - RNA, 22 nt, Human
gcucucugcagccuccuuggag

SEQ ID NO: 591673 - RNA, 22 nt, Human
augggcaguaacaguggcaguc

SEQ ID NO: 591674 - RNA, 22 nt, Human
uggagcuggaauuugagcugga

SEQ ID NO: 591675 - RNA, 22 nt, Human
gcaggaugaacuaacaccugca

SEQ ID NO: 591676 - RNA, 22 nt, Human
gugccugcuaccugacuuguuu

SEQ ID NO: 591677 - RNA, 22 nt, Human
ugggccaguuggugacuacaaa

SEQ ID NO: 591678 - RNA, 22 nt, Human
auuauuguuagugacaggguga

SEQ ID NO: 591679 - RNA, 22 nt, Human
gccuccuggccuuugcuccuca

SEQ ID NO: 591680 - RNA, 22 nt, Human
gacagcuuagugaaaauguaaa

SEQ ID NO: 591681 - RNA, 22 nt, Human
gcagccucugcaguucaggagg

SEQ ID NO: 591682 - RNA, 22 nt, Human
cucucugugguggcugucccau

SEQ ID NO: 591683 - RNA, 22 nt, Human
cagggccucucaucccacgggc

SEQ ID NO: 591684 - RNA, 22 nt, Human
cuucauguucugccuguggaag

SEQ ID NO: 591685 - RNA, 22 nt, Human
agggccagcugcagaauuagca

SEQ ID NO: 591686 - RNA, 22 nt, Human
agacauuuuaacaucuggguuu

SEQ ID NO: 591687 - RNA, 22 nt, Human
uaguggaguagaaaccaaagaa

SEQ ID NO: 591688 - RNA, 22 nt, Human
agagugugucuauggaaggggu

SEQ ID NO: 591689 - RNA, 22 nt, Human
ucaguaaaugguugcuguuauu

SEQ ID NO: 591690 - RNA, 22 nt, Human
ccauuguuuauuuagacuuaau

SEQ ID NO: 591691 - RNA, 22 nt, Human
cuucccaagacuguauugcaag

SEQ ID NO: 591692 - RNA, 23 nt, Human
agucucagcuggaaacauguguc

SEQ ID NO: 591693 - RNA, 22 nt, Human
cagcugccuguauuguccucau

SEQ ID NO: 591694 - RNA, 22 nt, Human
ugcuuccuucccguucuucucc

SEQ ID NO: 591695 - RNA, 22 nt, Human
ugcaaugagaauauauuaacca

SEQ ID NO: 591696 - RNA, 22 nt, Human
ucccaggaaggauucggcauuu

SEQ ID NO: 591697 - RNA, 23 nt, Human
gccuggguuguaacuagugcauc

SEQ ID NO: 591698 - RNA, 22 nt, Human
ccucuggcauagcaaguggccu

SEQ ID NO: 591699 - RNA, 22 nt, Human
gaggguggagcuccagaaucug

SEQ ID NO: 591700 - RNA, 22 nt, Human
uguuugugcugccuggugggca

SEQ ID NO: 591701 - RNA, 22 nt, Human
uagauauaagguccuuagaaca

SEQ ID NO: 591702 - RNA, 18 nt, Human
aauuucuuugacaacuua

SEQ ID NO: 591703 - RNA, 22 nt, Human
gggcgcgcacgccagacagccu

SEQ ID NO: 591704 - RNA, 22 nt, Human
uccucagaugcucuuggacgcc

SEQ ID NO: 591705 - RNA, 22 nt, Human
cacagugucugugcuucagugu

SEQ ID NO: 591706 - RNA, 22 nt, Human
ggugacaguuccggagguacag

SEQ ID NO: 591707 - RNA, 22 nt, Human
cacuguauuauuaggaaugaca

SEQ ID NO: 591708 - RNA, 22 nt, Human
cauauuucagucuaagaugugu

SEQ ID NO: 591709 - RNA, 22 nt, Human
uugcaauagccuuauuuccaaa

SEQ ID NO: 591710 - RNA, 22 nt, Human
uggagcugagagccaggcuggc

SEQ ID NO: 591711 - RNA, 22 nt, Human
agaagggaacucagagaugauu

SEQ ID NO: 591712 - RNA, 22 nt, Human
uaguugaaagggauuauugugg

SEQ ID NO: 591713 - RNA, 22 nt, Human
gugauuuugagaccuauauagu

SEQ ID NO: 591714 - RNA, 22 nt, Human
ucacaaauuucagcucccugaa

SEQ ID NO: 591715 - RNA, 22 nt, Human
uaacacugaaaaugaugcaugu

SEQ ID NO: 591716 - RNA, 22 nt, Human
ccugcagagggacuggcaggaa

SEQ ID NO: 591717 - RNA, 22 nt, Human
cucagcuccaggugugcaucuu

SEQ ID NO: 591718 - RNA, 23 nt, Human
uuguauuuuuaguagagacaggg

SEQ ID NO: 591719 - RNA, 22 nt, Human
cagcccugagagaaccaucuau

SEQ ID NO: 591720 - RNA, 22 nt, Human
gcuggguccuaugcugguagag

SEQ ID NO: 591721 - RNA, 22 nt, Human
auucucuggcuaaaaccugaag

SEQ ID NO: 591722 - RNA, 21 nt, Human
auucugaguugucagucuuca

SEQ ID NO: 591723 - RNA, 20 nt, Human
cagggcacacugcagccucg

SEQ ID NO: 591724 - RNA, 22 nt, Human
uacaucauggcuucaugcugca

SEQ ID NO: 591725 - RNA, 17 nt, Human
uucucuuccuggauagu

SEQ ID NO: 591726 - RNA, 22 nt, Human
aguuuucugaccccugcucuau

SEQ ID NO: 591727 - RNA, 22 nt, Human
ugccagcucccuuuucuccucc

SEQ ID NO: 591728 - RNA, 18 nt, Human
ggugagggagcuggaagc

SEQ ID NO: 591729 - RNA, 22 nt, Human
ccugugugcacacgaggccaug

SEQ ID NO: 591730 - RNA, 22 nt, Human
gaauuaggugcauguuuacaaa

SEQ ID NO: 591731 - RNA, 22 nt, Human
ccugggcagggagaccaggcuc

SEQ ID NO: 591732 - RNA, 22 nt, Human
agcuaggccauuuguucaguga

SEQ ID NO: 591733 - RNA, 22 nt, Human
uagaggggaaaaugcguauuaa

SEQ ID NO: 591734 - RNA, 22 nt, Human
cuguauuuucaugccuacguac

SEQ ID NO: 591735 - RNA, 22 nt, Human
gucccugcaucaccacgggacu

SEQ ID NO: 591736 - RNA, 22 nt, Human
agagccaggcggcugggcaccu

SEQ ID NO: 591737 - RNA, 22 nt, Human
caguuaaucuugccauuauauc

SEQ ID NO: 591738 - RNA, 22 nt, Human
acaauagacccaugacacauac

SEQ ID NO: 591739 - RNA, 22 nt, Human
ucauaggaguagcagugagagg

SEQ ID NO: 591740 - RNA, 22 nt, Human
cugaggccucuguucaccagaa

SEQ ID NO: 591741 - RNA, 22 nt, Human
agccaggucagcucacccugcu

SEQ ID NO: 591742 - RNA, 22 nt, Human
ucucuguagggcugcuugagua

SEQ ID NO: 591743 - RNA, 22 nt, Human
auuaguauucaguuuauaacac

SEQ ID NO: 591744 - RNA, 22 nt, Human
aagagccagugggaaagucuug

SEQ ID NO: 591745 - RNA, 22 nt, Human
auaguaugaauuaaaucaugag

SEQ ID NO: 591746 - RNA, 22 nt, Human
ccugccuggggacaaaggaggg

SEQ ID NO: 591747 - RNA, 22 nt, Human
agcuaaaugcauuucaagacug

SEQ ID NO: 591748 - RNA, 22 nt, Human
gcaccagcugcuggguucuaga

SEQ ID NO: 591749 - RNA, 22 nt, Human
acugggcaaggauaugaugggu

SEQ ID NO: 591750 - RNA, 18 nt, Human
aaugcaauguauuugcag

SEQ ID NO: 591751 - RNA, 21 nt, Human
ccugagguuucuggccucugu

SEQ ID NO: 591752 - RNA, 22 nt, Human
cccacacacauuuaugauagga

SEQ ID NO: 591753 - RNA, 22 nt, Human
cuagucacacaguaaggacggg

SEQ ID NO: 591754 - RNA, 22 nt, Human
guucuauucuccaguuacauau

SEQ ID NO: 591755 - RNA, 19 nt, Human
agcauuaggcaaauuuuga

SEQ ID NO: 591756 - RNA, 22 nt, Human
cugcacagagcagggcagacac

SEQ ID NO: 591757 - RNA, 22 nt, Human
gccagccacuucccagacuggc

SEQ ID NO: 591758 - RNA, 22 nt, Human
uuaugcuuccugauuggacucu

SEQ ID NO: 591759 - RNA, 22 nt, Human
aguuuuauugucccagagguga

SEQ ID NO: 591760 - RNA, 22 nt, Human
ugaggcuccagccaggccagca

SEQ ID NO: 591761 - RNA, 22 nt, Human
cagcagcaaggugaggguggag

SEQ ID NO: 591762 - RNA, 22 nt, Human
aguguuucugugccccaguguu

SEQ ID NO: 591763 - RNA, 22 nt, Human
cagaggacaauagaauggaaag

SEQ ID NO: 591764 - RNA, 22 nt, Human
guucaucacucagagaccuccc

SEQ ID NO: 591765 - RNA, 22 nt, Human
ugaauaauccacagucauucau

SEQ ID NO: 591766 - RNA, 22 nt, Human
cugcccugggauggucugugcg

SEQ ID NO: 591767 - RNA, 22 nt, Human
ugaaacagucuccagacuugga

SEQ ID NO: 591768 - RNA, 22 nt, Human
ugaacaacugcaaaaaucucca

SEQ ID NO: 591769 - RNA, 22 nt, Human
auuuagcaguccuccucacaau

SEQ ID NO: 591770 - RNA, 22 nt, Human
gcuccucccugugcagacccag

SEQ ID NO: 591771 - RNA, 20 nt, Human
guacuucagguguggucuga

SEQ ID NO: 591772 - RNA, 22 nt, Human
ucucugugacauuucugagccu

SEQ ID NO: 591773 - RNA, 22 nt, Human
acugaggcuuaaagagauuagg

SEQ ID NO: 591774 - RNA, 22 nt, Human
agucuccacacuggcagaugcc

SEQ ID NO: 591775 - RNA, 22 nt, Human
uguauuuucuucuggaagcuua

SEQ ID NO: 591776 - RNA, 22 nt, Human
uacuacauacagaauuuagaga

SEQ ID NO: 591777 - RNA, 22 nt, Human
cugggcuggagugcaauggcgc

SEQ ID NO: 591778 - RNA, 22 nt, Human
uuucuauuuacagugcuaggua

SEQ ID NO: 591779 - RNA, 22 nt, Human
uucugagggcuaauguacugua

SEQ ID NO: 591780 - RNA, 23 nt, Human
uagugauuggaaaaacuaguuuu

SEQ ID NO: 591781 - RNA, 22 nt, Human
acaguucuagcuuuuacauuuu

SEQ ID NO: 591782 - RNA, 22 nt, Human
aaaauauggggugagcccagag

SEQ ID NO: 591783 - RNA, 21 nt, Human
ucacacacguuuccaagggca

SEQ ID NO: 591784 - RNA, 19 nt, Human
uccuuugaauaucaguuga

SEQ ID NO: 591785 - RNA, 22 nt, Human
acucuuaugggaacaaggauua

SEQ ID NO: 591786 - RNA, 22 nt, Human
uugcaauugcuauggagagcgu

SEQ ID NO: 591787 - RNA, 22 nt, Human
agccugugugaagcccucagag

SEQ ID NO: 591788 - RNA, 19 nt, Human
ucacccaggcugcuggcuc

SEQ ID NO: 591789 - RNA, 22 nt, Human
cagcucuuuauugaaacaaaaa

SEQ ID NO: 591790 - RNA, 22 nt, Human
uguaggcaucacuuucucuugg

SEQ ID NO: 591791 - RNA, 22 nt, Human
ccugggguauauaggugaauau

SEQ ID NO: 591792 - RNA, 22 nt, Human
ucaugcaaggcugaaacauggu

SEQ ID NO: 591793 - RNA, 22 nt, Human
caggugacuucugaggccuuca

SEQ ID NO: 591794 - RNA, 22 nt, Human
caugcugauucuuccugagcuu

SEQ ID NO: 591795 - RNA, 22 nt, Human
cuuguacauagagaagaagccu

SEQ ID NO: 591796 - RNA, 22 nt, Human
cugagccaaaaagcagagcuug

SEQ ID NO: 591797 - RNA, 21 nt, Human
ugcagagauaucugaagcaga

SEQ ID NO: 591798 - RNA, 22 nt, Human
ugugaagauagcuguuacaucu

SEQ ID NO: 591799 - RNA, 22 nt, Human
cagcaauggcaggcggagagug

SEQ ID NO: 591800 - RNA, 22 nt, Human
ggcugcugagucacgacaguga

SEQ ID NO: 591801 - RNA, 22 nt, Human
cuuuucucuuacauuccacugg

SEQ ID NO: 591802 - RNA, 22 nt, Human
aagauacuucacuugccgaaau

SEQ ID NO: 591803 - RNA, 22 nt, Human
gucucugagcucugagcuggcu

SEQ ID NO: 591804 - RNA, 22 nt, Human
uguauuuucugaggagcauuag

SEQ ID NO: 591805 - RNA, 22 nt, Human
cugagcuucagugcacugggag

SEQ ID NO: 591806 - RNA, 22 nt, Human
caggcagugucccaggaagcca

SEQ ID NO: 591807 - RNA, 22 nt, Human
gcggcggagacagcaggaagcc

SEQ ID NO: 591808 - RNA, 22 nt, Human
aagagcuggauggaaucuggga

SEQ ID NO: 591809 - RNA, 22 nt, Human
gagaggcugauccugcagagaa

SEQ ID NO: 591810 - RNA, 22 nt, Human
uggaacaagacagcauagagcu

SEQ ID NO: 591811 - RNA, 22 nt, Human
ccaggugugccagcagggacug

SEQ ID NO: 591812 - RNA, 22 nt, Human
uucuaccuccuagaaaaucugg

SEQ ID NO: 591813 - RNA, 22 nt, Human
agcuguggcagcagccguggca

SEQ ID NO: 591814 - RNA, 22 nt, Human
auucagggaggaaaggggccuc

SEQ ID NO: 591815 - RNA, 22 nt, Human
acagacuguuugguucaugucu

SEQ ID NO: 591816 - RNA, 22 nt, Human
acagagcaauaacagggagagg

SEQ ID NO: 591817 - RNA, 19 nt, Human
gugcaguucagaguucaau

SEQ ID NO: 591818 - RNA, 22 nt, Human
aaaacacugccugcuugacuga

SEQ ID NO: 591819 - RNA, 22 nt, Human
caggggcagucugugugcgugg

SEQ ID NO: 591820 - RNA, 22 nt, Human
uagugcuuuaaguuuacagaga

SEQ ID NO: 591821 - RNA, 22 nt, Human
acaccuuugccccaagucauag

SEQ ID NO: 591822 - RNA, 22 nt, Human
cuggccuggucuggccucucca

SEQ ID NO: 591823 - RNA, 22 nt, Human
ggggugagugcucagccccgga

SEQ ID NO: 591824 - RNA, 22 nt, Human
ucaguguuuacaugcauccuug

SEQ ID NO: 591825 - RNA, 22 nt, Human
guccuggguccccgcaggucag

SEQ ID NO: 591826 - RNA, 22 nt, Human
uucacagugcugcaccuggcuu

SEQ ID NO: 591827 - RNA, 23 nt, Human
aagcuuccuucacgucuccuggg

SEQ ID NO: 591828 - RNA, 22 nt, Human
cacauuuuuacugccaacuuaa

SEQ ID NO: 591829 - RNA, 23 nt, Human
ucucugaguuguacuuucccuug

SEQ ID NO: 591830 - RNA, 21 nt, Human
augacagaugcugcagaucgu

SEQ ID NO: 591831 - RNA, 22 nt, Human
uagauguuugagaaguuuaugu

SEQ ID NO: 591832 - RNA, 20 nt, Human
uccagcccagguccugccug

SEQ ID NO: 591833 - RNA, 22 nt, Human
aagaacaugauggccaugugca

SEQ ID NO: 591834 - RNA, 22 nt, Human
aaggcaggagcuguaucuuauu

SEQ ID NO: 591835 - RNA, 22 nt, Human
uuucauuaaagucaaaucuggu

SEQ ID NO: 591836 - RNA, 22 nt, Human
acauuuaaauaccuauguuucu

SEQ ID NO: 591837 - RNA, 22 nt, Human
gugcccugagcuuaugcauucu

SEQ ID NO: 591838 - RNA, 22 nt, Human
uuacauucauugaagugauuca

SEQ ID NO: 591839 - RNA, 22 nt, Human
uaauuucacaguucaacgcaca

SEQ ID NO: 591840 - RNA, 22 nt, Human
gauguuaacuuguucugccucu

SEQ ID NO: 591841 - RNA, 22 nt, Human
cuucacaaaauauuucauuaua

SEQ ID NO: 591842 - RNA, 22 nt, Human
agugugggcccccagguuagcc

SEQ ID NO: 591843 - RNA, 22 nt, Human
aaaccaucagauaauucauacu

SEQ ID NO: 591844 - RNA, 22 nt, Human
ucugcucuguggcuucagcuaa

SEQ ID NO: 591845 - RNA, 22 nt, Human
augaagaugguucaacuggccu

SEQ ID NO: 591846 - RNA, 21 nt, Human
uccagcucuuauguucaugaa

SEQ ID NO: 591847 - RNA, 22 nt, Human
ggacaggagugaggcggguucc

SEQ ID NO: 591848 - RNA, 22 nt, Human
uuacagauacauuucuuuuguu

SEQ ID NO: 591849 - RNA, 22 nt, Human
augcauauuucuuggagcaccu

SEQ ID NO: 591850 - RNA, 22 nt, Human
uuguacagggaaguaauacaag

SEQ ID NO: 591851 - RNA, 22 nt, Human
cugcuuccauaaauaaugugcu

SEQ ID NO: 591852 - RNA, 22 nt, Human
aacagacaacuccuguggcuca

SEQ ID NO: 591853 - RNA, 22 nt, Human
cauuucuaagaaggcugcacau

SEQ ID NO: 591854 - RNA, 22 nt, Human
caggagauguaagacuucuguu

SEQ ID NO: 591855 - RNA, 20 nt, Human
uagaggggacaaucauugcc

SEQ ID NO: 591856 - RNA, 22 nt, Human
auuggcuuucuuuugugaaaau

SEQ ID NO: 591857 - RNA, 22 nt, Human
agaacauuugucaaaaagccaa

SEQ ID NO: 591858 - RNA, 22 nt, Human
aagaaaugcacacaacugcugg

SEQ ID NO: 591859 - RNA, 22 nt, Human
ccaggaggcagaaguugcagug

SEQ ID NO: 591860 - RNA, 22 nt, Human
agaugggucucccuuagcaccu

SEQ ID NO: 591861 - RNA, 22 nt, Human
auaauauuugcauuacugugau

SEQ ID NO: 591862 - RNA, 22 nt, Human
cuuuacaauucaagggaacucu

SEQ ID NO: 591863 - RNA, 20 nt, Human
uuaucugucaaucugucuca

SEQ ID NO: 591864 - RNA, 22 nt, Human
gaggaaaauauucagggagguu

SEQ ID NO: 591865 - RNA, 22 nt, Human
uaugucuuuaguaucuuuugga

SEQ ID NO: 591866 - RNA, 22 nt, Human
uagcuuugccacacauguagau

SEQ ID NO: 591867 - RNA, 18 nt, Human
gcaggugccacugcuguu

SEQ ID NO: 591868 - RNA, 20 nt, Human
auuagugcaucuggacaugc

SEQ ID NO: 591869 - RNA, 22 nt, Human
uuaaaugacgggacuggguuuu

SEQ ID NO: 591870 - RNA, 23 nt, Human
uggcuccaggagaagccagaagc

SEQ ID NO: 591871 - RNA, 22 nt, Human
caggggcucuaaugcaugauca

SEQ ID NO: 591872 - RNA, 22 nt, Human
cuccucuggcuuccuggaggca

SEQ ID NO: 591873 - RNA, 22 nt, Human
guccagcaggaugcaagugcca

SEQ ID NO: 591874 - RNA, 20 nt, Human
augauagucagaaaacuagc

SEQ ID NO: 591875 - RNA, 22 nt, Human
uuauggaagugcaaauugugug

SEQ ID NO: 591876 - RNA, 22 nt, Human
gccugccacgcaugcagaguca

SEQ ID NO: 591877 - RNA, 22 nt, Human
aucagaccauccagcguggaug

SEQ ID NO: 591878 - RNA, 22 nt, Human
gagcugggacauggguccucuc

SEQ ID NO: 591879 - RNA, 22 nt, Human
auacauucagcagugcucauga

SEQ ID NO: 591880 - RNA, 22 nt, Human
agagacuggcuucuaaaauggc

SEQ ID NO: 591881 - RNA, 22 nt, Human
agcaguggcugacagacuuacc

SEQ ID NO: 591882 - RNA, 22 nt, Human
acaucuuuguuucuuaguguau

SEQ ID NO: 591883 - RNA, 22 nt, Human
ucaguaaaugaaugaauauaug

SEQ ID NO: 591884 - RNA, 22 nt, Human
uguccccagguccucugccguc

SEQ ID NO: 591885 - RNA, 22 nt, Human
caguaccagucaccacauugau

SEQ ID NO: 591886 - RNA, 22 nt, Human
uuccuaacaagggguauucauc

SEQ ID NO: 591887 - RNA, 22 nt, Human
cuugcugagauaaaugcugucu

SEQ ID NO: 591888 - RNA, 22 nt, Human
uaacauuagguagacauaagcc

SEQ ID NO: 591889 - RNA, 22 nt, Human
auguagcaucuauccugauaaa

SEQ ID NO: 591890 - RNA, 22 nt, Human
ggcugccugaggcagugagaga

SEQ ID NO: 591891 - RNA, 22 nt, Human
agaaagggcuauuuugagguag

SEQ ID NO: 591892 - RNA, 19 nt, Human
ucugggaaugaugccagca

SEQ ID NO: 591893 - RNA, 22 nt, Human
ucugcucuaguugcuuccugcc

SEQ ID NO: 591894 - RNA, 22 nt, Human
ucucuguggcaacuacuuagcu

SEQ ID NO: 591895 - RNA, 22 nt, Human
gggauggacugacgguagcgcg

SEQ ID NO: 591896 - RNA, 22 nt, Human
ccaguucugagaugaauaucca

SEQ ID NO: 591897 - RNA, 22 nt, Human
aagaaucauuguaaaguucugu

SEQ ID NO: 591898 - RNA, 22 nt, Human
uuccugaaucccaaggagagcu

SEQ ID NO: 591899 - RNA, 22 nt, Human
aaggccuuucuagcuuugugcu

SEQ ID NO: 591900 - RNA, 18 nt, Human
ggcacuggugaugcagag

SEQ ID NO: 591901 - RNA, 22 nt, Human
cuggccaggccccuugcagggc

SEQ ID NO: 591902 - RNA, 22 nt, Human
ugggcuggcccaccacaccucg

SEQ ID NO: 591903 - RNA, 19 nt, Human
acucuacaguguguacaac

SEQ ID NO: 591904 - RNA, 22 nt, Human
uuaacaaggugacugcauuaaa

SEQ ID NO: 591905 - RNA, 22 nt, Human
agggcuccaaggaaguguagcu

SEQ ID NO: 591906 - RNA, 22 nt, Human
uugagaaaagcuguguaaggau

SEQ ID NO: 591907 - RNA, 18 nt, Human
uaaugauaagccuugaag

SEQ ID NO: 591908 - RNA, 22 nt, Human
uuuaaggaggggcucacguggg

SEQ ID NO: 591909 - RNA, 22 nt, Human
aacauguagcagaaacgacuaa

SEQ ID NO: 591910 - RNA, 22 nt, Human
gagcaagacucacugcaucuug

SEQ ID NO: 591911 - RNA, 22 nt, Human
uuauauaacucaggugggcuca

SEQ ID NO: 591912 - RNA, 22 nt, Human
uggaaauacuugccauaaaacu

SEQ ID NO: 591913 - RNA, 22 nt, Human
gcuggccauauauuuugcuguu

SEQ ID NO: 591914 - RNA, 22 nt, Human
agaaauagucacauuggaggaa

SEQ ID NO: 591915 - RNA, 22 nt, Human
uguagaagcuagccuggagcca

SEQ ID NO: 591916 - RNA, 22 nt, Human
uguccuuagaagaagugaaaga

SEQ ID NO: 591917 - RNA, 22 nt, Human
uuuauuauucuguucucucuac

SEQ ID NO: 591918 - RNA, 20 nt, Human
aggagaaauucgggacaccu

SEQ ID NO: 591919 - RNA, 22 nt, Human
ggcuguccuuggccaaggcacu

SEQ ID NO: 591920 - RNA, 22 nt, Human
ucagacagucaucagagcuugu

SEQ ID NO: 591921 - RNA, 22 nt, Human
auauucacuggguacuaaaaag

SEQ ID NO: 591922 - RNA, 22 nt, Human
agcaaagaaauggaggcucaga

SEQ ID NO: 591923 - RNA, 22 nt, Human
aaguuuagugaaacucuagggg

SEQ ID NO: 591924 - RNA, 22 nt, Human
auacuuuaacguggcgaaccuu

SEQ ID NO: 591925 - RNA, 22 nt, Human
ucuguccuguuuccuccugaca

SEQ ID NO: 591926 - RNA, 22 nt, Human
ggccuugagcagggagaaacca

SEQ ID NO: 591927 - RNA, 22 nt, Human
aguaaaauuaauggaucagaag

SEQ ID NO: 591928 - RNA, 22 nt, Human
uagugauucgauguggguaagu

SEQ ID NO: 591929 - RNA, 22 nt, Human
uugcugaaaacaggucaucagg

SEQ ID NO: 591930 - RNA, 22 nt, Human
ucacagcaacacuggggcagac

SEQ ID NO: 591931 - RNA, 22 nt, Human
uaaguaaaacauucaagaaguc

SEQ ID NO: 591932 - RNA, 22 nt, Human
uauacaauggcugaaucaucca

SEQ ID NO: 591933 - RNA, 22 nt, Human
aguccaggucucugagucacaa

SEQ ID NO: 591934 - RNA, 22 nt, Human
uugcugaaaguggcaagaagua

SEQ ID NO: 591935 - RNA, 22 nt, Human
guuucuuaaauguagcaggacc

SEQ ID NO: 591936 - RNA, 22 nt, Human
uggagccuuuuguucugggaca

SEQ ID NO: 591937 - RNA, 17 nt, Human
caggcacaugaagccag

SEQ ID NO: 591938 - RNA, 22 nt, Human
uuagcauucuucuggggggcac

SEQ ID NO: 591939 - RNA, 22 nt, Human
ccagccugguucagaauuggcu

SEQ ID NO: 591940 - RNA, 21 nt, Human
uuuagcauuuacauauuucca

SEQ ID NO: 591941 - RNA, 22 nt, Human
gugagcaggauuucauggugua

SEQ ID NO: 591942 - RNA, 22 nt, Human
caggaacaccugcagcuagugg

SEQ ID NO: 591943 - RNA, 22 nt, Human
aagacagcagcaccucucguuu

SEQ ID NO: 591944 - RNA, 22 nt, Human
ugugccugucacccucagagag

SEQ ID NO: 591945 - RNA, 22 nt, Human
aaagacacaugucucuuagauu

SEQ ID NO: 591946 - RNA, 20 nt, Human
auuagcuuggagacaguggc

SEQ ID NO: 591947 - RNA, 22 nt, Human
gaggcuggggucugccuuucug

SEQ ID NO: 591948 - RNA, 22 nt, Human
augaaauuuuaauuauaccucu

SEQ ID NO: 591949 - RNA, 22 nt, Human
aaaagagaaaguggcaggcuuu

SEQ ID NO: 591950 - RNA, 22 nt, Human
agcagcuguggaaaaguaacua

SEQ ID NO: 591951 - RNA, 22 nt, Human
auaguacacauccuacaauguu

SEQ ID NO: 591952 - RNA, 22 nt, Human
aacauaaauuugaaguggcaaa

SEQ ID NO: 591953 - RNA, 23 nt, Human
gaagcagaugucugaguaggcag

SEQ ID NO: 591954 - RNA, 22 nt, Human
aacagcuuuagaggauaauagu

SEQ ID NO: 591955 - RNA, 22 nt, Human
acuccugugggcauggcacccc

SEQ ID NO: 591956 - RNA, 22 nt, Human
ggcacaggaaucugugaagugc

SEQ ID NO: 591957 - RNA, 19 nt, Human
ccuccccuuggaccagcaa

SEQ ID NO: 591958 - RNA, 22 nt, Human
auucuucuaauaugaucguguu

SEQ ID NO: 591959 - RNA, 22 nt, Human
uccaugaggcagggaggcuggc

SEQ ID NO: 591960 - RNA, 22 nt, Human
ucagcucacucugcuuccuggg

SEQ ID NO: 591961 - RNA, 22 nt, Human
gcagaccucaggacaucauuag

SEQ ID NO: 591962 - RNA, 22 nt, Human
caaaucuuuaauugaggaauca

SEQ ID NO: 591963 - RNA, 22 nt, Human
cagcagcaugaauucgagccac

SEQ ID NO: 591964 - RNA, 22 nt, Human
acaguggaggccauaugguccu

SEQ ID NO: 591965 - RNA, 22 nt, Human
cugcccucuagggaugcacugg

SEQ ID NO: 591966 - RNA, 22 nt, Human
cugagggccuucuaugcugagc

SEQ ID NO: 591967 - RNA, 22 nt, Human
caucuuaccccugcuaaugacc

SEQ ID NO: 591968 - RNA, 22 nt, Human
uuacagucaggcaugaauucag

SEQ ID NO: 591969 - RNA, 22 nt, Human
aucuggaauccuuguggacaau

SEQ ID NO: 591970 - RNA, 22 nt, Human
acauuugagaugccuuuuaggu

SEQ ID NO: 591971 - RNA, 22 nt, Human
cuuuggcaacacaugugggaca

SEQ ID NO: 591972 - RNA, 22 nt, Human
ccuggagaccugauggcagcgg

SEQ ID NO: 591973 - RNA, 22 nt, Human
gcugcagggaauguauggauuu

SEQ ID NO: 591974 - RNA, 22 nt, Human
auuuccuuugcaaagacugugc

SEQ ID NO: 591975 - RNA, 22 nt, Human
aaaguauucuugacuguuuuuc

SEQ ID NO: 591976 - RNA, 22 nt, Human
uggcccuuguccugggagaguu

SEQ ID NO: 591977 - RNA, 22 nt, Human
guggagcaugugaggacugagu

SEQ ID NO: 591978 - RNA, 21 nt, Human
ucuucccucaggauguccugc

SEQ ID NO: 591979 - RNA, 22 nt, Human
uccagagccuuucugcuugaca

SEQ ID NO: 591980 - RNA, 22 nt, Human
uccaggagggguaggcaguaug

SEQ ID NO: 591981 - RNA, 22 nt, Human
uaacaaugcaaaaugaauuuag

SEQ ID NO: 591982 - RNA, 22 nt, Human
ccacagugaguucuguacucug

SEQ ID NO: 591983 - RNA, 22 nt, Human
ccaguguucaauacauauuugu

SEQ ID NO: 591984 - RNA, 22 nt, Human
gcccuuagccuuauagccucua

SEQ ID NO: 591985 - RNA, 23 nt, Human
cuucucagaagucugugccagga

SEQ ID NO: 591986 - RNA, 22 nt, Human
ugagauggcugggccccaggag

SEQ ID NO: 591987 - RNA, 22 nt, Human
gucuccuggcuuuugucccagu

SEQ ID NO: 591988 - RNA, 22 nt, Human
agacacuggugaagaaaucagg

SEQ ID NO: 591989 - RNA, 22 nt, Human
ugagguaugguaagguaaaauc

SEQ ID NO: 591990 - RNA, 22 nt, Human
aggcacagaauggcauucagug

SEQ ID NO: 591991 - RNA, 22 nt, Human
cagaauuuagcacaauguaugg

SEQ ID NO: 591992 - RNA, 22 nt, Human
uggagauggguuaauggagaga

SEQ ID NO: 591993 - RNA, 22 nt, Human
acagcccguucucuggcacaca

SEQ ID NO: 591994 - RNA, 22 nt, Human
cuguuagugaucaaagggagag

SEQ ID NO: 591995 - RNA, 22 nt, Human
uaaaucaagaauaucagcuugu

SEQ ID NO: 591996 - RNA, 21 nt, Human
cagagccuguguugacaguug

SEQ ID NO: 591997 - RNA, 22 nt, Human
ugaagccaccgaaccagaagag

SEQ ID NO: 591998 - RNA, 22 nt, Human
aagcuggauguaggaucccccu

SEQ ID NO: 591999 - RNA, 22 nt, Human
ucugggcagagggucuuaguca

SEQ ID NO: 592000 - RNA, 22 nt, Human
cugcagggaacugaggcccaga

SEQ ID NO: 592001 - RNA, 22 nt, Human
ccaggaguuugaggcugcagug

SEQ ID NO: 592002 - RNA, 22 nt, Human
uguaaugagucacuuaccuuaa

SEQ ID NO: 592003 - RNA, 22 nt, Human
aaucuguauuguuaacaaguaa

SEQ ID NO: 592004 - RNA, 17 nt, Human
uccugugggugcagcag

SEQ ID NO: 592005 - RNA, 22 nt, Human
uguguuuauaguguaucuucca

SEQ ID NO: 592006 - RNA, 18 nt, Human
gcuccuggaccaggucac

SEQ ID NO: 592007 - RNA, 22 nt, Human
gaaagguuguaacaagacucuu

SEQ ID NO: 592008 - RNA, 18 nt, Human
ugcagccuguagucuugu

SEQ ID NO: 592009 - RNA, 22 nt, Human
gccucagggauaggaugagcau

SEQ ID NO: 592010 - RNA, 22 nt, Human
aauuucagcucaaacuuguguu

SEQ ID NO: 592011 - RNA, 22 nt, Human
aacauaauguggccaaagucac

SEQ ID NO: 592012 - RNA, 22 nt, Human
uccugcagugugucuccugcac

SEQ ID NO: 592013 - RNA, 22 nt, Human
cuccccagcauucugacuuccu

SEQ ID NO: 592014 - RNA, 22 nt, Human
auuuuccucugguuuccccaga

SEQ ID NO: 592015 - RNA, 22 nt, Human
guuaugaaauaaauauagauca

SEQ ID NO: 592016 - RNA, 22 nt, Human
uaagacacauuggaguagauga

SEQ ID NO: 592017 - RNA, 22 nt, Human
aauuccaacagacaaaguuaga

SEQ ID NO: 592018 - RNA, 22 nt, Human
acuguaaaacugcuuuggaaac

SEQ ID NO: 592019 - RNA, 22 nt, Human
gagugugggucucagcuuuaag

SEQ ID NO: 592020 - RNA, 20 nt, Human
uccagcuccguguucuuccu

SEQ ID NO: 592021 - RNA, 22 nt, Human
gggacgggcacggagggcccuc

SEQ ID NO: 592022 - RNA, 22 nt, Human
acaggcaggagcuccccauucc

SEQ ID NO: 592023 - RNA, 21 nt, Human
aaaugaaugugguagugcaag

SEQ ID NO: 592024 - RNA, 22 nt, Human
cuuccugcauugugccagaguu

SEQ ID NO: 592025 - RNA, 22 nt, Human
ggcuucaggggcccagucagca

SEQ ID NO: 592026 - RNA, 22 nt, Human
aaugagacacgugaagcagaug

SEQ ID NO: 592027 - RNA, 22 nt, Human
guuuucugauuagcaaaucuga

SEQ ID NO: 592028 - RNA, 22 nt, Human
uggucucuucuuccaagauggc

SEQ ID NO: 592029 - RNA, 22 nt, Human
aaaguucucuaugguguaaaaa

SEQ ID NO: 592030 - RNA, 22 nt, Human
uaacauuguuaugaaucagguc

SEQ ID NO: 592031 - RNA, 22 nt, Human
agaugaagacucaggagcaggu

SEQ ID NO: 592032 - RNA, 22 nt, Human
gagcuggugaucagcuggagga

SEQ ID NO: 592033 - RNA, 22 nt, Human
cagagcuugaauguccaugguu

SEQ ID NO: 592034 - RNA, 19 nt, Human
auauagcauuauucaauuu

SEQ ID NO: 592035 - RNA, 22 nt, Human
ucacucucuaagcaugacagac

SEQ ID NO: 592036 - RNA, 22 nt, Human
caucaucaaaagugacagagaa

SEQ ID NO: 592037 - RNA, 22 nt, Human
ugccugaauucaauuccuggcu

SEQ ID NO: 592038 - RNA, 22 nt, Human
ugcugccagccaggccauggag

SEQ ID NO: 592039 - RNA, 18 nt, Human
acacuuccugguggugug

SEQ ID NO: 592040 - RNA, 22 nt, Human
aagacuguaugagacaauauaa

SEQ ID NO: 592041 - RNA, 22 nt, Human
uacauucagagaaaguuuccau

SEQ ID NO: 592042 - RNA, 22 nt, Human
agggcagagaucugagugggca

SEQ ID NO: 592043 - RNA, 22 nt, Human
aauguuuuagauuacugcuggg

SEQ ID NO: 592044 - RNA, 22 nt, Human
ucuugcaggcggcucagcaacc

SEQ ID NO: 592045 - RNA, 22 nt, Human
cacacaucaaccuagacauugu

SEQ ID NO: 592046 - RNA, 22 nt, Human
aguccccucuaacccaacuuua

SEQ ID NO: 592047 - RNA, 22 nt, Human
ugccagggagcccugcugacca

SEQ ID NO: 592048 - RNA, 23 nt, Human
ucugggcugagacuuggaagguc

SEQ ID NO: 592049 - RNA, 22 nt, Human
uucuuucuuagcaaucuauggu

SEQ ID NO: 592050 - RNA, 22 nt, Human
ucagaaauuuaggcuggacuug

SEQ ID NO: 592051 - RNA, 22 nt, Human
uuuuaaguuggauugcuaagua

SEQ ID NO: 592052 - RNA, 22 nt, Human
uaaaacuucucauuuuuauggu

SEQ ID NO: 592053 - RNA, 22 nt, Human
ugacagacagcuucucauuuua

SEQ ID NO: 592054 - RNA, 22 nt, Human
cugagaucccaggcaggguggc

SEQ ID NO: 592055 - RNA, 18 nt, Human
cauugacaguauaucuuu

SEQ ID NO: 592056 - RNA, 22 nt, Human
cugaggccgucugggucugcag

SEQ ID NO: 592057 - RNA, 22 nt, Human
uuauuauugugaccugagaaug

SEQ ID NO: 592058 - RNA, 22 nt, Human
gcugccuguccugaggaguccg

SEQ ID NO: 592059 - RNA, 22 nt, Human
uccugcaggcuugaguccucag

SEQ ID NO: 592060 - RNA, 22 nt, Human
uucuuuaaaauagugagaaaga

SEQ ID NO: 592061 - RNA, 22 nt, Human
aacucacuuuguggcuucugaa

SEQ ID NO: 592062 - RNA, 22 nt, Human
uagagcugggcagugcucugag

SEQ ID NO: 592063 - RNA, 22 nt, Human
gcagaugcugagauuuauuucu

SEQ ID NO: 592064 - RNA, 22 nt, Human
auucuucacuguuucagaauga

SEQ ID NO: 592065 - RNA, 22 nt, Human
uggcccugaggggcugugcccc

SEQ ID NO: 592066 - RNA, 22 nt, Human
aaacuacaucucauggaugagg

SEQ ID NO: 592067 - RNA, 22 nt, Human
cacagugcaugaugggcagaag

SEQ ID NO: 592068 - RNA, 22 nt, Human
gggcagcagagcccugccgagu

SEQ ID NO: 592069 - RNA, 22 nt, Human
ucugcagaagaauuaaggacag

SEQ ID NO: 592070 - RNA, 19 nt, Human
acacugaucagaucagcag

SEQ ID NO: 592071 - RNA, 22 nt, Human
gccagggugugcagggacagga

SEQ ID NO: 592072 - RNA, 20 nt, Human
cagauggcacgucagggcau

SEQ ID NO: 592073 - RNA, 22 nt, Human
auucucauaggagcgugaaccu

SEQ ID NO: 592074 - RNA, 22 nt, Human
ugagcccaggaguuggaggcug

SEQ ID NO: 592075 - RNA, 22 nt, Human
ggaggccaggguggguggaucg

SEQ ID NO: 592076 - RNA, 22 nt, Human
aacaaugcacuaucguaagugg

SEQ ID NO: 592077 - RNA, 22 nt, Human
aaauauaccaguugccugcauc

SEQ ID NO: 592078 - RNA, 22 nt, Human
aaauagcugaaaguuccuagau

SEQ ID NO: 592079 - RNA, 21 nt, Human
ucacguggucacaugagcuuu

SEQ ID NO: 592080 - RNA, 22 nt, Human
uggcagggugggcuucagcccc

SEQ ID NO: 592081 - RNA, 19 nt, Human
aaaguuuuauucucauuug

SEQ ID NO: 592082 - RNA, 22 nt, Human
caaauacugaguuuauuuucaa

SEQ ID NO: 592083 - RNA, 22 nt, Human
agggcgacaauggagagcguuu

SEQ ID NO: 592084 - RNA, 22 nt, Human
uuucacaacguuguggugagag

SEQ ID NO: 592085 - RNA, 22 nt, Human
cagggcugaacugagcuuguga

SEQ ID NO: 592086 - RNA, 22 nt, Human
uauaaauuaaugugcccaugag

SEQ ID NO: 592087 - RNA, 22 nt, Human
ucacaagauauuucaguccuuu

SEQ ID NO: 592088 - RNA, 22 nt, Human
aggugucugugaugggagcgau

SEQ ID NO: 592089 - RNA, 22 nt, Human
aauacuuuccuauauaaggugc

SEQ ID NO: 592090 - RNA, 22 nt, Human
uggguaggaccagaaaugcacu

SEQ ID NO: 592091 - RNA, 22 nt, Human
ugcaggaguuaagugcucuccu

SEQ ID NO: 592092 - RNA, 22 nt, Human
agcaccaguuucgucgugacaa

SEQ ID NO: 592093 - RNA, 22 nt, Human
cugacagauuagaugugcauau

SEQ ID NO: 592094 - RNA, 22 nt, Human
uccaggcaaagugcugggcugc

SEQ ID NO: 592095 - RNA, 22 nt, Human
ugaggcucuaugugguagauua

SEQ ID NO: 592096 - RNA, 22 nt, Human
uuugaagacagaucaauauaag

SEQ ID NO: 592097 - RNA, 22 nt, Human
uccuugaauccuagcauccuau

SEQ ID NO: 592098 - RNA, 21 nt, Human
gcagcuggucucagagcuugc

SEQ ID NO: 592099 - RNA, 22 nt, Human
uacugugacagaguacuuaaac

SEQ ID NO: 592100 - RNA, 18 nt, Human
augcaguugguacucuca

SEQ ID NO: 592101 - RNA, 22 nt, Human
acaugcacggcaccaucuucug

SEQ ID NO: 592102 - RNA, 22 nt, Human
gcagggccagggcucaggcugu

SEQ ID NO: 592103 - RNA, 22 nt, Human
ggaagccuaaagcccaggucuc

SEQ ID NO: 592104 - RNA, 22 nt, Human
aagaggaagucuccauggagag

SEQ ID NO: 592105 - RNA, 19 nt, Human
uauuauuuguagcaaggcc

SEQ ID NO: 592106 - RNA, 22 nt, Human
caauaaagaagauuuuugcaau

SEQ ID NO: 592107 - RNA, 22 nt, Human
auucaguuucaaucauuguagu

SEQ ID NO: 592108 - RNA, 22 nt, Human
acacagauuucacuggaauaga

SEQ ID NO: 592109 - RNA, 18 nt, Human
aagugacuggcaggccaa

SEQ ID NO: 592110 - RNA, 22 nt, Human
auuggaaauacaguagaaaaau

SEQ ID NO: 592111 - RNA, 19 nt, Human
agaagcugugaaaugaagg

SEQ ID NO: 592112 - RNA, 22 nt, Human
ugagguggugcuaaucucugcu

SEQ ID NO: 592113 - RNA, 20 nt, Human
gaaucuuacuacauucucuc

SEQ ID NO: 592114 - RNA, 22 nt, Human
gacccuggcugccgcggucugg

SEQ ID NO: 592115 - RNA, 22 nt, Human
uaggccacagaugagacauaag

SEQ ID NO: 592116 - RNA, 20 nt, Human
cauauauaccuagaagugga

SEQ ID NO: 592117 - RNA, 22 nt, Human
ccgcgccacccauucccacuga

SEQ ID NO: 592118 - RNA, 22 nt, Human
aagugaauuucauuccaauucu

SEQ ID NO: 592119 - RNA, 22 nt, Human
caggcaugcuucugucugggca

SEQ ID NO: 592120 - RNA, 22 nt, Human
caggaaggaccguccagaucag

SEQ ID NO: 592121 - RNA, 22 nt, Human
gcugccuuaugucuauuaguau

SEQ ID NO: 592122 - RNA, 18 nt, Human
uagagggggccugggcau

SEQ ID NO: 592123 - RNA, 22 nt, Human
gcuuuaaugcuucguggggcca

SEQ ID NO: 592124 - RNA, 22 nt, Human
gcacuaguucuacugccagcaa

SEQ ID NO: 592125 - RNA, 19 nt, Human
ggacauuugaguuguuuau

SEQ ID NO: 592126 - RNA, 22 nt, Human
gacugcuugagaaggaacaaau

SEQ ID NO: 592127 - RNA, 22 nt, Human
caagguuuuggaagauuuucgu

SEQ ID NO: 592128 - RNA, 22 nt, Human
uccagggagagccgcugcucca

SEQ ID NO: 592129 - RNA, 22 nt, Human
acaggcuuuuuuagaaugacau

SEQ ID NO: 592130 - RNA, 22 nt, Human
gccuaacuuggcuuuguucacc

SEQ ID NO: 592131 - RNA, 22 nt, Human
augagguaagcacugggcccaa

SEQ ID NO: 592132 - RNA, 22 nt, Human
caugcuuucuguccaaauguua

SEQ ID NO: 592133 - RNA, 22 nt, Human
cugcagggguguccuguauugg

SEQ ID NO: 592134 - RNA, 22 nt, Human
ucuuuacaagucacauuuucug

SEQ ID NO: 592135 - RNA, 23 nt, Human
ucucugguuaggggagauuggug

SEQ ID NO: 592136 - RNA, 19 nt, Human
augggcuauggugcuguuu

SEQ ID NO: 592137 - RNA, 22 nt, Human
uauguuuaaauguauguguaug

SEQ ID NO: 592138 - RNA, 19 nt, Human
auaacuacauuggcucagu

SEQ ID NO: 592139 - RNA, 20 nt, Human
cgcuccagucgcuggugugu

SEQ ID NO: 592140 - RNA, 22 nt, Human
cagguccuggcaucaggcaggu

SEQ ID NO: 592141 - RNA, 22 nt, Human
caugaauuuauauuauuaguga

SEQ ID NO: 592142 - RNA, 22 nt, Human
acaggcacaccuuccugcaggc

SEQ ID NO: 592143 - RNA, 22 nt, Human
gaauuugcaggugugcugugua

SEQ ID NO: 592144 - RNA, 22 nt, Human
cugugccugccuuguucacuga

SEQ ID NO: 592145 - RNA, 22 nt, Human
acagugucugacacauuguagc

SEQ ID NO: 592146 - RNA, 22 nt, Human
caggcuggagugcaauggugcu

SEQ ID NO: 592147 - RNA, 22 nt, Human
cuaguucugccauucaguguca

SEQ ID NO: 592148 - RNA, 22 nt, Human
uccauuuucuaaguaucacuua

SEQ ID NO: 592149 - RNA, 22 nt, Human
ugccugagguggucugcaaaug

SEQ ID NO: 592150 - RNA, 22 nt, Human
acccaggaaaacauggugcaga

SEQ ID NO: 592151 - RNA, 22 nt, Human
augagguagcuuggcccagggg

SEQ ID NO: 592152 - RNA, 22 nt, Human
cuccuguauguugggcuucaca

SEQ ID NO: 592153 - RNA, 22 nt, Human
uagcaauguguugacuugguca

SEQ ID NO: 592154 - RNA, 22 nt, Human
ugccaggcaggacccuagaacc

SEQ ID NO: 592155 - RNA, 22 nt, Human
cacaggcucuucucacuugauu

SEQ ID NO: 592156 - RNA, 22 nt, Human
uuuguucaugccuauauucuca

SEQ ID NO: 592157 - RNA, 22 nt, Human
gucuccaguuacagcagccagg

SEQ ID NO: 592158 - RNA, 22 nt, Human
uggcacuguggauuucacaagu

SEQ ID NO: 592159 - RNA, 22 nt, Human
uuauaugaguaucauaucacuu

SEQ ID NO: 592160 - RNA, 22 nt, Human
uuuccucugacugcuccccugc

SEQ ID NO: 592161 - RNA, 22 nt, Human
uccugagggcugcagucauagg

SEQ ID NO: 592162 - RNA, 22 nt, Human
uccuucagcuuguuagagugac

SEQ ID NO: 592163 - RNA, 22 nt, Human
cuguguggccucaagccagccu

SEQ ID NO: 592164 - RNA, 22 nt, Human
uggcuggaaacaggagauucag

SEQ ID NO: 592165 - RNA, 22 nt, Human
ucucuuccaguaagagucuuua

SEQ ID NO: 592166 - RNA, 22 nt, Human
auaauguugaugauugucuuug

SEQ ID NO: 592167 - RNA, 22 nt, Human
acaguagucucaggaauaggca

SEQ ID NO: 592168 - RNA, 21 nt, Human
agcagacagcccaagaaaauc

SEQ ID NO: 592169 - RNA, 22 nt, Human
uguugccuggggaagcucugau

SEQ ID NO: 592170 - RNA, 22 nt, Human
uaggccacagagaggagauuuc

SEQ ID NO: 592171 - RNA, 22 nt, Human
aggcacugggaauaugcugagg

SEQ ID NO: 592172 - RNA, 22 nt, Human
gauaaaauucuuauuuuacccg

SEQ ID NO: 592173 - RNA, 20 nt, Human
agguccacugaggcugccuc

SEQ ID NO: 592174 - RNA, 22 nt, Human
gggcacugaguggaugaugcag

SEQ ID NO: 592175 - RNA, 22 nt, Human
cuggcccuguggaggcaggaac

SEQ ID NO: 592176 - RNA, 20 nt, Human
agagccuggaaaaagacauc

SEQ ID NO: 592177 - RNA, 20 nt, Human
gcugaagauucccaugcaag

SEQ ID NO: 592178 - RNA, 23 nt, Human
agcuccaggugauuguaaugugu

SEQ ID NO: 592179 - RNA, 22 nt, Human
uaaaugcaguacaaauuguucu

SEQ ID NO: 592180 - RNA, 19 nt, Human
cugcucagagcagcuccag

SEQ ID NO: 592181 - RNA, 19 nt, Human
agcuaagacaagggacauc

SEQ ID NO: 592182 - RNA, 22 nt, Human
acucccacuccagaguagaagc

SEQ ID NO: 592183 - RNA, 22 nt, Human
ucucugcucugugccucaguuu

SEQ ID NO: 592184 - RNA, 22 nt, Human
ugaggggaacugaugcccauug

SEQ ID NO: 592185 - RNA, 22 nt, Human
uaagacagggagggcucucagc

SEQ ID NO: 592186 - RNA, 22 nt, Human
acauuugggacccucucuucac

SEQ ID NO: 592187 - RNA, 22 nt, Human
gucuccugcccccggugcuugg

SEQ ID NO: 592188 - RNA, 23 nt, Human
agcaauaagaagggauacaugug

SEQ ID NO: 592189 - RNA, 22 nt, Human
agcuguuuaaaugacuuacuuu

SEQ ID NO: 592190 - RNA, 22 nt, Human
uccagcccucagccaaguggaa

SEQ ID NO: 592191 - RNA, 23 nt, Human
cuguagcuaaaagcugggauuug

SEQ ID NO: 592192 - RNA, 22 nt, Human
gauuuacagguuagguccugua

SEQ ID NO: 592193 - RNA, 22 nt, Human
gcaguccuuaggagaggaagua

SEQ ID NO: 592194 - RNA, 22 nt, Human
agcauuccacacugaagucugc

SEQ ID NO: 592195 - RNA, 22 nt, Human
agggcagaaauauugauacugu

SEQ ID NO: 592196 - RNA, 22 nt, Human
ggcagggaaacagcugauccca

SEQ ID NO: 592197 - RNA, 22 nt, Human
accuuucguccugguuccuccg

SEQ ID NO: 592198 - RNA, 22 nt, Human
ucucuccuguguucugauguuu

SEQ ID NO: 592199 - RNA, 22 nt, Human
gggaggagggugcuggcuaaac

SEQ ID NO: 592200 - RNA, 22 nt, Human
aucaagaacuuauuuuggaaau

SEQ ID NO: 592201 - RNA, 22 nt, Human
gcaaagaaaugucagugagagg

SEQ ID NO: 592202 - RNA, 22 nt, Human
uuuuauugucuguauugccuau

SEQ ID NO: 592203 - RNA, 19 nt, Human
aagagcagggaaagaauug

SEQ ID NO: 592204 - RNA, 22 nt, Human
aacaggcaaacugugggauccc

SEQ ID NO: 592205 - RNA, 23 nt, Human
gugcaugugucuuuacaguagca

SEQ ID NO: 592206 - RNA, 22 nt, Human
ucuacuuuucccuauacaguuu

SEQ ID NO: 592207 - RNA, 22 nt, Human
auggaaauaucuuuagagcuua

SEQ ID NO: 592208 - RNA, 22 nt, Human
ucccugggguaucgcugaggca

SEQ ID NO: 592209 - RNA, 22 nt, Human
ugagucacacauuucuucauac

SEQ ID NO: 592210 - RNA, 22 nt, Human
uucuuucucuccacaaggcuug

SEQ ID NO: 592211 - RNA, 22 nt, Human
ugcagggcagcuagggagcuuu

SEQ ID NO: 592212 - RNA, 22 nt, Human
cugggugauuccuguccaggca

SEQ ID NO: 592213 - RNA, 22 nt, Human
ccaggcuguaagagugauguug

SEQ ID NO: 592214 - RNA, 22 nt, Human
uaaagugaaguucagaauggcu

SEQ ID NO: 592215 - RNA, 22 nt, Human
ggcaauuacguauuagucaugu

SEQ ID NO: 592216 - RNA, 22 nt, Human
uggcugagagaagacggggaag

SEQ ID NO: 592217 - RNA, 22 nt, Human
agucacuuccagacaccugccu

SEQ ID NO: 592218 - RNA, 22 nt, Human
aaaguguugauaugugacaucc

SEQ ID NO: 592219 - RNA, 22 nt, Human
ggcacagcaccuuuucacauug

SEQ ID NO: 592220 - RNA, 20 nt, Human
agccugccagcuggcccaga

SEQ ID NO: 592221 - RNA, 22 nt, Human
aguuucucuuaaucuaguaucu

SEQ ID NO: 592222 - RNA, 22 nt, Human
agugaaauacugucguuuuuag

SEQ ID NO: 592223 - RNA, 22 nt, Human
aagucaaucacaugcacacuga

SEQ ID NO: 592224 - RNA, 22 nt, Human
ccagcacucugucccagcuucc

SEQ ID NO: 592225 - RNA, 22 nt, Human
cauguguuuugucauuucaaua

SEQ ID NO: 592226 - RNA, 22 nt, Human
cauaacuguuaagauaauuuuu

SEQ ID NO: 592227 - RNA, 22 nt, Human
gaagccaguacugugcucugca

SEQ ID NO: 592228 - RNA, 22 nt, Human
ggccucagaaauagaguaaaau

SEQ ID NO: 592229 - RNA, 22 nt, Human
cugggcaccuuugcagcaggcu

SEQ ID NO: 592230 - RNA, 22 nt, Human
auaugaaaagaagucaccauug

SEQ ID NO: 592231 - RNA, 18 nt, Human
auauguuaauuagguagg

SEQ ID NO: 592232 - RNA, 22 nt, Human
acucugggccccagguggagcu

SEQ ID NO: 592233 - RNA, 22 nt, Human
acuguaaccaguguggugagag

SEQ ID NO: 592234 - RNA, 22 nt, Human
gugggacucuucuuuggcagug

SEQ ID NO: 592235 - RNA, 22 nt, Human
ccuucgagauuuaaacacugau

SEQ ID NO: 592236 - RNA, 22 nt, Human
cacaggaggaggugcccgggcc

SEQ ID NO: 592237 - RNA, 22 nt, Human
cuucagggugacgcaggcugca

SEQ ID NO: 592238 - RNA, 21 nt, Human
aauggaaguuuaaagguaucc

SEQ ID NO: 592239 - RNA, 22 nt, Human
cagcaagaaaauucacaugcuc

SEQ ID NO: 592240 - RNA, 22 nt, Human
agcagccuggacuuggaugugg

SEQ ID NO: 592241 - RNA, 22 nt, Human
gccugggagagggauagugcag

SEQ ID NO: 592242 - RNA, 22 nt, Human
accuuagcuguuaaaacuaagu

SEQ ID NO: 592243 - RNA, 22 nt, Human
gggcuagaaguuagcuagagaa

SEQ ID NO: 592244 - RNA, 22 nt, Human
ggcugcagggcagcuggugugg

SEQ ID NO: 592245 - RNA, 22 nt, Human
aaaucagaaaauauggagagga

SEQ ID NO: 592246 - RNA, 22 nt, Human
aagauaaacucuugauuucuga

SEQ ID NO: 592247 - RNA, 22 nt, Human
auucugcagguggaggauggca

SEQ ID NO: 592248 - RNA, 22 nt, Human
aggaacaacugauucagucaac

SEQ ID NO: 592249 - RNA, 22 nt, Human
cagagcugcgcuuuuuccuggu

SEQ ID NO: 592250 - RNA, 21 nt, Human
aguguccuugaucuugccuug

SEQ ID NO: 592251 - RNA, 22 nt, Human
uggagagugguuugggggacau

SEQ ID NO: 592252 - RNA, 22 nt, Human
uggcaguccagacccuggacuc

SEQ ID NO: 592253 - RNA, 22 nt, Human
uuucacaaacugaggagacaau

SEQ ID NO: 592254 - RNA, 21 nt, Human
aguuuccucaacugcagaagg

SEQ ID NO: 592255 - RNA, 22 nt, Human
ucagggcacauucugcaguggc

SEQ ID NO: 592256 - RNA, 22 nt, Human
guauuagcugccuuggagcuaa

SEQ ID NO: 592257 - RNA, 22 nt, Human
uggcugagaaugggaugaugcc

SEQ ID NO: 592258 - RNA, 22 nt, Human
agcugucuuucugccuccugau

SEQ ID NO: 592259 - RNA, 22 nt, Human
agcugagccagcagcaacagga

SEQ ID NO: 592260 - RNA, 22 nt, Human
agggaccucuucuugcagcuga

SEQ ID NO: 592261 - RNA, 22 nt, Human
caaaugaauauuuccauggguu

SEQ ID NO: 592262 - RNA, 22 nt, Human
gaaggagagagacaucgucccu

SEQ ID NO: 592263 - RNA, 22 nt, Human
ucuuaaagcuuacuucaauugu

SEQ ID NO: 592264 - RNA, 22 nt, Human
aguugcagccuucaggagaccc

SEQ ID NO: 592265 - RNA, 22 nt, Human
ugaggugggcuuguggauuugc

SEQ ID NO: 592266 - RNA, 21 nt, Human
uguaaguuucaucugaauugg

SEQ ID NO: 592267 - RNA, 19 nt, Human
ugggcagugccagggcuua

SEQ ID NO: 592268 - RNA, 22 nt, Human
ugugguagucucagggcaguau

SEQ ID NO: 592269 - RNA, 22 nt, Human
cagcuguuacucugaguaaaug

SEQ ID NO: 592270 - RNA, 22 nt, Human
cugugcaguaggucagggcugg

SEQ ID NO: 592271 - RNA, 22 nt, Human
aagaguuucugauucaguaggu

SEQ ID NO: 592272 - RNA, 22 nt, Human
guccacugcugugugcuucacc

SEQ ID NO: 592273 - RNA, 22 nt, Human
auagcaagcguucccaagccac

SEQ ID NO: 592274 - RNA, 22 nt, Human
ucuggaguggagcugaucauuu

SEQ ID NO: 592275 - RNA, 21 nt, Human
ugcaggaaagugcugcgaccc

SEQ ID NO: 592276 - RNA, 23 nt, Human
cuucagcagaaacauaaauucuc

SEQ ID NO: 592277 - RNA, 22 nt, Human
auggucaaagauaaagugaucu

SEQ ID NO: 592278 - RNA, 22 nt, Human
caguggcauacuuggcugauau

SEQ ID NO: 592279 - RNA, 22 nt, Human
auuauuagacuuauaugguagu

SEQ ID NO: 592280 - RNA, 22 nt, Human
gcugagaguccaggaaaacauc

SEQ ID NO: 592281 - RNA, 22 nt, Human
agugcuggauuacaggcgugag

SEQ ID NO: 592282 - RNA, 22 nt, Human
ugggccuggacaucuguauuuu

SEQ ID NO: 592283 - RNA, 22 nt, Human
gcccucagcaggaaagaucaac

SEQ ID NO: 592284 - RNA, 22 nt, Human
acagaaaaguuuacuuuugcuc

SEQ ID NO: 592285 - RNA, 22 nt, Human
uucugcauacacugaauguagu

SEQ ID NO: 592286 - RNA, 22 nt, Human
cauagcaaggugcuuuccacau

SEQ ID NO: 592287 - RNA, 22 nt, Human
uuguccuggagguuaauagagu

SEQ ID NO: 592288 - RNA, 22 nt, Human
aaagccaaaugaaagaugguuc

SEQ ID NO: 592289 - RNA, 22 nt, Human
ugggagcaguugcaucuccagu

SEQ ID NO: 592290 - RNA, 22 nt, Human
accagggcacaggagucugaag

SEQ ID NO: 592291 - RNA, 22 nt, Human
uuuuauauggcacauugguugg

SEQ ID NO: 592292 - RNA, 22 nt, Human
aggaccagccuccaggucucuu

SEQ ID NO: 592293 - RNA, 22 nt, Human
uggucucugagccuuccugugg

SEQ ID NO: 592294 - RNA, 22 nt, Human
aguuucucuagagucuuugaaa

SEQ ID NO: 592295 - RNA, 22 nt, Human
caggggccaaggguccagaccu

SEQ ID NO: 592296 - RNA, 22 nt, Human
gauuucucaauccuaguacuau

SEQ ID NO: 592297 - RNA, 20 nt, Human
ugcugagguugacaugccca

SEQ ID NO: 592298 - RNA, 22 nt, Human
uucugcagcccaacaguaguuu

SEQ ID NO: 592299 - RNA, 22 nt, Human
aaaguguuuuugagcuguaguu

SEQ ID NO: 592300 - RNA, 22 nt, Human
cucuagcuuuugauaccagugu

SEQ ID NO: 592301 - RNA, 22 nt, Human
ucaguaaauaacucagaugcuc

SEQ ID NO: 592302 - RNA, 22 nt, Human
uggggccagcggggaggacuca

SEQ ID NO: 592303 - RNA, 22 nt, Human
ccuguccuccaagagcacaucu

SEQ ID NO: 592304 - RNA, 21 nt, Human
uaggcagaggagcagguaucu

SEQ ID NO: 592305 - RNA, 18 nt, Human
cuggcuuucuuauccauc

SEQ ID NO: 592306 - RNA, 22 nt, Human
cagagccagcaguggggacagg

SEQ ID NO: 592307 - RNA, 22 nt, Human
cagcuauuauuuucucuaaauu

SEQ ID NO: 592308 - RNA, 22 nt, Human
uauaggaaaggaguggucacaa

SEQ ID NO: 592309 - RNA, 22 nt, Human
cugucuggauauaccuuggcca

SEQ ID NO: 592310 - RNA, 22 nt, Human
aauauuugaacagucacugagu

SEQ ID NO: 592311 - RNA, 22 nt, Human
ggagcuggcccucugaguuugu

SEQ ID NO: 592312 - RNA, 17 nt, Human
ggagacagggucuuuaa

SEQ ID NO: 592313 - RNA, 22 nt, Human
ugaaaugcuguagagacuguau

SEQ ID NO: 592314 - RNA, 22 nt, Human
agaaagggagcguggaucaauu

SEQ ID NO: 592315 - RNA, 22 nt, Human
auucaucuguacuucaauaucu

SEQ ID NO: 592316 - RNA, 20 nt, Human
uccagggcaacuagagugug

SEQ ID NO: 592317 - RNA, 22 nt, Human
aggcuggagagugcaguggcgu

SEQ ID NO: 592318 - RNA, 19 nt, Human
cugaagucuuuucagcugg

SEQ ID NO: 592319 - RNA, 22 nt, Human
gggugagggaugagccuucuuc

SEQ ID NO: 592320 - RNA, 22 nt, Human
gaggcagagucacaaagagucu

SEQ ID NO: 592321 - RNA, 22 nt, Human
caugagaaguggccuucaaaaa

SEQ ID NO: 592322 - RNA, 22 nt, Human
ggcugagacuagagugaggcau

SEQ ID NO: 592323 - RNA, 22 nt, Human
gggggaagacugggcuagugau

SEQ ID NO: 592324 - RNA, 22 nt, Human
uaguccuugguaaaauucuaug

SEQ ID NO: 592325 - RNA, 22 nt, Human
acacauguucaagaauguucag

SEQ ID NO: 592326 - RNA, 22 nt, Human
cacccugcucugcugugcggcc

SEQ ID NO: 592327 - RNA, 22 nt, Human
uucaaauuaccacauuugcuua

SEQ ID NO: 592328 - RNA, 22 nt, Human
uguuaacagccagauuugguga

SEQ ID NO: 592329 - RNA, 22 nt, Human
guaaauuucccgggccauuuaa

SEQ ID NO: 592330 - RNA, 22 nt, Human
gaccuccguguacaccucccag

SEQ ID NO: 592331 - RNA, 18 nt, Human
caggagcaggaguugaac

SEQ ID NO: 592332 - RNA, 22 nt, Human
uaagaggcaaaagauacucaga

SEQ ID NO: 592333 - RNA, 22 nt, Human
ugcuuaaaaugaugauuauuuu

SEQ ID NO: 592334 - RNA, 22 nt, Human
cauucauucagcaacuguuauu

SEQ ID NO: 592335 - RNA, 19 nt, Human
cccugcccuggugacuggg

SEQ ID NO: 592336 - RNA, 22 nt, Human
ugcugagggcagaugaauuaga

SEQ ID NO: 592337 - RNA, 22 nt, Human
acaggcagauuaaggguaggca

SEQ ID NO: 592338 - RNA, 22 nt, Human
cagccagaucaaacucagaugu

SEQ ID NO: 592339 - RNA, 22 nt, Human
gagcacaggcuuugguggacac

SEQ ID NO: 592340 - RNA, 22 nt, Human
ccugaggucaugcauuuccaac

SEQ ID NO: 592341 - RNA, 22 nt, Human
augacagaaggccucccugaca

SEQ ID NO: 592342 - RNA, 22 nt, Human
accagaggaagggaaucucaag

SEQ ID NO: 592343 - RNA, 21 nt, Human
ggcagcacuaccugaagcaua

SEQ ID NO: 592344 - RNA, 22 nt, Human
aacaauuaucauauacauugca

SEQ ID NO: 592345 - RNA, 22 nt, Human
cacaugcauaccuauguguaua

SEQ ID NO: 592346 - RNA, 22 nt, Human
ccagggccaagagaccucgagg

SEQ ID NO: 592347 - RNA, 22 nt, Human
ugcagugguugagagcccagac

SEQ ID NO: 592348 - RNA, 22 nt, Human
aauuucacuggaaaagauaauu

SEQ ID NO: 592349 - RNA, 22 nt, Human
uccaggacuagcauuucugaua

SEQ ID NO: 592350 - RNA, 22 nt, Human
agaguuugaaguuaucuuugac

SEQ ID NO: 592351 - RNA, 22 nt, Human
agaguuuguguccuuuaucagg

SEQ ID NO: 592352 - RNA, 22 nt, Human
ugagcugucuaugguccugucu

SEQ ID NO: 592353 - RNA, 22 nt, Human
aagccacuuucagcugucucag

SEQ ID NO: 592354 - RNA, 22 nt, Human
aagaagguguggaaagaugcuc

SEQ ID NO: 592355 - RNA, 22 nt, Human
uugugaauggugccgcaauaaa

SEQ ID NO: 592356 - RNA, 22 nt, Human
agggccagaguacaucagggcu

SEQ ID NO: 592357 - RNA, 22 nt, Human
augucuuucaaauucugccuag

SEQ ID NO: 592358 - RNA, 22 nt, Human
agcuggaggaguuucuccuagc

SEQ ID NO: 592359 - RNA, 22 nt, Human
gagacuuagagcuccuugaggg

SEQ ID NO: 592360 - RNA, 22 nt, Human
aggcugaggagggauguugcuu

SEQ ID NO: 592361 - RNA, 22 nt, Human
aaggccaggccagaugacaguc

SEQ ID NO: 592362 - RNA, 22 nt, Human
agauauaauaauuuacaagugu

SEQ ID NO: 592363 - RNA, 22 nt, Human
uucucuggccauagcuggcuag

SEQ ID NO: 592364 - RNA, 22 nt, Human
uucaugcuuuuaccgcuguuaa

SEQ ID NO: 592365 - RNA, 22 nt, Human
gagccaccuucaacucaggaau

SEQ ID NO: 592366 - RNA, 22 nt, Human
uggagcaggacugcugcccuca

SEQ ID NO: 592367 - RNA, 22 nt, Human
caucaguguggcaguucacugu

SEQ ID NO: 592368 - RNA, 22 nt, Human
gcuuccuaaaugcacagggcag

SEQ ID NO: 592369 - RNA, 22 nt, Human
acagagcauauaaagugcuuug

SEQ ID NO: 592370 - RNA, 22 nt, Human
acugucucucuagcaguucagg

SEQ ID NO: 592371 - RNA, 22 nt, Human
acacaucaugccaaguuucacc

SEQ ID NO: 592372 - RNA, 22 nt, Human
gagcucccaggccccagcaagg

SEQ ID NO: 592373 - RNA, 22 nt, Human
cagugccaugucugagccccua

SEQ ID NO: 592374 - RNA, 22 nt, Human
ccucaggcuagcuacugucccu

SEQ ID NO: 592375 - RNA, 18 nt, Human
uuuuucugauaaaacaag

SEQ ID NO: 592376 - RNA, 23 nt, Human
ucuggcuccauccuuggggaucc

SEQ ID NO: 592377 - RNA, 19 nt, Human
cagagccuucagugacucc

SEQ ID NO: 592378 - RNA, 22 nt, Human
aagucugagagaaacucucuca

SEQ ID NO: 592379 - RNA, 22 nt, Human
cuucccacagaauucaaucagu

SEQ ID NO: 592380 - RNA, 22 nt, Human
agggcccaccuuggugcugagg

SEQ ID NO: 592381 - RNA, 22 nt, Human
gaggggagacagggaaaucagu

SEQ ID NO: 592382 - RNA, 22 nt, Human
accugagccuagggagguugag

SEQ ID NO: 592383 - RNA, 22 nt, Human
cauuauauuacagcacuguuaa

SEQ ID NO: 592384 - RNA, 20 nt, Human
uucaugguguauuucuuucu

SEQ ID NO: 592385 - RNA, 19 nt, Human
uucccagagccaugaguga

SEQ ID NO: 592386 - RNA, 18 nt, Human
auuucucuggggugauuc

SEQ ID NO: 592387 - RNA, 22 nt, Human
aauggcaaggaaaccguuacca

SEQ ID NO: 592388 - RNA, 19 nt, Human
cugaaacacagagagggcu

SEQ ID NO: 592389 - RNA, 22 nt, Human
gaguguggaucccagaagcaga

SEQ ID NO: 592390 - RNA, 22 nt, Human
agcagggcuugccgcuuguccu

SEQ ID NO: 592391 - RNA, 22 nt, Human
uuggcucagcaucuuggugcca

SEQ ID NO: 592392 - RNA, 22 nt, Human
gagggagaaggacuaucaggcu

SEQ ID NO: 592393 - RNA, 22 nt, Human
auacaguaagugucccugaaac

SEQ ID NO: 592394 - RNA, 22 nt, Human
gaaauaauucugugucugaaca

SEQ ID NO: 592395 - RNA, 22 nt, Human
agugucuuugacacauucaaag

SEQ ID NO: 592396 - RNA, 22 nt, Human
aaagaggggacuguuaauucca

SEQ ID NO: 592397 - RNA, 22 nt, Human
gccacagcuuagaucacagccu

SEQ ID NO: 592398 - RNA, 21 nt, Human
ccugagccuguuuauccagaa

SEQ ID NO: 592399 - RNA, 17 nt, Human
auuuguaacuagcucuu

SEQ ID NO: 592400 - RNA, 22 nt, Human
acagugagauccaagggcaggc

SEQ ID NO: 592401 - RNA, 22 nt, Human
uagcaaugcucuaugaugaaaa

SEQ ID NO: 592402 - RNA, 22 nt, Human
cugugagggccagagucagggc

SEQ ID NO: 592403 - RNA, 22 nt, Human
gagggcugauguugccaccuca

SEQ ID NO: 592404 - RNA, 22 nt, Human
uggcugccuuucaccucaucuc

SEQ ID NO: 592405 - RNA, 22 nt, Human
agccccuguacccugagugcuu

SEQ ID NO: 592406 - RNA, 22 nt, Human
uuugcaauuugugcugcaaaug

SEQ ID NO: 592407 - RNA, 22 nt, Human
gaagggaaggaaagaaccagca

SEQ ID NO: 592408 - RNA, 22 nt, Human
acagaggggucacagccugaag

SEQ ID NO: 592409 - RNA, 20 nt, Human
gggaguggugguagccugug

SEQ ID NO: 592410 - RNA, 22 nt, Human
uuggaggggccacugcagagcu

SEQ ID NO: 592411 - RNA, 22 nt, Human
acagagcauuugggacagagag

SEQ ID NO: 592412 - RNA, 22 nt, Human
cuaauuauguuguuauaaucaa

SEQ ID NO: 592413 - RNA, 22 nt, Human
auuuugaaauacuugaaggaaa

SEQ ID NO: 592414 - RNA, 22 nt, Human
cugcagggauugcuucuguaua

SEQ ID NO: 592415 - RNA, 22 nt, Human
agcugccuguccuaggccauca

SEQ ID NO: 592416 - RNA, 22 nt, Human
uccugccuuagagcaaggaaaa

SEQ ID NO: 592417 - RNA, 19 nt, Human
agcugcagaccagaagugc

SEQ ID NO: 592418 - RNA, 22 nt, Human
uaucagaagacuuacaguaucg

SEQ ID NO: 592419 - RNA, 22 nt, Human
uguuuuaagggucaacugucac

SEQ ID NO: 592420 - RNA, 22 nt, Human
uccaccagccaggcccaggcug

SEQ ID NO: 592421 - RNA, 23 nt, Human
uuggaacacaguaaaugcacaau

SEQ ID NO: 592422 - RNA, 23 nt, Human
aaauauucuuuuuuaguaagugc

SEQ ID NO: 592423 - RNA, 22 nt, Human
agugaaaaccuaaucaugcagu

SEQ ID NO: 592424 - RNA, 22 nt, Human
ccaaggcuguggggcugugcag

SEQ ID NO: 592425 - RNA, 22 nt, Human
aggcaguuguagagagggcucu

SEQ ID NO: 592426 - RNA, 22 nt, Human
ugcugccaccccucaccagagc

SEQ ID NO: 592427 - RNA, 22 nt, Human
uuuucaucucugcuuuguaccu

SEQ ID NO: 592428 - RNA, 22 nt, Human
uccugggccuguacuccauccg

SEQ ID NO: 592429 - RNA, 22 nt, Human
gaauacaagccugccaccugga

SEQ ID NO: 592430 - RNA, 22 nt, Human
acuccagaggcagcugugcuga

SEQ ID NO: 592431 - RNA, 22 nt, Human
agccuggagaagauguguauug

SEQ ID NO: 592432 - RNA, 22 nt, Human
caccagggcucugagcucugaa

SEQ ID NO: 592433 - RNA, 22 nt, Human
cuggagaaacaucaggcauagg

SEQ ID NO: 592434 - RNA, 22 nt, Human
gaugauauuuugacuggagaau

SEQ ID NO: 592435 - RNA, 22 nt, Human
gugucccagcagcacauuggcu

SEQ ID NO: 592436 - RNA, 22 nt, Human
cauuccaaguauauacaugaua

SEQ ID NO: 592437 - RNA, 22 nt, Human
auauuucacguagguuguuuuc

SEQ ID NO: 592438 - RNA, 22 nt, Human
cgggcuggcugcagcugcugga

SEQ ID NO: 592439 - RNA, 22 nt, Human
ccuuucugacagugaugggggg

SEQ ID NO: 592440 - RNA, 22 nt, Human
uguuuucuggguggaagguacu

SEQ ID NO: 592441 - RNA, 20 nt, Human
uggauucuggagcugcccuc

SEQ ID NO: 592442 - RNA, 22 nt, Human
guggcccugucccaggccuccu

SEQ ID NO: 592443 - RNA, 22 nt, Human
ugagguagguugaaagauagau

SEQ ID NO: 592444 - RNA, 22 nt, Human
uucucaguuucacugauaacag

SEQ ID NO: 592445 - RNA, 22 nt, Human
cauauucaagggguaaggcaaa

SEQ ID NO: 592446 - RNA, 22 nt, Human
ggucagggggaucugugaggua

SEQ ID NO: 592447 - RNA, 22 nt, Human
auuugcaugcuucuauugugaa

SEQ ID NO: 592448 - RNA, 18 nt, Human
cgauguguaugugauuug

SEQ ID NO: 592449 - RNA, 22 nt, Human
aacaaugaccacacaauguacu

SEQ ID NO: 592450 - RNA, 22 nt, Human
uuuugaaagggugauuuggcuu

SEQ ID NO: 592451 - RNA, 22 nt, Human
ucaauagcaaucaagccuucca

SEQ ID NO: 592452 - RNA, 22 nt, Human
cugccuucaucucugagcuggg

SEQ ID NO: 592453 - RNA, 22 nt, Human
aggccagauauugugcuaccca

SEQ ID NO: 592454 - RNA, 22 nt, Human
ggacugaggacaugugaggcau

SEQ ID NO: 592455 - RNA, 22 nt, Human
gauaugaaguggcauugugaag

SEQ ID NO: 592456 - RNA, 22 nt, Human
uugcugauggagggaaugcuca

SEQ ID NO: 592457 - RNA, 22 nt, Human
aauucaaagacuagaauuuugc

SEQ ID NO: 592458 - RNA, 22 nt, Human
uuuauuagauuaucaaagaggu

SEQ ID NO: 592459 - RNA, 22 nt, Human
gucccucugugucccugcaguc

SEQ ID NO: 592460 - RNA, 22 nt, Human
gcugagcagguuugaugcuuuu

SEQ ID NO: 592461 - RNA, 22 nt, Human
cagggagcuauuaggguuagug

SEQ ID NO: 592462 - RNA, 22 nt, Human
aaacagcuuguaagguguaauu

SEQ ID NO: 592463 - RNA, 22 nt, Human
agugacauuauuuuguguacua

SEQ ID NO: 592464 - RNA, 22 nt, Human
cuugaaaaauaugccuugcuuc

SEQ ID NO: 592465 - RNA, 22 nt, Human
ggugggagagcucugucuccag

SEQ ID NO: 592466 - RNA, 22 nt, Human
gcagggcucugcuguaguccua

SEQ ID NO: 592467 - RNA, 22 nt, Human
cauguaguccuaaugcugguga

SEQ ID NO: 592468 - RNA, 22 nt, Human
cagcagccucaaguuuauuuuc

SEQ ID NO: 592469 - RNA, 22 nt, Human
ggccucucauguccugggcuuc

SEQ ID NO: 592470 - RNA, 22 nt, Human
agcacugugauuuauaacauuu

SEQ ID NO: 592471 - RNA, 22 nt, Human
aaacugaaacaucaucauguug

SEQ ID NO: 592472 - RNA, 22 nt, Human
caucugcuguuccuuggacuca

SEQ ID NO: 592473 - RNA, 22 nt, Human
ugcaggagcagagauggcugga

SEQ ID NO: 592474 - RNA, 22 nt, Human
ccccacagcuuguggagagaau

SEQ ID NO: 592475 - RNA, 22 nt, Human
aaaugcaggaaauuaugcuuuu

SEQ ID NO: 592476 - RNA, 22 nt, Human
uacaaugcugugcauguaaugg

SEQ ID NO: 592477 - RNA, 22 nt, Human
acaaaucuguuuuauagacuuu

SEQ ID NO: 592478 - RNA, 22 nt, Human
cuggagagaauguucauugcag

SEQ ID NO: 592479 - RNA, 22 nt, Human
uaggcugacuuguuucauaaag

SEQ ID NO: 592480 - RNA, 22 nt, Human
acaauguaggaguaugacagua

SEQ ID NO: 592481 - RNA, 22 nt, Human
uuauucaccaguguaaaacacu

SEQ ID NO: 592482 - RNA, 22 nt, Human
aggccacaagaacuaccccauc

SEQ ID NO: 592483 - RNA, 22 nt, Human
ucccagauuccugcucuuauau

SEQ ID NO: 592484 - RNA, 22 nt, Human
aaagaaauaccuuucucagcuu

SEQ ID NO: 592485 - RNA, 22 nt, Human
caaggcagaauucagacucagg

SEQ ID NO: 592486 - RNA, 22 nt, Human
agggccuggaacugugggcagg

SEQ ID NO: 592487 - RNA, 22 nt, Human
acaguguaugauauuucacagu

SEQ ID NO: 592488 - RNA, 22 nt, Human
aagccacucacaauaacugucc

SEQ ID NO: 592489 - RNA, 22 nt, Human
gagacacacacaggagguggca

SEQ ID NO: 592490 - RNA, 22 nt, Human
gggaggcgccgaggguagcuaa

SEQ ID NO: 592491 - RNA, 22 nt, Human
aagucacaaagugcuguacaug

SEQ ID NO: 592492 - RNA, 22 nt, Human
gccugccccuuccugggcaggg

SEQ ID NO: 592493 - RNA, 22 nt, Human
uacaacaugugguccuuuauga

SEQ ID NO: 592494 - RNA, 22 nt, Human
ugggccuguugccugaguccau

SEQ ID NO: 592495 - RNA, 22 nt, Human
cugugucucuccuuacaagacu

SEQ ID NO: 592496 - RNA, 22 nt, Human
acagaagugaguggcaagaacu

SEQ ID NO: 592497 - RNA, 22 nt, Human
aauaaugugugcugcagucuua

SEQ ID NO: 592498 - RNA, 22 nt, Human
gucuaugauauuuuguuauagc

SEQ ID NO: 592499 - RNA, 22 nt, Human
caguuucuuggaugccaauuuc

SEQ ID NO: 592500 - RNA, 23 nt, Human
ucugagaagguuucagccagacu

SEQ ID NO: 592501 - RNA, 22 nt, Human
aguaacaagugccaacguuaga

SEQ ID NO: 592502 - RNA, 22 nt, Human
uggcacaggaucucagcggcca

SEQ ID NO: 592503 - RNA, 22 nt, Human
uauugucacgucuuaauucuag

SEQ ID NO: 592504 - RNA, 22 nt, Human
gagcuuugcauuauucagaagc

SEQ ID NO: 592505 - RNA, 22 nt, Human
auggauaauggugauaguugca

SEQ ID NO: 592506 - RNA, 22 nt, Human
agcuuugaaaauccaaauuaca

SEQ ID NO: 592507 - RNA, 22 nt, Human
ccuuccucauccauuucucuug

SEQ ID NO: 592508 - RNA, 22 nt, Human
ugucauuuuagugcaucacuca

SEQ ID NO: 592509 - RNA, 22 nt, Human
acaaugaagauaauguugcagu

SEQ ID NO: 592510 - RNA, 22 nt, Human
guuuauugauaaaagcuggaca

SEQ ID NO: 592511 - RNA, 22 nt, Human
accauguuggccaagcuggucu

SEQ ID NO: 592512 - RNA, 23 nt, Human
cuucuggcucuauaucagaauuc

SEQ ID NO: 592513 - RNA, 23 nt, Human
uggcagcagaucuuaaagugacc

SEQ ID NO: 592514 - RNA, 22 nt, Human
uugaagcaaggcgaaucuugug

SEQ ID NO: 592515 - RNA, 22 nt, Human
cugcuagcccgccggccagcga

SEQ ID NO: 592516 - RNA, 22 nt, Human
guuugaaaaaagcaguauguaa

SEQ ID NO: 592517 - RNA, 22 nt, Human
uauuggaccacagacuuuaagg

SEQ ID NO: 592518 - RNA, 22 nt, Human
aucuggggucagacagcccugg

SEQ ID NO: 592519 - RNA, 22 nt, Human
acauuguugagccucuuguuca

SEQ ID NO: 592520 - RNA, 22 nt, Human
agauucagaaaauucucuguuc

SEQ ID NO: 592521 - RNA, 22 nt, Human
agccaagguaucaugagaggca

SEQ ID NO: 592522 - RNA, 22 nt, Human
cagugccacaggaauggccaau

SEQ ID NO: 592523 - RNA, 23 nt, Human
ccaggaagaggccauccacaguc

SEQ ID NO: 592524 - RNA, 23 nt, Human
cagaccuggcagucauccucaac

SEQ ID NO: 592525 - RNA, 22 nt, Human
gggagaaguggaaaucucauua

SEQ ID NO: 592526 - RNA, 22 nt, Human
agaugcugccucuccucacaag

SEQ ID NO: 592527 - RNA, 22 nt, Human
uuuuuauaacucuuuugugaca

SEQ ID NO: 592528 - RNA, 19 nt, Human
ucugaauuauuuauguacc

SEQ ID NO: 592529 - RNA, 22 nt, Human
ucagaaucuuucuagagucuag

SEQ ID NO: 592530 - RNA, 22 nt, Human
uuagcaaauaucuugaaacagg

SEQ ID NO: 592531 - RNA, 22 nt, Human
agcugcuuccucuuugauguca

SEQ ID NO: 592532 - RNA, 22 nt, Human
uguuuuuaaauaaugauagaaa

SEQ ID NO: 592533 - RNA, 22 nt, Human
acacugcuaaacaguaaagaug

SEQ ID NO: 592534 - RNA, 23 nt, Human
cagaaauaaacugguuuguagau

SEQ ID NO: 592535 - RNA, 22 nt, Human
gcuggaguccagugguaugauc

SEQ ID NO: 592536 - RNA, 22 nt, Human
agaguuugugggcuuuuccucc

SEQ ID NO: 592537 - RNA, 22 nt, Human
auuggcaguuagugacgaggcu

SEQ ID NO: 592538 - RNA, 22 nt, Human
ucugaagaggcucuugauaaga

SEQ ID NO: 592539 - RNA, 22 nt, Human
guaaucucagcuacuugggagg

SEQ ID NO: 592540 - RNA, 22 nt, Human
ggcagcaguuacaaaugugcag

SEQ ID NO: 592541 - RNA, 22 nt, Human
uuuauguuccucuugagcuuuc

SEQ ID NO: 592542 - RNA, 22 nt, Human
ccucucaucauuaucgcuuugu

SEQ ID NO: 592543 - RNA, 22 nt, Human
ucuuuugugaggacaagguacg

SEQ ID NO: 592544 - RNA, 22 nt, Human
uuugaugaguuuaauaacagcc

SEQ ID NO: 592545 - RNA, 21 nt, Human
auaaagacaaacacuauuugg

SEQ ID NO: 592546 - RNA, 22 nt, Human
uuuauaaaauagacugggucua

SEQ ID NO: 592547 - RNA, 21 nt, Human
ccaggcugggagggcaguucc

SEQ ID NO: 592548 - RNA, 22 nt, Human
cagcucucacacccuccuccca

SEQ ID NO: 592549 - RNA, 22 nt, Human
agcuucauggaaccugaggcua

SEQ ID NO: 592550 - RNA, 22 nt, Human
agugcuaaaggaucacaggguc

SEQ ID NO: 592551 - RNA, 22 nt, Human
agagccaggaaguggcgugggg

SEQ ID NO: 592552 - RNA, 22 nt, Human
agcugcuucaaaaugggcuccu

SEQ ID NO: 592553 - RNA, 22 nt, Human
gaggugccuggcgaugucucug

SEQ ID NO: 592554 - RNA, 22 nt, Human
gaaaucuuuucaucucauuuga

SEQ ID NO: 592555 - RNA, 22 nt, Human
cucagccugugaagagcagagg

SEQ ID NO: 592556 - RNA, 22 nt, Human
ucuuuuauagugaauuuucuug

SEQ ID NO: 592557 - RNA, 17 nt, Human
ucuguucaugcauaccu

SEQ ID NO: 592558 - RNA, 22 nt, Human
uuguaaaugaccuuuucuaauu

SEQ ID NO: 592559 - RNA, 22 nt, Human
ucaaauaaggagucaugaccau

SEQ ID NO: 592560 - RNA, 20 nt, Human
caaaagcaaugaaguuauga

SEQ ID NO: 592561 - RNA, 22 nt, Human
uaugaaacauucauacaaauaa

SEQ ID NO: 592562 - RNA, 22 nt, Human
gcuuccagacgaucauguaaga

SEQ ID NO: 592563 - RNA, 22 nt, Human
ccaggcuccucaugaucuuguu

SEQ ID NO: 592564 - RNA, 23 nt, Human
cuucagugugggacugcagcgug

SEQ ID NO: 592565 - RNA, 22 nt, Human
gcuggagugaugccugugucuc

SEQ ID NO: 592566 - RNA, 22 nt, Human
uggaaaacaaagcucucauuau

SEQ ID NO: 592567 - RNA, 22 nt, Human
caagaggcuaaacugggcuauu

SEQ ID NO: 592568 - RNA, 22 nt, Human
auucauuuagguauucacuuac

SEQ ID NO: 592569 - RNA, 22 nt, Human
gcugccuucccggaaugucauc

SEQ ID NO: 592570 - RNA, 22 nt, Human
cacagacagugucccuuuguug

SEQ ID NO: 592571 - RNA, 22 nt, Human
guccagcugaucuugacccagc

SEQ ID NO: 592572 - RNA, 22 nt, Human
cuguauuauuuucuuagcucug

SEQ ID NO: 592573 - RNA, 21 nt, Human
cucuuuauauaguaaagauau

SEQ ID NO: 592574 - RNA, 22 nt, Human
agcaccaggaaagaaggggcca

SEQ ID NO: 592575 - RNA, 22 nt, Human
ugugaauauccauuuguuucag

SEQ ID NO: 592576 - RNA, 22 nt, Human
ucucugugaguggaaggcaccc

SEQ ID NO: 592577 - RNA, 22 nt, Human
auuggcuuaguuggcaauuguu

SEQ ID NO: 592578 - RNA, 22 nt, Human
cauuucuccgccgagaucacug

SEQ ID NO: 592579 - RNA, 22 nt, Human
ucuuugcaugcauuuucccuua

SEQ ID NO: 592580 - RNA, 22 nt, Human
cagacuuuugggaggucugugg

SEQ ID NO: 592581 - RNA, 22 nt, Human
agggucucuggagagcugagga

SEQ ID NO: 592582 - RNA, 22 nt, Human
uccugggauuaagguggugauu

SEQ ID NO: 592583 - RNA, 22 nt, Human
uucucccacuccgugcuucagu

SEQ ID NO: 592584 - RNA, 22 nt, Human
agccugagugcuuaggacuguu

SEQ ID NO: 592585 - RNA, 22 nt, Human
ucacugggcccugaggugggac

SEQ ID NO: 592586 - RNA, 22 nt, Human
gcacuagucaagugaacaauuu

SEQ ID NO: 592587 - RNA, 22 nt, Human
cagcacuaauccugcaauuucu

SEQ ID NO: 592588 - RNA, 22 nt, Human
acacacagaaggaagccccacu

SEQ ID NO: 592589 - RNA, 22 nt, Human
guccucugggcagcugccccac

SEQ ID NO: 592590 - RNA, 22 nt, Human
ugucuguuauugguguauaaga

SEQ ID NO: 592591 - RNA, 22 nt, Human
uugcaggguugaccaauaggcu

SEQ ID NO: 592592 - RNA, 22 nt, Human
uggccaagaugcgaccucucag

SEQ ID NO: 592593 - RNA, 22 nt, Human
uucucuuugacauuauucaggu

SEQ ID NO: 592594 - RNA, 22 nt, Human
gcugcagacuucucaucucauu

SEQ ID NO: 592595 - RNA, 22 nt, Human
ggcugcugacuucauccagcuu

SEQ ID NO: 592596 - RNA, 22 nt, Human
agcugcagcacuccaguagccg

SEQ ID NO: 592597 - RNA, 20 nt, Human
cgaggccaaggggcugggcc

SEQ ID NO: 592598 - RNA, 22 nt, Human
aacccagccguguagcugccgc

SEQ ID NO: 592599 - RNA, 22 nt, Human
aaaaacuguaauuacuuuugca

SEQ ID NO: 592600 - RNA, 22 nt, Human
caaguuuugcauaguucuguau

SEQ ID NO: 592601 - RNA, 21 nt, Human
gcuggcucucugacgugcuuu

SEQ ID NO: 592602 - RNA, 19 nt, Human
cagaggcaccagguauaga

SEQ ID NO: 592603 - RNA, 22 nt, Human
ccaggcaucacgggcauguggc

SEQ ID NO: 592604 - RNA, 22 nt, Human
aagaauguucauuaaacuguug

SEQ ID NO: 592605 - RNA, 22 nt, Human
aacagggacaaggauagagaaa

SEQ ID NO: 592606 - RNA, 19 nt, Human
ccacacagugugcaauuua

SEQ ID NO: 592607 - RNA, 22 nt, Human
uaaagcagugugguuguguccc

SEQ ID NO: 592608 - RNA, 22 nt, Human
cccaggucugugccagcucuga

SEQ ID NO: 592609 - RNA, 22 nt, Human
uuagugcuucuguccaaauaua

SEQ ID NO: 592610 - RNA, 22 nt, Human
auaaucuguggaugguuuugag

SEQ ID NO: 592611 - RNA, 22 nt, Human
acagcagcuugucuguucuuua

SEQ ID NO: 592612 - RNA, 22 nt, Human
agcaggcuaaucuugcugaaca

SEQ ID NO: 592613 - RNA, 22 nt, Human
agucuucugcucugucacuaac

SEQ ID NO: 592614 - RNA, 17 nt, Human
uuuucuccugcccauuc

SEQ ID NO: 592615 - RNA, 22 nt, Human
cucugaaaaugugguggggaaa

SEQ ID NO: 592616 - RNA, 22 nt, Human
ccuggguagacuuugaagcauu

SEQ ID NO: 592617 - RNA, 20 nt, Human
cccuggagagaagcuccacg

SEQ ID NO: 592618 - RNA, 22 nt, Human
cuacagaagaaacuaucacuau

SEQ ID NO: 592619 - RNA, 22 nt, Human
ggcaggugaccuggccucccag

SEQ ID NO: 592620 - RNA, 22 nt, Human
ggaggaagcccucggugcccca

SEQ ID NO: 592621 - RNA, 22 nt, Human
cucccuggaggugagcuggcac

SEQ ID NO: 592622 - RNA, 19 nt, Human
ugcugcuguccuugcaggg

SEQ ID NO: 592623 - RNA, 22 nt, Human
aaagcagugcaccuuaauugau

SEQ ID NO: 592624 - RNA, 22 nt, Human
auagucacugccuuccauuugu

SEQ ID NO: 592625 - RNA, 23 nt, Human
ucccagggaaggugagcgaggcu

SEQ ID NO: 592626 - RNA, 22 nt, Human
gcagggcuauuggaaggagaug

SEQ ID NO: 592627 - RNA, 20 nt, Human
uuuccuaagugguuugcuga

SEQ ID NO: 592628 - RNA, 22 nt, Human
acaucccacagaaacauacaua

SEQ ID NO: 592629 - RNA, 22 nt, Human
ggguccagaguugaagagguua

SEQ ID NO: 592630 - RNA, 22 nt, Human
aacaucauuauguccauuaaug

SEQ ID NO: 592631 - RNA, 22 nt, Human
caguuucuacgaaggucaaccc

SEQ ID NO: 592632 - RNA, 23 nt, Human
ugucuaugagaaguucaggcuag

SEQ ID NO: 592633 - RNA, 20 nt, Human
cuguggcucaugcaucugcc

SEQ ID NO: 592634 - RNA, 22 nt, Human
uggcacagaccuuaucuucucu

SEQ ID NO: 592635 - RNA, 19 nt, Human
uuaugaauagcuucaucca

SEQ ID NO: 592636 - RNA, 22 nt, Human
cuggcccucggaguccagcugc

SEQ ID NO: 592637 - RNA, 22 nt, Human
uggaagcagugauucuugucug

SEQ ID NO: 592638 - RNA, 23 nt, Human
uacauucuguauuuuuauagagu

SEQ ID NO: 592639 - RNA, 22 nt, Human
uaaagacagauggaccagccau

SEQ ID NO: 592640 - RNA, 18 nt, Human
caauuucaauggucugaa

SEQ ID NO: 592641 - RNA, 22 nt, Human
caggggcucccugggugccagu

SEQ ID NO: 592642 - RNA, 22 nt, Human
ccacuggcauccagcugccauc

SEQ ID NO: 592643 - RNA, 22 nt, Human
gcaccuggacagugacccuagc

SEQ ID NO: 592644 - RNA, 19 nt, Human
uuuacagggaauggagacc

SEQ ID NO: 592645 - RNA, 22 nt, Human
accucccagcucugagcuuggg

SEQ ID NO: 592646 - RNA, 22 nt, Human
cugggagauugcuagagaugca

SEQ ID NO: 592647 - RNA, 22 nt, Human
gggcagauggggcacaggcuga

SEQ ID NO: 592648 - RNA, 21 nt, Human
ugcuccagggcagcuuccagc

SEQ ID NO: 592649 - RNA, 22 nt, Human
aguagggagaccggaggccgcc

SEQ ID NO: 592650 - RNA, 22 nt, Human
uccugccaccugcacagcuccc

SEQ ID NO: 592651 - RNA, 22 nt, Human
gucugaaauggaggugggaacu

SEQ ID NO: 592652 - RNA, 22 nt, Human
uucacacagaaucugaggagcu

SEQ ID NO: 592653 - RNA, 22 nt, Human
ugcagagcagcaacugcgugcg

SEQ ID NO: 592654 - RNA, 22 nt, Human
gcagcugaagcugcaguuccag

SEQ ID NO: 592655 - RNA, 22 nt, Human
ggggugagaucaaggaagcccu

SEQ ID NO: 592656 - RNA, 22 nt, Human
uguuagauuccugaugaauuua

SEQ ID NO: 592657 - RNA, 23 nt, Human
ugcuggcugaaacagccaaagga

SEQ ID NO: 592658 - RNA, 22 nt, Human
ucccagggacucucugccuucc

SEQ ID NO: 592659 - RNA, 21 nt, Human
ucacaggcucagggagagagu

SEQ ID NO: 592660 - RNA, 22 nt, Human
gagaugcuugucugucuuauca

SEQ ID NO: 592661 - RNA, 22 nt, Human
aaauuauuacaagcuaguuggc

SEQ ID NO: 592662 - RNA, 22 nt, Human
uggcugugccucuuuccaggcc

SEQ ID NO: 592663 - RNA, 20 nt, Human
cuuccaccagggccgcugau

SEQ ID NO: 592664 - RNA, 22 nt, Human
aacuacaguaguuugcccuucu

SEQ ID NO: 592665 - RNA, 22 nt, Human
cacagaggacuguagcggggag

SEQ ID NO: 592666 - RNA, 22 nt, Human
ggccugagucacaucaggagag

SEQ ID NO: 592667 - RNA, 22 nt, Human
ucaggcucugagcugaugcuaa

SEQ ID NO: 592668 - RNA, 22 nt, Human
ggcucaggccagaccacgacuc

SEQ ID NO: 592669 - RNA, 22 nt, Human
uugugaaaucguguuuggaagc

SEQ ID NO: 592670 - RNA, 20 nt, Human
aacauugaaagucuagaaga

SEQ ID NO: 592671 - RNA, 22 nt, Human
uuuaguguaagcauaaagaaca

SEQ ID NO: 592672 - RNA, 22 nt, Human
agcaugcugguuacguguagca

SEQ ID NO: 592673 - RNA, 22 nt, Human
uacagaaaucacaucgcuuuga

SEQ ID NO: 592674 - RNA, 22 nt, Human
ugccagggugucaggagagcua

SEQ ID NO: 592675 - RNA, 20 nt, Human
ccagaagguaggauggaaca

SEQ ID NO: 592676 - RNA, 22 nt, Human
gccagcagcccagaaggacuuu

SEQ ID NO: 592677 - RNA, 22 nt, Human
agagccugucugccuuucuacc

SEQ ID NO: 592678 - RNA, 22 nt, Human
aacaugaaaguugcuaagugca

SEQ ID NO: 592679 - RNA, 22 nt, Human
ucugauaggugguagaaggagg

SEQ ID NO: 592680 - RNA, 22 nt, Human
aaacugaggcucccgagggugu

SEQ ID NO: 592681 - RNA, 22 nt, Human
uugagaauguguuuugcuaagu

SEQ ID NO: 592682 - RNA, 22 nt, Human
uagugugguaucuucuauggaa

SEQ ID NO: 592683 - RNA, 22 nt, Human
aaagaagggacagacugccucu

SEQ ID NO: 592684 - RNA, 22 nt, Human
uaaaaaacauuacucuguccug

SEQ ID NO: 592685 - RNA, 22 nt, Human
ugucagcagcugguuugcuguu

SEQ ID NO: 592686 - RNA, 22 nt, Human
caucaaugugcagagaugaacg

SEQ ID NO: 592687 - RNA, 20 nt, Human
cuaagaggaggacuagguuu

SEQ ID NO: 592688 - RNA, 22 nt, Human
aaauggcaaucagcagaagcua

SEQ ID NO: 592689 - RNA, 22 nt, Human
aacuacagcucuugucuuucug

SEQ ID NO: 592690 - RNA, 22 nt, Human
aucaagaauugggagcuauuga

SEQ ID NO: 592691 - RNA, 22 nt, Human
cauuucuauggcaaugggaaaa

SEQ ID NO: 592692 - RNA, 22 nt, Human
acagcagaucuggcuacagguu

SEQ ID NO: 592693 - RNA, 22 nt, Human
ugugugccugagccgugccugg

SEQ ID NO: 592694 - RNA, 22 nt, Human
ggcuccugggaugggacugagc

SEQ ID NO: 592695 - RNA, 22 nt, Human
aaagauuugaaauuaggcauca

SEQ ID NO: 592696 - RNA, 22 nt, Human
ccuggaucccgauggcugugag

SEQ ID NO: 592697 - RNA, 22 nt, Human
caugcagucaauaaacaugugu

SEQ ID NO: 592698 - RNA, 22 nt, Human
gcaggagagucugugccagguu

SEQ ID NO: 592699 - RNA, 22 nt, Human
cccccaccguguuccugcucgg

SEQ ID NO: 592700 - RNA, 22 nt, Human
uucagaacaaccaugguuagau

SEQ ID NO: 592701 - RNA, 22 nt, Human
uucaacaaguaguacacacagu

SEQ ID NO: 592702 - RNA, 22 nt, Human
cacagagaggcuugucuccaag

SEQ ID NO: 592703 - RNA, 22 nt, Human
cacaugaugguggaagccauag

SEQ ID NO: 592704 - RNA, 22 nt, Human
ccuggcaccuucacagacuacu

SEQ ID NO: 592705 - RNA, 22 nt, Human
ccugaggcccuggcugugcuga

SEQ ID NO: 592706 - RNA, 22 nt, Human
uaguuacauaaaguggacuguu

SEQ ID NO: 592707 - RNA, 22 nt, Human
uguauaaauuuaaauuccugcu

SEQ ID NO: 592708 - RNA, 22 nt, Human
auuaauuuuaccuuuguaaaca

SEQ ID NO: 592709 - RNA, 22 nt, Human
gugcugggugcugcagacaggu

SEQ ID NO: 592710 - RNA, 21 nt, Human
aauaaaacaguuggugucaau

SEQ ID NO: 592711 - RNA, 22 nt, Human
ucagugcuuuugucacaugguc

SEQ ID NO: 592712 - RNA, 22 nt, Human
ggccaggcugguuccuugaccu

SEQ ID NO: 592713 - RNA, 22 nt, Human
cccugcagaucuaggguccuuc

SEQ ID NO: 592714 - RNA, 22 nt, Human
cuuauuauaaaauccuguuuga

SEQ ID NO: 592715 - RNA, 22 nt, Human
acuggccuaucagcaugagucu

SEQ ID NO: 592716 - RNA, 22 nt, Human
ugucucugagaugacucccacc

SEQ ID NO: 592717 - RNA, 22 nt, Human
ucuucuguuuuagauugcauac

SEQ ID NO: 592718 - RNA, 22 nt, Human
cucugggaugaggccuaggcac

SEQ ID NO: 592719 - RNA, 22 nt, Human
ggccugagcagacagcaugaug

SEQ ID NO: 592720 - RNA, 22 nt, Human
aaaugccaggauuauuagaggc

SEQ ID NO: 592721 - RNA, 22 nt, Human
ucagaaagguucuauguuuuac

SEQ ID NO: 592722 - RNA, 22 nt, Human
aaugggaagucacuacuguuac

SEQ ID NO: 592723 - RNA, 22 nt, Human
acacuuugggcuggauaauuau

SEQ ID NO: 592724 - RNA, 22 nt, Human
guuuauaauccaacucugcucc

SEQ ID NO: 592725 - RNA, 22 nt, Human
accagagaaugugcaucucuaa

SEQ ID NO: 592726 - RNA, 22 nt, Human
gcccagcuggcuuccagcacau

SEQ ID NO: 592727 - RNA, 22 nt, Human
uagcacaaagagucuuucagag

SEQ ID NO: 592728 - RNA, 22 nt, Human
auuguuuuccaaagaugcugcu

SEQ ID NO: 592729 - RNA, 22 nt, Human
cuggcagugugacccuggacag

SEQ ID NO: 592730 - RNA, 22 nt, Human
ucacccaggguguuuggugucu

SEQ ID NO: 592731 - RNA, 22 nt, Human
augcugaaggugaauugacaau

SEQ ID NO: 592732 - RNA, 22 nt, Human
gaaggggacuggcagcugcaga

SEQ ID NO: 592733 - RNA, 22 nt, Human
uacaacagacaggaauaagauu

SEQ ID NO: 592734 - RNA, 22 nt, Human
cccaggcugcaugaguccaugg

SEQ ID NO: 592735 - RNA, 23 nt, Human
acucacaaagcaggaucauguug

SEQ ID NO: 592736 - RNA, 22 nt, Human
gagauuuucagcuugacuggga

SEQ ID NO: 592737 - RNA, 22 nt, Human
gcugaggccucagaaggcugag

SEQ ID NO: 592738 - RNA, 20 nt, Human
uguauucuucuccuuccucc

SEQ ID NO: 592739 - RNA, 22 nt, Human
aaacaaguuuguagacuagcca

SEQ ID NO: 592740 - RNA, 22 nt, Human
cugagguggggccugggcauca

SEQ ID NO: 592741 - RNA, 22 nt, Human
uuaacaaauauuucccaugccc

SEQ ID NO: 592742 - RNA, 22 nt, Human
uuuuccuucuagagcagauuuc

SEQ ID NO: 592743 - RNA, 22 nt, Human
uuguuaaaaugcauauucuggu

SEQ ID NO: 592744 - RNA, 21 nt, Human
gacaggugauucagagcaggg

SEQ ID NO: 592745 - RNA, 22 nt, Human
augcaguuaguauacuuccagu

SEQ ID NO: 592746 - RNA, 22 nt, Human
accugcaggcacaggugugcgc

SEQ ID NO: 592747 - RNA, 22 nt, Human
gggcugagcacauacugacagc

SEQ ID NO: 592748 - RNA, 22 nt, Human
ccagcugguuaaaauagagaaa

SEQ ID NO: 592749 - RNA, 22 nt, Human
accaggguugagucagcugcgu

SEQ ID NO: 592750 - RNA, 22 nt, Human
ggggugugaguagagcugggga

SEQ ID NO: 592751 - RNA, 22 nt, Human
uccaggagcauccaggugaagc

SEQ ID NO: 592752 - RNA, 17 nt, Human
ucagggaaugagguugu

SEQ ID NO: 592753 - RNA, 22 nt, Human
cucuuuucaaaccuguuuaugg

SEQ ID NO: 592754 - RNA, 22 nt, Human
aaauacagauagauuuaaccca

SEQ ID NO: 592755 - RNA, 22 nt, Human
uccacaugaccauugugcuccu

SEQ ID NO: 592756 - RNA, 22 nt, Human
cuggaugcugagagguaccaag

SEQ ID NO: 592757 - RNA, 22 nt, Human
ucuccagggagguagcccagug

SEQ ID NO: 592758 - RNA, 22 nt, Human
uaucuguuggcuccuaguugua

SEQ ID NO: 592759 - RNA, 22 nt, Human
ggcuugagacccgggagccaga

SEQ ID NO: 592760 - RNA, 22 nt, Human
uccaggcugacgcagcuauuua

SEQ ID NO: 592761 - RNA, 22 nt, Human
agcaggagcugugggaagaugg

SEQ ID NO: 592762 - RNA, 22 nt, Human
aucucagggcuggagcccugga

SEQ ID NO: 592763 - RNA, 22 nt, Human
ggggaugguagaccggugacgu

SEQ ID NO: 592764 - RNA, 22 nt, Human
ucuuuuaaccuaacuagcuugg

SEQ ID NO: 592765 - RNA, 22 nt, Human
aggaggccaggcccucaagccu

SEQ ID NO: 592766 - RNA, 22 nt, Human
uccaggggacacuguuucucca

SEQ ID NO: 592767 - RNA, 22 nt, Human
acuguuaauucaaucaacaggu

SEQ ID NO: 592768 - RNA, 22 nt, Human
cauggcaacaacucuuuauucc

SEQ ID NO: 592769 - RNA, 22 nt, Human
cagcugcuguuacugcuuauua

SEQ ID NO: 592770 - RNA, 23 nt, Human
uccuccagaggcccuccuuggcc

SEQ ID NO: 592771 - RNA, 22 nt, Human
ucugcccacaguccaauaguug

SEQ ID NO: 592772 - RNA, 22 nt, Human
aaaguucagauuagacucaaga

SEQ ID NO: 592773 - RNA, 22 nt, Human
aggcuggcccuacuggcugccu

SEQ ID NO: 592774 - RNA, 22 nt, Human
ucaauuuauguggcuauucauu

SEQ ID NO: 592775 - RNA, 22 nt, Human
auucauuugcuauuguguaugg

SEQ ID NO: 592776 - RNA, 22 nt, Human
gcgaggaggggugcugggcccc

SEQ ID NO: 592777 - RNA, 22 nt, Human
cagagugaaaacugagcucaaa

SEQ ID NO: 592778 - RNA, 22 nt, Human
cagcuccugaggacugcuggga

SEQ ID NO: 592779 - RNA, 22 nt, Human
uuaaaagucugaugauuuacau

SEQ ID NO: 592780 - RNA, 22 nt, Human
uacaugucuacaugcauuuuug

SEQ ID NO: 592781 - RNA, 22 nt, Human
cugagcagccccaccagccauu

SEQ ID NO: 592782 - RNA, 22 nt, Human
acuuucuguuagaugaauggau

SEQ ID NO: 592783 - RNA, 22 nt, Human
uuguccugucaggcugggggcu

SEQ ID NO: 592784 - RNA, 22 nt, Human
uugauacauagcacaguuuagg

SEQ ID NO: 592785 - RNA, 22 nt, Human
ccaggccucaccugcccaccua

SEQ ID NO: 592786 - RNA, 22 nt, Human
gcugcaggagauuuugagaguc

SEQ ID NO: 592787 - RNA, 22 nt, Human
acuaaagucaucaaagaacuuu

SEQ ID NO: 592788 - RNA, 16 nt, Human
uggggaagcucgugag

SEQ ID NO: 592789 - RNA, 22 nt, Human
cgaggccaauguguuuuaugaa

SEQ ID NO: 592790 - RNA, 20 nt, Human
ccugggaaggcagccccagc

SEQ ID NO: 592791 - RNA, 19 nt, Human
aaagcagugcauccucuuu

SEQ ID NO: 592792 - RNA, 22 nt, Human
gcacuuuauaguagaaagagca

SEQ ID NO: 592793 - RNA, 18 nt, Human
ccagggaugcaugguccc

SEQ ID NO: 592794 - RNA, 22 nt, Human
ugccugcuuucugggcugccau

SEQ ID NO: 592795 - RNA, 22 nt, Human
aaaaggacaagcuuuggaguua

SEQ ID NO: 592796 - RNA, 22 nt, Human
ucaugcaacaacacauucuggc

SEQ ID NO: 592797 - RNA, 22 nt, Human
uguucagaacaaagguaaauga

SEQ ID NO: 592798 - RNA, 22 nt, Human
uuuuugugugagcaggguguua

SEQ ID NO: 592799 - RNA, 22 nt, Human
ccagagccucuuaugaagaucg

SEQ ID NO: 592800 - RNA, 22 nt, Human
uuuuucuuaaauguggguuggc

SEQ ID NO: 592801 - RNA, 22 nt, Human
guauucugggccgauuacaaaa

SEQ ID NO: 592802 - RNA, 22 nt, Human
gagguagcgaguggacagugca

SEQ ID NO: 592803 - RNA, 22 nt, Human
uguauguauacacauagauacg

SEQ ID NO: 592804 - RNA, 19 nt, Human
ugccugucaguagaucuca

SEQ ID NO: 592805 - RNA, 22 nt, Human
ugaggcacugggagagcacacu

SEQ ID NO: 592806 - RNA, 22 nt, Human
cugcagagcagccaguccccca

SEQ ID NO: 592807 - RNA, 22 nt, Human
cagagugaaauaggggaucaag

SEQ ID NO: 592808 - RNA, 22 nt, Human
ugaggcugaaacuggcgauaga

SEQ ID NO: 592809 - RNA, 22 nt, Human
acuaaagaagccaaaguuuucu

SEQ ID NO: 592810 - RNA, 22 nt, Human
uucuggaggagaaagggugggc

SEQ ID NO: 592811 - RNA, 22 nt, Human
gcacuggggucauagccuccag

SEQ ID NO: 592812 - RNA, 22 nt, Human
agccaggggagucagcugcugg

SEQ ID NO: 592813 - RNA, 17 nt, Human
acacagccagguucucc

SEQ ID NO: 592814 - RNA, 22 nt, Human
acuuaaagaggcuacuuuuggu

SEQ ID NO: 592815 - RNA, 22 nt, Human
aagcccuuggcgcacaccgggc

SEQ ID NO: 592816 - RNA, 22 nt, Human
uuacuugauuugaaaaucauag

SEQ ID NO: 592817 - RNA, 22 nt, Human
gagguaggcagggugacuuggc

SEQ ID NO: 592818 - RNA, 22 nt, Human
uacuguuuuuuagacucauggu

SEQ ID NO: 592819 - RNA, 22 nt, Human
cuuaucuuacuuccccuucaug

SEQ ID NO: 592820 - RNA, 22 nt, Human
aagcugccauagaacgagaggu

SEQ ID NO: 592821 - RNA, 22 nt, Human
aaaguccuugcaguuuccucuu

SEQ ID NO: 592822 - RNA, 22 nt, Human
cauuucuaccaaaugugacugg

SEQ ID NO: 592823 - RNA, 22 nt, Human
uuauaacuuuggauaugacaag

SEQ ID NO: 592824 - RNA, 22 nt, Human
aaauucucuaaagaaaacauga

SEQ ID NO: 592825 - RNA, 22 nt, Human
uucuuucuuuguaguccugaac

SEQ ID NO: 592826 - RNA, 22 nt, Human
agcagugagugggaggaccaug

SEQ ID NO: 592827 - RNA, 22 nt, Human
ucuaguuuuagcuugaguugca

SEQ ID NO: 592828 - RNA, 22 nt, Human
cuuuccuggcuggcaguugugg

SEQ ID NO: 592829 - RNA, 22 nt, Human
ccagagagcuacaaggcauaaa

SEQ ID NO: 592830 - RNA, 22 nt, Human
aacauugaacuuggcacaccca

SEQ ID NO: 592831 - RNA, 22 nt, Human
gcaugguggagucugagcaggg

SEQ ID NO: 592832 - RNA, 22 nt, Human
ugaaggaaaugacggcagaaga

SEQ ID NO: 592833 - RNA, 22 nt, Human
uacacagauuuaaaagcaggga

SEQ ID NO: 592834 - RNA, 22 nt, Human
aacuuucaggcaaugaauauuu

SEQ ID NO: 592835 - RNA, 22 nt, Human
ugucccagacauaaguggacau

SEQ ID NO: 592836 - RNA, 21 nt, Human
ucugauguguuuaaugguggg

SEQ ID NO: 592837 - RNA, 20 nt, Human
aggccugagagaugacuggg

SEQ ID NO: 592838 - RNA, 23 nt, Human
uggauaaagcugugcugcauagg

SEQ ID NO: 592839 - RNA, 22 nt, Human
ugcucacugaacucuugcuguc

SEQ ID NO: 592840 - RNA, 22 nt, Human
ggcaggugcuaagagagguaaa

SEQ ID NO: 592841 - RNA, 22 nt, Human
cugugugugagaagcagguuga

SEQ ID NO: 592842 - RNA, 22 nt, Human
uuuguguuuucccauacuauug

SEQ ID NO: 592843 - RNA, 22 nt, Human
augcaaaagacuauuuguugcu

SEQ ID NO: 592844 - RNA, 22 nt, Human
aggcaagggggcgccaccuucc

SEQ ID NO: 592845 - RNA, 22 nt, Human
cgcgcugcagacagcggaggcc

SEQ ID NO: 592846 - RNA, 22 nt, Human
cagagccagucagucagaaacu

SEQ ID NO: 592847 - RNA, 22 nt, Human
aaucacaggcauagauugcucc

SEQ ID NO: 592848 - RNA, 22 nt, Human
uguuuucagaugcagggacaca

SEQ ID NO: 592849 - RNA, 22 nt, Human
ucuucaugccaaaugaguuuug

SEQ ID NO: 592850 - RNA, 20 nt, Human
ccugggguacacuggcaugu

SEQ ID NO: 592851 - RNA, 22 nt, Human
augcaguuuaaggcacaauuag

SEQ ID NO: 592852 - RNA, 22 nt, Human
cagggccuccuaaggcaucuaa

SEQ ID NO: 592853 - RNA, 18 nt, Human
aggugcagccucugaggc

SEQ ID NO: 592854 - RNA, 22 nt, Human
cagagagggagcaguagucucu

SEQ ID NO: 592855 - RNA, 22 nt, Human
uguauacauucucuuggguuug

SEQ ID NO: 592856 - RNA, 22 nt, Human
cccacguugaaccgcuuacaga

SEQ ID NO: 592857 - RNA, 23 nt, Human
cuuuuaacuagaguaucagcugc

SEQ ID NO: 592858 - RNA, 22 nt, Human
augcaguggcagcuccuggugu

SEQ ID NO: 592859 - RNA, 22 nt, Human
ugcaaacaggcauuucacaaac

SEQ ID NO: 592860 - RNA, 22 nt, Human
ucccacuggacgucugugcugg

SEQ ID NO: 592861 - RNA, 22 nt, Human
uaaaaugacuuccuccaacauc

SEQ ID NO: 592862 - RNA, 22 nt, Human
gaucacauaauuuggaaacagc

SEQ ID NO: 592863 - RNA, 20 nt, Human
ucagguagaucuuugagguc

SEQ ID NO: 592864 - RNA, 22 nt, Human
uagacauuugucaagaaugacu

SEQ ID NO: 592865 - RNA, 22 nt, Human
ccaguucuaaacauaaagcuaa

SEQ ID NO: 592866 - RNA, 22 nt, Human
uauugaauuagacccuaaaaug

SEQ ID NO: 592867 - RNA, 22 nt, Human
acccaggagccgugagagguua

SEQ ID NO: 592868 - RNA, 22 nt, Human
cacaaaguggguggaaaacuaa

SEQ ID NO: 592869 - RNA, 22 nt, Human
cugaggugugaaaugguggcaa

SEQ ID NO: 592870 - RNA, 22 nt, Human
gcugcccugccucagacuccuc

SEQ ID NO: 592871 - RNA, 23 nt, Human
uggccagguagaggagguaguga

SEQ ID NO: 592872 - RNA, 22 nt, Human
gagugcaguuggggugagggga

SEQ ID NO: 592873 - RNA, 22 nt, Human
gguagcagggcugugagucaga

SEQ ID NO: 592874 - RNA, 22 nt, Human
gaaauguacuuuaaagccaucc

SEQ ID NO: 592875 - RNA, 19 nt, Human
uggcuuccugacucucauc

SEQ ID NO: 592876 - RNA, 22 nt, Human
ccagggugaggaggcucccacg

SEQ ID NO: 592877 - RNA, 22 nt, Human
ccuggcagacugugagggcagg

SEQ ID NO: 592878 - RNA, 22 nt, Human
uaguggagaguuguuuugugca

SEQ ID NO: 592879 - RNA, 22 nt, Human
uugcugaagaaaaaauauguua

SEQ ID NO: 592880 - RNA, 22 nt, Human
aacuuacaaggaugauagcugc

SEQ ID NO: 592881 - RNA, 22 nt, Human
ugucuuucugcaccaccucaca

SEQ ID NO: 592882 - RNA, 22 nt, Human
cuugaagacaauggcagauucc

SEQ ID NO: 592883 - RNA, 22 nt, Human
ugagaauauuguuuuagugagg

SEQ ID NO: 592884 - RNA, 22 nt, Human
gagccuggagcuggaacgaagc

SEQ ID NO: 592885 - RNA, 22 nt, Human
ucacuggcaacuugugcucccu

SEQ ID NO: 592886 - RNA, 22 nt, Human
guggugaagccccaucucugcu

SEQ ID NO: 592887 - RNA, 22 nt, Human
uuccugggauuauugucaagca

SEQ ID NO: 592888 - RNA, 23 nt, Human
agccaguuguagccacagaacuc

SEQ ID NO: 592889 - RNA, 22 nt, Human
caggagcccugguggguggaca

SEQ ID NO: 592890 - RNA, 22 nt, Human
uugggaggucauaaaucuguuc

SEQ ID NO: 592891 - RNA, 22 nt, Human
agcugaagaaaugggaagcauu

SEQ ID NO: 592892 - RNA, 23 nt, Human
acacagaagaagacccaaggaag

SEQ ID NO: 592893 - RNA, 22 nt, Human
uugggcagucuggcugcagagu

SEQ ID NO: 592894 - RNA, 22 nt, Human
uccagaggggcagcccugugcu

SEQ ID NO: 592895 - RNA, 22 nt, Human
uggcaggcagagagcggccuuu

SEQ ID NO: 592896 - RNA, 22 nt, Human
uguggcaggcauucugaggcug

SEQ ID NO: 592897 - RNA, 22 nt, Human
aacuagaaccacuuguauuucc

SEQ ID NO: 592898 - RNA, 22 nt, Human
gcugugagggcuucugaggcau

SEQ ID NO: 592899 - RNA, 22 nt, Human
gaccuggaagaacugaggccuu

SEQ ID NO: 592900 - RNA, 22 nt, Human
ccagagaguaaacauuuuccgg

SEQ ID NO: 592901 - RNA, 22 nt, Human
aagagcuggaguuugcagcccu

SEQ ID NO: 592902 - RNA, 22 nt, Human
auuguacuacaccauaguacug

SEQ ID NO: 592903 - RNA, 22 nt, Human
ccucuggcagccagccaguugu

SEQ ID NO: 592904 - RNA, 22 nt, Human
ccaggcucuaucccuccuucuu

SEQ ID NO: 592905 - RNA, 22 nt, Human
aauucacaguucugcaccuuac

SEQ ID NO: 592906 - RNA, 22 nt, Human
cugaggcaccuacagucucggg

SEQ ID NO: 592907 - RNA, 18 nt, Human
ugacucacccugucagug

SEQ ID NO: 592908 - RNA, 22 nt, Human
agauauauuuaagguaauaagu

SEQ ID NO: 592909 - RNA, 22 nt, Human
acuuucuccagaaaaccaagga

SEQ ID NO: 592910 - RNA, 22 nt, Human
gaggagugccagccguggaguc

SEQ ID NO: 592911 - RNA, 22 nt, Human
gacccuggcuggagcuggccug

SEQ ID NO: 592912 - RNA, 22 nt, Human
ugagcuggagucuguggcuccu

SEQ ID NO: 592913 - RNA, 19 nt, Human
acaggcagaauugggugug

SEQ ID NO: 592914 - RNA, 22 nt, Human
aauuuucugccuagcaaaaacu

SEQ ID NO: 592915 - RNA, 20 nt, Human
accagguggcugaugacacc

SEQ ID NO: 592916 - RNA, 22 nt, Human
ugcuuuaaaauggacuguuuug

SEQ ID NO: 592917 - RNA, 22 nt, Human
ccaggccuuucuucuuggucug

SEQ ID NO: 592918 - RNA, 22 nt, Human
gaaggagacccugaagaugcug

SEQ ID NO: 592919 - RNA, 22 nt, Human
gccugucaauuuuguguacaau

SEQ ID NO: 592920 - RNA, 22 nt, Human
ccagaaacagaugacaagcccu

SEQ ID NO: 592921 - RNA, 22 nt, Human
aacccaggagacagguugcagu

SEQ ID NO: 592922 - RNA, 22 nt, Human
ucccagcagucagagcuaugug

SEQ ID NO: 592923 - RNA, 22 nt, Human
agggccugucagcgguguccug

SEQ ID NO: 592924 - RNA, 22 nt, Human
uuggcugaaugaggucaccuuu

SEQ ID NO: 592925 - RNA, 22 nt, Human
auuuuguuuccuuuggaguaga

SEQ ID NO: 592926 - RNA, 22 nt, Human
gcugaaguugccuauuuuaaua

SEQ ID NO: 592927 - RNA, 22 nt, Human
gcugcuucagggacgugccagc

SEQ ID NO: 592928 - RNA, 22 nt, Human
agcugagcauuugauccaccuc

SEQ ID NO: 592929 - RNA, 22 nt, Human
gugcccacgaggccaggcuggu

SEQ ID NO: 592930 - RNA, 22 nt, Human
uccaguugcccaucucucuucu

SEQ ID NO: 592931 - RNA, 17 nt, Human
ggugagaccucccacuc

SEQ ID NO: 592932 - RNA, 22 nt, Human
gcaccugcaggaugagccaggg

SEQ ID NO: 592933 - RNA, 22 nt, Human
agucccagcccaguccuguaag

SEQ ID NO: 592934 - RNA, 22 nt, Human
uuuaggaaguuucagauaggaa

SEQ ID NO: 592935 - RNA, 17 nt, Human
acagucugccugacagu

SEQ ID NO: 592936 - RNA, 22 nt, Human
acuuuucugcagaugaucucuu

SEQ ID NO: 592937 - RNA, 22 nt, Human
ugcuucaaggacacugacuuuu

SEQ ID NO: 592938 - RNA, 22 nt, Human
aaaaugcaugagaaugugcucg

SEQ ID NO: 592939 - RNA, 22 nt, Human
uuugacagugaugauauauaca

SEQ ID NO: 592940 - RNA, 18 nt, Human
gggcagcacagcagccuc

SEQ ID NO: 592941 - RNA, 22 nt, Human
cagcaggcagccauuucacugu

SEQ ID NO: 592942 - RNA, 22 nt, Human
ucuggagugcccugcucugccc

SEQ ID NO: 592943 - RNA, 22 nt, Human
augggcugacccagucguggca

SEQ ID NO: 592944 - RNA, 22 nt, Human
agggccugaggcugacggggag

SEQ ID NO: 592945 - RNA, 19 nt, Human
ucauaaaaaugguaaccca

SEQ ID NO: 592946 - RNA, 22 nt, Human
aguugguucacuccuucaugcc

SEQ ID NO: 592947 - RNA, 22 nt, Human
gccuggagugguccugcugccc

SEQ ID NO: 592948 - RNA, 23 nt, Human
ucuuuacauacugaugaguucuc

SEQ ID NO: 592949 - RNA, 22 nt, Human
gagcuuccuuuuucugcaugac

SEQ ID NO: 592950 - RNA, 22 nt, Human
gacaggcuuccuaagugccaga

SEQ ID NO: 592951 - RNA, 22 nt, Human
ucugcugugauucuacuagugu

SEQ ID NO: 592952 - RNA, 22 nt, Human
uauaggugaauaaaugaguuua

SEQ ID NO: 592953 - RNA, 22 nt, Human
cugucugugccucuucucccag

SEQ ID NO: 592954 - RNA, 22 nt, Human
uuagauacgcaggcaguuuuaa

SEQ ID NO: 592955 - RNA, 22 nt, Human
aaaauuuccaccaucuuugugu

SEQ ID NO: 592956 - RNA, 22 nt, Human
uuugcagcaaggagagagcauu

SEQ ID NO: 592957 - RNA, 22 nt, Human
auaaaaaugagggcgguagcua

SEQ ID NO: 592958 - RNA, 22 nt, Human
uuacauuuggcuauguccucua

SEQ ID NO: 592959 - RNA, 22 nt, Human
cucaccaggaacagcugcggag

SEQ ID NO: 592960 - RNA, 22 nt, Human
ggggaagaaccgggauucccau

SEQ ID NO: 592961 - RNA, 22 nt, Human
agagcugucacauagagccaga

SEQ ID NO: 592962 - RNA, 22 nt, Human
caguggccaugguggcaggggu

SEQ ID NO: 592963 - RNA, 22 nt, Human
gcauggcagugaggauggugcu

SEQ ID NO: 592964 - RNA, 21 nt, Human
cuuuucuguguuccucccugu

SEQ ID NO: 592965 - RNA, 22 nt, Human
aaggguugaagauaaauaaggu

SEQ ID NO: 592966 - RNA, 22 nt, Human
gaguuauagauggacuauuauu

SEQ ID NO: 592967 - RNA, 22 nt, Human
uagggggcuuugcugcuugaca

SEQ ID NO: 592968 - RNA, 22 nt, Human
uuccucagaaaauacuguccaa

SEQ ID NO: 592969 - RNA, 22 nt, Human
uucugcugaagucacugggagc

SEQ ID NO: 592970 - RNA, 22 nt, Human
uaagaguaagugauuaagaaga

SEQ ID NO: 592971 - RNA, 22 nt, Human
uuugagguuagcuagcagauca

SEQ ID NO: 592972 - RNA, 22 nt, Human
augcaguuuuaaaucauuucag

SEQ ID NO: 592973 - RNA, 22 nt, Human
agcucaggcaacucugggcccc

SEQ ID NO: 592974 - RNA, 23 nt, Human
ggcuugagcuggaacagcuuggu

SEQ ID NO: 592975 - RNA, 22 nt, Human
aauaucuuggcccaacuccaga

SEQ ID NO: 592976 - RNA, 22 nt, Human
uguuaaggguaaacagcaguaa

SEQ ID NO: 592977 - RNA, 22 nt, Human
gagaggugaaauaguuguccgg

SEQ ID NO: 592978 - RNA, 22 nt, Human
ggaaggggugggugagccucag

SEQ ID NO: 592979 - RNA, 22 nt, Human
auuaaggaauguaggcaagaag

SEQ ID NO: 592980 - RNA, 22 nt, Human
uagggcugugucuccaggacca

SEQ ID NO: 592981 - RNA, 21 nt, Human
gcagagccggggcgagaaggc

SEQ ID NO: 592982 - RNA, 22 nt, Human
ugccugggacuguacuaaauuu

SEQ ID NO: 592983 - RNA, 22 nt, Human
uaggcugcucaccaggcucaga

SEQ ID NO: 592984 - RNA, 22 nt, Human
cucagccaggugggggucggga

SEQ ID NO: 592985 - RNA, 22 nt, Human
aaaagacaucuauuucaggcag

SEQ ID NO: 592986 - RNA, 22 nt, Human
ucuggggacggggcccagcaau

SEQ ID NO: 592987 - RNA, 22 nt, Human
gcugcugcuugaaggcucggag

SEQ ID NO: 592988 - RNA, 22 nt, Human
uacauucuggaaaggcacagac

SEQ ID NO: 592989 - RNA, 22 nt, Human
ccuuugugguggcccagugugg

SEQ ID NO: 592990 - RNA, 22 nt, Human
ugacaaacccugcaaauagcuc

SEQ ID NO: 592991 - RNA, 22 nt, Human
uagcuggucuuuaagcauguaa

SEQ ID NO: 592992 - RNA, 20 nt, Human
ucugagguaugauagggucu

SEQ ID NO: 592993 - RNA, 22 nt, Human
cuguggcacucaagaagccucc

SEQ ID NO: 592994 - RNA, 22 nt, Human
gcucugggcugcccucuggaca

SEQ ID NO: 592995 - RNA, 22 nt, Human
ugcuucaggagaugucaccaug

SEQ ID NO: 592996 - RNA, 22 nt, Human
aucuggggagguaucuguaguc

SEQ ID NO: 592997 - RNA, 22 nt, Human
cuuccuucugaagcauagaagc

SEQ ID NO: 592998 - RNA, 22 nt, Human
cugggccacuccagaugcccac

SEQ ID NO: 592999 - RNA, 22 nt, Human
ucucuguaucccagaaccaaaa

SEQ ID NO: 593000 - RNA, 23 nt, Human
gcagugcuuggcacagcuggguc

SEQ ID NO: 593001 - RNA, 22 nt, Human
accagagacugcauuucucuga

SEQ ID NO: 593002 - RNA, 22 nt, Human
cuuggaacuuaguaauaugaca

SEQ ID NO: 593003 - RNA, 22 nt, Human
ucauuuacuggauccauaagca

SEQ ID NO: 593004 - RNA, 22 nt, Human
cagcugguguccagggaagugg

SEQ ID NO: 593005 - RNA, 23 nt, Human
ugacacauuuccuuuccacugca

SEQ ID NO: 593006 - RNA, 22 nt, Human
ugaaaugagcauuuauucuuua

SEQ ID NO: 593007 - RNA, 22 nt, Human
ugcugccaggucuugcugucca

SEQ ID NO: 593008 - RNA, 22 nt, Human
aagaggagggcagauucaaggc

SEQ ID NO: 593009 - RNA, 22 nt, Human
uggcaguuuacagaguucugaa

SEQ ID NO: 593010 - RNA, 22 nt, Human
uuucaacauaccucaguguaug

SEQ ID NO: 593011 - RNA, 22 nt, Human
ucauuauccuaguaucuugaau

SEQ ID NO: 593012 - RNA, 22 nt, Human
uagcuuaucccacagugcccag

SEQ ID NO: 593013 - RNA, 22 nt, Human
agaagccauagucugggaggca

SEQ ID NO: 593014 - RNA, 22 nt, Human
uuggaagacaaugcugauucuc

SEQ ID NO: 593015 - RNA, 22 nt, Human
agaaaccugugugcugugauga

SEQ ID NO: 593016 - RNA, 22 nt, Human
ugcagucuuccagcugcacaaa

SEQ ID NO: 593017 - RNA, 22 nt, Human
uugcaguuugcuuuuaauggga

SEQ ID NO: 593018 - RNA, 22 nt, Human
agugauggggcccugcacugau

SEQ ID NO: 593019 - RNA, 22 nt, Human
gcagggagggccuuucaugaca

SEQ ID NO: 593020 - RNA, 20 nt, Human
cccaggugucugaagcucug

SEQ ID NO: 593021 - RNA, 22 nt, Human
ccugggaagaccggcagugggg

SEQ ID NO: 593022 - RNA, 18 nt, Human
aggaagcaggaggaaggc

SEQ ID NO: 593023 - RNA, 22 nt, Human
agacaguguguguauauauggu

SEQ ID NO: 593024 - RNA, 22 nt, Human
cacagguguaugaauaugucca

SEQ ID NO: 593025 - RNA, 22 nt, Human
ugagcauggugggugcagagca

SEQ ID NO: 593026 - RNA, 22 nt, Human
uguuuauuacaguucuuggaau

SEQ ID NO: 593027 - RNA, 22 nt, Human
agaaggaaggcugagugcugau

SEQ ID NO: 593028 - RNA, 22 nt, Human
auuuuacuuugugaauauugac

SEQ ID NO: 593029 - RNA, 22 nt, Human
uccucaggucaaagcaggagaa

SEQ ID NO: 593030 - RNA, 22 nt, Human
cucugcucaccagccaugugau

SEQ ID NO: 593031 - RNA, 22 nt, Human
auacaaaggaacacaggcaugu

SEQ ID NO: 593032 - RNA, 22 nt, Human
uguacaaaguuaaaccuauaua

SEQ ID NO: 593033 - RNA, 22 nt, Human
aauuagaagcuguuagcaaaau

SEQ ID NO: 593034 - RNA, 23 nt, Human
aggcugcagaagaauagggucau

SEQ ID NO: 593035 - RNA, 22 nt, Human
agagaccuuccugacuccagag

SEQ ID NO: 593036 - RNA, 22 nt, Human
cuggccagccucccagguaccc

SEQ ID NO: 593037 - RNA, 18 nt, Human
ccuggcuuuucuacuugc

SEQ ID NO: 593038 - RNA, 22 nt, Human
aacuuuucauaagggcaaauuu

SEQ ID NO: 593039 - RNA, 22 nt, Human
cuuacaaauacacuuaggagag

SEQ ID NO: 593040 - RNA, 22 nt, Human
augauauacuuccuagaacagu

SEQ ID NO: 593041 - RNA, 22 nt, Human
acaguguucuugauauuacagu

SEQ ID NO: 593042 - RNA, 19 nt, Human
guuuuguuugcagaacuua

SEQ ID NO: 593043 - RNA, 22 nt, Human
uuagcauuguacauuugugcuu

SEQ ID NO: 593044 - RNA, 21 nt, Human
uggcucugagccucauggcug

SEQ ID NO: 593045 - RNA, 22 nt, Human
gccagagacacuuggagguaga

SEQ ID NO: 593046 - RNA, 22 nt, Human
ugagugggaccugcguguguca

SEQ ID NO: 593047 - RNA, 17 nt, Human
aauguccuuggaccaca

SEQ ID NO: 593048 - RNA, 22 nt, Human
gauggcagucaaccaggugagg

SEQ ID NO: 593049 - RNA, 22 nt, Human
ggaggacucaggucuggccaug

SEQ ID NO: 593050 - RNA, 22 nt, Human
auggcuugucuaugagugcucu

SEQ ID NO: 593051 - RNA, 22 nt, Human
gagcugggaggacugggaacuu

SEQ ID NO: 593052 - RNA, 22 nt, Human
guuauaaaaugcacaguuguuu

SEQ ID NO: 593053 - RNA, 17 nt, Human
ggaaaagaagaguagga

SEQ ID NO: 593054 - RNA, 22 nt, Human
cuuccuuccacaccuucagaau

SEQ ID NO: 593055 - RNA, 22 nt, Human
uccugagagcagcugcuuugga

SEQ ID NO: 593056 - RNA, 21 nt, Human
guuauuuuaagugagcuuugc

SEQ ID NO: 593057 - RNA, 22 nt, Human
aggcacaggaggugguaagaag

SEQ ID NO: 593058 - RNA, 22 nt, Human
uaggucuguaaaugagagagac

SEQ ID NO: 593059 - RNA, 21 nt, Human
ugguggagugugcugagcaug

SEQ ID NO: 593060 - RNA, 22 nt, Human
gcuggagguuucaccugaguuu

SEQ ID NO: 593061 - RNA, 22 nt, Human
cuucuugagcauggguaguacu

SEQ ID NO: 593062 - RNA, 20 nt, Human
uuuuagcacuuguuauggug

SEQ ID NO: 593063 - RNA, 22 nt, Human
agaaacaucgcuuaguccucau

SEQ ID NO: 593064 - RNA, 19 nt, Human
cuuaugcagcugagcuugg

SEQ ID NO: 593065 - RNA, 18 nt, Human
gcucuuucugucuccagc

SEQ ID NO: 593066 - RNA, 22 nt, Human
acuaagaccuaaaauugugaau

SEQ ID NO: 593067 - RNA, 22 nt, Human
aaggcucuuggagugaaugcag

SEQ ID NO: 593068 - RNA, 22 nt, Human
auacaugugccgcguuggugug

SEQ ID NO: 593069 - RNA, 22 nt, Human
cauuuccugucuggaggucaaa

SEQ ID NO: 593070 - RNA, 22 nt, Human
cuuaaagaugucaaggcuguuu

SEQ ID NO: 593071 - RNA, 22 nt, Human
guuuucuggcaguuauuccuua

SEQ ID NO: 593072 - RNA, 22 nt, Human
gagaaacaacacuugaugccuu

SEQ ID NO: 593073 - RNA, 22 nt, Human
aguuuuauaaaggcaccucagu

SEQ ID NO: 593074 - RNA, 23 nt, Human
gcugccuccuacaaaagcccagc

SEQ ID NO: 593075 - RNA, 22 nt, Human
ucacuuugcaaauggcacggga

SEQ ID NO: 593076 - RNA, 22 nt, Human
agagaaggguguagccugggcc

SEQ ID NO: 593077 - RNA, 22 nt, Human
cuuucacaagauuugagaugcu

SEQ ID NO: 593078 - RNA, 22 nt, Human
cuuuguccauugauucguucaa

SEQ ID NO: 593079 - RNA, 17 nt, Human
ucugagaaaggagaauc

SEQ ID NO: 593080 - RNA, 22 nt, Human
aaugcauucucgguuugugugu

SEQ ID NO: 593081 - RNA, 22 nt, Human
ccagagcuaaacacacaggcug

SEQ ID NO: 593082 - RNA, 22 nt, Human
uccaggcaaaaggaacugcuug

SEQ ID NO: 593083 - RNA, 22 nt, Human
cccagcucucgcacuuacuagc

SEQ ID NO: 593084 - RNA, 22 nt, Human
agguggcuucuggccaggugug

SEQ ID NO: 593085 - RNA, 22 nt, Human
caguccuugcucugggaugaug

SEQ ID NO: 593086 - RNA, 21 nt, Human
ggagauggguaucgccugggc

SEQ ID NO: 593087 - RNA, 22 nt, Human
agccaaggagugcagguggcuu

SEQ ID NO: 593088 - RNA, 22 nt, Human
ccagcagagggcgcuucacacc

SEQ ID NO: 593089 - RNA, 22 nt, Human
aguaacaugcuaauuugauuau

SEQ ID NO: 593090 - RNA, 20 nt, Human
agcacuagguguggcaggug

SEQ ID NO: 593091 - RNA, 22 nt, Human
ugaaaauuaagcagaugaauga

SEQ ID NO: 593092 - RNA, 22 nt, Human
auggaaauccaagucaccguag

SEQ ID NO: 593093 - RNA, 22 nt, Human
cugugccucccuuuacuuugag

SEQ ID NO: 593094 - RNA, 22 nt, Human
ucuuaacauauuauuuuagcac

SEQ ID NO: 593095 - RNA, 22 nt, Human
aaacugucaccuaauguauuuu

SEQ ID NO: 593096 - RNA, 22 nt, Human
aggauucuguaaucugugaaau

SEQ ID NO: 593097 - RNA, 22 nt, Human
ccugggcuuccacgagcagagg

SEQ ID NO: 593098 - RNA, 22 nt, Human
ugcugaaaacucaaccauugug

SEQ ID NO: 593099 - RNA, 19 nt, Human
ggcuggcaagugacagugu

SEQ ID NO: 593100 - RNA, 22 nt, Human
aaggugucggguuagcucagcc

SEQ ID NO: 593101 - RNA, 23 nt, Human
ugaagugaaauuucacaagggac

SEQ ID NO: 593102 - RNA, 19 nt, Human
uggaggccaggacacaggu

SEQ ID NO: 593103 - RNA, 22 nt, Human
gccaguguuuauagcagugagg

SEQ ID NO: 593104 - RNA, 22 nt, Human
agugaccaacaaugcugagaag

SEQ ID NO: 593105 - RNA, 22 nt, Human
cuuuacugccaugcauuuauaa

SEQ ID NO: 593106 - RNA, 22 nt, Human
ggaggccaucuggcuggaggcu

SEQ ID NO: 593107 - RNA, 22 nt, Human
ugcauucugacuuaguuaauau

SEQ ID NO: 593108 - RNA, 22 nt, Human
cugggcuuagcagcuccugguc

SEQ ID NO: 593109 - RNA, 22 nt, Human
auugucauuggcuucuaugucu

SEQ ID NO: 593110 - RNA, 21 nt, Human
agcaccuucaauucuauuguc

SEQ ID NO: 593111 - RNA, 19 nt, Human
ggcagaagguguaggggga

SEQ ID NO: 593112 - RNA, 22 nt, Human
gcaaggcagcgcggaguagcua

SEQ ID NO: 593113 - RNA, 22 nt, Human
uguaggaaaaacaaugaucugc

SEQ ID NO: 593114 - RNA, 22 nt, Human
cucaagaaggaugagcuauugc

SEQ ID NO: 593115 - RNA, 21 nt, Human
gccacugcacuccagccuggg

SEQ ID NO: 593116 - RNA, 22 nt, Human
acaugcuacagugaaggaggaa

SEQ ID NO: 593117 - RNA, 22 nt, Human
uacagaaaaacaucuggagccg

SEQ ID NO: 593118 - RNA, 22 nt, Human
auucgcgggccuggaggguggg

SEQ ID NO: 593119 - RNA, 22 nt, Human
cugauucuuucuucuugccagg

SEQ ID NO: 593120 - RNA, 22 nt, Human
uaagcaaugagauaaucauggg

SEQ ID NO: 593121 - RNA, 22 nt, Human
uuacaauuacuugaucucagcu

SEQ ID NO: 593122 - RNA, 21 nt, Human
cgggcuggccgggcccucacc

SEQ ID NO: 593123 - RNA, 22 nt, Human
ucuuugcaguucugauuaaaua

SEQ ID NO: 593124 - RNA, 22 nt, Human
caggcuaaagcuuugagcaugu

SEQ ID NO: 593125 - RNA, 22 nt, Human
uugcuuuacaaaaauugauggu

SEQ ID NO: 593126 - RNA, 22 nt, Human
uccugaagaaggcagauauuug

SEQ ID NO: 593127 - RNA, 22 nt, Human
cagugggauugggauuggaacc

SEQ ID NO: 593128 - RNA, 22 nt, Human
ccagcucccgcaggcugcacag

SEQ ID NO: 593129 - RNA, 22 nt, Human
agggcucagggcacgucaucca

SEQ ID NO: 593130 - RNA, 22 nt, Human
aaugauugcaaacauugagaac

SEQ ID NO: 593131 - RNA, 22 nt, Human
uuuccuuucuagaagccuaaau

SEQ ID NO: 593132 - RNA, 22 nt, Human
aggcauuuuguucaagaugaca

SEQ ID NO: 593133 - RNA, 22 nt, Human
acaugaaaguuauucugaguug

SEQ ID NO: 593134 - RNA, 22 nt, Human
ugcagcugauuaaagggcagac

SEQ ID NO: 593135 - RNA, 22 nt, Human
ucaugcaaagccaauuccagcu

SEQ ID NO: 593136 - RNA, 22 nt, Human
auuuaugacaaccaaagaguga

SEQ ID NO: 593137 - RNA, 22 nt, Human
uuccugggggcagcagucuuga

SEQ ID NO: 593138 - RNA, 22 nt, Human
agcaaacaguuucuggggaucu

SEQ ID NO: 593139 - RNA, 22 nt, Human
uggcugcccccucccguggaca

SEQ ID NO: 593140 - RNA, 22 nt, Human
uccagcccuccugggaucacag

SEQ ID NO: 593141 - RNA, 22 nt, Human
guccagagggcugcaggaugcu

SEQ ID NO: 593142 - RNA, 22 nt, Human
ccaguguuccagagagcugaug

SEQ ID NO: 593143 - RNA, 23 nt, Human
gggcauggaguguagguggaagg

SEQ ID NO: 593144 - RNA, 22 nt, Human
gccugggaagacuaagugggag

SEQ ID NO: 593145 - RNA, 22 nt, Human
uaauauguguuacugacuuuuu

SEQ ID NO: 593146 - RNA, 22 nt, Human
cugggguggaggagcuccccug

SEQ ID NO: 593147 - RNA, 22 nt, Human
agaaguuugguccuauaaacuc

SEQ ID NO: 593148 - RNA, 22 nt, Human
uauaaaauucucaguuuggggu

SEQ ID NO: 593149 - RNA, 22 nt, Human
guccugugcccagacccucugu

SEQ ID NO: 593150 - RNA, 22 nt, Human
acaggcagcaaaaucagccuca

SEQ ID NO: 593151 - RNA, 22 nt, Human
uuuccucugucaugacagcuga

SEQ ID NO: 593152 - RNA, 21 nt, Human
uggagacucugguucuuugug

SEQ ID NO: 593153 - RNA, 18 nt, Human
uacuuuauucccccucca

SEQ ID NO: 593154 - RNA, 22 nt, Human
caggggccuguccuggcuucug

SEQ ID NO: 593155 - RNA, 23 nt, Human
ccugagaucuguaagggaccuug

SEQ ID NO: 593156 - RNA, 22 nt, Human
accacaggacccaugagucagu

SEQ ID NO: 593157 - RNA, 22 nt, Human
uuagugucuggcuauauuuaaa

SEQ ID NO: 593158 - RNA, 18 nt, Human
aggucugaggaagagccu

SEQ ID NO: 593159 - RNA, 22 nt, Human
acugucaccaucagagcgggaa

SEQ ID NO: 593160 - RNA, 22 nt, Human
ucagugcuugacagcucuggga

SEQ ID NO: 593161 - RNA, 20 nt, Human
uggaugcugcacguagaugg

SEQ ID NO: 593162 - RNA, 22 nt, Human
aagcagaaagaacaacugagug

SEQ ID NO: 593163 - RNA, 22 nt, Human
uggagugcaauaguaauaaggu

SEQ ID NO: 593164 - RNA, 22 nt, Human
gcaggcagucaucuuucauauu

SEQ ID NO: 593165 - RNA, 22 nt, Human
gcccuuacaggguggucagcca

SEQ ID NO: 593166 - RNA, 22 nt, Human
aggcugcugccuuggagagugu

SEQ ID NO: 593167 - RNA, 18 nt, Human
gugccaggaggcgcagcc

SEQ ID NO: 593168 - RNA, 22 nt, Human
gggacuggccaggguuuggaau

SEQ ID NO: 593169 - RNA, 22 nt, Human
gcuucuguuaacuuauguuccc

SEQ ID NO: 593170 - RNA, 22 nt, Human
acacagauaaugcucauauagg

SEQ ID NO: 593171 - RNA, 22 nt, Human
uacagugcacauuucuuaggaa

SEQ ID NO: 593172 - RNA, 22 nt, Human
gcugcucucauagauggcuuca

SEQ ID NO: 593173 - RNA, 22 nt, Human
caguuaaacgggccaugugagu

SEQ ID NO: 593174 - RNA, 20 nt, Human
gccacaguuuucucacugca

SEQ ID NO: 593175 - RNA, 22 nt, Human
cagugcagccaaggacaggcac

SEQ ID NO: 593176 - RNA, 22 nt, Human
ggcuucagaggggagguagugc

SEQ ID NO: 593177 - RNA, 22 nt, Human
aguguggagcaucgagggcaga

SEQ ID NO: 593178 - RNA, 19 nt, Human
accugcaguaauaauuccu

SEQ ID NO: 593179 - RNA, 22 nt, Human
uggagcaggacggggaguggua

SEQ ID NO: 593180 - RNA, 22 nt, Human
ucccaggaaugucugaaaguga

SEQ ID NO: 593181 - RNA, 22 nt, Human
gucugcccuuggcucagccaua

SEQ ID NO: 593182 - RNA, 22 nt, Human
ucacugcagguuuuucaggagg

SEQ ID NO: 593183 - RNA, 20 nt, Human
uguucacaguaguugcugcu

SEQ ID NO: 593184 - RNA, 22 nt, Human
aagaguauuugguauagaacac

SEQ ID NO: 593185 - RNA, 22 nt, Human
acuguacaaccucugccccugu

SEQ ID NO: 593186 - RNA, 22 nt, Human
cagcagccuacaaugcacagaa

SEQ ID NO: 593187 - RNA, 22 nt, Human
uuuaugacuucuaaucugaagc

SEQ ID NO: 593188 - RNA, 22 nt, Human
uggaaacucuaccucucuaaga

SEQ ID NO: 593189 - RNA, 22 nt, Human
auuacaaaagaagggagaaggu

SEQ ID NO: 593190 - RNA, 22 nt, Human
gagagcugucagcguagcaccg

SEQ ID NO: 593191 - RNA, 22 nt, Human
ggaggggccggcugccugccac

SEQ ID NO: 593192 - RNA, 19 nt, Human
uguuuuguuaaagcagucc

SEQ ID NO: 593193 - RNA, 22 nt, Human
agcccucucuauggcccucuug

SEQ ID NO: 593194 - RNA, 22 nt, Human
uaucaguagauaaacggauugc

SEQ ID NO: 593195 - RNA, 22 nt, Human
agaaaccaucuuuauauaucug

SEQ ID NO: 593196 - RNA, 22 nt, Human
uggcccugcuggccaaaggcua

SEQ ID NO: 593197 - RNA, 22 nt, Human
acucucugguguagaaagaccu

SEQ ID NO: 593198 - RNA, 22 nt, Human
cuggggaugggaccuggcauaa

SEQ ID NO: 593199 - RNA, 22 nt, Human
agugaggcaaagugagaggcag

SEQ ID NO: 593200 - RNA, 22 nt, Human
ugaaacauuugaugaucuuugg

SEQ ID NO: 593201 - RNA, 22 nt, Human
ugcuuaaacccugaucaugugu

SEQ ID NO: 593202 - RNA, 21 nt, Human
ggaguccaaaaauuagccaug

SEQ ID NO: 593203 - RNA, 22 nt, Human
acauuucauuugcaguauggau

SEQ ID NO: 593204 - RNA, 22 nt, Human
ggggauggaauguaguagugau

SEQ ID NO: 593205 - RNA, 22 nt, Human
uccaauaaccacaaucagauag

SEQ ID NO: 593206 - RNA, 22 nt, Human
auuagcuuuggauucagaagau

SEQ ID NO: 593207 - RNA, 22 nt, Human
ucuucgcuuacuguguaaggag

SEQ ID NO: 593208 - RNA, 22 nt, Human
agaggccaaagaaucuacaaga

SEQ ID NO: 593209 - RNA, 22 nt, Human
guguuauuagagcauuaauuuu

SEQ ID NO: 593210 - RNA, 22 nt, Human
uauugaccagacugacacacau

SEQ ID NO: 593211 - RNA, 22 nt, Human
uuuccugugcuuaacaaauauu

SEQ ID NO: 593212 - RNA, 22 nt, Human
gagggccaggcggagacaggcg

SEQ ID NO: 593213 - RNA, 22 nt, Human
acccaggggcgaagcuggccac

SEQ ID NO: 593214 - RNA, 22 nt, Human
aggcagagcuggguuuugaaau

SEQ ID NO: 593215 - RNA, 22 nt, Human
aucugcuuccugggcuccauga

SEQ ID NO: 593216 - RNA, 22 nt, Human
uaaauguuuuguggguugaguu

SEQ ID NO: 593217 - RNA, 22 nt, Human
gccagguguccucacagugagg

SEQ ID NO: 593218 - RNA, 20 nt, Human
agacccuguguccuguggcc

SEQ ID NO: 593219 - RNA, 22 nt, Human
guuucucugucuguuacauugg

SEQ ID NO: 593220 - RNA, 22 nt, Human
uccagggcugacuugggagagg

SEQ ID NO: 593221 - RNA, 22 nt, Human
gacagcaguuuuucucuagggu

SEQ ID NO: 593222 - RNA, 22 nt, Human
ugaucugguccuacugugggca

SEQ ID NO: 593223 - RNA, 22 nt, Human
uucagcacccucugaggcaucc

SEQ ID NO: 593224 - RNA, 19 nt, Human
auacaagacuagcauuuac

SEQ ID NO: 593225 - RNA, 22 nt, Human
aggcccugggagcagagaugca

SEQ ID NO: 593226 - RNA, 22 nt, Human
cagcuguucagcaacucgcaga

SEQ ID NO: 593227 - RNA, 22 nt, Human
cuuagcagauaaaaaccuucag

SEQ ID NO: 593228 - RNA, 22 nt, Human
cagcagugugcaggugugcugg

SEQ ID NO: 593229 - RNA, 22 nt, Human
acuucuugggacccuggcaccg

SEQ ID NO: 593230 - RNA, 22 nt, Human
ccagggcuuuaucugccuuuga

SEQ ID NO: 593231 - RNA, 22 nt, Human
ucuacaaauaaauuacuaugua

SEQ ID NO: 593232 - RNA, 22 nt, Human
ggagcacccugcucagccaagc

SEQ ID NO: 593233 - RNA, 22 nt, Human
acaugauuuuaguaucauaaua

SEQ ID NO: 593234 - RNA, 22 nt, Human
uaaaaucauucuggugucagua

SEQ ID NO: 593235 - RNA, 22 nt, Human
auggcauucacauuuccagaga

SEQ ID NO: 593236 - RNA, 22 nt, Human
uggcagguagucagaggcgaca

SEQ ID NO: 593237 - RNA, 22 nt, Human
caacagcuggaggcuuggcccg

SEQ ID NO: 593238 - RNA, 23 nt, Human
acagugaaacacgcaguaagagu

SEQ ID NO: 593239 - RNA, 22 nt, Human
cuccaguggugauggggaagaa

SEQ ID NO: 593240 - RNA, 22 nt, Human
uaaagcauguguuagaagugca

SEQ ID NO: 593241 - RNA, 22 nt, Human
uaacauuacggacaucugucag

SEQ ID NO: 593242 - RNA, 20 nt, Human
aaacagcuaaaccagcucuc

SEQ ID NO: 593243 - RNA, 22 nt, Human
caggaguguugauugcucagga

SEQ ID NO: 593244 - RNA, 22 nt, Human
cuguccccgcgaguccagagcu

SEQ ID NO: 593245 - RNA, 22 nt, Human
uccagcuucuugacuugguggu

SEQ ID NO: 593246 - RNA, 22 nt, Human
cuuguauacaguguacacauug

SEQ ID NO: 593247 - RNA, 21 nt, Human
gugcggaugccgucauuguca

SEQ ID NO: 593248 - RNA, 22 nt, Human
uuauuuauucauucugucuguc

SEQ ID NO: 593249 - RNA, 22 nt, Human
ucuggagaaucugucagugugg

SEQ ID NO: 593250 - RNA, 22 nt, Human
cugagcagugcuuugcaguggg

SEQ ID NO: 593251 - RNA, 22 nt, Human
aaaaugagcauauugauccuuu

SEQ ID NO: 593252 - RNA, 22 nt, Human
acagccuggacuggcucucugc

SEQ ID NO: 593253 - RNA, 21 nt, Human
ccaggggcaaauugucguuuc

SEQ ID NO: 593254 - RNA, 21 nt, Human
gagugcagcaagguagagucu

SEQ ID NO: 593255 - RNA, 22 nt, Human
aagucucuuuggguacuuuauu

SEQ ID NO: 593256 - RNA, 22 nt, Human
acuguauauacagcucaaggaa

SEQ ID NO: 593257 - RNA, 22 nt, Human
uccaggcuagguuuacaggaca

SEQ ID NO: 593258 - RNA, 22 nt, Human
ucuggagaagcagugagaguca

SEQ ID NO: 593259 - RNA, 22 nt, Human
acagggaagcucaggggcucug

SEQ ID NO: 593260 - RNA, 22 nt, Human
caggaacacaaguucagggaug

SEQ ID NO: 593261 - RNA, 22 nt, Human
ucucccaggcuggagugcagug

SEQ ID NO: 593262 - RNA, 23 nt, Human
cauguacacacagcuguacagug

SEQ ID NO: 593263 - RNA, 22 nt, Human
auaaacuugagucucagaguau

SEQ ID NO: 593264 - RNA, 22 nt, Human
gcccagaaguugaggcugcagu

SEQ ID NO: 593265 - RNA, 22 nt, Human
ugcugggcuugaaagcugcuaa

SEQ ID NO: 593266 - RNA, 23 nt, Human
agacauuuuaauaaggacuuuuu

SEQ ID NO: 593267 - RNA, 23 nt, Human
auaugucaugcaccagcacuuua

SEQ ID NO: 593268 - RNA, 22 nt, Human
cuucucuggcuccucagcgccc

SEQ ID NO: 593269 - RNA, 22 nt, Human
gcagaagcccggucagcgcacg

SEQ ID NO: 593270 - RNA, 20 nt, Human
aaccaacagaaucaugucuc

SEQ ID NO: 593271 - RNA, 22 nt, Human
agaucggcuuugcagaccucau

SEQ ID NO: 593272 - RNA, 22 nt, Human
gcuggaguuggcaaggcaugua

SEQ ID NO: 593273 - RNA, 22 nt, Human
guucaaauucuaugaaauaugu

SEQ ID NO: 593274 - RNA, 22 nt, Human
gcccugcccuguugaaacuaga

SEQ ID NO: 593275 - RNA, 22 nt, Human
cagaugaagaucauagaauagu

SEQ ID NO: 593276 - RNA, 22 nt, Human
cagaggcaggaagaugggcagu

SEQ ID NO: 593277 - RNA, 22 nt, Human
aagcacaucucaaacuucaucu

SEQ ID NO: 593278 - RNA, 21 nt, Human
uguguuuuaaugauauucugu

SEQ ID NO: 593279 - RNA, 22 nt, Human
ugcagagggacagccacagcuc

SEQ ID NO: 593280 - RNA, 22 nt, Human
aaaugguaguagcauuccauau

SEQ ID NO: 593281 - RNA, 22 nt, Human
auccuuccagaguuauucucaa

SEQ ID NO: 593282 - RNA, 22 nt, Human
gacaggcaauuaccagcgccca

SEQ ID NO: 593283 - RNA, 22 nt, Human
gcuuauuuucaccuucucucag

SEQ ID NO: 593284 - RNA, 22 nt, Human
acucuuuacuuaaacucuaagu

SEQ ID NO: 593285 - RNA, 22 nt, Human
ggauggagguucucagaugcuc

SEQ ID NO: 593286 - RNA, 22 nt, Human
cccugcagagaccacugaccuu

SEQ ID NO: 593287 - RNA, 22 nt, Human
ccaguguucauaauuuuacacu

SEQ ID NO: 593288 - RNA, 22 nt, Human
ugccauccaacaguuccaucuu

SEQ ID NO: 593289 - RNA, 19 nt, Human
ccuggagucgcgcugccuc

SEQ ID NO: 593290 - RNA, 22 nt, Human
ucacagcauucgcaauggacag

SEQ ID NO: 593291 - RNA, 22 nt, Human
ucccagagacagagccuccucc

SEQ ID NO: 593292 - RNA, 22 nt, Human
ugaaacauuaggaaaucauuau

SEQ ID NO: 593293 - RNA, 22 nt, Human
cccuggcagagggggcaggugc

SEQ ID NO: 593294 - RNA, 22 nt, Human
aguguuguaugggaugacugcu

SEQ ID NO: 593295 - RNA, 23 nt, Human
aggaauggcuagaagugugaccc

SEQ ID NO: 593296 - RNA, 22 nt, Human
ggaaagaggauaguggguaggu

SEQ ID NO: 593297 - RNA, 22 nt, Human
ggcgcuggccacgguggcucug

SEQ ID NO: 593298 - RNA, 22 nt, Human
agcaggguuccaggaguugcag

SEQ ID NO: 593299 - RNA, 20 nt, Human
ugacauagcucuuggggugc

SEQ ID NO: 593300 - RNA, 21 nt, Human
ugcuggcugaaaggcacagag

SEQ ID NO: 593301 - RNA, 22 nt, Human
uacacagaagccagaaggccug

SEQ ID NO: 593302 - RNA, 22 nt, Human
cuugucuugcacacgguugcca

SEQ ID NO: 593303 - RNA, 22 nt, Human
gucccagggaugcagacaugag

SEQ ID NO: 593304 - RNA, 22 nt, Human
auucugaauucugagccuuuca

SEQ ID NO: 593305 - RNA, 23 nt, Human
agaugaaagcuucccaucacagu

SEQ ID NO: 593306 - RNA, 22 nt, Human
uauugaguuacagaaaauacuu

SEQ ID NO: 593307 - RNA, 22 nt, Human
ugucugugaccucuuuggagcc

SEQ ID NO: 593308 - RNA, 22 nt, Human
auguguguaaacaaguauaauu

SEQ ID NO: 593309 - RNA, 22 nt, Human
aacagaaucuuggguucuuuuc

SEQ ID NO: 593310 - RNA, 22 nt, Human
ggugugggggcagcucugauau

SEQ ID NO: 593311 - RNA, 22 nt, Human
uugguagaaugaacauucauug

SEQ ID NO: 593312 - RNA, 22 nt, Human
gcccagaaagacugccuaacag

SEQ ID NO: 593313 - RNA, 22 nt, Human
uguaucuuucuguacuuuuaug

SEQ ID NO: 593314 - RNA, 22 nt, Human
guugggguaccuugaggcuggg

SEQ ID NO: 593315 - RNA, 22 nt, Human
guaagcauucauugucuguaua

SEQ ID NO: 593316 - RNA, 22 nt, Human
auccugggccucagaggugugu

SEQ ID NO: 593317 - RNA, 22 nt, Human
gcacuaguguucuucaguaaua

SEQ ID NO: 593318 - RNA, 22 nt, Human
agcaggugacagggcuguggug

SEQ ID NO: 593319 - RNA, 22 nt, Human
uacagaaagaccucucgggaaa

SEQ ID NO: 593320 - RNA, 22 nt, Human
uauaauuuaucaugucacaguu

SEQ ID NO: 593321 - RNA, 22 nt, Human
ccaggcucugagccucacucuu

SEQ ID NO: 593322 - RNA, 22 nt, Human
uagaauacuagugaagucaucg

SEQ ID NO: 593323 - RNA, 22 nt, Human
uugcauaauagcuacccacuca

SEQ ID NO: 593324 - RNA, 22 nt, Human
gcaaaggcuucuuuuauucucc

SEQ ID NO: 593325 - RNA, 22 nt, Human
agagguauuagguaauucagua

SEQ ID NO: 593326 - RNA, 22 nt, Human
auucagagauuguuauucagac

SEQ ID NO: 593327 - RNA, 22 nt, Human
cuccaaaggauaaaagcagagu

SEQ ID NO: 593328 - RNA, 22 nt, Human
ucaguccuauccaaacuauaua

SEQ ID NO: 593329 - RNA, 22 nt, Human
ucauuguuacuguuuaguugcc

SEQ ID NO: 593330 - RNA, 22 nt, Human
ucugaauguuaggaaacuuucu

SEQ ID NO: 593331 - RNA, 22 nt, Human
gaacauuuggauuuguaaauuu

SEQ ID NO: 593332 - RNA, 23 nt, Human
gggaccaggcccuuccugguuug

SEQ ID NO: 593333 - RNA, 23 nt, Human
uccagccaaaucuggcugacagu

SEQ ID NO: 593334 - RNA, 22 nt, Human
ugcugaaagucccaaaucucau

SEQ ID NO: 593335 - RNA, 22 nt, Human
gaaggaagucauuagugcagac

SEQ ID NO: 593336 - RNA, 22 nt, Human
ugcuccagcaacaggcuuagcu

SEQ ID NO: 593337 - RNA, 22 nt, Human
agauacuauggaauuuuaugag

SEQ ID NO: 593338 - RNA, 22 nt, Human
acugccugcuccuggcuccaca

SEQ ID NO: 593339 - RNA, 22 nt, Human
aaggcaggaugcggacccaucu

SEQ ID NO: 593340 - RNA, 22 nt, Human
ggaaacuaaagagguguuuuug

SEQ ID NO: 593341 - RNA, 21 nt, Human
uucucagagucuauuacaguu

SEQ ID NO: 593342 - RNA, 22 nt, Human
acaguucccgucuugcacagcu

SEQ ID NO: 593343 - RNA, 22 nt, Human
augugagggaaaucagucagaa

SEQ ID NO: 593344 - RNA, 22 nt, Human
ugagaugaauaacuccugcuaa

SEQ ID NO: 593345 - RNA, 22 nt, Human
uaugaggcacuucauuagcugg

SEQ ID NO: 593346 - RNA, 22 nt, Human
cacagcuucuuccauuccacuc

SEQ ID NO: 593347 - RNA, 22 nt, Human
uggagcuugggacucuugguag

SEQ ID NO: 593348 - RNA, 22 nt, Human
augaagacuaaugugaauggga

SEQ ID NO: 593349 - RNA, 22 nt, Human
uuagaguuuucuguuccucuaa

SEQ ID NO: 593350 - RNA, 22 nt, Human
auacaagaucacuccagaaaau

SEQ ID NO: 593351 - RNA, 21 nt, Human
ggguauaaaaugguaucucau

SEQ ID NO: 593352 - RNA, 22 nt, Human
agagcuguuuggacaucugagu

SEQ ID NO: 593353 - RNA, 22 nt, Human
agcagcucccuccucagccacc

SEQ ID NO: 593354 - RNA, 22 nt, Human
gcuggcugaguucugucgucug

SEQ ID NO: 593355 - RNA, 22 nt, Human
uucccugaagaccucaugugac

SEQ ID NO: 593356 - RNA, 22 nt, Human
caggccagugugcuucccaggc

SEQ ID NO: 593357 - RNA, 22 nt, Human
agcuccagggaaagaguggauc

SEQ ID NO: 593358 - RNA, 22 nt, Human
ugggacuuaauaugcccuugau

SEQ ID NO: 593359 - RNA, 22 nt, Human
agaggauuuuaaaagcauaugu

SEQ ID NO: 593360 - RNA, 22 nt, Human
agagggggugucagcacugcag

SEQ ID NO: 593361 - RNA, 22 nt, Human
caggugacccucaguguggacu

SEQ ID NO: 593362 - RNA, 22 nt, Human
ucuuggcuguaccauugacuag

SEQ ID NO: 593363 - RNA, 22 nt, Human
caucacauguaggcagcaucac

SEQ ID NO: 593364 - RNA, 22 nt, Human
cugaguguuuucagccacggcc

SEQ ID NO: 593365 - RNA, 21 nt, Human
ugcauaaagaaauacaaauac

SEQ ID NO: 593366 - RNA, 22 nt, Human
uuucacauaaauauuaugccua

SEQ ID NO: 593367 - RNA, 22 nt, Human
ugggcacagaauagauggccca

SEQ ID NO: 593368 - RNA, 22 nt, Human
gucugcuggugccuggccugcg

SEQ ID NO: 593369 - RNA, 20 nt, Human
ccuucucuggaauugccucc

SEQ ID NO: 593370 - RNA, 22 nt, Human
cagcagaggaaagcaaaucuaa

SEQ ID NO: 593371 - RNA, 22 nt, Human
acauuucacuguucacagcagg

SEQ ID NO: 593372 - RNA, 22 nt, Human
gggcuccacgcacgcgagaggu

SEQ ID NO: 593373 - RNA, 18 nt, Human
uuguuuuaagacucuguc

SEQ ID NO: 593374 - RNA, 21 nt, Human
gggcacugaaagggaauagca

SEQ ID NO: 593375 - RNA, 20 nt, Human
gugggcagaugugugcaugg

SEQ ID NO: 593376 - RNA, 22 nt, Human
uuccuggugaccucacugguag

SEQ ID NO: 593377 - RNA, 22 nt, Human
acuuuuugcuggucucuuccau

SEQ ID NO: 593378 - RNA, 20 nt, Human
acauaugugugcauaucuuu

SEQ ID NO: 593379 - RNA, 22 nt, Human
ugacucuguaccugucugccuu

SEQ ID NO: 593380 - RNA, 22 nt, Human
agaaaaguuuaaaucuuggcac

SEQ ID NO: 593381 - RNA, 22 nt, Human
gggaagcagcauugugcuggcu

SEQ ID NO: 593382 - RNA, 22 nt, Human
uaauuuaauccaaguguuacau

SEQ ID NO: 593383 - RNA, 22 nt, Human
uucugugugucucagcaagcug

SEQ ID NO: 593384 - RNA, 22 nt, Human
cagcaaagcaggcuccuagaac

SEQ ID NO: 593385 - RNA, 22 nt, Human
aguaauagagauuuuaaugucc

SEQ ID NO: 593386 - RNA, 22 nt, Human
uaaagacauaggaucagggaga

SEQ ID NO: 593387 - RNA, 22 nt, Human
gaguguggugaacaggagcacc

SEQ ID NO: 593388 - RNA, 18 nt, Human
cagcauuagcagcuucca

SEQ ID NO: 593389 - RNA, 18 nt, Human
agcagaauucuaggguuc

SEQ ID NO: 593390 - RNA, 22 nt, Human
accaugucauuuauuggccaaa

SEQ ID NO: 593391 - RNA, 22 nt, Human
agagcugaauucaagugcuggc

SEQ ID NO: 593392 - RNA, 22 nt, Human
ugucacauguuuaauguggacu

SEQ ID NO: 593393 - RNA, 22 nt, Human
acaguguuuaaaauaauaugcu

SEQ ID NO: 593394 - RNA, 22 nt, Human
cuugaaauccagauuucagagg

SEQ ID NO: 593395 - RNA, 22 nt, Human
aaguuacauuuuggucuaauug

SEQ ID NO: 593396 - RNA, 21 nt, Human
aggaggagagcuuggccuacc

SEQ ID NO: 593397 - RNA, 22 nt, Human
uugagagugccaagcauccucc

SEQ ID NO: 593398 - RNA, 22 nt, Human
gguuauuuugguugucuaaggc

SEQ ID NO: 593399 - RNA, 22 nt, Human
uauguacaaucagcaguucaua

SEQ ID NO: 593400 - RNA, 22 nt, Human
ugcuccaggagcaaccuuugag

SEQ ID NO: 593401 - RNA, 22 nt, Human
ucugaggcuauguucaggcuaa

SEQ ID NO: 593402 - RNA, 22 nt, Human
gaaggcugagcagacaggccaa

SEQ ID NO: 593403 - RNA, 22 nt, Human
uggugcaguccaaagggagcag

SEQ ID NO: 593404 - RNA, 22 nt, Human
guggguggaucaugaggucagg

SEQ ID NO: 593405 - RNA, 22 nt, Human
ucaggaugaagucagagggguc

SEQ ID NO: 593406 - RNA, 22 nt, Human
gcccaggaguucaagucuagug

SEQ ID NO: 593407 - RNA, 23 nt, Human
uuucaguuccagaaaaggggagc

SEQ ID NO: 593408 - RNA, 22 nt, Human
gaggagaaagcagugauuugug

SEQ ID NO: 593409 - RNA, 22 nt, Human
guuuugugaggcacccacaggu

SEQ ID NO: 593410 - RNA, 22 nt, Human
caccugcucccucaguuccagc

SEQ ID NO: 593411 - RNA, 20 nt, Human
ugauauuucuggaaguggag

SEQ ID NO: 593412 - RNA, 22 nt, Human
agcccugggcaccugugagggg

SEQ ID NO: 593413 - RNA, 22 nt, Human
ugucaccaugcgaggcuaauuu

SEQ ID NO: 593414 - RNA, 22 nt, Human
caauagcagcuucugaaugcaa

SEQ ID NO: 593415 - RNA, 22 nt, Human
ugagguaggugguaagagauac

SEQ ID NO: 593416 - RNA, 21 nt, Human
uggauaaaggcacuuuucauc

SEQ ID NO: 593417 - RNA, 22 nt, Human
uuuagugcuuugcuauucaugg

SEQ ID NO: 593418 - RNA, 22 nt, Human
gcagagccuugcgucaugugcc

SEQ ID NO: 593419 - RNA, 22 nt, Human
uacagguggaucacuaguauag

SEQ ID NO: 593420 - RNA, 18 nt, Human
ucucuucuuggcagucaa

SEQ ID NO: 593421 - RNA, 22 nt, Human
uagucacacaauuguguacauu

SEQ ID NO: 593422 - RNA, 22 nt, Human
acaagauuuggcugaaacucca

SEQ ID NO: 593423 - RNA, 22 nt, Human
accccaggaaguggaggucaug

SEQ ID NO: 593424 - RNA, 22 nt, Human
gucuuucuucagagcuuggacu

SEQ ID NO: 593425 - RNA, 22 nt, Human
cccaggagaauauaauguucuu

SEQ ID NO: 593426 - RNA, 20 nt, Human
gugccuggagaagaggcugu

SEQ ID NO: 593427 - RNA, 22 nt, Human
aggcuggcggugacugcucuga

SEQ ID NO: 593428 - RNA, 22 nt, Human
ggcagccuugagggaggccugg

SEQ ID NO: 593429 - RNA, 22 nt, Human
caagaggcaaauugucuagaag

SEQ ID NO: 593430 - RNA, 22 nt, Human
uccuuugguuguagacaggaau

SEQ ID NO: 593431 - RNA, 22 nt, Human
ccuccuggccugugcagagccc

SEQ ID NO: 593432 - RNA, 22 nt, Human
cuuggacccacucccagaauug

SEQ ID NO: 593433 - RNA, 22 nt, Human
ccuggagcacauggcaggaggc

SEQ ID NO: 593434 - RNA, 22 nt, Human
aaagggcagaguucacuagaaa

SEQ ID NO: 593435 - RNA, 19 nt, Human
uggagaggaaaugcugcuc

SEQ ID NO: 593436 - RNA, 22 nt, Human
gcuguucacggaggaggauggg

SEQ ID NO: 593437 - RNA, 22 nt, Human
gauguuaaagguugguaaguca

SEQ ID NO: 593438 - RNA, 22 nt, Human
guuuuucuagaaaucuccuccu

SEQ ID NO: 593439 - RNA, 22 nt, Human
ucaggcugaaucauccuagcuu

SEQ ID NO: 593440 - RNA, 22 nt, Human
gcagagguggcaucugggcucu

SEQ ID NO: 593441 - RNA, 22 nt, Human
uuugguaauguuucauugcaga

SEQ ID NO: 593442 - RNA, 22 nt, Human
cccagcucucugcucuuagccu

SEQ ID NO: 593443 - RNA, 22 nt, Human
ucugcucuguacugcacuggcc

SEQ ID NO: 593444 - RNA, 22 nt, Human
cccugguucagguuucucugaa

SEQ ID NO: 593445 - RNA, 22 nt, Human
aaauugugcucacacugauauu

SEQ ID NO: 593446 - RNA, 22 nt, Human
agcagccuauucuucucuugga

SEQ ID NO: 593447 - RNA, 22 nt, Human
gcccaaagagcuuugaucucag

SEQ ID NO: 593448 - RNA, 22 nt, Human
ccuacaguuauauucuugauug

SEQ ID NO: 593449 - RNA, 22 nt, Human
cuggggcuguaggaggacuuau

SEQ ID NO: 593450 - RNA, 22 nt, Human
cacagcagucuuucacuaaaua

SEQ ID NO: 593451 - RNA, 22 nt, Human
ucuugucacuacuguuaugcau

SEQ ID NO: 593452 - RNA, 22 nt, Human
cucaaaagacuuaaacauaaga

SEQ ID NO: 593453 - RNA, 22 nt, Human
cuguguuugacaggcggucucc

SEQ ID NO: 593454 - RNA, 22 nt, Human
uaccaugauguuugaguuacua

SEQ ID NO: 593455 - RNA, 22 nt, Human
augccuggacugacaugcacug

SEQ ID NO: 593456 - RNA, 22 nt, Human
ucaaugacugguccaagguggc

SEQ ID NO: 593457 - RNA, 22 nt, Human
uggcuuggugagcagaguguag

SEQ ID NO: 593458 - RNA, 22 nt, Human
uaaauguuguaaguacaucuaa

SEQ ID NO: 593459 - RNA, 22 nt, Human
agggugugcuguugggucuuuc

SEQ ID NO: 593460 - RNA, 22 nt, Human
aucuuugacugccauucuugac

SEQ ID NO: 593461 - RNA, 22 nt, Human
uucuucuuuaucucaguauccu

SEQ ID NO: 593462 - RNA, 22 nt, Human
gcaguguucagugaagcaggag

SEQ ID NO: 593463 - RNA, 22 nt, Human
acacacaugcaugcuugccauu

SEQ ID NO: 593464 - RNA, 22 nt, Human
auucugcauguagguuugcuca

SEQ ID NO: 593465 - RNA, 22 nt, Human
acagugcuaaugaugccaagau

SEQ ID NO: 593466 - RNA, 22 nt, Human
gcagagugagccgaggcugcuc

SEQ ID NO: 593467 - RNA, 22 nt, Human
aagaguuuaccagugcugcuuc

SEQ ID NO: 593468 - RNA, 22 nt, Human
guguauaaugcuuugaagauua

SEQ ID NO: 593469 - RNA, 22 nt, Human
ggugaaauuccuuguggaaagu

SEQ ID NO: 593470 - RNA, 22 nt, Human
ccaggcuggucugaauuucuag

SEQ ID NO: 593471 - RNA, 22 nt, Human
cuugccuguggcuaguuggcuc

SEQ ID NO: 593472 - RNA, 22 nt, Human
uguauaagccuagugaaauuuc

SEQ ID NO: 593473 - RNA, 22 nt, Human
cccuuucuucuugacugaaaac

SEQ ID NO: 593474 - RNA, 22 nt, Human
uuaauagauuugauuuuaaagg

SEQ ID NO: 593475 - RNA, 22 nt, Human
uccugcagcucugagaagcauc

SEQ ID NO: 593476 - RNA, 22 nt, Human
uugcgcgcggcuaggucucggu

SEQ ID NO: 593477 - RNA, 23 nt, Human
ggcagcugggcagcacucauggg

SEQ ID NO: 593478 - RNA, 22 nt, Human
caaggccugccucuggcagaaa

SEQ ID NO: 593479 - RNA, 22 nt, Human
uacaaagugaaauaauucugag

SEQ ID NO: 593480 - RNA, 22 nt, Human
cagaccuggaaaacaggcuugc

SEQ ID NO: 593481 - RNA, 22 nt, Human
aggcaccucuuaggcugcuacu

SEQ ID NO: 593482 - RNA, 22 nt, Human
cagucaacagagagcccgucag

SEQ ID NO: 593483 - RNA, 22 nt, Human
uuacagaaaauguguuuuaacu

SEQ ID NO: 593484 - RNA, 22 nt, Human
uccuccaggcaccucacuggcu

SEQ ID NO: 593485 - RNA, 22 nt, Human
acugcuucuccaaugaauuaga

SEQ ID NO: 593486 - RNA, 22 nt, Human
auauacacauguguauacauuu

SEQ ID NO: 593487 - RNA, 22 nt, Human
ugcugggcccccagugaccuuc

SEQ ID NO: 593488 - RNA, 22 nt, Human
gugugggaauggcggucgugca

SEQ ID NO: 593489 - RNA, 22 nt, Human
agagggcccauguugggcugcu

SEQ ID NO: 593490 - RNA, 18 nt, Human
agagaugggaguuggaaa

SEQ ID NO: 593491 - RNA, 22 nt, Human
guuuguaauuacugcagcaugg

SEQ ID NO: 593492 - RNA, 22 nt, Human
gcaagaguuuuuucucucuuga

SEQ ID NO: 593493 - RNA, 22 nt, Human
ccugugugguagccagcggugc

SEQ ID NO: 593494 - RNA, 22 nt, Human
cagcuguuugggcauggccaga

SEQ ID NO: 593495 - RNA, 22 nt, Human
guauuuccauuagugugugcac

SEQ ID NO: 593496 - RNA, 19 nt, Human
caggacagacuucaaagcc

SEQ ID NO: 593497 - RNA, 22 nt, Human
uguuacauuucucuuucuugga

SEQ ID NO: 593498 - RNA, 22 nt, Human
ucacaguuaauuguuggaaugu

SEQ ID NO: 593499 - RNA, 19 nt, Human
aguuauugaucuauucagg

SEQ ID NO: 593500 - RNA, 22 nt, Human
cugagcugcuuugcuuuugggg

SEQ ID NO: 593501 - RNA, 20 nt, Human
aagagcugacucacaguggu

SEQ ID NO: 593502 - RNA, 21 nt, Human
augggcagaggcagagaggcu

SEQ ID NO: 593503 - RNA, 22 nt, Human
uuucuaaguaagauuaacuucu

SEQ ID NO: 593504 - RNA, 22 nt, Human
ggaguggcuauuugugcugguu

SEQ ID NO: 593505 - RNA, 22 nt, Human
uggacaaauagcaugacacuug

SEQ ID NO: 593506 - RNA, 22 nt, Human
cucccuggggcuccuccuauuu

SEQ ID NO: 593507 - RNA, 22 nt, Human
gcagggaagaucuuggagcugc

SEQ ID NO: 593508 - RNA, 22 nt, Human
guuuuuucaugaguaguuaucu

SEQ ID NO: 593509 - RNA, 22 nt, Human
aguuuuauaucuuccauugguu

SEQ ID NO: 593510 - RNA, 22 nt, Human
ccugagcuggaagagcuugugc

SEQ ID NO: 593511 - RNA, 22 nt, Human
gcuagcuuuauaaugcugggcg

SEQ ID NO: 593512 - RNA, 22 nt, Human
uagcccagcucaaaugaccggu

SEQ ID NO: 593513 - RNA, 22 nt, Human
gaggccuggcugggaggaggug

SEQ ID NO: 593514 - RNA, 22 nt, Human
ucugcagagggagugcuggguc

SEQ ID NO: 593515 - RNA, 22 nt, Human
ugggaggcagguaggugaugau

SEQ ID NO: 593516 - RNA, 22 nt, Human
cacugguuggcugagauccaua

SEQ ID NO: 593517 - RNA, 22 nt, Human
cucaggacccgguccagguggg

SEQ ID NO: 593518 - RNA, 22 nt, Human
ucucugugugugugacagcauu

SEQ ID NO: 593519 - RNA, 19 nt, Human
gcuggagucacuuuugaga

SEQ ID NO: 593520 - RNA, 22 nt, Human
ggcugaaggaugaaagcugcag

SEQ ID NO: 593521 - RNA, 22 nt, Human
ccugagguuauccaucuaccug

SEQ ID NO: 593522 - RNA, 22 nt, Human
cauggaacuguauaaaggcacu

SEQ ID NO: 593523 - RNA, 22 nt, Human
aguggcaguggggcagggcccu

SEQ ID NO: 593524 - RNA, 22 nt, Human
aggaggaauacaauccagcagc

SEQ ID NO: 593525 - RNA, 23 nt, Human
uggucucagccugugagagcuga

SEQ ID NO: 593526 - RNA, 22 nt, Human
aggcaagugcauuagaagagca

SEQ ID NO: 593527 - RNA, 17 nt, Human
gcuccaggcgugaguga

SEQ ID NO: 593528 - RNA, 21 nt, Human
uuucauugaaugagauaaggu

SEQ ID NO: 593529 - RNA, 22 nt, Human
aauggguuucugucccagcucu

SEQ ID NO: 593530 - RNA, 22 nt, Human
ggguuggggcccagcagucugc

SEQ ID NO: 593531 - RNA, 22 nt, Human
uuuaauugcauuuaaagaugga

SEQ ID NO: 593532 - RNA, 22 nt, Human
uccagggcaggugcugggcucu

SEQ ID NO: 593533 - RNA, 22 nt, Human
ucacugcaaucucugccuucca

SEQ ID NO: 593534 - RNA, 20 nt, Human
uguccccuagaucccagcuc

SEQ ID NO: 593535 - RNA, 22 nt, Human
agcagagucugugugcacuuua

SEQ ID NO: 593536 - RNA, 21 nt, Human
agucccaggggugagugaugu

SEQ ID NO: 593537 - RNA, 22 nt, Human
guguuuuaucagacaaaguaua

SEQ ID NO: 593538 - RNA, 22 nt, Human
cuggcaguuugccaggagcucg

SEQ ID NO: 593539 - RNA, 22 nt, Human
uagaaacagaauaugagugaga

SEQ ID NO: 593540 - RNA, 22 nt, Human
ccuggccucgugcucacggcuc

SEQ ID NO: 593541 - RNA, 22 nt, Human
gcugaugugaugucagaagagg

SEQ ID NO: 593542 - RNA, 22 nt, Human
cagacaggcaggugcugcuuug

SEQ ID NO: 593543 - RNA, 22 nt, Human
acauuuuaauaugcuuagugug

SEQ ID NO: 593544 - RNA, 22 nt, Human
agacugggguucuggcaaggag

SEQ ID NO: 593545 - RNA, 21 nt, Human
gcucccuggcugugugaccug

SEQ ID NO: 593546 - RNA, 22 nt, Human
gagggggcgugcaaggcuccgc

SEQ ID NO: 593547 - RNA, 22 nt, Human
gcccugcucuggucucugcccg

SEQ ID NO: 593548 - RNA, 22 nt, Human
ucuacagccauuuugagcagug

SEQ ID NO: 593549 - RNA, 22 nt, Human
cauucucaauaguagaugagua

SEQ ID NO: 593550 - RNA, 22 nt, Human
ucaauuuccccuauugauagac

SEQ ID NO: 593551 - RNA, 18 nt, Human
uggagcaggaagccuggc

SEQ ID NO: 593552 - RNA, 22 nt, Human
gaguugaucauuauuugguuuc

SEQ ID NO: 593553 - RNA, 22 nt, Human
auugagaagaaaaucuaauaua

SEQ ID NO: 593554 - RNA, 22 nt, Human
aacauucuacuguacugcauug

SEQ ID NO: 593555 - RNA, 22 nt, Human
gagccuggauugucaccgacuu

SEQ ID NO: 593556 - RNA, 22 nt, Human
cacacagacagcucucugaaga

SEQ ID NO: 593557 - RNA, 22 nt, Human
agacagacuugaaaauguucuu

SEQ ID NO: 593558 - RNA, 22 nt, Human
agagggcuggacgcagguugga

SEQ ID NO: 593559 - RNA, 22 nt, Human
aaagcagucacuccagugugau

SEQ ID NO: 593560 - RNA, 22 nt, Human
augugcuucauucuacaugaca

SEQ ID NO: 593561 - RNA, 22 nt, Human
aaaugggccuggaaagaggaug

SEQ ID NO: 593562 - RNA, 21 nt, Human
aucuuaaaaggucuuaacuuu

SEQ ID NO: 593563 - RNA, 22 nt, Human
cugugccuucugccuggaacau

SEQ ID NO: 593564 - RNA, 22 nt, Human
augaggcaggagugcaguggca

SEQ ID NO: 593565 - RNA, 22 nt, Human
ugagaaaaguacauggagaagc

SEQ ID NO: 593566 - RNA, 22 nt, Human
aaaugcuuagagguguucaaau

SEQ ID NO: 593567 - RNA, 22 nt, Human
ggaggguccccagcagcaugaa

SEQ ID NO: 593568 - RNA, 22 nt, Human
cugcagggcccaaggucaacgg

SEQ ID NO: 593569 - RNA, 22 nt, Human
auuugcuuggucuucucuccgu

SEQ ID NO: 593570 - RNA, 22 nt, Human
guuuaauuuuagguugucaagc

SEQ ID NO: 593571 - RNA, 22 nt, Human
aagucagcacuccaggaagcca

SEQ ID NO: 593572 - RNA, 22 nt, Human
ccuggcucuguccucgcgcaaa

SEQ ID NO: 593573 - RNA, 22 nt, Human
gacuggaaucccaggcucugug

SEQ ID NO: 593574 - RNA, 22 nt, Human
aaaaaccauugucuucagucuc

SEQ ID NO: 593575 - RNA, 20 nt, Human
ugcccagcaagagugcaguu

SEQ ID NO: 593576 - RNA, 22 nt, Human
aacuacagaaaagguaagcucu

SEQ ID NO: 593577 - RNA, 22 nt, Human
aagcacagagaugggcacgccu

SEQ ID NO: 593578 - RNA, 22 nt, Human
ucaguggaacugucugggugag

SEQ ID NO: 593579 - RNA, 22 nt, Human
ucucaagcuuguugguauguuu

SEQ ID NO: 593580 - RNA, 22 nt, Human
cuaccuucaaguuccucccucu

SEQ ID NO: 593581 - RNA, 22 nt, Human
uguuaucucagacugaguuacu

SEQ ID NO: 593582 - RNA, 19 nt, Human
cucuggagaacaauagugc

SEQ ID NO: 593583 - RNA, 22 nt, Human
agcugggaggugggcagugaga

SEQ ID NO: 593584 - RNA, 22 nt, Human
ugcaggugucuccagggcaggu

SEQ ID NO: 593585 - RNA, 22 nt, Human
cuggugcacguggcugcagucg

SEQ ID NO: 593586 - RNA, 22 nt, Human
caaagugcuggaauuacaggug

SEQ ID NO: 593587 - RNA, 22 nt, Human
cuucagccucguuacuccugcg

SEQ ID NO: 593588 - RNA, 22 nt, Human
aacaagauagagcucuugccuu

SEQ ID NO: 593589 - RNA, 22 nt, Human
ggcccuuccucuugugcuggca

SEQ ID NO: 593590 - RNA, 22 nt, Human
aguguuucuggcaaaugaaagu

SEQ ID NO: 593591 - RNA, 22 nt, Human
agcccuggggcuggugcuuacc

SEQ ID NO: 593592 - RNA, 22 nt, Human
aauauccagguagaugucuucu

SEQ ID NO: 593593 - RNA, 23 nt, Human
ucuaaaauucaucauuuacguuc

SEQ ID NO: 593594 - RNA, 22 nt, Human
cuggagcugguauagggacaaa

SEQ ID NO: 593595 - RNA, 22 nt, Human
ugccucuuggagccuuuccucu

SEQ ID NO: 593596 - RNA, 22 nt, Human
aaaguacauguuuggccauuug

SEQ ID NO: 593597 - RNA, 22 nt, Human
caguggcuucucaugucauuca

SEQ ID NO: 593598 - RNA, 22 nt, Human
augggagugugcuugaggaguu

SEQ ID NO: 593599 - RNA, 19 nt, Human
ucauggaagaaaugugaua

SEQ ID NO: 593600 - RNA, 22 nt, Human
ugucuggggaacugugcaucca

SEQ ID NO: 593601 - RNA, 22 nt, Human
ugggauggagccugaguauagu

SEQ ID NO: 593602 - RNA, 22 nt, Human
cagcuuugcccuuugcccaauc

SEQ ID NO: 593603 - RNA, 20 nt, Human
uaaugucaaagucacaaggu

SEQ ID NO: 593604 - RNA, 22 nt, Human
agugguccugcaaacccgugug

SEQ ID NO: 593605 - RNA, 22 nt, Human
ucuggaguuacugcuggcuuug

SEQ ID NO: 593606 - RNA, 22 nt, Human
uucuuauucuugaaauguggga

SEQ ID NO: 593607 - RNA, 22 nt, Human
ccaaagagagaccuuucuucuc

SEQ ID NO: 593608 - RNA, 22 nt, Human
cagccacucucagacaguccca

SEQ ID NO: 593609 - RNA, 23 nt, Human
uucaaagcuuaagcucuuuccac

SEQ ID NO: 593610 - RNA, 19 nt, Human
ucacagcaucugucugaac

SEQ ID NO: 593611 - RNA, 22 nt, Human
aggaagggcuguuucuccaaga

SEQ ID NO: 593612 - RNA, 22 nt, Human
uugaagcaggaaaauuucuauu

SEQ ID NO: 593613 - RNA, 19 nt, Human
gcccucaggcagcuccauc

SEQ ID NO: 593614 - RNA, 22 nt, Human
acuggaguuuuaaaggaacuug

SEQ ID NO: 593615 - RNA, 22 nt, Human
caguuuuacccaagcuuauuuu

SEQ ID NO: 593616 - RNA, 22 nt, Human
aguguuucaagaagcaggaagu

SEQ ID NO: 593617 - RNA, 22 nt, Human
uggcaaggcugugggggcagag

SEQ ID NO: 593618 - RNA, 21 nt, Human
gggggaagaggaguugcuagu

SEQ ID NO: 593619 - RNA, 22 nt, Human
aggcagcagcuugcugguugcc

SEQ ID NO: 593620 - RNA, 20 nt, Human
agaagaggauacaaccaggc

SEQ ID NO: 593621 - RNA, 19 nt, Human
ucuacaaaguggcaucagg

SEQ ID NO: 593622 - RNA, 22 nt, Human
acaagcaugugguaaaaagacc

SEQ ID NO: 593623 - RNA, 22 nt, Human
ggaaauguaaucacagaggguu

SEQ ID NO: 593624 - RNA, 22 nt, Human
ugccucaguuucuccauaugaa

SEQ ID NO: 593625 - RNA, 22 nt, Human
gcugagagcaaggacaaagcau

SEQ ID NO: 593626 - RNA, 22 nt, Human
agaagccaacagggcaggagag

SEQ ID NO: 593627 - RNA, 22 nt, Human
uagggaaaagacuucacuguuu

SEQ ID NO: 593628 - RNA, 20 nt, Human
auugugcagcccuuggcaga

SEQ ID NO: 593629 - RNA, 22 nt, Human
agcuucagguggucuuguuucu

SEQ ID NO: 593630 - RNA, 22 nt, Human
cugcaaaaguaauugcagguuu

SEQ ID NO: 593631 - RNA, 22 nt, Human
ccaggagcccugccacaauggu

SEQ ID NO: 593632 - RNA, 22 nt, Human
cacacauuccaaaaucaagggu

SEQ ID NO: 593633 - RNA, 22 nt, Human
caaagaaucacucaucuuuagc

SEQ ID NO: 593634 - RNA, 22 nt, Human
ucuguugcuuucuuccugugug

SEQ ID NO: 593635 - RNA, 22 nt, Human
gacagucuggccuaaaggguua

SEQ ID NO: 593636 - RNA, 22 nt, Human
aggaagcgugggucuggcugga

SEQ ID NO: 593637 - RNA, 22 nt, Human
gccucccuggcccacagcagcg

SEQ ID NO: 593638 - RNA, 22 nt, Human
agggagcaugggugaagcaggc

SEQ ID NO: 593639 - RNA, 22 nt, Human
gacaggccuagauucacugcug

SEQ ID NO: 593640 - RNA, 22 nt, Human
caguuuuaaauuuugaaugucu

SEQ ID NO: 593641 - RNA, 20 nt, Human
ggcaguuaaggcacagucau

SEQ ID NO: 593642 - RNA, 22 nt, Human
gaagugugcacaucuuacaagu

SEQ ID NO: 593643 - RNA, 22 nt, Human
uugggcugaucuguggaagaag

SEQ ID NO: 593644 - RNA, 22 nt, Human
augauauuauucuagcccagag

SEQ ID NO: 593645 - RNA, 22 nt, Human
auggaaaucgaugucuaaguua

SEQ ID NO: 593646 - RNA, 22 nt, Human
ccugucauacuaacguaguggg

SEQ ID NO: 593647 - RNA, 22 nt, Human
ugaacauuaguugaguaaaguc

SEQ ID NO: 593648 - RNA, 22 nt, Human
uggugggagugagggcaugcca

SEQ ID NO: 593649 - RNA, 22 nt, Human
agaaguaggcagggcuguauca

SEQ ID NO: 593650 - RNA, 22 nt, Human
uaaaucucugcuccucuugggu

SEQ ID NO: 593651 - RNA, 22 nt, Human
ucucuaauucaaccagacacuu

SEQ ID NO: 593652 - RNA, 22 nt, Human
uuggaauuaauauuuguauaca

SEQ ID NO: 593653 - RNA, 22 nt, Human
cccaggucgucagcaguguggu

SEQ ID NO: 593654 - RNA, 18 nt, Human
gcagagcagaagcucaag

SEQ ID NO: 593655 - RNA, 18 nt, Human
uccugggaacuugcuagc

SEQ ID NO: 593656 - RNA, 22 nt, Human
gcuuacaaucauuucaguuuag

SEQ ID NO: 593657 - RNA, 22 nt, Human
cuggcagcagagcucaacauag

SEQ ID NO: 593658 - RNA, 22 nt, Human
cauugaaauauggaaacugaug

SEQ ID NO: 593659 - RNA, 22 nt, Human
uagggcugcagaacaauggccu

SEQ ID NO: 593660 - RNA, 20 nt, Human
gagggcaggcacccauuuca

SEQ ID NO: 593661 - RNA, 22 nt, Human
ggaggugguuugauuucuauau

SEQ ID NO: 593662 - RNA, 22 nt, Human
ccaggggccugugaaggugccc

SEQ ID NO: 593663 - RNA, 22 nt, Human
gaaauuuauuaucuacaucauu

SEQ ID NO: 593664 - RNA, 22 nt, Human
ggcuccagaaacuucaguccau

SEQ ID NO: 593665 - RNA, 22 nt, Human
uccuccagcccucuaggaaaau

SEQ ID NO: 593666 - RNA, 22 nt, Human
ccugcccuucuuuccccagcau

SEQ ID NO: 593667 - RNA, 22 nt, Human
aggcuaagugggugucagggcc

SEQ ID NO: 593668 - RNA, 22 nt, Human
agauuaugcuggcugcuacaag

SEQ ID NO: 593669 - RNA, 22 nt, Human
agcagcucgggcuacagagggg

SEQ ID NO: 593670 - RNA, 18 nt, Human
cugccugcucuccagcuu

SEQ ID NO: 593671 - RNA, 22 nt, Human
gguggcagcgucuaucugacau

SEQ ID NO: 593672 - RNA, 23 nt, Human
acagucguagguauccuuuuccu

SEQ ID NO: 593673 - RNA, 22 nt, Human
augcauauucuuagccccuccu

SEQ ID NO: 593674 - RNA, 22 nt, Human
uugcagggaaauagaaauaaac

SEQ ID NO: 593675 - RNA, 22 nt, Human
gagcuggaggaccaggacuggg

SEQ ID NO: 593676 - RNA, 22 nt, Human
cagcaguacuucucagagguau

SEQ ID NO: 593677 - RNA, 22 nt, Human
uuucuaguaaaagcuaauuacc

SEQ ID NO: 593678 - RNA, 22 nt, Human
cacaggaaaugauucugcagca

SEQ ID NO: 593679 - RNA, 22 nt, Human
uagagcauuuagaggggcagga

SEQ ID NO: 593680 - RNA, 22 nt, Human
uuuugugaauaguuuaucuaag

SEQ ID NO: 593681 - RNA, 22 nt, Human
uauacacaccuccaaagcagga

SEQ ID NO: 593682 - RNA, 22 nt, Human
ugucccagguccuagaugacca

SEQ ID NO: 593683 - RNA, 22 nt, Human
gcccaaagucacucagcuagga

SEQ ID NO: 593684 - RNA, 22 nt, Human
caguccuuagauuuuacugcca

SEQ ID NO: 593685 - RNA, 22 nt, Human
ugaauaaaguauguccugggaa

SEQ ID NO: 593686 - RNA, 22 nt, Human
agcagccagaaauccagaggug

SEQ ID NO: 593687 - RNA, 23 nt, Human
gaggccuggcccugccacaucuc

SEQ ID NO: 593688 - RNA, 22 nt, Human
aacaguuugccugaaauguauu

SEQ ID NO: 593689 - RNA, 22 nt, Human
uacaauauguggccuuuuguga

SEQ ID NO: 593690 - RNA, 22 nt, Human
ccagauaucacugccguguugu

SEQ ID NO: 593691 - RNA, 22 nt, Human
acaaaugaacauauaagcuuga

SEQ ID NO: 593692 - RNA, 22 nt, Human
gguguggguccuugugcuugcu

SEQ ID NO: 593693 - RNA, 22 nt, Human
ccugagcucugcacuuuuuaga

SEQ ID NO: 593694 - RNA, 22 nt, Human
cuggggcuggugaggcaggcuc

SEQ ID NO: 593695 - RNA, 22 nt, Human
ucaggaacacaggggcccaugc

SEQ ID NO: 593696 - RNA, 19 nt, Human
uccaggcugagagucagcu

SEQ ID NO: 593697 - RNA, 22 nt, Human
cuuauuguccugacucauggcc

SEQ ID NO: 593698 - RNA, 22 nt, Human
acaggcugagcguccaucuuca

SEQ ID NO: 593699 - RNA, 22 nt, Human
ucucucagaaagcccaugucug

SEQ ID NO: 593700 - RNA, 22 nt, Human
cccuuccuccucgccugucaga

SEQ ID NO: 593701 - RNA, 21 nt, Human
auuagcuucaaaagcuugucu

SEQ ID NO: 593702 - RNA, 22 nt, Human
uuauguuaugaauggaugaucu

SEQ ID NO: 593703 - RNA, 22 nt, Human
auacacauuugcuagagauggg

SEQ ID NO: 593704 - RNA, 18 nt, Human
gcaguaggcgcgcaggac

SEQ ID NO: 593705 - RNA, 22 nt, Human
aagccauuuguuguccuucagg

SEQ ID NO: 593706 - RNA, 20 nt, Human
ucugucucugagcuagacuu

SEQ ID NO: 593707 - RNA, 22 nt, Human
guuuuaugagaccucaggaaua

SEQ ID NO: 593708 - RNA, 22 nt, Human
guguggcaaggugagaaguggg

SEQ ID NO: 593709 - RNA, 22 nt, Human
gagauaauaauaguaccuaucu

SEQ ID NO: 593710 - RNA, 22 nt, Human
uuucugaccugcaacaguuuac

SEQ ID NO: 593711 - RNA, 22 nt, Human
ugaggcuugauuugcccgagag

SEQ ID NO: 593712 - RNA, 22 nt, Human
auuucagggugucuuccaacug

SEQ ID NO: 593713 - RNA, 21 nt, Human
aggugcagagccagggaccag

SEQ ID NO: 593714 - RNA, 22 nt, Human
gggcucaggaguuugaggcugc

SEQ ID NO: 593715 - RNA, 22 nt, Human
aaggaaaggaugagcaugcauu

SEQ ID NO: 593716 - RNA, 22 nt, Human
cugccaggggccucacaggcca

SEQ ID NO: 593717 - RNA, 22 nt, Human
agauaacauuuauugaauguaa

SEQ ID NO: 593718 - RNA, 22 nt, Human
ugacagggacaguggagaugga

SEQ ID NO: 593719 - RNA, 22 nt, Human
agcaacaggaccauggagccca

SEQ ID NO: 593720 - RNA, 22 nt, Human
uacuuauugguucagaaguuua

SEQ ID NO: 593721 - RNA, 22 nt, Human
ggaagaaaaugggcaacaggug

SEQ ID NO: 593722 - RNA, 22 nt, Human
auguuuuuaaauagacuuacag

SEQ ID NO: 593723 - RNA, 22 nt, Human
ccuuggcuugugggcugcagcc

SEQ ID NO: 593724 - RNA, 22 nt, Human
aagaguuagcucaauaacuuga

SEQ ID NO: 593725 - RNA, 22 nt, Human
cagaggaaaugggaaggagaua

SEQ ID NO: 593726 - RNA, 22 nt, Human
cuuguccagauguuuguuaggu

SEQ ID NO: 593727 - RNA, 19 nt, Human
guuaucaaggggcuacuuu

SEQ ID NO: 593728 - RNA, 22 nt, Human
gacagcuuaggaaguuucuauu

SEQ ID NO: 593729 - RNA, 22 nt, Human
agaauuagccggauucuuguuu

SEQ ID NO: 593730 - RNA, 22 nt, Human
cagagccagcuguccuuggcau

SEQ ID NO: 593731 - RNA, 22 nt, Human
ucaggagcagcaugggugagag

SEQ ID NO: 593732 - RNA, 22 nt, Human
ugaggcaggagaauggcgggaa

SEQ ID NO: 593733 - RNA, 21 nt, Human
uggcugcacuguggcuuucau

SEQ ID NO: 593734 - RNA, 22 nt, Human
aucugacaaguuguguguauag

SEQ ID NO: 593735 - RNA, 22 nt, Human
cagcagcucaggcugcuuccca

SEQ ID NO: 593736 - RNA, 22 nt, Human
uuugugcagugguuaagaccau

SEQ ID NO: 593737 - RNA, 22 nt, Human
gcaugcaggagagaaagacggc

SEQ ID NO: 593738 - RNA, 22 nt, Human
guggggagcagccuuagccccu

SEQ ID NO: 593739 - RNA, 22 nt, Human
cuguauaugugcauacacacac

SEQ ID NO: 593740 - RNA, 22 nt, Human
uguuuucucuugaaaagcaguc

SEQ ID NO: 593741 - RNA, 22 nt, Human
uggcugaguguuccaaggagca

SEQ ID NO: 593742 - RNA, 22 nt, Human
gcagaagcuguucgaaggccgc

SEQ ID NO: 593743 - RNA, 22 nt, Human
gcugucugcugugcacugagca

SEQ ID NO: 593744 - RNA, 22 nt, Human
aggugacaucccggcagcagag

SEQ ID NO: 593745 - RNA, 22 nt, Human
uucucagaaaagcaagcuuucu

SEQ ID NO: 593746 - RNA, 23 nt, Human
gagagcugacugucaagacuguu

SEQ ID NO: 593747 - RNA, 22 nt, Human
uggccuggaaccuggcagggac

SEQ ID NO: 593748 - RNA, 21 nt, Human
ugacauuuaguagcauuguca

SEQ ID NO: 593749 - RNA, 22 nt, Human
aucugacaucucccucugacau

SEQ ID NO: 593750 - RNA, 22 nt, Human
guccugggaggggcugguccug

SEQ ID NO: 593751 - RNA, 20 nt, Human
cuggggagccucgcgguggc

SEQ ID NO: 593752 - RNA, 22 nt, Human
uaccucaaguuccaggaaagcg

SEQ ID NO: 593753 - RNA, 22 nt, Human
agcugcagcuguuuucugagug

SEQ ID NO: 593754 - RNA, 18 nt, Human
ucuguggcagcagugcac

SEQ ID NO: 593755 - RNA, 22 nt, Human
gggggcaguaaccucaaagugu

SEQ ID NO: 593756 - RNA, 22 nt, Human
aggggccauguaaguguaucac

SEQ ID NO: 593757 - RNA, 22 nt, Human
cuaaacaugcaagagcuucugg

SEQ ID NO: 593758 - RNA, 22 nt, Human
aggcagccuuuagacagucugc

SEQ ID NO: 593759 - RNA, 18 nt, Human
uacaugcauaaaugaagc

SEQ ID NO: 593760 - RNA, 22 nt, Human
ucuauaucuuggcugcugugaa

SEQ ID NO: 593761 - RNA, 22 nt, Human
uggaucaucuuaagaagugauu

SEQ ID NO: 593762 - RNA, 22 nt, Human
uacaagaaggauggagcccacu

SEQ ID NO: 593763 - RNA, 22 nt, Human
caggcagagcaacugguccaga

SEQ ID NO: 593764 - RNA, 22 nt, Human
gggguacuggcuggagccccac

SEQ ID NO: 593765 - RNA, 22 nt, Human
ggcagaggugaaguucacaagg

SEQ ID NO: 593766 - RNA, 22 nt, Human
gccgaagacgcugggcgugggc

SEQ ID NO: 593767 - RNA, 22 nt, Human
gccagcugaggccgugcaggcu

SEQ ID NO: 593768 - RNA, 22 nt, Human
ggguccaggucuucaggcagag

SEQ ID NO: 593769 - RNA, 22 nt, Human
gagaugaagaggcccuuggagu

SEQ ID NO: 593770 - RNA, 22 nt, Human
uucagcagucguccaggaaaag

SEQ ID NO: 593771 - RNA, 22 nt, Human
auuacaaucgagagaaacaaau

SEQ ID NO: 593772 - RNA, 22 nt, Human
aggggccuggacauggacgcgc

SEQ ID NO: 593773 - RNA, 22 nt, Human
ucacaagacaagacaaauugca

SEQ ID NO: 593774 - RNA, 21 nt, Human
uaaagcuagaaccuuagcuuu

SEQ ID NO: 593775 - RNA, 22 nt, Human
agucagugaaggcauugcucaa

SEQ ID NO: 593776 - RNA, 22 nt, Human
ugucuuuuggagcaucuuucuu

SEQ ID NO: 593777 - RNA, 22 nt, Human
uaccaggcagcugcacagaggc

SEQ ID NO: 593778 - RNA, 20 nt, Human
ccagacagcaccugccuggu

SEQ ID NO: 593779 - RNA, 22 nt, Human
cagcuguuaugagguguacaug

SEQ ID NO: 593780 - RNA, 22 nt, Human
uagagaaaaccacuggugagcu

SEQ ID NO: 593781 - RNA, 22 nt, Human
ccaggagagcucucguucagug

SEQ ID NO: 593782 - RNA, 19 nt, Human
ucugaacaaugcaguuccc

SEQ ID NO: 593783 - RNA, 22 nt, Human
uagcacaguauuucucaacugg

SEQ ID NO: 593784 - RNA, 22 nt, Human
aaaauuuuacugguguuuccuu

SEQ ID NO: 593785 - RNA, 22 nt, Human
gugugggcugcagaggcacagc

SEQ ID NO: 593786 - RNA, 22 nt, Human
agcacagagauuauuuacaaga

SEQ ID NO: 593787 - RNA, 19 nt, Human
ugacugccucaggggugga

SEQ ID NO: 593788 - RNA, 22 nt, Human
aagaagcauucuuucauugguu

SEQ ID NO: 593789 - RNA, 17 nt, Human
ggaaagguagaguaauc

SEQ ID NO: 593790 - RNA, 22 nt, Human
ggacauuuaguuucauugggca

SEQ ID NO: 593791 - RNA, 22 nt, Human
auguccaauuucugaggcugcu

SEQ ID NO: 593792 - RNA, 22 nt, Human
uaaacaagaaacauuuucuguu

SEQ ID NO: 593793 - RNA, 22 nt, Human
auuugcuuguucaccaguacuu

SEQ ID NO: 593794 - RNA, 22 nt, Human
aacacugagcuauuacggugga

SEQ ID NO: 593795 - RNA, 22 nt, Human
ugcaggugagugcaggggcuca

SEQ ID NO: 593796 - RNA, 22 nt, Human
ugccugccucuggcagcccugc

SEQ ID NO: 593797 - RNA, 22 nt, Human
gccagcucuguggcuguacuug

SEQ ID NO: 593798 - RNA, 22 nt, Human
gcuggagugaguauguguaguc

SEQ ID NO: 593799 - RNA, 22 nt, Human
aggcagcaaagaaaugaugcug

SEQ ID NO: 593800 - RNA, 22 nt, Human
ugaggggagaagcagcagccug

SEQ ID NO: 593801 - RNA, 22 nt, Human
cugcugggcagaggcugcauga

SEQ ID NO: 593802 - RNA, 22 nt, Human
uccuagagccuccagagggaga

SEQ ID NO: 593803 - RNA, 22 nt, Human
uggcaugauaggaggugcagaa

SEQ ID NO: 593804 - RNA, 22 nt, Human
gacaguauccagguggugaaga

SEQ ID NO: 593805 - RNA, 21 nt, Human
ccagagccugagaggauuaug

SEQ ID NO: 593806 - RNA, 22 nt, Human
cuaggccauauuuugagaacug

SEQ ID NO: 593807 - RNA, 22 nt, Human
agguggggaguauauguaauug

SEQ ID NO: 593808 - RNA, 22 nt, Human
uuaguuuucucaucuaucucac

SEQ ID NO: 593809 - RNA, 22 nt, Human
ugaaaccauucucagguacacu

SEQ ID NO: 593810 - RNA, 22 nt, Human
uccgaguugaaguaggauagcg

SEQ ID NO: 593811 - RNA, 22 nt, Human
ggcuguguccuguaugauuauu

SEQ ID NO: 593812 - RNA, 22 nt, Human
aaauggugaaguguaauuuagc

SEQ ID NO: 593813 - RNA, 22 nt, Human
ccaggagggaccgcggcauccc

SEQ ID NO: 593814 - RNA, 23 nt, Human
ccuggguuucagagcugcuuuuc

SEQ ID NO: 593815 - RNA, 22 nt, Human
auugucuucuggucuuaucuuu

SEQ ID NO: 593816 - RNA, 22 nt, Human
cacaguauucacugggcagauu

SEQ ID NO: 593817 - RNA, 22 nt, Human
ucuuuugucgguguaucaugga

SEQ ID NO: 593818 - RNA, 20 nt, Human
acccugaggcuccccagccu

SEQ ID NO: 593819 - RNA, 22 nt, Human
gaaggaggcguuagcccuagga

SEQ ID NO: 593820 - RNA, 22 nt, Human
cagaggaagggugcugcgaaag

SEQ ID NO: 593821 - RNA, 21 nt, Human
ggagaaggacaauguugagua

SEQ ID NO: 593822 - RNA, 23 nt, Human
cuccuggaggguccggcccugcc

SEQ ID NO: 593823 - RNA, 22 nt, Human
agcaggagaacacuguggcucu

SEQ ID NO: 593824 - RNA, 22 nt, Human
augaagcaucucacaaucuagu

SEQ ID NO: 593825 - RNA, 22 nt, Human
ggcucuggggaagcucucuuca

SEQ ID NO: 593826 - RNA, 22 nt, Human
uuaaauuccagccucauaauag

SEQ ID NO: 593827 - RNA, 22 nt, Human
gagggagggacuagcauucucu

SEQ ID NO: 593828 - RNA, 19 nt, Human
caucauuaucaguucacug

SEQ ID NO: 593829 - RNA, 23 nt, Human
ugacagaccuucccagacaguca

SEQ ID NO: 593830 - RNA, 22 nt, Human
gucagcaaaaaauuuaugugag

SEQ ID NO: 593831 - RNA, 22 nt, Human
cuggcuaaagagcaagaagaug

SEQ ID NO: 593832 - RNA, 22 nt, Human
agacucugauucccucauguca

SEQ ID NO: 593833 - RNA, 20 nt, Human
aauguauauuuuaugccagg

SEQ ID NO: 593834 - RNA, 22 nt, Human
gcacacaguacuauaugcuaca

SEQ ID NO: 593835 - RNA, 18 nt, Human
guucaaggucaagagaga

SEQ ID NO: 593836 - RNA, 22 nt, Human
gggucuggagauccgggugaag

SEQ ID NO: 593837 - RNA, 22 nt, Human
cauaauuagagaauucauguua

SEQ ID NO: 593838 - RNA, 22 nt, Human
uuggggaguuaaugccaaagau

SEQ ID NO: 593839 - RNA, 20 nt, Human
aagaaacuugaaaguacaag

SEQ ID NO: 593840 - RNA, 21 nt, Human
ugucuccuguuggcacauggc

SEQ ID NO: 593841 - RNA, 22 nt, Human
cuacagcuggccuuggaaaacu

SEQ ID NO: 593842 - RNA, 22 nt, Human
uucaagaaagaguggcuauucc

SEQ ID NO: 593843 - RNA, 22 nt, Human
acuggaaaauucaaaugggguc

SEQ ID NO: 593844 - RNA, 22 nt, Human
acuguacaugcaucuugucuau

SEQ ID NO: 593845 - RNA, 22 nt, Human
cuugugcaauugacauugaauc

SEQ ID NO: 593846 - RNA, 22 nt, Human
gcuggcuuugcacugggugcau

SEQ ID NO: 593847 - RNA, 22 nt, Human
augggcagcugcagcaguggug

SEQ ID NO: 593848 - RNA, 22 nt, Human
ugagagggcccagagcacacca

SEQ ID NO: 593849 - RNA, 22 nt, Human
uuguuucucuggucuugaguga

SEQ ID NO: 593850 - RNA, 22 nt, Human
uggcagaguaggauggcccugu

SEQ ID NO: 593851 - RNA, 22 nt, Human
uagaaacaaaaucugaugacuc

SEQ ID NO: 593852 - RNA, 22 nt, Human
uggggcuguccuuagucugaga

SEQ ID NO: 593853 - RNA, 22 nt, Human
uucaagaaucuuccugaccacu

SEQ ID NO: 593854 - RNA, 22 nt, Human
gugcaaaaguaacugugguuuu

SEQ ID NO: 593855 - RNA, 22 nt, Human
uuucuuuuccaauaucccuacu

SEQ ID NO: 593856 - RNA, 22 nt, Human
gcagagaacccagcagauuggc

SEQ ID NO: 593857 - RNA, 22 nt, Human
ccucaggcugcucacacuuguc

SEQ ID NO: 593858 - RNA, 23 nt, Human
aaugggugcaacuauccaugaca

SEQ ID NO: 593859 - RNA, 20 nt, Human
augccucuaauuuugcaaac

SEQ ID NO: 593860 - RNA, 22 nt, Human
ugugaauauuuccuucuuugga

SEQ ID NO: 593861 - RNA, 22 nt, Human
auuguuaaaaagguggaaaugc

SEQ ID NO: 593862 - RNA, 22 nt, Human
agacuuuauaguuuuuggcuau

SEQ ID NO: 593863 - RNA, 22 nt, Human
ucuggagggcccacauccacaa

SEQ ID NO: 593864 - RNA, 19 nt, Human
cccaacuggauccaucaua

SEQ ID NO: 593865 - RNA, 22 nt, Human
uuuacagauguggaaagugagc

SEQ ID NO: 593866 - RNA, 22 nt, Human
ccauggcaauggucagucuauu

SEQ ID NO: 593867 - RNA, 23 nt, Human
uuauaaauauuuucagguguguu

SEQ ID NO: 593868 - RNA, 22 nt, Human
gcacugugacccagagcaggug

SEQ ID NO: 593869 - RNA, 22 nt, Human
cuuauuuugcugaugacccagg

SEQ ID NO: 593870 - RNA, 22 nt, Human
ccacugcuaacuugcugcagcu

SEQ ID NO: 593871 - RNA, 20 nt, Human
cacugcccuccagccugagc

SEQ ID NO: 593872 - RNA, 18 nt, Human
cauaauuuucuuucuuua

SEQ ID NO: 593873 - RNA, 19 nt, Human
ggauaagguuggagugauc

SEQ ID NO: 593874 - RNA, 22 nt, Human
ccucccugggugcugggauugc

SEQ ID NO: 593875 - RNA, 22 nt, Human
uguccaggugugucuaaagaga

SEQ ID NO: 593876 - RNA, 22 nt, Human
cauuugaugacucaacucauaa

SEQ ID NO: 593877 - RNA, 22 nt, Human
caugggcugcugacaggggcuc

SEQ ID NO: 593878 - RNA, 22 nt, Human
uuuuauguugcuauaauaggua

SEQ ID NO: 593879 - RNA, 22 nt, Human
gcauccagagguagccacugug

SEQ ID NO: 593880 - RNA, 22 nt, Human
aguguuggaccgagguggagcc

SEQ ID NO: 593881 - RNA, 22 nt, Human
ugggcacuguagcuggugcugg

SEQ ID NO: 593882 - RNA, 22 nt, Human
gcccauggucagggaggcaggg

SEQ ID NO: 593883 - RNA, 22 nt, Human
uaagacaugagacucagccagu

SEQ ID NO: 593884 - RNA, 22 nt, Human
aaagcuuaggauagggaauaua

SEQ ID NO: 593885 - RNA, 22 nt, Human
cuguguuuuuggucugaucuau

SEQ ID NO: 593886 - RNA, 17 nt, Human
gggaaguggagaaagcu

SEQ ID NO: 593887 - RNA, 22 nt, Human
gaagagcugcacacuggggacu

SEQ ID NO: 593888 - RNA, 22 nt, Human
caggugagaggcgguccugcau

SEQ ID NO: 593889 - RNA, 22 nt, Human
guuuuccugaaacugauggugu

SEQ ID NO: 593890 - RNA, 22 nt, Human
acuccuggggauccauuccuuu

SEQ ID NO: 593891 - RNA, 22 nt, Human
cgccccagaugcaagacaaaga

SEQ ID NO: 593892 - RNA, 22 nt, Human
agaugcauguuuaugucuuucc

SEQ ID NO: 593893 - RNA, 22 nt, Human
uucacugaauuaauuuccuucu

SEQ ID NO: 593894 - RNA, 22 nt, Human
gccuggagccucagcaaggagg

SEQ ID NO: 593895 - RNA, 22 nt, Human
uuucucuuucaaucugcaguac

SEQ ID NO: 593896 - RNA, 22 nt, Human
ucugaggcccugcaggcagugu

SEQ ID NO: 593897 - RNA, 22 nt, Human
cucuuuguagccuuugcauauu

SEQ ID NO: 593898 - RNA, 22 nt, Human
agauuuuaguuuggggaggugc

SEQ ID NO: 593899 - RNA, 22 nt, Human
ucagcugccuuucccaugcuag

SEQ ID NO: 593900 - RNA, 22 nt, Human
augcagguauauuuuauuaaag

SEQ ID NO: 593901 - RNA, 22 nt, Human
acacuucagcuccacaaacauu

SEQ ID NO: 593902 - RNA, 22 nt, Human
uucauuaauucauucagugacu

SEQ ID NO: 593903 - RNA, 22 nt, Human
acagccuguuugaucuggugcu

SEQ ID NO: 593904 - RNA, 22 nt, Human
gagaagggcuugggagucaaca

SEQ ID NO: 593905 - RNA, 22 nt, Human
ggguccugcgugggcccaggac

SEQ ID NO: 593906 - RNA, 20 nt, Human
uacauucaaaacaaacucug

SEQ ID NO: 593907 - RNA, 22 nt, Human
agcuucagugucaggcccgugg

SEQ ID NO: 593908 - RNA, 22 nt, Human
caugcaaacacguaaacauuca

SEQ ID NO: 593909 - RNA, 22 nt, Human
gcccacuuucugccagcucacc

SEQ ID NO: 593910 - RNA, 22 nt, Human
cugcugacaaaauaaaaugcuc

SEQ ID NO: 593911 - RNA, 22 nt, Human
ugaguuauggagaauaaaguca

SEQ ID NO: 593912 - RNA, 22 nt, Human
gcacuggagauacagagaugaa

SEQ ID NO: 593913 - RNA, 22 nt, Human
aguaaacacugucuuuauauau

SEQ ID NO: 593914 - RNA, 22 nt, Human
uuuuaaugggcgacuauuaugg

SEQ ID NO: 593915 - RNA, 22 nt, Human
agccugugagggaugcugcagu

SEQ ID NO: 593916 - RNA, 22 nt, Human
acaucacacgccuuccaggagg

SEQ ID NO: 593917 - RNA, 21 nt, Human
auauuucagauuuccguaauc

SEQ ID NO: 593918 - RNA, 22 nt, Human
cagcagagggagccauugaaau

SEQ ID NO: 593919 - RNA, 22 nt, Human
ugcaggcuguaaucugaggcua

SEQ ID NO: 593920 - RNA, 22 nt, Human
uccuuaaaggacuagaagucaa

SEQ ID NO: 593921 - RNA, 22 nt, Human
gaacagcagcuuccugggaauu

SEQ ID NO: 593922 - RNA, 22 nt, Human
uugacaaaggcugagaggaaaa

SEQ ID NO: 593923 - RNA, 22 nt, Human
ggguggagugugaaaucuggcu

SEQ ID NO: 593924 - RNA, 22 nt, Human
ucagguggccaaaugggagcgc

SEQ ID NO: 593925 - RNA, 22 nt, Human
cuuccucucuugcccauaagag

SEQ ID NO: 593926 - RNA, 22 nt, Human
cugcuuuaauggaaaguguuuu

SEQ ID NO: 593927 - RNA, 22 nt, Human
gcccagccccuggguggacgug

SEQ ID NO: 593928 - RNA, 22 nt, Human
ggggagaauuaccaaaagcgcu

SEQ ID NO: 593929 - RNA, 22 nt, Human
gaggcaggcagauugcuugagg

SEQ ID NO: 593930 - RNA, 22 nt, Human
ccugcccagggucaccacagag

SEQ ID NO: 593931 - RNA, 22 nt, Human
uggcucagcgcggccuggucuu

SEQ ID NO: 593932 - RNA, 22 nt, Human
aaagaguuuacaaauuagguaa

SEQ ID NO: 593933 - RNA, 23 nt, Human
uuuuccagaaucgacucuguaga

SEQ ID NO: 593934 - RNA, 22 nt, Human
ggcugcccucggggucgcaggc

SEQ ID NO: 593935 - RNA, 22 nt, Human
agcuccugcagacuccugcuca

SEQ ID NO: 593936 - RNA, 22 nt, Human
uagcacuacuuagguacagcca

SEQ ID NO: 593937 - RNA, 22 nt, Human
caguggucugugcuucuguaca

SEQ ID NO: 593938 - RNA, 22 nt, Human
agagacaaugccaaugcacacg

SEQ ID NO: 593939 - RNA, 22 nt, Human
aguaggauaagagccuguccaa

SEQ ID NO: 593940 - RNA, 22 nt, Human
uucuuucuguccauaaugagac

SEQ ID NO: 593941 - RNA, 22 nt, Human
gacauaaaauucaauaauuugu

SEQ ID NO: 593942 - RNA, 22 nt, Human
gugaaaaaucaucaugacuuga

SEQ ID NO: 593943 - RNA, 22 nt, Human
aauaguuuuauaggugggauua

SEQ ID NO: 593944 - RNA, 22 nt, Human
gcauauuuucacaagcucuugg

SEQ ID NO: 593945 - RNA, 22 nt, Human
ugaagccagcuuuggaagacac

SEQ ID NO: 593946 - RNA, 22 nt, Human
gugggcagauacauuugauaug

SEQ ID NO: 593947 - RNA, 22 nt, Human
aggcuagauagagggucaucuu

SEQ ID NO: 593948 - RNA, 21 nt, Human
aagaaagauaauuaaggaccc

SEQ ID NO: 593949 - RNA, 22 nt, Human
ucacacaugaguaaauacaggg

SEQ ID NO: 593950 - RNA, 22 nt, Human
cuugccuacuugucaaccagca

SEQ ID NO: 593951 - RNA, 22 nt, Human
ugcauguuucuguauguuaaug

SEQ ID NO: 593952 - RNA, 22 nt, Human
cuugcugucuugcauuuagagc

SEQ ID NO: 593953 - RNA, 22 nt, Human
uuucuucuuucccagugauggg

SEQ ID NO: 593954 - RNA, 22 nt, Human
ucucuuaggagaaauucauaaa

SEQ ID NO: 593955 - RNA, 22 nt, Human
aggguggccaugagggagagau

SEQ ID NO: 593956 - RNA, 22 nt, Human
ggcagaggaggggugaauuugc

SEQ ID NO: 593957 - RNA, 22 nt, Human
cucggcagguggagguuguagu

SEQ ID NO: 593958 - RNA, 20 nt, Human
agcagcuguguuuucauccu

SEQ ID NO: 593959 - RNA, 22 nt, Human
ggugcagaggagccagcugggg

SEQ ID NO: 593960 - RNA, 22 nt, Human
ggcucuggucagugaggggccu

SEQ ID NO: 593961 - RNA, 22 nt, Human
caggugggagccacagcguaca

SEQ ID NO: 593962 - RNA, 22 nt, Human
aaaucacuaaguuauagugugg

SEQ ID NO: 593963 - RNA, 19 nt, Human
ugagugggccccugcagac

SEQ ID NO: 593964 - RNA, 23 nt, Human
auuacaugagcaaauauagcuau

SEQ ID NO: 593965 - RNA, 22 nt, Human
aggagcuggguuccuuuggugg

SEQ ID NO: 593966 - RNA, 22 nt, Human
ucagaggugguaaaggacagca

SEQ ID NO: 593967 - RNA, 22 nt, Human
aaguuacaguuaggggugauga

SEQ ID NO: 593968 - RNA, 22 nt, Human
ucaguguuggcauucagaaaug

SEQ ID NO: 593969 - RNA, 22 nt, Human
gcuggcuugucccaggacaaag

SEQ ID NO: 593970 - RNA, 22 nt, Human
ucaagagaaggggaaauagacu

SEQ ID NO: 593971 - RNA, 22 nt, Human
ugagaauuuucaguuucacuuu

SEQ ID NO: 593972 - RNA, 22 nt, Human
ugcauuccacauaaagcgauaa

SEQ ID NO: 593973 - RNA, 22 nt, Human
caguaugagaguugaaucaagg

SEQ ID NO: 593974 - RNA, 22 nt, Human
ccugggaaggugaggcccugga

SEQ ID NO: 593975 - RNA, 22 nt, Human
ugggacagugugccuugcuccu

SEQ ID NO: 593976 - RNA, 22 nt, Human
aggucagacagggugucuuucu

SEQ ID NO: 593977 - RNA, 22 nt, Human
aagcucuuuccacuaaaccacu

SEQ ID NO: 593978 - RNA, 22 nt, Human
ucuuccaggagggugggcaaac

SEQ ID NO: 593979 - RNA, 22 nt, Human
acauucuaacauuguacagaua

SEQ ID NO: 593980 - RNA, 22 nt, Human
aagcagcugugugacauaaucu

SEQ ID NO: 593981 - RNA, 22 nt, Human
ugguuaaaaugcagauucagua

SEQ ID NO: 593982 - RNA, 22 nt, Human
ugcagaacagggccaugucacc

SEQ ID NO: 593983 - RNA, 22 nt, Human
caaggcugcuggcuucugagcu

SEQ ID NO: 593984 - RNA, 22 nt, Human
uuuuucuugugcuggaucuaau

SEQ ID NO: 593985 - RNA, 22 nt, Human
cacaggaaugaacagggaaaga

SEQ ID NO: 593986 - RNA, 22 nt, Human
agaggccaagccagacugugca

SEQ ID NO: 593987 - RNA, 22 nt, Human
uucaaugauuuuuagggaucau

SEQ ID NO: 593988 - RNA, 18 nt, Human
acacacacaccuguguau

SEQ ID NO: 593989 - RNA, 22 nt, Human
auggcacugaccucccuuguaa

SEQ ID NO: 593990 - RNA, 22 nt, Human
ucuggaaaagcgauaaaccauu

SEQ ID NO: 593991 - RNA, 22 nt, Human
ugcuucuguuucauugaucuua

SEQ ID NO: 593992 - RNA, 22 nt, Human
ggcuucagugagcugagcucac

SEQ ID NO: 593993 - RNA, 22 nt, Human
auucuuauuauaguaaaacagu

SEQ ID NO: 593994 - RNA, 22 nt, Human
acagcuggagugaggauggagu

SEQ ID NO: 593995 - RNA, 22 nt, Human
uacugucauuagcauuaacuuu

SEQ ID NO: 593996 - RNA, 22 nt, Human
auacguaaguugaacaucagaa

SEQ ID NO: 593997 - RNA, 20 nt, Human
cagaaagaagguagauuuuu

SEQ ID NO: 593998 - RNA, 22 nt, Human
uguguucuggaaagcucacuga

SEQ ID NO: 593999 - RNA, 22 nt, Human
ugggauagggcuauugcucaca

SEQ ID NO: 594000 - RNA, 22 nt, Human
cuucaagauccauagauauugc

SEQ ID NO: 594001 - RNA, 22 nt, Human
ggcugggacgaugaggauuagu

SEQ ID NO: 594002 - RNA, 22 nt, Human
aguuuuauuccaaugugcagca

SEQ ID NO: 594003 - RNA, 22 nt, Human
cuccaggaccagggcuccugga

SEQ ID NO: 594004 - RNA, 22 nt, Human
aaucagaauuuguccccugagu

SEQ ID NO: 594005 - RNA, 22 nt, Human
cccaggcucacuguccgcuucc

SEQ ID NO: 594006 - RNA, 22 nt, Human
ccugcucugguuuagucagucu

SEQ ID NO: 594007 - RNA, 22 nt, Human
gggggcuggacuuucccacaca

SEQ ID NO: 594008 - RNA, 22 nt, Human
uaaggagggggaaugauuggca

SEQ ID NO: 594009 - RNA, 22 nt, Human
aaagcacauaguagaaggauuu

SEQ ID NO: 594010 - RNA, 22 nt, Human
auguguguguauauacacacau

SEQ ID NO: 594011 - RNA, 22 nt, Human
ugcugccuggagccuuuuguuu

SEQ ID NO: 594012 - RNA, 22 nt, Human
ugugugaagcacauguucaagg

SEQ ID NO: 594013 - RNA, 22 nt, Human
ggcugagaggacgucgggcuca

SEQ ID NO: 594014 - RNA, 22 nt, Human
acaaugcucauauuuaugccaa

SEQ ID NO: 594015 - RNA, 22 nt, Human
gcaccugggguacacagcuaca

SEQ ID NO: 594016 - RNA, 22 nt, Human
cuggugucugauucuccccuga

SEQ ID NO: 594017 - RNA, 22 nt, Human
ccuuuuucccuggagggacagc

SEQ ID NO: 594018 - RNA, 22 nt, Human
ggaaguguuuccuugggcagca

SEQ ID NO: 594019 - RNA, 22 nt, Human
uaauguagggguguaacacaca

SEQ ID NO: 594020 - RNA, 22 nt, Human
ucucugugucucauguuccuau

SEQ ID NO: 594021 - RNA, 21 nt, Human
uauuuauuaauuuguaaggcu

SEQ ID NO: 594022 - RNA, 22 nt, Human
gcagagccagaauggccaggac

SEQ ID NO: 594023 - RNA, 22 nt, Human
ugucuccauagaagagacugca

SEQ ID NO: 594024 - RNA, 22 nt, Human
ggagggcucaauugacuccuga

SEQ ID NO: 594025 - RNA, 21 nt, Human
ucucugugucuuuaagcugga

SEQ ID NO: 594026 - RNA, 22 nt, Human
uuagaaaggagcuuauuucuuu

SEQ ID NO: 594027 - RNA, 22 nt, Human
agagccccugguggagugagaa

SEQ ID NO: 594028 - RNA, 22 nt, Human
ucaaaacaaucauuggaugugc

SEQ ID NO: 594029 - RNA, 22 nt, Human
cucucagauggagugugaaugg

SEQ ID NO: 594030 - RNA, 22 nt, Human
cuuuggcuugcccuggcaguac

SEQ ID NO: 594031 - RNA, 22 nt, Human
agcacaugacuuuuagucgagu

SEQ ID NO: 594032 - RNA, 22 nt, Human
agagaugaagggcauuccccag

SEQ ID NO: 594033 - RNA, 22 nt, Human
ugucugagcaccugugcugaac

SEQ ID NO: 594034 - RNA, 22 nt, Human
ccagcagcagcguccaaggaga

SEQ ID NO: 594035 - RNA, 19 nt, Human
acauuuaaauucagaucuc

SEQ ID NO: 594036 - RNA, 22 nt, Human
cugcccaccgugugcacgugcg

SEQ ID NO: 594037 - RNA, 22 nt, Human
guuuauuagaguuuucugucug

SEQ ID NO: 594038 - RNA, 22 nt, Human
uaaguuaguccuuuuuaaaagu

SEQ ID NO: 594039 - RNA, 22 nt, Human
uuucaaaauuuugcagugguaa

SEQ ID NO: 594040 - RNA, 17 nt, Human
gcuuccugugcugggga

SEQ ID NO: 594041 - RNA, 22 nt, Human
cugaaugauaaucuuuugcugg

SEQ ID NO: 594042 - RNA, 22 nt, Human
ugagaguucucucuucaggugg

SEQ ID NO: 594043 - RNA, 22 nt, Human
uuuuaauacugcuauuguagga

SEQ ID NO: 594044 - RNA, 22 nt, Human
ugucuccuugcuuuucccugua

SEQ ID NO: 594045 - RNA, 19 nt, Human
cuccuucccugguuucugu

SEQ ID NO: 594046 - RNA, 22 nt, Human
gucuuuauauuuacuaaagaau

SEQ ID NO: 594047 - RNA, 19 nt, Human
ucugcccaguugucugccc

SEQ ID NO: 594048 - RNA, 22 nt, Human
ugugacuucuuuuugaguucaa

SEQ ID NO: 594049 - RNA, 22 nt, Human
agguuagaauguaagaguuuca

SEQ ID NO: 594050 - RNA, 22 nt, Human
ccagcagggcagugcccuggac

SEQ ID NO: 594051 - RNA, 22 nt, Human
gaggacaaagcccaggugcugg

SEQ ID NO: 594052 - RNA, 22 nt, Human
ugucacauaggcaaaauguuuu

SEQ ID NO: 594053 - RNA, 22 nt, Human
accauucugucucuuuacaaau

SEQ ID NO: 594054 - RNA, 23 nt, Human
ucucaaauaugaucugggucauc

SEQ ID NO: 594055 - RNA, 22 nt, Human
ugacaguugagcauguaagaga

SEQ ID NO: 594056 - RNA, 22 nt, Human
uuugugcauggguauggccaau

SEQ ID NO: 594057 - RNA, 22 nt, Human
agggcuccgggccaccggccug

SEQ ID NO: 594058 - RNA, 22 nt, Human
ggaacauuuuuuaaggcagaaa

SEQ ID NO: 594059 - RNA, 22 nt, Human
cagagaaagaagcccauucauu

SEQ ID NO: 594060 - RNA, 21 nt, Human
uucaaaaugguguguuugucu

SEQ ID NO: 594061 - RNA, 22 nt, Human
augccauugcuuuaaaauuaag

SEQ ID NO: 594062 - RNA, 22 nt, Human
aggcaugacuuuggcugaagaa

SEQ ID NO: 594063 - RNA, 22 nt, Human
caugcagugguaaaaagucagg

SEQ ID NO: 594064 - RNA, 17 nt, Human
gcugagugcagggaguc

SEQ ID NO: 594065 - RNA, 22 nt, Human
agaccagggucccacagagucu

SEQ ID NO: 594066 - RNA, 22 nt, Human
ucacaggagucauaauuacagu

SEQ ID NO: 594067 - RNA, 22 nt, Human
acucucccacguucgacucuaa

SEQ ID NO: 594068 - RNA, 22 nt, Human
aaagaggaaccaagagcacgug

SEQ ID NO: 594069 - RNA, 22 nt, Human
ccucucagccggacugucaggc

SEQ ID NO: 594070 - RNA, 18 nt, Human
ggguccugugggagacag

SEQ ID NO: 594071 - RNA, 22 nt, Human
guaaaacaagcuuuaugguucc

SEQ ID NO: 594072 - RNA, 22 nt, Human
aaucagcaggcuucuaaauuuu

SEQ ID NO: 594073 - RNA, 22 nt, Human
auuaaagcuauccagucaugaa

SEQ ID NO: 594074 - RNA, 22 nt, Human
uuuaauuagcaagccagagagc

SEQ ID NO: 594075 - RNA, 22 nt, Human
ccaaggcacacucugcaagguu

SEQ ID NO: 594076 - RNA, 22 nt, Human
cagugcagucaaggaagaacca

SEQ ID NO: 594077 - RNA, 22 nt, Human
cacaaugucugguaggccacuu

SEQ ID NO: 594078 - RNA, 22 nt, Human
cucaaaauccauaaaaucaggu

SEQ ID NO: 594079 - RNA, 22 nt, Human
agcaagcugucaagagagcuga

SEQ ID NO: 594080 - RNA, 22 nt, Human
acauggaauguguacuaaguua

SEQ ID NO: 594081 - RNA, 22 nt, Human
ugaggaaugcugagcagaggaa

SEQ ID NO: 594082 - RNA, 22 nt, Human
acaagauuuaaugcaacccaag

SEQ ID NO: 594083 - RNA, 22 nt, Human
gcuguacauucuguggguuugg

SEQ ID NO: 594084 - RNA, 22 nt, Human
guuagcaugauuccugcucauu

SEQ ID NO: 594085 - RNA, 22 nt, Human
uagacauuauguauuaaguucu

SEQ ID NO: 594086 - RNA, 22 nt, Human
ggaagcaggaggcugggguaaa

SEQ ID NO: 594087 - RNA, 22 nt, Human
ucacaguacugugacuauugac

SEQ ID NO: 594088 - RNA, 22 nt, Human
gucaaguuuauccgcucauuca

SEQ ID NO: 594089 - RNA, 22 nt, Human
uccccaggacuaaguugcaauc

SEQ ID NO: 594090 - RNA, 22 nt, Human
ccccagcccacaagcauauuaa

SEQ ID NO: 594091 - RNA, 22 nt, Human
ugugccugacuaggugaaucaa

SEQ ID NO: 594092 - RNA, 22 nt, Human
uuacaauaguuccuucuuuugu

SEQ ID NO: 594093 - RNA, 22 nt, Human
acuuccaggaggugucacugaa

SEQ ID NO: 594094 - RNA, 22 nt, Human
aaugucauuuuuaaaugugaga

SEQ ID NO: 594095 - RNA, 22 nt, Human
augcuuaaugaggguauauaug

SEQ ID NO: 594096 - RNA, 22 nt, Human
guuuuguucaugaacauugggu

SEQ ID NO: 594097 - RNA, 22 nt, Human
acuuuuuuauaaggaagaagau

SEQ ID NO: 594098 - RNA, 22 nt, Human
auuaaagacagcagauggaugg

SEQ ID NO: 594099 - RNA, 22 nt, Human
cccagcuugcccaggacugagg

SEQ ID NO: 594100 - RNA, 22 nt, Human
ugggccacucuucccugggucu

SEQ ID NO: 594101 - RNA, 22 nt, Human
caucuuuaguuauugaauauag

SEQ ID NO: 594102 - RNA, 22 nt, Human
cagcuuugagcagccaguggca

SEQ ID NO: 594103 - RNA, 22 nt, Human
uccagggacagcgcuggagcua

SEQ ID NO: 594104 - RNA, 22 nt, Human
acaguauauauagucuaaaagc

SEQ ID NO: 594105 - RNA, 22 nt, Human
cuuuucuuguauuggaugcccc

SEQ ID NO: 594106 - RNA, 22 nt, Human
cagucccaguuugagacucugg

SEQ ID NO: 594107 - RNA, 22 nt, Human
gcgggggcggcgcagaccucag

SEQ ID NO: 594108 - RNA, 22 nt, Human
cuccagugcccuccuugggggc

SEQ ID NO: 594109 - RNA, 22 nt, Human
cuuguagaauugaaauggucuc

SEQ ID NO: 594110 - RNA, 22 nt, Human
ucacugcucgauaacaugauua

SEQ ID NO: 594111 - RNA, 22 nt, Human
ucagaacaguucuuaauauugc

SEQ ID NO: 594112 - RNA, 22 nt, Human
cugaagcaauugagagauguuu

SEQ ID NO: 594113 - RNA, 20 nt, Human
ugcugcugccuccgccucug

SEQ ID NO: 594114 - RNA, 22 nt, Human
gcugggcaaugccagagaggag

SEQ ID NO: 594115 - RNA, 22 nt, Human
cccaggcuggauuucgguggca

SEQ ID NO: 594116 - RNA, 22 nt, Human
gaguaaaaguuggauuacaaag

SEQ ID NO: 594117 - RNA, 22 nt, Human
cagaucugagccaagcucgaug

SEQ ID NO: 594118 - RNA, 22 nt, Human
ccugggaagagcugacaggagg

SEQ ID NO: 594119 - RNA, 22 nt, Human
ugcugugguucccagaguggau

SEQ ID NO: 594120 - RNA, 22 nt, Human
gcucaugggcccagagcagccc

SEQ ID NO: 594121 - RNA, 22 nt, Human
gugagcaggauaggggcucccu

SEQ ID NO: 594122 - RNA, 22 nt, Human
gagaaaagcgaaggaccuggag

SEQ ID NO: 594123 - RNA, 22 nt, Human
gagguggauguugcagugagcu

SEQ ID NO: 594124 - RNA, 22 nt, Human
aaaugucagaagcuuuacuucu

SEQ ID NO: 594125 - RNA, 22 nt, Human
gcaguccucguaaaggucgaag

SEQ ID NO: 594126 - RNA, 22 nt, Human
agacuacagaauggcauuguuu

SEQ ID NO: 594127 - RNA, 22 nt, Human
uuuaaauuauaguuaaugucug

SEQ ID NO: 594128 - RNA, 22 nt, Human
cacaugaauugaugccaagugc

SEQ ID NO: 594129 - RNA, 22 nt, Human
gcuggggagaauuggguuaucu

SEQ ID NO: 594130 - RNA, 22 nt, Human
ucauggaauagagcaguggcaa

SEQ ID NO: 594131 - RNA, 22 nt, Human
uucuuauguucacauaauucca

SEQ ID NO: 594132 - RNA, 22 nt, Human
cuggagccccagacagggagag

SEQ ID NO: 594133 - RNA, 22 nt, Human
gugaaugauagcuucucuuugg

SEQ ID NO: 594134 - RNA, 23 nt, Human
acacugucucauggauagacugc

SEQ ID NO: 594135 - RNA, 21 nt, Human
gcuuucuguggacucugcacc

SEQ ID NO: 594136 - RNA, 22 nt, Human
uauuuccaagcugaauccaaug

SEQ ID NO: 594137 - RNA, 22 nt, Human
uugcugauucuguauuuaaggu

SEQ ID NO: 594138 - RNA, 22 nt, Human
cugugaucauucuugauuuaag

SEQ ID NO: 594139 - RNA, 22 nt, Human
gacaugucggauagaaugaguu

SEQ ID NO: 594140 - RNA, 22 nt, Human
cccaggagagagacuugaaucu

SEQ ID NO: 594141 - RNA, 22 nt, Human
aaugcuuuugcugucauugcuu

SEQ ID NO: 594142 - RNA, 22 nt, Human
aaaaaccuuucauugcaaaugu

SEQ ID NO: 594143 - RNA, 22 nt, Human
ggguggcuccuaugggcauagc

SEQ ID NO: 594144 - RNA, 22 nt, Human
uacccaaggcccuuucaauuuc

SEQ ID NO: 594145 - RNA, 22 nt, Human
aacauagaauuguuauauuuuc

SEQ ID NO: 594146 - RNA, 22 nt, Human
aaaggucuugucuugacagagu

SEQ ID NO: 594147 - RNA, 22 nt, Human
cucugaguuucauuucccuccu

SEQ ID NO: 594148 - RNA, 22 nt, Human
uaggugugggcucaggaaugug

SEQ ID NO: 594149 - RNA, 22 nt, Human
aguugcugcuucucucuagaga

SEQ ID NO: 594150 - RNA, 22 nt, Human
gaaauaauuuagaagguauucc

SEQ ID NO: 594151 - RNA, 22 nt, Human
ugcuaaauaacuuacauagugg

SEQ ID NO: 594152 - RNA, 22 nt, Human
uugaaauauggauugaccuuga

SEQ ID NO: 594153 - RNA, 22 nt, Human
uugacuuuucuuggucacauga

SEQ ID NO: 594154 - RNA, 22 nt, Human
gugcaggagcucccgcaguggu

SEQ ID NO: 594155 - RNA, 22 nt, Human
caggagugucuccacacagcaa

SEQ ID NO: 594156 - RNA, 23 nt, Human
uggcaucuuggcaucuugcugcu

SEQ ID NO: 594157 - RNA, 23 nt, Human
accaggagccaagaucucccugg

SEQ ID NO: 594158 - RNA, 22 nt, Human
ggaggaugagcuacgaggagcu

SEQ ID NO: 594159 - RNA, 22 nt, Human
aagauacauuuucuucagagaa

SEQ ID NO: 594160 - RNA, 22 nt, Human
uugaagcauuugcuauagcauu

SEQ ID NO: 594161 - RNA, 22 nt, Human
gcuggggagcuagaccucagca

SEQ ID NO: 594162 - RNA, 20 nt, Human
aaacgagccaucauucuggu

SEQ ID NO: 594163 - RNA, 22 nt, Human
agccucugcuggcccuggcacu

SEQ ID NO: 594164 - RNA, 22 nt, Human
uauuauauuuaguaauguggag

SEQ ID NO: 594165 - RNA, 22 nt, Human
acaguuauuuucccagcauuua

SEQ ID NO: 594166 - RNA, 22 nt, Human
uucugaggaggagcaaaaacuc

SEQ ID NO: 594167 - RNA, 22 nt, Human
ugguuugucuaaaugaguaaua

SEQ ID NO: 594168 - RNA, 22 nt, Human
uuguacagguuccuagggugga

SEQ ID NO: 594169 - RNA, 22 nt, Human
gcugcuuugcaguagaguaaua

SEQ ID NO: 594170 - RNA, 23 nt, Human
ucaguuuguauaauccauaugca

SEQ ID NO: 594171 - RNA, 22 nt, Human
caggaaugaucugcugagugau

SEQ ID NO: 594172 - RNA, 20 nt, Human
agcaggugacggggccugcu

SEQ ID NO: 594173 - RNA, 18 nt, Human
auccugggagcagacagc

SEQ ID NO: 594174 - RNA, 22 nt, Human
ccaccccugggugcagggagcg

SEQ ID NO: 594175 - RNA, 22 nt, Human
gggugggguguaucggauccua

SEQ ID NO: 594176 - RNA, 22 nt, Human
gccagccugugcuuggccaggc

SEQ ID NO: 594177 - RNA, 22 nt, Human
aaaggauaagguuaucaauuuu

SEQ ID NO: 594178 - RNA, 22 nt, Human
caaugucagagaagcucauauc

SEQ ID NO: 594179 - RNA, 22 nt, Human
ucaguguugaauuuuuugcaaa

SEQ ID NO: 594180 - RNA, 22 nt, Human
agacuuuagauacgucuucuuc

SEQ ID NO: 594181 - RNA, 22 nt, Human
uagcaccauacccggcagcucg

SEQ ID NO: 594182 - RNA, 21 nt, Human
ugagaaguaugucuucagcca

SEQ ID NO: 594183 - RNA, 22 nt, Human
uguccuuuacugauugcuucug

SEQ ID NO: 594184 - RNA, 22 nt, Human
ugcugagcgcauccggcggccg

SEQ ID NO: 594185 - RNA, 22 nt, Human
uguacacacacguguguaucua

SEQ ID NO: 594186 - RNA, 22 nt, Human
ucccuccuuuaucaaaaagaga

SEQ ID NO: 594187 - RNA, 22 nt, Human
ugaaagguagcuggccucauag

SEQ ID NO: 594188 - RNA, 22 nt, Human
cucuuuggucgcaucauccauu

SEQ ID NO: 594189 - RNA, 22 nt, Human
ccaggcugcuuuauuacucugu

SEQ ID NO: 594190 - RNA, 22 nt, Human
caggaaaauggaaucaccugua

SEQ ID NO: 594191 - RNA, 22 nt, Human
uuaaagcuggcguuacaguuug

SEQ ID NO: 594192 - RNA, 22 nt, Human
aaaugucagaggaacauauuga

SEQ ID NO: 594193 - RNA, 22 nt, Human
uaugugcaugcugacuugagga

SEQ ID NO: 594194 - RNA, 22 nt, Human
cuucacagccaacaugggcaca

SEQ ID NO: 594195 - RNA, 22 nt, Human
ucacagcuguuuuguccauuaa

SEQ ID NO: 594196 - RNA, 22 nt, Human
agcagggcagugaucagaaagg

SEQ ID NO: 594197 - RNA, 22 nt, Human
uccuccagugguacuggccaau

SEQ ID NO: 594198 - RNA, 22 nt, Human
ccuuggugcucugcugggaugg

SEQ ID NO: 594199 - RNA, 22 nt, Human
augaggcagucuggccugaggg

SEQ ID NO: 594200 - RNA, 22 nt, Human
acucauuugcaugaugugcuau

SEQ ID NO: 594201 - RNA, 22 nt, Human
ccucucuguaagggucccuccc

SEQ ID NO: 594202 - RNA, 22 nt, Human
aacuguaaggcuuagaacagca

SEQ ID NO: 594203 - RNA, 22 nt, Human
ggccggccuuugcgagcauucu

SEQ ID NO: 594204 - RNA, 22 nt, Human
gcugggcccagaucccaggauc

SEQ ID NO: 594205 - RNA, 22 nt, Human
uagugugucccuggggaguguu

SEQ ID NO: 594206 - RNA, 22 nt, Human
aaacaucuucucuugauucuuu

SEQ ID NO: 594207 - RNA, 22 nt, Human
ugaagaauguugcagugagcau

SEQ ID NO: 594208 - RNA, 22 nt, Human
aguuagaauauaauuauguuaa

SEQ ID NO: 594209 - RNA, 22 nt, Human
cagacagggcccugugauggua

SEQ ID NO: 594210 - RNA, 22 nt, Human
aagggaggggauguaagccugg

SEQ ID NO: 594211 - RNA, 22 nt, Human
uauuuuguauuuaugcaagaaa

SEQ ID NO: 594212 - RNA, 22 nt, Human
gugaacagacuguucucuacag

SEQ ID NO: 594213 - RNA, 22 nt, Human
ggccuggaagaggacagagaaa

SEQ ID NO: 594214 - RNA, 22 nt, Human
aaacuguaaagcaggugaguag

SEQ ID NO: 594215 - RNA, 22 nt, Human
ugcugcccguaccugugcacuu

SEQ ID NO: 594216 - RNA, 22 nt, Human
gcugcagcuuuaggauccagug

SEQ ID NO: 594217 - RNA, 22 nt, Human
ucugguccccauuccagguggg

SEQ ID NO: 594218 - RNA, 22 nt, Human
gaggugaguggggucuccaggg

SEQ ID NO: 594219 - RNA, 22 nt, Human
aguucuuauugaauagaaauca

SEQ ID NO: 594220 - RNA, 22 nt, Human
ugcccuggggagcccagccagg

SEQ ID NO: 594221 - RNA, 22 nt, Human
auugaagcauggagaugaggca

SEQ ID NO: 594222 - RNA, 21 nt, Human
uucuagaaaaguaugggacug

SEQ ID NO: 594223 - RNA, 22 nt, Human
uagggaugacgaaaggacagag

SEQ ID NO: 594224 - RNA, 22 nt, Human
acacaguaccccaaggcugggc

SEQ ID NO: 594225 - RNA, 22 nt, Human
aggcccaaaagaaaccacuggg

SEQ ID NO: 594226 - RNA, 22 nt, Human
cccagcauccucagggagcggg

SEQ ID NO: 594227 - RNA, 17 nt, Human
uacuagaauagagacag

SEQ ID NO: 594228 - RNA, 22 nt, Human
agagccucugucauggagagaa

SEQ ID NO: 594229 - RNA, 22 nt, Human
agagcuguauccccuuaccagu

SEQ ID NO: 594230 - RNA, 22 nt, Human
uaacauuucggugacaguggga

SEQ ID NO: 594231 - RNA, 22 nt, Human
caagucugucugcuccugugug

SEQ ID NO: 594232 - RNA, 22 nt, Human
ugaagguguaugcuguggguca

SEQ ID NO: 594233 - RNA, 21 nt, Human
aggcaucuaaagagaguagac

SEQ ID NO: 594234 - RNA, 22 nt, Human
aaaucagagugguuggucaucc

SEQ ID NO: 594235 - RNA, 21 nt, Human
uaguuucuacccaguuaaugg

SEQ ID NO: 594236 - RNA, 22 nt, Human
gaacagugccagcacacaauaa

SEQ ID NO: 594237 - RNA, 22 nt, Human
auuuauugaacacugacuaugu

SEQ ID NO: 594238 - RNA, 22 nt, Human
acaaugaaaaaauuuacugugg

SEQ ID NO: 594239 - RNA, 22 nt, Human
ucugaggaguugggccagugcu

SEQ ID NO: 594240 - RNA, 22 nt, Human
ggacacaguggaagacagcuug

SEQ ID NO: 594241 - RNA, 22 nt, Human
acuguauuggaaauauagcaaa

SEQ ID NO: 594242 - RNA, 19 nt, Human
gcaggcuugggucucccca

SEQ ID NO: 594243 - RNA, 22 nt, Human
agaacaauugccccaaagcuug

SEQ ID NO: 594244 - RNA, 22 nt, Human
ucuccuggcccugucgccaucu

SEQ ID NO: 594245 - RNA, 22 nt, Human
agagagcuguccugggacaccc

SEQ ID NO: 594246 - RNA, 22 nt, Human
uugauuuauagaauguucaagc

SEQ ID NO: 594247 - RNA, 22 nt, Human
acagagaccagcaucuucugcc

SEQ ID NO: 594248 - RNA, 17 nt, Human
ucuucucuuccagucuu

SEQ ID NO: 594249 - RNA, 22 nt, Human
uuccauuuggcacuucacugag

SEQ ID NO: 594250 - RNA, 22 nt, Human
ucugaagaauaggauguugugu

SEQ ID NO: 594251 - RNA, 18 nt, Human
aguaggcacugugggguu

SEQ ID NO: 594252 - RNA, 22 nt, Human
aagacuugaccagguugaaggc

SEQ ID NO: 594253 - RNA, 22 nt, Human
acgggugguaaugagaaaagga

SEQ ID NO: 594254 - RNA, 22 nt, Human
auaaagauuuuuaggcauuucu

SEQ ID NO: 594255 - RNA, 22 nt, Human
ugccaguguggaacuaggaaga

SEQ ID NO: 594256 - RNA, 19 nt, Human
uaugucccuuucccccauu

SEQ ID NO: 594257 - RNA, 21 nt, Human
caguccugcaaauaauucuuu

SEQ ID NO: 594258 - RNA, 22 nt, Human
aucucagaucuacagaucuaca

SEQ ID NO: 594259 - RNA, 22 nt, Human
ugugagcacuauggcuaggcuc

SEQ ID NO: 594260 - RNA, 22 nt, Human
uggggagugaugccucggauaa

SEQ ID NO: 594261 - RNA, 22 nt, Human
ucucacucauuuccuaggucuu

SEQ ID NO: 594262 - RNA, 22 nt, Human
uggcugggagcuggaacugggc

SEQ ID NO: 594263 - RNA, 23 nt, Human
ggcuccuggauucaaauccugcc

SEQ ID NO: 594264 - RNA, 22 nt, Human
augggaggcaaagaucgcagaa

SEQ ID NO: 594265 - RNA, 22 nt, Human
ggaugugaaucugggcugagac

SEQ ID NO: 594266 - RNA, 22 nt, Human
uccagcucaucugucuccauua

SEQ ID NO: 594267 - RNA, 22 nt, Human
cagccacuggugccaggcuguu

SEQ ID NO: 594268 - RNA, 22 nt, Human
acacaccaugauuuauuuaccc

SEQ ID NO: 594269 - RNA, 22 nt, Human
aaaaaugaauucuucaguggca

SEQ ID NO: 594270 - RNA, 22 nt, Human
uucaagauccagcacaacagug

SEQ ID NO: 594271 - RNA, 22 nt, Human
uggagcagugguccuggagaug

SEQ ID NO: 594272 - RNA, 22 nt, Human
auagaaaggucuuuggcagaca

SEQ ID NO: 594273 - RNA, 20 nt, Human
ggcaggacccgguagggagc

SEQ ID NO: 594274 - RNA, 22 nt, Human
uuacagguguggaaauugagua

SEQ ID NO: 594275 - RNA, 22 nt, Human
aauaacagugccaugaaauuga

SEQ ID NO: 594276 - RNA, 22 nt, Human
gguggcugcuuccucaagagga

SEQ ID NO: 594277 - RNA, 23 nt, Human
cccagcugcagacaagggagggu

SEQ ID NO: 594278 - RNA, 22 nt, Human
uuguguuuucuuauggcauaaa

SEQ ID NO: 594279 - RNA, 22 nt, Human
uggagacucugcaucugugaca

SEQ ID NO: 594280 - RNA, 22 nt, Human
ugacauuuaucaaagaaauggu

SEQ ID NO: 594281 - RNA, 22 nt, Human
uccucuucugcccaucagaggc

SEQ ID NO: 594282 - RNA, 22 nt, Human
gcuuucuguagguaguuacugu

SEQ ID NO: 594283 - RNA, 22 nt, Human
gcugggagaggcccugaaguga

SEQ ID NO: 594284 - RNA, 22 nt, Human
ugcaauaacccaguaucuguga

SEQ ID NO: 594285 - RNA, 23 nt, Human
agcuaacagaucgacaaaguaua

SEQ ID NO: 594286 - RNA, 22 nt, Human
gccagaggggcucgaaggcgcg

SEQ ID NO: 594287 - RNA, 22 nt, Human
ucccaucacuagcaucugcacc

SEQ ID NO: 594288 - RNA, 22 nt, Human
gaaucagacuacaaaugacccc

SEQ ID NO: 594289 - RNA, 22 nt, Human
aaaauugagagucuugugcaag

SEQ ID NO: 594290 - RNA, 22 nt, Human
ugacacagauuagagacauacc

SEQ ID NO: 594291 - RNA, 22 nt, Human
agggauggaucuuggcccugga

SEQ ID NO: 594292 - RNA, 22 nt, Human
acacaggcauagccauacaugu

SEQ ID NO: 594293 - RNA, 22 nt, Human
auaugacauaaaaucauuuuug

SEQ ID NO: 594294 - RNA, 22 nt, Human
ugcauaaaacaugauuucugcu

SEQ ID NO: 594295 - RNA, 19 nt, Human
cugaaaaacauucucagga

SEQ ID NO: 594296 - RNA, 23 nt, Human
ccacagagcugccaauuccugug

SEQ ID NO: 594297 - RNA, 22 nt, Human
accagggcccgggagagcucuc

SEQ ID NO: 594298 - RNA, 22 nt, Human
ggacauuuagaacagaguauuu

SEQ ID NO: 594299 - RNA, 19 nt, Human
cauauuuuugggcuggcau

SEQ ID NO: 594300 - RNA, 22 nt, Human
aggggugaaggcccgauaggag

SEQ ID NO: 594301 - RNA, 22 nt, Human
ggccagcuggaugugggugacg

SEQ ID NO: 594302 - RNA, 22 nt, Human
caugcaguugaagcacagagag

SEQ ID NO: 594303 - RNA, 22 nt, Human
augaggucauccuggaguaagg

SEQ ID NO: 594304 - RNA, 22 nt, Human
ucuuguuuggauuuugggcagu

SEQ ID NO: 594305 - RNA, 22 nt, Human
aaccagcuccagccuccauuca

SEQ ID NO: 594306 - RNA, 22 nt, Human
gccuuccaccuaggccucugcu

SEQ ID NO: 594307 - RNA, 22 nt, Human
aaaacacaagaagcaggguaca

SEQ ID NO: 594308 - RNA, 22 nt, Human
gagcucaguguagucauggcuu

SEQ ID NO: 594309 - RNA, 20 nt, Human
cuugccaguucccuggcaga

SEQ ID NO: 594310 - RNA, 22 nt, Human
agaguucugaauuuuauucucu

SEQ ID NO: 594311 - RNA, 22 nt, Human
ggagaggagcuauugggggcuc

SEQ ID NO: 594312 - RNA, 22 nt, Human
ccucugugugaugcgcaaagua

SEQ ID NO: 594313 - RNA, 22 nt, Human
gugcugagcacaccuuggagca

SEQ ID NO: 594314 - RNA, 22 nt, Human
ugggauaguagcugagagacaa

SEQ ID NO: 594315 - RNA, 22 nt, Human
gccucugauggaggccagcgcu

SEQ ID NO: 594316 - RNA, 22 nt, Human
cacacaugaaguugcugagcua

SEQ ID NO: 594317 - RNA, 22 nt, Human
ggcacagagcuccagccuuggc

SEQ ID NO: 594318 - RNA, 22 nt, Human
aagaaagcugaauauucugugu

SEQ ID NO: 594319 - RNA, 22 nt, Human
uguuuaagcugaugagguaucg

SEQ ID NO: 594320 - RNA, 22 nt, Human
cacugcuucagucagagaaauu

SEQ ID NO: 594321 - RNA, 22 nt, Human
uuacaugguaaacacucuuuua

SEQ ID NO: 594322 - RNA, 22 nt, Human
uccuugaaugaauguucucucc

SEQ ID NO: 594323 - RNA, 22 nt, Human
uggagagcgugcuuagcacucu

SEQ ID NO: 594324 - RNA, 22 nt, Human
uagcaaagcccuugcuguguaa

SEQ ID NO: 594325 - RNA, 22 nt, Human
guauuucccugaguucugugag

SEQ ID NO: 594326 - RNA, 22 nt, Human
cuggggagugaagguaauuaca

SEQ ID NO: 594327 - RNA, 22 nt, Human
ggaggugggauuaggaccuaaa

SEQ ID NO: 594328 - RNA, 22 nt, Human
uuccuagggcagagccgcuggg

SEQ ID NO: 594329 - RNA, 22 nt, Human
cugcugggcuccucaugugacu

SEQ ID NO: 594330 - RNA, 22 nt, Human
cguuuucuucacuuugcaaguu

SEQ ID NO: 594331 - RNA, 22 nt, Human
uaaaugcucagaccuuauucca

SEQ ID NO: 594332 - RNA, 22 nt, Human
agggcccaguggagagcugagc

SEQ ID NO: 594333 - RNA, 22 nt, Human
gcucacugccauucucuagaug

SEQ ID NO: 594334 - RNA, 22 nt, Human
ucugaaauuguuaguaaaaaug

SEQ ID NO: 594335 - RNA, 22 nt, Human
cacugcucgcugcagcauggcc

SEQ ID NO: 594336 - RNA, 22 nt, Human
cagaaauaucaccuggacucua

SEQ ID NO: 594337 - RNA, 22 nt, Human
aaaguguuaugagaacuaagug

SEQ ID NO: 594338 - RNA, 22 nt, Human
gaguccaggcuguugcucaucu

SEQ ID NO: 594339 - RNA, 23 nt, Human
ccaggcucuuucaccugcuauuc

SEQ ID NO: 594340 - RNA, 22 nt, Human
aucaagaauguucauucuucua

SEQ ID NO: 594341 - RNA, 22 nt, Human
gcaugcacacacuuucucacua

SEQ ID NO: 594342 - RNA, 22 nt, Human
gcagcccugcaggcagcuccag

SEQ ID NO: 594343 - RNA, 22 nt, Human
gaggccagaagugccucgggcu

SEQ ID NO: 594344 - RNA, 22 nt, Human
gaggggccuggcgaggacaugu

SEQ ID NO: 594345 - RNA, 22 nt, Human
gucuuucuaugcauagagcaga

SEQ ID NO: 594346 - RNA, 20 nt, Human
cugaagagacuggaggggca

SEQ ID NO: 594347 - RNA, 22 nt, Human
uaauuauagcauuggaguggcc

SEQ ID NO: 594348 - RNA, 22 nt, Human
aucccacaccccuacaacauau

SEQ ID NO: 594349 - RNA, 22 nt, Human
ugcccaccuaacaguguuugga

SEQ ID NO: 594350 - RNA, 22 nt, Human
ccuaaguaaguugacuuucaga

SEQ ID NO: 594351 - RNA, 22 nt, Human
ucuccuggaagaauaccacacu

SEQ ID NO: 594352 - RNA, 22 nt, Human
uugcagaauacuuauucuguau

SEQ ID NO: 594353 - RNA, 22 nt, Human
acaagcaucagguucagcaaua

SEQ ID NO: 594354 - RNA, 22 nt, Human
ugucccagucaaggcugucauc

SEQ ID NO: 594355 - RNA, 22 nt, Human
caggucuggguugauggccugg

SEQ ID NO: 594356 - RNA, 22 nt, Human
uccucacagaguggcaggcaau

SEQ ID NO: 594357 - RNA, 22 nt, Human
ucagaaaagaccacauuauucu

SEQ ID NO: 594358 - RNA, 22 nt, Human
ccuuucucuaucgacccaucgc

SEQ ID NO: 594359 - RNA, 20 nt, Human
auaacaaggcucugcaagcu

SEQ ID NO: 594360 - RNA, 22 nt, Human
gggggcugaggcuguucugagg

SEQ ID NO: 594361 - RNA, 22 nt, Human
cuggacaggcuggggacugcaa

SEQ ID NO: 594362 - RNA, 22 nt, Human
aaguuguuguugagguggguaa

SEQ ID NO: 594363 - RNA, 22 nt, Human
cagguaaagcuucaaaucacuu

SEQ ID NO: 594364 - RNA, 22 nt, Human
ccugcccagcuucaccucaggc

SEQ ID NO: 594365 - RNA, 22 nt, Human
ugggacuucaaugcaaugaggu

SEQ ID NO: 594366 - RNA, 22 nt, Human
ggcugcugcuguguaggccugu

SEQ ID NO: 594367 - RNA, 22 nt, Human
cugaaaauguuacacaggaaga

SEQ ID NO: 594368 - RNA, 22 nt, Human
agcugggaagaguuuucugcag

SEQ ID NO: 594369 - RNA, 22 nt, Human
cauuauggcagccaggauauug

SEQ ID NO: 594370 - RNA, 22 nt, Human
aauucaacagucaguuaucuca

SEQ ID NO: 594371 - RNA, 22 nt, Human
ugaacagacugaccucugaccu

SEQ ID NO: 594372 - RNA, 22 nt, Human
aaugcaccuuggcagggauuca

SEQ ID NO: 594373 - RNA, 21 nt, Human
gcuugguuuugguuacuugcc

SEQ ID NO: 594374 - RNA, 21 nt, Human
cagaggcugagagggcaaucu

SEQ ID NO: 594375 - RNA, 18 nt, Human
ugaggaaggggaaguauu

SEQ ID NO: 594376 - RNA, 22 nt, Human
cucaggcugucuaauggauuag

SEQ ID NO: 594377 - RNA, 21 nt, Human
ccagggauguugaacugaaag

SEQ ID NO: 594378 - RNA, 22 nt, Human
uuagaaucagguguuauaauca

SEQ ID NO: 594379 - RNA, 22 nt, Human
aauuugaugaguuuguaagucu

SEQ ID NO: 594380 - RNA, 22 nt, Human
uccauauacaacuuaaucuuua

SEQ ID NO: 594381 - RNA, 22 nt, Human
ucggagcuguagaugaaacccu

SEQ ID NO: 594382 - RNA, 22 nt, Human
uuuaagguggacaucuaaguca

SEQ ID NO: 594383 - RNA, 21 nt, Human
ucacugaagccuaagauguuu

SEQ ID NO: 594384 - RNA, 22 nt, Human
aggggagccagggcugcgaguu

SEQ ID NO: 594385 - RNA, 22 nt, Human
uccagaaaaaguaauuuauuug

SEQ ID NO: 594386 - RNA, 22 nt, Human
gcucuccugugcagaugcugcu

SEQ ID NO: 594387 - RNA, 22 nt, Human
gaaccaugagaaauugcuauuu

SEQ ID NO: 594388 - RNA, 22 nt, Human
cugggcucagugucucacuccu

SEQ ID NO: 594389 - RNA, 22 nt, Human
uaaaagagaauggauaacagag

SEQ ID NO: 594390 - RNA, 21 nt, Human
cugauaauuguuaaauuauuu

SEQ ID NO: 594391 - RNA, 22 nt, Human
gaaguuauuuuaccuguuaaag

SEQ ID NO: 594392 - RNA, 22 nt, Human
agcuucuugacggauguucugg

SEQ ID NO: 594393 - RNA, 22 nt, Human
cuucugggcauucagcugcaca

SEQ ID NO: 594394 - RNA, 21 nt, Human
ucauggaaguaacaaacauau

SEQ ID NO: 594395 - RNA, 22 nt, Human
gggagcaggagccugccugcca

SEQ ID NO: 594396 - RNA, 22 nt, Human
auuuucuucucucccuggcugc

SEQ ID NO: 594397 - RNA, 22 nt, Human
aaagagaaacuuagaagccuga

SEQ ID NO: 594398 - RNA, 22 nt, Human
ggaggaagagguuguucucuca

SEQ ID NO: 594399 - RNA, 22 nt, Human
auguuuuacccuuugcacaaac

SEQ ID NO: 594400 - RNA, 22 nt, Human
acuacagucccucauauguugg

SEQ ID NO: 594401 - RNA, 22 nt, Human
gaagacaucauggagaggauag

SEQ ID NO: 594402 - RNA, 22 nt, Human
uggcuggauuauuggcuaguac

SEQ ID NO: 594403 - RNA, 22 nt, Human
agccagccgggggaccacagug

SEQ ID NO: 594404 - RNA, 22 nt, Human
agcuggguguguaucagauaaa

SEQ ID NO: 594405 - RNA, 22 nt, Human
uucugaaaccuucaguaugaag

SEQ ID NO: 594406 - RNA, 22 nt, Human
ugcuccagccuaugcucuccgg

SEQ ID NO: 594407 - RNA, 22 nt, Human
aggaaacuccccuacaucucaa

SEQ ID NO: 594408 - RNA, 22 nt, Human
ccuuggauuuugugcccacgcc

SEQ ID NO: 594409 - RNA, 22 nt, Human
acucagaagauauaaugacuca

SEQ ID NO: 594410 - RNA, 22 nt, Human
gagcuuuggggaagaauacaga

SEQ ID NO: 594411 - RNA, 22 nt, Human
uuugucaccaguggcuuuggua

SEQ ID NO: 594412 - RNA, 21 nt, Human
aacuacaguuguuccuucauu

SEQ ID NO: 594413 - RNA, 22 nt, Human
caggcccugggcaggaucagcc

SEQ ID NO: 594414 - RNA, 19 nt, Human
gucucuggauuucaggucc

SEQ ID NO: 594415 - RNA, 22 nt, Human
auauauuuuuugagacagaguc

SEQ ID NO: 594416 - RNA, 22 nt, Human
cugcagcuuucgcuccaucagc

SEQ ID NO: 594417 - RNA, 22 nt, Human
augggaggcagcagagcccagc

SEQ ID NO: 594418 - RNA, 22 nt, Human
gcugaggugaggcuggaaagga

SEQ ID NO: 594419 - RNA, 22 nt, Human
uacagcuugaugagagcgcgag

SEQ ID NO: 594420 - RNA, 23 nt, Human
aaaguugauuugcaguuuaagag

SEQ ID NO: 594421 - RNA, 22 nt, Human
cagcucugaugaaauguaccag

SEQ ID NO: 594422 - RNA, 22 nt, Human
aaauuuuguauucuaguucuag

SEQ ID NO: 594423 - RNA, 22 nt, Human
ggaggguuagcaaaggcacaga

SEQ ID NO: 594424 - RNA, 22 nt, Human
aggcuggucuguuggcauuuuu

SEQ ID NO: 594425 - RNA, 22 nt, Human
cuccugagcucugaggaagcuu

SEQ ID NO: 594426 - RNA, 22 nt, Human
uggggugacagugcagugguca

SEQ ID NO: 594427 - RNA, 22 nt, Human
guggcuauauuugaggauacgu

SEQ ID NO: 594428 - RNA, 22 nt, Human
gggcacagucuaaaguugggcc

SEQ ID NO: 594429 - RNA, 22 nt, Human
auuguuaauguugcacuaaggu

SEQ ID NO: 594430 - RNA, 22 nt, Human
auucugcaacuguuguuggugg

SEQ ID NO: 594431 - RNA, 19 nt, Human
agacacuggauggaaaaug

SEQ ID NO: 594432 - RNA, 22 nt, Human
gaagccuuugccuaaaacauua

SEQ ID NO: 594433 - RNA, 22 nt, Human
cugggcacugcagcaggcauca

SEQ ID NO: 594434 - RNA, 19 nt, Human
gcauuucaggcauguuugc

SEQ ID NO: 594435 - RNA, 22 nt, Human
ggaacauuuaaauucuuauuug

SEQ ID NO: 594436 - RNA, 22 nt, Human
gcuuuugugagauuaagcuacu

SEQ ID NO: 594437 - RNA, 22 nt, Human
cuguguuuugagauauuauuaa

SEQ ID NO: 594438 - RNA, 22 nt, Human
acaucucagaacugaguaaccg

SEQ ID NO: 594439 - RNA, 22 nt, Human
aggcuguccucucuugcucagu

SEQ ID NO: 594440 - RNA, 22 nt, Human
ugaaugaugcauuuguuuccca

SEQ ID NO: 594441 - RNA, 22 nt, Human
gaagcugagcugaggcauguug

SEQ ID NO: 594442 - RNA, 22 nt, Human
uacauacauauucauacaggug

SEQ ID NO: 594443 - RNA, 22 nt, Human
gugggagcugcggaggccuggg

SEQ ID NO: 594444 - RNA, 22 nt, Human
gugcugugcgcuuuuucuguau

SEQ ID NO: 594445 - RNA, 23 nt, Human
gagguacagcaccagugaauagg

SEQ ID NO: 594446 - RNA, 22 nt, Human
cugguuggugccacaugguggc

SEQ ID NO: 594447 - RNA, 22 nt, Human
auacaugaucacuguauuauaa

SEQ ID NO: 594448 - RNA, 22 nt, Human
ccuuagcaaauuggcaucuucu

SEQ ID NO: 594449 - RNA, 22 nt, Human
aacacaguuucugcauugguag

SEQ ID NO: 594450 - RNA, 22 nt, Human
agcagaugagccucaugacugg

SEQ ID NO: 594451 - RNA, 22 nt, Human
agggcugguauguccaugaaag

SEQ ID NO: 594452 - RNA, 22 nt, Human
aggcuaggguaacagauguggc

SEQ ID NO: 594453 - RNA, 22 nt, Human
cccugggacccgcugcagaggc

SEQ ID NO: 594454 - RNA, 22 nt, Human
gauucugagcugguguuuuacg

SEQ ID NO: 594455 - RNA, 22 nt, Human
cagggagggacaauugucaccu

SEQ ID NO: 594456 - RNA, 19 nt, Human
cccaggaagcggagguugc

SEQ ID NO: 594457 - RNA, 22 nt, Human
ugagauggagucuugcucuguu

SEQ ID NO: 594458 - RNA, 23 nt, Human
uggcucagggucucuuaugaagu

SEQ ID NO: 594459 - RNA, 22 nt, Human
agcacuuugagcagaugaagga

SEQ ID NO: 594460 - RNA, 22 nt, Human
agaaaugacacacaugagacau

SEQ ID NO: 594461 - RNA, 22 nt, Human
uucaacauuugauacaagucag

SEQ ID NO: 594462 - RNA, 22 nt, Human
acaguuuaugguguuuuauaua

SEQ ID NO: 594463 - RNA, 18 nt, Human
gacaccagccucugcccc

SEQ ID NO: 594464 - RNA, 22 nt, Human
ugcuucacaagaauucaggacc

SEQ ID NO: 594465 - RNA, 22 nt, Human
cccagaggguggagguugcagu

SEQ ID NO: 594466 - RNA, 22 nt, Human
agaagccauucucaguuccuga

SEQ ID NO: 594467 - RNA, 22 nt, Human
gguggggcuaggaccucaggau

SEQ ID NO: 594468 - RNA, 23 nt, Human
cuccccaguguccucaugcaucu

SEQ ID NO: 594469 - RNA, 22 nt, Human
ugggggcagccaggcugucaag

SEQ ID NO: 594470 - RNA, 22 nt, Human
aucugaaauagucuuaucugag

SEQ ID NO: 594471 - RNA, 22 nt, Human
uaguccagccuuggguguagcc

SEQ ID NO: 594472 - RNA, 22 nt, Human
ugcaggcucucugcugccagau

SEQ ID NO: 594473 - RNA, 22 nt, Human
cuggcugcaguagcaagagacu

SEQ ID NO: 594474 - RNA, 22 nt, Human
ucuguuuucauuugucuugaga

SEQ ID NO: 594475 - RNA, 22 nt, Human
aagcuuugcaaugcuucauuau

SEQ ID NO: 594476 - RNA, 22 nt, Human
cuggauguuuugcuaaggacuc

SEQ ID NO: 594477 - RNA, 22 nt, Human
caccagcuacucggguuuccug

SEQ ID NO: 594478 - RNA, 22 nt, Human
acaugcuuuaucggauugacac

SEQ ID NO: 594479 - RNA, 22 nt, Human
ugggccuguggcuuggcucuag

SEQ ID NO: 594480 - RNA, 22 nt, Human
cagcagccuggccccuccucgg

SEQ ID NO: 594481 - RNA, 22 nt, Human
ugcugcuuuuaguuggauagaa

SEQ ID NO: 594482 - RNA, 22 nt, Human
caggcagagacccucuccuaaa

SEQ ID NO: 594483 - RNA, 22 nt, Human
ggucuggaccauggacgccggg

SEQ ID NO: 594484 - RNA, 22 nt, Human
ugaggcuguucuaccagggcca

SEQ ID NO: 594485 - RNA, 22 nt, Human
ugaauguuugaugagaaauaga

SEQ ID NO: 594486 - RNA, 22 nt, Human
ugccccuucuacccgucucugu

SEQ ID NO: 594487 - RNA, 22 nt, Human
uaugcuuuaacccucuuauauu

SEQ ID NO: 594488 - RNA, 22 nt, Human
cauggcuuuccaguccuccacu

SEQ ID NO: 594489 - RNA, 22 nt, Human
gccuggagaggaagccggugga

SEQ ID NO: 594490 - RNA, 22 nt, Human
ggagaggcuuccagagucgugc

SEQ ID NO: 594491 - RNA, 22 nt, Human
aaguacaacgcauacagagaaa

SEQ ID NO: 594492 - RNA, 22 nt, Human
ucuccagguucagucgauggaa

SEQ ID NO: 594493 - RNA, 22 nt, Human
uggacaggauagugcaguacgc

SEQ ID NO: 594494 - RNA, 22 nt, Human
ucugcagacuugauaaccacug

SEQ ID NO: 594495 - RNA, 22 nt, Human
uuuuuauacuuugcucaagauu

SEQ ID NO: 594496 - RNA, 22 nt, Human
uaguagaauccaaaccaacagu

SEQ ID NO: 594497 - RNA, 22 nt, Human
aaaauauguauaacucuucugc

SEQ ID NO: 594498 - RNA, 22 nt, Human
cgcugcagaagcguguucagga

SEQ ID NO: 594499 - RNA, 23 nt, Human
acuugauuauuguugauagauuc

SEQ ID NO: 594500 - RNA, 22 nt, Human
cuggaggagagucugaaugaca

SEQ ID NO: 594501 - RNA, 22 nt, Human
uccccuccucuccugauauggg

SEQ ID NO: 594502 - RNA, 22 nt, Human
ucugaaagcccuaguuuguaau

SEQ ID NO: 594503 - RNA, 19 nt, Human
ucccaggaagcaaauguca

SEQ ID NO: 594504 - RNA, 22 nt, Human
acagaggucauggagaguucuc

SEQ ID NO: 594505 - RNA, 19 nt, Human
auccaggucauguaguucu

SEQ ID NO: 594506 - RNA, 22 nt, Human
ucccugugggaugaggacucug

SEQ ID NO: 594507 - RNA, 22 nt, Human
uugugucuaaauaaggagaccu

SEQ ID NO: 594508 - RNA, 22 nt, Human
gccacaggucggcuagaggguc

SEQ ID NO: 594509 - RNA, 23 nt, Human
ccaagacuguuaggaguggggag

SEQ ID NO: 594510 - RNA, 22 nt, Human
gcugugugccaggggaaggcug

SEQ ID NO: 594511 - RNA, 22 nt, Human
gacuuuaucuuguccuuccugc

SEQ ID NO: 594512 - RNA, 22 nt, Human
guggucagagaugacagugggu

SEQ ID NO: 594513 - RNA, 21 nt, Human
ucucuguauccauggguucca

SEQ ID NO: 594514 - RNA, 22 nt, Human
cugagcgcgggaccugaggcug

SEQ ID NO: 594515 - RNA, 22 nt, Human
aaauauaguaaaugcauaguuc

SEQ ID NO: 594516 - RNA, 22 nt, Human
cuuggaggaaaggcagggagac

SEQ ID NO: 594517 - RNA, 22 nt, Human
ucugggaacagccuggcugugu

SEQ ID NO: 594518 - RNA, 22 nt, Human
accagcucuggacaggcauuuc

SEQ ID NO: 594519 - RNA, 22 nt, Human
uggaacaaauuuuggggaccuu

SEQ ID NO: 594520 - RNA, 22 nt, Human
agaaugcauuuuguguagcuau

SEQ ID NO: 594521 - RNA, 22 nt, Human
aguguccccuacagaggcauuc

SEQ ID NO: 594522 - RNA, 22 nt, Human
augacaaaauucacagguguga

SEQ ID NO: 594523 - RNA, 22 nt, Human
agcugggcaaaaugugagguug

SEQ ID NO: 594524 - RNA, 22 nt, Human
cuuguauuaggaagaaugcuuu

SEQ ID NO: 594525 - RNA, 22 nt, Human
cuggggcucacuccagcccugg

SEQ ID NO: 594526 - RNA, 22 nt, Human
uuuuaugauugagcuggcuaca

SEQ ID NO: 594527 - RNA, 22 nt, Human
ugacauuuuaucaauaucacag

SEQ ID NO: 594528 - RNA, 22 nt, Human
uccaggcaucuguauuuuuuaa

SEQ ID NO: 594529 - RNA, 22 nt, Human
agaucaaagccaugagagauuu

SEQ ID NO: 594530 - RNA, 22 nt, Human
cccugggauugccuuggccuug

SEQ ID NO: 594531 - RNA, 22 nt, Human
ggggcagaaguagugccccuga

SEQ ID NO: 594532 - RNA, 22 nt, Human
auagaauucuuugaaauuuaug

SEQ ID NO: 594533 - RNA, 22 nt, Human
uggcucauucuuuagaauauac

SEQ ID NO: 594534 - RNA, 18 nt, Human
gagcugggagaaggaagg

SEQ ID NO: 594535 - RNA, 22 nt, Human
ucaggggacuuaggagagaagu

SEQ ID NO: 594536 - RNA, 22 nt, Human
acagagcaugauggaagaucga

SEQ ID NO: 594537 - RNA, 22 nt, Human
agggcugacagugaggagucaa

SEQ ID NO: 594538 - RNA, 22 nt, Human
ugcugaauaauaagauuacuca

SEQ ID NO: 594539 - RNA, 22 nt, Human
gccugccugcugucaucugccu

SEQ ID NO: 594540 - RNA, 22 nt, Human
cagguggcuucucccuaggcca

SEQ ID NO: 594541 - RNA, 22 nt, Human
cacagcaggugcuuaaugauua

SEQ ID NO: 594542 - RNA, 22 nt, Human
auacugaauuagguaaagcaua

SEQ ID NO: 594543 - RNA, 22 nt, Human
uaagcaguuuuucuuguauuaa

SEQ ID NO: 594544 - RNA, 22 nt, Human
ugcagguggcuccagggacugc

SEQ ID NO: 594545 - RNA, 22 nt, Human
gugucacaagagcccaggaaac

SEQ ID NO: 594546 - RNA, 22 nt, Human
uugcaggguccuguggcucucc

SEQ ID NO: 594547 - RNA, 22 nt, Human
ccaagcauuucuagccagucac

SEQ ID NO: 594548 - RNA, 22 nt, Human
ugcuggaggccugacuguguuu

SEQ ID NO: 594549 - RNA, 22 nt, Human
ucugcagaaggaaucagcugag

SEQ ID NO: 594550 - RNA, 21 nt, Human
ccauaauuuuguuucagaagu

SEQ ID NO: 594551 - RNA, 23 nt, Human
ucugagguccaccaguuugcaga

SEQ ID NO: 594552 - RNA, 22 nt, Human
auaaucugacaaagacuuaagc

SEQ ID NO: 594553 - RNA, 20 nt, Human
cucaguuuccucauggcuca

SEQ ID NO: 594554 - RNA, 22 nt, Human
cucuuacauucuuuuacuagca

SEQ ID NO: 594555 - RNA, 22 nt, Human
ucagaaagcuuuuacuuaaaca

SEQ ID NO: 594556 - RNA, 22 nt, Human
caggccaggcugcauuugcccc

SEQ ID NO: 594557 - RNA, 22 nt, Human
uaagcauauuccagucaugucc

SEQ ID NO: 594558 - RNA, 22 nt, Human
gggcuuggcacaugggcucagc

SEQ ID NO: 594559 - RNA, 22 nt, Human
cagcucuggcuuuggggagcuu

SEQ ID NO: 594560 - RNA, 22 nt, Human
cuugcugugugccaucagggcu

SEQ ID NO: 594561 - RNA, 22 nt, Human
cacccauuaaccaaagagugaa

SEQ ID NO: 594562 - RNA, 22 nt, Human
uuaccuuguaaaacauauuccu

SEQ ID NO: 594563 - RNA, 22 nt, Human
gcagagaagaugcccaggcuuc

SEQ ID NO: 594564 - RNA, 22 nt, Human
gaauaauugugaugcuugaagu

SEQ ID NO: 594565 - RNA, 22 nt, Human
uccaggcagggcagccaucaag

SEQ ID NO: 594566 - RNA, 22 nt, Human
ucagaaucgguggggccaggaa

SEQ ID NO: 594567 - RNA, 22 nt, Human
ucuucuggaugagagcggaggc

SEQ ID NO: 594568 - RNA, 22 nt, Human
aaauggcauagaggugaaggua

SEQ ID NO: 594569 - RNA, 22 nt, Human
cagacaguggacuugauaaagg

SEQ ID NO: 594570 - RNA, 22 nt, Human
cagaaaauaaaguuucuacgca

SEQ ID NO: 594571 - RNA, 22 nt, Human
uggcucagaagaaaagguaaac

SEQ ID NO: 594572 - RNA, 22 nt, Human
ucacugcuuucaaaaauuauug

SEQ ID NO: 594573 - RNA, 22 nt, Human
ucagugauuucuggggugaggg

SEQ ID NO: 594574 - RNA, 22 nt, Human
agcaccaggcaguauaucaaag

SEQ ID NO: 594575 - RNA, 22 nt, Human
uuugucuucccccuuuaaucag

SEQ ID NO: 594576 - RNA, 22 nt, Human
cccagcauuucugggcugcacu

SEQ ID NO: 594577 - RNA, 22 nt, Human
gaauacacgaaggcaagagucc

SEQ ID NO: 594578 - RNA, 22 nt, Human
cucuccagucauauucucaguc

SEQ ID NO: 594579 - RNA, 22 nt, Human
ccaggugucuguggccagcccu

SEQ ID NO: 594580 - RNA, 22 nt, Human
gaaacaaucaucaugugauuug

SEQ ID NO: 594581 - RNA, 18 nt, Human
agcugaggggacugaaga

SEQ ID NO: 594582 - RNA, 22 nt, Human
uaggcuggggguaggaauugag

SEQ ID NO: 594583 - RNA, 22 nt, Human
acagagcaguaagaacacagcu

SEQ ID NO: 594584 - RNA, 22 nt, Human
cugcccacaguucucugccaug

SEQ ID NO: 594585 - RNA, 22 nt, Human
uuucauuacguguuugacuugu

SEQ ID NO: 594586 - RNA, 22 nt, Human
ugcaggugugggcaggggagca

SEQ ID NO: 594587 - RNA, 22 nt, Human
ugcagcuguuacggacccuguc

SEQ ID NO: 594588 - RNA, 22 nt, Human
gaggagaaauuuggggaccuga

SEQ ID NO: 594589 - RNA, 22 nt, Human
uaaauguauaggcacuaaaccu

SEQ ID NO: 594590 - RNA, 22 nt, Human
caaagguuaugaaccacuugua

SEQ ID NO: 594591 - RNA, 23 nt, Human
aaaugucuucuagcucuugagaa

SEQ ID NO: 594592 - RNA, 22 nt, Human
agccaaaacaugugaguuuuga

SEQ ID NO: 594593 - RNA, 22 nt, Human
acuuacaagcuagggaagcuug

SEQ ID NO: 594594 - RNA, 17 nt, Human
cgugagcagcaggugcc

SEQ ID NO: 594595 - RNA, 22 nt, Human
ugccagcacuucuggcugucug

SEQ ID NO: 594596 - RNA, 22 nt, Human
cacugaaaucgaaaaauguagg

SEQ ID NO: 594597 - RNA, 22 nt, Human
uguuuagaucucauucuuccca

SEQ ID NO: 594598 - RNA, 22 nt, Human
cagaggccccauuggcugugcg

SEQ ID NO: 594599 - RNA, 20 nt, Human
ccugggcuccaggagccccg

SEQ ID NO: 594600 - RNA, 22 nt, Human
uuugcuauaaaagggucacacg

SEQ ID NO: 594601 - RNA, 22 nt, Human
gcacagagacaguccugagauc

SEQ ID NO: 594602 - RNA, 23 nt, Human
ugcucccaggugacgcugcuguu

SEQ ID NO: 594603 - RNA, 22 nt, Human
ucagccucagguguucagauuu

SEQ ID NO: 594604 - RNA, 22 nt, Human
gugcugagugcagagugcagag

SEQ ID NO: 594605 - RNA, 22 nt, Human
gugugcagugagcaaaagaucu

SEQ ID NO: 594606 - RNA, 22 nt, Human
aggccuggcuuugguuugcuga

SEQ ID NO: 594607 - RNA, 22 nt, Human
gcauuagaaacuauugcugcaa

SEQ ID NO: 594608 - RNA, 22 nt, Human
acuuuggggaacuuuucuccuc

SEQ ID NO: 594609 - RNA, 22 nt, Human
aaauacuggcaagugcuaauuc

SEQ ID NO: 594610 - RNA, 22 nt, Human
uacaagaaacuacaugaaugca

SEQ ID NO: 594611 - RNA, 22 nt, Human
cagcugcugcccuuggcugcag

SEQ ID NO: 594612 - RNA, 20 nt, Human
augaggccagcagggcucag

SEQ ID NO: 594613 - RNA, 22 nt, Human
caucuuucaguuuauaagucug

SEQ ID NO: 594614 - RNA, 22 nt, Human
aggcaugugacccuggacucag

SEQ ID NO: 594615 - RNA, 22 nt, Human
caccuugagggggaaaauaauc

SEQ ID NO: 594616 - RNA, 22 nt, Human
aaugaugaguucuaauagaccc

SEQ ID NO: 594617 - RNA, 22 nt, Human
agcuguuuuuccagucucugga

SEQ ID NO: 594618 - RNA, 22 nt, Human
uggaacacagugauugauagcg

SEQ ID NO: 594619 - RNA, 22 nt, Human
ggaaggcucuguuccuugacuu

SEQ ID NO: 594620 - RNA, 22 nt, Human
caaugcauacuucgaaauuuca

SEQ ID NO: 594621 - RNA, 22 nt, Human
uaguauaucuuuaguacauagu

SEQ ID NO: 594622 - RNA, 22 nt, Human
ggcacagagaggcccuggaagg

SEQ ID NO: 594623 - RNA, 22 nt, Human
ugucaguggucauaguagaaaa

SEQ ID NO: 594624 - RNA, 22 nt, Human
uacauuaucuuguuaucuuuca

SEQ ID NO: 594625 - RNA, 22 nt, Human
cuacucugaauugaagugauau

SEQ ID NO: 594626 - RNA, 22 nt, Human
ucuguuuuguaccagauacagc

SEQ ID NO: 594627 - RNA, 22 nt, Human
ucugauaaaugccaucuuuuug

SEQ ID NO: 594628 - RNA, 22 nt, Human
auuguauaagucuauuuacaau

SEQ ID NO: 594629 - RNA, 22 nt, Human
cugugugcaacuugcaguuuug

SEQ ID NO: 594630 - RNA, 22 nt, Human
acuguucugccaagaucaacgu

SEQ ID NO: 594631 - RNA, 20 nt, Human
cagugcuuccuccuuucuuu

SEQ ID NO: 594632 - RNA, 22 nt, Human
ucuuuacuggaauggaacuuuc

SEQ ID NO: 594633 - RNA, 20 nt, Human
ugcuccaggaacacuggccg

SEQ ID NO: 594634 - RNA, 22 nt, Human
aguuauuuacuccuuugucucu

SEQ ID NO: 594635 - RNA, 22 nt, Human
agcuucauaauuccuugacuca

SEQ ID NO: 594636 - RNA, 22 nt, Human
uguuucaaaauaacaagagggu

SEQ ID NO: 594637 - RNA, 22 nt, Human
gauacuuucucauuuacccaag

SEQ ID NO: 594638 - RNA, 22 nt, Human
gggucuggacggcugcaggaag

SEQ ID NO: 594639 - RNA, 22 nt, Human
acacagagguggccacucuuuu

SEQ ID NO: 594640 - RNA, 22 nt, Human
uguguucaagauuaguucuagu

SEQ ID NO: 594641 - RNA, 22 nt, Human
auacauguaacugcauuguaau

SEQ ID NO: 594642 - RNA, 22 nt, Human
cuggagcuggcccaggcuggcc

SEQ ID NO: 594643 - RNA, 22 nt, Human
gcuguucagggcacucaugggc

SEQ ID NO: 594644 - RNA, 22 nt, Human
aauaaagaauggaugagaucgu

SEQ ID NO: 594645 - RNA, 22 nt, Human
ccacuaguuuaauaccuuccuu

SEQ ID NO: 594646 - RNA, 22 nt, Human
cucugaaagacaagcucucauu

SEQ ID NO: 594647 - RNA, 22 nt, Human
cagcucugguccagggagggca

SEQ ID NO: 594648 - RNA, 22 nt, Human
cagcccuggcuagggcgagggc

SEQ ID NO: 594649 - RNA, 22 nt, Human
aggggaauggguagacuguuga

SEQ ID NO: 594650 - RNA, 22 nt, Human
ggcagcauuuagagcacagugu

SEQ ID NO: 594651 - RNA, 22 nt, Human
caccagcuaauuaaaacagcag

SEQ ID NO: 594652 - RNA, 22 nt, Human
acagcagcuaaccccugggcca

SEQ ID NO: 594653 - RNA, 22 nt, Human
uccucacagucaacacuuugag

SEQ ID NO: 594654 - RNA, 18 nt, Human
cugccccuucucugagau

SEQ ID NO: 594655 - RNA, 22 nt, Human
cagggagcuggugccagccgac

SEQ ID NO: 594656 - RNA, 22 nt, Human
agcauuaauaagaaauggcucc

SEQ ID NO: 594657 - RNA, 22 nt, Human
ucagccuggugauuccucuguc

SEQ ID NO: 594658 - RNA, 22 nt, Human
augggcugggaucugaguguca

SEQ ID NO: 594659 - RNA, 18 nt, Human
gccugccuagagcuugcc

SEQ ID NO: 594660 - RNA, 22 nt, Human
gugccugugcggacucagggaa

SEQ ID NO: 594661 - RNA, 22 nt, Human
aagauacugaugauguaggcua

SEQ ID NO: 594662 - RNA, 22 nt, Human
uucuguggcaguuugggaggug

SEQ ID NO: 594663 - RNA, 22 nt, Human
auugugcaggucaguuauugca

SEQ ID NO: 594664 - RNA, 22 nt, Human
auugucagcucgaaaugcauca

SEQ ID NO: 594665 - RNA, 22 nt, Human
gccuggggcaugcagcugauac

SEQ ID NO: 594666 - RNA, 22 nt, Human
cagaagagaugaaauaguauua

SEQ ID NO: 594667 - RNA, 22 nt, Human
cccagagggaagggaaugaggu

SEQ ID NO: 594668 - RNA, 22 nt, Human
cuccaugaauuugagcuuugug

SEQ ID NO: 594669 - RNA, 22 nt, Human
ugggaagggccugcccuuccuc

SEQ ID NO: 594670 - RNA, 22 nt, Human
gucuggaguggggccugagaau

SEQ ID NO: 594671 - RNA, 22 nt, Human
gggucuggcaugcugagaugga

SEQ ID NO: 594672 - RNA, 22 nt, Human
uacacugucagauuucgauugc

SEQ ID NO: 594673 - RNA, 22 nt, Human
guggggguggaaaggcaaguug

SEQ ID NO: 594674 - RNA, 22 nt, Human
uacauacagagaugcuaguuaa

SEQ ID NO: 594675 - RNA, 22 nt, Human
ccgggccucgggacaccgggua

SEQ ID NO: 594676 - RNA, 22 nt, Human
ccugccagcccgcguucaugcc

SEQ ID NO: 594677 - RNA, 22 nt, Human
uucaaauuugguaugcaagcca

SEQ ID NO: 594678 - RNA, 22 nt, Human
acagacauuuaauaaaugcuga

SEQ ID NO: 594679 - RNA, 22 nt, Human
gagaggucggggacacugcaaa

SEQ ID NO: 594680 - RNA, 22 nt, Human
ugaggcagggagaguggauaug

SEQ ID NO: 594681 - RNA, 22 nt, Human
uacacauaggucugaauaaaaa

SEQ ID NO: 594682 - RNA, 22 nt, Human
uauucacauguacauaugcuca

SEQ ID NO: 594683 - RNA, 20 nt, Human
agcccaggccugugugaguc

SEQ ID NO: 594684 - RNA, 22 nt, Human
cugcuggggucagagcacuggg

SEQ ID NO: 594685 - RNA, 22 nt, Human
ggggcuuuugcacgugggaggc

SEQ ID NO: 594686 - RNA, 22 nt, Human
ccaaggcagaagauggcucuug

SEQ ID NO: 594687 - RNA, 22 nt, Human
uuaaaugugauuucauuuaugu

SEQ ID NO: 594688 - RNA, 22 nt, Human
cccaggcuccugcuguguugac

SEQ ID NO: 594689 - RNA, 22 nt, Human
ggccucuggucaagacaagcau

SEQ ID NO: 594690 - RNA, 22 nt, Human
gccugagagacccauggggcaa

SEQ ID NO: 594691 - RNA, 22 nt, Human
uggaggcaguuuaagucugaga

SEQ ID NO: 594692 - RNA, 22 nt, Human
uggcugaggcuggagugcagug

SEQ ID NO: 594693 - RNA, 22 nt, Human
ucccucucccuauugccuggag

SEQ ID NO: 594694 - RNA, 22 nt, Human
auugcauuugucauuguugagg

SEQ ID NO: 594695 - RNA, 22 nt, Human
uaauguauaacaaauacucauc

SEQ ID NO: 594696 - RNA, 22 nt, Human
gcccaagagagcgaagguuggc

SEQ ID NO: 594697 - RNA, 17 nt, Human
ggccuguguggcugcag

SEQ ID NO: 594698 - RNA, 18 nt, Human
gggcucacacaggucauc

SEQ ID NO: 594699 - RNA, 22 nt, Human
aggccacaagaaaaugcuucau

SEQ ID NO: 594700 - RNA, 17 nt, Human
uauuagcuagcuuccag

SEQ ID NO: 594701 - RNA, 22 nt, Human
aaagaagguagggcuggugacu

SEQ ID NO: 594702 - RNA, 21 nt, Human
agacagagugcagucuacaua

SEQ ID NO: 594703 - RNA, 20 nt, Human
auaaaauaacugccacaaga

SEQ ID NO: 594704 - RNA, 22 nt, Human
gaggcagcucuucugaaugggg

SEQ ID NO: 594705 - RNA, 17 nt, Human
uggagcugcguguguuc

SEQ ID NO: 594706 - RNA, 18 nt, Human
uccagagcuggugcuucu

SEQ ID NO: 594707 - RNA, 22 nt, Human
cuaaggaaaaggauauauaugu

SEQ ID NO: 594708 - RNA, 22 nt, Human
cucugaaauuggcccucagcag

SEQ ID NO: 594709 - RNA, 22 nt, Human
auuuuucucuuuccacugagau

SEQ ID NO: 594710 - RNA, 22 nt, Human
cuccagggagcugcgggagcca

SEQ ID NO: 594711 - RNA, 22 nt, Human
gagggcugaugcuuacuuauuu

SEQ ID NO: 594712 - RNA, 22 nt, Human
cuuagcaugcaguguucugccc

SEQ ID NO: 594713 - RNA, 22 nt, Human
ucuccuggcauuugguugagua

SEQ ID NO: 594714 - RNA, 22 nt, Human
uagacagugagcuaugaguggu

SEQ ID NO: 594715 - RNA, 22 nt, Human
gggaagagggagcuggaaugau

SEQ ID NO: 594716 - RNA, 22 nt, Human
uccauuuucaucucauguauaa

SEQ ID NO: 594717 - RNA, 22 nt, Human
uucaguaucugcaaaaugggga

SEQ ID NO: 594718 - RNA, 22 nt, Human
ucugagguuauugucugccauu

SEQ ID NO: 594719 - RNA, 22 nt, Human
caugcagugaaauugauaucca

SEQ ID NO: 594720 - RNA, 22 nt, Human
gccugguggugugcucaagugg

SEQ ID NO: 594721 - RNA, 22 nt, Human
uccaucuggugagugaggagcc

SEQ ID NO: 594722 - RNA, 22 nt, Human
uauguucaugcuuaugcagaau

SEQ ID NO: 594723 - RNA, 22 nt, Human
acagccccccgcucaguuucca

SEQ ID NO: 594724 - RNA, 22 nt, Human
ugaggggcagagagguguccag

SEQ ID NO: 594725 - RNA, 22 nt, Human
agugcaauagcaaagaacaaca

SEQ ID NO: 594726 - RNA, 22 nt, Human
ucacagccuggucacucugccc

SEQ ID NO: 594727 - RNA, 22 nt, Human
uuuuaugagugucccucugugg

SEQ ID NO: 594728 - RNA, 22 nt, Human
gcaggggaguggaugauggauu

SEQ ID NO: 594729 - RNA, 21 nt, Human
caccuuauagauaaaauuaga

SEQ ID NO: 594730 - RNA, 22 nt, Human
aagaauaaauuaagauacuuag

SEQ ID NO: 594731 - RNA, 22 nt, Human
cccagcucucucaguucugcuu

SEQ ID NO: 594732 - RNA, 22 nt, Human
aguuccagugugagagaacaug

SEQ ID NO: 594733 - RNA, 22 nt, Human
cccagggcuuuucucacuagac

SEQ ID NO: 594734 - RNA, 22 nt, Human
acauuguucuacuucuaguuag

SEQ ID NO: 594735 - RNA, 22 nt, Human
agccccacacucucucugagaa

SEQ ID NO: 594736 - RNA, 22 nt, Human
uggcagagagacucuccuugau

SEQ ID NO: 594737 - RNA, 22 nt, Human
ggggggugacaaguagagguug

SEQ ID NO: 594738 - RNA, 22 nt, Human
acaguggagcucagaugaaaau

SEQ ID NO: 594739 - RNA, 22 nt, Human
aggcagcagucaugaggaaaga

SEQ ID NO: 594740 - RNA, 22 nt, Human
aggacagcauaugggaaccagu

SEQ ID NO: 594741 - RNA, 17 nt, Human
agcuucugcccuuucuu

SEQ ID NO: 594742 - RNA, 22 nt, Human
gcugaggagcgagaacucugcu

SEQ ID NO: 594743 - RNA, 22 nt, Human
aacaguuucuauguuagugguu

SEQ ID NO: 594744 - RNA, 22 nt, Human
uuacauaaaaguucacguaggc

SEQ ID NO: 594745 - RNA, 22 nt, Human
gucacugccucuuaacuuuuuc

SEQ ID NO: 594746 - RNA, 22 nt, Human
ugagggguugugagaaauguag

SEQ ID NO: 594747 - RNA, 22 nt, Human
cagcucugcuuccuuguacagg

SEQ ID NO: 594748 - RNA, 22 nt, Human
ugaggcucagagcaccugcucc

SEQ ID NO: 594749 - RNA, 22 nt, Human
uuucaaagaguuguaaauuacu

SEQ ID NO: 594750 - RNA, 22 nt, Human
gguggcauucagaagagcuggc

SEQ ID NO: 594751 - RNA, 21 nt, Human
ucauuuauugagaaaugacug

SEQ ID NO: 594752 - RNA, 22 nt, Human
aaacauuagacaccauaugcuc

SEQ ID NO: 594753 - RNA, 22 nt, Human
agcugaggcauggacaggcugc

SEQ ID NO: 594754 - RNA, 22 nt, Human
ccagaagcagagccugaggcag

SEQ ID NO: 594755 - RNA, 22 nt, Human
ggcagagcuuguuccuucuguu

SEQ ID NO: 594756 - RNA, 18 nt, Human
auccugggccagucuuuc

SEQ ID NO: 594757 - RNA, 21 nt, Human
uggcagaguugaguaguuaug

SEQ ID NO: 594758 - RNA, 22 nt, Human
guuguugaucacaugcauaucu

SEQ ID NO: 594759 - RNA, 22 nt, Human
ggucacugagcuguaauucugu

SEQ ID NO: 594760 - RNA, 22 nt, Human
uaacacuguccaaagaauucca

SEQ ID NO: 594761 - RNA, 22 nt, Human
guuuacauguaauguguuauug

SEQ ID NO: 594762 - RNA, 22 nt, Human
acacuuggagcaacacuuaugg

SEQ ID NO: 594763 - RNA, 22 nt, Human
guaguaaagcagguuuugcugu

SEQ ID NO: 594764 - RNA, 22 nt, Human
ugaggugguccaaagacuguuu

SEQ ID NO: 594765 - RNA, 22 nt, Human
uggaaggcaggaccugccuugg

SEQ ID NO: 594766 - RNA, 23 nt, Human
uacauuguggauggaguccuggg

SEQ ID NO: 594767 - RNA, 22 nt, Human
gcuuccugucccucagccauga

SEQ ID NO: 594768 - RNA, 22 nt, Human
gauugucugugaucaugagcaa

SEQ ID NO: 594769 - RNA, 22 nt, Human
ucagcucuacacacaccugugu

SEQ ID NO: 594770 - RNA, 18 nt, Human
uggcaggggcaguacgcc

SEQ ID NO: 594771 - RNA, 22 nt, Human
caugcaguauucaggacaguuc

SEQ ID NO: 594772 - RNA, 22 nt, Human
cagacacuaggugacagagugc

SEQ ID NO: 594773 - RNA, 22 nt, Human
ugaggccaugcccgugccggcc

SEQ ID NO: 594774 - RNA, 22 nt, Human
agcugucugucuccugaggaga

SEQ ID NO: 594775 - RNA, 22 nt, Human
gaacaauagugguaacaaagcc

SEQ ID NO: 594776 - RNA, 22 nt, Human
ucccugggagaugaugaugagg

SEQ ID NO: 594777 - RNA, 22 nt, Human
gugcugagaacaaaaguggaca

SEQ ID NO: 594778 - RNA, 22 nt, Human
uggagagucucaaggcaggaaa

SEQ ID NO: 594779 - RNA, 22 nt, Human
cagauggcugccaagaugggcu

SEQ ID NO: 594780 - RNA, 22 nt, Human
gccagcaaagcaaguugucagc

SEQ ID NO: 594781 - RNA, 22 nt, Human
ugaaggcauaaaucuugggaac

SEQ ID NO: 594782 - RNA, 22 nt, Human
uaguacagagacacuggaggaa

SEQ ID NO: 594783 - RNA, 22 nt, Human
cuuuucuggaaucaucucuaac

SEQ ID NO: 594784 - RNA, 22 nt, Human
uuccagucaaguaagaauaucu

SEQ ID NO: 594785 - RNA, 22 nt, Human
cugagcugguguuucaggguca

SEQ ID NO: 594786 - RNA, 22 nt, Human
uuuauuaagaugcgaaugcuga

SEQ ID NO: 594787 - RNA, 20 nt, Human
cuccaaggcuugcaggaggc

SEQ ID NO: 594788 - RNA, 22 nt, Human
acacacagguaaaggagccugg

SEQ ID NO: 594789 - RNA, 22 nt, Human
cucugggcuuguugaccugcac

SEQ ID NO: 594790 - RNA, 22 nt, Human
cuggguagggcaaggaacuggc

SEQ ID NO: 594791 - RNA, 22 nt, Human
acagagacuaagcuuuucauca

SEQ ID NO: 594792 - RNA, 18 nt, Human
ugcucuggucucacuugg

SEQ ID NO: 594793 - RNA, 22 nt, Human
cacccaggcagguggcugagaa

SEQ ID NO: 594794 - RNA, 23 nt, Human
uguaacaauuucauauacaugca

SEQ ID NO: 594795 - RNA, 22 nt, Human
ucaggcugauuucuuuugaggg

SEQ ID NO: 594796 - RNA, 22 nt, Human
gagaaaccgauucugcauguca

SEQ ID NO: 594797 - RNA, 22 nt, Human
caggccuccacuccacgcagac

SEQ ID NO: 594798 - RNA, 22 nt, Human
ccagggugggguccaggaacca

SEQ ID NO: 594799 - RNA, 22 nt, Human
uacaaugcuguuuguuucuacu

SEQ ID NO: 594800 - RNA, 22 nt, Human
uuaagacaguguauuuguuuuc

SEQ ID NO: 594801 - RNA, 22 nt, Human
cuaaauuaucaugagaauuaug

SEQ ID NO: 594802 - RNA, 22 nt, Human
ugccugggcucaccgccucuuu

SEQ ID NO: 594803 - RNA, 22 nt, Human
acaguguuuuagaaaagcuuga

SEQ ID NO: 594804 - RNA, 22 nt, Human
uuuuuuguuggguagaacggaa

SEQ ID NO: 594805 - RNA, 22 nt, Human
gcuguguaucagaugccacggg

SEQ ID NO: 594806 - RNA, 22 nt, Human
agagcccugcaguucuucagga

SEQ ID NO: 594807 - RNA, 22 nt, Human
aagaaaagaaaccugaggcuuu

SEQ ID NO: 594808 - RNA, 22 nt, Human
ggagaaggcacacccaccucug

SEQ ID NO: 594809 - RNA, 22 nt, Human
ggccagcugcucagugucucug

SEQ ID NO: 594810 - RNA, 22 nt, Human
agugcaggagccuggccagagc

SEQ ID NO: 594811 - RNA, 23 nt, Human
ugggcaucuccucugugccaggc

SEQ ID NO: 594812 - RNA, 23 nt, Human
ucucccugagguuguuagcauua

SEQ ID NO: 594813 - RNA, 22 nt, Human
uucucagaggagucgggagcug

SEQ ID NO: 594814 - RNA, 22 nt, Human
acuggagugaguaucgaugaac

SEQ ID NO: 594815 - RNA, 22 nt, Human
cugcucuguucccccaucaucu

SEQ ID NO: 594816 - RNA, 22 nt, Human
ccaggcuguaaacaccuucaaa

SEQ ID NO: 594817 - RNA, 22 nt, Human
uaaccuacaugagaacuuuaaa

SEQ ID NO: 594818 - RNA, 22 nt, Human
agugggggcuggcucugucugu

SEQ ID NO: 594819 - RNA, 22 nt, Human
uucuauguucuaagucucaagg

SEQ ID NO: 594820 - RNA, 22 nt, Human
gcauugauucugaagugaaaug

SEQ ID NO: 594821 - RNA, 22 nt, Human
aucagaaaggugggcaagcaga

SEQ ID NO: 594822 - RNA, 22 nt, Human
cauguuuucuaggcuuucacaa

SEQ ID NO: 594823 - RNA, 22 nt, Human
uuucacauguggaaugccaggu

SEQ ID NO: 594824 - RNA, 22 nt, Human
aggcaaggugcucuugcucuau

SEQ ID NO: 594825 - RNA, 22 nt, Human
cuguauaaccccaugcgacugu

SEQ ID NO: 594826 - RNA, 22 nt, Human
ggggcugggauuugaacccagg

SEQ ID NO: 594827 - RNA, 22 nt, Human
gaggggcuguggagcucucugg

SEQ ID NO: 594828 - RNA, 22 nt, Human
ccuccagccuuccugaagagcc

SEQ ID NO: 594829 - RNA, 22 nt, Human
ucagaaauacaaaacacuuacu

SEQ ID NO: 594830 - RNA, 22 nt, Human
aaugaugagaacuggaguaauu

SEQ ID NO: 594831 - RNA, 22 nt, Human
uguuuuaugagccauauaaccu

SEQ ID NO: 594832 - RNA, 22 nt, Human
ggcuccucucuggccgcucccg

SEQ ID NO: 594833 - RNA, 22 nt, Human
acagggcucccagcaggucugu

SEQ ID NO: 594834 - RNA, 22 nt, Human
gggaaggcaccaugguguucca

SEQ ID NO: 594835 - RNA, 22 nt, Human
cagacacugcagcagucuccca

SEQ ID NO: 594836 - RNA, 22 nt, Human
uucaacaaacuguucacgaaug

SEQ ID NO: 594837 - RNA, 22 nt, Human
cuucugagcagaccuccugggg

SEQ ID NO: 594838 - RNA, 22 nt, Human
cccagaggcugaguugggagca

SEQ ID NO: 594839 - RNA, 22 nt, Human
ggaggccaauuuucuaacugca

SEQ ID NO: 594840 - RNA, 22 nt, Human
aggcucugagucuggugucugc

SEQ ID NO: 594841 - RNA, 22 nt, Human
acauacauauguuuaaaugcau

SEQ ID NO: 594842 - RNA, 22 nt, Human
ucagaggauagaaauacuuauu

SEQ ID NO: 594843 - RNA, 23 nt, Human
agguucucuuaucaucucugccc

SEQ ID NO: 594844 - RNA, 22 nt, Human
gauaauuuugguuccagguugg

SEQ ID NO: 594845 - RNA, 20 nt, Human
cugagguagggcagaucacc

SEQ ID NO: 594846 - RNA, 22 nt, Human
auacaguauuaccuguucagga

SEQ ID NO: 594847 - RNA, 22 nt, Human
ucuggggagugccuaaguggaa

SEQ ID NO: 594848 - RNA, 22 nt, Human
uccaggagguaugaguggcccc

SEQ ID NO: 594849 - RNA, 22 nt, Human
aggugggcauagcuagaauauu

SEQ ID NO: 594850 - RNA, 22 nt, Human
agaucaguuagauagcuugaug

SEQ ID NO: 594851 - RNA, 22 nt, Human
auauaauuguucugaaguguuu

SEQ ID NO: 594852 - RNA, 22 nt, Human
uuccucuguaugcuuugcugcu

SEQ ID NO: 594853 - RNA, 22 nt, Human
aggcaguggagcuggaauaggc

SEQ ID NO: 594854 - RNA, 22 nt, Human
ugaaaugauaucugauaacaaa

SEQ ID NO: 594855 - RNA, 22 nt, Human
gcucacuuaauuucaugcuaca

SEQ ID NO: 594856 - RNA, 23 nt, Human
uggacaggacccccuucggaccc

SEQ ID NO: 594857 - RNA, 22 nt, Human
ugcccaggcuucacccucagag

SEQ ID NO: 594858 - RNA, 22 nt, Human
guuuccacuugagaggacuccu

SEQ ID NO: 594859 - RNA, 22 nt, Human
acucuuauucccucagaaauau

SEQ ID NO: 594860 - RNA, 22 nt, Human
agguggcagaggacuccuccug

SEQ ID NO: 594861 - RNA, 22 nt, Human
uuaaacacacugagauuuaugu

SEQ ID NO: 594862 - RNA, 22 nt, Human
uuccugaagucaaagaucuaaa

SEQ ID NO: 594863 - RNA, 22 nt, Human
guccuggauugaacauaggcag

SEQ ID NO: 594864 - RNA, 22 nt, Human
aaauuucuaagcagccacuucc

SEQ ID NO: 594865 - RNA, 22 nt, Human
guuuguuuguagggaagccgug

SEQ ID NO: 594866 - RNA, 22 nt, Human
ccugguguugugaaguagccgu

SEQ ID NO: 594867 - RNA, 22 nt, Human
cuacccaggcuuagagggcugg

SEQ ID NO: 594868 - RNA, 22 nt, Human
uacugucuggguucccaagcaa

SEQ ID NO: 594869 - RNA, 16 nt, Human
ucuuccuuuugauuuu

SEQ ID NO: 594870 - RNA, 22 nt, Human
ggaagacagaagccuacagcuu

SEQ ID NO: 594871 - RNA, 20 nt, Human
agcugccccugggcacugcc

SEQ ID NO: 594872 - RNA, 22 nt, Human
accuugaaagcugguuguuagg

SEQ ID NO: 594873 - RNA, 22 nt, Human
cagagggcacucggagugacau

SEQ ID NO: 594874 - RNA, 22 nt, Human
auuaaggaagccuauucucucc

SEQ ID NO: 594875 - RNA, 22 nt, Human
agguuucuuuaugcugcuagaa

SEQ ID NO: 594876 - RNA, 22 nt, Human
gcucugugccagggcugggcca

SEQ ID NO: 594877 - RNA, 22 nt, Human
uggcacugaccccaggccugug

SEQ ID NO: 594878 - RNA, 21 nt, Human
gggcgaggccugauguggcuc

SEQ ID NO: 594879 - RNA, 22 nt, Human
cccuggaggaccccaauguggc

SEQ ID NO: 594880 - RNA, 22 nt, Human
aacacugucagccuuugaugga

SEQ ID NO: 594881 - RNA, 22 nt, Human
cccagagauguccugagugaua

SEQ ID NO: 594882 - RNA, 22 nt, Human
cagcugucuaaguugagcagga

SEQ ID NO: 594883 - RNA, 22 nt, Human
gacauuuauuagaaaacuauca

SEQ ID NO: 594884 - RNA, 17 nt, Human
aggcaccucuuccugcu

SEQ ID NO: 594885 - RNA, 22 nt, Human
agagcugaggauccagcugagc

SEQ ID NO: 594886 - RNA, 22 nt, Human
caguggaggccuugggaccuuu

SEQ ID NO: 594887 - RNA, 22 nt, Human
gcacccagaggucagcagugcu

SEQ ID NO: 594888 - RNA, 22 nt, Human
uucuccuggagugcuuguuggg

SEQ ID NO: 594889 - RNA, 22 nt, Human
acacagaugauguuccaggaac

SEQ ID NO: 594890 - RNA, 22 nt, Human
cauuaaauuccuuguucucaaa

SEQ ID NO: 594891 - RNA, 20 nt, Human
ccagcauguacacaugugga

SEQ ID NO: 594892 - RNA, 22 nt, Human
uuacauuuugggguaaggauaa

SEQ ID NO: 594893 - RNA, 22 nt, Human
gcuaauucacaguaggaaauuu

SEQ ID NO: 594894 - RNA, 22 nt, Human
ucuccaaggagcuccugugccg

SEQ ID NO: 594895 - RNA, 22 nt, Human
gcuuucugccugggcuccauuu

SEQ ID NO: 594896 - RNA, 22 nt, Human
aagugaccucaugguuucuccu

SEQ ID NO: 594897 - RNA, 22 nt, Human
cugucauuuuuuuagaacaccu

SEQ ID NO: 594898 - RNA, 22 nt, Human
acaguggaaagaacauggauuu

SEQ ID NO: 594899 - RNA, 22 nt, Human
cuucuuucuuuugaucacaggu

SEQ ID NO: 594900 - RNA, 22 nt, Human
gccggggcuggggagagacaug

SEQ ID NO: 594901 - RNA, 22 nt, Human
gccuggaggaauguagcugagg

SEQ ID NO: 594902 - RNA, 22 nt, Human
agaaccuuucuuuagaaauuca

SEQ ID NO: 594903 - RNA, 23 nt, Human
aaauuauugcucuucaauugccu

SEQ ID NO: 594904 - RNA, 22 nt, Human
cuuauaguaugauguugagaau

SEQ ID NO: 594905 - RNA, 22 nt, Human
agccagagauugagaugcaggc

SEQ ID NO: 594906 - RNA, 22 nt, Human
uccuggagaaacucagagaucu

SEQ ID NO: 594907 - RNA, 22 nt, Human
guaaauauaaaugcuagcugcc

SEQ ID NO: 594908 - RNA, 22 nt, Human
agaguuuguugaauuuacuugg

SEQ ID NO: 594909 - RNA, 21 nt, Human
acuuggccaggcccccaccug

SEQ ID NO: 594910 - RNA, 22 nt, Human
uucaguauuugaaaccauaggc

SEQ ID NO: 594911 - RNA, 22 nt, Human
agacccugcauuuuccaggguu

SEQ ID NO: 594912 - RNA, 22 nt, Human
uaagaauagucccuagaugugu

SEQ ID NO: 594913 - RNA, 23 nt, Human
ugggccuggccucccaguccagc

SEQ ID NO: 594914 - RNA, 22 nt, Human
agcguguggagaacuaagcaga

SEQ ID NO: 594915 - RNA, 22 nt, Human
cugcaguugacucccuguuugc

SEQ ID NO: 594916 - RNA, 21 nt, Human
auggacaauugagugucuguc

SEQ ID NO: 594917 - RNA, 22 nt, Human
ugcugccuuagcagccaggcaa

SEQ ID NO: 594918 - RNA, 22 nt, Human
gaugggaggaaccugggucccu

SEQ ID NO: 594919 - RNA, 22 nt, Human
gcugugagcacugcugggugga

SEQ ID NO: 594920 - RNA, 22 nt, Human
uugcuuuucccugucucugauu

SEQ ID NO: 594921 - RNA, 18 nt, Human
ucugucucuguccuugcu

SEQ ID NO: 594922 - RNA, 20 nt, Human
agcuggagaagggcccuucc

SEQ ID NO: 594923 - RNA, 22 nt, Human
cugcugcaggaugggcacucug

SEQ ID NO: 594924 - RNA, 22 nt, Human
uauauuaccugccugaucuaua

SEQ ID NO: 594925 - RNA, 22 nt, Human
gaacaaugaaagacauaaacuc

SEQ ID NO: 594926 - RNA, 18 nt, Human
uccugguggagaaguggu

SEQ ID NO: 594927 - RNA, 22 nt, Human
augucucucucugagugccaga

SEQ ID NO: 594928 - RNA, 22 nt, Human
aaauggcaauuuaguuuauuua

SEQ ID NO: 594929 - RNA, 22 nt, Human
uacaagaugacaggugcaugau

SEQ ID NO: 594930 - RNA, 22 nt, Human
ucauuuuuagcgcgcaaaaguu

SEQ ID NO: 594931 - RNA, 22 nt, Human
ccccuggggaucagcuggaauu

SEQ ID NO: 594932 - RNA, 20 nt, Human
aagucccuaagucucuggcc

SEQ ID NO: 594933 - RNA, 22 nt, Human
agagccugaggccaggaaaaug

SEQ ID NO: 594934 - RNA, 22 nt, Human
cucccagggccaucgagucacu

SEQ ID NO: 594935 - RNA, 22 nt, Human
auugugcagcagugguaccugg

SEQ ID NO: 594936 - RNA, 22 nt, Human
gcagcaagaauaauuuggguag

SEQ ID NO: 594937 - RNA, 22 nt, Human
agucuucuugaucuuuucagug

SEQ ID NO: 594938 - RNA, 22 nt, Human
gagaauuugcuggcuucauugu

SEQ ID NO: 594939 - RNA, 22 nt, Human
ggaagcugccaguccaccagcu

SEQ ID NO: 594940 - RNA, 22 nt, Human
cuaauuuucccaaggccuucua

SEQ ID NO: 594941 - RNA, 22 nt, Human
gggacaucuuucuagucagggu

SEQ ID NO: 594942 - RNA, 22 nt, Human
gcugggcagccccuacagagag

SEQ ID NO: 594943 - RNA, 22 nt, Human
uagagcuuggggauuuaguagu

SEQ ID NO: 594944 - RNA, 22 nt, Human
caggcauggagaggcagagacu

SEQ ID NO: 594945 - RNA, 22 nt, Human
aaucuguuugaugcuugugaua

SEQ ID NO: 594946 - RNA, 22 nt, Human
cuccacagccccuccaguggca

SEQ ID NO: 594947 - RNA, 22 nt, Human
uacaugaauuugagucagagga

SEQ ID NO: 594948 - RNA, 20 nt, Human
ugccaggcugcacgccugcc

SEQ ID NO: 594949 - RNA, 23 nt, Human
aauauuccugccauuaaugacuc

SEQ ID NO: 594950 - RNA, 22 nt, Human
cauugcuuaucuaguucacaua

SEQ ID NO: 594951 - RNA, 21 nt, Human
cucuucaguggugagcucuuc

SEQ ID NO: 594952 - RNA, 21 nt, Human
aaagaaaucucccauugguag

SEQ ID NO: 594953 - RNA, 22 nt, Human
cuuguauugcaaacuggccagg

SEQ ID NO: 594954 - RNA, 22 nt, Human
uucuccucagcaaggcagcuuu

SEQ ID NO: 594955 - RNA, 22 nt, Human
guuuucuaccagggaagagagu

SEQ ID NO: 594956 - RNA, 22 nt, Human
uucugagguccaugcaguacug

SEQ ID NO: 594957 - RNA, 22 nt, Human
uacacauauguguguauaugug

SEQ ID NO: 594958 - RNA, 22 nt, Human
uggcuuccugcauggauccucu

SEQ ID NO: 594959 - RNA, 18 nt, Human
aggugcccuccuuacacu

SEQ ID NO: 594960 - RNA, 22 nt, Human
uuacaagaucuuugaaggcaag

SEQ ID NO: 594961 - RNA, 22 nt, Human
uccugagagcagaguccaggug

SEQ ID NO: 594962 - RNA, 22 nt, Human
uuuacuucauuuccagugagga

SEQ ID NO: 594963 - RNA, 21 nt, Human
agagcugguagguagguaggu

SEQ ID NO: 594964 - RNA, 22 nt, Human
agagaugggaaggcagacuuca

SEQ ID NO: 594965 - RNA, 22 nt, Human
ugcugggcccagggagccucug

SEQ ID NO: 594966 - RNA, 22 nt, Human
ucuguccauucagccauccauc

SEQ ID NO: 594967 - RNA, 22 nt, Human
ucaguguuuaccguauguuguu

SEQ ID NO: 594968 - RNA, 22 nt, Human
aggccagcuguuacuagagcca

SEQ ID NO: 594969 - RNA, 22 nt, Human
caucagaauagcucuguggaua

SEQ ID NO: 594970 - RNA, 22 nt, Human
gguggggauuccugaucacugu

SEQ ID NO: 594971 - RNA, 22 nt, Human
uugaaaggaauacagaggccua

SEQ ID NO: 594972 - RNA, 22 nt, Human
ucacaguguuggaaucagagcu

SEQ ID NO: 594973 - RNA, 22 nt, Human
gcaguaaaggugacaauauagg

SEQ ID NO: 594974 - RNA, 22 nt, Human
aauguuuugcauuaguuuucua

SEQ ID NO: 594975 - RNA, 22 nt, Human
ggcugcuguuucagagacuguu

SEQ ID NO: 594976 - RNA, 22 nt, Human
ugacauugguugcaagguacuc

SEQ ID NO: 594977 - RNA, 22 nt, Human
agauacauugaguuuccuccug

SEQ ID NO: 594978 - RNA, 22 nt, Human
uacuguuuccugaagcagaugc

SEQ ID NO: 594979 - RNA, 23 nt, Human
agcugaggugcagauccaaagaa

SEQ ID NO: 594980 - RNA, 22 nt, Human
uggagcugauacagcuggcuuu

SEQ ID NO: 594981 - RNA, 22 nt, Human
aauaucaucucucuuuucugca

SEQ ID NO: 594982 - RNA, 22 nt, Human
agcaggggcuccuccacagcca

SEQ ID NO: 594983 - RNA, 22 nt, Human
uccugggugugauauucauaga

SEQ ID NO: 594984 - RNA, 22 nt, Human
aguguaggguggucagagcaga

SEQ ID NO: 594985 - RNA, 22 nt, Human
auagaauucguguuuguaauuc

SEQ ID NO: 594986 - RNA, 22 nt, Human
uuuuagcacacuuucuuuagcg

SEQ ID NO: 594987 - RNA, 22 nt, Human
uuugaauauacuucaaacaaag

SEQ ID NO: 594988 - RNA, 22 nt, Human
uacaguggggagcucaggagag

SEQ ID NO: 594989 - RNA, 19 nt, Human
ggcuucgaggcuggggaag

SEQ ID NO: 594990 - RNA, 22 nt, Human
cuuuucuagagccgcagcccua

SEQ ID NO: 594991 - RNA, 22 nt, Human
acagaauuaaugaaaauuacaa

SEQ ID NO: 594992 - RNA, 22 nt, Human
uccuggccucacaguccugggu

SEQ ID NO: 594993 - RNA, 22 nt, Human
gaggccuggguuggaggugcau

SEQ ID NO: 594994 - RNA, 22 nt, Human
gcucccagcuggagccucaaca

SEQ ID NO: 594995 - RNA, 22 nt, Human
gagagcccuacaaggcguuuug

SEQ ID NO: 594996 - RNA, 21 nt, Human
acagaugggaugagcacacug

SEQ ID NO: 594997 - RNA, 22 nt, Human
acagugcagugugaugaguauu

SEQ ID NO: 594998 - RNA, 22 nt, Human
auuuucaaaacaucugcugugu

SEQ ID NO: 594999 - RNA, 22 nt, Human
auaauguacaacugcuuuuaau

SEQ ID NO: 595000 - RNA, 22 nt, Human
ugcugcaggccuuggcugggaa

SEQ ID NO: 595001 - RNA, 22 nt, Human
caucauuaccuuguaaccaaua

SEQ ID NO: 595002 - RNA, 22 nt, Human
gaaggcuguggcuggucucagu

SEQ ID NO: 595003 - RNA, 22 nt, Human
gggaagaagacauggugaaggc

SEQ ID NO: 595004 - RNA, 22 nt, Human
acauuucuauagugcaucuguu

SEQ ID NO: 595005 - RNA, 22 nt, Human
ggaaagagggacccagcuuggu

SEQ ID NO: 595006 - RNA, 22 nt, Human
uuaauuaugagaaagggaaaag

SEQ ID NO: 595007 - RNA, 22 nt, Human
gauaugcacauucaaaaauugc

SEQ ID NO: 595008 - RNA, 22 nt, Human
uuccuagaaugguuagaaaaua

SEQ ID NO: 595009 - RNA, 22 nt, Human
ucccugggaccggcagcucaca

SEQ ID NO: 595010 - RNA, 22 nt, Human
ccucagggacuccaugcugcag

SEQ ID NO: 595011 - RNA, 22 nt, Human
uaggaauuaugaugcuaucaag

SEQ ID NO: 595012 - RNA, 22 nt, Human
uccuucaguuaaagaucucaca

SEQ ID NO: 595013 - RNA, 22 nt, Human
aaaccugaaguacguuacauaa

SEQ ID NO: 595014 - RNA, 22 nt, Human
cuggcucucgcugggaguacuu

SEQ ID NO: 595015 - RNA, 22 nt, Human
acagagacugggagcaagaggc

SEQ ID NO: 595016 - RNA, 23 nt, Human
cuacagguuaauuuucaguggaa

SEQ ID NO: 595017 - RNA, 22 nt, Human
ccaggacacugcuucacagcag

SEQ ID NO: 595018 - RNA, 22 nt, Human
caguuucucucaauaagcaucg

SEQ ID NO: 595019 - RNA, 22 nt, Human
ugucccaguuuugcagguuaga

SEQ ID NO: 595020 - RNA, 22 nt, Human
gcugcccuguccggcucuccug

SEQ ID NO: 595021 - RNA, 22 nt, Human
aauagugaacaggaacaugcuu

SEQ ID NO: 595022 - RNA, 22 nt, Human
ggugagugccuggccuggccac

SEQ ID NO: 595023 - RNA, 22 nt, Human
agcagaugggagauggagcugc

SEQ ID NO: 595024 - RNA, 22 nt, Human
ggggaagaaaucuggguucuuc

SEQ ID NO: 595025 - RNA, 22 nt, Human
aaauuccauuaugauaauuucg

SEQ ID NO: 595026 - RNA, 22 nt, Human
ugcggcaggagaagguguuaug

SEQ ID NO: 595027 - RNA, 22 nt, Human
guauacauagaugaugaacaag

SEQ ID NO: 595028 - RNA, 22 nt, Human
acaggcagcgucauugcugcuc

SEQ ID NO: 595029 - RNA, 22 nt, Human
gaugcugauuauuucuugcuag

SEQ ID NO: 595030 - RNA, 18 nt, Human
gagagcccagcagguggu

SEQ ID NO: 595031 - RNA, 22 nt, Human
ucucuggggaaaaggcugauac

SEQ ID NO: 595032 - RNA, 22 nt, Human
ggaugcugggagacagcaggca

SEQ ID NO: 595033 - RNA, 22 nt, Human
uguagaaguaggagucaucuca

SEQ ID NO: 595034 - RNA, 22 nt, Human
ucagagccaaucauggugcauu

SEQ ID NO: 595035 - RNA, 22 nt, Human
augauuuuuucuaacacagucg

SEQ ID NO: 595036 - RNA, 22 nt, Human
gaggagacggggugccuggagc

SEQ ID NO: 595037 - RNA, 22 nt, Human
gccauccucugagcacuaggca

SEQ ID NO: 595038 - RNA, 22 nt, Human
uggaaagguguaaagcagaacc

SEQ ID NO: 595039 - RNA, 23 nt, Human
agcugaggcagaggggcauucuc

SEQ ID NO: 595040 - RNA, 22 nt, Human
auuuuucucucacacuuaccag

SEQ ID NO: 595041 - RNA, 22 nt, Human
ugcagccuuggcaaccagggac

SEQ ID NO: 595042 - RNA, 22 nt, Human
cugggcauuuuucucuguuaca

SEQ ID NO: 595043 - RNA, 22 nt, Human
ugggcucagccuucauguggcc

SEQ ID NO: 595044 - RNA, 22 nt, Human
ugcuucaaguugaaauauucuu

SEQ ID NO: 595045 - RNA, 22 nt, Human
cuugaaaauaagaaagacuuuc

SEQ ID NO: 595046 - RNA, 22 nt, Human
agaaacaucauuggaacacaag

SEQ ID NO: 595047 - RNA, 22 nt, Human
guuuuuguccauggaggcaaac

SEQ ID NO: 595048 - RNA, 22 nt, Human
gaggccacauuacuuggugggu

SEQ ID NO: 595049 - RNA, 22 nt, Human
uccagaguacggaagagucauc

SEQ ID NO: 595050 - RNA, 22 nt, Human
ugcacacacucguguauaugag

SEQ ID NO: 595051 - RNA, 22 nt, Human
cagcuuugaccuaaaguaggaa

SEQ ID NO: 595052 - RNA, 22 nt, Human
acugagaacuugccaaggacug

SEQ ID NO: 595053 - RNA, 22 nt, Human
ugagccaggaguuugaggcugu

SEQ ID NO: 595054 - RNA, 23 nt, Human
agagcuuucuaaaauguaaaucu

SEQ ID NO: 595055 - RNA, 22 nt, Human
acaguguuccuuuguugugacu

SEQ ID NO: 595056 - RNA, 22 nt, Human
cuaaggguugaaacagcaagaa

SEQ ID NO: 595057 - RNA, 21 nt, Human
agcaaaggcaggagagguuuc

SEQ ID NO: 595058 - RNA, 22 nt, Human
uccucugacucacagccugggg

SEQ ID NO: 595059 - RNA, 22 nt, Human
uccugguguccuggucugcuag

SEQ ID NO: 595060 - RNA, 22 nt, Human
aggcugaggcgggaggaucacu

SEQ ID NO: 595061 - RNA, 21 nt, Human
cacaccaggcaugucuugagc

SEQ ID NO: 595062 - RNA, 22 nt, Human
ugguggucauagcagaggccgu

SEQ ID NO: 595063 - RNA, 22 nt, Human
auuuccaccggcucaggaaguu

SEQ ID NO: 595064 - RNA, 22 nt, Human
cagggggcuguggcuguccagu

SEQ ID NO: 595065 - RNA, 22 nt, Human
cagcacaugcucaucagggaag

SEQ ID NO: 595066 - RNA, 22 nt, Human
gugcagggcagguguccuucca

SEQ ID NO: 595067 - RNA, 22 nt, Human
gaacaaacacaucccagcagug

SEQ ID NO: 595068 - RNA, 22 nt, Human
cugcagaugggcgauggggccu

SEQ ID NO: 595069 - RNA, 22 nt, Human
auguaaguuuaagcacaacaag

SEQ ID NO: 595070 - RNA, 22 nt, Human
agcgcgcucuaggacaccgcgg

SEQ ID NO: 595071 - RNA, 22 nt, Human
ugcugcaggcaauagaaaaccu

SEQ ID NO: 595072 - RNA, 22 nt, Human
uuauuauugugguugcauuauc

SEQ ID NO: 595073 - RNA, 22 nt, Human
auucucaaaacauaacuucacu

SEQ ID NO: 595074 - RNA, 18 nt, Human
ucaaaauauuucugugga

SEQ ID NO: 595075 - RNA, 22 nt, Human
cagagagggcggcccuggcuuc

SEQ ID NO: 595076 - RNA, 22 nt, Human
aaaguuuucugccuucauuaga

SEQ ID NO: 595077 - RNA, 22 nt, Human
ugcauauuuguaugauguuuag

SEQ ID NO: 595078 - RNA, 22 nt, Human
gaaauauuucucuugagccccu

SEQ ID NO: 595079 - RNA, 22 nt, Human
ugcauuguuuagaacucuuugg

SEQ ID NO: 595080 - RNA, 22 nt, Human
gcccagcuccauucuuggugag

SEQ ID NO: 595081 - RNA, 22 nt, Human
guggcauggagaaggaggcagu

SEQ ID NO: 595082 - RNA, 22 nt, Human
cuggccucauagccaagcugug

SEQ ID NO: 595083 - RNA, 23 nt, Human
agcauuagagaugccagcccugu

SEQ ID NO: 595084 - RNA, 22 nt, Human
cagcuuggcuuccgcuuuacug

SEQ ID NO: 595085 - RNA, 23 nt, Human
cuccuggugcugcuaucaggggu

SEQ ID NO: 595086 - RNA, 22 nt, Human
uuuuauucaaauaguucacacu

SEQ ID NO: 595087 - RNA, 22 nt, Human
uuuauugacuucagugagucuu

SEQ ID NO: 595088 - RNA, 20 nt, Human
caucaacaccuugucagccu

SEQ ID NO: 595089 - RNA, 22 nt, Human
gcuggagucuggaggugugcca

SEQ ID NO: 595090 - RNA, 20 nt, Human
gcucugggagggaugugaug

SEQ ID NO: 595091 - RNA, 22 nt, Human
gaaagguuuggcuuuucaguag

SEQ ID NO: 595092 - RNA, 22 nt, Human
ucagacaguuugcagugugccu

SEQ ID NO: 595093 - RNA, 22 nt, Human
gcugggagcaaagccaugcaua

SEQ ID NO: 595094 - RNA, 18 nt, Human
uccagggcuuccuccucu

SEQ ID NO: 595095 - RNA, 22 nt, Human
aaaaauuuaugguucuucucug

SEQ ID NO: 595096 - RNA, 21 nt, Human
auuuuguacauagaauuuguc

SEQ ID NO: 595097 - RNA, 22 nt, Human
ccagggcaugggaagaacugaa

SEQ ID NO: 595098 - RNA, 22 nt, Human
agguaggggguuugggaacugc

SEQ ID NO: 595099 - RNA, 22 nt, Human
gggcaggugccagcucccuguc

SEQ ID NO: 595100 - RNA, 22 nt, Human
acagagaaagugggcugaagau

SEQ ID NO: 595101 - RNA, 22 nt, Human
ggcaggcuggcuuuguuccagg

SEQ ID NO: 595102 - RNA, 18 nt, Human
uuuacucauaggccugac

SEQ ID NO: 595103 - RNA, 22 nt, Human
aagcaguguucccagcuggccc

SEQ ID NO: 595104 - RNA, 22 nt, Human
aggcacuggucuaccccuuagu

SEQ ID NO: 595105 - RNA, 22 nt, Human
caagggugguauugggagcaua

SEQ ID NO: 595106 - RNA, 22 nt, Human
auuauuucagucagacacuggc

SEQ ID NO: 595107 - RNA, 22 nt, Human
ucuggagucuggugguuauggu

SEQ ID NO: 595108 - RNA, 22 nt, Human
ggucucugagugaggaccuggg

SEQ ID NO: 595109 - RNA, 22 nt, Human
cuggaagugggguuggcuugaa

SEQ ID NO: 595110 - RNA, 22 nt, Human
gugacaggccacugcggcucug

SEQ ID NO: 595111 - RNA, 22 nt, Human
aaucacuuugcacucuuauuug

SEQ ID NO: 595112 - RNA, 22 nt, Human
gucaguaggaaccuagggucaa

SEQ ID NO: 595113 - RNA, 17 nt, Human
ucuuuccugccaugcuc

SEQ ID NO: 595114 - RNA, 22 nt, Human
cacugugcuccuuccuuagcac

SEQ ID NO: 595115 - RNA, 22 nt, Human
aggcccugcauuguacugaggg

SEQ ID NO: 595116 - RNA, 22 nt, Human
gcagaagcacaggugacgggcc

SEQ ID NO: 595117 - RNA, 22 nt, Human
aaagcacauuacaagcucaguc

SEQ ID NO: 595118 - RNA, 22 nt, Human
uguggggacugaguggaggcuu

SEQ ID NO: 595119 - RNA, 22 nt, Human
aaauguuccauuauuguguaau

SEQ ID NO: 595120 - RNA, 22 nt, Human
acaggcucuggggcaggauggc

SEQ ID NO: 595121 - RNA, 22 nt, Human
agggcagcugugagccacugug

SEQ ID NO: 595122 - RNA, 22 nt, Human
agagaaaagccaucccagccaa

SEQ ID NO: 595123 - RNA, 22 nt, Human
gucuuauuuaaggacaagaaga

SEQ ID NO: 595124 - RNA, 22 nt, Human
ugucacuuggagaagcugaucc

SEQ ID NO: 595125 - RNA, 22 nt, Human
gcagagucaggauuccauccca

SEQ ID NO: 595126 - RNA, 22 nt, Human
cuguccugaaguuuucaugaga

SEQ ID NO: 595127 - RNA, 22 nt, Human
gcauggcauuaacaagauggaa

SEQ ID NO: 595128 - RNA, 20 nt, Human
aaaguguaagcauauaauua

SEQ ID NO: 595129 - RNA, 22 nt, Human
cccagcccugaccuauuggaaa

SEQ ID NO: 595130 - RNA, 22 nt, Human
aggcugccaaagcuucugucuc

SEQ ID NO: 595131 - RNA, 22 nt, Human
uucccagaccuguaggaucaga

SEQ ID NO: 595132 - RNA, 22 nt, Human
gcagcaaucuucacagugucau

SEQ ID NO: 595133 - RNA, 22 nt, Human
cacaaggagguccugaggaagc

SEQ ID NO: 595134 - RNA, 22 nt, Human
uccuggccuuagcgaggcgguc

SEQ ID NO: 595135 - RNA, 22 nt, Human
gcccagccuccaagcuccaagg

SEQ ID NO: 595136 - RNA, 22 nt, Human
ggccugccucacagucagcacc

SEQ ID NO: 595137 - RNA, 22 nt, Human
ggcaggcuguucaccugcuuuu

SEQ ID NO: 595138 - RNA, 21 nt, Human
cucaaaauucuuucuguugga

SEQ ID NO: 595139 - RNA, 22 nt, Human
caggauugagcaaauggauuau

SEQ ID NO: 595140 - RNA, 22 nt, Human
ucagaauaaguuaugaaaugaa

SEQ ID NO: 595141 - RNA, 22 nt, Human
caguggauuagccagagcugga

SEQ ID NO: 595142 - RNA, 22 nt, Human
agucacaugcauuuucuucaau

SEQ ID NO: 595143 - RNA, 22 nt, Human
gggggcaguaaggauauggaaa

SEQ ID NO: 595144 - RNA, 22 nt, Human
uaguggaggguguagcugcugg

SEQ ID NO: 595145 - RNA, 22 nt, Human
cacugcuaugaugaugauauuu

SEQ ID NO: 595146 - RNA, 19 nt, Human
uacuuuuucaggacagagu

SEQ ID NO: 595147 - RNA, 22 nt, Human
auaagacacgccccacucacuc

SEQ ID NO: 595148 - RNA, 22 nt, Human
uuuaaggauguaaaggaagaag

SEQ ID NO: 595149 - RNA, 22 nt, Human
uguauucucucaauauuucaua

SEQ ID NO: 595150 - RNA, 22 nt, Human
ugcauguguuucccagcaagcu

SEQ ID NO: 595151 - RNA, 18 nt, Human
cccucuugcacaaagcaa

SEQ ID NO: 595152 - RNA, 22 nt, Human
auacuaagcucauuacauuuug

SEQ ID NO: 595153 - RNA, 22 nt, Human
ggcagcuggguuggccagaaac

SEQ ID NO: 595154 - RNA, 22 nt, Human
ggcaccaggcugggcauaggcc

SEQ ID NO: 595155 - RNA, 22 nt, Human
cuggucaggggauggggcucag

SEQ ID NO: 595156 - RNA, 22 nt, Human
uccagcucacagauagcguggg

SEQ ID NO: 595157 - RNA, 22 nt, Human
aaagcaauaguaaugguaauag

SEQ ID NO: 595158 - RNA, 22 nt, Human
ucuucagguuaacuugucuuuu

SEQ ID NO: 595159 - RNA, 22 nt, Human
agacaggagagggaacugccgg

SEQ ID NO: 595160 - RNA, 22 nt, Human
augcuucagauuugggguauua

SEQ ID NO: 595161 - RNA, 22 nt, Human
uccuugaacagagggccugggu

SEQ ID NO: 595162 - RNA, 22 nt, Human
uacaaagauaaaaucucaccau

SEQ ID NO: 595163 - RNA, 22 nt, Human
agcuggcaccaaauauaguaaa

SEQ ID NO: 595164 - RNA, 22 nt, Human
uccugccugcaaucccagcacu

SEQ ID NO: 595165 - RNA, 22 nt, Human
agcacagauggauguauucauu

SEQ ID NO: 595166 - RNA, 21 nt, Human
auggccacuauggugcagcag

SEQ ID NO: 595167 - RNA, 22 nt, Human
ucucagaaggguggugcuggag

SEQ ID NO: 595168 - RNA, 22 nt, Human
ccaggcauugugagugggcagg

SEQ ID NO: 595169 - RNA, 22 nt, Human
ugugcccaucccucuggagugu

SEQ ID NO: 595170 - RNA, 22 nt, Human
ugccugucucugacugccauua

SEQ ID NO: 595171 - RNA, 22 nt, Human
auuuaauggguagacauuguua

SEQ ID NO: 595172 - RNA, 22 nt, Human
gcagcuaccacccaggaaggac

SEQ ID NO: 595173 - RNA, 22 nt, Human
ucaagagacaggacguguuuca

SEQ ID NO: 595174 - RNA, 22 nt, Human
cugagaauguuuucugauugau

SEQ ID NO: 595175 - RNA, 22 nt, Human
uggagaauucuauguugagggg

SEQ ID NO: 595176 - RNA, 22 nt, Human
aagcacaugagcuauucaugcu

SEQ ID NO: 595177 - RNA, 22 nt, Human
aggagcugcuuaaaugguuggu

SEQ ID NO: 595178 - RNA, 22 nt, Human
uauaggaaauuuaucuccuggg

SEQ ID NO: 595179 - RNA, 22 nt, Human
aacagaauaguugauguacagu

SEQ ID NO: 595180 - RNA, 19 nt, Human
guuuugcaggcagagggga

SEQ ID NO: 595181 - RNA, 22 nt, Human
cuggaacaaguggccuugcaag

SEQ ID NO: 595182 - RNA, 22 nt, Human
agccacuggccugggcagcucu

SEQ ID NO: 595183 - RNA, 22 nt, Human
cccagagguuccuuagggacca

SEQ ID NO: 595184 - RNA, 19 nt, Human
uaacuuguagauaugaagu

SEQ ID NO: 595185 - RNA, 22 nt, Human
cugcuccuggucauccuccacu

SEQ ID NO: 595186 - RNA, 22 nt, Human
auuuucugaguccagaauuuac

SEQ ID NO: 595187 - RNA, 22 nt, Human
ugggcacuggaagccugcugug

SEQ ID NO: 595188 - RNA, 22 nt, Human
aggugggcccagugggcuccag

SEQ ID NO: 595189 - RNA, 17 nt, Human
augaggucauuaagaua

SEQ ID NO: 595190 - RNA, 22 nt, Human
aaagaacaauguggaaucuccu

SEQ ID NO: 595191 - RNA, 22 nt, Human
uccagaggcuccaaagggagau

SEQ ID NO: 595192 - RNA, 22 nt, Human
acagaauuaacauuugaugaau

SEQ ID NO: 595193 - RNA, 22 nt, Human
gagacaaaaguuggagugcaag

SEQ ID NO: 595194 - RNA, 22 nt, Human
ucuacauuuucacaaggucucc

SEQ ID NO: 595195 - RNA, 22 nt, Human
uuuuugugauaugacacuguau

SEQ ID NO: 595196 - RNA, 22 nt, Human
uauguacuaacuuucauucuag

SEQ ID NO: 595197 - RNA, 22 nt, Human
uaauuuuuccacguacacuggg

SEQ ID NO: 595198 - RNA, 22 nt, Human
cugaggagauccccccagaagu

SEQ ID NO: 595199 - RNA, 22 nt, Human
cauuagcaggcacuaagaaggu

SEQ ID NO: 595200 - RNA, 17 nt, Human
aagacagaagccaugag

SEQ ID NO: 595201 - RNA, 22 nt, Human
ggcuccugaggaccaggcacag

SEQ ID NO: 595202 - RNA, 22 nt, Human
caggugcucugcugcagguaag

SEQ ID NO: 595203 - RNA, 22 nt, Human
cagcuaccaugguuuguuccag

SEQ ID NO: 595204 - RNA, 22 nt, Human
uguuuacauaguagcugcccug

SEQ ID NO: 595205 - RNA, 22 nt, Human
uccacuucuauugggucuuggu

SEQ ID NO: 595206 - RNA, 22 nt, Human
ccucaggcccugucccugcgcc

SEQ ID NO: 595207 - RNA, 22 nt, Human
ugacuugucucuuugggagaca

SEQ ID NO: 595208 - RNA, 22 nt, Human
uuggucagcacugauguuucag

SEQ ID NO: 595209 - RNA, 18 nt, Human
uccagcucugccacuuac

SEQ ID NO: 595210 - RNA, 22 nt, Human
cccugccagaugugcuucaguu

SEQ ID NO: 595211 - RNA, 22 nt, Human
cuauaauuaugcucaaaaugua

SEQ ID NO: 595212 - RNA, 22 nt, Human
uguuacuuaucucacgugaugc

SEQ ID NO: 595213 - RNA, 22 nt, Human
gugcuuuuaauucuggugagua

SEQ ID NO: 595214 - RNA, 22 nt, Human
cuuuucuuauguggacguaccu

SEQ ID NO: 595215 - RNA, 19 nt, Human
aaggcagaaguuggauaug

SEQ ID NO: 595216 - RNA, 22 nt, Human
gcuccccaggcugguccccucg

SEQ ID NO: 595217 - RNA, 22 nt, Human
acuccacaccacgggggccgcc

SEQ ID NO: 595218 - RNA, 21 nt, Human
agcagcagaucuggugagggc

SEQ ID NO: 595219 - RNA, 22 nt, Human
ggagucaccaaguaggagucuu

SEQ ID NO: 595220 - RNA, 22 nt, Human
acuuauuuauucauucagcuca

SEQ ID NO: 595221 - RNA, 22 nt, Human
aaggcaaugacugauuuagaau

SEQ ID NO: 595222 - RNA, 22 nt, Human
cuggguuuagggucuccccuug

SEQ ID NO: 595223 - RNA, 22 nt, Human
ccaucuccaguuuauucuuccu

SEQ ID NO: 595224 - RNA, 22 nt, Human
uauguuuuuaagagaaugcauu

SEQ ID NO: 595225 - RNA, 22 nt, Human
aguuuauuucuccauuuaccua

SEQ ID NO: 595226 - RNA, 22 nt, Human
aguccccuggcaggagggacgu

SEQ ID NO: 595227 - RNA, 23 nt, Human
agggugagcaagcuauggagacc

SEQ ID NO: 595228 - RNA, 22 nt, Human
ugucaaugaagauaugaauaau

SEQ ID NO: 595229 - RNA, 22 nt, Human
ugaggccaaugacccugggcag

SEQ ID NO: 595230 - RNA, 22 nt, Human
ugaaacauaaaguuaucuucag

SEQ ID NO: 595231 - RNA, 22 nt, Human
ugguguggggauaagcacucug

SEQ ID NO: 595232 - RNA, 22 nt, Human
uuguguaaaugucugucuuucu

SEQ ID NO: 595233 - RNA, 22 nt, Human
cgucaucacggcaagcaucucc

SEQ ID NO: 595234 - RNA, 22 nt, Human
uugaggucuggcaguagcguug

SEQ ID NO: 595235 - RNA, 22 nt, Human
cgcugccaggauccccugccgg

SEQ ID NO: 595236 - RNA, 22 nt, Human
uuauugacucccagcuuuucca

SEQ ID NO: 595237 - RNA, 22 nt, Human
aaagguuugaggugggaagagg

SEQ ID NO: 595238 - RNA, 22 nt, Human
ugaggcagaaaauagcaguuca

SEQ ID NO: 595239 - RNA, 22 nt, Human
acauacauggugcuuucuuggu

SEQ ID NO: 595240 - RNA, 22 nt, Human
gaaaagaacugcaugggauuaa

SEQ ID NO: 595241 - RNA, 22 nt, Human
acauuucagaaucacacagcuu

SEQ ID NO: 595242 - RNA, 22 nt, Human
agccccagccccucucucacaa

SEQ ID NO: 595243 - RNA, 22 nt, Human
uauaauuuuaagugguaaauua

SEQ ID NO: 595244 - RNA, 22 nt, Human
gguggcagucuuaagagaucuu

SEQ ID NO: 595245 - RNA, 22 nt, Human
gaggggaguaaagucauguuac

SEQ ID NO: 595246 - RNA, 22 nt, Human
agggaagaagcugguaguaggu

SEQ ID NO: 595247 - RNA, 22 nt, Human
uguuaauuucuuuagaagugga

SEQ ID NO: 595248 - RNA, 22 nt, Human
uuuacacuccuggaaaugauau

SEQ ID NO: 595249 - RNA, 22 nt, Human
cccauucauccucgcuuccuuc

SEQ ID NO: 595250 - RNA, 22 nt, Human
agcagugaguaacacagaccag

SEQ ID NO: 595251 - RNA, 22 nt, Human
aaauuaacuaucacuuuuguga

SEQ ID NO: 595252 - RNA, 22 nt, Human
cuauaaaucuacccagcauugg

SEQ ID NO: 595253 - RNA, 22 nt, Human
cuggcugguuacuauuucuggu

SEQ ID NO: 595254 - RNA, 22 nt, Human
uuccuggaaauuaugcucaccu

SEQ ID NO: 595255 - RNA, 22 nt, Human
auuauggacaucaaauaacucu

SEQ ID NO: 595256 - RNA, 22 nt, Human
gacacaggauuccuggcucugc

SEQ ID NO: 595257 - RNA, 22 nt, Human
uaauccaggguauucuaguuuc

SEQ ID NO: 595258 - RNA, 22 nt, Human
uuucuuguuucauggugucuca

SEQ ID NO: 595259 - RNA, 22 nt, Human
ccuggccagggucugggcugcu

SEQ ID NO: 595260 - RNA, 22 nt, Human
ccauccuggccuugcuguccac

SEQ ID NO: 595261 - RNA, 22 nt, Human
gaacagcuucuugggagcuggg

SEQ ID NO: 595262 - RNA, 22 nt, Human
ccuggugcuuaccagagcuuuu

SEQ ID NO: 595263 - RNA, 22 nt, Human
aaacugagaccgaaagggguag

SEQ ID NO: 595264 - RNA, 22 nt, Human
cuuaggaaauauauacuaaacu

SEQ ID NO: 595265 - RNA, 22 nt, Human
cagcuguuacugaaguaaaaug

SEQ ID NO: 595266 - RNA, 22 nt, Human
ccucacacaguuaucucuucau

SEQ ID NO: 595267 - RNA, 22 nt, Human
aaggcagccucugccagccggg

SEQ ID NO: 595268 - RNA, 22 nt, Human
uuggcucaccugucuacccaga

SEQ ID NO: 595269 - RNA, 22 nt, Human
accugagcaugccaggagagug

SEQ ID NO: 595270 - RNA, 22 nt, Human
cugcuuauggagaugaguaaga

SEQ ID NO: 595271 - RNA, 22 nt, Human
cuuuuguucuacagcuggggaa

SEQ ID NO: 595272 - RNA, 22 nt, Human
uccaggcuggcucuucaaaauu

SEQ ID NO: 595273 - RNA, 22 nt, Human
cuaguucuccugaaauguuugg

SEQ ID NO: 595274 - RNA, 18 nt, Human
gcaaggcucaggccaggc

SEQ ID NO: 595275 - RNA, 22 nt, Human
agguagggaagaaggcaugaaa

SEQ ID NO: 595276 - RNA, 22 nt, Human
cacauguccuggcgcugagccc

SEQ ID NO: 595277 - RNA, 22 nt, Human
ugugaaauguggauguuaauag

SEQ ID NO: 595278 - RNA, 22 nt, Human
cucugggaaagauugugcaggc

SEQ ID NO: 595279 - RNA, 22 nt, Human
auuggagaagaacaugaauuag

SEQ ID NO: 595280 - RNA, 22 nt, Human
caggugggagcgaggagcuacu

SEQ ID NO: 595281 - RNA, 22 nt, Human
cauccugaagaagccgcacugu

SEQ ID NO: 595282 - RNA, 22 nt, Human
uggccagaguccagugagccuu

SEQ ID NO: 595283 - RNA, 19 nt, Human
gggcagaauggcaucucag

SEQ ID NO: 595284 - RNA, 22 nt, Human
caugcuuaauuggagcauucau

SEQ ID NO: 595285 - RNA, 22 nt, Human
cagacaugauguaagcagaggc

SEQ ID NO: 595286 - RNA, 22 nt, Human
aaggcagguauugaugccacag

SEQ ID NO: 595287 - RNA, 22 nt, Human
aggaaaaaccuguuaaugguag

SEQ ID NO: 595288 - RNA, 22 nt, Human
uggcuucuuuguagaaauugaa

SEQ ID NO: 595289 - RNA, 22 nt, Human
cucaguaaggaugcuucagcgg

SEQ ID NO: 595290 - RNA, 22 nt, Human
cagcugaguggacccuagaggc

SEQ ID NO: 595291 - RNA, 21 nt, Human
cagaaguaaggguaacuucuc

SEQ ID NO: 595292 - RNA, 22 nt, Human
uugcauuuugguuguaaauaug

SEQ ID NO: 595293 - RNA, 22 nt, Human
cccagcuugcgggcggcaggag

SEQ ID NO: 595294 - RNA, 22 nt, Human
ucagaacagugccuggcacuaa

SEQ ID NO: 595295 - RNA, 22 nt, Human
cugcuuuaagaaugaguguaag

SEQ ID NO: 595296 - RNA, 19 nt, Human
ucaugucucucaucuguga

SEQ ID NO: 595297 - RNA, 22 nt, Human
gcagggcuggguccugucucau

SEQ ID NO: 595298 - RNA, 22 nt, Human
acauuucucuuagaguuggacu

SEQ ID NO: 595299 - RNA, 22 nt, Human
cugaggccggagcacugaagag

SEQ ID NO: 595300 - RNA, 22 nt, Human
ucagggcacugucaccugauau

SEQ ID NO: 595301 - RNA, 22 nt, Human
uggaugcuauggaguauuuaga

SEQ ID NO: 595302 - RNA, 22 nt, Human
ccucugugggccgggccugcug

SEQ ID NO: 595303 - RNA, 22 nt, Human
aggagcugaagucucugcacuc

SEQ ID NO: 595304 - RNA, 22 nt, Human
gguaaaaaucacaaauacuuua

SEQ ID NO: 595305 - RNA, 22 nt, Human
cagugugccugaaucaaguguu

SEQ ID NO: 595306 - RNA, 22 nt, Human
cugugucccuugucccagagcc

SEQ ID NO: 595307 - RNA, 22 nt, Human
uagggugguuagaaggaguaug

SEQ ID NO: 595308 - RNA, 22 nt, Human
ugaaauguucuggaguuucugu

SEQ ID NO: 595309 - RNA, 20 nt, Human
aaauuacugccacacauuuc

SEQ ID NO: 595310 - RNA, 22 nt, Human
aguggcagaagccaagucugca

SEQ ID NO: 595311 - RNA, 20 nt, Human
uaccacuuauuugaauaauu

SEQ ID NO: 595312 - RNA, 22 nt, Human
gcucucugguuccagucaggaa

SEQ ID NO: 595313 - RNA, 22 nt, Human
gagcaauggaagauagauaaca

SEQ ID NO: 595314 - RNA, 22 nt, Human
ugagaauuacaaaugagucaca

SEQ ID NO: 595315 - RNA, 22 nt, Human
uuugucuuauccaaucucucag

SEQ ID NO: 595316 - RNA, 22 nt, Human
uagggacaaagagcugaggccu

SEQ ID NO: 595317 - RNA, 23 nt, Human
ucucuguacagaugaggacacac

SEQ ID NO: 595318 - RNA, 22 nt, Human
uaaaugagauguacauaacuca

SEQ ID NO: 595319 - RNA, 22 nt, Human
aucuggagugggacacagaaau

SEQ ID NO: 595320 - RNA, 22 nt, Human
uuaagucaauaucaaucucagc

SEQ ID NO: 595321 - RNA, 22 nt, Human
ugggugcuucgucagcucugag

SEQ ID NO: 595322 - RNA, 22 nt, Human
gauucauaccguuucuucucca

SEQ ID NO: 595323 - RNA, 22 nt, Human
uggcugcuuaaaauugcugcaa

SEQ ID NO: 595324 - RNA, 21 nt, Human
agcugcuguggccagaaucca

SEQ ID NO: 595325 - RNA, 22 nt, Human
uaauuauaaacugcaguaggua

SEQ ID NO: 595326 - RNA, 22 nt, Human
augaggcaaagguggagguggg

SEQ ID NO: 595327 - RNA, 22 nt, Human
cuucaugcugauauccucgaug

SEQ ID NO: 595328 - RNA, 22 nt, Human
ugggggaacuguugcgcgcggg

SEQ ID NO: 595329 - RNA, 22 nt, Human
ccugugccauccugagcauccc

SEQ ID NO: 595330 - RNA, 22 nt, Human
ggugggaugccucuggagaagu

SEQ ID NO: 595331 - RNA, 22 nt, Human
uauaguaaaauuuucauuuaug

SEQ ID NO: 595332 - RNA, 20 nt, Human
aggaggccugcagauaguuc

SEQ ID NO: 595333 - RNA, 22 nt, Human
cugccccuggugauggacgcca

SEQ ID NO: 595334 - RNA, 22 nt, Human
auuucaguguuuuaagaguuca

SEQ ID NO: 595335 - RNA, 22 nt, Human
acaggcuguugggguccagggu

SEQ ID NO: 595336 - RNA, 22 nt, Human
agagggcaaguguaguccagua

SEQ ID NO: 595337 - RNA, 22 nt, Human
aucagaaguugugcaugcaugg

SEQ ID NO: 595338 - RNA, 22 nt, Human
ugaaccagagucuccagugguu

SEQ ID NO: 595339 - RNA, 22 nt, Human
cacugaguucccugacauuuca

SEQ ID NO: 595340 - RNA, 22 nt, Human
ucaugcaagaauaauaggaagg

SEQ ID NO: 595341 - RNA, 22 nt, Human
agaguuuguauuuuucagugaa

SEQ ID NO: 595342 - RNA, 22 nt, Human
uuauggaauacuuaugcugcag

SEQ ID NO: 595343 - RNA, 22 nt, Human
cgaugggggcaguguuacauug

SEQ ID NO: 595344 - RNA, 22 nt, Human
gauuugucuauauucaaauaug

SEQ ID NO: 595345 - RNA, 22 nt, Human
uucaaaauuguucuaagcucug

SEQ ID NO: 595346 - RNA, 22 nt, Human
ugaagccaaggaugccuuucuc

SEQ ID NO: 595347 - RNA, 22 nt, Human
cugccuccaggcucaccuugac

SEQ ID NO: 595348 - RNA, 22 nt, Human
ggcaugaguggcagugggcagu

SEQ ID NO: 595349 - RNA, 22 nt, Human
cuccucccacggucucaggaag

SEQ ID NO: 595350 - RNA, 19 nt, Human
uuuauucaccuuuaccuug

SEQ ID NO: 595351 - RNA, 22 nt, Human
gcagccucugaugauggccgua

SEQ ID NO: 595352 - RNA, 22 nt, Human
agcucuccaucuaucugugaug

SEQ ID NO: 595353 - RNA, 22 nt, Human
ucugggcucuuaguguacccuc

SEQ ID NO: 595354 - RNA, 22 nt, Human
uguuacauuggaguuguuuaga

SEQ ID NO: 595355 - RNA, 22 nt, Human
uagcagaaccagucagugagcc

SEQ ID NO: 595356 - RNA, 22 nt, Human
ucuccugggaggacaaggaagg

SEQ ID NO: 595357 - RNA, 22 nt, Human
gaaaggagaggguuaaggagcu

SEQ ID NO: 595358 - RNA, 22 nt, Human
agcaggggcaggguuuugugcu

SEQ ID NO: 595359 - RNA, 16 nt, Human
uucucugggguugugc

SEQ ID NO: 595360 - RNA, 19 nt, Human
caggaacauggagggaggg

SEQ ID NO: 595361 - RNA, 22 nt, Human
ccucugcccuuuuccuguauca

SEQ ID NO: 595362 - RNA, 22 nt, Human
uuccugaugcacacagucauuu

SEQ ID NO: 595363 - RNA, 22 nt, Human
uugaagacacagacauauagag

SEQ ID NO: 595364 - RNA, 22 nt, Human
ggacuggacucucaggcucaca

SEQ ID NO: 595365 - RNA, 22 nt, Human
ucuguccuccacacuguaaguu

SEQ ID NO: 595366 - RNA, 22 nt, Human
ucauuucuccgaccugcugucc

SEQ ID NO: 595367 - RNA, 22 nt, Human
uauggaaaguguuuucuucugu

SEQ ID NO: 595368 - RNA, 22 nt, Human
ugcagcccuuccuuccucuggg

SEQ ID NO: 595369 - RNA, 18 nt, Human
guuuugaauugucuuaca

SEQ ID NO: 595370 - RNA, 22 nt, Human
ugggagcaguucagguguggcu

SEQ ID NO: 595371 - RNA, 22 nt, Human
aauuagaagggaguuauugaua

SEQ ID NO: 595372 - RNA, 22 nt, Human
guggaaggaauuaacagacuag

SEQ ID NO: 595373 - RNA, 22 nt, Human
agcuuccuguugagagagggag

SEQ ID NO: 595374 - RNA, 22 nt, Human
agucacagaaacccaggugugg

SEQ ID NO: 595375 - RNA, 22 nt, Human
augucugagucugcuccaguug

SEQ ID NO: 595376 - RNA, 22 nt, Human
uacaauagggcuuuuguuuaug

SEQ ID NO: 595377 - RNA, 22 nt, Human
ucugaaauuccuuccagacuuu

SEQ ID NO: 595378 - RNA, 22 nt, Human
cacugcaaccuccagcucucag

SEQ ID NO: 595379 - RNA, 17 nt, Human
accaccucucaccagca

SEQ ID NO: 595380 - RNA, 22 nt, Human
ugguggcugcucccugccuuga

SEQ ID NO: 595381 - RNA, 22 nt, Human
gcugaagagagaugcguccagc

SEQ ID NO: 595382 - RNA, 19 nt, Human
agccagaacuaguguuucu

SEQ ID NO: 595383 - RNA, 22 nt, Human
uauugcagacaaaaugagcuac

SEQ ID NO: 595384 - RNA, 22 nt, Human
gaccuucaguguguuucucaca

SEQ ID NO: 595385 - RNA, 22 nt, Human
uugcagaugaagaaagugguag

SEQ ID NO: 595386 - RNA, 22 nt, Human
cagcuuugaaacauggcucuag

SEQ ID NO: 595387 - RNA, 22 nt, Human
agcugggcugaugacucauguu

SEQ ID NO: 595388 - RNA, 22 nt, Human
ugugaaauugaaugcccauugc

SEQ ID NO: 595389 - RNA, 22 nt, Human
agcagagcagaaugugaaggug

SEQ ID NO: 595390 - RNA, 22 nt, Human
aucauucagucucugggacagu

SEQ ID NO: 595391 - RNA, 22 nt, Human
ucccugagacucuggaguguaa

SEQ ID NO: 595392 - RNA, 22 nt, Human
cuagggagacucgcaggacuca

SEQ ID NO: 595393 - RNA, 22 nt, Human
auaauuaucucagacacuuguu

SEQ ID NO: 595394 - RNA, 22 nt, Human
ucuucuguggcucucaccaccc

SEQ ID NO: 595395 - RNA, 22 nt, Human
uggaccaugagcugcagguguu

SEQ ID NO: 595396 - RNA, 22 nt, Human
cugacucagcagcugaugaucc

SEQ ID NO: 595397 - RNA, 22 nt, Human
uaaagacaauuucgagcuguag

SEQ ID NO: 595398 - RNA, 22 nt, Human
guuguuuuauaggcucaugccu

SEQ ID NO: 595399 - RNA, 22 nt, Human
uuuucuuggaguggcuguccuu

SEQ ID NO: 595400 - RNA, 21 nt, Human
guguuggcauauggugguuga

SEQ ID NO: 595401 - RNA, 22 nt, Human
ccaguggcuacagggggguuga

SEQ ID NO: 595402 - RNA, 22 nt, Human
gcaguguuaccucuucaguggg

SEQ ID NO: 595403 - RNA, 22 nt, Human
accuuauuuugaaauagauugu

SEQ ID NO: 595404 - RNA, 22 nt, Human
aaagcagagcagggcacuuaug

SEQ ID NO: 595405 - RNA, 22 nt, Human
uccugggugaaagaacaggcag

SEQ ID NO: 595406 - RNA, 22 nt, Human
gcuuagaaagugauugauacau

SEQ ID NO: 595407 - RNA, 22 nt, Human
ggaggcugcugccucacguggg

SEQ ID NO: 595408 - RNA, 21 nt, Human
aggucccagguuugggcagca

SEQ ID NO: 595409 - RNA, 22 nt, Human
acuuccagcugcccugugugcu

SEQ ID NO: 595410 - RNA, 22 nt, Human
uccuuaggcaauuugggagagu

SEQ ID NO: 595411 - RNA, 22 nt, Human
caggaaauggcugaauaaauuc

SEQ ID NO: 595412 - RNA, 22 nt, Human
ugccugcccugaaaacugccca

SEQ ID NO: 595413 - RNA, 22 nt, Human
acagagauguggaugagggauu

SEQ ID NO: 595414 - RNA, 20 nt, Human
ccagucccugagcaccaggg

SEQ ID NO: 595415 - RNA, 22 nt, Human
ugggaagcugcauuuuaacaag

SEQ ID NO: 595416 - RNA, 22 nt, Human
aauuaagaaaauguuuuaugau

SEQ ID NO: 595417 - RNA, 22 nt, Human
accagagggagacuuccucuuc

SEQ ID NO: 595418 - RNA, 22 nt, Human
gaggaugguaugaggcaagcaa

SEQ ID NO: 595419 - RNA, 22 nt, Human
gaccucagugaauggucaugua

SEQ ID NO: 595420 - RNA, 22 nt, Human
uggaaagcaguucuuagaaucg

SEQ ID NO: 595421 - RNA, 22 nt, Human
ccugggcucuauccugacccag

SEQ ID NO: 595422 - RNA, 22 nt, Human
gauguagagggaagauuuuaaa

SEQ ID NO: 595423 - RNA, 22 nt, Human
agcagcaccuguccucgcugcu

SEQ ID NO: 595424 - RNA, 22 nt, Human
uccaggcuggacaugaggcggg

SEQ ID NO: 595425 - RNA, 20 nt, Human
cccaggaguuugcucuuacu

SEQ ID NO: 595426 - RNA, 22 nt, Human
acugcccuguaacugccaggua

SEQ ID NO: 595427 - RNA, 22 nt, Human
aggccuggguguucaccagaag

SEQ ID NO: 595428 - RNA, 22 nt, Human
ugggccuccugcccuggccuag

SEQ ID NO: 595429 - RNA, 22 nt, Human
gcugccugcucggcuccuggga

SEQ ID NO: 595430 - RNA, 21 nt, Human
ucaagacagcauauuuaagaa

SEQ ID NO: 595431 - RNA, 22 nt, Human
aaagacuacacgggaaagagcu

SEQ ID NO: 595432 - RNA, 22 nt, Human
acugccacguuccaggcuuagc

SEQ ID NO: 595433 - RNA, 22 nt, Human
aguaaacaguaucuuuaguguc

SEQ ID NO: 595434 - RNA, 22 nt, Human
caaguuuuagaaauaucuggau

SEQ ID NO: 595435 - RNA, 22 nt, Human
ugcacacauuaaggauacacag

SEQ ID NO: 595436 - RNA, 22 nt, Human
agcugugucauccuggaaaaug

SEQ ID NO: 595437 - RNA, 22 nt, Human
cugguggagagugggcucugga

SEQ ID NO: 595438 - RNA, 19 nt, Human
uguagcaguuuaaaacaac

SEQ ID NO: 595439 - RNA, 22 nt, Human
aggcaccugagguggccagccu

SEQ ID NO: 595440 - RNA, 22 nt, Human
ccugaccacccuuggacaaggu

SEQ ID NO: 595441 - RNA, 22 nt, Human
auuuccuucaucagccuauccu

SEQ ID NO: 595442 - RNA, 22 nt, Human
cagaccaguagggcucauccca

SEQ ID NO: 595443 - RNA, 22 nt, Human
ccugggaguggcacucacagca

SEQ ID NO: 595444 - RNA, 22 nt, Human
aaaugaugcucacagauuagug

SEQ ID NO: 595445 - RNA, 22 nt, Human
cuucucuucccagggacacagg

SEQ ID NO: 595446 - RNA, 22 nt, Human
ucucagggaguugaggcugccu

SEQ ID NO: 595447 - RNA, 22 nt, Human
ucccuucuggcagcagugugag

SEQ ID NO: 595448 - RNA, 22 nt, Human
ugcugaauucuaccauccauuu

SEQ ID NO: 595449 - RNA, 22 nt, Human
aggcuguguuuaagugguaaug

SEQ ID NO: 595450 - RNA, 22 nt, Human
ugaguaucaauuacauaguugu

SEQ ID NO: 595451 - RNA, 22 nt, Human
auguuauggcucaaacauuugg

SEQ ID NO: 595452 - RNA, 22 nt, Human
uucuaguguccuuggacuugcu

SEQ ID NO: 595453 - RNA, 22 nt, Human
agccacagugggcuaccagcuc

SEQ ID NO: 595454 - RNA, 22 nt, Human
ugagguagguaccauuaucacu

SEQ ID NO: 595455 - RNA, 22 nt, Human
auacacacaaucagguuuugua

SEQ ID NO: 595456 - RNA, 22 nt, Human
cuggcccccacaccugucaggg

SEQ ID NO: 595457 - RNA, 22 nt, Human
ugggcagaaaucaguaucagau

SEQ ID NO: 595458 - RNA, 22 nt, Human
gagcccagggugaaauagcagc

SEQ ID NO: 595459 - RNA, 22 nt, Human
ucugcccacagccuccugucca

SEQ ID NO: 595460 - RNA, 22 nt, Human
agauuucacaugcugcucuauu

SEQ ID NO: 595461 - RNA, 22 nt, Human
ccagguggaaggucugugcucu

SEQ ID NO: 595462 - RNA, 23 nt, Human
ugagcagcuaaaggugaugcggg

SEQ ID NO: 595463 - RNA, 23 nt, Human
agguccuggacauaugugcauca

SEQ ID NO: 595464 - RNA, 22 nt, Human
cugagcccauugggugcuguua

SEQ ID NO: 595465 - RNA, 22 nt, Human
uaaagucaucuuuacaucuuug

SEQ ID NO: 595466 - RNA, 22 nt, Human
ggguggagagaaagaaacguga

SEQ ID NO: 595467 - RNA, 22 nt, Human
uuuuaauuuuagcccuucuggu

SEQ ID NO: 595468 - RNA, 18 nt, Human
gagguagauaagauuuuc

SEQ ID NO: 595469 - RNA, 22 nt, Human
uuucaguucuguacaaguccag

SEQ ID NO: 595470 - RNA, 22 nt, Human
ugagcuggaggacaggagggua

SEQ ID NO: 595471 - RNA, 22 nt, Human
cuaguucuagaucccugaggaa

SEQ ID NO: 595472 - RNA, 22 nt, Human
ugggaugagaagugcgaggguu

SEQ ID NO: 595473 - RNA, 22 nt, Human
guaaauuauuucaagaucaucu

SEQ ID NO: 595474 - RNA, 21 nt, Human
uucucuccauaugcccagccc

SEQ ID NO: 595475 - RNA, 22 nt, Human
ugggggugguucuugccuccag

SEQ ID NO: 595476 - RNA, 22 nt, Human
ugugacuuuucacaggcugguc

SEQ ID NO: 595477 - RNA, 21 nt, Human
cacugcagccuugaccugggc

SEQ ID NO: 595478 - RNA, 22 nt, Human
caucucuccacggcagcucucg

SEQ ID NO: 595479 - RNA, 22 nt, Human
gcaguggggaaugcuggggaga

SEQ ID NO: 595480 - RNA, 22 nt, Human
ucagugugauuaggcuaucuga

SEQ ID NO: 595481 - RNA, 22 nt, Human
aagugguguguuggaagaaauc

SEQ ID NO: 595482 - RNA, 21 nt, Human
ggcaugagggcagugagcaga

SEQ ID NO: 595483 - RNA, 22 nt, Human
caggacagacagaaugccuaac

SEQ ID NO: 595484 - RNA, 22 nt, Human
uuucauugaacuaaagaaucug

SEQ ID NO: 595485 - RNA, 22 nt, Human
auagugauugaaaacauucugu

SEQ ID NO: 595486 - RNA, 22 nt, Human
uaucaucacuguaauccguuga

SEQ ID NO: 595487 - RNA, 22 nt, Human
uaaaacuuugaaggugcucagu

SEQ ID NO: 595488 - RNA, 22 nt, Human
agagcuggcugguagcccugau

SEQ ID NO: 595489 - RNA, 22 nt, Human
uguagaaaauuggagcauucau

SEQ ID NO: 595490 - RNA, 19 nt, Human
cuggaaugagaacaugccc

SEQ ID NO: 595491 - RNA, 22 nt, Human
ucagggaaugaugcacacaguu

SEQ ID NO: 595492 - RNA, 22 nt, Human
aaccuuugaggggagcucuuuc

SEQ ID NO: 595493 - RNA, 22 nt, Human
cuucuacacaucccucuugcuu

SEQ ID NO: 595494 - RNA, 22 nt, Human
gggcccagcccucugcucacug

SEQ ID NO: 595495 - RNA, 17 nt, Human
aauugucagcaguagcu

SEQ ID NO: 595496 - RNA, 22 nt, Human
cuggcugcuuguagacucgacu

SEQ ID NO: 595497 - RNA, 21 nt, Human
cuguggaagggaacuagaggg

SEQ ID NO: 595498 - RNA, 22 nt, Human
uguacacaaugauaaauuauua

SEQ ID NO: 595499 - RNA, 22 nt, Human
aaaugcacacaccaggaaacua

SEQ ID NO: 595500 - RNA, 22 nt, Human
cugcagaaagcugagaugauua

SEQ ID NO: 595501 - RNA, 22 nt, Human
uuucuugaaguccuaacccuca

SEQ ID NO: 595502 - RNA, 18 nt, Human
gcacucugacugcagagc

SEQ ID NO: 595503 - RNA, 22 nt, Human
gagaacacuaaugguuucuuaa

SEQ ID NO: 595504 - RNA, 22 nt, Human
ggagaagggacagacucagcuu

SEQ ID NO: 595505 - RNA, 22 nt, Human
cauagcgguauuccacgugguu

SEQ ID NO: 595506 - RNA, 20 nt, Human
uuggccaaaucuuagucaug

SEQ ID NO: 595507 - RNA, 23 nt, Human
agggcugaugccauugcagcucu

SEQ ID NO: 595508 - RNA, 22 nt, Human
ugcagaaccaguccucagaccc

SEQ ID NO: 595509 - RNA, 22 nt, Human
ucauaaugaccccagaguccgc

SEQ ID NO: 595510 - RNA, 22 nt, Human
ggccuggacaccugaggucuua

SEQ ID NO: 595511 - RNA, 22 nt, Human
uaucuagauggauuuuagugaa

SEQ ID NO: 595512 - RNA, 22 nt, Human
ccagcuggugggucuuucucug

SEQ ID NO: 595513 - RNA, 22 nt, Human
gaguccuucuggcuggcaggau

SEQ ID NO: 595514 - RNA, 22 nt, Human
aacaucuuugauaaacuuagug

SEQ ID NO: 595515 - RNA, 23 nt, Human
cagugcagggcaacucagacucc

SEQ ID NO: 595516 - RNA, 22 nt, Human
ggcugcccucgucuacugccca

SEQ ID NO: 595517 - RNA, 22 nt, Human
agcucccaggcagucaugagga

SEQ ID NO: 595518 - RNA, 17 nt, Human
uggcuucccugggccac

SEQ ID NO: 595519 - RNA, 22 nt, Human
gggggcuguccugugcauugua

SEQ ID NO: 595520 - RNA, 22 nt, Human
acaguggaagcaugaugcuauc

SEQ ID NO: 595521 - RNA, 22 nt, Human
ugggccaggugcagugcuuuag

SEQ ID NO: 595522 - RNA, 21 nt, Human
aggaggaacccguggcugggc

SEQ ID NO: 595523 - RNA, 20 nt, Human
gcuugcuuugucugaugggc

SEQ ID NO: 595524 - RNA, 22 nt, Human
agucuggccuugccuugucgag

SEQ ID NO: 595525 - RNA, 22 nt, Human
uuucaaagaccauuaacuauca

SEQ ID NO: 595526 - RNA, 18 nt, Human
gucacagcagagaacugc

SEQ ID NO: 595527 - RNA, 21 nt, Human
uuuaugcagauaaugcuauuu

SEQ ID NO: 595528 - RNA, 22 nt, Human
ugccucaggcaccuggcagguu

SEQ ID NO: 595529 - RNA, 22 nt, Human
gaauguuagagauucuuagguu

SEQ ID NO: 595530 - RNA, 22 nt, Human
agugucuuugucucucaagcac

SEQ ID NO: 595531 - RNA, 22 nt, Human
gagcaaugcccuucaccagccc

SEQ ID NO: 595532 - RNA, 22 nt, Human
cugagcuuccaguuccuccagg

SEQ ID NO: 595533 - RNA, 22 nt, Human
ugaaagaguuugacaugauucu

SEQ ID NO: 595534 - RNA, 20 nt, Human
guccugggagccacagcaca

SEQ ID NO: 595535 - RNA, 22 nt, Human
aggggccauuguucugcccgcu

SEQ ID NO: 595536 - RNA, 22 nt, Human
guaacaaaggauaacuugguuu

SEQ ID NO: 595537 - RNA, 22 nt, Human
gcucuguguccacagcuggaaa

SEQ ID NO: 595538 - RNA, 22 nt, Human
augagguacuaguauauacgua

SEQ ID NO: 595539 - RNA, 21 nt, Human
aguggggucucuguggaggcc

SEQ ID NO: 595540 - RNA, 22 nt, Human
ucugggauuuuugacacugaag

SEQ ID NO: 595541 - RNA, 22 nt, Human
cucuggcugucccgaugagcag

SEQ ID NO: 595542 - RNA, 22 nt, Human
uccaccagcuucuucaccagcu

SEQ ID NO: 595543 - RNA, 22 nt, Human
caguauuuguucccuaucaaug

SEQ ID NO: 595544 - RNA, 22 nt, Human
ccugccugaaggucagccaccc

SEQ ID NO: 595545 - RNA, 22 nt, Human
guccucugagggggcugcacgc

SEQ ID NO: 595546 - RNA, 22 nt, Human
agugacuggugugaaguuaaau

SEQ ID NO: 595547 - RNA, 22 nt, Human
gaaagaaucaacuaugucucug

SEQ ID NO: 595548 - RNA, 22 nt, Human
gugcaauaaauaaauagauugu

SEQ ID NO: 595549 - RNA, 22 nt, Human
ugggcaagucacuucugucuuu

SEQ ID NO: 595550 - RNA, 22 nt, Human
ugugccugaguuggcugaguac

SEQ ID NO: 595551 - RNA, 17 nt, Human
cugaggcccagggccca

SEQ ID NO: 595552 - RNA, 22 nt, Human
ugguaagaacccaucagagaag

SEQ ID NO: 595553 - RNA, 22 nt, Human
caggcacuuugcugggggcgca

SEQ ID NO: 595554 - RNA, 22 nt, Human
cucagggaggccucugcugguu

SEQ ID NO: 595555 - RNA, 22 nt, Human
aggucacaggcuuugaaaucaa

SEQ ID NO: 595556 - RNA, 22 nt, Human
uaaugucuguguuucagugcag

SEQ ID NO: 595557 - RNA, 19 nt, Human
aaaugugaugguacaauuc

SEQ ID NO: 595558 - RNA, 22 nt, Human
gacacagaguauuuuaaguacu

SEQ ID NO: 595559 - RNA, 22 nt, Human
uaaaagacauauaacuguagga

SEQ ID NO: 595560 - RNA, 22 nt, Human
acucugccccgaguucugggaa

SEQ ID NO: 595561 - RNA, 22 nt, Human
auuguucaaagugcuuugcaug

SEQ ID NO: 595562 - RNA, 20 nt, Human
cagcccuugauuuacaaucc

SEQ ID NO: 595563 - RNA, 22 nt, Human
gagaggcuugugugaagaacaa

SEQ ID NO: 595564 - RNA, 23 nt, Human
uuucuguuggguauauauccaag

SEQ ID NO: 595565 - RNA, 19 nt, Human
gagguggguccccgcagcc

SEQ ID NO: 595566 - RNA, 22 nt, Human
acauugcaauuagguaccuaug

SEQ ID NO: 595567 - RNA, 22 nt, Human
auagaauaugacuuuuagaucc

SEQ ID NO: 595568 - RNA, 22 nt, Human
cugcacaguggacagugaagau

SEQ ID NO: 595569 - RNA, 22 nt, Human
cuguaaaacugcuuaaguaugc

SEQ ID NO: 595570 - RNA, 20 nt, Human
ccagaggcugacagacuuug

SEQ ID NO: 595571 - RNA, 22 nt, Human
uccagggccuuaccucuucaga

SEQ ID NO: 595572 - RNA, 22 nt, Human
guggccagucccgaugcuuguu

SEQ ID NO: 595573 - RNA, 19 nt, Human
caucacauggucugaugaa

SEQ ID NO: 595574 - RNA, 20 nt, Human
auguccucagccacugcccu

SEQ ID NO: 595575 - RNA, 22 nt, Human
uuacagaugggguugcaauaaa

SEQ ID NO: 595576 - RNA, 22 nt, Human
ugcagguaaauuuguggaggau

SEQ ID NO: 595577 - RNA, 22 nt, Human
cagcugcccaagccccagaugu

SEQ ID NO: 595578 - RNA, 22 nt, Human
ggccaggcgaugaccccuccac

SEQ ID NO: 595579 - RNA, 22 nt, Human
ugcagguacuugacaacuuggg

SEQ ID NO: 595580 - RNA, 22 nt, Human
ucauaaauugauuaugugcuuu

SEQ ID NO: 595581 - RNA, 22 nt, Human
ccagucuguucucaccucugag

SEQ ID NO: 595582 - RNA, 22 nt, Human
agaucaagcacugugcaaaaau

SEQ ID NO: 595583 - RNA, 22 nt, Human
gugaagcagggaaggaaaggau

SEQ ID NO: 595584 - RNA, 21 nt, Human
uccuccuggccaggcggcccc

SEQ ID NO: 595585 - RNA, 22 nt, Human
gugcuuccucugccaacacucu

SEQ ID NO: 595586 - RNA, 22 nt, Human
gucuccagggacacacuagccg

SEQ ID NO: 595587 - RNA, 22 nt, Human
gccuggagcucggcugagggcg

SEQ ID NO: 595588 - RNA, 22 nt, Human
aaugcuuuagcagugauuagug

SEQ ID NO: 595589 - RNA, 22 nt, Human
ugagcuuacgugggaacagacu

SEQ ID NO: 595590 - RNA, 22 nt, Human
cugaggaagagguaccauuugu

SEQ ID NO: 595591 - RNA, 22 nt, Human
cuuggaacaaauuaaacaauac

SEQ ID NO: 595592 - RNA, 22 nt, Human
aggcucuuugagacuaccugga

SEQ ID NO: 595593 - RNA, 22 nt, Human
ucagugucacaggaugcuaugc

SEQ ID NO: 595594 - RNA, 19 nt, Human
caagauuuguucacacaug

SEQ ID NO: 595595 - RNA, 22 nt, Human
uccugggaaguggcuggcugag

SEQ ID NO: 595596 - RNA, 22 nt, Human
uuaauuacaaaacacauagguu

SEQ ID NO: 595597 - RNA, 22 nt, Human
ccauuucauugccuguaaagug

SEQ ID NO: 595598 - RNA, 22 nt, Human
aauuuggugucuuaguuucccu

SEQ ID NO: 595599 - RNA, 22 nt, Human
gugaacaucagauuacaugaga

SEQ ID NO: 595600 - RNA, 22 nt, Human
uaccaggucugugcagguguca

SEQ ID NO: 595601 - RNA, 22 nt, Human
ugguaggagggaaaugcggguu

SEQ ID NO: 595602 - RNA, 22 nt, Human
auuguuuuguuucccagugacu

SEQ ID NO: 595603 - RNA, 22 nt, Human
aauaauacaugagauuaauguu

SEQ ID NO: 595604 - RNA, 22 nt, Human
ccaguucuuucugugugcaaca

SEQ ID NO: 595605 - RNA, 22 nt, Human
uucugccugauguagucauacc

SEQ ID NO: 595606 - RNA, 22 nt, Human
ggaggcuugaugaucuuggaua

SEQ ID NO: 595607 - RNA, 22 nt, Human
cugcccuguaucuucucccaau

SEQ ID NO: 595608 - RNA, 22 nt, Human
cugggcccugaagacagucagg

SEQ ID NO: 595609 - RNA, 22 nt, Human
gagaagaacuugggcaaaguca

SEQ ID NO: 595610 - RNA, 22 nt, Human
acugggaagagagaauucuguc

SEQ ID NO: 595611 - RNA, 22 nt, Human
ccaggugccuccagucacagug

SEQ ID NO: 595612 - RNA, 22 nt, Human
ucugauaagacagcugauuuga

SEQ ID NO: 595613 - RNA, 22 nt, Human
agagauggagagcacuggggcu

SEQ ID NO: 595614 - RNA, 22 nt, Human
acagaggccccgugggagagcc

SEQ ID NO: 595615 - RNA, 22 nt, Human
aagcaccugcaguugacaaaaa

SEQ ID NO: 595616 - RNA, 22 nt, Human
ugcuuuaaaguauuucucgcaa

SEQ ID NO: 595617 - RNA, 22 nt, Human
ucucugggagcaauuguuugcu

SEQ ID NO: 595618 - RNA, 22 nt, Human
gccuguccuggaugcucugcaa

SEQ ID NO: 595619 - RNA, 22 nt, Human
agcagggcuggggcacgagcca

SEQ ID NO: 595620 - RNA, 22 nt, Human
ccucucucagcuugcugcaacu

SEQ ID NO: 595621 - RNA, 22 nt, Human
aaauagcagccuuuaguuaaca

SEQ ID NO: 595622 - RNA, 23 nt, Human
uccaggcugggacuucaacuggc

SEQ ID NO: 595623 - RNA, 22 nt, Human
gcccaggauggagaauaguggu

SEQ ID NO: 595624 - RNA, 21 nt, Human
ggcugcagggagcccuggggu

SEQ ID NO: 595625 - RNA, 22 nt, Human
gaagagcuaaaggcacaggcuu

SEQ ID NO: 595626 - RNA, 22 nt, Human
gagcuuaggccagggacaggga

SEQ ID NO: 595627 - RNA, 22 nt, Human
aaugcaaacuucuuguuacuug

SEQ ID NO: 595628 - RNA, 22 nt, Human
ggagggggaagaagcuaaagac

SEQ ID NO: 595629 - RNA, 19 nt, Human
gaggcgaggcgugcaggag

SEQ ID NO: 595630 - RNA, 22 nt, Human
gacccuggagccgucugaggca

SEQ ID NO: 595631 - RNA, 20 nt, Human
cucucuccaucucaguggcc

SEQ ID NO: 595632 - RNA, 22 nt, Human
ucagaagagcuggugcugccug

SEQ ID NO: 595633 - RNA, 17 nt, Human
aggugcagaggcagagc

SEQ ID NO: 595634 - RNA, 22 nt, Human
ugggcacagagucccaucugcc

SEQ ID NO: 595635 - RNA, 22 nt, Human
guggcugcagcggcuguggaga

SEQ ID NO: 595636 - RNA, 22 nt, Human
agccugagcugccugccgccuc

SEQ ID NO: 595637 - RNA, 22 nt, Human
gcugaagcugcagcaggaggaa

SEQ ID NO: 595638 - RNA, 22 nt, Human
uagcuaguguuuggagauggau

SEQ ID NO: 595639 - RNA, 22 nt, Human
ugagaagauugggcagagugga

SEQ ID NO: 595640 - RNA, 22 nt, Human
ucagcuggagaugagaaccgaa

SEQ ID NO: 595641 - RNA, 17 nt, Human
cucagagcaggacagaa

SEQ ID NO: 595642 - RNA, 22 nt, Human
guuacauuacuugugcaguugu

SEQ ID NO: 595643 - RNA, 22 nt, Human
guuagcaugacuuagaaucagg

SEQ ID NO: 595644 - RNA, 22 nt, Human
cuggagcuaggaaguccaagau

SEQ ID NO: 595645 - RNA, 22 nt, Human
ccacucccuuccgguccagggc

SEQ ID NO: 595646 - RNA, 22 nt, Human
ucaucugaccacuuuaucucuc

SEQ ID NO: 595647 - RNA, 22 nt, Human
uggcuucugcuuucaguggagg

SEQ ID NO: 595648 - RNA, 19 nt, Human
gaguccugugcuccuuguu

SEQ ID NO: 595649 - RNA, 22 nt, Human
gagcagaacuacucacauaucg

SEQ ID NO: 595650 - RNA, 22 nt, Human
agaucuuuagugaagcuaaauc

SEQ ID NO: 595651 - RNA, 22 nt, Human
cuuuaugaaggaacaaugcucc

SEQ ID NO: 595652 - RNA, 19 nt, Human
ccauggcaaugaucugaug

SEQ ID NO: 595653 - RNA, 22 nt, Human
cuacaguagagaggauguagaa

SEQ ID NO: 595654 - RNA, 22 nt, Human
guucucucaaacuuuguguuug

SEQ ID NO: 595655 - RNA, 22 nt, Human
aaaucagagaauauauuuagaa

SEQ ID NO: 595656 - RNA, 22 nt, Human
ggcugagggccagggcuagucu

SEQ ID NO: 595657 - RNA, 22 nt, Human
aacuucagagcugugugguuug

SEQ ID NO: 595658 - RNA, 22 nt, Human
ugcagaagaaaacagcugugug

SEQ ID NO: 595659 - RNA, 22 nt, Human
auuuaagauugcguauucaugu

SEQ ID NO: 595660 - RNA, 22 nt, Human
gaaauuuacaacuuucucaugg

SEQ ID NO: 595661 - RNA, 22 nt, Human
ggucugagcuugagcccaugcu

SEQ ID NO: 595662 - RNA, 22 nt, Human
ggagccagugcccucuggugga

SEQ ID NO: 595663 - RNA, 22 nt, Human
aaaucucagcccuuauuuuaga

SEQ ID NO: 595664 - RNA, 22 nt, Human
uccaguucuaggucacucucug

SEQ ID NO: 595665 - RNA, 22 nt, Human
cagguggccaguacucaaggau

SEQ ID NO: 595666 - RNA, 22 nt, Human
uuuuaugugcuggacuggcagu

SEQ ID NO: 595667 - RNA, 22 nt, Human
gggcauggugagggauaugaag

SEQ ID NO: 595668 - RNA, 22 nt, Human
ucccaggcugggggccugaagu

SEQ ID NO: 595669 - RNA, 22 nt, Human
cagcagcuucuguugaucagaa

SEQ ID NO: 595670 - RNA, 22 nt, Human
cugaggcuggggaagggaagug

SEQ ID NO: 595671 - RNA, 22 nt, Human
uucccuggcaugaguguaagau

SEQ ID NO: 595672 - RNA, 22 nt, Human
agaggggcccgguucuccgucu

SEQ ID NO: 595673 - RNA, 22 nt, Human
aaggccaguggauaaaaccucu

SEQ ID NO: 595674 - RNA, 22 nt, Human
uucuacaugguugcucagaggg

SEQ ID NO: 595675 - RNA, 22 nt, Human
ggcuaggcaggcucagagccua

SEQ ID NO: 595676 - RNA, 22 nt, Human
ucccugcagccccugagccuuc

SEQ ID NO: 595677 - RNA, 22 nt, Human
uguggggacccaugccaugggc

SEQ ID NO: 595678 - RNA, 22 nt, Human
ucuggaugaaagggcuauauau

SEQ ID NO: 595679 - RNA, 22 nt, Human
ccuggcaggcaagaggaaggga

SEQ ID NO: 595680 - RNA, 21 nt, Human
ugaaugaucugguugccuuuu

SEQ ID NO: 595681 - RNA, 22 nt, Human
agcaguaagacuuuuuucugug

SEQ ID NO: 595682 - RNA, 22 nt, Human
auuuccacauaagggaaauaag

SEQ ID NO: 595683 - RNA, 22 nt, Human
ggagccagagggaugcaguuga

SEQ ID NO: 595684 - RNA, 20 nt, Human
gcugaggggucuauggcaua

SEQ ID NO: 595685 - RNA, 22 nt, Human
uccuggggcucugagcgagaca

SEQ ID NO: 595686 - RNA, 22 nt, Human
aaaaagacuuccaacucaggag

SEQ ID NO: 595687 - RNA, 22 nt, Human
ggaggaguguggggcacucugc

SEQ ID NO: 595688 - RNA, 22 nt, Human
augaagauuuauaauugccuuu

SEQ ID NO: 595689 - RNA, 22 nt, Human
gcugccuccugaaagcgcucug

SEQ ID NO: 595690 - RNA, 22 nt, Human
aguaacagagcauggguucaga

SEQ ID NO: 595691 - RNA, 22 nt, Human
gacaaugcauugugauugugac

SEQ ID NO: 595692 - RNA, 22 nt, Human
gggcuaggcuuggccagcacug

SEQ ID NO: 595693 - RNA, 23 nt, Human
uuuaccagaauagcaggggagag

SEQ ID NO: 595694 - RNA, 23 nt, Human
agagggugcaacauggggaucua

SEQ ID NO: 595695 - RNA, 22 nt, Human
uaauucuucaggccuuuugucu

SEQ ID NO: 595696 - RNA, 22 nt, Human
ugaagcaguuacuggguguuaa

SEQ ID NO: 595697 - RNA, 19 nt, Human
cuggcuucaagcaguccuc

SEQ ID NO: 595698 - RNA, 22 nt, Human
ucuuuauaaaagucauuauguc

SEQ ID NO: 595699 - RNA, 22 nt, Human
uccaugagggacacuggaugcu

SEQ ID NO: 595700 - RNA, 22 nt, Human
ucaacugguucuugaauguaua

SEQ ID NO: 595701 - RNA, 22 nt, Human
gguucuccuugagugucccagg

SEQ ID NO: 595702 - RNA, 19 nt, Human
uucucauuccuuuccacuu

SEQ ID NO: 595703 - RNA, 22 nt, Human
aaugggaagccagaagacaagg

SEQ ID NO: 595704 - RNA, 22 nt, Human
uugaagagucuagauugguuau

SEQ ID NO: 595705 - RNA, 22 nt, Human
uacaaaggaggugcauagaaca

SEQ ID NO: 595706 - RNA, 22 nt, Human
uugcagggaccugcagaaagcu

SEQ ID NO: 595707 - RNA, 21 nt, Human
ggccucugucauccugggaag

SEQ ID NO: 595708 - RNA, 22 nt, Human
uuuauuaauguagcauccaugg

SEQ ID NO: 595709 - RNA, 22 nt, Human
ugucaaguuguuaaguucuggg

SEQ ID NO: 595710 - RNA, 22 nt, Human
gaagaacugacaaacuagauca

SEQ ID NO: 595711 - RNA, 20 nt, Human
ggccuuggaauagcacagcu

SEQ ID NO: 595712 - RNA, 20 nt, Human
gcuccaggucagagaggacg

SEQ ID NO: 595713 - RNA, 22 nt, Human
cagaggaagagauacaagcccu

SEQ ID NO: 595714 - RNA, 22 nt, Human
ggacauuucauaagaccauucu

SEQ ID NO: 595715 - RNA, 22 nt, Human
uggcccugcccucuucaucuuu

SEQ ID NO: 595716 - RNA, 20 nt, Human
gcugaggauuccuggccccu

SEQ ID NO: 595717 - RNA, 22 nt, Human
ucagccucucugaguccagacc

SEQ ID NO: 595718 - RNA, 22 nt, Human
ucugauguugugacaucacuuc

SEQ ID NO: 595719 - RNA, 22 nt, Human
ccugggugucaugggcagcugg

SEQ ID NO: 595720 - RNA, 22 nt, Human
uaggaagccuaaauuaaguggu

SEQ ID NO: 595721 - RNA, 22 nt, Human
uuauugucaaaaacaggacacu

SEQ ID NO: 595722 - RNA, 22 nt, Human
cagcagagcuuauuaacuaaaa

SEQ ID NO: 595723 - RNA, 22 nt, Human
auucuuggcccguccucacgca

SEQ ID NO: 595724 - RNA, 22 nt, Human
ccugaggucuagagucagggug

SEQ ID NO: 595725 - RNA, 22 nt, Human
ucuccagggacugaggcuggag

SEQ ID NO: 595726 - RNA, 22 nt, Human
ugggccucuguuuccucaucug

SEQ ID NO: 595727 - RNA, 22 nt, Human
ucacucagguucaugucuuugu

SEQ ID NO: 595728 - RNA, 18 nt, Human
uguagagccagguuugcc

SEQ ID NO: 595729 - RNA, 22 nt, Human
augacaaaagaagacaugaggu

SEQ ID NO: 595730 - RNA, 22 nt, Human
ucucugugugggagaucuuuuu

SEQ ID NO: 595731 - RNA, 22 nt, Human
uggacaggugcacacagcagcc

SEQ ID NO: 595732 - RNA, 22 nt, Human
aauguucagugccuuuaaacau

SEQ ID NO: 595733 - RNA, 22 nt, Human
uugaaaguuaggauuuagcugg

SEQ ID NO: 595734 - RNA, 22 nt, Human
cucuuauuuuauggcauuugug

SEQ ID NO: 595735 - RNA, 22 nt, Human
ucucucauagagaaaaauauau

SEQ ID NO: 595736 - RNA, 22 nt, Human
cagucucucuuguagugcagcu

SEQ ID NO: 595737 - RNA, 22 nt, Human
aggacagggauucaaacuccca

SEQ ID NO: 595738 - RNA, 22 nt, Human
aaugucauuuaggauuauguuu

SEQ ID NO: 595739 - RNA, 21 nt, Human
ugcaggcugugcgcuccugcc

SEQ ID NO: 595740 - RNA, 23 nt, Human
ugccagggcccugugugcaaugc

SEQ ID NO: 595741 - RNA, 22 nt, Human
gacugggccaaggucagcagcu

SEQ ID NO: 595742 - RNA, 22 nt, Human
ugacaauggggcacauggaaag

SEQ ID NO: 595743 - RNA, 22 nt, Human
agccagcuaccggggcuccugg

SEQ ID NO: 595744 - RNA, 22 nt, Human
uugcagggcaggaccauggaca

SEQ ID NO: 595745 - RNA, 22 nt, Human
cagagcagugaggaguugugua

SEQ ID NO: 595746 - RNA, 22 nt, Human
gugacauuucgugacgugagaa

SEQ ID NO: 595747 - RNA, 22 nt, Human
aggugccaauuuucagugaaca

SEQ ID NO: 595748 - RNA, 22 nt, Human
augggcugaggugggauagaag

SEQ ID NO: 595749 - RNA, 22 nt, Human
gcaaagaaugcagauuugccuc

SEQ ID NO: 595750 - RNA, 22 nt, Human
uuuuuaccuggaggauaaaugu

SEQ ID NO: 595751 - RNA, 22 nt, Human
aauaaauguuuguuggauguuu

SEQ ID NO: 595752 - RNA, 22 nt, Human
cugccuccuggcugauggguag

SEQ ID NO: 595753 - RNA, 19 nt, Human
cuuugcaggggauggguga

SEQ ID NO: 595754 - RNA, 22 nt, Human
cagggcuggguuaaaagcaggg

SEQ ID NO: 595755 - RNA, 22 nt, Human
aauuauggaauuuuuagagaag

SEQ ID NO: 595756 - RNA, 22 nt, Human
uuuuaugaagauaauuuucuga

SEQ ID NO: 595757 - RNA, 22 nt, Human
uucauaugcagauuaacaaaua

SEQ ID NO: 595758 - RNA, 18 nt, Human
agcuguuguugacucugu

SEQ ID NO: 595759 - RNA, 22 nt, Human
acugcagccuuugggcucauaa

SEQ ID NO: 595760 - RNA, 22 nt, Human
caguuucuuaucuucaaaauug

SEQ ID NO: 595761 - RNA, 17 nt, Human
gcaggcacugcugccug

SEQ ID NO: 595762 - RNA, 22 nt, Human
guuuccuauaacucaggcacca

SEQ ID NO: 595763 - RNA, 20 nt, Human
gguagcagcugcugucaucc

SEQ ID NO: 595764 - RNA, 22 nt, Human
auuagaaugacagaaaugaggc

SEQ ID NO: 595765 - RNA, 22 nt, Human
uuccccugucacagugguucuc

SEQ ID NO: 595766 - RNA, 21 nt, Human
guggcccugguguggcugcac

SEQ ID NO: 595767 - RNA, 21 nt, Human
ggcuccugcuuugugaggggc

SEQ ID NO: 595768 - RNA, 22 nt, Human
agggcugacacaccuuauccuc

SEQ ID NO: 595769 - RNA, 22 nt, Human
ugcccauguuucucuguauccc

SEQ ID NO: 595770 - RNA, 22 nt, Human
auaaaaaggacagauguggucu

SEQ ID NO: 595771 - RNA, 22 nt, Human
uccaagagaauacuggagagua

SEQ ID NO: 595772 - RNA, 22 nt, Human
caaaggcaacauauacuuguuu

SEQ ID NO: 595773 - RNA, 22 nt, Human
agagguggccaugggcgcugga

SEQ ID NO: 595774 - RNA, 22 nt, Human
auugugcaaauauuaucuguag

SEQ ID NO: 595775 - RNA, 22 nt, Human
gcugucucaugggugcuagucc

SEQ ID NO: 595776 - RNA, 22 nt, Human
augcaguuagcaguagcucccc

SEQ ID NO: 595777 - RNA, 22 nt, Human
ugaaagguuauuuaggucugcu

SEQ ID NO: 595778 - RNA, 22 nt, Human
cagcucagacgcaggucgagca

SEQ ID NO: 595779 - RNA, 22 nt, Human
ccauccugcauugcuauucaga

SEQ ID NO: 595780 - RNA, 22 nt, Human
ucuggaguaugugugaacggug

SEQ ID NO: 595781 - RNA, 22 nt, Human
uuauuugauuaguaaaccugua

SEQ ID NO: 595782 - RNA, 22 nt, Human
auggaagguccuacagagcgca

SEQ ID NO: 595783 - RNA, 22 nt, Human
cuucaggauuaauuuggggccu

SEQ ID NO: 595784 - RNA, 22 nt, Human
ugauguuuaauacuaugcuuuu

SEQ ID NO: 595785 - RNA, 21 nt, Human
uuacuaaacaaaacaugcagg

SEQ ID NO: 595786 - RNA, 22 nt, Human
aaagguuuucuaggguugaggg

SEQ ID NO: 595787 - RNA, 22 nt, Human
ggggcagcuaccggaaguaggg

SEQ ID NO: 595788 - RNA, 22 nt, Human
cagaauaaagguacaauugagu

SEQ ID NO: 595789 - RNA, 22 nt, Human
cugagggugcuauucuugccuu

SEQ ID NO: 595790 - RNA, 22 nt, Human
acauucuugaagugaaguuuau

SEQ ID NO: 595791 - RNA, 22 nt, Human
auuagcuuugguggaaaggagu

SEQ ID NO: 595792 - RNA, 15 nt, Human
cccaggaguucgaga

SEQ ID NO: 595793 - RNA, 22 nt, Human
uugauacaggccuucuagauga

SEQ ID NO: 595794 - RNA, 22 nt, Human
caucuuuaauuugugacaacua

SEQ ID NO: 595795 - RNA, 20 nt, Human
agauggguuaaagcuauggg

SEQ ID NO: 595796 - RNA, 22 nt, Human
uuugcuuaaaguucuuucuggu

SEQ ID NO: 595797 - RNA, 22 nt, Human
caguaacauuucaagguagagg

SEQ ID NO: 595798 - RNA, 22 nt, Human
gaaagaggaaggagauguauua

SEQ ID NO: 595799 - RNA, 22 nt, Human
ggccugaggcgucccagcugug

SEQ ID NO: 595800 - RNA, 22 nt, Human
uucugugaaucuuuuuucccac

SEQ ID NO: 595801 - RNA, 22 nt, Human
agucugaguaucucugagccag

SEQ ID NO: 595802 - RNA, 19 nt, Human
guggcucauguagugggcc

SEQ ID NO: 595803 - RNA, 22 nt, Human
auuauuguacuuucaauaaggu

SEQ ID NO: 595804 - RNA, 22 nt, Human
aagcuuugggcagaagaggauu

SEQ ID NO: 595805 - RNA, 22 nt, Human
aaaguccuuuuugccaugcaag

SEQ ID NO: 595806 - RNA, 22 nt, Human
acuuucucccacccacccgucu

SEQ ID NO: 595807 - RNA, 22 nt, Human
ucuucuuccucauuuauacaua

SEQ ID NO: 595808 - RNA, 22 nt, Human
gacaacugccccauuuuaaaug

SEQ ID NO: 595809 - RNA, 22 nt, Human
augcaagauguauagaagacuu

SEQ ID NO: 595810 - RNA, 22 nt, Human
ucugggcaugucugugaacacg

SEQ ID NO: 595811 - RNA, 21 nt, Human
gcuggcuuccugagggcugag

SEQ ID NO: 595812 - RNA, 22 nt, Human
cuccugucccggggaccgccga

SEQ ID NO: 595813 - RNA, 20 nt, Human
guuuuucuugggcgagcuau

SEQ ID NO: 595814 - RNA, 22 nt, Human
ccaggcacuuguuugccaggca

SEQ ID NO: 595815 - RNA, 22 nt, Human
uucucagagugaccaagucuuu

SEQ ID NO: 595816 - RNA, 22 nt, Human
ucuuuagugaccaucucauucu

SEQ ID NO: 595817 - RNA, 22 nt, Human
gauuuucauuauagcuaguuuc

SEQ ID NO: 595818 - RNA, 22 nt, Human
cuugauauuuuaaacauacagu

SEQ ID NO: 595819 - RNA, 22 nt, Human
ccagaacacaguggaagaauau

SEQ ID NO: 595820 - RNA, 22 nt, Human
acacagugugugcagucggacg

SEQ ID NO: 595821 - RNA, 22 nt, Human
uucuuauuuuccugaggaagaa

SEQ ID NO: 595822 - RNA, 20 nt, Human
cugaaaggagucgggauguc

SEQ ID NO: 595823 - RNA, 22 nt, Human
gccagccacuucagcuauggcu

SEQ ID NO: 595824 - RNA, 22 nt, Human
gugaacuauuggguaucauaaa

SEQ ID NO: 595825 - RNA, 18 nt, Human
uuccuucugauguauaug

SEQ ID NO: 595826 - RNA, 22 nt, Human
caugcauguuuacuacagugac

SEQ ID NO: 595827 - RNA, 22 nt, Human
uuuauucuagcucagaauaguu

SEQ ID NO: 595828 - RNA, 22 nt, Human
gagagaagggggauaugagccu

SEQ ID NO: 595829 - RNA, 22 nt, Human
agcucaggucauuccagggaug

SEQ ID NO: 595830 - RNA, 21 nt, Human
uuggaauuugggagcuaugug

SEQ ID NO: 595831 - RNA, 22 nt, Human
ggccugugucugugccuguccu

SEQ ID NO: 595832 - RNA, 22 nt, Human
uacaaucaggauaauaauagug

SEQ ID NO: 595833 - RNA, 19 nt, Human
uucuggacagcagaaacca

SEQ ID NO: 595834 - RNA, 22 nt, Human
guaguaaagcggaaagggugau

SEQ ID NO: 595835 - RNA, 22 nt, Human
gcagggcuuagaaaugguggcu

SEQ ID NO: 595836 - RNA, 22 nt, Human
gcuggccaaaguguaccuggag

SEQ ID NO: 595837 - RNA, 22 nt, Human
ucuuacaagaaauaagccaaug

SEQ ID NO: 595838 - RNA, 22 nt, Human
cagagcccauggcacaugugga

SEQ ID NO: 595839 - RNA, 22 nt, Human
uugcaguugcauaugccccuac

SEQ ID NO: 595840 - RNA, 22 nt, Human
agggcccacaguuccuauggcc

SEQ ID NO: 595841 - RNA, 22 nt, Human
cuucuccuuauaugucccguuc

SEQ ID NO: 595842 - RNA, 22 nt, Human
gugagguccucccugcugggag

SEQ ID NO: 595843 - RNA, 22 nt, Human
ggcaacaacuggacauagcugg

SEQ ID NO: 595844 - RNA, 22 nt, Human
uagagaaauaagcuuugccuug

SEQ ID NO: 595845 - RNA, 22 nt, Human
caguggguaggaaaggcucuuc

SEQ ID NO: 595846 - RNA, 22 nt, Human
ggucucuguuuggggcuggcaa

SEQ ID NO: 595847 - RNA, 22 nt, Human
ucagcacuuugaagcagaagga

SEQ ID NO: 595848 - RNA, 22 nt, Human
ggcagcaaggccucgggugagc

SEQ ID NO: 595849 - RNA, 22 nt, Human
cugccagcagaggccagcgcug

SEQ ID NO: 595850 - RNA, 22 nt, Human
auguacugacuguacuuuuaaa

SEQ ID NO: 595851 - RNA, 22 nt, Human
aguaaggcauuuuucauguuua

SEQ ID NO: 595852 - RNA, 22 nt, Human
ugcugggauuacagucaugagc

SEQ ID NO: 595853 - RNA, 22 nt, Human
uauuuccauguuagaacuaagu

SEQ ID NO: 595854 - RNA, 22 nt, Human
auauuuucacugaaccaaagua

SEQ ID NO: 595855 - RNA, 22 nt, Human
agagcugagcaccaagcauggu

SEQ ID NO: 595856 - RNA, 22 nt, Human
cacugcccuggggguugccauc

SEQ ID NO: 595857 - RNA, 23 nt, Human
aagcugaacuuguuugcugggag

SEQ ID NO: 595858 - RNA, 22 nt, Human
ggcaggcagaggcugagacagg

SEQ ID NO: 595859 - RNA, 22 nt, Human
ggagcuggcuacagagaacucc

SEQ ID NO: 595860 - RNA, 22 nt, Human
agcagcacacgggagaaagaca

SEQ ID NO: 595861 - RNA, 22 nt, Human
auguuuucaaaguaaacuugua

SEQ ID NO: 595862 - RNA, 22 nt, Human
uuuccaauaaagugucauuguu

SEQ ID NO: 595863 - RNA, 22 nt, Human
uggcuggagugggagaaguuua

SEQ ID NO: 595864 - RNA, 22 nt, Human
cauggccaaggaugcucaacca

SEQ ID NO: 595865 - RNA, 22 nt, Human
auugucgucaauggacacauag

SEQ ID NO: 595866 - RNA, 22 nt, Human
caaggcaggucugaggagguug

SEQ ID NO: 595867 - RNA, 21 nt, Human
cuggagucuggggguggcagu

SEQ ID NO: 595868 - RNA, 20 nt, Human
uccaguggccugaaucugga

SEQ ID NO: 595869 - RNA, 22 nt, Human
agagcagacauccuugucuugu

SEQ ID NO: 595870 - RNA, 22 nt, Human
augggcuaaacuuagaggauau

SEQ ID NO: 595871 - RNA, 22 nt, Human
uuuucaauuuugaggcaguggu

SEQ ID NO: 595872 - RNA, 22 nt, Human
ucaucuugcugccauugcuuua

SEQ ID NO: 595873 - RNA, 22 nt, Human
cagggcugugcccaucuucccc

SEQ ID NO: 595874 - RNA, 22 nt, Human
guacauuucauuuaaaugaugu

SEQ ID NO: 595875 - RNA, 22 nt, Human
ccagcugcccacuauguguucu

SEQ ID NO: 595876 - RNA, 22 nt, Human
cagguguacacauuguguuuau

SEQ ID NO: 595877 - RNA, 22 nt, Human
ggccagggccuggggacugucc

SEQ ID NO: 595878 - RNA, 22 nt, Human
acugagaaagaccacauggaga

SEQ ID NO: 595879 - RNA, 22 nt, Human
uuucccaaguguaaacauggca

SEQ ID NO: 595880 - RNA, 22 nt, Human
aaugucauuuaaaauaauucug

SEQ ID NO: 595881 - RNA, 22 nt, Human
gagcuuuggugccaaguauuug

SEQ ID NO: 595882 - RNA, 22 nt, Human
agggugguggcgaugaggacau

SEQ ID NO: 595883 - RNA, 18 nt, Human
acacaguggaugccuggu

SEQ ID NO: 595884 - RNA, 22 nt, Human
ugugucaggagauagcaaaggg

SEQ ID NO: 595885 - RNA, 17 nt, Human
agagcucuucacuguga

SEQ ID NO: 595886 - RNA, 22 nt, Human
acuuuaaaacugaucaucagag

SEQ ID NO: 595887 - RNA, 22 nt, Human
agcagagaagacacaggcuuca

SEQ ID NO: 595888 - RNA, 22 nt, Human
gggcuggaagugcauugaugcu

SEQ ID NO: 595889 - RNA, 23 nt, Human
acauacauggagauaaagugaug

SEQ ID NO: 595890 - RNA, 22 nt, Human
aaugacucugcugcagagacac

SEQ ID NO: 595891 - RNA, 22 nt, Human
auucucuguuuccaagaugaaa

SEQ ID NO: 595892 - RNA, 22 nt, Human
cuuucucuugagcaagagcugu

SEQ ID NO: 595893 - RNA, 22 nt, Human
caagagcucaccggagagcauu

SEQ ID NO: 595894 - RNA, 22 nt, Human
gaggggagaggcuuauggauca

SEQ ID NO: 595895 - RNA, 22 nt, Human
caauaagauguauugagcagag

SEQ ID NO: 595896 - RNA, 22 nt, Human
ucugccugcuaacuccugcacc

SEQ ID NO: 595897 - RNA, 20 nt, Human
guguuucaugugauacaaug

SEQ ID NO: 595898 - RNA, 22 nt, Human
gccuggcuugccagcccuggcg

SEQ ID NO: 595899 - RNA, 22 nt, Human
gcaguguugcuaggugcgguga

SEQ ID NO: 595900 - RNA, 23 nt, Human
agcuuugugaaagcagacauggg

SEQ ID NO: 595901 - RNA, 22 nt, Human
uagggacacugcucaugaguuc

SEQ ID NO: 595902 - RNA, 22 nt, Human
cccagggguucuagaccagcuu

SEQ ID NO: 595903 - RNA, 22 nt, Human
accugccuaguugguucugccc

SEQ ID NO: 595904 - RNA, 22 nt, Human
acaacuguuggaggaacacagg

SEQ ID NO: 595905 - RNA, 20 nt, Human
acacauauagcagcauaaac

SEQ ID NO: 595906 - RNA, 22 nt, Human
cccucucuuagaagaaacacag

SEQ ID NO: 595907 - RNA, 22 nt, Human
uccugggaggcugugccuggcu

SEQ ID NO: 595908 - RNA, 22 nt, Human
gaggcuccagcgacaccuaggc

SEQ ID NO: 595909 - RNA, 22 nt, Human
aacuaacagucauuaaaagaac

SEQ ID NO: 595910 - RNA, 22 nt, Human
cugucaaugacaguuauuuggg

SEQ ID NO: 595911 - RNA, 22 nt, Human
gcugccugaagugucuacacug

SEQ ID NO: 595912 - RNA, 22 nt, Human
uuuuacauugggaaaugccucu

SEQ ID NO: 595913 - RNA, 22 nt, Human
ugcacagagagaugagacacgu

SEQ ID NO: 595914 - RNA, 22 nt, Human
cgcugggcgccgaccugcuggc

SEQ ID NO: 595915 - RNA, 22 nt, Human
ucaugaaaauagaucagaaauu

SEQ ID NO: 595916 - RNA, 22 nt, Human
uccaggcuccccugcgugcucc

SEQ ID NO: 595917 - RNA, 22 nt, Human
ccagcugcugacaugggcaggu

SEQ ID NO: 595918 - RNA, 22 nt, Human
agcuccagagucugaacuauuc

SEQ ID NO: 595919 - RNA, 22 nt, Human
uguacaguauauuucaaagcca

SEQ ID NO: 595920 - RNA, 22 nt, Human
agcugguaaguggcagagauuc

SEQ ID NO: 595921 - RNA, 22 nt, Human
gcugagagaaaagugagguucu

SEQ ID NO: 595922 - RNA, 22 nt, Human
acucucccugcuauccacuucc

SEQ ID NO: 595923 - RNA, 22 nt, Human
uaaaguuuauuugaacaucucu

SEQ ID NO: 595924 - RNA, 22 nt, Human
ggcaccuggagguuuacuggau

SEQ ID NO: 595925 - RNA, 22 nt, Human
agcugaaguucaguccagagaa

SEQ ID NO: 595926 - RNA, 22 nt, Human
uuucuaaguaucuugcaguuuu

SEQ ID NO: 595927 - RNA, 22 nt, Human
uaaaggaacagaggacucauuu

SEQ ID NO: 595928 - RNA, 22 nt, Human
augcaaauaaacagucuaguug

SEQ ID NO: 595929 - RNA, 22 nt, Human
cagaguggagauguguguggaa

SEQ ID NO: 595930 - RNA, 22 nt, Human
uuugauuuucagcaauaguggc

SEQ ID NO: 595931 - RNA, 22 nt, Human
ugagauggaguucugcucuugu

SEQ ID NO: 595932 - RNA, 22 nt, Human
uuggaucaaauuucaugcuguc

SEQ ID NO: 595933 - RNA, 21 nt, Human
ggccacaagcggaggagccgc

SEQ ID NO: 595934 - RNA, 22 nt, Human
ccccaggagaaaucuuaaacua

SEQ ID NO: 595935 - RNA, 22 nt, Human
agcucccugcacgacccugccc

SEQ ID NO: 595936 - RNA, 22 nt, Human
acugccuguuuggcauggcccc

SEQ ID NO: 595937 - RNA, 22 nt, Human
uuguaacaaagacacuccaaaa

SEQ ID NO: 595938 - RNA, 23 nt, Human
agugcaugcuugacuuagcaagc

SEQ ID NO: 595939 - RNA, 22 nt, Human
uggguuggaagcaggaggcacc

SEQ ID NO: 595940 - RNA, 22 nt, Human
caggagcuacucagguuggguu

SEQ ID NO: 595941 - RNA, 22 nt, Human
gauuaaaaauaacccaugcuga

SEQ ID NO: 595942 - RNA, 22 nt, Human
ucugcugagucagaccucuggg

SEQ ID NO: 595943 - RNA, 22 nt, Human
agcugccacauggugucacugu

SEQ ID NO: 595944 - RNA, 22 nt, Human
gaggcugggaaguccaauauca

SEQ ID NO: 595945 - RNA, 22 nt, Human
uccuggauucugcccugaaggc

SEQ ID NO: 595946 - RNA, 22 nt, Human
cagucuuauccugaaaacaaca

SEQ ID NO: 595947 - RNA, 22 nt, Human
aaaguucuggggguguuucugg

SEQ ID NO: 595948 - RNA, 22 nt, Human
cuuuucuuacucccgcaaggca

SEQ ID NO: 595949 - RNA, 22 nt, Human
uauuaucagagcuauuuggaau

SEQ ID NO: 595950 - RNA, 22 nt, Human
agcugccaucugaagaacugca

SEQ ID NO: 595951 - RNA, 22 nt, Human
ugacagggucagagcugagcug

SEQ ID NO: 595952 - RNA, 22 nt, Human
ucucacacaacauguuacuuug

SEQ ID NO: 595953 - RNA, 21 nt, Human
ugccagcauguaggcuaguug

SEQ ID NO: 595954 - RNA, 21 nt, Human
uuucccucauuguguuggcac

SEQ ID NO: 595955 - RNA, 22 nt, Human
ccucuggccaucccccauuaag

SEQ ID NO: 595956 - RNA, 22 nt, Human
gcuuuuauugucuuuacgacga

SEQ ID NO: 595957 - RNA, 22 nt, Human
cauuuaugauaguaauaugaaa

SEQ ID NO: 595958 - RNA, 22 nt, Human
auuaaaguugaaauugaacuga

SEQ ID NO: 595959 - RNA, 22 nt, Human
cuggcuuucauucauucaggcc

SEQ ID NO: 595960 - RNA, 22 nt, Human
gcuaggcuucaaaaucucccug

SEQ ID NO: 595961 - RNA, 21 nt, Human
ugcauauauaagugcauacac

SEQ ID NO: 595962 - RNA, 22 nt, Human
cagaugaacugugacugaaaau

SEQ ID NO: 595963 - RNA, 22 nt, Human
gaggcaguuugccaugccagga

SEQ ID NO: 595964 - RNA, 22 nt, Human
uuucuauaugaggagcuaaagu

SEQ ID NO: 595965 - RNA, 22 nt, Human
uaacagagauagaaauguaaag

SEQ ID NO: 595966 - RNA, 22 nt, Human
acauaugcucaucugcauuccc

SEQ ID NO: 595967 - RNA, 22 nt, Human
gugugcagggcugccugugccg

SEQ ID NO: 595968 - RNA, 22 nt, Human
uuauuaugguauuucuuugcag

SEQ ID NO: 595969 - RNA, 22 nt, Human
auuuuaaggcuuauuuaaaggc

SEQ ID NO: 595970 - RNA, 22 nt, Human
ucuugcacuucaugaauauguu

SEQ ID NO: 595971 - RNA, 22 nt, Human
cucugugccucaguuuucuucu

SEQ ID NO: 595972 - RNA, 22 nt, Human
guugugaauagugccgcaauaa

SEQ ID NO: 595973 - RNA, 22 nt, Human
gacauggauacuugauaagggg

SEQ ID NO: 595974 - RNA, 22 nt, Human
cuuuccuuaauaagcagguaua

SEQ ID NO: 595975 - RNA, 22 nt, Human
acauugcaauaauaauucucuu

SEQ ID NO: 595976 - RNA, 22 nt, Human
cugggccucaaucucagaguuu

SEQ ID NO: 595977 - RNA, 22 nt, Human
aaagagcaagcugagauuugaa

SEQ ID NO: 595978 - RNA, 22 nt, Human
caaucuauaaauaucaguuucc

SEQ ID NO: 595979 - RNA, 19 nt, Human
ucaguuuuagucaucaguu

SEQ ID NO: 595980 - RNA, 17 nt, Human
cuuguuuuccacuggga

SEQ ID NO: 595981 - RNA, 22 nt, Human
aaauaguucagcuuguaaaccc

SEQ ID NO: 595982 - RNA, 22 nt, Human
cuuuguuagcagccaauuuguu

SEQ ID NO: 595983 - RNA, 22 nt, Human
gggccagccuacugcuagaccc

SEQ ID NO: 595984 - RNA, 20 nt, Human
uggggaguugagcacgagca

SEQ ID NO: 595985 - RNA, 22 nt, Human
cuccaggccaagauuaaguaau

SEQ ID NO: 595986 - RNA, 22 nt, Human
gcugugugcuaggauauguuuu

SEQ ID NO: 595987 - RNA, 22 nt, Human
uggggccacacugaucucccag

SEQ ID NO: 595988 - RNA, 22 nt, Human
aggcuaggccuugcccuggaac

SEQ ID NO: 595989 - RNA, 22 nt, Human
aagcacauacauaauaaagucc

SEQ ID NO: 595990 - RNA, 18 nt, Human
ugagcagaguaaggcuuu

SEQ ID NO: 595991 - RNA, 22 nt, Human
aaaagcagaucuccaaagucua

SEQ ID NO: 595992 - RNA, 22 nt, Human
uguuuucaugguuaugugucua

SEQ ID NO: 595993 - RNA, 22 nt, Human
uucuuacagaguuuacagagcc

SEQ ID NO: 595994 - RNA, 19 nt, Human
cccaggaggcggagguugc

SEQ ID NO: 595995 - RNA, 22 nt, Human
gcgugggcuggacugggaugaa

SEQ ID NO: 595996 - RNA, 22 nt, Human
aaagaugucaguuugaaauaac

SEQ ID NO: 595997 - RNA, 22 nt, Human
agcuguguguuuccacugagcu

SEQ ID NO: 595998 - RNA, 22 nt, Human
ugguuucuuuccacucuccacc

SEQ ID NO: 595999 - RNA, 23 nt, Human
aauaaugucuugugcucucacuu

SEQ ID NO: 596000 - RNA, 22 nt, Human
cauguaaagaauuucacacaag

SEQ ID NO: 596001 - RNA, 22 nt, Human
agagauugcuagcuggcuuuaa

SEQ ID NO: 596002 - RNA, 22 nt, Human
cugugagugacccuggucagca

SEQ ID NO: 596003 - RNA, 22 nt, Human
ucauaaaugcagugucauaaau

SEQ ID NO: 596004 - RNA, 23 nt, Human
gcagccaagagaccagggcaggc

SEQ ID NO: 596005 - RNA, 22 nt, Human
gaggggcugggguugacuccaa

SEQ ID NO: 596006 - RNA, 20 nt, Human
uagauguuuccugucauaaa

SEQ ID NO: 596007 - RNA, 22 nt, Human
uccagggcuugacagggugccu

SEQ ID NO: 596008 - RNA, 22 nt, Human
uuuaaugauagucuuacgaaaa

SEQ ID NO: 596009 - RNA, 22 nt, Human
uguauuuugugaggaucacucu

SEQ ID NO: 596010 - RNA, 21 nt, Human
ggccugaguauaggacaggcc

SEQ ID NO: 596011 - RNA, 22 nt, Human
guuuccagagugagggcacuug

SEQ ID NO: 596012 - RNA, 22 nt, Human
ucauuucaguggcacagaagau

SEQ ID NO: 596013 - RNA, 22 nt, Human
cuccagcucgcgagcucugcuc

SEQ ID NO: 596014 - RNA, 22 nt, Human
cugaggucuagacaccccaggg

SEQ ID NO: 596015 - RNA, 22 nt, Human
auaguuuuauagauauugugua

SEQ ID NO: 596016 - RNA, 22 nt, Human
gaugcuaaaauaauuauuuuga

SEQ ID NO: 596017 - RNA, 22 nt, Human
gcaggcugaguugggaaaccaa

SEQ ID NO: 596018 - RNA, 22 nt, Human
ggcaagagugaggagugucucu

SEQ ID NO: 596019 - RNA, 22 nt, Human
uagaauguggagguaacagacu

SEQ ID NO: 596020 - RNA, 19 nt, Human
uucuuacaacacccuggga

SEQ ID NO: 596021 - RNA, 22 nt, Human
ugcuggcuuuuugguccuugcu

SEQ ID NO: 596022 - RNA, 22 nt, Human
augugugugaugggcgccgcca

SEQ ID NO: 596023 - RNA, 22 nt, Human
augauguuaccaguacuuagag

SEQ ID NO: 596024 - RNA, 22 nt, Human
uuuacaggaagcugaaaaacau

SEQ ID NO: 596025 - RNA, 22 nt, Human
ucuucucccaucuccaggcagg

SEQ ID NO: 596026 - RNA, 22 nt, Human
auguggaaugaacaaaggaggc

SEQ ID NO: 596027 - RNA, 22 nt, Human
uggcuucugcauauuuuuagag

SEQ ID NO: 596028 - RNA, 22 nt, Human
gggaaaggaucagugggaggcu

SEQ ID NO: 596029 - RNA, 22 nt, Human
gauaauuucuccaucucaaggu

SEQ ID NO: 596030 - RNA, 22 nt, Human
gcagagauuaugccauggaaag

SEQ ID NO: 596031 - RNA, 22 nt, Human
ggccagcagaccucagggacuc

SEQ ID NO: 596032 - RNA, 22 nt, Human
ucuguggcccaagugauggcug

SEQ ID NO: 596033 - RNA, 20 nt, Human
aagggcagagggaacagacu

SEQ ID NO: 596034 - RNA, 22 nt, Human
uucuagcagagggcaucugcug

SEQ ID NO: 596035 - RNA, 22 nt, Human
ggaggccaaggcgggcggauca

SEQ ID NO: 596036 - RNA, 22 nt, Human
cuaggguggauuugugcagagu

SEQ ID NO: 596037 - RNA, 22 nt, Human
aagauucuagaggaacuucuua

SEQ ID NO: 596038 - RNA, 22 nt, Human
ucauguuuggaguuugcucacu

SEQ ID NO: 596039 - RNA, 22 nt, Human
uacuugcuuggauuucaccaga

SEQ ID NO: 596040 - RNA, 22 nt, Human
uuaacagguuauauuguacagg

SEQ ID NO: 596041 - RNA, 18 nt, Human
acacagguuauucucucc

SEQ ID NO: 596042 - RNA, 22 nt, Human
cuccagccucaucuccuggcug

SEQ ID NO: 596043 - RNA, 21 nt, Human
ucuccuggguccaacccaugc

SEQ ID NO: 596044 - RNA, 22 nt, Human
gcccccagaagggccacagauu

SEQ ID NO: 596045 - RNA, 22 nt, Human
cacagagauggucuggcaggug

SEQ ID NO: 596046 - RNA, 23 nt, Human
gcagauggccccagagugcugcc

SEQ ID NO: 596047 - RNA, 22 nt, Human
uuuucauuuacauuagggaaga

SEQ ID NO: 596048 - RNA, 22 nt, Human
aggagugaguguccucagcaga

SEQ ID NO: 596049 - RNA, 22 nt, Human
acuuucugugguuaccagggag

SEQ ID NO: 596050 - RNA, 22 nt, Human
cuguggcaggaagggacuagca

SEQ ID NO: 596051 - RNA, 20 nt, Human
ccagagcugauggcugcccg

SEQ ID NO: 596052 - RNA, 22 nt, Human
aguugaauauacuugcuguugc

SEQ ID NO: 596053 - RNA, 22 nt, Human
caguccuuccuugccccuuggg

SEQ ID NO: 596054 - RNA, 22 nt, Human
auuauuuccuugcuuugaggaa

SEQ ID NO: 596055 - RNA, 22 nt, Human
aauucauuaagaaagagcuaaa

SEQ ID NO: 596056 - RNA, 22 nt, Human
acuuccuugucaggugcaucau

SEQ ID NO: 596057 - RNA, 22 nt, Human
guuggcagaaagcuuucgaucg

SEQ ID NO: 596058 - RNA, 22 nt, Human
gugaaggacuagcauggagggc

SEQ ID NO: 596059 - RNA, 22 nt, Human
ugccaggguccugagggccuug

SEQ ID NO: 596060 - RNA, 22 nt, Human
uuggaggaaauugcuuuugugg

SEQ ID NO: 596061 - RNA, 22 nt, Human
ccuuagcuggagugguggaaug

SEQ ID NO: 596062 - RNA, 22 nt, Human
caguggagaggcaugcuuggca

SEQ ID NO: 596063 - RNA, 22 nt, Human
ugagagcuugaguaucacuggc

SEQ ID NO: 596064 - RNA, 22 nt, Human
cacagcccccuugacacucugg

SEQ ID NO: 596065 - RNA, 21 nt, Human
auuucauggugcuuuuaagaa

SEQ ID NO: 596066 - RNA, 22 nt, Human
cccagccucagcuuuacuucca

SEQ ID NO: 596067 - RNA, 22 nt, Human
ccucucagcgauuccucuugga

SEQ ID NO: 596068 - RNA, 22 nt, Human
gaguccaggcaucccucccaua

SEQ ID NO: 596069 - RNA, 22 nt, Human
acauuucugagcagggagcugu

SEQ ID NO: 596070 - RNA, 22 nt, Human
cccuggagcuagucugagcaga

SEQ ID NO: 596071 - RNA, 22 nt, Human
cuaaagagaguucaagacuccu

SEQ ID NO: 596072 - RNA, 22 nt, Human
ugacuucaaaggcucuacuccu

SEQ ID NO: 596073 - RNA, 22 nt, Human
aaguuauuuccucgugacugaa

SEQ ID NO: 596074 - RNA, 22 nt, Human
uagaaacagauguuuuugaaga

SEQ ID NO: 596075 - RNA, 21 nt, Human
ccagagagagggaaguggguu

SEQ ID NO: 596076 - RNA, 17 nt, Human
ucagucucuguccugga

SEQ ID NO: 596077 - RNA, 22 nt, Human
auugaaagauaggcuacugugg

SEQ ID NO: 596078 - RNA, 22 nt, Human
aggcugugacagggucauggag

SEQ ID NO: 596079 - RNA, 22 nt, Human
uucaaaacagcuagauauugga

SEQ ID NO: 596080 - RNA, 22 nt, Human
ggccugagcuugggcagcguau

SEQ ID NO: 596081 - RNA, 22 nt, Human
uuaucuacguauuuaaacucuu

SEQ ID NO: 596082 - RNA, 22 nt, Human
uuucuacaguacugauuucaua

SEQ ID NO: 596083 - RNA, 22 nt, Human
caugauuuugucuuguguuaau

SEQ ID NO: 596084 - RNA, 22 nt, Human
agggcucuguccccagaggccc

SEQ ID NO: 596085 - RNA, 22 nt, Human
gaagagcugucagaaaagcuaa

SEQ ID NO: 596086 - RNA, 22 nt, Human
uggcccugugugcaggcugcac

SEQ ID NO: 596087 - RNA, 22 nt, Human
aaaugcaugagaaaguauucug

SEQ ID NO: 596088 - RNA, 22 nt, Human
agugaaagguugagaauauucu

SEQ ID NO: 596089 - RNA, 22 nt, Human
ucuucugugagaauucaagcaa

SEQ ID NO: 596090 - RNA, 22 nt, Human
cugagccaguagucagggacaa

SEQ ID NO: 596091 - RNA, 17 nt, Human
ugcaggcuccugucccu

SEQ ID NO: 596092 - RNA, 22 nt, Human
cuuugcuugacacugugauugu

SEQ ID NO: 596093 - RNA, 22 nt, Human
cucugaaacuccagccccaggu

SEQ ID NO: 596094 - RNA, 22 nt, Human
cauggauagaugaaugcuuaaa

SEQ ID NO: 596095 - RNA, 22 nt, Human
ucucugagcaugccauauugcu

SEQ ID NO: 596096 - RNA, 22 nt, Human
uggaaggggagcuggaaagggg

SEQ ID NO: 596097 - RNA, 22 nt, Human
ucuggaguugagagugugcgag

SEQ ID NO: 596098 - RNA, 22 nt, Human
gagccaggaggcagagacugca

SEQ ID NO: 596099 - RNA, 22 nt, Human
aaacaugcuggauuuagaauau

SEQ ID NO: 596100 - RNA, 18 nt, Human
gaggaaacaaggcagagg

SEQ ID NO: 596101 - RNA, 22 nt, Human
ggcugccugggagcccuccucu

SEQ ID NO: 596102 - RNA, 22 nt, Human
gaggagaggggcucccaagagc

SEQ ID NO: 596103 - RNA, 22 nt, Human
gggcuucucuuuagugagcuga

SEQ ID NO: 596104 - RNA, 22 nt, Human
gggcgagggcgaaagcgagagc

SEQ ID NO: 596105 - RNA, 22 nt, Human
uagacaggaaacauuaggaugg

SEQ ID NO: 596106 - RNA, 22 nt, Human
gaggucccccauggcugugacu

SEQ ID NO: 596107 - RNA, 22 nt, Human
gaauuuugcuuuuaugucaagu

SEQ ID NO: 596108 - RNA, 22 nt, Human
guuguuuugcaggauccuuaca

SEQ ID NO: 596109 - RNA, 22 nt, Human
uuacaggugagaaaacugaggc

SEQ ID NO: 596110 - RNA, 22 nt, Human
cuggggcuucaaugcuucggug

SEQ ID NO: 596111 - RNA, 19 nt, Human
cucugggcugcaucuuggu

SEQ ID NO: 596112 - RNA, 22 nt, Human
uuccacaggacuaaaugucauc

SEQ ID NO: 596113 - RNA, 22 nt, Human
ugguggcaauguccuggagaag

SEQ ID NO: 596114 - RNA, 22 nt, Human
ugcucugggcaacagccucccu

SEQ ID NO: 596115 - RNA, 22 nt, Human
agggugcagaaggagccuagga

SEQ ID NO: 596116 - RNA, 22 nt, Human
ggugagaggcagugcuguggaa

SEQ ID NO: 596117 - RNA, 22 nt, Human
augcagauuuaauuaguauagg

SEQ ID NO: 596118 - RNA, 22 nt, Human
cccugccucugaagcugcucag

SEQ ID NO: 596119 - RNA, 22 nt, Human
uuccuccuacgcuuaucacuuu

SEQ ID NO: 596120 - RNA, 22 nt, Human
gauuuuaauuauaggagguccu

SEQ ID NO: 596121 - RNA, 22 nt, Human
ugucauuuauucucuuauucua

SEQ ID NO: 596122 - RNA, 22 nt, Human
agcuguguuuccagaugguagc

SEQ ID NO: 596123 - RNA, 23 nt, Human
aggagccaugaguuggauauguu

SEQ ID NO: 596124 - RNA, 22 nt, Human
agccaggaaugcaugcucugcu

SEQ ID NO: 596125 - RNA, 22 nt, Human
uuucuagagugggcaugucuua

SEQ ID NO: 596126 - RNA, 22 nt, Human
agucaaagaugaccgaguuccu

SEQ ID NO: 596127 - RNA, 22 nt, Human
aacauguugaguugaaaguagc

SEQ ID NO: 596128 - RNA, 22 nt, Human
cuggagccccaggcugugcaga

SEQ ID NO: 596129 - RNA, 22 nt, Human
agauguggccggcuagggagag

SEQ ID NO: 596130 - RNA, 20 nt, Human
ggaaggggcaaaguguguga

SEQ ID NO: 596131 - RNA, 16 nt, Human
cuugucuguugcucau

SEQ ID NO: 596132 - RNA, 22 nt, Human
agugacauuugcaccagcugcu

SEQ ID NO: 596133 - RNA, 22 nt, Human
gggagaaaugucuggccugcug

SEQ ID NO: 596134 - RNA, 22 nt, Human
uacauuuucuaggggaccaaga

SEQ ID NO: 596135 - RNA, 22 nt, Human
ugccaggcugcccuccagucug

SEQ ID NO: 596136 - RNA, 22 nt, Human
cucugcaacuucuagcaguguc

SEQ ID NO: 596137 - RNA, 22 nt, Human
guuuauuaacugucaagugauu

SEQ ID NO: 596138 - RNA, 22 nt, Human
uccagcccugcuuccugccuca

SEQ ID NO: 596139 - RNA, 16 nt, Human
augaggcauaggcugc

SEQ ID NO: 596140 - RNA, 22 nt, Human
aggcauguauaugugcacaugu

SEQ ID NO: 596141 - RNA, 22 nt, Human
gcagugaaacaauaggaucaaa

SEQ ID NO: 596142 - RNA, 22 nt, Human
uuacuguagaagagaaugauuc

SEQ ID NO: 596143 - RNA, 22 nt, Human
ugaggaaguugaucucaucagu

SEQ ID NO: 596144 - RNA, 22 nt, Human
acauuucauguuuuccagagca

SEQ ID NO: 596145 - RNA, 22 nt, Human
cagaaugaguagcaucuucacc

SEQ ID NO: 596146 - RNA, 22 nt, Human
augcuuuauguucuggcauuuu

SEQ ID NO: 596147 - RNA, 22 nt, Human
cugggccuggacgggcagaucu

SEQ ID NO: 596148 - RNA, 22 nt, Human
aagacauuuuagagauagggaa

SEQ ID NO: 596149 - RNA, 22 nt, Human
gccagcagccacagaagucacu

SEQ ID NO: 596150 - RNA, 22 nt, Human
auuuaugacuggugaauagaac

SEQ ID NO: 596151 - RNA, 22 nt, Human
aaaaagagaaaugcucuagucc

SEQ ID NO: 596152 - RNA, 22 nt, Human
ucugaggcccaguucaacucuu

SEQ ID NO: 596153 - RNA, 22 nt, Human
uguauacauuuaacuagauaga

SEQ ID NO: 596154 - RNA, 22 nt, Human
ugucccagauacuggacauaga

SEQ ID NO: 596155 - RNA, 22 nt, Human
ugagaugcuaaagggcugcuca

SEQ ID NO: 596156 - RNA, 22 nt, Human
cauuucuacagcuucuucagaa

SEQ ID NO: 596157 - RNA, 22 nt, Human
ucucaagagggaggcaaucaug

SEQ ID NO: 596158 - RNA, 22 nt, Human
aaauagauuuaacauccauccc

SEQ ID NO: 596159 - RNA, 22 nt, Human
ucucucagaggaagaggcagug

SEQ ID NO: 596160 - RNA, 22 nt, Human
uagaugaaauuuguguguaugc

SEQ ID NO: 596161 - RNA, 22 nt, Human
augugaaaaauuucuuauuaca

SEQ ID NO: 596162 - RNA, 22 nt, Human
ggugccaggcucccagcucagg

SEQ ID NO: 596163 - RNA, 22 nt, Human
gacaaugcagaaguacuuguuc

SEQ ID NO: 596164 - RNA, 22 nt, Human
aagcacauuuggaaaacaugga

SEQ ID NO: 596165 - RNA, 22 nt, Human
gggcagaggcucuggcccaucc

SEQ ID NO: 596166 - RNA, 22 nt, Human
agugaaauuccuggucuuuguu

SEQ ID NO: 596167 - RNA, 22 nt, Human
ugccuguguaugugcaugcaca

SEQ ID NO: 596168 - RNA, 23 nt, Human
uggaaacauucugaauguccauc

SEQ ID NO: 596169 - RNA, 22 nt, Human
uaagguuuaacgcccugucucg

SEQ ID NO: 596170 - RNA, 22 nt, Human
ccacuuugcaagauauucagag

SEQ ID NO: 596171 - RNA, 22 nt, Human
gccaagccuguagacacaagcu

SEQ ID NO: 596172 - RNA, 22 nt, Human
ccugggauuuccugagcacucu

SEQ ID NO: 596173 - RNA, 22 nt, Human
ugagcccagagaucugagcuau

SEQ ID NO: 596174 - RNA, 19 nt, Human
uuuaccuucuugagagcag

SEQ ID NO: 596175 - RNA, 18 nt, Human
ggccagagggaggguccc

SEQ ID NO: 596176 - RNA, 22 nt, Human
gacacuuuaggccaccaugcaa

SEQ ID NO: 596177 - RNA, 22 nt, Human
guuuucucaucuccucaauggu

SEQ ID NO: 596178 - RNA, 22 nt, Human
cuacaucagaacauuuacccua

SEQ ID NO: 596179 - RNA, 22 nt, Human
ccuggcagcaggugggcccgug

SEQ ID NO: 596180 - RNA, 18 nt, Human
gauggaaaguguaugagu

SEQ ID NO: 596181 - RNA, 22 nt, Human
agcuccaguuacuuaccuagag

SEQ ID NO: 596182 - RNA, 22 nt, Human
cccugcagcauucucuaacugg

SEQ ID NO: 596183 - RNA, 22 nt, Human
cugagggcaccgacagagugga

SEQ ID NO: 596184 - RNA, 22 nt, Human
uguguaaauggcaucucucagc

SEQ ID NO: 596185 - RNA, 22 nt, Human
aggugcuguuggcagcgggcag

SEQ ID NO: 596186 - RNA, 22 nt, Human
ucugaggucuaugacuuugcuu

SEQ ID NO: 596187 - RNA, 22 nt, Human
aucaaaguucguaacugauaac

SEQ ID NO: 596188 - RNA, 21 nt, Human
gcugcugugggccagggaggc

SEQ ID NO: 596189 - RNA, 17 nt, Human
auuucacuuagcaugag

SEQ ID NO: 596190 - RNA, 22 nt, Human
ccagggcaacgcugucucagag

SEQ ID NO: 596191 - RNA, 22 nt, Human
ucaggcuacacucuuuucaugg

SEQ ID NO: 596192 - RNA, 22 nt, Human
uuuauugaguaucuacuaugug

SEQ ID NO: 596193 - RNA, 23 nt, Human
aggcagagccaaggucaaaaccc

SEQ ID NO: 596194 - RNA, 22 nt, Human
caggcugaggcaguaggguuug

SEQ ID NO: 596195 - RNA, 22 nt, Human
gagcuggggcggauacucagcu

SEQ ID NO: 596196 - RNA, 21 nt, Human
gggaaauuaggauugcucauc

SEQ ID NO: 596197 - RNA, 20 nt, Human
ugcuugucaugcacucaggc

SEQ ID NO: 596198 - RNA, 22 nt, Human
ccaggggcuggugcugagcugg

SEQ ID NO: 596199 - RNA, 22 nt, Human
agaugcuuuccugauauuuaug

SEQ ID NO: 596200 - RNA, 22 nt, Human
uuugcugaguuuucuccuaaga

SEQ ID NO: 596201 - RNA, 22 nt, Human
ucucucugaguugagcaggagu

SEQ ID NO: 596202 - RNA, 19 nt, Human
uucucagagcuugcagcac

SEQ ID NO: 596203 - RNA, 22 nt, Human
gcugucacucuccggccuuccc

SEQ ID NO: 596204 - RNA, 22 nt, Human
uggcacagacagaucaggaguc

SEQ ID NO: 596205 - RNA, 22 nt, Human
uccucacauggugagccacaca

SEQ ID NO: 596206 - RNA, 22 nt, Human
uucugaugcaugggucucuguu

SEQ ID NO: 596207 - RNA, 22 nt, Human
ggaggccaugaggcucuaggug

SEQ ID NO: 596208 - RNA, 23 nt, Human
ucagagaaugguaugcuuuuccu

SEQ ID NO: 596209 - RNA, 16 nt, Human
ggugggaggugaggug

SEQ ID NO: 596210 - RNA, 22 nt, Human
cagaacacauuuucagagucaa

SEQ ID NO: 596211 - RNA, 20 nt, Human
ccugggcucaaagcauccuc

SEQ ID NO: 596212 - RNA, 22 nt, Human
gaggcaccagccccgcuagccu

SEQ ID NO: 596213 - RNA, 22 nt, Human
acgggccuucucuucaggcgag

SEQ ID NO: 596214 - RNA, 22 nt, Human
cagggccccagggaugucugcu

SEQ ID NO: 596215 - RNA, 22 nt, Human
agccagggaagaggccuaccuc

SEQ ID NO: 596216 - RNA, 22 nt, Human
caaauagacaagauggcaggaa

SEQ ID NO: 596217 - RNA, 18 nt, Human
aguguuuauuuaggugaa

SEQ ID NO: 596218 - RNA, 22 nt, Human
uugaagaucuuugcauugcagg

SEQ ID NO: 596219 - RNA, 22 nt, Human
uggcuucauuauuguuuuuccu

SEQ ID NO: 596220 - RNA, 22 nt, Human
cccugcaggcucagacuggagu

SEQ ID NO: 596221 - RNA, 22 nt, Human
cuggucaaaaauuaugcuuacu

SEQ ID NO: 596222 - RNA, 22 nt, Human
agugcucugaucuccuuggguu

SEQ ID NO: 596223 - RNA, 22 nt, Human
ggucuccugaggcugccacacc

SEQ ID NO: 596224 - RNA, 19 nt, Human
agugugagacuccaucuca

SEQ ID NO: 596225 - RNA, 22 nt, Human
cuucucucggugcaucccucac

SEQ ID NO: 596226 - RNA, 22 nt, Human
ggcggcacgcaggcugcugucg

SEQ ID NO: 596227 - RNA, 22 nt, Human
caguuucugagguuccagguuu

SEQ ID NO: 596228 - RNA, 22 nt, Human
agauggcugauggcaggagcca

SEQ ID NO: 596229 - RNA, 22 nt, Human
cuccagagaguccagcucuggg

SEQ ID NO: 596230 - RNA, 22 nt, Human
cugccagggaggcugggaaguu

SEQ ID NO: 596231 - RNA, 22 nt, Human
uuugugcagauaggagacaauc

SEQ ID NO: 596232 - RNA, 22 nt, Human
cugagccccucugaccucagag

SEQ ID NO: 596233 - RNA, 22 nt, Human
gacuuuauuauaguggcaauag

SEQ ID NO: 596234 - RNA, 22 nt, Human
ugggcaggagagaagcuaaaga

SEQ ID NO: 596235 - RNA, 22 nt, Human
accagaguaauguguggaaauu

SEQ ID NO: 596236 - RNA, 22 nt, Human
gcacccagauauugccuugacc

SEQ ID NO: 596237 - RNA, 22 nt, Human
augaggcaucuaacauugcaaa

SEQ ID NO: 596238 - RNA, 22 nt, Human
cucaggaggaggaaguucauug

SEQ ID NO: 596239 - RNA, 22 nt, Human
augauacaccuaggagugggag

SEQ ID NO: 596240 - RNA, 22 nt, Human
ucugagaaggguaggcuccauu

SEQ ID NO: 596241 - RNA, 22 nt, Human
uucugucaugcucauguaauug

SEQ ID NO: 596242 - RNA, 22 nt, Human
gugaacuuccagaugauaaaca

SEQ ID NO: 596243 - RNA, 22 nt, Human
cccaggugggcaccucgaggaa

SEQ ID NO: 596244 - RNA, 22 nt, Human
cucuggagugcagccugguggc

SEQ ID NO: 596245 - RNA, 19 nt, Human
uacauuuguguacacuugu

SEQ ID NO: 596246 - RNA, 22 nt, Human
caggcuugauuauucagacaau

SEQ ID NO: 596247 - RNA, 17 nt, Human
ucauuucaguaaaucca

SEQ ID NO: 596248 - RNA, 22 nt, Human
gagaggcugugugccauuguug

SEQ ID NO: 596249 - RNA, 22 nt, Human
cacccacauuccaucacucugc

SEQ ID NO: 596250 - RNA, 22 nt, Human
gagaggcuccaugaccccggca

SEQ ID NO: 596251 - RNA, 19 nt, Human
uuugaugagaauuuaagca

SEQ ID NO: 596252 - RNA, 22 nt, Human
uugugcagaguugccuuuauuu

SEQ ID NO: 596253 - RNA, 22 nt, Human
cagguggguguaugaaugcaaa

SEQ ID NO: 596254 - RNA, 20 nt, Human
agggcagcuugaggagccgg

SEQ ID NO: 596255 - RNA, 22 nt, Human
uguguacaggacagaaaggagg

SEQ ID NO: 596256 - RNA, 22 nt, Human
gacugagggacagggcagugga

SEQ ID NO: 596257 - RNA, 22 nt, Human
ccuguguggccaggcuggaguc

SEQ ID NO: 596258 - RNA, 22 nt, Human
ucagcacuuuuacucucuuugc

SEQ ID NO: 596259 - RNA, 22 nt, Human
ucacccagcgggcgcacacucg

SEQ ID NO: 596260 - RNA, 22 nt, Human
ccuagaggcugcaaggagaggc

SEQ ID NO: 596261 - RNA, 22 nt, Human
gcugcaugacagacaggccugg

SEQ ID NO: 596262 - RNA, 16 nt, Human
uggcugagagaggguu

SEQ ID NO: 596263 - RNA, 22 nt, Human
auguuucugaguguauauacau

SEQ ID NO: 596264 - RNA, 22 nt, Human
ggcugcagcggauuggggauug

SEQ ID NO: 596265 - RNA, 17 nt, Human
gacugagguaaggugag

SEQ ID NO: 596266 - RNA, 21 nt, Human
gaacccagcagcagugcucug

SEQ ID NO: 596267 - RNA, 22 nt, Human
auacugugugugcucaaggaau

SEQ ID NO: 596268 - RNA, 22 nt, Human
ucacacacauaaucuaagauua

SEQ ID NO: 596269 - RNA, 22 nt, Human
agagauggccuuaggugggaau

SEQ ID NO: 596270 - RNA, 20 nt, Human
acuuuacagagaagacugac

SEQ ID NO: 596271 - RNA, 22 nt, Human
gaggggcaguugauugugcuau

SEQ ID NO: 596272 - RNA, 22 nt, Human
gaaggcuggaaggcaaguagga

SEQ ID NO: 596273 - RNA, 22 nt, Human
cccagggaagggcuaccugagg

SEQ ID NO: 596274 - RNA, 22 nt, Human
gugcuccaacauuagugugcuu

SEQ ID NO: 596275 - RNA, 22 nt, Human
auuugcuuucagguauaaaagg

SEQ ID NO: 596276 - RNA, 22 nt, Human
uaauaauuaacagugauggguc

SEQ ID NO: 596277 - RNA, 22 nt, Human
gggugggaucuguggagccuca

SEQ ID NO: 596278 - RNA, 18 nt, Human
ucuuuaaguugucagagu

SEQ ID NO: 596279 - RNA, 22 nt, Human
uucucuccaguccuggauucug

SEQ ID NO: 596280 - RNA, 22 nt, Human
uaacuacauuucacugcaauua

SEQ ID NO: 596281 - RNA, 22 nt, Human
augcugagacuggagcagcugg

SEQ ID NO: 596282 - RNA, 22 nt, Human
gaaaucuuccuucagugaagaa

SEQ ID NO: 596283 - RNA, 22 nt, Human
aggcauuuucacugaugucauc

SEQ ID NO: 596284 - RNA, 22 nt, Human
aauuaugguggaucccaguggg

SEQ ID NO: 596285 - RNA, 22 nt, Human
ggccucugcaacuggcuguggc

SEQ ID NO: 596286 - RNA, 20 nt, Human
uugaggcaugucuagaagua

SEQ ID NO: 596287 - RNA, 22 nt, Human
uuucacagaaagaagcuaguuu

SEQ ID NO: 596288 - RNA, 22 nt, Human
cuuugugcaaacccuagaauca

SEQ ID NO: 596289 - RNA, 22 nt, Human
agaaaucaauaucuauauguug

SEQ ID NO: 596290 - RNA, 22 nt, Human
acaagcagagauuaaauguuuu

SEQ ID NO: 596291 - RNA, 21 nt, Human
gagagggcauuauaggaagug

SEQ ID NO: 596292 - RNA, 22 nt, Human
uggcagagugcagaagaggcau

SEQ ID NO: 596293 - RNA, 22 nt, Human
cauagaaacugagacaaggauu

SEQ ID NO: 596294 - RNA, 20 nt, Human
aaguuucugguuuauaucuu

SEQ ID NO: 596295 - RNA, 22 nt, Human
gugacaggauagucagcuuugu

SEQ ID NO: 596296 - RNA, 22 nt, Human
uaaguguugaucugagugcuaa

SEQ ID NO: 596297 - RNA, 22 nt, Human
caggcagaagaaguggaaggac

SEQ ID NO: 596298 - RNA, 19 nt, Human
ucccucccuguaaucucac

SEQ ID NO: 596299 - RNA, 22 nt, Human
aaacauuccauuucuauguaag

SEQ ID NO: 596300 - RNA, 22 nt, Human
cagaggccucacuuccagccag

SEQ ID NO: 596301 - RNA, 20 nt, Human
cuacacaggguucgcugggc

SEQ ID NO: 596302 - RNA, 22 nt, Human
auuccuuggcauucuggacuug

SEQ ID NO: 596303 - RNA, 22 nt, Human
aguuuuucugcuggucucacua

SEQ ID NO: 596304 - RNA, 22 nt, Human
ucagaacauugacauucuuauu

SEQ ID NO: 596305 - RNA, 23 nt, Human
gcaagugaggcgucagcagucaa

SEQ ID NO: 596306 - RNA, 22 nt, Human
gcaguguuaggaauaaaaauga

SEQ ID NO: 596307 - RNA, 22 nt, Human
caguccaguccaauccucaaug

SEQ ID NO: 596308 - RNA, 22 nt, Human
auccuuggcagcucagaccuac

SEQ ID NO: 596309 - RNA, 16 nt, Human
uagggcugggaaggag

SEQ ID NO: 596310 - RNA, 22 nt, Human
cugccuggcauggagaagagaa

SEQ ID NO: 596311 - RNA, 22 nt, Human
gggaugagaguagggugugaaa

SEQ ID NO: 596312 - RNA, 21 nt, Human
ucaguaaaaaaacuaccuaga

SEQ ID NO: 596313 - RNA, 22 nt, Human
ugcuggagaucauuaauguuca

SEQ ID NO: 596314 - RNA, 22 nt, Human
auaaauaucacuguugucccuc

SEQ ID NO: 596315 - RNA, 22 nt, Human
ccaagugauacacccgccucgg

SEQ ID NO: 596316 - RNA, 22 nt, Human
uagaaagacuguccagauuuca

SEQ ID NO: 596317 - RNA, 22 nt, Human
ccaggcagccaagugugugugu

SEQ ID NO: 596318 - RNA, 22 nt, Human
ugagauggggagggcugcagaa

SEQ ID NO: 596319 - RNA, 22 nt, Human
acccugagucacugucugucug

SEQ ID NO: 596320 - RNA, 22 nt, Human
aaagaucacacuguggggcagu

SEQ ID NO: 596321 - RNA, 22 nt, Human
aguguuucuaaguagaugugaa

SEQ ID NO: 596322 - RNA, 22 nt, Human
aaauguguuccuuugcuacaga

SEQ ID NO: 596323 - RNA, 22 nt, Human
ugagccagaguggagugugccu

SEQ ID NO: 596324 - RNA, 22 nt, Human
cagccccuuguccgguagccac

SEQ ID NO: 596325 - RNA, 22 nt, Human
aagcauauuuuaauuagccaca

SEQ ID NO: 596326 - RNA, 22 nt, Human
agggugggcuagacucuucccc

SEQ ID NO: 596327 - RNA, 22 nt, Human
uggaagagggagcuggguggcc

SEQ ID NO: 596328 - RNA, 22 nt, Human
uccaggcuggagugcaguggcg

SEQ ID NO: 596329 - RNA, 22 nt, Human
uuuccuccuagccuccagccgc

SEQ ID NO: 596330 - RNA, 22 nt, Human
aaagccaugaauguuauagagg

SEQ ID NO: 596331 - RNA, 20 nt, Human
uuugagaccagucugcccaa

SEQ ID NO: 596332 - RNA, 22 nt, Human
aagcauauauuuuauauguugu

SEQ ID NO: 596333 - RNA, 22 nt, Human
aucagaaggggagguaaagaag

SEQ ID NO: 596334 - RNA, 22 nt, Human
ucugucacuuuuauuuacugaa

SEQ ID NO: 596335 - RNA, 22 nt, Human
ugcucuucggggccacugcuug

SEQ ID NO: 596336 - RNA, 22 nt, Human
acaauguuuuuguucaaagagu

SEQ ID NO: 596337 - RNA, 22 nt, Human
aagcacuaggucacacaaguua

SEQ ID NO: 596338 - RNA, 22 nt, Human
gcacagaaaugucuacacaugu

SEQ ID NO: 596339 - RNA, 22 nt, Human
aaauugaaugauuaagugguga

SEQ ID NO: 596340 - RNA, 22 nt, Human
ugagcugucugaauggugagga

SEQ ID NO: 596341 - RNA, 22 nt, Human
ugggccaguccugccuaaggug

SEQ ID NO: 596342 - RNA, 22 nt, Human
ggagccugugggaugagaugug

SEQ ID NO: 596343 - RNA, 22 nt, Human
aggugggguucagucucagccg

SEQ ID NO: 596344 - RNA, 22 nt, Human
cuuucucuguguuucacaugcu

SEQ ID NO: 596345 - RNA, 22 nt, Human
gugagguccugagaggcuugug

SEQ ID NO: 596346 - RNA, 21 nt, Human
uuuauucucagauacagggag

SEQ ID NO: 596347 - RNA, 22 nt, Human
caaguaaagaaucacauuucuu

SEQ ID NO: 596348 - RNA, 20 nt, Human
ugagaagcuccugucuccuc

SEQ ID NO: 596349 - RNA, 22 nt, Human
ucagaggacgcacuaggguugu

SEQ ID NO: 596350 - RNA, 22 nt, Human
gcugaagauuuuugcuagcccc

SEQ ID NO: 596351 - RNA, 22 nt, Human
gcccaggaggcagagguugugg

SEQ ID NO: 596352 - RNA, 22 nt, Human
gccagccccuuagggcucuccc

SEQ ID NO: 596353 - RNA, 22 nt, Human
ccuuacaaugcaguuuacuuag

SEQ ID NO: 596354 - RNA, 22 nt, Human
cugaggccccucucuugagcuu

SEQ ID NO: 596355 - RNA, 22 nt, Human
agcugggaggcuccucugugac

SEQ ID NO: 596356 - RNA, 22 nt, Human
ggcugaguggagguagcccugu

SEQ ID NO: 596357 - RNA, 22 nt, Human
uucugaaaauugggucauacuu

SEQ ID NO: 596358 - RNA, 22 nt, Human
uccugggaguaauugagucaug

SEQ ID NO: 596359 - RNA, 22 nt, Human
auacaaagcuaaauaugguuuc

SEQ ID NO: 596360 - RNA, 22 nt, Human
cggcuggguucggcugcaggcc

SEQ ID NO: 596361 - RNA, 22 nt, Human
gaaguucacauagcuggcaggu

SEQ ID NO: 596362 - RNA, 22 nt, Human
uagggcugcugcagaugacagg

SEQ ID NO: 596363 - RNA, 22 nt, Human
ucucugcuaagauugugucuag

SEQ ID NO: 596364 - RNA, 22 nt, Human
caggacaguuugcuuugcccug

SEQ ID NO: 596365 - RNA, 22 nt, Human
gggagcaggacauaauagcaau

SEQ ID NO: 596366 - RNA, 22 nt, Human
aucauuguaaauaaugcugcca

SEQ ID NO: 596367 - RNA, 22 nt, Human
guucaaauuuuggcuguacugc

SEQ ID NO: 596368 - RNA, 22 nt, Human
caaguuuucuggguucagagca

SEQ ID NO: 596369 - RNA, 22 nt, Human
gacagcuggcaguggaaaggug

SEQ ID NO: 596370 - RNA, 22 nt, Human
acucugaaccagagaucauacc

SEQ ID NO: 596371 - RNA, 22 nt, Human
cccuggaggagcuuagagcuug

SEQ ID NO: 596372 - RNA, 22 nt, Human
ggugugugaggagucacuuagu

SEQ ID NO: 596373 - RNA, 22 nt, Human
ugguccuguguucuuccugccu

SEQ ID NO: 596374 - RNA, 22 nt, Human
caggaacaggcugaugggcagg

SEQ ID NO: 596375 - RNA, 22 nt, Human
augauucuaggcauugaagaua

SEQ ID NO: 596376 - RNA, 22 nt, Human
agcuuugggccacuggcuggau

SEQ ID NO: 596377 - RNA, 22 nt, Human
acauuguuucugaccaugauga

SEQ ID NO: 596378 - RNA, 22 nt, Human
gaccucaggcuucuguaauuaa

SEQ ID NO: 596379 - RNA, 22 nt, Human
ucagguggcugguugcuggcua

SEQ ID NO: 596380 - RNA, 22 nt, Human
uuccuugagaaaggcacaaguu

SEQ ID NO: 596381 - RNA, 22 nt, Human
guuucugagcacuuuuauugca

SEQ ID NO: 596382 - RNA, 22 nt, Human
ccaggucucgggucugcucgug

SEQ ID NO: 596383 - RNA, 22 nt, Human
uuacacuaagcuacuucuauau

SEQ ID NO: 596384 - RNA, 22 nt, Human
ucaggccacuucacaggugauu

SEQ ID NO: 596385 - RNA, 22 nt, Human
ugccuggaugugcuggccucac

SEQ ID NO: 596386 - RNA, 22 nt, Human
auucuagacaucugcaguuguu

SEQ ID NO: 596387 - RNA, 22 nt, Human
gaaacuagauguauuagagauu

SEQ ID NO: 596388 - RNA, 22 nt, Human
uuacagaagaguaacuuggcaa

SEQ ID NO: 596389 - RNA, 22 nt, Human
gcauguggccuucaggcuggaa

SEQ ID NO: 596390 - RNA, 22 nt, Human
gcacacaugcaugugugcaucc

SEQ ID NO: 596391 - RNA, 22 nt, Human
cacaggaaguggucagugccag

SEQ ID NO: 596392 - RNA, 22 nt, Human
gcugucagugaggugagacaug

SEQ ID NO: 596393 - RNA, 22 nt, Human
aaagcaauuacaaaagggauaa

SEQ ID NO: 596394 - RNA, 22 nt, Human
ccuucucuacuccugaugcaug

SEQ ID NO: 596395 - RNA, 22 nt, Human
gugcagcugugugagagcucca

SEQ ID NO: 596396 - RNA, 22 nt, Human
uggcugccgacuggcucuuggc

SEQ ID NO: 596397 - RNA, 20 nt, Human
uuguuucugcuauuuucuaa

SEQ ID NO: 596398 - RNA, 22 nt, Human
acaagcauaagugagaugaaua

SEQ ID NO: 596399 - RNA, 22 nt, Human
agucccuggauugucucuguca

SEQ ID NO: 596400 - RNA, 22 nt, Human
ugaggugguucaagagccuugu

SEQ ID NO: 596401 - RNA, 22 nt, Human
uccuucagccaugggcucucca

SEQ ID NO: 596402 - RNA, 23 nt, Human
aagaacuuugguccugcagaguc

SEQ ID NO: 596403 - RNA, 22 nt, Human
cagaagugaaugugauaaacca

SEQ ID NO: 596404 - RNA, 21 nt, Human
guuauugaccuccaggcuggc

SEQ ID NO: 596405 - RNA, 22 nt, Human
acacuguuccacacuaagaagg

SEQ ID NO: 596406 - RNA, 22 nt, Human
guguauaacccaaauaugcugc

SEQ ID NO: 596407 - RNA, 22 nt, Human
ccaggcccuugcaagucccacc

SEQ ID NO: 596408 - RNA, 19 nt, Human
cuguggccuccaggaggga

SEQ ID NO: 596409 - RNA, 22 nt, Human
ugguuuuagaugccuuuacugc

SEQ ID NO: 596410 - RNA, 22 nt, Human
cuaguguuuauuaaucaugagg

SEQ ID NO: 596411 - RNA, 22 nt, Human
auuuagcaccuccaucucaaca

SEQ ID NO: 596412 - RNA, 22 nt, Human
cacuguugaagauacuuccucu

SEQ ID NO: 596413 - RNA, 22 nt, Human
agcugcccuggcggagcugcuc

SEQ ID NO: 596414 - RNA, 21 nt, Human
cccaggaguccuauuuaaaug

SEQ ID NO: 596415 - RNA, 22 nt, Human
aacaggcaacaguugacucuga

SEQ ID NO: 596416 - RNA, 22 nt, Human
acauucugggugauguucuuca

SEQ ID NO: 596417 - RNA, 22 nt, Human
agggggagcuuggcuacuccug

SEQ ID NO: 596418 - RNA, 22 nt, Human
agcagguggccuccugucuguc

SEQ ID NO: 596419 - RNA, 22 nt, Human
auggagggaaaaguggagagcc

SEQ ID NO: 596420 - RNA, 22 nt, Human
ucaccaggcuggaaugcagugg

SEQ ID NO: 596421 - RNA, 20 nt, Human
gcuucagaaccugggugcug

SEQ ID NO: 596422 - RNA, 22 nt, Human
ugcagugguguccagguguacu

SEQ ID NO: 596423 - RNA, 22 nt, Human
aggcaccuugagagcaggagcu

SEQ ID NO: 596424 - RNA, 22 nt, Human
ucacauucucagcaucuauaca

SEQ ID NO: 596425 - RNA, 22 nt, Human
aggaaacugggccucagguuag

SEQ ID NO: 596426 - RNA, 22 nt, Human
uauauauaugcacacacaccua

SEQ ID NO: 596427 - RNA, 22 nt, Human
caugcaguguguaucuacuuaa

SEQ ID NO: 596428 - RNA, 20 nt, Human
acaugcaguggucauuucag

SEQ ID NO: 596429 - RNA, 22 nt, Human
acauccucggggaaaggcacug

SEQ ID NO: 596430 - RNA, 22 nt, Human
ucuccaggugaaacuugcaggg

SEQ ID NO: 596431 - RNA, 20 nt, Human
ucauaaagaggaaauaaaua

SEQ ID NO: 596432 - RNA, 22 nt, Human
cagcuguugucucucacauauu

SEQ ID NO: 596433 - RNA, 22 nt, Human
ucacagagagugacuuguugcu

SEQ ID NO: 596434 - RNA, 22 nt, Human
uuaagauagaacccaguagucu

SEQ ID NO: 596435 - RNA, 22 nt, Human
cccugggcucagagcagguagc

SEQ ID NO: 596436 - RNA, 20 nt, Human
agcauacaucauaagaaacc

SEQ ID NO: 596437 - RNA, 22 nt, Human
gugccuuugagaaguuucucug

SEQ ID NO: 596438 - RNA, 22 nt, Human
agggcuccuaugccccauggac

SEQ ID NO: 596439 - RNA, 22 nt, Human
agcuuccugacuggugcucuua

SEQ ID NO: 596440 - RNA, 22 nt, Human
gcugugagaaacagggaguguc

SEQ ID NO: 596441 - RNA, 22 nt, Human
ucuggagauaagacagacagau

SEQ ID NO: 596442 - RNA, 22 nt, Human
gccucaguguccuccuccaugu

SEQ ID NO: 596443 - RNA, 22 nt, Human
gcgacgcucgggcuccgaugcc

SEQ ID NO: 596444 - RNA, 22 nt, Human
ggcugagaguggaucccaggga

SEQ ID NO: 596445 - RNA, 22 nt, Human
aggaggggcaaugauagucugg

SEQ ID NO: 596446 - RNA, 22 nt, Human
agacaguggaucgggaugcacu

SEQ ID NO: 596447 - RNA, 22 nt, Human
uagcuuugcaaaggaaguuuua

SEQ ID NO: 596448 - RNA, 22 nt, Human
ggcacugacugugcagcgcacc

SEQ ID NO: 596449 - RNA, 22 nt, Human
acuuucaagcaagaacacuuug

SEQ ID NO: 596450 - RNA, 22 nt, Human
uuucaacaucaccuagcaguuc

SEQ ID NO: 596451 - RNA, 22 nt, Human
uauuuguugaguuguuaugucu

SEQ ID NO: 596452 - RNA, 22 nt, Human
guggggaguguucugugauugg

SEQ ID NO: 596453 - RNA, 22 nt, Human
caagggaguuacugagggcggg

SEQ ID NO: 596454 - RNA, 22 nt, Human
ggcacugggugagggucacugg

SEQ ID NO: 596455 - RNA, 22 nt, Human
agagugcuuaguagugacaugg

SEQ ID NO: 596456 - RNA, 19 nt, Human
uucauucuuucuacuuacc

SEQ ID NO: 596457 - RNA, 18 nt, Human
ucucucagggaaacagaa

SEQ ID NO: 596458 - RNA, 22 nt, Human
ccagcuucaugggcaugcacca

SEQ ID NO: 596459 - RNA, 22 nt, Human
cuagucucuggaggucagggcu

SEQ ID NO: 596460 - RNA, 22 nt, Human
acaucuucacugguuucuggaa

SEQ ID NO: 596461 - RNA, 22 nt, Human
uuauggaaaauacaauuauaag

SEQ ID NO: 596462 - RNA, 22 nt, Human
uggggaugaaacccaggcaucu

SEQ ID NO: 596463 - RNA, 22 nt, Human
gaggcugcugagagcccuguuu

SEQ ID NO: 596464 - RNA, 22 nt, Human
agcaugcuuggcauuugucaga

SEQ ID NO: 596465 - RNA, 22 nt, Human
uaguuacaaaccaacaggcagc

SEQ ID NO: 596466 - RNA, 22 nt, Human
ugcaguucuaucacccaccccg

SEQ ID NO: 596467 - RNA, 22 nt, Human
ccagucccaggcagaaauccag

SEQ ID NO: 596468 - RNA, 22 nt, Human
gaaggcugcgaggggagugccg

SEQ ID NO: 596469 - RNA, 22 nt, Human
gcaugugucuccccaguggagg

SEQ ID NO: 596470 - RNA, 22 nt, Human
cacaguguuccagagcaguggu

SEQ ID NO: 596471 - RNA, 18 nt, Human
ccacuuugcagccuggcc

SEQ ID NO: 596472 - RNA, 22 nt, Human
cacuacagggguccacagcuga

SEQ ID NO: 596473 - RNA, 22 nt, Human
agauauuuguaucuugcuauug

SEQ ID NO: 596474 - RNA, 21 nt, Human
cacacagugaucuauccacau

SEQ ID NO: 596475 - RNA, 22 nt, Human
cacaguuucugaacacuuugca

SEQ ID NO: 596476 - RNA, 22 nt, Human
uaaacagagugcuaguucacgg

SEQ ID NO: 596477 - RNA, 22 nt, Human
acauacaucaaguaucacaaga

SEQ ID NO: 596478 - RNA, 22 nt, Human
cagaggaacguuuggauugauu

SEQ ID NO: 596479 - RNA, 22 nt, Human
cugaaggaagcagguggccugu

SEQ ID NO: 596480 - RNA, 22 nt, Human
ccaagcuucuuuccuacuacag

SEQ ID NO: 596481 - RNA, 22 nt, Human
uuucaaauaccauaaaccuaau

SEQ ID NO: 596482 - RNA, 22 nt, Human
aagcaaggcaaccuauguccag

SEQ ID NO: 596483 - RNA, 22 nt, Human
ugaaggagcugauguaaggggu

SEQ ID NO: 596484 - RNA, 22 nt, Human
ugcuuagacgucaaguacagcc

SEQ ID NO: 596485 - RNA, 22 nt, Human
cagcaucccucaggggccucug

SEQ ID NO: 596486 - RNA, 22 nt, Human
auugagaaaauucgagcaaguu

SEQ ID NO: 596487 - RNA, 22 nt, Human
gaguccaguuagugaggcuggg

SEQ ID NO: 596488 - RNA, 22 nt, Human
uagggcagaguccaggaugggc

SEQ ID NO: 596489 - RNA, 22 nt, Human
acagucucuccacacugcaggg

SEQ ID NO: 596490 - RNA, 19 nt, Human
augcuuuauguuauuucuu

SEQ ID NO: 596491 - RNA, 22 nt, Human
ugugccaagacuauauugugcu

SEQ ID NO: 596492 - RNA, 22 nt, Human
guuuccacgucucaguuccaaa

SEQ ID NO: 596493 - RNA, 22 nt, Human
gugcaguugauaguuuuaguga

SEQ ID NO: 596494 - RNA, 22 nt, Human
gcuggugagcaaaggagaagga

SEQ ID NO: 596495 - RNA, 22 nt, Human
gacccuggaguuaguccugugu

SEQ ID NO: 596496 - RNA, 22 nt, Human
uuccuggugagauuucguucug

SEQ ID NO: 596497 - RNA, 22 nt, Human
ugugugugcacaugcauauaca

SEQ ID NO: 596498 - RNA, 19 nt, Human
cccaggagcaguauugaug

SEQ ID NO: 596499 - RNA, 19 nt, Human
cccagagcauccugaacuu

SEQ ID NO: 596500 - RNA, 22 nt, Human
acacauagaaaauaaauaguua

SEQ ID NO: 596501 - RNA, 22 nt, Human
ggaagcuguugugagugcagca

SEQ ID NO: 596502 - RNA, 22 nt, Human
cugaugcuauaagccacagugg

SEQ ID NO: 596503 - RNA, 22 nt, Human
aguucuagaagacuuuuccauu

SEQ ID NO: 596504 - RNA, 22 nt, Human
gaaugagacuaugcgaguguga

SEQ ID NO: 596505 - RNA, 22 nt, Human
aggugcuggcgccccaggagac

SEQ ID NO: 596506 - RNA, 22 nt, Human
uuuuccuggagauggaguuguu

SEQ ID NO: 596507 - RNA, 22 nt, Human
acuuccagccccugucagcaaa

SEQ ID NO: 596508 - RNA, 22 nt, Human
cagagggcccccuggccacagu

SEQ ID NO: 596509 - RNA, 22 nt, Human
aaugcuuugagggaagaugaaa

SEQ ID NO: 596510 - RNA, 17 nt, Human
cagucacaggucuuuuc

SEQ ID NO: 596511 - RNA, 22 nt, Human
uacauacaugguggaaugguua

SEQ ID NO: 596512 - RNA, 22 nt, Human
gcuuaaacccaggaaguugugg

SEQ ID NO: 596513 - RNA, 22 nt, Human
uacagcuuaaaagaugcauuua

SEQ ID NO: 596514 - RNA, 22 nt, Human
ugaaggcauugaugaaggaauc

SEQ ID NO: 596515 - RNA, 22 nt, Human
cugcaagccaagcugagagccu

SEQ ID NO: 596516 - RNA, 22 nt, Human
aggcccuguaagguguggagau

SEQ ID NO: 596517 - RNA, 22 nt, Human
acagaacugcaggaggaaaagc

SEQ ID NO: 596518 - RNA, 22 nt, Human
uguggucuccccagugccagcu

SEQ ID NO: 596519 - RNA, 22 nt, Human
ucugagcugggcacagaaggcg

SEQ ID NO: 596520 - RNA, 22 nt, Human
gggauggaggguagagcaagug

SEQ ID NO: 596521 - RNA, 22 nt, Human
cucuccaucugugugaccuccc

SEQ ID NO: 596522 - RNA, 22 nt, Human
gggcccuggacguggcggcaga

SEQ ID NO: 596523 - RNA, 22 nt, Human
uacaggcauguagcauggugau

SEQ ID NO: 596524 - RNA, 21 nt, Human
ugggcacugagggugcugcuc

SEQ ID NO: 596525 - RNA, 20 nt, Human
ccaggcuggcaaaugggggc

SEQ ID NO: 596526 - RNA, 22 nt, Human
acauagcuuaaaugagaagaua

SEQ ID NO: 596527 - RNA, 22 nt, Human
cuggguggcgucuggggccagu

SEQ ID NO: 596528 - RNA, 22 nt, Human
aagucucuuuaccucuccaggc

SEQ ID NO: 596529 - RNA, 22 nt, Human
acaggucagauaaaggcuggug

SEQ ID NO: 596530 - RNA, 22 nt, Human
cuugggaguagaggcaggagca

SEQ ID NO: 596531 - RNA, 22 nt, Human
ggccucagaccggagcuggcca

SEQ ID NO: 596532 - RNA, 22 nt, Human
cugaggccuguguuggggcagu

SEQ ID NO: 596533 - RNA, 22 nt, Human
uaaacaucugaauccugcuucc

SEQ ID NO: 596534 - RNA, 22 nt, Human
ucucuucuaauuaggguccaug

SEQ ID NO: 596535 - RNA, 22 nt, Human
agugcagauuuuuagucagcuu

SEQ ID NO: 596536 - RNA, 22 nt, Human
aaucacaugaaaacuguguguu

SEQ ID NO: 596537 - RNA, 19 nt, Human
agcuccuguucagcagcuc

SEQ ID NO: 596538 - RNA, 22 nt, Human
auuuauugaagcuuauuacguu

SEQ ID NO: 596539 - RNA, 22 nt, Human
acuucacagguuuucauaaaac

SEQ ID NO: 596540 - RNA, 22 nt, Human
gccuucaguaacugagacggaa

SEQ ID NO: 596541 - RNA, 22 nt, Human
cuagagaaaaugauagcaggaa

SEQ ID NO: 596542 - RNA, 22 nt, Human
ggucccagcuggucacugucag

SEQ ID NO: 596543 - RNA, 22 nt, Human
aguaggaggcgggagcaugaag

SEQ ID NO: 596544 - RNA, 23 nt, Human
uuaugcuuuggcacucuuguuag

SEQ ID NO: 596545 - RNA, 22 nt, Human
gggucugggcaggcgcuuccuc

SEQ ID NO: 596546 - RNA, 22 nt, Human
ugagaggauauuuugggaggau

SEQ ID NO: 596547 - RNA, 22 nt, Human
aaauguuuugcucccauguggu

SEQ ID NO: 596548 - RNA, 22 nt, Human
cagcugugggccugacguggca

SEQ ID NO: 596549 - RNA, 22 nt, Human
auguguguguuuaauccucaaa

SEQ ID NO: 596550 - RNA, 22 nt, Human
ucuguaaaacuucuuuguaaau

SEQ ID NO: 596551 - RNA, 22 nt, Human
uuagaucuuaggcaaauguguu

SEQ ID NO: 596552 - RNA, 22 nt, Human
ugggagcacucuuugggaagca

SEQ ID NO: 596553 - RNA, 22 nt, Human
aaggccacgucuccuuccagag

SEQ ID NO: 596554 - RNA, 22 nt, Human
cagagcuggagcuugaauggag

SEQ ID NO: 596555 - RNA, 22 nt, Human
gaaacccugagagguggucugg

SEQ ID NO: 596556 - RNA, 22 nt, Human
aggcaaaagaaugucauaaaug

SEQ ID NO: 596557 - RNA, 22 nt, Human
acacuaguagaauaguguuugc

SEQ ID NO: 596558 - RNA, 22 nt, Human
aggagcugcauggauaccuggu

SEQ ID NO: 596559 - RNA, 22 nt, Human
uaacaaugggaaggacugauga

SEQ ID NO: 596560 - RNA, 22 nt, Human
gcagauggcagcccaggcuggg

SEQ ID NO: 596561 - RNA, 20 nt, Human
uauuucugggcaaccauuua

SEQ ID NO: 596562 - RNA, 22 nt, Human
ucccuggguucccguggaagug

SEQ ID NO: 596563 - RNA, 22 nt, Human
aaaauauuuuagggccaggaga

SEQ ID NO: 596564 - RNA, 22 nt, Human
uagggaugauggagccuaugua

SEQ ID NO: 596565 - RNA, 22 nt, Human
cuagcacagcccauucagucua

SEQ ID NO: 596566 - RNA, 22 nt, Human
guuauuauuucucuccuugcua

SEQ ID NO: 596567 - RNA, 22 nt, Human
cuguggcacauguggcaaggcc

SEQ ID NO: 596568 - RNA, 22 nt, Human
gagagcuguguucauucuacca

SEQ ID NO: 596569 - RNA, 22 nt, Human
caugaguucaaaaugccugccu

SEQ ID NO: 596570 - RNA, 22 nt, Human
uccugaagagcccugcucugug

SEQ ID NO: 596571 - RNA, 22 nt, Human
agggucagugaugagggagccc

SEQ ID NO: 596572 - RNA, 22 nt, Human
aguucuauaauuaaaaugaagg

SEQ ID NO: 596573 - RNA, 21 nt, Human
gcuucuguaucuagcaggaac

SEQ ID NO: 596574 - RNA, 22 nt, Human
cuagaacaaauuaggaggcaua

SEQ ID NO: 596575 - RNA, 16 nt, Human
uggagcaggcaggaug

SEQ ID NO: 596576 - RNA, 22 nt, Human
cugggccagggaggugucugua

SEQ ID NO: 596577 - RNA, 22 nt, Human
aauuagcuuauguguacuuuuc

SEQ ID NO: 596578 - RNA, 22 nt, Human
aaggcagcaggauuuggugacu

SEQ ID NO: 596579 - RNA, 22 nt, Human
ucagggaagacuucuuagagga

SEQ ID NO: 596580 - RNA, 22 nt, Human
ucucugagcuuaagguguuuca

SEQ ID NO: 596581 - RNA, 22 nt, Human
aaacuguaagagaauaaacuac

SEQ ID NO: 596582 - RNA, 22 nt, Human
cugagccagcgggcucacuuuu

SEQ ID NO: 596583 - RNA, 22 nt, Human
uugcagggcaaauggucagaua

SEQ ID NO: 596584 - RNA, 22 nt, Human
agcucccagcagagcuggccac

SEQ ID NO: 596585 - RNA, 22 nt, Human
gucaagcagaagauaauuuaaa

SEQ ID NO: 596586 - RNA, 22 nt, Human
aaggcugaggagggccugcagg

SEQ ID NO: 596587 - RNA, 22 nt, Human
ugcuggagacauagcaggcagc

SEQ ID NO: 596588 - RNA, 22 nt, Human
uaccucucuaaacccagggaca

SEQ ID NO: 596589 - RNA, 22 nt, Human
gaagcagaacccacuccccaac

SEQ ID NO: 596590 - RNA, 22 nt, Human
agggcccaggacagcaucaggg

SEQ ID NO: 596591 - RNA, 22 nt, Human
ucucagucagccuugauguccc

SEQ ID NO: 596592 - RNA, 22 nt, Human
agcccccagucuaaacuguugg

SEQ ID NO: 596593 - RNA, 22 nt, Human
ccccagaaggggacagagggua

SEQ ID NO: 596594 - RNA, 22 nt, Human
cauccagcuccugggggccacc

SEQ ID NO: 596595 - RNA, 22 nt, Human
cugcuucuaagaaccugcagcu

SEQ ID NO: 596596 - RNA, 22 nt, Human
cacagcagacagggaggcggcu

SEQ ID NO: 596597 - RNA, 22 nt, Human
uauacuuuccugcaacuuugau

SEQ ID NO: 596598 - RNA, 22 nt, Human
ugaggcccggguggaggaaugc

SEQ ID NO: 596599 - RNA, 22 nt, Human
gaagcaguagcaacugugucuu

SEQ ID NO: 596600 - RNA, 22 nt, Human
ucuauuuucuugccaaaacugc

SEQ ID NO: 596601 - RNA, 22 nt, Human
aggcucuguuugcugugguacc

SEQ ID NO: 596602 - RNA, 23 nt, Human
gcuaggugcuuccacacgugcug

SEQ ID NO: 596603 - RNA, 22 nt, Human
cagggagcugacaaccaaggag

SEQ ID NO: 596604 - RNA, 22 nt, Human
gccugcuuugugccugaucuuu

SEQ ID NO: 596605 - RNA, 22 nt, Human
agaaacuauccugaguagcaaa

SEQ ID NO: 596606 - RNA, 22 nt, Human
uaggacuuggugacucucaaug

SEQ ID NO: 596607 - RNA, 22 nt, Human
aauauuuguuaguguuuuaaug

SEQ ID NO: 596608 - RNA, 22 nt, Human
auuuguaccaucugguauacag

SEQ ID NO: 596609 - RNA, 19 nt, Human
ccugggagucagcugaagg

SEQ ID NO: 596610 - RNA, 22 nt, Human
agcaggaaagaaaaaucugugu

SEQ ID NO: 596611 - RNA, 22 nt, Human
aaauuuuaguaaggaaguugag

SEQ ID NO: 596612 - RNA, 23 nt, Human
ggcuucagugagagucccugcug

SEQ ID NO: 596613 - RNA, 22 nt, Human
cagcagcuuugccaagucagcc

SEQ ID NO: 596614 - RNA, 19 nt, Human
cacaguccuauguuuauca

SEQ ID NO: 596615 - RNA, 22 nt, Human
ucaagaauagcugcaaacaggg

SEQ ID NO: 596616 - RNA, 22 nt, Human
ugaggccuggacucugcaugga

SEQ ID NO: 596617 - RNA, 22 nt, Human
ggcccagcucuauugaauuaca

SEQ ID NO: 596618 - RNA, 22 nt, Human
gggcacugaaugccaagcuagg

SEQ ID NO: 596619 - RNA, 22 nt, Human
caaaugcuacuaauaggcaagu

SEQ ID NO: 596620 - RNA, 22 nt, Human
ggguaugauagggaggugaaau

SEQ ID NO: 596621 - RNA, 22 nt, Human
uagagcuguaucaaagagccuu

SEQ ID NO: 596622 - RNA, 22 nt, Human
caugccuguaaucccagcucuu

SEQ ID NO: 596623 - RNA, 22 nt, Human
aagugucugcuggcucuacccu

SEQ ID NO: 596624 - RNA, 22 nt, Human
aggcucugaguagagcugccag

SEQ ID NO: 596625 - RNA, 22 nt, Human
acugggaagacaagaaagauag

SEQ ID NO: 596626 - RNA, 22 nt, Human
ucccagaggacuguuggugcua

SEQ ID NO: 596627 - RNA, 22 nt, Human
ugcauuuaguuaugagaaaaac

SEQ ID NO: 596628 - RNA, 22 nt, Human
gaguuauuucagaaggaaagau

SEQ ID NO: 596629 - RNA, 21 nt, Human
aauggcuuauacagaaguaag

SEQ ID NO: 596630 - RNA, 22 nt, Human
acaguguucaaaccacuaggcu

SEQ ID NO: 596631 - RNA, 22 nt, Human
ucuguucuaagcauucuaugug

SEQ ID NO: 596632 - RNA, 22 nt, Human
aaacuggguuguggucaguggu

SEQ ID NO: 596633 - RNA, 22 nt, Human
ccuuuacaguaugguuguauca

SEQ ID NO: 596634 - RNA, 23 nt, Human
cugacucaucccaccaccuccuc

SEQ ID NO: 596635 - RNA, 22 nt, Human
cugaagcaaaugaaacagcucu

SEQ ID NO: 596636 - RNA, 22 nt, Human
caucuacaggagaaugucacug

SEQ ID NO: 596637 - RNA, 22 nt, Human
augaagucucuuuuucaugaga

SEQ ID NO: 596638 - RNA, 22 nt, Human
gugggcagccuccuuuauuuuc

SEQ ID NO: 596639 - RNA, 22 nt, Human
caggcgagggcccugaggagcc

SEQ ID NO: 596640 - RNA, 22 nt, Human
agcugauuccacuuuuucccca

SEQ ID NO: 596641 - RNA, 22 nt, Human
gaggcugagacucugaauuuuu

SEQ ID NO: 596642 - RNA, 23 nt, Human
uccugagaugagacagugcugcc

SEQ ID NO: 596643 - RNA, 22 nt, Human
uggcuaggcuccaagagcugga

SEQ ID NO: 596644 - RNA, 22 nt, Human
acacacaugguauuguucagaa

SEQ ID NO: 596645 - RNA, 22 nt, Human
gugcaaaagcaauugcaguuuu

SEQ ID NO: 596646 - RNA, 22 nt, Human
auuaaacaauguaaaguucuug

SEQ ID NO: 596647 - RNA, 22 nt, Human
gagcacagggaauagacagaua

SEQ ID NO: 596648 - RNA, 22 nt, Human
uaauggagauuuagcacuuacg

SEQ ID NO: 596649 - RNA, 22 nt, Human
ugccaggcgugguggugcgcac

SEQ ID NO: 596650 - RNA, 22 nt, Human
gauggguacucguuggacugag

SEQ ID NO: 596651 - RNA, 22 nt, Human
ugugucugaacaugcuuuguaa

SEQ ID NO: 596652 - RNA, 22 nt, Human
agauggcuccaguguccagagg

SEQ ID NO: 596653 - RNA, 22 nt, Human
auuugauuagcuguguaauuuu

SEQ ID NO: 596654 - RNA, 22 nt, Human
auuauucaaauucccacuauac

SEQ ID NO: 596655 - RNA, 22 nt, Human
uuucaacucaugcuaaaggaag

SEQ ID NO: 596656 - RNA, 22 nt, Human
auuucagaauguccuaauuuag

SEQ ID NO: 596657 - RNA, 22 nt, Human
cacauuuaucuguucuuucuag

SEQ ID NO: 596658 - RNA, 21 nt, Human
uccaggaguggcugggcaggg

SEQ ID NO: 596659 - RNA, 22 nt, Human
ugcccaggcuccucgcagccuu

SEQ ID NO: 596660 - RNA, 20 nt, Human
gccuggcacccggggcuggc

SEQ ID NO: 596661 - RNA, 22 nt, Human
agggcagcacaaggcauggacu

SEQ ID NO: 596662 - RNA, 22 nt, Human
uggcugcugagaaggcagcugu

SEQ ID NO: 596663 - RNA, 22 nt, Human
agaaagcagucccuuccgaccg

SEQ ID NO: 596664 - RNA, 22 nt, Human
aaugcaguuucauuuguagaau

SEQ ID NO: 596665 - RNA, 22 nt, Human
gccugucugcgucacgcuuauu

SEQ ID NO: 596666 - RNA, 22 nt, Human
uuguggaagcccuaugagagac

SEQ ID NO: 596667 - RNA, 22 nt, Human
cugaggaggggccugagugaga

SEQ ID NO: 596668 - RNA, 22 nt, Human
uucaauuucauaauaucuagcu

SEQ ID NO: 596669 - RNA, 22 nt, Human
cauggcaauaaaccuacacagu

SEQ ID NO: 596670 - RNA, 22 nt, Human
cuuucuaguugacagcaugcca

SEQ ID NO: 596671 - RNA, 22 nt, Human
uggcucagcaagacauugaccu

SEQ ID NO: 596672 - RNA, 22 nt, Human
gugcucugaucugucugacauc

SEQ ID NO: 596673 - RNA, 22 nt, Human
augggaggcaggcucagaaccg

SEQ ID NO: 596674 - RNA, 23 nt, Human
uggccaggcauaaaggugggugg

SEQ ID NO: 596675 - RNA, 23 nt, Human
gggaagcuccauggaggugcugg

SEQ ID NO: 596676 - RNA, 19 nt, Human
uccaggaggcugccauuga

SEQ ID NO: 596677 - RNA, 20 nt, Human
agaagcauucaaagaaaacu

SEQ ID NO: 596678 - RNA, 22 nt, Human
aggaaggggagaaguuaaagcu

SEQ ID NO: 596679 - RNA, 23 nt, Human
cugcuguguuggucucgauggga

SEQ ID NO: 596680 - RNA, 22 nt, Human
aggcugagggcuccugagggca

SEQ ID NO: 596681 - RNA, 22 nt, Human
uucaauucugaugaaggcaaua

SEQ ID NO: 596682 - RNA, 22 nt, Human
ugccagggccauagggagucua

SEQ ID NO: 596683 - RNA, 22 nt, Human
aggcucugucaggcggagcagc

SEQ ID NO: 596684 - RNA, 22 nt, Human
aaaguuacuaucacaaugaaau

SEQ ID NO: 596685 - RNA, 22 nt, Human
agguaucaacagcagagucuga

SEQ ID NO: 596686 - RNA, 22 nt, Human
cacauguuuggcaugucaccaa

SEQ ID NO: 596687 - RNA, 22 nt, Human
ucuuuauacaaacugggaaaca

SEQ ID NO: 596688 - RNA, 22 nt, Human
aguccauacauugagaauaaca

SEQ ID NO: 596689 - RNA, 22 nt, Human
gauggcagcagcagccagggau

SEQ ID NO: 596690 - RNA, 22 nt, Human
cagaaggcuuuguggaguagac

SEQ ID NO: 596691 - RNA, 22 nt, Human
ggagauaguccaggugaaggga

SEQ ID NO: 596692 - RNA, 22 nt, Human
acugugugcccugacgccaggg

SEQ ID NO: 596693 - RNA, 22 nt, Human
caggccaacugcauggugacca

SEQ ID NO: 596694 - RNA, 22 nt, Human
ugcucaguccuccugcagugcc

SEQ ID NO: 596695 - RNA, 22 nt, Human
ucugcaacauuccucuccccac

SEQ ID NO: 596696 - RNA, 19 nt, Human
gcucagagucccccugcgg

SEQ ID NO: 596697 - RNA, 22 nt, Human
cuucccugauaagagccucaga

SEQ ID NO: 596698 - RNA, 22 nt, Human
aaacuccugcauacucagaagc

SEQ ID NO: 596699 - RNA, 22 nt, Human
cuggagucuucagcuugcugcc

SEQ ID NO: 596700 - RNA, 19 nt, Human
uucuggucuggaaucaagg

SEQ ID NO: 596701 - RNA, 22 nt, Human
cugcugucauagccaucccucc

SEQ ID NO: 596702 - RNA, 22 nt, Human
gacaacugagcagaggaaauga

SEQ ID NO: 596703 - RNA, 22 nt, Human
ugacagggggcagagguggcug

SEQ ID NO: 596704 - RNA, 22 nt, Human
caaaguuuggcucucaugacau

SEQ ID NO: 596705 - RNA, 22 nt, Human
auguacauaaaauguauaauga

SEQ ID NO: 596706 - RNA, 23 nt, Human
cuguggcccugcuucaugcagcc

SEQ ID NO: 596707 - RNA, 22 nt, Human
aucacaaaggguuuucucugag

SEQ ID NO: 596708 - RNA, 20 nt, Human
uacuuugaucugauaagcaa

SEQ ID NO: 596709 - RNA, 22 nt, Human
cagaggcaggauaagaacugcg

SEQ ID NO: 596710 - RNA, 22 nt, Human
gagaggccauggggugggaugc

SEQ ID NO: 596711 - RNA, 22 nt, Human
uuggaucauggaaugucugcuu

SEQ ID NO: 596712 - RNA, 22 nt, Human
agcagccuuugaucaucuggga

SEQ ID NO: 596713 - RNA, 22 nt, Human
ucaguggaguauggaugaaguc

SEQ ID NO: 596714 - RNA, 22 nt, Human
aaguuugguccuucuaagaaga

SEQ ID NO: 596715 - RNA, 22 nt, Human
aagauucuacaguagguacauu

SEQ ID NO: 596716 - RNA, 22 nt, Human
aggcugcuucaauggauaagau

SEQ ID NO: 596717 - RNA, 22 nt, Human
ugggagcagcuuugcgagggag

SEQ ID NO: 596718 - RNA, 22 nt, Human
gcuuucuggagccugggggaac

SEQ ID NO: 596719 - RNA, 22 nt, Human
uugauucugggcucauuucuuu

SEQ ID NO: 596720 - RNA, 19 nt, Human
ugcccccagcaccucccug

SEQ ID NO: 596721 - RNA, 20 nt, Human
agccaggccucaaguuaagu

SEQ ID NO: 596722 - RNA, 22 nt, Human
auuaaauuggaucugcauaguu

SEQ ID NO: 596723 - RNA, 22 nt, Human
cacuuaaaucuguugagaaaaa

SEQ ID NO: 596724 - RNA, 17 nt, Human
agcagcuggguugaucu

SEQ ID NO: 596725 - RNA, 22 nt, Human
uuuauagaugucuguauuauaa

SEQ ID NO: 596726 - RNA, 22 nt, Human
cagagcugcucaugguggccag

SEQ ID NO: 596727 - RNA, 22 nt, Human
uucugugugccagaguugugcu

SEQ ID NO: 596728 - RNA, 22 nt, Human
caccagcuuugcccacugccca

SEQ ID NO: 596729 - RNA, 22 nt, Human
ugagcaggauucgccucuugca

SEQ ID NO: 596730 - RNA, 22 nt, Human
gauuuccucacuaacauccauc

SEQ ID NO: 596731 - RNA, 22 nt, Human
uuauaggaaaaguucuagaaaa

SEQ ID NO: 596732 - RNA, 22 nt, Human
uuguuaucaaugaaucaaaacu

SEQ ID NO: 596733 - RNA, 22 nt, Human
auucuugcaguauacaacuacu

SEQ ID NO: 596734 - RNA, 22 nt, Human
acagccagguaaaggcauggca

SEQ ID NO: 596735 - RNA, 22 nt, Human
uaagcaaucuaaaagccuuacc

SEQ ID NO: 596736 - RNA, 22 nt, Human
gagaagcaaucgugacaucucc

SEQ ID NO: 596737 - RNA, 22 nt, Human
ccugugccugccugugaguucu

SEQ ID NO: 596738 - RNA, 22 nt, Human
caucacaugccuaucaugagcu

SEQ ID NO: 596739 - RNA, 22 nt, Human
ugagccguggucucugagggug

SEQ ID NO: 596740 - RNA, 22 nt, Human
aaaugcugaguguuuagagauc

SEQ ID NO: 596741 - RNA, 22 nt, Human
cugcagccuaggugcagcuggg

SEQ ID NO: 596742 - RNA, 22 nt, Human
ucugcacauggcgcugguccug

SEQ ID NO: 596743 - RNA, 22 nt, Human
auauaaagagcuuaguauagug

SEQ ID NO: 596744 - RNA, 17 nt, Human
auccuucuguucuuucu

SEQ ID NO: 596745 - RNA, 22 nt, Human
uccugccucuccaugcuaacua

SEQ ID NO: 596746 - RNA, 22 nt, Human
ggccagucugggccacggucgg

SEQ ID NO: 596747 - RNA, 22 nt, Human
ucacauuugcuaucccacuccu

SEQ ID NO: 596748 - RNA, 22 nt, Human
cugaggccagaacccgacccug

SEQ ID NO: 596749 - RNA, 22 nt, Human
cuuuucuucucacggcugucag

SEQ ID NO: 596750 - RNA, 22 nt, Human
ccuggagcaucaggaggaaggg

SEQ ID NO: 596751 - RNA, 22 nt, Human
ugagguagggaguuuguuguug

SEQ ID NO: 596752 - RNA, 22 nt, Human
uccuugagccucccagacucag

SEQ ID NO: 596753 - RNA, 22 nt, Human
auauaccucauucuuugagugc

SEQ ID NO: 596754 - RNA, 22 nt, Human
gcaguguugugauccaggucuu

SEQ ID NO: 596755 - RNA, 22 nt, Human
gggggccuuguuaguggaugga

SEQ ID NO: 596756 - RNA, 22 nt, Human
uccccagggucccugcuuccau

SEQ ID NO: 596757 - RNA, 22 nt, Human
agugcugacucugggcacagug

SEQ ID NO: 596758 - RNA, 22 nt, Human
cacaugaccacucuuuacuucu

SEQ ID NO: 596759 - RNA, 22 nt, Human
cagcaaaggggaugcguccuaa

SEQ ID NO: 596760 - RNA, 22 nt, Human
guugcugauggcaagauuccag

SEQ ID NO: 596761 - RNA, 22 nt, Human
uguuucaugauugcugucauuu

SEQ ID NO: 596762 - RNA, 22 nt, Human
uucucagagcucacuguaguaa

SEQ ID NO: 596763 - RNA, 22 nt, Human
ucaauaaaauuguuuuccuauc

SEQ ID NO: 596764 - RNA, 22 nt, Human
gguguauaccuacacauuuuug

SEQ ID NO: 596765 - RNA, 22 nt, Human
gggcuggaugggagccuuggcc

SEQ ID NO: 596766 - RNA, 21 nt, Human
uccuccuguagaggguccugg

SEQ ID NO: 596767 - RNA, 22 nt, Human
acaugcuuugcacuuacaucau

SEQ ID NO: 596768 - RNA, 22 nt, Human
gcaguacuuuaucacauggaau

SEQ ID NO: 596769 - RNA, 22 nt, Human
ucucuucuugauuuucacugga

SEQ ID NO: 596770 - RNA, 22 nt, Human
uggccugccugggagcagcagg

SEQ ID NO: 596771 - RNA, 22 nt, Human
ucucuucugaaaccugucuuua

SEQ ID NO: 596772 - RNA, 22 nt, Human
acagggcuccuagguggugugc

SEQ ID NO: 596773 - RNA, 22 nt, Human
uucucuggaacugaaacaagau

SEQ ID NO: 596774 - RNA, 22 nt, Human
ugagugaaauucugguaaagga

SEQ ID NO: 596775 - RNA, 22 nt, Human
uucuuacauuagucugugcuuu

SEQ ID NO: 596776 - RNA, 22 nt, Human
agaaggccaauagggugcacug

SEQ ID NO: 596777 - RNA, 22 nt, Human
ugaggaagcaaaggcuugugug

SEQ ID NO: 596778 - RNA, 22 nt, Human
cagaauuauaguugcuuuuuaa

SEQ ID NO: 596779 - RNA, 21 nt, Human
agggccagaucaccaaggagc

SEQ ID NO: 596780 - RNA, 22 nt, Human
cucuccaggacuuuggcccaau

SEQ ID NO: 596781 - RNA, 22 nt, Human
cagcugccugcaacacaagcuu

SEQ ID NO: 596782 - RNA, 19 nt, Human
gcuggggccugaccagaca

SEQ ID NO: 596783 - RNA, 22 nt, Human
cuagaaaucucuguuuacauca

SEQ ID NO: 596784 - RNA, 22 nt, Human
caucuuuagggaccauuauucu

SEQ ID NO: 596785 - RNA, 22 nt, Human
cauaucauuugcuuauaaaucu

SEQ ID NO: 596786 - RNA, 21 nt, Human
gggccuugagugugcgguggg

SEQ ID NO: 596787 - RNA, 22 nt, Human
aaucagaaauugagggucuggu

SEQ ID NO: 596788 - RNA, 22 nt, Human
agggagccuuccuggcuguggu

SEQ ID NO: 596789 - RNA, 22 nt, Human
uccugcagagacagaggccuca

SEQ ID NO: 596790 - RNA, 22 nt, Human
ucccugggccuaucuuagcucc

SEQ ID NO: 596791 - RNA, 22 nt, Human
gaauucuagucacacacauuca

SEQ ID NO: 596792 - RNA, 22 nt, Human
gaacuguuuuuaaguccuaaga

SEQ ID NO: 596793 - RNA, 22 nt, Human
ccaggcagcucugauuuauguc

SEQ ID NO: 596794 - RNA, 22 nt, Human
cuccagugggggugagccuaga

SEQ ID NO: 596795 - RNA, 22 nt, Human
gcuccuggagagauugagaaag

SEQ ID NO: 596796 - RNA, 22 nt, Human
ccucaagucaauucugucucgc

SEQ ID NO: 596797 - RNA, 22 nt, Human
uaagcauaagauacaugagaca

SEQ ID NO: 596798 - RNA, 22 nt, Human
cgccucagccguggucaucuuc

SEQ ID NO: 596799 - RNA, 22 nt, Human
aggcaccucagcugagccuggg

SEQ ID NO: 596800 - RNA, 16 nt, Human
agaggcuguaauggaa

SEQ ID NO: 596801 - RNA, 22 nt, Human
uuacuugaaaugugauaagaga

SEQ ID NO: 596802 - RNA, 23 nt, Human
ucacuagucaagugccuuugagu

SEQ ID NO: 596803 - RNA, 22 nt, Human
cugggcagcuguaucagggagu

SEQ ID NO: 596804 - RNA, 22 nt, Human
gggcugagccauuugaaccuug

SEQ ID NO: 596805 - RNA, 22 nt, Human
uucagcacugacugagugguua

SEQ ID NO: 596806 - RNA, 22 nt, Human
ugaggccagcuucagcagugga

SEQ ID NO: 596807 - RNA, 22 nt, Human
gccucuccucuuaauaccauua

SEQ ID NO: 596808 - RNA, 22 nt, Human
aucugccuggcuccaggugagc

SEQ ID NO: 596809 - RNA, 22 nt, Human
aaaaccaggcguuuccuauuau

SEQ ID NO: 596810 - RNA, 22 nt, Human
aguuuuaucuguaagcuguuca

SEQ ID NO: 596811 - RNA, 22 nt, Human
agggacacuugcuuucaggccc

SEQ ID NO: 596812 - RNA, 19 nt, Human
ucaugcaaucagugaacug

SEQ ID NO: 596813 - RNA, 22 nt, Human
ucaaaaguuucacauagagaua

SEQ ID NO: 596814 - RNA, 22 nt, Human
uuucccaguucccugcucuaua

SEQ ID NO: 596815 - RNA, 22 nt, Human
gucuuauuuucugucuacuaaa

SEQ ID NO: 596816 - RNA, 22 nt, Human
ugcccuuacacauggaaaggga

SEQ ID NO: 596817 - RNA, 22 nt, Human
cuguggcucaaaaucccaugau

SEQ ID NO: 596818 - RNA, 22 nt, Human
ggaggccacgguuuagcaccga

SEQ ID NO: 596819 - RNA, 22 nt, Human
auaccuguguauccacaagcgu

SEQ ID NO: 596820 - RNA, 22 nt, Human
uuguguccugauuugacacaau

SEQ ID NO: 596821 - RNA, 22 nt, Human
uggcaaccgcauggccugcuuc

SEQ ID NO: 596822 - RNA, 22 nt, Human
gagagggguuugccauccuaug

SEQ ID NO: 596823 - RNA, 17 nt, Human
uuucuagauuauccucu

SEQ ID NO: 596824 - RNA, 22 nt, Human
aauaccagagacaguguuuacc

SEQ ID NO: 596825 - RNA, 22 nt, Human
ugugacugaagugucuagaccu

SEQ ID NO: 596826 - RNA, 17 nt, Human
gagagcugcugcuuccg

SEQ ID NO: 596827 - RNA, 22 nt, Human
gccagaggcccaaggacagcug

SEQ ID NO: 596828 - RNA, 21 nt, Human
gaguccuuccaauguccucag

SEQ ID NO: 596829 - RNA, 22 nt, Human
aucuuaugagacccauaaagau

SEQ ID NO: 596830 - RNA, 22 nt, Human
uuagcauucugccuccuauauc

SEQ ID NO: 596831 - RNA, 22 nt, Human
ucagccagggcagagcagguga

SEQ ID NO: 596832 - RNA, 22 nt, Human
augagacuaccuguaauguggc

SEQ ID NO: 596833 - RNA, 23 nt, Human
uucuggauguucuagucugagag

SEQ ID NO: 596834 - RNA, 22 nt, Human
gcucccagggacacuggccacu

SEQ ID NO: 596835 - RNA, 22 nt, Human
ucccuggguccugcuugcucuc

SEQ ID NO: 596836 - RNA, 22 nt, Human
cugaagcugggcacuuccuuuu

SEQ ID NO: 596837 - RNA, 22 nt, Human
gcugagguccagcauucgccua

SEQ ID NO: 596838 - RNA, 22 nt, Human
ggggaacaccgggcagaggcgc

SEQ ID NO: 596839 - RNA, 22 nt, Human
uuugacagcagauaaaauaaaa

SEQ ID NO: 596840 - RNA, 22 nt, Human
acauauuuugaaagcuuucuaa

SEQ ID NO: 596841 - RNA, 18 nt, Human
ugacauuuccagagugua

SEQ ID NO: 596842 - RNA, 22 nt, Human
cucaggagagucuuauaucucc

SEQ ID NO: 596843 - RNA, 21 nt, Human
cagaggccuaucacagacucc

SEQ ID NO: 596844 - RNA, 22 nt, Human
uccaggcugggcugaagggugc

SEQ ID NO: 596845 - RNA, 22 nt, Human
uagagguacuccccucaaaguu

SEQ ID NO: 596846 - RNA, 21 nt, Human
aguacaaaaauuccuuucuca

SEQ ID NO: 596847 - RNA, 22 nt, Human
ggacccagcucugagacccugc

SEQ ID NO: 596848 - RNA, 22 nt, Human
cuggcucugagcccaccuccag

SEQ ID NO: 596849 - RNA, 22 nt, Human
gcuggaaaaggaggcaaaauau

SEQ ID NO: 596850 - RNA, 20 nt, Human
aguuagugaguaauugagcu

SEQ ID NO: 596851 - RNA, 22 nt, Human
ugcccuuaggaaggcucaccaa

SEQ ID NO: 596852 - RNA, 15 nt, Human
uaccagcugauccgu

SEQ ID NO: 596853 - RNA, 22 nt, Human
uugaggcccggcaggccgagcg

SEQ ID NO: 596854 - RNA, 22 nt, Human
guaggccagugugaaaccuggu

SEQ ID NO: 596855 - RNA, 22 nt, Human
cuucucucccuggcacucagac

SEQ ID NO: 596856 - RNA, 22 nt, Human
gcuuucugaagcaguguuucuc

SEQ ID NO: 596857 - RNA, 22 nt, Human
uguacaauguggccaguguuaa

SEQ ID NO: 596858 - RNA, 22 nt, Human
ggcugcagaggcgaucugaggu

SEQ ID NO: 596859 - RNA, 22 nt, Human
ucaguguguuacuuucuccuau

SEQ ID NO: 596860 - RNA, 22 nt, Human
cauuuaaagguuguggguaaaa

SEQ ID NO: 596861 - RNA, 22 nt, Human
acauucuucagcuuugucaggc

SEQ ID NO: 596862 - RNA, 22 nt, Human
uaaaggcaguaauuccugaguu

SEQ ID NO: 596863 - RNA, 22 nt, Human
auuucacaaaccauccugauuu

SEQ ID NO: 596864 - RNA, 22 nt, Human
ucagcuuggacagcuugguuga

SEQ ID NO: 596865 - RNA, 22 nt, Human
gaaaacacuuugaucugaaagu

SEQ ID NO: 596866 - RNA, 22 nt, Human
agcagguguuggcugggccauc

SEQ ID NO: 596867 - RNA, 22 nt, Human
cagaaauggagcccaggaaucu

SEQ ID NO: 596868 - RNA, 22 nt, Human
auacagaucccacagcauguga

SEQ ID NO: 596869 - RNA, 22 nt, Human
agcaccaggcaccaaagggccu

SEQ ID NO: 596870 - RNA, 22 nt, Human
gcagugugucucuuggcuuccu

SEQ ID NO: 596871 - RNA, 22 nt, Human
cagcucuguaaauuccuucauc

SEQ ID NO: 596872 - RNA, 22 nt, Human
uccuuauaucuucagagaagca

SEQ ID NO: 596873 - RNA, 22 nt, Human
gccuggagaauuaaaaggaagg

SEQ ID NO: 596874 - RNA, 22 nt, Human
acugggcaugaugagucaccua

SEQ ID NO: 596875 - RNA, 22 nt, Human
uaugcuaauuguuagucacaug

SEQ ID NO: 596876 - RNA, 22 nt, Human
ugaggcagauauuuauuggguu

SEQ ID NO: 596877 - RNA, 22 nt, Human
uccugggcuucacagacucugu

SEQ ID NO: 596878 - RNA, 22 nt, Human
auccugggcagugugucacucu

SEQ ID NO: 596879 - RNA, 22 nt, Human
uacacugucuuagaaaggggca

SEQ ID NO: 596880 - RNA, 22 nt, Human
ugggcacaggggaauggaugaa

SEQ ID NO: 596881 - RNA, 22 nt, Human
auacagugccccuuuucacaug

SEQ ID NO: 596882 - RNA, 22 nt, Human
gcacauggacaauggaggugca

SEQ ID NO: 596883 - RNA, 22 nt, Human
guuuguuuuaagauaggaugga

SEQ ID NO: 596884 - RNA, 22 nt, Human
gaggugggagggcagucccuaa

SEQ ID NO: 596885 - RNA, 22 nt, Human
ugcaggagcccuugggcucugg

SEQ ID NO: 596886 - RNA, 22 nt, Human
acagggcuauauuccucagagu

SEQ ID NO: 596887 - RNA, 22 nt, Human
uacaguucuuugaaggaucuag

SEQ ID NO: 596888 - RNA, 23 nt, Human
acagacaacacugaugagagaaa

SEQ ID NO: 596889 - RNA, 22 nt, Human
aggcagcagggccacuggcuga

SEQ ID NO: 596890 - RNA, 22 nt, Human
uggaagggaacagguggguguu

SEQ ID NO: 596891 - RNA, 22 nt, Human
caguagcacucugucagugaag

SEQ ID NO: 596892 - RNA, 18 nt, Human
ggaugugauuuugguuuu

SEQ ID NO: 596893 - RNA, 22 nt, Human
aggagcugugaaugggaggggu

SEQ ID NO: 596894 - RNA, 22 nt, Human
agguguccggcugcauaaucuu

SEQ ID NO: 596895 - RNA, 22 nt, Human
uuauuuguggcauaugagacga

SEQ ID NO: 596896 - RNA, 22 nt, Human
uucaacugggcggaucugagaa

SEQ ID NO: 596897 - RNA, 22 nt, Human
aauguugcagagugauugucca

SEQ ID NO: 596898 - RNA, 22 nt, Human
acauuucucccugcaugccugc

SEQ ID NO: 596899 - RNA, 22 nt, Human
ucugggagggagccucagaauc

SEQ ID NO: 596900 - RNA, 22 nt, Human
agauaauuaugucaauuucuug

SEQ ID NO: 596901 - RNA, 22 nt, Human
augaggccuuucuucacccuuu

SEQ ID NO: 596902 - RNA, 22 nt, Human
cugggacugccauucacagcca

SEQ ID NO: 596903 - RNA, 22 nt, Human
gggaagggagggaccucagucu

SEQ ID NO: 596904 - RNA, 22 nt, Human
aggcuguguuuccccuggagcu

SEQ ID NO: 596905 - RNA, 22 nt, Human
cuggugcacauucgcucucaua

SEQ ID NO: 596906 - RNA, 21 nt, Human
uccugugaggaccugucagug

SEQ ID NO: 596907 - RNA, 22 nt, Human
uccugggucccgcacaucuguc

SEQ ID NO: 596908 - RNA, 22 nt, Human
gagccagagauccaggauggcu

SEQ ID NO: 596909 - RNA, 19 nt, Human
acuguguggaagugugauu

SEQ ID NO: 596910 - RNA, 22 nt, Human
cugccuuuuaaagccaguguua

SEQ ID NO: 596911 - RNA, 22 nt, Human
uaugcuaagauaaacagaguua

SEQ ID NO: 596912 - RNA, 23 nt, Human
ugugggcgcauuguaaggguagc

SEQ ID NO: 596913 - RNA, 22 nt, Human
gcaagcaguuguggcuucugag

SEQ ID NO: 596914 - RNA, 22 nt, Human
ucaguguucuuauuuaauuagg

SEQ ID NO: 596915 - RNA, 22 nt, Human
ccugagaggcccucucacuguc

SEQ ID NO: 596916 - RNA, 22 nt, Human
cuccugguuccugucuuaaaua

SEQ ID NO: 596917 - RNA, 22 nt, Human
uuagcacaggcaacuccacaua

SEQ ID NO: 596918 - RNA, 16 nt, Human
gcuccugggcccucga

SEQ ID NO: 596919 - RNA, 22 nt, Human
uuccauauuguacucuuuggag

SEQ ID NO: 596920 - RNA, 22 nt, Human
uccauucuuuugcugucuuccu

SEQ ID NO: 596921 - RNA, 22 nt, Human
agaacaggaggaagccagcucc

SEQ ID NO: 596922 - RNA, 22 nt, Human
gaguugaacauaugcaaucucu

SEQ ID NO: 596923 - RNA, 22 nt, Human
guacauuuuacuuuguuugaau

SEQ ID NO: 596924 - RNA, 22 nt, Human
gcaugggcaagaggacuggggg

SEQ ID NO: 596925 - RNA, 22 nt, Human
ucuuaaugcuagccaauagaga

SEQ ID NO: 596926 - RNA, 22 nt, Human
aaggcugguuccaucccuggug

SEQ ID NO: 596927 - RNA, 22 nt, Human
gaaggcugaguggguacggagg

SEQ ID NO: 596928 - RNA, 22 nt, Human
ucugaacaagggcaccuuccag

SEQ ID NO: 596929 - RNA, 22 nt, Human
caguuucuucaucugcagaauc

SEQ ID NO: 596930 - RNA, 22 nt, Human
uguaaauucuauacacuuaaaa

SEQ ID NO: 596931 - RNA, 22 nt, Human
caaugucaaggagaccaaaacg

SEQ ID NO: 596932 - RNA, 22 nt, Human
caagaugaaacuacagggagga

SEQ ID NO: 596933 - RNA, 22 nt, Human
ggcugggcugcugggucagagc

SEQ ID NO: 596934 - RNA, 19 nt, Human
ugcuuccucaccaucuccc

SEQ ID NO: 596935 - RNA, 22 nt, Human
ugugaucugccuuggaucugca

SEQ ID NO: 596936 - RNA, 22 nt, Human
ucauacauucagcagauauuug

SEQ ID NO: 596937 - RNA, 22 nt, Human
cacagggccuggggcagcugcu

SEQ ID NO: 596938 - RNA, 22 nt, Human
gccugggugucgaucacuagug

SEQ ID NO: 596939 - RNA, 20 nt, Human
agaaggcaggagacaaaagg

SEQ ID NO: 596940 - RNA, 22 nt, Human
aggggcucugagugggccagga

SEQ ID NO: 596941 - RNA, 22 nt, Human
cugagaggcggagcuugcagug

SEQ ID NO: 596942 - RNA, 22 nt, Human
cucucuggauauuuguaugcug

SEQ ID NO: 596943 - RNA, 22 nt, Human
ggaaggagucuuuaacacccau

SEQ ID NO: 596944 - RNA, 22 nt, Human
uuuaccauuauuaaaauuaagu

SEQ ID NO: 596945 - RNA, 22 nt, Human
uauugacaauuugugaaacuau

SEQ ID NO: 596946 - RNA, 22 nt, Human
ucagggaccaccacucacccag

SEQ ID NO: 596947 - RNA, 22 nt, Human
cagugaggaagcugucuggacc

SEQ ID NO: 596948 - RNA, 22 nt, Human
cugcccugggaguaccuguccu

SEQ ID NO: 596949 - RNA, 22 nt, Human
ggggauggugggaaggcaaucu

SEQ ID NO: 596950 - RNA, 22 nt, Human
acauacaugguucucagcccuu

SEQ ID NO: 596951 - RNA, 18 nt, Human
guccacagauucuucacu

SEQ ID NO: 596952 - RNA, 22 nt, Human
auauauuugagaauauucauga

SEQ ID NO: 596953 - RNA, 22 nt, Human
caugugucaaaugauguagcug

SEQ ID NO: 596954 - RNA, 22 nt, Human
auacaucauuucccaucaaucg

SEQ ID NO: 596955 - RNA, 22 nt, Human
aggugccuaucuggucucugca

SEQ ID NO: 596956 - RNA, 22 nt, Human
aggagcagauugguaagaucau

SEQ ID NO: 596957 - RNA, 19 nt, Human
ucugucacuggggguauuc

SEQ ID NO: 596958 - RNA, 22 nt, Human
augacaugauucuuucuuucau

SEQ ID NO: 596959 - RNA, 18 nt, Human
uugcuuuguaagcuugca

SEQ ID NO: 596960 - RNA, 20 nt, Human
gagcugugcucucaggagcc

SEQ ID NO: 596961 - RNA, 22 nt, Human
aaacaguuucauuuucaugacc

SEQ ID NO: 596962 - RNA, 22 nt, Human
ugguccagaugccuuggcuuua

SEQ ID NO: 596963 - RNA, 21 nt, Human
acuucccaggaccuacucaga

SEQ ID NO: 596964 - RNA, 22 nt, Human
agggggaggcugugcugcgucu

SEQ ID NO: 596965 - RNA, 20 nt, Human
acauguacuaaugaauacag

SEQ ID NO: 596966 - RNA, 22 nt, Human
aaagcaaugcccguucauuauc

SEQ ID NO: 596967 - RNA, 23 nt, Human
aagaauaaaugacauuaaaggug

SEQ ID NO: 596968 - RNA, 22 nt, Human
gcuggagugcaguugcacaguc

SEQ ID NO: 596969 - RNA, 22 nt, Human
cccucccaagcacucugacaua

SEQ ID NO: 596970 - RNA, 22 nt, Human
gagggugguggcuuaaggugcu

SEQ ID NO: 596971 - RNA, 22 nt, Human
gaucuuuauacuguaauaauga

SEQ ID NO: 596972 - RNA, 22 nt, Human
uggcagggaguugcaggauuuc

SEQ ID NO: 596973 - RNA, 22 nt, Human
ucucagaguuuagagcugagcc

SEQ ID NO: 596974 - RNA, 22 nt, Human
cugggcacauuuugacuagugu

SEQ ID NO: 596975 - RNA, 22 nt, Human
caauuucauuaauagauauaga

SEQ ID NO: 596976 - RNA, 22 nt, Human
ccuggaccaaacacuggccugg

SEQ ID NO: 596977 - RNA, 22 nt, Human
ucaggcugagaaaaucuggacc

SEQ ID NO: 596978 - RNA, 22 nt, Human
agcccaaggcuucccugcuggc

SEQ ID NO: 596979 - RNA, 22 nt, Human
acacuucagcaguaugcuuggg

SEQ ID NO: 596980 - RNA, 22 nt, Human
cuggcugaggcagagccugggg

SEQ ID NO: 596981 - RNA, 22 nt, Human
uauguguagugugaucccaaug

SEQ ID NO: 596982 - RNA, 22 nt, Human
cagcccuuguuucuaaagcugc

SEQ ID NO: 596983 - RNA, 22 nt, Human
cucaaagagccagguaaucacc

SEQ ID NO: 596984 - RNA, 22 nt, Human
aagaacuuuaaagcacuuauga

SEQ ID NO: 596985 - RNA, 22 nt, Human
gauuucugggcuuuauuucaga

SEQ ID NO: 596986 - RNA, 17 nt, Human
aggcaaugacugugguu

SEQ ID NO: 596987 - RNA, 22 nt, Human
ucagaagcaaacaucacucuag

SEQ ID NO: 596988 - RNA, 22 nt, Human
aaagcaugguuaaagacagugg

SEQ ID NO: 596989 - RNA, 22 nt, Human
ucugggcacugcugagccugua

SEQ ID NO: 596990 - RNA, 22 nt, Human
gagcuuugccuaaaacuagaau

SEQ ID NO: 596991 - RNA, 22 nt, Human
augcacaagcaagagauaaugg

SEQ ID NO: 596992 - RNA, 22 nt, Human
gggggccagucaucucccaaga

SEQ ID NO: 596993 - RNA, 22 nt, Human
caggaaugacccaacaguuuca

SEQ ID NO: 596994 - RNA, 22 nt, Human
auuguuaaaguaauaaccaugg

SEQ ID NO: 596995 - RNA, 22 nt, Human
gucagcacuuuuccgaggcaga

SEQ ID NO: 596996 - RNA, 22 nt, Human
ggcccccaggguggguguagac

SEQ ID NO: 596997 - RNA, 22 nt, Human
gaauuuaucuacguuaaguaug

SEQ ID NO: 596998 - RNA, 23 nt, Human
ugaagguauuaccugagaugcuc

SEQ ID NO: 596999 - RNA, 22 nt, Human
ccaugcccuugucaucuccagg

SEQ ID NO: 597000 - RNA, 22 nt, Human
agguggcaaggggcgccucucu

SEQ ID NO: 597001 - RNA, 22 nt, Human
auauggaaugguaaucuacaau

SEQ ID NO: 597002 - RNA, 22 nt, Human
aggcugucugaccccagagccc

SEQ ID NO: 597003 - RNA, 22 nt, Human
gaggcagcugaaggagugacag

SEQ ID NO: 597004 - RNA, 22 nt, Human
auugaaaauaaggccagaaaca

SEQ ID NO: 597005 - RNA, 22 nt, Human
cagcacaguuucccccaugagc

SEQ ID NO: 597006 - RNA, 22 nt, Human
ugcuuauugcuuucaagacugu

SEQ ID NO: 597007 - RNA, 22 nt, Human
ccuuccagugacuaaggaggaa

SEQ ID NO: 597008 - RNA, 22 nt, Human
uucuccugaguucccaggucua

SEQ ID NO: 597009 - RNA, 22 nt, Human
cauuuguacagaacagcuuuau

SEQ ID NO: 597010 - RNA, 22 nt, Human
cugggagagaagcgaagcuggg

SEQ ID NO: 597011 - RNA, 22 nt, Human
cccgucccuuuugcccgcuggu

SEQ ID NO: 597012 - RNA, 22 nt, Human
acaaauggacucucaucuuuug

SEQ ID NO: 597013 - RNA, 22 nt, Human
gauuuguuucaaguuagcaucu

SEQ ID NO: 597014 - RNA, 22 nt, Human
aaacaauuuccaccucuccuga

SEQ ID NO: 597015 - RNA, 22 nt, Human
acaauuacucaacuuugcugcu

SEQ ID NO: 597016 - RNA, 19 nt, Human
agugccuugcucucuaggu

SEQ ID NO: 597017 - RNA, 17 nt, Human
ggcuggaggggacccgg

SEQ ID NO: 597018 - RNA, 22 nt, Human
caguaaaugguacguauauuuu

SEQ ID NO: 597019 - RNA, 22 nt, Human
ugagcagagacgggggccucca

SEQ ID NO: 597020 - RNA, 22 nt, Human
uccucagaaaccccugugaggu

SEQ ID NO: 597021 - RNA, 22 nt, Human
caugcaguuucucuaugcguag

SEQ ID NO: 597022 - RNA, 22 nt, Human
auaaaacuuauuagaauugugu

SEQ ID NO: 597023 - RNA, 22 nt, Human
ggaagccaguugcuuggugugg

SEQ ID NO: 597024 - RNA, 22 nt, Human
ucuauaaaacucaagagcaauu

SEQ ID NO: 597025 - RNA, 22 nt, Human
acacagauauuuugaauacaua

SEQ ID NO: 597026 - RNA, 22 nt, Human
cauguguguccaugugacuaag

SEQ ID NO: 597027 - RNA, 22 nt, Human
uccaaagacuugcuguauguaa

SEQ ID NO: 597028 - RNA, 22 nt, Human
guuccugggccugcauucacca

SEQ ID NO: 597029 - RNA, 22 nt, Human
cagcuuugcaggcuggucagug

SEQ ID NO: 597030 - RNA, 22 nt, Human
cagcugcuuacuagcuguguga

SEQ ID NO: 597031 - RNA, 22 nt, Human
aaacucuaguaaaauguauuca

SEQ ID NO: 597032 - RNA, 22 nt, Human
cucucccuugggugggcuuugg

SEQ ID NO: 597033 - RNA, 22 nt, Human
ugcuuucacauguaugcacaaa

SEQ ID NO: 597034 - RNA, 22 nt, Human
ucacaguauucaugaacaugga

SEQ ID NO: 597035 - RNA, 22 nt, Human
uccuggugguuugaaaacugaa

SEQ ID NO: 597036 - RNA, 22 nt, Human
acaguaaaaagccuuagaauuu

SEQ ID NO: 597037 - RNA, 22 nt, Human
ucaaaagaaacaccauguuccu

SEQ ID NO: 597038 - RNA, 21 nt, Human
ugguaggauccaggaaucugc

SEQ ID NO: 597039 - RNA, 22 nt, Human
cucugcccgcggaugccacguc

SEQ ID NO: 597040 - RNA, 22 nt, Human
agcaucuguuaagugccuucaa

SEQ ID NO: 597041 - RNA, 22 nt, Human
aggaggccgauuucagaggucg

SEQ ID NO: 597042 - RNA, 22 nt, Human
uggggcagccacauagacaaca

SEQ ID NO: 597043 - RNA, 18 nt, Human
uucucugguggauguuau

SEQ ID NO: 597044 - RNA, 22 nt, Human
auagauauuagcaaaauuuuau

SEQ ID NO: 597045 - RNA, 22 nt, Human
caggaacaacucccagcaucuc

SEQ ID NO: 597046 - RNA, 22 nt, Human
aggcugcaggucugggucaugu

SEQ ID NO: 597047 - RNA, 22 nt, Human
aauuauauguuaaucuucaauu

SEQ ID NO: 597048 - RNA, 22 nt, Human
ggagaggacauggcucccacag

SEQ ID NO: 597049 - RNA, 22 nt, Human
gcaggcaguuugcuuuucccuc

SEQ ID NO: 597050 - RNA, 22 nt, Human
gguugguaacucccugugcagu

SEQ ID NO: 597051 - RNA, 22 nt, Human
ucugggagagcacguggcugac

SEQ ID NO: 597052 - RNA, 22 nt, Human
gaaauaauacagugcucuucuc

SEQ ID NO: 597053 - RNA, 20 nt, Human
gaugaaaucacugggcagcc

SEQ ID NO: 597054 - RNA, 22 nt, Human
gagauggagucuuuuucuguca

SEQ ID NO: 597055 - RNA, 22 nt, Human
aguguuaaugguguauauuagg

SEQ ID NO: 597056 - RNA, 17 nt, Human
uggcaucuuuugcucau

SEQ ID NO: 597057 - RNA, 21 nt, Human
cagaggucauccugaggacaa

SEQ ID NO: 597058 - RNA, 22 nt, Human
accaucuuaaggggacuucuua

SEQ ID NO: 597059 - RNA, 22 nt, Human
ugugccugucccgcauucuggu

SEQ ID NO: 597060 - RNA, 22 nt, Human
ugggccuguugggguugaguua

SEQ ID NO: 597061 - RNA, 22 nt, Human
gcaguggccacauggaggagga

SEQ ID NO: 597062 - RNA, 22 nt, Human
acggcaggcucagagcuggaau

SEQ ID NO: 597063 - RNA, 22 nt, Human
uacaaaggagacucuguauuua

SEQ ID NO: 597064 - RNA, 21 nt, Human
ucacuuauaauguauuugcug

SEQ ID NO: 597065 - RNA, 22 nt, Human
ucugugcuggacugauuucaua

SEQ ID NO: 597066 - RNA, 22 nt, Human
gcucccagcaauugaggcagcc

SEQ ID NO: 597067 - RNA, 22 nt, Human
aacaguaucuuuuaucagaaau

SEQ ID NO: 597068 - RNA, 22 nt, Human
cagaggaagcuggguguggagu

SEQ ID NO: 597069 - RNA, 20 nt, Human
auggaggaagggcaagagaa

SEQ ID NO: 597070 - RNA, 22 nt, Human
caguagcaugcuuaucuuuuga

SEQ ID NO: 597071 - RNA, 22 nt, Human
ccaguccagugccaugcauggc

SEQ ID NO: 597072 - RNA, 22 nt, Human
ucgucugugaaauugggauaag

SEQ ID NO: 597073 - RNA, 22 nt, Human
gacuuuauccugccugaccacg

SEQ ID NO: 597074 - RNA, 22 nt, Human
uggcacugccuggcagggcccc

SEQ ID NO: 597075 - RNA, 22 nt, Human
cugucgccugguccucucugga

SEQ ID NO: 597076 - RNA, 19 nt, Human
uccuucagucagaucuggg

SEQ ID NO: 597077 - RNA, 22 nt, Human
ucccaagcuuagggcucucagu

SEQ ID NO: 597078 - RNA, 22 nt, Human
ucuguccagaacguacaucuug

SEQ ID NO: 597079 - RNA, 21 nt, Human
cugaggcagcacagcuaguca

SEQ ID NO: 597080 - RNA, 22 nt, Human
uuuaacagaugcuaugucuacc

SEQ ID NO: 597081 - RNA, 22 nt, Human
gccuggagcagacgugucccgg

SEQ ID NO: 597082 - RNA, 22 nt, Human
cccacaggcuagggguagggca

SEQ ID NO: 597083 - RNA, 22 nt, Human
cucuucaaaagucuaauccuua

SEQ ID NO: 597084 - RNA, 19 nt, Human
gcuaggcuggccuugaggg

SEQ ID NO: 597085 - RNA, 22 nt, Human
cuggugaauauuggaggcauug

SEQ ID NO: 597086 - RNA, 22 nt, Human
uccagcuccugaguucacugcu

SEQ ID NO: 597087 - RNA, 22 nt, Human
ggagcugcuuugaucugaagaa

SEQ ID NO: 597088 - RNA, 22 nt, Human
uguggggcucccuggcagccug

SEQ ID NO: 597089 - RNA, 18 nt, Human
gucaccuggaucagauua

SEQ ID NO: 597090 - RNA, 22 nt, Human
uccuugaauauaauaacaguag

SEQ ID NO: 597091 - RNA, 22 nt, Human
cagaggcauacucccagucuug

SEQ ID NO: 597092 - RNA, 22 nt, Human
cugggaggauacacaagaucag

SEQ ID NO: 597093 - RNA, 22 nt, Human
cuggcagcuuccuuugcaucug

SEQ ID NO: 597094 - RNA, 22 nt, Human
ccaguuuuuccagugcuuucug

SEQ ID NO: 597095 - RNA, 23 nt, Human
ccuagauucaaagcuuauaauuc

SEQ ID NO: 597096 - RNA, 22 nt, Human
augggaauauaauuuuagcaac

SEQ ID NO: 597097 - RNA, 22 nt, Human
cagggccucgaagccucugggc

SEQ ID NO: 597098 - RNA, 22 nt, Human
aggaaacauccuuaucuauucu

SEQ ID NO: 597099 - RNA, 22 nt, Human
uccagcucuaaggcugauagcc

SEQ ID NO: 597100 - RNA, 22 nt, Human
uguguguguaaaagcauuuaua

SEQ ID NO: 597101 - RNA, 22 nt, Human
ucagaaaauaacuguuaguuug

SEQ ID NO: 597102 - RNA, 22 nt, Human
uuauugugucuugguuuaucuu

SEQ ID NO: 597103 - RNA, 22 nt, Human
aacuguacgauaauaaauuugu

SEQ ID NO: 597104 - RNA, 22 nt, Human
gauaauguggauuuauugugau

SEQ ID NO: 597105 - RNA, 19 nt, Human
ugagagugaggaaggcuuc

SEQ ID NO: 597106 - RNA, 22 nt, Human
gacauaaaguucuugcuugaau

SEQ ID NO: 597107 - RNA, 22 nt, Human
cuuucccacgcaguggaugaga

SEQ ID NO: 597108 - RNA, 22 nt, Human
auagcauuauuuacaauuagua

SEQ ID NO: 597109 - RNA, 21 nt, Human
aguaacauuuuguuguuuaca

SEQ ID NO: 597110 - RNA, 22 nt, Human
gcuacacaauagcguucacuua

SEQ ID NO: 597111 - RNA, 22 nt, Human
ucucaguguguugagaggucug

SEQ ID NO: 597112 - RNA, 22 nt, Human
aaagaucaaguaggcauggccu

SEQ ID NO: 597113 - RNA, 22 nt, Human
guacaggcagcaaacaccauaa

SEQ ID NO: 597114 - RNA, 22 nt, Human
ugugcagaguugaagacaggag

SEQ ID NO: 597115 - RNA, 22 nt, Human
gcccaaggucacacacaggaag

SEQ ID NO: 597116 - RNA, 22 nt, Human
uuucuacauucaaaaacuacca

SEQ ID NO: 597117 - RNA, 22 nt, Human
cugucugcuagaacaucuauac

SEQ ID NO: 597118 - RNA, 22 nt, Human
aggcuggcuuugguagcauggu

SEQ ID NO: 597119 - RNA, 22 nt, Human
auauuauaaguuauuucaaguu

SEQ ID NO: 597120 - RNA, 22 nt, Human
gaggcugaggguuagagaguca

SEQ ID NO: 597121 - RNA, 22 nt, Human
gaggcaggguguugauuacaga

SEQ ID NO: 597122 - RNA, 23 nt, Human
gaacccagcucugccacuugcca

SEQ ID NO: 597123 - RNA, 22 nt, Human
cuggaggagcauggacuggagu

SEQ ID NO: 597124 - RNA, 22 nt, Human
uugauuucaaaauauaugcuug

SEQ ID NO: 597125 - RNA, 19 nt, Human
gggucccaaaagaugugcu

SEQ ID NO: 597126 - RNA, 22 nt, Human
cacagcuuaugccacugauugg

SEQ ID NO: 597127 - RNA, 22 nt, Human
ucacuaugcccagaauacaguu

SEQ ID NO: 597128 - RNA, 22 nt, Human
cagcuauuuguaggaaaacugu

SEQ ID NO: 597129 - RNA, 22 nt, Human
ugccaggcauguaguagacuug

SEQ ID NO: 597130 - RNA, 22 nt, Human
ucuggccccuggucucuggugu

SEQ ID NO: 597131 - RNA, 22 nt, Human
caauauauaaugaguacuuucc

SEQ ID NO: 597132 - RNA, 22 nt, Human
guacauucagcuuagcacuucu

SEQ ID NO: 597133 - RNA, 22 nt, Human
agcaggcugccuuccaaagccu

SEQ ID NO: 597134 - RNA, 22 nt, Human
auuucucuuccuccuaggguug

SEQ ID NO: 597135 - RNA, 19 nt, Human
gggcacagccuccccccag

SEQ ID NO: 597136 - RNA, 22 nt, Human
guaggcagucucucaggugauc

SEQ ID NO: 597137 - RNA, 21 nt, Human
agcuuacauuaccauuguugc

SEQ ID NO: 597138 - RNA, 22 nt, Human
ggugcugguucaggguggcugu

SEQ ID NO: 597139 - RNA, 22 nt, Human
ugacaucauuaguaacauagcu

SEQ ID NO: 597140 - RNA, 22 nt, Human
gagaccuggaggauguggaugg

SEQ ID NO: 597141 - RNA, 22 nt, Human
uacauugaaagucauuuaaucc

SEQ ID NO: 597142 - RNA, 22 nt, Human
gucagaaaccagucaaacaaga

SEQ ID NO: 597143 - RNA, 22 nt, Human
cugagguaugugggacuagccu

SEQ ID NO: 597144 - RNA, 22 nt, Human
ucugugugggauaguuugagga

SEQ ID NO: 597145 - RNA, 23 nt, Human
auuuuuugucuuuguaacuagau

SEQ ID NO: 597146 - RNA, 23 nt, Human
ucucaguuccagaggcuacaagu

SEQ ID NO: 597147 - RNA, 22 nt, Human
ugcaggugguuuggacacugcu

SEQ ID NO: 597148 - RNA, 22 nt, Human
augcagaagcagaacuuacaca

SEQ ID NO: 597149 - RNA, 22 nt, Human
uggcagcauguuauguaaggaa

SEQ ID NO: 597150 - RNA, 22 nt, Human
aguggagaagaggauggucucc

SEQ ID NO: 597151 - RNA, 22 nt, Human
aucuucuucaaggaucuggagc

SEQ ID NO: 597152 - RNA, 23 nt, Human
gaguggggagaaauugguuaaac

SEQ ID NO: 597153 - RNA, 22 nt, Human
uuacuuugaugaucaaugagcg

SEQ ID NO: 597154 - RNA, 22 nt, Human
auguccaagucacagauuuuca

SEQ ID NO: 597155 - RNA, 22 nt, Human
uaaaugacauucuuaagucuug

SEQ ID NO: 597156 - RNA, 22 nt, Human
gggcuccagccaggugucccca

SEQ ID NO: 597157 - RNA, 22 nt, Human
uugcugauaccaugaauguuaa

SEQ ID NO: 597158 - RNA, 22 nt, Human
ucacuucccucuucagcuccca

SEQ ID NO: 597159 - RNA, 22 nt, Human
cugcaggagcaaagccucugcu

SEQ ID NO: 597160 - RNA, 22 nt, Human
augaaguucucaauaaucaugu

SEQ ID NO: 597161 - RNA, 22 nt, Human
uuucucuugcgauaugcuacac

SEQ ID NO: 597162 - RNA, 22 nt, Human
gucuggagggaagagaugucag

SEQ ID NO: 597163 - RNA, 22 nt, Human
uacuuacacagcuguagaaggu

SEQ ID NO: 597164 - RNA, 22 nt, Human
uuuuauugucucccaguucugg

SEQ ID NO: 597165 - RNA, 22 nt, Human
cccaggcuccuacuguauucug

SEQ ID NO: 597166 - RNA, 22 nt, Human
ugcccagccaauuuguuauguu

SEQ ID NO: 597167 - RNA, 22 nt, Human
cuggguucuauuuuuggcuuca

SEQ ID NO: 597168 - RNA, 22 nt, Human
ugcuugcuggaggcagacagaa

SEQ ID NO: 597169 - RNA, 22 nt, Human
aaagacaugacacauuggagag

SEQ ID NO: 597170 - RNA, 22 nt, Human
uccuaguucugguucugucacu

SEQ ID NO: 597171 - RNA, 22 nt, Human
ugcccuccuccugagcccaugu

SEQ ID NO: 597172 - RNA, 22 nt, Human
uguaguagcauucacgaagugu

SEQ ID NO: 597173 - RNA, 22 nt, Human
caauuucuggaacuaauucuga

SEQ ID NO: 597174 - RNA, 23 nt, Human
ugggggugcacgggccacaucuu

SEQ ID NO: 597175 - RNA, 22 nt, Human
agcuguggaguaggggguugga

SEQ ID NO: 597176 - RNA, 22 nt, Human
aaguuacaguuauuauuuaaaa

SEQ ID NO: 597177 - RNA, 22 nt, Human
ggaauaaaaauuguuuacugua

SEQ ID NO: 597178 - RNA, 22 nt, Human
cuguuuucccuggaguucagca

SEQ ID NO: 597179 - RNA, 22 nt, Human
uauaauuuuucuguggccaguu

SEQ ID NO: 597180 - RNA, 20 nt, Human
uggagagccucuggacugug

SEQ ID NO: 597181 - RNA, 22 nt, Human
gggaugaauugagucagaaggg

SEQ ID NO: 597182 - RNA, 22 nt, Human
cucuuuaagcuccuaacagcca

SEQ ID NO: 597183 - RNA, 22 nt, Human
gaggcacagucccgaggcaagg

SEQ ID NO: 597184 - RNA, 22 nt, Human
guuaacaaauguaaagcaauua

SEQ ID NO: 597185 - RNA, 22 nt, Human
acccaugugcucuuuuguaccc

SEQ ID NO: 597186 - RNA, 22 nt, Human
gugaaggaguuaucagugguua

SEQ ID NO: 597187 - RNA, 22 nt, Human
ugaucuuugguaguacgauaau

SEQ ID NO: 597188 - RNA, 22 nt, Human
aagaaauauugggccuuauaaa

SEQ ID NO: 597189 - RNA, 22 nt, Human
gcuggcagagacaagaagacua

SEQ ID NO: 597190 - RNA, 22 nt, Human
uggggaaggcggagcuugcagc

SEQ ID NO: 597191 - RNA, 22 nt, Human
ggaagaugcccaacccagcuuu

SEQ ID NO: 597192 - RNA, 18 nt, Human
cuggucucccuucgcuuu

SEQ ID NO: 597193 - RNA, 22 nt, Human
uagagcuggccgggacagcugg

SEQ ID NO: 597194 - RNA, 22 nt, Human
cugggcaggagggcucuaugga

SEQ ID NO: 597195 - RNA, 22 nt, Human
gccuggccgcuccgagcuccgc

SEQ ID NO: 597196 - RNA, 22 nt, Human
cagcacagcacagcggugacuc

SEQ ID NO: 597197 - RNA, 22 nt, Human
aaauaugacuagaaugccaggu

SEQ ID NO: 597198 - RNA, 22 nt, Human
ugaagcaggugaauggaugucg

SEQ ID NO: 597199 - RNA, 22 nt, Human
gggugggagucuggcccucaaa

SEQ ID NO: 597200 - RNA, 22 nt, Human
uccuccagugucuggggccuug

SEQ ID NO: 597201 - RNA, 22 nt, Human
gaggcugcuuugaugacaggag

SEQ ID NO: 597202 - RNA, 22 nt, Human
auuguaaaaguauucuaagauu

SEQ ID NO: 597203 - RNA, 22 nt, Human
uuucucuuaaugucucugugcu

SEQ ID NO: 597204 - RNA, 22 nt, Human
ucauuucaguccucugugugag

SEQ ID NO: 597205 - RNA, 22 nt, Human
gcagucucucaggauuuaagcu

SEQ ID NO: 597206 - RNA, 22 nt, Human
auggaaauacacaagagguuuc

SEQ ID NO: 597207 - RNA, 22 nt, Human
agggcaucuaguucccucucuu

SEQ ID NO: 597208 - RNA, 22 nt, Human
gaaaggcaguacagcugagccu

SEQ ID NO: 597209 - RNA, 22 nt, Human
uugcuuuauuggguuuacugcc

SEQ ID NO: 597210 - RNA, 22 nt, Human
uccagcucugcugugcgccggu

SEQ ID NO: 597211 - RNA, 22 nt, Human
uuucuuccuuaccuuacuagag

SEQ ID NO: 597212 - RNA, 22 nt, Human
aaggccagacaggaccacaucu

SEQ ID NO: 597213 - RNA, 19 nt, Human
cugggacaaugaaagcauc

SEQ ID NO: 597214 - RNA, 22 nt, Human
cagggccacuguagaugaggag

SEQ ID NO: 597215 - RNA, 16 nt, Human
aaggcugauuuucccu

SEQ ID NO: 597216 - RNA, 22 nt, Human
agcugcugccgguggccacccu

SEQ ID NO: 597217 - RNA, 22 nt, Human
ucccagggacugggcuaggcuu

SEQ ID NO: 597218 - RNA, 22 nt, Human
agagauucauguuuacuguagg

SEQ ID NO: 597219 - RNA, 22 nt, Human
ggcugcagcccucgccuagcca

SEQ ID NO: 597220 - RNA, 22 nt, Human
ggucucgagccaggcagcugca

SEQ ID NO: 597221 - RNA, 22 nt, Human
auacaaaguauuaauccuggau

SEQ ID NO: 597222 - RNA, 22 nt, Human
ucugaagcuggaggaagcuuug

SEQ ID NO: 597223 - RNA, 22 nt, Human
uuuguguuaaauguuaaauuca

SEQ ID NO: 597224 - RNA, 22 nt, Human
ugcaguccuggugaggggacau

SEQ ID NO: 597225 - RNA, 22 nt, Human
guaggcagguggaggagugaag

SEQ ID NO: 597226 - RNA, 22 nt, Human
agacuaaauaguuacagguagg

SEQ ID NO: 597227 - RNA, 22 nt, Human
aguggggacuuaugccagcauu

SEQ ID NO: 597228 - RNA, 22 nt, Human
ggcugggcaaacaagacucuuc

SEQ ID NO: 597229 - RNA, 22 nt, Human
uuuauuaugauggacaccuucg

SEQ ID NO: 597230 - RNA, 22 nt, Human
aaaagagaguugccagucugua

SEQ ID NO: 597231 - RNA, 22 nt, Human
cggcugcugccugagucgcugu

SEQ ID NO: 597232 - RNA, 22 nt, Human
uggcuuccagaacugagcaaca

SEQ ID NO: 597233 - RNA, 19 nt, Human
uccugcagaccagaccugu

SEQ ID NO: 597234 - RNA, 19 nt, Human
cugcuucaggcgccuugcc

SEQ ID NO: 597235 - RNA, 19 nt, Human
gcugccaggacaguuacug

SEQ ID NO: 597236 - RNA, 22 nt, Human
ucagaggcucaucugccuugca

SEQ ID NO: 597237 - RNA, 22 nt, Human
agaagauuuagguugacgcuau

SEQ ID NO: 597238 - RNA, 22 nt, Human
aaggcccuuccaccaguccucg

SEQ ID NO: 597239 - RNA, 22 nt, Human
uuucugccagguuucuggauga

SEQ ID NO: 597240 - RNA, 22 nt, Human
gcugggagacagacuuggaacc

SEQ ID NO: 597241 - RNA, 22 nt, Human
uaguuacagaucuaggacuguu

SEQ ID NO: 597242 - RNA, 18 nt, Human
uuccaugauuccuuucac

SEQ ID NO: 597243 - RNA, 22 nt, Human
cagagacacuuaacaggaaugg

SEQ ID NO: 597244 - RNA, 22 nt, Human
uacacccacauugagcauggga

SEQ ID NO: 597245 - RNA, 22 nt, Human
gccugcccacggggcuggcaua

SEQ ID NO: 597246 - RNA, 22 nt, Human
gaagaacuuuagggcagaauuu

SEQ ID NO: 597247 - RNA, 22 nt, Human
agugcagugguuaggagccagg

SEQ ID NO: 597248 - RNA, 16 nt, Human
accuccagucaagggu

SEQ ID NO: 597249 - RNA, 22 nt, Human
uucauuuaauuuguguauuaac

SEQ ID NO: 597250 - RNA, 22 nt, Human
gaggccacgguuuuccuugggg

SEQ ID NO: 597251 - RNA, 22 nt, Human
agcagccuggucucucgccaau

SEQ ID NO: 597252 - RNA, 22 nt, Human
cagagcuguugcggggcuuggc

SEQ ID NO: 597253 - RNA, 22 nt, Human
uacuuuuaugugaugaaaucug

SEQ ID NO: 597254 - RNA, 22 nt, Human
guuuuucucugaaauaguugac

SEQ ID NO: 597255 - RNA, 22 nt, Human
gcaggugguuaaggucccaugu

SEQ ID NO: 597256 - RNA, 22 nt, Human
aaauggcaguagaaaagaaucc

SEQ ID NO: 597257 - RNA, 22 nt, Human
ucugaggaaagagagugggaug

SEQ ID NO: 597258 - RNA, 22 nt, Human
uccuccagggggaucuucagcc

SEQ ID NO: 597259 - RNA, 22 nt, Human
uguacaaagccagaacucccaa

SEQ ID NO: 597260 - RNA, 22 nt, Human
acugucugcuggccccugguua

SEQ ID NO: 597261 - RNA, 22 nt, Human
gcugcagagacagcugccgaug

SEQ ID NO: 597262 - RNA, 22 nt, Human
aagcacagugggcagagcagcc

SEQ ID NO: 597263 - RNA, 22 nt, Human
uauuuccaccuauuauuuucug

SEQ ID NO: 597264 - RNA, 22 nt, Human
guggggagggagaugcugaagu

SEQ ID NO: 597265 - RNA, 22 nt, Human
ugcccugucgcucacucccacc

SEQ ID NO: 597266 - RNA, 22 nt, Human
ggugggugagcccugggagcug

SEQ ID NO: 597267 - RNA, 22 nt, Human
cugccugcucuauccaggccug

SEQ ID NO: 597268 - RNA, 22 nt, Human
ugugaggcgaggccagugagcu

SEQ ID NO: 597269 - RNA, 22 nt, Human
gccugugcuuaacugacgugag

SEQ ID NO: 597270 - RNA, 22 nt, Human
caagguuuugcuuguaagggaa

SEQ ID NO: 597271 - RNA, 22 nt, Human
acagcacaaucugagucccaga

SEQ ID NO: 597272 - RNA, 22 nt, Human
uguacuuccccaaugacagcac

SEQ ID NO: 597273 - RNA, 22 nt, Human
caugcacagugauaucugaaga

SEQ ID NO: 597274 - RNA, 22 nt, Human
aaacacuaauaacaguggcugg

SEQ ID NO: 597275 - RNA, 22 nt, Human
cuuaauguggaccugguuucua

SEQ ID NO: 597276 - RNA, 22 nt, Human
uacagugcuagaaccugcugua

SEQ ID NO: 597277 - RNA, 22 nt, Human
cacacuuucagguccucuuugc

SEQ ID NO: 597278 - RNA, 23 nt, Human
ccauucaucucagucauugcuuu

SEQ ID NO: 597279 - RNA, 18 nt, Human
ggaaggaguggaccccag

SEQ ID NO: 597280 - RNA, 22 nt, Human
ugagcccagagcccuuguaggg

SEQ ID NO: 597281 - RNA, 22 nt, Human
auucugagaaaugcauugucag

SEQ ID NO: 597282 - RNA, 22 nt, Human
ugggcagaaggaagagccaccu

SEQ ID NO: 597283 - RNA, 22 nt, Human
uacacacagaggccaugggauu

SEQ ID NO: 597284 - RNA, 22 nt, Human
cucuuuacugcuacuacaaaga

SEQ ID NO: 597285 - RNA, 21 nt, Human
gcagagaaugaacuuuggcuu

SEQ ID NO: 597286 - RNA, 22 nt, Human
gaguccuugucauaauucagug

SEQ ID NO: 597287 - RNA, 22 nt, Human
cccauuuguauagagccuuaua

SEQ ID NO: 597288 - RNA, 22 nt, Human
gcuguggccuccagcacucccc

SEQ ID NO: 597289 - RNA, 22 nt, Human
ucacaggacagccuuccacccg

SEQ ID NO: 597290 - RNA, 22 nt, Human
agugcuuuguggagaauuugua

SEQ ID NO: 597291 - RNA, 22 nt, Human
uaugcauagguaucuauacuca

SEQ ID NO: 597292 - RNA, 19 nt, Human
ccuuugaaucaggacacuu

SEQ ID NO: 597293 - RNA, 22 nt, Human
aggaaacuaauuaguagaauaa

SEQ ID NO: 597294 - RNA, 20 nt, Human
uucucuagccuuccccuggg

SEQ ID NO: 597295 - RNA, 19 nt, Human
gcuggcagauguggccgug

SEQ ID NO: 597296 - RNA, 22 nt, Human
acaggaguuuaagaaauauuuc

SEQ ID NO: 597297 - RNA, 22 nt, Human
uccagcucugauucucacuagc

SEQ ID NO: 597298 - RNA, 22 nt, Human
ucugaggcuucagacuguacug

SEQ ID NO: 597299 - RNA, 22 nt, Human
agcugucagugcugugccugua

SEQ ID NO: 597300 - RNA, 23 nt, Human
cccuggagcuagucugagcagag

SEQ ID NO: 597301 - RNA, 22 nt, Human
accaugccaguggcagccagac

SEQ ID NO: 597302 - RNA, 22 nt, Human
agcuuccugaugcaagagggcu

SEQ ID NO: 597303 - RNA, 23 nt, Human
ucugaagaugcuguuuccaguga

SEQ ID NO: 597304 - RNA, 23 nt, Human
ccccucugguggcucagcuccug

SEQ ID NO: 597305 - RNA, 21 nt, Human
uuuuauugaugaauggccacu

SEQ ID NO: 597306 - RNA, 22 nt, Human
cucacagcagcucugcgagaua

SEQ ID NO: 597307 - RNA, 22 nt, Human
gugcaguugaagcauggggaga

SEQ ID NO: 597308 - RNA, 22 nt, Human
uauuugaagggagaaagugcca

SEQ ID NO: 597309 - RNA, 22 nt, Human
cugagccagagggagucggguc

SEQ ID NO: 597310 - RNA, 22 nt, Human
acccaggacuuggcaaccucau

SEQ ID NO: 597311 - RNA, 22 nt, Human
aggagccaggaaaccugcucug

SEQ ID NO: 597312 - RNA, 19 nt, Human
aggccugggguuuugcacu

SEQ ID NO: 597313 - RNA, 22 nt, Human
ugauuucuucuaauuuccauca

SEQ ID NO: 597314 - RNA, 20 nt, Human
auauuucagguagugugccc

SEQ ID NO: 597315 - RNA, 22 nt, Human
ugcugggccaaagcaggguuuu

SEQ ID NO: 597316 - RNA, 22 nt, Human
gguggagcuggaccaggagagg

SEQ ID NO: 597317 - RNA, 22 nt, Human
gagcaacacuccacauugcuag

SEQ ID NO: 597318 - RNA, 22 nt, Human
augaagacaggucucaucacca

SEQ ID NO: 597319 - RNA, 22 nt, Human
ucugagguuacugcuuuguaga

SEQ ID NO: 597320 - RNA, 22 nt, Human
auggaaauguuccauauauuga

SEQ ID NO: 597321 - RNA, 22 nt, Human
ugccuggcaacuguggugggcu

SEQ ID NO: 597322 - RNA, 22 nt, Human
ugcacacaguucucaggaaaga

SEQ ID NO: 597323 - RNA, 22 nt, Human
gggcugaaaggccgccucagau

SEQ ID NO: 597324 - RNA, 22 nt, Human
ggaggggaacuaaucccgugac

SEQ ID NO: 597325 - RNA, 22 nt, Human
uccaggaguccuggguggcccc

SEQ ID NO: 597326 - RNA, 22 nt, Human
uucuuucuuggggaacacacuc

SEQ ID NO: 597327 - RNA, 22 nt, Human
uuauaacaacaguuuacuuuaa

SEQ ID NO: 597328 - RNA, 22 nt, Human
caguuuccugaagagaaagaau

SEQ ID NO: 597329 - RNA, 22 nt, Human
ugagaagauuugcucuucugag

SEQ ID NO: 597330 - RNA, 22 nt, Human
cagcccugucuaugacugauga

SEQ ID NO: 597331 - RNA, 21 nt, Human
ugguuaaaguugugucauccc

SEQ ID NO: 597332 - RNA, 22 nt, Human
cugaaagcaaaguaauucuuaa

SEQ ID NO: 597333 - RNA, 22 nt, Human
ugucauuuaaagcuuuccagau

SEQ ID NO: 597334 - RNA, 22 nt, Human
uauguguacucguuaaauauuu

SEQ ID NO: 597335 - RNA, 22 nt, Human
caggcuguggaucaggagccuu

SEQ ID NO: 597336 - RNA, 22 nt, Human
uucacauucagaaaaagcccgu

SEQ ID NO: 597337 - RNA, 22 nt, Human
agcuauugugugcccagcagga

SEQ ID NO: 597338 - RNA, 22 nt, Human
caucagaagauggcucuggaaa

SEQ ID NO: 597339 - RNA, 22 nt, Human
aacauggaggcagacagacgug

SEQ ID NO: 597340 - RNA, 22 nt, Human
ucuuguuucuguauauaaugac

SEQ ID NO: 597341 - RNA, 22 nt, Human
aggaacugaugagcagccaggg

SEQ ID NO: 597342 - RNA, 22 nt, Human
cagcuccugcagcugcugccgu

SEQ ID NO: 597343 - RNA, 22 nt, Human
aagagcaguguuuuacucagcu

SEQ ID NO: 597344 - RNA, 22 nt, Human
agccugggccuggcuucccgcc

SEQ ID NO: 597345 - RNA, 20 nt, Human
caccaggcgcucugagaaca

SEQ ID NO: 597346 - RNA, 22 nt, Human
uuugaagagccacagugaaauu

SEQ ID NO: 597347 - RNA, 22 nt, Human
uccugaagaacgaagucaugua

SEQ ID NO: 597348 - RNA, 22 nt, Human
ucccagccggugccuggguccc

SEQ ID NO: 597349 - RNA, 22 nt, Human
aaagcaugcuacuuuauauagg

SEQ ID NO: 597350 - RNA, 22 nt, Human
ccaggagauuuuuccauagcac

SEQ ID NO: 597351 - RNA, 22 nt, Human
ugacauuugagagagauauaca

SEQ ID NO: 597352 - RNA, 22 nt, Human
auuguuacuggguuaauuugga

SEQ ID NO: 597353 - RNA, 22 nt, Human
uauugugcauguugaauaacua

SEQ ID NO: 597354 - RNA, 22 nt, Human
agaugguuuugucuuuaugauu

SEQ ID NO: 597355 - RNA, 22 nt, Human
agccugagccccauccagcuga

SEQ ID NO: 597356 - RNA, 22 nt, Human
ccaguggacaauuucugaggaa

SEQ ID NO: 597357 - RNA, 22 nt, Human
aaagggcugucaaauaagcaac

SEQ ID NO: 597358 - RNA, 21 nt, Human
uucugccuuccccuagcuggg

SEQ ID NO: 597359 - RNA, 22 nt, Human
caguauuuucaggauuuggaag

SEQ ID NO: 597360 - RNA, 22 nt, Human
aggacugaugauggugcugaca

SEQ ID NO: 597361 - RNA, 22 nt, Human
ccugcagagccacgugccagcg

SEQ ID NO: 597362 - RNA, 22 nt, Human
uauaaagagucucaaagaaguu

SEQ ID NO: 597363 - RNA, 19 nt, Human
uuaagcuaagauacuagua

SEQ ID NO: 597364 - RNA, 22 nt, Human
gcugcccauugcacguuguggc

SEQ ID NO: 597365 - RNA, 22 nt, Human
ucaaugcaacuuccaccuccca

SEQ ID NO: 597366 - RNA, 22 nt, Human
ugcuuugugauaugcugugucu

SEQ ID NO: 597367 - RNA, 21 nt, Human
gauuuuaaagagacugccaca

SEQ ID NO: 597368 - RNA, 22 nt, Human
ugucuccaaaacaaucucagau

SEQ ID NO: 597369 - RNA, 22 nt, Human
gcaggagaaaugaagauugggu

SEQ ID NO: 597370 - RNA, 22 nt, Human
ucauuuauuugacuuuggagug

SEQ ID NO: 597371 - RNA, 22 nt, Human
auccuggcccucaugaccccuu

SEQ ID NO: 597372 - RNA, 16 nt, Human
uccuaacuggcaguuc

SEQ ID NO: 597373 - RNA, 20 nt, Human
gcuucucagggcuucucuga

SEQ ID NO: 597374 - RNA, 22 nt, Human
uccugccuugccugggacauca

SEQ ID NO: 597375 - RNA, 22 nt, Human
ucugcccaguuugugcucaggu

SEQ ID NO: 597376 - RNA, 22 nt, Human
gugcuuuaaagacaguuaugcu

SEQ ID NO: 597377 - RNA, 20 nt, Human
acacaugcauagagagagag

SEQ ID NO: 597378 - RNA, 22 nt, Human
uacaggauaucacuucauuucu

SEQ ID NO: 597379 - RNA, 23 nt, Human
ggcuccugcuucaugucccaccu

SEQ ID NO: 597380 - RNA, 22 nt, Human
ccugccagcauggcuuaucucc

SEQ ID NO: 597381 - RNA, 22 nt, Human
auuaauuuccaggcacugugcu

SEQ ID NO: 597382 - RNA, 23 nt, Human
uaaagcaaagucaagugcacucc

SEQ ID NO: 597383 - RNA, 22 nt, Human
gagguccagagcagguucagug

SEQ ID NO: 597384 - RNA, 22 nt, Human
aaagcagcaaguauuuguuacu

SEQ ID NO: 597385 - RNA, 22 nt, Human
cagggccuggagcugggccugc

SEQ ID NO: 597386 - RNA, 22 nt, Human
ucagcugcucuguugagcugaa

SEQ ID NO: 597387 - RNA, 22 nt, Human
aagugcugagacuacaggcaug

SEQ ID NO: 597388 - RNA, 22 nt, Human
gacuggagcccccaaggacacc

SEQ ID NO: 597389 - RNA, 20 nt, Human
gcuuucuaugagauggacug

SEQ ID NO: 597390 - RNA, 22 nt, Human
uguccauggagaagcucagggc

SEQ ID NO: 597391 - RNA, 22 nt, Human
ccuuuaaauggauguucaacug

SEQ ID NO: 597392 - RNA, 22 nt, Human
uuagaguucagcaugacuuuga

SEQ ID NO: 597393 - RNA, 22 nt, Human
ucuggagucugagaucugagga

SEQ ID NO: 597394 - RNA, 22 nt, Human
ugccucugggugaccaaggagc

SEQ ID NO: 597395 - RNA, 22 nt, Human
uucuuucugaauacaguugagu

SEQ ID NO: 597396 - RNA, 22 nt, Human
acagagaccuggccuugcuuug

SEQ ID NO: 597397 - RNA, 18 nt, Human
uuuuaauuucaggggugg

SEQ ID NO: 597398 - RNA, 23 nt, Human
agugcuggagaagcuucuggcuu

SEQ ID NO: 597399 - RNA, 22 nt, Human
uccagcagcccgaaggcccauc

SEQ ID NO: 597400 - RNA, 22 nt, Human
caagauucuaguugagguucaa

SEQ ID NO: 597401 - RNA, 22 nt, Human
agagccaguuacaacuguggag

SEQ ID NO: 597402 - RNA, 22 nt, Human
ugggaguagaugaggagugggc

SEQ ID NO: 597403 - RNA, 22 nt, Human
gcugguccacucccuggaggcu

SEQ ID NO: 597404 - RNA, 22 nt, Human
cuguggccagagcgccguugac

SEQ ID NO: 597405 - RNA, 22 nt, Human
caauauauaggaacaacuuagg

SEQ ID NO: 597406 - RNA, 22 nt, Human
cagaguguuucuuugggugggu

SEQ ID NO: 597407 - RNA, 23 nt, Human
caguggagacucaugcuuccuua

SEQ ID NO: 597408 - RNA, 22 nt, Human
cucuggcuuugcucaugcaucc

SEQ ID NO: 597409 - RNA, 22 nt, Human
gaggggcguccugagugggccu

SEQ ID NO: 597410 - RNA, 21 nt, Human
ccagagccugcugagcccccu

SEQ ID NO: 597411 - RNA, 22 nt, Human
acagugcugaucuagacugacc

SEQ ID NO: 597412 - RNA, 22 nt, Human
aaaagucuuggggaaggccagg

SEQ ID NO: 597413 - RNA, 22 nt, Human
aacaaauguguggcaguguggg

SEQ ID NO: 597414 - RNA, 22 nt, Human
uucuauguaguagcagagccaa

SEQ ID NO: 597415 - RNA, 20 nt, Human
ugcugggcaugcaguggaaa

SEQ ID NO: 597416 - RNA, 22 nt, Human
ggaagggguuaggggucccuga

SEQ ID NO: 597417 - RNA, 22 nt, Human
cugcugacucauuuucaacacu

SEQ ID NO: 597418 - RNA, 23 nt, Human
uuugaacauuucuagauuacaua

SEQ ID NO: 597419 - RNA, 22 nt, Human
aaaugguauaaugucauguauu

SEQ ID NO: 597420 - RNA, 22 nt, Human
acuuaaugguuccuaaaaugug

SEQ ID NO: 597421 - RNA, 22 nt, Human
acauuguuccagcgauagagaa

SEQ ID NO: 597422 - RNA, 22 nt, Human
cugggccucacccuagaccaau

SEQ ID NO: 597423 - RNA, 22 nt, Human
ugagcuuacuucuguacacaga

SEQ ID NO: 597424 - RNA, 22 nt, Human
cagcuuugugcaaugcagucuc

SEQ ID NO: 597425 - RNA, 22 nt, Human
ggccagaggccauccuccugcu

SEQ ID NO: 597426 - RNA, 20 nt, Human
cucagcucuucagggcaagu

SEQ ID NO: 597427 - RNA, 22 nt, Human
uuacuuuagggauguuuugcuu

SEQ ID NO: 597428 - RNA, 22 nt, Human
augcuauguaacuggcagauag

SEQ ID NO: 597429 - RNA, 22 nt, Human
ugcuguagggagaaagaguuga

SEQ ID NO: 597430 - RNA, 22 nt, Human
agcacuuaacugacaguacuau

SEQ ID NO: 597431 - RNA, 22 nt, Human
gcaccagggagggugugcuuca

SEQ ID NO: 597432 - RNA, 22 nt, Human
ccacuggcuuuuccuaggucuc

SEQ ID NO: 597433 - RNA, 22 nt, Human
uguacaaauucaguucuagggu

SEQ ID NO: 597434 - RNA, 22 nt, Human
acacagagccagggaauacagu

SEQ ID NO: 597435 - RNA, 22 nt, Human
ugugcacauauacucauauucc

SEQ ID NO: 597436 - RNA, 22 nt, Human
gcugaguugaaagcagaggaua

SEQ ID NO: 597437 - RNA, 22 nt, Human
gaaaggagugcuuuccaggucu

SEQ ID NO: 597438 - RNA, 22 nt, Human
ggcucagguuuaaagugcuuua

SEQ ID NO: 597439 - RNA, 22 nt, Human
gcaggcagagagggguuuccag

SEQ ID NO: 597440 - RNA, 22 nt, Human
aaagagcauggaaaguucagga

SEQ ID NO: 597441 - RNA, 22 nt, Human
uccugaaggagcaguugcuggg

SEQ ID NO: 597442 - RNA, 22 nt, Human
gagggaaagguuaauacaugau

SEQ ID NO: 597443 - RNA, 22 nt, Human
cagcagcuacuuggagcagcag

SEQ ID NO: 597444 - RNA, 22 nt, Human
agagccuggaccugagcuacaa

SEQ ID NO: 597445 - RNA, 22 nt, Human
auagaaaacagauguccuuaaa

SEQ ID NO: 597446 - RNA, 22 nt, Human
agagugggacacgggcgcuguc

SEQ ID NO: 597447 - RNA, 22 nt, Human
accagcuggucaccugggcacu

SEQ ID NO: 597448 - RNA, 22 nt, Human
uguucuugagccuuuagaccua

SEQ ID NO: 597449 - RNA, 22 nt, Human
agauggguugagaacacaugcu

SEQ ID NO: 597450 - RNA, 22 nt, Human
uuauuuccucucuaauagggua

SEQ ID NO: 597451 - RNA, 22 nt, Human
uaaggagguugguggguuggau

SEQ ID NO: 597452 - RNA, 22 nt, Human
uuagggaaauaaaauuaucagu

SEQ ID NO: 597453 - RNA, 20 nt, Human
gcccugugaugucuugaccu

SEQ ID NO: 597454 - RNA, 19 nt, Human
aggcagucauuggaauaua

SEQ ID NO: 597455 - RNA, 22 nt, Human
gaugcugagcuguauggcuggu

SEQ ID NO: 597456 - RNA, 22 nt, Human
cuggccugcagaucccaggguc

SEQ ID NO: 597457 - RNA, 22 nt, Human
gggagggauuaguucugccugg

SEQ ID NO: 597458 - RNA, 19 nt, Human
caggugguaaucugagccu

SEQ ID NO: 597459 - RNA, 22 nt, Human
ucugccuuccccauaaucugau

SEQ ID NO: 597460 - RNA, 22 nt, Human
aguacagaccugucucuuccug

SEQ ID NO: 597461 - RNA, 22 nt, Human
cugggagguggagguugcauug

SEQ ID NO: 597462 - RNA, 22 nt, Human
gggagggaaagcuugaucuguc

SEQ ID NO: 597463 - RNA, 22 nt, Human
aucagcaggugcugguggagac

SEQ ID NO: 597464 - RNA, 22 nt, Human
uucuuucccagaagauauguuu

SEQ ID NO: 597465 - RNA, 21 nt, Human
acagugagaaauaaauggaaa

SEQ ID NO: 597466 - RNA, 22 nt, Human
uucuguuugugaacuggcugag

SEQ ID NO: 597467 - RNA, 22 nt, Human
caagcagagguuuauguauuag

SEQ ID NO: 597468 - RNA, 22 nt, Human
uagcauuucccaaaugcauuug

SEQ ID NO: 597469 - RNA, 22 nt, Human
ucuuuccuguaacugcuguuca

SEQ ID NO: 597470 - RNA, 22 nt, Human
uuucugcuuaggacucugugga

SEQ ID NO: 597471 - RNA, 22 nt, Human
cccuuagccaggaaaucgaccu

SEQ ID NO: 597472 - RNA, 22 nt, Human
gcugccagcucacucuccugag

SEQ ID NO: 597473 - RNA, 22 nt, Human
guggcucacgucugucaucuca

SEQ ID NO: 597474 - RNA, 22 nt, Human
gggcuccaaaauccuguagccu

SEQ ID NO: 597475 - RNA, 22 nt, Human
aagaacauaacagaagcugugu

SEQ ID NO: 597476 - RNA, 22 nt, Human
uggcccugcuuaugucucucuu

SEQ ID NO: 597477 - RNA, 17 nt, Human
ucuccuggcucuaucag

SEQ ID NO: 597478 - RNA, 22 nt, Human
cagagggcuucagguucaggau

SEQ ID NO: 597479 - RNA, 22 nt, Human
ccccagcacucugacucuuacc

SEQ ID NO: 597480 - RNA, 22 nt, Human
caggcagcugggucaccguccc

SEQ ID NO: 597481 - RNA, 22 nt, Human
aguggcaguagaugagcugguu

SEQ ID NO: 597482 - RNA, 22 nt, Human
ggugggcagcucuuggcaggca

SEQ ID NO: 597483 - RNA, 22 nt, Human
gccuccggaguugcagugucuu

SEQ ID NO: 597484 - RNA, 22 nt, Human
uguacaaagguacuuugauguu

SEQ ID NO: 597485 - RNA, 22 nt, Human
cugccuggaaugccagcuucuc

SEQ ID NO: 597486 - RNA, 23 nt, Human
caggcucccggaccaggauccgc

SEQ ID NO: 597487 - RNA, 22 nt, Human
gcugcccauuccacuggauggu

SEQ ID NO: 597488 - RNA, 22 nt, Human
ccaggcugcucacaagcugccc

SEQ ID NO: 597489 - RNA, 22 nt, Human
auugcuuuguacaugccuagca

SEQ ID NO: 597490 - RNA, 17 nt, Human
ggcugcugugcuggugc

SEQ ID NO: 597491 - RNA, 22 nt, Human
gaauuauaaacuagugacuuca

SEQ ID NO: 597492 - RNA, 22 nt, Human
cugcccucuagaggaggacuga

SEQ ID NO: 597493 - RNA, 22 nt, Human
uggguagggacuuagcuggcug

SEQ ID NO: 597494 - RNA, 22 nt, Human
aucucugauuuacagcaucucu

SEQ ID NO: 597495 - RNA, 21 nt, Human
aguuacauguauagauaaagu

SEQ ID NO: 597496 - RNA, 22 nt, Human
uacuuguuaucaucuuuuccuu

SEQ ID NO: 597497 - RNA, 21 nt, Human
gccugggaagagaaagguaag

SEQ ID NO: 597498 - RNA, 22 nt, Human
caggcugcuguccacaaagcau

SEQ ID NO: 597499 - RNA, 22 nt, Human
cuuuacaaacuauaaagugcgg

SEQ ID NO: 597500 - RNA, 22 nt, Human
ccugcccacugcccggucagcc

SEQ ID NO: 597501 - RNA, 22 nt, Human
gccaggcagcugggagggugcc

SEQ ID NO: 597502 - RNA, 22 nt, Human
aggaagcucggagagggcaaau

SEQ ID NO: 597503 - RNA, 22 nt, Human
gccaggcuggugcaaggauauu

SEQ ID NO: 597504 - RNA, 22 nt, Human
aggagccauugcaggauggcag

SEQ ID NO: 597505 - RNA, 22 nt, Human
acauguaugugugcaaacacau

SEQ ID NO: 597506 - RNA, 22 nt, Human
gcccucagaguuccccacagug

SEQ ID NO: 597507 - RNA, 20 nt, Human
ccacaagggaauauuguuga

SEQ ID NO: 597508 - RNA, 22 nt, Human
ucccacugugaauccaaggccu

SEQ ID NO: 597509 - RNA, 22 nt, Human
uagaacagaggguugcccagau

SEQ ID NO: 597510 - RNA, 22 nt, Human
uuugaaagaauuuauguacuuu

SEQ ID NO: 597511 - RNA, 22 nt, Human
ccaggagucuggaugagguguc

SEQ ID NO: 597512 - RNA, 19 nt, Human
ucagaggauuuggcuauga

SEQ ID NO: 597513 - RNA, 22 nt, Human
cagcucccagagugaccagcag

SEQ ID NO: 597514 - RNA, 22 nt, Human
uugcuuuauguguaugacuuga

SEQ ID NO: 597515 - RNA, 22 nt, Human
uuguuuuaacgacucagcuugu

SEQ ID NO: 597516 - RNA, 22 nt, Human
ccugagacaugaaccaggcucc

SEQ ID NO: 597517 - RNA, 22 nt, Human
cuggcugggagcgagcugcuca

SEQ ID NO: 597518 - RNA, 22 nt, Human
uggcuucuugggaugggucauu

SEQ ID NO: 597519 - RNA, 22 nt, Human
cagaaguuuugcucucuugggu

SEQ ID NO: 597520 - RNA, 22 nt, Human
uucauugaagcacaagugaucu

SEQ ID NO: 597521 - RNA, 22 nt, Human
gaagcagucagcagcaccuuug

SEQ ID NO: 597522 - RNA, 22 nt, Human
agacuuaggugagauguuugua

SEQ ID NO: 597523 - RNA, 22 nt, Human
ugcugccaagcccgugcuccug

SEQ ID NO: 597524 - RNA, 21 nt, Human
ugagucucccuuagcccacgc

SEQ ID NO: 597525 - RNA, 22 nt, Human
gauuuaaaguagaccuuuguuu

SEQ ID NO: 597526 - RNA, 22 nt, Human
ugggcccugcccuugucugucc

SEQ ID NO: 597527 - RNA, 23 nt, Human
aaacuugcuauggcugaaaucau

SEQ ID NO: 597528 - RNA, 22 nt, Human
uccagcuccacagccucccugu

SEQ ID NO: 597529 - RNA, 22 nt, Human
uacacaguaaaugguaaauaca

SEQ ID NO: 597530 - RNA, 22 nt, Human
caagagcugcaaauagcgugac

SEQ ID NO: 597531 - RNA, 19 nt, Human
aggcagaggcuuggcuagc

SEQ ID NO: 597532 - RNA, 22 nt, Human
cagaagcaaguagugauucuuu

SEQ ID NO: 597533 - RNA, 22 nt, Human
acacacagaguuuauacaggca

SEQ ID NO: 597534 - RNA, 22 nt, Human
ugaagauuuagaccucuuugcc

SEQ ID NO: 597535 - RNA, 22 nt, Human
ggcagccauacucagaccuggg

SEQ ID NO: 597536 - RNA, 22 nt, Human
agucccagacuccaguuuucug

SEQ ID NO: 597537 - RNA, 22 nt, Human
ugaaggagggaagaaggcucug

SEQ ID NO: 597538 - RNA, 19 nt, Human
uuagggguaugaaguggua

SEQ ID NO: 597539 - RNA, 22 nt, Human
gaagcagagccuaaggcagaca

SEQ ID NO: 597540 - RNA, 22 nt, Human
uuguguguuuguagaaaaucca

SEQ ID NO: 597541 - RNA, 22 nt, Human
ggcugagggucccagacccuaa

SEQ ID NO: 597542 - RNA, 23 nt, Human
agcaccaggaacagugugguccu

SEQ ID NO: 597543 - RNA, 20 nt, Human
agguaggaucggugucauaa

SEQ ID NO: 597544 - RNA, 22 nt, Human
ccuccccacccacggcuggugg

SEQ ID NO: 597545 - RNA, 22 nt, Human
cuugugcaucucuucaugacca

SEQ ID NO: 597546 - RNA, 22 nt, Human
aaacacugaagaccuaucuggu

SEQ ID NO: 597547 - RNA, 22 nt, Human
gaggccuggucuaugagauguu

SEQ ID NO: 597548 - RNA, 22 nt, Human
ugaggccucugaggccuaggcu

SEQ ID NO: 597549 - RNA, 22 nt, Human
ugcuguguucaccaauaugugu

SEQ ID NO: 597550 - RNA, 20 nt, Human
ggggcagguuuuuauggcua

SEQ ID NO: 597551 - RNA, 22 nt, Human
uccuggaguauuucuguggugu

SEQ ID NO: 597552 - RNA, 22 nt, Human
augacaguacuggugacaauac

SEQ ID NO: 597553 - RNA, 22 nt, Human
auaaagaggauguauuuacagc

SEQ ID NO: 597554 - RNA, 22 nt, Human
caggguugcaugcaucuguggg

SEQ ID NO: 597555 - RNA, 22 nt, Human
auuaaggauuauacucuccuuu

SEQ ID NO: 597556 - RNA, 22 nt, Human
ugaaugcuuggagucauaaaau

SEQ ID NO: 597557 - RNA, 22 nt, Human
gucuggaggcacuuucucauga

SEQ ID NO: 597558 - RNA, 21 nt, Human
gguguccagaggaguccccag

SEQ ID NO: 597559 - RNA, 22 nt, Human
ucugggcuuuacacugugcuua

SEQ ID NO: 597560 - RNA, 22 nt, Human
caaugcacauggacaucaggcu

SEQ ID NO: 597561 - RNA, 22 nt, Human
auacauacguacauacguaugu

SEQ ID NO: 597562 - RNA, 22 nt, Human
ugggcaggaugcguugauucuu

SEQ ID NO: 597563 - RNA, 22 nt, Human
uaagcauaacuaaaaaugauuu

SEQ ID NO: 597564 - RNA, 22 nt, Human
agacaaguguggugagagcagu

SEQ ID NO: 597565 - RNA, 22 nt, Human
cugaauggcgaguuaguuaguu

SEQ ID NO: 597566 - RNA, 22 nt, Human
acagcugugacuuagagaaguu

SEQ ID NO: 597567 - RNA, 22 nt, Human
acaggggcaagggcucacggcc

SEQ ID NO: 597568 - RNA, 22 nt, Human
cugggagcggcugucacugguu

SEQ ID NO: 597569 - RNA, 22 nt, Human
auuagcauugcuacucucaaga

SEQ ID NO: 597570 - RNA, 22 nt, Human
ggagccaguauuuaguggucuu

SEQ ID NO: 597571 - RNA, 22 nt, Human
gaggccugaaaggggaccuaug

SEQ ID NO: 597572 - RNA, 19 nt, Human
aggcagcacccaguccuug

SEQ ID NO: 597573 - RNA, 22 nt, Human
acugaggcagaaggguaagugg

SEQ ID NO: 597574 - RNA, 22 nt, Human
ccuccugguaauuagcgaaagg

SEQ ID NO: 597575 - RNA, 22 nt, Human
guaacgaauaaacaagugauaa

SEQ ID NO: 597576 - RNA, 22 nt, Human
accagggcuuacagcaguagcu

SEQ ID NO: 597577 - RNA, 22 nt, Human
cugaggcuuguccucucagcuu

SEQ ID NO: 597578 - RNA, 22 nt, Human
aagggcagccugacucacgguc

SEQ ID NO: 597579 - RNA, 21 nt, Human
auggcuucucaggugcacuga

SEQ ID NO: 597580 - RNA, 22 nt, Human
uuguuacagcagugauuucaga

SEQ ID NO: 597581 - RNA, 22 nt, Human
ggcagcuggggcagugcccugu

SEQ ID NO: 597582 - RNA, 22 nt, Human
auucuaaagcuuguggagcuua

SEQ ID NO: 597583 - RNA, 22 nt, Human
acaggucuggucugggugggac

SEQ ID NO: 597584 - RNA, 19 nt, Human
cagaggccagaagcacagg

SEQ ID NO: 597585 - RNA, 22 nt, Human
ugucccauggacacaacuucuu

SEQ ID NO: 597586 - RNA, 22 nt, Human
uugcauaaaugcuuaaaauuug

SEQ ID NO: 597587 - RNA, 22 nt, Human
cauggcugaacacucagugacu

SEQ ID NO: 597588 - RNA, 18 nt, Human
cuuuuguuuucccuccuc

SEQ ID NO: 597589 - RNA, 18 nt, Human
agccugggcucugccugg

SEQ ID NO: 597590 - RNA, 22 nt, Human
aguuucuugaagacugauguuu

SEQ ID NO: 597591 - RNA, 22 nt, Human
guggagaggaacccagcucugu

SEQ ID NO: 597592 - RNA, 17 nt, Human
acccaggcucuaucuug

SEQ ID NO: 597593 - RNA, 22 nt, Human
uagaggagggcuguucuucagu

SEQ ID NO: 597594 - RNA, 22 nt, Human
acugagaagauucucacucuua

SEQ ID NO: 597595 - RNA, 22 nt, Human
uugauuucuauugaguuccugu

SEQ ID NO: 597596 - RNA, 22 nt, Human
uagggcugcuuuguauucugcu

SEQ ID NO: 597597 - RNA, 18 nt, Human
acaaaggucugcaagacc

SEQ ID NO: 597598 - RNA, 22 nt, Human
agcaggagagcagugcgugguc

SEQ ID NO: 597599 - RNA, 22 nt, Human
gcaguguuuguguucucacaug

SEQ ID NO: 597600 - RNA, 22 nt, Human
aggcugcagugcagguaggauu

SEQ ID NO: 597601 - RNA, 19 nt, Human
uucuccagggacuuaggga

SEQ ID NO: 597602 - RNA, 22 nt, Human
gcugagagugagcacuggauau

SEQ ID NO: 597603 - RNA, 22 nt, Human
accccaggcccagggaagaggc

SEQ ID NO: 597604 - RNA, 22 nt, Human
gcccccagcucucaagcucaaa

SEQ ID NO: 597605 - RNA, 22 nt, Human
cacccagagggcuugcugaaca

SEQ ID NO: 597606 - RNA, 22 nt, Human
gggcugaguuccugccucacuc

SEQ ID NO: 597607 - RNA, 22 nt, Human
caccagcucuccaccagguuuc

SEQ ID NO: 597608 - RNA, 22 nt, Human
ugguuuuagaguauauucaggg

SEQ ID NO: 597609 - RNA, 22 nt, Human
gggccaugagagguucaucaac

SEQ ID NO: 597610 - RNA, 22 nt, Human
uuuauugucuaugaacugcuug

SEQ ID NO: 597611 - RNA, 18 nt, Human
gagcugccauauuuaguu

SEQ ID NO: 597612 - RNA, 22 nt, Human
gcacccagauagcaaggauuag

SEQ ID NO: 597613 - RNA, 22 nt, Human
ccugaggucaugguccaguguu

SEQ ID NO: 597614 - RNA, 22 nt, Human
cucuggccagagccugcgggaa

SEQ ID NO: 597615 - RNA, 22 nt, Human
ugcugaaucccacccuccagug

SEQ ID NO: 597616 - RNA, 21 nt, Human
gcaggcacucuagaggagcug

SEQ ID NO: 597617 - RNA, 22 nt, Human
ggcugcuggaguugggucucuc

SEQ ID NO: 597618 - RNA, 19 nt, Human
ucugaaugggaugaguugg

SEQ ID NO: 597619 - RNA, 22 nt, Human
ggccuuccugcugcuccgggcc

SEQ ID NO: 597620 - RNA, 22 nt, Human
cccagccucugggcucacccaa

SEQ ID NO: 597621 - RNA, 19 nt, Human
gggcauggaugagcuuacc

SEQ ID NO: 597622 - RNA, 22 nt, Human
augcugggaagacaagguggag

SEQ ID NO: 597623 - RNA, 22 nt, Human
aacaggcuggccuugaagcagu

SEQ ID NO: 597624 - RNA, 22 nt, Human
agaguuuguaguggugaaugua

SEQ ID NO: 597625 - RNA, 22 nt, Human
uuagcauuucuggaaucacaag

SEQ ID NO: 597626 - RNA, 22 nt, Human
ccucagagacugcaucuucccu

SEQ ID NO: 597627 - RNA, 18 nt, Human
ucaugagguagaggcugg

SEQ ID NO: 597628 - RNA, 22 nt, Human
gauaacauacuugcauguguau

SEQ ID NO: 597629 - RNA, 20 nt, Human
aagguccaaacucuguguuc

SEQ ID NO: 597630 - RNA, 22 nt, Human
cuccagggaggucugcaggacu

SEQ ID NO: 597631 - RNA, 22 nt, Human
uauguucugucuguacagauuu

SEQ ID NO: 597632 - RNA, 19 nt, Human
cuuugccaaaagaggccau

SEQ ID NO: 597633 - RNA, 22 nt, Human
uuuucuuuaaucugguggggug

SEQ ID NO: 597634 - RNA, 21 nt, Human
aaguaaugugucucuucuacc

SEQ ID NO: 597635 - RNA, 22 nt, Human
auaaacaucuguuucucuucug

SEQ ID NO: 597636 - RNA, 22 nt, Human
cugcauuucacauuuaaacuuu

SEQ ID NO: 597637 - RNA, 22 nt, Human
ggguaggaaauccagagguggc

SEQ ID NO: 597638 - RNA, 22 nt, Human
ugugggcaaaggguagcugggu

SEQ ID NO: 597639 - RNA, 22 nt, Human
uucuaccauugggaaaacagcc

SEQ ID NO: 597640 - RNA, 22 nt, Human
uggaacaacaugcuggaaaauu

SEQ ID NO: 597641 - RNA, 22 nt, Human
caggccugugacaccgugucug

SEQ ID NO: 597642 - RNA, 22 nt, Human
uccuggggaggucgaggcugag

SEQ ID NO: 597643 - RNA, 22 nt, Human
aaugucaugggaauuuauucau

SEQ ID NO: 597644 - RNA, 22 nt, Human
agcagguggauuuagacgggag

SEQ ID NO: 597645 - RNA, 22 nt, Human
gacagagugcagggcuagaaga

SEQ ID NO: 597646 - RNA, 22 nt, Human
gccaggcuccccggaucccugg

SEQ ID NO: 597647 - RNA, 23 nt, Human
gccauggcugccccacaggccuc

SEQ ID NO: 597648 - RNA, 22 nt, Human
uuuccuuccagguuccuaaggc

SEQ ID NO: 597649 - RNA, 22 nt, Human
acugugcagguagaugccuggg

SEQ ID NO: 597650 - RNA, 22 nt, Human
uggcagcuguuaauguuuuguu

SEQ ID NO: 597651 - RNA, 22 nt, Human
cggggaagcgguucuggcggua

SEQ ID NO: 597652 - RNA, 22 nt, Human
cuugugcauaagaagaccugag

SEQ ID NO: 597653 - RNA, 22 nt, Human
caguuucugucuguucuuaucc

SEQ ID NO: 597654 - RNA, 22 nt, Human
augucaaacacaacaccagugg

SEQ ID NO: 597655 - RNA, 22 nt, Human
uaccugaguuauauuaauaauu

SEQ ID NO: 597656 - RNA, 22 nt, Human
aacaggcccugccauuuaucca

SEQ ID NO: 597657 - RNA, 22 nt, Human
cucuggguggucucacugagug

SEQ ID NO: 597658 - RNA, 22 nt, Human
uacauaguauucacauuguuuu

SEQ ID NO: 597659 - RNA, 22 nt, Human
gccaggaguguguggcuauguu

SEQ ID NO: 597660 - RNA, 22 nt, Human
aggugcagcugguggagucugg

SEQ ID NO: 597661 - RNA, 22 nt, Human
ggaagccagaaagugagaauau

SEQ ID NO: 597662 - RNA, 22 nt, Human
cauagcaagaucacauucugua

SEQ ID NO: 597663 - RNA, 22 nt, Human
agcuguggccagaugugagcgg

SEQ ID NO: 597664 - RNA, 22 nt, Human
gagguggcacugugaggagcac

SEQ ID NO: 597665 - RNA, 22 nt, Human
ccuccacugcuucccagcuuug

SEQ ID NO: 597666 - RNA, 22 nt, Human
aguaaagcauugucuucagagu

SEQ ID NO: 597667 - RNA, 22 nt, Human
ucacagugacagccaauguuuu

SEQ ID NO: 597668 - RNA, 22 nt, Human
gaugaggaauuugagguuagaa

SEQ ID NO: 597669 - RNA, 21 nt, Human
aauaaccacuaauauaguggc

SEQ ID NO: 597670 - RNA, 22 nt, Human
aaugcucaaaauguuucaucua

SEQ ID NO: 597671 - RNA, 22 nt, Human
acugcuaaaucuccaucgauua

SEQ ID NO: 597672 - RNA, 22 nt, Human
guuucuuucuauugacugaaca

SEQ ID NO: 597673 - RNA, 20 nt, Human
ucucccaggcucagggaaga

SEQ ID NO: 597674 - RNA, 22 nt, Human
ggggagcugggaggugaguuac

SEQ ID NO: 597675 - RNA, 22 nt, Human
gucaguucauuagcacuuccaa

SEQ ID NO: 597676 - RNA, 22 nt, Human
uuaagauuuguagagaaaaagc

SEQ ID NO: 597677 - RNA, 22 nt, Human
aucucauucucccgugccaugg

SEQ ID NO: 597678 - RNA, 22 nt, Human
ucucugugggcuuuggacuuga

SEQ ID NO: 597679 - RNA, 22 nt, Human
gucauucagagaugcagguaga

SEQ ID NO: 597680 - RNA, 22 nt, Human
ucuaguuaauuccuuugguguu

SEQ ID NO: 597681 - RNA, 22 nt, Human
auaaaaacugacccauccuuug

SEQ ID NO: 597682 - RNA, 22 nt, Human
agcccugguagccugcugccau

SEQ ID NO: 597683 - RNA, 22 nt, Human
uaaaucaguaaggcauauucuc

SEQ ID NO: 597684 - RNA, 22 nt, Human
ggcucuggugugaagcagccuc

SEQ ID NO: 597685 - RNA, 22 nt, Human
cugaggucuauuuugaaacugc

SEQ ID NO: 597686 - RNA, 22 nt, Human
uugcaguugcuguauuuaagga

SEQ ID NO: 597687 - RNA, 20 nt, Human
agagugagacuccaucucag

SEQ ID NO: 597688 - RNA, 22 nt, Human
uugacaaaacaacacagauuuc

SEQ ID NO: 597689 - RNA, 22 nt, Human
uauuaugguuguagguuaacaa

SEQ ID NO: 597690 - RNA, 21 nt, Human
ucuggggaagacaucuaggau

SEQ ID NO: 597691 - RNA, 22 nt, Human
cacauacauacguauguauaca

SEQ ID NO: 597692 - RNA, 22 nt, Human
gguucaguuuacauuaaaaucu

SEQ ID NO: 597693 - RNA, 22 nt, Human
cagugccaugaugcagagcaau

SEQ ID NO: 597694 - RNA, 22 nt, Human
agcaggaaggucugugugaguc

SEQ ID NO: 597695 - RNA, 22 nt, Human
ugacaauggguggacaagauag

SEQ ID NO: 597696 - RNA, 22 nt, Human
gcagaggcaaucagguaugugg

SEQ ID NO: 597697 - RNA, 22 nt, Human
aaugaacacauguggucaguuu

SEQ ID NO: 597698 - RNA, 22 nt, Human
cugggugaauuugaaggaaagg

SEQ ID NO: 597699 - RNA, 22 nt, Human
ggcagagcagccccaggguuug

SEQ ID NO: 597700 - RNA, 22 nt, Human
auaaggaaugauguaucaguuu

SEQ ID NO: 597701 - RNA, 22 nt, Human
auaaaacuuggguaugaucccu

SEQ ID NO: 597702 - RNA, 22 nt, Human
acauucuagaagucuuugcaau

SEQ ID NO: 597703 - RNA, 22 nt, Human
aacagcuuugcuucuggagaca

SEQ ID NO: 597704 - RNA, 22 nt, Human
acaauuuuucaaagaagcuuau

SEQ ID NO: 597705 - RNA, 22 nt, Human
aaauauuugucugaggcgguug

SEQ ID NO: 597706 - RNA, 22 nt, Human
uaucagaaggcacauggagucu

SEQ ID NO: 597707 - RNA, 22 nt, Human
ugugacagccaguaaaguaagc

SEQ ID NO: 597708 - RNA, 22 nt, Human
ccacagagacaggguccuugcu

SEQ ID NO: 597709 - RNA, 22 nt, Human
gcccugagggguggugucugua

SEQ ID NO: 597710 - RNA, 22 nt, Human
ucuucucucauguaggagggaa

SEQ ID NO: 597711 - RNA, 23 nt, Human
aguucucaaaaccagcuugacaa

SEQ ID NO: 597712 - RNA, 22 nt, Human
cuggccugugggcugucuccgg

SEQ ID NO: 597713 - RNA, 22 nt, Human
caggcacuggccagucagcaca

SEQ ID NO: 597714 - RNA, 22 nt, Human
ggcuggucaggaaacuaggcuc

SEQ ID NO: 597715 - RNA, 22 nt, Human
cuggcuggucaucagcaguacg

SEQ ID NO: 597716 - RNA, 22 nt, Human
ucuacugcacuggugucucauc

SEQ ID NO: 597717 - RNA, 22 nt, Human
uagcuuugccaucugucacaua

SEQ ID NO: 597718 - RNA, 22 nt, Human
caaggccaguucaccaagggca

SEQ ID NO: 597719 - RNA, 22 nt, Human
aagaaaacaugaucuaauuuaa

SEQ ID NO: 597720 - RNA, 22 nt, Human
uucuccagaguuucucucacug

SEQ ID NO: 597721 - RNA, 22 nt, Human
aggccacagauacugugaagua

SEQ ID NO: 597722 - RNA, 22 nt, Human
ccuggaugauccaugucaugga

SEQ ID NO: 597723 - RNA, 21 nt, Human
gagcugggcgaggcuccgggg

SEQ ID NO: 597724 - RNA, 22 nt, Human
cugcugacucuuccuggaguga

SEQ ID NO: 597725 - RNA, 22 nt, Human
caggaagagaacauggaggcug

SEQ ID NO: 597726 - RNA, 22 nt, Human
gugcuggggguuucuguagguc

SEQ ID NO: 597727 - RNA, 22 nt, Human
uagcaaagaagauauuauugca

SEQ ID NO: 597728 - RNA, 22 nt, Human
gcugccugcacagagcugcuuu

SEQ ID NO: 597729 - RNA, 20 nt, Human
uaaugccucaugauacuaga

SEQ ID NO: 597730 - RNA, 22 nt, Human
ugguaaaugcuauuccuauauu

SEQ ID NO: 597731 - RNA, 22 nt, Human
gcugcaggcggccgugguggcg

SEQ ID NO: 597732 - RNA, 22 nt, Human
gcaaagaaagccaaggucuaac

SEQ ID NO: 597733 - RNA, 22 nt, Human
uuauagaaugguggauuuucug

SEQ ID NO: 597734 - RNA, 22 nt, Human
gggaaacuguccaguucucccc

SEQ ID NO: 597735 - RNA, 20 nt, Human
acaguggguggggagcacug

SEQ ID NO: 597736 - RNA, 22 nt, Human
aguuuuuccugauuuuacagaa

SEQ ID NO: 597737 - RNA, 22 nt, Human
uuagaauuucugcucacuuuga

SEQ ID NO: 597738 - RNA, 22 nt, Human
ggguaggagaggugucugugug

SEQ ID NO: 597739 - RNA, 22 nt, Human
ccccaaaguguuggauaauuga

SEQ ID NO: 597740 - RNA, 22 nt, Human
acacagauggguagaaaacaga

SEQ ID NO: 597741 - RNA, 23 nt, Human
ccuccugggcacaggccugaugg

SEQ ID NO: 597742 - RNA, 23 nt, Human
accaacaagccucuggagagugg

SEQ ID NO: 597743 - RNA, 22 nt, Human
guuaagaagcuagagaugaaca

SEQ ID NO: 597744 - RNA, 22 nt, Human
agguuagauaguuuauuagaac

SEQ ID NO: 597745 - RNA, 22 nt, Human
gcugcuguuccuccaguggauc

SEQ ID NO: 597746 - RNA, 22 nt, Human
guuaaugccuacauauuaagca

SEQ ID NO: 597747 - RNA, 20 nt, Human
gccugccucagcuagcugag

SEQ ID NO: 597748 - RNA, 22 nt, Human
gaagaugugcaauacaaagaaa

SEQ ID NO: 597749 - RNA, 22 nt, Human
augcauaugugugcacacgugu

SEQ ID NO: 597750 - RNA, 21 nt, Human
ucucuguguacagucucaccc

SEQ ID NO: 597751 - RNA, 22 nt, Human
cuugcuguuauccauauuaucu

SEQ ID NO: 597752 - RNA, 22 nt, Human
agaggagguccuuuucugaugu

SEQ ID NO: 597753 - RNA, 22 nt, Human
gcccuuauaaacaaggcuucag

SEQ ID NO: 597754 - RNA, 22 nt, Human
aaaugcuuguaaauuuuccaug

SEQ ID NO: 597755 - RNA, 20 nt, Human
uuucaguugguuaauggcau

SEQ ID NO: 597756 - RNA, 22 nt, Human
cauucucugaucuucacauacc

SEQ ID NO: 597757 - RNA, 22 nt, Human
ccuccaggaacuugagagacac

SEQ ID NO: 597758 - RNA, 22 nt, Human
ucuuccuucgcccuugcuguuu

SEQ ID NO: 597759 - RNA, 22 nt, Human
uggaggcugguuucugcugagg

SEQ ID NO: 597760 - RNA, 22 nt, Human
cugggcaccaggcaugacaggg

SEQ ID NO: 597761 - RNA, 22 nt, Human
gcagagcuaucuucuggauuug

SEQ ID NO: 597762 - RNA, 22 nt, Human
ucucagguggcccccaugagug

SEQ ID NO: 597763 - RNA, 22 nt, Human
acauugaugaucccacuuacag

SEQ ID NO: 597764 - RNA, 22 nt, Human
guggcagagaacaaggagaggu

SEQ ID NO: 597765 - RNA, 22 nt, Human
ugcacacaaguuggagaaugaa

SEQ ID NO: 597766 - RNA, 22 nt, Human
agauacaugucaagagacuuau

SEQ ID NO: 597767 - RNA, 19 nt, Human
ggcugggucuggcagguuc

SEQ ID NO: 597768 - RNA, 22 nt, Human
agguggaaauggcuuuccuagg

SEQ ID NO: 597769 - RNA, 22 nt, Human
cccugcagagagugcuuuugug

SEQ ID NO: 597770 - RNA, 22 nt, Human
gucugccccacaggcucaguug

SEQ ID NO: 597771 - RNA, 22 nt, Human
agaaaggagaccagcucugccc

SEQ ID NO: 597772 - RNA, 22 nt, Human
ugcuggggguucagaugaguaa

SEQ ID NO: 597773 - RNA, 22 nt, Human
aaauacacguacauguguaaaa

SEQ ID NO: 597774 - RNA, 20 nt, Human
gaggaaaagcugccaggccu

SEQ ID NO: 597775 - RNA, 22 nt, Human
aguccaugguuguaguucucuc

SEQ ID NO: 597776 - RNA, 22 nt, Human
gcaggaugagugaguacauuua

SEQ ID NO: 597777 - RNA, 22 nt, Human
caggaagcaagugauuuucuug

SEQ ID NO: 597778 - RNA, 23 nt, Human
acauguggagagaacagauaucu

SEQ ID NO: 597779 - RNA, 22 nt, Human
aaguuacuuuaccucuuuagcu

SEQ ID NO: 597780 - RNA, 22 nt, Human
uugaggccaaaaaguccuauga

SEQ ID NO: 597781 - RNA, 22 nt, Human
uggcugagggggcaguucagga

SEQ ID NO: 597782 - RNA, 22 nt, Human
gagagggcucuguguggguacu

SEQ ID NO: 597783 - RNA, 22 nt, Human
aggcaaauuauuguaugcaguu

SEQ ID NO: 597784 - RNA, 19 nt, Human
gaggaggaaaacuagugua

SEQ ID NO: 597785 - RNA, 22 nt, Human
uuguuugugcuauuuaauguag

SEQ ID NO: 597786 - RNA, 22 nt, Human
auuacaucaguugacaugugag

SEQ ID NO: 597787 - RNA, 22 nt, Human
auacaucuaugccuuucugaca

SEQ ID NO: 597788 - RNA, 22 nt, Human
agcacaggaccaaggaagcugu

SEQ ID NO: 597789 - RNA, 22 nt, Human
aaacuucaaggauuugcaaauc

SEQ ID NO: 597790 - RNA, 22 nt, Human
caucaaaauuagacauuguuga

SEQ ID NO: 597791 - RNA, 22 nt, Human
ccagagugacgugaagugugaa

SEQ ID NO: 597792 - RNA, 22 nt, Human
aggccagaguuaaggagaacag

SEQ ID NO: 597793 - RNA, 20 nt, Human
ggcaugagaugugagggagg

SEQ ID NO: 597794 - RNA, 18 nt, Human
aauggaaggggugcuguu

SEQ ID NO: 597795 - RNA, 22 nt, Human
agagcugggaccgucuggaagu

SEQ ID NO: 597796 - RNA, 19 nt, Human
agguagcucagacucaaag

SEQ ID NO: 597797 - RNA, 22 nt, Human
ucugaggugucacaaggccagg

SEQ ID NO: 597798 - RNA, 22 nt, Human
aaacagaaauuuccucaugcuc

SEQ ID NO: 597799 - RNA, 22 nt, Human
cugcccugcuuguuuccagugg

SEQ ID NO: 597800 - RNA, 21 nt, Human
ucugagcugaguccucuaggu

SEQ ID NO: 597801 - RNA, 22 nt, Human
agccaggccuuagggagaggca

SEQ ID NO: 597802 - RNA, 22 nt, Human
gcagcccaggcucgcucacugc

SEQ ID NO: 597803 - RNA, 22 nt, Human
guauuauucucagcuuugggau

SEQ ID NO: 597804 - RNA, 22 nt, Human
cauaauuucuguaucagcacca

SEQ ID NO: 597805 - RNA, 22 nt, Human
cuucuucucaaggggcaggugg

SEQ ID NO: 597806 - RNA, 22 nt, Human
ucucugaagcuguuguagucuc

SEQ ID NO: 597807 - RNA, 22 nt, Human
aaaauaacuucuacuauuugca

SEQ ID NO: 597808 - RNA, 22 nt, Human
uggcagcugguacagugggucu

SEQ ID NO: 597809 - RNA, 22 nt, Human
gcugagguggaggaaggagacc

SEQ ID NO: 597810 - RNA, 22 nt, Human
ugccuguuauuguuggcuuagu

SEQ ID NO: 597811 - RNA, 22 nt, Human
uucaaacaacucauuuaugcaa

SEQ ID NO: 597812 - RNA, 18 nt, Human
agcuucccucugagaggg

SEQ ID NO: 597813 - RNA, 22 nt, Human
uucaggaauaauuaucauauga

SEQ ID NO: 597814 - RNA, 22 nt, Human
uagcugaaugccuuggauuuuu

SEQ ID NO: 597815 - RNA, 22 nt, Human
cugcccuguagcuguucuagca

SEQ ID NO: 597816 - RNA, 22 nt, Human
uuguuucuuugaaguuucuaga

SEQ ID NO: 597817 - RNA, 22 nt, Human
uccuggaggcaaaugagcacau

SEQ ID NO: 597818 - RNA, 22 nt, Human
ggaagggaaaauucauucggcu

SEQ ID NO: 597819 - RNA, 22 nt, Human
uacaaugagcuguacaucucca

SEQ ID NO: 597820 - RNA, 22 nt, Human
ggugaguuucaugguuguuuac

SEQ ID NO: 597821 - RNA, 22 nt, Human
gcccaagccgccuuccagagac

SEQ ID NO: 597822 - RNA, 22 nt, Human
augaugcuguuuaucauauacu

SEQ ID NO: 597823 - RNA, 23 nt, Human
cuggaagugcuuuuauagcuuug

SEQ ID NO: 597824 - RNA, 22 nt, Human
uuucucauggaacauagcuccu

SEQ ID NO: 597825 - RNA, 22 nt, Human
acagcuggacaggggagaguuu

SEQ ID NO: 597826 - RNA, 19 nt, Human
ugacaagauaauagccuug

SEQ ID NO: 597827 - RNA, 22 nt, Human
ucagggagagugacccauccac

SEQ ID NO: 597828 - RNA, 22 nt, Human
guggccucuguuggcuccuagg

SEQ ID NO: 597829 - RNA, 22 nt, Human
ugagccuguggggugacaacca

SEQ ID NO: 597830 - RNA, 22 nt, Human
uuucacacuagucagaauacca

SEQ ID NO: 597831 - RNA, 22 nt, Human
gugugaaaguaauugcgguuuu

SEQ ID NO: 597832 - RNA, 22 nt, Human
gcccacucuggagccuguuccc

SEQ ID NO: 597833 - RNA, 22 nt, Human
uggcugagggggcucugcucag

SEQ ID NO: 597834 - RNA, 22 nt, Human
auuuaguuuaggaaaaguaggu

SEQ ID NO: 597835 - RNA, 22 nt, Human
ccagggcuggugggagaugcug

SEQ ID NO: 597836 - RNA, 22 nt, Human
cagacugaguggauuaaacaau

SEQ ID NO: 597837 - RNA, 22 nt, Human
ugcugagggcuguuaaggaagc

SEQ ID NO: 597838 - RNA, 22 nt, Human
ccugccuguaagauggguacaa

SEQ ID NO: 597839 - RNA, 22 nt, Human
gugugagagaagcugccaugga

SEQ ID NO: 597840 - RNA, 22 nt, Human
uggagccagcccaggccccucu

SEQ ID NO: 597841 - RNA, 22 nt, Human
aggggcaguuccaaguuuugug

SEQ ID NO: 597842 - RNA, 22 nt, Human
guuuccuagaucaguguucuua

SEQ ID NO: 597843 - RNA, 18 nt, Human
auugucagaagucaugug

SEQ ID NO: 597844 - RNA, 22 nt, Human
aaagagucuggcguuuuaaugg

SEQ ID NO: 597845 - RNA, 22 nt, Human
gccacucaugggaggugugcaa

SEQ ID NO: 597846 - RNA, 22 nt, Human
cuauugcauuugcaucuucauc

SEQ ID NO: 597847 - RNA, 22 nt, Human
auagauguacguauguaaauca

SEQ ID NO: 597848 - RNA, 22 nt, Human
aagagauugguuauaagagauu

SEQ ID NO: 597849 - RNA, 22 nt, Human
gggcacagcccagugggguccc

SEQ ID NO: 597850 - RNA, 18 nt, Human
ggacacagauagguacag

SEQ ID NO: 597851 - RNA, 22 nt, Human
auguuacacauaggcauaaaug

SEQ ID NO: 597852 - RNA, 22 nt, Human
aauucuauaggcaagcuauuuu

SEQ ID NO: 597853 - RNA, 22 nt, Human
gcuccaggaggcucccgcgucu

SEQ ID NO: 597854 - RNA, 22 nt, Human
gagggccaacuagcaccacuuu

SEQ ID NO: 597855 - RNA, 22 nt, Human
ucagcuuuccugcagcuaaggg

SEQ ID NO: 597856 - RNA, 22 nt, Human
cugcuuuagcuagugcucuuag

SEQ ID NO: 597857 - RNA, 22 nt, Human
cucccuccucaaauaucuuugu

SEQ ID NO: 597858 - RNA, 22 nt, Human
ucuucccagaggaggugccagc

SEQ ID NO: 597859 - RNA, 22 nt, Human
ugaaggagaauuaauaggcauu

SEQ ID NO: 597860 - RNA, 22 nt, Human
ccuuuaggagugaggaccgagc

SEQ ID NO: 597861 - RNA, 22 nt, Human
aggcccaguagucgacggcgcu

SEQ ID NO: 597862 - RNA, 22 nt, Human
gcagaggagaugaagauacuuu

SEQ ID NO: 597863 - RNA, 17 nt, Human
cagacaggcugucaccc

SEQ ID NO: 597864 - RNA, 22 nt, Human
ugguaggauagugacuuauaug

SEQ ID NO: 597865 - RNA, 22 nt, Human
gugggggcuggcucguccugug

SEQ ID NO: 597866 - RNA, 22 nt, Human
aaggggaauagaguggguugug

SEQ ID NO: 597867 - RNA, 20 nt, Human
aaccugaggcaguguuccag

SEQ ID NO: 597868 - RNA, 22 nt, Human
uucuaguuauagaaaaagcauu

SEQ ID NO: 597869 - RNA, 22 nt, Human
uuauguaauuuguuugcucuuc

SEQ ID NO: 597870 - RNA, 22 nt, Human
cacuuuacuaucuauaaaauaa

SEQ ID NO: 597871 - RNA, 22 nt, Human
aagaggaaaugauugacuauau

SEQ ID NO: 597872 - RNA, 22 nt, Human
acugaggucagggguaugugau

SEQ ID NO: 597873 - RNA, 22 nt, Human
cagugggugaugaguccugggg

SEQ ID NO: 597874 - RNA, 22 nt, Human
aacaugcauguuauuuaucagu

SEQ ID NO: 597875 - RNA, 22 nt, Human
aaauauguaaccaaggugaagu

SEQ ID NO: 597876 - RNA, 22 nt, Human
cugccagcucucuggaggcucu

SEQ ID NO: 597877 - RNA, 22 nt, Human
caucaugccccgcuacagugca

SEQ ID NO: 597878 - RNA, 22 nt, Human
uuugaaagccuggcuuuucucu

SEQ ID NO: 597879 - RNA, 22 nt, Human
augcuuaaccuugguguacaau

SEQ ID NO: 597880 - RNA, 22 nt, Human
auuuuguuaucagggcuuugca

SEQ ID NO: 597881 - RNA, 22 nt, Human
gcagaauguaggccuucagugu

SEQ ID NO: 597882 - RNA, 22 nt, Human
acuccaguucucuuguuuauaa

SEQ ID NO: 597883 - RNA, 22 nt, Human
aggccugggcaagaaggggcgu

SEQ ID NO: 597884 - RNA, 22 nt, Human
acugcuuuucagagucugccug

SEQ ID NO: 597885 - RNA, 22 nt, Human
ccuacucugagcgccuccgcau

SEQ ID NO: 597886 - RNA, 22 nt, Human
cacaguguuugauuuaggggcc

SEQ ID NO: 597887 - RNA, 20 nt, Human
gccuggaggcaaugggaaga

SEQ ID NO: 597888 - RNA, 22 nt, Human
ucccacagggcuucucuguaca

SEQ ID NO: 597889 - RNA, 22 nt, Human
ugcugcaggaacuuaagaagcu

SEQ ID NO: 597890 - RNA, 22 nt, Human
agccagcagggcuuagaggaca

SEQ ID NO: 597891 - RNA, 22 nt, Human
uauguuuauacuuugauguacu

SEQ ID NO: 597892 - RNA, 22 nt, Human
cuuuugcagccauuauugcugc

SEQ ID NO: 597893 - RNA, 22 nt, Human
aggcuguggcccuggucuagca

SEQ ID NO: 597894 - RNA, 22 nt, Human
guguuacauauauacccacacc

SEQ ID NO: 597895 - RNA, 17 nt, Human
cauucuguaaucuuucu

SEQ ID NO: 597896 - RNA, 22 nt, Human
caggcagcgcucguggccuggc

SEQ ID NO: 597897 - RNA, 22 nt, Human
cugagcagcuguuacagagugu

SEQ ID NO: 597898 - RNA, 22 nt, Human
gagcagugagugaauguugccu

SEQ ID NO: 597899 - RNA, 22 nt, Human
gggcaagcacagcgagcgugcg

SEQ ID NO: 597900 - RNA, 22 nt, Human
caguggcacccacgggcugggc

SEQ ID NO: 597901 - RNA, 22 nt, Human
ccucuccagcggccucagggcc

SEQ ID NO: 597902 - RNA, 22 nt, Human
cuauacagcagcuuacuaguua

SEQ ID NO: 597903 - RNA, 22 nt, Human
agcaguggcuggauggugugcu

SEQ ID NO: 597904 - RNA, 22 nt, Human
cuggagcuguuuuuucaggaaa

SEQ ID NO: 597905 - RNA, 22 nt, Human
gaagcacugcauuucaagauca

SEQ ID NO: 597906 - RNA, 22 nt, Human
uccuucuuucccccuagucauu

SEQ ID NO: 597907 - RNA, 20 nt, Human
uccaccaggaaggguaggga

SEQ ID NO: 597908 - RNA, 22 nt, Human
cucuuacacagauuccucuagc

SEQ ID NO: 597909 - RNA, 18 nt, Human
gcaaacauucuuccaguc

SEQ ID NO: 597910 - RNA, 23 nt, Human
gcagagguuuuucaguaugguuu

SEQ ID NO: 597911 - RNA, 22 nt, Human
acaggcagguccugucccagcu

SEQ ID NO: 597912 - RNA, 23 nt, Human
gggaaaggauaugauccuagggg

SEQ ID NO: 597913 - RNA, 20 nt, Human
auguagaugaaagcaaaggc

SEQ ID NO: 597914 - RNA, 22 nt, Human
ugcugggcuagaagcugaggcc

SEQ ID NO: 597915 - RNA, 22 nt, Human
gagcugagaucauguacacuag

SEQ ID NO: 597916 - RNA, 22 nt, Human
uucgcauucagcuuugccacug

SEQ ID NO: 597917 - RNA, 22 nt, Human
cagcuauuccaggaguagaauc

SEQ ID NO: 597918 - RNA, 22 nt, Human
uucugggacaucuggacaguuu

SEQ ID NO: 597919 - RNA, 22 nt, Human
ugagcagagucgcuccagagug

SEQ ID NO: 597920 - RNA, 22 nt, Human
uccaaagaaccuggcuacuguc

SEQ ID NO: 597921 - RNA, 22 nt, Human
ccaggccuagccccugagggua

SEQ ID NO: 597922 - RNA, 23 nt, Human
cccagcagagaugaggagggguc

SEQ ID NO: 597923 - RNA, 19 nt, Human
aggcagcauucuggggcuu

SEQ ID NO: 597924 - RNA, 21 nt, Human
uagaaucacuaauaagaugua

SEQ ID NO: 597925 - RNA, 22 nt, Human
acaagaagucacaucuaggagu

SEQ ID NO: 597926 - RNA, 18 nt, Human
acauuucuccuucugacc

SEQ ID NO: 597927 - RNA, 22 nt, Human
aagacaauguuucugauagaua

SEQ ID NO: 597928 - RNA, 22 nt, Human
gccuggaggggccaggguggua

SEQ ID NO: 597929 - RNA, 22 nt, Human
ucucugggaauuuuuuggacau

SEQ ID NO: 597930 - RNA, 22 nt, Human
uggggaagggcacccuggagac

SEQ ID NO: 597931 - RNA, 19 nt, Human
uacaggauccucauacagu

SEQ ID NO: 597932 - RNA, 22 nt, Human
uucacugugaacucauauucag

SEQ ID NO: 597933 - RNA, 19 nt, Human
aggguggcaaaggagggug

SEQ ID NO: 597934 - RNA, 22 nt, Human
gagggcagagacagugauucac

SEQ ID NO: 597935 - RNA, 22 nt, Human
uuucaccucagucuuuuuauau

SEQ ID NO: 597936 - RNA, 22 nt, Human
aaaugauguuauaagaccagga

SEQ ID NO: 597937 - RNA, 22 nt, Human
ugcaggcugcuggcaguagcuu

SEQ ID NO: 597938 - RNA, 22 nt, Human
agccacagcacauuguaagaaa

SEQ ID NO: 597939 - RNA, 22 nt, Human
uguaacaguaagccugugagcu

SEQ ID NO: 597940 - RNA, 22 nt, Human
ccuuggguuccaagucacugaa

SEQ ID NO: 597941 - RNA, 22 nt, Human
aagagaauaucgauagcacucu

SEQ ID NO: 597942 - RNA, 23 nt, Human
agggcugaaugcagagaagcaga

SEQ ID NO: 597943 - RNA, 22 nt, Human
ccaaggcauauggcugaaacca

SEQ ID NO: 597944 - RNA, 22 nt, Human
aucucuggccuuccuuuuccaa

SEQ ID NO: 597945 - RNA, 22 nt, Human
gugccuggcaugcgccggugcu

SEQ ID NO: 597946 - RNA, 22 nt, Human
aauaucugucucuaaugcauau

SEQ ID NO: 597947 - RNA, 22 nt, Human
gccugggagcacaucggggucc

SEQ ID NO: 597948 - RNA, 22 nt, Human
ucuuucuuauuaugcucaaugu

SEQ ID NO: 597949 - RNA, 22 nt, Human
uuucucaaggugucauguauuu

SEQ ID NO: 597950 - RNA, 22 nt, Human
gugaacaaaauagcacauauua

SEQ ID NO: 597951 - RNA, 22 nt, Human
ucagaagccgggcagguuuugg

SEQ ID NO: 597952 - RNA, 22 nt, Human
gacacuggaaauauugaauugg

SEQ ID NO: 597953 - RNA, 22 nt, Human
cuacacaguucugccuaauggc

SEQ ID NO: 597954 - RNA, 22 nt, Human
acaggcugauagaccauaaaua

SEQ ID NO: 597955 - RNA, 22 nt, Human
caggauggccccggggcugugc

SEQ ID NO: 597956 - RNA, 22 nt, Human
ggcagucauuuaaucccugcau

SEQ ID NO: 597957 - RNA, 22 nt, Human
uaacacagacagccacuaguaa

SEQ ID NO: 597958 - RNA, 19 nt, Human
uuuuguguagcugcugguu

SEQ ID NO: 597959 - RNA, 22 nt, Human
cgaggccaugcaugcugaggac

SEQ ID NO: 597960 - RNA, 19 nt, Human
ggagaagcaucuagaaaua

SEQ ID NO: 597961 - RNA, 19 nt, Human
ucucagaauuaagagugcu

SEQ ID NO: 597962 - RNA, 22 nt, Human
ucugcugaggccuucccacucc

SEQ ID NO: 597963 - RNA, 22 nt, Human
uuccuuucccuugcuucugugc

SEQ ID NO: 597964 - RNA, 19 nt, Human
uugaaagauuagcuuucua

SEQ ID NO: 597965 - RNA, 22 nt, Human
auaaagcagguccccagacacu

SEQ ID NO: 597966 - RNA, 22 nt, Human
ccaggguuggaugagucacuua

SEQ ID NO: 597967 - RNA, 22 nt, Human
ugugccuucucaguccugcuca

SEQ ID NO: 597968 - RNA, 22 nt, Human
ugcuucuggaguaacaggguga

SEQ ID NO: 597969 - RNA, 22 nt, Human
aauuagcuuuccgccaucacac

SEQ ID NO: 597970 - RNA, 22 nt, Human
aggcagcguagcaaggcuagua

SEQ ID NO: 597971 - RNA, 22 nt, Human
ucauugaauuugguucaauaug

SEQ ID NO: 597972 - RNA, 22 nt, Human
uuguggcagaccaugagucuaa

SEQ ID NO: 597973 - RNA, 22 nt, Human
ucagaacauuacauuuugagcu

SEQ ID NO: 597974 - RNA, 22 nt, Human
uuguuuuaucuuucuacagacu

SEQ ID NO: 597975 - RNA, 22 nt, Human
uucccuccgaaccucagugcug

SEQ ID NO: 597976 - RNA, 22 nt, Human
aggguuuucauuucugagcauu

SEQ ID NO: 597977 - RNA, 22 nt, Human
agaagccaccagcugaggaaga

SEQ ID NO: 597978 - RNA, 22 nt, Human
uuucaaaguggagaauuagaca

SEQ ID NO: 597979 - RNA, 22 nt, Human
uucacaauuaacuuuauacuua

SEQ ID NO: 597980 - RNA, 22 nt, Human
cuccagcuuuuucccaguuggc

SEQ ID NO: 597981 - RNA, 22 nt, Human
uuauuuauggcacuguuggugg

SEQ ID NO: 597982 - RNA, 16 nt, Human
uguaggauaaccauac

SEQ ID NO: 597983 - RNA, 17 nt, Human
cugcuuugugcaacgcu

SEQ ID NO: 597984 - RNA, 22 nt, Human
cagggugacugcccuggccacu

SEQ ID NO: 597985 - RNA, 23 nt, Human
uccagggcaguggcugggucugc

SEQ ID NO: 597986 - RNA, 22 nt, Human
caggcuggucccagagcauugc

SEQ ID NO: 597987 - RNA, 22 nt, Human
auucaguguuugcagcaacuuu

SEQ ID NO: 597988 - RNA, 22 nt, Human
gauuucaaggaguuuucacagu

SEQ ID NO: 597989 - RNA, 22 nt, Human
cagaaaccucccugaauauuuu

SEQ ID NO: 597990 - RNA, 22 nt, Human
acaauucugaugguuucccagu

SEQ ID NO: 597991 - RNA, 18 nt, Human
uccucucuuuccccaggg

SEQ ID NO: 597992 - RNA, 22 nt, Human
ucaauucugccucuaaauauuu

SEQ ID NO: 597993 - RNA, 21 nt, Human
aguguguguggaaugagaaua

SEQ ID NO: 597994 - RNA, 22 nt, Human
uguguacauaucuauccuagau

SEQ ID NO: 597995 - RNA, 22 nt, Human
uuucauaauauccagagauuuu

SEQ ID NO: 597996 - RNA, 23 nt, Human
ccuucagaagaaguaacaggggc

SEQ ID NO: 597997 - RNA, 22 nt, Human
uccagauggauuuaagaccuaa

SEQ ID NO: 597998 - RNA, 22 nt, Human
acagcaggauuuggcgauguug

SEQ ID NO: 597999 - RNA, 22 nt, Human
ucuucaaguuccaaagugcagg

SEQ ID NO: 598000 - RNA, 23 nt, Human
aaguuguuuuuggccagggaaag

SEQ ID NO: 598001 - RNA, 22 nt, Human
acucugcuuauugcugcaggca

SEQ ID NO: 598002 - RNA, 22 nt, Human
ccugucaguugcugucagggau

SEQ ID NO: 598003 - RNA, 22 nt, Human
ucuucugugaucuauguguuuu

SEQ ID NO: 598004 - RNA, 22 nt, Human
guggggucucucuguaccuccc

SEQ ID NO: 598005 - RNA, 22 nt, Human
aacuguuacauaguuauagauc

SEQ ID NO: 598006 - RNA, 22 nt, Human
gcugcagugagccaagaucgug

SEQ ID NO: 598007 - RNA, 22 nt, Human
ugagcugggaagagcagccaga

SEQ ID NO: 598008 - RNA, 22 nt, Human
uccugaggacccugucaggggc

SEQ ID NO: 598009 - RNA, 22 nt, Human
agggccagcagcuuggccaacc

SEQ ID NO: 598010 - RNA, 22 nt, Human
ucugaggucauaaagcaacuuu

SEQ ID NO: 598011 - RNA, 22 nt, Human
uacagccucgaacuccugcauu

SEQ ID NO: 598012 - RNA, 22 nt, Human
aguacaaaaugcagcaucauca

SEQ ID NO: 598013 - RNA, 22 nt, Human
cacuuuacccuuguuacucaug

SEQ ID NO: 598014 - RNA, 22 nt, Human
augugauucccacugaaucacu

SEQ ID NO: 598015 - RNA, 22 nt, Human
uuacaguuagaaucugaugaaa

SEQ ID NO: 598016 - RNA, 22 nt, Human
cagguaggauggaagggcucaa

SEQ ID NO: 598017 - RNA, 22 nt, Human
cccaggcuagaaaggccaacaa

SEQ ID NO: 598018 - RNA, 22 nt, Human
cucccucucaccggagcccugg

SEQ ID NO: 598019 - RNA, 22 nt, Human
ucaccaggcuccuguuaagaug

SEQ ID NO: 598020 - RNA, 22 nt, Human
uggcuggagucuggugcuagcc

SEQ ID NO: 598021 - RNA, 22 nt, Human
uaagauaauaccaugggccagg

SEQ ID NO: 598022 - RNA, 22 nt, Human
uuuuccuguccaggcaauuauu

SEQ ID NO: 598023 - RNA, 22 nt, Human
uucucucuuacugccaugcugu

SEQ ID NO: 598024 - RNA, 22 nt, Human
gugcauauuuugcacacagaug

SEQ ID NO: 598025 - RNA, 21 nt, Human
ucuguacaucauugagucccc

SEQ ID NO: 598026 - RNA, 22 nt, Human
gacugaggugcccagaggugac

SEQ ID NO: 598027 - RNA, 22 nt, Human
acccagagcagagcuuggcuuc

SEQ ID NO: 598028 - RNA, 22 nt, Human
ugcccuguuaucuuggaagagu

SEQ ID NO: 598029 - RNA, 22 nt, Human
uggcugagaaaaugguuuuagg

SEQ ID NO: 598030 - RNA, 22 nt, Human
gaguuacauucauuguuacgcu

SEQ ID NO: 598031 - RNA, 22 nt, Human
uggcccaaagcagcccagcagg

SEQ ID NO: 598032 - RNA, 22 nt, Human
caguuucugagcccugucauuu

SEQ ID NO: 598033 - RNA, 22 nt, Human
caggcagcugacugucagauau

SEQ ID NO: 598034 - RNA, 22 nt, Human
agaaacagcauuagcaucaauu

SEQ ID NO: 598035 - RNA, 22 nt, Human
uugcacuagacacauuucaagu

SEQ ID NO: 598036 - RNA, 22 nt, Human
uuaaucuuauauguaaagguaa

SEQ ID NO: 598037 - RNA, 22 nt, Human
guccugugcccuggguggcgcu

SEQ ID NO: 598038 - RNA, 22 nt, Human
aaagcaaugaugguagacacgu

SEQ ID NO: 598039 - RNA, 22 nt, Human
cacacaugugugcagcuuagaa

SEQ ID NO: 598040 - RNA, 22 nt, Human
uugaccauaccuccaggcaguu

SEQ ID NO: 598041 - RNA, 22 nt, Human
caaaucacaaugugagacugag

SEQ ID NO: 598042 - RNA, 22 nt, Human
caaguuaauugguauuuugauc

SEQ ID NO: 598043 - RNA, 22 nt, Human
gagcuggugcucuugucaagac

SEQ ID NO: 598044 - RNA, 22 nt, Human
auucaucaacugauagccauag

SEQ ID NO: 598045 - RNA, 22 nt, Human
ucugagucuuggggucccuauu

SEQ ID NO: 598046 - RNA, 22 nt, Human
ccugggcuuucggcggcuuccu

SEQ ID NO: 598047 - RNA, 22 nt, Human
aaauucacucuguuccucaugg

SEQ ID NO: 598048 - RNA, 22 nt, Human
accagcucuucugcucuaguug

SEQ ID NO: 598049 - RNA, 20 nt, Human
cccagagccauagccagaca

SEQ ID NO: 598050 - RNA, 22 nt, Human
uacaagaaugucuuaaaagcuc

SEQ ID NO: 598051 - RNA, 20 nt, Human
ggccacagggugcuggugga

SEQ ID NO: 598052 - RNA, 22 nt, Human
uuaagacuuuucaaaggcaaac

SEQ ID NO: 598053 - RNA, 22 nt, Human
uccaggcuggaaaugucaaacu

SEQ ID NO: 598054 - RNA, 23 nt, Human
gcugagguacauuuacaggaaga

SEQ ID NO: 598055 - RNA, 22 nt, Human
agagacagacacaucgggcugc

SEQ ID NO: 598056 - RNA, 22 nt, Human
ccugggcuuacgaccucugacu

SEQ ID NO: 598057 - RNA, 22 nt, Human
cucugggacaucccuuggccua

SEQ ID NO: 598058 - RNA, 22 nt, Human
agggucugaccaccaguaggga

SEQ ID NO: 598059 - RNA, 22 nt, Human
cccaggcuucccaaucagaagg

SEQ ID NO: 598060 - RNA, 22 nt, Human
uacugugucuuaggauguggaa

SEQ ID NO: 598061 - RNA, 22 nt, Human
ggagaagccacacauugggugu

SEQ ID NO: 598062 - RNA, 22 nt, Human
uccuucaccuuagcccuccuag

SEQ ID NO: 598063 - RNA, 22 nt, Human
cuccauggaaccggggcugcuu

SEQ ID NO: 598064 - RNA, 22 nt, Human
acugugcacacaaaaauagauu

SEQ ID NO: 598065 - RNA, 22 nt, Human
aaacuuuaagacaguccucaag

SEQ ID NO: 598066 - RNA, 22 nt, Human
auaaugcauuuagaauaauuca

SEQ ID NO: 598067 - RNA, 22 nt, Human
uguguuuuaaauggaaauuuga

SEQ ID NO: 598068 - RNA, 22 nt, Human
ucucuguaucagcaccugcugg

SEQ ID NO: 598069 - RNA, 22 nt, Human
cugggcugauuuagucacguuu

SEQ ID NO: 598070 - RNA, 22 nt, Human
agccacagcgaaccucucuucc

SEQ ID NO: 598071 - RNA, 22 nt, Human
cuaauguaucauggcucucagc

SEQ ID NO: 598072 - RNA, 21 nt, Human
cugagggccgcagcugggcuc

SEQ ID NO: 598073 - RNA, 22 nt, Human
uucaaaaguaaucaguauuaga

SEQ ID NO: 598074 - RNA, 22 nt, Human
gcaguccugggauucuguccuu

SEQ ID NO: 598075 - RNA, 22 nt, Human
gcuuuugucauucaaaugcucu

SEQ ID NO: 598076 - RNA, 22 nt, Human
aacauagcuuuacucaaaugac

SEQ ID NO: 598077 - RNA, 22 nt, Human
gggcuggcaggaccugggcuga

SEQ ID NO: 598078 - RNA, 22 nt, Human
augcagcucauuuguuuaaaag

SEQ ID NO: 598079 - RNA, 22 nt, Human
aaacacauuagcccuguggaaa

SEQ ID NO: 598080 - RNA, 22 nt, Human
gaugcgggcccgcuccacugcc

SEQ ID NO: 598081 - RNA, 19 nt, Human
ucaguaacuuuuaagagga

SEQ ID NO: 598082 - RNA, 22 nt, Human
ugucacaaggccaugaaaagaa

SEQ ID NO: 598083 - RNA, 22 nt, Human
auguuugucccugacauccucu

SEQ ID NO: 598084 - RNA, 22 nt, Human
cugagguaauuuuccagauaau

SEQ ID NO: 598085 - RNA, 22 nt, Human
gagggaggggagcuccacccuc

SEQ ID NO: 598086 - RNA, 22 nt, Human
ggggaggaagcucucaguucca

SEQ ID NO: 598087 - RNA, 22 nt, Human
gaggcacugagagugggggaug

SEQ ID NO: 598088 - RNA, 22 nt, Human
uacuguuuucuauaauggcugu

SEQ ID NO: 598089 - RNA, 22 nt, Human
ccugccuggcacauaguacucu

SEQ ID NO: 598090 - RNA, 22 nt, Human
agcaggaaguagucuguaagca

SEQ ID NO: 598091 - RNA, 22 nt, Human
uaaagguuauaaagguuagggg

SEQ ID NO: 598092 - RNA, 22 nt, Human
aaggccagauucacuuuacaau

SEQ ID NO: 598093 - RNA, 22 nt, Human
uaagaggauauuuggccagaag

SEQ ID NO: 598094 - RNA, 22 nt, Human
gcacccaggcacuuuccuuucu

SEQ ID NO: 598095 - RNA, 22 nt, Human
caggucagagguagaugagaug

SEQ ID NO: 598096 - RNA, 22 nt, Human
gccagccaguuugcugauggcu

SEQ ID NO: 598097 - RNA, 22 nt, Human
agccucaguuucaggccuccuc

SEQ ID NO: 598098 - RNA, 22 nt, Human
ggaacacugccuuuuauuuucc

SEQ ID NO: 598099 - RNA, 22 nt, Human
ugucucaagguuacucuaugau

SEQ ID NO: 598100 - RNA, 19 nt, Human
gggguggcuggggcuccag

SEQ ID NO: 598101 - RNA, 22 nt, Human
uaaaugcagcaguuucuguucu

SEQ ID NO: 598102 - RNA, 22 nt, Human
ucacccaggcugguaugcagug

SEQ ID NO: 598103 - RNA, 22 nt, Human
agcaagaugcauuauuucuuau

SEQ ID NO: 598104 - RNA, 22 nt, Human
gagauuagaguuguuucauugu

SEQ ID NO: 598105 - RNA, 22 nt, Human
gcaugcacaguuuuucaccuca

SEQ ID NO: 598106 - RNA, 22 nt, Human
uuuauccauucaccaguugaac

SEQ ID NO: 598107 - RNA, 22 nt, Human
uauuugaugguucuaaaacagc

SEQ ID NO: 598108 - RNA, 22 nt, Human
agucuuaugguuaaauagaugc

SEQ ID NO: 598109 - RNA, 22 nt, Human
uucaauuugugcuaaggcaccg

SEQ ID NO: 598110 - RNA, 22 nt, Human
uagaaucuggaaggggcuauuc

SEQ ID NO: 598111 - RNA, 22 nt, Human
uugcuuauagagaguuucauac

SEQ ID NO: 598112 - RNA, 22 nt, Human
auacuuuagagcuagauugccu

SEQ ID NO: 598113 - RNA, 22 nt, Human
acacaucagccucagcuuuggg

SEQ ID NO: 598114 - RNA, 22 nt, Human
guaggcagaccaguggaugggu

SEQ ID NO: 598115 - RNA, 22 nt, Human
ucauuucagaugcauuuagaau

SEQ ID NO: 598116 - RNA, 22 nt, Human
uaauguuacacugcaugguuca

SEQ ID NO: 598117 - RNA, 22 nt, Human
ucagaaaccagcucucucaauu

SEQ ID NO: 598118 - RNA, 22 nt, Human
gaaaauuucugccacaugugug

SEQ ID NO: 598119 - RNA, 22 nt, Human
acacacuucagauguaauuugu

SEQ ID NO: 598120 - RNA, 22 nt, Human
uucucuguuuuccccucgaugu

SEQ ID NO: 598121 - RNA, 22 nt, Human
cagcugccacaggacuuucuga

SEQ ID NO: 598122 - RNA, 22 nt, Human
gcugagggggaaggaaagcuga

SEQ ID NO: 598123 - RNA, 22 nt, Human
cagacccaggauccaaauguug

SEQ ID NO: 598124 - RNA, 22 nt, Human
ucuguacaugaguugagaauca

SEQ ID NO: 598125 - RNA, 22 nt, Human
cagcuuuagagaaaacauauuu

SEQ ID NO: 598126 - RNA, 22 nt, Human
ugaaauucauuguuuuaugugu

SEQ ID NO: 598127 - RNA, 22 nt, Human
agagcuguagcuuccuagagcc

SEQ ID NO: 598128 - RNA, 22 nt, Human
ccaggagugcagggaugguauc

SEQ ID NO: 598129 - RNA, 22 nt, Human
gccucagcucccagcccaggcu

SEQ ID NO: 598130 - RNA, 22 nt, Human
caaggccagagccagcgauaag

SEQ ID NO: 598131 - RNA, 22 nt, Human
uguuuccuaagugucucugaag

SEQ ID NO: 598132 - RNA, 19 nt, Human
ucccuggcgccucucgggc

SEQ ID NO: 598133 - RNA, 22 nt, Human
gcucucuuuuuccagugguggu

SEQ ID NO: 598134 - RNA, 22 nt, Human
auuaaaagagauaauguguguu

SEQ ID NO: 598135 - RNA, 22 nt, Human
caggcaccaacuuccuggggag

SEQ ID NO: 598136 - RNA, 22 nt, Human
uauguacaugauuucauuugcu

SEQ ID NO: 598137 - RNA, 22 nt, Human
gucccucugcucuagagagcca

SEQ ID NO: 598138 - RNA, 22 nt, Human
gucaucauuuuuagcauauggg

SEQ ID NO: 598139 - RNA, 22 nt, Human
cuuacacuucaucucauccagg

SEQ ID NO: 598140 - RNA, 22 nt, Human
ucuuccagaaugcauucucuuu

SEQ ID NO: 598141 - RNA, 22 nt, Human
ccucagggucugaggagaccgu

SEQ ID NO: 598142 - RNA, 22 nt, Human
ucacagcaccaggaucucucca

SEQ ID NO: 598143 - RNA, 21 nt, Human
aaacugaccuugccugagaca

SEQ ID NO: 598144 - RNA, 19 nt, Human
caguuuguccagaggggac

SEQ ID NO: 598145 - RNA, 22 nt, Human
aguuacaaacacuaucaguucu

SEQ ID NO: 598146 - RNA, 19 nt, Human
ugaggggcucacagucuca

SEQ ID NO: 598147 - RNA, 22 nt, Human
aggccugcugucuugaggccaa

SEQ ID NO: 598148 - RNA, 22 nt, Human
uuguuuucuccacugcaucuua

SEQ ID NO: 598149 - RNA, 22 nt, Human
cagucugggacugagcuccacc

SEQ ID NO: 598150 - RNA, 18 nt, Human
uggcucugcagccagaug

SEQ ID NO: 598151 - RNA, 22 nt, Human
gcagagcuucuguccuucagga

SEQ ID NO: 598152 - RNA, 22 nt, Human
aguuauaaaaggagcacugauu

SEQ ID NO: 598153 - RNA, 22 nt, Human
guugucaucaccguuguuauca

SEQ ID NO: 598154 - RNA, 22 nt, Human
aggguuaauugguguccugagg

SEQ ID NO: 598155 - RNA, 22 nt, Human
caccagcuacagacuacugugu

SEQ ID NO: 598156 - RNA, 22 nt, Human
agcucuggaauaaugaugugau

SEQ ID NO: 598157 - RNA, 22 nt, Human
acacaguaaauauguauugaau

SEQ ID NO: 598158 - RNA, 22 nt, Human
acaaacugaauggguuuucugu

SEQ ID NO: 598159 - RNA, 22 nt, Human
guuuacauguacucauuauacu

SEQ ID NO: 598160 - RNA, 22 nt, Human
cagccuucgacaguuggaguag

SEQ ID NO: 598161 - RNA, 22 nt, Human
uaacagaaaggggacagaaaua

SEQ ID NO: 598162 - RNA, 23 nt, Human
aagcaaugcugagccaguucuga

SEQ ID NO: 598163 - RNA, 17 nt, Human
caguuggagacaagucc

SEQ ID NO: 598164 - RNA, 22 nt, Human
cuuucugaaguuuaaguucuaa

SEQ ID NO: 598165 - RNA, 22 nt, Human
ucuaagacacuguacuuucagu

SEQ ID NO: 598166 - RNA, 22 nt, Human
uuauugcagauggugugagaga

SEQ ID NO: 598167 - RNA, 22 nt, Human
gggguagggcgauugcugcuuu

SEQ ID NO: 598168 - RNA, 22 nt, Human
gccugagcuacuagggagucug

SEQ ID NO: 598169 - RNA, 22 nt, Human
aguggaggcacuaauuggauuu

SEQ ID NO: 598170 - RNA, 22 nt, Human
ggcugaggggcccagaggaaca

SEQ ID NO: 598171 - RNA, 22 nt, Human
gcuguacaguuuacuagguggg

SEQ ID NO: 598172 - RNA, 22 nt, Human
uguauuuaauuguaucaucaca

SEQ ID NO: 598173 - RNA, 22 nt, Human
gcaguaaguuaauagugcuggu

SEQ ID NO: 598174 - RNA, 22 nt, Human
ggaaacuuggaugccagcacuc

SEQ ID NO: 598175 - RNA, 22 nt, Human
agcagagucuucaagggcaggc

SEQ ID NO: 598176 - RNA, 19 nt, Human
aguuaaugagcuuuugauc

SEQ ID NO: 598177 - RNA, 22 nt, Human
uggcucagauuuuuguaggcuu

SEQ ID NO: 598178 - RNA, 22 nt, Human
uucauguguauggaacauuuuu

SEQ ID NO: 598179 - RNA, 20 nt, Human
caaggggaguaguaugggcc

SEQ ID NO: 598180 - RNA, 22 nt, Human
aauguuacgaucaacaacacau

SEQ ID NO: 598181 - RNA, 22 nt, Human
cagagagcacauaggauacuuu

SEQ ID NO: 598182 - RNA, 22 nt, Human
gcagaggagcaagcuggacacc

SEQ ID NO: 598183 - RNA, 22 nt, Human
ggcugagcucaggggcagcagg

SEQ ID NO: 598184 - RNA, 22 nt, Human
cccuccagccauggacccaggu

SEQ ID NO: 598185 - RNA, 22 nt, Human
uccuggugccuggagcucucca

SEQ ID NO: 598186 - RNA, 22 nt, Human
aagaguuucuuuauuaaccuuu

SEQ ID NO: 598187 - RNA, 22 nt, Human
uccugcuggaaguagggaauga

SEQ ID NO: 598188 - RNA, 22 nt, Human
gagugugggcacgggggccuug

SEQ ID NO: 598189 - RNA, 22 nt, Human
uggaacaagaagcaggucgcuu

SEQ ID NO: 598190 - RNA, 22 nt, Human
auggcaccuuccccagagcuca

SEQ ID NO: 598191 - RNA, 22 nt, Human
ucagaggcuugaagcccaagcc

SEQ ID NO: 598192 - RNA, 22 nt, Human
ccucccacauugaggacaugcu

SEQ ID NO: 598193 - RNA, 20 nt, Human
uccuccagaagggcagggug

SEQ ID NO: 598194 - RNA, 22 nt, Human
gaaauguaugucuucccccauu

SEQ ID NO: 598195 - RNA, 22 nt, Human
ucuacccugcggucuuggggca

SEQ ID NO: 598196 - RNA, 22 nt, Human
ggguggagaggcuaaguccagu

SEQ ID NO: 598197 - RNA, 22 nt, Human
cucauggagggagugcucuucc

SEQ ID NO: 598198 - RNA, 22 nt, Human
uuuugccuaagaaucucucuga

SEQ ID NO: 598199 - RNA, 22 nt, Human
augcucauuuuauugagaauga

SEQ ID NO: 598200 - RNA, 22 nt, Human
auggcuuggcaccaucuccuug

SEQ ID NO: 598201 - RNA, 22 nt, Human
uaucuuuagaggaagagaaucu

SEQ ID NO: 598202 - RNA, 22 nt, Human
uaacacuauccagauaugauaa

SEQ ID NO: 598203 - RNA, 22 nt, Human
gagcuggaagucuguggucaga

SEQ ID NO: 598204 - RNA, 22 nt, Human
aguaacaggguauuuguguggg

SEQ ID NO: 598205 - RNA, 22 nt, Human
gggaggcucagugguguccucu

SEQ ID NO: 598206 - RNA, 22 nt, Human
augggagaaacaucaugaggca

SEQ ID NO: 598207 - RNA, 22 nt, Human
gcaguguguggugagggcugcc

SEQ ID NO: 598208 - RNA, 22 nt, Human
gcuucugucuuagcuaccuccc

SEQ ID NO: 598209 - RNA, 22 nt, Human
guguccuguuucccugucuaua

SEQ ID NO: 598210 - RNA, 22 nt, Human
agacacugagcauuuuccuagc

SEQ ID NO: 598211 - RNA, 22 nt, Human
ucucugaguaagugacaguuca

SEQ ID NO: 598212 - RNA, 22 nt, Human
acacuuugcuacauuucauauu

SEQ ID NO: 598213 - RNA, 22 nt, Human
uugucugacuucuuuaguuacu

SEQ ID NO: 598214 - RNA, 22 nt, Human
gccugaccucuucugcccuggg

SEQ ID NO: 598215 - RNA, 22 nt, Human
ucuaggaaagccuuucacaacu

SEQ ID NO: 598216 - RNA, 21 nt, Human
gagaaucaggaaggauugaug

SEQ ID NO: 598217 - RNA, 22 nt, Human
gccuucaggaggguuccagaca

SEQ ID NO: 598218 - RNA, 22 nt, Human
gcguggcuuagagugggguacc

SEQ ID NO: 598219 - RNA, 22 nt, Human
cccugcagaucagugagaacuu

SEQ ID NO: 598220 - RNA, 22 nt, Human
ccagaugggaagaagcaugacu

SEQ ID NO: 598221 - RNA, 22 nt, Human
ugguccauguccuccaucucuc

SEQ ID NO: 598222 - RNA, 22 nt, Human
uucaacaaggcugucaaaaguu

SEQ ID NO: 598223 - RNA, 22 nt, Human
uagacacuuuagaaguaagggu

SEQ ID NO: 598224 - RNA, 22 nt, Human
acacugcagaugaaagcauaag

SEQ ID NO: 598225 - RNA, 22 nt, Human
gucaggaucaaauugaaguuau

SEQ ID NO: 598226 - RNA, 22 nt, Human
agccaggguuagaagauaguca

SEQ ID NO: 598227 - RNA, 16 nt, Human
gcacacacaucaauga

SEQ ID NO: 598228 - RNA, 22 nt, Human
gucaauaauugauagauauugg

SEQ ID NO: 598229 - RNA, 22 nt, Human
caguuuuauugguugaaaucug

SEQ ID NO: 598230 - RNA, 22 nt, Human
ucccagccuuccuuguggugaa

SEQ ID NO: 598231 - RNA, 21 nt, Human
acagaaguggcuuggucucag

SEQ ID NO: 598232 - RNA, 20 nt, Human
agcugcccuuuucacauguu

SEQ ID NO: 598233 - RNA, 21 nt, Human
cccuucuugggucaaaguaua

SEQ ID NO: 598234 - RNA, 22 nt, Human
guccugguccugccuccccaug

SEQ ID NO: 598235 - RNA, 22 nt, Human
ugcuucagaggaaaggcaaaag

SEQ ID NO: 598236 - RNA, 22 nt, Human
uaauauaccaaacuguaauuuu

SEQ ID NO: 598237 - RNA, 22 nt, Human
ucaagguucaaggcuggcuucu

SEQ ID NO: 598238 - RNA, 22 nt, Human
uccaggagugcugguuagagua

SEQ ID NO: 598239 - RNA, 22 nt, Human
cuggcucauuuuagcaucaggu

SEQ ID NO: 598240 - RNA, 22 nt, Human
uggcuccacaggccagggugug

SEQ ID NO: 598241 - RNA, 22 nt, Human
gccugcuuuaagucuguugccu

SEQ ID NO: 598242 - RNA, 23 nt, Human
agagcuuagggaauucacaugag

SEQ ID NO: 598243 - RNA, 22 nt, Human
auacaucuugucagauucaugu

SEQ ID NO: 598244 - RNA, 22 nt, Human
cuccugggagucuuccuggaug

SEQ ID NO: 598245 - RNA, 22 nt, Human
caggagacucagcauccaggau

SEQ ID NO: 598246 - RNA, 22 nt, Human
agaugcagaaaaacuaagugau

SEQ ID NO: 598247 - RNA, 22 nt, Human
acccaggcuggagugcaguggu

SEQ ID NO: 598248 - RNA, 22 nt, Human
gcagggcugggacuuacuggua

SEQ ID NO: 598249 - RNA, 22 nt, Human
cacuuaaaacuccuggaauugu

SEQ ID NO: 598250 - RNA, 21 nt, Human
cagugccagccacaggacgcc

SEQ ID NO: 598251 - RNA, 22 nt, Human
aguuucuuggucacaguuuuca

SEQ ID NO: 598252 - RNA, 23 nt, Human
cugcagccgcguggggacgugga

SEQ ID NO: 598253 - RNA, 22 nt, Human
uucagcagcuuuuaguacauug

SEQ ID NO: 598254 - RNA, 22 nt, Human
cuccuggcacucaguguggaag

SEQ ID NO: 598255 - RNA, 21 nt, Human
uggcacagaaaggaaaguuca

SEQ ID NO: 598256 - RNA, 22 nt, Human
uucuuaaagaggcaaaacacag

SEQ ID NO: 598257 - RNA, 22 nt, Human
cuggcucaggguggucuggguc

SEQ ID NO: 598258 - RNA, 22 nt, Human
gcuacaggagauaaaggccucu

SEQ ID NO: 598259 - RNA, 22 nt, Human
gacaggacuucacuguguugcc

SEQ ID NO: 598260 - RNA, 22 nt, Human
acuccaggcaucugcuucugcu

SEQ ID NO: 598261 - RNA, 22 nt, Human
uauuuaacuggaaacacaauga

SEQ ID NO: 598262 - RNA, 22 nt, Human
auauagaaggugcuauuuacau

SEQ ID NO: 598263 - RNA, 22 nt, Human
ugcaauaaggaguaauaguaaa

SEQ ID NO: 598264 - RNA, 22 nt, Human
uacagcuuugggaaggccccau

SEQ ID NO: 598265 - RNA, 22 nt, Human
gagaagguggaccugaaggagc

SEQ ID NO: 598266 - RNA, 22 nt, Human
ugugucuguuuugcucaccauu

SEQ ID NO: 598267 - RNA, 22 nt, Human
uaguccugaccuugccaccagc

SEQ ID NO: 598268 - RNA, 22 nt, Human
ugaagacagaccaaggagaaug

SEQ ID NO: 598269 - RNA, 22 nt, Human
auaguuugcuuuaauacaacug

SEQ ID NO: 598270 - RNA, 22 nt, Human
acuuagcaauuugauuaaaaga

SEQ ID NO: 598271 - RNA, 21 nt, Human
guacacacagguggaugggcu

SEQ ID NO: 598272 - RNA, 22 nt, Human
uuuaccauacaucaaaauauuu

SEQ ID NO: 598273 - RNA, 21 nt, Human
uuagcaaagcaaacacaugcu

SEQ ID NO: 598274 - RNA, 19 nt, Human
uagucuuuauucuuaauuu

SEQ ID NO: 598275 - RNA, 22 nt, Human
gguugcuggggguggcagagcu

SEQ ID NO: 598276 - RNA, 22 nt, Human
acagugcuuagcacagaguaga

SEQ ID NO: 598277 - RNA, 22 nt, Human
ugucuuuugccaaagaucaguu

SEQ ID NO: 598278 - RNA, 22 nt, Human
ucugugcagucagggcucaguc

SEQ ID NO: 598279 - RNA, 22 nt, Human
acucacagacugcagguuuauu

SEQ ID NO: 598280 - RNA, 22 nt, Human
ucaguggauuguagaaggcuua

SEQ ID NO: 598281 - RNA, 22 nt, Human
aggaauugagauccuagguuuu

SEQ ID NO: 598282 - RNA, 22 nt, Human
gcaggugaaugauggacuagga

SEQ ID NO: 598283 - RNA, 22 nt, Human
ggcagaguugguggagucaguu

SEQ ID NO: 598284 - RNA, 22 nt, Human
agggccaguggguugaaaggca

SEQ ID NO: 598285 - RNA, 22 nt, Human
cacaccagagguuaccugcaaa

SEQ ID NO: 598286 - RNA, 22 nt, Human
ugcaugcagcuggucgggcgcc

SEQ ID NO: 598287 - RNA, 22 nt, Human
gagugaggcuggaaucauggcu

SEQ ID NO: 598288 - RNA, 22 nt, Human
agaccuggagaccugaguggua

SEQ ID NO: 598289 - RNA, 21 nt, Human
ugagguaguguuugucaaguu

SEQ ID NO: 598290 - RNA, 22 nt, Human
ugccuggcaaugccagaagcca

SEQ ID NO: 598291 - RNA, 22 nt, Human
gguagggaaggcucugcgggga

SEQ ID NO: 598292 - RNA, 22 nt, Human
gggagggacacaaagaguuccc

SEQ ID NO: 598293 - RNA, 22 nt, Human
uuuaguguagcauucagaguca

SEQ ID NO: 598294 - RNA, 22 nt, Human
acugcagggcauccuggccaag

SEQ ID NO: 598295 - RNA, 22 nt, Human
gaaauucacuguauuucuuggg

SEQ ID NO: 598296 - RNA, 20 nt, Human
acaguguuagguuuuuccuu

SEQ ID NO: 598297 - RNA, 22 nt, Human
acauuagaugacucuuucuuuc

SEQ ID NO: 598298 - RNA, 22 nt, Human
cuuugccuccuagagcacguuc

SEQ ID NO: 598299 - RNA, 22 nt, Human
cagggcaggaugcugugauuau

SEQ ID NO: 598300 - RNA, 22 nt, Human
auuuaugagcugaaccaugaaa

SEQ ID NO: 598301 - RNA, 22 nt, Human
agcacacaggccaccuccacuu

SEQ ID NO: 598302 - RNA, 22 nt, Human
aucauggaaagguucagcaagc

SEQ ID NO: 598303 - RNA, 22 nt, Human
uggaaagaaaguaaaggcguau

SEQ ID NO: 598304 - RNA, 22 nt, Human
cagcuccccaugguuccugaag

SEQ ID NO: 598305 - RNA, 19 nt, Human
cccugaggcaaaagccuuu

SEQ ID NO: 598306 - RNA, 22 nt, Human
aaaaguuugugcaaacacucag

SEQ ID NO: 598307 - RNA, 19 nt, Human
uggucucugucucuuugca

SEQ ID NO: 598308 - RNA, 20 nt, Human
uuucugcagggagcugggcu

SEQ ID NO: 598309 - RNA, 22 nt, Human
aggaagaaaccuacuagaguuu

SEQ ID NO: 598310 - RNA, 22 nt, Human
ucauuaaucccgggguccaggg

SEQ ID NO: 598311 - RNA, 22 nt, Human
ucuacagagagucauagacuca

SEQ ID NO: 598312 - RNA, 22 nt, Human
uuucuguuuagcauaaaguggc

SEQ ID NO: 598313 - RNA, 22 nt, Human
uagucacaguacaggauaaaga

SEQ ID NO: 598314 - RNA, 22 nt, Human
caaagaaugagugaguacauaa

SEQ ID NO: 598315 - RNA, 22 nt, Human
ugaguuauauauacuggcucug

SEQ ID NO: 598316 - RNA, 22 nt, Human
cucuggguuuugucagcugagg

SEQ ID NO: 598317 - RNA, 22 nt, Human
uaggcacaaaaugaaaauggca

SEQ ID NO: 598318 - RNA, 22 nt, Human
gaacuguauaggagcaguguuu

SEQ ID NO: 598319 - RNA, 22 nt, Human
guggccagaagacugcaaugcu

SEQ ID NO: 598320 - RNA, 22 nt, Human
agacagaccauggcuauucaga

SEQ ID NO: 598321 - RNA, 22 nt, Human
uuucuacauuuguaaccagauu

SEQ ID NO: 598322 - RNA, 22 nt, Human
ucacauuuucauauucucugag

SEQ ID NO: 598323 - RNA, 22 nt, Human
aaauuucaguuggaaugagcuc

SEQ ID NO: 598324 - RNA, 17 nt, Human
gcaucacagauaacacg

SEQ ID NO: 598325 - RNA, 22 nt, Human
gccuggugucuccccaaggaag

SEQ ID NO: 598326 - RNA, 22 nt, Human
ggccagcauggcaagaccaacu

SEQ ID NO: 598327 - RNA, 23 nt, Human
aguucauaauuucuuauuugugu

SEQ ID NO: 598328 - RNA, 17 nt, Human
uggcuucaggcugagca

SEQ ID NO: 598329 - RNA, 22 nt, Human
gugcagguggauuugggcucaa

SEQ ID NO: 598330 - RNA, 22 nt, Human
ccacagugggcacagcaggacu

SEQ ID NO: 598331 - RNA, 22 nt, Human
guagacaagcacaggacucaga

SEQ ID NO: 598332 - RNA, 22 nt, Human
gagugggcaaaagaaaguaggc

SEQ ID NO: 598333 - RNA, 22 nt, Human
gguagcaagcgcuugcccugcg

SEQ ID NO: 598334 - RNA, 22 nt, Human
ggguggggccaggcaauuugca

SEQ ID NO: 598335 - RNA, 22 nt, Human
uauuucuuguuauucucguuga

SEQ ID NO: 598336 - RNA, 22 nt, Human
caugaacaaauucuguuugagg

SEQ ID NO: 598337 - RNA, 22 nt, Human
ggagacagugguagggccuaag

SEQ ID NO: 598338 - RNA, 22 nt, Human
aggcugaaaacgagauggcaau

SEQ ID NO: 598339 - RNA, 22 nt, Human
uuccuaauggcaaaacauguuu

SEQ ID NO: 598340 - RNA, 22 nt, Human
gggugagagucaggcagagauu

SEQ ID NO: 598341 - RNA, 19 nt, Human
cuuuucaagccaucaguuu

SEQ ID NO: 598342 - RNA, 20 nt, Human
ccagcugagccaaggggaga

SEQ ID NO: 598343 - RNA, 22 nt, Human
cuucugagggccuuugcuucca

SEQ ID NO: 598344 - RNA, 22 nt, Human
cuguucugcugcauaaaaacuu

SEQ ID NO: 598345 - RNA, 19 nt, Human
ccacaaaauuauuuuaguu

SEQ ID NO: 598346 - RNA, 22 nt, Human
gcccaggaguucaaggcugcag

SEQ ID NO: 598347 - RNA, 22 nt, Human
uuuucaugucauguccuugagg

SEQ ID NO: 598348 - RNA, 22 nt, Human
ugucauaacuuagugacaaauc

SEQ ID NO: 598349 - RNA, 22 nt, Human
auuuggaaggcguuucucugua

SEQ ID NO: 598350 - RNA, 22 nt, Human
aacuucauggguucaaagcugg

SEQ ID NO: 598351 - RNA, 22 nt, Human
uguggcauacacaugagguggu

SEQ ID NO: 598352 - RNA, 22 nt, Human
gcacacagaaucagugggcaua

SEQ ID NO: 598353 - RNA, 22 nt, Human
cuguggccagucccacaccucc

SEQ ID NO: 598354 - RNA, 22 nt, Human
cagcccuucuuccaaccagcuu

SEQ ID NO: 598355 - RNA, 22 nt, Human
cagcucuggccagaucuauccu

SEQ ID NO: 598356 - RNA, 22 nt, Human
aagggcuguaguuuguugauca

SEQ ID NO: 598357 - RNA, 22 nt, Human
ucuacaaagccauucaggaucu

SEQ ID NO: 598358 - RNA, 18 nt, Human
uccuaacuuagauacucc

SEQ ID NO: 598359 - RNA, 22 nt, Human
agaaaggucacuuagccucagc

SEQ ID NO: 598360 - RNA, 22 nt, Human
agaguguaccaaauauccuaca

SEQ ID NO: 598361 - RNA, 22 nt, Human
caaggcugcugcgggucgcacc

SEQ ID NO: 598362 - RNA, 22 nt, Human
uauccaaaguggcauauuauag

SEQ ID NO: 598363 - RNA, 22 nt, Human
aacuuuauuguuaggggcuaaa

SEQ ID NO: 598364 - RNA, 22 nt, Human
gagguccaggguggggccugag

SEQ ID NO: 598365 - RNA, 22 nt, Human
uguuuccuucugucucuuugga

SEQ ID NO: 598366 - RNA, 22 nt, Human
aagaguuugaccugugccaucc

SEQ ID NO: 598367 - RNA, 22 nt, Human
cuucucuguguagagauucaga

SEQ ID NO: 598368 - RNA, 21 nt, Human
agcugggccucagccugcagu

SEQ ID NO: 598369 - RNA, 22 nt, Human
aagccagauuucacucuuaauu

SEQ ID NO: 598370 - RNA, 22 nt, Human
cagcagugucuccagcaucaca

SEQ ID NO: 598371 - RNA, 22 nt, Human
uucccagagaaggaugaaaaag

SEQ ID NO: 598372 - RNA, 22 nt, Human
cagcucugguuccugggcccag

SEQ ID NO: 598373 - RNA, 22 nt, Human
aagaguuugggcaagucauaaa

SEQ ID NO: 598374 - RNA, 22 nt, Human
uugcugaaaagcuggccuuugu

SEQ ID NO: 598375 - RNA, 22 nt, Human
uccaggagauacacugcaccag

SEQ ID NO: 598376 - RNA, 22 nt, Human
aagagcugcccaaggugaacag

SEQ ID NO: 598377 - RNA, 22 nt, Human
agauauaguuguugagaagaac

SEQ ID NO: 598378 - RNA, 22 nt, Human
cugccugugccaaugcuccuuu

SEQ ID NO: 598379 - RNA, 22 nt, Human
agcaguggugugaggagggcuc

SEQ ID NO: 598380 - RNA, 22 nt, Human
cugggcacuuuggggagccuac

SEQ ID NO: 598381 - RNA, 22 nt, Human
ggagccugacagugcccagcau

SEQ ID NO: 598382 - RNA, 22 nt, Human
uguccuuuguucccugucucug

SEQ ID NO: 598383 - RNA, 22 nt, Human
ugaggccuggagggaggaguuu

SEQ ID NO: 598384 - RNA, 22 nt, Human
uugaaaggguuaaagugguaaa

SEQ ID NO: 598385 - RNA, 22 nt, Human
agcaagcuaacauaggagauug

SEQ ID NO: 598386 - RNA, 17 nt, Human
gagugcagacacaagca

SEQ ID NO: 598387 - RNA, 22 nt, Human
aggcccuggcccccagagauuc

SEQ ID NO: 598388 - RNA, 22 nt, Human
aggagcagaccguaguccugca

SEQ ID NO: 598389 - RNA, 22 nt, Human
cuuggcauguucaucugcuugg

SEQ ID NO: 598390 - RNA, 22 nt, Human
ggaaaauuuccuucaaaaugug

SEQ ID NO: 598391 - RNA, 19 nt, Human
cugggagguguucagagaa

SEQ ID NO: 598392 - RNA, 20 nt, Human
uacaagaauccccaguuguc

SEQ ID NO: 598393 - RNA, 22 nt, Human
cugcuuucuuguugcaucuuaa

SEQ ID NO: 598394 - RNA, 18 nt, Human
cugagggcaacagaggcu

SEQ ID NO: 598395 - RNA, 22 nt, Human
acuguacaaauauugcaaaaua

SEQ ID NO: 598396 - RNA, 22 nt, Human
caucuuuucagaagccauucug

SEQ ID NO: 598397 - RNA, 22 nt, Human
agaggcccucucucuccugaug

SEQ ID NO: 598398 - RNA, 22 nt, Human
cucaggaggugguagaggcccu

SEQ ID NO: 598399 - RNA, 22 nt, Human
auaagcauguuagaauauuuga

SEQ ID NO: 598400 - RNA, 22 nt, Human
gacuacaggccggcaucagaga

SEQ ID NO: 598401 - RNA, 20 nt, Human
gcuaccagaacaaggccauu

SEQ ID NO: 598402 - RNA, 22 nt, Human
gagcuggucgaaaugggcugac

SEQ ID NO: 598403 - RNA, 22 nt, Human
gagagcuguccggcugagcagc

SEQ ID NO: 598404 - RNA, 22 nt, Human
aaggaagauauaucaagcuuaa

SEQ ID NO: 598405 - RNA, 22 nt, Human
ccuggaaacacaugaugaugaa

SEQ ID NO: 598406 - RNA, 22 nt, Human
aaggcaaauguguucuuuuagu

SEQ ID NO: 598407 - RNA, 22 nt, Human
uggaggcaguaacugagcaaca

SEQ ID NO: 598408 - RNA, 22 nt, Human
caggaacagaguggcauugucu

SEQ ID NO: 598409 - RNA, 22 nt, Human
cagaggggcugacacccuuggc

SEQ ID NO: 598410 - RNA, 22 nt, Human
aaaggaggccacauggcuagga

SEQ ID NO: 598411 - RNA, 22 nt, Human
gucuuaaaaucagaggauauag

SEQ ID NO: 598412 - RNA, 22 nt, Human
agggccagggaaacgaucagca

SEQ ID NO: 598413 - RNA, 22 nt, Human
aaggcauguguccucagagaga

SEQ ID NO: 598414 - RNA, 22 nt, Human
guggggaaaggaguggggcuca

SEQ ID NO: 598415 - RNA, 22 nt, Human
aggcugagagcaacgugucaga

SEQ ID NO: 598416 - RNA, 22 nt, Human
cccacacauuuuucacuuaccg

SEQ ID NO: 598417 - RNA, 22 nt, Human
ccugucucuuucaaucugagag

SEQ ID NO: 598418 - RNA, 22 nt, Human
cugcucuggcuguguacuucag

SEQ ID NO: 598419 - RNA, 22 nt, Human
uggaggaaguggacaguugugu

SEQ ID NO: 598420 - RNA, 22 nt, Human
cugaagagaaagggagcucuuc

SEQ ID NO: 598421 - RNA, 22 nt, Human
uuagaguugaguuucuaugaga

SEQ ID NO: 598422 - RNA, 22 nt, Human
aguaccauuauccaguaaagga

SEQ ID NO: 598423 - RNA, 22 nt, Human
aggucagaugggagaugggaug

SEQ ID NO: 598424 - RNA, 22 nt, Human
ucacccagacugucugacucuu

SEQ ID NO: 598425 - RNA, 22 nt, Human
caggcagauuugcugcccucca

SEQ ID NO: 598426 - RNA, 22 nt, Human
augugcuuggacauucuaggaa

SEQ ID NO: 598427 - RNA, 22 nt, Human
uagaugcuacaauuuuguacuc

SEQ ID NO: 598428 - RNA, 22 nt, Human
caacauucaaccaacauuuaug

SEQ ID NO: 598429 - RNA, 22 nt, Human
agagcgcacugucugcaggcaa

SEQ ID NO: 598430 - RNA, 22 nt, Human
aggcuucaguuguaccuucuug

SEQ ID NO: 598431 - RNA, 22 nt, Human
guagaauuuuaauaauggagau

SEQ ID NO: 598432 - RNA, 22 nt, Human
uacuugcuggguguaauuuucu

SEQ ID NO: 598433 - RNA, 18 nt, Human
ugcccagaaaagcaggga

SEQ ID NO: 598434 - RNA, 23 nt, Human
agucagagagugugagacaacug

SEQ ID NO: 598435 - RNA, 22 nt, Human
uugagggaacaugagaaucauc

SEQ ID NO: 598436 - RNA, 22 nt, Human
aauuggcuuugugguuucugca

SEQ ID NO: 598437 - RNA, 19 nt, Human
ccugugcuaggagcugacc

SEQ ID NO: 598438 - RNA, 22 nt, Human
ucacuggggcccacaucaacau

SEQ ID NO: 598439 - RNA, 22 nt, Human
uuagucucuuugcauugccaua

SEQ ID NO: 598440 - RNA, 22 nt, Human
ggcucugguugaccaugauggc

SEQ ID NO: 598441 - RNA, 22 nt, Human
caggcaggagaggaggauuucu

SEQ ID NO: 598442 - RNA, 16 nt, Human
auuuccuugugaguuu

SEQ ID NO: 598443 - RNA, 18 nt, Human
uccaggcuccaggcuaac

SEQ ID NO: 598444 - RNA, 22 nt, Human
ggggcccuuguggcugcaggcc

SEQ ID NO: 598445 - RNA, 22 nt, Human
ucuaacuauacaaagaaaacau

SEQ ID NO: 598446 - RNA, 22 nt, Human
aucuuacaauuacaagacacuc

SEQ ID NO: 598447 - RNA, 22 nt, Human
ccaguguguucccugccucacu

SEQ ID NO: 598448 - RNA, 22 nt, Human
gugcaugaagacucagaaaguc

SEQ ID NO: 598449 - RNA, 22 nt, Human
gaaaaguauguuuauuuugacu

SEQ ID NO: 598450 - RNA, 22 nt, Human
uguggcaguauaagagcuagaa

SEQ ID NO: 598451 - RNA, 22 nt, Human
agggcagauggaacuuccccga

SEQ ID NO: 598452 - RNA, 22 nt, Human
auacuugagguuguauaaauau

SEQ ID NO: 598453 - RNA, 22 nt, Human
cagcaacuccuauauugaaagc

SEQ ID NO: 598454 - RNA, 22 nt, Human
aagggcuguuauguuuuuauac

SEQ ID NO: 598455 - RNA, 22 nt, Human
ucaaauaaugccauucaucauc

SEQ ID NO: 598456 - RNA, 22 nt, Human
cugcacagccugucugggggcc

SEQ ID NO: 598457 - RNA, 22 nt, Human
uguguucacccuagcacuuaac

SEQ ID NO: 598458 - RNA, 22 nt, Human
cagugucuuauuuguagcucag

SEQ ID NO: 598459 - RNA, 22 nt, Human
aaacuugauuuagaacuaaggc

SEQ ID NO: 598460 - RNA, 22 nt, Human
uuugaaagcaccauuugaguag

SEQ ID NO: 598461 - RNA, 22 nt, Human
auaaagcaaauaggacuauugc

SEQ ID NO: 598462 - RNA, 21 nt, Human
ugcaggaaguauggugccuau

SEQ ID NO: 598463 - RNA, 22 nt, Human
augucuaaaagauaaaguuuaa

SEQ ID NO: 598464 - RNA, 22 nt, Human
gcucaggaucagccaccucuuu

SEQ ID NO: 598465 - RNA, 22 nt, Human
uccuggugaggcuagaaguguc

SEQ ID NO: 598466 - RNA, 22 nt, Human
aggccgaaguggaugggcaucu

SEQ ID NO: 598467 - RNA, 23 nt, Human
ggggccugcaccggucugcgcgg

SEQ ID NO: 598468 - RNA, 22 nt, Human
uaccaaagaauauuuuaaauag

SEQ ID NO: 598469 - RNA, 22 nt, Human
ucugagacaggaaguggagggu

SEQ ID NO: 598470 - RNA, 21 nt, Human
aaauucaccuaguaaaacuuc

SEQ ID NO: 598471 - RNA, 22 nt, Human
ccacuggcugucagcaggacuc

SEQ ID NO: 598472 - RNA, 22 nt, Human
auugguaaaauucuucccauuu

SEQ ID NO: 598473 - RNA, 22 nt, Human
ugaagcaggaucguuugcuuca

SEQ ID NO: 598474 - RNA, 22 nt, Human
cagggagcuggcuggcugugcc

SEQ ID NO: 598475 - RNA, 22 nt, Human
gaggcagcagaacauggaagag

SEQ ID NO: 598476 - RNA, 22 nt, Human
aagucauugguagcuugauagg

SEQ ID NO: 598477 - RNA, 22 nt, Human
caggcugagcucuggccugggc

SEQ ID NO: 598478 - RNA, 22 nt, Human
ugggaggaucgcuugagcccag

SEQ ID NO: 598479 - RNA, 22 nt, Human
uuugauagggaaguaagaauga

SEQ ID NO: 598480 - RNA, 22 nt, Human
gaucacaguauuuuagaugugu

SEQ ID NO: 598481 - RNA, 19 nt, Human
uuucuguuugcuucugguu

SEQ ID NO: 598482 - RNA, 22 nt, Human
ugagauggguguccagggagga

SEQ ID NO: 598483 - RNA, 22 nt, Human
gaguuacacagaagucaguuug

SEQ ID NO: 598484 - RNA, 22 nt, Human
ccagggcaggggcuggaguuca

SEQ ID NO: 598485 - RNA, 22 nt, Human
uucucuggcgguguguuuuccu

SEQ ID NO: 598486 - RNA, 22 nt, Human
caggaggcaucauggagcggac

SEQ ID NO: 598487 - RNA, 23 nt, Human
uccccucaggcagccagugcccu

SEQ ID NO: 598488 - RNA, 22 nt, Human
aggcugguguguccugaagccu

SEQ ID NO: 598489 - RNA, 22 nt, Human
uaacugauguucccuuacugua

SEQ ID NO: 598490 - RNA, 22 nt, Human
cccaggcugccacgauuacugc

SEQ ID NO: 598491 - RNA, 21 nt, Human
gugcugaggauacaguaguaa

SEQ ID NO: 598492 - RNA, 22 nt, Human
cuuagcuucucugcaucugugu

SEQ ID NO: 598493 - RNA, 22 nt, Human
augggaguggaggaaaaaaguu

SEQ ID NO: 598494 - RNA, 22 nt, Human
cugcaaaagucauugugguuuu

SEQ ID NO: 598495 - RNA, 22 nt, Human
gcacaaacugcaauuacuuuug

SEQ ID NO: 598496 - RNA, 22 nt, Human
uguuuuauauaagcagagcggu

SEQ ID NO: 598497 - RNA, 22 nt, Human
ggcccugggaugcucagcagug

SEQ ID NO: 598498 - RNA, 22 nt, Human
cagaaauaaacuucucacaucg

SEQ ID NO: 598499 - RNA, 18 nt, Human
aguccuggcucuaccacc

SEQ ID NO: 598500 - RNA, 22 nt, Human
guggccagagauuaaauagagu

SEQ ID NO: 598501 - RNA, 18 nt, Human
uuucacaaccuccagagg

SEQ ID NO: 598502 - RNA, 22 nt, Human
uuggauaaaaauguuuaagugu

SEQ ID NO: 598503 - RNA, 22 nt, Human
uuugugauuaauuuucaaccuc

SEQ ID NO: 598504 - RNA, 22 nt, Human
gccuucccuggcuaggcaagca

SEQ ID NO: 598505 - RNA, 22 nt, Human
gaauuugcuuucgugacagggu

SEQ ID NO: 598506 - RNA, 22 nt, Human
aggacagagggaccagagccca

SEQ ID NO: 598507 - RNA, 22 nt, Human
cauaacuuuaaagacagugugg

SEQ ID NO: 598508 - RNA, 22 nt, Human
caagacaagaucuaagcaugcu

SEQ ID NO: 598509 - RNA, 22 nt, Human
uguaaacagccccauggagagc

SEQ ID NO: 598510 - RNA, 22 nt, Human
uuucuccuccagagagacacag

SEQ ID NO: 598511 - RNA, 22 nt, Human
uccaggggugauuuuugacuug

SEQ ID NO: 598512 - RNA, 22 nt, Human
gcaugcacaccugugcacauuu

SEQ ID NO: 598513 - RNA, 21 nt, Human
uagcaaagccagauguauauu

SEQ ID NO: 598514 - RNA, 23 nt, Human
aguuuuuaauggucauagcugag

SEQ ID NO: 598515 - RNA, 22 nt, Human
aaauucuggccuaucacaguga

SEQ ID NO: 598516 - RNA, 22 nt, Human
cacauucauggaguuugccugu

SEQ ID NO: 598517 - RNA, 22 nt, Human
agccaggccuuuucucaagguu

SEQ ID NO: 598518 - RNA, 22 nt, Human
uucacauuagugguucuauaua

SEQ ID NO: 598519 - RNA, 22 nt, Human
agaacacauagagaaguuuuau

SEQ ID NO: 598520 - RNA, 22 nt, Human
auguacauuuguaguaauauca

SEQ ID NO: 598521 - RNA, 22 nt, Human
cacaggagggagcgggcagcca

SEQ ID NO: 598522 - RNA, 23 nt, Human
agguuugucucagaggcagaguu

SEQ ID NO: 598523 - RNA, 22 nt, Human
auacagaagccuguauuucugg

SEQ ID NO: 598524 - RNA, 22 nt, Human
ccucagagguuuucauucugua

SEQ ID NO: 598525 - RNA, 22 nt, Human
ucaggcccuucucccaggacuc

SEQ ID NO: 598526 - RNA, 22 nt, Human
aaugcaaagugaggugaguggc

SEQ ID NO: 598527 - RNA, 22 nt, Human
cuccagcuuuagcucuccaggg

SEQ ID NO: 598528 - RNA, 22 nt, Human
uuaucuugguguuuuaguaauu

SEQ ID NO: 598529 - RNA, 22 nt, Human
cucaggucgcuauuucucuuac

SEQ ID NO: 598530 - RNA, 22 nt, Human
gacaguguuuguauaauuccug

SEQ ID NO: 598531 - RNA, 22 nt, Human
gccagcccauuaaccccugucc

SEQ ID NO: 598532 - RNA, 22 nt, Human
agcagcuguacuuucaucuguu

SEQ ID NO: 598533 - RNA, 22 nt, Human
cucauuagacagguauacuuua

SEQ ID NO: 598534 - RNA, 22 nt, Human
ugcugagucugaaacagcucag

SEQ ID NO: 598535 - RNA, 22 nt, Human
gaggagcugaggcugaggccuc

SEQ ID NO: 598536 - RNA, 22 nt, Human
ugcucuggacgcugagugguuu

SEQ ID NO: 598537 - RNA, 22 nt, Human
ggggccagcacugugccuuugu

SEQ ID NO: 598538 - RNA, 22 nt, Human
uaaguuuuaagcaaucugauaa

SEQ ID NO: 598539 - RNA, 21 nt, Human
ucugagaacuucugcugcagc

SEQ ID NO: 598540 - RNA, 22 nt, Human
aaaguccuagcgauccacagaa

SEQ ID NO: 598541 - RNA, 19 nt, Human
uuuuccuucuauauguuuc

SEQ ID NO: 598542 - RNA, 21 nt, Human
uucuccagggggagcucucuc

SEQ ID NO: 598543 - RNA, 22 nt, Human
cagaggcuggcggccgccccga

SEQ ID NO: 598544 - RNA, 22 nt, Human
agcccccaggagucuccacgcc

SEQ ID NO: 598545 - RNA, 22 nt, Human
aggggaagagcccuuuacaugg

SEQ ID NO: 598546 - RNA, 22 nt, Human
auugguuaccacuuuaaaucuu

SEQ ID NO: 598547 - RNA, 22 nt, Human
aggcuggagugugcaguggcgc

SEQ ID NO: 598548 - RNA, 22 nt, Human
uccugagaaggcacagcuugca

SEQ ID NO: 598549 - RNA, 19 nt, Human
ugucacugucauggcccag

SEQ ID NO: 598550 - RNA, 22 nt, Human
auguguguauauauagucauuu

SEQ ID NO: 598551 - RNA, 22 nt, Human
aaagagcuugcuugcuuuauau

SEQ ID NO: 598552 - RNA, 20 nt, Human
uuauuucaguugcuagauug

SEQ ID NO: 598553 - RNA, 22 nt, Human
ugccugaacaugaauaguuuau

SEQ ID NO: 598554 - RNA, 22 nt, Human
cugugaaacuggacagcacuug

SEQ ID NO: 598555 - RNA, 22 nt, Human
caggagcuucugcccauggcca

SEQ ID NO: 598556 - RNA, 22 nt, Human
cagaagaggacuggguagcuca

SEQ ID NO: 598557 - RNA, 23 nt, Human
agcuguguggccuugggcaaguu

SEQ ID NO: 598558 - RNA, 22 nt, Human
acugaugugauuucaaauucca

SEQ ID NO: 598559 - RNA, 22 nt, Human
gagaaccucuccacaagucugg

SEQ ID NO: 598560 - RNA, 22 nt, Human
auguguccacaggugugagaga

SEQ ID NO: 598561 - RNA, 22 nt, Human
gacagcagccacagggagaggg

SEQ ID NO: 598562 - RNA, 22 nt, Human
ggcagcaucucuggcagcagcu

SEQ ID NO: 598563 - RNA, 22 nt, Human
uagcugccuuugggcuccugcu

SEQ ID NO: 598564 - RNA, 22 nt, Human
aaauucauuuuucuuagugugc

SEQ ID NO: 598565 - RNA, 22 nt, Human
aaugauaccaaacauguagaua

SEQ ID NO: 598566 - RNA, 22 nt, Human
aaguuacuggcaagggcugcag

SEQ ID NO: 598567 - RNA, 22 nt, Human
auuuaagggauuuggagaccaa

SEQ ID NO: 598568 - RNA, 22 nt, Human
auugucacuuaaaagugcaugu

SEQ ID NO: 598569 - RNA, 22 nt, Human
caguuauaggagccauuguaua

SEQ ID NO: 598570 - RNA, 22 nt, Human
gaacuaaauuugacagacaaca

SEQ ID NO: 598571 - RNA, 18 nt, Human
cagauccaggcagcuauu

SEQ ID NO: 598572 - RNA, 22 nt, Human
ugcucuuaauuccauuagacuu

SEQ ID NO: 598573 - RNA, 22 nt, Human
uuuccuaaggcucauuuuaaaa

SEQ ID NO: 598574 - RNA, 22 nt, Human
uuaccugcaacucccaugguga

SEQ ID NO: 598575 - RNA, 22 nt, Human
ugggcagcagaaccaggccgac

SEQ ID NO: 598576 - RNA, 22 nt, Human
acagccuggccugaguuaaggc

SEQ ID NO: 598577 - RNA, 22 nt, Human
uggcuucuuagaccaguggccu

SEQ ID NO: 598578 - RNA, 20 nt, Human
ucaaggaaugucauuuuguu

SEQ ID NO: 598579 - RNA, 22 nt, Human
guaacauucuagaaacuuaaca

SEQ ID NO: 598580 - RNA, 22 nt, Human
cccagcuccagagccagaaaca

SEQ ID NO: 598581 - RNA, 22 nt, Human
cccaggagaccuagaucuguuu

SEQ ID NO: 598582 - RNA, 22 nt, Human
acaguucagacaaguguuccau

SEQ ID NO: 598583 - RNA, 22 nt, Human
gcacugggaaugcugaugggcu

SEQ ID NO: 598584 - RNA, 22 nt, Human
acagaguagcucaagaagauug

SEQ ID NO: 598585 - RNA, 22 nt, Human
aaugcagugagccauuaaaugg

SEQ ID NO: 598586 - RNA, 22 nt, Human
ugcauauauuugagauuauggc

SEQ ID NO: 598587 - RNA, 22 nt, Human
aaugucuuuugauacaaguuac

SEQ ID NO: 598588 - RNA, 16 nt, Human
agggccagaagcauca

SEQ ID NO: 598589 - RNA, 22 nt, Human
aagcuggggacucagaccccau

SEQ ID NO: 598590 - RNA, 22 nt, Human
acagugaaugcccaagaaaagu

SEQ ID NO: 598591 - RNA, 22 nt, Human
uucaaguacuguagauuucagg

SEQ ID NO: 598592 - RNA, 21 nt, Human
agggccugugcucuccagguc

SEQ ID NO: 598593 - RNA, 22 nt, Human
ggcaugggguguauguggcacg

SEQ ID NO: 598594 - RNA, 22 nt, Human
ggugacagcgggucaagaggag

SEQ ID NO: 598595 - RNA, 22 nt, Human
cccacuucaugggcaggaagga

SEQ ID NO: 598596 - RNA, 18 nt, Human
cccggcuaauuuuuggua

SEQ ID NO: 598597 - RNA, 23 nt, Human
auuuacagcugugugagcaaguu

SEQ ID NO: 598598 - RNA, 22 nt, Human
uaagaggcagcauuccucgccu

SEQ ID NO: 598599 - RNA, 22 nt, Human
agcuucucccuuuccuauuggu

SEQ ID NO: 598600 - RNA, 22 nt, Human
uuugcucuuaugaacaaggugg

SEQ ID NO: 598601 - RNA, 22 nt, Human
cugcuucacccaacuuugggau

SEQ ID NO: 598602 - RNA, 22 nt, Human
ugagcuguguccugggggcagu

SEQ ID NO: 598603 - RNA, 22 nt, Human
guguucuuuugcuucacagaaa

SEQ ID NO: 598604 - RNA, 22 nt, Human
cugagcagaagggugcacgugc

SEQ ID NO: 598605 - RNA, 22 nt, Human
cagaggaaaguauuucuggaag

SEQ ID NO: 598606 - RNA, 22 nt, Human
gcugccuguggcccuucugggu

SEQ ID NO: 598607 - RNA, 22 nt, Human
ugguggcaacauugcuggagug

SEQ ID NO: 598608 - RNA, 22 nt, Human
cauaacugggagauccaagggu

SEQ ID NO: 598609 - RNA, 22 nt, Human
guaauuuaauucucugacuuga

SEQ ID NO: 598610 - RNA, 22 nt, Human
cucugagagugcucagagggua

SEQ ID NO: 598611 - RNA, 22 nt, Human
ggugagcacugcccugggucuc

SEQ ID NO: 598612 - RNA, 21 nt, Human
caugaacaugcuuauccucag

SEQ ID NO: 598613 - RNA, 22 nt, Human
ugggacagugaccccagagguc

SEQ ID NO: 598614 - RNA, 22 nt, Human
ccucugggugacagacucuugg

SEQ ID NO: 598615 - RNA, 22 nt, Human
cugaggcugggcauggggucca

SEQ ID NO: 598616 - RNA, 21 nt, Human
ggagggcagcccagacuggcu

SEQ ID NO: 598617 - RNA, 22 nt, Human
uugggaaacaguauagcuaaca

SEQ ID NO: 598618 - RNA, 22 nt, Human
cuuccucuguguccugggcuuc

SEQ ID NO: 598619 - RNA, 20 nt, Human
gggcuccagcugugauucuu

SEQ ID NO: 598620 - RNA, 22 nt, Human
ucaauagagccuucuuucaggu

SEQ ID NO: 598621 - RNA, 22 nt, Human
gagaagcaaucagcagccaccc

SEQ ID NO: 598622 - RNA, 22 nt, Human
cagcagcugggaaggaggcuga

SEQ ID NO: 598623 - RNA, 22 nt, Human
acuuuguugaagaauauguuag

SEQ ID NO: 598624 - RNA, 19 nt, Human
ugcuagaaauucugugacu

SEQ ID NO: 598625 - RNA, 22 nt, Human
uaggauggucacagagauggac

SEQ ID NO: 598626 - RNA, 22 nt, Human
cuguccuggagggcauaggacg

SEQ ID NO: 598627 - RNA, 22 nt, Human
ucucuguaaaauguggaugaua

SEQ ID NO: 598628 - RNA, 22 nt, Human
cagagcagggguuucccagguu

SEQ ID NO: 598629 - RNA, 22 nt, Human
caggguccggcugccuggcugu

SEQ ID NO: 598630 - RNA, 22 nt, Human
uuucuuuaauucucacagcaau

SEQ ID NO: 598631 - RNA, 22 nt, Human
ggaaacagagggcaccugagcc

SEQ ID NO: 598632 - RNA, 22 nt, Human
ucagaugcuuagugacuacaca

SEQ ID NO: 598633 - RNA, 22 nt, Human
gggugaggcccauuugaggcca

SEQ ID NO: 598634 - RNA, 22 nt, Human
gagcuuugucuccuggagaccc

SEQ ID NO: 598635 - RNA, 22 nt, Human
ugccuggcccugacagcccugg

SEQ ID NO: 598636 - RNA, 22 nt, Human
ccagcagacacacaggcguggg

SEQ ID NO: 598637 - RNA, 19 nt, Human
ccagccucucuuccacccc

SEQ ID NO: 598638 - RNA, 22 nt, Human
uaguggagguggucugugaacu

SEQ ID NO: 598639 - RNA, 22 nt, Human
aucugaggguuugggcaucagc

SEQ ID NO: 598640 - RNA, 22 nt, Human
cagagcccuaguccugauggcc

SEQ ID NO: 598641 - RNA, 22 nt, Human
aagcacugggaggaggcugaga

SEQ ID NO: 598642 - RNA, 22 nt, Human
agcuguggggcaggcagcgagg

SEQ ID NO: 598643 - RNA, 22 nt, Human
cagcaggauaugguggagagag

SEQ ID NO: 598644 - RNA, 23 nt, Human
cuggucagaggcugcuggaaggg

SEQ ID NO: 598645 - RNA, 22 nt, Human
cuucuucuuuugugggugguaa

SEQ ID NO: 598646 - RNA, 22 nt, Human
uuggagguuauuaacacuggcc

SEQ ID NO: 598647 - RNA, 22 nt, Human
aaaagaguguuucaacuuuggc

SEQ ID NO: 598648 - RNA, 20 nt, Human
ugcugccuacuaagcccuca

SEQ ID NO: 598649 - RNA, 22 nt, Human
ccagagagauugcuucuaaaga

SEQ ID NO: 598650 - RNA, 22 nt, Human
gccucagccggcggacgccagg

SEQ ID NO: 598651 - RNA, 22 nt, Human
aucuuugugcuaauguaguucu

SEQ ID NO: 598652 - RNA, 22 nt, Human
uggacaucuuagucaugucaau

SEQ ID NO: 598653 - RNA, 22 nt, Human
cacugguuuugcugauaaggca

SEQ ID NO: 598654 - RNA, 22 nt, Human
acuaaggaauaugacaaacuca

SEQ ID NO: 598655 - RNA, 22 nt, Human
ugcagaagcagagccgguggcc

SEQ ID NO: 598656 - RNA, 22 nt, Human
auguauuucuauguagugaaga

SEQ ID NO: 598657 - RNA, 22 nt, Human
uaggaacaaguuuccuugcugu

SEQ ID NO: 598658 - RNA, 22 nt, Human
aggcaucugaguuugcaagcuu

SEQ ID NO: 598659 - RNA, 22 nt, Human
cagaggcuuggcauuaucaugc

SEQ ID NO: 598660 - RNA, 22 nt, Human
ugacagugagcuugggguacuu

SEQ ID NO: 598661 - RNA, 22 nt, Human
ggcuccagggucucuccuugug

SEQ ID NO: 598662 - RNA, 22 nt, Human
uggggugggcaugcgcuguccu

SEQ ID NO: 598663 - RNA, 22 nt, Human
ucucccccagucucuacagcag

SEQ ID NO: 598664 - RNA, 22 nt, Human
augcuaaagcuuugcuuucauu

SEQ ID NO: 598665 - RNA, 22 nt, Human
ugcuggaggccgagaagcagca

SEQ ID NO: 598666 - RNA, 22 nt, Human
agccuggagcuugaguuaugag

SEQ ID NO: 598667 - RNA, 22 nt, Human
acucuuuagagguacaucucuu

SEQ ID NO: 598668 - RNA, 22 nt, Human
uccucagacacccugcuggcuu

SEQ ID NO: 598669 - RNA, 22 nt, Human
aggcuccagcccaaggcugcag

SEQ ID NO: 598670 - RNA, 22 nt, Human
auugcugacuuuaauauuauau

SEQ ID NO: 598671 - RNA, 22 nt, Human
uaggcugagcuuguagaucgua

SEQ ID NO: 598672 - RNA, 22 nt, Human
agggcagagagaugaaugggau

SEQ ID NO: 598673 - RNA, 22 nt, Human
cauggccacaucuagcugcaag

SEQ ID NO: 598674 - RNA, 22 nt, Human
acauuuugcccuuauuugcuga

SEQ ID NO: 598675 - RNA, 22 nt, Human
ggcucaggacugcagcguagag

SEQ ID NO: 598676 - RNA, 18 nt, Human
ccuucagcucugccagua

SEQ ID NO: 598677 - RNA, 22 nt, Human
guggcccacacagacagcaucu

SEQ ID NO: 598678 - RNA, 22 nt, Human
uggcugaguuucaugcaucaug

SEQ ID NO: 598679 - RNA, 22 nt, Human
ucuccuucgaggcccagcuccc

SEQ ID NO: 598680 - RNA, 22 nt, Human
ccaggaagccucagaugcugag

SEQ ID NO: 598681 - RNA, 19 nt, Human
cuagaguaauaaguacuuu

SEQ ID NO: 598682 - RNA, 22 nt, Human
cagcuucugcucauggaggggu

SEQ ID NO: 598683 - RNA, 22 nt, Human
agaauucuuggugguuagaaua

SEQ ID NO: 598684 - RNA, 23 nt, Human
uaguuauuuucucuguaauuugc

SEQ ID NO: 598685 - RNA, 22 nt, Human
caaggauucucacuagacuaga

SEQ ID NO: 598686 - RNA, 22 nt, Human
gccuggaguggacuuggccccu

SEQ ID NO: 598687 - RNA, 22 nt, Human
acagcaggcaugaaugacacug

SEQ ID NO: 598688 - RNA, 22 nt, Human
ccuggagagcucgggccaggca

SEQ ID NO: 598689 - RNA, 22 nt, Human
aaucagaaccuugggucauaac

SEQ ID NO: 598690 - RNA, 22 nt, Human
ugggggagagaggcauucuuuc

SEQ ID NO: 598691 - RNA, 22 nt, Human
cacagugacuggcacauaguaa

SEQ ID NO: 598692 - RNA, 20 nt, Human
acagagacugagacacuugc

SEQ ID NO: 598693 - RNA, 22 nt, Human
uauuacaauuuacauugcacuu

SEQ ID NO: 598694 - RNA, 22 nt, Human
uuucuucuaagauuucaaacua

SEQ ID NO: 598695 - RNA, 22 nt, Human
gcaagauuuacagacaacuucg

SEQ ID NO: 598696 - RNA, 22 nt, Human
agaggcaacauggggaacagau

SEQ ID NO: 598697 - RNA, 22 nt, Human
cucugccugccacuguucaggc

SEQ ID NO: 598698 - RNA, 22 nt, Human
cuggccagggugcgaucguggu

SEQ ID NO: 598699 - RNA, 22 nt, Human
aacaguuugcuuuaagaggcac

SEQ ID NO: 598700 - RNA, 22 nt, Human
auuguuaaacugaagcauuacu

SEQ ID NO: 598701 - RNA, 22 nt, Human
uuaauuuuaaccuguuuguguc

SEQ ID NO: 598702 - RNA, 22 nt, Human
aaguuugacagaaguuucuaau

SEQ ID NO: 598703 - RNA, 22 nt, Human
uaaugacuugaaggacccaugg

SEQ ID NO: 598704 - RNA, 22 nt, Human
acagagcugggugcccccugga

SEQ ID NO: 598705 - RNA, 22 nt, Human
acugccuguagcucuucaucuc

SEQ ID NO: 598706 - RNA, 18 nt, Human
ugaggcugaggguagagg

SEQ ID NO: 598707 - RNA, 22 nt, Human
cacagcugcccuacuccaugug

SEQ ID NO: 598708 - RNA, 22 nt, Human
aacaaugccaacagcaugcugg

SEQ ID NO: 598709 - RNA, 22 nt, Human
aggggccuccucauuggagugu

SEQ ID NO: 598710 - RNA, 22 nt, Human
aguuucuagccucacuguuuag

SEQ ID NO: 598711 - RNA, 22 nt, Human
gcuucgcugcuagcuaguuggu

SEQ ID NO: 598712 - RNA, 22 nt, Human
ugaguccugcugagcagagagg

SEQ ID NO: 598713 - RNA, 22 nt, Human
uuacaucacuuuacuuaauaau

SEQ ID NO: 598714 - RNA, 22 nt, Human
gucucuggguuaagcagugcau

SEQ ID NO: 598715 - RNA, 22 nt, Human
gcagcaggagaguuuguccugc

SEQ ID NO: 598716 - RNA, 22 nt, Human
cuuucuuugcagugagccagag

SEQ ID NO: 598717 - RNA, 22 nt, Human
gugcuuuuuauaaggcagacug

SEQ ID NO: 598718 - RNA, 22 nt, Human
acugaaaugaaaucuaucaucu

SEQ ID NO: 598719 - RNA, 22 nt, Human
cugggucugggccuccuggagu

SEQ ID NO: 598720 - RNA, 22 nt, Human
uugugcugcugacuuaagauau

SEQ ID NO: 598721 - RNA, 22 nt, Human
uggagcaagcuggagagaacau

SEQ ID NO: 598722 - RNA, 22 nt, Human
gggguggcccuacccucuggaa

SEQ ID NO: 598723 - RNA, 20 nt, Human
aaaagagugcuucaacugcu

SEQ ID NO: 598724 - RNA, 22 nt, Human
gcuguggcggcagcagcuggug

SEQ ID NO: 598725 - RNA, 22 nt, Human
uucucagaggcugcuaagugca

SEQ ID NO: 598726 - RNA, 18 nt, Human
ccagcccugcagcaccug

SEQ ID NO: 598727 - RNA, 22 nt, Human
caugagaaccaggucuguguuu

SEQ ID NO: 598728 - RNA, 22 nt, Human
ugagccugggcuuucucuggag

SEQ ID NO: 598729 - RNA, 22 nt, Human
aucucagaaacauaucuaaucc

SEQ ID NO: 598730 - RNA, 22 nt, Human
ccaucccugggccauguccccu

SEQ ID NO: 598731 - RNA, 22 nt, Human
uugcuaaucauauuucaucacu

SEQ ID NO: 598732 - RNA, 22 nt, Human
aacaguuuguggauagcuugua

SEQ ID NO: 598733 - RNA, 22 nt, Human
ggaacaggaaaggagggaugcu

SEQ ID NO: 598734 - RNA, 20 nt, Human
auguucuucauuuaauguuc

SEQ ID NO: 598735 - RNA, 22 nt, Human
gaagcaguagauuccuacucau

SEQ ID NO: 598736 - RNA, 22 nt, Human
ggcaggacagucccaguucaaa

SEQ ID NO: 598737 - RNA, 21 nt, Human
ggaagcuguguccaugcuccu

SEQ ID NO: 598738 - RNA, 23 nt, Human
cucuggagauccucugccugggu

SEQ ID NO: 598739 - RNA, 22 nt, Human
ugcauuucuuuugaguauaugc

SEQ ID NO: 598740 - RNA, 22 nt, Human
cccugacagauggcaggggagc

SEQ ID NO: 598741 - RNA, 22 nt, Human
acccagagcacagaugcaacgu

SEQ ID NO: 598742 - RNA, 22 nt, Human
ucaguuucuuuacucauagaau

SEQ ID NO: 598743 - RNA, 22 nt, Human
auauuuauaagcaagcaggacu

SEQ ID NO: 598744 - RNA, 22 nt, Human
uuuugauaucaugaugaacaga

SEQ ID NO: 598745 - RNA, 21 nt, Human
ugaaggagaggaccgagugcu

SEQ ID NO: 598746 - RNA, 22 nt, Human
gcagguggugggggagccguuc

SEQ ID NO: 598747 - RNA, 22 nt, Human
ucccaaagcuacucuucugacu

SEQ ID NO: 598748 - RNA, 22 nt, Human
cugcuuuagugugguguuagag

SEQ ID NO: 598749 - RNA, 22 nt, Human
augagguauucguaauauuucc

SEQ ID NO: 598750 - RNA, 22 nt, Human
aucaaaguccaucagaagguag

SEQ ID NO: 598751 - RNA, 22 nt, Human
acuugauuguaugaaguuauuu

SEQ ID NO: 598752 - RNA, 22 nt, Human
aauauuucuccuucguuauagc

SEQ ID NO: 598753 - RNA, 22 nt, Human
ccugccugacagagaagguuca

SEQ ID NO: 598754 - RNA, 22 nt, Human
augcauauuucuugggcuuacc

SEQ ID NO: 598755 - RNA, 22 nt, Human
cccugguguccacuggaggaag

SEQ ID NO: 598756 - RNA, 22 nt, Human
agagggugaaugagauagaaaa

SEQ ID NO: 598757 - RNA, 22 nt, Human
ggguuacugcuucaaaaaauua

SEQ ID NO: 598758 - RNA, 22 nt, Human
aaagguuuauugauucugcucu

SEQ ID NO: 598759 - RNA, 22 nt, Human
auaauacaugguugaucuuuuc

SEQ ID NO: 598760 - RNA, 22 nt, Human
augcccugcucucgggaaggga

SEQ ID NO: 598761 - RNA, 22 nt, Human
uuagcauuuucugggcugaaau

SEQ ID NO: 598762 - RNA, 22 nt, Human
cagauuuaagauauuuguauug

SEQ ID NO: 598763 - RNA, 22 nt, Human
ugagaaaauuacuauaauuguc

SEQ ID NO: 598764 - RNA, 22 nt, Human
cagcuuugauucacugccuagu

SEQ ID NO: 598765 - RNA, 22 nt, Human
cuugugcaagaaaccuggaaug

SEQ ID NO: 598766 - RNA, 22 nt, Human
ugcccaggguggagugcagcgg

SEQ ID NO: 598767 - RNA, 20 nt, Human
gggaggccagccucagagaa

SEQ ID NO: 598768 - RNA, 22 nt, Human
cuucugggccauggccuuccuc

SEQ ID NO: 598769 - RNA, 22 nt, Human
ugugucuccauagccagcuagc

SEQ ID NO: 598770 - RNA, 22 nt, Human
uaaagacaugcaaagucuaauu

SEQ ID NO: 598771 - RNA, 22 nt, Human
cugcccuguccuucccgccggc

SEQ ID NO: 598772 - RNA, 20 nt, Human
ccaggcacugucccaugcag

SEQ ID NO: 598773 - RNA, 22 nt, Human
aaggaggagugggguccuggaa

SEQ ID NO: 598774 - RNA, 23 nt, Human
aaugauuucaugaugauagcagc

SEQ ID NO: 598775 - RNA, 22 nt, Human
gagacuguaagcuccuugagga

SEQ ID NO: 598776 - RNA, 22 nt, Human
agaacacacgucagaguuuccu

SEQ ID NO: 598777 - RNA, 22 nt, Human
uuugggaagaggaaucucugga

SEQ ID NO: 598778 - RNA, 22 nt, Human
cugaggaaggcugggggcaucc

SEQ ID NO: 598779 - RNA, 22 nt, Human
ccugcacagccggaccccugcu

SEQ ID NO: 598780 - RNA, 22 nt, Human
cuggagccagccagggcccucu

SEQ ID NO: 598781 - RNA, 18 nt, Human
ucaggcugcccugugucu

SEQ ID NO: 598782 - RNA, 23 nt, Human
gcuugccugguguguggcugacc

SEQ ID NO: 598783 - RNA, 21 nt, Human
agagggagaguggcccuucca

SEQ ID NO: 598784 - RNA, 22 nt, Human
aauucccauuugcagaaaauca

SEQ ID NO: 598785 - RNA, 20 nt, Human
ggaagccagggugcagggga

SEQ ID NO: 598786 - RNA, 22 nt, Human
ccaggaggaugaggggcauaga

SEQ ID NO: 598787 - RNA, 22 nt, Human
agauucauuguggauauuuucu

SEQ ID NO: 598788 - RNA, 22 nt, Human
gcccagcuuuucacuuccacac

SEQ ID NO: 598789 - RNA, 22 nt, Human
cagaagcaaaugccuugcugag

SEQ ID NO: 598790 - RNA, 21 nt, Human
cuguauuaacuuuugcaccuu

SEQ ID NO: 598791 - RNA, 22 nt, Human
gugccaggugcuaagcugugcu

SEQ ID NO: 598792 - RNA, 22 nt, Human
auuuuauccccacuggauuaca

SEQ ID NO: 598793 - RNA, 22 nt, Human
guggagcauaacacacuagccu

SEQ ID NO: 598794 - RNA, 22 nt, Human
ugaaaugcuuuuacaggauauu

SEQ ID NO: 598795 - RNA, 22 nt, Human
cuucugccccuguagccugagu

SEQ ID NO: 598796 - RNA, 22 nt, Human
cuagggcucgcaagggcuggag

SEQ ID NO: 598797 - RNA, 22 nt, Human
uccuguguugauagagaugguu

SEQ ID NO: 598798 - RNA, 22 nt, Human
ugcuacaaauucguaaucaauu

SEQ ID NO: 598799 - RNA, 22 nt, Human
cuggagggcugcagcgaggcug

SEQ ID NO: 598800 - RNA, 22 nt, Human
gaaauacagaaagggcugaaug

SEQ ID NO: 598801 - RNA, 22 nt, Human
cucugagaaagcugugagcuaa

SEQ ID NO: 598802 - RNA, 22 nt, Human
cagauaaaggcuuacuaguagu

SEQ ID NO: 598803 - RNA, 22 nt, Human
gaggucaggcuugcagcagggu

SEQ ID NO: 598804 - RNA, 22 nt, Human
aaguuacacauuuucauuguaa

SEQ ID NO: 598805 - RNA, 22 nt, Human
agggccagagucuguguagaua

SEQ ID NO: 598806 - RNA, 22 nt, Human
auggucaggcaaggagggcugg

SEQ ID NO: 598807 - RNA, 22 nt, Human
uuuucucuccagguggggugau

SEQ ID NO: 598808 - RNA, 22 nt, Human
gguggcagagacauaggacaua

SEQ ID NO: 598809 - RNA, 22 nt, Human
uccagccucauuucuccugcuu

SEQ ID NO: 598810 - RNA, 22 nt, Human
aggccuuaucuccaaauacagu

SEQ ID NO: 598811 - RNA, 22 nt, Human
gcagaugcugcuccucucuaga

SEQ ID NO: 598812 - RNA, 22 nt, Human
augucccaagauacagcuagag

SEQ ID NO: 598813 - RNA, 22 nt, Human
cugggcacacagugacucugca

SEQ ID NO: 598814 - RNA, 22 nt, Human
ugucaaauaguagaaagauggc

SEQ ID NO: 598815 - RNA, 22 nt, Human
uuccuaacucuggcaccuaguc

SEQ ID NO: 598816 - RNA, 22 nt, Human
accauguuaguuacugggaaug

SEQ ID NO: 598817 - RNA, 22 nt, Human
gaaugauauauuagcagauuuu

SEQ ID NO: 598818 - RNA, 22 nt, Human
ggcuccugggagauagagguca

SEQ ID NO: 598819 - RNA, 18 nt, Human
gaugggagcaagagaaga

SEQ ID NO: 598820 - RNA, 22 nt, Human
uuaaaaccaucagcuguaagau

SEQ ID NO: 598821 - RNA, 20 nt, Human
cagaggaguacauauguuca

SEQ ID NO: 598822 - RNA, 22 nt, Human
agauggguaauugauggcagua

SEQ ID NO: 598823 - RNA, 22 nt, Human
uaaaaucaccaaaagcaggugg

SEQ ID NO: 598824 - RNA, 22 nt, Human
caucauaauaacccagacacag

SEQ ID NO: 598825 - RNA, 22 nt, Human
ucaguguuagacaaguuuggaa

SEQ ID NO: 598826 - RNA, 22 nt, Human
cacacucauuagucauuucucu

SEQ ID NO: 598827 - RNA, 22 nt, Human
aagacuuucccucaucagaacg

SEQ ID NO: 598828 - RNA, 22 nt, Human
uauaaagugugaacugugagua

SEQ ID NO: 598829 - RNA, 22 nt, Human
cccugcccaccacaugcuggga

SEQ ID NO: 598830 - RNA, 22 nt, Human
aagaaacuguugcgugacagcg

SEQ ID NO: 598831 - RNA, 22 nt, Human
uaauuuacaguucgccaugucu

SEQ ID NO: 598832 - RNA, 22 nt, Human
ugagacaggcuuccuucuuggg

SEQ ID NO: 598833 - RNA, 22 nt, Human
agggcccauagaucgucagcuu

SEQ ID NO: 598834 - RNA, 22 nt, Human
gagugcuccgucuuggacaggg

SEQ ID NO: 598835 - RNA, 22 nt, Human
uugacaaagauauauucaugcu

SEQ ID NO: 598836 - RNA, 22 nt, Human
ucucauuuugagucagacacua

SEQ ID NO: 598837 - RNA, 22 nt, Human
aaguuacaguuacagaauggag

SEQ ID NO: 598838 - RNA, 22 nt, Human
ggucagggcucuuccaguggcu

SEQ ID NO: 598839 - RNA, 22 nt, Human
aaagguuuucugacccuuagua

SEQ ID NO: 598840 - RNA, 22 nt, Human
uuauuaugugcuagagaaugua

SEQ ID NO: 598841 - RNA, 22 nt, Human
auuuagcaagaguacaaaauaa

SEQ ID NO: 598842 - RNA, 22 nt, Human
gcaaacaucuuuauuuggcaag

SEQ ID NO: 598843 - RNA, 22 nt, Human
uucuacuuuagcaugcucauuc

SEQ ID NO: 598844 - RNA, 22 nt, Human
ccucugagaccagcucugcacc

SEQ ID NO: 598845 - RNA, 22 nt, Human
ugagcugugcuacgcccuggga

SEQ ID NO: 598846 - RNA, 22 nt, Human
acguaguguguuguggaaagag

SEQ ID NO: 598847 - RNA, 22 nt, Human
ccagccccgggaaccuggccgu

SEQ ID NO: 598848 - RNA, 22 nt, Human
agccagcuguguggucaggcaa

SEQ ID NO: 598849 - RNA, 20 nt, Human
ccauucugggugcagucugg

SEQ ID NO: 598850 - RNA, 22 nt, Human
caggcacugugcuagauccuug

SEQ ID NO: 598851 - RNA, 21 nt, Human
ugaagggcagccucaggcucc

SEQ ID NO: 598852 - RNA, 22 nt, Human
cccaucucagucgugcuaaggg

SEQ ID NO: 598853 - RNA, 22 nt, Human
cagcugccccauaaaucacagu

SEQ ID NO: 598854 - RNA, 22 nt, Human
ccagggcugagacuguauuggg

SEQ ID NO: 598855 - RNA, 22 nt, Human
caaaaguaauugugguuuucac

SEQ ID NO: 598856 - RNA, 22 nt, Human
augacuucugcuuuacagaguu

SEQ ID NO: 598857 - RNA, 22 nt, Human
augcaguaaaauaggagguaau

SEQ ID NO: 598858 - RNA, 22 nt, Human
ugaggcccagccgcccugagag

SEQ ID NO: 598859 - RNA, 22 nt, Human
aaagccacaguucuaugucugc

SEQ ID NO: 598860 - RNA, 22 nt, Human
augaugucccuaggcagguagu

SEQ ID NO: 598861 - RNA, 22 nt, Human
ucccagagaaagucaaggucuu

SEQ ID NO: 598862 - RNA, 22 nt, Human
cuguguccugcgucaagccaau

SEQ ID NO: 598863 - RNA, 22 nt, Human
auagcaguggauguggagaaag

SEQ ID NO: 598864 - RNA, 22 nt, Human
uuugauaugcaaaauuauggac

SEQ ID NO: 598865 - RNA, 22 nt, Human
ggaggugcuggcggccagcucu

SEQ ID NO: 598866 - RNA, 22 nt, Human
uggaauaaugaccacagaaaca

SEQ ID NO: 598867 - RNA, 22 nt, Human
gcugcagggagcuggaaggcuc

SEQ ID NO: 598868 - RNA, 22 nt, Human
ugaaauucaaaacacauuuguc

SEQ ID NO: 598869 - RNA, 22 nt, Human
uggaaugccgggccaggcuccg

SEQ ID NO: 598870 - RNA, 22 nt, Human
uccagucaggcugaauucaagg

SEQ ID NO: 598871 - RNA, 22 nt, Human
aaacacucauguguuacucucc

SEQ ID NO: 598872 - RNA, 22 nt, Human
ccucuggccacaugggacauag

SEQ ID NO: 598873 - RNA, 22 nt, Human
uuccugaucccccaggacaaag

SEQ ID NO: 598874 - RNA, 18 nt, Human
uaauuugcacaguugcaa

SEQ ID NO: 598875 - RNA, 22 nt, Human
uacacuguuuuuggaaagaaga

SEQ ID NO: 598876 - RNA, 22 nt, Human
ugcuggcaugcaugcuguagga

SEQ ID NO: 598877 - RNA, 21 nt, Human
aggcccuggaggucagagaaa

SEQ ID NO: 598878 - RNA, 22 nt, Human
uuuaauuauguuaagccacuga

SEQ ID NO: 598879 - RNA, 22 nt, Human
agaugggcgcccuggacugagg

SEQ ID NO: 598880 - RNA, 22 nt, Human
cugccuuuucaucugagcugga

SEQ ID NO: 598881 - RNA, 22 nt, Human
gagaggagguggcuaugacagc

SEQ ID NO: 598882 - RNA, 21 nt, Human
gcagagcuggaaccaggaccc

SEQ ID NO: 598883 - RNA, 22 nt, Human
acugucuccucaucaugccugg

SEQ ID NO: 598884 - RNA, 21 nt, Human
ggaguuuuucuggaagggacu

SEQ ID NO: 598885 - RNA, 22 nt, Human
acaucauuuucuucaguguuug

SEQ ID NO: 598886 - RNA, 22 nt, Human
gcaaaaacugcaauuacuuuug

SEQ ID NO: 598887 - RNA, 22 nt, Human
acuuacaaucaaccaccuugga

SEQ ID NO: 598888 - RNA, 22 nt, Human
uucacaaacaccagaauggcua

SEQ ID NO: 598889 - RNA, 22 nt, Human
ggcaucuggaucugcuucuccc

SEQ ID NO: 598890 - RNA, 19 nt, Human
acagggcuuggccugacau

SEQ ID NO: 598891 - RNA, 22 nt, Human
cugcuaaaccucucugagagcu

SEQ ID NO: 598892 - RNA, 22 nt, Human
uucugccaaaggcuuuguuuug

SEQ ID NO: 598893 - RNA, 22 nt, Human
cuuauuuaugucugucucuaau

SEQ ID NO: 598894 - RNA, 22 nt, Human
uauuacugagguuuuauggagu

SEQ ID NO: 598895 - RNA, 22 nt, Human
aagggcuguagacaagauugcu

SEQ ID NO: 598896 - RNA, 17 nt, Human
gcuggcuucuccuugcu

SEQ ID NO: 598897 - RNA, 22 nt, Human
aggagccagauucucucacuuu

SEQ ID NO: 598898 - RNA, 22 nt, Human
acucaggaauggggcugggacu

SEQ ID NO: 598899 - RNA, 22 nt, Human
agaagccagaggcaguggguac

SEQ ID NO: 598900 - RNA, 22 nt, Human
gccuggucucuuucaugucagu

SEQ ID NO: 598901 - RNA, 22 nt, Human
gcccagcuuuuugaggcaggca

SEQ ID NO: 598902 - RNA, 22 nt, Human
ggcaggagaauggcgugaacuc

SEQ ID NO: 598903 - RNA, 22 nt, Human
aaaugauaguauggaacuagga

SEQ ID NO: 598904 - RNA, 22 nt, Human
uuuacuaacaccauacaugcug

SEQ ID NO: 598905 - RNA, 22 nt, Human
ugagggcugacaggaggacagc

SEQ ID NO: 598906 - RNA, 22 nt, Human
cugggcuagaaggaccaggaug

SEQ ID NO: 598907 - RNA, 22 nt, Human
ucagcaccaguuauccucaggg

SEQ ID NO: 598908 - RNA, 22 nt, Human
cagacccucgggugaguuggcc

SEQ ID NO: 598909 - RNA, 22 nt, Human
caggugguuguuuggauucuaa

SEQ ID NO: 598910 - RNA, 22 nt, Human
ggcacugagaggcucuuccuaa

SEQ ID NO: 598911 - RNA, 22 nt, Human
ucacccaagaccaucggaagug

SEQ ID NO: 598912 - RNA, 22 nt, Human
caggauggucagaugcauuguc

SEQ ID NO: 598913 - RNA, 22 nt, Human
gggccccaagaaccuccuccug

SEQ ID NO: 598914 - RNA, 22 nt, Human
cuucuuuacuuucuagaaauaa

SEQ ID NO: 598915 - RNA, 22 nt, Human
gcacacagccagcugagggcua

SEQ ID NO: 598916 - RNA, 22 nt, Human
uuucuucccaagcaguuucaga

SEQ ID NO: 598917 - RNA, 22 nt, Human
ucaagagauugaauaauaacug

SEQ ID NO: 598918 - RNA, 22 nt, Human
ucuggcaaaggcaaccacaguu

SEQ ID NO: 598919 - RNA, 22 nt, Human
uccuugaagagugggcggucga

SEQ ID NO: 598920 - RNA, 22 nt, Human
ugggagagcuucaugccuucag

SEQ ID NO: 598921 - RNA, 22 nt, Human
gugggccaggccggagugcaga

SEQ ID NO: 598922 - RNA, 22 nt, Human
gagaggggaccugugugucuag

SEQ ID NO: 598923 - RNA, 22 nt, Human
gagccaggggucagcuccgagg

SEQ ID NO: 598924 - RNA, 22 nt, Human
ccauguuguaucucuuaucggc

SEQ ID NO: 598925 - RNA, 22 nt, Human
uggcagcuauggucuaagggcc

SEQ ID NO: 598926 - RNA, 20 nt, Human
guuuuaugccaguucugugu

SEQ ID NO: 598927 - RNA, 22 nt, Human
cuugggugcucagggaaagcuu

SEQ ID NO: 598928 - RNA, 22 nt, Human
cugcacugaagaaaggagcucu

SEQ ID NO: 598929 - RNA, 22 nt, Human
ccagacaggaacacacaucucc

SEQ ID NO: 598930 - RNA, 22 nt, Human
guggcagcugugggacacuggu

SEQ ID NO: 598931 - RNA, 22 nt, Human
uuucugauauacuguagaaucc

SEQ ID NO: 598932 - RNA, 22 nt, Human
uagcaucaugaucagaacuguu

SEQ ID NO: 598933 - RNA, 22 nt, Human
auugugcaccuacugugugcag

SEQ ID NO: 598934 - RNA, 22 nt, Human
gguggccucgguggugcacagg

SEQ ID NO: 598935 - RNA, 18 nt, Human
cagagcuccuggaugcag

SEQ ID NO: 598936 - RNA, 22 nt, Human
gugcccaggcccaaggcaccac

SEQ ID NO: 598937 - RNA, 22 nt, Human
augagguaucucauuuccugaa

SEQ ID NO: 598938 - RNA, 22 nt, Human
ccagggugugagaaggaaguag

SEQ ID NO: 598939 - RNA, 22 nt, Human
uuuccaauuugguagucaucgg

SEQ ID NO: 598940 - RNA, 22 nt, Human
cccagcuugcaaauggguugcu

SEQ ID NO: 598941 - RNA, 22 nt, Human
gccugggauagaggcaaugcau

SEQ ID NO: 598942 - RNA, 22 nt, Human
ugaguguuguaaccauaugauu

SEQ ID NO: 598943 - RNA, 22 nt, Human
uuccuggucugugccauucaga

SEQ ID NO: 598944 - RNA, 22 nt, Human
cugguggagaugccuggccccu

SEQ ID NO: 598945 - RNA, 22 nt, Human
aaagugauuuaaguaccucagg

SEQ ID NO: 598946 - RNA, 22 nt, Human
gcugcugugugggagacaggcg

SEQ ID NO: 598947 - RNA, 22 nt, Human
accugcuugagccaguaugaga

SEQ ID NO: 598948 - RNA, 22 nt, Human
ugaacauugucacauuccuagc

SEQ ID NO: 598949 - RNA, 22 nt, Human
augcagggauuaaaugacugcc

SEQ ID NO: 598950 - RNA, 21 nt, Human
ccagacuggccuaugugguag

SEQ ID NO: 598951 - RNA, 22 nt, Human
uucucugguuugcuguuucuga

SEQ ID NO: 598952 - RNA, 21 nt, Human
uggcugccuacaugcugcagg

SEQ ID NO: 598953 - RNA, 22 nt, Human
uugcuuuagggcaaauauuuca

SEQ ID NO: 598954 - RNA, 22 nt, Human
agucucugugagcucccaaugg

SEQ ID NO: 598955 - RNA, 22 nt, Human
cacagagaauacugcucuugcu

SEQ ID NO: 598956 - RNA, 22 nt, Human
uucugggccuccuaggacaggc

SEQ ID NO: 598957 - RNA, 22 nt, Human
cacagagacagaucuauuuugc

SEQ ID NO: 598958 - RNA, 22 nt, Human
gagugggcaccgugggcacacu

SEQ ID NO: 598959 - RNA, 22 nt, Human
uagcagggguagauagagugug

SEQ ID NO: 598960 - RNA, 21 nt, Human
gggagggauggaaaugauguu

SEQ ID NO: 598961 - RNA, 22 nt, Human
cugggaguccaggauacagaug

SEQ ID NO: 598962 - RNA, 22 nt, Human
aggggucuauccugagaugguc

SEQ ID NO: 598963 - RNA, 22 nt, Human
cauuucuccugggugauaaauu

SEQ ID NO: 598964 - RNA, 22 nt, Human
uggaaugaaaaguacuucagaa

SEQ ID NO: 598965 - RNA, 22 nt, Human
aacaaaugaccugauuucuucc

SEQ ID NO: 598966 - RNA, 22 nt, Human
gcccaggaguugaaugcagcag

SEQ ID NO: 598967 - RNA, 22 nt, Human
uaacucacuccaaaaaggcauu

SEQ ID NO: 598968 - RNA, 23 nt, Human
ugacaguguauuugacuauaugg

SEQ ID NO: 598969 - RNA, 22 nt, Human
caggguggggaaauagcgcccu

SEQ ID NO: 598970 - RNA, 22 nt, Human
gaacuuuauuccagaagaaagc

SEQ ID NO: 598971 - RNA, 17 nt, Human
ugcuucuguauugcugg

SEQ ID NO: 598972 - RNA, 22 nt, Human
ucaggaaauuaaacacuugaaa

SEQ ID NO: 598973 - RNA, 22 nt, Human
ccccaggacacauggaccaagu

SEQ ID NO: 598974 - RNA, 19 nt, Human
ggcuccuguggcugcagcc

SEQ ID NO: 598975 - RNA, 22 nt, Human
ccaggaacaaagccccauccac

SEQ ID NO: 598976 - RNA, 22 nt, Human
gauuuucauuugcacucuagaa

SEQ ID NO: 598977 - RNA, 22 nt, Human
ccagcagagcucaaacuuccug

SEQ ID NO: 598978 - RNA, 22 nt, Human
aaacauuuuucuucaucauccu

SEQ ID NO: 598979 - RNA, 22 nt, Human
uaaguccauaauggcaguaaau

SEQ ID NO: 598980 - RNA, 22 nt, Human
guacauuucaguuuccuuaaga

SEQ ID NO: 598981 - RNA, 17 nt, Human
caggcagacauguaagc

SEQ ID NO: 598982 - RNA, 22 nt, Human
gaggagcuugaggcuaggagcc

SEQ ID NO: 598983 - RNA, 22 nt, Human
ucugagguucccucaacuaccu

SEQ ID NO: 598984 - RNA, 22 nt, Human
agguagcuauccagacgcugaa

SEQ ID NO: 598985 - RNA, 22 nt, Human
ugcaggaguccaaucaggagac

SEQ ID NO: 598986 - RNA, 22 nt, Human
uuugugcacauugcuuuucuau

SEQ ID NO: 598987 - RNA, 22 nt, Human
agaccuggguucgaguccuaac

SEQ ID NO: 598988 - RNA, 22 nt, Human
caugcagugccucuggauucuu

SEQ ID NO: 598989 - RNA, 19 nt, Human
aucccaaggagcugggacu

SEQ ID NO: 598990 - RNA, 22 nt, Human
uauuuaaaauagugcuccagca

SEQ ID NO: 598991 - RNA, 22 nt, Human
cucucugguuucagcgaagggg

SEQ ID NO: 598992 - RNA, 22 nt, Human
aucuucuggucaaauuuuugca

SEQ ID NO: 598993 - RNA, 22 nt, Human
uuucauguauuucccaaagcuu

SEQ ID NO: 598994 - RNA, 22 nt, Human
gcaggugauucacccugggccu

SEQ ID NO: 598995 - RNA, 22 nt, Human
cacagaauuuucucuuuacaau

SEQ ID NO: 598996 - RNA, 22 nt, Human
uggcauggaccuuggaagaauu

SEQ ID NO: 598997 - RNA, 22 nt, Human
agauuuagugguggaauuuugg

SEQ ID NO: 598998 - RNA, 22 nt, Human
gacacuggauuucuagaaaugu

SEQ ID NO: 598999 - RNA, 21 nt, Human
ucugucucuccacugcccugc

SEQ ID NO: 599000 - RNA, 22 nt, Human
cauuuguuaauuacuauuaucu

SEQ ID NO: 599001 - RNA, 22 nt, Human
uauuugaugaagguaaagucuu

SEQ ID NO: 599002 - RNA, 20 nt, Human
agcucuuaagaagaagauga

SEQ ID NO: 599003 - RNA, 22 nt, Human
ggccagaguugauggcaucuug

SEQ ID NO: 599004 - RNA, 22 nt, Human
uuacaaaguguuaugauaaaca

SEQ ID NO: 599005 - RNA, 22 nt, Human
uaccaagucaucuauucccaug

SEQ ID NO: 599006 - RNA, 22 nt, Human
uccuggcccuguggccugcagu

SEQ ID NO: 599007 - RNA, 22 nt, Human
uucagaaaaaacuucaauaagu

SEQ ID NO: 599008 - RNA, 22 nt, Human
agagugggugaucucuguuguc

SEQ ID NO: 599009 - RNA, 22 nt, Human
aucaauguuuugauagcccaga

SEQ ID NO: 599010 - RNA, 22 nt, Human
gguuuauuaaugugaacuguau

SEQ ID NO: 599011 - RNA, 22 nt, Human
uucauggcaggagucagaagcu

SEQ ID NO: 599012 - RNA, 22 nt, Human
uacaguaaagcugcuaugaauu

SEQ ID NO: 599013 - RNA, 22 nt, Human
uuuguacaugaaugugcaccca

SEQ ID NO: 599014 - RNA, 22 nt, Human
ucuuauuggauaaaaggaaacc

SEQ ID NO: 599015 - RNA, 22 nt, Human
uguuacugauuugauauacagu

SEQ ID NO: 599016 - RNA, 22 nt, Human
uguuugcuuggucaguaaguag

SEQ ID NO: 599017 - RNA, 22 nt, Human
aagcacugugccucauaucuga

SEQ ID NO: 599018 - RNA, 22 nt, Human
guaugaucaacuucauguccua

SEQ ID NO: 599019 - RNA, 22 nt, Human
caggaggaagaacucugcaaca

SEQ ID NO: 599020 - RNA, 22 nt, Human
aaaucaaaagacauguguuuua

SEQ ID NO: 599021 - RNA, 21 nt, Human
agagagaaggccauauggucc

SEQ ID NO: 599022 - RNA, 22 nt, Human
augacaggaggcagcugggcag

SEQ ID NO: 599023 - RNA, 23 nt, Human
ucugggcugagcucgaguguaga

SEQ ID NO: 599024 - RNA, 22 nt, Human
ugcuggagaacugcucuguguu

SEQ ID NO: 599025 - RNA, 20 nt, Human
ugccccaggccugcaccugc

SEQ ID NO: 599026 - RNA, 22 nt, Human
auuucccaggacuagaaauaua

SEQ ID NO: 599027 - RNA, 23 nt, Human
cauccaggagcugagucugacug

SEQ ID NO: 599028 - RNA, 22 nt, Human
guugcugauuaacacuuugagu

SEQ ID NO: 599029 - RNA, 22 nt, Human
ccaggcucaggccugcucguug

SEQ ID NO: 599030 - RNA, 22 nt, Human
ugccagcaguagcaguaggcca

SEQ ID NO: 599031 - RNA, 22 nt, Human
uccuucaguuaucacaguacug

SEQ ID NO: 599032 - RNA, 22 nt, Human
cugcagucagcuuuuaagaucu

SEQ ID NO: 599033 - RNA, 22 nt, Human
agcagggguaacagaaggaaag

SEQ ID NO: 599034 - RNA, 22 nt, Human
agcuggcagucggccuugaugc

SEQ ID NO: 599035 - RNA, 22 nt, Human
aggcagcugaggucuggcgccc

SEQ ID NO: 599036 - RNA, 22 nt, Human
guggcagaaauauucuugcucu

SEQ ID NO: 599037 - RNA, 22 nt, Human
ggguccagcgacagcaggcuca

SEQ ID NO: 599038 - RNA, 22 nt, Human
aaauguuagguuguacugaguc

SEQ ID NO: 599039 - RNA, 22 nt, Human
ugucauuuaugcuucuucagug

SEQ ID NO: 599040 - RNA, 20 nt, Human
ucucuucaggagguccaugu

SEQ ID NO: 599041 - RNA, 22 nt, Human
gcaguaaauugagagucauguu

SEQ ID NO: 599042 - RNA, 20 nt, Human
cagcuuggaugagaggcuga

SEQ ID NO: 599043 - RNA, 22 nt, Human
aguuuauucugcuuggcccucc

SEQ ID NO: 599044 - RNA, 22 nt, Human
uuucuccucuccagagugcagu

SEQ ID NO: 599045 - RNA, 22 nt, Human
acagaauuuacacaucucuaaa

SEQ ID NO: 599046 - RNA, 22 nt, Human
gcacugcagccucagauggugg

SEQ ID NO: 599047 - RNA, 22 nt, Human
aguggcaguggcugggcagagc

SEQ ID NO: 599048 - RNA, 22 nt, Human
ugaagcagagugaaggugaauu

SEQ ID NO: 599049 - RNA, 21 nt, Human
cagaggcaggcucugugugug

SEQ ID NO: 599050 - RNA, 22 nt, Human
agcugguguccuccuggagcug

SEQ ID NO: 599051 - RNA, 22 nt, Human
gcagaggccaucaacuuugcca

SEQ ID NO: 599052 - RNA, 22 nt, Human
cagguagguauggugcagucuu

SEQ ID NO: 599053 - RNA, 22 nt, Human
gcugcagcuguaggacacaauu

SEQ ID NO: 599054 - RNA, 20 nt, Human
ggugcgaggccagagcagac

SEQ ID NO: 599055 - RNA, 22 nt, Human
uuuccugcacccgcugaugcca

SEQ ID NO: 599056 - RNA, 22 nt, Human
aaggcuggucagauguggugaa

SEQ ID NO: 599057 - RNA, 22 nt, Human
gcacaggcuccggaggagagcu

SEQ ID NO: 599058 - RNA, 22 nt, Human
gcuucuccucccgcucccaggc

SEQ ID NO: 599059 - RNA, 23 nt, Human
acagaggcuuaaaugaguggcag

SEQ ID NO: 599060 - RNA, 22 nt, Human
ucccuccauaacagaggugagc

SEQ ID NO: 599061 - RNA, 22 nt, Human
ucugccugagcagagggaggcc

SEQ ID NO: 599062 - RNA, 23 nt, Human
cugggcauggagcuucagaggcu

SEQ ID NO: 599063 - RNA, 22 nt, Human
cuggguggaucgcagccccagg

SEQ ID NO: 599064 - RNA, 22 nt, Human
ccagcuccaggacugggagcug

SEQ ID NO: 599065 - RNA, 22 nt, Human
accugcccuggaggaagauauu

SEQ ID NO: 599066 - RNA, 22 nt, Human
ccacagcaccgcugccaguccc

SEQ ID NO: 599067 - RNA, 22 nt, Human
gugggcagacagugcuuugcag

SEQ ID NO: 599068 - RNA, 20 nt, Human
aaaggcacagcaacagagcu

SEQ ID NO: 599069 - RNA, 22 nt, Human
agaugugggugucaggcaguga

SEQ ID NO: 599070 - RNA, 21 nt, Human
uacuacagucucuuuaucagu

SEQ ID NO: 599071 - RNA, 22 nt, Human
aauucacagcauuugcccaucu

SEQ ID NO: 599072 - RNA, 21 nt, Human
ugcaccugugccccauccuuc

SEQ ID NO: 599073 - RNA, 22 nt, Human
gucagcucauccaucccggugg

SEQ ID NO: 599074 - RNA, 22 nt, Human
agggcugacaguggcguggcgu

SEQ ID NO: 599075 - RNA, 22 nt, Human
gauuuccuaauguggaucucug

SEQ ID NO: 599076 - RNA, 19 nt, Human
aauaagcuuggguaaaacu

SEQ ID NO: 599077 - RNA, 22 nt, Human
cugucucuguugccuguaggug

SEQ ID NO: 599078 - RNA, 22 nt, Human
ggcuccagcuaaugguuucuau

SEQ ID NO: 599079 - RNA, 22 nt, Human
ugaggccaggacccccagcagg

SEQ ID NO: 599080 - RNA, 22 nt, Human
agcugccaaguuucucaguuua

SEQ ID NO: 599081 - RNA, 22 nt, Human
ccaggggggcguagaugcuggg

SEQ ID NO: 599082 - RNA, 22 nt, Human
ucauuauuugcuuuaguuaugu

SEQ ID NO: 599083 - RNA, 18 nt, Human
agggcucucugcuggguu

SEQ ID NO: 599084 - RNA, 22 nt, Human
aggagcagcccacuccuguccu

SEQ ID NO: 599085 - RNA, 22 nt, Human
ccugagaaaccuggugcaauua

SEQ ID NO: 599086 - RNA, 22 nt, Human
gucacccacucccugcugcugu

SEQ ID NO: 599087 - RNA, 22 nt, Human
ugacccucuuccccaugcgcuc

SEQ ID NO: 599088 - RNA, 22 nt, Human
acagcugugaagcaagcacucu

SEQ ID NO: 599089 - RNA, 22 nt, Human
aaugcuguccaauaggaacaua

SEQ ID NO: 599090 - RNA, 23 nt, Human
ggacacugcuauaaaggaucugc

SEQ ID NO: 599091 - RNA, 22 nt, Human
gaaguuuuagucaaaauguaga

SEQ ID NO: 599092 - RNA, 22 nt, Human
uaaagacaauaggaaaguuguu

SEQ ID NO: 599093 - RNA, 22 nt, Human
ugacauaaaccagugagcaaaa

SEQ ID NO: 599094 - RNA, 22 nt, Human
guuuccacuuauaugguaccua

SEQ ID NO: 599095 - RNA, 22 nt, Human
ggcugugcugagggggaagccc

SEQ ID NO: 599096 - RNA, 22 nt, Human
aaauaagaggacagauguuugg

SEQ ID NO: 599097 - RNA, 22 nt, Human
aggaaacuuucuuuugcuucau

SEQ ID NO: 599098 - RNA, 22 nt, Human
uggugcagacaggagccccgcu

SEQ ID NO: 599099 - RNA, 22 nt, Human
ugaaauuaugcauuguuguacc

SEQ ID NO: 599100 - RNA, 22 nt, Human
ggaaaggcuaacagucauggaa

SEQ ID NO: 599101 - RNA, 21 nt, Human
acacaaaccuccucagccugg

SEQ ID NO: 599102 - RNA, 22 nt, Human
uaaauuuacccaaggaacaugu

SEQ ID NO: 599103 - RNA, 22 nt, Human
uugagguaguucuauugugagu

SEQ ID NO: 599104 - RNA, 22 nt, Human
ugcaguucuaaguagacaaguc

SEQ ID NO: 599105 - RNA, 22 nt, Human
ucagcuggcaguucagaggcug

SEQ ID NO: 599106 - RNA, 22 nt, Human
gagguuucuuaucaagaaagcu

SEQ ID NO: 599107 - RNA, 22 nt, Human
ggaacccaugauuaugguuagg

SEQ ID NO: 599108 - RNA, 22 nt, Human
gaggggugggcuggaaguuaua

SEQ ID NO: 599109 - RNA, 22 nt, Human
ggcaagugguagaacaucugag

SEQ ID NO: 599110 - RNA, 22 nt, Human
gagaaaugcaugcaugucauca

SEQ ID NO: 599111 - RNA, 20 nt, Human
uccagcccugcuucucucuu

SEQ ID NO: 599112 - RNA, 22 nt, Human
aaggggggcaccugcaugcccg

SEQ ID NO: 599113 - RNA, 22 nt, Human
gacagcuugccugguacugcaa

SEQ ID NO: 599114 - RNA, 22 nt, Human
cccaggucuaugccagcucuga

SEQ ID NO: 599115 - RNA, 22 nt, Human
agcugagagguggcaagcugua

SEQ ID NO: 599116 - RNA, 22 nt, Human
gacccaggguauccagagcugc

SEQ ID NO: 599117 - RNA, 22 nt, Human
cugugggagcacuggggaccga

SEQ ID NO: 599118 - RNA, 22 nt, Human
cagggagaggcugguggaguaa

SEQ ID NO: 599119 - RNA, 22 nt, Human
agcagcucaaagccugcaagga

SEQ ID NO: 599120 - RNA, 20 nt, Human
uggcucucucuaguaagugg

SEQ ID NO: 599121 - RNA, 22 nt, Human
agcaauaacagaaaacuuuccu

SEQ ID NO: 599122 - RNA, 22 nt, Human
uccacugacaggugaauggaua

SEQ ID NO: 599123 - RNA, 19 nt, Human
gguuggagaagagcggccc

SEQ ID NO: 599124 - RNA, 22 nt, Human
uccugguggauagaagccaagg

SEQ ID NO: 599125 - RNA, 22 nt, Human
ucagaugguacuaauuuaagga

SEQ ID NO: 599126 - RNA, 22 nt, Human
agguguguauaaacauacauau

SEQ ID NO: 599127 - RNA, 22 nt, Human
gacacagggggauguguggacg

SEQ ID NO: 599128 - RNA, 22 nt, Human
ucugaagaacugaguaaacaug

SEQ ID NO: 599129 - RNA, 22 nt, Human
auuccuucuuugagaauaagca

SEQ ID NO: 599130 - RNA, 22 nt, Human
gccuuaauugcagagcaauaua

SEQ ID NO: 599131 - RNA, 22 nt, Human
aaggagcuaugcauaacugauc

SEQ ID NO: 599132 - RNA, 22 nt, Human
gggcccagcacuggcugggauc

SEQ ID NO: 599133 - RNA, 22 nt, Human
aaaauccacaacgcucauuuca

SEQ ID NO: 599134 - RNA, 23 nt, Human
cuggggcuuucaaaucugggcag

SEQ ID NO: 599135 - RNA, 22 nt, Human
uagcuuugaccaacgacugguc

SEQ ID NO: 599136 - RNA, 22 nt, Human
guggcugagcagcagagagcug

SEQ ID NO: 599137 - RNA, 22 nt, Human
ugaauucuggcccucucacuua

SEQ ID NO: 599138 - RNA, 22 nt, Human
uuuccuugggucucuuaguggc

SEQ ID NO: 599139 - RNA, 19 nt, Human
uuuugucuucccuuaguuu

SEQ ID NO: 599140 - RNA, 22 nt, Human
aacauuugcagaggaaagcuau

SEQ ID NO: 599141 - RNA, 22 nt, Human
uugggcugaacccugcagcuga

SEQ ID NO: 599142 - RNA, 22 nt, Human
guuaauguuaucugaagacagu

SEQ ID NO: 599143 - RNA, 22 nt, Human
agccagggcugcgagcagacag

SEQ ID NO: 599144 - RNA, 22 nt, Human
auuguuggguaguuuguucagc

SEQ ID NO: 599145 - RNA, 22 nt, Human
uugaggcacagauuuuaguggc

SEQ ID NO: 599146 - RNA, 22 nt, Human
uuuaauucuggcauaauagcuc

SEQ ID NO: 599147 - RNA, 22 nt, Human
aggccagguuccucaaucuuga

SEQ ID NO: 599148 - RNA, 18 nt, Human
aacaguuuccagauucuc

SEQ ID NO: 599149 - RNA, 22 nt, Human
acagugaauaagacaugugcuu

SEQ ID NO: 599150 - RNA, 22 nt, Human
acagaccucuagauuacauuug

SEQ ID NO: 599151 - RNA, 22 nt, Human
aaggcacugaacuuaaauucug

SEQ ID NO: 599152 - RNA, 19 nt, Human
ccuggguccacucagacua

SEQ ID NO: 599153 - RNA, 22 nt, Human
gacaggcugugauggccgggag

SEQ ID NO: 599154 - RNA, 22 nt, Human
uggcugagcugcagcguggcuu

SEQ ID NO: 599155 - RNA, 22 nt, Human
gagucugaggggagagcugggu

SEQ ID NO: 599156 - RNA, 22 nt, Human
acugggcagcagcucgagccgc

SEQ ID NO: 599157 - RNA, 22 nt, Human
gggccuggcaugcagccccguu

SEQ ID NO: 599158 - RNA, 22 nt, Human
gacaggggucccucugggcugu

SEQ ID NO: 599159 - RNA, 22 nt, Human
auuauuugaguuccucucuacc

SEQ ID NO: 599160 - RNA, 22 nt, Human
cuggaacuccuggggagcuggu

SEQ ID NO: 599161 - RNA, 22 nt, Human
ucugcagcgugcaggcuggugc

SEQ ID NO: 599162 - RNA, 22 nt, Human
ggcucacuuuggggucagcugg

SEQ ID NO: 599163 - RNA, 22 nt, Human
ucucuauuaauugacaauggcu

SEQ ID NO: 599164 - RNA, 22 nt, Human
aggcagggcucauuucuuaggc

SEQ ID NO: 599165 - RNA, 22 nt, Human
uacuuaaaaauuaucaaagugg

SEQ ID NO: 599166 - RNA, 22 nt, Human
gcucugggauuaccagccuuag

SEQ ID NO: 599167 - RNA, 22 nt, Human
cucacaguuuucuguaguccaa

SEQ ID NO: 599168 - RNA, 22 nt, Human
gcugagagugggugcagugcuu

SEQ ID NO: 599169 - RNA, 22 nt, Human
gggaaggacacagccaugacug

SEQ ID NO: 599170 - RNA, 22 nt, Human
ugguauaaguaaucauaauugc

SEQ ID NO: 599171 - RNA, 20 nt, Human
uggccaaguauccaacugga

SEQ ID NO: 599172 - RNA, 16 nt, Human
agcagggcgggaagga

SEQ ID NO: 599173 - RNA, 22 nt, Human
cuggccuucagacucggacuga

SEQ ID NO: 599174 - RNA, 22 nt, Human
uauguuauuuucauacaacaga

SEQ ID NO: 599175 - RNA, 21 nt, Human
cuguucacugugcugugcaaa

SEQ ID NO: 599176 - RNA, 22 nt, Human
gaauuuuaaguguucgccucuu

SEQ ID NO: 599177 - RNA, 22 nt, Human
agccaagcacucaacuccugga

SEQ ID NO: 599178 - RNA, 22 nt, Human
auacaucaccuauauauucaca

SEQ ID NO: 599179 - RNA, 22 nt, Human
gcuguauuuauuuucuaggguu

SEQ ID NO: 599180 - RNA, 22 nt, Human
gugaggggaguaaagccauguu

SEQ ID NO: 599181 - RNA, 22 nt, Human
aauucaaucuaagaaaugauca

SEQ ID NO: 599182 - RNA, 22 nt, Human
aaaguauauaugcacuuuagaa

SEQ ID NO: 599183 - RNA, 22 nt, Human
guggcugcugguacucugggaa

SEQ ID NO: 599184 - RNA, 22 nt, Human
cugaaugaaugguuugucuuau

SEQ ID NO: 599185 - RNA, 21 nt, Human
cuuuuacauucagucaugaug

SEQ ID NO: 599186 - RNA, 22 nt, Human
cuggauguucuucugcaauuau

SEQ ID NO: 599187 - RNA, 22 nt, Human
cacaguaagaaaugaagaggua

SEQ ID NO: 599188 - RNA, 23 nt, Human
agaaaaguucauaccuuuuuaac

SEQ ID NO: 599189 - RNA, 22 nt, Human
uugaguguacuuuagucaucug

SEQ ID NO: 599190 - RNA, 22 nt, Human
gaugccugcauuucaggagagu

SEQ ID NO: 599191 - RNA, 22 nt, Human
gcagggcucauugccaggcauu

SEQ ID NO: 599192 - RNA, 22 nt, Human
aagagguaaugacugcuugagu

SEQ ID NO: 599193 - RNA, 22 nt, Human
gaccucuugcacccuggcucuu

SEQ ID NO: 599194 - RNA, 22 nt, Human
ucagggaaaagucacacugggu

SEQ ID NO: 599195 - RNA, 22 nt, Human
ucaacaauaggauauagcaggu

SEQ ID NO: 599196 - RNA, 21 nt, Human
ucaaaucagguaucacuauug

SEQ ID NO: 599197 - RNA, 22 nt, Human
gcccaggaagugacucagaugu

SEQ ID NO: 599198 - RNA, 22 nt, Human
aauguucaguaucugguccacc

SEQ ID NO: 599199 - RNA, 17 nt, Human
ggaguucugcagucagg

SEQ ID NO: 599200 - RNA, 22 nt, Human
cugaggccguuggugggccuua

SEQ ID NO: 599201 - RNA, 22 nt, Human
guccugugaugaguaccaggug

SEQ ID NO: 599202 - RNA, 22 nt, Human
ggugaggaaagauggugacagu

SEQ ID NO: 599203 - RNA, 22 nt, Human
gcccugucccuuggcuucuagg

SEQ ID NO: 599204 - RNA, 21 nt, Human
agagucugcauuucugacaag

SEQ ID NO: 599205 - RNA, 22 nt, Human
cuauuuuucuguacccuaauuu

SEQ ID NO: 599206 - RNA, 22 nt, Human
uagcccagaaagcaaaugucuc

SEQ ID NO: 599207 - RNA, 22 nt, Human
ccugggcuuucaaaaccagccu

SEQ ID NO: 599208 - RNA, 22 nt, Human
gcccaggauucuuucuuccuua

SEQ ID NO: 599209 - RNA, 22 nt, Human
ucugaauguaucgaauugaggc

SEQ ID NO: 599210 - RNA, 22 nt, Human
cagcagagcugugugggaaggg

SEQ ID NO: 599211 - RNA, 22 nt, Human
ccugcuucagggaugauggcac

SEQ ID NO: 599212 - RNA, 22 nt, Human
gccaaagcagucuugccucugc

SEQ ID NO: 599213 - RNA, 22 nt, Human
agcucuaaauggaauuuugccu

SEQ ID NO: 599214 - RNA, 22 nt, Human
guaaauauucccucgguuccua

SEQ ID NO: 599215 - RNA, 17 nt, Human
cagagucugucugcauc

SEQ ID NO: 599216 - RNA, 22 nt, Human
uaucucuugcaugcuuuuuaga

SEQ ID NO: 599217 - RNA, 22 nt, Human
aagaggcuuucagugaacuugu

SEQ ID NO: 599218 - RNA, 22 nt, Human
cucuuaaaauuaccuuugcaaa

SEQ ID NO: 599219 - RNA, 22 nt, Human
aggcuagacuuuggcgaagcac

SEQ ID NO: 599220 - RNA, 22 nt, Human
uugugucccccuuugagagcca

SEQ ID NO: 599221 - RNA, 22 nt, Human
gcaggagccaggccgagcuggu

SEQ ID NO: 599222 - RNA, 22 nt, Human
gagcuggugugugcccgagcac

SEQ ID NO: 599223 - RNA, 22 nt, Human
uuucuuuaucauagcaucuuug

SEQ ID NO: 599224 - RNA, 22 nt, Human
aggguggcaguuacuggagcaa

SEQ ID NO: 599225 - RNA, 22 nt, Human
uuuuuccuuggaugugucucuc

SEQ ID NO: 599226 - RNA, 22 nt, Human
ggaggugggcuaaggacucucu

SEQ ID NO: 599227 - RNA, 22 nt, Human
uauuagcuucugguuuuguucu

SEQ ID NO: 599228 - RNA, 22 nt, Human
uuuauaauuaucucuacucuua

SEQ ID NO: 599229 - RNA, 22 nt, Human
ccaguguuggaggauggcuugc

SEQ ID NO: 599230 - RNA, 22 nt, Human
aaaaucacacaaguagaugggg

SEQ ID NO: 599231 - RNA, 20 nt, Human
uggcccagcacgacgaggac

SEQ ID NO: 599232 - RNA, 22 nt, Human
agacuaaauaaugauuuacugg

SEQ ID NO: 599233 - RNA, 21 nt, Human
aggcaggauucaaacacagag

SEQ ID NO: 599234 - RNA, 22 nt, Human
gugggggaugcugaguuggaaa

SEQ ID NO: 599235 - RNA, 20 nt, Human
caauuucaucauuuccugug

SEQ ID NO: 599236 - RNA, 21 nt, Human
gccagccuguuuaccuguggu

SEQ ID NO: 599237 - RNA, 22 nt, Human
gccaggcuggucuugaacuccu

SEQ ID NO: 599238 - RNA, 22 nt, Human
ggcagcugugaagugccucaca

SEQ ID NO: 599239 - RNA, 23 nt, Human
ccagggagguugauugguuaccc

SEQ ID NO: 599240 - RNA, 22 nt, Human
gcugcuguguuggccacugcuu

SEQ ID NO: 599241 - RNA, 19 nt, Human
gcugcagaguauucuuggg

SEQ ID NO: 599242 - RNA, 22 nt, Human
acccuuugucaagcacagaaga

SEQ ID NO: 599243 - RNA, 22 nt, Human
uaggccacucuccuuugucuca

SEQ ID NO: 599244 - RNA, 22 nt, Human
acugggcaccaucaugagaugg

SEQ ID NO: 599245 - RNA, 20 nt, Human
auguauauuacuggcuguga

SEQ ID NO: 599246 - RNA, 22 nt, Human
uugcugaaguuaaugcuugcaa

SEQ ID NO: 599247 - RNA, 22 nt, Human
gcagcuggcccugacacgcaga

SEQ ID NO: 599248 - RNA, 22 nt, Human
cacagcuggugcacuagcucug

SEQ ID NO: 599249 - RNA, 22 nt, Human
cagcucaggcucuccaugcucc

SEQ ID NO: 599250 - RNA, 22 nt, Human
gcuggagggguaauaggauggg

SEQ ID NO: 599251 - RNA, 22 nt, Human
guaauaagaaacagcaauuauu

SEQ ID NO: 599252 - RNA, 22 nt, Human
ugggccagggcacccaguccag

SEQ ID NO: 599253 - RNA, 22 nt, Human
aggcuggugccugcagugaauc

SEQ ID NO: 599254 - RNA, 20 nt, Human
gaguccaggggccuguagca

SEQ ID NO: 599255 - RNA, 22 nt, Human
cacccaggcuagagugcagugg

SEQ ID NO: 599256 - RNA, 22 nt, Human
uggcagagcaaaaagauagaau

SEQ ID NO: 599257 - RNA, 22 nt, Human
uuucaauuccaccaaagcgccc

SEQ ID NO: 599258 - RNA, 22 nt, Human
uugagaaugaugagauucuucc

SEQ ID NO: 599259 - RNA, 23 nt, Human
ucuuuccucagcacacaccaaga

SEQ ID NO: 599260 - RNA, 22 nt, Human
uuuaacuuagaagagauauccu

SEQ ID NO: 599261 - RNA, 22 nt, Human
gggcucugguacuuccuggcuc

SEQ ID NO: 599262 - RNA, 22 nt, Human
cccagcaucccagugggcagca

SEQ ID NO: 599263 - RNA, 22 nt, Human
uacgcgaagaaggaccugaugg

SEQ ID NO: 599264 - RNA, 22 nt, Human
uggccacauccuuuccuuguca

SEQ ID NO: 599265 - RNA, 22 nt, Human
gaaaacuauuggccuagaacaa

SEQ ID NO: 599266 - RNA, 17 nt, Human
agcugaaauugcugaag

SEQ ID NO: 599267 - RNA, 22 nt, Human
agauguaagaccuucaugaggg

SEQ ID NO: 599268 - RNA, 22 nt, Human
aauugaacaaguaauagaagag

SEQ ID NO: 599269 - RNA, 22 nt, Human
acccaggaggcaagguugcagu

SEQ ID NO: 599270 - RNA, 22 nt, Human
acaaauuugaauccugacuucu

SEQ ID NO: 599271 - RNA, 22 nt, Human
aaaggcacugaucuuauccagu

SEQ ID NO: 599272 - RNA, 19 nt, Human
ugcagggcugcgccugggg

SEQ ID NO: 599273 - RNA, 22 nt, Human
uuccaucugcuagguaaaugaa

SEQ ID NO: 599274 - RNA, 22 nt, Human
uggaggcugugugcaugagacc

SEQ ID NO: 599275 - RNA, 22 nt, Human
agcucuggggccugucccacau

SEQ ID NO: 599276 - RNA, 22 nt, Human
uuuuucaugagacuagaaguca

SEQ ID NO: 599277 - RNA, 22 nt, Human
ucucugugaauggcgucaccug

SEQ ID NO: 599278 - RNA, 21 nt, Human
acagcagacaggcuuaggacc

SEQ ID NO: 599279 - RNA, 22 nt, Human
cuacaaauauaaaacacagaua

SEQ ID NO: 599280 - RNA, 23 nt, Human
ugccucaguggaaugugagggug

SEQ ID NO: 599281 - RNA, 22 nt, Human
agucaggagcugcugcauugua

SEQ ID NO: 599282 - RNA, 22 nt, Human
gggcuggaccgcgaccccugag

SEQ ID NO: 599283 - RNA, 22 nt, Human
ugcagcugaaccuagagucugu

SEQ ID NO: 599284 - RNA, 22 nt, Human
cggcuggugucgggcacagcaa

SEQ ID NO: 599285 - RNA, 22 nt, Human
gaagauacacagagcugucuuu

SEQ ID NO: 599286 - RNA, 22 nt, Human
ggagaaggguauguguggcgga

SEQ ID NO: 599287 - RNA, 22 nt, Human
gagcagugacuggagcaugaga

SEQ ID NO: 599288 - RNA, 22 nt, Human
uccagcccgggggcaggugacc

SEQ ID NO: 599289 - RNA, 22 nt, Human
uuguccaaggucccacaguuag

SEQ ID NO: 599290 - RNA, 22 nt, Human
auugugcagcacagaucaugac

SEQ ID NO: 599291 - RNA, 22 nt, Human
cagaaggcauagaugaaggccu

SEQ ID NO: 599292 - RNA, 19 nt, Human
uggcagacacaccuucuuc

SEQ ID NO: 599293 - RNA, 19 nt, Human
uggaacaaacugcaaugac

SEQ ID NO: 599294 - RNA, 20 nt, Human
accucccucuguggguggga

SEQ ID NO: 599295 - RNA, 19 nt, Human
ccuggcccugcugcgcggg

SEQ ID NO: 599296 - RNA, 22 nt, Human
acacagaugcuauuuagucucu

SEQ ID NO: 599297 - RNA, 22 nt, Human
uugaucuugugauaguucaacu

SEQ ID NO: 599298 - RNA, 22 nt, Human
aggaagagcauucacaugguag

SEQ ID NO: 599299 - RNA, 22 nt, Human
uagaaacaagggagaggauucu

SEQ ID NO: 599300 - RNA, 22 nt, Human
ccugggcucaagcgaucuuguc

SEQ ID NO: 599301 - RNA, 22 nt, Human
cugagcugggcucucuugaggg

SEQ ID NO: 599302 - RNA, 22 nt, Human
ucacagaauuuuugcuuccagu

SEQ ID NO: 599303 - RNA, 22 nt, Human
ucugaggaagcagcaggaagug

SEQ ID NO: 599304 - RNA, 22 nt, Human
agccaaggcagcuagagcucug

SEQ ID NO: 599305 - RNA, 22 nt, Human
acccuuuagaaggcaucucagu

SEQ ID NO: 599306 - RNA, 22 nt, Human
ugcacgugugagcauucacaug

SEQ ID NO: 599307 - RNA, 22 nt, Human
acaggcuuacaggcugcaagua

SEQ ID NO: 599308 - RNA, 22 nt, Human
cacccucccgucagccccuggg

SEQ ID NO: 599309 - RNA, 18 nt, Human
aggccacacuccagaaca

SEQ ID NO: 599310 - RNA, 23 nt, Human
aauuggacuugcugucaaacuuc

SEQ ID NO: 599311 - RNA, 22 nt, Human
ugcagcucauugcuggggucug

SEQ ID NO: 599312 - RNA, 22 nt, Human
agucccagcuucccccaugcag

SEQ ID NO: 599313 - RNA, 22 nt, Human
cuucaagauauuucuagaauca

SEQ ID NO: 599314 - RNA, 22 nt, Human
uucuucaaccaucuacauaaac

SEQ ID NO: 599315 - RNA, 22 nt, Human
cagccagcugaauguaccauga

SEQ ID NO: 599316 - RNA, 22 nt, Human
agauacauuguucuaagcauug

SEQ ID NO: 599317 - RNA, 22 nt, Human
agcuuuauauuuaaugaauucu

SEQ ID NO: 599318 - RNA, 23 nt, Human
aaauaggaguaucuggaucauga

SEQ ID NO: 599319 - RNA, 22 nt, Human
acuucauugcuaagaacaaggu

SEQ ID NO: 599320 - RNA, 22 nt, Human
gugcaaugugcuucgugccaug

SEQ ID NO: 599321 - RNA, 22 nt, Human
uauucacagcugccgcacucag

SEQ ID NO: 599322 - RNA, 22 nt, Human
ugaugggaaaaugaggccuggg

SEQ ID NO: 599323 - RNA, 22 nt, Human
caguccuuauuccuauauuccu

SEQ ID NO: 599324 - RNA, 20 nt, Human
cccuaggaacgcagcaggag

SEQ ID NO: 599325 - RNA, 22 nt, Human
ugagggcagagcacuggggagc

SEQ ID NO: 599326 - RNA, 22 nt, Human
uguccuuguuccuaauguaaaa

SEQ ID NO: 599327 - RNA, 22 nt, Human
cacuguacugugaauaaggagg

SEQ ID NO: 599328 - RNA, 22 nt, Human
ggguggccuucauagcucaggg

SEQ ID NO: 599329 - RNA, 22 nt, Human
guuagcauuuguuuaauaucag

SEQ ID NO: 599330 - RNA, 22 nt, Human
gugaagcauaugcuucucugcc

SEQ ID NO: 599331 - RNA, 22 nt, Human
cacuuuguuuauugugcaguua

SEQ ID NO: 599332 - RNA, 22 nt, Human
gcugagcucccagcaguaucug

SEQ ID NO: 599333 - RNA, 22 nt, Human
agcuucuucuauuuuggggcca

SEQ ID NO: 599334 - RNA, 22 nt, Human
ucacagagaaaagcuaucacaa

SEQ ID NO: 599335 - RNA, 22 nt, Human
uguuuucugauucucguguggu

SEQ ID NO: 599336 - RNA, 22 nt, Human
cugcugaggcuccggaccaagu

SEQ ID NO: 599337 - RNA, 22 nt, Human
aagagacuauggugucuaugaa

SEQ ID NO: 599338 - RNA, 22 nt, Human
augcaaaauaaggcagaaacau

SEQ ID NO: 599339 - RNA, 22 nt, Human
aacauuucuucugaaacugagu

SEQ ID NO: 599340 - RNA, 22 nt, Human
auaugcuugacucuuucacauc

SEQ ID NO: 599341 - RNA, 22 nt, Human
cuuuccuaguaguuacagaaug

SEQ ID NO: 599342 - RNA, 22 nt, Human
cacaugaaggcuggggucguga

SEQ ID NO: 599343 - RNA, 22 nt, Human
ucugcaggugggccccuagaau

SEQ ID NO: 599344 - RNA, 22 nt, Human
cugcccaggggagugcugucgg

SEQ ID NO: 599345 - RNA, 22 nt, Human
aggaggcugguucaggccauau

SEQ ID NO: 599346 - RNA, 22 nt, Human
agaauaaauguuggacuuagga

SEQ ID NO: 599347 - RNA, 22 nt, Human
uagaagaaaagcacuuagagau

SEQ ID NO: 599348 - RNA, 19 nt, Human
uggaggccucaggaaaaga

SEQ ID NO: 599349 - RNA, 22 nt, Human
uaaugcauguaaugggcugaua

SEQ ID NO: 599350 - RNA, 22 nt, Human
cccaggccagaacuugguugcu

SEQ ID NO: 599351 - RNA, 22 nt, Human
ucccaggauguuggcggcaggu

SEQ ID NO: 599352 - RNA, 22 nt, Human
guuagagggcugccuuuuguuu

SEQ ID NO: 599353 - RNA, 22 nt, Human
aggaauguuuagaaugucagaa

SEQ ID NO: 599354 - RNA, 22 nt, Human
ucuccaggccuuucccaucuua

SEQ ID NO: 599355 - RNA, 22 nt, Human
ucaaguauuuauuucugcuggc

SEQ ID NO: 599356 - RNA, 22 nt, Human
uggcugcugcagacagacagga

SEQ ID NO: 599357 - RNA, 22 nt, Human
ucugauaagugguguauacugu

SEQ ID NO: 599358 - RNA, 22 nt, Human
uaaaguguuguacaaauguaug

SEQ ID NO: 599359 - RNA, 22 nt, Human
aacccauguuggaagcuuauca

SEQ ID NO: 599360 - RNA, 22 nt, Human
acagguggcuuauuggcugauu

SEQ ID NO: 599361 - RNA, 22 nt, Human
uggagcagaggcugagguuggg

SEQ ID NO: 599362 - RNA, 22 nt, Human
aaucacauuaagcccuguucag

SEQ ID NO: 599363 - RNA, 22 nt, Human
auggaaagugcauggaagucau

SEQ ID NO: 599364 - RNA, 22 nt, Human
uuguuuaauaucgugaaguacu

SEQ ID NO: 599365 - RNA, 22 nt, Human
cacuguacagcauuaacaaggc

SEQ ID NO: 599366 - RNA, 22 nt, Human
gcccccagagaaugagguacga

SEQ ID NO: 599367 - RNA, 23 nt, Human
ugggagcucaagggaggcugccc

SEQ ID NO: 599368 - RNA, 22 nt, Human
ugaacgcagguccacauggcuc

SEQ ID NO: 599369 - RNA, 22 nt, Human
ggagcacagccuugccaguacc

SEQ ID NO: 599370 - RNA, 19 nt, Human
aucuacaauuauucucagu

SEQ ID NO: 599371 - RNA, 22 nt, Human
ggguccagcuacaucagggugg

SEQ ID NO: 599372 - RNA, 22 nt, Human
gcugcucugugacagccuccgg

SEQ ID NO: 599373 - RNA, 22 nt, Human
uggucagcuucagaguguucca

SEQ ID NO: 599374 - RNA, 22 nt, Human
agcaacagcccugagguucaug

SEQ ID NO: 599375 - RNA, 22 nt, Human
acaaagcuagagaagagaauug

SEQ ID NO: 599376 - RNA, 22 nt, Human
auaccugaucaaggcaaaaaug

SEQ ID NO: 599377 - RNA, 22 nt, Human
agaggggcaaguaaagagucuu

SEQ ID NO: 599378 - RNA, 22 nt, Human
ggcuuucaacacaggcuuuccu

SEQ ID NO: 599379 - RNA, 22 nt, Human
uaaggccaauuacauauguuca

SEQ ID NO: 599380 - RNA, 22 nt, Human
uaagccacuagucuguuaugaa

SEQ ID NO: 599381 - RNA, 22 nt, Human
acagacauucagcuaagucuau

SEQ ID NO: 599382 - RNA, 22 nt, Human
cuccagagagaaaggaggccgc

SEQ ID NO: 599383 - RNA, 22 nt, Human
cagugccucuuaagugucaccc

SEQ ID NO: 599384 - RNA, 22 nt, Human
ugaggcucaagaaagauuuguu

SEQ ID NO: 599385 - RNA, 22 nt, Human
uugaaagacauuauuuauauau

SEQ ID NO: 599386 - RNA, 17 nt, Human
caggucugaggccaggc

SEQ ID NO: 599387 - RNA, 22 nt, Human
gcagcugcaagcacuucuggca

SEQ ID NO: 599388 - RNA, 22 nt, Human
uauacagauggaaagauacaca

SEQ ID NO: 599389 - RNA, 22 nt, Human
gguccaggaucaaggcaucacc

SEQ ID NO: 599390 - RNA, 22 nt, Human
acugucaugaucgaagauguca

SEQ ID NO: 599391 - RNA, 22 nt, Human
acagccuuggguucucuggggg

SEQ ID NO: 599392 - RNA, 22 nt, Human
uggaaagggacuuaugaguucc

SEQ ID NO: 599393 - RNA, 22 nt, Human
ugaggccucauuuagggagagg

SEQ ID NO: 599394 - RNA, 22 nt, Human
acaacacagcaaaaccccaucu

SEQ ID NO: 599395 - RNA, 22 nt, Human
augcuugaaaaccccaugaaua

SEQ ID NO: 599396 - RNA, 22 nt, Human
aguaaugcuucuagaacuauuu

SEQ ID NO: 599397 - RNA, 22 nt, Human
gcagugcuugaagagguggcca

SEQ ID NO: 599398 - RNA, 22 nt, Human
aggaaacaguugguaaugcaua

SEQ ID NO: 599399 - RNA, 22 nt, Human
cugcagucugacauacgaggac

SEQ ID NO: 599400 - RNA, 22 nt, Human
agcugcagcuuccuaguccagc

SEQ ID NO: 599401 - RNA, 22 nt, Human
gguccuggaaauugacggaaag

SEQ ID NO: 599402 - RNA, 22 nt, Human
aaagugggaacaauggagagug

SEQ ID NO: 599403 - RNA, 22 nt, Human
ccugaggcuggcccuuccaucc

SEQ ID NO: 599404 - RNA, 22 nt, Human
cuacacuuguucgacugcagga

SEQ ID NO: 599405 - RNA, 22 nt, Human
aaaugcugcagcuaguguguuu

SEQ ID NO: 599406 - RNA, 22 nt, Human
agcaacuucuacagauauagca

SEQ ID NO: 599407 - RNA, 22 nt, Human
ugaggacaaucccuaacucaga

SEQ ID NO: 599408 - RNA, 22 nt, Human
uaaugugugucaucaguagagu

SEQ ID NO: 599409 - RNA, 22 nt, Human
cagcccuccuuucacucccagg

SEQ ID NO: 599410 - RNA, 22 nt, Human
ggagaugcuauguaguuugguu

SEQ ID NO: 599411 - RNA, 22 nt, Human
gcugaagagcaaggcugggucu

SEQ ID NO: 599412 - RNA, 22 nt, Human
uagccauugacuuaaagcuuau

SEQ ID NO: 599413 - RNA, 19 nt, Human
ugcugaggaugcaagaucc

SEQ ID NO: 599414 - RNA, 19 nt, Human
uaauaagcaauauggaagu

SEQ ID NO: 599415 - RNA, 22 nt, Human
ccugcucuuauagcuguuucca

SEQ ID NO: 599416 - RNA, 22 nt, Human
cacagccuuacugagauccacu

SEQ ID NO: 599417 - RNA, 19 nt, Human
ucugagguggaacuggggg

SEQ ID NO: 599418 - RNA, 22 nt, Human
agcagagaccauauagcccaga

SEQ ID NO: 599419 - RNA, 22 nt, Human
acugggcaucccauggcagagc

SEQ ID NO: 599420 - RNA, 22 nt, Human
uagcaguguugccguuggcugc

SEQ ID NO: 599421 - RNA, 22 nt, Human
augagaaagaguuguaucuaga

SEQ ID NO: 599422 - RNA, 23 nt, Human
ucugaccauuugacaacauccug

SEQ ID NO: 599423 - RNA, 22 nt, Human
cuuagaauuuugccuacuacaa

SEQ ID NO: 599424 - RNA, 22 nt, Human
cuccagucuaguagagccugcu

SEQ ID NO: 599425 - RNA, 22 nt, Human
uucucugugagggugcuggauu

SEQ ID NO: 599426 - RNA, 22 nt, Human
ccuuucucauuuuaagcauuag

SEQ ID NO: 599427 - RNA, 18 nt, Human
aacaugcauuagaacugc

SEQ ID NO: 599428 - RNA, 22 nt, Human
ugaaauauuuagagaguaaguu

SEQ ID NO: 599429 - RNA, 21 nt, Human
cccaagggaggcaggauaagg

SEQ ID NO: 599430 - RNA, 22 nt, Human
agccaugcaccuuacucuugcu

SEQ ID NO: 599431 - RNA, 23 nt, Human
ggguccagccaauuccaaggaaa

SEQ ID NO: 599432 - RNA, 22 nt, Human
gcuuacaaggguaggaagucua

SEQ ID NO: 599433 - RNA, 20 nt, Human
cuuagcuucuaagguucugg

SEQ ID NO: 599434 - RNA, 21 nt, Human
acagacagggccagugucccc

SEQ ID NO: 599435 - RNA, 22 nt, Human
guaguucugcagugucaccuga

SEQ ID NO: 599436 - RNA, 22 nt, Human
uggguaggggacguggaagaaa

SEQ ID NO: 599437 - RNA, 22 nt, Human
guacauauuaaaggucuauaaa

SEQ ID NO: 599438 - RNA, 22 nt, Human
ggucucagguagggccuaggaa

SEQ ID NO: 599439 - RNA, 22 nt, Human
uuuuucuggauaacuguaucuc

SEQ ID NO: 599440 - RNA, 22 nt, Human
ugggcagcagcaaagccagacu

SEQ ID NO: 599441 - RNA, 22 nt, Human
uguccccugcccagggauggga

SEQ ID NO: 599442 - RNA, 22 nt, Human
gugucccaaagauuagaaauca

SEQ ID NO: 599443 - RNA, 20 nt, Human
gcaauguugguuccugucac

SEQ ID NO: 599444 - RNA, 22 nt, Human
ugcugaggucacggcggccaga

SEQ ID NO: 599445 - RNA, 21 nt, Human
agugugugauaggcaggaaga

SEQ ID NO: 599446 - RNA, 22 nt, Human
agauacacagagguaaagauga

SEQ ID NO: 599447 - RNA, 22 nt, Human
ccuaggcuaauucaguccagua

SEQ ID NO: 599448 - RNA, 22 nt, Human
aagugaaacauguaucucuuua

SEQ ID NO: 599449 - RNA, 22 nt, Human
uauuuuaucugccagaguggag

SEQ ID NO: 599450 - RNA, 22 nt, Human
acucugaggagugacuagaggu

SEQ ID NO: 599451 - RNA, 22 nt, Human
aaacuucagugaaugacuuaug

SEQ ID NO: 599452 - RNA, 22 nt, Human
auucugaucauucaagauguca

SEQ ID NO: 599453 - RNA, 22 nt, Human
ggccucagaggaggugugaguc

SEQ ID NO: 599454 - RNA, 22 nt, Human
cugagcuggucuauggacuugg

SEQ ID NO: 599455 - RNA, 22 nt, Human
agagggaaauccaggagugcuu

SEQ ID NO: 599456 - RNA, 22 nt, Human
ugggguagggaaaagaagucga

SEQ ID NO: 599457 - RNA, 22 nt, Human
acagcuguauccccagagcuca

SEQ ID NO: 599458 - RNA, 22 nt, Human
gagggccuggcacagggaggcu

SEQ ID NO: 599459 - RNA, 22 nt, Human
ugaaggugagcauuugcugauu

SEQ ID NO: 599460 - RNA, 22 nt, Human
ggaguggcagagaggguauacu

SEQ ID NO: 599461 - RNA, 22 nt, Human
gaagucagucaucuccugucuc

SEQ ID NO: 599462 - RNA, 22 nt, Human
uuuaagacucuuguaguacaca

SEQ ID NO: 599463 - RNA, 22 nt, Human
uaacuguugugcgggucucugg

SEQ ID NO: 599464 - RNA, 22 nt, Human
guguuugugagcuaggugacau

SEQ ID NO: 599465 - RNA, 22 nt, Human
aggcuuuguaccuggggucuua

SEQ ID NO: 599466 - RNA, 22 nt, Human
aggcucuggcaacagcuggugu

SEQ ID NO: 599467 - RNA, 22 nt, Human
ugggagcaaaugacugggagau

SEQ ID NO: 599468 - RNA, 22 nt, Human
uucaggaaucaaccaagucauu

SEQ ID NO: 599469 - RNA, 22 nt, Human
cacuguacccauuuaaauaaau

SEQ ID NO: 599470 - RNA, 22 nt, Human
accuuucaaaguggcuaucacu

SEQ ID NO: 599471 - RNA, 22 nt, Human
cagcuucuguuuauugugugcc

SEQ ID NO: 599472 - RNA, 22 nt, Human
gucuccagagguuacauccugu

SEQ ID NO: 599473 - RNA, 22 nt, Human
cagucaggaaugccuccuuccu

SEQ ID NO: 599474 - RNA, 22 nt, Human
cggggccuagcugcacacccuc

SEQ ID NO: 599475 - RNA, 17 nt, Human
gcucuggcacaggauug

SEQ ID NO: 599476 - RNA, 23 nt, Human
ugagaagccauuagagcaggugg

SEQ ID NO: 599477 - RNA, 19 nt, Human
agacucugugugagacuuu

SEQ ID NO: 599478 - RNA, 22 nt, Human
uggcccuguccucauuucaucu

SEQ ID NO: 599479 - RNA, 22 nt, Human
ccugggucacucaggcaggcgg

SEQ ID NO: 599480 - RNA, 22 nt, Human
acaguuuagaaugccacauagu

SEQ ID NO: 599481 - RNA, 22 nt, Human
gaugggcugucugagcgcugug

SEQ ID NO: 599482 - RNA, 22 nt, Human
gcugggcagcaggcucuccggg

SEQ ID NO: 599483 - RNA, 22 nt, Human
ugggacugcucuugcugggguc

SEQ ID NO: 599484 - RNA, 22 nt, Human
uuccaaagcugcuuuauuuagu

SEQ ID NO: 599485 - RNA, 22 nt, Human
aggaucauauaagcuccagcua

SEQ ID NO: 599486 - RNA, 22 nt, Human
uccugccuagcaggugaccuau

SEQ ID NO: 599487 - RNA, 22 nt, Human
uucuucuuuccuauaauuaauu

SEQ ID NO: 599488 - RNA, 22 nt, Human
uggccuugauaacuggggagag

SEQ ID NO: 599489 - RNA, 22 nt, Human
agaaaccuccauuuauucacuc

SEQ ID NO: 599490 - RNA, 22 nt, Human
augaaaacuuuagccucauuag

SEQ ID NO: 599491 - RNA, 22 nt, Human
uacauacagccaaguaugaagu

SEQ ID NO: 599492 - RNA, 22 nt, Human
auuaaauuaaguggcuaauuua

SEQ ID NO: 599493 - RNA, 22 nt, Human
agcacagaugugaguggaggcu

SEQ ID NO: 599494 - RNA, 22 nt, Human
uacacuguagguggcaggcagc

SEQ ID NO: 599495 - RNA, 22 nt, Human
ggggugggguuacucauugugc

SEQ ID NO: 599496 - RNA, 22 nt, Human
uggucccugaucuaaugucuca

SEQ ID NO: 599497 - RNA, 20 nt, Human
cugagcgucuaagaggugag

SEQ ID NO: 599498 - RNA, 18 nt, Human
gcauuuuaaucugaggca

SEQ ID NO: 599499 - RNA, 22 nt, Human
ugggagaaacugucucucccac

SEQ ID NO: 599500 - RNA, 22 nt, Human
aaggcagagggcuggaucagag

SEQ ID NO: 599501 - RNA, 22 nt, Human
gauacacauuuuagcuuugucu

SEQ ID NO: 599502 - RNA, 17 nt, Human
cuggagcuguguaaccu

SEQ ID NO: 599503 - RNA, 22 nt, Human
gcugauaaauaguugauguacc

SEQ ID NO: 599504 - RNA, 22 nt, Human
aggcaggugggagugauuccuu

SEQ ID NO: 599505 - RNA, 22 nt, Human
aguuuucugggaucacuggaau

SEQ ID NO: 599506 - RNA, 22 nt, Human
cagcagugcuucagugugagau

SEQ ID NO: 599507 - RNA, 22 nt, Human
cugcugcugcuaucuacccagg

SEQ ID NO: 599508 - RNA, 22 nt, Human
uguguucuaugguucagggugg

SEQ ID NO: 599509 - RNA, 22 nt, Human
ggcagcagggucuagauugaug

SEQ ID NO: 599510 - RNA, 19 nt, Human
uugagaauuaucugaguca

SEQ ID NO: 599511 - RNA, 22 nt, Human
agagcacaggugcuggagccca

SEQ ID NO: 599512 - RNA, 22 nt, Human
agagcuggggcauaaaugccac

SEQ ID NO: 599513 - RNA, 22 nt, Human
cuuucagggcaacacuucuuuu

SEQ ID NO: 599514 - RNA, 22 nt, Human
cauuacuucucaugcuucaugc

SEQ ID NO: 599515 - RNA, 22 nt, Human
ucugaaauaggcuucuuuuggu

SEQ ID NO: 599516 - RNA, 22 nt, Human
uaacagcaggguuacaggcauu

SEQ ID NO: 599517 - RNA, 22 nt, Human
aaauucagcauccugcacugga

SEQ ID NO: 599518 - RNA, 22 nt, Human
uauggaaagcucuuuuugauug

SEQ ID NO: 599519 - RNA, 20 nt, Human
uucaaaguguaugauaugca

SEQ ID NO: 599520 - RNA, 22 nt, Human
aaacacuuccuguaacaugaca

SEQ ID NO: 599521 - RNA, 22 nt, Human
auuguauaauuguauugccaaa

SEQ ID NO: 599522 - RNA, 22 nt, Human
aagcugccugggaggaagggcu

SEQ ID NO: 599523 - RNA, 22 nt, Human
uauaagaagugaagaagaguua

SEQ ID NO: 599524 - RNA, 22 nt, Human
uucagaggguuuuagggucaga

SEQ ID NO: 599525 - RNA, 22 nt, Human
cccccagaugcgagccauagcc

SEQ ID NO: 599526 - RNA, 22 nt, Human
ccaggcccaggguacugaccaa

SEQ ID NO: 599527 - RNA, 22 nt, Human
uggaagcggacguuguggggug

SEQ ID NO: 599528 - RNA, 22 nt, Human
uacugaauggggcaguaagaaa

SEQ ID NO: 599529 - RNA, 22 nt, Human
aucauuuaaaacaagucucuau

SEQ ID NO: 599530 - RNA, 22 nt, Human
ugucuucaucucagacacaguu

SEQ ID NO: 599531 - RNA, 22 nt, Human
gcuggggcugggcugaggaaga

SEQ ID NO: 599532 - RNA, 22 nt, Human
uccauacccagcuuucucacac

SEQ ID NO: 599533 - RNA, 22 nt, Human
uucucuggccugaggcgaggcc

SEQ ID NO: 599534 - RNA, 22 nt, Human
cccugaggagagcgcuucccga

SEQ ID NO: 599535 - RNA, 22 nt, Human
acagacaaguaguucagacaag

SEQ ID NO: 599536 - RNA, 22 nt, Human
ccuccucuggugcugccaaccc

SEQ ID NO: 599537 - RNA, 22 nt, Human
cagacuuucuggaagcuaaaaa

SEQ ID NO: 599538 - RNA, 22 nt, Human
uucagaaaaagaccauugcaau

SEQ ID NO: 599539 - RNA, 22 nt, Human
gcccagggcugcaaguggacgc

SEQ ID NO: 599540 - RNA, 22 nt, Human
ugacauuuacuauuccugguua

SEQ ID NO: 599541 - RNA, 21 nt, Human
cagcuuugucugucuucgggg

SEQ ID NO: 599542 - RNA, 22 nt, Human
aggggagguggcagaaaugugc

SEQ ID NO: 599543 - RNA, 22 nt, Human
uuccuaugaauaaauauugagc

SEQ ID NO: 599544 - RNA, 21 nt, Human
acaguaaauucccugcaaaga

SEQ ID NO: 599545 - RNA, 22 nt, Human
ccugccucaggacucugcauau

SEQ ID NO: 599546 - RNA, 22 nt, Human
gcuggguauuuuaagaaaggaa

SEQ ID NO: 599547 - RNA, 20 nt, Human
uucuuucaucuacacguugu

SEQ ID NO: 599548 - RNA, 22 nt, Human
uaggcacaagaccaugcaaagg

SEQ ID NO: 599549 - RNA, 22 nt, Human
acugucaccuaaauuuucauug

SEQ ID NO: 599550 - RNA, 22 nt, Human
cagagagagucaaaucuuugcu

SEQ ID NO: 599551 - RNA, 21 nt, Human
gucuuucuaccucuauguggc

SEQ ID NO: 599552 - RNA, 22 nt, Human
acacuggguuaccuguacuauu

SEQ ID NO: 599553 - RNA, 22 nt, Human
aaaaacugcaauuacuuuuguc

SEQ ID NO: 599554 - RNA, 22 nt, Human
uccaagaguucaaggcuacagu

SEQ ID NO: 599555 - RNA, 22 nt, Human
guucaaaucucaggacuucaga

SEQ ID NO: 599556 - RNA, 22 nt, Human
augcgagugaugcagaguggcu

SEQ ID NO: 599557 - RNA, 22 nt, Human
acauuucagauguaaugugaug

SEQ ID NO: 599558 - RNA, 22 nt, Human
aaguuucaugacuugguuauua

SEQ ID NO: 599559 - RNA, 21 nt, Human
ggcagaaguagcauggacggg

SEQ ID NO: 599560 - RNA, 22 nt, Human
aggcccugggcaguucuguagc

SEQ ID NO: 599561 - RNA, 22 nt, Human
cagaaacacuguauuuagggaa

SEQ ID NO: 599562 - RNA, 20 nt, Human
caguugaaauaauuuguuug

SEQ ID NO: 599563 - RNA, 22 nt, Human
guggucagcagcagugggagug

SEQ ID NO: 599564 - RNA, 20 nt, Human
ucaggcuggugggcuuuccc

SEQ ID NO: 599565 - RNA, 22 nt, Human
ggaugcugucuaagcugaggac

SEQ ID NO: 599566 - RNA, 22 nt, Human
aucagaagugauguguguuauu

SEQ ID NO: 599567 - RNA, 22 nt, Human
ccacagccauuccagggaggcu

SEQ ID NO: 599568 - RNA, 22 nt, Human
uauuugauagagauaaaugaua

SEQ ID NO: 599569 - RNA, 22 nt, Human
agggccugugcugaguagacga

SEQ ID NO: 599570 - RNA, 22 nt, Human
auaauaaugaaagccacugugu

SEQ ID NO: 599571 - RNA, 22 nt, Human
acuguauuccuacuagaaucua

SEQ ID NO: 599572 - RNA, 22 nt, Human
ucccuccuggugaugaugcaaa

SEQ ID NO: 599573 - RNA, 22 nt, Human
gguguugggcucacugguccuu

SEQ ID NO: 599574 - RNA, 20 nt, Human
ucugaacaaaauguaauguc

SEQ ID NO: 599575 - RNA, 22 nt, Human
ccucaggcuucgucuuccaccc

SEQ ID NO: 599576 - RNA, 22 nt, Human
aaugcauaaugguuugugacaa

SEQ ID NO: 599577 - RNA, 22 nt, Human
ucccucucuagccuguucagua

SEQ ID NO: 599578 - RNA, 22 nt, Human
aauguguagcauuuaaugcagu

SEQ ID NO: 599579 - RNA, 22 nt, Human
gcuggugcauuagcugcaguuc

SEQ ID NO: 599580 - RNA, 22 nt, Human
ccugccagugccucccacuggu

SEQ ID NO: 599581 - RNA, 22 nt, Human
gcauuuuucuaaucauuggcau

SEQ ID NO: 599582 - RNA, 22 nt, Human
aaauggcaacagaagggaguuc

SEQ ID NO: 599583 - RNA, 22 nt, Human
gagcuagaguuuguaggguaga

SEQ ID NO: 599584 - RNA, 22 nt, Human
accagcugccuuuucuuaguag

SEQ ID NO: 599585 - RNA, 18 nt, Human
gcagcugcaguuguagcu

SEQ ID NO: 599586 - RNA, 22 nt, Human
caaacuugucuaucuaggaauc

SEQ ID NO: 599587 - RNA, 22 nt, Human
uuuauaaacaguaccacggugc

SEQ ID NO: 599588 - RNA, 22 nt, Human
cugaaguucuacaagccucagg

SEQ ID NO: 599589 - RNA, 21 nt, Human
ugccagggauuuacagagccu

SEQ ID NO: 599590 - RNA, 22 nt, Human
gaacacuguuucuucgugaaca

SEQ ID NO: 599591 - RNA, 22 nt, Human
caacuuggcucucuggcuaucc

SEQ ID NO: 599592 - RNA, 22 nt, Human
ggccucugccccagccacaccu

SEQ ID NO: 599593 - RNA, 22 nt, Human
gccaggcuggccagcaccuucu

SEQ ID NO: 599594 - RNA, 22 nt, Human
agcagauggugucaugggaugg

SEQ ID NO: 599595 - RNA, 22 nt, Human
aagggaaaucauauggugcagu

SEQ ID NO: 599596 - RNA, 22 nt, Human
cuggggaggcagggcugccccu

SEQ ID NO: 599597 - RNA, 23 nt, Human
ucaauugaugauguucucuuuug

SEQ ID NO: 599598 - RNA, 20 nt, Human
aggggucuagcagcagugcu

SEQ ID NO: 599599 - RNA, 22 nt, Human
gagaaggauguggcucauagcu

SEQ ID NO: 599600 - RNA, 22 nt, Human
cuucauuuggagaacugugcuu

SEQ ID NO: 599601 - RNA, 22 nt, Human
gagaggcugaaaucacaggagc

SEQ ID NO: 599602 - RNA, 22 nt, Human
guggauggagcuggaagccauu

SEQ ID NO: 599603 - RNA, 22 nt, Human
ucucuggaguauaaccagggau

SEQ ID NO: 599604 - RNA, 22 nt, Human
uuuaaauaggacuccugggggu

SEQ ID NO: 599605 - RNA, 22 nt, Human
gcaggcagaucaccugucagga

SEQ ID NO: 599606 - RNA, 22 nt, Human
uugcagggauaaaacaagugaa

SEQ ID NO: 599607 - RNA, 20 nt, Human
agggaggugcugggccugag

SEQ ID NO: 599608 - RNA, 22 nt, Human
uccugggcgauuuucugaauau

SEQ ID NO: 599609 - RNA, 22 nt, Human
acagcauugcuccaucucaaga

SEQ ID NO: 599610 - RNA, 22 nt, Human
aaugaacacagcccucuacuuu

SEQ ID NO: 599611 - RNA, 22 nt, Human
ucucuucugaccuagccuugga

SEQ ID NO: 599612 - RNA, 22 nt, Human
ucuugacauuguuguuagcagg

SEQ ID NO: 599613 - RNA, 22 nt, Human
gacacugugcuagcugggcuua

SEQ ID NO: 599614 - RNA, 22 nt, Human
guguguccucaguaguggcaug

SEQ ID NO: 599615 - RNA, 22 nt, Human
aagcucugggguacacaucugc

SEQ ID NO: 599616 - RNA, 22 nt, Human
aacaaugcuugccaagugugau

SEQ ID NO: 599617 - RNA, 18 nt, Human
ugcuccaggcccaugggc

SEQ ID NO: 599618 - RNA, 22 nt, Human
gaagauuuucuccuuuaaauga

SEQ ID NO: 599619 - RNA, 22 nt, Human
cucuccugggcugaccguccga

SEQ ID NO: 599620 - RNA, 22 nt, Human
ugcccuggugaagugcucuccu

SEQ ID NO: 599621 - RNA, 23 nt, Human
ugcuggcuguguuauugccaaca

SEQ ID NO: 599622 - RNA, 22 nt, Human
cacacauuaauaucaaaggcuc

SEQ ID NO: 599623 - RNA, 22 nt, Human
uuuaaaaaacuagucugagucu

SEQ ID NO: 599624 - RNA, 22 nt, Human
gucuuauuaugagguuagacuu

SEQ ID NO: 599625 - RNA, 22 nt, Human
cugggucucuuaccaugugacu

SEQ ID NO: 599626 - RNA, 22 nt, Human
auguuauuaaaguacagauucu

SEQ ID NO: 599627 - RNA, 22 nt, Human
gugacaaaggucaagcuuuuga

SEQ ID NO: 599628 - RNA, 22 nt, Human
cccgggagguggagacugcagu

SEQ ID NO: 599629 - RNA, 17 nt, Human
uggcacagaggugcuau

SEQ ID NO: 599630 - RNA, 23 nt, Human
cccuucagcgagggcauuaaggu

SEQ ID NO: 599631 - RNA, 22 nt, Human
guucaagguuuuacagagugua

SEQ ID NO: 599632 - RNA, 22 nt, Human
cagucacauuucgacauaacua

SEQ ID NO: 599633 - RNA, 22 nt, Human
ugaaaacuccaaguuucaucag

SEQ ID NO: 599634 - RNA, 22 nt, Human
agugcuccuuucauugcugccc

SEQ ID NO: 599635 - RNA, 22 nt, Human
ugacaaauacaauaagaucugu

SEQ ID NO: 599636 - RNA, 22 nt, Human
caggcagaguuagagcaacugg

SEQ ID NO: 599637 - RNA, 20 nt, Human
agaauucuuacccuuugaug

SEQ ID NO: 599638 - RNA, 22 nt, Human
auuauuguuuuaauaguagaga

SEQ ID NO: 599639 - RNA, 22 nt, Human
uccaucugucuuucccauccac

SEQ ID NO: 599640 - RNA, 22 nt, Human
aacagucuuacagaaguagcca

SEQ ID NO: 599641 - RNA, 22 nt, Human
uggagaguaaauggcagaauca

SEQ ID NO: 599642 - RNA, 22 nt, Human
gggcugagccacagcuuuuguu

SEQ ID NO: 599643 - RNA, 22 nt, Human
agagcuggaaucagaccucagg

SEQ ID NO: 599644 - RNA, 22 nt, Human
uggcagcagacaaaaggccauu

SEQ ID NO: 599645 - RNA, 22 nt, Human
agcuuccuuggcgcugaggccu

SEQ ID NO: 599646 - RNA, 22 nt, Human
ucagagaacuccacaccuuagg

SEQ ID NO: 599647 - RNA, 20 nt, Human
ccacaguggagacuggagac

SEQ ID NO: 599648 - RNA, 20 nt, Human
acuggaguacccuagagaag

SEQ ID NO: 599649 - RNA, 20 nt, Human
agcaccagugggggcagccc

SEQ ID NO: 599650 - RNA, 18 nt, Human
cccacacagcaguagcuc

SEQ ID NO: 599651 - RNA, 22 nt, Human
gcucccugcacucugcagcccu

SEQ ID NO: 599652 - RNA, 22 nt, Human
ugaaggaagaauaggcaguguu

SEQ ID NO: 599653 - RNA, 22 nt, Human
agccuggaagaaccugaagucu

SEQ ID NO: 599654 - RNA, 21 nt, Human
gcacagugccaggcacacagu

SEQ ID NO: 599655 - RNA, 22 nt, Human
uaccugagcccagugcagcaua

SEQ ID NO: 599656 - RNA, 22 nt, Human
uagcugucagcaaucaaguggu

SEQ ID NO: 599657 - RNA, 22 nt, Human
auugucucuuucaauaacuugu

SEQ ID NO: 599658 - RNA, 22 nt, Human
uacauugcuagaaauguauuuu

SEQ ID NO: 599659 - RNA, 22 nt, Human
uucugaaaggcagguuguuugc

SEQ ID NO: 599660 - RNA, 22 nt, Human
ggguggagcuuggacaccagua

SEQ ID NO: 599661 - RNA, 22 nt, Human
uuaaaccauaguuuaacauaag

SEQ ID NO: 599662 - RNA, 22 nt, Human
caggcugggaacgccacccgcu

SEQ ID NO: 599663 - RNA, 23 nt, Human
aagugcucaguggacagcauugc

SEQ ID NO: 599664 - RNA, 22 nt, Human
cccuuccuggaguacccucugu

SEQ ID NO: 599665 - RNA, 22 nt, Human
aaaguucauugaugacugaggu

SEQ ID NO: 599666 - RNA, 22 nt, Human
uugcauuucacuuucaguaggc

SEQ ID NO: 599667 - RNA, 22 nt, Human
uggaagcggugcuggcccaugg

SEQ ID NO: 599668 - RNA, 22 nt, Human
cauaacauccuugcuacuuuga

SEQ ID NO: 599669 - RNA, 21 nt, Human
aacugcuucccaucuuagggc

SEQ ID NO: 599670 - RNA, 22 nt, Human
uuucagaaccgcuaaaauaaau

SEQ ID NO: 599671 - RNA, 22 nt, Human
agcuugccucuuaaucaccuca

SEQ ID NO: 599672 - RNA, 20 nt, Human
cugcccagccacugagggau

SEQ ID NO: 599673 - RNA, 22 nt, Human
aaucacagaaggcagucuucua

SEQ ID NO: 599674 - RNA, 22 nt, Human
cauggccucaaaggacugcaga

SEQ ID NO: 599675 - RNA, 22 nt, Human
ucccaggaagaucccagggacc

SEQ ID NO: 599676 - RNA, 20 nt, Human
ucugcccaccccggcuccca

SEQ ID NO: 599677 - RNA, 22 nt, Human
aaaaagucauauucuuguuccu

SEQ ID NO: 599678 - RNA, 22 nt, Human
augcuuuacgacaaaaaacuca

SEQ ID NO: 599679 - RNA, 20 nt, Human
gcucccugguagaaauguuu

SEQ ID NO: 599680 - RNA, 22 nt, Human
uggcucuggugcgggcuccugc

SEQ ID NO: 599681 - RNA, 22 nt, Human
agagguauauauucuccauauu

SEQ ID NO: 599682 - RNA, 22 nt, Human
uuauuuaauuuucucacucaga

SEQ ID NO: 599683 - RNA, 18 nt, Human
ggagagugagaucaaaca

SEQ ID NO: 599684 - RNA, 22 nt, Human
ccucugagagaaggccuucagc

SEQ ID NO: 599685 - RNA, 22 nt, Human
uucugucacuuaggaggucaua

SEQ ID NO: 599686 - RNA, 16 nt, Human
cacagugcugcugcuc

SEQ ID NO: 599687 - RNA, 22 nt, Human
caaggacacucccugcugggca

SEQ ID NO: 599688 - RNA, 19 nt, Human
ccagggcuccaagcugagu

SEQ ID NO: 599689 - RNA, 22 nt, Human
uacaaagaguuuggucucuaga

SEQ ID NO: 599690 - RNA, 21 nt, Human
agauucaggacagcagucacu

SEQ ID NO: 599691 - RNA, 22 nt, Human
ucuuaaaccacacaugugcucu

SEQ ID NO: 599692 - RNA, 22 nt, Human
cugagagaaacaugacucagga

SEQ ID NO: 599693 - RNA, 19 nt, Human
agugaacuccauaucaggu

SEQ ID NO: 599694 - RNA, 22 nt, Human
ucuccaggugagggugguuaga

SEQ ID NO: 599695 - RNA, 22 nt, Human
aguggagguuacagcuguacau

SEQ ID NO: 599696 - RNA, 22 nt, Human
cugcuuuacucauaggguuuca

SEQ ID NO: 599697 - RNA, 22 nt, Human
aaggagaguacaggaguuggua

SEQ ID NO: 599698 - RNA, 22 nt, Human
ggaaaggggccuggaucuuuug

SEQ ID NO: 599699 - RNA, 22 nt, Human
aggagacccaaugccagaaaga

SEQ ID NO: 599700 - RNA, 21 nt, Human
uccagggcuuugauucucuca

SEQ ID NO: 599701 - RNA, 20 nt, Human
uggcaggaggcagcagugga

SEQ ID NO: 599702 - RNA, 22 nt, Human
augacauaagugaaaaacauca

SEQ ID NO: 599703 - RNA, 22 nt, Human
ggcaggcuccaagcauccuaug

SEQ ID NO: 599704 - RNA, 22 nt, Human
uaacacugugucugccauaucc

SEQ ID NO: 599705 - RNA, 22 nt, Human
uuucaagcauaacugggaagag

SEQ ID NO: 599706 - RNA, 22 nt, Human
gcaguguugacuaugguaugag

SEQ ID NO: 599707 - RNA, 22 nt, Human
aaacacugucucugguauugaa

SEQ ID NO: 599708 - RNA, 22 nt, Human
aagcuccccgaaacccaccucu

SEQ ID NO: 599709 - RNA, 19 nt, Human
uuacuucaggagugaaauu

SEQ ID NO: 599710 - RNA, 22 nt, Human
cccaggaauuggaggcugcagu

SEQ ID NO: 599711 - RNA, 22 nt, Human
ggcuggcacugaggagagcucu

SEQ ID NO: 599712 - RNA, 22 nt, Human
uaaaugacaacaccugcuuuug

SEQ ID NO: 599713 - RNA, 22 nt, Human
aaaccuuuaccagacuagcaag

SEQ ID NO: 599714 - RNA, 20 nt, Human
agggucaguagcacagagcu

SEQ ID NO: 599715 - RNA, 22 nt, Human
uaguguuccagaagcaaacaag

SEQ ID NO: 599716 - RNA, 22 nt, Human
aagcuguugaaguaauucagcc

SEQ ID NO: 599717 - RNA, 22 nt, Human
aggggcaggugcugcacuuaga

SEQ ID NO: 599718 - RNA, 22 nt, Human
aacaacuugcguucagagaugu

SEQ ID NO: 599719 - RNA, 22 nt, Human
ucucugggacacugggucaguu

SEQ ID NO: 599720 - RNA, 18 nt, Human
agggccagcugugaguag

SEQ ID NO: 599721 - RNA, 22 nt, Human
uucuccuuuuccaguucccagu

SEQ ID NO: 599722 - RNA, 22 nt, Human
ccagucuggcaggagggggaac

SEQ ID NO: 599723 - RNA, 22 nt, Human
ugcacugaauaguagacuguac

SEQ ID NO: 599724 - RNA, 22 nt, Human
ggcuagggagacagagggcaug

SEQ ID NO: 599725 - RNA, 22 nt, Human
gagcgggaggaacggcucgggc

SEQ ID NO: 599726 - RNA, 22 nt, Human
ucauggcagcccuuuacuagag

SEQ ID NO: 599727 - RNA, 22 nt, Human
gcugccucuccugaguugacag

SEQ ID NO: 599728 - RNA, 22 nt, Human
ucagggcuccggaaguggccuc

SEQ ID NO: 599729 - RNA, 22 nt, Human
aaagcaauugugguuuuuguca

SEQ ID NO: 599730 - RNA, 22 nt, Human
accaggacuuuguauucagcuu

SEQ ID NO: 599731 - RNA, 22 nt, Human
cagacuggcugaaggccgagug

SEQ ID NO: 599732 - RNA, 22 nt, Human
cacagcaagagcuaaaugacca

SEQ ID NO: 599733 - RNA, 22 nt, Human
aggugcuuggcucgugcacaca

SEQ ID NO: 599734 - RNA, 22 nt, Human
gcagacagacugcagugauuuu

SEQ ID NO: 599735 - RNA, 22 nt, Human
caaaagcaguucuaucugaguu

SEQ ID NO: 599736 - RNA, 22 nt, Human
ggccucaucacagugcauuagu

SEQ ID NO: 599737 - RNA, 22 nt, Human
gaggccagccccucuugaaggc

SEQ ID NO: 599738 - RNA, 22 nt, Human
aagucucagaaaacuagugugg

SEQ ID NO: 599739 - RNA, 22 nt, Human
gccagagccacuuuugggugau

SEQ ID NO: 599740 - RNA, 22 nt, Human
acccaggguuccugggucccag

SEQ ID NO: 599741 - RNA, 17 nt, Human
agcagcugaagcagcca

SEQ ID NO: 599742 - RNA, 22 nt, Human
aucaggugaugcucugguuccc

SEQ ID NO: 599743 - RNA, 22 nt, Human
auggcucauuuaucuugcagcc

SEQ ID NO: 599744 - RNA, 22 nt, Human
caucuuaaauuaaagcuuaagg

SEQ ID NO: 599745 - RNA, 22 nt, Human
cuuauuucuccauccagaguca

SEQ ID NO: 599746 - RNA, 22 nt, Human
aaguaaauaucuguuuauagca

SEQ ID NO: 599747 - RNA, 22 nt, Human
uuacauaacgguaugaaaaaug

SEQ ID NO: 599748 - RNA, 22 nt, Human
aggccacagguggaagccagag

SEQ ID NO: 599749 - RNA, 22 nt, Human
agagcagcuggggcagagacca

SEQ ID NO: 599750 - RNA, 22 nt, Human
agguaggauagauaggaagacc

SEQ ID NO: 599751 - RNA, 20 nt, Human
auucaugucuuuauaaaagc

SEQ ID NO: 599752 - RNA, 22 nt, Human
gcugagguggcugccuuaguaa

SEQ ID NO: 599753 - RNA, 22 nt, Human
ugagauaacucugauuuauguu

SEQ ID NO: 599754 - RNA, 22 nt, Human
ggaaagccaggugcucuggugu

SEQ ID NO: 599755 - RNA, 22 nt, Human
ugaggcugacaaaagaugaggu

SEQ ID NO: 599756 - RNA, 22 nt, Human
ggcugcuugcuguuucuuggau

SEQ ID NO: 599757 - RNA, 22 nt, Human
ucuccaggaagcccucccugac

SEQ ID NO: 599758 - RNA, 22 nt, Human
cagagcagugggguuggucaga

SEQ ID NO: 599759 - RNA, 22 nt, Human
uaugucuuguguuugcuaaucu

SEQ ID NO: 599760 - RNA, 22 nt, Human
ucugggaugagaucagagacac

SEQ ID NO: 599761 - RNA, 22 nt, Human
acacagcucacaacgugugcau

SEQ ID NO: 599762 - RNA, 22 nt, Human
uggugccuugggccuacagcgc

SEQ ID NO: 599763 - RNA, 22 nt, Human
auguuacaauucaaaaugcugc

SEQ ID NO: 599764 - RNA, 22 nt, Human
cuaaacauguagcuuuuguggu

SEQ ID NO: 599765 - RNA, 22 nt, Human
agguaucugguaagaggcagac

SEQ ID NO: 599766 - RNA, 22 nt, Human
ccauuuaguaaggaagaacagc

SEQ ID NO: 599767 - RNA, 21 nt, Human
acaggcuuuagaaaaugacuc

SEQ ID NO: 599768 - RNA, 22 nt, Human
gugggcaggguugcuuucuccg

SEQ ID NO: 599769 - RNA, 22 nt, Human
gugucccaauguucaggacggc

SEQ ID NO: 599770 - RNA, 22 nt, Human
ugacacauuaaaugcucacaaa

SEQ ID NO: 599771 - RNA, 22 nt, Human
uucuaugugcuggagaauauuu

SEQ ID NO: 599772 - RNA, 19 nt, Human
aaagaucugggauugagac

SEQ ID NO: 599773 - RNA, 22 nt, Human
augcaagucuuaauaguuuagg

SEQ ID NO: 599774 - RNA, 22 nt, Human
ugacauuucuuguugauauaaa

SEQ ID NO: 599775 - RNA, 22 nt, Human
auaaacaagacuggccaacuuu

SEQ ID NO: 599776 - RNA, 22 nt, Human
ugccucugccuccauuguuagu

SEQ ID NO: 599777 - RNA, 22 nt, Human
agcagaugcauuaugauugaaa

SEQ ID NO: 599778 - RNA, 22 nt, Human
gguggcagaauaauugaagguc

SEQ ID NO: 599779 - RNA, 22 nt, Human
uccagggcagggugcgcauggg

SEQ ID NO: 599780 - RNA, 21 nt, Human
aaguuuuauguugccauuugu

SEQ ID NO: 599781 - RNA, 23 nt, Human
agcugaggcugugggugucagag

SEQ ID NO: 599782 - RNA, 21 nt, Human
ugggccaguagaaaggaaggc

SEQ ID NO: 599783 - RNA, 22 nt, Human
cugcagagcaaguucucuguug

SEQ ID NO: 599784 - RNA, 22 nt, Human
agugauggcaucggguccagca

SEQ ID NO: 599785 - RNA, 22 nt, Human
uagaaacauguucuguucuguu

SEQ ID NO: 599786 - RNA, 21 nt, Human
caguuacagccaggacaaggc

SEQ ID NO: 599787 - RNA, 22 nt, Human
aaggaagaagggaaguuacuua

SEQ ID NO: 599788 - RNA, 22 nt, Human
cugccuggcuaaacucaagucg

SEQ ID NO: 599789 - RNA, 22 nt, Human
ugagcugggcugggcugagcug

SEQ ID NO: 599790 - RNA, 22 nt, Human
gcaagggugugaaccaaugaga

SEQ ID NO: 599791 - RNA, 22 nt, Human
cucuaaauccaaauaagugucc

SEQ ID NO: 599792 - RNA, 22 nt, Human
gaacacaacucagaaugcuggu

SEQ ID NO: 599793 - RNA, 18 nt, Human
gugugcaguugcaggggu

SEQ ID NO: 599794 - RNA, 22 nt, Human
cagcacaucuccaagaauuucu

SEQ ID NO: 599795 - RNA, 18 nt, Human
cagacacucugcucugca

SEQ ID NO: 599796 - RNA, 22 nt, Human
uaacuucuuugguuuaaagaga

SEQ ID NO: 599797 - RNA, 22 nt, Human
uuuucaguuugcacugcagugc

SEQ ID NO: 599798 - RNA, 22 nt, Human
agcuuccuugaauucuguagaa

SEQ ID NO: 599799 - RNA, 22 nt, Human
ugcaguggaagagguggagauc

SEQ ID NO: 599800 - RNA, 22 nt, Human
ucuccaggcacuaccuggguaa

SEQ ID NO: 599801 - RNA, 22 nt, Human
guuuacagagacagaaaguagu

SEQ ID NO: 599802 - RNA, 22 nt, Human
uuuucaggugcaguaaucauau

SEQ ID NO: 599803 - RNA, 22 nt, Human
accaucugaguagagagaagua

SEQ ID NO: 599804 - RNA, 22 nt, Human
uuaugcaugagauaaaaauugg

SEQ ID NO: 599805 - RNA, 22 nt, Human
aggggcugggacagagccaagc

SEQ ID NO: 599806 - RNA, 22 nt, Human
gaagccaguguuugaagaauuu

SEQ ID NO: 599807 - RNA, 22 nt, Human
caggaugguggcaugaucagaa

SEQ ID NO: 599808 - RNA, 22 nt, Human
ccccucucccucacuuaucaau

SEQ ID NO: 599809 - RNA, 22 nt, Human
aaacaucaccauuuuaccuaau

SEQ ID NO: 599810 - RNA, 22 nt, Human
auggaaguuggaaccauucaua

SEQ ID NO: 599811 - RNA, 22 nt, Human
acauuucugucuuagggacugu

SEQ ID NO: 599812 - RNA, 22 nt, Human
cagcccccauggggaggucaag

SEQ ID NO: 599813 - RNA, 22 nt, Human
gcagggcuuuuugaaacauggu

SEQ ID NO: 599814 - RNA, 22 nt, Human
uggagagcugguucaaagcaga

SEQ ID NO: 599815 - RNA, 22 nt, Human
gugaagguggggagccucaguu

SEQ ID NO: 599816 - RNA, 22 nt, Human
ugucauugguacaaauugauug

SEQ ID NO: 599817 - RNA, 22 nt, Human
cgugcucuggacucguggcaca

SEQ ID NO: 599818 - RNA, 22 nt, Human
cuggagagaccgaaagaggcug

SEQ ID NO: 599819 - RNA, 22 nt, Human
uuugcacacacaauaacaaaug

SEQ ID NO: 599820 - RNA, 22 nt, Human
ugccagaugcaggagguaaggc

SEQ ID NO: 599821 - RNA, 22 nt, Human
agcuaaggacaguugauuuaga

SEQ ID NO: 599822 - RNA, 22 nt, Human
aguaaacauagaauguucuucc

SEQ ID NO: 599823 - RNA, 22 nt, Human
aggcagaggagaaugaucuucc

SEQ ID NO: 599824 - RNA, 22 nt, Human
auuuccuucggacaguuugggu

SEQ ID NO: 599825 - RNA, 22 nt, Human
ucuuguuaucaggaaaacagua

SEQ ID NO: 599826 - RNA, 22 nt, Human
ucugagguaccagcugguuuau

SEQ ID NO: 599827 - RNA, 22 nt, Human
uauuucuaagagauaucuguac

SEQ ID NO: 599828 - RNA, 22 nt, Human
aggaaacggcaaaacugcuuag

SEQ ID NO: 599829 - RNA, 22 nt, Human
cagcucugacacaguacaaaau

SEQ ID NO: 599830 - RNA, 22 nt, Human
ucacugcagagaccucuaguca

SEQ ID NO: 599831 - RNA, 23 nt, Human
ggcuggcccggggcugcuccuga

SEQ ID NO: 599832 - RNA, 22 nt, Human
uacauucacaguuguucaucuc

SEQ ID NO: 599833 - RNA, 22 nt, Human
ugggcuggcugaacuucaaccu

SEQ ID NO: 599834 - RNA, 22 nt, Human
ccucccuccauugccaucgucu

SEQ ID NO: 599835 - RNA, 22 nt, Human
uugauucuucugaauuugcaga

SEQ ID NO: 599836 - RNA, 22 nt, Human
ugcagagggaaaaggugcuccu

SEQ ID NO: 599837 - RNA, 22 nt, Human
uuagcauucucauuugcauaaa

SEQ ID NO: 599838 - RNA, 22 nt, Human
uacauaaugagcuaguuaaguu

SEQ ID NO: 599839 - RNA, 22 nt, Human
ggccaggcacugugugagauau

SEQ ID NO: 599840 - RNA, 22 nt, Human
caggaaaaugucaauggaaagc

SEQ ID NO: 599841 - RNA, 22 nt, Human
uaaagcauaaugaauaucuaga

SEQ ID NO: 599842 - RNA, 22 nt, Human
acuucucuucauagguggcaau

SEQ ID NO: 599843 - RNA, 22 nt, Human
accagggcggcuugaggaggca

SEQ ID NO: 599844 - RNA, 22 nt, Human
ucacuuuagaggaaacauugag

SEQ ID NO: 599845 - RNA, 22 nt, Human
caguguggguuugggaggagua

SEQ ID NO: 599846 - RNA, 22 nt, Human
uguguacacagauaguaauggc

SEQ ID NO: 599847 - RNA, 23 nt, Human
gccaggcuccggucuguggccac

SEQ ID NO: 599848 - RNA, 22 nt, Human
ucaggcugcuuucaugcuuaga

SEQ ID NO: 599849 - RNA, 22 nt, Human
ugcucuucacaguuucagcauc

SEQ ID NO: 599850 - RNA, 22 nt, Human
cuuguauuccccuaucucuaaa

SEQ ID NO: 599851 - RNA, 22 nt, Human
ccuggcugguggcagcgacaag

SEQ ID NO: 599852 - RNA, 22 nt, Human
ucauucagguugggcaaguguc

SEQ ID NO: 599853 - RNA, 23 nt, Human
cacaggcagaaaucaagacggua

SEQ ID NO: 599854 - RNA, 22 nt, Human
gacagcuguacacuccugguua

SEQ ID NO: 599855 - RNA, 22 nt, Human
uacagcuguugguguuuccucu

SEQ ID NO: 599856 - RNA, 22 nt, Human
ccuugcccgcugccucugaguu

SEQ ID NO: 599857 - RNA, 22 nt, Human
cccugguggggccagacuugcu

SEQ ID NO: 599858 - RNA, 22 nt, Human
accuucugaccaguuaucuuga

SEQ ID NO: 599859 - RNA, 22 nt, Human
caucugccuaaguggcccuguu

SEQ ID NO: 599860 - RNA, 22 nt, Human
guccacauaggaacccagcuuc

SEQ ID NO: 599861 - RNA, 22 nt, Human
cagcagcacucugcgggucccc

SEQ ID NO: 599862 - RNA, 22 nt, Human
agaggcucuggugggaguuggu

SEQ ID NO: 599863 - RNA, 22 nt, Human
uuuacaaggcaguuauuuuccu

SEQ ID NO: 599864 - RNA, 22 nt, Human
acagaguacagacaaaggucag

SEQ ID NO: 599865 - RNA, 22 nt, Human
guuaagaacuuguugaaggucu

SEQ ID NO: 599866 - RNA, 22 nt, Human
uucugguaccgugucagaaacc

SEQ ID NO: 599867 - RNA, 22 nt, Human
cauccaaacucucauuaucugu

SEQ ID NO: 599868 - RNA, 22 nt, Human
ucccuccacaccugcugguacc

SEQ ID NO: 599869 - RNA, 22 nt, Human
caaagaguuuuuucauauaaug

SEQ ID NO: 599870 - RNA, 22 nt, Human
gacaagacaccucucuccaucc

SEQ ID NO: 599871 - RNA, 22 nt, Human
ugggcuccucgucacucgcugu

SEQ ID NO: 599872 - RNA, 22 nt, Human
uggaggagggcuggugucugua

SEQ ID NO: 599873 - RNA, 22 nt, Human
caugcagggagcagaggagaca

SEQ ID NO: 599874 - RNA, 22 nt, Human
cucucuguauguguauauuuau

SEQ ID NO: 599875 - RNA, 22 nt, Human
uacauuguucaugcaugagaaa

SEQ ID NO: 599876 - RNA, 22 nt, Human
agugaaauccuggucaacaggu

SEQ ID NO: 599877 - RNA, 22 nt, Human
cagcggggccugugcuggggag

SEQ ID NO: 599878 - RNA, 19 nt, Human
uccuggugacccugaaauu

SEQ ID NO: 599879 - RNA, 22 nt, Human
ugccugcuuguuuaccuacucc

SEQ ID NO: 599880 - RNA, 22 nt, Human
uaugaccauaagauuacuguua

SEQ ID NO: 599881 - RNA, 20 nt, Human
aaucacaguuaacucuuucu

SEQ ID NO: 599882 - RNA, 22 nt, Human
cauuucaccuuagagaauuauu

SEQ ID NO: 599883 - RNA, 22 nt, Human
acagcugggaaucagcugggga

SEQ ID NO: 599884 - RNA, 22 nt, Human
uggccugacugucaggcuguau

SEQ ID NO: 599885 - RNA, 22 nt, Human
cuggagucucuucuguagcuac

SEQ ID NO: 599886 - RNA, 22 nt, Human
ucuggaguugugcaguggaccu

SEQ ID NO: 599887 - RNA, 22 nt, Human
ugcagggcuuccucuuggaguu

SEQ ID NO: 599888 - RNA, 22 nt, Human
acaggcuucucacagaaaaggg

SEQ ID NO: 599889 - RNA, 22 nt, Human
ugugaaugucuagguuuuaugu

SEQ ID NO: 599890 - RNA, 21 nt, Human
cccugcaggccagggcugagc

SEQ ID NO: 599891 - RNA, 22 nt, Human
ucuccugccacugcuucccauu

SEQ ID NO: 599892 - RNA, 22 nt, Human
auauguguguauuucuuacuag

SEQ ID NO: 599893 - RNA, 22 nt, Human
auucucaauggcuacuuucaua

SEQ ID NO: 599894 - RNA, 22 nt, Human
ccagugugguagguccacaggu

SEQ ID NO: 599895 - RNA, 22 nt, Human
uaggaacaguccuagaaaucug

SEQ ID NO: 599896 - RNA, 22 nt, Human
ccuccuggcccugggccuggaa

SEQ ID NO: 599897 - RNA, 22 nt, Human
uguggacugugcugccacagug

SEQ ID NO: 599898 - RNA, 22 nt, Human
caagagcuuuagaaaugcucau

SEQ ID NO: 599899 - RNA, 22 nt, Human
aauuaauauuuguggaauuaau

SEQ ID NO: 599900 - RNA, 22 nt, Human
caaugucugaccguuuugccca

SEQ ID NO: 599901 - RNA, 23 nt, Human
cucagggauagaaaggaagacag

SEQ ID NO: 599902 - RNA, 22 nt, Human
cagaaaccaaaugggaugggga

SEQ ID NO: 599903 - RNA, 22 nt, Human
agcugggacagacaacuauguu

SEQ ID NO: 599904 - RNA, 22 nt, Human
auaugcuggaguacaggaaaua

SEQ ID NO: 599905 - RNA, 22 nt, Human
aaacaacucggcaacugcuuuu

SEQ ID NO: 599906 - RNA, 22 nt, Human
gcagggcaguaagagcuagagu

SEQ ID NO: 599907 - RNA, 22 nt, Human
gcccagaacagugucacauguc

SEQ ID NO: 599908 - RNA, 22 nt, Human
aauaaugucuuuggcuugacca

SEQ ID NO: 599909 - RNA, 19 nt, Human
gagggcucauuugaacaau

SEQ ID NO: 599910 - RNA, 22 nt, Human
gcagcagcugacagugggugcc

SEQ ID NO: 599911 - RNA, 22 nt, Human
ucuuccuucuuugaugacaagg

SEQ ID NO: 599912 - RNA, 22 nt, Human
acaggagugaaucuggcacuua

SEQ ID NO: 599913 - RNA, 22 nt, Human
ucucugaguauccugaacugcc

SEQ ID NO: 599914 - RNA, 22 nt, Human
cagguccccuccccuaccaggc

SEQ ID NO: 599915 - RNA, 22 nt, Human
agacaacaucuaguuuggugga

SEQ ID NO: 599916 - RNA, 22 nt, Human
ucacauuuuccuugguaucugu

SEQ ID NO: 599917 - RNA, 23 nt, Human
ucugggcaccuuguugacaugau

SEQ ID NO: 599918 - RNA, 22 nt, Human
cugggagcuuguuaggaaugca

SEQ ID NO: 599919 - RNA, 22 nt, Human
cugagaaaagcuuucuuauaca

SEQ ID NO: 599920 - RNA, 22 nt, Human
cagagggaccagaacauacugu

SEQ ID NO: 599921 - RNA, 22 nt, Human
agccccaguccgcugcgggcgg

SEQ ID NO: 599922 - RNA, 22 nt, Human
aggaagaauguuuacauaucaa

SEQ ID NO: 599923 - RNA, 22 nt, Human
gcuaaugacugaguuuuuagca

SEQ ID NO: 599924 - RNA, 22 nt, Human
aucaagcauauauaaaacugca

SEQ ID NO: 599925 - RNA, 21 nt, Human
uggggaggggaccugauuaug

SEQ ID NO: 599926 - RNA, 22 nt, Human
uauuauggggggaacaucacuc

SEQ ID NO: 599927 - RNA, 22 nt, Human
ggugggaaggccacugaagguu

SEQ ID NO: 599928 - RNA, 22 nt, Human
cugaggucaggaguucaagcug

SEQ ID NO: 599929 - RNA, 22 nt, Human
uauuucauucuuuaucaggagc

SEQ ID NO: 599930 - RNA, 22 nt, Human
guggggaggccuaagcaaguug

SEQ ID NO: 599931 - RNA, 22 nt, Human
uugaacauuaacuucagucuau

SEQ ID NO: 599932 - RNA, 22 nt, Human
uccugguggcuuucccugccuu

SEQ ID NO: 599933 - RNA, 20 nt, Human
ucauggcagccacccacagg

SEQ ID NO: 599934 - RNA, 22 nt, Human
gcagccaggggcugugaccugu

SEQ ID NO: 599935 - RNA, 22 nt, Human
gaugugugugcccugggccugc

SEQ ID NO: 599936 - RNA, 22 nt, Human
gugaggucaccggccguugcca

SEQ ID NO: 599937 - RNA, 22 nt, Human
cuguuaaaaagaccaauggauu

SEQ ID NO: 599938 - RNA, 22 nt, Human
acaguacagugcagaggaagau

SEQ ID NO: 599939 - RNA, 22 nt, Human
uaaaugcaaagcuuggcgcuua

SEQ ID NO: 599940 - RNA, 22 nt, Human
cagcuuccccccgggcuugaga

SEQ ID NO: 599941 - RNA, 22 nt, Human
aagaccauaauguaagaugaau

SEQ ID NO: 599942 - RNA, 19 nt, Human
aauauuuuagccucuuccu

SEQ ID NO: 599943 - RNA, 20 nt, Human
agaggccaguuaggagucua

SEQ ID NO: 599944 - RNA, 22 nt, Human
ugccaggccacguagcuucaag

SEQ ID NO: 599945 - RNA, 22 nt, Human
gaacacagucaagggcugcugu

SEQ ID NO: 599946 - RNA, 22 nt, Human
aggcaggucacaugcuuggcga

SEQ ID NO: 599947 - RNA, 22 nt, Human
gcaaacauuccacagaaggaag

SEQ ID NO: 599948 - RNA, 22 nt, Human
agcacagggacaaugccaggug

SEQ ID NO: 599949 - RNA, 22 nt, Human
ggccuggagcagagacuaggga

SEQ ID NO: 599950 - RNA, 22 nt, Human
agcaggugaugugagucuggaa

SEQ ID NO: 599951 - RNA, 20 nt, Human
acuuggaacucauuuuucuu

SEQ ID NO: 599952 - RNA, 23 nt, Human
uucaaaacuggaaaaucagaugc

SEQ ID NO: 599953 - RNA, 22 nt, Human
gagggccagaguccugggguca

SEQ ID NO: 599954 - RNA, 22 nt, Human
aagagagagcauucuucuguua

SEQ ID NO: 599955 - RNA, 20 nt, Human
aggcuuggcuuggcaggaac

SEQ ID NO: 599956 - RNA, 22 nt, Human
uuuuggguggaagcuguuaugg

SEQ ID NO: 599957 - RNA, 22 nt, Human
agcagaacugaugagacuugag

SEQ ID NO: 599958 - RNA, 22 nt, Human
cuaggaaauuuaaaauaugauu

SEQ ID NO: 599959 - RNA, 22 nt, Human
aaaagguaguugccaaauaagg

SEQ ID NO: 599960 - RNA, 22 nt, Human
gccccucuccuugugcaccugc

SEQ ID NO: 599961 - RNA, 22 nt, Human
cuguggaaggacuuagcgauac

SEQ ID NO: 599962 - RNA, 22 nt, Human
cuguuuuaucucaagaguucaa

SEQ ID NO: 599963 - RNA, 22 nt, Human
cccagcucugccaucuacccac

SEQ ID NO: 599964 - RNA, 22 nt, Human
gcagugaagcaguccuuguuga

SEQ ID NO: 599965 - RNA, 22 nt, Human
auggaacaugaauuaauauggu

SEQ ID NO: 599966 - RNA, 19 nt, Human
uucugggaggggcugacug

SEQ ID NO: 599967 - RNA, 22 nt, Human
agggagaaugaccaagguauau

SEQ ID NO: 599968 - RNA, 22 nt, Human
auaccuuuuacucauuauccau

SEQ ID NO: 599969 - RNA, 22 nt, Human
cagugcagacguggagggggca

SEQ ID NO: 599970 - RNA, 22 nt, Human
gggguugguuuaaaugcuugag

SEQ ID NO: 599971 - RNA, 22 nt, Human
acugagaggugauagugacauu

SEQ ID NO: 599972 - RNA, 22 nt, Human
caaacauugcacuuucugcuau

SEQ ID NO: 599973 - RNA, 22 nt, Human
ucucucuugucaccccaucugc

SEQ ID NO: 599974 - RNA, 22 nt, Human
ugaauccagagcuauuucgucc

SEQ ID NO: 599975 - RNA, 22 nt, Human
gaaaugauuuuaguuuaucaug

SEQ ID NO: 599976 - RNA, 22 nt, Human
auaaucauucacauaaggugcu

SEQ ID NO: 599977 - RNA, 22 nt, Human
ugagcccaggaguaugaggcug

SEQ ID NO: 599978 - RNA, 21 nt, Human
acucccugcauaagugauuua

SEQ ID NO: 599979 - RNA, 22 nt, Human
uuuagaggcaucuugcuuuucu

SEQ ID NO: 599980 - RNA, 22 nt, Human
cacccaggcauggguugagaug

SEQ ID NO: 599981 - RNA, 22 nt, Human
caugcugagcacauucuguauu

SEQ ID NO: 599982 - RNA, 22 nt, Human
cagcaucuuucucuucuggagu

SEQ ID NO: 599983 - RNA, 22 nt, Human
ucugaaauaggagccauguaga

SEQ ID NO: 599984 - RNA, 22 nt, Human
gucugucucccugugacugaga

SEQ ID NO: 599985 - RNA, 22 nt, Human
uagaaagcaugcaaguuugaug

SEQ ID NO: 599986 - RNA, 22 nt, Human
auuuuacuacuccaauuaauga

SEQ ID NO: 599987 - RNA, 22 nt, Human
caguugcuggaugugcagcucu

SEQ ID NO: 599988 - RNA, 21 nt, Human
aggcuuggaucuagacaggcc

SEQ ID NO: 599989 - RNA, 22 nt, Human
uuuauccagaaucaggauuuuu

SEQ ID NO: 599990 - RNA, 22 nt, Human
auacauguucguguacauguuc

SEQ ID NO: 599991 - RNA, 22 nt, Human
uaaugaacaugcaucgugugua

SEQ ID NO: 599992 - RNA, 22 nt, Human
caaggcagucccuacucccugc

SEQ ID NO: 599993 - RNA, 22 nt, Human
aaacacacagaaaugaaugagg

SEQ ID NO: 599994 - RNA, 22 nt, Human
ugaggaagccaaacagcuacac

SEQ ID NO: 599995 - RNA, 22 nt, Human
aaagcuuucuagcuauguucua

SEQ ID NO: 599996 - RNA, 18 nt, Human
agcuccugaacucugugg

SEQ ID NO: 599997 - RNA, 22 nt, Human
auaggaaugugauuuauaaaug

SEQ ID NO: 599998 - RNA, 22 nt, Human
gccagcucuugaugggugggua

SEQ ID NO: 599999 - RNA, 22 nt, Human
accuucaggugagcacacagau

SEQ ID NO: 600000 - RNA, 22 nt, Human
aaaacugagguuuccugaagaa

SEQ ID NO: 600001 - RNA, 22 nt, Human
auuugcuuagauucagcacuuu

SEQ ID NO: 600002 - RNA, 22 nt, Human
ugcaggagcugugcggugaggg

SEQ ID NO: 600003 - RNA, 22 nt, Human
ucaggcugccuaucagacugug

SEQ ID NO: 600004 - RNA, 22 nt, Human
gauuucuucauucauuagaugg

SEQ ID NO: 600005 - RNA, 22 nt, Human
uaugaaauugccauuuuuaugg

SEQ ID NO: 600006 - RNA, 22 nt, Human
agccacagcccacaggacucuu

SEQ ID NO: 600007 - RNA, 22 nt, Human
auguuucaggcgaacuaacaug

SEQ ID NO: 600008 - RNA, 22 nt, Human
caagauaauuuauucugaguuu

SEQ ID NO: 600009 - RNA, 22 nt, Human
gcagggcagcugaagcuaggug

SEQ ID NO: 600010 - RNA, 22 nt, Human
uuugaagacuacugggagugaa

SEQ ID NO: 600011 - RNA, 22 nt, Human
uuaugauuuagaaagauucacu

SEQ ID NO: 600012 - RNA, 22 nt, Human
gagggccaggcagcaagaaggc

SEQ ID NO: 600013 - RNA, 22 nt, Human
agauccagauccuuccugguug

SEQ ID NO: 600014 - RNA, 22 nt, Human
cuaauguaaaacagacuugcau

SEQ ID NO: 600015 - RNA, 22 nt, Human
uucuugccauauuucagcccuu

SEQ ID NO: 600016 - RNA, 23 nt, Human
ucagcugcuuccuccugccugcc

SEQ ID NO: 600017 - RNA, 22 nt, Human
aacacuggacaggaggcuaggu

SEQ ID NO: 600018 - RNA, 22 nt, Human
cugccuggccugaucuccacgc

SEQ ID NO: 600019 - RNA, 22 nt, Human
cagccacuguggucuagcugca

SEQ ID NO: 600020 - RNA, 22 nt, Human
uauauuccaguucaucucuuga

SEQ ID NO: 600021 - RNA, 22 nt, Human
cauuuauucagcucagucgguu

SEQ ID NO: 600022 - RNA, 16 nt, Human
uccuggggauacugga

SEQ ID NO: 600023 - RNA, 22 nt, Human
auuccuugggcugccuuauuau

SEQ ID NO: 600024 - RNA, 22 nt, Human
gcuuccugagacaacauugagu

SEQ ID NO: 600025 - RNA, 23 nt, Human
cccaggucaaaauucacaggccu

SEQ ID NO: 600026 - RNA, 22 nt, Human
uggauuaguuaagaaauguuag

SEQ ID NO: 600027 - RNA, 22 nt, Human
uaacaguauagccuaacauuuc

SEQ ID NO: 600028 - RNA, 22 nt, Human
aaucauucuuauuucacagcaa

SEQ ID NO: 600029 - RNA, 22 nt, Human
ccagguccuguuuucaccacag

SEQ ID NO: 600030 - RNA, 23 nt, Human
acuuggaagcagugaacaacuuu

SEQ ID NO: 600031 - RNA, 22 nt, Human
ccagcccuacaguaucaccugu

SEQ ID NO: 600032 - RNA, 22 nt, Human
caccagcuccaccagggcaggu

SEQ ID NO: 600033 - RNA, 22 nt, Human
uuuucauuuuuguagaugcaag

SEQ ID NO: 600034 - RNA, 22 nt, Human
gaggcacagagcccuaggagcu

SEQ ID NO: 600035 - RNA, 22 nt, Human
aaaggcaugauuaauucugugu

SEQ ID NO: 600036 - RNA, 22 nt, Human
cacauccuucagcugagcccag

SEQ ID NO: 600037 - RNA, 22 nt, Human
ccucccaccguaucucaguggc

SEQ ID NO: 600038 - RNA, 23 nt, Human
uggaccugaaccagugccucugu

SEQ ID NO: 600039 - RNA, 22 nt, Human
uuccugggguacuggagaaaau

SEQ ID NO: 600040 - RNA, 21 nt, Human
augugcagcaagcagcaugcu

SEQ ID NO: 600041 - RNA, 22 nt, Human
gggggagcuacaggucccuugg

SEQ ID NO: 600042 - RNA, 22 nt, Human
guccuggugcuggucauugucg

SEQ ID NO: 600043 - RNA, 22 nt, Human
uggaaugcauggcucugugacg

SEQ ID NO: 600044 - RNA, 22 nt, Human
uucucucauucaaauuaaagug

SEQ ID NO: 600045 - RNA, 22 nt, Human
aggcuggcugagcugcagccug

SEQ ID NO: 600046 - RNA, 22 nt, Human
aggcacugacaauucuggacug

SEQ ID NO: 600047 - RNA, 22 nt, Human
cucucuggcccauccuguugcc

SEQ ID NO: 600048 - RNA, 22 nt, Human
caaucuuaguggcuuacaaaga

SEQ ID NO: 600049 - RNA, 22 nt, Human
cuuuacagcuuagugguaugga

SEQ ID NO: 600050 - RNA, 22 nt, Human
acagcagucagugaauauuuaa

SEQ ID NO: 600051 - RNA, 22 nt, Human
gguguguguggauuagcaugcc

SEQ ID NO: 600052 - RNA, 22 nt, Human
ugcagaagacacaagguaacgu

SEQ ID NO: 600053 - RNA, 22 nt, Human
ggcaggaaaacaaugagccagg

SEQ ID NO: 600054 - RNA, 22 nt, Human
aguuucuuuagauagaaaguuc

SEQ ID NO: 600055 - RNA, 22 nt, Human
gcugucccgaaccccugguaau

SEQ ID NO: 600056 - RNA, 22 nt, Human
aguuacagcuggcguggggaaa

SEQ ID NO: 600057 - RNA, 17 nt, Human
ugaggccugcaucagug

SEQ ID NO: 600058 - RNA, 20 nt, Human
gcuuagcaggcauaguagcu

SEQ ID NO: 600059 - RNA, 22 nt, Human
auuauuaugguugcucuuuucc

SEQ ID NO: 600060 - RNA, 22 nt, Human
ggaggccaaggaggagcuugcc

SEQ ID NO: 600061 - RNA, 22 nt, Human
cagaaguuagugucugccagua

SEQ ID NO: 600062 - RNA, 21 nt, Human
cuggaggguagaguugggcug

SEQ ID NO: 600063 - RNA, 22 nt, Human
ugucucugggugauucaguccu

SEQ ID NO: 600064 - RNA, 20 nt, Human
uuucuugucggcuguugcug

SEQ ID NO: 600065 - RNA, 22 nt, Human
cagggccagcgcccaggcccag

SEQ ID NO: 600066 - RNA, 22 nt, Human
agauaaugaauuuauugaaugu

SEQ ID NO: 600067 - RNA, 22 nt, Human
ucugcagaacuuuaugagcaaa

SEQ ID NO: 600068 - RNA, 22 nt, Human
cugggcaguaugaauauucaaa

SEQ ID NO: 600069 - RNA, 22 nt, Human
aaguaacuaaagauauccauuu

SEQ ID NO: 600070 - RNA, 22 nt, Human
ugacugccaugagggugagggc

SEQ ID NO: 600071 - RNA, 22 nt, Human
ucuuuguuauugcuuuaucuau

SEQ ID NO: 600072 - RNA, 22 nt, Human
ggcuccauccaaggccuucuag

SEQ ID NO: 600073 - RNA, 22 nt, Human
cagaggccagggggcucacaaa

SEQ ID NO: 600074 - RNA, 22 nt, Human
uuuccucugagugagcugggag

SEQ ID NO: 600075 - RNA, 22 nt, Human
uucucucuuccaguucccacuu

SEQ ID NO: 600076 - RNA, 20 nt, Human
uccuucugaggugaggagga

SEQ ID NO: 600077 - RNA, 22 nt, Human
uccagagacuugcaugugcuug

SEQ ID NO: 600078 - RNA, 21 nt, Human
cucuugcugaugucuccuuua

SEQ ID NO: 600079 - RNA, 22 nt, Human
gaugaguaauagcuaaugguuc

SEQ ID NO: 600080 - RNA, 22 nt, Human
ggagaagcaggugcuuuggguc

SEQ ID NO: 600081 - RNA, 22 nt, Human
uucaauaugauauuagcugugg

SEQ ID NO: 600082 - RNA, 21 nt, Human
caggcucugcugggugcuggg

SEQ ID NO: 600083 - RNA, 22 nt, Human
accagcuguguccuggcugcag

SEQ ID NO: 600084 - RNA, 23 nt, Human
ucacauaauccuucauccacagg

SEQ ID NO: 600085 - RNA, 22 nt, Human
uucucuuuuugcaucucaaccu

SEQ ID NO: 600086 - RNA, 23 nt, Human
gccagagcugccugcccuugcug

SEQ ID NO: 600087 - RNA, 22 nt, Human
cugccuguuagucuagcaguua

SEQ ID NO: 600088 - RNA, 22 nt, Human
gacuagucauuugcauuccguc

SEQ ID NO: 600089 - RNA, 22 nt, Human
agggagagguugaaaccucagu

SEQ ID NO: 600090 - RNA, 22 nt, Human
ucagagaaggcugagucacggc

SEQ ID NO: 600091 - RNA, 22 nt, Human
cagcccaggccgacaguuccuc

SEQ ID NO: 600092 - RNA, 22 nt, Human
aucaggaagccagucuaaugga

SEQ ID NO: 600093 - RNA, 22 nt, Human
gcaguguuuacauauuagaaac

SEQ ID NO: 600094 - RNA, 22 nt, Human
ccugccugcuuucugcuuugca

SEQ ID NO: 600095 - RNA, 22 nt, Human
cagagcuggcggugagaagaca

SEQ ID NO: 600096 - RNA, 22 nt, Human
auuugcacacagucuccugugg

SEQ ID NO: 600097 - RNA, 22 nt, Human
ugcuaauguccugaccguucug

SEQ ID NO: 600098 - RNA, 22 nt, Human
aaagaggcaaucaauguagcaa

SEQ ID NO: 600099 - RNA, 21 nt, Human
ugauucugcauuucuaacagg

SEQ ID NO: 600100 - RNA, 22 nt, Human
ugccagucagugguuuaaaagu

SEQ ID NO: 600101 - RNA, 22 nt, Human
uaguauuuuagaaaaccaugaa

SEQ ID NO: 600102 - RNA, 21 nt, Human
ggagucugaggaagaaaacug

SEQ ID NO: 600103 - RNA, 19 nt, Human
ggcuggagaaaggaaucag

SEQ ID NO: 600104 - RNA, 22 nt, Human
ggacaggggcguggggauuguu

SEQ ID NO: 600105 - RNA, 22 nt, Human
cagggcuggcucaugaaaaguu

SEQ ID NO: 600106 - RNA, 19 nt, Human
auucuucucuuccugcugu

SEQ ID NO: 600107 - RNA, 22 nt, Human
cuuggcugucauaagguccugg

SEQ ID NO: 600108 - RNA, 22 nt, Human
acaaaguuugugguauuccaag

SEQ ID NO: 600109 - RNA, 21 nt, Human
uagagugucugugugggaauu

SEQ ID NO: 600110 - RNA, 22 nt, Human
guuuauaugaacuucauaccca

SEQ ID NO: 600111 - RNA, 21 nt, Human
gcccccuggacuccucaucca

SEQ ID NO: 600112 - RNA, 20 nt, Human
acuuuaugaguucaauuuug

SEQ ID NO: 600113 - RNA, 22 nt, Human
ccucuauguacacauuuccagc

SEQ ID NO: 600114 - RNA, 21 nt, Human
agcagcugggcaacauggagg

SEQ ID NO: 600115 - RNA, 22 nt, Human
cugcuuuaaaacccucagcugg

SEQ ID NO: 600116 - RNA, 22 nt, Human
cugcccagauuuuaccaccugc

SEQ ID NO: 600117 - RNA, 22 nt, Human
uaguuuuaugaauugguauaau

SEQ ID NO: 600118 - RNA, 22 nt, Human
uuuuccuuuggaagaugcauau

SEQ ID NO: 600119 - RNA, 20 nt, Human
aaaaacaguaaugcugaaga

SEQ ID NO: 600120 - RNA, 22 nt, Human
aaauuagaagugcucaggaaua

SEQ ID NO: 600121 - RNA, 22 nt, Human
uggcagagaaccugggcuuugu

SEQ ID NO: 600122 - RNA, 22 nt, Human
gacagggaaacauugaaguguc

SEQ ID NO: 600123 - RNA, 22 nt, Human
uuguuucagcccagaucuuuac

SEQ ID NO: 600124 - RNA, 22 nt, Human
uugcuucagaaguucugcuugu

SEQ ID NO: 600125 - RNA, 22 nt, Human
uggaaagacauguccuucauua

SEQ ID NO: 600126 - RNA, 22 nt, Human
cacugcuugauugacaugcacg

SEQ ID NO: 600127 - RNA, 22 nt, Human
uccagggcagugacuacagcgg

SEQ ID NO: 600128 - RNA, 22 nt, Human
cugagccagggccacacaugga

SEQ ID NO: 600129 - RNA, 22 nt, Human
gcuggagucuacauucaagaau

SEQ ID NO: 600130 - RNA, 22 nt, Human
uacagaaauacugggggguucu

SEQ ID NO: 600131 - RNA, 22 nt, Human
auguuuuuggcuucaaguuucu

SEQ ID NO: 600132 - RNA, 22 nt, Human
uuauuggaaaagggcuguaauu

SEQ ID NO: 600133 - RNA, 22 nt, Human
cagagggcugcccugaguucgu

SEQ ID NO: 600134 - RNA, 22 nt, Human
aggcugagcugguagugaguac

SEQ ID NO: 600135 - RNA, 22 nt, Human
aauucacaauuauguugggaga

SEQ ID NO: 600136 - RNA, 22 nt, Human
uuaccauaaaguuuaucuuucu

SEQ ID NO: 600137 - RNA, 22 nt, Human
caaauacuuuauauacuucaaa

SEQ ID NO: 600138 - RNA, 22 nt, Human
uuugaaagacagaauauuuuug

SEQ ID NO: 600139 - RNA, 20 nt, Human
gccacugggcaccagcaggg

SEQ ID NO: 600140 - RNA, 18 nt, Human
caggccucuugaucuucc

SEQ ID NO: 600141 - RNA, 22 nt, Human
ucucuuaacugguucagcaauu

SEQ ID NO: 600142 - RNA, 22 nt, Human
agaguaauuucugcugaaaagg

SEQ ID NO: 600143 - RNA, 22 nt, Human
auugcauugcagcuagauuuug

SEQ ID NO: 600144 - RNA, 19 nt, Human
gucagcaccauggacaggg

SEQ ID NO: 600145 - RNA, 22 nt, Human
ucauaauuguauacauuuaugg

SEQ ID NO: 600146 - RNA, 22 nt, Human
cugaggagcagcuggcccgcua

SEQ ID NO: 600147 - RNA, 22 nt, Human
ccagcuuguuugaagcucguca

SEQ ID NO: 600148 - RNA, 22 nt, Human
ugggagaggcugccaucuugca

SEQ ID NO: 600149 - RNA, 22 nt, Human
aaagcaguauauugguaguugu

SEQ ID NO: 600150 - RNA, 22 nt, Human
ucugcuuuauuacacuagccaa

SEQ ID NO: 600151 - RNA, 19 nt, Human
uucuguguuaauuccuuua

SEQ ID NO: 600152 - RNA, 22 nt, Human
gugcagcuuccuggucucagcc

SEQ ID NO: 600153 - RNA, 22 nt, Human
ggcugccagcacugguguagag

SEQ ID NO: 600154 - RNA, 22 nt, Human
gcugagagcggccagcugggaa

SEQ ID NO: 600155 - RNA, 22 nt, Human
cuugagaaaggaacaggaagcu

SEQ ID NO: 600156 - RNA, 22 nt, Human
uagaauaugugguguauacuuu

SEQ ID NO: 600157 - RNA, 22 nt, Human
uaacuacaagggcggucucugu

SEQ ID NO: 600158 - RNA, 22 nt, Human
gcuuucugguucucaaagcacu

SEQ ID NO: 600159 - RNA, 22 nt, Human
cuagucacuguaauaaucugcu

SEQ ID NO: 600160 - RNA, 22 nt, Human
gucaaguuaagauaaggucaug

SEQ ID NO: 600161 - RNA, 22 nt, Human
uaacaauuugcuucauuuguuu

SEQ ID NO: 600162 - RNA, 22 nt, Human
guggagggaaugaaucuucucu

SEQ ID NO: 600163 - RNA, 22 nt, Human
auuuuuucuguaaacuggccuu

SEQ ID NO: 600164 - RNA, 22 nt, Human
cugagcagaccauggcagaggu

SEQ ID NO: 600165 - RNA, 22 nt, Human
ggcccacaccaggggccacagu

SEQ ID NO: 600166 - RNA, 22 nt, Human
ucuugacauucaaucauguaua

SEQ ID NO: 600167 - RNA, 22 nt, Human
ucuuucuuacaaagaaaacggu

SEQ ID NO: 600168 - RNA, 22 nt, Human
agaggccaggcugcagagggau

SEQ ID NO: 600169 - RNA, 22 nt, Human
cagagcucagagcugccaggca

SEQ ID NO: 600170 - RNA, 22 nt, Human
aguuuucugcuaaaccagcuaa

SEQ ID NO: 600171 - RNA, 22 nt, Human
caagcagccccaacaugaggau

SEQ ID NO: 600172 - RNA, 22 nt, Human
guguagauaguuuagauuucaa

SEQ ID NO: 600173 - RNA, 22 nt, Human
aggcacuggguaauuaguagcu

SEQ ID NO: 600174 - RNA, 22 nt, Human
ucuguccaggcuuacuauauau

SEQ ID NO: 600175 - RNA, 19 nt, Human
cacuagucuagaugggaug

SEQ ID NO: 600176 - RNA, 23 nt, Human
ugguggcuugugguggccaccag

SEQ ID NO: 600177 - RNA, 22 nt, Human
aaguccuuggagaauagaaagg

SEQ ID NO: 600178 - RNA, 22 nt, Human
uucuucuccuaaggagaguccu

SEQ ID NO: 600179 - RNA, 22 nt, Human
gcuggagugagggaccauauuu

SEQ ID NO: 600180 - RNA, 22 nt, Human
gaagagaugacaaaggagcaug

SEQ ID NO: 600181 - RNA, 22 nt, Human
aguuuauguuguuuauaagcca

SEQ ID NO: 600182 - RNA, 22 nt, Human
acccugagggaugagaguugca

SEQ ID NO: 600183 - RNA, 22 nt, Human
acuugaauaggugucaaggcca

SEQ ID NO: 600184 - RNA, 22 nt, Human
ugggagcaggaagcaggaagua

SEQ ID NO: 600185 - RNA, 21 nt, Human
ggagauguugugcaggagggu

SEQ ID NO: 600186 - RNA, 22 nt, Human
cugagcucuaaugucagccuug

SEQ ID NO: 600187 - RNA, 22 nt, Human
gcagcagcccagggcucucaga

SEQ ID NO: 600188 - RNA, 22 nt, Human
gagauggggucagcugggacau

SEQ ID NO: 600189 - RNA, 22 nt, Human
acaggccuggaaaggaaggagu

SEQ ID NO: 600190 - RNA, 22 nt, Human
uguuuuguuuaugagagcacag

SEQ ID NO: 600191 - RNA, 21 nt, Human
uccagggaauuucaacuuuua

SEQ ID NO: 600192 - RNA, 22 nt, Human
aggcucuccagagagcugcuuu

SEQ ID NO: 600193 - RNA, 22 nt, Human
aaggauugucuggcuauuuaug

SEQ ID NO: 600194 - RNA, 22 nt, Human
gggcugagggccaauuccuacu

SEQ ID NO: 600195 - RNA, 22 nt, Human
gcuuccaggggcugugggcuga

SEQ ID NO: 600196 - RNA, 22 nt, Human
uccugugggcucucggccucca

SEQ ID NO: 600197 - RNA, 22 nt, Human
aagcauuucaauauaauauuca

SEQ ID NO: 600198 - RNA, 19 nt, Human
caguuacaggcacuguggg

SEQ ID NO: 600199 - RNA, 22 nt, Human
gaugucuucucaacuguagacc

SEQ ID NO: 600200 - RNA, 22 nt, Human
ggagucuguuuuacaugcagga

SEQ ID NO: 600201 - RNA, 22 nt, Human
aaggcuuggaguaagcuuggcu

SEQ ID NO: 600202 - RNA, 22 nt, Human
auuugcuucuagucaguuccau

SEQ ID NO: 600203 - RNA, 22 nt, Human
cuccccauuaugcagucauuau

SEQ ID NO: 600204 - RNA, 22 nt, Human
caaauguuucuugaacaccaac

SEQ ID NO: 600205 - RNA, 22 nt, Human
aggugucauuucucugcaggug

SEQ ID NO: 600206 - RNA, 22 nt, Human
uggcuuucgcuauagagcacgg

SEQ ID NO: 600207 - RNA, 22 nt, Human
gcuugaaaaugacucuugugaa

SEQ ID NO: 600208 - RNA, 21 nt, Human
uccuggccagggcacuaggca

SEQ ID NO: 600209 - RNA, 22 nt, Human
agcugcuuugccaaugcguucc

SEQ ID NO: 600210 - RNA, 21 nt, Human
agaucccugaggagagcaucc

SEQ ID NO: 600211 - RNA, 22 nt, Human
ucuugauugguuguauagcuac

SEQ ID NO: 600212 - RNA, 22 nt, Human
auccugaaaacuuacgaagugg

SEQ ID NO: 600213 - RNA, 22 nt, Human
cggggcaggagucccuguagag

SEQ ID NO: 600214 - RNA, 22 nt, Human
uuggcucauuaaagaugauaau

SEQ ID NO: 600215 - RNA, 22 nt, Human
caggcuugcugcuagagcacuu

SEQ ID NO: 600216 - RNA, 22 nt, Human
aggaaugacagauguccgcacc

SEQ ID NO: 600217 - RNA, 22 nt, Human
ugaacacacaccuauguacaaa

SEQ ID NO: 600218 - RNA, 22 nt, Human
aaagcaauggaugagaaucugu

SEQ ID NO: 600219 - RNA, 22 nt, Human
aguggcuugcucugccucagcc

SEQ ID NO: 600220 - RNA, 22 nt, Human
cuugugcaaauccucgagcaca

SEQ ID NO: 600221 - RNA, 22 nt, Human
acuugccuccauauuuuauugc

SEQ ID NO: 600222 - RNA, 18 nt, Human
aagaggcuguucuguggg

SEQ ID NO: 600223 - RNA, 18 nt, Human
ugacagaaccuggagccu

SEQ ID NO: 600224 - RNA, 22 nt, Human
gagaaggagcucaaauauggcu

SEQ ID NO: 600225 - RNA, 22 nt, Human
gcuggugccuuguuguuguuac

SEQ ID NO: 600226 - RNA, 22 nt, Human
uuauuguagcacuuuggcagug

SEQ ID NO: 600227 - RNA, 22 nt, Human
ccuuccuuugcaucauuucuag

SEQ ID NO: 600228 - RNA, 22 nt, Human
agcccuggggugcagaaccaug

SEQ ID NO: 600229 - RNA, 22 nt, Human
agcaccagcaacuaugggcugc

SEQ ID NO: 600230 - RNA, 22 nt, Human
ucauccuuuugcaugggaaggc

SEQ ID NO: 600231 - RNA, 18 nt, Human
uggaggcagaguucuggc

SEQ ID NO: 600232 - RNA, 22 nt, Human
aaagaagacagacauuucuuuc

SEQ ID NO: 600233 - RNA, 22 nt, Human
agaaauagaggaaagguuugac

SEQ ID NO: 600234 - RNA, 22 nt, Human
gugggcagccccuucaaggcca

SEQ ID NO: 600235 - RNA, 22 nt, Human
caacuacaggaaaagucauuca

SEQ ID NO: 600236 - RNA, 22 nt, Human
caggucccguuccccagagauu

SEQ ID NO: 600237 - RNA, 22 nt, Human
ucugggcuuuaagaacucuguu

SEQ ID NO: 600238 - RNA, 22 nt, Human
aggcugagcugaccugguuugg

SEQ ID NO: 600239 - RNA, 22 nt, Human
cacagucucuguugcugggacc

SEQ ID NO: 600240 - RNA, 22 nt, Human
gagugugggggugcugaggaca

SEQ ID NO: 600241 - RNA, 22 nt, Human
accagcaguuaugaggccagga

SEQ ID NO: 600242 - RNA, 22 nt, Human
ucaggaagaaagaagggagugu

SEQ ID NO: 600243 - RNA, 22 nt, Human
ucucuucacauuccuggcaaac

SEQ ID NO: 600244 - RNA, 22 nt, Human
cucccagguuacaucugagccu

SEQ ID NO: 600245 - RNA, 22 nt, Human
cucucugggcccaguuggcacc

SEQ ID NO: 600246 - RNA, 23 nt, Human
gccuggccaccccagggcugcuu

SEQ ID NO: 600247 - RNA, 22 nt, Human
uuguacaaaugcauauuccugg

SEQ ID NO: 600248 - RNA, 22 nt, Human
uuucuggcagcgggacaggggu

SEQ ID NO: 600249 - RNA, 22 nt, Human
aggaacuggggcuauucacccu

SEQ ID NO: 600250 - RNA, 22 nt, Human
uauuaugaggcuuagggaugac

SEQ ID NO: 600251 - RNA, 22 nt, Human
cuguuuauggagguaaggcauc

SEQ ID NO: 600252 - RNA, 22 nt, Human
gcaguggcagcugaggggguau

SEQ ID NO: 600253 - RNA, 22 nt, Human
ccagaagaccggggagucaggg

SEQ ID NO: 600254 - RNA, 22 nt, Human
agacaacuagaaaacuagacag

SEQ ID NO: 600255 - RNA, 20 nt, Human
aaaguucauguuugcacuuu

SEQ ID NO: 600256 - RNA, 23 nt, Human
ucauuucacagugagcuuccuag

SEQ ID NO: 600257 - RNA, 22 nt, Human
gcucccugaaaagaacaaaguc

SEQ ID NO: 600258 - RNA, 22 nt, Human
auuuucucucaaaccuuaaaau

SEQ ID NO: 600259 - RNA, 22 nt, Human
ucccaaagucaagcugugucuu

SEQ ID NO: 600260 - RNA, 21 nt, Human
uucauaaaccauucucaugca

SEQ ID NO: 600261 - RNA, 22 nt, Human
gccagggggucagcaggcacuu

SEQ ID NO: 600262 - RNA, 22 nt, Human
cagaggccccagaacuagcucu

SEQ ID NO: 600263 - RNA, 22 nt, Human
ggcucuucacacagugauguca

SEQ ID NO: 600264 - RNA, 22 nt, Human
gcaguguguguccccacacugg

SEQ ID NO: 600265 - RNA, 22 nt, Human
ucugccugaaauucacauguaa

SEQ ID NO: 600266 - RNA, 22 nt, Human
ggaggagcccacucaaagggga

SEQ ID NO: 600267 - RNA, 22 nt, Human
ucuguguccugcuagcugucuu

SEQ ID NO: 600268 - RNA, 22 nt, Human
ggagaugcaauguagaaucugg

SEQ ID NO: 600269 - RNA, 22 nt, Human
ccugggccuauccuagaaccaa

SEQ ID NO: 600270 - RNA, 23 nt, Human
ccagcccuccaccagcucuaggc

SEQ ID NO: 600271 - RNA, 22 nt, Human
uggccugggcaugaagcaucgu

SEQ ID NO: 600272 - RNA, 19 nt, Human
ucagcuggcaggccuccuc

SEQ ID NO: 600273 - RNA, 22 nt, Human
cagaggcacaagaaagcaaggc

SEQ ID NO: 600274 - RNA, 22 nt, Human
ucuacagucaaguuauauugcu

SEQ ID NO: 600275 - RNA, 22 nt, Human
aauagcuuggacccauugcuuu

SEQ ID NO: 600276 - RNA, 22 nt, Human
acugagagcguguacaaacuua

SEQ ID NO: 600277 - RNA, 22 nt, Human
ucccaggaauccguccucuaga

SEQ ID NO: 600278 - RNA, 22 nt, Human
cuauggaaaccuaaucaggaga

SEQ ID NO: 600279 - RNA, 22 nt, Human
uagaaacagagcagguggccca

SEQ ID NO: 600280 - RNA, 22 nt, Human
auuauaugugggauagaauuua

SEQ ID NO: 600281 - RNA, 22 nt, Human
ucaaauuaguggaauaauaaug

SEQ ID NO: 600282 - RNA, 22 nt, Human
gacagccaggucugaugaccca

SEQ ID NO: 600283 - RNA, 22 nt, Human
caagcaggguuuaugcauggag

SEQ ID NO: 600284 - RNA, 22 nt, Human
uguauuccaaaaugcugaggau

SEQ ID NO: 600285 - RNA, 22 nt, Human
cagcagcaacaacggaagccuu

SEQ ID NO: 600286 - RNA, 22 nt, Human
agagggcauaaaauagagcacg

SEQ ID NO: 600287 - RNA, 22 nt, Human
ggugugggggcaaguuugagau

SEQ ID NO: 600288 - RNA, 22 nt, Human
gcuggaguacaucuuuggcggc

SEQ ID NO: 600289 - RNA, 22 nt, Human
cugucuccagggcaggugcagg

SEQ ID NO: 600290 - RNA, 22 nt, Human
gaggcagaaguugcagugagca

SEQ ID NO: 600291 - RNA, 22 nt, Human
gacaggcagaccugugcccugg

SEQ ID NO: 600292 - RNA, 22 nt, Human
auucuacaugauagaagggaga

SEQ ID NO: 600293 - RNA, 22 nt, Human
ucagccccacggggucagccaa

SEQ ID NO: 600294 - RNA, 22 nt, Human
uuuucucccgcuggcugcucuu

SEQ ID NO: 600295 - RNA, 22 nt, Human
cccucccaggaguggccagaga

SEQ ID NO: 600296 - RNA, 22 nt, Human
gggcaggaugcaguuucagaga

SEQ ID NO: 600297 - RNA, 22 nt, Human
cagccagugugaccgaggagga

SEQ ID NO: 600298 - RNA, 22 nt, Human
uggccuggaagagaggucgagg

SEQ ID NO: 600299 - RNA, 22 nt, Human
uugauucugauccugucuggag

SEQ ID NO: 600300 - RNA, 20 nt, Human
ugacacaaauugcuuucuca

SEQ ID NO: 600301 - RNA, 22 nt, Human
ugagggagagggcgaaaaugaa

SEQ ID NO: 600302 - RNA, 22 nt, Human
ucaggaacccuggucuccugcu

SEQ ID NO: 600303 - RNA, 19 nt, Human
ggaugagggucaggcauag

SEQ ID NO: 600304 - RNA, 22 nt, Human
uccugccuguuuaccuguacuu

SEQ ID NO: 600305 - RNA, 22 nt, Human
cuccugggcuaugucugcuugg

SEQ ID NO: 600306 - RNA, 22 nt, Human
uaugaauucucuuguguauagu

SEQ ID NO: 600307 - RNA, 22 nt, Human
auuauaaauauuuucuaggggu

SEQ ID NO: 600308 - RNA, 22 nt, Human
gcccagggcgauggucggggcc

SEQ ID NO: 600309 - RNA, 22 nt, Human
uuggcccagggucagcggcgcu

SEQ ID NO: 600310 - RNA, 22 nt, Human
acauuaaaauggagaauuuuga

SEQ ID NO: 600311 - RNA, 20 nt, Human
gccuccacacucaccccuua

SEQ ID NO: 600312 - RNA, 22 nt, Human
agaggggcucaagcaguggucu

SEQ ID NO: 600313 - RNA, 22 nt, Human
cagcucugcugguggugccagg

SEQ ID NO: 600314 - RNA, 22 nt, Human
ggcugaugagcuuagcuagaga

SEQ ID NO: 600315 - RNA, 22 nt, Human
accuccccacaugguagugagu

SEQ ID NO: 600316 - RNA, 22 nt, Human
cccugccuuguuggagccuaug

SEQ ID NO: 600317 - RNA, 22 nt, Human
ugagcagaaaagaaugcugagc

SEQ ID NO: 600318 - RNA, 22 nt, Human
ggcaggcugggagucaucagag

SEQ ID NO: 600319 - RNA, 22 nt, Human
aauuaaaaaaggagagcuugcu

SEQ ID NO: 600320 - RNA, 22 nt, Human
acaguuuaucgauucaccuacc

SEQ ID NO: 600321 - RNA, 22 nt, Human
agacaugguuuauuuuaauggu

SEQ ID NO: 600322 - RNA, 22 nt, Human
ugcugcugcuucuguacagccu

SEQ ID NO: 600323 - RNA, 23 nt, Human
uuaaacuucagugcagaacacuc

SEQ ID NO: 600324 - RNA, 22 nt, Human
guauaaaguauaagcuuguuuu

SEQ ID NO: 600325 - RNA, 22 nt, Human
gacugcuuugacaaaugauacc

SEQ ID NO: 600326 - RNA, 22 nt, Human
agcuggugugccaguuccaguu

SEQ ID NO: 600327 - RNA, 22 nt, Human
ugacuucuagcauuuagcaacc

SEQ ID NO: 600328 - RNA, 22 nt, Human
ggagggguggucgcgaagagca

SEQ ID NO: 600329 - RNA, 22 nt, Human
gcucuggcagcugauauuagga

SEQ ID NO: 600330 - RNA, 18 nt, Human
gcugagcaaauuccuccc

SEQ ID NO: 600331 - RNA, 22 nt, Human
gagagcugggggacuguggaug

SEQ ID NO: 600332 - RNA, 22 nt, Human
uaauacuuaccuugcagagucu

SEQ ID NO: 600333 - RNA, 22 nt, Human
agaauucucuuccauugaaaca

SEQ ID NO: 600334 - RNA, 22 nt, Human
auuuuaugacacgauucuucca

SEQ ID NO: 600335 - RNA, 22 nt, Human
accaaaaauuguggggcugaau

SEQ ID NO: 600336 - RNA, 22 nt, Human
agaaaauaauuucuuggcuggu

SEQ ID NO: 600337 - RNA, 22 nt, Human
cauuuacaauguacagguugug

SEQ ID NO: 600338 - RNA, 22 nt, Human
gcucucuguuauuaagaucuuu

SEQ ID NO: 600339 - RNA, 22 nt, Human
acaguggaauggugggccugca

SEQ ID NO: 600340 - RNA, 22 nt, Human
aagcacaauuuaggacugaaau

SEQ ID NO: 600341 - RNA, 22 nt, Human
gccgggaccaaggccacggagc

SEQ ID NO: 600342 - RNA, 22 nt, Human
agccuggaauuaaggaaaugca

SEQ ID NO: 600343 - RNA, 22 nt, Human
ccuuucuguguugcccuauuug

SEQ ID NO: 600344 - RNA, 22 nt, Human
cugagucauugcagauguggag

SEQ ID NO: 600345 - RNA, 17 nt, Human
ggccuugggcugcucuu

SEQ ID NO: 600346 - RNA, 22 nt, Human
acauuaacaccauaaguguguu

SEQ ID NO: 600347 - RNA, 22 nt, Human
ccaggagacccagggaaggagc

SEQ ID NO: 600348 - RNA, 21 nt, Human
agcagaacagucgagcacugc

SEQ ID NO: 600349 - RNA, 22 nt, Human
auuuacagccuugccaucuaua

SEQ ID NO: 600350 - RNA, 22 nt, Human
ccagggcagccaacccagaugc

SEQ ID NO: 600351 - RNA, 22 nt, Human
cucugccugcccaccgacccau

SEQ ID NO: 600352 - RNA, 22 nt, Human
ccccuucucugcaagccugcuc

SEQ ID NO: 600353 - RNA, 22 nt, Human
uuagcugagauuaagugaacuu

SEQ ID NO: 600354 - RNA, 22 nt, Human
cugggccuggagcccacgagcc

SEQ ID NO: 600355 - RNA, 21 nt, Human
cacaagacacauaggguguuu

SEQ ID NO: 600356 - RNA, 22 nt, Human
gcagccacuaguuuuccuguuu

SEQ ID NO: 600357 - RNA, 22 nt, Human
ugcaggcugccuucacagagcc

SEQ ID NO: 600358 - RNA, 20 nt, Human
ucuguggcagguggcgcuug

SEQ ID NO: 600359 - RNA, 20 nt, Human
ucauuucuugggguuccaag

SEQ ID NO: 600360 - RNA, 22 nt, Human
gauuucuacuugaacuugcuaa

SEQ ID NO: 600361 - RNA, 22 nt, Human
ugugaaaucacaggcuauuuag

SEQ ID NO: 600362 - RNA, 22 nt, Human
cucugucccagacccaccucuc

SEQ ID NO: 600363 - RNA, 22 nt, Human
gaggcccaggucaagcagccac

SEQ ID NO: 600364 - RNA, 21 nt, Human
acagcaagccuuccuuucagg

SEQ ID NO: 600365 - RNA, 19 nt, Human
ccugcugcaccacuuguua

SEQ ID NO: 600366 - RNA, 22 nt, Human
aggacuggcggucgguggggau

SEQ ID NO: 600367 - RNA, 22 nt, Human
gcugggcugagcuagacuuggc

SEQ ID NO: 600368 - RNA, 22 nt, Human
ucaccaaggcauuuucacagca

SEQ ID NO: 600369 - RNA, 22 nt, Human
gaaggcugcugggaaguguggu

SEQ ID NO: 600370 - RNA, 22 nt, Human
cccaggagaucuggaucucguc

SEQ ID NO: 600371 - RNA, 22 nt, Human
ucuuuaauuguggaagagcagc

SEQ ID NO: 600372 - RNA, 22 nt, Human
uaccuggaauuuauauagcuau

SEQ ID NO: 600373 - RNA, 22 nt, Human
uacauggauguuauccuuacug

SEQ ID NO: 600374 - RNA, 22 nt, Human
uccagcuugccuggucuuuugg

SEQ ID NO: 600375 - RNA, 22 nt, Human
cugcaggaggauccugagagug

SEQ ID NO: 600376 - RNA, 22 nt, Human
gcugggugucacggggcucgug

SEQ ID NO: 600377 - RNA, 22 nt, Human
auuuucauuuugcagggugaga

SEQ ID NO: 600378 - RNA, 22 nt, Human
ggaauaaagaaucugguucccc

SEQ ID NO: 600379 - RNA, 22 nt, Human
auaaaaguucaagagaguacag

SEQ ID NO: 600380 - RNA, 22 nt, Human
ucaaccagaguuuuucuuaaua

SEQ ID NO: 600381 - RNA, 22 nt, Human
cagcacccuuuccacugccuug

SEQ ID NO: 600382 - RNA, 22 nt, Human
gugaggucaaagccuuggguau

SEQ ID NO: 600383 - RNA, 22 nt, Human
uuauccaaacuggugaaucauu

SEQ ID NO: 600384 - RNA, 22 nt, Human
uauauggauagugaucauaaga

SEQ ID NO: 600385 - RNA, 22 nt, Human
uucagagccacuucaagucuaa

SEQ ID NO: 600386 - RNA, 22 nt, Human
gugggugcggggagccgaggcg

SEQ ID NO: 600387 - RNA, 23 nt, Human
ggccuaugggcaggcaaggaagc

SEQ ID NO: 600388 - RNA, 22 nt, Human
cagguuucuaguucuaagaaua

SEQ ID NO: 600389 - RNA, 22 nt, Human
gccccagguugccugucccagg

SEQ ID NO: 600390 - RNA, 22 nt, Human
acuguccauaauauuggugaac

SEQ ID NO: 600391 - RNA, 21 nt, Human
gugcucugggcagcagagggc

SEQ ID NO: 600392 - RNA, 22 nt, Human
aaagcaauuuaauggaccauga

SEQ ID NO: 600393 - RNA, 22 nt, Human
ccacccagccagaugcaggaag

SEQ ID NO: 600394 - RNA, 22 nt, Human
acccaggauagagugcugcagu

SEQ ID NO: 600395 - RNA, 22 nt, Human
uuggcccugaggaggcagcugc

SEQ ID NO: 600396 - RNA, 22 nt, Human
gcccccucuuuggagccagcca

SEQ ID NO: 600397 - RNA, 22 nt, Human
uccugccucaggcucuggagua

SEQ ID NO: 600398 - RNA, 22 nt, Human
ggagaaggugcuggucacugug

SEQ ID NO: 600399 - RNA, 18 nt, Human
gaggaacauucaccuccu

SEQ ID NO: 600400 - RNA, 19 nt, Human
aggguccagggagcggcuc

SEQ ID NO: 600401 - RNA, 22 nt, Human
ccacacagggggaugaguuauu

SEQ ID NO: 600402 - RNA, 21 nt, Human
uagggcaggcauuggaagaga

SEQ ID NO: 600403 - RNA, 22 nt, Human
agauuuaaauuugcuacaauuc

SEQ ID NO: 600404 - RNA, 22 nt, Human
ccucugaggugagcccagcugg

SEQ ID NO: 600405 - RNA, 22 nt, Human
aaacaguaaguucuaguauuau

SEQ ID NO: 600406 - RNA, 22 nt, Human
cacagcuuagaaaagaagccau

SEQ ID NO: 600407 - RNA, 22 nt, Human
ggggagcaauugcccccuuaga

SEQ ID NO: 600408 - RNA, 22 nt, Human
ggccuggagucagggaaagcaa

SEQ ID NO: 600409 - RNA, 22 nt, Human
agcuggagcuucaagcagguaa

SEQ ID NO: 600410 - RNA, 22 nt, Human
ugugugcucuaaugccuaguac

SEQ ID NO: 600411 - RNA, 19 nt, Human
gaggcccaugagggugcuc

SEQ ID NO: 600412 - RNA, 22 nt, Human
ucccugcccucagugcacccgg

SEQ ID NO: 600413 - RNA, 19 nt, Human
acccaggguugauguccag

SEQ ID NO: 600414 - RNA, 21 nt, Human
acuuugggcacuuuccugccc

SEQ ID NO: 600415 - RNA, 22 nt, Human
gccugccugcugugugcaaguu

SEQ ID NO: 600416 - RNA, 18 nt, Human
ugggagugggaguggaua

SEQ ID NO: 600417 - RNA, 22 nt, Human
aaugcacaaaggugucuauugc

SEQ ID NO: 600418 - RNA, 22 nt, Human
gaggugaaaguuauucauuuau

SEQ ID NO: 600419 - RNA, 22 nt, Human
caugcuaaccagagacauaaag

SEQ ID NO: 600420 - RNA, 22 nt, Human
gagggaggcaucaugaauccag

SEQ ID NO: 600421 - RNA, 22 nt, Human
guacauuucucccaacacuaaa

SEQ ID NO: 600422 - RNA, 22 nt, Human
ggagacccagguuaggaaguaa

SEQ ID NO: 600423 - RNA, 22 nt, Human
cuguggaguguagaugcugggu

SEQ ID NO: 600424 - RNA, 22 nt, Human
ggcccaaggcccaggucgagcu

SEQ ID NO: 600425 - RNA, 22 nt, Human
caggggaagaugccaagggaga

SEQ ID NO: 600426 - RNA, 22 nt, Human
augcaccugaacuccaucagcu

SEQ ID NO: 600427 - RNA, 22 nt, Human
gacagggaggagcagagcuucu

SEQ ID NO: 600428 - RNA, 22 nt, Human
agcugaggacgugaagggcggc

SEQ ID NO: 600429 - RNA, 22 nt, Human
uguagggagaagagaggcaccu

SEQ ID NO: 600430 - RNA, 22 nt, Human
cuugccugaggaacagagggua

SEQ ID NO: 600431 - RNA, 19 nt, Human
agagccagacagcauagga

SEQ ID NO: 600432 - RNA, 22 nt, Human
gauuuucaugauaaacuuguga

SEQ ID NO: 600433 - RNA, 23 nt, Human
ccagcuccgugagccucgggcuc

SEQ ID NO: 600434 - RNA, 22 nt, Human
uaugcagugagcacuauuuaua

SEQ ID NO: 600435 - RNA, 22 nt, Human
aacuuuacuugaaagaacaugu

SEQ ID NO: 600436 - RNA, 22 nt, Human
augggaggaugcucgggugcuc

SEQ ID NO: 600437 - RNA, 22 nt, Human
ugugugacccccagugaagccu

SEQ ID NO: 600438 - RNA, 22 nt, Human
cuccaggacacuaacccaggcu

SEQ ID NO: 600439 - RNA, 22 nt, Human
gagcuggaggcagugcugaggu

SEQ ID NO: 600440 - RNA, 22 nt, Human
ucacaguaaaagcauggaagag

SEQ ID NO: 600441 - RNA, 22 nt, Human
gugcagagaaaugagaagucga

SEQ ID NO: 600442 - RNA, 22 nt, Human
gacagaggagaagaugcugugg

SEQ ID NO: 600443 - RNA, 22 nt, Human
ugagcuguacuccuccccaggg

SEQ ID NO: 600444 - RNA, 22 nt, Human
cagcugagucugagguucuuug

SEQ ID NO: 600445 - RNA, 22 nt, Human
uaaugaauaaacuugagaguca

SEQ ID NO: 600446 - RNA, 22 nt, Human
aaguguuuccauugugcaggcu

SEQ ID NO: 600447 - RNA, 22 nt, Human
aacuguguccuuagcucucacu

SEQ ID NO: 600448 - RNA, 22 nt, Human
ucucaggaauagaguggcagca

SEQ ID NO: 600449 - RNA, 19 nt, Human
uccagggcuuuauggcuuu

SEQ ID NO: 600450 - RNA, 23 nt, Human
aggcauggcauggaugguggcuc

SEQ ID NO: 600451 - RNA, 22 nt, Human
ugagaacaguuggaagcaguca

SEQ ID NO: 600452 - RNA, 22 nt, Human
ucuacauuccuuuuauaauauc

SEQ ID NO: 600453 - RNA, 22 nt, Human
gggcuggcucccagguguugaa

SEQ ID NO: 600454 - RNA, 22 nt, Human
gcccugccugccgguguggguc

SEQ ID NO: 600455 - RNA, 22 nt, Human
augagggaggcaaggagaugcu

SEQ ID NO: 600456 - RNA, 22 nt, Human
aagugucuuuuagccacuuuua

SEQ ID NO: 600457 - RNA, 22 nt, Human
aauuggcaagcagauuuccacu

SEQ ID NO: 600458 - RNA, 22 nt, Human
cuggcucaccuccgcuccagca

SEQ ID NO: 600459 - RNA, 22 nt, Human
cucccagggucuaggcugcugg

SEQ ID NO: 600460 - RNA, 22 nt, Human
gcuuuucauagauaaaauucua

SEQ ID NO: 600461 - RNA, 22 nt, Human
uuucuuuuacaguguggcuauu

SEQ ID NO: 600462 - RNA, 22 nt, Human
ggcgaggccgggacaggcugga

SEQ ID NO: 600463 - RNA, 22 nt, Human
cagucagggacaccagcuagga

SEQ ID NO: 600464 - RNA, 22 nt, Human
ccuuagaaggcugaauaauucu

SEQ ID NO: 600465 - RNA, 22 nt, Human
ucagcuuugcaaguuagaaaau

SEQ ID NO: 600466 - RNA, 22 nt, Human
gcccacagcucguuccucuccu

SEQ ID NO: 600467 - RNA, 22 nt, Human
uguuugcacauucguuucaaua

SEQ ID NO: 600468 - RNA, 22 nt, Human
ggaaggaacaaacccugugugg

SEQ ID NO: 600469 - RNA, 22 nt, Human
aguccaagaucaaggugucagg

SEQ ID NO: 600470 - RNA, 22 nt, Human
aaacuucagggaauaaaagagu

SEQ ID NO: 600471 - RNA, 22 nt, Human
uacaagaaauuucugcauauau

SEQ ID NO: 600472 - RNA, 22 nt, Human
uuuuguaauuuccugacgacua

SEQ ID NO: 600473 - RNA, 22 nt, Human
gggugaagcuccugcaggggcc

SEQ ID NO: 600474 - RNA, 22 nt, Human
cagauaaauagauagauaaacu

SEQ ID NO: 600475 - RNA, 23 nt, Human
ucccaggaaucugcauuuuuaac

SEQ ID NO: 600476 - RNA, 22 nt, Human
cccuccccacaaagcuucacac

SEQ ID NO: 600477 - RNA, 22 nt, Human
cagccagcugucccaagugccu

SEQ ID NO: 600478 - RNA, 22 nt, Human
uguggcauugaauaaccuugga

SEQ ID NO: 600479 - RNA, 20 nt, Human
ucugugugccaucaccuaac

SEQ ID NO: 600480 - RNA, 22 nt, Human
cucuuaauuaagcugagaucug

SEQ ID NO: 600481 - RNA, 20 nt, Human
gguagcugcugcaguuggua

SEQ ID NO: 600482 - RNA, 23 nt, Human
agcccagcagagaaccuaggucc

SEQ ID NO: 600483 - RNA, 22 nt, Human
gcugaaaaauagugucguguuu

SEQ ID NO: 600484 - RNA, 22 nt, Human
aaaucucacuguagucaaagug

SEQ ID NO: 600485 - RNA, 22 nt, Human
aagaugcuugcaaauuucugaa

SEQ ID NO: 600486 - RNA, 22 nt, Human
cuagcuucaaguccuggcugug

SEQ ID NO: 600487 - RNA, 22 nt, Human
augucaaaucaguuuuaucaga

SEQ ID NO: 600488 - RNA, 19 nt, Human
ucuguggcaccugggaggg

SEQ ID NO: 600489 - RNA, 22 nt, Human
caggagaggaggcuacuucuua

SEQ ID NO: 600490 - RNA, 22 nt, Human
caacagcucagacacgggaccu

SEQ ID NO: 600491 - RNA, 22 nt, Human
gaccagcugauaaggcauauaa

SEQ ID NO: 600492 - RNA, 22 nt, Human
ccaggaagcggugagggcugcc

SEQ ID NO: 600493 - RNA, 22 nt, Human
agcacccuggggaagcacaaag

SEQ ID NO: 600494 - RNA, 22 nt, Human
gaaacagucaacuuucuuuccc

SEQ ID NO: 600495 - RNA, 22 nt, Human
uucaaagugcuguucaaaguag

SEQ ID NO: 600496 - RNA, 22 nt, Human
guuuucaauuauaagauggcuu

SEQ ID NO: 600497 - RNA, 22 nt, Human
gccagcaguccugcugugugcc

SEQ ID NO: 600498 - RNA, 22 nt, Human
ggaagcugugcucucaggccuc

SEQ ID NO: 600499 - RNA, 22 nt, Human
ucaccaggauugggcuguaggc

SEQ ID NO: 600500 - RNA, 22 nt, Human
ugaggccaggcaaaggcgaucu

SEQ ID NO: 600501 - RNA, 22 nt, Human
ccucccuuuuggugucugcaua

SEQ ID NO: 600502 - RNA, 22 nt, Human
caucagcuuuggcgcugagcau

SEQ ID NO: 600503 - RNA, 22 nt, Human
gggcagugggaccaggcaccag

SEQ ID NO: 600504 - RNA, 22 nt, Human
ugucucuuuggccucccauaug

SEQ ID NO: 600505 - RNA, 22 nt, Human
aacauagaagaugguuaauugu

SEQ ID NO: 600506 - RNA, 21 nt, Human
agcucagccgggcacaguggc

SEQ ID NO: 600507 - RNA, 22 nt, Human
ucaggggcccuucccucagcag

SEQ ID NO: 600508 - RNA, 22 nt, Human
cucugggcugccuuuuagcucu

SEQ ID NO: 600509 - RNA, 22 nt, Human
ccuccugggccuugcucuguga

SEQ ID NO: 600510 - RNA, 22 nt, Human
ucaagaguuggucaaauccaaa

SEQ ID NO: 600511 - RNA, 18 nt, Human
uuugaaggauggccugga

SEQ ID NO: 600512 - RNA, 22 nt, Human
acaaugaagggagacacuugcu

SEQ ID NO: 600513 - RNA, 22 nt, Human
uagacauacagugcaguacaua

SEQ ID NO: 600514 - RNA, 22 nt, Human
acuucaaacaauuaacagagaa

SEQ ID NO: 600515 - RNA, 22 nt, Human
aacgucuucucuccaaguaaau

SEQ ID NO: 600516 - RNA, 22 nt, Human
accaggcuggagugcaguggcg

SEQ ID NO: 600517 - RNA, 20 nt, Human
gcugccuuguccugcuuggu

SEQ ID NO: 600518 - RNA, 22 nt, Human
ccaggaagccuuuuucuuugac

SEQ ID NO: 600519 - RNA, 22 nt, Human
cagggagcagcaugggcaaagg

SEQ ID NO: 600520 - RNA, 22 nt, Human
uguucuuuggcuucacagcucu

SEQ ID NO: 600521 - RNA, 22 nt, Human
cauaauuugauaugcuugaugg

SEQ ID NO: 600522 - RNA, 22 nt, Human
ugaguccaagagccagugggaa

SEQ ID NO: 600523 - RNA, 22 nt, Human
caccagguggaaaugucacagc

SEQ ID NO: 600524 - RNA, 22 nt, Human
ucaugcuauuucgaauguaaua

SEQ ID NO: 600525 - RNA, 22 nt, Human
guggaaguagauuugagaaggu

SEQ ID NO: 600526 - RNA, 22 nt, Human
aaugacauggagcaucuuuuca

SEQ ID NO: 600527 - RNA, 22 nt, Human
ggaguggccacgacugggagau

SEQ ID NO: 600528 - RNA, 22 nt, Human
ucuccuuugaaaguuaggacug

SEQ ID NO: 600529 - RNA, 22 nt, Human
cagacuuucaaggagugaaggc

SEQ ID NO: 600530 - RNA, 22 nt, Human
gaggcugcggggaggagccugc

SEQ ID NO: 600531 - RNA, 22 nt, Human
uaaaaugaucucucauguucuu

SEQ ID NO: 600532 - RNA, 22 nt, Human
cccuccagagccuggacauucu

SEQ ID NO: 600533 - RNA, 22 nt, Human
uacauaauuaaucuuuaaguuc

SEQ ID NO: 600534 - RNA, 22 nt, Human
uccuggaagaucucugugagau

SEQ ID NO: 600535 - RNA, 17 nt, Human
gaacagcagaggggaca

SEQ ID NO: 600536 - RNA, 22 nt, Human
uaaguccaccucauucuucagc

SEQ ID NO: 600537 - RNA, 22 nt, Human
ucagagcuuuggagaccaggaa

SEQ ID NO: 600538 - RNA, 22 nt, Human
ggcagaccucuccagccccaca

SEQ ID NO: 600539 - RNA, 22 nt, Human
gugggcuggagcaaugauuuca

SEQ ID NO: 600540 - RNA, 22 nt, Human
acaguggagaagcaaaugcagu

SEQ ID NO: 600541 - RNA, 22 nt, Human
agcuggaggggccagcaggugu

SEQ ID NO: 600542 - RNA, 22 nt, Human
ccucuacagggcauagcccaaa

SEQ ID NO: 600543 - RNA, 22 nt, Human
ucccagggacuggaugaugcag

SEQ ID NO: 600544 - RNA, 22 nt, Human
gcuucuguucaaggauauaagg

SEQ ID NO: 600545 - RNA, 22 nt, Human
ugagcacagcuuucacuagaaa

SEQ ID NO: 600546 - RNA, 22 nt, Human
gacccuccuacuacccuggaaa

SEQ ID NO: 600547 - RNA, 22 nt, Human
aauuugauucccugcaccuguu

SEQ ID NO: 600548 - RNA, 22 nt, Human
uuguuuugcuaaagggucauca

SEQ ID NO: 600549 - RNA, 22 nt, Human
gaaauacaguugggaggaggua

SEQ ID NO: 600550 - RNA, 22 nt, Human
ucuguauugauucuguuaggca

SEQ ID NO: 600551 - RNA, 22 nt, Human
acagguggggaggcugagguuc

SEQ ID NO: 600552 - RNA, 22 nt, Human
augcugaauugaugcgagggag

SEQ ID NO: 600553 - RNA, 22 nt, Human
uauuuugacgauuuuaugcaaa

SEQ ID NO: 600554 - RNA, 22 nt, Human
uggaggcacuaaauggccacaa

SEQ ID NO: 600555 - RNA, 22 nt, Human
ucugucuuagcaucuuugcuca

SEQ ID NO: 600556 - RNA, 19 nt, Human
ucaaguccuaggcccacaa

SEQ ID NO: 600557 - RNA, 22 nt, Human
guggguggaggcgucgagggca

SEQ ID NO: 600558 - RNA, 22 nt, Human
uucuugaauagggauugauaaa

SEQ ID NO: 600559 - RNA, 22 nt, Human
acagcuucgaggaucucauccc

SEQ ID NO: 600560 - RNA, 22 nt, Human
ugcuggcuguauaugugagagu

SEQ ID NO: 600561 - RNA, 22 nt, Human
aaaggucuuaagguuaagcagg

SEQ ID NO: 600562 - RNA, 22 nt, Human
ugagugcucuguaugugccaga

SEQ ID NO: 600563 - RNA, 22 nt, Human
guuaaggaucuugagaugagga

SEQ ID NO: 600564 - RNA, 22 nt, Human
ggccuugauguucuugggagau

SEQ ID NO: 600565 - RNA, 21 nt, Human
aggaggcugucucuuucagcu

SEQ ID NO: 600566 - RNA, 22 nt, Human
ugauuaacugucuauuaaucau

SEQ ID NO: 600567 - RNA, 22 nt, Human
aaacaguuuauaacaugauacu

SEQ ID NO: 600568 - RNA, 22 nt, Human
cauaggaaaagcauucuucuug

SEQ ID NO: 600569 - RNA, 22 nt, Human
gcuggccacacugcugauggag

SEQ ID NO: 600570 - RNA, 22 nt, Human
ugccugaugcaggaguaucaga

SEQ ID NO: 600571 - RNA, 22 nt, Human
uccuggagaauggacaaugcac

SEQ ID NO: 600572 - RNA, 22 nt, Human
acaaagagggaccagugacuug

SEQ ID NO: 600573 - RNA, 22 nt, Human
agcugaaagugcuuugaggacu

SEQ ID NO: 600574 - RNA, 22 nt, Human
ucaggagggugacaggcccugg

SEQ ID NO: 600575 - RNA, 22 nt, Human
agaagugccauacuguggucca

SEQ ID NO: 600576 - RNA, 22 nt, Human
uacaaaugguugaauggaugaa

SEQ ID NO: 600577 - RNA, 22 nt, Human
gcugccuggagcucagccugcc

SEQ ID NO: 600578 - RNA, 22 nt, Human
cacucugcagcugaagggcugg

SEQ ID NO: 600579 - RNA, 22 nt, Human
ugcuuucauucacaaaauagca

SEQ ID NO: 600580 - RNA, 22 nt, Human
cagcugcaguucaaugcuugcu

SEQ ID NO: 600581 - RNA, 22 nt, Human
aggaagcaaaaggcagggucua

SEQ ID NO: 600582 - RNA, 22 nt, Human
uuuccagagcugagaaggcuug

SEQ ID NO: 600583 - RNA, 22 nt, Human
ggagacaauggaggccaaaaga

SEQ ID NO: 600584 - RNA, 22 nt, Human
aggggugauuugggacaggaca

SEQ ID NO: 600585 - RNA, 22 nt, Human
gccaggcugccuuaucucuagc

SEQ ID NO: 600586 - RNA, 22 nt, Human
ucagaacacuuucucuacugac

SEQ ID NO: 600587 - RNA, 22 nt, Human
ugggaaguuguaccuucuguua

SEQ ID NO: 600588 - RNA, 22 nt, Human
cacagcagccagaacauuuuug

SEQ ID NO: 600589 - RNA, 22 nt, Human
agcuacaugaaauugcugauau

SEQ ID NO: 600590 - RNA, 22 nt, Human
gugugcaggugucagugcagcu

SEQ ID NO: 600591 - RNA, 22 nt, Human
auuaacaugaguuggagauagg

SEQ ID NO: 600592 - RNA, 22 nt, Human
uggugacaccccaucucuaaag

SEQ ID NO: 600593 - RNA, 23 nt, Human
ugaggcugauugauuuuugcuca

SEQ ID NO: 600594 - RNA, 22 nt, Human
gugcaaaaguaauugugguuuu

SEQ ID NO: 600595 - RNA, 22 nt, Human
ggcagggagagcaugcugauaa

SEQ ID NO: 600596 - RNA, 22 nt, Human
ccugugccuuaacccuuuaggc

SEQ ID NO: 600597 - RNA, 22 nt, Human
cacagcuuccauuagaaugaga

SEQ ID NO: 600598 - RNA, 22 nt, Human
ggucagaagugcaaaaucaguu

SEQ ID NO: 600599 - RNA, 18 nt, Human
guggaggguucucagaau

SEQ ID NO: 600600 - RNA, 22 nt, Human
auuugcuugugcuaugaaaguu

SEQ ID NO: 600601 - RNA, 21 nt, Human
ugaggauaaguaaagcugaag

SEQ ID NO: 600602 - RNA, 22 nt, Human
cccugcagagggaugggggcag

SEQ ID NO: 600603 - RNA, 22 nt, Human
uuccugaggcucaucggagucg

SEQ ID NO: 600604 - RNA, 22 nt, Human
uaggcugaaaggagaggugaag

SEQ ID NO: 600605 - RNA, 21 nt, Human
aggcugcuggcucaggguccu

SEQ ID NO: 600606 - RNA, 22 nt, Human
uagcuuugugaaguuuacagac

SEQ ID NO: 600607 - RNA, 16 nt, Human
gcagaggaaaggggag

SEQ ID NO: 600608 - RNA, 18 nt, Human
uccucagccucaccuagc

SEQ ID NO: 600609 - RNA, 22 nt, Human
auuuguaauuucuuaucugugu

SEQ ID NO: 600610 - RNA, 22 nt, Human
uagcuguuaaguuguuuggaaa

SEQ ID NO: 600611 - RNA, 22 nt, Human
ugcccuguuccugccuccagcu

SEQ ID NO: 600612 - RNA, 22 nt, Human
ugggccagagaguaagaaaggu

SEQ ID NO: 600613 - RNA, 22 nt, Human
aaugaccagcgccugcagaggg

SEQ ID NO: 600614 - RNA, 22 nt, Human
gagcucaggagcaucagaagaa

SEQ ID NO: 600615 - RNA, 22 nt, Human
cagcuucagcgugacaccagug

SEQ ID NO: 600616 - RNA, 23 nt, Human
uccucccugacuucuacagcaca

SEQ ID NO: 600617 - RNA, 22 nt, Human
ugaggggccgcccaagcacuuc

SEQ ID NO: 600618 - RNA, 22 nt, Human
agcccugggaggccagcuugua

SEQ ID NO: 600619 - RNA, 22 nt, Human
ugccuggguucccaccccaaag

SEQ ID NO: 600620 - RNA, 22 nt, Human
aacacugaagccguuaaaccuu

SEQ ID NO: 600621 - RNA, 22 nt, Human
cugagggucaacuugauuguau

SEQ ID NO: 600622 - RNA, 22 nt, Human
uuuucauaguaauggugcaugu

SEQ ID NO: 600623 - RNA, 22 nt, Human
agcuaaauguugcuuaaaauuu

SEQ ID NO: 600624 - RNA, 22 nt, Human
acauacuaugaauacauguguc

SEQ ID NO: 600625 - RNA, 22 nt, Human
cagaggcuucaagucauucucc

SEQ ID NO: 600626 - RNA, 22 nt, Human
uucuacauugugaaguucuuua

SEQ ID NO: 600627 - RNA, 22 nt, Human
uccucuccagcaaacuggcuau

SEQ ID NO: 600628 - RNA, 22 nt, Human
ugaggcaguucuuacuuguauu

SEQ ID NO: 600629 - RNA, 22 nt, Human
ucagcucugccuguggaggcac

SEQ ID NO: 600630 - RNA, 22 nt, Human
cuuccccaggaccucugcuaaa

SEQ ID NO: 600631 - RNA, 22 nt, Human
cugcaggaaucugugcuaggug

SEQ ID NO: 600632 - RNA, 18 nt, Human
agcugcccugggcuggag

SEQ ID NO: 600633 - RNA, 22 nt, Human
uauuuugacuauuaaaccaaca

SEQ ID NO: 600634 - RNA, 22 nt, Human
uccuggucuacacugcauuggg

SEQ ID NO: 600635 - RNA, 22 nt, Human
auacaguaauuuguaacucauc

SEQ ID NO: 600636 - RNA, 22 nt, Human
cauuguuauagcauuacacacc

SEQ ID NO: 600637 - RNA, 22 nt, Human
agcagggcagguaaggaucaga

SEQ ID NO: 600638 - RNA, 22 nt, Human
cucccguggauguucuucaguc

SEQ ID NO: 600639 - RNA, 22 nt, Human
cugcccagaaucacucacucga

SEQ ID NO: 600640 - RNA, 22 nt, Human
uagaaaagaauuuuauuugaua

SEQ ID NO: 600641 - RNA, 22 nt, Human
cuaggugauccacugcucucuu

SEQ ID NO: 600642 - RNA, 22 nt, Human
ugucauuucacaauaucacuca

SEQ ID NO: 600643 - RNA, 22 nt, Human
ccagcagcugcaaagccugggu

SEQ ID NO: 600644 - RNA, 22 nt, Human
ccauccuggccucgcuguccac

SEQ ID NO: 600645 - RNA, 22 nt, Human
gcugggucuggaugcucaggug

SEQ ID NO: 600646 - RNA, 22 nt, Human
gugcagugacccuggagagcug

SEQ ID NO: 600647 - RNA, 17 nt, Human
ccugcccagagacagau

SEQ ID NO: 600648 - RNA, 22 nt, Human
uaagacaucauuaaacagcaau

SEQ ID NO: 600649 - RNA, 22 nt, Human
aagagagggguugcauggaaau

SEQ ID NO: 600650 - RNA, 22 nt, Human
acacagauuuuacauguuaugc

SEQ ID NO: 600651 - RNA, 22 nt, Human
ugucuuuacuuagaaguucagg

SEQ ID NO: 600652 - RNA, 22 nt, Human
ccuggagcccaaggcagugaga

SEQ ID NO: 600653 - RNA, 22 nt, Human
cugacauuuacugagcacuuac

SEQ ID NO: 600654 - RNA, 22 nt, Human
ucacuuugaauuccuugauuuu

SEQ ID NO: 600655 - RNA, 22 nt, Human
gagugcuggaggugugaguggg

SEQ ID NO: 600656 - RNA, 22 nt, Human
guggacagcuucuaggugccag

SEQ ID NO: 600657 - RNA, 22 nt, Human
gaaagcauaacuaauauuuauu

SEQ ID NO: 600658 - RNA, 21 nt, Human
ggugggcacaggagagcagag

SEQ ID NO: 600659 - RNA, 22 nt, Human
cucuccagucaggaacucugac

SEQ ID NO: 600660 - RNA, 22 nt, Human
agcacagaguugcagagagcgu

SEQ ID NO: 600661 - RNA, 22 nt, Human
uauguacucaucaacuauugaa

SEQ ID NO: 600662 - RNA, 22 nt, Human
uccuggugaggacuccaagaua

SEQ ID NO: 600663 - RNA, 22 nt, Human
cauggccaggcccagggcccag

SEQ ID NO: 600664 - RNA, 22 nt, Human
aauggcuuacccuggauugugu

SEQ ID NO: 600665 - RNA, 18 nt, Human
aggcaggauccuggccuc

SEQ ID NO: 600666 - RNA, 21 nt, Human
uacaagaccggauucgggccc

SEQ ID NO: 600667 - RNA, 22 nt, Human
uggcuucucaguuucauaauga

SEQ ID NO: 600668 - RNA, 22 nt, Human
cuuccucuauguucagguagaa

SEQ ID NO: 600669 - RNA, 21 nt, Human
ucugggggugagccuagaaau

SEQ ID NO: 600670 - RNA, 21 nt, Human
cagaggcagguccugggacgg

SEQ ID NO: 600671 - RNA, 22 nt, Human
ggaggggcauaguucaccauca

SEQ ID NO: 600672 - RNA, 22 nt, Human
uaagauaauaaguaugucuaug

SEQ ID NO: 600673 - RNA, 22 nt, Human
auuguucaauguaauaauuuug

SEQ ID NO: 600674 - RNA, 22 nt, Human
agauauucugccuaacagguuu

SEQ ID NO: 600675 - RNA, 22 nt, Human
ucauccaaggagaccuugcaga

SEQ ID NO: 600676 - RNA, 22 nt, Human
gcucugucauuuugcagacacu

SEQ ID NO: 600677 - RNA, 22 nt, Human
uuguauuugauugucauaucgu

SEQ ID NO: 600678 - RNA, 22 nt, Human
uuggagauaucacaccuucaca

SEQ ID NO: 600679 - RNA, 22 nt, Human
uugcaaaagccgaggcacucca

SEQ ID NO: 600680 - RNA, 22 nt, Human
ggcucauguuucagaaagugga

SEQ ID NO: 600681 - RNA, 21 nt, Human
agagcuggccugccaggcccu

SEQ ID NO: 600682 - RNA, 22 nt, Human
ugucucuucugccuccagcugu

SEQ ID NO: 600683 - RNA, 22 nt, Human
caagauaaaaucagcauuccaa

SEQ ID NO: 600684 - RNA, 22 nt, Human
aggccucagccugccaggccug

SEQ ID NO: 600685 - RNA, 22 nt, Human
auacaucaauuucuuaguuauc

SEQ ID NO: 600686 - RNA, 22 nt, Human
ccacacagucaguuuccaagaa

SEQ ID NO: 600687 - RNA, 22 nt, Human
aaaaccaaguuuuccuuagucu

SEQ ID NO: 600688 - RNA, 22 nt, Human
cagccacugacaggaauggucc

SEQ ID NO: 600689 - RNA, 22 nt, Human
ccucucuccaauuuucaccuca

SEQ ID NO: 600690 - RNA, 22 nt, Human
cuuggaaaguuaucauuuuccu

SEQ ID NO: 600691 - RNA, 22 nt, Human
ucacagaguuaaaaguuucuuu

SEQ ID NO: 600692 - RNA, 22 nt, Human
gauaaagcaaggaugacugaag

SEQ ID NO: 600693 - RNA, 22 nt, Human
guuucuuuuaaaauauguagac

SEQ ID NO: 600694 - RNA, 22 nt, Human
uucuccaggggaggguucucca

SEQ ID NO: 600695 - RNA, 22 nt, Human
auagcaaauauuuuaaugagca

SEQ ID NO: 600696 - RNA, 22 nt, Human
acuauucaagugcucauucaga

SEQ ID NO: 600697 - RNA, 22 nt, Human
ggaaacacaugaucagacaucu

SEQ ID NO: 600698 - RNA, 22 nt, Human
ccucacagcccuccucuagcac

SEQ ID NO: 600699 - RNA, 22 nt, Human
gcuuccagaaugacuaggaugu

SEQ ID NO: 600700 - RNA, 22 nt, Human
aacacagaguauuugaagcauu

SEQ ID NO: 600701 - RNA, 22 nt, Human
augaagcaggcacagcuucagg

SEQ ID NO: 600702 - RNA, 22 nt, Human
uaaauaugcauguauccuuauc

SEQ ID NO: 600703 - RNA, 22 nt, Human
uucuagauagagugcaaauuau

SEQ ID NO: 600704 - RNA, 22 nt, Human
gcucucuggguggugggcaaca

SEQ ID NO: 600705 - RNA, 22 nt, Human
agauuucuguggucauguaaug

SEQ ID NO: 600706 - RNA, 19 nt, Human
ugcuugccugccuuuccca

SEQ ID NO: 600707 - RNA, 22 nt, Human
agucaguggcuccgagccuggu

SEQ ID NO: 600708 - RNA, 22 nt, Human
cuggguccuggugcugaguucu

SEQ ID NO: 600709 - RNA, 22 nt, Human
ucaggccaagguagacaugacu

SEQ ID NO: 600710 - RNA, 22 nt, Human
agggccugucuguagaacugaa

SEQ ID NO: 600711 - RNA, 22 nt, Human
ccucaggccucugccucauugg

SEQ ID NO: 600712 - RNA, 22 nt, Human
ucaaacauaggcacacauucag

SEQ ID NO: 600713 - RNA, 22 nt, Human
agggaaagguagugaggucaca

SEQ ID NO: 600714 - RNA, 22 nt, Human
auguuaaauagccauuuguuug

SEQ ID NO: 600715 - RNA, 22 nt, Human
uggccuggugcucaggcaguag

SEQ ID NO: 600716 - RNA, 22 nt, Human
agcuuugaauccuggcucuguc

SEQ ID NO: 600717 - RNA, 22 nt, Human
gacuucaugacauucaggucag

SEQ ID NO: 600718 - RNA, 22 nt, Human
cuggcaguauuaagagaaguga

SEQ ID NO: 600719 - RNA, 21 nt, Human
aggauuucugucauuucagau

SEQ ID NO: 600720 - RNA, 22 nt, Human
uggcugagagcaauugacucug

SEQ ID NO: 600721 - RNA, 22 nt, Human
cugccguugugaagcucuuaga

SEQ ID NO: 600722 - RNA, 22 nt, Human
gcccaagaucacacuggaaauc

SEQ ID NO: 600723 - RNA, 22 nt, Human
uggucugauggucccaccaccg

SEQ ID NO: 600724 - RNA, 20 nt, Human
uuucauugucagaaucuuau

SEQ ID NO: 600725 - RNA, 22 nt, Human
cugagguccucagagggaaagg

SEQ ID NO: 600726 - RNA, 22 nt, Human
uccucaucucggaaccugccac

SEQ ID NO: 600727 - RNA, 22 nt, Human
cugcccuggccacugugcccag

SEQ ID NO: 600728 - RNA, 22 nt, Human
uauucuccccggaucagggcaa

SEQ ID NO: 600729 - RNA, 22 nt, Human
cuacagaaaaucagccacaggc

SEQ ID NO: 600730 - RNA, 22 nt, Human
cagaggccuauccaguguccau

SEQ ID NO: 600731 - RNA, 22 nt, Human
cauaacauuaagccucuauuuc

SEQ ID NO: 600732 - RNA, 22 nt, Human
cauuuagagaguaaaaauuagc

SEQ ID NO: 600733 - RNA, 18 nt, Human
caguggcauaguugagua

SEQ ID NO: 600734 - RNA, 23 nt, Human
ccaguaaacccuuccucaguguc

SEQ ID NO: 600735 - RNA, 22 nt, Human
agacagagauacuauguuguca

SEQ ID NO: 600736 - RNA, 22 nt, Human
gaacacugacauuuuccugacu

SEQ ID NO: 600737 - RNA, 22 nt, Human
cccagcagauggcuaugugcua

SEQ ID NO: 600738 - RNA, 22 nt, Human
ucauaaaaugcuccugauauug

SEQ ID NO: 600739 - RNA, 22 nt, Human
aggauuuugacuuauucaggga

SEQ ID NO: 600740 - RNA, 22 nt, Human
uuucaauuaggauguuuccaug

SEQ ID NO: 600741 - RNA, 22 nt, Human
ugcaggucuccauuggcagacu

SEQ ID NO: 600742 - RNA, 22 nt, Human
gaguggggcuuuaaaggcucag

SEQ ID NO: 600743 - RNA, 21 nt, Human
aacuauggaggaaauaagucc

SEQ ID NO: 600744 - RNA, 22 nt, Human
cuuagaugaagucacagaaccc

SEQ ID NO: 600745 - RNA, 22 nt, Human
uugcaguuguugccuucccuga

SEQ ID NO: 600746 - RNA, 22 nt, Human
uaggaugguacaaggcaggggu

SEQ ID NO: 600747 - RNA, 22 nt, Human
aagcaaagaguuuaguggguga

SEQ ID NO: 600748 - RNA, 22 nt, Human
augagcugugggauuccagagg

SEQ ID NO: 600749 - RNA, 22 nt, Human
cuuccaggacaccaggguagua

SEQ ID NO: 600750 - RNA, 22 nt, Human
cacaguccagacuccuggaguu

SEQ ID NO: 600751 - RNA, 22 nt, Human
gcuggcuuuugaagucuagcua

SEQ ID NO: 600752 - RNA, 22 nt, Human
auacacuguucacuagaucuuc

SEQ ID NO: 600753 - RNA, 22 nt, Human
uggcucagccauucguguugcc

SEQ ID NO: 600754 - RNA, 19 nt, Human
gcacacccugcaccaccau

SEQ ID NO: 600755 - RNA, 22 nt, Human
uggacaggcaagcaagacauac

SEQ ID NO: 600756 - RNA, 22 nt, Human
aaggagcucccggcagaccagg

SEQ ID NO: 600757 - RNA, 22 nt, Human
acacaauaaauuuauccuuuga

SEQ ID NO: 600758 - RNA, 22 nt, Human
ggagccugugcccaagcccaga

SEQ ID NO: 600759 - RNA, 22 nt, Human
cauugaaaccuaacauaggcug

SEQ ID NO: 600760 - RNA, 22 nt, Human
guuacaaauguaaauucugggg

SEQ ID NO: 600761 - RNA, 22 nt, Human
guucacaagcuggguuucugca

SEQ ID NO: 600762 - RNA, 22 nt, Human
auggaauauagucuuauaucuc

SEQ ID NO: 600763 - RNA, 22 nt, Human
auucuaaugcccuggccccagc

SEQ ID NO: 600764 - RNA, 20 nt, Human
cucucucuccauucccaggg

SEQ ID NO: 600765 - RNA, 22 nt, Human
agaauuuaggaugcaugugaau

SEQ ID NO: 600766 - RNA, 19 nt, Human
acucaagucuaaugaaauc

SEQ ID NO: 600767 - RNA, 22 nt, Human
aagaauaucuguuuuauuuagg

SEQ ID NO: 600768 - RNA, 22 nt, Human
aucauggaagccuaucuugaga

SEQ ID NO: 600769 - RNA, 22 nt, Human
gagcuuugaucgcuaagccuca

SEQ ID NO: 600770 - RNA, 22 nt, Human
gaccagucauuacucaugcccu

SEQ ID NO: 600771 - RNA, 22 nt, Human
cuggaagagugacuuugcauuu

SEQ ID NO: 600772 - RNA, 22 nt, Human
aagcuucaguggacuguagugu

SEQ ID NO: 600773 - RNA, 18 nt, Human
gcuuucugugcagcggag

SEQ ID NO: 600774 - RNA, 22 nt, Human
gagccagaaaagcugccugacu

SEQ ID NO: 600775 - RNA, 22 nt, Human
ucagaggacaagcucccuggug

SEQ ID NO: 600776 - RNA, 22 nt, Human
gccaggcucuugguuauguuuu

SEQ ID NO: 600777 - RNA, 22 nt, Human
ucauuguuaauuguaugaucug

SEQ ID NO: 600778 - RNA, 22 nt, Human
cuggccaggcucucacgugguc

SEQ ID NO: 600779 - RNA, 22 nt, Human
ugcauauuugauugagauaccu

SEQ ID NO: 600780 - RNA, 23 nt, Human
ucauugugacugugccacauaac

SEQ ID NO: 600781 - RNA, 22 nt, Human
ugggccaguccagccccaggga

SEQ ID NO: 600782 - RNA, 23 nt, Human
cuguggcaaguccugcaccugcc

SEQ ID NO: 600783 - RNA, 22 nt, Human
aggacugacuuuugccaugaaa

SEQ ID NO: 600784 - RNA, 22 nt, Human
ugaggcaggacauggacaacug

SEQ ID NO: 600785 - RNA, 22 nt, Human
agcucugggcugacaugcuccc

SEQ ID NO: 600786 - RNA, 22 nt, Human
gagggcuccucacauucucuau

SEQ ID NO: 600787 - RNA, 19 nt, Human
agacagagcucaguggguu

SEQ ID NO: 600788 - RNA, 22 nt, Human
uuuagcuugaaaguuuuggagg

SEQ ID NO: 600789 - RNA, 22 nt, Human
ugauuguaugauugaaauauuu

SEQ ID NO: 600790 - RNA, 22 nt, Human
aagcuguuuuggccuuaguuga

SEQ ID NO: 600791 - RNA, 22 nt, Human
cuuccuugugguccuucucauu

SEQ ID NO: 600792 - RNA, 22 nt, Human
auguucuucuaucuuuauuaaa

SEQ ID NO: 600793 - RNA, 22 nt, Human
guggguggagacugggugcaag

SEQ ID NO: 600794 - RNA, 22 nt, Human
uuccuucuaauuuuacaccuga

SEQ ID NO: 600795 - RNA, 22 nt, Human
gggcucagcuccuuccuuccua

SEQ ID NO: 600796 - RNA, 22 nt, Human
ugcuggcagccaugccuuggaa

SEQ ID NO: 600797 - RNA, 22 nt, Human
gaggauggaggugugagcuaug

SEQ ID NO: 600798 - RNA, 22 nt, Human
gugcaguucuuguaacaugcug

SEQ ID NO: 600799 - RNA, 22 nt, Human
ggagagaggagcccacugcugu

SEQ ID NO: 600800 - RNA, 22 nt, Human
uuccacagucauccugggaauu

SEQ ID NO: 600801 - RNA, 22 nt, Human
uuguauaagaaguuggcagaua

SEQ ID NO: 600802 - RNA, 22 nt, Human
cugagguccuugacugcuugcc

SEQ ID NO: 600803 - RNA, 22 nt, Human
cuccuccuggacacaggcugug

SEQ ID NO: 600804 - RNA, 22 nt, Human
aacccaggaggcagaggcugca

SEQ ID NO: 600805 - RNA, 22 nt, Human
uacaagaagaggcagagcugga

SEQ ID NO: 600806 - RNA, 22 nt, Human
agagggggaaaauagagguguu

SEQ ID NO: 600807 - RNA, 22 nt, Human
cauaauuugugguaguggggga

SEQ ID NO: 600808 - RNA, 22 nt, Human
agaucuuaugaugcacagggca

SEQ ID NO: 600809 - RNA, 22 nt, Human
ucagaagcugguguccuuugaa

SEQ ID NO: 600810 - RNA, 22 nt, Human
agcucccagaguccucugccca

SEQ ID NO: 600811 - RNA, 22 nt, Human
gaauacuuuuguuaggaaaacg

SEQ ID NO: 600812 - RNA, 22 nt, Human
cucuuuuucagccuuaccaaag

SEQ ID NO: 600813 - RNA, 22 nt, Human
uggguagguguggccugaaugu

SEQ ID NO: 600814 - RNA, 22 nt, Human
agccagacauggcuccugcucc

SEQ ID NO: 600815 - RNA, 22 nt, Human
uuacaucauguaacuggauaua

SEQ ID NO: 600816 - RNA, 22 nt, Human
uguuuugucuaaucuaaauucu

SEQ ID NO: 600817 - RNA, 22 nt, Human
cugcagggccauggguucuaua

SEQ ID NO: 600818 - RNA, 22 nt, Human
guacaggacauagacagaguag

SEQ ID NO: 600819 - RNA, 22 nt, Human
uggcuccaggggacacgcagua

SEQ ID NO: 600820 - RNA, 22 nt, Human
uugaaaguuaucuagauucuga

SEQ ID NO: 600821 - RNA, 22 nt, Human
cugggcagaauuuuaggauggc

SEQ ID NO: 600822 - RNA, 22 nt, Human
ggagaggggaacuuguugcuug

SEQ ID NO: 600823 - RNA, 22 nt, Human
ugcaggguguccggaggaucac

SEQ ID NO: 600824 - RNA, 22 nt, Human
ugguggcagagcaagagcugga

SEQ ID NO: 600825 - RNA, 22 nt, Human
aaagcauggcaugaagaacaug

SEQ ID NO: 600826 - RNA, 22 nt, Human
cagugcugcaggcgccugcggu

SEQ ID NO: 600827 - RNA, 22 nt, Human
gagaggugaauguggaugccac

SEQ ID NO: 600828 - RNA, 22 nt, Human
guuuagcaauaaaaacacauga

SEQ ID NO: 600829 - RNA, 21 nt, Human
aaagauguuucuuuuccucac

SEQ ID NO: 600830 - RNA, 22 nt, Human
agugggggcagagccucucucg

SEQ ID NO: 600831 - RNA, 16 nt, Human
uaacauuuuuaaaagg

SEQ ID NO: 600832 - RNA, 22 nt, Human
aaaggcucauacagaaaauaca

SEQ ID NO: 600833 - RNA, 22 nt, Human
uuaucaugggaccugaauuuua

SEQ ID NO: 600834 - RNA, 22 nt, Human
ggaggccaaggcagguggauca

SEQ ID NO: 600835 - RNA, 22 nt, Human
cagccagaggcugcgaggggcc

SEQ ID NO: 600836 - RNA, 22 nt, Human
uccugggguccugacugcuucc

SEQ ID NO: 600837 - RNA, 22 nt, Human
agcuggugaggguugaggggua

SEQ ID NO: 600838 - RNA, 22 nt, Human
uuccuucuuccuuuaguaacca

SEQ ID NO: 600839 - RNA, 22 nt, Human
gccuggagacagcagaggcggc

SEQ ID NO: 600840 - RNA, 22 nt, Human
cuuacauuuaaucaugugucau

SEQ ID NO: 600841 - RNA, 23 nt, Human
uucauguggaccuagaggccugu

SEQ ID NO: 600842 - RNA, 22 nt, Human
guccugggaacuggacagcuaa

SEQ ID NO: 600843 - RNA, 22 nt, Human
auuucuuuucaagagggugcuu

SEQ ID NO: 600844 - RNA, 22 nt, Human
ugaggccauggaacuagcuugg

SEQ ID NO: 600845 - RNA, 22 nt, Human
gcuugcuuauuugcccuucucc

SEQ ID NO: 600846 - RNA, 22 nt, Human
cugaagaugucugagaugcuca

SEQ ID NO: 600847 - RNA, 22 nt, Human
uggcaggaaccuuaaccacaaa

SEQ ID NO: 600848 - RNA, 22 nt, Human
auguaaaagauuauuuuccugu

SEQ ID NO: 600849 - RNA, 21 nt, Human
cccagggaagccgcagucacc

SEQ ID NO: 600850 - RNA, 22 nt, Human
agagauuggggaugaaucuuuc

SEQ ID NO: 600851 - RNA, 22 nt, Human
ucccagagacaucauuucuccg

SEQ ID NO: 600852 - RNA, 22 nt, Human
agggcugcuuugcuaaauaugg

SEQ ID NO: 600853 - RNA, 22 nt, Human
gggacaggcaaagguaugcuuc

SEQ ID NO: 600854 - RNA, 22 nt, Human
acacuucucccaucuccuguug

SEQ ID NO: 600855 - RNA, 22 nt, Human
cacugguugccucuuucuguuc

SEQ ID NO: 600856 - RNA, 22 nt, Human
ucagagaauguccuucuucauu

SEQ ID NO: 600857 - RNA, 22 nt, Human
acagcagcgucaacuuaaaauu

SEQ ID NO: 600858 - RNA, 22 nt, Human
auaugaguuucccacuucugga

SEQ ID NO: 600859 - RNA, 22 nt, Human
aaaauugagaguuauagauggu

SEQ ID NO: 600860 - RNA, 22 nt, Human
uacagaguggugagaucuuuug

SEQ ID NO: 600861 - RNA, 22 nt, Human
ugucugugaccucuuaggcaag

SEQ ID NO: 600862 - RNA, 22 nt, Human
uagacauuucugguuauugaca

SEQ ID NO: 600863 - RNA, 22 nt, Human
aucauucagccuaagcaaguac

SEQ ID NO: 600864 - RNA, 22 nt, Human
acaguaaggguaaauaagaaca

SEQ ID NO: 600865 - RNA, 22 nt, Human
guacacaggcagcccagugcug

SEQ ID NO: 600866 - RNA, 22 nt, Human
augaagucuagcaagcauugaa

SEQ ID NO: 600867 - RNA, 22 nt, Human
cugagagaugauauagcuuaau

SEQ ID NO: 600868 - RNA, 22 nt, Human
gcucuggccagacccucagugg

SEQ ID NO: 600869 - RNA, 22 nt, Human
cuguagagaaagcauggaagcu

SEQ ID NO: 600870 - RNA, 22 nt, Human
ucugagguuaauccugcugcau

SEQ ID NO: 600871 - RNA, 22 nt, Human
acauugaugaaaagguaucauu

SEQ ID NO: 600872 - RNA, 22 nt, Human
ggggggcagcuguccuggccau

SEQ ID NO: 600873 - RNA, 22 nt, Human
cagaaauauuuauugagugaca

SEQ ID NO: 600874 - RNA, 22 nt, Human
uuucuggaaagcaagauacauu

SEQ ID NO: 600875 - RNA, 22 nt, Human
caugcuuuucaaucuaucuuaa

SEQ ID NO: 600876 - RNA, 22 nt, Human
acagucucuguugcugcuguuu

SEQ ID NO: 600877 - RNA, 22 nt, Human
ggaauauagccaguaacaguca

SEQ ID NO: 600878 - RNA, 22 nt, Human
auaugaaaguaagcaugugugu

SEQ ID NO: 600879 - RNA, 22 nt, Human
ucuguaaagauguuuauaccuu

SEQ ID NO: 600880 - RNA, 22 nt, Human
gccuggagaaaggaagguggga

SEQ ID NO: 600881 - RNA, 22 nt, Human
acauugaucagccucccaugca

SEQ ID NO: 600882 - RNA, 22 nt, Human
ccagggcuucagagguuuuggc

SEQ ID NO: 600883 - RNA, 22 nt, Human
ugggaaugggccuagaaggcug

SEQ ID NO: 600884 - RNA, 22 nt, Human
gugugugugccugcacacacac

SEQ ID NO: 600885 - RNA, 22 nt, Human
ggaugcugacuuuggagcaugg

SEQ ID NO: 600886 - RNA, 22 nt, Human
uccuuagccagggcagcucaaa

SEQ ID NO: 600887 - RNA, 22 nt, Human
cagugcuggcuguuaggacagu

SEQ ID NO: 600888 - RNA, 22 nt, Human
acuggcacuauguuggagaaau

SEQ ID NO: 600889 - RNA, 22 nt, Human
augaaauucaucugagaaugcu

SEQ ID NO: 600890 - RNA, 22 nt, Human
gcugcaggcagaaucucccaau

SEQ ID NO: 600891 - RNA, 22 nt, Human
uuugugcaggugugucagaucg

SEQ ID NO: 600892 - RNA, 22 nt, Human
auccuguggcuccagggagccg

SEQ ID NO: 600893 - RNA, 22 nt, Human
gccaggcuggaaagaacagaca

SEQ ID NO: 600894 - RNA, 22 nt, Human
ugaggcagcuuuuucugugugu

SEQ ID NO: 600895 - RNA, 22 nt, Human
aggcagggucuugcuauguugc

SEQ ID NO: 600896 - RNA, 22 nt, Human
ucaaagcaucagucaauuuagg

SEQ ID NO: 600897 - RNA, 20 nt, Human
gacaugucuuucucacacaa

SEQ ID NO: 600898 - RNA, 20 nt, Human
aggguggggacguucugacu

SEQ ID NO: 600899 - RNA, 22 nt, Human
gaaauauuguacuggagauguu

SEQ ID NO: 600900 - RNA, 22 nt, Human
caagagacuuauguggaaaccu

SEQ ID NO: 600901 - RNA, 22 nt, Human
gggaaaggauuuacaguuugau

SEQ ID NO: 600902 - RNA, 22 nt, Human
uagaggggaaucugccuccucu

SEQ ID NO: 600903 - RNA, 22 nt, Human
caugaauauuuaguauuuacuu

SEQ ID NO: 600904 - RNA, 20 nt, Human
gcccaagcgccggccgcaga

SEQ ID NO: 600905 - RNA, 22 nt, Human
ugcaggaauuuuuugcagaaag

SEQ ID NO: 600906 - RNA, 22 nt, Human
gcugggucagaaucucccugug

SEQ ID NO: 600907 - RNA, 22 nt, Human
agagaaggucacuaaggaccca

SEQ ID NO: 600908 - RNA, 22 nt, Human
uuauuuauguuaacagucgaga

SEQ ID NO: 600909 - RNA, 22 nt, Human
gggaaggagccugcuugcuaga

SEQ ID NO: 600910 - RNA, 22 nt, Human
guggcagcuguguugcaguuuu

SEQ ID NO: 600911 - RNA, 22 nt, Human
gaagcaauuaaguuugugaucu

SEQ ID NO: 600912 - RNA, 22 nt, Human
aauaagugaugaugagucacuc

SEQ ID NO: 600913 - RNA, 22 nt, Human
aguacaaugucugacacaguag

SEQ ID NO: 600914 - RNA, 20 nt, Human
aggcacuggauuucuuauau

SEQ ID NO: 600915 - RNA, 22 nt, Human
caaucagauaugugacauauuu

SEQ ID NO: 600916 - RNA, 22 nt, Human
cgggagcacgggaggcggagcu

SEQ ID NO: 600917 - RNA, 22 nt, Human
cuucugggagagcuuuugcuuc

SEQ ID NO: 600918 - RNA, 22 nt, Human
cugcagguugagcagccagguu

SEQ ID NO: 600919 - RNA, 22 nt, Human
ugugcccauuacacagaggcau

SEQ ID NO: 600920 - RNA, 22 nt, Human
cccuccaugagugugcugcugg

SEQ ID NO: 600921 - RNA, 22 nt, Human
aucugcuugaaacuucuuauac

SEQ ID NO: 600922 - RNA, 21 nt, Human
uauacaguaauuaagugguau

SEQ ID NO: 600923 - RNA, 22 nt, Human
agaauguguuauuagagaagga

SEQ ID NO: 600924 - RNA, 22 nt, Human
gaguuauuuguagggauuauau

SEQ ID NO: 600925 - RNA, 22 nt, Human
ugaagguggaagggugguucug

SEQ ID NO: 600926 - RNA, 22 nt, Human
uagacuauuucuuuugcauagg

SEQ ID NO: 600927 - RNA, 22 nt, Human
acaggcugcugagccauuugcu

SEQ ID NO: 600928 - RNA, 22 nt, Human
uccccaggaaggcccuuccugg

SEQ ID NO: 600929 - RNA, 22 nt, Human
ggcugcagauagccagccacca

SEQ ID NO: 600930 - RNA, 22 nt, Human
uaaaauagccagugccccucug

SEQ ID NO: 600931 - RNA, 22 nt, Human
agccacagcaacaagugcaauu

SEQ ID NO: 600932 - RNA, 18 nt, Human
agagaaagaccaaagcau

SEQ ID NO: 600933 - RNA, 22 nt, Human
caguuucugccaggauguguua

SEQ ID NO: 600934 - RNA, 22 nt, Human
cugggccucauccucagaguuu

SEQ ID NO: 600935 - RNA, 22 nt, Human
aucaacagguauggaugagauu

SEQ ID NO: 600936 - RNA, 22 nt, Human
cuccagccucagaugacgguac

SEQ ID NO: 600937 - RNA, 22 nt, Human
uuacuuuaucuccuagauucca

SEQ ID NO: 600938 - RNA, 22 nt, Human
gcucuuccauuucucuugaacu

SEQ ID NO: 600939 - RNA, 22 nt, Human
gagauggggucuugcuauguug

SEQ ID NO: 600940 - RNA, 22 nt, Human
ucuuuugucaucccuuguacau

SEQ ID NO: 600941 - RNA, 22 nt, Human
ggagggucuaagggagaacuga

SEQ ID NO: 600942 - RNA, 22 nt, Human
ucugcccuuggcucucuuguug

SEQ ID NO: 600943 - RNA, 17 nt, Human
guccugggaggagagag

SEQ ID NO: 600944 - RNA, 22 nt, Human
cuuguacauugauuucugcauu

SEQ ID NO: 600945 - RNA, 22 nt, Human
acacaugcucauaaauaaauag

SEQ ID NO: 600946 - RNA, 22 nt, Human
aguguucacucuguggagccca

SEQ ID NO: 600947 - RNA, 22 nt, Human
gaaauagaucucugggaugcaa

SEQ ID NO: 600948 - RNA, 22 nt, Human
aauuccacagcugcacagaggu

SEQ ID NO: 600949 - RNA, 22 nt, Human
ugggagagaauucuggugacug

SEQ ID NO: 600950 - RNA, 22 nt, Human
agggcugcugaggaagccuugc

SEQ ID NO: 600951 - RNA, 22 nt, Human
caguuucuguuuuaaauagcag

SEQ ID NO: 600952 - RNA, 22 nt, Human
aaagccagagcaagcugucaca

SEQ ID NO: 600953 - RNA, 22 nt, Human
ucugggagguacugggaggugu

SEQ ID NO: 600954 - RNA, 22 nt, Human
agagcuggauggucaagauggc

SEQ ID NO: 600955 - RNA, 21 nt, Human
gccacguuucagucuucucag

SEQ ID NO: 600956 - RNA, 22 nt, Human
auacacagccauuaugaauuag

SEQ ID NO: 600957 - RNA, 22 nt, Human
uccaggagguugagacugcagu

SEQ ID NO: 600958 - RNA, 22 nt, Human
cagacaggcuagccagacucac

SEQ ID NO: 600959 - RNA, 22 nt, Human
ccuccaaguuugacucaggaca

SEQ ID NO: 600960 - RNA, 22 nt, Human
aaguacauggaggauagcugcu

SEQ ID NO: 600961 - RNA, 22 nt, Human
accgcagugacgugggacuucc

SEQ ID NO: 600962 - RNA, 18 nt, Human
aguaaagcuuauuacaug

SEQ ID NO: 600963 - RNA, 22 nt, Human
uugaggucccugccuugccuuc

SEQ ID NO: 600964 - RNA, 22 nt, Human
cuaacgaaauaccucagacuuu

SEQ ID NO: 600965 - RNA, 22 nt, Human
ugcacuacugugauacacagcc

SEQ ID NO: 600966 - RNA, 19 nt, Human
aggcugugagggaggacuc

SEQ ID NO: 600967 - RNA, 22 nt, Human
uguaaggugcucauguauuucu

SEQ ID NO: 600968 - RNA, 22 nt, Human
cagcagggaagcugugcuguuu

SEQ ID NO: 600969 - RNA, 22 nt, Human
uuuauuacaccagguuaacuca

SEQ ID NO: 600970 - RNA, 22 nt, Human
ugagugaauucaaguaaagggc

SEQ ID NO: 600971 - RNA, 22 nt, Human
uguuuucuguguagagaucaca

SEQ ID NO: 600972 - RNA, 22 nt, Human
uggcacauccacagaaucugga

SEQ ID NO: 600973 - RNA, 22 nt, Human
cagaggcuagacugugcuuccu

SEQ ID NO: 600974 - RNA, 22 nt, Human
gagcucagacucgggccugggg

SEQ ID NO: 600975 - RNA, 22 nt, Human
auguaaggagccacaguggggg

SEQ ID NO: 600976 - RNA, 22 nt, Human
gagguuagaggucagugcaguc

SEQ ID NO: 600977 - RNA, 19 nt, Human
cagugauuaauucaucuua

SEQ ID NO: 600978 - RNA, 22 nt, Human
acagauguggaguuugcaugau

SEQ ID NO: 600979 - RNA, 22 nt, Human
uucaagaugucuucacaauagu

SEQ ID NO: 600980 - RNA, 22 nt, Human
uggcugacaauguagcaguaac

SEQ ID NO: 600981 - RNA, 22 nt, Human
caguguucccugaacauauguu

SEQ ID NO: 600982 - RNA, 22 nt, Human
ugcugaauaaauaaagucuauu

SEQ ID NO: 600983 - RNA, 22 nt, Human
uuacacagaaacacuguucaga

SEQ ID NO: 600984 - RNA, 22 nt, Human
gggcagagagcuggaacuccuu

SEQ ID NO: 600985 - RNA, 22 nt, Human
gaaagaagcuuuagauggcuau

SEQ ID NO: 600986 - RNA, 22 nt, Human
cugaggcaggauggccuggcug

SEQ ID NO: 600987 - RNA, 22 nt, Human
agagcugggugaagugccauca

SEQ ID NO: 600988 - RNA, 22 nt, Human
gugcauaugguuacagcaccgc

SEQ ID NO: 600989 - RNA, 22 nt, Human
uacccucucccgguccagcuuu

SEQ ID NO: 600990 - RNA, 22 nt, Human
ccuuggagcggucagcacuggu

SEQ ID NO: 600991 - RNA, 22 nt, Human
ugggccacgugacccuuacccu

SEQ ID NO: 600992 - RNA, 22 nt, Human
cugaggcacugucagcugaggc

SEQ ID NO: 600993 - RNA, 22 nt, Human
ggggaaauuguggcugacagug

SEQ ID NO: 600994 - RNA, 22 nt, Human
ugaugcccccaaaucuggcuca

SEQ ID NO: 600995 - RNA, 22 nt, Human
gacagcagacagaacuaccugc

SEQ ID NO: 600996 - RNA, 22 nt, Human
gcagugaagccagaucugaaau

SEQ ID NO: 600997 - RNA, 23 nt, Human
ugcuccagccucuuugauagugu

SEQ ID NO: 600998 - RNA, 20 nt, Human
agcaagaguaaggacagcga

SEQ ID NO: 600999 - RNA, 22 nt, Human
aagucuuaaccaaauaaauguu

SEQ ID NO: 601000 - RNA, 22 nt, Human
ugggcagggaucucuuuugcaa

SEQ ID NO: 601001 - RNA, 22 nt, Human
acugcugugaucugauguaauu

SEQ ID NO: 601002 - RNA, 22 nt, Human
uucuggccaaggcugccagauu

SEQ ID NO: 601003 - RNA, 22 nt, Human
auuccuugcucucaucaaccuu

SEQ ID NO: 601004 - RNA, 22 nt, Human
aguguguacauuuggugcaguu

SEQ ID NO: 601005 - RNA, 20 nt, Human
auaugcuuaaucucacuaca

SEQ ID NO: 601006 - RNA, 22 nt, Human
cauggcugcgagaagagugggu

SEQ ID NO: 601007 - RNA, 17 nt, Human
uuuuguucaucuucaaa

SEQ ID NO: 601008 - RNA, 22 nt, Human
agccacagugcaagagagaaaa

SEQ ID NO: 601009 - RNA, 22 nt, Human
aaacaauccaggaaccuguuua

SEQ ID NO: 601010 - RNA, 22 nt, Human
gugagguccaguaacuugucca

SEQ ID NO: 601011 - RNA, 19 nt, Human
gccaggccuggaccugcag

SEQ ID NO: 601012 - RNA, 22 nt, Human
aggccaagauuuuggaucagcu

SEQ ID NO: 601013 - RNA, 22 nt, Human
gccuggggggcaugucauaaua

SEQ ID NO: 601014 - RNA, 22 nt, Human
uuguuuuaaccuaguguuuaug

SEQ ID NO: 601015 - RNA, 22 nt, Human
gugaauaacuuucuauguuaau

SEQ ID NO: 601016 - RNA, 22 nt, Human
uuuguucuaacuucugcagaca

SEQ ID NO: 601017 - RNA, 20 nt, Human
ggagcuggcauccagccucu

SEQ ID NO: 601018 - RNA, 22 nt, Human
ucugggaaaugggcagcuucgc

SEQ ID NO: 601019 - RNA, 22 nt, Human
gcucccacaaccuucuugcucc

SEQ ID NO: 601020 - RNA, 22 nt, Human
uggagaugaacauggugauguu

SEQ ID NO: 601021 - RNA, 22 nt, Human
ucucuucuuuggggugggcuca

SEQ ID NO: 601022 - RNA, 22 nt, Human
gguuaggaucagauccuggagg

SEQ ID NO: 601023 - RNA, 22 nt, Human
cccugcuuucaaccuucuagcu

SEQ ID NO: 601024 - RNA, 22 nt, Human
uccucccugaguggggacagcu

SEQ ID NO: 601025 - RNA, 22 nt, Human
ggcuauggcaaagaacucagau

SEQ ID NO: 601026 - RNA, 22 nt, Human
gccuggcuggucacugccuggc

SEQ ID NO: 601027 - RNA, 22 nt, Human
ucacugcucugaaaguacaggg

SEQ ID NO: 601028 - RNA, 22 nt, Human
gcugagcugaggcagggcuggg

SEQ ID NO: 601029 - RNA, 22 nt, Human
gcccuccauggugauccaggcc

SEQ ID NO: 601030 - RNA, 22 nt, Human
gacuucauaauauugagcaugu

SEQ ID NO: 601031 - RNA, 22 nt, Human
ccaggccucuggcugcuuaguc

SEQ ID NO: 601032 - RNA, 22 nt, Human
gugcugaguagaaugaaugccu

SEQ ID NO: 601033 - RNA, 22 nt, Human
uacaugaagaaaauuaagcagu

SEQ ID NO: 601034 - RNA, 22 nt, Human
ugaaaaacacuaauuggaaagc

SEQ ID NO: 601035 - RNA, 22 nt, Human
auacuguaucacuugugaguga

SEQ ID NO: 601036 - RNA, 22 nt, Human
ucuugaggucaucaucugaaac

SEQ ID NO: 601037 - RNA, 22 nt, Human
cuuaaauccaucauuucuaauc

SEQ ID NO: 601038 - RNA, 22 nt, Human
uccccagguccugucggcuccu

SEQ ID NO: 601039 - RNA, 22 nt, Human
aaugaaacuguauauagacugu

SEQ ID NO: 601040 - RNA, 22 nt, Human
ugcuggcucccaggagccgcug

SEQ ID NO: 601041 - RNA, 20 nt, Human
ucaguuaaguugcugaaucu

SEQ ID NO: 601042 - RNA, 22 nt, Human
aggucagcugcugauaggcagc

SEQ ID NO: 601043 - RNA, 22 nt, Human
ugggaauguggcaaggcauaga

SEQ ID NO: 601044 - RNA, 22 nt, Human
auauccuuuacugugucacaga

SEQ ID NO: 601045 - RNA, 22 nt, Human
caaagacacgggaaacaacguu

SEQ ID NO: 601046 - RNA, 22 nt, Human
uucuuucccuuccagcagcucc

SEQ ID NO: 601047 - RNA, 22 nt, Human
uaacacugguauuucauuuagu

SEQ ID NO: 601048 - RNA, 22 nt, Human
gcucugguucucuuagaguagu

SEQ ID NO: 601049 - RNA, 22 nt, Human
caucaagucaucaaagaauuca

SEQ ID NO: 601050 - RNA, 22 nt, Human
gagaccugcagcuguagucugc

SEQ ID NO: 601051 - RNA, 22 nt, Human
ggcugugaacccuggcagugug

SEQ ID NO: 601052 - RNA, 22 nt, Human
uggcccugcuguaucaucugcu

SEQ ID NO: 601053 - RNA, 22 nt, Human
aggagugagcuuuggggucaga

SEQ ID NO: 601054 - RNA, 22 nt, Human
cuguuaaagauaguuaagcuuc

SEQ ID NO: 601055 - RNA, 22 nt, Human
uucuccagacaacagaggguga

SEQ ID NO: 601056 - RNA, 18 nt, Human
agagcagcggcaucacac

SEQ ID NO: 601057 - RNA, 22 nt, Human
cagcaagacaguuuccuaagug

SEQ ID NO: 601058 - RNA, 23 nt, Human
gcccagagaggcucaccaggaau

SEQ ID NO: 601059 - RNA, 22 nt, Human
uuguuaaaacuccauugguuug

SEQ ID NO: 601060 - RNA, 22 nt, Human
gaaagcaguauuuaguucuguu

SEQ ID NO: 601061 - RNA, 22 nt, Human
cagugcuuuuuuaccuuccaac

SEQ ID NO: 601062 - RNA, 22 nt, Human
cagcccugucccugagggaccu

SEQ ID NO: 601063 - RNA, 22 nt, Human
ggacagcguggcugguggaggg

SEQ ID NO: 601064 - RNA, 22 nt, Human
aaggcaguggcuggaaaaccug

SEQ ID NO: 601065 - RNA, 21 nt, Human
guugugguuggggcugcagcu

SEQ ID NO: 601066 - RNA, 22 nt, Human
uuuccaauaaggucaccuuccu

SEQ ID NO: 601067 - RNA, 18 nt, Human
gcuccugguuggaaagaa

SEQ ID NO: 601068 - RNA, 22 nt, Human
aggcucagccccugggaggaga

SEQ ID NO: 601069 - RNA, 22 nt, Human
cagagaaaaaauccugcucuca

SEQ ID NO: 601070 - RNA, 20 nt, Human
cuugaacugauucuauuucc

SEQ ID NO: 601071 - RNA, 22 nt, Human
uugaagacuaauuuagauaaug

SEQ ID NO: 601072 - RNA, 22 nt, Human
uucauucuugucuuuguauagu

SEQ ID NO: 601073 - RNA, 22 nt, Human
agccugccaggcgcugccugga

SEQ ID NO: 601074 - RNA, 22 nt, Human
uagcuuuggauucuuuggggaa

SEQ ID NO: 601075 - RNA, 20 nt, Human
cucuuuacaugucucuuccu

SEQ ID NO: 601076 - RNA, 22 nt, Human
ccagcugaggcagccacacagg

SEQ ID NO: 601077 - RNA, 22 nt, Human
cauaucauaggucuuggauaau

SEQ ID NO: 601078 - RNA, 18 nt, Human
gaagcauauuuguucuuc

SEQ ID NO: 601079 - RNA, 22 nt, Human
uggccacaguguccagcagcag

SEQ ID NO: 601080 - RNA, 23 nt, Human
ugguggcagaaguagcagaugac

SEQ ID NO: 601081 - RNA, 22 nt, Human
cuuaauuuaaaauaguucaggc

SEQ ID NO: 601082 - RNA, 22 nt, Human
ugggggagaguuuagaugauuu

SEQ ID NO: 601083 - RNA, 22 nt, Human
uggcagaaguucacuaguagcu

SEQ ID NO: 601084 - RNA, 22 nt, Human
agcaaauaaagacaauuauguc

SEQ ID NO: 601085 - RNA, 22 nt, Human
ugucuccaugugauaguggccu

SEQ ID NO: 601086 - RNA, 17 nt, Human
aggagucucagaugagc

SEQ ID NO: 601087 - RNA, 22 nt, Human
guuuauaaauucugcuuuuguu

SEQ ID NO: 601088 - RNA, 22 nt, Human
gcuccaggagcucacagcucgc

SEQ ID NO: 601089 - RNA, 22 nt, Human
guuuuucuagacugggaguuug

SEQ ID NO: 601090 - RNA, 22 nt, Human
uauuccugguguuggcuggguc

SEQ ID NO: 601091 - RNA, 22 nt, Human
uagucuuccuggaagaaguguu

SEQ ID NO: 601092 - RNA, 22 nt, Human
guugaaaguagaugcuauuugg

SEQ ID NO: 601093 - RNA, 22 nt, Human
aagagcuggaagugaagauaac

SEQ ID NO: 601094 - RNA, 20 nt, Human
agaaacauuucuugagaacu

SEQ ID NO: 601095 - RNA, 23 nt, Human
gacagggcugacuuggcagcugc

SEQ ID NO: 601096 - RNA, 22 nt, Human
aggccagggccagauuagccac

SEQ ID NO: 601097 - RNA, 22 nt, Human
ccagugcagucccccugaacug

SEQ ID NO: 601098 - RNA, 22 nt, Human
acaaauuuggugagaguaaaua

SEQ ID NO: 601099 - RNA, 22 nt, Human
accagggcagccgagguguguc

SEQ ID NO: 601100 - RNA, 22 nt, Human
uggguuggucagcauaagaugg

SEQ ID NO: 601101 - RNA, 23 nt, Human
agaauuucuaacucuagcucugu

SEQ ID NO: 601102 - RNA, 22 nt, Human
acaaaggugagcagaagacaca

SEQ ID NO: 601103 - RNA, 22 nt, Human
uccugaaggcagauggggauca

SEQ ID NO: 601104 - RNA, 22 nt, Human
auuuucuauguuguaauuguua

SEQ ID NO: 601105 - RNA, 22 nt, Human
cugcuagcccaggaugcaggga

SEQ ID NO: 601106 - RNA, 22 nt, Human
uuagauaauguuauuguaauuu

SEQ ID NO: 601107 - RNA, 22 nt, Human
caggacagugcagguccauccu

SEQ ID NO: 601108 - RNA, 22 nt, Human
uauuuagaugcauuuggauugc

SEQ ID NO: 601109 - RNA, 22 nt, Human
uucuucaaagaugucuguugga

SEQ ID NO: 601110 - RNA, 22 nt, Human
aggcucuggaguuagccaggca

SEQ ID NO: 601111 - RNA, 22 nt, Human
gcuucuauuauuuggagcugag

SEQ ID NO: 601112 - RNA, 22 nt, Human
ugucaauguguacaggagcuca

SEQ ID NO: 601113 - RNA, 22 nt, Human
cuggggucucaauucuagcggg

SEQ ID NO: 601114 - RNA, 22 nt, Human
cacaguguagacuaauaauaga

SEQ ID NO: 601115 - RNA, 22 nt, Human
aggcaggggagcuggaagggua

SEQ ID NO: 601116 - RNA, 22 nt, Human
ugggugggagcgcccugucugg

SEQ ID NO: 601117 - RNA, 19 nt, Human
gcugggagcagacccuccc

SEQ ID NO: 601118 - RNA, 22 nt, Human
gucaaaaugagcuuuguuauug

SEQ ID NO: 601119 - RNA, 22 nt, Human
ggggccaguaggagugauguac

SEQ ID NO: 601120 - RNA, 22 nt, Human
auccacccugugguggcuuucu

SEQ ID NO: 601121 - RNA, 22 nt, Human
gccucagugauaugugggacaa

SEQ ID NO: 601122 - RNA, 18 nt, Human
uggccuggagacaacucu

SEQ ID NO: 601123 - RNA, 22 nt, Human
ccccagagaaagucagcagcau

SEQ ID NO: 601124 - RNA, 22 nt, Human
aaaugaacaguugcauucucug

SEQ ID NO: 601125 - RNA, 21 nt, Human
uuacuuuagaaauugccuuuu

SEQ ID NO: 601126 - RNA, 22 nt, Human
aggcagcuggcaaauucuagag

SEQ ID NO: 601127 - RNA, 19 nt, Human
uccaggggcuccaccuccu

SEQ ID NO: 601128 - RNA, 17 nt, Human
ggccacagagcuugggg

SEQ ID NO: 601129 - RNA, 22 nt, Human
caggcacugcacuaccacuuuu

SEQ ID NO: 601130 - RNA, 22 nt, Human
uuucaagcucuucaguguuauu

SEQ ID NO: 601131 - RNA, 22 nt, Human
gguagugaggugaaagagaggu

SEQ ID NO: 601132 - RNA, 22 nt, Human
ucccagagucagagguggggcc

SEQ ID NO: 601133 - RNA, 22 nt, Human
ccugaguagcuggaauuaaagg

SEQ ID NO: 601134 - RNA, 22 nt, Human
auaauauaauccuacuucccau

SEQ ID NO: 601135 - RNA, 22 nt, Human
uuuucauuagaaugacugagaa

SEQ ID NO: 601136 - RNA, 22 nt, Human
ggguggaggagaacaggcccca

SEQ ID NO: 601137 - RNA, 22 nt, Human
ucucuguggugggaggcugagu

SEQ ID NO: 601138 - RNA, 22 nt, Human
aggagcagaacuguuguggagg

SEQ ID NO: 601139 - RNA, 22 nt, Human
augacaauauagcuuugauuuu

SEQ ID NO: 601140 - RNA, 22 nt, Human
uagcuucccugcuggaucauaa

SEQ ID NO: 601141 - RNA, 22 nt, Human
uagaggagcggcgagcugagcu

SEQ ID NO: 601142 - RNA, 20 nt, Human
ggcagcaaccauaugcuaca

SEQ ID NO: 601143 - RNA, 22 nt, Human
auguguuuugguggaucauuca

SEQ ID NO: 601144 - RNA, 22 nt, Human
agggggcuccuccggugcuucc

SEQ ID NO: 601145 - RNA, 20 nt, Human
aauacuaaacacaaagcagu

SEQ ID NO: 601146 - RNA, 22 nt, Human
uagcacaucuggcgcuuauagg

SEQ ID NO: 601147 - RNA, 22 nt, Human
aaguuccucuucucugcaggga

SEQ ID NO: 601148 - RNA, 22 nt, Human
acagccaggacuuggcccucuu

SEQ ID NO: 601149 - RNA, 22 nt, Human
ggcuucucagcacacuguccac

SEQ ID NO: 601150 - RNA, 22 nt, Human
ugacacaggcagcucccagcac

SEQ ID NO: 601151 - RNA, 22 nt, Human
uccaggcugcaaggccacaggg

SEQ ID NO: 601152 - RNA, 19 nt, Human
uccccagcaccucugaguc

SEQ ID NO: 601153 - RNA, 22 nt, Human
cccagacauaacagcagagagg

SEQ ID NO: 601154 - RNA, 22 nt, Human
uucagacaauaagagucaucuc

SEQ ID NO: 601155 - RNA, 22 nt, Human
agcacuagcuuuaagcauucug

SEQ ID NO: 601156 - RNA, 22 nt, Human
cugccugcaugcugccauagcu

SEQ ID NO: 601157 - RNA, 22 nt, Human
gggccccaguccucccacgugg

SEQ ID NO: 601158 - RNA, 22 nt, Human
ccaggagcuggagggugcagug

SEQ ID NO: 601159 - RNA, 22 nt, Human
auugcugacucaauaauugaag

SEQ ID NO: 601160 - RNA, 22 nt, Human
ugcucagagcucuggugcaggu

SEQ ID NO: 601161 - RNA, 22 nt, Human
cuugcagaugugacuaaauuaa

SEQ ID NO: 601162 - RNA, 22 nt, Human
uggcucaguuucaguccugguu

SEQ ID NO: 601163 - RNA, 22 nt, Human
gcucuggguagccacugccugg

SEQ ID NO: 601164 - RNA, 22 nt, Human
uauuucaagaacuucuauccau

SEQ ID NO: 601165 - RNA, 22 nt, Human
cacaugaacaugcuggaaaagc

SEQ ID NO: 601166 - RNA, 22 nt, Human
gaaaguuuucauauauaccaaa

SEQ ID NO: 601167 - RNA, 22 nt, Human
ggaagaagcagggcauuugaau

SEQ ID NO: 601168 - RNA, 22 nt, Human
uccuucagcuacucaguuucca

SEQ ID NO: 601169 - RNA, 20 nt, Human
uugaaaaugcauugugcagu

SEQ ID NO: 601170 - RNA, 22 nt, Human
gccuuuaugucugaaaaucagc

SEQ ID NO: 601171 - RNA, 22 nt, Human
ugcaguuuaaacuuggcaacuu

SEQ ID NO: 601172 - RNA, 22 nt, Human
uaaaucacaaauuuucucauuu

SEQ ID NO: 601173 - RNA, 22 nt, Human
cucagagaguuaagugaauuac

SEQ ID NO: 601174 - RNA, 22 nt, Human
gagggagggccaggucccaacc

SEQ ID NO: 601175 - RNA, 22 nt, Human
ucuucuuugaaucauagugacc

SEQ ID NO: 601176 - RNA, 22 nt, Human
aucuuuuuacuaacacugcuua

SEQ ID NO: 601177 - RNA, 22 nt, Human
uucuaaaauaaguuuaucuggu

SEQ ID NO: 601178 - RNA, 22 nt, Human
aauacaaucaaauucacuagca

SEQ ID NO: 601179 - RNA, 22 nt, Human
ugccucugugggcagagcugcc

SEQ ID NO: 601180 - RNA, 22 nt, Human
auaaauuaugaauggcccuuuu

SEQ ID NO: 601181 - RNA, 22 nt, Human
aucuuucaucucuauuauuuga

SEQ ID NO: 601182 - RNA, 22 nt, Human
cuugcucacaguaccuggcuug

SEQ ID NO: 601183 - RNA, 22 nt, Human
uuggcuucccagagcuuacgcu

SEQ ID NO: 601184 - RNA, 22 nt, Human
cccaggaggcagauguugcagu

SEQ ID NO: 601185 - RNA, 22 nt, Human
ggcaaggguugaagauaaggua

SEQ ID NO: 601186 - RNA, 22 nt, Human
uugcagggaaacaguuuaggaa

SEQ ID NO: 601187 - RNA, 22 nt, Human
gacagccaucagcacacgcugc

SEQ ID NO: 601188 - RNA, 22 nt, Human
gcagcugcugggaucauuuagg

SEQ ID NO: 601189 - RNA, 22 nt, Human
uagcuuuguccuccacccucag

SEQ ID NO: 601190 - RNA, 22 nt, Human
aacauucagcuggguggagcag

SEQ ID NO: 601191 - RNA, 22 nt, Human
agucaggagauauuuugauaug

SEQ ID NO: 601192 - RNA, 22 nt, Human
agguccagguuccguuucugcg

SEQ ID NO: 601193 - RNA, 22 nt, Human
ucccagggauccuccgggucgc

SEQ ID NO: 601194 - RNA, 22 nt, Human
gagcccagggcaggcaaggcag

SEQ ID NO: 601195 - RNA, 22 nt, Human
uucugaaaugagauauaaggua

SEQ ID NO: 601196 - RNA, 22 nt, Human
agcaggaaggcuuuggggguuc

SEQ ID NO: 601197 - RNA, 22 nt, Human
guacaggucuuaucuccuagga

SEQ ID NO: 601198 - RNA, 22 nt, Human
agcucagaaaugccaguaggua

SEQ ID NO: 601199 - RNA, 23 nt, Human
gacacaggagcacccagcugagc

SEQ ID NO: 601200 - RNA, 22 nt, Human
ccaggcucugcaaaaucaggcu

SEQ ID NO: 601201 - RNA, 22 nt, Human
uucucugaguacguuucagugu

SEQ ID NO: 601202 - RNA, 22 nt, Human
uccaagaaucacugacacagcu

SEQ ID NO: 601203 - RNA, 22 nt, Human
guccugugugagugcaccaccu

SEQ ID NO: 601204 - RNA, 22 nt, Human
uauuaucauuaacuguugaauu

SEQ ID NO: 601205 - RNA, 22 nt, Human
ccaggucuuugacuaauaugcu

SEQ ID NO: 601206 - RNA, 22 nt, Human
uccauauuaacuaaaacuagaa

SEQ ID NO: 601207 - RNA, 23 nt, Human
ucauggaacugggcaaucuugaa

SEQ ID NO: 601208 - RNA, 22 nt, Human
aucacagauugugaauaacuau

SEQ ID NO: 601209 - RNA, 22 nt, Human
aaccugaauuuaauugaaauga

SEQ ID NO: 601210 - RNA, 22 nt, Human
gugugggggcagcucugauaug

SEQ ID NO: 601211 - RNA, 22 nt, Human
gagagcuggguucaaguagcug

SEQ ID NO: 601212 - RNA, 22 nt, Human
gaaaguuuauagguuauauaau

SEQ ID NO: 601213 - RNA, 22 nt, Human
auaaugcugggagaaauuguua

SEQ ID NO: 601214 - RNA, 22 nt, Human
guuguuuuauaauugauugcaa

SEQ ID NO: 601215 - RNA, 22 nt, Human
uuccaguuggcacugcaauuua

SEQ ID NO: 601216 - RNA, 21 nt, Human
uucuacaggaugaaugaaaac

SEQ ID NO: 601217 - RNA, 22 nt, Human
ucaguaaaauaaaacaugggac

SEQ ID NO: 601218 - RNA, 22 nt, Human
cuacauuuuucaccgagccucu

SEQ ID NO: 601219 - RNA, 22 nt, Human
agauugcuuuccaaaagcguug

SEQ ID NO: 601220 - RNA, 22 nt, Human
gcugaggcucaagucauggguc

SEQ ID NO: 601221 - RNA, 22 nt, Human
cuggccccgguuccuaaaaacc

SEQ ID NO: 601222 - RNA, 22 nt, Human
aggcagagcugauguucuguga

SEQ ID NO: 601223 - RNA, 22 nt, Human
uccaggcuaauuuugcauuguu

SEQ ID NO: 601224 - RNA, 22 nt, Human
gcaaacuguuggaguagagucu

SEQ ID NO: 601225 - RNA, 22 nt, Human
gcugggcacugucccauaggcu

SEQ ID NO: 601226 - RNA, 22 nt, Human
auuguauuagcacaauacaauu

SEQ ID NO: 601227 - RNA, 22 nt, Human
cagagcagucuggagauccagc

SEQ ID NO: 601228 - RNA, 22 nt, Human
caggccuggcugcagcucgccu

SEQ ID NO: 601229 - RNA, 19 nt, Human
ggcugcugguuacagaggc

SEQ ID NO: 601230 - RNA, 22 nt, Human
cagauggaacacagaaaggaga

SEQ ID NO: 601231 - RNA, 22 nt, Human
cuggggugagcagaaacagggg

SEQ ID NO: 601232 - RNA, 22 nt, Human
gaggcugggggcugccuuccuc

SEQ ID NO: 601233 - RNA, 17 nt, Human
aaucuguuuacagucag

SEQ ID NO: 601234 - RNA, 22 nt, Human
cagagaacuccaguggcuggcg

SEQ ID NO: 601235 - RNA, 22 nt, Human
aagauucaguugauguguucca

SEQ ID NO: 601236 - RNA, 22 nt, Human
uuagggaaguguuauucucagg

SEQ ID NO: 601237 - RNA, 22 nt, Human
agcugggcagacugcagugguu

SEQ ID NO: 601238 - RNA, 22 nt, Human
ugcaaaguugaggaaggcaugg

SEQ ID NO: 601239 - RNA, 22 nt, Human
guagacagaaagcggaaucaua

SEQ ID NO: 601240 - RNA, 22 nt, Human
gagcagcugagcuggaaugaga

SEQ ID NO: 601241 - RNA, 22 nt, Human
acaggugcaugcuaccaugucu

SEQ ID NO: 601242 - RNA, 22 nt, Human
uccaggcuagagugcaguggcc

SEQ ID NO: 601243 - RNA, 22 nt, Human
ucucugagaucagccacugacu

SEQ ID NO: 601244 - RNA, 22 nt, Human
ccucacaguuuggcuaacugug

SEQ ID NO: 601245 - RNA, 22 nt, Human
ucuugcagcuucaucugcaauu

SEQ ID NO: 601246 - RNA, 18 nt, Human
gaaagccaugcagcagug

SEQ ID NO: 601247 - RNA, 22 nt, Human
cagggagaggccucuguugccc

SEQ ID NO: 601248 - RNA, 22 nt, Human
ucaggagacaaagggugcggag

SEQ ID NO: 601249 - RNA, 23 nt, Human
aaagccaagucagucuacuggaa

SEQ ID NO: 601250 - RNA, 22 nt, Human
cagagcaguggagaguaggucu

SEQ ID NO: 601251 - RNA, 20 nt, Human
cagcucugggaaagaggcca

SEQ ID NO: 601252 - RNA, 22 nt, Human
uggguccauggaacagaggugc

SEQ ID NO: 601253 - RNA, 22 nt, Human
cugcagaggccucgccuccucu

SEQ ID NO: 601254 - RNA, 22 nt, Human
uagagcugcuggacuguaacag

SEQ ID NO: 601255 - RNA, 22 nt, Human
uuuuccuacugauaaacaguua

SEQ ID NO: 601256 - RNA, 22 nt, Human
ggaaggagcauuugccaguuua

SEQ ID NO: 601257 - RNA, 18 nt, Human
cugaggcuuagagagguu

SEQ ID NO: 601258 - RNA, 22 nt, Human
cacagagacaugaugucauugc

SEQ ID NO: 601259 - RNA, 22 nt, Human
cagccugcauuuguaucuguau

SEQ ID NO: 601260 - RNA, 22 nt, Human
acauuuugaaagggaaauuguu

SEQ ID NO: 601261 - RNA, 22 nt, Human
uuuaugacauuacaauaucaag

SEQ ID NO: 601262 - RNA, 22 nt, Human
uggcagagacaaggccgggccu

SEQ ID NO: 601263 - RNA, 22 nt, Human
ggcccagccggcgagucucgcg

SEQ ID NO: 601264 - RNA, 22 nt, Human
uggaaugugguaucaguagaaa

SEQ ID NO: 601265 - RNA, 22 nt, Human
ugagccagagagguugaggcua

SEQ ID NO: 601266 - RNA, 18 nt, Human
uggagccagcucuaggau

SEQ ID NO: 601267 - RNA, 22 nt, Human
augucuuuuaugauuacgggau

SEQ ID NO: 601268 - RNA, 22 nt, Human
auuuuaacccucuuauauauac

SEQ ID NO: 601269 - RNA, 22 nt, Human
uucuuucacucaagaaggaucu

SEQ ID NO: 601270 - RNA, 22 nt, Human
uuaucauaaguaauugaaauaa

SEQ ID NO: 601271 - RNA, 22 nt, Human
uccaccauguaacaagcucugu

SEQ ID NO: 601272 - RNA, 22 nt, Human
uauuaaagggaaguuaugcaug

SEQ ID NO: 601273 - RNA, 22 nt, Human
ucccugagaaagcccaggaggu

SEQ ID NO: 601274 - RNA, 22 nt, Human
ccaggacugcagggggcgagga

SEQ ID NO: 601275 - RNA, 22 nt, Human
gcccagcaaggaccaagggccg

SEQ ID NO: 601276 - RNA, 22 nt, Human
ucugcagaauucgaggaagaaa

SEQ ID NO: 601277 - RNA, 22 nt, Human
uaaggcagauguggaaucaauu

SEQ ID NO: 601278 - RNA, 22 nt, Human
ucaggcugugggcacuggccau

SEQ ID NO: 601279 - RNA, 22 nt, Human
acauuauagcuuugaguuugga

SEQ ID NO: 601280 - RNA, 22 nt, Human
uucuucaaaauccagcaugauu

SEQ ID NO: 601281 - RNA, 22 nt, Human
ucugcugacauuuaugaauaga

SEQ ID NO: 601282 - RNA, 22 nt, Human
caggccugucugcacaugaggc

SEQ ID NO: 601283 - RNA, 22 nt, Human
cacacauuucagaugcuacaau

SEQ ID NO: 601284 - RNA, 22 nt, Human
cuuggggacacagagcccaggg

SEQ ID NO: 601285 - RNA, 22 nt, Human
gccaugggcaaaugcagagcug

SEQ ID NO: 601286 - RNA, 22 nt, Human
uauugaaauccauuacguucuu

SEQ ID NO: 601287 - RNA, 22 nt, Human
ccagaaaauauggcuaagguga

SEQ ID NO: 601288 - RNA, 22 nt, Human
acuuucuucuacuacuuggaga

SEQ ID NO: 601289 - RNA, 22 nt, Human
aggcagaauguuggaaaggaag

SEQ ID NO: 601290 - RNA, 22 nt, Human
cagaagccugccucagaugcac

SEQ ID NO: 601291 - RNA, 22 nt, Human
aagaaauaagacuucucugucc

SEQ ID NO: 601292 - RNA, 19 nt, Human
ucucacaagcaacauuguu

SEQ ID NO: 601293 - RNA, 22 nt, Human
augacaguagguaaaugauagc

SEQ ID NO: 601294 - RNA, 22 nt, Human
ugaggcaggacugagcgggaug

SEQ ID NO: 601295 - RNA, 22 nt, Human
ggcccaaggugccaaggccucc

SEQ ID NO: 601296 - RNA, 22 nt, Human
augcugugagugugccgcagag

SEQ ID NO: 601297 - RNA, 23 nt, Human
uacagcugcagaaucaggcuaag

SEQ ID NO: 601298 - RNA, 22 nt, Human
guccugggcggagggcugcugu

SEQ ID NO: 601299 - RNA, 22 nt, Human
ucuucagcagagaauuaugaug

SEQ ID NO: 601300 - RNA, 22 nt, Human
aaacaguggccaauucuggaga

SEQ ID NO: 601301 - RNA, 19 nt, Human
uccuuucuguuccugagau

SEQ ID NO: 601302 - RNA, 22 nt, Human
cagcuccuauuagacacugaau

SEQ ID NO: 601303 - RNA, 22 nt, Human
acacaaaguuggaugacaaaau

SEQ ID NO: 601304 - RNA, 22 nt, Human
aaagguuuuucagcagggagau

SEQ ID NO: 601305 - RNA, 22 nt, Human
uuacaagacagugugguaaaua

SEQ ID NO: 601306 - RNA, 20 nt, Human
cugcugcccugucagccucu

SEQ ID NO: 601307 - RNA, 22 nt, Human
guucucugccggcaccuacccg

SEQ ID NO: 601308 - RNA, 22 nt, Human
ccauggagcgggugagugagug

SEQ ID NO: 601309 - RNA, 22 nt, Human
uuucugauucucacuuuggcau

SEQ ID NO: 601310 - RNA, 22 nt, Human
acuuucugcaguguuggaaaug

SEQ ID NO: 601311 - RNA, 22 nt, Human
auuagcuucaaagccaucaacc

SEQ ID NO: 601312 - RNA, 22 nt, Human
ucaagacauauuaaaugugcga

SEQ ID NO: 601313 - RNA, 22 nt, Human
cauaauuacugauaugcugauu

SEQ ID NO: 601314 - RNA, 22 nt, Human
ugcugguccuggagcuggguuc

SEQ ID NO: 601315 - RNA, 22 nt, Human
ccacagaguuacaaaacaguca

SEQ ID NO: 601316 - RNA, 22 nt, Human
cuguuggccuuucaucaguaau

SEQ ID NO: 601317 - RNA, 22 nt, Human
cacugugucaguuugguuagac

SEQ ID NO: 601318 - RNA, 22 nt, Human
cucuuaguuuaucuuugacaaa

SEQ ID NO: 601319 - RNA, 22 nt, Human
ugcuugaagccuacauucguca

SEQ ID NO: 601320 - RNA, 22 nt, Human
cugaggcauguuacaggacaua

SEQ ID NO: 601321 - RNA, 22 nt, Human
auuuauuggaugcuuacuuggg

SEQ ID NO: 601322 - RNA, 22 nt, Human
cauuaauauuguucuucuuuag

SEQ ID NO: 601323 - RNA, 22 nt, Human
ucacugaacucucauagagaaa

SEQ ID NO: 601324 - RNA, 22 nt, Human
auguguuuuuauucuggcaugu

SEQ ID NO: 601325 - RNA, 22 nt, Human
uauaggaaauaggucuucugug

SEQ ID NO: 601326 - RNA, 19 nt, Human
auggcagcagcagcucucc

SEQ ID NO: 601327 - RNA, 22 nt, Human
aggcucccaagcacugacccca

SEQ ID NO: 601328 - RNA, 22 nt, Human
acugcagagcuuuucaguugag

SEQ ID NO: 601329 - RNA, 22 nt, Human
ccugaggcuccaccuccagaga

SEQ ID NO: 601330 - RNA, 22 nt, Human
augauugaccaucugcugggcu

SEQ ID NO: 601331 - RNA, 22 nt, Human
aaggcuuguguguucagugagg

SEQ ID NO: 601332 - RNA, 22 nt, Human
uccuuuuuauaguuagagaaac

SEQ ID NO: 601333 - RNA, 22 nt, Human
gggaaacugaauucaggacucu

SEQ ID NO: 601334 - RNA, 22 nt, Human
gugcaaaaggcauugugguuuu

SEQ ID NO: 601335 - RNA, 22 nt, Human
caggaaagccgagugccauagg

SEQ ID NO: 601336 - RNA, 22 nt, Human
auaggccauuugagggccaggu

SEQ ID NO: 601337 - RNA, 22 nt, Human
gcauucuugguaugaaggacag

SEQ ID NO: 601338 - RNA, 22 nt, Human
gcugggaguuugauuugacugg

SEQ ID NO: 601339 - RNA, 22 nt, Human
cuggcucugugggaccuggccu

SEQ ID NO: 601340 - RNA, 22 nt, Human
ugcaauauguugcauuguaugg

SEQ ID NO: 601341 - RNA, 22 nt, Human
uauuaugaggacugguguaagg

SEQ ID NO: 601342 - RNA, 22 nt, Human
uggcagcugugcuucauucuuu

SEQ ID NO: 601343 - RNA, 22 nt, Human
cagaguucaaagccugcuggga

SEQ ID NO: 601344 - RNA, 22 nt, Human
gccugcagccucagagaauuuu

SEQ ID NO: 601345 - RNA, 22 nt, Human
cagcacagggcuugagaggugu

SEQ ID NO: 601346 - RNA, 22 nt, Human
guuuccauggcucuguuaaugg

SEQ ID NO: 601347 - RNA, 22 nt, Human
gagguauggauaucuggagagg

SEQ ID NO: 601348 - RNA, 22 nt, Human
ugggucuguagggcuguccaau

SEQ ID NO: 601349 - RNA, 21 nt, Human
ccugagaucuggaguggcuuu

SEQ ID NO: 601350 - RNA, 22 nt, Human
gaacaguauuuccaggaauccc

SEQ ID NO: 601351 - RNA, 22 nt, Human
ucugaaggucugagaaccagga

SEQ ID NO: 601352 - RNA, 22 nt, Human
uccaggugacagagacaggaua

SEQ ID NO: 601353 - RNA, 20 nt, Human
gcugugccuccagcuggugg

SEQ ID NO: 601354 - RNA, 18 nt, Human
uagcacagagcaggaugu

SEQ ID NO: 601355 - RNA, 22 nt, Human
ucuauacaugugcacacacauc

SEQ ID NO: 601356 - RNA, 22 nt, Human
cugaggcugagacaggugaaau

SEQ ID NO: 601357 - RNA, 21 nt, Human
gagugcaggucugaugccauc

SEQ ID NO: 601358 - RNA, 22 nt, Human
ucuggggaccauggcaucuaaa

SEQ ID NO: 601359 - RNA, 22 nt, Human
ugguggagaccucgcuaacccc

SEQ ID NO: 601360 - RNA, 22 nt, Human
cuccugggaugacucuuucuuu

SEQ ID NO: 601361 - RNA, 22 nt, Human
cucagcucugacaggaggcauc

SEQ ID NO: 601362 - RNA, 18 nt, Human
agccuggaggguugaagu

SEQ ID NO: 601363 - RNA, 22 nt, Human
acucugugugaguagagccugu

SEQ ID NO: 601364 - RNA, 22 nt, Human
caguucuaauuaauaggaguaa

SEQ ID NO: 601365 - RNA, 22 nt, Human
uuuguauuuuucccagcuagcu

SEQ ID NO: 601366 - RNA, 22 nt, Human
ucuucuguccuaagucaaagca

SEQ ID NO: 601367 - RNA, 22 nt, Human
caaaacugucuagagagagaag

SEQ ID NO: 601368 - RNA, 22 nt, Human
gccaguggcccucuggagaagg

SEQ ID NO: 601369 - RNA, 22 nt, Human
uaggcugggccugccuuccagg

SEQ ID NO: 601370 - RNA, 22 nt, Human
agugaagaggaaguggggcaca

SEQ ID NO: 601371 - RNA, 19 nt, Human
cuugugcaguucacgcuca

SEQ ID NO: 601372 - RNA, 22 nt, Human
ucugaaauaagggagaagggaa

SEQ ID NO: 601373 - RNA, 22 nt, Human
cagcucugccucuggggcugag

SEQ ID NO: 601374 - RNA, 19 nt, Human
ggcccaaguacugagugcc

SEQ ID NO: 601375 - RNA, 22 nt, Human
auguuaaaaaccaguacaguug

SEQ ID NO: 601376 - RNA, 22 nt, Human
auaguacagagggcuacugguu

SEQ ID NO: 601377 - RNA, 22 nt, Human
ugggggaagagcuuguuaaagu

SEQ ID NO: 601378 - RNA, 23 nt, Human
acagccaguucaccucuccuugg

SEQ ID NO: 601379 - RNA, 22 nt, Human
uagugaaaccugacagaucaug

SEQ ID NO: 601380 - RNA, 22 nt, Human
gacccagccugguuuuuauagg

SEQ ID NO: 601381 - RNA, 22 nt, Human
aaaaccagacacuguuucuggg

SEQ ID NO: 601382 - RNA, 22 nt, Human
cagggcuuuuuauuagcugccu

SEQ ID NO: 601383 - RNA, 20 nt, Human
cccugugauuggcaaguguc

SEQ ID NO: 601384 - RNA, 22 nt, Human
gccaggaggucagccccucaac

SEQ ID NO: 601385 - RNA, 22 nt, Human
aaaauucucuugaucuugacag

SEQ ID NO: 601386 - RNA, 22 nt, Human
aucauucaagugcucuaaaaug

SEQ ID NO: 601387 - RNA, 22 nt, Human
ugaaaugacagucuuaagcucu

SEQ ID NO: 601388 - RNA, 22 nt, Human
agacaaaugaacaaauauguga

SEQ ID NO: 601389 - RNA, 22 nt, Human
gcagggucuugagaggcagcca

SEQ ID NO: 601390 - RNA, 22 nt, Human
uugaggaaaggaauuuauuuua

SEQ ID NO: 601391 - RNA, 22 nt, Human
aguggggaagagcaugggcccu

SEQ ID NO: 601392 - RNA, 22 nt, Human
ucccagaaucuuuggaagagca

SEQ ID NO: 601393 - RNA, 22 nt, Human
cccagggcccuggacagcuaca

SEQ ID NO: 601394 - RNA, 22 nt, Human
aggcagcagacuguuaaucaga

SEQ ID NO: 601395 - RNA, 22 nt, Human
ccaggacuucgaggcuacagug

SEQ ID NO: 601396 - RNA, 22 nt, Human
caaaauuagggagugagcugga

SEQ ID NO: 601397 - RNA, 22 nt, Human
caugugugaaucuugugaucau

SEQ ID NO: 601398 - RNA, 22 nt, Human
gaggcugcaggcaaugcugccc

SEQ ID NO: 601399 - RNA, 22 nt, Human
ugcauuuuuaacaaggcuaauu

SEQ ID NO: 601400 - RNA, 19 nt, Human
uaccauguugacuuuccug

SEQ ID NO: 601401 - RNA, 22 nt, Human
gagaagccgagucagcugagcc

SEQ ID NO: 601402 - RNA, 22 nt, Human
gacugggaggguucagcugggu

SEQ ID NO: 601403 - RNA, 22 nt, Human
cacuaguccugguuucaugcua

SEQ ID NO: 601404 - RNA, 22 nt, Human
ugcugccaaaugcgagcucugu

SEQ ID NO: 601405 - RNA, 22 nt, Human
cccugcccugggcagaaguggg

SEQ ID NO: 601406 - RNA, 22 nt, Human
aggcaucugccuccucuacccc

SEQ ID NO: 601407 - RNA, 22 nt, Human
gggcugagaauucagcuuuccu

SEQ ID NO: 601408 - RNA, 22 nt, Human
acagguggacacagcagcaguc

SEQ ID NO: 601409 - RNA, 22 nt, Human
uuuguuuucuguaggccuuucc

SEQ ID NO: 601410 - RNA, 22 nt, Human
gauauuuucgcagggagaauuc

SEQ ID NO: 601411 - RNA, 22 nt, Human
gagguuggcgcccugccuggcc

SEQ ID NO: 601412 - RNA, 22 nt, Human
augaaugagugcuagguuuguc

SEQ ID NO: 601413 - RNA, 22 nt, Human
uccccaggaaucaggugguugc

SEQ ID NO: 601414 - RNA, 22 nt, Human
ggucucugucacugaguggccc

SEQ ID NO: 601415 - RNA, 22 nt, Human
agaauacuaggcuucagaaagg

SEQ ID NO: 601416 - RNA, 22 nt, Human
caugcuuaugauuugcuaagcc

SEQ ID NO: 601417 - RNA, 22 nt, Human
uggcuucucugugugagggaga

SEQ ID NO: 601418 - RNA, 22 nt, Human
aauaaacaaauccuuccuuccc

SEQ ID NO: 601419 - RNA, 22 nt, Human
cacaagaaauaagcugccuuuc

SEQ ID NO: 601420 - RNA, 22 nt, Human
agcagcugcagggagggucugc

SEQ ID NO: 601421 - RNA, 22 nt, Human
gugagcagaacagguggcuucu

SEQ ID NO: 601422 - RNA, 22 nt, Human
cuccccauugugaccucaucca

SEQ ID NO: 601423 - RNA, 22 nt, Human
gcacaggccaugggaggacagc

SEQ ID NO: 601424 - RNA, 22 nt, Human
ccucccugggugacgggcuccu

SEQ ID NO: 601425 - RNA, 21 nt, Human
uggguggaagcgggaggccgc

SEQ ID NO: 601426 - RNA, 22 nt, Human
aucuguccugugacagugggag

SEQ ID NO: 601427 - RNA, 23 nt, Human
cucagagguguuuuucacuuacu

SEQ ID NO: 601428 - RNA, 22 nt, Human
aggaaacucaaagugucaggua

SEQ ID NO: 601429 - RNA, 22 nt, Human
uccuccagaaacugaggcagaa

SEQ ID NO: 601430 - RNA, 20 nt, Human
augcuuaaguguucauuauu

SEQ ID NO: 601431 - RNA, 22 nt, Human
ggugggggagacuuggucaaga

SEQ ID NO: 601432 - RNA, 22 nt, Human
ucuggaguuaguuauaaugguu

SEQ ID NO: 601433 - RNA, 21 nt, Human
ucaggcugaugucgauguuag

SEQ ID NO: 601434 - RNA, 22 nt, Human
acuucuucuucagcugggggau

SEQ ID NO: 601435 - RNA, 22 nt, Human
gaacagcuauaaucaucugucc

SEQ ID NO: 601436 - RNA, 22 nt, Human
aagugaagaaauacaugagaau

SEQ ID NO: 601437 - RNA, 22 nt, Human
ccugggcuugguuguugagaac

SEQ ID NO: 601438 - RNA, 22 nt, Human
cucagcuggcaauucuggcucc

SEQ ID NO: 601439 - RNA, 22 nt, Human
cgucacuucuuagucuauuuuc

SEQ ID NO: 601440 - RNA, 22 nt, Human
ucuauaauccuauuucaacugc

SEQ ID NO: 601441 - RNA, 22 nt, Human
agagcuguguuuaguaguuacg

SEQ ID NO: 601442 - RNA, 22 nt, Human
cagcucuucagagugagcaaug

SEQ ID NO: 601443 - RNA, 22 nt, Human
aggucacguccugugaugucau

SEQ ID NO: 601444 - RNA, 22 nt, Human
gggccaggaguggagauauggg

SEQ ID NO: 601445 - RNA, 22 nt, Human
gaugauuuuguuggugauucaa

SEQ ID NO: 601446 - RNA, 22 nt, Human
auucuucuugagucuuggacuc

SEQ ID NO: 601447 - RNA, 22 nt, Human
uugaggaggccuuucagggcuu

SEQ ID NO: 601448 - RNA, 22 nt, Human
caggcauuucgcaaaggcugag

SEQ ID NO: 601449 - RNA, 22 nt, Human
gucugcccuuccucuccacgau

SEQ ID NO: 601450 - RNA, 23 nt, Human
cccaggaguuucacugcaaaggu

SEQ ID NO: 601451 - RNA, 22 nt, Human
cucccucaccaugacccgcugu

SEQ ID NO: 601452 - RNA, 22 nt, Human
aauacugucuuucacagauauu

SEQ ID NO: 601453 - RNA, 22 nt, Human
guuccugaugcuuugaaauuca

SEQ ID NO: 601454 - RNA, 22 nt, Human
ugguaaauauguccauucucuu

SEQ ID NO: 601455 - RNA, 22 nt, Human
gagugcaguaucuucugugucc

SEQ ID NO: 601456 - RNA, 22 nt, Human
uugcugauuuccccuugagugu

SEQ ID NO: 601457 - RNA, 22 nt, Human
aaauauacuagaugaugaccca

SEQ ID NO: 601458 - RNA, 22 nt, Human
caugauauaaaguaguagauaa

SEQ ID NO: 601459 - RNA, 23 nt, Human
agaugaggcuucuccauguuggu

SEQ ID NO: 601460 - RNA, 22 nt, Human
aucuucaacuugaucauuugaa

SEQ ID NO: 601461 - RNA, 21 nt, Human
uccugggggguaggugaguuu

SEQ ID NO: 601462 - RNA, 22 nt, Human
uccagcucagaugcagggauca

SEQ ID NO: 601463 - RNA, 22 nt, Human
uaagauaauccauuauaauguu

SEQ ID NO: 601464 - RNA, 22 nt, Human
cccagggacagaugggcagcua

SEQ ID NO: 601465 - RNA, 22 nt, Human
agagaagacuuacagccacagu

SEQ ID NO: 601466 - RNA, 22 nt, Human
aggaaaaucgagucuggaggca

SEQ ID NO: 601467 - RNA, 22 nt, Human
cugccaggccuggggugcuguc

SEQ ID NO: 601468 - RNA, 22 nt, Human
gcagccuguuguaccagccugu

SEQ ID NO: 601469 - RNA, 21 nt, Human
caaagccaggcaacucucucc

SEQ ID NO: 601470 - RNA, 22 nt, Human
cagcagcucacucagguggcuc

SEQ ID NO: 601471 - RNA, 22 nt, Human
accagaaaggaauaauagaauu

SEQ ID NO: 601472 - RNA, 22 nt, Human
uaaucuacuguuuauaugaaau

SEQ ID NO: 601473 - RNA, 22 nt, Human
auucuucucccuuagggcccag

SEQ ID NO: 601474 - RNA, 22 nt, Human
ccagcagcgauagggugagugc

SEQ ID NO: 601475 - RNA, 20 nt, Human
aagcagaagcugcucucagc

SEQ ID NO: 601476 - RNA, 22 nt, Human
ggcagucaagagggagucugaa

SEQ ID NO: 601477 - RNA, 22 nt, Human
aaacagcuaaguacauucaagg

SEQ ID NO: 601478 - RNA, 22 nt, Human
guggccaggacauugccaggca

SEQ ID NO: 601479 - RNA, 22 nt, Human
ccaggagaugauguuggggauu

SEQ ID NO: 601480 - RNA, 20 nt, Human
ugugcccaauguccagguuc

SEQ ID NO: 601481 - RNA, 19 nt, Human
ccuuccuccccagggccau

SEQ ID NO: 601482 - RNA, 22 nt, Human
aauguguacaugacagauagaa

SEQ ID NO: 601483 - RNA, 22 nt, Human
uucagcuugcugacugcggcag

SEQ ID NO: 601484 - RNA, 22 nt, Human
ucuaccacuaagugugcuuuga

SEQ ID NO: 601485 - RNA, 22 nt, Human
agaggccaucugcucugugggg

SEQ ID NO: 601486 - RNA, 21 nt, Human
cugggcucaugguguuacaga

SEQ ID NO: 601487 - RNA, 22 nt, Human
gacggggcagccagcugguggc

SEQ ID NO: 601488 - RNA, 22 nt, Human
uauaaaugccaggacuuuagau

SEQ ID NO: 601489 - RNA, 22 nt, Human
acugagggagagucuuagguug

SEQ ID NO: 601490 - RNA, 22 nt, Human
agucuacaacgcaagcaacaug

SEQ ID NO: 601491 - RNA, 22 nt, Human
auuucacagcugcuguucaggu

SEQ ID NO: 601492 - RNA, 22 nt, Human
ucugagcuggagcccaucaccu

SEQ ID NO: 601493 - RNA, 22 nt, Human
uuuagaggaggaagaaauuuug

SEQ ID NO: 601494 - RNA, 23 nt, Human
aguguuaaauuucgcaccuaaau

SEQ ID NO: 601495 - RNA, 19 nt, Human
ucagggggcugauaggagg

SEQ ID NO: 601496 - RNA, 22 nt, Human
ggauggccuucuugcucaggaa

SEQ ID NO: 601497 - RNA, 22 nt, Human
agccacagcauguguguaugua

SEQ ID NO: 601498 - RNA, 22 nt, Human
aacuucauguaauuuaaaacag

SEQ ID NO: 601499 - RNA, 22 nt, Human
uccugagauaaaucucauguga

SEQ ID NO: 601500 - RNA, 22 nt, Human
acaacuuuguagcaauuccacg

SEQ ID NO: 601501 - RNA, 22 nt, Human
cuucugaagagguuaucauaga

SEQ ID NO: 601502 - RNA, 22 nt, Human
ccagcacucuauugaauauucu

SEQ ID NO: 601503 - RNA, 22 nt, Human
agggaggaucugcuccuugucu

SEQ ID NO: 601504 - RNA, 22 nt, Human
cagagcagauuucuaaguauug

SEQ ID NO: 601505 - RNA, 22 nt, Human
uggcucagaugcucuuccagug

SEQ ID NO: 601506 - RNA, 22 nt, Human
aaguggaggccgaguucacgca

SEQ ID NO: 601507 - RNA, 22 nt, Human
gagcuggacuuucagauacauc

SEQ ID NO: 601508 - RNA, 22 nt, Human
cugggguggugcaggccucaug

SEQ ID NO: 601509 - RNA, 22 nt, Human
ucacaaagcuuugauaagcaga

SEQ ID NO: 601510 - RNA, 22 nt, Human
uggggccagggaggaccagaca

SEQ ID NO: 601511 - RNA, 22 nt, Human
augcuuuagugucaaguuuggg

SEQ ID NO: 601512 - RNA, 22 nt, Human
ugcuuaaaauaguucauuuuug

SEQ ID NO: 601513 - RNA, 22 nt, Human
acuucuguaaagggaagacagu

SEQ ID NO: 601514 - RNA, 22 nt, Human
auccuucuucugcuagugucua

SEQ ID NO: 601515 - RNA, 22 nt, Human
aauccagcugugucacagguga

SEQ ID NO: 601516 - RNA, 22 nt, Human
uggugcaaaacuaauugcgguu

SEQ ID NO: 601517 - RNA, 22 nt, Human
gcucugggccauccuggccggg

SEQ ID NO: 601518 - RNA, 22 nt, Human
ucucagaauccuugcccaggug

SEQ ID NO: 601519 - RNA, 22 nt, Human
uuguuuucagggugucauucac

SEQ ID NO: 601520 - RNA, 22 nt, Human
ugagguaggugucgagagaggu

SEQ ID NO: 601521 - RNA, 22 nt, Human
ucugccugcaguguggcagggc

SEQ ID NO: 601522 - RNA, 22 nt, Human
aacuuuucauugaaucauguca

SEQ ID NO: 601523 - RNA, 22 nt, Human
accuggagucauuugaggagua

SEQ ID NO: 601524 - RNA, 22 nt, Human
gcacccagaauaaggacaggac

SEQ ID NO: 601525 - RNA, 19 nt, Human
cacauuuugagucugagau

SEQ ID NO: 601526 - RNA, 22 nt, Human
ugggccugggucuuugcugcca

SEQ ID NO: 601527 - RNA, 19 nt, Human
gcuggggaauggauauuga

SEQ ID NO: 601528 - RNA, 22 nt, Human
cggcagagacggcgcuuugaac

SEQ ID NO: 601529 - RNA, 22 nt, Human
caugcuaaaccagaacauagga

SEQ ID NO: 601530 - RNA, 22 nt, Human
cagucccagcugcucagaaggc

SEQ ID NO: 601531 - RNA, 22 nt, Human
ucaaguaacaugaacacacaga

SEQ ID NO: 601532 - RNA, 22 nt, Human
cuuuuaagggauaauaagaugu

SEQ ID NO: 601533 - RNA, 22 nt, Human
gccugaagaacagcugugagga

SEQ ID NO: 601534 - RNA, 22 nt, Human
agggccugggguagcuuacugc

SEQ ID NO: 601535 - RNA, 22 nt, Human
uuccuuaaugaaucaggccauu

SEQ ID NO: 601536 - RNA, 22 nt, Human
cacagaggauuuuuagggcagu

SEQ ID NO: 601537 - RNA, 22 nt, Human
augaggucuggcaaucagaaac

SEQ ID NO: 601538 - RNA, 22 nt, Human
uuuuagauugggaaauguaaag

SEQ ID NO: 601539 - RNA, 22 nt, Human
acuuaaaguaguuuuacugugg

SEQ ID NO: 601540 - RNA, 22 nt, Human
cuuuccucuggcacugucuggu

SEQ ID NO: 601541 - RNA, 22 nt, Human
ccagggcuuaacuuuucaggag

SEQ ID NO: 601542 - RNA, 22 nt, Human
gugccuccaucagugccuccaa

SEQ ID NO: 601543 - RNA, 22 nt, Human
uugaaauauuugggaguguuug

SEQ ID NO: 601544 - RNA, 18 nt, Human
guuaauuuugaaguucau

SEQ ID NO: 601545 - RNA, 22 nt, Human
cccugcagccuugcaugccuuc

SEQ ID NO: 601546 - RNA, 22 nt, Human
cagaccugagguugaguaccag

SEQ ID NO: 601547 - RNA, 22 nt, Human
gcaauguuguguuggcauucua

SEQ ID NO: 601548 - RNA, 18 nt, Human
aguaaauguuaaauauug

SEQ ID NO: 601549 - RNA, 20 nt, Human
uguucugucgucuuucuuca

SEQ ID NO: 601550 - RNA, 22 nt, Human
uacauucauggugacuuguaug

SEQ ID NO: 601551 - RNA, 22 nt, Human
uagcuuugacaguugcaggcag

SEQ ID NO: 601552 - RNA, 22 nt, Human
ugaaggcacuugccuaggggca

SEQ ID NO: 601553 - RNA, 22 nt, Human
acgcagaagggccuggcgugcc

SEQ ID NO: 601554 - RNA, 22 nt, Human
aauaucaguauauuguaucagu

SEQ ID NO: 601555 - RNA, 22 nt, Human
auaaacugaagggaacacugag

SEQ ID NO: 601556 - RNA, 22 nt, Human
uggcuucuuuccacuguccugu

SEQ ID NO: 601557 - RNA, 22 nt, Human
aggauggggucugcagccuggu

SEQ ID NO: 601558 - RNA, 22 nt, Human
agggauggagugcggcccggac

SEQ ID NO: 601559 - RNA, 22 nt, Human
uagaggcugggaauuauuuuca

SEQ ID NO: 601560 - RNA, 22 nt, Human
ucccugggaacaaaggaugaga

SEQ ID NO: 601561 - RNA, 22 nt, Human
cauauacacuuccaccucugug

SEQ ID NO: 601562 - RNA, 22 nt, Human
aauacuuugccaaguucgaaga

SEQ ID NO: 601563 - RNA, 22 nt, Human
gcuucuguggugaggucaccuu

SEQ ID NO: 601564 - RNA, 21 nt, Human
auuugcauuaaaauauuacgc

SEQ ID NO: 601565 - RNA, 22 nt, Human
ugcagccauuuucugccaaugc

SEQ ID NO: 601566 - RNA, 22 nt, Human
uacacauuacauaauacuaucu

SEQ ID NO: 601567 - RNA, 22 nt, Human
acaaacuaaaauucuuuauuga

SEQ ID NO: 601568 - RNA, 22 nt, Human
cauuaaaauaucucaugguguu

SEQ ID NO: 601569 - RNA, 22 nt, Human
uugugcauuucucugagugugu

SEQ ID NO: 601570 - RNA, 22 nt, Human
ccuggguccacccugugaagua

SEQ ID NO: 601571 - RNA, 22 nt, Human
caaguccucugguuucaaauag

SEQ ID NO: 601572 - RNA, 22 nt, Human
augcauauguacuugcauaugu

SEQ ID NO: 601573 - RNA, 22 nt, Human
uacauugcucauuauauugcuu

SEQ ID NO: 601574 - RNA, 22 nt, Human
agguuagauaagaagguugugg

SEQ ID NO: 601575 - RNA, 19 nt, Human
ugagaggcuuaaggcagcu

SEQ ID NO: 601576 - RNA, 22 nt, Human
aaagaggauggaguagucagcu

SEQ ID NO: 601577 - RNA, 22 nt, Human
auuuucuaagccugucagacuu

SEQ ID NO: 601578 - RNA, 22 nt, Human
aguaccaugcuuccugacuggu

SEQ ID NO: 601579 - RNA, 22 nt, Human
uuuagcuuuaccucauagauuu

SEQ ID NO: 601580 - RNA, 22 nt, Human
agagcaagugacagaaacaggg

SEQ ID NO: 601581 - RNA, 22 nt, Human
uugaggucugugauaaaaguca

SEQ ID NO: 601582 - RNA, 22 nt, Human
gaagauuuggauuccaugucac

SEQ ID NO: 601583 - RNA, 22 nt, Human
gugggagaagauuuggucaucu

SEQ ID NO: 601584 - RNA, 22 nt, Human
gccuggagcucuccacuugggg

SEQ ID NO: 601585 - RNA, 19 nt, Human
ggcagccugcacgggcugc

SEQ ID NO: 601586 - RNA, 22 nt, Human
cugcaggcaucuaacugugggc

SEQ ID NO: 601587 - RNA, 21 nt, Human
cagccugcugcuccagggcca

SEQ ID NO: 601588 - RNA, 22 nt, Human
caaauuuuguguguucucuagu

SEQ ID NO: 601589 - RNA, 22 nt, Human
gagaaagauuguccuucagggg

SEQ ID NO: 601590 - RNA, 22 nt, Human
caguggaaaucagagugagagu

SEQ ID NO: 601591 - RNA, 22 nt, Human
uauguacauggagagcaauuga

SEQ ID NO: 601592 - RNA, 20 nt, Human
uuaugcaagcaucaauauug

SEQ ID NO: 601593 - RNA, 22 nt, Human
cagucuuuuguauauuagcaga

SEQ ID NO: 601594 - RNA, 22 nt, Human
ggcacaagguuuaaauaacauc

SEQ ID NO: 601595 - RNA, 22 nt, Human
cucuccacuguccuuugcuggu

SEQ ID NO: 601596 - RNA, 22 nt, Human
gaguuauucuagguccuuugua

SEQ ID NO: 601597 - RNA, 22 nt, Human
auaguucacuaauagcaaaagc

SEQ ID NO: 601598 - RNA, 22 nt, Human
ccagguguucuuugucccuguu

SEQ ID NO: 601599 - RNA, 20 nt, Human
acagaugaggaaaaugaagu

SEQ ID NO: 601600 - RNA, 20 nt, Human
uucuuuguuccuuacauuug

SEQ ID NO: 601601 - RNA, 22 nt, Human
gcagggggauggaguugaaaug

SEQ ID NO: 601602 - RNA, 22 nt, Human
uugcugaagugaagguauguuu

SEQ ID NO: 601603 - RNA, 22 nt, Human
caugugggaagaggccagcugg

SEQ ID NO: 601604 - RNA, 22 nt, Human
uggaaagaauuccuaugguuca

SEQ ID NO: 601605 - RNA, 22 nt, Human
gcagaacauuucacaguaucuu

SEQ ID NO: 601606 - RNA, 22 nt, Human
ccagugugcauuaucauguguc

SEQ ID NO: 601607 - RNA, 22 nt, Human
guuuauuauacaacaaaagcua

SEQ ID NO: 601608 - RNA, 23 nt, Human
agcucugaaauagggaaagagga

SEQ ID NO: 601609 - RNA, 22 nt, Human
guccuggggauacagaagugaa

SEQ ID NO: 601610 - RNA, 20 nt, Human
aaacugucugucaguaucua

SEQ ID NO: 601611 - RNA, 22 nt, Human
acaggcugggcgcuuccugcgg

SEQ ID NO: 601612 - RNA, 22 nt, Human
acagaauucucucugcagaggc

SEQ ID NO: 601613 - RNA, 15 nt, Human
ggaggccaggcugug

SEQ ID NO: 601614 - RNA, 22 nt, Human
uaggcuggaacuuaggcagagg

SEQ ID NO: 601615 - RNA, 22 nt, Human
aaccaacauaggaaugcagaga

SEQ ID NO: 601616 - RNA, 22 nt, Human
uggaacaccuugcuccagaaag

SEQ ID NO: 601617 - RNA, 22 nt, Human
cuuuccugaggaguauggcugu

SEQ ID NO: 601618 - RNA, 22 nt, Human
cauuuugugcuagacacuaugg

SEQ ID NO: 601619 - RNA, 22 nt, Human
gaaacuuucaugaauauaagau

SEQ ID NO: 601620 - RNA, 22 nt, Human
cagcuguugugauccauuuacg

SEQ ID NO: 601621 - RNA, 22 nt, Human
caugcauucagaaucucucaca

SEQ ID NO: 601622 - RNA, 20 nt, Human
aacacugugcgugguaggug

SEQ ID NO: 601623 - RNA, 22 nt, Human
aaauuuucucucuaagacuuaa

SEQ ID NO: 601624 - RNA, 22 nt, Human
aaguggagucccuacaaccagc

SEQ ID NO: 601625 - RNA, 22 nt, Human
cuaccugaaaagguugugguga

SEQ ID NO: 601626 - RNA, 23 nt, Human
ccacugaugcauuuucucucugu

SEQ ID NO: 601627 - RNA, 22 nt, Human
cuuguauuaagcuuagagaggc

SEQ ID NO: 601628 - RNA, 22 nt, Human
cccuggaggcuggaggcaguag

SEQ ID NO: 601629 - RNA, 22 nt, Human
uggccaggcagguagaacggcc

SEQ ID NO: 601630 - RNA, 20 nt, Human
gacaggagaguuagguaggu

SEQ ID NO: 601631 - RNA, 22 nt, Human
uuuuuaugccuacgcugaaaag

SEQ ID NO: 601632 - RNA, 22 nt, Human
agggccugugaauucucccugc

SEQ ID NO: 601633 - RNA, 18 nt, Human
cucagggugaccaaugca

SEQ ID NO: 601634 - RNA, 22 nt, Human
cacagggcagugcugcccacuc

SEQ ID NO: 601635 - RNA, 22 nt, Human
uuccccaggcuggagugcagug

SEQ ID NO: 601636 - RNA, 22 nt, Human
gguggagcuauacgggauggcu

SEQ ID NO: 601637 - RNA, 21 nt, Human
ugaggcuguuguaccagggag

SEQ ID NO: 601638 - RNA, 22 nt, Human
acaaucccacaagaaacacugg

SEQ ID NO: 601639 - RNA, 22 nt, Human
uaacaguauauuuaccaaaccu

SEQ ID NO: 601640 - RNA, 22 nt, Human
aaagagcucuuacucuagugua

SEQ ID NO: 601641 - RNA, 22 nt, Human
ucuggaguuccugcaggcugug

SEQ ID NO: 601642 - RNA, 22 nt, Human
uccuggaacauggauaaagaau

SEQ ID NO: 601643 - RNA, 22 nt, Human
uuuuauaaagagagucaguugg

SEQ ID NO: 601644 - RNA, 21 nt, Human
acugagguuagaugccuugcc

SEQ ID NO: 601645 - RNA, 22 nt, Human
acagcagagccugguacuuacu

SEQ ID NO: 601646 - RNA, 22 nt, Human
ggcugcagguugguuggcagcu

SEQ ID NO: 601647 - RNA, 20 nt, Human
aggcugaguucuaugcacuu

SEQ ID NO: 601648 - RNA, 22 nt, Human
cugugucugaauaacucugugu

SEQ ID NO: 601649 - RNA, 22 nt, Human
ugagaacggauacuaagggcug

SEQ ID NO: 601650 - RNA, 22 nt, Human
gcaggggcugagcaccagcggg

SEQ ID NO: 601651 - RNA, 22 nt, Human
aaggcuaaauucuguacugcau

SEQ ID NO: 601652 - RNA, 21 nt, Human
auucuuggcuuagcucucugg

SEQ ID NO: 601653 - RNA, 22 nt, Human
uauuuucauucugugugacugu

SEQ ID NO: 601654 - RNA, 22 nt, Human
uggcagccacaucucguggauu

SEQ ID NO: 601655 - RNA, 22 nt, Human
ugcagggccaugguggcggcug

SEQ ID NO: 601656 - RNA, 22 nt, Human
guauauaagguaaagcgauugu

SEQ ID NO: 601657 - RNA, 22 nt, Human
cucugcccucgcacaucugcca

SEQ ID NO: 601658 - RNA, 22 nt, Human
acauucuagauauguuauauuu

SEQ ID NO: 601659 - RNA, 22 nt, Human
ugcucccagggacucuggcugg

SEQ ID NO: 601660 - RNA, 22 nt, Human
uauaauauuccuuguuguaggu

SEQ ID NO: 601661 - RNA, 22 nt, Human
aagucguggcaggcuugcacga

SEQ ID NO: 601662 - RNA, 22 nt, Human
uugaccacugaaugguucugaa

SEQ ID NO: 601663 - RNA, 22 nt, Human
uuuacagucugucuagcaaugu

SEQ ID NO: 601664 - RNA, 22 nt, Human
gacacagaaggucacauguuca

SEQ ID NO: 601665 - RNA, 18 nt, Human
uggcaggaaaugcacuuu

SEQ ID NO: 601666 - RNA, 22 nt, Human
ggcuguguuucuguuugacauu

SEQ ID NO: 601667 - RNA, 22 nt, Human
ucaguucuaagugcuuuacaug

SEQ ID NO: 601668 - RNA, 22 nt, Human
cuucuauucacuggucacaguu

SEQ ID NO: 601669 - RNA, 22 nt, Human
uuagccauuugaggucuucauu

SEQ ID NO: 601670 - RNA, 22 nt, Human
gaagacauuaagucuaugucac

SEQ ID NO: 601671 - RNA, 22 nt, Human
guauuagcaagaguugugauuu

SEQ ID NO: 601672 - RNA, 17 nt, Human
aaacuucauucucagga

SEQ ID NO: 601673 - RNA, 22 nt, Human
caugggcuugcucucugagcuc

SEQ ID NO: 601674 - RNA, 22 nt, Human
ggcaccagcaggcaccgaugcc

SEQ ID NO: 601675 - RNA, 23 nt, Human
cuugccuggccucucugcccaga

SEQ ID NO: 601676 - RNA, 22 nt, Human
aaguuucuguucgcuuuaauaa

SEQ ID NO: 601677 - RNA, 22 nt, Human
uggguaggccaggaagcagugu

SEQ ID NO: 601678 - RNA, 22 nt, Human
agggccaccagagcagggcagu

SEQ ID NO: 601679 - RNA, 22 nt, Human
uucauuaaguauaaaauguggu

SEQ ID NO: 601680 - RNA, 23 nt, Human
uugaggacaauuuacaugguguu

SEQ ID NO: 601681 - RNA, 22 nt, Human
gggcccugccccguggcucuga

SEQ ID NO: 601682 - RNA, 22 nt, Human
gccuuucagugccuucuguuca

SEQ ID NO: 601683 - RNA, 22 nt, Human
cugggaguggugacagcucucg

SEQ ID NO: 601684 - RNA, 22 nt, Human
gccuggagggucccucucugga

SEQ ID NO: 601685 - RNA, 22 nt, Human
uucuuuuuaucuucccauaaga

SEQ ID NO: 601686 - RNA, 22 nt, Human
caggcagcaggagcccugcucg

SEQ ID NO: 601687 - RNA, 22 nt, Human
uggcagagaacacggcugaucu

SEQ ID NO: 601688 - RNA, 22 nt, Human
augucuugauauuuuacuguuu

SEQ ID NO: 601689 - RNA, 22 nt, Human
uuauaauucuggcauaggcugu

SEQ ID NO: 601690 - RNA, 22 nt, Human
agcagccagagucugaacauua

SEQ ID NO: 601691 - RNA, 22 nt, Human
gcuucuguggauuggcuggcuu

SEQ ID NO: 601692 - RNA, 22 nt, Human
aguagaaauguaguguagagaa

SEQ ID NO: 601693 - RNA, 22 nt, Human
uuagaaaucaccucugaagauc

SEQ ID NO: 601694 - RNA, 22 nt, Human
gggaggguguucucccaagaac

SEQ ID NO: 601695 - RNA, 20 nt, Human
uccugagaccugggaagguu

SEQ ID NO: 601696 - RNA, 22 nt, Human
uugauucuggugacugauggaa

SEQ ID NO: 601697 - RNA, 22 nt, Human
ucugccuggauuuuggaaagcu

SEQ ID NO: 601698 - RNA, 22 nt, Human
aaacacuggcaauuucaugcac

SEQ ID NO: 601699 - RNA, 22 nt, Human
acaauguaguugucaugagaca

SEQ ID NO: 601700 - RNA, 22 nt, Human
cagcugaagagaggugcugagu

SEQ ID NO: 601701 - RNA, 22 nt, Human
ucccagaguauuagcaauugcu

SEQ ID NO: 601702 - RNA, 22 nt, Human
ggagcaagucccaggcacuagu

SEQ ID NO: 601703 - RNA, 22 nt, Human
ugaaacaaaccaguaauuuugu

SEQ ID NO: 601704 - RNA, 22 nt, Human
cacacaugacccacuuuuaccg

SEQ ID NO: 601705 - RNA, 22 nt, Human
cacuacagaaucaaauacgggc

SEQ ID NO: 601706 - RNA, 22 nt, Human
cuguccugauggugccacuggu

SEQ ID NO: 601707 - RNA, 22 nt, Human
ugagaugaugggauaagagggc

SEQ ID NO: 601708 - RNA, 22 nt, Human
cugcaggcugagcgccugccgg

SEQ ID NO: 601709 - RNA, 22 nt, Human
uucugggcacacaggcccuggu

SEQ ID NO: 601710 - RNA, 22 nt, Human
uagaauuaugccuugcugucca

SEQ ID NO: 601711 - RNA, 22 nt, Human
acuacugaauauuaguucugaa

SEQ ID NO: 601712 - RNA, 22 nt, Human
acaguuuauugcacagguaacc

SEQ ID NO: 601713 - RNA, 22 nt, Human
aggacaugugccuccagggcag

SEQ ID NO: 601714 - RNA, 22 nt, Human
augaaacugggauaacuauagc

SEQ ID NO: 601715 - RNA, 22 nt, Human
agcagugggugguuuuugagca

SEQ ID NO: 601716 - RNA, 22 nt, Human
gcccagggcagggcaagaguga

SEQ ID NO: 601717 - RNA, 22 nt, Human
auggggugcaugcagauuggga

SEQ ID NO: 601718 - RNA, 22 nt, Human
cuucuuggcugcaagucucugu

SEQ ID NO: 601719 - RNA, 22 nt, Human
augacaaacccaggauguaaca

SEQ ID NO: 601720 - RNA, 18 nt, Human
gcagugaagaaagagcuu

SEQ ID NO: 601721 - RNA, 22 nt, Human
agacugggccauuuccccagcu

SEQ ID NO: 601722 - RNA, 22 nt, Human
cuuuuccuauugauucuguuac

SEQ ID NO: 601723 - RNA, 22 nt, Human
aaaggcagaguuguuggaggca

SEQ ID NO: 601724 - RNA, 22 nt, Human
uaacaucaaacauguuuuaaag

SEQ ID NO: 601725 - RNA, 22 nt, Human
uguaggauguaaggcaggcauc

SEQ ID NO: 601726 - RNA, 20 nt, Human
uuacaagguagaggagggaa

SEQ ID NO: 601727 - RNA, 22 nt, Human
ugaacagauggcccagcagagg

SEQ ID NO: 601728 - RNA, 22 nt, Human
uaagauuauacuuaaagagaaa

SEQ ID NO: 601729 - RNA, 22 nt, Human
ucacuaaugagcuaaggaaaag

SEQ ID NO: 601730 - RNA, 22 nt, Human
gcugugugcugggcauggcacu

SEQ ID NO: 601731 - RNA, 20 nt, Human
acugcaagucacuuuuaggg

SEQ ID NO: 601732 - RNA, 22 nt, Human
ucagugcugccauggcagggcc

SEQ ID NO: 601733 - RNA, 22 nt, Human
cagaagugauguugagcuaguc

SEQ ID NO: 601734 - RNA, 22 nt, Human
ggcagggcagcgcugauuaggg

SEQ ID NO: 601735 - RNA, 22 nt, Human
uggcugaguucuccaggaguag

SEQ ID NO: 601736 - RNA, 22 nt, Human
aaugucaaaauaauugauuugu

SEQ ID NO: 601737 - RNA, 17 nt, Human
cucuggggacaguucua

SEQ ID NO: 601738 - RNA, 20 nt, Human
gagugcuuuggcuugcucuc

SEQ ID NO: 601739 - RNA, 22 nt, Human
uuaguauuaggaucauauuuga

SEQ ID NO: 601740 - RNA, 22 nt, Human
aagacauugcugcuuuuaauug

SEQ ID NO: 601741 - RNA, 22 nt, Human
ccaguccuggccaguaacauga

SEQ ID NO: 601742 - RNA, 22 nt, Human
cuuauggaagaaaccucagaga

SEQ ID NO: 601743 - RNA, 22 nt, Human
ucauugucagcucuugacuucu

SEQ ID NO: 601744 - RNA, 19 nt, Human
cccuggggguuucugguac

SEQ ID NO: 601745 - RNA, 22 nt, Human
agccucagcacgcagcucugug

SEQ ID NO: 601746 - RNA, 22 nt, Human
cagugugaggaauuagugucca

SEQ ID NO: 601747 - RNA, 22 nt, Human
uggaagggagcuggaauuugga

SEQ ID NO: 601748 - RNA, 21 nt, Human
uggcugcuggcccucucucca

SEQ ID NO: 601749 - RNA, 22 nt, Human
cacauucacuucucuguccacc

SEQ ID NO: 601750 - RNA, 22 nt, Human
acucucagggacagggucuggg

SEQ ID NO: 601751 - RNA, 22 nt, Human
ugcaggccucacaccuggcacc

SEQ ID NO: 601752 - RNA, 19 nt, Human
aaaaagaggcuauaauauu

SEQ ID NO: 601753 - RNA, 20 nt, Human
ucuccuggucugguccgugc

SEQ ID NO: 601754 - RNA, 22 nt, Human
cauuucucauaauauuagcacu

SEQ ID NO: 601755 - RNA, 22 nt, Human
aauguacaaggguuccaguuuu

SEQ ID NO: 601756 - RNA, 22 nt, Human
cucagggacuuggauccuggcc

SEQ ID NO: 601757 - RNA, 22 nt, Human
ugggcaagggacaggccuggcu

SEQ ID NO: 601758 - RNA, 21 nt, Human
agagagggagaugaaacaucc

SEQ ID NO: 601759 - RNA, 22 nt, Human
gucugcuuuuguuuuacuggua

SEQ ID NO: 601760 - RNA, 23 nt, Human
cucugggcgggcaggucagccuc

SEQ ID NO: 601761 - RNA, 22 nt, Human
uggguagaaacaaggcuggacu

SEQ ID NO: 601762 - RNA, 22 nt, Human
ugauaugcauguaagggagaca

SEQ ID NO: 601763 - RNA, 22 nt, Human
agaaacagaagggaaagcuuuu

SEQ ID NO: 601764 - RNA, 22 nt, Human
cuuuauuguccuucuuaggugg

SEQ ID NO: 601765 - RNA, 22 nt, Human
auuugcuucugcuaaacaacuu

SEQ ID NO: 601766 - RNA, 22 nt, Human
ucagcaagcagggggauguuca

SEQ ID NO: 601767 - RNA, 19 nt, Human
cugcugggugcugagggag

SEQ ID NO: 601768 - RNA, 22 nt, Human
cagguggggcgcccucaggcag

SEQ ID NO: 601769 - RNA, 22 nt, Human
caguguggcuuagggaauaggc

SEQ ID NO: 601770 - RNA, 22 nt, Human
cuacagaguucacaggauuuua

SEQ ID NO: 601771 - RNA, 22 nt, Human
accaacuugcagccaaauuuga

SEQ ID NO: 601772 - RNA, 22 nt, Human
cugaggcuggcguuugaggaag

SEQ ID NO: 601773 - RNA, 22 nt, Human
caggcaccacacuaggggcuga

SEQ ID NO: 601774 - RNA, 22 nt, Human
uuuuugauacucaagaggggua

SEQ ID NO: 601775 - RNA, 22 nt, Human
ucuccacaccagaaggagcuga

SEQ ID NO: 601776 - RNA, 22 nt, Human
aacaguguuuuucuucagcacu

SEQ ID NO: 601777 - RNA, 22 nt, Human
gggagaaggaggacugugcugu

SEQ ID NO: 601778 - RNA, 21 nt, Human
gugguucuagagaaacagaau

SEQ ID NO: 601779 - RNA, 22 nt, Human
auggauaagucaaagaguaucc

SEQ ID NO: 601780 - RNA, 22 nt, Human
gcagcagguccgcaucaucauc

SEQ ID NO: 601781 - RNA, 22 nt, Human
gugcaggggaucagguugcagc

SEQ ID NO: 601782 - RNA, 22 nt, Human
agcagggacauggcaucucucc

SEQ ID NO: 601783 - RNA, 22 nt, Human
augugugugcauuucucucccu

SEQ ID NO: 601784 - RNA, 22 nt, Human
ggaggccagggacccagucagc

SEQ ID NO: 601785 - RNA, 22 nt, Human
cucugggcuuaccugcuuccug

SEQ ID NO: 601786 - RNA, 22 nt, Human
auugauauauuauuucuaacug

SEQ ID NO: 601787 - RNA, 22 nt, Human
ucaggaacauuuaaccacaggg

SEQ ID NO: 601788 - RNA, 22 nt, Human
ucuccugggugcuuuaucagaa

SEQ ID NO: 601789 - RNA, 22 nt, Human
uggguacuccuauuaguucagu

SEQ ID NO: 601790 - RNA, 22 nt, Human
uucuagggaaugggaugaggau

SEQ ID NO: 601791 - RNA, 23 nt, Human
uuauugcaagguaaaauugcuga

SEQ ID NO: 601792 - RNA, 22 nt, Human
cuagucacucagcacugacaaa

SEQ ID NO: 601793 - RNA, 22 nt, Human
auguuuauguugggcuauauuu

SEQ ID NO: 601794 - RNA, 22 nt, Human
uauauuaaagugcuuugcagug

SEQ ID NO: 601795 - RNA, 22 nt, Human
auuagcuugguaugccauaaag

SEQ ID NO: 601796 - RNA, 22 nt, Human
cagcuuuaggacucauaauaaa

SEQ ID NO: 601797 - RNA, 22 nt, Human
acaggcagcacuaaucucuggu

SEQ ID NO: 601798 - RNA, 22 nt, Human
uggagaugaggacauggacguc

SEQ ID NO: 601799 - RNA, 22 nt, Human
ggcccuuccugcucucuuagcu

SEQ ID NO: 601800 - RNA, 21 nt, Human
ggguggccgcaugggugcgug

SEQ ID NO: 601801 - RNA, 22 nt, Human
gaggccugucgcuaggccucug

SEQ ID NO: 601802 - RNA, 22 nt, Human
uucuaacucuguuauguguuuc

SEQ ID NO: 601803 - RNA, 22 nt, Human
gcuuccuagcauuagccauugc

SEQ ID NO: 601804 - RNA, 22 nt, Human
ucugggcugucuacagguuggc

SEQ ID NO: 601805 - RNA, 22 nt, Human
cugcucuccccaggccagucug

SEQ ID NO: 601806 - RNA, 23 nt, Human
agaggcugcaggguauugagaau

SEQ ID NO: 601807 - RNA, 22 nt, Human
gacuguacgucauugaaggcca

SEQ ID NO: 601808 - RNA, 22 nt, Human
agcuccugcucuuugucccuaa

SEQ ID NO: 601809 - RNA, 22 nt, Human
ugacaggauugguugcuucuga

SEQ ID NO: 601810 - RNA, 22 nt, Human
uguguccuuucuuaagagugag

SEQ ID NO: 601811 - RNA, 22 nt, Human
gcuggccagugucccagggauc

SEQ ID NO: 601812 - RNA, 22 nt, Human
guucugcagacuuggaaggugg

SEQ ID NO: 601813 - RNA, 22 nt, Human
ugucauuccuucaauguagaua

SEQ ID NO: 601814 - RNA, 22 nt, Human
gucuccugcuagcaagcaccac

SEQ ID NO: 601815 - RNA, 22 nt, Human
ucuuugcauggacauguguuuu

SEQ ID NO: 601816 - RNA, 22 nt, Human
aucauaaaccacuuuguaaucu

SEQ ID NO: 601817 - RNA, 22 nt, Human
cugucucugauaagcucgaggg

SEQ ID NO: 601818 - RNA, 22 nt, Human
cacaggaagagguauacaauuc

SEQ ID NO: 601819 - RNA, 22 nt, Human
ucuaacuaacuacaguaagagg

SEQ ID NO: 601820 - RNA, 22 nt, Human
ucacaagacugagcuugcuuga

SEQ ID NO: 601821 - RNA, 22 nt, Human
uaguauagauugaagcagauca

SEQ ID NO: 601822 - RNA, 22 nt, Human
uacuuacaugaauucaagagca

SEQ ID NO: 601823 - RNA, 22 nt, Human
uugcugauuuguuucuauucca

SEQ ID NO: 601824 - RNA, 22 nt, Human
uccagccaccaccuugauugcc

SEQ ID NO: 601825 - RNA, 17 nt, Human
cucuccuuccucugagg

SEQ ID NO: 601826 - RNA, 22 nt, Human
guggcagguggagccuccugca

SEQ ID NO: 601827 - RNA, 22 nt, Human
ugaaugagugaguucagaccuc

SEQ ID NO: 601828 - RNA, 22 nt, Human
ccuagggagccugagagcagug

SEQ ID NO: 601829 - RNA, 22 nt, Human
ggcagcagcaagguuggagcug

SEQ ID NO: 601830 - RNA, 23 nt, Human
augaagacccgugguguccccac

SEQ ID NO: 601831 - RNA, 22 nt, Human
uucaguaaggauaauaaacaga

SEQ ID NO: 601832 - RNA, 22 nt, Human
cagggcugaaaucaagguguag

SEQ ID NO: 601833 - RNA, 22 nt, Human
ccaguguuuccccagaagagag

SEQ ID NO: 601834 - RNA, 22 nt, Human
uugaggucaaagaagugagugg

SEQ ID NO: 601835 - RNA, 22 nt, Human
ucuucacaccgggcagcaggaa

SEQ ID NO: 601836 - RNA, 22 nt, Human
ccugcagaagaguccagcucau

SEQ ID NO: 601837 - RNA, 22 nt, Human
cacacauuagagccaaugucag

SEQ ID NO: 601838 - RNA, 22 nt, Human
aaaugcaaggccaugugaagga

SEQ ID NO: 601839 - RNA, 22 nt, Human
agugauaggacauauggauuuu

SEQ ID NO: 601840 - RNA, 22 nt, Human
cuggugggaggcaagguggaag

SEQ ID NO: 601841 - RNA, 19 nt, Human
acuaaaaaugauguuugag

SEQ ID NO: 601842 - RNA, 22 nt, Human
uuuaguagaaauauuugggccu

SEQ ID NO: 601843 - RNA, 22 nt, Human
ucugaccaggcuggcucagggc

SEQ ID NO: 601844 - RNA, 22 nt, Human
acaggugacuugcauuuucaca

SEQ ID NO: 601845 - RNA, 17 nt, Human
ggcaggugcggggccgc

SEQ ID NO: 601846 - RNA, 22 nt, Human
cccucccagaugggcuugaggu

SEQ ID NO: 601847 - RNA, 22 nt, Human
ccagagagagaggucaauggca

SEQ ID NO: 601848 - RNA, 22 nt, Human
cuacuuuaccuccaucagacug

SEQ ID NO: 601849 - RNA, 20 nt, Human
aaacuaaagguguuugguuu

SEQ ID NO: 601850 - RNA, 22 nt, Human
gaaggaagggcuggcugucuug

SEQ ID NO: 601851 - RNA, 22 nt, Human
acaaauauuuacugaauccacu

SEQ ID NO: 601852 - RNA, 22 nt, Human
uggcucaguuuagcagcucagu

SEQ ID NO: 601853 - RNA, 20 nt, Human
caccagucaugagucaauac

SEQ ID NO: 601854 - RNA, 22 nt, Human
guggaggguuugcaaugugcag

SEQ ID NO: 601855 - RNA, 22 nt, Human
uggcaaugagcaggugcucugg

SEQ ID NO: 601856 - RNA, 22 nt, Human
gaacaucaugaagaaaacauau

SEQ ID NO: 601857 - RNA, 21 nt, Human
ugggggagaauugguugcuuu

SEQ ID NO: 601858 - RNA, 22 nt, Human
gagagcugugguuugaccaggc

SEQ ID NO: 601859 - RNA, 22 nt, Human
cucuggguucuggccugcaccc

SEQ ID NO: 601860 - RNA, 23 nt, Human
ugaauuuuggcauauucugaaau

SEQ ID NO: 601861 - RNA, 22 nt, Human
aagggcugagaaguggggcugg

SEQ ID NO: 601862 - RNA, 22 nt, Human
ccaguggaauuaaaaauaagug

SEQ ID NO: 601863 - RNA, 22 nt, Human
gugagcugggugaaugguaggg

SEQ ID NO: 601864 - RNA, 22 nt, Human
aagagguaaccauagcaaccac

SEQ ID NO: 601865 - RNA, 22 nt, Human
ggagggagucagcugauuagaa

SEQ ID NO: 601866 - RNA, 22 nt, Human
cugccuggggaaugugaggauu

SEQ ID NO: 601867 - RNA, 22 nt, Human
ggcagguggacgugcuaaagcu

SEQ ID NO: 601868 - RNA, 22 nt, Human
auugagaaaauaaguauggaua

SEQ ID NO: 601869 - RNA, 22 nt, Human
gaaguggaauuacugggucaua

SEQ ID NO: 601870 - RNA, 22 nt, Human
uuacucugaauguuucuacuga

SEQ ID NO: 601871 - RNA, 22 nt, Human
gaguuauaaccuaguuuaacug

SEQ ID NO: 601872 - RNA, 22 nt, Human
uugacaaguaauacuuaaauua

SEQ ID NO: 601873 - RNA, 22 nt, Human
ccuggugcccccaagccagcug

SEQ ID NO: 601874 - RNA, 22 nt, Human
aggcagagagcaguggccgucu

SEQ ID NO: 601875 - RNA, 22 nt, Human
gguggcagggagugucccuggg

SEQ ID NO: 601876 - RNA, 22 nt, Human
uacuacauuaauaaaacauuca

SEQ ID NO: 601877 - RNA, 22 nt, Human
ggaaaaaugacacauaucucaa

SEQ ID NO: 601878 - RNA, 21 nt, Human
ucauauuucucuugcuauugu

SEQ ID NO: 601879 - RNA, 22 nt, Human
aggggcuccucucugagaguag

SEQ ID NO: 601880 - RNA, 22 nt, Human
uacuguaugauuucauguauau

SEQ ID NO: 601881 - RNA, 22 nt, Human
gcugccuguguggccacucacu

SEQ ID NO: 601882 - RNA, 21 nt, Human
uggagcugccacuuguccucc

SEQ ID NO: 601883 - RNA, 19 nt, Human
uguguucaaacuccaucuc

SEQ ID NO: 601884 - RNA, 22 nt, Human
uacuguuuuugccucuuuagaa

SEQ ID NO: 601885 - RNA, 22 nt, Human
cagggagcagccccuagaagua

SEQ ID NO: 601886 - RNA, 22 nt, Human
gcugcagguuugucuagucugg

SEQ ID NO: 601887 - RNA, 22 nt, Human
ucagaaauguaagcugaugacu

SEQ ID NO: 601888 - RNA, 22 nt, Human
aacagaaggggguauuuacauu

SEQ ID NO: 601889 - RNA, 22 nt, Human
guuacaaaggucauaaaagugu

SEQ ID NO: 601890 - RNA, 22 nt, Human
aggggcuuguggaguugcuggu

SEQ ID NO: 601891 - RNA, 19 nt, Human
aggcuucuacccuguccag

SEQ ID NO: 601892 - RNA, 22 nt, Human
cauaucaaagagaaggauagga

SEQ ID NO: 601893 - RNA, 22 nt, Human
aggauguguguaggcugguuaa

SEQ ID NO: 601894 - RNA, 22 nt, Human
uccugggcuuaagugauccucc

SEQ ID NO: 601895 - RNA, 22 nt, Human
acauacauaugacaacuuuccu

SEQ ID NO: 601896 - RNA, 22 nt, Human
ccaccagcuucagcagccgcgg

SEQ ID NO: 601897 - RNA, 22 nt, Human
gcuggagaguaguaagcaguua

SEQ ID NO: 601898 - RNA, 22 nt, Human
ggggggcuguucuggacaggaa

SEQ ID NO: 601899 - RNA, 22 nt, Human
gucccagggaagaaggcagcac

SEQ ID NO: 601900 - RNA, 22 nt, Human
acaaugaagcuccacugagcuu

SEQ ID NO: 601901 - RNA, 22 nt, Human
gucuccuggccuccaguuucuc

SEQ ID NO: 601902 - RNA, 22 nt, Human
aggugucuuugcggcccgccgc

SEQ ID NO: 601903 - RNA, 22 nt, Human
uugaaguuuaaugguagauucc

SEQ ID NO: 601904 - RNA, 22 nt, Human
aaggacaggcuaaccugacauu

SEQ ID NO: 601905 - RNA, 22 nt, Human
cagcagccauguaccacacuca

SEQ ID NO: 601906 - RNA, 22 nt, Human
auacacauaucagguguauaca

SEQ ID NO: 601907 - RNA, 22 nt, Human
gaggauguaaaauagacaaaau

SEQ ID NO: 601908 - RNA, 22 nt, Human
uaguuauuauuguuacuaucag

SEQ ID NO: 601909 - RNA, 22 nt, Human
aaagacugcaaaaacgcacaga

SEQ ID NO: 601910 - RNA, 22 nt, Human
auauauaauacuugcugugggc

SEQ ID NO: 601911 - RNA, 22 nt, Human
agcucuggaagcccugguaguu

SEQ ID NO: 601912 - RNA, 22 nt, Human
agcuacaguggacaagugaacu

SEQ ID NO: 601913 - RNA, 22 nt, Human
uccuuagccggagcagcucauc

SEQ ID NO: 601914 - RNA, 23 nt, Human
uaucauuucagcucucugccugg

SEQ ID NO: 601915 - RNA, 22 nt, Human
acaucuuuauacuaguccuuga

SEQ ID NO: 601916 - RNA, 22 nt, Human
cauuuauucauuugcuagggcu

SEQ ID NO: 601917 - RNA, 22 nt, Human
uggagguggaguuggaaacuga

SEQ ID NO: 601918 - RNA, 22 nt, Human
uuuaugagccucaaaucugagu

SEQ ID NO: 601919 - RNA, 22 nt, Human
uuggcucaggcuuucauuguaa

SEQ ID NO: 601920 - RNA, 22 nt, Human
uuucugcuaaucuuuuacugag

SEQ ID NO: 601921 - RNA, 23 nt, Human
cccuggagcuagucugagcgggg

SEQ ID NO: 601922 - RNA, 20 nt, Human
auuuguuucuacucucugac

SEQ ID NO: 601923 - RNA, 22 nt, Human
ccaagggaaggauguauaugau

SEQ ID NO: 601924 - RNA, 22 nt, Human
uuagcugaaaaaauucaugcaa

SEQ ID NO: 601925 - RNA, 22 nt, Human
ccacagagcauuagauuucaga

SEQ ID NO: 601926 - RNA, 22 nt, Human
aguccuugaauguuuugaaauc

SEQ ID NO: 601927 - RNA, 22 nt, Human
acucuucaguacaauaauaucu

SEQ ID NO: 601928 - RNA, 22 nt, Human
ucccagccuuaucuccccuggc

SEQ ID NO: 601929 - RNA, 22 nt, Human
cacacaugucucuccaugcucu

SEQ ID NO: 601930 - RNA, 22 nt, Human
auauaauacaaccugcuaagug

SEQ ID NO: 601931 - RNA, 22 nt, Human
gaagcccauuuguacagcacau

SEQ ID NO: 601932 - RNA, 22 nt, Human
cagagagagcaggaaaccuccg

SEQ ID NO: 601933 - RNA, 22 nt, Human
aacaguaucuacgggaacuauu

SEQ ID NO: 601934 - RNA, 22 nt, Human
cccagggaaugacucuggccuu

SEQ ID NO: 601935 - RNA, 22 nt, Human
ccacaugcucaccaagucccug

SEQ ID NO: 601936 - RNA, 22 nt, Human
gggcagcugcagggauggugac

SEQ ID NO: 601937 - RNA, 22 nt, Human
aauuauacauugaacaaucuag

SEQ ID NO: 601938 - RNA, 22 nt, Human
gagcuucccucugcagucccug

SEQ ID NO: 601939 - RNA, 22 nt, Human
ccauggagcaccucacagaggc

SEQ ID NO: 601940 - RNA, 22 nt, Human
aagauuauggcagauaacaauu

SEQ ID NO: 601941 - RNA, 22 nt, Human
ugcauuggguugacauacuaaa

SEQ ID NO: 601942 - RNA, 22 nt, Human
caggcagcucugcuuuuccuaa

SEQ ID NO: 601943 - RNA, 22 nt, Human
ugagaacuugugcuauugcaca

SEQ ID NO: 601944 - RNA, 22 nt, Human
uuguuuuggagaugagcuaaaa

SEQ ID NO: 601945 - RNA, 22 nt, Human
ccacagcuagggcaaucugauu

SEQ ID NO: 601946 - RNA, 22 nt, Human
ucacauuuguuccucugcacuu

SEQ ID NO: 601947 - RNA, 22 nt, Human
acaucugaaagggauugcagaa

SEQ ID NO: 601948 - RNA, 22 nt, Human
uauaaaguuggggcugaaguaa

SEQ ID NO: 601949 - RNA, 22 nt, Human
cuggaguucgacugaguugaau

SEQ ID NO: 601950 - RNA, 22 nt, Human
cuucaagucgccaaaugcugaa

SEQ ID NO: 601951 - RNA, 22 nt, Human
gagcagggccacuucuguaccu

SEQ ID NO: 601952 - RNA, 22 nt, Human
gcaccaggaggcccuucucauc

SEQ ID NO: 601953 - RNA, 22 nt, Human
ucugaaugcacuuaguuaccaa

SEQ ID NO: 601954 - RNA, 22 nt, Human
ccacugggcguuucuguccaau

SEQ ID NO: 601955 - RNA, 22 nt, Human
ggcagagcuugcagugagccga

SEQ ID NO: 601956 - RNA, 22 nt, Human
aaacagcuggucucaaauguuc

SEQ ID NO: 601957 - RNA, 22 nt, Human
cagagucuggacugcaggcucc

SEQ ID NO: 601958 - RNA, 22 nt, Human
cagcaguaauuagugcugcaug

SEQ ID NO: 601959 - RNA, 22 nt, Human
aagcuguugcccugcucuuucu

SEQ ID NO: 601960 - RNA, 22 nt, Human
gccacaggugggcucugggaaa

SEQ ID NO: 601961 - RNA, 22 nt, Human
gugugggacgggugaguggcca

SEQ ID NO: 601962 - RNA, 21 nt, Human
uuugaaagcccuauguuuuca

SEQ ID NO: 601963 - RNA, 22 nt, Human
aggcuggauuuauggggacuuc

SEQ ID NO: 601964 - RNA, 17 nt, Human
ggcuucagggagcuggg

SEQ ID NO: 601965 - RNA, 22 nt, Human
agcagcugaccagugaguccug

SEQ ID NO: 601966 - RNA, 22 nt, Human
cuggggagacgaucgauguucu

SEQ ID NO: 601967 - RNA, 22 nt, Human
guggggcugaguggagccagaa

SEQ ID NO: 601968 - RNA, 20 nt, Human
ugcagaagaacguucugguu

SEQ ID NO: 601969 - RNA, 22 nt, Human
auguguaugagugugcuucuuu

SEQ ID NO: 601970 - RNA, 22 nt, Human
ggccuugauccuccagagcacu

SEQ ID NO: 601971 - RNA, 22 nt, Human
uugaggucauauauauuuggca

SEQ ID NO: 601972 - RNA, 22 nt, Human
cagcagcaacaauagcggucac

SEQ ID NO: 601973 - RNA, 22 nt, Human
caaacauuugacuucucucagg

SEQ ID NO: 601974 - RNA, 22 nt, Human
aucuaaaaggagcucuuuaucu

SEQ ID NO: 601975 - RNA, 22 nt, Human
aucugggagucuuggcucugcu

SEQ ID NO: 601976 - RNA, 22 nt, Human
cuggaguucuaugugcuuguga

SEQ ID NO: 601977 - RNA, 22 nt, Human
ggaggccaugggcagaaucuuu

SEQ ID NO: 601978 - RNA, 22 nt, Human
uugggcaggcuggcagacugcu

SEQ ID NO: 601979 - RNA, 22 nt, Human
uggggccagguggcugcagguc

SEQ ID NO: 601980 - RNA, 22 nt, Human
gcugggcucguucccacacgcg

SEQ ID NO: 601981 - RNA, 22 nt, Human
caucuucaccagagacaagcaa

SEQ ID NO: 601982 - RNA, 20 nt, Human
uuacucaguuccugccaugc

SEQ ID NO: 601983 - RNA, 22 nt, Human
ucagggaccccucugaguggag

SEQ ID NO: 601984 - RNA, 22 nt, Human
ggucccugccugaggcuggccu

SEQ ID NO: 601985 - RNA, 22 nt, Human
caguauguuugggagacaugac

SEQ ID NO: 601986 - RNA, 22 nt, Human
uuugaugaaccuauauaauuug

SEQ ID NO: 601987 - RNA, 22 nt, Human
gaggccaggguaccaucaacau

SEQ ID NO: 601988 - RNA, 22 nt, Human
agggccugcucuaucacucuca

SEQ ID NO: 601989 - RNA, 22 nt, Human
ggagugggcagcacugcccugu

SEQ ID NO: 601990 - RNA, 22 nt, Human
uauucucuccccaaucuugcuu

SEQ ID NO: 601991 - RNA, 21 nt, Human
ucagaaucugugagcuaucuc

SEQ ID NO: 601992 - RNA, 22 nt, Human
cuuguuuucuucugcagucuau

SEQ ID NO: 601993 - RNA, 22 nt, Human
gugguccugccagccaggucca

SEQ ID NO: 601994 - RNA, 22 nt, Human
ugccuagggccuaaccagagcc

SEQ ID NO: 601995 - RNA, 22 nt, Human
gagcugccugaacaagcagcag

SEQ ID NO: 601996 - RNA, 22 nt, Human
uuugucaaagaucagaugcuuu

SEQ ID NO: 601997 - RNA, 22 nt, Human
caggccucuccuuagucuggca

SEQ ID NO: 601998 - RNA, 18 nt, Human
gcuuucuguagaaaaggg

SEQ ID NO: 601999 - RNA, 23 nt, Human
ccugcagcugcuggggcuccacc

SEQ ID NO: 602000 - RNA, 22 nt, Human
uggaggcaggggauacagguca

SEQ ID NO: 602001 - RNA, 22 nt, Human
aauagagagcagcuuugcgguu

SEQ ID NO: 602002 - RNA, 22 nt, Human
uagaugcugaaacauggaggcg

SEQ ID NO: 602003 - RNA, 22 nt, Human
uacuauguucuuccuaaauagu

SEQ ID NO: 602004 - RNA, 22 nt, Human
aaauggcagcccagagguaagg

SEQ ID NO: 602005 - RNA, 22 nt, Human
uggcucagagccuugagagcug

SEQ ID NO: 602006 - RNA, 22 nt, Human
uccagcccagcuccucucagaa

SEQ ID NO: 602007 - RNA, 22 nt, Human
ugaggccagucucaucacaggc

SEQ ID NO: 602008 - RNA, 22 nt, Human
cuuugugcuuugaaugauagcu

SEQ ID NO: 602009 - RNA, 22 nt, Human
uccucccuugacuccugcuuuu

SEQ ID NO: 602010 - RNA, 22 nt, Human
cacccagcacagagggaggcga

SEQ ID NO: 602011 - RNA, 22 nt, Human
agcugggcgcaguggcugguga

SEQ ID NO: 602012 - RNA, 20 nt, Human
uccugggguaagccaugguc

SEQ ID NO: 602013 - RNA, 22 nt, Human
ugaggcagaaauuccuguuuuc

SEQ ID NO: 602014 - RNA, 22 nt, Human
auuugcauaaggaugcuacugu

SEQ ID NO: 602015 - RNA, 22 nt, Human
ccuuccuuucagggcuaugccu

SEQ ID NO: 602016 - RNA, 22 nt, Human
cucacaguuucacaguguagau

SEQ ID NO: 602017 - RNA, 22 nt, Human
ucucugaagauauuuauuauua

SEQ ID NO: 602018 - RNA, 22 nt, Human
uuugguaaaaugaacuagcuuu

SEQ ID NO: 602019 - RNA, 22 nt, Human
ugguaggagauauggucuccga

SEQ ID NO: 602020 - RNA, 22 nt, Human
acagaggccgccucucucacgg

SEQ ID NO: 602021 - RNA, 22 nt, Human
auacuuccugcuucccugaucu

SEQ ID NO: 602022 - RNA, 22 nt, Human
gugcauuuauauuugccuuugg

SEQ ID NO: 602023 - RNA, 22 nt, Human
uguggagguuuaaguaauggga

SEQ ID NO: 602024 - RNA, 22 nt, Human
acauuucucagggaguuuugcu

SEQ ID NO: 602025 - RNA, 22 nt, Human
augcaguuuucaaagacuauuc

SEQ ID NO: 602026 - RNA, 22 nt, Human
caggauggucuucauuuggcuc

SEQ ID NO: 602027 - RNA, 22 nt, Human
cuguuuucuacagucugggucu

SEQ ID NO: 602028 - RNA, 22 nt, Human
cuguuucagaacuucuuaaaaa

SEQ ID NO: 602029 - RNA, 22 nt, Human
uuuugugagaugcguaugaaug

SEQ ID NO: 602030 - RNA, 22 nt, Human
cagcucaaguuucccaggucag

SEQ ID NO: 602031 - RNA, 21 nt, Human
cauuucaaagagcuggaaauc

SEQ ID NO: 602032 - RNA, 22 nt, Human
caguuuauaguuguuaugugug

SEQ ID NO: 602033 - RNA, 22 nt, Human
gcugccucugcgacucugggcg

SEQ ID NO: 602034 - RNA, 22 nt, Human
uguguuucagaaccuucuuuca

SEQ ID NO: 602035 - RNA, 22 nt, Human
ucagcagacuaggcagauuacu

SEQ ID NO: 602036 - RNA, 22 nt, Human
augagcuucccagacaggaugg

SEQ ID NO: 602037 - RNA, 22 nt, Human
ccugagcuggcagugaccugga

SEQ ID NO: 602038 - RNA, 22 nt, Human
cagaagcacauguuuacaugua

SEQ ID NO: 602039 - RNA, 17 nt, Human
ccaggugggaggugggg

SEQ ID NO: 602040 - RNA, 22 nt, Human
uggcuucuugaucuuggacuug

SEQ ID NO: 602041 - RNA, 22 nt, Human
uuagucuucuuccuuauauguu

SEQ ID NO: 602042 - RNA, 22 nt, Human
gcaaaacagucgaugccuccca

SEQ ID NO: 602043 - RNA, 22 nt, Human
agaaacagaaccaggugucauu

SEQ ID NO: 602044 - RNA, 22 nt, Human
cuccugccaccgcgguguccug

SEQ ID NO: 602045 - RNA, 23 nt, Human
aggagccaggugcagcccuugug

SEQ ID NO: 602046 - RNA, 20 nt, Human
ccucacagggcagagagggg

SEQ ID NO: 602047 - RNA, 22 nt, Human
aaagcugcuuuaaacaucuaug

SEQ ID NO: 602048 - RNA, 22 nt, Human
agccaguagaucgggaggaugu

SEQ ID NO: 602049 - RNA, 22 nt, Human
auucuucugccuacuuucaucc

SEQ ID NO: 602050 - RNA, 22 nt, Human
guguguguucaauaaauuuaag

SEQ ID NO: 602051 - RNA, 22 nt, Human
gcugaggaaaccaaugcucaga

SEQ ID NO: 602052 - RNA, 22 nt, Human
uaggggcuuguaauuuaauaga

SEQ ID NO: 602053 - RNA, 22 nt, Human
uaaagcagugcaaaagcguuuu

SEQ ID NO: 602054 - RNA, 22 nt, Human
gccuggagagcacugugcgcuu

SEQ ID NO: 602055 - RNA, 22 nt, Human
cagcaguggccaucuguguggu

SEQ ID NO: 602056 - RNA, 22 nt, Human
uuugcaaauaccaugaaacuug

SEQ ID NO: 602057 - RNA, 22 nt, Human
augcaguuccacaggcgcaugg

SEQ ID NO: 602058 - RNA, 22 nt, Human
gagguaguaagcagaguggggu

SEQ ID NO: 602059 - RNA, 22 nt, Human
ugugugggcgaagacagccuuu

SEQ ID NO: 602060 - RNA, 22 nt, Human
agcuccaggauaagacaggugc

SEQ ID NO: 602061 - RNA, 22 nt, Human
agggccaguucuaccucugaau

SEQ ID NO: 602062 - RNA, 22 nt, Human
ucaguguuuguggcaaauguua

SEQ ID NO: 602063 - RNA, 22 nt, Human
uaaaguuuggcagacaauaaca

SEQ ID NO: 602064 - RNA, 22 nt, Human
cagggccucauccucagagauu

SEQ ID NO: 602065 - RNA, 22 nt, Human
acacaggcaagagugcaggucu

SEQ ID NO: 602066 - RNA, 22 nt, Human
accccagcucugagccacacca

SEQ ID NO: 602067 - RNA, 22 nt, Human
ucugugcucauucagucauuca

SEQ ID NO: 602068 - RNA, 22 nt, Human
ugccugccuaggaagcugugaa

SEQ ID NO: 602069 - RNA, 22 nt, Human
gccaccagcagaaaaggggcca

SEQ ID NO: 602070 - RNA, 22 nt, Human
accugaaaccaacuuguguacu

SEQ ID NO: 602071 - RNA, 22 nt, Human
acagcugggugcugcucagagc

SEQ ID NO: 602072 - RNA, 22 nt, Human
aucuuacagcagcaaggaagua

SEQ ID NO: 602073 - RNA, 22 nt, Human
gaaagcacgauaguagcaaaag

SEQ ID NO: 602074 - RNA, 22 nt, Human
gcaugugucccucagucugugc

SEQ ID NO: 602075 - RNA, 22 nt, Human
uaaagcuagaaggugcuguaca

SEQ ID NO: 602076 - RNA, 22 nt, Human
cacuguguaagaagaugggcuu

SEQ ID NO: 602077 - RNA, 22 nt, Human
cugaaugaggaaaagagugagg

SEQ ID NO: 602078 - RNA, 21 nt, Human
gugaauaugcagcagaggcag

SEQ ID NO: 602079 - RNA, 22 nt, Human
gcuuucugaugagcuuaagaaa

SEQ ID NO: 602080 - RNA, 20 nt, Human
ccagaagcacucuucauguu

SEQ ID NO: 602081 - RNA, 22 nt, Human
aggagccaccuaggagcuguuu

SEQ ID NO: 602082 - RNA, 21 nt, Human
uuacacacugcuucuagaaug

SEQ ID NO: 602083 - RNA, 22 nt, Human
gaaacuuuuaaaccucaugagu

SEQ ID NO: 602084 - RNA, 22 nt, Human
cccaggagccaucugucuuggc

SEQ ID NO: 602085 - RNA, 22 nt, Human
auaaagcuauuccucucuuuuu

SEQ ID NO: 602086 - RNA, 22 nt, Human
cugggagggguagccaauccua

SEQ ID NO: 602087 - RNA, 22 nt, Human
ucuuuguuugccuuuaucaaga

SEQ ID NO: 602088 - RNA, 22 nt, Human
cucugagaggugagaagcagca

SEQ ID NO: 602089 - RNA, 22 nt, Human
ccagcuccugggucuuagucag

SEQ ID NO: 602090 - RNA, 22 nt, Human
ccaggcucaggugcgagagaca

SEQ ID NO: 602091 - RNA, 22 nt, Human
aauagauacuacuuagauguag

SEQ ID NO: 602092 - RNA, 22 nt, Human
aguaugucagagugaaaauggu

SEQ ID NO: 602093 - RNA, 20 nt, Human
cuggguggcaagcaaggggg

SEQ ID NO: 602094 - RNA, 22 nt, Human
gcugacaguuacugcuguaaca

SEQ ID NO: 602095 - RNA, 22 nt, Human
ugagguagaaguugggcugcuu

SEQ ID NO: 602096 - RNA, 22 nt, Human
uggugggcacagugcccaggcu

SEQ ID NO: 602097 - RNA, 22 nt, Human
aauugauggacagagaugaaga

SEQ ID NO: 602098 - RNA, 22 nt, Human
cugaggcucaagggcagguggg

SEQ ID NO: 602099 - RNA, 21 nt, Human
cauaugaaagaaguaucugac

SEQ ID NO: 602100 - RNA, 22 nt, Human
agcaaaagauagauuaacaaga

SEQ ID NO: 602101 - RNA, 22 nt, Human
agcuuucaggauaaugaaaaag

SEQ ID NO: 602102 - RNA, 22 nt, Human
caaggcugcuucagacuaguga

SEQ ID NO: 602103 - RNA, 22 nt, Human
gccagcuccgcaggauggcgcg

SEQ ID NO: 602104 - RNA, 22 nt, Human
ucauuguugacauaccaagagc

SEQ ID NO: 602105 - RNA, 22 nt, Human
ggcuuccuggggccuccugcaa

SEQ ID NO: 602106 - RNA, 22 nt, Human
guuauugcuggauagauacauc

SEQ ID NO: 602107 - RNA, 22 nt, Human
uuggaacaugccgggguccagg

SEQ ID NO: 602108 - RNA, 22 nt, Human
caugcuccagcuccagacaggu

SEQ ID NO: 602109 - RNA, 22 nt, Human
ccugcuuaacauugccaugaca

SEQ ID NO: 602110 - RNA, 22 nt, Human
gggcccuggggccugauuugca

SEQ ID NO: 602111 - RNA, 23 nt, Human
cagaugagguuggcagcaugguc

SEQ ID NO: 602112 - RNA, 22 nt, Human
uccuguauccugauacaauaag

SEQ ID NO: 602113 - RNA, 22 nt, Human
agcuggagaguuuccaggaagg

SEQ ID NO: 602114 - RNA, 22 nt, Human
cuuaauuuaagccuagaaugca

SEQ ID NO: 602115 - RNA, 22 nt, Human
agcugggccugagcuggaagcu

SEQ ID NO: 602116 - RNA, 22 nt, Human
ggcucugaaggagacagcugcu

SEQ ID NO: 602117 - RNA, 21 nt, Human
gcuucagcaaggcuugcuggu

SEQ ID NO: 602118 - RNA, 22 nt, Human
gccugggacugcagauccccag

SEQ ID NO: 602119 - RNA, 22 nt, Human
gccagcuguaggugguggguug

SEQ ID NO: 602120 - RNA, 22 nt, Human
ucagugucuugaccugggugug

SEQ ID NO: 602121 - RNA, 22 nt, Human
caucuccuuuggucuacuucca

SEQ ID NO: 602122 - RNA, 22 nt, Human
accucacaagucucugucagcu

SEQ ID NO: 602123 - RNA, 22 nt, Human
ucucugagacaguagccucugc

SEQ ID NO: 602124 - RNA, 22 nt, Human
agaagaaagauugaagguuccu

SEQ ID NO: 602125 - RNA, 22 nt, Human
cagggcugaagaaauucaaaag

SEQ ID NO: 602126 - RNA, 22 nt, Human
caaacuugguggauuaguacag

SEQ ID NO: 602127 - RNA, 22 nt, Human
ugagagauugcuguauguuuug

SEQ ID NO: 602128 - RNA, 20 nt, Human
uacaaaccuccacacuggug

SEQ ID NO: 602129 - RNA, 21 nt, Human
uuaaggucacuucugagccua

SEQ ID NO: 602130 - RNA, 22 nt, Human
guuguuuucagcaguuuaugac

SEQ ID NO: 602131 - RNA, 22 nt, Human
auuuuuucagauugaguguuaa

SEQ ID NO: 602132 - RNA, 22 nt, Human
aaagacuaagaagaguauuauu

SEQ ID NO: 602133 - RNA, 17 nt, Human
ugagacagggcaggccc

SEQ ID NO: 602134 - RNA, 22 nt, Human
auuagcaugccaagcuuuuaga

SEQ ID NO: 602135 - RNA, 22 nt, Human
aagcacauuguacauuugugcu

SEQ ID NO: 602136 - RNA, 22 nt, Human
ucugggcuuuguaaugggaggu

SEQ ID NO: 602137 - RNA, 22 nt, Human
uguauuuugaguccaaucuccu

SEQ ID NO: 602138 - RNA, 22 nt, Human
gagaaggaguagcugaccuggg

SEQ ID NO: 602139 - RNA, 22 nt, Human
aagagguugucugugaugaguu

SEQ ID NO: 602140 - RNA, 21 nt, Human
uuacaggucauccaagucacc

SEQ ID NO: 602141 - RNA, 22 nt, Human
agaaaguuagcagacucuuggc

SEQ ID NO: 602142 - RNA, 22 nt, Human
aauacgugguuacucuauagag

SEQ ID NO: 602143 - RNA, 22 nt, Human
acaggcagugauuuccucuggu

SEQ ID NO: 602144 - RNA, 22 nt, Human
uuuuccugccugucucuagagg

SEQ ID NO: 602145 - RNA, 22 nt, Human
gugcagcugcccaagccugagc

SEQ ID NO: 602146 - RNA, 20 nt, Human
guggagaggcuggcgggacu

SEQ ID NO: 602147 - RNA, 22 nt, Human
gagacaggauuuaaccaaagcu

SEQ ID NO: 602148 - RNA, 22 nt, Human
ucccagagccaagcuauggaug

SEQ ID NO: 602149 - RNA, 22 nt, Human
agggaaacuagacugccuuucu

SEQ ID NO: 602150 - RNA, 22 nt, Human
aggcccugagcauccgagggca

SEQ ID NO: 602151 - RNA, 22 nt, Human
uacacuaagaacaaagaucugu

SEQ ID NO: 602152 - RNA, 22 nt, Human
agagccagagaccuggguucac

SEQ ID NO: 602153 - RNA, 22 nt, Human
agcugcuuuuauuaggacaaug

SEQ ID NO: 602154 - RNA, 22 nt, Human
cuccacucaacaagcccagugu

SEQ ID NO: 602155 - RNA, 22 nt, Human
cccaggcagccugcagggaagg

SEQ ID NO: 602156 - RNA, 19 nt, Human
gaauuuuaggacuucagca

SEQ ID NO: 602157 - RNA, 21 nt, Human
ucuccaguugacagugucucc

SEQ ID NO: 602158 - RNA, 22 nt, Human
cauaauuaggcaguugaucauu

SEQ ID NO: 602159 - RNA, 22 nt, Human
cacgagggcacacgugggaggg

SEQ ID NO: 602160 - RNA, 22 nt, Human
ggcagcacugcagcuuguuggg

SEQ ID NO: 602161 - RNA, 22 nt, Human
ucuuuaaaguuggagcuugcaa

SEQ ID NO: 602162 - RNA, 22 nt, Human
aggcgcugcaugugaaggaguu

SEQ ID NO: 602163 - RNA, 22 nt, Human
uggcaagaauauuggaccagaa

SEQ ID NO: 602164 - RNA, 22 nt, Human
gugcaggaggaugacaacugca

SEQ ID NO: 602165 - RNA, 22 nt, Human
uggguauauauguugcuacaga

SEQ ID NO: 602166 - RNA, 19 nt, Human
guuguuuuucuuauuaugg

SEQ ID NO: 602167 - RNA, 22 nt, Human
uggcuucuaaaguuucuuuuag

SEQ ID NO: 602168 - RNA, 22 nt, Human
cagguggcagaggucucuggaa

SEQ ID NO: 602169 - RNA, 22 nt, Human
gaagagagagcccugggguccg

SEQ ID NO: 602170 - RNA, 22 nt, Human
gugacauuuuuacugaugagag

SEQ ID NO: 602171 - RNA, 22 nt, Human
ugacaaugacauggacagugau

SEQ ID NO: 602172 - RNA, 22 nt, Human
auauuaguguagguagcuaaua

SEQ ID NO: 602173 - RNA, 22 nt, Human
agaaaggguucucugaggugcu

SEQ ID NO: 602174 - RNA, 22 nt, Human
ggccuugggauguggcugcagc

SEQ ID NO: 602175 - RNA, 22 nt, Human
gccagauuuacagauuugcccu

SEQ ID NO: 602176 - RNA, 22 nt, Human
aaguauacugaagguauccagg

SEQ ID NO: 602177 - RNA, 19 nt, Human
uaagacagauuccuagagu

SEQ ID NO: 602178 - RNA, 22 nt, Human
cccaggagguuggggcuacagu

SEQ ID NO: 602179 - RNA, 22 nt, Human
acauuuuacaguugucuggcua

SEQ ID NO: 602180 - RNA, 22 nt, Human
uuguacaaguauuaugugaaca

SEQ ID NO: 602181 - RNA, 22 nt, Human
gagcagcuguccccaaagcuuc

SEQ ID NO: 602182 - RNA, 19 nt, Human
uucucugugcuagacucug

SEQ ID NO: 602183 - RNA, 20 nt, Human
guauaagauuucacacauua

SEQ ID NO: 602184 - RNA, 22 nt, Human
uuugcuauugugaauagugcca

SEQ ID NO: 602185 - RNA, 22 nt, Human
uaguaaacaggcaagggaccac

SEQ ID NO: 602186 - RNA, 22 nt, Human
ugggccuggacaaggccacuag

SEQ ID NO: 602187 - RNA, 22 nt, Human
agaauaguuuuacuuuucuaug

SEQ ID NO: 602188 - RNA, 23 nt, Human
gcugcagcuguggauguucucag

SEQ ID NO: 602189 - RNA, 22 nt, Human
acccaggcuggagugcaguguc

SEQ ID NO: 602190 - RNA, 22 nt, Human
uaagauuuuuaaaauguccuca

SEQ ID NO: 602191 - RNA, 22 nt, Human
uggcuccacuacuggguguguu

SEQ ID NO: 602192 - RNA, 22 nt, Human
auuuauguaucuguguagauca

SEQ ID NO: 602193 - RNA, 22 nt, Human
ugaaaccccagauuaccacaaa

SEQ ID NO: 602194 - RNA, 22 nt, Human
aggggagcgacauuccgugccg

SEQ ID NO: 602195 - RNA, 22 nt, Human
gccugggagugcacagugaggu

SEQ ID NO: 602196 - RNA, 20 nt, Human
ucucugagcuucucuugggg

SEQ ID NO: 602197 - RNA, 17 nt, Human
agugugugaaauggugg

SEQ ID NO: 602198 - RNA, 22 nt, Human
ugggccugaguuugggaacugg

SEQ ID NO: 602199 - RNA, 22 nt, Human
aggcugccuguuccaaucuccu

SEQ ID NO: 602200 - RNA, 22 nt, Human
cugguccaguggaugcugaggg

SEQ ID NO: 602201 - RNA, 18 nt, Human
uaguggaacugcucuggg

SEQ ID NO: 602202 - RNA, 22 nt, Human
agucaccaacaugguucccagg

SEQ ID NO: 602203 - RNA, 22 nt, Human
ugucacaguuuguacuuuauag

SEQ ID NO: 602204 - RNA, 22 nt, Human
cuggagggauguaggguguauu

SEQ ID NO: 602205 - RNA, 22 nt, Human
cugagcugguucucuugugaaa

SEQ ID NO: 602206 - RNA, 22 nt, Human
gaaauacaggaaugccacacag

SEQ ID NO: 602207 - RNA, 22 nt, Human
gcaggucuagaagcugccucug

SEQ ID NO: 602208 - RNA, 22 nt, Human
cagaguggaguuuuucagcggg

SEQ ID NO: 602209 - RNA, 22 nt, Human
agaggcugagaaacccucuucu

SEQ ID NO: 602210 - RNA, 22 nt, Human
uacaauaugugaacuuuggugu

SEQ ID NO: 602211 - RNA, 22 nt, Human
ugugcccagacugccucaguga

SEQ ID NO: 602212 - RNA, 22 nt, Human
ucacugcuuuguuuacaacuau

SEQ ID NO: 602213 - RNA, 22 nt, Human
guccuggggauuauagaguguu

SEQ ID NO: 602214 - RNA, 17 nt, Human
acagggcagaaacagcu

SEQ ID NO: 602215 - RNA, 23 nt, Human
uaucuguauuuguucacugcugu

SEQ ID NO: 602216 - RNA, 22 nt, Human
ugagaugguucacagagaaggc

SEQ ID NO: 602217 - RNA, 20 nt, Human
ucccucccuccagcucuggg

SEQ ID NO: 602218 - RNA, 22 nt, Human
gcugccuccgccggcuccacag

SEQ ID NO: 602219 - RNA, 23 nt, Human
gagagagauugcuaaaccacucc

SEQ ID NO: 602220 - RNA, 22 nt, Human
gaacauuuccagaaaggaacua

SEQ ID NO: 602221 - RNA, 19 nt, Human
auccuggguccuccagcug

SEQ ID NO: 602222 - RNA, 21 nt, Human
gggguauaccuaugagauagu

SEQ ID NO: 602223 - RNA, 23 nt, Human
gcccucccucccagguggguguu

SEQ ID NO: 602224 - RNA, 22 nt, Human
gggcugagucugcugccuguca

SEQ ID NO: 602225 - RNA, 21 nt, Human
uggugccuucagcugucuuuu

SEQ ID NO: 602226 - RNA, 22 nt, Human
ucaguggauugacaugaaaaag

SEQ ID NO: 602227 - RNA, 22 nt, Human
uggagcagagaugggagcccaa

SEQ ID NO: 602228 - RNA, 22 nt, Human
guuuuuauauccuguggagugu

SEQ ID NO: 602229 - RNA, 22 nt, Human
ucugaggucacagauuucaaga

SEQ ID NO: 602230 - RNA, 21 nt, Human
gccuggcucucacuggccugg

SEQ ID NO: 602231 - RNA, 22 nt, Human
uaaguccaaggguaugaguugg

SEQ ID NO: 602232 - RNA, 22 nt, Human
ggugggcaacauuuggccugag

SEQ ID NO: 602233 - RNA, 22 nt, Human
caaucccaucaccaucugcucu

SEQ ID NO: 602234 - RNA, 22 nt, Human
ucugguuucccaguuccuccgu

SEQ ID NO: 602235 - RNA, 22 nt, Human
acugcagccuugaacucugggc

SEQ ID NO: 602236 - RNA, 21 nt, Human
uuuuuucuugcgugaggccug

SEQ ID NO: 602237 - RNA, 22 nt, Human
cauuuauuaguuaguucgaugu

SEQ ID NO: 602238 - RNA, 22 nt, Human
cuggcuggccggaggcaucccu

SEQ ID NO: 602239 - RNA, 22 nt, Human
cagaacugggcagggagcagag

SEQ ID NO: 602240 - RNA, 22 nt, Human
uucuguaggcauggaacaggga

SEQ ID NO: 602241 - RNA, 22 nt, Human
agacagcugcucgcagagcuau

SEQ ID NO: 602242 - RNA, 22 nt, Human
cugcuuuagacggcuuucgcug

SEQ ID NO: 602243 - RNA, 22 nt, Human
uggaggcauaggccugggcccu

SEQ ID NO: 602244 - RNA, 19 nt, Human
caagacaaagcccaucuuc

SEQ ID NO: 602245 - RNA, 22 nt, Human
uuuuguuuguguccacugcagu

SEQ ID NO: 602246 - RNA, 22 nt, Human
uaguggggccugggaggguucc

SEQ ID NO: 602247 - RNA, 22 nt, Human
aacaggaaacaaguuguuagga

SEQ ID NO: 602248 - RNA, 22 nt, Human
uagaaacauauaggauggcagg

SEQ ID NO: 602249 - RNA, 22 nt, Human
uacuguacugucuuuuuugcug

SEQ ID NO: 602250 - RNA, 22 nt, Human
cgugccuuggucccaaccccca

SEQ ID NO: 602251 - RNA, 22 nt, Human
gcuguacaucacaauuugcugu

SEQ ID NO: 602252 - RNA, 19 nt, Human
ugcugacugggccucaccg

SEQ ID NO: 602253 - RNA, 22 nt, Human
gcugccacauuuucaggacuaa

SEQ ID NO: 602254 - RNA, 22 nt, Human
ccccagccagcaggaccucuga

SEQ ID NO: 602255 - RNA, 22 nt, Human
auuccacagcuacaucaaucua

SEQ ID NO: 602256 - RNA, 22 nt, Human
gggcuucuugccauggggacgg

SEQ ID NO: 602257 - RNA, 22 nt, Human
ucauaaaguuaucaccaaaucc

SEQ ID NO: 602258 - RNA, 22 nt, Human
caucuucagguguuuuccauca

SEQ ID NO: 602259 - RNA, 22 nt, Human
gcaguguuaaugcgaguguuca

SEQ ID NO: 602260 - RNA, 22 nt, Human
agcacaggaacauggagauggg

SEQ ID NO: 602261 - RNA, 22 nt, Human
auuguaagagguuuggcugugu

SEQ ID NO: 602262 - RNA, 22 nt, Human
caggucuguuuccaucagugcu

SEQ ID NO: 602263 - RNA, 22 nt, Human
uuuaauuugaaaugaguaaccc

SEQ ID NO: 602264 - RNA, 22 nt, Human
gacagcaggugcuugggaaagg

SEQ ID NO: 602265 - RNA, 22 nt, Human
uaagaagguaguuuccaaguca

SEQ ID NO: 602266 - RNA, 22 nt, Human
cuagucacgucuuucaguuacc

SEQ ID NO: 602267 - RNA, 22 nt, Human
guuaaauaaccucauguccguu

SEQ ID NO: 602268 - RNA, 23 nt, Human
uucuucucaauuaguugauucag

SEQ ID NO: 602269 - RNA, 22 nt, Human
ugucacuucaggaaugcaggga

SEQ ID NO: 602270 - RNA, 22 nt, Human
acucucucacagcuuggcugau

SEQ ID NO: 602271 - RNA, 22 nt, Human
cagugcugggcagaggagagcg

SEQ ID NO: 602272 - RNA, 22 nt, Human
gaggcucagagggagcaugguc

SEQ ID NO: 602273 - RNA, 22 nt, Human
gacaugugcugucucuuaaauu

SEQ ID NO: 602274 - RNA, 22 nt, Human
agagaacacgugcaucugcaau

SEQ ID NO: 602275 - RNA, 22 nt, Human
aguguuugggggccuuguaaca

SEQ ID NO: 602276 - RNA, 22 nt, Human
aagcaauuguccugucucuaca

SEQ ID NO: 602277 - RNA, 22 nt, Human
cacaccuguaauaccagcuacu

SEQ ID NO: 602278 - RNA, 22 nt, Human
aaagcaguauaaguaacggaag

SEQ ID NO: 602279 - RNA, 22 nt, Human
agauucauuaggagacauucag

SEQ ID NO: 602280 - RNA, 22 nt, Human
cugcacagcugggcaagauaua

SEQ ID NO: 602281 - RNA, 22 nt, Human
augugugugugcgcgcgcagga

SEQ ID NO: 602282 - RNA, 22 nt, Human
uaacauugaguccacuaaacag

SEQ ID NO: 602283 - RNA, 22 nt, Human
aaagcaauagguuaggucaaga

SEQ ID NO: 602284 - RNA, 23 nt, Human
aacugucuugcaagugugauacc

SEQ ID NO: 602285 - RNA, 22 nt, Human
ucugggcuugguuagggcuguu

SEQ ID NO: 602286 - RNA, 22 nt, Human
ucucauugguauauacaugugu

SEQ ID NO: 602287 - RNA, 22 nt, Human
gaggccugaggcugccuggagc

SEQ ID NO: 602288 - RNA, 22 nt, Human
cagagggaucaucuuccugaag

SEQ ID NO: 602289 - RNA, 22 nt, Human
cacugcccuuacaugcccugca

SEQ ID NO: 602290 - RNA, 22 nt, Human
ccugcagacacuuguccagcaa

SEQ ID NO: 602291 - RNA, 22 nt, Human
aguguacaucagaacauaucaa

SEQ ID NO: 602292 - RNA, 22 nt, Human
aaagacuuucaccuagcaaaga

SEQ ID NO: 602293 - RNA, 22 nt, Human
aacaucuuugccaaauugcuau

SEQ ID NO: 602294 - RNA, 22 nt, Human
ccagcagcuuuauuggcucucc

SEQ ID NO: 602295 - RNA, 22 nt, Human
gugggcagugguuugcgcgguc

SEQ ID NO: 602296 - RNA, 22 nt, Human
cauuuacacuucuaaccacaag

SEQ ID NO: 602297 - RNA, 22 nt, Human
cucuuauuccuacaguaacagg

SEQ ID NO: 602298 - RNA, 22 nt, Human
ggcaggugggaacccuccccac

SEQ ID NO: 602299 - RNA, 22 nt, Human
acacaugugucugcaugcagug

SEQ ID NO: 602300 - RNA, 22 nt, Human
ucauggauggccgggaggugau

SEQ ID NO: 602301 - RNA, 22 nt, Human
cugaggccucucuccugggcuu

SEQ ID NO: 602302 - RNA, 22 nt, Human
caaagucuucaguugauucuga

SEQ ID NO: 602303 - RNA, 22 nt, Human
gccuuggccuuccuaggccuga

SEQ ID NO: 602304 - RNA, 22 nt, Human
uugggcagaggccaggaggaug

SEQ ID NO: 602305 - RNA, 22 nt, Human
uucuuuccuugccucagugaag

SEQ ID NO: 602306 - RNA, 22 nt, Human
cugcugacagcccugcuucagg

SEQ ID NO: 602307 - RNA, 22 nt, Human
uuccuuagauccuucaaucacg

SEQ ID NO: 602308 - RNA, 22 nt, Human
gggagaagaaugugucaauugu

SEQ ID NO: 602309 - RNA, 22 nt, Human
uggcacaugguuaaucauaauu

SEQ ID NO: 602310 - RNA, 22 nt, Human
uaccugcagcgggaauccauua

SEQ ID NO: 602311 - RNA, 22 nt, Human
agcucugggguagggcccaaca

SEQ ID NO: 602312 - RNA, 18 nt, Human
uaaucuuacagacaggau

SEQ ID NO: 602313 - RNA, 22 nt, Human
gcccacaguuaaugggggcucu

SEQ ID NO: 602314 - RNA, 22 nt, Human
cugcagccuccugggguacaug

SEQ ID NO: 602315 - RNA, 22 nt, Human
cagccaaaugagucauaaaugu

SEQ ID NO: 602316 - RNA, 22 nt, Human
accauggaccauaguuccuauu

SEQ ID NO: 602317 - RNA, 22 nt, Human
uuuccauauuuaaucaaaauaa

SEQ ID NO: 602318 - RNA, 23 nt, Human
agcuggguggccugcgugaagcu

SEQ ID NO: 602319 - RNA, 22 nt, Human
aggcugaguuucucauucucgc

SEQ ID NO: 602320 - RNA, 22 nt, Human
aucugaaaguuuagaauucuug

SEQ ID NO: 602321 - RNA, 22 nt, Human
uccagcuuauagguagauuuaa

SEQ ID NO: 602322 - RNA, 20 nt, Human
ugggguccuggaggggaucc

SEQ ID NO: 602323 - RNA, 22 nt, Human
uuucagaggugcuuggaaugcu

SEQ ID NO: 602324 - RNA, 22 nt, Human
uugucugaagucacacagaugc

SEQ ID NO: 602325 - RNA, 22 nt, Human
caggcucacuguaaggucagcu

SEQ ID NO: 602326 - RNA, 22 nt, Human
uuggggcaccuccccagcauuu

SEQ ID NO: 602327 - RNA, 22 nt, Human
uaucagcaucuccucaaagaua

SEQ ID NO: 602328 - RNA, 22 nt, Human
acugagguauaauugacauaac

SEQ ID NO: 602329 - RNA, 20 nt, Human
gggcccugggauucagagca

SEQ ID NO: 602330 - RNA, 22 nt, Human
ugcugaaugggauauguugagc

SEQ ID NO: 602331 - RNA, 22 nt, Human
ucuucuuccuccacagggccca

SEQ ID NO: 602332 - RNA, 22 nt, Human
agaaaguacagaugagacacuu

SEQ ID NO: 602333 - RNA, 22 nt, Human
agggccagucguguauuacugu

SEQ ID NO: 602334 - RNA, 22 nt, Human
uucuacauauauuuuucucacu

SEQ ID NO: 602335 - RNA, 22 nt, Human
cagugggaaugaaguggaggcc

SEQ ID NO: 602336 - RNA, 22 nt, Human
uuacuguugguguauccauagc

SEQ ID NO: 602337 - RNA, 23 nt, Human
uagaacaucggugucuuggagca

SEQ ID NO: 602338 - RNA, 22 nt, Human
gacagacauuuccugauccaau

SEQ ID NO: 602339 - RNA, 22 nt, Human
cuccuggcccugagcucccagg

SEQ ID NO: 602340 - RNA, 22 nt, Human
ccaagcaugggguucaguagga

SEQ ID NO: 602341 - RNA, 21 nt, Human
auaauguacaaaaacugucuu

SEQ ID NO: 602342 - RNA, 22 nt, Human
uuucuccuaacucaaauuuaag

SEQ ID NO: 602343 - RNA, 22 nt, Human
aaaaaguauuggccaugguuga

SEQ ID NO: 602344 - RNA, 22 nt, Human
gacuuuauuacuaacccuguga

SEQ ID NO: 602345 - RNA, 22 nt, Human
ugccauauugcaaagugucugc

SEQ ID NO: 602346 - RNA, 22 nt, Human
gaggcacugcugggccccugua

SEQ ID NO: 602347 - RNA, 22 nt, Human
gcagccagaagacucagaacaa

SEQ ID NO: 602348 - RNA, 22 nt, Human
cagggcaguaacgggaacaucu

SEQ ID NO: 602349 - RNA, 22 nt, Human
uccucuggcccagcugccucug

SEQ ID NO: 602350 - RNA, 22 nt, Human
aucugucuuuuauucaugagcu

SEQ ID NO: 602351 - RNA, 21 nt, Human
uccuguaagcuuggguggcuc

SEQ ID NO: 602352 - RNA, 22 nt, Human
ucucuggcccuguuuucuaucu

SEQ ID NO: 602353 - RNA, 22 nt, Human
guuuacaaauauuuuaaauggu

SEQ ID NO: 602354 - RNA, 23 nt, Human
ccugggcauuggcugcagcuucu

SEQ ID NO: 602355 - RNA, 22 nt, Human
ccuggccucagccuagggcuga

SEQ ID NO: 602356 - RNA, 22 nt, Human
ggggcaggagguguucucuuuu

SEQ ID NO: 602357 - RNA, 20 nt, Human
agggcugagaagggacuagc

SEQ ID NO: 602358 - RNA, 22 nt, Human
ucugaaagagaguacauacagu

SEQ ID NO: 602359 - RNA, 22 nt, Human
agagaacagccuccuagagaaa

SEQ ID NO: 602360 - RNA, 22 nt, Human
aggccagggucccacacucgca

SEQ ID NO: 602361 - RNA, 20 nt, Human
ugaaaggugggaauuguggg

SEQ ID NO: 602362 - RNA, 22 nt, Human
aagaaugauuacaaagcaacga

SEQ ID NO: 602363 - RNA, 22 nt, Human
agccagcaggugagugcagccu

SEQ ID NO: 602364 - RNA, 22 nt, Human
ucacauuuauuucaaaguuacu

SEQ ID NO: 602365 - RNA, 22 nt, Human
auuuauuaccucggaguuucug

SEQ ID NO: 602366 - RNA, 22 nt, Human
gggacucugagagccugagggu

SEQ ID NO: 602367 - RNA, 22 nt, Human
agaugagggguagaaaggacuu

SEQ ID NO: 602368 - RNA, 22 nt, Human
uagaaaauguuccacugccauu

SEQ ID NO: 602369 - RNA, 18 nt, Human
uccaggucccaggggaag

SEQ ID NO: 602370 - RNA, 22 nt, Human
uagagguagaguuacauuaguc

SEQ ID NO: 602371 - RNA, 22 nt, Human
acagcaauaggaaauacuugca

SEQ ID NO: 602372 - RNA, 22 nt, Human
uugucugaggguuugagagaau

SEQ ID NO: 602373 - RNA, 22 nt, Human
ugccucugugggccuuccuggc

SEQ ID NO: 602374 - RNA, 22 nt, Human
gcagcuggacccacacggcuua

SEQ ID NO: 602375 - RNA, 23 nt, Human
uccagccucuugcucucacaugc

SEQ ID NO: 602376 - RNA, 22 nt, Human
uugcagggcaucuaugucuggu

SEQ ID NO: 602377 - RNA, 23 nt, Human
aaaugacauaugguuucugaagg

SEQ ID NO: 602378 - RNA, 22 nt, Human
cugcuuuauagggcuuccaugu

SEQ ID NO: 602379 - RNA, 22 nt, Human
auggagggugucagagagcgaa

SEQ ID NO: 602380 - RNA, 22 nt, Human
agaagcugacagaugcagcagg

SEQ ID NO: 602381 - RNA, 21 nt, Human
uggcugaguggaugcaugaau

SEQ ID NO: 602382 - RNA, 22 nt, Human
ccucccacauccuagcucugcu

SEQ ID NO: 602383 - RNA, 22 nt, Human
cucuuuagucuguguggagaag

SEQ ID NO: 602384 - RNA, 21 nt, Human
ugcaaugcauugacagcagca

SEQ ID NO: 602385 - RNA, 22 nt, Human
cugggagagguggugggaagua

SEQ ID NO: 602386 - RNA, 22 nt, Human
uccugggcugugugccacucug

SEQ ID NO: 602387 - RNA, 22 nt, Human
aggauggcuugcaggaggcugu

SEQ ID NO: 602388 - RNA, 22 nt, Human
uugcuaaauuuauuuucgaaca

SEQ ID NO: 602389 - RNA, 22 nt, Human
aacaugcuuugauaaauaaaag

SEQ ID NO: 602390 - RNA, 22 nt, Human
ugguccaguagcagggauacca

SEQ ID NO: 602391 - RNA, 22 nt, Human
ggcucccugggugcuccugcuc

SEQ ID NO: 602392 - RNA, 22 nt, Human
cucucuggacuugaguaucagc

SEQ ID NO: 602393 - RNA, 22 nt, Human
gggcgggguggcucaugccugu

SEQ ID NO: 602394 - RNA, 22 nt, Human
uuuguaccugugggaauacaga

SEQ ID NO: 602395 - RNA, 22 nt, Human
gggccagugagucgggagagcu

SEQ ID NO: 602396 - RNA, 22 nt, Human
auuuccuaauuuaugcaggagu

SEQ ID NO: 602397 - RNA, 22 nt, Human
ucugaggcugucucugggcucc

SEQ ID NO: 602398 - RNA, 23 nt, Human
ugcuccagguacagaacuccagg

SEQ ID NO: 602399 - RNA, 22 nt, Human
ccugggcagccugcucaaggac

SEQ ID NO: 602400 - RNA, 22 nt, Human
agacagugcuaucccaucugug

SEQ ID NO: 602401 - RNA, 22 nt, Human
ggccaugcaggucagagguggg

SEQ ID NO: 602402 - RNA, 22 nt, Human
uuuccuacccuuccaggcagag

SEQ ID NO: 602403 - RNA, 22 nt, Human
aggcugugagcaagaacaccua

SEQ ID NO: 602404 - RNA, 22 nt, Human
gcugcuuuagaauugaaacaga

SEQ ID NO: 602405 - RNA, 22 nt, Human
uuuucaggcugauuuguguuag

SEQ ID NO: 602406 - RNA, 22 nt, Human
ucugaggccuuggcagcuaagg

SEQ ID NO: 602407 - RNA, 22 nt, Human
gauagggcuucacuaggcggag

SEQ ID NO: 602408 - RNA, 22 nt, Human
acauucuaugaagauaauuuua

SEQ ID NO: 602409 - RNA, 22 nt, Human
ccuucucugcagguaguuggcu

SEQ ID NO: 602410 - RNA, 22 nt, Human
ccagguggcccugcccuacucu

SEQ ID NO: 602411 - RNA, 21 nt, Human
cagaucuguagguacuaccau

SEQ ID NO: 602412 - RNA, 22 nt, Human
ugguggcagugagaaggagagg

SEQ ID NO: 602413 - RNA, 22 nt, Human
ggcagguguggugaccagagau

SEQ ID NO: 602414 - RNA, 22 nt, Human
ucugucuuugagaucucagccu

SEQ ID NO: 602415 - RNA, 22 nt, Human
ugaaauguugguaauuuuauau

SEQ ID NO: 602416 - RNA, 22 nt, Human
uuuauuguguugaaacugaauu

SEQ ID NO: 602417 - RNA, 22 nt, Human
uugaaagucacaauggcauuaa

SEQ ID NO: 602418 - RNA, 22 nt, Human
acuuuguugaugaaauaguuuu

SEQ ID NO: 602419 - RNA, 22 nt, Human
uggcagcugcguuguguuucug

SEQ ID NO: 602420 - RNA, 22 nt, Human
aguccagagaggaggcugugug

SEQ ID NO: 602421 - RNA, 22 nt, Human
ucacccaggcuggacugcagug

SEQ ID NO: 602422 - RNA, 22 nt, Human
caggaugugaggaggccauuug

SEQ ID NO: 602423 - RNA, 22 nt, Human
uguaaaauaauucuccauguuu

SEQ ID NO: 602424 - RNA, 22 nt, Human
uugagguaauaaacagccauuc

SEQ ID NO: 602425 - RNA, 22 nt, Human
aaaacuguaucuucuugggacu

SEQ ID NO: 602426 - RNA, 22 nt, Human
uccuggaggcaaaugaagacuc

SEQ ID NO: 602427 - RNA, 22 nt, Human
cagggccagggcuauggugaag

SEQ ID NO: 602428 - RNA, 22 nt, Human
uucaaacuaguuaaaagucaga

SEQ ID NO: 602429 - RNA, 22 nt, Human
aaggccaaaguuuucaggcuaa

SEQ ID NO: 602430 - RNA, 22 nt, Human
gauggcaggcaggugaguagag

SEQ ID NO: 602431 - RNA, 22 nt, Human
aaaaguaauugaugcaaucgua

SEQ ID NO: 602432 - RNA, 22 nt, Human
cucagaaagugacaggggggug

SEQ ID NO: 602433 - RNA, 22 nt, Human
agccaggguaagguacuuagua

SEQ ID NO: 602434 - RNA, 22 nt, Human
aggggcucuaaagaucauggaa

SEQ ID NO: 602435 - RNA, 22 nt, Human
cauuuguucugauuucaaaagg

SEQ ID NO: 602436 - RNA, 22 nt, Human
aaagccagcucugagcugcacc

SEQ ID NO: 602437 - RNA, 22 nt, Human
ucugggcagaagcagugcaaag

SEQ ID NO: 602438 - RNA, 22 nt, Human
ccaggugggcgugucuucaccu

SEQ ID NO: 602439 - RNA, 22 nt, Human
uguuuuuaaaauguccugguua

SEQ ID NO: 602440 - RNA, 22 nt, Human
gucuuauuaaaaugcaguuucu

SEQ ID NO: 602441 - RNA, 19 nt, Human
cccucaggucugagcaguc

SEQ ID NO: 602442 - RNA, 22 nt, Human
cugugaauuaaguauuguuauc

SEQ ID NO: 602443 - RNA, 22 nt, Human
uagcuuuguuuaucaaggggca

SEQ ID NO: 602444 - RNA, 22 nt, Human
ccagaggugaacaggaggcugu

SEQ ID NO: 602445 - RNA, 22 nt, Human
aaauuagaccagggcuccugga

SEQ ID NO: 602446 - RNA, 20 nt, Human
uguccccaccaaaauuucau

SEQ ID NO: 602447 - RNA, 22 nt, Human
agcuggagaugcccagcaccgg

SEQ ID NO: 602448 - RNA, 22 nt, Human
ucucuuaauaaguaaauacuga

SEQ ID NO: 602449 - RNA, 22 nt, Human
aucuuaaacagaggaaugacuu

SEQ ID NO: 602450 - RNA, 22 nt, Human
uuggagugacagaugaggaaac

SEQ ID NO: 602451 - RNA, 22 nt, Human
aaugaaugugauuaacuucaag

SEQ ID NO: 602452 - RNA, 22 nt, Human
aggggcacuucucaggcugugg

SEQ ID NO: 602453 - RNA, 22 nt, Human
acuuagaauuaaauauuuuugg

SEQ ID NO: 602454 - RNA, 22 nt, Human
uacaagaauuucuuucugguug

SEQ ID NO: 602455 - RNA, 22 nt, Human
ggcaccagcacuugggauggcu

SEQ ID NO: 602456 - RNA, 22 nt, Human
uuccccaggggcuccugccuuu

SEQ ID NO: 602457 - RNA, 22 nt, Human
cuccuccagcucucccuggggg

SEQ ID NO: 602458 - RNA, 22 nt, Human
agugugaguuacaaagugugaa

SEQ ID NO: 602459 - RNA, 22 nt, Human
aagaacauugauauugucuaug

SEQ ID NO: 602460 - RNA, 22 nt, Human
ugagcaguaggucugaauagug

SEQ ID NO: 602461 - RNA, 22 nt, Human
gggcucugguccugaacugaag

SEQ ID NO: 602462 - RNA, 22 nt, Human
cuuccucuguguccugggcuug

SEQ ID NO: 602463 - RNA, 22 nt, Human
gcagggcugggugggagacaga

SEQ ID NO: 602464 - RNA, 22 nt, Human
aggaaggcugaucacugcuugu

SEQ ID NO: 602465 - RNA, 22 nt, Human
ugaagacucagaagcuaagaua

SEQ ID NO: 602466 - RNA, 22 nt, Human
gaauagaugaaagugucucuua

SEQ ID NO: 602467 - RNA, 22 nt, Human
agaaagacgugaugaagaagua

SEQ ID NO: 602468 - RNA, 22 nt, Human
caauagauguuuuugcuuacca

SEQ ID NO: 602469 - RNA, 22 nt, Human
ucagugcugaguagcgugcacc

SEQ ID NO: 602470 - RNA, 22 nt, Human
uaggccaacguggaagggucca

SEQ ID NO: 602471 - RNA, 22 nt, Human
gcaggcugugguauguugggca

SEQ ID NO: 602472 - RNA, 22 nt, Human
auuguacuuuuauuacauguag

SEQ ID NO: 602473 - RNA, 22 nt, Human
ccugaggacacacgcugcagga

SEQ ID NO: 602474 - RNA, 22 nt, Human
agaugaauugauguuggacaga

SEQ ID NO: 602475 - RNA, 22 nt, Human
gggcacuguguucagagugcag

SEQ ID NO: 602476 - RNA, 22 nt, Human
augcaaaaacugcacuuacgcu

SEQ ID NO: 602477 - RNA, 22 nt, Human
ggaagccaugagggacaguucu

SEQ ID NO: 602478 - RNA, 20 nt, Human
uucugggaauuggguagcug

SEQ ID NO: 602479 - RNA, 22 nt, Human
uaggcagggauuaggguugauu

SEQ ID NO: 602480 - RNA, 22 nt, Human
gccaaagugcugcucuuuacca

SEQ ID NO: 602481 - RNA, 22 nt, Human
uccucagcuuugguuuacucau

SEQ ID NO: 602482 - RNA, 22 nt, Human
ugccuuuugaagccucacaggu

SEQ ID NO: 602483 - RNA, 20 nt, Human
ucucaggcccccuccuugcu

SEQ ID NO: 602484 - RNA, 22 nt, Human
ggcagcagaacuggcccuguau

SEQ ID NO: 602485 - RNA, 22 nt, Human
auaacugccugaugacucucaa

SEQ ID NO: 602486 - RNA, 22 nt, Human
aggugccugggagcucccugag

SEQ ID NO: 602487 - RNA, 22 nt, Human
aacuugguaccaccuucugaag

SEQ ID NO: 602488 - RNA, 22 nt, Human
aaauuccaccagaaucaguaau

SEQ ID NO: 602489 - RNA, 22 nt, Human
ggagauguagugucacuggacu

SEQ ID NO: 602490 - RNA, 22 nt, Human
gccugccucaaaaucccaguuc

SEQ ID NO: 602491 - RNA, 22 nt, Human
aggcugccucgugagcucgcug

SEQ ID NO: 602492 - RNA, 22 nt, Human
auuuuacuucauuugaaaugcc

SEQ ID NO: 602493 - RNA, 22 nt, Human
guuucucacaaggcugcaaucc

SEQ ID NO: 602494 - RNA, 20 nt, Human
aagauucugauuuguagcgu

SEQ ID NO: 602495 - RNA, 22 nt, Human
cacagagaacugugggagugug

SEQ ID NO: 602496 - RNA, 22 nt, Human
ccaggcucugcgcuggacaugg

SEQ ID NO: 602497 - RNA, 22 nt, Human
aaugcuuccaaaauaccaagcc

SEQ ID NO: 602498 - RNA, 22 nt, Human
aggcugugcauuuuggagggcc

SEQ ID NO: 602499 - RNA, 23 nt, Human
gcuggcuggcaguaaagguuguu

SEQ ID NO: 602500 - RNA, 22 nt, Human
acauacauggauucauggauuc

SEQ ID NO: 602501 - RNA, 22 nt, Human
aggcccuauucaauggggccca

SEQ ID NO: 602502 - RNA, 22 nt, Human
ggcaggaaguagcagucugagc

SEQ ID NO: 602503 - RNA, 18 nt, Human
ggccugcagugaagcaag

SEQ ID NO: 602504 - RNA, 22 nt, Human
caggcaccccaggugagcacug

SEQ ID NO: 602505 - RNA, 18 nt, Human
cuccugggcugcagaugc

SEQ ID NO: 602506 - RNA, 22 nt, Human
ugcuuuaucaaagcuauaguga

SEQ ID NO: 602507 - RNA, 22 nt, Human
gccagagguucaacaacugucu

SEQ ID NO: 602508 - RNA, 22 nt, Human
ugucccagggaaggcccagcac

SEQ ID NO: 602509 - RNA, 22 nt, Human
aggugccagaugcacagcugaa

SEQ ID NO: 602510 - RNA, 22 nt, Human
acaucaugagagacuuaaauug

SEQ ID NO: 602511 - RNA, 18 nt, Human
ucucuuuccucaguggag

SEQ ID NO: 602512 - RNA, 23 nt, Human
ucuguacaauugagaagagaaca

SEQ ID NO: 602513 - RNA, 22 nt, Human
augcugcagcugcaggaucaga

SEQ ID NO: 602514 - RNA, 22 nt, Human
gccagguguaguggccacaccu

SEQ ID NO: 602515 - RNA, 22 nt, Human
aaaaagucugcaaaggagguug

SEQ ID NO: 602516 - RNA, 22 nt, Human
agauuuuauagauaauuuccca

SEQ ID NO: 602517 - RNA, 22 nt, Human
auuucagauucagaaauguagg

SEQ ID NO: 602518 - RNA, 22 nt, Human
gaaaauaguucaucacaaugau

SEQ ID NO: 602519 - RNA, 22 nt, Human
cuucucugacagucuguuucac

SEQ ID NO: 602520 - RNA, 22 nt, Human
uuggcaaugaucucaaucuucu

SEQ ID NO: 602521 - RNA, 22 nt, Human
cuagagaagagguuaagcauga

SEQ ID NO: 602522 - RNA, 22 nt, Human
uuuuaagaacuguucugugcuu

SEQ ID NO: 602523 - RNA, 22 nt, Human
gguggaaggcagcagucucagg

SEQ ID NO: 602524 - RNA, 22 nt, Human
caggguggggcuggcuaucaaa

SEQ ID NO: 602525 - RNA, 22 nt, Human
gcucuccaggucucaugcacug

SEQ ID NO: 602526 - RNA, 22 nt, Human
gcccuucaguuacuccuugaug

SEQ ID NO: 602527 - RNA, 22 nt, Human
uaucuguauccccaucuagcua

SEQ ID NO: 602528 - RNA, 22 nt, Human
auguuuuugagauacaaacaga

SEQ ID NO: 602529 - RNA, 22 nt, Human
agcugagcucaggcugauguaa

SEQ ID NO: 602530 - RNA, 22 nt, Human
cacagcaaagacacucucaacu

SEQ ID NO: 602531 - RNA, 22 nt, Human
aagcagcuuaaauuagagccug

SEQ ID NO: 602532 - RNA, 22 nt, Human
uagaaacacagaucugguguca

SEQ ID NO: 602533 - RNA, 22 nt, Human
gcuggcuucccuaccugcaccu

SEQ ID NO: 602534 - RNA, 22 nt, Human
cuaggccagagagaccucauga

SEQ ID NO: 602535 - RNA, 22 nt, Human
cuugauccuaggauggaaggga

SEQ ID NO: 602536 - RNA, 23 nt, Human
uugacaguaggugguuuucauug

SEQ ID NO: 602537 - RNA, 23 nt, Human
uucauucaaaaggaaaagucaug

SEQ ID NO: 602538 - RNA, 22 nt, Human
gaagccacagagauuguggggg

SEQ ID NO: 602539 - RNA, 22 nt, Human
uggaggagaacucccuggcuac

SEQ ID NO: 602540 - RNA, 22 nt, Human
gcccacaguacgaggcucaggc

SEQ ID NO: 602541 - RNA, 22 nt, Human
augaggcacaucacagccaaug

SEQ ID NO: 602542 - RNA, 22 nt, Human
cuccagcuucccucagcugugg

SEQ ID NO: 602543 - RNA, 22 nt, Human
ccagcucuaaacggcucugugg

SEQ ID NO: 602544 - RNA, 22 nt, Human
cccagcagaaucugaugagggc

SEQ ID NO: 602545 - RNA, 22 nt, Human
aggcggugugcuuugcagagca

SEQ ID NO: 602546 - RNA, 22 nt, Human
auacagcuuacaguucuaaugc

SEQ ID NO: 602547 - RNA, 22 nt, Human
cagaggcuguguaggcagacug

SEQ ID NO: 602548 - RNA, 22 nt, Human
auccuucaaaaggaauagcagg

SEQ ID NO: 602549 - RNA, 22 nt, Human
ugugggaagagcaguggcagca

SEQ ID NO: 602550 - RNA, 22 nt, Human
ugcuuagaaucuggacuuguug

SEQ ID NO: 602551 - RNA, 20 nt, Human
ugguccaggaccuggugucc

SEQ ID NO: 602552 - RNA, 22 nt, Human
cugcaguuggauaaagauacuu

SEQ ID NO: 602553 - RNA, 22 nt, Human
aauuagcugucaaugaggaucu

SEQ ID NO: 602554 - RNA, 22 nt, Human
ugucuucaggaguaaauaucau

SEQ ID NO: 602555 - RNA, 22 nt, Human
ggucccaggcugcgggcuggug

SEQ ID NO: 602556 - RNA, 22 nt, Human
uccucugguuauacuugcaccc

SEQ ID NO: 602557 - RNA, 21 nt, Human
cggaaacucggcucugguucc

SEQ ID NO: 602558 - RNA, 22 nt, Human
ugcugccacauuuaaagagggg

SEQ ID NO: 602559 - RNA, 22 nt, Human
ugaaagaaacagguauauuggg

SEQ ID NO: 602560 - RNA, 22 nt, Human
uggcugagguaacuaugaauaa

SEQ ID NO: 602561 - RNA, 22 nt, Human
agucuccuuaaauauuucccag

SEQ ID NO: 602562 - RNA, 22 nt, Human
gacuuuauuuccuuauuuguga

SEQ ID NO: 602563 - RNA, 22 nt, Human
ccugggcuucugucuagauguu

SEQ ID NO: 602564 - RNA, 22 nt, Human
gucugggcuuagggacauggca

SEQ ID NO: 602565 - RNA, 22 nt, Human
aguguccugugucccagacugu

SEQ ID NO: 602566 - RNA, 22 nt, Human
cacagugugggcauggugccug

SEQ ID NO: 602567 - RNA, 22 nt, Human
cuucugggcagaaguuuugaga

SEQ ID NO: 602568 - RNA, 22 nt, Human
cagaaggcaaggccugccacgc

SEQ ID NO: 602569 - RNA, 22 nt, Human
acugaagagaagcauuuucugc

SEQ ID NO: 602570 - RNA, 22 nt, Human
gcacuuuggaaaauuuugaguu

SEQ ID NO: 602571 - RNA, 22 nt, Human
agaaacugcagcucagagaagu

SEQ ID NO: 602572 - RNA, 22 nt, Human
uccuucuccuccuugagugaca

SEQ ID NO: 602573 - RNA, 22 nt, Human
ggugaggggcuccucugcccgg

SEQ ID NO: 602574 - RNA, 22 nt, Human
gggaaggacauucugggcucag

SEQ ID NO: 602575 - RNA, 22 nt, Human
uagauuuuacuucugucauuac

SEQ ID NO: 602576 - RNA, 22 nt, Human
aguggguacugggcaggcagag

SEQ ID NO: 602577 - RNA, 22 nt, Human
uagguaagauguuaacagcuga

SEQ ID NO: 602578 - RNA, 22 nt, Human
cagcccucagguccucagcagc

SEQ ID NO: 602579 - RNA, 22 nt, Human
cacauuuaaaaaauccacgauc

SEQ ID NO: 602580 - RNA, 22 nt, Human
uauuagaggaaccaagguggag

SEQ ID NO: 602581 - RNA, 22 nt, Human
agaagagcccuuuaagggggaa

SEQ ID NO: 602582 - RNA, 22 nt, Human
aguaaacacgugggguuucuuu

SEQ ID NO: 602583 - RNA, 22 nt, Human
ugcagccugguggucacuggag

SEQ ID NO: 602584 - RNA, 19 nt, Human
cucuccagcuccaguagcu

SEQ ID NO: 602585 - RNA, 22 nt, Human
gagggccacguucagggcucuc

SEQ ID NO: 602586 - RNA, 20 nt, Human
cugugcuccggguuccugga

SEQ ID NO: 602587 - RNA, 22 nt, Human
uacuguuaauguuaaauucagg

SEQ ID NO: 602588 - RNA, 22 nt, Human
auuguuuuauuaaaugagcccu

SEQ ID NO: 602589 - RNA, 22 nt, Human
agaaucaaagagaaauacuuug

SEQ ID NO: 602590 - RNA, 22 nt, Human
uggggaagaauaauguauguac

SEQ ID NO: 602591 - RNA, 22 nt, Human
auucagaaauagaaaauuugau

SEQ ID NO: 602592 - RNA, 18 nt, Human
ucaggcugggccuccuuc

SEQ ID NO: 602593 - RNA, 22 nt, Human
uugagguccagucuccacccac

SEQ ID NO: 602594 - RNA, 22 nt, Human
aucccucugcagcugguuccug

SEQ ID NO: 602595 - RNA, 22 nt, Human
cccaggcuggggcuccuccagc

SEQ ID NO: 602596 - RNA, 22 nt, Human
agaugcuuaaguuuucagugua

SEQ ID NO: 602597 - RNA, 22 nt, Human
acaucuguuugagaaaaagaag

SEQ ID NO: 602598 - RNA, 22 nt, Human
gcagcuggagcaucuucucauc

SEQ ID NO: 602599 - RNA, 22 nt, Human
ucucugucccuaggagccuugc

SEQ ID NO: 602600 - RNA, 22 nt, Human
gggcagcacguuucaggaggau

SEQ ID NO: 602601 - RNA, 22 nt, Human
uguaaggagugugaguuugagu

SEQ ID NO: 602602 - RNA, 19 nt, Human
cauuuucccaucauccuuu

SEQ ID NO: 602603 - RNA, 22 nt, Human
acagcacuuauucagcacagug

SEQ ID NO: 602604 - RNA, 22 nt, Human
caaauagaagguacucagagaa

SEQ ID NO: 602605 - RNA, 22 nt, Human
ugucaccaaguugaugaaugca

SEQ ID NO: 602606 - RNA, 22 nt, Human
cugcuagaauuucuggaaaaga

SEQ ID NO: 602607 - RNA, 22 nt, Human
ggcagcaaccaaccaggcauuu

SEQ ID NO: 602608 - RNA, 22 nt, Human
ucuuucuggucucgccuuauuc

SEQ ID NO: 602609 - RNA, 22 nt, Human
ugcuggcuacugauggcaggcc

SEQ ID NO: 602610 - RNA, 22 nt, Human
cucuggccugcuuccucaggua

SEQ ID NO: 602611 - RNA, 18 nt, Human
acauuucucucugcguga

SEQ ID NO: 602612 - RNA, 22 nt, Human
agccacagucugaugccugaga

SEQ ID NO: 602613 - RNA, 22 nt, Human
uccugaggcuaaagugcagugg

SEQ ID NO: 602614 - RNA, 22 nt, Human
ggccaugcuguugccugcuggu

SEQ ID NO: 602615 - RNA, 22 nt, Human
cuccucacacccacugcaacca

SEQ ID NO: 602616 - RNA, 22 nt, Human
guacaugcagauuauagcuaau

SEQ ID NO: 602617 - RNA, 22 nt, Human
ucaccauuggcaauuauaaaac

SEQ ID NO: 602618 - RNA, 22 nt, Human
agcuccagauuaauuguaggag

SEQ ID NO: 602619 - RNA, 22 nt, Human
cugagaaaggaccucaaacagg

SEQ ID NO: 602620 - RNA, 22 nt, Human
gcuguuucugaguagcuaggcu

SEQ ID NO: 602621 - RNA, 22 nt, Human
ugaaggagcucaggagauaguc

SEQ ID NO: 602622 - RNA, 22 nt, Human
aacaaugauauagggauuggca

SEQ ID NO: 602623 - RNA, 21 nt, Human
aggacaggaacuggcugaaua

SEQ ID NO: 602624 - RNA, 22 nt, Human
uaguaacagcagcuucccugug

SEQ ID NO: 602625 - RNA, 22 nt, Human
uuucacuguuaggaguaugcua

SEQ ID NO: 602626 - RNA, 22 nt, Human
acauagcauguuuggacacaug

SEQ ID NO: 602627 - RNA, 22 nt, Human
ugcaggagagugagucaguagg

SEQ ID NO: 602628 - RNA, 22 nt, Human
cugccuguuuucugauagauuu

SEQ ID NO: 602629 - RNA, 22 nt, Human
acauauaagggaucagugacag

SEQ ID NO: 602630 - RNA, 17 nt, Human
ggacugggcggggcagg

SEQ ID NO: 602631 - RNA, 22 nt, Human
auuugaauggcuuaacacaacg

SEQ ID NO: 602632 - RNA, 22 nt, Human
acauauuaacugcacuacacua

SEQ ID NO: 602633 - RNA, 23 nt, Human
acagagacaaugguuucaucuug

SEQ ID NO: 602634 - RNA, 22 nt, Human
acagccagggcauugucgccga

SEQ ID NO: 602635 - RNA, 22 nt, Human
uuagucacaugcccaucucuga

SEQ ID NO: 602636 - RNA, 22 nt, Human
ugaggccaaaaugacucaaaug

SEQ ID NO: 602637 - RNA, 22 nt, Human
gugcugaauugugcucuuuaca

SEQ ID NO: 602638 - RNA, 22 nt, Human
gucagaggggacaagacacaga

SEQ ID NO: 602639 - RNA, 22 nt, Human
uuauuagcugggcuucagggug

SEQ ID NO: 602640 - RNA, 22 nt, Human
gauuccacagcuucgaggucuu

SEQ ID NO: 602641 - RNA, 22 nt, Human
ccccuuccacagugcuuccuaa

SEQ ID NO: 602642 - RNA, 22 nt, Human
uccauaaaccagaaaaucaaga

SEQ ID NO: 602643 - RNA, 22 nt, Human
ugccugccccacaagggguugc

SEQ ID NO: 602644 - RNA, 21 nt, Human
ucaggguucaaaggaacugau

SEQ ID NO: 602645 - RNA, 22 nt, Human
ggcugccagugagugcagaccg

SEQ ID NO: 602646 - RNA, 22 nt, Human
gagaacauuaauaguuaauuuu

SEQ ID NO: 602647 - RNA, 22 nt, Human
guuguuuucacaaacccaugau

SEQ ID NO: 602648 - RNA, 22 nt, Human
uaacagcacuggcaggcacugu

SEQ ID NO: 602649 - RNA, 22 nt, Human
aaagccacguggccuggggagc

SEQ ID NO: 602650 - RNA, 22 nt, Human
uugggaaggcguggaagcagaa

SEQ ID NO: 602651 - RNA, 20 nt, Human
caacacugcccauuguuugc

SEQ ID NO: 602652 - RNA, 22 nt, Human
auaacagaugugaagugcuaau

SEQ ID NO: 602653 - RNA, 22 nt, Human
gagggacagcuaaagagaaauu

SEQ ID NO: 602654 - RNA, 22 nt, Human
acaguagcuaauauugcauuau

SEQ ID NO: 602655 - RNA, 22 nt, Human
ucaggcagguggcuggcuaugg

SEQ ID NO: 602656 - RNA, 22 nt, Human
acuuggaaagaugcaacacagu

SEQ ID NO: 602657 - RNA, 22 nt, Human
ugcagcauccauauauuauuag

SEQ ID NO: 602658 - RNA, 22 nt, Human
agcugugcugccaaguugcuga

SEQ ID NO: 602659 - RNA, 22 nt, Human
agcuguuuucuucuaggaagac

SEQ ID NO: 602660 - RNA, 22 nt, Human
aucugcuugaaugagcaacagg

SEQ ID NO: 602661 - RNA, 20 nt, Human
gcucagggccugggucugga

SEQ ID NO: 602662 - RNA, 22 nt, Human
guugcugaaggcaugccagaga

SEQ ID NO: 602663 - RNA, 22 nt, Human
gaggggagcaugaucuagauug

SEQ ID NO: 602664 - RNA, 22 nt, Human
aacaguauugguugaacucaag

SEQ ID NO: 602665 - RNA, 22 nt, Human
uuauaucuuuuuacaucucucc

SEQ ID NO: 602666 - RNA, 22 nt, Human
ucucagguaaaaggguaucuac

SEQ ID NO: 602667 - RNA, 18 nt, Human
ucaggcucucuggcuaga

SEQ ID NO: 602668 - RNA, 22 nt, Human
cccaggcagcggggucuccuug

SEQ ID NO: 602669 - RNA, 22 nt, Human
ugauagaaaggaaauuaauugg

SEQ ID NO: 602670 - RNA, 22 nt, Human
gccugcagaacugugaggcaau

SEQ ID NO: 602671 - RNA, 22 nt, Human
acagggagucugaggggauagu

SEQ ID NO: 602672 - RNA, 23 nt, Human
acucagcuuugggagaugacuca

SEQ ID NO: 602673 - RNA, 22 nt, Human
cucagccaugcaacaugcuggg

SEQ ID NO: 602674 - RNA, 22 nt, Human
agcugggaugauaaccucaguc

SEQ ID NO: 602675 - RNA, 22 nt, Human
cacagcuucuccccgcugcggc

SEQ ID NO: 602676 - RNA, 22 nt, Human
cuuuacauaaggauaaaccugg

SEQ ID NO: 602677 - RNA, 22 nt, Human
gccugccuuuguaugacccuga

SEQ ID NO: 602678 - RNA, 22 nt, Human
uauucuacaguguuaguguuag

SEQ ID NO: 602679 - RNA, 22 nt, Human
agggugucagccacggaauggg

SEQ ID NO: 602680 - RNA, 22 nt, Human
aauguguuuaguuaaugaguug

SEQ ID NO: 602681 - RNA, 22 nt, Human
uaaggguucagaaugcaguggu

SEQ ID NO: 602682 - RNA, 22 nt, Human
gcccaggagccuggagaugugu

SEQ ID NO: 602683 - RNA, 22 nt, Human
ucuagaccuggcacugcccugu

SEQ ID NO: 602684 - RNA, 17 nt, Human
ccaggcuccaucacugu

SEQ ID NO: 602685 - RNA, 17 nt, Human
ccagggaggggccgcgc

SEQ ID NO: 602686 - RNA, 22 nt, Human
uccuguguuacccuugcaguga

SEQ ID NO: 602687 - RNA, 22 nt, Human
gccuggcacucacugaagaggc

SEQ ID NO: 602688 - RNA, 22 nt, Human
ccugggugguuccggcaaggag

SEQ ID NO: 602689 - RNA, 22 nt, Human
uugggguaaaaugucguaagag

SEQ ID NO: 602690 - RNA, 22 nt, Human
ucagcucuguuuugaguggaac

SEQ ID NO: 602691 - RNA, 22 nt, Human
gagaggcucagggacuugcuga

SEQ ID NO: 602692 - RNA, 22 nt, Human
cugaugcuugcaacaaagaacc

SEQ ID NO: 602693 - RNA, 22 nt, Human
ggcagaggaaggaugaauucac

SEQ ID NO: 602694 - RNA, 22 nt, Human
uugugauacugagcuuggcauu

SEQ ID NO: 602695 - RNA, 18 nt, Human
ucugagguggacgaggag

SEQ ID NO: 602696 - RNA, 19 nt, Human
guauauuuauauggcugua

SEQ ID NO: 602697 - RNA, 22 nt, Human
auaguguuuuacuuagacuucu

SEQ ID NO: 602698 - RNA, 22 nt, Human
gaacauaacuauugugaauagu

SEQ ID NO: 602699 - RNA, 22 nt, Human
cuccuggcaguuccccuuguca

SEQ ID NO: 602700 - RNA, 22 nt, Human
guccugguagggcucugugucu

SEQ ID NO: 602701 - RNA, 22 nt, Human
gcaggaguguauuugcauguaa

SEQ ID NO: 602702 - RNA, 22 nt, Human
ggcugcuggggacgugggagag

SEQ ID NO: 602703 - RNA, 22 nt, Human
cuccucagucaggucuaggguc

SEQ ID NO: 602704 - RNA, 22 nt, Human
uuccugggagcuagccacaucu

SEQ ID NO: 602705 - RNA, 22 nt, Human
uucugagaaggcuguggacaca

SEQ ID NO: 602706 - RNA, 22 nt, Human
uuccucugaaauggcuuggaaa

SEQ ID NO: 602707 - RNA, 23 nt, Human
ugccagaggcagucacaguggug

SEQ ID NO: 602708 - RNA, 22 nt, Human
uguuccugaaugccuggcuggc

SEQ ID NO: 602709 - RNA, 19 nt, Human
augucucuguagcacauac

SEQ ID NO: 602710 - RNA, 22 nt, Human
cugaggcuuugugugcaugccu

SEQ ID NO: 602711 - RNA, 22 nt, Human
ggucccaggaagugcggcggcg

SEQ ID NO: 602712 - RNA, 21 nt, Human
aguuuucugaguuauaaaaua

SEQ ID NO: 602713 - RNA, 17 nt, Human
uuuaaacuacuacaagg

SEQ ID NO: 602714 - RNA, 22 nt, Human
aaggaggguucccagguccugg

SEQ ID NO: 602715 - RNA, 23 nt, Human
auguuaagugaaauaggccagga

SEQ ID NO: 602716 - RNA, 22 nt, Human
cagcacaggcaggggaacuaua

SEQ ID NO: 602717 - RNA, 22 nt, Human
augcugcagucaggccagauug

SEQ ID NO: 602718 - RNA, 22 nt, Human
guucagcaaguacucaguccac

SEQ ID NO: 602719 - RNA, 22 nt, Human
uggaaaggacaguugcugauag

SEQ ID NO: 602720 - RNA, 22 nt, Human
ccaggcucagcgcgcacgucug

SEQ ID NO: 602721 - RNA, 22 nt, Human
uaaucauauggguaauccaaug

SEQ ID NO: 602722 - RNA, 22 nt, Human
auauucuggguuagauauguuu

SEQ ID NO: 602723 - RNA, 22 nt, Human
agggauggcaaguuaaccugag

SEQ ID NO: 602724 - RNA, 22 nt, Human
agugaaaucagguuuugacugc

SEQ ID NO: 602725 - RNA, 23 nt, Human
uuucacaaugagcauuacagaau

SEQ ID NO: 602726 - RNA, 22 nt, Human
gcaggagugacauggaugugga

SEQ ID NO: 602727 - RNA, 22 nt, Human
aaaacucugcaguuaguuucua

SEQ ID NO: 602728 - RNA, 22 nt, Human
caugcuuugggucagaaaugcc

SEQ ID NO: 602729 - RNA, 22 nt, Human
uacuguauuugauaagugaagu

SEQ ID NO: 602730 - RNA, 22 nt, Human
aagauccuugguucugcuuucc

SEQ ID NO: 602731 - RNA, 22 nt, Human
aaagauuaaaucaaauugguca

SEQ ID NO: 602732 - RNA, 22 nt, Human
agcaaugaccagugaucuugua

SEQ ID NO: 602733 - RNA, 21 nt, Human
agugacagaggaaggugcaua

SEQ ID NO: 602734 - RNA, 20 nt, Human
aguguuucucaacauggggc

SEQ ID NO: 602735 - RNA, 22 nt, Human
aauaaagcaugaggcauuuauc

SEQ ID NO: 602736 - RNA, 22 nt, Human
auggcaggauacccaguccggc

SEQ ID NO: 602737 - RNA, 22 nt, Human
uaagauaaggaacauucuguga

SEQ ID NO: 602738 - RNA, 22 nt, Human
ugugauucucagaagagggaag

SEQ ID NO: 602739 - RNA, 22 nt, Human
acauuuuuggguugaugucuga

SEQ ID NO: 602740 - RNA, 21 nt, Human
aggauuuuguugaaguuucug

SEQ ID NO: 602741 - RNA, 22 nt, Human
agccacaggaaacagagacagc

SEQ ID NO: 602742 - RNA, 22 nt, Human
cagcccaaagccccaggcuaga

SEQ ID NO: 602743 - RNA, 22 nt, Human
aaguuuguuuuagucuaaugau

SEQ ID NO: 602744 - RNA, 22 nt, Human
auaaaugugaauuagagcuuug

SEQ ID NO: 602745 - RNA, 22 nt, Human
aggcuggcgucaggggcuguac

SEQ ID NO: 602746 - RNA, 22 nt, Human
gcaguggcuaagcucgcaugca

SEQ ID NO: 602747 - RNA, 22 nt, Human
aggcuggcgacaucuggcgggc

SEQ ID NO: 602748 - RNA, 22 nt, Human
ucucccuggagcccugaagcau

SEQ ID NO: 602749 - RNA, 22 nt, Human
ugucuuaugcugcauagacuau

SEQ ID NO: 602750 - RNA, 22 nt, Human
uacacuggccaaaugccuuugg

SEQ ID NO: 602751 - RNA, 22 nt, Human
ggcaggcaggagcgugcuuggg

SEQ ID NO: 602752 - RNA, 22 nt, Human
agccaggccagcugucuugagu

SEQ ID NO: 602753 - RNA, 22 nt, Human
uuggaaacgucaccuuuuccuu

SEQ ID NO: 602754 - RNA, 22 nt, Human
uagaaaugauugguugagcucu

SEQ ID NO: 602755 - RNA, 22 nt, Human
cccaggagauaacguucccaag

SEQ ID NO: 602756 - RNA, 22 nt, Human
ugcuucuguuuguuucugucau

SEQ ID NO: 602757 - RNA, 22 nt, Human
aacagcuugcugcaccuuaaua

SEQ ID NO: 602758 - RNA, 22 nt, Human
uggcagugaugcggcaggacau

SEQ ID NO: 602759 - RNA, 22 nt, Human
auugagaaauauaaucuggaaa

SEQ ID NO: 602760 - RNA, 22 nt, Human
cuggagggugagccucaucucu

SEQ ID NO: 602761 - RNA, 22 nt, Human
cuucuguuacuguuagcugaag

SEQ ID NO: 602762 - RNA, 22 nt, Human
uuaaacauuuuugaugaucgau

SEQ ID NO: 602763 - RNA, 22 nt, Human
acaugauuucagggaauucuca

SEQ ID NO: 602764 - RNA, 22 nt, Human
uaauuucaccguugcuagaaau

SEQ ID NO: 602765 - RNA, 20 nt, Human
uauauguguacauacacaca

SEQ ID NO: 602766 - RNA, 22 nt, Human
uugcaaaagcaauugcaguuuu

SEQ ID NO: 602767 - RNA, 21 nt, Human
gaugaagcaaucuuucuguug

SEQ ID NO: 602768 - RNA, 22 nt, Human
cucuuccuuucccuugagggug

SEQ ID NO: 602769 - RNA, 22 nt, Human
ccucugugcuuuguccagccuc

SEQ ID NO: 602770 - RNA, 22 nt, Human
ugagagugaaaugucacauguc

SEQ ID NO: 602771 - RNA, 22 nt, Human
aauauauagaaguacccguugu

SEQ ID NO: 602772 - RNA, 22 nt, Human
aacaugauuuaguauaaugcag

SEQ ID NO: 602773 - RNA, 22 nt, Human
gauggcagcauauugacagcau

SEQ ID NO: 602774 - RNA, 22 nt, Human
agcucugggucacggcugccga

SEQ ID NO: 602775 - RNA, 22 nt, Human
gagcuguguucaugaggagaaa

SEQ ID NO: 602776 - RNA, 22 nt, Human
cccugagcaacaaacugaauac

SEQ ID NO: 602777 - RNA, 22 nt, Human
uaguuaaagagauccacauucc

SEQ ID NO: 602778 - RNA, 23 nt, Human
ucugcagacgcuguucuauuguc

SEQ ID NO: 602779 - RNA, 22 nt, Human
aauucugaggagggaagaggaa

SEQ ID NO: 602780 - RNA, 22 nt, Human
guccccuggcccccagcgucgg

SEQ ID NO: 602781 - RNA, 22 nt, Human
agagcuguucaacguagcaaug

SEQ ID NO: 602782 - RNA, 22 nt, Human
gugcuacagacugaguacacuu

SEQ ID NO: 602783 - RNA, 22 nt, Human
uggaaaaucaggggacauugau

SEQ ID NO: 602784 - RNA, 22 nt, Human
ucaggaauuuuguucuguaucc

SEQ ID NO: 602785 - RNA, 22 nt, Human
uccaccagagccuucccaugcu

SEQ ID NO: 602786 - RNA, 22 nt, Human
ggaggaagugcaguucuacuac

SEQ ID NO: 602787 - RNA, 22 nt, Human
ugcuucucccaaccagggccug

SEQ ID NO: 602788 - RNA, 19 nt, Human
uguguguuuauauauguau

SEQ ID NO: 602789 - RNA, 18 nt, Human
uucaguuucuaguuccuu

SEQ ID NO: 602790 - RNA, 22 nt, Human
uuugugcaagacaugcuaagag

SEQ ID NO: 602791 - RNA, 17 nt, Human
acaggccugcuugcacu

SEQ ID NO: 602792 - RNA, 22 nt, Human
ggcacugcuguaggcagugagg

SEQ ID NO: 602793 - RNA, 22 nt, Human
ucaaagcuuagauaauuucuuu

SEQ ID NO: 602794 - RNA, 22 nt, Human
auuuuguggcagaugcagaacc

SEQ ID NO: 602795 - RNA, 22 nt, Human
gcacugggugugaggcagcguc

SEQ ID NO: 602796 - RNA, 22 nt, Human
ucagggccaucuuuugccucaa

SEQ ID NO: 602797 - RNA, 22 nt, Human
gcuggagagugaggggagcaag

SEQ ID NO: 602798 - RNA, 22 nt, Human
gugcugccugccagcuucuggg

SEQ ID NO: 602799 - RNA, 22 nt, Human
auacaugucaucauauguuugu

SEQ ID NO: 602800 - RNA, 22 nt, Human
cuggcugaggucaccaguagcu

SEQ ID NO: 602801 - RNA, 22 nt, Human
ggcugcaggaugcccagccgug

SEQ ID NO: 602802 - RNA, 22 nt, Human
uuuagagguuagaggcugauag

SEQ ID NO: 602803 - RNA, 22 nt, Human
cuggcagcuuagcacucugguu

SEQ ID NO: 602804 - RNA, 21 nt, Human
cagcucugagauuucuacuag

SEQ ID NO: 602805 - RNA, 22 nt, Human
uucuguucuuuauuuaccauau

SEQ ID NO: 602806 - RNA, 22 nt, Human
uguuaucacuuagacaugcuag

SEQ ID NO: 602807 - RNA, 22 nt, Human
gcucuggcucaaaccaccggcu

SEQ ID NO: 602808 - RNA, 18 nt, Human
accugccuguucuucucu

SEQ ID NO: 602809 - RNA, 22 nt, Human
cuguuuucaaagagagagaaug

SEQ ID NO: 602810 - RNA, 22 nt, Human
agcuaggaaauugaggcugaga

SEQ ID NO: 602811 - RNA, 22 nt, Human
cacaggggcaaacuguagggga

SEQ ID NO: 602812 - RNA, 22 nt, Human
uacuucugccuuagagaacacu

SEQ ID NO: 602813 - RNA, 22 nt, Human
aacacuguaacagcaucauuuu

SEQ ID NO: 602814 - RNA, 22 nt, Human
agcuugccucccccucuuagga

SEQ ID NO: 602815 - RNA, 22 nt, Human
aagccaguguuuuugagaguug

SEQ ID NO: 602816 - RNA, 22 nt, Human
acaaaugauuaucacagaggag

SEQ ID NO: 602817 - RNA, 22 nt, Human
uuagaaaugucacagaucugau

SEQ ID NO: 602818 - RNA, 22 nt, Human
cccaggagagaggccaguuggc

SEQ ID NO: 602819 - RNA, 22 nt, Human
uggguccacaaacaucagauau

SEQ ID NO: 602820 - RNA, 22 nt, Human
uggcagggucuugcuguguugc

SEQ ID NO: 602821 - RNA, 22 nt, Human
cagcagccacuagagggcucac

SEQ ID NO: 602822 - RNA, 22 nt, Human
guauuucaucuugaaaaccagu

SEQ ID NO: 602823 - RNA, 22 nt, Human
uaacaguugguguaauuucuug

SEQ ID NO: 602824 - RNA, 22 nt, Human
uggcagggagccaccggucaug

SEQ ID NO: 602825 - RNA, 22 nt, Human
agccaccaccacugaaagguua

SEQ ID NO: 602826 - RNA, 22 nt, Human
cagcagagaaauuaaacuucug

SEQ ID NO: 602827 - RNA, 22 nt, Human
ucuuuauuuaagucuguuguaa

SEQ ID NO: 602828 - RNA, 22 nt, Human
ugucauuuggacuuugguauua

SEQ ID NO: 602829 - RNA, 22 nt, Human
ccuuuaauuuacaauguuaauu

SEQ ID NO: 602830 - RNA, 23 nt, Human
agacugaggcugccagggucaga

SEQ ID NO: 602831 - RNA, 21 nt, Human
gggugggaggacacagcaggc

SEQ ID NO: 602832 - RNA, 22 nt, Human
uaagagcuguucagguacccau

SEQ ID NO: 602833 - RNA, 22 nt, Human
gagggcugugaaggagcggguu

SEQ ID NO: 602834 - RNA, 23 nt, Human
ccugcucaggcgugugcccugcu

SEQ ID NO: 602835 - RNA, 22 nt, Human
cuggccagcauggcugaaguac

SEQ ID NO: 602836 - RNA, 22 nt, Human
ucgauaauaucuuacaugugcu

SEQ ID NO: 602837 - RNA, 22 nt, Human
gaacaaacagaagaggcggaac

SEQ ID NO: 602838 - RNA, 22 nt, Human
ggcucagcacagggcuggcauc

SEQ ID NO: 602839 - RNA, 22 nt, Human
ggccgugcuccaaagucaucgu

SEQ ID NO: 602840 - RNA, 22 nt, Human
aaggcagcagugcacgacugau

SEQ ID NO: 602841 - RNA, 22 nt, Human
cccagcccacgguccugggugg

SEQ ID NO: 602842 - RNA, 22 nt, Human
uggcauccucucuucugagugc

SEQ ID NO: 602843 - RNA, 22 nt, Human
ccaguggccaugcacgagcagc

SEQ ID NO: 602844 - RNA, 22 nt, Human
ugccagaguuacaugaggguca

SEQ ID NO: 602845 - RNA, 22 nt, Human
cagccugagccuucuguagcaa

SEQ ID NO: 602846 - RNA, 22 nt, Human
ugaaagaaggguggaaaaugua

SEQ ID NO: 602847 - RNA, 22 nt, Human
gcagggacaacugugcaccuga

SEQ ID NO: 602848 - RNA, 23 nt, Human
gguuggcuguacccaggcucccu

SEQ ID NO: 602849 - RNA, 22 nt, Human
gacagugcauuuccuggcaugg

SEQ ID NO: 602850 - RNA, 22 nt, Human
cagcagaaaaugugggugauuu

SEQ ID NO: 602851 - RNA, 22 nt, Human
uccauuuuguagguaugcuaca

SEQ ID NO: 602852 - RNA, 22 nt, Human
uuaccauuuuauaaguuaaagu

SEQ ID NO: 602853 - RNA, 22 nt, Human
ugaggcuaaaggugaccagauu

SEQ ID NO: 602854 - RNA, 22 nt, Human
ccagccaguccagcauuggugu

SEQ ID NO: 602855 - RNA, 22 nt, Human
cucagagccaguuagcaggugc

SEQ ID NO: 602856 - RNA, 22 nt, Human
ccaguccuagaagaggagucga

SEQ ID NO: 602857 - RNA, 22 nt, Human
aucauugaauauaagugcuauu

SEQ ID NO: 602858 - RNA, 22 nt, Human
ggagacagugacuuagagacug

SEQ ID NO: 602859 - RNA, 22 nt, Human
ggcucucugaggaaacccuucc

SEQ ID NO: 602860 - RNA, 22 nt, Human
gccagaagggguggauccaggc

SEQ ID NO: 602861 - RNA, 23 nt, Human
ugccucugccucccuagucugca

SEQ ID NO: 602862 - RNA, 22 nt, Human
auucagcaguuccugcuucagu

SEQ ID NO: 602863 - RNA, 22 nt, Human
ucauaaaaauagacucuaaagu

SEQ ID NO: 602864 - RNA, 22 nt, Human
cucaguuugagggguagguguu

SEQ ID NO: 602865 - RNA, 22 nt, Human
uggcagagucucuccuuuccag

SEQ ID NO: 602866 - RNA, 22 nt, Human
ugauggucaggaugcauggaga

SEQ ID NO: 602867 - RNA, 22 nt, Human
uguggguccuccugugugcccg

SEQ ID NO: 602868 - RNA, 22 nt, Human
guaggugagugggagaagaggc

SEQ ID NO: 602869 - RNA, 20 nt, Human
ucucuucuggggagauaaaa

SEQ ID NO: 602870 - RNA, 22 nt, Human
gagcugaguguccuaggcaugg

SEQ ID NO: 602871 - RNA, 22 nt, Human
ucugaagagucaucuuugggug

SEQ ID NO: 602872 - RNA, 22 nt, Human
aaugacagagauagaagggaug

SEQ ID NO: 602873 - RNA, 22 nt, Human
uccugguggugccagcugcagg

SEQ ID NO: 602874 - RNA, 22 nt, Human
uuccagaggcuucagggaagaa

SEQ ID NO: 602875 - RNA, 22 nt, Human
uagcuccuggugagccuacucu

SEQ ID NO: 602876 - RNA, 22 nt, Human
cugcugggggacacagguccgg

SEQ ID NO: 602877 - RNA, 22 nt, Human
acccagcuggaugcauggaggc

SEQ ID NO: 602878 - RNA, 22 nt, Human
cuggugcaaaaguaauuguggu

SEQ ID NO: 602879 - RNA, 22 nt, Human
agcugaagaccucaaguaagag

SEQ ID NO: 602880 - RNA, 22 nt, Human
uucaucuugauggcuuccuaau

SEQ ID NO: 602881 - RNA, 22 nt, Human
gggagcugagcuggaagagaau

SEQ ID NO: 602882 - RNA, 22 nt, Human
auguuuucuagaguuuaaaauc

SEQ ID NO: 602883 - RNA, 22 nt, Human
cuccagagacacuucucaugau

SEQ ID NO: 602884 - RNA, 22 nt, Human
aucaucuggguuaaugugcuca

SEQ ID NO: 602885 - RNA, 22 nt, Human
ccugccaggcuuugggcuucug

SEQ ID NO: 602886 - RNA, 22 nt, Human
uuuacauugcauuagguauuau

SEQ ID NO: 602887 - RNA, 22 nt, Human
cacugcaguuccccagugcgca

SEQ ID NO: 602888 - RNA, 22 nt, Human
caaauggcaacaagaacacugg

SEQ ID NO: 602889 - RNA, 22 nt, Human
ugagccagauaagggcucacgc

SEQ ID NO: 602890 - RNA, 21 nt, Human
uuccuggggacuuccguggga

SEQ ID NO: 602891 - RNA, 22 nt, Human
aguccuuacucgggggcccaga

SEQ ID NO: 602892 - RNA, 22 nt, Human
gcuccuccaauauggacuccuc

SEQ ID NO: 602893 - RNA, 22 nt, Human
ugcuggaguaacaagacacuca

SEQ ID NO: 602894 - RNA, 22 nt, Human
gcagugaacauaacacagaagg

SEQ ID NO: 602895 - RNA, 22 nt, Human
uugcagucacacucuaaaguag

SEQ ID NO: 602896 - RNA, 22 nt, Human
aagccuuaaauguuucuaauau

SEQ ID NO: 602897 - RNA, 22 nt, Human
ucuuggcugcugccaauuuacu

SEQ ID NO: 602898 - RNA, 22 nt, Human
ugcauguggaccccuggugccu

SEQ ID NO: 602899 - RNA, 22 nt, Human
caagggugaaggcagaggacau

SEQ ID NO: 602900 - RNA, 22 nt, Human
ugcuuccuauccacacaaugcc

SEQ ID NO: 602901 - RNA, 22 nt, Human
aguaguggggccaggguuugaa

SEQ ID NO: 602902 - RNA, 22 nt, Human
uauuuguauguguguacauaua

SEQ ID NO: 602903 - RNA, 22 nt, Human
acagggcaugugcaagagacau

SEQ ID NO: 602904 - RNA, 22 nt, Human
uaguguucuaagaacauccaug

SEQ ID NO: 602905 - RNA, 22 nt, Human
gggcucaggccuggccucucac

SEQ ID NO: 602906 - RNA, 22 nt, Human
caagggcugcuaucagcuacug

SEQ ID NO: 602907 - RNA, 22 nt, Human
uacauacaagauguguuuaaaa

SEQ ID NO: 602908 - RNA, 22 nt, Human
aagaaaguggguaauaugauuu

SEQ ID NO: 602909 - RNA, 22 nt, Human
cauuuauuggcauguaguaggu

SEQ ID NO: 602910 - RNA, 22 nt, Human
ccauuuuucacaagacucacuu

SEQ ID NO: 602911 - RNA, 22 nt, Human
gcacugggagucuguggggguu

SEQ ID NO: 602912 - RNA, 22 nt, Human
augaaggauagggcaaaauuuu

SEQ ID NO: 602913 - RNA, 22 nt, Human
ucuguuaugcauaagcaucagu

SEQ ID NO: 602914 - RNA, 22 nt, Human
acauagcauaaagaaugacucu

SEQ ID NO: 602915 - RNA, 22 nt, Human
aucugucuuccaccacacaucc

SEQ ID NO: 602916 - RNA, 22 nt, Human
aucuggcucacuuagucuagga

SEQ ID NO: 602917 - RNA, 22 nt, Human
ugccugggacaugcuguggacu

SEQ ID NO: 602918 - RNA, 22 nt, Human
gggagggucugagagcugcacc

SEQ ID NO: 602919 - RNA, 22 nt, Human
auauucuuccaaaacaucauuu

SEQ ID NO: 602920 - RNA, 22 nt, Human
cuuuccaacucuagugaaauuu

SEQ ID NO: 602921 - RNA, 22 nt, Human
agcagcccaguuguacugagug

SEQ ID NO: 602922 - RNA, 22 nt, Human
ccaagggcugcugaggugucca

SEQ ID NO: 602923 - RNA, 22 nt, Human
ccuugguccaacccugcacagc

SEQ ID NO: 602924 - RNA, 20 nt, Human
uccagggcccuggcuccucu

SEQ ID NO: 602925 - RNA, 22 nt, Human
ucucugugagaugccuuccuga

SEQ ID NO: 602926 - RNA, 22 nt, Human
uuuuuguggugcagacuaaagc

SEQ ID NO: 602927 - RNA, 23 nt, Human
uuuuccuguggagacaugacugg

SEQ ID NO: 602928 - RNA, 22 nt, Human
agauucgaaaccuuuaggucuu

SEQ ID NO: 602929 - RNA, 22 nt, Human
ugccaggccucaggagucucca

SEQ ID NO: 602930 - RNA, 22 nt, Human
uuacaaagaaaauuaggcauuu

SEQ ID NO: 602931 - RNA, 20 nt, Human
cccagggguuguggugagga

SEQ ID NO: 602932 - RNA, 22 nt, Human
cugucagcuucuccuggccaga

SEQ ID NO: 602933 - RNA, 22 nt, Human
cacauguuuuuggccaucaugg

SEQ ID NO: 602934 - RNA, 22 nt, Human
guuuguaaccagaacagagagu

SEQ ID NO: 602935 - RNA, 22 nt, Human
uuuaagaugguauuuuauaaag

SEQ ID NO: 602936 - RNA, 22 nt, Human
uauuuaagaugugucauaaaga

SEQ ID NO: 602937 - RNA, 22 nt, Human
gugggccacugggaggcaaggg

SEQ ID NO: 602938 - RNA, 23 nt, Human
auuuaaugcugaguugaauguua

SEQ ID NO: 602939 - RNA, 22 nt, Human
cugggaagauggugacagaauu

SEQ ID NO: 602940 - RNA, 22 nt, Human
agacuguagggauagaggucuu

SEQ ID NO: 602941 - RNA, 22 nt, Human
ucaggacacuuggcacaagguc

SEQ ID NO: 602942 - RNA, 22 nt, Human
aaucuucauuuugacaagauuc

SEQ ID NO: 602943 - RNA, 22 nt, Human
agaggaaucugucuagacacaa

SEQ ID NO: 602944 - RNA, 22 nt, Human
aaagagacaccaaagacucuag

SEQ ID NO: 602945 - RNA, 22 nt, Human
ccauggccucgcucuacguggg

SEQ ID NO: 602946 - RNA, 21 nt, Human
ugcagcugacacugguaugcc

SEQ ID NO: 602947 - RNA, 22 nt, Human
gcuugggauaugcugauguaaa

SEQ ID NO: 602948 - RNA, 22 nt, Human
gcaugaaaugagcgaauauaau

SEQ ID NO: 602949 - RNA, 21 nt, Human
aguguguucuuggcauuaccu

SEQ ID NO: 602950 - RNA, 21 nt, Human
gaacauuuggguuguuucuac

SEQ ID NO: 602951 - RNA, 22 nt, Human
caggcuugagggcaggcccagu

SEQ ID NO: 602952 - RNA, 22 nt, Human
gucuucuguucugugaggcuuc

SEQ ID NO: 602953 - RNA, 22 nt, Human
augcacaagaggcuagaaaaga

SEQ ID NO: 602954 - RNA, 22 nt, Human
agcagguguagggcucuuugua

SEQ ID NO: 602955 - RNA, 22 nt, Human
uuaaauagcucuuguagaagaa

SEQ ID NO: 602956 - RNA, 22 nt, Human
aagacauugucauuuuauaauu

SEQ ID NO: 602957 - RNA, 22 nt, Human
acagcaguuuagaggacagcca

SEQ ID NO: 602958 - RNA, 22 nt, Human
ggugaccucaccuggucccacc

SEQ ID NO: 602959 - RNA, 22 nt, Human
agggcccaugugggagcacuug

SEQ ID NO: 602960 - RNA, 22 nt, Human
uacaggguauucaaggguaguu

SEQ ID NO: 602961 - RNA, 22 nt, Human
agauacauagcugugagcacac

SEQ ID NO: 602962 - RNA, 22 nt, Human
ggcuucuccagguacugagcau

SEQ ID NO: 602963 - RNA, 22 nt, Human
caucucaucagugagagucagc

SEQ ID NO: 602964 - RNA, 22 nt, Human
gcuuuaaauggcuugcccaagu

SEQ ID NO: 602965 - RNA, 22 nt, Human
ucaugucucuaugugccuauua

SEQ ID NO: 602966 - RNA, 22 nt, Human
uuuagacaucuauaauugcuaa

SEQ ID NO: 602967 - RNA, 22 nt, Human
gggcagcuagcccucuagccca

SEQ ID NO: 602968 - RNA, 22 nt, Human
agcaggguccugaggugaguca

SEQ ID NO: 602969 - RNA, 22 nt, Human
uauuaugagguauuuggacuuu

SEQ ID NO: 602970 - RNA, 20 nt, Human
uuugcuaugcauaucugacc

SEQ ID NO: 602971 - RNA, 22 nt, Human
gcagauggacuguaugaccuga

SEQ ID NO: 602972 - RNA, 22 nt, Human
acacauguauguuuuguauuug

SEQ ID NO: 602973 - RNA, 22 nt, Human
acaggcagagaacucagccaga

SEQ ID NO: 602974 - RNA, 22 nt, Human
acccccaaacaugaucauggug

SEQ ID NO: 602975 - RNA, 22 nt, Human
ugagccagucucucagaacccu

SEQ ID NO: 602976 - RNA, 22 nt, Human
gcauuuuaaugagguuuaugag

SEQ ID NO: 602977 - RNA, 22 nt, Human
aaauaugaaugauaagaguuau

SEQ ID NO: 602978 - RNA, 22 nt, Human
ugaauaaucuuggguauuaaua

SEQ ID NO: 602979 - RNA, 22 nt, Human
ucuggaguggacccagagcacu

SEQ ID NO: 602980 - RNA, 22 nt, Human
cagucccacuagugccaauacc

SEQ ID NO: 602981 - RNA, 17 nt, Human
uccuucagggccucaca

SEQ ID NO: 602982 - RNA, 20 nt, Human
uaguauuugcauaaggauag

SEQ ID NO: 602983 - RNA, 22 nt, Human
uucacauugugcagauuauggu

SEQ ID NO: 602984 - RNA, 22 nt, Human
ugaagccagucaauguuaaguu

SEQ ID NO: 602985 - RNA, 22 nt, Human
auguaguuagaagauucaaaca

SEQ ID NO: 602986 - RNA, 22 nt, Human
cugcugccauuagggcacagac

SEQ ID NO: 602987 - RNA, 18 nt, Human
gcccugguggagcuggug

SEQ ID NO: 602988 - RNA, 22 nt, Human
uuccucagccaaggcugggauc

SEQ ID NO: 602989 - RNA, 22 nt, Human
uacuuuacaguauuagauaauu

SEQ ID NO: 602990 - RNA, 22 nt, Human
cugggccugggaggccaggucu

SEQ ID NO: 602991 - RNA, 22 nt, Human
ccacuuuguaauguguuauguu

SEQ ID NO: 602992 - RNA, 22 nt, Human
gagcuggucaguuucagggcca

SEQ ID NO: 602993 - RNA, 22 nt, Human
ucuuccucuucugcugagaagu

SEQ ID NO: 602994 - RNA, 22 nt, Human
acuuccuuuugggaaacuguuu

SEQ ID NO: 602995 - RNA, 20 nt, Human
agcuucagcccuaggauugc

SEQ ID NO: 602996 - RNA, 22 nt, Human
acucuuauaguauugguuauua

SEQ ID NO: 602997 - RNA, 22 nt, Human
uuuucuuauggugaagcacaaa

SEQ ID NO: 602998 - RNA, 22 nt, Human
uguguccuucugggagucccag

SEQ ID NO: 602999 - RNA, 22 nt, Human
acaguguauaaaaucuuaaaga

SEQ ID NO: 603000 - RNA, 21 nt, Human
aaaaguuugacaggaaaggga

SEQ ID NO: 603001 - RNA, 22 nt, Human
ucaggcaguagaauugcuugaa

SEQ ID NO: 603002 - RNA, 22 nt, Human
gcuggcuuuaucgucagacucc

SEQ ID NO: 603003 - RNA, 22 nt, Human
aggccuggccuuuauguucaag

SEQ ID NO: 603004 - RNA, 22 nt, Human
gcagcaagucuaguuuguaggc

SEQ ID NO: 603005 - RNA, 22 nt, Human
caucagagguacuuaaugaaug

SEQ ID NO: 603006 - RNA, 22 nt, Human
gaagggcuuggcugggaggcca

SEQ ID NO: 603007 - RNA, 22 nt, Human
cccuugaaggcagggaguccug

SEQ ID NO: 603008 - RNA, 22 nt, Human
caggugacccucucaccugcuu

SEQ ID NO: 603009 - RNA, 22 nt, Human
ucuuagguguaugucauuaggg

SEQ ID NO: 603010 - RNA, 22 nt, Human
cgcagaagagguugucuagucc

SEQ ID NO: 603011 - RNA, 22 nt, Human
ggagauggccacgucacucagu

SEQ ID NO: 603012 - RNA, 22 nt, Human
uuccuuucacguuuuaaugcac

SEQ ID NO: 603013 - RNA, 22 nt, Human
ucccugcagacguccugcgggu

SEQ ID NO: 603014 - RNA, 19 nt, Human
uuccugggguuccauugug

SEQ ID NO: 603015 - RNA, 22 nt, Human
cacaggcuuuucugacauaggc

SEQ ID NO: 603016 - RNA, 22 nt, Human
ccaucacaguccccaucgugau

SEQ ID NO: 603017 - RNA, 22 nt, Human
guacuuuaaaucaauguagauu

SEQ ID NO: 603018 - RNA, 22 nt, Human
aacaugauuggaaaaugcuguc

SEQ ID NO: 603019 - RNA, 22 nt, Human
ucuuucuugugggugcccuuuu

SEQ ID NO: 603020 - RNA, 22 nt, Human
uuacagaaguuucagcguuuua

SEQ ID NO: 603021 - RNA, 22 nt, Human
aacaagaauaagugguuucugg

SEQ ID NO: 603022 - RNA, 22 nt, Human
ucucaugaugccuaugcagggu

SEQ ID NO: 603023 - RNA, 22 nt, Human
gcuggcuuugaucuucccaucu

SEQ ID NO: 603024 - RNA, 22 nt, Human
ugaaagcaaccuguaacaguga

SEQ ID NO: 603025 - RNA, 22 nt, Human
gggugguggcggaggcuccagg

SEQ ID NO: 603026 - RNA, 22 nt, Human
cagaggucugacacugaauggu

SEQ ID NO: 603027 - RNA, 20 nt, Human
ucucccugcccaucucagau

SEQ ID NO: 603028 - RNA, 21 nt, Human
agacacugguuuagcauucau

SEQ ID NO: 603029 - RNA, 19 nt, Human
aauaauguucaugagauug

SEQ ID NO: 603030 - RNA, 18 nt, Human
ccagaggcccgggcaggc

SEQ ID NO: 603031 - RNA, 18 nt, Human
cuuaaacuguccccagua

SEQ ID NO: 603032 - RNA, 22 nt, Human
gcagguggaagcagcagacuca

SEQ ID NO: 603033 - RNA, 22 nt, Human
ugcaggagcccaggaauacuau

SEQ ID NO: 603034 - RNA, 22 nt, Human
uggcccugaaucaaggccagca

SEQ ID NO: 603035 - RNA, 22 nt, Human
agaggggaaggaugugauguga

SEQ ID NO: 603036 - RNA, 22 nt, Human
aacaaacaguuaaguguggaug

SEQ ID NO: 603037 - RNA, 22 nt, Human
gcugggaggaucucucccuguc

SEQ ID NO: 603038 - RNA, 22 nt, Human
aagcuuuguccaaggccaugca

SEQ ID NO: 603039 - RNA, 22 nt, Human
auguuaaauaaucccuuaaagc

SEQ ID NO: 603040 - RNA, 20 nt, Human
cuggccagaacgccuacaca

SEQ ID NO: 603041 - RNA, 21 nt, Human
gggcaggucucugaugucaac

SEQ ID NO: 603042 - RNA, 22 nt, Human
gcacaggcucucuuggggacac

SEQ ID NO: 603043 - RNA, 22 nt, Human
uccuccugccuuugcuucuugu

SEQ ID NO: 603044 - RNA, 22 nt, Human
cagcccacgucagggccacuca

SEQ ID NO: 603045 - RNA, 22 nt, Human
ugugcuuuucucugcuccugga

SEQ ID NO: 603046 - RNA, 22 nt, Human
guggcagagugcgguucugacc

SEQ ID NO: 603047 - RNA, 23 nt, Human
acagacauuccauaauguacacc

SEQ ID NO: 603048 - RNA, 22 nt, Human
auuuacagccuugaaaacagca

SEQ ID NO: 603049 - RNA, 22 nt, Human
acagggugaaugugacauuauc

SEQ ID NO: 603050 - RNA, 22 nt, Human
cucccuggcagccgcacuccug

SEQ ID NO: 603051 - RNA, 22 nt, Human
cuaaagauaaggaaaguauccu

SEQ ID NO: 603052 - RNA, 22 nt, Human
gcugggcucuuaucaccuguac

SEQ ID NO: 603053 - RNA, 21 nt, Human
agccuggguauccuuugagga

SEQ ID NO: 603054 - RNA, 22 nt, Human
uguuacacagcagaauagcaag

SEQ ID NO: 603055 - RNA, 23 nt, Human
uguguucagucaaggaucagagu

SEQ ID NO: 603056 - RNA, 22 nt, Human
uguuugcuauauccuacuucau

SEQ ID NO: 603057 - RNA, 22 nt, Human
uccaggggagacuagacccaca

SEQ ID NO: 603058 - RNA, 18 nt, Human
gccagagggaagcaggug

SEQ ID NO: 603059 - RNA, 22 nt, Human
ucaaugcaaccuccaccucccg

SEQ ID NO: 603060 - RNA, 22 nt, Human
agguauuuuauagauaaguaaa

SEQ ID NO: 603061 - RNA, 22 nt, Human
ggagccuggcaaugcugcgucc

SEQ ID NO: 603062 - RNA, 22 nt, Human
acacagaagaucucuuaaugcu

SEQ ID NO: 603063 - RNA, 22 nt, Human
uguuacaaaugcggaguuugug

SEQ ID NO: 603064 - RNA, 22 nt, Human
aaaguguugggauuacaggcau

SEQ ID NO: 603065 - RNA, 22 nt, Human
uccaggcucagucaagcacuuc

SEQ ID NO: 603066 - RNA, 22 nt, Human
acaggauuucaccauguuggcc

SEQ ID NO: 603067 - RNA, 17 nt, Human
caagagagaugacugga

SEQ ID NO: 603068 - RNA, 22 nt, Human
accugcaguggccacuccuaau

SEQ ID NO: 603069 - RNA, 22 nt, Human
acugugugaaacaucaaugugu

SEQ ID NO: 603070 - RNA, 22 nt, Human
acacagaggaaagugugaaggg

SEQ ID NO: 603071 - RNA, 22 nt, Human
aagguccuguagccacagagcc

SEQ ID NO: 603072 - RNA, 22 nt, Human
acaaagauguuuaaagcauuua

SEQ ID NO: 603073 - RNA, 22 nt, Human
uuugcauuaguuuagauuucaa

SEQ ID NO: 603074 - RNA, 22 nt, Human
uuuaagagccuguacaaauauu

SEQ ID NO: 603075 - RNA, 22 nt, Human
ucacaguaucacacaaggauua

SEQ ID NO: 603076 - RNA, 22 nt, Human
ggcagccaugcacgcugccugg

SEQ ID NO: 603077 - RNA, 22 nt, Human
ugcuggcuguguaccaucucaa

SEQ ID NO: 603078 - RNA, 22 nt, Human
gcacugggggcagcagugaggg

SEQ ID NO: 603079 - RNA, 20 nt, Human
cucagaaaagcuaaggagaa

SEQ ID NO: 603080 - RNA, 22 nt, Human
ccaugcugugacacaguaguua

SEQ ID NO: 603081 - RNA, 22 nt, Human
ggcacugggcaccggcugaggg

SEQ ID NO: 603082 - RNA, 22 nt, Human
aacaaaguguacuuccauacug

SEQ ID NO: 603083 - RNA, 19 nt, Human
uccucaggggcucacagac

SEQ ID NO: 603084 - RNA, 22 nt, Human
gcccuguguauccccugugcuu

SEQ ID NO: 603085 - RNA, 20 nt, Human
aaaggaauauaugaaguaua

SEQ ID NO: 603086 - RNA, 22 nt, Human
acaguccuagcugcaaagaagu

SEQ ID NO: 603087 - RNA, 22 nt, Human
caggccacaaguuggguucaag

SEQ ID NO: 603088 - RNA, 22 nt, Human
agugaaauaugcccauugcugu

SEQ ID NO: 603089 - RNA, 22 nt, Human
ucacacauacucaugugugagu

SEQ ID NO: 603090 - RNA, 22 nt, Human
ugguggcacaagggagagaauc

SEQ ID NO: 603091 - RNA, 22 nt, Human
cucuggggaagcagccagcugg

SEQ ID NO: 603092 - RNA, 21 nt, Human
uucuuucugaaucugaaguau

SEQ ID NO: 603093 - RNA, 22 nt, Human
gccagacacuccccugggcagg

SEQ ID NO: 603094 - RNA, 22 nt, Human
uaauagaauaguggaaacauug

SEQ ID NO: 603095 - RNA, 22 nt, Human
uggcaauuguccacugucugcc

SEQ ID NO: 603096 - RNA, 22 nt, Human
ugggguggauagaaagugaugu

SEQ ID NO: 603097 - RNA, 22 nt, Human
auucuccuuauucugaaaaaag

SEQ ID NO: 603098 - RNA, 20 nt, Human
ucaauuucagguagcauagu

SEQ ID NO: 603099 - RNA, 21 nt, Human
ugcagcagaguaagcagggga

SEQ ID NO: 603100 - RNA, 17 nt, Human
aguuuugauauaauggc

SEQ ID NO: 603101 - RNA, 22 nt, Human
acaguuuauaaaaauaaugagg

SEQ ID NO: 603102 - RNA, 22 nt, Human
agccacaaaggcuugccucgga

SEQ ID NO: 603103 - RNA, 22 nt, Human
ucucagggcucagagcucaggc

SEQ ID NO: 603104 - RNA, 22 nt, Human
aggaggccgcugaugggcuccc

SEQ ID NO: 603105 - RNA, 22 nt, Human
agugggguccucaguaugguuc

SEQ ID NO: 603106 - RNA, 22 nt, Human
gcacagggcaacaggucuguua

SEQ ID NO: 603107 - RNA, 22 nt, Human
ugcaaguaauuccagcuacuga

SEQ ID NO: 603108 - RNA, 22 nt, Human
uagucacaugaucacaggaucg

SEQ ID NO: 603109 - RNA, 23 nt, Human
auuugaaacuuucuuguuuccag

SEQ ID NO: 603110 - RNA, 22 nt, Human
cuccucugucuaccacgagggu

SEQ ID NO: 603111 - RNA, 22 nt, Human
guguuuguucgugacuccaaag

SEQ ID NO: 603112 - RNA, 22 nt, Human
cuaaaauuaucaagauaauucc

SEQ ID NO: 603113 - RNA, 22 nt, Human
cugcucuagguuccugcauaug

SEQ ID NO: 603114 - RNA, 22 nt, Human
aaagguuuuguucaucgauuuu

SEQ ID NO: 603115 - RNA, 22 nt, Human
aaagucaaugauuucuccugga

SEQ ID NO: 603116 - RNA, 22 nt, Human
gagcccugacacugagggaguu

SEQ ID NO: 603117 - RNA, 22 nt, Human
caugcagaugucaugaggcaug

SEQ ID NO: 603118 - RNA, 22 nt, Human
uaucaacauuaauauuuucugg

SEQ ID NO: 603119 - RNA, 22 nt, Human
agugcaaagcagccuguacacc

SEQ ID NO: 603120 - RNA, 22 nt, Human
uaucucuugucuguuuugcaaa

SEQ ID NO: 603121 - RNA, 22 nt, Human
cuccagggagcuuggaaagacc

SEQ ID NO: 603122 - RNA, 22 nt, Human
acuucauucauuuucacgaaug

SEQ ID NO: 603123 - RNA, 22 nt, Human
aaacuugaacccagcucaggcu

SEQ ID NO: 603124 - RNA, 22 nt, Human
gcccugugcgacucuagagguu

SEQ ID NO: 603125 - RNA, 22 nt, Human
ugcugaggcccaggagcacuuu

SEQ ID NO: 603126 - RNA, 22 nt, Human
cuuccugcauggagucugaaug

SEQ ID NO: 603127 - RNA, 22 nt, Human
agcugcagcccuccugcauggc

SEQ ID NO: 603128 - RNA, 22 nt, Human
aaucaaaaccuacagagguaau

SEQ ID NO: 603129 - RNA, 22 nt, Human
ccugcagaggucaggccagaaa

SEQ ID NO: 603130 - RNA, 22 nt, Human
ggcucauguaugaaagggugug

SEQ ID NO: 603131 - RNA, 22 nt, Human
aguauuugaucagaugauagua

SEQ ID NO: 603132 - RNA, 22 nt, Human
aaagacacaaauguagaccaaa

SEQ ID NO: 603133 - RNA, 22 nt, Human
uacauuaaggauauggacauga

SEQ ID NO: 603134 - RNA, 22 nt, Human
auucuuacaaaugaaacugcaa

SEQ ID NO: 603135 - RNA, 22 nt, Human
guuuaauucccacaccugcccu

SEQ ID NO: 603136 - RNA, 22 nt, Human
aauuuacaguugcugaugguac

SEQ ID NO: 603137 - RNA, 22 nt, Human
cagucauuuuauuugaaaauua

SEQ ID NO: 603138 - RNA, 22 nt, Human
acccucccauuuccauguagca

SEQ ID NO: 603139 - RNA, 22 nt, Human
cagcuaggaaaccagagggcag

SEQ ID NO: 603140 - RNA, 22 nt, Human
aaaacagacagccaguguagag

SEQ ID NO: 603141 - RNA, 22 nt, Human
agggcccuuacgcaggcccuuc

SEQ ID NO: 603142 - RNA, 22 nt, Human
uuauuauuuuguguacagcaaa

SEQ ID NO: 603143 - RNA, 19 nt, Human
uaacaggggaaaaugauca

SEQ ID NO: 603144 - RNA, 19 nt, Human
cugcucuccuugacuugga

SEQ ID NO: 603145 - RNA, 23 nt, Human
ugcagcugccucuggcgggccgg

SEQ ID NO: 603146 - RNA, 22 nt, Human
auguguuugguuauaugguauu

SEQ ID NO: 603147 - RNA, 22 nt, Human
caaaaguaauugugguuuuugc

SEQ ID NO: 603148 - RNA, 22 nt, Human
uuuuuuccuucaugacuuaaga

SEQ ID NO: 603149 - RNA, 22 nt, Human
cugcugagcccuggcacaggug

SEQ ID NO: 603150 - RNA, 22 nt, Human
gauggucuuugucucugauaag

SEQ ID NO: 603151 - RNA, 22 nt, Human
augcuaaauccagaagcaguca

SEQ ID NO: 603152 - RNA, 21 nt, Human
aggcagcaucugauuuauaug

SEQ ID NO: 603153 - RNA, 22 nt, Human
gcaguggcaccgcuggcucugg

SEQ ID NO: 603154 - RNA, 22 nt, Human
cacaguuuuaucuuauacugau

SEQ ID NO: 603155 - RNA, 22 nt, Human
uuucaugauuaacuuagugaau

SEQ ID NO: 603156 - RNA, 22 nt, Human
aaaauagauaaugccaggguca

SEQ ID NO: 603157 - RNA, 22 nt, Human
aggaugugagccagccuggccu

SEQ ID NO: 603158 - RNA, 22 nt, Human
gccuggcaggggccugggagug

SEQ ID NO: 603159 - RNA, 22 nt, Human
caggggcuguggcacauggugu

SEQ ID NO: 603160 - RNA, 22 nt, Human
cugcuuuaaucccugccuggaa

SEQ ID NO: 603161 - RNA, 22 nt, Human
agagccugcaucuagccucaga

SEQ ID NO: 603162 - RNA, 22 nt, Human
aauaucaacaguguccuucuaa

SEQ ID NO: 603163 - RNA, 23 nt, Human
acauuucaauacugagggucuga

SEQ ID NO: 603164 - RNA, 22 nt, Human
ccaggccauucccagaguugcu

SEQ ID NO: 603165 - RNA, 22 nt, Human
uuucucucuggcccugauuguc

SEQ ID NO: 603166 - RNA, 22 nt, Human
acucauuuaaacauuuacugaa

SEQ ID NO: 603167 - RNA, 22 nt, Human
ugggaugaauacaaugggauca

SEQ ID NO: 603168 - RNA, 22 nt, Human
aggcuaagauguggucugagca

SEQ ID NO: 603169 - RNA, 20 nt, Human
cccagccccuaccuguugcc

SEQ ID NO: 603170 - RNA, 22 nt, Human
agguguggcuugaagucucuau

SEQ ID NO: 603171 - RNA, 22 nt, Human
uacauguaauuuucauaguaag

SEQ ID NO: 603172 - RNA, 22 nt, Human
uuccuucuauucagcuccaaga

SEQ ID NO: 603173 - RNA, 22 nt, Human
agaguuaaauaagcauuaacuu

SEQ ID NO: 603174 - RNA, 23 nt, Human
ugcugggcagagcuggugcugag

SEQ ID NO: 603175 - RNA, 22 nt, Human
aaguggagagcccuggaggucu

SEQ ID NO: 603176 - RNA, 22 nt, Human
caaaucuauauguugauauucu

SEQ ID NO: 603177 - RNA, 22 nt, Human
ccuucagccuagaacuugagag

SEQ ID NO: 603178 - RNA, 22 nt, Human
ugugugugacucauacuagaac

SEQ ID NO: 603179 - RNA, 22 nt, Human
ugugaauguauaguuuguauau

SEQ ID NO: 603180 - RNA, 21 nt, Human
ugugucacuaacuagaggcua

SEQ ID NO: 603181 - RNA, 19 nt, Human
ccaggccuccugggagguc

SEQ ID NO: 603182 - RNA, 22 nt, Human
uccaguggcaggcggugagguc

SEQ ID NO: 603183 - RNA, 22 nt, Human
acacauauauuugcauauacac

SEQ ID NO: 603184 - RNA, 22 nt, Human
aacaguaaaaaucauuuaguug

SEQ ID NO: 603185 - RNA, 22 nt, Human
acugugcuuucucuggaggcau

SEQ ID NO: 603186 - RNA, 22 nt, Human
ucaaugcacacaggacuuggug

SEQ ID NO: 603187 - RNA, 22 nt, Human
ugucuuuagcccauauagacuu

SEQ ID NO: 603188 - RNA, 22 nt, Human
aggaaacuaacuuaucuuuaua

SEQ ID NO: 603189 - RNA, 20 nt, Human
gaaaggagugucccugugag

SEQ ID NO: 603190 - RNA, 22 nt, Human
ggggaaacugaggcacagacag

SEQ ID NO: 603191 - RNA, 22 nt, Human
aaggagggaaagcagugcuucu

SEQ ID NO: 603192 - RNA, 22 nt, Human
agauccaguuaauagcuucauu

SEQ ID NO: 603193 - RNA, 22 nt, Human
uuucuccugugaggucagaagu

SEQ ID NO: 603194 - RNA, 21 nt, Human
ucauggauuuucucugcuuuu

SEQ ID NO: 603195 - RNA, 22 nt, Human
uacauggguagguuaagucaua

SEQ ID NO: 603196 - RNA, 22 nt, Human
ugaaauguacaagugcuuuuuu

SEQ ID NO: 603197 - RNA, 22 nt, Human
ucugaggccccagcccugcaca

SEQ ID NO: 603198 - RNA, 22 nt, Human
cuauggugauagaaaucagaau

SEQ ID NO: 603199 - RNA, 22 nt, Human
agcaggcaggaaggcagcacug

SEQ ID NO: 603200 - RNA, 22 nt, Human
cuccaucagcuguugguugagg

SEQ ID NO: 603201 - RNA, 22 nt, Human
gcugggcucagaccuagugaac

SEQ ID NO: 603202 - RNA, 22 nt, Human
agcugucuaccugcagaguccu

SEQ ID NO: 603203 - RNA, 22 nt, Human
aaucagaaagaggucauguugc

SEQ ID NO: 603204 - RNA, 22 nt, Human
ccugggaacaguggguuggcuc

SEQ ID NO: 603205 - RNA, 22 nt, Human
aacuaguuuagcuuuuuaagac

SEQ ID NO: 603206 - RNA, 22 nt, Human
uugcuauaaaugguuucauauu

SEQ ID NO: 603207 - RNA, 22 nt, Human
cuccuggcacugucuugaccca

SEQ ID NO: 603208 - RNA, 22 nt, Human
cugcuccuguccagcagggcca

SEQ ID NO: 603209 - RNA, 22 nt, Human
augaggcauucacagaaggcac

SEQ ID NO: 603210 - RNA, 22 nt, Human
agugggcaaaacagcucagagc

SEQ ID NO: 603211 - RNA, 22 nt, Human
ucaguuuauaaauuguauuuag

SEQ ID NO: 603212 - RNA, 22 nt, Human
cuuccuggaugagcaggcugau

SEQ ID NO: 603213 - RNA, 22 nt, Human
uaguuuuuaaguguacaauuuc

SEQ ID NO: 603214 - RNA, 22 nt, Human
cugccugugugugccugcagaa

SEQ ID NO: 603215 - RNA, 22 nt, Human
agcacagguacggagaugcuac

SEQ ID NO: 603216 - RNA, 22 nt, Human
gacggagcugguugcugcggcu

SEQ ID NO: 603217 - RNA, 22 nt, Human
auguuuguugaucauuuaugaa

SEQ ID NO: 603218 - RNA, 22 nt, Human
uugcugagcuuuggcaaggaag

SEQ ID NO: 603219 - RNA, 17 nt, Human
agcaaaaguaucaaagc

SEQ ID NO: 603220 - RNA, 22 nt, Human
aauucacuguuccuucugcuuu

SEQ ID NO: 603221 - RNA, 22 nt, Human
gugaauaaucacccuucuggau

SEQ ID NO: 603222 - RNA, 22 nt, Human
gcaagcaagcagguagagcuga

SEQ ID NO: 603223 - RNA, 22 nt, Human
aaugugaaaccgcacagaauaa

SEQ ID NO: 603224 - RNA, 22 nt, Human
ugugacuuaauccuuggguggg

SEQ ID NO: 603225 - RNA, 22 nt, Human
gcccagaguucaaggcugcagu

SEQ ID NO: 603226 - RNA, 22 nt, Human
gagcugccuacauugccaagag

SEQ ID NO: 603227 - RNA, 22 nt, Human
ccauggcuuacagauggagcau

SEQ ID NO: 603228 - RNA, 22 nt, Human
uuccugagucccggguaaagau

SEQ ID NO: 603229 - RNA, 22 nt, Human
auacuaaaguauagaacuuagu

SEQ ID NO: 603230 - RNA, 22 nt, Human
uaucagcucggaaucuguugaa

SEQ ID NO: 603231 - RNA, 18 nt, Human
cuccagagcugugagaca

SEQ ID NO: 603232 - RNA, 22 nt, Human
ccagagcaugaagggcaaugac

SEQ ID NO: 603233 - RNA, 22 nt, Human
aagagcuguaugccauaugauu

SEQ ID NO: 603234 - RNA, 22 nt, Human
aaagagaaaaugaucuguacau

SEQ ID NO: 603235 - RNA, 20 nt, Human
uacaguucuguagaaguaga

SEQ ID NO: 603236 - RNA, 22 nt, Human
ugagcuggauccaacuccguuu

SEQ ID NO: 603237 - RNA, 22 nt, Human
uggcagcagccauggaaggccc

SEQ ID NO: 603238 - RNA, 22 nt, Human
aaugcagaguaaauauuuaauu

SEQ ID NO: 603239 - RNA, 22 nt, Human
agucucuuuugcgaagaguguu

SEQ ID NO: 603240 - RNA, 22 nt, Human
ccuggaguuuuuugguugacuc

SEQ ID NO: 603241 - RNA, 22 nt, Human
aauaguauuuauuuggaaaaag

SEQ ID NO: 603242 - RNA, 22 nt, Human
agacccccuuuaauggaagugc

SEQ ID NO: 603243 - RNA, 22 nt, Human
ccuggggagaagagcuuccccc

SEQ ID NO: 603244 - RNA, 22 nt, Human
gaguuacauuuggugacacuuc

SEQ ID NO: 603245 - RNA, 22 nt, Human
ucaccucucuggccgucuaccu

SEQ ID NO: 603246 - RNA, 22 nt, Human
ugcaaaugcccauuuauuuucu

SEQ ID NO: 603247 - RNA, 20 nt, Human
uaacaggaagcauuauuuua

SEQ ID NO: 603248 - RNA, 22 nt, Human
guggggaggcauucuucucccu

SEQ ID NO: 603249 - RNA, 22 nt, Human
gugaagcacgcugccgcacugg

SEQ ID NO: 603250 - RNA, 18 nt, Human
gccaggcaggguggggaa

SEQ ID NO: 603251 - RNA, 19 nt, Human
acuguucuaacuugcagcu

SEQ ID NO: 603252 - RNA, 22 nt, Human
uacuauugaaucauugucaauc

SEQ ID NO: 603253 - RNA, 22 nt, Human
uuccuggucccguucuucacug

SEQ ID NO: 603254 - RNA, 22 nt, Human
cuaaacaaugaacaaagcacug

SEQ ID NO: 603255 - RNA, 20 nt, Human
cagggacagcaguggguuuu

SEQ ID NO: 603256 - RNA, 22 nt, Human
aacuccaugguucucagauucu

SEQ ID NO: 603257 - RNA, 22 nt, Human
guugaaauccuaacccccuagu

SEQ ID NO: 603258 - RNA, 22 nt, Human
guuuacauauuuuaauugguga

SEQ ID NO: 603259 - RNA, 22 nt, Human
uugugugugagccuucaccaca

SEQ ID NO: 603260 - RNA, 22 nt, Human
gaagauuaaaugaagugaccug

SEQ ID NO: 603261 - RNA, 22 nt, Human
ucacauuuucuuaggaaacuua

SEQ ID NO: 603262 - RNA, 22 nt, Human
auggaaagccaguguuccauca

SEQ ID NO: 603263 - RNA, 19 nt, Human
auacaguaagguguuugcc

SEQ ID NO: 603264 - RNA, 22 nt, Human
gcuuuuauuucuucacaaaagu

SEQ ID NO: 603265 - RNA, 22 nt, Human
acaguguucugcuuuuuaaucc

SEQ ID NO: 603266 - RNA, 22 nt, Human
gggcacuggaggccaaggagcu

SEQ ID NO: 603267 - RNA, 19 nt, Human
ccacuuugcagauagugag

SEQ ID NO: 603268 - RNA, 22 nt, Human
aggcaucaggaguauagccaga

SEQ ID NO: 603269 - RNA, 22 nt, Human
ggauggcagucugcaugagaaa

SEQ ID NO: 603270 - RNA, 22 nt, Human
agaguggagagaaacaacucug

SEQ ID NO: 603271 - RNA, 22 nt, Human
gugggaugguagguagguaaua

SEQ ID NO: 603272 - RNA, 22 nt, Human
auacauaugaaugauuuggcuc

SEQ ID NO: 603273 - RNA, 23 nt, Human
accagcugcccugaacuuugugc

SEQ ID NO: 603274 - RNA, 22 nt, Human
cuggggccacaacggcgcacgc

SEQ ID NO: 603275 - RNA, 21 nt, Human
acugcaucugaagucccagga

SEQ ID NO: 603276 - RNA, 20 nt, Human
uuggggcauccaccgaaugg

SEQ ID NO: 603277 - RNA, 22 nt, Human
agagccugaggaugucccagcu

SEQ ID NO: 603278 - RNA, 20 nt, Human
uuggcucagauuuuuauggg

SEQ ID NO: 603279 - RNA, 22 nt, Human
agggacagucuacuguucacug

SEQ ID NO: 603280 - RNA, 22 nt, Human
uaauuuaugguauguguguaau

SEQ ID NO: 603281 - RNA, 22 nt, Human
cacuguuauuacuacuauacau

SEQ ID NO: 603282 - RNA, 22 nt, Human
agacacuggcacuggggaagcc

SEQ ID NO: 603283 - RNA, 22 nt, Human
cugcagcuuuggaaaccuguuu

SEQ ID NO: 603284 - RNA, 21 nt, Human
auuauuauuucuguguccagc

SEQ ID NO: 603285 - RNA, 20 nt, Human
agcuccagugcugacgcuuc

SEQ ID NO: 603286 - RNA, 22 nt, Human
ucagaggaacacuguuucaugc

SEQ ID NO: 603287 - RNA, 22 nt, Human
ccuguacauggccaucuuuacc

SEQ ID NO: 603288 - RNA, 22 nt, Human
ugucuccugggcccuggcccug

SEQ ID NO: 603289 - RNA, 19 nt, Human
cuugccuguuccuacagcu

SEQ ID NO: 603290 - RNA, 22 nt, Human
ugguccucagguucucugugcg

SEQ ID NO: 603291 - RNA, 19 nt, Human
gcaggcacagcccugggug

SEQ ID NO: 603292 - RNA, 22 nt, Human
gaugucuuaagcccagaaguuc

SEQ ID NO: 603293 - RNA, 22 nt, Human
uaguuuaggugggguagacaga

SEQ ID NO: 603294 - RNA, 22 nt, Human
uuguuuuccugggauaccaacc

SEQ ID NO: 603295 - RNA, 22 nt, Human
gauucugaucuauaguguuaua

SEQ ID NO: 603296 - RNA, 22 nt, Human
gccaccuccuuauuccaccugu

SEQ ID NO: 603297 - RNA, 22 nt, Human
aaauaacuuucuguguauaguc

SEQ ID NO: 603298 - RNA, 22 nt, Human
gggcacuggcagucggggacgc

SEQ ID NO: 603299 - RNA, 22 nt, Human
cuucacuucacagaugccaaga

SEQ ID NO: 603300 - RNA, 20 nt, Human
accccagccccucuaucuga

SEQ ID NO: 603301 - RNA, 22 nt, Human
aggcagugcucaagacagcagc

SEQ ID NO: 603302 - RNA, 22 nt, Human
guggagggugagcucauguuug

SEQ ID NO: 603303 - RNA, 22 nt, Human
ggccacagcaaugcugugaugu

SEQ ID NO: 603304 - RNA, 22 nt, Human
caggcucccuaagucagcagcc

SEQ ID NO: 603305 - RNA, 22 nt, Human
ugagguagggacuuaaaacugu

SEQ ID NO: 603306 - RNA, 22 nt, Human
ucacaaauauuuuaacaguagg

SEQ ID NO: 603307 - RNA, 22 nt, Human
cuuggagucaauaagaucuaga

SEQ ID NO: 603308 - RNA, 22 nt, Human
gagacagaucucggcuccaugc

SEQ ID NO: 603309 - RNA, 22 nt, Human
cuugcaguuuagguccucugug

SEQ ID NO: 603310 - RNA, 19 nt, Human
ugugagaggcuagcugccc

SEQ ID NO: 603311 - RNA, 22 nt, Human
ugcagaaggaggaggaaaucca

SEQ ID NO: 603312 - RNA, 22 nt, Human
aaaauugucgaacaguaguaac

SEQ ID NO: 603313 - RNA, 22 nt, Human
uucuguuacuugcaaccacagg

SEQ ID NO: 603314 - RNA, 22 nt, Human
uccagcuggggacaugggcuuc

SEQ ID NO: 603315 - RNA, 22 nt, Human
gagagaggccuccauguacuga

SEQ ID NO: 603316 - RNA, 22 nt, Human
uggcacauagcagguacucagu

SEQ ID NO: 603317 - RNA, 22 nt, Human
uugcauauauuucuaaggaggu

SEQ ID NO: 603318 - RNA, 20 nt, Human
aauagcugagggcaagagua

SEQ ID NO: 603319 - RNA, 22 nt, Human
ggcagaagaaaggcuaagucuc

SEQ ID NO: 603320 - RNA, 22 nt, Human
ugaaacaagggaccguccuuuc

SEQ ID NO: 603321 - RNA, 22 nt, Human
ugcccuccacaguggcuccacc

SEQ ID NO: 603322 - RNA, 22 nt, Human
agugggagaaugaauaagggcc

SEQ ID NO: 603323 - RNA, 22 nt, Human
uucauugcauuccagccugggu

SEQ ID NO: 603324 - RNA, 22 nt, Human
uaugaacugugagugugauggg

SEQ ID NO: 603325 - RNA, 22 nt, Human
agugugugccuuuggauaccug

SEQ ID NO: 603326 - RNA, 22 nt, Human
gugcaaaaguaauggcaguuuu

SEQ ID NO: 603327 - RNA, 22 nt, Human
gcccaagcuggacugcaguggc

SEQ ID NO: 603328 - RNA, 22 nt, Human
auuucuacugugagaaacauga

SEQ ID NO: 603329 - RNA, 22 nt, Human
agcaggugaauuccuggaugug

SEQ ID NO: 603330 - RNA, 22 nt, Human
ucaaggcuauuaauucugugag

SEQ ID NO: 603331 - RNA, 22 nt, Human
aaggcucucugauggcagcagu

SEQ ID NO: 603332 - RNA, 22 nt, Human
cuguggucaccaggcuggggcc

SEQ ID NO: 603333 - RNA, 22 nt, Human
uacauagcaaggaaaugacaga

SEQ ID NO: 603334 - RNA, 21 nt, Human
uguggcugccucuggcccugg

SEQ ID NO: 603335 - RNA, 22 nt, Human
uaaagcaggugcucagugacca

SEQ ID NO: 603336 - RNA, 22 nt, Human
aagcagagccugagacagggau

SEQ ID NO: 603337 - RNA, 22 nt, Human
cucaggagcuuccucagcccau

SEQ ID NO: 603338 - RNA, 22 nt, Human
cugcagcaggaggcuccugcag

SEQ ID NO: 603339 - RNA, 22 nt, Human
ucaggcugcaguggcaaaagac

SEQ ID NO: 603340 - RNA, 22 nt, Human
aaauaaguaguuuaguguugug

SEQ ID NO: 603341 - RNA, 22 nt, Human
cagagcuguccaaacccugaca

SEQ ID NO: 603342 - RNA, 20 nt, Human
aggucugaaugucagggcug

SEQ ID NO: 603343 - RNA, 22 nt, Human
uguggcagucucacuggagggc

SEQ ID NO: 603344 - RNA, 20 nt, Human
uucaugggagcaaagaggcc

SEQ ID NO: 603345 - RNA, 22 nt, Human
ugguagcaacaucucaguggcu

SEQ ID NO: 603346 - RNA, 22 nt, Human
gaaggcuuuuuggguaauugua

SEQ ID NO: 603347 - RNA, 22 nt, Human
agcaguuuggcccgagcaguuc

SEQ ID NO: 603348 - RNA, 22 nt, Human
gcaaaaaccacaauuacuuuug

SEQ ID NO: 603349 - RNA, 22 nt, Human
uucuuccuugguuuccuggaua

SEQ ID NO: 603350 - RNA, 22 nt, Human
cugaagccaguuugcugcccuu

SEQ ID NO: 603351 - RNA, 21 nt, Human
gcaggaugcaucuuggugucu

SEQ ID NO: 603352 - RNA, 22 nt, Human
aucagcaaucucguguauuagg

SEQ ID NO: 603353 - RNA, 22 nt, Human
agauggggcagaauggagccau

SEQ ID NO: 603354 - RNA, 22 nt, Human
agggggugcauuugugaaugaa

SEQ ID NO: 603355 - RNA, 23 nt, Human
gccugccugaccugugcaaaguc

SEQ ID NO: 603356 - RNA, 22 nt, Human
agggccagaugaagccacaagc

SEQ ID NO: 603357 - RNA, 22 nt, Human
gcagguagugaucgagggugac

SEQ ID NO: 603358 - RNA, 22 nt, Human
acagugcuggcuacaacccugg

SEQ ID NO: 603359 - RNA, 21 nt, Human
agcagagugcuuugacuuugu

SEQ ID NO: 603360 - RNA, 22 nt, Human
ggugcugacauucagagucugg

SEQ ID NO: 603361 - RNA, 21 nt, Human
ucacuagugccuucugucauu

SEQ ID NO: 603362 - RNA, 23 nt, Human
ccaagcuucuaaugcugcugagc

SEQ ID NO: 603363 - RNA, 22 nt, Human
auuuucugugugcagauaaaua

SEQ ID NO: 603364 - RNA, 18 nt, Human
auuaaggaauucuuuaga

SEQ ID NO: 603365 - RNA, 20 nt, Human
caauagaauguggagauaag

SEQ ID NO: 603366 - RNA, 19 nt, Human
aguagcagaaagugcagug

SEQ ID NO: 603367 - RNA, 22 nt, Human
ugaagcaaacgcuucuguuccu

SEQ ID NO: 603368 - RNA, 22 nt, Human
uucccuuccucacucuacuugu

SEQ ID NO: 603369 - RNA, 21 nt, Human
ugaagggguggcagugugcuu

SEQ ID NO: 603370 - RNA, 22 nt, Human
ugagcaggugagucuagggcag

SEQ ID NO: 603371 - RNA, 22 nt, Human
aaugaacaggugaaugucagau

SEQ ID NO: 603372 - RNA, 22 nt, Human
cuuuccuucucgugguucucac

SEQ ID NO: 603373 - RNA, 22 nt, Human
aggaaacauugauauugggaaa

SEQ ID NO: 603374 - RNA, 22 nt, Human
aaagagaugugccaaauagccu

SEQ ID NO: 603375 - RNA, 22 nt, Human
auauuauagacagagucuucug

SEQ ID NO: 603376 - RNA, 22 nt, Human
acaugggaucaaugaggcaggc

SEQ ID NO: 603377 - RNA, 22 nt, Human
aaacauugagcacuugcuauuu

SEQ ID NO: 603378 - RNA, 22 nt, Human
gguaggaguauuuugcagcagu

SEQ ID NO: 603379 - RNA, 22 nt, Human
agguuggccucagggaggcucu

SEQ ID NO: 603380 - RNA, 23 nt, Human
agccccucauggugucuagacag

SEQ ID NO: 603381 - RNA, 22 nt, Human
cuuuuugucucuguccugauga

SEQ ID NO: 603382 - RNA, 22 nt, Human
cugcccugggugcuggggaucc

SEQ ID NO: 603383 - RNA, 22 nt, Human
gggaugggagagcauuuagaga

SEQ ID NO: 603384 - RNA, 19 nt, Human
uucugcuguuccuaggcug

SEQ ID NO: 603385 - RNA, 22 nt, Human
gccacaggcuccagcaucagua

SEQ ID NO: 603386 - RNA, 22 nt, Human
cuggcccagguggucguugagg

SEQ ID NO: 603387 - RNA, 22 nt, Human
uugcuuuccgucaugugcuaau

SEQ ID NO: 603388 - RNA, 16 nt, Human
ucccaggaggcggaac

SEQ ID NO: 603389 - RNA, 20 nt, Human
aagggagaauaaugauugua

SEQ ID NO: 603390 - RNA, 22 nt, Human
gcuguuccugcuuagaggucgg

SEQ ID NO: 603391 - RNA, 22 nt, Human
uccagguuuucugaaggcagga

SEQ ID NO: 603392 - RNA, 22 nt, Human
acagagcugggaucugaaccca

SEQ ID NO: 603393 - RNA, 22 nt, Human
gcaggaugaaggcagaggcuga

SEQ ID NO: 603394 - RNA, 22 nt, Human
uuuugcuuaaucuagauuuugc

SEQ ID NO: 603395 - RNA, 22 nt, Human
cuuccagugcauagguagauca

SEQ ID NO: 603396 - RNA, 22 nt, Human
agacaaugucaaggugaucauc

SEQ ID NO: 603397 - RNA, 22 nt, Human
uugcaggggaaggagcagagcu

SEQ ID NO: 603398 - RNA, 21 nt, Human
ggcugggucaugcagcuggcc

SEQ ID NO: 603399 - RNA, 22 nt, Human
uucagaaguagcuaagcaguca

SEQ ID NO: 603400 - RNA, 22 nt, Human
ucugcaaacuuaaguugaaaua

SEQ ID NO: 603401 - RNA, 22 nt, Human
gaauguuauugaacuacgagcu

SEQ ID NO: 603402 - RNA, 22 nt, Human
cucuuccuacagucugcuaugc

SEQ ID NO: 603403 - RNA, 18 nt, Human
gcagucucucuggucuuc

SEQ ID NO: 603404 - RNA, 22 nt, Human
ucuuuaauaucugccccagagc

SEQ ID NO: 603405 - RNA, 22 nt, Human
auuguuuccccggaauuauuca

SEQ ID NO: 603406 - RNA, 22 nt, Human
uucucacaguaccuaacaugua

SEQ ID NO: 603407 - RNA, 22 nt, Human
ugcuuaaacauacuauuuauau

SEQ ID NO: 603408 - RNA, 22 nt, Human
gugaagaaggcaauacaaagaa

SEQ ID NO: 603409 - RNA, 22 nt, Human
uaaaucuccuguuuuucaucua

SEQ ID NO: 603410 - RNA, 22 nt, Human
uggccagguugggcuuugcagc

SEQ ID NO: 603411 - RNA, 22 nt, Human
acaggugaccugcucauaugaa

SEQ ID NO: 603412 - RNA, 22 nt, Human
aaugugaacuuugucauguaac

SEQ ID NO: 603413 - RNA, 22 nt, Human
ucaagaauuuuuaaugugacug

SEQ ID NO: 603414 - RNA, 22 nt, Human
uuagcuuaauuaaauaaucagu

SEQ ID NO: 603415 - RNA, 22 nt, Human
ugugccaaucugcugacugucu

SEQ ID NO: 603416 - RNA, 20 nt, Human
gcugaggucauuaugccuca

SEQ ID NO: 603417 - RNA, 22 nt, Human
gcucccacgcaauucuuuucag

SEQ ID NO: 603418 - RNA, 22 nt, Human
cuaaauaaucccucuggucuua

SEQ ID NO: 603419 - RNA, 22 nt, Human
acagggcuugugacaacuuuaa

SEQ ID NO: 603420 - RNA, 22 nt, Human
ugaauaauuccuuuuugucaag

SEQ ID NO: 603421 - RNA, 22 nt, Human
aggccacacaacucuuagagau

SEQ ID NO: 603422 - RNA, 22 nt, Human
uaauggauuaacgucccugucg

SEQ ID NO: 603423 - RNA, 20 nt, Human
cugaacacagaauaagcaca

SEQ ID NO: 603424 - RNA, 22 nt, Human
augaugaaaacugaagguuagg

SEQ ID NO: 603425 - RNA, 22 nt, Human
gcuggcagacugggggcagaac

SEQ ID NO: 603426 - RNA, 22 nt, Human
gagaaagggaacuuacagagug

SEQ ID NO: 603427 - RNA, 22 nt, Human
ucugaaagcauuacaguuuauu

SEQ ID NO: 603428 - RNA, 22 nt, Human
ugaucaguguugguucuaucua

SEQ ID NO: 603429 - RNA, 22 nt, Human
uagcacagagcuuuuaaacuuc

SEQ ID NO: 603430 - RNA, 22 nt, Human
augcaauauagggaagauagau

SEQ ID NO: 603431 - RNA, 22 nt, Human
aaacaguguuuuuaugauuuau

SEQ ID NO: 603432 - RNA, 22 nt, Human
ggccucugccucaucugggcac

SEQ ID NO: 603433 - RNA, 20 nt, Human
aggcuggcacuccuggccag

SEQ ID NO: 603434 - RNA, 22 nt, Human
augagcccagggaauuccuuuc

SEQ ID NO: 603435 - RNA, 22 nt, Human
cccugggaguccacugauguca

SEQ ID NO: 603436 - RNA, 22 nt, Human
uguggggcugugguguucuucu

SEQ ID NO: 603437 - RNA, 19 nt, Human
cucuccaccuaacagguau

SEQ ID NO: 603438 - RNA, 22 nt, Human
caggcagauauguucgcuuuaa

SEQ ID NO: 603439 - RNA, 22 nt, Human
ucuuccuugccuugcuucauca

SEQ ID NO: 603440 - RNA, 22 nt, Human
aggagaaggaagugcaucacua

SEQ ID NO: 603441 - RNA, 22 nt, Human
gcucccagcauugcugcugaau

SEQ ID NO: 603442 - RNA, 18 nt, Human
agagaugguguagaguuu

SEQ ID NO: 603443 - RNA, 22 nt, Human
gcaggcagagaaggaacauuua

SEQ ID NO: 603444 - RNA, 22 nt, Human
ccucugugucagggaagagacu

SEQ ID NO: 603445 - RNA, 22 nt, Human
guuaacaaccaaacagaaguuc

SEQ ID NO: 603446 - RNA, 22 nt, Human
ucaguaaaggcuagguuaugcu

SEQ ID NO: 603447 - RNA, 22 nt, Human
ugaagccaucccucagauggcc

SEQ ID NO: 603448 - RNA, 22 nt, Human
uuccuucuucauuguguuacag

SEQ ID NO: 603449 - RNA, 22 nt, Human
gucccaggcuccauggcagcca

SEQ ID NO: 603450 - RNA, 22 nt, Human
aaaacagaggugccugggccca

SEQ ID NO: 603451 - RNA, 23 nt, Human
uugaggucggcucucugagccug

SEQ ID NO: 603452 - RNA, 22 nt, Human
gcagagugagauaugaacccag

SEQ ID NO: 603453 - RNA, 22 nt, Human
gcuagugagcucuuugucaucu

SEQ ID NO: 603454 - RNA, 22 nt, Human
uggcagcuacagacagagguga

SEQ ID NO: 603455 - RNA, 21 nt, Human
uaagcauaucagauagacucu

SEQ ID NO: 603456 - RNA, 22 nt, Human
agggcugaagggaggugcucau

SEQ ID NO: 603457 - RNA, 22 nt, Human
ugauuccuaggcacucuucucc

SEQ ID NO: 603458 - RNA, 21 nt, Human
ccauaaucuuaggaucaaaau

SEQ ID NO: 603459 - RNA, 22 nt, Human
cauuucugucacguucuuuuau

SEQ ID NO: 603460 - RNA, 22 nt, Human
aaagcaugacucaagaauuacu

SEQ ID NO: 603461 - RNA, 22 nt, Human
ucccagaauccucacucuauca

SEQ ID NO: 603462 - RNA, 22 nt, Human
aguggcuggucuaaggucacag

SEQ ID NO: 603463 - RNA, 22 nt, Human
agccagcaugaagacagaggcc

SEQ ID NO: 603464 - RNA, 22 nt, Human
ugugugugcaggagagcaggug

SEQ ID NO: 603465 - RNA, 22 nt, Human
ugcugagguuucgucugcuugc

SEQ ID NO: 603466 - RNA, 22 nt, Human
caggcugccaaggcuggggagg

SEQ ID NO: 603467 - RNA, 19 nt, Human
uaaaaacugaaggaagcag

SEQ ID NO: 603468 - RNA, 22 nt, Human
uuuuaauucaaagugaauagug

SEQ ID NO: 603469 - RNA, 22 nt, Human
acugggccggugcagaguaguu

SEQ ID NO: 603470 - RNA, 20 nt, Human
uuuccacuguaauguaugau

SEQ ID NO: 603471 - RNA, 22 nt, Human
cuaggcuggagugcauuggcgu

SEQ ID NO: 603472 - RNA, 22 nt, Human
uuccuugaaaguuugaacugac

SEQ ID NO: 603473 - RNA, 22 nt, Human
uuucuuccuauguaucuugcug

SEQ ID NO: 603474 - RNA, 22 nt, Human
aggcacugguccauuuucugca

SEQ ID NO: 603475 - RNA, 22 nt, Human
cucugagaagaguucaaguaaa

SEQ ID NO: 603476 - RNA, 22 nt, Human
aagucugaucauuucuucuaua

SEQ ID NO: 603477 - RNA, 22 nt, Human
augcuaaugagcuaaggagucc

SEQ ID NO: 603478 - RNA, 23 nt, Human
aagcugccagucugaagccuggg

SEQ ID NO: 603479 - RNA, 22 nt, Human
gugcucugaguuugcaugucag

SEQ ID NO: 603480 - RNA, 22 nt, Human
ugcugaaauuagaacauugagg

SEQ ID NO: 603481 - RNA, 22 nt, Human
guagaugagcucacaugaccuu

SEQ ID NO: 603482 - RNA, 22 nt, Human
agccaggcuacuccuugcugac

SEQ ID NO: 603483 - RNA, 22 nt, Human
aauagacuccagggucuauuuu

SEQ ID NO: 603484 - RNA, 22 nt, Human
gcagugugaccgagcuugcuuc

SEQ ID NO: 603485 - RNA, 22 nt, Human
uuguccugaggacuguuaucag

SEQ ID NO: 603486 - RNA, 22 nt, Human
ccugccucccagagguccucua

SEQ ID NO: 603487 - RNA, 22 nt, Human
uguggcaggcaagauguacaga

SEQ ID NO: 603488 - RNA, 22 nt, Human
aaaguguagagugccucaaaau

SEQ ID NO: 603489 - RNA, 22 nt, Human
uuacagauguaggaacugaagu

SEQ ID NO: 603490 - RNA, 22 nt, Human
ugggagaaagaacccugaguga

SEQ ID NO: 603491 - RNA, 22 nt, Human
gccuggugguauccuggcaaga

SEQ ID NO: 603492 - RNA, 18 nt, Human
ugcauuuaguacaucuag

SEQ ID NO: 603493 - RNA, 22 nt, Human
uuuggcagagucauuucagaaa

SEQ ID NO: 603494 - RNA, 22 nt, Human
gggggcaggucuggaacuuuga

SEQ ID NO: 603495 - RNA, 22 nt, Human
cuggugcugggcagggcucagg

SEQ ID NO: 603496 - RNA, 22 nt, Human
acccagccacagcauugaggga

SEQ ID NO: 603497 - RNA, 22 nt, Human
cgcugugugcagacugaaaaug

SEQ ID NO: 603498 - RNA, 22 nt, Human
ggaggccauaguuugggaguca

SEQ ID NO: 603499 - RNA, 22 nt, Human
uucucauggugucuuuauacau

SEQ ID NO: 603500 - RNA, 22 nt, Human
cuggagggacuuucucacggau

SEQ ID NO: 603501 - RNA, 22 nt, Human
cccagggagguagcaggagaaa

SEQ ID NO: 603502 - RNA, 22 nt, Human
acagauaaggcaguuaagaguu

SEQ ID NO: 603503 - RNA, 22 nt, Human
cucccaggcagggcugcccacu

SEQ ID NO: 603504 - RNA, 22 nt, Human
ugccaggcccagcagggcggcc

SEQ ID NO: 603505 - RNA, 22 nt, Human
ucucugaauuguuuaaguuauu

SEQ ID NO: 603506 - RNA, 22 nt, Human
guggacuggcagugaccuuggu

SEQ ID NO: 603507 - RNA, 22 nt, Human
acacaggaaaugguuuaguuuu

SEQ ID NO: 603508 - RNA, 21 nt, Human
acagauuagcacaaugcaggc

SEQ ID NO: 603509 - RNA, 22 nt, Human
uuuuagauuauaagucuaauuc

SEQ ID NO: 603510 - RNA, 22 nt, Human
cauuaauaaacauuucagaaga

SEQ ID NO: 603511 - RNA, 22 nt, Human
gagguagggaagacaaauaugc

SEQ ID NO: 603512 - RNA, 23 nt, Human
ugggauagaauuucauggcugcu

SEQ ID NO: 603513 - RNA, 22 nt, Human
auauuaagaugcuauugguuuu

SEQ ID NO: 603514 - RNA, 22 nt, Human
caucagaacgugagcuccuugu

SEQ ID NO: 603515 - RNA, 22 nt, Human
cuccugagaggaucucuguugu

SEQ ID NO: 603516 - RNA, 22 nt, Human
caguacauuucauaugauucua

SEQ ID NO: 603517 - RNA, 22 nt, Human
gauuaagagaaguuucuuaucg

SEQ ID NO: 603518 - RNA, 22 nt, Human
uaucauuuaacagaaucauugc

SEQ ID NO: 603519 - RNA, 20 nt, Human
gaaauguaucucuugauucu

SEQ ID NO: 603520 - RNA, 22 nt, Human
cugagaauuacucugaugagua

SEQ ID NO: 603521 - RNA, 22 nt, Human
gacagacagggguucuccugga

SEQ ID NO: 603522 - RNA, 22 nt, Human
uuucuucuuaauacuggcugcu

SEQ ID NO: 603523 - RNA, 22 nt, Human
uggcagagagagugcagucgac

SEQ ID NO: 603524 - RNA, 22 nt, Human
ugugaaaucaauuagcugcaga

SEQ ID NO: 603525 - RNA, 22 nt, Human
caucacuacaaauuuaagaaau

SEQ ID NO: 603526 - RNA, 22 nt, Human
ugagaacauuugcagggagagu

SEQ ID NO: 603527 - RNA, 22 nt, Human
aagccaagguuuuggucacagc

SEQ ID NO: 603528 - RNA, 22 nt, Human
agaggggaguccuaaucugauu

SEQ ID NO: 603529 - RNA, 22 nt, Human
ucagcuuucuauguugcuaaac

SEQ ID NO: 603530 - RNA, 22 nt, Human
gaguggcuguguacaugcccag

SEQ ID NO: 603531 - RNA, 18 nt, Human
cugggcucgagagauccu

SEQ ID NO: 603532 - RNA, 22 nt, Human
uccagacauuuuauagcagucu

SEQ ID NO: 603533 - RNA, 22 nt, Human
cccuggagcugcuugcauguug

SEQ ID NO: 603534 - RNA, 22 nt, Human
ucagcagaaguauagaggccau

SEQ ID NO: 603535 - RNA, 22 nt, Human
gggcugagucaucuggggccuc

SEQ ID NO: 603536 - RNA, 22 nt, Human
ucacuuuugaucccuaugcagu

SEQ ID NO: 603537 - RNA, 22 nt, Human
ggagcagaugucuucauggccu

SEQ ID NO: 603538 - RNA, 22 nt, Human
ugcuguaauacuuaagguuaag

SEQ ID NO: 603539 - RNA, 22 nt, Human
cugcaggggaccaaagucugac

SEQ ID NO: 603540 - RNA, 23 nt, Human
uuguucuuggaucuuccugaagc

SEQ ID NO: 603541 - RNA, 22 nt, Human
uucugucaaagacuuuuucagg

SEQ ID NO: 603542 - RNA, 22 nt, Human
gcagcugccuauucagggcuug

SEQ ID NO: 603543 - RNA, 17 nt, Human
gcagccucuugguagug

SEQ ID NO: 603544 - RNA, 22 nt, Human
ucaguuucuucuuuagauaaaa

SEQ ID NO: 603545 - RNA, 22 nt, Human
aaguaaaauucaaucuucacug

SEQ ID NO: 603546 - RNA, 22 nt, Human
aucacauauuuaagaaacaugu

SEQ ID NO: 603547 - RNA, 22 nt, Human
ugacacaggggaaggagucugg

SEQ ID NO: 603548 - RNA, 22 nt, Human
cugcccugcagcuccacggacu

SEQ ID NO: 603549 - RNA, 22 nt, Human
aagacugucugggacaagauga

SEQ ID NO: 603550 - RNA, 22 nt, Human
uaaagcagccagggucuaagcc

SEQ ID NO: 603551 - RNA, 22 nt, Human
augagagguuucgucagaggaa

SEQ ID NO: 603552 - RNA, 21 nt, Human
auggagggaccagggaagcag

SEQ ID NO: 603553 - RNA, 22 nt, Human
aggugagguuugggagguguca

SEQ ID NO: 603554 - RNA, 22 nt, Human
aauggcuuucagcaaggauaga

SEQ ID NO: 603555 - RNA, 22 nt, Human
uaaaacacucagcaccuagcaa

SEQ ID NO: 603556 - RNA, 17 nt, Human
ugaagaugcauggcagc

SEQ ID NO: 603557 - RNA, 22 nt, Human
ccaggagaagcaucugagugua

SEQ ID NO: 603558 - RNA, 22 nt, Human
uggugccaagcaugaggacucu

SEQ ID NO: 603559 - RNA, 20 nt, Human
gcugagguuucuuccuauau

SEQ ID NO: 603560 - RNA, 22 nt, Human
cugggacucagaccaguucugu

SEQ ID NO: 603561 - RNA, 22 nt, Human
acagcaggcaugaagaaauguu

SEQ ID NO: 603562 - RNA, 22 nt, Human
uugguccugcccccuccagguc

SEQ ID NO: 603563 - RNA, 22 nt, Human
uucuuuucuuuaggcauugugu

SEQ ID NO: 603564 - RNA, 20 nt, Human
ugucauucuucuuucacagg

SEQ ID NO: 603565 - RNA, 22 nt, Human
cccaggaggacauuccauaccc

SEQ ID NO: 603566 - RNA, 22 nt, Human
uaauuauaacaguuacaucuua

SEQ ID NO: 603567 - RNA, 21 nt, Human
uaaaucucuguauucuucagu

SEQ ID NO: 603568 - RNA, 22 nt, Human
cuuaggaacacuuacugguacu

SEQ ID NO: 603569 - RNA, 22 nt, Human
uuacuuuagaucauacugugug

SEQ ID NO: 603570 - RNA, 22 nt, Human
cuggcaggcagacuucugcaag

SEQ ID NO: 603571 - RNA, 22 nt, Human
uacagugcgauuuuuaggccuc

SEQ ID NO: 603572 - RNA, 22 nt, Human
uuuuaagaaauguaugacuguc

SEQ ID NO: 603573 - RNA, 21 nt, Human
gcagacugcccugcugucccc

SEQ ID NO: 603574 - RNA, 22 nt, Human
ugccaggcuccggaacgacagu

SEQ ID NO: 603575 - RNA, 22 nt, Human
gggcugacucaaccuugcaaag

SEQ ID NO: 603576 - RNA, 22 nt, Human
cucaugucuucacccauucuaa

SEQ ID NO: 603577 - RNA, 22 nt, Human
ucacuuuggaagauagcacauc

SEQ ID NO: 603578 - RNA, 21 nt, Human
ccugugugucugacugggcua

SEQ ID NO: 603579 - RNA, 22 nt, Human
uaggaaaaauacagaauuauau

SEQ ID NO: 603580 - RNA, 22 nt, Human
auuuuagagaaacaaacguagg

SEQ ID NO: 603581 - RNA, 19 nt, Human
aggcuucaggccacaugcu

SEQ ID NO: 603582 - RNA, 18 nt, Human
uaagaagguggcuccagc

SEQ ID NO: 603583 - RNA, 22 nt, Human
uugcccugaagaacgucccaga

SEQ ID NO: 603584 - RNA, 22 nt, Human
uggcaucuuugucccagaagcu

SEQ ID NO: 603585 - RNA, 22 nt, Human
gaggcaggcccugaaugaguca

SEQ ID NO: 603586 - RNA, 22 nt, Human
uaccagcaucacagcauguugg

SEQ ID NO: 603587 - RNA, 22 nt, Human
auguuucuagagcuuuguccca

SEQ ID NO: 603588 - RNA, 19 nt, Human
caguggagauuggaggagg

SEQ ID NO: 603589 - RNA, 22 nt, Human
uaggaacacagggacuugauga

SEQ ID NO: 603590 - RNA, 22 nt, Human
uuaauugauauaaagaacuuca

SEQ ID NO: 603591 - RNA, 22 nt, Human
acuugucuuuguaaaauagaaa

SEQ ID NO: 603592 - RNA, 22 nt, Human
auaaaugauucagcaggaaaua

SEQ ID NO: 603593 - RNA, 21 nt, Human
ucccugcuuucuggcccaguc

SEQ ID NO: 603594 - RNA, 22 nt, Human
acaaugaacacacaaggaauuc

SEQ ID NO: 603595 - RNA, 22 nt, Human
agagcuguucagcagccagguu

SEQ ID NO: 603596 - RNA, 22 nt, Human
aggcuagaggcuucuggcuuca

SEQ ID NO: 603597 - RNA, 22 nt, Human
ucaaaauuucagcacuagcccu

SEQ ID NO: 603598 - RNA, 22 nt, Human
ccuccagggccccucucacugg

SEQ ID NO: 603599 - RNA, 22 nt, Human
uucacagaagaggucacauuuc

SEQ ID NO: 603600 - RNA, 23 nt, Human
gccugggacucaggaggagcuca

SEQ ID NO: 603601 - RNA, 22 nt, Human
caaugcaaugcaaugcaaugca

SEQ ID NO: 603602 - RNA, 23 nt, Human
ugccacaagaucugugaauaaga

SEQ ID NO: 603603 - RNA, 22 nt, Human
ggcaguggguuccccaaggcac

SEQ ID NO: 603604 - RNA, 22 nt, Human
cacucugacacaugaacuugau

SEQ ID NO: 603605 - RNA, 22 nt, Human
uaucuguucugcuugauuuuga

SEQ ID NO: 603606 - RNA, 22 nt, Human
cuuggguauaaaacuuggcuau

SEQ ID NO: 603607 - RNA, 18 nt, Human
uuauggcugugaaagagu

SEQ ID NO: 603608 - RNA, 22 nt, Human
cuuucuugguccugaagauggc

SEQ ID NO: 603609 - RNA, 22 nt, Human
ccacuggaagaugcugagguca

SEQ ID NO: 603610 - RNA, 22 nt, Human
aggcauggcuuuaggcaggcgu

SEQ ID NO: 603611 - RNA, 23 nt, Human
uccuugggccugcccagaguggu

SEQ ID NO: 603612 - RNA, 22 nt, Human
auuagcuuuauuugaaauagga

SEQ ID NO: 603613 - RNA, 22 nt, Human
cuccucugucuggcccugagcc

SEQ ID NO: 603614 - RNA, 22 nt, Human
aauaauguuuauuuguauucuc

SEQ ID NO: 603615 - RNA, 22 nt, Human
uacuuuauuguaaaugcugaug

SEQ ID NO: 603616 - RNA, 21 nt, Human
cugcaucucauagaacauguc

SEQ ID NO: 603617 - RNA, 22 nt, Human
acaacugucaguaaagaauauu

SEQ ID NO: 603618 - RNA, 23 nt, Human
ucacaguaucucuggagccauag

SEQ ID NO: 603619 - RNA, 22 nt, Human
uuucucuaaauagggaggcuua

SEQ ID NO: 603620 - RNA, 22 nt, Human
ggaggaggcaaguaccagaugc

SEQ ID NO: 603621 - RNA, 22 nt, Human
aucacauugccagugauuaccc

SEQ ID NO: 603622 - RNA, 22 nt, Human
gacauaaaccuugagauauuaa

SEQ ID NO: 603623 - RNA, 22 nt, Human
uuggaagaucuaacagaggcau

SEQ ID NO: 603624 - RNA, 22 nt, Human
ucuucuaugaaucauuggaaca

SEQ ID NO: 603625 - RNA, 22 nt, Human
uguuaauauacuaaaauccacu

SEQ ID NO: 603626 - RNA, 22 nt, Human
uuugaaagaaaccagugaguga

SEQ ID NO: 603627 - RNA, 22 nt, Human
ucaggacagagaucagaacuuc

SEQ ID NO: 603628 - RNA, 22 nt, Human
aguguuuacauugaagcuugua

SEQ ID NO: 603629 - RNA, 22 nt, Human
uaauuauaacaugcuuucuggc

SEQ ID NO: 603630 - RNA, 22 nt, Human
uccugaaaaauuacauguucag

SEQ ID NO: 603631 - RNA, 22 nt, Human
gcugagcugcuguucauccugc

SEQ ID NO: 603632 - RNA, 22 nt, Human
ucacaguguggcaacucacaga

SEQ ID NO: 603633 - RNA, 22 nt, Human
caguagcagggauuauuuuagg

SEQ ID NO: 603634 - RNA, 22 nt, Human
cugugucucauccgccucuggc

SEQ ID NO: 603635 - RNA, 20 nt, Human
uccaagcccuccuuccauuc

SEQ ID NO: 603636 - RNA, 22 nt, Human
gccagcugucuaagagaguaaa

SEQ ID NO: 603637 - RNA, 22 nt, Human
ggcuggguucugagaaagagua

SEQ ID NO: 603638 - RNA, 22 nt, Human
gugcagagagguggagggacuu

SEQ ID NO: 603639 - RNA, 22 nt, Human
agugauaaugugguaauuauuu

SEQ ID NO: 603640 - RNA, 22 nt, Human
agucccagugacuuggccagaa

SEQ ID NO: 603641 - RNA, 22 nt, Human
ucagcugaaguggagaagcaga

SEQ ID NO: 603642 - RNA, 22 nt, Human
cugccaggccuccgcugucccc

SEQ ID NO: 603643 - RNA, 22 nt, Human
gccaccucggcuuucucugcuc

SEQ ID NO: 603644 - RNA, 22 nt, Human
ugaagaaacagaccaagaggau

SEQ ID NO: 603645 - RNA, 22 nt, Human
cugggcugcuguccacuagggu

SEQ ID NO: 603646 - RNA, 22 nt, Human
aggccaaguuacuugggaaagc

SEQ ID NO: 603647 - RNA, 22 nt, Human
ccagccucaucgccugccuguc

SEQ ID NO: 603648 - RNA, 22 nt, Human
caaaguaauuuggagauauaua

SEQ ID NO: 603649 - RNA, 22 nt, Human
ccugugugcugaugacgacaga

SEQ ID NO: 603650 - RNA, 22 nt, Human
uauuuucaucuuguccuuggau

SEQ ID NO: 603651 - RNA, 22 nt, Human
uuauaguauuagguacucaaca

SEQ ID NO: 603652 - RNA, 22 nt, Human
cugaggagucaguuccacucag

SEQ ID NO: 603653 - RNA, 23 nt, Human
ccagggagugcuacuaucaagcc

SEQ ID NO: 603654 - RNA, 22 nt, Human
aaucagaaauucuacaucacaa

SEQ ID NO: 603655 - RNA, 22 nt, Human
gcccagggugcuuagaacccau

SEQ ID NO: 603656 - RNA, 22 nt, Human
gaaggagcuacuaauaagaggg

SEQ ID NO: 603657 - RNA, 22 nt, Human
auuaaggagguaaacuaugguu

SEQ ID NO: 603658 - RNA, 22 nt, Human
cucaggaguaguucagcagcug

SEQ ID NO: 603659 - RNA, 22 nt, Human
uuucaugucauuccauuucaga

SEQ ID NO: 603660 - RNA, 22 nt, Human
agcugcccugggcuggagaugg

SEQ ID NO: 603661 - RNA, 16 nt, Human
gagaagagcccggcag

SEQ ID NO: 603662 - RNA, 22 nt, Human
aaagcuuagaggccaguggagg

SEQ ID NO: 603663 - RNA, 17 nt, Human
gagcagggaugcgguuc

SEQ ID NO: 603664 - RNA, 22 nt, Human
ccaggcucacugacuaccacau

SEQ ID NO: 603665 - RNA, 22 nt, Human
ggucuggauaauuccaguaccu

SEQ ID NO: 603666 - RNA, 22 nt, Human
uaaaugaagaaauggagauugu

SEQ ID NO: 603667 - RNA, 22 nt, Human
cuucuucuggacaggcagcucc

SEQ ID NO: 603668 - RNA, 22 nt, Human
ugcuuuaacauaagauaucuuu

SEQ ID NO: 603669 - RNA, 22 nt, Human
cagaaauguacugacaugcagu

SEQ ID NO: 603670 - RNA, 22 nt, Human
guuuuuauuguguaaauguggg

SEQ ID NO: 603671 - RNA, 22 nt, Human
ugugugcaagugacauuagaaa

SEQ ID NO: 603672 - RNA, 19 nt, Human
gccugggaugggcagaacu

SEQ ID NO: 603673 - RNA, 22 nt, Human
ccuggugcagguguguugccag

SEQ ID NO: 603674 - RNA, 21 nt, Human
gcucucugcaugguggcucag

SEQ ID NO: 603675 - RNA, 20 nt, Human
uccuggccucccuggggcuc

SEQ ID NO: 603676 - RNA, 22 nt, Human
caugugaauuccaaagcuaggu

SEQ ID NO: 603677 - RNA, 22 nt, Human
cugccugcacugccuggcucca

SEQ ID NO: 603678 - RNA, 22 nt, Human
ccagcugcaggggagcagugga

SEQ ID NO: 603679 - RNA, 22 nt, Human
gaugcagaaaguagacaccauc

SEQ ID NO: 603680 - RNA, 22 nt, Human
auguuuuccauugccauggaaa

SEQ ID NO: 603681 - RNA, 22 nt, Human
ccagggcuccauugcucauccu

SEQ ID NO: 603682 - RNA, 22 nt, Human
uaaugccuuucuguacuauaug

SEQ ID NO: 603683 - RNA, 22 nt, Human
agcucucccaccuucuucuuac

SEQ ID NO: 603684 - RNA, 22 nt, Human
gggacaggccccucgcuagcuu

SEQ ID NO: 603685 - RNA, 22 nt, Human
gccaggagagcuccuucagguu

SEQ ID NO: 603686 - RNA, 22 nt, Human
uggcagggaauacagauguuua

SEQ ID NO: 603687 - RNA, 20 nt, Human
gccuguccugagugucaugg

SEQ ID NO: 603688 - RNA, 22 nt, Human
aacagcugucugccuaucucug

SEQ ID NO: 603689 - RNA, 22 nt, Human
gcccaggaaagauagggccuca

SEQ ID NO: 603690 - RNA, 22 nt, Human
acaaauggaagguguucucuuc

SEQ ID NO: 603691 - RNA, 22 nt, Human
gagcaggaaggccagaaggguc

SEQ ID NO: 603692 - RNA, 22 nt, Human
gcagcccagguguagcucuuug

SEQ ID NO: 603693 - RNA, 22 nt, Human
gaugcugauuuuacuguuuucu

SEQ ID NO: 603694 - RNA, 22 nt, Human
auuccuuguauaucuacaugca

SEQ ID NO: 603695 - RNA, 22 nt, Human
ucccaaggccaggcaucuagaa

SEQ ID NO: 603696 - RNA, 22 nt, Human
ugucauuuaguccucugugugu

SEQ ID NO: 603697 - RNA, 22 nt, Human
aacuaaaucuggcauuuagagc

SEQ ID NO: 603698 - RNA, 22 nt, Human
ucuugaaagcauuuucuucauc

SEQ ID NO: 603699 - RNA, 22 nt, Human
cacacaugagucuccccauugg

SEQ ID NO: 603700 - RNA, 19 nt, Human
ccagcagacacagcugccc

SEQ ID NO: 603701 - RNA, 22 nt, Human
cucugagguccuucccagcucu

SEQ ID NO: 603702 - RNA, 21 nt, Human
agcucccuguuuccucacucu

SEQ ID NO: 603703 - RNA, 22 nt, Human
uuuaacagaugaggaggugagg

SEQ ID NO: 603704 - RNA, 22 nt, Human
cugaggccucucccacuccagc

SEQ ID NO: 603705 - RNA, 22 nt, Human
augcagaaggagccaugcuugc

SEQ ID NO: 603706 - RNA, 22 nt, Human
agcucacagaaauccugcagga

SEQ ID NO: 603707 - RNA, 22 nt, Human
agaagaaaugaggccguucugc

SEQ ID NO: 603708 - RNA, 22 nt, Human
gcagaucuuuaacagggucacu

SEQ ID NO: 603709 - RNA, 22 nt, Human
cccugggauaccagacaccaga

SEQ ID NO: 603710 - RNA, 22 nt, Human
cuuuaucuaggguaagaaaacc

SEQ ID NO: 603711 - RNA, 22 nt, Human
cacugcaaccucagacuccugg

SEQ ID NO: 603712 - RNA, 22 nt, Human
ucccagggggaugaacacugcc

SEQ ID NO: 603713 - RNA, 22 nt, Human
aaagucaguuggccagaucacu

SEQ ID NO: 603714 - RNA, 22 nt, Human
guccucaguaagagggccucug

SEQ ID NO: 603715 - RNA, 22 nt, Human
acugagguuguaguaggaauuc

SEQ ID NO: 603716 - RNA, 21 nt, Human
ugagcccuugccucagagccc

SEQ ID NO: 603717 - RNA, 22 nt, Human
gucuccugagacugcagucacc

SEQ ID NO: 603718 - RNA, 22 nt, Human
gaggccagaguuccccgaguca

SEQ ID NO: 603719 - RNA, 22 nt, Human
agaggaaguaaucaggaccugc

SEQ ID NO: 603720 - RNA, 22 nt, Human
uguacaugaauaaaagaucuug

SEQ ID NO: 603721 - RNA, 22 nt, Human
cugagagaugguguguuuauaa

SEQ ID NO: 603722 - RNA, 22 nt, Human
acugauacaucuguggaagugg

SEQ ID NO: 603723 - RNA, 22 nt, Human
aguuuuauguagacaauucauu

SEQ ID NO: 603724 - RNA, 23 nt, Human
auguuuuaugucucuagcugcca

SEQ ID NO: 603725 - RNA, 22 nt, Human
aaguuucaaauguugauuaugc

SEQ ID NO: 603726 - RNA, 22 nt, Human
ugagcugugauuaacucugaga

SEQ ID NO: 603727 - RNA, 22 nt, Human
cauuucuagagucccaagaggu

SEQ ID NO: 603728 - RNA, 22 nt, Human
ucuuuuucuuauucccacacug

SEQ ID NO: 603729 - RNA, 22 nt, Human
cacacaguggaguauuacucag

SEQ ID NO: 603730 - RNA, 22 nt, Human
gagaugcuuuugguccaagagu

SEQ ID NO: 603731 - RNA, 20 nt, Human
gggcagccucgggagugggu

SEQ ID NO: 603732 - RNA, 22 nt, Human
uuccucagagggcgcuggggaa

SEQ ID NO: 603733 - RNA, 22 nt, Human
cagcagcaucaggucugugguu

SEQ ID NO: 603734 - RNA, 23 nt, Human
gcugggcuuacucuuucagugag

SEQ ID NO: 603735 - RNA, 22 nt, Human
acagcagcauaaacugacuaag

SEQ ID NO: 603736 - RNA, 22 nt, Human
ucuauuucgcauauaaguuuug

SEQ ID NO: 603737 - RNA, 22 nt, Human
uauuauggcagcauucaguaug

SEQ ID NO: 603738 - RNA, 22 nt, Human
gaggcugaauggccagaagcca

SEQ ID NO: 603739 - RNA, 22 nt, Human
gccagcugugcuuuuccuaaaa

SEQ ID NO: 603740 - RNA, 22 nt, Human
acaguguuacuugauaguguau

SEQ ID NO: 603741 - RNA, 21 nt, Human
ucauuuuuauugcuaccuugc

SEQ ID NO: 603742 - RNA, 22 nt, Human
acauucaugucccacuucuagc

SEQ ID NO: 603743 - RNA, 20 nt, Human
accuuucaaaugauucagca

SEQ ID NO: 603744 - RNA, 22 nt, Human
auguucuaaucccugcuaugua

SEQ ID NO: 603745 - RNA, 22 nt, Human
gcagaagcagaggagccuauga

SEQ ID NO: 603746 - RNA, 22 nt, Human
caguuacaugcucaugucauca

SEQ ID NO: 603747 - RNA, 22 nt, Human
auugaaaaaugacuauugcuua

SEQ ID NO: 603748 - RNA, 22 nt, Human
cacugcccagcgucuuaggcac

SEQ ID NO: 603749 - RNA, 16 nt, Human
gcaguaaaaugguuag

SEQ ID NO: 603750 - RNA, 22 nt, Human
gacagcagggacauguaggaag

SEQ ID NO: 603751 - RNA, 22 nt, Human
auuaagaucauuguagaagauu

SEQ ID NO: 603752 - RNA, 22 nt, Human
aagcugcccucauucccagugc

SEQ ID NO: 603753 - RNA, 22 nt, Human
aauaugaauuauuguuacaagu

SEQ ID NO: 603754 - RNA, 22 nt, Human
ccugcugggccugagcaaugag

SEQ ID NO: 603755 - RNA, 22 nt, Human
ggaacauacuguguagacuuug

SEQ ID NO: 603756 - RNA, 23 nt, Human
uccuugagugucccccaagaguc

SEQ ID NO: 603757 - RNA, 22 nt, Human
ucuggaguuuuuucugucugug

SEQ ID NO: 603758 - RNA, 22 nt, Human
gcugagagcaaagcaugucuag

SEQ ID NO: 603759 - RNA, 22 nt, Human
ugcuggaggaguuuacuguggc

SEQ ID NO: 603760 - RNA, 22 nt, Human
ugggccugcuggggcauuuuca

SEQ ID NO: 603761 - RNA, 22 nt, Human
cagggcuguaaauuagugcuga

SEQ ID NO: 603762 - RNA, 22 nt, Human
uugacaaaaaccucauuucacc

SEQ ID NO: 603763 - RNA, 22 nt, Human
agggccaaguccaggaccucgg

SEQ ID NO: 603764 - RNA, 20 nt, Human
gccaggagggugugaugagc

SEQ ID NO: 603765 - RNA, 22 nt, Human
agaaaaaucuuggcgcuugucu

SEQ ID NO: 603766 - RNA, 22 nt, Human
aaaaucuugugacuuaggaagg

SEQ ID NO: 603767 - RNA, 22 nt, Human
uuucuauugaucuaauaaacau

SEQ ID NO: 603768 - RNA, 18 nt, Human
uuaucucuggcaugugcc

SEQ ID NO: 603769 - RNA, 22 nt, Human
ucccugggccuccugcuaugca

SEQ ID NO: 603770 - RNA, 22 nt, Human
auuucacagcugucaguguuac

SEQ ID NO: 603771 - RNA, 18 nt, Human
gagcugagaagaggaugc

SEQ ID NO: 603772 - RNA, 22 nt, Human
caggauggugugagugugagga

SEQ ID NO: 603773 - RNA, 22 nt, Human
uugauaaaaugauaucuucuuu

SEQ ID NO: 603774 - RNA, 22 nt, Human
agcugccuguguagaaccaucu

SEQ ID NO: 603775 - RNA, 22 nt, Human
cagcugccacaccucuuucucu

SEQ ID NO: 603776 - RNA, 22 nt, Human
gagguagccacagauagagacu

SEQ ID NO: 603777 - RNA, 23 nt, Human
ggguccagagacaggcaugggug

SEQ ID NO: 603778 - RNA, 22 nt, Human
gagacaggcagcuaguggguca

SEQ ID NO: 603779 - RNA, 22 nt, Human
cugggagaucuccugagggcag

SEQ ID NO: 603780 - RNA, 22 nt, Human
cuagagaauugucuugagaguu

SEQ ID NO: 603781 - RNA, 22 nt, Human
aaaugcaauuguauguacucca

SEQ ID NO: 603782 - RNA, 22 nt, Human
ggguggaguagaaagaugaauu

SEQ ID NO: 603783 - RNA, 22 nt, Human
guguaacuugcuggaaaaacua

SEQ ID NO: 603784 - RNA, 22 nt, Human
caguccuguguuaaacaagagc

SEQ ID NO: 603785 - RNA, 22 nt, Human
gaugauuuugaugcaguaaaga

SEQ ID NO: 603786 - RNA, 22 nt, Human
ucgucaucugaaggcugucaau

SEQ ID NO: 603787 - RNA, 22 nt, Human
cauuauggaagugaagagcucu

SEQ ID NO: 603788 - RNA, 22 nt, Human
cccugcagagccagcccugacc

SEQ ID NO: 603789 - RNA, 22 nt, Human
ggaaaaggccacagggacacau

SEQ ID NO: 603790 - RNA, 18 nt, Human
agcaguguggcaagcaga

SEQ ID NO: 603791 - RNA, 22 nt, Human
uuggccagacacuaccccccuu

SEQ ID NO: 603792 - RNA, 22 nt, Human
ucagugucuucucuuuccuacc

SEQ ID NO: 603793 - RNA, 17 nt, Human
auuuagcaaguagacag

SEQ ID NO: 603794 - RNA, 22 nt, Human
ucugucacaauuugcuuacucu

SEQ ID NO: 603795 - RNA, 22 nt, Human
gccuggaguucagccaaguccc

SEQ ID NO: 603796 - RNA, 19 nt, Human
gacaggacgaagggaaguu

SEQ ID NO: 603797 - RNA, 22 nt, Human
aggagacacugagacuucacca

SEQ ID NO: 603798 - RNA, 22 nt, Human
gcccuugacaguggcagaagca

SEQ ID NO: 603799 - RNA, 18 nt, Human
uuuuccuuccaccuugaa

SEQ ID NO: 603800 - RNA, 22 nt, Human
cauacauauguggaugucauau

SEQ ID NO: 603801 - RNA, 17 nt, Human
uccaggagaggcaaugg

SEQ ID NO: 603802 - RNA, 22 nt, Human
gcuggcuuuauggggcuugugg

SEQ ID NO: 603803 - RNA, 22 nt, Human
uuuuccuuugauucccagaugu

SEQ ID NO: 603804 - RNA, 22 nt, Human
agcaggugaucgcgugugcucc

SEQ ID NO: 603805 - RNA, 22 nt, Human
uugaaugagaaguuauugccau

SEQ ID NO: 603806 - RNA, 22 nt, Human
uggcauuuaguugcguauugca

SEQ ID NO: 603807 - RNA, 23 nt, Human
ucacacagcuggucagguacaga

SEQ ID NO: 603808 - RNA, 22 nt, Human
aauaaucuugacuacugaauca

SEQ ID NO: 603809 - RNA, 22 nt, Human
cuauuuaucuauuucugaauga

SEQ ID NO: 603810 - RNA, 22 nt, Human
cuuguuuucuaaaacaucauuu

SEQ ID NO: 603811 - RNA, 22 nt, Human
uggcuucugagcauugaaacgu

SEQ ID NO: 603812 - RNA, 22 nt, Human
cacugccuccccaggcuccaca

SEQ ID NO: 603813 - RNA, 22 nt, Human
cuucuggguaauucuucuucau

SEQ ID NO: 603814 - RNA, 22 nt, Human
gcugaggauugaagaguugcca

SEQ ID NO: 603815 - RNA, 22 nt, Human
uuccuaacgccaguauuuucau

SEQ ID NO: 603816 - RNA, 21 nt, Human
uuuuaacaaggauuucccuag

SEQ ID NO: 603817 - RNA, 22 nt, Human
cugaggcugggcuugccuucuu

SEQ ID NO: 603818 - RNA, 22 nt, Human
aggaaacagagugaagcuuggg

SEQ ID NO: 603819 - RNA, 22 nt, Human
ggggcagggagguuaucgccga

SEQ ID NO: 603820 - RNA, 22 nt, Human
acacaaacagucuauagcacca

SEQ ID NO: 603821 - RNA, 22 nt, Human
cauuuauucucagauccuuguc

SEQ ID NO: 603822 - RNA, 22 nt, Human
auacaguggcugugagcugggc

SEQ ID NO: 603823 - RNA, 22 nt, Human
gggauaggaaacuuagguacac

SEQ ID NO: 603824 - RNA, 22 nt, Human
cuuauugugucuuugaauaagu

SEQ ID NO: 603825 - RNA, 22 nt, Human
aggcucugugcauccuccccaa

SEQ ID NO: 603826 - RNA, 22 nt, Human
auacuuuuaauuccuucugagu

SEQ ID NO: 603827 - RNA, 22 nt, Human
uucucuggggacuugguuggag

SEQ ID NO: 603828 - RNA, 22 nt, Human
aggaucugugagugcugcagac

SEQ ID NO: 603829 - RNA, 22 nt, Human
gagaggcugguaaagucugaac

SEQ ID NO: 603830 - RNA, 22 nt, Human
uaccaccucaaccucaucugac

SEQ ID NO: 603831 - RNA, 22 nt, Human
gauuaauucaggaucaggaaau

SEQ ID NO: 603832 - RNA, 19 nt, Human
uccaaagaaguucacauuu

SEQ ID NO: 603833 - RNA, 23 nt, Human
gccaggcacaugguggacacgca

SEQ ID NO: 603834 - RNA, 22 nt, Human
agguacuaccagggauuuucag

SEQ ID NO: 603835 - RNA, 22 nt, Human
uacccagcuucaagucaggacu

SEQ ID NO: 603836 - RNA, 22 nt, Human
uugagaggauggauuagacaaa

SEQ ID NO: 603837 - RNA, 22 nt, Human
ucuuccuauggggcugcaggaa

SEQ ID NO: 603838 - RNA, 21 nt, Human
ccugugugugucccuuuaaga

SEQ ID NO: 603839 - RNA, 22 nt, Human
agggcugcaggcaagauauggc

SEQ ID NO: 603840 - RNA, 22 nt, Human
ucaaaucaccaaacucacuggc

SEQ ID NO: 603841 - RNA, 22 nt, Human
acaugauuuuucuuugacucua

SEQ ID NO: 603842 - RNA, 22 nt, Human
cccuggccagcucaugucugag

SEQ ID NO: 603843 - RNA, 22 nt, Human
aggaagggauacauaggauagu

SEQ ID NO: 603844 - RNA, 22 nt, Human
uuaaaauguacaggggaaagug

SEQ ID NO: 603845 - RNA, 22 nt, Human
uugaccuuggcuuuuaaaauau

SEQ ID NO: 603846 - RNA, 22 nt, Human
ugcagaagcagagaguugccaa

SEQ ID NO: 603847 - RNA, 22 nt, Human
gcuucagacugugcuucuguug

SEQ ID NO: 603848 - RNA, 17 nt, Human
gguucaguucugcauuc

SEQ ID NO: 603849 - RNA, 22 nt, Human
uguuuacagcacugcacacugc

SEQ ID NO: 603850 - RNA, 22 nt, Human
aaagagcuuuagaaaucucaga

SEQ ID NO: 603851 - RNA, 22 nt, Human
guuuuccagguaccuugguauu

SEQ ID NO: 603852 - RNA, 22 nt, Human
ucuccuggccuuuagguuaagg

SEQ ID NO: 603853 - RNA, 17 nt, Human
ucacugggccugcuccc

SEQ ID NO: 603854 - RNA, 22 nt, Human
gagccagggcugugagcugagc

SEQ ID NO: 603855 - RNA, 22 nt, Human
aaaugcagauugucauucagga

SEQ ID NO: 603856 - RNA, 22 nt, Human
auuucaguaguccuuacuugua

SEQ ID NO: 603857 - RNA, 22 nt, Human
ucagucuucccuccagugcaac

SEQ ID NO: 603858 - RNA, 22 nt, Human
uggggccacacaucucuuucua

SEQ ID NO: 603859 - RNA, 22 nt, Human
cagucucuggugaguugacagu

SEQ ID NO: 603860 - RNA, 20 nt, Human
gagagcuggggaugaggcug

SEQ ID NO: 603861 - RNA, 19 nt, Human
ucugcaagugucagaggcg

SEQ ID NO: 603862 - RNA, 22 nt, Human
cagccaggcccagaucaugcug

SEQ ID NO: 603863 - RNA, 22 nt, Human
cugccugcuucugagccagagg

SEQ ID NO: 603864 - RNA, 22 nt, Human
caggaaugccaaccagugcaug

SEQ ID NO: 603865 - RNA, 22 nt, Human
acuuuccuuauggauggggaaa

SEQ ID NO: 603866 - RNA, 22 nt, Human
ugcugcugaucauuuauagucu

SEQ ID NO: 603867 - RNA, 22 nt, Human
acuccagggcuccaucccuugu

SEQ ID NO: 603868 - RNA, 22 nt, Human
gaagcuucguggcucuucaaau

SEQ ID NO: 603869 - RNA, 22 nt, Human
ucacuggaaaugcacagcugua

SEQ ID NO: 603870 - RNA, 22 nt, Human
aaacagcuccuuaguuuccauc

SEQ ID NO: 603871 - RNA, 22 nt, Human
acaguguuuuaugagaauuguu

SEQ ID NO: 603872 - RNA, 22 nt, Human
uguagaugagucagggugcacc

SEQ ID NO: 603873 - RNA, 21 nt, Human
ggccuuccccugcagucuccg

SEQ ID NO: 603874 - RNA, 22 nt, Human
uagaaagaaauucagauuggcu

SEQ ID NO: 603875 - RNA, 22 nt, Human
uuuuaguuuggauuucuaaagc

SEQ ID NO: 603876 - RNA, 22 nt, Human
uggagggaacaaaggaguccca

SEQ ID NO: 603877 - RNA, 22 nt, Human
agugcagggggaaagggugucu

SEQ ID NO: 603878 - RNA, 22 nt, Human
gcugagcaggguggggaaaggc

SEQ ID NO: 603879 - RNA, 22 nt, Human
gcuguggcuguacagagaccau

SEQ ID NO: 603880 - RNA, 17 nt, Human
uggcaugaggguguggg

SEQ ID NO: 603881 - RNA, 22 nt, Human
caagugucuauaucagugcuug

SEQ ID NO: 603882 - RNA, 21 nt, Human
cugcugcuggggucugggcag

SEQ ID NO: 603883 - RNA, 22 nt, Human
guuagugcuuauuaaauaguau

SEQ ID NO: 603884 - RNA, 21 nt, Human
aucugaaaugucaaagcagau

SEQ ID NO: 603885 - RNA, 21 nt, Human
uuucacaaaaguaugugacaa

SEQ ID NO: 603886 - RNA, 22 nt, Human
aacugcuugagauauguuuguc

SEQ ID NO: 603887 - RNA, 22 nt, Human
uuuugcagaaugggaagguagu

SEQ ID NO: 603888 - RNA, 22 nt, Human
accugcagguguuuccacacuu

SEQ ID NO: 603889 - RNA, 23 nt, Human
gcaguguuugcuucaucuuaucc

SEQ ID NO: 603890 - RNA, 23 nt, Human
auuuuacaggucaguuccuugaa

SEQ ID NO: 603891 - RNA, 22 nt, Human
caauuuuacucuuccucuucca

SEQ ID NO: 603892 - RNA, 22 nt, Human
uaugagauaauagauguguaaa

SEQ ID NO: 603893 - RNA, 22 nt, Human
aauccuuauauaaugccuucca

SEQ ID NO: 603894 - RNA, 22 nt, Human
auagagugauguaagguaugug

SEQ ID NO: 603895 - RNA, 22 nt, Human
ugaaguauccaucuuguucuag

SEQ ID NO: 603896 - RNA, 22 nt, Human
gcagccaggaaagcuggacccu

SEQ ID NO: 603897 - RNA, 22 nt, Human
ugggcagauguccucugaagug

SEQ ID NO: 603898 - RNA, 22 nt, Human
ugcagugugaccuguagcgagc

SEQ ID NO: 603899 - RNA, 22 nt, Human
aagaggcugaaugagaaaguac

SEQ ID NO: 603900 - RNA, 22 nt, Human
ccuggagugggguccgugcaug

SEQ ID NO: 603901 - RNA, 22 nt, Human
aacacugucuuauacuucaaug

SEQ ID NO: 603902 - RNA, 22 nt, Human
ugcgggucccagggucacaggc

SEQ ID NO: 603903 - RNA, 23 nt, Human
ccaagcuugucccugccugcuuu

SEQ ID NO: 603904 - RNA, 22 nt, Human
caauagcagaccuagaaagcaa

SEQ ID NO: 603905 - RNA, 22 nt, Human
cuggagcccaggccuggugucu

SEQ ID NO: 603906 - RNA, 22 nt, Human
uggacaggugagugacucaggg

SEQ ID NO: 603907 - RNA, 22 nt, Human
aaucagcaaaugcuuacucagg

SEQ ID NO: 603908 - RNA, 22 nt, Human
gagaaggaugaggaaaugguau

SEQ ID NO: 603909 - RNA, 22 nt, Human
agcucucccauagggcaagauc

SEQ ID NO: 603910 - RNA, 22 nt, Human
uaugcaaaugacugguauguuu

SEQ ID NO: 603911 - RNA, 21 nt, Human
ugcagccucugcccagcagug

SEQ ID NO: 603912 - RNA, 22 nt, Human
gaggcaugcagagcuggagcag

SEQ ID NO: 603913 - RNA, 22 nt, Human
gaaaagggcaagagagagggca

SEQ ID NO: 603914 - RNA, 22 nt, Human
ccucuugauugguuggaagcgg

SEQ ID NO: 603915 - RNA, 22 nt, Human
ucugcagggcccuuggcuccug

SEQ ID NO: 603916 - RNA, 22 nt, Human
auuuucucuuuguauaugcuag

SEQ ID NO: 603917 - RNA, 22 nt, Human
acuagaaaauuccuagaaacua

SEQ ID NO: 603918 - RNA, 22 nt, Human
ugaggccagggauuccaucauu

SEQ ID NO: 603919 - RNA, 22 nt, Human
gacaauaaaaugaucuuacagu

SEQ ID NO: 603920 - RNA, 22 nt, Human
ccagggugagugucauggguua

SEQ ID NO: 603921 - RNA, 22 nt, Human
uggacagggcagagaccgaguc

SEQ ID NO: 603922 - RNA, 22 nt, Human
ugguggggauucccucccuggc

SEQ ID NO: 603923 - RNA, 22 nt, Human
cugugucggacgugggcagcag

SEQ ID NO: 603924 - RNA, 22 nt, Human
uccagggcuuggcugggacggu

SEQ ID NO: 603925 - RNA, 22 nt, Human
uucaagacuccaagaaauuagu

SEQ ID NO: 603926 - RNA, 22 nt, Human
uagaggcuacuagaggcaccug

SEQ ID NO: 603927 - RNA, 22 nt, Human
gaauucuaggguaaauauccua

SEQ ID NO: 603928 - RNA, 22 nt, Human
uucaagguaugguagcugguca

SEQ ID NO: 603929 - RNA, 22 nt, Human
gccugcuucucagucagcuugg

SEQ ID NO: 603930 - RNA, 22 nt, Human
gugaggaugcagaugagggccu

SEQ ID NO: 603931 - RNA, 22 nt, Human
cucaguuuccccggccugggcg

SEQ ID NO: 603932 - RNA, 22 nt, Human
caucagagugguggccuggugu

SEQ ID NO: 603933 - RNA, 21 nt, Human
acauucacaggauauuaucau

SEQ ID NO: 603934 - RNA, 22 nt, Human
aguguguagcauuuggcaggca

SEQ ID NO: 603935 - RNA, 22 nt, Human
ccagggaaaaucaacuucuacu

SEQ ID NO: 603936 - RNA, 22 nt, Human
auggaguuuggggucaaauacu

SEQ ID NO: 603937 - RNA, 22 nt, Human
agcagccacagucugggacagg

SEQ ID NO: 603938 - RNA, 22 nt, Human
guggccagccagggugcugaug

SEQ ID NO: 603939 - RNA, 22 nt, Human
agauauucaaccaaacacuaau

SEQ ID NO: 603940 - RNA, 22 nt, Human
cugcugcccuagacccaguccu

SEQ ID NO: 603941 - RNA, 19 nt, Human
ccugggaggcggagguugc

SEQ ID NO: 603942 - RNA, 22 nt, Human
cagagggucaccaggaagugca

SEQ ID NO: 603943 - RNA, 22 nt, Human
aaggcugaggcuggagaauuac

SEQ ID NO: 603944 - RNA, 22 nt, Human
cccaguggagauaggagugugg

SEQ ID NO: 603945 - RNA, 22 nt, Human
uauguucaucuggugcaucagu

SEQ ID NO: 603946 - RNA, 22 nt, Human
ccagagcccgggaccuggacuu

SEQ ID NO: 603947 - RNA, 22 nt, Human
gcaguguuaccuugggcugguu

SEQ ID NO: 603948 - RNA, 22 nt, Human
uguauuuuuagaccuuuagacc

SEQ ID NO: 603949 - RNA, 22 nt, Human
uuuuguuuucuuagaaaccugg

SEQ ID NO: 603950 - RNA, 22 nt, Human
cugcuuuaauuuagacaaggca

SEQ ID NO: 603951 - RNA, 22 nt, Human
ugggaaggggagcuggaaagga

SEQ ID NO: 603952 - RNA, 22 nt, Human
uuccuggggcgacuguaucuga

SEQ ID NO: 603953 - RNA, 18 nt, Human
cugucuuuuuucucucca

SEQ ID NO: 603954 - RNA, 22 nt, Human
cucaggcucuggccauccaagg

SEQ ID NO: 603955 - RNA, 22 nt, Human
gcugccucccagagcccugcag

SEQ ID NO: 603956 - RNA, 22 nt, Human
cuuucauucuuagauauuagug

SEQ ID NO: 603957 - RNA, 18 nt, Human
uggagccauugccaccau

SEQ ID NO: 603958 - RNA, 22 nt, Human
ccagacaguuccuugagguuca

SEQ ID NO: 603959 - RNA, 22 nt, Human
ugguggaccuggcauugaaccu

SEQ ID NO: 603960 - RNA, 22 nt, Human
agggccugagcucuccuccagu

SEQ ID NO: 603961 - RNA, 22 nt, Human
cuuguuuuggaacagagugaau

SEQ ID NO: 603962 - RNA, 22 nt, Human
uucauugugaacacauucugcc

SEQ ID NO: 603963 - RNA, 17 nt, Human
aaggagcugagagaugg

SEQ ID NO: 603964 - RNA, 22 nt, Human
uaguggggaaggaggacaagaa

SEQ ID NO: 603965 - RNA, 22 nt, Human
gagcaggcauucuaguggcuga

SEQ ID NO: 603966 - RNA, 22 nt, Human
ugagagaugaaguuaguuguuc

SEQ ID NO: 603967 - RNA, 22 nt, Human
uagaacuuugccuuagggcaaa

SEQ ID NO: 603968 - RNA, 22 nt, Human
ucccugcuuucuugugagggga

SEQ ID NO: 603969 - RNA, 22 nt, Human
uggaaugaaggagauggccuuu

SEQ ID NO: 603970 - RNA, 19 nt, Human
aagcaauguugugaaucua

SEQ ID NO: 603971 - RNA, 22 nt, Human
agcuggcugggugccagucucc

SEQ ID NO: 603972 - RNA, 19 nt, Human
uccagccccucugugugug

SEQ ID NO: 603973 - RNA, 22 nt, Human
uggcuaugaggagcgcaggugu

SEQ ID NO: 603974 - RNA, 22 nt, Human
ucaugcuaguuaagaacacaau

SEQ ID NO: 603975 - RNA, 22 nt, Human
acacacacaagcagguugugga

SEQ ID NO: 603976 - RNA, 22 nt, Human
gcuggaguccaguggcaugauc

SEQ ID NO: 603977 - RNA, 22 nt, Human
uucaggaagccuuucuuggucu

SEQ ID NO: 603978 - RNA, 22 nt, Human
gcccugaggauuugcauuuccu

SEQ ID NO: 603979 - RNA, 22 nt, Human
agggaauucacuggaacgcccu

SEQ ID NO: 603980 - RNA, 22 nt, Human
ugaauucuggcucuucuguuua

SEQ ID NO: 603981 - RNA, 22 nt, Human
ugugugaggugguucugagaag

SEQ ID NO: 603982 - RNA, 22 nt, Human
uaaaauguguuucuguaugguu

SEQ ID NO: 603983 - RNA, 22 nt, Human
acuggcuuugagggaauagcua

SEQ ID NO: 603984 - RNA, 22 nt, Human
cuuuacuugcuuuguuacaaaa

SEQ ID NO: 603985 - RNA, 22 nt, Human
gagcugaguagaggcugcuccc

SEQ ID NO: 603986 - RNA, 22 nt, Human
ucacagacacuggguuauugca

SEQ ID NO: 603987 - RNA, 22 nt, Human
uugaaaggccuguuuauccagc

SEQ ID NO: 603988 - RNA, 22 nt, Human
caagauggagaagcagcaaggg

SEQ ID NO: 603989 - RNA, 22 nt, Human
uuucccuuugcacucuacaauu

SEQ ID NO: 603990 - RNA, 22 nt, Human
augcuucuuguauuuggcugac

SEQ ID NO: 603991 - RNA, 22 nt, Human
ugaugccuaugaauuguaaugu

SEQ ID NO: 603992 - RNA, 22 nt, Human
uuauucaucagugcauuaauuu

SEQ ID NO: 603993 - RNA, 22 nt, Human
uccuucaaagcuccuagugagc

SEQ ID NO: 603994 - RNA, 22 nt, Human
cuggcucuguggcuuccuucau

SEQ ID NO: 603995 - RNA, 22 nt, Human
agcaccugcuaugugucaggga

SEQ ID NO: 603996 - RNA, 22 nt, Human
cggggaggcuucggauuaaagc

SEQ ID NO: 603997 - RNA, 22 nt, Human
gcaguguuucagugcuuuuucu

SEQ ID NO: 603998 - RNA, 22 nt, Human
uagggcagccacccaggcugcu

SEQ ID NO: 603999 - RNA, 22 nt, Human
gggugguggccagcagugggca

SEQ ID NO: 604000 - RNA, 22 nt, Human
acuuuuaucaaggaagugaucu

SEQ ID NO: 604001 - RNA, 19 nt, Human
gaaggagagcugaguuagg

SEQ ID NO: 604002 - RNA, 22 nt, Human
gggaagucggguugagcacuua

SEQ ID NO: 604003 - RNA, 22 nt, Human
acauuucuuccuaauuaucccu

SEQ ID NO: 604004 - RNA, 22 nt, Human
cacaggagaacccacagauucu

SEQ ID NO: 604005 - RNA, 22 nt, Human
aguucucaggucagcugagucu

SEQ ID NO: 604006 - RNA, 22 nt, Human
auaacacuaaauguauguaaca

SEQ ID NO: 604007 - RNA, 22 nt, Human
uucuaguucccucuggaaugua

SEQ ID NO: 604008 - RNA, 22 nt, Human
ccagcuggucugugcucauguu

SEQ ID NO: 604009 - RNA, 22 nt, Human
accagaggaggaauuaccuucc

SEQ ID NO: 604010 - RNA, 22 nt, Human
cucccaggccaugcucuagcca

SEQ ID NO: 604011 - RNA, 22 nt, Human
uccuaaaggcugcuuuuauauu

SEQ ID NO: 604012 - RNA, 22 nt, Human
aauaauuuccagccaacuggaa

SEQ ID NO: 604013 - RNA, 22 nt, Human
agccuaggucugggucuagcag

SEQ ID NO: 604014 - RNA, 22 nt, Human
agagcagauuucaaauauuggc

SEQ ID NO: 604015 - RNA, 22 nt, Human
uggaaagguaggauuucaagac

SEQ ID NO: 604016 - RNA, 22 nt, Human
ggggcuggcucacuaagagacu

SEQ ID NO: 604017 - RNA, 22 nt, Human
ccugaggucagccauucuugcc

SEQ ID NO: 604018 - RNA, 22 nt, Human
uugcagaagggcacagugauca

SEQ ID NO: 604019 - RNA, 22 nt, Human
ccuggcuggacuggaccguggc

SEQ ID NO: 604020 - RNA, 22 nt, Human
uggauggggcagcuuaggugug

SEQ ID NO: 604021 - RNA, 19 nt, Human
gccugagccagccaugcaa

SEQ ID NO: 604022 - RNA, 22 nt, Human
cccagugccaggcacaggcagc

SEQ ID NO: 604023 - RNA, 22 nt, Human
ugggccaggucugcggucauuu

SEQ ID NO: 604024 - RNA, 22 nt, Human
ugcucaggucguucugccccuu

SEQ ID NO: 604025 - RNA, 22 nt, Human
gcaggcccuccucuagcaaggc

SEQ ID NO: 604026 - RNA, 22 nt, Human
uagagcugauaaugaggccaag

SEQ ID NO: 604027 - RNA, 22 nt, Human
aagaguuucugggucaaggauu

SEQ ID NO: 604028 - RNA, 22 nt, Human
cucugggguuagaucugaugcu

SEQ ID NO: 604029 - RNA, 22 nt, Human
uuauggagcagacagcugguca

SEQ ID NO: 604030 - RNA, 22 nt, Human
acaguaaaauuaagggcaguua

SEQ ID NO: 604031 - RNA, 22 nt, Human
acccaggauaaucuguguaucu

SEQ ID NO: 604032 - RNA, 22 nt, Human
acaaugaauaucaugaaguacu

SEQ ID NO: 604033 - RNA, 22 nt, Human
guaagaggaucaaggcggugca

SEQ ID NO: 604034 - RNA, 22 nt, Human
caggugucuaauucucaccccc

SEQ ID NO: 604035 - RNA, 22 nt, Human
cugugacuuccacuacugauca

SEQ ID NO: 604036 - RNA, 22 nt, Human
aucugacaaggccacauauucu

SEQ ID NO: 604037 - RNA, 22 nt, Human
ugagcagaggagugacguaggu

SEQ ID NO: 604038 - RNA, 22 nt, Human
ugggaagacuccucaggaggcg

SEQ ID NO: 604039 - RNA, 22 nt, Human
auagaauguauuauaguacaga

SEQ ID NO: 604040 - RNA, 20 nt, Human
ugcugaggccugaggccugg

SEQ ID NO: 604041 - RNA, 22 nt, Human
aggggcugccuggcuuggcacu

SEQ ID NO: 604042 - RNA, 22 nt, Human
cuggggcaucugacagauaaau

SEQ ID NO: 604043 - RNA, 18 nt, Human
ccugucugggguccccac

SEQ ID NO: 604044 - RNA, 22 nt, Human
augacaaaaugaaugcagcuag

SEQ ID NO: 604045 - RNA, 22 nt, Human
agggacuggcucucugagcagg

SEQ ID NO: 604046 - RNA, 20 nt, Human
ugccugccccugcuuuuucc

SEQ ID NO: 604047 - RNA, 22 nt, Human
ccugaagggacuccagagagca

SEQ ID NO: 604048 - RNA, 22 nt, Human
cuacauuuguucuauagcuuuu

SEQ ID NO: 604049 - RNA, 18 nt, Human
cccagaggaaugccugga

SEQ ID NO: 604050 - RNA, 19 nt, Human
ccaccccuuugcugggccc

SEQ ID NO: 604051 - RNA, 20 nt, Human
uccucagaagacauuugggg

SEQ ID NO: 604052 - RNA, 22 nt, Human
ugcauauuauaaagagaauuag

SEQ ID NO: 604053 - RNA, 22 nt, Human
uuucauauuauuccuugagucu

SEQ ID NO: 604054 - RNA, 22 nt, Human
aaauguaccuugauaguuuggu

SEQ ID NO: 604055 - RNA, 22 nt, Human
agagcacagugcaggauccccg

SEQ ID NO: 604056 - RNA, 22 nt, Human
ucaggcugaaaggacuccaguu

SEQ ID NO: 604057 - RNA, 22 nt, Human
gauuagcucuagaucugggcua

SEQ ID NO: 604058 - RNA, 22 nt, Human
aauguauucugggaaaauguua

SEQ ID NO: 604059 - RNA, 22 nt, Human
uuggcauugaaguuucauuggu

SEQ ID NO: 604060 - RNA, 22 nt, Human
ucaguucuugggcugcuaggac

SEQ ID NO: 604061 - RNA, 22 nt, Human
aaaugguagguuuucuuaagaa

SEQ ID NO: 604062 - RNA, 22 nt, Human
ccccagcucagugcagggacau

SEQ ID NO: 604063 - RNA, 22 nt, Human
gggccagcaguaucggaggcau

SEQ ID NO: 604064 - RNA, 22 nt, Human
auauaaagaaguggaaaaugag

SEQ ID NO: 604065 - RNA, 22 nt, Human
cagaccagccauuugccucuuc

SEQ ID NO: 604066 - RNA, 22 nt, Human
acagaguaucuaucaggaguau

SEQ ID NO: 604067 - RNA, 22 nt, Human
uaggaaaugcuccauugcauaa

SEQ ID NO: 604068 - RNA, 22 nt, Human
cagcucuguucauagauggugc

SEQ ID NO: 604069 - RNA, 22 nt, Human
uggagguguccaacucgugggu

SEQ ID NO: 604070 - RNA, 22 nt, Human
ugggaagauggagugacaggca

SEQ ID NO: 604071 - RNA, 23 nt, Human
uuucacagaaggauuguagggcc

SEQ ID NO: 604072 - RNA, 22 nt, Human
agcacuguuaugggaugacuua

SEQ ID NO: 604073 - RNA, 22 nt, Human
uguuuuaagagcgcacuuuaua

SEQ ID NO: 604074 - RNA, 22 nt, Human
agagagguuugcuggaagauuc

SEQ ID NO: 604075 - RNA, 22 nt, Human
ugcauuaaaaugugccucucuu

SEQ ID NO: 604076 - RNA, 22 nt, Human
gcccucucggcauagcaggggc

SEQ ID NO: 604077 - RNA, 19 nt, Human
caguccuuuccgcuuucuc

SEQ ID NO: 604078 - RNA, 22 nt, Human
gccuggagcucaugugggcauu

SEQ ID NO: 604079 - RNA, 22 nt, Human
gucuuauuuaaggcuuauacaa

SEQ ID NO: 604080 - RNA, 22 nt, Human
ccuguacaucugcucucauugc

SEQ ID NO: 604081 - RNA, 22 nt, Human
acccuggguucccgcagcacca

SEQ ID NO: 604082 - RNA, 22 nt, Human
aauguuuaauguuagugguaau

SEQ ID NO: 604083 - RNA, 22 nt, Human
gaaaucuuccaauggucacauc

SEQ ID NO: 604084 - RNA, 17 nt, Human
ugucuucugaagagagc

SEQ ID NO: 604085 - RNA, 22 nt, Human
ccagagcugaggagaugggcuu

SEQ ID NO: 604086 - RNA, 22 nt, Human
accaggaggccuggagcacaaa

SEQ ID NO: 604087 - RNA, 22 nt, Human
uucucaugaaacucgcuuccuc

SEQ ID NO: 604088 - RNA, 22 nt, Human
gaagcacugugcugcuaaguug

SEQ ID NO: 604089 - RNA, 22 nt, Human
aaagacugggacugcagcaggc

SEQ ID NO: 604090 - RNA, 22 nt, Human
gugaaauauuuuguuuauguca

SEQ ID NO: 604091 - RNA, 22 nt, Human
acagaacaacaagguggaccag

SEQ ID NO: 604092 - RNA, 22 nt, Human
uuauuauaaugagggauaaaaa

SEQ ID NO: 604093 - RNA, 22 nt, Human
agacagggagggagcgcggcug

SEQ ID NO: 604094 - RNA, 22 nt, Human
cagccagagaggaaggaaugca

SEQ ID NO: 604095 - RNA, 22 nt, Human
aagagagaacucccuucgccag

SEQ ID NO: 604096 - RNA, 19 nt, Human
agucccaggcccgaaagag

SEQ ID NO: 604097 - RNA, 22 nt, Human
aaaguguuuacauugcuauaag

SEQ ID NO: 604098 - RNA, 22 nt, Human
cugcagagaauuguggggcuuc

SEQ ID NO: 604099 - RNA, 22 nt, Human
cugacacacugagcauuugaua

SEQ ID NO: 604100 - RNA, 22 nt, Human
ucugccuguggauacaugcucu

SEQ ID NO: 604101 - RNA, 22 nt, Human
aaugauggauuuagacaagcug

SEQ ID NO: 604102 - RNA, 22 nt, Human
agccccaggcccggacgccucu

SEQ ID NO: 604103 - RNA, 22 nt, Human
agagagcugacuuuggagucag

SEQ ID NO: 604104 - RNA, 22 nt, Human
agcugccccaugagaggcaggu

SEQ ID NO: 604105 - RNA, 22 nt, Human
agccacugugagaggaccaggg

SEQ ID NO: 604106 - RNA, 22 nt, Human
cauaaaguagcagagcaugacu

SEQ ID NO: 604107 - RNA, 20 nt, Human
agaggcuuccuugggaggag

SEQ ID NO: 604108 - RNA, 22 nt, Human
cuguuaucaucaggaggggaua

SEQ ID NO: 604109 - RNA, 18 nt, Human
agggagagaccgcggguc

SEQ ID NO: 604110 - RNA, 22 nt, Human
uuauucacucauuaaagcagga

SEQ ID NO: 604111 - RNA, 18 nt, Human
agcucucccccacaugcc

SEQ ID NO: 604112 - RNA, 22 nt, Human
guuccuaaccagcagagaaaca

SEQ ID NO: 604113 - RNA, 22 nt, Human
ggccugagggugggcucucagu

SEQ ID NO: 604114 - RNA, 18 nt, Human
cucucuuuccacucuuug

SEQ ID NO: 604115 - RNA, 22 nt, Human
uagaaagcguuaaaucuacaga

SEQ ID NO: 604116 - RNA, 22 nt, Human
ggcucaggcuggagugcagugg

SEQ ID NO: 604117 - RNA, 19 nt, Human
aggggcacugucucuagag

SEQ ID NO: 604118 - RNA, 22 nt, Human
acacaggagauauguaauggcu

SEQ ID NO: 604119 - RNA, 22 nt, Human
ucagaagcagaaaauagguggg

SEQ ID NO: 604120 - RNA, 22 nt, Human
uacagaagcugagacacugaga

SEQ ID NO: 604121 - RNA, 22 nt, Human
ucuggaguccagauccauuugg

SEQ ID NO: 604122 - RNA, 22 nt, Human
auuaauuuuucugacagccaca

SEQ ID NO: 604123 - RNA, 22 nt, Human
auaugacagcggauucacauau

SEQ ID NO: 604124 - RNA, 22 nt, Human
aaggcagagauuagcagaauga

SEQ ID NO: 604125 - RNA, 22 nt, Human
gcugucuggcauggcguggcug

SEQ ID NO: 604126 - RNA, 22 nt, Human
augcauuuguaaaauauaaucg

SEQ ID NO: 604127 - RNA, 22 nt, Human
uggcacagacugggccaaggaa

SEQ ID NO: 604128 - RNA, 22 nt, Human
aaaagagaauccuguacagaga

SEQ ID NO: 604129 - RNA, 22 nt, Human
cugaggcaguuuaauuuuugaa

SEQ ID NO: 604130 - RNA, 22 nt, Human
caguccagcucaucaguggcac

SEQ ID NO: 604131 - RNA, 22 nt, Human
ccugaggauuguuggugcuucc

SEQ ID NO: 604132 - RNA, 22 nt, Human
cuuuguuuauauuucuccucga

SEQ ID NO: 604133 - RNA, 22 nt, Human
guacauaaaggaggcucuuugc

SEQ ID NO: 604134 - RNA, 22 nt, Human
gcagagcucaugccugcaccuc

SEQ ID NO: 604135 - RNA, 22 nt, Human
aaauguucuacuuugauaauua

SEQ ID NO: 604136 - RNA, 23 nt, Human
aaagcaaggaauuggcaacagag

SEQ ID NO: 604137 - RNA, 22 nt, Human
gcccucagugaccacugauuca

SEQ ID NO: 604138 - RNA, 22 nt, Human
gaagaaauugaauucaugagcu

SEQ ID NO: 604139 - RNA, 22 nt, Human
gggugggccugucuggccaugu

SEQ ID NO: 604140 - RNA, 22 nt, Human
ucuccaggugacucugauguau

SEQ ID NO: 604141 - RNA, 22 nt, Human
ggcuguaguuaccugaugaaau

SEQ ID NO: 604142 - RNA, 22 nt, Human
uuucuauucuggaucuguggca

SEQ ID NO: 604143 - RNA, 22 nt, Human
uccuguccucugggugccccau

SEQ ID NO: 604144 - RNA, 22 nt, Human
ugggagaagcauggggugcaga

SEQ ID NO: 604145 - RNA, 22 nt, Human
uugggcagcauugcaguucccu

SEQ ID NO: 604146 - RNA, 22 nt, Human
cagcuuccacagacuuggcucg

SEQ ID NO: 604147 - RNA, 22 nt, Human
ugagaggaacaggcaguagguu

SEQ ID NO: 604148 - RNA, 22 nt, Human
cuggugucugcucccucacagc

SEQ ID NO: 604149 - RNA, 22 nt, Human
agccaguuuaagcaggaggggu

SEQ ID NO: 604150 - RNA, 22 nt, Human
aagccacugagauuucacugca

SEQ ID NO: 604151 - RNA, 22 nt, Human
ccuggcugcccauggacccucu

SEQ ID NO: 604152 - RNA, 22 nt, Human
ucugucucaaguucuugcacuc

SEQ ID NO: 604153 - RNA, 22 nt, Human
cuugucugugucggauaaaacu

SEQ ID NO: 604154 - RNA, 22 nt, Human
ugggaagaguuagagacagcug

SEQ ID NO: 604155 - RNA, 22 nt, Human
guuauuaucuugaggaaucugu

SEQ ID NO: 604156 - RNA, 22 nt, Human
uugaggucuguguaggcagcaa

SEQ ID NO: 604157 - RNA, 22 nt, Human
aggcccagcuugaagugggaag

SEQ ID NO: 604158 - RNA, 22 nt, Human
aguuucuauuuucaugucuguu

SEQ ID NO: 604159 - RNA, 22 nt, Human
ucaugcaaucucuuguucagga

SEQ ID NO: 604160 - RNA, 19 nt, Human
uccaauuucuauucauguu

SEQ ID NO: 604161 - RNA, 20 nt, Human
uucauucauuccacaacuuc

SEQ ID NO: 604162 - RNA, 22 nt, Human
uuauuucauugauuucuaagac

SEQ ID NO: 604163 - RNA, 22 nt, Human
aaacagcugcaguacacggccu

SEQ ID NO: 604164 - RNA, 19 nt, Human
agcaggcagguggcccagg

SEQ ID NO: 604165 - RNA, 22 nt, Human
ucugucuccucugaggugccag

SEQ ID NO: 604166 - RNA, 22 nt, Human
cagcauggugccagugagucca

SEQ ID NO: 604167 - RNA, 22 nt, Human
ucaagaaacugugcuacagagu

SEQ ID NO: 604168 - RNA, 22 nt, Human
ugaaggaaugaguauacuguuu

SEQ ID NO: 604169 - RNA, 19 nt, Human
ugaggccagcuggcauuuu

SEQ ID NO: 604170 - RNA, 22 nt, Human
uccugcuggacucugaguacaa

SEQ ID NO: 604171 - RNA, 21 nt, Human
ccuguggucuggagggagcac

SEQ ID NO: 604172 - RNA, 22 nt, Human
gcaagauuucuuuuaggugaag

SEQ ID NO: 604173 - RNA, 22 nt, Human
gaggaagaagcaaaccagcuaa

SEQ ID NO: 604174 - RNA, 22 nt, Human
agacuuuaucccuguuuuucuc

SEQ ID NO: 604175 - RNA, 22 nt, Human
acagaguaggugcucaguaaau

SEQ ID NO: 604176 - RNA, 22 nt, Human
gggaguggauuauguggaccca

SEQ ID NO: 604177 - RNA, 22 nt, Human
gcugcagagggaggggcucgca

SEQ ID NO: 604178 - RNA, 22 nt, Human
ccuggcccuggaauagggcagg

SEQ ID NO: 604179 - RNA, 22 nt, Human
uguugcugacaagagaggagca

SEQ ID NO: 604180 - RNA, 22 nt, Human
augaaagugaagguuuacuaag

SEQ ID NO: 604181 - RNA, 21 nt, Human
uccuugcuauuuuccucagcu

SEQ ID NO: 604182 - RNA, 22 nt, Human
ccuggccacagggcucugcauu

SEQ ID NO: 604183 - RNA, 22 nt, Human
gggagugguugauggugaaaau

SEQ ID NO: 604184 - RNA, 22 nt, Human
ucaauauucuucuuuaguagga

SEQ ID NO: 604185 - RNA, 21 nt, Human
cugcaagacaugcuguucuug

SEQ ID NO: 604186 - RNA, 22 nt, Human
agcuacaacuuuuccaugagca

SEQ ID NO: 604187 - RNA, 22 nt, Human
cacauuuaauccuuuauaagua

SEQ ID NO: 604188 - RNA, 22 nt, Human
ugacaaagugaggucuucagua

SEQ ID NO: 604189 - RNA, 22 nt, Human
uccuccagcuguauccugccug

SEQ ID NO: 604190 - RNA, 22 nt, Human
gagcuuccagagacaucagagu

SEQ ID NO: 604191 - RNA, 20 nt, Human
caggcuccgcaggacuaggg

SEQ ID NO: 604192 - RNA, 22 nt, Human
uagaacuucuuacagcuaaguu

SEQ ID NO: 604193 - RNA, 22 nt, Human
uccugggacucugccucaggcu

SEQ ID NO: 604194 - RNA, 22 nt, Human
gccuggaguuguggugaagcca

SEQ ID NO: 604195 - RNA, 22 nt, Human
caaauuccucagaaucagaaaa

SEQ ID NO: 604196 - RNA, 22 nt, Human
aacauggcucaugagagauuug

SEQ ID NO: 604197 - RNA, 22 nt, Human
ucaucugaccccaucuauucuc

SEQ ID NO: 604198 - RNA, 22 nt, Human
aaacuuuuccugcucuuguccu

SEQ ID NO: 604199 - RNA, 22 nt, Human
cuuugaaaacuuaaauaacagc

SEQ ID NO: 604200 - RNA, 23 nt, Human
agacccagagacuggcucugcuc

SEQ ID NO: 604201 - RNA, 22 nt, Human
ugugagaagggugaggcuuuua

SEQ ID NO: 604202 - RNA, 22 nt, Human
ggcugggaggccgugcugaccu

SEQ ID NO: 604203 - RNA, 22 nt, Human
aagggcugccagggggugccag

SEQ ID NO: 604204 - RNA, 22 nt, Human
cagaagcauuccagcaaauagu

SEQ ID NO: 604205 - RNA, 22 nt, Human
aggcgugguugaggcgagcaua

SEQ ID NO: 604206 - RNA, 22 nt, Human
ugagggcuaaauuguggcaggu

SEQ ID NO: 604207 - RNA, 22 nt, Human
uuauauaaagauaacuuuucuu

SEQ ID NO: 604208 - RNA, 22 nt, Human
aaauuucaagcaaaguagcuau

SEQ ID NO: 604209 - RNA, 22 nt, Human
ugauuucucuuggcaauauguu

SEQ ID NO: 604210 - RNA, 22 nt, Human
aggaugagagauacauggagca

SEQ ID NO: 604211 - RNA, 22 nt, Human
aagcaauguguuugaaaggcca

SEQ ID NO: 604212 - RNA, 22 nt, Human
ggcuguggcagcuggaaguggu

SEQ ID NO: 604213 - RNA, 22 nt, Human
aucaggaaauacuuauuuauaa

SEQ ID NO: 604214 - RNA, 22 nt, Human
augggcuggggaagcucacucc

SEQ ID NO: 604215 - RNA, 22 nt, Human
uuuuggcagauuacuuaauaug

SEQ ID NO: 604216 - RNA, 22 nt, Human
gggcagguguuuccaaggugag

SEQ ID NO: 604217 - RNA, 22 nt, Human
uccuucuauuuguuuauguggc

SEQ ID NO: 604218 - RNA, 23 nt, Human
aauuugguugaugaaagcauugu

SEQ ID NO: 604219 - RNA, 22 nt, Human
cugcaggcccccuuccuggagu

SEQ ID NO: 604220 - RNA, 22 nt, Human
caugaguuuuuuaguucaugca

SEQ ID NO: 604221 - RNA, 22 nt, Human
agggccugggucuguacuccuc

SEQ ID NO: 604222 - RNA, 22 nt, Human
uauuccaacugucauagucaua

SEQ ID NO: 604223 - RNA, 22 nt, Human
auggaacaagaacucagauuua

SEQ ID NO: 604224 - RNA, 22 nt, Human
augccaaguacaggcacugcuc

SEQ ID NO: 604225 - RNA, 22 nt, Human
acauuucaguaaguguuaauuu

SEQ ID NO: 604226 - RNA, 22 nt, Human
ugugucugcccuuaguacaucu

SEQ ID NO: 604227 - RNA, 22 nt, Human
uacaugaauguuucaauauugu

SEQ ID NO: 604228 - RNA, 22 nt, Human
cccacagggcugcugauggcag

SEQ ID NO: 604229 - RNA, 22 nt, Human
gcacccaggcuugggcagcaac

SEQ ID NO: 604230 - RNA, 22 nt, Human
agggaugacucuuggcugauuc

SEQ ID NO: 604231 - RNA, 22 nt, Human
augcaguaaauguucuaguuug

SEQ ID NO: 604232 - RNA, 22 nt, Human
gcaccuuggcuuucuugguggc

SEQ ID NO: 604233 - RNA, 22 nt, Human
guggccagaaccaggagaauga

SEQ ID NO: 604234 - RNA, 22 nt, Human
ggcagccagagggcagcuggau

SEQ ID NO: 604235 - RNA, 22 nt, Human
cagcagagcugggcuuugaauu

SEQ ID NO: 604236 - RNA, 22 nt, Human
acauuucucaucuaguagagua

SEQ ID NO: 604237 - RNA, 22 nt, Human
caggggcugugggcggagccuc

SEQ ID NO: 604238 - RNA, 22 nt, Human
gagaagcaaucaguggccaccc

SEQ ID NO: 604239 - RNA, 22 nt, Human
uaugcuuugguagagaguugug

SEQ ID NO: 604240 - RNA, 22 nt, Human
gggcugagagugacuguucugu

SEQ ID NO: 604241 - RNA, 22 nt, Human
agaauguagucuuggagauuua

SEQ ID NO: 604242 - RNA, 22 nt, Human
aaauacugcugcuauuccuuuu

SEQ ID NO: 604243 - RNA, 22 nt, Human
uuucuccuugugucuccuuuga

SEQ ID NO: 604244 - RNA, 22 nt, Human
ccuguacaagagccaucuggau

SEQ ID NO: 604245 - RNA, 22 nt, Human
ccagggaagucacauugucuag

SEQ ID NO: 604246 - RNA, 22 nt, Human
ucugaguuuaggaccaggcuga

SEQ ID NO: 604247 - RNA, 22 nt, Human
auauacaguauguacugugguu

SEQ ID NO: 604248 - RNA, 22 nt, Human
guacaauagcaguuuucccuuu

SEQ ID NO: 604249 - RNA, 22 nt, Human
gcccacagucuaucaguuugcg

SEQ ID NO: 604250 - RNA, 22 nt, Human
auguuacuuagaauaauucugg

SEQ ID NO: 604251 - RNA, 17 nt, Human
ugagcaguagaagaugc

SEQ ID NO: 604252 - RNA, 22 nt, Human
acaugcauacacguacauaccu

SEQ ID NO: 604253 - RNA, 23 nt, Human
agacaaaagccucagucuuaggc

SEQ ID NO: 604254 - RNA, 22 nt, Human
cucugccaccaugcuuccugac

SEQ ID NO: 604255 - RNA, 22 nt, Human
ucacaguuuccauaggucagca

SEQ ID NO: 604256 - RNA, 22 nt, Human
aguggaaggucaggggacagug

SEQ ID NO: 604257 - RNA, 22 nt, Human
augcauaucacagucuccaugu

SEQ ID NO: 604258 - RNA, 18 nt, Human
aagaggaggaaacccagg

SEQ ID NO: 604259 - RNA, 22 nt, Human
agcugguggauuaugcuguaca

SEQ ID NO: 604260 - RNA, 23 nt, Human
cuuucauugugguuucacagagc

SEQ ID NO: 604261 - RNA, 22 nt, Human
uugggcagguguggcucuccuu

SEQ ID NO: 604262 - RNA, 22 nt, Human
gccacagcuccagucaggugac

SEQ ID NO: 604263 - RNA, 22 nt, Human
ggcccagugcuguucacccagu

SEQ ID NO: 604264 - RNA, 22 nt, Human
ugagguagguggugaaaaauga

SEQ ID NO: 604265 - RNA, 22 nt, Human
uugcugagcaguguuuaauugu

SEQ ID NO: 604266 - RNA, 19 nt, Human
aucauccugggucaugcac

SEQ ID NO: 604267 - RNA, 22 nt, Human
uggguggcacuucuggggucca

SEQ ID NO: 604268 - RNA, 22 nt, Human
cucugugugguccucuguauug

SEQ ID NO: 604269 - RNA, 22 nt, Human
uugauucugauccuuugcuagc

SEQ ID NO: 604270 - RNA, 22 nt, Human
ggcaggugaucuagagucaaua

SEQ ID NO: 604271 - RNA, 22 nt, Human
ccuuccaggagucucugcaggu

SEQ ID NO: 604272 - RNA, 22 nt, Human
aaguuacacagaguuggaggcu

SEQ ID NO: 604273 - RNA, 22 nt, Human
gucauuauaccauuauaauugu

SEQ ID NO: 604274 - RNA, 22 nt, Human
uaguauuuaaucacuuuugucu

SEQ ID NO: 604275 - RNA, 22 nt, Human
uccaugggaagauuuugagugg

SEQ ID NO: 604276 - RNA, 22 nt, Human
cccaggaggaggaaaaagcucg

SEQ ID NO: 604277 - RNA, 22 nt, Human
gcuuuuucaaaugaaagcuggu

SEQ ID NO: 604278 - RNA, 22 nt, Human
gaggccacuuccuacuggagga

SEQ ID NO: 604279 - RNA, 23 nt, Human
auggggcucaacacuuaguagcu

SEQ ID NO: 604280 - RNA, 22 nt, Human
ccucagaagacuuuagggaaga

SEQ ID NO: 604281 - RNA, 22 nt, Human
gagcauggaucaugugcugggu

SEQ ID NO: 604282 - RNA, 22 nt, Human
ugggccuccuuuccauucagag

SEQ ID NO: 604283 - RNA, 22 nt, Human
gccugccuagaauugcagcuuu

SEQ ID NO: 604284 - RNA, 22 nt, Human
gggccugcagguucugagaggc

SEQ ID NO: 604285 - RNA, 22 nt, Human
agagaacauauuuuguaugauu

SEQ ID NO: 604286 - RNA, 22 nt, Human
cugagauggccacugggucuca

SEQ ID NO: 604287 - RNA, 22 nt, Human
caggccacgccccggcguguga

SEQ ID NO: 604288 - RNA, 22 nt, Human
cugggugucaggagacaugaug

SEQ ID NO: 604289 - RNA, 22 nt, Human
cacuuggaggcccccugugccc

SEQ ID NO: 604290 - RNA, 20 nt, Human
gcagucugucacagagcaug

SEQ ID NO: 604291 - RNA, 22 nt, Human
ugcuacauaggauagcucaaau

SEQ ID NO: 604292 - RNA, 22 nt, Human
uuucugccuuaucuuugcugag

SEQ ID NO: 604293 - RNA, 21 nt, Human
guuuguaaggcacuguguucu

SEQ ID NO: 604294 - RNA, 22 nt, Human
aaaggcaguggguauguggauc

SEQ ID NO: 604295 - RNA, 22 nt, Human
gaguggggcgaagucggcgagu

SEQ ID NO: 604296 - RNA, 22 nt, Human
ugucccaguuggguauugaauu

SEQ ID NO: 604297 - RNA, 22 nt, Human
uacaguagaaucuuauagccca

SEQ ID NO: 604298 - RNA, 22 nt, Human
uucccagaggcaaagucuggau

SEQ ID NO: 604299 - RNA, 22 nt, Human
acaggaguggagaggugccucu

SEQ ID NO: 604300 - RNA, 22 nt, Human
cccuccagcucaaagcaaccgg

SEQ ID NO: 604301 - RNA, 22 nt, Human
accagggcacauuccggccaga

SEQ ID NO: 604302 - RNA, 22 nt, Human
aggccuagaggaauggccaggg

SEQ ID NO: 604303 - RNA, 22 nt, Human
ugaggaagugguuguaugguuu

SEQ ID NO: 604304 - RNA, 22 nt, Human
cugccaaggcuggggaggacaa

SEQ ID NO: 604305 - RNA, 22 nt, Human
auuagcuuaggcaugaagagaa

SEQ ID NO: 604306 - RNA, 22 nt, Human
ugccaccaucuggcuguguuga

SEQ ID NO: 604307 - RNA, 22 nt, Human
gguaggcacuggugggaagaga

SEQ ID NO: 604308 - RNA, 22 nt, Human
ucugcugaccuuucucugacac

SEQ ID NO: 604309 - RNA, 22 nt, Human
aucuguaauuuugaaugcaaau

SEQ ID NO: 604310 - RNA, 22 nt, Human
uauuuccuguggauacuuuuag

SEQ ID NO: 604311 - RNA, 22 nt, Human
ucucacagcaggggccaggucu

SEQ ID NO: 604312 - RNA, 22 nt, Human
ccagagagaaaauggagggcca

SEQ ID NO: 604313 - RNA, 22 nt, Human
ucaccacugaacagaccuuugg

SEQ ID NO: 604314 - RNA, 22 nt, Human
aacuguaagacaaaugacuucu

SEQ ID NO: 604315 - RNA, 22 nt, Human
guauacagauacuuagacgugc

SEQ ID NO: 604316 - RNA, 22 nt, Human
ucugucacuauuggccagaaca

SEQ ID NO: 604317 - RNA, 21 nt, Human
aggugccaaggagaagcaggc

SEQ ID NO: 604318 - RNA, 22 nt, Human
uggcaggggaggugcuugcuua

SEQ ID NO: 604319 - RNA, 22 nt, Human
uuaauuacuaagcacaaugcaa

SEQ ID NO: 604320 - RNA, 22 nt, Human
ccucuggggugagugggccacu

SEQ ID NO: 604321 - RNA, 22 nt, Human
agugacaaggccugaagcuccu

SEQ ID NO: 604322 - RNA, 22 nt, Human
acacugagauuuuccugacacc

SEQ ID NO: 604323 - RNA, 22 nt, Human
uccugggagcauggugccguga

SEQ ID NO: 604324 - RNA, 22 nt, Human
caguccugcccaggcugacaga

SEQ ID NO: 604325 - RNA, 22 nt, Human
ugcugaauaagacguggcuugu

SEQ ID NO: 604326 - RNA, 22 nt, Human
guggcagggcaaugcucccucu

SEQ ID NO: 604327 - RNA, 22 nt, Human
cauuugcaagagauaaauguuu

SEQ ID NO: 604328 - RNA, 22 nt, Human
cuucugaucuggauuccuaacu

SEQ ID NO: 604329 - RNA, 21 nt, Human
acagccugucaucucaugguc

SEQ ID NO: 604330 - RNA, 22 nt, Human
augaaauauucuuugguaagaa

SEQ ID NO: 604331 - RNA, 22 nt, Human
gccuguguggaugcgccggugc

SEQ ID NO: 604332 - RNA, 22 nt, Human
agggccuggcgcguggccgccg

SEQ ID NO: 604333 - RNA, 22 nt, Human
ucucccucucagauuuauucac

SEQ ID NO: 604334 - RNA, 22 nt, Human
uguucacauguacaugaauauu

SEQ ID NO: 604335 - RNA, 22 nt, Human
gcacugccaucaaugcaugaca

SEQ ID NO: 604336 - RNA, 22 nt, Human
cgcugcagaugggagcugguug

SEQ ID NO: 604337 - RNA, 22 nt, Human
aauaguguuugaagcaugauag

SEQ ID NO: 604338 - RNA, 22 nt, Human
uuuaccauccucuuuuagaauu

SEQ ID NO: 604339 - RNA, 22 nt, Human
aaauauugguaggaugcuuguu

SEQ ID NO: 604340 - RNA, 22 nt, Human
gccugcagugagugcagaaggu

SEQ ID NO: 604341 - RNA, 22 nt, Human
uccugaagucacaggcucugag

SEQ ID NO: 604342 - RNA, 22 nt, Human
aguucucgagcgucccuguuuc

SEQ ID NO: 604343 - RNA, 19 nt, Human
ugugacaucacugggcagc

SEQ ID NO: 604344 - RNA, 22 nt, Human
ugcugaggaauuugguuuaugu

SEQ ID NO: 604345 - RNA, 22 nt, Human
ucacacacauggauaguauuuu

SEQ ID NO: 604346 - RNA, 22 nt, Human
ggguuaggucccucccuucugg

SEQ ID NO: 604347 - RNA, 22 nt, Human
ugucucugucucccagguugug

SEQ ID NO: 604348 - RNA, 22 nt, Human
uuuccuaaucccaaugacauuu

SEQ ID NO: 604349 - RNA, 22 nt, Human
auucuagaaggcaaagcaaggg

SEQ ID NO: 604350 - RNA, 22 nt, Human
gcugugcugauucauucccugc

SEQ ID NO: 604351 - RNA, 20 nt, Human
cugcuuaaguaagugacaca

SEQ ID NO: 604352 - RNA, 22 nt, Human
acuagucauuuaggugauauua

SEQ ID NO: 604353 - RNA, 22 nt, Human
gagcugggacuuggaauccaca

SEQ ID NO: 604354 - RNA, 22 nt, Human
acugagguagggcacaccuagg

SEQ ID NO: 604355 - RNA, 22 nt, Human
agcugccacagagccuggccag

SEQ ID NO: 604356 - RNA, 22 nt, Human
gggacuggcacagggcugggag

SEQ ID NO: 604357 - RNA, 22 nt, Human
uguaagauaugaguacauguaa

SEQ ID NO: 604358 - RNA, 22 nt, Human
uuacuguagcuugacauauguc

SEQ ID NO: 604359 - RNA, 22 nt, Human
guuggugaugccacacauauuu

SEQ ID NO: 604360 - RNA, 22 nt, Human
gggucagcgauuucaggggcag

SEQ ID NO: 604361 - RNA, 20 nt, Human
ugcaguuugucaagguuccu

SEQ ID NO: 604362 - RNA, 22 nt, Human
cagcggaggacagaugggagcu

SEQ ID NO: 604363 - RNA, 22 nt, Human
aggucugaguauggccugagaa

SEQ ID NO: 604364 - RNA, 22 nt, Human
gggccugggaacuugcauuuag

SEQ ID NO: 604365 - RNA, 22 nt, Human
agggcagagaaauguaguugag

SEQ ID NO: 604366 - RNA, 22 nt, Human
uccuuauagcccaagugaugga

SEQ ID NO: 604367 - RNA, 22 nt, Human
uguaggaguccaaucaggagac

SEQ ID NO: 604368 - RNA, 22 nt, Human
aaauugcauucuugucuugaua

SEQ ID NO: 604369 - RNA, 17 nt, Human
accagccucuccugggg

SEQ ID NO: 604370 - RNA, 22 nt, Human
ggggacgggacuuagcaugagu

SEQ ID NO: 604371 - RNA, 23 nt, Human
ggacacugugcagaugcuagugc

SEQ ID NO: 604372 - RNA, 22 nt, Human
gaugcauguauggagugagggu

SEQ ID NO: 604373 - RNA, 20 nt, Human
agcuguuuacauggauuucu

SEQ ID NO: 604374 - RNA, 22 nt, Human
gcaggccagcugugcagauggg

SEQ ID NO: 604375 - RNA, 22 nt, Human
gaggcugggaaguccaagauca

SEQ ID NO: 604376 - RNA, 22 nt, Human
uuauacauguguuuugagauga

SEQ ID NO: 604377 - RNA, 22 nt, Human
uguuaauggcugaagacauccu

SEQ ID NO: 604378 - RNA, 22 nt, Human
aggaaacagugaacuuggcagg

SEQ ID NO: 604379 - RNA, 20 nt, Human
uggaauaaguuaaguuguuu

SEQ ID NO: 604380 - RNA, 22 nt, Human
ucacauuuucuacuacuguacg

SEQ ID NO: 604381 - RNA, 20 nt, Human
gucuccacuggggguuaacc

SEQ ID NO: 604382 - RNA, 22 nt, Human
cugaggcaugggaaguugggug

SEQ ID NO: 604383 - RNA, 22 nt, Human
uugcaguuuauguuccugcagu

SEQ ID NO: 604384 - RNA, 22 nt, Human
cugggccuuggauugacacugu

SEQ ID NO: 604385 - RNA, 20 nt, Human
cuuucucuaauuuauaagua

SEQ ID NO: 604386 - RNA, 22 nt, Human
gggcugaggcuaccacuggucu

SEQ ID NO: 604387 - RNA, 22 nt, Human
acuucuggugucauacugcauu

SEQ ID NO: 604388 - RNA, 22 nt, Human
cagacacaccaggcccauucug

SEQ ID NO: 604389 - RNA, 22 nt, Human
cuacucugugguguauuugcau

SEQ ID NO: 604390 - RNA, 23 nt, Human
gaggccacauuccccugcuugag

SEQ ID NO: 604391 - RNA, 19 nt, Human
uuuuccuucuccucuuaau

SEQ ID NO: 604392 - RNA, 22 nt, Human
cugagaaaguuuauguuuauuu

SEQ ID NO: 604393 - RNA, 22 nt, Human
gaggcugguaggaaaggaaaca

SEQ ID NO: 604394 - RNA, 22 nt, Human
auaagccugauucacuugucau

SEQ ID NO: 604395 - RNA, 22 nt, Human
uuucuauuggcgucacuguugu

SEQ ID NO: 604396 - RNA, 22 nt, Human
gaagcuuaauuaugaccagcug

SEQ ID NO: 604397 - RNA, 21 nt, Human
acuaugucauuuaagucacug

SEQ ID NO: 604398 - RNA, 22 nt, Human
uuaagagacaggagaaugaugu

SEQ ID NO: 604399 - RNA, 22 nt, Human
cagauggagucccguggaguuc

SEQ ID NO: 604400 - RNA, 22 nt, Human
agcagauguuucagagcaggcu

SEQ ID NO: 604401 - RNA, 22 nt, Human
caggcugaggguuaggccuuag

SEQ ID NO: 604402 - RNA, 22 nt, Human
cccagccagccucuucccauau

SEQ ID NO: 604403 - RNA, 22 nt, Human
gagguacagaguguuccaaugu

SEQ ID NO: 604404 - RNA, 22 nt, Human
agaggcuguuacacucccagau

SEQ ID NO: 604405 - RNA, 21 nt, Human
aggaaaggaaguccccagggu

SEQ ID NO: 604406 - RNA, 22 nt, Human
aggauguguuuugagcugacua

SEQ ID NO: 604407 - RNA, 22 nt, Human
uugauacacaauggaacaaugu

SEQ ID NO: 604408 - RNA, 22 nt, Human
ucucuguacaguacaugccgug

SEQ ID NO: 604409 - RNA, 22 nt, Human
ucugaaauaacugaugccagau

SEQ ID NO: 604410 - RNA, 22 nt, Human
ugggaggaucucuugaggccag

SEQ ID NO: 604411 - RNA, 22 nt, Human
gcacagagccugguaccgagaa

SEQ ID NO: 604412 - RNA, 19 nt, Human
uccucugguaccacccuug

SEQ ID NO: 604413 - RNA, 22 nt, Human
cuguccuaugaguacucacuag

SEQ ID NO: 604414 - RNA, 17 nt, Human
uggggaugguucaugag

SEQ ID NO: 604415 - RNA, 22 nt, Human
acuuugcugcagguuuaaagag

SEQ ID NO: 604416 - RNA, 22 nt, Human
ggcacugagcgggcucugagcg

SEQ ID NO: 604417 - RNA, 22 nt, Human
gaauggaaacugggagauggcc

SEQ ID NO: 604418 - RNA, 22 nt, Human
ugggccaguuggaauggauacu

SEQ ID NO: 604419 - RNA, 23 nt, Human
ucagaggaucaucaaacguuuuc

SEQ ID NO: 604420 - RNA, 22 nt, Human
uugaggucaauucuguuuccug

SEQ ID NO: 604421 - RNA, 22 nt, Human
ugucuuuaagcaaacaguguuu

SEQ ID NO: 604422 - RNA, 22 nt, Human
uaguuuagaauguugcaauaca

SEQ ID NO: 604423 - RNA, 22 nt, Human
ugaagucagggauuccaugaag

SEQ ID NO: 604424 - RNA, 22 nt, Human
agcuggccuucggugucacugg

SEQ ID NO: 604425 - RNA, 22 nt, Human
aagggcugagcacagugagcca

SEQ ID NO: 604426 - RNA, 22 nt, Human
cauuaacaaugacugcuugacu

SEQ ID NO: 604427 - RNA, 21 nt, Human
cauuucuauugaugagaaaag

SEQ ID NO: 604428 - RNA, 22 nt, Human
gccuucugcgcucgugucuccg

SEQ ID NO: 604429 - RNA, 22 nt, Human
gagaggaguaggcugauggugc

SEQ ID NO: 604430 - RNA, 22 nt, Human
uggagcagcaucacuuugagcu

SEQ ID NO: 604431 - RNA, 22 nt, Human
uggaaugugcuagggcuguggc

SEQ ID NO: 604432 - RNA, 22 nt, Human
ccugcccaggagucucucugug

SEQ ID NO: 604433 - RNA, 22 nt, Human
ugcugcuuugauguguaaauca

SEQ ID NO: 604434 - RNA, 22 nt, Human
gggcagguacaagaugcuucuu

SEQ ID NO: 604435 - RNA, 19 nt, Human
cucugccucuggcuguggc

SEQ ID NO: 604436 - RNA, 21 nt, Human
agucugagguggggccuagga

SEQ ID NO: 604437 - RNA, 22 nt, Human
gggcacuggccgcccaucccug

SEQ ID NO: 604438 - RNA, 22 nt, Human
ccugggaugaaagcagcccacu

SEQ ID NO: 604439 - RNA, 22 nt, Human
gagcacccuaccugccacugag

SEQ ID NO: 604440 - RNA, 22 nt, Human
cugcaguguucuggaaugcauu

SEQ ID NO: 604441 - RNA, 16 nt, Human
aggcagagauuuaccc

SEQ ID NO: 604442 - RNA, 22 nt, Human
ggcugccuccugcugggcugga

SEQ ID NO: 604443 - RNA, 22 nt, Human
cuguggcuuucucugccuccuu

SEQ ID NO: 604444 - RNA, 22 nt, Human
auaagcuuuugauucacuucag

SEQ ID NO: 604445 - RNA, 22 nt, Human
ugaagguguuuauaccucagau

SEQ ID NO: 604446 - RNA, 22 nt, Human
aggaaaggccuuugcauuuggu

SEQ ID NO: 604447 - RNA, 22 nt, Human
agagugagggggcacugagacg

SEQ ID NO: 604448 - RNA, 22 nt, Human
gugcauauauaugggagggagc

SEQ ID NO: 604449 - RNA, 18 nt, Human
aggccugggaagcugagg

SEQ ID NO: 604450 - RNA, 22 nt, Human
caguaauuccaagugcuuauac

SEQ ID NO: 604451 - RNA, 22 nt, Human
uguccucacaggaaugaacuuu

SEQ ID NO: 604452 - RNA, 22 nt, Human
cucagcucauuguggauccggu

SEQ ID NO: 604453 - RNA, 22 nt, Human
auuuacagacguggauuagugc

SEQ ID NO: 604454 - RNA, 22 nt, Human
guacaugauuccccauaaaaag

SEQ ID NO: 604455 - RNA, 22 nt, Human
gcugggagaggcagcuuucgga

SEQ ID NO: 604456 - RNA, 22 nt, Human
uguguaacaaucuacacuuagg

SEQ ID NO: 604457 - RNA, 22 nt, Human
gugcuggggagauaggaagaga

SEQ ID NO: 604458 - RNA, 22 nt, Human
ucacugggcaucggagcugaaa

SEQ ID NO: 604459 - RNA, 18 nt, Human
cugggucuccaggcugcc

SEQ ID NO: 604460 - RNA, 22 nt, Human
uaugguaaaugagcauauguuc

SEQ ID NO: 604461 - RNA, 22 nt, Human
uguccuuuaugaaaugguguuu

SEQ ID NO: 604462 - RNA, 22 nt, Human
cauugcuugauagcugaaaauu

SEQ ID NO: 604463 - RNA, 22 nt, Human
gccaggccugcaagugcuggug

SEQ ID NO: 604464 - RNA, 22 nt, Human
aaggaacacuacaaggcuggga

SEQ ID NO: 604465 - RNA, 22 nt, Human
agcugcccagcuaggaagaagg

SEQ ID NO: 604466 - RNA, 22 nt, Human
ggguggcacaggugcagagggu

SEQ ID NO: 604467 - RNA, 22 nt, Human
gcccagugguaaaagcaggccu

SEQ ID NO: 604468 - RNA, 22 nt, Human
aaaaguauuggccaccauuucu

SEQ ID NO: 604469 - RNA, 22 nt, Human
auggcaauguggcuuauuugga

SEQ ID NO: 604470 - RNA, 22 nt, Human
guggcagagagcaagugucuga

SEQ ID NO: 604471 - RNA, 22 nt, Human
gcagagccugggggucugcgga

SEQ ID NO: 604472 - RNA, 22 nt, Human
caguccuuucaauggugaccuu

SEQ ID NO: 604473 - RNA, 22 nt, Human
uuacagaaguauugagagaucc

SEQ ID NO: 604474 - RNA, 22 nt, Human
ucugcccucauugcugccugga

SEQ ID NO: 604475 - RNA, 22 nt, Human
cagauguacaugaagggcaaug

SEQ ID NO: 604476 - RNA, 22 nt, Human
gggguggagcuaaaugucuacu

SEQ ID NO: 604477 - RNA, 22 nt, Human
cagggugcuuccguggagcugu

SEQ ID NO: 604478 - RNA, 22 nt, Human
uuccugggcaggacgagagucu

SEQ ID NO: 604479 - RNA, 22 nt, Human
acuggggccuccuccaugcucu

SEQ ID NO: 604480 - RNA, 20 nt, Human
ggagcugcccugggcuggag

SEQ ID NO: 604481 - RNA, 22 nt, Human
gcugccugccuaguuccacagu

SEQ ID NO: 604482 - RNA, 22 nt, Human
cugugugucauuugucaauccu

SEQ ID NO: 604483 - RNA, 22 nt, Human
caggugugccgggagcaguuug

SEQ ID NO: 604484 - RNA, 23 nt, Human
agcaaugcugggagacucuguaa

SEQ ID NO: 604485 - RNA, 22 nt, Human
ucuaguuuaagaucuguuaguc

SEQ ID NO: 604486 - RNA, 22 nt, Human
uggcagcuuuuuguuucaggcu

SEQ ID NO: 604487 - RNA, 22 nt, Human
uggugccuccagcugcuucucc

SEQ ID NO: 604488 - RNA, 22 nt, Human
cuggauggucccaugagcagcu

SEQ ID NO: 604489 - RNA, 22 nt, Human
uuacuugaaaggaaauuaaggu

SEQ ID NO: 604490 - RNA, 22 nt, Human
cuucuuucccaggcauguuuua

SEQ ID NO: 604491 - RNA, 22 nt, Human
ugaaauaucauuuucaucuccc

SEQ ID NO: 604492 - RNA, 22 nt, Human
agaaacauccugcuuuccauuu

SEQ ID NO: 604493 - RNA, 22 nt, Human
ucuuuucugccacagccugagc

SEQ ID NO: 604494 - RNA, 22 nt, Human
gcucuguggcaggaggucuugu

SEQ ID NO: 604495 - RNA, 22 nt, Human
agagaagggggaaagaucucac

SEQ ID NO: 604496 - RNA, 22 nt, Human
cauagaaaguauuauggaauuu

SEQ ID NO: 604497 - RNA, 22 nt, Human
ugugcuucuugcagcuccugua

SEQ ID NO: 604498 - RNA, 22 nt, Human
aggcagguccccuggaaggcac

SEQ ID NO: 604499 - RNA, 22 nt, Human
caugaauauacauccugauggc

SEQ ID NO: 604500 - RNA, 22 nt, Human
auuccuaaggaaggcuggcaag

SEQ ID NO: 604501 - RNA, 22 nt, Human
ccuggaucagagccagagaagc

SEQ ID NO: 604502 - RNA, 22 nt, Human
agugcuuuauguuguugugcaa

SEQ ID NO: 604503 - RNA, 22 nt, Human
ucagaccauccugcuguuagug

SEQ ID NO: 604504 - RNA, 22 nt, Human
aagaugugaaauugucucuggg

SEQ ID NO: 604505 - RNA, 22 nt, Human
gccugugcauagcagcggacuc

SEQ ID NO: 604506 - RNA, 23 nt, Human
acuccccagucucuucuugccaa

SEQ ID NO: 604507 - RNA, 22 nt, Human
cagagccucucagccccuuggg

SEQ ID NO: 604508 - RNA, 22 nt, Human
ccagggcaaaugagaucauagc

SEQ ID NO: 604509 - RNA, 22 nt, Human
agaugaaagauuuuuauagaga

SEQ ID NO: 604510 - RNA, 22 nt, Human
acagucuggaggcugcuucauu

SEQ ID NO: 604511 - RNA, 22 nt, Human
cuucuuccugcugcagccucca

SEQ ID NO: 604512 - RNA, 22 nt, Human
cauggccugccuccuccuggug

SEQ ID NO: 604513 - RNA, 22 nt, Human
auagagacuauagagcacuuac

SEQ ID NO: 604514 - RNA, 19 nt, Human
augacagaguugauaagug

SEQ ID NO: 604515 - RNA, 22 nt, Human
ggcaggguggcccuccagugag

SEQ ID NO: 604516 - RNA, 22 nt, Human
agcuucuuuaauucagcaugau

SEQ ID NO: 604517 - RNA, 22 nt, Human
acaccaugguucccaaacugug

SEQ ID NO: 604518 - RNA, 22 nt, Human
ugccugggccucugaggaaggc

SEQ ID NO: 604519 - RNA, 22 nt, Human
gggagauggcucagaggccgcg

SEQ ID NO: 604520 - RNA, 22 nt, Human
guucuuuaaguggagaaggaaa

SEQ ID NO: 604521 - RNA, 20 nt, Human
auauuucuuaagaacuuuca

SEQ ID NO: 604522 - RNA, 22 nt, Human
auuaaggaacaaagccuuuuga

SEQ ID NO: 604523 - RNA, 22 nt, Human
gaaggccauugcguccugggau

SEQ ID NO: 604524 - RNA, 22 nt, Human
ccacugagaccuuuuggaggag

SEQ ID NO: 604525 - RNA, 22 nt, Human
aaagacauugaagaaggacuua

SEQ ID NO: 604526 - RNA, 22 nt, Human
aagcagaauuuaauagaaaggu

SEQ ID NO: 604527 - RNA, 23 nt, Human
acagccccaugcagguguguuug

SEQ ID NO: 604528 - RNA, 22 nt, Human
ucugccaguuuauagacaagcc

SEQ ID NO: 604529 - RNA, 22 nt, Human
caggcaccaauagggaucgugg

SEQ ID NO: 604530 - RNA, 22 nt, Human
ggugugggagagauucuuuccu

SEQ ID NO: 604531 - RNA, 22 nt, Human
uagaagcaccacucaucacgug

SEQ ID NO: 604532 - RNA, 22 nt, Human
gggagacacgcugcaggcauaa

SEQ ID NO: 604533 - RNA, 22 nt, Human
gcauguggugggcuggccacuc

SEQ ID NO: 604534 - RNA, 20 nt, Human
gugcugagugaaaugagauu

SEQ ID NO: 604535 - RNA, 22 nt, Human
acacuguagcugagggcaugcg

SEQ ID NO: 604536 - RNA, 22 nt, Human
gcccuuagucagcacuuucacu

SEQ ID NO: 604537 - RNA, 22 nt, Human
cuaggaaaugaauacaguacac

SEQ ID NO: 604538 - RNA, 22 nt, Human
aggagggaauaagaaagaguca

SEQ ID NO: 604539 - RNA, 22 nt, Human
uaucuacauguagguauguaug

SEQ ID NO: 604540 - RNA, 22 nt, Human
ucucauguuuuaccuguccuca

SEQ ID NO: 604541 - RNA, 22 nt, Human
ugaggaaacugaggcacagaug

SEQ ID NO: 604542 - RNA, 22 nt, Human
ugagcagggacuuuggagucug

SEQ ID NO: 604543 - RNA, 22 nt, Human
acaggcugcccgcuccccaccu

SEQ ID NO: 604544 - RNA, 22 nt, Human
agaggaauaaauuucuguagug

SEQ ID NO: 604545 - RNA, 22 nt, Human
ucaguguucagggaccaggucc

SEQ ID NO: 604546 - RNA, 23 nt, Human
uugaggcaaacauguaaguagga

SEQ ID NO: 604547 - RNA, 22 nt, Human
uuucaguuuaugucuugaauua

SEQ ID NO: 604548 - RNA, 22 nt, Human
ggcaccagggacaauccucuuc

SEQ ID NO: 604549 - RNA, 22 nt, Human
ucugaaauagaagugucuuucu

SEQ ID NO: 604550 - RNA, 22 nt, Human
augaacaucggaaaugagacug

SEQ ID NO: 604551 - RNA, 20 nt, Human
uaccuugaaccuccaccugg

SEQ ID NO: 604552 - RNA, 22 nt, Human
aaguuacaguuggaacugugaa

SEQ ID NO: 604553 - RNA, 22 nt, Human
auggccagucuguuggacagca

SEQ ID NO: 604554 - RNA, 22 nt, Human
cuuguuaaaaugcagauuccaa

SEQ ID NO: 604555 - RNA, 22 nt, Human
uuugaggaagaucggagggaaa

SEQ ID NO: 604556 - RNA, 22 nt, Human
uggcugagaccuucccaaauuc

SEQ ID NO: 604557 - RNA, 22 nt, Human
uuccucuguaguugcugaugaa

SEQ ID NO: 604558 - RNA, 22 nt, Human
aggugggcggauucaugagguc

SEQ ID NO: 604559 - RNA, 18 nt, Human
cugaggcccagagagggc

SEQ ID NO: 604560 - RNA, 22 nt, Human
aggugccagugcuguggucccc

SEQ ID NO: 604561 - RNA, 18 nt, Human
gcuccuggagucugacuc

SEQ ID NO: 604562 - RNA, 22 nt, Human
gacuguguccaugugcuggauu

SEQ ID NO: 604563 - RNA, 19 nt, Human
ucugaaguccagggcauac

SEQ ID NO: 604564 - RNA, 22 nt, Human
uaaaggcaugcaggugaaugua

SEQ ID NO: 604565 - RNA, 22 nt, Human
augcauaauguauguauugacu

SEQ ID NO: 604566 - RNA, 22 nt, Human
aaagcuauagggucaagcauuu

SEQ ID NO: 604567 - RNA, 22 nt, Human
ugccagcuuuugacuaucuuag

SEQ ID NO: 604568 - RNA, 22 nt, Human
gcacagggcugccaggcggcuu

SEQ ID NO: 604569 - RNA, 22 nt, Human
cagcaacuuaggcagaacaucu

SEQ ID NO: 604570 - RNA, 23 nt, Human
acagcaagaggaccagaugugag

SEQ ID NO: 604571 - RNA, 22 nt, Human
gcugugugaccugggcaagucu

SEQ ID NO: 604572 - RNA, 22 nt, Human
ugucuccacaggugucagcuca

SEQ ID NO: 604573 - RNA, 22 nt, Human
gguccuugugucucuauggccc

SEQ ID NO: 604574 - RNA, 18 nt, Human
ugagaauguaagaaaugg

SEQ ID NO: 604575 - RNA, 22 nt, Human
aaugaugugaguuuuuauucuc

SEQ ID NO: 604576 - RNA, 22 nt, Human
ucauauaaguuuaaaacuaucu

SEQ ID NO: 604577 - RNA, 18 nt, Human
ugagaggcuauuuuuugc

SEQ ID NO: 604578 - RNA, 22 nt, Human
ucuuccucucuaauugaucaga

SEQ ID NO: 604579 - RNA, 22 nt, Human
aggcccugaagucggccccuca

SEQ ID NO: 604580 - RNA, 22 nt, Human
caugcagugcuuugcgccgggc

SEQ ID NO: 604581 - RNA, 17 nt, Human
cuggagccaagagggcc

SEQ ID NO: 604582 - RNA, 22 nt, Human
ugccaggcacgugagaguggcc

SEQ ID NO: 604583 - RNA, 22 nt, Human
cauucacaauaguugaaaggug

SEQ ID NO: 604584 - RNA, 22 nt, Human
ucaggcugcccguucagggcuc

SEQ ID NO: 604585 - RNA, 19 nt, Human
caaggguugggucugucau

SEQ ID NO: 604586 - RNA, 22 nt, Human
gcucugugaguauuggcccugg

SEQ ID NO: 604587 - RNA, 22 nt, Human
uaguuucauaugcaaaauagua

SEQ ID NO: 604588 - RNA, 18 nt, Human
aguggaaaacaaauacac

SEQ ID NO: 604589 - RNA, 22 nt, Human
uggcagagcuggcugcggauga

SEQ ID NO: 604590 - RNA, 22 nt, Human
uaugcacugguacuauucgugu

SEQ ID NO: 604591 - RNA, 22 nt, Human
ggcugagccacugcgccuggcu

SEQ ID NO: 604592 - RNA, 22 nt, Human
acuugauuuugaaccuuucuac

SEQ ID NO: 604593 - RNA, 19 nt, Human
uccaauuuguauguuuuca

SEQ ID NO: 604594 - RNA, 22 nt, Human
aacacuuuuuaguaaagauuga

SEQ ID NO: 604595 - RNA, 22 nt, Human
uguagggacugaggcuggagag

SEQ ID NO: 604596 - RNA, 22 nt, Human
agaucacaguggcaacucccuu

SEQ ID NO: 604597 - RNA, 22 nt, Human
ucugagguguagcugggcuuca

SEQ ID NO: 604598 - RNA, 22 nt, Human
uucauucuugggaucagagagu

SEQ ID NO: 604599 - RNA, 22 nt, Human
agucaucauuuauaucaagucu

SEQ ID NO: 604600 - RNA, 22 nt, Human
uaggauuccagaacagugcugc

SEQ ID NO: 604601 - RNA, 22 nt, Human
agaggaggcuggguccagauaa

SEQ ID NO: 604602 - RNA, 22 nt, Human
uuuccuuugcccaauacauguc

SEQ ID NO: 604603 - RNA, 22 nt, Human
guauuuuuagguaaggaaagua

SEQ ID NO: 604604 - RNA, 22 nt, Human
agcagaaaauuggaaaugacaa

SEQ ID NO: 604605 - RNA, 22 nt, Human
ugguccaggguguaguacagag

SEQ ID NO: 604606 - RNA, 22 nt, Human
gcaggggcuacucugagcuucc

SEQ ID NO: 604607 - RNA, 22 nt, Human
agacacuguucucacaugcuug

SEQ ID NO: 604608 - RNA, 22 nt, Human
aagaggcuucagauccuucaga

SEQ ID NO: 604609 - RNA, 22 nt, Human
uccagggcagccgcgggugcgc

SEQ ID NO: 604610 - RNA, 22 nt, Human
uaaggcaagagcagggucuuug

SEQ ID NO: 604611 - RNA, 22 nt, Human
gcugaggaggugugguuaggug

SEQ ID NO: 604612 - RNA, 22 nt, Human
cuccaggugcagaaggacucag

SEQ ID NO: 604613 - RNA, 22 nt, Human
gacauuuagaaguuagauucaa

SEQ ID NO: 604614 - RNA, 22 nt, Human
uuagcugacugugugauuuggc

SEQ ID NO: 604615 - RNA, 22 nt, Human
aaagguuuauugcuaugguugu

SEQ ID NO: 604616 - RNA, 22 nt, Human
cccaggaggcagaaguugcagu

SEQ ID NO: 604617 - RNA, 21 nt, Human
ugagucucucagcuucaggua

SEQ ID NO: 604618 - RNA, 22 nt, Human
cuuaggaaugucccuucccaca

SEQ ID NO: 604619 - RNA, 21 nt, Human
agaggcaggcauuaaguacac

SEQ ID NO: 604620 - RNA, 20 nt, Human
ugcaagauggguggggagaa

SEQ ID NO: 604621 - RNA, 22 nt, Human
uccagggaugguaaugagcagu

SEQ ID NO: 604622 - RNA, 22 nt, Human
ccugagcugaacuaagcaguuu

SEQ ID NO: 604623 - RNA, 22 nt, Human
uaaugcaauuuagcaaaguuuu

SEQ ID NO: 604624 - RNA, 22 nt, Human
aacaugcugccuuucuacgagu

SEQ ID NO: 604625 - RNA, 22 nt, Human
ggaagagccuggggugucaggc

SEQ ID NO: 604626 - RNA, 22 nt, Human
ugauacagucagcucacaauug

SEQ ID NO: 604627 - RNA, 18 nt, Human
ucugggcuucccgaggcu

SEQ ID NO: 604628 - RNA, 22 nt, Human
caggaaauaucucaacacuuua

SEQ ID NO: 604629 - RNA, 22 nt, Human
gagaagcagguuuagcagacaa

SEQ ID NO: 604630 - RNA, 17 nt, Human
gagguaggaagugaguc

SEQ ID NO: 604631 - RNA, 22 nt, Human
uucuuucucuguaaaaggaaaa

SEQ ID NO: 604632 - RNA, 22 nt, Human
acaauagaguucucauaggaca

SEQ ID NO: 604633 - RNA, 22 nt, Human
aggagaaagacuggacagccaa

SEQ ID NO: 604634 - RNA, 22 nt, Human
agguaguguagcugagugggau

SEQ ID NO: 604635 - RNA, 22 nt, Human
ugcugggcuggagcugccaggg

SEQ ID NO: 604636 - RNA, 22 nt, Human
aguuucuaccgguacauucagg

SEQ ID NO: 604637 - RNA, 22 nt, Human
aggaauaugagcugcugcagug

SEQ ID NO: 604638 - RNA, 22 nt, Human
caucauaaaauugagauaacug

SEQ ID NO: 604639 - RNA, 22 nt, Human
ugaggccaacuagggagaugga

SEQ ID NO: 604640 - RNA, 22 nt, Human
acucauugaaacuuaagaucua

SEQ ID NO: 604641 - RNA, 22 nt, Human
caggacaggcccuguggggucu

SEQ ID NO: 604642 - RNA, 22 nt, Human
aacacagcuaauuucugucaau

SEQ ID NO: 604643 - RNA, 22 nt, Human
uugaaaauaucacaggagcagc

SEQ ID NO: 604644 - RNA, 22 nt, Human
aggugaaugcucacauucuaau

SEQ ID NO: 604645 - RNA, 22 nt, Human
uggggaggauaugugaguuauu

SEQ ID NO: 604646 - RNA, 22 nt, Human
uucugucuucccacugaggagc

SEQ ID NO: 604647 - RNA, 22 nt, Human
cuggcuggccggagcgaggcgg

SEQ ID NO: 604648 - RNA, 22 nt, Human
gaaucuuaccucucuauuguug

SEQ ID NO: 604649 - RNA, 22 nt, Human
uaauuuacagagauacagucag

SEQ ID NO: 604650 - RNA, 22 nt, Human
cagcaggcaggugggccaaguc

SEQ ID NO: 604651 - RNA, 22 nt, Human
ccagcucugauuuugaccucca

SEQ ID NO: 604652 - RNA, 22 nt, Human
uuacaguugcuacaaaggauaa

SEQ ID NO: 604653 - RNA, 18 nt, Human
ggcagcaagaagggaggg

SEQ ID NO: 604654 - RNA, 22 nt, Human
cauguuuuguguacagaauauu

SEQ ID NO: 604655 - RNA, 22 nt, Human
uacaugcuccacuuucuccugu

SEQ ID NO: 604656 - RNA, 22 nt, Human
cucagcuacgcuuucaccagcu

SEQ ID NO: 604657 - RNA, 22 nt, Human
uuuagacuaauuccuaaagggc

SEQ ID NO: 604658 - RNA, 22 nt, Human
cugcuuugauuagaagaguaca

SEQ ID NO: 604659 - RNA, 19 nt, Human
accaggagacagugagcuu

SEQ ID NO: 604660 - RNA, 22 nt, Human
ggaggcggacacagguaguguu

SEQ ID NO: 604661 - RNA, 22 nt, Human
aagaaagcauuagacaggcauu

SEQ ID NO: 604662 - RNA, 22 nt, Human
ggggcugacgggcauguggcuu

SEQ ID NO: 604663 - RNA, 22 nt, Human
gagaagggauaugccacucucg

SEQ ID NO: 604664 - RNA, 22 nt, Human
gcaggggcugcugggaacucgg

SEQ ID NO: 604665 - RNA, 22 nt, Human
aauuauauugaaguugaauguc

SEQ ID NO: 604666 - RNA, 20 nt, Human
auucugcuuucugauagagc

SEQ ID NO: 604667 - RNA, 22 nt, Human
guccucuguuagaaaugugcuu

SEQ ID NO: 604668 - RNA, 22 nt, Human
gcugagcagguguaaggaaggc

SEQ ID NO: 604669 - RNA, 22 nt, Human
gacacaggaaucaccuuggaug

SEQ ID NO: 604670 - RNA, 22 nt, Human
agguggaguuggcuguaguuca

SEQ ID NO: 604671 - RNA, 22 nt, Human
ccugaggucagcgguucccaca

SEQ ID NO: 604672 - RNA, 22 nt, Human
ucuuccugcuuggugugucugg

SEQ ID NO: 604673 - RNA, 22 nt, Human
cuugagaacaggguuagguaac

SEQ ID NO: 604674 - RNA, 22 nt, Human
ucauucucagacucuuggccuc

SEQ ID NO: 604675 - RNA, 22 nt, Human
gcacagcagcugggggcccugg

SEQ ID NO: 604676 - RNA, 22 nt, Human
uaauuuuguauugccauuguag

SEQ ID NO: 604677 - RNA, 22 nt, Human
ggcccaaaccaaguaccucaaa

SEQ ID NO: 604678 - RNA, 22 nt, Human
cuauugaauuaacuauuaaagu

SEQ ID NO: 604679 - RNA, 22 nt, Human
aaaugguaaugucuuucuguuu

SEQ ID NO: 604680 - RNA, 22 nt, Human
uccuuugacuucuugcagucca

SEQ ID NO: 604681 - RNA, 22 nt, Human
gaagccaggggccugacaggca

SEQ ID NO: 604682 - RNA, 20 nt, Human
aagagucuuuacugagcuaa

SEQ ID NO: 604683 - RNA, 22 nt, Human
cuugggcuuagaagguaaguga

SEQ ID NO: 604684 - RNA, 22 nt, Human
ucugagguggacgauggagccu

SEQ ID NO: 604685 - RNA, 22 nt, Human
uguaaaacaaaauuuguggaga

SEQ ID NO: 604686 - RNA, 22 nt, Human
uggcugcuagccagagcuucag

SEQ ID NO: 604687 - RNA, 22 nt, Human
cugggacacccaaggaaagagc

SEQ ID NO: 604688 - RNA, 22 nt, Human
acuugccccagaauugcugcug

SEQ ID NO: 604689 - RNA, 22 nt, Human
aggcccuggucaggucuggcug

SEQ ID NO: 604690 - RNA, 22 nt, Human
uuucucaaguucagauauuuga

SEQ ID NO: 604691 - RNA, 23 nt, Human
ggauaaaucucagcuucuuccau

SEQ ID NO: 604692 - RNA, 22 nt, Human
aguaaaaauaugcuuguggcua

SEQ ID NO: 604693 - RNA, 22 nt, Human
ugggaagggccgauggagccuc

SEQ ID NO: 604694 - RNA, 22 nt, Human
ccugggcucugaggagggaguc

SEQ ID NO: 604695 - RNA, 22 nt, Human
ugaguccugucuuugucacuua

SEQ ID NO: 604696 - RNA, 22 nt, Human
ugcugaaggcaggggagguggc

SEQ ID NO: 604697 - RNA, 22 nt, Human
auaauaacaccugaauaggaaa

SEQ ID NO: 604698 - RNA, 20 nt, Human
auggaagcugcucuucuccu

SEQ ID NO: 604699 - RNA, 22 nt, Human
ccccaggaagccucagauuugc

SEQ ID NO: 604700 - RNA, 22 nt, Human
augcuuuuaugucacaugguca

SEQ ID NO: 604701 - RNA, 22 nt, Human
cagagggcguccggguuaacuu

SEQ ID NO: 604702 - RNA, 22 nt, Human
uuuauuauucucuggagaaugu

SEQ ID NO: 604703 - RNA, 20 nt, Human
cccugagacaaaggaggggc

SEQ ID NO: 604704 - RNA, 22 nt, Human
cagggggcucaaaggagagugc

SEQ ID NO: 604705 - RNA, 22 nt, Human
cagcuuggaggaggaucuaaga

SEQ ID NO: 604706 - RNA, 22 nt, Human
caaugcuuuuagcuucagcuug

SEQ ID NO: 604707 - RNA, 22 nt, Human
uagaaacaaguuucucuuuggg

SEQ ID NO: 604708 - RNA, 22 nt, Human
gggcaugagagggcagcuggca

SEQ ID NO: 604709 - RNA, 22 nt, Human
gucuuauuaaaaaucuaauccc

SEQ ID NO: 604710 - RNA, 22 nt, Human
cucugagaagccuugaugggga

SEQ ID NO: 604711 - RNA, 22 nt, Human
uacaguucuagucaaaaaucac

SEQ ID NO: 604712 - RNA, 22 nt, Human
cagagcagcagagcuuccaugg

SEQ ID NO: 604713 - RNA, 22 nt, Human
caagagcuggagaggcagucua

SEQ ID NO: 604714 - RNA, 22 nt, Human
ugaggcagugcugggaagccug

SEQ ID NO: 604715 - RNA, 22 nt, Human
caaacauuuugagugguuucug

SEQ ID NO: 604716 - RNA, 22 nt, Human
uagagcagccuucagagcaguu

SEQ ID NO: 604717 - RNA, 22 nt, Human
ucugacaaugaacaaucuauag

SEQ ID NO: 604718 - RNA, 22 nt, Human
uugcuucuuagauauuccucuc

SEQ ID NO: 604719 - RNA, 23 nt, Human
cccagcgcugagcccugcaggca

SEQ ID NO: 604720 - RNA, 23 nt, Human
agcuccagaacauagcacaggaa

SEQ ID NO: 604721 - RNA, 22 nt, Human
gcugggcaagugccuuggguuu

SEQ ID NO: 604722 - RNA, 22 nt, Human
auauagucaaacauauaugugu

SEQ ID NO: 604723 - RNA, 22 nt, Human
uaaagacaaaugacauuacggc

SEQ ID NO: 604724 - RNA, 22 nt, Human
ugagcuucaaaguuggaucuga

SEQ ID NO: 604725 - RNA, 22 nt, Human
cugacuccuuaccauaugcuuu

SEQ ID NO: 604726 - RNA, 22 nt, Human
ccauggcuuuugagucucaaga

SEQ ID NO: 604727 - RNA, 22 nt, Human
gagaagggggcucgaguguccu

SEQ ID NO: 604728 - RNA, 22 nt, Human
guccuggcuuaguucgcuguaa

SEQ ID NO: 604729 - RNA, 22 nt, Human
gcagggguggaggcuguccugu

SEQ ID NO: 604730 - RNA, 22 nt, Human
uugauucuaugagguaagcuau

SEQ ID NO: 604731 - RNA, 19 nt, Human
ccugagauuccuccuuuuc

SEQ ID NO: 604732 - RNA, 22 nt, Human
guuguauucuucaauaucagag

SEQ ID NO: 604733 - RNA, 18 nt, Human
aaguaacagaagagcaca

SEQ ID NO: 604734 - RNA, 22 nt, Human
ccucuguguccuggucauugaa

SEQ ID NO: 604735 - RNA, 21 nt, Human
ucccagagugcuugggacugc

SEQ ID NO: 604736 - RNA, 20 nt, Human
agcugaggcaccugagguua

SEQ ID NO: 604737 - RNA, 22 nt, Human
ugagaaacauaugagagauuug

SEQ ID NO: 604738 - RNA, 22 nt, Human
cagcagcagccccaggaagguu

SEQ ID NO: 604739 - RNA, 21 nt, Human
ugcaggagucugugagucagg

SEQ ID NO: 604740 - RNA, 22 nt, Human
uggaacacaggacuaucagcug

SEQ ID NO: 604741 - RNA, 21 nt, Human
aucacauuggcuguuauuauu

SEQ ID NO: 604742 - RNA, 22 nt, Human
gagcagugaagacagaaguaca

SEQ ID NO: 604743 - RNA, 22 nt, Human
ugagccaggcccagugggguca

SEQ ID NO: 604744 - RNA, 22 nt, Human
gaacuuuaaaacaaaguacagu

SEQ ID NO: 604745 - RNA, 22 nt, Human
ggaaaagaaagggacugauugg

SEQ ID NO: 604746 - RNA, 22 nt, Human
gcaguguuggcaggauggggcu

SEQ ID NO: 604747 - RNA, 22 nt, Human
ucuucuguuaccacagcgauga

SEQ ID NO: 604748 - RNA, 19 nt, Human
ggaaggagagaaaugcaug

SEQ ID NO: 604749 - RNA, 22 nt, Human
aagagacuucuagauuuguuga

SEQ ID NO: 604750 - RNA, 22 nt, Human
ucucagugcagcuugacagaga

SEQ ID NO: 604751 - RNA, 22 nt, Human
aaggccagcuuguagggcuggu

SEQ ID NO: 604752 - RNA, 22 nt, Human
gaggaguggaguugcuggguug

SEQ ID NO: 604753 - RNA, 22 nt, Human
gcagugguccaguucacaccca

SEQ ID NO: 604754 - RNA, 22 nt, Human
cccccaggcucugacacaggag

SEQ ID NO: 604755 - RNA, 22 nt, Human
aaggugguuguaggcuggucug

SEQ ID NO: 604756 - RNA, 22 nt, Human
uacagucucugauaacugucag

SEQ ID NO: 604757 - RNA, 22 nt, Human
gaaucuaugccucauauagacc

SEQ ID NO: 604758 - RNA, 22 nt, Human
augaaagaugauuuaaaguacu

SEQ ID NO: 604759 - RNA, 22 nt, Human
cugccacuagcuuucacaucuu

SEQ ID NO: 604760 - RNA, 22 nt, Human
agugcuguuggauaaugcuguc

SEQ ID NO: 604761 - RNA, 22 nt, Human
gauaauuuuagucugaaaauug

SEQ ID NO: 604762 - RNA, 22 nt, Human
ugccccagacucugcucaccuc

SEQ ID NO: 604763 - RNA, 20 nt, Human
cacaggaaagcuacucaguu

SEQ ID NO: 604764 - RNA, 22 nt, Human
gagagaaaagggggaauugauu

SEQ ID NO: 604765 - RNA, 22 nt, Human
acuacaguaagggaggcagcau

SEQ ID NO: 604766 - RNA, 22 nt, Human
ucacugucccuguccucuuauc

SEQ ID NO: 604767 - RNA, 22 nt, Human
uuacauuuuaguuaaccuguga

SEQ ID NO: 604768 - RNA, 22 nt, Human
uucuuggaugcccucaugccuu

SEQ ID NO: 604769 - RNA, 22 nt, Human
aaaaauagcuucucuugucccu

SEQ ID NO: 604770 - RNA, 22 nt, Human
aacugcuucuuacugcugggca

SEQ ID NO: 604771 - RNA, 22 nt, Human
gcugucacacaugggaucucag

SEQ ID NO: 604772 - RNA, 22 nt, Human
gccaacaggccuugcucugcuc

SEQ ID NO: 604773 - RNA, 22 nt, Human
gcacucuguuucuccugucagc

SEQ ID NO: 604774 - RNA, 22 nt, Human
cuccugguucagagagcugaga

SEQ ID NO: 604775 - RNA, 22 nt, Human
gccagggcaggggagcaucugc

SEQ ID NO: 604776 - RNA, 22 nt, Human
ugcguugcgcuccugcagcagg

SEQ ID NO: 604777 - RNA, 22 nt, Human
augccagccucuaagcacuuua

SEQ ID NO: 604778 - RNA, 22 nt, Human
gaagauuuauaggagccuauua

SEQ ID NO: 604779 - RNA, 22 nt, Human
ccagcugguguuccuuaggacc

SEQ ID NO: 604780 - RNA, 22 nt, Human
gaaggcaagaucucaguggagg

SEQ ID NO: 604781 - RNA, 22 nt, Human
ucaggcuuuuccugccuccuac

SEQ ID NO: 604782 - RNA, 22 nt, Human
gcagggguagugucuuccugag

SEQ ID NO: 604783 - RNA, 22 nt, Human
uguggcaguaaaauugggcaac

SEQ ID NO: 604784 - RNA, 22 nt, Human
gaaggcuguuucugguagugau

SEQ ID NO: 604785 - RNA, 22 nt, Human
ccuggggaaucuugcaggggaa

SEQ ID NO: 604786 - RNA, 22 nt, Human
aacuguaaagguugagugguaa

SEQ ID NO: 604787 - RNA, 22 nt, Human
aagcuguuggcagauagcucug

SEQ ID NO: 604788 - RNA, 22 nt, Human
uugcugaaguaugaaaaagaca

SEQ ID NO: 604789 - RNA, 22 nt, Human
ccucugaguccucccugguugc

SEQ ID NO: 604790 - RNA, 22 nt, Human
cagugaggcucugcugagcggu

SEQ ID NO: 604791 - RNA, 22 nt, Human
aagaguuauauaauguguaguu

SEQ ID NO: 604792 - RNA, 22 nt, Human
agaggccagcccaggccaccga

SEQ ID NO: 604793 - RNA, 16 nt, Human
ugguggggaggacagc

SEQ ID NO: 604794 - RNA, 22 nt, Human
gcugggagcaaguacucaucuu

SEQ ID NO: 604795 - RNA, 22 nt, Human
uuacauuagacccacuuucaug

SEQ ID NO: 604796 - RNA, 22 nt, Human
ugaguuuuuucaacauaugaag

SEQ ID NO: 604797 - RNA, 22 nt, Human
acaguguucugaaaguugaggg

SEQ ID NO: 604798 - RNA, 22 nt, Human
acuggaguugauuacauaaaac

SEQ ID NO: 604799 - RNA, 22 nt, Human
acacugggcuuguuacguugca

SEQ ID NO: 604800 - RNA, 22 nt, Human
cuucuuaaugcauaaacugugu

SEQ ID NO: 604801 - RNA, 20 nt, Human
acuggaguucaugcuaagag

SEQ ID NO: 604802 - RNA, 22 nt, Human
ccacagaccuuggcuuccaccu

SEQ ID NO: 604803 - RNA, 22 nt, Human
cuaguucuaaaucuguugucca

SEQ ID NO: 604804 - RNA, 16 nt, Human
gggagggaguuggugg

SEQ ID NO: 604805 - RNA, 22 nt, Human
aaaguguugggaagaaagugca

SEQ ID NO: 604806 - RNA, 22 nt, Human
cugauggagacuccacugugau

SEQ ID NO: 604807 - RNA, 22 nt, Human
aauuagcuaauuaauuguagcc

SEQ ID NO: 604808 - RNA, 22 nt, Human
ggaaacaaaccacucauggugg

SEQ ID NO: 604809 - RNA, 22 nt, Human
ccucucuguagcagcccccagu

SEQ ID NO: 604810 - RNA, 22 nt, Human
cagggagccccaauuccaugcc

SEQ ID NO: 604811 - RNA, 22 nt, Human
gcucuugucaaaaauuaguuga

SEQ ID NO: 604812 - RNA, 22 nt, Human
agagugaagguugacacuucac

SEQ ID NO: 604813 - RNA, 22 nt, Human
cccaggcuggagugcaauggca

SEQ ID NO: 604814 - RNA, 22 nt, Human
ccaguguucugguguucauuuc

SEQ ID NO: 604815 - RNA, 22 nt, Human
cagcuacagaggccacauggcu

SEQ ID NO: 604816 - RNA, 22 nt, Human
uggcucagaaggcugccuucac

SEQ ID NO: 604817 - RNA, 22 nt, Human
cuguuaaaugagaaagcagacu

SEQ ID NO: 604818 - RNA, 22 nt, Human
cugcagagaugaagaagguggc

SEQ ID NO: 604819 - RNA, 22 nt, Human
uuuucauguuccuuguuaagug

SEQ ID NO: 604820 - RNA, 22 nt, Human
gcugucaguuuuacccacagac

SEQ ID NO: 604821 - RNA, 22 nt, Human
cuccucuguauugauugggacu

SEQ ID NO: 604822 - RNA, 22 nt, Human
agggaggugguuccccagugga

SEQ ID NO: 604823 - RNA, 21 nt, Human
gaagagaguccucauccugag

SEQ ID NO: 604824 - RNA, 22 nt, Human
uacuuacagaaggaagcaauug

SEQ ID NO: 604825 - RNA, 22 nt, Human
gcccuugggagguuccacuggg

SEQ ID NO: 604826 - RNA, 20 nt, Human
agagaugggguaucaccgua

SEQ ID NO: 604827 - RNA, 20 nt, Human
ucagcucugugccugggaug

SEQ ID NO: 604828 - RNA, 22 nt, Human
gagcaggacgugggaaugggaa

SEQ ID NO: 604829 - RNA, 22 nt, Human
gcaaacaugcugagaaauaaga

SEQ ID NO: 604830 - RNA, 22 nt, Human
ugagccaguggaagauggcagu

SEQ ID NO: 604831 - RNA, 22 nt, Human
uucgaguuggcuuuauuaaacu

SEQ ID NO: 604832 - RNA, 22 nt, Human
gccaggaugacuauacaacagc

SEQ ID NO: 604833 - RNA, 22 nt, Human
gaagcaauuuagaaucagaagc

SEQ ID NO: 604834 - RNA, 20 nt, Human
cagaggcauuuucagacucu

SEQ ID NO: 604835 - RNA, 22 nt, Human
gugcaggcauugggcuagccau

SEQ ID NO: 604836 - RNA, 22 nt, Human
ucgaaaaugaagagucaauuaa

SEQ ID NO: 604837 - RNA, 22 nt, Human
ccagcuggaagagugcagaacu

SEQ ID NO: 604838 - RNA, 22 nt, Human
uccugucugucuuuggucccuu

SEQ ID NO: 604839 - RNA, 22 nt, Human
uguaugcuugaguguguauacu

SEQ ID NO: 604840 - RNA, 22 nt, Human
cugccacuuacuaggcauggug

SEQ ID NO: 604841 - RNA, 22 nt, Human
gcuucuauuacuacuuugagau

SEQ ID NO: 604842 - RNA, 22 nt, Human
ugcagccaucuuucuuggagga

SEQ ID NO: 604843 - RNA, 22 nt, Human
ggacaggauaagagacacugcc

SEQ ID NO: 604844 - RNA, 22 nt, Human
ugucacauaauuuaucuguagg

SEQ ID NO: 604845 - RNA, 22 nt, Human
uccaguuguuuguauuaacucu

SEQ ID NO: 604846 - RNA, 22 nt, Human
aggccugcagcaggagcaaacc

SEQ ID NO: 604847 - RNA, 22 nt, Human
guggcagagcaggagacaggac

SEQ ID NO: 604848 - RNA, 22 nt, Human
uguaaagaaauagcauuuguag

SEQ ID NO: 604849 - RNA, 22 nt, Human
uuucaagcagcgugaaaaacga

SEQ ID NO: 604850 - RNA, 21 nt, Human
agccugggaggcggagguugc

SEQ ID NO: 604851 - RNA, 22 nt, Human
ucacacaucucagguguuuaau

SEQ ID NO: 604852 - RNA, 22 nt, Human
ucuccaggcuuaaucucagcuu

SEQ ID NO: 604853 - RNA, 22 nt, Human
aaaguuugucacuuggcuagaa

SEQ ID NO: 604854 - RNA, 22 nt, Human
gaguuuauucaggaaauagcca

SEQ ID NO: 604855 - RNA, 22 nt, Human
cagcucuguguauuuuccccac

SEQ ID NO: 604856 - RNA, 22 nt, Human
gcucccagucugauggaggaga

SEQ ID NO: 604857 - RNA, 22 nt, Human
cacuucauugggaccagggcug

SEQ ID NO: 604858 - RNA, 22 nt, Human
agacaauggaccaagcaccuuc

SEQ ID NO: 604859 - RNA, 22 nt, Human
uugcagagccaugaggcuggcu

SEQ ID NO: 604860 - RNA, 22 nt, Human
agaagagccuggggaccauggc

SEQ ID NO: 604861 - RNA, 22 nt, Human
ugggcuccguugccuggggcag

SEQ ID NO: 604862 - RNA, 22 nt, Human
ccaaggcuucccagagaugcuc

SEQ ID NO: 604863 - RNA, 21 nt, Human
ugguggaccagugcugggaga

SEQ ID NO: 604864 - RNA, 22 nt, Human
aguucagcuucccaggucacug

SEQ ID NO: 604865 - RNA, 22 nt, Human
cucucuguucauugagucaaaa

SEQ ID NO: 604866 - RNA, 22 nt, Human
uagugcuucuacccuaggcagg

SEQ ID NO: 604867 - RNA, 19 nt, Human
ugcugacugagcugcaaaa

SEQ ID NO: 604868 - RNA, 22 nt, Human
cuggaggcugaguugggucucc

SEQ ID NO: 604869 - RNA, 22 nt, Human
aggggucuugaggacuccagca

SEQ ID NO: 604870 - RNA, 22 nt, Human
caccaggaccccacgguggguu

SEQ ID NO: 604871 - RNA, 22 nt, Human
agccaguguuaagugacugguu

SEQ ID NO: 604872 - RNA, 22 nt, Human
ugcacaucuuucagcaucauac

SEQ ID NO: 604873 - RNA, 22 nt, Human
uccugucuuaaugaucucgugc

SEQ ID NO: 604874 - RNA, 22 nt, Human
gcugauguuuaguugauguuac

SEQ ID NO: 604875 - RNA, 22 nt, Human
gauggguagaaguggaagaggu

SEQ ID NO: 604876 - RNA, 22 nt, Human
uguugauuugugggcugcaaaa

SEQ ID NO: 604877 - RNA, 22 nt, Human
uugacaaaaauaacacagcaua

SEQ ID NO: 604878 - RNA, 22 nt, Human
aauugcacuuuagcaaugguga

SEQ ID NO: 604879 - RNA, 22 nt, Human
gagagggugccuggaagccagg

SEQ ID NO: 604880 - RNA, 22 nt, Human
uucagaacugucuguccuuuuc

SEQ ID NO: 604881 - RNA, 18 nt, Human
uggcagugagguaggcau

SEQ ID NO: 604882 - RNA, 20 nt, Human
gaggcugaaguguuuuugcu

SEQ ID NO: 604883 - RNA, 22 nt, Human
aaguguggggucucagagcuga

SEQ ID NO: 604884 - RNA, 22 nt, Human
uucugucucccugauguagagc

SEQ ID NO: 604885 - RNA, 22 nt, Human
ggcugccucaaagcucaagcuc

SEQ ID NO: 604886 - RNA, 22 nt, Human
gaguuauuaauggcugaguuug

SEQ ID NO: 604887 - RNA, 22 nt, Human
gguauacaagagcaauuuaggg

SEQ ID NO: 604888 - RNA, 22 nt, Human
aauuuuaucucuaagcaggcuu

SEQ ID NO: 604889 - RNA, 22 nt, Human
ucugcuguucauucuuuuagcu

SEQ ID NO: 604890 - RNA, 22 nt, Human
ugggacugagaauaugaugggg

SEQ ID NO: 604891 - RNA, 22 nt, Human
ucuggcaggaccaugaagcgua

SEQ ID NO: 604892 - RNA, 22 nt, Human
agucagugaaaacuagaauguu

SEQ ID NO: 604893 - RNA, 22 nt, Human
cacuggauuuccaggaauacuc

SEQ ID NO: 604894 - RNA, 22 nt, Human
uucuaaauuuuggaagaugcag

SEQ ID NO: 604895 - RNA, 22 nt, Human
gcuguaugugaggccacaguga

SEQ ID NO: 604896 - RNA, 22 nt, Human
ccagaagcuucuacacaggaga

SEQ ID NO: 604897 - RNA, 22 nt, Human
aagaacaugaacacaauguuua

SEQ ID NO: 604898 - RNA, 22 nt, Human
aguggcagagguugacugcagu

SEQ ID NO: 604899 - RNA, 18 nt, Human
agaauugcugcuucuucu

SEQ ID NO: 604900 - RNA, 22 nt, Human
acagauaauuuaauuaaugcau

SEQ ID NO: 604901 - RNA, 22 nt, Human
uuugaaugagaauuauugucau

SEQ ID NO: 604902 - RNA, 22 nt, Human
ccugcucagccccagcucaccc

SEQ ID NO: 604903 - RNA, 22 nt, Human
aggcuggaguguagcagugcag

SEQ ID NO: 604904 - RNA, 22 nt, Human
cugugccucaguguccucgagu

SEQ ID NO: 604905 - RNA, 22 nt, Human
aggggaggcagcgauaaaccug

SEQ ID NO: 604906 - RNA, 22 nt, Human
gccagggcugugcagguuuguu

SEQ ID NO: 604907 - RNA, 21 nt, Human
agcaccaguuuuaugccaggc

SEQ ID NO: 604908 - RNA, 22 nt, Human
ugcauaaagugccauaguauua

SEQ ID NO: 604909 - RNA, 22 nt, Human
ugccaaggguaugggcaagaua

SEQ ID NO: 604910 - RNA, 22 nt, Human
aagcaugcaaucugugauaagg

SEQ ID NO: 604911 - RNA, 22 nt, Human
auaagcagggucaaaugccuac

SEQ ID NO: 604912 - RNA, 22 nt, Human
ccugucugcagauaucucaggu

SEQ ID NO: 604913 - RNA, 22 nt, Human
uuucuggguuuaugucacagcu

SEQ ID NO: 604914 - RNA, 22 nt, Human
uauaauuaguaaauggcagauu

SEQ ID NO: 604915 - RNA, 22 nt, Human
gcccaggaggucaaguagcuau

SEQ ID NO: 604916 - RNA, 22 nt, Human
augcuaaacuaugaucauuuuc

SEQ ID NO: 604917 - RNA, 22 nt, Human
accaugggcagaaucuuugcag

SEQ ID NO: 604918 - RNA, 22 nt, Human
uugcagggaaaucagugaggau

SEQ ID NO: 604919 - RNA, 22 nt, Human
aaagccagggacagugugcaug

SEQ ID NO: 604920 - RNA, 20 nt, Human
cucaucucugagccuccugg

SEQ ID NO: 604921 - RNA, 22 nt, Human
ggcauuuaguuuucauauucug

SEQ ID NO: 604922 - RNA, 22 nt, Human
aguucuauuucuaacauguuau

SEQ ID NO: 604923 - RNA, 22 nt, Human
agguugaaauagguuaucuaag

SEQ ID NO: 604924 - RNA, 22 nt, Human
agauaauuugaguaaauuaauu

SEQ ID NO: 604925 - RNA, 23 nt, Human
ggcuccaggccugacgggcgcgg

SEQ ID NO: 604926 - RNA, 22 nt, Human
caaacauucaaguacaagucuu

SEQ ID NO: 604927 - RNA, 22 nt, Human
ucccuagucgcaucuguggaga

SEQ ID NO: 604928 - RNA, 22 nt, Human
uuuguguuguacuucugugcau

SEQ ID NO: 604929 - RNA, 22 nt, Human
auuauuauuguugauguuaggg

SEQ ID NO: 604930 - RNA, 22 nt, Human
gaggccacaguccugaggcauc

SEQ ID NO: 604931 - RNA, 22 nt, Human
gcugggcaccucucccagauug

SEQ ID NO: 604932 - RNA, 22 nt, Human
cagcucugaggaacacuccuuu

SEQ ID NO: 604933 - RNA, 20 nt, Human
guagaaccaugugugcuggg

SEQ ID NO: 604934 - RNA, 22 nt, Human
uagcaucagccacaccuuguac

SEQ ID NO: 604935 - RNA, 22 nt, Human
aguugaagguuggcugauccau

SEQ ID NO: 604936 - RNA, 22 nt, Human
auccucagcaucuagcaugaag

SEQ ID NO: 604937 - RNA, 22 nt, Human
uucuuuuagucauucagggaag

SEQ ID NO: 604938 - RNA, 22 nt, Human
uggcagggugccaguugcgagu

SEQ ID NO: 604939 - RNA, 22 nt, Human
cccugacccaaaacugucagaa

SEQ ID NO: 604940 - RNA, 22 nt, Human
agguaggaguugauggauguuc

SEQ ID NO: 604941 - RNA, 22 nt, Human
acaguguuuauguacagauugu

SEQ ID NO: 604942 - RNA, 22 nt, Human
auaaaaguaggaccaacuuaca

SEQ ID NO: 604943 - RNA, 22 nt, Human
ggugggaggcaggcugcuccca

SEQ ID NO: 604944 - RNA, 22 nt, Human
agcugagcuaguaguuccagug

SEQ ID NO: 604945 - RNA, 22 nt, Human
ucucugugagccagguccuagu

SEQ ID NO: 604946 - RNA, 22 nt, Human
accagagggcaaaccccagugu

SEQ ID NO: 604947 - RNA, 22 nt, Human
gcugccuggauuugcaauccuc

SEQ ID NO: 604948 - RNA, 22 nt, Human
caauuucuuguuaauucucagg

SEQ ID NO: 604949 - RNA, 19 nt, Human
ggugugugcuggggccugu

SEQ ID NO: 604950 - RNA, 22 nt, Human
uuucuuaugugcagagugagua

SEQ ID NO: 604951 - RNA, 18 nt, Human
agcagagcccaugcauuc

SEQ ID NO: 604952 - RNA, 22 nt, Human
augcugaagagugcacaggcua

SEQ ID NO: 604953 - RNA, 22 nt, Human
aucuacaggauuuuacagaguu

SEQ ID NO: 604954 - RNA, 22 nt, Human
ugcaugugugacaaggacaguu

SEQ ID NO: 604955 - RNA, 22 nt, Human
uaguuucuaaacugaacuguca

SEQ ID NO: 604956 - RNA, 22 nt, Human
uagucuuuugagaaguauaucu

SEQ ID NO: 604957 - RNA, 22 nt, Human
ucagagagguuggugauaagaa

SEQ ID NO: 604958 - RNA, 23 nt, Human
aggcuccacucccugggaugugg

SEQ ID NO: 604959 - RNA, 22 nt, Human
ucccuucaauaauucaacauua

SEQ ID NO: 604960 - RNA, 22 nt, Human
auguuucaguucuaaaguuaga

SEQ ID NO: 604961 - RNA, 22 nt, Human
ggguggccuuaggcaagucacu

SEQ ID NO: 604962 - RNA, 22 nt, Human
auagaaacagaugcacuucucu

SEQ ID NO: 604963 - RNA, 22 nt, Human
ggcugccucugaugugcagacg

SEQ ID NO: 604964 - RNA, 22 nt, Human
uggagacugacugccuguauuu

SEQ ID NO: 604965 - RNA, 17 nt, Human
uccuucagugccucugc

SEQ ID NO: 604966 - RNA, 22 nt, Human
ucuuacaagaaggaaaagggag

SEQ ID NO: 604967 - RNA, 22 nt, Human
gaacuuuaauuagcuuuugucu

SEQ ID NO: 604968 - RNA, 22 nt, Human
cugggcugcagcgggagcgacg

SEQ ID NO: 604969 - RNA, 22 nt, Human
ugacacugcaaauauaaauauu

SEQ ID NO: 604970 - RNA, 19 nt, Human
acccucucuguagaaagau

SEQ ID NO: 604971 - RNA, 22 nt, Human
ugggcugcacccucagccucug

SEQ ID NO: 604972 - RNA, 22 nt, Human
uggaaauacaagaaguauguca

SEQ ID NO: 604973 - RNA, 23 nt, Human
ggucccaguggagaggccucacc

SEQ ID NO: 604974 - RNA, 22 nt, Human
ugcccucauuauaagaggcuca

SEQ ID NO: 604975 - RNA, 22 nt, Human
ucccagccacagguguagcccu

SEQ ID NO: 604976 - RNA, 22 nt, Human
ucagcacuguguccagucuccc

SEQ ID NO: 604977 - RNA, 22 nt, Human
uuuaauuuucugggcccagcag

SEQ ID NO: 604978 - RNA, 19 nt, Human
ugcaagcuuuuucuuguua

SEQ ID NO: 604979 - RNA, 22 nt, Human
cagcugcugauggccugacaga

SEQ ID NO: 604980 - RNA, 23 nt, Human
gcuucugccauuugcuagcugug

SEQ ID NO: 604981 - RNA, 22 nt, Human
aaacuguaggagggaaaggaag

SEQ ID NO: 604982 - RNA, 22 nt, Human
ugucaucucacugauauagaug

SEQ ID NO: 604983 - RNA, 22 nt, Human
aaaauuuucagcuugacuugau

SEQ ID NO: 604984 - RNA, 18 nt, Human
ucacuggguguauguggc

SEQ ID NO: 604985 - RNA, 20 nt, Human
uacauauuauaucagcugca

SEQ ID NO: 604986 - RNA, 22 nt, Human
auucugcacauccaagaacagg

SEQ ID NO: 604987 - RNA, 22 nt, Human
cucuccagggcaugaguuccac

SEQ ID NO: 604988 - RNA, 22 nt, Human
cacugcccucacugugguucuc

SEQ ID NO: 604989 - RNA, 22 nt, Human
gccucucugggcugccgaggcu

SEQ ID NO: 604990 - RNA, 22 nt, Human
uuuacacauuauuuucagugug

SEQ ID NO: 604991 - RNA, 22 nt, Human
ugaaggaaagagggaacauccc

SEQ ID NO: 604992 - RNA, 22 nt, Human
ccaggugguucaggucaccaua

SEQ ID NO: 604993 - RNA, 22 nt, Human
ucucaaauuuauacagaguuca

SEQ ID NO: 604994 - RNA, 20 nt, Human
gagccuuccccucaccacug

SEQ ID NO: 604995 - RNA, 22 nt, Human
uaugucaaaguuaagaaauagg

SEQ ID NO: 604996 - RNA, 21 nt, Human
uagcagaaacaguucaggcca

SEQ ID NO: 604997 - RNA, 20 nt, Human
uccuaacuauaaaguggcuc

SEQ ID NO: 604998 - RNA, 19 nt, Human
ccagcagcuuugauucucu

SEQ ID NO: 604999 - RNA, 22 nt, Human
gaggcugcccacaccugcgccg

SEQ ID NO: 605000 - RNA, 20 nt, Human
ggccucaguguccuuguuug

SEQ ID NO: 605001 - RNA, 20 nt, Human
ucuggcaggugaacgagcug

SEQ ID NO: 605002 - RNA, 22 nt, Human
uuccuucuccagaacuucuagg

SEQ ID NO: 605003 - RNA, 22 nt, Human
acagacagaggcuccaugagga

SEQ ID NO: 605004 - RNA, 22 nt, Human
agcagcaacugcuagaguggca

SEQ ID NO: 605005 - RNA, 22 nt, Human
ucugaaaucuguaagcacuagc

SEQ ID NO: 605006 - RNA, 22 nt, Human
uggcagcuagcuguuuucaugc

SEQ ID NO: 605007 - RNA, 22 nt, Human
uuauggagugcuuaccugccag

SEQ ID NO: 605008 - RNA, 22 nt, Human
gcaggauugggcugaaggagug

SEQ ID NO: 605009 - RNA, 22 nt, Human
uuccuaaccucuagcugcauau

SEQ ID NO: 605010 - RNA, 18 nt, Human
gcugagguggugucagag

SEQ ID NO: 605011 - RNA, 22 nt, Human
gggcacugagaauuuuccacuu

SEQ ID NO: 605012 - RNA, 19 nt, Human
acagagggcaacugagaaa

SEQ ID NO: 605013 - RNA, 22 nt, Human
ccugggugacccgugagcgucc

SEQ ID NO: 605014 - RNA, 22 nt, Human
caaagcaguuuuaaucaaguag

SEQ ID NO: 605015 - RNA, 22 nt, Human
uggaggcagucaccugaaguca

SEQ ID NO: 605016 - RNA, 22 nt, Human
agcugaggguucgguguccaca

SEQ ID NO: 605017 - RNA, 22 nt, Human
gcaggcuguagacaccaaacua

SEQ ID NO: 605018 - RNA, 22 nt, Human
aggagaguaccauugggccgca

SEQ ID NO: 605019 - RNA, 22 nt, Human
ugcugcuucaccuguuguacag

SEQ ID NO: 605020 - RNA, 22 nt, Human
acaguguugaggugcuuguuuc

SEQ ID NO: 605021 - RNA, 22 nt, Human
cugccugcaucccacagugggg

SEQ ID NO: 605022 - RNA, 17 nt, Human
agacagaccucugcauc

SEQ ID NO: 605023 - RNA, 22 nt, Human
ggaaaagacagaauucuagaau

SEQ ID NO: 605024 - RNA, 22 nt, Human
aacauucuucaaauaucacucu

SEQ ID NO: 605025 - RNA, 22 nt, Human
uggagcaggugcucaggguaau

SEQ ID NO: 605026 - RNA, 22 nt, Human
gcugccaguaguuggagcucca

SEQ ID NO: 605027 - RNA, 22 nt, Human
uuuccuuugaggguccuacacu

SEQ ID NO: 605028 - RNA, 21 nt, Human
agggaaagaaaaugagcuaau

SEQ ID NO: 605029 - RNA, 22 nt, Human
uucuccuugguuuaugggacau

SEQ ID NO: 605030 - RNA, 17 nt, Human
auguuaauuucacauuu

SEQ ID NO: 605031 - RNA, 18 nt, Human
gcacagagcccaggcucu

SEQ ID NO: 605032 - RNA, 22 nt, Human
acagcucugggugcaggaggug

SEQ ID NO: 605033 - RNA, 21 nt, Human
ccuccaggugauuccgugcuc

SEQ ID NO: 605034 - RNA, 22 nt, Human
gagcagagacaguacaacuggc

SEQ ID NO: 605035 - RNA, 22 nt, Human
uggacaggggcugcuguuguca

SEQ ID NO: 605036 - RNA, 22 nt, Human
aauaugauccuuaaccuucaug

SEQ ID NO: 605037 - RNA, 22 nt, Human
gcagcuccuccugggcuggaga

SEQ ID NO: 605038 - RNA, 22 nt, Human
uuaaaugaacgagauaugcaac

SEQ ID NO: 605039 - RNA, 22 nt, Human
uguccugggaaugggaugcagu

SEQ ID NO: 605040 - RNA, 22 nt, Human
ugugacagucguuaggagcuca

SEQ ID NO: 605041 - RNA, 22 nt, Human
gcuggcucaagugugcuuccca

SEQ ID NO: 605042 - RNA, 22 nt, Human
aauguuuucauuauccuaacug

SEQ ID NO: 605043 - RNA, 22 nt, Human
agacaggccacucuggucuggu

SEQ ID NO: 605044 - RNA, 22 nt, Human
caugucuuucucaucacaucua

SEQ ID NO: 605045 - RNA, 22 nt, Human
ucugggauagggccagaacaug

SEQ ID NO: 605046 - RNA, 22 nt, Human
gagaaauaggcaaugguaucua

SEQ ID NO: 605047 - RNA, 22 nt, Human
uuaccuaaaauagcucaauuua

SEQ ID NO: 605048 - RNA, 22 nt, Human
gagcuggccucaggcacaggag

SEQ ID NO: 605049 - RNA, 22 nt, Human
cugagggcagugaugaagguga

SEQ ID NO: 605050 - RNA, 22 nt, Human
aagaguuuccaugcucugugcu

SEQ ID NO: 605051 - RNA, 22 nt, Human
agcugccucagcaacacagacc

SEQ ID NO: 605052 - RNA, 22 nt, Human
aggugcuggagucugggcagga

SEQ ID NO: 605053 - RNA, 22 nt, Human
ucucucuccuaguuuuuagugg

SEQ ID NO: 605054 - RNA, 22 nt, Human
cucuggcuuguuaaugcauauu

SEQ ID NO: 605055 - RNA, 22 nt, Human
auccagcacuuguucaugugaa

SEQ ID NO: 605056 - RNA, 22 nt, Human
ugcugaggucauuuccaaguga

SEQ ID NO: 605057 - RNA, 22 nt, Human
gugcugagauuacaggugugag

SEQ ID NO: 605058 - RNA, 22 nt, Human
ggcuggaggagaauggguguga

SEQ ID NO: 605059 - RNA, 22 nt, Human
aguguacaguucuaugaauuuc

SEQ ID NO: 605060 - RNA, 22 nt, Human
gcuuuggucagguguccagccc

SEQ ID NO: 605061 - RNA, 22 nt, Human
aagauuuucucaacuguauuug

SEQ ID NO: 605062 - RNA, 23 nt, Human
auugaccagcugucucauuuuca

SEQ ID NO: 605063 - RNA, 22 nt, Human
aacacugugagguaaugaccua

SEQ ID NO: 605064 - RNA, 22 nt, Human
ugugcaguuucuauguugucca

SEQ ID NO: 605065 - RNA, 22 nt, Human
aaagaagauggagaccugacua

SEQ ID NO: 605066 - RNA, 17 nt, Human
ccucccacaccgcccug

SEQ ID NO: 605067 - RNA, 22 nt, Human
agggcucccgugaggugacugc

SEQ ID NO: 605068 - RNA, 22 nt, Human
uccuuccuuccugaaauuuuag

SEQ ID NO: 605069 - RNA, 22 nt, Human
gccuucugauugcuggacugac

SEQ ID NO: 605070 - RNA, 22 nt, Human
aguaaauuucugcauguguacu

SEQ ID NO: 605071 - RNA, 22 nt, Human
aauuagcauuucccauauaaau

SEQ ID NO: 605072 - RNA, 22 nt, Human
aagcuucauuucaacucagggg

SEQ ID NO: 605073 - RNA, 22 nt, Human
uacagguagagucucuaguuua

SEQ ID NO: 605074 - RNA, 22 nt, Human
cugcugggauagaaguaucuca

SEQ ID NO: 605075 - RNA, 22 nt, Human
aacuuucuuucacagaaguauc

SEQ ID NO: 605076 - RNA, 22 nt, Human
accugggaggcagagguugcag

SEQ ID NO: 605077 - RNA, 22 nt, Human
agggccagccccacccucucug

SEQ ID NO: 605078 - RNA, 22 nt, Human
cuacagaguaucuaaagaggua

SEQ ID NO: 605079 - RNA, 22 nt, Human
uugccuuugacggugcagcagu

SEQ ID NO: 605080 - RNA, 22 nt, Human
accuuaaaugugacauagucua

SEQ ID NO: 605081 - RNA, 22 nt, Human
cauuugaaccuggauguucuua

SEQ ID NO: 605082 - RNA, 22 nt, Human
uguuucuugggugcucacauca

SEQ ID NO: 605083 - RNA, 22 nt, Human
gccacagcagggcccucucagg

SEQ ID NO: 605084 - RNA, 22 nt, Human
ugagcuggcaggggcucaggga

SEQ ID NO: 605085 - RNA, 21 nt, Human
guggccugauuaugaaugggu

SEQ ID NO: 605086 - RNA, 22 nt, Human
uuuacacaaaagauagcacacc

SEQ ID NO: 605087 - RNA, 22 nt, Human
aguuuacagauguaguaggggu

SEQ ID NO: 605088 - RNA, 22 nt, Human
guauuuuacugcucaaagcucu

SEQ ID NO: 605089 - RNA, 22 nt, Human
agggggcucagcaggcucugga

SEQ ID NO: 605090 - RNA, 22 nt, Human
cuuuacaaauagggagggagug

SEQ ID NO: 605091 - RNA, 22 nt, Human
aggcuaaggugggaggaucgcu

SEQ ID NO: 605092 - RNA, 22 nt, Human
uacuguaugaauuauguuauuu

SEQ ID NO: 605093 - RNA, 22 nt, Human
ucugaggaaaagaggagguagc

SEQ ID NO: 605094 - RNA, 22 nt, Human
gcaguaaagccugagauauaug

SEQ ID NO: 605095 - RNA, 22 nt, Human
accaggagggacccugguggcc

SEQ ID NO: 605096 - RNA, 22 nt, Human
agcugcuggggagggcagacac

SEQ ID NO: 605097 - RNA, 22 nt, Human
acaugaaaagacuaucugauua

SEQ ID NO: 605098 - RNA, 22 nt, Human
caguuuuugccauuaagaguaa

SEQ ID NO: 605099 - RNA, 22 nt, Human
aagaggcuggaggauacugcgc

SEQ ID NO: 605100 - RNA, 22 nt, Human
uaacauuuaaauuuuucacaua

SEQ ID NO: 605101 - RNA, 20 nt, Human
gggugagauguaggagaggg

SEQ ID NO: 605102 - RNA, 23 nt, Human
auaaugcaaguggugguaaucug

SEQ ID NO: 605103 - RNA, 22 nt, Human
cauggggaugaggcugagacuu

SEQ ID NO: 605104 - RNA, 19 nt, Human
uagagcugcuuccuggcag

SEQ ID NO: 605105 - RNA, 22 nt, Human
ucuggcuucaguaggguucacu

SEQ ID NO: 605106 - RNA, 22 nt, Human
caaugcuucugagggaauuaca

SEQ ID NO: 605107 - RNA, 22 nt, Human
acagcuguauucaaguugcaag

SEQ ID NO: 605108 - RNA, 22 nt, Human
uggaaggaaagguagcagagaa

SEQ ID NO: 605109 - RNA, 22 nt, Human
aggagagucuugagucacuggu

SEQ ID NO: 605110 - RNA, 22 nt, Human
gcugccuccugagauuugggca

SEQ ID NO: 605111 - RNA, 22 nt, Human
uccuugacugugaggaacuagc

SEQ ID NO: 605112 - RNA, 22 nt, Human
uaggcugggcugagcuggacgg

SEQ ID NO: 605113 - RNA, 22 nt, Human
ugaaugauaugugaaaaggaac

SEQ ID NO: 605114 - RNA, 22 nt, Human
ggucugagguuugggauucacu

SEQ ID NO: 605115 - RNA, 22 nt, Human
aucaaauuaugugcuacaagaa

SEQ ID NO: 605116 - RNA, 22 nt, Human
gucccucaagguccagucaugg

SEQ ID NO: 605117 - RNA, 14 nt, Human
aagaucaccuuccu

SEQ ID NO: 605118 - RNA, 22 nt, Human
gggcacuggaaggcucucaggc

SEQ ID NO: 605119 - RNA, 22 nt, Human
agguaaagacagugaaagaggg

SEQ ID NO: 605120 - RNA, 22 nt, Human
ugggacagauuauaagucugca

SEQ ID NO: 605121 - RNA, 22 nt, Human
ugggcagcaaagacugugugcu

SEQ ID NO: 605122 - RNA, 22 nt, Human
cagggccaggcugauggccugg

SEQ ID NO: 605123 - RNA, 22 nt, Human
ccuucccaggcuagaccaacau

SEQ ID NO: 605124 - RNA, 22 nt, Human
agcccaugguguacucuguggc

SEQ ID NO: 605125 - RNA, 22 nt, Human
uugaaguugcacauuauaauuu

SEQ ID NO: 605126 - RNA, 22 nt, Human
aacuaauacauuaauacaugug

SEQ ID NO: 605127 - RNA, 22 nt, Human
cagugcccuuccaggacugcag

SEQ ID NO: 605128 - RNA, 22 nt, Human
aagaggccacagcugacagcac

SEQ ID NO: 605129 - RNA, 22 nt, Human
gguaggagugaagacuuaagau

SEQ ID NO: 605130 - RNA, 22 nt, Human
agggagaaaauuggaugcacaa

SEQ ID NO: 605131 - RNA, 22 nt, Human
acauucucuccaugucuucuuu

SEQ ID NO: 605132 - RNA, 22 nt, Human
uaucuugccuuuaacugcucau

SEQ ID NO: 605133 - RNA, 20 nt, Human
ugugcccugcagacuucuuu

SEQ ID NO: 605134 - RNA, 22 nt, Human
aauguauaauauuuaaugcuuu

SEQ ID NO: 605135 - RNA, 22 nt, Human
gcugucacauuuggagcacugg

SEQ ID NO: 605136 - RNA, 22 nt, Human
uaaaggaaucaguuuuagagau

SEQ ID NO: 605137 - RNA, 18 nt, Human
gacccagcagaugggcuu

SEQ ID NO: 605138 - RNA, 22 nt, Human
cacagagauuagaauuagacua

SEQ ID NO: 605139 - RNA, 22 nt, Human
ccaguguuugaugggauuuuca

SEQ ID NO: 605140 - RNA, 22 nt, Human
aaauaguucagccacggugacu

SEQ ID NO: 605141 - RNA, 22 nt, Human
acauaaauagauuauugggagg

SEQ ID NO: 605142 - RNA, 22 nt, Human
cuuggcauuguguugauagaag

SEQ ID NO: 605143 - RNA, 19 nt, Human
agcuaauggaaguuuacug

SEQ ID NO: 605144 - RNA, 22 nt, Human
guucaaauggcugcaguuacca

SEQ ID NO: 605145 - RNA, 22 nt, Human
cugaacaucccgcagugcacga

SEQ ID NO: 605146 - RNA, 19 nt, Human
aggucugcagcugcaguuu

SEQ ID NO: 605147 - RNA, 19 nt, Human
agccacagaacuugcagga

SEQ ID NO: 605148 - RNA, 22 nt, Human
cuuccucccccacacacucacu

SEQ ID NO: 605149 - RNA, 22 nt, Human
ugaagcaaauuguuuagccuga

SEQ ID NO: 605150 - RNA, 22 nt, Human
cagggugcgggagaugugcacc

SEQ ID NO: 605151 - RNA, 22 nt, Human
uggccaugaaggaggcagcaga

SEQ ID NO: 605152 - RNA, 20 nt, Human
gagccugggaagucuaaggu

SEQ ID NO: 605153 - RNA, 22 nt, Human
uggagcagggcaucacugugcg

SEQ ID NO: 605154 - RNA, 22 nt, Human
ggcuucuuccuggcuccuauua

SEQ ID NO: 605155 - RNA, 22 nt, Human
aucuuuacaguguaagugcaga

SEQ ID NO: 605156 - RNA, 22 nt, Human
auauguguauggauuucuaucu

SEQ ID NO: 605157 - RNA, 22 nt, Human
uucuguuuuagaaauaaguagu

SEQ ID NO: 605158 - RNA, 22 nt, Human
uggaucaugugaugucaggagu

SEQ ID NO: 605159 - RNA, 22 nt, Human
cugggcucaguggcucauggcu

SEQ ID NO: 605160 - RNA, 22 nt, Human
cugccuuccaaccccagacucc

SEQ ID NO: 605161 - RNA, 18 nt, Human
ccuguguguguugcaggc

SEQ ID NO: 605162 - RNA, 22 nt, Human
cuuuguaagucuuucuccaaga

SEQ ID NO: 605163 - RNA, 22 nt, Human
gccauggggcucagcugcacua

SEQ ID NO: 605164 - RNA, 22 nt, Human
uuucagaaauuauauuagaugc

SEQ ID NO: 605165 - RNA, 22 nt, Human
aggaggggcauagaaauguaau

SEQ ID NO: 605166 - RNA, 22 nt, Human
cagcuuccauaagagauggaga

SEQ ID NO: 605167 - RNA, 19 nt, Human
ucucuggggacacuuucac

SEQ ID NO: 605168 - RNA, 22 nt, Human
aucugccugcaguggagguggg

SEQ ID NO: 605169 - RNA, 22 nt, Human
ugcauuaaggccauugaaauuu

SEQ ID NO: 605170 - RNA, 22 nt, Human
gggaaacuucugcuaaaaccag

SEQ ID NO: 605171 - RNA, 18 nt, Human
gcagagcugggauuccca

SEQ ID NO: 605172 - RNA, 22 nt, Human
uuuaugcagcacuuuacauuug

SEQ ID NO: 605173 - RNA, 22 nt, Human
uguaacaugguucuuacucuca

SEQ ID NO: 605174 - RNA, 22 nt, Human
cggggccuagucuaccucggca

SEQ ID NO: 605175 - RNA, 22 nt, Human
uccucauacauaucucagucuu

SEQ ID NO: 605176 - RNA, 22 nt, Human
uggucucuccaugcccuccacc

SEQ ID NO: 605177 - RNA, 22 nt, Human
caggcuccagcuuccugcucag

SEQ ID NO: 605178 - RNA, 22 nt, Human
aaggccuugccugacagcacca

SEQ ID NO: 605179 - RNA, 20 nt, Human
cccagggaccugagcuccau

SEQ ID NO: 605180 - RNA, 22 nt, Human
gcuggccucgcaggcaggaugu

SEQ ID NO: 605181 - RNA, 22 nt, Human
uggccuuggcagugagaagagu

SEQ ID NO: 605182 - RNA, 22 nt, Human
ugcagaagaaugagcuuggagu

SEQ ID NO: 605183 - RNA, 22 nt, Human
gacaagacugguuuauuuaagg

SEQ ID NO: 605184 - RNA, 22 nt, Human
ucugccuugagguccucagcuc

SEQ ID NO: 605185 - RNA, 22 nt, Human
auggcuggcacuggccuggguu

SEQ ID NO: 605186 - RNA, 22 nt, Human
uuugugcacuucuguagcugcc

SEQ ID NO: 605187 - RNA, 22 nt, Human
caggcuggaguacaauugugug

SEQ ID NO: 605188 - RNA, 22 nt, Human
cugugcucuggcaucgcugcaa

SEQ ID NO: 605189 - RNA, 22 nt, Human
gaggaagggacuuuauuaucug

SEQ ID NO: 605190 - RNA, 22 nt, Human
acccagggagugcuccuguucu

SEQ ID NO: 605191 - RNA, 19 nt, Human
aaacacagauuucuuacca

SEQ ID NO: 605192 - RNA, 22 nt, Human
uccacgcugugugaccuugggc

SEQ ID NO: 605193 - RNA, 22 nt, Human
gccuggcuccuaagagcacaac

SEQ ID NO: 605194 - RNA, 22 nt, Human
gaacuggguccuugagucuaga

SEQ ID NO: 605195 - RNA, 22 nt, Human
aucuggagcuuguuagauguuu

SEQ ID NO: 605196 - RNA, 22 nt, Human
uuugaaaggguuaugagacuga

SEQ ID NO: 605197 - RNA, 22 nt, Human
aagauugucaggcuugcuguau

SEQ ID NO: 605198 - RNA, 22 nt, Human
aauaagcuggagcuauauugag

SEQ ID NO: 605199 - RNA, 22 nt, Human
uguccacaucacucacuuguca

SEQ ID NO: 605200 - RNA, 22 nt, Human
guuaugaagucauucacaaaua

SEQ ID NO: 605201 - RNA, 20 nt, Human
cacaggcuauaugagagcca

SEQ ID NO: 605202 - RNA, 22 nt, Human
ucuuuccuacuuuauugugaac

SEQ ID NO: 605203 - RNA, 22 nt, Human
cuucucucugcauaggcauggg

SEQ ID NO: 605204 - RNA, 22 nt, Human
cucucugguacauagaguuugg

SEQ ID NO: 605205 - RNA, 22 nt, Human
ggcaggugcucugugggccugg

SEQ ID NO: 605206 - RNA, 21 nt, Human
aggcagcuggaaggccuggcu

SEQ ID NO: 605207 - RNA, 22 nt, Human
agucuccacaacagcccugaua

SEQ ID NO: 605208 - RNA, 22 nt, Human
cuagaauuuuaauuggguauau

SEQ ID NO: 605209 - RNA, 22 nt, Human
cauaauuaaauucugggcaaga

SEQ ID NO: 605210 - RNA, 22 nt, Human
cagagguagggagcuauguuau

SEQ ID NO: 605211 - RNA, 22 nt, Human
ccaccagcagugugcaaggauu

SEQ ID NO: 605212 - RNA, 22 nt, Human
uaggccacggaaagcagguugc

SEQ ID NO: 605213 - RNA, 22 nt, Human
ccacugucugcaggccucagca

SEQ ID NO: 605214 - RNA, 22 nt, Human
aauuacuuaagagaaacuuuga

SEQ ID NO: 605215 - RNA, 23 nt, Human
acuuuucaauuagcuaugcuuaa

SEQ ID NO: 605216 - RNA, 22 nt, Human
ucagcacuauacauuuugaaua

SEQ ID NO: 605217 - RNA, 18 nt, Human
ucauucaaagucuacuga

SEQ ID NO: 605218 - RNA, 22 nt, Human
acauuugaggauguuaagaaug

SEQ ID NO: 605219 - RNA, 22 nt, Human
uggcagagaauaaaucuugacu

SEQ ID NO: 605220 - RNA, 22 nt, Human
uaucauaaguuaauuaaacagu

SEQ ID NO: 605221 - RNA, 22 nt, Human
ugaggaagggugugacggcacc

SEQ ID NO: 605222 - RNA, 22 nt, Human
cugggccuccagcucugccagc

SEQ ID NO: 605223 - RNA, 22 nt, Human
uguccuuuuggcugucuauggu

SEQ ID NO: 605224 - RNA, 22 nt, Human
ggacaggguaaguacuagugug

SEQ ID NO: 605225 - RNA, 22 nt, Human
ugagcagauggaggcuucugca

SEQ ID NO: 605226 - RNA, 22 nt, Human
aauucauauggauaugcuagua

SEQ ID NO: 605227 - RNA, 22 nt, Human
uagcaggguccaaugugaggca

SEQ ID NO: 605228 - RNA, 22 nt, Human
cauaauuuuuuuaagucagaac

SEQ ID NO: 605229 - RNA, 22 nt, Human
cauacaaauguguccaggcucu

SEQ ID NO: 605230 - RNA, 22 nt, Human
aaucagaaaauucaguggaauu

SEQ ID NO: 605231 - RNA, 22 nt, Human
ugggcuggcugaggcauucacu

SEQ ID NO: 605232 - RNA, 22 nt, Human
ucucugagggagauggccugcc

SEQ ID NO: 605233 - RNA, 22 nt, Human
ugagcaguaacagcucacaggg

SEQ ID NO: 605234 - RNA, 18 nt, Human
acucaaggguggagagaa

SEQ ID NO: 605235 - RNA, 22 nt, Human
acacauauguaugcaucaugug

SEQ ID NO: 605236 - RNA, 22 nt, Human
uuucagaguuauguaagaaaau

SEQ ID NO: 605237 - RNA, 22 nt, Human
uaugaagauauaucugaucucu

SEQ ID NO: 605238 - RNA, 22 nt, Human
agcuuugggcagaagaggauuc

SEQ ID NO: 605239 - RNA, 22 nt, Human
cugccccaggccuccuuuucuu

SEQ ID NO: 605240 - RNA, 22 nt, Human
cagaggcauuacugaaaaggug

SEQ ID NO: 605241 - RNA, 22 nt, Human
gugaggugggcuggccagagac

SEQ ID NO: 605242 - RNA, 22 nt, Human
gaguccaguucuuuccagcagu

SEQ ID NO: 605243 - RNA, 22 nt, Human
uauauguguggauucuuguaga

SEQ ID NO: 605244 - RNA, 22 nt, Human
cucgcaggacagugcuaggacu

SEQ ID NO: 605245 - RNA, 22 nt, Human
agggccagggaagcuguauuuu

SEQ ID NO: 605246 - RNA, 22 nt, Human
cccucccugugugccucauuug

SEQ ID NO: 605247 - RNA, 22 nt, Human
uuugcauuguaauauuuaguuc

SEQ ID NO: 605248 - RNA, 22 nt, Human
cuggcuuucugaacaucaguga

SEQ ID NO: 605249 - RNA, 22 nt, Human
caggagaagguuuggagugcag

SEQ ID NO: 605250 - RNA, 18 nt, Human
gcagagugcgucucugug

SEQ ID NO: 605251 - RNA, 22 nt, Human
auuuccuucccagauuugguuc

SEQ ID NO: 605252 - RNA, 22 nt, Human
uaaaugaagcucaugggccaca

SEQ ID NO: 605253 - RNA, 22 nt, Human
cacacugucuuucagaaugguu

SEQ ID NO: 605254 - RNA, 22 nt, Human
gcugcagaauuuccuucucauu

SEQ ID NO: 605255 - RNA, 20 nt, Human
aagcuuccaggaucuggugu

SEQ ID NO: 605256 - RNA, 22 nt, Human
uauagcauauacagauaagcug

SEQ ID NO: 605257 - RNA, 22 nt, Human
gcuuucugauugcgaaaacaaa

SEQ ID NO: 605258 - RNA, 22 nt, Human
ugacugccccuuccauuccugc

SEQ ID NO: 605259 - RNA, 22 nt, Human
gaggccagggaugcaaugagag

SEQ ID NO: 605260 - RNA, 22 nt, Human
aaaaaaucagaucuuugguuaa

SEQ ID NO: 605261 - RNA, 22 nt, Human
uccccaccuacacacugcuccu

SEQ ID NO: 605262 - RNA, 22 nt, Human
aguggaccagaagacugaagcu

SEQ ID NO: 605263 - RNA, 22 nt, Human
ugcccuuauaaaggaggccuga

SEQ ID NO: 605264 - RNA, 22 nt, Human
uccaguuugggugugagcugcg

SEQ ID NO: 605265 - RNA, 22 nt, Human
ucuguugacuccuagcagccau

SEQ ID NO: 605266 - RNA, 22 nt, Human
caaugcacgcucagauuugacc

SEQ ID NO: 605267 - RNA, 22 nt, Human
gacuggggcucuagccaggccu

SEQ ID NO: 605268 - RNA, 22 nt, Human
cagcucagucuggagagaugca

SEQ ID NO: 605269 - RNA, 22 nt, Human
auuagcuuaguguuuccguaau

SEQ ID NO: 605270 - RNA, 22 nt, Human
ucucuuauuuugccuuugacaa

SEQ ID NO: 605271 - RNA, 22 nt, Human
uggcugagaaaaaagagcuaua

SEQ ID NO: 605272 - RNA, 22 nt, Human
aaauugcauugagcugcuuauu

SEQ ID NO: 605273 - RNA, 22 nt, Human
ccagcuggggaaguggggcaua

SEQ ID NO: 605274 - RNA, 22 nt, Human
cugguuuuauguuauagaugga

SEQ ID NO: 605275 - RNA, 22 nt, Human
uccucauagacugacugcuugc

SEQ ID NO: 605276 - RNA, 22 nt, Human
auggguggagggugacacggau

SEQ ID NO: 605277 - RNA, 18 nt, Human
ccagagcuggcuccucgc

SEQ ID NO: 605278 - RNA, 22 nt, Human
gaauauuuguaauuacuguuga

SEQ ID NO: 605279 - RNA, 22 nt, Human
gaaagcagcuaagucuuaugau

SEQ ID NO: 605280 - RNA, 22 nt, Human
gggucccaggaaggagcagugu

SEQ ID NO: 605281 - RNA, 22 nt, Human
ucugaaauucacaguugaguca

SEQ ID NO: 605282 - RNA, 22 nt, Human
ugucaccacuggcugaaacacc

SEQ ID NO: 605283 - RNA, 22 nt, Human
agcacccuucagcccagccugg

SEQ ID NO: 605284 - RNA, 22 nt, Human
cugacaaaggcaaggcaggggg

SEQ ID NO: 605285 - RNA, 19 nt, Human
cugaggugcaguaagaggc

SEQ ID NO: 605286 - RNA, 22 nt, Human
gcaggaguaugcagcuaugguu

SEQ ID NO: 605287 - RNA, 22 nt, Human
aucacauuuauaguggcacgca

SEQ ID NO: 605288 - RNA, 22 nt, Human
gccacagcuuuuaaccucgggg

SEQ ID NO: 605289 - RNA, 22 nt, Human
guuuugcagagugcaauaaauc

SEQ ID NO: 605290 - RNA, 22 nt, Human
agccaggauggucucgaucggc

SEQ ID NO: 605291 - RNA, 22 nt, Human
aggagcacugagccagcauggg

SEQ ID NO: 605292 - RNA, 22 nt, Human
gaggaagaauugguuauuggag

SEQ ID NO: 605293 - RNA, 19 nt, Human
ucugaagaauuagagagca

SEQ ID NO: 605294 - RNA, 22 nt, Human
aaugguuuaacauaugcuugag

SEQ ID NO: 605295 - RNA, 20 nt, Human
caaguguuauugugcauuua

SEQ ID NO: 605296 - RNA, 22 nt, Human
gcagagcauguccucaggacag

SEQ ID NO: 605297 - RNA, 22 nt, Human
uacacauaggaggguaauaaaa

SEQ ID NO: 605298 - RNA, 22 nt, Human
agguggggccaaaugcuacagu

SEQ ID NO: 605299 - RNA, 22 nt, Human
auuuuacauaaggaagguuuaa

SEQ ID NO: 605300 - RNA, 22 nt, Human
guuuagaugagauuuuagaaca

SEQ ID NO: 605301 - RNA, 23 nt, Human
ugcaaaauuugcagaguucgaug

SEQ ID NO: 605302 - RNA, 22 nt, Human
agcagagacaugaaauaugcuu

SEQ ID NO: 605303 - RNA, 22 nt, Human
auuuucaguugaaaaaguuggu

SEQ ID NO: 605304 - RNA, 22 nt, Human
ggaggaggcggcagaaguuccu

SEQ ID NO: 605305 - RNA, 22 nt, Human
uccugguguaaugguaagcaug

SEQ ID NO: 605306 - RNA, 22 nt, Human
agaugauggccauguccucucc

SEQ ID NO: 605307 - RNA, 22 nt, Human
acaggauuaauaaaaaauugua

SEQ ID NO: 605308 - RNA, 22 nt, Human
uuuauauuguaaaaaugguucu

SEQ ID NO: 605309 - RNA, 22 nt, Human
ugguggccgaagcccucucuca

SEQ ID NO: 605310 - RNA, 22 nt, Human
aggcuucauuacagugguucaa

SEQ ID NO: 605311 - RNA, 22 nt, Human
uucuucaugcuguugcugcuug

SEQ ID NO: 605312 - RNA, 22 nt, Human
ugcacaaauuuguguaugcuca

SEQ ID NO: 605313 - RNA, 22 nt, Human
ugcugguaccgcgccuccgcca

SEQ ID NO: 605314 - RNA, 22 nt, Human
uuaauaauaaugagcccauuuu

SEQ ID NO: 605315 - RNA, 17 nt, Human
ccaggagagaugcuugu

SEQ ID NO: 605316 - RNA, 21 nt, Human
agcugcuccagggagcucagg

SEQ ID NO: 605317 - RNA, 22 nt, Human
cuuuaagacuaaauuagaguuu

SEQ ID NO: 605318 - RNA, 22 nt, Human
cugauuuucaaaauguguuaaa

SEQ ID NO: 605319 - RNA, 22 nt, Human
gcagacagcauguugggcuauu

SEQ ID NO: 605320 - RNA, 22 nt, Human
aauaaugucugcuauuuuaaaa

SEQ ID NO: 605321 - RNA, 22 nt, Human
uuaucuuagaggugauuguauu

SEQ ID NO: 605322 - RNA, 22 nt, Human
ggcacagcucaggucccagcuc

SEQ ID NO: 605323 - RNA, 22 nt, Human
uuagugucuucuucauccucug

SEQ ID NO: 605324 - RNA, 22 nt, Human
cagaaauaucaguugaaagugc

SEQ ID NO: 605325 - RNA, 22 nt, Human
uuguuuuuaaacaugugacuga

SEQ ID NO: 605326 - RNA, 20 nt, Human
uagggagauaugcucuuuuc

SEQ ID NO: 605327 - RNA, 22 nt, Human
aacaugaaguuuucuauaguga

SEQ ID NO: 605328 - RNA, 22 nt, Human
cugugccuuaguauucucauuu

SEQ ID NO: 605329 - RNA, 22 nt, Human
agucacaugagcacuaauuagg

SEQ ID NO: 605330 - RNA, 22 nt, Human
cuauuacaaucugcuacuauga

SEQ ID NO: 605331 - RNA, 20 nt, Human
uauacuaacauauaucuguu

SEQ ID NO: 605332 - RNA, 22 nt, Human
ugcaagggcuuagggggcugug

SEQ ID NO: 605333 - RNA, 22 nt, Human
gugccacauggccuaauagaga

SEQ ID NO: 605334 - RNA, 22 nt, Human
uuauguguguacaugcauaugu

SEQ ID NO: 605335 - RNA, 22 nt, Human
aacaaucuguucgauagaaaau

SEQ ID NO: 605336 - RNA, 22 nt, Human
ucccugcccugccuucaugguu

SEQ ID NO: 605337 - RNA, 22 nt, Human
ggguccaccugagcagcagccu

SEQ ID NO: 605338 - RNA, 22 nt, Human
ggccgggcaggucucagccagc

SEQ ID NO: 605339 - RNA, 22 nt, Human
agacacagucugucuggaggag

SEQ ID NO: 605340 - RNA, 22 nt, Human
cauucacaucuuguuccaucac

SEQ ID NO: 605341 - RNA, 22 nt, Human
ggucaucugccuccaaagcacu

SEQ ID NO: 605342 - RNA, 22 nt, Human
acaguggaaagaaacgaauuag

SEQ ID NO: 605343 - RNA, 22 nt, Human
uggcagagcccagaacugagca

SEQ ID NO: 605344 - RNA, 22 nt, Human
gagggccaaagagcaagagccu

SEQ ID NO: 605345 - RNA, 22 nt, Human
auuugugccaaauuauuucuaa

SEQ ID NO: 605346 - RNA, 22 nt, Human
gggggaggugaaugcaauaagg

SEQ ID NO: 605347 - RNA, 22 nt, Human
ucccugagugggcugguaguau

SEQ ID NO: 605348 - RNA, 22 nt, Human
uucugaaagucuuuuuaaguua

SEQ ID NO: 605349 - RNA, 22 nt, Human
aagugccugaccuagccuggag

SEQ ID NO: 605350 - RNA, 22 nt, Human
uguguccuuaugaaaauacugu

SEQ ID NO: 605351 - RNA, 15 nt, Human
gccuugaaugugaau

SEQ ID NO: 605352 - RNA, 22 nt, Human
ucacuuugaugacauuguagcu

SEQ ID NO: 605353 - RNA, 22 nt, Human
uuaguuuucccaucuuuauggu

SEQ ID NO: 605354 - RNA, 22 nt, Human
guccucagucaguuuggugggg

SEQ ID NO: 605355 - RNA, 22 nt, Human
gggcacugcuggaggcucccug

SEQ ID NO: 605356 - RNA, 20 nt, Human
uacuggaaauuucuccaccu

SEQ ID NO: 605357 - RNA, 22 nt, Human
accaccaggggauuuucagaac

SEQ ID NO: 605358 - RNA, 22 nt, Human
ucugucuuuagaggccugugcu

SEQ ID NO: 605359 - RNA, 22 nt, Human
cccaagggaugcuugaguaguu

SEQ ID NO: 605360 - RNA, 22 nt, Human
ccucuucuagguuucagccugc

SEQ ID NO: 605361 - RNA, 22 nt, Human
uuauuuccaguccagaaauuua

SEQ ID NO: 605362 - RNA, 22 nt, Human
gcaggcacuccuaggaccauca

SEQ ID NO: 605363 - RNA, 22 nt, Human
ggucugaggugggacccaggaa

SEQ ID NO: 605364 - RNA, 22 nt, Human
augcuaaaaacuugaucauuau

SEQ ID NO: 605365 - RNA, 22 nt, Human
aaauguuccuuuggauuaaacu

SEQ ID NO: 605366 - RNA, 22 nt, Human
agcagguggccacgaggaggag

SEQ ID NO: 605367 - RNA, 22 nt, Human
uagaggugagaggaacuuugga

SEQ ID NO: 605368 - RNA, 22 nt, Human
augcuuaauacacuguuaaagg

SEQ ID NO: 605369 - RNA, 22 nt, Human
gcagagcagaggugcagguugg

SEQ ID NO: 605370 - RNA, 20 nt, Human
caggcacacucauuccugcu

SEQ ID NO: 605371 - RNA, 22 nt, Human
auaccaauuagaguuuguugca

SEQ ID NO: 605372 - RNA, 22 nt, Human
ggcuucugaaaucucugugcgu

SEQ ID NO: 605373 - RNA, 22 nt, Human
augcugaucuguaauaagauuu

SEQ ID NO: 605374 - RNA, 22 nt, Human
uccuggagggaggcggugcuac

SEQ ID NO: 605375 - RNA, 21 nt, Human
ugugauaaacuccaaguggga

SEQ ID NO: 605376 - RNA, 22 nt, Human
ugcaggcuccaugaggacaggc

SEQ ID NO: 605377 - RNA, 22 nt, Human
ucuccucuauuucuguauguau

SEQ ID NO: 605378 - RNA, 22 nt, Human
guacacagaugcuugagaaucu

SEQ ID NO: 605379 - RNA, 22 nt, Human
cagcauggggaucacuguaggc

SEQ ID NO: 605380 - RNA, 22 nt, Human
acaggggcuccgaaggugaggg

SEQ ID NO: 605381 - RNA, 20 nt, Human
agugaauagagacauugccc

SEQ ID NO: 605382 - RNA, 22 nt, Human
uuauaagaguauauaguguacu

SEQ ID NO: 605383 - RNA, 18 nt, Human
ucuagaaacuucucuccu

SEQ ID NO: 605384 - RNA, 22 nt, Human
aacaauaggagugaugcaguau

SEQ ID NO: 605385 - RNA, 22 nt, Human
auauuguguguacaaguaguua

SEQ ID NO: 605386 - RNA, 23 nt, Human
gaagccacacaaaggucgccaag

SEQ ID NO: 605387 - RNA, 21 nt, Human
ggaacauuguuaauagucucu

SEQ ID NO: 605388 - RNA, 21 nt, Human
agaaaaaccagcauguuuuca

SEQ ID NO: 605389 - RNA, 22 nt, Human
ggagguggagcuggaaguucca

SEQ ID NO: 605390 - RNA, 22 nt, Human
acuuucucaaaucagacuuuaa

SEQ ID NO: 605391 - RNA, 22 nt, Human
augcagggucuccgugugacga

SEQ ID NO: 605392 - RNA, 22 nt, Human
uucauagagcagcucacugaau

SEQ ID NO: 605393 - RNA, 22 nt, Human
aggcugagucaaguuaggguga

SEQ ID NO: 605394 - RNA, 22 nt, Human
cucugggcaggaccaguggacc

SEQ ID NO: 605395 - RNA, 22 nt, Human
cuucccagacgggguggcagcc

SEQ ID NO: 605396 - RNA, 20 nt, Human
ucuugagaacaauuucuggc

SEQ ID NO: 605397 - RNA, 22 nt, Human
uuaugacaggaaaaucacagaa

SEQ ID NO: 605398 - RNA, 22 nt, Human
uagcagaggcuacugcuccuug

SEQ ID NO: 605399 - RNA, 18 nt, Human
aagaacugagguccuaga

SEQ ID NO: 605400 - RNA, 22 nt, Human
uugaggucaucugaaguacuag

SEQ ID NO: 605401 - RNA, 20 nt, Human
gaacagucuucugagccaca

SEQ ID NO: 605402 - RNA, 22 nt, Human
cucucuguuaugcuuucaugaa

SEQ ID NO: 605403 - RNA, 19 nt, Human
ugaggggaggagaggccug

SEQ ID NO: 605404 - RNA, 21 nt, Human
ucuuuuguaacuauuucagcc

SEQ ID NO: 605405 - RNA, 22 nt, Human
cugggagaugacucagagcagg

SEQ ID NO: 605406 - RNA, 22 nt, Human
uacuuuuuagcacagugugugc

SEQ ID NO: 605407 - RNA, 22 nt, Human
cacagagcugaaccugggucau

SEQ ID NO: 605408 - RNA, 22 nt, Human
acagugcuuggcacacaguaau

SEQ ID NO: 605409 - RNA, 22 nt, Human
uucaguaaaacacugcaauguc

SEQ ID NO: 605410 - RNA, 22 nt, Human
aagaaauuaaugugccauuacu

SEQ ID NO: 605411 - RNA, 22 nt, Human
acaaaguuauucuuucagagga

SEQ ID NO: 605412 - RNA, 23 nt, Human
ucauuucagguugcaugguacca

SEQ ID NO: 605413 - RNA, 22 nt, Human
uaguuuacucaucuauaaaaug

SEQ ID NO: 605414 - RNA, 22 nt, Human
agagccugugggagaugcagcu

SEQ ID NO: 605415 - RNA, 22 nt, Human
ugagcagacuugaugaggcagc

SEQ ID NO: 605416 - RNA, 22 nt, Human
uguaggucucagugucugagcu

SEQ ID NO: 605417 - RNA, 22 nt, Human
agagagagaaaugaaaugugcu

SEQ ID NO: 605418 - RNA, 22 nt, Human
ugagccuggccugcagagacca

SEQ ID NO: 605419 - RNA, 21 nt, Human
uuguaaauggcuuuuuccuuc

SEQ ID NO: 605420 - RNA, 22 nt, Human
agccccucuccgcccugagucg

SEQ ID NO: 605421 - RNA, 22 nt, Human
gagcuucucaacaguuaucucu

SEQ ID NO: 605422 - RNA, 22 nt, Human
cagaugcuauguauuauguaug

SEQ ID NO: 605423 - RNA, 22 nt, Human
aggcuccauuuuccugcagcug

SEQ ID NO: 605424 - RNA, 22 nt, Human
uacauguaagacaugagacucu

SEQ ID NO: 605425 - RNA, 22 nt, Human
uaggaaacucucagcuggucau

SEQ ID NO: 605426 - RNA, 22 nt, Human
cagcagugacaagacuaagaag

SEQ ID NO: 605427 - RNA, 22 nt, Human
ggccccagcagacccuccucug

SEQ ID NO: 605428 - RNA, 22 nt, Human
uacaaauguauuuuauuuuggu

SEQ ID NO: 605429 - RNA, 22 nt, Human
agugugaguaauucagggaggg

SEQ ID NO: 605430 - RNA, 22 nt, Human
gaagcccuauccucuccuggga

SEQ ID NO: 605431 - RNA, 21 nt, Human
agcagaggcugccuggugacu

SEQ ID NO: 605432 - RNA, 22 nt, Human
cuauugaaaguguacaauucaa

SEQ ID NO: 605433 - RNA, 22 nt, Human
caggcuccuucccagggauggu

SEQ ID NO: 605434 - RNA, 22 nt, Human
ucucaucuucauaucugaaaga

SEQ ID NO: 605435 - RNA, 22 nt, Human
aucaggcuaguguguguguuca

SEQ ID NO: 605436 - RNA, 22 nt, Human
uuagggaaauauuuauauacuu

SEQ ID NO: 605437 - RNA, 22 nt, Human
uaguaaaucucagaaaaagauc

SEQ ID NO: 605438 - RNA, 22 nt, Human
ggaggcucuaaacuuuccuugg

SEQ ID NO: 605439 - RNA, 22 nt, Human
ucagcuugcuaaaagggcaucu

SEQ ID NO: 605440 - RNA, 22 nt, Human
acucucuugggggagagcagag

SEQ ID NO: 605441 - RNA, 22 nt, Human
ucccagcuuagauuugcucauu

SEQ ID NO: 605442 - RNA, 22 nt, Human
cuccuggacauggagcggagga

SEQ ID NO: 605443 - RNA, 21 nt, Human
ugaggccaauagccccuggac

SEQ ID NO: 605444 - RNA, 22 nt, Human
gagcugugugccuggauggucu

SEQ ID NO: 605445 - RNA, 22 nt, Human
aaugguuuguaccuguccuugg

SEQ ID NO: 605446 - RNA, 22 nt, Human
ggaagcagccugaagccaaggg

SEQ ID NO: 605447 - RNA, 22 nt, Human
ugaagacaagugugcugguguu

SEQ ID NO: 605448 - RNA, 23 nt, Human
ggagugcaauggcgccaucucgg

SEQ ID NO: 605449 - RNA, 22 nt, Human
uggagcagcuaagccucugaga

SEQ ID NO: 605450 - RNA, 22 nt, Human
aagggcaggaaaagauggaugu

SEQ ID NO: 605451 - RNA, 22 nt, Human
caguucauccccauguuuucaa

SEQ ID NO: 605452 - RNA, 22 nt, Human
agguccugucuuaucucuguaa

SEQ ID NO: 605453 - RNA, 22 nt, Human
uuucuauuuuaaaggcauaugg

SEQ ID NO: 605454 - RNA, 22 nt, Human
gaggguggguuucuugcacguc

SEQ ID NO: 605455 - RNA, 17 nt, Human
gauuuccugaaguucuu

SEQ ID NO: 605456 - RNA, 22 nt, Human
gcagugccuugcuucucugucu

SEQ ID NO: 605457 - RNA, 22 nt, Human
ugaacuucagugauuugcugca

SEQ ID NO: 605458 - RNA, 22 nt, Human
cucuccaggcugggacaggacc

SEQ ID NO: 605459 - RNA, 22 nt, Human
acugagguugaaauagugaugu

SEQ ID NO: 605460 - RNA, 22 nt, Human
ccagccucacuggcaucaccua

SEQ ID NO: 605461 - RNA, 22 nt, Human
uagaagcagcaggacucauggu

SEQ ID NO: 605462 - RNA, 22 nt, Human
agcauagauacauugagccaca

SEQ ID NO: 605463 - RNA, 22 nt, Human
ggaggccaaagugugggcggcu

SEQ ID NO: 605464 - RNA, 22 nt, Human
uguaugaaaaggaauagauuga

SEQ ID NO: 605465 - RNA, 22 nt, Human
aaucuacauuucaguuuugccc

SEQ ID NO: 605466 - RNA, 22 nt, Human
ugaugaaugucauacauaauga

SEQ ID NO: 605467 - RNA, 22 nt, Human
aagaacauaaacagaaggacag

SEQ ID NO: 605468 - RNA, 22 nt, Human
gggaaacuagaagcaggguuau

SEQ ID NO: 605469 - RNA, 22 nt, Human
caggcugaucagggcugggaug

SEQ ID NO: 605470 - RNA, 22 nt, Human
guuuucuuccugcaauuggcau

SEQ ID NO: 605471 - RNA, 22 nt, Human
uacauauuguccauaguugcuu

SEQ ID NO: 605472 - RNA, 23 nt, Human
cagcugaagcagccugggcugga

SEQ ID NO: 605473 - RNA, 22 nt, Human
ucccuugagaguuggccaauug

SEQ ID NO: 605474 - RNA, 22 nt, Human
ccugcuggcauucuugcucccu

SEQ ID NO: 605475 - RNA, 22 nt, Human
aucucuggguccauagaagaga

SEQ ID NO: 605476 - RNA, 22 nt, Human
cuuuuuauaccgugccaguuga

SEQ ID NO: 605477 - RNA, 22 nt, Human
guaauuuuggaguauaaccugg

SEQ ID NO: 605478 - RNA, 22 nt, Human
ugccucgugucugagucuguuc

SEQ ID NO: 605479 - RNA, 22 nt, Human
agaaacugacaggaaaugaauu

SEQ ID NO: 605480 - RNA, 21 nt, Human
agcuuguguguaucacagugu

SEQ ID NO: 605481 - RNA, 17 nt, Human
uguuuuuucccuguucu

SEQ ID NO: 605482 - RNA, 22 nt, Human
ggcucacgcaauuaucccggcc

SEQ ID NO: 605483 - RNA, 22 nt, Human
uagugcuugguggagauggaga

SEQ ID NO: 605484 - RNA, 22 nt, Human
cugugucuguggaauagcgaau

SEQ ID NO: 605485 - RNA, 22 nt, Human
uuguuuuaguagguacacugag

SEQ ID NO: 605486 - RNA, 22 nt, Human
acaugcauauacuuaaauaugu

SEQ ID NO: 605487 - RNA, 22 nt, Human
uaucaaaaggaguugaaagggg

SEQ ID NO: 605488 - RNA, 22 nt, Human
auguuucaccaguuuuauaaga

SEQ ID NO: 605489 - RNA, 22 nt, Human
cuuccuggcaugggucucauga

SEQ ID NO: 605490 - RNA, 22 nt, Human
aacaaaguagcugcuguucuua

SEQ ID NO: 605491 - RNA, 22 nt, Human
uuggaagauuacuuaguuuucu

SEQ ID NO: 605492 - RNA, 22 nt, Human
caugcucuagauucucucuaau

SEQ ID NO: 605493 - RNA, 22 nt, Human
uccugagugagagcugggaggu

SEQ ID NO: 605494 - RNA, 22 nt, Human
aaagaugaucuacaaguucauu

SEQ ID NO: 605495 - RNA, 22 nt, Human
auugugcagcucugcucuuauu

SEQ ID NO: 605496 - RNA, 22 nt, Human
auggggagagccucugucccca

SEQ ID NO: 605497 - RNA, 22 nt, Human
ucugggcugcuaugaggcagag

SEQ ID NO: 605498 - RNA, 22 nt, Human
ugugaguucuuagaaagucagu

SEQ ID NO: 605499 - RNA, 20 nt, Human
uggccuuggggagcucacac

SEQ ID NO: 605500 - RNA, 22 nt, Human
agcauguaaagcucuuagcacc

SEQ ID NO: 605501 - RNA, 22 nt, Human
cccaggagguggagcuugcagu

SEQ ID NO: 605502 - RNA, 22 nt, Human
ucuuggcuaguaccuuccugcc

SEQ ID NO: 605503 - RNA, 22 nt, Human
agcaaagauguccggggcaagc

SEQ ID NO: 605504 - RNA, 22 nt, Human
caggguagggcaagggaaccug

SEQ ID NO: 605505 - RNA, 22 nt, Human
gaauguaauagucaguagaaca

SEQ ID NO: 605506 - RNA, 22 nt, Human
cugccccaggaccucuucugga

SEQ ID NO: 605507 - RNA, 22 nt, Human
agggcgccugcuguggccaccg

SEQ ID NO: 605508 - RNA, 22 nt, Human
agaggagaauccguuuccuugc

SEQ ID NO: 605509 - RNA, 22 nt, Human
gccuucagcggccgcucgcugc

SEQ ID NO: 605510 - RNA, 22 nt, Human
agaaauaagagcuuuccuuggg

SEQ ID NO: 605511 - RNA, 21 nt, Human
uuuacugagcacuuacuaugu

SEQ ID NO: 605512 - RNA, 22 nt, Human
cagcaaaauuugaggauugccu

SEQ ID NO: 605513 - RNA, 22 nt, Human
cuguggauuuacuugagaagcu

SEQ ID NO: 605514 - RNA, 22 nt, Human
uucauaaucaccaaaaacugga

SEQ ID NO: 605515 - RNA, 22 nt, Human
ggcuccagaugucuccuggcaa

SEQ ID NO: 605516 - RNA, 22 nt, Human
aguugaaagccuuauuucucug

SEQ ID NO: 605517 - RNA, 22 nt, Human
ccugccaggcgagucuaggcca

SEQ ID NO: 605518 - RNA, 22 nt, Human
cuggagcagguuuaggaguccc

SEQ ID NO: 605519 - RNA, 22 nt, Human
ucacaugcuacugagccagacc

SEQ ID NO: 605520 - RNA, 22 nt, Human
auuuuccuccaugugagcaguu

SEQ ID NO: 605521 - RNA, 22 nt, Human
ugacuuuuggaccucacugucc

SEQ ID NO: 605522 - RNA, 22 nt, Human
ucaacaauugcauguugauguu

SEQ ID NO: 605523 - RNA, 22 nt, Human
acagaauauugguuacuguugc

SEQ ID NO: 605524 - RNA, 22 nt, Human
caggaugagguagaggcagaua

SEQ ID NO: 605525 - RNA, 22 nt, Human
augaaugacugucuacuuuggg

SEQ ID NO: 605526 - RNA, 19 nt, Human
uuucaggagcuaugcaggg

SEQ ID NO: 605527 - RNA, 22 nt, Human
gagccuguguuuccuguagcca

SEQ ID NO: 605528 - RNA, 22 nt, Human
caugggccauggugaagccagg

SEQ ID NO: 605529 - RNA, 17 nt, Human
ugaggccauggcaccau

SEQ ID NO: 605530 - RNA, 22 nt, Human
ggucccaggagaauaggugcaa

SEQ ID NO: 605531 - RNA, 22 nt, Human
aaaugacacucauucaguguca

SEQ ID NO: 605532 - RNA, 22 nt, Human
uggcucagucuggguugacuga

SEQ ID NO: 605533 - RNA, 22 nt, Human
ccuggccaggcauggagucaca

SEQ ID NO: 605534 - RNA, 22 nt, Human
uggaaggaagccaaggaagguu

SEQ ID NO: 605535 - RNA, 22 nt, Human
guauuucccccagacucccugg

SEQ ID NO: 605536 - RNA, 22 nt, Human
cuugggugcuggaggcugccgc

SEQ ID NO: 605537 - RNA, 22 nt, Human
cugagggcccugaagcuuggca

SEQ ID NO: 605538 - RNA, 21 nt, Human
agaugcugugcuccaggagca

SEQ ID NO: 605539 - RNA, 22 nt, Human
aaugucuucaguguauacaugg

SEQ ID NO: 605540 - RNA, 22 nt, Human
uuugucagucaugucugcuuuu

SEQ ID NO: 605541 - RNA, 20 nt, Human
cagcaacuuuggacugaguu

SEQ ID NO: 605542 - RNA, 22 nt, Human
acagagaccaguuacagcgucc

SEQ ID NO: 605543 - RNA, 22 nt, Human
gcaguaggggcuggagggcugu

SEQ ID NO: 605544 - RNA, 22 nt, Human
agugucucagccccaacuagag

SEQ ID NO: 605545 - RNA, 22 nt, Human
ucugcuguaaccuucagaggua

SEQ ID NO: 605546 - RNA, 22 nt, Human
cauuaagauuuuuuucuacugg

SEQ ID NO: 605547 - RNA, 22 nt, Human
agcaaggaaacuauggagagau

SEQ ID NO: 605548 - RNA, 22 nt, Human
agggcugaugcaccauguagcc

SEQ ID NO: 605549 - RNA, 22 nt, Human
cagggccacugcaugagguuca

SEQ ID NO: 605550 - RNA, 22 nt, Human
uguuucaacuguuaagauaugc

SEQ ID NO: 605551 - RNA, 22 nt, Human
aaaacaguuuaggcaucacagu

SEQ ID NO: 605552 - RNA, 22 nt, Human
uuggcucagcugggacuguuga

SEQ ID NO: 605553 - RNA, 22 nt, Human
ugggaacaguagcugcugagcu

SEQ ID NO: 605554 - RNA, 22 nt, Human
agagguguggccaggacucaag

SEQ ID NO: 605555 - RNA, 22 nt, Human
aacagaaaagguagguggcuuu

SEQ ID NO: 605556 - RNA, 22 nt, Human
aaggggaguuagugauaaaacc

SEQ ID NO: 605557 - RNA, 22 nt, Human
uuacauuuugcacagauguccc

SEQ ID NO: 605558 - RNA, 22 nt, Human
gcugcugccuguagccagggug

SEQ ID NO: 605559 - RNA, 22 nt, Human
ugcuuccgcuaaaaauuaaucc

SEQ ID NO: 605560 - RNA, 22 nt, Human
cagaauuuaaguggauuauucu

SEQ ID NO: 605561 - RNA, 22 nt, Human
gcauuagacccaagguauuuug

SEQ ID NO: 605562 - RNA, 22 nt, Human
ucugccugaaccacucuuggag

SEQ ID NO: 605563 - RNA, 22 nt, Human
uggcugaggagggucuucuggu

SEQ ID NO: 605564 - RNA, 22 nt, Human
cacacaugcauguaagaccucu

SEQ ID NO: 605565 - RNA, 22 nt, Human
gcuggcuguaucaccuggccag

SEQ ID NO: 605566 - RNA, 22 nt, Human
gagcuuugcuggaagccugggg

SEQ ID NO: 605567 - RNA, 22 nt, Human
aaguuaugaaauuuggacagcu

SEQ ID NO: 605568 - RNA, 22 nt, Human
gcagccugaugaucuggguugu

SEQ ID NO: 605569 - RNA, 22 nt, Human
gaggagcccuguuccccaggcc

SEQ ID NO: 605570 - RNA, 22 nt, Human
aggcagaggaaggguggauuug

SEQ ID NO: 605571 - RNA, 21 nt, Human
gcuggcuuuauucugcguuug

SEQ ID NO: 605572 - RNA, 22 nt, Human
uuucaaagucaagaaggauacu

SEQ ID NO: 605573 - RNA, 22 nt, Human
cuuagaaugucuacucuuacca

SEQ ID NO: 605574 - RNA, 22 nt, Human
acaaaguaggucaucaaagcuc

SEQ ID NO: 605575 - RNA, 22 nt, Human
auguaacauugaauuauauagu

SEQ ID NO: 605576 - RNA, 22 nt, Human
aggcuuuccugucacucaugcu

SEQ ID NO: 605577 - RNA, 22 nt, Human
uacagugcauagaggcaugaua

SEQ ID NO: 605578 - RNA, 22 nt, Human
ugcagcauuaguacaagucuca

SEQ ID NO: 605579 - RNA, 22 nt, Human
uuucauagcugaaaauguugaa

SEQ ID NO: 605580 - RNA, 22 nt, Human
agcuccugaaaagcgcuugcuu

SEQ ID NO: 605581 - RNA, 22 nt, Human
caguuuuccaugacucagagag

SEQ ID NO: 605582 - RNA, 22 nt, Human
aggagcugcagauucugccuug

SEQ ID NO: 605583 - RNA, 22 nt, Human
uuuauuguuaucaugggugagu

SEQ ID NO: 605584 - RNA, 22 nt, Human
ucugucacuuauuaagauggau

SEQ ID NO: 605585 - RNA, 21 nt, Human
uuagacuuggguuuuuccugg

SEQ ID NO: 605586 - RNA, 22 nt, Human
uggcaucuguguugcgguuguc

SEQ ID NO: 605587 - RNA, 22 nt, Human
acagacaguaugguggggcuga

SEQ ID NO: 605588 - RNA, 22 nt, Human
caguucucugugccucgcuggg

SEQ ID NO: 605589 - RNA, 22 nt, Human
aacacaggccagccugugcagu

SEQ ID NO: 605590 - RNA, 22 nt, Human
acaggaggagcagcugugugcc

SEQ ID NO: 605591 - RNA, 22 nt, Human
ccaggagagcaaaggucacucu

SEQ ID NO: 605592 - RNA, 22 nt, Human
ccucagugaccuauugcauuca

SEQ ID NO: 605593 - RNA, 22 nt, Human
gccaaaggauucuauggagaua

SEQ ID NO: 605594 - RNA, 22 nt, Human
gaaggcaguaaauggcuguuuu

SEQ ID NO: 605595 - RNA, 22 nt, Human
caagguuucuaugcucaaagga

SEQ ID NO: 605596 - RNA, 22 nt, Human
agcagccuugugacuccggggu

SEQ ID NO: 605597 - RNA, 22 nt, Human
aaaucuguaagcaauugcucag

SEQ ID NO: 605598 - RNA, 23 nt, Human
ugagcccaguuuucccucuugcc

SEQ ID NO: 605599 - RNA, 22 nt, Human
aggcucugccaauuccuuccuc

SEQ ID NO: 605600 - RNA, 22 nt, Human
uaagagaugguuaucaaaagca

SEQ ID NO: 605601 - RNA, 22 nt, Human
gagcaucgcugagaucccagac

SEQ ID NO: 605602 - RNA, 22 nt, Human
gacaugggaugagaugaagcau

SEQ ID NO: 605603 - RNA, 22 nt, Human
cagguccaacuauuuaucugug

SEQ ID NO: 605604 - RNA, 22 nt, Human
auuuucaagggagaggccucug

SEQ ID NO: 605605 - RNA, 22 nt, Human
gcucccaccuuugcuaucagua

SEQ ID NO: 605606 - RNA, 18 nt, Human
ugugccucugcaggacgu

SEQ ID NO: 605607 - RNA, 20 nt, Human
ccugcugugcuuuccaugga

SEQ ID NO: 605608 - RNA, 22 nt, Human
gcagggugccgacuucagggau

SEQ ID NO: 605609 - RNA, 22 nt, Human
ucccucagggugcaguugcuuu

SEQ ID NO: 605610 - RNA, 22 nt, Human
gagcugccagacaugggaauga

SEQ ID NO: 605611 - RNA, 22 nt, Human
ugaggaugacgauggcaauggc

SEQ ID NO: 605612 - RNA, 22 nt, Human
uuggccuuaaccucucugugcc

SEQ ID NO: 605613 - RNA, 19 nt, Human
aggcuaaagagucuugcgu

SEQ ID NO: 605614 - RNA, 22 nt, Human
agguacaucuauggggauagaa

SEQ ID NO: 605615 - RNA, 22 nt, Human
ucugugcuagaggaguuggcca

SEQ ID NO: 605616 - RNA, 21 nt, Human
uuuauuuauauaggacacaug

SEQ ID NO: 605617 - RNA, 22 nt, Human
ucaguggagagcuuccaggauu

SEQ ID NO: 605618 - RNA, 22 nt, Human
caagcuccuuacauccacaggg

SEQ ID NO: 605619 - RNA, 22 nt, Human
cacauuuaaagguugaagcuga

SEQ ID NO: 605620 - RNA, 22 nt, Human
ggcuucaccaggugcaugcaug

SEQ ID NO: 605621 - RNA, 22 nt, Human
acugaaaaagacaucuugguaa

SEQ ID NO: 605622 - RNA, 22 nt, Human
gugcauauguaccugugaucau

SEQ ID NO: 605623 - RNA, 22 nt, Human
ccuuagaucaggcugucuaggg

SEQ ID NO: 605624 - RNA, 19 nt, Human
agugguagaugagcaggag

SEQ ID NO: 605625 - RNA, 22 nt, Human
caguacuuugaagauauuuuag

SEQ ID NO: 605626 - RNA, 22 nt, Human
aagcugaggucaaguagcuagu

SEQ ID NO: 605627 - RNA, 22 nt, Human
uaggaaacaaaguaaugcaacu

SEQ ID NO: 605628 - RNA, 22 nt, Human
gaguggagcaaaagagguagau

SEQ ID NO: 605629 - RNA, 17 nt, Human
cccagagaugcugccuu

SEQ ID NO: 605630 - RNA, 22 nt, Human
gggggcgggagacagcagugac

SEQ ID NO: 605631 - RNA, 22 nt, Human
aauaacugcacuuguugaaugc

SEQ ID NO: 605632 - RNA, 22 nt, Human
ccuugaaauguucucacugggg

SEQ ID NO: 605633 - RNA, 21 nt, Human
ugcugccaucaugcagagaug

SEQ ID NO: 605634 - RNA, 22 nt, Human
ggccucaguuucuccauggguu

SEQ ID NO: 605635 - RNA, 22 nt, Human
ugccuuuucuguagcucuggaa

SEQ ID NO: 605636 - RNA, 19 nt, Human
cugagucaaagguuguggg

SEQ ID NO: 605637 - RNA, 22 nt, Human
auccuuuaaguuaauaaaauuc

SEQ ID NO: 605638 - RNA, 22 nt, Human
cugcugaaugucucuuugguuu

SEQ ID NO: 605639 - RNA, 22 nt, Human
auaauguuucaguacugucugu

SEQ ID NO: 605640 - RNA, 22 nt, Human
uuccugggccuuaaaucuuuug

SEQ ID NO: 605641 - RNA, 22 nt, Human
uugaaugauccuaucuagcaca

SEQ ID NO: 605642 - RNA, 22 nt, Human
uucuccagccuauuggccuauc

SEQ ID NO: 605643 - RNA, 22 nt, Human
aaaguaaagauugggaaugugu

SEQ ID NO: 605644 - RNA, 22 nt, Human
auucaugaaucuacauuguggu

SEQ ID NO: 605645 - RNA, 22 nt, Human
agccaggugcaguggcacacac

SEQ ID NO: 605646 - RNA, 22 nt, Human
acuuucucaggaauucacagac

SEQ ID NO: 605647 - RNA, 22 nt, Human
uguaacaaaauaccuuggauug

SEQ ID NO: 605648 - RNA, 22 nt, Human
gcuaaaugaugggaaaucuggg

SEQ ID NO: 605649 - RNA, 22 nt, Human
uuauaauugcuuauuagaccca

SEQ ID NO: 605650 - RNA, 22 nt, Human
guuauuuuaacuucucaguaau

SEQ ID NO: 605651 - RNA, 22 nt, Human
cagcggccggugaggaagggga

SEQ ID NO: 605652 - RNA, 18 nt, Human
uggcagguagacucaggu

SEQ ID NO: 605653 - RNA, 22 nt, Human
uuguaacagguacuaaauaacu

SEQ ID NO: 605654 - RNA, 22 nt, Human
cuccugggagcagggauggaug

SEQ ID NO: 605655 - RNA, 22 nt, Human
cauggcccucuucuggagcaau

SEQ ID NO: 605656 - RNA, 22 nt, Human
ucccuggggaagggcaagcaag

SEQ ID NO: 605657 - RNA, 22 nt, Human
caggaggcuccuagggcucugu

SEQ ID NO: 605658 - RNA, 22 nt, Human
guccucugggagccuugagccu

SEQ ID NO: 605659 - RNA, 21 nt, Human
cagaggggcuagccuggcugc

SEQ ID NO: 605660 - RNA, 22 nt, Human
gagguuuuaggcugccauuauu

SEQ ID NO: 605661 - RNA, 22 nt, Human
ugaaagguuaaaaguaguauug

SEQ ID NO: 605662 - RNA, 19 nt, Human
auuuauuguaugauuccau

SEQ ID NO: 605663 - RNA, 22 nt, Human
ggcagaaggcaauuagagacug

SEQ ID NO: 605664 - RNA, 22 nt, Human
cagucucugucaucucauggga

SEQ ID NO: 605665 - RNA, 22 nt, Human
cuucuuccaagcuuaugcucaa

SEQ ID NO: 605666 - RNA, 22 nt, Human
uuccaauggaaucaugucuuga

SEQ ID NO: 605667 - RNA, 22 nt, Human
uaaaacugaauacauacugagg

SEQ ID NO: 605668 - RNA, 22 nt, Human
uuuaaaaguuaucaucugucca

SEQ ID NO: 605669 - RNA, 22 nt, Human
gcugcagcagaaguucucagag

SEQ ID NO: 605670 - RNA, 22 nt, Human
uuaauauacaauuuuacgggcu

SEQ ID NO: 605671 - RNA, 22 nt, Human
cuugugcagccuccucuugcag

SEQ ID NO: 605672 - RNA, 22 nt, Human
ucagcuucccuaucugaccaua

SEQ ID NO: 605673 - RNA, 22 nt, Human
ugaaggugaccugacaguggcu

SEQ ID NO: 605674 - RNA, 23 nt, Human
cccuguagcccaggacaggcuuu

SEQ ID NO: 605675 - RNA, 17 nt, Human
cagcucugcaucuuccu

SEQ ID NO: 605676 - RNA, 22 nt, Human
ugacauccggccacuagacucc

SEQ ID NO: 605677 - RNA, 22 nt, Human
ccuggccaaucuagggcuguua

SEQ ID NO: 605678 - RNA, 22 nt, Human
uaugaacuguacuguacuaagc

SEQ ID NO: 605679 - RNA, 22 nt, Human
gauuuguccacagagugaugaa

SEQ ID NO: 605680 - RNA, 22 nt, Human
agagaccuuucuccugccuuuc

SEQ ID NO: 605681 - RNA, 22 nt, Human
acauggcucagucucaugacag

SEQ ID NO: 605682 - RNA, 17 nt, Human
ggacacagcucauggcu

SEQ ID NO: 605683 - RNA, 22 nt, Human
agccuggauccauguggcuacc

SEQ ID NO: 605684 - RNA, 22 nt, Human
cuggccagaguuggagggugug

SEQ ID NO: 605685 - RNA, 22 nt, Human
gaaugaacaaaugugguggaga

SEQ ID NO: 605686 - RNA, 22 nt, Human
auuguauaacagcauguauuuu

SEQ ID NO: 605687 - RNA, 22 nt, Human
uaagaacauuuucggaaagaua

SEQ ID NO: 605688 - RNA, 22 nt, Human
uugaggccugcuggaagguguu

SEQ ID NO: 605689 - RNA, 20 nt, Human
caaagacaugcuaggggugg

SEQ ID NO: 605690 - RNA, 22 nt, Human
aaauuccagcaacaccuuuuua

SEQ ID NO: 605691 - RNA, 22 nt, Human
ccagguggaggugugagguccu

SEQ ID NO: 605692 - RNA, 22 nt, Human
uucuagagccagggcagcugca

SEQ ID NO: 605693 - RNA, 22 nt, Human
acaaacagcuaacauauguuaa

SEQ ID NO: 605694 - RNA, 23 nt, Human
uuaagacuggcugaacuuaguag

SEQ ID NO: 605695 - RNA, 22 nt, Human
uacaugcucaguaacuuucagu

SEQ ID NO: 605696 - RNA, 22 nt, Human
agggccagcacuccuggcagga

SEQ ID NO: 605697 - RNA, 22 nt, Human
cuuagugacauguauucuucau

SEQ ID NO: 605698 - RNA, 23 nt, Human
agggagaugccacaaagaugccc

SEQ ID NO: 605699 - RNA, 22 nt, Human
ucagggaaaggggagagucauu

SEQ ID NO: 605700 - RNA, 22 nt, Human
gguuuuaacuacagaauugcaa

SEQ ID NO: 605701 - RNA, 22 nt, Human
ugcauggaguaauugaugcuug

SEQ ID NO: 605702 - RNA, 22 nt, Human
cccagcuguaacgggucugcac

SEQ ID NO: 605703 - RNA, 22 nt, Human
ugcugaaguuacuagagacuau

SEQ ID NO: 605704 - RNA, 17 nt, Human
ugcuugacucucuuguu

SEQ ID NO: 605705 - RNA, 22 nt, Human
ggagcaccaaaguaacuagcac

SEQ ID NO: 605706 - RNA, 22 nt, Human
uagcccaggcuggagggcagug

SEQ ID NO: 605707 - RNA, 22 nt, Human
uugaaugaggaagagcacuggc

SEQ ID NO: 605708 - RNA, 22 nt, Human
gcucuguucaucaguuuguugg

SEQ ID NO: 605709 - RNA, 20 nt, Human
gugggcagagcaccaccugg

SEQ ID NO: 605710 - RNA, 22 nt, Human
ggcugccauaacagaguaccac

SEQ ID NO: 605711 - RNA, 22 nt, Human
uccagggacacagaguccuucu

SEQ ID NO: 605712 - RNA, 22 nt, Human
acauuguuccugagaacuuggg

SEQ ID NO: 605713 - RNA, 22 nt, Human
cuucucagaggccagaagcuau

SEQ ID NO: 605714 - RNA, 22 nt, Human
agguggcagagugacaggcuga

SEQ ID NO: 605715 - RNA, 22 nt, Human
ggcagccaugucccagggcuuc

SEQ ID NO: 605716 - RNA, 22 nt, Human
aauucugagaacaaaagguacu

SEQ ID NO: 605717 - RNA, 22 nt, Human
uucugcuucugugugucccagg

SEQ ID NO: 605718 - RNA, 22 nt, Human
ugagguguguccccagggaggu

SEQ ID NO: 605719 - RNA, 22 nt, Human
ggagagcugguagcuggcucca

SEQ ID NO: 605720 - RNA, 22 nt, Human
auuucaacguuagauguaauag

SEQ ID NO: 605721 - RNA, 22 nt, Human
uuggaagacagugaaacagcac

SEQ ID NO: 605722 - RNA, 22 nt, Human
ugggagaugguucugagacuuu

SEQ ID NO: 605723 - RNA, 22 nt, Human
ugcuuuauuuauaaaauagcaa

SEQ ID NO: 605724 - RNA, 22 nt, Human
cguccccucguucccacuuugg

SEQ ID NO: 605725 - RNA, 22 nt, Human
cuacugaauuagacugcauuuu

SEQ ID NO: 605726 - RNA, 22 nt, Human
acauaacaugucaaucacccga

SEQ ID NO: 605727 - RNA, 22 nt, Human
cuucccagaacaauguaggcuu

SEQ ID NO: 605728 - RNA, 22 nt, Human
aagcagaggguauggccagguu

SEQ ID NO: 605729 - RNA, 21 nt, Human
acagcauguuuguguguuugc

SEQ ID NO: 605730 - RNA, 22 nt, Human
acuguauuuuguacuuucgugu

SEQ ID NO: 605731 - RNA, 22 nt, Human
ucucaucuagacucugcccuug

SEQ ID NO: 605732 - RNA, 22 nt, Human
uuaugagcuaaguuguggcccc

SEQ ID NO: 605733 - RNA, 20 nt, Human
auucuaaagcucugcucuuu

SEQ ID NO: 605734 - RNA, 22 nt, Human
agcacugauuuuguugcacuua

SEQ ID NO: 605735 - RNA, 22 nt, Human
ugcugcaggcagccccucuacu

SEQ ID NO: 605736 - RNA, 21 nt, Human
uuucccagcagagauagcugg

SEQ ID NO: 605737 - RNA, 22 nt, Human
uggcacugacagggugcucaag

SEQ ID NO: 605738 - RNA, 22 nt, Human
aguguacauguacacauuagua

SEQ ID NO: 605739 - RNA, 22 nt, Human
ugacauuuuuaaaaccacuagu

SEQ ID NO: 605740 - RNA, 22 nt, Human
agcaaugacuaaggcacuuugg

SEQ ID NO: 605741 - RNA, 22 nt, Human
aagcagaggccacagagugggc

SEQ ID NO: 605742 - RNA, 22 nt, Human
cuccugacuugugagccccucc

SEQ ID NO: 605743 - RNA, 22 nt, Human
ggaugggaacuugguagggcau

SEQ ID NO: 605744 - RNA, 22 nt, Human
gaauguuacuuugauuuugucc

SEQ ID NO: 605745 - RNA, 20 nt, Human
caguauugauccauugucug

SEQ ID NO: 605746 - RNA, 22 nt, Human
cugccugcugcccuccagagcc

SEQ ID NO: 605747 - RNA, 22 nt, Human
uuaaaguuugccuauguguugu

SEQ ID NO: 605748 - RNA, 22 nt, Human
uggcggcucaggaggggcaguu

SEQ ID NO: 605749 - RNA, 22 nt, Human
uacacuggggcucugggaguga

SEQ ID NO: 605750 - RNA, 22 nt, Human
gugcaugugucuuuauaguaga

SEQ ID NO: 605751 - RNA, 22 nt, Human
aggagcugggcugcugcuggga

SEQ ID NO: 605752 - RNA, 22 nt, Human
agcacugauuuaaacuggauuu

SEQ ID NO: 605753 - RNA, 22 nt, Human
ucuguuucuauaaagacaagag

SEQ ID NO: 605754 - RNA, 22 nt, Human
caggcuggagugaguguagugg

SEQ ID NO: 605755 - RNA, 22 nt, Human
ugcacgugggcucucugcucuu

SEQ ID NO: 605756 - RNA, 22 nt, Human
agcugugguucugggcagcgac

SEQ ID NO: 605757 - RNA, 20 nt, Human
uucugccuaggguuagccug

SEQ ID NO: 605758 - RNA, 22 nt, Human
gggcagugacaaaggggaugaa

SEQ ID NO: 605759 - RNA, 22 nt, Human
cagaaguuaugucaauggucau

SEQ ID NO: 605760 - RNA, 22 nt, Human
guaggcagugcuugauuuucca

SEQ ID NO: 605761 - RNA, 22 nt, Human
uaaucacagaaacagacuguuu

SEQ ID NO: 605762 - RNA, 22 nt, Human
uacagugucugcaacugcacac

SEQ ID NO: 605763 - RNA, 22 nt, Human
ggagaugcuuuccaguggggau

SEQ ID NO: 605764 - RNA, 22 nt, Human
uagaacuagaacaaggauuuga

SEQ ID NO: 605765 - RNA, 22 nt, Human
aguguguacucauauacuucca

SEQ ID NO: 605766 - RNA, 22 nt, Human
cauuucaauacaguuuguaaau

SEQ ID NO: 605767 - RNA, 22 nt, Human
ucagggcugcagaagaggcagg

SEQ ID NO: 605768 - RNA, 22 nt, Human
acagguggagugguuagcaggc

SEQ ID NO: 605769 - RNA, 22 nt, Human
cccaggaggugugcccaacucg

SEQ ID NO: 605770 - RNA, 22 nt, Human
uaauuuugucccccugcacaua

SEQ ID NO: 605771 - RNA, 22 nt, Human
ccgcccacacuaaauaugagcg

SEQ ID NO: 605772 - RNA, 22 nt, Human
aauagcugauuaauguacuacc

SEQ ID NO: 605773 - RNA, 22 nt, Human
uucuccagaccacugccucugu

SEQ ID NO: 605774 - RNA, 22 nt, Human
uuuagcuugaaucuuguuuaaa

SEQ ID NO: 605775 - RNA, 22 nt, Human
caguaggaaggaugcagaaaaa

SEQ ID NO: 605776 - RNA, 22 nt, Human
ucuuauaaucucuauuuuaaug

SEQ ID NO: 605777 - RNA, 22 nt, Human
augccugcuuacuccaggugcu

SEQ ID NO: 605778 - RNA, 22 nt, Human
aaaaccaggcuugcugugcucg

SEQ ID NO: 605779 - RNA, 22 nt, Human
uggcccagcugcagauggugga

SEQ ID NO: 605780 - RNA, 22 nt, Human
caggguggaagcuguagagugg

SEQ ID NO: 605781 - RNA, 22 nt, Human
uccugcaggccuguucccagua

SEQ ID NO: 605782 - RNA, 22 nt, Human
aggcacugugcuucuuauaugu

SEQ ID NO: 605783 - RNA, 22 nt, Human
ccuggcugccgagugugcagcg

SEQ ID NO: 605784 - RNA, 19 nt, Human
ucugaggcuucuccccuug

SEQ ID NO: 605785 - RNA, 22 nt, Human
ugcaggugugugcaagggaggg

SEQ ID NO: 605786 - RNA, 22 nt, Human
aacauacuuauacuaaauaaug

SEQ ID NO: 605787 - RNA, 22 nt, Human
cacagcuucccaaaguggaccu

SEQ ID NO: 605788 - RNA, 22 nt, Human
ucugugugauuucagggaaguc

SEQ ID NO: 605789 - RNA, 22 nt, Human
uacuguacauuccguuuguugc

SEQ ID NO: 605790 - RNA, 22 nt, Human
uauaagugacagauuauccaaa

SEQ ID NO: 605791 - RNA, 22 nt, Human
ccugcagggaaucgaggcagaa

SEQ ID NO: 605792 - RNA, 22 nt, Human
auauuaaauggauuuugggagc

SEQ ID NO: 605793 - RNA, 17 nt, Human
gcccaggaaggacggcc

SEQ ID NO: 605794 - RNA, 22 nt, Human
ggagcagccgcgucucagggca

SEQ ID NO: 605795 - RNA, 22 nt, Human
gccaggcuaagaaaggugugau

SEQ ID NO: 605796 - RNA, 22 nt, Human
cuuccuagugucuacuuuggag

SEQ ID NO: 605797 - RNA, 22 nt, Human
gcugcucuggcucugcaguguc

SEQ ID NO: 605798 - RNA, 22 nt, Human
uccaggcugugcaugaguuuag

SEQ ID NO: 605799 - RNA, 22 nt, Human
gugcccugaugcaauugucuca

SEQ ID NO: 605800 - RNA, 22 nt, Human
uauuaugaggggcagagggcau

SEQ ID NO: 605801 - RNA, 22 nt, Human
uagcugcccaucuuuccuuuag

SEQ ID NO: 605802 - RNA, 22 nt, Human
auguaguuuggggcuagauuua

SEQ ID NO: 605803 - RNA, 22 nt, Human
cagcucuuuuucacacaacaug

SEQ ID NO: 605804 - RNA, 22 nt, Human
ucugucacucccugaugaugaa

SEQ ID NO: 605805 - RNA, 22 nt, Human
aggaaugauaguaaaagagaau

SEQ ID NO: 605806 - RNA, 22 nt, Human
cauaauuucacugucguauggc

SEQ ID NO: 605807 - RNA, 22 nt, Human
aauuccauccauuuguuucaac

SEQ ID NO: 605808 - RNA, 22 nt, Human
cagcuuugauucuuucugccau

SEQ ID NO: 605809 - RNA, 22 nt, Human
ugaggacaugagugggacagag

SEQ ID NO: 605810 - RNA, 20 nt, Human
gaaacauuggcagcaacuga

SEQ ID NO: 605811 - RNA, 22 nt, Human
uccagaaaauucagaaauuguu

SEQ ID NO: 605812 - RNA, 22 nt, Human
uaauggaaguuaaauaugguau

SEQ ID NO: 605813 - RNA, 22 nt, Human
gggccugaaaccuucagggcuu

SEQ ID NO: 605814 - RNA, 22 nt, Human
auacagcuuaugcauauaucuc

SEQ ID NO: 605815 - RNA, 22 nt, Human
gccuggcagggcccggacggca

SEQ ID NO: 605816 - RNA, 21 nt, Human
agaggaagugauuggucuggc

SEQ ID NO: 605817 - RNA, 22 nt, Human
ugaagccauaggacagaggaua

SEQ ID NO: 605818 - RNA, 23 nt, Human
cuauggaauaccaaugauucuca

SEQ ID NO: 605819 - RNA, 22 nt, Human
cuucucggccguguggaugcgc

SEQ ID NO: 605820 - RNA, 22 nt, Human
agagacagaggcaauauagcuu

SEQ ID NO: 605821 - RNA, 22 nt, Human
auacaaugggugcaaagaugug

SEQ ID NO: 605822 - RNA, 15 nt, Human
uacauucauuuccac

SEQ ID NO: 605823 - RNA, 22 nt, Human
ccuggagauuucuucaagcuuu

SEQ ID NO: 605824 - RNA, 22 nt, Human
acucucucacacacgccuauau

SEQ ID NO: 605825 - RNA, 22 nt, Human
cugaguccuugggcuuagagug

SEQ ID NO: 605826 - RNA, 22 nt, Human
gaggccuguagucauggaugua

SEQ ID NO: 605827 - RNA, 19 nt, Human
uggcauugguccagauaaa

SEQ ID NO: 605828 - RNA, 22 nt, Human
guauuagcuguuagcuacauca

SEQ ID NO: 605829 - RNA, 22 nt, Human
uaccauuugagagagaacauaa

SEQ ID NO: 605830 - RNA, 22 nt, Human
gguuccaccuggcgagggguau

SEQ ID NO: 605831 - RNA, 22 nt, Human
aauaguguauuuuucaaaauua

SEQ ID NO: 605832 - RNA, 22 nt, Human
cagggcacuuaaauugccucgu

SEQ ID NO: 605833 - RNA, 22 nt, Human
ucucauuuggcuuuguuuuaaa

SEQ ID NO: 605834 - RNA, 22 nt, Human
ugaaugauuaaaacccggacua

SEQ ID NO: 605835 - RNA, 22 nt, Human
ugggccacacacagaagaauca

SEQ ID NO: 605836 - RNA, 22 nt, Human
agaugguagguggcaggacuga

SEQ ID NO: 605837 - RNA, 21 nt, Human
aucucacagcccagagaagcc

SEQ ID NO: 605838 - RNA, 22 nt, Human
cugggucugugcccagggaccu

SEQ ID NO: 605839 - RNA, 22 nt, Human
cagagacaggaaucagcugcag

SEQ ID NO: 605840 - RNA, 22 nt, Human
gugaagcauaacugaaggauuu

SEQ ID NO: 605841 - RNA, 22 nt, Human
uggaacacaucucgcugcaggg

SEQ ID NO: 605842 - RNA, 22 nt, Human
uuccccaggugauucucauggc

SEQ ID NO: 605843 - RNA, 22 nt, Human
ucagccuuguggcccugcucca

SEQ ID NO: 605844 - RNA, 22 nt, Human
cccgagccucgguuucuuuucu

SEQ ID NO: 605845 - RNA, 22 nt, Human
ucuagaaaguuuguacugauuu

SEQ ID NO: 605846 - RNA, 22 nt, Human
cuccugucagaagcauccugag

SEQ ID NO: 605847 - RNA, 22 nt, Human
gagggcuccauuccccgugccc

SEQ ID NO: 605848 - RNA, 22 nt, Human
ucuuccuuuuguaccuucugaa

SEQ ID NO: 605849 - RNA, 23 nt, Human
cuagaauuuugcuaaaagacuag

SEQ ID NO: 605850 - RNA, 22 nt, Human
gugccucugagcucugcuacag

SEQ ID NO: 605851 - RNA, 22 nt, Human
acagccuguguaccagcuggga

SEQ ID NO: 605852 - RNA, 22 nt, Human
guguggggucuucucuuggccu

SEQ ID NO: 605853 - RNA, 22 nt, Human
aacaugaugacauuguaagcuu

SEQ ID NO: 605854 - RNA, 22 nt, Human
acaguggaaaugugggagggga

SEQ ID NO: 605855 - RNA, 22 nt, Human
cugcugggccuggucucugagg

SEQ ID NO: 605856 - RNA, 22 nt, Human
gcugggcaggccucgugagggc

SEQ ID NO: 605857 - RNA, 22 nt, Human
guuggugaguuucugaucacaa

SEQ ID NO: 605858 - RNA, 22 nt, Human
gggccugugcacaguucuguua

SEQ ID NO: 605859 - RNA, 22 nt, Human
aucuucaacaacaaauugccuc

SEQ ID NO: 605860 - RNA, 22 nt, Human
gaauuucaaaagccagaacggg

SEQ ID NO: 605861 - RNA, 22 nt, Human
auuuaugauagcugcauuaaag

SEQ ID NO: 605862 - RNA, 22 nt, Human
ggcagacuguaauaggagaauu

SEQ ID NO: 605863 - RNA, 22 nt, Human
ugaggcagcccacuuuccuuag

SEQ ID NO: 605864 - RNA, 22 nt, Human
cuaaacaggaaggagcaccuga

SEQ ID NO: 605865 - RNA, 22 nt, Human
ucuguuuccucuuguguaaagu

SEQ ID NO: 605866 - RNA, 22 nt, Human
auaacuuaaugggucaugcucu

SEQ ID NO: 605867 - RNA, 22 nt, Human
ccucaggcucugggugccuacc

SEQ ID NO: 605868 - RNA, 22 nt, Human
ugguccuucucugccugcagug

SEQ ID NO: 605869 - RNA, 22 nt, Human
ggcuuccuaucccaucugagug

SEQ ID NO: 605870 - RNA, 18 nt, Human
aacuaaagaucuuuaagc

SEQ ID NO: 605871 - RNA, 22 nt, Human
cuguacaggucaaugauaagau

SEQ ID NO: 605872 - RNA, 22 nt, Human
ugggcugaguggcagccagagu

SEQ ID NO: 605873 - RNA, 22 nt, Human
uaaagccauacugaaagccacu

SEQ ID NO: 605874 - RNA, 22 nt, Human
cugccuagggucugguaccaca

SEQ ID NO: 605875 - RNA, 22 nt, Human
uuccuaaugucuacuuuaguuc

SEQ ID NO: 605876 - RNA, 22 nt, Human
ccuggugcugcuaucaggggua

SEQ ID NO: 605877 - RNA, 22 nt, Human
gccaguggcaugcggcagggac

SEQ ID NO: 605878 - RNA, 23 nt, Human
agugagcagcuguagggcaagga

SEQ ID NO: 605879 - RNA, 22 nt, Human
acagggcuauauuccucagagc

SEQ ID NO: 605880 - RNA, 22 nt, Human
caggccaggguugagaagagaa

SEQ ID NO: 605881 - RNA, 22 nt, Human
aaguuacauauucuugggcuau

SEQ ID NO: 605882 - RNA, 22 nt, Human
uguuuaauuucacaaaguugac

SEQ ID NO: 605883 - RNA, 22 nt, Human
ggucccugguucccucugagcu

SEQ ID NO: 605884 - RNA, 23 nt, Human
aggcagcagguuguccaggguga

SEQ ID NO: 605885 - RNA, 22 nt, Human
gcugaggccaggccccaccgga

SEQ ID NO: 605886 - RNA, 22 nt, Human
cuaguucuuaacuguuaugauu

SEQ ID NO: 605887 - RNA, 19 nt, Human
ucuucccuggcugucaguc

SEQ ID NO: 605888 - RNA, 22 nt, Human
gagcucuguguggcuugggugg

SEQ ID NO: 605889 - RNA, 22 nt, Human
uguguucugaaggagaagagug

SEQ ID NO: 605890 - RNA, 22 nt, Human
ggccaggcuggucucagacuuc

SEQ ID NO: 605891 - RNA, 22 nt, Human
acauucaagaugcauucacuua

SEQ ID NO: 605892 - RNA, 22 nt, Human
gaggagggcaguuccucuuuua

SEQ ID NO: 605893 - RNA, 21 nt, Human
uggcugacucuuccuaucauu

SEQ ID NO: 605894 - RNA, 22 nt, Human
gccuggaguacuccuugaagug

SEQ ID NO: 605895 - RNA, 22 nt, Human
ggacccagguagggaggaagau

SEQ ID NO: 605896 - RNA, 22 nt, Human
cagguuccaguugcagggacuu

SEQ ID NO: 605897 - RNA, 22 nt, Human
gggcugggauugcuugcuguga

SEQ ID NO: 605898 - RNA, 22 nt, Human
ucaguuaccugacagugguuau

SEQ ID NO: 605899 - RNA, 22 nt, Human
ucugaagacauaugauauggug

SEQ ID NO: 605900 - RNA, 22 nt, Human
ugaccaaagaguugcuuguauu

SEQ ID NO: 605901 - RNA, 22 nt, Human
ugggguagguaugaaaacuagg

SEQ ID NO: 605902 - RNA, 22 nt, Human
aguucugauaaaggaggaagau

SEQ ID NO: 605903 - RNA, 22 nt, Human
cgagaguggacagggcgcagcu

SEQ ID NO: 605904 - RNA, 22 nt, Human
auuuucagaacauucauucacu

SEQ ID NO: 605905 - RNA, 22 nt, Human
ugagcuggucacuccuucugaa

SEQ ID NO: 605906 - RNA, 22 nt, Human
ugcaaaauaaugaacgauuuuu

SEQ ID NO: 605907 - RNA, 22 nt, Human
aagaugcaugcugaagcuggcu

SEQ ID NO: 605908 - RNA, 22 nt, Human
agggccaguaccaggugggugg

SEQ ID NO: 605909 - RNA, 22 nt, Human
acacaguaucaaauuucaucuu

SEQ ID NO: 605910 - RNA, 22 nt, Human
gaggucaggcucaagcugggcc

SEQ ID NO: 605911 - RNA, 22 nt, Human
gucuuucuuaauucaagugcuu

SEQ ID NO: 605912 - RNA, 22 nt, Human
aagacauuggcauugacuguaa

SEQ ID NO: 605913 - RNA, 22 nt, Human
gguagcguuaucaauuugagug

SEQ ID NO: 605914 - RNA, 22 nt, Human
aaguuccucaaauaaaacauga

SEQ ID NO: 605915 - RNA, 22 nt, Human
acccaggguagagugcaguggc

SEQ ID NO: 605916 - RNA, 22 nt, Human
caugcuaauuaauuccaccugc

SEQ ID NO: 605917 - RNA, 22 nt, Human
caggggcaagaaugcugucagc

SEQ ID NO: 605918 - RNA, 22 nt, Human
gcuaggugcagcagacagcuua

SEQ ID NO: 605919 - RNA, 22 nt, Human
ugcaugauagagaugguauuag

SEQ ID NO: 605920 - RNA, 22 nt, Human
uuguuagcaugcuuaauggaua

SEQ ID NO: 605921 - RNA, 22 nt, Human
cuguagcaaguuauucaauaaa

SEQ ID NO: 605922 - RNA, 22 nt, Human
uugcccugucucacuauguuaa

SEQ ID NO: 605923 - RNA, 21 nt, Human
uauuuccaacccuuuauccuu

SEQ ID NO: 605924 - RNA, 22 nt, Human
uggccaccccuuucucugcacu

SEQ ID NO: 605925 - RNA, 22 nt, Human
gugggccuugcagggugcaggg

SEQ ID NO: 605926 - RNA, 22 nt, Human
aaugcuuauggguuccauaaua

SEQ ID NO: 605927 - RNA, 20 nt, Human
aggcacuggggauagguaag

SEQ ID NO: 605928 - RNA, 22 nt, Human
acacuagagagcaggcauuccc

SEQ ID NO: 605929 - RNA, 22 nt, Human
aauaagcugcuaggaacuuagu

SEQ ID NO: 605930 - RNA, 22 nt, Human
ucaggagcugugaauacaaagg

SEQ ID NO: 605931 - RNA, 22 nt, Human
ccagcuccaaguuugggcauca

SEQ ID NO: 605932 - RNA, 22 nt, Human
cuucucaaacugagacugucua

SEQ ID NO: 605933 - RNA, 22 nt, Human
ugggcuuccuggagccugugcu

SEQ ID NO: 605934 - RNA, 22 nt, Human
cuuugcagcaauuucuguuaaa

SEQ ID NO: 605935 - RNA, 22 nt, Human
gcauuuuaauaagauucauagg

SEQ ID NO: 605936 - RNA, 17 nt, Human
aaacuggggucaggagc

SEQ ID NO: 605937 - RNA, 22 nt, Human
uaaugcuucuguuaggaucuuc

SEQ ID NO: 605938 - RNA, 22 nt, Human
aaggaggaauucugaguucaug

SEQ ID NO: 605939 - RNA, 22 nt, Human
cagcucuucagugccugagaua

SEQ ID NO: 605940 - RNA, 22 nt, Human
ugagcaggcgcagcaggagguc

SEQ ID NO: 605941 - RNA, 22 nt, Human
ggacagagcccugguggccuaa

SEQ ID NO: 605942 - RNA, 22 nt, Human
ccugcagguccccggaugcgca

SEQ ID NO: 605943 - RNA, 22 nt, Human
cuuagcuuuguccuaggucucu

SEQ ID NO: 605944 - RNA, 22 nt, Human
aaaaggcagugcaagagagggu

SEQ ID NO: 605945 - RNA, 22 nt, Human
uaugcuuuacuuuucauuguga

SEQ ID NO: 605946 - RNA, 22 nt, Human
uucaguuugaauucuguagaac

SEQ ID NO: 605947 - RNA, 22 nt, Human
uggaaggagcuaaggaccuggg

SEQ ID NO: 605948 - RNA, 22 nt, Human
auuuucacccugaauauauuga

SEQ ID NO: 605949 - RNA, 22 nt, Human
gucacaugccagugcacacagg

SEQ ID NO: 605950 - RNA, 22 nt, Human
agagguagagguugcagugagc

SEQ ID NO: 605951 - RNA, 22 nt, Human
uguauuaacauuaauaaaaugg

SEQ ID NO: 605952 - RNA, 22 nt, Human
agagccuggcaaaagguccugc

SEQ ID NO: 605953 - RNA, 22 nt, Human
agccagagagccccagguucua

SEQ ID NO: 605954 - RNA, 18 nt, Human
uguuaaggauccaguagu

SEQ ID NO: 605955 - RNA, 22 nt, Human
ucucagaaaaacuuugagggua

SEQ ID NO: 605956 - RNA, 22 nt, Human
ccagaagucaggaaugagucuu

SEQ ID NO: 605957 - RNA, 22 nt, Human
uggcagcaauuugugauguuga

SEQ ID NO: 605958 - RNA, 22 nt, Human
aauguaaacagcaagagaaggg

SEQ ID NO: 605959 - RNA, 22 nt, Human
gccuguuuguuugcaaaggagc

SEQ ID NO: 605960 - RNA, 22 nt, Human
cccagggauguggcagauguua

SEQ ID NO: 605961 - RNA, 22 nt, Human
caaagacugcauaacacaugaa

SEQ ID NO: 605962 - RNA, 22 nt, Human
uacugcuuguuagcuguauuug

SEQ ID NO: 605963 - RNA, 22 nt, Human
ucugaaauccuuuaucuuggcu

SEQ ID NO: 605964 - RNA, 22 nt, Human
gggaaacuuucacaauguccag

SEQ ID NO: 605965 - RNA, 22 nt, Human
aggcaauuguuuguguaauagg

SEQ ID NO: 605966 - RNA, 22 nt, Human
uuaaaugaugcauaucauuuag

SEQ ID NO: 605967 - RNA, 22 nt, Human
auggaagcagaccggaggaaua

SEQ ID NO: 605968 - RNA, 22 nt, Human
ggucccuggggaacuaggcugu

SEQ ID NO: 605969 - RNA, 23 nt, Human
ugcaggcuaggaagagagccuuc

SEQ ID NO: 605970 - RNA, 22 nt, Human
uccagagccuauauguucaacu

SEQ ID NO: 605971 - RNA, 22 nt, Human
acauuauaguugcuacagagua

SEQ ID NO: 605972 - RNA, 22 nt, Human
uggagaagucaaagugaacagg

SEQ ID NO: 605973 - RNA, 22 nt, Human
uacacuuuuuacuacagauucu

SEQ ID NO: 605974 - RNA, 22 nt, Human
cccagcucugcagaccugcccu

SEQ ID NO: 605975 - RNA, 22 nt, Human
auuaguguucuuaucuucuagg

SEQ ID NO: 605976 - RNA, 22 nt, Human
gcuguggcucucacaagcaaau

SEQ ID NO: 605977 - RNA, 22 nt, Human
caugcggcucuuuccaaaccgg

SEQ ID NO: 605978 - RNA, 22 nt, Human
ugccuccauguuucagcaucua

SEQ ID NO: 605979 - RNA, 22 nt, Human
ggcuccuguccccucagcugcu

SEQ ID NO: 605980 - RNA, 22 nt, Human
agggcugagugggagagaguug

SEQ ID NO: 605981 - RNA, 22 nt, Human
caggacugaagggcacagggaa

SEQ ID NO: 605982 - RNA, 22 nt, Human
uccccucccuuccaacagagcu

SEQ ID NO: 605983 - RNA, 22 nt, Human
aacaguuuccugacuccuauga

SEQ ID NO: 605984 - RNA, 22 nt, Human
auguuauaguuauaaaaugagg

SEQ ID NO: 605985 - RNA, 22 nt, Human
augcuguuauucuaauguguga

SEQ ID NO: 605986 - RNA, 22 nt, Human
uggcuucauucagcaugacagu

SEQ ID NO: 605987 - RNA, 22 nt, Human
cagggccugcuuccuucuuguu

SEQ ID NO: 605988 - RNA, 22 nt, Human
aagaauuauugcaauacuagau

SEQ ID NO: 605989 - RNA, 22 nt, Human
acagaguuguguuuguacaacg

SEQ ID NO: 605990 - RNA, 18 nt, Human
auaucagcuacuucaugg

SEQ ID NO: 605991 - RNA, 22 nt, Human
ucaaaguaaaaguauagaguuu

SEQ ID NO: 605992 - RNA, 22 nt, Human
uguuuacacuucaagguuaagg

SEQ ID NO: 605993 - RNA, 23 nt, Human
auagaaacuaacaauuuggcuua

SEQ ID NO: 605994 - RNA, 22 nt, Human
aaauccuuuggaggacaugaug

SEQ ID NO: 605995 - RNA, 22 nt, Human
cccagcauggagugaggacuca

SEQ ID NO: 605996 - RNA, 22 nt, Human
aggcaggauugcugacaacaau

SEQ ID NO: 605997 - RNA, 22 nt, Human
gauauuuucauucggaugcuca

SEQ ID NO: 605998 - RNA, 22 nt, Human
uuccucagacccucauugugag

SEQ ID NO: 605999 - RNA, 22 nt, Human
gcuaggucugugcgcagccgcu

SEQ ID NO: 606000 - RNA, 22 nt, Human
aaucaacugagcccugguucuc

SEQ ID NO: 606001 - RNA, 23 nt, Human
acagggcuuaucugucacucauc

SEQ ID NO: 606002 - RNA, 22 nt, Human
guggcaguggagacccgagccu

SEQ ID NO: 606003 - RNA, 22 nt, Human
uuucccuacuuguaacuggaaa

SEQ ID NO: 606004 - RNA, 22 nt, Human
aacacaaucuuccaguuugcug

SEQ ID NO: 606005 - RNA, 22 nt, Human
caggcagcaucagucugcugua

SEQ ID NO: 606006 - RNA, 22 nt, Human
aacaaguaaguuuauauauauu

SEQ ID NO: 606007 - RNA, 22 nt, Human
aaauagagcuggguuaaacuuu

SEQ ID NO: 606008 - RNA, 22 nt, Human
gccaggcucagcagucaaccug

SEQ ID NO: 606009 - RNA, 22 nt, Human
gcuguccaugucuggccucagu

SEQ ID NO: 606010 - RNA, 22 nt, Human
gaaggagagggucaaggauaau

SEQ ID NO: 606011 - RNA, 22 nt, Human
gggcucaguucugcuucaugcu

SEQ ID NO: 606012 - RNA, 22 nt, Human
aaaugcauuucacuaauguuuc

SEQ ID NO: 606013 - RNA, 22 nt, Human
ccuccccacgggcagccggcgc

SEQ ID NO: 606014 - RNA, 22 nt, Human
uggcacaguccugggugccugc

SEQ ID NO: 606015 - RNA, 22 nt, Human
gcaaacauuuggucuagugugu

SEQ ID NO: 606016 - RNA, 23 nt, Human
ucccugagcuggagagacugcac

SEQ ID NO: 606017 - RNA, 22 nt, Human
ccuggagugacagguguagccu

SEQ ID NO: 606018 - RNA, 22 nt, Human
aaagaacaaauuagcuguuuua

SEQ ID NO: 606019 - RNA, 22 nt, Human
gauggaagaaaaaugcaugucu

SEQ ID NO: 606020 - RNA, 22 nt, Human
ccugucuguuugcccauucuug

SEQ ID NO: 606021 - RNA, 22 nt, Human
ccagccuggacugggucuugug

SEQ ID NO: 606022 - RNA, 22 nt, Human
auccaggaaggauggcauugag

SEQ ID NO: 606023 - RNA, 22 nt, Human
aucugaaagcuaggaguucuca

SEQ ID NO: 606024 - RNA, 22 nt, Human
gacauuuaaggcagucacuuaa

SEQ ID NO: 606025 - RNA, 22 nt, Human
uggcagagaacacacaugauuc

SEQ ID NO: 606026 - RNA, 22 nt, Human
aaauagauuucucuggguuugu

SEQ ID NO: 606027 - RNA, 22 nt, Human
cugggaggcaccgcgucgugcu

SEQ ID NO: 606028 - RNA, 22 nt, Human
uguacuugcuuauuagaaaucu

SEQ ID NO: 606029 - RNA, 22 nt, Human
gacagacaggugugguaggcac

SEQ ID NO: 606030 - RNA, 22 nt, Human
gugagaguguuuggaaauagaa

SEQ ID NO: 606031 - RNA, 22 nt, Human
ccacuuugaaccacugaggugg

SEQ ID NO: 606032 - RNA, 22 nt, Human
agggcuaggaauggaacuggag

SEQ ID NO: 606033 - RNA, 22 nt, Human
aauuuuaugccuugcacguugg

SEQ ID NO: 606034 - RNA, 22 nt, Human
ccuucugucucccucauauuga

SEQ ID NO: 606035 - RNA, 22 nt, Human
uccucuugggaauaccuuucua

SEQ ID NO: 606036 - RNA, 22 nt, Human
uacacagauaugugaucaauca

SEQ ID NO: 606037 - RNA, 22 nt, Human
gaggcugaacagguucucauga

SEQ ID NO: 606038 - RNA, 22 nt, Human
gccugagcaggcguggaccaug

SEQ ID NO: 606039 - RNA, 22 nt, Human
aguugcucaauguggcugugga

SEQ ID NO: 606040 - RNA, 22 nt, Human
ccugccugcaaaaugggacaag

SEQ ID NO: 606041 - RNA, 22 nt, Human
ugcaggggcuugucugggccug

SEQ ID NO: 606042 - RNA, 21 nt, Human
aagagcuggaucaaggauaag

SEQ ID NO: 606043 - RNA, 22 nt, Human
uacuuucuuucccaagaggugg

SEQ ID NO: 606044 - RNA, 22 nt, Human
auggacaaugugaaacuacaag

SEQ ID NO: 606045 - RNA, 22 nt, Human
uggaacaaaauauuuauguuug

SEQ ID NO: 606046 - RNA, 22 nt, Human
uaccaaaaagugagccccagag

SEQ ID NO: 606047 - RNA, 16 nt, Human
agguggagaaguucac

SEQ ID NO: 606048 - RNA, 22 nt, Human
aaacacaccuuuggaacuguga

SEQ ID NO: 606049 - RNA, 20 nt, Human
aagagaagaagucuuugaaa

SEQ ID NO: 606050 - RNA, 22 nt, Human
ugcaccuuuaaauucagcagua

SEQ ID NO: 606051 - RNA, 22 nt, Human
agacauauggugaaacauuuua

SEQ ID NO: 606052 - RNA, 22 nt, Human
ucugagcuacgaugccugucac

SEQ ID NO: 606053 - RNA, 22 nt, Human
cugucucugucuuaacucccag

SEQ ID NO: 606054 - RNA, 22 nt, Human
ugugcccaucucccagcuugac

SEQ ID NO: 606055 - RNA, 22 nt, Human
gggcugagaaguugaucccaag

SEQ ID NO: 606056 - RNA, 22 nt, Human
aaguuaagggucccagucuguu

SEQ ID NO: 606057 - RNA, 22 nt, Human
ucuggggagucaaagagaccug

SEQ ID NO: 606058 - RNA, 22 nt, Human
cagcucugaagaaaggugucua

SEQ ID NO: 606059 - RNA, 22 nt, Human
ccagggcaggagaaagacucac

SEQ ID NO: 606060 - RNA, 22 nt, Human
gcauucaucaaaaauguuccuc

SEQ ID NO: 606061 - RNA, 22 nt, Human
auugcugaaaguauuuuaugac

SEQ ID NO: 606062 - RNA, 20 nt, Human
aaugucuugagacauuucag

SEQ ID NO: 606063 - RNA, 22 nt, Human
gagagcuguaauagucaugucu

SEQ ID NO: 606064 - RNA, 22 nt, Human
auauggaaauagcaauaugguu

SEQ ID NO: 606065 - RNA, 17 nt, Human
gcaagggaugggagauu

SEQ ID NO: 606066 - RNA, 20 nt, Human
uucugcuugcaaauaucaag

SEQ ID NO: 606067 - RNA, 22 nt, Human
cuaggcugugcauugcaugaca

SEQ ID NO: 606068 - RNA, 22 nt, Human
uuuacaaggcagaacugauuaa

SEQ ID NO: 606069 - RNA, 22 nt, Human
uagaggcuucuacugcucacuu

SEQ ID NO: 606070 - RNA, 22 nt, Human
ugaaaucuacccuauucagggu

SEQ ID NO: 606071 - RNA, 22 nt, Human
aggugagggugccagugcaugg

SEQ ID NO: 606072 - RNA, 22 nt, Human
aacagcuuuuuuggucagcauu

SEQ ID NO: 606073 - RNA, 22 nt, Human
cugaggucucuuuccauaguga

SEQ ID NO: 606074 - RNA, 22 nt, Human
ucccucacugguucugcauccc

SEQ ID NO: 606075 - RNA, 22 nt, Human
aaagaucagucugaagcaacau

SEQ ID NO: 606076 - RNA, 22 nt, Human
ggagcuggucagccuugagcau

SEQ ID NO: 606077 - RNA, 22 nt, Human
acucucugucuaaaugcaguuu

SEQ ID NO: 606078 - RNA, 22 nt, Human
uagcuuaaggaguaccagauca

SEQ ID NO: 606079 - RNA, 22 nt, Human
cccaagccagacccugacccug

SEQ ID NO: 606080 - RNA, 22 nt, Human
acauuuuucuaggaggcaaggu

SEQ ID NO: 606081 - RNA, 22 nt, Human
augcugaacugagauguaacuu

SEQ ID NO: 606082 - RNA, 22 nt, Human
aaauagaauuggaagcagaguu

SEQ ID NO: 606083 - RNA, 22 nt, Human
ucacuggguaggacaugcugau

SEQ ID NO: 606084 - RNA, 23 nt, Human
acaacaggaaaucagaccugaac

SEQ ID NO: 606085 - RNA, 22 nt, Human
auaaucuuguauuuccuaaagu

SEQ ID NO: 606086 - RNA, 22 nt, Human
ggcccugggacacaacaccgaa

SEQ ID NO: 606087 - RNA, 19 nt, Human
gggacuggaggauguggag

SEQ ID NO: 606088 - RNA, 22 nt, Human
gcugcagaucccacccauuccc

SEQ ID NO: 606089 - RNA, 22 nt, Human
aggaauaaccucauugcuuuuu

SEQ ID NO: 606090 - RNA, 22 nt, Human
uacugcuagaugaaaauguagg

SEQ ID NO: 606091 - RNA, 20 nt, Human
uuacagaaaugauguuauuu

SEQ ID NO: 606092 - RNA, 22 nt, Human
aaacaugcauucaagaaaaucu

SEQ ID NO: 606093 - RNA, 22 nt, Human
ccucccacuucuugcugagguc

SEQ ID NO: 606094 - RNA, 22 nt, Human
aaagcagcagcacguggaagag

SEQ ID NO: 606095 - RNA, 22 nt, Human
gcagccugaggcccuuucuggc

SEQ ID NO: 606096 - RNA, 22 nt, Human
agucauuuugccagucuucagg

SEQ ID NO: 606097 - RNA, 22 nt, Human
uucaguuuguuugacuguuaga

SEQ ID NO: 606098 - RNA, 22 nt, Human
aggucugaguagagaaaaggca

SEQ ID NO: 606099 - RNA, 22 nt, Human
gggaguggggcuuaccuugaag

SEQ ID NO: 606100 - RNA, 22 nt, Human
ugagccugcaauaagcacagcc

SEQ ID NO: 606101 - RNA, 22 nt, Human
cuggagcucagcccagguucca

SEQ ID NO: 606102 - RNA, 22 nt, Human
cugcuuuaaaacugauacauga

SEQ ID NO: 606103 - RNA, 22 nt, Human
ccucgaccuccccaggcucagg

SEQ ID NO: 606104 - RNA, 22 nt, Human
gacaggaagucugaaggaggga

SEQ ID NO: 606105 - RNA, 19 nt, Human
ccagcagaagccacuccug

SEQ ID NO: 606106 - RNA, 22 nt, Human
auuauuuagaaaucgauugaaa

SEQ ID NO: 606107 - RNA, 22 nt, Human
uccuggcuuuucuuggcucauc

SEQ ID NO: 606108 - RNA, 22 nt, Human
acaggccugagauuuugcauuu

SEQ ID NO: 606109 - RNA, 22 nt, Human
acucauguuuucucuagcugga

SEQ ID NO: 606110 - RNA, 22 nt, Human
auuuacauuccauggugguuac

SEQ ID NO: 606111 - RNA, 23 nt, Human
cugaggccugcugcguucagguu

SEQ ID NO: 606112 - RNA, 22 nt, Human
ggguggggcccaggaaaucuau

SEQ ID NO: 606113 - RNA, 23 nt, Human
uagaauccucugagauggaauag

SEQ ID NO: 606114 - RNA, 22 nt, Human
acugaguuauggguaugccuug

SEQ ID NO: 606115 - RNA, 18 nt, Human
uccagcgugcuccagggc

SEQ ID NO: 606116 - RNA, 22 nt, Human
uccugagggcgauucagcaggu

SEQ ID NO: 606117 - RNA, 22 nt, Human
auuccuuguuucacugaaaagg

SEQ ID NO: 606118 - RNA, 22 nt, Human
cucccucagaggagcaccuguu

SEQ ID NO: 606119 - RNA, 22 nt, Human
gggcagccucggugccugcugc

SEQ ID NO: 606120 - RNA, 22 nt, Human
uuuucuaacaucuaguaauuug

SEQ ID NO: 606121 - RNA, 22 nt, Human
cagacaggguggguuucugggc

SEQ ID NO: 606122 - RNA, 22 nt, Human
uaaugccacggcagggaacagc

SEQ ID NO: 606123 - RNA, 22 nt, Human
acagcugggaacucacacagca

SEQ ID NO: 606124 - RNA, 22 nt, Human
ucauuccauuuccagcucugaa

SEQ ID NO: 606125 - RNA, 22 nt, Human
ugggagcaguugugaagcucag

SEQ ID NO: 606126 - RNA, 22 nt, Human
gggcuggagacaagugagccgc

SEQ ID NO: 606127 - RNA, 22 nt, Human
cuucuuggugauggcuuaccug

SEQ ID NO: 606128 - RNA, 22 nt, Human
ugaccacauugauuucucaucc

SEQ ID NO: 606129 - RNA, 22 nt, Human
uggaaaggaggcuuguggaaua

SEQ ID NO: 606130 - RNA, 22 nt, Human
cacagggaggcggucacuggcu

SEQ ID NO: 606131 - RNA, 22 nt, Human
augcauauuucaugaaucuuug

SEQ ID NO: 606132 - RNA, 22 nt, Human
gaggagcugggacccugucauc

SEQ ID NO: 606133 - RNA, 22 nt, Human
uuuucauuguuccucgagcauu

SEQ ID NO: 606134 - RNA, 22 nt, Human
ucaggcuggggugcuaaggugu

SEQ ID NO: 606135 - RNA, 22 nt, Human
cucccaggugucccuucugcca

SEQ ID NO: 606136 - RNA, 22 nt, Human
acccaggcgggagugcaguguc

SEQ ID NO: 606137 - RNA, 22 nt, Human
aaaugugcaugagucagaagug

SEQ ID NO: 606138 - RNA, 22 nt, Human
uccuggggcucaugggauuugu

SEQ ID NO: 606139 - RNA, 23 nt, Human
ugugggaauguuggagaggaaac

SEQ ID NO: 606140 - RNA, 22 nt, Human
uuccccagggaagcuccugcgc

SEQ ID NO: 606141 - RNA, 22 nt, Human
agaaugcucuucaaaaucuagc

SEQ ID NO: 606142 - RNA, 22 nt, Human
cugaggcaggggcagcuggaga

SEQ ID NO: 606143 - RNA, 19 nt, Human
cugaggcaaguggugguca

SEQ ID NO: 606144 - RNA, 22 nt, Human
cacacacugacaccuuaucuug

SEQ ID NO: 606145 - RNA, 22 nt, Human
uugcugaaggccucuugggguu

SEQ ID NO: 606146 - RNA, 22 nt, Human
uggcagcuugaaugcagucuuu

SEQ ID NO: 606147 - RNA, 22 nt, Human
cccaauaaaauucauuuucauu

SEQ ID NO: 606148 - RNA, 22 nt, Human
uucuuacauauuuucauauggu

SEQ ID NO: 606149 - RNA, 18 nt, Human
agcuugccucaagcuuuu

SEQ ID NO: 606150 - RNA, 22 nt, Human
guggaacauguccauauacauu

SEQ ID NO: 606151 - RNA, 22 nt, Human
aguccuggcauauagguccuca

SEQ ID NO: 606152 - RNA, 22 nt, Human
cucccucaggccuuagcccugc

SEQ ID NO: 606153 - RNA, 22 nt, Human
aguuauaaucugcuacugauau

SEQ ID NO: 606154 - RNA, 22 nt, Human
auagggcagucaggccgccacu

SEQ ID NO: 606155 - RNA, 22 nt, Human
uuaguuaauugacuauguugca

SEQ ID NO: 606156 - RNA, 22 nt, Human
cugcauccauguugcugcaaag

SEQ ID NO: 606157 - RNA, 22 nt, Human
auucugcacuuccuuugcuucc

SEQ ID NO: 606158 - RNA, 22 nt, Human
ugagugagcuggggagccggug

SEQ ID NO: 606159 - RNA, 22 nt, Human
gcauggcagccaguacauggug

SEQ ID NO: 606160 - RNA, 22 nt, Human
augcuauuaauauccagucuga

SEQ ID NO: 606161 - RNA, 22 nt, Human
cucacacacgaagcccuuggcc

SEQ ID NO: 606162 - RNA, 22 nt, Human
cauguguuucgagacuguugag

SEQ ID NO: 606163 - RNA, 22 nt, Human
gaggauggaggcaguuagggcc

SEQ ID NO: 606164 - RNA, 22 nt, Human
ugauucuguaaacaugucuuua

SEQ ID NO: 606165 - RNA, 22 nt, Human
agugcuguccaguuucacaggu

SEQ ID NO: 606166 - RNA, 22 nt, Human
uccuccagaccacuucugugcg

SEQ ID NO: 606167 - RNA, 22 nt, Human
cauugucacccaaagcucauag

SEQ ID NO: 606168 - RNA, 22 nt, Human
ucauggggcucuucaaguggag

SEQ ID NO: 606169 - RNA, 22 nt, Human
uuucauuucauagaauuguguu

SEQ ID NO: 606170 - RNA, 22 nt, Human
uggcaguucaggcugcaaucau

SEQ ID NO: 606171 - RNA, 22 nt, Human
agguggagugaaggaaaggcag

SEQ ID NO: 606172 - RNA, 22 nt, Human
agcccuccuggggccacgcugg

SEQ ID NO: 606173 - RNA, 22 nt, Human
cucugagagagcuggugagcac

SEQ ID NO: 606174 - RNA, 22 nt, Human
gaaagguugggugaauggugga

SEQ ID NO: 606175 - RNA, 22 nt, Human
gggugguguauuagagcugcag

SEQ ID NO: 606176 - RNA, 22 nt, Human
guaacaguuuggguuccaauug

SEQ ID NO: 606177 - RNA, 22 nt, Human
accuuuauauaucaacuucucc

SEQ ID NO: 606178 - RNA, 22 nt, Human
agccuggaggaggaguugagca

SEQ ID NO: 606179 - RNA, 22 nt, Human
acugcuuuaucugagaaguccu

SEQ ID NO: 606180 - RNA, 22 nt, Human
ggcacugggagaggugagacgg

SEQ ID NO: 606181 - RNA, 22 nt, Human
ugcacaggccuugaagggagag

SEQ ID NO: 606182 - RNA, 22 nt, Human
caagcuggagguuggagcuacu

SEQ ID NO: 606183 - RNA, 22 nt, Human
ugcagaggagcuggaaggcugg

SEQ ID NO: 606184 - RNA, 22 nt, Human
ugcagcuucuccaaauauuaca

SEQ ID NO: 606185 - RNA, 22 nt, Human
gcugcccugcaucugugccuuc

SEQ ID NO: 606186 - RNA, 22 nt, Human
ucuuuauugcuacugguuuguc

SEQ ID NO: 606187 - RNA, 22 nt, Human
acagagcacugcccugugccgc

SEQ ID NO: 606188 - RNA, 22 nt, Human
ugugaauagauugaagcuuugg

SEQ ID NO: 606189 - RNA, 22 nt, Human
ggcgugggaaguggggcuucug

SEQ ID NO: 606190 - RNA, 22 nt, Human
augacccuuacugcaucauaca

SEQ ID NO: 606191 - RNA, 22 nt, Human
ugggcuggcguggagaguuuag

SEQ ID NO: 606192 - RNA, 22 nt, Human
cauuucuagacaaguccuggag

SEQ ID NO: 606193 - RNA, 22 nt, Human
gcaugcaguaaaauucagcaac

SEQ ID NO: 606194 - RNA, 22 nt, Human
cuuccugaacaaugccaucaau

SEQ ID NO: 606195 - RNA, 22 nt, Human
uauuuaauaaaacuauggcaug

SEQ ID NO: 606196 - RNA, 22 nt, Human
gauaucauaucagacaaccucu

SEQ ID NO: 606197 - RNA, 21 nt, Human
agcuuguuauuaauucagaac

SEQ ID NO: 606198 - RNA, 22 nt, Human
uccaggagugauaaggccacug

SEQ ID NO: 606199 - RNA, 22 nt, Human
ccuccugggcuccugucugcac

SEQ ID NO: 606200 - RNA, 22 nt, Human
ugccugcuagauauccagguga

SEQ ID NO: 606201 - RNA, 22 nt, Human
ggcccaggaugcaagaacugaa

SEQ ID NO: 606202 - RNA, 17 nt, Human
ccaggagcgugggucuc

SEQ ID NO: 606203 - RNA, 22 nt, Human
ucugaguucauaccaggcuacc

SEQ ID NO: 606204 - RNA, 22 nt, Human
aaaaacacugggcugggaguca

SEQ ID NO: 606205 - RNA, 22 nt, Human
uuacacagugcacaagcagagu

SEQ ID NO: 606206 - RNA, 22 nt, Human
ucaguguuuuaacugucuuuua

SEQ ID NO: 606207 - RNA, 22 nt, Human
auuuguucauggguuguuaugc

SEQ ID NO: 606208 - RNA, 22 nt, Human
ucucugaguucuccuccagccc

SEQ ID NO: 606209 - RNA, 22 nt, Human
acugcuuuaaaaaagcaagcuu

SEQ ID NO: 606210 - RNA, 22 nt, Human
ccacaggacggaggucuggccg

SEQ ID NO: 606211 - RNA, 22 nt, Human
acuuagcaguuuagaauauguc

SEQ ID NO: 606212 - RNA, 22 nt, Human
uucugaugguggaaugcuucag

SEQ ID NO: 606213 - RNA, 22 nt, Human
aaggaagggaaauagugauguc

SEQ ID NO: 606214 - RNA, 22 nt, Human
uccgggagcugaacgucuugcg

SEQ ID NO: 606215 - RNA, 22 nt, Human
cagcugggcuaagaguagaggc

SEQ ID NO: 606216 - RNA, 22 nt, Human
gcuacaggagcugucacaugcu

SEQ ID NO: 606217 - RNA, 22 nt, Human
gccugaggaaugcuccugacuu

SEQ ID NO: 606218 - RNA, 21 nt, Human
cacuguauagcaggagaaaac

SEQ ID NO: 606219 - RNA, 22 nt, Human
cccaggcugauguucagcgggu

SEQ ID NO: 606220 - RNA, 22 nt, Human
cagggccagccauccugcuggg

SEQ ID NO: 606221 - RNA, 22 nt, Human
aaccugagauacuggucuuuau

SEQ ID NO: 606222 - RNA, 22 nt, Human
cagucacuuacaaaaauauaau

SEQ ID NO: 606223 - RNA, 22 nt, Human
gaaauugucagcuucuuucagu

SEQ ID NO: 606224 - RNA, 22 nt, Human
ugcaggugauucugaugcaguu

SEQ ID NO: 606225 - RNA, 22 nt, Human
caaauacuaaacauaagauuuu

SEQ ID NO: 606226 - RNA, 22 nt, Human
cccaggagacugagcuguaacc

SEQ ID NO: 606227 - RNA, 22 nt, Human
cagaggaggccaccgcauaggc

SEQ ID NO: 606228 - RNA, 22 nt, Human
cuacaucacuuaauucuuagaa

SEQ ID NO: 606229 - RNA, 22 nt, Human
acaauuagugaucagugaugcc

SEQ ID NO: 606230 - RNA, 22 nt, Human
cggccaagccggggccccgaag

SEQ ID NO: 606231 - RNA, 22 nt, Human
aucaaaguggaaguuuacuagg

SEQ ID NO: 606232 - RNA, 19 nt, Human
agcaacaccguuuauuucc

SEQ ID NO: 606233 - RNA, 22 nt, Human
uaucagaaaugccuuaaauugg

SEQ ID NO: 606234 - RNA, 22 nt, Human
guguguguguaaaaauccagag

SEQ ID NO: 606235 - RNA, 22 nt, Human
cagcgccuccuggaccuccucu

SEQ ID NO: 606236 - RNA, 22 nt, Human
acauuuaguaugagucucugua

SEQ ID NO: 606237 - RNA, 22 nt, Human
ggggaugguggcauuuguaaaa

SEQ ID NO: 606238 - RNA, 22 nt, Human
cagaggugcuggagugaguccu

SEQ ID NO: 606239 - RNA, 21 nt, Human
caggcucugcuagaggagccu

SEQ ID NO: 606240 - RNA, 22 nt, Human
ccagggugaccagcuggccuag

SEQ ID NO: 606241 - RNA, 17 nt, Human
cagcucugcagacuucc

SEQ ID NO: 606242 - RNA, 22 nt, Human
cugagcccuugcuuaugcuucc

SEQ ID NO: 606243 - RNA, 22 nt, Human
ugcccugcuaaccuugguucca

SEQ ID NO: 606244 - RNA, 22 nt, Human
ggcaccaggggauguaaugucc

SEQ ID NO: 606245 - RNA, 22 nt, Human
ugagguccugcauguugagguc

SEQ ID NO: 606246 - RNA, 22 nt, Human
cuggccacuggagguggcaccc

SEQ ID NO: 606247 - RNA, 22 nt, Human
ccauuuuuaaagagcuuaagua

SEQ ID NO: 606248 - RNA, 22 nt, Human
cugugcacuucucuuuauuugu

SEQ ID NO: 606249 - RNA, 22 nt, Human
agagcauccugguuuuaugaag

SEQ ID NO: 606250 - RNA, 19 nt, Human
agaggccucagcagcuggc

SEQ ID NO: 606251 - RNA, 19 nt, Human
ugagugggagcccagguau

SEQ ID NO: 606252 - RNA, 22 nt, Human
uccugucagugaggcagaugaa

SEQ ID NO: 606253 - RNA, 22 nt, Human
aaugaugguuaaacacuggagg

SEQ ID NO: 606254 - RNA, 22 nt, Human
cauugcaccacauugcaucccu

SEQ ID NO: 606255 - RNA, 22 nt, Human
uucaagcagagauauuucaaga

SEQ ID NO: 606256 - RNA, 22 nt, Human
aacaugaugacaaagguauauu

SEQ ID NO: 606257 - RNA, 22 nt, Human
cauugaaaaacguugacugagu

SEQ ID NO: 606258 - RNA, 22 nt, Human
uugaggcacacacagguugcau

SEQ ID NO: 606259 - RNA, 22 nt, Human
acauuaaauuucauagugauua

SEQ ID NO: 606260 - RNA, 22 nt, Human
auuguucauguaugaauaaaua

SEQ ID NO: 606261 - RNA, 22 nt, Human
ccugugccaaaaggcugcuuau

SEQ ID NO: 606262 - RNA, 22 nt, Human
ccagggcagcgccccuccacgc

SEQ ID NO: 606263 - RNA, 18 nt, Human
ugagguagcuuuccuccu

SEQ ID NO: 606264 - RNA, 22 nt, Human
aaguuuauguugguaagauauc

SEQ ID NO: 606265 - RNA, 22 nt, Human
gaagggugugauuugccugaga

SEQ ID NO: 606266 - RNA, 22 nt, Human
ugcugagacaacaggaaacaag

SEQ ID NO: 606267 - RNA, 20 nt, Human
aagcaucuggauguagcaau

SEQ ID NO: 606268 - RNA, 22 nt, Human
cgcauccagggcgcaggaucug

SEQ ID NO: 606269 - RNA, 22 nt, Human
ugaauguucucuaaauacuccu

SEQ ID NO: 606270 - RNA, 22 nt, Human
uugcauaugaagcugacuuaaa

SEQ ID NO: 606271 - RNA, 22 nt, Human
caucuuuauuuauauagacagg

SEQ ID NO: 606272 - RNA, 20 nt, Human
ccugccugccucggcucauu

SEQ ID NO: 606273 - RNA, 22 nt, Human
uauuuuacagacuacuuuagau

SEQ ID NO: 606274 - RNA, 22 nt, Human
gaaugauaaauggaagcagcau

SEQ ID NO: 606275 - RNA, 22 nt, Human
aagaauguggguggauaugaug

SEQ ID NO: 606276 - RNA, 22 nt, Human
accaggcuccccuuggauccug

SEQ ID NO: 606277 - RNA, 22 nt, Human
ccaggguggcguagaugcuggg

SEQ ID NO: 606278 - RNA, 22 nt, Human
cgaggccagcucuaagcccuac

SEQ ID NO: 606279 - RNA, 22 nt, Human
gcccagagugaguccugggccc

SEQ ID NO: 606280 - RNA, 22 nt, Human
gaggccaacuuuggagaacagg

SEQ ID NO: 606281 - RNA, 22 nt, Human
ucaauuuuaugaaacaaaguga

SEQ ID NO: 606282 - RNA, 22 nt, Human
uuucuaagcuuaguaugaggca

SEQ ID NO: 606283 - RNA, 22 nt, Human
uccaggcuuuggggcaggagcg

SEQ ID NO: 606284 - RNA, 22 nt, Human
accugggaaaaggaguggccau

SEQ ID NO: 606285 - RNA, 22 nt, Human
gguggacaguguuagcucuggg

SEQ ID NO: 606286 - RNA, 22 nt, Human
aggggccugguuggccucuguu

SEQ ID NO: 606287 - RNA, 22 nt, Human
cccagcucccugguauuugugc

SEQ ID NO: 606288 - RNA, 20 nt, Human
aguuuaagaaaaagcuccag

SEQ ID NO: 606289 - RNA, 22 nt, Human
ucaccuugugaucucccugccu

SEQ ID NO: 606290 - RNA, 22 nt, Human
uguccagugauucucaugagcc

SEQ ID NO: 606291 - RNA, 22 nt, Human
cagcuucauugccugaugucuu

SEQ ID NO: 606292 - RNA, 19 nt, Human
ggcagacacaguugacaug

SEQ ID NO: 606293 - RNA, 22 nt, Human
uaaauaucaccuggaauuguua

SEQ ID NO: 606294 - RNA, 22 nt, Human
auuuccuaggugcucgagugcu

SEQ ID NO: 606295 - RNA, 22 nt, Human
uacagcuuuauacccaucaaaa

SEQ ID NO: 606296 - RNA, 22 nt, Human
cuacauuuggagaguauaggaa

SEQ ID NO: 606297 - RNA, 22 nt, Human
ugcuuucuguuuuucauauaau

SEQ ID NO: 606298 - RNA, 22 nt, Human
aguuaacucauuuuauaaugcc

SEQ ID NO: 606299 - RNA, 21 nt, Human
ucacagagccacagaauuggu

SEQ ID NO: 606300 - RNA, 22 nt, Human
uuugacaguguuggggcaggcu

SEQ ID NO: 606301 - RNA, 22 nt, Human
cuggcuccuccaaggccuggag

SEQ ID NO: 606302 - RNA, 22 nt, Human
uuagccauuuuauucagcaggu

SEQ ID NO: 606303 - RNA, 22 nt, Human
aaacacagggauauauauucca

SEQ ID NO: 606304 - RNA, 22 nt, Human
uuaagauuuucuucaguauuau

SEQ ID NO: 606305 - RNA, 22 nt, Human
cauuaugccaaaguagaaauau

SEQ ID NO: 606306 - RNA, 22 nt, Human
ugagggagcugaccuuucugug

SEQ ID NO: 606307 - RNA, 22 nt, Human
cuugucugcuauaaaaauccag

SEQ ID NO: 606308 - RNA, 22 nt, Human
ugccacagagcaauucugcuga

SEQ ID NO: 606309 - RNA, 21 nt, Human
ggacacugauaaucuuguugc

SEQ ID NO: 606310 - RNA, 16 nt, Human
gggcugggggauucug

SEQ ID NO: 606311 - RNA, 22 nt, Human
caugccagggcuugcugccugg

SEQ ID NO: 606312 - RNA, 22 nt, Human
aguggggccggugaggccgagg

SEQ ID NO: 606313 - RNA, 22 nt, Human
auuaagugacuaaaguaaugcu

SEQ ID NO: 606314 - RNA, 22 nt, Human
guacuuuagaguaaaauagacc

SEQ ID NO: 606315 - RNA, 22 nt, Human
ugucccagcacuuugggagucu

SEQ ID NO: 606316 - RNA, 22 nt, Human
acuccucagccagcaucaggga

SEQ ID NO: 606317 - RNA, 23 nt, Human
agagagaguuugugucagguacc

SEQ ID NO: 606318 - RNA, 23 nt, Human
uaggccagggugaccuggggaga

SEQ ID NO: 606319 - RNA, 22 nt, Human
cuauuuuaagaggccauuaggu

SEQ ID NO: 606320 - RNA, 22 nt, Human
aauugcauguuaaugacuaagu

SEQ ID NO: 606321 - RNA, 22 nt, Human
ccaugcuccuuaccacucacuu

SEQ ID NO: 606322 - RNA, 23 nt, Human
uugcagggauggaguucaaaaug

SEQ ID NO: 606323 - RNA, 22 nt, Human
gaguaagagcuggcuuuggugu

SEQ ID NO: 606324 - RNA, 22 nt, Human
guauuuuucauuccaagugaga

SEQ ID NO: 606325 - RNA, 22 nt, Human
gcuguccaggagugcagagauu

SEQ ID NO: 606326 - RNA, 22 nt, Human
ugcauggauaaaaguauauuau

SEQ ID NO: 606327 - RNA, 22 nt, Human
cugcagggacccaagucuuugg

SEQ ID NO: 606328 - RNA, 22 nt, Human
acccugggucauauacagugug

SEQ ID NO: 606329 - RNA, 22 nt, Human
guugcuucucuuaaguccagcu

SEQ ID NO: 606330 - RNA, 21 nt, Human
aagaacuauugagguacacag

SEQ ID NO: 606331 - RNA, 22 nt, Human
ugcuuaaaaaguaacugcugau

SEQ ID NO: 606332 - RNA, 22 nt, Human
aaacauuguuaugauaaauuac

SEQ ID NO: 606333 - RNA, 22 nt, Human
agugauggugagugagaagcuc

SEQ ID NO: 606334 - RNA, 19 nt, Human
cacugugguccuucacugc

SEQ ID NO: 606335 - RNA, 22 nt, Human
aagcagcauaugacagcaucca

SEQ ID NO: 606336 - RNA, 22 nt, Human
cagaggcgaggcagcugaaccu

SEQ ID NO: 606337 - RNA, 22 nt, Human
uccaccaggcuccauguucagu

SEQ ID NO: 606338 - RNA, 22 nt, Human
uuuauguuugacaaugaucugg

SEQ ID NO: 606339 - RNA, 22 nt, Human
uaguuuuacuugcgaugauaau

SEQ ID NO: 606340 - RNA, 17 nt, Human
ccuguuguugccuuugc

SEQ ID NO: 606341 - RNA, 22 nt, Human
ggagaugggggauuuuacagcg

SEQ ID NO: 606342 - RNA, 21 nt, Human
ucuggcuuucauuccccuucu

SEQ ID NO: 606343 - RNA, 22 nt, Human
aguccuuaugagaugcugccuu

SEQ ID NO: 606344 - RNA, 22 nt, Human
uggcaggaggaugaggcggcua

SEQ ID NO: 606345 - RNA, 22 nt, Human
gaccaggaaagagugugacuaa

SEQ ID NO: 606346 - RNA, 23 nt, Human
uaagacacccgacuccagagaug

SEQ ID NO: 606347 - RNA, 22 nt, Human
cuuccucucaauaagaugagaa

SEQ ID NO: 606348 - RNA, 19 nt, Human
uuugaaaggauuguuauuu

SEQ ID NO: 606349 - RNA, 22 nt, Human
aagauacagugaaagggcauug

SEQ ID NO: 606350 - RNA, 22 nt, Human
cagggcaaagagagcacaugcu

SEQ ID NO: 606351 - RNA, 22 nt, Human
ugaguuauaaugaauauuugaa

SEQ ID NO: 606352 - RNA, 22 nt, Human
ggagccuauuauuagcauggca

SEQ ID NO: 606353 - RNA, 22 nt, Human
uagaaacagcauauauuagccc

SEQ ID NO: 606354 - RNA, 22 nt, Human
gcuuccaguaaguugcugccau

SEQ ID NO: 606355 - RNA, 22 nt, Human
aacacugacgacgugaacuaaa

SEQ ID NO: 606356 - RNA, 20 nt, Human
agcuaggagaaagcauggag

SEQ ID NO: 606357 - RNA, 22 nt, Human
gcuggcucugcacccaggccuc

SEQ ID NO: 606358 - RNA, 22 nt, Human
ugcuucuggcuuaucucgugcc

SEQ ID NO: 606359 - RNA, 22 nt, Human
caugagauaauuuuucuccagu

SEQ ID NO: 606360 - RNA, 22 nt, Human
agaucauaugaaaaauuucaag

SEQ ID NO: 606361 - RNA, 22 nt, Human
ucagaacauucucauugacugc

SEQ ID NO: 606362 - RNA, 21 nt, Human
acaaugucaaggucagacauu

SEQ ID NO: 606363 - RNA, 22 nt, Human
ucccagaggcuccagucucuau

SEQ ID NO: 606364 - RNA, 22 nt, Human
ggaagcugguaauuguugggac

SEQ ID NO: 606365 - RNA, 22 nt, Human
uuuuggggagaacgguugcuau

SEQ ID NO: 606366 - RNA, 22 nt, Human
cagggagaggcaucauagggaa

SEQ ID NO: 606367 - RNA, 21 nt, Human
agcagaggcagaauguaugca

SEQ ID NO: 606368 - RNA, 22 nt, Human
gauucagugagggugagaagaa

SEQ ID NO: 606369 - RNA, 22 nt, Human
gcagagcagcaaauggaaagga

SEQ ID NO: 606370 - RNA, 22 nt, Human
augacauuuauacagugagcuu

SEQ ID NO: 606371 - RNA, 19 nt, Human
auagucuuuccaauuauac

SEQ ID NO: 606372 - RNA, 21 nt, Human
gacuuuaauuugagagcaaaa

SEQ ID NO: 606373 - RNA, 22 nt, Human
ucagggacagggugcugcugcg

SEQ ID NO: 606374 - RNA, 22 nt, Human
gaaggagcuaaagggagcccug

SEQ ID NO: 606375 - RNA, 22 nt, Human
ucccuguccugggcaaucccag

SEQ ID NO: 606376 - RNA, 22 nt, Human
uucucagacuuccagcaccagc

SEQ ID NO: 606377 - RNA, 22 nt, Human
ugggguggaacccuucugcugg

SEQ ID NO: 606378 - RNA, 22 nt, Human
caaagcaguauuggauucuuua

SEQ ID NO: 606379 - RNA, 22 nt, Human
acuuccagcaccucaagcggaa

SEQ ID NO: 606380 - RNA, 22 nt, Human
ggugguggagccagcugggagu

SEQ ID NO: 606381 - RNA, 22 nt, Human
cuccagcuagggcuggcuuacu

SEQ ID NO: 606382 - RNA, 21 nt, Human
ccagcugcuccuugagguucc

SEQ ID NO: 606383 - RNA, 22 nt, Human
uaacaaacuggaaauugacauu

SEQ ID NO: 606384 - RNA, 22 nt, Human
aagcacugagcacaguggcuga

SEQ ID NO: 606385 - RNA, 22 nt, Human
ucaggagaaggcaauguggaaa

SEQ ID NO: 606386 - RNA, 22 nt, Human
ucuuuaaugugauuguaauuau

SEQ ID NO: 606387 - RNA, 22 nt, Human
uauuuauucauucagcaagcau

SEQ ID NO: 606388 - RNA, 22 nt, Human
aaauugauguucccaguugaaa

SEQ ID NO: 606389 - RNA, 22 nt, Human
agaacugguggugaucaguuau

SEQ ID NO: 606390 - RNA, 22 nt, Human
gguggccugaauuagcucaggg

SEQ ID NO: 606391 - RNA, 22 nt, Human
aagagaaagcagacuuugucau

SEQ ID NO: 606392 - RNA, 22 nt, Human
agggcuccuccccggccuccac

SEQ ID NO: 606393 - RNA, 22 nt, Human
acauauuggcuuagcucuguga

SEQ ID NO: 606394 - RNA, 22 nt, Human
cugggcucagaaccuuguuaag

SEQ ID NO: 606395 - RNA, 22 nt, Human
ucaucacucauuggacaacaga

SEQ ID NO: 606396 - RNA, 22 nt, Human
ucugugccagcagccuccugga

SEQ ID NO: 606397 - RNA, 22 nt, Human
uguagcauuuuauguaauaagu

SEQ ID NO: 606398 - RNA, 22 nt, Human
aaaauuauagaucuagugccug

SEQ ID NO: 606399 - RNA, 22 nt, Human
ugagcugugucuuggugagagu

SEQ ID NO: 606400 - RNA, 22 nt, Human
uccagcccgacugggccugccg

SEQ ID NO: 606401 - RNA, 22 nt, Human
uuuucugaaguuuaagacauuu

SEQ ID NO: 606402 - RNA, 22 nt, Human
cucaggucacggaucugagcug

SEQ ID NO: 606403 - RNA, 22 nt, Human
ggcauuaacucuguuucaauuu

SEQ ID NO: 606404 - RNA, 22 nt, Human
aauguagaugagauauuuuuug

SEQ ID NO: 606405 - RNA, 22 nt, Human
gagucucugaccagggugccaa

SEQ ID NO: 606406 - RNA, 22 nt, Human
uggcaaggccacaggugcaguu

SEQ ID NO: 606407 - RNA, 22 nt, Human
aaaugcacaaagauuuugcacu

SEQ ID NO: 606408 - RNA, 22 nt, Human
uaggagacauugaucccaagaa

SEQ ID NO: 606409 - RNA, 22 nt, Human
uuaaaaugcagauuaugacuca

SEQ ID NO: 606410 - RNA, 22 nt, Human
cuggaugcuuccucucugcuag

SEQ ID NO: 606411 - RNA, 22 nt, Human
gacauugaaguauuuuugucga

SEQ ID NO: 606412 - RNA, 22 nt, Human
gaucagaaugggacauauccug

SEQ ID NO: 606413 - RNA, 22 nt, Human
ugccugagugauguggcagcca

SEQ ID NO: 606414 - RNA, 22 nt, Human
cugggaggauucauugagguga

SEQ ID NO: 606415 - RNA, 22 nt, Human
agcagugugcuucguuucauga

SEQ ID NO: 606416 - RNA, 22 nt, Human
gcaagagacuuuuaugucugcc

SEQ ID NO: 606417 - RNA, 22 nt, Human
aagacaggaacauagcaaaucc

SEQ ID NO: 606418 - RNA, 22 nt, Human
augcuguguuuuaaauggaaau

SEQ ID NO: 606419 - RNA, 22 nt, Human
ucuguguugauaauuuuggaga

SEQ ID NO: 606420 - RNA, 22 nt, Human
uuucaugauccauuuacaaaau

SEQ ID NO: 606421 - RNA, 22 nt, Human
gguaggcagaucacugucuaug

SEQ ID NO: 606422 - RNA, 22 nt, Human
uaaagacacccagggagggacu

SEQ ID NO: 606423 - RNA, 22 nt, Human
cucuuuaguggugaugaugcua

SEQ ID NO: 606424 - RNA, 22 nt, Human
cagggcagggagcuuagaauga

SEQ ID NO: 606425 - RNA, 22 nt, Human
agaggccaauaguagguggcau

SEQ ID NO: 606426 - RNA, 22 nt, Human
cuccaggaaaauagggaaugag

SEQ ID NO: 606427 - RNA, 22 nt, Human
gccaggaguucagaugcauguu

SEQ ID NO: 606428 - RNA, 17 nt, Human
cuccuggcagccucagg

SEQ ID NO: 606429 - RNA, 22 nt, Human
ucuuggcuucuguauuuccugu

SEQ ID NO: 606430 - RNA, 18 nt, Human
auagaaaccuuuaaucag

SEQ ID NO: 606431 - RNA, 22 nt, Human
ucucuuggugauagucuuucuu

SEQ ID NO: 606432 - RNA, 22 nt, Human
caugcucacaaaagauggcaaa

SEQ ID NO: 606433 - RNA, 22 nt, Human
gcccaggaaauaaaagugggcu

SEQ ID NO: 606434 - RNA, 22 nt, Human
cugcagggaccacaagcagguu

SEQ ID NO: 606435 - RNA, 22 nt, Human
ccaggagcaacuugaaggcaag

SEQ ID NO: 606436 - RNA, 19 nt, Human
ugaagcaggcagagaagau

SEQ ID NO: 606437 - RNA, 22 nt, Human
cuacaucaaguaaucuucaaaa

SEQ ID NO: 606438 - RNA, 22 nt, Human
cuggccagaagcaccuuuggcg

SEQ ID NO: 606439 - RNA, 22 nt, Human
uccuccagcuucucuuuugggg

SEQ ID NO: 606440 - RNA, 22 nt, Human
aggggaugccuaguggagucuc

SEQ ID NO: 606441 - RNA, 22 nt, Human
ucucugugguaugucauagcaa

SEQ ID NO: 606442 - RNA, 22 nt, Human
cuggcugaauccuagucucaua

SEQ ID NO: 606443 - RNA, 22 nt, Human
cagcugagaagugauagcugca

SEQ ID NO: 606444 - RNA, 22 nt, Human
ccagaggagaugccuccucugu

SEQ ID NO: 606445 - RNA, 22 nt, Human
auaaauagugcugccaugagua

SEQ ID NO: 606446 - RNA, 22 nt, Human
accuuuuuguucuguucucagc

SEQ ID NO: 606447 - RNA, 22 nt, Human
gugcagggcuggcaccggaggc

SEQ ID NO: 606448 - RNA, 22 nt, Human
ggccacagucucuggaaggaug

SEQ ID NO: 606449 - RNA, 22 nt, Human
uguaaaauaccauuccuuguca

SEQ ID NO: 606450 - RNA, 22 nt, Human
ugauuagacaaaggaaucaugc

SEQ ID NO: 606451 - RNA, 22 nt, Human
uuuacaauucucuaccaguguu

SEQ ID NO: 606452 - RNA, 22 nt, Human
uuucaaugacacaaaagagaaa

SEQ ID NO: 606453 - RNA, 22 nt, Human
agaccugguuuaucaccagcau

SEQ ID NO: 606454 - RNA, 23 nt, Human
auuuacagguuaaaugaaaucag

SEQ ID NO: 606455 - RNA, 22 nt, Human
uucauugauaguuuuauguaug

SEQ ID NO: 606456 - RNA, 22 nt, Human
caggaacauuguagaauugaaa

SEQ ID NO: 606457 - RNA, 22 nt, Human
cagagcagccuccagggggagc

SEQ ID NO: 606458 - RNA, 22 nt, Human
ucagcuuuuaaaaacaagaagu

SEQ ID NO: 606459 - RNA, 22 nt, Human
gaggggagaaggcacuaaccag

SEQ ID NO: 606460 - RNA, 20 nt, Human
ccauggccacaucugugcug

SEQ ID NO: 606461 - RNA, 20 nt, Human
aaagucuuaugguuaauuuu

SEQ ID NO: 606462 - RNA, 21 nt, Human
accuucaguguucucagcugc

SEQ ID NO: 606463 - RNA, 22 nt, Human
caggagcucucaucgucagggc

SEQ ID NO: 606464 - RNA, 22 nt, Human
ugggcagauuaaugcaguggcu

SEQ ID NO: 606465 - RNA, 22 nt, Human
cugggagaggaaccucgagggu

SEQ ID NO: 606466 - RNA, 22 nt, Human
ugcuuaauaggaguugaacauu

SEQ ID NO: 606467 - RNA, 22 nt, Human
gucccagagagcacuaguccau

SEQ ID NO: 606468 - RNA, 22 nt, Human
uucagaaacaucaguggaugga

SEQ ID NO: 606469 - RNA, 22 nt, Human
agaaaacacugcccccucucuc

SEQ ID NO: 606470 - RNA, 19 nt, Human
ucuccaguugcuuucaggg

SEQ ID NO: 606471 - RNA, 22 nt, Human
gcugcuuugugaaaaucauuca

SEQ ID NO: 606472 - RNA, 22 nt, Human
ucaguguuuccugugguacagc

SEQ ID NO: 606473 - RNA, 22 nt, Human
cugaguccagggacagaggcgu

SEQ ID NO: 606474 - RNA, 22 nt, Human
aggaggaggcuggaguacaccc

SEQ ID NO: 606475 - RNA, 22 nt, Human
gcagugggcaacaagagcugga

SEQ ID NO: 606476 - RNA, 22 nt, Human
cuaggcagauggagaaguggcu

SEQ ID NO: 606477 - RNA, 22 nt, Human
ggcagugagcuggagggaagga

SEQ ID NO: 606478 - RNA, 22 nt, Human
cuugaaucuucugaguauuugc

SEQ ID NO: 606479 - RNA, 20 nt, Human
ucccuggggcccuacuuccu

SEQ ID NO: 606480 - RNA, 22 nt, Human
auuauucagucuuguaaggagu

SEQ ID NO: 606481 - RNA, 22 nt, Human
acaucucacuucuuugaaggcu

SEQ ID NO: 606482 - RNA, 22 nt, Human
aggcugagcuggcccuugaaau

SEQ ID NO: 606483 - RNA, 22 nt, Human
cugucuucuccuuuguuucagg

SEQ ID NO: 606484 - RNA, 22 nt, Human
cugggagagccuuuccugaguc

SEQ ID NO: 606485 - RNA, 22 nt, Human
acagaacaagaccugcuuauug

SEQ ID NO: 606486 - RNA, 22 nt, Human
guguauaauccugcaaagggag

SEQ ID NO: 606487 - RNA, 22 nt, Human
agcuuccuacaaccaucucaga

SEQ ID NO: 606488 - RNA, 22 nt, Human
gaugcugagagguggagggaac

SEQ ID NO: 606489 - RNA, 23 nt, Human
uugauucuccaguaugggcugag

SEQ ID NO: 606490 - RNA, 22 nt, Human
caguguggcugagacagaggcu

SEQ ID NO: 606491 - RNA, 22 nt, Human
gggcacugagggcccacaggau

SEQ ID NO: 606492 - RNA, 22 nt, Human
uucaaugugguuauaauaacua

SEQ ID NO: 606493 - RNA, 22 nt, Human
uccugggaacucggaaagcucu

SEQ ID NO: 606494 - RNA, 22 nt, Human
agcugcucuuugaaggacacuu

SEQ ID NO: 606495 - RNA, 22 nt, Human
aggggcgcugcgguccucagcc

SEQ ID NO: 606496 - RNA, 22 nt, Human
aagauguugcauuagaauaccu

SEQ ID NO: 606497 - RNA, 22 nt, Human
acuuguuuuaucugucaauaga

SEQ ID NO: 606498 - RNA, 22 nt, Human
auuauuauuuuagagagaggcc

SEQ ID NO: 606499 - RNA, 22 nt, Human
gagaauuuucuaguaguuucau

SEQ ID NO: 606500 - RNA, 22 nt, Human
ucuaggccguaggauacagagc

SEQ ID NO: 606501 - RNA, 22 nt, Human
gaaauagaggacagcuggauca

SEQ ID NO: 606502 - RNA, 22 nt, Human
gacaguguuacaauuuaaugga

SEQ ID NO: 606503 - RNA, 19 nt, Human
ucuuggcuuugucuacugu

SEQ ID NO: 606504 - RNA, 22 nt, Human
uauacaguaucuuuugaaggca

SEQ ID NO: 606505 - RNA, 22 nt, Human
caggugggccgggguuuguucu

SEQ ID NO: 606506 - RNA, 22 nt, Human
ugaccaggauacugcagggaug

SEQ ID NO: 606507 - RNA, 22 nt, Human
acauagauuuaagagcaauuag

SEQ ID NO: 606508 - RNA, 22 nt, Human
auggcuucucgcuggcaccugu

SEQ ID NO: 606509 - RNA, 22 nt, Human
gggaugaggaucaaucagggag

SEQ ID NO: 606510 - RNA, 22 nt, Human
gcucacaguacagugcuggcuc

SEQ ID NO: 606511 - RNA, 22 nt, Human
ucuauucaggcagagugcagca

SEQ ID NO: 606512 - RNA, 22 nt, Human
ugggccucggagcacaggagac

SEQ ID NO: 606513 - RNA, 22 nt, Human
gagccccaggacagcucuaguu

SEQ ID NO: 606514 - RNA, 22 nt, Human
gcauguggugcugaggcugucg

SEQ ID NO: 606515 - RNA, 22 nt, Human
agccccuugugggcgcacagca

SEQ ID NO: 606516 - RNA, 22 nt, Human
cucccagacaugugccuccuug

SEQ ID NO: 606517 - RNA, 22 nt, Human
caguggcagagaacagagaccu

SEQ ID NO: 606518 - RNA, 22 nt, Human
ugcaagaaagguggggccaggc

SEQ ID NO: 606519 - RNA, 22 nt, Human
gcacacauucggauucuuaacc

SEQ ID NO: 606520 - RNA, 22 nt, Human
ucugccaggccugcuuccgggg

SEQ ID NO: 606521 - RNA, 18 nt, Human
aagccagagaccacugcc

SEQ ID NO: 606522 - RNA, 22 nt, Human
uucuucuucaagugcugcauuc

SEQ ID NO: 606523 - RNA, 22 nt, Human
uauguuaagugggauaaucaaa

SEQ ID NO: 606524 - RNA, 22 nt, Human
cagaggccuuucuacagugaua

SEQ ID NO: 606525 - RNA, 22 nt, Human
ucccagggcacucacccucccu

SEQ ID NO: 606526 - RNA, 22 nt, Human
gacaggggcuuugcaugcuuua

SEQ ID NO: 606527 - RNA, 22 nt, Human
aggagaggcucuaacucugugu

SEQ ID NO: 606528 - RNA, 22 nt, Human
gggcaggagagaacagucaugg

SEQ ID NO: 606529 - RNA, 23 nt, Human
aggcaaugcccugcugagaacuc

SEQ ID NO: 606530 - RNA, 22 nt, Human
uuuauaugaaagugaccagugg

SEQ ID NO: 606531 - RNA, 22 nt, Human
cuggcagcuucaggacacucgg

SEQ ID NO: 606532 - RNA, 16 nt, Human
cuuccucuucacuggc

SEQ ID NO: 606533 - RNA, 22 nt, Human
gugaagcagaguguggaagcaa

SEQ ID NO: 606534 - RNA, 22 nt, Human
uuucuucuaugugugauauuuu

SEQ ID NO: 606535 - RNA, 22 nt, Human
gcugauccuuuuaugucuagcu

SEQ ID NO: 606536 - RNA, 22 nt, Human
cuuguuuuggcuaguaugaugu

SEQ ID NO: 606537 - RNA, 22 nt, Human
cacagggccuugugugacugca

SEQ ID NO: 606538 - RNA, 22 nt, Human
cucuuuaacucccauucugucc

SEQ ID NO: 606539 - RNA, 22 nt, Human
cugugugugcuacaggcuucca

SEQ ID NO: 606540 - RNA, 22 nt, Human
cucaggauggaagccuacagga

SEQ ID NO: 606541 - RNA, 22 nt, Human
uccagagguauguagagaguau

SEQ ID NO: 606542 - RNA, 22 nt, Human
guauuuuauggcaugcaguggc

SEQ ID NO: 606543 - RNA, 22 nt, Human
ugagcagggacuuugaguguag

SEQ ID NO: 606544 - RNA, 22 nt, Human
uuuauugacccaaagcgagagu

SEQ ID NO: 606545 - RNA, 22 nt, Human
aggcagcccacaggacacagga

SEQ ID NO: 606546 - RNA, 22 nt, Human
cacaggagauugaucuauuggu

SEQ ID NO: 606547 - RNA, 22 nt, Human
aggggccaccaccaaggaaggu

SEQ ID NO: 606548 - RNA, 22 nt, Human
ucuucaaacugaaaauuuagaa

SEQ ID NO: 606549 - RNA, 22 nt, Human
gaugauuugaggauuucaugag

SEQ ID NO: 606550 - RNA, 22 nt, Human
aauguuuuacagaucccauuag

SEQ ID NO: 606551 - RNA, 18 nt, Human
ccuaagcuccagccccag

SEQ ID NO: 606552 - RNA, 19 nt, Human
gaggggaggaauugacaag

SEQ ID NO: 606553 - RNA, 22 nt, Human
auacaaagacaaaucucaaucu

SEQ ID NO: 606554 - RNA, 22 nt, Human
uuauuuccacaaugugguaggg

SEQ ID NO: 606555 - RNA, 22 nt, Human
augggaggguggaaaggcucug

SEQ ID NO: 606556 - RNA, 22 nt, Human
auguacaauucuccuugguagg

SEQ ID NO: 606557 - RNA, 22 nt, Human
aggaagccuggcauuaaaaagc

SEQ ID NO: 606558 - RNA, 22 nt, Human
acuguuaaguaugaaguaaggc

SEQ ID NO: 606559 - RNA, 22 nt, Human
ugaugggacugccagcugcuga

SEQ ID NO: 606560 - RNA, 22 nt, Human
cgaggccaccgugguuuccgag

SEQ ID NO: 606561 - RNA, 22 nt, Human
gaagucugcugcucaggaguuu

SEQ ID NO: 606562 - RNA, 22 nt, Human
gaccuccagcggcccugcagag

SEQ ID NO: 606563 - RNA, 18 nt, Human
uucagcagcagacacacu

SEQ ID NO: 606564 - RNA, 22 nt, Human
auggagagugaaagucucucua

SEQ ID NO: 606565 - RNA, 22 nt, Human
guuuuauuuccaugagagaccg

SEQ ID NO: 606566 - RNA, 22 nt, Human
guggucagaaaucucaguggca

SEQ ID NO: 606567 - RNA, 22 nt, Human
uugugcauauagaguuagaugg

SEQ ID NO: 606568 - RNA, 19 nt, Human
ucucacaguuuccuugccu

SEQ ID NO: 606569 - RNA, 22 nt, Human
cagagagaggccacugcuauua

SEQ ID NO: 606570 - RNA, 21 nt, Human
ucugcccuccaggagcucaua

SEQ ID NO: 606571 - RNA, 22 nt, Human
gguguuggaacauggugagauu

SEQ ID NO: 606572 - RNA, 22 nt, Human
acaaggcuguuggucacaaacc

SEQ ID NO: 606573 - RNA, 22 nt, Human
aagcugcccuguguuagaguuc

SEQ ID NO: 606574 - RNA, 22 nt, Human
ucugagcuccaugcaggaggcu

SEQ ID NO: 606575 - RNA, 22 nt, Human
cugucaucacaguugagcagcc

SEQ ID NO: 606576 - RNA, 22 nt, Human
agcuccacucccugccuguuuc

SEQ ID NO: 606577 - RNA, 22 nt, Human
ucuagaaacagguuucuagaaa

SEQ ID NO: 606578 - RNA, 22 nt, Human
cuguaugaaauugucauuuuua

SEQ ID NO: 606579 - RNA, 22 nt, Human
uuuaauauccaguggauacaaa

SEQ ID NO: 606580 - RNA, 22 nt, Human
cugcccugacugaccuuuugaa

SEQ ID NO: 606581 - RNA, 22 nt, Human
auggcagagggauugaacagcu

SEQ ID NO: 606582 - RNA, 22 nt, Human
ucagugucuugggcuugaaugc

SEQ ID NO: 606583 - RNA, 22 nt, Human
ggcugccuugacccuggcuccg

SEQ ID NO: 606584 - RNA, 22 nt, Human
ggugcaggaaucugcaauugaa

SEQ ID NO: 606585 - RNA, 22 nt, Human
aacaucuuaagauagaagggga

SEQ ID NO: 606586 - RNA, 20 nt, Human
uaagcacaugaacaguccuc

SEQ ID NO: 606587 - RNA, 22 nt, Human
cuuugugaugaggccuaagaca

SEQ ID NO: 606588 - RNA, 20 nt, Human
acagaaagagagaaugucag

SEQ ID NO: 606589 - RNA, 22 nt, Human
agaaacaacuuguuucucuugc

SEQ ID NO: 606590 - RNA, 22 nt, Human
uaguuaauucuuuaagaacaag

SEQ ID NO: 606591 - RNA, 21 nt, Human
ggcaagaaacacaaucaagua

SEQ ID NO: 606592 - RNA, 22 nt, Human
caugaggugauaaagcugggau

SEQ ID NO: 606593 - RNA, 22 nt, Human
gcugagcugggacaguccuggg

SEQ ID NO: 606594 - RNA, 22 nt, Human
ucuggcuuuccuggagcaagaa

SEQ ID NO: 606595 - RNA, 19 nt, Human
guccagccuuugggucuua

SEQ ID NO: 606596 - RNA, 22 nt, Human
ccauccugucuguggccucagg

SEQ ID NO: 606597 - RNA, 22 nt, Human
ccagggaggguccuguggcuuc

SEQ ID NO: 606598 - RNA, 22 nt, Human
uguggacucgcauggcugaggc

SEQ ID NO: 606599 - RNA, 22 nt, Human
ccuccccacagcccaggagacu

SEQ ID NO: 606600 - RNA, 22 nt, Human
cuggcuuccaugcuguaguggc

SEQ ID NO: 606601 - RNA, 22 nt, Human
caaggaauauuuaagaacguca

SEQ ID NO: 606602 - RNA, 22 nt, Human
augaaauuaaucaacacauaca

SEQ ID NO: 606603 - RNA, 22 nt, Human
guauacauacuucuagauuaaa

SEQ ID NO: 606604 - RNA, 22 nt, Human
uuuuccuucaccucuugagccu

SEQ ID NO: 606605 - RNA, 19 nt, Human
agcuccaggccuggaugcu

SEQ ID NO: 606606 - RNA, 22 nt, Human
uuuauuaaaacuguuggcucug

SEQ ID NO: 606607 - RNA, 20 nt, Human
acaguguuuuugaguagagc

SEQ ID NO: 606608 - RNA, 22 nt, Human
aauacuugaauuucaugucagg

SEQ ID NO: 606609 - RNA, 22 nt, Human
gaggccagcgcgcagcacuuuu

SEQ ID NO: 606610 - RNA, 22 nt, Human
uggcuucaaagguagcauacaa

SEQ ID NO: 606611 - RNA, 22 nt, Human
acaggcagguaauuuacauauu

SEQ ID NO: 606612 - RNA, 22 nt, Human
uaaagccacuucauucuagucu

SEQ ID NO: 606613 - RNA, 22 nt, Human
cccccagcucugcugggucccg

SEQ ID NO: 606614 - RNA, 22 nt, Human
uugggggguugaggaguagaua

SEQ ID NO: 606615 - RNA, 22 nt, Human
ggcugcucaaggacucugaucg

SEQ ID NO: 606616 - RNA, 22 nt, Human
caggccucaggggcucaggcug

SEQ ID NO: 606617 - RNA, 22 nt, Human
ugcuggcuguucuagggaggcc

SEQ ID NO: 606618 - RNA, 22 nt, Human
gagagcugcagccgagaggggg

SEQ ID NO: 606619 - RNA, 22 nt, Human
augaagcauuacaggaugacag

SEQ ID NO: 606620 - RNA, 22 nt, Human
auaagcuuccuguuagaaaccg

SEQ ID NO: 606621 - RNA, 22 nt, Human
cagugcuguuguaagcucauug

SEQ ID NO: 606622 - RNA, 22 nt, Human
uuuuauugcaauaaagugugua

SEQ ID NO: 606623 - RNA, 22 nt, Human
cuccccauggcaacaguuaugg

SEQ ID NO: 606624 - RNA, 22 nt, Human
auuauuucucacucacauaaua

SEQ ID NO: 606625 - RNA, 22 nt, Human
ugcggcagccaccgcguggccc

SEQ ID NO: 606626 - RNA, 22 nt, Human
acuguacauguaaacauuguca

SEQ ID NO: 606627 - RNA, 22 nt, Human
cccaggaguuggaggcuacggu

SEQ ID NO: 606628 - RNA, 22 nt, Human
cagccucuaagcacagccucuc

SEQ ID NO: 606629 - RNA, 22 nt, Human
uucaaacucuugcucugcuagu

SEQ ID NO: 606630 - RNA, 22 nt, Human
aggcugugggacaguuaggaga

SEQ ID NO: 606631 - RNA, 22 nt, Human
gcagggcucagccgcucccacc

SEQ ID NO: 606632 - RNA, 22 nt, Human
uuuaucaucuuguuuuuaaagc

SEQ ID NO: 606633 - RNA, 23 nt, Human
auaauaauuauggcagcaaagug

SEQ ID NO: 606634 - RNA, 22 nt, Human
ggccacauguggcugcucguau

SEQ ID NO: 606635 - RNA, 22 nt, Human
gugaggacugguaaggacugca

SEQ ID NO: 606636 - RNA, 18 nt, Human
auauucaagaagacagag

SEQ ID NO: 606637 - RNA, 22 nt, Human
agccagaggucaugagcacagg

SEQ ID NO: 606638 - RNA, 22 nt, Human
ucaguaaaugccuuucugugaa

SEQ ID NO: 606639 - RNA, 22 nt, Human
cuggcuuguuuuaagaauacaa

SEQ ID NO: 606640 - RNA, 22 nt, Human
agcucacaguguccuuccucaa

SEQ ID NO: 606641 - RNA, 22 nt, Human
ugugggccucagcaggacucca

SEQ ID NO: 606642 - RNA, 19 nt, Human
agaugucuauuugacuauc

SEQ ID NO: 606643 - RNA, 22 nt, Human
acauuaugagcccacuggugaa

SEQ ID NO: 606644 - RNA, 22 nt, Human
aguggcuguuccaggugaggac

SEQ ID NO: 606645 - RNA, 22 nt, Human
caggacagcucaacaccuccuc

SEQ ID NO: 606646 - RNA, 22 nt, Human
auccucaguguuucugacaucu

SEQ ID NO: 606647 - RNA, 22 nt, Human
gccugggauucccagaggggca

SEQ ID NO: 606648 - RNA, 22 nt, Human
augcugagauccucaggccaga

SEQ ID NO: 606649 - RNA, 22 nt, Human
ucuucaccaucaacagaaugaa

SEQ ID NO: 606650 - RNA, 22 nt, Human
ucccugcuugcucucagcccuu

SEQ ID NO: 606651 - RNA, 22 nt, Human
cugagcugacaucuuccucuuu

SEQ ID NO: 606652 - RNA, 20 nt, Human
uuauguguaccugugcuccc

SEQ ID NO: 606653 - RNA, 22 nt, Human
uuagagauacauuuguagcuug

SEQ ID NO: 606654 - RNA, 22 nt, Human
uccugggcagaaugggauggcu

SEQ ID NO: 606655 - RNA, 22 nt, Human
ugagcucuguuagggcuggaac

SEQ ID NO: 606656 - RNA, 22 nt, Human
cuucuucaucuguaaaacuugg

SEQ ID NO: 606657 - RNA, 22 nt, Human
uuucucuccccaaguggaauug

SEQ ID NO: 606658 - RNA, 22 nt, Human
agucagcagugaaagcacagcc

SEQ ID NO: 606659 - RNA, 22 nt, Human
ggaagccacccagcuuugauag

SEQ ID NO: 606660 - RNA, 22 nt, Human
auauacaggugguauguguaaa

SEQ ID NO: 606661 - RNA, 22 nt, Human
augucauugccaagaugcuaau

SEQ ID NO: 606662 - RNA, 22 nt, Human
ggugcccagagccaggaaugag

SEQ ID NO: 606663 - RNA, 22 nt, Human
gcugaggaaaggcuggaaggga

SEQ ID NO: 606664 - RNA, 23 nt, Human
uuuagcaugaagcagcuggagaa

SEQ ID NO: 606665 - RNA, 22 nt, Human
ugaggaagaacaagaauuuaga

SEQ ID NO: 606666 - RNA, 22 nt, Human
cuugacacugucacucaggcca

SEQ ID NO: 606667 - RNA, 22 nt, Human
agaguuuguacuuuacccugag

SEQ ID NO: 606668 - RNA, 22 nt, Human
cagugaaguuuaaaguguagau

SEQ ID NO: 606669 - RNA, 22 nt, Human
ggagggacccacucuagaggug

SEQ ID NO: 606670 - RNA, 22 nt, Human
uggccuugguccucuuugcaau

SEQ ID NO: 606671 - RNA, 22 nt, Human
ugaugaauuaguaacaaaugag

SEQ ID NO: 606672 - RNA, 22 nt, Human
gcuuuaaugcaauuucaccuca

SEQ ID NO: 606673 - RNA, 22 nt, Human
gccuucaguagugucagcugua

SEQ ID NO: 606674 - RNA, 22 nt, Human
ggcuucugagugcucugcuguu

SEQ ID NO: 606675 - RNA, 22 nt, Human
cuggaguuugcggggacagaga

SEQ ID NO: 606676 - RNA, 22 nt, Human
acagaggucaccuuuguaucuu

SEQ ID NO: 606677 - RNA, 22 nt, Human
ccagcuccagguagaugggcag

SEQ ID NO: 606678 - RNA, 22 nt, Human
gauuuuauauggcauacugugg

SEQ ID NO: 606679 - RNA, 22 nt, Human
gaaugauagagcugccuucgga

SEQ ID NO: 606680 - RNA, 22 nt, Human
agccagugggauuagagccucu

SEQ ID NO: 606681 - RNA, 22 nt, Human
uuucaguuagcugagacccagg

SEQ ID NO: 606682 - RNA, 22 nt, Human
uggagagucucugagccagggc

SEQ ID NO: 606683 - RNA, 23 nt, Human
uaucuacuuugcaauucaguacc

SEQ ID NO: 606684 - RNA, 20 nt, Human
ccucugccuuucuagucuga

SEQ ID NO: 606685 - RNA, 22 nt, Human
uguaggauuuucaccagaccuu

SEQ ID NO: 606686 - RNA, 22 nt, Human
gugcagcagggggaagacagug

SEQ ID NO: 606687 - RNA, 22 nt, Human
auuuccuaggguagaugucaca

SEQ ID NO: 606688 - RNA, 23 nt, Human
uggggcucuggcaggccugaggu

SEQ ID NO: 606689 - RNA, 22 nt, Human
uuccugccuacaugccuuaugc

SEQ ID NO: 606690 - RNA, 22 nt, Human
uacaguagaauuuuuaguaacu

SEQ ID NO: 606691 - RNA, 22 nt, Human
ccauguggugggaaggagaaug

SEQ ID NO: 606692 - RNA, 22 nt, Human
cucugugagggucuguacagaa

SEQ ID NO: 606693 - RNA, 22 nt, Human
gccugccuuugugaggaagcgg

SEQ ID NO: 606694 - RNA, 22 nt, Human
uugauuucuauucagauguaga

SEQ ID NO: 606695 - RNA, 22 nt, Human
uugccacaguagcaaaagguuc

SEQ ID NO: 606696 - RNA, 22 nt, Human
ugccaggcccugcgggguccca

SEQ ID NO: 606697 - RNA, 20 nt, Human
guucaugucucaaauagaaa

SEQ ID NO: 606698 - RNA, 21 nt, Human
gggcagcacgucauuccugug

SEQ ID NO: 606699 - RNA, 22 nt, Human
ucccagaacccugccagguccu

SEQ ID NO: 606700 - RNA, 22 nt, Human
caaauucaaugaacauguuuaa

SEQ ID NO: 606701 - RNA, 22 nt, Human
caaaaguaauuaugguuuuugc

SEQ ID NO: 606702 - RNA, 21 nt, Human
ucuccagugcuucugccucuu

SEQ ID NO: 606703 - RNA, 23 nt, Human
uuucaacaggcagagaagacuua

SEQ ID NO: 606704 - RNA, 22 nt, Human
uaucuauguggugaucuuauuu

SEQ ID NO: 606705 - RNA, 22 nt, Human
agaugguucagaauuauaaaga

SEQ ID NO: 606706 - RNA, 22 nt, Human
cacggccagggcugugggugcg

SEQ ID NO: 606707 - RNA, 22 nt, Human
uccuggguagccuguccaagau

SEQ ID NO: 606708 - RNA, 22 nt, Human
aggccucauugcccaccugugg

SEQ ID NO: 606709 - RNA, 22 nt, Human
uucuuuuaaaagagagcagaaa

SEQ ID NO: 606710 - RNA, 22 nt, Human
gacagcaggagaucaugauaga

SEQ ID NO: 606711 - RNA, 20 nt, Human
ccuccaggcacacccaugug

SEQ ID NO: 606712 - RNA, 22 nt, Human
ugccugggccuucccaccucug

SEQ ID NO: 606713 - RNA, 22 nt, Human
ccaggcagggcucaaggaaccu

SEQ ID NO: 606714 - RNA, 19 nt, Human
ugacagguuuuauguguuu

SEQ ID NO: 606715 - RNA, 22 nt, Human
cagggcauccgugcuccaugcu

SEQ ID NO: 606716 - RNA, 22 nt, Human
uagaaagcugaguaauacauuu

SEQ ID NO: 606717 - RNA, 22 nt, Human
uuuuuccaggguuagauguuua

SEQ ID NO: 606718 - RNA, 18 nt, Human
uucucagacuuuggaagu

SEQ ID NO: 606719 - RNA, 22 nt, Human
cugccugcuuaccaugcaucag

SEQ ID NO: 606720 - RNA, 22 nt, Human
cucuuaauguuuuauagauuga

SEQ ID NO: 606721 - RNA, 22 nt, Human
gaaagagaggggcugagaugca

SEQ ID NO: 606722 - RNA, 22 nt, Human
cccaguggcuguccccaugggc

SEQ ID NO: 606723 - RNA, 22 nt, Human
gaagccacuauagauauucuaa

SEQ ID NO: 606724 - RNA, 22 nt, Human
ccaccaggcacucacagggaag

SEQ ID NO: 606725 - RNA, 22 nt, Human
ccaugugggauuuuggugucug

SEQ ID NO: 606726 - RNA, 22 nt, Human
aaggcagcacagcaacugcuca

SEQ ID NO: 606727 - RNA, 22 nt, Human
uucaaaaagguauguucaaguc

SEQ ID NO: 606728 - RNA, 22 nt, Human
accuguguuuucccucaguuuc

SEQ ID NO: 606729 - RNA, 22 nt, Human
agagcuggguggacuuguaguu

SEQ ID NO: 606730 - RNA, 22 nt, Human
aucucuguaauuacaugauauu

SEQ ID NO: 606731 - RNA, 22 nt, Human
uagaggcuuucagcgguagguc

SEQ ID NO: 606732 - RNA, 21 nt, Human
aggugggagaccauguagguc

SEQ ID NO: 606733 - RNA, 22 nt, Human
ccucugccugcacaucauccug

SEQ ID NO: 606734 - RNA, 22 nt, Human
ucuauaaauuaugcagucucag

SEQ ID NO: 606735 - RNA, 22 nt, Human
caggaggagcauuagcgucuca

SEQ ID NO: 606736 - RNA, 22 nt, Human
uggcucucugggagguccuggc

SEQ ID NO: 606737 - RNA, 22 nt, Human
uagacagauuuaaaggaaugga

SEQ ID NO: 606738 - RNA, 22 nt, Human
ugaggaggucagagucuggcug

SEQ ID NO: 606739 - RNA, 22 nt, Human
aacaguuuaugauaaauucuua

SEQ ID NO: 606740 - RNA, 22 nt, Human
gaagaagguggcccagggguag

SEQ ID NO: 606741 - RNA, 22 nt, Human
gucuccaguguucaggugacug

SEQ ID NO: 606742 - RNA, 22 nt, Human
acagcucauuuguaaaacggag

SEQ ID NO: 606743 - RNA, 20 nt, Human
cugacagaaaauauuucauc

SEQ ID NO: 606744 - RNA, 22 nt, Human
ccaccugcugguuuugcucucc

SEQ ID NO: 606745 - RNA, 22 nt, Human
agugugcauuugcagaagaccc

SEQ ID NO: 606746 - RNA, 22 nt, Human
aagcccuuuucaagauacaaca

SEQ ID NO: 606747 - RNA, 22 nt, Human
agggaagcagcagccgccuguc

SEQ ID NO: 606748 - RNA, 22 nt, Human
cccugugccuaguuggccuaaa

SEQ ID NO: 606749 - RNA, 22 nt, Human
uuggccaacauggugaaacccc

SEQ ID NO: 606750 - RNA, 22 nt, Human
cugggcugcgguucucugaagc

SEQ ID NO: 606751 - RNA, 22 nt, Human
agcugagggcaggaugggguga

SEQ ID NO: 606752 - RNA, 22 nt, Human
accugccucuaagcagcaggug

SEQ ID NO: 606753 - RNA, 22 nt, Human
cuggguggcuguccagccagcc

SEQ ID NO: 606754 - RNA, 22 nt, Human
cuucagagcuuguuaaaacugu

SEQ ID NO: 606755 - RNA, 22 nt, Human
acaguucuguccuagacuucgu

SEQ ID NO: 606756 - RNA, 22 nt, Human
gaagaauauucuugaucuuaga

SEQ ID NO: 606757 - RNA, 22 nt, Human
ucaccacugaggccacguggcu

SEQ ID NO: 606758 - RNA, 22 nt, Human
ggguuaaagcaggaagcaucuu

SEQ ID NO: 606759 - RNA, 22 nt, Human
acagcacaggaguugaaugggc

SEQ ID NO: 606760 - RNA, 22 nt, Human
cuguaugaaauuaaguaaacag

SEQ ID NO: 606761 - RNA, 20 nt, Human
agcggcagcuuccugcuucg

SEQ ID NO: 606762 - RNA, 22 nt, Human
uggcugaggcacagcugccgcc

SEQ ID NO: 606763 - RNA, 22 nt, Human
aaauggcagugucauaaggcuc

SEQ ID NO: 606764 - RNA, 22 nt, Human
caaucuauagagcuuuagacua

SEQ ID NO: 606765 - RNA, 22 nt, Human
augagguaauagggcagugggg

SEQ ID NO: 606766 - RNA, 22 nt, Human
caaggagaaaacggcuucugaa

SEQ ID NO: 606767 - RNA, 22 nt, Human
cagcaagaaucagacaaccuca

SEQ ID NO: 606768 - RNA, 22 nt, Human
ucaguauaauugcuggcacuga

SEQ ID NO: 606769 - RNA, 22 nt, Human
acaagcaugggcuuugacauca

SEQ ID NO: 606770 - RNA, 22 nt, Human
gacccuguuucuacaaauaauu

SEQ ID NO: 606771 - RNA, 22 nt, Human
ggagaaggaauauuggaguagg

SEQ ID NO: 606772 - RNA, 23 nt, Human
uccagcagagccuuccaggaggg

SEQ ID NO: 606773 - RNA, 22 nt, Human
acaggccagccugggguaaggu

SEQ ID NO: 606774 - RNA, 22 nt, Human
ugugagcuuaggacagggcuau

SEQ ID NO: 606775 - RNA, 22 nt, Human
aaauuuaagaagugugugcgug

SEQ ID NO: 606776 - RNA, 22 nt, Human
aaaugucaaggugauagaugca

SEQ ID NO: 606777 - RNA, 22 nt, Human
uuucuauuguaagucuccuaua

SEQ ID NO: 606778 - RNA, 18 nt, Human
gggcauggaugcagcauc

SEQ ID NO: 606779 - RNA, 22 nt, Human
ccagugggaacacuggcauugc

SEQ ID NO: 606780 - RNA, 22 nt, Human
uagaacuuauuagaaaggcuca

SEQ ID NO: 606781 - RNA, 18 nt, Human
cuuauuguuuaaauggcc

SEQ ID NO: 606782 - RNA, 20 nt, Human
aagcuucacuucauuugauc

SEQ ID NO: 606783 - RNA, 22 nt, Human
cagccagccucucaaccaugca

SEQ ID NO: 606784 - RNA, 22 nt, Human
uuugcuauuuuucugugcagcu

SEQ ID NO: 606785 - RNA, 22 nt, Human
cucugguucagggcucccuggc

SEQ ID NO: 606786 - RNA, 22 nt, Human
ggccugagaaccauggggccaa

SEQ ID NO: 606787 - RNA, 22 nt, Human
ugaugaggaccuggucucugcu

SEQ ID NO: 606788 - RNA, 22 nt, Human
gggccuggggugacguaccccu

SEQ ID NO: 606789 - RNA, 22 nt, Human
gcugccuucccaggccuuugcu

SEQ ID NO: 606790 - RNA, 22 nt, Human
guaaagaaggcaaccugguuau

SEQ ID NO: 606791 - RNA, 22 nt, Human
agcuucuuugugggcuccagaa

SEQ ID NO: 606792 - RNA, 22 nt, Human
gaccugccugagcugccucugc

SEQ ID NO: 606793 - RNA, 23 nt, Human
cuacaagagcaagcauggacaag

SEQ ID NO: 606794 - RNA, 22 nt, Human
ucccagggcuuuucucaugcuu

SEQ ID NO: 606795 - RNA, 22 nt, Human
ugucagugucuaugaagaauuu

SEQ ID NO: 606796 - RNA, 22 nt, Human
aaauauagugacacuuauaguc

SEQ ID NO: 606797 - RNA, 22 nt, Human
aaaucugagaaauauuguccag

SEQ ID NO: 606798 - RNA, 22 nt, Human
uaguugacuucucuaucccagc

SEQ ID NO: 606799 - RNA, 22 nt, Human
ggggccuguagagcuucaggga

SEQ ID NO: 606800 - RNA, 22 nt, Human
cgggcgcacuccgggcagcugu

SEQ ID NO: 606801 - RNA, 22 nt, Human
gucuggagccccagucaaugag

SEQ ID NO: 606802 - RNA, 22 nt, Human
agaguuuaccacuauuuuuggu

SEQ ID NO: 606803 - RNA, 20 nt, Human
ccucuguguccugugucaua

SEQ ID NO: 606804 - RNA, 22 nt, Human
ugcagggcaguuuguuucggca

SEQ ID NO: 606805 - RNA, 22 nt, Human
uagguuuacugaauuaguggaa

SEQ ID NO: 606806 - RNA, 22 nt, Human
cugagguagccauggcccaagu

SEQ ID NO: 606807 - RNA, 22 nt, Human
auggaaagcuaagccauuuacc

SEQ ID NO: 606808 - RNA, 22 nt, Human
cagccacucggccauaaaggcu

SEQ ID NO: 606809 - RNA, 22 nt, Human
agaaaacuggagccugggguug

SEQ ID NO: 606810 - RNA, 22 nt, Human
ugagggccgaggagcugugggu

SEQ ID NO: 606811 - RNA, 22 nt, Human
cccuccagugucccagugggga

SEQ ID NO: 606812 - RNA, 22 nt, Human
guggugcaggaagcaucuggcu

SEQ ID NO: 606813 - RNA, 22 nt, Human
ucccagagauuuccucuccuuc

SEQ ID NO: 606814 - RNA, 22 nt, Human
guguccagagaaacucacagcu

SEQ ID NO: 606815 - RNA, 22 nt, Human
ucaaaaucaaagauacuugaaa

SEQ ID NO: 606816 - RNA, 22 nt, Human
uuugcauugcauuaaguauucu

SEQ ID NO: 606817 - RNA, 22 nt, Human
ucaguucuuuauuucacaguga

SEQ ID NO: 606818 - RNA, 22 nt, Human
agccuggccugggcaggcacau

SEQ ID NO: 606819 - RNA, 19 nt, Human
uuuucccacccuuuagaau

SEQ ID NO: 606820 - RNA, 22 nt, Human
aacaugaaaagcccagagaggu

SEQ ID NO: 606821 - RNA, 22 nt, Human
gccuuauuaccugcacuuugaa

SEQ ID NO: 606822 - RNA, 22 nt, Human
uggaggccuagguugaugugug

SEQ ID NO: 606823 - RNA, 22 nt, Human
cugauauucuuugagcugcuaa

SEQ ID NO: 606824 - RNA, 22 nt, Human
auuuaauuuacauuugacagag

SEQ ID NO: 606825 - RNA, 22 nt, Human
acaggcugaggaugauugcauc

SEQ ID NO: 606826 - RNA, 22 nt, Human
cuuauauuugucaacuuuacaa

SEQ ID NO: 606827 - RNA, 22 nt, Human
ucaggcaggcucagaggaaaac

SEQ ID NO: 606828 - RNA, 19 nt, Human
acagcagguguggggauaa

SEQ ID NO: 606829 - RNA, 22 nt, Human
gcaggccuaagagaaggcauug

SEQ ID NO: 606830 - RNA, 22 nt, Human
uggggggcacuucagcacaaug

SEQ ID NO: 606831 - RNA, 17 nt, Human
uguucucuucagaaauc

SEQ ID NO: 606832 - RNA, 22 nt, Human
gcucugggugaacuuggagcaa

SEQ ID NO: 606833 - RNA, 22 nt, Human
ugggagcaagcuggugcuggag

SEQ ID NO: 606834 - RNA, 22 nt, Human
auacacagcuacauugaacaau

SEQ ID NO: 606835 - RNA, 20 nt, Human
gcagccucaacaggcacagc

SEQ ID NO: 606836 - RNA, 22 nt, Human
aacagauauaggcagaacuuug

SEQ ID NO: 606837 - RNA, 22 nt, Human
gcauggcaaauaucgagggcag

SEQ ID NO: 606838 - RNA, 22 nt, Human
aucauucuaguccuuauggucu

SEQ ID NO: 606839 - RNA, 22 nt, Human
auggaacaucagguuaagaaau

SEQ ID NO: 606840 - RNA, 22 nt, Human
cucccucacaaagcauucucuu

SEQ ID NO: 606841 - RNA, 22 nt, Human
acaagaagagcauuugcagggu

SEQ ID NO: 606842 - RNA, 22 nt, Human
ggagucugcucccagacaugau

SEQ ID NO: 606843 - RNA, 22 nt, Human
agggaggaguccucaaagucau

SEQ ID NO: 606844 - RNA, 22 nt, Human
gaggcauggccugaggcuagga

SEQ ID NO: 606845 - RNA, 22 nt, Human
aaguuucauguggagguagacu

SEQ ID NO: 606846 - RNA, 21 nt, Human
uuugaaagugggugauucuuu

SEQ ID NO: 606847 - RNA, 22 nt, Human
acuuguuuggagccagcuguaa

SEQ ID NO: 606848 - RNA, 22 nt, Human
acuuccuguguuggucuugcug

SEQ ID NO: 606849 - RNA, 22 nt, Human
uaauuguaaaguaguaguacag

SEQ ID NO: 606850 - RNA, 22 nt, Human
agcuagaauguuccuuuucauu

SEQ ID NO: 606851 - RNA, 22 nt, Human
agccugucugucuccaaagcug

SEQ ID NO: 606852 - RNA, 22 nt, Human
gcccucucuucugcagccucca

SEQ ID NO: 606853 - RNA, 22 nt, Human
cuugaauugggggaagaucacu

SEQ ID NO: 606854 - RNA, 22 nt, Human
agugcugagugauugcaaagga

SEQ ID NO: 606855 - RNA, 22 nt, Human
acagcuccuacugaagccaugu

SEQ ID NO: 606856 - RNA, 22 nt, Human
cagacagaccugcaagggcaca

SEQ ID NO: 606857 - RNA, 19 nt, Human
gccuugaagcaacucuugu

SEQ ID NO: 606858 - RNA, 22 nt, Human
uacuuuauucaggaaggcuggu

SEQ ID NO: 606859 - RNA, 22 nt, Human
ucaguccacuaagacccuuguu

SEQ ID NO: 606860 - RNA, 22 nt, Human
cccugcucuucugacucaagcu

SEQ ID NO: 606861 - RNA, 22 nt, Human
aagaugcagcuuuacaauaagg

SEQ ID NO: 606862 - RNA, 19 nt, Human
agccagggugagaaggagc

SEQ ID NO: 606863 - RNA, 22 nt, Human
auguguguaugugccuauaucu

SEQ ID NO: 606864 - RNA, 22 nt, Human
uacauucuauaucuguuacauc

SEQ ID NO: 606865 - RNA, 22 nt, Human
gggagcagccugccucccaccu

SEQ ID NO: 606866 - RNA, 22 nt, Human
gaggaagaaagcauaggugggg

SEQ ID NO: 606867 - RNA, 22 nt, Human
cccaggaacuccagagcuccuc

SEQ ID NO: 606868 - RNA, 22 nt, Human
ucacuuuaccucauucaggcag

SEQ ID NO: 606869 - RNA, 22 nt, Human
uaaguuaacccuguuaauagau

SEQ ID NO: 606870 - RNA, 22 nt, Human
uugaggcagguccggguccuuc

SEQ ID NO: 606871 - RNA, 22 nt, Human
ucaauucuagagccuuacauug

SEQ ID NO: 606872 - RNA, 22 nt, Human
gaauacauuggaaaucagaaua

SEQ ID NO: 606873 - RNA, 22 nt, Human
ugagcuccuggucacaauuauc

SEQ ID NO: 606874 - RNA, 22 nt, Human
ggcucuccacuauggaugagaa

SEQ ID NO: 606875 - RNA, 22 nt, Human
ccagggucuuggagaggagugc

SEQ ID NO: 606876 - RNA, 22 nt, Human
agccagcucccuccccugcagg

SEQ ID NO: 606877 - RNA, 19 nt, Human
ucacaagagagauaaagug

SEQ ID NO: 606878 - RNA, 22 nt, Human
uuacaugaugauuucauaaaca

SEQ ID NO: 606879 - RNA, 22 nt, Human
augcaggguucugggcuagaga

SEQ ID NO: 606880 - RNA, 22 nt, Human
cuuccucuguggccagagugua

SEQ ID NO: 606881 - RNA, 22 nt, Human
uccaggcaguuuuccagguugu

SEQ ID NO: 606882 - RNA, 22 nt, Human
auuccucauuuguugagaacca

SEQ ID NO: 606883 - RNA, 22 nt, Human
ggcuucaguggccagagaugau

SEQ ID NO: 606884 - RNA, 22 nt, Human
ggagauggcaagaaguuauuag

SEQ ID NO: 606885 - RNA, 22 nt, Human
uggagagcagggcuggaguuca

SEQ ID NO: 606886 - RNA, 22 nt, Human
uaccauuuacuugaaaauaaaa

SEQ ID NO: 606887 - RNA, 22 nt, Human
uaauacacacucucauuccuaa

SEQ ID NO: 606888 - RNA, 22 nt, Human
cugugcccagcucccugacugc

SEQ ID NO: 606889 - RNA, 22 nt, Human
ugguuacacagcauguggacuu

SEQ ID NO: 606890 - RNA, 22 nt, Human
caggcaggugcagauuccucuu

SEQ ID NO: 606891 - RNA, 23 nt, Human
aagcacagaaugguuuaggaguu

SEQ ID NO: 606892 - RNA, 22 nt, Human
cucaguuuuugcugucugguuc

SEQ ID NO: 606893 - RNA, 22 nt, Human
aauaauguaggaugauaaauga

SEQ ID NO: 606894 - RNA, 18 nt, Human
cacaggcucccagugagg

SEQ ID NO: 606895 - RNA, 22 nt, Human
ugcugaggcaguccuaacagga

SEQ ID NO: 606896 - RNA, 22 nt, Human
cagcucugugcaggccugggga

SEQ ID NO: 606897 - RNA, 20 nt, Human
uacugcaggaaucagcuagc

SEQ ID NO: 606898 - RNA, 22 nt, Human
ggucugagugggcaggggccgg

SEQ ID NO: 606899 - RNA, 22 nt, Human
cagcccuugaugauaauuuauc

SEQ ID NO: 606900 - RNA, 22 nt, Human
aauucucuccaggguaacauca

SEQ ID NO: 606901 - RNA, 22 nt, Human
cuucuuauuaauccuucucugu

SEQ ID NO: 606902 - RNA, 22 nt, Human
ccagcugcauccuauucacugc

SEQ ID NO: 606903 - RNA, 22 nt, Human
aaugaaugaaccacauauaaca

SEQ ID NO: 606904 - RNA, 22 nt, Human
cacagcuucugagugaggauuu

SEQ ID NO: 606905 - RNA, 23 nt, Human
gcacugggcucucagcaaggugu

SEQ ID NO: 606906 - RNA, 22 nt, Human
ucucuucacaugcuugcuccaa

SEQ ID NO: 606907 - RNA, 22 nt, Human
agaagcuugaaggagcagugac

SEQ ID NO: 606908 - RNA, 22 nt, Human
aacagaauaucaaaagauuaug

SEQ ID NO: 606909 - RNA, 22 nt, Human
aggcauggauguagcagugacc

SEQ ID NO: 606910 - RNA, 22 nt, Human
uacacacaugcauuugccuuau

SEQ ID NO: 606911 - RNA, 22 nt, Human
ucacugaagacugggcucuaaa

SEQ ID NO: 606912 - RNA, 22 nt, Human
uaauacuuuugccuuguauuca

SEQ ID NO: 606913 - RNA, 22 nt, Human
acagugcugugcagucugcccu

SEQ ID NO: 606914 - RNA, 21 nt, Human
uuguguuuccccagucacuuu

SEQ ID NO: 606915 - RNA, 22 nt, Human
uggcugcaguucacaggagcaa

SEQ ID NO: 606916 - RNA, 16 nt, Human
gcaggcagaucacaug

SEQ ID NO: 606917 - RNA, 22 nt, Human
aaggccaggccuagcacggagg

SEQ ID NO: 606918 - RNA, 22 nt, Human
aggccuggcaugagaccugaga

SEQ ID NO: 606919 - RNA, 22 nt, Human
cuauggaagggaugcaaagaaa

SEQ ID NO: 606920 - RNA, 22 nt, Human
ucauucuggaugacuuucuaga

SEQ ID NO: 606921 - RNA, 22 nt, Human
uaggcugagcuaagagagcuua

SEQ ID NO: 606922 - RNA, 22 nt, Human
caagauucagagucuucuaacc

SEQ ID NO: 606923 - RNA, 22 nt, Human
ugagacaggagaggccccuccu

SEQ ID NO: 606924 - RNA, 22 nt, Human
acagucuuuagaguauuguccu

SEQ ID NO: 606925 - RNA, 22 nt, Human
cccagcugauuuuugcagagau

SEQ ID NO: 606926 - RNA, 22 nt, Human
ugaaucauggauaaauagcuua

SEQ ID NO: 606927 - RNA, 22 nt, Human
guggccuggaaaggcuggucug

SEQ ID NO: 606928 - RNA, 22 nt, Human
ccagggcuugguggcuuguauc

SEQ ID NO: 606929 - RNA, 22 nt, Human
uagaaacaugagagaaacucuu

SEQ ID NO: 606930 - RNA, 22 nt, Human
aggcggcugguguccugcaggu

SEQ ID NO: 606931 - RNA, 22 nt, Human
caagauauugauuuccagcuga

SEQ ID NO: 606932 - RNA, 22 nt, Human
ucucugaagaaucgaugauucu

SEQ ID NO: 606933 - RNA, 20 nt, Human
guggccuguccuguuguggg

SEQ ID NO: 606934 - RNA, 20 nt, Human
ccugccuguguuugugauga

SEQ ID NO: 606935 - RNA, 22 nt, Human
uuuauuccaugugucuaugacc

SEQ ID NO: 606936 - RNA, 22 nt, Human
uagcauuagagauagaaauagu

SEQ ID NO: 606937 - RNA, 22 nt, Human
gccucaggccuauagcugcugu

SEQ ID NO: 606938 - RNA, 22 nt, Human
gacaggaauguguggaugcgga

SEQ ID NO: 606939 - RNA, 22 nt, Human
uuacacaugcucacuuauuugu

SEQ ID NO: 606940 - RNA, 22 nt, Human
aauagcauccuguaucucuucc

SEQ ID NO: 606941 - RNA, 22 nt, Human
cagaaaaggguguuuguucagg

SEQ ID NO: 606942 - RNA, 19 nt, Human
ugcuuugcucuuggacuca

SEQ ID NO: 606943 - RNA, 22 nt, Human
cgcaacucagcaacuuaacugc

SEQ ID NO: 606944 - RNA, 22 nt, Human
cuuuauguccaccagacugcaa

SEQ ID NO: 606945 - RNA, 22 nt, Human
uggcuuccgccgcgggccucgg

SEQ ID NO: 606946 - RNA, 22 nt, Human
ggacacagccacuuaggguacc

SEQ ID NO: 606947 - RNA, 20 nt, Human
cagcacagagcuuggcucua

SEQ ID NO: 606948 - RNA, 22 nt, Human
ggcuguagguuggugcuggaca

SEQ ID NO: 606949 - RNA, 22 nt, Human
uuaauuguuggaaauagauuau

SEQ ID NO: 606950 - RNA, 22 nt, Human
ugucccauggauaccaggcuau

SEQ ID NO: 606951 - RNA, 22 nt, Human
auccaaaucaugucagaagaac

SEQ ID NO: 606952 - RNA, 22 nt, Human
uuggggcucugaaaaagaugua

SEQ ID NO: 606953 - RNA, 21 nt, Human
ggcccugguuacgccuccucu

SEQ ID NO: 606954 - RNA, 22 nt, Human
gcaaacuggcaaaccugucugu

SEQ ID NO: 606955 - RNA, 22 nt, Human
agcuguguaagucauguaggug

SEQ ID NO: 606956 - RNA, 22 nt, Human
acagccagugacuggacaagcu

SEQ ID NO: 606957 - RNA, 22 nt, Human
cugcuuucugcaccccaggucg

SEQ ID NO: 606958 - RNA, 21 nt, Human
agacagaacaacugcucucca

SEQ ID NO: 606959 - RNA, 22 nt, Human
ugcccuggggucuggagcagca

SEQ ID NO: 606960 - RNA, 20 nt, Human
auaauuuacccugcaccacu

SEQ ID NO: 606961 - RNA, 22 nt, Human
aaggccaggaaauuaucccuau

SEQ ID NO: 606962 - RNA, 20 nt, Human
ccuggagccuggaaggaguc

SEQ ID NO: 606963 - RNA, 22 nt, Human
caucacagguccugaugacauu

SEQ ID NO: 606964 - RNA, 22 nt, Human
acagugcuaucaauagcuagaa

SEQ ID NO: 606965 - RNA, 22 nt, Human
augcagacaugggagaguugag

SEQ ID NO: 606966 - RNA, 22 nt, Human
caguggaagcuggcugugaaga

SEQ ID NO: 606967 - RNA, 22 nt, Human
guguuugcuggagcucuggguc

SEQ ID NO: 606968 - RNA, 22 nt, Human
ggcgcucaguguugccccagag

SEQ ID NO: 606969 - RNA, 21 nt, Human
caguuacacaaguguuaccag

SEQ ID NO: 606970 - RNA, 22 nt, Human
cccuucagugcuaggcugccug

SEQ ID NO: 606971 - RNA, 22 nt, Human
cugggcuguucugccccugggu

SEQ ID NO: 606972 - RNA, 22 nt, Human
aagcaggaaggagcccagggca

SEQ ID NO: 606973 - RNA, 21 nt, Human
ucauuucucuauguauuucac

SEQ ID NO: 606974 - RNA, 22 nt, Human
guccuguguguugccggcugaa

SEQ ID NO: 606975 - RNA, 22 nt, Human
agcuccuccugugccaggccag

SEQ ID NO: 606976 - RNA, 22 nt, Human
agauguggauccuaggguagaa

SEQ ID NO: 606977 - RNA, 23 nt, Human
ugaaagcaaugggucuauaguau

SEQ ID NO: 606978 - RNA, 22 nt, Human
uuggaagggauauuggcauaug

SEQ ID NO: 606979 - RNA, 22 nt, Human
guuccaaauuuggaucuuuagg

SEQ ID NO: 606980 - RNA, 22 nt, Human
gcaugcugagcccacgccuggg

SEQ ID NO: 606981 - RNA, 22 nt, Human
agcauaaaggucaacguuuuag

SEQ ID NO: 606982 - RNA, 22 nt, Human
agagaagggccuguauguaauc

SEQ ID NO: 606983 - RNA, 22 nt, Human
ccucacuggccagccaggggug

SEQ ID NO: 606984 - RNA, 22 nt, Human
acuugucuggcagaucaugcaa

SEQ ID NO: 606985 - RNA, 22 nt, Human
gcagggcuccacuguggccaag

SEQ ID NO: 606986 - RNA, 22 nt, Human
ggcaggagggcggacaaugacc

SEQ ID NO: 606987 - RNA, 23 nt, Human
uuaaaauguggucucucccuagu

SEQ ID NO: 606988 - RNA, 22 nt, Human
ccacagaggacaacugccuggc

SEQ ID NO: 606989 - RNA, 22 nt, Human
uggccuggggaccugugagacc

SEQ ID NO: 606990 - RNA, 22 nt, Human
agcugaagcagucaguucagcu

SEQ ID NO: 606991 - RNA, 22 nt, Human
uugaaucauuacaauagauaag

SEQ ID NO: 606992 - RNA, 22 nt, Human
auuugguuucaggauucucagg

SEQ ID NO: 606993 - RNA, 22 nt, Human
uccugguggucugugcuucuuc

SEQ ID NO: 606994 - RNA, 22 nt, Human
aauagcuuaguccugauucugu

SEQ ID NO: 606995 - RNA, 22 nt, Human
agagacaggauaucugcucaug

SEQ ID NO: 606996 - RNA, 22 nt, Human
gaaaguuugccucucucuugag

SEQ ID NO: 606997 - RNA, 22 nt, Human
agcuaggggaccaagguggccc

SEQ ID NO: 606998 - RNA, 22 nt, Human
uuugggcugguuugccaugccc

SEQ ID NO: 606999 - RNA, 22 nt, Human
ggcagugaugucaaacagugaa

SEQ ID NO: 607000 - RNA, 22 nt, Human
ccugcaccucugugcuuggaac

SEQ ID NO: 607001 - RNA, 22 nt, Human
agggccagcuagagcccucgcc

SEQ ID NO: 607002 - RNA, 22 nt, Human
ccagcuucucucugaugcagcu

SEQ ID NO: 607003 - RNA, 22 nt, Human
cuggccuuucgugagagcuggg

SEQ ID NO: 607004 - RNA, 22 nt, Human
uucugaaauucgacuauccaau

SEQ ID NO: 607005 - RNA, 22 nt, Human
uccuucuguagucccugucccu

SEQ ID NO: 607006 - RNA, 22 nt, Human
gauuauggagaagaacaaugaa

SEQ ID NO: 607007 - RNA, 22 nt, Human
ggagcuguuggcagcuaucuug

SEQ ID NO: 607008 - RNA, 22 nt, Human
aagcacugaggaaaaauuugau

SEQ ID NO: 607009 - RNA, 22 nt, Human
aaaucucaggccucuauuuacu

SEQ ID NO: 607010 - RNA, 22 nt, Human
uaggcagauguuaacaggaaaa

SEQ ID NO: 607011 - RNA, 22 nt, Human
agcagcuggugagcaagcucag

SEQ ID NO: 607012 - RNA, 22 nt, Human
uccugggcccaggcugccaggg

SEQ ID NO: 607013 - RNA, 22 nt, Human
uggguccaguguccuggcuaug

SEQ ID NO: 607014 - RNA, 22 nt, Human
cauauuuuaguugcugaacagc

SEQ ID NO: 607015 - RNA, 22 nt, Human
ugucuucauuccccaugaaguc

SEQ ID NO: 607016 - RNA, 22 nt, Human
aauaaucucccuuuuuguaugu

SEQ ID NO: 607017 - RNA, 22 nt, Human
ucagggcaucaucaugaauaua

SEQ ID NO: 607018 - RNA, 22 nt, Human
uuggcucaugcuguuuugugca

SEQ ID NO: 607019 - RNA, 22 nt, Human
ugggacagagugagcuuuggcc

SEQ ID NO: 607020 - RNA, 22 nt, Human
gcugcagccaaauucauuguca

SEQ ID NO: 607021 - RNA, 22 nt, Human
aauuggacugugcugcucaaaa

SEQ ID NO: 607022 - RNA, 21 nt, Human
uccauaagagaccaucuccua

SEQ ID NO: 607023 - RNA, 22 nt, Human
aagccacagaucguucugucac

SEQ ID NO: 607024 - RNA, 22 nt, Human
uccccacacagauacagaguag

SEQ ID NO: 607025 - RNA, 22 nt, Human
cugccuccugccgugcagcuuc

SEQ ID NO: 607026 - RNA, 22 nt, Human
acaaagugcugacauuacaggc

SEQ ID NO: 607027 - RNA, 20 nt, Human
acuguguaaacaugauucau

SEQ ID NO: 607028 - RNA, 22 nt, Human
gagcuuugagauucuuauggua

SEQ ID NO: 607029 - RNA, 22 nt, Human
augcaugcuucuuauaguacuu

SEQ ID NO: 607030 - RNA, 22 nt, Human
caggaaacauucccauaacaca

SEQ ID NO: 607031 - RNA, 22 nt, Human
cugggccacuuccucaggggaa

SEQ ID NO: 607032 - RNA, 22 nt, Human
cugagggcuggagcugaggccu

SEQ ID NO: 607033 - RNA, 22 nt, Human
ucaaaguuuguggcaauuuauu

SEQ ID NO: 607034 - RNA, 22 nt, Human
gggucaggcucagcagggcagc

SEQ ID NO: 607035 - RNA, 22 nt, Human
ugucauggggaaaauaacagac

SEQ ID NO: 607036 - RNA, 22 nt, Human
uggagacugauaaaggcuauug

SEQ ID NO: 607037 - RNA, 22 nt, Human
ugugggcucuaauggcagcaga

SEQ ID NO: 607038 - RNA, 22 nt, Human
accagcuggcccaugagcacgu

SEQ ID NO: 607039 - RNA, 22 nt, Human
ggcccagguccagcgaguaccu

SEQ ID NO: 607040 - RNA, 22 nt, Human
uuuacaggguucaagaaugaaa

SEQ ID NO: 607041 - RNA, 22 nt, Human
aagcaggcgagggccuggagca

SEQ ID NO: 607042 - RNA, 22 nt, Human
uguuaaaaauucagcucuagau

SEQ ID NO: 607043 - RNA, 22 nt, Human
gaggagggagaauuaggcuuaa

SEQ ID NO: 607044 - RNA, 22 nt, Human
ugcagggccuugggaugugucc

SEQ ID NO: 607045 - RNA, 22 nt, Human
ucucaugaaaggucucuccugg

SEQ ID NO: 607046 - RNA, 22 nt, Human
gaacauucuuggaggaaauaac

SEQ ID NO: 607047 - RNA, 22 nt, Human
gaucuggaaucugaaggcugag

SEQ ID NO: 607048 - RNA, 22 nt, Human
agaaucugcauuuuaacaagcu

SEQ ID NO: 607049 - RNA, 22 nt, Human
agugcuucuuaaaccuuucuac

SEQ ID NO: 607050 - RNA, 23 nt, Human
augaggucagccauaagacggaa

SEQ ID NO: 607051 - RNA, 22 nt, Human
ccugcaggggagagacuucuag

SEQ ID NO: 607052 - RNA, 22 nt, Human
uaacacaugguucugucaggaa

SEQ ID NO: 607053 - RNA, 22 nt, Human
aagagagaccaugggggacagg

SEQ ID NO: 607054 - RNA, 20 nt, Human
ggugcagguaacgcugugcu

SEQ ID NO: 607055 - RNA, 22 nt, Human
cacaggagaaaggggaagcucg

SEQ ID NO: 607056 - RNA, 22 nt, Human
uaggacaggugaggggcugugg

SEQ ID NO: 607057 - RNA, 22 nt, Human
ccaggagagcauugcacagagg

SEQ ID NO: 607058 - RNA, 22 nt, Human
uaccugucaaaagacauggaga

SEQ ID NO: 607059 - RNA, 22 nt, Human
ccagccccuauccucgcuccac

SEQ ID NO: 607060 - RNA, 22 nt, Human
cuccugggcucauaucauucag

SEQ ID NO: 607061 - RNA, 22 nt, Human
agaugugggcaauggaauggag

SEQ ID NO: 607062 - RNA, 22 nt, Human
auguuuucuccauguuaugcuu

SEQ ID NO: 607063 - RNA, 22 nt, Human
auuaaggagggcugggcaugau

SEQ ID NO: 607064 - RNA, 22 nt, Human
agaauacaucuagugcugcaug

SEQ ID NO: 607065 - RNA, 22 nt, Human
agccccucuguggcucugccuc

SEQ ID NO: 607066 - RNA, 23 nt, Human
agucaguguaaguuuggaaugca

SEQ ID NO: 607067 - RNA, 22 nt, Human
uguguguguccucauuugcaga

SEQ ID NO: 607068 - RNA, 22 nt, Human
caggugaacucaguuuuguauu

SEQ ID NO: 607069 - RNA, 22 nt, Human
uuacauucaauuucuagaggua

SEQ ID NO: 607070 - RNA, 22 nt, Human
ugggcuccagcaccugugcucu

SEQ ID NO: 607071 - RNA, 22 nt, Human
cccaggagaugcacuccauugg

SEQ ID NO: 607072 - RNA, 22 nt, Human
cugaggucagaguuuagucugg

SEQ ID NO: 607073 - RNA, 22 nt, Human
ggagcugugggacgcuguccca

SEQ ID NO: 607074 - RNA, 22 nt, Human
uguaugugcuugagaagguggg

SEQ ID NO: 607075 - RNA, 22 nt, Human
aagcucugcucagcagacuagg

SEQ ID NO: 607076 - RNA, 22 nt, Human
cagagguagcaugcuguggcuu

SEQ ID NO: 607077 - RNA, 22 nt, Human
auccaagagacauuugugaaug

SEQ ID NO: 607078 - RNA, 22 nt, Human
gcuccagggacccaagagaaaa

SEQ ID NO: 607079 - RNA, 22 nt, Human
cauguuaaguguuugauaacca

SEQ ID NO: 607080 - RNA, 22 nt, Human
aagugaugcuacgacuuugaca

SEQ ID NO: 607081 - RNA, 22 nt, Human
ucccagcagggccgaccagccu

SEQ ID NO: 607082 - RNA, 22 nt, Human
auuuuuccaugauacuuaucug

SEQ ID NO: 607083 - RNA, 22 nt, Human
aaagguuugccgaccucugcuu

SEQ ID NO: 607084 - RNA, 22 nt, Human
ugcagcugaugauacccccaug

SEQ ID NO: 607085 - RNA, 22 nt, Human
uaaaguuuguagcaauugauau

SEQ ID NO: 607086 - RNA, 22 nt, Human
accucugaagggccaagcaaug

SEQ ID NO: 607087 - RNA, 22 nt, Human
caggaggaaaguuccacucaac

SEQ ID NO: 607088 - RNA, 22 nt, Human
auuuaacaagacagagaacugg

SEQ ID NO: 607089 - RNA, 19 nt, Human
aaggcuuggcugagcuggg

SEQ ID NO: 607090 - RNA, 22 nt, Human
agucauaauuauaaacaucagu

SEQ ID NO: 607091 - RNA, 22 nt, Human
ugugggaaugacgaggaagagg

SEQ ID NO: 607092 - RNA, 22 nt, Human
ugcaagaucuugucucugccac

SEQ ID NO: 607093 - RNA, 22 nt, Human
cggcagagcggcgagccccucc

SEQ ID NO: 607094 - RNA, 21 nt, Human
ggcugcugucaccgcugucac

SEQ ID NO: 607095 - RNA, 22 nt, Human
ggaccugaacauaaaacgaggc

SEQ ID NO: 607096 - RNA, 22 nt, Human
gaaguuuagguucuuauguuua

SEQ ID NO: 607097 - RNA, 19 nt, Human
aguuggggcagggaagaga

SEQ ID NO: 607098 - RNA, 22 nt, Human
uggaggcaacugaagauguagu

SEQ ID NO: 607099 - RNA, 22 nt, Human
ugaagacagggucuuuaacgag

SEQ ID NO: 607100 - RNA, 22 nt, Human
aucaugacagagucugccaucc

SEQ ID NO: 607101 - RNA, 22 nt, Human
aaucuucacucauucagaguug

SEQ ID NO: 607102 - RNA, 22 nt, Human
aggcaggagugacccugacagg

SEQ ID NO: 607103 - RNA, 22 nt, Human
cagagguacaagcuaaguuggg

SEQ ID NO: 607104 - RNA, 22 nt, Human
gaguggggcccacugcugggug

SEQ ID NO: 607105 - RNA, 22 nt, Human
aacugauuucaaguucaguuuc

SEQ ID NO: 607106 - RNA, 22 nt, Human
ugccugggagugaccaagacuc

SEQ ID NO: 607107 - RNA, 22 nt, Human
cacccugcccacuagcaaucug

SEQ ID NO: 607108 - RNA, 22 nt, Human
gcucacugcaaccucugcuucc

SEQ ID NO: 607109 - RNA, 22 nt, Human
uucugggaggcuggcugucaua

SEQ ID NO: 607110 - RNA, 22 nt, Human
gccugagaaggauaggaagcga

SEQ ID NO: 607111 - RNA, 22 nt, Human
ugggacucacucuuuuggccag

SEQ ID NO: 607112 - RNA, 22 nt, Human
agacacugaaucagagggacau

SEQ ID NO: 607113 - RNA, 22 nt, Human
ccucacucugcacccugcagca

SEQ ID NO: 607114 - RNA, 22 nt, Human
ugcaggagacauaauagggacu

SEQ ID NO: 607115 - RNA, 22 nt, Human
gaagguuugauccuuauuuaua

SEQ ID NO: 607116 - RNA, 22 nt, Human
aacagcagaaacugcaagcuac

SEQ ID NO: 607117 - RNA, 22 nt, Human
ggccagagagcagccaggauuc

SEQ ID NO: 607118 - RNA, 22 nt, Human
gaggcuagagcaggggcucaau

SEQ ID NO: 607119 - RNA, 21 nt, Human
gccugggaaaucugggaagcc

SEQ ID NO: 607120 - RNA, 22 nt, Human
ccccaggacguggcccucauag

SEQ ID NO: 607121 - RNA, 22 nt, Human
uuagugguacucagggagggaa

SEQ ID NO: 607122 - RNA, 22 nt, Human
acuuccagugucugcugcuagc

SEQ ID NO: 607123 - RNA, 22 nt, Human
ugaccaauacuguggaugccag

SEQ ID NO: 607124 - RNA, 22 nt, Human
aaaguacagauggugagguugg

SEQ ID NO: 607125 - RNA, 23 nt, Human
uggcugagcccacuaucuuggcc

SEQ ID NO: 607126 - RNA, 22 nt, Human
uagcacaggucuuguugccauu

SEQ ID NO: 607127 - RNA, 22 nt, Human
gaagucugagugggggccaggc

SEQ ID NO: 607128 - RNA, 22 nt, Human
ucugaccacagacaaccugcua

SEQ ID NO: 607129 - RNA, 21 nt, Human
augugaaauaucaucagagca

SEQ ID NO: 607130 - RNA, 23 nt, Human
acugagccagggccugggucagc

SEQ ID NO: 607131 - RNA, 22 nt, Human
aggcaggaacccugugugcgcc

SEQ ID NO: 607132 - RNA, 22 nt, Human
ugaggaugguguuggagagggc

SEQ ID NO: 607133 - RNA, 22 nt, Human
uguacaaaacaagaugggggua

SEQ ID NO: 607134 - RNA, 22 nt, Human
gaagagguagcauuggcaggug

SEQ ID NO: 607135 - RNA, 21 nt, Human
ucucuggaauuagaccauguu

SEQ ID NO: 607136 - RNA, 22 nt, Human
uacuuuaauauaugugaaguuc

SEQ ID NO: 607137 - RNA, 22 nt, Human
cagcaguuaugaguagaauagu

SEQ ID NO: 607138 - RNA, 22 nt, Human
gggcacugugcugggugcuuua

SEQ ID NO: 607139 - RNA, 22 nt, Human
cugucagcacucuacuacagau

SEQ ID NO: 607140 - RNA, 22 nt, Human
acagaugagagacaaugugcua

SEQ ID NO: 607141 - RNA, 22 nt, Human
aguccuggguccagcagguccu

SEQ ID NO: 607142 - RNA, 22 nt, Human
uugcuuagcgacuccccuuccu

SEQ ID NO: 607143 - RNA, 22 nt, Human
cacuguuuuauuccaacauagg

SEQ ID NO: 607144 - RNA, 22 nt, Human
acucccagguugccuggcaggc

SEQ ID NO: 607145 - RNA, 22 nt, Human
guaaauauuaaaggcugcuaga

SEQ ID NO: 607146 - RNA, 22 nt, Human
cauguguuaaucuuucugcaaa

SEQ ID NO: 607147 - RNA, 22 nt, Human
ugcuacagagccaggaagagug

SEQ ID NO: 607148 - RNA, 19 nt, Human
cuccuggcucugucauuuu

SEQ ID NO: 607149 - RNA, 22 nt, Human
caggaguggugugagggacucc

SEQ ID NO: 607150 - RNA, 22 nt, Human
cagaggcccagugagagggcug

SEQ ID NO: 607151 - RNA, 22 nt, Human
gcugggaguuacugucuccuuu

SEQ ID NO: 607152 - RNA, 22 nt, Human
cccaggcuccugacucauucua

SEQ ID NO: 607153 - RNA, 22 nt, Human
uauuuuaaagugaagggucuug

SEQ ID NO: 607154 - RNA, 22 nt, Human
aucuuuaaagacaugugaacuu

SEQ ID NO: 607155 - RNA, 22 nt, Human
acaggaguuaaggcugaguuga

SEQ ID NO: 607156 - RNA, 22 nt, Human
gcugggccagagcagcagcacu

SEQ ID NO: 607157 - RNA, 20 nt, Human
cuggggaggaggauguguuc

SEQ ID NO: 607158 - RNA, 22 nt, Human
cagaaacauguauaaaguugua

SEQ ID NO: 607159 - RNA, 21 nt, Human
aggaguugcuguggccugguu

SEQ ID NO: 607160 - RNA, 22 nt, Human
cuacagguaugugcaugacauc

SEQ ID NO: 607161 - RNA, 22 nt, Human
cucugaagaugguaccagcuuu

SEQ ID NO: 607162 - RNA, 22 nt, Human
cgcccagcugaaaucuccaggc

SEQ ID NO: 607163 - RNA, 22 nt, Human
agugugggccacgcagcugagc

SEQ ID NO: 607164 - RNA, 22 nt, Human
gaagcaguucgaaagcaguugg

SEQ ID NO: 607165 - RNA, 22 nt, Human
agcugccugcuuaugagcucca

SEQ ID NO: 607166 - RNA, 19 nt, Human
ugguggaggccccauguuc

SEQ ID NO: 607167 - RNA, 22 nt, Human
ucuuucaaagcaaaaugaggcu

SEQ ID NO: 607168 - RNA, 22 nt, Human
aagcacuuagaagagugccugc

SEQ ID NO: 607169 - RNA, 21 nt, Human
cuguuugcaagccuauguguc

SEQ ID NO: 607170 - RNA, 20 nt, Human
auugugaauacugcauaugu

SEQ ID NO: 607171 - RNA, 22 nt, Human
uuugucauguccuuaacugucu

SEQ ID NO: 607172 - RNA, 22 nt, Human
ugccuguguggucugcgcauua

SEQ ID NO: 607173 - RNA, 22 nt, Human
agcugcuuauaagauuugggag

SEQ ID NO: 607174 - RNA, 22 nt, Human
gugcagguggcuucuagcuucu

SEQ ID NO: 607175 - RNA, 22 nt, Human
ugccugucuuuccucccucgua

SEQ ID NO: 607176 - RNA, 22 nt, Human
gccacagguggaauuaagaaau

SEQ ID NO: 607177 - RNA, 22 nt, Human
cucauaaagugagaauaugacc

SEQ ID NO: 607178 - RNA, 18 nt, Human
ucugaggaauggaagagc

SEQ ID NO: 607179 - RNA, 22 nt, Human
cuccagugucucagagcagaug

SEQ ID NO: 607180 - RNA, 22 nt, Human
agcugguggagaagcagaccuc

SEQ ID NO: 607181 - RNA, 22 nt, Human
ggucccaggaaucuguguucua

SEQ ID NO: 607182 - RNA, 22 nt, Human
ucccagaaaaaggaggcuauga

SEQ ID NO: 607183 - RNA, 22 nt, Human
ucaagggaggagacacagcccu

SEQ ID NO: 607184 - RNA, 22 nt, Human
ugcacugauccugaccagugaa

SEQ ID NO: 607185 - RNA, 22 nt, Human
uguguacaucucuucucacauu

SEQ ID NO: 607186 - RNA, 22 nt, Human
ugucauuuccugaaugcugagu

SEQ ID NO: 607187 - RNA, 19 nt, Human
ucaaggcucccugagggau

SEQ ID NO: 607188 - RNA, 22 nt, Human
caggugccucaggaugagacaa

SEQ ID NO: 607189 - RNA, 22 nt, Human
gcugggcuucacagagccuuua

SEQ ID NO: 607190 - RNA, 22 nt, Human
gaaucuuaaaucggaaucuuaa

SEQ ID NO: 607191 - RNA, 22 nt, Human
gcaguggaagccucuuuaagca

SEQ ID NO: 607192 - RNA, 22 nt, Human
aaguuacagauugggagcagag

SEQ ID NO: 607193 - RNA, 23 nt, Human
uccagucuccugaaaggcagcgu

SEQ ID NO: 607194 - RNA, 22 nt, Human
auguuacauaguccuuauuugu

SEQ ID NO: 607195 - RNA, 22 nt, Human
acauuucuaauuuaauguaaca

SEQ ID NO: 607196 - RNA, 22 nt, Human
aauauuucuggugcuucucacu

SEQ ID NO: 607197 - RNA, 22 nt, Human
uggaggaaguggcuggccagaa

SEQ ID NO: 607198 - RNA, 22 nt, Human
uaguccuuacuuacuagaauaa

SEQ ID NO: 607199 - RNA, 22 nt, Human
aguggcaguuugggagcuacag

SEQ ID NO: 607200 - RNA, 18 nt, Human
aguuuuuaggaagaaaug

SEQ ID NO: 607201 - RNA, 20 nt, Human
cacaugcuguguguuucucu

SEQ ID NO: 607202 - RNA, 22 nt, Human
ugaacacaguucugaugagcuu

SEQ ID NO: 607203 - RNA, 22 nt, Human
ucaggcugauaggaggaacuga

SEQ ID NO: 607204 - RNA, 20 nt, Human
uccagcugucuuucagagac

SEQ ID NO: 607205 - RNA, 22 nt, Human
gacagaggcaagaccagaagcc

SEQ ID NO: 607206 - RNA, 22 nt, Human
agagauaugaguaguugugaca

SEQ ID NO: 607207 - RNA, 22 nt, Human
ugcaugcaugcuacugggaggu

SEQ ID NO: 607208 - RNA, 22 nt, Human
uaaagcaaggcaaauuguuggu

SEQ ID NO: 607209 - RNA, 22 nt, Human
agugggaggaaguggugauauu

SEQ ID NO: 607210 - RNA, 22 nt, Human
ccaggccuuccaguacgcagaa

SEQ ID NO: 607211 - RNA, 22 nt, Human
gcauaucagcaucaaaacacag

SEQ ID NO: 607212 - RNA, 20 nt, Human
ccucucugcaugcucccuga

SEQ ID NO: 607213 - RNA, 22 nt, Human
agauucaggacuggccacagcc

SEQ ID NO: 607214 - RNA, 22 nt, Human
uuucuagucucgaucucuuaau

SEQ ID NO: 607215 - RNA, 23 nt, Human
uaaagacagccuucaggauucug

SEQ ID NO: 607216 - RNA, 22 nt, Human
ucugcuuucuuacuaaaaauga

SEQ ID NO: 607217 - RNA, 22 nt, Human
uacaugcauuggauggcaauag

SEQ ID NO: 607218 - RNA, 22 nt, Human
gaacacugaggacacugagaau

SEQ ID NO: 607219 - RNA, 19 nt, Human
augaauugagcacuuacua

SEQ ID NO: 607220 - RNA, 17 nt, Human
aucaguagcauaucaga

SEQ ID NO: 607221 - RNA, 22 nt, Human
cuuggcuguaaaaucagaggcu

SEQ ID NO: 607222 - RNA, 22 nt, Human
acacagaguaucuuuugccuag

SEQ ID NO: 607223 - RNA, 22 nt, Human
ugggaaugugagcauucauuca

SEQ ID NO: 607224 - RNA, 22 nt, Human
auagcuuacaggugauaucagc

SEQ ID NO: 607225 - RNA, 23 nt, Human
acugauucuugaaguugacaagu

SEQ ID NO: 607226 - RNA, 22 nt, Human
agcugcagagguuugugcaaca

SEQ ID NO: 607227 - RNA, 22 nt, Human
uugugacauugauuaaacuaug

SEQ ID NO: 607228 - RNA, 22 nt, Human
cacauguacagaagcaggcugg

SEQ ID NO: 607229 - RNA, 22 nt, Human
ucacauuugcaauugcauuguu

SEQ ID NO: 607230 - RNA, 22 nt, Human
cacaggcucuccagggccugga

SEQ ID NO: 607231 - RNA, 22 nt, Human
agagguugggucugaggugaga

SEQ ID NO: 607232 - RNA, 22 nt, Human
gauacauuccgggagggcuacc

SEQ ID NO: 607233 - RNA, 22 nt, Human
guacaaaaguuauugcgguuuu

SEQ ID NO: 607234 - RNA, 22 nt, Human
aucuuccuuugccaugggauag

SEQ ID NO: 607235 - RNA, 22 nt, Human
ugccucagucuaaagucucuca

SEQ ID NO: 607236 - RNA, 22 nt, Human
uugaaacuuuaguaaacuaagg

SEQ ID NO: 607237 - RNA, 22 nt, Human
acugaauaauggucugugaucu

SEQ ID NO: 607238 - RNA, 22 nt, Human
gaguccaguuguucacagaggc

SEQ ID NO: 607239 - RNA, 22 nt, Human
cauuucuaagaagaucugggua

SEQ ID NO: 607240 - RNA, 22 nt, Human
uggcucugucacugugagcuau

SEQ ID NO: 607241 - RNA, 22 nt, Human
ucauaaacucacuaguuuaugu

SEQ ID NO: 607242 - RNA, 22 nt, Human
uaaaugcuaucgcauaaaaccu

SEQ ID NO: 607243 - RNA, 21 nt, Human
uuccacagugagaacugcaag

SEQ ID NO: 607244 - RNA, 19 nt, Human
uacauuccacacaaucucu

SEQ ID NO: 607245 - RNA, 22 nt, Human
acagugugguuugagcacuggg

SEQ ID NO: 607246 - RNA, 22 nt, Human
ucacugggagagcugacaagga

SEQ ID NO: 607247 - RNA, 23 nt, Human
ccacugaagaauccagggaguuu

SEQ ID NO: 607248 - RNA, 22 nt, Human
gcugagugauucauacgcugcu

SEQ ID NO: 607249 - RNA, 22 nt, Human
aacauagaauggcuccagagcu

SEQ ID NO: 607250 - RNA, 22 nt, Human
caccagggcagcagccuagucu

SEQ ID NO: 607251 - RNA, 22 nt, Human
caacuguuauaaaucaacagag

SEQ ID NO: 607252 - RNA, 22 nt, Human
cagcuauuggcaagaaguggug

SEQ ID NO: 607253 - RNA, 21 nt, Human
cagagguggccugaccucuga

SEQ ID NO: 607254 - RNA, 22 nt, Human
uaguuucuuucacguaguaaua

SEQ ID NO: 607255 - RNA, 22 nt, Human
uucccugaucacgugucaggag

SEQ ID NO: 607256 - RNA, 22 nt, Human
uuccuggggcuuagcaauggag

SEQ ID NO: 607257 - RNA, 22 nt, Human
auuaggcauuauggggauaagg

SEQ ID NO: 607258 - RNA, 22 nt, Human
ucuggccccuggcaguccugga

SEQ ID NO: 607259 - RNA, 22 nt, Human
ucaggccacggcucacugagac

SEQ ID NO: 607260 - RNA, 22 nt, Human
aagaugaagaacaugagcacac

SEQ ID NO: 607261 - RNA, 22 nt, Human
ggaagggcaauaaaaucucagg

SEQ ID NO: 607262 - RNA, 22 nt, Human
aucgaauaauugcauucuauaa

SEQ ID NO: 607263 - RNA, 20 nt, Human
aucuuugucucuguaguugu

SEQ ID NO: 607264 - RNA, 22 nt, Human
cagguuggggacuuaggaugac

SEQ ID NO: 607265 - RNA, 22 nt, Human
ugaauuuaaaauaaauguaguu

SEQ ID NO: 607266 - RNA, 22 nt, Human
auuaucuaggaauugacagaag

SEQ ID NO: 607267 - RNA, 22 nt, Human
uccaggugggcugcacccaggc

SEQ ID NO: 607268 - RNA, 22 nt, Human
acacuuuguccuuuuucauugu

SEQ ID NO: 607269 - RNA, 22 nt, Human
uugcuuuugugugcucucugga

SEQ ID NO: 607270 - RNA, 22 nt, Human
aggccaagugcugggacaggug

SEQ ID NO: 607271 - RNA, 22 nt, Human
ugaaagaacuagcaucuucaag

SEQ ID NO: 607272 - RNA, 21 nt, Human
cagaggguuucucagguguuu

SEQ ID NO: 607273 - RNA, 22 nt, Human
uguggacuuuaguaggugagag

SEQ ID NO: 607274 - RNA, 22 nt, Human
gagcuccagggaacagcagcua

SEQ ID NO: 607275 - RNA, 22 nt, Human
guguccagggccguguugucuu

SEQ ID NO: 607276 - RNA, 22 nt, Human
caacacugacaauggacugauu

SEQ ID NO: 607277 - RNA, 22 nt, Human
cugagauggaguuucgcucuuc

SEQ ID NO: 607278 - RNA, 22 nt, Human
ugggagaagcagugggacagua

SEQ ID NO: 607279 - RNA, 22 nt, Human
guuuuguuuugagucaacucca

SEQ ID NO: 607280 - RNA, 22 nt, Human
ccaguguuacggcuugaacuau

SEQ ID NO: 607281 - RNA, 22 nt, Human
agccccaggaugggccgcagga

SEQ ID NO: 607282 - RNA, 21 nt, Human
aggggacagaguagcuccagg

SEQ ID NO: 607283 - RNA, 22 nt, Human
aacuuuaaggcuauaaauuaug

SEQ ID NO: 607284 - RNA, 22 nt, Human
cuguuuuugugcugugucuccc

SEQ ID NO: 607285 - RNA, 22 nt, Human
cugcuguacuuaggaagaggaa

SEQ ID NO: 607286 - RNA, 22 nt, Human
gccaccagggggcuccagugag

SEQ ID NO: 607287 - RNA, 22 nt, Human
aagcugcagacccccugucuca

SEQ ID NO: 607288 - RNA, 22 nt, Human
gugaaugaaaggaugauucuuu

SEQ ID NO: 607289 - RNA, 22 nt, Human
uguagggaggaaagggcucuug

SEQ ID NO: 607290 - RNA, 22 nt, Human
agccuaggagguuggggcugca

SEQ ID NO: 607291 - RNA, 22 nt, Human
augggaugaucaccugagcuca

SEQ ID NO: 607292 - RNA, 22 nt, Human
gcuccacugccccugggcaccg

SEQ ID NO: 607293 - RNA, 22 nt, Human
ggcagucacaggggagacuggg

SEQ ID NO: 607294 - RNA, 22 nt, Human
aacaucaucaugaacaacuaau

SEQ ID NO: 607295 - RNA, 22 nt, Human
aggcagcaugggccccagcucc

SEQ ID NO: 607296 - RNA, 21 nt, Human
cucugcugaguccuaggauuc

SEQ ID NO: 607297 - RNA, 22 nt, Human
ugugcuuucaaaguuaaguaaa

SEQ ID NO: 607298 - RNA, 22 nt, Human
gucccaggggagcucucugauu

SEQ ID NO: 607299 - RNA, 19 nt, Human
uccuggggaggggcauggc

SEQ ID NO: 607300 - RNA, 22 nt, Human
uggcugcagacaccuauggcag

SEQ ID NO: 607301 - RNA, 22 nt, Human
cugcaugaagucuuuuuuauag

SEQ ID NO: 607302 - RNA, 22 nt, Human
agauuacaacaugggacgcaua

SEQ ID NO: 607303 - RNA, 22 nt, Human
cagcuucuggcguggagccuga

SEQ ID NO: 607304 - RNA, 22 nt, Human
aggggcgucuguaggcaguggg

SEQ ID NO: 607305 - RNA, 22 nt, Human
aacugaggccaagugaggaaag

SEQ ID NO: 607306 - RNA, 22 nt, Human
caagaugccccugguagggauc

SEQ ID NO: 607307 - RNA, 22 nt, Human
ugagaaccaugaaaagcuguca

SEQ ID NO: 607308 - RNA, 22 nt, Human
aauaaacugcucaauugcauca

SEQ ID NO: 607309 - RNA, 20 nt, Human
cucucuggaaggugggagcc

SEQ ID NO: 607310 - RNA, 22 nt, Human
cagcagaggugguucacauugu

SEQ ID NO: 607311 - RNA, 22 nt, Human
uagagcuagcuucaaaaugcga

SEQ ID NO: 607312 - RNA, 22 nt, Human
aauuauauuguggugugaaugu

SEQ ID NO: 607313 - RNA, 22 nt, Human
uaguuucugguucuugcucugg

SEQ ID NO: 607314 - RNA, 22 nt, Human
auaugcuauugcuguaauuuaa

SEQ ID NO: 607315 - RNA, 22 nt, Human
aggaaagggguagguguggacg

SEQ ID NO: 607316 - RNA, 22 nt, Human
gcacacagcuagauuaccauuc

SEQ ID NO: 607317 - RNA, 21 nt, Human
ugugaaauagcuaugcuacau

SEQ ID NO: 607318 - RNA, 22 nt, Human
acaggcagggaccuuggcuaag

SEQ ID NO: 607319 - RNA, 22 nt, Human
ccagcagagcauggggaggaag

SEQ ID NO: 607320 - RNA, 22 nt, Human
aguccaggcucuuccugaagaa

SEQ ID NO: 607321 - RNA, 22 nt, Human
aggugacugguuuaucuggcag

SEQ ID NO: 607322 - RNA, 22 nt, Human
acugucacuugcaacugugagg

SEQ ID NO: 607323 - RNA, 22 nt, Human
uaggcugggagccugaggcuag

SEQ ID NO: 607324 - RNA, 22 nt, Human
caucagcuuuucuaugugguga

SEQ ID NO: 607325 - RNA, 22 nt, Human
caggucugcagacagggccaug

SEQ ID NO: 607326 - RNA, 22 nt, Human
ugggcugaaaugcuguggacua

SEQ ID NO: 607327 - RNA, 19 nt, Human
gcaggguguugacuguccc

SEQ ID NO: 607328 - RNA, 21 nt, Human
acagcagagaucaagacuaag

SEQ ID NO: 607329 - RNA, 22 nt, Human
ggccucuguuuggagccaggau

SEQ ID NO: 607330 - RNA, 22 nt, Human
agccccucuguagcuaauagua

SEQ ID NO: 607331 - RNA, 22 nt, Human
ucugaagggcugaguggaggag

SEQ ID NO: 607332 - RNA, 22 nt, Human
ugccccucuugcuggcccuguc

SEQ ID NO: 607333 - RNA, 22 nt, Human
aggggcucaagcaguguggucu

SEQ ID NO: 607334 - RNA, 22 nt, Human
ucugcugaacuugcugcccaga

SEQ ID NO: 607335 - RNA, 22 nt, Human
cuggcuggaggugagucacuga

SEQ ID NO: 607336 - RNA, 20 nt, Human
aagcuggguaggagaggagc

SEQ ID NO: 607337 - RNA, 22 nt, Human
agcagagcggggccuccggaag

SEQ ID NO: 607338 - RNA, 22 nt, Human
uuggaauuuagggaauauucau

SEQ ID NO: 607339 - RNA, 22 nt, Human
ucucacagcaucauugcucaug

SEQ ID NO: 607340 - RNA, 22 nt, Human
aauguuauuguccuuuccaaaa

SEQ ID NO: 607341 - RNA, 22 nt, Human
agaagcugcguuuauuuaaauc

SEQ ID NO: 607342 - RNA, 22 nt, Human
guccagaguagucgaguauucu

SEQ ID NO: 607343 - RNA, 21 nt, Human
accuuuggguguuuauaauag

SEQ ID NO: 607344 - RNA, 22 nt, Human
uacagugcuuuuugguggagaa

SEQ ID NO: 607345 - RNA, 22 nt, Human
acuccccaaaacuaaccaugca

SEQ ID NO: 607346 - RNA, 22 nt, Human
ugaagguggcauaggagagaug

SEQ ID NO: 607347 - RNA, 22 nt, Human
auaauguguucaucuuacaauu

SEQ ID NO: 607348 - RNA, 22 nt, Human
cuguaugaguugggaauagaau

SEQ ID NO: 607349 - RNA, 22 nt, Human
gaggcucuggaguagguacaca

SEQ ID NO: 607350 - RNA, 22 nt, Human
ggcaggcagccuccauccacag

SEQ ID NO: 607351 - RNA, 22 nt, Human
ugcugcagcuaaggugaggugc

SEQ ID NO: 607352 - RNA, 22 nt, Human
aggcccccacaggcuugaggca

SEQ ID NO: 607353 - RNA, 20 nt, Human
gccagaggccggcaggggcu

SEQ ID NO: 607354 - RNA, 22 nt, Human
agagccugcuaccucauuccag

SEQ ID NO: 607355 - RNA, 22 nt, Human
acuggaguuauuauuugcagcu

SEQ ID NO: 607356 - RNA, 22 nt, Human
uuagaaaaauguucaguaguuu

SEQ ID NO: 607357 - RNA, 22 nt, Human
ggaugcuggggaccaaucucug

SEQ ID NO: 607358 - RNA, 22 nt, Human
cacaugaagagagucuaguaau

SEQ ID NO: 607359 - RNA, 22 nt, Human
gccuggcaggccugggccagca

SEQ ID NO: 607360 - RNA, 22 nt, Human
gaggccaggagugcuguaaguu

SEQ ID NO: 607361 - RNA, 22 nt, Human
gcugugcagucuuuggugugcc

SEQ ID NO: 607362 - RNA, 22 nt, Human
ugcauaaaauaugagaaaugua

SEQ ID NO: 607363 - RNA, 17 nt, Human
uuguuucuucucugugg

SEQ ID NO: 607364 - RNA, 22 nt, Human
ugccaaaaugggcuuuauaccg

SEQ ID NO: 607365 - RNA, 22 nt, Human
agaggccaccuucucuugagaa

SEQ ID NO: 607366 - RNA, 22 nt, Human
agccuuaaaugcuagauucaua

SEQ ID NO: 607367 - RNA, 22 nt, Human
ccucagcucuucccugugcaca

SEQ ID NO: 607368 - RNA, 22 nt, Human
ugaaagcacaaguucuaacagg

SEQ ID NO: 607369 - RNA, 22 nt, Human
uucugcaggagcccuaguguau

SEQ ID NO: 607370 - RNA, 22 nt, Human
gggucuaggagacaugggcaag

SEQ ID NO: 607371 - RNA, 22 nt, Human
cuccagucauagccucuugagu

SEQ ID NO: 607372 - RNA, 22 nt, Human
ugcaugcacuuggcuggcacgu

SEQ ID NO: 607373 - RNA, 22 nt, Human
cagcacacagugacucgcaccu

SEQ ID NO: 607374 - RNA, 22 nt, Human
agauggcugauuaacuccaugg

SEQ ID NO: 607375 - RNA, 22 nt, Human
gcaacacagaucuucuuuguug

SEQ ID NO: 607376 - RNA, 22 nt, Human
gggcacaguacuccaaucaacu

SEQ ID NO: 607377 - RNA, 22 nt, Human
auccaaagauggaaagaacuuu

SEQ ID NO: 607378 - RNA, 22 nt, Human
ugacaauggauauuaguugugg

SEQ ID NO: 607379 - RNA, 22 nt, Human
agcagacaauugccuggaugga

SEQ ID NO: 607380 - RNA, 22 nt, Human
uccugacuccagguccugugug

SEQ ID NO: 607381 - RNA, 22 nt, Human
uccugggagcacaugguccugc

SEQ ID NO: 607382 - RNA, 22 nt, Human
aggagagaauuacuggguguca

SEQ ID NO: 607383 - RNA, 22 nt, Human
ccagccuggggaggcagcuucu

SEQ ID NO: 607384 - RNA, 22 nt, Human
aggcaaugcagauagaugaaug

SEQ ID NO: 607385 - RNA, 23 nt, Human
agggcccaagccuggacagcagg

SEQ ID NO: 607386 - RNA, 22 nt, Human
cacagggaaccaaggcugggcc

SEQ ID NO: 607387 - RNA, 22 nt, Human
aaaugucuguuagucauaucau

SEQ ID NO: 607388 - RNA, 22 nt, Human
agaccuggaguggggccucagg

SEQ ID NO: 607389 - RNA, 23 nt, Human
aguuccagaaaaaugcucaagca

SEQ ID NO: 607390 - RNA, 22 nt, Human
gcuguguuggugaagcuguagc

SEQ ID NO: 607391 - RNA, 22 nt, Human
ucugugugugccuguuaauauu

SEQ ID NO: 607392 - RNA, 21 nt, Human
ccaggaaggacugagcucccu

SEQ ID NO: 607393 - RNA, 22 nt, Human
uucuaauuguguuugcauaucu

SEQ ID NO: 607394 - RNA, 22 nt, Human
caguccuuggcaaguucucagu

SEQ ID NO: 607395 - RNA, 22 nt, Human
gcagguggauuaucagaagugc

SEQ ID NO: 607396 - RNA, 22 nt, Human
uggcaugcaagaggaggcuccc

SEQ ID NO: 607397 - RNA, 22 nt, Human
gaggggcucuuuaauaguaaca

SEQ ID NO: 607398 - RNA, 22 nt, Human
aguguucucagcuacuagagag

SEQ ID NO: 607399 - RNA, 22 nt, Human
ugagcagaacacgggauccaug

SEQ ID NO: 607400 - RNA, 22 nt, Human
uuuagcuuguuggaacaauuga

SEQ ID NO: 607401 - RNA, 22 nt, Human
cucagcacaucuuuacauuucc

SEQ ID NO: 607402 - RNA, 22 nt, Human
agggcagcuagcuguagaaaga

SEQ ID NO: 607403 - RNA, 22 nt, Human
cacacugucuuuaugagcugua

SEQ ID NO: 607404 - RNA, 22 nt, Human
ccaccagcuuugccacccugcu

SEQ ID NO: 607405 - RNA, 21 nt, Human
agaucauucuucugagcacuu

SEQ ID NO: 607406 - RNA, 22 nt, Human
ugggcucauguuucuuugagga

SEQ ID NO: 607407 - RNA, 22 nt, Human
ugacauuuaaucccuaaauauu

SEQ ID NO: 607408 - RNA, 22 nt, Human
ggccaaggaugguggcucuggu

SEQ ID NO: 607409 - RNA, 22 nt, Human
gcuucuguggugcaucuuugcu

SEQ ID NO: 607410 - RNA, 22 nt, Human
gagaaagcuucagaaauggccu

SEQ ID NO: 607411 - RNA, 21 nt, Human
auaaaguuuuacaggaaugca

SEQ ID NO: 607412 - RNA, 22 nt, Human
uggcccaggaggccagagggca

SEQ ID NO: 607413 - RNA, 22 nt, Human
augauacaucuucaugucagug

SEQ ID NO: 607414 - RNA, 22 nt, Human
cagggcugaggacacaaguaaa

SEQ ID NO: 607415 - RNA, 22 nt, Human
gucccuaguggaaagacaugau

SEQ ID NO: 607416 - RNA, 22 nt, Human
acuuucaacuuggugggagagc

SEQ ID NO: 607417 - RNA, 22 nt, Human
cacagcugcccuaacuguacuc

SEQ ID NO: 607418 - RNA, 22 nt, Human
uuucaucugugcugccaagacu

SEQ ID NO: 607419 - RNA, 22 nt, Human
gagcacagcagggcucugggug

SEQ ID NO: 607420 - RNA, 22 nt, Human
accccagcccugcuucugggag

SEQ ID NO: 607421 - RNA, 21 nt, Human
auuagaagguauuuagggccu

SEQ ID NO: 607422 - RNA, 22 nt, Human
guguccacggcugagaaugauu

SEQ ID NO: 607423 - RNA, 22 nt, Human
gaggccaugaauggauguuccu

SEQ ID NO: 607424 - RNA, 22 nt, Human
auuuuugagcugugaacauagc

SEQ ID NO: 607425 - RNA, 22 nt, Human
aggcucugcagaccccagcugu

SEQ ID NO: 607426 - RNA, 22 nt, Human
cauuucuguucucuuccuguac

SEQ ID NO: 607427 - RNA, 22 nt, Human
agaguuaagcuuugccuaaaga

SEQ ID NO: 607428 - RNA, 22 nt, Human
aggcacugaaagguggccagag

SEQ ID NO: 607429 - RNA, 22 nt, Human
ugcccuugaaauacgcuugggg

SEQ ID NO: 607430 - RNA, 23 nt, Human
aggggcagcaaguuuugguguua

SEQ ID NO: 607431 - RNA, 22 nt, Human
cagcucugggagucccaccccu

SEQ ID NO: 607432 - RNA, 22 nt, Human
auagaauagcauagaaaauuga

SEQ ID NO: 607433 - RNA, 22 nt, Human
cugaggcuuggaggggucuggu

SEQ ID NO: 607434 - RNA, 23 nt, Human
ugcacaggacggccuuauaagua

SEQ ID NO: 607435 - RNA, 20 nt, Human
ggcacuggaagcacacagga

SEQ ID NO: 607436 - RNA, 23 nt, Human
acugccagauugaagguuucuua

SEQ ID NO: 607437 - RNA, 22 nt, Human
ugaaauaggaaacagauguuuc

SEQ ID NO: 607438 - RNA, 22 nt, Human
cagcugaguguuggcauguuca

SEQ ID NO: 607439 - RNA, 22 nt, Human
gcucccaccaggcagaccuacc

SEQ ID NO: 607440 - RNA, 22 nt, Human
cgagaugguauuuuuaacgcag

SEQ ID NO: 607441 - RNA, 21 nt, Human
ucucugggaggacuugugaga

SEQ ID NO: 607442 - RNA, 22 nt, Human
uauaauaugaggcaggagugau

SEQ ID NO: 607443 - RNA, 22 nt, Human
agugugugaccuuuuaauuuaa

SEQ ID NO: 607444 - RNA, 22 nt, Human
gugagacaagauuuguaggcag

SEQ ID NO: 607445 - RNA, 22 nt, Human
guauuuuuaguagagucggggu

SEQ ID NO: 607446 - RNA, 22 nt, Human
ucucagagggaaacaugaguga

SEQ ID NO: 607447 - RNA, 22 nt, Human
aaagccaguucuuagagaaagc

SEQ ID NO: 607448 - RNA, 22 nt, Human
cuguccagcugaccagagcagc

SEQ ID NO: 607449 - RNA, 23 nt, Human
uccagcagccaagaaggguagaa

SEQ ID NO: 607450 - RNA, 22 nt, Human
gacagcugaaaaauguaaggua

SEQ ID NO: 607451 - RNA, 22 nt, Human
uuccagagugacugugccacuu

SEQ ID NO: 607452 - RNA, 22 nt, Human
gcccagggugaagugcaguugu

SEQ ID NO: 607453 - RNA, 22 nt, Human
gccagguggagguugcagugag

SEQ ID NO: 607454 - RNA, 22 nt, Human
ccaggccccagggcuggcuuuc

SEQ ID NO: 607455 - RNA, 22 nt, Human
auuuuuguauccccagcuccug

SEQ ID NO: 607456 - RNA, 22 nt, Human
ccugggcaggccggacgcuggg

SEQ ID NO: 607457 - RNA, 22 nt, Human
acagaguacauucagagacuau

SEQ ID NO: 607458 - RNA, 22 nt, Human
auguagcugcagaugauaaugc

SEQ ID NO: 607459 - RNA, 22 nt, Human
uucuauuuccaguccuucagag

SEQ ID NO: 607460 - RNA, 22 nt, Human
gccaggguugccaaugggggca

SEQ ID NO: 607461 - RNA, 22 nt, Human
ggccucucuggcauggcugccc

SEQ ID NO: 607462 - RNA, 22 nt, Human
guggcagguuauaagcaucuca

SEQ ID NO: 607463 - RNA, 22 nt, Human
aaauaacagucagggacaacau

SEQ ID NO: 607464 - RNA, 22 nt, Human
acuguuaaaguaauuaauuguc

SEQ ID NO: 607465 - RNA, 22 nt, Human
ggcaagauccaaggggcuagga

SEQ ID NO: 607466 - RNA, 22 nt, Human
auacaucuagagucauaaaaac

SEQ ID NO: 607467 - RNA, 22 nt, Human
gcccagcugucuggcagggaug

SEQ ID NO: 607468 - RNA, 22 nt, Human
cauaauuuuccaugguuugcua

SEQ ID NO: 607469 - RNA, 22 nt, Human
aagcuguuaauggcuugcagcu

SEQ ID NO: 607470 - RNA, 22 nt, Human
cugcuguccaggagugcccugu

SEQ ID NO: 607471 - RNA, 22 nt, Human
ugcacuccaggcugggugacag

SEQ ID NO: 607472 - RNA, 22 nt, Human
guuuaugaauugcauucccuuu

SEQ ID NO: 607473 - RNA, 22 nt, Human
ugcccacauucugaagcucccu

SEQ ID NO: 607474 - RNA, 19 nt, Human
cccagguguuugaggcugc

SEQ ID NO: 607475 - RNA, 22 nt, Human
aggaaagguagcgugccagcag

SEQ ID NO: 607476 - RNA, 22 nt, Human
guggcagcggcccaggccgucu

SEQ ID NO: 607477 - RNA, 22 nt, Human
ccagaggcggagguuugcagug

SEQ ID NO: 607478 - RNA, 22 nt, Human
uuugaauaucacaaacuuucaa

SEQ ID NO: 607479 - RNA, 22 nt, Human
cugagcuguuuaaucccagaua

SEQ ID NO: 607480 - RNA, 22 nt, Human
agaggcccugggcuggugugcu

SEQ ID NO: 607481 - RNA, 22 nt, Human
ccuggagcaaaaaucuaaggag

SEQ ID NO: 607482 - RNA, 22 nt, Human
aaacuguauauuuauggcaugu

SEQ ID NO: 607483 - RNA, 22 nt, Human
aagauuuagggccaguuuacau

SEQ ID NO: 607484 - RNA, 22 nt, Human
ugcugcuuuuguauaucagaga

SEQ ID NO: 607485 - RNA, 22 nt, Human
aggcacugggggaugagcaagg

SEQ ID NO: 607486 - RNA, 22 nt, Human
ucagccaguauuugagugcuca

SEQ ID NO: 607487 - RNA, 22 nt, Human
gcuggccaguguggugaccacc

SEQ ID NO: 607488 - RNA, 22 nt, Human
gugcuccaggucgcucagagag

SEQ ID NO: 607489 - RNA, 22 nt, Human
cugugcccaccuggcucugagg

SEQ ID NO: 607490 - RNA, 22 nt, Human
cugcaguucuucuccucaaggc

SEQ ID NO: 607491 - RNA, 22 nt, Human
aggguccaucaaggacugcaca

SEQ ID NO: 607492 - RNA, 22 nt, Human
aaucagaaaggcuaaggaagca

SEQ ID NO: 607493 - RNA, 22 nt, Human
gcagccacccucaaggcugaau

SEQ ID NO: 607494 - RNA, 22 nt, Human
uguuuuaaagccauugccuuuc

SEQ ID NO: 607495 - RNA, 22 nt, Human
gagcugagccuggguggaccgc

SEQ ID NO: 607496 - RNA, 21 nt, Human
auccauccaucuuggccuaac

SEQ ID NO: 607497 - RNA, 22 nt, Human
uuucugcaaacuuccacgucuc

SEQ ID NO: 607498 - RNA, 22 nt, Human
cugaggaucuaauuauuggguc

SEQ ID NO: 607499 - RNA, 22 nt, Human
acaagauuuuaugacucuuuuu

SEQ ID NO: 607500 - RNA, 22 nt, Human
acagauaaaaguuguuuaaaau

SEQ ID NO: 607501 - RNA, 22 nt, Human
cucucuagaggcccaccuugag

SEQ ID NO: 607502 - RNA, 22 nt, Human
auucacagggacaaugggagag

SEQ ID NO: 607503 - RNA, 18 nt, Human
agacaaacuucuucugcc

SEQ ID NO: 607504 - RNA, 22 nt, Human
ggcucccuguucuauucccugg

SEQ ID NO: 607505 - RNA, 22 nt, Human
cuggguugcaaagcgcuggcug

SEQ ID NO: 607506 - RNA, 22 nt, Human
uuuuacaggucauagguauagu

SEQ ID NO: 607507 - RNA, 22 nt, Human
ucugaggcauaaccuguucugc

SEQ ID NO: 607508 - RNA, 22 nt, Human
ugccucaguuucaucugcagaa

SEQ ID NO: 607509 - RNA, 22 nt, Human
auguauaugcaugcauucaaag

SEQ ID NO: 607510 - RNA, 19 nt, Human
uucacauuuugcucugagg

SEQ ID NO: 607511 - RNA, 22 nt, Human
ucauauuuauauguuggcacag

SEQ ID NO: 607512 - RNA, 22 nt, Human
agguggggaaaccagcgauccc

SEQ ID NO: 607513 - RNA, 22 nt, Human
aaggcagcccuggcucagccug

SEQ ID NO: 607514 - RNA, 22 nt, Human
acugcaggagacacagcugcug

SEQ ID NO: 607515 - RNA, 18 nt, Human
uugauaaacaauuucauu

SEQ ID NO: 607516 - RNA, 22 nt, Human
gcccuguuuucuggguuccuug

SEQ ID NO: 607517 - RNA, 22 nt, Human
guccugggcaugcagggcuuuc

SEQ ID NO: 607518 - RNA, 22 nt, Human
gaauuagacaugcuuugcuuuu

SEQ ID NO: 607519 - RNA, 22 nt, Human
ggcccagcgaggccaccuacag

SEQ ID NO: 607520 - RNA, 22 nt, Human
cucuaggcugcccaggagcuga

SEQ ID NO: 607521 - RNA, 22 nt, Human
agugcauauaugaagaguauga

SEQ ID NO: 607522 - RNA, 22 nt, Human
cuggcuuuaccucacuggggcu

SEQ ID NO: 607523 - RNA, 22 nt, Human
gcugccugggcuggcauuccca

SEQ ID NO: 607524 - RNA, 22 nt, Human
cuacaaaaguaauugugguuuu

SEQ ID NO: 607525 - RNA, 22 nt, Human
cagcuguguaaacacaugugua

SEQ ID NO: 607526 - RNA, 22 nt, Human
cuagggugugcagauuuugccu

SEQ ID NO: 607527 - RNA, 22 nt, Human
gugggcugaggggacaccaagg

SEQ ID NO: 607528 - RNA, 22 nt, Human
uaucaguagaacaauggacauu

SEQ ID NO: 607529 - RNA, 22 nt, Human
uucagccuguucaugcuguugc

SEQ ID NO: 607530 - RNA, 21 nt, Human
uccaggggccagcacccaagc

SEQ ID NO: 607531 - RNA, 22 nt, Human
cuuugccauguugccugcagaa

SEQ ID NO: 607532 - RNA, 22 nt, Human
ugcaggugugguuccucagcca

SEQ ID NO: 607533 - RNA, 22 nt, Human
gugacauugcuaggaacagauu

SEQ ID NO: 607534 - RNA, 22 nt, Human
aagauuuucagugccuaaaaca

SEQ ID NO: 607535 - RNA, 23 nt, Human
uccugcagauaagcugguugaca

SEQ ID NO: 607536 - RNA, 22 nt, Human
uugcuuuacuuugccauucguu

SEQ ID NO: 607537 - RNA, 22 nt, Human
aagcaggcauuccagagacaau

SEQ ID NO: 607538 - RNA, 22 nt, Human
cugccucucaggucccugagau

SEQ ID NO: 607539 - RNA, 22 nt, Human
agacuggaagccugccaagcaa

SEQ ID NO: 607540 - RNA, 22 nt, Human
gggaggcugccauccuucagga

SEQ ID NO: 607541 - RNA, 22 nt, Human
aauauucauuugcagaagaagu

SEQ ID NO: 607542 - RNA, 22 nt, Human
uucaaaucccugcuccacuauu

SEQ ID NO: 607543 - RNA, 20 nt, Human
gggcagcuccccucauucug

SEQ ID NO: 607544 - RNA, 22 nt, Human
agggcauuggcacagaucugcu

SEQ ID NO: 607545 - RNA, 22 nt, Human
ugggaagggagaguguccugga

SEQ ID NO: 607546 - RNA, 22 nt, Human
guuuaucuuaauggacucagag

SEQ ID NO: 607547 - RNA, 22 nt, Human
agucccagaucuacaggaggga

SEQ ID NO: 607548 - RNA, 22 nt, Human
agaagcacgguuuugucuagca

SEQ ID NO: 607549 - RNA, 22 nt, Human
ucccagacaaucauuggccacc

SEQ ID NO: 607550 - RNA, 22 nt, Human
aggcuccaaauuaccaagcucu

SEQ ID NO: 607551 - RNA, 22 nt, Human
ugguuuuaaaagauguuugaga

SEQ ID NO: 607552 - RNA, 22 nt, Human
uaguaaaugugaaaugugggga

SEQ ID NO: 607553 - RNA, 22 nt, Human
acccagaggugucuagcaagcu

SEQ ID NO: 607554 - RNA, 22 nt, Human
cuccagaggaugcaggugaggg

SEQ ID NO: 607555 - RNA, 22 nt, Human
uagcaccugugcacaccaggca

SEQ ID NO: 607556 - RNA, 22 nt, Human
uagggcuauaagagaauaagac

SEQ ID NO: 607557 - RNA, 23 nt, Human
uggcagugaucaaaagcuuacau

SEQ ID NO: 607558 - RNA, 22 nt, Human
uuauuacaaugcagaaaauaga

SEQ ID NO: 607559 - RNA, 22 nt, Human
aggaggugcuagagaagauguu

SEQ ID NO: 607560 - RNA, 22 nt, Human
gugggacagucagaagugagca

SEQ ID NO: 607561 - RNA, 22 nt, Human
uuagaaucuaacauucuuaucu

SEQ ID NO: 607562 - RNA, 22 nt, Human
cacccauguuucccucugucuu

SEQ ID NO: 607563 - RNA, 22 nt, Human
aaagaggcucaaggugggccag

SEQ ID NO: 607564 - RNA, 22 nt, Human
uagacauuuggcaugguuuuca

SEQ ID NO: 607565 - RNA, 22 nt, Human
aucuauacccaucaugauuuaa

SEQ ID NO: 607566 - RNA, 22 nt, Human
guggcugguuuccugcaugcaa

SEQ ID NO: 607567 - RNA, 21 nt, Human
agccaggcaagcacccccacu

SEQ ID NO: 607568 - RNA, 22 nt, Human
gcaguaaauaauuuuguguaua

SEQ ID NO: 607569 - RNA, 22 nt, Human
ggugccagugggucucaggaua

SEQ ID NO: 607570 - RNA, 22 nt, Human
ugggcucucuggcaggaaggcu

SEQ ID NO: 607571 - RNA, 22 nt, Human
ccagguguggggaggacucaca

SEQ ID NO: 607572 - RNA, 22 nt, Human
gggccugccauugcugccccag

SEQ ID NO: 607573 - RNA, 22 nt, Human
ugguuuuauuuauguugaguca

SEQ ID NO: 607574 - RNA, 20 nt, Human
acuccagguggcaugaggac

SEQ ID NO: 607575 - RNA, 22 nt, Human
uagcauuuagaacaccuugaga

SEQ ID NO: 607576 - RNA, 22 nt, Human
aagucauuaucucuucuaaucu

SEQ ID NO: 607577 - RNA, 22 nt, Human
ugugaggccuagacagccuggg

SEQ ID NO: 607578 - RNA, 22 nt, Human
cagcugccuucugcgggaaguc

SEQ ID NO: 607579 - RNA, 22 nt, Human
agauaugacuagaagcucauuu

SEQ ID NO: 607580 - RNA, 22 nt, Human
ucugauaaugugcuucgugacc

SEQ ID NO: 607581 - RNA, 22 nt, Human
gcuucagauuccucuucuguaa

SEQ ID NO: 607582 - RNA, 22 nt, Human
gaggcagcuuggggcugugggu

SEQ ID NO: 607583 - RNA, 22 nt, Human
ucugcuuuagaauccaguagcu

SEQ ID NO: 607584 - RNA, 17 nt, Human
uccagcccugcccgacg

SEQ ID NO: 607585 - RNA, 22 nt, Human
acaggaacagcuugauggcauc

SEQ ID NO: 607586 - RNA, 22 nt, Human
agccagagauccaucccuagga

SEQ ID NO: 607587 - RNA, 22 nt, Human
augacacccccacagcauuguu

SEQ ID NO: 607588 - RNA, 22 nt, Human
gggcacugacagggucccaacu

SEQ ID NO: 607589 - RNA, 22 nt, Human
gcagugauuggaucagagaugg

SEQ ID NO: 607590 - RNA, 22 nt, Human
cugagcagucugacucaagcua

SEQ ID NO: 607591 - RNA, 22 nt, Human
ucaguucugaaguucugccucc

SEQ ID NO: 607592 - RNA, 23 nt, Human
cuagggcaguauuucacagacac

SEQ ID NO: 607593 - RNA, 19 nt, Human
ccaggaccuuuccaggguc

SEQ ID NO: 607594 - RNA, 22 nt, Human
gcccuccccucuggguggugag

SEQ ID NO: 607595 - RNA, 22 nt, Human
uaaaggguagguuuuacuguaa

SEQ ID NO: 607596 - RNA, 22 nt, Human
ggaaucuuugaaggauuuuaag

SEQ ID NO: 607597 - RNA, 22 nt, Human
uccagggccugagguugaagug

SEQ ID NO: 607598 - RNA, 21 nt, Human
uaacuuuugugccuaucuugu

SEQ ID NO: 607599 - RNA, 22 nt, Human
gacagggcugugggaggagcag

SEQ ID NO: 607600 - RNA, 22 nt, Human
uucugucucuguguuuacauua

SEQ ID NO: 607601 - RNA, 22 nt, Human
agagcugugaaaaugagguuug

SEQ ID NO: 607602 - RNA, 22 nt, Human
cagaggcugauggcuguagcca

SEQ ID NO: 607603 - RNA, 22 nt, Human
ugugaaauguguguauaauuaa

SEQ ID NO: 607604 - RNA, 22 nt, Human
cucaagaagagggagaccuaca

SEQ ID NO: 607605 - RNA, 22 nt, Human
gaaaacuaacggaaaaguuagg

SEQ ID NO: 607606 - RNA, 22 nt, Human
aggaagugaaagggaaggaguu

SEQ ID NO: 607607 - RNA, 22 nt, Human
uuuuaugagaaugcgccacuug

SEQ ID NO: 607608 - RNA, 18 nt, Human
agucuuguucuguugccc

SEQ ID NO: 607609 - RNA, 22 nt, Human
ccaggcugggcggggaaccugg

SEQ ID NO: 607610 - RNA, 22 nt, Human
auggaagcugaaaaagacacgg

SEQ ID NO: 607611 - RNA, 22 nt, Human
gcagaggacucaaucaagguau

SEQ ID NO: 607612 - RNA, 22 nt, Human
gaaauauacaugaagucggcug

SEQ ID NO: 607613 - RNA, 22 nt, Human
aaagaacuuauccuagaauuug

SEQ ID NO: 607614 - RNA, 22 nt, Human
cuaguggaaacuaacuggaauu

SEQ ID NO: 607615 - RNA, 22 nt, Human
auggcucugcugggcaaagcaa

SEQ ID NO: 607616 - RNA, 21 nt, Human
aucauucuggaaaauucaagc

SEQ ID NO: 607617 - RNA, 22 nt, Human
cuggaucuguuugugcuugugg

SEQ ID NO: 607618 - RNA, 22 nt, Human
uguacauacauagauauacaca

SEQ ID NO: 607619 - RNA, 22 nt, Human
ucucccagaaguccucaguaca

SEQ ID NO: 607620 - RNA, 22 nt, Human
aacaauaacuagacaugccaug

SEQ ID NO: 607621 - RNA, 22 nt, Human
agaaacuguguuacuagaaugu

SEQ ID NO: 607622 - RNA, 22 nt, Human
ccugggugaugugcugcccucg

SEQ ID NO: 607623 - RNA, 22 nt, Human
uggcucuggauuaaucuaggaa

SEQ ID NO: 607624 - RNA, 22 nt, Human
uacacagaggcagcugucugcu

SEQ ID NO: 607625 - RNA, 22 nt, Human
uggcagaguucgcugugccuuu

SEQ ID NO: 607626 - RNA, 22 nt, Human
uuuacaccauuagaagcuacuu

SEQ ID NO: 607627 - RNA, 22 nt, Human
uguuuauagggucugucacuug

SEQ ID NO: 607628 - RNA, 22 nt, Human
uuuaucugagcugauagauagu

SEQ ID NO: 607629 - RNA, 22 nt, Human
uauguauccguguguguacaga

SEQ ID NO: 607630 - RNA, 19 nt, Human
aggcacagguugucuggac

SEQ ID NO: 607631 - RNA, 22 nt, Human
accagagcuggcucugagcacc

SEQ ID NO: 607632 - RNA, 22 nt, Human
ucaugcugugaacuguauacau

SEQ ID NO: 607633 - RNA, 22 nt, Human
cugagagucaguggaguggugu

SEQ ID NO: 607634 - RNA, 22 nt, Human
augcagagcuuccaguggccug

SEQ ID NO: 607635 - RNA, 22 nt, Human
cucuacucuuaacacagcuagg

SEQ ID NO: 607636 - RNA, 22 nt, Human
guuucucuuaacacauaaagua

SEQ ID NO: 607637 - RNA, 22 nt, Human
agcagcacccagagccaugucu

SEQ ID NO: 607638 - RNA, 22 nt, Human
agagacugcgugucagcgcugg

SEQ ID NO: 607639 - RNA, 22 nt, Human
acaguaccugcucucaagcaaa

SEQ ID NO: 607640 - RNA, 18 nt, Human
ggcugagguugacuagaa

SEQ ID NO: 607641 - RNA, 22 nt, Human
auucugucuuuuuaaaauaaua

SEQ ID NO: 607642 - RNA, 22 nt, Human
ccaguccuaguucuaccuuaca

SEQ ID NO: 607643 - RNA, 17 nt, Human
gggcagggacuccuggg

SEQ ID NO: 607644 - RNA, 22 nt, Human
cugcagugccugccacugagcc

SEQ ID NO: 607645 - RNA, 22 nt, Human
gguggaaggccuggaaggaggc

SEQ ID NO: 607646 - RNA, 22 nt, Human
ccagagccugcugagccccauu

SEQ ID NO: 607647 - RNA, 22 nt, Human
gcugcuuuacugaagagauaug

SEQ ID NO: 607648 - RNA, 22 nt, Human
caggaggccaacugugggacuu

SEQ ID NO: 607649 - RNA, 22 nt, Human
ugugcagaguaaggcagcuguu

SEQ ID NO: 607650 - RNA, 22 nt, Human
acccagucauccuggugugaga

SEQ ID NO: 607651 - RNA, 22 nt, Human
ggggccagguccagcuuccaaa

SEQ ID NO: 607652 - RNA, 22 nt, Human
ggaggccaggaaggcucggaga

SEQ ID NO: 607653 - RNA, 22 nt, Human
gcuggagucccugccuuuccuu

SEQ ID NO: 607654 - RNA, 22 nt, Human
acagguggcauaggcaguuuga

SEQ ID NO: 607655 - RNA, 22 nt, Human
ugugccaggcacuugcccaggc

SEQ ID NO: 607656 - RNA, 22 nt, Human
uccaggaggcagggcugugccc

SEQ ID NO: 607657 - RNA, 23 nt, Human
ucuuccugaacuaucaggcacau

SEQ ID NO: 607658 - RNA, 22 nt, Human
ucuuuacaguccucugucaauc

SEQ ID NO: 607659 - RNA, 22 nt, Human
gauauuuaacucucacaggucc

SEQ ID NO: 607660 - RNA, 22 nt, Human
aggagggagaugcccauccugg

SEQ ID NO: 607661 - RNA, 22 nt, Human
ggacugggauucuggaucugcu

SEQ ID NO: 607662 - RNA, 22 nt, Human
aaggcagggaaaguggauuagg

SEQ ID NO: 607663 - RNA, 22 nt, Human
aggcugaggaucccuguguucu

SEQ ID NO: 607664 - RNA, 22 nt, Human
aagaauuuuccagcaugucagu

SEQ ID NO: 607665 - RNA, 22 nt, Human
gauauuuuugcagacaccuggg

SEQ ID NO: 607666 - RNA, 22 nt, Human
guuacaaaugccaaagcugaga

SEQ ID NO: 607667 - RNA, 22 nt, Human
cuuuggaacauacugcugagcu

SEQ ID NO: 607668 - RNA, 22 nt, Human
aggcaaggugcuacagacagug

SEQ ID NO: 607669 - RNA, 23 nt, Human
auauaaacaccagauagauugua

SEQ ID NO: 607670 - RNA, 22 nt, Human
cacaagacuuauuuguguagaa

SEQ ID NO: 607671 - RNA, 22 nt, Human
gggcauggccaggugagggguc

SEQ ID NO: 607672 - RNA, 22 nt, Human
uuucaguuacugcuauaucauu

SEQ ID NO: 607673 - RNA, 22 nt, Human
cacagcugaaguagccaugugg

SEQ ID NO: 607674 - RNA, 22 nt, Human
uuugcauuuguucaaguauuga

SEQ ID NO: 607675 - RNA, 22 nt, Human
cugaauccacacaaggugaugg

SEQ ID NO: 607676 - RNA, 22 nt, Human
uggagugggcaauguaggcaag

SEQ ID NO: 607677 - RNA, 22 nt, Human
ugugucccuuggaaccucagcu

SEQ ID NO: 607678 - RNA, 22 nt, Human
agacugaaacaaucugcaggca

SEQ ID NO: 607679 - RNA, 22 nt, Human
cagucccaggguugguucagcu

SEQ ID NO: 607680 - RNA, 22 nt, Human
aagggaggccagagguuuugca

SEQ ID NO: 607681 - RNA, 22 nt, Human
agccaaggucgccccagggcaa

SEQ ID NO: 607682 - RNA, 22 nt, Human
agagcaggcauaaagcuuugaa

SEQ ID NO: 607683 - RNA, 22 nt, Human
acugcugauauaagaaaagauu

SEQ ID NO: 607684 - RNA, 23 nt, Human
gcucaucaggcuuagagucaagg

SEQ ID NO: 607685 - RNA, 18 nt, Human
caggaugagugaugggga

SEQ ID NO: 607686 - RNA, 22 nt, Human
uccugggguuuuggccgcagcu

SEQ ID NO: 607687 - RNA, 22 nt, Human
ccaggagguggagauugcagug

SEQ ID NO: 607688 - RNA, 19 nt, Human
ggcagcaagcucugaaggc

SEQ ID NO: 607689 - RNA, 22 nt, Human
uccuccagcaggacugaggccc

SEQ ID NO: 607690 - RNA, 22 nt, Human
aguggggccgcgguccugcccu

SEQ ID NO: 607691 - RNA, 22 nt, Human
ggccaggagcaagccaggcucu

SEQ ID NO: 607692 - RNA, 22 nt, Human
uggaaagaaaaacaggccauga

SEQ ID NO: 607693 - RNA, 23 nt, Human
uggagaugccccacucccugucu

SEQ ID NO: 607694 - RNA, 22 nt, Human
gaagaauauggcucucagcaau

SEQ ID NO: 607695 - RNA, 22 nt, Human
ccaguguuuacaguugaacaaa

SEQ ID NO: 607696 - RNA, 22 nt, Human
ugaaagcacugauucucaacuc

SEQ ID NO: 607697 - RNA, 22 nt, Human
auugcaaauaacuguacugaau

SEQ ID NO: 607698 - RNA, 22 nt, Human
caaggcugugcaggguccauau

SEQ ID NO: 607699 - RNA, 22 nt, Human
uaaguguugguaauuacaauga

SEQ ID NO: 607700 - RNA, 22 nt, Human
cugcuuuaauguaagauauacc

SEQ ID NO: 607701 - RNA, 23 nt, Human
cuggggcucauugcaguagccau

SEQ ID NO: 607702 - RNA, 22 nt, Human
gcucugugccacaugcaguguu

SEQ ID NO: 607703 - RNA, 22 nt, Human
agcuuuguuucacauacaccuu

SEQ ID NO: 607704 - RNA, 22 nt, Human
guccucagggaauguggcgggu

SEQ ID NO: 607705 - RNA, 22 nt, Human
cugugcaguggcagcguguggg

SEQ ID NO: 607706 - RNA, 22 nt, Human
acagcagcuaaaggugucuccu

SEQ ID NO: 607707 - RNA, 22 nt, Human
auucaguuccuugugauuguag

SEQ ID NO: 607708 - RNA, 22 nt, Human
ucugaaaauguugacuuuguuu

SEQ ID NO: 607709 - RNA, 22 nt, Human
aggcucugggaagcagugaguu

SEQ ID NO: 607710 - RNA, 22 nt, Human
ucaauucaacacaugcacauug

SEQ ID NO: 607711 - RNA, 22 nt, Human
agagcugccgagcuggggccau

SEQ ID NO: 607712 - RNA, 22 nt, Human
acaauguagaggcugaaagcaa

SEQ ID NO: 607713 - RNA, 22 nt, Human
cagcccucaucucagcuucuuu

SEQ ID NO: 607714 - RNA, 22 nt, Human
ggagagagaugccgccuugcuc

SEQ ID NO: 607715 - RNA, 22 nt, Human
auggguaggauuuacucagaug

SEQ ID NO: 607716 - RNA, 22 nt, Human
aagccaguguccagaaugggca

SEQ ID NO: 607717 - RNA, 22 nt, Human
uaaaacagcagggcagagaagu

SEQ ID NO: 607718 - RNA, 22 nt, Human
ccuggggagccgccugagcccc

SEQ ID NO: 607719 - RNA, 22 nt, Human
uaacaauacccauucuaauuac

SEQ ID NO: 607720 - RNA, 22 nt, Human
cuaggcacuuguaaggccgcuc

SEQ ID NO: 607721 - RNA, 22 nt, Human
agaggagcugggaggcccucgu

SEQ ID NO: 607722 - RNA, 22 nt, Human
agggggugaaugucugucuaca

SEQ ID NO: 607723 - RNA, 21 nt, Human
acuguuaagacguagcugggg

SEQ ID NO: 607724 - RNA, 22 nt, Human
acuuguguaacacagaaagaac

SEQ ID NO: 607725 - RNA, 22 nt, Human
agggaugguggaggaauuucaa

SEQ ID NO: 607726 - RNA, 22 nt, Human
uuagaaagaacuuuagauauca

SEQ ID NO: 607727 - RNA, 22 nt, Human
agcuugggcaacacagcaagac

SEQ ID NO: 607728 - RNA, 19 nt, Human
gcacacaguagggcuggca

SEQ ID NO: 607729 - RNA, 22 nt, Human
ucaguucucucaugccugcccu

SEQ ID NO: 607730 - RNA, 22 nt, Human
uuuguacagugauguuguaugc

SEQ ID NO: 607731 - RNA, 22 nt, Human
gucuuguuugggauguggaugg

SEQ ID NO: 607732 - RNA, 22 nt, Human
aauucugaugaauaaaucaucc

SEQ ID NO: 607733 - RNA, 22 nt, Human
uauacacaaggugugcauuugu

SEQ ID NO: 607734 - RNA, 20 nt, Human
ccugaagaguuucucuuucu

SEQ ID NO: 607735 - RNA, 22 nt, Human
gugugugugcauauaacauaua

SEQ ID NO: 607736 - RNA, 19 nt, Human
agcuccugggcucugggcc

SEQ ID NO: 607737 - RNA, 22 nt, Human
uuggcucuuuccucacacagga

SEQ ID NO: 607738 - RNA, 22 nt, Human
cugggaagaaauugugggaggc

SEQ ID NO: 607739 - RNA, 22 nt, Human
ucuggaguggcagucaucugaa

SEQ ID NO: 607740 - RNA, 22 nt, Human
ccuggccugugaaucugagagc

SEQ ID NO: 607741 - RNA, 22 nt, Human
uuccuuucugucagccugagug

SEQ ID NO: 607742 - RNA, 22 nt, Human
gucugcccggccuuccuccacc

SEQ ID NO: 607743 - RNA, 22 nt, Human
ggccacagaacagcuacaggac

SEQ ID NO: 607744 - RNA, 22 nt, Human
uugcagagugguugugaggauu

SEQ ID NO: 607745 - RNA, 22 nt, Human
cagagacaggaucucgaagacu

SEQ ID NO: 607746 - RNA, 21 nt, Human
caucuuagguuguacauauau

SEQ ID NO: 607747 - RNA, 18 nt, Human
gggaggccccagcaggag

SEQ ID NO: 607748 - RNA, 22 nt, Human
gagguggcgcgccaucccugcc

SEQ ID NO: 607749 - RNA, 22 nt, Human
accuuagaaaaucaaaauuaga

SEQ ID NO: 607750 - RNA, 22 nt, Human
uacuuacauuucuguaaucggc

SEQ ID NO: 607751 - RNA, 19 nt, Human
ugaguguguguuucucuaa

SEQ ID NO: 607752 - RNA, 22 nt, Human
agcugggcuuggccaggucgcu

SEQ ID NO: 607753 - RNA, 22 nt, Human
ugcugccuuuguggggucacug

SEQ ID NO: 607754 - RNA, 21 nt, Human
ucacaggucaaugugugaagg

SEQ ID NO: 607755 - RNA, 22 nt, Human
ucugggcuuuuccaugccugug

SEQ ID NO: 607756 - RNA, 22 nt, Human
uacuaugugaaaauacuauagu

SEQ ID NO: 607757 - RNA, 22 nt, Human
aacacagaagugccaagagcca

SEQ ID NO: 607758 - RNA, 22 nt, Human
gaccagcuacuuguacaguuca

SEQ ID NO: 607759 - RNA, 22 nt, Human
agacggauuaccugaggucagg

SEQ ID NO: 607760 - RNA, 22 nt, Human
gcagcucuggggcaggccugag

SEQ ID NO: 607761 - RNA, 22 nt, Human
ucugggcugcuucagccuucgc

SEQ ID NO: 607762 - RNA, 22 nt, Human
uaauaauuuuaaagaaggcuag

SEQ ID NO: 607763 - RNA, 22 nt, Human
cguuuauuuugaagauuccacu

SEQ ID NO: 607764 - RNA, 22 nt, Human
cagcuguggagauggggugcau

SEQ ID NO: 607765 - RNA, 22 nt, Human
cuccuuccugcagaucugagau

SEQ ID NO: 607766 - RNA, 22 nt, Human
aagagggaggugcgggugcaga

SEQ ID NO: 607767 - RNA, 22 nt, Human
uuugaugaaagcuacuauuuac

SEQ ID NO: 607768 - RNA, 22 nt, Human
ccagcugcuaucaugccauuuc

SEQ ID NO: 607769 - RNA, 23 nt, Human
aguggcugagaguguuucauaug

SEQ ID NO: 607770 - RNA, 22 nt, Human
uuggaugagguugagaaucauu

SEQ ID NO: 607771 - RNA, 22 nt, Human
gggacauggaggcgcgcaggca

SEQ ID NO: 607772 - RNA, 22 nt, Human
cugcagggcuguggucuggagu

SEQ ID NO: 607773 - RNA, 22 nt, Human
aaccaaggacagcuagugaugc

SEQ ID NO: 607774 - RNA, 22 nt, Human
agaagcagcuuucaaggugauu

SEQ ID NO: 607775 - RNA, 20 nt, Human
cucaguguggccugaguguu

SEQ ID NO: 607776 - RNA, 22 nt, Human
gaauaucuuguacaucuaagua

SEQ ID NO: 607777 - RNA, 20 nt, Human
caucagugccugacaggucc

SEQ ID NO: 607778 - RNA, 22 nt, Human
ggcuucugaaccaggcccugga

SEQ ID NO: 607779 - RNA, 22 nt, Human
gcacugcaucuacuggcaagua

SEQ ID NO: 607780 - RNA, 22 nt, Human
caagauuuauauuuucacacaa

SEQ ID NO: 607781 - RNA, 22 nt, Human
uguuaaaaaugcagauuccuau

SEQ ID NO: 607782 - RNA, 22 nt, Human
auugucuuuggugcuuccagga

SEQ ID NO: 607783 - RNA, 22 nt, Human
ggcaggggugaggccacucuga

SEQ ID NO: 607784 - RNA, 22 nt, Human
cacaggcuccggccuugcagcc

SEQ ID NO: 607785 - RNA, 22 nt, Human
gaucaauacuauuaagaucaua

SEQ ID NO: 607786 - RNA, 22 nt, Human
gugaggcagaaguucccuuuua

SEQ ID NO: 607787 - RNA, 22 nt, Human
uccuuucucccagguuaguugu

SEQ ID NO: 607788 - RNA, 22 nt, Human
ccuggggaagucacuucucuuu

SEQ ID NO: 607789 - RNA, 19 nt, Human
uccaggagcaaagccaguu

SEQ ID NO: 607790 - RNA, 22 nt, Human
ggcugagcacuuuaggcaggag

SEQ ID NO: 607791 - RNA, 22 nt, Human
ggcacagggggcugaggacuag

SEQ ID NO: 607792 - RNA, 22 nt, Human
caguuuccuuguuuaccuacug

SEQ ID NO: 607793 - RNA, 22 nt, Human
aaagauuauggcauugaaauac

SEQ ID NO: 607794 - RNA, 22 nt, Human
cuacugaaacucagaaauucaa

SEQ ID NO: 607795 - RNA, 22 nt, Human
auugcacaaagagggaaacuga

SEQ ID NO: 607796 - RNA, 22 nt, Human
gaccagcucucugaagaaagag

SEQ ID NO: 607797 - RNA, 22 nt, Human
caguguguggauccucccagga

SEQ ID NO: 607798 - RNA, 22 nt, Human
aguguuucaauccuagggguug

SEQ ID NO: 607799 - RNA, 22 nt, Human
aaggcugcuuuuaacaugcaua

SEQ ID NO: 607800 - RNA, 22 nt, Human
auauaguaagcagucuguaaau

SEQ ID NO: 607801 - RNA, 22 nt, Human
acuguguauucuaaugacuaaa

SEQ ID NO: 607802 - RNA, 22 nt, Human
ccucucuuggccgcagucuucu

SEQ ID NO: 607803 - RNA, 22 nt, Human
aagagccagcuagugaagaggc

SEQ ID NO: 607804 - RNA, 22 nt, Human
gcaggacaggcguugguccagu

SEQ ID NO: 607805 - RNA, 22 nt, Human
gcuggagauagaauggccacug

SEQ ID NO: 607806 - RNA, 22 nt, Human
ggcugcaguuugucuuuugcuu

SEQ ID NO: 607807 - RNA, 22 nt, Human
uagaaguucaugcgaauuauuu

SEQ ID NO: 607808 - RNA, 22 nt, Human
aucaaagaaugugacugaaaua

SEQ ID NO: 607809 - RNA, 22 nt, Human
uggaggauuaaucuggaaagau

SEQ ID NO: 607810 - RNA, 22 nt, Human
cuaggcugagcugggcugagcu

SEQ ID NO: 607811 - RNA, 22 nt, Human
cucugggcacuguauggguucu

SEQ ID NO: 607812 - RNA, 22 nt, Human
agauaggccauuaagaaggaua

SEQ ID NO: 607813 - RNA, 22 nt, Human
ggccagcuucucugcugccugu

SEQ ID NO: 607814 - RNA, 22 nt, Human
agaagccacuggagguugagau

SEQ ID NO: 607815 - RNA, 19 nt, Human
agccaggguccagacaugu

SEQ ID NO: 607816 - RNA, 22 nt, Human
aauuuauuuccugccaguacac

SEQ ID NO: 607817 - RNA, 20 nt, Human
acacaugugcguguucagua

SEQ ID NO: 607818 - RNA, 22 nt, Human
gccucagggggagaggccagcu

SEQ ID NO: 607819 - RNA, 22 nt, Human
uaauccaauggcacaauguaug

SEQ ID NO: 607820 - RNA, 22 nt, Human
aaagccacugcauguguaguau

SEQ ID NO: 607821 - RNA, 22 nt, Human
cugguuccaggauggaucuuuc

SEQ ID NO: 607822 - RNA, 22 nt, Human
agauacaccggaaccugaggcu

SEQ ID NO: 607823 - RNA, 22 nt, Human
ggaaaacuguauuugaauaacu

SEQ ID NO: 607824 - RNA, 22 nt, Human
agaggcuggguacgggccaccu

SEQ ID NO: 607825 - RNA, 22 nt, Human
accaucuuuuccucugccuccu

SEQ ID NO: 607826 - RNA, 21 nt, Human
gagugggacaugggagugguu

SEQ ID NO: 607827 - RNA, 22 nt, Human
agccucugauggcucccaagga

SEQ ID NO: 607828 - RNA, 23 nt, Human
cugugcccggggcuccaccugau

SEQ ID NO: 607829 - RNA, 22 nt, Human
uuguggggaggauuugaugaga

SEQ ID NO: 607830 - RNA, 22 nt, Human
uauguauaugguagaaguaugu

SEQ ID NO: 607831 - RNA, 22 nt, Human
auuccuucuaaaacgcugcccu

SEQ ID NO: 607832 - RNA, 22 nt, Human
ucagcuuuuuacaugugaaaua

SEQ ID NO: 607833 - RNA, 22 nt, Human
cagcuccugggccaucuccuag

SEQ ID NO: 607834 - RNA, 22 nt, Human
ggaggugggagacauaggcggc

SEQ ID NO: 607835 - RNA, 22 nt, Human
auggagcuguagggagcagugg

SEQ ID NO: 607836 - RNA, 22 nt, Human
agcauccagcauccuauagaaa

SEQ ID NO: 607837 - RNA, 22 nt, Human
uuccaaaugaguuccaucgaau

SEQ ID NO: 607838 - RNA, 22 nt, Human
gaaggcagguuuuucaaaacug

SEQ ID NO: 607839 - RNA, 22 nt, Human
agcugguggggaagcugcaggu

SEQ ID NO: 607840 - RNA, 22 nt, Human
acaguguucuuggcgcugagug

SEQ ID NO: 607841 - RNA, 22 nt, Human
ugcauggaacggucuccugguc

SEQ ID NO: 607842 - RNA, 22 nt, Human
uggucucuguaggcuaccccau

SEQ ID NO: 607843 - RNA, 22 nt, Human
cagcccagcacuaaguagauuu

SEQ ID NO: 607844 - RNA, 22 nt, Human
uggaauaacucaccaaggucau

SEQ ID NO: 607845 - RNA, 22 nt, Human
acacugaagagcacuuucaaag

SEQ ID NO: 607846 - RNA, 22 nt, Human
cugaggcagaaaaagcaagggu

SEQ ID NO: 607847 - RNA, 22 nt, Human
gcucucugaggugcuggcagag

SEQ ID NO: 607848 - RNA, 22 nt, Human
uuuuugaaggcugaugugauua

SEQ ID NO: 607849 - RNA, 22 nt, Human
caugauagguauuuaauuaaau

SEQ ID NO: 607850 - RNA, 22 nt, Human
cuaagaagucaggggacagagg

SEQ ID NO: 607851 - RNA, 22 nt, Human
aggccaggcgagacacccggcu

SEQ ID NO: 607852 - RNA, 19 nt, Human
uuacaucugcaacacuggu

SEQ ID NO: 607853 - RNA, 22 nt, Human
uuugacagugcugcuaaaaugc

SEQ ID NO: 607854 - RNA, 22 nt, Human
aaaauugaggcucauguuaaau

SEQ ID NO: 607855 - RNA, 22 nt, Human
gcacugaugcaaaaaucacuca

SEQ ID NO: 607856 - RNA, 22 nt, Human
uuucaguguguaaauugaaaua

SEQ ID NO: 607857 - RNA, 22 nt, Human
cucugcuucauccaccacuggc

SEQ ID NO: 607858 - RNA, 22 nt, Human
ugcagccuuuagaaguucagau

SEQ ID NO: 607859 - RNA, 22 nt, Human
acauuccugaggaaauacauuc

SEQ ID NO: 607860 - RNA, 22 nt, Human
ucucauucauccaaggauuuau

SEQ ID NO: 607861 - RNA, 22 nt, Human
uacaaagcuuguacugugugac

SEQ ID NO: 607862 - RNA, 22 nt, Human
gggcuccaaccccagugaacuc

SEQ ID NO: 607863 - RNA, 19 nt, Human
cuagggcuuggcagcaggc

SEQ ID NO: 607864 - RNA, 22 nt, Human
aguaacaguaacaucuuccuag

SEQ ID NO: 607865 - RNA, 22 nt, Human
cauguccuucucauugccucau

SEQ ID NO: 607866 - RNA, 22 nt, Human
uucuuuuacauuaagauuucag

SEQ ID NO: 607867 - RNA, 22 nt, Human
acuguucauuuguccuguaucu

SEQ ID NO: 607868 - RNA, 22 nt, Human
uuaggaaacgcugcuauugacu

SEQ ID NO: 607869 - RNA, 22 nt, Human
cugccagguaaacugcaggaau

SEQ ID NO: 607870 - RNA, 22 nt, Human
accagcacuuccagaggucagg

SEQ ID NO: 607871 - RNA, 22 nt, Human
ugucaaaaagcugggacaagca

SEQ ID NO: 607872 - RNA, 22 nt, Human
uguuaaggggauauagcagggc

SEQ ID NO: 607873 - RNA, 22 nt, Human
uccugggguuuagagggaagug

SEQ ID NO: 607874 - RNA, 22 nt, Human
agacauuuauucacacauuuau

SEQ ID NO: 607875 - RNA, 22 nt, Human
caccaggagccaucaggagucc

SEQ ID NO: 607876 - RNA, 22 nt, Human
cugaggaaugagugaggagcca

SEQ ID NO: 607877 - RNA, 22 nt, Human
uuucuacuucuccugaaugucu

SEQ ID NO: 607878 - RNA, 22 nt, Human
cucccucucuaaggcaaagaga

SEQ ID NO: 607879 - RNA, 22 nt, Human
ucauuuucacacauaaauagca

SEQ ID NO: 607880 - RNA, 22 nt, Human
auuguugagugcuucagcugua

SEQ ID NO: 607881 - RNA, 16 nt, Human
ugggugggaggagcgg

SEQ ID NO: 607882 - RNA, 22 nt, Human
acuggggagagucaugccagca

SEQ ID NO: 607883 - RNA, 18 nt, Human
cuaagaggucguuucuca

SEQ ID NO: 607884 - RNA, 22 nt, Human
gcacagcucgagcucaggaggg

SEQ ID NO: 607885 - RNA, 22 nt, Human
uuuguucuugcaacaguuauua

SEQ ID NO: 607886 - RNA, 22 nt, Human
uaaaacuagaccgugagucuaa

SEQ ID NO: 607887 - RNA, 22 nt, Human
ccugccagccagaucacucgcc

SEQ ID NO: 607888 - RNA, 22 nt, Human
aagcuucaucugaugccgaacu

SEQ ID NO: 607889 - RNA, 22 nt, Human
gugcagagcaagggcugagggc

SEQ ID NO: 607890 - RNA, 22 nt, Human
uauuucuguuuauuuguacauc

SEQ ID NO: 607891 - RNA, 22 nt, Human
agucccaguucgguucuuccuc

SEQ ID NO: 607892 - RNA, 22 nt, Human
cugcuggguuugccuuucacca

SEQ ID NO: 607893 - RNA, 22 nt, Human
ccuggcucucugcagauccugg

SEQ ID NO: 607894 - RNA, 22 nt, Human
cuugcucauuaaguagcucaca

SEQ ID NO: 607895 - RNA, 22 nt, Human
gcugagggaggcugaacugagu

SEQ ID NO: 607896 - RNA, 22 nt, Human
ccaguguugcauaggaugggga

SEQ ID NO: 607897 - RNA, 22 nt, Human
ugggaggagcccucugggaagg

SEQ ID NO: 607898 - RNA, 22 nt, Human
auguguaaugugguauuuuaau

SEQ ID NO: 607899 - RNA, 22 nt, Human
cuggucacuggucucauccagc

SEQ ID NO: 607900 - RNA, 22 nt, Human
ucugcccacugcucugcugccc

SEQ ID NO: 607901 - RNA, 22 nt, Human
agcuuucucuucuuuagaaagu

SEQ ID NO: 607902 - RNA, 22 nt, Human
uggccccaucaagggaugaguu

SEQ ID NO: 607903 - RNA, 22 nt, Human
cuggccugaggucggcuguagg

SEQ ID NO: 607904 - RNA, 19 nt, Human
ggccaccucucuucccagg

SEQ ID NO: 607905 - RNA, 19 nt, Human
agucacagggaagaggaac

SEQ ID NO: 607906 - RNA, 22 nt, Human
gucuuauaguacaauuugaagu

SEQ ID NO: 607907 - RNA, 22 nt, Human
ucuguuagcugucaaaguguuu

SEQ ID NO: 607908 - RNA, 22 nt, Human
ugaacauuggcacaaggcagca

SEQ ID NO: 607909 - RNA, 22 nt, Human
cagaggaguucaguacacagcc

SEQ ID NO: 607910 - RNA, 22 nt, Human
ugcaagacuccucacuuucucu

SEQ ID NO: 607911 - RNA, 22 nt, Human
augucuuugccauaguucauau

SEQ ID NO: 607912 - RNA, 22 nt, Human
caguccaaccugccccuugggc

SEQ ID NO: 607913 - RNA, 22 nt, Human
ucugggugaugaaaugcacugu

SEQ ID NO: 607914 - RNA, 20 nt, Human
uggcuuguuucuaugggcag

SEQ ID NO: 607915 - RNA, 22 nt, Human
caguggaggcucaagugugcuu

SEQ ID NO: 607916 - RNA, 22 nt, Human
ucucauuugugugcaauucaga

SEQ ID NO: 607917 - RNA, 22 nt, Human
gcgguagcucaagcuuguaauc

SEQ ID NO: 607918 - RNA, 22 nt, Human
caaaaguaaucguggcuuuugc

SEQ ID NO: 607919 - RNA, 22 nt, Human
gggaaggagguggcuugaagug

SEQ ID NO: 607920 - RNA, 22 nt, Human
cagugcaggcuuguggccgcag

SEQ ID NO: 607921 - RNA, 22 nt, Human
acagagacugggaugccugccu

SEQ ID NO: 607922 - RNA, 22 nt, Human
ucuucccacugcccaugggcag

SEQ ID NO: 607923 - RNA, 22 nt, Human
ugcugccaccugguggcugaag

SEQ ID NO: 607924 - RNA, 22 nt, Human
uucuuaaucuguguggguucga

SEQ ID NO: 607925 - RNA, 20 nt, Human
acaggagaucugaggaaagg

SEQ ID NO: 607926 - RNA, 22 nt, Human
uuucuucucuaaucucaaugau

SEQ ID NO: 607927 - RNA, 22 nt, Human
aaacuguauagggaaaaguaga

SEQ ID NO: 607928 - RNA, 22 nt, Human
uugaaacaguagcucauagacc

SEQ ID NO: 607929 - RNA, 22 nt, Human
agccagaggaacuugaugacug

SEQ ID NO: 607930 - RNA, 22 nt, Human
agcaggaguguccccuggcugu

SEQ ID NO: 607931 - RNA, 22 nt, Human
gccuccugguugcuucuccaac

SEQ ID NO: 607932 - RNA, 22 nt, Human
gucugaggccugaggcccuggg

SEQ ID NO: 607933 - RNA, 22 nt, Human
augcaguccaagcucuagaguu

SEQ ID NO: 607934 - RNA, 20 nt, Human
uggcuccuggcuccucccuc

SEQ ID NO: 607935 - RNA, 22 nt, Human
auaauuuaauuuucacaguggu

SEQ ID NO: 607936 - RNA, 22 nt, Human
ggcugagcuuauauaugugcug

SEQ ID NO: 607937 - RNA, 22 nt, Human
cagccuuugaacuucagagguu

SEQ ID NO: 607938 - RNA, 22 nt, Human
ugauuaaaauuuaacuuaguua

SEQ ID NO: 607939 - RNA, 22 nt, Human
auucagaauggcaaacuucuag

SEQ ID NO: 607940 - RNA, 22 nt, Human
gcacacagaauugauucacugu

SEQ ID NO: 607941 - RNA, 22 nt, Human
gagcaggaacugaaaaugagac

SEQ ID NO: 607942 - RNA, 22 nt, Human
ucuguaaacaccauguuagagu

SEQ ID NO: 607943 - RNA, 22 nt, Human
uucagcaaacacgaugcuuguu

SEQ ID NO: 607944 - RNA, 22 nt, Human
uuuaguuuuaacugaaagcuau

SEQ ID NO: 607945 - RNA, 22 nt, Human
aaacuucauggauaauauaaag

SEQ ID NO: 607946 - RNA, 22 nt, Human
ugacccugcuucuuggugcagg

SEQ ID NO: 607947 - RNA, 22 nt, Human
ccugaggccccugaggauagca

SEQ ID NO: 607948 - RNA, 22 nt, Human
ccagcucagggucacauggcac

SEQ ID NO: 607949 - RNA, 22 nt, Human
agugagggacuagugcugggga

SEQ ID NO: 607950 - RNA, 22 nt, Human
augcagauaugcaaacuguagu

SEQ ID NO: 607951 - RNA, 22 nt, Human
aaauagauuuccuagcauugga

SEQ ID NO: 607952 - RNA, 22 nt, Human
guucuucagucacaucacagaa

SEQ ID NO: 607953 - RNA, 22 nt, Human
aggccacagucagugggugcug

SEQ ID NO: 607954 - RNA, 22 nt, Human
gcugcaggcauuuuccugggca

SEQ ID NO: 607955 - RNA, 22 nt, Human
aggcacugacagauucuguguc

SEQ ID NO: 607956 - RNA, 22 nt, Human
aacuuaggaaaauaaggcauga

SEQ ID NO: 607957 - RNA, 22 nt, Human
uuucccuugaauaaagauaucu

SEQ ID NO: 607958 - RNA, 22 nt, Human
aggaacaagggagccuuuucuc

SEQ ID NO: 607959 - RNA, 22 nt, Human
ucuccagguggggucaccuuuu

SEQ ID NO: 607960 - RNA, 22 nt, Human
cagggccaagcugcagcaucug

SEQ ID NO: 607961 - RNA, 18 nt, Human
ggagccagucugucucug

SEQ ID NO: 607962 - RNA, 22 nt, Human
ugagacagucaccaggcaggcc

SEQ ID NO: 607963 - RNA, 22 nt, Human
ucugaaaguaucuggaucuuuu

SEQ ID NO: 607964 - RNA, 22 nt, Human
uacuguuauauauagcagcagu

SEQ ID NO: 607965 - RNA, 22 nt, Human
aagauuaaaggggagacaagcu

SEQ ID NO: 607966 - RNA, 22 nt, Human
ucacccagguaauagcaguuug

SEQ ID NO: 607967 - RNA, 21 nt, Human
agcugagguaaggcaagagag

SEQ ID NO: 607968 - RNA, 22 nt, Human
agcuuugggauucaggcaggaa

SEQ ID NO: 607969 - RNA, 22 nt, Human
aaagacacacagccagcaagug

SEQ ID NO: 607970 - RNA, 22 nt, Human
ugguuucugcccucagagcuca

SEQ ID NO: 607971 - RNA, 22 nt, Human
cagcucagugaugccuucacag

SEQ ID NO: 607972 - RNA, 22 nt, Human
aggcugugggaguugagagucu

SEQ ID NO: 607973 - RNA, 22 nt, Human
ugcuuucaccuguuugcaccca

SEQ ID NO: 607974 - RNA, 22 nt, Human
gcagugcucugccuauaaugga

SEQ ID NO: 607975 - RNA, 22 nt, Human
ucauacaacuaagaguuucaga

SEQ ID NO: 607976 - RNA, 22 nt, Human
ugcauuggaaacucagcagcac

SEQ ID NO: 607977 - RNA, 22 nt, Human
cagcaggaggugagaugugacc

SEQ ID NO: 607978 - RNA, 22 nt, Human
aaagugcacucucagugcugcu

SEQ ID NO: 607979 - RNA, 22 nt, Human
caguuacacaccauugugaaca

SEQ ID NO: 607980 - RNA, 22 nt, Human
caggugaguuuuccuccuuggu

SEQ ID NO: 607981 - RNA, 22 nt, Human
aacacugugcaguguaaugcug

SEQ ID NO: 607982 - RNA, 22 nt, Human
ggcagcaggagccaucugguag

SEQ ID NO: 607983 - RNA, 22 nt, Human
acuuauaagagugcuaugggga

SEQ ID NO: 607984 - RNA, 22 nt, Human
gugggccucuugaggguggcua

SEQ ID NO: 607985 - RNA, 22 nt, Human
uaggaagcuaugggagauguga

SEQ ID NO: 607986 - RNA, 22 nt, Human
uggggcucaugccugcuggaac

SEQ ID NO: 607987 - RNA, 22 nt, Human
ugggacacccucacgccugcac

SEQ ID NO: 607988 - RNA, 22 nt, Human
uuuagaaugugacuguauuuga

SEQ ID NO: 607989 - RNA, 22 nt, Human
aggcacuguucccaguuauccu

SEQ ID NO: 607990 - RNA, 22 nt, Human
uuugagugcccauguuucccag

SEQ ID NO: 607991 - RNA, 22 nt, Human
cugcuuuaacagaugauggugu

SEQ ID NO: 607992 - RNA, 22 nt, Human
aaagguuuauuuguugcucaca

SEQ ID NO: 607993 - RNA, 22 nt, Human
gaauaauagcagaaauuagcag

SEQ ID NO: 607994 - RNA, 22 nt, Human
uucuuggaaauacauucaauaa

SEQ ID NO: 607995 - RNA, 20 nt, Human
agaguaacuggcacauaggg

SEQ ID NO: 607996 - RNA, 22 nt, Human
aaacaguagaaguguauuuuau

SEQ ID NO: 607997 - RNA, 22 nt, Human
acaggccuagcuaaugcuuucc

SEQ ID NO: 607998 - RNA, 20 nt, Human
ggucccugcccucugucauc

SEQ ID NO: 607999 - RNA, 22 nt, Human
ccacuguauaagcaaaaugaaa

SEQ ID NO: 608000 - RNA, 22 nt, Human
augauauuugcaaugugcuugc

SEQ ID NO: 608001 - RNA, 22 nt, Human
ugagcagaauguucagauaaau

SEQ ID NO: 608002 - RNA, 22 nt, Human
uuucacauuagauaugucauuu

SEQ ID NO: 608003 - RNA, 22 nt, Human
cacaggcugggaagccuaggcc

SEQ ID NO: 608004 - RNA, 22 nt, Human
aagcugucaauguaucuagucu

SEQ ID NO: 608005 - RNA, 22 nt, Human
aacauuaagauggcggaacagu

SEQ ID NO: 608006 - RNA, 22 nt, Human
uauuagcuccaguacuguugcc

SEQ ID NO: 608007 - RNA, 22 nt, Human
ugcacagaugcuaggaggugaa

SEQ ID NO: 608008 - RNA, 22 nt, Human
aagagcaucuauuucacagugg

SEQ ID NO: 608009 - RNA, 22 nt, Human
auuuaugacagaagauaugcug

SEQ ID NO: 608010 - RNA, 22 nt, Human
uauguucagaagaagaaugggg

SEQ ID NO: 608011 - RNA, 18 nt, Human
gcuuuauuucuuggggaa

SEQ ID NO: 608012 - RNA, 22 nt, Human
caggcacuggggaugcugggau

SEQ ID NO: 608013 - RNA, 22 nt, Human
ccacuguaaguuugaaaauaac

SEQ ID NO: 608014 - RNA, 19 nt, Human
uugcaguuggguggggagu

SEQ ID NO: 608015 - RNA, 22 nt, Human
gagcugggaguuauagcauguu

SEQ ID NO: 608016 - RNA, 22 nt, Human
cccaggcagggacgugcucugg

SEQ ID NO: 608017 - RNA, 19 nt, Human
ccaggcuuuaugcaaauac

SEQ ID NO: 608018 - RNA, 22 nt, Human
gcugccucacuccagcccaaua

SEQ ID NO: 608019 - RNA, 22 nt, Human
agggccugggccagcacccuuu

SEQ ID NO: 608020 - RNA, 22 nt, Human
acagagacuuggagcaggcuga

SEQ ID NO: 608021 - RNA, 22 nt, Human
cuuccucccggcccaugcucug

SEQ ID NO: 608022 - RNA, 22 nt, Human
gggcugagcuguucugaguuua

SEQ ID NO: 608023 - RNA, 21 nt, Human
uuuguucauagcucacucuuu

SEQ ID NO: 608024 - RNA, 22 nt, Human
uguuugaguucuagcgcauuua

SEQ ID NO: 608025 - RNA, 22 nt, Human
caaaugcauaguuuauaagaag

SEQ ID NO: 608026 - RNA, 22 nt, Human
ugccuucaccaggccuucagcc

SEQ ID NO: 608027 - RNA, 22 nt, Human
cuggggcugcagcgaucuucau

SEQ ID NO: 608028 - RNA, 22 nt, Human
ucucugccacagcuucugccuu

SEQ ID NO: 608029 - RNA, 22 nt, Human
uucuaccagaccccagacuugu

SEQ ID NO: 608030 - RNA, 22 nt, Human
agcuguggcaaccuugucagac

SEQ ID NO: 608031 - RNA, 22 nt, Human
ggugagggaguggaacgaggug

SEQ ID NO: 608032 - RNA, 22 nt, Human
uaugguagaaaaacugaguccc

SEQ ID NO: 608033 - RNA, 23 nt, Human
uuuuuugucuugcuaggcugccc

SEQ ID NO: 608034 - RNA, 22 nt, Human
augaaauaucuugaagaaauuc

SEQ ID NO: 608035 - RNA, 22 nt, Human
guuagcaaugcccaggaaugca

SEQ ID NO: 608036 - RNA, 23 nt, Human
aacacaaagcugauuccaguggc

SEQ ID NO: 608037 - RNA, 22 nt, Human
aaaagcaagaggcuggauuaaa

SEQ ID NO: 608038 - RNA, 22 nt, Human
ggagagcugacaucaugauguu

SEQ ID NO: 608039 - RNA, 22 nt, Human
uaguuacaauuaugcauggaaa

SEQ ID NO: 608040 - RNA, 22 nt, Human
guggccagccccauggacaguu

SEQ ID NO: 608041 - RNA, 22 nt, Human
acugagcucuugacugggaguu

SEQ ID NO: 608042 - RNA, 22 nt, Human
uuuccuuucugguuuggucaua

SEQ ID NO: 608043 - RNA, 22 nt, Human
cagcugccugucuggaggcaau

SEQ ID NO: 608044 - RNA, 22 nt, Human
aauuucaguaugaaguuucaca

SEQ ID NO: 608045 - RNA, 22 nt, Human
guguuuuauuggugcagucaga

SEQ ID NO: 608046 - RNA, 18 nt, Human
uccagcucacagaugggc

SEQ ID NO: 608047 - RNA, 22 nt, Human
cauucacagagggggaagcauc

SEQ ID NO: 608048 - RNA, 19 nt, Human
gccaggcucuuauucugug

SEQ ID NO: 608049 - RNA, 22 nt, Human
uaucaucauuggcaggugagaa

SEQ ID NO: 608050 - RNA, 22 nt, Human
ggcugagacaaccugggaccca

SEQ ID NO: 608051 - RNA, 22 nt, Human
auuaugaaguugagggacccug

SEQ ID NO: 608052 - RNA, 22 nt, Human
agucacccuccaacucuccacu

SEQ ID NO: 608053 - RNA, 22 nt, Human
gugggcagacaugauagaagga

SEQ ID NO: 608054 - RNA, 17 nt, Human
cugaaauauuaugauaa

SEQ ID NO: 608055 - RNA, 19 nt, Human
ccugcagggaugagagguu

SEQ ID NO: 608056 - RNA, 22 nt, Human
cugcccuguuuggacagcccgg

SEQ ID NO: 608057 - RNA, 22 nt, Human
uuuuccuucugauacuccauuu

SEQ ID NO: 608058 - RNA, 22 nt, Human
cugggcucaagaagucuucccu

SEQ ID NO: 608059 - RNA, 22 nt, Human
ggucugagagccacugaauccc

SEQ ID NO: 608060 - RNA, 22 nt, Human
cuucagcaccauagcuccuucu

SEQ ID NO: 608061 - RNA, 20 nt, Human
uuguuuuaaauccuggauga

SEQ ID NO: 608062 - RNA, 22 nt, Human
aaagcaguccuucccuuaaggu

SEQ ID NO: 608063 - RNA, 23 nt, Human
gggaaguggggauuugaagucau

SEQ ID NO: 608064 - RNA, 22 nt, Human
ugguuaaaugcuccgaucuugg

SEQ ID NO: 608065 - RNA, 22 nt, Human
acugauguucagccauguucug

SEQ ID NO: 608066 - RNA, 22 nt, Human
gcauuaauguaagacccacucc

SEQ ID NO: 608067 - RNA, 22 nt, Human
agucuucagagaaauuaacucu

SEQ ID NO: 608068 - RNA, 22 nt, Human
gaggggaagacuucuggacagu

SEQ ID NO: 608069 - RNA, 22 nt, Human
ugucaugaugugcacaccacag

SEQ ID NO: 608070 - RNA, 22 nt, Human
uucauuugcacuggauuacugg

SEQ ID NO: 608071 - RNA, 22 nt, Human
agcuggccuguuagagcugagu

SEQ ID NO: 608072 - RNA, 22 nt, Human
cguguuucagccagggccaccu

SEQ ID NO: 608073 - RNA, 22 nt, Human
uuaggcaugcaagauuaagcuc

SEQ ID NO: 608074 - RNA, 19 nt, Human
gggaugggcccucacccuc

SEQ ID NO: 608075 - RNA, 22 nt, Human
aggaaagguucagugauugaaa

SEQ ID NO: 608076 - RNA, 22 nt, Human
uaauucuagauugacauuuuga

SEQ ID NO: 608077 - RNA, 22 nt, Human
ugcucaguagcagugugcugcu

SEQ ID NO: 608078 - RNA, 22 nt, Human
ucccugccaguccuggucugaa

SEQ ID NO: 608079 - RNA, 22 nt, Human
caggccuggggcuggcuuccag

SEQ ID NO: 608080 - RNA, 19 nt, Human
acccucuccccacuggguc

SEQ ID NO: 608081 - RNA, 22 nt, Human
ugcuucugacuaagcugcauga

SEQ ID NO: 608082 - RNA, 22 nt, Human
ucauuuuucucuuacacguaga

SEQ ID NO: 608083 - RNA, 22 nt, Human
ccagcucuagccccauguggcu

SEQ ID NO: 608084 - RNA, 19 nt, Human
agggcugcucuggccuggg

SEQ ID NO: 608085 - RNA, 22 nt, Human
aagaggaacugggggcugaguc

SEQ ID NO: 608086 - RNA, 22 nt, Human
ggaggcugagaggucgcagugg

SEQ ID NO: 608087 - RNA, 22 nt, Human
ccaugcugacccugugcaggca

SEQ ID NO: 608088 - RNA, 22 nt, Human
agaauucuccuucagggcagga

SEQ ID NO: 608089 - RNA, 21 nt, Human
gucagggauucaagugcucac

SEQ ID NO: 608090 - RNA, 22 nt, Human
ucagaaacacucuucuucuguc

SEQ ID NO: 608091 - RNA, 22 nt, Human
uacauacacaaauauacuguuu

SEQ ID NO: 608092 - RNA, 22 nt, Human
uacaagaaaguccaguggguuu

SEQ ID NO: 608093 - RNA, 22 nt, Human
aggaagaaccuaagaaagucuc

SEQ ID NO: 608094 - RNA, 22 nt, Human
ggcuauggaagauaaggcugaa

SEQ ID NO: 608095 - RNA, 22 nt, Human
uaucuauaaguacuaacauggu

SEQ ID NO: 608096 - RNA, 22 nt, Human
aaugcuuugauugauuaaaaca

SEQ ID NO: 608097 - RNA, 22 nt, Human
cccuucaggguuaaguagaggg

SEQ ID NO: 608098 - RNA, 22 nt, Human
aggcuugaaaugaaaucuguaa

SEQ ID NO: 608099 - RNA, 22 nt, Human
ccagccagcugcccuuggggcc

SEQ ID NO: 608100 - RNA, 22 nt, Human
ucugggaacacacgucacuuca

SEQ ID NO: 608101 - RNA, 22 nt, Human
ccugccucaucaacuugucgug

SEQ ID NO: 608102 - RNA, 22 nt, Human
uccuggcucuaaguccugagug

SEQ ID NO: 608103 - RNA, 22 nt, Human
gccagguggucuggcuccagag

SEQ ID NO: 608104 - RNA, 22 nt, Human
gccaccucucucuugacucgag

SEQ ID NO: 608105 - RNA, 22 nt, Human
gaaggcugaugacagauucugc

SEQ ID NO: 608106 - RNA, 22 nt, Human
gcugcccuccaguucccacagu

SEQ ID NO: 608107 - RNA, 22 nt, Human
auaaaagaaguuuugguacuug

SEQ ID NO: 608108 - RNA, 22 nt, Human
uggggccagagcugcagggagc

SEQ ID NO: 608109 - RNA, 17 nt, Human
acagcagggaaguguug

SEQ ID NO: 608110 - RNA, 22 nt, Human
auccacuuggcugguuguucua

SEQ ID NO: 608111 - RNA, 22 nt, Human
uccagggaaggugugaggcugg

SEQ ID NO: 608112 - RNA, 21 nt, Human
caggaaaagcggaagucuagc

SEQ ID NO: 608113 - RNA, 22 nt, Human
ucaagcaaagauacaaauggaa

SEQ ID NO: 608114 - RNA, 22 nt, Human
cagaccugaggagcacugagcc

SEQ ID NO: 608115 - RNA, 22 nt, Human
ucugaacauuuuuugcagccua

SEQ ID NO: 608116 - RNA, 22 nt, Human
cugcucuaacugcauuaguuuu

SEQ ID NO: 608117 - RNA, 22 nt, Human
ggguagggugacuuaggcuggc

SEQ ID NO: 608118 - RNA, 22 nt, Human
gcuggaggauggacuggaagaa

SEQ ID NO: 608119 - RNA, 22 nt, Human
uagauguuuuaacucuugguua

SEQ ID NO: 608120 - RNA, 21 nt, Human
ccaggcaugacugcagagagc

SEQ ID NO: 608121 - RNA, 22 nt, Human
gggcaucugguggagccucagg

SEQ ID NO: 608122 - RNA, 22 nt, Human
gggcuucuauucaagucuguuu

SEQ ID NO: 608123 - RNA, 20 nt, Human
ucuuuaguuccuggcccuuu

SEQ ID NO: 608124 - RNA, 20 nt, Human
agucuggcaugaugcaggca

SEQ ID NO: 608125 - RNA, 22 nt, Human
aguuuuauggcucaaccuaaua

SEQ ID NO: 608126 - RNA, 22 nt, Human
aucuccgccaucgcgaacgccu

SEQ ID NO: 608127 - RNA, 22 nt, Human
uacuguacucaacaugugaguu

SEQ ID NO: 608128 - RNA, 22 nt, Human
ucaguugccaguauuuuauaua

SEQ ID NO: 608129 - RNA, 22 nt, Human
ugccuggguccaggccaagccu

SEQ ID NO: 608130 - RNA, 22 nt, Human
gguuccugugccucuagcuggc

SEQ ID NO: 608131 - RNA, 23 nt, Human
uuuuaauuuggacauaagaagau

SEQ ID NO: 608132 - RNA, 21 nt, Human
ucugaacaacauacgaaucuu

SEQ ID NO: 608133 - RNA, 22 nt, Human
ugaaacuuauaagaauaugaau

SEQ ID NO: 608134 - RNA, 22 nt, Human
ggaauucuguagcucuuccucu

SEQ ID NO: 608135 - RNA, 22 nt, Human
uucaaguucauguguagucagu

SEQ ID NO: 608136 - RNA, 22 nt, Human
uaccuucucuagaucuuuauuc

SEQ ID NO: 608137 - RNA, 22 nt, Human
cuuuuuauagcuauguccuaug

SEQ ID NO: 608138 - RNA, 22 nt, Human
auuuguaagcuagagccaugau

SEQ ID NO: 608139 - RNA, 22 nt, Human
ucucugugcccaguaguucucu

SEQ ID NO: 608140 - RNA, 22 nt, Human
ucugggagauccaagcagaacu

SEQ ID NO: 608141 - RNA, 22 nt, Human
aaauaaucaauuuuuguagaua

SEQ ID NO: 608142 - RNA, 22 nt, Human
ucugcaggagagugcccuagag

SEQ ID NO: 608143 - RNA, 22 nt, Human
ggaugggagcagaggacgacca

SEQ ID NO: 608144 - RNA, 22 nt, Human
gcagcugaauguccauugcugc

SEQ ID NO: 608145 - RNA, 22 nt, Human
uagagauggggucuugcuauga

SEQ ID NO: 608146 - RNA, 22 nt, Human
ucaggcuuccaggcucugcuga

SEQ ID NO: 608147 - RNA, 22 nt, Human
ccugagugcuuccagagucaug

SEQ ID NO: 608148 - RNA, 22 nt, Human
aggaugggucagcuagagucca

SEQ ID NO: 608149 - RNA, 19 nt, Human
agcagagcagggccguggg

SEQ ID NO: 608150 - RNA, 22 nt, Human
augggcaguguauuggaaggaa

SEQ ID NO: 608151 - RNA, 22 nt, Human
aggagggagcuuaagccaggca

SEQ ID NO: 608152 - RNA, 22 nt, Human
aaucacaguggguacuagauug

SEQ ID NO: 608153 - RNA, 22 nt, Human
ccugggcaacauagggagaccc

SEQ ID NO: 608154 - RNA, 22 nt, Human
aucauuaaauauaagcuucaca

SEQ ID NO: 608155 - RNA, 22 nt, Human
aggguggggugcuacaucuuua

SEQ ID NO: 608156 - RNA, 22 nt, Human
guguucuaauggcugagggaug

SEQ ID NO: 608157 - RNA, 22 nt, Human
uacacagauuucaguaucauca

SEQ ID NO: 608158 - RNA, 22 nt, Human
caaaugcauagaaagaugaaac

SEQ ID NO: 608159 - RNA, 22 nt, Human
agacacuguguacagaaaaaga

SEQ ID NO: 608160 - RNA, 22 nt, Human
gcagcugagagaagaacagggc

SEQ ID NO: 608161 - RNA, 22 nt, Human
acugccugugucccuucagugc

SEQ ID NO: 608162 - RNA, 20 nt, Human
cagaugggacguggaggagu

SEQ ID NO: 608163 - RNA, 22 nt, Human
cuguccuggccgcccuugugag

SEQ ID NO: 608164 - RNA, 22 nt, Human
caccccagcuucucaggauaga

SEQ ID NO: 608165 - RNA, 22 nt, Human
acugucuucaaaugaauauauu

SEQ ID NO: 608166 - RNA, 22 nt, Human
guacaggaaggagggaguuuca

SEQ ID NO: 608167 - RNA, 22 nt, Human
uccaggcugauccaugaagaau

SEQ ID NO: 608168 - RNA, 22 nt, Human
gcucugaggagccaagaaugug

SEQ ID NO: 608169 - RNA, 22 nt, Human
acugcuuugcucugcccccagg

SEQ ID NO: 608170 - RNA, 22 nt, Human
acauccugaagucagucauuug

SEQ ID NO: 608171 - RNA, 22 nt, Human
cugguccucuccagcaggcauu

SEQ ID NO: 608172 - RNA, 22 nt, Human
aaaguuuuuaagcaagacccuu

SEQ ID NO: 608173 - RNA, 22 nt, Human
gagggagagugauggaccauug

SEQ ID NO: 608174 - RNA, 22 nt, Human
gcuacugugaaggagucuuucu

SEQ ID NO: 608175 - RNA, 22 nt, Human
ggugaauaagcugaacacuugg

SEQ ID NO: 608176 - RNA, 22 nt, Human
uauguucugacucuacauggga

SEQ ID NO: 608177 - RNA, 22 nt, Human
uggccuggccacauccagcagg

SEQ ID NO: 608178 - RNA, 18 nt, Human
ggcucagcaggcucucuc

SEQ ID NO: 608179 - RNA, 22 nt, Human
ccugagcuagggaaggaagacc

SEQ ID NO: 608180 - RNA, 22 nt, Human
ugaagauuuccaccaaaucaca

SEQ ID NO: 608181 - RNA, 18 nt, Human
gagcaugggcagugggga

SEQ ID NO: 608182 - RNA, 22 nt, Human
uuuucuagggugcuaaaugaac

SEQ ID NO: 608183 - RNA, 22 nt, Human
uggcccuguguccugcugccag

SEQ ID NO: 608184 - RNA, 22 nt, Human
gcugucugcaucucuagagcuu

SEQ ID NO: 608185 - RNA, 22 nt, Human
aaacaugaugccuguacuaaga

SEQ ID NO: 608186 - RNA, 22 nt, Human
acagaagauaacugggaccaga

SEQ ID NO: 608187 - RNA, 22 nt, Human
ugcccaggcuggaaugcagugg

SEQ ID NO: 608188 - RNA, 22 nt, Human
agugggggccaacgagggcagc

SEQ ID NO: 608189 - RNA, 23 nt, Human
cauggcugauuucaagcuaccac

SEQ ID NO: 608190 - RNA, 22 nt, Human
aaauaauguuaggccuuugcuc

SEQ ID NO: 608191 - RNA, 22 nt, Human
aaaagucugcuuucuauuauca

SEQ ID NO: 608192 - RNA, 22 nt, Human
ugagaauuugugaacuuuucuc

SEQ ID NO: 608193 - RNA, 23 nt, Human
aaguaacagggauaauagcaguu

SEQ ID NO: 608194 - RNA, 22 nt, Human
aaucagaaagaucuugaugaga

SEQ ID NO: 608195 - RNA, 22 nt, Human
ccugccagaaaagagggaguuc

SEQ ID NO: 608196 - RNA, 22 nt, Human
agaggagguggugaugcuuuaa

SEQ ID NO: 608197 - RNA, 22 nt, Human
uggagaugaauauguguaccug

SEQ ID NO: 608198 - RNA, 22 nt, Human
acugggcagggaaggagaccga

SEQ ID NO: 608199 - RNA, 22 nt, Human
aggucuggugagagcaggugcu

SEQ ID NO: 608200 - RNA, 22 nt, Human
agagcugcccacacagcagauu

SEQ ID NO: 608201 - RNA, 22 nt, Human
aaacacugcaggguuuacuuga

SEQ ID NO: 608202 - RNA, 22 nt, Human
caacugagcaguagcgucugga

SEQ ID NO: 608203 - RNA, 22 nt, Human
uuccugagaaauuuguaccugg

SEQ ID NO: 608204 - RNA, 22 nt, Human
agaggcuuccugccaccugaga

SEQ ID NO: 608205 - RNA, 22 nt, Human
ucagcucucugggcucgaaccu

SEQ ID NO: 608206 - RNA, 22 nt, Human
agcccaggucuggcccagccug

SEQ ID NO: 608207 - RNA, 22 nt, Human
ugucaugggucuaaacauugau

SEQ ID NO: 608208 - RNA, 22 nt, Human
ccuggcucagaguaugucaucg

SEQ ID NO: 608209 - RNA, 22 nt, Human
aucagaaaaacauaauguuauu

SEQ ID NO: 608210 - RNA, 22 nt, Human
uuuaguuauuguuacaguauga

SEQ ID NO: 608211 - RNA, 22 nt, Human
guuccuuguaauuuguuaagga

SEQ ID NO: 608212 - RNA, 22 nt, Human
gcugagcuagaaaaggaccaca

SEQ ID NO: 608213 - RNA, 21 nt, Human
gcagccagacgggauucaguu

SEQ ID NO: 608214 - RNA, 22 nt, Human
ggcuugggagcaggcaugugac

SEQ ID NO: 608215 - RNA, 22 nt, Human
gggaguggguuuggccuaggcc

SEQ ID NO: 608216 - RNA, 22 nt, Human
cuggccuggcaggggaccucua

SEQ ID NO: 608217 - RNA, 22 nt, Human
ucugccugugguggaggaaguu

SEQ ID NO: 608218 - RNA, 22 nt, Human
agcaagaugaaggauucaagac

SEQ ID NO: 608219 - RNA, 22 nt, Human
ucugaggcagcuugccacucua

SEQ ID NO: 608220 - RNA, 22 nt, Human
uuucucuauuaggggcuagcuu

SEQ ID NO: 608221 - RNA, 22 nt, Human
uuaauucuaguuuaacacuuag

SEQ ID NO: 608222 - RNA, 22 nt, Human
uuccuucuagagcuuguuuagg

SEQ ID NO: 608223 - RNA, 22 nt, Human
uccuccagcuacuaggcaaaua

SEQ ID NO: 608224 - RNA, 22 nt, Human
aucaucuuaagguaucucaagc

SEQ ID NO: 608225 - RNA, 22 nt, Human
uggcauccagauacccugaggg

SEQ ID NO: 608226 - RNA, 18 nt, Human
gccucuguugcuugccug

SEQ ID NO: 608227 - RNA, 22 nt, Human
gcccagagagaugcuguagacc

SEQ ID NO: 608228 - RNA, 20 nt, Human
cuuggccuacuuagcuuugu

SEQ ID NO: 608229 - RNA, 22 nt, Human
gcuuggccagcagccgggaugc

SEQ ID NO: 608230 - RNA, 21 nt, Human
ugucuuuaggaccuguuaaau

SEQ ID NO: 608231 - RNA, 22 nt, Human
ccaggccugauugggaaucuug

SEQ ID NO: 608232 - RNA, 21 nt, Human
acuuaaauuccuugauauuua

SEQ ID NO: 608233 - RNA, 22 nt, Human
gggaaacucacaggugcagggg

SEQ ID NO: 608234 - RNA, 22 nt, Human
agaggcugaaugaugucaucau

SEQ ID NO: 608235 - RNA, 22 nt, Human
ggggaaacauguuguucagacc

SEQ ID NO: 608236 - RNA, 22 nt, Human
uguggucccaaggcaacuggaa

SEQ ID NO: 608237 - RNA, 22 nt, Human
agcuuuaaaaauccaauaucca

SEQ ID NO: 608238 - RNA, 22 nt, Human
uuccaaauggagaagaugaguu

SEQ ID NO: 608239 - RNA, 22 nt, Human
cagacagggguaaccuuccuca

SEQ ID NO: 608240 - RNA, 22 nt, Human
ccucuuugugccugcaggcugc

SEQ ID NO: 608241 - RNA, 22 nt, Human
aagggccuccuggggagccugg

SEQ ID NO: 608242 - RNA, 22 nt, Human
ggagacuugaguuuuugucuua

SEQ ID NO: 608243 - RNA, 22 nt, Human
ucuuuccauggccacacagucu

SEQ ID NO: 608244 - RNA, 22 nt, Human
gacaggcccgaguagcugauga

SEQ ID NO: 608245 - RNA, 20 nt, Human
ugggaguacaaucaugagca

SEQ ID NO: 608246 - RNA, 22 nt, Human
caagguuugaaaacgccauggc

SEQ ID NO: 608247 - RNA, 22 nt, Human
acugcagccuagggaccacagu

SEQ ID NO: 608248 - RNA, 22 nt, Human
uaaacagagaugccugggucug

SEQ ID NO: 608249 - RNA, 22 nt, Human
gauuuauuggucuuucauuggu

SEQ ID NO: 608250 - RNA, 22 nt, Human
augggcugaaagaguaagcugu

SEQ ID NO: 608251 - RNA, 22 nt, Human
cagaggcugacccugcuguugu

SEQ ID NO: 608252 - RNA, 22 nt, Human
cagaaaauaaacauuuguggaa

SEQ ID NO: 608253 - RNA, 19 nt, Human
ugcagaggguaggaaggcc

SEQ ID NO: 608254 - RNA, 22 nt, Human
agcauuuauuucuuagaaauug

SEQ ID NO: 608255 - RNA, 22 nt, Human
gccagcuggagacuggcagggg

SEQ ID NO: 608256 - RNA, 22 nt, Human
gcuggguuuccagcaggcagga

SEQ ID NO: 608257 - RNA, 22 nt, Human
ccacccuuggguucggaggccg

SEQ ID NO: 608258 - RNA, 19 nt, Human
cuuuuucaccuucuagaag

SEQ ID NO: 608259 - RNA, 19 nt, Human
acaaagcugugagcagcuu

SEQ ID NO: 608260 - RNA, 22 nt, Human
aguccuuagaacacuguaucug

SEQ ID NO: 608261 - RNA, 22 nt, Human
aaugccacuaaaucugugaaua

SEQ ID NO: 608262 - RNA, 22 nt, Human
acagcucucccucagagaaaug

SEQ ID NO: 608263 - RNA, 22 nt, Human
uuugcauuauauuuauagaaga

SEQ ID NO: 608264 - RNA, 22 nt, Human
aucugccaaugccaugagaaga

SEQ ID NO: 608265 - RNA, 22 nt, Human
aaaguuguuguucacagguuau

SEQ ID NO: 608266 - RNA, 21 nt, Human
uauuagcuucuggugcuguuu

SEQ ID NO: 608267 - RNA, 22 nt, Human
aagaauguuaguuucugauaca

SEQ ID NO: 608268 - RNA, 22 nt, Human
ucagggaaauuuccauguguuu

SEQ ID NO: 608269 - RNA, 22 nt, Human
uuuaaacaaauaggauugccua

SEQ ID NO: 608270 - RNA, 22 nt, Human
gggcagugaauauuggugggaa

SEQ ID NO: 608271 - RNA, 18 nt, Human
ugguggugacagggucau

SEQ ID NO: 608272 - RNA, 22 nt, Human
uuaaagcaugcugcuuuuccau

SEQ ID NO: 608273 - RNA, 18 nt, Human
caggucugucugccuccc

SEQ ID NO: 608274 - RNA, 22 nt, Human
cagacacuuauugagcaaguac

SEQ ID NO: 608275 - RNA, 22 nt, Human
cccaugagauucugaauuuggc

SEQ ID NO: 608276 - RNA, 22 nt, Human
aaagccagugguaugagagaaa

SEQ ID NO: 608277 - RNA, 22 nt, Human
cugccucuauaggaguccacca

SEQ ID NO: 608278 - RNA, 22 nt, Human
auuucccagauaaacagcugga

SEQ ID NO: 608279 - RNA, 22 nt, Human
uggccaggaggcugcuucugac

SEQ ID NO: 608280 - RNA, 22 nt, Human
ucugccuguucaagucuucuag

SEQ ID NO: 608281 - RNA, 22 nt, Human
ucagcacuuggauuucagagau

SEQ ID NO: 608282 - RNA, 22 nt, Human
augggggccugaacaggcaaaa

SEQ ID NO: 608283 - RNA, 21 nt, Human
ucagugacaggugcugaccuc

SEQ ID NO: 608284 - RNA, 22 nt, Human
guaggcagaauaauuccuccuu

SEQ ID NO: 608285 - RNA, 22 nt, Human
ccugcccacagagagggugcau

SEQ ID NO: 608286 - RNA, 22 nt, Human
uuuuuuguagcaagcgcagaua

SEQ ID NO: 608287 - RNA, 22 nt, Human
cccaggcuggagggcaguguca

SEQ ID NO: 608288 - RNA, 22 nt, Human
ucugugccucaucugguucagg

SEQ ID NO: 608289 - RNA, 22 nt, Human
uagaaaccucagggaaaucuuu

SEQ ID NO: 608290 - RNA, 22 nt, Human
agcagggccaacaguaaacacc

SEQ ID NO: 608291 - RNA, 22 nt, Human
gucuuauugcguauguauacaa

SEQ ID NO: 608292 - RNA, 22 nt, Human
uugcaguuaaaaaucauuaguu

SEQ ID NO: 608293 - RNA, 22 nt, Human
agagcuuauaucuuggccaucc

SEQ ID NO: 608294 - RNA, 22 nt, Human
cagagccucagaauccugugga

SEQ ID NO: 608295 - RNA, 22 nt, Human
augcuuuaaaacguauguguaa

SEQ ID NO: 608296 - RNA, 22 nt, Human
gugagacacgugugugaccugg

SEQ ID NO: 608297 - RNA, 22 nt, Human
ugggccuggcccuguggaggag

SEQ ID NO: 608298 - RNA, 22 nt, Human
uucugggggaauacagcuauga

SEQ ID NO: 608299 - RNA, 22 nt, Human
aaggcagcagaggaaaggugcu

SEQ ID NO: 608300 - RNA, 22 nt, Human
aaggcacuacgcugcuggggcg

SEQ ID NO: 608301 - RNA, 22 nt, Human
uagcacauaacuuagaauaguu

SEQ ID NO: 608302 - RNA, 22 nt, Human
uuagaggacaagaggccuggcu

SEQ ID NO: 608303 - RNA, 23 nt, Human
ucagaacaguucuuggugcauag

SEQ ID NO: 608304 - RNA, 22 nt, Human
ucugccagaagccagggucugg

SEQ ID NO: 608305 - RNA, 22 nt, Human
ccacagcugaccgcaggugagc

SEQ ID NO: 608306 - RNA, 22 nt, Human
ugccaggcaacugcccagccau

SEQ ID NO: 608307 - RNA, 22 nt, Human
cagcuuuccccgugccucagcc

SEQ ID NO: 608308 - RNA, 22 nt, Human
ucucagaacuuuauauguauca

SEQ ID NO: 608309 - RNA, 22 nt, Human
auacuguacgucccagauagga

SEQ ID NO: 608310 - RNA, 22 nt, Human
auuuccuauuucuuguccccua

SEQ ID NO: 608311 - RNA, 22 nt, Human
caggagcucacagucuuugggu

SEQ ID NO: 608312 - RNA, 22 nt, Human
ugcugaauuuacauuuuuguag

SEQ ID NO: 608313 - RNA, 20 nt, Human
aguggggagucaggagugcc

SEQ ID NO: 608314 - RNA, 22 nt, Human
uggcauggcguggcaucgugug

SEQ ID NO: 608315 - RNA, 22 nt, Human
agggccaguauuaagguaauua

SEQ ID NO: 608316 - RNA, 22 nt, Human
gugagaauaccagcagugagaa

SEQ ID NO: 608317 - RNA, 22 nt, Human
gaagguuugaaauagguauaga

SEQ ID NO: 608318 - RNA, 22 nt, Human
gaauguuaaugcacuucuagcu

SEQ ID NO: 608319 - RNA, 22 nt, Human
aggaggugcuguuuguccugga

SEQ ID NO: 608320 - RNA, 22 nt, Human
caaagccaggcuuucuaaugua

SEQ ID NO: 608321 - RNA, 22 nt, Human
acacuuuacagcuuccuuugca

SEQ ID NO: 608322 - RNA, 22 nt, Human
ggcagccuugacuagugacuua

SEQ ID NO: 608323 - RNA, 22 nt, Human
cuccuggggccauggaaggaac

SEQ ID NO: 608324 - RNA, 22 nt, Human
gucugaaaaugcccuacgauug

SEQ ID NO: 608325 - RNA, 22 nt, Human
gacugcuuugguuuguaaaugu

SEQ ID NO: 608326 - RNA, 22 nt, Human
uaaacaagcugucugauauucu

SEQ ID NO: 608327 - RNA, 22 nt, Human
gcacugggaaugugagcagcug

SEQ ID NO: 608328 - RNA, 22 nt, Human
ucucugagcucaggagcugcag

SEQ ID NO: 608329 - RNA, 22 nt, Human
cagacaggcaggugagagcucc

SEQ ID NO: 608330 - RNA, 22 nt, Human
uuugugcauaaagggcuauagu

SEQ ID NO: 608331 - RNA, 22 nt, Human
cagugagggaagaucucagcac

SEQ ID NO: 608332 - RNA, 22 nt, Human
ggcccagcugugcuuccagccc

SEQ ID NO: 608333 - RNA, 22 nt, Human
cccaguggugcuggcaucugug

SEQ ID NO: 608334 - RNA, 22 nt, Human
ucuggccacuaauaggucucac

SEQ ID NO: 608335 - RNA, 22 nt, Human
ucuagaaaguacuagagcuggu

SEQ ID NO: 608336 - RNA, 22 nt, Human
agggccugagaccguggcuuga

SEQ ID NO: 608337 - RNA, 22 nt, Human
ccaguccugggagcuugcacug

SEQ ID NO: 608338 - RNA, 22 nt, Human
uauaagaaacaaggcaaauuuu

SEQ ID NO: 608339 - RNA, 22 nt, Human
cacagugugacugaccuucagc

SEQ ID NO: 608340 - RNA, 22 nt, Human
cuacagugaagacuagcuauag

SEQ ID NO: 608341 - RNA, 21 nt, Human
acagcaagccuucacaugagu

SEQ ID NO: 608342 - RNA, 21 nt, Human
uggaaacagcgccaucugccg

SEQ ID NO: 608343 - RNA, 22 nt, Human
uauuagcucaugauuucggugg

SEQ ID NO: 608344 - RNA, 22 nt, Human
gcagggagguuugcugaccugg

SEQ ID NO: 608345 - RNA, 19 nt, Human
cuccacagggauugugauu

SEQ ID NO: 608346 - RNA, 22 nt, Human
augcuuugaaguuuuuccucau

SEQ ID NO: 608347 - RNA, 22 nt, Human
uucuaauccugacucagcugcu

SEQ ID NO: 608348 - RNA, 22 nt, Human
gagcugaguuaccuccagauca

SEQ ID NO: 608349 - RNA, 22 nt, Human
ccaggagaugggaaaguagcag

SEQ ID NO: 608350 - RNA, 22 nt, Human
uucagaaaucccucuucuaccc

SEQ ID NO: 608351 - RNA, 22 nt, Human
guauuugauagauuucaaagga

SEQ ID NO: 608352 - RNA, 22 nt, Human
ccucccucccugcagaagccac

SEQ ID NO: 608353 - RNA, 21 nt, Human
uggccucccacacuuccaugg

SEQ ID NO: 608354 - RNA, 22 nt, Human
gcagugggagcuuaggcagugc

SEQ ID NO: 608355 - RNA, 22 nt, Human
cagccuggccugggacugcuga

SEQ ID NO: 608356 - RNA, 22 nt, Human
gcugcucuacccaugcaucugu

SEQ ID NO: 608357 - RNA, 22 nt, Human
accagaguuuuauuaguucuaa

SEQ ID NO: 608358 - RNA, 22 nt, Human
uucauuagagauuauaaaauga

SEQ ID NO: 608359 - RNA, 22 nt, Human
ccugucugcaugaucccugcca

SEQ ID NO: 608360 - RNA, 22 nt, Human
ggguguguuccuaaggaaacca

SEQ ID NO: 608361 - RNA, 22 nt, Human
agggcagagcacugaauuggga

SEQ ID NO: 608362 - RNA, 22 nt, Human
uugucacauguaguucauucuc

SEQ ID NO: 608363 - RNA, 22 nt, Human
agcucagagauaaucaagagac

SEQ ID NO: 608364 - RNA, 22 nt, Human
agaguaugcaucuauuguaccu

SEQ ID NO: 608365 - RNA, 22 nt, Human
ucaggccuuugaacuuggagug

SEQ ID NO: 608366 - RNA, 22 nt, Human
guccugugggcccaccaugagc

SEQ ID NO: 608367 - RNA, 22 nt, Human
aacuacagcaucuauacaaaua

SEQ ID NO: 608368 - RNA, 18 nt, Human
agcuggugaaauccagua

SEQ ID NO: 608369 - RNA, 22 nt, Human
agugcccaccucucuucagcua

SEQ ID NO: 608370 - RNA, 22 nt, Human
acagacaucaucaacaucuucc

SEQ ID NO: 608371 - RNA, 22 nt, Human
uacccagcccaugccuaccuca

SEQ ID NO: 608372 - RNA, 22 nt, Human
cacaggagcuguggggcagugu

SEQ ID NO: 608373 - RNA, 22 nt, Human
ugcugagucguauuauuuuuua

SEQ ID NO: 608374 - RNA, 22 nt, Human
ugagcagacucugcagagccac

SEQ ID NO: 608375 - RNA, 22 nt, Human
uggggacauagccagucuggcu

SEQ ID NO: 608376 - RNA, 22 nt, Human
ucaggagauguaaccuuagcug

SEQ ID NO: 608377 - RNA, 22 nt, Human
ugcaaaaugacuucugaaaaga

SEQ ID NO: 608378 - RNA, 22 nt, Human
gcaggaguggagaccaugggga

SEQ ID NO: 608379 - RNA, 21 nt, Human
uugaagcaaggguggcucuga

SEQ ID NO: 608380 - RNA, 22 nt, Human
caacauaugauuuuguauauaa

SEQ ID NO: 608381 - RNA, 22 nt, Human
gcaaauguggcuuccuuucuag

SEQ ID NO: 608382 - RNA, 22 nt, Human
aagcuuugcaccgguggcugga

SEQ ID NO: 608383 - RNA, 22 nt, Human
ccucccugguggcucuggucua

SEQ ID NO: 608384 - RNA, 22 nt, Human
uccuuauaucuauaguuuugca

SEQ ID NO: 608385 - RNA, 22 nt, Human
ggcuccuguccuccuggagcuc

SEQ ID NO: 608386 - RNA, 22 nt, Human
cagggcuggcuuccaaguuguu

SEQ ID NO: 608387 - RNA, 22 nt, Human
cagugccaagccacagaucacu

SEQ ID NO: 608388 - RNA, 23 nt, Human
gguggcaggaguggaugcugagc

SEQ ID NO: 608389 - RNA, 22 nt, Human
uagaugcuguagaaauacuuau

SEQ ID NO: 608390 - RNA, 22 nt, Human
ggaacagggauuuggccugguu

SEQ ID NO: 608391 - RNA, 22 nt, Human
gaacagcugcuagagaucugug

SEQ ID NO: 608392 - RNA, 22 nt, Human
guggguggauuccagcaacgcu

SEQ ID NO: 608393 - RNA, 22 nt, Human
caauuacauuuauugagcauuc

SEQ ID NO: 608394 - RNA, 22 nt, Human
agucuucuuuguguucucucau

SEQ ID NO: 608395 - RNA, 22 nt, Human
ccagcucccugaagccuggucu

SEQ ID NO: 608396 - RNA, 22 nt, Human
uaguuuuuacugcgaguuauaa

SEQ ID NO: 608397 - RNA, 22 nt, Human
auuagcuuaucacacaagcugc

SEQ ID NO: 608398 - RNA, 22 nt, Human
acugcuuuucuaagauucugug

SEQ ID NO: 608399 - RNA, 22 nt, Human
ugaggccucugugccauccagg

SEQ ID NO: 608400 - RNA, 22 nt, Human
aguaagcaccgggauggucaag

SEQ ID NO: 608401 - RNA, 22 nt, Human
cagaguaaaccugucaucaaga

SEQ ID NO: 608402 - RNA, 22 nt, Human
aguguuucacagcacuuuuucu

SEQ ID NO: 608403 - RNA, 22 nt, Human
acccucaacaaauucacucuau

SEQ ID NO: 608404 - RNA, 22 nt, Human
ccagcucugcuugcccagucag

SEQ ID NO: 608405 - RNA, 20 nt, Human
ggaccagcugucugaggggc

SEQ ID NO: 608406 - RNA, 19 nt, Human
ugggaguggggaagguccu

SEQ ID NO: 608407 - RNA, 22 nt, Human
ccagggcagaaaaagagggaau

SEQ ID NO: 608408 - RNA, 22 nt, Human
aaauuguugaucuacaguaagg

SEQ ID NO: 608409 - RNA, 22 nt, Human
gaaaucuugcucauugugacaa

SEQ ID NO: 608410 - RNA, 22 nt, Human
uuuguuauaacaauaaaaaguc

SEQ ID NO: 608411 - RNA, 21 nt, Human
uuuuacagaugaggggaaggg

SEQ ID NO: 608412 - RNA, 22 nt, Human
aaguggagccagggaaacugaa

SEQ ID NO: 608413 - RNA, 19 nt, Human
ugccucagggcuuugagga

SEQ ID NO: 608414 - RNA, 22 nt, Human
uuuguacauccuaauucugagu

SEQ ID NO: 608415 - RNA, 22 nt, Human
gcugaaauucagauuccuaggc

SEQ ID NO: 608416 - RNA, 22 nt, Human
acugaggauuagcccaggcuag

SEQ ID NO: 608417 - RNA, 22 nt, Human
aggcagugccuggaccccagcu

SEQ ID NO: 608418 - RNA, 22 nt, Human
guuauaaaggugauaaugguca

SEQ ID NO: 608419 - RNA, 22 nt, Human
cuccugggagcuguggcagagc

SEQ ID NO: 608420 - RNA, 22 nt, Human
cagcuucaacugcacagucaac

SEQ ID NO: 608421 - RNA, 22 nt, Human
aauuuaaggaggccuucacucu

SEQ ID NO: 608422 - RNA, 22 nt, Human
ugucagugaguuaguugcaagu

SEQ ID NO: 608423 - RNA, 22 nt, Human
ugugggcaggcccgggucugag

SEQ ID NO: 608424 - RNA, 21 nt, Human
agguuuauuucaacuucagga

SEQ ID NO: 608425 - RNA, 22 nt, Human
uucucccagaccaaaggcagca

SEQ ID NO: 608426 - RNA, 22 nt, Human
ggcuggcagugugagagaggga

SEQ ID NO: 608427 - RNA, 22 nt, Human
ugaugcugagccugggacugac

SEQ ID NO: 608428 - RNA, 22 nt, Human
cuagaacagaaaguacaggaaa

SEQ ID NO: 608429 - RNA, 22 nt, Human
uagaggcucuucauugcaguag

SEQ ID NO: 608430 - RNA, 22 nt, Human
aagcuucuuagaaugcaugugc

SEQ ID NO: 608431 - RNA, 22 nt, Human
ugugggaaaugggaguggaaga

SEQ ID NO: 608432 - RNA, 22 nt, Human
aauucacuugugcacgcuaugg

SEQ ID NO: 608433 - RNA, 22 nt, Human
uguguuuguuagacuaauguua

SEQ ID NO: 608434 - RNA, 22 nt, Human
augcuuuaaacuauaaauccac

SEQ ID NO: 608435 - RNA, 22 nt, Human
cuggcuuuaaugucaucuuucu

SEQ ID NO: 608436 - RNA, 19 nt, Human
ugagauuucuuaggugauu

SEQ ID NO: 608437 - RNA, 22 nt, Human
gcucaggccuccagaggggcaa

SEQ ID NO: 608438 - RNA, 22 nt, Human
agaguucugucugccacacgaa

SEQ ID NO: 608439 - RNA, 22 nt, Human
agaggggcucauauccugucau

SEQ ID NO: 608440 - RNA, 22 nt, Human
gagaacuugaacuuuuccucug

SEQ ID NO: 608441 - RNA, 22 nt, Human
uuucagggaaguguugaaaagg

SEQ ID NO: 608442 - RNA, 19 nt, Human
accucugagaaugccaguc

SEQ ID NO: 608443 - RNA, 22 nt, Human
caguggugaagagcaggggcuc

SEQ ID NO: 608444 - RNA, 22 nt, Human
ugagcagggagcugggcugagc

SEQ ID NO: 608445 - RNA, 19 nt, Human
ucucuucucccugguuuua

SEQ ID NO: 608446 - RNA, 22 nt, Human
gauauuuuuaggugaugcaggc

SEQ ID NO: 608447 - RNA, 22 nt, Human
gggcuucucccuaaggacucug

SEQ ID NO: 608448 - RNA, 22 nt, Human
gcagggugacguugcccaccuc

SEQ ID NO: 608449 - RNA, 22 nt, Human
gcuuggcccugccgccuggguc

SEQ ID NO: 608450 - RNA, 22 nt, Human
gaagcaagugcaaggaagaggc

SEQ ID NO: 608451 - RNA, 22 nt, Human
ggacagcuccugcacuugagua

SEQ ID NO: 608452 - RNA, 22 nt, Human
uucugcacuaaauaucaaauau

SEQ ID NO: 608453 - RNA, 22 nt, Human
uuccccaguaacauacauguga

SEQ ID NO: 608454 - RNA, 22 nt, Human
cagagcugcaaaugccccuccg

SEQ ID NO: 608455 - RNA, 20 nt, Human
agaagccaagugacauguuu

SEQ ID NO: 608456 - RNA, 22 nt, Human
cucugaggucagggcccggcaa

SEQ ID NO: 608457 - RNA, 22 nt, Human
uagggaggcuacuucuuguagg

SEQ ID NO: 608458 - RNA, 22 nt, Human
gcaguguugguuugcucugcag

SEQ ID NO: 608459 - RNA, 22 nt, Human
ugggcugcccaagguggccaug

SEQ ID NO: 608460 - RNA, 22 nt, Human
gaaaggcaucuucagucucuga

SEQ ID NO: 608461 - RNA, 22 nt, Human
uggcagcuccggguaggggcug

SEQ ID NO: 608462 - RNA, 22 nt, Human
uaggggcucagaacauguccuu

SEQ ID NO: 608463 - RNA, 22 nt, Human
augggaggcagacacuaaguuc

SEQ ID NO: 608464 - RNA, 23 nt, Human
accugcuccaugucaccuucacu

SEQ ID NO: 608465 - RNA, 22 nt, Human
guugugcagucagacugccugg

SEQ ID NO: 608466 - RNA, 22 nt, Human
cuuguuuauuaugcacuguaga

SEQ ID NO: 608467 - RNA, 22 nt, Human
ccuuucugauggccucccagcc

SEQ ID NO: 608468 - RNA, 22 nt, Human
ucauuucucugagucugauaau

SEQ ID NO: 608469 - RNA, 22 nt, Human
gcugccaguguggcaugaugca

SEQ ID NO: 608470 - RNA, 22 nt, Human
ugcugucaguuggcaggaugag

SEQ ID NO: 608471 - RNA, 22 nt, Human
guccaggccaugguggacacag

SEQ ID NO: 608472 - RNA, 22 nt, Human
uggcugagccacuuguucagau

SEQ ID NO: 608473 - RNA, 22 nt, Human
uugagggucuggaucugcugcu

SEQ ID NO: 608474 - RNA, 22 nt, Human
agaugaaaagauaagcagcaau

SEQ ID NO: 608475 - RNA, 22 nt, Human
gaagguuuacugaagauuuaaa

SEQ ID NO: 608476 - RNA, 22 nt, Human
cugacagucuugccaaguuucu

SEQ ID NO: 608477 - RNA, 22 nt, Human
augaggccaccuucuacauuuc

SEQ ID NO: 608478 - RNA, 18 nt, Human
agcugcuuuuggcuuaaa

SEQ ID NO: 608479 - RNA, 21 nt, Human
ugcaggcaggcagagaugcug

SEQ ID NO: 608480 - RNA, 22 nt, Human
auuauggauggaggcauuaguc

SEQ ID NO: 608481 - RNA, 22 nt, Human
gggugugucuuuugcuccugga

SEQ ID NO: 608482 - RNA, 22 nt, Human
auaauuuaaauuaguaugugau

SEQ ID NO: 608483 - RNA, 22 nt, Human
uaacagaauuugcuaaacuccg

SEQ ID NO: 608484 - RNA, 22 nt, Human
aaggcuggaguacagugcagug

SEQ ID NO: 608485 - RNA, 23 nt, Human
cugggcacccaguaccuaggccc

SEQ ID NO: 608486 - RNA, 20 nt, Human
uagauacccaaugcucauca

SEQ ID NO: 608487 - RNA, 22 nt, Human
acuguauucuagucauguuugu

SEQ ID NO: 608488 - RNA, 22 nt, Human
ggcuauggaaauggcaggacau

SEQ ID NO: 608489 - RNA, 22 nt, Human
ugcacacacaugaaguagcaug

SEQ ID NO: 608490 - RNA, 16 nt, Human
ccccaggacuuggcac

SEQ ID NO: 608491 - RNA, 22 nt, Human
ugacaugcuaagauuauguuau

SEQ ID NO: 608492 - RNA, 20 nt, Human
gcacuuggcugcugcuucuc

SEQ ID NO: 608493 - RNA, 23 nt, Human
gcuucuagucaauuucaccagga

SEQ ID NO: 608494 - RNA, 19 nt, Human
ccagaggacuguuaaugaa

SEQ ID NO: 608495 - RNA, 22 nt, Human
uacagaaaaacuuggaggcuuu

SEQ ID NO: 608496 - RNA, 22 nt, Human
agggccugagcuggcugaccuc

SEQ ID NO: 608497 - RNA, 22 nt, Human
acccagcuguuucccgugucau

SEQ ID NO: 608498 - RNA, 22 nt, Human
ucuguuuagaugcuuuaucugu

SEQ ID NO: 608499 - RNA, 22 nt, Human
ggagccuggucagguuggcucc

SEQ ID NO: 608500 - RNA, 22 nt, Human
gucuggacagcagcaccucggc

SEQ ID NO: 608501 - RNA, 22 nt, Human
cuucuuggaagucguccuucca

SEQ ID NO: 608502 - RNA, 22 nt, Human
auaugcauaugucaaaacuuau

SEQ ID NO: 608503 - RNA, 22 nt, Human
uccucaggaucuaggagugcuu

SEQ ID NO: 608504 - RNA, 22 nt, Human
uucaugaaacuuaacuguuggg

SEQ ID NO: 608505 - RNA, 22 nt, Human
uggcaggagacacauggcauag

SEQ ID NO: 608506 - RNA, 22 nt, Human
aggaaacaacuuggcaugagcc

SEQ ID NO: 608507 - RNA, 22 nt, Human
caaaccaguaggaagucuauua

SEQ ID NO: 608508 - RNA, 22 nt, Human
ccagcugucugguuccagagcc

SEQ ID NO: 608509 - RNA, 22 nt, Human
aggcagcaaugaaugaaaugga

SEQ ID NO: 608510 - RNA, 22 nt, Human
cagggcuuuccugagaagugau

SEQ ID NO: 608511 - RNA, 22 nt, Human
acacauaucuaagauagaugac

SEQ ID NO: 608512 - RNA, 22 nt, Human
ugaggccauggucuucccaguc

SEQ ID NO: 608513 - RNA, 22 nt, Human
uccagggcuacaaggcaccaga

SEQ ID NO: 608514 - RNA, 22 nt, Human
gucccaggcuuauguggagcuu

SEQ ID NO: 608515 - RNA, 22 nt, Human
agugccuuggcugugaugggga

SEQ ID NO: 608516 - RNA, 22 nt, Human
uucuugggaauuuuuccaacac

SEQ ID NO: 608517 - RNA, 22 nt, Human
ccaguggacuucucccuguggu

SEQ ID NO: 608518 - RNA, 20 nt, Human
gccugagcuauugccaggau

SEQ ID NO: 608519 - RNA, 22 nt, Human
uuuaucucuuuugaccaagauu

SEQ ID NO: 608520 - RNA, 22 nt, Human
agcuguaagcuuugggcaaguc

SEQ ID NO: 608521 - RNA, 22 nt, Human
gcugcucuguuaauugcuguaa

SEQ ID NO: 608522 - RNA, 22 nt, Human
gcuggagucuugaaaguggacu

SEQ ID NO: 608523 - RNA, 22 nt, Human
uuaguuaaaauucugcugacau

SEQ ID NO: 608524 - RNA, 22 nt, Human
guuuuauaggcuguugcuauau

SEQ ID NO: 608525 - RNA, 22 nt, Human
cucuggagguugagcccagcaa

SEQ ID NO: 608526 - RNA, 22 nt, Human
cuuauuguuccuggacccugag

SEQ ID NO: 608527 - RNA, 22 nt, Human
uuccugagggccccagaggagg

SEQ ID NO: 608528 - RNA, 22 nt, Human
ugucccagaucacaggagggga

SEQ ID NO: 608529 - RNA, 22 nt, Human
gagggcuguggggcaugaccag

SEQ ID NO: 608530 - RNA, 22 nt, Human
ucaguuuccugguugugauauu

SEQ ID NO: 608531 - RNA, 22 nt, Human
auugugcaauguuuuacaauuu

SEQ ID NO: 608532 - RNA, 22 nt, Human
aaacauagauaauagauagaug

SEQ ID NO: 608533 - RNA, 22 nt, Human
cuggguauaggaaacaguuaag

SEQ ID NO: 608534 - RNA, 22 nt, Human
caugggggucuggacaacaggc

SEQ ID NO: 608535 - RNA, 19 nt, Human
gcucugugaugcugagggg

SEQ ID NO: 608536 - RNA, 22 nt, Human
auaauuuacuaagcucuaccuu

SEQ ID NO: 608537 - RNA, 22 nt, Human
ucaugcagauuuggagguauuu

SEQ ID NO: 608538 - RNA, 22 nt, Human
ucccugccugacagcacccacc

SEQ ID NO: 608539 - RNA, 20 nt, Human
ccuuuauuauuuguaugaug

SEQ ID NO: 608540 - RNA, 18 nt, Human
caaagcucacguuccauc

SEQ ID NO: 608541 - RNA, 22 nt, Human
cagccugcaggaggccgucagc

SEQ ID NO: 608542 - RNA, 22 nt, Human
acugauacgguuuuagagucca

SEQ ID NO: 608543 - RNA, 22 nt, Human
gaggggaaagugugaggcugcg

SEQ ID NO: 608544 - RNA, 22 nt, Human
gauauuuugagaaauccuauga

SEQ ID NO: 608545 - RNA, 22 nt, Human
ccaguccugugugacccugcac

SEQ ID NO: 608546 - RNA, 22 nt, Human
uuuuucauauuccccucucugg

SEQ ID NO: 608547 - RNA, 22 nt, Human
accagcucagaagccagaaaga

SEQ ID NO: 608548 - RNA, 22 nt, Human
cacagcagggaugaauggagug

SEQ ID NO: 608549 - RNA, 22 nt, Human
ggcugcuuuaucggcugcugaa

SEQ ID NO: 608550 - RNA, 22 nt, Human
auuuggggcucaccagggcuga

SEQ ID NO: 608551 - RNA, 22 nt, Human
gcccaggaguuugcauuuuaac

SEQ ID NO: 608552 - RNA, 22 nt, Human
ucucccacagucucccauggcu

SEQ ID NO: 608553 - RNA, 22 nt, Human
gagagguacacccuuuaaacuu

SEQ ID NO: 608554 - RNA, 22 nt, Human
cuucuugggucagagaaucauu

SEQ ID NO: 608555 - RNA, 22 nt, Human
ucucugggcccagaccuuccuu

SEQ ID NO: 608556 - RNA, 22 nt, Human
gcuguccauccacuucccagcg

SEQ ID NO: 608557 - RNA, 22 nt, Human
cuccuguggcuuucugauuuca

SEQ ID NO: 608558 - RNA, 22 nt, Human
ugcaggagagcuggucuggccc

SEQ ID NO: 608559 - RNA, 22 nt, Human
cagucuccgccagcuccucaca

SEQ ID NO: 608560 - RNA, 21 nt, Human
ccaggcuggccaugguauuga

SEQ ID NO: 608561 - RNA, 22 nt, Human
uuuccuuguuauuauuuguccu

SEQ ID NO: 608562 - RNA, 20 nt, Human
cuucuuggagaugguguuuu

SEQ ID NO: 608563 - RNA, 22 nt, Human
acacuuuaucaauauucaaaaa

SEQ ID NO: 608564 - RNA, 22 nt, Human
gcagggcucauucuaguacaau

SEQ ID NO: 608565 - RNA, 22 nt, Human
agagcaaauagagaagccagcu

SEQ ID NO: 608566 - RNA, 22 nt, Human
cccuggggcugagggauggccg

SEQ ID NO: 608567 - RNA, 22 nt, Human
gguuuguugggguccaggccca

SEQ ID NO: 608568 - RNA, 22 nt, Human
cagagccuuccuagcagacucu

SEQ ID NO: 608569 - RNA, 22 nt, Human
ugcugggggcuuucuggauacc

SEQ ID NO: 608570 - RNA, 19 nt, Human
aacaucuuuccaguagagg

SEQ ID NO: 608571 - RNA, 22 nt, Human
ucuccagucccuucucuguuag

SEQ ID NO: 608572 - RNA, 22 nt, Human
uagacauuagguagguucaugg

SEQ ID NO: 608573 - RNA, 22 nt, Human
uuaaauaguaggucuauuuugg

SEQ ID NO: 608574 - RNA, 22 nt, Human
ggggauggaggcgugugguccu

SEQ ID NO: 608575 - RNA, 22 nt, Human
uggcuccaccgccgcggagcuc

SEQ ID NO: 608576 - RNA, 22 nt, Human
ugggcugcugucugcacaugcu

SEQ ID NO: 608577 - RNA, 22 nt, Human
cugcagucuuccuuccuuaggc

SEQ ID NO: 608578 - RNA, 22 nt, Human
uugggguguuggauggagcaag

SEQ ID NO: 608579 - RNA, 22 nt, Human
aggcuggggaauugaauuugcu

SEQ ID NO: 608580 - RNA, 22 nt, Human
auggccagagaaggcaggguca

SEQ ID NO: 608581 - RNA, 22 nt, Human
uggucugggcaaauccuucuga

SEQ ID NO: 608582 - RNA, 22 nt, Human
uuuccccucaguacuaaacaua

SEQ ID NO: 608583 - RNA, 21 nt, Human
uuuagaggacacagggaggca

SEQ ID NO: 608584 - RNA, 22 nt, Human
cagaagugcaauuuaaauuagg

SEQ ID NO: 608585 - RNA, 22 nt, Human
gaugauuuucuguguuagaaga

SEQ ID NO: 608586 - RNA, 22 nt, Human
agggcccuccccgcucagggca

SEQ ID NO: 608587 - RNA, 22 nt, Human
aagaaaacaaugacuugccagc

SEQ ID NO: 608588 - RNA, 22 nt, Human
gccccaggugguaaaccuaaga

SEQ ID NO: 608589 - RNA, 22 nt, Human
uggcccagcccugcucuagggc

SEQ ID NO: 608590 - RNA, 22 nt, Human
ucuagcuuggcguuugccuucu

SEQ ID NO: 608591 - RNA, 22 nt, Human
cucucuucccgugaguguugca

SEQ ID NO: 608592 - RNA, 22 nt, Human
cccagggaggcccaggcucugc

SEQ ID NO: 608593 - RNA, 22 nt, Human
ucccaaagguccgagcgggaau

SEQ ID NO: 608594 - RNA, 22 nt, Human
gagguaacaacugaaaugagaa

SEQ ID NO: 608595 - RNA, 22 nt, Human
auuuaauaccacuuggugcuuu

SEQ ID NO: 608596 - RNA, 22 nt, Human
cuccagccagagugccucuguu

SEQ ID NO: 608597 - RNA, 22 nt, Human
uaagaaauuuaguuauagaaug

SEQ ID NO: 608598 - RNA, 22 nt, Human
auucacaauagcagcuugcaug

SEQ ID NO: 608599 - RNA, 22 nt, Human
caguccugggcacagcccuggg

SEQ ID NO: 608600 - RNA, 23 nt, Human
cacuccuguuucuaagccagcau

SEQ ID NO: 608601 - RNA, 22 nt, Human
cauuguauugaggauacuuaag

SEQ ID NO: 608602 - RNA, 22 nt, Human
aaagccaguucuuuuauauugg

SEQ ID NO: 608603 - RNA, 22 nt, Human
aagggcuggagacugggucuuc

SEQ ID NO: 608604 - RNA, 22 nt, Human
ugcaaagauuuaucuuucucca

SEQ ID NO: 608605 - RNA, 17 nt, Human
cauaaaacaguucuauu

SEQ ID NO: 608606 - RNA, 22 nt, Human
ggcagugccacuaagcucugcu

SEQ ID NO: 608607 - RNA, 22 nt, Human
gaaagacauaguugcaagaugg

SEQ ID NO: 608608 - RNA, 22 nt, Human
caggcucugcugcuacagcugu

SEQ ID NO: 608609 - RNA, 22 nt, Human
uugcaagauguuaccauuguua

SEQ ID NO: 608610 - RNA, 22 nt, Human
ucaguguuuuccagggucuacu

SEQ ID NO: 608611 - RNA, 22 nt, Human
ucugaggucagugcugcaguua

SEQ ID NO: 608612 - RNA, 22 nt, Human
agcaguggagcgagauguuuaa

SEQ ID NO: 608613 - RNA, 22 nt, Human
ugaggcucagagaagugcuguu

SEQ ID NO: 608614 - RNA, 22 nt, Human
auucacaguuuccucauauucu

SEQ ID NO: 608615 - RNA, 22 nt, Human
gggcagcugucuugguucucaa

SEQ ID NO: 608616 - RNA, 22 nt, Human
aauaaaauggucaguuuucuca

SEQ ID NO: 608617 - RNA, 22 nt, Human
ugugugccagggcaugcacagg

SEQ ID NO: 608618 - RNA, 23 nt, Human
uacuacagggucuugcuaugaau

SEQ ID NO: 608619 - RNA, 22 nt, Human
uguaggaauggauucuagaagg

SEQ ID NO: 608620 - RNA, 22 nt, Human
caggcagcguccugcuuccugu

SEQ ID NO: 608621 - RNA, 22 nt, Human
uggccuugauuaugccaguaga

SEQ ID NO: 608622 - RNA, 22 nt, Human
agagccagaccauugccgugca

SEQ ID NO: 608623 - RNA, 22 nt, Human
cagguggggagaguguggagca

SEQ ID NO: 608624 - RNA, 22 nt, Human
gagccucguggcggccacugcg

SEQ ID NO: 608625 - RNA, 22 nt, Human
guuuucugccugaaggugacca

SEQ ID NO: 608626 - RNA, 18 nt, Human
ucagagagaauaguaauu

SEQ ID NO: 608627 - RNA, 22 nt, Human
caggggccggcuguccgugccc

SEQ ID NO: 608628 - RNA, 22 nt, Human
auuuaaaugcuuaagaggguuu

SEQ ID NO: 608629 - RNA, 22 nt, Human
uccuggaagugcuuggugaggg

SEQ ID NO: 608630 - RNA, 22 nt, Human
agauucaugggaaagcuuuagg

SEQ ID NO: 608631 - RNA, 22 nt, Human
agucuucuggguguuuccagag

SEQ ID NO: 608632 - RNA, 22 nt, Human
uguuuugugcauuuacaacaug

SEQ ID NO: 608633 - RNA, 23 nt, Human
uaauuagauguugauuccugaga

SEQ ID NO: 608634 - RNA, 22 nt, Human
ucauggaugggcccagcucugu

SEQ ID NO: 608635 - RNA, 22 nt, Human
guaaacaucgacccaacagggg

SEQ ID NO: 608636 - RNA, 22 nt, Human
uacauauguaaacauguauaaa

SEQ ID NO: 608637 - RNA, 22 nt, Human
auauauuuacucuccuguugca

SEQ ID NO: 608638 - RNA, 21 nt, Human
ugcacagggcccaggagagcc

SEQ ID NO: 608639 - RNA, 19 nt, Human
cuggggcuuugguacugcc

SEQ ID NO: 608640 - RNA, 22 nt, Human
cccuggguucuggcugggcugc

SEQ ID NO: 608641 - RNA, 22 nt, Human
aagagcaggcugcuguggagua

SEQ ID NO: 608642 - RNA, 22 nt, Human
ccauggaguuccucuggucuau

SEQ ID NO: 608643 - RNA, 22 nt, Human
caggaauguagcagcgauggaa

SEQ ID NO: 608644 - RNA, 22 nt, Human
aauuaugcaaccaaugaccacg

SEQ ID NO: 608645 - RNA, 22 nt, Human
aagccaguaaguuuuugucauu

SEQ ID NO: 608646 - RNA, 22 nt, Human
aagcagggcucccuggggacuc

SEQ ID NO: 608647 - RNA, 22 nt, Human
aacaaacauuaccuggugcugg

SEQ ID NO: 608648 - RNA, 22 nt, Human
gugaggugguacaauauuaacu

SEQ ID NO: 608649 - RNA, 22 nt, Human
caccaggcugcccaggacaggg

SEQ ID NO: 608650 - RNA, 22 nt, Human
uagucuuuuuaauaaauaaugc

SEQ ID NO: 608651 - RNA, 19 nt, Human
gccucugagggcaggacac

SEQ ID NO: 608652 - RNA, 22 nt, Human
ggacagcugcuuucaggccaca

SEQ ID NO: 608653 - RNA, 22 nt, Human
gacugcuuauauguuaaagaua

SEQ ID NO: 608654 - RNA, 22 nt, Human
gcauggcauuugaagguagaag

SEQ ID NO: 608655 - RNA, 22 nt, Human
ccugcccuguguuuggggacua

SEQ ID NO: 608656 - RNA, 22 nt, Human
uuccuguggccuuacaucugug

SEQ ID NO: 608657 - RNA, 22 nt, Human
ggccagcaguauauagcuaauu

SEQ ID NO: 608658 - RNA, 22 nt, Human
aaucauaauuguauacauucau

SEQ ID NO: 608659 - RNA, 22 nt, Human
caagcccaggauuccccaguua

SEQ ID NO: 608660 - RNA, 21 nt, Human
gcuaugaauguagaaaauuau

SEQ ID NO: 608661 - RNA, 22 nt, Human
ugugaaagagucuuauaguuuc

SEQ ID NO: 608662 - RNA, 22 nt, Human
ucaguaacccugcuguucagag

SEQ ID NO: 608663 - RNA, 22 nt, Human
cuucugaggacucuaaagagga

SEQ ID NO: 608664 - RNA, 22 nt, Human
ugcagggccagacuggguugga

SEQ ID NO: 608665 - RNA, 20 nt, Human
gcuuccaggagggcugauau

SEQ ID NO: 608666 - RNA, 22 nt, Human
uuacagaacugucuugaaauuu

SEQ ID NO: 608667 - RNA, 22 nt, Human
cucucagcaggaaagcaugcaa

SEQ ID NO: 608668 - RNA, 22 nt, Human
uugucuguccaggcaccccaag

SEQ ID NO: 608669 - RNA, 22 nt, Human
ugaaagcuguccacuaggcugu

SEQ ID NO: 608670 - RNA, 22 nt, Human
agagcuguguuaagaacaggcc

SEQ ID NO: 608671 - RNA, 22 nt, Human
gccuggguuccaugaucuccag

SEQ ID NO: 608672 - RNA, 22 nt, Human
agggaagcuuguuacugagaag

SEQ ID NO: 608673 - RNA, 22 nt, Human
auuuugaaaagcauuugaguaa

SEQ ID NO: 608674 - RNA, 22 nt, Human
cuagccagauuuaaagagagac

SEQ ID NO: 608675 - RNA, 22 nt, Human
gccucccuccaccacugcaggu

SEQ ID NO: 608676 - RNA, 22 nt, Human
ggggaggaguguacagguuuau

SEQ ID NO: 608677 - RNA, 22 nt, Human
ugaaggaggaauguggccucca

SEQ ID NO: 608678 - RNA, 22 nt, Human
gaauuuuaauaaagguuuauca

SEQ ID NO: 608679 - RNA, 22 nt, Human
ugaacacacacaucuuaauaau

SEQ ID NO: 608680 - RNA, 22 nt, Human
caagaauaaccagacaauagca

SEQ ID NO: 608681 - RNA, 22 nt, Human
ccuggagucugugacuuuccuc

SEQ ID NO: 608682 - RNA, 22 nt, Human
uguaaauaauuccuaggcuuuu

SEQ ID NO: 608683 - RNA, 22 nt, Human
cucuacagcugcugccccuggu

SEQ ID NO: 608684 - RNA, 22 nt, Human
gcauuuuagaauauuggagcaa

SEQ ID NO: 608685 - RNA, 22 nt, Human
cauacauaccacugcugucuuu

SEQ ID NO: 608686 - RNA, 22 nt, Human
ucaguguuggucaagaaucagu

SEQ ID NO: 608687 - RNA, 22 nt, Human
uacauugcuuucuaauacaucu

SEQ ID NO: 608688 - RNA, 22 nt, Human
aauauaugacuccacugcauga

SEQ ID NO: 608689 - RNA, 22 nt, Human
aacauuuuuaagaccaagugcu

SEQ ID NO: 608690 - RNA, 22 nt, Human
agcaaagaagacacaggcuuca

SEQ ID NO: 608691 - RNA, 22 nt, Human
gauggcacacagacauccccgc

SEQ ID NO: 608692 - RNA, 22 nt, Human
agggaagcaaugauuauuauuc

SEQ ID NO: 608693 - RNA, 22 nt, Human
cugaauaauauuccauuaugag

SEQ ID NO: 608694 - RNA, 20 nt, Human
aagagcauaguacaggaaga

SEQ ID NO: 608695 - RNA, 22 nt, Human
acauguguuuuccuacuuauga

SEQ ID NO: 608696 - RNA, 22 nt, Human
gaaggcaggcuucugauuaggu

SEQ ID NO: 608697 - RNA, 19 nt, Human
acaauaacucauugauugc

SEQ ID NO: 608698 - RNA, 22 nt, Human
ggccagggggcuucagacucca

SEQ ID NO: 608699 - RNA, 22 nt, Human
uuccacuggcuuucagugaucu

SEQ ID NO: 608700 - RNA, 22 nt, Human
auuagcuucugugcauggacuu

SEQ ID NO: 608701 - RNA, 22 nt, Human
ugggcaggauaauaucucaugu

SEQ ID NO: 608702 - RNA, 22 nt, Human
acuuugcaaauaaacucucuaa

SEQ ID NO: 608703 - RNA, 21 nt, Human
gggccuggcugcgcaggacgg

SEQ ID NO: 608704 - RNA, 22 nt, Human
agcaacagggggauggccacug

SEQ ID NO: 608705 - RNA, 22 nt, Human
aaagaguuaagagucuuaagcu

SEQ ID NO: 608706 - RNA, 22 nt, Human
ggguggcaggauuggcaggagu

SEQ ID NO: 608707 - RNA, 22 nt, Human
uguucccauuuucugcauaauc

SEQ ID NO: 608708 - RNA, 23 nt, Human
cagucugcagcccacuugggcag

SEQ ID NO: 608709 - RNA, 19 nt, Human
acuuucuccaggaccuguu

SEQ ID NO: 608710 - RNA, 22 nt, Human
aggcugaggcaagaggaucacu

SEQ ID NO: 608711 - RNA, 22 nt, Human
gcaagcuauagaauauaagggg

SEQ ID NO: 608712 - RNA, 22 nt, Human
cuucauuuggcaggcuggccuc

SEQ ID NO: 608713 - RNA, 21 nt, Human
uucuccuccaaguugcuccug

SEQ ID NO: 608714 - RNA, 23 nt, Human
uccuggguuugaauucuagucuu

SEQ ID NO: 608715 - RNA, 22 nt, Human
ugaagucccugacauuuagaaa

SEQ ID NO: 608716 - RNA, 22 nt, Human
uuagaacauuuuuagaccaaua

SEQ ID NO: 608717 - RNA, 22 nt, Human
ucagaagccaccuuuuguuggg

SEQ ID NO: 608718 - RNA, 22 nt, Human
guaggcagauaggagugcagcc

SEQ ID NO: 608719 - RNA, 22 nt, Human
augaagcaauuagaaacuugaa

SEQ ID NO: 608720 - RNA, 22 nt, Human
cuagggccaaaggcugugaugc

SEQ ID NO: 608721 - RNA, 22 nt, Human
ggggcagaaagcccacagagug

SEQ ID NO: 608722 - RNA, 22 nt, Human
gccacugaacauuagagcuagu

SEQ ID NO: 608723 - RNA, 22 nt, Human
aaaugucuguaugagaaagaga

SEQ ID NO: 608724 - RNA, 22 nt, Human
ugaggccagugacauauauuaa

SEQ ID NO: 608725 - RNA, 22 nt, Human
gauuuauugucccuguccugcu

SEQ ID NO: 608726 - RNA, 22 nt, Human
uggcacugaagcuggaaagccu

SEQ ID NO: 608727 - RNA, 22 nt, Human
gagcugagcuuaacuccuugaa

SEQ ID NO: 608728 - RNA, 22 nt, Human
caaacauugggggcuucaacac

SEQ ID NO: 608729 - RNA, 22 nt, Human
ugcuccugauaucuaaugugua

SEQ ID NO: 608730 - RNA, 20 nt, Human
agcauucauucagcaagccu

SEQ ID NO: 608731 - RNA, 22 nt, Human
cuccuggugcuggggcugccgc

SEQ ID NO: 608732 - RNA, 22 nt, Human
gggcagcaggcuccacguuccu

SEQ ID NO: 608733 - RNA, 22 nt, Human
gaggaggcuuccgggaggcacg

SEQ ID NO: 608734 - RNA, 22 nt, Human
ugggggucaggaugaggccuug

SEQ ID NO: 608735 - RNA, 22 nt, Human
ccuggagguggagguugcagug

SEQ ID NO: 608736 - RNA, 22 nt, Human
uccagguguauuuacugaagua

SEQ ID NO: 608737 - RNA, 22 nt, Human
uuauggagacuuucagaagcgg

SEQ ID NO: 608738 - RNA, 22 nt, Human
gcccaggggaguagucaauuua

SEQ ID NO: 608739 - RNA, 22 nt, Human
ucccagaggaaauggcagcuga

SEQ ID NO: 608740 - RNA, 22 nt, Human
acccuccaggcugcagcuccug

SEQ ID NO: 608741 - RNA, 20 nt, Human
cccuccagcaaccaggacuu

SEQ ID NO: 608742 - RNA, 21 nt, Human
cagugaggcccuccuguuccc

SEQ ID NO: 608743 - RNA, 22 nt, Human
ccuggccacucagguguggggc

SEQ ID NO: 608744 - RNA, 22 nt, Human
ugacagugcggguacaucauag

SEQ ID NO: 608745 - RNA, 22 nt, Human
auggauaagaacaaauaucuga

SEQ ID NO: 608746 - RNA, 22 nt, Human
uaagcucacuguaagaacugau

SEQ ID NO: 608747 - RNA, 22 nt, Human
aaggcacuuaacgugggaggau

SEQ ID NO: 608748 - RNA, 22 nt, Human
agcauacacccuaaacugcuua

SEQ ID NO: 608749 - RNA, 22 nt, Human
aagacucuaucuuuagagauca

SEQ ID NO: 608750 - RNA, 22 nt, Human
ggacacagauaaucacacagau

SEQ ID NO: 608751 - RNA, 22 nt, Human
cagagguauuuugauaaacgcc

SEQ ID NO: 608752 - RNA, 22 nt, Human
uguccuuuguguaucuauagua

SEQ ID NO: 608753 - RNA, 22 nt, Human
cuggggccagugaggaggcuuu

SEQ ID NO: 608754 - RNA, 22 nt, Human
gacagguaccggucagacuacg

SEQ ID NO: 608755 - RNA, 22 nt, Human
ugagacagcccuucugcacagg

SEQ ID NO: 608756 - RNA, 22 nt, Human
ucucccucuguaagaucagggg

SEQ ID NO: 608757 - RNA, 22 nt, Human
ccugccuggcuuccagaagaga

SEQ ID NO: 608758 - RNA, 22 nt, Human
agggaagaaaauccaucgcugc

SEQ ID NO: 608759 - RNA, 22 nt, Human
uacuguuugcaguuugcaguau

SEQ ID NO: 608760 - RNA, 22 nt, Human
gcaaacauguugugagauacca

SEQ ID NO: 608761 - RNA, 22 nt, Human
agcagcuccccucaugcuccac

SEQ ID NO: 608762 - RNA, 23 nt, Human
uuguuucuuuguauugucucuau

SEQ ID NO: 608763 - RNA, 22 nt, Human
gaagggcuuucugggagaagag

SEQ ID NO: 608764 - RNA, 22 nt, Human
ugaggcaggagaaucacaugaa

SEQ ID NO: 608765 - RNA, 21 nt, Human
ucucugggcccuccugugggg

SEQ ID NO: 608766 - RNA, 22 nt, Human
ugcaucauuuauaaugucuuug

SEQ ID NO: 608767 - RNA, 22 nt, Human
agacuuuauaaaucuuaauuuc

SEQ ID NO: 608768 - RNA, 22 nt, Human
guagaauuaccucucuaugucc

SEQ ID NO: 608769 - RNA, 22 nt, Human
gugaaggcuacaagagaucaag

SEQ ID NO: 608770 - RNA, 19 nt, Human
uuuacaaguucuuuguaug

SEQ ID NO: 608771 - RNA, 22 nt, Human
uccucacacuauagaugaggau

SEQ ID NO: 608772 - RNA, 22 nt, Human
ucugggucggaagccccaggga

SEQ ID NO: 608773 - RNA, 21 nt, Human
gcuccuggugcugcguggcgc

SEQ ID NO: 608774 - RNA, 22 nt, Human
uauauuaacacccacuugccuc

SEQ ID NO: 608775 - RNA, 22 nt, Human
uuccugagggacuuuugagauu

SEQ ID NO: 608776 - RNA, 22 nt, Human
uccugguggcagauuuuagguc

SEQ ID NO: 608777 - RNA, 22 nt, Human
aguuagaagugugucaucugug

SEQ ID NO: 608778 - RNA, 22 nt, Human
guggucuggggucaggccugag

SEQ ID NO: 608779 - RNA, 22 nt, Human
agaaaucugacugcugugcaca

SEQ ID NO: 608780 - RNA, 22 nt, Human
gaaaaaugagcugaugucaggg

SEQ ID NO: 608781 - RNA, 22 nt, Human
gauagucaccucccuuaacuuu

SEQ ID NO: 608782 - RNA, 22 nt, Human
gcugaggcugggagcagccugu

SEQ ID NO: 608783 - RNA, 22 nt, Human
agggcugaaacauaauccuucu

SEQ ID NO: 608784 - RNA, 22 nt, Human
uacacugugacaaucaugacag

SEQ ID NO: 608785 - RNA, 22 nt, Human
agccaggaagagaggccucacc

SEQ ID NO: 608786 - RNA, 22 nt, Human
aguggcagccgagcaggagaug

SEQ ID NO: 608787 - RNA, 22 nt, Human
auauaacauacauacagaaaag

SEQ ID NO: 608788 - RNA, 22 nt, Human
ucuuggcuacuuuccugucugc

SEQ ID NO: 608789 - RNA, 22 nt, Human
ggagcuguucaggacugcuuca

SEQ ID NO: 608790 - RNA, 22 nt, Human
acaucacagagcccagauaaag

SEQ ID NO: 608791 - RNA, 20 nt, Human
ucccaaggaugccugggugu

SEQ ID NO: 608792 - RNA, 17 nt, Human
acagugagaagucaucu

SEQ ID NO: 608793 - RNA, 22 nt, Human
aucacagggugaggauuagacc

SEQ ID NO: 608794 - RNA, 19 nt, Human
agggccacggggagguauu

SEQ ID NO: 608795 - RNA, 22 nt, Human
cagcaagacaaggaacaaacug

SEQ ID NO: 608796 - RNA, 22 nt, Human
cuggaagaguaauauaaauuag

SEQ ID NO: 608797 - RNA, 22 nt, Human
gcagaggacagggauuuagauu

SEQ ID NO: 608798 - RNA, 22 nt, Human
gauuuuuauauaaagugagaaa

SEQ ID NO: 608799 - RNA, 22 nt, Human
gcaagauuccuugagccuaguu

SEQ ID NO: 608800 - RNA, 22 nt, Human
ccagacuggggcuccuugaggg

SEQ ID NO: 608801 - RNA, 22 nt, Human
guggcagggcuuugcuguucuu

SEQ ID NO: 608802 - RNA, 22 nt, Human
aggccacaguacuuugcagacc

SEQ ID NO: 608803 - RNA, 22 nt, Human
ucacuuugacggccaacuucua

SEQ ID NO: 608804 - RNA, 22 nt, Human
cagcacugcugcuguacacaca

SEQ ID NO: 608805 - RNA, 22 nt, Human
ucuccugacaugucuggaggaa

SEQ ID NO: 608806 - RNA, 22 nt, Human
acuccccagacugccaugcugg

SEQ ID NO: 608807 - RNA, 22 nt, Human
uuaaagucuauguacuacacuu

SEQ ID NO: 608808 - RNA, 22 nt, Human
aggcagaaccagcugggacuuu

SEQ ID NO: 608809 - RNA, 22 nt, Human
gcucugguuaaaaagaauuaaa

SEQ ID NO: 608810 - RNA, 19 nt, Human
agacucugccacucuucuc

SEQ ID NO: 608811 - RNA, 22 nt, Human
ccacugucagaggggcugugcc

SEQ ID NO: 608812 - RNA, 22 nt, Human
ucuggaguguccaguucuacuc

SEQ ID NO: 608813 - RNA, 22 nt, Human
gagugcaggccugagcaccauc

SEQ ID NO: 608814 - RNA, 22 nt, Human
aaaugugagacugaguuuuccu

SEQ ID NO: 608815 - RNA, 22 nt, Human
acagagagguaaaauauauagu

SEQ ID NO: 608816 - RNA, 22 nt, Human
gguggccugcccugaucccugg

SEQ ID NO: 608817 - RNA, 22 nt, Human
caggcucccacccuccugcagc

SEQ ID NO: 608818 - RNA, 22 nt, Human
cugguccuugacgcgugggagg

SEQ ID NO: 608819 - RNA, 22 nt, Human
ggcugagguguggggaacuaua

SEQ ID NO: 608820 - RNA, 22 nt, Human
cuuuggcagccucagcugcagg

SEQ ID NO: 608821 - RNA, 17 nt, Human
aagauuucauuagcuga

SEQ ID NO: 608822 - RNA, 22 nt, Human
ugggaaggcagucacuguccua

SEQ ID NO: 608823 - RNA, 21 nt, Human
aauguauaacagagcccauca

SEQ ID NO: 608824 - RNA, 22 nt, Human
agccacugugugaccagcuguc

SEQ ID NO: 608825 - RNA, 20 nt, Human
augcagucuuguggcaacua

SEQ ID NO: 608826 - RNA, 22 nt, Human
uguucuugggaaucuuacaguu

SEQ ID NO: 608827 - RNA, 22 nt, Human
gcuggugcucugggcccugagg

SEQ ID NO: 608828 - RNA, 22 nt, Human
auuuucaucgcuagguuggccu

SEQ ID NO: 608829 - RNA, 22 nt, Human
uacauacaguggaugcuuuagg

SEQ ID NO: 608830 - RNA, 21 nt, Human
uuuaauuugcauguaugacgc

SEQ ID NO: 608831 - RNA, 22 nt, Human
ucuuggccagaugcacuuccuc

SEQ ID NO: 608832 - RNA, 22 nt, Human
cugaggagcguuggucacgugu

SEQ ID NO: 608833 - RNA, 22 nt, Human
guuuucuuugaaugcuucuaga

SEQ ID NO: 608834 - RNA, 22 nt, Human
cuccuccagugggucccucagg

SEQ ID NO: 608835 - RNA, 22 nt, Human
gcuggggacuccccaccauagc

SEQ ID NO: 608836 - RNA, 19 nt, Human
ugcuucuggggcuucucca

SEQ ID NO: 608837 - RNA, 22 nt, Human
uucauugagcuguacacuuagg

SEQ ID NO: 608838 - RNA, 21 nt, Human
uauacaugugugcauacgugu

SEQ ID NO: 608839 - RNA, 22 nt, Human
gggcauggugcugguguucaug

SEQ ID NO: 608840 - RNA, 22 nt, Human
uuuccuaacucaucggauguac

SEQ ID NO: 608841 - RNA, 22 nt, Human
cugguccuccuugccuucagau

SEQ ID NO: 608842 - RNA, 23 nt, Human
cuuuccuuucuuugacacccagc

SEQ ID NO: 608843 - RNA, 22 nt, Human
uuagguaaggauggugacagua

SEQ ID NO: 608844 - RNA, 22 nt, Human
auuggcaguuggcugugguuca

SEQ ID NO: 608845 - RNA, 22 nt, Human
ucuguucuuuagccugcuugag

SEQ ID NO: 608846 - RNA, 21 nt, Human
ugaagccugaggcauagcccc

SEQ ID NO: 608847 - RNA, 22 nt, Human
cugcccucgggcccucccauag

SEQ ID NO: 608848 - RNA, 18 nt, Human
gagagggaucccucagga

SEQ ID NO: 608849 - RNA, 22 nt, Human
auuuccaagaaagcuuuaggau

SEQ ID NO: 608850 - RNA, 22 nt, Human
ugagccaggcuccaugccaccu

SEQ ID NO: 608851 - RNA, 22 nt, Human
gcaguguuguuaaaagauuaga

SEQ ID NO: 608852 - RNA, 22 nt, Human
guguguccaggcgggagucaag

SEQ ID NO: 608853 - RNA, 22 nt, Human
guaguauuuucugugauguagg

SEQ ID NO: 608854 - RNA, 22 nt, Human
uugcaguuuguggcaacuuuga

SEQ ID NO: 608855 - RNA, 22 nt, Human
uccuuagcaggcauucaggacc

SEQ ID NO: 608856 - RNA, 22 nt, Human
guuguauagagggcaugaaucu

SEQ ID NO: 608857 - RNA, 22 nt, Human
uuguuagugcaauguuugguga

SEQ ID NO: 608858 - RNA, 22 nt, Human
gcugcuggccccacaugcucca

SEQ ID NO: 608859 - RNA, 22 nt, Human
aguauaaugaaaugugucagua

SEQ ID NO: 608860 - RNA, 22 nt, Human
caggcagccugagggaucuggg

SEQ ID NO: 608861 - RNA, 22 nt, Human
uagauuucgcugcaucucaauc

SEQ ID NO: 608862 - RNA, 22 nt, Human
guaggaaagggagugaagggaa

SEQ ID NO: 608863 - RNA, 22 nt, Human
ucuaaaaaagucuguucacuug

SEQ ID NO: 608864 - RNA, 20 nt, Human
caggcaguuugugguuaggg

SEQ ID NO: 608865 - RNA, 22 nt, Human
uagacauuuucccuacccucau

SEQ ID NO: 608866 - RNA, 22 nt, Human
agagucugggcacugggaaugc

SEQ ID NO: 608867 - RNA, 22 nt, Human
gccuggcaauggccucaggaag

SEQ ID NO: 608868 - RNA, 22 nt, Human
cucuguaugaaucauauggagu

SEQ ID NO: 608869 - RNA, 22 nt, Human
acagggcaaccucugggagacu

SEQ ID NO: 608870 - RNA, 22 nt, Human
gagaaggaggcgaagcgugugc

SEQ ID NO: 608871 - RNA, 22 nt, Human
aaauuugccagaucaauucuga

SEQ ID NO: 608872 - RNA, 22 nt, Human
caggcacuucggcagcguggua

SEQ ID NO: 608873 - RNA, 23 nt, Human
guaaaauacgcagugcaguguga

SEQ ID NO: 608874 - RNA, 22 nt, Human
ugugugggagcacgggcuguug

SEQ ID NO: 608875 - RNA, 22 nt, Human
ccaggcugagcaugauuggagc

SEQ ID NO: 608876 - RNA, 22 nt, Human
gccuccaguuuuuuucugaacu

SEQ ID NO: 608877 - RNA, 22 nt, Human
ucugucuuggccagccaucugg

SEQ ID NO: 608878 - RNA, 21 nt, Human
uguauaacaacuaugcaaugu

SEQ ID NO: 608879 - RNA, 22 nt, Human
cucuggcuggcaccugaucuga

SEQ ID NO: 608880 - RNA, 22 nt, Human
ccaggcauccauugcuuccucu

SEQ ID NO: 608881 - RNA, 22 nt, Human
uccucuggauauaagccucacc

SEQ ID NO: 608882 - RNA, 22 nt, Human
gaggugggaugugugugcuacu

SEQ ID NO: 608883 - RNA, 22 nt, Human
agcccagcacugggggcccagc

SEQ ID NO: 608884 - RNA, 22 nt, Human
uuuauugcauacacaaauguca

SEQ ID NO: 608885 - RNA, 22 nt, Human
cugggacuugggcuaugcucug

SEQ ID NO: 608886 - RNA, 22 nt, Human
uuguauuagcuguaaauuuucu

SEQ ID NO: 608887 - RNA, 22 nt, Human
ugaagccauuacuguguuaggg

SEQ ID NO: 608888 - RNA, 22 nt, Human
aagcaguuaauguuuugucaau

SEQ ID NO: 608889 - RNA, 22 nt, Human
cagagagaaucuuggcagcuga

SEQ ID NO: 608890 - RNA, 22 nt, Human
uggaaagaggaagugcccagca

SEQ ID NO: 608891 - RNA, 22 nt, Human
aggcagcugcccucuccuuccu

SEQ ID NO: 608892 - RNA, 22 nt, Human
cauucacaaaaccacaugccau

SEQ ID NO: 608893 - RNA, 22 nt, Human
gcccugaggcaaaagaacaguc

SEQ ID NO: 608894 - RNA, 22 nt, Human
auuucaugugaagaagagauaa

SEQ ID NO: 608895 - RNA, 22 nt, Human
uugcaucagaaaauaugggaag

SEQ ID NO: 608896 - RNA, 23 nt, Human
cugaggggaaaagggcuucaggc

SEQ ID NO: 608897 - RNA, 22 nt, Human
cuacaggcucagggagcccucu

SEQ ID NO: 608898 - RNA, 22 nt, Human
cagaaacagagaaauauuggcu

SEQ ID NO: 608899 - RNA, 22 nt, Human
ugcagggcuacaggacuacaac

SEQ ID NO: 608900 - RNA, 22 nt, Human
aggagggcaggcuggcugccua

SEQ ID NO: 608901 - RNA, 22 nt, Human
agcugcugcgccucacccuggc

SEQ ID NO: 608902 - RNA, 22 nt, Human
ucucuguaguugggcagcugcu

SEQ ID NO: 608903 - RNA, 22 nt, Human
gccaguggagcacauggugaag

SEQ ID NO: 608904 - RNA, 22 nt, Human
ggcugcugggucaugaugcaga

SEQ ID NO: 608905 - RNA, 22 nt, Human
ccuccccacaggccaaauaggc

SEQ ID NO: 608906 - RNA, 19 nt, Human
gccaggcuccauagccggc

SEQ ID NO: 608907 - RNA, 22 nt, Human
caagaaucaacauuauuuagug

SEQ ID NO: 608908 - RNA, 21 nt, Human
uccagccuuucccucacuucc

SEQ ID NO: 608909 - RNA, 22 nt, Human
gaagcagugugaacccauguaa

SEQ ID NO: 608910 - RNA, 22 nt, Human
ugagccagaggaggcugugugg

SEQ ID NO: 608911 - RNA, 22 nt, Human
ugagguagggaaggcugguauu

SEQ ID NO: 608912 - RNA, 22 nt, Human
ucaagcuggcuguugcuauuuc

SEQ ID NO: 608913 - RNA, 22 nt, Human
gccccagaaaguucaaggcaca

SEQ ID NO: 608914 - RNA, 22 nt, Human
ugccuagaacuuuauucuuuau

SEQ ID NO: 608915 - RNA, 22 nt, Human
agccacagagcaggagaccuuu

SEQ ID NO: 608916 - RNA, 22 nt, Human
ucuccugguuuguuaaauaauu

SEQ ID NO: 608917 - RNA, 22 nt, Human
gagucugagaacugggcucagu

SEQ ID NO: 608918 - RNA, 20 nt, Human
uagcauuccagaaaacucag

SEQ ID NO: 608919 - RNA, 22 nt, Human
caagagcuagacuuugucagga

SEQ ID NO: 608920 - RNA, 22 nt, Human
cuucauuaaccaaaaugcaaua

SEQ ID NO: 608921 - RNA, 22 nt, Human
gcagggcuaauggggcaaguag

SEQ ID NO: 608922 - RNA, 22 nt, Human
cccagcaggucggugcugccug

SEQ ID NO: 608923 - RNA, 22 nt, Human
uggaggaaaaaaccaggcagag

SEQ ID NO: 608924 - RNA, 22 nt, Human
ggcuagggaucuagaccaggac

SEQ ID NO: 608925 - RNA, 22 nt, Human
acagagcuuaauucaggagcuu

SEQ ID NO: 608926 - RNA, 22 nt, Human
auaaaauuugcuacuguuaaau

SEQ ID NO: 608927 - RNA, 22 nt, Human
accagcugccaagggcuacacu

SEQ ID NO: 608928 - RNA, 22 nt, Human
uacaucaagauaaaaacuguca

SEQ ID NO: 608929 - RNA, 19 nt, Human
gaagaagcuugagaaguag

SEQ ID NO: 608930 - RNA, 22 nt, Human
auacauuagaaucugguacuca

SEQ ID NO: 608931 - RNA, 22 nt, Human
uggaagcgagacagagaucucc

SEQ ID NO: 608932 - RNA, 22 nt, Human
gucagcucagcaggugggagug

SEQ ID NO: 608933 - RNA, 23 nt, Human
acagaaaguucugcuggacagag

SEQ ID NO: 608934 - RNA, 22 nt, Human
aauugcuucauuaacauuuagg

SEQ ID NO: 608935 - RNA, 22 nt, Human
ugagccuggggccugggcagcg

SEQ ID NO: 608936 - RNA, 22 nt, Human
gugcccaggggccagcugccgg

SEQ ID NO: 608937 - RNA, 22 nt, Human
aaucuuagguuuggcuucaucu

SEQ ID NO: 608938 - RNA, 22 nt, Human
cagguccucgggggaggccggc

SEQ ID NO: 608939 - RNA, 23 nt, Human
uggcagagacccagaaucuacau

SEQ ID NO: 608940 - RNA, 21 nt, Human
uaggagcugauggggaaguag

SEQ ID NO: 608941 - RNA, 22 nt, Human
ucugggaaguccucugucaugc

SEQ ID NO: 608942 - RNA, 19 nt, Human
agccuggagggcuggucac

SEQ ID NO: 608943 - RNA, 22 nt, Human
ucacauacacuaggauauuuuu

SEQ ID NO: 608944 - RNA, 23 nt, Human
ccuggcuguggauuugggccugc

SEQ ID NO: 608945 - RNA, 22 nt, Human
uuucugucauaguuaucuuugu

SEQ ID NO: 608946 - RNA, 22 nt, Human
gcuucagcccaucccaguacau

SEQ ID NO: 608947 - RNA, 22 nt, Human
ucugcugugucccuggucuccu

SEQ ID NO: 608948 - RNA, 17 nt, Human
gagaguguauuggaugc

SEQ ID NO: 608949 - RNA, 17 nt, Human
cagcucuuccucccucu

SEQ ID NO: 608950 - RNA, 22 nt, Human
gcaggagacaacuguaaggaga

SEQ ID NO: 608951 - RNA, 22 nt, Human
aacaauaggcuauaugcuaggc

SEQ ID NO: 608952 - RNA, 22 nt, Human
guacaugugcacaacaugcaug

SEQ ID NO: 608953 - RNA, 22 nt, Human
aaauagacacuuggacagacaa

SEQ ID NO: 608954 - RNA, 22 nt, Human
aacaagauagauaucacuuagg

SEQ ID NO: 608955 - RNA, 23 nt, Human
uuuuccuuuggacaggcuguauu

SEQ ID NO: 608956 - RNA, 22 nt, Human
ugccugggcucgguagccaucg

SEQ ID NO: 608957 - RNA, 22 nt, Human
ucauaaauuagcugucuuugaa

SEQ ID NO: 608958 - RNA, 22 nt, Human
cacugaccauggccaauuggca

SEQ ID NO: 608959 - RNA, 22 nt, Human
cuccuggccacguucuugcugg

SEQ ID NO: 608960 - RNA, 22 nt, Human
ucugggagagcugcugucagag

SEQ ID NO: 608961 - RNA, 22 nt, Human
agugggagcggcagucggggac

SEQ ID NO: 608962 - RNA, 22 nt, Human
uggcaaagacgcuagcuaagau

SEQ ID NO: 608963 - RNA, 22 nt, Human
cuccagugcugucaucccuucc

SEQ ID NO: 608964 - RNA, 22 nt, Human
aggagacauggaauagugaggc

SEQ ID NO: 608965 - RNA, 22 nt, Human
ggccaggcugcccugggagcag

SEQ ID NO: 608966 - RNA, 22 nt, Human
ucucuguggguuucaccagcgc

SEQ ID NO: 608967 - RNA, 22 nt, Human
uguuagauauucauuaauagga

SEQ ID NO: 608968 - RNA, 22 nt, Human
caggccaccagauacaugcccc

SEQ ID NO: 608969 - RNA, 22 nt, Human
aucucuggccccugggguccga

SEQ ID NO: 608970 - RNA, 21 nt, Human
ucuggagucaucuuuaccaua

SEQ ID NO: 608971 - RNA, 22 nt, Human
ggaagaaaguagaaaaccgugg

SEQ ID NO: 608972 - RNA, 22 nt, Human
cccuggagaucgggagaggaag

SEQ ID NO: 608973 - RNA, 22 nt, Human
ucuaacauuguuuuucacagau

SEQ ID NO: 608974 - RNA, 19 nt, Human
cccaggagucuggcugguu

SEQ ID NO: 608975 - RNA, 22 nt, Human
gcuuaauucuggcucaguuucc

SEQ ID NO: 608976 - RNA, 22 nt, Human
agucacugggcugcuuccuaua

SEQ ID NO: 608977 - RNA, 22 nt, Human
ucauuuacuguaggagugaacc

SEQ ID NO: 608978 - RNA, 22 nt, Human
ugggccuggagcccuggagagu

SEQ ID NO: 608979 - RNA, 20 nt, Human
uauuaugaccuguguucugg

SEQ ID NO: 608980 - RNA, 22 nt, Human
cuuggucauuucuuguccuguu

SEQ ID NO: 608981 - RNA, 22 nt, Human
gaggccuauaggcaagugcugc

SEQ ID NO: 608982 - RNA, 22 nt, Human
cuggccccagaguuucacuugg

SEQ ID NO: 608983 - RNA, 22 nt, Human
cagcuggcuggucagugcacaa

SEQ ID NO: 608984 - RNA, 18 nt, Human
ggcagccuacccacuugu

SEQ ID NO: 608985 - RNA, 22 nt, Human
gacugcagugaaggcacauggg

SEQ ID NO: 608986 - RNA, 22 nt, Human
cuucuugucaauuugccauugu

SEQ ID NO: 608987 - RNA, 22 nt, Human
agcaaugcaaucuuaaccuuga

SEQ ID NO: 608988 - RNA, 22 nt, Human
agccagcaggugcagaauucca

SEQ ID NO: 608989 - RNA, 22 nt, Human
cuaguguuuggaagucauagcc

SEQ ID NO: 608990 - RNA, 20 nt, Human
ccagggcuggcuccugggau

SEQ ID NO: 608991 - RNA, 20 nt, Human
aacacaggguuaccaucaga

SEQ ID NO: 608992 - RNA, 22 nt, Human
ugaccucuguccugcagucugg

SEQ ID NO: 608993 - RNA, 22 nt, Human
ccugagaccaaguugcagccau

SEQ ID NO: 608994 - RNA, 22 nt, Human
acaagauagguugagucuagcc

SEQ ID NO: 608995 - RNA, 22 nt, Human
cuggggcucacuuuggucaggc

SEQ ID NO: 608996 - RNA, 22 nt, Human
gcccagggcuucaaagagagaa

SEQ ID NO: 608997 - RNA, 22 nt, Human
ggcacagcgacuaccaucgaaa

SEQ ID NO: 608998 - RNA, 22 nt, Human
uauauaauuuguaaaagcaccu

SEQ ID NO: 608999 - RNA, 22 nt, Human
aaagccaagcugggaaggcagg

SEQ ID NO: 609000 - RNA, 20 nt, Human
gcugggcuaccacuggcccu

SEQ ID NO: 609001 - RNA, 22 nt, Human
ggccuaggaaggggauguaacu

SEQ ID NO: 609002 - RNA, 22 nt, Human
ucacccaggcuggugcgcagug

SEQ ID NO: 609003 - RNA, 22 nt, Human
auauucuuauccuuuucucugu

SEQ ID NO: 609004 - RNA, 22 nt, Human
gaggaagggcugccugccgggc

SEQ ID NO: 609005 - RNA, 22 nt, Human
gcaggcaccacggcucaggucu

SEQ ID NO: 609006 - RNA, 22 nt, Human
agacagugcaagaagagcaggc

SEQ ID NO: 609007 - RNA, 22 nt, Human
cagagcccugggcacaugguag

SEQ ID NO: 609008 - RNA, 22 nt, Human
aagaauaagaggauuuagaaca

SEQ ID NO: 609009 - RNA, 22 nt, Human
gagcuuuuauaccuucucucag

SEQ ID NO: 609010 - RNA, 22 nt, Human
uugcuguuuuacaucugguggg

SEQ ID NO: 609011 - RNA, 22 nt, Human
acauuguucacaggggcuucuc

SEQ ID NO: 609012 - RNA, 22 nt, Human
uuaagacacauuucucagacgg

SEQ ID NO: 609013 - RNA, 20 nt, Human
aggcaucugagucacaucuu

SEQ ID NO: 609014 - RNA, 22 nt, Human
caggaaccuaaagagacauuac

SEQ ID NO: 609015 - RNA, 22 nt, Human
cccacccagccuggcugagggg

SEQ ID NO: 609016 - RNA, 23 nt, Human
ucuuguuuccuuugcgcuaucca

SEQ ID NO: 609017 - RNA, 22 nt, Human
ucauggauuaaauuauuaaguu

SEQ ID NO: 609018 - RNA, 22 nt, Human
gcagcugcuggaaguuccugcc

SEQ ID NO: 609019 - RNA, 22 nt, Human
cuggcagcagcuucuggaucga

SEQ ID NO: 609020 - RNA, 22 nt, Human
cugggacaugauagaaacagau

SEQ ID NO: 609021 - RNA, 17 nt, Human
cagggcugucugccuag

SEQ ID NO: 609022 - RNA, 22 nt, Human
uggagcaggccggaaguggcuu

SEQ ID NO: 609023 - RNA, 22 nt, Human
cuggagucacacacaccaaggu

SEQ ID NO: 609024 - RNA, 22 nt, Human
cugaagacugcugagaaguuac

SEQ ID NO: 609025 - RNA, 22 nt, Human
augcacuaugaugagcuagucu

SEQ ID NO: 609026 - RNA, 18 nt, Human
ccacccagggggagagga

SEQ ID NO: 609027 - RNA, 23 nt, Human
gcccagggacugggaaucagugg

SEQ ID NO: 609028 - RNA, 22 nt, Human
ugcaguggugguaaagaugcuc

SEQ ID NO: 609029 - RNA, 23 nt, Human
ggccucagcgcacagaaacugcu

SEQ ID NO: 609030 - RNA, 22 nt, Human
ccagcugcugugcagggaggcu

SEQ ID NO: 609031 - RNA, 22 nt, Human
ugucacuuuggggagaguuuug

SEQ ID NO: 609032 - RNA, 22 nt, Human
acuguguggaaauuugugaggg

SEQ ID NO: 609033 - RNA, 22 nt, Human
gggccaggucggugaaugguca

SEQ ID NO: 609034 - RNA, 22 nt, Human
cuauggaaacucaacauuuguu

SEQ ID NO: 609035 - RNA, 22 nt, Human
acaugaauauaugaaguucaac

SEQ ID NO: 609036 - RNA, 22 nt, Human
ggccugggcccacugucaagag

SEQ ID NO: 609037 - RNA, 22 nt, Human
gagaaacuuggaguuauucugg

SEQ ID NO: 609038 - RNA, 19 nt, Human
ucugggaagccgggcucca

SEQ ID NO: 609039 - RNA, 22 nt, Human
agggagcccugaaccagagggu

SEQ ID NO: 609040 - RNA, 22 nt, Human
ugaaaggugacauuucuuggau

SEQ ID NO: 609041 - RNA, 22 nt, Human
gcuggagcggguucgggccgcu

SEQ ID NO: 609042 - RNA, 22 nt, Human
guaggcagggcuguggggagaa

SEQ ID NO: 609043 - RNA, 22 nt, Human
aagagguucuaauuuaacuauc

SEQ ID NO: 609044 - RNA, 22 nt, Human
uuacagauggcaguuucuugag

SEQ ID NO: 609045 - RNA, 22 nt, Human
uuucacaaucaaauggugaaau

SEQ ID NO: 609046 - RNA, 22 nt, Human
agccagagaacagcaggaaaug

SEQ ID NO: 609047 - RNA, 22 nt, Human
gugguuuguuuuauuccuggaa

SEQ ID NO: 609048 - RNA, 21 nt, Human
aacuggcagaccaacuauggc

SEQ ID NO: 609049 - RNA, 22 nt, Human
cagagguagaaggcaugcagug

SEQ ID NO: 609050 - RNA, 22 nt, Human
cuucagcaucuuuuucuugggg

SEQ ID NO: 609051 - RNA, 22 nt, Human
aucagaagaaauggaugugacu

SEQ ID NO: 609052 - RNA, 22 nt, Human
caguccuuucugaaauccuaua

SEQ ID NO: 609053 - RNA, 21 nt, Human
uggcagagugcagucuauaca

SEQ ID NO: 609054 - RNA, 21 nt, Human
agagcucaaggcaaaaauaau

SEQ ID NO: 609055 - RNA, 22 nt, Human
ggucccaggauugguugcgcag

SEQ ID NO: 609056 - RNA, 22 nt, Human
ucuuucuuaaauagguggauug

SEQ ID NO: 609057 - RNA, 22 nt, Human
cuggagaguaaucucuguguua

SEQ ID NO: 609058 - RNA, 22 nt, Human
uccuggggccaggcaccucugg

SEQ ID NO: 609059 - RNA, 22 nt, Human
augaggccuaucuuggcagagg

SEQ ID NO: 609060 - RNA, 22 nt, Human
cagucucuugcuucauuaguug

SEQ ID NO: 609061 - RNA, 22 nt, Human
gaagcagcuaggaucuucauuu

SEQ ID NO: 609062 - RNA, 22 nt, Human
ugggcacucaggcugaggccgu

SEQ ID NO: 609063 - RNA, 22 nt, Human
guuuucaaggggauuuaacuga

SEQ ID NO: 609064 - RNA, 22 nt, Human
acauauaugugcacaugugcag

SEQ ID NO: 609065 - RNA, 22 nt, Human
gugcuacaugguaguguaguua

SEQ ID NO: 609066 - RNA, 22 nt, Human
cuuucucuucacugucaugauc

SEQ ID NO: 609067 - RNA, 22 nt, Human
ccugggaaggggaagagaauuc

SEQ ID NO: 609068 - RNA, 19 nt, Human
cacacccaugcuugccaag

SEQ ID NO: 609069 - RNA, 22 nt, Human
gcucacaggggcagacgaguug

SEQ ID NO: 609070 - RNA, 22 nt, Human
cugccuuuggggaguuagaggg

SEQ ID NO: 609071 - RNA, 22 nt, Human
ugagucagucugcccuggcuuc

SEQ ID NO: 609072 - RNA, 22 nt, Human
gcugagauuacgggcaugagcc

SEQ ID NO: 609073 - RNA, 22 nt, Human
augcuaaagggguaggccuccu

SEQ ID NO: 609074 - RNA, 22 nt, Human
gggagccacagugaggugcaug

SEQ ID NO: 609075 - RNA, 22 nt, Human
cccaagggguguugauggagga

SEQ ID NO: 609076 - RNA, 22 nt, Human
gcuuccuuauuguugccauagu

SEQ ID NO: 609077 - RNA, 22 nt, Human
gcucaagagagaugcaguucuu

SEQ ID NO: 609078 - RNA, 22 nt, Human
guugugcaccacuguugauuga

SEQ ID NO: 609079 - RNA, 22 nt, Human
uguacacauaucauuuguggga

SEQ ID NO: 609080 - RNA, 22 nt, Human
aggcccaguagugcugccuuua

SEQ ID NO: 609081 - RNA, 22 nt, Human
ccugcuggccaguggagggcug

SEQ ID NO: 609082 - RNA, 22 nt, Human
ucugaaaugcaaauuugacuga

SEQ ID NO: 609083 - RNA, 22 nt, Human
ugaagauuuuguagcuuucagc

SEQ ID NO: 609084 - RNA, 22 nt, Human
cuuuccuagaaauauauacuua

SEQ ID NO: 609085 - RNA, 22 nt, Human
augcugagcagagcugacaugc

SEQ ID NO: 609086 - RNA, 22 nt, Human
caggccucagagaguggcgggg

SEQ ID NO: 609087 - RNA, 22 nt, Human
cagggagcaggcucuguccauc

SEQ ID NO: 609088 - RNA, 22 nt, Human
ugaaugaucuaguuuuguagac

SEQ ID NO: 609089 - RNA, 22 nt, Human
aagagagaguuccuaggcaaaa

SEQ ID NO: 609090 - RNA, 22 nt, Human
agaagugccgaaaggaagacag

SEQ ID NO: 609091 - RNA, 22 nt, Human
uccagagcuaauucagcagcug

SEQ ID NO: 609092 - RNA, 22 nt, Human
agcaccaggucgcuggcacgcu

SEQ ID NO: 609093 - RNA, 22 nt, Human
uccagggcgugugugaaggaaa

SEQ ID NO: 609094 - RNA, 22 nt, Human
ccagccugaaaugccucauccu

SEQ ID NO: 609095 - RNA, 20 nt, Human
uucacagaggacucagguca

SEQ ID NO: 609096 - RNA, 22 nt, Human
gagccuggguccuucccuggga

SEQ ID NO: 609097 - RNA, 22 nt, Human
uauauguuuuucuaauuaggga

SEQ ID NO: 609098 - RNA, 22 nt, Human
agguccuggacugcucuuguua

SEQ ID NO: 609099 - RNA, 22 nt, Human
uaauuuaauuucaugccagccu

SEQ ID NO: 609100 - RNA, 22 nt, Human
agaaaucaggaacaguaaggag

SEQ ID NO: 609101 - RNA, 22 nt, Human
agagcuggugcauauucagaaa

SEQ ID NO: 609102 - RNA, 22 nt, Human
auaggaugauaaaauuagaaac

SEQ ID NO: 609103 - RNA, 22 nt, Human
ucucuguccccucagcuggggu

SEQ ID NO: 609104 - RNA, 22 nt, Human
cagaggaaggcucugggaaugu

SEQ ID NO: 609105 - RNA, 22 nt, Human
uaauguacaagaggcuagggug

SEQ ID NO: 609106 - RNA, 22 nt, Human
ccaggagaauaauggcagauua

SEQ ID NO: 609107 - RNA, 20 nt, Human
agugcuguggcugaauaaga

SEQ ID NO: 609108 - RNA, 17 nt, Human
ucagcauacacagagaa

SEQ ID NO: 609109 - RNA, 22 nt, Human
gcagggugaaggucacauagaa

SEQ ID NO: 609110 - RNA, 22 nt, Human
cagacaggguuuuggucuuugg

SEQ ID NO: 609111 - RNA, 22 nt, Human
uugggagguaauggagccaagu

SEQ ID NO: 609112 - RNA, 20 nt, Human
cagaugcuggaucuuggucc

SEQ ID NO: 609113 - RNA, 22 nt, Human
agucauuuucugccuguaaucu

SEQ ID NO: 609114 - RNA, 22 nt, Human
gcagggcagaaggugcugagga

SEQ ID NO: 609115 - RNA, 22 nt, Human
uuuauccaucaucugcugaagg

SEQ ID NO: 609116 - RNA, 22 nt, Human
cuuccgugucaguuccaggugg

SEQ ID NO: 609117 - RNA, 23 nt, Human
ggacaugucucuggguauuuuga

SEQ ID NO: 609118 - RNA, 22 nt, Human
aagcagcugauuucacagcuca

SEQ ID NO: 609119 - RNA, 22 nt, Human
ucugggaagccuguaugcagaa

SEQ ID NO: 609120 - RNA, 22 nt, Human
acauuuaaugauccuacuguga

SEQ ID NO: 609121 - RNA, 22 nt, Human
ccaggcugccgaggaaagaaag

SEQ ID NO: 609122 - RNA, 22 nt, Human
uuucucaaauugcaugaguagc

SEQ ID NO: 609123 - RNA, 22 nt, Human
ucucagggcgcagugaggcagu

SEQ ID NO: 609124 - RNA, 22 nt, Human
uuccuucuagcccaaguauugg

SEQ ID NO: 609125 - RNA, 22 nt, Human
agccauggcgccacuagaggga

SEQ ID NO: 609126 - RNA, 22 nt, Human
gaaguuuuuguagagacagggu

SEQ ID NO: 609127 - RNA, 21 nt, Human
acuuucuguggguucaagcau

SEQ ID NO: 609128 - RNA, 22 nt, Human
ucuggaaauaaaauuauaguug

SEQ ID NO: 609129 - RNA, 22 nt, Human
aaaucagaucuuacacaauugu

SEQ ID NO: 609130 - RNA, 23 nt, Human
uguacaguuguuugacucagcuc

SEQ ID NO: 609131 - RNA, 22 nt, Human
gcacugcagguggguggagagg

SEQ ID NO: 609132 - RNA, 22 nt, Human
uguauaaguguguagaguaaga

SEQ ID NO: 609133 - RNA, 21 nt, Human
agcugccuuuagagagaacca

SEQ ID NO: 609134 - RNA, 22 nt, Human
ggagguagucugagucauaggc

SEQ ID NO: 609135 - RNA, 22 nt, Human
uugaaacagacaaguaaauguc

SEQ ID NO: 609136 - RNA, 22 nt, Human
ggcugccugccgcccacuuggc

SEQ ID NO: 609137 - RNA, 22 nt, Human
aaagacugguguguuacauaua

SEQ ID NO: 609138 - RNA, 21 nt, Human
gacaaugcagucuuuuuugga

SEQ ID NO: 609139 - RNA, 22 nt, Human
uuccuccacgugacaggagcca

SEQ ID NO: 609140 - RNA, 22 nt, Human
cuuuagaauuugauauaaucaa

SEQ ID NO: 609141 - RNA, 23 nt, Human
gcagagcugcccuauugccuugg

SEQ ID NO: 609142 - RNA, 22 nt, Human
agaguucugcucuucucaguga

SEQ ID NO: 609143 - RNA, 18 nt, Human
uuuccuuguaugaacaua

SEQ ID NO: 609144 - RNA, 22 nt, Human
gcugaggcuccucgggaggaca

SEQ ID NO: 609145 - RNA, 22 nt, Human
cucuccauucccuacaguuuuc

SEQ ID NO: 609146 - RNA, 22 nt, Human
cauggcagcuuugggaggagga

SEQ ID NO: 609147 - RNA, 22 nt, Human
uccagggccacagaggaugcua

SEQ ID NO: 609148 - RNA, 22 nt, Human
ccaggcuuuaagagguggaaac

SEQ ID NO: 609149 - RNA, 22 nt, Human
gugcuugggggaaguaacagac

SEQ ID NO: 609150 - RNA, 23 nt, Human
uguuaauacaucugccacucauu

SEQ ID NO: 609151 - RNA, 22 nt, Human
ugccugucagggggagugggaa

SEQ ID NO: 609152 - RNA, 23 nt, Human
cguuuuuuccucagauguucugg

SEQ ID NO: 609153 - RNA, 22 nt, Human
acuacacuccaauuuucuaggu

SEQ ID NO: 609154 - RNA, 22 nt, Human
uauuuccaaaagccuauuauga

SEQ ID NO: 609155 - RNA, 22 nt, Human
gaggguggccuuuagagcccau

SEQ ID NO: 609156 - RNA, 22 nt, Human
guuuacauugcuguuugugucu

SEQ ID NO: 609157 - RNA, 22 nt, Human
aaagcuucuaggccuauugcuu

SEQ ID NO: 609158 - RNA, 22 nt, Human
uuccugccccugagagcuccca

SEQ ID NO: 609159 - RNA, 22 nt, Human
caccagaguuguccaaaugauu

SEQ ID NO: 609160 - RNA, 22 nt, Human
gucccagaaacauauugcuggu

SEQ ID NO: 609161 - RNA, 22 nt, Human
caguuacagcugcaccagagcc

SEQ ID NO: 609162 - RNA, 22 nt, Human
agccugggcaugggacgggagg

SEQ ID NO: 609163 - RNA, 22 nt, Human
caguggaauauauaggggauuu

SEQ ID NO: 609164 - RNA, 22 nt, Human
aagcauaaaacguuacaacaug

SEQ ID NO: 609165 - RNA, 22 nt, Human
uggcaguguuucuaaggggcuc

SEQ ID NO: 609166 - RNA, 22 nt, Human
cagaucugcuccucuguccaug

SEQ ID NO: 609167 - RNA, 22 nt, Human
gcuggagccuucugcucuguug

SEQ ID NO: 609168 - RNA, 22 nt, Human
cacugcuugcaguaugagugga

SEQ ID NO: 609169 - RNA, 21 nt, Human
ugccagcugcugcaucugucu

SEQ ID NO: 609170 - RNA, 22 nt, Human
aacacuggaagggacaucaagu

SEQ ID NO: 609171 - RNA, 22 nt, Human
auauaauuaauuuagcugccuc

SEQ ID NO: 609172 - RNA, 22 nt, Human
acaguguuuaagagauggcauu

SEQ ID NO: 609173 - RNA, 22 nt, Human
cuugcuuuaucugguuucucau

SEQ ID NO: 609174 - RNA, 22 nt, Human
gggaagauaguguugagggccc

SEQ ID NO: 609175 - RNA, 22 nt, Human
cagaugagcaugggcacaagca

SEQ ID NO: 609176 - RNA, 22 nt, Human
gcccaggagguggaggugcagu

SEQ ID NO: 609177 - RNA, 22 nt, Human
ucaguaaagucucuagagggua

SEQ ID NO: 609178 - RNA, 22 nt, Human
gggcccaguacccucugccaag

SEQ ID NO: 609179 - RNA, 18 nt, Human
uucacaagggcuugguuu

SEQ ID NO: 609180 - RNA, 22 nt, Human
uucacuguuguuagcagaggcg

SEQ ID NO: 609181 - RNA, 20 nt, Human
aaucagaaagugugagcucu

SEQ ID NO: 609182 - RNA, 22 nt, Human
caugcuggucagccaguggaug

SEQ ID NO: 609183 - RNA, 22 nt, Human
uuuagcauuacuaaaaugaaaa

SEQ ID NO: 609184 - RNA, 22 nt, Human
agcagccagaaagggcagucga

SEQ ID NO: 609185 - RNA, 22 nt, Human
cauaucuuaugguuuucuaagu

SEQ ID NO: 609186 - RNA, 18 nt, Human
uauaaacacacuuagguu

SEQ ID NO: 609187 - RNA, 22 nt, Human
uggucacccacugggacugcgg

SEQ ID NO: 609188 - RNA, 20 nt, Human
gggcaucuuugcuccuguuu

SEQ ID NO: 609189 - RNA, 20 nt, Human
gugcugagggcugggcaaug

SEQ ID NO: 609190 - RNA, 21 nt, Human
aggcacuguuugugguuuggg

SEQ ID NO: 609191 - RNA, 22 nt, Human
uggcuggacagugggcagugga

SEQ ID NO: 609192 - RNA, 22 nt, Human
uucagcacuggacagcgagucu

SEQ ID NO: 609193 - RNA, 22 nt, Human
aaggaagagucuagaacaggca

SEQ ID NO: 609194 - RNA, 22 nt, Human
ccugguggcuucuggguggacg

SEQ ID NO: 609195 - RNA, 22 nt, Human
guuuaugaauguuacuauagag

SEQ ID NO: 609196 - RNA, 22 nt, Human
ggcugcugacaaacaugaucau

SEQ ID NO: 609197 - RNA, 22 nt, Human
ggagauggcuggcagguagaug

SEQ ID NO: 609198 - RNA, 22 nt, Human
cugggaguuuguuaguaaugca

SEQ ID NO: 609199 - RNA, 22 nt, Human
uagaaaugagccaugguagagc

SEQ ID NO: 609200 - RNA, 22 nt, Human
ugcuccagugccugccccacag

SEQ ID NO: 609201 - RNA, 22 nt, Human
ggcucagggaaugaggaagaau

SEQ ID NO: 609202 - RNA, 22 nt, Human
acuuugugcccaacagaaagaa

SEQ ID NO: 609203 - RNA, 22 nt, Human
ucagagcugcccaugcaagggg

SEQ ID NO: 609204 - RNA, 21 nt, Human
augaaugauuucuacucuuaa

SEQ ID NO: 609205 - RNA, 22 nt, Human
acagcagagugugagauagcca

SEQ ID NO: 609206 - RNA, 22 nt, Human
auauccuugagacguggcuacu

SEQ ID NO: 609207 - RNA, 20 nt, Human
uugcacagagaaggaggcag

SEQ ID NO: 609208 - RNA, 22 nt, Human
cagugcaguugguggcaggggu

SEQ ID NO: 609209 - RNA, 22 nt, Human
ggggcagaguagcuggggugug

SEQ ID NO: 609210 - RNA, 22 nt, Human
ugggccagcacugggugcucau

SEQ ID NO: 609211 - RNA, 22 nt, Human
uggagccaaugaacauuugcug

SEQ ID NO: 609212 - RNA, 22 nt, Human
cuggucugggaugagggaugua

SEQ ID NO: 609213 - RNA, 22 nt, Human
gccaccagggggugcaaggucc

SEQ ID NO: 609214 - RNA, 22 nt, Human
guuuaaauaauuaggggccugu

SEQ ID NO: 609215 - RNA, 22 nt, Human
ucuuccaggagggcauuucuuu

SEQ ID NO: 609216 - RNA, 19 nt, Human
ugggcagcucccucugucc

SEQ ID NO: 609217 - RNA, 22 nt, Human
gcugcuggcacuggagugagcc

SEQ ID NO: 609218 - RNA, 22 nt, Human
caaauaagcaauuccauucuuc

SEQ ID NO: 609219 - RNA, 22 nt, Human
acuuugaaacuaaaauucauua

SEQ ID NO: 609220 - RNA, 18 nt, Human
ucaugcaaacgcuucaua

SEQ ID NO: 609221 - RNA, 22 nt, Human
uggaggucucugucugggcagg

SEQ ID NO: 609222 - RNA, 22 nt, Human
ggugcaggacgaaguggggguu

SEQ ID NO: 609223 - RNA, 22 nt, Human
caaugcuuuuguucuuuacuca

SEQ ID NO: 609224 - RNA, 22 nt, Human
aagcaggcaucuuggaggucaa

SEQ ID NO: 609225 - RNA, 22 nt, Human
aagaaccaaaaugaagcuaggu

SEQ ID NO: 609226 - RNA, 22 nt, Human
cucagaaaaccucuuucuugau

SEQ ID NO: 609227 - RNA, 21 nt, Human
agcaggaggcagucacagcuc

SEQ ID NO: 609228 - RNA, 22 nt, Human
uagaaauucaaugcucugagua

SEQ ID NO: 609229 - RNA, 22 nt, Human
agggccagccaggcccuacaaa

SEQ ID NO: 609230 - RNA, 22 nt, Human
uucuuuucccaauauuuugcug

SEQ ID NO: 609231 - RNA, 20 nt, Human
ugaugguauuaggaggugug

SEQ ID NO: 609232 - RNA, 22 nt, Human
acuuccugaauggggcuaauua

SEQ ID NO: 609233 - RNA, 22 nt, Human
ugcuggagagccuuggccaagg

SEQ ID NO: 609234 - RNA, 18 nt, Human
ucaggcuggaaguuugcc

SEQ ID NO: 609235 - RNA, 22 nt, Human
gggcagugguccaggcuacagc

SEQ ID NO: 609236 - RNA, 21 nt, Human
uaaagaagaugaaugugauca

SEQ ID NO: 609237 - RNA, 22 nt, Human
ccagaggucuccugcacgggau

SEQ ID NO: 609238 - RNA, 22 nt, Human
ucccagagguugagucacuuau

SEQ ID NO: 609239 - RNA, 22 nt, Human
uagcuuugccuguuaaucacaa

SEQ ID NO: 609240 - RNA, 22 nt, Human
gcugucuguucgagcguguguu

SEQ ID NO: 609241 - RNA, 22 nt, Human
aguggcugcuaugaucaggaca

SEQ ID NO: 609242 - RNA, 22 nt, Human
uccaagcacuguuaauuaaacu

SEQ ID NO: 609243 - RNA, 22 nt, Human
uggcagcuauuacaaggaaguc

SEQ ID NO: 609244 - RNA, 22 nt, Human
aaggaggaauuucagggugaau

SEQ ID NO: 609245 - RNA, 22 nt, Human
ugacaguuaagguauacauuca

SEQ ID NO: 609246 - RNA, 22 nt, Human
uuaaaauuuccccaccauguau

SEQ ID NO: 609247 - RNA, 22 nt, Human
cagcugaguuacucugaggucu

SEQ ID NO: 609248 - RNA, 19 nt, Human
agcuguggaugugggauuu

SEQ ID NO: 609249 - RNA, 22 nt, Human
ugucuuuaguuuuacugucugg

SEQ ID NO: 609250 - RNA, 22 nt, Human
uccuggugcuuguauuugaagu

SEQ ID NO: 609251 - RNA, 22 nt, Human
uuucuuagcgaugcuugauaaa

SEQ ID NO: 609252 - RNA, 22 nt, Human
gagugcugcuugggauagugag

SEQ ID NO: 609253 - RNA, 22 nt, Human
aauauucaaguuauucuuucuu

SEQ ID NO: 609254 - RNA, 23 nt, Human
uucuuuguggauaaucuccagug

SEQ ID NO: 609255 - RNA, 22 nt, Human
caggcagaaggaaguaccaggc

SEQ ID NO: 609256 - RNA, 22 nt, Human
ggccauggggacagagggugaa

SEQ ID NO: 609257 - RNA, 22 nt, Human
augcugugaaaaagaaggcuga

SEQ ID NO: 609258 - RNA, 22 nt, Human
uacagcuuaaaaaagccaacuu

SEQ ID NO: 609259 - RNA, 22 nt, Human
uggcagagcccagacuccaguc

SEQ ID NO: 609260 - RNA, 22 nt, Human
aaggccaaagacaccuacacag

SEQ ID NO: 609261 - RNA, 22 nt, Human
cugggcuguaauguggcacuga

SEQ ID NO: 609262 - RNA, 22 nt, Human
uguagcagugucuaccacauua

SEQ ID NO: 609263 - RNA, 23 nt, Human
uaugauccuccacaccuucucuc

SEQ ID NO: 609264 - RNA, 22 nt, Human
agagcugucagcguuuuggcca

SEQ ID NO: 609265 - RNA, 22 nt, Human
ucucagaaaugacaggagguac

SEQ ID NO: 609266 - RNA, 22 nt, Human
gcuuccccuccaagcacugccu

SEQ ID NO: 609267 - RNA, 19 nt, Human
gagcacagcggcauuuggu

SEQ ID NO: 609268 - RNA, 22 nt, Human
ucuuucugguuauguauagaga

SEQ ID NO: 609269 - RNA, 21 nt, Human
accucaagcaacaaccaaggu

SEQ ID NO: 609270 - RNA, 22 nt, Human
aacuggaauagcacaggaaaag

SEQ ID NO: 609271 - RNA, 22 nt, Human
cuuuacacaaugauuuucuuua

SEQ ID NO: 609272 - RNA, 22 nt, Human
ugcagagaguuagggcccguau

SEQ ID NO: 609273 - RNA, 22 nt, Human
ucauugacaguuguuucaaaua

SEQ ID NO: 609274 - RNA, 22 nt, Human
gcaggagcaauggccuaucaga

SEQ ID NO: 609275 - RNA, 22 nt, Human
cagcuuucaucagugacacuca

SEQ ID NO: 609276 - RNA, 22 nt, Human
auauagugaaagugaugugugg

SEQ ID NO: 609277 - RNA, 22 nt, Human
gaguggcauaugugccugugaa

SEQ ID NO: 609278 - RNA, 21 nt, Human
uggcacagcaagugggcucau

SEQ ID NO: 609279 - RNA, 19 nt, Human
uuuccuaaaaagcugugcu

SEQ ID NO: 609280 - RNA, 22 nt, Human
ugaggccugcuuggaauugaau

SEQ ID NO: 609281 - RNA, 23 nt, Human
ggcaugcaauggacagagcugga

SEQ ID NO: 609282 - RNA, 22 nt, Human
guuuuucuaaguagcgauauuu

SEQ ID NO: 609283 - RNA, 22 nt, Human
auucauagcucaguacagacuc

SEQ ID NO: 609284 - RNA, 22 nt, Human
guuaaugccauuaggaaauuua

SEQ ID NO: 609285 - RNA, 22 nt, Human
cacccaggcuggagugcagggg

SEQ ID NO: 609286 - RNA, 23 nt, Human
uuuacagggcacucuuaugcagc

SEQ ID NO: 609287 - RNA, 22 nt, Human
acuccacauuugaacacaguuc

SEQ ID NO: 609288 - RNA, 22 nt, Human
aggcgguggccaaggagcggga

SEQ ID NO: 609289 - RNA, 22 nt, Human
aaugaaaucugcuggguaaaga

SEQ ID NO: 609290 - RNA, 22 nt, Human
ugauauuuaagcaaaaauaugg

SEQ ID NO: 609291 - RNA, 20 nt, Human
gcacacauagaaaugcauau

SEQ ID NO: 609292 - RNA, 22 nt, Human
gcccacaguguagcagguacuc

SEQ ID NO: 609293 - RNA, 22 nt, Human
guuuuacaagguuaaucagcag

SEQ ID NO: 609294 - RNA, 22 nt, Human
uuuaucuuuggaucuucagaaa

SEQ ID NO: 609295 - RNA, 22 nt, Human
ugggcuacucugggagccuaac

SEQ ID NO: 609296 - RNA, 22 nt, Human
aucaaagagcuugacaauccua

SEQ ID NO: 609297 - RNA, 22 nt, Human
gcaggccauucaggagaugugc

SEQ ID NO: 609298 - RNA, 22 nt, Human
gcaggaguguggugggacaucc

SEQ ID NO: 609299 - RNA, 20 nt, Human
agggccugcucugugguguc

SEQ ID NO: 609300 - RNA, 22 nt, Human
ugcucuggcuggagcaaugacu

SEQ ID NO: 609301 - RNA, 22 nt, Human
uucuuacacucuuaaaaaucau

SEQ ID NO: 609302 - RNA, 22 nt, Human
aaggcugagccagggccccuau

SEQ ID NO: 609303 - RNA, 20 nt, Human
agcuggcccacagguguggg

SEQ ID NO: 609304 - RNA, 22 nt, Human
uuugugaaaugaagucacaacu

SEQ ID NO: 609305 - RNA, 22 nt, Human
uccucacaagcaagcacaggua

SEQ ID NO: 609306 - RNA, 20 nt, Human
uccaggagguuaguguggcu

SEQ ID NO: 609307 - RNA, 22 nt, Human
ugcaggcuuuagccccauggcu

SEQ ID NO: 609308 - RNA, 22 nt, Human
ccagucccgcaugguccagaau

SEQ ID NO: 609309 - RNA, 22 nt, Human
agcacagagcucggggaaugga

SEQ ID NO: 609310 - RNA, 22 nt, Human
guuguuuuuguucucuauagcu

SEQ ID NO: 609311 - RNA, 22 nt, Human
cuggugcuggagccuagucccu

SEQ ID NO: 609312 - RNA, 22 nt, Human
uugcugaaugcaaguuggauag

SEQ ID NO: 609313 - RNA, 22 nt, Human
uuucucggcagagaugaugggc

SEQ ID NO: 609314 - RNA, 22 nt, Human
agcucuggcacuggcgcgggau

SEQ ID NO: 609315 - RNA, 22 nt, Human
ggaaaaacagucuuuauuauuu

SEQ ID NO: 609316 - RNA, 22 nt, Human
aguaacaucuuugacauuuguu

SEQ ID NO: 609317 - RNA, 20 nt, Human
uuucuuguacuuggagaagg

SEQ ID NO: 609318 - RNA, 22 nt, Human
agaaggcaccguggccaauauu

SEQ ID NO: 609319 - RNA, 23 nt, Human
ugggccuggaaagccuuagagag

SEQ ID NO: 609320 - RNA, 22 nt, Human
aaauaauuauagcgagucuauc

SEQ ID NO: 609321 - RNA, 22 nt, Human
gcagagcaguacucucuugacu

SEQ ID NO: 609322 - RNA, 22 nt, Human
acagggcaccugagguaggaag

SEQ ID NO: 609323 - RNA, 18 nt, Human
gacagcuguccugagccc

SEQ ID NO: 609324 - RNA, 22 nt, Human
cugggaggcacuauucaggagg

SEQ ID NO: 609325 - RNA, 22 nt, Human
ucgaagguuauugucuuuacgu

SEQ ID NO: 609326 - RNA, 19 nt, Human
cuguccuuggcugcacugu

SEQ ID NO: 609327 - RNA, 22 nt, Human
aguguuuauauuauggaaauau

SEQ ID NO: 609328 - RNA, 22 nt, Human
ucaauacauacaauguauagug

SEQ ID NO: 609329 - RNA, 22 nt, Human
agagacuaagaaguuuuaacuu

SEQ ID NO: 609330 - RNA, 22 nt, Human
uucacaguggcuuaggcuaugg

SEQ ID NO: 609331 - RNA, 22 nt, Human
agcuacaccccuuuacaguccu

SEQ ID NO: 609332 - RNA, 22 nt, Human
aaggcaguacuuuauguccaua

SEQ ID NO: 609333 - RNA, 22 nt, Human
gggcagcucagccaccaugcag

SEQ ID NO: 609334 - RNA, 22 nt, Human
ggcagauguuauaugaucugag

SEQ ID NO: 609335 - RNA, 22 nt, Human
agggaagcaauauuagauauca

SEQ ID NO: 609336 - RNA, 22 nt, Human
auguuucaaauauauagaguug

SEQ ID NO: 609337 - RNA, 22 nt, Human
gagcuucacgggggacagcauu

SEQ ID NO: 609338 - RNA, 22 nt, Human
ugagggguaaguaaaggaauug

SEQ ID NO: 609339 - RNA, 22 nt, Human
gacaggguacgggcuaggcaca

SEQ ID NO: 609340 - RNA, 22 nt, Human
cagcuguuucaguagcguuacu

SEQ ID NO: 609341 - RNA, 22 nt, Human
ugcucccaaacgaccuacugug

SEQ ID NO: 609342 - RNA, 22 nt, Human
uauguacaccaaggauugaaaa

SEQ ID NO: 609343 - RNA, 22 nt, Human
guuuccuacacuguaguauuau

SEQ ID NO: 609344 - RNA, 22 nt, Human
ugcugaauuccagggccccacu

SEQ ID NO: 609345 - RNA, 22 nt, Human
gcuccaggcgagcuggaccaga

SEQ ID NO: 609346 - RNA, 22 nt, Human
cucugggcaaguaugauagaaa

SEQ ID NO: 609347 - RNA, 22 nt, Human
uagcaauguguguguauaaauu

SEQ ID NO: 609348 - RNA, 22 nt, Human
agucuucuuucauuuacucagu

SEQ ID NO: 609349 - RNA, 22 nt, Human
ccaggcugcuuagccuuaucuu

SEQ ID NO: 609350 - RNA, 22 nt, Human
gcagccagccccucugaccucu

SEQ ID NO: 609351 - RNA, 22 nt, Human
aggccacaaccacccugugccc

SEQ ID NO: 609352 - RNA, 22 nt, Human
cugugugcugaaaugcagugag

SEQ ID NO: 609353 - RNA, 22 nt, Human
aggcccugcaggaagcaggaug

SEQ ID NO: 609354 - RNA, 22 nt, Human
uggcagagacuccuccugggag

SEQ ID NO: 609355 - RNA, 22 nt, Human
aggaaagcaauggcugagaaca

SEQ ID NO: 609356 - RNA, 21 nt, Human
aguccaggaggaggccagguu

SEQ ID NO: 609357 - RNA, 22 nt, Human
cugacucccaagcuagugcucu

SEQ ID NO: 609358 - RNA, 22 nt, Human
cugaaugucgaucagcuugggu

SEQ ID NO: 609359 - RNA, 22 nt, Human
acagcucuuaggcagaaccaac

SEQ ID NO: 609360 - RNA, 22 nt, Human
guuauuuaacuuuguagcaugg

SEQ ID NO: 609361 - RNA, 20 nt, Human
ucauggaaucucacucuagu

SEQ ID NO: 609362 - RNA, 20 nt, Human
uccuccuugcagagcccaga

SEQ ID NO: 609363 - RNA, 22 nt, Human
cugggccugguagggcuugaaa

SEQ ID NO: 609364 - RNA, 22 nt, Human
agcagcugucccuuaacaucag

SEQ ID NO: 609365 - RNA, 22 nt, Human
ccuggcugagggaccucgggua

SEQ ID NO: 609366 - RNA, 22 nt, Human
cuuccuucaauauaauuuuuac

SEQ ID NO: 609367 - RNA, 22 nt, Human
aaagccagaguguguuagagac

SEQ ID NO: 609368 - RNA, 22 nt, Human
aacuaaaccaugacauuauauu

SEQ ID NO: 609369 - RNA, 21 nt, Human
aagccagcccacagugguuug

SEQ ID NO: 609370 - RNA, 22 nt, Human
cugggggucgcgccucugggca

SEQ ID NO: 609371 - RNA, 22 nt, Human
aguucucuuuagcucauauggu

SEQ ID NO: 609372 - RNA, 22 nt, Human
agggagcagcagccacaggaug

SEQ ID NO: 609373 - RNA, 22 nt, Human
cuucugggugccugugaguguu

SEQ ID NO: 609374 - RNA, 22 nt, Human
cuccugggcugggaacucagcc

SEQ ID NO: 609375 - RNA, 21 nt, Human
augcugaaucuuguugugcuc

SEQ ID NO: 609376 - RNA, 22 nt, Human
uuauguaugaauauaguagaag

SEQ ID NO: 609377 - RNA, 22 nt, Human
uccuccuguuucucaggccugg

SEQ ID NO: 609378 - RNA, 22 nt, Human
agcaggcuuguuaugucugaga

SEQ ID NO: 609379 - RNA, 22 nt, Human
ugcagaaaccaauucaaguaag

SEQ ID NO: 609380 - RNA, 22 nt, Human
aaaaauagaaggauugacugag

SEQ ID NO: 609381 - RNA, 22 nt, Human
cacauguccugggaaaauaacu

SEQ ID NO: 609382 - RNA, 22 nt, Human
uccugggagaguuugauucauu

SEQ ID NO: 609383 - RNA, 22 nt, Human
guguauaaugcuguuuguacau

SEQ ID NO: 609384 - RNA, 19 nt, Human
aagggcugggcaccucacu

SEQ ID NO: 609385 - RNA, 22 nt, Human
aggacacacugcaagagccugg

SEQ ID NO: 609386 - RNA, 22 nt, Human
gcccagcuccucugcagacccu

SEQ ID NO: 609387 - RNA, 19 nt, Human
ccugaccacacaggccuug

SEQ ID NO: 609388 - RNA, 22 nt, Human
ucugucacccgagcaggcgaga

SEQ ID NO: 609389 - RNA, 19 nt, Human
ccuggcucugagcccagcc

SEQ ID NO: 609390 - RNA, 22 nt, Human
gcagccaggaagccuuucccuc

SEQ ID NO: 609391 - RNA, 22 nt, Human
uaggccaguggcagguugugug

SEQ ID NO: 609392 - RNA, 22 nt, Human
caggccucccggugcacacuga

SEQ ID NO: 609393 - RNA, 22 nt, Human
gcagcugccaguccccuuccag

SEQ ID NO: 609394 - RNA, 22 nt, Human
cucuucuguaccucggccucca

SEQ ID NO: 609395 - RNA, 22 nt, Human
aagggcugcuguagaagcagag

SEQ ID NO: 609396 - RNA, 22 nt, Human
agcuggagaucaugcugauacu

SEQ ID NO: 609397 - RNA, 22 nt, Human
uauucacaaaaugagguccuca

SEQ ID NO: 609398 - RNA, 22 nt, Human
ggagccagagucugcaguguaa

SEQ ID NO: 609399 - RNA, 22 nt, Human
uaaagcaaaaaugaacugccau

SEQ ID NO: 609400 - RNA, 22 nt, Human
uccuucagugucccgcucaggu

SEQ ID NO: 609401 - RNA, 22 nt, Human
cauacaguuuucccuagaugug

SEQ ID NO: 609402 - RNA, 22 nt, Human
gaauacauguguguauagaggu

SEQ ID NO: 609403 - RNA, 22 nt, Human
gaaugcuaagcaugugggaguu

SEQ ID NO: 609404 - RNA, 21 nt, Human
uauaguguggauaugcugaug

SEQ ID NO: 609405 - RNA, 22 nt, Human
ggccauggaccccgagcugacc

SEQ ID NO: 609406 - RNA, 19 nt, Human
agggagaauuccaagagga

SEQ ID NO: 609407 - RNA, 22 nt, Human
uccagcucccacucucacugcu

SEQ ID NO: 609408 - RNA, 22 nt, Human
aggccagugccuuuccagggcu

SEQ ID NO: 609409 - RNA, 22 nt, Human
aucggggaaaagggaggcugug

SEQ ID NO: 609410 - RNA, 22 nt, Human
auguagaacagguuaaugacag

SEQ ID NO: 609411 - RNA, 22 nt, Human
aagccaggagcgaggccucggc

SEQ ID NO: 609412 - RNA, 21 nt, Human
aggcuguccuuugccagcccu

SEQ ID NO: 609413 - RNA, 22 nt, Human
auguacacaugcaugcaugugc

SEQ ID NO: 609414 - RNA, 22 nt, Human
gaggaaaaugggacaggcugua

SEQ ID NO: 609415 - RNA, 22 nt, Human
ccuggagcgcgggucaagcugg

SEQ ID NO: 609416 - RNA, 19 nt, Human
agguuucuaacuauucaag

SEQ ID NO: 609417 - RNA, 20 nt, Human
augugucuuagagcaucagg

SEQ ID NO: 609418 - RNA, 22 nt, Human
uuuguacacugucuacuaugaa

SEQ ID NO: 609419 - RNA, 23 nt, Human
caucaaguacuuuugacaagugu

SEQ ID NO: 609420 - RNA, 22 nt, Human
cagugauucagacucaucauuu

SEQ ID NO: 609421 - RNA, 22 nt, Human
auguuaugucugggaaggggua

SEQ ID NO: 609422 - RNA, 22 nt, Human
gcucccaggaugaggagccagg

SEQ ID NO: 609423 - RNA, 22 nt, Human
acccagggcucaagcguaggca

SEQ ID NO: 609424 - RNA, 22 nt, Human
cacagauaaggauguuaauuuu

SEQ ID NO: 609425 - RNA, 22 nt, Human
aguccuggccccaaggaaggau

SEQ ID NO: 609426 - RNA, 22 nt, Human
gcugucagcgcccaaggagcuc

SEQ ID NO: 609427 - RNA, 22 nt, Human
gggagggaggugcugguucacg

SEQ ID NO: 609428 - RNA, 22 nt, Human
ucugggauaagaccacagauuu

SEQ ID NO: 609429 - RNA, 22 nt, Human
agcagacauaucucaugucaca

SEQ ID NO: 609430 - RNA, 22 nt, Human
cuggaguuagaguagacacuga

SEQ ID NO: 609431 - RNA, 20 nt, Human
agccagaagaaggcuggaga

SEQ ID NO: 609432 - RNA, 22 nt, Human
cccugugggccaugugucuaca

SEQ ID NO: 609433 - RNA, 22 nt, Human
aagcuucaaugagauaauuguu

SEQ ID NO: 609434 - RNA, 22 nt, Human
gaaucauagaacauuaauagaa

SEQ ID NO: 609435 - RNA, 22 nt, Human
acaggcagcccucucccugguu

SEQ ID NO: 609436 - RNA, 22 nt, Human
guccuguguacuccugauacuu

SEQ ID NO: 609437 - RNA, 22 nt, Human
gaaacacuaugccaagacaggg

SEQ ID NO: 609438 - RNA, 22 nt, Human
ggugagaaagggauuccuguuc

SEQ ID NO: 609439 - RNA, 23 nt, Human
auuuugccucuuggcugcuuagg

SEQ ID NO: 609440 - RNA, 22 nt, Human
ucuggcaucuguuuucauauuu

SEQ ID NO: 609441 - RNA, 22 nt, Human
ugcacacacgcggcacaucugu

SEQ ID NO: 609442 - RNA, 18 nt, Human
uuugcuuuccuucuucag

SEQ ID NO: 609443 - RNA, 22 nt, Human
gcaguccuggaggaagguguga

SEQ ID NO: 609444 - RNA, 22 nt, Human
cagccuggagccacagcccagg

SEQ ID NO: 609445 - RNA, 22 nt, Human
cccaggaguuagagguuguggu

SEQ ID NO: 609446 - RNA, 18 nt, Human
cauuccaaguucuaccuc

SEQ ID NO: 609447 - RNA, 22 nt, Human
uccagccaacugccuagggagc

SEQ ID NO: 609448 - RNA, 22 nt, Human
uuagaacaccauucuauauuac

SEQ ID NO: 609449 - RNA, 22 nt, Human
gcuaggcuguguuucagacccu

SEQ ID NO: 609450 - RNA, 22 nt, Human
caugaacaccaggcaugaacaa

SEQ ID NO: 609451 - RNA, 22 nt, Human
uccuucaaaaguugagagagcc

SEQ ID NO: 609452 - RNA, 22 nt, Human
acaguucaagucuuagacaaca

SEQ ID NO: 609453 - RNA, 22 nt, Human
cuucuucauaggcaguccuguu

SEQ ID NO: 609454 - RNA, 22 nt, Human
caggcugugaaacugagaugcg

SEQ ID NO: 609455 - RNA, 22 nt, Human
aggcugugcgaggucucagagu

SEQ ID NO: 609456 - RNA, 22 nt, Human
gucuggagccacugcugcugcu

SEQ ID NO: 609457 - RNA, 22 nt, Human
uggcagcuccuggggccagcac

SEQ ID NO: 609458 - RNA, 22 nt, Human
agugggcagugcgcucggaugc

SEQ ID NO: 609459 - RNA, 22 nt, Human
gucccagcuucccacuagcagc

SEQ ID NO: 609460 - RNA, 22 nt, Human
aagcauuuuguuuuaagaauga

SEQ ID NO: 609461 - RNA, 19 nt, Human
augagguagcagcuggugc

SEQ ID NO: 609462 - RNA, 22 nt, Human
uuggaauuccuguuguuucguc

SEQ ID NO: 609463 - RNA, 22 nt, Human
cagcuguucacauuuccaaaac

SEQ ID NO: 609464 - RNA, 22 nt, Human
uccagggaagagcagaggcuac

SEQ ID NO: 609465 - RNA, 22 nt, Human
gaauauuuucaguacagauggu

SEQ ID NO: 609466 - RNA, 22 nt, Human
uuguagaaucauuauuucuagu

SEQ ID NO: 609467 - RNA, 22 nt, Human
caggaaagucuguaaaggaacc

SEQ ID NO: 609468 - RNA, 22 nt, Human
cagcugcuuucagcaggaggga

SEQ ID NO: 609469 - RNA, 22 nt, Human
aaggccagcgcagaccauuguc

SEQ ID NO: 609470 - RNA, 22 nt, Human
uacaaagggggaagagauucug

SEQ ID NO: 609471 - RNA, 22 nt, Human
ugaggcuggcaaggcugguauu

SEQ ID NO: 609472 - RNA, 20 nt, Human
uacugggcaagcccacagac

SEQ ID NO: 609473 - RNA, 22 nt, Human
uuccaaaaugccuugauaugau

SEQ ID NO: 609474 - RNA, 22 nt, Human
uaacuugauaaguauucucugc

SEQ ID NO: 609475 - RNA, 20 nt, Human
accaggagauggaggcaggg

SEQ ID NO: 609476 - RNA, 23 nt, Human
ggagccuggcauaugagacgcau

SEQ ID NO: 609477 - RNA, 22 nt, Human
caggaagaaggguggugagucc

SEQ ID NO: 609478 - RNA, 22 nt, Human
auacaucaaggaugauggugua

SEQ ID NO: 609479 - RNA, 22 nt, Human
uauuuuguaauuggucauagcu

SEQ ID NO: 609480 - RNA, 22 nt, Human
ugcugggcauuuaugcagaugg

SEQ ID NO: 609481 - RNA, 22 nt, Human
acccugagaaagucacaugcau

SEQ ID NO: 609482 - RNA, 22 nt, Human
auuccacauaggccuucaugac

SEQ ID NO: 609483 - RNA, 22 nt, Human
uuuuuaucuacagauucucagc

SEQ ID NO: 609484 - RNA, 22 nt, Human
aggaaucaggagaugagcacgg

SEQ ID NO: 609485 - RNA, 22 nt, Human
ugccugccuugcugcuggacag

SEQ ID NO: 609486 - RNA, 22 nt, Human
uuguagaaaauucucuuggaua

SEQ ID NO: 609487 - RNA, 22 nt, Human
agacagugauggacaggcagac

SEQ ID NO: 609488 - RNA, 22 nt, Human
cuuccuuccuuccccgaaaugc

SEQ ID NO: 609489 - RNA, 22 nt, Human
cuggagcaaaagugacuccucu

SEQ ID NO: 609490 - RNA, 22 nt, Human
accagaaaggaugccuccuucc

SEQ ID NO: 609491 - RNA, 22 nt, Human
aguggcagaucucuggucugga

SEQ ID NO: 609492 - RNA, 22 nt, Human
uccauuuuagagaugaagaaac

SEQ ID NO: 609493 - RNA, 22 nt, Human
ccugccagcgcuuaucucucgg

SEQ ID NO: 609494 - RNA, 22 nt, Human
accaggaguagaauaucuguga

SEQ ID NO: 609495 - RNA, 22 nt, Human
gccuggggucucugacucacag

SEQ ID NO: 609496 - RNA, 22 nt, Human
gcucacuggccugaagaggacg

SEQ ID NO: 609497 - RNA, 22 nt, Human
acaguguucucuuccuguauag

SEQ ID NO: 609498 - RNA, 22 nt, Human
cugugccugcaggccacaucaa

SEQ ID NO: 609499 - RNA, 22 nt, Human
acagcuguggggacucuugccc

SEQ ID NO: 609500 - RNA, 22 nt, Human
gcagcugggacacugaggccag

SEQ ID NO: 609501 - RNA, 22 nt, Human
caugagucauagugaagcagga

SEQ ID NO: 609502 - RNA, 22 nt, Human
agagcuguguccugugcacuag

SEQ ID NO: 609503 - RNA, 22 nt, Human
uugauaaaaugaugaaaucacu

SEQ ID NO: 609504 - RNA, 22 nt, Human
agaauuuuaucuaaagggagua

SEQ ID NO: 609505 - RNA, 22 nt, Human
ucaggcuuuuucucaaccucuu

SEQ ID NO: 609506 - RNA, 22 nt, Human
ccagaggacuugggggcugaau

SEQ ID NO: 609507 - RNA, 22 nt, Human
uuugugcagauguauauuugug

SEQ ID NO: 609508 - RNA, 22 nt, Human
aguguguguuugggcgguuuau

SEQ ID NO: 609509 - RNA, 22 nt, Human
gcuucagauucuuuucaugucu

SEQ ID NO: 609510 - RNA, 21 nt, Human
uuuuaugcauaggaaauauau

SEQ ID NO: 609511 - RNA, 22 nt, Human
aaaguugauaagguaucguagu

SEQ ID NO: 609512 - RNA, 22 nt, Human
gggaggugauuaggaccaugua

SEQ ID NO: 609513 - RNA, 22 nt, Human
acaguaugaaugcagaauguag

SEQ ID NO: 609514 - RNA, 18 nt, Human
agaggggagguaagucug

SEQ ID NO: 609515 - RNA, 22 nt, Human
ggggucugggcuuagcuggaau

SEQ ID NO: 609516 - RNA, 22 nt, Human
uuuguugugauaauggucugca

SEQ ID NO: 609517 - RNA, 22 nt, Human
gacagcagacagccuggccccu

SEQ ID NO: 609518 - RNA, 22 nt, Human
cucacugucuguacuagcugau

SEQ ID NO: 609519 - RNA, 22 nt, Human
ugccugugcccuuugcugggag

SEQ ID NO: 609520 - RNA, 22 nt, Human
aagcagccuggcaugaugcuuu

SEQ ID NO: 609521 - RNA, 22 nt, Human
ggcuggcugauaaaggguugag

SEQ ID NO: 609522 - RNA, 22 nt, Human
gcugggagcccuggucugcucc

SEQ ID NO: 609523 - RNA, 22 nt, Human
aggcagugcagaguccucuucu

SEQ ID NO: 609524 - RNA, 17 nt, Human
caggaaaauaugaguga

SEQ ID NO: 609525 - RNA, 22 nt, Human
gucagaggaggcugaguaggaa

SEQ ID NO: 609526 - RNA, 22 nt, Human
ucuuucuguaagcuccauggaa

SEQ ID NO: 609527 - RNA, 22 nt, Human
ccugccugggcucacuugccag

SEQ ID NO: 609528 - RNA, 22 nt, Human
uggcacugccaaccugcuaggu

SEQ ID NO: 609529 - RNA, 22 nt, Human
cugccccagugccaggcaggug

SEQ ID NO: 609530 - RNA, 22 nt, Human
gugccugcagcaauccauggca

SEQ ID NO: 609531 - RNA, 22 nt, Human
ugcugaggcuagaccuggaagu

SEQ ID NO: 609532 - RNA, 22 nt, Human
cagccagaucagggcagggguu

SEQ ID NO: 609533 - RNA, 22 nt, Human
ugaagcaaugaucuuuuggugg

SEQ ID NO: 609534 - RNA, 22 nt, Human
uuucauugaugggugauagaaa

SEQ ID NO: 609535 - RNA, 22 nt, Human
ccagcucauauuuuaugugcag

SEQ ID NO: 609536 - RNA, 22 nt, Human
caugggaggucugcaaggugcu

SEQ ID NO: 609537 - RNA, 22 nt, Human
cuggcuugggucuaccugccuu

SEQ ID NO: 609538 - RNA, 22 nt, Human
gcugcagacugggaggcaggug

SEQ ID NO: 609539 - RNA, 21 nt, Human
ugauugauauuugcaaacaga

SEQ ID NO: 609540 - RNA, 22 nt, Human
uccagggaucuuuagagucuuu

SEQ ID NO: 609541 - RNA, 22 nt, Human
acugaucaaggguuuaauuuua

SEQ ID NO: 609542 - RNA, 22 nt, Human
ugugaaauauuggcaauuucau

SEQ ID NO: 609543 - RNA, 22 nt, Human
ugaggccacaggaaagggcccg

SEQ ID NO: 609544 - RNA, 19 nt, Human
ucuuucauuucuagcucug

SEQ ID NO: 609545 - RNA, 22 nt, Human
cuccuacaguguuugaguccag

SEQ ID NO: 609546 - RNA, 17 nt, Human
uuuagaauacaauguuu

SEQ ID NO: 609547 - RNA, 22 nt, Human
gcucugagucacacugcccugu

SEQ ID NO: 609548 - RNA, 22 nt, Human
cuuucuugcauaauuugaaacc

SEQ ID NO: 609549 - RNA, 22 nt, Human
auggcaaaaacugcaguuaccu

SEQ ID NO: 609550 - RNA, 20 nt, Human
ugcaggugggcccuucuggg

SEQ ID NO: 609551 - RNA, 19 nt, Human
uuugugcagcaacauuaau

SEQ ID NO: 609552 - RNA, 22 nt, Human
agggccacaguggggccugaga

SEQ ID NO: 609553 - RNA, 22 nt, Human
cagagggugugaaggggaugaa

SEQ ID NO: 609554 - RNA, 20 nt, Human
uuggcucugaucaguggagc

SEQ ID NO: 609555 - RNA, 22 nt, Human
cacuucaaggaauaucuagaaa

SEQ ID NO: 609556 - RNA, 22 nt, Human
cugccagcucaccggcucagac

SEQ ID NO: 609557 - RNA, 22 nt, Human
gcugugugacugagagccuggc

SEQ ID NO: 609558 - RNA, 22 nt, Human
uccagggcaccagcgucccccu

SEQ ID NO: 609559 - RNA, 23 nt, Human
auuugcauggccggauuauggau

SEQ ID NO: 609560 - RNA, 22 nt, Human
uuucuuucaauucuccuaaugc

SEQ ID NO: 609561 - RNA, 22 nt, Human
ugacauuuuuguacaaagucag

SEQ ID NO: 609562 - RNA, 21 nt, Human
aguccuugaaacucuuucuug

SEQ ID NO: 609563 - RNA, 22 nt, Human
ugagacagcagucagggaaaua

SEQ ID NO: 609564 - RNA, 22 nt, Human
agcucucaagauaagaaagaac

SEQ ID NO: 609565 - RNA, 22 nt, Human
acauuguuguuugcagcacagg

SEQ ID NO: 609566 - RNA, 22 nt, Human
gaugggcuggggagaaagcaug

SEQ ID NO: 609567 - RNA, 22 nt, Human
ggugcagaaggaagggagcugg

SEQ ID NO: 609568 - RNA, 22 nt, Human
cacugcccaccaaguggcuggu

SEQ ID NO: 609569 - RNA, 22 nt, Human
aagucucuuuucuuccuguauu

SEQ ID NO: 609570 - RNA, 22 nt, Human
ggagcugcacgcucugaagccu

SEQ ID NO: 609571 - RNA, 19 nt, Human
ucugguucauuucugcugu

SEQ ID NO: 609572 - RNA, 22 nt, Human
aaucuguaacauucaauaaaga

SEQ ID NO: 609573 - RNA, 22 nt, Human
gaggcacaauacaugucucaag

SEQ ID NO: 609574 - RNA, 22 nt, Human
cugagguguugaugaccuaugc

SEQ ID NO: 609575 - RNA, 22 nt, Human
uguccuuauaagaaaaggaaau

SEQ ID NO: 609576 - RNA, 20 nt, Human
caggucuucauguggcuguc

SEQ ID NO: 609577 - RNA, 22 nt, Human
augcuaaggcccaggagaaaau

SEQ ID NO: 609578 - RNA, 22 nt, Human
ucauuucuauugcuacugucug

SEQ ID NO: 609579 - RNA, 22 nt, Human
guggggcuggaagauggguacu

SEQ ID NO: 609580 - RNA, 22 nt, Human
gcaggcugccaccuucugaguu

SEQ ID NO: 609581 - RNA, 22 nt, Human
agggccagaaucccucagucua

SEQ ID NO: 609582 - RNA, 22 nt, Human
auggaucacagugccgugggug

SEQ ID NO: 609583 - RNA, 22 nt, Human
ucaggcugaggucaucugcauc

SEQ ID NO: 609584 - RNA, 22 nt, Human
uagcaauaugcuaccuuaaaug

SEQ ID NO: 609585 - RNA, 22 nt, Human
ugcuggagacucacucaggugc

SEQ ID NO: 609586 - RNA, 22 nt, Human
aggggcuggcuuaucugagagu

SEQ ID NO: 609587 - RNA, 22 nt, Human
caugagagacauucugugugaa

SEQ ID NO: 609588 - RNA, 19 nt, Human
cuucauucuucagcuuuug

SEQ ID NO: 609589 - RNA, 22 nt, Human
uaccaaaaccaagccauuaucu

SEQ ID NO: 609590 - RNA, 22 nt, Human
cuucucuuggguguggugucuu

SEQ ID NO: 609591 - RNA, 22 nt, Human
guagcugauccugaggacaggg

SEQ ID NO: 609592 - RNA, 23 nt, Human
ucacugcuacucagccugagauu

SEQ ID NO: 609593 - RNA, 22 nt, Human
ugagcuggcuugucaaccaggg

SEQ ID NO: 609594 - RNA, 22 nt, Human
ugcaggugccaucgcugcucau

SEQ ID NO: 609595 - RNA, 22 nt, Human
ugaagacaaagucaggcccaga

SEQ ID NO: 609596 - RNA, 22 nt, Human
agaguucugaaauuaucuuuac

SEQ ID NO: 609597 - RNA, 22 nt, Human
gcagcuguggguuccaagucua

SEQ ID NO: 609598 - RNA, 22 nt, Human
uagaugauuuucagucaaagca

SEQ ID NO: 609599 - RNA, 22 nt, Human
aaggcugaaagaccuugaaccu

SEQ ID NO: 609600 - RNA, 22 nt, Human
cugagccuguguuucucuggca

SEQ ID NO: 609601 - RNA, 22 nt, Human
ugcagcucaggauucucagggc

SEQ ID NO: 609602 - RNA, 22 nt, Human
uagcuaauggugaagauucaga

SEQ ID NO: 609603 - RNA, 18 nt, Human
ccugaggugggaggaagg

SEQ ID NO: 609604 - RNA, 22 nt, Human
caggcuggagugcaauggcaca

SEQ ID NO: 609605 - RNA, 22 nt, Human
uuccugaaaauacagggagaga

SEQ ID NO: 609606 - RNA, 22 nt, Human
ggcugcagcagagggacucacg

SEQ ID NO: 609607 - RNA, 23 nt, Human
gugcuugaaagaugcagaauuaa

SEQ ID NO: 609608 - RNA, 22 nt, Human
guacauaauuuucagccaguuu

SEQ ID NO: 609609 - RNA, 22 nt, Human
uucugccuuacgauauuuucaa

SEQ ID NO: 609610 - RNA, 22 nt, Human
ucagaauaugcuaaugacauuu

SEQ ID NO: 609611 - RNA, 22 nt, Human
gccagccugugggggcucugug

SEQ ID NO: 609612 - RNA, 22 nt, Human
ucugcagcuugcacaggcaggc

SEQ ID NO: 609613 - RNA, 22 nt, Human
uaagacacauugagaaacacaa

SEQ ID NO: 609614 - RNA, 22 nt, Human
uuggcagaaauguggcugggag

SEQ ID NO: 609615 - RNA, 22 nt, Human
uagagcuggaauuugcagcaag

SEQ ID NO: 609616 - RNA, 22 nt, Human
cagggcuggauccuccagacuc

SEQ ID NO: 609617 - RNA, 22 nt, Human
gcccacugagugacucccucag

SEQ ID NO: 609618 - RNA, 22 nt, Human
agcccugagccagccuggucag

SEQ ID NO: 609619 - RNA, 22 nt, Human
uugaaucuauguauucagugua

SEQ ID NO: 609620 - RNA, 22 nt, Human
uugugcaauccccucauuuuau

SEQ ID NO: 609621 - RNA, 22 nt, Human
ccuuguguuuacaccugucuuu

SEQ ID NO: 609622 - RNA, 22 nt, Human
aagaacuguaucaagauguagu

SEQ ID NO: 609623 - RNA, 22 nt, Human
gaacaaggauucccaaagaaga

SEQ ID NO: 609624 - RNA, 23 nt, Human
gaggugugaauucugggugcugc

SEQ ID NO: 609625 - RNA, 22 nt, Human
cagaacauuccaugugcccugc

SEQ ID NO: 609626 - RNA, 22 nt, Human
gugcuuuuaacuuuugaaagga

SEQ ID NO: 609627 - RNA, 22 nt, Human
ucuguguguugucaggaggauu

SEQ ID NO: 609628 - RNA, 22 nt, Human
gauggaggagauggcagggugc

SEQ ID NO: 609629 - RNA, 22 nt, Human
cagaucuguuugccagaucagc

SEQ ID NO: 609630 - RNA, 22 nt, Human
aacagcagggggaccugcuggu

SEQ ID NO: 609631 - RNA, 22 nt, Human
ggcaugcuucugagaugucucc

SEQ ID NO: 609632 - RNA, 22 nt, Human
ucucuggggauggaccugggag

SEQ ID NO: 609633 - RNA, 22 nt, Human
ugacaaagguguugccagaggg

SEQ ID NO: 609634 - RNA, 22 nt, Human
aguaacaugaguuuuucuaaug

SEQ ID NO: 609635 - RNA, 19 nt, Human
cagcaagaaugaaggcaua

SEQ ID NO: 609636 - RNA, 22 nt, Human
gaucagaauucuuguguguuuc

SEQ ID NO: 609637 - RNA, 22 nt, Human
caugcauuuggaguuuucaagu

SEQ ID NO: 609638 - RNA, 22 nt, Human
gauucuuuggccuuuauugaca

SEQ ID NO: 609639 - RNA, 22 nt, Human
auguugcacaaaguccauccau

SEQ ID NO: 609640 - RNA, 22 nt, Human
gcuggccugggcagccugucgg

SEQ ID NO: 609641 - RNA, 22 nt, Human
agaauuuaggcuugucugcugu

SEQ ID NO: 609642 - RNA, 18 nt, Human
agucuucugauccauuuu

SEQ ID NO: 609643 - RNA, 22 nt, Human
uggcacagacagcacagcaaug

SEQ ID NO: 609644 - RNA, 21 nt, Human
ccugugccagucuauguguuc

SEQ ID NO: 609645 - RNA, 22 nt, Human
uaacagcuggcguuauaggaau

SEQ ID NO: 609646 - RNA, 22 nt, Human
auuccauuacagaucuuuuccu

SEQ ID NO: 609647 - RNA, 23 nt, Human
ucucaggguggcugggcccaucc

SEQ ID NO: 609648 - RNA, 22 nt, Human
gagguaucuuagagaguguaga

SEQ ID NO: 609649 - RNA, 22 nt, Human
ggugaggggagagugaaagaaa

SEQ ID NO: 609650 - RNA, 22 nt, Human
guccagagaggcaggaggcuac

SEQ ID NO: 609651 - RNA, 22 nt, Human
gggcaggugcccagggccagag

SEQ ID NO: 609652 - RNA, 22 nt, Human
aaauuugucaacuucauauguu

SEQ ID NO: 609653 - RNA, 22 nt, Human
auguguucacgugcacaugugc

SEQ ID NO: 609654 - RNA, 22 nt, Human
aggcaagcauugggaacagggc

SEQ ID NO: 609655 - RNA, 22 nt, Human
ugucaacagauacuagagagcu

SEQ ID NO: 609656 - RNA, 22 nt, Human
ugccagcuccgaggagcugcag

SEQ ID NO: 609657 - RNA, 19 nt, Human
augcagagaauggcaguag

SEQ ID NO: 609658 - RNA, 20 nt, Human
ccagagcagccacugaaguu

SEQ ID NO: 609659 - RNA, 17 nt, Human
agaugcuggccacaugu

SEQ ID NO: 609660 - RNA, 22 nt, Human
caguuacauuaauaaugcacau

SEQ ID NO: 609661 - RNA, 23 nt, Human
agcuuccuagugaccuggagucu

SEQ ID NO: 609662 - RNA, 22 nt, Human
aagccaaguuggaagacugaau

SEQ ID NO: 609663 - RNA, 21 nt, Human
cuggacugaggagacagucgc

SEQ ID NO: 609664 - RNA, 22 nt, Human
ggcugggucccagcugggagga

SEQ ID NO: 609665 - RNA, 22 nt, Human
acacaggcaaugugagugggag

SEQ ID NO: 609666 - RNA, 22 nt, Human
gcauuuuucucuccuauaggag

SEQ ID NO: 609667 - RNA, 22 nt, Human
cugacaaacuuaauuuucugaa

SEQ ID NO: 609668 - RNA, 22 nt, Human
aagaugauaggacuugcuuaag

SEQ ID NO: 609669 - RNA, 22 nt, Human
caucauuuguuugcaugcagga

SEQ ID NO: 609670 - RNA, 22 nt, Human
aagaacaugaguuaugaugauu

SEQ ID NO: 609671 - RNA, 22 nt, Human
ccagagcuccagggcuacagaa

SEQ ID NO: 609672 - RNA, 22 nt, Human
cccacucccuacgacacgcucc

SEQ ID NO: 609673 - RNA, 22 nt, Human
agcagcccuagggauugcuguu

SEQ ID NO: 609674 - RNA, 22 nt, Human
acagugagcccacuccaggaga

SEQ ID NO: 609675 - RNA, 22 nt, Human
ugagcagaggaggcugccaacu

SEQ ID NO: 609676 - RNA, 22 nt, Human
aaaggccacacugcucuuucuc

SEQ ID NO: 609677 - RNA, 17 nt, Human
acacagggagagggagc

SEQ ID NO: 609678 - RNA, 22 nt, Human
uucuuguacuggagauacauga

SEQ ID NO: 609679 - RNA, 22 nt, Human
ugaggcucacgaacagaagacu

SEQ ID NO: 609680 - RNA, 22 nt, Human
aguuugcugaugaagaaaauuu

SEQ ID NO: 609681 - RNA, 22 nt, Human
cacaggcacgccucuggccagg

SEQ ID NO: 609682 - RNA, 22 nt, Human
ugcaauuuuaauacauuagagg

SEQ ID NO: 609683 - RNA, 22 nt, Human
uucuccugcgcaggcccaggga

SEQ ID NO: 609684 - RNA, 23 nt, Human
uggcucugagagguucagaugcu

SEQ ID NO: 609685 - RNA, 22 nt, Human
caaauagacucuagaauuuauu

SEQ ID NO: 609686 - RNA, 22 nt, Human
agcagcaguugcugacguucua

SEQ ID NO: 609687 - RNA, 22 nt, Human
uggagaguggauaugggagcaa

SEQ ID NO: 609688 - RNA, 22 nt, Human
ccaggcuucaggagugguuucc

SEQ ID NO: 609689 - RNA, 22 nt, Human
uaauuuaugaugcaaagaaaag

SEQ ID NO: 609690 - RNA, 22 nt, Human
cugccugcuaccugaaaugcca

SEQ ID NO: 609691 - RNA, 22 nt, Human
aucaaaaugcuccagugauggu

SEQ ID NO: 609692 - RNA, 20 nt, Human
ggcagcucuagucgaggccc

SEQ ID NO: 609693 - RNA, 22 nt, Human
aagaguggagcuggaaaguggg

SEQ ID NO: 609694 - RNA, 22 nt, Human
aagcugggacuuagcgcagaua

SEQ ID NO: 609695 - RNA, 22 nt, Human
auacagcugccuucuaacuaug

SEQ ID NO: 609696 - RNA, 22 nt, Human
uauaaauuauuaggcugcuaaa

SEQ ID NO: 609697 - RNA, 22 nt, Human
acuuggaaaauucaaaauggca

SEQ ID NO: 609698 - RNA, 22 nt, Human
cagcacugcuucgcagccaggg

SEQ ID NO: 609699 - RNA, 22 nt, Human
caugggggcugaggcugcugua

SEQ ID NO: 609700 - RNA, 21 nt, Human
ucuuccugcuccacacucccc

SEQ ID NO: 609701 - RNA, 22 nt, Human
uacuauacucuccauuuuauag

SEQ ID NO: 609702 - RNA, 22 nt, Human
uguggcagggauacugaggcag

SEQ ID NO: 609703 - RNA, 22 nt, Human
auuuggaagaaaucugucacag

SEQ ID NO: 609704 - RNA, 22 nt, Human
aggucacacaacugucagaggc

SEQ ID NO: 609705 - RNA, 19 nt, Human
agccagugagccucugggu

SEQ ID NO: 609706 - RNA, 22 nt, Human
cccaagggugcccagcagagga

SEQ ID NO: 609707 - RNA, 22 nt, Human
ugaucaaaacauuacuccacca

SEQ ID NO: 609708 - RNA, 23 nt, Human
uugcaaaaugagucuugagugaa

SEQ ID NO: 609709 - RNA, 22 nt, Human
acccaggacaaaauaaccaggu

SEQ ID NO: 609710 - RNA, 22 nt, Human
acauuucuuuucaucucuauau

SEQ ID NO: 609711 - RNA, 22 nt, Human
ccucuucugagugagacucccu

SEQ ID NO: 609712 - RNA, 19 nt, Human
accaggaacuucccuaggc

SEQ ID NO: 609713 - RNA, 23 nt, Human
cagugcugguucugccugugggg

SEQ ID NO: 609714 - RNA, 22 nt, Human
guucaaggaagggaggaaagcc

SEQ ID NO: 609715 - RNA, 23 nt, Human
acaguuauagcugugaauaacau

SEQ ID NO: 609716 - RNA, 22 nt, Human
auguuuaaauuuauagacagug

SEQ ID NO: 609717 - RNA, 22 nt, Human
aagaugcagcaaacuacuuuuu

SEQ ID NO: 609718 - RNA, 22 nt, Human
aggcacagccucccuucacaug

SEQ ID NO: 609719 - RNA, 22 nt, Human
uauaaagaauccagaagagaca

SEQ ID NO: 609720 - RNA, 23 nt, Human
ccuggaguacuaaggggauggaa

SEQ ID NO: 609721 - RNA, 22 nt, Human
agaggaggcagcuuaacucagu

SEQ ID NO: 609722 - RNA, 22 nt, Human
guugaacuauguuuuaucugac

SEQ ID NO: 609723 - RNA, 22 nt, Human
cugugcuggagaugggccagag

SEQ ID NO: 609724 - RNA, 22 nt, Human
uaaaacuagugguugggacuaa

SEQ ID NO: 609725 - RNA, 22 nt, Human
ugaggcauuaaagggaggucaa

SEQ ID NO: 609726 - RNA, 22 nt, Human
guggugcaggccagcaggggcg

SEQ ID NO: 609727 - RNA, 22 nt, Human
gaccucagguuuguaauggaca

SEQ ID NO: 609728 - RNA, 22 nt, Human
uuccugagacccucacagugau

SEQ ID NO: 609729 - RNA, 22 nt, Human
cacugcaaugucuaccuccugg

SEQ ID NO: 609730 - RNA, 22 nt, Human
uguaagauauucagcuuauuga

SEQ ID NO: 609731 - RNA, 22 nt, Human
guggcucagcggagcucugcac

SEQ ID NO: 609732 - RNA, 22 nt, Human
cuggagucagcaaggacgaggc

SEQ ID NO: 609733 - RNA, 17 nt, Human
ucucuuucccuuucugc

SEQ ID NO: 609734 - RNA, 19 nt, Human
ucaggcaguuauucacaaa

SEQ ID NO: 609735 - RNA, 22 nt, Human
uguuuaauaauucuaugauagu

SEQ ID NO: 609736 - RNA, 22 nt, Human
gugcauguuaaugguguacaaa

SEQ ID NO: 609737 - RNA, 22 nt, Human
gggcuuaaggccagugugcuuu

SEQ ID NO: 609738 - RNA, 22 nt, Human
uguacaaagaguauagcuuuga

SEQ ID NO: 609739 - RNA, 22 nt, Human
aaacuuuuuuagguucauaggc

SEQ ID NO: 609740 - RNA, 22 nt, Human
agcccagaggcugggcgugcau

SEQ ID NO: 609741 - RNA, 22 nt, Human
ucaguucuggcugcugcuguca

SEQ ID NO: 609742 - RNA, 22 nt, Human
ucaaguguaguggugucagguc

SEQ ID NO: 609743 - RNA, 22 nt, Human
guuccugagaaauaaagagaga

SEQ ID NO: 609744 - RNA, 22 nt, Human
cuuccugaggugcugagcacag

SEQ ID NO: 609745 - RNA, 22 nt, Human
ucugagcagggcaguguccaug

SEQ ID NO: 609746 - RNA, 22 nt, Human
auuuuccaaaauaauuguuacu

SEQ ID NO: 609747 - RNA, 22 nt, Human
cuccagucauguuuacugugca

SEQ ID NO: 609748 - RNA, 22 nt, Human
aggaagccugcaggugacugcu

SEQ ID NO: 609749 - RNA, 22 nt, Human
aauuuauucccgucucugggcu

SEQ ID NO: 609750 - RNA, 21 nt, Human
cuguuucuugugaagugacac

SEQ ID NO: 609751 - RNA, 22 nt, Human
gauucugaaauuaacagacugg

SEQ ID NO: 609752 - RNA, 22 nt, Human
ugagaacauacaaacagagaaa

SEQ ID NO: 609753 - RNA, 22 nt, Human
uugcuaaaggauuuuguauuua

SEQ ID NO: 609754 - RNA, 22 nt, Human
uucccucuccaggagcccugag

SEQ ID NO: 609755 - RNA, 22 nt, Human
uuucugaagucuucuaacagau

SEQ ID NO: 609756 - RNA, 22 nt, Human
agcuucuugaccaagccuguaa

SEQ ID NO: 609757 - RNA, 22 nt, Human
ucagaacaauugggaaccauua

SEQ ID NO: 609758 - RNA, 22 nt, Human
uuccaguuggagccugccuuua

SEQ ID NO: 609759 - RNA, 22 nt, Human
cggcugagacggccauagacac

SEQ ID NO: 609760 - RNA, 22 nt, Human
ugucaggagccaccagcacucc

SEQ ID NO: 609761 - RNA, 22 nt, Human
gccuugccaaggggcagcagag

SEQ ID NO: 609762 - RNA, 23 nt, Human
cugagguggagagugagguaagu

SEQ ID NO: 609763 - RNA, 22 nt, Human
agcaggagcccuuaucaccagg

SEQ ID NO: 609764 - RNA, 22 nt, Human
uccccagaggugaggcagcuuu

SEQ ID NO: 609765 - RNA, 22 nt, Human
gcagggccagguacaagaagca

SEQ ID NO: 609766 - RNA, 22 nt, Human
acuguguguuugucuagcacag

SEQ ID NO: 609767 - RNA, 22 nt, Human
ucacuaaugauuuugaaagaag

SEQ ID NO: 609768 - RNA, 22 nt, Human
aguauaauuuacauuugguauu

SEQ ID NO: 609769 - RNA, 22 nt, Human
ugccuguccugaggaugagggu

SEQ ID NO: 609770 - RNA, 19 nt, Human
cuggaaugauagagaccuc

SEQ ID NO: 609771 - RNA, 22 nt, Human
caccugggcuaaacuaugcagg

SEQ ID NO: 609772 - RNA, 22 nt, Human
uaagacauccuggauguucaaa

SEQ ID NO: 609773 - RNA, 22 nt, Human
cuaaacauguuggugcuuuaaa

SEQ ID NO: 609774 - RNA, 22 nt, Human
ccugugggagcccaggcagaua

SEQ ID NO: 609775 - RNA, 22 nt, Human
agauacauuaguaguuacuugu

SEQ ID NO: 609776 - RNA, 22 nt, Human
ggagacaguauggcuuguagcu

SEQ ID NO: 609777 - RNA, 22 nt, Human
uccugaaggccugaguuccacc

SEQ ID NO: 609778 - RNA, 22 nt, Human
aggagacauaacuaugaugaga

SEQ ID NO: 609779 - RNA, 22 nt, Human
aaagaauagccuuuguccaaau

SEQ ID NO: 609780 - RNA, 22 nt, Human
caaggagauaaaauguugagcu

SEQ ID NO: 609781 - RNA, 22 nt, Human
caggcugggcagccuccccggc

SEQ ID NO: 609782 - RNA, 22 nt, Human
cagggcaaagucuucuagaacc

SEQ ID NO: 609783 - RNA, 22 nt, Human
ugugaggccucugcaggagcag

SEQ ID NO: 609784 - RNA, 22 nt, Human
auuucagauucgagaggaagug

SEQ ID NO: 609785 - RNA, 22 nt, Human
guaggaagcucugaggcuaguu

SEQ ID NO: 609786 - RNA, 22 nt, Human
agaguuuggauuuuaggacauc

SEQ ID NO: 609787 - RNA, 22 nt, Human
cacaucuuccagaguagcuaaa

SEQ ID NO: 609788 - RNA, 22 nt, Human
acacaggggaaaguggagcuga

SEQ ID NO: 609789 - RNA, 22 nt, Human
gcaguguuaaacaacugcugcu

SEQ ID NO: 609790 - RNA, 22 nt, Human
cagacagaggcuguaugagggc

SEQ ID NO: 609791 - RNA, 22 nt, Human
aucccagauagugacccucagg

SEQ ID NO: 609792 - RNA, 22 nt, Human
ucuggcuccacaccucacugca

SEQ ID NO: 609793 - RNA, 20 nt, Human
cugggcucgguggcccuggc

SEQ ID NO: 609794 - RNA, 22 nt, Human
ucugccugugcuguguuuucau

SEQ ID NO: 609795 - RNA, 22 nt, Human
cuacaggucaguaagaccuaga

SEQ ID NO: 609796 - RNA, 22 nt, Human
agcaaguguaagaaugcagaau

SEQ ID NO: 609797 - RNA, 23 nt, Human
aggucuggacccuuggccccugc

SEQ ID NO: 609798 - RNA, 22 nt, Human
agggcagccugagugcuggccc

SEQ ID NO: 609799 - RNA, 22 nt, Human
cguccagggcgggcuccccuca

SEQ ID NO: 609800 - RNA, 22 nt, Human
cucagucugucuugucuguguu

SEQ ID NO: 609801 - RNA, 22 nt, Human
auguuaugugcaagauacauaa

SEQ ID NO: 609802 - RNA, 22 nt, Human
gcugggacggcucaguaagaag

SEQ ID NO: 609803 - RNA, 21 nt, Human
auacagaagguggcaaaguac

SEQ ID NO: 609804 - RNA, 22 nt, Human
ugaaagcagugauuucuccuuc

SEQ ID NO: 609805 - RNA, 22 nt, Human
ccaggguuggucucucugaggu

SEQ ID NO: 609806 - RNA, 22 nt, Human
uuccuucuuugugguagaaagu

SEQ ID NO: 609807 - RNA, 22 nt, Human
augggcugacaagacaugcaua

SEQ ID NO: 609808 - RNA, 22 nt, Human
gccaguuccuguggagucagag

SEQ ID NO: 609809 - RNA, 22 nt, Human
uuucuaacguagacagggaggu

SEQ ID NO: 609810 - RNA, 22 nt, Human
gucccuuggcucacaaacagcu

SEQ ID NO: 609811 - RNA, 22 nt, Human
acagaagcaaaagcaggaucuu

SEQ ID NO: 609812 - RNA, 18 nt, Human
cugaaggauccaggugua

SEQ ID NO: 609813 - RNA, 22 nt, Human
auuaaaauuccaagguaugcca

SEQ ID NO: 609814 - RNA, 22 nt, Human
aacaugcaaugucugaaaaucc

SEQ ID NO: 609815 - RNA, 22 nt, Human
agaaugaauuaaucaacuggaa

SEQ ID NO: 609816 - RNA, 22 nt, Human
acccacagccgcugugcguccc

SEQ ID NO: 609817 - RNA, 22 nt, Human
gcuuccauguugcugcugguca

SEQ ID NO: 609818 - RNA, 18 nt, Human
gcagccccucuuccuucc

SEQ ID NO: 609819 - RNA, 22 nt, Human
ugcuucugucucuuaugccuug

SEQ ID NO: 609820 - RNA, 22 nt, Human
auggacucacuaauuccuccac

SEQ ID NO: 609821 - RNA, 22 nt, Human
agcugcucaggagagccagguc

SEQ ID NO: 609822 - RNA, 22 nt, Human
agccaggcgcaguggcuuaugc

SEQ ID NO: 609823 - RNA, 22 nt, Human
caccuagggcaucccugcccca

SEQ ID NO: 609824 - RNA, 22 nt, Human
ucuguuaaccuggucuuggcuu

SEQ ID NO: 609825 - RNA, 18 nt, Human
cggaucaugcgcugaggc

SEQ ID NO: 609826 - RNA, 22 nt, Human
uggccucuuaggacauccucua

SEQ ID NO: 609827 - RNA, 22 nt, Human
augauguuauuuucagaaacau

SEQ ID NO: 609828 - RNA, 22 nt, Human
aggggugugcauccuggaggau

SEQ ID NO: 609829 - RNA, 22 nt, Human
ggcccacuugaaauggagcuca

SEQ ID NO: 609830 - RNA, 22 nt, Human
uagugauuaaaggcagaauguu

SEQ ID NO: 609831 - RNA, 22 nt, Human
aagagggcucgauuuggcaaaa

SEQ ID NO: 609832 - RNA, 22 nt, Human
uuuaaaugcagacguugauuca

SEQ ID NO: 609833 - RNA, 22 nt, Human
gcagaggauagcauaugaaccu

SEQ ID NO: 609834 - RNA, 22 nt, Human
guguagagugacaaggugggaa

SEQ ID NO: 609835 - RNA, 22 nt, Human
ugcucauugcugauuuacaugu

SEQ ID NO: 609836 - RNA, 23 nt, Human
acagccaggaugggagcagaagc

SEQ ID NO: 609837 - RNA, 22 nt, Human
auuuagcuuucucucacuggug

SEQ ID NO: 609838 - RNA, 22 nt, Human
aucuuucucugcacuauacaau

SEQ ID NO: 609839 - RNA, 22 nt, Human
aaagccauaagccuaauacuaa

SEQ ID NO: 609840 - RNA, 22 nt, Human
cccucagcuccacccucagcag

SEQ ID NO: 609841 - RNA, 22 nt, Human
aaaugucuuuaucucauguaac

SEQ ID NO: 609842 - RNA, 22 nt, Human
aacaucaggaucuuguuacagu

SEQ ID NO: 609843 - RNA, 22 nt, Human
aguguccaacucagcuugucaa

SEQ ID NO: 609844 - RNA, 22 nt, Human
aaaagacauaugugggcauucu

SEQ ID NO: 609845 - RNA, 22 nt, Human
uagaggcacccuggaggagacu

SEQ ID NO: 609846 - RNA, 22 nt, Human
ccugguguggcugucacagagg

SEQ ID NO: 609847 - RNA, 22 nt, Human
aggcagagcuaggaagaauugu

SEQ ID NO: 609848 - RNA, 22 nt, Human
uuaaaauuauggcccauuugga

SEQ ID NO: 609849 - RNA, 19 nt, Human
uuccuaguagacugugugu

SEQ ID NO: 609850 - RNA, 22 nt, Human
uggaggagaauuuauggucgaa

SEQ ID NO: 609851 - RNA, 22 nt, Human
uguuuuuccaugugcagaacaa

SEQ ID NO: 609852 - RNA, 22 nt, Human
uacagugucccuuuuucagaca

SEQ ID NO: 609853 - RNA, 22 nt, Human
cacacacaguuuuguauucugu

SEQ ID NO: 609854 - RNA, 22 nt, Human
auacuuggugguguuccauagg

SEQ ID NO: 609855 - RNA, 22 nt, Human
gggcgccgugggaaacagccgg

SEQ ID NO: 609856 - RNA, 22 nt, Human
caggaagagguaucaccgagca

SEQ ID NO: 609857 - RNA, 22 nt, Human
agugaacaaagguagugagcau

SEQ ID NO: 609858 - RNA, 22 nt, Human
ucagagaucuucaggaugggac

SEQ ID NO: 609859 - RNA, 22 nt, Human
aggcugagugcuccccuagaug

SEQ ID NO: 609860 - RNA, 22 nt, Human
guuauugacucucuuguggcuu

SEQ ID NO: 609861 - RNA, 22 nt, Human
uugguauauugugcuacuuuau

SEQ ID NO: 609862 - RNA, 22 nt, Human
uuauggaauggagaaagucugc

SEQ ID NO: 609863 - RNA, 22 nt, Human
uauaaaugcacuuuugaaauau

SEQ ID NO: 609864 - RNA, 22 nt, Human
uggcugagggcacuaugaagcc

SEQ ID NO: 609865 - RNA, 22 nt, Human
auaagcuuugcuggagagaccu

SEQ ID NO: 609866 - RNA, 22 nt, Human
gugcugacaggagccuggcggu

SEQ ID NO: 609867 - RNA, 22 nt, Human
gaggcagcagggcugguuccuu

SEQ ID NO: 609868 - RNA, 23 nt, Human
cugggcuguccugaggucaccuc

SEQ ID NO: 609869 - RNA, 22 nt, Human
uugaggucugagacugugcagg

SEQ ID NO: 609870 - RNA, 22 nt, Human
ugaggcugccuugggaagaggg

SEQ ID NO: 609871 - RNA, 22 nt, Human
uaaucacaauucagaugucuua

SEQ ID NO: 609872 - RNA, 23 nt, Human
ccucaugaaggucugcuuccugg

SEQ ID NO: 609873 - RNA, 22 nt, Human
acguggagagaauagggcacca

SEQ ID NO: 609874 - RNA, 22 nt, Human
aggcagcagugauaagauagga

SEQ ID NO: 609875 - RNA, 22 nt, Human
cugaggccagagugggccucuu

SEQ ID NO: 609876 - RNA, 22 nt, Human
aaauaucauuuauaacuuuuaa

SEQ ID NO: 609877 - RNA, 22 nt, Human
aaauuucaguuaccuuuacguu

SEQ ID NO: 609878 - RNA, 22 nt, Human
ugcaugugcccacucuggcuua

SEQ ID NO: 609879 - RNA, 22 nt, Human
ugggagaaucuugcucugcuac

SEQ ID NO: 609880 - RNA, 22 nt, Human
agcuccugcccaggaaggcucu

SEQ ID NO: 609881 - RNA, 23 nt, Human
cggggccagggucaggaccgguc

SEQ ID NO: 609882 - RNA, 22 nt, Human
auugagaauauugugacagugu

SEQ ID NO: 609883 - RNA, 22 nt, Human
aaaguuuggauuagcaguuaga

SEQ ID NO: 609884 - RNA, 22 nt, Human
aggugggcggaucacaagguca

SEQ ID NO: 609885 - RNA, 22 nt, Human
ucugcaggucacgcuccagccu

SEQ ID NO: 609886 - RNA, 22 nt, Human
agaaauagcagagucaggcggg

SEQ ID NO: 609887 - RNA, 22 nt, Human
cggcagagcccugagucagccu

SEQ ID NO: 609888 - RNA, 22 nt, Human
caguuauaagacuaagcuauuc

SEQ ID NO: 609889 - RNA, 22 nt, Human
cugggacuuuacccuguggccc

SEQ ID NO: 609890 - RNA, 22 nt, Human
ucaggcuggaaugcaguggggc

SEQ ID NO: 609891 - RNA, 22 nt, Human
aagcucaggcuggaccuggcuu

SEQ ID NO: 609892 - RNA, 22 nt, Human
gggccagagcuuggcagcuggg

SEQ ID NO: 609893 - RNA, 22 nt, Human
caaaucauggcucuagcuuaca

SEQ ID NO: 609894 - RNA, 22 nt, Human
caugcagugacucagacacagg

SEQ ID NO: 609895 - RNA, 22 nt, Human
gcagcccaggucucucucacuc

SEQ ID NO: 609896 - RNA, 22 nt, Human
uuggcauuggagaugcaagaac

SEQ ID NO: 609897 - RNA, 18 nt, Human
cuggucagggcaaugggc

SEQ ID NO: 609898 - RNA, 22 nt, Human
uuaacauuguccuuagcagauu

SEQ ID NO: 609899 - RNA, 22 nt, Human
uugaaaaugguaagcaugauau

SEQ ID NO: 609900 - RNA, 22 nt, Human
cuuagccagcuaacuuaagcac

SEQ ID NO: 609901 - RNA, 20 nt, Human
ucccaggcugggcuccagcu

SEQ ID NO: 609902 - RNA, 22 nt, Human
auguacauucuucucaccgaag

SEQ ID NO: 609903 - RNA, 22 nt, Human
cugggaagcuucgagcaggaaa

SEQ ID NO: 609904 - RNA, 22 nt, Human
aagcagcaacaaacuggauaaa

SEQ ID NO: 609905 - RNA, 22 nt, Human
uggggcagggaugggaaacuau

SEQ ID NO: 609906 - RNA, 22 nt, Human
ucagcacugucuauuagugaga

SEQ ID NO: 609907 - RNA, 23 nt, Human
auguuaaacauaacugaagagcc

SEQ ID NO: 609908 - RNA, 22 nt, Human
auugccaccuguugcuauggag

SEQ ID NO: 609909 - RNA, 22 nt, Human
aauauuuuugaggcccuguuau

SEQ ID NO: 609910 - RNA, 22 nt, Human
agccuggauucgugcauccaca

SEQ ID NO: 609911 - RNA, 22 nt, Human
cgugggaggaaaaaugggcuuc

SEQ ID NO: 609912 - RNA, 21 nt, Human
uuuguucaggggcaaaguuaa

SEQ ID NO: 609913 - RNA, 22 nt, Human
agcagcagaagggagacccagg

SEQ ID NO: 609914 - RNA, 22 nt, Human
aaaguucuggcauuuucugucu

SEQ ID NO: 609915 - RNA, 22 nt, Human
gaauucugguuuugaaaugaau

SEQ ID NO: 609916 - RNA, 22 nt, Human
guggccagcaagugcugccucu

SEQ ID NO: 609917 - RNA, 22 nt, Human
caucucauccugcccuaaaaca

SEQ ID NO: 609918 - RNA, 22 nt, Human
cuagccagaugauucccaaaua

SEQ ID NO: 609919 - RNA, 20 nt, Human
ugcuuccuggccacugcggg

SEQ ID NO: 609920 - RNA, 23 nt, Human
uugcuuagagaccuccucaucag

SEQ ID NO: 609921 - RNA, 22 nt, Human
ugagguagagauugugacugua

SEQ ID NO: 609922 - RNA, 22 nt, Human
gagagguacggaaagagcgugg

SEQ ID NO: 609923 - RNA, 22 nt, Human
cgagcagaauggagggugccga

SEQ ID NO: 609924 - RNA, 22 nt, Human
aggcucagccugggccuagagc

SEQ ID NO: 609925 - RNA, 22 nt, Human
cuaguuguuuaauauugauuga

SEQ ID NO: 609926 - RNA, 22 nt, Human
ugggcaguugcuccucagaccc

SEQ ID NO: 609927 - RNA, 22 nt, Human
uacagauuuugugaagaagugu

SEQ ID NO: 609928 - RNA, 22 nt, Human
uuucuaauucuaacuggcagag

SEQ ID NO: 609929 - RNA, 22 nt, Human
gauaaugugccgauaauuucua

SEQ ID NO: 609930 - RNA, 22 nt, Human
cuguggcaggugucuggggcag

SEQ ID NO: 609931 - RNA, 22 nt, Human
uuucucauggacccuucaugau

SEQ ID NO: 609932 - RNA, 21 nt, Human
guuuucuuugauagagggaag

SEQ ID NO: 609933 - RNA, 22 nt, Human
acuauacauugaauguuaaggu

SEQ ID NO: 609934 - RNA, 22 nt, Human
uuugaacaagagcuucacauua

SEQ ID NO: 609935 - RNA, 22 nt, Human
caguccugcuagugugaaaagc

SEQ ID NO: 609936 - RNA, 22 nt, Human
uccuagaaggaucauucuagug

SEQ ID NO: 609937 - RNA, 22 nt, Human
cagcucaggcacuggcgcggga

SEQ ID NO: 609938 - RNA, 22 nt, Human
uagcuugacuauucuaugaugu

SEQ ID NO: 609939 - RNA, 22 nt, Human
aaauguacaacauccauauaua

SEQ ID NO: 609940 - RNA, 22 nt, Human
agggauggaagcucgucugcaa

SEQ ID NO: 609941 - RNA, 22 nt, Human
aaagcuuaagguagguacagag

SEQ ID NO: 609942 - RNA, 22 nt, Human
cagcccuggccccagguggucu

SEQ ID NO: 609943 - RNA, 22 nt, Human
agcaaggcagcuuucacugcuu

SEQ ID NO: 609944 - RNA, 22 nt, Human
aguucucaagacaauuaccugu

SEQ ID NO: 609945 - RNA, 22 nt, Human
gagagugcugaacggcaagggu

SEQ ID NO: 609946 - RNA, 22 nt, Human
cagucuccaaaucagucugaau

SEQ ID NO: 609947 - RNA, 22 nt, Human
ccugggagugugccaucucugu

SEQ ID NO: 609948 - RNA, 22 nt, Human
aaaacauugaauugcacacuau

SEQ ID NO: 609949 - RNA, 22 nt, Human
aagcacaucuccugugcagaac

SEQ ID NO: 609950 - RNA, 22 nt, Human
cugcccugucugcagccuggcu

SEQ ID NO: 609951 - RNA, 17 nt, Human
ccugucuuguuucugcc

SEQ ID NO: 609952 - RNA, 22 nt, Human
gcaguguuauguuuucuauaau

SEQ ID NO: 609953 - RNA, 22 nt, Human
cugagccaugagccugcgccca

SEQ ID NO: 609954 - RNA, 22 nt, Human
ucaaauaguugacauuaacuug

SEQ ID NO: 609955 - RNA, 22 nt, Human
aaagccuuggucaucugguucc

SEQ ID NO: 609956 - RNA, 22 nt, Human
aaacacugugggacaucuuacu

SEQ ID NO: 609957 - RNA, 22 nt, Human
cguguguguaccugcgcauuua

SEQ ID NO: 609958 - RNA, 22 nt, Human
uuucugcaucucuacaguuguu

SEQ ID NO: 609959 - RNA, 22 nt, Human
ucuccugcucagaacagccuca

SEQ ID NO: 609960 - RNA, 20 nt, Human
ggcugugcccuuccguggcc

SEQ ID NO: 609961 - RNA, 22 nt, Human
cagguaagaccguuuaggcagu

SEQ ID NO: 609962 - RNA, 22 nt, Human
cuguaugauauccaaauugaua

SEQ ID NO: 609963 - RNA, 22 nt, Human
aggcugaugcuggcugaggcug

SEQ ID NO: 609964 - RNA, 22 nt, Human
auguauaaguacacagucggaa

SEQ ID NO: 609965 - RNA, 22 nt, Human
gacccugacucuaaugcuuggc

SEQ ID NO: 609966 - RNA, 22 nt, Human
uguuuacauauuuggucucaga

SEQ ID NO: 609967 - RNA, 22 nt, Human
gcuauguguguuuugcugcagc

SEQ ID NO: 609968 - RNA, 22 nt, Human
aacccuggcccuggaauaggca

SEQ ID NO: 609969 - RNA, 22 nt, Human
guuauuuucauuggcucagacu

SEQ ID NO: 609970 - RNA, 23 nt, Human
cagcaagugaauuccaagagaga

SEQ ID NO: 609971 - RNA, 22 nt, Human
uuucagaaagcugaacauauga

SEQ ID NO: 609972 - RNA, 22 nt, Human
ccuugagccagggagcuggcag

SEQ ID NO: 609973 - RNA, 22 nt, Human
acagguggaaacaugguguugg

SEQ ID NO: 609974 - RNA, 22 nt, Human
gagcugggccucagaacacagu

SEQ ID NO: 609975 - RNA, 22 nt, Human
agaggccgggugccugcucaga

SEQ ID NO: 609976 - RNA, 22 nt, Human
uuauuuauaucucugcaguuua

SEQ ID NO: 609977 - RNA, 22 nt, Human
aaugcaauaccuuuuuaugcug

SEQ ID NO: 609978 - RNA, 22 nt, Human
agccagcugccuuucacaucug

SEQ ID NO: 609979 - RNA, 22 nt, Human
ucagaagguggagguugcagug

SEQ ID NO: 609980 - RNA, 23 nt, Human
acauacauaagcaccacauuuug

SEQ ID NO: 609981 - RNA, 22 nt, Human
aggugaggauagguggccaagg

SEQ ID NO: 609982 - RNA, 22 nt, Human
ugaggccccgaagcugagguuu

SEQ ID NO: 609983 - RNA, 22 nt, Human
uucuguaauucuguuaguuuca

SEQ ID NO: 609984 - RNA, 22 nt, Human
ucuaaagauguuuauugacaua

SEQ ID NO: 609985 - RNA, 22 nt, Human
ugagccugggagauggaggcug

SEQ ID NO: 609986 - RNA, 22 nt, Human
gugcaaaagucauugugguuuu

SEQ ID NO: 609987 - RNA, 22 nt, Human
aagccagccagugccagucuua

SEQ ID NO: 609988 - RNA, 22 nt, Human
aaacaugaugucauauaugcca

SEQ ID NO: 609989 - RNA, 22 nt, Human
aguggcagggcuggcugcugca

SEQ ID NO: 609990 - RNA, 22 nt, Human
cccagggcugcagauggaggcu

SEQ ID NO: 609991 - RNA, 22 nt, Human
ugcuuuguguuugaauagauaa

SEQ ID NO: 609992 - RNA, 22 nt, Human
uuccuuugggaaaucacuaagg

SEQ ID NO: 609993 - RNA, 22 nt, Human
ggugggagggcugcguuccucu

SEQ ID NO: 609994 - RNA, 21 nt, Human
cagagcuguccaaacccugac

SEQ ID NO: 609995 - RNA, 22 nt, Human
cuagagaaaaagcuuagguacg

SEQ ID NO: 609996 - RNA, 22 nt, Human
ccugugugucugucacugcaca

SEQ ID NO: 609997 - RNA, 22 nt, Human
ugcagagcuucauugcauaggc

SEQ ID NO: 609998 - RNA, 22 nt, Human
agaagccagucgcucucccgca

SEQ ID NO: 609999 - RNA, 22 nt, Human
uuccuucuggaagcuucagggg

SEQ ID NO: 610000 - RNA, 22 nt, Human
auuucucucauuguuagcuagg

SEQ ID NO: 610001 - RNA, 17 nt, Human
gcugccaccuuuggagc

SEQ ID NO: 610002 - RNA, 22 nt, Human
ggccuaggauucugcauuucua

SEQ ID NO: 610003 - RNA, 22 nt, Human
auacacauauguguguauaugu

SEQ ID NO: 610004 - RNA, 22 nt, Human
uaauauauaccuuuguuaggaa

SEQ ID NO: 610005 - RNA, 22 nt, Human
gaaggcuaaaggggcagagguu

SEQ ID NO: 610006 - RNA, 20 nt, Human
uccagcucaguuuuuuuguc

SEQ ID NO: 610007 - RNA, 22 nt, Human
cuggaaugagcagggcuuaugg

SEQ ID NO: 610008 - RNA, 22 nt, Human
ugguccugaggcuuguuuccac

SEQ ID NO: 610009 - RNA, 22 nt, Human
guucagauggagaaggaaaacu

SEQ ID NO: 610010 - RNA, 22 nt, Human
agauuucugucaccuucuaugc

SEQ ID NO: 610011 - RNA, 22 nt, Human
ugaggccacuuccccacagccc

SEQ ID NO: 610012 - RNA, 22 nt, Human
cucuagcugaggucacugcuau

SEQ ID NO: 610013 - RNA, 22 nt, Human
agucagugaaugguguaugcua

SEQ ID NO: 610014 - RNA, 22 nt, Human
cacucugagaaacacuaaacca

SEQ ID NO: 610015 - RNA, 22 nt, Human
caguggguaguggggauuagca

SEQ ID NO: 610016 - RNA, 22 nt, Human
cagagcaggcccacugcccucc

SEQ ID NO: 610017 - RNA, 22 nt, Human
ccagcugguaagugauggagcc

SEQ ID NO: 610018 - RNA, 22 nt, Human
uuagaacaaagccaccagguga

SEQ ID NO: 610019 - RNA, 22 nt, Human
guuaucuucuauuucucauacu

SEQ ID NO: 610020 - RNA, 22 nt, Human
acccaggcuggaaugcaguggc

SEQ ID NO: 610021 - RNA, 22 nt, Human
acccaggcuggagugcagugac

SEQ ID NO: 610022 - RNA, 20 nt, Human
caggccucugggggcccugg

SEQ ID NO: 610023 - RNA, 22 nt, Human
cugaauaauguucucuuguaug

SEQ ID NO: 610024 - RNA, 22 nt, Human
cagccagugguugaagaugcag

SEQ ID NO: 610025 - RNA, 18 nt, Human
ccugcagcccaggaggcc

SEQ ID NO: 610026 - RNA, 22 nt, Human
aaccagcuuugauacgcauuau

SEQ ID NO: 610027 - RNA, 22 nt, Human
cagagucagagcuccauggagu

SEQ ID NO: 610028 - RNA, 22 nt, Human
cagggugcagagcuaggguagu

SEQ ID NO: 610029 - RNA, 22 nt, Human
ggcagugggaaauaagugagaa

SEQ ID NO: 610030 - RNA, 22 nt, Human
gagcuuuguaaaaaacuugcac

SEQ ID NO: 610031 - RNA, 22 nt, Human
uaacaaaguauuguuuguguau

SEQ ID NO: 610032 - RNA, 22 nt, Human
gggcuuggcuggggccaccaga

SEQ ID NO: 610033 - RNA, 22 nt, Human
cagcaugcccagacugagcuaa

SEQ ID NO: 610034 - RNA, 22 nt, Human
ggcaugugccugaggucacaca

SEQ ID NO: 610035 - RNA, 22 nt, Human
aaaugcacugaauauuccaaau

SEQ ID NO: 610036 - RNA, 22 nt, Human
gaaggccacggaauggagcugg

SEQ ID NO: 610037 - RNA, 22 nt, Human
ucucccaaggcacagaaagagu

SEQ ID NO: 610038 - RNA, 22 nt, Human
uagggagaugcaagggacggag

SEQ ID NO: 610039 - RNA, 22 nt, Human
ugggggugaaagucuggacagu

SEQ ID NO: 610040 - RNA, 20 nt, Human
aggcucagcugagcucuugg

SEQ ID NO: 610041 - RNA, 22 nt, Human
agcauuaagagagacugaacug

SEQ ID NO: 610042 - RNA, 22 nt, Human
ugugaaaagggcuuuguacaaa

SEQ ID NO: 610043 - RNA, 22 nt, Human
agcuucaggaacaggcagccug

SEQ ID NO: 610044 - RNA, 22 nt, Human
ucucccaagugaccaggaaaga

SEQ ID NO: 610045 - RNA, 22 nt, Human
ccagcugacgaugccuggucuc

SEQ ID NO: 610046 - RNA, 22 nt, Human
aaaguuuguuauaugauaagga

SEQ ID NO: 610047 - RNA, 22 nt, Human
cagcacuaggauauacauuucc

SEQ ID NO: 610048 - RNA, 22 nt, Human
cagcaggguuaagugacucacc

SEQ ID NO: 610049 - RNA, 22 nt, Human
aaucuucaacagaaugguagga

SEQ ID NO: 610050 - RNA, 22 nt, Human
agcuggcugccuucuccuuagg

SEQ ID NO: 610051 - RNA, 22 nt, Human
cacagucccgugcuuaccaugu

SEQ ID NO: 610052 - RNA, 20 nt, Human
cauauggaaagauauuguuc

SEQ ID NO: 610053 - RNA, 22 nt, Human
gaggggcucuugggcaugaagg

SEQ ID NO: 610054 - RNA, 22 nt, Human
auggauggaaaaguugaggaga

SEQ ID NO: 610055 - RNA, 22 nt, Human
agcagugggggaguguuaguuu

SEQ ID NO: 610056 - RNA, 22 nt, Human
auauucuugugauuauaaagua

SEQ ID NO: 610057 - RNA, 22 nt, Human
cuggugugauugagcccaggug

SEQ ID NO: 610058 - RNA, 22 nt, Human
gagcucagccugaggccuggcu

SEQ ID NO: 610059 - RNA, 22 nt, Human
cucugaguugaggcaggagagu

SEQ ID NO: 610060 - RNA, 22 nt, Human
acugggcuucacuuggcacauc

SEQ ID NO: 610061 - RNA, 20 nt, Human
cagugccuaucauuaauucc

SEQ ID NO: 610062 - RNA, 22 nt, Human
uucuccucuguuggccuucccu

SEQ ID NO: 610063 - RNA, 22 nt, Human
cugcacagagcggcaguucuua

SEQ ID NO: 610064 - RNA, 19 nt, Human
ccagcuggccugggaccuc

SEQ ID NO: 610065 - RNA, 22 nt, Human
gcucuucuaaagaauguacagg

SEQ ID NO: 610066 - RNA, 22 nt, Human
ccccucccugaccugguugggc

SEQ ID NO: 610067 - RNA, 21 nt, Human
auacacauacacauaaaugug

SEQ ID NO: 610068 - RNA, 23 nt, Human
agggaaaguaguaauggccuuug

SEQ ID NO: 610069 - RNA, 22 nt, Human
uuuacaggauuacccuggcugc

SEQ ID NO: 610070 - RNA, 22 nt, Human
uucucuaagccuuaguuucuuc

SEQ ID NO: 610071 - RNA, 20 nt, Human
acuuucucgguuucucaccu

SEQ ID NO: 610072 - RNA, 18 nt, Human
aguugcuagaugcuguag

SEQ ID NO: 610073 - RNA, 22 nt, Human
uugcaguuuugacagaccaaau

SEQ ID NO: 610074 - RNA, 21 nt, Human
uggaaagauucaaagaccagg

SEQ ID NO: 610075 - RNA, 22 nt, Human
uuucagugcacguaguuuauuu

SEQ ID NO: 610076 - RNA, 22 nt, Human
agcuguucccucacugcaguca

SEQ ID NO: 610077 - RNA, 22 nt, Human
uucagucuccucauuuuacaaa

SEQ ID NO: 610078 - RNA, 22 nt, Human
ucuuugcuccacacucuagaga

SEQ ID NO: 610079 - RNA, 22 nt, Human
ugcaccugagaggucucugagg

SEQ ID NO: 610080 - RNA, 22 nt, Human
accuuagaccagcaagauauuu

SEQ ID NO: 610081 - RNA, 22 nt, Human
cugcugugucagaguccagggg

SEQ ID NO: 610082 - RNA, 22 nt, Human
aggugugggaaacgggugaccu

SEQ ID NO: 610083 - RNA, 23 nt, Human
ugcaaauaacaaggaguuuaagg

SEQ ID NO: 610084 - RNA, 22 nt, Human
uuuacugaauuugguauauucc

SEQ ID NO: 610085 - RNA, 22 nt, Human
gcuuggcugugagcuuugcugu

SEQ ID NO: 610086 - RNA, 22 nt, Human
aggguagggcccggagacagac

SEQ ID NO: 610087 - RNA, 22 nt, Human
gcuggcaccugcaccaagcagg

SEQ ID NO: 610088 - RNA, 22 nt, Human
acuggacucacguauuccugag

SEQ ID NO: 610089 - RNA, 22 nt, Human
ugagaugaaagcagaaagacuu

SEQ ID NO: 610090 - RNA, 22 nt, Human
agggucaggagacacuggcaac

SEQ ID NO: 610091 - RNA, 22 nt, Human
cuacauggagaagaaaauucuu

SEQ ID NO: 610092 - RNA, 22 nt, Human
gcuggguccaugguccucgggu

SEQ ID NO: 610093 - RNA, 20 nt, Human
uccaggagaacugggagccg

SEQ ID NO: 610094 - RNA, 22 nt, Human
uucuggagccgggccugggcag

SEQ ID NO: 610095 - RNA, 22 nt, Human
cagcugcugccucauccacuuu

SEQ ID NO: 610096 - RNA, 17 nt, Human
cccucuggggagggagg

SEQ ID NO: 610097 - RNA, 22 nt, Human
ugggagaacacugcucuggaug

SEQ ID NO: 610098 - RNA, 22 nt, Human
aagucuuacagacaagcugaag

SEQ ID NO: 610099 - RNA, 22 nt, Human
uccugcacaccuugagcuugga

SEQ ID NO: 610100 - RNA, 22 nt, Human
gcacagggagcaggucucuggu

SEQ ID NO: 610101 - RNA, 22 nt, Human
aguggcagagcaggugcuggaa

SEQ ID NO: 610102 - RNA, 22 nt, Human
uauucucagcaacacacaugga

SEQ ID NO: 610103 - RNA, 22 nt, Human
uucaaguuuuuaaaggcaguua

SEQ ID NO: 610104 - RNA, 22 nt, Human
agagccuggaccugggcucuga

SEQ ID NO: 610105 - RNA, 22 nt, Human
cagccccucccucaggcaggug

SEQ ID NO: 610106 - RNA, 22 nt, Human
uugcagagagguuaggaacuca

SEQ ID NO: 610107 - RNA, 22 nt, Human
uacauuccaaaggaaacuggcu

SEQ ID NO: 610108 - RNA, 19 nt, Human
uccaguuuggcaggaagac

SEQ ID NO: 610109 - RNA, 22 nt, Human
gucacaaauccccucagcaacu

SEQ ID NO: 610110 - RNA, 22 nt, Human
aaauagcuguauuuacccugua

SEQ ID NO: 610111 - RNA, 22 nt, Human
gucugucucucuccagagugca

SEQ ID NO: 610112 - RNA, 22 nt, Human
ggacugaggcccacuugaggga

SEQ ID NO: 610113 - RNA, 22 nt, Human
agggaaggagguuagaacccac

SEQ ID NO: 610114 - RNA, 22 nt, Human
aaggaaucacuucuuuaaauga

SEQ ID NO: 610115 - RNA, 22 nt, Human
gggagcuggagcuggaagacuc

SEQ ID NO: 610116 - RNA, 22 nt, Human
gccaagggggcagugcaugggu

SEQ ID NO: 610117 - RNA, 22 nt, Human
auucccagguaaaaguagagcu

SEQ ID NO: 610118 - RNA, 21 nt, Human
gcagcagaggcuugacagaca

SEQ ID NO: 610119 - RNA, 22 nt, Human
ucagaggauuggacuuuuaugu

SEQ ID NO: 610120 - RNA, 22 nt, Human
ucagcaaugugauacugugcaa

SEQ ID NO: 610121 - RNA, 22 nt, Human
cuggagcugucuucacaggccu

SEQ ID NO: 610122 - RNA, 22 nt, Human
aggcacgagcaauggccgagga

SEQ ID NO: 610123 - RNA, 22 nt, Human
aaggcugguuuccuugauguuu

SEQ ID NO: 610124 - RNA, 23 nt, Human
gagugcagaauagacaugcagug

SEQ ID NO: 610125 - RNA, 22 nt, Human
cagcuccucacgagucuugaaa

SEQ ID NO: 610126 - RNA, 22 nt, Human
caaaugcaggucauaaccugag

SEQ ID NO: 610127 - RNA, 22 nt, Human
caugaacagcuaacauuuuggg

SEQ ID NO: 610128 - RNA, 22 nt, Human
acuguauuuggauauaagaucu

SEQ ID NO: 610129 - RNA, 22 nt, Human
gcaggggcggcuggguuuccag

SEQ ID NO: 610130 - RNA, 22 nt, Human
caguuucucucauacauauuug

SEQ ID NO: 610131 - RNA, 22 nt, Human
gccagcucccaagugagccccu

SEQ ID NO: 610132 - RNA, 22 nt, Human
aaggcaggaugggaaaagauuu

SEQ ID NO: 610133 - RNA, 22 nt, Human
uuggcuuuagaccugagacugu

SEQ ID NO: 610134 - RNA, 22 nt, Human
uucaacaugcaaacauguuugu

SEQ ID NO: 610135 - RNA, 22 nt, Human
uucccagacuccacacugaggc

SEQ ID NO: 610136 - RNA, 22 nt, Human
cagguggggcagcugugggagc

SEQ ID NO: 610137 - RNA, 18 nt, Human
uggacaggguggagaaaa

SEQ ID NO: 610138 - RNA, 22 nt, Human
gguuuauugaaggccaccccac

SEQ ID NO: 610139 - RNA, 22 nt, Human
augcuaucuucagcaccuaggg

SEQ ID NO: 610140 - RNA, 22 nt, Human
gcucaggagcugacagccucaa

SEQ ID NO: 610141 - RNA, 22 nt, Human
cuuuccuaguuggucccagcac

SEQ ID NO: 610142 - RNA, 22 nt, Human
ugcuacacucaaucagugcuau

SEQ ID NO: 610143 - RNA, 22 nt, Human
auuucccagggcccucauaguu

SEQ ID NO: 610144 - RNA, 22 nt, Human
caggaaaugggucguuuuauaa

SEQ ID NO: 610145 - RNA, 19 nt, Human
acauagcuggcuacacugu

SEQ ID NO: 610146 - RNA, 22 nt, Human
uccagcccaggcuggaguguag

SEQ ID NO: 610147 - RNA, 22 nt, Human
uucucuuuauguauuuaguggg

SEQ ID NO: 610148 - RNA, 22 nt, Human
cuccugucaauaggcuccuggc

SEQ ID NO: 610149 - RNA, 20 nt, Human
ugcuuugauggaaauacagc

SEQ ID NO: 610150 - RNA, 23 nt, Human
guggagccacaucacaggcuccu

SEQ ID NO: 610151 - RNA, 22 nt, Human
agccugguguggggcugcagag

SEQ ID NO: 610152 - RNA, 22 nt, Human
uucugaaaccacugaccaacua

SEQ ID NO: 610153 - RNA, 22 nt, Human
gcuggagguagggagguccugu

SEQ ID NO: 610154 - RNA, 22 nt, Human
uacuucauuccuuuguaaaaug

SEQ ID NO: 610155 - RNA, 20 nt, Human
ucaugcaagauucauaaagg

SEQ ID NO: 610156 - RNA, 22 nt, Human
aagcugaggcccauggcaaggu

SEQ ID NO: 610157 - RNA, 22 nt, Human
ucccagcacgucugcuguuucu

SEQ ID NO: 610158 - RNA, 22 nt, Human
uccugggguguguuuugcugcu

SEQ ID NO: 610159 - RNA, 18 nt, Human
ggcugcuuaaggagaucc

SEQ ID NO: 610160 - RNA, 22 nt, Human
acagcagccuuguugguuucga

SEQ ID NO: 610161 - RNA, 22 nt, Human
gaugucuuugccaugcaugugu

SEQ ID NO: 610162 - RNA, 22 nt, Human
augauacaagcaaaacuaauca

SEQ ID NO: 610163 - RNA, 22 nt, Human
ucccucucuugggcguggcuca

SEQ ID NO: 610164 - RNA, 22 nt, Human
agcucuuccugcaccuguggcu

SEQ ID NO: 610165 - RNA, 22 nt, Human
aggcaccuugcgguccagugaa

SEQ ID NO: 610166 - RNA, 22 nt, Human
ggcaggagcucagguugguucc

SEQ ID NO: 610167 - RNA, 22 nt, Human
aagcccaguaccuucagugagg

SEQ ID NO: 610168 - RNA, 22 nt, Human
gccugccaaaagaagcugcugg

SEQ ID NO: 610169 - RNA, 19 nt, Human
aauacaguguuauagaauu

SEQ ID NO: 610170 - RNA, 22 nt, Human
cuggagccggaccagggacggu

SEQ ID NO: 610171 - RNA, 22 nt, Human
gucagugucuuaacagagauua

SEQ ID NO: 610172 - RNA, 22 nt, Human
acaggccuuggcaggcauguga

SEQ ID NO: 610173 - RNA, 22 nt, Human
ugggccuggggcagcccaaauc

SEQ ID NO: 610174 - RNA, 22 nt, Human
ugaaugauuugggugcauucag

SEQ ID NO: 610175 - RNA, 22 nt, Human
ggggaggaagcuggaacacggg

SEQ ID NO: 610176 - RNA, 22 nt, Human
gcugggcuguaguuugcugacc

SEQ ID NO: 610177 - RNA, 22 nt, Human
ucucacugcaaauauuauguau

SEQ ID NO: 610178 - RNA, 22 nt, Human
aggugcaggagcugugcaggga

SEQ ID NO: 610179 - RNA, 22 nt, Human
cauuguuaauugguaucuuaca

SEQ ID NO: 610180 - RNA, 22 nt, Human
gcuggcagguccaagauagagc

SEQ ID NO: 610181 - RNA, 22 nt, Human
aauauguucaaaauagaucacu

SEQ ID NO: 610182 - RNA, 22 nt, Human
augaguucauugcauuugacag

SEQ ID NO: 610183 - RNA, 22 nt, Human
agcagccacacgccuccuucuc

SEQ ID NO: 610184 - RNA, 22 nt, Human
uccugggcagccucucuggaag

SEQ ID NO: 610185 - RNA, 22 nt, Human
gcagguggcagaggugggaucu

SEQ ID NO: 610186 - RNA, 22 nt, Human
gaaaguauuuacauuaacaucu

SEQ ID NO: 610187 - RNA, 22 nt, Human
gaggcugaugcugccucacaga

SEQ ID NO: 610188 - RNA, 23 nt, Human
ggccuguguuuugucugaaguac

SEQ ID NO: 610189 - RNA, 22 nt, Human
ucuggaguuugaggacaagcuu

SEQ ID NO: 610190 - RNA, 22 nt, Human
agcuccugauacaugcaggaau

SEQ ID NO: 610191 - RNA, 22 nt, Human
uggugugggcguggcaggcaag

SEQ ID NO: 610192 - RNA, 22 nt, Human
ugaggcagcauucuucaagaca

SEQ ID NO: 610193 - RNA, 22 nt, Human
aagagcauauuaauaguggaga

SEQ ID NO: 610194 - RNA, 22 nt, Human
aggagagaauguuccaggcuug

SEQ ID NO: 610195 - RNA, 22 nt, Human
uacacaaaggcacucuguuguu

SEQ ID NO: 610196 - RNA, 22 nt, Human
caaauguaaauucuuuugaagc

SEQ ID NO: 610197 - RNA, 22 nt, Human
cuguguggacugguugaggccc

SEQ ID NO: 610198 - RNA, 22 nt, Human
ggugggacagguaggaguggcu

SEQ ID NO: 610199 - RNA, 22 nt, Human
auguuuuccugggagagcacuc

SEQ ID NO: 610200 - RNA, 22 nt, Human
uuuauuguugggucuuaagcug

SEQ ID NO: 610201 - RNA, 22 nt, Human
ucuuuuauccuacauuuagcuc

SEQ ID NO: 610202 - RNA, 22 nt, Human
caaauguauucucacuucaggg

SEQ ID NO: 610203 - RNA, 22 nt, Human
uuuccucuucuucccaugucau

SEQ ID NO: 610204 - RNA, 22 nt, Human
acuuguuaguuuuaucugcaug

SEQ ID NO: 610205 - RNA, 22 nt, Human
gcacacagaacauuuggauccu

SEQ ID NO: 610206 - RNA, 22 nt, Human
augacaaauucagaccauagca

SEQ ID NO: 610207 - RNA, 22 nt, Human
cugccguguuuuucauguuaaa

SEQ ID NO: 610208 - RNA, 22 nt, Human
cugaggcacugguaaugggcau

SEQ ID NO: 610209 - RNA, 22 nt, Human
gcaggggcaggagaucucaggc

SEQ ID NO: 610210 - RNA, 22 nt, Human
cagcccucugaagaggcgcuug

SEQ ID NO: 610211 - RNA, 20 nt, Human
ugagggcuaaccagacucug

SEQ ID NO: 610212 - RNA, 22 nt, Human
cagacaggguccuguccgucac

SEQ ID NO: 610213 - RNA, 22 nt, Human
ugucccucugaggcuucccugg

SEQ ID NO: 610214 - RNA, 21 nt, Human
uggccagcugcucgucuccuc

SEQ ID NO: 610215 - RNA, 22 nt, Human
cugcccaccacaccugcuccug

SEQ ID NO: 610216 - RNA, 22 nt, Human
gcuuccuguaggcagguccaag

SEQ ID NO: 610217 - RNA, 22 nt, Human
uuucaguuaaguggcuaguccc

SEQ ID NO: 610218 - RNA, 22 nt, Human
auguuauuucugaaagaucauu

SEQ ID NO: 610219 - RNA, 22 nt, Human
ucaggggcuugaggugcauguc

SEQ ID NO: 610220 - RNA, 22 nt, Human
caggggcugagaaggaacgucc

SEQ ID NO: 610221 - RNA, 22 nt, Human
auuguuuuaauuccauugugaa

SEQ ID NO: 610222 - RNA, 22 nt, Human
ugaagcaucuggucugagaauu

SEQ ID NO: 610223 - RNA, 22 nt, Human
gcuguagauggacuggcaucca

SEQ ID NO: 610224 - RNA, 19 nt, Human
aaacuaaggggaaauguuu

SEQ ID NO: 610225 - RNA, 22 nt, Human
aaucaugaaauaucaguucuuu

SEQ ID NO: 610226 - RNA, 22 nt, Human
acaugugucuaagaaugaaaga

SEQ ID NO: 610227 - RNA, 22 nt, Human
aacacugggauaggugauagac

SEQ ID NO: 610228 - RNA, 22 nt, Human
uacauugaggcaguagcuggag

SEQ ID NO: 610229 - RNA, 19 nt, Human
ugccagagauacucccaga

SEQ ID NO: 610230 - RNA, 21 nt, Human
cauuucaugauuauagaaaug

SEQ ID NO: 610231 - RNA, 22 nt, Human
ucaggcugggcuccucucccca

SEQ ID NO: 610232 - RNA, 22 nt, Human
cugagagguaagcagcgcagug

SEQ ID NO: 610233 - RNA, 22 nt, Human
cccagcuccaagggacagcgaa

SEQ ID NO: 610234 - RNA, 22 nt, Human
cacacaguaggcacucauuaau

SEQ ID NO: 610235 - RNA, 22 nt, Human
gcuggcugguccagcaggggcu

SEQ ID NO: 610236 - RNA, 22 nt, Human
cagagaugggucgcagagaugg

SEQ ID NO: 610237 - RNA, 18 nt, Human
ccagagggugcgucagcu

SEQ ID NO: 610238 - RNA, 22 nt, Human
aggcccauguucacuugcucag

SEQ ID NO: 610239 - RNA, 22 nt, Human
aaagguuaagguguucaagaaa

SEQ ID NO: 610240 - RNA, 22 nt, Human
cuuaguuuuugcccuggaguuu

SEQ ID NO: 610241 - RNA, 22 nt, Human
auggaagacuaacagaaacaug

SEQ ID NO: 610242 - RNA, 22 nt, Human
gcaagauuagaaucaacuguga

SEQ ID NO: 610243 - RNA, 17 nt, Human
agacagugagugccuug

SEQ ID NO: 610244 - RNA, 22 nt, Human
uucagaaagugaaucuuguuau

SEQ ID NO: 610245 - RNA, 22 nt, Human
acaagaauuuacauguagugga

SEQ ID NO: 610246 - RNA, 21 nt, Human
ggacagaggagaaggcacccu

SEQ ID NO: 610247 - RNA, 22 nt, Human
gcauuuaaauuugaacuucaga

SEQ ID NO: 610248 - RNA, 22 nt, Human
agccucugucaagcuuuucaaa

SEQ ID NO: 610249 - RNA, 22 nt, Human
ggaugcugcuaucaggcuucga

SEQ ID NO: 610250 - RNA, 22 nt, Human
acacugguaggaagagauggcu

SEQ ID NO: 610251 - RNA, 22 nt, Human
aggggccuggcacugagcuggc

SEQ ID NO: 610252 - RNA, 20 nt, Human
aacuccuagccucaagugau

SEQ ID NO: 610253 - RNA, 22 nt, Human
uacuugcuguuaguauuuuaca

SEQ ID NO: 610254 - RNA, 22 nt, Human
gagggcugaaguguuuuaugag

SEQ ID NO: 610255 - RNA, 22 nt, Human
gcuggcuugauaguuucugcuu

SEQ ID NO: 610256 - RNA, 22 nt, Human
uuucacaauuuuaaggagcaaa

SEQ ID NO: 610257 - RNA, 22 nt, Human
ugagauggauuggguugguucc

SEQ ID NO: 610258 - RNA, 22 nt, Human
ugggaugggaucucgcuguguc

SEQ ID NO: 610259 - RNA, 23 nt, Human
ucccuguguacagccugcaugag

SEQ ID NO: 610260 - RNA, 22 nt, Human
cugggcagagcuaacaccugag

SEQ ID NO: 610261 - RNA, 17 nt, Human
ugguccagguggagcca

SEQ ID NO: 610262 - RNA, 22 nt, Human
uucagagcaucucuaaagccag

SEQ ID NO: 610263 - RNA, 22 nt, Human
agcuccccucguuucucuccau

SEQ ID NO: 610264 - RNA, 22 nt, Human
uuacagauggaucuagcaaaau

SEQ ID NO: 610265 - RNA, 22 nt, Human
acagcaggcacacaaggauaga

SEQ ID NO: 610266 - RNA, 22 nt, Human
ugagcugggaguggugaugagg

SEQ ID NO: 610267 - RNA, 22 nt, Human
cugugucccccucagccaggug

SEQ ID NO: 610268 - RNA, 22 nt, Human
cccagcucuaggagugguggca

SEQ ID NO: 610269 - RNA, 22 nt, Human
ucugccaggagccaugagcaag

SEQ ID NO: 610270 - RNA, 22 nt, Human
aggaaaguggugggaaaucagg

SEQ ID NO: 610271 - RNA, 20 nt, Human
agaagcaucauucugauguc

SEQ ID NO: 610272 - RNA, 22 nt, Human
uguguaaauuuauuuacauaaa

SEQ ID NO: 610273 - RNA, 18 nt, Human
gaggccugagaaccaggu

SEQ ID NO: 610274 - RNA, 22 nt, Human
uagcaaguguuggugaagaugu

SEQ ID NO: 610275 - RNA, 22 nt, Human
ggcuagaguggaacuggagcgg

SEQ ID NO: 610276 - RNA, 22 nt, Human
agcccaggagguggagguugca

SEQ ID NO: 610277 - RNA, 22 nt, Human
uuacagaauguucuuccaacag

SEQ ID NO: 610278 - RNA, 22 nt, Human
auguuuuauuaccaacuuguac

SEQ ID NO: 610279 - RNA, 22 nt, Human
acagagguuuccauugagguuu

SEQ ID NO: 610280 - RNA, 23 nt, Human
augugcaaagugcuacaguauag

SEQ ID NO: 610281 - RNA, 22 nt, Human
gugggaagagccaauuggggua

SEQ ID NO: 610282 - RNA, 21 nt, Human
ucucuccucaagcucgacccc

SEQ ID NO: 610283 - RNA, 22 nt, Human
cuggagggaguuaggacccgga

SEQ ID NO: 610284 - RNA, 20 nt, Human
cagagcuguuauggaugaug

SEQ ID NO: 610285 - RNA, 22 nt, Human
ucugccugccagucugguccuc

SEQ ID NO: 610286 - RNA, 22 nt, Human
augcugggaaacugaaaggaau

SEQ ID NO: 610287 - RNA, 22 nt, Human
cuuagcuuuuccagcuucuaga

SEQ ID NO: 610288 - RNA, 22 nt, Human
aaaguuugaaugauauauuagu

SEQ ID NO: 610289 - RNA, 22 nt, Human
aagccaggcugcacuugcuggg

SEQ ID NO: 610290 - RNA, 22 nt, Human
ucucucagucagaugcuaaaga

SEQ ID NO: 610291 - RNA, 22 nt, Human
gcaugggcuuucucagaguucu

SEQ ID NO: 610292 - RNA, 23 nt, Human
ugggccaguucuguugaaagcca

SEQ ID NO: 610293 - RNA, 22 nt, Human
aagaagagaaaugugcugcugg

SEQ ID NO: 610294 - RNA, 16 nt, Human
uggggauggggaagag

SEQ ID NO: 610295 - RNA, 22 nt, Human
ugcaucuguaguggaaaccuua

SEQ ID NO: 610296 - RNA, 22 nt, Human
cagggauggagagacuacuggc

SEQ ID NO: 610297 - RNA, 22 nt, Human
guugugcaaacacuggggucug

SEQ ID NO: 610298 - RNA, 22 nt, Human
ugaggccaagccuccucugcca

SEQ ID NO: 610299 - RNA, 19 nt, Human
ucaguggaugaacauguuu

SEQ ID NO: 610300 - RNA, 22 nt, Human
ucucuagacauggggaauguca

SEQ ID NO: 610301 - RNA, 22 nt, Human
ggucccugcugaagccuuggug

SEQ ID NO: 610302 - RNA, 22 nt, Human
gaaaaagugaccuugguagcua

SEQ ID NO: 610303 - RNA, 22 nt, Human
aggccuccagccacaugccagu

SEQ ID NO: 610304 - RNA, 22 nt, Human
acaaauucuacaaucauaugau

SEQ ID NO: 610305 - RNA, 22 nt, Human
uuuaugacaagcauuacugauu

SEQ ID NO: 610306 - RNA, 22 nt, Human
agguacauaggaaaguggagcu

SEQ ID NO: 610307 - RNA, 22 nt, Human
auccugggcugcacccucagcc

SEQ ID NO: 610308 - RNA, 22 nt, Human
aucuauuaugcugagaaacugu

SEQ ID NO: 610309 - RNA, 21 nt, Human
cggaaaggacuagggcucaga

SEQ ID NO: 610310 - RNA, 22 nt, Human
cuggccaggcggccccugcaug

SEQ ID NO: 610311 - RNA, 22 nt, Human
uauucacauucucaggccuggu

SEQ ID NO: 610312 - RNA, 22 nt, Human
augcauuuauguguguacauug

SEQ ID NO: 610313 - RNA, 21 nt, Human
aauggcugggcaaggucucuc

SEQ ID NO: 610314 - RNA, 22 nt, Human
cugaaggagguagagugacaua

SEQ ID NO: 610315 - RNA, 22 nt, Human
uccugaacauuaugcaagcuuc

SEQ ID NO: 610316 - RNA, 22 nt, Human
agcugucuggaaguuccucaug

SEQ ID NO: 610317 - RNA, 22 nt, Human
cagcugaggucaaagaagcagg

SEQ ID NO: 610318 - RNA, 22 nt, Human
acacaauacagggcucaaaaua

SEQ ID NO: 610319 - RNA, 22 nt, Human
cccaguggaaggaguagaagac

SEQ ID NO: 610320 - RNA, 22 nt, Human
acccagccuacaaagcucaccu

SEQ ID NO: 610321 - RNA, 22 nt, Human
cugggccuuugcuuauuaauuu

SEQ ID NO: 610322 - RNA, 22 nt, Human
uccaggaggaggaaggcugcca

SEQ ID NO: 610323 - RNA, 22 nt, Human
acugagguuuacuugaaggaga

SEQ ID NO: 610324 - RNA, 23 nt, Human
uccuccugacacagccugaguga

SEQ ID NO: 610325 - RNA, 21 nt, Human
gaugguagccucauagaagua

SEQ ID NO: 610326 - RNA, 22 nt, Human
aaggcuggguuugggaugugau

SEQ ID NO: 610327 - RNA, 23 nt, Human
auucuucauuaucuucuagaaaa

SEQ ID NO: 610328 - RNA, 22 nt, Human
gggagggguugcauguuugagu

SEQ ID NO: 610329 - RNA, 22 nt, Human
auuugcuucuugcuuccagcac

SEQ ID NO: 610330 - RNA, 22 nt, Human
ggccaaaagcauaauccucaca

SEQ ID NO: 610331 - RNA, 19 nt, Human
gagcugagaguagcacugg

SEQ ID NO: 610332 - RNA, 22 nt, Human
caguuucuucaucaguuaagca

SEQ ID NO: 610333 - RNA, 22 nt, Human
cugggaagcauggugaugguau

SEQ ID NO: 610334 - RNA, 22 nt, Human
cuucuuucaagaauggauuagg

SEQ ID NO: 610335 - RNA, 22 nt, Human
agcucccagggcugggcaaguu

SEQ ID NO: 610336 - RNA, 22 nt, Human
agagccuggggauuggcaaggg

SEQ ID NO: 610337 - RNA, 22 nt, Human
ugaagcauaagaggguucuuuu

SEQ ID NO: 610338 - RNA, 22 nt, Human
acuuuccuagacuucagugaca

SEQ ID NO: 610339 - RNA, 18 nt, Human
acccaguuugaaggaaag

SEQ ID NO: 610340 - RNA, 22 nt, Human
auuagcauaaguguucggugca

SEQ ID NO: 610341 - RNA, 20 nt, Human
cguguguggcuauuuugggu

SEQ ID NO: 610342 - RNA, 22 nt, Human
ugcuucagugugucauuauuua

SEQ ID NO: 610343 - RNA, 22 nt, Human
uauugaaaugaaugacagugau

SEQ ID NO: 610344 - RNA, 22 nt, Human
ugccugcucuugagacuuacaa

SEQ ID NO: 610345 - RNA, 22 nt, Human
ucucugucucccguguguccgg

SEQ ID NO: 610346 - RNA, 22 nt, Human
guggccaaggcagagaaagagc

SEQ ID NO: 610347 - RNA, 22 nt, Human
cccgcaggggcagcccucaucc

SEQ ID NO: 610348 - RNA, 22 nt, Human
acaaauuauagaaaauugagcu

SEQ ID NO: 610349 - RNA, 22 nt, Human
acaucuauuuuuuucuguccau

SEQ ID NO: 610350 - RNA, 22 nt, Human
aggaggccucuauccagagaga

SEQ ID NO: 610351 - RNA, 22 nt, Human
cuaaggaaaggaaauacaguaa

SEQ ID NO: 610352 - RNA, 22 nt, Human
uuuguuuugaacuagcucagaa

SEQ ID NO: 610353 - RNA, 22 nt, Human
cuuuuuguguaugcuacaguug

SEQ ID NO: 610354 - RNA, 22 nt, Human
agagauggcgucucagagccug

SEQ ID NO: 610355 - RNA, 22 nt, Human
gcugggcugcccaaccucugac

SEQ ID NO: 610356 - RNA, 22 nt, Human
auagggaggaacugagucagga

SEQ ID NO: 610357 - RNA, 22 nt, Human
caaacauugcuaccagagguuu

SEQ ID NO: 610358 - RNA, 22 nt, Human
guccuucaucuggagccugguc

SEQ ID NO: 610359 - RNA, 22 nt, Human
gggccacaggccuugcccgcag

SEQ ID NO: 610360 - RNA, 22 nt, Human
gguguccucaugauuuucuaga

SEQ ID NO: 610361 - RNA, 22 nt, Human
cuucugggauuaauuuuuccug

SEQ ID NO: 610362 - RNA, 22 nt, Human
aguccuggacuuggagucaggg

SEQ ID NO: 610363 - RNA, 22 nt, Human
auugcuaggaacagguugcacc

SEQ ID NO: 610364 - RNA, 22 nt, Human
uguccucuuccagugcuccuuc

SEQ ID NO: 610365 - RNA, 22 nt, Human
ccccaccugugcgucugccgca

SEQ ID NO: 610366 - RNA, 22 nt, Human
cuuuacagccuccagaaggaac

SEQ ID NO: 610367 - RNA, 22 nt, Human
agaguuagguccagaauguugc

SEQ ID NO: 610368 - RNA, 22 nt, Human
caccagcuugcagucuuaaccc

SEQ ID NO: 610369 - RNA, 22 nt, Human
uugugaauagugccgcaauaaa

SEQ ID NO: 610370 - RNA, 22 nt, Human
agugaaauagcauuuaugaagc

SEQ ID NO: 610371 - RNA, 22 nt, Human
uccugaggcucacuuugaaugu

SEQ ID NO: 610372 - RNA, 22 nt, Human
uggcagguagaguucugagaug

SEQ ID NO: 610373 - RNA, 22 nt, Human
cccaggcuccuagaggcccaga

SEQ ID NO: 610374 - RNA, 22 nt, Human
aguaauaauagcuguaaagugc

SEQ ID NO: 610375 - RNA, 22 nt, Human
agaaaagaggcuuucuaagcau

SEQ ID NO: 610376 - RNA, 20 nt, Human
ucuuggaaaaaguucagaau

SEQ ID NO: 610377 - RNA, 22 nt, Human
cugauaugaugggugauuuuca

SEQ ID NO: 610378 - RNA, 22 nt, Human
ggagcagccacgucucagggca

SEQ ID NO: 610379 - RNA, 22 nt, Human
caucuuuaacaauuuacaaugu

SEQ ID NO: 610380 - RNA, 22 nt, Human
ucugauuccagugacccuagga

SEQ ID NO: 610381 - RNA, 22 nt, Human
gugacauguuauggacuggcua

SEQ ID NO: 610382 - RNA, 22 nt, Human
uggagucaugauggcugcugau

SEQ ID NO: 610383 - RNA, 22 nt, Human
acaggagggacaccuuccugcu

SEQ ID NO: 610384 - RNA, 22 nt, Human
auguuuucuuucagacuucccu

SEQ ID NO: 610385 - RNA, 23 nt, Human
cugugugugccgaggguggccac

SEQ ID NO: 610386 - RNA, 22 nt, Human
gggcuggaggagauccagaggc

SEQ ID NO: 610387 - RNA, 22 nt, Human
uuucauuuugguuaugccauaa

SEQ ID NO: 610388 - RNA, 22 nt, Human
aggccaagggcaaagcggagag

SEQ ID NO: 610389 - RNA, 22 nt, Human
cuucugugcuucacaguugcca

SEQ ID NO: 610390 - RNA, 22 nt, Human
uccuccaagcagaggcccugaa

SEQ ID NO: 610391 - RNA, 22 nt, Human
uggccucugaggcaccuuugcc

SEQ ID NO: 610392 - RNA, 22 nt, Human
uuucucucuuaaggaguuuaaa

SEQ ID NO: 610393 - RNA, 23 nt, Human
cucuggguccgauguccugacag

SEQ ID NO: 610394 - RNA, 22 nt, Human
uuaacaugucuugacuucaucu

SEQ ID NO: 610395 - RNA, 22 nt, Human
uuugacagaguugugaggauuu

SEQ ID NO: 610396 - RNA, 22 nt, Human
cugagagccuccuguuggcuag

SEQ ID NO: 610397 - RNA, 22 nt, Human
ggcugagccaugggcacugcag

SEQ ID NO: 610398 - RNA, 22 nt, Human
gcagggacgccagggacagcaa

SEQ ID NO: 610399 - RNA, 22 nt, Human
agcgagggaggucugaggacag

SEQ ID NO: 610400 - RNA, 22 nt, Human
guuauaaauaccuaauaggauu

SEQ ID NO: 610401 - RNA, 20 nt, Human
aaguugcagagaguugucuu

SEQ ID NO: 610402 - RNA, 21 nt, Human
ucuuauacagcaauagaucug

SEQ ID NO: 610403 - RNA, 17 nt, Human
caggugaccuggugaug

SEQ ID NO: 610404 - RNA, 22 nt, Human
cauucaaaagcuccauguuugu

SEQ ID NO: 610405 - RNA, 22 nt, Human
uggugcaggccaagcugcgagc

SEQ ID NO: 610406 - RNA, 22 nt, Human
cagcuuugccaaguaaggucuu

SEQ ID NO: 610407 - RNA, 22 nt, Human
aagaacaugaagucacaaaugc

SEQ ID NO: 610408 - RNA, 22 nt, Human
uaugauauucuaaauugacacc

SEQ ID NO: 610409 - RNA, 22 nt, Human
ccacaaguuucagcacccagag

SEQ ID NO: 610410 - RNA, 22 nt, Human
uagaaucauaccucuaggaaca

SEQ ID NO: 610411 - RNA, 16 nt, Human
uggagguguuucuagu

SEQ ID NO: 610412 - RNA, 22 nt, Human
ugggugguccaggcucagcaga

SEQ ID NO: 610413 - RNA, 22 nt, Human
auucuaauggcagagacuccug

SEQ ID NO: 610414 - RNA, 22 nt, Human
ucauuccuuaacauucauuugc

SEQ ID NO: 610415 - RNA, 18 nt, Human
uggagcagguaggcauga

SEQ ID NO: 610416 - RNA, 20 nt, Human
ccugucuggagacaaagaga

SEQ ID NO: 610417 - RNA, 22 nt, Human
cugcccuggcagccuaccaugg

SEQ ID NO: 610418 - RNA, 22 nt, Human
gagggccagcagccucagcaug

SEQ ID NO: 610419 - RNA, 22 nt, Human
agggcagagggugccucaccug

SEQ ID NO: 610420 - RNA, 22 nt, Human
uuuacaguccccaggugaggau

SEQ ID NO: 610421 - RNA, 22 nt, Human
accaggcugugaagugagacua

SEQ ID NO: 610422 - RNA, 20 nt, Human
ugggccugagccugugggcu

SEQ ID NO: 610423 - RNA, 22 nt, Human
aaucacaugugggucuuguagc

SEQ ID NO: 610424 - RNA, 22 nt, Human
cagugguauuugagagaaugga

SEQ ID NO: 610425 - RNA, 22 nt, Human
guccacagcuggccagggccuc

SEQ ID NO: 610426 - RNA, 22 nt, Human
cugcugaaaacaauaaugauga

SEQ ID NO: 610427 - RNA, 22 nt, Human
acauuuguaugcguuuuuacug

SEQ ID NO: 610428 - RNA, 22 nt, Human
gcuguacaaggccucugccauc

SEQ ID NO: 610429 - RNA, 22 nt, Human
gaaggagggugcggaucugagc

SEQ ID NO: 610430 - RNA, 22 nt, Human
acacagcuagugaguggcagag

SEQ ID NO: 610431 - RNA, 22 nt, Human
uccucuggggcgugguccugga

SEQ ID NO: 610432 - RNA, 22 nt, Human
uccucacagggcaggaaggagg

SEQ ID NO: 610433 - RNA, 21 nt, Human
caauggcgagaucuuggcuca

SEQ ID NO: 610434 - RNA, 22 nt, Human
uccagccuuucuacucacugag

SEQ ID NO: 610435 - RNA, 21 nt, Human
gcacccagccgguucucccag

SEQ ID NO: 610436 - RNA, 22 nt, Human
auuuccauguccaaaaauuagu

SEQ ID NO: 610437 - RNA, 22 nt, Human
aaaaguauggugguccuuuuua

SEQ ID NO: 610438 - RNA, 22 nt, Human
agcccagcugcuauguaccugg

SEQ ID NO: 610439 - RNA, 22 nt, Human
auacuuaaugucaguuugaugu

SEQ ID NO: 610440 - RNA, 22 nt, Human
uaaugucuuuaagagcauuggg

SEQ ID NO: 610441 - RNA, 22 nt, Human
agcagggcuucugugccugugc

SEQ ID NO: 610442 - RNA, 22 nt, Human
ccagagccagagaggugccugc

SEQ ID NO: 610443 - RNA, 22 nt, Human
auuccacagccgauaccaugac

SEQ ID NO: 610444 - RNA, 22 nt, Human
uaaggaggugcccacucucagg

SEQ ID NO: 610445 - RNA, 22 nt, Human
uuucucaacuguauuaugcaga

SEQ ID NO: 610446 - RNA, 21 nt, Human
aaagcaguucuuccugccucu

SEQ ID NO: 610447 - RNA, 22 nt, Human
gccuacuuaguagcugggauua

SEQ ID NO: 610448 - RNA, 22 nt, Human
ggccugugggaggacagcuggg

SEQ ID NO: 610449 - RNA, 22 nt, Human
uuucaaagucaauaucauuacc

SEQ ID NO: 610450 - RNA, 22 nt, Human
caaagccucugauuucacuugu

SEQ ID NO: 610451 - RNA, 22 nt, Human
agauguggaacacuagacugcu

SEQ ID NO: 610452 - RNA, 22 nt, Human
uugucuuuggaaauuuaauguu

SEQ ID NO: 610453 - RNA, 22 nt, Human
ucugagaaaguacuguauguuc

SEQ ID NO: 610454 - RNA, 22 nt, Human
ugcagcugcuugauucaucuug

SEQ ID NO: 610455 - RNA, 22 nt, Human
ccagcucuguaagcugugaaau

SEQ ID NO: 610456 - RNA, 22 nt, Human
gucuccugagccuugacugcaa

SEQ ID NO: 610457 - RNA, 22 nt, Human
cagcagcccacgcgugcugucc

SEQ ID NO: 610458 - RNA, 22 nt, Human
uaaggccaccguuauagaacca

SEQ ID NO: 610459 - RNA, 22 nt, Human
uguccucaaggagcuucagucu

SEQ ID NO: 610460 - RNA, 22 nt, Human
guaagacauagauuucucauga

SEQ ID NO: 610461 - RNA, 22 nt, Human
cuguccugcccacccugcaggg

SEQ ID NO: 610462 - RNA, 22 nt, Human
uggucaguugcaucagagaagu

SEQ ID NO: 610463 - RNA, 20 nt, Human
aguguacagacacuagaaau

SEQ ID NO: 610464 - RNA, 22 nt, Human
cccaggcacauccacucuguga

SEQ ID NO: 610465 - RNA, 22 nt, Human
ucucuggcagggauaucuggcu

SEQ ID NO: 610466 - RNA, 22 nt, Human
uagcagcccaguuucuggccaa

SEQ ID NO: 610467 - RNA, 22 nt, Human
cagccacuguggaauagccccc

SEQ ID NO: 610468 - RNA, 22 nt, Human
gaggcuggagauauuccaaucu

SEQ ID NO: 610469 - RNA, 22 nt, Human
auuucuagacuuagaacucuua

SEQ ID NO: 610470 - RNA, 22 nt, Human
gacagugugaacaucuaauagu

SEQ ID NO: 610471 - RNA, 22 nt, Human
cuguuuccugucuucucacuau

SEQ ID NO: 610472 - RNA, 22 nt, Human
guggcucaucuuugggaaguaa

SEQ ID NO: 610473 - RNA, 22 nt, Human
uggugcugccaccuccucugcu

SEQ ID NO: 610474 - RNA, 22 nt, Human
uccuuuaucaaggagccuuaga

SEQ ID NO: 610475 - RNA, 22 nt, Human
ucaguguuggagauaauugcac

SEQ ID NO: 610476 - RNA, 22 nt, Human
ccugcagcuuugccuccugaac

SEQ ID NO: 610477 - RNA, 22 nt, Human
ugagguaggaggauugauugag

SEQ ID NO: 610478 - RNA, 22 nt, Human
ccagcagaagcucccgcugggu

SEQ ID NO: 610479 - RNA, 22 nt, Human
caagguuuacuuuaugauccag

SEQ ID NO: 610480 - RNA, 22 nt, Human
ugaagccaaucugccaggcaga

SEQ ID NO: 610481 - RNA, 22 nt, Human
gaacacaguacuuuuccugaug

SEQ ID NO: 610482 - RNA, 22 nt, Human
aaaaguaauugugguuuuggcc

SEQ ID NO: 610483 - RNA, 22 nt, Human
ccagcccugccucucagggccc

SEQ ID NO: 610484 - RNA, 18 nt, Human
agcagagagugaauggga

SEQ ID NO: 610485 - RNA, 22 nt, Human
aggaaagaaaggaggugcauuu

SEQ ID NO: 610486 - RNA, 22 nt, Human
cagacaggagacuggaucaugg

SEQ ID NO: 610487 - RNA, 22 nt, Human
ugccucagucagcuucccuggg

SEQ ID NO: 610488 - RNA, 22 nt, Human
auucugcauaauuuccuggcag

SEQ ID NO: 610489 - RNA, 23 nt, Human
auaacugagccgaggcuuaagaa

SEQ ID NO: 610490 - RNA, 19 nt, Human
uccaggcuccauuggcaga

SEQ ID NO: 610491 - RNA, 18 nt, Human
ucucugaauauuuuaugu

SEQ ID NO: 610492 - RNA, 23 nt, Human
aacuuuacuauuuugaauaaugc

SEQ ID NO: 610493 - RNA, 22 nt, Human
uccaggcuagaagucacaggcc

SEQ ID NO: 610494 - RNA, 22 nt, Human
uaaugacuguaccaaggcuuca

SEQ ID NO: 610495 - RNA, 22 nt, Human
aaugucucuauaucucauaaga

SEQ ID NO: 610496 - RNA, 22 nt, Human
ggacugggaaucagggagaugc

SEQ ID NO: 610497 - RNA, 20 nt, Human
cuguagggugcagcaggcuc

SEQ ID NO: 610498 - RNA, 22 nt, Human
uggaagacaguugaugggaguu

SEQ ID NO: 610499 - RNA, 22 nt, Human
acuucaugcagaagagagcugu

SEQ ID NO: 610500 - RNA, 22 nt, Human
aacacauauuuauauaugcaca

SEQ ID NO: 610501 - RNA, 22 nt, Human
cauaacauguacauauaaaugc

SEQ ID NO: 610502 - RNA, 22 nt, Human
ugcuucugaguugcaggacuug

SEQ ID NO: 610503 - RNA, 22 nt, Human
aggcuggugcuuccuagggcag

SEQ ID NO: 610504 - RNA, 22 nt, Human
cugcccaccccgaggcaggaag

SEQ ID NO: 610505 - RNA, 21 nt, Human
gcagaggaaugguauacauaa

SEQ ID NO: 610506 - RNA, 22 nt, Human
acugccugccuuccagguacug

SEQ ID NO: 610507 - RNA, 22 nt, Human
acuggaguauuguuuaauacca

SEQ ID NO: 610508 - RNA, 19 nt, Human
gugcugagaugugguacua

SEQ ID NO: 610509 - RNA, 22 nt, Human
gugaagacuuggagaaguuaag

SEQ ID NO: 610510 - RNA, 22 nt, Human
caggacagaaauaaggaauaua

SEQ ID NO: 610511 - RNA, 22 nt, Human
uuuuuuccagcuucuagaggcc

SEQ ID NO: 610512 - RNA, 22 nt, Human
aaaggaggaauggagagaugcu

SEQ ID NO: 610513 - RNA, 22 nt, Human
cugugggaacacugaggacuuc

SEQ ID NO: 610514 - RNA, 22 nt, Human
ucuucaguugucauacugccuu

SEQ ID NO: 610515 - RNA, 22 nt, Human
uucaaacagaugacucugcucu

SEQ ID NO: 610516 - RNA, 22 nt, Human
gcacagcaugaagagaggaagc

SEQ ID NO: 610517 - RNA, 22 nt, Human
cccagagaaccuucugugccac

SEQ ID NO: 610518 - RNA, 22 nt, Human
gaugcuuacauagcccaagugu

SEQ ID NO: 610519 - RNA, 22 nt, Human
auauaaaguguuuagaaagcug

SEQ ID NO: 610520 - RNA, 22 nt, Human
uucuugaaaauagccauguaca

SEQ ID NO: 610521 - RNA, 22 nt, Human
ucaguguuucaguuuggaaaug

SEQ ID NO: 610522 - RNA, 22 nt, Human
uaaacauggcuguuucaguuau

SEQ ID NO: 610523 - RNA, 22 nt, Human
ucuccuggauagauacuaucca

SEQ ID NO: 610524 - RNA, 22 nt, Human
aacacauuuugccuaggcaaua

SEQ ID NO: 610525 - RNA, 22 nt, Human
agcagcuguggggacaagggua

SEQ ID NO: 610526 - RNA, 22 nt, Human
gguggggcccuggcacugguau

SEQ ID NO: 610527 - RNA, 17 nt, Human
ggccuuggggccucagu

SEQ ID NO: 610528 - RNA, 22 nt, Human
aggggagccgaggggcaucugu

SEQ ID NO: 610529 - RNA, 22 nt, Human
acuguaauuaucugaacgugca

SEQ ID NO: 610530 - RNA, 19 nt, Human
uagcuucacguggucuaga

SEQ ID NO: 610531 - RNA, 22 nt, Human
acaguguccuuguggucccugu

SEQ ID NO: 610532 - RNA, 22 nt, Human
ggcgggagcagcagcucugagc

SEQ ID NO: 610533 - RNA, 22 nt, Human
uuucuacagguugauggguuug

SEQ ID NO: 610534 - RNA, 22 nt, Human
uggcugagcucccuguguguug

SEQ ID NO: 610535 - RNA, 22 nt, Human
aaacuuuuuauucuaaugucua

SEQ ID NO: 610536 - RNA, 22 nt, Human
caaaguauauuggauugaaugg

SEQ ID NO: 610537 - RNA, 22 nt, Human
aaucauugagacaaauuagcuu

SEQ ID NO: 610538 - RNA, 22 nt, Human
aggagcugggcccaaggaugcu

SEQ ID NO: 610539 - RNA, 22 nt, Human
agauacuaaaaggggaagcucc

SEQ ID NO: 610540 - RNA, 22 nt, Human
caggauugcagauuugauuaga

SEQ ID NO: 610541 - RNA, 22 nt, Human
agaagcagaaaagggcacuuuu

SEQ ID NO: 610542 - RNA, 22 nt, Human
guguggaaagaguggccucuca

SEQ ID NO: 610543 - RNA, 22 nt, Human
gggcaggugugcagagcuguug

SEQ ID NO: 610544 - RNA, 22 nt, Human
ccaggacccugcaaacccuguu

SEQ ID NO: 610545 - RNA, 22 nt, Human
ucuuuaaucauaaccaagaugg

SEQ ID NO: 610546 - RNA, 22 nt, Human
cuccagcugcuggucugagacu

SEQ ID NO: 610547 - RNA, 22 nt, Human
uugcucugaacccagggcacca

SEQ ID NO: 610548 - RNA, 22 nt, Human
uucuuuaucaguuacucauagg

SEQ ID NO: 610549 - RNA, 23 nt, Human
uccagagcucaugcucucaacca

SEQ ID NO: 610550 - RNA, 21 nt, Human
gcagcaguguucuagaauacu

SEQ ID NO: 610551 - RNA, 22 nt, Human
cuggggucagggaucagagagc

SEQ ID NO: 610552 - RNA, 23 nt, Human
aggcccaacucugugagggcugc

SEQ ID NO: 610553 - RNA, 22 nt, Human
uuguauuucgaugcacguguag

SEQ ID NO: 610554 - RNA, 22 nt, Human
ggcacugggaaugcagugauga

SEQ ID NO: 610555 - RNA, 22 nt, Human
gcaagauguuaacauagggaga

SEQ ID NO: 610556 - RNA, 22 nt, Human
cagcauggagacaaagugggca

SEQ ID NO: 610557 - RNA, 22 nt, Human
aucugaaaagcuuuaaugagcu

SEQ ID NO: 610558 - RNA, 22 nt, Human
auaaugcagcuuuucaauggcc

SEQ ID NO: 610559 - RNA, 22 nt, Human
agcacugggaacgcauggggcc

SEQ ID NO: 610560 - RNA, 22 nt, Human
cagcugagcucccaggccauca

SEQ ID NO: 610561 - RNA, 22 nt, Human
cucugggugugacagcaccugg

SEQ ID NO: 610562 - RNA, 22 nt, Human
caacugaacugauaucaacuau

SEQ ID NO: 610563 - RNA, 22 nt, Human
acucaguacaucuggaguuggc

SEQ ID NO: 610564 - RNA, 22 nt, Human
uuaaagcaguuuguauacaugg

SEQ ID NO: 610565 - RNA, 22 nt, Human
ugccgcugucgccaccauggcu

SEQ ID NO: 610566 - RNA, 22 nt, Human
ucagcagguggugggcagguga

SEQ ID NO: 610567 - RNA, 17 nt, Human
agaaaagagaccagcag

SEQ ID NO: 610568 - RNA, 22 nt, Human
gcucucuggaagguaucauuau

SEQ ID NO: 610569 - RNA, 22 nt, Human
uggagcuggaagaauguagacg

SEQ ID NO: 610570 - RNA, 22 nt, Human
auacauuagugaacaaaagaga

SEQ ID NO: 610571 - RNA, 22 nt, Human
uucuaguugagggagacaaaua

SEQ ID NO: 610572 - RNA, 22 nt, Human
aaacagcuaauggccaggaaua

SEQ ID NO: 610573 - RNA, 22 nt, Human
cccaggcugaguuagagguguc

SEQ ID NO: 610574 - RNA, 22 nt, Human
agcaccuccuuagcuaugacca

SEQ ID NO: 610575 - RNA, 22 nt, Human
cagggugccucccgcucgccgg

SEQ ID NO: 610576 - RNA, 22 nt, Human
agcacaggcuuuggugugaggg

SEQ ID NO: 610577 - RNA, 22 nt, Human
acaugauucuugauaggcauug

SEQ ID NO: 610578 - RNA, 22 nt, Human
agugguggagccaggaaaugug

SEQ ID NO: 610579 - RNA, 22 nt, Human
augaggucuuauugcaguaguu

SEQ ID NO: 610580 - RNA, 22 nt, Human
acucugaauuaauugcucucaa

SEQ ID NO: 610581 - RNA, 22 nt, Human
cucccuucaggagaggcucaca

SEQ ID NO: 610582 - RNA, 22 nt, Human
ucucugcccauccucaguccac

SEQ ID NO: 610583 - RNA, 22 nt, Human
aguccagaccccggcagcuggu

SEQ ID NO: 610584 - RNA, 22 nt, Human
aaaugcagaaugauuucaucua

SEQ ID NO: 610585 - RNA, 22 nt, Human
acucauuugacacuuuaaacug

SEQ ID NO: 610586 - RNA, 20 nt, Human
agcuucugcugccuuucggc

SEQ ID NO: 610587 - RNA, 22 nt, Human
uggagcugagcaccuccagggc

SEQ ID NO: 610588 - RNA, 22 nt, Human
gggcugagugucccaggccgaa

SEQ ID NO: 610589 - RNA, 22 nt, Human
uguggccagcagguggcugugu

SEQ ID NO: 610590 - RNA, 22 nt, Human
aaaaucuugacuguuuuuagaa

SEQ ID NO: 610591 - RNA, 22 nt, Human
uggcccagggcacagcagggag

SEQ ID NO: 610592 - RNA, 22 nt, Human
gugccugugccaggggugugcu

SEQ ID NO: 610593 - RNA, 22 nt, Human
ggcaugcuugccaugggccagu

SEQ ID NO: 610594 - RNA, 22 nt, Human
ucucucacuggugccucuguug

SEQ ID NO: 610595 - RNA, 22 nt, Human
cugagcacugggcacauagcug

SEQ ID NO: 610596 - RNA, 22 nt, Human
aaccacagacccagacuagaga

SEQ ID NO: 610597 - RNA, 22 nt, Human
uggcccagucagcaggagaggg

SEQ ID NO: 610598 - RNA, 22 nt, Human
gcaagcuggcuguuagaggaug

SEQ ID NO: 610599 - RNA, 22 nt, Human
acuccagggcugaacgaggccc

SEQ ID NO: 610600 - RNA, 22 nt, Human
cugaggccucacuguagucccu

SEQ ID NO: 610601 - RNA, 22 nt, Human
ggacagggaucauuaucugagc

SEQ ID NO: 610602 - RNA, 22 nt, Human
uguccucuccaacagccucugu

SEQ ID NO: 610603 - RNA, 22 nt, Human
uggacacacauguaugucagag

SEQ ID NO: 610604 - RNA, 22 nt, Human
ugggccuggguuccuccugggc

SEQ ID NO: 610605 - RNA, 22 nt, Human
gccugcugaaccucaugcaguc

SEQ ID NO: 610606 - RNA, 22 nt, Human
gcuuucuguggugauguaaagg

SEQ ID NO: 610607 - RNA, 22 nt, Human
agggucugacugaauggaaaag

SEQ ID NO: 610608 - RNA, 22 nt, Human
gaacuugagauaugaguaggua

SEQ ID NO: 610609 - RNA, 22 nt, Human
cucauuuauguaaugauuaagg

SEQ ID NO: 610610 - RNA, 22 nt, Human
ggcuccagauguccccuggcaa

SEQ ID NO: 610611 - RNA, 22 nt, Human
gcccacagaggcaccaccaggc

SEQ ID NO: 610612 - RNA, 22 nt, Human
aggaaaacacaguauugaugga

SEQ ID NO: 610613 - RNA, 22 nt, Human
gcuggccauagaagccaaagag

SEQ ID NO: 610614 - RNA, 22 nt, Human
uugcagacccuuacugcuagag

SEQ ID NO: 610615 - RNA, 22 nt, Human
ugccaggccaauucuauuugac

SEQ ID NO: 610616 - RNA, 22 nt, Human
caugggcucucugagcuccagg

SEQ ID NO: 610617 - RNA, 22 nt, Human
aguuaagaaggucaacgaggga

SEQ ID NO: 610618 - RNA, 22 nt, Human
ugaggccugaagccugaaguga

SEQ ID NO: 610619 - RNA, 22 nt, Human
uugacaaaguuuaguaauaauc

SEQ ID NO: 610620 - RNA, 22 nt, Human
caaagauaugacauggaaaaug

SEQ ID NO: 610621 - RNA, 22 nt, Human
ucaggcaggacaauuauuuagg

SEQ ID NO: 610622 - RNA, 22 nt, Human
aaacucagauguggugaagacc

SEQ ID NO: 610623 - RNA, 18 nt, Human
cugugggaagaguuuggg

SEQ ID NO: 610624 - RNA, 22 nt, Human
aggcugggaaaccugaaguugu

SEQ ID NO: 610625 - RNA, 22 nt, Human
aauccugaggcaaagagaugag

SEQ ID NO: 610626 - RNA, 22 nt, Human
caguggguccuaaguacaguuc

SEQ ID NO: 610627 - RNA, 22 nt, Human
gaggaacagcagccacaugucc

SEQ ID NO: 610628 - RNA, 22 nt, Human
caaaaacugcaauuacuuuuac

SEQ ID NO: 610629 - RNA, 22 nt, Human
ggaguggugucacugagaggaa

SEQ ID NO: 610630 - RNA, 22 nt, Human
aagcagaugggacuccaaggca

SEQ ID NO: 610631 - RNA, 22 nt, Human
agucaccaucuguggcagccug

SEQ ID NO: 610632 - RNA, 22 nt, Human
gccugggagauuaauuaggaag

SEQ ID NO: 610633 - RNA, 22 nt, Human
cagugggggugaggccgaggua

SEQ ID NO: 610634 - RNA, 22 nt, Human
ucuauuagauuauucucaagga

SEQ ID NO: 610635 - RNA, 22 nt, Human
gggucgggcaggcgcccucguc

SEQ ID NO: 610636 - RNA, 22 nt, Human
ccaggccucccuuuuccagcca

SEQ ID NO: 610637 - RNA, 22 nt, Human
aucagucuguguuagaaaagag

SEQ ID NO: 610638 - RNA, 22 nt, Human
auucuuuccagacacugauugc

SEQ ID NO: 610639 - RNA, 22 nt, Human
ggccagagucuauaugcagaca

SEQ ID NO: 610640 - RNA, 20 nt, Human
ugcugcuuugccacuaguug

SEQ ID NO: 610641 - RNA, 18 nt, Human
guacacaaagucaaagua

SEQ ID NO: 610642 - RNA, 20 nt, Human
uaggcagagcugugcagccu

SEQ ID NO: 610643 - RNA, 18 nt, Human
gaauacugagagcacaaa

SEQ ID NO: 610644 - RNA, 22 nt, Human
gccuccagcuggggcauuucag

SEQ ID NO: 610645 - RNA, 22 nt, Human
gccugcagaggugcugcuagcu

SEQ ID NO: 610646 - RNA, 22 nt, Human
aagaacaguugggaggugagcc

SEQ ID NO: 610647 - RNA, 22 nt, Human
gcuggacaggccacauggagga

SEQ ID NO: 610648 - RNA, 22 nt, Human
cacaggaggcaaugguaagauu

SEQ ID NO: 610649 - RNA, 22 nt, Human
cagaggucaagaucugaaguga

SEQ ID NO: 610650 - RNA, 22 nt, Human
gauucacucauauuuuacguuu

SEQ ID NO: 610651 - RNA, 22 nt, Human
uccuggagagaggccuggaaga

SEQ ID NO: 610652 - RNA, 21 nt, Human
gaccacagggaaggucuugca

SEQ ID NO: 610653 - RNA, 22 nt, Human
ucagaggagaccaaggggaaua

SEQ ID NO: 610654 - RNA, 22 nt, Human
uagaacuuucagaaauuccaaa

SEQ ID NO: 610655 - RNA, 22 nt, Human
ugcaggagaaaguacggagcgu

SEQ ID NO: 610656 - RNA, 22 nt, Human
ucuucagcagggccucucugag

SEQ ID NO: 610657 - RNA, 22 nt, Human
aggcugaggcuggcagcuccag

SEQ ID NO: 610658 - RNA, 21 nt, Human
gggccacaccuucugcagacc

SEQ ID NO: 610659 - RNA, 22 nt, Human
uggcagggaguucguucacaac

SEQ ID NO: 610660 - RNA, 22 nt, Human
cccagcucgccgccgaugugcg

SEQ ID NO: 610661 - RNA, 18 nt, Human
agggagcaucugguugcc

SEQ ID NO: 610662 - RNA, 22 nt, Human
caaugguucucaaacuaucaug

SEQ ID NO: 610663 - RNA, 22 nt, Human
gcuguauuuaacaacuggcuca

SEQ ID NO: 610664 - RNA, 22 nt, Human
auacaaauccucugggauggua

SEQ ID NO: 610665 - RNA, 22 nt, Human
agugcagagagcaauacucuac

SEQ ID NO: 610666 - RNA, 22 nt, Human
cuggcuggucaugucaugagcc

SEQ ID NO: 610667 - RNA, 22 nt, Human
auacuuaacuguggagucauug

SEQ ID NO: 610668 - RNA, 22 nt, Human
aacaauaauugcgguucucuau

SEQ ID NO: 610669 - RNA, 18 nt, Human
aggcacuggaauuaaggg

SEQ ID NO: 610670 - RNA, 22 nt, Human
cuuugggcaaagggccaauucg

SEQ ID NO: 610671 - RNA, 22 nt, Human
aggcuguguggucaugguggcu

SEQ ID NO: 610672 - RNA, 22 nt, Human
ccuuuucuugccacugacucgg

SEQ ID NO: 610673 - RNA, 22 nt, Human
uaaagcaggccacauaugugau

SEQ ID NO: 610674 - RNA, 22 nt, Human
uuucuacaugucaauccaaacc

SEQ ID NO: 610675 - RNA, 22 nt, Human
ucagaggcuucugcucaccuca

SEQ ID NO: 610676 - RNA, 22 nt, Human
ucuccuugacaggcaggcagac

SEQ ID NO: 610677 - RNA, 22 nt, Human
ccacguccagcuaauuuucgua

SEQ ID NO: 610678 - RNA, 22 nt, Human
augugggagauuucaggaggug

SEQ ID NO: 610679 - RNA, 22 nt, Human
guaggcagugguuggaagagaa

SEQ ID NO: 610680 - RNA, 22 nt, Human
gaaugcuggcuuacaggcaguu

SEQ ID NO: 610681 - RNA, 18 nt, Human
cugccuguugcugagagg

SEQ ID NO: 610682 - RNA, 22 nt, Human
acuuuccuggcccuguccucug

SEQ ID NO: 610683 - RNA, 22 nt, Human
acuuuuuaguuuccucaaacau

SEQ ID NO: 610684 - RNA, 22 nt, Human
cugccaggcacgugcagcauca

SEQ ID NO: 610685 - RNA, 22 nt, Human
ccagcagaggggcggagugcag

SEQ ID NO: 610686 - RNA, 20 nt, Human
gcagcagacagacaggggac

SEQ ID NO: 610687 - RNA, 22 nt, Human
cacagaaguuucauagucucga

SEQ ID NO: 610688 - RNA, 22 nt, Human
uguggcagaaccagaauucaaa

SEQ ID NO: 610689 - RNA, 22 nt, Human
cacacaugaaucccuaguaccu

SEQ ID NO: 610690 - RNA, 22 nt, Human
acaauagacaaagugaauggcu

SEQ ID NO: 610691 - RNA, 22 nt, Human
ucagaggaaagggaacauaguc

SEQ ID NO: 610692 - RNA, 22 nt, Human
cagagagaauauguaguaugga

SEQ ID NO: 610693 - RNA, 22 nt, Human
aauggcuucugaagcacacuuu

SEQ ID NO: 610694 - RNA, 22 nt, Human
cuggagcugccagacgggcaca

SEQ ID NO: 610695 - RNA, 22 nt, Human
cacagcuucuccuugauaucgc

SEQ ID NO: 610696 - RNA, 22 nt, Human
acaagaaccaaagaaggauauu

SEQ ID NO: 610697 - RNA, 22 nt, Human
gggcuggggcucaauaauuugu

SEQ ID NO: 610698 - RNA, 22 nt, Human
cuagggucaggggccugcgucg

SEQ ID NO: 610699 - RNA, 22 nt, Human
cucugccaucuuggagcucaag

SEQ ID NO: 610700 - RNA, 22 nt, Human
uuuaaauucugucugccgcuua

SEQ ID NO: 610701 - RNA, 20 nt, Human
aagaggcuguggauccuacu

SEQ ID NO: 610702 - RNA, 22 nt, Human
uaguaacaacaacuagcauuuu

SEQ ID NO: 610703 - RNA, 22 nt, Human
ugguuuuaaaaacaugcugcau

SEQ ID NO: 610704 - RNA, 18 nt, Human
ucccucccugcuguggcc

SEQ ID NO: 610705 - RNA, 22 nt, Human
gcuucuggaggagcugggcuga

SEQ ID NO: 610706 - RNA, 22 nt, Human
cuuauugucuuacaguaauaga

SEQ ID NO: 610707 - RNA, 22 nt, Human
acacuuuagaaaaaagaauggu

SEQ ID NO: 610708 - RNA, 22 nt, Human
ugcccugccaagacucaguggu

SEQ ID NO: 610709 - RNA, 22 nt, Human
cauguaaaaaauuaggucaucu

SEQ ID NO: 610710 - RNA, 22 nt, Human
uuggcaggaauauugcagaggu

SEQ ID NO: 610711 - RNA, 22 nt, Human
cugaggagcugaaggcccucca

SEQ ID NO: 610712 - RNA, 22 nt, Human
uccaggcacuauauauacuuuu

SEQ ID NO: 610713 - RNA, 22 nt, Human
acacagggcagagagcuggcuc

SEQ ID NO: 610714 - RNA, 22 nt, Human
ucaggggcugugcauuucccag

SEQ ID NO: 610715 - RNA, 22 nt, Human
cacagaaaaaggcuugaaaauc

SEQ ID NO: 610716 - RNA, 22 nt, Human
ggggagaauuacauggcgugga

SEQ ID NO: 610717 - RNA, 22 nt, Human
ugaaggcagcaugcacacuagu

SEQ ID NO: 610718 - RNA, 22 nt, Human
acuccugggugcugaccagcgu

SEQ ID NO: 610719 - RNA, 19 nt, Human
ugcaagugucuuggacaag

SEQ ID NO: 610720 - RNA, 22 nt, Human
gccuucccacccugcgaggcug

SEQ ID NO: 610721 - RNA, 22 nt, Human
gcccaggaagccaccgggaagu

SEQ ID NO: 610722 - RNA, 22 nt, Human
gcaggcuugcccggccuccuuc

SEQ ID NO: 610723 - RNA, 22 nt, Human
uccacagcacaaagccagugug

SEQ ID NO: 610724 - RNA, 22 nt, Human
caggugguuaugaggaagguga

SEQ ID NO: 610725 - RNA, 22 nt, Human
aggcuuaaugaguuaaaucacu

SEQ ID NO: 610726 - RNA, 22 nt, Human
uggcagugccccuugaccagug

SEQ ID NO: 610727 - RNA, 22 nt, Human
cugugcccucuuugcuggccuu

SEQ ID NO: 610728 - RNA, 22 nt, Human
uuguauauauucuuaaagaugu

SEQ ID NO: 610729 - RNA, 22 nt, Human
guuuaugaggaaaaguuaugau

SEQ ID NO: 610730 - RNA, 22 nt, Human
caguggguccugcgucugccag

SEQ ID NO: 610731 - RNA, 21 nt, Human
cuccugggcuaagauauagug

SEQ ID NO: 610732 - RNA, 22 nt, Human
agaauuuagcuccuuggucaua

SEQ ID NO: 610733 - RNA, 22 nt, Human
gaggacagcuuagggcuuccug

SEQ ID NO: 610734 - RNA, 20 nt, Human
aguguuugcucacagucucc

SEQ ID NO: 610735 - RNA, 22 nt, Human
auccagguaugaauugugugac

SEQ ID NO: 610736 - RNA, 22 nt, Human
ccauuuuucauaaacuauccaa

SEQ ID NO: 610737 - RNA, 22 nt, Human
ucucccacuggccuuguaugau

SEQ ID NO: 610738 - RNA, 19 nt, Human
aacauggaacuggagaggg

SEQ ID NO: 610739 - RNA, 22 nt, Human
ugccugucuccucugcagggug

SEQ ID NO: 610740 - RNA, 23 nt, Human
gggcccagcacaggaccuggcag

SEQ ID NO: 610741 - RNA, 22 nt, Human
agguuucuggaaagguuuugcu

SEQ ID NO: 610742 - RNA, 22 nt, Human
uccaucaccauuucugcgagcu

SEQ ID NO: 610743 - RNA, 22 nt, Human
gcagacugcgugaggcgccgcc

SEQ ID NO: 610744 - RNA, 22 nt, Human
ggcugcggaucuaaggcuggga

SEQ ID NO: 610745 - RNA, 22 nt, Human
gcuggcugcacaggggcucacu

SEQ ID NO: 610746 - RNA, 22 nt, Human
gcagaggagcaaguugcuacag

SEQ ID NO: 610747 - RNA, 22 nt, Human
ggcaggaggugaguggcgggug

SEQ ID NO: 610748 - RNA, 22 nt, Human
caaugggccuggagagagcugg

SEQ ID NO: 610749 - RNA, 22 nt, Human
ugugaagauuaaguuacugggc

SEQ ID NO: 610750 - RNA, 22 nt, Human
guuagguagaaguuuacuuuga

SEQ ID NO: 610751 - RNA, 22 nt, Human
ucucuguggagcaguguguuca

SEQ ID NO: 610752 - RNA, 22 nt, Human
uguauuuauucaggauguaacu

SEQ ID NO: 610753 - RNA, 22 nt, Human
acagcucugcauuuuggguuaa

SEQ ID NO: 610754 - RNA, 22 nt, Human
cugagccauccauaccagcuua

SEQ ID NO: 610755 - RNA, 22 nt, Human
guagcccaccuggggagggcga

SEQ ID NO: 610756 - RNA, 20 nt, Human
gcccaagguccagaaggggg

SEQ ID NO: 610757 - RNA, 22 nt, Human
ugcauccuucccauuuaaacca

SEQ ID NO: 610758 - RNA, 22 nt, Human
ucugagaacuccggguuagauc

SEQ ID NO: 610759 - RNA, 22 nt, Human
aacaaaugauaccaguucucaa

SEQ ID NO: 610760 - RNA, 22 nt, Human
acaacaguaggaaaacaugucu

SEQ ID NO: 610761 - RNA, 22 nt, Human
uucuacuuuggacauaaaggac

SEQ ID NO: 610762 - RNA, 22 nt, Human
augucuuucuuauggucuguug

SEQ ID NO: 610763 - RNA, 22 nt, Human
agaagugcuccagugaguuggg

SEQ ID NO: 610764 - RNA, 22 nt, Human
uucauucucuuagcauaguccu

SEQ ID NO: 610765 - RNA, 23 nt, Human
uuuaugcagcauguagaacaugg

SEQ ID NO: 610766 - RNA, 22 nt, Human
agauauucuagaaccuaguaga

SEQ ID NO: 610767 - RNA, 22 nt, Human
gcuggcugugauuuugccaaca

SEQ ID NO: 610768 - RNA, 22 nt, Human
acagcucuucuucaagccuggc

SEQ ID NO: 610769 - RNA, 21 nt, Human
uacaugaguguaugagcauau

SEQ ID NO: 610770 - RNA, 19 nt, Human
aacuacagcgcacuguccu

SEQ ID NO: 610771 - RNA, 22 nt, Human
cugcuuuuucuaggaggacaau

SEQ ID NO: 610772 - RNA, 22 nt, Human
cuucugaccccuggucuacagc

SEQ ID NO: 610773 - RNA, 22 nt, Human
uggaaagacauucagccgcugg

SEQ ID NO: 610774 - RNA, 22 nt, Human
ucacuuaaaaauucuaguuaug

SEQ ID NO: 610775 - RNA, 21 nt, Human
auacuuugaauuacagccuug

SEQ ID NO: 610776 - RNA, 22 nt, Human
gcaaggcugcugccacccaucu

SEQ ID NO: 610777 - RNA, 22 nt, Human
ugugaacauuucugguuauuug

SEQ ID NO: 610778 - RNA, 22 nt, Human
aaguccuuuauccuaaaagguc

SEQ ID NO: 610779 - RNA, 22 nt, Human
gggcucuggauggagccugcag

SEQ ID NO: 610780 - RNA, 22 nt, Human
caugaaauauuaguaacuguuu

SEQ ID NO: 610781 - RNA, 22 nt, Human
uguuaagagaguuucuaauauu

SEQ ID NO: 610782 - RNA, 22 nt, Human
ccacuuuggcaccuucugccua

SEQ ID NO: 610783 - RNA, 22 nt, Human
ucugaggcaaacagaggagugu

SEQ ID NO: 610784 - RNA, 22 nt, Human
ccaguggaaauguggucaggau

SEQ ID NO: 610785 - RNA, 22 nt, Human
uggcaguggugucugcacaggc

SEQ ID NO: 610786 - RNA, 21 nt, Human
agaagccauuuguuaggacuu

SEQ ID NO: 610787 - RNA, 22 nt, Human
acuugucuaccaugaauauuua

SEQ ID NO: 610788 - RNA, 22 nt, Human
cucugagcagaggccguggcua

SEQ ID NO: 610789 - RNA, 22 nt, Human
ugagaaaugggucugcugaaga

SEQ ID NO: 610790 - RNA, 22 nt, Human
aaacaugagcacuugcuucaua

SEQ ID NO: 610791 - RNA, 21 nt, Human
agagacagagaaaguaacauu

SEQ ID NO: 610792 - RNA, 22 nt, Human
ggaagaaagcacacaaacuuga

SEQ ID NO: 610793 - RNA, 22 nt, Human
aaggcugaauucaaggguaggc

SEQ ID NO: 610794 - RNA, 22 nt, Human
aaugccaguguguugauuccag

SEQ ID NO: 610795 - RNA, 22 nt, Human
cagguaggaggcucccuagucc

SEQ ID NO: 610796 - RNA, 22 nt, Human
ucuuguuuugaacucaucagga

SEQ ID NO: 610797 - RNA, 22 nt, Human
uccugcuguuuaccuacaaugg

SEQ ID NO: 610798 - RNA, 22 nt, Human
cagcuguguagaugcaggguca

SEQ ID NO: 610799 - RNA, 22 nt, Human
cacugcuauuauuagacaaugu

SEQ ID NO: 610800 - RNA, 22 nt, Human
caggagaaacauaauuuucugg

SEQ ID NO: 610801 - RNA, 18 nt, Human
ucugucuguguugucuuu

SEQ ID NO: 610802 - RNA, 22 nt, Human
cuuacauuaaguaagagauuga

SEQ ID NO: 610803 - RNA, 22 nt, Human
cuuuuucuucuaggugugccug

SEQ ID NO: 610804 - RNA, 22 nt, Human
uauuaugagccaggugcugucu

SEQ ID NO: 610805 - RNA, 22 nt, Human
augcugaagagagaacuacuca

SEQ ID NO: 610806 - RNA, 22 nt, Human
cugaagcagauguggcugagau

SEQ ID NO: 610807 - RNA, 22 nt, Human
gcuguagguaaggauggcaaag

SEQ ID NO: 610808 - RNA, 22 nt, Human
uccuccaguggcccaguccuuc

SEQ ID NO: 610809 - RNA, 22 nt, Human
auucccacagcugguauaaaua

SEQ ID NO: 610810 - RNA, 22 nt, Human
ugugaaauugagaaacuuucac

SEQ ID NO: 610811 - RNA, 23 nt, Human
uggcacagaggaccaugcuuugc

SEQ ID NO: 610812 - RNA, 22 nt, Human
agcagcugguaggaguggccac

SEQ ID NO: 610813 - RNA, 21 nt, Human
cucaggcuggcagcaggcuag

SEQ ID NO: 610814 - RNA, 22 nt, Human
aaggggccucacagaugggcuu

SEQ ID NO: 610815 - RNA, 22 nt, Human
acaugcacacgauucagucugg

SEQ ID NO: 610816 - RNA, 22 nt, Human
uccagccaaucagagcugaggc

SEQ ID NO: 610817 - RNA, 22 nt, Human
cuggagccuucaccaggggaaa

SEQ ID NO: 610818 - RNA, 22 nt, Human
ugguuccuucugcauuuucagc

SEQ ID NO: 610819 - RNA, 21 nt, Human
gggcauccuuucccacccugc

SEQ ID NO: 610820 - RNA, 22 nt, Human
gccuggcuucccuuggagcauu

SEQ ID NO: 610821 - RNA, 23 nt, Human
aggcccugccugucccucuuuuu

SEQ ID NO: 610822 - RNA, 22 nt, Human
ucuggcugacauccuguaugag

SEQ ID NO: 610823 - RNA, 22 nt, Human
uuuuaugugucaaagcaguggu

SEQ ID NO: 610824 - RNA, 22 nt, Human
cugccugccuggagacagaugg

SEQ ID NO: 610825 - RNA, 22 nt, Human
uuuuuugucccagagagccugg

SEQ ID NO: 610826 - RNA, 22 nt, Human
gcaaacauccacugcccuugua

SEQ ID NO: 610827 - RNA, 22 nt, Human
agcucuggaacucccggcugcu

SEQ ID NO: 610828 - RNA, 22 nt, Human
gugcagucccuccucccaaggc

SEQ ID NO: 610829 - RNA, 22 nt, Human
guucagcacaggugcucagaca

SEQ ID NO: 610830 - RNA, 22 nt, Human
uuccuggguugugcauuguaca

SEQ ID NO: 610831 - RNA, 22 nt, Human
auuagaagauagugauuucugc

SEQ ID NO: 610832 - RNA, 20 nt, Human
agguggcucuuccugggcuu

SEQ ID NO: 610833 - RNA, 22 nt, Human
uaucaggaagaacacgugaaau

SEQ ID NO: 610834 - RNA, 20 nt, Human
cugggcaccugucugcaguu

SEQ ID NO: 610835 - RNA, 18 nt, Human
ggcuccagucuucagugg

SEQ ID NO: 610836 - RNA, 20 nt, Human
ugccaggcacggagugcaug

SEQ ID NO: 610837 - RNA, 22 nt, Human
uucauugauuuccuuggaauaa

SEQ ID NO: 610838 - RNA, 19 nt, Human
cgcaggagccgaggugacc

SEQ ID NO: 610839 - RNA, 22 nt, Human
agccacacagcuuaaugacaga

SEQ ID NO: 610840 - RNA, 22 nt, Human
agucccagcucugccacuuacu

SEQ ID NO: 610841 - RNA, 22 nt, Human
acagugcuaaacacuucuugaa

SEQ ID NO: 610842 - RNA, 22 nt, Human
augauacucuaggugauuuaca

SEQ ID NO: 610843 - RNA, 22 nt, Human
agaaaauaaauugaugguggaa

SEQ ID NO: 610844 - RNA, 22 nt, Human
gauaauuuaagucuugggggcu

SEQ ID NO: 610845 - RNA, 22 nt, Human
ugacagucugcaguuuuaaaaa

SEQ ID NO: 610846 - RNA, 22 nt, Human
agcuggcuuugagcugggaggu

SEQ ID NO: 610847 - RNA, 22 nt, Human
auuucuugccccugcucccuga

SEQ ID NO: 610848 - RNA, 20 nt, Human
cugggcucaagugauccucc

SEQ ID NO: 610849 - RNA, 22 nt, Human
ggaggcuccaugagcuccugca

SEQ ID NO: 610850 - RNA, 22 nt, Human
aggccacaggauugcacagcau

SEQ ID NO: 610851 - RNA, 22 nt, Human
aucauuuugugacaaugccugu

SEQ ID NO: 610852 - RNA, 22 nt, Human
aauguuaaguuuagauuauaac

SEQ ID NO: 610853 - RNA, 22 nt, Human
cuguggccuuggaccagcaucu

SEQ ID NO: 610854 - RNA, 22 nt, Human
guuuagauuucaugaagacacu

SEQ ID NO: 610855 - RNA, 22 nt, Human
ugccaggcucagccccuaucuu

SEQ ID NO: 610856 - RNA, 22 nt, Human
uucaaaugauggcaguccuggc

SEQ ID NO: 610857 - RNA, 22 nt, Human
acaagaaagguaggauucaggu

SEQ ID NO: 610858 - RNA, 22 nt, Human
cagagcugggaucccaugggcg

SEQ ID NO: 610859 - RNA, 22 nt, Human
auugaaaggcaaaguaggaagc

SEQ ID NO: 610860 - RNA, 22 nt, Human
ugucugagcgagaaaguagugu

SEQ ID NO: 610861 - RNA, 22 nt, Human
agguggcaguuguggaaccauc

SEQ ID NO: 610862 - RNA, 22 nt, Human
gagaagcaauuuccaacugugc

SEQ ID NO: 610863 - RNA, 22 nt, Human
auugucaucgauguuagccagu

SEQ ID NO: 610864 - RNA, 20 nt, Human
uccaugcaaauacagaguuu

SEQ ID NO: 610865 - RNA, 22 nt, Human
uaugugacuugacaaagcuucc

SEQ ID NO: 610866 - RNA, 22 nt, Human
cagguagggauaugauggugau

SEQ ID NO: 610867 - RNA, 22 nt, Human
uucucaggugaggcugaggcug

SEQ ID NO: 610868 - RNA, 22 nt, Human
agugugggugagggaggcccuc

SEQ ID NO: 610869 - RNA, 22 nt, Human
agcuuugguugaggggagugug

SEQ ID NO: 610870 - RNA, 21 nt, Human
ggcuguggagccaugacucac

SEQ ID NO: 610871 - RNA, 21 nt, Human
ugucucaagaaaggccucucc

SEQ ID NO: 610872 - RNA, 22 nt, Human
cuggacagaaguggcugggcag

SEQ ID NO: 610873 - RNA, 22 nt, Human
ugcuaauguuucauuuuuagau

SEQ ID NO: 610874 - RNA, 22 nt, Human
acagggcagguggcuacugguc

SEQ ID NO: 610875 - RNA, 22 nt, Human
cuggagcagcagguggccaggg

SEQ ID NO: 610876 - RNA, 22 nt, Human
agcagagcccuuccauggccuu

SEQ ID NO: 610877 - RNA, 22 nt, Human
caggcagggagccacuguauaa

SEQ ID NO: 610878 - RNA, 23 nt, Human
acuuuauugaccccaggucaguu

SEQ ID NO: 610879 - RNA, 22 nt, Human
ugcugagcccagaacggccugg

SEQ ID NO: 610880 - RNA, 22 nt, Human
gccucuggucccucaugcugug

SEQ ID NO: 610881 - RNA, 22 nt, Human
ucacuccauagcuuaacucuuu

SEQ ID NO: 610882 - RNA, 22 nt, Human
aagagagaagucucucugguuc

SEQ ID NO: 610883 - RNA, 22 nt, Human
gagggccagaucccaggaggaa

SEQ ID NO: 610884 - RNA, 20 nt, Human
agucacaggccuggaacaug

SEQ ID NO: 610885 - RNA, 22 nt, Human
caguugcagaggcagagugcua

SEQ ID NO: 610886 - RNA, 22 nt, Human
uuauucuuggaucugagucucu

SEQ ID NO: 610887 - RNA, 22 nt, Human
auguuucagggugauagaaggu

SEQ ID NO: 610888 - RNA, 22 nt, Human
cagggcuuggaucuguggucag

SEQ ID NO: 610889 - RNA, 22 nt, Human
acagggcagagggcaguuggua

SEQ ID NO: 610890 - RNA, 22 nt, Human
ugugaaaugaagauaauucuug

SEQ ID NO: 610891 - RNA, 22 nt, Human
ggcaggugcugggagcaucuca

SEQ ID NO: 610892 - RNA, 22 nt, Human
ucacagucggugacuucuugcu

SEQ ID NO: 610893 - RNA, 22 nt, Human
gacaagacuauguagaaaguau

SEQ ID NO: 610894 - RNA, 21 nt, Human
ugacugaggcuucuucacaca

SEQ ID NO: 610895 - RNA, 21 nt, Human
ugcaggaguguaaugugaccc

SEQ ID NO: 610896 - RNA, 22 nt, Human
uuucucucuacaguacuuucau

SEQ ID NO: 610897 - RNA, 22 nt, Human
agccaagggucagcugcacaga

SEQ ID NO: 610898 - RNA, 22 nt, Human
gacagcuucuagaggaauuggu

SEQ ID NO: 610899 - RNA, 22 nt, Human
acacaagucccuccauacucuc

SEQ ID NO: 610900 - RNA, 22 nt, Human
ugugugaguaaggcugagagag

SEQ ID NO: 610901 - RNA, 20 nt, Human
cucugggcugcacccucgcc

SEQ ID NO: 610902 - RNA, 22 nt, Human
aaauggaauguguuuauaauuc

SEQ ID NO: 610903 - RNA, 22 nt, Human
gggugggaaggcuaagggauug

SEQ ID NO: 610904 - RNA, 18 nt, Human
uugagggaggggcagagu

SEQ ID NO: 610905 - RNA, 22 nt, Human
aaaggagacagucuuaccugga

SEQ ID NO: 610906 - RNA, 22 nt, Human
cagagcagagugauuguucugg

SEQ ID NO: 610907 - RNA, 22 nt, Human
uaucucuguaaaagaaaucaca

SEQ ID NO: 610908 - RNA, 22 nt, Human
gcagccucaaacuccccagcuc

SEQ ID NO: 610909 - RNA, 17 nt, Human
cagcugugagagccuua

SEQ ID NO: 610910 - RNA, 22 nt, Human
ucaaggaaggucuguugcucca

SEQ ID NO: 610911 - RNA, 22 nt, Human
uauuaauaagugacuacuagcu

SEQ ID NO: 610912 - RNA, 22 nt, Human
gaagcagcagcuggggacaguu

SEQ ID NO: 610913 - RNA, 22 nt, Human
uuacaguugcccccagccucgc

SEQ ID NO: 610914 - RNA, 22 nt, Human
ccucagcugcuucccuggagcc

SEQ ID NO: 610915 - RNA, 22 nt, Human
uucaguuucagucuugcaaaaa

SEQ ID NO: 610916 - RNA, 22 nt, Human
cuucuggguugcaggucuuggc

SEQ ID NO: 610917 - RNA, 22 nt, Human
augucacaguugcaacaugaau

SEQ ID NO: 610918 - RNA, 22 nt, Human
ugaggcucuccaagcagaugag

SEQ ID NO: 610919 - RNA, 22 nt, Human
gccagccccagacauccuaucg

SEQ ID NO: 610920 - RNA, 22 nt, Human
uagcugccuaugugauaagaga

SEQ ID NO: 610921 - RNA, 22 nt, Human
agacucugcauuucuaauaagc

SEQ ID NO: 610922 - RNA, 22 nt, Human
uccaagcauguggucaggagcc

SEQ ID NO: 610923 - RNA, 22 nt, Human
aggauuugcacugguguuugag

SEQ ID NO: 610924 - RNA, 22 nt, Human
gacuuuaugaagagaugaccaa

SEQ ID NO: 610925 - RNA, 21 nt, Human
acacacuacacauuccuaguu

SEQ ID NO: 610926 - RNA, 22 nt, Human
cuuagugaggaaugaauuuguu

SEQ ID NO: 610927 - RNA, 23 nt, Human
auguaagaguuccaguuacuuug

SEQ ID NO: 610928 - RNA, 22 nt, Human
ucuccccagggguauggguauu

SEQ ID NO: 610929 - RNA, 22 nt, Human
gccgaggcucugcccagcugcu

SEQ ID NO: 610930 - RNA, 23 nt, Human
cccagggacacgaugacaccucc

SEQ ID NO: 610931 - RNA, 22 nt, Human
uucuuacagauuuggugaauga

SEQ ID NO: 610932 - RNA, 21 nt, Human
ucccagggccaggugccauca

SEQ ID NO: 610933 - RNA, 22 nt, Human
uuuuucauugcagccucucucc

SEQ ID NO: 610934 - RNA, 22 nt, Human
ugcagcugguaucccauggauu

SEQ ID NO: 610935 - RNA, 22 nt, Human
uuggcucacaugauuauggagg

SEQ ID NO: 610936 - RNA, 22 nt, Human
agagaauuuuaaaagccuugaa

SEQ ID NO: 610937 - RNA, 21 nt, Human
cacacagcugcccuuagguag

SEQ ID NO: 610938 - RNA, 22 nt, Human
agguuagugcugaaaugacaug

SEQ ID NO: 610939 - RNA, 22 nt, Human
cuauuagaaagcaucuucuaua

SEQ ID NO: 610940 - RNA, 23 nt, Human
uucauuuaggaguucauaagagc

SEQ ID NO: 610941 - RNA, 22 nt, Human
uauguuuuucaagugcacacua

SEQ ID NO: 610942 - RNA, 22 nt, Human
uggcaauaugcuuucaguggcc

SEQ ID NO: 610943 - RNA, 22 nt, Human
ucaggcagagggagaagccaag

SEQ ID NO: 610944 - RNA, 22 nt, Human
gcccagugcugagggugcugcu

SEQ ID NO: 610945 - RNA, 22 nt, Human
agccaggcuaaaugagccauga

SEQ ID NO: 610946 - RNA, 22 nt, Human
aaaugaacucaaugaucuccca

SEQ ID NO: 610947 - RNA, 22 nt, Human
ggugugggcccugaugucagca

SEQ ID NO: 610948 - RNA, 22 nt, Human
cagaaaccugucuggaguggga

SEQ ID NO: 610949 - RNA, 22 nt, Human
uccauggguagcccugguugag

SEQ ID NO: 610950 - RNA, 22 nt, Human
gcaggccaagcccucgcagaga

SEQ ID NO: 610951 - RNA, 18 nt, Human
uaggaggauacugagaug

SEQ ID NO: 610952 - RNA, 22 nt, Human
uuaguaauguguuaauaugaau

SEQ ID NO: 610953 - RNA, 22 nt, Human
cuggcagcgugagcagcaucca

SEQ ID NO: 610954 - RNA, 22 nt, Human
ucuggagugggacuuugcaucu

SEQ ID NO: 610955 - RNA, 22 nt, Human
auaauauuuggauaggacagua

SEQ ID NO: 610956 - RNA, 22 nt, Human
cuacauuucauccagggagagc

SEQ ID NO: 610957 - RNA, 22 nt, Human
uuccuuccauagcaaaacaugc

SEQ ID NO: 610958 - RNA, 22 nt, Human
auuuaauuugugucuuuagcug

SEQ ID NO: 610959 - RNA, 22 nt, Human
uuuugcaaaguacauuaucagg

SEQ ID NO: 610960 - RNA, 22 nt, Human
uaacacaguguccucagaaaca

SEQ ID NO: 610961 - RNA, 22 nt, Human
cccagccugugacagccguccu

SEQ ID NO: 610962 - RNA, 22 nt, Human
ggccuggccuccagaugugggc

SEQ ID NO: 610963 - RNA, 22 nt, Human
ucaaagagcucuaucuucaaaa

SEQ ID NO: 610964 - RNA, 22 nt, Human
accaagcacaaagaugaguaaa

SEQ ID NO: 610965 - RNA, 22 nt, Human
aaguucuuagacaagcuugugg

SEQ ID NO: 610966 - RNA, 22 nt, Human
gcagcccugcagcuccacaccg

SEQ ID NO: 610967 - RNA, 22 nt, Human
uaugcuaaauauguucacauug

SEQ ID NO: 610968 - RNA, 22 nt, Human
uuuguucauuaguacaguugua

SEQ ID NO: 610969 - RNA, 22 nt, Human
cugcuccucugagguagccaca

SEQ ID NO: 610970 - RNA, 22 nt, Human
uauuaaagagagaaucaucauc

SEQ ID NO: 610971 - RNA, 22 nt, Human
auuauugugauaggugucagug

SEQ ID NO: 610972 - RNA, 22 nt, Human
ccuguacacaauuccgaggaua

SEQ ID NO: 610973 - RNA, 23 nt, Human
uaaauuaccuuuccagugcaggg

SEQ ID NO: 610974 - RNA, 22 nt, Human
guguccuucauuggaaucucuc

SEQ ID NO: 610975 - RNA, 22 nt, Human
agcugaggccacgagugaaggg

SEQ ID NO: 610976 - RNA, 22 nt, Human
gggcaugccugcgcagugcaug

SEQ ID NO: 610977 - RNA, 22 nt, Human
ucuuacagaaaauagauaacau

SEQ ID NO: 610978 - RNA, 22 nt, Human
agggcagugggaaagccugcuc

SEQ ID NO: 610979 - RNA, 22 nt, Human
ucagcagggcugugguguggcu

SEQ ID NO: 610980 - RNA, 22 nt, Human
cuuuauuagauguagacuuucu

SEQ ID NO: 610981 - RNA, 22 nt, Human
aaggccagccugagagcuaaca

SEQ ID NO: 610982 - RNA, 22 nt, Human
cuacuucugugaugaaacuaca

SEQ ID NO: 610983 - RNA, 22 nt, Human
guguuaaugguagaaucugagu

SEQ ID NO: 610984 - RNA, 22 nt, Human
agacucugauaagcaacucuug

SEQ ID NO: 610985 - RNA, 22 nt, Human
aggagggcuaggaaaaccagga

SEQ ID NO: 610986 - RNA, 22 nt, Human
aaccaguacuuuacacagcucu

SEQ ID NO: 610987 - RNA, 22 nt, Human
ggacugggagaauggaggcaag

SEQ ID NO: 610988 - RNA, 22 nt, Human
gaagcgcggcgucggcgugggu

SEQ ID NO: 610989 - RNA, 22 nt, Human
agaggcugcacuugcucaugau

SEQ ID NO: 610990 - RNA, 22 nt, Human
cagagccuaaaacgacuccacu

SEQ ID NO: 610991 - RNA, 22 nt, Human
aagcggagcauuugaacuugaa

SEQ ID NO: 610992 - RNA, 22 nt, Human
uucuuacaaacaagaucauuga

SEQ ID NO: 610993 - RNA, 22 nt, Human
uucauauuugaaacagaaguua

SEQ ID NO: 610994 - RNA, 22 nt, Human
aggcucugaggcagauuuucgu

SEQ ID NO: 610995 - RNA, 22 nt, Human
caaagugcugagauuacaggua

SEQ ID NO: 610996 - RNA, 22 nt, Human
cauuuagaagucuuagaacuau

SEQ ID NO: 610997 - RNA, 22 nt, Human
gcaggcagagucaauuugaucc

SEQ ID NO: 610998 - RNA, 22 nt, Human
acauucuuugaguuuuguuaaa

SEQ ID NO: 610999 - RNA, 22 nt, Human
gagcugccuguugcauagcaac

SEQ ID NO: 611000 - RNA, 22 nt, Human
uuuguucugaaaacucaagucc

SEQ ID NO: 611001 - RNA, 22 nt, Human
uuagaaguucaggucuguaauc

SEQ ID NO: 611002 - RNA, 22 nt, Human
aaugauaagacaugaguagagg

SEQ ID NO: 611003 - RNA, 22 nt, Human
ugagguagcuguuuagaaagac

SEQ ID NO: 611004 - RNA, 22 nt, Human
ugcucuggguucuugcuguuac

SEQ ID NO: 611005 - RNA, 22 nt, Human
ccagaccacccuggccaugcac

SEQ ID NO: 611006 - RNA, 22 nt, Human
cuguucucuggcgguggcuguu

SEQ ID NO: 611007 - RNA, 22 nt, Human
accuuucauuaaagucuguagu

SEQ ID NO: 611008 - RNA, 22 nt, Human
ugugacagaucuuuaaauaaug

SEQ ID NO: 611009 - RNA, 22 nt, Human
cagacacuaugcuaagguacua

SEQ ID NO: 611010 - RNA, 22 nt, Human
aguggagacaggacagucgaua

SEQ ID NO: 611011 - RNA, 22 nt, Human
cagccaggagcucccccugcuc

SEQ ID NO: 611012 - RNA, 22 nt, Human
ugagauggugaagaagacagca

SEQ ID NO: 611013 - RNA, 22 nt, Human
auuaaaugguggucauucauuu

SEQ ID NO: 611014 - RNA, 22 nt, Human
cuucuccagccacgcccacucc

SEQ ID NO: 611015 - RNA, 21 nt, Human
cuacuuaaguaggggauuagg

SEQ ID NO: 611016 - RNA, 22 nt, Human
ugauauuuuucacuggccucug

SEQ ID NO: 611017 - RNA, 18 nt, Human
ugagacagcuaccacuug

SEQ ID NO: 611018 - RNA, 22 nt, Human
uaccauuucaguaaaaacuuag

SEQ ID NO: 611019 - RNA, 22 nt, Human
aagacaaucuaaggggaauggu

SEQ ID NO: 611020 - RNA, 22 nt, Human
aucuuucagagcuccaucaggg

SEQ ID NO: 611021 - RNA, 22 nt, Human
aaugauaugcaaauuaucauca

SEQ ID NO: 611022 - RNA, 22 nt, Human
ugucccuggagcuucugucccc

SEQ ID NO: 611023 - RNA, 22 nt, Human
caaaccuugcagaacugggcag

SEQ ID NO: 611024 - RNA, 22 nt, Human
ugaggcuccuuguagagagugg

SEQ ID NO: 611025 - RNA, 22 nt, Human
cagcaggcucugaguggcugcc

SEQ ID NO: 611026 - RNA, 22 nt, Human
uauuuauucuuuguacugccuu

SEQ ID NO: 611027 - RNA, 23 nt, Human
gcuguacaggaaccaguuuggag

SEQ ID NO: 611028 - RNA, 23 nt, Human
cugggccuauggucugaauccaa

SEQ ID NO: 611029 - RNA, 22 nt, Human
gacugagggauagaggugcuuc

SEQ ID NO: 611030 - RNA, 22 nt, Human
uggcuuccuguuucccagaaag

SEQ ID NO: 611031 - RNA, 22 nt, Human
uccaagcuugcuuuagccacag

SEQ ID NO: 611032 - RNA, 22 nt, Human
aguacaaauuauagcgcuugga

SEQ ID NO: 611033 - RNA, 22 nt, Human
uacacuuuucugguuacucuug

SEQ ID NO: 611034 - RNA, 22 nt, Human
gcagcagcucagccgggcacug

SEQ ID NO: 611035 - RNA, 22 nt, Human
aggcugguaguauuuagucaca

SEQ ID NO: 611036 - RNA, 22 nt, Human
uguaagaugcugggauagauga

SEQ ID NO: 611037 - RNA, 22 nt, Human
guggaaaacugagaaaauugcu

SEQ ID NO: 611038 - RNA, 22 nt, Human
cugaggucaccccacuggcugu

SEQ ID NO: 611039 - RNA, 22 nt, Human
aggagcugucagagugccagag

SEQ ID NO: 611040 - RNA, 22 nt, Human
auggaauaggcugcucuuuaaa

SEQ ID NO: 611041 - RNA, 22 nt, Human
aaacaaugagcuuuuacacacu

SEQ ID NO: 611042 - RNA, 22 nt, Human
ucugccagguggggagaggcca

SEQ ID NO: 611043 - RNA, 22 nt, Human
ugcaguguuuuucagggcauau

SEQ ID NO: 611044 - RNA, 18 nt, Human
auucuagaagaugccuug

SEQ ID NO: 611045 - RNA, 22 nt, Human
uccuaacuccacuagccuuggg

SEQ ID NO: 611046 - RNA, 22 nt, Human
cacaugaguccugccagguaug

SEQ ID NO: 611047 - RNA, 22 nt, Human
gccaggggacgcggagcgacga

SEQ ID NO: 611048 - RNA, 22 nt, Human
acauacacaagcguacaugaac

SEQ ID NO: 611049 - RNA, 22 nt, Human
acacuggguaacauaucuguua

SEQ ID NO: 611050 - RNA, 22 nt, Human
ucagcugagcuccagcucauag

SEQ ID NO: 611051 - RNA, 22 nt, Human
cccugcagacgucuugaugccu

SEQ ID NO: 611052 - RNA, 22 nt, Human
caaaugcaggucagcagguguc

SEQ ID NO: 611053 - RNA, 22 nt, Human
uuuuuuaucuaugguaguacca

SEQ ID NO: 611054 - RNA, 22 nt, Human
acugggagggucuugaagaggg

SEQ ID NO: 611055 - RNA, 22 nt, Human
uagcugccaaaagggugggcua

SEQ ID NO: 611056 - RNA, 19 nt, Human
gcagccaggugcucuaccu

SEQ ID NO: 611057 - RNA, 22 nt, Human
aggagucacucagggcuucauc

SEQ ID NO: 611058 - RNA, 22 nt, Human
uaaaguuggaccugauuuuauu

SEQ ID NO: 611059 - RNA, 22 nt, Human
cagcagacuuacuagaauguaa

SEQ ID NO: 611060 - RNA, 22 nt, Human
aaaaucuaaguagcgaguaagg

SEQ ID NO: 611061 - RNA, 22 nt, Human
gaggaaggucccaucagaauuu

SEQ ID NO: 611062 - RNA, 22 nt, Human
ucgaacucauagucguagcugu

SEQ ID NO: 611063 - RNA, 19 nt, Human
caugcugaccugcuguggu

SEQ ID NO: 611064 - RNA, 19 nt, Human
ggagacucagcccaugccu

SEQ ID NO: 611065 - RNA, 20 nt, Human
aagcuggaagaccagcauug

SEQ ID NO: 611066 - RNA, 22 nt, Human
caacagcuuuagaaacacuuuc

SEQ ID NO: 611067 - RNA, 22 nt, Human
cucugacagccuucauuaugca

SEQ ID NO: 611068 - RNA, 22 nt, Human
uaaaugcuccauacauacacca

SEQ ID NO: 611069 - RNA, 22 nt, Human
aaaaagauagcauugugcuccu

SEQ ID NO: 611070 - RNA, 22 nt, Human
ugcaguuuugccaggcaaugga

SEQ ID NO: 611071 - RNA, 18 nt, Human
acauuuaggagagucaau

SEQ ID NO: 611072 - RNA, 21 nt, Human
aucugaaguuugagaggaaag

SEQ ID NO: 611073 - RNA, 22 nt, Human
agugcaaagaaaucagcuuugu

SEQ ID NO: 611074 - RNA, 22 nt, Human
uggaggucuuacccagggcuau

SEQ ID NO: 611075 - RNA, 22 nt, Human
ugcuaaauucauuauugauuua

SEQ ID NO: 611076 - RNA, 22 nt, Human
uguguucaucuuuaaagggaag

SEQ ID NO: 611077 - RNA, 22 nt, Human
auucucuggguuccaguaaaug

SEQ ID NO: 611078 - RNA, 19 nt, Human
ggcagcucuugucuucugc

SEQ ID NO: 611079 - RNA, 22 nt, Human
cagagccugcucacgucucugu

SEQ ID NO: 611080 - RNA, 22 nt, Human
agacccagaaagcagcugcauu

SEQ ID NO: 611081 - RNA, 22 nt, Human
gggcaucuuguagccuucacuu

SEQ ID NO: 611082 - RNA, 22 nt, Human
aguccagggagcccaggcuuug

SEQ ID NO: 611083 - RNA, 23 nt, Human
agcagguagguugaaauuuuccu

SEQ ID NO: 611084 - RNA, 22 nt, Human
ucauuccuuauccguaucuuuu

SEQ ID NO: 611085 - RNA, 22 nt, Human
caggcuggcaaugcgucaagca

SEQ ID NO: 611086 - RNA, 22 nt, Human
aggaaggagggcagauauuaag

SEQ ID NO: 611087 - RNA, 22 nt, Human
gggauaggagauugggaguguu

SEQ ID NO: 611088 - RNA, 22 nt, Human
agggcagcauugccuuucucca

SEQ ID NO: 611089 - RNA, 23 nt, Human
uagggcagcugggagggacaugc

SEQ ID NO: 611090 - RNA, 22 nt, Human
uguguguguuuacaguuucuca

SEQ ID NO: 611091 - RNA, 22 nt, Human
ggcaggagcucuccaguuugcc

SEQ ID NO: 611092 - RNA, 17 nt, Human
agcugccuugcuugagc

SEQ ID NO: 611093 - RNA, 22 nt, Human
ccugccugcaccuucucugggg

SEQ ID NO: 611094 - RNA, 22 nt, Human
ugccacuggcucaauggugcag

SEQ ID NO: 611095 - RNA, 22 nt, Human
gcuuaaaagccacuuagucuau

SEQ ID NO: 611096 - RNA, 22 nt, Human
gucuccuggcugcagcuaagac

SEQ ID NO: 611097 - RNA, 22 nt, Human
agcagggggccacagucacagc

SEQ ID NO: 611098 - RNA, 22 nt, Human
gcgcgcuaccgccagggcugca

SEQ ID NO: 611099 - RNA, 20 nt, Human
uaacugaucauuuucaccag

SEQ ID NO: 611100 - RNA, 22 nt, Human
aagcagauuggggauuuccaug

SEQ ID NO: 611101 - RNA, 22 nt, Human
cugggcucuagaaaggaaagaa

SEQ ID NO: 611102 - RNA, 22 nt, Human
ccuggggcuccagagcagcgga

SEQ ID NO: 611103 - RNA, 19 nt, Human
ugcagccacgugagagacu

SEQ ID NO: 611104 - RNA, 18 nt, Human
acauuucuaugcuucugg

SEQ ID NO: 611105 - RNA, 22 nt, Human
ggacccugggcucugggccuau

SEQ ID NO: 611106 - RNA, 22 nt, Human
ucugcaagcgucacaugauucu

SEQ ID NO: 611107 - RNA, 21 nt, Human
gcccagugauuucuucacagu

SEQ ID NO: 611108 - RNA, 22 nt, Human
cucuccuuuacugcagagagcg

SEQ ID NO: 611109 - RNA, 22 nt, Human
ugccgcagugcggggagggccc

SEQ ID NO: 611110 - RNA, 22 nt, Human
guccugucccccaaggcugugg

SEQ ID NO: 611111 - RNA, 22 nt, Human
uauguagcaauagcaucauacu

SEQ ID NO: 611112 - RNA, 22 nt, Human
gcugguccugggguugcagcau

SEQ ID NO: 611113 - RNA, 22 nt, Human
uccaucugguggcuuccuuuug

SEQ ID NO: 611114 - RNA, 22 nt, Human
uucuauguagauaaggcugcuc

SEQ ID NO: 611115 - RNA, 22 nt, Human
ggcugguccuuucucuguccua

SEQ ID NO: 611116 - RNA, 22 nt, Human
uagaaagaucuguaggcaagag

SEQ ID NO: 611117 - RNA, 22 nt, Human
ggaaagggcagaggccuuggag

SEQ ID NO: 611118 - RNA, 22 nt, Human
uuucauagccuucuaaugaguu

SEQ ID NO: 611119 - RNA, 22 nt, Human
gucauucaacugcacauuaggu

SEQ ID NO: 611120 - RNA, 22 nt, Human
uauugugccagguaauguguuc

SEQ ID NO: 611121 - RNA, 22 nt, Human
gggcagaggggcgcuucccucu

SEQ ID NO: 611122 - RNA, 22 nt, Human
cacugcaacaaccucuaccucc

SEQ ID NO: 611123 - RNA, 22 nt, Human
gcuucagcuuugucuccuuggg

SEQ ID NO: 611124 - RNA, 22 nt, Human
cauaauaucuccgauuacuugc

SEQ ID NO: 611125 - RNA, 22 nt, Human
cugggccacaucagaugaagac

SEQ ID NO: 611126 - RNA, 19 nt, Human
acucugaggcugagacaag

SEQ ID NO: 611127 - RNA, 22 nt, Human
ccaggcuuuuagcugcauggca

SEQ ID NO: 611128 - RNA, 22 nt, Human
aacuucuugguccugagcuguu

SEQ ID NO: 611129 - RNA, 22 nt, Human
augaagcaguuaaggugcauga

SEQ ID NO: 611130 - RNA, 22 nt, Human
caggguggcaggcaccauggcc

SEQ ID NO: 611131 - RNA, 22 nt, Human
caggccaaagaucccauugaca

SEQ ID NO: 611132 - RNA, 22 nt, Human
uggagguggggcucaggaaucu

SEQ ID NO: 611133 - RNA, 22 nt, Human
gcagcugcagguggucccaugc

SEQ ID NO: 611134 - RNA, 22 nt, Human
ccagccagucccgcaugaccgc

SEQ ID NO: 611135 - RNA, 21 nt, Human
gaggccacuaauaggggcaga

SEQ ID NO: 611136 - RNA, 22 nt, Human
cuggagaaguacugagacauuu

SEQ ID NO: 611137 - RNA, 22 nt, Human
gcacacagagaggugguauguc

SEQ ID NO: 611138 - RNA, 21 nt, Human
agguggggcugcaccucugcu

SEQ ID NO: 611139 - RNA, 22 nt, Human
ugagagauuuucaugagugcuu

SEQ ID NO: 611140 - RNA, 22 nt, Human
aauaucuucuaaggauagaacu

SEQ ID NO: 611141 - RNA, 22 nt, Human
gaaaauuuagaacugaacuucu

SEQ ID NO: 611142 - RNA, 22 nt, Human
aggcucugugcagccugcaucu

SEQ ID NO: 611143 - RNA, 22 nt, Human
gcucucagggugauggcauacu

SEQ ID NO: 611144 - RNA, 22 nt, Human
gagcccagcuguccuuggcaaa

SEQ ID NO: 611145 - RNA, 22 nt, Human
acauccgcagguuauaaagccc

SEQ ID NO: 611146 - RNA, 22 nt, Human
acagccagaucugagagaucuu

SEQ ID NO: 611147 - RNA, 20 nt, Human
cccagagguugcggcaggag

SEQ ID NO: 611148 - RNA, 22 nt, Human
acuguauagauggaguugauuu

SEQ ID NO: 611149 - RNA, 22 nt, Human
ggaagaaaucugguuaagagau

SEQ ID NO: 611150 - RNA, 22 nt, Human
uacauguauugauuucucuucu

SEQ ID NO: 611151 - RNA, 22 nt, Human
ucugaaaacuccaugagcucgu

SEQ ID NO: 611152 - RNA, 22 nt, Human
caguuccuaugggcaaaacaca

SEQ ID NO: 611153 - RNA, 23 nt, Human
agcaggaaaccgagggugauguu

SEQ ID NO: 611154 - RNA, 22 nt, Human
auguacaucuuuauaacaagcu

SEQ ID NO: 611155 - RNA, 22 nt, Human
aaggcuuguagauuugggcuuu

SEQ ID NO: 611156 - RNA, 22 nt, Human
caccagggacaaugcuaggggu

SEQ ID NO: 611157 - RNA, 22 nt, Human
ucugagcugugaguugcuuagg

SEQ ID NO: 611158 - RNA, 22 nt, Human
aguuacaugugaauagaaagua

SEQ ID NO: 611159 - RNA, 22 nt, Human
cuguggauuuaggcagagcuga

SEQ ID NO: 611160 - RNA, 22 nt, Human
uuccuguuagccauuauuagcu

SEQ ID NO: 611161 - RNA, 22 nt, Human
cucugcagaauuugagcugcuc

SEQ ID NO: 611162 - RNA, 22 nt, Human
cagaauuuagaaaacaacauaa

SEQ ID NO: 611163 - RNA, 22 nt, Human
ugggcaaguaucggacucugag

SEQ ID NO: 611164 - RNA, 22 nt, Human
acaucuguccucugcagagcuc

SEQ ID NO: 611165 - RNA, 22 nt, Human
acacuuuacagaauguuuugau

SEQ ID NO: 611166 - RNA, 21 nt, Human
agagcugggacuugccugaga

SEQ ID NO: 611167 - RNA, 19 nt, Human
augaagcauuguuuuugua

SEQ ID NO: 611168 - RNA, 22 nt, Human
cucugaagccccaaauaguccg

SEQ ID NO: 611169 - RNA, 22 nt, Human
ccacccugccuugggccaguga

SEQ ID NO: 611170 - RNA, 22 nt, Human
cuggaauguagagacagcuuag

SEQ ID NO: 611171 - RNA, 22 nt, Human
cugagccauaagggaggcuggg

SEQ ID NO: 611172 - RNA, 22 nt, Human
cuuguauagggaaagauaaauc

SEQ ID NO: 611173 - RNA, 22 nt, Human
caggcacuguguuaggcacugu

SEQ ID NO: 611174 - RNA, 22 nt, Human
cccacagguggaagccucggaa

SEQ ID NO: 611175 - RNA, 22 nt, Human
agcaggcaggcccagcggcugg

SEQ ID NO: 611176 - RNA, 21 nt, Human
gcagccacagccaccaagcua

SEQ ID NO: 611177 - RNA, 19 nt, Human
ugcuccaggccuugccgca

SEQ ID NO: 611178 - RNA, 22 nt, Human
ugcuccuucccuucccagugag

SEQ ID NO: 611179 - RNA, 22 nt, Human
guggagaggagcagcuaccuca

SEQ ID NO: 611180 - RNA, 23 nt, Human
acuagaaaaugacuuucucccug

SEQ ID NO: 611181 - RNA, 22 nt, Human
uauuuucuggggagagugaacc

SEQ ID NO: 611182 - RNA, 22 nt, Human
gucaggacucugacccgucccg

SEQ ID NO: 611183 - RNA, 22 nt, Human
caugauggaugugcacuucgcu

SEQ ID NO: 611184 - RNA, 22 nt, Human
agaggaugauuuuaaggacacu

SEQ ID NO: 611185 - RNA, 22 nt, Human
uuauucacucauuuaacauuau

SEQ ID NO: 611186 - RNA, 22 nt, Human
uuuaaggagcuacucaccguca

SEQ ID NO: 611187 - RNA, 22 nt, Human
gugacaaaugcaaauugggcug

SEQ ID NO: 611188 - RNA, 22 nt, Human
ucuguuagagagguaguucuug

SEQ ID NO: 611189 - RNA, 22 nt, Human
agcuggcuucucugcagacauu

SEQ ID NO: 611190 - RNA, 22 nt, Human
aggaagggugucaugagcccuu

SEQ ID NO: 611191 - RNA, 22 nt, Human
caaguuuugauuuugcaguaaa

SEQ ID NO: 611192 - RNA, 22 nt, Human
gccaggcugcuggcugcugucc

SEQ ID NO: 611193 - RNA, 22 nt, Human
agcugccugggcuuguacaccu

SEQ ID NO: 611194 - RNA, 22 nt, Human
ccuggucagagcagucaggauc

SEQ ID NO: 611195 - RNA, 22 nt, Human
caaguuugcugauccuuguuuu

SEQ ID NO: 611196 - RNA, 22 nt, Human
gaucgaguuguuuguucugggg

SEQ ID NO: 611197 - RNA, 22 nt, Human
auguuuuauauuuugcagcagu

SEQ ID NO: 611198 - RNA, 20 nt, Human
agcaggaaugaugcuuucau

SEQ ID NO: 611199 - RNA, 22 nt, Human
ccacuguaaccauuaucaccau

SEQ ID NO: 611200 - RNA, 22 nt, Human
aaguuuuaacaaguacuuacua

SEQ ID NO: 611201 - RNA, 22 nt, Human
caucuuaaaaugugucauaacu

SEQ ID NO: 611202 - RNA, 22 nt, Human
agggcgaggagacggaggcaca

SEQ ID NO: 611203 - RNA, 22 nt, Human
ucuuucggccauagcgaugauu

SEQ ID NO: 611204 - RNA, 22 nt, Human
ugcagggcacggugcgcguggg

SEQ ID NO: 611205 - RNA, 22 nt, Human
cagcucccgccaucgggaggca

SEQ ID NO: 611206 - RNA, 22 nt, Human
aucaguaggccaagcagcuggc

SEQ ID NO: 611207 - RNA, 22 nt, Human
uggccugucuuguugugcuaga

SEQ ID NO: 611208 - RNA, 22 nt, Human
cugagguggcauccuagcucua

SEQ ID NO: 611209 - RNA, 22 nt, Human
uaagaggcauuagagacauagc

SEQ ID NO: 611210 - RNA, 22 nt, Human
uucauacaaugggauauuauga

SEQ ID NO: 611211 - RNA, 22 nt, Human
uccaggagaccagauguaggcc

SEQ ID NO: 611212 - RNA, 22 nt, Human
uccugagguggauugagcagag

SEQ ID NO: 611213 - RNA, 22 nt, Human
auacuuaugauaaauaauugcu

SEQ ID NO: 611214 - RNA, 22 nt, Human
uacaagagcaguaagcuugucc

SEQ ID NO: 611215 - RNA, 20 nt, Human
ucaggcaguggggaaaggca

SEQ ID NO: 611216 - RNA, 22 nt, Human
gcaauacaguagguuuauuggu

SEQ ID NO: 611217 - RNA, 22 nt, Human
ucccugggcaucacguugcuuc

SEQ ID NO: 611218 - RNA, 22 nt, Human
cccuccauuaaaacagaccuau

SEQ ID NO: 611219 - RNA, 19 nt, Human
uugcugaaggaagccucug

SEQ ID NO: 611220 - RNA, 22 nt, Human
uuuaucuuuaggacuuugcaga

SEQ ID NO: 611221 - RNA, 22 nt, Human
ggcuugaagacuaugacauuuc

SEQ ID NO: 611222 - RNA, 20 nt, Human
gucuuguagcucaaguuauu

SEQ ID NO: 611223 - RNA, 22 nt, Human
uucaauucaauucuaaauauau

SEQ ID NO: 611224 - RNA, 17 nt, Human
ccagcugcucccucaga

SEQ ID NO: 611225 - RNA, 22 nt, Human
uggcucuguucgccaucaggag

SEQ ID NO: 611226 - RNA, 17 nt, Human
ggugaguguccaggugg

SEQ ID NO: 611227 - RNA, 22 nt, Human
gugcagugaaaaaagaaugucc

SEQ ID NO: 611228 - RNA, 22 nt, Human
cugucuccgcccucuugguagg

SEQ ID NO: 611229 - RNA, 22 nt, Human
cuucuucccagcuucccucacc

SEQ ID NO: 611230 - RNA, 22 nt, Human
guguuuucucuccagcaggcag

SEQ ID NO: 611231 - RNA, 22 nt, Human
ugcauguuaagaaaauauugag

SEQ ID NO: 611232 - RNA, 22 nt, Human
uccagaggcaaaaagguaugga

SEQ ID NO: 611233 - RNA, 22 nt, Human
ucucugugagauuuguauuaag

SEQ ID NO: 611234 - RNA, 22 nt, Human
uucuggaaguguuagaaucugg

SEQ ID NO: 611235 - RNA, 22 nt, Human
gcagcugcaauaggcaucaagc

SEQ ID NO: 611236 - RNA, 22 nt, Human
aauacagauauucagugguacu

SEQ ID NO: 611237 - RNA, 22 nt, Human
agccuucucugaaauucuguuu

SEQ ID NO: 611238 - RNA, 22 nt, Human
uaaguuucuccaaagcacagaa

SEQ ID NO: 611239 - RNA, 22 nt, Human
ggacacuguauaaguuagagua

SEQ ID NO: 611240 - RNA, 22 nt, Human
uacaaagucacauugaaaugaa

SEQ ID NO: 611241 - RNA, 20 nt, Human
uaugcaguauguguguauaa

SEQ ID NO: 611242 - RNA, 22 nt, Human
ggagcugggacccugucaucug

SEQ ID NO: 611243 - RNA, 22 nt, Human
gucaggggaugugcugguggcc

SEQ ID NO: 611244 - RNA, 22 nt, Human
agguuggcugcucuuuuccuaa

SEQ ID NO: 611245 - RNA, 22 nt, Human
uggugcugacaguucugagugc

SEQ ID NO: 611246 - RNA, 22 nt, Human
gucugcccucacgccagcuggg

SEQ ID NO: 611247 - RNA, 17 nt, Human
cugggauguggacucuu

SEQ ID NO: 611248 - RNA, 22 nt, Human
aggagcccagccugggcucgga

SEQ ID NO: 611249 - RNA, 22 nt, Human
ggaccuggcaauuugcaucucu

SEQ ID NO: 611250 - RNA, 22 nt, Human
uuucagaaauggcacugaaauc

SEQ ID NO: 611251 - RNA, 22 nt, Human
agcaguuaccaaggaaccuggu

SEQ ID NO: 611252 - RNA, 22 nt, Human
ugucugaaagaggacgagcugg

SEQ ID NO: 611253 - RNA, 22 nt, Human
agcugagguugaagagugaacg

SEQ ID NO: 611254 - RNA, 22 nt, Human
auguuucugaaguuuacagaua

SEQ ID NO: 611255 - RNA, 22 nt, Human
gcccugagccaccaaugccauu

SEQ ID NO: 611256 - RNA, 22 nt, Human
uguguuggaaauagggucuuug

SEQ ID NO: 611257 - RNA, 22 nt, Human
uuauugaaauggaagcuauaac

SEQ ID NO: 611258 - RNA, 22 nt, Human
agagcuggccagggaucacucu

SEQ ID NO: 611259 - RNA, 22 nt, Human
auucuguguguacugagauggg

SEQ ID NO: 611260 - RNA, 22 nt, Human
cugggccuugcaucccagagcc

SEQ ID NO: 611261 - RNA, 22 nt, Human
aaggggagaugucaugggcccu

SEQ ID NO: 611262 - RNA, 22 nt, Human
ucaggaaaguguucucagagga

SEQ ID NO: 611263 - RNA, 22 nt, Human
gagaggauccacaaaccaggaa

SEQ ID NO: 611264 - RNA, 21 nt, Human
agggaaauccagucacuuuuc

SEQ ID NO: 611265 - RNA, 19 nt, Human
agauggggaagagugugag

SEQ ID NO: 611266 - RNA, 22 nt, Human
cugaaugauauaagaucuuucu

SEQ ID NO: 611267 - RNA, 22 nt, Human
gggugggacugaagucugaggg

SEQ ID NO: 611268 - RNA, 22 nt, Human
acuauaaaaggauaaaccagaa

SEQ ID NO: 611269 - RNA, 22 nt, Human
uaauauacuucccauaguuuga

SEQ ID NO: 611270 - RNA, 22 nt, Human
aagcagaauuucccacuaguug

SEQ ID NO: 611271 - RNA, 19 nt, Human
acuuccugcccgcuccuuu

SEQ ID NO: 611272 - RNA, 22 nt, Human
uucaauucuaaacuaauauucu

SEQ ID NO: 611273 - RNA, 22 nt, Human
ccuguguggaaaccgcaugacg

SEQ ID NO: 611274 - RNA, 18 nt, Human
uccugccugcgggcuccc

SEQ ID NO: 611275 - RNA, 22 nt, Human
uuccagagguucucagcccugu

SEQ ID NO: 611276 - RNA, 22 nt, Human
uaugugacauaucucaguuuga

SEQ ID NO: 611277 - RNA, 22 nt, Human
ugggcagagucguggggaauag

SEQ ID NO: 611278 - RNA, 22 nt, Human
uuagugucucaccuaaaaucug

SEQ ID NO: 611279 - RNA, 22 nt, Human
ugacauugugugcauuuaaagu

SEQ ID NO: 611280 - RNA, 22 nt, Human
cccuggagcaucucugcugucu

SEQ ID NO: 611281 - RNA, 22 nt, Human
cugaaugaguggauuuuucauu

SEQ ID NO: 611282 - RNA, 22 nt, Human
aaggaagaagacucuuuacucc

SEQ ID NO: 611283 - RNA, 19 nt, Human
gaggaacuggcuugguucc

SEQ ID NO: 611284 - RNA, 22 nt, Human
uccaguuuauuuuuggcagggu

SEQ ID NO: 611285 - RNA, 22 nt, Human
auauuuaaacaggguaccaaua

SEQ ID NO: 611286 - RNA, 22 nt, Human
cuccaacgaggcugggguacaa

SEQ ID NO: 611287 - RNA, 22 nt, Human
aggcaguucucguguguguccc

SEQ ID NO: 611288 - RNA, 22 nt, Human
ugcugaaucaaaacaaagguuu

SEQ ID NO: 611289 - RNA, 22 nt, Human
cucuccuuugaagcaacuguau

SEQ ID NO: 611290 - RNA, 22 nt, Human
cuguguuucugagaagugggga

SEQ ID NO: 611291 - RNA, 20 nt, Human
aguuuauuccaggagaacug

SEQ ID NO: 611292 - RNA, 18 nt, Human
agccaaggaggaggagga

SEQ ID NO: 611293 - RNA, 22 nt, Human
aaaugcacgcuacccagcuaga

SEQ ID NO: 611294 - RNA, 22 nt, Human
uuugcaaauacagaggucuugc

SEQ ID NO: 611295 - RNA, 22 nt, Human
aggcuugacugcugauuuugcc

SEQ ID NO: 611296 - RNA, 22 nt, Human
ccuggguuaguaucuguuucca

SEQ ID NO: 611297 - RNA, 22 nt, Human
ucacuggggagcacugacaugu

SEQ ID NO: 611298 - RNA, 22 nt, Human
uccauggggcccaggaugagag

SEQ ID NO: 611299 - RNA, 22 nt, Human
cuaacuacaagcggggcauccu

SEQ ID NO: 611300 - RNA, 22 nt, Human
ugauauuuuaugagcuuucaua

SEQ ID NO: 611301 - RNA, 22 nt, Human
cuugggugugaccuuggcauug

SEQ ID NO: 611302 - RNA, 22 nt, Human
gccuccccaaagugcugacagc

SEQ ID NO: 611303 - RNA, 22 nt, Human
agccaguuuccagauauuaacu

SEQ ID NO: 611304 - RNA, 22 nt, Human
caacacagguucugcaaaggaa

SEQ ID NO: 611305 - RNA, 22 nt, Human
aaucuucuuucuuaacaguaca

SEQ ID NO: 611306 - RNA, 19 nt, Human
auggcucugggaucacugc

SEQ ID NO: 611307 - RNA, 22 nt, Human
augcugaaauuuauugguaagg

SEQ ID NO: 611308 - RNA, 17 nt, Human
ggccagaggcggggcug

SEQ ID NO: 611309 - RNA, 22 nt, Human
ucuguacuuccuuuaaacuuua

SEQ ID NO: 611310 - RNA, 22 nt, Human
caguccuugcuaugacccugag

SEQ ID NO: 611311 - RNA, 22 nt, Human
cugcagggagaggggacagccu

SEQ ID NO: 611312 - RNA, 22 nt, Human
acugcaacaccuccuggguuca

SEQ ID NO: 611313 - RNA, 22 nt, Human
gggcacuguacacugugcaugg

SEQ ID NO: 611314 - RNA, 22 nt, Human
gggauggggagcuggaaagggg

SEQ ID NO: 611315 - RNA, 22 nt, Human
caccugagugucaguauucuca

SEQ ID NO: 611316 - RNA, 22 nt, Human
uggccucugcaauggauucacc

SEQ ID NO: 611317 - RNA, 22 nt, Human
agcagggguggaagguagcuuu

SEQ ID NO: 611318 - RNA, 22 nt, Human
acaauaauguauugccaaaagu

SEQ ID NO: 611319 - RNA, 22 nt, Human
uaguauuugcagauuuguguca

SEQ ID NO: 611320 - RNA, 19 nt, Human
ucucucuguacauuagaua

SEQ ID NO: 611321 - RNA, 22 nt, Human
cuccucucuggaguuaugcaga

SEQ ID NO: 611322 - RNA, 22 nt, Human
augggcagacagggagcucacg

SEQ ID NO: 611323 - RNA, 22 nt, Human
caagcagggauacugcagggag

SEQ ID NO: 611324 - RNA, 22 nt, Human
ucuccaggggcugcugugccac

SEQ ID NO: 611325 - RNA, 22 nt, Human
caggcccugccuugagggaccu

SEQ ID NO: 611326 - RNA, 22 nt, Human
ugcaugugucgggccugugcua

SEQ ID NO: 611327 - RNA, 22 nt, Human
agggcugccugacuccagagcc

SEQ ID NO: 611328 - RNA, 22 nt, Human
gcacccagugggaugcuuagca

SEQ ID NO: 611329 - RNA, 22 nt, Human
uguacaaauucauugaacugua

SEQ ID NO: 611330 - RNA, 22 nt, Human
ugugugugaaccauugagggcu

SEQ ID NO: 611331 - RNA, 22 nt, Human
agcacagagaagauuucaauua

SEQ ID NO: 611332 - RNA, 22 nt, Human
ggaaaagaauugcagugaagua

SEQ ID NO: 611333 - RNA, 22 nt, Human
gccugguguccagaggcgagug

SEQ ID NO: 611334 - RNA, 22 nt, Human
uccuggugggacagaaaaccuc

SEQ ID NO: 611335 - RNA, 22 nt, Human
acagccagggucucaggaggcg

SEQ ID NO: 611336 - RNA, 22 nt, Human
ggcuggagauaugucuggaaca

SEQ ID NO: 611337 - RNA, 22 nt, Human
gaggcuggaauauuagaaaugu

SEQ ID NO: 611338 - RNA, 21 nt, Human
aguauuucuucauguccuugc

SEQ ID NO: 611339 - RNA, 22 nt, Human
ccucagccuuggccccaggcag

SEQ ID NO: 611340 - RNA, 22 nt, Human
ccucucucuuguagucccugcc

SEQ ID NO: 611341 - RNA, 22 nt, Human
acuguguaugauauguacuggg

SEQ ID NO: 611342 - RNA, 22 nt, Human
auugacaauucuaugcagagca

SEQ ID NO: 611343 - RNA, 22 nt, Human
agugcaauguguacagaaaaau

SEQ ID NO: 611344 - RNA, 22 nt, Human
cucaguuuugcuagcuggaguu

SEQ ID NO: 611345 - RNA, 22 nt, Human
ucuccacaagcuuucuccuuuu

SEQ ID NO: 611346 - RNA, 21 nt, Human
agugaagagugaaacacaugg

SEQ ID NO: 611347 - RNA, 22 nt, Human
aaacaacuucugcacuaugggu

SEQ ID NO: 611348 - RNA, 22 nt, Human
ugggcugagcacugaggaagga

SEQ ID NO: 611349 - RNA, 20 nt, Human
ucuguuauuauuacauugcc

SEQ ID NO: 611350 - RNA, 22 nt, Human
aaguuauaucaucucauugacg

SEQ ID NO: 611351 - RNA, 22 nt, Human
agggaaggaggccauguguccc

SEQ ID NO: 611352 - RNA, 22 nt, Human
aacaaagucguugccuagaaga

SEQ ID NO: 611353 - RNA, 22 nt, Human
ccacagaaaauaaagcacgauu

SEQ ID NO: 611354 - RNA, 22 nt, Human
augaggucaucuugaaguaggg

SEQ ID NO: 611355 - RNA, 22 nt, Human
cccuuagcuggugagcccagcg

SEQ ID NO: 611356 - RNA, 22 nt, Human
cccaggccccagggcuugucag

SEQ ID NO: 611357 - RNA, 22 nt, Human
aaccagcucugcaaaaugucau

SEQ ID NO: 611358 - RNA, 22 nt, Human
gaguuugugggaauggaguauu

SEQ ID NO: 611359 - RNA, 22 nt, Human
aucuaaagugucauaaguagcu

SEQ ID NO: 611360 - RNA, 22 nt, Human
uuagaaaaaggcuguggucuua

SEQ ID NO: 611361 - RNA, 22 nt, Human
aagucaauuaguaaacuuggaa

SEQ ID NO: 611362 - RNA, 22 nt, Human
aagcacagggacucaggaccgg

SEQ ID NO: 611363 - RNA, 22 nt, Human
uuuguguuggaagaaaugcuac

SEQ ID NO: 611364 - RNA, 22 nt, Human
uucacagugguaaggguuguga

SEQ ID NO: 611365 - RNA, 22 nt, Human
augcauugaggaugacaugagu

SEQ ID NO: 611366 - RNA, 22 nt, Human
augcuuccagauugguaggggu

SEQ ID NO: 611367 - RNA, 22 nt, Human
uuuugucagugagaacagaguu

SEQ ID NO: 611368 - RNA, 22 nt, Human
aagacagugacagucacaauug

SEQ ID NO: 611369 - RNA, 23 nt, Human
uggagaauucagucuuuguuuug

SEQ ID NO: 611370 - RNA, 22 nt, Human
caugaaaugauauuuggguggg

SEQ ID NO: 611371 - RNA, 22 nt, Human
uucauugauuuccuuggaauaa

SEQ ID NO: 611372 - RNA, 22 nt, Human
gugcuuccuguauugauuccau

SEQ ID NO: 611373 - RNA, 22 nt, Human
ucuuugcauggacauguguuuu

SEQ ID NO: 611374 - RNA, 22 nt, Human
aaugcaaugcagcaccuccuug

SEQ ID NO: 611375 - RNA, 22 nt, Human
aggacagagggaccagagccca

SEQ ID NO: 611376 - RNA, 22 nt, Human
gucacucaggcuggaguucagu

SEQ ID NO: 611377 - RNA, 22 nt, Human
uuacuguagcuugacauauguc

SEQ ID NO: 611378 - RNA, 22 nt, Human
guuaacaacacugugagugcug

SEQ ID NO: 611379 - RNA, 22 nt, Human
gaugaguucuuucuauucuauu

SEQ ID NO: 611380 - RNA, 22 nt, Human
ucagaagucuggacugcuucuc

SEQ ID NO: 611381 - RNA, 22 nt, Human
auccauuugccgugcuaugugc

SEQ ID NO: 611382 - RNA, 18 nt, Human
uauaaacacacuuagguu

SEQ ID NO: 611383 - RNA, 22 nt, Human
auucugcugccuaguuuaugaa

SEQ ID NO: 611384 - RNA, 22 nt, Human
uaaaacuagugguugggacuaa

SEQ ID NO: 611385 - RNA, 22 nt, Human
gcuuuggaaauauagacucaag

SEQ ID NO: 611386 - RNA, 22 nt, Human
auucucuguacagaagguaccg

SEQ ID NO: 611387 - RNA, 22 nt, Human
ucugcucagccgaucugcuccg

SEQ ID NO: 611388 - RNA, 22 nt, Human
uacagcuugauguuuguguguu

SEQ ID NO: 611389 - RNA, 22 nt, Human
acaguguuacuugauaguguau

SEQ ID NO: 611390 - RNA, 22 nt, Human
aguacaagugaugugguaaaaa

SEQ ID NO: 611391 - RNA, 22 nt, Human
aggaauuugggguuacaugaug

SEQ ID NO: 611392 - RNA, 22 nt, Human
cacaguuuuaucuuauacugau

SEQ ID NO: 611393 - RNA, 21 nt, Human
aguuagcagauuucugucucc

SEQ ID NO: 611394 - RNA, 22 nt, Human
cuguauaugugcauacacacac

SEQ ID NO: 611395 - RNA, 22 nt, Human
uuuuuggguccaggcuguaucu

SEQ ID NO: 611396 - RNA, 22 nt, Human
gcaguuaccuauuuuguagaaa

SEQ ID NO: 611397 - RNA, 22 nt, Human
cagcuccaucuugcuuauacca

SEQ ID NO: 611398 - RNA, 22 nt, Human
guguaucaaagcacagacuuca

SEQ ID NO: 611399 - RNA, 22 nt, Human
auguaagagcuuugcagggaaa

SEQ ID NO: 611400 - RNA, 22 nt, Human
uuucugugauaggcugcgacgc

SEQ ID NO: 611401 - RNA, 22 nt, Human
uacuuugucauucuaaccuucc

SEQ ID NO: 611402 - RNA, 22 nt, Human
caauaauugcuuuccagaguua

SEQ ID NO: 611403 - RNA, 22 nt, Human
aguggcugugaaauacauggga

SEQ ID NO: 611404 - RNA, 22 nt, Human
gugauuuucuccuccuagaagu

SEQ ID NO: 611405 - RNA, 22 nt, Human
agacagcgaggacagaggggug

SEQ ID NO: 611406 - RNA, 22 nt, Human
caugucaagacugaagauccag

SEQ ID NO: 611407 - RNA, 22 nt, Human
uuauuugcccauguuuagcaga

SEQ ID NO: 611408 - RNA, 19 nt, Human
caguuuguccagaggggac

SEQ ID NO: 611409 - RNA, 22 nt, Human
agaaaucugacugcugugcaca

SEQ ID NO: 611410 - RNA, 22 nt, Human
aauguuugaacuuugcauauuu

SEQ ID NO: 611411 - RNA, 22 nt, Human
auguaugagagauucuuuuauu

SEQ ID NO: 611412 - RNA, 22 nt, Human
gccagaggggcucgaaggcgcg

SEQ ID NO: 611413 - RNA, 22 nt, Human
aucuucaaggaaaaaauacagu

SEQ ID NO: 611414 - RNA, 22 nt, Human
uuauuuaaaauguagguuggga

SEQ ID NO: 611415 - RNA, 22 nt, Human
ucagacaccgucuauuuugccu

SEQ ID NO: 611416 - RNA, 22 nt, Human
gucaucaucaggcagaugcugc

SEQ ID NO: 611417 - RNA, 21 nt, Human
uguguucuucuaggucagcua

SEQ ID NO: 611418 - RNA, 22 nt, Human
caagcagauauuuuagucaaga

SEQ ID NO: 611419 - RNA, 22 nt, Human
ucuuugcagaauuuaacuuugc

SEQ ID NO: 611420 - RNA, 22 nt, Human
aacacaguuucugcauugguag

SEQ ID NO: 611421 - RNA, 22 nt, Human
ucacuacaaccgcuaccugaca

SEQ ID NO: 611422 - RNA, 21 nt, Human
cuuuucuagucccagccccgc

SEQ ID NO: 611423 - RNA, 22 nt, Human
uacaguaaccagucuacuuaga

SEQ ID NO: 611424 - RNA, 22 nt, Human
auuugugggacuauaaugcagg

SEQ ID NO: 611425 - RNA, 22 nt, Human
gaaagagaaccugggccuagau

SEQ ID NO: 611426 - RNA, 22 nt, Human
cuucucaaaguugugaaucagg

SEQ ID NO: 611427 - RNA, 22 nt, Human
agugaaaaccuaaucaugcagu

SEQ ID NO: 611428 - RNA, 22 nt, Human
aggcagagaaaaaccagauaug

SEQ ID NO: 611429 - RNA, 22 nt, Human
uaccaaaaccaagccauuaucu

SEQ ID NO: 611430 - RNA, 22 nt, Human
uaucacauacuucucauccagg

SEQ ID NO: 611431 - RNA, 22 nt, Human
aaaagagccacuuaugaccuca

SEQ ID NO: 611432 - RNA, 22 nt, Human
uuugagaagauaggggaauacu

SEQ ID NO: 611433 - RNA, 22 nt, Human
acauauuuugaaagcuuucuaa

SEQ ID NO: 611434 - RNA, 22 nt, Human
gcuuucuuuucaagaauguauu

SEQ ID NO: 611435 - RNA, 22 nt, Human
aucuuacaauuacaagacacuc

SEQ ID NO: 611436 - RNA, 22 nt, Human
acagagacaauauuuguaaagu

SEQ ID NO: 611437 - RNA, 22 nt, Human
guuuuguucaugaacauugggu

SEQ ID NO: 611438 - RNA, 22 nt, Human
cuccaggacugaggacagagcu

SEQ ID NO: 611439 - RNA, 23 nt, Human
gacagguaaggguugggagaauc

SEQ ID NO: 611440 - RNA, 22 nt, Human
gacacuacguggcucacauuuc

SEQ ID NO: 611441 - RNA, 22 nt, Human
uauugccaaaugucugcuggaa

SEQ ID NO: 611442 - RNA, 19 nt, Human
acacaccagugccugugac

SEQ ID NO: 611443 - RNA, 22 nt, Human
agcuuuauuugucauucacggc

SEQ ID NO: 611444 - RNA, 22 nt, Human
aucucuguaaaccauaaauuga

SEQ ID NO: 611445 - RNA, 22 nt, Human
aguuuccacuggagacacugug

SEQ ID NO: 611446 - RNA, 22 nt, Human
aaaacauuuuacugccaucuca

SEQ ID NO: 611447 - RNA, 22 nt, Human
gaaacauuuguugaguacuugc

SEQ ID NO: 611448 - RNA, 22 nt, Human
ucacagcugggguuuuggcagc

SEQ ID NO: 611449 - RNA, 22 nt, Human
caaacuuacuguguuuaaagag

SEQ ID NO: 611450 - RNA, 21 nt, Human
uugauuuagcagaucuagcug

SEQ ID NO: 611451 - RNA, 22 nt, Human
ccaggcaaagcccaugcaagag

SEQ ID NO: 611452 - RNA, 22 nt, Human
aaggcacauauuuuagagucac

SEQ ID NO: 611453 - RNA, 22 nt, Human
uuuacuucugcauuuccccuag

SEQ ID NO: 611454 - RNA, 22 nt, Human
uugagauagguggaaucucuuu

SEQ ID NO: 611455 - RNA, 22 nt, Human
ugaagcuagaauguccauauuu

SEQ ID NO: 611456 - RNA, 22 nt, Human
uuuaggaagaguugaguaaauu

SEQ ID NO: 611457 - RNA, 22 nt, Human
caagauauguccuguuacuaag

SEQ ID NO: 611458 - RNA, 22 nt, Human
ugaaacagucuccagacuugga

SEQ ID NO: 611459 - RNA, 22 nt, Human
uuuauucucuaguuggucagau

SEQ ID NO: 611460 - RNA, 22 nt, Human
agagacauagcacaguuuuucg

SEQ ID NO: 611461 - RNA, 22 nt, Human
cugaaagcaaaguaauucuuaa

SEQ ID NO: 611462 - RNA, 18 nt, Human
ucagacaaguuagacagg

SEQ ID NO: 611463 - RNA, 22 nt, Human
aaggcauggcaggguuuacaca

SEQ ID NO: 611464 - RNA, 21 nt, Human
uaagccaccaugugaaaccag

SEQ ID NO: 611465 - RNA, 19 nt, Human
cagcaaacacuguaaaugg

SEQ ID NO: 611466 - RNA, 22 nt, Human
augguuuuguccucuuugguuc

SEQ ID NO: 611467 - RNA, 22 nt, Human
cuuauguaaacuacagauaaua

SEQ ID NO: 611468 - RNA, 22 nt, Human
aauggagugguucuugcccucu

SEQ ID NO: 611469 - RNA, 22 nt, Human
uccacagguccucuuugcaaag

SEQ ID NO: 611470 - RNA, 22 nt, Human
gaaucucaggggaguuacugga

SEQ ID NO: 611471 - RNA, 22 nt, Human
uuaaguauauccauuugacugg

SEQ ID NO: 611472 - RNA, 23 nt, Human
gguucugccgcuuacugcugugc

SEQ ID NO: 611473 - RNA, 22 nt, Human
ucaggagaguguucaguggagg

SEQ ID NO: 611474 - RNA, 22 nt, Human
auucaugcaggauugucuccaa

SEQ ID NO: 611475 - RNA, 23 nt, Human
aaauugucguaagguggagaugu

SEQ ID NO: 611476 - RNA, 22 nt, Human
uaucuguagucucaugguuccu

SEQ ID NO: 611477 - RNA, 22 nt, Human
uucuucauucccuuacuuccga

SEQ ID NO: 611478 - RNA, 21 nt, Human
uaagcuaaacauucaguuaac

SEQ ID NO: 611479 - RNA, 22 nt, Human
aaugaaacuaguagaaucuuug

SEQ ID NO: 611480 - RNA, 22 nt, Human
guuugagauggguuauugcucu

SEQ ID NO: 611481 - RNA, 22 nt, Human
uucagaaagugaaucuuguuau

SEQ ID NO: 611482 - RNA, 22 nt, Human
cagcugcuguucaguuuuguuu

SEQ ID NO: 611483 - RNA, 22 nt, Human
auuucauccauuaagaguacuc

SEQ ID NO: 611484 - RNA, 22 nt, Human
gugaagaugccucaggugaccc

SEQ ID NO: 611485 - RNA, 22 nt, Human
aaugaguuuguucuauuauuug

SEQ ID NO: 611486 - RNA, 22 nt, Human
uucaguaagcacuucuagagcu

SEQ ID NO: 611487 - RNA, 23 nt, Human
cguuuuuuccucagauguucugg

SEQ ID NO: 611488 - RNA, 17 nt, Human
ugcaugcgucugugaua

SEQ ID NO: 611489 - RNA, 20 nt, Human
gacuucaauuucuaucuuuu

SEQ ID NO: 611490 - RNA, 22 nt, Human
uuuggagagaugaaguucugug

SEQ ID NO: 611491 - RNA, 21 nt, Human
ugcauauauaagugcauacac

SEQ ID NO: 611492 - RNA, 19 nt, Human
agcagccaucgaccaugga

SEQ ID NO: 611493 - RNA, 22 nt, Human
acuucagugugguauaaaacgu

SEQ ID NO: 611494 - RNA, 22 nt, Human
aagacacuuucuaaauagaagu

SEQ ID NO: 611495 - RNA, 22 nt, Human
uccugucucaguguauuugcag

SEQ ID NO: 611496 - RNA, 22 nt, Human
cuaguauuaagugugaguaaaa

SEQ ID NO: 611497 - RNA, 22 nt, Human
cauugcugugggcauuugcugc

SEQ ID NO: 611498 - RNA, 22 nt, Human
uuuccaguuguucuagaaagcu

SEQ ID NO: 611499 - RNA, 22 nt, Human
gacaguggagccacguugggag

SEQ ID NO: 611500 - RNA, 22 nt, Human
cagcaguguacaaggugucaga

SEQ ID NO: 611501 - RNA, 22 nt, Human
cagacagagucuucccaucagu

SEQ ID NO: 611502 - RNA, 22 nt, Human
uugcuauuuugagagucauagu

SEQ ID NO: 611503 - RNA, 22 nt, Human
aagggaaacuuucacaaugucc

SEQ ID NO: 611504 - RNA, 23 nt, Human
uuguucuuggaucuuccugaagc

SEQ ID NO: 611505 - RNA, 22 nt, Human
cagcugcucugguggucucucc

SEQ ID NO: 611506 - RNA, 19 nt, Human
aaggcuuucugagugaaaa

SEQ ID NO: 611507 - RNA, 22 nt, Human
auuucagaguagaucguuauuu

SEQ ID NO: 611508 - RNA, 22 nt, Human
ucaucuccauacggucucgcag

SEQ ID NO: 611509 - RNA, 22 nt, Human
acauuuaaugauccuacuguga

SEQ ID NO: 611510 - RNA, 22 nt, Human
accuuuaugaaacagcugucgu

SEQ ID NO: 611511 - RNA, 22 nt, Human
gcugcuuugucuguaaaaugga

SEQ ID NO: 611512 - RNA, 22 nt, Human
uuugcaaaguccauugaaguua

SEQ ID NO: 611513 - RNA, 22 nt, Human
auguucaaguaccuuugugucu

SEQ ID NO: 611514 - RNA, 22 nt, Human
uauggcaagaugacauguucuc

SEQ ID NO: 611515 - RNA, 18 nt, Human
ucaugcaaacgcuucaua

SEQ ID NO: 611516 - RNA, 22 nt, Human
uaaagcaaugaaaguuuugcag

SEQ ID NO: 611517 - RNA, 23 nt, Human
aguguucagcauguaguaaauac

SEQ ID NO: 611518 - RNA, 22 nt, Human
uuggaauuugagaccaagaaaa

SEQ ID NO: 611519 - RNA, 22 nt, Human
ccaagaggggcagagggcugca

SEQ ID NO: 611520 - RNA, 22 nt, Human
ugagacaaagcagcugacagaa

SEQ ID NO: 611521 - RNA, 20 nt, Human
aauagcacagcucaaacauu

SEQ ID NO: 611522 - RNA, 22 nt, Human
ucuuccagauacuuccugacuu

SEQ ID NO: 611523 - RNA, 22 nt, Human
aaggauuuuuggaaugagaugg

SEQ ID NO: 611524 - RNA, 22 nt, Human
ccagagaggccuuggcaagaca

SEQ ID NO: 611525 - RNA, 22 nt, Human
cugagcagucuagccagguguu

SEQ ID NO: 611526 - RNA, 22 nt, Human
augcuugcccauguuucugaag

SEQ ID NO: 611527 - RNA, 22 nt, Human
cucugaguagauagggaaccug

SEQ ID NO: 611528 - RNA, 22 nt, Human
auugagaaaauucgagcaaguu

SEQ ID NO: 611529 - RNA, 20 nt, Human
uugagcuuuuaguacagaca

SEQ ID NO: 611530 - RNA, 22 nt, Human
uaauccaaaacugaaucugugg

SEQ ID NO: 611531 - RNA, 22 nt, Human
caaagaagagauuuacagagcu

SEQ ID NO: 611532 - RNA, 22 nt, Human
acaaguuucauuguuuagaacc

SEQ ID NO: 611533 - RNA, 22 nt, Human
gaugucuucagauggcaagaga

SEQ ID NO: 611534 - RNA, 21 nt, Human
auucaaagaagaggaaggccc

SEQ ID NO: 611535 - RNA, 22 nt, Human
gcgguauuugugugggugucga

SEQ ID NO: 611536 - RNA, 22 nt, Human
agaaggcaucagaaguguguag

SEQ ID NO: 611537 - RNA, 22 nt, Human
uaaguauuggccuauagcuaga

SEQ ID NO: 611538 - RNA, 20 nt, Human
uguauuuaaugaaggcuuuu

SEQ ID NO: 611539 - RNA, 23 nt, Human
agcaacagugggugaguguugcu

SEQ ID NO: 611540 - RNA, 20 nt, Human
uucaugcagugguugcugug

SEQ ID NO: 611541 - RNA, 20 nt, Human
uauuucugggcaaccauuua

SEQ ID NO: 611542 - RNA, 22 nt, Human
auucuagaguuucaauccaagg

SEQ ID NO: 611543 - RNA, 22 nt, Human
acuuuuaaggggccuugauuua

SEQ ID NO: 611544 - RNA, 22 nt, Human
auacaugacucacacauucugc

SEQ ID NO: 611545 - RNA, 21 nt, Human
gucuuuuuaauugcgauuucc

SEQ ID NO: 611546 - RNA, 22 nt, Human
acugccaguuguuuuguccagu

SEQ ID NO: 611547 - RNA, 22 nt, Human
guaauagucucaaacuccugga

SEQ ID NO: 611548 - RNA, 22 nt, Human
ucuucaugucucugcuugaguc

SEQ ID NO: 611549 - RNA, 22 nt, Human
uccguuuucacacugcuauaaa

SEQ ID NO: 611550 - RNA, 22 nt, Human
cagguguugcaguugaagacug

SEQ ID NO: 611551 - RNA, 22 nt, Human
auuaguguuguggcuucauggc

SEQ ID NO: 611552 - RNA, 23 nt, Human
ggacaugucucuggguauuuuga

SEQ ID NO: 611553 - RNA, 22 nt, Human
agauuauuuaagacaggaacca

SEQ ID NO: 611554 - RNA, 22 nt, Human
uucguuuaguccacaaaugcau

SEQ ID NO: 611555 - RNA, 22 nt, Human
aaggcuauaucucaauacuauu

SEQ ID NO: 611556 - RNA, 22 nt, Human
uucacagcucauacuguucuca

SEQ ID NO: 611557 - RNA, 22 nt, Human
uuucaaguagagggaucgcuag

SEQ ID NO: 611558 - RNA, 22 nt, Human
uuuaauuuucugggcccagcag

SEQ ID NO: 611559 - RNA, 22 nt, Human
uuacaguuuacauaagaauugu

SEQ ID NO: 611560 - RNA, 22 nt, Human
ucagagacaucagguuguagca

SEQ ID NO: 611561 - RNA, 22 nt, Human
agagaauuaacauuccauggcu

SEQ ID NO: 611562 - RNA, 22 nt, Human
gauuguacuuauugagcuaaac

SEQ ID NO: 611563 - RNA, 22 nt, Human
guugaaauccuaacccccuagu

SEQ ID NO: 611564 - RNA, 21 nt, Human
uaaacauaaccuuguauggcu

SEQ ID NO: 611565 - RNA, 22 nt, Human
aagaauaagaggauuuagaaca

SEQ ID NO: 611566 - RNA, 22 nt, Human
gauuuucauuauagcuaguuuc

SEQ ID NO: 611567 - RNA, 22 nt, Human
auagcaaaggacaauagucagu

SEQ ID NO: 611568 - RNA, 22 nt, Human
auuaaauuggacgcugggggaa

SEQ ID NO: 611569 - RNA, 22 nt, Human
cagggacucgcuggacauaccg

SEQ ID NO: 611570 - RNA, 22 nt, Human
ugaaauguggagaugguaagua

SEQ ID NO: 611571 - RNA, 22 nt, Human
aucgaguucugaugucccuucu

SEQ ID NO: 611572 - RNA, 22 nt, Human
gaaguauuucugaguugcccag

SEQ ID NO: 611573 - RNA, 22 nt, Human
auuaauaucccccgccguucug

SEQ ID NO: 611574 - RNA, 22 nt, Human
ugucuucuaccuugacagcauu

SEQ ID NO: 611575 - RNA, 22 nt, Human
cauaacuugguguuggaaacug

SEQ ID NO: 611576 - RNA, 21 nt, Human
aaagugguaaggauuauuuug

SEQ ID NO: 611577 - RNA, 20 nt, Human
aaaaacaguaaugcugaaga

SEQ ID NO: 611578 - RNA, 22 nt, Human
guuuccaagucucucaacaccc

SEQ ID NO: 611579 - RNA, 22 nt, Human
gagguauaguucuauuagauga

SEQ ID NO: 611580 - RNA, 22 nt, Human
uaaaaucaugacagauugacau

SEQ ID NO: 611581 - RNA, 22 nt, Human
uuguauuaaaauguguuucugu

SEQ ID NO: 611582 - RNA, 22 nt, Human
cuucuaauucuuauguaagcuu

SEQ ID NO: 611583 - RNA, 22 nt, Human
uauuucagcucuuuggauuauc

SEQ ID NO: 611584 - RNA, 22 nt, Human
aauaguguauuuuucaaaauua

SEQ ID NO: 611585 - RNA, 22 nt, Human
uucaaacacugcuuugagaggg

SEQ ID NO: 611586 - RNA, 22 nt, Human
cuugcuuuaucugguuucucau

SEQ ID NO: 611587 - RNA, 22 nt, Human
uuguuuaaagaacuucugacuu

SEQ ID NO: 611588 - RNA, 22 nt, Human
uucuguuuauaauuugcaguug

SEQ ID NO: 611589 - RNA, 21 nt, Human
ucccacuggcccagggcucca

SEQ ID NO: 611590 - RNA, 22 nt, Human
aggugcuuggcucgugcacaca

SEQ ID NO: 611591 - RNA, 22 nt, Human
cacuuggaggaaggccuauuca

SEQ ID NO: 611592 - RNA, 22 nt, Human
aauagcaaaugcucauuugaaa

SEQ ID NO: 611593 - RNA, 22 nt, Human
auugaagacuugguauccgugg

SEQ ID NO: 611594 - RNA, 22 nt, Human
auacuaagcucauuacauuuug

SEQ ID NO: 611595 - RNA, 22 nt, Human
uuguugcaagccuggaaucugg

SEQ ID NO: 611596 - RNA, 22 nt, Human
aagcgcagacacagagagugga

SEQ ID NO: 611597 - RNA, 22 nt, Human
gaacaguuucccuguagaaaau

SEQ ID NO: 611598 - RNA, 22 nt, Human
ucacuuuaccucauucaggcag

SEQ ID NO: 611599 - RNA, 23 nt, Human
uguacacuuggucaagguacuua

SEQ ID NO: 611600 - RNA, 23 nt, Human
aucauagucuuugugacuggccc

SEQ ID NO: 611601 - RNA, 22 nt, Human
ucuuuuccuugaugguuaaaua

SEQ ID NO: 611602 - RNA, 22 nt, Human
ucuucagacuguuguucuuuug

SEQ ID NO: 611603 - RNA, 22 nt, Human
uuguuuguaaggcucuuagaau

SEQ ID NO: 611604 - RNA, 22 nt, Human
agauaucuuacacuuugaaguu

SEQ ID NO: 611605 - RNA, 22 nt, Human
cuuuacagauggauaauuguuu

SEQ ID NO: 611606 - RNA, 22 nt, Human
uuugcuugauuaggauauggaa

SEQ ID NO: 611607 - RNA, 20 nt, Human
uugaggagauauugaauacu

SEQ ID NO: 611608 - RNA, 22 nt, Human
guuuugaauacuacuagaacuu

SEQ ID NO: 611609 - RNA, 22 nt, Human
auacacauguuauuguggaagc

SEQ ID NO: 611610 - RNA, 22 nt, Human
ugugacagugccagcuucauag

SEQ ID NO: 611611 - RNA, 22 nt, Human
ugucacagagcgugcaacagaa

SEQ ID NO: 611612 - RNA, 22 nt, Human
ugugcuugucguggagccaggc

SEQ ID NO: 611613 - RNA, 22 nt, Human
aaugagaauguaagugaagaga

SEQ ID NO: 611614 - RNA, 19 nt, Human
uuugauagggcauaauaua

SEQ ID NO: 611615 - RNA, 22 nt, Human
auuauugcaagcagugaaggga

SEQ ID NO: 611616 - RNA, 22 nt, Human
aaauucuguccugaaugccauu

SEQ ID NO: 611617 - RNA, 23 nt, Human
ccucaaauguagccuuuuuccca

SEQ ID NO: 611618 - RNA, 22 nt, Human
auccuucaaaaggaauagcagg

SEQ ID NO: 611619 - RNA, 22 nt, Human
gagucacauacuauguaauaga

SEQ ID NO: 611620 - RNA, 22 nt, Human
uguuuuaagggucaacugucac

SEQ ID NO: 611621 - RNA, 22 nt, Human
aagugauuucugccugcauguu

SEQ ID NO: 611622 - RNA, 18 nt, Human
gacaaaaguacagacaga

SEQ ID NO: 611623 - RNA, 22 nt, Human
guaauucugugugaaucuauua

SEQ ID NO: 611624 - RNA, 22 nt, Human
acagcuucgaggaucucauccc

SEQ ID NO: 611625 - RNA, 22 nt, Human
gcuugcuuuguaaauaucugug

SEQ ID NO: 611626 - RNA, 22 nt, Human
auguuuguguuucccauucagg

SEQ ID NO: 611627 - RNA, 22 nt, Human
ggcagaggagcuggaaacaugg

SEQ ID NO: 611628 - RNA, 22 nt, Human
caguuuuaugaaugcuuauuag

SEQ ID NO: 611629 - RNA, 22 nt, Human
uacugcaaaccauuuacaguag

SEQ ID NO: 611630 - RNA, 22 nt, Human
uuuucuaacaucuaguaauuug

SEQ ID NO: 611631 - RNA, 22 nt, Human
uuaguguccagaguuuuuauua

SEQ ID NO: 611632 - RNA, 22 nt, Human
gagaauguuaauguugaaguau

SEQ ID NO: 611633 - RNA, 22 nt, Human
aucagugacuucuuccaaaguu

SEQ ID NO: 611634 - RNA, 22 nt, Human
agaugguucagaauuauaaaga

SEQ ID NO: 611635 - RNA, 22 nt, Human
uuccaggacuggguguuugaag

SEQ ID NO: 611636 - RNA, 22 nt, Human
uugcacagaugcacaugguugc

SEQ ID NO: 611637 - RNA, 22 nt, Human
auguuguugaacucuuugcaug

SEQ ID NO: 611638 - RNA, 22 nt, Human
ugucuucauuccccaugaaguc

SEQ ID NO: 611639 - RNA, 22 nt, Human
auuaguagcacacagagaucag

SEQ ID NO: 611640 - RNA, 20 nt, Human
ucauaugugguuguauacaa

SEQ ID NO: 611641 - RNA, 22 nt, Human
uacuuugagaugaugcugaucg

SEQ ID NO: 611642 - RNA, 22 nt, Human
ucuuauaccccuaaacugcagc

SEQ ID NO: 611643 - RNA, 22 nt, Human
uucagucuuguugaaaacuugg

SEQ ID NO: 611644 - RNA, 22 nt, Human
ucuguggcauguugcacuugua

SEQ ID NO: 611645 - RNA, 22 nt, Human
uaaaguuuauuggcaccaccau

SEQ ID NO: 611646 - RNA, 22 nt, Human
agagaagagucuugucaaauua

SEQ ID NO: 611647 - RNA, 22 nt, Human
uaaaccuuauuugaauaccaac

SEQ ID NO: 611648 - RNA, 22 nt, Human
ugcaucauuaagguacaguugg

SEQ ID NO: 611649 - RNA, 22 nt, Human
aauuauugagcaucuacugugu

SEQ ID NO: 611650 - RNA, 22 nt, Human
agaacagaggccuuauguuuca

SEQ ID NO: 611651 - RNA, 22 nt, Human
acugguuuuggaaaucaguaca

SEQ ID NO: 611652 - RNA, 22 nt, Human
cuucauguacaguuauuggaga

SEQ ID NO: 611653 - RNA, 22 nt, Human
uuggaaauguagaaaagcagau

SEQ ID NO: 611654 - RNA, 22 nt, Human
cuccagaggcgacuugcaucac

SEQ ID NO: 611655 - RNA, 22 nt, Human
uuuacgaauggggugacaacuu

SEQ ID NO: 611656 - RNA, 22 nt, Human
guaaagcaaaauguagagauug

SEQ ID NO: 611657 - RNA, 22 nt, Human
uuccuuuucuucuaccacaugu

SEQ ID NO: 611658 - RNA, 22 nt, Human
uguauauacacacucccauguu

SEQ ID NO: 611659 - RNA, 22 nt, Human
aacagaaaucauuuagggcucu

SEQ ID NO: 611660 - RNA, 22 nt, Human
caauuaccaguaauugagguuu

SEQ ID NO: 611661 - RNA, 22 nt, Human
cacuguugaagauacuuccucu

SEQ ID NO: 611662 - RNA, 22 nt, Human
uuuucuuggaguggcuguccuu

SEQ ID NO: 611663 - RNA, 22 nt, Human
gguuccaggcauggcaggaugu

SEQ ID NO: 611664 - RNA, 22 nt, Human
uuagcacugucugguuaucuug

SEQ ID NO: 611665 - RNA, 22 nt, Human
cuucuuaaaguugucacagcug

SEQ ID NO: 611666 - RNA, 22 nt, Human
ugaaagcucugucaucauuccu

SEQ ID NO: 611667 - RNA, 22 nt, Human
cuuucuuucgaagacgugauua

SEQ ID NO: 611668 - RNA, 22 nt, Human
caacauuucaaggucuuuagga

SEQ ID NO: 611669 - RNA, 22 nt, Human
ccauuuguaccauuucuuugua

SEQ ID NO: 611670 - RNA, 22 nt, Human
uagaugaacagaaagccacugu

SEQ ID NO: 611671 - RNA, 22 nt, Human
cauuguuggcagagggacagag

SEQ ID NO: 611672 - RNA, 22 nt, Human
caguaaauguccucgcagggaa

SEQ ID NO: 611673 - RNA, 22 nt, Human
acucauguccuaggaguaaagc

SEQ ID NO: 611674 - RNA, 22 nt, Human
uauagugucucuagaucaaaga

SEQ ID NO: 611675 - RNA, 22 nt, Human
accuuguuguagguacaaaaga

SEQ ID NO: 611676 - RNA, 22 nt, Human
ucucugagaucagccacugacu

SEQ ID NO: 611677 - RNA, 22 nt, Human
cuggagauaagcagucccaggc

SEQ ID NO: 611678 - RNA, 22 nt, Human
uaaauacuuuuacuccacugau

SEQ ID NO: 611679 - RNA, 22 nt, Human
cugcaucaguggauaugauggu

SEQ ID NO: 611680 - RNA, 22 nt, Human
uugaauaguuuuggauagcaua

SEQ ID NO: 611681 - RNA, 23 nt, Human
aaugaguugggcagcauacaggc

SEQ ID NO: 611682 - RNA, 22 nt, Human
uucuccacccacucuuuuguug

SEQ ID NO: 611683 - RNA, 22 nt, Human
acuuugccuucuuacuguguug

SEQ ID NO: 611684 - RNA, 22 nt, Human
uuaccacagugccugucuaaug

SEQ ID NO: 611685 - RNA, 22 nt, Human
auacaugugugugcauacaugu

SEQ ID NO: 611686 - RNA, 22 nt, Human
cucagcaacagcgacuuaaggg

SEQ ID NO: 611687 - RNA, 22 nt, Human
agugcacuggcaccaucucagc

SEQ ID NO: 611688 - RNA, 22 nt, Human
augugaaagagguguucagugg

SEQ ID NO: 611689 - RNA, 22 nt, Human
ugaaucaaugaauugcacuuca

SEQ ID NO: 611690 - RNA, 23 nt, Human
aguacauuugacccaaauaagcu

SEQ ID NO: 611691 - RNA, 22 nt, Human
uucacagcuaagagcuaaguaa

SEQ ID NO: 611692 - RNA, 22 nt, Human
uuuccucacacagaagaucuug

SEQ ID NO: 611693 - RNA, 22 nt, Human
ugaggaaugugacaaaaccaag

SEQ ID NO: 611694 - RNA, 22 nt, Human
auuucagcagcccauguuugga

SEQ ID NO: 611695 - RNA, 22 nt, Human
uguaucauauggggaagcuuca

SEQ ID NO: 611696 - RNA, 22 nt, Human
guuuccagccuccuggguaaag

SEQ ID NO: 611697 - RNA, 22 nt, Human
ucuguucagaagaggugaaagu

SEQ ID NO: 611698 - RNA, 22 nt, Human
ucagaacauccugguuuaaaau

SEQ ID NO: 611699 - RNA, 22 nt, Human
ucuuagaaacuguaucgauuag

SEQ ID NO: 611700 - RNA, 22 nt, Human
aagagagaacucccuucgccag

SEQ ID NO: 611701 - RNA, 22 nt, Human
auuaaugaaacuuugguuaagc

SEQ ID NO: 611702 - RNA, 22 nt, Human
gcuguccugggaacaggcacua

SEQ ID NO: 611703 - RNA, 22 nt, Human
acaugcauaaacuacuucuuau

SEQ ID NO: 611704 - RNA, 22 nt, Human
aguucaauuguuuuguaaaagu

SEQ ID NO: 611705 - RNA, 22 nt, Human
uaagcuauuccugaagaagguu

SEQ ID NO: 611706 - RNA, 20 nt, Human
uugcaaagugaauagcaauu

SEQ ID NO: 611707 - RNA, 22 nt, Human
uauuacaguucgaguuucuagg

SEQ ID NO: 611708 - RNA, 22 nt, Human
augcuuucucuuaguucauuga

SEQ ID NO: 611709 - RNA, 22 nt, Human
cuggaucaugggaaagggauca

SEQ ID NO: 611710 - RNA, 22 nt, Human
cuggcuuugaucagagugaccu

SEQ ID NO: 611711 - RNA, 18 nt, Human
cgauguguaugugauuug

SEQ ID NO: 611712 - RNA, 22 nt, Human
auagcuuugagggcuccuuagg

SEQ ID NO: 611713 - RNA, 23 nt, Human
uaucauuucagcucucugccugg

SEQ ID NO: 611714 - RNA, 22 nt, Human
uaggaaauaauucacucuggcu

SEQ ID NO: 611715 - RNA, 22 nt, Human
agcaauguuggccuauauaccu

SEQ ID NO: 611716 - RNA, 22 nt, Human
auguacauuauucgagugaugg

SEQ ID NO: 611717 - RNA, 22 nt, Human
aaagcuauuuuauugcagcucu

SEQ ID NO: 611718 - RNA, 22 nt, Human
uaccauuucaguaaaaacuuag

SEQ ID NO: 611719 - RNA, 22 nt, Human
agaguuuacagaaauaagcugu

SEQ ID NO: 611720 - RNA, 22 nt, Human
ccuucaaucuuaagucagccca

SEQ ID NO: 611721 - RNA, 21 nt, Human
cuagaaagaauguugucgucu

SEQ ID NO: 611722 - RNA, 22 nt, Human
cuacagcuguguguuuaugugc

SEQ ID NO: 611723 - RNA, 22 nt, Human
aaugucaacacaagagaaaugc

SEQ ID NO: 611724 - RNA, 21 nt, Human
aauuucagacccauuuugccu

SEQ ID NO: 611725 - RNA, 22 nt, Human
gaguaauuuucuuaaaacauca

SEQ ID NO: 611726 - RNA, 22 nt, Human
ccuuagaaaaucauggaauauu

SEQ ID NO: 611727 - RNA, 22 nt, Human
aauuccagcugauugacuuucc

SEQ ID NO: 611728 - RNA, 22 nt, Human
cucuaaauguggucugcagaua

SEQ ID NO: 611729 - RNA, 22 nt, Human
cucagagaagauggaugaggua

SEQ ID NO: 611730 - RNA, 22 nt, Human
aguguucuagcgcugugcuugu

SEQ ID NO: 611731 - RNA, 18 nt, Human
accugauuggcgcagccc

SEQ ID NO: 611732 - RNA, 22 nt, Human
uuguacacacaggaacaaacgu

SEQ ID NO: 611733 - RNA, 22 nt, Human
uuugaaaggagcuuuauccaga

SEQ ID NO: 611734 - RNA, 22 nt, Human
aauaucaucucucuuuucugca

SEQ ID NO: 611735 - RNA, 22 nt, Human
augaauaaaacauuuuaaucag

SEQ ID NO: 611736 - RNA, 22 nt, Human
ucauuacuuauuaaaagccuug

SEQ ID NO: 611737 - RNA, 22 nt, Human
uuguaacaguagcugucagcuc

SEQ ID NO: 611738 - RNA, 22 nt, Human
gaaauguuggacacuugaaauu

SEQ ID NO: 611739 - RNA, 23 nt, Human
uggaaacauucugaauguccauc

SEQ ID NO: 611740 - RNA, 22 nt, Human
ugcuuguauucauaucacagcu

SEQ ID NO: 611741 - RNA, 19 nt, Human
uaugaaguugauaaaaguu

SEQ ID NO: 611742 - RNA, 22 nt, Human
uucaguaugcugaaugauuuuu

SEQ ID NO: 611743 - RNA, 22 nt, Human
gagcugcagcggcugacgcaac

SEQ ID NO: 611744 - RNA, 22 nt, Human
ucccacugucuucucgugcucg

SEQ ID NO: 611745 - RNA, 22 nt, Human
agugaauuagccuauuuguaaa

SEQ ID NO: 611746 - RNA, 22 nt, Human
guaugucuuaggguucaguaac

SEQ ID NO: 611747 - RNA, 22 nt, Human
ugaagacaguuuuacucaugag

SEQ ID NO: 611748 - RNA, 22 nt, Human
uaguauuuccuguaagcuauag

SEQ ID NO: 611749 - RNA, 22 nt, Human
ggaugacagaugcaggcuuuga

SEQ ID NO: 611750 - RNA, 22 nt, Human
uuagaaaucaccucugaagauc

SEQ ID NO: 611751 - RNA, 22 nt, Human
uguguacauguaucaacuaucg

SEQ ID NO: 611752 - RNA, 22 nt, Human
acaauuucuaauauagaucuua

SEQ ID NO: 611753 - RNA, 22 nt, Human
guuuacaacaucuuguccuuca

SEQ ID NO: 611754 - RNA, 22 nt, Human
ucuuauugguaaugauggcauu

SEQ ID NO: 611755 - RNA, 21 nt, Human
guucaauagcucuuugaaugc

SEQ ID NO: 611756 - RNA, 22 nt, Human
cuuuacagugaacuugcuuguc

SEQ ID NO: 611757 - RNA, 22 nt, Human
caauuuuuaaacuaugaaguug

SEQ ID NO: 611758 - RNA, 20 nt, Human
agcauuuagccuuuauccac

SEQ ID NO: 611759 - RNA, 22 nt, Human
uuccugguaacaaucucaaagu

SEQ ID NO: 611760 - RNA, 22 nt, Human
acauuuuuggguugaugucuga

SEQ ID NO: 611761 - RNA, 18 nt, Human
cuuuagcugucaucuuug

SEQ ID NO: 611762 - RNA, 22 nt, Human
cagacucuugagcugauuguau

SEQ ID NO: 611763 - RNA, 22 nt, Human
augcaguuagguaauagucuca

SEQ ID NO: 611764 - RNA, 22 nt, Human
auaguagcgagaucucagcuca

SEQ ID NO: 611765 - RNA, 22 nt, Human
augucccugagggucucucuga

SEQ ID NO: 611766 - RNA, 22 nt, Human
guuauacuuaugugcaaaaaua

SEQ ID NO: 611767 - RNA, 22 nt, Human
ugcaaauauuccaugcuguuca

SEQ ID NO: 611768 - RNA, 20 nt, Human
uuuuccacuccucaaaacag

SEQ ID NO: 611769 - RNA, 22 nt, Human
ugguaugcuuauuaucuucaac

SEQ ID NO: 611770 - RNA, 22 nt, Human
guuguacauaugaggauaaguu

SEQ ID NO: 611771 - RNA, 22 nt, Human
caagucuagcuuggucacuugg

SEQ ID NO: 611772 - RNA, 23 nt, Human
auaugucaugcaccagcacuuua

SEQ ID NO: 611773 - RNA, 22 nt, Human
ugcauaaacuucucugguguga

SEQ ID NO: 611774 - RNA, 22 nt, Human
ucauuuacacuucacaaaugga

SEQ ID NO: 611775 - RNA, 22 nt, Human
augcuuuauuggagacagucau

SEQ ID NO: 611776 - RNA, 22 nt, Human
gcagggcagggcaagaacuggg

SEQ ID NO: 611777 - RNA, 22 nt, Human
ucuaauuuuggcauuuuaaccu

SEQ ID NO: 611778 - RNA, 22 nt, Human
augcaauaguaauucuagucug

SEQ ID NO: 611779 - RNA, 23 nt, Human
uugcauuaauguggaggcacagg

SEQ ID NO: 611780 - RNA, 22 nt, Human
auuuccuggaggaauggaagca

SEQ ID NO: 611781 - RNA, 22 nt, Human
aucauccauggcugaucauaaa

SEQ ID NO: 611782 - RNA, 22 nt, Human
acuucacagauauuuauuuggu

SEQ ID NO: 611783 - RNA, 22 nt, Human
aggcauuuaaagauguaagacu

SEQ ID NO: 611784 - RNA, 22 nt, Human
uauaugcagauuuucaucaucg

SEQ ID NO: 611785 - RNA, 22 nt, Human
uuugacaugugcuuauaacuuu

SEQ ID NO: 611786 - RNA, 18 nt, Human
agcugaggggacugaaga

SEQ ID NO: 611787 - RNA, 22 nt, Human
cugcauaucaaauuacuccugg

SEQ ID NO: 611788 - RNA, 22 nt, Human
aaguuugucucauuugaucuuc

SEQ ID NO: 611789 - RNA, 19 nt, Human
auagaguagaguaucuguu

SEQ ID NO: 611790 - RNA, 22 nt, Human
gcacagucaacacuuauucacc

SEQ ID NO: 611791 - RNA, 22 nt, Human
aaguuacacauuuucauuguaa

SEQ ID NO: 611792 - RNA, 22 nt, Human
aucaugugacuagguuuggcca

SEQ ID NO: 611793 - RNA, 22 nt, Human
gaauguuuaaaaggugcaguuu

SEQ ID NO: 611794 - RNA, 22 nt, Human
uucucaaagugugcucccugga

SEQ ID NO: 611795 - RNA, 22 nt, Human
aauguuaaguuuagauuauaac

SEQ ID NO: 611796 - RNA, 22 nt, Human
aaucugagggaacuugaacucc

SEQ ID NO: 611797 - RNA, 22 nt, Human
uaaagcauguuucaguaagguu

SEQ ID NO: 611798 - RNA, 22 nt, Human
ucuccaggcuuaaucucagcuu

SEQ ID NO: 611799 - RNA, 22 nt, Human
aaauugcauuuuaaagguagau

SEQ ID NO: 611800 - RNA, 22 nt, Human
agcacugugagcaccagcacgc

SEQ ID NO: 611801 - RNA, 20 nt, Human
caauaauuuacuucccuauu

SEQ ID NO: 611802 - RNA, 22 nt, Human
gcucuaugaaccugaaucucac

SEQ ID NO: 611803 - RNA, 22 nt, Human
agugacagauuaccggcagagc

SEQ ID NO: 611804 - RNA, 22 nt, Human
aaagacuaaccaguugucaaaa

SEQ ID NO: 611805 - RNA, 22 nt, Human
uggugcugccaccuccucugcu

SEQ ID NO: 611806 - RNA, 22 nt, Human
aauucagguuauauuugcaacu

SEQ ID NO: 611807 - RNA, 22 nt, Human
guguuuugugaggccuucuuuc

SEQ ID NO: 611808 - RNA, 22 nt, Human
uagaaguuaaaggaauacagaa

SEQ ID NO: 611809 - RNA, 22 nt, Human
uaaugccuuaugucaaauguaa

SEQ ID NO: 611810 - RNA, 22 nt, Human
cucaaaauccauaaaaucaggu

SEQ ID NO: 611811 - RNA, 22 nt, Human
uguccuuaucuccaaacaauca

SEQ ID NO: 611812 - RNA, 22 nt, Human
guugcauuaaucugcucaggcu

SEQ ID NO: 611813 - RNA, 22 nt, Human
aauucauacucuauauugcuuu

SEQ ID NO: 611814 - RNA, 22 nt, Human
aaugaaacuauauuuagagagg

SEQ ID NO: 611815 - RNA, 22 nt, Human
ugcaugguuauauacuacuagu

SEQ ID NO: 611816 - RNA, 22 nt, Human
uuuuccuuaacagagggagaaa

SEQ ID NO: 611817 - RNA, 22 nt, Human
gauuugucuauauucaaauaug

SEQ ID NO: 611818 - RNA, 22 nt, Human
acuugcaucuuagagacucacc

SEQ ID NO: 611819 - RNA, 22 nt, Human
guggucaucuaacuaaauuuuc

SEQ ID NO: 611820 - RNA, 22 nt, Human
cccuuguuuuugaguacaauag

SEQ ID NO: 611821 - RNA, 22 nt, Human
aauuagaagcuguuagcaaaau

SEQ ID NO: 611822 - RNA, 22 nt, Human
aucaugcagcaacaagcaaggc

SEQ ID NO: 611823 - RNA, 22 nt, Human
uuaaguccuugguaauuuucuu

SEQ ID NO: 611824 - RNA, 22 nt, Human
uaaguauguuagaaaaucaagu

SEQ ID NO: 611825 - RNA, 22 nt, Human
cuccuuaaagggagcagcagcu

SEQ ID NO: 611826 - RNA, 22 nt, Human
guuuccuuuuggaauuagagcu

SEQ ID NO: 611827 - RNA, 22 nt, Human
ugauuccugugcuuauuccagu

SEQ ID NO: 611828 - RNA, 22 nt, Human
cacuguuuuacauguuauuuaa

SEQ ID NO: 611829 - RNA, 22 nt, Human
guguccagagccgggcugaaug

SEQ ID NO: 611830 - RNA, 22 nt, Human
uuauuuaaaagugguaagauuc

SEQ ID NO: 611831 - RNA, 22 nt, Human
cacauuuaaagguugaagcuga

SEQ ID NO: 611832 - RNA, 22 nt, Human
aaagccauaucuauucuauucu

SEQ ID NO: 611833 - RNA, 22 nt, Human
caaaauuguugaugcugcuuug

SEQ ID NO: 611834 - RNA, 22 nt, Human
guggaaauuuuaggaucaucuu

SEQ ID NO: 611835 - RNA, 23 nt, Human
uuaagacuggcugaacuuaguag

SEQ ID NO: 611836 - RNA, 22 nt, Human
caaacauuuguuggaaccccug

SEQ ID NO: 611837 - RNA, 22 nt, Human
acaugacagugacuuuauaaga

SEQ ID NO: 611838 - RNA, 22 nt, Human
guuuauuggguauuguggagcc

SEQ ID NO: 611839 - RNA, 22 nt, Human
gcauucuugguggagugcuaaa

SEQ ID NO: 611840 - RNA, 23 nt, Human
uguguucagucaaggaucagagu

SEQ ID NO: 611841 - RNA, 23 nt, Human
aacauuuguaaggugauuuuguu

SEQ ID NO: 611842 - RNA, 22 nt, Human
ucacacuuuauuuauuucaugc

SEQ ID NO: 611843 - RNA, 22 nt, Human
acagaagugacaauuucuuggg

SEQ ID NO: 611844 - RNA, 22 nt, Human
aggacaaaggaccagaucugga

SEQ ID NO: 611845 - RNA, 22 nt, Human
guauuucuuuacauaugcucau

SEQ ID NO: 611846 - RNA, 22 nt, Human
ucccucugcuagugcuugagcu

SEQ ID NO: 611847 - RNA, 22 nt, Human
uugauuugauuguaauggcucu

SEQ ID NO: 611848 - RNA, 22 nt, Human
acagacacaggcguggagucgc

SEQ ID NO: 611849 - RNA, 22 nt, Human
acagcugugggcucugcauaua

SEQ ID NO: 611850 - RNA, 22 nt, Human
uaaaugcaguacaaauuguucu

SEQ ID NO: 611851 - RNA, 22 nt, Human
agacagcacuuuuguauggggg

SEQ ID NO: 611852 - RNA, 22 nt, Human
uugaguuuccugacagcgaagg

SEQ ID NO: 611853 - RNA, 22 nt, Human
ugagucauguaauaaugcugcu

SEQ ID NO: 611854 - RNA, 22 nt, Human
ucucagaaaugacaggagguac

SEQ ID NO: 611855 - RNA, 22 nt, Human
aucaacuuguccuugauguuaa

SEQ ID NO: 611856 - RNA, 22 nt, Human
uuuucaguugugcucucuaguu

SEQ ID NO: 611857 - RNA, 19 nt, Human
cuucuggauccgcagggcc

SEQ ID NO: 611858 - RNA, 20 nt, Human
uuucacaaugaacaugucuc

SEQ ID NO: 611859 - RNA, 22 nt, Human
cuagaaguuuggguccauuaag

SEQ ID NO: 611860 - RNA, 22 nt, Human
gcaguaaauugagagucauguu

SEQ ID NO: 611861 - RNA, 22 nt, Human
uauaagaaacaaggcaaauuuu

SEQ ID NO: 611862 - RNA, 22 nt, Human
uuucucuuucaaucugcaguac

SEQ ID NO: 611863 - RNA, 22 nt, Human
uggcuuccagaacugagcaaca

SEQ ID NO: 611864 - RNA, 22 nt, Human
uucaaacaguguagaauauaug

SEQ ID NO: 611865 - RNA, 22 nt, Human
gccaugaacucgggcauggaga

SEQ ID NO: 611866 - RNA, 22 nt, Human
uuucuucucacccaggacagag

SEQ ID NO: 611867 - RNA, 21 nt, Human
uuuguucacacacagggcagc

SEQ ID NO: 611868 - RNA, 22 nt, Human
uuuugguaauuaaguagauauu

SEQ ID NO: 611869 - RNA, 22 nt, Human
aacuuaaacaagcucccaaguu

SEQ ID NO: 611870 - RNA, 22 nt, Human
uuuauacuccacucugcaagcg

SEQ ID NO: 611871 - RNA, 22 nt, Human
ugacuuuggacuagugauuuaa

SEQ ID NO: 611872 - RNA, 22 nt, Human
ucuuucagaaacuuugucugcg

SEQ ID NO: 611873 - RNA, 22 nt, Human
cuugaguaaagaaguauuuuag

SEQ ID NO: 611874 - RNA, 22 nt, Human
uagauuaucccugauuugucca

SEQ ID NO: 611875 - RNA, 22 nt, Human
ugauucaguacuuucucuaacu

SEQ ID NO: 611876 - RNA, 22 nt, Human
uagcugcacaggaaguaagauu

SEQ ID NO: 611877 - RNA, 22 nt, Human
acucccuugguggagaaugcaa

SEQ ID NO: 611878 - RNA, 22 nt, Human
acaagauagcuuagaagauuca

SEQ ID NO: 611879 - RNA, 22 nt, Human
auuugcuuguucaccaguacuu

SEQ ID NO: 611880 - RNA, 23 nt, Human
guuauugcuggugcuggccagcc

SEQ ID NO: 611881 - RNA, 22 nt, Human
ggaagccaguugcuuggugugg

SEQ ID NO: 611882 - RNA, 22 nt, Human
ugaaaugccuaugaagucagga

SEQ ID NO: 611883 - RNA, 22 nt, Human
agagcaauuagcuuagguaaaa

SEQ ID NO: 611884 - RNA, 22 nt, Human
uagaucuuucacuacuguguag

SEQ ID NO: 611885 - RNA, 22 nt, Human
ucuucaugaaauugauugcuua

SEQ ID NO: 611886 - RNA, 22 nt, Human
guucuucagauuccauuucagu

SEQ ID NO: 611887 - RNA, 22 nt, Human
ucucagcucauggcagccuuga

SEQ ID NO: 611888 - RNA, 22 nt, Human
uucaguuuugcuuuuaaucaug

SEQ ID NO: 611889 - RNA, 22 nt, Human
uucacagaauugucuugacugg

SEQ ID NO: 611890 - RNA, 22 nt, Human
agcaguuuauccucauaaugga

SEQ ID NO: 611891 - RNA, 22 nt, Human
uugggauacaucuugcugagcc

SEQ ID NO: 611892 - RNA, 18 nt, Human
gaacagcaauuucauguu

SEQ ID NO: 611893 - RNA, 22 nt, Human
gauccacaggaaccaaaacgca

SEQ ID NO: 611894 - RNA, 22 nt, Human
ucauuacaagauuuccaauuug

SEQ ID NO: 611895 - RNA, 22 nt, Human
uuaugcaaaggggccucuuccu

SEQ ID NO: 611896 - RNA, 22 nt, Human
auuuccagcagcauauuugucu

SEQ ID NO: 611897 - RNA, 22 nt, Human
cugucaaauggaaacuuauccu

SEQ ID NO: 611898 - RNA, 18 nt, Human
ucugaaggaaugauucca

SEQ ID NO: 611899 - RNA, 22 nt, Human
gucucuaucauagcugaacccu

SEQ ID NO: 611900 - RNA, 22 nt, Human
aacuagaaagaacauauuucca

SEQ ID NO: 611901 - RNA, 22 nt, Human
uuucuacauuuguaaccagauu

SEQ ID NO: 611902 - RNA, 22 nt, Human
cacagauaaggcuuugucccca

SEQ ID NO: 611903 - RNA, 22 nt, Human
uuuccaaggaugugucucucua

SEQ ID NO: 611904 - RNA, 22 nt, Human
ugcauguuucuguauguuaaug

SEQ ID NO: 611905 - RNA, 22 nt, Human
caugcauuucuaccaaggaaua

SEQ ID NO: 611906 - RNA, 22 nt, Human
ccagugugcauuaucauguguc

SEQ ID NO: 611907 - RNA, 22 nt, Human
ugcaugacaauugccgucaagu

SEQ ID NO: 611908 - RNA, 22 nt, Human
cuuguuuucuucugcagucuau

SEQ ID NO: 611909 - RNA, 22 nt, Human
uagauucugacccucuuuuuac

SEQ ID NO: 611910 - RNA, 22 nt, Human
guucuuaaagauucaucaagca

SEQ ID NO: 611911 - RNA, 22 nt, Human
aaaucaugguggaagaaacaga

SEQ ID NO: 611912 - RNA, 22 nt, Human
ccaguucuuucugugugcaaca

SEQ ID NO: 611913 - RNA, 22 nt, Human
uugaagcauuugcuauagcauu

SEQ ID NO: 611914 - RNA, 22 nt, Human
ucuguccauucagaauggcccu

SEQ ID NO: 611915 - RNA, 22 nt, Human
cagaaagcaguugucaaugggc

SEQ ID NO: 611916 - RNA, 22 nt, Human
gaaagcagaugaaauugcaaca

SEQ ID NO: 611917 - RNA, 22 nt, Human
auaggcauaacacugauguccu

SEQ ID NO: 611918 - RNA, 22 nt, Human
agugacauuauuuuguguacua

SEQ ID NO: 611919 - RNA, 22 nt, Human
auuccaaagccugaauaaugga

SEQ ID NO: 611920 - RNA, 22 nt, Human
gcuuuuauuucuucacaaaagu

SEQ ID NO: 611921 - RNA, 22 nt, Human
aaguuauugguggagagcacug

SEQ ID NO: 611922 - RNA, 22 nt, Human
uuuacaaggcaguuauuuuccu

SEQ ID NO: 611923 - RNA, 22 nt, Human
uuuagcaaggagaaauaauccu

SEQ ID NO: 611924 - RNA, 23 nt, Human
ugcaaaauuugcagaguucgaug

SEQ ID NO: 611925 - RNA, 22 nt, Human
uucugauuguuggaggaugcuu

SEQ ID NO: 611926 - RNA, 22 nt, Human
uucucugguuugcuguuucuga

SEQ ID NO: 611927 - RNA, 22 nt, Human
caaagccaggcuuucuaaugua

SEQ ID NO: 611928 - RNA, 22 nt, Human
aucauugaguaaaaugaauaca

SEQ ID NO: 611929 - RNA, 22 nt, Human
agaguguggaaauguucagagu

SEQ ID NO: 611930 - RNA, 22 nt, Human
cccauugugguuguugaggaua

SEQ ID NO: 611931 - RNA, 22 nt, Human
auugcacaucugcacuacagcc

SEQ ID NO: 611932 - RNA, 22 nt, Human
caguauuuaggauuaggagaga

SEQ ID NO: 611933 - RNA, 22 nt, Human
aaucuguugucaggaauccaca

SEQ ID NO: 611934 - RNA, 22 nt, Human
ucaguaaaugagcaaaaauuuc

SEQ ID NO: 611935 - RNA, 22 nt, Human
uaucaguagaacaauggacauu

SEQ ID NO: 611936 - RNA, 22 nt, Human
uuuccagaaauaccauuuggug

SEQ ID NO: 611937 - RNA, 22 nt, Human
uucuggagacccagcaacaggg

SEQ ID NO: 611938 - RNA, 22 nt, Human
ucauggcacaugcccuccaggg

SEQ ID NO: 611939 - RNA, 22 nt, Human
uucucugaguacguuucagugu

SEQ ID NO: 611940 - RNA, 22 nt, Human
gaguuucuucauggugcagagg

SEQ ID NO: 611941 - RNA, 22 nt, Human
caguuaaacagauugaguguua

SEQ ID NO: 611942 - RNA, 22 nt, Human
uagaagaacaugucaaacuaua

SEQ ID NO: 611943 - RNA, 22 nt, Human
aucauuugaacagaauuuguuu

SEQ ID NO: 611944 - RNA, 22 nt, Human
gaaggcaguaaauggcuguuuu

SEQ ID NO: 611945 - RNA, 22 nt, Human
cuucuucagaggccagccucug

SEQ ID NO: 611946 - RNA, 22 nt, Human
aaucuucaggguccuggggcuc

SEQ ID NO: 611947 - RNA, 22 nt, Human
uauuuggugaaucuauggucag

SEQ ID NO: 611948 - RNA, 22 nt, Human
ucuguaaacacccguaagcuuu

SEQ ID NO: 611949 - RNA, 22 nt, Human
cauuuuacgacauagggcaggc

SEQ ID NO: 611950 - RNA, 22 nt, Human
uucuuuuaauagagauccugug

SEQ ID NO: 611951 - RNA, 22 nt, Human
aaguuacaggagaaagagauca

SEQ ID NO: 611952 - RNA, 22 nt, Human
ucugcuguuuacugugugauau

SEQ ID NO: 611953 - RNA, 22 nt, Human
auuucagagugagagugcucaa

SEQ ID NO: 611954 - RNA, 20 nt, Human
uucacagaggacucagguca

SEQ ID NO: 611955 - RNA, 22 nt, Human
uggaauuaucugaagugauuug

SEQ ID NO: 611956 - RNA, 22 nt, Human
caggaaugguuaaucuaaagug

SEQ ID NO: 611957 - RNA, 17 nt, Human
uuuguucguuaguccgg

SEQ ID NO: 611958 - RNA, 22 nt, Human
cagucucuugcuucauuaguug

SEQ ID NO: 611959 - RNA, 22 nt, Human
uuccuuucucuggacugcagcc

SEQ ID NO: 611960 - RNA, 22 nt, Human
uacugcauuaucaaggggaagg

SEQ ID NO: 611961 - RNA, 18 nt, Human
uuugggauccucuuuucu

SEQ ID NO: 611962 - RNA, 22 nt, Human
augaucaagaauuuuguauucc

SEQ ID NO: 611963 - RNA, 22 nt, Human
uucacugugauguuuaagagaa

SEQ ID NO: 611964 - RNA, 22 nt, Human
cuucauuucaggcugaagaaua

SEQ ID NO: 611965 - RNA, 22 nt, Human
agaauguaagaaugcaaagauu

SEQ ID NO: 611966 - RNA, 22 nt, Human
uacuguauacuacugcuguucu

SEQ ID NO: 611967 - RNA, 22 nt, Human
uuuucaguuccaucucugcucu

SEQ ID NO: 611968 - RNA, 22 nt, Human
acuguagucuaaauauagucuu

SEQ ID NO: 611969 - RNA, 22 nt, Human
auuuacagacguggauuagugc

SEQ ID NO: 611970 - RNA, 22 nt, Human
cuacauuuacacaguuaggcuu

SEQ ID NO: 611971 - RNA, 22 nt, Human
uuuuuugucuugaagaaauggu

SEQ ID NO: 611972 - RNA, 21 nt, Human
acauguccccuaugcuuaagg

SEQ ID NO: 611973 - RNA, 22 nt, Human
ggauguuuauccuaucuuaguu

SEQ ID NO: 611974 - RNA, 22 nt, Human
guuguuuuugaacggugguggc

SEQ ID NO: 611975 - RNA, 22 nt, Human
uugacacagucaacuugauuuu

SEQ ID NO: 611976 - RNA, 22 nt, Human
cugaaacuauggggaggggagc

SEQ ID NO: 611977 - RNA, 22 nt, Human
uacauguacaugcauagguaga

SEQ ID NO: 611978 - RNA, 22 nt, Human
uuuccuguccugguacuuggca

SEQ ID NO: 611979 - RNA, 22 nt, Human
cuucacaaaauauuucauuaua

SEQ ID NO: 611980 - RNA, 22 nt, Human
gucuuuuuuacaccuuacauca

SEQ ID NO: 611981 - RNA, 22 nt, Human
accagucauagaaagcaguggu

SEQ ID NO: 611982 - RNA, 22 nt, Human
ccagaaugugugaaauuugaug

SEQ ID NO: 611983 - RNA, 22 nt, Human
ugggcacagugaguugccuuua

SEQ ID NO: 611984 - RNA, 21 nt, Human
cugcacugugauuuaaaaugu

SEQ ID NO: 611985 - RNA, 22 nt, Human
aagcauuucagguagagauauu

SEQ ID NO: 611986 - RNA, 22 nt, Human
ugcauuaagaauuucugaggau

SEQ ID NO: 611987 - RNA, 19 nt, Human
acaguuugggaaaugagca

SEQ ID NO: 611988 - RNA, 22 nt, Human
ccucuaaauuguuugaaguugg

SEQ ID NO: 611989 - RNA, 22 nt, Human
uucuuuccucccagccuuugga

SEQ ID NO: 611990 - RNA, 22 nt, Human
caauguuuuuccuuccuuaaua

SEQ ID NO: 611991 - RNA, 22 nt, Human
cugggcuuucaggcccuaaggc

SEQ ID NO: 611992 - RNA, 22 nt, Human
gaaggcaagugagccaagagaa

SEQ ID NO: 611993 - RNA, 22 nt, Human
uuuaaacuaacaguacacguug

SEQ ID NO: 611994 - RNA, 21 nt, Human
acaaauuguuuauauaggaag

SEQ ID NO: 611995 - RNA, 22 nt, Human
accaaucuccuauuuuguuuca

SEQ ID NO: 611996 - RNA, 19 nt, Human
cuccacagggauugugauu

SEQ ID NO: 611997 - RNA, 22 nt, Human
uguguuucugagaaucccaccu

SEQ ID NO: 611998 - RNA, 22 nt, Human
cagcuuuugcagacuucuugcc

SEQ ID NO: 611999 - RNA, 21 nt, Human
uaaggaagagcauuuuagguc

SEQ ID NO: 612000 - RNA, 22 nt, Human
augcuugaaaguuauuucauuu

SEQ ID NO: 612001 - RNA, 22 nt, Human
cuggcuuucauggcgcaguuga

SEQ ID NO: 612002 - RNA, 22 nt, Human
gaagauuaccugagaccacuug

SEQ ID NO: 612003 - RNA, 22 nt, Human
cagucauuaugggaguuaaucc

SEQ ID NO: 612004 - RNA, 22 nt, Human
uuggaaaugcauuuguuauuau

SEQ ID NO: 612005 - RNA, 22 nt, Human
cauuuugugcuagacacuaugg

SEQ ID NO: 612006 - RNA, 22 nt, Human
uucagauaagucaaguuaguau

SEQ ID NO: 612007 - RNA, 22 nt, Human
uacuacauacagaauuuagaga

SEQ ID NO: 612008 - RNA, 22 nt, Human
gaugggcaucaaacaugacgug

SEQ ID NO: 612009 - RNA, 21 nt, Human
agcauucaaaagaugccauaa

SEQ ID NO: 612010 - RNA, 22 nt, Human
gaagguuuuguuugcaaaucau

SEQ ID NO: 612011 - RNA, 22 nt, Human
cauuucaaacaguuacagcugc

SEQ ID NO: 612012 - RNA, 22 nt, Human
auaagugcccaaaaugaaagga

SEQ ID NO: 612013 - RNA, 19 nt, Human
uccuugacuguauucagag

SEQ ID NO: 612014 - RNA, 22 nt, Human
agccagcauauauauaguugaa

SEQ ID NO: 612015 - RNA, 22 nt, Human
uaaagacaauuucgagcuguag

SEQ ID NO: 612016 - RNA, 22 nt, Human
auucuggacaaggcaagcuccu

SEQ ID NO: 612017 - RNA, 22 nt, Human
uuauuccauagaagucaaggaa

SEQ ID NO: 612018 - RNA, 22 nt, Human
uuaaaagaauccuguuauccuc

SEQ ID NO: 612019 - RNA, 22 nt, Human
caaagaugccaaaaggaagaca

SEQ ID NO: 612020 - RNA, 22 nt, Human
uuuuccuucugauacuccauuu

SEQ ID NO: 612021 - RNA, 22 nt, Human
cauugcuguuaauugucucuag

SEQ ID NO: 612022 - RNA, 22 nt, Human
uaccuugugagcuuucuaacau

SEQ ID NO: 612023 - RNA, 23 nt, Human
acacauguuuaugcuugggggca

SEQ ID NO: 612024 - RNA, 22 nt, Human
uuccaauaaaauguuauuugca

SEQ ID NO: 612025 - RNA, 22 nt, Human
auuguacagacaugggaaacaa

SEQ ID NO: 612026 - RNA, 23 nt, Human
aacugcaagguugcugggaagua

SEQ ID NO: 612027 - RNA, 22 nt, Human
uuuuucaagacaaccugcaugu

SEQ ID NO: 612028 - RNA, 22 nt, Human
cauaaauuguacccauuccaac

SEQ ID NO: 612029 - RNA, 22 nt, Human
acaagucaguggaauuaauauu

SEQ ID NO: 612030 - RNA, 22 nt, Human
gaauacaaauaauaccaaggug

SEQ ID NO: 612031 - RNA, 22 nt, Human
uuucuagguguucacagagcau

SEQ ID NO: 612032 - RNA, 22 nt, Human
ucauuguuucugcuuuucauga

SEQ ID NO: 612033 - RNA, 22 nt, Human
guuuuaguggguggccacugau

SEQ ID NO: 612034 - RNA, 22 nt, Human
aauugguuugaauaaauaaaga

SEQ ID NO: 612035 - RNA, 22 nt, Human
aagcauuuuagauaaagcauca

SEQ ID NO: 612036 - RNA, 22 nt, Human
acaaaugcuuaguucaccaaaa

SEQ ID NO: 612037 - RNA, 22 nt, Human
uacaagcuuuuguguauaaaug

SEQ ID NO: 612038 - RNA, 22 nt, Human
ggaagcuguuaucaucuguauc

SEQ ID NO: 612039 - RNA, 22 nt, Human
agaaucugcauuuuaacaagau

SEQ ID NO: 612040 - RNA, 22 nt, Human
caaauacaaauacgggcagcuu

SEQ ID NO: 612041 - RNA, 22 nt, Human
cuucauuaaugucuauaaguuu

SEQ ID NO: 612042 - RNA, 22 nt, Human
ccugguuuaaugcucacuguug

SEQ ID NO: 612043 - RNA, 22 nt, Human
guguuucccuggcacaagaacc

SEQ ID NO: 612044 - RNA, 22 nt, Human
ugagaacaaaguugaaaguuug

SEQ ID NO: 612045 - RNA, 22 nt, Human
gauauucauaggcagguauuua

SEQ ID NO: 612046 - RNA, 22 nt, Human
uggaauguuaaaccucaaugau

SEQ ID NO: 612047 - RNA, 22 nt, Human
uguauuucugcuuucucuagua

SEQ ID NO: 612048 - RNA, 20 nt, Human
uuucacuggcuugauaaggu

SEQ ID NO: 612049 - RNA, 22 nt, Human
gacauacagcccucucccuggu

SEQ ID NO: 612050 - RNA, 22 nt, Human
uuuugaauaauucagaaacagc

SEQ ID NO: 612051 - RNA, 21 nt, Human
ucacuagugccuucugucauu

SEQ ID NO: 612052 - RNA, 23 nt, Human
gacagagugagaccuugucuuac

SEQ ID NO: 612053 - RNA, 20 nt, Human
aucggcuugccuggaaacaa

SEQ ID NO: 612054 - RNA, 21 nt, Human
acucugaaaauuaauaguuau

SEQ ID NO: 612055 - RNA, 22 nt, Human
uacauuccaaaggaaacuggcu

SEQ ID NO: 612056 - RNA, 22 nt, Human
acaacuuuaauggguuucagcu

SEQ ID NO: 612057 - RNA, 22 nt, Human
auuuuagagaaacaaacguagg

SEQ ID NO: 612058 - RNA, 22 nt, Human
uaaaguauaagcauuggaguau

SEQ ID NO: 612059 - RNA, 22 nt, Human
ccaaaauauuagugcuuaagua

SEQ ID NO: 612060 - RNA, 22 nt, Human
aucauuaacccuugaugcuggg

SEQ ID NO: 612061 - RNA, 22 nt, Human
aguaaaaucaccaucucuuugu

SEQ ID NO: 612062 - RNA, 22 nt, Human
cuccaaaggauaaaagcagagu

SEQ ID NO: 612063 - RNA, 22 nt, Human
aguaacagguguacagacuauc

SEQ ID NO: 612064 - RNA, 22 nt, Human
auuuugacauugcggcauugcu

SEQ ID NO: 612065 - RNA, 22 nt, Human
cagcaugaauguguucguaggg

SEQ ID NO: 612066 - RNA, 22 nt, Human
agcauucuguggucuucuaugg

SEQ ID NO: 612067 - RNA, 22 nt, Human
uucuaguuacagaagccuugcu

SEQ ID NO: 612068 - RNA, 22 nt, Human
agccuauucaucugaucuugaa

SEQ ID NO: 612069 - RNA, 22 nt, Human
cugucuacagaugaaauaagca

SEQ ID NO: 612070 - RNA, 22 nt, Human
cugagcaugcuacaugcagcac

SEQ ID NO: 612071 - RNA, 22 nt, Human
ucuauuaaugauucaauagugu

SEQ ID NO: 612072 - RNA, 22 nt, Human
agcaggcauuugauauauauuu

SEQ ID NO: 612073 - RNA, 22 nt, Human
aaaugcaugugcuauagaugug

SEQ ID NO: 612074 - RNA, 17 nt, Human
cauucuguaaucuuucu

SEQ ID NO: 612075 - RNA, 22 nt, Human
agcugcaaguccaaaggaauua

SEQ ID NO: 612076 - RNA, 17 nt, Human
uagauuaaacacggcca

SEQ ID NO: 612077 - RNA, 22 nt, Human
cuucuggguauuccagauaccu

SEQ ID NO: 612078 - RNA, 22 nt, Human
gugauuucagguuuuucauacu

SEQ ID NO: 612079 - RNA, 22 nt, Human
ucuucaugucaugguauauuga

SEQ ID NO: 612080 - RNA, 22 nt, Human
cacaguuuugucuugguuucca

SEQ ID NO: 612081 - RNA, 22 nt, Human
gagauuuccauauuuuguaaca

SEQ ID NO: 612082 - RNA, 22 nt, Human
ucaaagaucagaugguuguagg

SEQ ID NO: 612083 - RNA, 22 nt, Human
cuggcuuuuuucccauuaugca

SEQ ID NO: 612084 - RNA, 22 nt, Human
uugaugcugucuuucagaauca

SEQ ID NO: 612085 - RNA, 22 nt, Human
gcauuuaaauuugaacuucaga

SEQ ID NO: 612086 - RNA, 22 nt, Human
aauuauguuugcuuuagaugga

SEQ ID NO: 612087 - RNA, 22 nt, Human
ucugcuugugucuguccagccu

SEQ ID NO: 612088 - RNA, 22 nt, Human
acagugucuccugguacccagu

SEQ ID NO: 612089 - RNA, 22 nt, Human
ugucuuaugcugcauagacuau

SEQ ID NO: 612090 - RNA, 22 nt, Human
uuugcagagugcagaagcaucu

SEQ ID NO: 612091 - RNA, 22 nt, Human
cuggcagcucugagucccuucu

SEQ ID NO: 612092 - RNA, 22 nt, Human
uucuaagaaauggaaaacgauu

SEQ ID NO: 612093 - RNA, 22 nt, Human
cuguuuauucucaucuaaaaug

SEQ ID NO: 612094 - RNA, 22 nt, Human
ugcagugaugcuucuggcucag

SEQ ID NO: 612095 - RNA, 22 nt, Human
uuuacuuuugguaaggucauuu

SEQ ID NO: 612096 - RNA, 18 nt, Human
ucuuccaacacugacacc

SEQ ID NO: 612097 - RNA, 22 nt, Human
uccaaauagcuggaugauggug

SEQ ID NO: 612098 - RNA, 22 nt, Human
gggauaagagaguauuuaugca

SEQ ID NO: 612099 - RNA, 22 nt, Human
aucuucaaagcacaucguuugu

SEQ ID NO: 612100 - RNA, 22 nt, Human
cauagacauugauagguuauau

SEQ ID NO: 612101 - RNA, 22 nt, Human
gaugucuggcuaccacucgcac

SEQ ID NO: 612102 - RNA, 22 nt, Human
ucuacaacgugguuuuguugua

SEQ ID NO: 612103 - RNA, 22 nt, Human
cauuaacacuuuggauuuagac

SEQ ID NO: 612104 - RNA, 22 nt, Human
cuuucugaggagacgggcuuug

SEQ ID NO: 612105 - RNA, 22 nt, Human
aaagaugucauacacauuaaga

SEQ ID NO: 612106 - RNA, 22 nt, Human
uggaaauaguugugagucaggc

SEQ ID NO: 612107 - RNA, 22 nt, Human
cuaaauguuuuaucuuccuggc

SEQ ID NO: 612108 - RNA, 22 nt, Human
cagagggagcccuccaggagca

SEQ ID NO: 612109 - RNA, 22 nt, Human
ugaaagaagccucccuuuggag

SEQ ID NO: 612110 - RNA, 16 nt, Human
ucauugaagacaguac

SEQ ID NO: 612111 - RNA, 22 nt, Human
uugauucugcugaucucggacg

SEQ ID NO: 612112 - RNA, 21 nt, Human
uugcuguuuucccaaugcagu

SEQ ID NO: 612113 - RNA, 22 nt, Human
acugcauuaucaccaagaugua

SEQ ID NO: 612114 - RNA, 17 nt, Human
ucugagaaugcuggagg

SEQ ID NO: 612115 - RNA, 22 nt, Human
uggaaaauauuuaggugaauga

SEQ ID NO: 612116 - RNA, 22 nt, Human
uuugaauauacuucaaacaaag

SEQ ID NO: 612117 - RNA, 22 nt, Human
cuccuucacgcaggcugccaug

SEQ ID NO: 612118 - RNA, 20 nt, Human
uuugauugccccucugacuu

SEQ ID NO: 612119 - RNA, 22 nt, Human
uguaauguuagaaacaauugcu

SEQ ID NO: 612120 - RNA, 22 nt, Human
aaaguaauugugguucuugcca

SEQ ID NO: 612121 - RNA, 22 nt, Human
guaugugucuuagaacuuggga

SEQ ID NO: 612122 - RNA, 22 nt, Human
uuuaauuauaucugggcaguua

SEQ ID NO: 612123 - RNA, 22 nt, Human
aaacucuacauggucgcaaaaa

SEQ ID NO: 612124 - RNA, 22 nt, Human
uaaaguuggaccugauuuuauu

SEQ ID NO: 612125 - RNA, 20 nt, Human
ugugguuuuugccaguugaa

SEQ ID NO: 612126 - RNA, 22 nt, Human
uggaaacacccacgcaugcaua

SEQ ID NO: 612127 - RNA, 22 nt, Human
gacaagaugacaucauggcuuc

SEQ ID NO: 612128 - RNA, 22 nt, Human
auauggcuguugcacaucuaag

SEQ ID NO: 612129 - RNA, 23 nt, Human
cuuuccuuucuuugacacccagc

SEQ ID NO: 612130 - RNA, 22 nt, Human
uucucucaguuaaacuuuguga

SEQ ID NO: 612131 - RNA, 21 nt, Human
caaaagagacugauucuugga

SEQ ID NO: 612132 - RNA, 22 nt, Human
gagcugcauagcugggauccuc

SEQ ID NO: 612133 - RNA, 22 nt, Human
uacauuuauaaggcuucucugu

SEQ ID NO: 612134 - RNA, 22 nt, Human
gacauuuauuggauuuuacgag

SEQ ID NO: 612135 - RNA, 22 nt, Human
guuucuuauuucaacuggaaca

SEQ ID NO: 612136 - RNA, 22 nt, Human
auuauguagcuaaaaauugugu

SEQ ID NO: 612137 - RNA, 22 nt, Human
agaaguaucaggaagauucuca

SEQ ID NO: 612138 - RNA, 22 nt, Human
caaauguuugguggcauuuugu

SEQ ID NO: 612139 - RNA, 22 nt, Human
agcuaugaagccacuuuuaaca

SEQ ID NO: 612140 - RNA, 21 nt, Human
aucuuaaaaggucuuaacuuu

SEQ ID NO: 612141 - RNA, 22 nt, Human
aaaacuuucagggauacagaaa

SEQ ID NO: 612142 - RNA, 22 nt, Human
gaaaacacuuugaucugaaagu

SEQ ID NO: 612143 - RNA, 22 nt, Human
caagagcuggguggcaagcuag

SEQ ID NO: 612144 - RNA, 22 nt, Human
agcugaaacuucccauuaauug

SEQ ID NO: 612145 - RNA, 20 nt, Human
uccaguuuuggagacauucu

SEQ ID NO: 612146 - RNA, 22 nt, Human
uagaagaugccuuaaaguugaa

SEQ ID NO: 612147 - RNA, 22 nt, Human
guuauucuauuaaugugauugu

SEQ ID NO: 612148 - RNA, 22 nt, Human
aaaugcacaauaaaguaaaggc

SEQ ID NO: 612149 - RNA, 22 nt, Human
ucaguguccuucguucuuguug

SEQ ID NO: 612150 - RNA, 22 nt, Human
augaaacaacagacuuggucaa

SEQ ID NO: 612151 - RNA, 22 nt, Human
gguuauuguggagaaguuccgg

SEQ ID NO: 612152 - RNA, 22 nt, Human
cuucucuuggguguggugucuu

SEQ ID NO: 612153 - RNA, 22 nt, Human
caguauuucauucagaauuguu

SEQ ID NO: 612154 - RNA, 23 nt, Human
auaauaacgucugucuugucucu

SEQ ID NO: 612155 - RNA, 22 nt, Human
aaugagauggaggacucuuaau

SEQ ID NO: 612156 - RNA, 20 nt, Human
uaugauaauuacaaaauagu

SEQ ID NO: 612157 - RNA, 22 nt, Human
augaaaacggaccagagcuauu

SEQ ID NO: 612158 - RNA, 22 nt, Human
uucuuuuaauuucugucugcag

SEQ ID NO: 612159 - RNA, 22 nt, Human
cuauuuucccauaugguugaca

SEQ ID NO: 612160 - RNA, 22 nt, Human
uacaaagugauuuuggaauuga

SEQ ID NO: 612161 - RNA, 22 nt, Human
aagugucuucugauggggugug

SEQ ID NO: 612162 - RNA, 22 nt, Human
cuuccagcugauuggcauccag

SEQ ID NO: 612163 - RNA, 22 nt, Human
ugucuuacagcaaucuguucug

SEQ ID NO: 612164 - RNA, 22 nt, Human
uucagaagguaggaaugucccu

SEQ ID NO: 612165 - RNA, 22 nt, Human
ugguaaaugucuaacaaucacu

SEQ ID NO: 612166 - RNA, 22 nt, Human
uaauuuugucacagugacaugc

SEQ ID NO: 612167 - RNA, 22 nt, Human
ucgcuuuaauggucuucacagc

SEQ ID NO: 612168 - RNA, 22 nt, Human
ugguuaaaugcuccgaucuugg

SEQ ID NO: 612169 - RNA, 22 nt, Human
auuuggucuacauuuuccaaau

SEQ ID NO: 612170 - RNA, 22 nt, Human
caggaaauucccagaaggacug

SEQ ID NO: 612171 - RNA, 22 nt, Human
gaaguucugguguaugugauaa

SEQ ID NO: 612172 - RNA, 22 nt, Human
aaauugcuugagauuagucucc

SEQ ID NO: 612173 - RNA, 22 nt, Human
aauggcuguucucugugauugg

SEQ ID NO: 612174 - RNA, 22 nt, Human
aacuuucuuugcaucuaaguuu

SEQ ID NO: 612175 - RNA, 22 nt, Human
ucugaaauuuuaguuauagaaa

SEQ ID NO: 612176 - RNA, 22 nt, Human
uguuugcucugacuaucuugcg

SEQ ID NO: 612177 - RNA, 22 nt, Human
ucaauuuauguggcuauucauu

SEQ ID NO: 612178 - RNA, 22 nt, Human
acuuccagaaaugauuuaauuu

SEQ ID NO: 612179 - RNA, 19 nt, Human
aucaggcuucuauuuucuc

SEQ ID NO: 612180 - RNA, 22 nt, Human
gcaaggaagcagaguugcuauc

SEQ ID NO: 612181 - RNA, 22 nt, Human
uucgcauucagcuuugccacug

SEQ ID NO: 612182 - RNA, 22 nt, Human
ugguccagacuuugaccucuca

SEQ ID NO: 612183 - RNA, 22 nt, Human
uugcaguuuugacagaccaaau

SEQ ID NO: 612184 - RNA, 22 nt, Human
agucaacauuugagaugcaaug

SEQ ID NO: 612185 - RNA, 17 nt, Human
cagucacaggucuuuuc

SEQ ID NO: 612186 - RNA, 22 nt, Human
uuaccuuguaaaacauauuccu

SEQ ID NO: 612187 - RNA, 22 nt, Human
cuugucugcuauaaaaauccag

SEQ ID NO: 612188 - RNA, 22 nt, Human
uugauguaauacuuugcaacca

SEQ ID NO: 612189 - RNA, 22 nt, Human
cuccaggacaugacuuucuugc

SEQ ID NO: 612190 - RNA, 22 nt, Human
ucacacaucucagguguuuaau

SEQ ID NO: 612191 - RNA, 22 nt, Human
auacuucuuuagcauauugaac

SEQ ID NO: 612192 - RNA, 22 nt, Human
ucucccaaccucuggugggugc

SEQ ID NO: 612193 - RNA, 22 nt, Human
uuucacauacaguguauaguag

SEQ ID NO: 612194 - RNA, 22 nt, Human
ccacuuaagagaacagcuauag

SEQ ID NO: 612195 - RNA, 22 nt, Human
acauucaugcaccuuccuaucc

SEQ ID NO: 612196 - RNA, 22 nt, Human
gagcaacacauugaaugaggau

SEQ ID NO: 612197 - RNA, 20 nt, Human
ucuuuuauuggcagauccug

SEQ ID NO: 612198 - RNA, 22 nt, Human
aaauugcaaaaguacuuuuagg

SEQ ID NO: 612199 - RNA, 22 nt, Human
ugaauaaucuuggguauuaaua

SEQ ID NO: 612200 - RNA, 22 nt, Human
augaauuguccgauguugugca

SEQ ID NO: 612201 - RNA, 22 nt, Human
aaauccaucaaaucuucuagaa

SEQ ID NO: 612202 - RNA, 22 nt, Human
aauacagauggcaugugaagau

SEQ ID NO: 612203 - RNA, 22 nt, Human
aacacauggcaagagcaggaaa

SEQ ID NO: 612204 - RNA, 22 nt, Human
uuauuuuguagcucugaucuuu

SEQ ID NO: 612205 - RNA, 22 nt, Human
guuaaaugcagauucugacuca

SEQ ID NO: 612206 - RNA, 22 nt, Human
aaaucugagaaauauuguccag

SEQ ID NO: 612207 - RNA, 18 nt, Human
agcucacagaucuguuuu

SEQ ID NO: 612208 - RNA, 22 nt, Human
uuguaagacuguagaaugcaaa

SEQ ID NO: 612209 - RNA, 22 nt, Human
acagagacacggaagcuaaaga

SEQ ID NO: 612210 - RNA, 22 nt, Human
cacuuuuaacaggagaauuccc

SEQ ID NO: 612211 - RNA, 21 nt, Human
ccacaauucuaguuacauaug

SEQ ID NO: 612212 - RNA, 22 nt, Human
aaauugaauuugggaaacauug

SEQ ID NO: 612213 - RNA, 22 nt, Human
caggcuugaugugucuauacuu

SEQ ID NO: 612214 - RNA, 22 nt, Human
uuuacagagaauguacauaaag

SEQ ID NO: 612215 - RNA, 22 nt, Human
cugaagcugggcacuuccuuuu

SEQ ID NO: 612216 - RNA, 22 nt, Human
acauuuguuucucuagaguagg

SEQ ID NO: 612217 - RNA, 22 nt, Human
gucauuuuugacuuugaaguga

SEQ ID NO: 612218 - RNA, 22 nt, Human
aaacaucuucucuugauucuuu

SEQ ID NO: 612219 - RNA, 22 nt, Human
caggaacacaaugagucucaaa

SEQ ID NO: 612220 - RNA, 22 nt, Human
aaaauuaagugucugggaagcc

SEQ ID NO: 612221 - RNA, 22 nt, Human
ucuaugucucuggaaggagugu

SEQ ID NO: 612222 - RNA, 22 nt, Human
aaagcacauuacaagcucaguc

SEQ ID NO: 612223 - RNA, 22 nt, Human
agcuaauguauguugaaagcac

SEQ ID NO: 612224 - RNA, 22 nt, Human
ucucauuuacuuccacaggcug

SEQ ID NO: 612225 - RNA, 22 nt, Human
augauugaaaaugacauugcca

SEQ ID NO: 612226 - RNA, 22 nt, Human
cagcuugcacacauauuagacg

SEQ ID NO: 612227 - RNA, 22 nt, Human
auuuccuguaggggcuugcgaa

SEQ ID NO: 612228 - RNA, 22 nt, Human
gauucugaaauuaacagacugg

SEQ ID NO: 612229 - RNA, 22 nt, Human
aucuuuggguacaaacuugccu

SEQ ID NO: 612230 - RNA, 22 nt, Human
uaaucuuagacauguauuuuuc

SEQ ID NO: 612231 - RNA, 22 nt, Human
acauuugauauggaguugugua

SEQ ID NO: 612232 - RNA, 22 nt, Human
ggaaacauuccaagaguugaaa

SEQ ID NO: 612233 - RNA, 22 nt, Human
uggaaagaggaagugcccagca

SEQ ID NO: 612234 - RNA, 16 nt, Human
aaacugacggcaucug

SEQ ID NO: 612235 - RNA, 22 nt, Human
agagcuagaaggaagcauuucu

SEQ ID NO: 612236 - RNA, 22 nt, Human
auauaguuggguuucauucuac

SEQ ID NO: 612237 - RNA, 22 nt, Human
aguuauguccucagcaaaucaa

SEQ ID NO: 612238 - RNA, 22 nt, Human
aacagauuguaaccugauagcc

SEQ ID NO: 612239 - RNA, 22 nt, Human
uuugggcuguacaauuucugua

SEQ ID NO: 612240 - RNA, 22 nt, Human
ggucauagagcuggaaauuggc

SEQ ID NO: 612241 - RNA, 22 nt, Human
uacaucucaucugugcucuccg

SEQ ID NO: 612242 - RNA, 22 nt, Human
cuggucaauaaucauguaguac

SEQ ID NO: 612243 - RNA, 22 nt, Human
auguacaaucuaucacaagaag

SEQ ID NO: 612244 - RNA, 22 nt, Human
agcacauucccaccuguacuuc

SEQ ID NO: 612245 - RNA, 22 nt, Human
aggcgaagggaccagacgguag

SEQ ID NO: 612246 - RNA, 22 nt, Human
cucucuccuuagcugcagacca

SEQ ID NO: 612247 - RNA, 22 nt, Human
gaaaauaguucaucacaaugau

SEQ ID NO: 612248 - RNA, 22 nt, Human
augaaacucuagcuuucagcac

SEQ ID NO: 612249 - RNA, 22 nt, Human
uuugacaacugugcaguuugua

SEQ ID NO: 612250 - RNA, 22 nt, Human
aaaaugcucaucagcgauggcu

SEQ ID NO: 612251 - RNA, 22 nt, Human
auugagaaggagauuggcaucu

SEQ ID NO: 612252 - RNA, 22 nt, Human
uaucauuuuacugugacauuuu

SEQ ID NO: 612253 - RNA, 22 nt, Human
uugagcagaucgggcugugggg

SEQ ID NO: 612254 - RNA, 22 nt, Human
auaucuaggcugaauguaaaau

SEQ ID NO: 612255 - RNA, 20 nt, Human
uacaauauucccacuuugcu

SEQ ID NO: 612256 - RNA, 22 nt, Human
aaucuguuuuaaaguuugugcc

SEQ ID NO: 612257 - RNA, 22 nt, Human
ucaugcaccucuccaugucccc

SEQ ID NO: 612258 - RNA, 22 nt, Human
cugcuuuaaaacugauacauga

SEQ ID NO: 612259 - RNA, 22 nt, Human
aacaucuagguucucaucgaua

SEQ ID NO: 612260 - RNA, 22 nt, Human
uaaaugaaaggguuuaauuuau

SEQ ID NO: 612261 - RNA, 22 nt, Human
auucagaaauagaaaauuugau

SEQ ID NO: 612262 - RNA, 22 nt, Human
uuacacaacaucuguauuauua

SEQ ID NO: 612263 - RNA, 22 nt, Human
aaagucuuaauguaaguuuagu

SEQ ID NO: 612264 - RNA, 22 nt, Human
aaugcuuuuugcgaaaugugca

SEQ ID NO: 612265 - RNA, 22 nt, Human
ugucuuuagccacuugccucuu

SEQ ID NO: 612266 - RNA, 22 nt, Human
ucaauucugccucuaaauauuu

SEQ ID NO: 612267 - RNA, 22 nt, Human
uuugagaaacagacgaaagaca

SEQ ID NO: 612268 - RNA, 22 nt, Human
auguuugaaauuguaaguauau

SEQ ID NO: 612269 - RNA, 19 nt, Human
ggaggcuucuuggggucgg

SEQ ID NO: 612270 - RNA, 22 nt, Human
gugguuguuuccagguuugaaa

SEQ ID NO: 612271 - RNA, 22 nt, Human
uuagcaaacaucuucgugugag

SEQ ID NO: 612272 - RNA, 22 nt, Human
aacugcuaacugguuugauacu

SEQ ID NO: 612273 - RNA, 22 nt, Human
aaugcugugauuuauuaaguau

SEQ ID NO: 612274 - RNA, 22 nt, Human
uaaguugauuauaaccacugga

SEQ ID NO: 612275 - RNA, 21 nt, Human
uggagagugauuucagugugg

SEQ ID NO: 612276 - RNA, 22 nt, Human
agccacauggaccugaugcuag

SEQ ID NO: 612277 - RNA, 22 nt, Human
acugcauucuuuaucccacaac

SEQ ID NO: 612278 - RNA, 22 nt, Human
gaugcugauuuuacuguuuucu

SEQ ID NO: 612279 - RNA, 22 nt, Human
guugcaaaugggaagaugguua

SEQ ID NO: 612280 - RNA, 22 nt, Human
ugcaauuagcguauuaguuuau

SEQ ID NO: 612281 - RNA, 22 nt, Human
aaacacaucauucaugucguca

SEQ ID NO: 612282 - RNA, 22 nt, Human
uuuccuacugcccuauacacac

SEQ ID NO: 612283 - RNA, 22 nt, Human
aagcuguuagggagugguaggu

SEQ ID NO: 612284 - RNA, 22 nt, Human
cauccauagauugagagauggu

SEQ ID NO: 612285 - RNA, 22 nt, Human
uuuguucaccuagcaaacuuuu

SEQ ID NO: 612286 - RNA, 20 nt, Human
caucaacaccuugucagccu

SEQ ID NO: 612287 - RNA, 22 nt, Human
uuccauacgacugaggucucgg

SEQ ID NO: 612288 - RNA, 22 nt, Human
uagcagaacaauagucaaugau

SEQ ID NO: 612289 - RNA, 22 nt, Human
aagcucuuuccacuaaaccacu

SEQ ID NO: 612290 - RNA, 22 nt, Human
gaauaauugugaugcuugaagu

SEQ ID NO: 612291 - RNA, 22 nt, Human
auauuuguuuggcagaguucag

SEQ ID NO: 612292 - RNA, 22 nt, Human
auuacugaggcaaaguaguuuu

SEQ ID NO: 612293 - RNA, 22 nt, Human
cugguuuuccaauguuuugacu

SEQ ID NO: 612294 - RNA, 18 nt, Human
gcugaaauucuaaacaaa

SEQ ID NO: 612295 - RNA, 22 nt, Human
ugauuugaaaccuuuggcaaga

SEQ ID NO: 612296 - RNA, 22 nt, Human
aacacuaaaggucaguuagaag

SEQ ID NO: 612297 - RNA, 22 nt, Human
uagaaagagcuuugcuuccuuu

SEQ ID NO: 612298 - RNA, 22 nt, Human
uucagaacugucuguccuuuuc

SEQ ID NO: 612299 - RNA, 22 nt, Human
auggaguugagcucuguugucc

SEQ ID NO: 612300 - RNA, 22 nt, Human
ugucuagaaaugcugagucuca

SEQ ID NO: 612301 - RNA, 22 nt, Human
uagcagcacuauuuguuguagu

SEQ ID NO: 612302 - RNA, 22 nt, Human
gcaaggagcaccuuucuggaac

SEQ ID NO: 612303 - RNA, 22 nt, Human
uuaaccagguccuuugaaaaca

SEQ ID NO: 612304 - RNA, 22 nt, Human
cuuauuugcccauguuucuuua

SEQ ID NO: 612305 - RNA, 22 nt, Human
gagacagagagguacucaacau

SEQ ID NO: 612306 - RNA, 19 nt, Human
aacuacagcgcacuguccu

SEQ ID NO: 612307 - RNA, 19 nt, Human
uaugacaaguacuaguucu

SEQ ID NO: 612308 - RNA, 22 nt, Human
ugaaaacacuuuaguuuagguc

SEQ ID NO: 612309 - RNA, 22 nt, Human
gcuuccaaugcuucuaucacau

SEQ ID NO: 612310 - RNA, 22 nt, Human
uuugagugcccauguuucccag

SEQ ID NO: 612311 - RNA, 22 nt, Human
uacauguuauuucacuauuggu

SEQ ID NO: 612312 - RNA, 22 nt, Human
uucagaaaggcugugccagcca

SEQ ID NO: 612313 - RNA, 22 nt, Human
aaacuagguucugauuuccaag

SEQ ID NO: 612314 - RNA, 22 nt, Human
uuguacuuaaauaugcaaauag

SEQ ID NO: 612315 - RNA, 22 nt, Human
agaaaagaggcuuucuaagcau

SEQ ID NO: 612316 - RNA, 22 nt, Human
aucuaugugggaaucauaauag

SEQ ID NO: 612317 - RNA, 22 nt, Human
cucuccaggcgagguccuacug

SEQ ID NO: 612318 - RNA, 22 nt, Human
cuugugaaaugccagauaaucu

SEQ ID NO: 612319 - RNA, 22 nt, Human
uuacaauuacuugaucucagcu

SEQ ID NO: 612320 - RNA, 22 nt, Human
aacaguaugugagauuuacaca

SEQ ID NO: 612321 - RNA, 22 nt, Human
aucuguucuucaaaauauuaca

SEQ ID NO: 612322 - RNA, 22 nt, Human
uuccuguucaggaaaguugugu

SEQ ID NO: 612323 - RNA, 22 nt, Human
uuugaagauaaauauggagaaa

SEQ ID NO: 612324 - RNA, 22 nt, Human
ugucacagugcacagcuaagaa

SEQ ID NO: 612325 - RNA, 22 nt, Human
agaaagcacccugcacuuucug

SEQ ID NO: 612326 - RNA, 22 nt, Human
ucaaagcacuggggaaagccug

SEQ ID NO: 612327 - RNA, 22 nt, Human
cugcugucuuuauuucacugcu

SEQ ID NO: 612328 - RNA, 22 nt, Human
ggaaugcacuagacugugaaac

SEQ ID NO: 612329 - RNA, 22 nt, Human
uucuguaauucuguuaguuuca

SEQ ID NO: 612330 - RNA, 23 nt, Human
agugaugucacccacagacaagg

SEQ ID NO: 612331 - RNA, 20 nt, Human
uuacagaaaugauguuauuu

SEQ ID NO: 612332 - RNA, 21 nt, Human
gcucuguguuacaaguugggg

SEQ ID NO: 612333 - RNA, 22 nt, Human
auuguugacuugauuacucaac

SEQ ID NO: 612334 - RNA, 22 nt, Human
agauguuuuuccaggucuaauu

SEQ ID NO: 612335 - RNA, 22 nt, Human
guucuucaggcugugcucuaga

SEQ ID NO: 612336 - RNA, 22 nt, Human
uaucuguauucugacagucacu

SEQ ID NO: 612337 - RNA, 22 nt, Human
aacuuagagcucuccuaaauga

SEQ ID NO: 612338 - RNA, 22 nt, Human
agacauauuggcuugcuuuaau

SEQ ID NO: 612339 - RNA, 22 nt, Human
uaggaaugcagaugcauaauaa

SEQ ID NO: 612340 - RNA, 21 nt, Human
acagaagcggcgaguggcccc

SEQ ID NO: 612341 - RNA, 22 nt, Human
uguaagcuucaaauaucuguga

SEQ ID NO: 612342 - RNA, 22 nt, Human
uaucuagagccuggaagucuug

SEQ ID NO: 612343 - RNA, 22 nt, Human
gccagagaggccuuagaaucca

SEQ ID NO: 612344 - RNA, 22 nt, Human
cuuguauuaggaagaaugcuuu

SEQ ID NO: 612345 - RNA, 22 nt, Human
aaaugcacugaauauuccaaau

SEQ ID NO: 612346 - RNA, 22 nt, Human
gcugaagagagaugcguccagc

SEQ ID NO: 612347 - RNA, 22 nt, Human
uagcaggagagaaguuuuaagu

SEQ ID NO: 612348 - RNA, 22 nt, Human
auccauuuuuucagaaugcucu

SEQ ID NO: 612349 - RNA, 22 nt, Human
uaacacauagauauuuuaacuu

SEQ ID NO: 612350 - RNA, 22 nt, Human
aauguuacgaucaacaacacau

SEQ ID NO: 612351 - RNA, 22 nt, Human
ucacaguucaacuaguucagau

SEQ ID NO: 612352 - RNA, 22 nt, Human
ugcacagagggaggcauaaaau

SEQ ID NO: 612353 - RNA, 22 nt, Human
aagcaauucacaguucacuuaa

SEQ ID NO: 612354 - RNA, 22 nt, Human
uugcucuauguuuguaaacaga

SEQ ID NO: 612355 - RNA, 23 nt, Human
auuuccuaaaagauaaucauuac

SEQ ID NO: 612356 - RNA, 22 nt, Human
uuagacaucaagaagccaaugu

SEQ ID NO: 612357 - RNA, 17 nt, Human
auucaugaacauguccu

SEQ ID NO: 612358 - RNA, 22 nt, Human
auuuacucgugcuucauugaau

SEQ ID NO: 612359 - RNA, 22 nt, Human
uucucaggaacucagugucagc

SEQ ID NO: 612360 - RNA, 22 nt, Human
aagcaaaagguuacacuucugg

SEQ ID NO: 612361 - RNA, 21 nt, Human
uuuguucaggggcaaaguuaa

SEQ ID NO: 612362 - RNA, 22 nt, Human
aaggccaucuacuuacggaauu

SEQ ID NO: 612363 - RNA, 22 nt, Human
aagauuuaccacuuuauucaag

SEQ ID NO: 612364 - RNA, 22 nt, Human
cagaaagugauuugcuauucca

SEQ ID NO: 612365 - RNA, 22 nt, Human
uugcaucagcaggcauaauugg

SEQ ID NO: 612366 - RNA, 22 nt, Human
ucccagauuccugcucuuauau

SEQ ID NO: 612367 - RNA, 22 nt, Human
ggggaagaaauagaacauuuug

SEQ ID NO: 612368 - RNA, 22 nt, Human
uucuacauugugaaguucuuua

SEQ ID NO: 612369 - RNA, 22 nt, Human
ugugucuaaugacuauuucuuc

SEQ ID NO: 612370 - RNA, 22 nt, Human
cucugcaaggcccuccaguagc

SEQ ID NO: 612371 - RNA, 22 nt, Human
auuuccuauacaguuguccaua

SEQ ID NO: 612372 - RNA, 22 nt, Human
guuugcaaauuguguuaaagcu

SEQ ID NO: 612373 - RNA, 22 nt, Human
auggcuucugucuuggaaauuu

SEQ ID NO: 612374 - RNA, 22 nt, Human
acuagaaacuaauggauuauua

SEQ ID NO: 612375 - RNA, 22 nt, Human
cacagaggaugcccaagcgauc

SEQ ID NO: 612376 - RNA, 22 nt, Human
cagaaacacuguauuuagggaa

SEQ ID NO: 612377 - RNA, 22 nt, Human
ggcaagaaccucaauuaccuuu

SEQ ID NO: 612378 - RNA, 22 nt, Human
auagucuuagaaucuugagugu

SEQ ID NO: 612379 - RNA, 22 nt, Human
guucucucagcgauagugaugg

SEQ ID NO: 612380 - RNA, 22 nt, Human
uuugaaauguaucaguauaggu

SEQ ID NO: 612381 - RNA, 22 nt, Human
cgaguaauuggaaauuugcuau

SEQ ID NO: 612382 - RNA, 22 nt, Human
cauaacauccuugcuacuuuga

SEQ ID NO: 612383 - RNA, 22 nt, Human
uuuauccaccuuacccuguucc

SEQ ID NO: 612384 - RNA, 22 nt, Human
aagucauugguagcuugauagg

SEQ ID NO: 612385 - RNA, 22 nt, Human
aagaaaagguaaccgcuuaucu

SEQ ID NO: 612386 - RNA, 22 nt, Human
agugaaauaugcccauugcugu

SEQ ID NO: 612387 - RNA, 22 nt, Human
ggcccucucuacauguuagacg

SEQ ID NO: 612388 - RNA, 22 nt, Human
aguguuaaggcugguugcuaua

SEQ ID NO: 612389 - RNA, 22 nt, Human
auggcauuugaaucugucuuuu

SEQ ID NO: 612390 - RNA, 22 nt, Human
aucacaguuuuaccauuuggua

SEQ ID NO: 612391 - RNA, 22 nt, Human
cacaauuuccauugagcagcag

SEQ ID NO: 612392 - RNA, 22 nt, Human
cuuuaguucuagaaagugaaac

SEQ ID NO: 612393 - RNA, 22 nt, Human
agaaacaucgcuuaguccucau

SEQ ID NO: 612394 - RNA, 22 nt, Human
uagcauuucacugaucuucacu

SEQ ID NO: 612395 - RNA, 22 nt, Human
ucacuguuaauaaauagcaaag

SEQ ID NO: 612396 - RNA, 22 nt, Human
augagcuaagcagaaagcacac

SEQ ID NO: 612397 - RNA, 22 nt, Human
acucauuugcaugaugugcuau

SEQ ID NO: 612398 - RNA, 21 nt, Human
acaguacuugagaucuuuuga

SEQ ID NO: 612399 - RNA, 22 nt, Human
aauucaaggaucuguuaaaucu

SEQ ID NO: 612400 - RNA, 22 nt, Human
uguggaagaacuucuugcuugg

SEQ ID NO: 612401 - RNA, 22 nt, Human
ucuucacaguccuggucagugg

SEQ ID NO: 612402 - RNA, 22 nt, Human
cuuuacuucagcaagcuuuccu

SEQ ID NO: 612403 - RNA, 22 nt, Human
auacagaagaccccuccgucau

SEQ ID NO: 612404 - RNA, 22 nt, Human
gugauugugaaaacauuaagaa

SEQ ID NO: 612405 - RNA, 22 nt, Human
caagaaguugacagccagguga

SEQ ID NO: 612406 - RNA, 22 nt, Human
uggccagaacucagacaugugg

SEQ ID NO: 612407 - RNA, 22 nt, Human
acugauuucagggaugagaaga

SEQ ID NO: 612408 - RNA, 22 nt, Human
uucagagcuggugucuacagcu

SEQ ID NO: 612409 - RNA, 22 nt, Human
acugcauuugguaaagucaaga

SEQ ID NO: 612410 - RNA, 22 nt, Human
uuuguguuguacuucugugcau

SEQ ID NO: 612411 - RNA, 22 nt, Human
uguguuuuggaaggaacaugca

SEQ ID NO: 612412 - RNA, 22 nt, Human
acaggauuaauaaaaaauugua

SEQ ID NO: 612413 - RNA, 22 nt, Human
uucaacaacuugguucaaaugg

SEQ ID NO: 612414 - RNA, 22 nt, Human
ugaauagagcugcaguggacau

SEQ ID NO: 612415 - RNA, 22 nt, Human
augcacacguacccuacaaggc

SEQ ID NO: 612416 - RNA, 17 nt, Human
ucuggaugucauggaag

SEQ ID NO: 612417 - RNA, 22 nt, Human
augauuuguuaacagacuuaau

SEQ ID NO: 612418 - RNA, 22 nt, Human
gaagaaguguaagucuguuuca

SEQ ID NO: 612419 - RNA, 22 nt, Human
gaaaugucaagauauguuugga

SEQ ID NO: 612420 - RNA, 22 nt, Human
auacaacagaaaaugauuauuc

SEQ ID NO: 612421 - RNA, 22 nt, Human
caaacugaacacgaaagucuuu

SEQ ID NO: 612422 - RNA, 22 nt, Human
cacagagagcuacgugcagcgu

SEQ ID NO: 612423 - RNA, 21 nt, Human
uucacaguggauaacuuucug

SEQ ID NO: 612424 - RNA, 22 nt, Human
uuggcaauauuuacugaaguug

SEQ ID NO: 612425 - RNA, 21 nt, Human
uaaaagaugacaagacagcuc

SEQ ID NO: 612426 - RNA, 22 nt, Human
uugagacacaaggcacaguaag

SEQ ID NO: 612427 - RNA, 22 nt, Human
uuucugaggaauuaauacagaa

SEQ ID NO: 612428 - RNA, 22 nt, Human
aaguguguauuuuucuucagug

SEQ ID NO: 612429 - RNA, 22 nt, Human
ugcuugucacccugccugagug

SEQ ID NO: 612430 - RNA, 22 nt, Human
gccaaucaggaggcuguacauc

SEQ ID NO: 612431 - RNA, 22 nt, Human
ucauacauguuguguucaaaug

SEQ ID NO: 612432 - RNA, 22 nt, Human
aguacuuuuuguucaauugugc

SEQ ID NO: 612433 - RNA, 22 nt, Human
guaguucuuucucaauguucaa

SEQ ID NO: 612434 - RNA, 22 nt, Human
agauauguuaggcuuguucccu

SEQ ID NO: 612435 - RNA, 22 nt, Human
uauuuguuucuaguggcagcaa

SEQ ID NO: 612436 - RNA, 20 nt, Human
aaagauacuuuuuguaaugg

SEQ ID NO: 612437 - RNA, 23 nt, Human
cuguuauauggguguuaugugcu

SEQ ID NO: 612438 - RNA, 22 nt, Human
ucaagaaagggcuucaccagga

SEQ ID NO: 612439 - RNA, 22 nt, Human
uaauuucagugcaagcucacgg

SEQ ID NO: 612440 - RNA, 22 nt, Human
uaucugucgggagucuuccgga

SEQ ID NO: 612441 - RNA, 22 nt, Human
cugcagaugguauuguucuggu

SEQ ID NO: 612442 - RNA, 22 nt, Human
uuguacaaauaggaaccucuga

SEQ ID NO: 612443 - RNA, 22 nt, Human
caguuuuacccaagcuuauuuu

SEQ ID NO: 612444 - RNA, 22 nt, Human
uuuaaaccuaucuaagaaauag

SEQ ID NO: 612445 - RNA, 22 nt, Human
guacauauccuuuacguuuugu

SEQ ID NO: 612446 - RNA, 22 nt, Human
guguggcuaggauggcuuugcu

SEQ ID NO: 612447 - RNA, 22 nt, Human
uauccaaaggaacaaucacagc

SEQ ID NO: 612448 - RNA, 22 nt, Human
cucaggaaaauauugaagaagu

SEQ ID NO: 612449 - RNA, 22 nt, Human
uugcauauccuccaacacaugg

SEQ ID NO: 612450 - RNA, 22 nt, Human
auuagccuguugcauuuucacu

SEQ ID NO: 612451 - RNA, 22 nt, Human
gucaaaacaaaguuaagaauuc

SEQ ID NO: 612452 - RNA, 22 nt, Human
ucuguuauaaaucacacugcau

SEQ ID NO: 612453 - RNA, 20 nt, Human
cucuuuucacucucaguggu

SEQ ID NO: 612454 - RNA, 22 nt, Human
ucuuauugugaugaugaagaac

SEQ ID NO: 612455 - RNA, 22 nt, Human
ugggcacacugaaucugcuauu

SEQ ID NO: 612456 - RNA, 22 nt, Human
aguucugacucugaaucuggga

SEQ ID NO: 612457 - RNA, 22 nt, Human
aggcauuacaucuaaauauuua

SEQ ID NO: 612458 - RNA, 22 nt, Human
uuuccaaagguggcaggaacaa

SEQ ID NO: 612459 - RNA, 22 nt, Human
auucauucugaccucaagagaa

SEQ ID NO: 612460 - RNA, 22 nt, Human
uucacauaaucugcagcaagcg

SEQ ID NO: 612461 - RNA, 19 nt, Human
ucuuucauuucuagcucug

SEQ ID NO: 612462 - RNA, 22 nt, Human
caucuuuguuuuggauauaauc

SEQ ID NO: 612463 - RNA, 22 nt, Human
guguaucaacauguuuuuugug

SEQ ID NO: 612464 - RNA, 22 nt, Human
acaguaaucugggaacuuguua

SEQ ID NO: 612465 - RNA, 22 nt, Human
auugaacauuguucuaggaggc

SEQ ID NO: 612466 - RNA, 21 nt, Human
uuccuggaggcagaaacguga

SEQ ID NO: 612467 - RNA, 22 nt, Human
aaugauguuuuuaaagaacaua

SEQ ID NO: 612468 - RNA, 22 nt, Human
uaugcuguauucuguauguuag

SEQ ID NO: 612469 - RNA, 22 nt, Human
uaagaaacauuuuuaugacagu

SEQ ID NO: 612470 - RNA, 22 nt, Human
auuguuacuggguuaauuugga

SEQ ID NO: 612471 - RNA, 22 nt, Human
uagcaucuguacugacauaauc

SEQ ID NO: 612472 - RNA, 22 nt, Human
cagcacauggauggaguuagga

SEQ ID NO: 612473 - RNA, 22 nt, Human
auugucgucaauggacacauag

SEQ ID NO: 612474 - RNA, 22 nt, Human
gugacagguauacucaccauug

SEQ ID NO: 612475 - RNA, 22 nt, Human
acuuuucuuaucagaaaggcca

SEQ ID NO: 612476 - RNA, 22 nt, Human
uugagacucgagucucucagac

SEQ ID NO: 612477 - RNA, 20 nt, Human
auuugcuuaccuuguuucua

SEQ ID NO: 612478 - RNA, 22 nt, Human
uuugaacuucuaccugucauau

SEQ ID NO: 612479 - RNA, 22 nt, Human
accaagaguccaagugagguug

SEQ ID NO: 612480 - RNA, 21 nt, Human
ucaauuauggaugugugcaaa

SEQ ID NO: 612481 - RNA, 22 nt, Human
uacugaaagagugguggacucu

SEQ ID NO: 612482 - RNA, 22 nt, Human
ucacgugagggaccugugucug

SEQ ID NO: 612483 - RNA, 22 nt, Human
cugguuuuuagugcuuaggagu

SEQ ID NO: 612484 - RNA, 22 nt, Human
guucuucaaagugacaacuaaa

SEQ ID NO: 612485 - RNA, 22 nt, Human
augaaaacagccuccugugaua

SEQ ID NO: 612486 - RNA, 22 nt, Human
uuuuuaagagucuggaaauagu

SEQ ID NO: 612487 - RNA, 19 nt, Human
ugaggauugagguccagua

SEQ ID NO: 612488 - RNA, 22 nt, Human
agccugugaaaucucugccacu

SEQ ID NO: 612489 - RNA, 22 nt, Human
auguaacauaugugaucgcauu

SEQ ID NO: 612490 - RNA, 22 nt, Human
auuuuguaucuuacggggacua

SEQ ID NO: 612491 - RNA, 22 nt, Human
uuuccagucucugccuccaagg

SEQ ID NO: 612492 - RNA, 22 nt, Human
uuucauguuggauacuguuuca

SEQ ID NO: 612493 - RNA, 22 nt, Human
uuccaaggcugcuauuuguuuc

SEQ ID NO: 612494 - RNA, 22 nt, Human
uccacagugguggaauuguuca

SEQ ID NO: 612495 - RNA, 21 nt, Human
uaagaacauuaucuucuuccu

SEQ ID NO: 612496 - RNA, 22 nt, Human
uugaacaguccuaagagacccu

SEQ ID NO: 612497 - RNA, 22 nt, Human
acucaucuuugaauuuucagua

SEQ ID NO: 612498 - RNA, 22 nt, Human
ugaguguuguaaccauaugauu

SEQ ID NO: 612499 - RNA, 22 nt, Human
aagcaccuggguuauaucuuag

SEQ ID NO: 612500 - RNA, 22 nt, Human
uccaagaagcuuacaaucuaau

SEQ ID NO: 612501 - RNA, 22 nt, Human
uuucccaggcuggaaugcagug

SEQ ID NO: 612502 - RNA, 22 nt, Human
acuaauugaaaugagacuggug

SEQ ID NO: 612503 - RNA, 22 nt, Human
aacuuucagaauccuaugcauu

SEQ ID NO: 612504 - RNA, 22 nt, Human
ucagcacaggucuugcaaaaca

SEQ ID NO: 612505 - RNA, 22 nt, Human
agccuugcaugauuucauucau

SEQ ID NO: 612506 - RNA, 22 nt, Human
ugcaggcuggaggagggacuaa

SEQ ID NO: 612507 - RNA, 22 nt, Human
cugagcaucauggcagaaucuu

SEQ ID NO: 612508 - RNA, 22 nt, Human
uguuccugacggccaaagaggu

SEQ ID NO: 612509 - RNA, 22 nt, Human
uacauggauguuauccuuacug

SEQ ID NO: 612510 - RNA, 22 nt, Human
cacuguugagcaauguacagug

SEQ ID NO: 612511 - RNA, 22 nt, Human
uuuggcaagcgaguacuuucug

SEQ ID NO: 612512 - RNA, 22 nt, Human
cuuugcuaauguugcauuuuca

SEQ ID NO: 612513 - RNA, 22 nt, Human
uagcuguucucuguaaauugga

SEQ ID NO: 612514 - RNA, 22 nt, Human
cuguccauggcaaugaugcaga

SEQ ID NO: 612515 - RNA, 22 nt, Human
ucuuuuaucuguuguguaacaa

SEQ ID NO: 612516 - RNA, 22 nt, Human
ugaggucuguccugucuuugga

SEQ ID NO: 612517 - RNA, 22 nt, Human
caguguuuagcacagugcuugg

SEQ ID NO: 612518 - RNA, 22 nt, Human
aggaaauuuugaaucagugucu

SEQ ID NO: 612519 - RNA, 22 nt, Human
ugcacccacuuagcugaaguuc

SEQ ID NO: 612520 - RNA, 22 nt, Human
agauuucaauggauauugcaag

SEQ ID NO: 612521 - RNA, 22 nt, Human
uguccugugcacuguagcaugu

SEQ ID NO: 612522 - RNA, 22 nt, Human
acauucucuuuuagaaagcugu

SEQ ID NO: 612523 - RNA, 20 nt, Human
ugugcccaauguccagguuc

SEQ ID NO: 612524 - RNA, 22 nt, Human
cauuuacauuuaagguuaauau

SEQ ID NO: 612525 - RNA, 22 nt, Human
uugcuucacuacuucuaggcuc

SEQ ID NO: 612526 - RNA, 17 nt, Human
aggucugagaguaucug

SEQ ID NO: 612527 - RNA, 22 nt, Human
auuguauacaagcuuaauuguu

SEQ ID NO: 612528 - RNA, 22 nt, Human
auucuugauauagauaguuaau

SEQ ID NO: 612529 - RNA, 19 nt, Human
auucuucucuuccugcugu

SEQ ID NO: 612530 - RNA, 23 nt, Human
caaaaugcuaugugcccaaugca

SEQ ID NO: 612531 - RNA, 22 nt, Human
ugaauaugugacuuugauuuca

SEQ ID NO: 612532 - RNA, 22 nt, Human
caugcaugccgggcugacagag

SEQ ID NO: 612533 - RNA, 22 nt, Human
ccuuuuauauggcucaucacag

SEQ ID NO: 612534 - RNA, 22 nt, Human
aauggcaaaguguuuucauacc

SEQ ID NO: 612535 - RNA, 22 nt, Human
ugugcuauuuuugcauaugugu

SEQ ID NO: 612536 - RNA, 22 nt, Human
ugguggcacugacaucagacac

SEQ ID NO: 612537 - RNA, 22 nt, Human
uaucuguuuuuacagugucuuu

SEQ ID NO: 612538 - RNA, 22 nt, Human
caacuuuagaccccaaguagcu

SEQ ID NO: 612539 - RNA, 21 nt, Human
agaaggcaaaagcagacaucu

SEQ ID NO: 612540 - RNA, 22 nt, Human
uacguuuuaaacacggagccag

SEQ ID NO: 612541 - RNA, 22 nt, Human
agcaaauaauugucuuugaggg

SEQ ID NO: 612542 - RNA, 22 nt, Human
ugacauuugagagagauauaca

SEQ ID NO: 612543 - RNA, 22 nt, Human
uaacauuucggugacaguggga

SEQ ID NO: 612544 - RNA, 22 nt, Human
uuuuaauccucuugguaucuua

SEQ ID NO: 612545 - RNA, 22 nt, Human
uauaaacuccucuugcauuccu

SEQ ID NO: 612546 - RNA, 22 nt, Human
augccccagugugugcuuccuu

SEQ ID NO: 612547 - RNA, 22 nt, Human
acaaacagaguugaaaaauagg

SEQ ID NO: 612548 - RNA, 22 nt, Human
aacaugaugacauuguaagcuu

SEQ ID NO: 612549 - RNA, 22 nt, Human
uguucuuagguauuugacaguc

SEQ ID NO: 612550 - RNA, 22 nt, Human
uaaaaguuagcuaggacaaagu

SEQ ID NO: 612551 - RNA, 22 nt, Human
ucuuuugagggccagaggaaga

SEQ ID NO: 612552 - RNA, 22 nt, Human
uguaaagaaagacgcagaguua

SEQ ID NO: 612553 - RNA, 22 nt, Human
uugcaaauaauagccugaaacu

SEQ ID NO: 612554 - RNA, 22 nt, Human
ggacaucuguugugguagagga

SEQ ID NO: 612555 - RNA, 22 nt, Human
agagacuguaaugagagguaca

SEQ ID NO: 612556 - RNA, 23 nt, Human
cauuugauccucacaauaaaugg

SEQ ID NO: 612557 - RNA, 20 nt, Human
uugagcagcagugcuguguc

SEQ ID NO: 612558 - RNA, 22 nt, Human
guuuccaggcuuugguaugguu

SEQ ID NO: 612559 - RNA, 22 nt, Human
acauuguugagccucuuguuca

SEQ ID NO: 612560 - RNA, 22 nt, Human
uuauugagcacauaguaugugg

SEQ ID NO: 612561 - RNA, 22 nt, Human
uggcauuuuguagcuguguauc

SEQ ID NO: 612562 - RNA, 22 nt, Human
cucagcaacccacacacggucu

SEQ ID NO: 612563 - RNA, 22 nt, Human
cauugcaacuucaaacuccugg

SEQ ID NO: 612564 - RNA, 22 nt, Human
gugcauauguguguauacaaac

SEQ ID NO: 612565 - RNA, 19 nt, Human
uuuaaugugugcugcaauc

SEQ ID NO: 612566 - RNA, 22 nt, Human
uggaaauacaagaaguauguca

SEQ ID NO: 612567 - RNA, 22 nt, Human
aaaucccacucacgaguuuugc

SEQ ID NO: 612568 - RNA, 22 nt, Human
gcucugugggggaaauccuggg

SEQ ID NO: 612569 - RNA, 22 nt, Human
gaauguuaaugcacuucuagcu

SEQ ID NO: 612570 - RNA, 22 nt, Human
gaaacacucaauuuaguaauuc

SEQ ID NO: 612571 - RNA, 17 nt, Human
aguuuuuggaccugugu

SEQ ID NO: 612572 - RNA, 22 nt, Human
uuuggauugcuuggaugcuucg

SEQ ID NO: 612573 - RNA, 22 nt, Human
cuuuggaaaaauaccuggcaua

SEQ ID NO: 612574 - RNA, 22 nt, Human
agauguuuauaacucaugagug

SEQ ID NO: 612575 - RNA, 22 nt, Human
ugcucagaauugcgcuggugga

SEQ ID NO: 612576 - RNA, 19 nt, Human
aaugcugcuucuuuuugca

SEQ ID NO: 612577 - RNA, 22 nt, Human
acauuucuccuacuuguuauuu

SEQ ID NO: 612578 - RNA, 18 nt, Human
guagauccuugagcuacc

SEQ ID NO: 612579 - RNA, 22 nt, Human
caguuuuucaaaauuacaugau

SEQ ID NO: 612580 - RNA, 20 nt, Human
cuugaguucagagcugucau

SEQ ID NO: 612581 - RNA, 22 nt, Human
cauucauaggaggagaugauua

SEQ ID NO: 612582 - RNA, 22 nt, Human
uuuacagcuacuguccuauuuc

SEQ ID NO: 612583 - RNA, 22 nt, Human
gagcuuuucccgucuuucucgu

SEQ ID NO: 612584 - RNA, 22 nt, Human
gucuguggaguugcuugcugga

SEQ ID NO: 612585 - RNA, 22 nt, Human
agacacuguguacagaaaaaga

SEQ ID NO: 612586 - RNA, 22 nt, Human
ccagagacaaggagcuggaguc

SEQ ID NO: 612587 - RNA, 22 nt, Human
cacaucauguuaauucauuaca

SEQ ID NO: 612588 - RNA, 22 nt, Human
acacaucagaaauaugaaugag

SEQ ID NO: 612589 - RNA, 22 nt, Human
uuucaugauuaacuuagugaau

SEQ ID NO: 612590 - RNA, 22 nt, Human
uaauucuagauugacauuuuga

SEQ ID NO: 612591 - RNA, 22 nt, Human
uuaagagaagaguaucuagaac

SEQ ID NO: 612592 - RNA, 22 nt, Human herpesvirus 7
agucauuuucaaauagaguuua

SEQ ID NO: 612593 - RNA, 22 nt, Human herpesvirus 7
auccaaaucucagauauugcgu

SEQ ID NO: 612594 - RNA, 22 nt, Human herpesvirus 7
accagguuaugcaauuuuuacc

SEQ ID NO: 612595 - RNA, 22 nt, Human herpesvirus 7
agucucagcaccgcggauuuac

SEQ ID NO: 612596 - RNA, 22 nt, Human herpesvirus 7
aaucuauauguuguauuaaaau

SEQ ID NO: 612597 - RNA, 22 nt, Human herpesvirus 7
aaucuauggaugcaccaaacac

SEQ ID NO: 612598 - RNA, 22 nt, Human herpesvirus 7
acaguaaguaaaaaugguuaca

SEQ ID NO: 612599 - RNA, 22 nt, Human herpesvirus 7
aaaaagauauuuuauauagauu

SEQ ID NO: 612600 - RNA, 22 nt, Human herpesvirus 7
aaauuuuagcuucacugaaaag

SEQ ID NO: 612601 - RNA, 21 nt, Human herpesvirus 7
aaaaagauugugagcaauuua

SEQ ID NO: 612602 - RNA, 22 nt, Human herpesvirus 7
acacugaaacauaguacaaggg

SEQ ID NO: 612603 - RNA, 22 nt, Human herpesvirus 7
acaguuuauggacaauuuuggc

SEQ ID NO: 612604 - RNA, 20 nt, Human herpesvirus 7
aauaugucucugauggucuc

SEQ ID NO: 612605 - RNA, 22 nt, Human herpesvirus 7
agaagcuaugaugccugugaau

SEQ ID NO: 612606 - RNA, 19 nt, Human herpesvirus 7
gaaguucacaucuguucuu

SEQ ID NO: 612607 - RNA, 22 nt, Human herpesvirus 7
gacagguguuguuuccgaucua

SEQ ID NO: 612608 - RNA, 22 nt, Human herpesvirus 7
gacauugaaaaaaucugcuguu

SEQ ID NO: 612609 - RNA, 22 nt, Human herpesvirus 7
cauguaaguauugguuugcuca

SEQ ID NO: 612610 - RNA, 22 nt, Human herpesvirus 7
auucacaggcaucauagcuucu

SEQ ID NO: 612611 - RNA, 20 nt, Human herpesvirus 7
auuucuucaaaauugcuauu

SEQ ID NO: 612612 - RNA, 22 nt, Human herpesvirus 7
auggagcaaauguuuuacuacg

SEQ ID NO: 612613 - RNA, 22 nt, Human herpesvirus 7
acauuuguggccaggcaauuga

SEQ ID NO: 612614 - RNA, 22 nt, Human herpesvirus 7
aaacacaggaaaaauaguggug

SEQ ID NO: 612615 - RNA, 22 nt, Human herpesvirus 7
aaguugggacaaugcuuagaau

SEQ ID NO: 612616 - RNA, 22 nt, Human herpesvirus 7
aagaggaauagcacgucgcgga

SEQ ID NO: 612617 - RNA, 22 nt, Human herpesvirus 7
augaacaauaucguuuauuuca

SEQ ID NO: 612618 - RNA, 18 nt, Human herpesvirus 7
auaucuaaaguggagaca

SEQ ID NO: 612619 - RNA, 22 nt, Human herpesvirus 7
auuuaccucacuuucuucagua

SEQ ID NO: 612620 - RNA, 22 nt, Human herpesvirus 7
cacuggagaaugucgaggucuu

SEQ ID NO: 612621 - RNA, 22 nt, Human herpesvirus 7
caggggcuaucagaaacuuuca

SEQ ID NO: 612622 - RNA, 22 nt, Human herpesvirus 7
ugugcucuggcgucucgauagg

SEQ ID NO: 612623 - RNA, 22 nt, Human herpesvirus 7
ggguuagggccgcagcccuagg

SEQ ID NO: 612624 - RNA, 22 nt, Human herpesvirus 7
ggccauggcaaugcuacgaguu

SEQ ID NO: 612625 - RNA, 22 nt, Human herpesvirus 7
guacuaggucuuguucuagcuu

SEQ ID NO: 612626 - RNA, 21 nt, Human herpesvirus 7
uaugaagaguucuuguuugga

SEQ ID NO: 612627 - RNA, 22 nt, Human herpesvirus 7
guuguugucauuaaaagagauu

SEQ ID NO: 612628 - RNA, 22 nt, Human herpesvirus 7
uccuucuugagaugcccaagga

SEQ ID NO: 612629 - RNA, 23 nt, Human herpesvirus 7
ucuaaaaauaucuauuugcuuau

SEQ ID NO: 612630 - RNA, 22 nt, Human herpesvirus 7
ucaaauguuugcauuguguuuc

SEQ ID NO: 612631 - RNA, 22 nt, Human herpesvirus 7
ucagaacacaaucuuucggugu

SEQ ID NO: 612632 - RNA, 22 nt, Human herpesvirus 7
uuauagacguggaauuucuugg

SEQ ID NO: 612633 - RNA, 22 nt, Human herpesvirus 7
ugugauuauugcauuugcuuca

SEQ ID NO: 612634 - RNA, 22 nt, Human herpesvirus 7
uggucucuggaagcguggucug

SEQ ID NO: 612635 - RNA, 22 nt, Human herpesvirus 7
ugauaacaguugaaagccaaau

SEQ ID NO: 612636 - RNA, 22 nt, Human herpesvirus 7
uggagggaauagacgauuauca

SEQ ID NO: 612637 - RNA, 22 nt, Human herpesvirus 7
uucaggaaaaacgguguuguaa

SEQ ID NO: 612638 - RNA, 22 nt, Human herpesvirus 7
uucaugcucaucgucuccaagc

SEQ ID NO: 612639 - RNA, 22 nt, Human herpesvirus 7
uugaucagcgaauugggaauaa

SEQ ID NO: 612640 - RNA, 22 nt, Human herpesvirus 7
uuuggaagugcagaaaguuggu

SEQ ID NO: 612641 - RNA, 22 nt, Human herpesvirus 7
ugauggaucugguguccuucuu

SEQ ID NO: 612642 - RNA, 22 nt, Human herpesvirus 7
ugucauaaauuuuaguugccgu

SEQ ID NO: 612643 - RNA, 22 nt, Human herpesvirus 7
auauuucugaugaauagcuuuu

SEQ ID NO: 612644 - RNA, 22 nt, Human herpesvirus 7
aucuucuagaguuauugccgug

SEQ ID NO: 612645 - RNA, 22 nt, Human herpesvirus 7
augccaccgcuaacuacggugg

SEQ ID NO: 612646 - RNA, 22 nt, Human herpesvirus 7
cugcaacuuuucuccgcguccg

SEQ ID NO: 612647 - RNA, 22 nt, Human herpesvirus 7
uuggagucguucuauguaugaa

SEQ ID NO: 612648 - RNA, 22 nt, Human herpesvirus 7
uugaaucaacugcauaaauucg

SEQ ID NO: 612649 - RNA, 22 nt, Human herpesvirus 7
uugauuggaaaucaaaauucug

SEQ ID NO: 612650 - RNA, 22 nt, Human herpesvirus 7
uugcaagaugcugaggauuuaa

SEQ ID NO: 612651 - RNA, 22 nt, Human herpesvirus 7
uuccuauguguguaugaugaua

SEQ ID NO: 612652 - RNA, 22 nt, Human herpesvirus 7
uaauuucugguauggaauuggc

SEQ ID NO: 612653 - RNA, 22 nt, Human herpesvirus 7
uacaugagacagucaggugagu

SEQ ID NO: 612654 - RNA, 22 nt, Human herpesvirus 7
uacgcuuuuuucgaguccaucg

SEQ ID NO: 612655 - RNA, 22 nt, Human herpesvirus 7
gcagggguaauaacagaacauu

SEQ ID NO: 612656 - RNA, 22 nt, Human herpesvirus 7
gauauuuuggguaauaugucuu

SEQ ID NO: 612657 - RNA, 22 nt, Human herpesvirus 7
uagaugauacuuuugucaguuc

SEQ ID NO: 612658 - RNA, 22 nt, Human herpesvirus 7
uauagacauuucguuauuccau

SEQ ID NO: 612659 - RNA, 19 nt, Human herpesvirus 7
ucucuguguuuaccucacc

SEQ ID NO: 612660 - RNA, 22 nt, Human herpesvirus 7
ugauauuuuuaacacaauggca

SEQ ID NO: 612661 - RNA, 22 nt, Human herpesvirus 7
uggauuuagaugcagaucuaga

SEQ ID NO: 612662 - RNA, 22 nt, Human herpesvirus 7
cagaaucuauuccacuugaauc

SEQ ID NO: 612663 - RNA, 22 nt, Human herpesvirus 7
auucagaagaugaaagauuucu

SEQ ID NO: 612664 - RNA, 22 nt, Human herpesvirus 7
auuugaagaacaagaggcacug

SEQ ID NO: 612665 - RNA, 22 nt, Human herpesvirus 7
auuugcguuucgcuguugccaa

SEQ ID NO: 612666 - RNA, 22 nt, Human herpesvirus 7
cuguggaaauaaauccgcuugc

SEQ ID NO: 612667 - RNA, 22 nt, Human herpesvirus 7
cguuguucaguuuuuauaaaug

SEQ ID NO: 612668 - RNA, 22 nt, Human herpesvirus 7
cugaaggcgcggcucuguugcg

SEQ ID NO: 612669 - RNA, 22 nt, Human herpesvirus 7
cgaggggccuauuuauuaguau

SEQ ID NO: 612670 - RNA, 22 nt, Human herpesvirus 7
gaauggucuauuuuuuacucga

SEQ ID NO: 612671 - RNA, 22 nt, Human herpesvirus 7
cguagagagcauuagcauuaaa

SEQ ID NO: 612672 - RNA, 22 nt, Human herpesvirus 7
agggaauugauuugguuaauca

SEQ ID NO: 612673 - RNA, 22 nt, Human herpesvirus 7
agaguuucgaauccuuuuaagc

SEQ ID NO: 612674 - RNA, 22 nt, Human herpesvirus 7
acauaaaaagagagaugucuac

SEQ ID NO: 612675 - RNA, 22 nt, Human herpesvirus 7
accugucaaaaauugauuagua

SEQ ID NO: 612676 - RNA, 22 nt, Human herpesvirus 7
aaucaaguauuucagucuguag

SEQ ID NO: 612677 - RNA, 22 nt, Human herpesvirus 7
aaauacuguguucugaauuuga

SEQ ID NO: 612678 - RNA, 22 nt, Human herpesvirus 7
caugugaaauuggcauuaaugc

SEQ ID NO: 612679 - RNA, 22 nt, Human herpesvirus 7
uacauuuuuuacgaugacaaac

SEQ ID NO: 612680 - RNA, 22 nt, Human herpesvirus 7
gcuguacagauagaaaucguuc

SEQ ID NO: 612681 - RNA, 22 nt, Human herpesvirus 7
uauauuuccagacauauuguaa

SEQ ID NO: 612682 - RNA, 22 nt, Human herpesvirus 7
ucaccgccauagauguccgaca

SEQ ID NO: 612683 - RNA, 22 nt, Human herpesvirus 7
ucagagcugcuucuagaucugu

SEQ ID NO: 612684 - RNA, 23 nt, Human herpesvirus 7
ucagaugaucuucuugcagcgca

SEQ ID NO: 612685 - RNA, 22 nt, Human herpesvirus 7
uaacaacacgcuauccaaagau

SEQ ID NO: 612686 - RNA, 22 nt, Human herpesvirus 7
uagaaucaucaaugcuucaucg

SEQ ID NO: 612687 - RNA, 22 nt, Human herpesvirus 7
uagaggcagaccuaaacccaga

SEQ ID NO: 612688 - RNA, 22 nt, Human herpesvirus 7
ucugugguugcagcagucauag

SEQ ID NO: 612689 - RNA, 22 nt, Human herpesvirus 7
ugccauugaaugcguuggaaau

SEQ ID NO: 612690 - RNA, 22 nt, Human herpesvirus 7
ugaagcagguuaaagauauugu

SEQ ID NO: 612691 - RNA, 19 nt, Human herpesvirus 7
uggacguaaacaggaaaga

SEQ ID NO: 612692 - RNA, 22 nt, Human herpesvirus 7
uuuaucccaccgguccuuccuc

SEQ ID NO: 612693 - RNA, 22 nt, Human herpesvirus 7
uuuaagacauuauuugcugaac

SEQ ID NO: 612694 - RNA, 22 nt, Human herpesvirus 7
guuaggguuagggccgcagccc

SEQ ID NO: 612695 - RNA, 22 nt, Human herpesvirus 7
guugaauauauacgcuuaaaau

SEQ ID NO: 612696 - RNA, 22 nt, Human herpesvirus 7
uaaauuccauuuauaguuacaa

SEQ ID NO: 612697 - RNA, 22 nt, Human herpesvirus 7
uaagcaauguagauauagugga

SEQ ID NO: 612698 - RNA, 22 nt, Human herpesvirus 7
gcuguucgugcuucacaguguu

SEQ ID NO: 612699 - RNA, 22 nt, Human herpesvirus 7
gcucugaagauggguuguuauc

SEQ ID NO: 612700 - RNA, 22 nt, Human herpesvirus 7
gagugcagaaaugcuccgcgcu

SEQ ID NO: 612701 - RNA, 22 nt, Human herpesvirus 7
ugauauuuuuaacacaauggca

SEQ ID NO: 612702 - RNA, 22 nt, Human herpesvirus 7
uaggcugcauuguaaaauucga

SEQ ID NO: 612703 - RNA, 22 nt, Human herpesvirus 7
ucaaauguuugcauuguguuuc

SEQ ID NO: 612704 - RNA, 22 nt, Human herpesvirus 7
ucagagcugcuucuagaucugu

SEQ ID NO: 612705 - RNA, 23 nt, Human herpesvirus 7
ucagaugaucuucuugcagcgca

SEQ ID NO: 612706 - RNA, 21 nt, Human herpesvirus 7
uaugaagaguucuuguuugga

SEQ ID NO: 612707 - RNA, 22 nt, Human herpesvirus 7
ugaagcagguuaaagauauugu

SEQ ID NO: 612708 - RNA, 22 nt, Human herpesvirus 7
gauauuuuggguaauaugucuu

SEQ ID NO: 612709 - RNA, 22 nt, Human herpesvirus 7
aauggcaacgguugagcaaauu

SEQ ID NO: 612710 - RNA, 22 nt, Human herpesvirus 7
uagaaucaucaaugcuucaucg

SEQ ID NO: 612711 - RNA, 22 nt, Human herpesvirus 7
uaauuucugguauggaauuggc

SEQ ID NO: 612712 - RNA, 22 nt, Human herpesvirus 7
uaagcaauguagauauagugga

SEQ ID NO: 612713 - RNA, 22 nt, Human herpesvirus 7
uuccuauguguguaugaugaua

SEQ ID NO: 612714 - RNA, 22 nt, Human herpesvirus 7
uugacgguggaaaguucgacag

SEQ ID NO: 612715 - RNA, 22 nt, Human herpesvirus 7
auccaaaucucagauauugcgu

SEQ ID NO: 612716 - RNA, 22 nt, Human herpesvirus 7
agucauuuucaaauagaguuua

SEQ ID NO: 612717 - RNA, 22 nt, Human herpesvirus 7
agucucagcaccgcggauuuac

SEQ ID NO: 612718 - RNA, 22 nt, Human herpesvirus 7
aucuucuagaguuauugccgug

SEQ ID NO: 612719 - RNA, 22 nt, Human herpesvirus 7
aagacguauuggucaauauaau

SEQ ID NO: 612720 - RNA, 22 nt, Human herpesvirus 7
ugucauaaauuuuaguugccgu

SEQ ID NO: 612721 - RNA, 22 nt, Human herpesvirus 7
ugucaucguaauaauggaaacu

SEQ ID NO: 612722 - RNA, 22 nt, Human herpesvirus 7
auucacaggcaucauagcuucu

SEQ ID NO: 612723 - RNA, 22 nt, Human herpesvirus 7
cacuggagaaugucgaggucuu

SEQ ID NO: 612724 - RNA, 22 nt, Human
aaggaggaauguagccagcucc

SEQ ID NO: 612725 - RNA, 22 nt, Human
uugacccgaguccuucuugggg

SEQ ID NO: 612726 - RNA, 22 nt, Human
uggcuccaggggacacgcagua

SEQ ID NO: 612727 - RNA, 22 nt, Human
ggcagcugaagaggaacuuugg

SEQ ID NO: 612728 - RNA, 22 nt, Human
uccguggggccuguggcuuccg

SEQ ID NO: 612729 - RNA, 22 nt, Human
ucauuuacacuucacaaaugga

SEQ ID NO: 612730 - RNA, 22 nt, Human
ccagcugggucccugcuggggc

SEQ ID NO: 612731 - RNA, 22 nt, Human
caggcucgguccaguggcaccc

SEQ ID NO: 612732 - RNA, 22 nt, Human
ccagcagcucccucaggguccg

SEQ ID NO: 612733 - RNA, 22 nt, Human
aauggcugccagggcaggaggu

SEQ ID NO: 612734 - RNA, 22 nt, Human
cuccaggacugaggacagagcu

SEQ ID NO: 612735 - RNA, 22 nt, Human
cccuuguuuuugaguacaauag

SEQ ID NO: 612736 - RNA, 22 nt, Human
uggaaacacccacgcaugcaua

SEQ ID NO: 612737 - RNA, 23 nt, Human
ucuggcugcuccuuucaaugcuc

SEQ ID NO: 612738 - RNA, 22 nt, Human
auacaacagaaaaugauuauuc

SEQ ID NO: 612739 - RNA, 22 nt, Human
agagugaaguaauuguuaggau

SEQ ID NO: 612740 - RNA, 22 nt, Human
auauaccucauucuuugagugc

SEQ ID NO: 612741 - RNA, 18 nt, Human
gguccugggccuggcuca

SEQ ID NO: 612742 - RNA, 22 nt, Human
guauuucuuuacauaugcucau

SEQ ID NO: 612743 - RNA, 22 nt, Human
uccuggccaaguagauguggcg

SEQ ID NO: 612744 - RNA, 22 nt, Human
ccacugcuaacuugcugcagcu

SEQ ID NO: 612745 - RNA, 20 nt, Human
ggucacuguggcugcaggau

SEQ ID NO: 612746 - RNA, 22 nt, Human
cccagccucuggguucugccgg

SEQ ID NO: 612747 - RNA, 22 nt, Human
ccuggaaaaugccacuuucaca

SEQ ID NO: 612748 - RNA, 22 nt, Human
ggugcccaaggaagguugccgu

SEQ ID NO: 612749 - RNA, 22 nt, Human
augaagcauuacaggaugacag

SEQ ID NO: 612750 - RNA, 22 nt, Human
ugucuagaaaugcugagucuca

SEQ ID NO: 612751 - RNA, 22 nt, Human
cuggagauaagcagucccaggc

SEQ ID NO: 612752 - RNA, 22 nt, Human
caaugcacauggacaucaggcu

SEQ ID NO: 612753 - RNA, 22 nt, Human
ugccuggcugggcugcucaugg

SEQ ID NO: 612754 - RNA, 22 nt, Human
ugaaagcucugucaucauuccu

SEQ ID NO: 612755 - RNA, 21 nt, Human
ucccacuggcccagggcucca

SEQ ID NO: 612756 - RNA, 22 nt, Human
gugcaugucuuuggaggccucc

SEQ ID NO: 612757 - RNA, 22 nt, Human
ugcauguuucuguauguuaaug

SEQ ID NO: 612758 - RNA, 22 nt, Human
cauuguccucugaugccuuccc

SEQ ID NO: 612759 - RNA, 22 nt, Human
uccuggcccuguggccugcagu

SEQ ID NO: 612760 - RNA, 22 nt, Human
cauuguuggcagagggacagag

SEQ ID NO: 612761 - RNA, 22 nt, Human
gcagggcagggcaagaacuggg

SEQ ID NO: 612762 - RNA, 22 nt, Human
aaugcugugauuuauuaaguau

SEQ ID NO: 612763 - RNA, 22 nt, Human
caccgagugacaguagccauca

SEQ ID NO: 612764 - RNA, 22 nt, Human
uuggaaauguagaaaagcagau

SEQ ID NO: 612765 - RNA, 22 nt, Human
gagcuuggugcugccuguuguc

SEQ ID NO: 612766 - RNA, 22 nt, Human
ggcaguggugggaggcucgcuc

SEQ ID NO: 612767 - RNA, 22 nt, Human
uugaacaguccuaagagacccu

SEQ ID NO: 612768 - RNA, 22 nt, Human
uucagaaaggcugugccagcca

SEQ ID NO: 612769 - RNA, 22 nt, Human
gacagcagccacagggagaggg

SEQ ID NO: 612770 - RNA, 22 nt, Human
ugcuugucacccugccugagug

SEQ ID NO: 612771 - RNA, 22 nt, Human
aguggcugugaaauacauggga

SEQ ID NO: 612772 - RNA, 22 nt, Human
acauucaggccacaguggaguc

SEQ ID NO: 612773 - RNA, 22 nt, Human
uuccaggaagcucucggccucu

SEQ ID NO: 612774 - RNA, 22 nt, Human
acuguagucuaaauauagucuu

SEQ ID NO: 612775 - RNA, 19 nt, Human
acccucuccccacuggguc

SEQ ID NO: 612776 - RNA, 22 nt, Human
guguggcuaggauggcuuugcu

SEQ ID NO: 612777 - RNA, 22 nt, Human
ugcuccaggcugcugaagaucu

SEQ ID NO: 612778 - RNA, 18 nt, Human
cgcauguacacgucaugc

SEQ ID NO: 612779 - RNA, 22 nt, Human
ggcgcaguugagcgugcuguuc

SEQ ID NO: 612780 - RNA, 22 nt, Human
gagcugcagcggcugacgcaac

SEQ ID NO: 612781 - RNA, 22 nt, Human
aaugucaacacaagagaaaugc

SEQ ID NO: 612782 - RNA, 22 nt, Human
ggccacuguuuccugggcaguu

SEQ ID NO: 612783 - RNA, 22 nt, Human
ugguccugagcaccagccugac

SEQ ID NO: 612784 - RNA, 22 nt, Human
cagacucuugagcugauuguau

SEQ ID NO: 612785 - RNA, 22 nt, Human
cugggcccaggcggcucucgga

SEQ ID NO: 612786 - RNA, 22 nt, Human
uuguccuuaccucaaucuggaa

SEQ ID NO: 612787 - RNA, 22 nt, Human
ucaaagcacuggggaaagccug

SEQ ID NO: 612788 - RNA, 22 nt, Human
aggaaauuuugaaucagugucu

SEQ ID NO: 612789 - RNA, 22 nt, Human
cuggcagcugcccgagaugccc

SEQ ID NO: 612790 - RNA, 22 nt, Human
uuuguguuguacuucugugcau

SEQ ID NO: 612791 - RNA, 22 nt, Human
uuccccuugcacuaucacccug

SEQ ID NO: 612792 - RNA, 20 nt, Human
ggaaaaguacuccuccuuaa

SEQ ID NO: 612793 - RNA, 22 nt, Human
uccacagugguggaauuguuca

SEQ ID NO: 612794 - RNA, 21 nt, Human
cugugauguugccgggguagg

SEQ ID NO: 612795 - RNA, 22 nt, Human
ccaggugugcucugcaguggau

SEQ ID NO: 612796 - RNA, 22 nt, Human
aggcucaguauagcuggcaagu

SEQ ID NO: 612797 - RNA, 22 nt, Human
cuccacagccccuccaguggca

SEQ ID NO: 612798 - RNA, 20 nt, Human
uuacagaaaugauguuauuu

SEQ ID NO: 612799 - RNA, 22 nt, Human
gugacagguauacucaccauug

SEQ ID NO: 612800 - RNA, 22 nt, Human
ccugugauauuguucauaauau

SEQ ID NO: 612801 - RNA, 22 nt, Human
cugucacagcccgcgucuccuc

SEQ ID NO: 612802 - RNA, 22 nt, Human
aguguguccaggaagcagaugg

SEQ ID NO: 612803 - RNA, 23 nt, Human
guccuagugcuuggugcccaggc

SEQ ID NO: 612804 - RNA, 22 nt, Human
uggugcugccaccuccucugcu

SEQ ID NO: 612805 - RNA, 22 nt, Human
aggugcaucucguagcucuucu

SEQ ID NO: 612806 - RNA, 18 nt, Human
cugccagugugcucuccg

SEQ ID NO: 612807 - RNA, 22 nt, Human
gcacaguauuuaguagaaugag

SEQ ID NO: 612808 - RNA, 19 nt, Human
aacuacagcgcacuguccu

SEQ ID NO: 612809 - RNA, 22 nt, Human
ugagaagcauuaggaagaacau

SEQ ID NO: 612810 - RNA, 23 nt, Human
cuguggaucuagagggggcccua

SEQ ID NO: 612811 - RNA, 22 nt, Human
caauaguaaauuacggaggaga

SEQ ID NO: 612812 - RNA, 22 nt, Human
uuccuggccucuuccaccacca

SEQ ID NO: 612813 - RNA, 22 nt, Human
uuuacagagaauguacauaaag

SEQ ID NO: 612814 - RNA, 22 nt, Human
uccagcucugcugugcgccggu

SEQ ID NO: 612815 - RNA, 22 nt, Human
gauggugcaggugaagugcugg

SEQ ID NO: 612816 - RNA, 22 nt, Human
aaggcacauauuuuagagucac

SEQ ID NO: 612817 - RNA, 22 nt, Human
cucccugggccucaguuucucu

SEQ ID NO: 612818 - RNA, 22 nt, Human
gugacaugguuugccgucccug

SEQ ID NO: 612819 - RNA, 22 nt, Human
caggaaauucccagaaggacug

SEQ ID NO: 612820 - RNA, 22 nt, Human
uucuuucugggguccuucggcu

SEQ ID NO: 612821 - RNA, 22 nt, Human
cagguagaggcugccaucagcu

SEQ ID NO: 612822 - RNA, 22 nt, Human
uggggcuccuccuggcaggagg

SEQ ID NO: 612823 - RNA, 22 nt, Human
accaagaguccaagugagguug

SEQ ID NO: 612824 - RNA, 22 nt, Human
gagguuggagggcuggccugca

SEQ ID NO: 612825 - RNA, 22 nt, Human
ugaguggacgugaggcugagua

SEQ ID NO: 612826 - RNA, 22 nt, Human
gucccagaggacagggucacau

SEQ ID NO: 612827 - RNA, 22 nt, Human
guaugucuuaggguucaguaac

SEQ ID NO: 612828 - RNA, 22 nt, Human
ugcccguucauucauacuuaac

SEQ ID NO: 612829 - RNA, 22 nt, Human
cagggccugccugguuccugga

SEQ ID NO: 612830 - RNA, 22 nt, Human
uggcaggaaaaagggccagagg

SEQ ID NO: 612831 - RNA, 22 nt, Human
cucuccaggcgagguccuacug

SEQ ID NO: 612832 - RNA, 22 nt, Human
uguccugugcacuguagcaugu

SEQ ID NO: 612833 - RNA, 22 nt, Human
uaaggagagaauuuagagguuu

SEQ ID NO: 612834 - RNA, 22 nt, Human
aaucuguugucaggaauccaca

SEQ ID NO: 612835 - RNA, 20 nt, Human
gugcccaguuggugacagac

SEQ ID NO: 612836 - RNA, 22 nt, Human
cagaugaaguaggugacgagca

SEQ ID NO: 612837 - RNA, 22 nt, Human
ccaggcagccaagugugugugu

SEQ ID NO: 612838 - RNA, 22 nt, Human
ugccuaggcuggaaugcagugg

SEQ ID NO: 612839 - RNA, 23 nt, Human
uggccucuccccaccuggcagaa

SEQ ID NO: 612840 - RNA, 22 nt, Human
ccaagcuggacagcagcaagga

SEQ ID NO: 612841 - RNA, 22 nt, Human
gugugcgccgacacagccaggu

SEQ ID NO: 612842 - RNA, 22 nt, Human
ucuccaggcuuaaucucagcuu

SEQ ID NO: 612843 - RNA, 22 nt, Human
caauguuuuuccuuccuuaaua

SEQ ID NO: 612844 - RNA, 22 nt, Human
ccgcuguccuggagcugcugcu

SEQ ID NO: 612845 - RNA, 22 nt, Human
aggcucugucaggcggagcagc

SEQ ID NO: 612846 - RNA, 22 nt, Human
ggcccucucuacauguuagacg

SEQ ID NO: 612847 - RNA, 22 nt, Human
aaauccaucaaaucuucuagaa

SEQ ID NO: 612848 - RNA, 20 nt, Human
cugggcagguguuugaucuc

SEQ ID NO: 612849 - RNA, 22 nt, Human
uggccagucuuagcugugccug

SEQ ID NO: 612850 - RNA, 22 nt, Human
cagggucuuggcgccaucaccc

SEQ ID NO: 612851 - RNA, 22 nt, Human
acaguuaguugaggaguguuug

SEQ ID NO: 612852 - RNA, 22 nt, Human
uggcucugccccauaccccugc

SEQ ID NO: 612853 - RNA, 22 nt, Human
gacuuugguucagggcucagag

SEQ ID NO: 612854 - RNA, 22 nt, Human
guaaagcaaaauguagagauug

SEQ ID NO: 612855 - RNA, 22 nt, Human
guguguggaaugcucauuuauu

SEQ ID NO: 612856 - RNA, 22 nt, Human
cgcaggugccggcagauggggu

SEQ ID NO: 612857 - RNA, 22 nt, Human
uuuaagguacagcuagcagcau

SEQ ID NO: 612858 - RNA, 22 nt, Human
uccacagggaugccugcggcuu

SEQ ID NO: 612859 - RNA, 20 nt, Human
gagcagugagccagggaaag

SEQ ID NO: 612860 - RNA, 22 nt, Human
aaggugccacuucccucagacu

SEQ ID NO: 612861 - RNA, 22 nt, Human
ucaccgccuugcccggccgggc

SEQ ID NO: 612862 - RNA, 22 nt, Human
cuguauaugugcauacacacac

SEQ ID NO: 612863 - RNA, 22 nt, Human
aaaucugagaaauauuguccag

SEQ ID NO: 612864 - RNA, 22 nt, Human
agccaccaccacugaaagguua

SEQ ID NO: 612865 - RNA, 22 nt, Human
caauaaaguggaggcccgggcu

SEQ ID NO: 612866 - RNA, 22 nt, Human
ccugucugaaggcagggggaug

SEQ ID NO: 612867 - RNA, 22 nt, Human
aggaggguggggucugccuguc

SEQ ID NO: 612868 - RNA, 22 nt, Human
uuccuuuucuucuaccacaugu

SEQ ID NO: 612869 - RNA, 22 nt, Human
cucaugucggcaggacucgccc

SEQ ID NO: 612870 - RNA, 22 nt, Human
ucuaauuuuggcauuuuaaccu

SEQ ID NO: 612871 - RNA, 22 nt, Human
aacuuucugaaaagcuugauca

SEQ ID NO: 612872 - RNA, 22 nt, Human
cugguuuuuagugcuuaggagu

SEQ ID NO: 612873 - RNA, 22 nt, Human
caugagaucugcagggaugggc

SEQ ID NO: 612874 - RNA, 22 nt, Human
aaagcacauuacaagcucaguc

SEQ ID NO: 612875 - RNA, 21 nt, Human
auacaagaagauggcagucug

SEQ ID NO: 612876 - RNA, 22 nt, Human
ccagcugcgggcaucgagaguu

SEQ ID NO: 612877 - RNA, 22 nt, Human
acucuguuugcagguagcucag

SEQ ID NO: 612878 - RNA, 22 nt, Human
augaauuguccgauguugugca

SEQ ID NO: 612879 - RNA, 22 nt, Human
acaguaaucugggaacuuguua

SEQ ID NO: 612880 - RNA, 22 nt, Human
gugagguccucccugcugggag

SEQ ID NO: 612881 - RNA, 21 nt, Human
gucuuggcaccaggagagaga

SEQ ID NO: 612882 - RNA, 22 nt, Human
cugaaacuauggggaggggagc

SEQ ID NO: 612883 - RNA, 22 nt, Human
aggacagcagugcuggcacuug

SEQ ID NO: 612884 - RNA, 22 nt, Human
ugacuuuggacuagugauuuaa

SEQ ID NO: 612885 - RNA, 18 nt, Human
cgauguguaugugauuug

SEQ ID NO: 612886 - RNA, 22 nt, Human
ucucugagguuguuuccagcac

SEQ ID NO: 612887 - RNA, 22 nt, Human
uauacuacgcaccaaacaaagg

SEQ ID NO: 612888 - RNA, 22 nt, Human
gaaaauaguucaucacaaugau

SEQ ID NO: 612889 - RNA, 22 nt, Human
aucuggcucccuuggaauccgu

SEQ ID NO: 612890 - RNA, 22 nt, Human
agcuuuauuugucauucacggc

SEQ ID NO: 612891 - RNA, 22 nt, Human
uuguccagcgaccaggcucugu

SEQ ID NO: 612892 - RNA, 22 nt, Human
cccaggcacacugaagugacau

SEQ ID NO: 612893 - RNA, 22 nt, Human
gccuggaaugcaaugugacgaa

SEQ ID NO: 612894 - RNA, 22 nt, Human
acagugugcaagaaauggggga

SEQ ID NO: 612895 - RNA, 22 nt, Human
ccagcagcgauagggugagugc

SEQ ID NO: 612896 - RNA, 19 nt, Human
cgcacagccugccaggcgc

SEQ ID NO: 612897 - RNA, 22 nt, Human
gacuguggacucucaugauaga

SEQ ID NO: 612898 - RNA, 22 nt, Human
uccugaaaauaauuucacaaga

SEQ ID NO: 612899 - RNA, 22 nt, Human
ccuggcagaauauuaaagugca

SEQ ID NO: 612900 - RNA, 22 nt, Human
gaggcuggcagaaaagcacagg

SEQ ID NO: 612901 - RNA, 22 nt, Human
gcaaggaagcagaguugcuauc

SEQ ID NO: 612902 - RNA, 22 nt, Human
gcaugcaggaagggcuugggga

SEQ ID NO: 612903 - RNA, 22 nt, Human
caggaugccuuugaacucugga

SEQ ID NO: 612904 - RNA, 22 nt, Human
cacauuuaugggcugggaggca

SEQ ID NO: 612905 - RNA, 22 nt, Human
caagggcagcagccucaagcgg

SEQ ID NO: 612906 - RNA, 18 nt, Human
uggcaugcuuugauacau

SEQ ID NO: 612907 - RNA, 22 nt, Human
acccacagccgcugugcguccc

SEQ ID NO: 612908 - RNA, 22 nt, Human
uggguccuggaaggcgacaggu

SEQ ID NO: 612909 - RNA, 22 nt, Human
agaguguggaaauguucagagu

SEQ ID NO: 612910 - RNA, 22 nt, Human
aacacuaaaggucaguuagaag

SEQ ID NO: 612911 - RNA, 22 nt, Human
gucuguggaguugcuugcugga

SEQ ID NO: 612912 - RNA, 22 nt, Human
cguggcucugggcuccuuugcc

SEQ ID NO: 612913 - RNA, 22 nt, Human
aaagugcugggauuacaggugu

SEQ ID NO: 612914 - RNA, 22 nt, Human
ugguccagacuuugaccucuca

SEQ ID NO: 612915 - RNA, 22 nt, Human
aaucuucaggguccuggggcuc

SEQ ID NO: 612916 - RNA, 22 nt, Human
guuuacaacaucuuguccuuca

SEQ ID NO: 612917 - RNA, 22 nt, Human
agguggaguuaagugugaacug

SEQ ID NO: 612918 - RNA, 22 nt, Human
ugaggucuguccugucuuugga

SEQ ID NO: 612919 - RNA, 22 nt, Human
uuggccguuucacugggcaguu

SEQ ID NO: 612920 - RNA, 22 nt, Human
caggaggaaaguuccacucaac

SEQ ID NO: 612921 - RNA, 22 nt, Human
ugaggccaagccuccucugcca

SEQ ID NO: 612922 - RNA, 22 nt, Human
ugucccuggacuccaggagcca

SEQ ID NO: 612923 - RNA, 22 nt, Human
guggccaaggcagagaaagagc

SEQ ID NO: 612924 - RNA, 22 nt, Human
ccagcaugcucagucuaaauug

SEQ ID NO: 612925 - RNA, 22 nt, Human
cugcggcuggggacagcuguug

SEQ ID NO: 612926 - RNA, 22 nt, Human
uggcggugacggcggcgccugg

SEQ ID NO: 612927 - RNA, 22 nt, Human
cugcaucacagcaggaggcaca

SEQ ID NO: 612928 - RNA, 22 nt, Human
ccugugggagggagcggcugga

SEQ ID NO: 612929 - RNA, 22 nt, Human
ugcagggcagcuagggagcuuu

SEQ ID NO: 612930 - RNA, 22 nt, Human
aguggcuguuccaggugaggac

SEQ ID NO: 612931 - RNA, 22 nt, Human
caagcuuguuucuccugggggu

SEQ ID NO: 612932 - RNA, 22 nt, Human
cccccagcucugcugggucccg

SEQ ID NO: 612933 - RNA, 22 nt, Human
cagcuccagccaccggggggug

SEQ ID NO: 612934 - RNA, 22 nt, Human
ggcacagcugaugcagacacac

SEQ ID NO: 612935 - RNA, 22 nt, Human
uaccaaaaccaagccauuaucu

SEQ ID NO: 612936 - RNA, 22 nt, Human
caggcacaaugagcgccaucuu

SEQ ID NO: 612937 - RNA, 22 nt, Human
ugugucuuuggcgaugucugga

SEQ ID NO: 612938 - RNA, 22 nt, Human
caacuuuagaccccaaguagcu

SEQ ID NO: 612939 - RNA, 22 nt, Human
uggcucaggccuacgacgccuu

SEQ ID NO: 612940 - RNA, 18 nt, Human
uagcucuuguugguccau

SEQ ID NO: 612941 - RNA, 20 nt, Human
acagaugaggaugcggaggc

SEQ ID NO: 612942 - RNA, 20 nt, Human
guggcagugguggcagcagu

SEQ ID NO: 612943 - RNA, 22 nt, Human
caacauggcgaaaccccaucuc

SEQ ID NO: 612944 - RNA, 22 nt, Human
aggugcugccccgagaaggaug

SEQ ID NO: 612945 - RNA, 22 nt, Human
agcucaguggcuggggcgcugc

SEQ ID NO: 612946 - RNA, 22 nt, Human
uugcuucacuacuucuaggcuc

SEQ ID NO: 612947 - RNA, 21 nt, Human
ggucaggcaugugcccugagc

SEQ ID NO: 612948 - RNA, 20 nt, Human
aucagguguucagccacugc

SEQ ID NO: 612949 - RNA, 22 nt, Human
ggggugaagguuuucugaaagc

SEQ ID NO: 612950 - RNA, 22 nt, Human
ucuuuugagggccagaggaaga

SEQ ID NO: 612951 - RNA, 22 nt, Human
gccaggaccucagaugcagggc

SEQ ID NO: 612952 - RNA, 22 nt, Human
uggccaggcagguagaacggcc

SEQ ID NO: 612953 - RNA, 22 nt, Human
ugucacagagcgugcaacagaa

SEQ ID NO: 612954 - RNA, 22 nt, Human
uggcauuuuguagcuguguauc

SEQ ID NO: 612955 - RNA, 22 nt, Human
auauacacuguuucaguugaag

SEQ ID NO: 612956 - RNA, 22 nt, Human
aagcacagggacucaggaccgg

SEQ ID NO: 612957 - RNA, 22 nt, Human
uccagcaguccaugugagacac

SEQ ID NO: 612958 - RNA, 21 nt, Human
uaaacauaaccuuguauggcu

SEQ ID NO: 612959 - RNA, 22 nt, Human
uuccuggggacuuaccgucauu

SEQ ID NO: 612960 - RNA, 22 nt, Human
ucucuacagcacccgcaugcua

SEQ ID NO: 612961 - RNA, 22 nt, Human
aagacagugacagucacaauug

SEQ ID NO: 612962 - RNA, 22 nt, Human
cccucucccugcagaauguggc

SEQ ID NO: 612963 - RNA, 22 nt, Human
uaucuguauucugacagucacu

SEQ ID NO: 612964 - RNA, 22 nt, Human
acagccaggaauucuggagaag

SEQ ID NO: 612965 - RNA, 22 nt, Human
ccagccagcugcccuuggggcc

SEQ ID NO: 612966 - RNA, 22 nt, Human
gcccagccccuggguggacgug

SEQ ID NO: 612967 - RNA, 22 nt, Human
agagacauagcacaguuuuucg

SEQ ID NO: 612968 - RNA, 22 nt, Human
auggucacuucacccaugagcu

SEQ ID NO: 612969 - RNA, 22 nt, Human
acugcauucuuuaucccacaac

SEQ ID NO: 612970 - RNA, 22 nt, Human
auguccagaguaaagcacauuc

SEQ ID NO: 612971 - RNA, 22 nt, Human
uccaggagcucauccacgucaa

SEQ ID NO: 612972 - RNA, 19 nt, Human
agcagccaucgaccaugga

SEQ ID NO: 612973 - RNA, 22 nt, Human
gagccacaguggauugauucca

SEQ ID NO: 612974 - RNA, 22 nt, Human
aaguuacaggagaaagagauca

SEQ ID NO: 612975 - RNA, 22 nt, Human
uggcacugucaccaaugcuguc

SEQ ID NO: 612976 - RNA, 21 nt, Human
cuguccccagugagcaccccc

SEQ ID NO: 612977 - RNA, 22 nt, Human
augugagcuggggcccggccag

SEQ ID NO: 612978 - RNA, 22 nt, Human
cuggcaguguccagcucgugau

SEQ ID NO: 612979 - RNA, 22 nt, Human
ucaccucucuggccgucuaccu

SEQ ID NO: 612980 - RNA, 22 nt, Human
auccgggguucauuuucacuga

SEQ ID NO: 612981 - RNA, 22 nt, Human
ccauggccaggaaagccaaggu

SEQ ID NO: 612982 - RNA, 22 nt, Human
ccacuguuuccuuucugcuggc

SEQ ID NO: 612983 - RNA, 22 nt, Human
uggaucuugaugcuccaagagu

SEQ ID NO: 612984 - RNA, 22 nt, Human
ucccugagugggcugguaguau

SEQ ID NO: 612985 - RNA, 22 nt, Human
guggauggagcuggaagccauu

SEQ ID NO: 612986 - RNA, 20 nt, Human
agugauuuguuaguacauug

SEQ ID NO: 612987 - RNA, 22 nt, Human
ugacaagagaccccuccgcagg

SEQ ID NO: 612988 - RNA, 20 nt, Human
ucacuguaauugccuacauu

SEQ ID NO: 612989 - RNA, 22 nt, Human
cuucucuuggguguggugucuu

SEQ ID NO: 612990 - RNA, 22 nt, Human
auguuguugaacucuuugcaug

SEQ ID NO: 612991 - RNA, 22 nt, Human
ugcauccuguucuagguuuggg

SEQ ID NO: 612992 - RNA, 22 nt, Human
gcagugacagacaacuguuuga

SEQ ID NO: 612993 - RNA, 22 nt, Human
uaaucuuagacauguauuuuuc

SEQ ID NO: 612994 - RNA, 22 nt, Human
uuugcagagugcagaagcaucu

SEQ ID NO: 612995 - RNA, 21 nt, Human
uuccuccucuggagaagaaga

SEQ ID NO: 612996 - RNA, 22 nt, Human
acccugccucugcuuccuguag

SEQ ID NO: 612997 - RNA, 22 nt, Human
agagcaauuagcuuagguaaaa

SEQ ID NO: 612998 - RNA, 22 nt, Human
cuucuggcguuggaggucugag

SEQ ID NO: 612999 - RNA, 22 nt, Human
ugugguuuugguucagaaacaa

SEQ ID NO: 613000 - RNA, 23 nt, Human
aagugcucaguggacagcauugc

SEQ ID NO: 613001 - RNA, 18 nt, Human
gccuggcuucggagccgc

SEQ ID NO: 613002 - RNA, 21 nt, Human
uacaucaguuuucuuggcuca

SEQ ID NO: 613003 - RNA, 22 nt, Human
uguguacauguaucaacuaucg

SEQ ID NO: 613004 - RNA, 22 nt, Human
uuagcacccugauacuagaaug

SEQ ID NO: 613005 - RNA, 22 nt, Human
cagcuauuguucuguauaauga

SEQ ID NO: 613006 - RNA, 22 nt, Human
gcggagaggcagagacuccgcg

SEQ ID NO: 613007 - RNA, 22 nt, Human
gccucugcacuguggcacacca

SEQ ID NO: 613008 - RNA, 22 nt, Human
agccacugugugaccagcuguc

SEQ ID NO: 613009 - RNA, 22 nt, Human
cccagccugaucucggccagcu

SEQ ID NO: 613010 - RNA, 22 nt, Human
acaggacagucuaguaacagua

SEQ ID NO: 613011 - RNA, 22 nt, Human
cucugccagccaaagucaucac

SEQ ID NO: 613012 - RNA, 22 nt, Human
gagaguuaguugagcagucuga

SEQ ID NO: 613013 - RNA, 22 nt, Human
cagggaugggauggagucaguu

SEQ ID NO: 613014 - RNA, 22 nt, Human
agucacuguuuaaucuagcuaa

SEQ ID NO: 613015 - RNA, 22 nt, Human
uaaaaucaugacagauugacau

SEQ ID NO: 613016 - RNA, 22 nt, Human
uucuucauucccuuacuuccga

SEQ ID NO: 613017 - RNA, 22 nt, Human
guugggcugaagugugugcuua

SEQ ID NO: 613018 - RNA, 22 nt, Human
uggcccagaucucugaccuuga

SEQ ID NO: 613019 - RNA, 22 nt, Human
gugcugccuccauauccgucag

SEQ ID NO: 613020 - RNA, 22 nt, Human
ugcugugcuggcggcagaggcc

SEQ ID NO: 613021 - RNA, 22 nt, Human
aucccugugacgagcaucccua

SEQ ID NO: 613022 - RNA, 22 nt, Human
cuggccgcaguguggaguugug

SEQ ID NO: 613023 - RNA, 22 nt, Human
ggagcggagggagggccacugu

SEQ ID NO: 613024 - RNA, 22 nt, Human
accgugucugacacuuugggcg

SEQ ID NO: 613025 - RNA, 22 nt, Human
uuguaacaguagcugucagcuc

SEQ ID NO: 613026 - RNA, 22 nt, Human
ccaggagcccugccacaauggu

SEQ ID NO: 613027 - RNA, 22 nt, Human
ccaagaggggcagagggcugca

SEQ ID NO: 613028 - RNA, 22 nt, Human
uacauguuauuucacuauuggu

SEQ ID NO: 613029 - RNA, 22 nt, Human
ugggguccucucacuuggaggg

SEQ ID NO: 613030 - RNA, 22 nt, Human
guggccuuuucaaguaggguau

SEQ ID NO: 613031 - RNA, 21 nt, Human
aucuuaaaaggucuuaacuuu

SEQ ID NO: 613032 - RNA, 22 nt, Human
uggcuggcuguccagcugggca

SEQ ID NO: 613033 - RNA, 22 nt, Human
ccugggcaaaugccagagacaa

SEQ ID NO: 613034 - RNA, 20 nt, Human
cuguuugcuaucaugagcug

SEQ ID NO: 613035 - RNA, 22 nt, Human
gauggaggagauggcagggugc

SEQ ID NO: 613036 - RNA, 22 nt, Human
gagguggcugcuugcugggaaa

SEQ ID NO: 613037 - RNA, 21 nt, Human
gcuccuggugcugcguggcgc

SEQ ID NO: 613038 - RNA, 22 nt, Human
auuauguagcuaaaaauugugu

SEQ ID NO: 613039 - RNA, 22 nt, Human
ugcagcugccuagggcuggcuu

SEQ ID NO: 613040 - RNA, 22 nt, Human
gcccucugguggccgccucggc

SEQ ID NO: 613041 - RNA, 22 nt, Human
cugggucccggcuucuauccac

SEQ ID NO: 613042 - RNA, 22 nt, Human
aggcggguuuaggacaaugcuu

SEQ ID NO: 613043 - RNA, 22 nt, Human
caucaguuccugccccugcccc

SEQ ID NO: 613044 - RNA, 22 nt, Human
acagcuggccgaggcucaggga

SEQ ID NO: 613045 - RNA, 18 nt, Human
uauaaacacacuuagguu

SEQ ID NO: 613046 - RNA, 22 nt, Human
cuagcagcauucuucuaguuag

SEQ ID NO: 613047 - RNA, 22 nt, Human
gccuggcgccgggcugccuguc

SEQ ID NO: 613048 - RNA, 22 nt, Human
cagaccagccauuugccucuuc

SEQ ID NO: 613049 - RNA, 22 nt, Human
aggggagguggcagaaaugugc

SEQ ID NO: 613050 - RNA, 22 nt, Human
gcaguggccacauggaggagga

SEQ ID NO: 613051 - RNA, 22 nt, Human
gcagcuuuggagguggaacucu

SEQ ID NO: 613052 - RNA, 22 nt, Human
aaguuacacauuuucauuguaa

SEQ ID NO: 613053 - RNA, 22 nt, Human
gggagggucugagagcugcacc

SEQ ID NO: 613054 - RNA, 22 nt, Human
ggccgugcuccaaagucaucgu

SEQ ID NO: 613055 - RNA, 22 nt, Human
cuucagggguguuaguuuugug

SEQ ID NO: 613056 - RNA, 22 nt, Human
uagcugcacaggaaguaagauu

SEQ ID NO: 613057 - RNA, 22 nt, Human
acuugcaucuuagagacucacc

SEQ ID NO: 613058 - RNA, 21 nt, Human
aaacugaccuugccugagaca

SEQ ID NO: 613059 - RNA, 22 nt, Human
acaaaugcuuaguucaccaaaa

SEQ ID NO: 613060 - RNA, 22 nt, Human
agccacauggaccugaugcuag

SEQ ID NO: 613061 - RNA, 22 nt, Human
ucacccagacugucugacucuu

SEQ ID NO: 613062 - RNA, 22 nt, Human
uuugacaacugugcaguuugua

SEQ ID NO: 613063 - RNA, 17 nt, Human
uggcacagaggugcuau

SEQ ID NO: 613064 - RNA, 22 nt, Human
uggaaaauauuuaggugaauga

SEQ ID NO: 613065 - RNA, 22 nt, Human
ugcuggaguggcacuguguggc

SEQ ID NO: 613066 - RNA, 22 nt, Human
ugggaccugcucuuggaaugag

SEQ ID NO: 613067 - RNA, 22 nt, Human
uccguuuucacacugcuauaaa

SEQ ID NO: 613068 - RNA, 23 nt, Human
auagaccauugucucacacuuca

SEQ ID NO: 613069 - RNA, 22 nt, Human
acauucaugcaccuuccuaucc

SEQ ID NO: 613070 - RNA, 20 nt, Human
ucauccaggacaggaguggc

SEQ ID NO: 613071 - RNA, 22 nt, Human
ugcuuuauucgacaucugguag

SEQ ID NO: 613072 - RNA, 22 nt, Human
ccugugucaucagcuguggcua

SEQ ID NO: 613073 - RNA, 22 nt, Human
aauaaguacuuggggauaacuu

SEQ ID NO: 613074 - RNA, 22 nt, Human
uaggaaauaauucacucuggcu

SEQ ID NO: 613075 - RNA, 22 nt, Human
aaugguaauauuucauaguugu

SEQ ID NO: 613076 - RNA, 22 nt, Human
ugggagagauaggcuucuggac

SEQ ID NO: 613077 - RNA, 22 nt, Human
auggaguucugccagcgcugcu

SEQ ID NO: 613078 - RNA, 22 nt, Human
cccacaggcaggugcaugggcu

SEQ ID NO: 613079 - RNA, 22 nt, Human
acuuuagauauuccucuguaca

SEQ ID NO: 613080 - RNA, 22 nt, Human
ugcucuguucaguguaucuugu

SEQ ID NO: 613081 - RNA, 22 nt, Human
guugcaaaugggaagaugguua

SEQ ID NO: 613082 - RNA, 22 nt, Human
ugcaggaacucgaaaacuauag

SEQ ID NO: 613083 - RNA, 22 nt, Human
agcacugugagcaccagcacgc

SEQ ID NO: 613084 - RNA, 22 nt, Human
gcugucugcugggucgcucagg

SEQ ID NO: 613085 - RNA, 22 nt, Human
gaccaggagauuugagcuaggc

SEQ ID NO: 613086 - RNA, 22 nt, Human
ugggcccaucauugcugugggc

SEQ ID NO: 613087 - RNA, 22 nt, Human
gaaccuguccugagugaggagu

SEQ ID NO: 613088 - RNA, 22 nt, Human
cacgcacgcuggguggaggcgc

SEQ ID NO: 613089 - RNA, 22 nt, Human
cugagcagaagggugcacgugc

SEQ ID NO: 613090 - RNA, 22 nt, Human
uagcagaacaauagucaaugau

SEQ ID NO: 613091 - RNA, 18 nt, Human
cuggucucccuucgcuuu

SEQ ID NO: 613092 - RNA, 22 nt, Human
cugcaccgugucucgggcugcc

SEQ ID NO: 613093 - RNA, 22 nt, Human
gcugccuggaauaacggcuggc

SEQ ID NO: 613094 - RNA, 22 nt, Human
agggcaguguggugggacugac

SEQ ID NO: 613095 - RNA, 22 nt, Human
gagcaacacauugaaugaggau

SEQ ID NO: 613096 - RNA, 22 nt, Human
ccuggguccaauucuggcuugu

SEQ ID NO: 613097 - RNA, 22 nt, Human
gccagcuagaggcugcagugca

SEQ ID NO: 613098 - RNA, 22 nt, Human
ucuccacaccagaaggagcuga

SEQ ID NO: 613099 - RNA, 22 nt, Human
guuugagauggguuauugcucu

SEQ ID NO: 613100 - RNA, 22 nt, Human
ccccuuucucccgcgucuggcc

SEQ ID NO: 613101 - RNA, 22 nt, Human
uaucacauacuucucauccagg

SEQ ID NO: 613102 - RNA, 19 nt, Human
auagaguagaguaucuguu

SEQ ID NO: 613103 - RNA, 22 nt, Human
uuuccuguccugguacuuggca

SEQ ID NO: 613104 - RNA, 22 nt, Human
ccaagaggggaagggccgcagc

SEQ ID NO: 613105 - RNA, 22 nt, Human
cuagagaaaaagcuuagguacg

SEQ ID NO: 613106 - RNA, 22 nt, Human
guggcaggagggcaucacuugg

SEQ ID NO: 613107 - RNA, 22 nt, Human
gucccaggggagcucucugauu

SEQ ID NO: 613108 - RNA, 20 nt, Human
aaaaacaguaaugcugaaga

SEQ ID NO: 613109 - RNA, 22 nt, Human
ggcgaggugucugccaucaagc

SEQ ID NO: 613110 - RNA, 22 nt, Human
uggugcaggccaagcugcgagc

SEQ ID NO: 613111 - RNA, 20 nt, Human
caacacugcccauuguuugc

SEQ ID NO: 613112 - RNA, 22 nt, Human
auuuccuguaggggcuugcgaa

SEQ ID NO: 613113 - RNA, 23 nt, Human
aacauuuguaaggugauuuuguu

SEQ ID NO: 613114 - RNA, 22 nt, Human
aagccagguguuuaggccagcg

SEQ ID NO: 613115 - RNA, 21 nt, Human
ccaccaggucuucugcucggg

SEQ ID NO: 613116 - RNA, 22 nt, Human
gugcuaaugaauuggagugccu

SEQ ID NO: 613117 - RNA, 22 nt, Human
uuucuggcagcgggacaggggu

SEQ ID NO: 613118 - RNA, 22 nt, Human
auaucuaggcugaauguaaaau

SEQ ID NO: 613119 - RNA, 22 nt, Human
aguggcagggacuucauauaaa

SEQ ID NO: 613120 - RNA, 22 nt, Human
aucccuggccacgaagcugccc

SEQ ID NO: 613121 - RNA, 21 nt, Human
ucccucagaagcucuugguca

SEQ ID NO: 613122 - RNA, 22 nt, Human
aaacugaggcucccgagggugu

SEQ ID NO: 613123 - RNA, 22 nt, Human
acagcuggaggucugugagcac

SEQ ID NO: 613124 - RNA, 22 nt, Human
uuaccacagugccugucuaaug

SEQ ID NO: 613125 - RNA, 22 nt, Human
gcucagugaagggugccaagua

SEQ ID NO: 613126 - RNA, 22 nt, Human
cagggagaucuuggcuccuggu

SEQ ID NO: 613127 - RNA, 22 nt, Human
ugcauguuuuauaccaaagcuu

SEQ ID NO: 613128 - RNA, 22 nt, Human
cuggcuccauccuugagcucug

SEQ ID NO: 613129 - RNA, 22 nt, Human
cuccccacgccuggacuaagag

SEQ ID NO: 613130 - RNA, 22 nt, Human
uaaagugaaguucagaauggcu

SEQ ID NO: 613131 - RNA, 22 nt, Human
gucuuuuuuacaccuuacauca

SEQ ID NO: 613132 - RNA, 22 nt, Human
uacagugcuugguaucuaguaa

SEQ ID NO: 613133 - RNA, 22 nt, Human
agacaagagcugaggacauauu

SEQ ID NO: 613134 - RNA, 22 nt, Human
ggggucacacuguggugacugg

SEQ ID NO: 613135 - RNA, 22 nt, Human
acaugcauaaacuacuucuuau

SEQ ID NO: 613136 - RNA, 19 nt, Human
aggaaggcggcggcugccc

SEQ ID NO: 613137 - RNA, 22 nt, Human
uugagcagaucgggcugugggg

SEQ ID NO: 613138 - RNA, 22 nt, Human
uguguuuuggaaggaacaugca

SEQ ID NO: 613139 - RNA, 22 nt, Human
gccaggcaggccacgcuguguu

SEQ ID NO: 613140 - RNA, 22 nt, Human
gggcagcaucaggaggggcuuu

SEQ ID NO: 613141 - RNA, 22 nt, Human
ggcggcacgcaggcugcugucg

SEQ ID NO: 613142 - RNA, 22 nt, Human
cccuggaacccauggccagugu

SEQ ID NO: 613143 - RNA, 21 nt, Human
aacaggucccccacgggcuuu

SEQ ID NO: 613144 - RNA, 22 nt, Human
uccuggcucaggccccuggugc

SEQ ID NO: 613145 - RNA, 22 nt, Human
ggguucagugaugccuucagga

SEQ ID NO: 613146 - RNA, 22 nt, Human
ggcugagcuuuucaugaugguu

SEQ ID NO: 613147 - RNA, 22 nt, Human
caggcacaagaucggcuagaua

SEQ ID NO: 613148 - RNA, 22 nt, Human
gcugcuccgcagagugugugug

SEQ ID NO: 613149 - RNA, 20 nt, Human
gcagcagacagacaggggac

SEQ ID NO: 613150 - RNA, 23 nt, Human
agcaacagugggugaguguugcu

SEQ ID NO: 613151 - RNA, 21 nt, Human
gcagcaugagaaagccccaaa

SEQ ID NO: 613152 - RNA, 22 nt, Human
uaaguauguuagaaaaucaagu

SEQ ID NO: 613153 - RNA, 22 nt, Human
cuggacacuggggaugcgcagu

SEQ ID NO: 613154 - RNA, 22 nt, Human
augucccugagggucucucuga

SEQ ID NO: 613155 - RNA, 22 nt, Human
aaugcauacguguuuguggcaa

SEQ ID NO: 613156 - RNA, 22 nt, Human
uacauguacaugcauagguaga

SEQ ID NO: 613157 - RNA, 22 nt, Human
ccaggaugacccccacuuuccu

SEQ ID NO: 613158 - RNA, 22 nt, Human
ccagaucccuguuugccucugg

SEQ ID NO: 613159 - RNA, 22 nt, Human
gcagcugcgcugguguggggca

SEQ ID NO: 613160 - RNA, 22 nt, Human
cccagccuuugcuuccugguuc

SEQ ID NO: 613161 - RNA, 23 nt, Human
cagcacaguacauuuccugucuc

SEQ ID NO: 613162 - RNA, 22 nt, Human
gcugggucucucccugguccug

SEQ ID NO: 613163 - RNA, 22 nt, Human
cccagagcaugugcugccuuug

SEQ ID NO: 613164 - RNA, 21 nt, Human
acagaagcggcgaguggcccc

SEQ ID NO: 613165 - RNA, 22 nt, Human
aacacaguuucugcauugguag

SEQ ID NO: 613166 - RNA, 22 nt, Human
aaccauggauuucaguucaccu

SEQ ID NO: 613167 - RNA, 22 nt, Human
agacacuguguacagaaaaaga

SEQ ID NO: 613168 - RNA, 22 nt, Human
ucccuggcugguguagagggau

SEQ ID NO: 613169 - RNA, 22 nt, Human
acuggcaguagagggagcgcau

SEQ ID NO: 613170 - RNA, 17 nt, Human
ugagcaguagaagaugc

SEQ ID NO: 613171 - RNA, 20 nt, Human
uuucacaaugaacaugucuc

SEQ ID NO: 613172 - RNA, 22 nt, Human
cugaggcucugagaaagccaaa

SEQ ID NO: 613173 - RNA, 22 nt, Human
agugacagauuaccggcagagc

SEQ ID NO: 613174 - RNA, 22 nt, Human
cugagcaucauggcagaaucuu

SEQ ID NO: 613175 - RNA, 22 nt, Human
ucccagaacccugccagguccu

SEQ ID NO: 613176 - RNA, 22 nt, Human
gggaggaaggcuugggugagua

SEQ ID NO: 613177 - RNA, 22 nt, Human
cuccguggcuguggacgcagcc

SEQ ID NO: 613178 - RNA, 22 nt, Human
gauccacaggaaccaaaacgca

SEQ ID NO: 613179 - RNA, 22 nt, Human
agaaagcacccugcacuuucug

SEQ ID NO: 613180 - RNA, 22 nt, Human
ggagaggguguggaaaguuauc

SEQ ID NO: 613181 - RNA, 22 nt, Human
gccacguagaagugccgcgaga

SEQ ID NO: 613182 - RNA, 22 nt, Human
uccagaugcugcacauuccuga

SEQ ID NO: 613183 - RNA, 22 nt, Human
gcucaugggcccagagcagccc

SEQ ID NO: 613184 - RNA, 22 nt, Human
acugcauuaucaccaagaugua

SEQ ID NO: 613185 - RNA, 22 nt, Human
cagcaugaauguguucguaggg

SEQ ID NO: 613186 - RNA, 22 nt, Human
ggugacgaauccauagcaucga

SEQ ID NO: 613187 - RNA, 22 nt, Human
gccuggcucugaguuucucucc

SEQ ID NO: 613188 - RNA, 22 nt, Human
ugcagugaugcuucuggcucag

SEQ ID NO: 613189 - RNA, 22 nt, Human
uccuggcaaagauguugguguu

SEQ ID NO: 613190 - RNA, 22 nt, Human
ucccacacagcccgcucaccgg

SEQ ID NO: 613191 - RNA, 20 nt, Human
ugugcccaauguccagguuc

SEQ ID NO: 613192 - RNA, 22 nt, Human
uauuuggugaaucuauggucag

SEQ ID NO: 613193 - RNA, 21 nt, Human
gcuggcugucucuuacacggu

SEQ ID NO: 613194 - RNA, 22 nt, Human
auaacugagugagcagcgacuc

SEQ ID NO: 613195 - RNA, 22 nt, Human
cuaccugguacauagaaauguu

SEQ ID NO: 613196 - RNA, 22 nt, Human
aucugucccuccucacagccuc

SEQ ID NO: 613197 - RNA, 22 nt, Human
ugugaggaccucagcagagucu

SEQ ID NO: 613198 - RNA, 18 nt, Human
uaaguggacacaggucac

SEQ ID NO: 613199 - RNA, 22 nt, Human
ucaauuuauguggcuauucauu

SEQ ID NO: 613200 - RNA, 22 nt, Human
cagggcacuuaaauugccucgu

SEQ ID NO: 613201 - RNA, 22 nt, Human
ugcucccaaaccugacaggcuc

SEQ ID NO: 613202 - RNA, 22 nt, Human
ggcuuuuguuucagcucugcua

SEQ ID NO: 613203 - RNA, 22 nt, Human
agugacauuauuuuguguacua

SEQ ID NO: 613204 - RNA, 22 nt, Human
cggcuggagcugagaaaggagc

SEQ ID NO: 613205 - RNA, 22 nt, Human
ccugacagcgugucccuggccc

SEQ ID NO: 613206 - RNA, 22 nt, Human
cuguguccaauggccuuagcag

SEQ ID NO: 613207 - RNA, 22 nt, Human
ugcuggccucggcgcugggccu

SEQ ID NO: 613208 - RNA, 22 nt, Human
ccagcagccaccuucucgaaau

SEQ ID NO: 613209 - RNA, 22 nt, Human
agucuggagugauuauguggga

SEQ ID NO: 613210 - RNA, 22 nt, Human
ugugcugcucucagugacagcc

SEQ ID NO: 613211 - RNA, 22 nt, Human
acuggcccuggcugcuaggcug

SEQ ID NO: 613212 - RNA, 18 nt, Human
acagggagggcgcugggg

SEQ ID NO: 613213 - RNA, 22 nt, Human
agagaugcuguggguagaggca

SEQ ID NO: 613214 - RNA, 22 nt, Human
uagucaccuguugugugaugcc

SEQ ID NO: 613215 - RNA, 22 nt, Human
uguguuucugagaaucccaccu

SEQ ID NO: 613216 - RNA, 22 nt, Human
cugggacacguugugcuuuaac

SEQ ID NO: 613217 - RNA, 22 nt, Human
caucucccacuuccuugggggu

SEQ ID NO: 613218 - RNA, 22 nt, Human
ccaggcauccauugcuuccucu

SEQ ID NO: 613219 - RNA, 22 nt, Human
gcagcccaggcucgcucacugc

SEQ ID NO: 613220 - RNA, 22 nt, Human
ggcaguggcuccucucuacucc

SEQ ID NO: 613221 - RNA, 22 nt, Human
uugcccacuggcuguuggucag

SEQ ID NO: 613222 - RNA, 22 nt, Human
uucuccacccacucuuuuguug

SEQ ID NO: 613223 - RNA, 22 nt, Human
agccccaggcccggacgccucu

SEQ ID NO: 613224 - RNA, 22 nt, Human
ggcagagcuugcagugagccga

SEQ ID NO: 613225 - RNA, 22 nt, Human
gcuuggccagcagccgggaugc

SEQ ID NO: 613226 - RNA, 22 nt, Human
cugggguccuugccauguguca

SEQ ID NO: 613227 - RNA, 22 nt, Human
gguggcagaggugcaucagccc

SEQ ID NO: 613228 - RNA, 22 nt, Human
ggugagagaaaagaaacacugu

SEQ ID NO: 613229 - RNA, 22 nt, Human
uuucuuggucuucccgaccugg

SEQ ID NO: 613230 - RNA, 22 nt, Human
cccuggcucaggcagcuuuguu

SEQ ID NO: 613231 - RNA, 21 nt, Human
acagaaguggcuuggucucag

SEQ ID NO: 613232 - RNA, 22 nt, Human
caguuuuucaaaauuacaugau

SEQ ID NO: 613233 - RNA, 22 nt, Human
gugccgcuggagcuggaauuga

SEQ ID NO: 613234 - RNA, 22 nt, Human
cugggauccacgggcucccaag

SEQ ID NO: 613235 - RNA, 22 nt, Human
ccagucagccaagcugcagcgg

SEQ ID NO: 613236 - RNA, 22 nt, Human
gggcagcaggcuccacguuccu

SEQ ID NO: 613237 - RNA, 22 nt, Human
gccgugcgugcgcaggugcugu

SEQ ID NO: 613238 - RNA, 22 nt, Human
augccccagugugugcuuccuu

SEQ ID NO: 613239 - RNA, 17 nt, Human
gccuggcccagccuggc

SEQ ID NO: 613240 - RNA, 19 nt, Human
cuggcuucaagcaguccuc

SEQ ID NO: 613241 - RNA, 22 nt, Human
auacaccaccuuggaucuuuca

SEQ ID NO: 613242 - RNA, 22 nt, Human
uccuuucuucuucugcccaugg

SEQ ID NO: 613243 - RNA, 22 nt, Human
acagugcuaucaauagcuagaa

SEQ ID NO: 613244 - RNA, 22 nt, Human
aaugccuuggagagccuagagg

SEQ ID NO: 613245 - RNA, 22 nt, Human
guggcagcggcccaggccgucu

SEQ ID NO: 613246 - RNA, 22 nt, Human
uagcuguucucuguaaauugga

SEQ ID NO: 613247 - RNA, 22 nt, Human
gcacugagcuuuggaggagcag

SEQ ID NO: 613248 - RNA, 22 nt, Human
cauggcaggugcagauucugug

SEQ ID NO: 613249 - RNA, 22 nt, Human
cucccagggucuaggcugcugg

SEQ ID NO: 613250 - RNA, 22 nt, Human
ucugggccggagccgacggcag

SEQ ID NO: 613251 - RNA, 22 nt, Human
uuccuggcagaggccccgacag

SEQ ID NO: 613252 - RNA, 22 nt, Human
ugacagcuuggacaggucccuc

SEQ ID NO: 613253 - RNA, 22 nt, Human
ggcgagcaugagucacucuggg

SEQ ID NO: 613254 - RNA, 22 nt, Human
agggccacgugcaccgcggucu

SEQ ID NO: 613255 - RNA, 22 nt, Human
gcgacgcaggcacgacguguug

SEQ ID NO: 613256 - RNA, 22 nt, Human
ugggaagauaugagugaccaac

SEQ ID NO: 613257 - RNA, 22 nt, Human
cuggaagcgucggaggaagggc

SEQ ID NO: 613258 - RNA, 22 nt, Human
ccagcaggaaagugacguuuga

SEQ ID NO: 613259 - RNA, 18 nt, Human
uucggcagauacgcuugg

SEQ ID NO: 613260 - RNA, 22 nt, Human
cagggcuccccagagagccucu

SEQ ID NO: 613261 - RNA, 22 nt, Human
gcugggcaggccucgugagggc

SEQ ID NO: 613262 - RNA, 22 nt, Human
gcgagaaacuaagugcccuuug

SEQ ID NO: 613263 - RNA, 22 nt, Human
ugucauggacuggauuucugcu

SEQ ID NO: 613264 - RNA, 22 nt, Human
agcugcaccggcuggaccacug

SEQ ID NO: 613265 - RNA, 19 nt, Human
augggaagcggccagcgga

SEQ ID NO: 613266 - RNA, 22 nt, Human
auguacaaucuaucacaagaag

SEQ ID NO: 613267 - RNA, 22 nt, Human
gagaauacaaccagaagcugag

SEQ ID NO: 613268 - RNA, 22 nt, Human
uucaaacacugcuuugagaggg

SEQ ID NO: 613269 - RNA, 22 nt, Human
cccuggcucugccucagagccc

SEQ ID NO: 613270 - RNA, 22 nt, Human
agagcaccaaggugguuuggac

SEQ ID NO: 613271 - RNA, 22 nt, Human
cauagacauugauagguuauau

SEQ ID NO: 613272 - RNA, 22 nt, Human
ugacaggcuugcuaagacauag

SEQ ID NO: 613273 - RNA, 22 nt, Human
acaaaggugagcagaagacaca

SEQ ID NO: 613274 - RNA, 22 nt, Human
cugagcaugcuacaugcagcac

SEQ ID NO: 613275 - RNA, 22 nt, Human
cagagguagccgagugcaaucg

SEQ ID NO: 613276 - RNA, 22 nt, Human
ucugccaucaagaugcucuggc

SEQ ID NO: 613277 - RNA, 22 nt, Human
uuuacagcuacuguccuauuuc

SEQ ID NO: 613278 - RNA, 22 nt, Human
cggagaggugggggcagcaucu

SEQ ID NO: 613279 - RNA, 22 nt, Human
cagcugccuaugaccuagccuc

SEQ ID NO: 613280 - RNA, 22 nt, Human
uaucugucgggagucuuccgga

SEQ ID NO: 613281 - RNA, 22 nt, Human
gcggcccgagcaggacgggugg

SEQ ID NO: 613282 - RNA, 22 nt, Human
guguccagagccgggcugaaug

SEQ ID NO: 613283 - RNA, 22 nt, Human
uccugggcccuccggaucaggu

SEQ ID NO: 613284 - RNA, 22 nt, Human
ucuguggcaugguaucuggagg

SEQ ID NO: 613285 - RNA, 22 nt, Human
auagacacagcuaugauuugag

SEQ ID NO: 613286 - RNA, 21 nt, Human
uuccuggaggcagaaacguga

SEQ ID NO: 613287 - RNA, 18 nt, Human
ucugugggaucagugagg

SEQ ID NO: 613288 - RNA, 22 nt, Human
aagcgcagacacagagagugga

SEQ ID NO: 613289 - RNA, 22 nt, Human
cagucccaguuugagacucugg

SEQ ID NO: 613290 - RNA, 22 nt, Human
gucugcccuuggccugggacuu

SEQ ID NO: 613291 - RNA, 22 nt, Human
ccuguacuuguauuaaaggucc

SEQ ID NO: 613292 - RNA, 22 nt, Human
aaaggagacuucagaucuccuu

SEQ ID NO: 613293 - RNA, 22 nt, Human
ccuugcagcauauagagucccu

SEQ ID NO: 613294 - RNA, 22 nt, Human
caggacccaaccucccugcucu

SEQ ID NO: 613295 - RNA, 22 nt, Human
cagagccuuaguucuccuagaa

SEQ ID NO: 613296 - RNA, 22 nt, Human
uuagacagagcuccuugagggc

SEQ ID NO: 613297 - RNA, 20 nt, Human
ggcagagcuaugucuguugc

SEQ ID NO: 613298 - RNA, 20 nt, Human
ucuggggaugaggucuagga

SEQ ID NO: 613299 - RNA, 22 nt, Human
ugugacagugccagcuucauag

SEQ ID NO: 613300 - RNA, 22 nt, Human
uaaaaguuagcuaggacaaagu

SEQ ID NO: 613301 - RNA, 18 nt, Human
gcugaaauucuaaacaaa

SEQ ID NO: 613302 - RNA, 22 nt, Human
uggcccugccgccacgacgucu

SEQ ID NO: 613303 - RNA, 22 nt, Human
augaugaagcaugguuacacug

SEQ ID NO: 613304 - RNA, 22 nt, Human
ugcugaggagguggcugugcuu

SEQ ID NO: 613305 - RNA, 22 nt, Human
uggagugcaguugggaggacac

SEQ ID NO: 613306 - RNA, 20 nt, Human
ucucccugcccaucucagau

SEQ ID NO: 613307 - RNA, 21 nt, Human
aggucccagguuugggcagca

SEQ ID NO: 613308 - RNA, 22 nt, Human
auguauacgugcaggucacagg

SEQ ID NO: 613309 - RNA, 22 nt, Human
ccucuggccuaggccgggagag

SEQ ID NO: 613310 - RNA, 22 nt, Human
cagcagcucaggcuccuuccca

SEQ ID NO: 613311 - RNA, 22 nt, Human
gaugucuggcuaccacucgcac

SEQ ID NO: 613312 - RNA, 22 nt, Human
auacaggaugcugaacaucucu

SEQ ID NO: 613313 - RNA, 22 nt, Human
augcggagccccaagcuugaag

SEQ ID NO: 613314 - RNA, 18 nt, Human
uacagcuugaguugacug

SEQ ID NO: 613315 - RNA, 22 nt, Human
aaugugcugguaacugcuuugc

SEQ ID NO: 613316 - RNA, 22 nt, Human
uccuggguccauggcagccgaa

SEQ ID NO: 613317 - RNA, 22 nt, Human
uuaguguccagaguuuuuauua

SEQ ID NO: 613318 - RNA, 22 nt, Human
cucagaggggaugcuuggagaa

SEQ ID NO: 613319 - RNA, 22 nt, Human
cuugggcaggggaaacagcugc

SEQ ID NO: 613320 - RNA, 22 nt, Human
auugagaaaauucgagcaaguu

SEQ ID NO: 613321 - RNA, 22 nt, Human
auuuacugagguaaauaaacug

SEQ ID NO: 613322 - RNA, 22 nt, Human
aguaacagguguacagacuauc

SEQ ID NO: 613323 - RNA, 22 nt, Human
ucugcucagccgaucugcuccg

SEQ ID NO: 613324 - RNA, 22 nt, Human
ggccagccuggggcucccagac

SEQ ID NO: 613325 - RNA, 22 nt, Human
acaguguuacuugauaguguau

SEQ ID NO: 613326 - RNA, 22 nt, Human
cuguggcugcgcccugggggag

SEQ ID NO: 613327 - RNA, 22 nt, Human
aguguauucugcaugggagacu

SEQ ID NO: 613328 - RNA, 22 nt, Human
auguuuguguuucccauucagg

SEQ ID NO: 613329 - RNA, 22 nt, Human
gugccuccaggcucgacuaguc

SEQ ID NO: 613330 - RNA, 22 nt, Human
ccuguggcacaugcagggauuc

SEQ ID NO: 613331 - RNA, 22 nt, Human
guuauguaaucuaacacucagu

SEQ ID NO: 613332 - RNA, 22 nt, Human
ccaugcccuugucaucuccagg

SEQ ID NO: 613333 - RNA, 22 nt, Human
aaugaaacuaguagaaucuuug

SEQ ID NO: 613334 - RNA, 22 nt, Human
accauccaaacugcuuucugug

SEQ ID NO: 613335 - RNA, 22 nt, Human
caacagcuggaggcuuggcccg

SEQ ID NO: 613336 - RNA, 22 nt, Human
cagacagagucuucccaucagu

SEQ ID NO: 613337 - RNA, 22 nt, Human
ucgcuugaacccaggaagugga

SEQ ID NO: 613338 - RNA, 22 nt, Human
ucacaauacucacucaauggcu

SEQ ID NO: 613339 - RNA, 22 nt, Human
gaaacacucaauuuaguaauuc

SEQ ID NO: 613340 - RNA, 19 nt, Human
ucuggcugccaaggauuga

SEQ ID NO: 613341 - RNA, 18 nt, Human
gaggcacauaguuggggc

SEQ ID NO: 613342 - RNA, 22 nt, Human
aggugcuuggcucgugcacaca

SEQ ID NO: 613343 - RNA, 19 nt, Human
cagcaaacacuguaaaugg

SEQ ID NO: 613344 - RNA, 22 nt, Human
aacacauggcaagagcaggaaa

SEQ ID NO: 613345 - RNA, 19 nt, Human
ucuuucauuucuagcucug

SEQ ID NO: 613346 - RNA, 22 nt, Human
ucauuguuucugcuuuucauga

SEQ ID NO: 613347 - RNA, 22 nt, Human
cugcacagucauuuccucucaa

SEQ ID NO: 613348 - RNA, 22 nt, Human
ccagaacagaccugccugaccu

SEQ ID NO: 613349 - RNA, 22 nt, Human
ggagguggagcuggaaguucca

SEQ ID NO: 613350 - RNA, 23 nt, Human
caaaaugcuaugugcccaaugca

SEQ ID NO: 613351 - RNA, 22 nt, Human
cagcuccccucuguggggcagu

SEQ ID NO: 613352 - RNA, 22 nt, Human
guggcauugccuucugcaggaa

SEQ ID NO: 613353 - RNA, 22 nt, Human
aggcuccaugguucucccucag

SEQ ID NO: 613354 - RNA, 22 nt, Human
gucugugcaguuacuagcuggu

SEQ ID NO: 613355 - RNA, 22 nt, Human
auucccuuugacgaucccuagg

SEQ ID NO: 613356 - RNA, 22 nt, Human
ugcaugguguaauucuaaugcu

SEQ ID NO: 613357 - RNA, 22 nt, Human
gcuuucuuuucaagaauguauu

SEQ ID NO: 613358 - RNA, 22 nt, Human
gacacugcacuuggggcccaca

SEQ ID NO: 613359 - RNA, 22 nt, Human
aucagagcuaguacuugcaggu

SEQ ID NO: 613360 - RNA, 22 nt, Human
guucucucagcgauagugaugg

SEQ ID NO: 613361 - RNA, 22 nt, Human
gacagcaggaugugaggggaug

SEQ ID NO: 613362 - RNA, 22 nt, Human
uuccagcuaacucacaucccuu

SEQ ID NO: 613363 - RNA, 22 nt, Human
uuucacauacaguguauaguag

SEQ ID NO: 613364 - RNA, 22 nt, Human
aaggcagcaugaaucccuguac

SEQ ID NO: 613365 - RNA, 22 nt, Human
caugugguauugugagauccac

SEQ ID NO: 613366 - RNA, 22 nt, Human
aucuguucuucaaaauauuaca

SEQ ID NO: 613367 - RNA, 22 nt, Human
cagggccagggcuauggugaag

SEQ ID NO: 613368 - RNA, 22 nt, Human
aaugauguuuuuaaagaacaua

SEQ ID NO: 613369 - RNA, 22 nt, Human
ucucgugcaggccuugcucgga

SEQ ID NO: 613370 - RNA, 22 nt, Human
uccaugacagcgugagaguuug

SEQ ID NO: 613371 - RNA, 22 nt, Human
caagagcuggguggcaagcuag

SEQ ID NO: 613372 - RNA, 19 nt, Human
uccugcccaccagccaggg

SEQ ID NO: 613373 - RNA, 22 nt, Human
uaaccuguuaagggcugaccca

SEQ ID NO: 613374 - RNA, 22 nt, Human
agucaacauuugagaugcaaug

SEQ ID NO: 613375 - RNA, 22 nt, Human
ucucugagaucagccacugacu

SEQ ID NO: 613376 - RNA, 22 nt, Human
uuccuucuucauuguguuacag

SEQ ID NO: 613377 - RNA, 22 nt, Human
cugcgugguaggacucaguucu

SEQ ID NO: 613378 - RNA, 22 nt, Human
aaaucccacucacgaguuuugc

SEQ ID NO: 613379 - RNA, 22 nt, Human
gaggcuggacgugcauuucuac

SEQ ID NO: 613380 - RNA, 22 nt, Human
cagcugccuguauuguccucau

SEQ ID NO: 613381 - RNA, 22 nt, Human
uugggcccugcucugaguugcu

SEQ ID NO: 613382 - RNA, 22 nt, Human
uccagcugugcuccaggaggug

SEQ ID NO: 613383 - RNA, 23 nt, Human
acucugacuuaguuauagcuauu

SEQ ID NO: 613384 - RNA, 22 nt, Human
acaggcgcacaugagggccgug

SEQ ID NO: 613385 - RNA, 22 nt, Human
cacauuuaaagguugaagcuga

SEQ ID NO: 613386 - RNA, 22 nt, Human
uaguggggaaggaggacaagaa

SEQ ID NO: 613387 - RNA, 22 nt, Human
auguggcuuucugcguuuucuc

SEQ ID NO: 613388 - RNA, 20 nt, Human
cucagugcuuucauugccuc

SEQ ID NO: 613389 - RNA, 22 nt, Human
uucugugcucaaaacuuuccaa

SEQ ID NO: 613390 - RNA, 22 nt, Human
auacaugugugugcauacaugu

SEQ ID NO: 613391 - RNA, 17 nt, Human
gagguaggaagugaguc

SEQ ID NO: 613392 - RNA, 22 nt, Human
augaggagucaaggagucggag

SEQ ID NO: 613393 - RNA, 22 nt, Human
ccaaacauuucaaauuuagaga

SEQ ID NO: 613394 - RNA, 22 nt, Human
gccaggguggcagaaggcccca

SEQ ID NO: 613395 - RNA, 22 nt, Human
auuaguguuguggcuucauggc

SEQ ID NO: 613396 - RNA, 22 nt, Human
cuuugcagagggggugggagcu

SEQ ID NO: 613397 - RNA, 22 nt, Human
aguggcaguagaugagcugguu

SEQ ID NO: 613398 - RNA, 22 nt, Human
ugcccuguuccugccuccagcu

SEQ ID NO: 613399 - RNA, 22 nt, Human
ugccagcaguagcaguaggcca

SEQ ID NO: 613400 - RNA, 22 nt, Human
uguguccuucugggagucccag

SEQ ID NO: 613401 - RNA, 22 nt, Human
ccccaacccugguuccguggcg

SEQ ID NO: 613402 - RNA, 22 nt, Human
ggccauggcgggagccggcguc

SEQ ID NO: 613403 - RNA, 22 nt, Human
aacuuucuuugcaucuaaguuu

SEQ ID NO: 613404 - RNA, 19 nt, Human
uuuaaugugugcugcaauc

SEQ ID NO: 613405 - RNA, 22 nt, Human
agugcuuuauguuguugugcaa

SEQ ID NO: 613406 - RNA, 22 nt, Human
aggcagccuauggggagcucag

SEQ ID NO: 613407 - RNA, 22 nt, Human
uaauuuugucacagugacaugc

SEQ ID NO: 613408 - RNA, 22 nt, Human
agauaaaguccaaacuguguag

SEQ ID NO: 613409 - RNA, 22 nt, Human
gcuguaacuuuuucauuuucaa

SEQ ID NO: 613410 - RNA, 19 nt, Human
ugguggaggugcaccugac

SEQ ID NO: 613411 - RNA, 22 nt, Human
aauggcuguucucugugauugg

SEQ ID NO: 613412 - RNA, 22 nt, Human
cuuggcauguucaucugcuugg

SEQ ID NO: 613413 - RNA, 22 nt, Human
ucuggcuucaguaggguucacu

SEQ ID NO: 613414 - RNA, 22 nt, Human
uucaaacaguguagaauauaug

SEQ ID NO: 613415 - RNA, 22 nt, Human
uccaggagugauaaggccacug

SEQ ID NO: 613416 - RNA, 22 nt, Human
ugguccucacccuacccagcug

SEQ ID NO: 613417 - RNA, 22 nt, Human
uuauuccauagaagucaaggaa

SEQ ID NO: 613418 - RNA, 22 nt, Human
ggcagugaugucaaacagugaa

SEQ ID NO: 613419 - RNA, 22 nt, Human
uuuccaaagguggcaggaacaa

SEQ ID NO: 613420 - RNA, 22 nt, Human
uuucuaguggguauucccuguu

SEQ ID NO: 613421 - RNA, 22 nt, Human
gagaugggcgagaagguggacu

SEQ ID NO: 613422 - RNA, 22 nt, Human
uuuguguuggaagaaaugcuac

SEQ ID NO: 613423 - RNA, 22 nt, Human
cuggcuccucaggacugcggga

SEQ ID NO: 613424 - RNA, 22 nt, Human
aagcaaaagguuacacuucugg

SEQ ID NO: 613425 - RNA, 22 nt, Human
gccuguuucuccuccuuggccc

SEQ ID NO: 613426 - RNA, 22 nt, Human
gagcugcauagcugggauccuc

SEQ ID NO: 613427 - RNA, 22 nt, Human
aagggccacaugccauuuaaaa

SEQ ID NO: 613428 - RNA, 22 nt, Human
gggcucuguuuagaccagagau

SEQ ID NO: 613429 - RNA, 21 nt, Human
ugugacagaggcggugccuac

SEQ ID NO: 613430 - RNA, 22 nt, Human
cauugcuuugugcauauuuaaa

SEQ ID NO: 613431 - RNA, 23 nt, Human
uacagccaugucgcugauuuaac

SEQ ID NO: 613432 - RNA, 22 nt, Human
acuugguggcgaacgaggguca

SEQ ID NO: 613433 - RNA, 22 nt, Human
gggagaguagcuggaagguucu

SEQ ID NO: 613434 - RNA, 19 nt, Human
ccauucugucucugccaca

SEQ ID NO: 613435 - RNA, 18 nt, Human
gaaggcauucaguggcuu

SEQ ID NO: 613436 - RNA, 22 nt, Human
aauacagugaaagugagcaagg

SEQ ID NO: 613437 - RNA, 22 nt, Human
cccauugugguuguugaggaua

SEQ ID NO: 613438 - RNA, 22 nt, Human
ucccuggcacaagaaggcuguc

SEQ ID NO: 613439 - RNA, 22 nt, Human
gccagguugcugacgacgaucu

SEQ ID NO: 613440 - RNA, 22 nt, Human
ucugaggucauuccaaggacau

SEQ ID NO: 613441 - RNA, 22 nt, Human
gucuuaagaaugaaugcugaga

SEQ ID NO: 613442 - RNA, 22 nt, Human
ucugaggcugaauggacuccgu

SEQ ID NO: 613443 - RNA, 22 nt, Human
cagcuccaucuugcuuauacca

SEQ ID NO: 613444 - RNA, 22 nt, Human
gggcagcaaaucugagucuggu

SEQ ID NO: 613445 - RNA, 22 nt, Human
ccugugguuuacucuguggcua

SEQ ID NO: 613446 - RNA, 21 nt, Human
cuuuucuagucccagccccgc

SEQ ID NO: 613447 - RNA, 22 nt, Human
gcaggaguguggugggacaucc

SEQ ID NO: 613448 - RNA, 20 nt, Human
ugcuggaggcgccggcgcuc

SEQ ID NO: 613449 - RNA, 22 nt, Human
cuccuucacgcaggcugccaug

SEQ ID NO: 613450 - RNA, 22 nt, Human
cagcgguggcaaggugacugug

SEQ ID NO: 613451 - RNA, 22 nt, Human
auguaacauaugugaucgcauu

SEQ ID NO: 613452 - RNA, 22 nt, Human
ucauggcacaugcccuccaggg

SEQ ID NO: 613453 - RNA, 22 nt, Human
aaugcaaugcagcaccuccuug

SEQ ID NO: 613454 - RNA, 21 nt, Human
uccaggagcacgggacuagga

SEQ ID NO: 613455 - RNA, 22 nt, Human
ugccaggcugcccuccagucug

SEQ ID NO: 613456 - RNA, 22 nt, Human
uaacacauagauauuuuaacuu

SEQ ID NO: 613457 - RNA, 22 nt, Human
aauuauguuugcuuuagaugga

SEQ ID NO: 613458 - RNA, 22 nt, Human
cucuggucaagcaaagagguuu

SEQ ID NO: 613459 - RNA, 22 nt, Human
cagugcaacguugugcauucaa

SEQ ID NO: 613460 - RNA, 20 nt, Human
caucaacaccuugucagccu

SEQ ID NO: 613461 - RNA, 18 nt, Human
gggguagaguguccuauu

SEQ ID NO: 613462 - RNA, 22 nt, Human
uucuguucccuaggaccugggg

SEQ ID NO: 613463 - RNA, 22 nt, Human
ucacuaugcccagaauacaguu

SEQ ID NO: 613464 - RNA, 22 nt, Human
cacagaggaugcccaagcgauc

SEQ ID NO: 613465 - RNA, 18 nt, Human
acccauuauauuuguagc

SEQ ID NO: 613466 - RNA, 22 nt, Human
aggccacaggaguacugucggu

SEQ ID NO: 613467 - RNA, 22 nt, Human
uuuccagaaauaccauuuggug

SEQ ID NO: 613468 - RNA, 21 nt, Human
uugauuuagcagaucuagcug

SEQ ID NO: 613469 - RNA, 22 nt, Human
uccagcagguccgagacaaguu

SEQ ID NO: 613470 - RNA, 22 nt, Human
ucagagccccuccgcuguccca

SEQ ID NO: 613471 - RNA, 22 nt, Human
uuaauggauuggagguuucaau

SEQ ID NO: 613472 - RNA, 20 nt, Human
gaccagaucccuuaccagcu

SEQ ID NO: 613473 - RNA, 22 nt, Human
uccagccauaucuuguagcccu

SEQ ID NO: 613474 - RNA, 22 nt, Human
gucuccugaggcauccauugaa

SEQ ID NO: 613475 - RNA, 22 nt, Human
uuccagagaguuauuccccugg

SEQ ID NO: 613476 - RNA, 22 nt, Human
gguggcugugagcauuauguga

SEQ ID NO: 613477 - RNA, 22 nt, Human
augcacacguacccuacaaggc

SEQ ID NO: 613478 - RNA, 22 nt, Human
cuccugcagcccucagcagcca

SEQ ID NO: 613479 - RNA, 23 nt, Human
augcuagcugugccaacaccaua

SEQ ID NO: 613480 - RNA, 22 nt, Human
uuccuguucaggaaaguugugu

SEQ ID NO: 613481 - RNA, 22 nt, Human
aucugguuuggggauccuugug

SEQ ID NO: 613482 - RNA, 22 nt, Human
guuuauuggguauuguggagcc

SEQ ID NO: 613483 - RNA, 22 nt, Human
gcaggguaggugacagguaguc

SEQ ID NO: 613484 - RNA, 22 nt, Human
acuggaaaguauucuuucacug

SEQ ID NO: 613485 - RNA, 21 nt, Human
gcugcucgagauccagugcuu

SEQ ID NO: 613486 - RNA, 22 nt, Human
cccagcauuucugggcugcacu

SEQ ID NO: 613487 - RNA, 22 nt, Human
gcuguggcuccaauggugagcc

SEQ ID NO: 613488 - RNA, 22 nt, Human
aggccagaacagcucugcacca

SEQ ID NO: 613489 - RNA, 20 nt, Human
uugagcagcagugcuguguc

SEQ ID NO: 613490 - RNA, 22 nt, Human
cagcccacugccucugugguag

SEQ ID NO: 613491 - RNA, 22 nt, Human
uacuuucuagcucuccccaguu

SEQ ID NO: 613492 - RNA, 22 nt, Human
agcaauguuggccuauauaccu

SEQ ID NO: 613493 - RNA, 20 nt, Human
ccacccuguccggggcggag

SEQ ID NO: 613494 - RNA, 22 nt, Human
gacuggcucuaucaggauaaau

SEQ ID NO: 613495 - RNA, 22 nt, Human
gccugagccgccugagcggcgg

SEQ ID NO: 613496 - RNA, 22 nt, Human
uccaguggugguuugaagggca

SEQ ID NO: 613497 - RNA, 23 nt, Human
acagaagccaggagccgcugggc

SEQ ID NO: 613498 - RNA, 22 nt, Human
gccggucuuaagcugacuguga

SEQ ID NO: 613499 - RNA, 22 nt, Human
uuggcgcccaggacgccgccgc

SEQ ID NO: 613500 - RNA, 22 nt, Human
ggcucagaaaccucuggugucu

SEQ ID NO: 613501 - RNA, 22 nt, Human
gagcacugauuuauuuuugucu

SEQ ID NO: 613502 - RNA, 22 nt, Human
acagugucuccugguacccagu

SEQ ID NO: 613503 - RNA, 22 nt, Human
cuuugggcacugaaguaugggu

SEQ ID NO: 613504 - RNA, 22 nt, Human
uauaugcagauuuucaucaucg

SEQ ID NO: 613505 - RNA, 22 nt, Human
cuguuuauucucaucuaaaaug

SEQ ID NO: 613506 - RNA, 22 nt, Human
gacaagaugacaucauggcuuc

SEQ ID NO: 613507 - RNA, 22 nt, Human
ccucuuccacugggccccaucc

SEQ ID NO: 613508 - RNA, 22 nt, Human
aggggcuuguggaguugcuggu

SEQ ID NO: 613509 - RNA, 22 nt, Human
cagugcugcaggcgccugcggu

SEQ ID NO: 613510 - RNA, 18 nt, Human
uuugggauccucuuuucu

SEQ ID NO: 613511 - RNA, 22 nt, Human
uacagcagcccaccuucuucug

SEQ ID NO: 613512 - RNA, 22 nt, Human
agcugcaaguccaaaggaauua

SEQ ID NO: 613513 - RNA, 22 nt, Human
cugcuuuaaaacugauacauga

SEQ ID NO: 613514 - RNA, 22 nt, Human
cugggaggcccacguugggaag

SEQ ID NO: 613515 - RNA, 22 nt, Human
ucaaaaugccgagugcccaggu

SEQ ID NO: 613516 - RNA, 22 nt, Human
cauggccaaagaauuauauuuu

SEQ ID NO: 613517 - RNA, 22 nt, Human
gagugccuuccccaugcuuugg

SEQ ID NO: 613518 - RNA, 20 nt, Human
uuuuccacuccucaaaacag

SEQ ID NO: 613519 - RNA, 22 nt, Human
uugauggacagggaccacuguc

SEQ ID NO: 613520 - RNA, 22 nt, Human
guggacagacauaauccuaauu

SEQ ID NO: 613521 - RNA, 23 nt, Human
uggcucugagcuuccugguggcc

SEQ ID NO: 613522 - RNA, 22 nt, Human
aaggcuccagugaaugcuggca

SEQ ID NO: 613523 - RNA, 21 nt, Human
agagacugucacugcaguacc

SEQ ID NO: 613524 - RNA, 22 nt, Human
gcagcugccgugagcucacgcc

SEQ ID NO: 613525 - RNA, 22 nt, Human
gcagauggauguggacggcgcc

SEQ ID NO: 613526 - RNA, 19 nt, Human
cuucaguguucaccuggcc

SEQ ID NO: 613527 - RNA, 22 nt, Human
ugcccacaggaagacaccagcg

SEQ ID NO: 613528 - RNA, 21 nt, Human
cccagaaguuccauggggggc

SEQ ID NO: 613529 - RNA, 20 nt, Human
aauagcacagcucaaacauu

SEQ ID NO: 613530 - RNA, 22 nt, Human
gucuguccacuuggaagcuccc

SEQ ID NO: 613531 - RNA, 22 nt, Human
agggcucagaaagcagguuuuc

SEQ ID NO: 613532 - RNA, 22 nt, Human
ggcuucuuagaauuugacuuac

SEQ ID NO: 613533 - RNA, 22 nt, Human
ucccacagcuucgugcuucccc

SEQ ID NO: 613534 - RNA, 19 nt, Human
ugaggauugagguccagua

SEQ ID NO: 613535 - RNA, 22 nt, Human
ccuacucccuuucuagaguaug

SEQ ID NO: 613536 - RNA, 18 nt, Human
ucugaaggaaugauucca

SEQ ID NO: 613537 - RNA, 22 nt, Human
gaaaugucaagauauguuugga

SEQ ID NO: 613538 - RNA, 22 nt, Human
accugguaaccugccugacuaa

SEQ ID NO: 613539 - RNA, 23 nt, Human
aguacauuugacccaaauaagcu

SEQ ID NO: 613540 - RNA, 21 nt, Human
agccugcaauguagguaccgg

SEQ ID NO: 613541 - RNA, 22 nt, Human
auacacauguuauuguggaagc

SEQ ID NO: 613542 - RNA, 22 nt, Human
ugacagcccaccucacaggauu

SEQ ID NO: 613543 - RNA, 17 nt, Human
agcuuggagcagcauga

SEQ ID NO: 613544 - RNA, 22 nt, Human
ucccagucuagagccggauugg

SEQ ID NO: 613545 - RNA, 22 nt, Human
ucuugggcaauuucucuagagg

SEQ ID NO: 613546 - RNA, 23 nt, Human
ugagagccuggcagccuggguuc

SEQ ID NO: 613547 - RNA, 22 nt, Human
uggcuacauuuauacucucauu

SEQ ID NO: 613548 - RNA, 22 nt, Human
uuauguauggauggcugaaagu

SEQ ID NO: 613549 - RNA, 23 nt, Human
ggacaugucucuggguauuuuga

SEQ ID NO: 613550 - RNA, 22 nt, Human
gugcaggugguuggcccagccg

SEQ ID NO: 613551 - RNA, 23 nt, Human
uccaguuaaugguucccagucug

SEQ ID NO: 613552 - RNA, 22 nt, Human
ccuucaaucuuaagucagccca

SEQ ID NO: 613553 - RNA, 22 nt, Human
ugaugggaggugcugcaggacc

SEQ ID NO: 613554 - RNA, 22 nt, Human
ugcacagagggaggcauaaaau

SEQ ID NO: 613555 - RNA, 22 nt, Human
ucuucacaguccuggucagugg

SEQ ID NO: 613556 - RNA, 22 nt, Human
aacacugagaggggaguggcac

SEQ ID NO: 613557 - RNA, 22 nt, Human
caggaaugccaaccagugcaug

SEQ ID NO: 613558 - RNA, 22 nt, Human
gcugauggcuugcuggcugaca

SEQ ID NO: 613559 - RNA, 22 nt, Human
ggugggucuuguggggcagcuu

SEQ ID NO: 613560 - RNA, 22 nt, Human
ugcugcuuguuuuguaaauaaa

SEQ ID NO: 613561 - RNA, 22 nt, Human
ucugagugggaacucucaugac

SEQ ID NO: 613562 - RNA, 22 nt, Human
ugcacacaguucucaggaaaga

SEQ ID NO: 613563 - RNA, 22 nt, Human
agcucagggccaggcgcguuuc

SEQ ID NO: 613564 - RNA, 22 nt, Human
acagaagugacaauuucuuggg

SEQ ID NO: 613565 - RNA, 22 nt, Human
gagcacugagcuggaauuggag

SEQ ID NO: 613566 - RNA, 22 nt, Human
ugccgcugucgccaccauggcu

SEQ ID NO: 613567 - RNA, 22 nt, Human
gacuuugccacuugcuccagcu

SEQ ID NO: 613568 - RNA, 22 nt, Human
cuacagaauucaacaaaugguu

SEQ ID NO: 613569 - RNA, 22 nt, Human
aucaagggcgcgugguucggcg

SEQ ID NO: 613570 - RNA, 22 nt, Human
gcggcuccgaagccaggccgcg

SEQ ID NO: 613571 - RNA, 22 nt, Human
ccaucuucucuugaaccuccuu

SEQ ID NO: 613572 - RNA, 22 nt, Human
caggacccaucagccaggcacu

SEQ ID NO: 613573 - RNA, 22 nt, Human
ugugacuaggccugagcucuug

SEQ ID NO: 613574 - RNA, 22 nt, Human
uaagaaacauuuuuaugacagu

SEQ ID NO: 613575 - RNA, 22 nt, Human
gagggccaaugugucccugagc

SEQ ID NO: 613576 - RNA, 22 nt, Human
ggucuccugaccuuuagucccu

SEQ ID NO: 613577 - RNA, 22 nt, Human
gggaggugauuaggaccaugua

SEQ ID NO: 613578 - RNA, 22 nt, Human
acgcggugcggcaaguucaugg

SEQ ID NO: 613579 - RNA, 22 nt, Human
gaggugggaugugugugcuacu

SEQ ID NO: 613580 - RNA, 22 nt, Human
ugcuuguauucauaucacagcu

SEQ ID NO: 613581 - RNA, 22 nt, Human
cuguccauggcaaugaugcaga

SEQ ID NO: 613582 - RNA, 22 nt, Human
uuugggcaggcuuuucccuaga

SEQ ID NO: 613583 - RNA, 23 nt, Human
uggaaacauucugaauguccauc

SEQ ID NO: 613584 - RNA, 22 nt, Human
ugaggcuggaugggaugccucc

SEQ ID NO: 613585 - RNA, 22 nt, Human
acuuuucuuaucagaaaggcca

SEQ ID NO: 613586 - RNA, 22 nt, Human
cagagccacugucugccaggca

SEQ ID NO: 613587 - RNA, 22 nt, Human
ggagcugugcugggugaucagg

SEQ ID NO: 613588 - RNA, 22 nt, Human
gcuagggagacuugugucauca

SEQ ID NO: 613589 - RNA, 22 nt, Human
ugcugcacuuauggcucugagg

SEQ ID NO: 613590 - RNA, 22 nt, Human
aggggcacgaguagagcucuag

SEQ ID NO: 613591 - RNA, 22 nt, Human
ugcuccaucuagagcucugcag

SEQ ID NO: 613592 - RNA, 22 nt, Human
caaagccaggcuuucuaaugua

SEQ ID NO: 613593 - RNA, 22 nt, Human
gcuugcugaacaggaaccuggc

SEQ ID NO: 613594 - RNA, 22 nt, Human
cgugaugcucaggaggucauag

SEQ ID NO: 613595 - RNA, 22 nt, Human
uggaaauaguugugagucaggc

SEQ ID NO: 613596 - RNA, 22 nt, Human
agggcacucugcagggaccacc

SEQ ID NO: 613597 - RNA, 22 nt, Human
agacagcacuuuuguauggggg

SEQ ID NO: 613598 - RNA, 23 nt, Human
ucugaccucguuugcuguguucu

SEQ ID NO: 613599 - RNA, 22 nt, Human
uagugucuuccaggacauggua

SEQ ID NO: 613600 - RNA, 22 nt, Human
augacagcucuagcacacagua

SEQ ID NO: 613601 - RNA, 21 nt, Human
ugcuggguuugcccaucaggc

SEQ ID NO: 613602 - RNA, 22 nt, Human
uugggacaaagacuccuugaau

SEQ ID NO: 613603 - RNA, 19 nt, Human
ugggcagugccagggcuua

SEQ ID NO: 613604 - RNA, 22 nt, Human
ccacccuuccauucuuccucuu

SEQ ID NO: 613605 - RNA, 22 nt, Human
gccacccuggacgcacuguucg

SEQ ID NO: 613606 - RNA, 22 nt, Human
aaauucuguccugaaugccauu

SEQ ID NO: 613607 - RNA, 22 nt, Human
acagggcaccugagguaggaag

SEQ ID NO: 613608 - RNA, 22 nt, Human
ucucauaauuguuucccagcua

SEQ ID NO: 613609 - RNA, 22 nt, Human
uucccuuucuuaaagaguuagg

SEQ ID NO: 613610 - RNA, 22 nt, Human
guguuuugugaggccuucuuuc

SEQ ID NO: 613611 - RNA, 22 nt, Human
uuucacaugguacugccuguuu

SEQ ID NO: 613612 - RNA, 22 nt, Human
uggccagaacucagacaugugg

SEQ ID NO: 613613 - RNA, 22 nt, Human
cuugacacugucacucaggcca

SEQ ID NO: 613614 - RNA, 22 nt, Human
ucagguccaagauggccaucca

SEQ ID NO: 613615 - RNA, 22 nt, Human
gccuggcaaggcccuguugacu

SEQ ID NO: 613616 - RNA, 22 nt, Human
agacacauuuucagcucugcca

SEQ ID NO: 613617 - RNA, 23 nt, Human
acacauguuuaugcuugggggca

SEQ ID NO: 613618 - RNA, 22 nt, Human
ccacuguuggcccgaagggguc

SEQ ID NO: 613619 - RNA, 22 nt, Human
ggcucugcugguaagaugccuc

SEQ ID NO: 613620 - RNA, 22 nt, Human
gguguggcaguggaccugugaa

SEQ ID NO: 613621 - RNA, 22 nt, Human
cugccguguuuuucauguuaaa

SEQ ID NO: 613622 - RNA, 22 nt, Human
ggaagccaguugcuuggugugg

SEQ ID NO: 613623 - RNA, 22 nt, Human
ucauccagccucaucaggagcu

SEQ ID NO: 613624 - RNA, 22 nt, Human
ugaaaacacuuuaguuuagguc

SEQ ID NO: 613625 - RNA, 22 nt, Human
auugaacauuguucuaggaggc

SEQ ID NO: 613626 - RNA, 22 nt, Human
ugaggaggugggcacacagagu

SEQ ID NO: 613627 - RNA, 19 nt, Human
gcagcugugggaagagcca

SEQ ID NO: 613628 - RNA, 22 nt, Human
aaccagcacugcuggggccugc

SEQ ID NO: 613629 - RNA, 22 nt, Human
uccaagaagcuuacaaucuaau

SEQ ID NO: 613630 - RNA, 22 nt, Human
aaacacaucauucaugucguca

SEQ ID NO: 613631 - RNA, 22 nt, Human
gucccugauaagagccaucgau

SEQ ID NO: 613632 - RNA, 22 nt, Human
ugcccauggcaggauuucugaa

SEQ ID NO: 613633 - RNA, 22 nt, Human
agacgcgguggugcaugccugu

SEQ ID NO: 613634 - RNA, 21 nt, Human
ccaugucagaugugggcugug

SEQ ID NO: 613635 - RNA, 22 nt, Human
aggccugggacgggagccguga

SEQ ID NO: 613636 - RNA, 22 nt, Human
auguuugaaauuguaaguauau

SEQ ID NO: 613637 - RNA, 23 nt, Human
aaaguacuuaaucugcaaaccac

SEQ ID NO: 613638 - RNA, 22 nt, Human
ugucugccugcgggccggcaca

SEQ ID NO: 613639 - RNA, 22 nt, Human
ugcauaaacuucucugguguga

SEQ ID NO: 613640 - RNA, 22 nt, Human
cugggcuuucaggcccuaaggc

SEQ ID NO: 613641 - RNA, 23 nt, Human
uggugggcccugcuugcucacug

SEQ ID NO: 613642 - RNA, 22 nt, Human herpesvirus 8 [Kaposi`s sarcoma-associated h
ucuaaaucccagcaugccagau

SEQ ID NO: 613643 - RNA, 22 nt, Human herpesvirus 8 [Kaposi`s sarcoma-associated h
uccagggucaccgccucacucu

SEQ ID NO: 613644 - RNA, 22 nt, Human herpesvirus 8 [Kaposi`s sarcoma-associated h
uccaggucagagagcagggaug

SEQ ID NO: 613645 - RNA, 22 nt, Human herpesvirus 8 [Kaposi`s sarcoma-associated h
gauggccuugaagucuauguuu

SEQ ID NO: 613646 - RNA, 22 nt, Human herpesvirus 8 [Kaposi`s sarcoma-associated h
gacgguggacaugaucagggug

SEQ ID NO: 613647 - RNA, 21 nt, Human herpesvirus 8 [Kaposi`s sarcoma-associated h
cggauuccauccguggugccc

SEQ ID NO: 613648 - RNA, 22 nt, Human herpesvirus 8 [Kaposi`s sarcoma-associated h
cgccucagcgaggaccugcgca

SEQ ID NO: 613649 - RNA, 22 nt, Human herpesvirus 8 [Kaposi`s sarcoma-associated h
accgcaccaaaaauggcgucug

SEQ ID NO: 613650 - RNA, 22 nt, Human herpesvirus 8 [Kaposi`s sarcoma-associated h
ccggggaugugaugaaguuggg

SEQ ID NO: 613651 - RNA, 22 nt, Human herpesvirus 8 [Kaposi`s sarcoma-associated h
agucccgacuaaugaggacaau

SEQ ID NO: 613652 - RNA, 22 nt, Human herpesvirus 8 [Kaposi`s sarcoma-associated h
uguuuuuuguacuacagcucuc

SEQ ID NO: 613653 - RNA, 22 nt, Human herpesvirus 8 [Kaposi`s sarcoma-associated h
ggggacugucauccuguugguc

SEQ ID NO: 613654 - RNA, 22 nt, Human herpesvirus 8 [Kaposi`s sarcoma-associated h
gcuaccgacggacguauuccug

SEQ ID NO: 613655 - RNA, 22 nt, Human herpesvirus 8 [Kaposi`s sarcoma-associated h
gcaguuagacaccguuaucucc

SEQ ID NO: 613656 - RNA, 22 nt, Human herpesvirus 8 [Kaposi`s sarcoma-associated h
gcaucuuugacgagcgugacua

SEQ ID NO: 613657 - RNA, 22 nt, Human herpesvirus 8 [Kaposi`s sarcoma-associated h
cuugugcacacggcccguaugg

SEQ ID NO: 613658 - RNA, 22 nt, Human herpesvirus 8 [Kaposi`s sarcoma-associated h
gacgauguggcucgggugaaug

SEQ ID NO: 613659 - RNA, 19 nt, Human herpesvirus 8 [Kaposi`s sarcoma-associated h
agggcggguuauuggcagu

SEQ ID NO: 613660 - RNA, 16 nt, Human herpesvirus 8 [Kaposi`s sarcoma-associated h
cgcccgagcugucguu

SEQ ID NO: 613661 - RNA, 22 nt, Human herpesvirus 8 [Kaposi`s sarcoma-associated h
cgaggaauaggcagcagaggca

SEQ ID NO: 613662 - RNA, 22 nt, Human herpesvirus 8 [Kaposi`s sarcoma-associated h
agccuggacgauguacuugaac

SEQ ID NO: 613663 - RNA, 22 nt, Human herpesvirus 8 [Kaposi`s sarcoma-associated h
gggucuccugcggaggccaaua

SEQ ID NO: 613664 - RNA, 22 nt, Human herpesvirus 8 [Kaposi`s sarcoma-associated h
ggugccccuaaagaccgucugu

SEQ ID NO: 613665 - RNA, 22 nt, Human herpesvirus 8 [Kaposi`s sarcoma-associated h
guccaccauuccuccggugacu

SEQ ID NO: 613666 - RNA, 22 nt, Human herpesvirus 8 [Kaposi`s sarcoma-associated h
uccguggcaguggcagcauguu

SEQ ID NO: 613667 - RNA, 22 nt, Human herpesvirus 8 [Kaposi`s sarcoma-associated h
ggacaucgccguggaccccgga

SEQ ID NO: 613668 - RNA, 22 nt, Human herpesvirus 8 [Kaposi`s sarcoma-associated h
uguccaccggacgaguggcgcg

SEQ ID NO: 613669 - RNA, 22 nt, Human herpesvirus 8 [Kaposi`s sarcoma-associated h
cagcaccagcuucugucggugu

SEQ ID NO: 613670 - RNA, 22 nt, Human herpesvirus 8 [Kaposi`s sarcoma-associated h
auuguaaaagauccgauccuca

SEQ ID NO: 613671 - RNA, 19 nt, Human herpesvirus 8 [Kaposi`s sarcoma-associated h
caaccuaaccuagugcugc

SEQ ID NO: 613672 - RNA, 22 nt, Human herpesvirus 8 [Kaposi`s sarcoma-associated h
caaucacgggaggcuugguggc

SEQ ID NO: 613673 - RNA, 22 nt, Human herpesvirus 8 [Kaposi`s sarcoma-associated h
cacaucagcuuguccugugggg

SEQ ID NO: 613674 - RNA, 22 nt, Human herpesvirus 8 [Kaposi`s sarcoma-associated h
cacccugauaucgacggccucg

SEQ ID NO: 613675 - RNA, 22 nt, Human herpesvirus 8 [Kaposi`s sarcoma-associated h
uggcgcuggaagaaggcugucg

SEQ ID NO: 613676 - RNA, 22 nt, Human herpesvirus 8 [Kaposi`s sarcoma-associated h
uggcugcgcaguccaagggcga

SEQ ID NO: 613677 - RNA, 22 nt, Human herpesvirus 8 [Kaposi`s sarcoma-associated h
cagggggugucuccgucugcuc

SEQ ID NO: 613678 - RNA, 22 nt, Human
ucuguacacuucagcaugcauc

SEQ ID NO: 613679 - RNA, 22 nt, Human
ucaggaaaauacugcuuaucca

SEQ ID NO: 613680 - RNA, 22 nt, Human
gaacuguauaggagcaguguuu

SEQ ID NO: 613681 - RNA, 22 nt, Human
cagggugcuuccguggagcugu

SEQ ID NO: 613682 - RNA, 22 nt, Human
aauacagaggggucacaauuca

SEQ ID NO: 613683 - RNA, 19 nt, Human
uuagggguaugaaguggua

SEQ ID NO: 613684 - RNA, 22 nt, Human
gaacauuuccagaaaggaacua

SEQ ID NO: 613685 - RNA, 22 nt, Human
gaaauucacuguauuucuuggg

SEQ ID NO: 613686 - RNA, 22 nt, Human
ccauggccucgcucuacguggg

SEQ ID NO: 613687 - RNA, 18 nt, Human
agcugcccugggcuggag

SEQ ID NO: 613688 - RNA, 22 nt, Human
ugcagcugacccacuccagucc

SEQ ID NO: 613689 - RNA, 23 nt, Human
cuacaagagcaagcauggacaag

SEQ ID NO: 613690 - RNA, 22 nt, Human
uauauguguggauucuuguaga

SEQ ID NO: 613691 - RNA, 22 nt, Human
cuacagaaaaucagccacaggc

SEQ ID NO: 613692 - RNA, 22 nt, Human
cagcugagaagugauagcugca

SEQ ID NO: 613693 - RNA, 22 nt, Human
ugugccugauggucacguggcc

SEQ ID NO: 613694 - RNA, 22 nt, Human
cagcucccaguggcagcuccuu

SEQ ID NO: 613695 - RNA, 20 nt, Human
ggcaguuaaggcacagucau

SEQ ID NO: 613696 - RNA, 22 nt, Human
aggcagagcuggguuuugaaau

SEQ ID NO: 613697 - RNA, 20 nt, Human
acguggccaccaguggcuua

SEQ ID NO: 613698 - RNA, 21 nt, Human
uccuguaagcuuggguggcuc

SEQ ID NO: 613699 - RNA, 22 nt, Human
ugaguccaccuuaguauauggg

SEQ ID NO: 613700 - RNA, 22 nt, Human
uuucuacauuuguaaccagauu

SEQ ID NO: 613701 - RNA, 22 nt, Human
aagcuggagaguuucacagaug

SEQ ID NO: 613702 - RNA, 22 nt, Human
aaagucaaugauuucuccugga

SEQ ID NO: 613703 - RNA, 19 nt, Human
cucuccagcuccaguagcu

SEQ ID NO: 613704 - RNA, 22 nt, Human
ucauuucucugagucugauaau

SEQ ID NO: 613705 - RNA, 22 nt, Human
acuguacaaauauugcaaaaua

SEQ ID NO: 613706 - RNA, 22 nt, Human
acuaaaaacuacugccaauagc

SEQ ID NO: 613707 - RNA, 22 nt, Human
ggaggcuccuaagcugacuuga

SEQ ID NO: 613708 - RNA, 22 nt, Human
ugugcucuugucugugacuaac

SEQ ID NO: 613709 - RNA, 23 nt, Human
uacagcugcagaaucaggcuaag

SEQ ID NO: 613710 - RNA, 20 nt, Human
acaugaaaggaaacaggaaa

SEQ ID NO: 613711 - RNA, 22 nt, Human
ucuaccacuuauuagcucugug

SEQ ID NO: 613712 - RNA, 22 nt, Human
ccaccaugggaagagagacuaa

SEQ ID NO: 613713 - RNA, 22 nt, Human
ucugcucugggccagcuauuaa

SEQ ID NO: 613714 - RNA, 22 nt, Human
gagauuuccauauuuuguaaca

SEQ ID NO: 613715 - RNA, 22 nt, Human
gagcugccagacaugggaauga

SEQ ID NO: 613716 - RNA, 22 nt, Human
auuucuacaguacacaugcauu

SEQ ID NO: 613717 - RNA, 17 nt, Human
gacaagacagaauucau

SEQ ID NO: 613718 - RNA, 22 nt, Human
agaggugacauaggagaggcuc

SEQ ID NO: 613719 - RNA, 22 nt, Human
ggccuggacaccugaggucuua

SEQ ID NO: 613720 - RNA, 22 nt, Human
uggagguggaguuggaaacuga

SEQ ID NO: 613721 - RNA, 22 nt, Human
guucaaguucauaucucuuaac

SEQ ID NO: 613722 - RNA, 20 nt, Human
gucuccacuggggguuaacc

SEQ ID NO: 613723 - RNA, 22 nt, Human
gcucugugaccuuaggcaaguu

SEQ ID NO: 613724 - RNA, 22 nt, Human
cugugccuucugccuggaacau

SEQ ID NO: 613725 - RNA, 22 nt, Human
uuucuaguucucugccaaaaaa

SEQ ID NO: 613726 - RNA, 22 nt, Human
ccugcccagagccccuuucacu

SEQ ID NO: 613727 - RNA, 22 nt, Human
ucagaaugaaauuucuuucaga

SEQ ID NO: 613728 - RNA, 22 nt, Human
caagggugguauugggagcaua

SEQ ID NO: 613729 - RNA, 22 nt, Human
gaacaaacacaucccagcagug

SEQ ID NO: 613730 - RNA, 21 nt, Human
gcccccuggacuccucaucca

SEQ ID NO: 613731 - RNA, 22 nt, Human
uaggaagcuaugggagauguga

SEQ ID NO: 613732 - RNA, 22 nt, Human
cagccacugaacuccuggcuau

SEQ ID NO: 613733 - RNA, 22 nt, Human
ucuguacauuuguguugugaau

SEQ ID NO: 613734 - RNA, 22 nt, Human
acugugcuaucuacugaauuau

SEQ ID NO: 613735 - RNA, 22 nt, Human
cuccagcuucccucagcugugg

SEQ ID NO: 613736 - RNA, 22 nt, Human
ccuguacaagcucuuggugaca

SEQ ID NO: 613737 - RNA, 22 nt, Human
cucaggagguuuccugucuagg

SEQ ID NO: 613738 - RNA, 22 nt, Human
ccuacacaucucaccucacagg

SEQ ID NO: 613739 - RNA, 22 nt, Human
ugccauggaaguggccagaccu

SEQ ID NO: 613740 - RNA, 22 nt, Human
auggcagaauuaggauuucaag

SEQ ID NO: 613741 - RNA, 22 nt, Human
cagucucugugccagauccugg

SEQ ID NO: 613742 - RNA, 21 nt, Human
ucagcuuugcaacugcacauc

SEQ ID NO: 613743 - RNA, 22 nt, Human
cacuguacuggguugaaggacg

SEQ ID NO: 613744 - RNA, 22 nt, Human
guggaggguuugcaaugugcag

SEQ ID NO: 613745 - RNA, 22 nt, Human
ugaaggaaaugacggcagaaga

SEQ ID NO: 613746 - RNA, 22 nt, Human
cugggguggaggagcuccccug

SEQ ID NO: 613747 - RNA, 22 nt, Human
uucugaaaggcagguuguuugc

SEQ ID NO: 613748 - RNA, 22 nt, Human
cuggagggugagccucaucucu

SEQ ID NO: 613749 - RNA, 22 nt, Human
gguuugguuuuggccaucuucc

SEQ ID NO: 613750 - RNA, 22 nt, Human
uggcuugucauguaucugaggc

SEQ ID NO: 613751 - RNA, 22 nt, Human
ccugucuguccuuugcauucuu

SEQ ID NO: 613752 - RNA, 23 nt, Human
gcuguacaggaaccaguuuggag

SEQ ID NO: 613753 - RNA, 21 nt, Human
acuuugggcacuuuccugccc

SEQ ID NO: 613754 - RNA, 22 nt, Human
ugagcugggaguggugaugagg

SEQ ID NO: 613755 - RNA, 22 nt, Human
gcagcugccaguccccuuccag

SEQ ID NO: 613756 - RNA, 22 nt, Human
cauguacauucuguagauggag

SEQ ID NO: 613757 - RNA, 22 nt, Human
acauuucuuagccuaguuccag

SEQ ID NO: 613758 - RNA, 22 nt, Human
cacuguacagcauuaacaaggc

SEQ ID NO: 613759 - RNA, 22 nt, Human
uguugauuugugggcugcaaaa

SEQ ID NO: 613760 - RNA, 22 nt, Human
cuggcuuuuagugugaagacuu

SEQ ID NO: 613761 - RNA, 22 nt, Human
ugagcuggucacuccuucugaa

SEQ ID NO: 613762 - RNA, 19 nt, Human
ccuguacauuauucucccc

SEQ ID NO: 613763 - RNA, 22 nt, Human
ucagcugcugugguauguacau

SEQ ID NO: 613764 - RNA, 22 nt, Human
cgcccagcugaaaucuccaggc

SEQ ID NO: 613765 - RNA, 22 nt, Human
cagguccuggcaucaggcaggu

SEQ ID NO: 613766 - RNA, 22 nt, Human
cauuucuagacaaguccuggag

SEQ ID NO: 613767 - RNA, 22 nt, Human
aacuguaaagguugagugguaa

SEQ ID NO: 613768 - RNA, 22 nt, Human
acuguacacauucgucaagacu

SEQ ID NO: 613769 - RNA, 22 nt, Human
uucugucugauggugccagaac

SEQ ID NO: 613770 - RNA, 22 nt, Human
gcugcccugcaucugugccuuc

SEQ ID NO: 613771 - RNA, 21 nt, Human
uagggcaggcauuggaagaga

SEQ ID NO: 613772 - RNA, 22 nt, Human
uuucuccaauguaucagcacac

SEQ ID NO: 613773 - RNA, 22 nt, Human
uaaacaagcugucugauauucu

SEQ ID NO: 613774 - RNA, 22 nt, Human
gacaagacaugugaugacauca

SEQ ID NO: 613775 - RNA, 22 nt, Human
ucaggagauguaaccuuagcug

SEQ ID NO: 613776 - RNA, 22 nt, Human
aguuucuguuaccauauuugac

SEQ ID NO: 613777 - RNA, 19 nt, Human
caaguucuggagauuaggg

SEQ ID NO: 613778 - RNA, 22 nt, Human
ucuccacucugagugccuuuca

SEQ ID NO: 613779 - RNA, 22 nt, Human
caggagacuauggcccaaggcc

SEQ ID NO: 613780 - RNA, 22 nt, Human
ccuguacaagagccaucuggau

SEQ ID NO: 613781 - RNA, 22 nt, Human
uggaaacuaagacuagagagac

SEQ ID NO: 613782 - RNA, 22 nt, Human
acuguacuuuucuuggcuagau

SEQ ID NO: 613783 - RNA, 22 nt, Human
auuguacagaugagguaaguga

SEQ ID NO: 613784 - RNA, 16 nt, Human
gggggugagagagagu

SEQ ID NO: 613785 - RNA, 22 nt, Human
ugugugccagccuacgaggagc

SEQ ID NO: 613786 - RNA, 22 nt, Human
aaaaacugguaacuauucccca

SEQ ID NO: 613787 - RNA, 22 nt, Human
aacaacuugcguucagagaugu

SEQ ID NO: 613788 - RNA, 22 nt, Human
uucuucauggguucuuuuagga

SEQ ID NO: 613789 - RNA, 22 nt, Human
cugcucuaacugcauuaguuuu

SEQ ID NO: 613790 - RNA, 22 nt, Human
aauguuacgaucaacaacacau

SEQ ID NO: 613791 - RNA, 20 nt, Human
agcugcccuuuucacauguu

SEQ ID NO: 613792 - RNA, 22 nt, Human
uuucuauuggcgucacuguugu

SEQ ID NO: 613793 - RNA, 22 nt, Human
cugagagaaacaugacucagga

SEQ ID NO: 613794 - RNA, 22 nt, Human
ggcagaggaaggaugaauucac

SEQ ID NO: 613795 - RNA, 22 nt, Human
cugcccacaguucucugccaug

SEQ ID NO: 613796 - RNA, 22 nt, Human
uucucuugugccaaguuguugc

SEQ ID NO: 613797 - RNA, 21 nt, Human
uuuaggaaguuuaaggcaggu

SEQ ID NO: 613798 - RNA, 22 nt, Human
ucagucuccuuuccucuagaca

SEQ ID NO: 613799 - RNA, 22 nt, Human
ucaugaaaauagaucagaaauu

SEQ ID NO: 613800 - RNA, 21 nt, Human
agaauucuuaaguauucuaau

SEQ ID NO: 613801 - RNA, 22 nt, Human
aucuggaaaacacaguguagac

SEQ ID NO: 613802 - RNA, 22 nt, Human
ccuguacacaauuccgaggaua

SEQ ID NO: 613803 - RNA, 22 nt, Human
ggggugagaucaaggaagcccu

SEQ ID NO: 613804 - RNA, 22 nt, Human
cuccagcugccaccagauguuu

SEQ ID NO: 613805 - RNA, 22 nt, Human
gugcccaggggccagcugccgg

SEQ ID NO: 613806 - RNA, 19 nt, Human
acugugcucgggaaccacu

SEQ ID NO: 613807 - RNA, 23 nt, Human
acagcugcaccuggccgccuggc

SEQ ID NO: 613808 - RNA, 20 nt, Human
cugcugcccugucagccucu

SEQ ID NO: 613809 - RNA, 22 nt, Human
gauuaagagaaguuucuuaucg

SEQ ID NO: 613810 - RNA, 22 nt, Human
acauuucucauucuccccuaac

SEQ ID NO: 613811 - RNA, 22 nt, Human
ugcucuaagaacucuaggaauu

SEQ ID NO: 613812 - RNA, 22 nt, Human
guuauauauaguauuucucuga

SEQ ID NO: 613813 - RNA, 22 nt, Human
gacaaaacacauuaguuuaaaa

SEQ ID NO: 613814 - RNA, 22 nt, Human
aacaugaaacccaaacagaaua

SEQ ID NO: 613815 - RNA, 22 nt, Human
gcagcugcaauaggcaucaagc

SEQ ID NO: 613816 - RNA, 19 nt, Human
ugaaacaaacuuaaaagga

SEQ ID NO: 613817 - RNA, 18 nt, Human
aacaguuuccagauucuc

SEQ ID NO: 613818 - RNA, 22 nt, Human
gaggaaaauauucagggagguu

SEQ ID NO: 613819 - RNA, 22 nt, Human
acagacaaguaguucagacaag

SEQ ID NO: 613820 - RNA, 22 nt, Human
acaaaaagcuccauuacugucc

SEQ ID NO: 613821 - RNA, 17 nt, Human
gacagcugguuccuggc

SEQ ID NO: 613822 - RNA, 22 nt, Human
caaaguucucggcucaaguccu

SEQ ID NO: 613823 - RNA, 22 nt, Human
acagaacugcaggaggaaaagc

SEQ ID NO: 613824 - RNA, 22 nt, Human
uuucuauugaucuaauaaacau

SEQ ID NO: 613825 - RNA, 22 nt, Human
ugaaacaaaccaguaauuuugu

SEQ ID NO: 613826 - RNA, 23 nt, Human
ucuguacacaucagcaucuccca

SEQ ID NO: 613827 - RNA, 22 nt, Human
acauuucugcauguaggguaau

SEQ ID NO: 613828 - RNA, 21 nt, Human
ccugucuuggacugaggcacc

SEQ ID NO: 613829 - RNA, 22 nt, Human
gaaaucuuuauggaaauaacaa

SEQ ID NO: 613830 - RNA, 22 nt, Human
ggaagaaagcacacaaacuuga

SEQ ID NO: 613831 - RNA, 22 nt, Human
aaugcaguuucauuuguagaau

SEQ ID NO: 613832 - RNA, 22 nt, Human
aauguacaaaccuucuuuguag

SEQ ID NO: 613833 - RNA, 22 nt, Human
agugcaauguguacagaaaaau

SEQ ID NO: 613834 - RNA, 22 nt, Human
gggcaggaugcaguuucagaga

SEQ ID NO: 613835 - RNA, 22 nt, Human
gacaagacaccucucuccaucc

SEQ ID NO: 613836 - RNA, 22 nt, Human
uaaggaaaguacauguuuugac

SEQ ID NO: 613837 - RNA, 22 nt, Human
cugcugcugcuaucuacccagg

SEQ ID NO: 613838 - RNA, 22 nt, Human
aagaaacugaaaguggcuucau

SEQ ID NO: 613839 - RNA, 22 nt, Human
ucagucuucccuccagugcaac

SEQ ID NO: 613840 - RNA, 22 nt, Human
gguucaguuuacauuaaaaucu

SEQ ID NO: 613841 - RNA, 22 nt, Human
cuacagcagagcuacacuaacu

SEQ ID NO: 613842 - RNA, 22 nt, Human
aaagacugggacugcagcaggc

SEQ ID NO: 613843 - RNA, 22 nt, Human
gaaacuuuuaaaccucaugagu

SEQ ID NO: 613844 - RNA, 22 nt, Human
cugcucuguuucuuagcugggu

SEQ ID NO: 613845 - RNA, 22 nt, Human
cucuggggaagcagccagcugg

SEQ ID NO: 613846 - RNA, 22 nt, Human
ugugccuacugauagagccaag

SEQ ID NO: 613847 - RNA, 22 nt, Human
ggagugacucacagcugggaca

SEQ ID NO: 613848 - RNA, 23 nt, Human
uuuuccagaaucgacucuguaga

SEQ ID NO: 613849 - RNA, 22 nt, Human
auacaagaucacuccagaaaau

SEQ ID NO: 613850 - RNA, 22 nt, Human
ucuuuugagggccagaggaaga

SEQ ID NO: 613851 - RNA, 22 nt, Human
ggggcagcucccgagggcagga

SEQ ID NO: 613852 - RNA, 22 nt, Human
acauuucuuuucaucucuauau

SEQ ID NO: 613853 - RNA, 21 nt, Human
ugcaccugugccccauccuuc

SEQ ID NO: 613854 - RNA, 22 nt, Human
acuguacacgugucauuuacag

SEQ ID NO: 613855 - RNA, 22 nt, Human
acuuuuuuauaaggaagaagau

SEQ ID NO: 613856 - RNA, 22 nt, Human
agcuuuuaguacguuaaaauug

SEQ ID NO: 613857 - RNA, 22 nt, Human
guccaagagucaagaagggggc

SEQ ID NO: 613858 - RNA, 22 nt, Human
agcagcugagccccagcuguga

SEQ ID NO: 613859 - RNA, 22 nt, Human
uguaaguaguaauggaaggaca

SEQ ID NO: 613860 - RNA, 19 nt, Human
ccuggcccugcugcgcggg

SEQ ID NO: 613861 - RNA, 22 nt, Human
uuccagcuaacucacaucccuu

SEQ ID NO: 613862 - RNA, 21 nt, Human
ucuguacaucauugagucccc

SEQ ID NO: 613863 - RNA, 22 nt, Human
uugggguguuggauggagcaag

SEQ ID NO: 613864 - RNA, 22 nt, Human
ugagcuggaaucuucuugacug

SEQ ID NO: 613865 - RNA, 22 nt, Human
gcagaggccaucaacuuugcca

SEQ ID NO: 613866 - RNA, 22 nt, Human
ucauuucuccgaccugcugucc

SEQ ID NO: 613867 - RNA, 22 nt, Human
gccagcccauuaaccccugucc

SEQ ID NO: 613868 - RNA, 22 nt, Human
caguccuggggaccaggcugag

SEQ ID NO: 613869 - RNA, 22 nt, Human
ucugucuuugagaucucagccu

SEQ ID NO: 613870 - RNA, 22 nt, Human
acuuugcugcagguuuaaagag

SEQ ID NO: 613871 - RNA, 22 nt, Human
cugucuuuucauacuuucccuc

SEQ ID NO: 613872 - RNA, 22 nt, Human
aggaccugagaguuggaaaucc

SEQ ID NO: 613873 - RNA, 23 nt, Human
aggagaagagauuuccacaugca

SEQ ID NO: 613874 - RNA, 22 nt, Human
aggcugugacagggucauggag

SEQ ID NO: 613875 - RNA, 22 nt, Human
gacaagacagcuugcagacaac

SEQ ID NO: 613876 - RNA, 22 nt, Human
uggccugguccuugucaaggca

SEQ ID NO: 613877 - RNA, 22 nt, Human
aacacuguacuggaagauggac

SEQ ID NO: 613878 - RNA, 22 nt, Human
uauugaaauccauuacguucuu

SEQ ID NO: 613879 - RNA, 22 nt, Human
agccccacacucucucugagaa

SEQ ID NO: 613880 - RNA, 22 nt, Human
gcccacucuggagccuguuccc

SEQ ID NO: 613881 - RNA, 22 nt, Human
uucaggagaaaguucaguacuu

SEQ ID NO: 613882 - RNA, 22 nt, Human
uagcugccaaaagggugggcua

SEQ ID NO: 613883 - RNA, 22 nt, Human
aggcgguggccaaggagcggga

SEQ ID NO: 613884 - RNA, 22 nt, Human
ugcacaucuuucagcaucauac

SEQ ID NO: 613885 - RNA, 22 nt, Human
ugggaagggagaguguccugga

SEQ ID NO: 613886 - RNA, 22 nt, Human
caauaguaaauuacggaggaga

SEQ ID NO: 613887 - RNA, 22 nt, Human
cucuccagaucugcugagccag

SEQ ID NO: 613888 - RNA, 22 nt, Human
ugugugggcgaagacagccuuu

SEQ ID NO: 613889 - RNA, 22 nt, Human
ugguggccgaagcccucucuca

SEQ ID NO: 613890 - RNA, 22 nt, Human
auguaacaaaugguauacaugu

SEQ ID NO: 613891 - RNA, 22 nt, Human
aacuguaauuuuuacauaguaa

SEQ ID NO: 613892 - RNA, 22 nt, Human
uucuacuuuagcaugcucauuc

SEQ ID NO: 613893 - RNA, 22 nt, Human
gcuuuaaaccucuacucugucc

SEQ ID NO: 613894 - RNA, 22 nt, Human
auggcagagggauugaacagcu

SEQ ID NO: 613895 - RNA, 22 nt, Human
auuaaacaauguaaaguucuug

SEQ ID NO: 613896 - RNA, 23 nt, Human
uggcuccaugaaaauuacgagga

SEQ ID NO: 613897 - RNA, 20 nt, Human
agggcagagggauuacaggc

SEQ ID NO: 613898 - RNA, 22 nt, Human
acauuucuaauuuaauguaaca

SEQ ID NO: 613899 - RNA, 22 nt, Human
ggcagaggugacagugucuuuu

SEQ ID NO: 613900 - RNA, 18 nt, Human
acaguaaagaaaggaauu

SEQ ID NO: 613901 - RNA, 21 nt, Human
auuagaagguauuuagggccu

SEQ ID NO: 613902 - RNA, 22 nt, Human
ucuauuugcugguugcuucugu

SEQ ID NO: 613903 - RNA, 22 nt, Human
gugcccaguugaggccaggacu

SEQ ID NO: 613904 - RNA, 22 nt, Human
acuauacauugaauguuaaggu

SEQ ID NO: 613905 - RNA, 20 nt, Human
auucuacaagaauaagcaug

SEQ ID NO: 613906 - RNA, 22 nt, Human
acucucugucuaaaugcaguuu

SEQ ID NO: 613907 - RNA, 22 nt, Human
gugcaccagucacaugggcaga

SEQ ID NO: 613908 - RNA, 22 nt, Human
acuguucauuuggauuucucug

SEQ ID NO: 613909 - RNA, 22 nt, Human
cagccacugacaggaauggucc

SEQ ID NO: 613910 - RNA, 22 nt, Human
ggcagcagggucuagauugaug

SEQ ID NO: 613911 - RNA, 22 nt, Human
cuggcccccacaccugucaggg

SEQ ID NO: 613912 - RNA, 22 nt, Human
gcugcuguguuggccacugcuu

SEQ ID NO: 613913 - RNA, 22 nt, Human
aacaugaaaaccuccacagcaa

SEQ ID NO: 613914 - RNA, 22 nt, Human
aauaagaauuuacuugucaaga

SEQ ID NO: 613915 - RNA, 22 nt, Human
acucucugggcaugccccacca

SEQ ID NO: 613916 - RNA, 22 nt, Human
aaauguucuacuuugauaauua

SEQ ID NO: 613917 - RNA, 22 nt, Human
caguuuuauacacugcagcucc

SEQ ID NO: 613918 - RNA, 22 nt, Human
uucuaauuguguuugcauaucu

SEQ ID NO: 613919 - RNA, 22 nt, Human
ggcagaggaggggugaauuugc

SEQ ID NO: 613920 - RNA, 22 nt, Human
ggcagugaacagaaaugcagaa

SEQ ID NO: 613921 - RNA, 22 nt, Human
agggggugcauuugugaaugaa

SEQ ID NO: 613922 - RNA, 22 nt, Human
auugauaucaguuugcugauug

SEQ ID NO: 613923 - RNA, 22 nt, Human
guuagguagaaguuuacuuuga

SEQ ID NO: 613924 - RNA, 22 nt, Human
cagccacucggccauaaaggcu

SEQ ID NO: 613925 - RNA, 22 nt, Human
gcgguagcucaagcuuguaauc

SEQ ID NO: 613926 - RNA, 22 nt, Human
ggagguggcagagggacauucu

SEQ ID NO: 613927 - RNA, 22 nt, Human
aagacuguacauuuuccagucu

SEQ ID NO: 613928 - RNA, 22 nt, Human
uccucacauggugagccacaca

SEQ ID NO: 613929 - RNA, 22 nt, Human
aggagguggcugaacuugaggg

SEQ ID NO: 613930 - RNA, 22 nt, Human
cucaggaggugguagaggcccu

SEQ ID NO: 613931 - RNA, 22 nt, Human
cagcugaguuacucugaggucu

SEQ ID NO: 613932 - RNA, 22 nt, Human
acugucugcuggccccugguua

SEQ ID NO: 613933 - RNA, 22 nt, Human
aauaacaggcucaucagaugcu

SEQ ID NO: 613934 - RNA, 22 nt, Human
uucuggaaguguuagaaucugg

SEQ ID NO: 613935 - RNA, 22 nt, Human
cuggagggaggaggcugcuauu

SEQ ID NO: 613936 - RNA, 22 nt, Human
uccaucuguuuacuauaaagau

SEQ ID NO: 613937 - RNA, 22 nt, Human
cugugccugccuuguucacuga

SEQ ID NO: 613938 - RNA, 22 nt, Human
ggccaggagcaagccaggcucu

SEQ ID NO: 613939 - RNA, 22 nt, Human
auaauacaugguugaucuuuuc

SEQ ID NO: 613940 - RNA, 22 nt, Human
ugacaggaugaugagcaggggg

SEQ ID NO: 613941 - RNA, 18 nt, Human
ccugucugggguccccac

SEQ ID NO: 613942 - RNA, 21 nt, Human
ggaagcuguguccaugcuccu

SEQ ID NO: 613943 - RNA, 22 nt, Human
aucuggggagguaucuguaguc

SEQ ID NO: 613944 - RNA, 22 nt, Human
caguucuaauuaauaggaguaa

SEQ ID NO: 613945 - RNA, 22 nt, Human
acauuucuuccacaugcugcug

SEQ ID NO: 613946 - RNA, 22 nt, Human
gauuaagauuacauauuuaagu

SEQ ID NO: 613947 - RNA, 22 nt, Human
uaauccaaaacugaaucugugg

SEQ ID NO: 613948 - RNA, 17 nt, Human
aucuggaagcuagcuga

SEQ ID NO: 613949 - RNA, 22 nt, Human
cugcccugcuugaugacagcga

SEQ ID NO: 613950 - RNA, 22 nt, Human
ugggaaugugagcauucauuca

SEQ ID NO: 613951 - RNA, 22 nt, Human
agguggaguuaagugugaacug

SEQ ID NO: 613952 - RNA, 22 nt, Human
aagcuuuaaggaauuuuaugga

SEQ ID NO: 613953 - RNA, 22 nt, Human
aggaggugcuguuuguccugga

SEQ ID NO: 613954 - RNA, 22 nt, Human
aggcaagaacagacaugggagu

SEQ ID NO: 613955 - RNA, 22 nt, Human
acauuucuucccuuuagcagaa

SEQ ID NO: 613956 - RNA, 22 nt, Human
cuggccccaucuggagucugag

SEQ ID NO: 613957 - RNA, 22 nt, Human
ucuguacaguaccagauaguaa

SEQ ID NO: 613958 - RNA, 22 nt, Human
cuguaaaacugcuuaaguaugc

SEQ ID NO: 613959 - RNA, 22 nt, Human
ccagcuccugggucuuagucag

SEQ ID NO: 613960 - RNA, 17 nt, Human
ccugucuuguuucugcc

SEQ ID NO: 613961 - RNA, 22 nt, Human
ccagucuggcaggagggggaac

SEQ ID NO: 613962 - RNA, 22 nt, Human
gcucugugguggggcagaguuu

SEQ ID NO: 613963 - RNA, 23 nt, Human
uugcuuagagaccuccucaucag

SEQ ID NO: 613964 - RNA, 22 nt, Human
acugcagacucuacaguuauaa

SEQ ID NO: 613965 - RNA, 22 nt, Human
agcugcccagauaggaggaggc

SEQ ID NO: 613966 - RNA, 22 nt, Human
uggccugggugcugcugacauc

SEQ ID NO: 613967 - RNA, 22 nt, Human
gaaagacauaguugcaagaugg

SEQ ID NO: 613968 - RNA, 22 nt, Human
aggcagagagcaguggccgucu

SEQ ID NO: 613969 - RNA, 22 nt, Human
ccugucuggccuuccacggggg

SEQ ID NO: 613970 - RNA, 22 nt, Human
aaaaacuguaauuacuuuugca

SEQ ID NO: 613971 - RNA, 19 nt, Human
ggugugccaaaugggaaug

SEQ ID NO: 613972 - RNA, 22 nt, Human
aucuggggucagacagcccugg

SEQ ID NO: 613973 - RNA, 22 nt, Human
ucugaaaugcaaauuugacuga

SEQ ID NO: 613974 - RNA, 22 nt, Human
ggagagcugguagcuggcucca

SEQ ID NO: 613975 - RNA, 22 nt, Human
ugcccagcacccagcaugaugc

SEQ ID NO: 613976 - RNA, 22 nt, Human
gaagggugugauuugccugaga

SEQ ID NO: 613977 - RNA, 22 nt, Human
uucuacacucacccagcuguaa

SEQ ID NO: 613978 - RNA, 23 nt, Human
uucuuauuuacuuuggaaucucc

SEQ ID NO: 613979 - RNA, 20 nt, Human
aggcagagcgcacuuuuaga

SEQ ID NO: 613980 - RNA, 22 nt, Human
gcucucuguuauuaagaucuuu

SEQ ID NO: 613981 - RNA, 22 nt, Human
uggccagcccuucagccaugcc

SEQ ID NO: 613982 - RNA, 22 nt, Human
agaacugguggugaucaguuau

SEQ ID NO: 613983 - RNA, 22 nt, Human
acagguccuuauaagagcacuc

SEQ ID NO: 613984 - RNA, 22 nt, Human
uccagcuggggacaugggcuuc

SEQ ID NO: 613985 - RNA, 22 nt, Human
aagacugugucuauggcuacuc

SEQ ID NO: 613986 - RNA, 22 nt, Human
aggcugugauuccaccacucuc

SEQ ID NO: 613987 - RNA, 22 nt, Human
cugccuggaugaauggcgccuu

SEQ ID NO: 613988 - RNA, 22 nt, Human
ucugcucugagagggccaucag

SEQ ID NO: 613989 - RNA, 22 nt, Human
cuggaggggccauccacagucu

SEQ ID NO: 613990 - RNA, 22 nt, Human
acagucugcauaugaccuguag

SEQ ID NO: 613991 - RNA, 18 nt, Human
gacagcuguccugagccc

SEQ ID NO: 613992 - RNA, 22 nt, Human
uccauauuaacuaaaacuagaa

SEQ ID NO: 613993 - RNA, 22 nt, Human
acagcuccuacugaagccaugu

SEQ ID NO: 613994 - RNA, 22 nt, Human
uuuccacugggcacggggccag

SEQ ID NO: 613995 - RNA, 22 nt, Human
ugucucaucucuuaaccccacu

SEQ ID NO: 613996 - RNA, 22 nt, Human
caguuuuauugguugaaaucug

SEQ ID NO: 613997 - RNA, 22 nt, Human
uggccuggaaccuggcagggac

SEQ ID NO: 613998 - RNA, 22 nt, Human
ucuuuuaucuguuguguaacaa

SEQ ID NO: 613999 - RNA, 22 nt, Human
aaacuguaagagaauaaacuac

SEQ ID NO: 614000 - RNA, 22 nt, Human
cugcagccucaaccuccugagc

SEQ ID NO: 614001 - RNA, 22 nt, Human
augggcagacagggagcucacg

SEQ ID NO: 614002 - RNA, 22 nt, Human
ucugccgugcgaggucccacca

SEQ ID NO: 614003 - RNA, 22 nt, Human
caaggcagaauucagacucagg

SEQ ID NO: 614004 - RNA, 22 nt, Human
cuggagggacaagguaugcauu

SEQ ID NO: 614005 - RNA, 22 nt, Human
gccagccccuuagggcucuccc

SEQ ID NO: 614006 - RNA, 22 nt, Human
agaggaaaaugaguuccagaau

SEQ ID NO: 614007 - RNA, 22 nt, Human
acaguccuguacaggccauauc

SEQ ID NO: 614008 - RNA, 22 nt, Human
cugggguggugcaggccucaug

SEQ ID NO: 614009 - RNA, 22 nt, Human
uucuaguuaaaguauguauuag

SEQ ID NO: 614010 - RNA, 22 nt, Human
gugcaaugugcuucgugccaug

SEQ ID NO: 614011 - RNA, 22 nt, Human
gcucucuggcuaguccaucggg

SEQ ID NO: 614012 - RNA, 22 nt, Human
gagaggauccacaaaccaggaa

SEQ ID NO: 614013 - RNA, 22 nt, Human
aacuguaagacaaaugacuucu

SEQ ID NO: 614014 - RNA, 22 nt, Human
ugagggguaaguaaaggaauug

SEQ ID NO: 614015 - RNA, 22 nt, Human
ccugcucugguuuagucagucu

SEQ ID NO: 614016 - RNA, 22 nt, Human
aacaguuuggguagguauguag

SEQ ID NO: 614017 - RNA, 22 nt, Human
cagcccuccuuucacucccagg

SEQ ID NO: 614018 - RNA, 22 nt, Human
cucugcaggcacccaggguggg

SEQ ID NO: 614019 - RNA, 22 nt, Human
cuguuauuuagaacauggaauc

SEQ ID NO: 614020 - RNA, 22 nt, Human
cugcccugagucaugccagaug

SEQ ID NO: 614021 - RNA, 22 nt, Human
aauucuauaggcaagcuauuuu

SEQ ID NO: 614022 - RNA, 20 nt, Human
aacacugugcgugguaggug

SEQ ID NO: 614023 - RNA, 22 nt, Human
ucccagcacgucugcuguuucu

SEQ ID NO: 614024 - RNA, 22 nt, Human
ugcucagugagucugugacagg

SEQ ID NO: 614025 - RNA, 22 nt, Human
aacaaguaaguuuauauauauu

SEQ ID NO: 614026 - RNA, 22 nt, Human
uaaaaaguagugagaauggcgc

SEQ ID NO: 614027 - RNA, 22 nt, Human
aacuguucuucauuuucaguau

SEQ ID NO: 614028 - RNA, 20 nt, Human
acagcagauaccacaacuau

SEQ ID NO: 614029 - RNA, 21 nt, Human
aucuggaagaacugguaagug

SEQ ID NO: 614030 - RNA, 22 nt, Human
ccuguacuagggucucauugcc

SEQ ID NO: 614031 - RNA, 22 nt, Human
acauuucucuuagaguuggacu

SEQ ID NO: 614032 - RNA, 22 nt, Human
gccagccugugcuuggccaggc

SEQ ID NO: 614033 - RNA, 22 nt, Human
cacaguccagacuccuggaguu

SEQ ID NO: 614034 - RNA, 22 nt, Human
gcaguuuuagagcuuuaagaug

SEQ ID NO: 614035 - RNA, 22 nt, Human
uaggagggcccugaaaauggca

SEQ ID NO: 614036 - RNA, 22 nt, Human
acuuuggguaagccaggugcua

SEQ ID NO: 614037 - RNA, 22 nt, Human
uggagguguauaagguagcuuc

SEQ ID NO: 614038 - RNA, 22 nt, Human
agccaguuuccagauauuaacu

SEQ ID NO: 614039 - RNA, 22 nt, Human
uucugucucccugauguagagc

SEQ ID NO: 614040 - RNA, 22 nt, Human
aacauuucagcaaauaagaaca

SEQ ID NO: 614041 - RNA, 22 nt, Human
caguuuuagcuagagcaaacca

SEQ ID NO: 614042 - RNA, 22 nt, Human
uuucuauucuggaucuguggca

SEQ ID NO: 614043 - RNA, 22 nt, Human
accaucuuaguggccagcucuc

SEQ ID NO: 614044 - RNA, 22 nt, Human
gagcugcccugagcuuugcaug

SEQ ID NO: 614045 - RNA, 21 nt, Human
caaguguggauguggaaggua

SEQ ID NO: 614046 - RNA, 22 nt, Human
gaggggugggcuggaaguuaua

SEQ ID NO: 614047 - RNA, 22 nt, Human
gcuggaggauggacuggaagaa

SEQ ID NO: 614048 - RNA, 22 nt, Human
caguuucucucauacauauuug

SEQ ID NO: 614049 - RNA, 22 nt, Human
gcccacuccagcuucucccaca

SEQ ID NO: 614050 - RNA, 22 nt, Human
ucuuuuauuaggcugaaauggg

SEQ ID NO: 614051 - RNA, 22 nt, Human
ccagguggaaggucugugcucu

SEQ ID NO: 614052 - RNA, 22 nt, Human
ugugccugacuaggugaaucaa

SEQ ID NO: 614053 - RNA, 22 nt, Human
acaucacagagcccagauaaag

SEQ ID NO: 614054 - RNA, 22 nt, Human
acauuucucagggaguuuugcu

SEQ ID NO: 614055 - RNA, 22 nt, Human
caguuuuaugucgaauguauac

SEQ ID NO: 614056 - RNA, 22 nt, Human
gcugucugagaacaugguggaa

SEQ ID NO: 614057 - RNA, 22 nt, Human
caauuucuuguuaauucucagg

SEQ ID NO: 614058 - RNA, 22 nt, Human
caaacuguucucugugggauuc

SEQ ID NO: 614059 - RNA, 22 nt, Human
gucuggggguccgggugccugc

SEQ ID NO: 614060 - RNA, 22 nt, Human
ggaggggugcucagcugucacg

SEQ ID NO: 614061 - RNA, 20 nt, Human
cagggacagcaguggguuuu

SEQ ID NO: 614062 - RNA, 22 nt, Human
aagacuguaugagacaauauaa

SEQ ID NO: 614063 - RNA, 22 nt, Human
acuguacaaccucugccccugu

SEQ ID NO: 614064 - RNA, 22 nt, Human
auaaacugaagggaacacugag

SEQ ID NO: 614065 - RNA, 22 nt, Human
acuguccauaauauuggugaac

SEQ ID NO: 614066 - RNA, 17 nt, Human
agcacuaaaaugcuucc

SEQ ID NO: 614067 - RNA, 21 nt, Human
accaucuuccaugcauuauau

SEQ ID NO: 614068 - RNA, 22 nt, Human
aguuucuaacauauagcauugg

SEQ ID NO: 614069 - RNA, 22 nt, Human
aacauuaauuacagucaaacau

SEQ ID NO: 614070 - RNA, 22 nt, Human
ugugccuggaucucugugacaa

SEQ ID NO: 614071 - RNA, 22 nt, Human
gcugucuggcauggcguggcug

SEQ ID NO: 614072 - RNA, 22 nt, Human
cuuuggaacauacugcugagcu

SEQ ID NO: 614073 - RNA, 22 nt, Human
aacaguuugagcuuugaauuuc

SEQ ID NO: 614074 - RNA, 21 nt, Human
uuuauuaacaacuguggacgu

SEQ ID NO: 614075 - RNA, 22 nt, Human
caggcagugucccaggaagcca

SEQ ID NO: 614076 - RNA, 22 nt, Human
caguuuuaaauuuugaaugucu

SEQ ID NO: 614077 - RNA, 22 nt, Human
cuggaaugagcagggcuuaugg

SEQ ID NO: 614078 - RNA, 21 nt, Human
cauuucuauugaugagaaaag

SEQ ID NO: 614079 - RNA, 22 nt, Human
uagcauuucacugaucuucacu

SEQ ID NO: 614080 - RNA, 22 nt, Human
aacaguuugcuuuaagaggcac

SEQ ID NO: 614081 - RNA, 22 nt, Human
gccgugggugucauggcccaua

SEQ ID NO: 614082 - RNA, 22 nt, Human
cugaaacauugcaauaacaaag

SEQ ID NO: 614083 - RNA, 22 nt, Human
gacaagacuauguagaaaguau

SEQ ID NO: 614084 - RNA, 22 nt, Human
cagggugcagagcuaggguagu

SEQ ID NO: 614085 - RNA, 22 nt, Human
uaaagccacuucauucuagucu

SEQ ID NO: 614086 - RNA, 22 nt, Human
ccugaggacacacgcugcagga

SEQ ID NO: 614087 - RNA, 22 nt, Human
aggcagagcuaggaagaauugu

SEQ ID NO: 614088 - RNA, 22 nt, Human
cagaaacuucuggugucaaaua

SEQ ID NO: 614089 - RNA, 22 nt, Human
uguuuuuccaugugcagaacaa

SEQ ID NO: 614090 - RNA, 22 nt, Human
ucuguacaccaggggccauucu

SEQ ID NO: 614091 - RNA, 22 nt, Human
aaaaguuaccucuguaauauaa

SEQ ID NO: 614092 - RNA, 22 nt, Human
uucaggaggugagcaagaaggg

SEQ ID NO: 614093 - RNA, 22 nt, Human
acaagauuuuaugacucuuuuu

SEQ ID NO: 614094 - RNA, 22 nt, Human
aaacuguaaauacuaguaagug

SEQ ID NO: 614095 - RNA, 22 nt, Human
aaacaacuucugcacuaugggu

SEQ ID NO: 614096 - RNA, 22 nt, Human
gaaaaagugaccuugguagcua

SEQ ID NO: 614097 - RNA, 19 nt, Human
acaaacugaguacacuugu

SEQ ID NO: 614098 - RNA, 22 nt, Human
acugaaaaugaauuagaaacag

SEQ ID NO: 614099 - RNA, 22 nt, Human
gaaaguuuucauauauaccaaa

SEQ ID NO: 614100 - RNA, 22 nt, Human
caguccuguguuaaacaagagc

SEQ ID NO: 614101 - RNA, 22 nt, Human
agcugccccaugagaggcaggu

SEQ ID NO: 614102 - RNA, 22 nt, Human
agucucuuggcauucugaaaca

SEQ ID NO: 614103 - RNA, 22 nt, Human
aggaagcugggaaacugacauu

SEQ ID NO: 614104 - RNA, 22 nt, Human
acagucugcuugucuccauggu

SEQ ID NO: 614105 - RNA, 20 nt, Human
aggcaguuagaaggagauga

SEQ ID NO: 614106 - RNA, 20 nt, Human
aagaaacuugaaaguacaag

SEQ ID NO: 614107 - RNA, 22 nt, Human
cagaaacuauguaagaaaguga

SEQ ID NO: 614108 - RNA, 22 nt, Human
cugugacagagcuugagugaga

SEQ ID NO: 614109 - RNA, 22 nt, Human
uaggaagcugagcagcauuccu

SEQ ID NO: 614110 - RNA, 22 nt, Human
acuguacaugcaucuugucuau

SEQ ID NO: 614111 - RNA, 22 nt, Human
gaaaguuugccucucucuugag

SEQ ID NO: 614112 - RNA, 22 nt, Human
gacauaaaccuugagauauuaa

SEQ ID NO: 614113 - RNA, 22 nt, Human
ucaggaaagaguguauccauca

SEQ ID NO: 614114 - RNA, 22 nt, Human
acugauacaucuguggaagugg

SEQ ID NO: 614115 - RNA, 22 nt, Human
acauuucuuugcuagacagcag

SEQ ID NO: 614116 - RNA, 22 nt, Human
acauuucucaucuaguagagua

SEQ ID NO: 614117 - RNA, 22 nt, Human
uacuguacugcaguucugcaaa

SEQ ID NO: 614118 - RNA, 22 nt, Human
ccugcucugccaaguccucuuu

SEQ ID NO: 614119 - RNA, 22 nt, Human
ugcccagcaauaaaccagaaga

SEQ ID NO: 614120 - RNA, 22 nt, Human
acugaguguaggacuuugaguu

SEQ ID NO: 614121 - RNA, 22 nt, Human
aagucaaucacaugcacacuga

SEQ ID NO: 614122 - RNA, 22 nt, Human
cuuggucauuuggggcugcuau

SEQ ID NO: 614123 - RNA, 22 nt, Human
ugaguccaagagccagugggaa

SEQ ID NO: 614124 - RNA, 21 nt, Human
uacaagaccggauucgggccc

SEQ ID NO: 614125 - RNA, 22 nt, Human
cagcccacgucagggccacuca

SEQ ID NO: 614126 - RNA, 22 nt, Human
cugcucuagguuccugcauaug

SEQ ID NO: 614127 - RNA, 22 nt, Human
gagaaaauagcauguguaguau

SEQ ID NO: 614128 - RNA, 22 nt, Human
aaaagcucuuucugcuguagau

SEQ ID NO: 614129 - RNA, 22 nt, Human
gcuguacaaauuccacaagaga

SEQ ID NO: 614130 - RNA, 22 nt, Human
aaacuagagcaugugaguggga

SEQ ID NO: 614131 - RNA, 22 nt, Human
ccacugagaccuuuuggaggag

SEQ ID NO: 614132 - RNA, 22 nt, Human
uacuguacauuccguuuguugc

SEQ ID NO: 614133 - RNA, 22 nt, Human
ucauuucuaucuaugcagcuuc

SEQ ID NO: 614134 - RNA, 22 nt, Human
aagagcugugggugguaguccu

SEQ ID NO: 614135 - RNA, 22 nt, Human
cugucgccugguccucucugga

SEQ ID NO: 614136 - RNA, 22 nt, Human
uucuaguuuugccuuaucaaca

SEQ ID NO: 614137 - RNA, 22 nt, Human
acauuucuccuugcaggaguca

SEQ ID NO: 614138 - RNA, 19 nt, Human
cucucagccugucuccuug

SEQ ID NO: 614139 - RNA, 22 nt, Human
uuuaggaaguuucagauaggaa

SEQ ID NO: 614140 - RNA, 22 nt, Human
uggcucugggcaccguguccac

SEQ ID NO: 614141 - RNA, 22 nt, Human
aggaggugacagccugcaucug

SEQ ID NO: 614142 - RNA, 22 nt, Human
uggcacauagcagguacucagu

SEQ ID NO: 614143 - RNA, 22 nt, Human
aaacaguauuaucaauauauuu

SEQ ID NO: 614144 - RNA, 22 nt, Human
acauaaaggugacuaacaucuu

SEQ ID NO: 614145 - RNA, 22 nt, Human
guaggggugcugagaucuggaa

SEQ ID NO: 614146 - RNA, 22 nt, Human
ccugaggaccagcacccaucug

SEQ ID NO: 614147 - RNA, 22 nt, Human
aaaaacugcaauuacuuuuguc

SEQ ID NO: 614148 - RNA, 22 nt, Human
aacaguuuaugagauaugcuau

SEQ ID NO: 614149 - RNA, 16 nt, Human
aggcagagauuuaccc

SEQ ID NO: 614150 - RNA, 22 nt, Human
aaggcaggaugggaaaagauuu

SEQ ID NO: 614151 - RNA, 22 nt, Human
aaaacuguaucuucuugggacu

SEQ ID NO: 614152 - RNA, 22 nt, Human
ucugucugagggagugacauuu

SEQ ID NO: 614153 - RNA, 22 nt, Human
gcugucuguucgagcguguguu

SEQ ID NO: 614154 - RNA, 22 nt, Human
ucugaaaugcaggcaauuugcu

SEQ ID NO: 614155 - RNA, 22 nt, Human
gaacauuuaugaugcaauaccu

SEQ ID NO: 614156 - RNA, 18 nt, Human
gugggguguugugaggau

SEQ ID NO: 614157 - RNA, 22 nt, Human
aggacagcauaugggaaccagu

SEQ ID NO: 614158 - RNA, 22 nt, Human
cagcugagcaucacuagucugg

SEQ ID NO: 614159 - RNA, 20 nt, Human
gaggaaaagcugccaggccu

SEQ ID NO: 614160 - RNA, 22 nt, Human
aggagguguagauuuccuguca

SEQ ID NO: 614161 - RNA, 16 nt, Human
uggagguguuucuagu

SEQ ID NO: 614162 - RNA, 22 nt, Human
auuuauuauugugguuacuucu

SEQ ID NO: 614163 - RNA, 19 nt, Human
cuggaaugauagagaccuc

SEQ ID NO: 614164 - RNA, 22 nt, Human
ggccuggagcagagacuaggga

SEQ ID NO: 614165 - RNA, 22 nt, Human
acauuucuaguuguucaucucc

SEQ ID NO: 614166 - RNA, 22 nt, Human
cagggauucagcugaaggaggc

SEQ ID NO: 614167 - RNA, 22 nt, Human
acacuacaaucucagaacuaua

SEQ ID NO: 614168 - RNA, 22 nt, Human
ucucucugaguugagcaggagu

SEQ ID NO: 614169 - RNA, 22 nt, Human
ccuggcuuuuguuuauaaauuc

SEQ ID NO: 614170 - RNA, 22 nt, Human
ccuguacaucugcucucauugc

SEQ ID NO: 614171 - RNA, 22 nt, Human
aggggugaaggcccgauaggag

SEQ ID NO: 614172 - RNA, 22 nt, Human
acauguguggacaugaaucuac

SEQ ID NO: 614173 - RNA, 22 nt, Human
cucaggaggccauucucaaggu

SEQ ID NO: 614174 - RNA, 22 nt, Human
ccuggagggacccuggcccugu

SEQ ID NO: 614175 - RNA, 17 nt, Human
ucugucuugacugucac

SEQ ID NO: 614176 - RNA, 22 nt, Human
ucugcucuguggcuucagcuaa

SEQ ID NO: 614177 - RNA, 22 nt, Human
ccugcccaggagucucucugug

SEQ ID NO: 614178 - RNA, 22 nt, Human
gcuuuaaauggcuugcccaagu

SEQ ID NO: 614179 - RNA, 22 nt, Human
uggagguggggcucaggaaucu

SEQ ID NO: 614180 - RNA, 22 nt, Human
uccagcuggggcaguggcuggg

SEQ ID NO: 614181 - RNA, 22 nt, Human
ucugucacuauuggccagaaca

SEQ ID NO: 614182 - RNA, 22 nt, Human
aguuucuauguaagcuacguga

SEQ ID NO: 614183 - RNA, 20 nt, Human
agcugccccugggcacugcc

SEQ ID NO: 614184 - RNA, 22 nt, Human
auaacagaugugaagugcuaau

SEQ ID NO: 614185 - RNA, 22 nt, Human
cauuuguacagaacagcuuuau

SEQ ID NO: 614186 - RNA, 22 nt, Human
ugugccuguugguguagacaua

SEQ ID NO: 614187 - RNA, 22 nt, Human
gcugcccucucuggccccacac

SEQ ID NO: 614188 - RNA, 22 nt, Human
caggacagcucaacaccuccuc

SEQ ID NO: 614189 - RNA, 22 nt, Human
ugggacaggaggccucuggaga

SEQ ID NO: 614190 - RNA, 22 nt, Human
acuguaaauuuugguugcaggu

SEQ ID NO: 614191 - RNA, 18 nt, Human
guggaggguucucagaau

SEQ ID NO: 614192 - RNA, 22 nt, Human
ucccuagucgcaucuguggaga

SEQ ID NO: 614193 - RNA, 22 nt, Human
cuggccugugggcugucuccgg

SEQ ID NO: 614194 - RNA, 22 nt, Human
agcugccccucauuuucaccac

SEQ ID NO: 614195 - RNA, 22 nt, Human
gcuuuuauugucuuuacgacga

SEQ ID NO: 614196 - RNA, 22 nt, Human
ucugucacccaggcuggagugc

SEQ ID NO: 614197 - RNA, 22 nt, Human
gaaauugucagcuucuuucagu

SEQ ID NO: 614198 - RNA, 22 nt, Human
gaggaaaauaacaacuaagggc

SEQ ID NO: 614199 - RNA, 22 nt, Human
uacaggaagcacucaagaaaug

SEQ ID NO: 614200 - RNA, 22 nt, Human
uuucuacaguacugauuucaua

SEQ ID NO: 614201 - RNA, 22 nt, Human
aauacagauauucagugguacu

SEQ ID NO: 614202 - RNA, 22 nt, Human
aggcagaggagaaugaucuucc

SEQ ID NO: 614203 - RNA, 22 nt, Human
aaaauccacaacgcucauuuca

SEQ ID NO: 614204 - RNA, 22 nt, Human
agggaaauuaaugugagcaaug

SEQ ID NO: 614205 - RNA, 22 nt, Human
ggaaacagagggcaccugagcc

SEQ ID NO: 614206 - RNA, 22 nt, Human
uagggguggagcuaagaguccc

SEQ ID NO: 614207 - RNA, 22 nt, Human
cccacguugaaccgcuuacaga

SEQ ID NO: 614208 - RNA, 23 nt, Human
aaauauucuuuuuuaguaagugc

SEQ ID NO: 614209 - RNA, 19 nt, Human
aggcugugagggaggacuc

SEQ ID NO: 614210 - RNA, 22 nt, Human
aagucaauuaguaaacuuggaa

SEQ ID NO: 614211 - RNA, 22 nt, Human
aaaguuugaaugauauauuagu

SEQ ID NO: 614212 - RNA, 22 nt, Human
aaauauguaagauuagcacuag

SEQ ID NO: 614213 - RNA, 22 nt, Human
uggacaacauagugagaccuca

SEQ ID NO: 614214 - RNA, 22 nt, Human
uggaggagaccauuccacucag

SEQ ID NO: 614215 - RNA, 22 nt, Human
gacaagacauugguaaagauau

SEQ ID NO: 614216 - RNA, 22 nt, Human
ucugaaauguucucuuguuuug

SEQ ID NO: 614217 - RNA, 21 nt, Human
uuuguucaggggcaaaguuaa

SEQ ID NO: 614218 - RNA, 22 nt, Human
aaauguuccauuauuguguaau

SEQ ID NO: 614219 - RNA, 22 nt, Human
agcauaaaggucaacguuuuag

SEQ ID NO: 614220 - RNA, 22 nt, Human
ucugucuuagcaucuuugcuca

SEQ ID NO: 614221 - RNA, 22 nt, Human
agccacugugcaggagcagugu

SEQ ID NO: 614222 - RNA, 22 nt, Human
acuguacauauggauucuaaga

SEQ ID NO: 614223 - RNA, 22 nt, Human
gcugaggauauagcaggaacaa

SEQ ID NO: 614224 - RNA, 22 nt, Human
gugugcacagagcuccaguguu

SEQ ID NO: 614225 - RNA, 22 nt, Human
caguccugagccaaucaugaug

SEQ ID NO: 614226 - RNA, 22 nt, Human
cuacaagauuuuuaaaacugua

SEQ ID NO: 614227 - RNA, 22 nt, Human
uauggaaaguguuuucuucugu

SEQ ID NO: 614228 - RNA, 22 nt, Human
uaacagcucuguguggcuguaa

SEQ ID NO: 614229 - RNA, 22 nt, Human
ugagggguugugagaaauguag

SEQ ID NO: 614230 - RNA, 22 nt, Human
uuuaggaagaucugaaggaaga

SEQ ID NO: 614231 - RNA, 22 nt, Human
agagggguuaagugcuaguccg

SEQ ID NO: 614232 - RNA, 22 nt, Human
uuuccuuugcccaauacauguc

SEQ ID NO: 614233 - RNA, 22 nt, Human
auccacccugugguggcuuucu

SEQ ID NO: 614234 - RNA, 22 nt, Human
cugcccuggccacugugcccag

SEQ ID NO: 614235 - RNA, 22 nt, Human
cagcugaguuuccaagucugcc

SEQ ID NO: 614236 - RNA, 22 nt, Human
uucuaguuuagggcucuucaac

SEQ ID NO: 614237 - RNA, 22 nt, Human
acacuguagcugagggcaugcg

SEQ ID NO: 614238 - RNA, 22 nt, Human
gcucucugaggugcuggcagag

SEQ ID NO: 614239 - RNA, 22 nt, Human
caguauuuucaggauuuggaag

SEQ ID NO: 614240 - RNA, 22 nt, Human
uuccacuuaguggaagggcaug

SEQ ID NO: 614241 - RNA, 23 nt, Human
aagcugccuucgcaguuggucug

SEQ ID NO: 614242 - RNA, 22 nt, Human
uuauuuauucauucugucuguc

SEQ ID NO: 614243 - RNA, 22 nt, Human
gacagcuggcaguggaaaggug

SEQ ID NO: 614244 - RNA, 22 nt, Human
aagaaacuguugcgugacagcg

SEQ ID NO: 614245 - RNA, 18 nt, Human
cugcccagagcauuucau

SEQ ID NO: 614246 - RNA, 22 nt, Human
aagccacucacaauaacugucc

SEQ ID NO: 614247 - RNA, 22 nt, Human
auguuacaauucaaaaugcugc

SEQ ID NO: 614248 - RNA, 22 nt, Human
caguuccuaugggcaaaacaca

SEQ ID NO: 614249 - RNA, 22 nt, Human
cagccacucucagacaguccca

SEQ ID NO: 614250 - RNA, 22 nt, Human
gcuggcccagugacccacagug

SEQ ID NO: 614251 - RNA, 22 nt, Human
ccuguacacggucuaugccucc

SEQ ID NO: 614252 - RNA, 20 nt, Human
gcccacucuaauccacuguc

SEQ ID NO: 614253 - RNA, 22 nt, Human
uugacaaaggaccuugcuauuu

SEQ ID NO: 614254 - RNA, 22 nt, Human
uucugucuucccacugaggagc

SEQ ID NO: 614255 - RNA, 22 nt, Human
cucaggaggaugacugccuugg

SEQ ID NO: 614256 - RNA, 22 nt, Human
uuuauauagagauuugugcaug

SEQ ID NO: 614257 - RNA, 22 nt, Human
uaggaaaaauacagaauuauau

SEQ ID NO: 614258 - RNA, 22 nt, Human
gcugucugcugugcacugagca

SEQ ID NO: 614259 - RNA, 22 nt, Human
guacaaaaguuauugcgguuuu

SEQ ID NO: 614260 - RNA, 22 nt, Human
uuggccacacucacuagagccc

SEQ ID NO: 614261 - RNA, 22 nt, Human
ugcagcugguaucccauggauu

SEQ ID NO: 614262 - RNA, 22 nt, Human
ucaagucuugaugagacaaacc

SEQ ID NO: 614263 - RNA, 22 nt, Human
uaaacaaggguuacugagcaug

SEQ ID NO: 614264 - RNA, 22 nt, Human
ucugaaaauguugacuuuguuu

SEQ ID NO: 614265 - RNA, 22 nt, Human
aaauaaagguccacuuuagggc

SEQ ID NO: 614266 - RNA, 22 nt, Human
uagcauuucccaaaugcauuug

SEQ ID NO: 614267 - RNA, 22 nt, Human
ccuggcccuggaauagggcagg

SEQ ID NO: 614268 - RNA, 22 nt, Human
gaagccuggagaccagauguug

SEQ ID NO: 614269 - RNA, 22 nt, Human
agcuggccuuagugagcaccug

SEQ ID NO: 614270 - RNA, 22 nt, Human
gggggugaggacaggagcacug

SEQ ID NO: 614271 - RNA, 22 nt, Human
acccucaacaaauucacucuau

SEQ ID NO: 614272 - RNA, 22 nt, Human
uggccugggccugccggugcaa

SEQ ID NO: 614273 - RNA, 22 nt, Human
gcuguacauucuguggguuugg

SEQ ID NO: 614274 - RNA, 22 nt, Human
cuggcucuuuccuagcuaggcu

SEQ ID NO: 614275 - RNA, 22 nt, Human
gcuguacaaggccucugccauc

SEQ ID NO: 614276 - RNA, 22 nt, Human
uggaggugggagggacuguccu

SEQ ID NO: 614277 - RNA, 22 nt, Human
auaaaaaugagggcgguagcua

SEQ ID NO: 614278 - RNA, 22 nt, Human
uuucuaguccucaugcaucauu

SEQ ID NO: 614279 - RNA, 20 nt, Human
ggaagcuguggguccccagg

SEQ ID NO: 614280 - RNA, 22 nt, Human
ggacaggaugcugaagaugaag

SEQ ID NO: 614281 - RNA, 22 nt, Human
uucgaguuggcuuuauuaaacu

SEQ ID NO: 614282 - RNA, 20 nt, Human
uggauucuggagcugcccuc

SEQ ID NO: 614283 - RNA, 22 nt, Human
gcuguacauuuguguacacuug

SEQ ID NO: 614284 - RNA, 22 nt, Human
cuuagaugaagucacagaaccc

SEQ ID NO: 614285 - RNA, 22 nt, Human
uucagucuccucauuuuacaaa

SEQ ID NO: 614286 - RNA, 22 nt, Human
cugagcugagccaaaucugucu

SEQ ID NO: 614287 - RNA, 22 nt, Human
gaggaaaaugcaacaggaaugc

SEQ ID NO: 614288 - RNA, 22 nt, Human
aacaguuuaucaaguuuuuaca

SEQ ID NO: 614289 - RNA, 22 nt, Human
acauuucugcuagaauagguga

SEQ ID NO: 614290 - RNA, 22 nt, Human
cacagcauaaugaaauauacuu

SEQ ID NO: 614291 - RNA, 22 nt, Human
gcucucugcaagucagcagccu

SEQ ID NO: 614292 - RNA, 20 nt, Human
ccugucuggagacaaagaga

SEQ ID NO: 614293 - RNA, 23 nt, Human
ucuguacaauugagaagagaaca

SEQ ID NO: 614294 - RNA, 22 nt, Human
aaacuugauuuagaacuaaggc

SEQ ID NO: 614295 - RNA, 22 nt, Human
aggggugacacauaucagugca

SEQ ID NO: 614296 - RNA, 22 nt, Human
gccuggccgcuccgagcuccgc

SEQ ID NO: 614297 - RNA, 18 nt, Human
cugucuuuuuucucucca

SEQ ID NO: 614298 - RNA, 22 nt, Human
cuacaggucaguaagaccuaga

SEQ ID NO: 614299 - RNA, 22 nt, Human
ucugugcugccauccuguggcc

SEQ ID NO: 614300 - RNA, 22 nt, Human
aaauuuucucucuaagacuuaa

SEQ ID NO: 614301 - RNA, 19 nt, Human
ggccuggcuaucccugcug

SEQ ID NO: 614302 - RNA, 22 nt, Human
aagaauuuuccagcaugucagu

SEQ ID NO: 614303 - RNA, 22 nt, Human
aacauuucuucugaaacugagu

SEQ ID NO: 614304 - RNA, 22 nt, Human
cucugcucaccagccaugugau

SEQ ID NO: 614305 - RNA, 22 nt, Human
cuggaauguagagacagcuuag

SEQ ID NO: 614306 - RNA, 22 nt, Human
uacaaaaaauugauacugacga

SEQ ID NO: 614307 - RNA, 22 nt, Human
uuuacacauaccucuuuaaagu

SEQ ID NO: 614308 - RNA, 22 nt, Human
cuccagucuaguagagccugcu

SEQ ID NO: 614309 - RNA, 23 nt, Human
cauguacacacagcuguacagug

SEQ ID NO: 614310 - RNA, 22 nt, Human
agacucugauucccucauguca

SEQ ID NO: 614311 - RNA, 22 nt, Human
cucccacuccuggcucaccaca

SEQ ID NO: 614312 - RNA, 20 nt, Human
ucauuucuugggguuccaag

SEQ ID NO: 614313 - RNA, 22 nt, Human
auucagaaauagaaaauuugau

SEQ ID NO: 614314 - RNA, 22 nt, Human
ggagggguggucaccuggcagg

SEQ ID NO: 614315 - RNA, 22 nt, Human
auacuguaucacuugugaguga

SEQ ID NO: 614316 - RNA, 22 nt, Human
acauuucugagcagggagcugu

SEQ ID NO: 614317 - RNA, 23 nt, Human
aucaagucaucagcaaaauacau

SEQ ID NO: 614318 - RNA, 22 nt, Human
gacagcugugcaggagaagggg

SEQ ID NO: 614319 - RNA, 22 nt, Human
uggucucugcugcagcuucuca

SEQ ID NO: 614320 - RNA, 18 nt, Human
ucugucuguguugucuuu

SEQ ID NO: 614321 - RNA, 22 nt, Human
uuucuacagguugauggguuug

SEQ ID NO: 614322 - RNA, 22 nt, Human
uauuucuaagcuguaagucuga

SEQ ID NO: 614323 - RNA, 22 nt, Human
cugcugccccugagcucagccu

SEQ ID NO: 614324 - RNA, 22 nt, Human
gccaccucucucuugacucgag

SEQ ID NO: 614325 - RNA, 22 nt, Human
caagucaaagacuagaacuagu

SEQ ID NO: 614326 - RNA, 22 nt, Human
uauccaauucaccauugauggg

SEQ ID NO: 614327 - RNA, 22 nt, Human
ugccgcagugcggggagggccc

SEQ ID NO: 614328 - RNA, 22 nt, Human
aggggugauuugggacaggaca

SEQ ID NO: 614329 - RNA, 22 nt, Human
cuuuggaaaaauaccuggcaua

SEQ ID NO: 614330 - RNA, 22 nt, Human
aggcagagcugauguucuguga

SEQ ID NO: 614331 - RNA, 23 nt, Human
ccacgucugcacuguagcuguug

SEQ ID NO: 614332 - RNA, 22 nt, Human
uggacucuaugaugcgccagca

SEQ ID NO: 614333 - RNA, 22 nt, Human
uugaaaaaauugguagaggaug

SEQ ID NO: 614334 - RNA, 22 nt, Human
cuguacauaaaggaauaggugu

SEQ ID NO: 614335 - RNA, 23 nt, Human
aaaaaaccauguaggcacucagu

SEQ ID NO: 614336 - RNA, 22 nt, Human
cuggccccgguuccuaaaaacc

SEQ ID NO: 614337 - RNA, 20 nt, Human
uuucauugucagaaucuuau

SEQ ID NO: 614338 - RNA, 22 nt, Human
agcugcccaauccugcagggcg

SEQ ID NO: 614339 - RNA, 22 nt, Human
ggaagcugccaguccaccagcu

SEQ ID NO: 614340 - RNA, 22 nt, Human
uacuguacucaacaugugaguu

SEQ ID NO: 614341 - RNA, 22 nt, Human
uccaauaacaucuaaaaacuua

SEQ ID NO: 614342 - RNA, 22 nt, Human
cucaggaguuggaggcuacagu

SEQ ID NO: 614343 - RNA, 22 nt, Human
acuuuggggaacuuuucuccuc

SEQ ID NO: 614344 - RNA, 22 nt, Human
acuuuuaugauaaucaauguuc

SEQ ID NO: 614345 - RNA, 21 nt, Human
uuuauuuauauaggacacaug

SEQ ID NO: 614346 - RNA, 22 nt, Human
cuggagggcugcagcgaggcug

SEQ ID NO: 614347 - RNA, 22 nt, Human
gcuggagggguaauaggauggg

SEQ ID NO: 614348 - RNA, 22 nt, Human
agcugcccagcuaggaagaagg

SEQ ID NO: 614349 - RNA, 22 nt, Human
uuuguucacugagcaaugauua

SEQ ID NO: 614350 - RNA, 22 nt, Human
cugugccuccaaguggucucug

SEQ ID NO: 614351 - RNA, 22 nt, Human
aaaaaccuuucccauacuaaga

SEQ ID NO: 614352 - RNA, 22 nt, Human
ucuaaucuacaaaaggaaauuc

SEQ ID NO: 614353 - RNA, 22 nt, Human
gugcccaguaaaugaaagcuuu

SEQ ID NO: 614354 - RNA, 22 nt, Human
auuuaacaagacagagaacugg

SEQ ID NO: 614355 - RNA, 22 nt, Human
aggagguggccugagcgugccc

SEQ ID NO: 614356 - RNA, 20 nt, Human
aggggugaucgggugacacu

SEQ ID NO: 614357 - RNA, 20 nt, Human
gaaauucucguauuaguuua

SEQ ID NO: 614358 - RNA, 17 nt, Human
ugcagcugcucccaggc

SEQ ID NO: 614359 - RNA, 22 nt, Human
gaagccacagggaaggagaaca

SEQ ID NO: 614360 - RNA, 22 nt, Human
cucuggagggaggcugagcugg

SEQ ID NO: 614361 - RNA, 22 nt, Human
ucagaaauagucuuuaaaauga

SEQ ID NO: 614362 - RNA, 22 nt, Human
gcaggauugggcugaaggagug

SEQ ID NO: 614363 - RNA, 22 nt, Human
aguguuaaugguguauauuagg

SEQ ID NO: 614364 - RNA, 22 nt, Human
uccauuuuagagaugaagaaac

SEQ ID NO: 614365 - RNA, 22 nt, Human
aagccacuuucagcugucucag

SEQ ID NO: 614366 - RNA, 19 nt, Human
agacucugccacucuucuc

SEQ ID NO: 614367 - RNA, 22 nt, Human
ugaaacaaauuuggaaaaucua

SEQ ID NO: 614368 - RNA, 22 nt, Human
uggccuggaaaaaugcagaugg

SEQ ID NO: 614369 - RNA, 21 nt, Human
aagaacuauugagguacacag

SEQ ID NO: 614370 - RNA, 22 nt, Human
cuguacaggucaaugauaagau

SEQ ID NO: 614371 - RNA, 22 nt, Human
aaacagacugaagaguugaagc

SEQ ID NO: 614372 - RNA, 22 nt, Human
gucccacugggcaacuagaaaa

SEQ ID NO: 614373 - RNA, 22 nt, Human
gugcucuccuggcugcccugac

SEQ ID NO: 614374 - RNA, 22 nt, Human
uaggggugaggccaggcaucag

SEQ ID NO: 614375 - RNA, 22 nt, Human
cacuguacccauuuaaauaaau

SEQ ID NO: 614376 - RNA, 22 nt, Human
gaaggcagguuuuucaaaacug

SEQ ID NO: 614377 - RNA, 22 nt, Human
uuuaccauccucuuuuagaauu

SEQ ID NO: 614378 - RNA, 22 nt, Human
uggaggugacggggccucguug

SEQ ID NO: 614379 - RNA, 22 nt, Human
aaguuuuauuggcuauagcacu

SEQ ID NO: 614380 - RNA, 22 nt, Human
auucuacaacccaauaauaauu

SEQ ID NO: 614381 - RNA, 22 nt, Human
uucaaguucauguguagucagu

SEQ ID NO: 614382 - RNA, 22 nt, Human
ugacaaaacugcaauuacuuuu

SEQ ID NO: 614383 - RNA, 22 nt, Human
uccacauucucuguuacagaua

SEQ ID NO: 614384 - RNA, 22 nt, Human
uucuacuuuggacauaaaggac

SEQ ID NO: 614385 - RNA, 22 nt, Human
ccaggcccugcuccucacacca

SEQ ID NO: 614386 - RNA, 22 nt, Human
cuauuuaucuauuucugaauga

SEQ ID NO: 614387 - RNA, 22 nt, Human
aagaagaaguguuauuuuuaga

SEQ ID NO: 614388 - RNA, 22 nt, Human
uucuaguucccacauaguugcc

SEQ ID NO: 614389 - RNA, 22 nt, Human
ggccuggaaggacagcgugaug

SEQ ID NO: 614390 - RNA, 22 nt, Human
aaauguuccuuuggauuaaacu

SEQ ID NO: 614391 - RNA, 22 nt, Human
gcuguacauucugcacaggccc

SEQ ID NO: 614392 - RNA, 22 nt, Human
aagcugccagcugagcugaggc

SEQ ID NO: 614393 - RNA, 22 nt, Human
gcccagcccugaggucacagcu

SEQ ID NO: 614394 - RNA, 22 nt, Human
ggcaggagcucuccaguuugcc

SEQ ID NO: 614395 - RNA, 22 nt, Human
caggacagguguucuagaucag

SEQ ID NO: 614396 - RNA, 22 nt, Human
gacuguacgucauugaaggcca

SEQ ID NO: 614397 - RNA, 22 nt, Human
cuauuacaauucugcaaggagu

SEQ ID NO: 614398 - RNA, 22 nt, Human
cucaggaguaguucagcagcug

SEQ ID NO: 614399 - RNA, 22 nt, Human
auuuuuuagaaccuggccugau

SEQ ID NO: 614400 - RNA, 22 nt, Human
uaagacaauucuucagucacaa

SEQ ID NO: 614401 - RNA, 22 nt, Human
caaaagaagcucuuggggcuag

SEQ ID NO: 614402 - RNA, 22 nt, Human
ucuuauuauuguuguaaaagca

SEQ ID NO: 614403 - RNA, 22 nt, Human
cucaggagacaguguccacaug

SEQ ID NO: 614404 - RNA, 22 nt, Human
aagaaaacguuuugaggaguuu

SEQ ID NO: 614405 - RNA, 22 nt, Human
cuuggucauuucuuguccuguu

SEQ ID NO: 614406 - RNA, 22 nt, Human
ggcagugaaucugagagccugg

SEQ ID NO: 614407 - RNA, 22 nt, Human
agcuguggaagacugucagggu

SEQ ID NO: 614408 - RNA, 22 nt, Human
gcaaaaaccacaauuacuuuua

SEQ ID NO: 614409 - RNA, 23 nt, Human
aagcugccagucugaagccuggg

SEQ ID NO: 614410 - RNA, 22 nt, Human
ugcagcugaugauacccccaug

SEQ ID NO: 614411 - RNA, 22 nt, Human
acuguacacacuucucugucuu

SEQ ID NO: 614412 - RNA, 22 nt, Human
cagcuggcugcaugaugccaaa

SEQ ID NO: 614413 - RNA, 22 nt, Human
aggaagccaugguggacgucua

SEQ ID NO: 614414 - RNA, 22 nt, Human
gcugccaccguggagaugagug

SEQ ID NO: 614415 - RNA, 20 nt, Human
acuuuggggucuuucucaga

SEQ ID NO: 614416 - RNA, 22 nt, Human
gugugccucccauuagggugua

SEQ ID NO: 614417 - RNA, 22 nt, Human
acagaacugagaauucucuauc

SEQ ID NO: 614418 - RNA, 22 nt, Human
gaagaacugugacagaagcagu

SEQ ID NO: 614419 - RNA, 22 nt, Human
caaaaacugcaauuacuuuuac

SEQ ID NO: 614420 - RNA, 22 nt, Human
acuguauaaggcauagguaagc

SEQ ID NO: 614421 - RNA, 22 nt, Human
cacaagacuuauuuguguagaa

SEQ ID NO: 614422 - RNA, 22 nt, Human
caguuuuagggcaaugugaaga

SEQ ID NO: 614423 - RNA, 22 nt, Human
uaaggaaggggaaagacauguc

SEQ ID NO: 614424 - RNA, 22 nt, Human
acauuucucccugcaugccugc

SEQ ID NO: 614425 - RNA, 22 nt, Human
uuaguaauguguuaauaugaau

SEQ ID NO: 614426 - RNA, 22 nt, Human
ucuguaaucaagauauuugaga

SEQ ID NO: 614427 - RNA, 22 nt, Human
gcaaaaaccacaauuacuuuug

SEQ ID NO: 614428 - RNA, 22 nt, Human
cccugcagccuugcaugccuuc

SEQ ID NO: 614429 - RNA, 22 nt, Human
uuuguucaugccuauauucuca

SEQ ID NO: 614430 - RNA, 22 nt, Human
acagauccugguuacagccauu

SEQ ID NO: 614431 - RNA, 22 nt, Human
auagcagaaaccaagcuucuuc

SEQ ID NO: 614432 - RNA, 22 nt, Human
caugaaaaauuuacuguuaaca

SEQ ID NO: 614433 - RNA, 22 nt, Human
cucucugggguuccagacgugg

SEQ ID NO: 614434 - RNA, 22 nt, Human
ugagacaguucugcagcugggu

SEQ ID NO: 614435 - RNA, 22 nt, Human
caguuuuaggacauguggaugu

SEQ ID NO: 614436 - RNA, 22 nt, Human
ccaguucugacacaagcacagu

SEQ ID NO: 614437 - RNA, 22 nt, Human
uaaucacagaaacagacuguuu

SEQ ID NO: 614438 - RNA, 22 nt, Human
aacuguaaugaauuguucauga

SEQ ID NO: 614439 - RNA, 22 nt, Human
cugagcugguucucuugugaaa

SEQ ID NO: 614440 - RNA, 22 nt, Human
uuuuucugccauucaaagagga

SEQ ID NO: 614441 - RNA, 22 nt, Human
uacaagacgagggaaguucuuu

SEQ ID NO: 614442 - RNA, 19 nt, Human
gcuuuaguuuacucaucua

SEQ ID NO: 614443 - RNA, 22 nt, Human
cauuucuaagaaggcugcacau

SEQ ID NO: 614444 - RNA, 22 nt, Human
ugcccagcugucaaaguagaua

SEQ ID NO: 614445 - RNA, 22 nt, Human
cuggccccagaguuucacuugg

SEQ ID NO: 614446 - RNA, 22 nt, Human
cugugccucccuuuacuuugag

SEQ ID NO: 614447 - RNA, 22 nt, Human
guggagggaaugaaucuucucu

SEQ ID NO: 614448 - RNA, 23 nt, Human
ucugcucugaaguucggcugagc

SEQ ID NO: 614449 - RNA, 22 nt, Human
aguuucuauuuucaugucuguu

SEQ ID NO: 614450 - RNA, 22 nt, Human
aaacuguaaagcaggugaguag

SEQ ID NO: 614451 - RNA, 22 nt, Human
uuuuaucagcagggauaacaag

SEQ ID NO: 614452 - RNA, 22 nt, Human
uccucugcucagcauuccucac

SEQ ID NO: 614453 - RNA, 22 nt, Human
acauuucugucuuagggacugu

SEQ ID NO: 614454 - RNA, 22 nt, Human
aaggcaguucacucacgcagcc

SEQ ID NO: 614455 - RNA, 22 nt, Human
gcugugagcugccugugucaca

SEQ ID NO: 614456 - RNA, 22 nt, Human
aaggcaguggcuggaaaaccug

SEQ ID NO: 614457 - RNA, 17 nt, Human
gguucaguucugcauuc

SEQ ID NO: 614458 - RNA, 22 nt, Human
ucuguacaugaguugagaauca

SEQ ID NO: 614459 - RNA, 22 nt, Human
uagggguguuucgagagagguu

SEQ ID NO: 614460 - RNA, 22 nt, Human
uucuaguuuucaguccaccagg

SEQ ID NO: 614461 - RNA, 22 nt, Human
ucaggagacuuaugucacagug

SEQ ID NO: 614462 - RNA, 22 nt, Human
cuauuaaacacuacugugcacu

SEQ ID NO: 614463 - RNA, 22 nt, Human
ugaucaguguugguucuaucua

SEQ ID NO: 614464 - RNA, 22 nt, Human
gcagaauguaggccuucagugu

SEQ ID NO: 614465 - RNA, 19 nt, Human
aggcagaggcuuggcuagc

SEQ ID NO: 614466 - RNA, 22 nt, Human
auucgcgggccuggaggguggg

SEQ ID NO: 614467 - RNA, 22 nt, Human
gaagggugugugugagggacac

SEQ ID NO: 614468 - RNA, 22 nt, Human
augaaacugggauaacuauagc

SEQ ID NO: 614469 - RNA, 22 nt, Human
gcagcugcuggaaguuccugcc

SEQ ID NO: 614470 - RNA, 22 nt, Human
gaagucugcugcucaggaguuu

SEQ ID NO: 614471 - RNA, 22 nt, Human
cagccacuguggaauagccccc

SEQ ID NO: 614472 - RNA, 20 nt, Human
agccccacccuuguccuggc

SEQ ID NO: 614473 - RNA, 22 nt, Human
gcucucuggaggccauggacag

SEQ ID NO: 614474 - RNA, 22 nt, Human
uguauuccaaaaugcugaggau

SEQ ID NO: 614475 - RNA, 22 nt, Human
cugucuuugguccugucuguua

SEQ ID NO: 614476 - RNA, 22 nt, Human
ucuauuucgcauauaaguuuug

SEQ ID NO: 614477 - RNA, 22 nt, Human
agcugcccuguggggaggguug

SEQ ID NO: 614478 - RNA, 22 nt, Human
guggaaguagauuugagaaggu

SEQ ID NO: 614479 - RNA, 22 nt, Human
ugcagcugaggccagcuaugcc

SEQ ID NO: 614480 - RNA, 22 nt, Human
cuguaaaacacuguaguaucug

SEQ ID NO: 614481 - RNA, 22 nt, Human
augcagaaggagccaugcuugc

SEQ ID NO: 614482 - RNA, 22 nt, Human
gcagcugcagacccucagugcu

SEQ ID NO: 614483 - RNA, 22 nt, Human
auacaaaguauuaauccuggau

SEQ ID NO: 614484 - RNA, 22 nt, Human
ggcagagguagcuggaaccagg

SEQ ID NO: 614485 - RNA, 22 nt, Human
gcuguacaucacaauuugcugu

SEQ ID NO: 614486 - RNA, 22 nt, Human
cagccacuugugaugcugggga

SEQ ID NO: 614487 - RNA, 22 nt, Human
ccagcuuuucuuaucauuauaa

SEQ ID NO: 614488 - RNA, 20 nt, Human
gugcaauggcucagucucag

SEQ ID NO: 614489 - RNA, 22 nt, Human
agccaggauggucucgaucggc

SEQ ID NO: 614490 - RNA, 22 nt, Human
acuaagaccuagauacuagggg

SEQ ID NO: 614491 - RNA, 22 nt, Human
aaguuuuaacaaguacuuacua

SEQ ID NO: 614492 - RNA, 22 nt, Human
cugguuccaggauggaucuuuc

SEQ ID NO: 614493 - RNA, 22 nt, Human
acaggccucaagacacccaggu

SEQ ID NO: 614494 - RNA, 22 nt, Human
aagcuggauguaggaucccccu

SEQ ID NO: 614495 - RNA, 22 nt, Human
uaaaacugaauacauacugagg

SEQ ID NO: 614496 - RNA, 21 nt, Human
uaaaacuguaacuuuguccug

SEQ ID NO: 614497 - RNA, 22 nt, Human
agacuguagggauagaggucuu

SEQ ID NO: 614498 - RNA, 22 nt, Human
ugcagccaucgcagagucugua

SEQ ID NO: 614499 - RNA, 22 nt, Human
gcucuaacuauuaagaggucau

SEQ ID NO: 614500 - RNA, 22 nt, Human
aaaacauguccauacagaaacu

SEQ ID NO: 614501 - RNA, 22 nt, Human
cauuucuacagcuucuucagaa

SEQ ID NO: 614502 - RNA, 22 nt, Human
cacaguccuacagagaucagag

SEQ ID NO: 614503 - RNA, 22 nt, Human
ugagggcagagcacuggggagc

SEQ ID NO: 614504 - RNA, 18 nt, Human
agugucuggauauuuggg

SEQ ID NO: 614505 - RNA, 20 nt, Human
uuuuauauguaggguauaug

SEQ ID NO: 614506 - RNA, 22 nt, Human
aacuguaaggcuuagaacagca

SEQ ID NO: 614507 - RNA, 22 nt, Human
gcucucugggugugucuagaua

SEQ ID NO: 614508 - RNA, 21 nt, Human
aaacugaagagacaggaacuu

SEQ ID NO: 614509 - RNA, 22 nt, Human
cucaggagagucuuauaucucc

SEQ ID NO: 614510 - RNA, 22 nt, Human
accagacacugugaagacaggc

SEQ ID NO: 614511 - RNA, 22 nt, Human
ccugaggagauuguggcugggg

SEQ ID NO: 614512 - RNA, 20 nt, Human
cugcucugcuuugcaggugg

SEQ ID NO: 614513 - RNA, 20 nt, Human
ucagguagaucuuugagguc

SEQ ID NO: 614514 - RNA, 22 nt, Human
uaggaaaagcacaggauguucu

SEQ ID NO: 614515 - RNA, 22 nt, Human
guggagggugagcucauguuug

SEQ ID NO: 614516 - RNA, 22 nt, Human
ccugcuuaacauugccaugaca

SEQ ID NO: 614517 - RNA, 22 nt, Human
ugguuacacagcauguggacuu

SEQ ID NO: 614518 - RNA, 22 nt, Human
caaagacugcauaacacaugaa

SEQ ID NO: 614519 - RNA, 22 nt, Human
uagcauuuggacauugucaccu

SEQ ID NO: 614520 - RNA, 22 nt, Human
acuguacacagugguguacugu

SEQ ID NO: 614521 - RNA, 22 nt, Human
auuaagacugcccauguuuuua

SEQ ID NO: 614522 - RNA, 22 nt, Human
cagggguguuuuuggccaggag

SEQ ID NO: 614523 - RNA, 22 nt, Human
ggaagaaagguggacaacaggu

SEQ ID NO: 614524 - RNA, 22 nt, Human
cugucccagauguucucagcac

SEQ ID NO: 614525 - RNA, 22 nt, Human
auucuucugccuacuuucaucc

SEQ ID NO: 614526 - RNA, 22 nt, Human
cuguacagaguucugaguguac

SEQ ID NO: 614527 - RNA, 22 nt, Human
ccuguacauggccaucuuuacc

SEQ ID NO: 614528 - RNA, 22 nt, Human
agcaaacagugugcuaagaaau

SEQ ID NO: 614529 - RNA, 22 nt, Human
uacuguacugucuuuuuugcug

SEQ ID NO: 614530 - RNA, 22 nt, Human
gguuccacgguguuuggaggca

SEQ ID NO: 614531 - RNA, 22 nt, Human
aagcugcccaagacugaagcau

SEQ ID NO: 614532 - RNA, 22 nt, Human
gccagccccuccauccuguuca

SEQ ID NO: 614533 - RNA, 17 nt, Human
gcaguuaaauuaagaug

SEQ ID NO: 614534 - RNA, 21 nt, Human
acagcagagaucaagacuaag

SEQ ID NO: 614535 - RNA, 22 nt, Human
aucuggaagccagauacucagu

SEQ ID NO: 614536 - RNA, 22 nt, Human
ucugcucuguacugcacuggcc

SEQ ID NO: 614537 - RNA, 22 nt, Human
gggacucugagagccugagggu

SEQ ID NO: 614538 - RNA, 22 nt, Human
uuucauugucaauaaacuguau

SEQ ID NO: 614539 - RNA, 22 nt, Human
uaaggaaacaacuuguauuuuu

SEQ ID NO: 614540 - RNA, 22 nt, Human
gcaggauugggcagagggugaa

SEQ ID NO: 614541 - RNA, 22 nt, Human
aacuguacgauaauaaauuugu

SEQ ID NO: 614542 - RNA, 22 nt, Human
uggccuggugucugcgaggccu

SEQ ID NO: 614543 - RNA, 22 nt, Human
caguuuuaaauuguuagauaau

SEQ ID NO: 614544 - RNA, 22 nt, Human
uguaacaaaauaccuuggauug

SEQ ID NO: 614545 - RNA, 22 nt, Human
ccagucugaggccuggugaggg

SEQ ID NO: 614546 - RNA, 22 nt, Human
aagcugccuuccaugugaggaa

SEQ ID NO: 614547 - RNA, 22 nt, Human
aagcugccacacggugaguacu

SEQ ID NO: 614548 - RNA, 22 nt, Human
acaggccugugugcacacgagg

SEQ ID NO: 614549 - RNA, 23 nt, Human
cagaggcaucggauucaacauca

SEQ ID NO: 614550 - RNA, 22 nt, Human
ccaguccuggccaguaacauga

SEQ ID NO: 614551 - RNA, 22 nt, Human
cucaggagcuuccucagcccau

SEQ ID NO: 614552 - RNA, 22 nt, Human
gugcugccggcauagcagugaa

SEQ ID NO: 614553 - RNA, 22 nt, Human
gugcucuccagccccacgugga

SEQ ID NO: 614554 - RNA, 22 nt, Human
acuuucuuaggcuguauaaaug

SEQ ID NO: 614555 - RNA, 22 nt, Human
aaaguucucuaugguguaaaaa

SEQ ID NO: 614556 - RNA, 22 nt, Human
agacucugugcuccuugcuuuc

SEQ ID NO: 614557 - RNA, 22 nt, Human
cugcccugggaguaccuguccu

SEQ ID NO: 614558 - RNA, 22 nt, Human
cugggcaggagggcucuaugga

SEQ ID NO: 614559 - RNA, 22 nt, Human
caggauuaaggugaggggagua

SEQ ID NO: 614560 - RNA, 22 nt, Human
aagcugccugccacgcuagaua

SEQ ID NO: 614561 - RNA, 22 nt, Human
uuaggaggucuauggacauccu

SEQ ID NO: 614562 - RNA, 22 nt, Human
aagccacugagauuucacugca

SEQ ID NO: 614563 - RNA, 22 nt, Human
aggcggugcuguggacagugac

SEQ ID NO: 614564 - RNA, 22 nt, Human
cugagaaaggaccucaaacagg

SEQ ID NO: 614565 - RNA, 22 nt, Human
aaggcaguuugggccaccaucu

SEQ ID NO: 614566 - RNA, 18 nt, Human
gcagcugacacuggaguu

SEQ ID NO: 614567 - RNA, 22 nt, Human
gcucucugcagccuccuuggag

SEQ ID NO: 614568 - RNA, 22 nt, Human
cagugcuguuguaagcucauug

SEQ ID NO: 614569 - RNA, 22 nt, Human
cauuucuagggaucauaaagua

SEQ ID NO: 614570 - RNA, 22 nt, Human
acauuguauaaugauuaucaca

SEQ ID NO: 614571 - RNA, 21 nt, Human
uguuuauggaaaagagacaaa

SEQ ID NO: 614572 - RNA, 22 nt, Human
uuuuauucucaagacaauggga

SEQ ID NO: 614573 - RNA, 22 nt, Human
uuauuauagauuaugcaagauu

SEQ ID NO: 614574 - RNA, 22 nt, Human
guuuaauuuuagguugucaagc

SEQ ID NO: 614575 - RNA, 22 nt, Human
aggaagaaccuaagaaagucuc

SEQ ID NO: 614576 - RNA, 22 nt, Human
aaacucuuuccacgauuacuuu

SEQ ID NO: 614577 - RNA, 22 nt, Human
uuucuacaugucaauccaaacc

SEQ ID NO: 614578 - RNA, 22 nt, Human
ucaagucuggagaucuggaacu

SEQ ID NO: 614579 - RNA, 22 nt, Human
ggaggggucucuagcgaggaga

SEQ ID NO: 614580 - RNA, 22 nt, Human
guuucuuuugugaucaccaacc

SEQ ID NO: 614581 - RNA, 22 nt, Human
cugugccuccagucucgcuucu

SEQ ID NO: 614582 - RNA, 22 nt, Human
cagagcuguauuuaucuuucca

SEQ ID NO: 614583 - RNA, 22 nt, Human
aaauucuaugucaauguuuauu

SEQ ID NO: 614584 - RNA, 22 nt, Human
acagacuguuugguucaugucu

SEQ ID NO: 614585 - RNA, 22 nt, Human
agcugcccccagggcugugcuu

SEQ ID NO: 614586 - RNA, 22 nt, Human
uaggggugggauccaggaauua

SEQ ID NO: 614587 - RNA, 22 nt, Human
ucuuacagaaaauagauaacau

SEQ ID NO: 614588 - RNA, 22 nt, Human
auaccuguguauccacaagcgu

SEQ ID NO: 614589 - RNA, 22 nt, Human
aguuucuagccucacuguuuag

SEQ ID NO: 614590 - RNA, 22 nt, Human
aucuuaaucgaguccaugaaaa

SEQ ID NO: 614591 - RNA, 23 nt, Human
ccccucugguggcucagcuccug

SEQ ID NO: 614592 - RNA, 22 nt, Human
ccuacucugagcgccuccgcau

SEQ ID NO: 614593 - RNA, 22 nt, Human
gcaaaaacugcaauuacuuuug

SEQ ID NO: 614594 - RNA, 22 nt, Human
ccuguacauuagcugugaauug

SEQ ID NO: 614595 - RNA, 22 nt, Human
acaguucccgucuugcacagcu

SEQ ID NO: 614596 - RNA, 22 nt, Human
aacuuucuuucacagaaguauc

SEQ ID NO: 614597 - RNA, 19 nt, Human
uagcugccuguuaccucca

SEQ ID NO: 614598 - RNA, 22 nt, Human
uagggcaggggaggaaucugaa

SEQ ID NO: 614599 - RNA, 22 nt, Human
ugcucuguccagugcaccauca

SEQ ID NO: 614600 - RNA, 22 nt, Human
caguuuuacccaagcuuauuuu

SEQ ID NO: 614601 - RNA, 22 nt, Human
ggcagugagcuggagggaagga

SEQ ID NO: 614602 - RNA, 22 nt, Human
cauuucuauggcaaugggaaaa

SEQ ID NO: 614603 - RNA, 22 nt, Human
uuucuauuuacagugcuaggua

SEQ ID NO: 614604 - RNA, 22 nt, Human
uaaaacugcuugguauggucua

SEQ ID NO: 614605 - RNA, 22 nt, Human
ggcaggaggaagaguuagcacc

SEQ ID NO: 614606 - RNA, 22 nt, Human
aaagacugcaaaaacgcacaga

SEQ ID NO: 614607 - RNA, 22 nt, Human
uucuaguugagggagacaaaua

SEQ ID NO: 614608 - RNA, 22 nt, Human
ugaaacaaaaguauguagcuug

SEQ ID NO: 614609 - RNA, 21 nt, Human
ugcaggagucugugagucagg

SEQ ID NO: 614610 - RNA, 22 nt, Human
aguuuuaaaugauggugguggu

SEQ ID NO: 614611 - RNA, 22 nt, Human
uuucuacauucaaaaacuacca

SEQ ID NO: 614612 - RNA, 22 nt, Human
uagggcagccacccaggcugcu

SEQ ID NO: 614613 - RNA, 22 nt, Human
gcagcugccuauucagggcuug

SEQ ID NO: 614614 - RNA, 22 nt, Human
agcaauaacagaaaacuuuccu

SEQ ID NO: 614615 - RNA, 22 nt, Human
gcagcugcaagcacuucuggca

SEQ ID NO: 614616 - RNA, 19 nt, Human
caggacagacuucaaagcc

SEQ ID NO: 614617 - RNA, 22 nt, Human
uguuaggacuccccagaagcug

SEQ ID NO: 614618 - RNA, 20 nt, Human
gugcaauggcgcaaucucgg

SEQ ID NO: 614619 - RNA, 22 nt, Human
gcagcugcagguggucccaugc

SEQ ID NO: 614620 - RNA, 22 nt, Human
cugagcugacaucuuccucuuu

SEQ ID NO: 614621 - RNA, 22 nt, Human
auacaagacucagcacagacgg

SEQ ID NO: 614622 - RNA, 20 nt, Human
ugcccagcaagagugcaguu

SEQ ID NO: 614623 - RNA, 22 nt, Human
cuaguucuuaacuguuaugauu

SEQ ID NO: 614624 - RNA, 22 nt, Human
acaagaauuauuucuaguuaac

SEQ ID NO: 614625 - RNA, 22 nt, Human
augucuuucaaauucugccuag

SEQ ID NO: 614626 - RNA, 18 nt, Human
aagcugcccucaggcagg

SEQ ID NO: 614627 - RNA, 22 nt, Human
agggagaagguuuagcugugag

SEQ ID NO: 614628 - RNA, 22 nt, Human
uccagcucaggguuggcucaag

SEQ ID NO: 614629 - RNA, 22 nt, Human
agcuggccuucggugucacugg

SEQ ID NO: 614630 - RNA, 22 nt, Human
uaccacuacauuugcuaauggc

SEQ ID NO: 614631 - RNA, 22 nt, Human
gugcccagugcaggcccgcagg

SEQ ID NO: 614632 - RNA, 22 nt, Human
cacuguacugugaauaaggagg

SEQ ID NO: 614633 - RNA, 22 nt, Human
gcuguacaguuuacuagguggg

SEQ ID NO: 614634 - RNA, 22 nt, Human
agcugcccugggcuggagaugg

SEQ ID NO: 614635 - RNA, 22 nt, Human
uagcugccagaccauucuuacu

SEQ ID NO: 614636 - RNA, 22 nt, Human
auaaaagaaguuuugguacuug

SEQ ID NO: 614637 - RNA, 22 nt, Human
uaucugcaucugcauguguauu

SEQ ID NO: 614638 - RNA, 22 nt, Human
ucuuucuacaucauuugcuucu

SEQ ID NO: 614639 - RNA, 22 nt, Human
ccuguauuagguagacaacuau

SEQ ID NO: 614640 - RNA, 22 nt, Human
uauuucuauuccccaggcaagu

SEQ ID NO: 614641 - RNA, 22 nt, Human
gacagcuguacacuccugguua

SEQ ID NO: 614642 - RNA, 22 nt, Human
cccuggccccucacuccgaggc

SEQ ID NO: 614643 - RNA, 22 nt, Human
ggcagccaugugggcagcgagu

SEQ ID NO: 614644 - RNA, 22 nt, Human
agggugugcuguugggucuuuc

SEQ ID NO: 614645 - RNA, 22 nt, Human
uacaagaugacaggugcaugau

SEQ ID NO: 614646 - RNA, 22 nt, Human
uugucuuuggaaauuuaauguu

SEQ ID NO: 614647 - RNA, 21 nt, Human
auggagggaccagggaagcag

SEQ ID NO: 614648 - RNA, 22 nt, Human
agacuguacuuucugcagcucu

SEQ ID NO: 614649 - RNA, 22 nt, Human
ucuccugccacugcuucccauu

SEQ ID NO: 614650 - RNA, 22 nt, Human
cuguguacccacgugggcaccc

SEQ ID NO: 614651 - RNA, 22 nt, Human
ucacaagauacaguuagaagca

SEQ ID NO: 614652 - RNA, 22 nt, Human
cuggccccuguggcuaaaauca

SEQ ID NO: 614653 - RNA, 22 nt, Human
aucagucuguguuagaaaagag

SEQ ID NO: 614654 - RNA, 22 nt, Human
uucucaggugaggcugaggcug

SEQ ID NO: 614655 - RNA, 22 nt, Human
aaaauuuccaccaucuuugugu

SEQ ID NO: 614656 - RNA, 22 nt, Human
cuggagggaguuaggacccgga

SEQ ID NO: 614657 - RNA, 22 nt, Human
agggcagugggaaagccugcuc

SEQ ID NO: 614658 - RNA, 22 nt, Human
aacacuguggucuuuucaguaa

SEQ ID NO: 614659 - RNA, 22 nt, Human
acaacugucaguaaagaauauu

SEQ ID NO: 614660 - RNA, 22 nt, Human
gccagccccagacauccuaucg

SEQ ID NO: 614661 - RNA, 22 nt, Human
cagcuccuauuagacacugaau

SEQ ID NO: 614662 - RNA, 22 nt, Human
ucucugaguaagugacaguuca

SEQ ID NO: 614663 - RNA, 22 nt, Human
aaguucuacagcuucgcaggca

SEQ ID NO: 614664 - RNA, 22 nt, Human
ugaggcagugcugggaagccug

SEQ ID NO: 614665 - RNA, 22 nt, Human
gcagcccaggucucucucacuc

SEQ ID NO: 614666 - RNA, 18 nt, Human
ggccagccccaggccagc

SEQ ID NO: 614667 - RNA, 22 nt, Human
ugcagcugagucacccagccau

SEQ ID NO: 614668 - RNA, 22 nt, Human
cuggagggauguaggguguauu

SEQ ID NO: 614669 - RNA, 22 nt, Human
acucucugguguagaaagaccu

SEQ ID NO: 614670 - RNA, 22 nt, Human
ggaggcucgcuggucgcacagc

SEQ ID NO: 614671 - RNA, 23 nt, Human
gccauggcugccccacaggccuc

SEQ ID NO: 614672 - RNA, 22 nt, Human
aaauguucccaauaugaagcug

SEQ ID NO: 614673 - RNA, 22 nt, Human
uucuaccagaccccagacuugu

SEQ ID NO: 614674 - RNA, 22 nt, Human
guguuaaccagcuaaacuuugc

SEQ ID NO: 614675 - RNA, 22 nt, Human
gcagaggcucuuuaaugcuuag

SEQ ID NO: 614676 - RNA, 19 nt, Human
gagcugccuuuugaagacc

SEQ ID NO: 614677 - RNA, 22 nt, Human
uggagguguccaacucgugggu

SEQ ID NO: 614678 - RNA, 22 nt, Human
cugucugucaccaaaacagacu

SEQ ID NO: 614679 - RNA, 22 nt, Human
acuguacauguaaacauuguca

SEQ ID NO: 614680 - RNA, 22 nt, Human
aggaaacagagugaagcuuggg

SEQ ID NO: 614681 - RNA, 22 nt, Human
ccuagccccagauaucucacac

SEQ ID NO: 614682 - RNA, 22 nt, Human
aacauguagcagaaacgacuaa

SEQ ID NO: 614683 - RNA, 22 nt, Human
acuguacaacugcugagcagaa

SEQ ID NO: 614684 - RNA, 22 nt, Human
acauuucucagguaagucauuu

SEQ ID NO: 614685 - RNA, 22 nt, Human
cagguccugcagggagaguaaa

SEQ ID NO: 614686 - RNA, 21 nt, Human
uucuacaggaugaaugaaaac

SEQ ID NO: 614687 - RNA, 22 nt, Human
cucaggagaugacagaagguau

SEQ ID NO: 614688 - RNA, 22 nt, Human
ccugaggauuguuggugcuucc

SEQ ID NO: 614689 - RNA, 22 nt, Human
caguuuuaucaucugugaaaug

SEQ ID NO: 614690 - RNA, 21 nt, Human
ucugagaacuucugcugcagc

SEQ ID NO: 614691 - RNA, 19 nt, Human
aaaaggaauauucuuuggg

SEQ ID NO: 614692 - RNA, 21 nt, Human
agaaaaacacgauauaagccc

SEQ ID NO: 614693 - RNA, 22 nt, Human
aaacugaaacaucaucauguug

SEQ ID NO: 614694 - RNA, 22 nt, Human
gacuguacuugagagaggaacu

SEQ ID NO: 614695 - RNA, 21 nt, Human
ugagggguuauaacagggugg

SEQ ID NO: 614696 - RNA, 22 nt, Human
agaaaauuagauuuuacugugu

SEQ ID NO: 614697 - RNA, 22 nt, Human
agacuguaauugacaugucagc

SEQ ID NO: 614698 - RNA, 22 nt, Human
aagaauguucauuaaacuguug

SEQ ID NO: 614699 - RNA, 22 nt, Human
gaaauccaguucccuacucuua

SEQ ID NO: 614700 - RNA, 22 nt, Human
agacuguaauuuguggccuccu

SEQ ID NO: 614701 - RNA, 22 nt, Human
acauuucucuugaugucucuau

SEQ ID NO: 614702 - RNA, 22 nt, Human
caaaauucugcauuucuaauaa

SEQ ID NO: 614703 - RNA, 22 nt, Human
ggagggguggucgcgaagagca

SEQ ID NO: 614704 - RNA, 22 nt, Human
gcugccacuuggucaugucaug

SEQ ID NO: 614705 - RNA, 18 nt, Human
acauuucuaggugaaagc

SEQ ID NO: 614706 - RNA, 22 nt, Human
caggcauuucgcaaaggcugag

SEQ ID NO: 614707 - RNA, 18 nt, Human
aagaacugagguccuaga

SEQ ID NO: 614708 - RNA, 20 nt, Human
uacagucagggcacaggcag

SEQ ID NO: 614709 - RNA, 22 nt, Human
cugcuuccaugcaauggcaguc

SEQ ID NO: 614710 - RNA, 22 nt, Human
uaaggaaagugccaugauuucu

SEQ ID NO: 614711 - RNA, 22 nt, Human
ggugugccacuucacugagcag

SEQ ID NO: 614712 - RNA, 19 nt, Human
uaaaaacugaaggaagcag

SEQ ID NO: 614713 - RNA, 22 nt, Human
ugggggcauggaccagccuggc

SEQ ID NO: 614714 - RNA, 22 nt, Human
cugagcugcuuugcuuuugggg

SEQ ID NO: 614715 - RNA, 22 nt, Human
cugcuuccauggucuggagacu

SEQ ID NO: 614716 - RNA, 22 nt, Human
ucuaccacuaagugugcuuuga

SEQ ID NO: 614717 - RNA, 22 nt, Human
cauuuacuuaaaucuuuacaag

SEQ ID NO: 614718 - RNA, 22 nt, Human
aagacugucugggacaagauga

SEQ ID NO: 614719 - RNA, 22 nt, Human
cuauugcauuugcaucuucauc

SEQ ID NO: 614720 - RNA, 22 nt, Human
ugagaugaauaacuccugcuaa

SEQ ID NO: 614721 - RNA, 22 nt, Human
aagauuuaccacuuuauucaag

SEQ ID NO: 614722 - RNA, 19 nt, Human
ggcagacacaguugacaug

SEQ ID NO: 614723 - RNA, 22 nt, Human
aaaguuuggauuagcaguuaga

SEQ ID NO: 614724 - RNA, 22 nt, Human
uucaucuugauggcuuccuaau

SEQ ID NO: 614725 - RNA, 22 nt, Human
aucuggaacaaagcuuaggaau

SEQ ID NO: 614726 - RNA, 18 nt, Human
ugugccucugcaggacgu

SEQ ID NO: 614727 - RNA, 22 nt, Human
aaagaacuuauccuagaauuug

SEQ ID NO: 614728 - RNA, 22 nt, Human
uaauccaauggcacaauguaug

SEQ ID NO: 614729 - RNA, 22 nt, Human
cuccagcuuuuucccaguuggc

SEQ ID NO: 614730 - RNA, 22 nt, Human
aagaaaguggguaauaugauuu

SEQ ID NO: 614731 - RNA, 22 nt, Human
ggcagccagagggcagcuggau

SEQ ID NO: 614732 - RNA, 23 nt, Human
agaaaaguucauaccuuuuuaac

SEQ ID NO: 614733 - RNA, 22 nt, Human
gcuuuuauuucuucacaaaagu

SEQ ID NO: 614734 - RNA, 22 nt, Human
ccuuggagcggucagcacuggu

SEQ ID NO: 614735 - RNA, 22 nt, Human
augaaacaaaccucuauggagu

SEQ ID NO: 614736 - RNA, 22 nt, Human
gcuguacaggguuauccuuucc

SEQ ID NO: 614737 - RNA, 22 nt, Human
aggcucuggcaacagcuggugu

SEQ ID NO: 614738 - RNA, 22 nt, Human
ugaaacaagggaccguccuuuc

SEQ ID NO: 614739 - RNA, 22 nt, Human
agacucugauaagcaacucuug

SEQ ID NO: 614740 - RNA, 22 nt, Human
ucuuugcauggacauguguuuu

SEQ ID NO: 614741 - RNA, 22 nt, Human
acuguaaccaguguggugagag

SEQ ID NO: 614742 - RNA, 22 nt, Human
ggugugccuggggcuuagcugc

SEQ ID NO: 614743 - RNA, 22 nt, Human
aagcugccaaugguaagcugcu

SEQ ID NO: 614744 - RNA, 22 nt, Human
uuguauauauucuuaaagaugu

SEQ ID NO: 614745 - RNA, 22 nt, Human
ugcuuccagcucucuguaaggu

SEQ ID NO: 614746 - RNA, 22 nt, Human
gugugcgccgacacagccaggu

SEQ ID NO: 614747 - RNA, 22 nt, Human
uuuguucauuuugagcucauca

SEQ ID NO: 614748 - RNA, 22 nt, Human
ucuguacauuuggggaccccag

SEQ ID NO: 614749 - RNA, 22 nt, Human
aggcugugcacagggcaccugc

SEQ ID NO: 614750 - RNA, 22 nt, Human
cuacagguaugugcaugacauc

SEQ ID NO: 614751 - RNA, 22 nt, Human
uuauacuaaaacgcauugaauu

SEQ ID NO: 614752 - RNA, 22 nt, Human
uucuaccauugggaaaacagcc

SEQ ID NO: 614753 - RNA, 22 nt, Human
accaucuuaaggggacuucuua

SEQ ID NO: 614754 - RNA, 22 nt, Human
aauguacaucucaguguaguac

SEQ ID NO: 614755 - RNA, 22 nt, Human
uaacagcuggcguuauaggaau

SEQ ID NO: 614756 - RNA, 21 nt, Human
agcugcccagaguagggaagg

SEQ ID NO: 614757 - RNA, 22 nt, Human
aggcagaggaaggguggauuug

SEQ ID NO: 614758 - RNA, 22 nt, Human
gacccuguuucuacaaauaauu

SEQ ID NO: 614759 - RNA, 20 nt, Human
acuggacacugaggugagcu

SEQ ID NO: 614760 - RNA, 22 nt, Human
caguccugcccaggcugacaga

SEQ ID NO: 614761 - RNA, 22 nt, Human
uucaggagaauuccaagaagua

SEQ ID NO: 614762 - RNA, 22 nt, Human
uucuaccagcuacucacugaua

SEQ ID NO: 614763 - RNA, 22 nt, Human
ucuguacaaaggcuauuuggag

SEQ ID NO: 614764 - RNA, 22 nt, Human
ccacucugauuuuggcuccacu

SEQ ID NO: 614765 - RNA, 21 nt, Human
ggcuguggagccaugacucac

SEQ ID NO: 614766 - RNA, 22 nt, Human
cugagggagggacuuugagacu

SEQ ID NO: 614767 - RNA, 22 nt, Human
ggaagcugugcucucaggccuc

SEQ ID NO: 614768 - RNA, 22 nt, Human
ucauuucuauugcuacugucug

SEQ ID NO: 614769 - RNA, 22 nt, Human
ccacugccagcuuuguccuccc

SEQ ID NO: 614770 - RNA, 22 nt, Human
aggaggugagcggucauguggu

SEQ ID NO: 614771 - RNA, 22 nt, Human
ggcagagacuggguuggcagag

SEQ ID NO: 614772 - RNA, 22 nt, Human
ugaggcagcauucuucaagaca

SEQ ID NO: 614773 - RNA, 22 nt, Human
auacaaagcuuucugucuggua

SEQ ID NO: 614774 - RNA, 22 nt, Human
gguuccccaggcggcccuugga

SEQ ID NO: 614775 - RNA, 22 nt, Human
caaaacugucuagagagagaag

SEQ ID NO: 614776 - RNA, 20 nt, Human
ucuguacacucaucuucugc

SEQ ID NO: 614777 - RNA, 22 nt, Human
uuuauauccaucuuugaaguaa

SEQ ID NO: 614778 - RNA, 22 nt, Human
gguuccaccuggcgagggguau

SEQ ID NO: 614779 - RNA, 20 nt, Human
uggagguggucugcuguccu

SEQ ID NO: 614780 - RNA, 22 nt, Human
uggcuccaucauccaugcaaga

SEQ ID NO: 614781 - RNA, 22 nt, Human
gagcugccggcccacaguacua

SEQ ID NO: 614782 - RNA, 22 nt, Human
uggccugguuguugcugccguu

SEQ ID NO: 614783 - RNA, 22 nt, Human
aggggugugcauccuggaggau

SEQ ID NO: 614784 - RNA, 22 nt, Human
cugugccugcaggccacaucaa

SEQ ID NO: 614785 - RNA, 22 nt, Human
cuggccccaggcagccugcugg

SEQ ID NO: 614786 - RNA, 22 nt, Human
aaagacugguguguuacauaua

SEQ ID NO: 614787 - RNA, 22 nt, Human
uuccuguucaggaaaguugugu

SEQ ID NO: 614788 - RNA, 22 nt, Human
uaaggcaggacuggauagcuau

SEQ ID NO: 614789 - RNA, 22 nt, Human
uucauaguguuuccuuccagug

SEQ ID NO: 614790 - RNA, 19 nt, Human
gcuguacaguaaggagaca

SEQ ID NO: 614791 - RNA, 22 nt, Human
acaugaaaagacuaucugauua

SEQ ID NO: 614792 - RNA, 23 nt, Human
aaagacugcugagaauuuuagga

SEQ ID NO: 614793 - RNA, 22 nt, Human
aaagucaaaaugcucuccuguc

SEQ ID NO: 614794 - RNA, 22 nt, Human
cuuuggaauaauuuccuggagu

SEQ ID NO: 614795 - RNA, 22 nt, Human
guuaagaagcuagagaugaaca

SEQ ID NO: 614796 - RNA, 22 nt, Human
ccuguacagugaaugaauguga

SEQ ID NO: 614797 - RNA, 22 nt, Human
gaggaaaaugggacaggcugua

SEQ ID NO: 614798 - RNA, 18 nt, Human
acauuucuaugcuucugg

SEQ ID NO: 614799 - RNA, 22 nt, Human
caauuucuaacauuccauggau

SEQ ID NO: 614800 - RNA, 22 nt, Human
gcagcccaggcucgcucacugc

SEQ ID NO: 614801 - RNA, 22 nt, Human
gccacagcuuagaucacagccu

SEQ ID NO: 614802 - RNA, 22 nt, Human
acuguucauuuguccuguaucu

SEQ ID NO: 614803 - RNA, 22 nt, Human
uuagaucuuaggcaaauguguu

SEQ ID NO: 614804 - RNA, 22 nt, Human
uccagucucuacucugagauaa

SEQ ID NO: 614805 - RNA, 22 nt, Human
aucuggaauccuuguggacaau

SEQ ID NO: 614806 - RNA, 22 nt, Human
ugcagucuuccagcugcacaaa

SEQ ID NO: 614807 - RNA, 22 nt, Human
aaaacuguaggaauugggugcc

SEQ ID NO: 614808 - RNA, 21 nt, Human
cacaagacacauaggguguuu

SEQ ID NO: 614809 - RNA, 22 nt, Human
cucaggaggaggaaguucauug

SEQ ID NO: 614810 - RNA, 16 nt, Human
caguuuuaaggcccaa

SEQ ID NO: 614811 - RNA, 22 nt, Human
guccagcugaucuugacccagc

SEQ ID NO: 614812 - RNA, 22 nt, Human
aaacucuuccuuucuuuaaagu

SEQ ID NO: 614813 - RNA, 22 nt, Human
gacauaaaauucaauaauuugu

SEQ ID NO: 614814 - RNA, 22 nt, Human
uuuugauaucaugaugaacaga

SEQ ID NO: 614815 - RNA, 22 nt, Human
caggaaugacccaacaguuuca

SEQ ID NO: 614816 - RNA, 22 nt, Human
ucuguacaacaaagggaugaga

SEQ ID NO: 614817 - RNA, 22 nt, Human
ucagcugcucaaauuuauguca

SEQ ID NO: 614818 - RNA, 21 nt, Human
ccagcccagcugugucccagc

SEQ ID NO: 614819 - RNA, 17 nt, Human
ucugcucugccaaucca

SEQ ID NO: 614820 - RNA, 22 nt, Human
uucuaguucauauucucaaaga

SEQ ID NO: 614821 - RNA, 22 nt, Human
uaggaaaagucuagauugauga

SEQ ID NO: 614822 - RNA, 22 nt, Human
ucugucuuuagaggccugugcu

SEQ ID NO: 614823 - RNA, 22 nt, Human
aggaagcuccuggagagccagu

SEQ ID NO: 614824 - RNA, 22 nt, Human
aaacaguagaaguguauuuuau

SEQ ID NO: 614825 - RNA, 22 nt, Human
ugccgcugucgccaccauggcu

SEQ ID NO: 614826 - RNA, 19 nt, Human
agacucugugugagacuuu

SEQ ID NO: 614827 - RNA, 22 nt, Human
augucuuucuuauggucuguug

SEQ ID NO: 614828 - RNA, 22 nt, Human
aggcaguuguagagagggcucu

SEQ ID NO: 614829 - RNA, 22 nt, Human
gaaaacugugauuagaaugccu

SEQ ID NO: 614830 - RNA, 22 nt, Human
aaaaguguucaggaagaauaau

SEQ ID NO: 614831 - RNA, 22 nt, Human
aauuuguuacacagcaauauaa

SEQ ID NO: 614832 - RNA, 22 nt, Human
aggcaguucucguguguguccc

SEQ ID NO: 614833 - RNA, 22 nt, Human
caccugagcacuggggccgccc

SEQ ID NO: 614834 - RNA, 22 nt, Human
agcugcccuuuaugaugcugaa

SEQ ID NO: 614835 - RNA, 22 nt, Human
aaacuguaggagggaaaggaag

SEQ ID NO: 614836 - RNA, 22 nt, Human
ggugcugccuauagucugaaac

SEQ ID NO: 614837 - RNA, 22 nt, Human
auguucuaaucccugcuaugua

SEQ ID NO: 614838 - RNA, 22 nt, Human
auguaacacccacuuuuauagc

SEQ ID NO: 614839 - RNA, 22 nt, Human
caguuuuaugaaugcuuauuag

SEQ ID NO: 614840 - RNA, 22 nt, Human
uggucaacaggcagggaugaaa

SEQ ID NO: 614841 - RNA, 22 nt, Human
aaaguucagugccuucuauaca

SEQ ID NO: 614842 - RNA, 22 nt, Human
guaaucucagcuacuugggagg

SEQ ID NO: 614843 - RNA, 22 nt, Human
agugcaauagcaaagaacaaca

SEQ ID NO: 614844 - RNA, 22 nt, Human
uagcugccuuugggcuccugcu

SEQ ID NO: 614845 - RNA, 22 nt, Human
auacuaagcucauuacauuuug

SEQ ID NO: 614846 - RNA, 22 nt, Human
acagcaaaggacgaacacucug

SEQ ID NO: 614847 - RNA, 22 nt, Human
cacuuggaggaaggccuauuca

SEQ ID NO: 614848 - RNA, 22 nt, Human
gagcugccugugugccaugaug

SEQ ID NO: 614849 - RNA, 22 nt, Human
uucuaguucccucuggaaugua

SEQ ID NO: 614850 - RNA, 22 nt, Human
auguaacauugaauuauauagu

SEQ ID NO: 614851 - RNA, 22 nt, Human
guguggggagcugcagccacau

SEQ ID NO: 614852 - RNA, 22 nt, Human
aggaaacagugaacuuggcagg

SEQ ID NO: 614853 - RNA, 22 nt, Human
ccugucugcaugaucccugcca

SEQ ID NO: 614854 - RNA, 22 nt, Human
gacaagacugguuuauuuaagg

SEQ ID NO: 614855 - RNA, 22 nt, Human
uuuccacuguagagauguugaa

SEQ ID NO: 614856 - RNA, 22 nt, Human
gaaauucaggacaaagacucuu

SEQ ID NO: 614857 - RNA, 22 nt, Human
cuggagggacuuucucacggau

SEQ ID NO: 614858 - RNA, 22 nt, Human
aaacacuagcaggaagcacuga

SEQ ID NO: 614859 - RNA, 22 nt, Human
cacuuggaggcccccugugccc

SEQ ID NO: 614860 - RNA, 22 nt, Human
acacuguaaauugagugcguga

SEQ ID NO: 614861 - RNA, 22 nt, Human
cuggagggcuucugcagguuac

SEQ ID NO: 614862 - RNA, 22 nt, Human
cagccacuggugccaggcuguu

SEQ ID NO: 614863 - RNA, 22 nt, Human
uagcauuuggcaccaguuauuu

SEQ ID NO: 614864 - RNA, 22 nt, Human
acauuucuuucuauucaguagc

SEQ ID NO: 614865 - RNA, 22 nt, Human
gcuuucuaggcagagaugacug

SEQ ID NO: 614866 - RNA, 22 nt, Human
agguccugaggguucgucugca

SEQ ID NO: 614867 - RNA, 20 nt, Human
agaaaauguuuucagcugga

SEQ ID NO: 614868 - RNA, 22 nt, Human
accaaaaccugcuacuaaagga

SEQ ID NO: 614869 - RNA, 22 nt, Human
gagugcaguuggggugagggga

SEQ ID NO: 614870 - RNA, 22 nt, Human
aggucaagaguaaauuugggua

SEQ ID NO: 614871 - RNA, 22 nt, Human
gcgcagaguagcagagugcuga

SEQ ID NO: 614872 - RNA, 22 nt, Human
ucauacauucagcagauauuug

SEQ ID NO: 614873 - RNA, 22 nt, Human
aagaauugguuuccucugucau

SEQ ID NO: 614874 - RNA, 22 nt, Human
uccugggucccgcacaucuguc

SEQ ID NO: 614875 - RNA, 22 nt, Human
uuccugggcucuggcuggccua

SEQ ID NO: 614876 - RNA, 17 nt, Human
ucugucuugacugucac

SEQ ID NO: 614877 - RNA, 22 nt, Human
acaaagugcugacauuacaggc

SEQ ID NO: 614878 - RNA, 22 nt, Human
cuggccacugauuccuccccug

SEQ ID NO: 614879 - RNA, 22 nt, Human
ugucuuuuaccuaaugagcugg

SEQ ID NO: 614880 - RNA, 22 nt, Human
ugcccugguuacacuggagucc

SEQ ID NO: 614881 - RNA, 22 nt, Human
acauguuugauaaauauuuggg

SEQ ID NO: 614882 - RNA, 22 nt, Human
ugaggcagaaauuccuguuuuc

SEQ ID NO: 614883 - RNA, 22 nt, Human
gcucuuugcacagcucugcccu

SEQ ID NO: 614884 - RNA, 17 nt, Human
ugggggcgccagggucu

SEQ ID NO: 614885 - RNA, 22 nt, Human
uagaaagcugaguaauacauuu

SEQ ID NO: 614886 - RNA, 18 nt, Human
acaaaggaucaugaggga

SEQ ID NO: 614887 - RNA, 22 nt, Human
uggagucagaaugcgacaggcc

SEQ ID NO: 614888 - RNA, 22 nt, Human
uaauuuuuccacguacacuggg

SEQ ID NO: 614889 - RNA, 22 nt, Human
gagagcuguaauagucaugucu

SEQ ID NO: 614890 - RNA, 22 nt, Human
aauagcugggaccugaauuagc

SEQ ID NO: 614891 - RNA, 22 nt, Human
aaugcagauucuuauucuguag

SEQ ID NO: 614892 - RNA, 22 nt, Human
ucuggugucaguauucuuugaa

SEQ ID NO: 614893 - RNA, 22 nt, Human
uuccugccuacaugccuuaugc

SEQ ID NO: 614894 - RNA, 22 nt, Human
caggcaggagaggaggauuucu

SEQ ID NO: 614895 - RNA, 22 nt, Human
cagaguccuggacacagagaca

SEQ ID NO: 614896 - RNA, 22 nt, Human
ugguccuggccuugaccccagg

SEQ ID NO: 614897 - RNA, 22 nt, Human
auuccuugcacaucagauaguu

SEQ ID NO: 614898 - RNA, 22 nt, Human
gggcagguaggugaaauaauga

SEQ ID NO: 614899 - RNA, 22 nt, Human
augcccuguggcaguacauauu

SEQ ID NO: 614900 - RNA, 22 nt, Human
uacaaaaggaagagggaucuua

SEQ ID NO: 614901 - RNA, 22 nt, Human
ugcauaaaauaugagaaaugua

SEQ ID NO: 614902 - RNA, 22 nt, Human
cccuggcauaaaacuucuccag

SEQ ID NO: 614903 - RNA, 19 nt, Human
gcaggguguugacuguccc

SEQ ID NO: 614904 - RNA, 21 nt, Human
ggcuuuaugcucacccagccu

SEQ ID NO: 614905 - RNA, 22 nt, Human
uugacucauaccugccugaccc

SEQ ID NO: 614906 - RNA, 22 nt, Human
agcuaggacagguagagauggg

SEQ ID NO: 614907 - RNA, 22 nt, Human
gucccugggaaaggagagggca

SEQ ID NO: 614908 - RNA, 22 nt, Human
cugaggccccucucuugagcuu

SEQ ID NO: 614909 - RNA, 22 nt, Human
ggagucuucagauagaguauuu

SEQ ID NO: 614910 - RNA, 22 nt, Human
aggugccauugcuugccaguuu

SEQ ID NO: 614911 - RNA, 22 nt, Human
uugggguacgcaggucugggag

SEQ ID NO: 614912 - RNA, 22 nt, Human
caguggcgugaucucugcucac

SEQ ID NO: 614913 - RNA, 22 nt, Human
auacauguugagaaaauaucug

SEQ ID NO: 614914 - RNA, 22 nt, Human
uuguauuugauugucauaucgu

SEQ ID NO: 614915 - RNA, 22 nt, Human
ucagcaggcacggacaggcugc

SEQ ID NO: 614916 - RNA, 22 nt, Human
caguggguccugcgucugccag

SEQ ID NO: 614917 - RNA, 22 nt, Human
gccuucugauugcuggacugac

SEQ ID NO: 614918 - RNA, 22 nt, Human
uaccaugucuucaauaagucua

SEQ ID NO: 614919 - RNA, 22 nt, Human
ccagggaguuuccaaucugaga

SEQ ID NO: 614920 - RNA, 22 nt, Human
uguggcugacuccuggucccca

SEQ ID NO: 614921 - RNA, 22 nt, Human
cauguguuuugucauuucaaua

SEQ ID NO: 614922 - RNA, 22 nt, Human
cuugagcuaggaaggcugaggc

SEQ ID NO: 614923 - RNA, 22 nt, Human
uccugagguauaugcuuugcag

SEQ ID NO: 614924 - RNA, 22 nt, Human
uucuccuugaaaagcugcaucu

SEQ ID NO: 614925 - RNA, 22 nt, Human
gcugggagaggcagcuuucgga

SEQ ID NO: 614926 - RNA, 22 nt, Human
auuauuauauagggaaaguccc

SEQ ID NO: 614927 - RNA, 22 nt, Human
agggccaguucagaggacaugg

SEQ ID NO: 614928 - RNA, 22 nt, Human
gcugggagcaaagccaugcaua

SEQ ID NO: 614929 - RNA, 22 nt, Human
ggaacuccugcuccaagcagcu

SEQ ID NO: 614930 - RNA, 22 nt, Human
ggccaccugggaucucauccug

SEQ ID NO: 614931 - RNA, 22 nt, Human
ccugagauggggauuauuccaa

SEQ ID NO: 614932 - RNA, 22 nt, Human
agggcucuuccuuugccucuca

SEQ ID NO: 614933 - RNA, 22 nt, Human
auacaguauaacuaauaaaccc

SEQ ID NO: 614934 - RNA, 22 nt, Human
aaugcuuuaauugcauguagug

SEQ ID NO: 614935 - RNA, 22 nt, Human
aaagcaguauaaguaacggaag

SEQ ID NO: 614936 - RNA, 22 nt, Human
aaaugauugucaaaguucuguu

SEQ ID NO: 614937 - RNA, 22 nt, Human
ccucuuugacaaguaccugccc

SEQ ID NO: 614938 - RNA, 22 nt, Human
ugaagcagagugaaggugaauu

SEQ ID NO: 614939 - RNA, 22 nt, Human
uggugcaauauuaugaaaggua

SEQ ID NO: 614940 - RNA, 22 nt, Human
uucacagagcuuguucauggcc

SEQ ID NO: 614941 - RNA, 22 nt, Human
uccaggugugcucugugcccug

SEQ ID NO: 614942 - RNA, 22 nt, Human
auaagcagggucaaaugccuac

SEQ ID NO: 614943 - RNA, 22 nt, Human
aucuggagaugggucugucacc

SEQ ID NO: 614944 - RNA, 22 nt, Human
acagccagugacugcagacccu

SEQ ID NO: 614945 - RNA, 22 nt, Human
ucucuuugucugcucuuaguug

SEQ ID NO: 614946 - RNA, 22 nt, Human
uacauucucuucccauugucuc

SEQ ID NO: 614947 - RNA, 22 nt, Human
ccugagcuuuaaaagccaugua

SEQ ID NO: 614948 - RNA, 22 nt, Human
acagcagguuacaguggcacag

SEQ ID NO: 614949 - RNA, 22 nt, Human
cccuggcucugccucagagccc

SEQ ID NO: 614950 - RNA, 22 nt, Human
uccugagggacugguuccucgc

SEQ ID NO: 614951 - RNA, 19 nt, Human
uguugaagauuauuugugg

SEQ ID NO: 614952 - RNA, 22 nt, Human
caucagucccacggagcagccc

SEQ ID NO: 614953 - RNA, 22 nt, Human
aagggcucugugcuugucccau

SEQ ID NO: 614954 - RNA, 22 nt, Human
guaggcagauaggagugcagcc

SEQ ID NO: 614955 - RNA, 22 nt, Human
aggcaggucuguaucuagucuc

SEQ ID NO: 614956 - RNA, 22 nt, Human
cuggcccuguggaggcaggaac

SEQ ID NO: 614957 - RNA, 22 nt, Human
uggaaucuuuaggaagcacaua

SEQ ID NO: 614958 - RNA, 19 nt, Human
auccuggguccuccagcug

SEQ ID NO: 614959 - RNA, 22 nt, Human
gggaucuugaaacagcuggauu

SEQ ID NO: 614960 - RNA, 22 nt, Human
uccuucaaaaguugagagagcc

SEQ ID NO: 614961 - RNA, 22 nt, Human
guuuuacaagguuaaucagcag

SEQ ID NO: 614962 - RNA, 22 nt, Human
gaggcaggguguugauuacaga

SEQ ID NO: 614963 - RNA, 22 nt, Human
guuauaaaaugcacaguuguuu

SEQ ID NO: 614964 - RNA, 22 nt, Human
gccaggucuaagcaucagccac

SEQ ID NO: 614965 - RNA, 23 nt, Human
acugccaguuuuaccacagacgg

SEQ ID NO: 614966 - RNA, 22 nt, Human
acagguccucaagucagcuggg

SEQ ID NO: 614967 - RNA, 22 nt, Human
ggagucuuggccugcugagaaa

SEQ ID NO: 614968 - RNA, 22 nt, Human
aauauugagaaccagcauguuu

SEQ ID NO: 614969 - RNA, 22 nt, Human
cagugugucucuuguccuggcu

SEQ ID NO: 614970 - RNA, 22 nt, Human
uguguacauaucuauccuagau

SEQ ID NO: 614971 - RNA, 22 nt, Human
ccugaggcuugggaguuccgcc

SEQ ID NO: 614972 - RNA, 22 nt, Human
guucauuuuucccuaaugagua

SEQ ID NO: 614973 - RNA, 22 nt, Human
uccuucuccuccuugagugaca

SEQ ID NO: 614974 - RNA, 22 nt, Human
uguggcucggccagcugcugaa

SEQ ID NO: 614975 - RNA, 18 nt, Human
aguuuuuaggaagaaaug

SEQ ID NO: 614976 - RNA, 22 nt, Human
uuuucauuuuuguagaugcaag

SEQ ID NO: 614977 - RNA, 22 nt, Human
ugucauuuucuaaucuguuguc

SEQ ID NO: 614978 - RNA, 22 nt, Human
guccuggggaauacagaagccg

SEQ ID NO: 614979 - RNA, 22 nt, Human
caggcuggagugcagugucgcc

SEQ ID NO: 614980 - RNA, 22 nt, Human
uuccacagcccaagcugguggc

SEQ ID NO: 614981 - RNA, 19 nt, Human
ccagcagacacagcugccc

SEQ ID NO: 614982 - RNA, 22 nt, Human
guccugggcaugcagggcuuuc

SEQ ID NO: 614983 - RNA, 22 nt, Human
uccagggcuguuacuuuacaua

SEQ ID NO: 614984 - RNA, 22 nt, Human
agcacuuuccuggcaaaugugg

SEQ ID NO: 614985 - RNA, 22 nt, Human
gccccucuccuugugcaccugc

SEQ ID NO: 614986 - RNA, 22 nt, Human
ggagucaucucagcugagaggc

SEQ ID NO: 614987 - RNA, 22 nt, Human
cagguccaccaugccucaagcc

SEQ ID NO: 614988 - RNA, 22 nt, Human
acagcucucccucagagaaaug

SEQ ID NO: 614989 - RNA, 22 nt, Human
cuguggcugcagccuugguccu

SEQ ID NO: 614990 - RNA, 22 nt, Human
cagaaaauagaguuucucugag

SEQ ID NO: 614991 - RNA, 22 nt, Human
ggcuguggucugggugcucccc

SEQ ID NO: 614992 - RNA, 22 nt, Human
uuuucuggucacauguuauuaa

SEQ ID NO: 614993 - RNA, 22 nt, Human
cugcccuguaucuucucccaau

SEQ ID NO: 614994 - RNA, 22 nt, Human
ugggcuggcugaacuucaaccu

SEQ ID NO: 614995 - RNA, 22 nt, Human
cgguccaggauggcuggcaagc

SEQ ID NO: 614996 - RNA, 22 nt, Human
uguggcucuccuccugcugccc

SEQ ID NO: 614997 - RNA, 22 nt, Human
aguccuggcauauagguccuca

SEQ ID NO: 614998 - RNA, 22 nt, Human
cuguggagaugcagaccaggcc

SEQ ID NO: 614999 - RNA, 19 nt, Human
gccaggcucuuauucugug

SEQ ID NO: 615000 - RNA, 22 nt, Human
ggcuuuaugcacagcagauggu

SEQ ID NO: 615001 - RNA, 22 nt, Human
gccugcagugagugcagaaggu

SEQ ID NO: 615002 - RNA, 22 nt, Human
accuguuuucagaaaaugcaga

SEQ ID NO: 615003 - RNA, 22 nt, Human
cuuuaguguucaacccagauaa

SEQ ID NO: 615004 - RNA, 22 nt, Human
cugguuuugucagaagcuuuau

SEQ ID NO: 615005 - RNA, 23 nt, Human
aagauacagguguggaaugguuu

SEQ ID NO: 615006 - RNA, 22 nt, Human
cuuaaacugggcauucagagaa

SEQ ID NO: 615007 - RNA, 22 nt, Human
aaauacacguacauguguaaaa

SEQ ID NO: 615008 - RNA, 22 nt, Human
guacagucuucuuaaugcuuuu

SEQ ID NO: 615009 - RNA, 22 nt, Human
uguggagaugugagcaagggga

SEQ ID NO: 615010 - RNA, 22 nt, Human
agggcugguauguccaugaaag

SEQ ID NO: 615011 - RNA, 22 nt, Human
agggcuuucuuuguaaaagaag

SEQ ID NO: 615012 - RNA, 19 nt, Human
ccaaaggaaguuucccucc

SEQ ID NO: 615013 - RNA, 22 nt, Human
auaauguuucaguacugucugu

SEQ ID NO: 615014 - RNA, 22 nt, Human
uagauucaugcaguaugcuagu

SEQ ID NO: 615015 - RNA, 22 nt, Human
ggugcccagcaagcuuucaaug

SEQ ID NO: 615016 - RNA, 22 nt, Human
ccagggcaugggaagaacugaa

SEQ ID NO: 615017 - RNA, 22 nt, Human
ucaguguuagacaaguuuggaa

SEQ ID NO: 615018 - RNA, 22 nt, Human
agcuuuaaagcauauuucuaag

SEQ ID NO: 615019 - RNA, 22 nt, Human
cauggccaaagaauuauauuuu

SEQ ID NO: 615020 - RNA, 22 nt, Human
ggugcaggcgguggggcaagua

SEQ ID NO: 615021 - RNA, 22 nt, Human
uggcaggugcacuuuugguuuc

SEQ ID NO: 615022 - RNA, 22 nt, Human
cagcucaggaaggaaggccggc

SEQ ID NO: 615023 - RNA, 22 nt, Human
cuucaguuagccaauucagguc

SEQ ID NO: 615024 - RNA, 22 nt, Human
agaaagaacguugguuaucuua

SEQ ID NO: 615025 - RNA, 22 nt, Human
uggccaccuuauggcuauugga

SEQ ID NO: 615026 - RNA, 22 nt, Human
cuguggagcuuguggcaguggg

SEQ ID NO: 615027 - RNA, 19 nt, Human
gcagauccaaaagucacau

SEQ ID NO: 615028 - RNA, 22 nt, Human
cugcccuggaaaacguaucuua

SEQ ID NO: 615029 - RNA, 22 nt, Human
uggcuuggcuaagaucuaagcu

SEQ ID NO: 615030 - RNA, 22 nt, Human
cucaaauagaacugaucuauaa

SEQ ID NO: 615031 - RNA, 22 nt, Human
uucacagaccaggaggcuguga

SEQ ID NO: 615032 - RNA, 22 nt, Human
gugcccuggaugacuuuggucu

SEQ ID NO: 615033 - RNA, 22 nt, Human
gaggcuagagcaggggcucaau

SEQ ID NO: 615034 - RNA, 22 nt, Human
gcaguggggaaugcuggggaga

SEQ ID NO: 615035 - RNA, 22 nt, Human
uaccuguuuuaaagcuaaaagg

SEQ ID NO: 615036 - RNA, 20 nt, Human
aucaaaauccuauugagguu

SEQ ID NO: 615037 - RNA, 22 nt, Human
uggcucuguucgccaucaggag

SEQ ID NO: 615038 - RNA, 22 nt, Human
cagaggucccuguucuuaagga

SEQ ID NO: 615039 - RNA, 22 nt, Human
uccagccuugccacuuuucugu

SEQ ID NO: 615040 - RNA, 22 nt, Human
ccaggcugugguuuagauagag

SEQ ID NO: 615041 - RNA, 22 nt, Human
aggacuggcccugaggggaggc

SEQ ID NO: 615042 - RNA, 23 nt, Human
augcccuguagaggcugcugacc

SEQ ID NO: 615043 - RNA, 22 nt, Human
gauaaauugcacuuuuucuuac

SEQ ID NO: 615044 - RNA, 22 nt, Human
gugcagagagguggagggacuu

SEQ ID NO: 615045 - RNA, 22 nt, Human
gucaaaaaguagucauuucugu

SEQ ID NO: 615046 - RNA, 22 nt, Human
agugcaggagccuggccagagc

SEQ ID NO: 615047 - RNA, 22 nt, Human
cagagcggccacuagagggcgc

SEQ ID NO: 615048 - RNA, 22 nt, Human
auuccuugcucucaucaaccuu

SEQ ID NO: 615049 - RNA, 22 nt, Human
gcagguccagucaccagagaga

SEQ ID NO: 615050 - RNA, 22 nt, Human
aaagaauuuguacacccuacua

SEQ ID NO: 615051 - RNA, 22 nt, Human
guccagagaguaaaggggguaa

SEQ ID NO: 615052 - RNA, 21 nt, Human
ucaguaaaccuaaagauugua

SEQ ID NO: 615053 - RNA, 22 nt, Human
auaaggaaaugaaacucuaaua

SEQ ID NO: 615054 - RNA, 22 nt, Human
aagugcaaaucuguggcugaaa

SEQ ID NO: 615055 - RNA, 22 nt, Human
ggcagguacagcaagaggacaa

SEQ ID NO: 615056 - RNA, 22 nt, Human
aggcagaagccagccagggucc

SEQ ID NO: 615057 - RNA, 22 nt, Human
aaugcaccuaccuugauucugc

SEQ ID NO: 615058 - RNA, 22 nt, Human
agugggagagaagcaaguagua

SEQ ID NO: 615059 - RNA, 22 nt, Human
agguucagaugacuuuuaugcu

SEQ ID NO: 615060 - RNA, 22 nt, Human
aaauuugauaagccauuguuac

SEQ ID NO: 615061 - RNA, 22 nt, Human
cugcauccuaaccuccaugcag

SEQ ID NO: 615062 - RNA, 22 nt, Human
aaaguagaguuguggaauuacu

SEQ ID NO: 615063 - RNA, 18 nt, Human
cugggucuccaggcugcc

SEQ ID NO: 615064 - RNA, 22 nt, Human
caaauagauuguucaauccuga

SEQ ID NO: 615065 - RNA, 22 nt, Human
ccaguguuuuccaguuugccca

SEQ ID NO: 615066 - RNA, 22 nt, Human
gcagcaggcacuuaccguugcu

SEQ ID NO: 615067 - RNA, 22 nt, Human
gguccagggaacuuugaaggau

SEQ ID NO: 615068 - RNA, 19 nt, Human
cgcagguggaaggagccgc

SEQ ID NO: 615069 - RNA, 22 nt, Human
cagauaacacaaagaaaugggc

SEQ ID NO: 615070 - RNA, 22 nt, Human
auguguuuauaauuacucaauc

SEQ ID NO: 615071 - RNA, 22 nt, Human
uaugcuuuacuuuucauuguga

SEQ ID NO: 615072 - RNA, 22 nt, Human
guccugggcccaggggcugccu

SEQ ID NO: 615073 - RNA, 22 nt, Human
ugcccuggaaccaucuacaguc

SEQ ID NO: 615074 - RNA, 22 nt, Human
ucagguccucugggucccagcc

SEQ ID NO: 615075 - RNA, 22 nt, Human
agguccugucuaucacccucgc

SEQ ID NO: 615076 - RNA, 22 nt, Human
gugcccuggcucacagugucuc

SEQ ID NO: 615077 - RNA, 22 nt, Human
gggacaauggaggccucucucc

SEQ ID NO: 615078 - RNA, 22 nt, Human
uguggggaucuucuagcuuuuc

SEQ ID NO: 615079 - RNA, 22 nt, Human
ggcuuuauuugcagccauuguu

SEQ ID NO: 615080 - RNA, 22 nt, Human
gcugagagugggugcagugcuu

SEQ ID NO: 615081 - RNA, 20 nt, Human
ccagagcagccacugaaguu

SEQ ID NO: 615082 - RNA, 22 nt, Human
accaggagccauagagucaggc

SEQ ID NO: 615083 - RNA, 22 nt, Human
ccggcgggcgcggugacgucag

SEQ ID NO: 615084 - RNA, 22 nt, Human
gugcccaguccugccuugacag

SEQ ID NO: 615085 - RNA, 22 nt, Human
gcaguuccuacaguggaaagcg

SEQ ID NO: 615086 - RNA, 22 nt, Human
ggccuguccagccugccuggcu

SEQ ID NO: 615087 - RNA, 22 nt, Human
ggugcaaagauggcaguugcaa

SEQ ID NO: 615088 - RNA, 22 nt, Human
caugagugucaucucagcagcu

SEQ ID NO: 615089 - RNA, 22 nt, Human
agaaaugccuacgagauaggga

SEQ ID NO: 615090 - RNA, 22 nt, Human
auuauaggcuugagccaccgug

SEQ ID NO: 615091 - RNA, 22 nt, Human
aucaaaaugcuccagugauggu

SEQ ID NO: 615092 - RNA, 22 nt, Human
uuccuggggcuccagcuaccag

SEQ ID NO: 615093 - RNA, 23 nt, Human
aguuccagaaaaaugcucaagca

SEQ ID NO: 615094 - RNA, 22 nt, Human
ucacuuagauggggaucaucac

SEQ ID NO: 615095 - RNA, 22 nt, Human
ugagaaugaaucuuuugcuuuc

SEQ ID NO: 615096 - RNA, 22 nt, Human
ccagccugaaaugccucauccu

SEQ ID NO: 615097 - RNA, 22 nt, Human
aaucaagaaaaugaggauucuu

SEQ ID NO: 615098 - RNA, 22 nt, Human
uacagcauugcauuuuccuuug

SEQ ID NO: 615099 - RNA, 22 nt, Human
uccucccuucucacugggaagg

SEQ ID NO: 615100 - RNA, 22 nt, Human
uuucauuucauagaauuguguu

SEQ ID NO: 615101 - RNA, 22 nt, Human
cuccuggcccugagcucccagg

SEQ ID NO: 615102 - RNA, 19 nt, Human
uuggaaggagccagagugg

SEQ ID NO: 615103 - RNA, 22 nt, Human
caggcuccacuguaggcagcuc

SEQ ID NO: 615104 - RNA, 22 nt, Human
agagccagcaagugaauaguga

SEQ ID NO: 615105 - RNA, 22 nt, Human
caggcuggagugaguguagugg

SEQ ID NO: 615106 - RNA, 22 nt, Human
ggagaagggacagacucagcuu

SEQ ID NO: 615107 - RNA, 18 nt, Human
uccugggaaaggcauaca

SEQ ID NO: 615108 - RNA, 22 nt, Human
cugggcucaaauccuggcccug

SEQ ID NO: 615109 - RNA, 22 nt, Human
ggccaggccaagaggguuggaa

SEQ ID NO: 615110 - RNA, 22 nt, Human
cuggaaggcggagguuguagug

SEQ ID NO: 615111 - RNA, 22 nt, Human
cuggcugaggcagagccugggg

SEQ ID NO: 615112 - RNA, 22 nt, Human
agaggcaagauuaucagggcau

SEQ ID NO: 615113 - RNA, 22 nt, Human
uggcagguuaacuuacaacugu

SEQ ID NO: 615114 - RNA, 22 nt, Human
acagaauauuguaagugccacu

SEQ ID NO: 615115 - RNA, 20 nt, Human
agugcaagaaagcacagcug

SEQ ID NO: 615116 - RNA, 22 nt, Human
guuauuuucauuggcucagacu

SEQ ID NO: 615117 - RNA, 22 nt, Human
aggagaggcucuaacucugugu

SEQ ID NO: 615118 - RNA, 22 nt, Human
ugguugugucacuuagauuaga

SEQ ID NO: 615119 - RNA, 22 nt, Human
agaggcagaaguguucaaaccc

SEQ ID NO: 615120 - RNA, 22 nt, Human
aagcagaguuagcuugucaccu

SEQ ID NO: 615121 - RNA, 16 nt, Human
uugcccugaggggagg

SEQ ID NO: 615122 - RNA, 18 nt, Human
uggcagguagacucaggu

SEQ ID NO: 615123 - RNA, 22 nt, Human
gcaguguuaccucuucaguggg

SEQ ID NO: 615124 - RNA, 22 nt, Human
cgccggcuugaggcaggcggca

SEQ ID NO: 615125 - RNA, 22 nt, Human
uacauacauuaccucauuuagu

SEQ ID NO: 615126 - RNA, 22 nt, Human
ugcaggucaucccugugcuucu

SEQ ID NO: 615127 - RNA, 22 nt, Human
ggcaggacauugacuacaguga

SEQ ID NO: 615128 - RNA, 22 nt, Human
ccaguguuuccccagaagagag

SEQ ID NO: 615129 - RNA, 20 nt, Human
ucagccuucucauccugggg

SEQ ID NO: 615130 - RNA, 22 nt, Human
ggcagguggacgugcuaaagcu

SEQ ID NO: 615131 - RNA, 22 nt, Human
agcagggggcauccuugcccuu

SEQ ID NO: 615132 - RNA, 19 nt, Human
acagucagggaauaaagac

SEQ ID NO: 615133 - RNA, 23 nt, Human
uggacgccgacuuuggaggcgcu

SEQ ID NO: 615134 - RNA, 22 nt, Human
ucugugugcccaccugacaccu

SEQ ID NO: 615135 - RNA, 21 nt, Human
acaaaggaagucucuuuuaag

SEQ ID NO: 615136 - RNA, 22 nt, Human
ugauuucucauauuguucaaaa

SEQ ID NO: 615137 - RNA, 22 nt, Human
cugggagaugacucagagcagg

SEQ ID NO: 615138 - RNA, 21 nt, Human
gggccacucuagagaaagaaa

SEQ ID NO: 615139 - RNA, 22 nt, Human
uuggaaaugcaaauauauugaa

SEQ ID NO: 615140 - RNA, 22 nt, Human
gcuggcugggucccugagaggc

SEQ ID NO: 615141 - RNA, 22 nt, Human
agcuggcuucucugcagacauu

SEQ ID NO: 615142 - RNA, 22 nt, Human
agguaccauaugcgggagcaac

SEQ ID NO: 615143 - RNA, 22 nt, Human
gguccagguauguggugugaau

SEQ ID NO: 615144 - RNA, 22 nt, Human
auucacaaaugcugccccauuc

SEQ ID NO: 615145 - RNA, 22 nt, Human
ugcaggucaaucuucagguucc

SEQ ID NO: 615146 - RNA, 22 nt, Human
cuucauguucugccuguggaag

SEQ ID NO: 615147 - RNA, 22 nt, Human
uuagagaauuccaaaugacuac

SEQ ID NO: 615148 - RNA, 20 nt, Human
agggucaguagcacagagcu

SEQ ID NO: 615149 - RNA, 22 nt, Human
caggcugggcagccuccccggc

SEQ ID NO: 615150 - RNA, 22 nt, Human
accugaggacuggaugguagaa

SEQ ID NO: 615151 - RNA, 22 nt, Human
ugguccugucucaaggagccuu

SEQ ID NO: 615152 - RNA, 22 nt, Human
ccagcucuggcuucuugcuggg

SEQ ID NO: 615153 - RNA, 18 nt, Human
ggccucuggacuggcagc

SEQ ID NO: 615154 - RNA, 22 nt, Human
aaauuacagaucaccaaugcau

SEQ ID NO: 615155 - RNA, 22 nt, Human
cugagggcuggagcugaggccu

SEQ ID NO: 615156 - RNA, 22 nt, Human
ugcuuaaaggauaguuuaaacu

SEQ ID NO: 615157 - RNA, 21 nt, Human
agaagccaugccaguaaaauu

SEQ ID NO: 615158 - RNA, 22 nt, Human
accugaggaagggcgagaagcu

SEQ ID NO: 615159 - RNA, 22 nt, Human
ccugcagguuucccccggacgg

SEQ ID NO: 615160 - RNA, 22 nt, Human
caggccaggguugagaagagaa

SEQ ID NO: 615161 - RNA, 20 nt, Human
gcuguggcaaagcuuugugu

SEQ ID NO: 615162 - RNA, 22 nt, Human
auuugucaauaagaugaacaua

SEQ ID NO: 615163 - RNA, 22 nt, Human
uauaaauuauuaggcugcuaaa

SEQ ID NO: 615164 - RNA, 22 nt, Human
uccuucaacuuuuuacuugccc

SEQ ID NO: 615165 - RNA, 22 nt, Human
aagccuucccuuuuugagcuca

SEQ ID NO: 615166 - RNA, 22 nt, Human
ugcaggucucugcaaggccuau

SEQ ID NO: 615167 - RNA, 22 nt, Human
uguuccuggggaccugccuucc

SEQ ID NO: 615168 - RNA, 22 nt, Human
aaagagaaaaagaucccggcuc

SEQ ID NO: 615169 - RNA, 22 nt, Human
ccuggccuuaagggcagggagc

SEQ ID NO: 615170 - RNA, 22 nt, Human
ugccagcucccuuuucuccucc

SEQ ID NO: 615171 - RNA, 22 nt, Human
gagcauuuuugucugcauuuua

SEQ ID NO: 615172 - RNA, 22 nt, Human
aaucuguuaagaacagaaaugu

SEQ ID NO: 615173 - RNA, 22 nt, Human
cccagcucuggaagguggggga

SEQ ID NO: 615174 - RNA, 22 nt, Human
guagaauauaugguuaguauug

SEQ ID NO: 615175 - RNA, 23 nt, Human
uaacucugugaagggugacuggg

SEQ ID NO: 615176 - RNA, 22 nt, Human
aagcagagaaaagcuuagguuc

SEQ ID NO: 615177 - RNA, 19 nt, Human
gagcgcagagggcagggga

SEQ ID NO: 615178 - RNA, 22 nt, Human
ugaggcaggaggauugcaggau

SEQ ID NO: 615179 - RNA, 22 nt, Human
gggcuuuagauugcagaggauu

SEQ ID NO: 615180 - RNA, 22 nt, Human
cugcccugagucaugccagaug

SEQ ID NO: 615181 - RNA, 21 nt, Human
cugugcuuuuuaagugugaug

SEQ ID NO: 615182 - RNA, 22 nt, Human
aaauauugguaggaugcuuguu

SEQ ID NO: 615183 - RNA, 22 nt, Human
accaggaguuuugaccaggggc

SEQ ID NO: 615184 - RNA, 22 nt, Human
cuguggcuaugguguacauacu

SEQ ID NO: 615185 - RNA, 22 nt, Human
cugcccuguuuggacagcccgg

SEQ ID NO: 615186 - RNA, 21 nt, Human
cagcuccacuaaagcagcugu

SEQ ID NO: 615187 - RNA, 22 nt, Human
aaccagagaaauggagugauaa

SEQ ID NO: 615188 - RNA, 22 nt, Human
ggagaggugcaggucaguggca

SEQ ID NO: 615189 - RNA, 22 nt, Human
gacagcagagcagacuaaugga

SEQ ID NO: 615190 - RNA, 22 nt, Human
cagagaaacucagauagcugau

SEQ ID NO: 615191 - RNA, 22 nt, Human
gccuguuucccugacgcuuaca

SEQ ID NO: 615192 - RNA, 22 nt, Human
ugggugaggagaggcugucuaa

SEQ ID NO: 615193 - RNA, 22 nt, Human
gaggccugggagaacuguuuuu

SEQ ID NO: 615194 - RNA, 22 nt, Human
guccagagccggaagagugaca

SEQ ID NO: 615195 - RNA, 19 nt, Human
gaggcgaggcgugcaggag

SEQ ID NO: 615196 - RNA, 22 nt, Human
auguggcuaguccucugcggca

SEQ ID NO: 615197 - RNA, 22 nt, Human
agcuccaggaucugaaaguucg

SEQ ID NO: 615198 - RNA, 18 nt, Human
uucuggcucacucaugcu

SEQ ID NO: 615199 - RNA, 22 nt, Human
acaauguuuuuguucaaagagu

SEQ ID NO: 615200 - RNA, 22 nt, Human
ugaagcaggaaccagcagcauu

SEQ ID NO: 615201 - RNA, 21 nt, Human
gcagccaggacuuugggcugg

SEQ ID NO: 615202 - RNA, 22 nt, Human
cuuaucagauuaucugggcugu

SEQ ID NO: 615203 - RNA, 22 nt, Human
gucacuuuauuaauuuugguga

SEQ ID NO: 615204 - RNA, 22 nt, Human
caggcagggagccacuguauaa

SEQ ID NO: 615205 - RNA, 22 nt, Human
uucuuuuuggauagcugaugaa

SEQ ID NO: 615206 - RNA, 22 nt, Human
guuuauaaggcccaauauuucu

SEQ ID NO: 615207 - RNA, 22 nt, Human
aagcaauagcaacaacuuuaca

SEQ ID NO: 615208 - RNA, 19 nt, Human
ucccucagucugccaggcc

SEQ ID NO: 615209 - RNA, 22 nt, Human
ccaguguucaauacauauuugu

SEQ ID NO: 615210 - RNA, 22 nt, Human
aaaaugcuauuucauggaggag

SEQ ID NO: 615211 - RNA, 22 nt, Human
aguuagagacacaugcacaugc

SEQ ID NO: 615212 - RNA, 22 nt, Human
uagugcaaggauugcugcagag

SEQ ID NO: 615213 - RNA, 20 nt, Human
uaaagacauaagcuacuauc

SEQ ID NO: 615214 - RNA, 22 nt, Human
cugccacuuacuaggcauggug

SEQ ID NO: 615215 - RNA, 22 nt, Human
ucaguguucuggauuuggggca

SEQ ID NO: 615216 - RNA, 22 nt, Human
gccuggagcagacgugucccgg

SEQ ID NO: 615217 - RNA, 22 nt, Human
cagggaugggauggagucaguu

SEQ ID NO: 615218 - RNA, 22 nt, Human
gcugaggcuuagcuaaaaauuu

SEQ ID NO: 615219 - RNA, 22 nt, Human
ugcaggucuccauuggcagacu

SEQ ID NO: 615220 - RNA, 22 nt, Human
gaauuacagccagaagaaugaa

SEQ ID NO: 615221 - RNA, 22 nt, Human
ucagaacaauuccuuuauaaca

SEQ ID NO: 615222 - RNA, 22 nt, Human
guuuuacacaccuaugaaagac

SEQ ID NO: 615223 - RNA, 22 nt, Human
ucugggagcacacgcagugauc

SEQ ID NO: 615224 - RNA, 22 nt, Human
agcuucauaauuccuugacuca

SEQ ID NO: 615225 - RNA, 22 nt, Human
ugaggcaggacuugcauaaagu

SEQ ID NO: 615226 - RNA, 22 nt, Human
gcaaggagacuguagggccaag

SEQ ID NO: 615227 - RNA, 22 nt, Human
cagcuguucacauuuccaaaac

SEQ ID NO: 615228 - RNA, 22 nt, Human
gcugggagaggcccugaaguga

SEQ ID NO: 615229 - RNA, 19 nt, Human
cuccaaguuaagagggagg

SEQ ID NO: 615230 - RNA, 22 nt, Human
ugugugcuaauguaugcucuaa

SEQ ID NO: 615231 - RNA, 22 nt, Human
guauagaaacccagaaagauag

SEQ ID NO: 615232 - RNA, 22 nt, Human
uuuagcaauuauuaaggguuga

SEQ ID NO: 615233 - RNA, 22 nt, Human
augaggcaugugaggagaaggg

SEQ ID NO: 615234 - RNA, 22 nt, Human
ccuccuggugggcgcuucuggc

SEQ ID NO: 615235 - RNA, 22 nt, Human
cuggcucuaagugucagcuccc

SEQ ID NO: 615236 - RNA, 22 nt, Human
aggcauggguagaagagaagcc

SEQ ID NO: 615237 - RNA, 22 nt, Human
cugcauccuggaaauagcuaag

SEQ ID NO: 615238 - RNA, 22 nt, Human
cagaaagcgggaugcagcaugu

SEQ ID NO: 615239 - RNA, 22 nt, Human
ccuuccuuucagggcuaugccu

SEQ ID NO: 615240 - RNA, 20 nt, Human
auuauucauacaugugugac

SEQ ID NO: 615241 - RNA, 22 nt, Human
agaaggguaguuguaagaguga

SEQ ID NO: 615242 - RNA, 22 nt, Human
aggcaguggcugagaccagggg

SEQ ID NO: 615243 - RNA, 22 nt, Human
ucaaaggaaacgugguccuggc

SEQ ID NO: 615244 - RNA, 22 nt, Human
aauguguucacaggaaauacag

SEQ ID NO: 615245 - RNA, 22 nt, Human
ucaaagagcuauucaguugugg

SEQ ID NO: 615246 - RNA, 22 nt, Human
gcaguguuccuucuacuggggc

SEQ ID NO: 615247 - RNA, 22 nt, Human
aaugaacuggagaacaaugacc

SEQ ID NO: 615248 - RNA, 22 nt, Human
accuucaacucaaaguguccca

SEQ ID NO: 615249 - RNA, 22 nt, Human
aaguagcaaucucauuaguugg

SEQ ID NO: 615250 - RNA, 22 nt, Human
agggagaggagggucuuguuga

SEQ ID NO: 615251 - RNA, 22 nt, Human
auggcagaccugggcuggagaa

SEQ ID NO: 615252 - RNA, 22 nt, Human
ugucauuuaguccucugugugu

SEQ ID NO: 615253 - RNA, 22 nt, Human
acagaacaggcugagaaaaaca

SEQ ID NO: 615254 - RNA, 22 nt, Human
uuuacauggaauauugucuugu

SEQ ID NO: 615255 - RNA, 22 nt, Human
uucuuuuaauguucugaaguuu

SEQ ID NO: 615256 - RNA, 22 nt, Human
agcuccugaguagcuuuacuca

SEQ ID NO: 615257 - RNA, 22 nt, Human
ugggagaaucuugcucugcuac

SEQ ID NO: 615258 - RNA, 22 nt, Human
uccucagcaaacacuucacucu

SEQ ID NO: 615259 - RNA, 22 nt, Human
cggcaggugugcucacucugcc

SEQ ID NO: 615260 - RNA, 22 nt, Human
cagggcaaagucuucuagaacc

SEQ ID NO: 615261 - RNA, 22 nt, Human
guggaaggugcuagaacaagga

SEQ ID NO: 615262 - RNA, 22 nt, Human
cacagauagaccuuaugagauu

SEQ ID NO: 615263 - RNA, 22 nt, Human
ucccuuguccucuucgucacug

SEQ ID NO: 615264 - RNA, 22 nt, Human
ugcuuaaacacauacauacaua

SEQ ID NO: 615265 - RNA, 22 nt, Human
ggcugaggcucaugccaucuug

SEQ ID NO: 615266 - RNA, 22 nt, Human
aacagaaggggguauuuacauu

SEQ ID NO: 615267 - RNA, 21 nt, Human
gccugggauaguggccuccgg

SEQ ID NO: 615268 - RNA, 22 nt, Human
ugaggccugaagccuggagccu

SEQ ID NO: 615269 - RNA, 22 nt, Human
gagccaggucgggccgcggcga

SEQ ID NO: 615270 - RNA, 22 nt, Human
augcuugggacucccuguagca

SEQ ID NO: 615271 - RNA, 22 nt, Human
uagcaaaagcucaacaggaagg

SEQ ID NO: 615272 - RNA, 19 nt, Human
accugccaugacagccuga

SEQ ID NO: 615273 - RNA, 22 nt, Human
caggaacaacucccagcaucuc

SEQ ID NO: 615274 - RNA, 22 nt, Human
ugaccuguguuugcuguugcuc

SEQ ID NO: 615275 - RNA, 22 nt, Human
ugacagaacagguugggagcaa

SEQ ID NO: 615276 - RNA, 22 nt, Human
cuggcuuguuuuaagaauacaa

SEQ ID NO: 615277 - RNA, 18 nt, Human
aggcaggugcuaauauuu

SEQ ID NO: 615278 - RNA, 22 nt, Human
gcuggcuguaucaccuggccag

SEQ ID NO: 615279 - RNA, 22 nt, Human
uuccuacagcccugaaucucua

SEQ ID NO: 615280 - RNA, 23 nt, Human
ucuguuuugcaacaugugacaag

SEQ ID NO: 615281 - RNA, 22 nt, Human
auguacaaucuaucacaagaag

SEQ ID NO: 615282 - RNA, 22 nt, Human
aaauaugugaucagugaauaaa

SEQ ID NO: 615283 - RNA, 22 nt, Human
ggcuuuauauuguuugagcaga

SEQ ID NO: 615284 - RNA, 22 nt, Human
ggccuugguuccaaagcaggca

SEQ ID NO: 615285 - RNA, 22 nt, Human
gccaggcuguggggaacuugaa

SEQ ID NO: 615286 - RNA, 22 nt, Human
aagauacaucauucaggaguga

SEQ ID NO: 615287 - RNA, 22 nt, Human
ccaaaccauccaucuccaggcu

SEQ ID NO: 615288 - RNA, 20 nt, Human
aaguccugaccuagucuaaa

SEQ ID NO: 615289 - RNA, 23 nt, Human
aaagaugugaguauucauauggc

SEQ ID NO: 615290 - RNA, 21 nt, Human
aagaggaagcauuauggcaua

SEQ ID NO: 615291 - RNA, 22 nt, Human
cuguccuccagacgacaguccc

SEQ ID NO: 615292 - RNA, 22 nt, Human
uuauuuacaacucuucucuucc

SEQ ID NO: 615293 - RNA, 22 nt, Human
ugaggcagugcugggaagccug

SEQ ID NO: 615294 - RNA, 22 nt, Human
auggaagggacagaagggcaag

SEQ ID NO: 615295 - RNA, 22 nt, Human
caggcccagcccuuagccaggu

SEQ ID NO: 615296 - RNA, 22 nt, Human
cauggccacaucuagcugcaag

SEQ ID NO: 615297 - RNA, 22 nt, Human
ucccaggguuacagccagggca

SEQ ID NO: 615298 - RNA, 22 nt, Human
uacaacaguucaugaaaugaaa

SEQ ID NO: 615299 - RNA, 22 nt, Human
aagcacugggaggaggcugaga

SEQ ID NO: 615300 - RNA, 22 nt, Human
ccuggagaccagaggauacuuc

SEQ ID NO: 615301 - RNA, 22 nt, Human
ugccaccuaguggucuuuaguc

SEQ ID NO: 615302 - RNA, 22 nt, Human
gugcuggggagauaggaagaga

SEQ ID NO: 615303 - RNA, 22 nt, Human
aggcccuuaggaccccugcgug

SEQ ID NO: 615304 - RNA, 22 nt, Human
ggcugggagccccacagaguca

SEQ ID NO: 615305 - RNA, 22 nt, Human
uacaagagacaccagggaggcu

SEQ ID NO: 615306 - RNA, 22 nt, Human
cuuaagauugucagcuucagcc

SEQ ID NO: 615307 - RNA, 22 nt, Human
cuuggccugacauguggcaggg

SEQ ID NO: 615308 - RNA, 22 nt, Human
gcuggcuuuugaagucuagcua

SEQ ID NO: 615309 - RNA, 22 nt, Human
ggaaagauuugucacaugaaug

SEQ ID NO: 615310 - RNA, 22 nt, Human
uuccuugaccacugcauaauga

SEQ ID NO: 615311 - RNA, 22 nt, Human
cagaggcugcucuggguggcau

SEQ ID NO: 615312 - RNA, 19 nt, Human
uccagccugcuguuucucu

SEQ ID NO: 615313 - RNA, 22 nt, Human
ucagcaggguuugacuucuaau

SEQ ID NO: 615314 - RNA, 22 nt, Human
agcacaugcacagugcuacacu

SEQ ID NO: 615315 - RNA, 22 nt, Human
aguuuccuuggauucaauuugg

SEQ ID NO: 615316 - RNA, 22 nt, Human
caccaggcugaaccagagggga

SEQ ID NO: 615317 - RNA, 22 nt, Human
uccugggcuuaagugauccucc

SEQ ID NO: 615318 - RNA, 22 nt, Human
uccugcaggcuugaguccucag

SEQ ID NO: 615319 - RNA, 22 nt, Human
cuccugggaugacucuuucuuu

SEQ ID NO: 615320 - RNA, 22 nt, Human
ucuguggccugccuccucauuu

SEQ ID NO: 615321 - RNA, 22 nt, Human
uacaaaguuugggguccucaaa

SEQ ID NO: 615322 - RNA, 20 nt, Human
gggaggccccagaguccagg

SEQ ID NO: 615323 - RNA, 22 nt, Human
aagugcuuuacaaaugucuguu

SEQ ID NO: 615324 - RNA, 22 nt, Human
ugguccaguagcagggauacca

SEQ ID NO: 615325 - RNA, 21 nt, Human
aaagcagcccauggcacaguc

SEQ ID NO: 615326 - RNA, 22 nt, Human
gcucaccacugcuagagucuau

SEQ ID NO: 615327 - RNA, 19 nt, Human
cugggcugaggucugccuu

SEQ ID NO: 615328 - RNA, 22 nt, Human
augcccugcucucgggaaggga

SEQ ID NO: 615329 - RNA, 22 nt, Human
acaccuuugccccaagucauag

SEQ ID NO: 615330 - RNA, 22 nt, Human
cuccaggguuccccgauccacu

SEQ ID NO: 615331 - RNA, 22 nt, Human
cuggccuggucuggccucucca

SEQ ID NO: 615332 - RNA, 22 nt, Human
gccugguggugugcucaagugg

SEQ ID NO: 615333 - RNA, 22 nt, Human
uucuuuguggcagugagcuggg

SEQ ID NO: 615334 - RNA, 22 nt, Human
ugaacacacacaucuuaauaau

SEQ ID NO: 615335 - RNA, 22 nt, Human
gaaagaaugcuauagugacuuc

SEQ ID NO: 615336 - RNA, 22 nt, Human
gcaguguuaaugcgaguguuca

SEQ ID NO: 615337 - RNA, 22 nt, Human
ugaagcaggguggccagauugu

SEQ ID NO: 615338 - RNA, 22 nt, Human
gccuguuuaaguauucugacau

SEQ ID NO: 615339 - RNA, 22 nt, Human
aaucauaauuguauacauucau

SEQ ID NO: 615340 - RNA, 22 nt, Human
cuggcucuucagugcuugguuc

SEQ ID NO: 615341 - RNA, 22 nt, Human
gcucuuuggauuccuuuacaaa

SEQ ID NO: 615342 - RNA, 22 nt, Human
uuuucaugucauguccuugagg

SEQ ID NO: 615343 - RNA, 22 nt, Human
uccaaaggcccuaauaagcuug

SEQ ID NO: 615344 - RNA, 20 nt, Human
accaggagauggaggcaggg

SEQ ID NO: 615345 - RNA, 20 nt, Human
uccugagugcaguuggcuug

SEQ ID NO: 615346 - RNA, 22 nt, Human
cugccuuugcccuugacacugu

SEQ ID NO: 615347 - RNA, 19 nt, Human
cuuugcuuguuucuguguc

SEQ ID NO: 615348 - RNA, 22 nt, Human
agcacagagguggaaguguaua

SEQ ID NO: 615349 - RNA, 22 nt, Human
ugccauuucuuucaauauucuu

SEQ ID NO: 615350 - RNA, 22 nt, Human
cuccuggggcacuuagaagcaa

SEQ ID NO: 615351 - RNA, 22 nt, Human
ggcacacaaaggcagcauuuga

SEQ ID NO: 615352 - RNA, 21 nt, Human
uggcucugcucagagcagucc

SEQ ID NO: 615353 - RNA, 22 nt, Human
uccuggccugucuggaguagcu

SEQ ID NO: 615354 - RNA, 17 nt, Human
aggcagguaagaguuau

SEQ ID NO: 615355 - RNA, 22 nt, Human
agaauaugaucggaauacagau

SEQ ID NO: 615356 - RNA, 21 nt, Human
gugcccuguucccacaugccc

SEQ ID NO: 615357 - RNA, 20 nt, Human
gggaugagaguccuagcucu

SEQ ID NO: 615358 - RNA, 22 nt, Human
aacagugucaggauuacagaua

SEQ ID NO: 615359 - RNA, 22 nt, Human
gcacaaaagguacuucauguag

SEQ ID NO: 615360 - RNA, 22 nt, Human
agucucugucguagaucagcgu

SEQ ID NO: 615361 - RNA, 21 nt, Human
ccagaggccucucuuggccac

SEQ ID NO: 615362 - RNA, 22 nt, Human
uuaaaaauauguagggcccgau

SEQ ID NO: 615363 - RNA, 22 nt, Human
agccuugaaugcgcugcauugg

SEQ ID NO: 615364 - RNA, 22 nt, Human
aauguuugugcauaaauauguu

SEQ ID NO: 615365 - RNA, 22 nt, Human
caguguuuguggaauucaggug

SEQ ID NO: 615366 - RNA, 22 nt, Human
aagcagagaccggcuaauggag

SEQ ID NO: 615367 - RNA, 22 nt, Human
uccaggagacacaagguacaua

SEQ ID NO: 615368 - RNA, 23 nt, Human
agcuccaggugauuguaaugugu

SEQ ID NO: 615369 - RNA, 22 nt, Human
gcugaggcggaaggauugcuag

SEQ ID NO: 615370 - RNA, 22 nt, Human
ucccugggaccggcagcucaca

SEQ ID NO: 615371 - RNA, 22 nt, Human
ugggccagcacugggugcucau

SEQ ID NO: 615372 - RNA, 22 nt, Human
uccagagcagguggucagaagg

SEQ ID NO: 615373 - RNA, 22 nt, Human
aaaucgguugguucaagguaau

SEQ ID NO: 615374 - RNA, 20 nt, Human
uggccuuggggagcucacac

SEQ ID NO: 615375 - RNA, 22 nt, Human
guccugugugagugcaccaccu

SEQ ID NO: 615376 - RNA, 20 nt, Human
cacagagucuugcagcguuc

SEQ ID NO: 615377 - RNA, 17 nt, Human
ccucagcuucuuuccuc

SEQ ID NO: 615378 - RNA, 22 nt, Human
aauaaugagacagcuuauuuaa

SEQ ID NO: 615379 - RNA, 22 nt, Human
ggagcuguguuauccauuccca

SEQ ID NO: 615380 - RNA, 22 nt, Human
agagccugugauugucaucacc

SEQ ID NO: 615381 - RNA, 22 nt, Human
guggaaggaagagauggcccca

SEQ ID NO: 615382 - RNA, 22 nt, Human
acaguguucugcuuuuuaaucc

SEQ ID NO: 615383 - RNA, 22 nt, Human
uuagcaaauaucuugaaacagg

SEQ ID NO: 615384 - RNA, 22 nt, Human
ugaggcaggacauggacaacug

SEQ ID NO: 615385 - RNA, 22 nt, Human
caucaugucugcaggaaugugu

SEQ ID NO: 615386 - RNA, 20 nt, Human
uauaaauucagagcuuuggu

SEQ ID NO: 615387 - RNA, 22 nt, Human
ugccgcuccaggucucgcggug

SEQ ID NO: 615388 - RNA, 22 nt, Human
uccugccaggagugcuggcccu

SEQ ID NO: 615389 - RNA, 20 nt, Human
augcccuguccucuucuguu

SEQ ID NO: 615390 - RNA, 22 nt, Human
uccuggcccgaucccugugaag

SEQ ID NO: 615391 - RNA, 22 nt, Human
ugucucaucucuuaaccccacu

SEQ ID NO: 615392 - RNA, 22 nt, Human
caccuguuagcucuaauuuucu

SEQ ID NO: 615393 - RNA, 21 nt, Human
uucuuucugaaucugaaguau

SEQ ID NO: 615394 - RNA, 22 nt, Human
uuucagagucuggcugcagccu

SEQ ID NO: 615395 - RNA, 20 nt, Human
gaaguccuuucacucuuccc

SEQ ID NO: 615396 - RNA, 22 nt, Human
uuuuauaaagagagucaguugg

SEQ ID NO: 615397 - RNA, 22 nt, Human
cccugcagagccagcccugacc

SEQ ID NO: 615398 - RNA, 22 nt, Human
gccaggcucucagugacugccc

SEQ ID NO: 615399 - RNA, 22 nt, Human
gcugggagugggcaagaugaga

SEQ ID NO: 615400 - RNA, 22 nt, Human
cugugcuucagagucagugcug

SEQ ID NO: 615401 - RNA, 21 nt, Human
cuguccucagauguggacgag

SEQ ID NO: 615402 - RNA, 22 nt, Human
uuccauuuuucuaacucucaga

SEQ ID NO: 615403 - RNA, 22 nt, Human
accuguuuguguuuggacugca

SEQ ID NO: 615404 - RNA, 22 nt, Human
uggccugaguugucugcaggcc

SEQ ID NO: 615405 - RNA, 22 nt, Human
auucauaacggcaaaugucacc

SEQ ID NO: 615406 - RNA, 22 nt, Human
ggcgccagcccaggccgucgug

SEQ ID NO: 615407 - RNA, 22 nt, Human
ccaguguuccagagagcugaug

SEQ ID NO: 615408 - RNA, 22 nt, Human
uaaaugaguaauauagcuguuu

SEQ ID NO: 615409 - RNA, 22 nt, Human
gacccugaggaugcaccagcag

SEQ ID NO: 615410 - RNA, 22 nt, Human
gacagcagacaaaccauguuuu

SEQ ID NO: 615411 - RNA, 22 nt, Human
augaauugaaagaagaauaucu

SEQ ID NO: 615412 - RNA, 22 nt, Human
ggagaaggcgaagucauucuuu

SEQ ID NO: 615413 - RNA, 18 nt, Human
ucucuucuuggcagucaa

SEQ ID NO: 615414 - RNA, 22 nt, Human
guccagaguauucaaguaacuu

SEQ ID NO: 615415 - RNA, 22 nt, Human
aaagauaauguuuccuuauucu

SEQ ID NO: 615416 - RNA, 22 nt, Human
caaaugaauuucccugcaaaug

SEQ ID NO: 615417 - RNA, 22 nt, Human
uuuauuauguacaggcacuaua

SEQ ID NO: 615418 - RNA, 22 nt, Human
aacacauggcaagagcaggaaa

SEQ ID NO: 615419 - RNA, 22 nt, Human
ugaagcaguucucagaaguggg

SEQ ID NO: 615420 - RNA, 22 nt, Human
ucuuggcuccucacagcaucag

SEQ ID NO: 615421 - RNA, 22 nt, Human
gcagcagguccgcaucaucauc

SEQ ID NO: 615422 - RNA, 22 nt, Human
uccaggcauuccagccauucca

SEQ ID NO: 615423 - RNA, 22 nt, Human
agcuccagggaaagaguggauc

SEQ ID NO: 615424 - RNA, 22 nt, Human
caaaugcaugagaaauaagagg

SEQ ID NO: 615425 - RNA, 22 nt, Human
aggagaggaaucauuauuacaa

SEQ ID NO: 615426 - RNA, 22 nt, Human
gaggaaaagagacagguuauug

SEQ ID NO: 615427 - RNA, 20 nt, Human
ugugaaagcaguagaaugac

SEQ ID NO: 615428 - RNA, 22 nt, Human
ggcaggggugaggccacucuga

SEQ ID NO: 615429 - RNA, 22 nt, Human
acaguguuuaaaaaucagaucu

SEQ ID NO: 615430 - RNA, 22 nt, Human
aacauuuaugguagucauugca

SEQ ID NO: 615431 - RNA, 22 nt, Human
auuccuuguauaucuacaugca

SEQ ID NO: 615432 - RNA, 19 nt, Human
uggagaggaaaugcugcuc

SEQ ID NO: 615433 - RNA, 22 nt, Human
ggccaccucugcccuacugagu

SEQ ID NO: 615434 - RNA, 22 nt, Human
gcucucuggaagguaucauuau

SEQ ID NO: 615435 - RNA, 22 nt, Human
gccuguuuaucuaucaugaacu

SEQ ID NO: 615436 - RNA, 22 nt, Human
cugggcccacgagggcucuggg

SEQ ID NO: 615437 - RNA, 22 nt, Human
ccaguguucaucaagaaaaugu

SEQ ID NO: 615438 - RNA, 22 nt, Human
agggcuuuugcaauccaagucu

SEQ ID NO: 615439 - RNA, 22 nt, Human
gcagcgagugcggcugccacag

SEQ ID NO: 615440 - RNA, 22 nt, Human
ucaaguaguacccaaugcgugg

SEQ ID NO: 615441 - RNA, 22 nt, Human
cugguccagaauuuaugauucu

SEQ ID NO: 615442 - RNA, 22 nt, Human
cucuuugugcuauuaugauccu

SEQ ID NO: 615443 - RNA, 22 nt, Human
ucuggccugaaaguccaugcuu

SEQ ID NO: 615444 - RNA, 22 nt, Human
ucaguguuuuaacugucuuuua

SEQ ID NO: 615445 - RNA, 22 nt, Human
uccuuaaaugugaucuagauuu

SEQ ID NO: 615446 - RNA, 22 nt, Human
gggcugugugcccacuucccau

SEQ ID NO: 615447 - RNA, 22 nt, Human
ugccagccuccugauaucaucc

SEQ ID NO: 615448 - RNA, 22 nt, Human
gccaccuguuucgcuugcccag

SEQ ID NO: 615449 - RNA, 22 nt, Human
auacaguguacuauuuagcagu

SEQ ID NO: 615450 - RNA, 22 nt, Human
uuccugggguacuggagaaaau

SEQ ID NO: 615451 - RNA, 22 nt, Human
caagaggagcaggcaggugugc

SEQ ID NO: 615452 - RNA, 22 nt, Human
ggucucaaggaauauaaugagu

SEQ ID NO: 615453 - RNA, 22 nt, Human
agguccagaguugagauacaga

SEQ ID NO: 615454 - RNA, 22 nt, Human
augaggcaggagugcaguggca

SEQ ID NO: 615455 - RNA, 22 nt, Human
acuccugguuuguguccuggcu

SEQ ID NO: 615456 - RNA, 22 nt, Human
ucauuguugacauaccaagagc

SEQ ID NO: 615457 - RNA, 22 nt, Human
ucagcagggccaugcucucucu

SEQ ID NO: 615458 - RNA, 22 nt, Human
uucaggaagguccuauagcaga

SEQ ID NO: 615459 - RNA, 22 nt, Human
uuaugacagaaaugaaaagcug

SEQ ID NO: 615460 - RNA, 22 nt, Human
ccacagguacggauugaggacc

SEQ ID NO: 615461 - RNA, 22 nt, Human
ugcaggagcugcuguccugcuc

SEQ ID NO: 615462 - RNA, 22 nt, Human
gguuccaggcauggcaggaugu

SEQ ID NO: 615463 - RNA, 22 nt, Human
uucauguuuuauucaguaauua

SEQ ID NO: 615464 - RNA, 22 nt, Human
gaggcaugcagagcuggagcag

SEQ ID NO: 615465 - RNA, 21 nt, Human
uggcagggguaguaguacagc

SEQ ID NO: 615466 - RNA, 22 nt, Human
agggaucagcagaggguguggu

SEQ ID NO: 615467 - RNA, 22 nt, Human
guggcucuguaaaaugccugca

SEQ ID NO: 615468 - RNA, 22 nt, Human
caaaggcaugugaguauaugug

SEQ ID NO: 615469 - RNA, 22 nt, Human
uggagugcaguugggaggacac

SEQ ID NO: 615470 - RNA, 22 nt, Human
guaagccugagaaacaccaccu

SEQ ID NO: 615471 - RNA, 22 nt, Human
cgaggcagaggcugaaacggcu

SEQ ID NO: 615472 - RNA, 22 nt, Human
accugccaagcaucaguggcag

SEQ ID NO: 615473 - RNA, 22 nt, Human
augcccugugacucuccuggac

SEQ ID NO: 615474 - RNA, 22 nt, Human
uucaaaacaaucuguuugcauu

SEQ ID NO: 615475 - RNA, 22 nt, Human
aacaaagcaccacugagucagu

SEQ ID NO: 615476 - RNA, 23 nt, Human
ugaagguauuaccugagaugcuc

SEQ ID NO: 615477 - RNA, 22 nt, Human
caagggggcaggaucacacuug

SEQ ID NO: 615478 - RNA, 20 nt, Human
cagugcccguggaaaagaug

SEQ ID NO: 615479 - RNA, 22 nt, Human
acuguggccuuguggguucagg

SEQ ID NO: 615480 - RNA, 22 nt, Human
aaguccaggcuggcguagaguc

SEQ ID NO: 615481 - RNA, 22 nt, Human
uguauuuugugaggaucacucu

SEQ ID NO: 615482 - RNA, 22 nt, Human
acaguacagugcagaggaagau

SEQ ID NO: 615483 - RNA, 22 nt, Human
gacagcaugagagaugccagug

SEQ ID NO: 615484 - RNA, 22 nt, Human
ucaguguucgcucagggacucc

SEQ ID NO: 615485 - RNA, 20 nt, Human
ucacauccucucccaacaug

SEQ ID NO: 615486 - RNA, 22 nt, Human
ugcaaaaauugcuggaaucuuu

SEQ ID NO: 615487 - RNA, 22 nt, Human
cugcccugcagcuccacggacu

SEQ ID NO: 615488 - RNA, 22 nt, Human
ucagccuuugaagggcugcagg

SEQ ID NO: 615489 - RNA, 22 nt, Human
uggccacccccaaugucaguag

SEQ ID NO: 615490 - RNA, 22 nt, Human
guguccagcguggaaugagggu

SEQ ID NO: 615491 - RNA, 20 nt, Human
ugguccaggaccuggugucc

SEQ ID NO: 615492 - RNA, 22 nt, Human
ugucaaaaccuuggaggcaagg

SEQ ID NO: 615493 - RNA, 22 nt, Human
ggugaggguaaauauaggcaaa

SEQ ID NO: 615494 - RNA, 22 nt, Human
ucauucacugcccagcagugua

SEQ ID NO: 615495 - RNA, 22 nt, Human
uuacaacaaaggcacgugcaug

SEQ ID NO: 615496 - RNA, 22 nt, Human
ggccaccuuaaguuaaggauau

SEQ ID NO: 615497 - RNA, 22 nt, Human
gguguccgcgcuguagaagguc

SEQ ID NO: 615498 - RNA, 22 nt, Human
agcagcagauccaaaaaaugug

SEQ ID NO: 615499 - RNA, 19 nt, Human
ugcuauuugaagaagugua

SEQ ID NO: 615500 - RNA, 22 nt, Human
auauuuguuagagucuaugugu

SEQ ID NO: 615501 - RNA, 22 nt, Human
uaggacauaaguauucuaacuu

SEQ ID NO: 615502 - RNA, 19 nt, Human
aguguuaacccaguguugg

SEQ ID NO: 615503 - RNA, 22 nt, Human
acacacaacucauuguguaaua

SEQ ID NO: 615504 - RNA, 22 nt, Human
aguccugguucugauucugaca

SEQ ID NO: 615505 - RNA, 22 nt, Human
aggcuccauuccaggagcuaga

SEQ ID NO: 615506 - RNA, 22 nt, Human
augaggcagguggaggcugcca

SEQ ID NO: 615507 - RNA, 22 nt, Human
ggcuuuauuaacucauccguaa

SEQ ID NO: 615508 - RNA, 22 nt, Human
agagaacagacagaugcaauga

SEQ ID NO: 615509 - RNA, 22 nt, Human
caaaccuugcagaacugggcag

SEQ ID NO: 615510 - RNA, 22 nt, Human
ggcgggagauggggccguucag

SEQ ID NO: 615511 - RNA, 22 nt, Human
guuuauaaugucugugccaaaa

SEQ ID NO: 615512 - RNA, 22 nt, Human
uguauuuucagaguggcauuuc

SEQ ID NO: 615513 - RNA, 22 nt, Human
cagcccugaaacaaccuccucu

SEQ ID NO: 615514 - RNA, 22 nt, Human
uaacuucuggaaaugcaucugc

SEQ ID NO: 615515 - RNA, 22 nt, Human
cuucagaaacuaguaacagcua

SEQ ID NO: 615516 - RNA, 22 nt, Human
agccagggcucuccuucgcgug

SEQ ID NO: 615517 - RNA, 22 nt, Human
ucccauguugugccuggcugca

SEQ ID NO: 615518 - RNA, 22 nt, Human
cuggcccuauuccaggccuucc

SEQ ID NO: 615519 - RNA, 22 nt, Human
ggacaaagccugguggcaggug

SEQ ID NO: 615520 - RNA, 22 nt, Human
cucucccccacagcagccuucu

SEQ ID NO: 615521 - RNA, 22 nt, Human
cugggagagaagcgaagcuggg

SEQ ID NO: 615522 - RNA, 22 nt, Human
cuauauacuuuucacagauguu

SEQ ID NO: 615523 - RNA, 22 nt, Human
cagggugacaaguggcaaggag

SEQ ID NO: 615524 - RNA, 22 nt, Human
uuauuuuaccuuccucugagcu

SEQ ID NO: 615525 - RNA, 22 nt, Human
cuccuggcaguuccccuuguca

SEQ ID NO: 615526 - RNA, 22 nt, Human
gggggcggagcacgugaccacg

SEQ ID NO: 615527 - RNA, 22 nt, Human
gucuguggcaggggagaaguuu

SEQ ID NO: 615528 - RNA, 22 nt, Human
aauguggcauugucauuauugg

SEQ ID NO: 615529 - RNA, 22 nt, Human
ugugaagguagcucuuggcacu

SEQ ID NO: 615530 - RNA, 22 nt, Human
uucagacaauaagagucaucuc

SEQ ID NO: 615531 - RNA, 22 nt, Human
uucuuugugcugaagaagcccu

SEQ ID NO: 615532 - RNA, 22 nt, Human
cuggggauccuuuuugcaucua

SEQ ID NO: 615533 - RNA, 22 nt, Human
cuguggagugcuuggcucagug

SEQ ID NO: 615534 - RNA, 21 nt, Human
ucucugggaggacuugugaga

SEQ ID NO: 615535 - RNA, 22 nt, Human
ccuugcagacaucaguaguggc

SEQ ID NO: 615536 - RNA, 22 nt, Human
uauuauuaugcauagcaugaaa

SEQ ID NO: 615537 - RNA, 22 nt, Human
cuggccuggggccucagcugcu

SEQ ID NO: 615538 - RNA, 22 nt, Human
gggaggagcugagugugugugc

SEQ ID NO: 615539 - RNA, 22 nt, Human
caguaaauacauaucagagaag

SEQ ID NO: 615540 - RNA, 22 nt, Human
ugaggcaggaugcuugcacagg

SEQ ID NO: 615541 - RNA, 22 nt, Human
guccugguagggcucugugucu

SEQ ID NO: 615542 - RNA, 22 nt, Human
ccuggggccccgagccagaagc

SEQ ID NO: 615543 - RNA, 22 nt, Human
gaaaauaggcugcaucuccuuc

SEQ ID NO: 615544 - RNA, 22 nt, Human
uccucccugcacucagugaagu

SEQ ID NO: 615545 - RNA, 22 nt, Human
agggccagcacuccuggcagga

SEQ ID NO: 615546 - RNA, 22 nt, Human
ggacaggugcaaagggcacaug

SEQ ID NO: 615547 - RNA, 22 nt, Human
aguguguacucauauacuucca

SEQ ID NO: 615548 - RNA, 22 nt, Human
ugcccuggugaagugcucuccu

SEQ ID NO: 615549 - RNA, 22 nt, Human
ugccuggguugacucuuagcug

SEQ ID NO: 615550 - RNA, 22 nt, Human
ucauuucaguggcacagaagau

SEQ ID NO: 615551 - RNA, 22 nt, Human
accugcagcugagaaaaugacu

SEQ ID NO: 615552 - RNA, 22 nt, Human
ucuguggccuccuuccacuuac

SEQ ID NO: 615553 - RNA, 22 nt, Human
ccuggcagcgugccgagcugcg

SEQ ID NO: 615554 - RNA, 22 nt, Human
aucccccucuuggauggcggca

SEQ ID NO: 615555 - RNA, 22 nt, Human
ucucuucuaauuaggguccaug

SEQ ID NO: 615556 - RNA, 22 nt, Human
gccacugauuccaagucaauuu

SEQ ID NO: 615557 - RNA, 19 nt, Human
uuccugggguuccauugug

SEQ ID NO: 615558 - RNA, 20 nt, Human
agugggagagggcagacugc

SEQ ID NO: 615559 - RNA, 22 nt, Human
uaccuggggcugggcuuugauu

SEQ ID NO: 615560 - RNA, 22 nt, Human
uccagagccccagucuaguggg

SEQ ID NO: 615561 - RNA, 22 nt, Human
aguugucccggucuagccacuu

SEQ ID NO: 615562 - RNA, 20 nt, Human
ugccagggccagcagaggcu

SEQ ID NO: 615563 - RNA, 21 nt, Human
ugggcucuuuaacccaggcac

SEQ ID NO: 615564 - RNA, 22 nt, Human
uggcagguggcucuggcauucu

SEQ ID NO: 615565 - RNA, 22 nt, Human
acugugugaaacaucaaugugu

SEQ ID NO: 615566 - RNA, 22 nt, Human
ugcacgugggcucucugcucuu

SEQ ID NO: 615567 - RNA, 22 nt, Human
cccuucaagcucucuggguuuu

SEQ ID NO: 615568 - RNA, 22 nt, Human
uccccaguaagccugcacugug

SEQ ID NO: 615569 - RNA, 22 nt, Human
uccucuggcucuuucccuagga

SEQ ID NO: 615570 - RNA, 22 nt, Human
uacaacaggaauuucaacuuug

SEQ ID NO: 615571 - RNA, 22 nt, Human
uuuauuaauguagcauccaugg

SEQ ID NO: 615572 - RNA, 22 nt, Human
gguguucaaaugaacacaugca

SEQ ID NO: 615573 - RNA, 22 nt, Human
ccaaggucuuggacagcuaaug

SEQ ID NO: 615574 - RNA, 22 nt, Human
aggcagguuggggaaaagcacu

SEQ ID NO: 615575 - RNA, 22 nt, Human
uugcccugcggguccugcgcaa

SEQ ID NO: 615576 - RNA, 21 nt, Human
gccugggaaaucugggaagcc

SEQ ID NO: 615577 - RNA, 22 nt, Human
uacauguguucuguuucaaguu

SEQ ID NO: 615578 - RNA, 22 nt, Human
gaagccaacauuccaaguagaa

SEQ ID NO: 615579 - RNA, 22 nt, Human
cgucaucacggcaagcaucucc

SEQ ID NO: 615580 - RNA, 22 nt, Human
gugcccugucucuugucuccag

SEQ ID NO: 615581 - RNA, 22 nt, Human
ugggaaauauucuaaaagucuu

SEQ ID NO: 615582 - RNA, 22 nt, Human
uguccagggauggggucaggga

SEQ ID NO: 615583 - RNA, 23 nt, Human
ugguccugccaacggugccccuc

SEQ ID NO: 615584 - RNA, 22 nt, Human
ccuggggagaagagcuuccccc

SEQ ID NO: 615585 - RNA, 23 nt, Human
acaaugucuguucauaaaauacc

SEQ ID NO: 615586 - RNA, 22 nt, Human
augcccugagcaggccuucaag

SEQ ID NO: 615587 - RNA, 22 nt, Human
gaggcaccagacauggccucau

SEQ ID NO: 615588 - RNA, 22 nt, Human
uacucaaacucacuaagacaga

SEQ ID NO: 615589 - RNA, 22 nt, Human
aggacaaaggaccagaucugga

SEQ ID NO: 615590 - RNA, 22 nt, Human
aauaaugagcuugucuaauugu

SEQ ID NO: 615591 - RNA, 22 nt, Human
uggacuuucuaggguagaggaa

SEQ ID NO: 615592 - RNA, 22 nt, Human
aaccagagugacacucuacaga

SEQ ID NO: 615593 - RNA, 22 nt, Human
gugcuuccucugccaacacucu

SEQ ID NO: 615594 - RNA, 22 nt, Human
auucaauaagucacuguggaau

SEQ ID NO: 615595 - RNA, 22 nt, Human
aaggcugguggauuaugagguc

SEQ ID NO: 615596 - RNA, 21 nt, Human
gucagcagauccagcacuugu

SEQ ID NO: 615597 - RNA, 22 nt, Human
agggcuuugauggcauucucau

SEQ ID NO: 615598 - RNA, 20 nt, Human
gcaggucccuggcaugcaga

SEQ ID NO: 615599 - RNA, 21 nt, Human
caaauacuuagaaacuuaaga

SEQ ID NO: 615600 - RNA, 22 nt, Human
uucuucugacacugaugcugua

SEQ ID NO: 615601 - RNA, 21 nt, Human
cuuuuacauucagucaugaug

SEQ ID NO: 615602 - RNA, 22 nt, Human
gucccuggaucugggacagcug

SEQ ID NO: 615603 - RNA, 22 nt, Human
uuacacaguugguaggggcaga

SEQ ID NO: 615604 - RNA, 22 nt, Human
auuucuguaacuuaugaaaguu

SEQ ID NO: 615605 - RNA, 22 nt, Human
ugcacuuugcaggcauggaaac

SEQ ID NO: 615606 - RNA, 22 nt, Human
caaguagaguucacuugucuuu

SEQ ID NO: 615607 - RNA, 20 nt, Human
cuugauucuuugaugaggua

SEQ ID NO: 615608 - RNA, 20 nt, Human
ggccaccugcuucagacccc

SEQ ID NO: 615609 - RNA, 22 nt, Human
cagguccacggcgcccaggggu

SEQ ID NO: 615610 - RNA, 22 nt, Human
ugacaaagacaaagauaugucc

SEQ ID NO: 615611 - RNA, 22 nt, Human
uagugcaacagggaaagagugu

SEQ ID NO: 615612 - RNA, 17 nt, Human
cuuguugagcucguucc

SEQ ID NO: 615613 - RNA, 23 nt, Human
ugcagaggcaugaucacugcuca

SEQ ID NO: 615614 - RNA, 22 nt, Human
gcagggacaacugugcaccuga

SEQ ID NO: 615615 - RNA, 22 nt, Human
uguggcuuuugcuagcuuugca

SEQ ID NO: 615616 - RNA, 22 nt, Human
uuggcauugaaguuucauuggu

SEQ ID NO: 615617 - RNA, 22 nt, Human
ccucuguacaggucagcaucua

SEQ ID NO: 615618 - RNA, 21 nt, Human
ucagcaggcaccagaaggcug

SEQ ID NO: 615619 - RNA, 22 nt, Human
uaccuguugucacgauaacacu

SEQ ID NO: 615620 - RNA, 22 nt, Human
uuuacaaguacaccuaacagcu

SEQ ID NO: 615621 - RNA, 22 nt, Human
ggccugagaauguaccagaucu

SEQ ID NO: 615622 - RNA, 22 nt, Human
uguccagggggcuuaccuggag

SEQ ID NO: 615623 - RNA, 18 nt, Human
uccuggccacacuaccuu

SEQ ID NO: 615624 - RNA, 22 nt, Human
ggguccagcuacaucagggugg

SEQ ID NO: 615625 - RNA, 22 nt, Human
cagaaauauuccaaguacugca

SEQ ID NO: 615626 - RNA, 22 nt, Human
aaggcagguauugaugccacag

SEQ ID NO: 615627 - RNA, 22 nt, Human
cuguggcucauucuugguggca

SEQ ID NO: 615628 - RNA, 22 nt, Human
agcuggccauugugaguggccu

SEQ ID NO: 615629 - RNA, 22 nt, Human
guccugggaggggcugguccug

SEQ ID NO: 615630 - RNA, 21 nt, Human
ggagaaggacaauguugagua

SEQ ID NO: 615631 - RNA, 22 nt, Human
gggcggggcuuccguccuccac

SEQ ID NO: 615632 - RNA, 21 nt, Human
aggugccaaggagaagcaggc

SEQ ID NO: 615633 - RNA, 22 nt, Human
cagcaggaggugagaugugacc

SEQ ID NO: 615634 - RNA, 22 nt, Human
ugccucuguugagccuuggcug

SEQ ID NO: 615635 - RNA, 22 nt, Human
ugcccuuggguaacuugcugau

SEQ ID NO: 615636 - RNA, 22 nt, Human
cuccugggcugggaacucagcc

SEQ ID NO: 615637 - RNA, 22 nt, Human
aaauauuugucugaggcgguug

SEQ ID NO: 615638 - RNA, 23 nt, Human
cagcuccagugcacucagguagc

SEQ ID NO: 615639 - RNA, 22 nt, Human
aaauaguuuagcucucauuuca

SEQ ID NO: 615640 - RNA, 22 nt, Human
uggaaggccuguuguguccuag

SEQ ID NO: 615641 - RNA, 22 nt, Human
gugaaauauuuaacguccaggu

SEQ ID NO: 615642 - RNA, 22 nt, Human
ugccugggacaugcuguggacu

SEQ ID NO: 615643 - RNA, 22 nt, Human
ugaggcagccugcauuaaagag

SEQ ID NO: 615644 - RNA, 22 nt, Human
auagguccaaggagaggucuuu

SEQ ID NO: 615645 - RNA, 18 nt, Human
gccugccagccgagggac

SEQ ID NO: 615646 - RNA, 22 nt, Human
ugccuucaccaggccuucagcc

SEQ ID NO: 615647 - RNA, 20 nt, Human
uccuggaggcuucauccaua

SEQ ID NO: 615648 - RNA, 22 nt, Human
agguccaggccucaugauggcc

SEQ ID NO: 615649 - RNA, 22 nt, Human
uccaggcaaagccuuguagacg

SEQ ID NO: 615650 - RNA, 22 nt, Human
gugugaaaguaauugcgguuuu

SEQ ID NO: 615651 - RNA, 22 nt, Human
gucuggugggauuccaaguggc

SEQ ID NO: 615652 - RNA, 22 nt, Human
uuuauuaagaugcgaaugcuga

SEQ ID NO: 615653 - RNA, 22 nt, Human
ugagaaugugcaauauccuucc

SEQ ID NO: 615654 - RNA, 22 nt, Human
caugucuuauuuaugcuucuua

SEQ ID NO: 615655 - RNA, 22 nt, Human
uguguguguccucauuugcaga

SEQ ID NO: 615656 - RNA, 22 nt, Human
guuuauaaauucugcuuuuguu

SEQ ID NO: 615657 - RNA, 22 nt, Human
agcccagugggccgaggcgggg

SEQ ID NO: 615658 - RNA, 22 nt, Human
cucuagcugaggucacugcuau

SEQ ID NO: 615659 - RNA, 23 nt, Human
gccucuggagccccagugcucag

SEQ ID NO: 615660 - RNA, 20 nt, Human
ucaggaugugcugagugaag

SEQ ID NO: 615661 - RNA, 22 nt, Human
cuccugggggacagcggcaggg

SEQ ID NO: 615662 - RNA, 22 nt, Human
uauuucacauaccacagagugu

SEQ ID NO: 615663 - RNA, 22 nt, Human
acaaauagagauucaaauaaag

SEQ ID NO: 615664 - RNA, 22 nt, Human
agcauucaaguaauucacuugg

SEQ ID NO: 615665 - RNA, 22 nt, Human
ucccagggcucuagagugcugg

SEQ ID NO: 615666 - RNA, 22 nt, Human
uauuuucauucugugugacugu

SEQ ID NO: 615667 - RNA, 22 nt, Human
ccagaggcuggcaagggcuccu

SEQ ID NO: 615668 - RNA, 22 nt, Human
aaagagaacuuuuacccaagaa

SEQ ID NO: 615669 - RNA, 22 nt, Human
uccuugggaaacaucauguaau

SEQ ID NO: 615670 - RNA, 22 nt, Human
cuucuccuuauaugucccguuc

SEQ ID NO: 615671 - RNA, 22 nt, Human
aggugcaguggcucaugccugu

SEQ ID NO: 615672 - RNA, 22 nt, Human
gaaaaggaaauuuauagagauc

SEQ ID NO: 615673 - RNA, 22 nt, Human
ucuagcugaggguaggagaccu

SEQ ID NO: 615674 - RNA, 22 nt, Human
gagaaagacguaggcugggagg

SEQ ID NO: 615675 - RNA, 22 nt, Human
uucauguguauggaacauuuuu

SEQ ID NO: 615676 - RNA, 22 nt, Human
aagucuguagaaaaacaguuua

SEQ ID NO: 615677 - RNA, 22 nt, Human
ccagggaggagcauuucauggu

SEQ ID NO: 615678 - RNA, 22 nt, Human
uagaaagacuguccagauuuca

SEQ ID NO: 615679 - RNA, 22 nt, Human
gaggccugggagccuguccucc

SEQ ID NO: 615680 - RNA, 20 nt, Human
acaguguuagguuuuuccuu

SEQ ID NO: 615681 - RNA, 22 nt, Human
cagcuucaacugcacagucaac

SEQ ID NO: 615682 - RNA, 22 nt, Human
aguggggaagagcaugggcccu

SEQ ID NO: 615683 - RNA, 22 nt, Human
augcaaaaguaauugcaauuuu

SEQ ID NO: 615684 - RNA, 22 nt, Human
guuccuuguauuucagacauga

SEQ ID NO: 615685 - RNA, 21 nt, Human
cagggcaaccaaguccagaga

SEQ ID NO: 615686 - RNA, 22 nt, Human
agaucugguuggaguccugaca

SEQ ID NO: 615687 - RNA, 22 nt, Human
aaaggucuugucuugacagagu

SEQ ID NO: 615688 - RNA, 23 nt, Human
uuggaagggaagagcauuugaga

SEQ ID NO: 615689 - RNA, 22 nt, Human
aguuucaguucugucauuuaua

SEQ ID NO: 615690 - RNA, 22 nt, Human
gugugaaaugguucucuuuguu

SEQ ID NO: 615691 - RNA, 22 nt, Human
uugaagguuuaacugagaggca

SEQ ID NO: 615692 - RNA, 22 nt, Human
uucuuaaagaggcaaaacacag

SEQ ID NO: 615693 - RNA, 22 nt, Human
uuccugggcaggacgagagucu

SEQ ID NO: 615694 - RNA, 22 nt, Human
uugcacuccagcccgagcaaca

SEQ ID NO: 615695 - RNA, 22 nt, Human
cuguggcugcguaggucuggca

SEQ ID NO: 615696 - RNA, 21 nt, Human
agguccaguucugucuuggac

SEQ ID NO: 615697 - RNA, 22 nt, Human
auuuauuauugugguuacuucu

SEQ ID NO: 615698 - RNA, 22 nt, Human
gcuuccugagaaacaaucugau

SEQ ID NO: 615699 - RNA, 20 nt, Human
agaagccaagugacauguuu

SEQ ID NO: 615700 - RNA, 22 nt, Human
ggugagaaagggauuccuguuc

SEQ ID NO: 615701 - RNA, 22 nt, Human
uccugagggcauuuuggugacu

SEQ ID NO: 615702 - RNA, 22 nt, Human
augcccugggagugcuguacca

SEQ ID NO: 615703 - RNA, 22 nt, Human
ucauagaaauaucacgucuuuu

SEQ ID NO: 615704 - RNA, 22 nt, Human
aaagcacauaguagaaggauuu

SEQ ID NO: 615705 - RNA, 22 nt, Human
uccugggaggcaggaccccuuu

SEQ ID NO: 615706 - RNA, 22 nt, Human
auucacaauuagaaguagauaa

SEQ ID NO: 615707 - RNA, 22 nt, Human
aagccuuccugagugcaaggcc

SEQ ID NO: 615708 - RNA, 22 nt, Human
uggcagccuggaaucucucagc

SEQ ID NO: 615709 - RNA, 22 nt, Human
auguugagagcugagaucagcc

SEQ ID NO: 615710 - RNA, 22 nt, Human
aaguguuuggggaucauuuuaa

SEQ ID NO: 615711 - RNA, 22 nt, Human
ucaguguucagggaccaggucc

SEQ ID NO: 615712 - RNA, 22 nt, Human
cuguggcugcgccaucgaaaac

SEQ ID NO: 615713 - RNA, 22 nt, Human
gggcagguacaagaugcuucuu

SEQ ID NO: 615714 - RNA, 22 nt, Human
aaggccugcucagcugucugug

SEQ ID NO: 615715 - RNA, 22 nt, Human
ccugauuauuguaaauauauuu

SEQ ID NO: 615716 - RNA, 22 nt, Human
aagugugggaaguagguggcga

SEQ ID NO: 615717 - RNA, 22 nt, Human
uggaggucgcuagcgagcgggc

SEQ ID NO: 615718 - RNA, 22 nt, Human
ggcaggguggcccuccagugag

SEQ ID NO: 615719 - RNA, 17 nt, Human
uugcccugauuuuuaac

SEQ ID NO: 615720 - RNA, 22 nt, Human
aaaaaauuaucauaguuccuga

SEQ ID NO: 615721 - RNA, 22 nt, Human
cuccugggagcuguggcagagc

SEQ ID NO: 615722 - RNA, 22 nt, Human
gccaccucuuugucucugccgc

SEQ ID NO: 615723 - RNA, 22 nt, Human
ucaaaggaauuugauuuugaug

SEQ ID NO: 615724 - RNA, 22 nt, Human
uucuggcucuccccugcugggu

SEQ ID NO: 615725 - RNA, 22 nt, Human
gcucuuauagucccagcauguu

SEQ ID NO: 615726 - RNA, 22 nt, Human
gaaaucuuccaauggucacauc

SEQ ID NO: 615727 - RNA, 22 nt, Human
uccuggaguugucuguacucau

SEQ ID NO: 615728 - RNA, 22 nt, Human
cagugggugccaucgugcccuu

SEQ ID NO: 615729 - RNA, 22 nt, Human
agggccugcucuaucacucuca

SEQ ID NO: 615730 - RNA, 22 nt, Human
caaguagagauuacagugugca

SEQ ID NO: 615731 - RNA, 22 nt, Human
agacauuauggcuuucacuggg

SEQ ID NO: 615732 - RNA, 22 nt, Human
uugcccugcguuaccaucucuu

SEQ ID NO: 615733 - RNA, 22 nt, Human
cuuagcaugcaguguucugccc

SEQ ID NO: 615734 - RNA, 22 nt, Human
ugcaaguaguccagccuuuggg

SEQ ID NO: 615735 - RNA, 22 nt, Human
gcugcccugucugcagcaggac

SEQ ID NO: 615736 - RNA, 22 nt, Human
auagugucagaaaaucauaaga

SEQ ID NO: 615737 - RNA, 22 nt, Human
aaaugaguagcgaugcacauua

SEQ ID NO: 615738 - RNA, 22 nt, Human
uuugggcaggcuuuucccuaga

SEQ ID NO: 615739 - RNA, 22 nt, Human
aggcagcguagcaaggcuagua

SEQ ID NO: 615740 - RNA, 22 nt, Human
cagugcaauguuaaauaggaaa

SEQ ID NO: 615741 - RNA, 22 nt, Human
agaaggguucaggaauauguua

SEQ ID NO: 615742 - RNA, 23 nt, Human
aggcagguuugggcucuucuugu

SEQ ID NO: 615743 - RNA, 22 nt, Human
acaguguuauuucugaguaaug

SEQ ID NO: 615744 - RNA, 20 nt, Human
accugaggucccuauggucu

SEQ ID NO: 615745 - RNA, 22 nt, Human
ucauccaggaaaagauuuggaa

SEQ ID NO: 615746 - RNA, 22 nt, Human
uuguuuaaaagaaaucauagaa

SEQ ID NO: 615747 - RNA, 22 nt, Human
aagcuguuguucauccugaauu

SEQ ID NO: 615748 - RNA, 22 nt, Human
cccagccugaucucggccagcu

SEQ ID NO: 615749 - RNA, 22 nt, Human
caagcagacaguaggccuagaa

SEQ ID NO: 615750 - RNA, 22 nt, Human
gcagaacaacguaggaguggag

SEQ ID NO: 615751 - RNA, 22 nt, Human
aaugaaagaaugaaacagccca

SEQ ID NO: 615752 - RNA, 22 nt, Human
gcagggggauggaguugaaaug

SEQ ID NO: 615753 - RNA, 21 nt, Human
uggcauggagguagcagugug

SEQ ID NO: 615754 - RNA, 22 nt, Human
guuuuacaaaugacggcauuca

SEQ ID NO: 615755 - RNA, 22 nt, Human
ccacugggggcugcucccaggu

SEQ ID NO: 615756 - RNA, 22 nt, Human
aagcaugggaggccuggaggag

SEQ ID NO: 615757 - RNA, 22 nt, Human
agauaauuauuuacuucaaagu

SEQ ID NO: 615758 - RNA, 22 nt, Human
agaugaaagauuuuuauagaga

SEQ ID NO: 615759 - RNA, 22 nt, Human
cuguggcucuccaauggaggga

SEQ ID NO: 615760 - RNA, 22 nt, Human
cuccagugggggugagccuaga

SEQ ID NO: 615761 - RNA, 22 nt, Human
aagaaaugugaauauugaauag

SEQ ID NO: 615762 - RNA, 23 nt, Human
agcugggaauuuucugaagcuuu

SEQ ID NO: 615763 - RNA, 22 nt, Human
gggcaagugucaagcaugucau

SEQ ID NO: 615764 - RNA, 22 nt, Human
uggcacuugcuucagaugaugu

SEQ ID NO: 615765 - RNA, 18 nt, Human
cuguucagcugaacuaca

SEQ ID NO: 615766 - RNA, 22 nt, Human
ggagggggaagaagcuaaagac

SEQ ID NO: 615767 - RNA, 22 nt, Human
ccaaguaguugagacuacaggu

SEQ ID NO: 615768 - RNA, 19 nt, Human
uuuuuacaaguagguguga

SEQ ID NO: 615769 - RNA, 22 nt, Human
uccuguuuccaauuuguugggu

SEQ ID NO: 615770 - RNA, 22 nt, Human
ucugcaaacuuaaguugaaaua

SEQ ID NO: 615771 - RNA, 22 nt, Human
aagaaagugcuuuguaaauuau

SEQ ID NO: 615772 - RNA, 22 nt, Human
uaguguucuaagaacauccaug

SEQ ID NO: 615773 - RNA, 22 nt, Human
cucuggcuggcaccugaucuga

SEQ ID NO: 615774 - RNA, 22 nt, Human
aaaguagauuucucauggcgaa

SEQ ID NO: 615775 - RNA, 22 nt, Human
aagugcaaugaauagcugcaau

SEQ ID NO: 615776 - RNA, 22 nt, Human
agguacaguagacagacaguua

SEQ ID NO: 615777 - RNA, 22 nt, Human
cucccuggugacucccaaagcu

SEQ ID NO: 615778 - RNA, 22 nt, Human
uggagaggaaagugcaguuuug

SEQ ID NO: 615779 - RNA, 22 nt, Human
acccgggaggcaggagucauag

SEQ ID NO: 615780 - RNA, 22 nt, Human
ccucugccugcacaucauccug

SEQ ID NO: 615781 - RNA, 22 nt, Human
uucaguuccauuucaggugggu

SEQ ID NO: 615782 - RNA, 22 nt, Human
uuccugggauuauugucaagca

SEQ ID NO: 615783 - RNA, 22 nt, Human
auauuacauaaacaugagugaa

SEQ ID NO: 615784 - RNA, 22 nt, Human
acauuaacacuggugcuggugu

SEQ ID NO: 615785 - RNA, 22 nt, Human
agaagcagcaagcccuucaaag

SEQ ID NO: 615786 - RNA, 22 nt, Human
ucugaggcagcuugccacucua

SEQ ID NO: 615787 - RNA, 22 nt, Human
ggggaggccaguggaccguccc

SEQ ID NO: 615788 - RNA, 22 nt, Human
uugauugaauuuugaaaaucua

SEQ ID NO: 615789 - RNA, 22 nt, Human
aaaaaucacuuuuauaggcagc

SEQ ID NO: 615790 - RNA, 22 nt, Human
cagguccacagcccaucacugc

SEQ ID NO: 615791 - RNA, 22 nt, Human
gggagggcuuggacccagaugu

SEQ ID NO: 615792 - RNA, 18 nt, Human
ccuguguguguugcaggc

SEQ ID NO: 615793 - RNA, 22 nt, Human
aggucucaaguugagaaggcag

SEQ ID NO: 615794 - RNA, 22 nt, Human
aucuguuguuuguuugcuaaag

SEQ ID NO: 615795 - RNA, 23 nt, Human
auuuacagcugugugagcaaguu

SEQ ID NO: 615796 - RNA, 22 nt, Human
uuccugugauauuagccacugu

SEQ ID NO: 615797 - RNA, 22 nt, Human
guggaaggaauuaacagacuag

SEQ ID NO: 615798 - RNA, 22 nt, Human
agguucagugccuggaacaggg

SEQ ID NO: 615799 - RNA, 22 nt, Human
cccauucuucaugguuuccugu

SEQ ID NO: 615800 - RNA, 22 nt, Human
uccaggaguggggcagaggucu

SEQ ID NO: 615801 - RNA, 22 nt, Human
gaggcaguggucugaugcaagg

SEQ ID NO: 615802 - RNA, 22 nt, Human
agggucugaccaccaguaggga

SEQ ID NO: 615803 - RNA, 22 nt, Human
cuucuugucaauuugccauugu

SEQ ID NO: 615804 - RNA, 22 nt, Human
aguguucauuuauucauucacu

SEQ ID NO: 615805 - RNA, 23 nt, Human
uaaagacagccuucaggauucug

SEQ ID NO: 615806 - RNA, 22 nt, Human
agcaccuggucuccuggcgcug

SEQ ID NO: 615807 - RNA, 22 nt, Human
aaaagagagcugaggagcucca

SEQ ID NO: 615808 - RNA, 22 nt, Human
uuguugaauuaguugacugugu

SEQ ID NO: 615809 - RNA, 22 nt, Human
uuccacaggacuaaaugucauc

SEQ ID NO: 615810 - RNA, 22 nt, Human
auggaaggcuuuaugacucaaa

SEQ ID NO: 615811 - RNA, 22 nt, Human
gugcccuggggugaaccccugg

SEQ ID NO: 615812 - RNA, 22 nt, Human
gggcucagucugcggcgcgcgg

SEQ ID NO: 615813 - RNA, 22 nt, Human
uggcagguagucagaggcgaca

SEQ ID NO: 615814 - RNA, 22 nt, Human
uuucacaaguuucaggauucug

SEQ ID NO: 615815 - RNA, 23 nt, Human
gagcagagcgggcggggguccug

SEQ ID NO: 615816 - RNA, 22 nt, Human
ucuccuugcuacccaguauguc

SEQ ID NO: 615817 - RNA, 22 nt, Human
uuccucuuuagggcuggccagg

SEQ ID NO: 615818 - RNA, 22 nt, Human
uacagaagcugagacacugaga

SEQ ID NO: 615819 - RNA, 22 nt, Human
uccugggcgguuaugugaucug

SEQ ID NO: 615820 - RNA, 22 nt, Human
ucaaauagguaugaguagaaau

SEQ ID NO: 615821 - RNA, 22 nt, Human
gggcaaguugagaagaaugcua

SEQ ID NO: 615822 - RNA, 22 nt, Human
ugcccugggaacacagaugcca

SEQ ID NO: 615823 - RNA, 22 nt, Human
ucccagccuggacccugccagu

SEQ ID NO: 615824 - RNA, 22 nt, Human
uacagugugacauuucuacaaa

SEQ ID NO: 615825 - RNA, 22 nt, Human
aauggcucugauguuguuguga

SEQ ID NO: 615826 - RNA, 22 nt, Human
uugugaauagugccgcaauaaa

SEQ ID NO: 615827 - RNA, 22 nt, Human
gcuuucugguucucaaagcacu

SEQ ID NO: 615828 - RNA, 19 nt, Human
gccugggaugggcagaacu

SEQ ID NO: 615829 - RNA, 22 nt, Human
agacugggauucucccugauca

SEQ ID NO: 615830 - RNA, 22 nt, Human
gacaaagucaacaguacucuca

SEQ ID NO: 615831 - RNA, 22 nt, Human
ugaaugugaugcuaaacauaug

SEQ ID NO: 615832 - RNA, 22 nt, Human
cuuccuugugguccuucucauu

SEQ ID NO: 615833 - RNA, 18 nt, Human
auacaagaucaaguguuc

SEQ ID NO: 615834 - RNA, 22 nt, Human
gagguucauucagcucugucac

SEQ ID NO: 615835 - RNA, 22 nt, Human
ugccagccagggaagcucaccc

SEQ ID NO: 615836 - RNA, 20 nt, Human
guccaggacccagcaggagg

SEQ ID NO: 615837 - RNA, 22 nt, Human
ggagaagaggagcuggaagccu

SEQ ID NO: 615838 - RNA, 22 nt, Human
agguccagugaaacuuuauuug

SEQ ID NO: 615839 - RNA, 22 nt, Human
caggcgggcaggugcggccccu

SEQ ID NO: 615840 - RNA, 21 nt, Human
uccagggaauuucaacuuuua

SEQ ID NO: 615841 - RNA, 22 nt, Human
agguccagcuguugcagccucc

SEQ ID NO: 615842 - RNA, 22 nt, Human
ucccuggguccugcuugcucuc

SEQ ID NO: 615843 - RNA, 22 nt, Human
ggcaugucugauggcccaaguc

SEQ ID NO: 615844 - RNA, 22 nt, Human
uggcuccugcagaccaucugga

SEQ ID NO: 615845 - RNA, 22 nt, Human
augcuuuagugucaaguuuggg

SEQ ID NO: 615846 - RNA, 22 nt, Human
ugagaaaugggucugcugaaga

SEQ ID NO: 615847 - RNA, 22 nt, Human
auccuggguaaguuccuuuuaa

SEQ ID NO: 615848 - RNA, 22 nt, Human
gcaguggcuaggagucuggcgu

SEQ ID NO: 615849 - RNA, 20 nt, Human
ugaagcagccuugauucugu

SEQ ID NO: 615850 - RNA, 22 nt, Human
agguggagaagagaugggcagu

SEQ ID NO: 615851 - RNA, 23 nt, Human
uccugcagauaagcugguugaca

SEQ ID NO: 615852 - RNA, 22 nt, Human
ccaaauauuaacaaaguaauuu

SEQ ID NO: 615853 - RNA, 22 nt, Human
aaguagacuuuugcaucaagga

SEQ ID NO: 615854 - RNA, 22 nt, Human
uccuggggaggguucuggcucc

SEQ ID NO: 615855 - RNA, 22 nt, Human
uucugguucucaggaaugcuaa

SEQ ID NO: 615856 - RNA, 22 nt, Human
agugcaaagggaucagauuggg

SEQ ID NO: 615857 - RNA, 22 nt, Human
aggagauuguacugucaucacu

SEQ ID NO: 615858 - RNA, 22 nt, Human
uccugcagagucccacugauuu

SEQ ID NO: 615859 - RNA, 22 nt, Human
uacaguauggaaaauguauagu

SEQ ID NO: 615860 - RNA, 22 nt, Human
cagagaaagggugaauuccuuc

SEQ ID NO: 615861 - RNA, 22 nt, Human
aaagcagucucagacuuaagca

SEQ ID NO: 615862 - RNA, 22 nt, Human
uccugcagcucugagaagcauc

SEQ ID NO: 615863 - RNA, 22 nt, Human
aggaggcaggaagucuauggga

SEQ ID NO: 615864 - RNA, 19 nt, Human
uuucuaagcuaaaugcuuc

SEQ ID NO: 615865 - RNA, 22 nt, Human
gccuguggccacugcgucugca

SEQ ID NO: 615866 - RNA, 22 nt, Human
agcacuuugggagauaaagcug

SEQ ID NO: 615867 - RNA, 22 nt, Human
ggcaggguggcagaggcucaga

SEQ ID NO: 615868 - RNA, 22 nt, Human
cugcaggagcaaagccucugcu

SEQ ID NO: 615869 - RNA, 22 nt, Human
aguccuggacuuggagucaggg

SEQ ID NO: 615870 - RNA, 22 nt, Human
gcaguguuucaaaucaaaggca

SEQ ID NO: 615871 - RNA, 22 nt, Human
gaaagcagaugaaauugcaaca

SEQ ID NO: 615872 - RNA, 22 nt, Human
cuuaauguggaccugguuucua

SEQ ID NO: 615873 - RNA, 22 nt, Human
cucaguccgucccgcuaggugc

SEQ ID NO: 615874 - RNA, 22 nt, Human
cugcccugaccugccucagagu

SEQ ID NO: 615875 - RNA, 22 nt, Human
ugaggcagcuuuuucugugugu

SEQ ID NO: 615876 - RNA, 22 nt, Human
cccgacuagcugggauuacagg

SEQ ID NO: 615877 - RNA, 22 nt, Human
aauguguuauuucagaauccag

SEQ ID NO: 615878 - RNA, 22 nt, Human
ugcuuccuugagcucuccaauc

SEQ ID NO: 615879 - RNA, 22 nt, Human
cauugugcagggauaaugcagc

SEQ ID NO: 615880 - RNA, 22 nt, Human
gaggcaguccaguggguaagaa

SEQ ID NO: 615881 - RNA, 22 nt, Human
uauacaagaggugagaugagca

SEQ ID NO: 615882 - RNA, 22 nt, Human
accugggaggcggagguugcag

SEQ ID NO: 615883 - RNA, 20 nt, Human
ugacaaagaguaagaggagg

SEQ ID NO: 615884 - RNA, 22 nt, Human
ccugugugguagccagcggugc

SEQ ID NO: 615885 - RNA, 22 nt, Human
auuauaaauauuuucuaggggu

SEQ ID NO: 615886 - RNA, 22 nt, Human
auugacaacccugguaugagca

SEQ ID NO: 615887 - RNA, 22 nt, Human
aguucaaagcugcaguaaugga

SEQ ID NO: 615888 - RNA, 22 nt, Human
gaagauaauuccuacuuauaac

SEQ ID NO: 615889 - RNA, 22 nt, Human
aggcagguagaaggaucuuuau

SEQ ID NO: 615890 - RNA, 19 nt, Human
uggcucuguuucucuggag

SEQ ID NO: 615891 - RNA, 22 nt, Human
aaguccagggaucaaaguaggc

SEQ ID NO: 615892 - RNA, 22 nt, Human
ugaagcuggaaguuagguagac

SEQ ID NO: 615893 - RNA, 22 nt, Human
caggcuggagugcaauggugcu

SEQ ID NO: 615894 - RNA, 22 nt, Human
ucugggagauccaagcagaacu

SEQ ID NO: 615895 - RNA, 22 nt, Human
uuccugguaguaagacaucugg

SEQ ID NO: 615896 - RNA, 22 nt, Human
agggucuguggaugcaucuggg

SEQ ID NO: 615897 - RNA, 23 nt, Human
uguuuuucauucacaugggcugu

SEQ ID NO: 615898 - RNA, 20 nt, Human
gcuuucuaugagauggacug

SEQ ID NO: 615899 - RNA, 22 nt, Human
cgaggcagacaaaaguuggaag

SEQ ID NO: 615900 - RNA, 22 nt, Human
ccuggggagccgccugagcccc

SEQ ID NO: 615901 - RNA, 22 nt, Human
uacauuugcuuugauuuucagc

SEQ ID NO: 615902 - RNA, 22 nt, Human
gccuguuuuugcuucguuuaag

SEQ ID NO: 615903 - RNA, 22 nt, Human
cacaguguagacuaauaauaga

SEQ ID NO: 615904 - RNA, 22 nt, Human
ccugacaggagaagcgcagcau

SEQ ID NO: 615905 - RNA, 22 nt, Human
gccugggaaagaguagggaaau

SEQ ID NO: 615906 - RNA, 22 nt, Human
ggcugagcuuauauaugugcug

SEQ ID NO: 615907 - RNA, 22 nt, Human
agaguccaaaugugcaguuaug

SEQ ID NO: 615908 - RNA, 22 nt, Human
cagacaggcuagccagacucac

SEQ ID NO: 615909 - RNA, 18 nt, Human
agggucagugucacuggc

SEQ ID NO: 615910 - RNA, 22 nt, Human
ucauccaguuguggagagggaa

SEQ ID NO: 615911 - RNA, 22 nt, Human
ggguccagauggugagaguuaa

SEQ ID NO: 615912 - RNA, 22 nt, Human
gguccagaagcugguaggguag

SEQ ID NO: 615913 - RNA, 22 nt, Human
ucccuggagguguuugcucagg

SEQ ID NO: 615914 - RNA, 22 nt, Human
ccugucuguauugguuugcuau

SEQ ID NO: 615915 - RNA, 22 nt, Human
aaagccuuuucuguuuaacaca

SEQ ID NO: 615916 - RNA, 22 nt, Human
uuucagagcucuaggcucucag

SEQ ID NO: 615917 - RNA, 22 nt, Human
agccagggcugcagguuccuug

SEQ ID NO: 615918 - RNA, 22 nt, Human
auggccaccauuuaaugaagcu

SEQ ID NO: 615919 - RNA, 22 nt, Human
gucaagaugagaauucuuuuua

SEQ ID NO: 615920 - RNA, 22 nt, Human
ccuggguuggagagcaauggug

SEQ ID NO: 615921 - RNA, 22 nt, Human
cugcccugcucuccgggaucuu

SEQ ID NO: 615922 - RNA, 22 nt, Human
gauuuucaugauaaacuuguga

SEQ ID NO: 615923 - RNA, 22 nt, Human
ccuggggaagucacuucucuuu

SEQ ID NO: 615924 - RNA, 22 nt, Human
aagacaauuuugaguaugcaca

SEQ ID NO: 615925 - RNA, 22 nt, Human
cagaggcaggauaagaacugcg

SEQ ID NO: 615926 - RNA, 22 nt, Human
gguggcggccacuucagcccug

SEQ ID NO: 615927 - RNA, 22 nt, Human
agugcaaauuauuuaccugauu

SEQ ID NO: 615928 - RNA, 22 nt, Human
accagggcagccgagguguguc

SEQ ID NO: 615929 - RNA, 22 nt, Human
auucagaaaggguugccugguu

SEQ ID NO: 615930 - RNA, 22 nt, Human
ugaaagaacuagcaucuucaag

SEQ ID NO: 615931 - RNA, 22 nt, Human
ccucuuugugccugcaggcugc

SEQ ID NO: 615932 - RNA, 22 nt, Human
ucugaggcccuacccugagccu

SEQ ID NO: 615933 - RNA, 22 nt, Human
ccaguguugcauaggaugggga

SEQ ID NO: 615934 - RNA, 22 nt, Human
gggcagguggcaaagccagagg

SEQ ID NO: 615935 - RNA, 22 nt, Human
uuguauuucgaugcacguguag

SEQ ID NO: 615936 - RNA, 22 nt, Human
agguucagacgcauaauaggca

SEQ ID NO: 615937 - RNA, 22 nt, Human
gccaggucucauaaaugcagcu

SEQ ID NO: 615938 - RNA, 22 nt, Human
agaaaauaauuucuuggcuggu

SEQ ID NO: 615939 - RNA, 22 nt, Human
gaaauauucuugucuuguuuuc

SEQ ID NO: 615940 - RNA, 22 nt, Human
auacagugaauacuuacagugu

SEQ ID NO: 615941 - RNA, 22 nt, Human
accaaggagacaaagguguauu

SEQ ID NO: 615942 - RNA, 22 nt, Human
cuguggcuggccuuauugcugc

SEQ ID NO: 615943 - RNA, 22 nt, Human
ugaggcagcaauugauuauuca

SEQ ID NO: 615944 - RNA, 22 nt, Human
agagcuaagaaacagaauugcu

SEQ ID NO: 615945 - RNA, 22 nt, Human
cuguggagcagggcagggucac

SEQ ID NO: 615946 - RNA, 22 nt, Human
ucucagcugacugcuuuccucg

SEQ ID NO: 615947 - RNA, 22 nt, Human
ucaaaggaguuuaaguuacugg

SEQ ID NO: 615948 - RNA, 22 nt, Human
cuuccuugcugucugcuccagg

SEQ ID NO: 615949 - RNA, 22 nt, Human
cuuugaaaacuuaaauaacagc

SEQ ID NO: 615950 - RNA, 22 nt, Human
uuaaauuauuucuagugaggug

SEQ ID NO: 615951 - RNA, 22 nt, Human
auuugcuuucccuucccugaca

SEQ ID NO: 615952 - RNA, 22 nt, Human
ugggcugcggauaggccucgga

SEQ ID NO: 615953 - RNA, 22 nt, Human
ugcaaauauugggacagucuag

SEQ ID NO: 615954 - RNA, 22 nt, Human
cuuacaagaccaaagaaaggau

SEQ ID NO: 615955 - RNA, 22 nt, Human
cagcucuguaaauuccuucauc

SEQ ID NO: 615956 - RNA, 22 nt, Human
aggucaagggcaagagugaggu

SEQ ID NO: 615957 - RNA, 22 nt, Human
ugcuuaaaaugaugauuauuuu

SEQ ID NO: 615958 - RNA, 22 nt, Human
ugcaaaaacugcaauugcuuuu

SEQ ID NO: 615959 - RNA, 22 nt, Human
aguggcaauugacaacaaagga

SEQ ID NO: 615960 - RNA, 22 nt, Human
uuaaagcugagcccucagaagc

SEQ ID NO: 615961 - RNA, 22 nt, Human
auguccagggcacacagcagug

SEQ ID NO: 615962 - RNA, 22 nt, Human
ggccuuugcguccacgccgcuu

SEQ ID NO: 615963 - RNA, 22 nt, Human
ugaccacagacccaaugacuac

SEQ ID NO: 615964 - RNA, 22 nt, Human
acaaguaguaaauuauuaggug

SEQ ID NO: 615965 - RNA, 22 nt, Human
cacauacaugcacaccuaaaua

SEQ ID NO: 615966 - RNA, 23 nt, Human
agguucaggagauggaggaacaa

SEQ ID NO: 615967 - RNA, 23 nt, Human
ugucaucuccagacucccagugc

SEQ ID NO: 615968 - RNA, 22 nt, Human
caggaggcccacaggccccugc

SEQ ID NO: 615969 - RNA, 18 nt, Human
cgggcgggcgccuggccc

SEQ ID NO: 615970 - RNA, 22 nt, Human
ugcagucuccaccuccugggug

SEQ ID NO: 615971 - RNA, 21 nt, Human
aggugggcagguggaguggcc

SEQ ID NO: 615972 - RNA, 23 nt, Human
ucauggaacugggcaaucuugaa

SEQ ID NO: 615973 - RNA, 22 nt, Human
uuauuugccagaauuucucuug

SEQ ID NO: 615974 - RNA, 22 nt, Human
aauaauuuuagcucagaguugu

SEQ ID NO: 615975 - RNA, 19 nt, Human
ugggagaggcaacagagua

SEQ ID NO: 615976 - RNA, 22 nt, Human
gcacuucuauuuuuuucagugg

SEQ ID NO: 615977 - RNA, 22 nt, Human
cuuugauauaaguauacauagu

SEQ ID NO: 615978 - RNA, 22 nt, Human
ccaggauggggagcagauagaa

SEQ ID NO: 615979 - RNA, 17 nt, Human
uuucagauucacuuucu

SEQ ID NO: 615980 - RNA, 22 nt, Human
gggugcaggcagcccaggcagg

SEQ ID NO: 615981 - RNA, 22 nt, Human
cagugagauaccacagagcaaa

SEQ ID NO: 615982 - RNA, 22 nt, Human
gcucagcugagcgaaggacaug

SEQ ID NO: 615983 - RNA, 22 nt, Human
uuucuuuugaauaguguguggu

SEQ ID NO: 615984 - RNA, 22 nt, Human
aaaggaaaauaaguaguuccau

SEQ ID NO: 615985 - RNA, 22 nt, Human
ccagccuuugcaucccccaucu

SEQ ID NO: 615986 - RNA, 22 nt, Human
aagguccagaggucccgucacc

SEQ ID NO: 615987 - RNA, 22 nt, Human
agguccaguugccagaauggcc

SEQ ID NO: 615988 - RNA, 17 nt, Human
gaaagguccuagaaauc

SEQ ID NO: 615989 - RNA, 22 nt, Human
cugguuuuaauguuauguuuau

SEQ ID NO: 615990 - RNA, 22 nt, Human
aacuuguuuagaagagguuacu

SEQ ID NO: 615991 - RNA, 22 nt, Human
gcugaggccccagggugauggg

SEQ ID NO: 615992 - RNA, 22 nt, Human
acagccagaggagccaggcugg

SEQ ID NO: 615993 - RNA, 22 nt, Human
cuggaaggagaaggaggcugug

SEQ ID NO: 615994 - RNA, 22 nt, Human
ggccacugccuccgccauggcu

SEQ ID NO: 615995 - RNA, 22 nt, Human
aguggcagagccaggguuggga

SEQ ID NO: 615996 - RNA, 22 nt, Human
cagcuauuuugccuaucauggu

SEQ ID NO: 615997 - RNA, 22 nt, Human
caggcacugcacuaccacuuuu

SEQ ID NO: 615998 - RNA, 22 nt, Human
cugcccugauaugauuuagaac

SEQ ID NO: 615999 - RNA, 22 nt, Human
uccagggaucuuuagagucuuu

SEQ ID NO: 616000 - RNA, 22 nt, Human
cugggacacccagagcugcaga

SEQ ID NO: 616001 - RNA, 22 nt, Human
agaacgucuuuacucuuacgaa

SEQ ID NO: 616002 - RNA, 22 nt, Human
ucugucuuugagaucucagccu

SEQ ID NO: 616003 - RNA, 22 nt, Human
ccugggcucaagugaugguccc

SEQ ID NO: 616004 - RNA, 22 nt, Human
acacaagauuguguauugaauu

SEQ ID NO: 616005 - RNA, 22 nt, Human
acauuucucagguaagucauuu

SEQ ID NO: 616006 - RNA, 22 nt, Human
gccaggcuggugcaaggauauu

SEQ ID NO: 616007 - RNA, 22 nt, Human
aaacucuguugagauaauauuu

SEQ ID NO: 616008 - RNA, 22 nt, Human
aguuucaauucuuuucacaaag

SEQ ID NO: 616009 - RNA, 20 nt, Human
acaguguuuuugaguagagc

SEQ ID NO: 616010 - RNA, 20 nt, Human
uggccaccacuguauaucaa

SEQ ID NO: 616011 - RNA, 22 nt, Human
ggcaggacucucaggaccaagc

SEQ ID NO: 616012 - RNA, 22 nt, Human
gcagggcagccacaggcccccu

SEQ ID NO: 616013 - RNA, 22 nt, Human
ggugcccagagccaggaaugag

SEQ ID NO: 616014 - RNA, 22 nt, Human
ugaggcagaaaauagcaguuca

SEQ ID NO: 616015 - RNA, 22 nt, Human
ggagaguuguuuuugccuagau

SEQ ID NO: 616016 - RNA, 22 nt, Human
ucuggagucugagaucugagga

SEQ ID NO: 616017 - RNA, 22 nt, Human
aaauaugacuagaaugccaggu

SEQ ID NO: 616018 - RNA, 22 nt, Human
aagaccuugucuaaacauguag

SEQ ID NO: 616019 - RNA, 22 nt, Human
gcuuuuguggugauggagaggc

SEQ ID NO: 616020 - RNA, 23 nt, Human
gcucaucaggcuuagagucaagg

SEQ ID NO: 616021 - RNA, 22 nt, Human
cugugccuuggcgcugugccac

SEQ ID NO: 616022 - RNA, 22 nt, Human
accugggauggggccagguuua

SEQ ID NO: 616023 - RNA, 22 nt, Human
uacagucacauucugaggucuu

SEQ ID NO: 616024 - RNA, 22 nt, Human
agauauauuuccugcccaaggc

SEQ ID NO: 616025 - RNA, 22 nt, Human
ucccugggccuccugcuaugca

SEQ ID NO: 616026 - RNA, 22 nt, Human
uugaagguaaauuauauugauc

SEQ ID NO: 616027 - RNA, 18 nt, Human
agaagcagguaaaauucu

SEQ ID NO: 616028 - RNA, 22 nt, Human
cugccacucugggugggccugg

SEQ ID NO: 616029 - RNA, 22 nt, Human
uccuggcccacuaugccagcau

SEQ ID NO: 616030 - RNA, 22 nt, Human
gaggccugcuuuggcacucugg

SEQ ID NO: 616031 - RNA, 22 nt, Human
auguuuuauuaccaacuuguac

SEQ ID NO: 616032 - RNA, 22 nt, Human
agcugccuuaaauuacuuugug

SEQ ID NO: 616033 - RNA, 22 nt, Human
cuguggcucugcagucccaaca

SEQ ID NO: 616034 - RNA, 22 nt, Human
agucccaggcagccgagccggu

SEQ ID NO: 616035 - RNA, 22 nt, Human
ugcccuggcuggagugcagugg

SEQ ID NO: 616036 - RNA, 22 nt, Human
ccaguccugccacccugucuau

SEQ ID NO: 616037 - RNA, 22 nt, Human
uaggaagggcucagggcucggu

SEQ ID NO: 616038 - RNA, 22 nt, Human
uuccuggggugaagauauuuuu

SEQ ID NO: 616039 - RNA, 22 nt, Human
uggcagguggagacagcagagc

SEQ ID NO: 616040 - RNA, 22 nt, Human
agucauccaagagccugggcag

SEQ ID NO: 616041 - RNA, 20 nt, Human
gcaacucacccacagcagcu

SEQ ID NO: 616042 - RNA, 22 nt, Human
ccucccuuccccaguagucaag

SEQ ID NO: 616043 - RNA, 22 nt, Human
gucccuggguagcucaguggcu

SEQ ID NO: 616044 - RNA, 22 nt, Human
guccacagcuggccagggccuc

SEQ ID NO: 616045 - RNA, 22 nt, Human
gcugggagccccgagccagcgc

SEQ ID NO: 616046 - RNA, 22 nt, Human
caugucuuauauccugucuuca

SEQ ID NO: 616047 - RNA, 22 nt, Human
gcaguguuacuugguuugcaga

SEQ ID NO: 616048 - RNA, 22 nt, Human
ggcuuuaucaaaugagacccug

SEQ ID NO: 616049 - RNA, 22 nt, Human
uugauucagagaagauuggccc

SEQ ID NO: 616050 - RNA, 22 nt, Human
ccagcucuguaagcugugaaau

SEQ ID NO: 616051 - RNA, 22 nt, Human
cagagaaaaaauccugcucuca

SEQ ID NO: 616052 - RNA, 22 nt, Human
gcaaggucuuucagaaaggaaa

SEQ ID NO: 616053 - RNA, 22 nt, Human
agugucuuugacacauucaaag

SEQ ID NO: 616054 - RNA, 22 nt, Human
gccucugcaacuccgccuuggu

SEQ ID NO: 616055 - RNA, 22 nt, Human
auaugcaagcacauagaauacu

SEQ ID NO: 616056 - RNA, 22 nt, Human
uuaguuuucccaucuuuauggu

SEQ ID NO: 616057 - RNA, 22 nt, Human
ggagaucuugcuugaaggcaug

SEQ ID NO: 616058 - RNA, 22 nt, Human
ccauuguaaauucuguggaagu

SEQ ID NO: 616059 - RNA, 20 nt, Human
cuccaggggaagagccuucc

SEQ ID NO: 616060 - RNA, 21 nt, Human
gaaaauacaaugagcuugacc

SEQ ID NO: 616061 - RNA, 22 nt, Human
auguguguguuuaauccucaaa

SEQ ID NO: 616062 - RNA, 22 nt, Human
ucccugggccuaucuuagcucc

SEQ ID NO: 616063 - RNA, 22 nt, Human
aagcaauaggguaaucuacuca

SEQ ID NO: 616064 - RNA, 22 nt, Human
cagcuucuuagucuuuccuugu

SEQ ID NO: 616065 - RNA, 22 nt, Human
auccucuguggauuacaccuag

SEQ ID NO: 616066 - RNA, 22 nt, Human
uccugcagagacagaggccuca

SEQ ID NO: 616067 - RNA, 22 nt, Human
cagaggcauuacugaaaaggug

SEQ ID NO: 616068 - RNA, 21 nt, Human
uccuggcuuuaugcuaccucu

SEQ ID NO: 616069 - RNA, 22 nt, Human
ucaaaggauaacugagggcagu

SEQ ID NO: 616070 - RNA, 22 nt, Human
uucuggcuugaccccuacuucc

SEQ ID NO: 616071 - RNA, 22 nt, Human
caggcaagauuagagaugagca

SEQ ID NO: 616072 - RNA, 22 nt, Human
cagcucagacgcaggucgagca

SEQ ID NO: 616073 - RNA, 22 nt, Human
auccugggcaagucaauguccc

SEQ ID NO: 616074 - RNA, 22 nt, Human
gugcccuguucauuucucuccc

SEQ ID NO: 616075 - RNA, 22 nt, Human
acagaauaguuggcccugcuau

SEQ ID NO: 616076 - RNA, 22 nt, Human
gcuacaaacugucauggugcuu

SEQ ID NO: 616077 - RNA, 22 nt, Human
uccagaguuguaaguguugaca

SEQ ID NO: 616078 - RNA, 17 nt, Human
ccugggaggaguuauga

SEQ ID NO: 616079 - RNA, 22 nt, Human
ugcccagcacugugccagucac

SEQ ID NO: 616080 - RNA, 22 nt, Human
uggccagugauuaaugacgcuu

SEQ ID NO: 616081 - RNA, 20 nt, Human
gcuucaaagccauccuuuua

SEQ ID NO: 616082 - RNA, 22 nt, Human
uagguucaggagauauugcaca

SEQ ID NO: 616083 - RNA, 22 nt, Human
uuuuuccaccguacuuccugag

SEQ ID NO: 616084 - RNA, 21 nt, Human
cccugcaggccagggcugagc

SEQ ID NO: 616085 - RNA, 22 nt, Human
agaggcagccguauuucaaagg

SEQ ID NO: 616086 - RNA, 22 nt, Human
aauuuguuacacagcaauauaa

SEQ ID NO: 616087 - RNA, 22 nt, Human
ccuggccagcgccggcugcucg

SEQ ID NO: 616088 - RNA, 23 nt, Human
gccagccuugcucuccugcagcc

SEQ ID NO: 616089 - RNA, 22 nt, Human
cugcccugagggccuguguguu

SEQ ID NO: 616090 - RNA, 22 nt, Human
auucaucuaugacucuaaugug

SEQ ID NO: 616091 - RNA, 22 nt, Human
ggucccaguugcccaggucagg

SEQ ID NO: 616092 - RNA, 22 nt, Human
aaggaucaaguggauuuucuua

SEQ ID NO: 616093 - RNA, 22 nt, Human
ucauguuuuugccauaugacuc

SEQ ID NO: 616094 - RNA, 22 nt, Human
ccaguguuauuuuagaguguga

SEQ ID NO: 616095 - RNA, 22 nt, Human
ucugggagaagcugaugugaag

SEQ ID NO: 616096 - RNA, 22 nt, Human
uccagggaagagcagaggcuac

SEQ ID NO: 616097 - RNA, 22 nt, Human
gagugcaaguucuuccuucuuc

SEQ ID NO: 616098 - RNA, 22 nt, Human
cuggguguagauggaaguuugg

SEQ ID NO: 616099 - RNA, 20 nt, Human
uaaauuagccuugaagauua

SEQ ID NO: 616100 - RNA, 21 nt, Human
gccugcaguuuugaagcccuu

SEQ ID NO: 616101 - RNA, 22 nt, Human
gccuguuugagaauagucaggg

SEQ ID NO: 616102 - RNA, 22 nt, Human
acacacaaaucuauuagugaau

SEQ ID NO: 616103 - RNA, 22 nt, Human
gauucaauguugcagauggaau

SEQ ID NO: 616104 - RNA, 22 nt, Human
aacaaaggccguuaauaaccac

SEQ ID NO: 616105 - RNA, 22 nt, Human
aaauugcucuuuaaaaguacug

SEQ ID NO: 616106 - RNA, 22 nt, Human
uccugggaccaggcaccuacug

SEQ ID NO: 616107 - RNA, 22 nt, Human
cuuccugggucagccuggaggu

SEQ ID NO: 616108 - RNA, 22 nt, Human
acagcaaaggacgaacacucug

SEQ ID NO: 616109 - RNA, 22 nt, Human
ucucccucuuugucugcuuugg

SEQ ID NO: 616110 - RNA, 22 nt, Human
ggugggaucaaagagucauucg

SEQ ID NO: 616111 - RNA, 22 nt, Human
guccuggguccccgcaggucag

SEQ ID NO: 616112 - RNA, 22 nt, Human
uacaagaaaguccaguggguuu

SEQ ID NO: 616113 - RNA, 22 nt, Human
guccuagugccuggaagcuggg

SEQ ID NO: 616114 - RNA, 22 nt, Human
uuaaacaccugucuaguguagc

SEQ ID NO: 616115 - RNA, 22 nt, Human
cugggccacaucagaugaagac

SEQ ID NO: 616116 - RNA, 22 nt, Human
ucgaacucauagucguagcugu

SEQ ID NO: 616117 - RNA, 22 nt, Human
uggccaggccggggacagaacu

SEQ ID NO: 616118 - RNA, 22 nt, Human
aggcagguccccuggaaggcac

SEQ ID NO: 616119 - RNA, 22 nt, Human
gcagcucaagagaggugcuaug

SEQ ID NO: 616120 - RNA, 22 nt, Human
caggauggagagugagggguca

SEQ ID NO: 616121 - RNA, 22 nt, Human
uuucaucugugcugccaagacu

SEQ ID NO: 616122 - RNA, 22 nt, Human
cucuuuguggaacggcaguguc

SEQ ID NO: 616123 - RNA, 22 nt, Human
acucaggaaaugaagacugguu

SEQ ID NO: 616124 - RNA, 22 nt, Human
ggcaguucuggaugcauuguca

SEQ ID NO: 616125 - RNA, 22 nt, Human
uggcagguuaugcgggccacau

SEQ ID NO: 616126 - RNA, 22 nt, Human
ccucugccuuuagugaaaguug

SEQ ID NO: 616127 - RNA, 22 nt, Human
agguccagaggcuccuuauuac

SEQ ID NO: 616128 - RNA, 22 nt, Human
caggcuggucccagagcauugc

SEQ ID NO: 616129 - RNA, 19 nt, Human
cagaaauagcgaaguguaa

SEQ ID NO: 616130 - RNA, 22 nt, Human
uugugaguagugccgcaauaaa

SEQ ID NO: 616131 - RNA, 19 nt, Human
cagaguccuugaccagucc

SEQ ID NO: 616132 - RNA, 22 nt, Human
ucugggugugguaucuuagcca

SEQ ID NO: 616133 - RNA, 22 nt, Human
agaggcaggaagagcugauuuu

SEQ ID NO: 616134 - RNA, 22 nt, Human
aaauagacaggcuuaaauagga

SEQ ID NO: 616135 - RNA, 17 nt, Human
cagugaucauuacauua

SEQ ID NO: 616136 - RNA, 22 nt, Human
gggcagguggccucuuguacua

SEQ ID NO: 616137 - RNA, 22 nt, Human
gccuguuuuccugcugugguug

SEQ ID NO: 616138 - RNA, 22 nt, Human
cuggcuuuguucugauugcuuc

SEQ ID NO: 616139 - RNA, 22 nt, Human
agccaugggcucccaguccuuu

SEQ ID NO: 616140 - RNA, 21 nt, Human
acuggcugccaugauccaggg

SEQ ID NO: 616141 - RNA, 18 nt, Human
cagauccaggcagcuauu

SEQ ID NO: 616142 - RNA, 22 nt, Human
ggcaggguuuacaauagcaaua

SEQ ID NO: 616143 - RNA, 22 nt, Human
ggucauugaaaucagaaggguu

SEQ ID NO: 616144 - RNA, 22 nt, Human
guccagccagcugguccuugcc

SEQ ID NO: 616145 - RNA, 22 nt, Human
gaaagaaugagcaucaugacuu

SEQ ID NO: 616146 - RNA, 22 nt, Human
ucuugcuagaaucauuuggaga

SEQ ID NO: 616147 - RNA, 22 nt, Human
gcuggagaaacugcagcugagg

SEQ ID NO: 616148 - RNA, 22 nt, Human
gcauggccuugcuguaguggua

SEQ ID NO: 616149 - RNA, 22 nt, Human
acaugugucuaagaaugaaaga

SEQ ID NO: 616150 - RNA, 22 nt, Human
cagggucaccagagaucugcau

SEQ ID NO: 616151 - RNA, 22 nt, Human
gcagugggccugaggaagggug

SEQ ID NO: 616152 - RNA, 22 nt, Human
cugggagaggaaccucgagggu

SEQ ID NO: 616153 - RNA, 22 nt, Human
cgaggcaggcaggcggaggaua

SEQ ID NO: 616154 - RNA, 21 nt, Human
gccugggaagagaaagguaag

SEQ ID NO: 616155 - RNA, 22 nt, Human
cugggagagccuuuccugaguc

SEQ ID NO: 616156 - RNA, 19 nt, Human
ccucugccagcccgccucu

SEQ ID NO: 616157 - RNA, 22 nt, Human
aggcaggcacuccggaaguguc

SEQ ID NO: 616158 - RNA, 22 nt, Human
agugcgugguuuacagcuaguu

SEQ ID NO: 616159 - RNA, 22 nt, Human
aggucacacuuggaucauagaa

SEQ ID NO: 616160 - RNA, 22 nt, Human
cccugccaaucccgucucucug

SEQ ID NO: 616161 - RNA, 22 nt, Human
ucagcaggugaacaucaugcca

SEQ ID NO: 616162 - RNA, 22 nt, Human
gcagccaggguuaauuauauuu

SEQ ID NO: 616163 - RNA, 22 nt, Human
agucauuaauuaguaggaaggu

SEQ ID NO: 616164 - RNA, 22 nt, Human
cagcuucaugacaaacaguuuu

SEQ ID NO: 616165 - RNA, 22 nt, Human
uccuggugaucaaaauucauuu

SEQ ID NO: 616166 - RNA, 22 nt, Human
ccugaggacagugugaccaugg

SEQ ID NO: 616167 - RNA, 17 nt, Human
ggaaggucaaggggagg

SEQ ID NO: 616168 - RNA, 22 nt, Human
ugguccagaagauauucaacca

SEQ ID NO: 616169 - RNA, 22 nt, Human
cugagaagcaaagaacugcacu

SEQ ID NO: 616170 - RNA, 22 nt, Human
uccugaggccucugugauguga

SEQ ID NO: 616171 - RNA, 22 nt, Human
ccuguugucucuuccuguugac

SEQ ID NO: 616172 - RNA, 19 nt, Human
ugaagcagcaaacucucag

SEQ ID NO: 616173 - RNA, 22 nt, Human
ccugagcuggcagugaccugga

SEQ ID NO: 616174 - RNA, 20 nt, Human
ccagacagcaccugccuggu

SEQ ID NO: 616175 - RNA, 22 nt, Human
ggcguggggccuucugcccgcu

SEQ ID NO: 616176 - RNA, 18 nt, Human
aagcaggguccauugugc

SEQ ID NO: 616177 - RNA, 19 nt, Human
gcucagagacaccuguugc

SEQ ID NO: 616178 - RNA, 22 nt, Human
agagccugggaauuugcauguu

SEQ ID NO: 616179 - RNA, 21 nt, Human
aaugugugcuauuuaucuuuu

SEQ ID NO: 616180 - RNA, 22 nt, Human
gucagugugagauaaucuugga

SEQ ID NO: 616181 - RNA, 22 nt, Human
agggagaguuugauguuuccuc

SEQ ID NO: 616182 - RNA, 22 nt, Human
acuuccuuuugggaaacuguuu

SEQ ID NO: 616183 - RNA, 22 nt, Human
agguccuguccuuggucucuga

SEQ ID NO: 616184 - RNA, 22 nt, Human
aauguauucugggaaaauguua

SEQ ID NO: 616185 - RNA, 22 nt, Human
ggagaaggaauauuggaguagg

SEQ ID NO: 616186 - RNA, 22 nt, Human
cagaaauauuuauugagugaca

SEQ ID NO: 616187 - RNA, 22 nt, Human
ccuggggcucugcacagagcag

SEQ ID NO: 616188 - RNA, 22 nt, Human
cagguccagaaaccaaaggauu

SEQ ID NO: 616189 - RNA, 22 nt, Human
aaugauuuccccuacacagaag

SEQ ID NO: 616190 - RNA, 22 nt, Human
cuccugaggaaaagcuugguca

SEQ ID NO: 616191 - RNA, 22 nt, Human
ggagaggcgaugagucacagcc

SEQ ID NO: 616192 - RNA, 22 nt, Human
cuggccugugggcugucuccgg

SEQ ID NO: 616193 - RNA, 22 nt, Human
aaucucuucccaguaaaaaugg

SEQ ID NO: 616194 - RNA, 22 nt, Human
uguccacuuugucagugucaua

SEQ ID NO: 616195 - RNA, 22 nt, Human
ggcccuguccccuucaguuuug

SEQ ID NO: 616196 - RNA, 22 nt, Human
guggcucuggcuuuccaggcgg

SEQ ID NO: 616197 - RNA, 22 nt, Human
ugcacuuuuauaucacucuggc

SEQ ID NO: 616198 - RNA, 22 nt, Human
uccaggagugcugguuagagua

SEQ ID NO: 616199 - RNA, 22 nt, Human
cacaguguuugauuuaggggcc

SEQ ID NO: 616200 - RNA, 22 nt, Human
acuguggccggaacagugggac

SEQ ID NO: 616201 - RNA, 22 nt, Human
aaggcuggaguacagugcagug

SEQ ID NO: 616202 - RNA, 19 nt, Human
ugucccuggucaccagacu

SEQ ID NO: 616203 - RNA, 22 nt, Human
ugaaaccacugaugguaccaag

SEQ ID NO: 616204 - RNA, 22 nt, Human
cuucaaauacaaguagauuaug

SEQ ID NO: 616205 - RNA, 22 nt, Human
cugcccuguagcuguucuagca

SEQ ID NO: 616206 - RNA, 22 nt, Human
augcauuuuugaguaugaauga

SEQ ID NO: 616207 - RNA, 22 nt, Human
uuuauuuauaagccacuugcug

SEQ ID NO: 616208 - RNA, 18 nt, Human
aggcaggugcuggaaguc

SEQ ID NO: 616209 - RNA, 22 nt, Human
ugaggcaggacugagcgggaug

SEQ ID NO: 616210 - RNA, 22 nt, Human
ugugaagguuaaauaauaugau

SEQ ID NO: 616211 - RNA, 22 nt, Human
caccagcuacagacuacugugu

SEQ ID NO: 616212 - RNA, 22 nt, Human
caugaaagcaggaaugguuuua

SEQ ID NO: 616213 - RNA, 22 nt, Human
ugccuucacugagcuuauggga

SEQ ID NO: 616214 - RNA, 22 nt, Human
cccagaggugaaggagguggga

SEQ ID NO: 616215 - RNA, 22 nt, Human
uuggaaggauuuagagaugucu

SEQ ID NO: 616216 - RNA, 22 nt, Human
gcuggcugaguucugucgucug

SEQ ID NO: 616217 - RNA, 22 nt, Human
agcuccugggccaagcccaugc

SEQ ID NO: 616218 - RNA, 22 nt, Human
gggcagguuggcaucccgggca

SEQ ID NO: 616219 - RNA, 22 nt, Human
agccuucaaccuagcuagagca

SEQ ID NO: 616220 - RNA, 22 nt, Human
gagaagggauauggcuucuuga

SEQ ID NO: 616221 - RNA, 22 nt, Human
auaugaguuucccacuucugga

SEQ ID NO: 616222 - RNA, 23 nt, Human
ccuggguuucagagcugcuuuuc

SEQ ID NO: 616223 - RNA, 22 nt, Human
guuccuuggaagaacuugaggu

SEQ ID NO: 616224 - RNA, 22 nt, Human
cagugggguuucugugggugcu

SEQ ID NO: 616225 - RNA, 23 nt, Human
ccgugaagacagacagacagcag

SEQ ID NO: 616226 - RNA, 22 nt, Human
cagggcggggucugccggcccu

SEQ ID NO: 616227 - RNA, 22 nt, Human
guauuuuuagguaaggaaagua

SEQ ID NO: 616228 - RNA, 22 nt, Human
aggcuccagcagccagaggaag

SEQ ID NO: 616229 - RNA, 22 nt, Human
ucagcaggcugucagcaggggc

SEQ ID NO: 616230 - RNA, 22 nt, Human
uggccagccuugucaucgcuuu

SEQ ID NO: 616231 - RNA, 22 nt, Human
uccugaggaugguugaagugca

SEQ ID NO: 616232 - RNA, 21 nt, Human
aaggcuggagaugcaggucug

SEQ ID NO: 616233 - RNA, 22 nt, Human
uauguugaucauagguaaaaga

SEQ ID NO: 616234 - RNA, 22 nt, Human
agagccaggcggcugggcaccu

SEQ ID NO: 616235 - RNA, 22 nt, Human
auguggcugccaccugccugaa

SEQ ID NO: 616236 - RNA, 22 nt, Human
ugcacaaaggcucccugcugag

SEQ ID NO: 616237 - RNA, 22 nt, Human
guccagagauggacgagcagau

SEQ ID NO: 616238 - RNA, 22 nt, Human
ugguccagacauuucugaggua

SEQ ID NO: 616239 - RNA, 22 nt, Human
guuuauaagguaaaggagagag

SEQ ID NO: 616240 - RNA, 22 nt, Human
uuaaaauuuccccaccauguau

SEQ ID NO: 616241 - RNA, 22 nt, Human
aagccaaauaauguagguacau

SEQ ID NO: 616242 - RNA, 22 nt, Human
gccaggagugucccacucauuu

SEQ ID NO: 616243 - RNA, 22 nt, Human
uuaagaaugugccuuuugguug

SEQ ID NO: 616244 - RNA, 22 nt, Human
ugggagcagcagggagaugcgg

SEQ ID NO: 616245 - RNA, 22 nt, Human
agcugguaaaggggaaagcaga

SEQ ID NO: 616246 - RNA, 22 nt, Human
cuccugggaaaugaaggggcag

SEQ ID NO: 616247 - RNA, 19 nt, Human
uggccaccucugcuguucu

SEQ ID NO: 616248 - RNA, 22 nt, Human
cuccagugagcgcggggcaugg

SEQ ID NO: 616249 - RNA, 22 nt, Human
ggagaaggcacacccaccucug

SEQ ID NO: 616250 - RNA, 19 nt, Human
agagccagacagcauagga

SEQ ID NO: 616251 - RNA, 22 nt, Human
gguggggccagggcuccaaccu

SEQ ID NO: 616252 - RNA, 22 nt, Human
uuuauucuagcucagaauaguu

SEQ ID NO: 616253 - RNA, 20 nt, Human
gcucuuuguaagggaauuug

SEQ ID NO: 616254 - RNA, 22 nt, Human
ccugggagccgacugacugugc

SEQ ID NO: 616255 - RNA, 22 nt, Human
gugcuccucacaguguggcccu

SEQ ID NO: 616256 - RNA, 22 nt, Human
acaguguucacuuaacaaugga

SEQ ID NO: 616257 - RNA, 22 nt, Human
ucucuucuagcuucuugugguu

SEQ ID NO: 616258 - RNA, 22 nt, Human
gaaguagauucguugcaucuug

SEQ ID NO: 616259 - RNA, 22 nt, Human
uuccuuugggaaaucacuaagg

SEQ ID NO: 616260 - RNA, 23 nt, Human
cugggcugcuugagucccuggcu

SEQ ID NO: 616261 - RNA, 22 nt, Human
uggcuccuggcagguguuucaa

SEQ ID NO: 616262 - RNA, 23 nt, Human
aagcacagaaugguuuaggaguu

SEQ ID NO: 616263 - RNA, 22 nt, Human
uggaugugucgcccuggcucuc

SEQ ID NO: 616264 - RNA, 22 nt, Human
gugcccugaaagaguuaauuca

SEQ ID NO: 616265 - RNA, 22 nt, Human
caggccagagcgcgugguuggg

SEQ ID NO: 616266 - RNA, 22 nt, Human
ucugggcucacgagucuggaca

SEQ ID NO: 616267 - RNA, 22 nt, Human
gccucugucauagcucauguga

SEQ ID NO: 616268 - RNA, 22 nt, Human
uuucucaaaagacagaagugaa

SEQ ID NO: 616269 - RNA, 22 nt, Human
augcacaagaggcuagaaaaga

SEQ ID NO: 616270 - RNA, 22 nt, Human
uuccuccagccuggagcacuuc

SEQ ID NO: 616271 - RNA, 21 nt, Human
ugugaguccaucugagcagaa

SEQ ID NO: 616272 - RNA, 22 nt, Human
uccagggaugccagccauguug

SEQ ID NO: 616273 - RNA, 22 nt, Human
agaaugugaagauuuugaauua

SEQ ID NO: 616274 - RNA, 22 nt, Human
aggugacugguuuaucuggcag

SEQ ID NO: 616275 - RNA, 22 nt, Human
ggaaggcagugaaggggcugau

SEQ ID NO: 616276 - RNA, 22 nt, Human
gagagcaggcucucgggggcca

SEQ ID NO: 616277 - RNA, 22 nt, Human
ugggcagggaucucuuuugcaa

SEQ ID NO: 616278 - RNA, 22 nt, Human
ugaggcaguugagcuuccugag

SEQ ID NO: 616279 - RNA, 22 nt, Human
ggauacagcggcuucugcgcga

SEQ ID NO: 616280 - RNA, 22 nt, Human
acagcaguggugcacugagcca

SEQ ID NO: 616281 - RNA, 22 nt, Human
uaauacagaaguguauuaaaau

SEQ ID NO: 616282 - RNA, 22 nt, Human
uguggggaagaguaugacuugg

SEQ ID NO: 616283 - RNA, 22 nt, Human
aaauauaguaaaugcauaguuc

SEQ ID NO: 616284 - RNA, 22 nt, Human
guuucaauuugacccaaaucuu

SEQ ID NO: 616285 - RNA, 22 nt, Human
gccucuguggcucagccuugcu

SEQ ID NO: 616286 - RNA, 22 nt, Human
accuguuuacccugggcucccc

SEQ ID NO: 616287 - RNA, 22 nt, Human
gcugguccucaagggcacagcc

SEQ ID NO: 616288 - RNA, 22 nt, Human
cuuuucugugaugcugacaguc

SEQ ID NO: 616289 - RNA, 22 nt, Human
acuaggaaggcauaugggcaga

SEQ ID NO: 616290 - RNA, 22 nt, Human
agaaaaagucaaggaauuggac

SEQ ID NO: 616291 - RNA, 23 nt, Human
agguggagcugugcagccggggc

SEQ ID NO: 616292 - RNA, 18 nt, Human
gcuccuggagucugacuc

SEQ ID NO: 616293 - RNA, 21 nt, Human
agguuccagcagccagagaau

SEQ ID NO: 616294 - RNA, 22 nt, Human
ggcaggugcuugucgaaggccu

SEQ ID NO: 616295 - RNA, 22 nt, Human
auguaaauuguacugacacacg

SEQ ID NO: 616296 - RNA, 22 nt, Human
ucuggcugcguggccuuuagca

SEQ ID NO: 616297 - RNA, 22 nt, Human
guugacagaaaaauaacauagc

SEQ ID NO: 616298 - RNA, 20 nt, Human
cucacagucaaugcagaggu

SEQ ID NO: 616299 - RNA, 22 nt, Human
uccucacacuauagaugaggau

SEQ ID NO: 616300 - RNA, 22 nt, Human
agagggaucacccuguuucugg

SEQ ID NO: 616301 - RNA, 22 nt, Human
ucccuggcagcuguccuuucag

SEQ ID NO: 616302 - RNA, 22 nt, Human
ugguccaguaaggguggagaga

SEQ ID NO: 616303 - RNA, 22 nt, Human
uccagggccaugaaguugcaca

SEQ ID NO: 616304 - RNA, 22 nt, Human
uuucaugcacaaaugagcaagg

SEQ ID NO: 616305 - RNA, 22 nt, Human
cuccugggaauuuaguugugag

SEQ ID NO: 616306 - RNA, 22 nt, Human
aagcagaacugggaaguagugg

SEQ ID NO: 616307 - RNA, 22 nt, Human
caaauggauacaggcaaacauu

SEQ ID NO: 616308 - RNA, 22 nt, Human
uggcagguuucguuaaaaaugg

SEQ ID NO: 616309 - RNA, 22 nt, Human
aacuucauuccuuuuuaugacu

SEQ ID NO: 616310 - RNA, 22 nt, Human
ucagcaggcccauccuccaggc

SEQ ID NO: 616311 - RNA, 22 nt, Human
agguccaggagauuuggcaauu

SEQ ID NO: 616312 - RNA, 18 nt, Human
gaguguggcacugggccc

SEQ ID NO: 616313 - RNA, 22 nt, Human
aggcauggggcugcagucaggu

SEQ ID NO: 616314 - RNA, 22 nt, Human
uguuaaaguggauaagcugaau

SEQ ID NO: 616315 - RNA, 22 nt, Human
ccaggcugcuguugguguccgc

SEQ ID NO: 616316 - RNA, 22 nt, Human
ugcuuccuucccguucuucucc

SEQ ID NO: 616317 - RNA, 22 nt, Human
uggccacccagcugacgccuuc

SEQ ID NO: 616318 - RNA, 22 nt, Human
agcugccucugcugguuuagaa

SEQ ID NO: 616319 - RNA, 22 nt, Human
gccagccugugcuuggccaggc

SEQ ID NO: 616320 - RNA, 22 nt, Human
aggcuaggguaacagauguggc

SEQ ID NO: 616321 - RNA, 22 nt, Human
gccuguuuggaaucuguuuaau

SEQ ID NO: 616322 - RNA, 20 nt, Human
uccugcagucgcuagcgccc

SEQ ID NO: 616323 - RNA, 22 nt, Human
uguguuuacuucuaugcaguuu

SEQ ID NO: 616324 - RNA, 22 nt, Human
ucagcucucacagaucucaacc

SEQ ID NO: 616325 - RNA, 22 nt, Human
aaguuagaaauaagggcucucc

SEQ ID NO: 616326 - RNA, 22 nt, Human
ugcuuaaaaagcuccaucaaua

SEQ ID NO: 616327 - RNA, 22 nt, Human
gagguccaggguggggccugag

SEQ ID NO: 616328 - RNA, 22 nt, Human
gaaauacaggaaugccacacag

SEQ ID NO: 616329 - RNA, 22 nt, Human
gaggcuagauguuugcugggag

SEQ ID NO: 616330 - RNA, 22 nt, Human
gaugagaauguuuaucaaaugc

SEQ ID NO: 616331 - RNA, 22 nt, Human
uuggaaauggcuguaguuauga

SEQ ID NO: 616332 - RNA, 22 nt, Human
ggacugggccagggguuggacu

SEQ ID NO: 616333 - RNA, 22 nt, Human
uuucaaagguggaagagugaau

SEQ ID NO: 616334 - RNA, 22 nt, Human
ucccugggcacaaucugcuggc

SEQ ID NO: 616335 - RNA, 22 nt, Human
ugugucuguccucgguugaugc

SEQ ID NO: 616336 - RNA, 18 nt, Human
uuucacaaccuccagagg

SEQ ID NO: 616337 - RNA, 22 nt, Human
ucuguuuucauuugucuugaga

SEQ ID NO: 616338 - RNA, 22 nt, Human
cugacccuugcucgggcccugu

SEQ ID NO: 616339 - RNA, 22 nt, Human
uccccagucccggcggugggug

SEQ ID NO: 616340 - RNA, 22 nt, Human
ccugucugaggaggugcucuuu

SEQ ID NO: 616341 - RNA, 22 nt, Human
gaggaggcuuccgggaggcacg

SEQ ID NO: 616342 - RNA, 22 nt, Human
acauuucucccugcaugccugc

SEQ ID NO: 616343 - RNA, 22 nt, Human
cuguaucuguguuggaugaguu

SEQ ID NO: 616344 - RNA, 22 nt, Human
caguaaauauaggaacguggaa

SEQ ID NO: 616345 - RNA, 22 nt, Human
gcagcaggaauuuaaauuuaua

SEQ ID NO: 616346 - RNA, 22 nt, Human
cugccaggcugucccagguccg

SEQ ID NO: 616347 - RNA, 23 nt, Human
ucaaaggaggcaucguucugcag

SEQ ID NO: 616348 - RNA, 22 nt, Human
cuguggugagcaacugacugaa

SEQ ID NO: 616349 - RNA, 22 nt, Human
ggcuauauccucacaagaugga

SEQ ID NO: 616350 - RNA, 22 nt, Human
uaaagacaugcaaagucuaauu

SEQ ID NO: 616351 - RNA, 22 nt, Human
accugggaggcagagguugcag

SEQ ID NO: 616352 - RNA, 19 nt, Human
ccagcagguucauuucagg

SEQ ID NO: 616353 - RNA, 22 nt, Human
cacagugucugugcuucagugu

SEQ ID NO: 616354 - RNA, 22 nt, Human
agaagccagauuguagugggac

SEQ ID NO: 616355 - RNA, 20 nt, Human
guggagaggcuggcgggacu

SEQ ID NO: 616356 - RNA, 21 nt, Human
gaagacaaaugggaauagcug

SEQ ID NO: 616357 - RNA, 23 nt, Human
augguccagccagcugcacagga

SEQ ID NO: 616358 - RNA, 22 nt, Human
ucccaaagcuacucuucugacu

SEQ ID NO: 616359 - RNA, 22 nt, Human
gcggggggcagcagucgcucag

SEQ ID NO: 616360 - RNA, 22 nt, Human
ccucuucuaggacguccuugug

SEQ ID NO: 616361 - RNA, 22 nt, Human
cugcccugugcacaggaaacug

SEQ ID NO: 616362 - RNA, 22 nt, Human
gauuagaugacuaaugagcugu

SEQ ID NO: 616363 - RNA, 22 nt, Human
ucagcagggaggcucugugccc

SEQ ID NO: 616364 - RNA, 22 nt, Human
guauuuuucaguuaggagcuua

SEQ ID NO: 616365 - RNA, 19 nt, Human
acauauguggauauacaug

SEQ ID NO: 616366 - RNA, 22 nt, Human
gcuaccugagcaagagcuucaa

SEQ ID NO: 616367 - RNA, 22 nt, Human
ucaguguuugaacccaggguua

SEQ ID NO: 616368 - RNA, 22 nt, Human
auuaguguacaucucacacgca

SEQ ID NO: 616369 - RNA, 22 nt, Human
aucuuggggaauccucugugua

SEQ ID NO: 616370 - RNA, 22 nt, Human
gcauggccuucagggacagcug

SEQ ID NO: 616371 - RNA, 20 nt, Human
aagguccaaacucuguguuc

SEQ ID NO: 616372 - RNA, 22 nt, Human
uccuggagcuggugucuuuccc

SEQ ID NO: 616373 - RNA, 22 nt, Human
auguguauccaucugucuauuu

SEQ ID NO: 616374 - RNA, 22 nt, Human
guggaaggugaaggagcagcga

SEQ ID NO: 616375 - RNA, 22 nt, Human
gaugcaggugugccacagagcu

SEQ ID NO: 616376 - RNA, 22 nt, Human
gucuggcuagagacacccuccc

SEQ ID NO: 616377 - RNA, 22 nt, Human
auccugggcaaaguaugcuguc

SEQ ID NO: 616378 - RNA, 22 nt, Human
guaagccucugcucuaucuggu

SEQ ID NO: 616379 - RNA, 22 nt, Human
uuaaauuccagccucauaauag

SEQ ID NO: 616380 - RNA, 22 nt, Human
acagggucuuagagaucaccug

SEQ ID NO: 616381 - RNA, 22 nt, Human
gagaaggggugauguggguaau

SEQ ID NO: 616382 - RNA, 22 nt, Human
guggaagggacugccuagagga

SEQ ID NO: 616383 - RNA, 22 nt, Human
uaccucaaguuccaggaaagcg

SEQ ID NO: 616384 - RNA, 22 nt, Human
gugggagaagcccuguucguag

SEQ ID NO: 616385 - RNA, 22 nt, Human
gcaguguuucagugcuuuuucu

SEQ ID NO: 616386 - RNA, 22 nt, Human
uucaccuguguuuuguggcuga

SEQ ID NO: 616387 - RNA, 22 nt, Human
cugugccuccagucucgcuucu

SEQ ID NO: 616388 - RNA, 22 nt, Human
cagugcaagugacugaucaagg

SEQ ID NO: 616389 - RNA, 22 nt, Human
ucagaaacacucuucuucuguc

SEQ ID NO: 616390 - RNA, 22 nt, Human
agcaggucuugcucucaacagg

SEQ ID NO: 616391 - RNA, 22 nt, Human
guggcauugacauguaaacagu

SEQ ID NO: 616392 - RNA, 22 nt, Human
cuggagucacucauguagcugc

SEQ ID NO: 616393 - RNA, 22 nt, Human
aaagccuuuuaugaucaguuaa

SEQ ID NO: 616394 - RNA, 22 nt, Human
auuggaaauacaguagaaaaau

SEQ ID NO: 616395 - RNA, 22 nt, Human
auguaaaguaucugaaaugcug

SEQ ID NO: 616396 - RNA, 22 nt, Human
gcuggguuuucuuccgggccua

SEQ ID NO: 616397 - RNA, 22 nt, Human
acugucuccucaucaugccugg

SEQ ID NO: 616398 - RNA, 22 nt, Human
cuggaaggguacauaggaaacu

SEQ ID NO: 616399 - RNA, 22 nt, Human
cccagccucugggcucacccaa

SEQ ID NO: 616400 - RNA, 22 nt, Human
caucuugcuugucuuuaguaag

SEQ ID NO: 616401 - RNA, 22 nt, Human
agcuuucacgauuuggaacagg

SEQ ID NO: 616402 - RNA, 22 nt, Human
caaguuuuagaaauaucuggau

SEQ ID NO: 616403 - RNA, 22 nt, Human
cuggcucccaugagcucucacg

SEQ ID NO: 616404 - RNA, 22 nt, Human
cgaggcggcggaagugcccgua

SEQ ID NO: 616405 - RNA, 22 nt, Human
uccugagggcugcagucauagg

SEQ ID NO: 616406 - RNA, 22 nt, Human
ggacaggugacugcccagagug

SEQ ID NO: 616407 - RNA, 22 nt, Human
cugugggcuccugcagcucagg

SEQ ID NO: 616408 - RNA, 23 nt, Human
gcagaaauucucacacugaggcc

SEQ ID NO: 616409 - RNA, 22 nt, Human
gcuggcuguguuccuucugcca

SEQ ID NO: 616410 - RNA, 22 nt, Human
cuguggcuuugugucuauugua

SEQ ID NO: 616411 - RNA, 22 nt, Human
cuggguucuauuuuuggcuuca

SEQ ID NO: 616412 - RNA, 22 nt, Human
auucaauaaauaugcuacaugg

SEQ ID NO: 616413 - RNA, 22 nt, Human
gcagggucgcucuaggagauca

SEQ ID NO: 616414 - RNA, 22 nt, Human
aggaagcuuggggcagggcuac

SEQ ID NO: 616415 - RNA, 22 nt, Human
guccugggggcagcugugucca

SEQ ID NO: 616416 - RNA, 22 nt, Human
acagcucugagauauuacuauu

SEQ ID NO: 616417 - RNA, 22 nt, Human
acauuucugcuagaauagguga

SEQ ID NO: 616418 - RNA, 22 nt, Human
ccaaaggaugucccuguguuuu

SEQ ID NO: 616419 - RNA, 22 nt, Human
ugggcucuggggaaacugugau

SEQ ID NO: 616420 - RNA, 22 nt, Human
ugccuggcugaggugacagguu

SEQ ID NO: 616421 - RNA, 22 nt, Human
cugggcucagcaggccaaggcc

SEQ ID NO: 616422 - RNA, 22 nt, Human
cuuuacagauaggaacuacuca

SEQ ID NO: 616423 - RNA, 22 nt, Human
ugauacauaaaccaucauuuug

SEQ ID NO: 616424 - RNA, 22 nt, Human
caguaaaagauggaaauagaau

SEQ ID NO: 616425 - RNA, 22 nt, Human
gaauuccuuaggcucuugacug

SEQ ID NO: 616426 - RNA, 22 nt, Human
gccuggagggucccucucugga

SEQ ID NO: 616427 - RNA, 22 nt, Human
acaaaauagaguucuccccugg

SEQ ID NO: 616428 - RNA, 22 nt, Human
ucaguguuuccugugguacagc

SEQ ID NO: 616429 - RNA, 22 nt, Human
gcccagcugucuggcagggaug

SEQ ID NO: 616430 - RNA, 22 nt, Human
ugcuuuaaaccauggaugugag

SEQ ID NO: 616431 - RNA, 22 nt, Human
ucagaggcuugaagcccaagcc

SEQ ID NO: 616432 - RNA, 22 nt, Human
aggucagguaucagcagguauu

SEQ ID NO: 616433 - RNA, 22 nt, Human
uguggucuccugucuuggccuu

SEQ ID NO: 616434 - RNA, 21 nt, Human
cccuucuugggucaaaguaua

SEQ ID NO: 616435 - RNA, 22 nt, Human
agucuguggauggacuggcaga

SEQ ID NO: 616436 - RNA, 22 nt, Human
aggaucaaaugaaauauuuuga

SEQ ID NO: 616437 - RNA, 23 nt, Human
cagugggcuucuaacugcuccug

SEQ ID NO: 616438 - RNA, 22 nt, Human
accuucaaguaugugggcugaa

SEQ ID NO: 616439 - RNA, 23 nt, Human
cuguggcugaguccuguuggagu

SEQ ID NO: 616440 - RNA, 22 nt, Human
agggcuuuacuucucaguucua

SEQ ID NO: 616441 - RNA, 22 nt, Human
cugugcuuucgagaugugaucu

SEQ ID NO: 616442 - RNA, 22 nt, Human
guucgcaucuugaucauggacu

SEQ ID NO: 616443 - RNA, 20 nt, Human
caugcugccuccauugaugc

SEQ ID NO: 616444 - RNA, 22 nt, Human
gcaguguucuuguugcuuuuau

SEQ ID NO: 616445 - RNA, 22 nt, Human
ggaggccaaagugugggcggcu

SEQ ID NO: 616446 - RNA, 22 nt, Human
gcuggagucuggaggugugcca

SEQ ID NO: 616447 - RNA, 22 nt, Human
ggaggcggggaaggcaucccau

SEQ ID NO: 616448 - RNA, 22 nt, Human
agggccagagucuguguagaua

SEQ ID NO: 616449 - RNA, 22 nt, Human
gcuggccuugugucugaggaag

SEQ ID NO: 616450 - RNA, 22 nt, Human
aaauugcuaaauuguaagaggg

SEQ ID NO: 616451 - RNA, 22 nt, Human
uacaagaaacuacaugaaugca

SEQ ID NO: 616452 - RNA, 22 nt, Human
uuggaaggcccugccuagcagg

SEQ ID NO: 616453 - RNA, 22 nt, Human
agagguggccaugggcgcugga

SEQ ID NO: 616454 - RNA, 22 nt, Human
gguggccauaggaccagccugg

SEQ ID NO: 616455 - RNA, 23 nt, Human
cugcccugaucuugaucuauugu

SEQ ID NO: 616456 - RNA, 22 nt, Human
uccugugucucagcgugaagca

SEQ ID NO: 616457 - RNA, 22 nt, Human
uagguccagcacgguguagcuu

SEQ ID NO: 616458 - RNA, 22 nt, Human
ugaaggucaugguaauauuuuu

SEQ ID NO: 616459 - RNA, 22 nt, Human
aggcagguuacaaaaacuuuau

SEQ ID NO: 616460 - RNA, 22 nt, Human
gccugggauagaggcaaugcau

SEQ ID NO: 616461 - RNA, 22 nt, Human
uagguucagcuuucauccugaa

SEQ ID NO: 616462 - RNA, 22 nt, Human
cuggagaaguacugagacauuu

SEQ ID NO: 616463 - RNA, 22 nt, Human
ccaggccagcgcuggcuggagg

SEQ ID NO: 616464 - RNA, 22 nt, Human
cuuuucuggaaucaucucuaac

SEQ ID NO: 616465 - RNA, 22 nt, Human
uggagucacuuccauaugggaa

SEQ ID NO: 616466 - RNA, 22 nt, Human
auuucucaaccaggucaaaaag

SEQ ID NO: 616467 - RNA, 22 nt, Human
ggcagucccaggcugcauguug

SEQ ID NO: 616468 - RNA, 22 nt, Human
uccagggccacagaggaugcua

SEQ ID NO: 616469 - RNA, 22 nt, Human
uuuauauuguaaaaaugguucu

SEQ ID NO: 616470 - RNA, 22 nt, Human
gugcauauguguguauacaaac

SEQ ID NO: 616471 - RNA, 22 nt, Human
uggagagguuuaaacaaaaguu

SEQ ID NO: 616472 - RNA, 21 nt, Human
uggcuuuuauggagcucuggg

SEQ ID NO: 616473 - RNA, 22 nt, Human
agcuucuguucaucuuccaggc

SEQ ID NO: 616474 - RNA, 22 nt, Human
ucucuuuguggccaggagagga

SEQ ID NO: 616475 - RNA, 22 nt, Human
cugguuaaaugaaaaaguauua

SEQ ID NO: 616476 - RNA, 22 nt, Human
gcagccagaagacucagaacaa

SEQ ID NO: 616477 - RNA, 22 nt, Human
cugggucugggccuccuggagu

SEQ ID NO: 616478 - RNA, 22 nt, Human
ugcccuguggguaucugauggc

SEQ ID NO: 616479 - RNA, 22 nt, Human
cauuugcuagcaggccuuuuau

SEQ ID NO: 616480 - RNA, 22 nt, Human
agaggcaggagguugacuugag

SEQ ID NO: 616481 - RNA, 22 nt, Human
caggcuccuucccagggauggu

SEQ ID NO: 616482 - RNA, 22 nt, Human
cccuguuuuaaguugauauuga

SEQ ID NO: 616483 - RNA, 22 nt, Human
caaagaaggaacuauaauccca

SEQ ID NO: 616484 - RNA, 22 nt, Human
guggcaggagacuggaagaugg

SEQ ID NO: 616485 - RNA, 22 nt, Human
ucuucuguuuuagauugcauac

SEQ ID NO: 616486 - RNA, 22 nt, Human
gaagcagaaguacgauuuacua

SEQ ID NO: 616487 - RNA, 22 nt, Human
aagccaguaaguuuuugucauu

SEQ ID NO: 616488 - RNA, 22 nt, Human
gcaaguacaaacgcaucggcug

SEQ ID NO: 616489 - RNA, 23 nt, Human
uuguauuuuuaguagagacaggg

SEQ ID NO: 616490 - RNA, 22 nt, Human
uuggaaggggcagaguggcugc

SEQ ID NO: 616491 - RNA, 22 nt, Human
ugggagagaauucuggugacug

SEQ ID NO: 616492 - RNA, 19 nt, Human
uggaaaauggauugaauca

SEQ ID NO: 616493 - RNA, 22 nt, Human
ggaagaaaucugguuaagagau

SEQ ID NO: 616494 - RNA, 20 nt, Human
ggcaggacccgguagggagc

SEQ ID NO: 616495 - RNA, 22 nt, Human
uuuccuuguucauuugcccuau

SEQ ID NO: 616496 - RNA, 22 nt, Human
caggcuggaguuaccuuuaggg

SEQ ID NO: 616497 - RNA, 22 nt, Human
ugauaaacuggagagguggagg

SEQ ID NO: 616498 - RNA, 22 nt, Human
ggugcaggacgaaguggggguu

SEQ ID NO: 616499 - RNA, 22 nt, Human
gcuccugggcucuaccuugcua

SEQ ID NO: 616500 - RNA, 22 nt, Human
gcugaggcaagauuugaaccca

SEQ ID NO: 616501 - RNA, 22 nt, Human
uccuguuuaucugugugacucg

SEQ ID NO: 616502 - RNA, 22 nt, Human
agcuccaggugcaagucauggu

SEQ ID NO: 616503 - RNA, 22 nt, Human
ugaguccagaugggccagcagg

SEQ ID NO: 616504 - RNA, 22 nt, Human
augcccugcaucaagugacacu

SEQ ID NO: 616505 - RNA, 22 nt, Human
guuccuugggaacaacgcugaa

SEQ ID NO: 616506 - RNA, 22 nt, Human
caguuuugguccuuucuaggua

SEQ ID NO: 616507 - RNA, 22 nt, Human
uccuguggcguuaucaugugau

SEQ ID NO: 616508 - RNA, 22 nt, Human
aggaaauaggaccagacaaagc

SEQ ID NO: 616509 - RNA, 22 nt, Human
gaaauauugggacucagagcuu

SEQ ID NO: 616510 - RNA, 22 nt, Human
caaguccaagaucaagaagcca

SEQ ID NO: 616511 - RNA, 22 nt, Human
aaauaugagggugaugcccaga

SEQ ID NO: 616512 - RNA, 22 nt, Human
gaggccuggaauuccagccugg

SEQ ID NO: 616513 - RNA, 22 nt, Human
uucagcuucauuugucuuuaug

SEQ ID NO: 616514 - RNA, 22 nt, Human
acauuuuuggguugaugucuga

SEQ ID NO: 616515 - RNA, 22 nt, Human
uauuuucuggggagagugaacc

SEQ ID NO: 616516 - RNA, 22 nt, Human
caggcccauuuguagccacuuu

SEQ ID NO: 616517 - RNA, 22 nt, Human
gcaguguuauguuuucuauaau

SEQ ID NO: 616518 - RNA, 21 nt, Human
uuccuggggaaggagcugccu

SEQ ID NO: 616519 - RNA, 22 nt, Human
gcgguccaggagcgcagguccu

SEQ ID NO: 616520 - RNA, 22 nt, Human
cagggcauuacuucagguccuu

SEQ ID NO: 616521 - RNA, 22 nt, Human
aacaaacaguuaaguguggaug

SEQ ID NO: 616522 - RNA, 22 nt, Human
uccugguguuuaugucacauag

SEQ ID NO: 616523 - RNA, 21 nt, Human
ugcagcagaagucucuguguc

SEQ ID NO: 616524 - RNA, 18 nt, Human
ccagggagcuuauuagga

SEQ ID NO: 616525 - RNA, 22 nt, Human
acaguguuuuagaaaagcuuga

SEQ ID NO: 616526 - RNA, 22 nt, Human
aaguuuugaaauacugaagugu

SEQ ID NO: 616527 - RNA, 22 nt, Human
cagguccaacuauuuaucugug

SEQ ID NO: 616528 - RNA, 22 nt, Human
ucuggccccggucuucacagcu

SEQ ID NO: 616529 - RNA, 22 nt, Human
ucuggcuucccacucugccggg

SEQ ID NO: 616530 - RNA, 22 nt, Human
cuuuucuuauguggacguaccu

SEQ ID NO: 616531 - RNA, 21 nt, Human
agcuggaaucuggcugugcuu

SEQ ID NO: 616532 - RNA, 22 nt, Human
uagggacaaagagcugaggccu

SEQ ID NO: 616533 - RNA, 19 nt, Human
agaggcagucuccaacagg

SEQ ID NO: 616534 - RNA, 22 nt, Human
cugcccugggaguaccuguccu

SEQ ID NO: 616535 - RNA, 22 nt, Human
ggcaggcgugguggccucagaa

SEQ ID NO: 616536 - RNA, 22 nt, Human
auauuguacuaggguuacaugu

SEQ ID NO: 616537 - RNA, 19 nt, Human
aaauggagcuaaucuuguc

SEQ ID NO: 616538 - RNA, 22 nt, Human
ugucugcuacuugguucuacca

SEQ ID NO: 616539 - RNA, 22 nt, Human
agacaauauauaauuuuaguug

SEQ ID NO: 616540 - RNA, 22 nt, Human
cugcccugggauggucugugcg

SEQ ID NO: 616541 - RNA, 22 nt, Human
ccagagguccugcucacuggug

SEQ ID NO: 616542 - RNA, 20 nt, Human
ugguccugucccacccacuc

SEQ ID NO: 616543 - RNA, 22 nt, Human
ggcacuuugccuuuaugcacug

SEQ ID NO: 616544 - RNA, 22 nt, Human
gcugaggcugggagcagccugu

SEQ ID NO: 616545 - RNA, 22 nt, Human
gggucuggcaugcugagaugga

SEQ ID NO: 616546 - RNA, 22 nt, Human
augcccugaaagauucaaaggc

SEQ ID NO: 616547 - RNA, 22 nt, Human
uggagagguugaauaacuuguc

SEQ ID NO: 616548 - RNA, 22 nt, Human
uguuuuuccaugugcagaacaa

SEQ ID NO: 616549 - RNA, 22 nt, Human
cuguggcuuucucugccuccuu

SEQ ID NO: 616550 - RNA, 22 nt, Human
gcagaggauagcauaugaaccu

SEQ ID NO: 616551 - RNA, 22 nt, Human
aggaagcuaaccagggagugag

SEQ ID NO: 616552 - RNA, 22 nt, Human
agagucugccuuuuucuccugc

SEQ ID NO: 616553 - RNA, 22 nt, Human
agguccuggugaccauggaguu

SEQ ID NO: 616554 - RNA, 22 nt, Human
uuugcaaauaccaugaaacuug

SEQ ID NO: 616555 - RNA, 22 nt, Human
ggccagguuggguggaaguggc

SEQ ID NO: 616556 - RNA, 22 nt, Human
uccaggcacagaguuggucagu

SEQ ID NO: 616557 - RNA, 22 nt, Human
cacacaaauauucuggaggcaa

SEQ ID NO: 616558 - RNA, 18 nt, Human
ggucaggggcggagagaa

SEQ ID NO: 616559 - RNA, 22 nt, Human
ucaguaaaucucuaauuggcau

SEQ ID NO: 616560 - RNA, 22 nt, Human
uuuccagucucagcccuguaac

SEQ ID NO: 616561 - RNA, 18 nt, Human
acagugguuugaugugcu

SEQ ID NO: 616562 - RNA, 22 nt, Human
uaggaacaaguuuccuugcugu

SEQ ID NO: 616563 - RNA, 17 nt, Human
agcaaaaguaucaaagc

SEQ ID NO: 616564 - RNA, 22 nt, Human
aagguccaugacucggcauagu

SEQ ID NO: 616565 - RNA, 22 nt, Human
ggaggcaggaaagacagguuca

SEQ ID NO: 616566 - RNA, 17 nt, Human
gagauggguggaucacc

SEQ ID NO: 616567 - RNA, 22 nt, Human
ugaggcagggaguuuaauuguc

SEQ ID NO: 616568 - RNA, 22 nt, Human
uguccuguucuugcuguguccu

SEQ ID NO: 616569 - RNA, 22 nt, Human
uagauaugaugagucacuugag

SEQ ID NO: 616570 - RNA, 22 nt, Human
accuguuuaccugcaccuguuu

SEQ ID NO: 616571 - RNA, 22 nt, Human
aggucucaagagaaaaguggug

SEQ ID NO: 616572 - RNA, 19 nt, Human
uccuggggauguggucacc

SEQ ID NO: 616573 - RNA, 22 nt, Human
aguguucuucuucaaagcucug

SEQ ID NO: 616574 - RNA, 22 nt, Human
auguucuacagauggaaagggg

SEQ ID NO: 616575 - RNA, 22 nt, Human
uggggagagguaucauugagau

SEQ ID NO: 616576 - RNA, 18 nt, Human
uuugcaaaggaaguaugg

SEQ ID NO: 616577 - RNA, 22 nt, Human
auaguauuuccagaaauagucu

SEQ ID NO: 616578 - RNA, 22 nt, Human
uuucagaggaggaaggcaguua

SEQ ID NO: 616579 - RNA, 22 nt, Human
ggcagggcaggaaagucaggaa

SEQ ID NO: 616580 - RNA, 22 nt, Human
ggguccagaguugaagagguua

SEQ ID NO: 616581 - RNA, 22 nt, Human
ccugcagguccccggaugcgca

SEQ ID NO: 616582 - RNA, 22 nt, Human
cugcccugcuucugagggaagc

SEQ ID NO: 616583 - RNA, 20 nt, Human
acaaaauagguacuggguag

SEQ ID NO: 616584 - RNA, 20 nt, Human
cuguggugagcaggagagua

SEQ ID NO: 616585 - RNA, 22 nt, Human
agcaccugugugguagggaggu

SEQ ID NO: 616586 - RNA, 22 nt, Human
ccagcucuaaacggcucugugg

SEQ ID NO: 616587 - RNA, 22 nt, Human
uccuaggguaaucagcauacau

SEQ ID NO: 616588 - RNA, 22 nt, Human
gccugggugucgaucacuagug

SEQ ID NO: 616589 - RNA, 22 nt, Human
uggccaccccuuucucugcacu

SEQ ID NO: 616590 - RNA, 22 nt, Human
agugggagccagcagcuugggg

SEQ ID NO: 616591 - RNA, 22 nt, Human
gcuguuggcgaggagcucagcu

SEQ ID NO: 616592 - RNA, 22 nt, Human
ucaggucccacugcuaguaagu

SEQ ID NO: 616593 - RNA, 22 nt, Human
agggccaggcucccaugucagg

SEQ ID NO: 616594 - RNA, 22 nt, Human
uaguuaaagcccuaaauugaua

SEQ ID NO: 616595 - RNA, 22 nt, Human
ggguccagagccucagcccaga

SEQ ID NO: 616596 - RNA, 22 nt, Human
ugggggcuccaggcuccaggga

SEQ ID NO: 616597 - RNA, 22 nt, Human
agccuguggaucccugcacugg

SEQ ID NO: 616598 - RNA, 22 nt, Human
agcuaggagauuuugugaggcu

SEQ ID NO: 616599 - RNA, 22 nt, Human
gggccuguaugggucucagaua

SEQ ID NO: 616600 - RNA, 22 nt, Human
uguguucaaucccuagucucag

SEQ ID NO: 616601 - RNA, 22 nt, Human
uuacaagauaacggagaaagca

SEQ ID NO: 616602 - RNA, 22 nt, Human
cuaggcuguaaagagcuaggag

SEQ ID NO: 616603 - RNA, 22 nt, Human
gcgcaggugcugcuggagcagc

SEQ ID NO: 616604 - RNA, 22 nt, Human
auucaagaggaacaaugaagau

SEQ ID NO: 616605 - RNA, 22 nt, Human
ggaaggcucuguuccuugacuu

SEQ ID NO: 616606 - RNA, 22 nt, Human
ugguccagugacagauaggcac

SEQ ID NO: 616607 - RNA, 22 nt, Human
guccugguccugccuccccaug

SEQ ID NO: 616608 - RNA, 22 nt, Human
agaggcaguauacaauccgagc

SEQ ID NO: 616609 - RNA, 22 nt, Human
uuucuaaaggguagauuuggcc

SEQ ID NO: 616610 - RNA, 22 nt, Human
guccaggaaucaaaagauggaa

SEQ ID NO: 616611 - RNA, 22 nt, Human
cauccagggcagccauggccug

SEQ ID NO: 616612 - RNA, 22 nt, Human
gccaccugcgggccguggugga

SEQ ID NO: 616613 - RNA, 22 nt, Human
gggcugaugaugagcagaggug

SEQ ID NO: 616614 - RNA, 22 nt, Human
aaaugcuaacaaggaaugcugc

SEQ ID NO: 616615 - RNA, 22 nt, Human
aggucaaagaaccuagcuauag

SEQ ID NO: 616616 - RNA, 22 nt, Human
aaagccuugagauccuauaguu

SEQ ID NO: 616617 - RNA, 22 nt, Human
uuccuugaaaguuugaacugac

SEQ ID NO: 616618 - RNA, 22 nt, Human
cagcuucagggacagcuucuuu

SEQ ID NO: 616619 - RNA, 22 nt, Human
acacagaguuauuaugugaacu

SEQ ID NO: 616620 - RNA, 22 nt, Human
cuguggcuguauuuggccagag

SEQ ID NO: 616621 - RNA, 22 nt, Human
aggacuggcagugugagggguc

SEQ ID NO: 616622 - RNA, 22 nt, Human
acucagcuuccuacagcuagaa

SEQ ID NO: 616623 - RNA, 22 nt, Human
ucuggggugcagccuggacaua

SEQ ID NO: 616624 - RNA, 22 nt, Human
gaggaaaauggaguguaauuaa

SEQ ID NO: 616625 - RNA, 20 nt, Human
aggcaguguagagaugagua

SEQ ID NO: 616626 - RNA, 22 nt, Human
auuguaucuugucauuaugcau

SEQ ID NO: 616627 - RNA, 22 nt, Human
aggccaggccuuucuccauucc

SEQ ID NO: 616628 - RNA, 17 nt, Human
guccuggugugugagga

SEQ ID NO: 616629 - RNA, 22 nt, Human
uuggaaggguuucaguuagucu

SEQ ID NO: 616630 - RNA, 22 nt, Human
caggggcgguggcucacgccug

SEQ ID NO: 616631 - RNA, 22 nt, Human
ugagggagucaugauuaaggaa

SEQ ID NO: 616632 - RNA, 22 nt, Human
auauucuugugauuauaaagua

SEQ ID NO: 616633 - RNA, 22 nt, Human
uauuauuauaguuauugggaag

SEQ ID NO: 616634 - RNA, 22 nt, Human
gccuguuuguuugcaaaggagc

SEQ ID NO: 616635 - RNA, 22 nt, Human
gcucccagaaccaaggcugggg

SEQ ID NO: 616636 - RNA, 22 nt, Human
uagugcaaugugaggcaguacc

SEQ ID NO: 616637 - RNA, 22 nt, Human
augaugcuguuuaucauauacu

SEQ ID NO: 616638 - RNA, 22 nt, Human
ggcaggugaucuagagucaaua

SEQ ID NO: 616639 - RNA, 22 nt, Human
cugccuggguucaaguccuguu

SEQ ID NO: 616640 - RNA, 22 nt, Human
ucuucaaacccugguuuuguga

SEQ ID NO: 616641 - RNA, 22 nt, Human
ugaggcagugugagauaauaaa

SEQ ID NO: 616642 - RNA, 20 nt, Human
uccugguggauacugcuuaa

SEQ ID NO: 616643 - RNA, 22 nt, Human
agaaagggucacugaaagagga

SEQ ID NO: 616644 - RNA, 22 nt, Human
ggguccaguaguugguggccgu

SEQ ID NO: 616645 - RNA, 22 nt, Human
ugcaugucaaggcacucaggau

SEQ ID NO: 616646 - RNA, 19 nt, Human
agucuguggauuugugggu

SEQ ID NO: 616647 - RNA, 22 nt, Human
gcagaauuccuucuuccuuggg

SEQ ID NO: 616648 - RNA, 22 nt, Human
ucgugaagucacaauaaagucu

SEQ ID NO: 616649 - RNA, 22 nt, Human
ucaaguuuaauugagauguuua

SEQ ID NO: 616650 - RNA, 18 nt, Human
cgaggcaggcggaucacg

SEQ ID NO: 616651 - RNA, 22 nt, Human
cuggguuccauguagccaagag

SEQ ID NO: 616652 - RNA, 22 nt, Human
uucuggcugaaaguuuauuuga

SEQ ID NO: 616653 - RNA, 22 nt, Human
caaagaagagauuuacagagcu

SEQ ID NO: 616654 - RNA, 22 nt, Human
aguccagggcuuagucagcggg

SEQ ID NO: 616655 - RNA, 22 nt, Human
cagaggcagccgggggagaacg

SEQ ID NO: 616656 - RNA, 22 nt, Human
uuuucaguuugcacugcagugc

SEQ ID NO: 616657 - RNA, 22 nt, Human
ugggcuggcugaggcauucacu

SEQ ID NO: 616658 - RNA, 22 nt, Human
auuaaagaaacccagcauguga

SEQ ID NO: 616659 - RNA, 22 nt, Human
gugucagauguccagggcagca

SEQ ID NO: 616660 - RNA, 21 nt, Human
cagugggcugcugcgcuccag

SEQ ID NO: 616661 - RNA, 22 nt, Human
aaagagaaaaugaucuguacau

SEQ ID NO: 616662 - RNA, 20 nt, Human
aaagagaagccucaccuugu

SEQ ID NO: 616663 - RNA, 22 nt, Human
uagguucagugucuuguucugc

SEQ ID NO: 616664 - RNA, 22 nt, Human
ugccagggugucaggagagcua

SEQ ID NO: 616665 - RNA, 22 nt, Human
cuaaauuaucaugagaauuaug

SEQ ID NO: 616666 - RNA, 22 nt, Human
aagggcuggaucucucugagca

SEQ ID NO: 616667 - RNA, 22 nt, Human
uggcagguuuccuccucauagu

SEQ ID NO: 616668 - RNA, 22 nt, Human
gcagaaguaggcucuguguagg

SEQ ID NO: 616669 - RNA, 16 nt, Human
cuguggcucccagguu

SEQ ID NO: 616670 - RNA, 17 nt, Human
gugcagggaugaaggau

SEQ ID NO: 616671 - RNA, 20 nt, Human
uggaauggguccuugaaaaa

SEQ ID NO: 616672 - RNA, 22 nt, Human
uuggaauucaaguuguagcuua

SEQ ID NO: 616673 - RNA, 20 nt, Human
uuaagaaaagcacauccugc

SEQ ID NO: 616674 - RNA, 22 nt, Human
agauuuguaugucuaaauguaa

SEQ ID NO: 616675 - RNA, 23 nt, Human
uucuuuguggauaaucuccagug

SEQ ID NO: 616676 - RNA, 22 nt, Human
gcugggagccguaccugucacg

SEQ ID NO: 616677 - RNA, 22 nt, Human
auuagauuguaaauguuuucac

SEQ ID NO: 616678 - RNA, 22 nt, Human
ugucuuuuuacuauguucaauc

SEQ ID NO: 616679 - RNA, 22 nt, Human
ucuguuuugcauaauguucuuu

SEQ ID NO: 616680 - RNA, 22 nt, Human
agaggucuuuuggucugcagaa

SEQ ID NO: 616681 - RNA, 22 nt, Human
acuggcugcgggguggaagaag

SEQ ID NO: 616682 - RNA, 22 nt, Human
gcccauggacacccaagugcca

SEQ ID NO: 616683 - RNA, 22 nt, Human
cucuuugucacucauacaguca

SEQ ID NO: 616684 - RNA, 22 nt, Human
uuguugaauggauaaauaaauu

SEQ ID NO: 616685 - RNA, 22 nt, Human
cagcaggauagguuucuuugga

SEQ ID NO: 616686 - RNA, 22 nt, Human
uccugggaacucggaaagcucu

SEQ ID NO: 616687 - RNA, 22 nt, Human
uccucugcuccaucuuuacugu

SEQ ID NO: 616688 - RNA, 22 nt, Human
ccugcaggggagagacuucuag

SEQ ID NO: 616689 - RNA, 22 nt, Human
gggccagagcuuggcagcuggg

SEQ ID NO: 616690 - RNA, 22 nt, Human
augaccagccgagauaaacaga

SEQ ID NO: 616691 - RNA, 23 nt, Human
cucccugaacaugacacaccaga

SEQ ID NO: 616692 - RNA, 22 nt, Human
gccuguuuggcaucauugguug

SEQ ID NO: 616693 - RNA, 22 nt, Human
ugauacccuuuggcugcgagca

SEQ ID NO: 616694 - RNA, 22 nt, Human
uacaugcuccuuaugagaaucu

SEQ ID NO: 616695 - RNA, 22 nt, Human
cuggcagcuucaggacacucgg

SEQ ID NO: 616696 - RNA, 22 nt, Human
aaaggucuacaucacugaaaga

SEQ ID NO: 616697 - RNA, 22 nt, Human
ggacucucaggcugucggcuuc

SEQ ID NO: 616698 - RNA, 22 nt, Human
uuccuggguuuacguauugggu

SEQ ID NO: 616699 - RNA, 22 nt, Human
uuugucuuguaaguuaaauuca

SEQ ID NO: 616700 - RNA, 17 nt, Human
agcaggcacgucagcac

SEQ ID NO: 616701 - RNA, 22 nt, Human
cacaggaaaugauucugcagca

SEQ ID NO: 616702 - RNA, 22 nt, Human
cugcccugugguuguggguucu

SEQ ID NO: 616703 - RNA, 22 nt, Human
gugcccugagcuuaugcauucu

SEQ ID NO: 616704 - RNA, 22 nt, Human
caacaccuugaucuuggacuuc

SEQ ID NO: 616705 - RNA, 22 nt, Human
gcauggccaggaaagguagaaa

SEQ ID NO: 616706 - RNA, 22 nt, Human
aggccucugggucuccucugac

SEQ ID NO: 616707 - RNA, 22 nt, Human
aguuuacauaaaaaggcagagg

SEQ ID NO: 616708 - RNA, 22 nt, Human
gaggggcagugcacccgggccc

SEQ ID NO: 616709 - RNA, 22 nt, Human
gaggcaggcagauugcuugagg

SEQ ID NO: 616710 - RNA, 22 nt, Human
uggccaggcauucagauaagac

SEQ ID NO: 616711 - RNA, 22 nt, Human
uuugucuuaaaucuuguuacug

SEQ ID NO: 616712 - RNA, 22 nt, Human
cccugcaggggaccugcagccu

SEQ ID NO: 616713 - RNA, 22 nt, Human
ggcaggacugaucagugggaug

SEQ ID NO: 616714 - RNA, 22 nt, Human
uuucuguagggauuucacaguu

SEQ ID NO: 616715 - RNA, 22 nt, Human
ggaugggcugaaagguagcccc

SEQ ID NO: 616716 - RNA, 21 nt, Human
aaggaaaagcuuggucucuga

SEQ ID NO: 616717 - RNA, 22 nt, Human
ugcacaaagcauucuagacgca

SEQ ID NO: 616718 - RNA, 22 nt, Human
gucuggcuuuauauuugcuauu

SEQ ID NO: 616719 - RNA, 22 nt, Human
aacaguaagagauguuuuaucu

SEQ ID NO: 616720 - RNA, 22 nt, Human
ugguccagaugccuuggcuuua

SEQ ID NO: 616721 - RNA, 22 nt, Human
accauguuggccaagcuggucu

SEQ ID NO: 616722 - RNA, 22 nt, Human
ccagugggagggagcuaggcca

SEQ ID NO: 616723 - RNA, 22 nt, Human
guuuauuagaguuuucugucug

SEQ ID NO: 616724 - RNA, 20 nt, Human
uacagaaacaggacuuuugg

SEQ ID NO: 616725 - RNA, 22 nt, Human
agcuccuggcaaggucauggug

SEQ ID NO: 616726 - RNA, 22 nt, Human
auuguugaggcaguucaucuug

SEQ ID NO: 616727 - RNA, 20 nt, Human
cagaggcauuuucagacucu

SEQ ID NO: 616728 - RNA, 22 nt, Human
uaaaugcuuucuaugaaagagg

SEQ ID NO: 616729 - RNA, 22 nt, Human
caggccagcguccagaacaagc

SEQ ID NO: 616730 - RNA, 22 nt, Human
accugagggcccaaacuuggua

SEQ ID NO: 616731 - RNA, 21 nt, Human
uggcagguucaaaggccuauc

SEQ ID NO: 616732 - RNA, 22 nt, Human
ugcaaguaaccaucacuaucuc

SEQ ID NO: 616733 - RNA, 21 nt, Human
uagaggcaggagggacugcag

SEQ ID NO: 616734 - RNA, 22 nt, Human
ugcaggucuauuuaaaugauug

SEQ ID NO: 616735 - RNA, 22 nt, Human
cauuuacacuucuaaccacaag

SEQ ID NO: 616736 - RNA, 22 nt, Human
uuggaaggagucaaccagcuga

SEQ ID NO: 616737 - RNA, 22 nt, Human
acugaggauggauaggucauau

SEQ ID NO: 616738 - RNA, 23 nt, Human
ggugggagauuauccagaauuau

SEQ ID NO: 616739 - RNA, 22 nt, Human
uuucaucucucuaaaagacagu

SEQ ID NO: 616740 - RNA, 19 nt, Human
ugggcagguucaguaaugg

SEQ ID NO: 616741 - RNA, 22 nt, Human
ugugugaagcacauguucaagg

SEQ ID NO: 616742 - RNA, 22 nt, Human
ccagggaaguaguugugagagc

SEQ ID NO: 616743 - RNA, 22 nt, Human
ucauugucuugauaugauuguc

SEQ ID NO: 616744 - RNA, 22 nt, Human
ggcuccacccugcuuccagaag

SEQ ID NO: 616745 - RNA, 22 nt, Human
auaaauuaggaucugggguucc

SEQ ID NO: 616746 - RNA, 22 nt, Human
gcagggcagaaggugcugagga

SEQ ID NO: 616747 - RNA, 22 nt, Human
gcaggguggauggcagggccag

SEQ ID NO: 616748 - RNA, 22 nt, Human
uuggaaggaccaggccuugauu

SEQ ID NO: 616749 - RNA, 22 nt, Human
uccucugcuccaggcuggacuu

SEQ ID NO: 616750 - RNA, 19 nt, Human
gcuccugggccucacucau

SEQ ID NO: 616751 - RNA, 18 nt, Human
cuccagggaacucaguca

SEQ ID NO: 616752 - RNA, 22 nt, Human
ccugaguagcuggaauuaaagg

SEQ ID NO: 616753 - RNA, 22 nt, Human
uccugggcugugugccacucug

SEQ ID NO: 616754 - RNA, 22 nt, Human
aagaauggugguggggccagca

SEQ ID NO: 616755 - RNA, 22 nt, Human
guccuggggauuauagaguguu

SEQ ID NO: 616756 - RNA, 20 nt, Human
cuuguugauucuaggaauga

SEQ ID NO: 616757 - RNA, 22 nt, Human
gcagggcauagaggcacggagg

SEQ ID NO: 616758 - RNA, 20 nt, Human
acagaaagcugccuuguccc

SEQ ID NO: 616759 - RNA, 22 nt, Human
auuaaauacugcaggcuaagca

SEQ ID NO: 616760 - RNA, 22 nt, Human
ugaccuauuagauuuccuugcc

SEQ ID NO: 616761 - RNA, 22 nt, Human
uggcauggcaacccugcaggga

SEQ ID NO: 616762 - RNA, 22 nt, Human
aauuacaaauguagacucucau

SEQ ID NO: 616763 - RNA, 22 nt, Human
ucaugccaaaauccaguggcuu

SEQ ID NO: 616764 - RNA, 22 nt, Human
caggaaaaaugccaggagucag

SEQ ID NO: 616765 - RNA, 22 nt, Human
auacagaacucucaguuguaua

SEQ ID NO: 616766 - RNA, 22 nt, Human
agccaggaagaaggucacacca

SEQ ID NO: 616767 - RNA, 22 nt, Human
gccagcucaguuucaaaguagg

SEQ ID NO: 616768 - RNA, 22 nt, Human
cuccagggcagcauggcagugg

SEQ ID NO: 616769 - RNA, 22 nt, Human
uuccagcuaacucacaucccuu

SEQ ID NO: 616770 - RNA, 22 nt, Human
ucuggcccagccccugagguca

SEQ ID NO: 616771 - RNA, 22 nt, Human
augaagauauucuuguuuucug

SEQ ID NO: 616772 - RNA, 22 nt, Human
acagagaaagugggcugaagau

SEQ ID NO: 616773 - RNA, 22 nt, Human
cagguccugcagggagaguaaa

SEQ ID NO: 616774 - RNA, 22 nt, Human
agguauuauuagcaucucuauu

SEQ ID NO: 616775 - RNA, 20 nt, Human
auucacaaagccaguguugc

SEQ ID NO: 616776 - RNA, 22 nt, Human
gcugaggcaguccacccuugug

SEQ ID NO: 616777 - RNA, 22 nt, Human
guccucuggccuuucccaggac

SEQ ID NO: 616778 - RNA, 22 nt, Human
aggcuuuaaguggccuacagcu

SEQ ID NO: 616779 - RNA, 22 nt, Human
augugggccgugcggguguccu

SEQ ID NO: 616780 - RNA, 22 nt, Human
acaguguucucuuccuguauag

SEQ ID NO: 616781 - RNA, 22 nt, Human
gaaauauuucucuugagccccu

SEQ ID NO: 616782 - RNA, 22 nt, Human
augucuguuuauccuucaagau

SEQ ID NO: 616783 - RNA, 22 nt, Human
gggcaggugccagcucccuguc

SEQ ID NO: 616784 - RNA, 21 nt, Human
cagaggcagguccugggacgg

SEQ ID NO: 616785 - RNA, 22 nt, Human
agcaggcaggaaggcagcacug

SEQ ID NO: 616786 - RNA, 22 nt, Human
uguauacauucucuuggguuug

SEQ ID NO: 616787 - RNA, 22 nt, Human
ccucuuugacucucaggucuuu

SEQ ID NO: 616788 - RNA, 22 nt, Human
agcaccuggagggcugggaccu

SEQ ID NO: 616789 - RNA, 22 nt, Human
aaguaacuuauuugcaaacagg

SEQ ID NO: 616790 - RNA, 22 nt, Human
gaggcauggccugaggcuagga

SEQ ID NO: 616791 - RNA, 22 nt, Human
gagagaaagccccugcaucccu

SEQ ID NO: 616792 - RNA, 21 nt, Human
ucccagggccaggugccauca

SEQ ID NO: 616793 - RNA, 22 nt, Human
uuggaaggaagaaccgcgguag

SEQ ID NO: 616794 - RNA, 22 nt, Human
gcccagugcugagggugcugcu

SEQ ID NO: 616795 - RNA, 22 nt, Human
gucuuuggagaggugccauuuc

SEQ ID NO: 616796 - RNA, 22 nt, Human
uacagucaacauugaugaugau

SEQ ID NO: 616797 - RNA, 22 nt, Human
gcugccuucccggaaugucauc

SEQ ID NO: 616798 - RNA, 22 nt, Human
uuucagagaauuagaagcugau

SEQ ID NO: 616799 - RNA, 22 nt, Human
uucuuccucacacucucaccca

SEQ ID NO: 616800 - RNA, 22 nt, Human
cuaaaaauccacacuaggugaa

SEQ ID NO: 616801 - RNA, 21 nt, Human
agcugccuccacuucugaggc

SEQ ID NO: 616802 - RNA, 22 nt, Human
gaagaagccucuguggaucuga

SEQ ID NO: 616803 - RNA, 22 nt, Human
agccugguuuaagcauuuuaua

SEQ ID NO: 616804 - RNA, 22 nt, Human
ucagcagggagaggagaaugca

SEQ ID NO: 616805 - RNA, 22 nt, Human
gcaaagcagaacccucucuauc

SEQ ID NO: 616806 - RNA, 23 nt, Human
uggagggcagaauaacagacuac

SEQ ID NO: 616807 - RNA, 22 nt, Human
uaagcagaaaaagugggaguua

SEQ ID NO: 616808 - RNA, 21 nt, Human
uccugggggguaggugaguuu

SEQ ID NO: 616809 - RNA, 19 nt, Human
ccccaggguaggcuagggg

SEQ ID NO: 616810 - RNA, 22 nt, Human
ucaaagagcucuaucuucaaaa

SEQ ID NO: 616811 - RNA, 22 nt, Human
uccagggcaggugcugggcucu

SEQ ID NO: 616812 - RNA, 22 nt, Human
ccaggagccacucaggcccaca

SEQ ID NO: 616813 - RNA, 23 nt, Human
uggaagcagaaguuucaauaucc

SEQ ID NO: 616814 - RNA, 22 nt, Human
ucaguguucagcggugugugca

SEQ ID NO: 616815 - RNA, 22 nt, Human
gcaguguucagugaagcaggag

SEQ ID NO: 616816 - RNA, 22 nt, Human
ucaguguuacauuauauagaac

SEQ ID NO: 616817 - RNA, 22 nt, Human
acaguguuacuugauaguguau

SEQ ID NO: 616818 - RNA, 22 nt, Human
gucacccugcuggcuguucagc

SEQ ID NO: 616819 - RNA, 22 nt, Human
uuuauauuaccuggaauagcuu

SEQ ID NO: 616820 - RNA, 22 nt, Human
cuccugggcuucgaaggcuccc

SEQ ID NO: 616821 - RNA, 22 nt, Human
ggguccaggucuucaggcagag

SEQ ID NO: 616822 - RNA, 22 nt, Human
ucaguguuuguggcaaauguua

SEQ ID NO: 616823 - RNA, 22 nt, Human
agguccagagguugaacggugg

SEQ ID NO: 616824 - RNA, 23 nt, Human
auaugucaugcaccagcacuuua

SEQ ID NO: 616825 - RNA, 23 nt, Human
ggguccagagacaggcaugggug

SEQ ID NO: 616826 - RNA, 18 nt, Human
cucucugggugaggacaa

SEQ ID NO: 616827 - RNA, 22 nt, Human
cccucaccaggcuccaggcaug

SEQ ID NO: 616828 - RNA, 20 nt, Human
cuccugggacugcugguuau

SEQ ID NO: 616829 - RNA, 22 nt, Human
uuaccuguuuuacaugcacaac

SEQ ID NO: 616830 - RNA, 22 nt, Human
acaguguuucacuuaaccguuu

SEQ ID NO: 616831 - RNA, 22 nt, Human
uguauuuuuaggaaugcgcuau

SEQ ID NO: 616832 - RNA, 21 nt, Human
auuuacaaaacagucccuucc

SEQ ID NO: 616833 - RNA, 22 nt, Human
uagguucagagaacugaaaaua

SEQ ID NO: 616834 - RNA, 22 nt, Human
ucccucagucccuggacaggca

SEQ ID NO: 616835 - RNA, 20 nt, Human
uggaugucaaauuaggcugg

SEQ ID NO: 616836 - RNA, 17 nt, Human
gagcagggaugcgguuc

SEQ ID NO: 616837 - RNA, 22 nt, Human
ucuugcuaggagcuauggaaga

SEQ ID NO: 616838 - RNA, 22 nt, Human
gaggcaggcccugaaugaguca

SEQ ID NO: 616839 - RNA, 22 nt, Human
aggugggcgcugcucccgcugg

SEQ ID NO: 616840 - RNA, 22 nt, Human
gacggcagaaacucaugagguc

SEQ ID NO: 616841 - RNA, 22 nt, Human
gaagaaagggaauuaacuugag

SEQ ID NO: 616842 - RNA, 22 nt, Human
uaauauguguuacugacuuuuu

SEQ ID NO: 616843 - RNA, 22 nt, Human
ucugggagugaagcaacagaug

SEQ ID NO: 616844 - RNA, 22 nt, Human
uuccugggggcagcagucuuga

SEQ ID NO: 616845 - RNA, 22 nt, Human
uucagcuugaaucuggcuuuga

SEQ ID NO: 616846 - RNA, 22 nt, Human
uugcuauaaaugguuucauauu

SEQ ID NO: 616847 - RNA, 22 nt, Human
gcucuggccagacccucagugg

SEQ ID NO: 616848 - RNA, 22 nt, Human
agguccaaauguugagacugau

SEQ ID NO: 616849 - RNA, 22 nt, Human
ugcagaaggaggaggaaaucca

SEQ ID NO: 616850 - RNA, 22 nt, Human
auggguuuauagguggacuuuu

SEQ ID NO: 616851 - RNA, 22 nt, Human
caggaacaauaucuguccuggu

SEQ ID NO: 616852 - RNA, 18 nt, Human
uggaaauugaaacagaaa

SEQ ID NO: 616853 - RNA, 22 nt, Human
ucaguguuaaucagugguaccu

SEQ ID NO: 616854 - RNA, 22 nt, Human
gagguucaguccugcucuguca

SEQ ID NO: 616855 - RNA, 22 nt, Human
aagugugauuuguagaaugccu

SEQ ID NO: 616856 - RNA, 22 nt, Human
caucugcuguuccuuggacuca

SEQ ID NO: 616857 - RNA, 23 nt, Human
uaggcaggacucagauaugacag

SEQ ID NO: 616858 - RNA, 22 nt, Human
uuggaaggcagcauuuguccau

SEQ ID NO: 616859 - RNA, 22 nt, Human
ugugcacaggaagcuauucucu

SEQ ID NO: 616860 - RNA, 19 nt, Human
cccuggagaauacccugga

SEQ ID NO: 616861 - RNA, 22 nt, Human
uggcagguggcacagccuggga

SEQ ID NO: 616862 - RNA, 22 nt, Human
cugggccaagaaguuguguaug

SEQ ID NO: 616863 - RNA, 22 nt, Human
caggucucggguucagcaguga

SEQ ID NO: 616864 - RNA, 22 nt, Human
agaagccaacagggcaggagag

SEQ ID NO: 616865 - RNA, 22 nt, Human
cugaggcugggcugaggguaua

SEQ ID NO: 616866 - RNA, 22 nt, Human
aaauuagaaauacuuucaaagc

SEQ ID NO: 616867 - RNA, 22 nt, Human
agucauuacggacuaguacuac

SEQ ID NO: 616868 - RNA, 19 nt, Human
aaaaagaggcuauaauauu

SEQ ID NO: 616869 - RNA, 22 nt, Human
acauuucuuugcuagacagcag

SEQ ID NO: 616870 - RNA, 22 nt, Human
gccaccuguuucagaugugguu

SEQ ID NO: 616871 - RNA, 22 nt, Human
guccagagaagggaggggacuc

SEQ ID NO: 616872 - RNA, 22 nt, Human
gaugaggcagcucagggggaaa

SEQ ID NO: 616873 - RNA, 22 nt, Human
agagaaggguguagccugggcc

SEQ ID NO: 616874 - RNA, 22 nt, Human
gccugggagaaugaccuccaac

SEQ ID NO: 616875 - RNA, 22 nt, Human
ugguccagcuugauucucuucu

SEQ ID NO: 616876 - RNA, 22 nt, Human
ucuguggcacgauugcacugca

SEQ ID NO: 616877 - RNA, 22 nt, Human
agagaacagcauugcagcuuug

SEQ ID NO: 616878 - RNA, 22 nt, Human
auguguuuguaccuuuaaauau

SEQ ID NO: 616879 - RNA, 22 nt, Human
uggcccugcugggucagagcug

SEQ ID NO: 616880 - RNA, 22 nt, Human
ccaggagcgcgugaacaggcug

SEQ ID NO: 616881 - RNA, 22 nt, Human
ucaugccaaacugaacacaguu

SEQ ID NO: 616882 - RNA, 22 nt, Human
guuuauuaacugucaagugauu

SEQ ID NO: 616883 - RNA, 22 nt, Human
gcuggcugaggucuagcucuuu

SEQ ID NO: 616884 - RNA, 22 nt, Human
aauaugcaaauagguguaauga

SEQ ID NO: 616885 - RNA, 22 nt, Human
augcuuggcguuucacuuccug

SEQ ID NO: 616886 - RNA, 22 nt, Human
ggccaggcuggucucagacuuc

SEQ ID NO: 616887 - RNA, 22 nt, Human
agggcuuuguggcagucacuau

SEQ ID NO: 616888 - RNA, 22 nt, Human
augugcagcuuuucuagagaag

SEQ ID NO: 616889 - RNA, 22 nt, Human
gggcuuuaacacccagucaggg

SEQ ID NO: 616890 - RNA, 22 nt, Human
caagaauauaaauacuuucaaa

SEQ ID NO: 616891 - RNA, 22 nt, Human
cugggccacaagccugugugau

SEQ ID NO: 616892 - RNA, 22 nt, Human
uacagugucuggauaucaaagg

SEQ ID NO: 616893 - RNA, 22 nt, Human
auuuccaugaaggcagauuuua

SEQ ID NO: 616894 - RNA, 22 nt, Human
ugggagaggcugccaucuugca

SEQ ID NO: 616895 - RNA, 22 nt, Human
gcagggcagcugaagcuaggug

SEQ ID NO: 616896 - RNA, 22 nt, Human
uuuucauuguuacuaugagcua

SEQ ID NO: 616897 - RNA, 22 nt, Human
ucccagggauuaggacauggau

SEQ ID NO: 616898 - RNA, 22 nt, Human
aggcuccaaauuaccaagcucu

SEQ ID NO: 616899 - RNA, 22 nt, Human
ugagagaggggacugccugcuu

SEQ ID NO: 616900 - RNA, 22 nt, Human
agucccagccuaggcugugcug

SEQ ID NO: 616901 - RNA, 22 nt, Human
acugcaugauaauaauagcaga

SEQ ID NO: 616902 - RNA, 22 nt, Human
auggaguucugccagcgcugcu

SEQ ID NO: 616903 - RNA, 22 nt, Human
gagcuuuucccgucuuucucgu

SEQ ID NO: 616904 - RNA, 22 nt, Human
caaggugaacuugcuguacagc

SEQ ID NO: 616905 - RNA, 22 nt, Human
uuauuucauugauuucuaagac

SEQ ID NO: 616906 - RNA, 22 nt, Human
ucagcucuaccugggagcuguc

SEQ ID NO: 616907 - RNA, 22 nt, Human
ucaguccucacuugguucuaag

SEQ ID NO: 616908 - RNA, 22 nt, Human
cuggaagggucagagugaugag

SEQ ID NO: 616909 - RNA, 22 nt, Human
ugguuaaguccagaaaggaagc

SEQ ID NO: 616910 - RNA, 22 nt, Human
uuuacaaggaucaagggaucuc

SEQ ID NO: 616911 - RNA, 22 nt, Human
cagaggcaggaagaugggcagu

SEQ ID NO: 616912 - RNA, 22 nt, Human
gucagcaggguccccuugagug

SEQ ID NO: 616913 - RNA, 22 nt, Human
ugguccaggcacccuucuagag

SEQ ID NO: 616914 - RNA, 22 nt, Human
gccaccuguaagccauuaggcc

SEQ ID NO: 616915 - RNA, 22 nt, Human
ucauccaguaccauggaaggca

SEQ ID NO: 616916 - RNA, 22 nt, Human
aaguagaaaaccgcacuggacu

SEQ ID NO: 616917 - RNA, 22 nt, Human
ggcgcacaaugugcagguuugu

SEQ ID NO: 616918 - RNA, 19 nt, Human
cacauacagaaaagaguaa

SEQ ID NO: 616919 - RNA, 22 nt, Human
agauacaaguuaagagaaagga

SEQ ID NO: 616920 - RNA, 21 nt, Human
ugaaugcuucgucauccuggc

SEQ ID NO: 616921 - RNA, 22 nt, Human
uagugcaaaggcccugagaugg

SEQ ID NO: 616922 - RNA, 22 nt, Human
gauaaauuaucagggguuuaaa

SEQ ID NO: 616923 - RNA, 22 nt, Human
aggcaauccccugaggauacuu

SEQ ID NO: 616924 - RNA, 22 nt, Human
uggccuuggagaggcacggccc

SEQ ID NO: 616925 - RNA, 22 nt, Human
ggaggaaaggcucccucccucu

SEQ ID NO: 616926 - RNA, 22 nt, Human
uuguuugaauaacagacaaauu

SEQ ID NO: 616927 - RNA, 22 nt, Human
aggguccaucaaggacugcaca

SEQ ID NO: 616928 - RNA, 22 nt, Human
gauggcagucaaccaggugagg

SEQ ID NO: 616929 - RNA, 22 nt, Human
uugagaagguggucauuugcaa

SEQ ID NO: 616930 - RNA, 22 nt, Human
gugcccugugaacuguaaggaa

SEQ ID NO: 616931 - RNA, 22 nt, Human
aggcaggucacaugcuuggcga

SEQ ID NO: 616932 - RNA, 22 nt, Human
ucuugaaggggggcaguguuga

SEQ ID NO: 616933 - RNA, 22 nt, Human
gcagccaggaaagcuggacccu

SEQ ID NO: 616934 - RNA, 18 nt, Human
ugacagaaccuggagccu

SEQ ID NO: 616935 - RNA, 22 nt, Human
gccucccugagucacccaagca

SEQ ID NO: 616936 - RNA, 22 nt, Human
ucccccuccaauugccauguua

SEQ ID NO: 616937 - RNA, 22 nt, Human
gaagaaagauuggcaugcuuca

SEQ ID NO: 616938 - RNA, 22 nt, Human
aaccagagagucuucuucauug

SEQ ID NO: 616939 - RNA, 22 nt, Human
uugaagauuauucuauuaaaag

SEQ ID NO: 616940 - RNA, 22 nt, Human
agaagccauguuuaguaggaug

SEQ ID NO: 616941 - RNA, 20 nt, Human
agagauuuuaguagccacag

SEQ ID NO: 616942 - RNA, 22 nt, Human
ucuguggcuguuaucuuuauau

SEQ ID NO: 616943 - RNA, 22 nt, Human
aggcagguuggugagaagacug

SEQ ID NO: 616944 - RNA, 22 nt, Human
uaugcuuugguagagaguugug

SEQ ID NO: 616945 - RNA, 22 nt, Human
gccaggcugccuuaucucuagc

SEQ ID NO: 616946 - RNA, 22 nt, Human
gccuguggccgacugagagccu

SEQ ID NO: 616947 - RNA, 22 nt, Human
ggaagggguuaggggucccuga

SEQ ID NO: 616948 - RNA, 22 nt, Human
uggacucagugcugccauuccc

SEQ ID NO: 616949 - RNA, 22 nt, Human
aaacucuguagcuaaacauaau

SEQ ID NO: 616950 - RNA, 22 nt, Human
ucaguguugugcacauacaaaa

SEQ ID NO: 616951 - RNA, 22 nt, Human
cuuuuucauuggcuuuaggaca

SEQ ID NO: 616952 - RNA, 22 nt, Human
ucuggccccuggcaguccugga

SEQ ID NO: 616953 - RNA, 22 nt, Human
ugaacagaugccuucucccaug

SEQ ID NO: 616954 - RNA, 22 nt, Human
agcaaauacuugaauaaaaaga

SEQ ID NO: 616955 - RNA, 22 nt, Human
auaccuguguauccacaagcgu

SEQ ID NO: 616956 - RNA, 19 nt, Human
gcuggcuggaggagggaca

SEQ ID NO: 616957 - RNA, 22 nt, Human
ugaaugcuuggagucauaaaau

SEQ ID NO: 616958 - RNA, 22 nt, Human
uguguucaccaaaguguagaaa

SEQ ID NO: 616959 - RNA, 22 nt, Human
cuguggcucaggccuguaagcc

SEQ ID NO: 616960 - RNA, 19 nt, Human
auuugcuugucugcucugc

SEQ ID NO: 616961 - RNA, 22 nt, Human
gaagcuaaugagauaaaugcca

SEQ ID NO: 616962 - RNA, 22 nt, Human
auccugggggcagcuggaaaca

SEQ ID NO: 616963 - RNA, 22 nt, Human
gagguccauacagcuauucuac

SEQ ID NO: 616964 - RNA, 19 nt, Human
accaggaguaucagagcug

SEQ ID NO: 616965 - RNA, 22 nt, Human
gcauuuuucuaaucauuggcau

SEQ ID NO: 616966 - RNA, 22 nt, Human
ccagggcagcagaauuggggca

SEQ ID NO: 616967 - RNA, 22 nt, Human
uggcccugaggacccagugugg

SEQ ID NO: 616968 - RNA, 21 nt, Human
agagacugucacugcaguacc

SEQ ID NO: 616969 - RNA, 22 nt, Human
ggccaccuggguucgacugggc

SEQ ID NO: 616970 - RNA, 22 nt, Human
uggagcugaacuuugaggccag

SEQ ID NO: 616971 - RNA, 22 nt, Human
aagaugaaucaguauguguccu

SEQ ID NO: 616972 - RNA, 22 nt, Human
agcaggucgccgaagauagcuc

SEQ ID NO: 616973 - RNA, 22 nt, Human
cucucugguacauagaguuugg

SEQ ID NO: 616974 - RNA, 20 nt, Human
accugggaaaaccuuuuccu

SEQ ID NO: 616975 - RNA, 22 nt, Human
aaguccugugcuagagacaccu

SEQ ID NO: 616976 - RNA, 22 nt, Human
gucuggcuuugcucagaugcug

SEQ ID NO: 616977 - RNA, 22 nt, Human
gccugggagagggauagugcag

SEQ ID NO: 616978 - RNA, 22 nt, Human
ggcagguagccuagaggagguu

SEQ ID NO: 616979 - RNA, 22 nt, Human
gcuggcagguaaagccccgggg

SEQ ID NO: 616980 - RNA, 22 nt, Human
ucauguguccuaguucauauaa

SEQ ID NO: 616981 - RNA, 22 nt, Human
cccugcagaucuaggguccuuc

SEQ ID NO: 616982 - RNA, 22 nt, Human
ccugccucaggacucugcauau

SEQ ID NO: 616983 - RNA, 22 nt, Human
auuuuguuauagaacucuguga

SEQ ID NO: 616984 - RNA, 22 nt, Human
uuugcaaaaugaggugaagagu

SEQ ID NO: 616985 - RNA, 22 nt, Human
ucuucacauucacguaacauag

SEQ ID NO: 616986 - RNA, 22 nt, Human
ucaaaagaaacaccauguuccu

SEQ ID NO: 616987 - RNA, 22 nt, Human
cauguccauuuaugcacagaaa

SEQ ID NO: 616988 - RNA, 22 nt, Human
uucauuguacuuuaagagaugc

SEQ ID NO: 616989 - RNA, 22 nt, Human
auagggccuaaaaaguauugcu

SEQ ID NO: 616990 - RNA, 22 nt, Human
aggcaggcccucuggaaaggua

SEQ ID NO: 616991 - RNA, 22 nt, Human
aggccagggcacugcucuuuag

SEQ ID NO: 616992 - RNA, 22 nt, Human
uaugcuaauuguuagucacaug

SEQ ID NO: 616993 - RNA, 22 nt, Human
uggaagggagugacagucagag

SEQ ID NO: 616994 - RNA, 22 nt, Human
gagagcugggggacuguggaug

SEQ ID NO: 616995 - RNA, 22 nt, Human
ugaagguaaaggaaggaggcuu

SEQ ID NO: 616996 - RNA, 22 nt, Human
uccugcagagccgcccucaggu

SEQ ID NO: 616997 - RNA, 22 nt, Human
uccaaauauuaugauuauagga

SEQ ID NO: 616998 - RNA, 22 nt, Human
guggaagggucacagccccuac

SEQ ID NO: 616999 - RNA, 22 nt, Human
cccugcagcauucucuaacugg

SEQ ID NO: 617000 - RNA, 22 nt, Human
cugaggcugaagagggccuacg

SEQ ID NO: 617001 - RNA, 22 nt, Human
uuagcugcugauuaaauauguu

SEQ ID NO: 617002 - RNA, 22 nt, Human
agcaucugcauauugggagacc

SEQ ID NO: 617003 - RNA, 22 nt, Human
gagaaagauguaggcugggagg

SEQ ID NO: 617004 - RNA, 22 nt, Human
agcacagaaugagguggaagug

SEQ ID NO: 617005 - RNA, 22 nt, Human
gucccuggagcugagcagugcu

SEQ ID NO: 617006 - RNA, 22 nt, Human
aaauagaauuggaagcagaguu

SEQ ID NO: 617007 - RNA, 22 nt, Human
ugugugauugcaggagaugugg

SEQ ID NO: 617008 - RNA, 22 nt, Human
cauggccagauucuuucuucuc

SEQ ID NO: 617009 - RNA, 22 nt, Human
uccuguuucaacccuuacacug

SEQ ID NO: 617010 - RNA, 21 nt, Human
gcagggacaaagcuucaggag

SEQ ID NO: 617011 - RNA, 20 nt, Human
caaggccuggaucuaguugc

SEQ ID NO: 617012 - RNA, 22 nt, Human
ccuggggaccugccucagcccu

SEQ ID NO: 617013 - RNA, 22 nt, Human
acucagagaaacagcagggugu

SEQ ID NO: 617014 - RNA, 22 nt, Human
uccugggaaguugcaucaccgu

SEQ ID NO: 617015 - RNA, 23 nt, Human
uuuauuuauuuaggcugagggau

SEQ ID NO: 617016 - RNA, 22 nt, Human
ggaggcagaacuucccgucagu

SEQ ID NO: 617017 - RNA, 22 nt, Human
gccuguuucuccuccuuggccc

SEQ ID NO: 617018 - RNA, 21 nt, Human
uacacaaagcgugguccagag

SEQ ID NO: 617019 - RNA, 22 nt, Human
ggguccaguuucaucugagguu

SEQ ID NO: 617020 - RNA, 22 nt, Human
uugcuuuugucucggguuugga

SEQ ID NO: 617021 - RNA, 22 nt, Human
accugaggccuccccagcagac

SEQ ID NO: 617022 - RNA, 22 nt, Human
cagcucugaagaaaggugucua

SEQ ID NO: 617023 - RNA, 22 nt, Human
gugcccuggagggguugaaggg

SEQ ID NO: 617024 - RNA, 22 nt, Human
gcaguguugacuaugguaugag

SEQ ID NO: 617025 - RNA, 22 nt, Human
aaaauacuguggaguguugaaa

SEQ ID NO: 617026 - RNA, 22 nt, Human
uccugggauuaagguggugauu

SEQ ID NO: 617027 - RNA, 22 nt, Human
uggccuuguguuuaagcaagaa

SEQ ID NO: 617028 - RNA, 22 nt, Human
ccaggccucaccugcccaccua

SEQ ID NO: 617029 - RNA, 22 nt, Human
ucuaccuggaguccguuguuaa

SEQ ID NO: 617030 - RNA, 22 nt, Human
uagguucaaguucaggcucuau

SEQ ID NO: 617031 - RNA, 20 nt, Human
ucauccaggacaggaguggc

SEQ ID NO: 617032 - RNA, 22 nt, Human
acaugcuacacagagcuccucg

SEQ ID NO: 617033 - RNA, 22 nt, Human
gggguuaacaguauugcucaug

SEQ ID NO: 617034 - RNA, 22 nt, Human
gccugccaguguuugaggauug

SEQ ID NO: 617035 - RNA, 22 nt, Human
guaggcagugguuggaagagaa

SEQ ID NO: 617036 - RNA, 22 nt, Human
uugcauuuugguuguaaauaug

SEQ ID NO: 617037 - RNA, 22 nt, Human
gcugucuugaugauuggaugcu

SEQ ID NO: 617038 - RNA, 22 nt, Human
cuguggcuuuggggcggaggac

SEQ ID NO: 617039 - RNA, 22 nt, Human
ggagcagggaauuacagcgcag

SEQ ID NO: 617040 - RNA, 22 nt, Human
ggcaaguaauacaggauuauuu

SEQ ID NO: 617041 - RNA, 22 nt, Human
acaguagaguaaaugguuagau

SEQ ID NO: 617042 - RNA, 22 nt, Human
uaaauuagggacuuuaguuaau

SEQ ID NO: 617043 - RNA, 22 nt, Human
gaaugcuauuauuucugugugu

SEQ ID NO: 617044 - RNA, 17 nt, Human
auguaagaagaaagcag

SEQ ID NO: 617045 - RNA, 22 nt, Human
cauggccaaggaugcucaacca

SEQ ID NO: 617046 - RNA, 22 nt, Human
guccugggagaugggacccuga

SEQ ID NO: 617047 - RNA, 22 nt, Human
ccaggagagcaaaggucacucu

SEQ ID NO: 617048 - RNA, 22 nt, Human
cugcccugacugaccuuuugaa

SEQ ID NO: 617049 - RNA, 22 nt, Human
ugggcuuuaucaugggucuggu

SEQ ID NO: 617050 - RNA, 22 nt, Human
cacaaauaccaguuuccuaaca

SEQ ID NO: 617051 - RNA, 22 nt, Human
uccugcgguucaugcucauucu

SEQ ID NO: 617052 - RNA, 19 nt, Human
gccugccagauaguaauga

SEQ ID NO: 617053 - RNA, 22 nt, Human
cucuggcucccgcagcccccau

SEQ ID NO: 617054 - RNA, 22 nt, Human
guauuuuauggcaugcaguggc

SEQ ID NO: 617055 - RNA, 22 nt, Human
acuaggaauucaaguagacaga

SEQ ID NO: 617056 - RNA, 22 nt, Human
uucugugugcuuacugguguuc

SEQ ID NO: 617057 - RNA, 22 nt, Human
uuucugcaacgagucuuugacu

SEQ ID NO: 617058 - RNA, 22 nt, Human
caggucucucccaagcuacaau

SEQ ID NO: 617059 - RNA, 23 nt, Human
ugugucugaggauauaugugcau

SEQ ID NO: 617060 - RNA, 22 nt, Human
aguguucacucuguggagccca

SEQ ID NO: 617061 - RNA, 22 nt, Human
uuggaagggaacaccauuugac

SEQ ID NO: 617062 - RNA, 22 nt, Human
aguggcagaagucacuggguag

SEQ ID NO: 617063 - RNA, 22 nt, Human
ccaaagugauaugugcuguaag

SEQ ID NO: 617064 - RNA, 18 nt, Human
uguuccugccuuucucug

SEQ ID NO: 617065 - RNA, 22 nt, Human
uaccuggcuggggaauagccag

SEQ ID NO: 617066 - RNA, 22 nt, Human
ugggccacagagugagaaaugu

SEQ ID NO: 617067 - RNA, 22 nt, Human
caggaaaaggagacuuuagcac

SEQ ID NO: 617068 - RNA, 23 nt, Human
aagugcaagugaaaggcacaguu

SEQ ID NO: 617069 - RNA, 22 nt, Human
gacagcauuccaucugcagguu

SEQ ID NO: 617070 - RNA, 22 nt, Human
uggcuccucuucuggguguccc

SEQ ID NO: 617071 - RNA, 18 nt, Human
gucagaggauggggaaau

SEQ ID NO: 617072 - RNA, 22 nt, Human
uccugaggcacaauccuagaau

SEQ ID NO: 617073 - RNA, 23 nt, Human
guucauuuuauugucugauugcu

SEQ ID NO: 617074 - RNA, 22 nt, Human
aaauuacagccuuggguagcuu

SEQ ID NO: 617075 - RNA, 19 nt, Human
cacugugguccuucacugc

SEQ ID NO: 617076 - RNA, 22 nt, Human
uccaaaggggcaguguccagcc

SEQ ID NO: 617077 - RNA, 22 nt, Human
acugugugacuguuauuacugu

SEQ ID NO: 617078 - RNA, 22 nt, Human
caguccugagcuccugggcuga

SEQ ID NO: 617079 - RNA, 22 nt, Human
uccugggaguggccauguaaug

SEQ ID NO: 617080 - RNA, 22 nt, Human
ggguccaggcacuaugcuaagu

SEQ ID NO: 617081 - RNA, 22 nt, Human
gacagcuccuuuuggugcauau

SEQ ID NO: 617082 - RNA, 22 nt, Human
gucaugccuggcuucuuagaca

SEQ ID NO: 617083 - RNA, 22 nt, Human
aguagaauaauuggauuacagu

SEQ ID NO: 617084 - RNA, 22 nt, Human
acauuuuuacugggcaucugca

SEQ ID NO: 617085 - RNA, 22 nt, Human
aaagcaguauaguggaagggcu

SEQ ID NO: 617086 - RNA, 22 nt, Human
ggccaccuuccaguugccugca

SEQ ID NO: 617087 - RNA, 18 nt, Human
ucaugagguagaggcugg

SEQ ID NO: 617088 - RNA, 22 nt, Human
cuugagcuuagguucaggauug

SEQ ID NO: 617089 - RNA, 22 nt, Human
caggccucuauggucagcugag

SEQ ID NO: 617090 - RNA, 22 nt, Human
aaauggaggcacgcagugguua

SEQ ID NO: 617091 - RNA, 18 nt, Human
gccugcucugcucucccc

SEQ ID NO: 617092 - RNA, 22 nt, Human
caggucaaagguuaguuauguu

SEQ ID NO: 617093 - RNA, 22 nt, Human
uaaagcagugugguuguguccc

SEQ ID NO: 617094 - RNA, 22 nt, Human
gcaguguugcuaggugcgguga

SEQ ID NO: 617095 - RNA, 22 nt, Human
aacacaaaaauucucaggggca

SEQ ID NO: 617096 - RNA, 22 nt, Human
gaguaaaucgucauugcagcau

SEQ ID NO: 617097 - RNA, 22 nt, Human
guuuauaauccaacucugcucc

SEQ ID NO: 617098 - RNA, 22 nt, Human
gcuccuggcaggcagugugugu

SEQ ID NO: 617099 - RNA, 22 nt, Human
agggccagaaucccucagucua

SEQ ID NO: 617100 - RNA, 22 nt, Human
uguccuccagcagcaugguaug

SEQ ID NO: 617101 - RNA, 22 nt, Human
uccugcagaucaaagccuuuga

SEQ ID NO: 617102 - RNA, 22 nt, Human
gaaauauuacaguggaggggau

SEQ ID NO: 617103 - RNA, 22 nt, Human
cagcaguacuucucagagguau

SEQ ID NO: 617104 - RNA, 22 nt, Human
ggugccaggcuguagucagggu

SEQ ID NO: 617105 - RNA, 22 nt, Human
uguuuucucuugaaaagcaguc

SEQ ID NO: 617106 - RNA, 22 nt, Human
aggaaaauuaucaugagagcca

SEQ ID NO: 617107 - RNA, 21 nt, Human
aguguguucuuggcauuaccu

SEQ ID NO: 617108 - RNA, 22 nt, Human
gcaguguuuuacagaccagcau

SEQ ID NO: 617109 - RNA, 22 nt, Human
cccuguuuauuuuuggagagaa

SEQ ID NO: 617110 - RNA, 22 nt, Human
uuguggcugugcaccgcugccu

SEQ ID NO: 617111 - RNA, 22 nt, Human
agcuuuaugcuuccuacaagcu

SEQ ID NO: 617112 - RNA, 21 nt, Human
ggcaagaaacacaaucaagua

SEQ ID NO: 617113 - RNA, 22 nt, Human
agugucuggucucugaacuaaa

SEQ ID NO: 617114 - RNA, 20 nt, Human
cugcccagccacugagggau

SEQ ID NO: 617115 - RNA, 22 nt, Human
ggagaaggugcuggucacugug

SEQ ID NO: 617116 - RNA, 22 nt, Human
uggagaggagcaccauggccau

SEQ ID NO: 617117 - RNA, 22 nt, Human
ugaggcagguggauuacaaggu

SEQ ID NO: 617118 - RNA, 22 nt, Human
acaaacagaguugaaaaauagg

SEQ ID NO: 617119 - RNA, 22 nt, Human
uccagagcugagggucaguaga

SEQ ID NO: 617120 - RNA, 22 nt, Human
cccuggaggcggauguugcagu

SEQ ID NO: 617121 - RNA, 22 nt, Human
aaaccuuuaccagacuagcaag

SEQ ID NO: 617122 - RNA, 22 nt, Human
uagugcaaucucuuccucagca

SEQ ID NO: 617123 - RNA, 22 nt, Human
uuuaaaaaacuagucugagucu

SEQ ID NO: 617124 - RNA, 22 nt, Human
cuggccugaggccgccuucaga

SEQ ID NO: 617125 - RNA, 22 nt, Human
uacaaagugagcaaccucuuuu

SEQ ID NO: 617126 - RNA, 22 nt, Human
guccugggaaggaagccaggga

SEQ ID NO: 617127 - RNA, 22 nt, Human
uggcuccuaggauggugccugg

SEQ ID NO: 617128 - RNA, 23 nt, Human
uggcuaaacaguggagaaagcuu

SEQ ID NO: 617129 - RNA, 22 nt, Human
cuguggcuuugcagggcuuguu

SEQ ID NO: 617130 - RNA, 22 nt, Human
cacagugugacugaccuucagc

SEQ ID NO: 617131 - RNA, 21 nt, Human
ggcuggucgcgugcaugucuc

SEQ ID NO: 617132 - RNA, 22 nt, Human
gggcaaguguuuugucugccug

SEQ ID NO: 617133 - RNA, 18 nt, Human
caggucugucugccuccc

SEQ ID NO: 617134 - RNA, 22 nt, Human
aguccaggcauuccagccauuc

SEQ ID NO: 617135 - RNA, 18 nt, Human
gcccaugguaaaugcugu

SEQ ID NO: 617136 - RNA, 22 nt, Human
acaguguucaaaccacuaggcu

SEQ ID NO: 617137 - RNA, 22 nt, Human
agguggagugugcagggagagc

SEQ ID NO: 617138 - RNA, 22 nt, Human
uaaauuagagccagguaaguuu

SEQ ID NO: 617139 - RNA, 22 nt, Human
ccagcuggugggucuuucucug

SEQ ID NO: 617140 - RNA, 22 nt, Human
gcaggcccuccucuagcaaggc

SEQ ID NO: 617141 - RNA, 22 nt, Human
guuguugaugaagaucugacug

SEQ ID NO: 617142 - RNA, 22 nt, Human
gccuucugauaucucuuggcau

SEQ ID NO: 617143 - RNA, 22 nt, Human
uccaggcuugagaccaggcucu

SEQ ID NO: 617144 - RNA, 22 nt, Human
cuuuguugugccugagugcacc

SEQ ID NO: 617145 - RNA, 22 nt, Human
aguucaaagucaaggaaacugu

SEQ ID NO: 617146 - RNA, 22 nt, Human
ugaggccagagaguuugcauuu

SEQ ID NO: 617147 - RNA, 22 nt, Human
gagcccgagcgcguacccggcg

SEQ ID NO: 617148 - RNA, 22 nt, Human
gagucagguccguggacaguua

SEQ ID NO: 617149 - RNA, 22 nt, Human
ccagcucugcuugcccagucag

SEQ ID NO: 617150 - RNA, 22 nt, Human
ucuucacaccgggcagcaggaa

SEQ ID NO: 617151 - RNA, 22 nt, Human
ggucucagacuggcaggcagug

SEQ ID NO: 617152 - RNA, 22 nt, Human
uaugcuuucauucauaugugag

SEQ ID NO: 617153 - RNA, 22 nt, Human
aaagcaaugcccguucauuauc

SEQ ID NO: 617154 - RNA, 22 nt, Human
agcuccaggauaagacaggugc

SEQ ID NO: 617155 - RNA, 22 nt, Human
uccugggaguaauugagucaug

SEQ ID NO: 617156 - RNA, 19 nt, Human
gccucugcuggggacaggc

SEQ ID NO: 617157 - RNA, 22 nt, Human
caaauagacuucaaucucuuga

SEQ ID NO: 617158 - RNA, 22 nt, Human
aaguccagugcuuuagauucca

SEQ ID NO: 617159 - RNA, 22 nt, Human
gagaagggggcucgaguguccu

SEQ ID NO: 617160 - RNA, 22 nt, Human
gaggcacuggaggaaaggagaa

SEQ ID NO: 617161 - RNA, 22 nt, Human
uugagggucuggaucugcugcu

SEQ ID NO: 617162 - RNA, 22 nt, Human
ggcagaguugguggagucaguu

SEQ ID NO: 617163 - RNA, 22 nt, Human
gaguccaggcuggucaaauagc

SEQ ID NO: 617164 - RNA, 22 nt, Human
cucuguuuggcgcugcuccuuc

SEQ ID NO: 617165 - RNA, 22 nt, Human
uaccugcagcgggaauccauua

SEQ ID NO: 617166 - RNA, 22 nt, Human
uaaguagaugcaaaauggaguu

SEQ ID NO: 617167 - RNA, 22 nt, Human
cuguggcuggaauaauaaaugu

SEQ ID NO: 617168 - RNA, 22 nt, Human
uuggaaggcugaauggccucuc

SEQ ID NO: 617169 - RNA, 19 nt, Human
ccagccucucuuccacccc

SEQ ID NO: 617170 - RNA, 22 nt, Human
uuucaucuuccuuggcauaggu

SEQ ID NO: 617171 - RNA, 22 nt, Human
cauacagaaaauauauuuugau

SEQ ID NO: 617172 - RNA, 22 nt, Human
ucaguguuggcuacaucugccu

SEQ ID NO: 617173 - RNA, 22 nt, Human
ucaguguuggcauucagaaaug

SEQ ID NO: 617174 - RNA, 22 nt, Human
aagauacagacagagccaaaau

SEQ ID NO: 617175 - RNA, 22 nt, Human
auuuauuaagcaucugcuaugu

SEQ ID NO: 617176 - RNA, 22 nt, Human
uguuuugucuaauagggcaggu

SEQ ID NO: 617177 - RNA, 22 nt, Human
uguguucauuucucucugcugu

SEQ ID NO: 617178 - RNA, 22 nt, Human
gcaggcaccacggcucaggucu

SEQ ID NO: 617179 - RNA, 22 nt, Human
gcagcucccuggcugcaaauga

SEQ ID NO: 617180 - RNA, 20 nt, Human
auaaaauaacugccacaaga

SEQ ID NO: 617181 - RNA, 22 nt, Human
accuucuggucugccugacagc

SEQ ID NO: 617182 - RNA, 21 nt, Human
cugagggccgcagcugggcuc

SEQ ID NO: 617183 - RNA, 22 nt, Human
uucaaaaguaaucaguauuaga

SEQ ID NO: 617184 - RNA, 21 nt, Human
uagggggcagugggaugcuua

SEQ ID NO: 617185 - RNA, 22 nt, Human
gccugggagcacaucggggucc

SEQ ID NO: 617186 - RNA, 22 nt, Human
cugggacauauugcuaguguug

SEQ ID NO: 617187 - RNA, 22 nt, Human
cacugugggccugucgugggug

SEQ ID NO: 617188 - RNA, 22 nt, Human
ucuuucagcucuucaggaccca

SEQ ID NO: 617189 - RNA, 22 nt, Human
ucugcaggacugaggccuguuu

SEQ ID NO: 617190 - RNA, 22 nt, Human
auuguugaggagacucuucaau

SEQ ID NO: 617191 - RNA, 22 nt, Human
acagcucacucacagggcuagu

SEQ ID NO: 617192 - RNA, 22 nt, Human
ggcacuuugauuuugagaugca

SEQ ID NO: 617193 - RNA, 22 nt, Human
aauuguuguacagaauaaauga

SEQ ID NO: 617194 - RNA, 22 nt, Human
uccugugguaugggagugaugu

SEQ ID NO: 617195 - RNA, 22 nt, Human
ugugugaagugauuuuaagucu

SEQ ID NO: 617196 - RNA, 22 nt, Human
caaaugcauaguuuauaagaag

SEQ ID NO: 617197 - RNA, 22 nt, Human
ucaguguuuccuagagcauaua

SEQ ID NO: 617198 - RNA, 22 nt, Human
cuggguauaggaaacaguuaag

SEQ ID NO: 617199 - RNA, 22 nt, Human
gagguggauguugcagugagcu

SEQ ID NO: 617200 - RNA, 22 nt, Human
uuuaaauucugucugccgcuua

SEQ ID NO: 617201 - RNA, 22 nt, Human
uugaggagaagacuuugcuucc

SEQ ID NO: 617202 - RNA, 22 nt, Human
agcugagagguggcaagcugua

SEQ ID NO: 617203 - RNA, 22 nt, Human
ggcagucccagcccagaggcgc

SEQ ID NO: 617204 - RNA, 22 nt, Human
ugaggcaggaguucaggcugcg

SEQ ID NO: 617205 - RNA, 22 nt, Human
acucaggaauggggcugggacu

SEQ ID NO: 617206 - RNA, 22 nt, Human
ccagagggagccaccagggugu

SEQ ID NO: 617207 - RNA, 22 nt, Human
ucauuuuuagcgcgcaaaaguu

SEQ ID NO: 617208 - RNA, 22 nt, Human
gggcuauagcacuauguauggg

SEQ ID NO: 617209 - RNA, 22 nt, Human
aagacaauguuucugauagaua

SEQ ID NO: 617210 - RNA, 22 nt, Human
gugcagugagcagugcagcacc

SEQ ID NO: 617211 - RNA, 23 nt, Human
uccagggcaguggcugggucugc

SEQ ID NO: 617212 - RNA, 22 nt, Human
ugcccugguagacacagacugu

SEQ ID NO: 617213 - RNA, 22 nt, Human
caggcaggucagugaagaagga

SEQ ID NO: 617214 - RNA, 22 nt, Human
agcaguuuuccugagcuccuca

SEQ ID NO: 617215 - RNA, 22 nt, Human
agagaggcauucggugauccca

SEQ ID NO: 617216 - RNA, 22 nt, Human
cucuggcuuguuaaugcauauu

SEQ ID NO: 617217 - RNA, 22 nt, Human
auuuucaguugaaaaaguuggu

SEQ ID NO: 617218 - RNA, 22 nt, Human
acaguguugaggugcuuguuuc

SEQ ID NO: 617219 - RNA, 22 nt, Human
aaggcuggucagauguggugaa

SEQ ID NO: 617220 - RNA, 22 nt, Human
ucauugccauggcauuugcaga

SEQ ID NO: 617221 - RNA, 22 nt, Human
ucuuggcuacuuaggaggauuc

SEQ ID NO: 617222 - RNA, 22 nt, Human
uauaaaauggcaucagcuccaa

SEQ ID NO: 617223 - RNA, 23 nt, Human
guaaaauacgcagugcaguguga

SEQ ID NO: 617224 - RNA, 22 nt, Human
agggccagccgacuuccagccu

SEQ ID NO: 617225 - RNA, 22 nt, Human
uccccaccuaagauacccaucu

SEQ ID NO: 617226 - RNA, 15 nt, Human
cuguggcuaaccuaa

SEQ ID NO: 617227 - RNA, 22 nt, Human
uugcauuugagaaaguucuccu

SEQ ID NO: 617228 - RNA, 22 nt, Human
auuguugacuugauuacucaac

SEQ ID NO: 617229 - RNA, 22 nt, Human
acaguguuuauguacagauugu

SEQ ID NO: 617230 - RNA, 22 nt, Human
aaagcagagguugcagugagcu

SEQ ID NO: 617231 - RNA, 22 nt, Human
augcagaauugcuaaguaucug

SEQ ID NO: 617232 - RNA, 22 nt, Human
uacagcauuaacaggcuguuua

SEQ ID NO: 617233 - RNA, 20 nt, Human
agaaacagcacaauucuguu

SEQ ID NO: 617234 - RNA, 22 nt, Human
uuggaaaugauuucuauuauua

SEQ ID NO: 617235 - RNA, 22 nt, Human
uuguuuguaaggcucuuagaau

SEQ ID NO: 617236 - RNA, 22 nt, Human
ugaggcaggaguuaaugugcuc

SEQ ID NO: 617237 - RNA, 22 nt, Human
uggaggucugcaaggcgcugga

SEQ ID NO: 617238 - RNA, 21 nt, Human
gaaaggucuuaacuuacagag

SEQ ID NO: 617239 - RNA, 22 nt, Human
gcaguguuuuucaaugcuucca

SEQ ID NO: 617240 - RNA, 22 nt, Human
gagccuggccuccugccucagc

SEQ ID NO: 617241 - RNA, 22 nt, Human
ggccaucugccucaaugugugc

SEQ ID NO: 617242 - RNA, 22 nt, Human
uuaaaguauagaggacaaaaac

SEQ ID NO: 617243 - RNA, 22 nt, Human
agugccaaacaguacauaacau

SEQ ID NO: 617244 - RNA, 22 nt, Human
auuucucauguacaaaaacacu

SEQ ID NO: 617245 - RNA, 22 nt, Human
uggccagcccucuucccacacu

SEQ ID NO: 617246 - RNA, 22 nt, Human
uuuauuuaaagucguguguuaa

SEQ ID NO: 617247 - RNA, 22 nt, Human
aauguagaaugauccuuaggau

SEQ ID NO: 617248 - RNA, 22 nt, Human
uucacccuggaccagaaauugg

SEQ ID NO: 617249 - RNA, 22 nt, Human
aagaggggugugugucaaccca

SEQ ID NO: 617250 - RNA, 22 nt, Human
cuuuucuguaucaaaaggauua

SEQ ID NO: 617251 - RNA, 22 nt, Human
auauacagggagaaacagcuua

SEQ ID NO: 617252 - RNA, 18 nt, Human
cagggcuguggggucacu

SEQ ID NO: 617253 - RNA, 22 nt, Human
uaggacugauaaggggccagag

SEQ ID NO: 617254 - RNA, 22 nt, Human
uguccugugaccuggcaccaca

SEQ ID NO: 617255 - RNA, 22 nt, Human
ucuugagugcgcuuggguguuc

SEQ ID NO: 617256 - RNA, 22 nt, Human
gaagccuugaacugcaaacccc

SEQ ID NO: 617257 - RNA, 22 nt, Human
gaucucuguggacucuuagcac

SEQ ID NO: 617258 - RNA, 22 nt, Human
ccagucuguacuuugcucuguu

SEQ ID NO: 617259 - RNA, 22 nt, Human
aagguccaguuugaauuacugu

SEQ ID NO: 617260 - RNA, 22 nt, Human
cuccagggagcuguggagguuu

SEQ ID NO: 617261 - RNA, 22 nt, Human
ugggcucucuuuaccucauaac

SEQ ID NO: 617262 - RNA, 22 nt, Human
cuccugggucauugccagcaaa

SEQ ID NO: 617263 - RNA, 22 nt, Human
gcuggagaguaguaagcaguua

SEQ ID NO: 617264 - RNA, 22 nt, Human
ugaggaaauugaggcucacaga

SEQ ID NO: 617265 - RNA, 22 nt, Human
ccaugcagugcuggagcugauu

SEQ ID NO: 617266 - RNA, 22 nt, Human
ugcaaguaauuccagcuacuga

SEQ ID NO: 617267 - RNA, 22 nt, Human
aacagcuagaauucuacuggcu

SEQ ID NO: 617268 - RNA, 22 nt, Human
gagucaggcacugcugcugcuc

SEQ ID NO: 617269 - RNA, 22 nt, Human
uccaggagguaugaguggcccc

SEQ ID NO: 617270 - RNA, 22 nt, Human
ggaaucuuaauggcauggaguu

SEQ ID NO: 617271 - RNA, 22 nt, Human
cugggcuagaaggaccaggaug

SEQ ID NO: 617272 - RNA, 22 nt, Human
ccagggcaucacauccaguguu

SEQ ID NO: 617273 - RNA, 22 nt, Human
gaaaccuuugccgauggggucc

SEQ ID NO: 617274 - RNA, 22 nt, Human
cauucaaacauuaauuuauuca

SEQ ID NO: 617275 - RNA, 22 nt, Human
gaauauuuguaauuacuguuga

SEQ ID NO: 617276 - RNA, 22 nt, Human
gccuguuuacuuugccgcagga

SEQ ID NO: 617277 - RNA, 22 nt, Human
uuuaauguagcgugaaaugauu

SEQ ID NO: 617278 - RNA, 22 nt, Human
agggccugugaauucucccugc

SEQ ID NO: 617279 - RNA, 22 nt, Human
ggacaaaggucuggggaaccug

SEQ ID NO: 617280 - RNA, 22 nt, Human
gcuccuggcuucacugacauca

SEQ ID NO: 617281 - RNA, 22 nt, Human
ccagcccuugaggucuguccau

SEQ ID NO: 617282 - RNA, 22 nt, Human
uucagccuguucaugcuguugc

SEQ ID NO: 617283 - RNA, 22 nt, Human
acauuucugcaucucagagcua

SEQ ID NO: 617284 - RNA, 22 nt, Human
cucugcgccacccucgccugcu

SEQ ID NO: 617285 - RNA, 22 nt, Human
uacaggcccauagucccugcuu

SEQ ID NO: 617286 - RNA, 22 nt, Human
uuucacaaagcauagcacuuua

SEQ ID NO: 617287 - RNA, 22 nt, Human
gccuguuuuagaugcauugaug

SEQ ID NO: 617288 - RNA, 22 nt, Human
cuguggcuucuagguccccgau

SEQ ID NO: 617289 - RNA, 22 nt, Human
uacaaagugaaauaauucugag

SEQ ID NO: 617290 - RNA, 19 nt, Human
cuguggcugaccucuggcc

SEQ ID NO: 617291 - RNA, 22 nt, Human
cugcccugggccaggaagcggc

SEQ ID NO: 617292 - RNA, 22 nt, Human
cccagccuuugcuuccugguuc

SEQ ID NO: 617293 - RNA, 22 nt, Human
accuucaagauugugggucaau

SEQ ID NO: 617294 - RNA, 22 nt, Human
augaggcauauccuccuauggu

SEQ ID NO: 617295 - RNA, 22 nt, Human
gggagggccaggcucacccagg

SEQ ID NO: 617296 - RNA, 22 nt, Human
ucccauguaagaaggagacagg

SEQ ID NO: 617297 - RNA, 22 nt, Human
ugggggcuagaacccagggauu

SEQ ID NO: 617298 - RNA, 22 nt, Human
gccugaggaaugcuccugacuu

SEQ ID NO: 617299 - RNA, 22 nt, Human
auuuccauguccaaaaauuagu

SEQ ID NO: 617300 - RNA, 22 nt, Human
ggucugugcucuggagccucug

SEQ ID NO: 617301 - RNA, 22 nt, Human
gcaggcaccggguugcuccccu

SEQ ID NO: 617302 - RNA, 22 nt, Human
agggaugacucuuggcugauuc

SEQ ID NO: 617303 - RNA, 20 nt, Human
ucccauguccauaucagccc

SEQ ID NO: 617304 - RNA, 22 nt, Human
ugcccuugaggacagcucccag

SEQ ID NO: 617305 - RNA, 22 nt, Human
ccugaggcccuggcugugcuga

SEQ ID NO: 617306 - RNA, 22 nt, Human
uuacuuuagaucauacugugug

SEQ ID NO: 617307 - RNA, 22 nt, Human
caggcugggaacgccacccgcu

SEQ ID NO: 617308 - RNA, 22 nt, Human
augucuuugccauaguucauau

SEQ ID NO: 617309 - RNA, 20 nt, Human
auguuguuuacucauagcau

SEQ ID NO: 617310 - RNA, 22 nt, Human
aggcagguguuaccucugguuu

SEQ ID NO: 617311 - RNA, 22 nt, Human
ggccagggaggagaggccccug

SEQ ID NO: 617312 - RNA, 22 nt, Human
uccuggccuagaguuuguguuc

SEQ ID NO: 617313 - RNA, 22 nt, Human
uccugcagcugaagcucaugug

SEQ ID NO: 617314 - RNA, 22 nt, Human
cagguccaauugcgcuaaaauc

SEQ ID NO: 617315 - RNA, 21 nt, Human
cccugguuccacugucaccgc

SEQ ID NO: 617316 - RNA, 22 nt, Human
cuucaaaagccagaagccugcg

SEQ ID NO: 617317 - RNA, 22 nt, Human
cugggaugauagugcuaguauu

SEQ ID NO: 617318 - RNA, 22 nt, Human
uggggagaaaugucuuuguucc

SEQ ID NO: 617319 - RNA, 22 nt, Human
uguguugugacauucuuggaug

SEQ ID NO: 617320 - RNA, 22 nt, Human
cuugaaauccagauuucagagg

SEQ ID NO: 617321 - RNA, 22 nt, Human
aagggcuuuuaagauuuauccu

SEQ ID NO: 617322 - RNA, 22 nt, Human
uuguguuucccuugcauauucc

SEQ ID NO: 617323 - RNA, 22 nt, Human
uggagaauuuugucaccagaca

SEQ ID NO: 617324 - RNA, 22 nt, Human
cagggcaaagagagcacaugcu

SEQ ID NO: 617325 - RNA, 22 nt, Human
ugaagccagggacugacacuuc

SEQ ID NO: 617326 - RNA, 22 nt, Human
uaaagcagccagggucuaagcc

SEQ ID NO: 617327 - RNA, 21 nt, Human
uccagaggaggacagacucag

SEQ ID NO: 617328 - RNA, 22 nt, Human
acagcagcauaaacugacuaag

SEQ ID NO: 617329 - RNA, 22 nt, Human
cagggauggccuggcgggccac

SEQ ID NO: 617330 - RNA, 22 nt, Human
caacuuguucuugguagaucua

SEQ ID NO: 617331 - RNA, 21 nt, Human
ccuucuccacagggucuccgg

SEQ ID NO: 617332 - RNA, 22 nt, Human
gcuuucugaagcaguguuucuc

SEQ ID NO: 617333 - RNA, 22 nt, Human
augauggaauauuauucaggca

SEQ ID NO: 617334 - RNA, 22 nt, Human
agugggugggugucugacaguu

SEQ ID NO: 617335 - RNA, 20 nt, Human
cagaggcaaggagacuugga

SEQ ID NO: 617336 - RNA, 22 nt, Human
uuucuauuguaagucuccuaua

SEQ ID NO: 617337 - RNA, 22 nt, Human
uucccaugccuggccccuaucc

SEQ ID NO: 617338 - RNA, 22 nt, Human
auauacaguuuuacaggguuuc

SEQ ID NO: 617339 - RNA, 23 nt, Human
aaguccagaaggagaacugggag

SEQ ID NO: 617340 - RNA, 22 nt, Human
uaaauuacucaaugcacauaaa

SEQ ID NO: 617341 - RNA, 22 nt, Human
gugcccugaggucuucacuuug

SEQ ID NO: 617342 - RNA, 22 nt, Human
ggucucgagccaggcagcugca

SEQ ID NO: 617343 - RNA, 22 nt, Human
gcgggcggggguucccaggucu

SEQ ID NO: 617344 - RNA, 21 nt, Human
guggcucugccaggacugaaa

SEQ ID NO: 617345 - RNA, 22 nt, Human
auugaagaaacccaaauaaugg

SEQ ID NO: 617346 - RNA, 22 nt, Human
cuggaaggugacugucuugaau

SEQ ID NO: 617347 - RNA, 21 nt, Human
uuuucuggaguaugucuccuc

SEQ ID NO: 617348 - RNA, 23 nt, Human
ugaugcaguaaauuggucucuaa

SEQ ID NO: 617349 - RNA, 22 nt, Human
gagugcaguaugagaggcugcu

SEQ ID NO: 617350 - RNA, 22 nt, Human
gcaguguugagugguggcugaa

SEQ ID NO: 617351 - RNA, 22 nt, Human
ggaggcagaauagagugugggu

SEQ ID NO: 617352 - RNA, 22 nt, Human
uacagucaauacuaggaccaua

SEQ ID NO: 617353 - RNA, 22 nt, Human
acaaaugaaucauacauaaugu

SEQ ID NO: 617354 - RNA, 22 nt, Human
cauuugcucugugucaguggca

SEQ ID NO: 617355 - RNA, 19 nt, Human
uuucacaaagagagcguga

SEQ ID NO: 617356 - RNA, 22 nt, Human
aguguggggucaccggcccagg

SEQ ID NO: 617357 - RNA, 22 nt, Human
ccagggcagugggagaaggugc

SEQ ID NO: 617358 - RNA, 22 nt, Human
aaauauaauuucugccucaaua

SEQ ID NO: 617359 - RNA, 22 nt, Human
gcaggucuggcauagagccugc

SEQ ID NO: 617360 - RNA, 22 nt, Human
auacagcaguuugugauccuag

SEQ ID NO: 617361 - RNA, 22 nt, Human
acaguguuguggcucuuaauag

SEQ ID NO: 617362 - RNA, 22 nt, Human
ggagagaauuccauggacaugu

SEQ ID NO: 617363 - RNA, 22 nt, Human
aggugcaguguuuaaaaguagc

SEQ ID NO: 617364 - RNA, 23 nt, Human
gcaagagacagagcauccuguuc

SEQ ID NO: 617365 - RNA, 22 nt, Human
ccaggcugugcuuuucauaaau

SEQ ID NO: 617366 - RNA, 22 nt, Human
ggagaaggaagaaagcuacuau

SEQ ID NO: 617367 - RNA, 22 nt, Human
uuccuggggcuuagcaauggag

SEQ ID NO: 617368 - RNA, 22 nt, Human
uccucugguuauacuugcaccc

SEQ ID NO: 617369 - RNA, 22 nt, Human
aacacauuuugccuaggcaaua

SEQ ID NO: 617370 - RNA, 22 nt, Human
gccugggacccuuagcucuugg

SEQ ID NO: 617371 - RNA, 22 nt, Human
uuuugccuaagaaucucucuga

SEQ ID NO: 617372 - RNA, 22 nt, Human
cagaagcagauucuaaagcaag

SEQ ID NO: 617373 - RNA, 22 nt, Human
acaguguucuuggcgcugagug

SEQ ID NO: 617374 - RNA, 22 nt, Human
auuuucagaacauucauucacu

SEQ ID NO: 617375 - RNA, 22 nt, Human
gaagcuaaaccacagcuaagaa

SEQ ID NO: 617376 - RNA, 22 nt, Human
caaguaugagaaagcuauuacc

SEQ ID NO: 617377 - RNA, 22 nt, Human
gcuggcuugacagaggccuggg

SEQ ID NO: 617378 - RNA, 22 nt, Human
aagcaugggaaucccacagggu

SEQ ID NO: 617379 - RNA, 18 nt, Human
cccagccucuccuuucua

SEQ ID NO: 617380 - RNA, 22 nt, Human
aagucaaagcuuucagaggaaa

SEQ ID NO: 617381 - RNA, 22 nt, Human
guuguaaguuuaaugucaauug

SEQ ID NO: 617382 - RNA, 20 nt, Human
uagugcaaaggcagccauag

SEQ ID NO: 617383 - RNA, 22 nt, Human
cagaugaagaucauagaauagu

SEQ ID NO: 617384 - RNA, 22 nt, Human
uuguagcugaaaguaaagaagu

SEQ ID NO: 617385 - RNA, 22 nt, Human
ucucuucacacuaccccugugu

SEQ ID NO: 617386 - RNA, 17 nt, Human
uuucaucugggaccacc

SEQ ID NO: 617387 - RNA, 22 nt, Human
uuggguuuugauacaugucuaa

SEQ ID NO: 617388 - RNA, 22 nt, Human
uccaggagaccagauguaggcc

SEQ ID NO: 617389 - RNA, 22 nt, Human
ugugagucuaggucaggguguu

SEQ ID NO: 617390 - RNA, 22 nt, Human
ugggcucuggagggccuaggau

SEQ ID NO: 617391 - RNA, 22 nt, Human
cacucccucuaguugcauucug

SEQ ID NO: 617392 - RNA, 17 nt, Human
ccaggcuauaccaggcu

SEQ ID NO: 617393 - RNA, 22 nt, Human
gaggcagugucgguggcaggau

SEQ ID NO: 617394 - RNA, 20 nt, Human
uggccaccugcgucccagcc

SEQ ID NO: 617395 - RNA, 22 nt, Human
agggggcuggagacaccuccuc

SEQ ID NO: 617396 - RNA, 21 nt, Human
uccugggagucugagauccug

SEQ ID NO: 617397 - RNA, 22 nt, Human
uagaaacauucaguugcagucc

SEQ ID NO: 617398 - RNA, 22 nt, Human
caggcuggcaaugcgucaagca

SEQ ID NO: 617399 - RNA, 22 nt, Human
agagauuugucaaugauuucca

SEQ ID NO: 617400 - RNA, 22 nt, Human
gcacaaagguggaaggaggaag

SEQ ID NO: 617401 - RNA, 22 nt, Human
aacguccucaccuguaacuugg

SEQ ID NO: 617402 - RNA, 22 nt, Human
gagcaggugccuguagcucucu

SEQ ID NO: 617403 - RNA, 22 nt, Human
ccugggcaacauagggagaccc

SEQ ID NO: 617404 - RNA, 22 nt, Human
agaggcugaaugaugucaucau

SEQ ID NO: 617405 - RNA, 21 nt, Human
gcagaaguggcuacaucucca

SEQ ID NO: 617406 - RNA, 18 nt, Human
caggagcaggaguugaac

SEQ ID NO: 617407 - RNA, 22 nt, Human
ccagggcacguugggacaguac

SEQ ID NO: 617408 - RNA, 22 nt, Human
uguguucagaauuugcugcuuu

SEQ ID NO: 617409 - RNA, 22 nt, Human
caaugcugugcuccucaugagg

SEQ ID NO: 617410 - RNA, 22 nt, Human
uccugcagaccucagucagguc

SEQ ID NO: 617411 - RNA, 22 nt, Human
cauggccacaugauaaucaagu

SEQ ID NO: 617412 - RNA, 23 nt, Human
aggugccaacugagagcugagag

SEQ ID NO: 617413 - RNA, 23 nt, Human
auuuuaaccuugacuaacaugca

SEQ ID NO: 617414 - RNA, 22 nt, Human
ccugggcaacauagugagaccu

SEQ ID NO: 617415 - RNA, 22 nt, Human
ucugggcuuuacacugugcuua

SEQ ID NO: 617416 - RNA, 21 nt, Human
cauuuacaugacagauugguu

SEQ ID NO: 617417 - RNA, 22 nt, Human
uuuucugccugcguguuuagga

SEQ ID NO: 617418 - RNA, 22 nt, Human
agcuuccugaugcaagagggcu

SEQ ID NO: 617419 - RNA, 18 nt, Human
uugaggaguucacugucu

SEQ ID NO: 617420 - RNA, 22 nt, Human
auggccaggguggcacuguggu

SEQ ID NO: 617421 - RNA, 22 nt, Human
gauggcagcagcagccagggau

SEQ ID NO: 617422 - RNA, 22 nt, Human
auuccugguggcagaaacauga

SEQ ID NO: 617423 - RNA, 22 nt, Human
ugugaauggacaauuaaaucua

SEQ ID NO: 617424 - RNA, 22 nt, Human
aagaacagguucuagaaccauu

SEQ ID NO: 617425 - RNA, 22 nt, Human
agguccagacuguguacccuag

SEQ ID NO: 617426 - RNA, 22 nt, Human
uuacaagauaugugagaacuag

SEQ ID NO: 617427 - RNA, 22 nt, Human
aauucaaugguuuuuaggauau

SEQ ID NO: 617428 - RNA, 22 nt, Human
gcugggcuucaccuccagaguu

SEQ ID NO: 617429 - RNA, 22 nt, Human
cuccugggcuaugucugcuugg

SEQ ID NO: 617430 - RNA, 22 nt, Human
uuuuccucaccuaacucaaggu

SEQ ID NO: 617431 - RNA, 22 nt, Human
aaaaugcugggaaaguuggaau

SEQ ID NO: 617432 - RNA, 22 nt, Human
uugaagaugguagcaauuuccu

SEQ ID NO: 617433 - RNA, 22 nt, Human
accuucaaugaaaauaauaguc

SEQ ID NO: 617434 - RNA, 22 nt, Human
gggcagguguuuccaaggugag

SEQ ID NO: 617435 - RNA, 22 nt, Human
uuuaaauuuguguuuagagggu

SEQ ID NO: 617436 - RNA, 22 nt, Human
aggagaaguaaggcuagaugau

SEQ ID NO: 617437 - RNA, 22 nt, Human
aagcagcuuaaauuagagccug

SEQ ID NO: 617438 - RNA, 22 nt, Human
aggugccagcucucaggcagga

SEQ ID NO: 617439 - RNA, 22 nt, Human
gagaagggcuugggagucaaca

SEQ ID NO: 617440 - RNA, 22 nt, Human
gagagcauguggucuaguuuua

SEQ ID NO: 617441 - RNA, 22 nt, Human
caagccagcuccugccacagag

SEQ ID NO: 617442 - RNA, 22 nt, Human
acaguguucacuaagguuagcu

SEQ ID NO: 617443 - RNA, 22 nt, Human
ggaugucgaggaugggguagca

SEQ ID NO: 617444 - RNA, 22 nt, Human
augcccugcugccaucuggccg

SEQ ID NO: 617445 - RNA, 22 nt, Human
aaaugcaaggcacauuccuuuu

SEQ ID NO: 617446 - RNA, 22 nt, Human
aggcagguguugggagacacca

SEQ ID NO: 617447 - RNA, 22 nt, Human
acagacaguaaauaguguggcu

SEQ ID NO: 617448 - RNA, 22 nt, Human
ccuccugcacuugcuuuccuuc

SEQ ID NO: 617449 - RNA, 22 nt, Human
gcuggcuuccuucugcagcuag

SEQ ID NO: 617450 - RNA, 20 nt, Human
uuuucugugccaagaaaacu

SEQ ID NO: 617451 - RNA, 21 nt, Human
auggagucaggggaaugggcc

SEQ ID NO: 617452 - RNA, 22 nt, Human
gagguccauuuucacauaugau

SEQ ID NO: 617453 - RNA, 22 nt, Human
cuggccucagagggucauggug

SEQ ID NO: 617454 - RNA, 22 nt, Human
agggcucagaacaaugagugua

SEQ ID NO: 617455 - RNA, 22 nt, Human
caggcuggagugcaauggcaca

SEQ ID NO: 617456 - RNA, 22 nt, Human
auaaaaaggacagauguggucu

SEQ ID NO: 617457 - RNA, 22 nt, Human
ucuggcccaaguuuucggugag

SEQ ID NO: 617458 - RNA, 22 nt, Human
gagcuccaccaccuucaggcag

SEQ ID NO: 617459 - RNA, 22 nt, Human
gccuggagaccugcuccucuac

SEQ ID NO: 617460 - RNA, 22 nt, Human
uuccugggugguccugguagag

SEQ ID NO: 617461 - RNA, 22 nt, Human
gaaacaaucaucaugugauuug

SEQ ID NO: 617462 - RNA, 20 nt, Human
gucugaggagcagugggaaa

SEQ ID NO: 617463 - RNA, 22 nt, Human
uuccuggggggauagauuucac

SEQ ID NO: 617464 - RNA, 22 nt, Human
uuccagcccgcgacuuguucag

SEQ ID NO: 617465 - RNA, 22 nt, Human
cccuggaggcaaagguugcagu

SEQ ID NO: 617466 - RNA, 22 nt, Human
gcaguguuaaacaacugcugcu

SEQ ID NO: 617467 - RNA, 19 nt, Human
gccagcagaaugaugaggc

SEQ ID NO: 617468 - RNA, 22 nt, Human
gggcccagcacuggcugggauc

SEQ ID NO: 617469 - RNA, 22 nt, Human
agacaaaggauuaaugaugaug

SEQ ID NO: 617470 - RNA, 22 nt, Human
aaccagaggcagcaguaccuga

SEQ ID NO: 617471 - RNA, 22 nt, Human
caaggccugacugcuugucuaa

SEQ ID NO: 617472 - RNA, 22 nt, Human
ccuguccagggacugagggaga

SEQ ID NO: 617473 - RNA, 17 nt, Human
gggcuuuagguggugua

SEQ ID NO: 617474 - RNA, 23 nt, Human
agacuggggcauaagaagauggc

SEQ ID NO: 617475 - RNA, 22 nt, Human
uuuacaagaaaucaugaugcua

SEQ ID NO: 617476 - RNA, 22 nt, Human
caagccuuggaaauccauucug

SEQ ID NO: 617477 - RNA, 22 nt, Human
aggaagcaguuuauaaugcauu

SEQ ID NO: 617478 - RNA, 22 nt, Human
ccaugccuuucacugaaccagu

SEQ ID NO: 617479 - RNA, 22 nt, Human
accuucugaccaguuaucuuga

SEQ ID NO: 617480 - RNA, 22 nt, Human
uaggcacaagaccaugcaaagg

SEQ ID NO: 617481 - RNA, 22 nt, Human
cugccagcaaugugaccaugcu

SEQ ID NO: 617482 - RNA, 22 nt, Human
cugugugcucggauggacucgu

SEQ ID NO: 617483 - RNA, 22 nt, Human
uucuuuguuugauaaguaugcu

SEQ ID NO: 617484 - RNA, 22 nt, Human
guacaauagcaguuuucccuuu

SEQ ID NO: 617485 - RNA, 22 nt, Human
uuccugggagcuagccacaucu

SEQ ID NO: 617486 - RNA, 22 nt, Human
uuuccucuuuguaccuugacua

SEQ ID NO: 617487 - RNA, 22 nt, Human
agguccaguuuucugacaaggg

SEQ ID NO: 617488 - RNA, 22 nt, Human
ugggagucagucguucucagag

SEQ ID NO: 617489 - RNA, 21 nt, Human
cugcaggaugcugaagccagg

SEQ ID NO: 617490 - RNA, 22 nt, Human
cugaggcacugucagcugaggc

SEQ ID NO: 617491 - RNA, 22 nt, Human
gggcuuuaaucuuguuaacuag

SEQ ID NO: 617492 - RNA, 22 nt, Human
uuuuuaucuacagauucucagc

SEQ ID NO: 617493 - RNA, 22 nt, Human
auuaguguucuuaucuucuagg

SEQ ID NO: 617494 - RNA, 22 nt, Human
auguccagaguguccuggaaag

SEQ ID NO: 617495 - RNA, 21 nt, Human
agcuggccugguuugagcucc

SEQ ID NO: 617496 - RNA, 22 nt, Human
uuucagaguuaguagagcaugu

SEQ ID NO: 617497 - RNA, 22 nt, Human
ugcauguuaagaaaauauugag

SEQ ID NO: 617498 - RNA, 22 nt, Human
acagguguccucacagggggug

SEQ ID NO: 617499 - RNA, 22 nt, Human
cagcuguucggggcuggcaugu

SEQ ID NO: 617500 - RNA, 22 nt, Human
aguggcaguagaugagcugguu

SEQ ID NO: 617501 - RNA, 22 nt, Human
cuggagucuucagcuugcugcc

SEQ ID NO: 617502 - RNA, 22 nt, Human
agaaucaaagagaaauacuuug

SEQ ID NO: 617503 - RNA, 22 nt, Human
ggaugggagcagaggacgacca

SEQ ID NO: 617504 - RNA, 22 nt, Human
ugugcaaaauaauaaaucacug

SEQ ID NO: 617505 - RNA, 22 nt, Human
aaacaaagccagggaaguuaug

SEQ ID NO: 617506 - RNA, 22 nt, Human
agguggagacccagagaaggcg

SEQ ID NO: 617507 - RNA, 22 nt, Human
aagucagauaggugaguccaaa

SEQ ID NO: 617508 - RNA, 20 nt, Human
cucugcagcaaggccugggu

SEQ ID NO: 617509 - RNA, 22 nt, Human
ggagggacccacugcggugacc

SEQ ID NO: 617510 - RNA, 22 nt, Human
ccagcuuuucuuaucauuauaa

SEQ ID NO: 617511 - RNA, 22 nt, Human
cagauccacccuuguagugaca

SEQ ID NO: 617512 - RNA, 22 nt, Human
uguagaaagaauauguuucaua

SEQ ID NO: 617513 - RNA, 22 nt, Human
ccagcucucuuugaagcauaaa

SEQ ID NO: 617514 - RNA, 22 nt, Human
cuucaaaugugauuuuaauaac

SEQ ID NO: 617515 - RNA, 22 nt, Human
uuacaagauugauuugcuuggc

SEQ ID NO: 617516 - RNA, 22 nt, Human
ggagaucuuuaggaguuggacu

SEQ ID NO: 617517 - RNA, 20 nt, Human
cugggccauccuuuuacaau

SEQ ID NO: 617518 - RNA, 22 nt, Human
cagggugccucugcucccacca

SEQ ID NO: 617519 - RNA, 20 nt, Human
cucuuaaauguaaaguaggc

SEQ ID NO: 617520 - RNA, 22 nt, Human
ggcuccuguccccucagcugcu

SEQ ID NO: 617521 - RNA, 22 nt, Human
auauucaucguguagaaauacu

SEQ ID NO: 617522 - RNA, 22 nt, Human
uagguucaugaaauuuucagga

SEQ ID NO: 617523 - RNA, 22 nt, Human
aauuaaaaaaggagagcuugcu

SEQ ID NO: 617524 - RNA, 22 nt, Human
ccaggagcagauauggacauaa

SEQ ID NO: 617525 - RNA, 22 nt, Human
ucugggagagggaaagaagacu

SEQ ID NO: 617526 - RNA, 22 nt, Human
aaggcugggaaacaugcaggcc

SEQ ID NO: 617527 - RNA, 22 nt, Human
ugaagauuuccaccaaaucaca

SEQ ID NO: 617528 - RNA, 22 nt, Human
aggagaggguggcauuaaguuu

SEQ ID NO: 617529 - RNA, 22 nt, Human
aacagcuauucacuacuauggg

SEQ ID NO: 617530 - RNA, 22 nt, Human
auuccuuggaacagaugcgaag

SEQ ID NO: 617531 - RNA, 22 nt, Human
ugaugcaguguccucccaugca

SEQ ID NO: 617532 - RNA, 22 nt, Human
augcccuggacuucuaguauuc

SEQ ID NO: 617533 - RNA, 22 nt, Human
gaaagcaauuuguguaaucugu

SEQ ID NO: 617534 - RNA, 22 nt, Human
caguauuuucaggauuuggaag

SEQ ID NO: 617535 - RNA, 22 nt, Human
uccuggcccaaucugcccauga

SEQ ID NO: 617536 - RNA, 22 nt, Human
cuguggcucagcacggggucag

SEQ ID NO: 617537 - RNA, 22 nt, Human
cccaguggcuuuugcccagguu

SEQ ID NO: 617538 - RNA, 22 nt, Human
cacuggcugagcuucucuaggg

SEQ ID NO: 617539 - RNA, 22 nt, Human
ggugcaggagcggggugcucgg

SEQ ID NO: 617540 - RNA, 22 nt, Human
aaagaugucaguuugaaauaac

SEQ ID NO: 617541 - RNA, 22 nt, Human
aaaggaagaugccaggacucug

SEQ ID NO: 617542 - RNA, 22 nt, Human
agguucaggcacuugcccaaca

SEQ ID NO: 617543 - RNA, 22 nt, Human
gccugccaugagcuaaugacac

SEQ ID NO: 617544 - RNA, 22 nt, Human
aaggcuguccaggagaaaauag

SEQ ID NO: 617545 - RNA, 22 nt, Human
auuccuuguuucacugaaaagg

SEQ ID NO: 617546 - RNA, 22 nt, Human
ugugcacauauacucauauucc

SEQ ID NO: 617547 - RNA, 20 nt, Human
ggcaggaccccaguggcauc

SEQ ID NO: 617548 - RNA, 18 nt, Human
cugccacuuaauguggug

SEQ ID NO: 617549 - RNA, 22 nt, Human
aauguguuuucacugaagauuc

SEQ ID NO: 617550 - RNA, 22 nt, Human
gaguccaguaguuaggacagag

SEQ ID NO: 617551 - RNA, 22 nt, Human
agggccaguaccaggugggugg

SEQ ID NO: 617552 - RNA, 22 nt, Human
aacuuaaacccacucauguaga

SEQ ID NO: 617553 - RNA, 22 nt, Human
cacagugugggcauggugccug

SEQ ID NO: 617554 - RNA, 22 nt, Human
cugucccucucacaccucacca

SEQ ID NO: 617555 - RNA, 22 nt, Human
ugaggcaguauuuuagugacuu

SEQ ID NO: 617556 - RNA, 22 nt, Human
uugcagcuucuugcaucagaaa

SEQ ID NO: 617557 - RNA, 22 nt, Human
gucccuggggaaucagcuggag

SEQ ID NO: 617558 - RNA, 22 nt, Human
gaguccaguucuuuccagcagu

SEQ ID NO: 617559 - RNA, 19 nt, Human
ggccaggcugacugugguc

SEQ ID NO: 617560 - RNA, 22 nt, Human
gugcccuguugcacacuugagg

SEQ ID NO: 617561 - RNA, 22 nt, Human
ugaggcagugauguuuaagcac

SEQ ID NO: 617562 - RNA, 22 nt, Human
uggcuccucccugugugugcgu

SEQ ID NO: 617563 - RNA, 22 nt, Human
uuccuugaaugagucauggaaa

SEQ ID NO: 617564 - RNA, 22 nt, Human
aggcagucagcccugcuagggu

SEQ ID NO: 617565 - RNA, 22 nt, Human
gggcagguggagggcccagcca

SEQ ID NO: 617566 - RNA, 22 nt, Human
ggcaaggugcuacagacaguga

SEQ ID NO: 617567 - RNA, 22 nt, Human
uagcaaaauguggauguaguug

SEQ ID NO: 617568 - RNA, 22 nt, Human
cgcaggcucgguucacagagca

SEQ ID NO: 617569 - RNA, 22 nt, Human
agcuucuuaaguuccugcagca

SEQ ID NO: 617570 - RNA, 22 nt, Human
gcugaggccaggccccaccgga

SEQ ID NO: 617571 - RNA, 22 nt, Human
gagccaggggucagcuccgagg

SEQ ID NO: 617572 - RNA, 22 nt, Human
auaggccaauacuguagaguuu

SEQ ID NO: 617573 - RNA, 22 nt, Human
aaauuagauaugugugagacuc

SEQ ID NO: 617574 - RNA, 22 nt, Human
ucaggcugauaggaggaacuga

SEQ ID NO: 617575 - RNA, 22 nt, Human
cuggaagggagcacuguagaga

SEQ ID NO: 617576 - RNA, 22 nt, Human
ucaguguuucaguuuggaaaug

SEQ ID NO: 617577 - RNA, 22 nt, Human
caccaggcacauaguaggcacu

SEQ ID NO: 617578 - RNA, 22 nt, Human
cuauaaaucuacccagcauugg

SEQ ID NO: 617579 - RNA, 23 nt, Human
uccaggagaauuccagggcccgg

SEQ ID NO: 617580 - RNA, 22 nt, Human
ccugcaagagcggagaagccag

SEQ ID NO: 617581 - RNA, 22 nt, Human
uccagggauguccuguagcacu

SEQ ID NO: 617582 - RNA, 22 nt, Human
gggcgggguggcucaugccugu

SEQ ID NO: 617583 - RNA, 19 nt, Human
uuucaggagcuaugcaggg

SEQ ID NO: 617584 - RNA, 22 nt, Human
aaagacacacagccagcaagug

SEQ ID NO: 617585 - RNA, 22 nt, Human
ucaguuuccugguuuuaauauu

SEQ ID NO: 617586 - RNA, 22 nt, Human
auuugcuuguaaauguaugccu

SEQ ID NO: 617587 - RNA, 22 nt, Human
ggcccuuggagccuccacagug

SEQ ID NO: 617588 - RNA, 22 nt, Human
cauccagcuccugggggccacc

SEQ ID NO: 617589 - RNA, 22 nt, Human
gcugggaggcagcaccuuuagc

SEQ ID NO: 617590 - RNA, 20 nt, Human
ugugcccugcagacuucuuu

SEQ ID NO: 617591 - RNA, 22 nt, Human
uuggaaggagucuuuggggaug

SEQ ID NO: 617592 - RNA, 22 nt, Human
auuuuacuucauuugaaaugcc

SEQ ID NO: 617593 - RNA, 23 nt, Human
auaagccuuuucuuucugcccca

SEQ ID NO: 617594 - RNA, 22 nt, Human
gcuuuauuuugugagggauuac

SEQ ID NO: 617595 - RNA, 22 nt, Human
uccugaggaaaguucaugaaug

SEQ ID NO: 617596 - RNA, 17 nt, Human
caggaaaauaugaguga

SEQ ID NO: 617597 - RNA, 22 nt, Human
aagcaggauggagguugaguua

SEQ ID NO: 617598 - RNA, 22 nt, Human
gugcccugggccuucagggcca

SEQ ID NO: 617599 - RNA, 22 nt, Human
uuauguguguacaugcauaugu

SEQ ID NO: 617600 - RNA, 22 nt, Human
cuggaaggagcccgggcggauc

SEQ ID NO: 617601 - RNA, 22 nt, Human
cuguggcuaggaagcuguggga

SEQ ID NO: 617602 - RNA, 22 nt, Human
agcagggagaccaucucuuccu

SEQ ID NO: 617603 - RNA, 22 nt, Human
aggcagugagcagggugucaug

SEQ ID NO: 617604 - RNA, 22 nt, Human
agagccuguacuuuucugugaa

SEQ ID NO: 617605 - RNA, 22 nt, Human
aucuguggcuggugagaggcag

SEQ ID NO: 617606 - RNA, 22 nt, Human
gggcggugccugucuccgaagc

SEQ ID NO: 617607 - RNA, 22 nt, Human
aucuggaggccugucuuauccc

SEQ ID NO: 617608 - RNA, 22 nt, Human
aacaaagcccugcccaagagcu

SEQ ID NO: 617609 - RNA, 22 nt, Human
ggcaucuuguugcucaaaucua

SEQ ID NO: 617610 - RNA, 22 nt, Human
cucugguugcagcugaaguucc

SEQ ID NO: 617611 - RNA, 23 nt, Human
ggagugcaauggcgccaucucgg

SEQ ID NO: 617612 - RNA, 22 nt, Human
aacuuuaaggcuauaaauuaug

SEQ ID NO: 617613 - RNA, 22 nt, Human
acaaauaugguacucggagaaa

SEQ ID NO: 617614 - RNA, 22 nt, Human
agugucuuugucucucaagcac

SEQ ID NO: 617615 - RNA, 20 nt, Human
ugccuugggacagugccugu

SEQ ID NO: 617616 - RNA, 22 nt, Human
ucagguccuuuugguguauauu

SEQ ID NO: 617617 - RNA, 22 nt, Human
gccagcuguucagacauucuuu

SEQ ID NO: 617618 - RNA, 22 nt, Human
ucagaaaccagcucucucaauu

SEQ ID NO: 617619 - RNA, 23 nt, Human
gccaggcuccggucuguggccac

SEQ ID NO: 617620 - RNA, 22 nt, Human
aaggugacucacaaagccaguu

SEQ ID NO: 617621 - RNA, 22 nt, Human
cuucaauaggaacugcauggca

SEQ ID NO: 617622 - RNA, 22 nt, Human
gagaggcugacuggcuguccug

SEQ ID NO: 617623 - RNA, 22 nt, Human
accuguuuuccuaucuagauug

SEQ ID NO: 617624 - RNA, 22 nt, Human
caggcagggagcuggaaaggau

SEQ ID NO: 617625 - RNA, 22 nt, Human
cccuggcucuucaccaccugcc

SEQ ID NO: 617626 - RNA, 22 nt, Human
ugggcuccagcaccugugcucu

SEQ ID NO: 617627 - RNA, 22 nt, Human
caaauuacccucaacaucuaga

SEQ ID NO: 617628 - RNA, 22 nt, Human
cuucacaaauggccuagaguuc

SEQ ID NO: 617629 - RNA, 17 nt, Human
cuccuggcagccucagg

SEQ ID NO: 617630 - RNA, 17 nt, Human
cucugcagugcauggcu

SEQ ID NO: 617631 - RNA, 19 nt, Human
uggcucugucgaaggcaca

SEQ ID NO: 617632 - RNA, 22 nt, Human
agccuucacugggaccuuggau

SEQ ID NO: 617633 - RNA, 22 nt, Human
aaauuagaucaguggauuuucu

SEQ ID NO: 617634 - RNA, 22 nt, Human
aacacaaagaagcugcaggauc

SEQ ID NO: 617635 - RNA, 22 nt, Human
gcugcccacaaccccgugucua

SEQ ID NO: 617636 - RNA, 22 nt, Human
ucucuggguucucacucagcac

SEQ ID NO: 617637 - RNA, 22 nt, Human
cuguggcugugaaacuucucag

SEQ ID NO: 617638 - RNA, 22 nt, Human
aaauggaggcaaaauugguuuc

SEQ ID NO: 617639 - RNA, 22 nt, Human
cagggugacugcccuggccacu

SEQ ID NO: 617640 - RNA, 22 nt, Human
ccccagcccacaagcauauuaa

SEQ ID NO: 617641 - RNA, 22 nt, Human
uuccugggcuuuccccucuggu

SEQ ID NO: 617642 - RNA, 23 nt, Human
gagugcagaauagacaugcagug

SEQ ID NO: 617643 - RNA, 22 nt, Human
ugggcucugaagggucccggau

SEQ ID NO: 617644 - RNA, 22 nt, Human
agcugccuaguagauugauugg

SEQ ID NO: 617645 - RNA, 19 nt, Human
cuuccuugcuccccaugug

SEQ ID NO: 617646 - RNA, 22 nt, Human
gagaaaaugucagacuuggucg

SEQ ID NO: 617647 - RNA, 22 nt, Human
ccuuccuugagaagcaauuccu

SEQ ID NO: 617648 - RNA, 22 nt, Human
gcagggcuuuuugaaacauggu

SEQ ID NO: 617649 - RNA, 22 nt, Human
uucuuuguugagcaaguaggac

SEQ ID NO: 617650 - RNA, 22 nt, Human
auuguugagugcuucagcugua

SEQ ID NO: 617651 - RNA, 22 nt, Human
gagguccacugaggcaacaggg

SEQ ID NO: 617652 - RNA, 22 nt, Human
uguggaauauuagauuagguug

SEQ ID NO: 617653 - RNA, 22 nt, Human
aaggcagggaaaguggauuagg

SEQ ID NO: 617654 - RNA, 22 nt, Human
uuucagugcacguaguuuauuu

SEQ ID NO: 617655 - RNA, 22 nt, Human
caaacauagugaagcaaugaca

SEQ ID NO: 617656 - RNA, 22 nt, Human
ggcaguguggccugaguaaguc

SEQ ID NO: 617657 - RNA, 22 nt, Human
gagggcaguagccucguacccu

SEQ ID NO: 617658 - RNA, 22 nt, Human
uuccuggggacuuaccgucauu

SEQ ID NO: 617659 - RNA, 22 nt, Human
auguguauauuuauuguaguuu

SEQ ID NO: 617660 - RNA, 22 nt, Human
caaguccaggugggcaaauaaa

SEQ ID NO: 617661 - RNA, 22 nt, Human
ccagugugguagguccacaggu

SEQ ID NO: 617662 - RNA, 22 nt, Human
cuccuggcucgcccccagcuga

SEQ ID NO: 617663 - RNA, 22 nt, Human
ggagacagugguagggccuaag

SEQ ID NO: 617664 - RNA, 22 nt, Human
caguggucccugagguugcugg

SEQ ID NO: 617665 - RNA, 22 nt, Human
aggcuagaggcuucuggcuuca

SEQ ID NO: 617666 - RNA, 22 nt, Human
ugagaagcccacacucuuuccu

SEQ ID NO: 617667 - RNA, 22 nt, Human
agucccagugagaugagccacg

SEQ ID NO: 617668 - RNA, 22 nt, Human
cauuugcugaggccuucagagg

SEQ ID NO: 617669 - RNA, 22 nt, Human
uaaauuacccuuuagggaauug

SEQ ID NO: 617670 - RNA, 22 nt, Human
auguccagaguaaagcacauuc

SEQ ID NO: 617671 - RNA, 22 nt, Human
acaguguuguauuuaguuugau

SEQ ID NO: 617672 - RNA, 22 nt, Human
ucugggcuuggauuggcucugc

SEQ ID NO: 617673 - RNA, 19 nt, Human
accaggagacagugagcuu

SEQ ID NO: 617674 - RNA, 21 nt, Human
accuucaagccagaggugguc

SEQ ID NO: 617675 - RNA, 22 nt, Human
cuccucuucugaguaccaggga

SEQ ID NO: 617676 - RNA, 22 nt, Human
aaacucuguauuugcugugggu

SEQ ID NO: 617677 - RNA, 22 nt, Human
gccagggaacccaagggccuca

SEQ ID NO: 617678 - RNA, 22 nt, Human
cuuggcaguuucggaaggauga

SEQ ID NO: 617679 - RNA, 22 nt, Human
uguggagaagaaggccacugca

SEQ ID NO: 617680 - RNA, 22 nt, Human
uuggguuuucccuugaaacuga

SEQ ID NO: 617681 - RNA, 22 nt, Human
agggccugggucuguacuccuc

SEQ ID NO: 617682 - RNA, 22 nt, Human
ugugaauauuuccuucuuugga

SEQ ID NO: 617683 - RNA, 22 nt, Human
cauuugucucuaggaagugagg

SEQ ID NO: 617684 - RNA, 22 nt, Human
gccuucugcgcucgugucuccg

SEQ ID NO: 617685 - RNA, 22 nt, Human
ccuuucugauggccucccagcc

SEQ ID NO: 617686 - RNA, 22 nt, Human
ugcacuuuaaaaaauggugaug

SEQ ID NO: 617687 - RNA, 19 nt, Human
acaggggcuagcggaagca

SEQ ID NO: 617688 - RNA, 22 nt, Human
agauuuguccugcuuucuaccu

SEQ ID NO: 617689 - RNA, 22 nt, Human
cccgagugucuacucacuccca

SEQ ID NO: 617690 - RNA, 22 nt, Human
uugcccugcagcggugaguggu

SEQ ID NO: 617691 - RNA, 22 nt, Human
agagauuuacacaugccuuuuc

SEQ ID NO: 617692 - RNA, 22 nt, Human
ucaguuucacagucugugcaga

SEQ ID NO: 617693 - RNA, 22 nt, Human
gaauuugucccuugauauaaaa

SEQ ID NO: 617694 - RNA, 22 nt, Human
gagccuggauagccuuguucca

SEQ ID NO: 617695 - RNA, 22 nt, Human
cccugcagagagugcuuuugug

SEQ ID NO: 617696 - RNA, 22 nt, Human
cagcuggcagcccuggcccugc

SEQ ID NO: 617697 - RNA, 22 nt, Human
cugggagaggcugcuccgcucu

SEQ ID NO: 617698 - RNA, 21 nt, Human
gacaggggaagaagcaaggag

SEQ ID NO: 617699 - RNA, 22 nt, Human
uuuacaagucagggacuguucu

SEQ ID NO: 617700 - RNA, 22 nt, Human
uuugcaaagugcuugcagagua

SEQ ID NO: 617701 - RNA, 22 nt, Human
ccagagaauuuuagacaaaaau

SEQ ID NO: 617702 - RNA, 22 nt, Human
auggguuucccucugaaauuau

SEQ ID NO: 617703 - RNA, 22 nt, Human
uauuuuacuuuaaagcgagaga

SEQ ID NO: 617704 - RNA, 22 nt, Human
agagcuaggaaugaccacucuc

SEQ ID NO: 617705 - RNA, 22 nt, Human
gugagaagauaaguauugcaaa

SEQ ID NO: 617706 - RNA, 22 nt, Human
acagaagcucaagagagcagug

SEQ ID NO: 617707 - RNA, 22 nt, Human
cuccuggggccauggaaggaac

SEQ ID NO: 617708 - RNA, 22 nt, Human
cagaauaugacaagauuuuccu

SEQ ID NO: 617709 - RNA, 22 nt, Human
cccugcagaucagugagaacuu

SEQ ID NO: 617710 - RNA, 22 nt, Human
uccugggauucugcauuucuaa

SEQ ID NO: 617711 - RNA, 22 nt, Human
uuuucaguaaugucuacauaau

SEQ ID NO: 617712 - RNA, 22 nt, Human
ugaggcaggagaauggcgggaa

SEQ ID NO: 617713 - RNA, 22 nt, Human
cuuguccagauguuuguuaggu

SEQ ID NO: 617714 - RNA, 19 nt, Human
gggcuuuacuccaaguggg

SEQ ID NO: 617715 - RNA, 22 nt, Human
ccuacucugagcgccuccgcau

SEQ ID NO: 617716 - RNA, 22 nt, Human
ggcgccagcacugcagcgccuc

SEQ ID NO: 617717 - RNA, 22 nt, Human
ggagaagguggcucagcaaagg

SEQ ID NO: 617718 - RNA, 22 nt, Human
cuccugggaggaugcggacccg

SEQ ID NO: 617719 - RNA, 22 nt, Human
gaggcagugcauugucuagggg

SEQ ID NO: 617720 - RNA, 22 nt, Human
ucccugugucuuccucuugccc

SEQ ID NO: 617721 - RNA, 22 nt, Human
cucuggcuguuugcagcucaag

SEQ ID NO: 617722 - RNA, 22 nt, Human
uucccacagagauuacauugaa

SEQ ID NO: 617723 - RNA, 22 nt, Human
uccuucaaucacccagugggga

SEQ ID NO: 617724 - RNA, 22 nt, Human
gaggccuggaccagccacagag

SEQ ID NO: 617725 - RNA, 22 nt, Human
agaguauugugaccauuuguca

SEQ ID NO: 617726 - RNA, 22 nt, Human
uccugggagcacaugguccugc

SEQ ID NO: 617727 - RNA, 18 nt, Human
uggcuccugccuccugca

SEQ ID NO: 617728 - RNA, 18 nt, Human
auauucaagaagacagag

SEQ ID NO: 617729 - RNA, 22 nt, Human
uugaguguaaggaauguggggc

SEQ ID NO: 617730 - RNA, 22 nt, Human
uccaggcagggcagccaucaag

SEQ ID NO: 617731 - RNA, 21 nt, Human
cagaauccagucucuuauuac

SEQ ID NO: 617732 - RNA, 22 nt, Human
ccugggaguggcacucacagca

SEQ ID NO: 617733 - RNA, 21 nt, Human
uccaggaguucuaauaggugu

SEQ ID NO: 617734 - RNA, 22 nt, Human
gggcggcgucggcgaggccauc

SEQ ID NO: 617735 - RNA, 22 nt, Human
gaauuuacaaguugaauaacaa

SEQ ID NO: 617736 - RNA, 22 nt, Human
uggaugagucugagauugggca

SEQ ID NO: 617737 - RNA, 22 nt, Human
cagcaggaaagacaucugagca

SEQ ID NO: 617738 - RNA, 22 nt, Human
gagcuggaggaccaggacuggg

SEQ ID NO: 617739 - RNA, 22 nt, Human
cccagguccccaccugucugcu

SEQ ID NO: 617740 - RNA, 22 nt, Human
gcagcagggugccagcuuugca

SEQ ID NO: 617741 - RNA, 20 nt, Human
cugagccaacucucuucuug

SEQ ID NO: 617742 - RNA, 22 nt, Human
guuucccaaauuguucacaggg

SEQ ID NO: 617743 - RNA, 20 nt, Human
aacuccuagccucaagugau

SEQ ID NO: 617744 - RNA, 22 nt, Human
uuguuuccuuucuauacaggau

SEQ ID NO: 617745 - RNA, 22 nt, Human
cccaguggggagcugagguuca

SEQ ID NO: 617746 - RNA, 22 nt, Human
agugcuggguacuguucccauu

SEQ ID NO: 617747 - RNA, 22 nt, Human
ugcauauccacaccuuaucucu

SEQ ID NO: 617748 - RNA, 22 nt, Human
ugucaaaaagcugggacaagca

SEQ ID NO: 617749 - RNA, 22 nt, Human
gcuguucagaugcgauucagga

SEQ ID NO: 617750 - RNA, 22 nt, Human
uggccagguugggcuuugcagc

SEQ ID NO: 617751 - RNA, 22 nt, Human
guucugaguccuccuuugaagg

SEQ ID NO: 617752 - RNA, 22 nt, Human
uccuguggucuggaaggaaugg

SEQ ID NO: 617753 - RNA, 22 nt, Human
ugaagcaguuacuggguguuaa

SEQ ID NO: 617754 - RNA, 22 nt, Human
uagaaagacaugggccagcagc

SEQ ID NO: 617755 - RNA, 22 nt, Human
cuuucacaguccugacugagcg

SEQ ID NO: 617756 - RNA, 22 nt, Human
aggcgcaggguuuggacccagg

SEQ ID NO: 617757 - RNA, 22 nt, Human
ggugcaggaaucugcaauugaa

SEQ ID NO: 617758 - RNA, 22 nt, Human
ugaggcagaguaagauacauga

SEQ ID NO: 617759 - RNA, 22 nt, Human
gguccaggggguagauauguga

SEQ ID NO: 617760 - RNA, 22 nt, Human
agcaguaagcaacugagcuugc

SEQ ID NO: 617761 - RNA, 22 nt, Human
ugagcuccggcauauggaauua

SEQ ID NO: 617762 - RNA, 22 nt, Human
uauacaagugagaagaagaguu

SEQ ID NO: 617763 - RNA, 23 nt, Human
cccaugcugggcgcagugaaugg

SEQ ID NO: 617764 - RNA, 22 nt, Human
cagggugcugcaccaucccuca

SEQ ID NO: 617765 - RNA, 22 nt, Human
cuuccaaguugcucugcugacc

SEQ ID NO: 617766 - RNA, 22 nt, Human
caguguggugugcacagcuuag

SEQ ID NO: 617767 - RNA, 22 nt, Human
agugcaaaauucagaagcaauu

SEQ ID NO: 617768 - RNA, 20 nt, Human
aauuagauguuuaaucaaua

SEQ ID NO: 617769 - RNA, 22 nt, Human
gcaguguuaggaauaaaaauga

SEQ ID NO: 617770 - RNA, 21 nt, Human
ugccuuggcaaaugaccauga

SEQ ID NO: 617771 - RNA, 17 nt, Human
ggcaggugcggggccgc

SEQ ID NO: 617772 - RNA, 22 nt, Human
cugagggagaagucacgggcag

SEQ ID NO: 617773 - RNA, 22 nt, Human
uggagagcgcgacgggaggaag

SEQ ID NO: 617774 - RNA, 22 nt, Human
agccuucaguaaauccacugug

SEQ ID NO: 617775 - RNA, 22 nt, Human
ugcaaaaaggcagacuggugau

SEQ ID NO: 617776 - RNA, 22 nt, Human
agcgcaggaacacgucugccuu

SEQ ID NO: 617777 - RNA, 22 nt, Human
cagggcuugaaucaaggaaguc

SEQ ID NO: 617778 - RNA, 22 nt, Human
aagggcugagaaguggggcugg

SEQ ID NO: 617779 - RNA, 22 nt, Human
gggcuuuaggggccagugacca

SEQ ID NO: 617780 - RNA, 18 nt, Human
agggagagaccgcggguc

SEQ ID NO: 617781 - RNA, 21 nt, Human
cuccugggcuaagauauagug

SEQ ID NO: 617782 - RNA, 23 nt, Human
uggagaauguguuuacuucgugu

SEQ ID NO: 617783 - RNA, 22 nt, Human
agaagcaguuauuuuuugcaca

SEQ ID NO: 617784 - RNA, 22 nt, Human
uguguucauuuaacuguucuuu

SEQ ID NO: 617785 - RNA, 22 nt, Human
auggauaaucaugaacuuugag

SEQ ID NO: 617786 - RNA, 20 nt, Human
gaguccaggggccuguagca

SEQ ID NO: 617787 - RNA, 22 nt, Human
gggcaggagagaacagucaugg

SEQ ID NO: 617788 - RNA, 22 nt, Human
agcuggcuuugagcugggaggu

SEQ ID NO: 617789 - RNA, 22 nt, Human
gcaggcguguuucacgugccag

SEQ ID NO: 617790 - RNA, 22 nt, Human
cagcucugccucuggggcugag

SEQ ID NO: 617791 - RNA, 22 nt, Human
uccuguggaagacaguguuggg

SEQ ID NO: 617792 - RNA, 22 nt, Human
ccaguguucaguaugcauuaag

SEQ ID NO: 617793 - RNA, 22 nt, Human
cccuggaggagcuuagagcuug

SEQ ID NO: 617794 - RNA, 22 nt, Human
gagaagccgagucagcugagcc

SEQ ID NO: 617795 - RNA, 22 nt, Human
gguggggccugcuccagcggcc

SEQ ID NO: 617796 - RNA, 22 nt, Human
uuccugggcugcagagagcacc

SEQ ID NO: 617797 - RNA, 22 nt, Human
acaacaaagacacuugaaauga

SEQ ID NO: 617798 - RNA, 22 nt, Human
agacagcaugagccugcugaug

SEQ ID NO: 617799 - RNA, 22 nt, Human
cugcccuggccacugugcccag

SEQ ID NO: 617800 - RNA, 18 nt, Human
aggccucugugugcccag

SEQ ID NO: 617801 - RNA, 22 nt, Human
gucaugccagcggagcucggga

SEQ ID NO: 617802 - RNA, 22 nt, Human
ugaggcaggagaaucacaugaa

SEQ ID NO: 617803 - RNA, 22 nt, Human
gaagucauccacuaugggggag

SEQ ID NO: 617804 - RNA, 22 nt, Human
guuagaauaaaaggucagagag

SEQ ID NO: 617805 - RNA, 22 nt, Human
agaacaauguuaaauuauuaag

SEQ ID NO: 617806 - RNA, 22 nt, Human
gcuggggacuccccaccauagc

SEQ ID NO: 617807 - RNA, 22 nt, Human
ccacagcuagggcaaucugauu

SEQ ID NO: 617808 - RNA, 22 nt, Human
cugggccagcaacugcaaugga

SEQ ID NO: 617809 - RNA, 18 nt, Human
auccugggagcagacagc

SEQ ID NO: 617810 - RNA, 22 nt, Human
uccagaggcucugagggagagu

SEQ ID NO: 617811 - RNA, 22 nt, Human
cuaguagacagaaauguccagu

SEQ ID NO: 617812 - RNA, 22 nt, Human
uccacagcacaaagccagugug

SEQ ID NO: 617813 - RNA, 22 nt, Human
cagaaauaaacuucucacaucg

SEQ ID NO: 617814 - RNA, 22 nt, Human
acuccugggugcugaccagcgu

SEQ ID NO: 617815 - RNA, 22 nt, Human
ucaugccaauuucugcauggcu

SEQ ID NO: 617816 - RNA, 19 nt, Human
uuuacaaguucuuuguaug

SEQ ID NO: 617817 - RNA, 18 nt, Human
cugccccuucucugagau

SEQ ID NO: 617818 - RNA, 22 nt, Human
aaagacaguggauucaaaaucc

SEQ ID NO: 617819 - RNA, 22 nt, Human
accugccagcugagaagggugu

SEQ ID NO: 617820 - RNA, 22 nt, Human
cugcagagaugaagaagguggc

SEQ ID NO: 617821 - RNA, 22 nt, Human
ggccaccuccgugaaggaauga

SEQ ID NO: 617822 - RNA, 22 nt, Human
aggacugggugcagagggcauc

SEQ ID NO: 617823 - RNA, 22 nt, Human
auacaguauguaggcuuuucag

SEQ ID NO: 617824 - RNA, 22 nt, Human
gccucccuccaccacugcaggu

SEQ ID NO: 617825 - RNA, 21 nt, Human
ucuuuuaacaccaggaauucc

SEQ ID NO: 617826 - RNA, 22 nt, Human
aaggaaauacaacauguauuca

SEQ ID NO: 617827 - RNA, 22 nt, Human
ucauccaguucacauggugagu

SEQ ID NO: 617828 - RNA, 22 nt, Human
ugguccaggguguaguacagag

SEQ ID NO: 617829 - RNA, 22 nt, Human
agccagggucucucgcucuguu

SEQ ID NO: 617830 - RNA, 22 nt, Human
ccugaguggagggauucugcag

SEQ ID NO: 617831 - RNA, 22 nt, Human
uugauuuuuccagcuucuagag

SEQ ID NO: 617832 - RNA, 22 nt, Human
agggccuggaacuggagaccac

SEQ ID NO: 617833 - RNA, 22 nt, Human
uguuuugucuaaucuaaauucu

SEQ ID NO: 617834 - RNA, 22 nt, Human
aauguguucaguuaaaugaacu

SEQ ID NO: 617835 - RNA, 22 nt, Human
caggcaggagacauuugguugg

SEQ ID NO: 617836 - RNA, 22 nt, Human
gaagagaagguguaggccaucc

SEQ ID NO: 617837 - RNA, 22 nt, Human
gagagaaaaaugagcuucauug

SEQ ID NO: 617838 - RNA, 22 nt, Human
ggagguccaugugaauguggcc

SEQ ID NO: 617839 - RNA, 22 nt, Human
ccagugcaccaagaggccuaga

SEQ ID NO: 617840 - RNA, 22 nt, Human
ucuucaaaaauacagguuuuca

SEQ ID NO: 617841 - RNA, 22 nt, Human
ugggcuuugagcucggucaccu

SEQ ID NO: 617842 - RNA, 22 nt, Human
uccuggccgccgcguggggccg

SEQ ID NO: 617843 - RNA, 22 nt, Human
uccaggcaaagggacuagcagg

SEQ ID NO: 617844 - RNA, 22 nt, Human
uuucaggauuaguuuaagcagg

SEQ ID NO: 617845 - RNA, 22 nt, Human
uagaagaacaugucaaacuaua

SEQ ID NO: 617846 - RNA, 22 nt, Human
ugucagugaguuggguccugag

SEQ ID NO: 617847 - RNA, 20 nt, Human
aaagcaguaugcaaguagag

SEQ ID NO: 617848 - RNA, 22 nt, Human
aaggccugggaggccucucuuc

SEQ ID NO: 617849 - RNA, 22 nt, Human
caggcucacuguaaggucagcu

SEQ ID NO: 617850 - RNA, 22 nt, Human
uccacagugguugaacuaguaa

SEQ ID NO: 617851 - RNA, 22 nt, Human
guuuuuuggguguauaucuucu

SEQ ID NO: 617852 - RNA, 23 nt, Human
uccagccucuugcucucacaugc

SEQ ID NO: 617853 - RNA, 23 nt, Human
uaauuagauguugauuccugaga

SEQ ID NO: 617854 - RNA, 22 nt, Human
agugucugaaccugcaguggga

SEQ ID NO: 617855 - RNA, 22 nt, Human
uccagagccugcgcacuggcug

SEQ ID NO: 617856 - RNA, 23 nt, Human
gggcagguuuuuauaggcuucag

SEQ ID NO: 617857 - RNA, 22 nt, Human
augugcaggauccaggcuccua

SEQ ID NO: 617858 - RNA, 22 nt, Human
auuuauuaccucggaguuucug

SEQ ID NO: 617859 - RNA, 22 nt, Human
gggaguccaaauugguacaaua

SEQ ID NO: 617860 - RNA, 22 nt, Human
aggcagaaccagcugggacuuu

SEQ ID NO: 617861 - RNA, 22 nt, Human
agucugucuaauauuauucagg

SEQ ID NO: 617862 - RNA, 22 nt, Human
ucaguguuuacaugcauccuug

SEQ ID NO: 617863 - RNA, 22 nt, Human
aguuuuguaauucucaaaaaua

SEQ ID NO: 617864 - RNA, 22 nt, Human
ucugggugcccuuugcucuguu

SEQ ID NO: 617865 - RNA, 18 nt, Human
ugguccaguucagauaua

SEQ ID NO: 617866 - RNA, 22 nt, Human
uggcaggugaaguuguuaggga

SEQ ID NO: 617867 - RNA, 22 nt, Human
uuugcuauaaaagggucacacg

SEQ ID NO: 617868 - RNA, 22 nt, Human
gaaugcuacuugacucagcuca

SEQ ID NO: 617869 - RNA, 18 nt, Human
ucagucuauuguauaaga

SEQ ID NO: 617870 - RNA, 22 nt, Human
agguacagaugaaagucuaguu

SEQ ID NO: 617871 - RNA, 22 nt, Human
gcuggccucgcaggcaggaugu

SEQ ID NO: 617872 - RNA, 22 nt, Human
ucucagcucuuuuuucacagaa

SEQ ID NO: 617873 - RNA, 22 nt, Human
aauccuggcugcguuggccagc

SEQ ID NO: 617874 - RNA, 22 nt, Human
gacucugugggaggaggcucag

SEQ ID NO: 617875 - RNA, 22 nt, Human
gagugcaauaaacuguuuucua

SEQ ID NO: 617876 - RNA, 22 nt, Human
gaggcacugcugggccccugua

SEQ ID NO: 617877 - RNA, 22 nt, Human
aaacagcucaagaaguuacucu

SEQ ID NO: 617878 - RNA, 22 nt, Human
guuguugaucacaugcauaucu

SEQ ID NO: 617879 - RNA, 22 nt, Human
ggucucagcccucgccagcagc

SEQ ID NO: 617880 - RNA, 22 nt, Human
ugaguagacgugaucuaguaac

SEQ ID NO: 617881 - RNA, 22 nt, Human
ggggaucuaggauauuucauga

SEQ ID NO: 617882 - RNA, 22 nt, Human
uagcagaggcuacugcuccuug

SEQ ID NO: 617883 - RNA, 22 nt, Human
uugcauuuuuagaugcuucugu

SEQ ID NO: 617884 - RNA, 22 nt, Human
uggagaaugauauuccaucauu

SEQ ID NO: 617885 - RNA, 22 nt, Human
gcuggcugccuuacuuugugga

SEQ ID NO: 617886 - RNA, 22 nt, Human
ucuguggcugugcugggccaga

SEQ ID NO: 617887 - RNA, 22 nt, Human
cuccaggggccagaagccuggc

SEQ ID NO: 617888 - RNA, 22 nt, Human
uccugggccaagggcugugagg

SEQ ID NO: 617889 - RNA, 22 nt, Human
caaguauauuugaacauguaaa

SEQ ID NO: 617890 - RNA, 22 nt, Human
ccagcaggguugguuucuucug

SEQ ID NO: 617891 - RNA, 22 nt, Human
gaauauuuuuaaagggacuaau

SEQ ID NO: 617892 - RNA, 22 nt, Human
agccagggauggcagugcccag

SEQ ID NO: 617893 - RNA, 22 nt, Human
agccagggcugcgagcagacag

SEQ ID NO: 617894 - RNA, 22 nt, Human
agaacaaugcguauuuuacucc

SEQ ID NO: 617895 - RNA, 22 nt, Human
aaaaggcucuucaaaauggaag

SEQ ID NO: 617896 - RNA, 22 nt, Human
aauaugcaaagcguguuaucug

SEQ ID NO: 617897 - RNA, 17 nt, Human
ugccagccugucccagg

SEQ ID NO: 617898 - RNA, 22 nt, Human
aggugacaucccggcagcagag

SEQ ID NO: 617899 - RNA, 22 nt, Human
gugugagagaagcugccaugga

SEQ ID NO: 617900 - RNA, 22 nt, Human
gcuggcuugauaguuucugcuu

SEQ ID NO: 617901 - RNA, 22 nt, Human
uagugcaauuccccauacuaac

SEQ ID NO: 617902 - RNA, 22 nt, Human
gauuucuucucucccaagagga

SEQ ID NO: 617903 - RNA, 22 nt, Human
auauguguguauuucuuacuag

SEQ ID NO: 617904 - RNA, 22 nt, Human
ccagcaggagaugccugugucu

SEQ ID NO: 617905 - RNA, 22 nt, Human
uuggcauucaugggacaacaaa

SEQ ID NO: 617906 - RNA, 22 nt, Human
guccagggggcuuaagcaaacu

SEQ ID NO: 617907 - RNA, 22 nt, Human
augcccuggggcuaccucugag

SEQ ID NO: 617908 - RNA, 22 nt, Human
acauuucuaauuuaauguaaca

SEQ ID NO: 617909 - RNA, 22 nt, Human
ggagaggugaauggcugcucua

SEQ ID NO: 617910 - RNA, 22 nt, Human
cuguggccccacccucuuggcc

SEQ ID NO: 617911 - RNA, 22 nt, Human
uccagggaaggugugaggcugg

SEQ ID NO: 617912 - RNA, 22 nt, Human
aagcagaguccccuucccaugg

SEQ ID NO: 617913 - RNA, 22 nt, Human
aaagccuucugucuagcagaua

SEQ ID NO: 617914 - RNA, 22 nt, Human
uccagggcuugacagggugccu

SEQ ID NO: 617915 - RNA, 22 nt, Human
aggcagguuucccggcugucaa

SEQ ID NO: 617916 - RNA, 22 nt, Human
aggaaagguagcgugccagcag

SEQ ID NO: 617917 - RNA, 22 nt, Human
agaauguguuuuaacaugggaa

SEQ ID NO: 617918 - RNA, 22 nt, Human
ucuguggcccaagugauggcug

SEQ ID NO: 617919 - RNA, 22 nt, Human
gcccuggccuucaucucagaca

SEQ ID NO: 617920 - RNA, 22 nt, Human
auguggcucagcaggcucccgu

SEQ ID NO: 617921 - RNA, 22 nt, Human
cugcaaaaguaauuggggcuuu

SEQ ID NO: 617922 - RNA, 22 nt, Human
cauugaaauauggaaacugaug

SEQ ID NO: 617923 - RNA, 22 nt, Human
ggagaagggcaugguaguuuua

SEQ ID NO: 617924 - RNA, 22 nt, Human
uaggcacaaaaugaaaauggca

SEQ ID NO: 617925 - RNA, 16 nt, Human
uccuggccuuuggaag

SEQ ID NO: 617926 - RNA, 22 nt, Human
ugcaggucauguggcgggacug

SEQ ID NO: 617927 - RNA, 22 nt, Human
gcaggucccagaaaguuaauuc

SEQ ID NO: 617928 - RNA, 22 nt, Human
ugggccagcugaagugccgccc

SEQ ID NO: 617929 - RNA, 22 nt, Human
agcaggaggguuuuguagaguc

SEQ ID NO: 617930 - RNA, 22 nt, Human
agccuugcaugauuucauucau

SEQ ID NO: 617931 - RNA, 22 nt, Human
auccagcuuugucuggucuucg

SEQ ID NO: 617932 - RNA, 22 nt, Human
agagcggggauaguuaauauuc

SEQ ID NO: 617933 - RNA, 22 nt, Human
agguccagccugcccucucucc

SEQ ID NO: 617934 - RNA, 22 nt, Human
uccaaagacuugcuguauguaa

SEQ ID NO: 617935 - RNA, 22 nt, Human
uuacaagauuaauuauuggagu

SEQ ID NO: 617936 - RNA, 22 nt, Human
uccagggccccccaguugcacg

SEQ ID NO: 617937 - RNA, 22 nt, Human
uggaaucuugcgggcacauggc

SEQ ID NO: 617938 - RNA, 22 nt, Human
aaggcaggagcuguaucuuauu

SEQ ID NO: 617939 - RNA, 22 nt, Human
aaauuagaccagggcuccugga

SEQ ID NO: 617940 - RNA, 22 nt, Human
gccaggagaaugcuagcagagg

SEQ ID NO: 617941 - RNA, 22 nt, Human
augcagaaggagccaugcuugc

SEQ ID NO: 617942 - RNA, 20 nt, Human
uagguccaaugcucgucuuc

SEQ ID NO: 617943 - RNA, 22 nt, Human
uggaaggggccaggcgcggagu

SEQ ID NO: 617944 - RNA, 22 nt, Human
ugcaggagagugagucaguagg

SEQ ID NO: 617945 - RNA, 22 nt, Human
ccagggcauguaacuaauggug

SEQ ID NO: 617946 - RNA, 22 nt, Human
acacauaagccuaaucaucucc

SEQ ID NO: 617947 - RNA, 22 nt, Human
uuccuguggccuuacaucugug

SEQ ID NO: 617948 - RNA, 22 nt, Human
uaggccauugauuuuuauaagu

SEQ ID NO: 617949 - RNA, 22 nt, Human
caguccugggcaggucaggcca

SEQ ID NO: 617950 - RNA, 22 nt, Human
gccucuggggcagcugagucau

SEQ ID NO: 617951 - RNA, 22 nt, Human
uuucagagaggcuucaaaucuu

SEQ ID NO: 617952 - RNA, 22 nt, Human
uauauacaagguagguuuaggu

SEQ ID NO: 617953 - RNA, 22 nt, Human
auguccaggaagucuuaacuca

SEQ ID NO: 617954 - RNA, 22 nt, Human
guuucucacuuccaguagccaa

SEQ ID NO: 617955 - RNA, 22 nt, Human
agccaggccagcugucuugagu

SEQ ID NO: 617956 - RNA, 22 nt, Human
uagguucagcuuccacugccua

SEQ ID NO: 617957 - RNA, 20 nt, Human
agggccuggaguacagcagg

SEQ ID NO: 617958 - RNA, 22 nt, Human
aauuacagucggagcagcacug

SEQ ID NO: 617959 - RNA, 22 nt, Human
aaagccuuugucucaggcucug

SEQ ID NO: 617960 - RNA, 22 nt, Human
ucagcagggccuccuugugcag

SEQ ID NO: 617961 - RNA, 22 nt, Human
uccuguuucuccugcaaaaucc

SEQ ID NO: 617962 - RNA, 22 nt, Human
cucuuaaaaacuugauauauuu

SEQ ID NO: 617963 - RNA, 22 nt, Human
agcuggaacccgggugggcagc

SEQ ID NO: 617964 - RNA, 21 nt, Human
uucugccuucgaggucucagg

SEQ ID NO: 617965 - RNA, 22 nt, Human
ucuuggaaucuccauagaguga

SEQ ID NO: 617966 - RNA, 22 nt, Human
ugccaccuggacaaccuuaugc

SEQ ID NO: 617967 - RNA, 22 nt, Human
uggcaggucaugaguggccacc

SEQ ID NO: 617968 - RNA, 22 nt, Human
agcugcugagccauguccugcu

SEQ ID NO: 617969 - RNA, 22 nt, Human
auccccaggggcauucaagcuu

SEQ ID NO: 617970 - RNA, 19 nt, Human
uuucaaagggcauaagccu

SEQ ID NO: 617971 - RNA, 21 nt, Human
gacaaagugaagcaggcagga

SEQ ID NO: 617972 - RNA, 22 nt, Human
cccagccuuccacccuggacua

SEQ ID NO: 617973 - RNA, 22 nt, Human
aaacucuggagauguuuaugca

SEQ ID NO: 617974 - RNA, 22 nt, Human
ggaggccaguccuggccgggcu

SEQ ID NO: 617975 - RNA, 20 nt, Human
uuccuggggaaugauagaag

SEQ ID NO: 617976 - RNA, 22 nt, Human
gccucugcugcaagccugguug

SEQ ID NO: 617977 - RNA, 22 nt, Human
agcugaagcucagcccaguagu

SEQ ID NO: 617978 - RNA, 22 nt, Human
agaaagaggaugcagaucucau

SEQ ID NO: 617979 - RNA, 22 nt, Human
gggaugagagcugggacagaag

SEQ ID NO: 617980 - RNA, 22 nt, Human
ucauccaguaugacuggugucu

SEQ ID NO: 617981 - RNA, 22 nt, Human
uugccacuaacuagcugugaga

SEQ ID NO: 617982 - RNA, 22 nt, Human
cugccacuagcuuucacaucuu

SEQ ID NO: 617983 - RNA, 22 nt, Human
ucagcuuuugucagaaauugua

SEQ ID NO: 617984 - RNA, 22 nt, Human
ugaccacugaauaugacugccu

SEQ ID NO: 617985 - RNA, 19 nt, Human
ucaugcaguggggggugug

SEQ ID NO: 617986 - RNA, 20 nt, Human
uggaaggcaucugcauuauu

SEQ ID NO: 617987 - RNA, 23 nt, Human
uggagaauuuagagucucuagga

SEQ ID NO: 617988 - RNA, 22 nt, Human
ugagucuucuuccgggauugcu

SEQ ID NO: 617989 - RNA, 18 nt, Human
agaagcagguucucccag

SEQ ID NO: 617990 - RNA, 22 nt, Human
cuguggcuucagcauucagagc

SEQ ID NO: 617991 - RNA, 22 nt, Human
uauuucugauugcucaugaggc

SEQ ID NO: 617992 - RNA, 22 nt, Human
ggcaguucucagccaaggcaau

SEQ ID NO: 617993 - RNA, 22 nt, Human
uucuggcuguaugauauuuaau

SEQ ID NO: 617994 - RNA, 22 nt, Human
ggagaaggguauguguggcgga

SEQ ID NO: 617995 - RNA, 22 nt, Human
cuggguuuagggucuccccuug

SEQ ID NO: 617996 - RNA, 22 nt, Human
uggaaggagcuaaggaccuggg

SEQ ID NO: 617997 - RNA, 22 nt, Human
ugaggcaguauucuccauucca

SEQ ID NO: 617998 - RNA, 22 nt, Human
aaaauggcuuaauaggcaauaa

SEQ ID NO: 617999 - RNA, 22 nt, Human
cauaaauuguacccauuccaac

SEQ ID NO: 618000 - RNA, 23 nt, Human
ugacaaagcgagacuccagcuca

SEQ ID NO: 618001 - RNA, 22 nt, Human
uagguccacagauuugguuucu

SEQ ID NO: 618002 - RNA, 20 nt, Human
accugccacagagaaaggua

SEQ ID NO: 618003 - RNA, 22 nt, Human
ggccugagcuugggcagcguau

SEQ ID NO: 618004 - RNA, 22 nt, Human
agcaaguaguaccaaguagcuc

SEQ ID NO: 618005 - RNA, 22 nt, Human
aggcagguuuacucuuauuugg

SEQ ID NO: 618006 - RNA, 22 nt, Human
cuggaaggucuguccccacugc

SEQ ID NO: 618007 - RNA, 22 nt, Human
auccaggguguggagagagcuc

SEQ ID NO: 618008 - RNA, 21 nt, Human
uuccuggggacuuccguggga

SEQ ID NO: 618009 - RNA, 22 nt, Human
augugcagaggcuuccuugacu

SEQ ID NO: 618010 - RNA, 22 nt, Human
accuucaauuauuuuuguucca

SEQ ID NO: 618011 - RNA, 22 nt, Human
cauggccaggcccagggcccag

SEQ ID NO: 618012 - RNA, 22 nt, Human
gaggaaggcuaaggggcuuaga

SEQ ID NO: 618013 - RNA, 22 nt, Human
ugcuccugcugcaugcaucucc

SEQ ID NO: 618014 - RNA, 22 nt, Human
uuagaaaaauguucaguaguuu

SEQ ID NO: 618015 - RNA, 22 nt, Human
acauguguggacaugaaucuac

SEQ ID NO: 618016 - RNA, 22 nt, Human
uacagugucccuuuuucagaca

SEQ ID NO: 618017 - RNA, 22 nt, Human
gccaccuggacagcugugcccu

SEQ ID NO: 618018 - RNA, 23 nt, Human
ucuguggccccuucgccccacuc

SEQ ID NO: 618019 - RNA, 22 nt, Human
guccagagaggcaggaggcuac

SEQ ID NO: 618020 - RNA, 22 nt, Human
gcaguguugugauccaggucuu

SEQ ID NO: 618021 - RNA, 22 nt, Human
gccaggcugcuggcugcugucc

SEQ ID NO: 618022 - RNA, 22 nt, Human
uccugcagguggaugauucucu

SEQ ID NO: 618023 - RNA, 22 nt, Human
cugaggacauugaugaggcaau

SEQ ID NO: 618024 - RNA, 22 nt, Human
uugcauuucacuuucaguaggc

SEQ ID NO: 618025 - RNA, 22 nt, Human
ggcccugagcugaaguacugug

SEQ ID NO: 618026 - RNA, 22 nt, Human
acaaguaggugcacuucaauag

SEQ ID NO: 618027 - RNA, 22 nt, Human
cuggagucagcaaggacgaggc

SEQ ID NO: 618028 - RNA, 22 nt, Human
ccugaggacacacgcugcagga

SEQ ID NO: 618029 - RNA, 22 nt, Human
cagccaagaaagcagugcucca

SEQ ID NO: 618030 - RNA, 19 nt, Human
uggagguccaggaguaggg

SEQ ID NO: 618031 - RNA, 22 nt, Human
uccuggccuugcgucuugggag

SEQ ID NO: 618032 - RNA, 22 nt, Human
acauuucucuugaugucucuau

SEQ ID NO: 618033 - RNA, 22 nt, Human
caaugucaaggagaccaaaacg

SEQ ID NO: 618034 - RNA, 22 nt, Human
ugcuuccuugaucauucccaaa

SEQ ID NO: 618035 - RNA, 22 nt, Human
gcaguguuucccagagauggaa

SEQ ID NO: 618036 - RNA, 22 nt, Human
agggcuggaggguacuaguuua

SEQ ID NO: 618037 - RNA, 22 nt, Human
uaccaaguguauuaugcuuugu

SEQ ID NO: 618038 - RNA, 22 nt, Human
aggcaggugagucaaaacagac

SEQ ID NO: 618039 - RNA, 22 nt, Human
uccuggcccuguggccugcagu

SEQ ID NO: 618040 - RNA, 17 nt, Human
ggacacagcucauggcu

SEQ ID NO: 618041 - RNA, 22 nt, Human
cuggcugugcugacugagaggg

SEQ ID NO: 618042 - RNA, 22 nt, Human
ucugggaguuagaauacauggg

SEQ ID NO: 618043 - RNA, 22 nt, Human
cuggcccucgucaguuucacug

SEQ ID NO: 618044 - RNA, 22 nt, Human
gucuuuuuuacaccuuacauca

SEQ ID NO: 618045 - RNA, 22 nt, Human
cuggcucccucucccugaguca

SEQ ID NO: 618046 - RNA, 22 nt, Human
cuccucuggaaauuccucugcc

SEQ ID NO: 618047 - RNA, 22 nt, Human
ggagggggacugacacugauuu

SEQ ID NO: 618048 - RNA, 22 nt, Human
ugugugaggacucagugaaaca

SEQ ID NO: 618049 - RNA, 20 nt, Human
ucucuggguucucacucagc

SEQ ID NO: 618050 - RNA, 22 nt, Human
guggcuuuauaggaagaggaac

SEQ ID NO: 618051 - RNA, 20 nt, Human
gggaggcauuggucccucac

SEQ ID NO: 618052 - RNA, 22 nt, Human
guccuggugccaccugcgggau

SEQ ID NO: 618053 - RNA, 22 nt, Human
ccaggcuuucccagccucucca

SEQ ID NO: 618054 - RNA, 19 nt, Human
cuggaaggagggacuguuc

SEQ ID NO: 618055 - RNA, 20 nt, Human
cagguccagcacgugcacgg

SEQ ID NO: 618056 - RNA, 22 nt, Human
auguccagggggcuugacuggu

SEQ ID NO: 618057 - RNA, 22 nt, Human
uggcucuggccaccgggagggc

SEQ ID NO: 618058 - RNA, 21 nt, Human
cuggagucuggggguggcagu

SEQ ID NO: 618059 - RNA, 22 nt, Human
ugggcaggggcccugcuuccgu

SEQ ID NO: 618060 - RNA, 23 nt, Human
ucccagccucuucucuugcauac

SEQ ID NO: 618061 - RNA, 22 nt, Human
ccugguguugccaaucugugcc

SEQ ID NO: 618062 - RNA, 22 nt, Human
agcugauuccacuuuuucccca

SEQ ID NO: 618063 - RNA, 22 nt, Human
acauuucuggaguuucucaaca

SEQ ID NO: 618064 - RNA, 22 nt, Human
cugccaggugagcuccaggccu

SEQ ID NO: 618065 - RNA, 22 nt, Human
aggcauggauguagcagugacc

SEQ ID NO: 618066 - RNA, 21 nt, Human
ugggagagcguugcuguccuc

SEQ ID NO: 618067 - RNA, 23 nt, Human
agccuucaggcaaugucaguaga

SEQ ID NO: 618068 - RNA, 22 nt, Human
ugaggcagcaauuguauuguau

SEQ ID NO: 618069 - RNA, 22 nt, Human
aaaguacaugcaauucuucuga

SEQ ID NO: 618070 - RNA, 22 nt, Human
ggcuuccuggagaaggucugag

SEQ ID NO: 618071 - RNA, 22 nt, Human
ucuggaguguguguauucagcu

SEQ ID NO: 618072 - RNA, 22 nt, Human
ugcauaucuucaaugcuguugc

SEQ ID NO: 618073 - RNA, 22 nt, Human
uuauuuaaaagugguaagauuc

SEQ ID NO: 618074 - RNA, 22 nt, Human
agaggcuggauugagcauagac

SEQ ID NO: 618075 - RNA, 22 nt, Human
aaccaugcuagcaucaaaaugu

SEQ ID NO: 618076 - RNA, 22 nt, Human
agaggcagcagucauacuacag

SEQ ID NO: 618077 - RNA, 22 nt, Human
acacuagcuaaaugcugauuaa

SEQ ID NO: 618078 - RNA, 22 nt, Human
ggcgcucaguguugccccagag

SEQ ID NO: 618079 - RNA, 22 nt, Human
aguaaauaacagagaaaauggg

SEQ ID NO: 618080 - RNA, 22 nt, Human
cuggcccuguaggaugugaguu

SEQ ID NO: 618081 - RNA, 22 nt, Human
caaauagacucuagaauuuauu

SEQ ID NO: 618082 - RNA, 22 nt, Human
cauggccacauuggaccgaagc

SEQ ID NO: 618083 - RNA, 22 nt, Human
ugggcucucaaagugcggcuug

SEQ ID NO: 618084 - RNA, 22 nt, Human
gaagggggagcucuuccuaauu

SEQ ID NO: 618085 - RNA, 22 nt, Human
ccagggaaaggagguugacuug

SEQ ID NO: 618086 - RNA, 22 nt, Human
auccucgucugcacaucaaagg

SEQ ID NO: 618087 - RNA, 22 nt, Human
uucaaacacagacagcagcaug

SEQ ID NO: 618088 - RNA, 21 nt, Human
gccagccuguuuaccuguggu

SEQ ID NO: 618089 - RNA, 17 nt, Human
ccuguguuugcuccuuc

SEQ ID NO: 618090 - RNA, 22 nt, Human
caggaaagaaaugagaacacca

SEQ ID NO: 618091 - RNA, 22 nt, Human
caggcaaggagcuggcucaagu

SEQ ID NO: 618092 - RNA, 22 nt, Human
accugggaguaugcagugguga

SEQ ID NO: 618093 - RNA, 22 nt, Human
ugugugugaguccuggcuuucc

SEQ ID NO: 618094 - RNA, 22 nt, Human
cagggaugucucuggaagggag

SEQ ID NO: 618095 - RNA, 22 nt, Human
uugaaggugacauaucuggagc

SEQ ID NO: 618096 - RNA, 22 nt, Human
uugcccuguggggccuccagcc

SEQ ID NO: 618097 - RNA, 22 nt, Human
agaagccagaggcaguggguac

SEQ ID NO: 618098 - RNA, 22 nt, Human
auuguugauaaucguguuguca

SEQ ID NO: 618099 - RNA, 22 nt, Human
aggcauggcauggggcagaugu

SEQ ID NO: 618100 - RNA, 22 nt, Human
uauacaggaacuguuggcuccc

SEQ ID NO: 618101 - RNA, 22 nt, Human
aaguaugucaaucauacuucaa

SEQ ID NO: 618102 - RNA, 22 nt, Human
guaaacauuacugugcuguaua

SEQ ID NO: 618103 - RNA, 22 nt, Human
auauguguauggauuucuaucu

SEQ ID NO: 618104 - RNA, 22 nt, Human
uagaaagaacuucauguaaaac

SEQ ID NO: 618105 - RNA, 22 nt, Human
aagguccacaacugguaaaugg

SEQ ID NO: 618106 - RNA, 22 nt, Human
ccagggcaacgcugucucagag

SEQ ID NO: 618107 - RNA, 22 nt, Human
cugaggcugcccagggccaggu

SEQ ID NO: 618108 - RNA, 23 nt, Human
agcuuuaacccuuucaggagcau

SEQ ID NO: 618109 - RNA, 22 nt, Human
auauacaggugguauguguaaa

SEQ ID NO: 618110 - RNA, 22 nt, Human
gagaaagaaagggaaguuuguu

SEQ ID NO: 618111 - RNA, 22 nt, Human
auacucaauuuguuggaaagca

SEQ ID NO: 618112 - RNA, 22 nt, Human
uccugggagcccuugcuccacc

SEQ ID NO: 618113 - RNA, 22 nt, Human
aguagaauguucuaugucaaug

SEQ ID NO: 618114 - RNA, 22 nt, Human
auuuguuguugcuccccuaaga

SEQ ID NO: 618115 - RNA, 22 nt, Human
cugugccugccuuguucacuga

SEQ ID NO: 618116 - RNA, 21 nt, Human
gggccuggcugcgcaggacgg

SEQ ID NO: 618117 - RNA, 22 nt, Human
cugggcucaccuguggcuggca

SEQ ID NO: 618118 - RNA, 22 nt, Human
ucugcagcuuacuuucacauga

SEQ ID NO: 618119 - RNA, 22 nt, Human
ugcucaucaacaugaugaucau

SEQ ID NO: 618120 - RNA, 22 nt, Human
gcugaggcuccucgggaggaca

SEQ ID NO: 618121 - RNA, 22 nt, Human
uuccacauuccuuacauucaua

SEQ ID NO: 618122 - RNA, 22 nt, Human
uggcaggggaggugcuugcuua

SEQ ID NO: 618123 - RNA, 18 nt, Human
gcuuuauuucuuggggaa

SEQ ID NO: 618124 - RNA, 22 nt, Human
uagucccggaacuccuucaggu

SEQ ID NO: 618125 - RNA, 22 nt, Human
ggagaggguagggguccugccc

SEQ ID NO: 618126 - RNA, 22 nt, Human
gggcaggagagggccaccugga

SEQ ID NO: 618127 - RNA, 22 nt, Human
gccagccuucuguggccugcaa

SEQ ID NO: 618128 - RNA, 22 nt, Human
aauucaaucuguagauugugau

SEQ ID NO: 618129 - RNA, 22 nt, Human
uguguuuauaguguaucuucca

SEQ ID NO: 618130 - RNA, 22 nt, Human
uaaaguuauaaauuaccuguca

SEQ ID NO: 618131 - RNA, 22 nt, Human
ccugcagguugcagaggcggaa

SEQ ID NO: 618132 - RNA, 22 nt, Human
cagggcaaguuugagauuauuu

SEQ ID NO: 618133 - RNA, 22 nt, Human
uccagggaccucccugagagcu

SEQ ID NO: 618134 - RNA, 22 nt, Human
ugagaaugaggggguagaaggu

SEQ ID NO: 618135 - RNA, 22 nt, Human
gucugcucaugcuaccgcgggc

SEQ ID NO: 618136 - RNA, 23 nt, Human
aaagcaaggaauuggcaacagag

SEQ ID NO: 618137 - RNA, 22 nt, Human
cagccuucaaggcuuagcucag

SEQ ID NO: 618138 - RNA, 22 nt, Human
uuuuuacacuuagcauugagcg

SEQ ID NO: 618139 - RNA, 22 nt, Human
cagugcaauuacaagcuaauuc

SEQ ID NO: 618140 - RNA, 22 nt, Human
cucauggagggagugcucuucc

SEQ ID NO: 618141 - RNA, 22 nt, Human
cuuccuugcggccccugccuag

SEQ ID NO: 618142 - RNA, 22 nt, Human
accuguuuagaaagcuuaugag

SEQ ID NO: 618143 - RNA, 22 nt, Human
guggcucuugcauggggucucu

SEQ ID NO: 618144 - RNA, 22 nt, Human
uccagccacguauuaucucacu

SEQ ID NO: 618145 - RNA, 22 nt, Human
ggaagggccucgggcgugggac

SEQ ID NO: 618146 - RNA, 22 nt, Human
aggaccaggucuaaugaagaca

SEQ ID NO: 618147 - RNA, 22 nt, Human
aggggcaggugcugcacuuaga

SEQ ID NO: 618148 - RNA, 22 nt, Human
aaaguccagggaaagagcgucu

SEQ ID NO: 618149 - RNA, 22 nt, Human
cccugugucuucuugccuuugu

SEQ ID NO: 618150 - RNA, 22 nt, Human
ucagcaggggccguugggugga

SEQ ID NO: 618151 - RNA, 22 nt, Human
gagcucauucauucauugccug

SEQ ID NO: 618152 - RNA, 22 nt, Human
uggaagggaacagguggguguu

SEQ ID NO: 618153 - RNA, 22 nt, Human
cccugcagagaccacugaccuu

SEQ ID NO: 618154 - RNA, 22 nt, Human
cccugcagggaggauucugaag

SEQ ID NO: 618155 - RNA, 22 nt, Human
acuguggccaaagccucuggga

SEQ ID NO: 618156 - RNA, 22 nt, Human
gggcagguuauuggaguaggga

SEQ ID NO: 618157 - RNA, 22 nt, Human
gugcagggcagccgaaugggcu

SEQ ID NO: 618158 - RNA, 18 nt, Human
uccugcagcuucuaugua

SEQ ID NO: 618159 - RNA, 22 nt, Human
cagguccuuuaguguccagaac

SEQ ID NO: 618160 - RNA, 22 nt, Human
uuaggaaaggguuuucuaacag

SEQ ID NO: 618161 - RNA, 22 nt, Human
agagucugauauuuguaccaga

SEQ ID NO: 618162 - RNA, 22 nt, Human
gcagcucccaucagggcacaga

SEQ ID NO: 618163 - RNA, 19 nt, Human
ugguccagcuucuucuccu

SEQ ID NO: 618164 - RNA, 22 nt, Human
cuugaauccaaaugggagauga

SEQ ID NO: 618165 - RNA, 21 nt, Human
cucuuuguggcaauguauuuu

SEQ ID NO: 618166 - RNA, 22 nt, Human
aggcuuuaauuaucuacaggag

SEQ ID NO: 618167 - RNA, 22 nt, Human
ccugaccacccuuggacaaggu

SEQ ID NO: 618168 - RNA, 22 nt, Human
acucagcucaggagcuggcugg

SEQ ID NO: 618169 - RNA, 23 nt, Human
ggguccagccaauuccaaggaaa

SEQ ID NO: 618170 - RNA, 22 nt, Human
gcuggggagcaagaguagugag

SEQ ID NO: 618171 - RNA, 22 nt, Human
cagggaugcugcuuaggcaguu

SEQ ID NO: 618172 - RNA, 19 nt, Human
gucccugggcagaggcacc

SEQ ID NO: 618173 - RNA, 22 nt, Human
uaggauaggauggagacagaau

SEQ ID NO: 618174 - RNA, 22 nt, Human
ugggcagggagcuggaaccaca

SEQ ID NO: 618175 - RNA, 22 nt, Human
aacaaagaugggugggaaagag

SEQ ID NO: 618176 - RNA, 22 nt, Human
uaaagacaugguguaggugaac

SEQ ID NO: 618177 - RNA, 22 nt, Human
acaacaaaaucacuagucuucc

SEQ ID NO: 618178 - RNA, 22 nt, Human
cagguccuggcaucaggcaggu

SEQ ID NO: 618179 - RNA, 22 nt, Human
gaggcacucucgacaagggugg

SEQ ID NO: 618180 - RNA, 22 nt, Human
cccagugucugggccugcaggg

SEQ ID NO: 618181 - RNA, 22 nt, Human
aguagauuuuagauuacauagu

SEQ ID NO: 618182 - RNA, 22 nt, Human
gccugccuuuguaugacccuga

SEQ ID NO: 618183 - RNA, 21 nt, Human
uguccaagguaugcacugggg

SEQ ID NO: 618184 - RNA, 23 nt, Human
uccuggguuugaauucuagucuu

SEQ ID NO: 618185 - RNA, 22 nt, Human
acuguuuucuuagcucccugcu

SEQ ID NO: 618186 - RNA, 22 nt, Human
uugucugaaaagguaaauauuu

SEQ ID NO: 618187 - RNA, 22 nt, Human
aauaugcauuaacuguguacau

SEQ ID NO: 618188 - RNA, 23 nt, Human
agguccuggacauaugugcauca

SEQ ID NO: 618189 - RNA, 22 nt, Human
cagggauggcugucaggaugua

SEQ ID NO: 618190 - RNA, 21 nt, Human
uuuauuuauauaggacacaug

SEQ ID NO: 618191 - RNA, 22 nt, Human
uguuuucuguguagagaucaca

SEQ ID NO: 618192 - RNA, 22 nt, Human
gcuuccuagcauuagccauugc

SEQ ID NO: 618193 - RNA, 20 nt, Human
caugccugcugguaucuggc

SEQ ID NO: 618194 - RNA, 22 nt, Human
ggaaagcuuuguacuugaaaac

SEQ ID NO: 618195 - RNA, 22 nt, Human
agggagagacauuuccuucuug

SEQ ID NO: 618196 - RNA, 20 nt, Human
gcuuccaccugaagcgcacc

SEQ ID NO: 618197 - RNA, 23 nt, Human
agcauaaaccucuguggcuuuag

SEQ ID NO: 618198 - RNA, 22 nt, Human
gcagagucagguccaaggacug

SEQ ID NO: 618199 - RNA, 21 nt, Human
agaggcaggcauuaaguacac

SEQ ID NO: 618200 - RNA, 22 nt, Human
agcagggacuacgugaaaguga

SEQ ID NO: 618201 - RNA, 22 nt, Human
gccgagcacagugcagcugccu

SEQ ID NO: 618202 - RNA, 22 nt, Human
uagaaagagcuuugcuuccuuu

SEQ ID NO: 618203 - RNA, 22 nt, Human
agccaggggauucaucagggac

SEQ ID NO: 618204 - RNA, 22 nt, Human
ugugaagcuggauccuggagcu

SEQ ID NO: 618205 - RNA, 22 nt, Human
gauuuacagaucuaagggucac

SEQ ID NO: 618206 - RNA, 20 nt, Human
aaaauauguauaacucuucu

SEQ ID NO: 618207 - RNA, 22 nt, Human
uuuguauuuuucccagcuagcu

SEQ ID NO: 618208 - RNA, 22 nt, Human
uaaagugucugccucagcucag

SEQ ID NO: 618209 - RNA, 22 nt, Human
gccagcuggcugcaggucccag

SEQ ID NO: 618210 - RNA, 22 nt, Human
ugggaagggccgauggagccuc

SEQ ID NO: 618211 - RNA, 22 nt, Human
guguccagggcuggaagugagg

SEQ ID NO: 618212 - RNA, 22 nt, Human
acaugaaaagacuaucugauua

SEQ ID NO: 618213 - RNA, 20 nt, Human
uugcaaagugaauagcaauu

SEQ ID NO: 618214 - RNA, 23 nt, Human
gguccaggaaaggcagcagcacc

SEQ ID NO: 618215 - RNA, 22 nt, Human
aagaugaacugucuucacccau

SEQ ID NO: 618216 - RNA, 22 nt, Human
ccugggcuccacuccaagagca

SEQ ID NO: 618217 - RNA, 22 nt, Human
uccugaggacuaacaggaagga

SEQ ID NO: 618218 - RNA, 22 nt, Human
ugugaagguaagguuugcuuga

SEQ ID NO: 618219 - RNA, 22 nt, Human
uacucaaaaaguuaugaaucau

SEQ ID NO: 618220 - RNA, 22 nt, Human
cuggguguagcccaguaugagg

SEQ ID NO: 618221 - RNA, 22 nt, Human
aguagaaucccuugcaaugucc

SEQ ID NO: 618222 - RNA, 22 nt, Human
ggccaccuaggagccacaguga

SEQ ID NO: 618223 - RNA, 22 nt, Human
augacagaugcuguggggaggu

SEQ ID NO: 618224 - RNA, 22 nt, Human
accugcagcuaaagauguaggg

SEQ ID NO: 618225 - RNA, 22 nt, Human
caaguagaacagagcuaccuug

SEQ ID NO: 618226 - RNA, 22 nt, Human
ccaacaguccagaugagauggu

SEQ ID NO: 618227 - RNA, 22 nt, Human
ucacugggcaucggagcugaaa

SEQ ID NO: 618228 - RNA, 22 nt, Human
agaggccggccgagcccauggg

SEQ ID NO: 618229 - RNA, 22 nt, Human
uggaaggcugugauuacugugc

SEQ ID NO: 618230 - RNA, 21 nt, Human
gagugcaggucugaugccauc

SEQ ID NO: 618231 - RNA, 22 nt, Human
guugaguggguuaggaugcuga

SEQ ID NO: 618232 - RNA, 19 nt, Human
agagucugugcucuuccua

SEQ ID NO: 618233 - RNA, 22 nt, Human
auaagccugauucacuugucau

SEQ ID NO: 618234 - RNA, 22 nt, Human
cauuucagugucuugugaugaa

SEQ ID NO: 618235 - RNA, 23 nt, Human
auaaauuacuaucucccuagagc

SEQ ID NO: 618236 - RNA, 22 nt, Human
gucaauauauucugucucuuug

SEQ ID NO: 618237 - RNA, 21 nt, Human
accugccacauugcagacuug

SEQ ID NO: 618238 - RNA, 22 nt, Human
ggcaggugcccagagagcacga

SEQ ID NO: 618239 - RNA, 18 nt, Human
cugaggcuggcaggagcc

SEQ ID NO: 618240 - RNA, 22 nt, Human
ucaguguuuaccguauguuguu

SEQ ID NO: 618241 - RNA, 20 nt, Human
cuccaguguucaggggagug

SEQ ID NO: 618242 - RNA, 22 nt, Human
uguggaaugcuccuaagugaau

SEQ ID NO: 618243 - RNA, 22 nt, Human
uuccugggccuuaaaucuuuug

SEQ ID NO: 618244 - RNA, 20 nt, Human
gccagcugcccuuccacccu

SEQ ID NO: 618245 - RNA, 22 nt, Human
caggcuggaguacaauugugug

SEQ ID NO: 618246 - RNA, 22 nt, Human
uugagcucuccucaucacccug

SEQ ID NO: 618247 - RNA, 22 nt, Human
aauaucagcucugucacuuacu

SEQ ID NO: 618248 - RNA, 22 nt, Human
ggguccagaguuuucccgcccu

SEQ ID NO: 618249 - RNA, 22 nt, Human
uuucaaagagaggcagaaggaa

SEQ ID NO: 618250 - RNA, 22 nt, Human
uccugaggcuaaagugcagugg

SEQ ID NO: 618251 - RNA, 22 nt, Human
aaaguagaacauuuucuuaucu

SEQ ID NO: 618252 - RNA, 22 nt, Human
augucuuuauuaauaucaugcc

SEQ ID NO: 618253 - RNA, 22 nt, Human
acucugugaagaugcaggcuug

SEQ ID NO: 618254 - RNA, 22 nt, Human
agggaaauggagaguguaguuu

SEQ ID NO: 618255 - RNA, 22 nt, Human
agugucaacucggaauaaggau

SEQ ID NO: 618256 - RNA, 22 nt, Human
cuuucccuuagccccauucuau

SEQ ID NO: 618257 - RNA, 22 nt, Human
ggacuuuagcuguaaugugugu

SEQ ID NO: 618258 - RNA, 22 nt, Human
ggagagguguauucaguggguc

SEQ ID NO: 618259 - RNA, 22 nt, Human
gccacagggcgagcggaggcca

SEQ ID NO: 618260 - RNA, 22 nt, Human
ccuggguggcugccugccuuuc

SEQ ID NO: 618261 - RNA, 22 nt, Human
uagguucacugucuugaggagc

SEQ ID NO: 618262 - RNA, 23 nt, Human
gggggcgugucauggagggccac

SEQ ID NO: 618263 - RNA, 22 nt, Human
uuacaagaucuuugaaggcaag

SEQ ID NO: 618264 - RNA, 22 nt, Human
gccagcucagugccaggccccu

SEQ ID NO: 618265 - RNA, 22 nt, Human
aucuguguccuuauaagagaca

SEQ ID NO: 618266 - RNA, 19 nt, Human
uccugggcugcgucuugcc

SEQ ID NO: 618267 - RNA, 22 nt, Human
gucccugguuugcccaggacca

SEQ ID NO: 618268 - RNA, 22 nt, Human
cagggagaagucuggucagucc

SEQ ID NO: 618269 - RNA, 22 nt, Human
ggaaggaacaaacccugugugg

SEQ ID NO: 618270 - RNA, 22 nt, Human
caugcagucaauaaacaugugu

SEQ ID NO: 618271 - RNA, 22 nt, Human
ggguccagcgacagcaggcuca

SEQ ID NO: 618272 - RNA, 20 nt, Human
ccugucuccucuuaccuggc

SEQ ID NO: 618273 - RNA, 22 nt, Human
aacuucauggguucaaagcugg

SEQ ID NO: 618274 - RNA, 18 nt, Human
gcuggcugcacuucugcu

SEQ ID NO: 618275 - RNA, 22 nt, Human
gugguguaggucacaguuagga

SEQ ID NO: 618276 - RNA, 20 nt, Human
agggucugaugugguggccc

SEQ ID NO: 618277 - RNA, 22 nt, Human
gagucauugcacacuagcucag

SEQ ID NO: 618278 - RNA, 22 nt, Human
ucccaugugacucagcugccug

SEQ ID NO: 618279 - RNA, 22 nt, Human
cagaggcacagugcgggccacu

SEQ ID NO: 618280 - RNA, 22 nt, Human
aguccguggccagacucaagag

SEQ ID NO: 618281 - RNA, 22 nt, Human
ugcuuccuauccacacaaugcc

SEQ ID NO: 618282 - RNA, 22 nt, Human
agggccugggguagcuuacugc

SEQ ID NO: 618283 - RNA, 19 nt, Human
cagaggcaccagguauaga

SEQ ID NO: 618284 - RNA, 22 nt, Human
uaagagcuaggauuuuaaauca

SEQ ID NO: 618285 - RNA, 22 nt, Human
gaucucuggguccuguuggccu

SEQ ID NO: 618286 - RNA, 22 nt, Human
cuguggcuaggauuauuccuga

SEQ ID NO: 618287 - RNA, 22 nt, Human
uggcacuuaaugcaugugcuau

SEQ ID NO: 618288 - RNA, 22 nt, Human
cguggcugguggaccugagggc

SEQ ID NO: 618289 - RNA, 22 nt, Human
guggcucucgccagccugcggg

SEQ ID NO: 618290 - RNA, 22 nt, Human
agcuuuagagagccaagacuca

SEQ ID NO: 618291 - RNA, 22 nt, Human
cuuuuucuaaucauaauugucu

SEQ ID NO: 618292 - RNA, 22 nt, Human
gggccaggaguggagauauggg

SEQ ID NO: 618293 - RNA, 22 nt, Human
agccaggggagucagcugcugg

SEQ ID NO: 618294 - RNA, 22 nt, Human
acugugugggccgcucacuggg

SEQ ID NO: 618295 - RNA, 22 nt, Human
uaaaaguuuuaguuguacauaa

SEQ ID NO: 618296 - RNA, 23 nt, Human
uaaauuaccuuuccagugcaggg

SEQ ID NO: 618297 - RNA, 20 nt, Human
gcugccuuguccugcuuggu

SEQ ID NO: 618298 - RNA, 22 nt, Human
ucaugugucugccaguguuuau

SEQ ID NO: 618299 - RNA, 22 nt, Human
uacauauuugucuuuguacugu

SEQ ID NO: 618300 - RNA, 20 nt, Human
uuggagucuaaagacugggg

SEQ ID NO: 618301 - RNA, 22 nt, Human
ccucccugggugacgggcuccu

SEQ ID NO: 618302 - RNA, 22 nt, Human
ccuuggcugaggagggagcuga

SEQ ID NO: 618303 - RNA, 19 nt, Human
agccagaacuaguguuucu

SEQ ID NO: 618304 - RNA, 22 nt, Human
aagccuucaguccguugcagag

SEQ ID NO: 618305 - RNA, 22 nt, Human
ggcuuuauuuugcaugaaugcu

SEQ ID NO: 618306 - RNA, 22 nt, Human
ggcaggugcugggagcaucuca

SEQ ID NO: 618307 - RNA, 21 nt, Human
accuucugaauuaccuaccaa

SEQ ID NO: 618308 - RNA, 22 nt, Human
uggcaaggcugugggggcagag

SEQ ID NO: 618309 - RNA, 22 nt, Human
uaaauacagucauuugagccau

SEQ ID NO: 618310 - RNA, 22 nt, Human
gcugcaggagcuggagcugugg

SEQ ID NO: 618311 - RNA, 22 nt, Human
auuuuugcccugcaguacauaa

SEQ ID NO: 618312 - RNA, 22 nt, Human
cggagaggaccugcaacucgcu

SEQ ID NO: 618313 - RNA, 22 nt, Human
acaguuagguccuaaaauucug

SEQ ID NO: 618314 - RNA, 22 nt, Human
auuuaaauuuucugauggagag

SEQ ID NO: 618315 - RNA, 21 nt, Human
ccacucugaguguugaacaga

SEQ ID NO: 618316 - RNA, 22 nt, Human
cugacucugacaggacuugugg

SEQ ID NO: 618317 - RNA, 22 nt, Human
guagaugagcucacaugaccuu

SEQ ID NO: 618318 - RNA, 22 nt, Human
agggaggaucugcuccuugucu

SEQ ID NO: 618319 - RNA, 22 nt, Human
auuacaagggucugacuggagg

SEQ ID NO: 618320 - RNA, 19 nt, Human
ccacuuugcuucucugggu

SEQ ID NO: 618321 - RNA, 23 nt, Human
uguugaaguaacuguuacauaga

SEQ ID NO: 618322 - RNA, 18 nt, Human
auguacauuugcuaaagc

SEQ ID NO: 618323 - RNA, 22 nt, Human
auaaaaaugagggcgguagcua

SEQ ID NO: 618324 - RNA, 22 nt, Human
ucuggccucuugggaugcuccc

SEQ ID NO: 618325 - RNA, 22 nt, Human
gcagggcagcuuagucccuguc

SEQ ID NO: 618326 - RNA, 19 nt, Human
uccagggcaggaacaugua

SEQ ID NO: 618327 - RNA, 22 nt, Human
aaacucuggggguggagcccag

SEQ ID NO: 618328 - RNA, 22 nt, Human
gcugaggccucagaaggcugag

SEQ ID NO: 618329 - RNA, 22 nt, Human
uauuuaucaagguaggagaaua

SEQ ID NO: 618330 - RNA, 22 nt, Human
cuagaaagauacuuaaaucaag

SEQ ID NO: 618331 - RNA, 22 nt, Human
ugccauccaacaguuccaucuu

SEQ ID NO: 618332 - RNA, 20 nt, Human
uuugcuaugcauaucugacc

SEQ ID NO: 618333 - RNA, 22 nt, Human
gccaggcugguuauuuaaugag

SEQ ID NO: 618334 - RNA, 22 nt, Human
uacacagggaaaggucucagag

SEQ ID NO: 618335 - RNA, 22 nt, Human
aaauaugagauguucucuuucg

SEQ ID NO: 618336 - RNA, 22 nt, Human
gacauaaaccuugagauauuaa

SEQ ID NO: 618337 - RNA, 22 nt, Human
ucccuguggauaucugcagcug

SEQ ID NO: 618338 - RNA, 22 nt, Human
uagcagaacaauagucaaugau

SEQ ID NO: 618339 - RNA, 22 nt, Human
ugggagagucuaaaaccgaggu

SEQ ID NO: 618340 - RNA, 22 nt, Human
agggcuuugagaauaguggaac

SEQ ID NO: 618341 - RNA, 22 nt, Human
ggaaaguggugguggaaagagg

SEQ ID NO: 618342 - RNA, 21 nt, Human
guuauuuuaagugagcuuugc

SEQ ID NO: 618343 - RNA, 22 nt, Human
uucauugugaacacauucugcc

SEQ ID NO: 618344 - RNA, 22 nt, Human
ugguccagucguuccuuuccuu

SEQ ID NO: 618345 - RNA, 22 nt, Human
aggcccagcuugaagugggaag

SEQ ID NO: 618346 - RNA, 22 nt, Human
aaagcaaucagauucagauguc

SEQ ID NO: 618347 - RNA, 22 nt, Human
ccuggccacagggcucugcauu

SEQ ID NO: 618348 - RNA, 22 nt, Human
gcaggcucagagcagauuagca

SEQ ID NO: 618349 - RNA, 22 nt, Human
uugagcccaggaggccugggug

SEQ ID NO: 618350 - RNA, 19 nt, Human
gggcccagcauggaggguu

SEQ ID NO: 618351 - RNA, 22 nt, Human
uccuguggagaggacuggaggu

SEQ ID NO: 618352 - RNA, 22 nt, Human
cugggagaucuccugagggcag

SEQ ID NO: 618353 - RNA, 22 nt, Human
ugauucuguucuccuugagaau

SEQ ID NO: 618354 - RNA, 22 nt, Human
agaaauccugauggagucugaa

SEQ ID NO: 618355 - RNA, 20 nt, Human
gaaguccuguuauauccuuu

SEQ ID NO: 618356 - RNA, 18 nt, Human
augcccuguugacuucag

SEQ ID NO: 618357 - RNA, 22 nt, Human
aacaguguuuuucuucagcacu

SEQ ID NO: 618358 - RNA, 22 nt, Human
uccagggcugacuugggagagg

SEQ ID NO: 618359 - RNA, 22 nt, Human
uucaguuuugcuuuuaaucaug

SEQ ID NO: 618360 - RNA, 21 nt, Human
agagccugagaucuuccagca

SEQ ID NO: 618361 - RNA, 23 nt, Human
aaggcauuggcuucucucauuuc

SEQ ID NO: 618362 - RNA, 22 nt, Human
uaacucugcuuguucucugagu

SEQ ID NO: 618363 - RNA, 22 nt, Human
ggguucagguuggccugagcac

SEQ ID NO: 618364 - RNA, 22 nt, Human
uuugauaauuaaaaauuguagu

SEQ ID NO: 618365 - RNA, 22 nt, Human
ugucuuuuggagcaucuuucuu

SEQ ID NO: 618366 - RNA, 22 nt, Human
uugccacugaaccagucuugca

SEQ ID NO: 618367 - RNA, 22 nt, Human
agcaggaguuugaugcuuuuau

SEQ ID NO: 618368 - RNA, 22 nt, Human
uuucaaagcaacugaaaaggaa

SEQ ID NO: 618369 - RNA, 22 nt, Human
gguccugaggggagcugaaggu

SEQ ID NO: 618370 - RNA, 22 nt, Human
uccagggcuggguuggcucagc

SEQ ID NO: 618371 - RNA, 22 nt, Human
ugugaaagucaaauuaauugaa

SEQ ID NO: 618372 - RNA, 22 nt, Human
aguggguguagucuuccuccug

SEQ ID NO: 618373 - RNA, 22 nt, Human
cagugcaacagauucgagaagc

SEQ ID NO: 618374 - RNA, 22 nt, Human
aggcaagugcauuagaagagca

SEQ ID NO: 618375 - RNA, 22 nt, Human
aaggcaggaugcggacccaucu

SEQ ID NO: 618376 - RNA, 22 nt, Human
gcuccuggucuggagcuucaag

SEQ ID NO: 618377 - RNA, 22 nt, Human
gagccuucaucgcagccuuguu

SEQ ID NO: 618378 - RNA, 22 nt, Human
uugaucaucuugugcugacggc

SEQ ID NO: 618379 - RNA, 22 nt, Human
aaagccuucaaguagauguaag

SEQ ID NO: 618380 - RNA, 22 nt, Human
ccaguguuuucauccucccuug

SEQ ID NO: 618381 - RNA, 22 nt, Human
ccaugggaauugggagguccca

SEQ ID NO: 618382 - RNA, 22 nt, Human
uacaaauggguuaaaauauagu

SEQ ID NO: 618383 - RNA, 22 nt, Human
uauuuuugccucucagauaaaa

SEQ ID NO: 618384 - RNA, 22 nt, Human
ccuggccacccagccuuggcca

SEQ ID NO: 618385 - RNA, 23 nt, Human
aagaggaggcccugcucccgucc

SEQ ID NO: 618386 - RNA, 18 nt, Human
agcuccugaacucugugg

SEQ ID NO: 618387 - RNA, 22 nt, Human
ucugccaccuucauccuccacu

SEQ ID NO: 618388 - RNA, 22 nt, Human
gccugggaagacuaagugggag

SEQ ID NO: 618389 - RNA, 22 nt, Human
ugauuuuuggaucugagcugca

SEQ ID NO: 618390 - RNA, 22 nt, Human
gcggagggcgagcccgcggagc

SEQ ID NO: 618391 - RNA, 22 nt, Human
uauguacaccggggaagguggg

SEQ ID NO: 618392 - RNA, 22 nt, Human
gguccccguggaggcuggagcg

SEQ ID NO: 618393 - RNA, 22 nt, Human
cugcccuggucccauggcugau

SEQ ID NO: 618394 - RNA, 22 nt, Human
acacaauacagggcucaaaaua

SEQ ID NO: 618395 - RNA, 22 nt, Human
caucucugguucagucucugug

SEQ ID NO: 618396 - RNA, 22 nt, Human
uuuccucacacagaagaucuug

SEQ ID NO: 618397 - RNA, 22 nt, Human
ucuggaguaauuacagugacug

SEQ ID NO: 618398 - RNA, 22 nt, Human
guccagccccugacucccaggc

SEQ ID NO: 618399 - RNA, 22 nt, Human
aggcagggcugggauuagacuc

SEQ ID NO: 618400 - RNA, 22 nt, Human
gaagccuuaucagucacuuaua

SEQ ID NO: 618401 - RNA, 22 nt, Human
agguccaggcauuuggguuggg

SEQ ID NO: 618402 - RNA, 22 nt, Human
uuauugugucuugguuuaucuu

SEQ ID NO: 618403 - RNA, 22 nt, Human
auccugggccucagaggugugu

SEQ ID NO: 618404 - RNA, 22 nt, Human
ccuggcacacgguggcauucaa

SEQ ID NO: 618405 - RNA, 22 nt, Human
ugggcucugguuuccuggcugg

SEQ ID NO: 618406 - RNA, 22 nt, Human
uuucauuuugguuaugccauaa

SEQ ID NO: 618407 - RNA, 22 nt, Human
aggcuagggccauggcugguga

SEQ ID NO: 618408 - RNA, 22 nt, Human
agaacagaggccuuauguuuca

SEQ ID NO: 618409 - RNA, 22 nt, Human
uauugaguuacagaaaauacuu

SEQ ID NO: 618410 - RNA, 22 nt, Human
uuuacaaggcagaacugauuaa

SEQ ID NO: 618411 - RNA, 22 nt, Human
cuguguuucugagaagugggga

SEQ ID NO: 618412 - RNA, 22 nt, Human
gcuuccuucuaccacaucaugc

SEQ ID NO: 618413 - RNA, 23 nt, Human
uggcucugugucacauacaggau

SEQ ID NO: 618414 - RNA, 22 nt, Human
gagguccagagcagguucagug

SEQ ID NO: 618415 - RNA, 22 nt, Human
cuggcuccauccuugagcucug

SEQ ID NO: 618416 - RNA, 19 nt, Human
ggccaccucucuucccagg

SEQ ID NO: 618417 - RNA, 22 nt, Human
uggaaggcagugauauuguuga

SEQ ID NO: 618418 - RNA, 22 nt, Human
cucuggcuuugcucaugcaucc

SEQ ID NO: 618419 - RNA, 22 nt, Human
uggcauuuaguugcguauugca

SEQ ID NO: 618420 - RNA, 22 nt, Human
ggcaagguacucuagagcacau

SEQ ID NO: 618421 - RNA, 22 nt, Human
uaaaaggagguugaagcuguca

SEQ ID NO: 618422 - RNA, 22 nt, Human
ucugucauuagccuugacugua

SEQ ID NO: 618423 - RNA, 22 nt, Human
gagaaagggaacuuacagagug

SEQ ID NO: 618424 - RNA, 22 nt, Human
aaagaugucacaagaugugaug

SEQ ID NO: 618425 - RNA, 22 nt, Human
uucuuuuuaaaguguguaugca

SEQ ID NO: 618426 - RNA, 20 nt, Human
cuguggcucaugcaucugcc

SEQ ID NO: 618427 - RNA, 22 nt, Human
ugggcaggagagaagcuaaaga

SEQ ID NO: 618428 - RNA, 22 nt, Human
cagguccaagagauccuccuac

SEQ ID NO: 618429 - RNA, 22 nt, Human
caagccagcaguuuaaugacuc

SEQ ID NO: 618430 - RNA, 21 nt, Human
auggccacuauggugcagcag

SEQ ID NO: 618431 - RNA, 22 nt, Human
ugugaauauccauuuguuucag

SEQ ID NO: 618432 - RNA, 21 nt, Human
gagccuucccucugcccuuuc

SEQ ID NO: 618433 - RNA, 22 nt, Human
cccagccucagcuuuacuucca

SEQ ID NO: 618434 - RNA, 17 nt, Human
acagcaggcccggaggg

SEQ ID NO: 618435 - RNA, 22 nt, Human
agggcagcucucaccucuggcc

SEQ ID NO: 618436 - RNA, 22 nt, Human
ccugaccauuugccacaugggu

SEQ ID NO: 618437 - RNA, 22 nt, Human
gcaggguccauggaggcagccc

SEQ ID NO: 618438 - RNA, 19 nt, Human
gcaggcacagcccugggug

SEQ ID NO: 618439 - RNA, 22 nt, Human
uucugcauuggagucuauucuu

SEQ ID NO: 618440 - RNA, 22 nt, Human
aggcccagagagccaguuagug

SEQ ID NO: 618441 - RNA, 22 nt, Human
ccuggcaggcaagaggaaggga

SEQ ID NO: 618442 - RNA, 22 nt, Human
gugccacuuaccugggaggagu

SEQ ID NO: 618443 - RNA, 22 nt, Human
caguccagagcccaccagagga

SEQ ID NO: 618444 - RNA, 22 nt, Human
agcuccugcacccagccuugag

SEQ ID NO: 618445 - RNA, 22 nt, Human
cuguggauuuaggcagagcuga

SEQ ID NO: 618446 - RNA, 22 nt, Human
agaaaacauuacauaggugugu

SEQ ID NO: 618447 - RNA, 22 nt, Human
cugcccugcuggagaucacagu

SEQ ID NO: 618448 - RNA, 22 nt, Human
auguaauuuauguuauccauaa

SEQ ID NO: 618449 - RNA, 22 nt, Human
cuucauuuggagaacugugcuu

SEQ ID NO: 618450 - RNA, 22 nt, Human
cagaaauaucaguugaaagugc

SEQ ID NO: 618451 - RNA, 22 nt, Human
aggaauggugcucagcagaaau

SEQ ID NO: 618452 - RNA, 22 nt, Human
caugcuuugggucagaaaugcc

SEQ ID NO: 618453 - RNA, 22 nt, Human
aggaggcacucacucucagggu

SEQ ID NO: 618454 - RNA, 22 nt, Human
uucaaaagacucagauguagcg

SEQ ID NO: 618455 - RNA, 22 nt, Human
gacaucaauucagcauuuuaag

SEQ ID NO: 618456 - RNA, 22 nt, Human
cagguucccuagcagcaaagcc

SEQ ID NO: 618457 - RNA, 22 nt, Human
acuguggcuaauucauuugguc

SEQ ID NO: 618458 - RNA, 22 nt, Human
agcuaggaaauugaggcugaga

SEQ ID NO: 618459 - RNA, 21 nt, Human
ccagggaagaaaugagggcag

SEQ ID NO: 618460 - RNA, 22 nt, Human
agcuuuaaaaauccaauaucca

SEQ ID NO: 618461 - RNA, 21 nt, Human
uggauaaaggcacuuuucauc

SEQ ID NO: 618462 - RNA, 22 nt, Human
aguggcagagcaggugcuggaa

SEQ ID NO: 618463 - RNA, 22 nt, Human
cauaauaucuccgauuacuugc

SEQ ID NO: 618464 - RNA, 22 nt, Human
ugaggcagauauuuauuggguu

SEQ ID NO: 618465 - RNA, 22 nt, Human
gcaggucucaaucugagcaggc

SEQ ID NO: 618466 - RNA, 22 nt, Human
ggcggggucugagcgccgcgcc

SEQ ID NO: 618467 - RNA, 22 nt, Human
cuguggcuuuuccggggagccu

SEQ ID NO: 618468 - RNA, 22 nt, Human
cuguggcucaaaaucccaugau

SEQ ID NO: 618469 - RNA, 22 nt, Human
uccucuggaaccucacccuugc

SEQ ID NO: 618470 - RNA, 19 nt, Human
ggaaggcagaggggcugug

SEQ ID NO: 618471 - RNA, 22 nt, Human
aggagggcuaggaaaaccagga

SEQ ID NO: 618472 - RNA, 22 nt, Human
cugggccaugggccagcgaggc

SEQ ID NO: 618473 - RNA, 22 nt, Human
cauggccagcccugagguucag

SEQ ID NO: 618474 - RNA, 22 nt, Human
aucauacagccuuuguuagugu

SEQ ID NO: 618475 - RNA, 22 nt, Human
uggggagaagcaauagacucua

SEQ ID NO: 618476 - RNA, 22 nt, Human
aagggggccacaccugguguga

SEQ ID NO: 618477 - RNA, 22 nt, Human
gcauggccucugugcuuguugc

SEQ ID NO: 618478 - RNA, 22 nt, Human
cuauacaucccaauuucagaga

SEQ ID NO: 618479 - RNA, 22 nt, Human
ugggcucugcaucagugcccau

SEQ ID NO: 618480 - RNA, 22 nt, Human
aggcaggccuacacaaugggag

SEQ ID NO: 618481 - RNA, 22 nt, Human
uuacuuuaucuccuagauucca

SEQ ID NO: 618482 - RNA, 22 nt, Human
ugggguacuuguaucaaagcac

SEQ ID NO: 618483 - RNA, 22 nt, Human
ccuggcccuggaauagggcagg

SEQ ID NO: 618484 - RNA, 22 nt, Human
ugccacuggcucaauggugcag

SEQ ID NO: 618485 - RNA, 22 nt, Human
ugaggcaguucuuacuuguauu

SEQ ID NO: 618486 - RNA, 22 nt, Human
gagaggcccuguggucccagcu

SEQ ID NO: 618487 - RNA, 22 nt, Human
agucucuuacccaagcagaaug

SEQ ID NO: 618488 - RNA, 22 nt, Human
ccaguguuagagacugauacag

SEQ ID NO: 618489 - RNA, 19 nt, Human
gcuccuggaugaccugugg

SEQ ID NO: 618490 - RNA, 22 nt, Human
ugccagcuuuugacuaucuuag

SEQ ID NO: 618491 - RNA, 22 nt, Human
aauauuuaugacaggaaguagc

SEQ ID NO: 618492 - RNA, 22 nt, Human
ggcaggguaaaccgagguaagu

SEQ ID NO: 618493 - RNA, 22 nt, Human
augcuucuguaaugugggaaug

SEQ ID NO: 618494 - RNA, 22 nt, Human
aggcauggacauuucggcagcu

SEQ ID NO: 618495 - RNA, 17 nt, Human
agaaagaggauccacag

SEQ ID NO: 618496 - RNA, 22 nt, Human
ccugggcaacauagugagaccc

SEQ ID NO: 618497 - RNA, 22 nt, Human
gggagggccagugcucucuaga

SEQ ID NO: 618498 - RNA, 22 nt, Human
cuguggcuggcucaucauaggu

SEQ ID NO: 618499 - RNA, 22 nt, Human
uucauuuguggugaaugaagug

SEQ ID NO: 618500 - RNA, 22 nt, Human
gggaaagaagaucuagauacug

SEQ ID NO: 618501 - RNA, 22 nt, Human
aucuucaauugaaaacuagccu

SEQ ID NO: 618502 - RNA, 22 nt, Human
uuuucucuauauugucugugaa

SEQ ID NO: 618503 - RNA, 22 nt, Human
caugccuguauuucugaucuau

SEQ ID NO: 618504 - RNA, 22 nt, Human
ccagggaggguccuguggcuuc

SEQ ID NO: 618505 - RNA, 22 nt, Human
agggccagcccauaaugccaaa

SEQ ID NO: 618506 - RNA, 22 nt, Human
cuggaaagucaggucagaaacu

SEQ ID NO: 618507 - RNA, 22 nt, Human
guccaggaguuuccaauuaagc

SEQ ID NO: 618508 - RNA, 22 nt, Human
cugcccugcuuguuuccagugg

SEQ ID NO: 618509 - RNA, 22 nt, Human
ucccagugagguccuggcuguc

SEQ ID NO: 618510 - RNA, 22 nt, Human
uuucuuuugcccuguggguuag

SEQ ID NO: 618511 - RNA, 18 nt, Human
acauuucuccuucugacc

SEQ ID NO: 618512 - RNA, 22 nt, Human
uccugugugggcaggaugagaa

SEQ ID NO: 618513 - RNA, 22 nt, Human
gcucuguggcaggaggucuugu

SEQ ID NO: 618514 - RNA, 22 nt, Human
cuggcagcccaaccuagagucu

SEQ ID NO: 618515 - RNA, 21 nt, Human
uuccucuugcuuccgccuugc

SEQ ID NO: 618516 - RNA, 22 nt, Human
uccugggacucaacuuagaagg

SEQ ID NO: 618517 - RNA, 22 nt, Human
augacagacagaagggauuuuu

SEQ ID NO: 618518 - RNA, 22 nt, Human
uccucagcuuuuauuucacuug

SEQ ID NO: 618519 - RNA, 22 nt, Human
aauacagagaauguuauuugga

SEQ ID NO: 618520 - RNA, 22 nt, Human
agaaggguguauacauuuccug

SEQ ID NO: 618521 - RNA, 22 nt, Human
cuuauaaaguccaucugaacaa

SEQ ID NO: 618522 - RNA, 22 nt, Human
uugagucucugccaaaacacaa

SEQ ID NO: 618523 - RNA, 22 nt, Human
ucauuucuccuaagugaaauau

SEQ ID NO: 618524 - RNA, 22 nt, Human
uuacaagauaaccugaugcugu

SEQ ID NO: 618525 - RNA, 22 nt, Human
aaggcuguuuauuagaaaaagu

SEQ ID NO: 618526 - RNA, 22 nt, Human
aagggaaaucauauggugcagu

SEQ ID NO: 618527 - RNA, 22 nt, Human
uuuauaaacaguaccacggugc

SEQ ID NO: 618528 - RNA, 22 nt, Human
guccugguuuucacagaccuuu

SEQ ID NO: 618529 - RNA, 19 nt, Human
ccugcagggaugagagguu

SEQ ID NO: 618530 - RNA, 20 nt, Human
ggaaucuuugcaggaaaaua

SEQ ID NO: 618531 - RNA, 22 nt, Human
caaagacacgggaaacaacguu

SEQ ID NO: 618532 - RNA, 22 nt, Human
cuguggcuccagugaaccaaug

SEQ ID NO: 618533 - RNA, 22 nt, Human
agcuccagaagccugcaaggua

SEQ ID NO: 618534 - RNA, 22 nt, Human
cugacccuagcaucucugugca

SEQ ID NO: 618535 - RNA, 22 nt, Human
cugggccaucucucugcaagug

SEQ ID NO: 618536 - RNA, 22 nt, Human
ucucuuugacccuuuagcucca

SEQ ID NO: 618537 - RNA, 22 nt, Human
uagaauaguguuuucauuaugg

SEQ ID NO: 618538 - RNA, 22 nt, Human
aggagacauaacuaugaugaga

SEQ ID NO: 618539 - RNA, 22 nt, Human
aaguuucauuguucauguaaca

SEQ ID NO: 618540 - RNA, 22 nt, Human
aaauuagaccaguucaggucca

SEQ ID NO: 618541 - RNA, 20 nt, Human
uaacagaaguagaagugggu

SEQ ID NO: 618542 - RNA, 22 nt, Human
agauuuguauagaugugguuga

SEQ ID NO: 618543 - RNA, 22 nt, Human
ugagguagaagccuggguugag

SEQ ID NO: 618544 - RNA, 22 nt, Human
augcuuggaugcugccauggga

SEQ ID NO: 618545 - RNA, 22 nt, Human
ucugaaauacugcagguucucu

SEQ ID NO: 618546 - RNA, 22 nt, Human
uuuucauuagaaugacugagaa

SEQ ID NO: 618547 - RNA, 22 nt, Human
gcuguaaagaacauuaggaauc

SEQ ID NO: 618548 - RNA, 22 nt, Human
cacaggaauaagucaaacuuca

SEQ ID NO: 618549 - RNA, 22 nt, Human
ccaggggaaacagggagcacuc

SEQ ID NO: 618550 - RNA, 22 nt, Human
acaguguuuucuuaaggagaaa

SEQ ID NO: 618551 - RNA, 22 nt, Human
aaguagaaucucagguaggcua

SEQ ID NO: 618552 - RNA, 22 nt, Human
uaagccugcaugaaccaugaga

SEQ ID NO: 618553 - RNA, 21 nt, Human
cacuccacuuagaacaggguu

SEQ ID NO: 618554 - RNA, 22 nt, Human
gcaguguugguuugcucugcag

SEQ ID NO: 618555 - RNA, 22 nt, Human
uauacaggaaauuuuggaacag

SEQ ID NO: 618556 - RNA, 22 nt, Human
cuucuccucugaguccugggag

SEQ ID NO: 618557 - RNA, 22 nt, Human
caggccucaugguguguccuuc

SEQ ID NO: 618558 - RNA, 22 nt, Human
aggaaaaagaguugcugccuuc

SEQ ID NO: 618559 - RNA, 22 nt, Human
auguguuuugguaauuucugcu

SEQ ID NO: 618560 - RNA, 22 nt, Human
cucaguccuuauuugccucuac

SEQ ID NO: 618561 - RNA, 22 nt, Human
gccuguuugacuggucucugcu

SEQ ID NO: 618562 - RNA, 22 nt, Human
accugaggcuguuagucuaggu

SEQ ID NO: 618563 - RNA, 22 nt, Human
ggagaagggaacugaguuuuug

SEQ ID NO: 618564 - RNA, 22 nt, Human
aaugggaaagagacuagaugcu

SEQ ID NO: 618565 - RNA, 18 nt, Human
uccugggaacuugcuagc

SEQ ID NO: 618566 - RNA, 22 nt, Human
ggcccagcugugcuuccagccc

SEQ ID NO: 618567 - RNA, 22 nt, Human
aaguccugggugagaacugucc

SEQ ID NO: 618568 - RNA, 22 nt, Human
gccagaggggcucgaaggcgcg

SEQ ID NO: 618569 - RNA, 22 nt, Human
uaccugcacagccagccaugug

SEQ ID NO: 618570 - RNA, 22 nt, Human
ggaugggcagacaggacggcac

SEQ ID NO: 618571 - RNA, 20 nt, Human
agcuaggagaaagcauggag

SEQ ID NO: 618572 - RNA, 22 nt, Human
cguccgcaaugcaagccuuuua

SEQ ID NO: 618573 - RNA, 22 nt, Human
aggagagggguaggauuaauuu

SEQ ID NO: 618574 - RNA, 22 nt, Human
uagauucaaguauucaguuugg

SEQ ID NO: 618575 - RNA, 22 nt, Human
gauuucuuuaugaaguacagaa

SEQ ID NO: 618576 - RNA, 22 nt, Human
agaagcaggccucacagaucug

SEQ ID NO: 618577 - RNA, 22 nt, Human
cugcaaaaguaauugcagguuu

SEQ ID NO: 618578 - RNA, 22 nt, Human
ucauagaagcacucagcucccu

SEQ ID NO: 618579 - RNA, 22 nt, Human
aauguguuuuaugagagaauau

SEQ ID NO: 618580 - RNA, 22 nt, Human
cuccugggagucuuccuggaug

SEQ ID NO: 618581 - RNA, 22 nt, Human
uccaaagaaccuggcuacuguc

SEQ ID NO: 618582 - RNA, 22 nt, Human
gcuggguuuccagcaggcagga

SEQ ID NO: 618583 - RNA, 16 nt, Human
ucaguguuccagaaua

SEQ ID NO: 618584 - RNA, 22 nt, Human
uccuggugccuggagcucucca

SEQ ID NO: 618585 - RNA, 22 nt, Human
ccuggguuauuuuggucuagug

SEQ ID NO: 618586 - RNA, 22 nt, Human
ggcuuuaugcagggauagaaau

SEQ ID NO: 618587 - RNA, 22 nt, Human
gagagcugauagaugagcuacu

SEQ ID NO: 618588 - RNA, 22 nt, Human
ugugacagccaguaaaguaagc

SEQ ID NO: 618589 - RNA, 22 nt, Human
agggcuuugauguccaugagga

SEQ ID NO: 618590 - RNA, 18 nt, Human
ugagaauguaagaaaugg

SEQ ID NO: 618591 - RNA, 22 nt, Human
ggagaaugauucuuugcucacu

SEQ ID NO: 618592 - RNA, 22 nt, Human
uuucacagcgucuuucucuugc

SEQ ID NO: 618593 - RNA, 22 nt, Human
cccuguuuggauggggacccag

SEQ ID NO: 618594 - RNA, 22 nt, Human
uccacagauuaaaaacauacuu

SEQ ID NO: 618595 - RNA, 22 nt, Human
ggguucagagucaggugugaua

SEQ ID NO: 618596 - RNA, 22 nt, Human
auuaaagacagcagauggaugg

SEQ ID NO: 618597 - RNA, 22 nt, Human
cuggcccuggagggcugugcga

SEQ ID NO: 618598 - RNA, 21 nt, Human
uuguugagaguuagaacaugg

SEQ ID NO: 618599 - RNA, 23 nt, Human
aacacaaagcugauuccaguggc

SEQ ID NO: 618600 - RNA, 22 nt, Human
gcggcgccuaagccccgaccuc

SEQ ID NO: 618601 - RNA, 22 nt, Human
aagacuugaccagguugaaggc

SEQ ID NO: 618602 - RNA, 21 nt, Human
uccuggcccacucuaucccca

SEQ ID NO: 618603 - RNA, 22 nt, Human
ugaagaucugucaaccccauau

SEQ ID NO: 618604 - RNA, 22 nt, Human
uccugggcacaagugagucucc

SEQ ID NO: 618605 - RNA, 22 nt, Human
caggaaaauggaaucaccugua

SEQ ID NO: 618606 - RNA, 17 nt, Human
cccuggcaaagaauggc

SEQ ID NO: 618607 - RNA, 22 nt, Human
gcugaggcaaaccaagaaugua

SEQ ID NO: 618608 - RNA, 22 nt, Human
aucuggaggauucugggacuug

SEQ ID NO: 618609 - RNA, 22 nt, Human
uucaauagaaaugacauucuuu

SEQ ID NO: 618610 - RNA, 22 nt, Human
accugagggagauuaggccuga

SEQ ID NO: 618611 - RNA, 22 nt, Human
ugguuugagagugugagcuuuu

SEQ ID NO: 618612 - RNA, 18 nt, Human
gccugggaggaggaaaug

SEQ ID NO: 618613 - RNA, 22 nt, Human
agggccagcugcagaauuagca

SEQ ID NO: 618614 - RNA, 22 nt, Human
uugcccugucuuaagcuggcaa

SEQ ID NO: 618615 - RNA, 22 nt, Human
cagggcuuuccugagaagugau

SEQ ID NO: 618616 - RNA, 22 nt, Human
ucccucugguccucgguggaga

SEQ ID NO: 618617 - RNA, 22 nt, Human
agggcuuugcaaugcacagugg

SEQ ID NO: 618618 - RNA, 22 nt, Human
agggggugcuacuuccagaguu

SEQ ID NO: 618619 - RNA, 22 nt, Human
uccagggcuacaaggcaccaga

SEQ ID NO: 618620 - RNA, 22 nt, Human
cacaguggcuuugcuggucucg

SEQ ID NO: 618621 - RNA, 22 nt, Human
ggcagagugcucugggcagggg

SEQ ID NO: 618622 - RNA, 23 nt, Human
cccugcagucagggugagauggu

SEQ ID NO: 618623 - RNA, 19 nt, Human
ccagugcaagguaagauag

SEQ ID NO: 618624 - RNA, 22 nt, Human
caaguagaaggaugugauugua

SEQ ID NO: 618625 - RNA, 22 nt, Human
ucaaauauuggcuauuucacau

SEQ ID NO: 618626 - RNA, 22 nt, Human
caggaaaugcuaucauagcuga

SEQ ID NO: 618627 - RNA, 22 nt, Human
ggcauggccuguaagacggaga

SEQ ID NO: 618628 - RNA, 23 nt, Human
uccagggauuaaugaagucaguc

SEQ ID NO: 618629 - RNA, 22 nt, Human
ucaguguugaauuuuuugcaaa

SEQ ID NO: 618630 - RNA, 22 nt, Human
agcugccucccugugcuugucc

SEQ ID NO: 618631 - RNA, 22 nt, Human
gccugggagugcacagugaggu

SEQ ID NO: 618632 - RNA, 22 nt, Human
ugugaagguaaggaggggcaag

SEQ ID NO: 618633 - RNA, 22 nt, Human
cuuuuacauuuguugaagagua

SEQ ID NO: 618634 - RNA, 22 nt, Human
gccucugcucggacuuugccuc

SEQ ID NO: 618635 - RNA, 22 nt, Human
gcaggccagcugugcagauggg

SEQ ID NO: 618636 - RNA, 22 nt, Human
cacaguccagacuccuggaguu

SEQ ID NO: 618637 - RNA, 22 nt, Human
uucuuucucuguaaaaggaaaa

SEQ ID NO: 618638 - RNA, 22 nt, Human
uguuucuucucacacaaacuca

SEQ ID NO: 618639 - RNA, 22 nt, Human
auccugggaaugggagggucau

SEQ ID NO: 618640 - RNA, 22 nt, Human
agaaggaaggauaacugcauua

SEQ ID NO: 618641 - RNA, 22 nt, Human
ugaggcagggagaguggauaug

SEQ ID NO: 618642 - RNA, 22 nt, Human
gcugugugcuaggauauguuuu

SEQ ID NO: 618643 - RNA, 22 nt, Human
gggaucuuucugaugcuguggc

SEQ ID NO: 618644 - RNA, 22 nt, Human
ugcugcuuugauguguaaauca

SEQ ID NO: 618645 - RNA, 22 nt, Human
agagaugaagggcauuccccag

SEQ ID NO: 618646 - RNA, 22 nt, Human
uugcaagauguuaccauuguua

SEQ ID NO: 618647 - RNA, 22 nt, Human
auuagugucugugaauaauucu

SEQ ID NO: 618648 - RNA, 23 nt, Human
aacguccucaacaggauugcacc

SEQ ID NO: 618649 - RNA, 22 nt, Human
gcccagugguaaaagcaggccu

SEQ ID NO: 618650 - RNA, 22 nt, Human
augcccugccaagcaggcuaaa

SEQ ID NO: 618651 - RNA, 20 nt, Human
agucccaacauucagcucug

SEQ ID NO: 618652 - RNA, 22 nt, Human
uuggaaggugagucccuggguu

SEQ ID NO: 618653 - RNA, 22 nt, Human
uccugcagccauuagaggucaa

SEQ ID NO: 618654 - RNA, 22 nt, Human
ggagggguggaaggagugccug

SEQ ID NO: 618655 - RNA, 22 nt, Human
auguguguauauauagucauuu

SEQ ID NO: 618656 - RNA, 22 nt, Human
guccacagagggcugggcaggc

SEQ ID NO: 618657 - RNA, 22 nt, Human
caccaaagucgcuucugucguc

SEQ ID NO: 618658 - RNA, 22 nt, Human
cuguggcucuuuaguugagcac

SEQ ID NO: 618659 - RNA, 22 nt, Human
cagucagucaauacucuuugag

SEQ ID NO: 618660 - RNA, 22 nt, Human
uuaccuguguguuugauacaua

SEQ ID NO: 618661 - RNA, 22 nt, Human
auugaaagagaauguagcucuu

SEQ ID NO: 618662 - RNA, 22 nt, Human
uugcuuucccaaggcagaacau

SEQ ID NO: 618663 - RNA, 22 nt, Human
auuuauuaugggauuuggcaca

SEQ ID NO: 618664 - RNA, 21 nt, Human
aucagaaucucuagauuugga

SEQ ID NO: 618665 - RNA, 22 nt, Human
uuugcuuuugugcucuaguggu

SEQ ID NO: 618666 - RNA, 17 nt, Human
uuugaaaggaugucagu

SEQ ID NO: 618667 - RNA, 22 nt, Human
ggccaccuuccuguggucucug

SEQ ID NO: 618668 - RNA, 22 nt, Human
uccugaggacccugucaggggc

SEQ ID NO: 618669 - RNA, 22 nt, Human
aaauugcuauaugugaauguga

SEQ ID NO: 618670 - RNA, 22 nt, Human
accagggcggcuugaggaggca

SEQ ID NO: 618671 - RNA, 22 nt, Human
acugggcccauauacucagucu

SEQ ID NO: 618672 - RNA, 19 nt, Human
ccagcccugucacuucuug

SEQ ID NO: 618673 - RNA, 22 nt, Human
cauguguuucgagacuguugag

SEQ ID NO: 618674 - RNA, 22 nt, Human
ggguccagaaugagaaugggcu

SEQ ID NO: 618675 - RNA, 22 nt, Human
uauuucuaagagauaucuguac

SEQ ID NO: 618676 - RNA, 22 nt, Human
gggcugggcaugguguucccuc

SEQ ID NO: 618677 - RNA, 22 nt, Human
ggcggguggcgaggcuucucgg

SEQ ID NO: 618678 - RNA, 19 nt, Human
aggcaugggaagagaaguc

SEQ ID NO: 618679 - RNA, 22 nt, Human
uccugggguccugacugcuucc

SEQ ID NO: 618680 - RNA, 22 nt, Human
gcugccuucccaggccuuugcu

SEQ ID NO: 618681 - RNA, 22 nt, Human
uggagaauggaauguugugcag

SEQ ID NO: 618682 - RNA, 22 nt, Human
aaaauacacauacuaggggaaa

SEQ ID NO: 618683 - RNA, 22 nt, Human
aaaaugcucaucagcgauggcu

SEQ ID NO: 618684 - RNA, 22 nt, Human
ucuccuggcucaccaggcugga

SEQ ID NO: 618685 - RNA, 22 nt, Human
gcugugcugauucauucccugc

SEQ ID NO: 618686 - RNA, 22 nt, Human
aagcagcuucccuggcuccugg

SEQ ID NO: 618687 - RNA, 22 nt, Human
agcaggugguaggcagucagca

SEQ ID NO: 618688 - RNA, 22 nt, Human
gcucuggcuacuccacccuguu

SEQ ID NO: 618689 - RNA, 22 nt, Human
aauguugauguuuucagugagc

SEQ ID NO: 618690 - RNA, 22 nt, Human
gcucuucucagauuguacacuc

SEQ ID NO: 618691 - RNA, 22 nt, Human
guuauaaaggugauaaugguca

SEQ ID NO: 618692 - RNA, 22 nt, Human
uggccagcagaguucacucucu

SEQ ID NO: 618693 - RNA, 22 nt, Human
aaguuagagauuccaucaugcu

SEQ ID NO: 618694 - RNA, 22 nt, Human
cacuucagcuacaaucacauga

SEQ ID NO: 618695 - RNA, 22 nt, Human
uuuaaauuauaguuaaugucug

SEQ ID NO: 618696 - RNA, 22 nt, Human
aggguccauguuuccaguuaau

SEQ ID NO: 618697 - RNA, 22 nt, Human
auaaugcauuuagaauaauuca

SEQ ID NO: 618698 - RNA, 23 nt, Human
ccagugugguagguccacaggug

SEQ ID NO: 618699 - RNA, 22 nt, Human
agccaggacagggcagcucgcu

SEQ ID NO: 618700 - RNA, 22 nt, Human
uaagaaauuuaguuauagaaug

SEQ ID NO: 618701 - RNA, 22 nt, Human
cagcuacagaggccacauggcu

SEQ ID NO: 618702 - RNA, 22 nt, Human
ggguucagacuaaagcuaugca

SEQ ID NO: 618703 - RNA, 20 nt, Human
auauuucuuaagaacuuuca

SEQ ID NO: 618704 - RNA, 23 nt, Human
uuuuccuuuggacaggcuguauu

SEQ ID NO: 618705 - RNA, 22 nt, Human
uguccuagauccagcugugcug

SEQ ID NO: 618706 - RNA, 22 nt, Human
ugugcagagaagccacuggggg

SEQ ID NO: 618707 - RNA, 19 nt, Human
agaggcaaggguggaagua

SEQ ID NO: 618708 - RNA, 22 nt, Human
ccaugccuggacuccacucuca

SEQ ID NO: 618709 - RNA, 22 nt, Human
aacuccugaggaaauggucuca

SEQ ID NO: 618710 - RNA, 22 nt, Human
gugcccagcuccaccucacaga

SEQ ID NO: 618711 - RNA, 17 nt, Human
uccuggccuggugugug

SEQ ID NO: 618712 - RNA, 22 nt, Human
cuggguuuuauuacagugagcu

SEQ ID NO: 618713 - RNA, 22 nt, Human
caggcugggcuccggagauaaa

SEQ ID NO: 618714 - RNA, 22 nt, Human
ggcuccuggggaggugagcuug

SEQ ID NO: 618715 - RNA, 20 nt, Human
cuuccacacaagaagcacag

SEQ ID NO: 618716 - RNA, 22 nt, Human
auugaaaaaugacuauugcuua

SEQ ID NO: 618717 - RNA, 22 nt, Human
uuauuuacuggauggccuuggg

SEQ ID NO: 618718 - RNA, 22 nt, Human
ucacaaagcuuugauaagcaga

SEQ ID NO: 618719 - RNA, 22 nt, Human
uagauucagauauuuaggacaa

SEQ ID NO: 618720 - RNA, 21 nt, Human
gggcaggucucugaugucaac

SEQ ID NO: 618721 - RNA, 22 nt, Human
uacaacagaccuagaugaauga

SEQ ID NO: 618722 - RNA, 22 nt, Human
agcagggaggcggugugcuggc

SEQ ID NO: 618723 - RNA, 22 nt, Human
aggcauggcuuuaggcaggcgu

SEQ ID NO: 618724 - RNA, 22 nt, Human
auccuggguuugugaguuuaug

SEQ ID NO: 618725 - RNA, 22 nt, Human
caggaaaaugucaauggaaagc

SEQ ID NO: 618726 - RNA, 18 nt, Human
agucccaucuucagcucu

SEQ ID NO: 618727 - RNA, 22 nt, Human
uuuacaaggcaguuauuuuccu

SEQ ID NO: 618728 - RNA, 22 nt, Human
cuuccuggccauugccauggca

SEQ ID NO: 618729 - RNA, 22 nt, Human
gcagaggacacaggagggcaag

SEQ ID NO: 618730 - RNA, 21 nt, Human
cgcagagcgaacuugcggcgc

SEQ ID NO: 618731 - RNA, 18 nt, Human
uugagucuagccauggaa

SEQ ID NO: 618732 - RNA, 22 nt, Human
uggcagaaugaagacuggggcc

SEQ ID NO: 618733 - RNA, 22 nt, Human
uauuucuguuuauuuguacauc

SEQ ID NO: 618734 - RNA, 22 nt, Human
augagcuagaaaaccaugugga

SEQ ID NO: 618735 - RNA, 22 nt, Human
ccuguggcugccacuuggguga

SEQ ID NO: 618736 - RNA, 22 nt, Human
ggguccagacuaugaagaacuu

SEQ ID NO: 618737 - RNA, 22 nt, Human
gcagcuccuuuaggcugcaaag

SEQ ID NO: 618738 - RNA, 22 nt, Human
ggagcaagucccaggcacuagu

SEQ ID NO: 618739 - RNA, 22 nt, Human
aggcaggugggucacuugaguc

SEQ ID NO: 618740 - RNA, 20 nt, Human
uccaggcagacagcuauggg

SEQ ID NO: 618741 - RNA, 22 nt, Human
uacuuuuuaugauaagaacuga

SEQ ID NO: 618742 - RNA, 22 nt, Human
ggagagguuauccguguuaugu

SEQ ID NO: 618743 - RNA, 22 nt, Human
ugaguggacaccugcuucuuua

SEQ ID NO: 618744 - RNA, 22 nt, Human
cgcaccacugaauuccagccug

SEQ ID NO: 618745 - RNA, 18 nt, Human
ucucaaaaauaauggcuu

SEQ ID NO: 618746 - RNA, 22 nt, Human
aggaggguggggucugccuguc

SEQ ID NO: 618747 - RNA, 22 nt, Human
ggcuuuauuauguggccaugug

SEQ ID NO: 618748 - RNA, 22 nt, Human
cauugcaacuucaaacuccugg

SEQ ID NO: 618749 - RNA, 22 nt, Human
uggcuuuaagaagacugacagc

SEQ ID NO: 618750 - RNA, 22 nt, Human
uauguacaucguugaauucaaa

SEQ ID NO: 618751 - RNA, 22 nt, Human
agagcccucucauuggcuuauu

SEQ ID NO: 618752 - RNA, 22 nt, Human
gaagagaagcaucaauagguaa

SEQ ID NO: 618753 - RNA, 22 nt, Human
agagcuguuuggacaucugagu

SEQ ID NO: 618754 - RNA, 22 nt, Human
ggcuuccuggggccuccugcaa

SEQ ID NO: 618755 - RNA, 22 nt, Human
ugcagcaguuuaaugcaggguu

SEQ ID NO: 618756 - RNA, 22 nt, Human
ucuuuuucuuauucccacacug

SEQ ID NO: 618757 - RNA, 22 nt, Human
ugcacaaacacagagaauagau

SEQ ID NO: 618758 - RNA, 22 nt, Human
gccuguuuccaucaacacaugc

SEQ ID NO: 618759 - RNA, 22 nt, Human
cagaggccccagaacuagcucu

SEQ ID NO: 618760 - RNA, 22 nt, Human
guucaaaauucaaaugguauac

SEQ ID NO: 618761 - RNA, 22 nt, Human
uuacaagacacagugcugaagg

SEQ ID NO: 618762 - RNA, 22 nt, Human
acaugcaaaaauauauuuauga

SEQ ID NO: 618763 - RNA, 22 nt, Human
uugcuucagaaguucugcuugu

SEQ ID NO: 618764 - RNA, 22 nt, Human
gcuggcagcauuagacccuggg

SEQ ID NO: 618765 - RNA, 19 nt, Human
gcccaggggcccgaugcug

SEQ ID NO: 618766 - RNA, 22 nt, Human
ugaagauauuuuaaaauacuga

SEQ ID NO: 618767 - RNA, 22 nt, Human
cuguggaguccuggggaaugga

SEQ ID NO: 618768 - RNA, 22 nt, Human
gcauggccuugugcuccuucuc

SEQ ID NO: 618769 - RNA, 17 nt, Human
uaaauacacaaggguau

SEQ ID NO: 618770 - RNA, 22 nt, Human
uuugaagagccacagugaaauu

SEQ ID NO: 618771 - RNA, 22 nt, Human
gccaggucuggguagcagagga

SEQ ID NO: 618772 - RNA, 22 nt, Human
agacagggagggagcgcggcug

SEQ ID NO: 618773 - RNA, 22 nt, Human
guuuacaguggcuucauuggau

SEQ ID NO: 618774 - RNA, 22 nt, Human
gcugggcuccaggccaggguga

SEQ ID NO: 618775 - RNA, 21 nt, Human
agggccagaucaccaaggagc

SEQ ID NO: 618776 - RNA, 22 nt, Human
uucugugugccagaguugugcu

SEQ ID NO: 618777 - RNA, 19 nt, Human
uggcucuuuuuaugacauu

SEQ ID NO: 618778 - RNA, 22 nt, Human
uaacucugaauccucacagcag

SEQ ID NO: 618779 - RNA, 22 nt, Human
gaaggccugugguagugagacg

SEQ ID NO: 618780 - RNA, 22 nt, Human
caguaaauuuuauuugugggug

SEQ ID NO: 618781 - RNA, 22 nt, Human
uacacaaaggcacucuguuguu

SEQ ID NO: 618782 - RNA, 22 nt, Human
gggccuggugcuucugacuccu

SEQ ID NO: 618783 - RNA, 22 nt, Human
uuuauuuauccuucuggauugc

SEQ ID NO: 618784 - RNA, 22 nt, Human
ccugggagagccaucuguggcc

SEQ ID NO: 618785 - RNA, 23 nt, Human
gcaguguuugcuucaucuuaucc

SEQ ID NO: 618786 - RNA, 22 nt, Human
ugucacuuuggccaagccauug

SEQ ID NO: 618787 - RNA, 22 nt, Human
ugaaagaagugucacauugcca

SEQ ID NO: 618788 - RNA, 19 nt, Human
gacuccaacuuuaagcaug

SEQ ID NO: 618789 - RNA, 22 nt, Human
uauuacaaauuauaaugggaga

SEQ ID NO: 618790 - RNA, 22 nt, Human
gagcucauccccaugguccguc

SEQ ID NO: 618791 - RNA, 20 nt, Human
cucuuuguuggcaaacucuu

SEQ ID NO: 618792 - RNA, 17 nt, Human
ucagcaggggccaagcu

SEQ ID NO: 618793 - RNA, 22 nt, Human
uggcagguagaguucugagaug

SEQ ID NO: 618794 - RNA, 22 nt, Human
uugaagaucuuugcauugcagg

SEQ ID NO: 618795 - RNA, 22 nt, Human
ccagcuggcccagcugugcucc

SEQ ID NO: 618796 - RNA, 22 nt, Human
ugcugaaauuagaacauugagg

SEQ ID NO: 618797 - RNA, 22 nt, Human
gaagaucagaguaagcuuuuua

SEQ ID NO: 618798 - RNA, 22 nt, Human
aagugggaauagaaaugaaggu

SEQ ID NO: 618799 - RNA, 22 nt, Human
cuuugggcaaagggccaauucg

SEQ ID NO: 618800 - RNA, 22 nt, Human
ggaugggcccgggacggcgcug

SEQ ID NO: 618801 - RNA, 20 nt, Human
uccaagcccuccuuccauuc

SEQ ID NO: 618802 - RNA, 22 nt, Human
agaaugugugauugaagcucuu

SEQ ID NO: 618803 - RNA, 23 nt, Human
ugcagccacucaggagcucagug

SEQ ID NO: 618804 - RNA, 22 nt, Human
cuggaagggaaaucucuuggca

SEQ ID NO: 618805 - RNA, 22 nt, Human
gaauuagacaugcuuugcuuuu

SEQ ID NO: 618806 - RNA, 22 nt, Human
cagggugccucccgcucgccgg

SEQ ID NO: 618807 - RNA, 22 nt, Human
ccaguguuuccgucaguacacg

SEQ ID NO: 618808 - RNA, 18 nt, Human
cuucauuuguagaguucc

SEQ ID NO: 618809 - RNA, 22 nt, Human
gcauuucugugcauacacauga

SEQ ID NO: 618810 - RNA, 22 nt, Human
acaguguuuuaugagaauuguu

SEQ ID NO: 618811 - RNA, 22 nt, Human
ugccagggcugcuacuggcuga

SEQ ID NO: 618812 - RNA, 22 nt, Human
caagguaguucuggucauugac

SEQ ID NO: 618813 - RNA, 22 nt, Human
ggcugcaggaacgacggagggg

SEQ ID NO: 618814 - RNA, 22 nt, Human
auaaugagcuuuugaauacuga

SEQ ID NO: 618815 - RNA, 22 nt, Human
ggagucuuaaaaaucaaaugga

SEQ ID NO: 618816 - RNA, 22 nt, Human
ccaguguuacggcuugaacuau

SEQ ID NO: 618817 - RNA, 22 nt, Human
uucaggugucaaggauaggcug

SEQ ID NO: 618818 - RNA, 22 nt, Human
gcuagcuuuauaaugcugggcg

SEQ ID NO: 618819 - RNA, 21 nt, Human
uucagcuuaugugucacuugc

SEQ ID NO: 618820 - RNA, 20 nt, Human
cucagcucuucagggcaagu

SEQ ID NO: 618821 - RNA, 22 nt, Human
ggugcagggagaggcaggcccc

SEQ ID NO: 618822 - RNA, 22 nt, Human
gcauaugaucacgugugucggu

SEQ ID NO: 618823 - RNA, 22 nt, Human
cucaaaagacuuaaacauaaga

SEQ ID NO: 618824 - RNA, 22 nt, Human
aagcacugagcacaguggcuga

SEQ ID NO: 618825 - RNA, 22 nt, Human
uacugugugauuccauuuacgu

SEQ ID NO: 618826 - RNA, 22 nt, Human
ugauuuaaaagaaacauugucu

SEQ ID NO: 618827 - RNA, 22 nt, Human
cagcuauuauuuucucuaaauu

SEQ ID NO: 618828 - RNA, 22 nt, Human
ucagcucucugggcucgaaccu

SEQ ID NO: 618829 - RNA, 22 nt, Human
guuuuggcucuggcauguggaa

SEQ ID NO: 618830 - RNA, 23 nt, Human
uuucacaaugagcauuacagaau

SEQ ID NO: 618831 - RNA, 23 nt, Human
uugagcucaguagcucugcuggu

SEQ ID NO: 618832 - RNA, 22 nt, Human
gggcauguacauaaucuagaaa

SEQ ID NO: 618833 - RNA, 23 nt, Human
agcuccagcugacgugggcagcc

SEQ ID NO: 618834 - RNA, 21 nt, Human
agcuggcucucucuggagaga

SEQ ID NO: 618835 - RNA, 22 nt, Human
uacuguguggugagcugucucc

SEQ ID NO: 618836 - RNA, 20 nt, Human
ugcugcuuugccacuaguug

SEQ ID NO: 618837 - RNA, 22 nt, Human
aauaugcauguauacaugugua

SEQ ID NO: 618838 - RNA, 22 nt, Human
ccagaggagcaggcuggcucca

SEQ ID NO: 618839 - RNA, 21 nt, Human
uggcaggcagcuggaagcuug

SEQ ID NO: 618840 - RNA, 22 nt, Human
uaauauuucuacccugcugccu

SEQ ID NO: 618841 - RNA, 21 nt, Human
ucccauuguuccccuccagug

SEQ ID NO: 618842 - RNA, 22 nt, Human
ugggccacggggguggagagcu

SEQ ID NO: 618843 - RNA, 22 nt, Human
ucagcaggcaggaggcaugcca

SEQ ID NO: 618844 - RNA, 18 nt, Human
uccagagcuacuguggug

SEQ ID NO: 618845 - RNA, 22 nt, Human
agagauugugcuacucacccaa

SEQ ID NO: 618846 - RNA, 22 nt, Human
uccuggguuaauuaugauucac

SEQ ID NO: 618847 - RNA, 22 nt, Human
gccacaggcacuuaagggcugg

SEQ ID NO: 618848 - RNA, 21 nt, Human
ggcccugguuacgccuccucu

SEQ ID NO: 618849 - RNA, 22 nt, Human
cauguguuaaucuuucugcaaa

SEQ ID NO: 618850 - RNA, 22 nt, Human
uguaagccuucccugagaaagu

SEQ ID NO: 618851 - RNA, 22 nt, Human
cagagccucucagaggucagac

SEQ ID NO: 618852 - RNA, 22 nt, Human
guccaggcugcccaggguccug

SEQ ID NO: 618853 - RNA, 22 nt, Human
accuguuuggaggagguguuag

SEQ ID NO: 618854 - RNA, 22 nt, Human
aguuccagaacuggaaaaggac

SEQ ID NO: 618855 - RNA, 22 nt, Human
ucugggagagcacguggcugac

SEQ ID NO: 618856 - RNA, 22 nt, Human
uccucccugaguggggacagcu

SEQ ID NO: 618857 - RNA, 19 nt, Human
agggcuuugugugcugcuc

SEQ ID NO: 618858 - RNA, 22 nt, Human
uuugcaaaugcucugcagagcu

SEQ ID NO: 618859 - RNA, 22 nt, Human
ugcaaguaacuuguuugggagg

SEQ ID NO: 618860 - RNA, 22 nt, Human
uguguggcaagcuguaugcuag

SEQ ID NO: 618861 - RNA, 22 nt, Human
ggcaggucaucaacuguaauuu

SEQ ID NO: 618862 - RNA, 22 nt, Human
acugaggacagugaggagggcu

SEQ ID NO: 618863 - RNA, 22 nt, Human
ccaguguggccaggugcuggua

SEQ ID NO: 618864 - RNA, 22 nt, Human
aaauggaguucuaaguauagua

SEQ ID NO: 618865 - RNA, 22 nt, Human
aagauauucaaagauuuauuag

SEQ ID NO: 618866 - RNA, 17 nt, Human
gcauguaguacauguaa

SEQ ID NO: 618867 - RNA, 22 nt, Human
auucauuugcuauuguguaugg

SEQ ID NO: 618868 - RNA, 22 nt, Human
gcaguguuuguguucucacaug

SEQ ID NO: 618869 - RNA, 22 nt, Human
ugggaguccaaggcaggcggau

SEQ ID NO: 618870 - RNA, 21 nt, Human
gggcagaggggccuccugggu

SEQ ID NO: 618871 - RNA, 18 nt, Human
aaauuagauggaccugug

SEQ ID NO: 618872 - RNA, 22 nt, Human
agggcugaguggugcagucaaa

SEQ ID NO: 618873 - RNA, 22 nt, Human
aggaagcauguuggauccacuu

SEQ ID NO: 618874 - RNA, 22 nt, Human
agcagccaaccuuacauucauc

SEQ ID NO: 618875 - RNA, 22 nt, Human
cauggccagggagagagaaugu

SEQ ID NO: 618876 - RNA, 22 nt, Human
acauuaacaccauaaguguguu

SEQ ID NO: 618877 - RNA, 22 nt, Human
acauuaacaccgugaguuuggu

SEQ ID NO: 618878 - RNA, 22 nt, Human
cccuuuaaguagaauauauuau

SEQ ID NO: 618879 - RNA, 22 nt, Human
acugggccuugccauggcagcc

SEQ ID NO: 618880 - RNA, 22 nt, Human
acauuuuuauucaucaaagcag

SEQ ID NO: 618881 - RNA, 22 nt, Human
uauguacauaacaugaaaugca

SEQ ID NO: 618882 - RNA, 20 nt, Human
ucagccuugaaugcuugaaa

SEQ ID NO: 618883 - RNA, 22 nt, Human
ggacaaaggguggagccucuga

SEQ ID NO: 618884 - RNA, 22 nt, Human
accagggcuuacagcaguagcu

SEQ ID NO: 618885 - RNA, 22 nt, Human
uuucagagaugcagaauucagg

SEQ ID NO: 618886 - RNA, 22 nt, Human
uugcccugucucacuauguuaa

SEQ ID NO: 618887 - RNA, 22 nt, Human
ugcuugcaagagaugcaaugac

SEQ ID NO: 618888 - RNA, 22 nt, Human
cagaggcgaggcagcugaaccu

SEQ ID NO: 618889 - RNA, 22 nt, Human
aauuuucacagugcugugagau

SEQ ID NO: 618890 - RNA, 22 nt, Human
agugacaaggugguaaugaagc

SEQ ID NO: 618891 - RNA, 22 nt, Human
guggagaggaacccagcucugu

SEQ ID NO: 618892 - RNA, 22 nt, Human
cuucaauaccugcguugcuagu

SEQ ID NO: 618893 - RNA, 22 nt, Human
cugggcugcaguuccugguccu

SEQ ID NO: 618894 - RNA, 22 nt, Human
gcugaggcucaagucauggguc

SEQ ID NO: 618895 - RNA, 22 nt, Human
caggcaggagccagggauucca

SEQ ID NO: 618896 - RNA, 22 nt, Human
cuuccuggcucggugccucacc

SEQ ID NO: 618897 - RNA, 22 nt, Human
cuggaagggucuacuuagcaga

SEQ ID NO: 618898 - RNA, 22 nt, Human
ucuuggcugcagagccggcaag

SEQ ID NO: 618899 - RNA, 22 nt, Human
ucuucuuuggaugaaagaauau

SEQ ID NO: 618900 - RNA, 22 nt, Human
ccagggaagauuagaagccacu

SEQ ID NO: 618901 - RNA, 22 nt, Human
caaaaggcaggggaaagagugc

SEQ ID NO: 618902 - RNA, 22 nt, Human
uggagucaucuuaaucuaggca

SEQ ID NO: 618903 - RNA, 22 nt, Human
ucucuucuuuggggugggcuca

SEQ ID NO: 618904 - RNA, 22 nt, Human
cucuuuuucaccucugucagcg

SEQ ID NO: 618905 - RNA, 22 nt, Human
agcacagauggauguauucauu

SEQ ID NO: 618906 - RNA, 22 nt, Human
cugagcugcucccgcugcagcg

SEQ ID NO: 618907 - RNA, 18 nt, Human
aggcugcacugucuuaaa

SEQ ID NO: 618908 - RNA, 22 nt, Human
gggcaaguccggugcccagagc

SEQ ID NO: 618909 - RNA, 22 nt, Human
acaggaaaugaaaugguaucua

SEQ ID NO: 618910 - RNA, 22 nt, Human
gaagguccagcguggccaaguc

SEQ ID NO: 618911 - RNA, 22 nt, Human
guccagugcuuauagaaucagu

SEQ ID NO: 618912 - RNA, 22 nt, Human
caggcugggacugaccccugcu

SEQ ID NO: 618913 - RNA, 22 nt, Human
uccugcaggccuguucccagua

SEQ ID NO: 618914 - RNA, 22 nt, Human
agaaagacgugaugaagaagua

SEQ ID NO: 618915 - RNA, 22 nt, Human
gugcagguuuaggaagcagcuc

SEQ ID NO: 618916 - RNA, 22 nt, Human
uguguucauguauguauacaua

SEQ ID NO: 618917 - RNA, 22 nt, Human
uagguucacacaucuuccagau

SEQ ID NO: 618918 - RNA, 22 nt, Human
aggaugagccgcgcaagcugac

SEQ ID NO: 618919 - RNA, 22 nt, Human
gguugguaacucccugugcagu

SEQ ID NO: 618920 - RNA, 22 nt, Human
ggaggugguggcagugacaauu

SEQ ID NO: 618921 - RNA, 18 nt, Human
gcucuggcucaccuccag

SEQ ID NO: 618922 - RNA, 22 nt, Human
ccugggagugucagacuugcuu

SEQ ID NO: 618923 - RNA, 22 nt, Human
agggggugaaugucugucuaca

SEQ ID NO: 618924 - RNA, 22 nt, Human
uucacaguggcccucucugagu

SEQ ID NO: 618925 - RNA, 22 nt, Human
aaagugggaacaauggagagug

SEQ ID NO: 618926 - RNA, 22 nt, Human
ccagaggcuggggaaggauaca

SEQ ID NO: 618927 - RNA, 22 nt, Human
cugcccugcuugaugacagcga

SEQ ID NO: 618928 - RNA, 22 nt, Human
cuggcuccaaauucugauguuc

SEQ ID NO: 618929 - RNA, 22 nt, Human
auuucuguggcuucauucuccu

SEQ ID NO: 618930 - RNA, 22 nt, Human
ccucuggcaacuucacagccca

SEQ ID NO: 618931 - RNA, 22 nt, Human
aaagccagaguguguuagagac

SEQ ID NO: 618932 - RNA, 22 nt, Human
agguccagguuccguuucugcg

SEQ ID NO: 618933 - RNA, 22 nt, Human
uccugggccuguacuccauccg

SEQ ID NO: 618934 - RNA, 22 nt, Human
ggcagguggaaguuggcagagc

SEQ ID NO: 618935 - RNA, 22 nt, Human
uccugagguggauugagcagag

SEQ ID NO: 618936 - RNA, 22 nt, Human
gcuggcuguuggagguaccugc

SEQ ID NO: 618937 - RNA, 22 nt, Human
guccagugacaaguagcuggcc

SEQ ID NO: 618938 - RNA, 22 nt, Human
uuccuccacgugacaggagcca

SEQ ID NO: 618939 - RNA, 22 nt, Human
gcggggggcaggcaguacguug

SEQ ID NO: 618940 - RNA, 23 nt, Human
gcagagucaaguagucaugagug

SEQ ID NO: 618941 - RNA, 22 nt, Human
gccuggaggggacagucucugg

SEQ ID NO: 618942 - RNA, 22 nt, Human
uaguguuuaguacauaugcaua

SEQ ID NO: 618943 - RNA, 22 nt, Human
cugcccugccuggccagugugg

SEQ ID NO: 618944 - RNA, 19 nt, Human
cagcucaguuugauucucu

SEQ ID NO: 618945 - RNA, 22 nt, Human
ccaggaguuugaggcugcagug

SEQ ID NO: 618946 - RNA, 22 nt, Human
cucccugcuuguuucccuucag

SEQ ID NO: 618947 - RNA, 22 nt, Human
cuucacaauucuaacagggcaa

SEQ ID NO: 618948 - RNA, 22 nt, Human
ugccuccuucaggagggcccgg

SEQ ID NO: 618949 - RNA, 22 nt, Human
ucuucuuugaaucauagugacc

SEQ ID NO: 618950 - RNA, 22 nt, Human
uugauucagaaaaagauggaga

SEQ ID NO: 618951 - RNA, 22 nt, Human
uuucuagaaacauuaucucuau

SEQ ID NO: 618952 - RNA, 22 nt, Human
accugccagaaugcuaguccug

SEQ ID NO: 618953 - RNA, 22 nt, Human
ccaguguuugaugggauuuuca

SEQ ID NO: 618954 - RNA, 22 nt, Human
uggaaacagaucauaacuaagc

SEQ ID NO: 618955 - RNA, 22 nt, Human
gcaaguagugggaaagaagaug

SEQ ID NO: 618956 - RNA, 22 nt, Human
gcccagcugagaagcgcggggc

SEQ ID NO: 618957 - RNA, 22 nt, Human
gcuggcuguguuucaucucuga

SEQ ID NO: 618958 - RNA, 23 nt, Human
cucaccaagcgccgccgcugugu

SEQ ID NO: 618959 - RNA, 22 nt, Human
uugcuuuuuaauuaggaggcag

SEQ ID NO: 618960 - RNA, 22 nt, Human
aauaugcagcaugaugaaguaa

SEQ ID NO: 618961 - RNA, 22 nt, Human
guaccagucucugugggcaccu

SEQ ID NO: 618962 - RNA, 20 nt, Human
cagugcaacugaagaacuga

SEQ ID NO: 618963 - RNA, 22 nt, Human
ggcaggcaacggaccacuaguc

SEQ ID NO: 618964 - RNA, 22 nt, Human
ggccaggcacugugugagauau

SEQ ID NO: 618965 - RNA, 22 nt, Human
uggaaacacucaagcuuauauu

SEQ ID NO: 618966 - RNA, 22 nt, Human
aauauagaaucacuuuccuuca

SEQ ID NO: 618967 - RNA, 22 nt, Human
ucacucucuaagcaugacagac

SEQ ID NO: 618968 - RNA, 18 nt, Human
ggccugaggauuucagca

SEQ ID NO: 618969 - RNA, 22 nt, Human
gugcaaaaaucuaucaccagca

SEQ ID NO: 618970 - RNA, 22 nt, Human
uuucuuuuacaguguggcuauu

SEQ ID NO: 618971 - RNA, 22 nt, Human
gaaauauuguacuggagauguu

SEQ ID NO: 618972 - RNA, 22 nt, Human
aaagauguuaugaaauaacuau

SEQ ID NO: 618973 - RNA, 22 nt, Human
guauuuuuaguagagucggggu

SEQ ID NO: 618974 - RNA, 22 nt, Human
gccaggcuaagaaaggugugau

SEQ ID NO: 618975 - RNA, 22 nt, Human
ccucuggcuguaccacuggcac

SEQ ID NO: 618976 - RNA, 22 nt, Human
uggaaggcuuugcuguccuugc

SEQ ID NO: 618977 - RNA, 22 nt, Human
gucagaggaauggaugagugau

SEQ ID NO: 618978 - RNA, 19 nt, Human
uggcagguagugagcaguc

SEQ ID NO: 618979 - RNA, 22 nt, Human
cuguggcugaacucugaagagg

SEQ ID NO: 618980 - RNA, 22 nt, Human
acaguguuuugucuggcagggc

SEQ ID NO: 618981 - RNA, 20 nt, Human
ggguccaggacucugaauuu

SEQ ID NO: 618982 - RNA, 22 nt, Human
gugcccugaugcaauugucuca

SEQ ID NO: 618983 - RNA, 22 nt, Human
uaacuucugcacagaaaauuug

SEQ ID NO: 618984 - RNA, 22 nt, Human
uccuaggaaguggaggcaccug

SEQ ID NO: 618985 - RNA, 22 nt, Human
gguccagaguccuugcuagaga

SEQ ID NO: 618986 - RNA, 22 nt, Human
acauacauggauucauggauuc

SEQ ID NO: 618987 - RNA, 22 nt, Human
auagcaaagccuggcacaauga

SEQ ID NO: 618988 - RNA, 22 nt, Human
auagcagaaaccaagcuucuuc

SEQ ID NO: 618989 - RNA, 22 nt, Human
ucagcaggcucugguugaccau

SEQ ID NO: 618990 - RNA, 22 nt, Human
aggcaguguauugcuagcggcu

SEQ ID NO: 618991 - RNA, 21 nt, Human
aguuuccucaacugcagaagg

SEQ ID NO: 618992 - RNA, 22 nt, Human
aaacuuguucucuugugccuau

SEQ ID NO: 618993 - RNA, 22 nt, Human
cagccucuaagcacagccucuc

SEQ ID NO: 618994 - RNA, 22 nt, Human
aguaacaaagugggagaaugau

SEQ ID NO: 618995 - RNA, 23 nt, Human
aggauguaggauguauggcagag

SEQ ID NO: 618996 - RNA, 22 nt, Human
cagguacacaggacaaaguacu

SEQ ID NO: 618997 - RNA, 22 nt, Human
ugcugggccaaagcaggguuuu

SEQ ID NO: 618998 - RNA, 22 nt, Human
ucaguguuggagauaauugcac

SEQ ID NO: 618999 - RNA, 22 nt, Human
cagguccaagguuccugaauag

SEQ ID NO: 619000 - RNA, 22 nt, Human
gggugccacagagcuuccacuu

SEQ ID NO: 619001 - RNA, 22 nt, Human
cuacagguaugugcaugacauc

SEQ ID NO: 619002 - RNA, 22 nt, Human
gagucugugguauuuuaucaua

SEQ ID NO: 619003 - RNA, 22 nt, Human
aggucacaggguugaaguacuu

SEQ ID NO: 619004 - RNA, 22 nt, Human
uguguucugaaggagaagagug

SEQ ID NO: 619005 - RNA, 22 nt, Human
acaacagagcuggacugagagg

SEQ ID NO: 619006 - RNA, 22 nt, Human
cagguggccuugccaucuccug

SEQ ID NO: 619007 - RNA, 22 nt, Human
uggagggcaugcuguccauggg

SEQ ID NO: 619008 - RNA, 22 nt, Human
gguggccaggccagcucuggcc

SEQ ID NO: 619009 - RNA, 22 nt, Human
accuguuuguguccauuaguga

SEQ ID NO: 619010 - RNA, 22 nt, Human
auuacuuucagaugugcuguaa

SEQ ID NO: 619011 - RNA, 22 nt, Human
uccugagggcgauucagcaggu

SEQ ID NO: 619012 - RNA, 22 nt, Human
uagugcaaaggucuugcaccag

SEQ ID NO: 619013 - RNA, 22 nt, Human
gcugaggcucaauccccuucug

SEQ ID NO: 619014 - RNA, 22 nt, Human
gcuguggcuuucuguuucuguu

SEQ ID NO: 619015 - RNA, 22 nt, Human
ugugugaacauguuuucauuuc

SEQ ID NO: 619016 - RNA, 22 nt, Human
guguccugccacccugggcuuu

SEQ ID NO: 619017 - RNA, 22 nt, Human
uccugguggugccagcugcagg

SEQ ID NO: 619018 - RNA, 22 nt, Human
gccugggagauuaauuaggaag

SEQ ID NO: 619019 - RNA, 21 nt, Human
ugaaacaaucagacagagucu

SEQ ID NO: 619020 - RNA, 17 nt, Human
caguggucugagguaug

SEQ ID NO: 619021 - RNA, 22 nt, Human
cugcccuggcagccuaccaugg

SEQ ID NO: 619022 - RNA, 21 nt, Human
agcaggucuacagguucauag

SEQ ID NO: 619023 - RNA, 22 nt, Human
ggcuuuauaggguagaggauca

SEQ ID NO: 619024 - RNA, 20 nt, Human
uccuggagcugcuugaauuc

SEQ ID NO: 619025 - RNA, 19 nt, Human
uccugcagaccagaccugu

SEQ ID NO: 619026 - RNA, 22 nt, Human
ggcaggucagguccaugaccaa

SEQ ID NO: 619027 - RNA, 23 nt, Human
ugaggaccucucaggggccaggc

SEQ ID NO: 619028 - RNA, 18 nt, Human
agcuggcccuggcugccg

SEQ ID NO: 619029 - RNA, 22 nt, Human
cuuggacuuuagucucucucca

SEQ ID NO: 619030 - RNA, 19 nt, Human
agccaggguccagacaugu

SEQ ID NO: 619031 - RNA, 22 nt, Human
uuuuauuaucuuugaaugggac

SEQ ID NO: 619032 - RNA, 22 nt, Human
ugccucugugugcaggugagca

SEQ ID NO: 619033 - RNA, 22 nt, Human
ucaaaaauguuuuauauuggua

SEQ ID NO: 619034 - RNA, 22 nt, Human
ggcuuuauguuuuucauguggu

SEQ ID NO: 619035 - RNA, 22 nt, Human
ugcaaguaugacagccccaugg

SEQ ID NO: 619036 - RNA, 22 nt, Human
ugaagcaggugaauggaugucg

SEQ ID NO: 619037 - RNA, 22 nt, Human
ggcucuucuguuucacaggcca

SEQ ID NO: 619038 - RNA, 19 nt, Human
cgccuggcaggcccugcgc

SEQ ID NO: 619039 - RNA, 22 nt, Human
ccagguggcuucugcccgaugu

SEQ ID NO: 619040 - RNA, 22 nt, Human
ccagaggaugcuggucagccuc

SEQ ID NO: 619041 - RNA, 22 nt, Human
gcagggugacguugcccaccuc

SEQ ID NO: 619042 - RNA, 22 nt, Human
ucuguuuugugucucucuggug

SEQ ID NO: 619043 - RNA, 22 nt, Human
ccuugugcagguucaugauggg

SEQ ID NO: 619044 - RNA, 22 nt, Human
uuuguugaguuacagagaugaa

SEQ ID NO: 619045 - RNA, 22 nt, Human
ccagugugaaccucaccacccu

SEQ ID NO: 619046 - RNA, 22 nt, Human
uaaguagacuguugaacuuggu

SEQ ID NO: 619047 - RNA, 22 nt, Human
auguccagaggugagucagagc

SEQ ID NO: 619048 - RNA, 22 nt, Human
ugauucaacuuucuugaaugca

SEQ ID NO: 619049 - RNA, 22 nt, Human
uggacuccagugucuguguucu

SEQ ID NO: 619050 - RNA, 22 nt, Human
agccagggaugcagcacaguga

SEQ ID NO: 619051 - RNA, 22 nt, Human
ugcacuccaggcugggugacag

SEQ ID NO: 619052 - RNA, 22 nt, Human
aagaaaacaaugacuugccagc

SEQ ID NO: 619053 - RNA, 22 nt, Human
augugugugcauuucucucccu

SEQ ID NO: 619054 - RNA, 22 nt, Human
agugggagcggcagucggggac

SEQ ID NO: 619055 - RNA, 22 nt, Human
acuggacagaggaaauauggag

SEQ ID NO: 619056 - RNA, 22 nt, Human
cuguggcuucugggucaguuca

SEQ ID NO: 619057 - RNA, 22 nt, Human
uuuguauaagaacauucuagca

SEQ ID NO: 619058 - RNA, 22 nt, Human
guuuuauaggugaaauauuacu

SEQ ID NO: 619059 - RNA, 22 nt, Human
cuccugcugaauggccaggagc

SEQ ID NO: 619060 - RNA, 22 nt, Human
caggcucacuuucucagucaca

SEQ ID NO: 619061 - RNA, 22 nt, Human
gaagccagauuaucacaagcca

SEQ ID NO: 619062 - RNA, 22 nt, Human
uugacguccucgauggggaacu

SEQ ID NO: 619063 - RNA, 22 nt, Human
gcuggaaggcuaggcucaguug

SEQ ID NO: 619064 - RNA, 22 nt, Human
caggccaggugcucuagaauca

SEQ ID NO: 619065 - RNA, 22 nt, Human
guccuggggauacagaagugaa

SEQ ID NO: 619066 - RNA, 22 nt, Human
cgguccagagcuaguucauugc

SEQ ID NO: 619067 - RNA, 22 nt, Human
ccuggcacugaccaggcacuga

SEQ ID NO: 619068 - RNA, 22 nt, Human
aaagcacaugaguaguguagua

SEQ ID NO: 619069 - RNA, 22 nt, Human
uggcaggaaauacccugccuag

SEQ ID NO: 619070 - RNA, 22 nt, Human
gagcagcuugcgcugucuucac

SEQ ID NO: 619071 - RNA, 22 nt, Human
aggagggcaggcuggcugccua

SEQ ID NO: 619072 - RNA, 22 nt, Human
uucagaaagugaaucuuguuau

SEQ ID NO: 619073 - RNA, 22 nt, Human
uuccaugugaguacacugugau

SEQ ID NO: 619074 - RNA, 22 nt, Human
agcagggaggucuagcacgugg

SEQ ID NO: 619075 - RNA, 22 nt, Human
gcgggggcggcgcagaccucag

SEQ ID NO: 619076 - RNA, 22 nt, Human
augacuucugcaaggucauuug

SEQ ID NO: 619077 - RNA, 22 nt, Human
aucucuggccuuccuuuuccaa

SEQ ID NO: 619078 - RNA, 22 nt, Human
cagguucccuugcagcuaagug

SEQ ID NO: 619079 - RNA, 22 nt, Human
aaacacuucuuaggucuuaagu

SEQ ID NO: 619080 - RNA, 22 nt, Human
uuaaaaugcagauuaugacuca

SEQ ID NO: 619081 - RNA, 22 nt, Human
uuuccuugccuccuguccuucu

SEQ ID NO: 619082 - RNA, 22 nt, Human
aguuucuuuagauagaaaguuc

SEQ ID NO: 619083 - RNA, 22 nt, Human
uggcaggugccuguaaucucag

SEQ ID NO: 619084 - RNA, 22 nt, Human
cugggcaggagggcucuaugga

SEQ ID NO: 619085 - RNA, 22 nt, Human
caggcccauaaugcaaauauuu

SEQ ID NO: 619086 - RNA, 17 nt, Human
uccagagcacagagcuc

SEQ ID NO: 619087 - RNA, 22 nt, Human
acucagaguuuuacccagagac

SEQ ID NO: 619088 - RNA, 22 nt, Human
guccagcccgggcuccgccagc

SEQ ID NO: 619089 - RNA, 22 nt, Human
uguggagcucagaaguagcagu

SEQ ID NO: 619090 - RNA, 22 nt, Human
caacugaaaagauucuacgcag

SEQ ID NO: 619091 - RNA, 22 nt, Human
agguucaguaaauguuaguuga

SEQ ID NO: 619092 - RNA, 22 nt, Human
uuguuucugaguuuucauguau

SEQ ID NO: 619093 - RNA, 17 nt, Human
ugguccagguggagcca

SEQ ID NO: 619094 - RNA, 22 nt, Human
ucuguggcuuccuauuucuugg

SEQ ID NO: 619095 - RNA, 22 nt, Human
uuuacaaguuuacagaaugaug

SEQ ID NO: 619096 - RNA, 22 nt, Human
ccuuuaaagacugcauaacuuc

SEQ ID NO: 619097 - RNA, 22 nt, Human
ggcaagucaggaaguugacauu

SEQ ID NO: 619098 - RNA, 22 nt, Human
aggucaaggcugcagugagcug

SEQ ID NO: 619099 - RNA, 22 nt, Human
gacccugauaggaguagaagaa

SEQ ID NO: 619100 - RNA, 23 nt, Human
agcuccagaacauagcacaggaa

SEQ ID NO: 619101 - RNA, 22 nt, Human
gaugcgggcccgcuccacugcc

SEQ ID NO: 619102 - RNA, 22 nt, Human
aggucuaggagucugaaaguau

SEQ ID NO: 619103 - RNA, 22 nt, Human
gccaggcuggugucacaacucu

SEQ ID NO: 619104 - RNA, 22 nt, Human
cucccugugucuucacuuggcc

SEQ ID NO: 619105 - RNA, 22 nt, Human
uccuguuuaggcuguggucugg

SEQ ID NO: 619106 - RNA, 19 nt, Human
ucucuucucccugguuuua

SEQ ID NO: 619107 - RNA, 22 nt, Human
agggaaauaaucuauucugagg

SEQ ID NO: 619108 - RNA, 22 nt, Human
gaggagagaagcuaacggugcu

SEQ ID NO: 619109 - RNA, 17 nt, Human
ccaggugggaggugggg

SEQ ID NO: 619110 - RNA, 18 nt, Human
uggcagguccagcugugg

SEQ ID NO: 619111 - RNA, 22 nt, Human
cuacaggucaagcaguagcucu

SEQ ID NO: 619112 - RNA, 22 nt, Human
auccugggaaguggccuccucc

SEQ ID NO: 619113 - RNA, 22 nt, Human
aacaucugaucgaacagugcca

SEQ ID NO: 619114 - RNA, 18 nt, Human
aaguagaucaugagccac

SEQ ID NO: 619115 - RNA, 22 nt, Human
aggagaauuaggaacucaagau

SEQ ID NO: 619116 - RNA, 22 nt, Human
aagcagcuuucuuuccugugaa

SEQ ID NO: 619117 - RNA, 22 nt, Human
uauugaauuagacccuaaaaug

SEQ ID NO: 619118 - RNA, 22 nt, Human
agguacagggugaaaguuuaug

SEQ ID NO: 619119 - RNA, 22 nt, Human
cuccagugagugagcaggcgac

SEQ ID NO: 619120 - RNA, 22 nt, Human
guuuguugauaugccccuuugu

SEQ ID NO: 619121 - RNA, 22 nt, Human
auggccagucaagccucuggcu

SEQ ID NO: 619122 - RNA, 22 nt, Human
acacacaauuaguuuuaugcuu

SEQ ID NO: 619123 - RNA, 22 nt, Human
auacaguagacaaucucaugaa

SEQ ID NO: 619124 - RNA, 22 nt, Human
gcuuccucccugcugcucacua

SEQ ID NO: 619125 - RNA, 22 nt, Human
aggcaggugcuuaugacuugcu

SEQ ID NO: 619126 - RNA, 22 nt, Human
ucauuucugagccuuccaugau

SEQ ID NO: 619127 - RNA, 23 nt, Human
ggccacugaauuuucugcaucuu

SEQ ID NO: 619128 - RNA, 22 nt, Human
uuggaagggaaccgaguuugcu

SEQ ID NO: 619129 - RNA, 21 nt, Human
ccucugugcuaaagggcuccc

SEQ ID NO: 619130 - RNA, 22 nt, Human
cuucauuucaggcugaagaaua

SEQ ID NO: 619131 - RNA, 22 nt, Human
caucucaguguacagggagucu

SEQ ID NO: 619132 - RNA, 23 nt, Human
guccuagugcuuggugcccaggc

SEQ ID NO: 619133 - RNA, 22 nt, Human
uuuucaggugcaguaaucauau

SEQ ID NO: 619134 - RNA, 22 nt, Human
uuagaggugucaggagcacagg

SEQ ID NO: 619135 - RNA, 22 nt, Human
uuugcaaauaaauaagugcucg

SEQ ID NO: 619136 - RNA, 22 nt, Human
aaggcaggaugggaaaagauuu

SEQ ID NO: 619137 - RNA, 22 nt, Human
gccugggauuguguaagugaau

SEQ ID NO: 619138 - RNA, 22 nt, Human
ccugcagggugcugccacagau

SEQ ID NO: 619139 - RNA, 20 nt, Human
agguccuguuccuugucucc

SEQ ID NO: 619140 - RNA, 21 nt, Human
uuguuuccucccaaaaugcca

SEQ ID NO: 619141 - RNA, 21 nt, Human
ggcuggacaucccaggagacu

SEQ ID NO: 619142 - RNA, 22 nt, Human
gagaaugggaaugaaaguagca

SEQ ID NO: 619143 - RNA, 23 nt, Human
ucccuguguacagccugcaugag

SEQ ID NO: 619144 - RNA, 22 nt, Human
gccagaggcccaaggacagcug

SEQ ID NO: 619145 - RNA, 22 nt, Human
ugggagagugcucaaugugcaa

SEQ ID NO: 619146 - RNA, 22 nt, Human
aaauggcuacaagaugugcucu

SEQ ID NO: 619147 - RNA, 22 nt, Human
ugauuuuuagcuauucugaaga

SEQ ID NO: 619148 - RNA, 22 nt, Human
aaagucacuuccuucugucagc

SEQ ID NO: 619149 - RNA, 22 nt, Human
uauuauuaaauggcagaauuuu

SEQ ID NO: 619150 - RNA, 22 nt, Human
agaauauucaucuguauucuua

SEQ ID NO: 619151 - RNA, 22 nt, Human
uugaagucaguucauauuuuua

SEQ ID NO: 619152 - RNA, 22 nt, Human
aaacucuggauuggaguccagc

SEQ ID NO: 619153 - RNA, 16 nt, Human
uggcagguuuuuaucu

SEQ ID NO: 619154 - RNA, 22 nt, Human
cagaagcuuugucuagucuuga

SEQ ID NO: 619155 - RNA, 22 nt, Human
ucaaaacacuauuaccuuuaau

SEQ ID NO: 619156 - RNA, 22 nt, Human
ccugugucaucagcuguggcua

SEQ ID NO: 619157 - RNA, 18 nt, Human
augugagagaaucuucuu

SEQ ID NO: 619158 - RNA, 19 nt, Human
ggcagguagagggccaguc

SEQ ID NO: 619159 - RNA, 22 nt, Human
ugauucaauaggaauugaguag

SEQ ID NO: 619160 - RNA, 22 nt, Human
cugggcugucaauggcccucug

SEQ ID NO: 619161 - RNA, 22 nt, Human
agauugucauugacgaugagca

SEQ ID NO: 619162 - RNA, 22 nt, Human
cuguggaguggggaguacuggu

SEQ ID NO: 619163 - RNA, 22 nt, Human
aaauaagaaauucuucuuugca

SEQ ID NO: 619164 - RNA, 22 nt, Human
ccucccugcuccucaacuggca

SEQ ID NO: 619165 - RNA, 22 nt, Human
aaaaguaauugaugcaaucgua

SEQ ID NO: 619166 - RNA, 22 nt, Human
cauuuguucugauuucaaaagg

SEQ ID NO: 619167 - RNA, 22 nt, Human
ggucaggggcugcucuacagag

SEQ ID NO: 619168 - RNA, 22 nt, Human
cugggcuggacacacuuaaccu

SEQ ID NO: 619169 - RNA, 22 nt, Human
uauuuuacaugauccagaguug

SEQ ID NO: 619170 - RNA, 22 nt, Human
ugcccccugguggccagagccg

SEQ ID NO: 619171 - RNA, 23 nt, Human
aggaggaaaaguuaucugcugag

SEQ ID NO: 619172 - RNA, 22 nt, Human
aggucucacuuuguggaaguga

SEQ ID NO: 619173 - RNA, 22 nt, Human
agccuucagcaguucaggugcc

SEQ ID NO: 619174 - RNA, 19 nt, Human
uggcaggcccaggauggac

SEQ ID NO: 619175 - RNA, 18 nt, Human
auccugggccagucuuuc

SEQ ID NO: 619176 - RNA, 22 nt, Human
cagauaauaauaugacuucacu

SEQ ID NO: 619177 - RNA, 21 nt, Human
ucccacugccacagcuucagg

SEQ ID NO: 619178 - RNA, 20 nt, Human
caguccugcaggcgggagaa

SEQ ID NO: 619179 - RNA, 19 nt, Human
ggcaggcuggauagagagg

SEQ ID NO: 619180 - RNA, 22 nt, Human
uuugucuucccccuuuaaucag

SEQ ID NO: 619181 - RNA, 22 nt, Human
gaagaccacccccuacagcaca

SEQ ID NO: 619182 - RNA, 22 nt, Human
ugucaaaaauaagagagauugu

SEQ ID NO: 619183 - RNA, 22 nt, Human
ucuacagugucaaugugucuug

SEQ ID NO: 619184 - RNA, 22 nt, Human
auggaagguccuacagagcgca

SEQ ID NO: 619185 - RNA, 22 nt, Human
ugugugaauggauuauucuauu

SEQ ID NO: 619186 - RNA, 22 nt, Human
cagaaauguuuguuaauauugu

SEQ ID NO: 619187 - RNA, 22 nt, Human
gugcaaguccagaaagaacucu

SEQ ID NO: 619188 - RNA, 22 nt, Human
cacaguggcaaaggggcuuggg

SEQ ID NO: 619189 - RNA, 21 nt, Human
guagauaaagcauuuucauua

SEQ ID NO: 619190 - RNA, 22 nt, Human
uuucuguuaggcaucauuuuaa

SEQ ID NO: 619191 - RNA, 22 nt, Human
acaguguuuaaaauaauaugcu

SEQ ID NO: 619192 - RNA, 22 nt, Human
uagagaaacagaaccaacaggg

SEQ ID NO: 619193 - RNA, 20 nt, Human
caguccugccccuuggggac

SEQ ID NO: 619194 - RNA, 22 nt, Human
auugaagauuaaaugcuuccuu

SEQ ID NO: 619195 - RNA, 22 nt, Human
gcccuuuguggucagaggccug

SEQ ID NO: 619196 - RNA, 22 nt, Human
gcaccaugauggagccucauua

SEQ ID NO: 619197 - RNA, 22 nt, Human
uguguguuaucuuaguucaucu

SEQ ID NO: 619198 - RNA, 19 nt, Human
cuggccuguguccugugcu

SEQ ID NO: 619199 - RNA, 22 nt, Human
ucucugagcccaauguagcaau

SEQ ID NO: 619200 - RNA, 22 nt, Human
gaggcaguaauugugggcaaua

SEQ ID NO: 619201 - RNA, 22 nt, Human
aaguuuguucauucauucaucc

SEQ ID NO: 619202 - RNA, 22 nt, Human
uggcagguccacucacagaucu

SEQ ID NO: 619203 - RNA, 22 nt, Human
cauauucuguuggucacauaga

SEQ ID NO: 619204 - RNA, 22 nt, Human
guccugggccugcugaggcuga

SEQ ID NO: 619205 - RNA, 22 nt, Human
ggcacuuuucuccccggucaug

SEQ ID NO: 619206 - RNA, 22 nt, Human
aaguuuguagcuggaugucugu

SEQ ID NO: 619207 - RNA, 22 nt, Human
aaguccuguuccucauacuucc

SEQ ID NO: 619208 - RNA, 22 nt, Human
cugcccucccaguugguccgug

SEQ ID NO: 619209 - RNA, 22 nt, Human
agccagggacgcugcaggcuac

SEQ ID NO: 619210 - RNA, 22 nt, Human
agagccugggcagcuccucugg

SEQ ID NO: 619211 - RNA, 22 nt, Human
acuccuggguugcaguccucaa

SEQ ID NO: 619212 - RNA, 22 nt, Human
accugccagaauccaagccaca

SEQ ID NO: 619213 - RNA, 22 nt, Human
gcauggccauggcacuauggac

SEQ ID NO: 619214 - RNA, 22 nt, Human
aguggcaauguagagagugauc

SEQ ID NO: 619215 - RNA, 20 nt, Human
uuauuuguuuacuuuggucc

SEQ ID NO: 619216 - RNA, 22 nt, Human
acagguccuuauaagagcacuc

SEQ ID NO: 619217 - RNA, 22 nt, Human
auguguaugagugugcuucuuu

SEQ ID NO: 619218 - RNA, 22 nt, Human
ugcaagaaugacccaucuaccc

SEQ ID NO: 619219 - RNA, 22 nt, Human
ucugcauauuguuaauggaaug

SEQ ID NO: 619220 - RNA, 19 nt, Human
ucuggcugccaaggauuga

SEQ ID NO: 619221 - RNA, 22 nt, Human
agcaggaaagaaaaaucugugu

SEQ ID NO: 619222 - RNA, 22 nt, Human
ucuggcccugcugcugugagca

SEQ ID NO: 619223 - RNA, 22 nt, Human
gcaguguugagccagcuggggg

SEQ ID NO: 619224 - RNA, 22 nt, Human
uagguucacuuagcugugggaa

SEQ ID NO: 619225 - RNA, 22 nt, Human
uugaaaaguuuugaaacacucu

SEQ ID NO: 619226 - RNA, 22 nt, Human
aguuucauauuaccaugucacc

SEQ ID NO: 619227 - RNA, 22 nt, Human
ggagccagaggcugcugcugug

SEQ ID NO: 619228 - RNA, 22 nt, Human
uuccugggacuggagcagccca

SEQ ID NO: 619229 - RNA, 22 nt, Human
auccugggcaguuuugagugcu

SEQ ID NO: 619230 - RNA, 22 nt, Human
cauuugcuguauuuucagauuc

SEQ ID NO: 619231 - RNA, 22 nt, Human
uccucacauggugagccacaca

SEQ ID NO: 619232 - RNA, 22 nt, Human
cuuuuacaguggaccugccauu

SEQ ID NO: 619233 - RNA, 22 nt, Human
ccucucccacguggcagaggcu

SEQ ID NO: 619234 - RNA, 22 nt, Human
augcaaaauuaccauucuguuc

SEQ ID NO: 619235 - RNA, 23 nt, Human
agcacaaaguguuuuccuuguag

SEQ ID NO: 619236 - RNA, 22 nt, Human
ucaguguuuauugcggugugua

SEQ ID NO: 619237 - RNA, 22 nt, Human
acaaaggacugaaacuggcugu

SEQ ID NO: 619238 - RNA, 22 nt, Human
uagugucagcaucucauugagc

SEQ ID NO: 619239 - RNA, 21 nt, Human
gcuggcugucccagggaagca

SEQ ID NO: 619240 - RNA, 22 nt, Human
ggcaggugcuaagagagguaaa

SEQ ID NO: 619241 - RNA, 22 nt, Human
uugcccugucaguagaagugca

SEQ ID NO: 619242 - RNA, 21 nt, Human
ugcacuuugggggacaggcug

SEQ ID NO: 619243 - RNA, 22 nt, Human
gcucuggcuacuguggcuaccg

SEQ ID NO: 619244 - RNA, 22 nt, Human
ccagacaggaacacacaucucc

SEQ ID NO: 619245 - RNA, 22 nt, Human
cuguggcugccucaccuacagg

SEQ ID NO: 619246 - RNA, 22 nt, Human
cuccugggcucaagugauccuc

SEQ ID NO: 619247 - RNA, 22 nt, Human
ccugcaggcugcaggccaguuc

SEQ ID NO: 619248 - RNA, 22 nt, Human
auacaaagacaaaucucaaucu

SEQ ID NO: 619249 - RNA, 22 nt, Human
cugugcuuguguucauuguuaa

SEQ ID NO: 619250 - RNA, 22 nt, Human
caguuucuuaagacugagaucu

SEQ ID NO: 619251 - RNA, 22 nt, Human
uuuuggcucugucuguaucuuu

SEQ ID NO: 619252 - RNA, 22 nt, Human
cuguggcuaauaauuaguauuu

SEQ ID NO: 619253 - RNA, 22 nt, Human
auuccucauuuguugagaacca

SEQ ID NO: 619254 - RNA, 22 nt, Human
agagaaugcagggcuucggaca

SEQ ID NO: 619255 - RNA, 22 nt, Human
gaucuugaaauaucuuuuccua

SEQ ID NO: 619256 - RNA, 21 nt, Human
ugucuuuggccucauucccag

SEQ ID NO: 619257 - RNA, 22 nt, Human
uagcagagguaaguguggcaau

SEQ ID NO: 619258 - RNA, 22 nt, Human
ggcaccuggauguagcagugaa

SEQ ID NO: 619259 - RNA, 22 nt, Human
ucuuggaacuuauuauuguaga

SEQ ID NO: 619260 - RNA, 22 nt, Human
uccugcagugugucuccugcac

SEQ ID NO: 619261 - RNA, 22 nt, Human
ugggcucuagacuuuagugugg

SEQ ID NO: 619262 - RNA, 22 nt, Human
gguggccauucuaccgccuucu

SEQ ID NO: 619263 - RNA, 22 nt, Human
ucaguguuggucaagaaucagu

SEQ ID NO: 619264 - RNA, 22 nt, Human
cucuggcuccauuucccuaugu

SEQ ID NO: 619265 - RNA, 22 nt, Human
ccugggcaauauagugaggccc

SEQ ID NO: 619266 - RNA, 22 nt, Human
uccuucuuugacaaguggcaga

SEQ ID NO: 619267 - RNA, 22 nt, Human
uuucagagucagcuccucucua

SEQ ID NO: 619268 - RNA, 22 nt, Human
ggcggggguccaggagccugca

SEQ ID NO: 619269 - RNA, 22 nt, Human
auuuguugcuagcagcacugau

SEQ ID NO: 619270 - RNA, 22 nt, Human
guucugucugagcaccacagga

SEQ ID NO: 619271 - RNA, 22 nt, Human
aggagaggcaucaagaaaaucg

SEQ ID NO: 619272 - RNA, 22 nt, Human
gccagcugaaauuucaguucug

SEQ ID NO: 619273 - RNA, 22 nt, Human
ucaaaaaguugaagaguugggg

SEQ ID NO: 619274 - RNA, 22 nt, Human
uugcuuuucccugucucugauu

SEQ ID NO: 619275 - RNA, 22 nt, Human
agggaucacgguggacuuggau

SEQ ID NO: 619276 - RNA, 21 nt, Human
gugcagaggaauguagggggc

SEQ ID NO: 619277 - RNA, 22 nt, Human
uuguauuaauugaaaugaaugc

SEQ ID NO: 619278 - RNA, 22 nt, Human
agcuggcuaugcccugugaacc

SEQ ID NO: 619279 - RNA, 22 nt, Human
uagugcaagguuuugccaacuu

SEQ ID NO: 619280 - RNA, 22 nt, Human
ucacuggggcccacaucaacau

SEQ ID NO: 619281 - RNA, 22 nt, Human
caggcugggcugguguuagagu

SEQ ID NO: 619282 - RNA, 23 nt, Human
caggcaggaugaggacuacacuc

SEQ ID NO: 619283 - RNA, 22 nt, Human
caggcuggacauuagauacaua

SEQ ID NO: 619284 - RNA, 19 nt, Human
cugcagggaugugcagagu

SEQ ID NO: 619285 - RNA, 22 nt, Human
uccugggcuugcuccuccagcu

SEQ ID NO: 619286 - RNA, 22 nt, Human
guuuucugauuagcaaaucuga

SEQ ID NO: 619287 - RNA, 23 nt, Human
caguggucagaacgugggagggu

SEQ ID NO: 619288 - RNA, 22 nt, Human
aguuuagaagaggaacuuguua

SEQ ID NO: 619289 - RNA, 22 nt, Human
uuaaaugacgggacuggguuuu

SEQ ID NO: 619290 - RNA, 22 nt, Human
auuggucaccucccucagcucu

SEQ ID NO: 619291 - RNA, 22 nt, Human
ccagcuccagcauagccaccau

SEQ ID NO: 619292 - RNA, 22 nt, Human
agagccaggcucccauggggca

SEQ ID NO: 619293 - RNA, 22 nt, Human
gccggggcuggggagagacaug

SEQ ID NO: 619294 - RNA, 22 nt, Human
uggauauccuuguuaacuuucu

SEQ ID NO: 619295 - RNA, 22 nt, Human
agcagagacaugaaauaugcuu

SEQ ID NO: 619296 - RNA, 18 nt, Human
aguccuggagaucaccaa

SEQ ID NO: 619297 - RNA, 22 nt, Human
aaaauagguacggauuagaaug

SEQ ID NO: 619298 - RNA, 22 nt, Human
uuggaaauguagaaaagcagau

SEQ ID NO: 619299 - RNA, 22 nt, Human
gcagggcaucccugagcgggug

SEQ ID NO: 619300 - RNA, 22 nt, Human
gaggcaggcacuguuaucagca

SEQ ID NO: 619301 - RNA, 22 nt, Human
ugagucaugggcuugagguuac

SEQ ID NO: 619302 - RNA, 22 nt, Human
uuaccuaaaauagcucaauuua

SEQ ID NO: 619303 - RNA, 22 nt, Human
caucucuucauuagcauuauug

SEQ ID NO: 619304 - RNA, 22 nt, Human
uccucagcuuugguuuacucau

SEQ ID NO: 619305 - RNA, 22 nt, Human
aaagccuucuucggucugugau

SEQ ID NO: 619306 - RNA, 22 nt, Human
aaacucugcacugcgguaaggu

SEQ ID NO: 619307 - RNA, 22 nt, Human
gggcgcagccaauccuggcccu

SEQ ID NO: 619308 - RNA, 22 nt, Human
cugcccuggguuuuaugggagu

SEQ ID NO: 619309 - RNA, 22 nt, Human
ccugggcucaccaugccuugga

SEQ ID NO: 619310 - RNA, 22 nt, Human
gacacagggacgugcucugccu

SEQ ID NO: 619311 - RNA, 22 nt, Human
ugcccugggaggcuuuccuguu

SEQ ID NO: 619312 - RNA, 22 nt, Human
ugcagccauuugaaaagcaguu

SEQ ID NO: 619313 - RNA, 22 nt, Human
guggcaggaucacggcucacug

SEQ ID NO: 619314 - RNA, 22 nt, Human
acaaugcaccagcaucuucacc

SEQ ID NO: 619315 - RNA, 22 nt, Human
aacaaaguagcugcuguucuua

SEQ ID NO: 619316 - RNA, 22 nt, Human
cuguaaauaugaagaauauaug

SEQ ID NO: 619317 - RNA, 22 nt, Human
agcugccuggagucauuuccug

SEQ ID NO: 619318 - RNA, 22 nt, Human
agcucagcccuccugugcagcu

SEQ ID NO: 619319 - RNA, 22 nt, Human
caggcaaggaggcacugaggga

SEQ ID NO: 619320 - RNA, 23 nt, Human
aacuccugaaucgugagccaucu

SEQ ID NO: 619321 - RNA, 22 nt, Human
gcugcccugugguccagcaggu

SEQ ID NO: 619322 - RNA, 22 nt, Human
ccagccucacuggcaucaccua

SEQ ID NO: 619323 - RNA, 22 nt, Human
gggcagguggcagggucucugg

SEQ ID NO: 619324 - RNA, 19 nt, Human
agcucuuugcugcauucca

SEQ ID NO: 619325 - RNA, 22 nt, Human
gcuggcugcgucaucacagggc

SEQ ID NO: 619326 - RNA, 22 nt, Human
aauuccagcuaggaaaagcuuc

SEQ ID NO: 619327 - RNA, 22 nt, Human
aggaaaggccucagcagaaacc

SEQ ID NO: 619328 - RNA, 22 nt, Human
ccuuuugcucucccauccagaa

SEQ ID NO: 619329 - RNA, 22 nt, Human
gaugcagggcuggcaggagcuu

SEQ ID NO: 619330 - RNA, 21 nt, Human
caaaagagacugauucuugga

SEQ ID NO: 619331 - RNA, 22 nt, Human
ugguccagacuuugaccucuca

SEQ ID NO: 619332 - RNA, 22 nt, Human
uccuggcccggccgggccugcu

SEQ ID NO: 619333 - RNA, 22 nt, Human
uaaaaaguagugagaauggcgc

SEQ ID NO: 619334 - RNA, 22 nt, Human
uuuccucugacugcuccccugc

SEQ ID NO: 619335 - RNA, 22 nt, Human
guguggcuagaagugucuuguu

SEQ ID NO: 619336 - RNA, 22 nt, Human
cagguccaguaaaaagaguccu

SEQ ID NO: 619337 - RNA, 22 nt, Human
gugcccugacacaccuggugug

SEQ ID NO: 619338 - RNA, 20 nt, Human
uccuggccuucucgggcagu

SEQ ID NO: 619339 - RNA, 20 nt, Human
agcugccuucauuuucuaga

SEQ ID NO: 619340 - RNA, 22 nt, Human
cccagugucucuugugccuuuc

SEQ ID NO: 619341 - RNA, 22 nt, Human
gcagaagucagaccaucugaau

SEQ ID NO: 619342 - RNA, 22 nt, Human
uuagauaccuuuguguuguaga

SEQ ID NO: 619343 - RNA, 22 nt, Human
ucuguccagcucuggggcucac

SEQ ID NO: 619344 - RNA, 22 nt, Human
uaacagaaaggggacagaaaua

SEQ ID NO: 619345 - RNA, 22 nt, Human
ugaggcaggaauggggaaaagu

SEQ ID NO: 619346 - RNA, 22 nt, Human
uuuaaauuuagaagaaacacug

SEQ ID NO: 619347 - RNA, 22 nt, Human
uccaugggaagauuuugagugg

SEQ ID NO: 619348 - RNA, 22 nt, Human
gcuggccugucuagagccuuac

SEQ ID NO: 619349 - RNA, 20 nt, Human
uauuuacaacuuagagccuc

SEQ ID NO: 619350 - RNA, 22 nt, Human
cugcccugcuaaugaguuccaa

SEQ ID NO: 619351 - RNA, 22 nt, Human
guaaaauucuagcaucugaaag

SEQ ID NO: 619352 - RNA, 22 nt, Human
gcuggacucaggggacucaggg

SEQ ID NO: 619353 - RNA, 22 nt, Human
ucucacucauuuccuaggucuu

SEQ ID NO: 619354 - RNA, 22 nt, Human
uggccaggaggcugcuucugac

SEQ ID NO: 619355 - RNA, 22 nt, Human
auguguuuugguggaucauuca

SEQ ID NO: 619356 - RNA, 22 nt, Human
acaaaaagcuccauuacugucc

SEQ ID NO: 619357 - RNA, 22 nt, Human
acaguguuccuuuguugugacu

SEQ ID NO: 619358 - RNA, 18 nt, Human
uuuccuuguaugaacaua

SEQ ID NO: 619359 - RNA, 22 nt, Human
ggcaggacagucccaguucaaa

SEQ ID NO: 619360 - RNA, 22 nt, Human
uaaagcaggcaucucucuccuc

SEQ ID NO: 619361 - RNA, 22 nt, Human
aggcgcagaaggccaggggccu

SEQ ID NO: 619362 - RNA, 22 nt, Human
aggaaaugcaggcaaauacucu

SEQ ID NO: 619363 - RNA, 22 nt, Human
ugaggcagucacccccuccugc

SEQ ID NO: 619364 - RNA, 22 nt, Human
aacaaacauuaccuggugcugg

SEQ ID NO: 619365 - RNA, 22 nt, Human
gcugcagggagcuggaaggcuc

SEQ ID NO: 619366 - RNA, 22 nt, Human
ccaggcuggagugcaauggugc

SEQ ID NO: 619367 - RNA, 22 nt, Human
ucccugggccacagcugugagc

SEQ ID NO: 619368 - RNA, 22 nt, Human
cuccugggagcagggauggaug

SEQ ID NO: 619369 - RNA, 22 nt, Human
cuguggcuucugcuugggccuc

SEQ ID NO: 619370 - RNA, 22 nt, Human
gagccagguuggaggcugcagu

SEQ ID NO: 619371 - RNA, 22 nt, Human
cucagucucuugggcugugaag

SEQ ID NO: 619372 - RNA, 22 nt, Human
guuauaaaugacugcaaaaguu

SEQ ID NO: 619373 - RNA, 22 nt, Human
caucaucuggcuuuuagaaaaa

SEQ ID NO: 619374 - RNA, 22 nt, Human
gcugggagcccuggucugcucc

SEQ ID NO: 619375 - RNA, 22 nt, Human
uguuuugugcauuuacaacaug

SEQ ID NO: 619376 - RNA, 22 nt, Human
auuauaaaccuuugaggguggg

SEQ ID NO: 619377 - RNA, 22 nt, Human
cgcagggauuucaaggggccuu

SEQ ID NO: 619378 - RNA, 22 nt, Human
gcauuuuucaucccucuugggu

SEQ ID NO: 619379 - RNA, 22 nt, Human
acaaagauguuuaaagcauuua

SEQ ID NO: 619380 - RNA, 22 nt, Human
uggaaggcaggaccugccuugg

SEQ ID NO: 619381 - RNA, 22 nt, Human
accugcaguggccacuccuaau

SEQ ID NO: 619382 - RNA, 22 nt, Human
acauuucuuuucaucucuauau

SEQ ID NO: 619383 - RNA, 22 nt, Human
cccagccuacucugccauagca

SEQ ID NO: 619384 - RNA, 22 nt, Human
caagucugaccucugggugaag

SEQ ID NO: 619385 - RNA, 22 nt, Human
caaaggcaacauauacuuguuu

SEQ ID NO: 619386 - RNA, 22 nt, Human
guggcagcugugggacacuggu

SEQ ID NO: 619387 - RNA, 20 nt, Human
uccagggcaacuagagugug

SEQ ID NO: 619388 - RNA, 22 nt, Human
ucaggcacuggcugagugaugg

SEQ ID NO: 619389 - RNA, 22 nt, Human
uucuggcugcagucccuguaau

SEQ ID NO: 619390 - RNA, 21 nt, Human
acacaaaccuccucagccugg

SEQ ID NO: 619391 - RNA, 17 nt, Human
uccugccaccugucagg

SEQ ID NO: 619392 - RNA, 22 nt, Human
gccucuggaguugcuuguaaau

SEQ ID NO: 619393 - RNA, 20 nt, Human
uccagggcuagggagcucau

SEQ ID NO: 619394 - RNA, 19 nt, Human
caggccucuggucugcugu

SEQ ID NO: 619395 - RNA, 22 nt, Human
aucauuuuauggcugagaggac

SEQ ID NO: 619396 - RNA, 22 nt, Human
ggagccuuagacaucugauccu

SEQ ID NO: 619397 - RNA, 20 nt, Human
guccugggagccacagcaca

SEQ ID NO: 619398 - RNA, 22 nt, Human
agggcuuuaaugauuauuuucu

SEQ ID NO: 619399 - RNA, 22 nt, Human
cccauucccuuuacuguugcau

SEQ ID NO: 619400 - RNA, 22 nt, Human
aaugggaaaagaguaugauuua

SEQ ID NO: 619401 - RNA, 22 nt, Human
augcuauguaacuggcagauag

SEQ ID NO: 619402 - RNA, 22 nt, Human
aagaugcagcuuuacaauaagg

SEQ ID NO: 619403 - RNA, 19 nt, Human
acuaaaaaugauguuugag

SEQ ID NO: 619404 - RNA, 22 nt, Human
agcaccugugcccugauggaga

SEQ ID NO: 619405 - RNA, 22 nt, Human
uccagagguauguagagaguau

SEQ ID NO: 619406 - RNA, 22 nt, Human
gauuuucauuugcacucuagaa

SEQ ID NO: 619407 - RNA, 22 nt, Human
uggaaucucugguaucugggga

SEQ ID NO: 619408 - RNA, 22 nt, Human
acuggcugugcccauagagcuc

SEQ ID NO: 619409 - RNA, 22 nt, Human
agucauuacagcaggcagaagg

SEQ ID NO: 619410 - RNA, 23 nt, Human
gccugccauauaccuggaaacag

SEQ ID NO: 619411 - RNA, 22 nt, Human
ucugugugugccuguuaauauu

SEQ ID NO: 619412 - RNA, 22 nt, Human
uccugccagcuggggcugcuuc

SEQ ID NO: 619413 - RNA, 22 nt, Human
cugcccacuauguugucauggg

SEQ ID NO: 619414 - RNA, 22 nt, Human
gccaggcucuugguuauguuuu

SEQ ID NO: 619415 - RNA, 22 nt, Human
aaacucuauaggcagaagcaau

SEQ ID NO: 619416 - RNA, 22 nt, Human
augagguaauacuuucaguccu

SEQ ID NO: 619417 - RNA, 22 nt, Human
gagagcaggaggcagcgggacg

SEQ ID NO: 619418 - RNA, 22 nt, Human
uguggaauuucuuucagguaug

SEQ ID NO: 619419 - RNA, 22 nt, Human
gaauuuccucuaaaccccugag

SEQ ID NO: 619420 - RNA, 19 nt, Human
ugguaaagacuguccccca

SEQ ID NO: 619421 - RNA, 22 nt, Human
ucaguccucucuggguuucuua

SEQ ID NO: 619422 - RNA, 22 nt, Human
auuccuugggaauuauugaaug

SEQ ID NO: 619423 - RNA, 22 nt, Human
aaguccaccagucagacuagga

SEQ ID NO: 619424 - RNA, 17 nt, Human
agguucagguuacauuc

SEQ ID NO: 619425 - RNA, 22 nt, Human
caggcuggagugcaguugugca

SEQ ID NO: 619426 - RNA, 22 nt, Human
cugaucuuaaguaacauuauuu

SEQ ID NO: 619427 - RNA, 22 nt, Human
gagguccaacacaauggguguu

SEQ ID NO: 619428 - RNA, 22 nt, Human
gcaguggcuaagcucgcaugca

SEQ ID NO: 619429 - RNA, 22 nt, Human
agaaaaugugaacuugugaauu

SEQ ID NO: 619430 - RNA, 22 nt, Human
uccugggagaguuugauucauu

SEQ ID NO: 619431 - RNA, 22 nt, Human
gggcaggucugggucagccuga

SEQ ID NO: 619432 - RNA, 22 nt, Human
aguccuggguccagcagguccu

SEQ ID NO: 619433 - RNA, 23 nt, Human
ucuguguagccaggucuggaggg

SEQ ID NO: 619434 - RNA, 22 nt, Human
ugacaaacccugcaaauagcuc

SEQ ID NO: 619435 - RNA, 22 nt, Human
auacaaugggugcaaagaugug

SEQ ID NO: 619436 - RNA, 22 nt, Human
uccugggacuuucaaggcuagg

SEQ ID NO: 619437 - RNA, 22 nt, Human
ugcuuccugaggccgucuucuc

SEQ ID NO: 619438 - RNA, 22 nt, Human
gccccuugucuccaggccccaa

SEQ ID NO: 619439 - RNA, 22 nt, Human
uguuucuguaugaucaauauug

SEQ ID NO: 619440 - RNA, 22 nt, Human
gaugaggcaagccagaggacug

SEQ ID NO: 619441 - RNA, 22 nt, Human
cccagccucuggauucugcccu

SEQ ID NO: 619442 - RNA, 22 nt, Human
cucggaauggaacaacagcggu

SEQ ID NO: 619443 - RNA, 22 nt, Human
agguccaucguggaugaacugc

SEQ ID NO: 619444 - RNA, 22 nt, Human
caggcaggugcagauuccucuu

SEQ ID NO: 619445 - RNA, 22 nt, Human
uuaaauuauugagggauuguca

SEQ ID NO: 619446 - RNA, 22 nt, Human
cuguggcugucucuuucccaug

SEQ ID NO: 619447 - RNA, 22 nt, Human
agugucaaaugugugccaagcu

SEQ ID NO: 619448 - RNA, 22 nt, Human
cauggccagggcagauggcagg

SEQ ID NO: 619449 - RNA, 22 nt, Human
uuggaagguucuggucaugguu

SEQ ID NO: 619450 - RNA, 22 nt, Human
ugaggcaggagguugagaacug

SEQ ID NO: 619451 - RNA, 22 nt, Human
aaggaaagacauauaaaugacu

SEQ ID NO: 619452 - RNA, 22 nt, Human
cauggccaggcacgcgcauagc

SEQ ID NO: 619453 - RNA, 22 nt, Human
aaagcagguugcaauuacagug

SEQ ID NO: 619454 - RNA, 22 nt, Human
ugugaaggcagagccagugaaa

SEQ ID NO: 619455 - RNA, 17 nt, Human
uccuguuuaucauugau

SEQ ID NO: 619456 - RNA, 22 nt, Human
gccugggauucucaaaggggug

SEQ ID NO: 619457 - RNA, 22 nt, Human
cuguggcucucagaggcugcug

SEQ ID NO: 619458 - RNA, 22 nt, Human
gaagucaugcucccaucuugcu

SEQ ID NO: 619459 - RNA, 22 nt, Human
gcagggcaaauguggaaaggag

SEQ ID NO: 619460 - RNA, 21 nt, Human
ugaggcaggggugcuuuuguc

SEQ ID NO: 619461 - RNA, 22 nt, Human
cucugcaacuucuagcaguguc

SEQ ID NO: 619462 - RNA, 22 nt, Human
aaggcugugucagaagcucccu

SEQ ID NO: 619463 - RNA, 22 nt, Human
uucuuucucuacuagcagagcu

SEQ ID NO: 619464 - RNA, 22 nt, Human
uuucaaagaccauuaacuauca

SEQ ID NO: 619465 - RNA, 22 nt, Human
gcagggccagguacaagaagca

SEQ ID NO: 619466 - RNA, 22 nt, Human
ccaguguuccauggagugauua

SEQ ID NO: 619467 - RNA, 22 nt, Human
ucauaaagcauuucagcuuuug

SEQ ID NO: 619468 - RNA, 23 nt, Human
ccagggagguugauugguuaccc

SEQ ID NO: 619469 - RNA, 22 nt, Human
cccagguagugagaaauggagg

SEQ ID NO: 619470 - RNA, 22 nt, Human
aggucaccauggcaugcuccac

SEQ ID NO: 619471 - RNA, 22 nt, Human
acucuguguuuugguggcagca

SEQ ID NO: 619472 - RNA, 22 nt, Human
auccugggcugcacccucagcc

SEQ ID NO: 619473 - RNA, 22 nt, Human
gauuucuuuagguguaauagug

SEQ ID NO: 619474 - RNA, 20 nt, Human
ggccggggagcucuccaggg

SEQ ID NO: 619475 - RNA, 22 nt, Human
uuucagaggaaaucucauugag

SEQ ID NO: 619476 - RNA, 22 nt, Human
uggagucaguggcuauugggca

SEQ ID NO: 619477 - RNA, 22 nt, Human
ucuggccccgcaugcacuuuau

SEQ ID NO: 619478 - RNA, 22 nt, Human
aguacugucagcaggguguuga

SEQ ID NO: 619479 - RNA, 22 nt, Human
guuuucuuugaaugcuucuaga

SEQ ID NO: 619480 - RNA, 22 nt, Human
auaaugagaauacaguaacuau

SEQ ID NO: 619481 - RNA, 22 nt, Human
aaguuacaguuacagaauggag

SEQ ID NO: 619482 - RNA, 20 nt, Human
aucccuggccuuaaggagug

SEQ ID NO: 619483 - RNA, 22 nt, Human
guagggacuuguuuuacuagua

SEQ ID NO: 619484 - RNA, 23 nt, Human
ugccaggguuuguuugugguuca

SEQ ID NO: 619485 - RNA, 22 nt, Human
ccaguguugaacaguauuugga

SEQ ID NO: 619486 - RNA, 22 nt, Human
ugcugggggugucucaccaggc

SEQ ID NO: 619487 - RNA, 22 nt, Human
uacagaaagggaugauugaucu

SEQ ID NO: 619488 - RNA, 22 nt, Human
ggaaggcuugaguucccagguc

SEQ ID NO: 619489 - RNA, 22 nt, Human
accuguuuuagucuuuaaucau

SEQ ID NO: 619490 - RNA, 22 nt, Human
ucauaaagcuugccugcagugu

SEQ ID NO: 619491 - RNA, 22 nt, Human
ggguccaggcggcauaguugua

SEQ ID NO: 619492 - RNA, 22 nt, Human
cagugaaguucuacugaauggu

SEQ ID NO: 619493 - RNA, 22 nt, Human
uuggaaggccagcaccuugagu

SEQ ID NO: 619494 - RNA, 22 nt, Human
uccugggcgauuuucugaauau

SEQ ID NO: 619495 - RNA, 20 nt, Human
ugccuuggagcagccaaggu

SEQ ID NO: 619496 - RNA, 23 nt, Human
cugggcuguccugaggucaccuc

SEQ ID NO: 619497 - RNA, 21 nt, Human
ugcagcagauuugggggaaga

SEQ ID NO: 619498 - RNA, 22 nt, Human
uggcagguacccauuggcugua

SEQ ID NO: 619499 - RNA, 22 nt, Human
uuuaacuuagaagagauauccu

SEQ ID NO: 619500 - RNA, 21 nt, Human
ucauuucucuauguauuucac

SEQ ID NO: 619501 - RNA, 22 nt, Human
ugguccaguuuagcauugagug

SEQ ID NO: 619502 - RNA, 22 nt, Human
cuguguuuggacaacuuuucag

SEQ ID NO: 619503 - RNA, 22 nt, Human
aauucaaucuaagaaaugauca

SEQ ID NO: 619504 - RNA, 22 nt, Human
auauuuaacuggucccaauaua

SEQ ID NO: 619505 - RNA, 22 nt, Human
uugcagcuucuaacagcuucag

SEQ ID NO: 619506 - RNA, 22 nt, Human
cucuuuguggccaccuaaucuu

SEQ ID NO: 619507 - RNA, 22 nt, Human
augcagaacguuugugaaacuu

SEQ ID NO: 619508 - RNA, 19 nt, Human
uccucugguaccacccuug

SEQ ID NO: 619509 - RNA, 22 nt, Human
caggccagcagggccuccgugg

SEQ ID NO: 619510 - RNA, 22 nt, Human
agguccaggauuuguggggucu

SEQ ID NO: 619511 - RNA, 22 nt, Human
gccugagggcuccuagcaggcu

SEQ ID NO: 619512 - RNA, 22 nt, Human
uuuccuugggucucuuaguggc

SEQ ID NO: 619513 - RNA, 22 nt, Human
gaaagguuguaacaagacucuu

SEQ ID NO: 619514 - RNA, 22 nt, Human
guccugggcggagggcugcugu

SEQ ID NO: 619515 - RNA, 22 nt, Human
cugggcucaguggcucauggcu

SEQ ID NO: 619516 - RNA, 21 nt, Human
gcagggaccgcgacuucuggg

SEQ ID NO: 619517 - RNA, 22 nt, Human
cuguguuuugagauauuauuaa

SEQ ID NO: 619518 - RNA, 22 nt, Human
uggagucacagugaccugaguc

SEQ ID NO: 619519 - RNA, 22 nt, Human
aaaugcuacauacacaucaggg

SEQ ID NO: 619520 - RNA, 22 nt, Human
ccaguguuggaggauggcuugc

SEQ ID NO: 619521 - RNA, 19 nt, Human
ccaggccuggcgucuccgc

SEQ ID NO: 619522 - RNA, 22 nt, Human
ucagguccagcuccugugccuc

SEQ ID NO: 619523 - RNA, 22 nt, Human
uuacaagaugggaaagggaagu

SEQ ID NO: 619524 - RNA, 16 nt, Human
uuuauuuacuaguguu

SEQ ID NO: 619525 - RNA, 22 nt, Human
gcuuccaccuacuaaaugccac

SEQ ID NO: 619526 - RNA, 22 nt, Human
aaguccagugaaauagaaugca

SEQ ID NO: 619527 - RNA, 22 nt, Human
aggugggcccagugggcuccag

SEQ ID NO: 619528 - RNA, 22 nt, Human
gaagagaaaggcaaggaguuuu

SEQ ID NO: 619529 - RNA, 22 nt, Human
acaguguuuaagagauggcauu

SEQ ID NO: 619530 - RNA, 22 nt, Human
cagcagguggacacacucaccu

SEQ ID NO: 619531 - RNA, 19 nt, Human
aaagaucugggauugagac

SEQ ID NO: 619532 - RNA, 22 nt, Human
cugcccugggugcuggggaucc

SEQ ID NO: 619533 - RNA, 22 nt, Human
gcuguucuuugcaucucuggug

SEQ ID NO: 619534 - RNA, 22 nt, Human
aucuguggcgcaaacaaaggcu

SEQ ID NO: 619535 - RNA, 22 nt, Human
guaaauuauuucaagaucaucu

SEQ ID NO: 619536 - RNA, 22 nt, Human
auccugggaagcugacauugaa

SEQ ID NO: 619537 - RNA, 22 nt, Human
cugcagagcaaguucucuguug

SEQ ID NO: 619538 - RNA, 22 nt, Human
augagugugaaguuagcucagu

SEQ ID NO: 619539 - RNA, 22 nt, Human
cuggaaggcagagguugcagug

SEQ ID NO: 619540 - RNA, 22 nt, Human
gagagcuggauucuggauaggu

SEQ ID NO: 619541 - RNA, 22 nt, Human
ucuggaguagggucugggaauu

SEQ ID NO: 619542 - RNA, 22 nt, Human
gugagcuuugugguaaugaagu

SEQ ID NO: 619543 - RNA, 22 nt, Human
agucauuaagacaacuggagua

SEQ ID NO: 619544 - RNA, 22 nt, Human
agucuucucauuucacaugcuu

SEQ ID NO: 619545 - RNA, 17 nt, Human
aggugcagaggcagagc

SEQ ID NO: 619546 - RNA, 22 nt, Human
uccuggaggcaaaugagcacau

SEQ ID NO: 619547 - RNA, 22 nt, Human
ucauugucagcucuugacuucu

SEQ ID NO: 619548 - RNA, 22 nt, Human
acuguggcacuaggcaccuuac

SEQ ID NO: 619549 - RNA, 22 nt, Human
uucaugaauguuccaugugagu

SEQ ID NO: 619550 - RNA, 22 nt, Human
ucccacucccaggcaggccucu

SEQ ID NO: 619551 - RNA, 18 nt, Human
agggccagcugugaguag

SEQ ID NO: 619552 - RNA, 22 nt, Human
augaggcaaggaucagguaagg

SEQ ID NO: 619553 - RNA, 22 nt, Human
ugucuuuaagcaaacaguguuu

SEQ ID NO: 619554 - RNA, 22 nt, Human
gacccugacucuaaugcuuggc

SEQ ID NO: 619555 - RNA, 22 nt, Human
aaaaugauauccugacuuuuau

SEQ ID NO: 619556 - RNA, 22 nt, Human
uuuaaauaggacuccugggggu

SEQ ID NO: 619557 - RNA, 23 nt, Human
ggguccagagaagccauuagggc

SEQ ID NO: 619558 - RNA, 22 nt, Human
auucacaacaaaaggauaugag

SEQ ID NO: 619559 - RNA, 19 nt, Human
ggcauggucggaagagcuc

SEQ ID NO: 619560 - RNA, 22 nt, Human
gaauauuuucaguacagauggu

SEQ ID NO: 619561 - RNA, 22 nt, Human
uauuuguugaguuguuaugucu

SEQ ID NO: 619562 - RNA, 23 nt, Human
uccuucaaguuaggaagugaaca

SEQ ID NO: 619563 - RNA, 22 nt, Human
uuuauucacuucagugccaaag

SEQ ID NO: 619564 - RNA, 22 nt, Human
ucagcaggcagugggucacaau

SEQ ID NO: 619565 - RNA, 22 nt, Human
ucaaaauuuuauuucucaagga

SEQ ID NO: 619566 - RNA, 22 nt, Human
gggacaucuuucuagucagggu

SEQ ID NO: 619567 - RNA, 22 nt, Human
gggcgcaucaccugaggucagg

SEQ ID NO: 619568 - RNA, 22 nt, Human
cuucagagaacuugaucgcugc

SEQ ID NO: 619569 - RNA, 20 nt, Human
gugugaagcccucaggagga

SEQ ID NO: 619570 - RNA, 22 nt, Human
aguaaaaauugaggugcaaaau

SEQ ID NO: 619571 - RNA, 22 nt, Human
ccagcucaucucagugaaaugc

SEQ ID NO: 619572 - RNA, 22 nt, Human
aaacucugaugcuuauugggaa

SEQ ID NO: 619573 - RNA, 22 nt, Human
ccugcagguaaggcuaacugcc

SEQ ID NO: 619574 - RNA, 22 nt, Human
uauuuuacuauuuggcaaaguc

SEQ ID NO: 619575 - RNA, 22 nt, Human
ucagcagggcugggagcuguga

SEQ ID NO: 619576 - RNA, 18 nt, Human
uuucacagauucaugacu

SEQ ID NO: 619577 - RNA, 22 nt, Human
agccuucauaaucuugggcuuu

SEQ ID NO: 619578 - RNA, 22 nt, Human
aagaucaauguucauuaagaug

SEQ ID NO: 619579 - RNA, 22 nt, Human
uggaagggguuacgcagcagga

SEQ ID NO: 619580 - RNA, 22 nt, Human
ggucccagaauugguuagcaca

SEQ ID NO: 619581 - RNA, 22 nt, Human
gagcaggucuuucauggugcau

SEQ ID NO: 619582 - RNA, 22 nt, Human
aaggaggagugggguccuggaa

SEQ ID NO: 619583 - RNA, 22 nt, Human
gucccugggucuaaggcaguaa

SEQ ID NO: 619584 - RNA, 22 nt, Human
cagguggcuuauuagggucagu

SEQ ID NO: 619585 - RNA, 22 nt, Human
agcgugaauuaguugguacaca

SEQ ID NO: 619586 - RNA, 21 nt, Human
ugaaagaggauguggucauuc

SEQ ID NO: 619587 - RNA, 22 nt, Human
ggcucugcccagguggacagca

SEQ ID NO: 619588 - RNA, 22 nt, Human
ucugugugggauaguuugagga

SEQ ID NO: 619589 - RNA, 22 nt, Human
uccacagugguugaacuaguuu

SEQ ID NO: 619590 - RNA, 22 nt, Human
gccuucugaucgcuggacugac

SEQ ID NO: 619591 - RNA, 22 nt, Human
cuggaaggggcagucuuugggc

SEQ ID NO: 619592 - RNA, 22 nt, Human
ggcaguaugaguucaaauaauu

SEQ ID NO: 619593 - RNA, 22 nt, Human
uuaccugugucaguauaugaga

SEQ ID NO: 619594 - RNA, 19 nt, Human
agguccugaucagcaagga

SEQ ID NO: 619595 - RNA, 22 nt, Human
cugccagcucgccacaaugaca

SEQ ID NO: 619596 - RNA, 22 nt, Human
ucugggcuauauggucucugcu

SEQ ID NO: 619597 - RNA, 22 nt, Human
acaguguucuugauauuacagu

SEQ ID NO: 619598 - RNA, 22 nt, Human
uaggcaggcugaauguagauuu

SEQ ID NO: 619599 - RNA, 22 nt, Human
uaugcuuuuaaccuguaacuga

SEQ ID NO: 619600 - RNA, 22 nt, Human
cuuccuuggcuucuggggugug

SEQ ID NO: 619601 - RNA, 22 nt, Human
agacacugauguucagcucaau

SEQ ID NO: 619602 - RNA, 22 nt, Human
gaucuugagcaaguugcauccc

SEQ ID NO: 619603 - RNA, 19 nt, Human
cucugggcugcaucuuggu

SEQ ID NO: 619604 - RNA, 20 nt, Human
uggcagguggccucaguucc

SEQ ID NO: 619605 - RNA, 22 nt, Human
gaaacaauuuuuguugucuaag

SEQ ID NO: 619606 - RNA, 22 nt, Human
auaaauuaugaauggcccuuuu

SEQ ID NO: 619607 - RNA, 22 nt, Human
auguuucaaauauauagaguug

SEQ ID NO: 619608 - RNA, 22 nt, Human
gagagucuagugcaccuaguuu

SEQ ID NO: 619609 - RNA, 18 nt, Human
caggugggucuccugccc

SEQ ID NO: 619610 - RNA, 22 nt, Human
uuaaauuaggacucuaguucug

SEQ ID NO: 619611 - RNA, 22 nt, Human
ccuugcuguuagccuacauuau

SEQ ID NO: 619612 - RNA, 22 nt, Human
uccagagggcgauggcuggggg

SEQ ID NO: 619613 - RNA, 22 nt, Human
uuuaccaucugccacagauaug

SEQ ID NO: 619614 - RNA, 22 nt, Human
gugugcauguggaagcauguau

SEQ ID NO: 619615 - RNA, 22 nt, Human
gugggcuggacccuccugcucc

SEQ ID NO: 619616 - RNA, 22 nt, Human
aaauggcugacuaaauuaaauu

SEQ ID NO: 619617 - RNA, 22 nt, Human
acagaagcaaagacucaggcaa

SEQ ID NO: 619618 - RNA, 22 nt, Human
gcagggucuugagaggcagcca

SEQ ID NO: 619619 - RNA, 22 nt, Human
gaguccagcagaaugagccaag

SEQ ID NO: 619620 - RNA, 22 nt, Human
agaaaauaaauugaugguggaa

SEQ ID NO: 619621 - RNA, 19 nt, Human
aggugacaugugacagccu

SEQ ID NO: 619622 - RNA, 22 nt, Human
ccugagcucaaagggugccugg

SEQ ID NO: 619623 - RNA, 22 nt, Human
uugagucuccucagcagggcua

SEQ ID NO: 619624 - RNA, 22 nt, Human
ccugggugcccggcccuucucu

SEQ ID NO: 619625 - RNA, 22 nt, Human
agccagcaucccuucagucucc

SEQ ID NO: 619626 - RNA, 19 nt, Human
aaagcagaggagcaucuga

SEQ ID NO: 619627 - RNA, 17 nt, Human
uggggaugguucaugag

SEQ ID NO: 619628 - RNA, 20 nt, Human
gccagaggccggcaggggcu

SEQ ID NO: 619629 - RNA, 21 nt, Human
agaagccauuuguuaggacuu

SEQ ID NO: 619630 - RNA, 22 nt, Human
ucuguggcuuucuuauguugua

SEQ ID NO: 619631 - RNA, 22 nt, Human
cuggaagguggauggcgaggcc

SEQ ID NO: 619632 - RNA, 22 nt, Human
gaggcagagugcaccccaggag

SEQ ID NO: 619633 - RNA, 22 nt, Human
gggaacagggccugagcugggg

SEQ ID NO: 619634 - RNA, 22 nt, Human
gcaguguuuggauccauagcga

SEQ ID NO: 619635 - RNA, 22 nt, Human
cugcccugugaggguccuuggg

SEQ ID NO: 619636 - RNA, 22 nt, Human
cuguggagguaggagcaggaca

SEQ ID NO: 619637 - RNA, 22 nt, Human
ggcucccugggugcuccugcuc

SEQ ID NO: 619638 - RNA, 20 nt, Human
ugggcucugcuuccuggagu

SEQ ID NO: 619639 - RNA, 22 nt, Human
cugcccuguccuucccgccggc

SEQ ID NO: 619640 - RNA, 23 nt, Human
uccugaggguuucccagccuugg

SEQ ID NO: 619641 - RNA, 22 nt, Human
aggcuccacccuacagagcucc

SEQ ID NO: 619642 - RNA, 22 nt, Human
gcuuccuuauuguugccauagu

SEQ ID NO: 619643 - RNA, 20 nt, Human
cagaaagaagguagauuuuu

SEQ ID NO: 619644 - RNA, 22 nt, Human
ugguuaaaaugcagauucagua

SEQ ID NO: 619645 - RNA, 22 nt, Human
aaauagaauuaacuagcuacug

SEQ ID NO: 619646 - RNA, 22 nt, Human
cugcccugucuuuuucugauga

SEQ ID NO: 619647 - RNA, 22 nt, Human
aagcaggacguauuucuauccu

SEQ ID NO: 619648 - RNA, 22 nt, Human
caguaaauaguggagauguggg

SEQ ID NO: 619649 - RNA, 22 nt, Human
uuuuaauacugcuauuguagga

SEQ ID NO: 619650 - RNA, 22 nt, Human
aagaaagagaucacuccuccau

SEQ ID NO: 619651 - RNA, 23 nt, Human
agcuccagggaacaggcaguagg

SEQ ID NO: 619652 - RNA, 22 nt, Human
cccuggagguggagguugcagg

SEQ ID NO: 619653 - RNA, 22 nt, Human
accuguuuguuaagaaagcuuc

SEQ ID NO: 619654 - RNA, 22 nt, Human
ggccagggccaaggcuuuccca

SEQ ID NO: 619655 - RNA, 22 nt, Human
cuguggcugcagaccuuaaaca

SEQ ID NO: 619656 - RNA, 22 nt, Human
ggcccagcccgagucagccuuc

SEQ ID NO: 619657 - RNA, 22 nt, Human
gccaccuggacucagagccagg

SEQ ID NO: 619658 - RNA, 22 nt, Human
ggucccagguugacagggagac

SEQ ID NO: 619659 - RNA, 22 nt, Human
aucucugguuguuuugcuccca

SEQ ID NO: 619660 - RNA, 22 nt, Human
uguuuacuuuccuucucacagg

SEQ ID NO: 619661 - RNA, 22 nt, Human
ggagaagggccaauuccaugua

SEQ ID NO: 619662 - RNA, 19 nt, Human
aaacucugaaggccacugg

SEQ ID NO: 619663 - RNA, 22 nt, Human
cccagccucuguuugcuccucu

SEQ ID NO: 619664 - RNA, 22 nt, Human
agagcuguuaauuuugcacugg

SEQ ID NO: 619665 - RNA, 22 nt, Human
cccaguguuacgugacagccug

SEQ ID NO: 619666 - RNA, 22 nt, Human
accugcagccacuucucuccuu

SEQ ID NO: 619667 - RNA, 22 nt, Human
ugaggcagguaagcaaguuuug

SEQ ID NO: 619668 - RNA, 22 nt, Human
acauagaguucaauuuucaguc

SEQ ID NO: 619669 - RNA, 22 nt, Human
gaaauacaaagccagccauuuu

SEQ ID NO: 619670 - RNA, 22 nt, Human
gcaggcucccuugcagagcagg

SEQ ID NO: 619671 - RNA, 22 nt, Human
agcuuccuguugagagagggag

SEQ ID NO: 619672 - RNA, 20 nt, Human
uccaggcccacucagcugaa

SEQ ID NO: 619673 - RNA, 22 nt, Human
ggcucuucugguugucacauuu

SEQ ID NO: 619674 - RNA, 22 nt, Human
ccugaggcaaggacuugguggc

SEQ ID NO: 619675 - RNA, 22 nt, Human
ugccauauugcaaagugucugc

SEQ ID NO: 619676 - RNA, 22 nt, Human
uaggcagggauuaggguugauu

SEQ ID NO: 619677 - RNA, 22 nt, Human
uccugcagcugcagaccugggg

SEQ ID NO: 619678 - RNA, 22 nt, Human
agguucagucuuuggaccccuc

SEQ ID NO: 619679 - RNA, 22 nt, Human
cuguggcugaguuccuuauguu

SEQ ID NO: 619680 - RNA, 22 nt, Human
gguggauagguacauggacuuu

SEQ ID NO: 619681 - RNA, 22 nt, Human
uaauuacaaagcaagcacaggg

SEQ ID NO: 619682 - RNA, 22 nt, Human
agugucuuucauauccuccauc

SEQ ID NO: 619683 - RNA, 22 nt, Human
ucagcagggcauacugagccua

SEQ ID NO: 619684 - RNA, 22 nt, Human
auuucuucagguucuucuagga

SEQ ID NO: 619685 - RNA, 22 nt, Human
ugcauuccuuugucuguuaaag

SEQ ID NO: 619686 - RNA, 22 nt, Human
guucauuuuacuguaaauagca

SEQ ID NO: 619687 - RNA, 22 nt, Human
aaguccagcauuuggguagauu

SEQ ID NO: 619688 - RNA, 22 nt, Human
gugcccugcaugccccggguau

SEQ ID NO: 619689 - RNA, 22 nt, Human
ggcggggccucgcgaacggccu

SEQ ID NO: 619690 - RNA, 22 nt, Human
cacaguguuccagagcaguggu

SEQ ID NO: 619691 - RNA, 22 nt, Human
uuuauaaaauagacugggucua

SEQ ID NO: 619692 - RNA, 22 nt, Human
aguguuuggggugauuguaacc

SEQ ID NO: 619693 - RNA, 19 nt, Human
gcaggucauuaggcuaggu

SEQ ID NO: 619694 - RNA, 22 nt, Human
acuucuucuucagcugggggau

SEQ ID NO: 619695 - RNA, 22 nt, Human
augcuaaauucagacaggguua

SEQ ID NO: 619696 - RNA, 22 nt, Human
caggucgccagcaggaacguca

SEQ ID NO: 619697 - RNA, 22 nt, Human
agcuccagaggcagugaugaag

SEQ ID NO: 619698 - RNA, 22 nt, Human
gcaaguaggaaguguccuccuu

SEQ ID NO: 619699 - RNA, 22 nt, Human
auuuucuguaacuauuucuaua

SEQ ID NO: 619700 - RNA, 22 nt, Human
ucucugaucuuuaauucagaua

SEQ ID NO: 619701 - RNA, 22 nt, Human
cugaagauuauaaacagacaua

SEQ ID NO: 619702 - RNA, 22 nt, Human
ucauuguugcguuaaugucuuc

SEQ ID NO: 619703 - RNA, 22 nt, Human
cagcaggaaguacuagcuuuga

SEQ ID NO: 619704 - RNA, 20 nt, Human
uuucagagugucuuuccauu

SEQ ID NO: 619705 - RNA, 22 nt, Human
uuucagagguaugcugcuuauc

SEQ ID NO: 619706 - RNA, 22 nt, Human
aagauucacagagugaaugaaa

SEQ ID NO: 619707 - RNA, 22 nt, Human
cugggccagucucggccgcucu

SEQ ID NO: 619708 - RNA, 22 nt, Human
gccagcaguccugcugugugcc

SEQ ID NO: 619709 - RNA, 22 nt, Human
ggagggccaucuugggugugau

SEQ ID NO: 619710 - RNA, 22 nt, Human
ccuugcucaagcuagugacggg

SEQ ID NO: 619711 - RNA, 20 nt, Human
uuguugagcucuucaaagaa

SEQ ID NO: 619712 - RNA, 22 nt, Human
cucuuccuacagucugcuaugc

SEQ ID NO: 619713 - RNA, 22 nt, Human
gaguccaguuagugaggcuggg

SEQ ID NO: 619714 - RNA, 22 nt, Human
ugaguccaagagccagugggaa

SEQ ID NO: 619715 - RNA, 22 nt, Human
gcuggcuggaguaaggagggag

SEQ ID NO: 619716 - RNA, 23 nt, Human
agaggcaggaguggcuugcccgg

SEQ ID NO: 619717 - RNA, 22 nt, Human
augcagaaagagaauguaaugu

SEQ ID NO: 619718 - RNA, 22 nt, Human
gcagcaggcuuuucauaccuug

SEQ ID NO: 619719 - RNA, 22 nt, Human
cagggaugagcagauggagcaa

SEQ ID NO: 619720 - RNA, 22 nt, Human
uucagcagguggugaguucugc

SEQ ID NO: 619721 - RNA, 22 nt, Human
aaggaaagauucucucucuaga

SEQ ID NO: 619722 - RNA, 22 nt, Human
ccacagugacacgggcuggccc

SEQ ID NO: 619723 - RNA, 22 nt, Human
agaauauugaaaguucuugaca

SEQ ID NO: 619724 - RNA, 22 nt, Human
cugaagaugucugagaugcuca

SEQ ID NO: 619725 - RNA, 22 nt, Human
cuggaagguaacaaggccauua

SEQ ID NO: 619726 - RNA, 22 nt, Human
guuuccuguggccacagaauaa

SEQ ID NO: 619727 - RNA, 22 nt, Human
agaaaacauaggagacaggaaa

SEQ ID NO: 619728 - RNA, 22 nt, Human
cuuccuucugaagcauagaagc

SEQ ID NO: 619729 - RNA, 22 nt, Human
ggaguggccucuccugugcagg

SEQ ID NO: 619730 - RNA, 22 nt, Human
auuccuuggcauucuggacuug

SEQ ID NO: 619731 - RNA, 22 nt, Human
uacaguagucgucuuauuuuga

SEQ ID NO: 619732 - RNA, 22 nt, Human
accugcaggcacaggugugcgc

SEQ ID NO: 619733 - RNA, 22 nt, Human
agccaaaguccaaaugcagugu

SEQ ID NO: 619734 - RNA, 19 nt, Human
cccaacuugacuauuuucu

SEQ ID NO: 619735 - RNA, 22 nt, Human
gcaguggggcgcugggaguugg

SEQ ID NO: 619736 - RNA, 22 nt, Human
uuccuggguugugcauuguaca

SEQ ID NO: 619737 - RNA, 22 nt, Human
gcacaaaacacauuuugacaau

SEQ ID NO: 619738 - RNA, 22 nt, Human
uuuccuccuagccuccagccgc

SEQ ID NO: 619739 - RNA, 23 nt, Human
gggagaugggaaaugaaggcucu

SEQ ID NO: 619740 - RNA, 22 nt, Human
uauuucuaagcuguaagucuga

SEQ ID NO: 619741 - RNA, 22 nt, Human
uauuuucaucuuguccuuggau

SEQ ID NO: 619742 - RNA, 22 nt, Human
ggagcagaugucuucauggccu

SEQ ID NO: 619743 - RNA, 22 nt, Human
ugaucccaaucuuuccugcucc

SEQ ID NO: 619744 - RNA, 22 nt, Human
uaggccaugcagcaaagaggcu

SEQ ID NO: 619745 - RNA, 22 nt, Human
agagagcccgggccagggcaca

SEQ ID NO: 619746 - RNA, 22 nt, Human
ccaggagcgggaaaaggaagaa

SEQ ID NO: 619747 - RNA, 22 nt, Human
cugcaggggaccaaagucugac

SEQ ID NO: 619748 - RNA, 22 nt, Human
gucuggcuguccagcuuaucua

SEQ ID NO: 619749 - RNA, 22 nt, Human
cuaugaccccagcaugaauaag

SEQ ID NO: 619750 - RNA, 22 nt, Human
gauuucuuuagcucaucagauc

SEQ ID NO: 619751 - RNA, 19 nt, Human
accugcaguaauaauuccu

SEQ ID NO: 619752 - RNA, 22 nt, Human
aguguccccuccaagggccugg

SEQ ID NO: 619753 - RNA, 22 nt, Human
aggugggacccguggggugcga

SEQ ID NO: 619754 - RNA, 22 nt, Human
gagugcaauggcaugaucuggg

SEQ ID NO: 619755 - RNA, 22 nt, Human
uaggaacauaugcagugcuuuu

SEQ ID NO: 619756 - RNA, 22 nt, Human
ucaguguuugguuucagaauug

SEQ ID NO: 619757 - RNA, 22 nt, Human
ugaggcaggaaguuauauaaug

SEQ ID NO: 619758 - RNA, 22 nt, Human
auacagggacauccaguuuuuc

SEQ ID NO: 619759 - RNA, 22 nt, Human
aaagccuugggauuugugauca

SEQ ID NO: 619760 - RNA, 22 nt, Human
cuggccuggagccucugggugg

SEQ ID NO: 619761 - RNA, 22 nt, Human
uccuggaguggagucuguuguu

SEQ ID NO: 619762 - RNA, 22 nt, Human
ccacaucugguggccagugcua

SEQ ID NO: 619763 - RNA, 22 nt, Human
acauuucuccuugcaggaguca

SEQ ID NO: 619764 - RNA, 18 nt, Human
ugaucuuugaguauaaug

SEQ ID NO: 619765 - RNA, 22 nt, Human
ccucccuucaguagagcccaau

SEQ ID NO: 619766 - RNA, 22 nt, Human
ucugugugguaguuucagugaa

SEQ ID NO: 619767 - RNA, 22 nt, Human
agguucagaguuguugauguuu

SEQ ID NO: 619768 - RNA, 22 nt, Human
acagcagggggagcuguuggac

SEQ ID NO: 619769 - RNA, 22 nt, Human
uagguccacaagaucaaugcag

SEQ ID NO: 619770 - RNA, 22 nt, Human
uuuccuugcacauugguuucca

SEQ ID NO: 619771 - RNA, 22 nt, Human
gcaguguuacuuggaguacuaa

SEQ ID NO: 619772 - RNA, 22 nt, Human
gaaguagaaagccucguaaaua

SEQ ID NO: 619773 - RNA, 22 nt, Human
cugcaggcugagcgccugccgg

SEQ ID NO: 619774 - RNA, 22 nt, Human
ugccuucaaucaggauggucuc

SEQ ID NO: 619775 - RNA, 22 nt, Human
cuguucaguaaccuauaaaaca

SEQ ID NO: 619776 - RNA, 22 nt, Human
cccagcuccuuacagggccgaa

SEQ ID NO: 619777 - RNA, 20 nt, Human
augcaaacucacaaaauacc

SEQ ID NO: 619778 - RNA, 20 nt, Human
uccuggccucccuggggcuc

SEQ ID NO: 619779 - RNA, 22 nt, Human
uacagcaugaucacaauggaaa

SEQ ID NO: 619780 - RNA, 20 nt, Human
ugcugaagaaucacagaugg

SEQ ID NO: 619781 - RNA, 22 nt, Human
ccaguguucauaauuuuacacu

SEQ ID NO: 619782 - RNA, 22 nt, Human
auuauaaagaacaugugugugg

SEQ ID NO: 619783 - RNA, 22 nt, Human
ccugggaggcuguuuccagccu

SEQ ID NO: 619784 - RNA, 22 nt, Human
auuuguagugaagugaaaauaa

SEQ ID NO: 619785 - RNA, 16 nt, Human
gcugggagggagaggu

SEQ ID NO: 619786 - RNA, 21 nt, Human
aggagggcacaaggccaggaa

SEQ ID NO: 619787 - RNA, 22 nt, Human
auuuugcacacuaugcagcuuu

SEQ ID NO: 619788 - RNA, 22 nt, Human
uuccuggggcgacuguaucuga

SEQ ID NO: 619789 - RNA, 22 nt, Human
agccagggaaggauaacaagaa

SEQ ID NO: 619790 - RNA, 22 nt, Human
uccagggcuuggcugggacggu

SEQ ID NO: 619791 - RNA, 23 nt, Human
uuauaaauauuuucagguguguu

SEQ ID NO: 619792 - RNA, 23 nt, Human
uccugccagaugacuccuuucuu

SEQ ID NO: 619793 - RNA, 22 nt, Human
cagcaguaacucccgugcagca

SEQ ID NO: 619794 - RNA, 22 nt, Human
gggcugaucgcuugagcucagg

SEQ ID NO: 619795 - RNA, 22 nt, Human
uccaguggaacagauguugccu

SEQ ID NO: 619796 - RNA, 22 nt, Human
ccugggagccaagccucugugu

SEQ ID NO: 619797 - RNA, 22 nt, Human
ccagguggugaaagugggcccu

SEQ ID NO: 619798 - RNA, 22 nt, Human
auauuucuccaaauguuuucaa

SEQ ID NO: 619799 - RNA, 20 nt, Human
uacaaaccuccacacuggug

SEQ ID NO: 619800 - RNA, 22 nt, Human
aaacagcagcuguuuaauuugc

SEQ ID NO: 619801 - RNA, 22 nt, Human
ggcgggugcacagacccuuccc

SEQ ID NO: 619802 - RNA, 22 nt, Human
uugaaauaucaaguuauuagug

SEQ ID NO: 619803 - RNA, 18 nt, Human
uucuccagaaaacauagc

SEQ ID NO: 619804 - RNA, 20 nt, Human
uaugcuuuuuauaagauuga

SEQ ID NO: 619805 - RNA, 19 nt, Human
aggcaggugcagagguccc

SEQ ID NO: 619806 - RNA, 22 nt, Human
ugugggaggucuggaaggcucc

SEQ ID NO: 619807 - RNA, 22 nt, Human
ucagguccaagauggccaucca

SEQ ID NO: 619808 - RNA, 22 nt, Human
agaucaaaaacuuaauggcuuu

SEQ ID NO: 619809 - RNA, 22 nt, Human
ugucaugggcauuuauugaggg

SEQ ID NO: 619810 - RNA, 21 nt, Human
uguguucuucuaggucagcua

SEQ ID NO: 619811 - RNA, 22 nt, Human
cuggguguuggguacugaccgu

SEQ ID NO: 619812 - RNA, 22 nt, Human
gacaucauaucaggaggcaugu

SEQ ID NO: 619813 - RNA, 22 nt, Human
caauuagaggaggaagcucaua

SEQ ID NO: 619814 - RNA, 22 nt, Human
cccagcucuaggagugguggca

SEQ ID NO: 619815 - RNA, 22 nt, Human
ugacuugucucuuugggagaca

SEQ ID NO: 619816 - RNA, 22 nt, Human
ccuggcagguggagguugcagu

SEQ ID NO: 619817 - RNA, 22 nt, Human
cggagaggugggggcagcaucu

SEQ ID NO: 619818 - RNA, 22 nt, Human
ucaaguagaacuauaaugaugu

SEQ ID NO: 619819 - RNA, 22 nt, Human
cuguucacagaauccuccccug

SEQ ID NO: 619820 - RNA, 23 nt, Human
uggcaggugguuagauguuuugu

SEQ ID NO: 619821 - RNA, 22 nt, Human
uucacaguggcugugccauuug

SEQ ID NO: 619822 - RNA, 20 nt, Human
uuucacaaugaacaugucuc

SEQ ID NO: 619823 - RNA, 22 nt, Human
agugauggggcccugcacugau

SEQ ID NO: 619824 - RNA, 22 nt, Human
uccuggaguaggccuuagccau

SEQ ID NO: 619825 - RNA, 22 nt, Human
uggagaauucuauguugagggg

SEQ ID NO: 619826 - RNA, 22 nt, Human
gaggaaaaugcaacaggaaugc

SEQ ID NO: 619827 - RNA, 22 nt, Human
auuccuugggcugccuuauuau

SEQ ID NO: 619828 - RNA, 22 nt, Human
agcucucugauaaauugauaaa

SEQ ID NO: 619829 - RNA, 18 nt, Human
ugaggcagucagugaugg

SEQ ID NO: 619830 - RNA, 22 nt, Human
ugccuaggcuggaaugcagugg

SEQ ID NO: 619831 - RNA, 19 nt, Human
uggccagguacugucugcu

SEQ ID NO: 619832 - RNA, 22 nt, Human
accuguggaucagauucuugua

SEQ ID NO: 619833 - RNA, 22 nt, Human
gagcucauuguggauggauggg

SEQ ID NO: 619834 - RNA, 22 nt, Human
ccaggucccuggaauuuaugag

SEQ ID NO: 619835 - RNA, 22 nt, Human
ugcauacauaaagugcuaucau

SEQ ID NO: 619836 - RNA, 22 nt, Human
aggccaucaaaucauguagugc

SEQ ID NO: 619837 - RNA, 22 nt, Human
gggcuggaggagauccagaggc

SEQ ID NO: 619838 - RNA, 23 nt, Human
gguaccagcacagaguggagagg

SEQ ID NO: 619839 - RNA, 22 nt, Human
aggugcagugaaggaaaaggaa

SEQ ID NO: 619840 - RNA, 22 nt, Human
cugggugucaggagacaugaug

SEQ ID NO: 619841 - RNA, 22 nt, Human
cuguguuuuuggucugaucuau

SEQ ID NO: 619842 - RNA, 17 nt, Human
agcugccuugcuugagc

SEQ ID NO: 619843 - RNA, 22 nt, Human
aggcauggauggauccagggcu

SEQ ID NO: 619844 - RNA, 22 nt, Human
caugcagugacucagacacagg

SEQ ID NO: 619845 - RNA, 22 nt, Human
auacagugccccuuuucacaug

SEQ ID NO: 619846 - RNA, 22 nt, Human
aagcacaggaucuugaggagcg

SEQ ID NO: 619847 - RNA, 18 nt, Human
uugaaguuauuuacauuc

SEQ ID NO: 619848 - RNA, 22 nt, Human
gaauccaggguuguuugagcua

SEQ ID NO: 619849 - RNA, 22 nt, Human
acaggaaagagcuaggcauagg

SEQ ID NO: 619850 - RNA, 22 nt, Human
cugcccaggaaggagaggaugg

SEQ ID NO: 619851 - RNA, 22 nt, Human
gccuguuucuaaucucauuucu

SEQ ID NO: 619852 - RNA, 22 nt, Human
agaagcagggcagggaaaagca

SEQ ID NO: 619853 - RNA, 22 nt, Human
agacacugccacuucuguuccc

SEQ ID NO: 619854 - RNA, 22 nt, Human
gggcagguguugucaaucuaau

SEQ ID NO: 619855 - RNA, 22 nt, Human
ugugugaacucucugauguaca

SEQ ID NO: 619856 - RNA, 22 nt, Human
cuguucagaaaaaaucuucaug

SEQ ID NO: 619857 - RNA, 22 nt, Human
uacaaagucaccagcuucuugc

SEQ ID NO: 619858 - RNA, 22 nt, Human
aaacucugccauuuuuggccug

SEQ ID NO: 619859 - RNA, 22 nt, Human
ucugggagagucuaacuuguuu

SEQ ID NO: 619860 - RNA, 22 nt, Human
gcagccagccccucugaccucu

SEQ ID NO: 619861 - RNA, 22 nt, Human
ugacuuccugcacucaggugau

SEQ ID NO: 619862 - RNA, 22 nt, Human
ccagugcgagccugugcuggcc

SEQ ID NO: 619863 - RNA, 22 nt, Human
uccuggggcucuuugaugugau

SEQ ID NO: 619864 - RNA, 22 nt, Human
gcaggcucaaaagcugguagga

SEQ ID NO: 619865 - RNA, 22 nt, Human
aagccuucagaguuggcugguc

SEQ ID NO: 619866 - RNA, 22 nt, Human
gucacccugcuguuuguccauu

SEQ ID NO: 619867 - RNA, 22 nt, Human
ucaaaggagacacaaggagaaa

SEQ ID NO: 619868 - RNA, 22 nt, Human
uuggaaggaauuaaggucauga

SEQ ID NO: 619869 - RNA, 23 nt, Human
agguucagcuuucuuacucuggg

SEQ ID NO: 619870 - RNA, 22 nt, Human
cugugucuucacauuugugugc

SEQ ID NO: 619871 - RNA, 23 nt, Human
gcuugcucauucuaucacacagc

SEQ ID NO: 619872 - RNA, 22 nt, Human
uuguauuuccuauaaccuuucu

SEQ ID NO: 619873 - RNA, 22 nt, Human
auaaugcagcuuuucaauggcc

SEQ ID NO: 619874 - RNA, 22 nt, Human
aggcaggggagcuggaagggua

SEQ ID NO: 619875 - RNA, 22 nt, Human
agucucuuaaugggcagaaagu

SEQ ID NO: 619876 - RNA, 22 nt, Human
guuccuuguaauuuguuaagga

SEQ ID NO: 619877 - RNA, 22 nt, Human
gcugaggccaguuuaaugagga

SEQ ID NO: 619878 - RNA, 22 nt, Human
uccuucaaagcuccuagugagc

SEQ ID NO: 619879 - RNA, 22 nt, Human
agagaaaguccugaucucucua

SEQ ID NO: 619880 - RNA, 22 nt, Human
aguguucagugauugucaaccg

SEQ ID NO: 619881 - RNA, 22 nt, Human
caucuugcuucaucugcugugu

SEQ ID NO: 619882 - RNA, 22 nt, Human
agccaggacguugcucagcucc

SEQ ID NO: 619883 - RNA, 22 nt, Human
cugggcucuagaaaggaaagaa

SEQ ID NO: 619884 - RNA, 22 nt, Human
uguccaguccuuggggugcugu

SEQ ID NO: 619885 - RNA, 21 nt, Human
uccucccugagcuguggggga

SEQ ID NO: 619886 - RNA, 22 nt, Human
ugccuggcacagagcagguggc

SEQ ID NO: 619887 - RNA, 22 nt, Human
gccaccugguggcaucuucugg

SEQ ID NO: 619888 - RNA, 19 nt, Human
gcugggagcagacccuccc

SEQ ID NO: 619889 - RNA, 22 nt, Human
uuugaaagaauuuauguacuuu

SEQ ID NO: 619890 - RNA, 22 nt, Human
guggcugcuguccucucugguu

SEQ ID NO: 619891 - RNA, 23 nt, Human
aguucaaaaucaaccaggacacu

SEQ ID NO: 619892 - RNA, 22 nt, Human
accugcagguguuuccacacuu

SEQ ID NO: 619893 - RNA, 22 nt, Human
gcaaauacauguugagcaccua

SEQ ID NO: 619894 - RNA, 22 nt, Human
auucagaaagauaugccugguu

SEQ ID NO: 619895 - RNA, 22 nt, Human
aggcaggugggagugauuccuu

SEQ ID NO: 619896 - RNA, 22 nt, Human
agugcaaagcagccuguacacc

SEQ ID NO: 619897 - RNA, 22 nt, Human
auuggccauuugcauguauuau

SEQ ID NO: 619898 - RNA, 22 nt, Human
gcaggcacuccuaggaccauca

SEQ ID NO: 619899 - RNA, 22 nt, Human
ggccccagauucugggcugggu

SEQ ID NO: 619900 - RNA, 22 nt, Human
uauuacaagaaagggcaugaau

SEQ ID NO: 619901 - RNA, 22 nt, Human
caauuagacauuuauuggccag

SEQ ID NO: 619902 - RNA, 22 nt, Human
uuccugggaggcuguguacuug

SEQ ID NO: 619903 - RNA, 22 nt, Human
ccccaugcugggaucugacacc

SEQ ID NO: 619904 - RNA, 18 nt, Human
cuggagucacagugggga

SEQ ID NO: 619905 - RNA, 22 nt, Human
gacccugagcaaaagcaguucu

SEQ ID NO: 619906 - RNA, 22 nt, Human
ggaaggaaagcagcuuggcccu

SEQ ID NO: 619907 - RNA, 22 nt, Human
agucuugguccaggcucauuuc

SEQ ID NO: 619908 - RNA, 22 nt, Human
guaagccuggaauuuuugacuu

SEQ ID NO: 619909 - RNA, 18 nt, Human
uucagcagcagacacacu

SEQ ID NO: 619910 - RNA, 22 nt, Human
aguaaucaauuuuucgguggau

SEQ ID NO: 619911 - RNA, 22 nt, Human
augucaccuucgguggcacggu

SEQ ID NO: 619912 - RNA, 22 nt, Human
uggagcaugagagucuuuagcu

SEQ ID NO: 619913 - RNA, 21 nt, Human
ugagugccaccugcuggccaa

SEQ ID NO: 619914 - RNA, 22 nt, Human
gcggggcccccggccgagcucu

SEQ ID NO: 619915 - RNA, 22 nt, Human
caagaagucauuuagccucuca

SEQ ID NO: 619916 - RNA, 22 nt, Human
ucuuacaagaaauaagccaaug

SEQ ID NO: 619917 - RNA, 22 nt, Human
caggccagugggaaauagggau

SEQ ID NO: 619918 - RNA, 22 nt, Human
acccagagcccuuagcacagac

SEQ ID NO: 619919 - RNA, 22 nt, Human
cuggccacaugugugcugagca

SEQ ID NO: 619920 - RNA, 22 nt, Human
ucuugcacuucaugaauauguu

SEQ ID NO: 619921 - RNA, 22 nt, Human
uuguugcaaggguuaaaugaga

SEQ ID NO: 619922 - RNA, 22 nt, Human
ggccagggggcuucagacucca

SEQ ID NO: 619923 - RNA, 22 nt, Human
cugcagggaccacaagcagguu

SEQ ID NO: 619924 - RNA, 22 nt, Human
acuggcugaaaguaaagaacac

SEQ ID NO: 619925 - RNA, 22 nt, Human
gaagagcuggaauccagucugg

SEQ ID NO: 619926 - RNA, 18 nt, Human
gcaagcccucuccauuaa

SEQ ID NO: 619927 - RNA, 19 nt, Human
ucucaauguucagaaagcu

SEQ ID NO: 619928 - RNA, 22 nt, Human
uaaauucugaucaaguuccuuc

SEQ ID NO: 619929 - RNA, 22 nt, Human
cuggccacuggagguggcaccc

SEQ ID NO: 619930 - RNA, 22 nt, Human
cuccuggcuaugacuacauuuc

SEQ ID NO: 619931 - RNA, 22 nt, Human
uuugagguuagcuagcagauca

SEQ ID NO: 619932 - RNA, 22 nt, Human
cacaguggaaguccaggauccc

SEQ ID NO: 619933 - RNA, 16 nt, Human
ggguccagaucugcuc

SEQ ID NO: 619934 - RNA, 22 nt, Human
cagcaggauuggauacaucuca

SEQ ID NO: 619935 - RNA, 23 nt, Human
aaauaggaguaucuggaucauga

SEQ ID NO: 619936 - RNA, 22 nt, Human
aggucacacaacugucagaggc

SEQ ID NO: 619937 - RNA, 22 nt, Human
agucuugaaagcacauuagagu

SEQ ID NO: 619938 - RNA, 21 nt, Human
ugcauauauaagugcauacac

SEQ ID NO: 619939 - RNA, 22 nt, Human
ucuguggcauguugcacuugua

SEQ ID NO: 619940 - RNA, 22 nt, Human
gccaccugugugggccuuugug

SEQ ID NO: 619941 - RNA, 22 nt, Human
ccagggggcuuggugaggccau

SEQ ID NO: 619942 - RNA, 22 nt, Human
uuguggcucaucuucagcuccc

SEQ ID NO: 619943 - RNA, 22 nt, Human
ggguccagggccaguggcugag

SEQ ID NO: 619944 - RNA, 22 nt, Human
cugccccugccaggcagcuguc

SEQ ID NO: 619945 - RNA, 22 nt, Human
gagcagggagacaacucuggug

SEQ ID NO: 619946 - RNA, 22 nt, Human
aacaugcaaugucugaaaaucc

SEQ ID NO: 619947 - RNA, 22 nt, Human
auguuucugaaguuuacagaua

SEQ ID NO: 619948 - RNA, 22 nt, Human
aaagaucagucugaagcaacau

SEQ ID NO: 619949 - RNA, 22 nt, Human
ggcuuuauuucacuguaccaua

SEQ ID NO: 619950 - RNA, 20 nt, Human
aaauuuaggaaauuuuacgc

SEQ ID NO: 619951 - RNA, 22 nt, Human
agggcgggcucaucacaugcuc

SEQ ID NO: 619952 - RNA, 22 nt, Human
uucuggcuccagaugcuucugu

SEQ ID NO: 619953 - RNA, 22 nt, Human
uuuucugugauucugagguugg

SEQ ID NO: 619954 - RNA, 22 nt, Human
ggccugaggcgucccagcugug

SEQ ID NO: 619955 - RNA, 22 nt, Human
ugagucuuuccaaagccgucau

SEQ ID NO: 619956 - RNA, 22 nt, Human
cuggcuccauuacucagcaucu

SEQ ID NO: 619957 - RNA, 22 nt, Human
cugcccugucugcagccuggcu

SEQ ID NO: 619958 - RNA, 23 nt, Human
uugaauaggguggcaacaaacug

SEQ ID NO: 619959 - RNA, 22 nt, Human
aggcgcagacauacagggucug

SEQ ID NO: 619960 - RNA, 22 nt, Human
gccagccugugggggcucugug

SEQ ID NO: 619961 - RNA, 22 nt, Human
guccagugcuaacagguugagg

SEQ ID NO: 619962 - RNA, 22 nt, Human
ucagccuugcuucuggacuggu

SEQ ID NO: 619963 - RNA, 22 nt, Human
caggcucccugcaggccaguga

SEQ ID NO: 619964 - RNA, 22 nt, Human
ugugacagugccagcuucauag

SEQ ID NO: 619965 - RNA, 22 nt, Human
uccuguuuuuguaaucgacucu

SEQ ID NO: 619966 - RNA, 22 nt, Human
uuugggcugguuugccaugccc

SEQ ID NO: 619967 - RNA, 22 nt, Human
uguguucaaucaccaaagguau

SEQ ID NO: 619968 - RNA, 22 nt, Human
ggagggcaacuuuucaguaggu

SEQ ID NO: 619969 - RNA, 22 nt, Human
aaaaugacauuccagugauauu

SEQ ID NO: 619970 - RNA, 22 nt, Human
uuuauuauccaguguugucaug

SEQ ID NO: 619971 - RNA, 23 nt, Human
aggagaagagauuuccacaugca

SEQ ID NO: 619972 - RNA, 22 nt, Human
guccugguggagucucugggga

SEQ ID NO: 619973 - RNA, 22 nt, Human
cagaagcacauguuuacaugua

SEQ ID NO: 619974 - RNA, 22 nt, Human
acuuuucaaaugggaaacucag

SEQ ID NO: 619975 - RNA, 22 nt, Human
ggguccaggcguggcccagaug

SEQ ID NO: 619976 - RNA, 22 nt, Human
aagcacagggacucaggaccgg

SEQ ID NO: 619977 - RNA, 22 nt, Human
uuguuaaaacuccauugguuug

SEQ ID NO: 619978 - RNA, 17 nt, Human
cugaagauaauggcaac

SEQ ID NO: 619979 - RNA, 22 nt, Human
uacauacacaaauauacuguuu

SEQ ID NO: 619980 - RNA, 22 nt, Human
aaacuuguucucauguugcaga

SEQ ID NO: 619981 - RNA, 21 nt, Human
ugccagggauuuacagagccu

SEQ ID NO: 619982 - RNA, 22 nt, Human
ccugugugaagguuaggcaggu

SEQ ID NO: 619983 - RNA, 22 nt, Human
acuccugggugcauuucugauu

SEQ ID NO: 619984 - RNA, 22 nt, Human
caggcaggcugcuuuuuguuca

SEQ ID NO: 619985 - RNA, 22 nt, Human
cucuggcugccucucaggccug

SEQ ID NO: 619986 - RNA, 22 nt, Human
auaaaagaucccuucugagcuc

SEQ ID NO: 619987 - RNA, 22 nt, Human
ugccuucauccauguuauagug

SEQ ID NO: 619988 - RNA, 22 nt, Human
ucaguguuauuagaugagguuu

SEQ ID NO: 619989 - RNA, 22 nt, Human
aguguuucaagugaugcuuugg

SEQ ID NO: 619990 - RNA, 22 nt, Human
agccuguguuuuuucuauugca

SEQ ID NO: 619991 - RNA, 22 nt, Human
uuccuggguucccucucauucu

SEQ ID NO: 619992 - RNA, 22 nt, Human
ugaggcaggagaaucaccggaa

SEQ ID NO: 619993 - RNA, 22 nt, Human
auggccaccaucucuaaaacac

SEQ ID NO: 619994 - RNA, 22 nt, Human
caaaaagcuuagguaacaagcc

SEQ ID NO: 619995 - RNA, 22 nt, Human
guauuuuucauuccaagugaga

SEQ ID NO: 619996 - RNA, 22 nt, Human
uugcccuggggcuggccuggca

SEQ ID NO: 619997 - RNA, 22 nt, Human
uuugucuuauccaaucucucag

SEQ ID NO: 619998 - RNA, 22 nt, Human
gacagcauggugucuguucagg

SEQ ID NO: 619999 - RNA, 22 nt, Human
gucaggucuuggaagauaggcu

SEQ ID NO: 620000 - RNA, 22 nt, Human
ucuucaaacccuggcucuuccu

SEQ ID NO: 620001 - RNA, 21 nt, Human
auucagaguaauucaucuuua

SEQ ID NO: 620002 - RNA, 22 nt, Human
uccagaggcuccaaagggagau

SEQ ID NO: 620003 - RNA, 22 nt, Human
cuguggcuccauagaaguugca

SEQ ID NO: 620004 - RNA, 22 nt, Human
gacccugaggauucccugcuga

SEQ ID NO: 620005 - RNA, 22 nt, Human
ugcauccuccuuuguccucuug

SEQ ID NO: 620006 - RNA, 22 nt, Human
ggugcccaccugucuuccugga

SEQ ID NO: 620007 - RNA, 22 nt, Human
agaaaggaggaagaaugaccuc

SEQ ID NO: 620008 - RNA, 23 nt, Human
agaaggguccuuggcagcgacag

SEQ ID NO: 620009 - RNA, 22 nt, Human
uagaggcacccuggaggagacu

SEQ ID NO: 620010 - RNA, 22 nt, Human
acucaggaaaugagaggcucuc

SEQ ID NO: 620011 - RNA, 22 nt, Human
ggauccagaggugaagauggga

SEQ ID NO: 620012 - RNA, 22 nt, Human
agggcuuuggcccccugcugca

SEQ ID NO: 620013 - RNA, 22 nt, Human
uccugggucugggugucugagg

SEQ ID NO: 620014 - RNA, 22 nt, Human
gagaggccauggcugugcagug

SEQ ID NO: 620015 - RNA, 22 nt, Human
aggacuggugccagacaaggua

SEQ ID NO: 620016 - RNA, 22 nt, Human
aaauugcugugaggugguagua

SEQ ID NO: 620017 - RNA, 17 nt, Human
aaguccagaguugagca

SEQ ID NO: 620018 - RNA, 22 nt, Human
cuccugggcugucggcgcucug

SEQ ID NO: 620019 - RNA, 20 nt, Human
uuggaagguggagaagagga

SEQ ID NO: 620020 - RNA, 22 nt, Human
aaguagacagucaucuacuuug

SEQ ID NO: 620021 - RNA, 22 nt, Human
ggcugcagagcugggugggccu

SEQ ID NO: 620022 - RNA, 22 nt, Human
uacaugucuacaugcauuuuug

SEQ ID NO: 620023 - RNA, 22 nt, Human
ggcuuuauuaagcaggguaagu

SEQ ID NO: 620024 - RNA, 21 nt, Human
aggaggaacccguggcugggc

SEQ ID NO: 620025 - RNA, 22 nt, Human
ugccaguugggaaaacagacau

SEQ ID NO: 620026 - RNA, 22 nt, Human
ccagagcagaaccggaacacca

SEQ ID NO: 620027 - RNA, 22 nt, Human
gggcaggugcccagggccagag

SEQ ID NO: 620028 - RNA, 22 nt, Human
uuggaagggauauuggcauaug

SEQ ID NO: 620029 - RNA, 20 nt, Human
acuuuacagagaagacugac

SEQ ID NO: 620030 - RNA, 22 nt, Human
ccuuuuuucuaugccaacucug

SEQ ID NO: 620031 - RNA, 22 nt, Human
gcauggccuccagccaacagca

SEQ ID NO: 620032 - RNA, 22 nt, Human
ggccacugaccuacaucugggg

SEQ ID NO: 620033 - RNA, 22 nt, Human
agagccuguaacaucuuucuua

SEQ ID NO: 620034 - RNA, 22 nt, Human
agagccaggcucuaccuggguu

SEQ ID NO: 620035 - RNA, 22 nt, Human
agcuuuaaaucaauccagugag

SEQ ID NO: 620036 - RNA, 20 nt, Human
cugcccugcccuggguccug

SEQ ID NO: 620037 - RNA, 22 nt, Human
gggcaggugaccucuuguccug

SEQ ID NO: 620038 - RNA, 22 nt, Human
uuacaagacagugugguaaaua

SEQ ID NO: 620039 - RNA, 22 nt, Human
ggagcagagcauuucacagccu

SEQ ID NO: 620040 - RNA, 22 nt, Human
uugcccugccucccugagguga

SEQ ID NO: 620041 - RNA, 22 nt, Human
uacuuaaaacugauagaaucuc

SEQ ID NO: 620042 - RNA, 22 nt, Human
auuuauaacgugcagccagggu

SEQ ID NO: 620043 - RNA, 23 nt, Human
agcuuccuagugaccuggagucu

SEQ ID NO: 620044 - RNA, 22 nt, Human
auggccacauuuaguaacuggu

SEQ ID NO: 620045 - RNA, 22 nt, Human
aaagcagaggugauaugacuua

SEQ ID NO: 620046 - RNA, 22 nt, Human
cugugcuugcggguguggagcc

SEQ ID NO: 620047 - RNA, 22 nt, Human
gggcuuuaugagauugagaucu

SEQ ID NO: 620048 - RNA, 22 nt, Human
cgaggcagggaagcugcaaaag

SEQ ID NO: 620049 - RNA, 22 nt, Human
augcccugcugcuggggcagug

SEQ ID NO: 620050 - RNA, 22 nt, Human
uaggcaggugugcacugcccac

SEQ ID NO: 620051 - RNA, 22 nt, Human
agggcuuucggcacucugaggg

SEQ ID NO: 620052 - RNA, 22 nt, Human
auacauauccacaggagauaaa

SEQ ID NO: 620053 - RNA, 22 nt, Human
uuuacaagucuguugaucccaa

SEQ ID NO: 620054 - RNA, 22 nt, Human
aaacagaaauuuccucaugcuc

SEQ ID NO: 620055 - RNA, 22 nt, Human
uuguugacgacuugacuuucuc

SEQ ID NO: 620056 - RNA, 22 nt, Human
ggagagcugacaucaugauguu

SEQ ID NO: 620057 - RNA, 22 nt, Human
guguccagagaacugugggagc

SEQ ID NO: 620058 - RNA, 22 nt, Human
acaguuaucuuugaaauagaga

SEQ ID NO: 620059 - RNA, 22 nt, Human
aggcuggugccugcagugaauc

SEQ ID NO: 620060 - RNA, 22 nt, Human
agugcaggccccaggccaggcc

SEQ ID NO: 620061 - RNA, 22 nt, Human
uaaaguguaugccaucucucau

SEQ ID NO: 620062 - RNA, 22 nt, Human
agaaggguagggacuuauccaa

SEQ ID NO: 620063 - RNA, 22 nt, Human
gggggcuggaauauccaucaac

SEQ ID NO: 620064 - RNA, 22 nt, Human
cuguggcuggccugucugacau

SEQ ID NO: 620065 - RNA, 22 nt, Human
acugccaaugguaguuugaugg

SEQ ID NO: 620066 - RNA, 22 nt, Human
caggucagagguagaugagaug

SEQ ID NO: 620067 - RNA, 22 nt, Human
ugucuguggcaauuguggguaa

SEQ ID NO: 620068 - RNA, 22 nt, Human
ccaggcugcuuuauuacucugu

SEQ ID NO: 620069 - RNA, 22 nt, Human
gggcagguacuggguggugagc

SEQ ID NO: 620070 - RNA, 22 nt, Human
aaauggcuuugaggguaggaca

SEQ ID NO: 620071 - RNA, 22 nt, Human
gaggggaaagugugaggcugcg

SEQ ID NO: 620072 - RNA, 22 nt, Human
ggcaaguauuugugcaucuaca

SEQ ID NO: 620073 - RNA, 22 nt, Human
ccaguguguucccugccucacu

SEQ ID NO: 620074 - RNA, 19 nt, Human
uaccauguugacuuuccug

SEQ ID NO: 620075 - RNA, 22 nt, Human
gaagcuccguacuaugacuuuu

SEQ ID NO: 620076 - RNA, 22 nt, Human
gacacaaaguuugucagaaauu

SEQ ID NO: 620077 - RNA, 22 nt, Human
ucauggcuugcagauggccacc

SEQ ID NO: 620078 - RNA, 22 nt, Human
uggagaauuaggccaaaucucc

SEQ ID NO: 620079 - RNA, 22 nt, Human
gccuguuuggcugcugacauug

SEQ ID NO: 620080 - RNA, 22 nt, Human
aggcagguguuaacccucugag

SEQ ID NO: 620081 - RNA, 22 nt, Human
uuuauuuaccuuauguccucca

SEQ ID NO: 620082 - RNA, 22 nt, Human
agguccaguuuucaguucucau

SEQ ID NO: 620083 - RNA, 22 nt, Human
ugcugccuggagccuuuuguuu

SEQ ID NO: 620084 - RNA, 22 nt, Human
guggcagggguauuccagcuga

SEQ ID NO: 620085 - RNA, 22 nt, Human
cugaggcugggcauggggucca

SEQ ID NO: 620086 - RNA, 22 nt, Human
agguccagugcucuuggugguu

SEQ ID NO: 620087 - RNA, 22 nt, Human
ggacaaagcucugcugccuccc

SEQ ID NO: 620088 - RNA, 22 nt, Human
cuggcccuggcuggagcccagg

SEQ ID NO: 620089 - RNA, 22 nt, Human
agggaaggaaaagcugucgcuu

SEQ ID NO: 620090 - RNA, 22 nt, Human
uuucucucagccuguagaaacu

SEQ ID NO: 620091 - RNA, 22 nt, Human
cuuuacaaauagggagggagug

SEQ ID NO: 620092 - RNA, 21 nt, Human
gcagccagccgagaccaugcc

SEQ ID NO: 620093 - RNA, 22 nt, Human
cagagaaagaagcccauucauu

SEQ ID NO: 620094 - RNA, 22 nt, Human
ucagcaggcgguuccuuguggg

SEQ ID NO: 620095 - RNA, 22 nt, Human
caaauauuccagguacaucccu

SEQ ID NO: 620096 - RNA, 22 nt, Human
gggaaaucucguccucuauuua

SEQ ID NO: 620097 - RNA, 22 nt, Human
uccuucaagugcaguaccugag

SEQ ID NO: 620098 - RNA, 22 nt, Human
ggucccagcugcucaagaggcu

SEQ ID NO: 620099 - RNA, 23 nt, Human
uugagucuuauaggauugaggug

SEQ ID NO: 620100 - RNA, 22 nt, Human
ugaaaaugcacgcuggaaagca

SEQ ID NO: 620101 - RNA, 22 nt, Human
agagccuggagguucugcugaa

SEQ ID NO: 620102 - RNA, 22 nt, Human
aauaaaauggucaguuuucuca

SEQ ID NO: 620103 - RNA, 22 nt, Human
uuucaauaacaaagcucauuuu

SEQ ID NO: 620104 - RNA, 22 nt, Human
ccggcgggcagcggcagugagc

SEQ ID NO: 620105 - RNA, 20 nt, Human
gugcccugugggcuauuuuc

SEQ ID NO: 620106 - RNA, 22 nt, Human
auuuuacauaaggaagguuuaa

SEQ ID NO: 620107 - RNA, 22 nt, Human
aguguuuaaugccuuuuccagc

SEQ ID NO: 620108 - RNA, 22 nt, Human
uuucaaagguuuugucaugucu

SEQ ID NO: 620109 - RNA, 22 nt, Human
ccagcagggcagugcccuggac

SEQ ID NO: 620110 - RNA, 23 nt, Human
cuguuaaauuccuuaagagcagg

SEQ ID NO: 620111 - RNA, 17 nt, Human
uuaagguggaucagcac

SEQ ID NO: 620112 - RNA, 21 nt, Human
agaaguccccacucugucgca

SEQ ID NO: 620113 - RNA, 22 nt, Human
guuaaauaaccucauguccguu

SEQ ID NO: 620114 - RNA, 20 nt, Human
uugauucaagggcugaugga

SEQ ID NO: 620115 - RNA, 22 nt, Human
ugaagcugugggcaguggagcc

SEQ ID NO: 620116 - RNA, 22 nt, Human
ucugugugcccuaaagccugcu

SEQ ID NO: 620117 - RNA, 22 nt, Human
cuggaagguuccucccagcucc

SEQ ID NO: 620118 - RNA, 22 nt, Human
ggguccagguuuagucauuugu

SEQ ID NO: 620119 - RNA, 22 nt, Human
uccagggacagcgcuggagcua

SEQ ID NO: 620120 - RNA, 22 nt, Human
ucugcaggcauuuuugguuguc

SEQ ID NO: 620121 - RNA, 22 nt, Human
auggcaaaaauuaacagaucaa

SEQ ID NO: 620122 - RNA, 22 nt, Human
uauguccugcuacucucucaug

SEQ ID NO: 620123 - RNA, 22 nt, Human
agccagaaaggggcauuaucug

SEQ ID NO: 620124 - RNA, 22 nt, Human
gcuggggagaauuggguuaucu

SEQ ID NO: 620125 - RNA, 22 nt, Human
agaaguccccccagcaucguag

SEQ ID NO: 620126 - RNA, 22 nt, Human
uucauggaucaugccuuuugug

SEQ ID NO: 620127 - RNA, 22 nt, Human
cagcucagucuggagagaugca

SEQ ID NO: 620128 - RNA, 22 nt, Human
gcaucuaaauaaacgugggagu

SEQ ID NO: 620129 - RNA, 22 nt, Human
cuuuacagaaagagaacucugg

SEQ ID NO: 620130 - RNA, 22 nt, Human
ccagugcgcaggcgccaccugu

SEQ ID NO: 620131 - RNA, 22 nt, Human
gcuucaaacugagcuucaagug

SEQ ID NO: 620132 - RNA, 22 nt, Human
uuuacaugaguagcagauguuc

SEQ ID NO: 620133 - RNA, 22 nt, Human
agcaagaagggcaaggaaguuu

SEQ ID NO: 620134 - RNA, 22 nt, Human
acagcaggaagcuggagggaaa

SEQ ID NO: 620135 - RNA, 22 nt, Human
ugguccaguucugugauauugc

SEQ ID NO: 620136 - RNA, 22 nt, Human
uucucacaggcuggaaugauga

SEQ ID NO: 620137 - RNA, 22 nt, Human
ucagguccccaacucuucucac

SEQ ID NO: 620138 - RNA, 22 nt, Human
cagcuggguggcucuucugcuc

SEQ ID NO: 620139 - RNA, 22 nt, Human
caguuucuguggucucuuuuca

SEQ ID NO: 620140 - RNA, 22 nt, Human
accugcaggggugcucucuggg

SEQ ID NO: 620141 - RNA, 22 nt, Human
gcuggcuggcgggugcguccuc

SEQ ID NO: 620142 - RNA, 22 nt, Human
uccaaaggaagaggcugucagu

SEQ ID NO: 620143 - RNA, 22 nt, Human
cccagccugucuuucccaauga

SEQ ID NO: 620144 - RNA, 22 nt, Human
acaggggcuccgaaggugaggg

SEQ ID NO: 620145 - RNA, 22 nt, Human
ugaagauccuaucugcaaauau

SEQ ID NO: 620146 - RNA, 22 nt, Human
ggggcccagcaccccuccucgc

SEQ ID NO: 620147 - RNA, 22 nt, Human
ugguuccuacgcacauugaauu

SEQ ID NO: 620148 - RNA, 22 nt, Human
ccugggcuuacgaccucugacu

SEQ ID NO: 620149 - RNA, 22 nt, Human
augggcaagggguaaggacacu

SEQ ID NO: 620150 - RNA, 22 nt, Human
augaaagaugauuuaaaguacu

SEQ ID NO: 620151 - RNA, 23 nt, Human
uggcucucucagugcugcagagg

SEQ ID NO: 620152 - RNA, 22 nt, Human
guggaagguaaugcagcuuacu

SEQ ID NO: 620153 - RNA, 22 nt, Human
uccuguguaaauagaucugguu

SEQ ID NO: 620154 - RNA, 22 nt, Human
uuaaauaguaggucuauuuugg

SEQ ID NO: 620155 - RNA, 22 nt, Human
uccugggugugauauucauaga

SEQ ID NO: 620156 - RNA, 20 nt, Human
agccucugcccuucccacug

SEQ ID NO: 620157 - RNA, 22 nt, Human
cuggagcucuucugagugugcu

SEQ ID NO: 620158 - RNA, 22 nt, Human
accuguuucucucugaguuacu

SEQ ID NO: 620159 - RNA, 22 nt, Human
ggagggccccuccagugggcag

SEQ ID NO: 620160 - RNA, 22 nt, Human
auuuauuaugggauuuggcuca

SEQ ID NO: 620161 - RNA, 22 nt, Human
cuggcucauagagcagcuccaa

SEQ ID NO: 620162 - RNA, 22 nt, Human
cucaaauauguggucagaaagc

SEQ ID NO: 620163 - RNA, 22 nt, Human
gugggagaagauuuggucaucu

SEQ ID NO: 620164 - RNA, 22 nt, Human
agagucugugcuuucaucagga

SEQ ID NO: 620165 - RNA, 22 nt, Human
ggguccagggacguuucugcag

SEQ ID NO: 620166 - RNA, 22 nt, Human
acaguguucugaaaguugaggg

SEQ ID NO: 620167 - RNA, 22 nt, Human
ggcaggcucagcagccaaggag

SEQ ID NO: 620168 - RNA, 22 nt, Human
uccuucaagaugccacagcuuu

SEQ ID NO: 620169 - RNA, 22 nt, Human
gcaguguuguuaaaagauuaga

SEQ ID NO: 620170 - RNA, 22 nt, Human
uggcacuuagaucagguugggu

SEQ ID NO: 620171 - RNA, 22 nt, Human
agggcucaauggugggcaugua

SEQ ID NO: 620172 - RNA, 22 nt, Human
auauuauucuagcucuugugug

SEQ ID NO: 620173 - RNA, 22 nt, Human
acuuguugcccuccugaaaauu

SEQ ID NO: 620174 - RNA, 22 nt, Human
ggccacuguccucuagcccaga

SEQ ID NO: 620175 - RNA, 22 nt, Human
uuguuuccauugcagacugugu

SEQ ID NO: 620176 - RNA, 22 nt, Human
agaagccauggggucaccagag

SEQ ID NO: 620177 - RNA, 22 nt, Human
uccucacagaguggcaggcaau

SEQ ID NO: 620178 - RNA, 22 nt, Human
gagaagggauaugccacucucg

SEQ ID NO: 620179 - RNA, 22 nt, Human
cuuuuacacucaucugggaggg

SEQ ID NO: 620180 - RNA, 22 nt, Human
ggcuccugccgucuuuucugag

SEQ ID NO: 620181 - RNA, 22 nt, Human
cuguuaaaugagaaagcagacu

SEQ ID NO: 620182 - RNA, 22 nt, Human
gcagcaggauggccaauugcca

SEQ ID NO: 620183 - RNA, 22 nt, Human
uucuggcuuauccuaacucuaa

SEQ ID NO: 620184 - RNA, 22 nt, Human
cuguggcucucugcaggguccc

SEQ ID NO: 620185 - RNA, 23 nt, Human
ucuggcuuugcuggaaguuuuga

SEQ ID NO: 620186 - RNA, 23 nt, Human
uggagaauucuuccuuccacugu

SEQ ID NO: 620187 - RNA, 22 nt, Human
uuggcauuggagaugcaagaac

SEQ ID NO: 620188 - RNA, 23 nt, Human
gccugggacucaggaggagcuca

SEQ ID NO: 620189 - RNA, 22 nt, Human
uugaagauucuuuuuguuagua

SEQ ID NO: 620190 - RNA, 22 nt, Human
aaaguagaggcauugaucaggu

SEQ ID NO: 620191 - RNA, 23 nt, Human
ucucugggugggcugugucuaua

SEQ ID NO: 620192 - RNA, 22 nt, Human
cuggugaauggauaaacuguug

SEQ ID NO: 620193 - RNA, 22 nt, Human
uuaaaugagauguucagauauu

SEQ ID NO: 620194 - RNA, 22 nt, Human
aauagaauguaaucuaauacau

SEQ ID NO: 620195 - RNA, 20 nt, Human
ugaggcaggagaauggcaug

SEQ ID NO: 620196 - RNA, 22 nt, Human
uuucugugguggguaguucaga

SEQ ID NO: 620197 - RNA, 22 nt, Human
gucuggcuuuugcccuguguuu

SEQ ID NO: 620198 - RNA, 22 nt, Human
gccucugcaauuacauugugcc

SEQ ID NO: 620199 - RNA, 22 nt, Human
uauuuucaccuucucuggauau

SEQ ID NO: 620200 - RNA, 22 nt, Human
uggaaggcuuggaauacuucca

SEQ ID NO: 620201 - RNA, 22 nt, Human
augagagguuucgucagaggaa

SEQ ID NO: 620202 - RNA, 22 nt, Human
uggaccucacugucugcuggua

SEQ ID NO: 620203 - RNA, 22 nt, Human
ccaguguuuaggaauaaaaugu

SEQ ID NO: 620204 - RNA, 22 nt, Human
ccaggcugaauauguuccaggg

SEQ ID NO: 620205 - RNA, 22 nt, Human
agguucaggcugcacaccugag

SEQ ID NO: 620206 - RNA, 22 nt, Human
aaagcacuucaggagcaguuug

SEQ ID NO: 620207 - RNA, 22 nt, Human
ucagcaggcacaccaaaaacug

SEQ ID NO: 620208 - RNA, 22 nt, Human
acaugaaaguuauucugaguug

SEQ ID NO: 620209 - RNA, 22 nt, Human
guccugggaacuggacagcuaa

SEQ ID NO: 620210 - RNA, 22 nt, Human
ugugcaaaguguacaaauuaau

SEQ ID NO: 620211 - RNA, 22 nt, Human
aucugucuauguggcuauguau

SEQ ID NO: 620212 - RNA, 22 nt, Human
uccuguguuacugccuggagcg

SEQ ID NO: 620213 - RNA, 22 nt, Human
cauuaaaauaucucaugguguu

SEQ ID NO: 620214 - RNA, 22 nt, Human
gugcccugguccccagcauaua

SEQ ID NO: 620215 - RNA, 22 nt, Human
uugcccugaagaacgucccaga

SEQ ID NO: 620216 - RNA, 22 nt, Human
ggguccagacacuccagaggaa

SEQ ID NO: 620217 - RNA, 22 nt, Human
cuguggcucauaucuguaaucu

SEQ ID NO: 620218 - RNA, 23 nt, Human
guuuuacaggugagaaaauggag

SEQ ID NO: 620219 - RNA, 22 nt, Human
uuuuauaagcaagaaagggaaa

SEQ ID NO: 620220 - RNA, 22 nt, Human
agguccagaacgugccuacucu

SEQ ID NO: 620221 - RNA, 22 nt, Human
gcagccaggggcugugaccugu

SEQ ID NO: 620222 - RNA, 22 nt, Human
aagggaaacuuucacaaugucc

SEQ ID NO: 620223 - RNA, 22 nt, Human
aauggcuauacaacaugaguau

SEQ ID NO: 620224 - RNA, 22 nt, Human
ccagguccuguuuucaccacag

SEQ ID NO: 620225 - RNA, 22 nt, Human
uucccuggggaaggugaccuuu

SEQ ID NO: 620226 - RNA, 22 nt, Human
gcaguguuuacauauuagaaac

SEQ ID NO: 620227 - RNA, 22 nt, Human
uccagggccugagguugaagug

SEQ ID NO: 620228 - RNA, 18 nt, Human
gggcuuuacagaguggag

SEQ ID NO: 620229 - RNA, 22 nt, Human
aaggcuggguuugggaugugau

SEQ ID NO: 620230 - RNA, 22 nt, Human
uggccaggcagguagaacggcc

SEQ ID NO: 620231 - RNA, 22 nt, Human
aaggagucugggccauucagag

SEQ ID NO: 620232 - RNA, 15 nt, Human
gggcaggucuggggc

SEQ ID NO: 620233 - RNA, 22 nt, Human
aaaaaauuccauucugugccuu

SEQ ID NO: 620234 - RNA, 22 nt, Human
aagcaggagaugggugcuuuuc

SEQ ID NO: 620235 - RNA, 22 nt, Human
gcucuuuguauuuuggaaucaa

SEQ ID NO: 620236 - RNA, 22 nt, Human
ccugggugaugugcugcccucg

SEQ ID NO: 620237 - RNA, 22 nt, Human
uggcaggugccaugggcucaga

SEQ ID NO: 620238 - RNA, 22 nt, Human
gcaguguuaccuugggcugguu

SEQ ID NO: 620239 - RNA, 22 nt, Human
uggagaauauuuccaaaucuaa

SEQ ID NO: 620240 - RNA, 22 nt, Human
gcaccuuucuauauucaguggc

SEQ ID NO: 620241 - RNA, 22 nt, Human
uucuuucugaauacaguugagu

SEQ ID NO: 620242 - RNA, 22 nt, Human
auuugcuuccuaauacucauau

SEQ ID NO: 620243 - RNA, 22 nt, Human
accuucaagaaacauuuccuug

SEQ ID NO: 620244 - RNA, 22 nt, Human
aagacaauauugcugugaacgu

SEQ ID NO: 620245 - RNA, 22 nt, Human
gugugucugaaguugaguagac

SEQ ID NO: 620246 - RNA, 23 nt, Human
gcucuggcagcuugugucagcac

SEQ ID NO: 620247 - RNA, 22 nt, Human
ucaaaaauggucuuugagcugc

SEQ ID NO: 620248 - RNA, 22 nt, Human
agcuguguucugguugauucac

SEQ ID NO: 620249 - RNA, 22 nt, Human
uccuuggggacgcugacaucgu

SEQ ID NO: 620250 - RNA, 22 nt, Human
auuugcuugacuauggcuugca

SEQ ID NO: 620251 - RNA, 22 nt, Human
ggggccuuggaucugugccccg

SEQ ID NO: 620252 - RNA, 22 nt, Human
gccucccuggcccacagcagcg

SEQ ID NO: 620253 - RNA, 22 nt, Human
accaggaggccuggagcacaaa

SEQ ID NO: 620254 - RNA, 22 nt, Human
aaaacacugcaaagcugauugg

SEQ ID NO: 620255 - RNA, 22 nt, Human
guuuucuaaguagguagcacca

SEQ ID NO: 620256 - RNA, 22 nt, Human
agaaagaacgcacuugugcugc

SEQ ID NO: 620257 - RNA, 22 nt, Human
uggcuccuuuccgggucuccag

SEQ ID NO: 620258 - RNA, 22 nt, Human
auggccagccacuccugauggc

SEQ ID NO: 620259 - RNA, 22 nt, Human
ggcaccugguaagugcucagua

SEQ ID NO: 620260 - RNA, 22 nt, Human
ugccuucaagacccauccucca

SEQ ID NO: 620261 - RNA, 22 nt, Human
ugcagcagagugggccugggug

SEQ ID NO: 620262 - RNA, 22 nt, Human
ggagaauggccaucuuuucaga

SEQ ID NO: 620263 - RNA, 22 nt, Human
cagcccugcacgcugccuccgc

SEQ ID NO: 620264 - RNA, 22 nt, Human
acaagcuccuuauucagcuggg

SEQ ID NO: 620265 - RNA, 22 nt, Human
cugugucggacgugggcagcag

SEQ ID NO: 620266 - RNA, 23 nt, Human
aauuacaaccaagaacuggaagg

SEQ ID NO: 620267 - RNA, 22 nt, Human
ccaggccucccuuuuccagcca

SEQ ID NO: 620268 - RNA, 22 nt, Human
uuugcaaacacuuaagaagaga

SEQ ID NO: 620269 - RNA, 22 nt, Human
aggaccagaggccagagucagc

SEQ ID NO: 620270 - RNA, 22 nt, Human
uggcggggcagcucuggcuucu

SEQ ID NO: 620271 - RNA, 22 nt, Human
uuuauuauagugguggggacug

SEQ ID NO: 620272 - RNA, 22 nt, Human
ggccaccuggcugugggggcag

SEQ ID NO: 620273 - RNA, 22 nt, Human
uagguucauauucuagaaucau

SEQ ID NO: 620274 - RNA, 22 nt, Human
uauuuuacagacuacuuuagau

SEQ ID NO: 620275 - RNA, 22 nt, Human
augguguuuauaggcaaagauc

SEQ ID NO: 620276 - RNA, 22 nt, Human
caggugggcugccucuccagcu

SEQ ID NO: 620277 - RNA, 17 nt, Human
aggcauggucuggggug

SEQ ID NO: 620278 - RNA, 21 nt, Human
cucugcagugcccaccuugcc

SEQ ID NO: 620279 - RNA, 22 nt, Human
cugggucuggcuacugcuuccu

SEQ ID NO: 620280 - RNA, 22 nt, Human
ccuggguuaguaucuguuucca

SEQ ID NO: 620281 - RNA, 22 nt, Human
ugucauuuauucucuuauucua

SEQ ID NO: 620282 - RNA, 22 nt, Human
uuacaagacacugcugacacag

SEQ ID NO: 620283 - RNA, 21 nt, Human
ccugugugugucccuuuaaga

SEQ ID NO: 620284 - RNA, 22 nt, Human
gaaguagaaaacucaguuucaa

SEQ ID NO: 620285 - RNA, 22 nt, Human
ggccuggagucagggaaagcaa

SEQ ID NO: 620286 - RNA, 22 nt, Human
agccucugucaagcuuuucaaa

SEQ ID NO: 620287 - RNA, 22 nt, Human
auuguugaucuucugguaagcc

SEQ ID NO: 620288 - RNA, 22 nt, Human
caaagauaugacauggaaaaug

SEQ ID NO: 620289 - RNA, 22 nt, Human
uccgggagcugaacgucuugcg

SEQ ID NO: 620290 - RNA, 22 nt, Human
caggucccguuccccagagauu

SEQ ID NO: 620291 - RNA, 22 nt, Human
ucaaaggaaacacaagcuucug

SEQ ID NO: 620292 - RNA, 22 nt, Human
ggcgaggccgggacaggcugga

SEQ ID NO: 620293 - RNA, 22 nt, Human
uuucaguguguaaauugaaaua

SEQ ID NO: 620294 - RNA, 22 nt, Human
ucuguggcuugggccugccugu

SEQ ID NO: 620295 - RNA, 22 nt, Human
aacuuguuagaaaugcagaauc

SEQ ID NO: 620296 - RNA, 22 nt, Human
ccagugugggcccggccuccuc

SEQ ID NO: 620297 - RNA, 22 nt, Human
agcaaaauaagguaauuuauug

SEQ ID NO: 620298 - RNA, 22 nt, Human
cauggccagcccccaguuccuc

SEQ ID NO: 620299 - RNA, 22 nt, Human
gcaguguucuaaauugggugug

SEQ ID NO: 620300 - RNA, 22 nt, Human
uuucagagaacugaguccuugc

SEQ ID NO: 620301 - RNA, 22 nt, Human
cgucuuccucuuacgaugcgcu

SEQ ID NO: 620302 - RNA, 22 nt, Human
aggcugguaguauuuagucaca

SEQ ID NO: 620303 - RNA, 21 nt, Human
agauuacaggugugauccacc

SEQ ID NO: 620304 - RNA, 22 nt, Human
uccccuccaacuccaacuaugg

SEQ ID NO: 620305 - RNA, 22 nt, Human
uucacagugagcuaugucuugu

SEQ ID NO: 620306 - RNA, 22 nt, Human
caggugccucaggaugagacaa

SEQ ID NO: 620307 - RNA, 20 nt, Human
aggucucagagcaagagccc

SEQ ID NO: 620308 - RNA, 22 nt, Human
cccuguuuaagaaaccuguaaa

SEQ ID NO: 620309 - RNA, 22 nt, Human
uauaaauuaaugugcccaugag

SEQ ID NO: 620310 - RNA, 22 nt, Human
aaaauauuuuagggccaggaga

SEQ ID NO: 620311 - RNA, 22 nt, Human
augcccuggacuagcuauacuu

SEQ ID NO: 620312 - RNA, 22 nt, Human
gaagucuucaucugaugcucug

SEQ ID NO: 620313 - RNA, 22 nt, Human
aggucaaguuuagauagaguua

SEQ ID NO: 620314 - RNA, 22 nt, Human
cugugugcauaguugugcucaa

SEQ ID NO: 620315 - RNA, 22 nt, Human
uuaucaguuguguguauacacg

SEQ ID NO: 620316 - RNA, 17 nt, Human
agcuccuggggucuuua

SEQ ID NO: 620317 - RNA, 22 nt, Human
gaaggaagauucuguuggaauc

SEQ ID NO: 620318 - RNA, 22 nt, Human
uuuauuaugauggacaccuucg

SEQ ID NO: 620319 - RNA, 22 nt, Human
ugcacuuuauuuccucucacac

SEQ ID NO: 620320 - RNA, 22 nt, Human
auauuuaaacaggguaccaaua

SEQ ID NO: 620321 - RNA, 22 nt, Human
aagaaagccaaaguucauaccu

SEQ ID NO: 620322 - RNA, 22 nt, Human
ccagggagccuggugugucagc

SEQ ID NO: 620323 - RNA, 22 nt, Human
agagagccugaguggcagcuau

SEQ ID NO: 620324 - RNA, 22 nt, Human
aaaaugaagcaaaggcauucag

SEQ ID NO: 620325 - RNA, 22 nt, Human
ugcugccugguuucuucuugcu

SEQ ID NO: 620326 - RNA, 22 nt, Human
auuuuuccugcuggaucugcuc

SEQ ID NO: 620327 - RNA, 21 nt, Human
guucaauagcucuuugaaugc

SEQ ID NO: 620328 - RNA, 22 nt, Human
ccugugugauuggaagcugaga

SEQ ID NO: 620329 - RNA, 22 nt, Human
uuuuaacuuaaaauacauagau

SEQ ID NO: 620330 - RNA, 22 nt, Human
aagugcaaauuuaagaaggcau

SEQ ID NO: 620331 - RNA, 22 nt, Human
ugucaugggucuaaacauugau

SEQ ID NO: 620332 - RNA, 22 nt, Human
aagacaauuugauacuaguugc

SEQ ID NO: 620333 - RNA, 22 nt, Human
cccaguguuccuugaggggcug

SEQ ID NO: 620334 - RNA, 22 nt, Human
acucagcugaugaagcacaagu

SEQ ID NO: 620335 - RNA, 22 nt, Human
ugggagucaacccucacgagca

SEQ ID NO: 620336 - RNA, 22 nt, Human
uccaggcaaagugcugggcugc

SEQ ID NO: 620337 - RNA, 22 nt, Human
uuuugaaagggugauuuggcuu

SEQ ID NO: 620338 - RNA, 22 nt, Human
guuuuggcagccguguucacau

SEQ ID NO: 620339 - RNA, 22 nt, Human
gugugagcaucaaagccuguca

SEQ ID NO: 620340 - RNA, 22 nt, Human
gcuguguaucagaugccacggg

SEQ ID NO: 620341 - RNA, 22 nt, Human
ccucccugcgcuccugcggcgg

SEQ ID NO: 620342 - RNA, 22 nt, Human
uggccacccacccuaaucuuuc

SEQ ID NO: 620343 - RNA, 22 nt, Human
cuggcucuuucagccgcuggag

SEQ ID NO: 620344 - RNA, 23 nt, Human
augcccugugcagaaauguggaa

SEQ ID NO: 620345 - RNA, 22 nt, Human
auccugggcagugugucacucu

SEQ ID NO: 620346 - RNA, 22 nt, Human
cagguccagucacuggucugca

SEQ ID NO: 620347 - RNA, 22 nt, Human
aagggggcacagucacuguaau

SEQ ID NO: 620348 - RNA, 22 nt, Human
ccugggcagggagaccaggcuc

SEQ ID NO: 620349 - RNA, 22 nt, Human
uccugagggcucggggcucaug

SEQ ID NO: 620350 - RNA, 22 nt, Human
uugaagauaggccaggaugagc

SEQ ID NO: 620351 - RNA, 22 nt, Human
acucaucagauuagauuagggc

SEQ ID NO: 620352 - RNA, 22 nt, Human
gccagugugguguagucaugaa

SEQ ID NO: 620353 - RNA, 22 nt, Human
auuuguugaauaaauuaguauu

SEQ ID NO: 620354 - RNA, 22 nt, Human
uccugggaagagaccugagcau

SEQ ID NO: 620355 - RNA, 18 nt, Human
ugauggaggagggcuggu

SEQ ID NO: 620356 - RNA, 22 nt, Human
uggacucaaguccaaguucacg

SEQ ID NO: 620357 - RNA, 22 nt, Human
aguuucuugaagacugauguuu

SEQ ID NO: 620358 - RNA, 22 nt, Human
ggucagggggaucugugaggua

SEQ ID NO: 620359 - RNA, 22 nt, Human
guggagcaggacuagcugagaa

SEQ ID NO: 620360 - RNA, 22 nt, Human
ucaguguuuuuaaagcaauaua

SEQ ID NO: 620361 - RNA, 22 nt, Human
ucuuuuauuaggcugaaauggg

SEQ ID NO: 620362 - RNA, 23 nt, Human
aggaagcuaaguguggcugcgga

SEQ ID NO: 620363 - RNA, 20 nt, Human
ggaagcagagaacuguuuuc

SEQ ID NO: 620364 - RNA, 22 nt, Human
ucagcucugccuguggaggcac

SEQ ID NO: 620365 - RNA, 22 nt, Human
gaucucugaaucugaagccuuc

SEQ ID NO: 620366 - RNA, 22 nt, Human
augcccugugguucaugugaga

SEQ ID NO: 620367 - RNA, 22 nt, Human
augcccugaggaaugucacgcu

SEQ ID NO: 620368 - RNA, 22 nt, Human
aggucuagauuuauagacagca

SEQ ID NO: 620369 - RNA, 19 nt, Human
uccaggagcaaagccaguu

SEQ ID NO: 620370 - RNA, 21 nt, Human
aucucgggcuucucgcccagc

SEQ ID NO: 620371 - RNA, 22 nt, Human
ggccucacccaucggugccuuu

SEQ ID NO: 620372 - RNA, 22 nt, Human
uucugugucuucuuguucugug

SEQ ID NO: 620373 - RNA, 22 nt, Human
uuugaguugcuuauuuaauagg

SEQ ID NO: 620374 - RNA, 22 nt, Human
gacacuguuauggugagguaag

SEQ ID NO: 620375 - RNA, 19 nt, Human
gcagugucaugguaggagc

SEQ ID NO: 620376 - RNA, 19 nt, Human
aggagaagacucucucccc

SEQ ID NO: 620377 - RNA, 22 nt, Human
cuguguuugacaggcggucucc

SEQ ID NO: 620378 - RNA, 22 nt, Human
uuaacaaaguaacgggaaaaga

SEQ ID NO: 620379 - RNA, 22 nt, Human
agcagaagugccuuagcaauca

SEQ ID NO: 620380 - RNA, 22 nt, Human
cuuguuaaauuauauaagcaga

SEQ ID NO: 620381 - RNA, 22 nt, Human
auauacaguauguacugugguu

SEQ ID NO: 620382 - RNA, 22 nt, Human
cccagccugugacagccguccu

SEQ ID NO: 620383 - RNA, 22 nt, Human
ccagcucugcauguuucccuug

SEQ ID NO: 620384 - RNA, 22 nt, Human
uccuggaggacagaggcaucuc

SEQ ID NO: 620385 - RNA, 22 nt, Human
ggagcugcacgcucugaagccu

SEQ ID NO: 620386 - RNA, 22 nt, Human
uccuggccuuagcgaggcgguc

SEQ ID NO: 620387 - RNA, 22 nt, Human
uuccgcuguuuaguugaaguuu

SEQ ID NO: 620388 - RNA, 22 nt, Human
agauggggcugaaaguuccaau

SEQ ID NO: 620389 - RNA, 22 nt, Human
guccaagagucaagaagggggc

SEQ ID NO: 620390 - RNA, 22 nt, Human
ucugcccuuggcucucuuguug

SEQ ID NO: 620391 - RNA, 22 nt, Human
uuggcucaggaccccugugacu

SEQ ID NO: 620392 - RNA, 22 nt, Human
gccugggauucccagaggggca

SEQ ID NO: 620393 - RNA, 22 nt, Human
gccuucuguccaaccccacgau

SEQ ID NO: 620394 - RNA, 22 nt, Human
ccucagucugucugaucugcca

SEQ ID NO: 620395 - RNA, 22 nt, Human
guguucauugcuagugaggugu

SEQ ID NO: 620396 - RNA, 22 nt, Human
auacaucaccuauauauucaca

SEQ ID NO: 620397 - RNA, 22 nt, Human
gauuuguuucaaguuagcaucu

SEQ ID NO: 620398 - RNA, 22 nt, Human
aggagaggucucccuuccccag

SEQ ID NO: 620399 - RNA, 20 nt, Human
acaguguuaguuaucaucuc

SEQ ID NO: 620400 - RNA, 22 nt, Human
ucccagggucaguggugaggcc

SEQ ID NO: 620401 - RNA, 22 nt, Human
ggcuggagugggcuccagaguu

SEQ ID NO: 620402 - RNA, 22 nt, Human
aaagggcugaugugacauagcu

SEQ ID NO: 620403 - RNA, 22 nt, Human
gaaguccuccuaucuugcucuu

SEQ ID NO: 620404 - RNA, 22 nt, Human
ucaguguucuuauuuaauuagg

SEQ ID NO: 620405 - RNA, 20 nt, Human
uccugcaguuccuaggaggg

SEQ ID NO: 620406 - RNA, 22 nt, Human
ucaguguuuauucaauguuauu

SEQ ID NO: 620407 - RNA, 22 nt, Human
aggaacaacugauucagucaac

SEQ ID NO: 620408 - RNA, 22 nt, Human
cuguggcugcgcccugggggag

SEQ ID NO: 620409 - RNA, 22 nt, Human
uagcaauguguguguauaaauu

SEQ ID NO: 620410 - RNA, 21 nt, Human
gacacaaaggguaguaauggu

SEQ ID NO: 620411 - RNA, 23 nt, Human
auuuuacaggucaguuccuugaa

SEQ ID NO: 620412 - RNA, 22 nt, Human
acaguguuuggcaaugcaugca

SEQ ID NO: 620413 - RNA, 22 nt, Human
uuguaugaucaaaagaaaugua

SEQ ID NO: 620414 - RNA, 22 nt, Human
ggcuuuaagguuuaggaagcaa

SEQ ID NO: 620415 - RNA, 22 nt, Human
aggucccaggcauagcuggucu

SEQ ID NO: 620416 - RNA, 22 nt, Human
agccuucaguaagggcuuagca

SEQ ID NO: 620417 - RNA, 22 nt, Human
uagugugguaaauaaauguuuu

SEQ ID NO: 620418 - RNA, 22 nt, Human
uuaaauuagucaagcuucucug

SEQ ID NO: 620419 - RNA, 22 nt, Human
cuggaagggggacagccacaca

SEQ ID NO: 620420 - RNA, 22 nt, Human
gugcccugaguggguaggagag

SEQ ID NO: 620421 - RNA, 22 nt, Human
gcagcuuucuugcccuaaucuu

SEQ ID NO: 620422 - RNA, 22 nt, Human
cgguccagggaacgcccccgcc

SEQ ID NO: 620423 - RNA, 22 nt, Human
auagaaaacagauguccuuaaa

SEQ ID NO: 620424 - RNA, 22 nt, Human
uccugggcagcgggacgcucag

SEQ ID NO: 620425 - RNA, 22 nt, Human
agccaugcuccuuccccucugg

SEQ ID NO: 620426 - RNA, 22 nt, Human
auccacccugugguggcuuucu

SEQ ID NO: 620427 - RNA, 22 nt, Human
ugagucuuuucauuguguggau

SEQ ID NO: 620428 - RNA, 22 nt, Human
auauuucuggggguguguuucu

SEQ ID NO: 620429 - RNA, 22 nt, Human
cuccugggcucauaucauucag

SEQ ID NO: 620430 - RNA, 22 nt, Human
ccaguccugcucccugaccacc

SEQ ID NO: 620431 - RNA, 22 nt, Human
cagguagaggcugccaucagcu

SEQ ID NO: 620432 - RNA, 22 nt, Human
uugucuggucaaaucacuugua

SEQ ID NO: 620433 - RNA, 22 nt, Human
ugagaaugccauaagagcuauu

SEQ ID NO: 620434 - RNA, 22 nt, Human
uucauauaaauggaaucagaau

SEQ ID NO: 620435 - RNA, 22 nt, Human
cugcccuguggcucugagucau

SEQ ID NO: 620436 - RNA, 17 nt, Human
agaggcagauacuugga

SEQ ID NO: 620437 - RNA, 22 nt, Human
aagguccaguggaaacuagagu

SEQ ID NO: 620438 - RNA, 22 nt, Human
ucugccugagggagcugaggaa

SEQ ID NO: 620439 - RNA, 22 nt, Human
agcugugguguuuucaagcccu

SEQ ID NO: 620440 - RNA, 22 nt, Human
gggagagguuacccgagcaacu

SEQ ID NO: 620441 - RNA, 22 nt, Human
aaauagaaaccaacaaggucag

SEQ ID NO: 620442 - RNA, 22 nt, Human
ucugggagguguuuugagaacu

SEQ ID NO: 620443 - RNA, 22 nt, Human
gcaguaaauaauuuuguguaua

SEQ ID NO: 620444 - RNA, 22 nt, Human
ugaguccaauaggggccuggaa

SEQ ID NO: 620445 - RNA, 23 nt, Human
agucauuaagaaguucaggaacu

SEQ ID NO: 620446 - RNA, 22 nt, Human
uaaauuguuuucuagaaguugu

SEQ ID NO: 620447 - RNA, 22 nt, Human
agaagacagagucuacauucua

SEQ ID NO: 620448 - RNA, 22 nt, Human
gaggcacugcaguacagugacu

SEQ ID NO: 620449 - RNA, 22 nt, Human
uccugaggcucacuuugaaugu

SEQ ID NO: 620450 - RNA, 22 nt, Human
ucuuuuuauauugacaaaaggu

SEQ ID NO: 620451 - RNA, 22 nt, Human
uagaauugggccuaacuuccau

SEQ ID NO: 620452 - RNA, 22 nt, Human
cagcaggaggugaguagcaggu

SEQ ID NO: 620453 - RNA, 23 nt, Human
cccuggaguaaauucuuggaagg

SEQ ID NO: 620454 - RNA, 22 nt, Human
cugggcuguuuguucuggucuc

SEQ ID NO: 620455 - RNA, 20 nt, Human
ccuguuccauucccucaacc

SEQ ID NO: 620456 - RNA, 22 nt, Human
cccugguucagguuucucugaa

SEQ ID NO: 620457 - RNA, 22 nt, Human
aauagcauagaguuaaaaugca

SEQ ID NO: 620458 - RNA, 22 nt, Human
cagcuguucuugggacagacag

SEQ ID NO: 620459 - RNA, 22 nt, Human
uggccaccuucccacuucugcc

SEQ ID NO: 620460 - RNA, 22 nt, Human
gggcaggugugcagagcuguug

SEQ ID NO: 620461 - RNA, 22 nt, Human
aaauuagaagugcucaggaaua

SEQ ID NO: 620462 - RNA, 22 nt, Human
agguccagcucuauugaaaaga

SEQ ID NO: 620463 - RNA, 22 nt, Human
agguccugaagauuuuacuaga

SEQ ID NO: 620464 - RNA, 22 nt, Human
ccaguguuuacaguugaacaaa

SEQ ID NO: 620465 - RNA, 22 nt, Human
uauucaugagauaggcaguuuu

SEQ ID NO: 620466 - RNA, 22 nt, Human
cucuucuuauggccguggcuga

SEQ ID NO: 620467 - RNA, 22 nt, Human
aguuuggaagucaggcuuuucu

SEQ ID NO: 620468 - RNA, 22 nt, Human
ugaggcagcauucuucaagaca

SEQ ID NO: 620469 - RNA, 22 nt, Human
cggucaggugcagcguuggcac

SEQ ID NO: 620470 - RNA, 22 nt, Human
gaggcaguuugccaugccagga

SEQ ID NO: 620471 - RNA, 22 nt, Human
augacagaaggccucccugaca

SEQ ID NO: 620472 - RNA, 21 nt, Human
gccagcugcagggcuuccuug

SEQ ID NO: 620473 - RNA, 22 nt, Human
ccaguguucccucggguucaug

SEQ ID NO: 620474 - RNA, 22 nt, Human
ugucuuuuauaacugacauaua

SEQ ID NO: 620475 - RNA, 22 nt, Human
gugcccugaucgcuaggcuccc

SEQ ID NO: 620476 - RNA, 22 nt, Human
uggcagguuggccuuugguuca

SEQ ID NO: 620477 - RNA, 22 nt, Human
uggcuccuucauucuccugcca

SEQ ID NO: 620478 - RNA, 22 nt, Human
aaguccugggcauuugaacagg

SEQ ID NO: 620479 - RNA, 22 nt, Human
ccugcagggaaucgaggcagaa

SEQ ID NO: 620480 - RNA, 22 nt, Human
uccugaggcccuguuagggucu

SEQ ID NO: 620481 - RNA, 22 nt, Human
caaucccaucaccaucugcucu

SEQ ID NO: 620482 - RNA, 22 nt, Human
cccagccucuggguucugccgg

SEQ ID NO: 620483 - RNA, 22 nt, Human
accugccagugaauacuaucuu

SEQ ID NO: 620484 - RNA, 22 nt, Human
ucaaaacaacacucagguguaa

SEQ ID NO: 620485 - RNA, 18 nt, Human
cuccugggcugcagaugc

SEQ ID NO: 620486 - RNA, 22 nt, Human
cucugcuuuuuagggagccuag

SEQ ID NO: 620487 - RNA, 22 nt, Human
caggccagguggcaggcaaaac

SEQ ID NO: 620488 - RNA, 22 nt, Human
gaagaaagaucaaauaguuucc

SEQ ID NO: 620489 - RNA, 22 nt, Human
cagagccuggcgaugucaugga

SEQ ID NO: 620490 - RNA, 22 nt, Human
uuugucuuggccaagguucuga

SEQ ID NO: 620491 - RNA, 22 nt, Human
auuucacaaagaacagaugcag

SEQ ID NO: 620492 - RNA, 22 nt, Human
uccuuggagguguucaucugcc

SEQ ID NO: 620493 - RNA, 22 nt, Human
aaguaacuaaagauauccauuu

SEQ ID NO: 620494 - RNA, 22 nt, Human
ccugggcuucugucuagauguu

SEQ ID NO: 620495 - RNA, 22 nt, Human
aggugcagcugguggagucugg

SEQ ID NO: 620496 - RNA, 22 nt, Human
ugaagcagaggggucuugagcu

SEQ ID NO: 620497 - RNA, 17 nt, Human
gagucuguguucaucag

SEQ ID NO: 620498 - RNA, 22 nt, Human
uugugaauggugccgcaauaaa

SEQ ID NO: 620499 - RNA, 22 nt, Human
uguuccuguacugcuguggcuu

SEQ ID NO: 620500 - RNA, 22 nt, Human
cagcuguuacucugaguaaaug

SEQ ID NO: 620501 - RNA, 22 nt, Human
gccuguuuguuaugucauggua

SEQ ID NO: 620502 - RNA, 17 nt, Human
gcaggcacugcugccug

SEQ ID NO: 620503 - RNA, 22 nt, Human
ccagcucucugcagaaaggacu

SEQ ID NO: 620504 - RNA, 22 nt, Human
cagaggccauauuucuucacuc

SEQ ID NO: 620505 - RNA, 22 nt, Human
cuggaagguucuuugugugccu

SEQ ID NO: 620506 - RNA, 20 nt, Human
gauaaauugucucuuaagug

SEQ ID NO: 620507 - RNA, 22 nt, Human
ccucugcacuucaccuuagcuc

SEQ ID NO: 620508 - RNA, 22 nt, Human
uauauaugggggaagcuggaug

SEQ ID NO: 620509 - RNA, 20 nt, Human
uuauguguaccugugcuccc

SEQ ID NO: 620510 - RNA, 22 nt, Human
gccuucugugcuccuggccuuu

SEQ ID NO: 620511 - RNA, 22 nt, Human
gcaaagaaaugucagugagagg

SEQ ID NO: 620512 - RNA, 22 nt, Human
ugaagcuuuaggauggguucau

SEQ ID NO: 620513 - RNA, 22 nt, Human
gcugccuuccaaagaguuuuau

SEQ ID NO: 620514 - RNA, 22 nt, Human
gagagcugggcuuugggugaag

SEQ ID NO: 620515 - RNA, 22 nt, Human
agauuucacaugcugcucuauu

SEQ ID NO: 620516 - RNA, 22 nt, Human
ucugacccguggcucugccucc

SEQ ID NO: 620517 - RNA, 22 nt, Human
cagauaaauagauagauaaacu

SEQ ID NO: 620518 - RNA, 22 nt, Human
ccucucccgggugccgcugggc

SEQ ID NO: 620519 - RNA, 22 nt, Human
uccagaggcaaaaagguaugga

SEQ ID NO: 620520 - RNA, 22 nt, Human
ucagcucuguuuugaguggaac

SEQ ID NO: 620521 - RNA, 22 nt, Human
augaucucauucuuucaaaggg

SEQ ID NO: 620522 - RNA, 22 nt, Human
uccuuagacaaagagugggcuu

SEQ ID NO: 620523 - RNA, 22 nt, Human
ucauugcaguagggagagaccc

SEQ ID NO: 620524 - RNA, 20 nt, Human
ugggauuguuuuuuagcuuc

SEQ ID NO: 620525 - RNA, 18 nt, Human
agaauugcugcuucuucu

SEQ ID NO: 620526 - RNA, 20 nt, Human
gcaagugaaaacuaugggug

SEQ ID NO: 620527 - RNA, 22 nt, Human
gggcggggggagcuggaaugaa

SEQ ID NO: 620528 - RNA, 22 nt, Human
gauggagucugaagcugggaac

SEQ ID NO: 620529 - RNA, 22 nt, Human
gcugaggcaaauaguuuuaagu

SEQ ID NO: 620530 - RNA, 22 nt, Human
cagaagcugcagugaucuggga

SEQ ID NO: 620531 - RNA, 22 nt, Human
gagguccagccaagcggcaagg

SEQ ID NO: 620532 - RNA, 22 nt, Human
cccuggaguccuggcaguugau

SEQ ID NO: 620533 - RNA, 22 nt, Human
uaacagaaauagaaaugagagu

SEQ ID NO: 620534 - RNA, 22 nt, Human
augacuucaccucugugaagca

SEQ ID NO: 620535 - RNA, 22 nt, Human
uggcagccaucagagcaggggu

SEQ ID NO: 620536 - RNA, 22 nt, Human
ccaguguucugguguucauuuc

SEQ ID NO: 620537 - RNA, 22 nt, Human
auggccaguguuucccucaguu

SEQ ID NO: 620538 - RNA, 22 nt, Human
gacagcaucuguguggcaggag

SEQ ID NO: 620539 - RNA, 22 nt, Human
uagaggcauaagagggaagcag

SEQ ID NO: 620540 - RNA, 22 nt, Human
gaaggggguugcagucuagggu

SEQ ID NO: 620541 - RNA, 22 nt, Human
ucagaacaguucuuaauauugc

SEQ ID NO: 620542 - RNA, 22 nt, Human
ucugggagcagcucagcagauu

SEQ ID NO: 620543 - RNA, 22 nt, Human
caauauauaaugaguacuuucc

SEQ ID NO: 620544 - RNA, 22 nt, Human
cugccacuuuggagugcucaga

SEQ ID NO: 620545 - RNA, 22 nt, Human
gaguccaguuguucacagaggc

SEQ ID NO: 620546 - RNA, 20 nt, Human
ggagggcagcugagaguugg

SEQ ID NO: 620547 - RNA, 21 nt, Human
agcugccugcucuggaccugg

SEQ ID NO: 620548 - RNA, 22 nt, Human
gagggccagaguccugggguca

SEQ ID NO: 620549 - RNA, 22 nt, Human
gccaccugccaacuugcuggaa

SEQ ID NO: 620550 - RNA, 22 nt, Human
uuaauuacaaaacacauagguu

SEQ ID NO: 620551 - RNA, 22 nt, Human
gacagcagccacagggagaggg

SEQ ID NO: 620552 - RNA, 20 nt, Human
uccuggaguauuccaugcuu

SEQ ID NO: 620553 - RNA, 21 nt, Human
acaguucaugauaacuccauc

SEQ ID NO: 620554 - RNA, 22 nt, Human
aagaucaagaucagagaacagc

SEQ ID NO: 620555 - RNA, 22 nt, Human
cuggcagcauuaacagagagca

SEQ ID NO: 620556 - RNA, 22 nt, Human
agacaaagaaaccguagaagca

SEQ ID NO: 620557 - RNA, 22 nt, Human
agggccugggccagcacccuuu

SEQ ID NO: 620558 - RNA, 22 nt, Human
uuucagagccuuuaucucucua

SEQ ID NO: 620559 - RNA, 22 nt, Human
uguaccuggagagcucuuggcc

SEQ ID NO: 620560 - RNA, 22 nt, Human
ucagcuuuccugcagcuaaggg

SEQ ID NO: 620561 - RNA, 22 nt, Human
ucuugggagucccaggacauag

SEQ ID NO: 620562 - RNA, 22 nt, Human
ugugugaaucuauugaauauau

SEQ ID NO: 620563 - RNA, 22 nt, Human
cuggagaagcauucaaauaauu

SEQ ID NO: 620564 - RNA, 22 nt, Human
gggcaggugauuuuggcuccau

SEQ ID NO: 620565 - RNA, 22 nt, Human
uuuucaguuacuguuuauguga

SEQ ID NO: 620566 - RNA, 22 nt, Human
ucaguguuuuccagggucuacu

SEQ ID NO: 620567 - RNA, 22 nt, Human
aauaauacaugagauuaauguu

SEQ ID NO: 620568 - RNA, 22 nt, Human
cccuguguaguuaacuuuccac

SEQ ID NO: 620569 - RNA, 20 nt, Human
ccuguguggccagcugaggc

SEQ ID NO: 620570 - RNA, 22 nt, Human
gggcagguauuuaucuucuauu

SEQ ID NO: 620571 - RNA, 22 nt, Human
acuguggccugcuguaugggcu

SEQ ID NO: 620572 - RNA, 22 nt, Human
ucuggaguugugcaguggaccu

SEQ ID NO: 620573 - RNA, 22 nt, Human
aaaacauuuuacugccaucuca

SEQ ID NO: 620574 - RNA, 22 nt, Human
uuuccuuguuauuauuuguccu

SEQ ID NO: 620575 - RNA, 22 nt, Human
uccacagggauguugaguucuu

SEQ ID NO: 620576 - RNA, 18 nt, Human
ccucugccauagccagca

SEQ ID NO: 620577 - RNA, 22 nt, Human
accuucaaacuagauagaaguu

SEQ ID NO: 620578 - RNA, 22 nt, Human
uuuaauuagcaagccagagagc

SEQ ID NO: 620579 - RNA, 22 nt, Human
gggagauggcucagaggccgcg

SEQ ID NO: 620580 - RNA, 22 nt, Human
cagagcauaauugacaugaggu

SEQ ID NO: 620581 - RNA, 22 nt, Human
cagguucagcaggaggcauccc

SEQ ID NO: 620582 - RNA, 22 nt, Human
uccuucuuucccccuagucauu

SEQ ID NO: 620583 - RNA, 19 nt, Human
agggaauccggcugaggga

SEQ ID NO: 620584 - RNA, 22 nt, Human
cugcccugcccaggccuugggc

SEQ ID NO: 620585 - RNA, 22 nt, Human
cauaaauucaguucugccucuu

SEQ ID NO: 620586 - RNA, 22 nt, Human
guccaggaagcaauaaauagaa

SEQ ID NO: 620587 - RNA, 21 nt, Human
uggcggggacuuguggcugcc

SEQ ID NO: 620588 - RNA, 22 nt, Human
uuacuaggccaguuuucacuuu

SEQ ID NO: 620589 - RNA, 19 nt, Human
ucuguggccuucccugaug

SEQ ID NO: 620590 - RNA, 22 nt, Human
uggaaucucuuuggggacugaa

SEQ ID NO: 620591 - RNA, 21 nt, Human
agcagagugcuuugacuuugu

SEQ ID NO: 620592 - RNA, 22 nt, Human
agggccuggaacugugggcagg

SEQ ID NO: 620593 - RNA, 22 nt, Human
cuguggcucaauugccuacuga

SEQ ID NO: 620594 - RNA, 22 nt, Human
ccaggaguuggaagcugccaug

SEQ ID NO: 620595 - RNA, 19 nt, Human
gguccagacuucagacuag

SEQ ID NO: 620596 - RNA, 22 nt, Human
uuuguugacaucccuguacuuu

SEQ ID NO: 620597 - RNA, 22 nt, Human
ugggcugccggcaggcucugcc

SEQ ID NO: 620598 - RNA, 22 nt, Human
agauauuuguaucuugcuauug

SEQ ID NO: 620599 - RNA, 22 nt, Human
uuuuuacagucauggucacuca

SEQ ID NO: 620600 - RNA, 22 nt, Human
aaaugcuagggagaaacucucc

SEQ ID NO: 620601 - RNA, 22 nt, Human
uuggaaauacgaguaguaucau

SEQ ID NO: 620602 - RNA, 22 nt, Human
ggccggggccuccccgcgucgc

SEQ ID NO: 620603 - RNA, 22 nt, Human
agccucugcuggcccuggcacu

SEQ ID NO: 620604 - RNA, 22 nt, Human
agaucacaguggcaacucccuu

SEQ ID NO: 620605 - RNA, 22 nt, Human
gcaguguuggcaggauggggcu

SEQ ID NO: 620606 - RNA, 22 nt, Human
ucauccagccucaucaggagcu

SEQ ID NO: 620607 - RNA, 22 nt, Human
guuuauaugaacuucauaccca

SEQ ID NO: 620608 - RNA, 22 nt, Human
ugugaaggacuuguuccauugu

SEQ ID NO: 620609 - RNA, 22 nt, Human
uuucaguguuaugacuuucauu

SEQ ID NO: 620610 - RNA, 22 nt, Human
acuguuuucuguaaagggccag

SEQ ID NO: 620611 - RNA, 22 nt, Human
cuggagucucuucuguagcuac

SEQ ID NO: 620612 - RNA, 22 nt, Human
uccugggcagccucucuggaag

SEQ ID NO: 620613 - RNA, 22 nt, Human
guuauaaauaccuaauaggauu

SEQ ID NO: 620614 - RNA, 22 nt, Human
uccacagggccuuucuggugug

SEQ ID NO: 620615 - RNA, 22 nt, Human
uguuuacuagccaacauggaga

SEQ ID NO: 620616 - RNA, 22 nt, Human
uggagaaucuggaaacuguuga

SEQ ID NO: 620617 - RNA, 22 nt, Human
ggagaggugagagguacaaguu

SEQ ID NO: 620618 - RNA, 22 nt, Human
gucccuggggguuuaggacuca

SEQ ID NO: 620619 - RNA, 22 nt, Human
ggccaccucugcccuaccgagu

SEQ ID NO: 620620 - RNA, 22 nt, Human
agccagggaagaggccuaccuc

SEQ ID NO: 620621 - RNA, 22 nt, Human
aagaaugauuacaaagcaacga

SEQ ID NO: 620622 - RNA, 22 nt, Human
gagggccagaucccaggaggaa

SEQ ID NO: 620623 - RNA, 22 nt, Human
aaagcaagucucuacaaaguac

SEQ ID NO: 620624 - RNA, 22 nt, Human
aguggcagagucaggguuugga

SEQ ID NO: 620625 - RNA, 22 nt, Human
agggcuuuguuuaggugaccac

SEQ ID NO: 620626 - RNA, 22 nt, Human
gccaggcuguuuuuauuacugu

SEQ ID NO: 620627 - RNA, 22 nt, Human
gucaaaacaaaguuaagaauuc

SEQ ID NO: 620628 - RNA, 22 nt, Human
caggauccuggcugcauggacg

SEQ ID NO: 620629 - RNA, 22 nt, Human
cuggaaggcucugcugccuguc

SEQ ID NO: 620630 - RNA, 22 nt, Human
ucagacagagaaguacaaugag

SEQ ID NO: 620631 - RNA, 22 nt, Human
uuaguugauagccaaaauuuau

SEQ ID NO: 620632 - RNA, 22 nt, Human
agggcuuuugagcgcacgucug

SEQ ID NO: 620633 - RNA, 22 nt, Human
ucagguccuuacugugcucccu

SEQ ID NO: 620634 - RNA, 22 nt, Human
cauggccaggccaagagaguac

SEQ ID NO: 620635 - RNA, 22 nt, Human
gaaaaugccucuggcauuaaac

SEQ ID NO: 620636 - RNA, 22 nt, Human
gcugucuggaggcucugaggga

SEQ ID NO: 620637 - RNA, 22 nt, Human
ggugcccagcgaaguggcugug

SEQ ID NO: 620638 - RNA, 22 nt, Human
caauguaucaagaagcaucagu

SEQ ID NO: 620639 - RNA, 22 nt, Human
ugaggcagcccacuuuccuuag

SEQ ID NO: 620640 - RNA, 22 nt, Human
ucagcaggcaccggaaguguuu

SEQ ID NO: 620641 - RNA, 22 nt, Human
uauauaugagcaugugaggaca

SEQ ID NO: 620642 - RNA, 22 nt, Human
gagcagagucuauuuccacacu

SEQ ID NO: 620643 - RNA, 22 nt, Human
ggaugggaacuugguagggcau

SEQ ID NO: 620644 - RNA, 22 nt, Human
ccagcagguguagggcucaugg

SEQ ID NO: 620645 - RNA, 22 nt, Human
cagugugacuucugagcugcca

SEQ ID NO: 620646 - RNA, 22 nt, Human
ugagucuuuuauccugggaaug

SEQ ID NO: 620647 - RNA, 22 nt, Human
ggaaggguucaggugggccugc

SEQ ID NO: 620648 - RNA, 22 nt, Human
guggcagcugguaugcagacag

SEQ ID NO: 620649 - RNA, 22 nt, Human
ccugggucuucagucugcuggu

SEQ ID NO: 620650 - RNA, 17 nt, Human
guccugggaggagagag

SEQ ID NO: 620651 - RNA, 22 nt, Human
acauuguugagccucuuguuca

SEQ ID NO: 620652 - RNA, 19 nt, Human
agcaguggagccaugccug

SEQ ID NO: 620653 - RNA, 22 nt, Human
ggcucacgcaauuaucccggcc

SEQ ID NO: 620654 - RNA, 22 nt, Human
ccagagagggcgccaccuggag

SEQ ID NO: 620655 - RNA, 22 nt, Human
aacagguagggacucuaacuug

SEQ ID NO: 620656 - RNA, 22 nt, Human
uuccuccagccuggagcacuuc

SEQ ID NO: 620657 - RNA, 22 nt, Human
uuuuccuucugauacuccauuu

SEQ ID NO: 620658 - RNA, 22 nt, Human
agcucagaacugcagacaugug

SEQ ID NO: 620659 - RNA, 22 nt, Human
ccagagaggccuuggcaagaca

SEQ ID NO: 620660 - RNA, 22 nt, Human
aguccccucuaacccaacuuua

SEQ ID NO: 620661 - RNA, 22 nt, Human
cuucucugucacaggguuacgu

SEQ ID NO: 620662 - RNA, 22 nt, Human
ucugagggauuugucccuuauc

SEQ ID NO: 620663 - RNA, 22 nt, Human
uggaucugcucuaugaacugcu

SEQ ID NO: 620664 - RNA, 22 nt, Human
ucuucaugaaauugauugcuua

SEQ ID NO: 620665 - RNA, 22 nt, Human
cuuguauuaggaagaaugcuuu

SEQ ID NO: 620666 - RNA, 22 nt, Human
ccuucuagcaaaucaacauaaa

SEQ ID NO: 620667 - RNA, 22 nt, Human
ucaauucugccucuaaauauuu

SEQ ID NO: 620668 - RNA, 22 nt, Human
uuuaaaccuaucuaagaaauag

SEQ ID NO: 620669 - RNA, 22 nt, Human
caguggaugucucauaguguga

SEQ ID NO: 620670 - RNA, 22 nt, Human
uaacuucucugagccucauucc

SEQ ID NO: 620671 - RNA, 22 nt, Human
gaugaguucuuucuauucuauu

SEQ ID NO: 620672 - RNA, 22 nt, Human
aggcuguagaucuagacaugua

SEQ ID NO: 620673 - RNA, 23 nt, Human
cugagggcuggucugaagucugc

SEQ ID NO: 620674 - RNA, 22 nt, Human
ugcucccaggcauucucuguug

SEQ ID NO: 620675 - RNA, 22 nt, Human
ugcuuuggcccaacauugaugc

SEQ ID NO: 620676 - RNA, 22 nt, Human
aauagcaaaugcucauuugaaa

SEQ ID NO: 620677 - RNA, 22 nt, Human
gaggcucagagggacuuucaag

SEQ ID NO: 620678 - RNA, 22 nt, Human
uucuuuuaauuucugucugcag

SEQ ID NO: 620679 - RNA, 22 nt, Human
gggagcugaacugcugaaguug

SEQ ID NO: 620680 - RNA, 18 nt, Human
uccuuucaccccuucucu

SEQ ID NO: 620681 - RNA, 22 nt, Human
uguuuuaagggucaacugucac

SEQ ID NO: 620682 - RNA, 22 nt, Human
acaggaucgcccuguugcccag

SEQ ID NO: 620683 - RNA, 22 nt, Human
ucauccugaagaaccugcuucc

SEQ ID NO: 620684 - RNA, 22 nt, Human
gaauaauugugaugcuugaagu

SEQ ID NO: 620685 - RNA, 22 nt, Human
aguucugacucugaaucuggga

SEQ ID NO: 620686 - RNA, 22 nt, Human
cugcugucuuuauuucacugcu

SEQ ID NO: 620687 - RNA, 22 nt, Human
aguguucuagcgcugugcuugu

SEQ ID NO: 620688 - RNA, 22 nt, Human
ccaggcccugccugugguuccu

SEQ ID NO: 620689 - RNA, 22 nt, Human
ggcugcugcccaccccugcaug

SEQ ID NO: 620690 - RNA, 21 nt, Human
ccacaauucuaguuacauaug

SEQ ID NO: 620691 - RNA, 22 nt, Human
ccugguguuaucauaggucaug

SEQ ID NO: 620692 - RNA, 22 nt, Human
ucucagcucauggcagccuuga

SEQ ID NO: 620693 - RNA, 22 nt, Human
augcaggaagagcccuggagcu

SEQ ID NO: 620694 - RNA, 22 nt, Human
ugcugcucaagcugcagcaaaa

SEQ ID NO: 620695 - RNA, 22 nt, Human
aggacucaucccugcuugucag

SEQ ID NO: 620696 - RNA, 22 nt, Human
gcauucuugguggagugcuaaa

SEQ ID NO: 620697 - RNA, 17 nt, Human
cauucuguaaucuuucu

SEQ ID NO: 620698 - RNA, 22 nt, Human
cauuguguauuucuguaguacu

SEQ ID NO: 620699 - RNA, 22 nt, Human
agcugcugcaaguggugcuaac

SEQ ID NO: 620700 - RNA, 20 nt, Human
cuuguuaaauaugcagguag

SEQ ID NO: 620701 - RNA, 22 nt, Human
uucuuugcccauguuuccuaag

SEQ ID NO: 620702 - RNA, 22 nt, Human
acauuuaaugauccuacuguga

SEQ ID NO: 620703 - RNA, 22 nt, Human
agguagcuggugcugggcuccu

SEQ ID NO: 620704 - RNA, 22 nt, Human
ucagucucuggggcuucuguuu

SEQ ID NO: 620705 - RNA, 22 nt, Human
cauaacauccuugcuacuuuga

SEQ ID NO: 620706 - RNA, 22 nt, Human
cugagggccuucuaugcugagc

SEQ ID NO: 620707 - RNA, 22 nt, Human
uaucauuuuacugugacauuuu

SEQ ID NO: 620708 - RNA, 22 nt, Human
aguuagugaagcucaucacagc

SEQ ID NO: 620709 - RNA, 22 nt, Human
gccagagaggccuuagaaucca

SEQ ID NO: 620710 - RNA, 22 nt, Human
uucuguuuauaauuugcaguug

SEQ ID NO: 620711 - RNA, 16 nt, Human
aggcucagaggcugga

SEQ ID NO: 620712 - RNA, 22 nt, Human
uucuuuuaauagagauccugug

SEQ ID NO: 620713 - RNA, 22 nt, Human
uuacaauuacuugaucucagcu

SEQ ID NO: 620714 - RNA, 19 nt, Human
auucuucucuuccugcugu

SEQ ID NO: 620715 - RNA, 19 nt, Human
ugggcuuccccagggcaga

SEQ ID NO: 620716 - RNA, 22 nt, Human
agaugcugccaggccccucagu

SEQ ID NO: 620717 - RNA, 22 nt, Human
aagcaccuggguuauaucuuag

SEQ ID NO: 620718 - RNA, 22 nt, Human
uccagguccuacuggcccauag

SEQ ID NO: 620719 - RNA, 22 nt, Human
ucuuuuccuugaugguuaaaua

SEQ ID NO: 620720 - RNA, 22 nt, Human
cccaccacgugcuuugcuggag

SEQ ID NO: 620721 - RNA, 22 nt, Human
augggaggcagacacuaaguuc

SEQ ID NO: 620722 - RNA, 22 nt, Human
cugcucucuguuccccuggauc

SEQ ID NO: 620723 - RNA, 22 nt, Human
cuugaaguggagcuuuugaaau

SEQ ID NO: 620724 - RNA, 22 nt, Human
aggcucagcaucugauucauau

SEQ ID NO: 620725 - RNA, 22 nt, Human
ggccuuccauugcucuuuucua

SEQ ID NO: 620726 - RNA, 22 nt, Human
uuauugcuaugaugauguguag

SEQ ID NO: 620727 - RNA, 22 nt, Human
gcuucuggugaggccucaggaa

SEQ ID NO: 620728 - RNA, 19 nt, Human
ggaggcuucuuggggucgg

SEQ ID NO: 620729 - RNA, 15 nt, Human
gagaugcucucaggg

SEQ ID NO: 620730 - RNA, 22 nt, Human
ggcucagaggagcuggaacggu

SEQ ID NO: 620731 - RNA, 18 nt, Human
uccaggcuccaggcuaac

SEQ ID NO: 620732 - RNA, 22 nt, Human
ucuccucuccuuucauguuguu

SEQ ID NO: 620733 - RNA, 22 nt, Human
acagccaacgucuuucuuacuu

SEQ ID NO: 620734 - RNA, 22 nt, Human
guccagagaguaaaggggguaa

SEQ ID NO: 620735 - RNA, 22 nt, Human
uuuaauuuucugggcccagcag

SEQ ID NO: 620736 - RNA, 22 nt, Human
caggcgaccccuaggagcaaca

SEQ ID NO: 620737 - RNA, 22 nt, Human
agagaccuuccugacuccagag

SEQ ID NO: 620738 - RNA, 22 nt, Human
uguggccaccagagcugcuauu

SEQ ID NO: 620739 - RNA, 22 nt, Human
uuucauguuggauacuguuuca

SEQ ID NO: 620740 - RNA, 22 nt, Human
cuccagaggcgacuugcaucac

SEQ ID NO: 620741 - RNA, 22 nt, Human
uccucuucaaaauagcucugaa

SEQ ID NO: 620742 - RNA, 22 nt, Human
cugggaggcggagguuguagug

SEQ ID NO: 620743 - RNA, 22 nt, Human
agaucugaggguccaagggagg

SEQ ID NO: 620744 - RNA, 22 nt, Human
caguggguccugcgucugccag

SEQ ID NO: 620745 - RNA, 22 nt, Human
gccacaggaaagcacccuggag

SEQ ID NO: 620746 - RNA, 23 nt, Human
uuguucuuggaucuuccugaagc

SEQ ID NO: 620747 - RNA, 22 nt, Human
aucauccauggcugaucauaaa

SEQ ID NO: 620748 - RNA, 22 nt, Human
guucuccaggggcuguucaucu

SEQ ID NO: 620749 - RNA, 22 nt, Human
ucaggccaggagaucagauuga

SEQ ID NO: 620750 - RNA, 21 nt, Human
gccaccucaaucuucuagcgc

SEQ ID NO: 620751 - RNA, 22 nt, Human
gcugucccgaaccccugguaau

SEQ ID NO: 620752 - RNA, 22 nt, Human
agggcuccuaugccccauggac

SEQ ID NO: 620753 - RNA, 22 nt, Human
aucccaggcggcacagguugca

SEQ ID NO: 620754 - RNA, 22 nt, Human
ucuuccuggauggggguugaug

SEQ ID NO: 620755 - RNA, 22 nt, Human
ucucugucucccguguguccgg

SEQ ID NO: 620756 - RNA, 22 nt, Human
ugauuccugugcuuauuccagu

SEQ ID NO: 620757 - RNA, 22 nt, Human
caggccacagcuaaagaggauu

SEQ ID NO: 620758 - RNA, 19 nt, Human
gcuuccagcacugcaggag

SEQ ID NO: 620759 - RNA, 22 nt, Human
cuuuauguuggggugucuuagu

SEQ ID NO: 620760 - RNA, 22 nt, Human
acaagcgggccacagugcuggu

SEQ ID NO: 620761 - RNA, 22 nt, Human
gugcuuccuguauugauuccau

SEQ ID NO: 620762 - RNA, 20 nt, Human
cauuccugaggaauucaugu

SEQ ID NO: 620763 - RNA, 22 nt, Human
caucccugauuccuaguacagu

SEQ ID NO: 620764 - RNA, 22 nt, Human
ccucuucuaggacguccuugug

SEQ ID NO: 620765 - RNA, 22 nt, Human
ucuuccagauacuuccugacuu

SEQ ID NO: 620766 - RNA, 22 nt, Human
uuuucuaacaucuaguaauuug

SEQ ID NO: 620767 - RNA, 22 nt, Human
ucuaguuagugguugauacugu

SEQ ID NO: 620768 - RNA, 22 nt, Human
ugcagcaucuccuugugccaug

SEQ ID NO: 620769 - RNA, 22 nt, Human
uucccagauuggagggcagggg

SEQ ID NO: 620770 - RNA, 22 nt, Human
augcaguuagguaauagucuca

SEQ ID NO: 620771 - RNA, 22 nt, Human
ggagagaacugaccugaaagga

SEQ ID NO: 620772 - RNA, 22 nt, Human
gggcugacaguuuccccugaaa

SEQ ID NO: 620773 - RNA, 22 nt, Human
caguuaaucuugccauuauauc

SEQ ID NO: 620774 - RNA, 22 nt, Human
caggauaaauaguaaauguaag

SEQ ID NO: 620775 - RNA, 19 nt, Human
agauuuaccucauauaguu

SEQ ID NO: 620776 - RNA, 22 nt, Human
ggcauuuaguuuucauauucug

SEQ ID NO: 620777 - RNA, 22 nt, Human
ucccucugggcuccagcacgga

SEQ ID NO: 620778 - RNA, 22 nt, Human
ccagagucauuuugagucauaa

SEQ ID NO: 620779 - RNA, 22 nt, Human
uguuacagaaugaauuuccgga

SEQ ID NO: 620780 - RNA, 23 nt, Human
cacaggcugcgcauaagcuucuc

SEQ ID NO: 620781 - RNA, 22 nt, Human
uacagaggguaauugaucaagg

SEQ ID NO: 620782 - RNA, 22 nt, Human
caucucaucagugagagucagc

SEQ ID NO: 620783 - RNA, 22 nt, Human
ugcuggcccuggcucagggaac

SEQ ID NO: 620784 - RNA, 22 nt, Human
aaugaugguuaaacacuggagg

SEQ ID NO: 620785 - RNA, 22 nt, Human
gggcagguguugucaaucuaau

SEQ ID NO: 620786 - RNA, 22 nt, Human
guagaauaaauguacacaucug

SEQ ID NO: 620787 - RNA, 16 nt, Human
uuguggcuuuugcaca

SEQ ID NO: 620788 - RNA, 22 nt, Human
aucaaagaaugugacugaaaua

SEQ ID NO: 620789 - RNA, 22 nt, Human
cagcccuggaacagcugacuca

SEQ ID NO: 620790 - RNA, 22 nt, Human
auggcagaauccauaguaggug

SEQ ID NO: 620791 - RNA, 22 nt, Human
cuuuggcugcauucgaguugcu

SEQ ID NO: 620792 - RNA, 22 nt, Human
gcaggccucuguugagggccuu

SEQ ID NO: 620793 - RNA, 22 nt, Human
ucucugaaggcuguguugaugg

SEQ ID NO: 620794 - RNA, 22 nt, Human
gagagcugggcuuugggugaag

SEQ ID NO: 620795 - RNA, 22 nt, Human
gcucaggacuggaggagcgggg

SEQ ID NO: 620796 - RNA, 22 nt, Human
uagaaacaaagaccugggugcu

SEQ ID NO: 620797 - RNA, 20 nt, Human
aggaugcagggagucugcag

SEQ ID NO: 620798 - RNA, 22 nt, Human
auuuagacuucuugcagguaau

SEQ ID NO: 620799 - RNA, 22 nt, Human
uccugcagcucugagaagcauc

SEQ ID NO: 620800 - RNA, 17 nt, Human
acauacacuggugaaca

SEQ ID NO: 620801 - RNA, 22 nt, Human
aguguuucccaguaggaugaaa

SEQ ID NO: 620802 - RNA, 22 nt, Human
gcugucgugugcaagugacaga

SEQ ID NO: 620803 - RNA, 22 nt, Human
cuguccucaucugccccaaggg

SEQ ID NO: 620804 - RNA, 22 nt, Human
aggugcagcugacaccaugugg

SEQ ID NO: 620805 - RNA, 19 nt, Human
uugugagcugaagaacagg

SEQ ID NO: 620806 - RNA, 22 nt, Human
gugcugaggaaggaagacuuau

SEQ ID NO: 620807 - RNA, 22 nt, Human
ggcuuaaaucacagugacuuuu

SEQ ID NO: 620808 - RNA, 22 nt, Human
uuuagcaaaacauuaugucugu

SEQ ID NO: 620809 - RNA, 22 nt, Human
ugaggcucuccaagcagaugag

SEQ ID NO: 620810 - RNA, 22 nt, Human
gucugacaccuagaguccagga

SEQ ID NO: 620811 - RNA, 22 nt, Human
acagcuucgaggaucucauccc

SEQ ID NO: 620812 - RNA, 22 nt, Human
cuggccaguguggcucugaucu

SEQ ID NO: 620813 - RNA, 20 nt, Human
agagcagcaguuggugaggu

SEQ ID NO: 620814 - RNA, 22 nt, Human
ugaggcaggacauggacaacug

SEQ ID NO: 620815 - RNA, 22 nt, Human
agcacuuugggagauaaagcug

SEQ ID NO: 620816 - RNA, 22 nt, Human
uaaggcacccuucugaguagag

SEQ ID NO: 620817 - RNA, 21 nt, Human
uccuugcuauuuuccucagcu

SEQ ID NO: 620818 - RNA, 22 nt, Human
augucugucuuuguacuccaca

SEQ ID NO: 620819 - RNA, 22 nt, Human
ugcuggagcccaggcggccuuu

SEQ ID NO: 620820 - RNA, 22 nt, Human
gcacuugucaaauauuauagua

SEQ ID NO: 620821 - RNA, 22 nt, Human
aaggagaaggguaaucaacaca

SEQ ID NO: 620822 - RNA, 22 nt, Human
gcacccaggcuugggcagcaac

SEQ ID NO: 620823 - RNA, 23 nt, Human
ugucccagagggagggauaggcu

SEQ ID NO: 620824 - RNA, 22 nt, Human
uagaagcagcaggacucauggu

SEQ ID NO: 620825 - RNA, 22 nt, Human
uuucuucagccacuccaaacug

SEQ ID NO: 620826 - RNA, 22 nt, Human
uaaagguagugugacauauugu

SEQ ID NO: 620827 - RNA, 22 nt, Human
ugggaggacuugugggcuucau

SEQ ID NO: 620828 - RNA, 22 nt, Human
cugcagggaccacaagcagguu

SEQ ID NO: 620829 - RNA, 22 nt, Human
ucagaggauagaaauacuuauu

SEQ ID NO: 620830 - RNA, 22 nt, Human
aguacuuuacuucuuacaguuu

SEQ ID NO: 620831 - RNA, 22 nt, Human
gagcagcuccagccgcaugacu

SEQ ID NO: 620832 - RNA, 22 nt, Human
ugcccucuuaggucugcgcagc

SEQ ID NO: 620833 - RNA, 22 nt, Human
aggaucuuauguaauaauuaug

SEQ ID NO: 620834 - RNA, 22 nt, Human
gagggcugcuggaaaaaugcag

SEQ ID NO: 620835 - RNA, 22 nt, Human
aaaauugagaguuauagauggu

SEQ ID NO: 620836 - RNA, 22 nt, Human
uggcaggaaggagacucagccc

SEQ ID NO: 620837 - RNA, 22 nt, Human
guuuaagaaaauucauguuguu

SEQ ID NO: 620838 - RNA, 18 nt, Human
gcauuuuaaucugaggca

SEQ ID NO: 620839 - RNA, 22 nt, Human
uuccagauguuuaaguucugcu

SEQ ID NO: 620840 - RNA, 22 nt, Human
cuuaggaaaguuggcugauuuc

SEQ ID NO: 620841 - RNA, 18 nt, Human
aaguaugccuauguuauu

SEQ ID NO: 620842 - RNA, 21 nt, Human
gagauggcccaguagcgggcc

SEQ ID NO: 620843 - RNA, 22 nt, Human
uucuccaacacaagcaugaugu

SEQ ID NO: 620844 - RNA, 22 nt, Human
gagaagaaauagaaucacauuu

SEQ ID NO: 620845 - RNA, 22 nt, Human
caggccaauaucacaugcuaug

SEQ ID NO: 620846 - RNA, 22 nt, Human
uuccauaauaggcuuaagugaa

SEQ ID NO: 620847 - RNA, 22 nt, Human
uagcccaggcuguagugcagug

SEQ ID NO: 620848 - RNA, 22 nt, Human
ugagaaggcucaggcuuagaga

SEQ ID NO: 620849 - RNA, 22 nt, Human
cuguuuucuagggcugagguga

SEQ ID NO: 620850 - RNA, 22 nt, Human
aagcuuuagagaugaguuccuu

SEQ ID NO: 620851 - RNA, 22 nt, Human
agcauguguaaucucaauaccu

SEQ ID NO: 620852 - RNA, 22 nt, Human
ucuggcucuauaacuccuagcu

SEQ ID NO: 620853 - RNA, 22 nt, Human
gcccagcccagaaagguucgga

SEQ ID NO: 620854 - RNA, 21 nt, Human
agaauaaugguaucauuugcu

SEQ ID NO: 620855 - RNA, 22 nt, Human
agagcagcugacagccugccau

SEQ ID NO: 620856 - RNA, 22 nt, Human
gccaccaugucuggcugaguuu

SEQ ID NO: 620857 - RNA, 22 nt, Human
auggggugagacuaggauuaaa

SEQ ID NO: 620858 - RNA, 22 nt, Human
ugcugguccccugcagccugug

SEQ ID NO: 620859 - RNA, 22 nt, Human
uccucugcuccaggcuggacuu

SEQ ID NO: 620860 - RNA, 22 nt, Human
ugagaauuuuuugucaugcauu

SEQ ID NO: 620861 - RNA, 19 nt, Human
cugugggcggaggaggggc

SEQ ID NO: 620862 - RNA, 22 nt, Human
aaaugucuuuaucucauguaac

SEQ ID NO: 620863 - RNA, 22 nt, Human
ucuugaaaauugagguugaagg

SEQ ID NO: 620864 - RNA, 22 nt, Human
cugggcagugguggcaucuuug

SEQ ID NO: 620865 - RNA, 22 nt, Human
gucaacauuuacugcccuggcc

SEQ ID NO: 620866 - RNA, 22 nt, Human
auucucucuagaagcugagaug

SEQ ID NO: 620867 - RNA, 23 nt, Human
ugcagcugccucuggcgggccgg

SEQ ID NO: 620868 - RNA, 22 nt, Human
uuggaaggaagaaccgcgguag

SEQ ID NO: 620869 - RNA, 22 nt, Human
aguagauuucugcugaagcuuu

SEQ ID NO: 620870 - RNA, 22 nt, Human
gguucaguuuacauuaaaaucu

SEQ ID NO: 620871 - RNA, 22 nt, Human
aaugaugaacucagagggaacc

SEQ ID NO: 620872 - RNA, 22 nt, Human
cugugcugggugugcuuaugau

SEQ ID NO: 620873 - RNA, 22 nt, Human
uccuugacugugaggaacuagc

SEQ ID NO: 620874 - RNA, 22 nt, Human
gcacacaugcaugugugcaucc

SEQ ID NO: 620875 - RNA, 22 nt, Human
auguuucauuuagauaucaggc

SEQ ID NO: 620876 - RNA, 22 nt, Human
uggggagagauugaggaguuuu

SEQ ID NO: 620877 - RNA, 22 nt, Human
agagccugcaucaggcuugggg

SEQ ID NO: 620878 - RNA, 22 nt, Human
aaugcacaugccacauguggua

SEQ ID NO: 620879 - RNA, 21 nt, Human
ggagucuguggaugcuguuuc

SEQ ID NO: 620880 - RNA, 22 nt, Human
aaguguuuauuuauaacgaucu

SEQ ID NO: 620881 - RNA, 22 nt, Human
agagaaggucacuaaggaccca

SEQ ID NO: 620882 - RNA, 22 nt, Human
uuccuugagguauucaguuuua

SEQ ID NO: 620883 - RNA, 22 nt, Human
gaucagaaucuucauuuucagu

SEQ ID NO: 620884 - RNA, 18 nt, Human
gcuagggcaugcauggug

SEQ ID NO: 620885 - RNA, 22 nt, Human
gccagauguagauagcaaggua

SEQ ID NO: 620886 - RNA, 22 nt, Human
uuaccuaaaauagcucaauuua

SEQ ID NO: 620887 - RNA, 22 nt, Human
uugaacauuaacuucagucuau

SEQ ID NO: 620888 - RNA, 22 nt, Human
caggugccucaggaugagacaa

SEQ ID NO: 620889 - RNA, 22 nt, Human
ggcagcugaccuagcaccaucc

SEQ ID NO: 620890 - RNA, 19 nt, Human
uggcaucuguaaaauggug

SEQ ID NO: 620891 - RNA, 22 nt, Human
cagagggugugaaggggaugaa

SEQ ID NO: 620892 - RNA, 22 nt, Human
cugggagagguggugggaagua

SEQ ID NO: 620893 - RNA, 22 nt, Human
cugcccugucugcagccuggcu

SEQ ID NO: 620894 - RNA, 23 nt, Human
ucaucaaacagcugcucaagaaa

SEQ ID NO: 620895 - RNA, 22 nt, Human
gacagcugggaggaugacauaa

SEQ ID NO: 620896 - RNA, 22 nt, Human
aggagcugucauuugauucaca

SEQ ID NO: 620897 - RNA, 22 nt, Human
gcuggcacugggaaggacugag

SEQ ID NO: 620898 - RNA, 22 nt, Human
ugccugccccacaagggguugc

SEQ ID NO: 620899 - RNA, 23 nt, Human
uauggcuuacagugcuuuaggua

SEQ ID NO: 620900 - RNA, 22 nt, Human
gaauaauuuugaucagaaggga

SEQ ID NO: 620901 - RNA, 20 nt, Human
agguccugggacuggcagag

SEQ ID NO: 620902 - RNA, 22 nt, Human
caagaauuguacaaacugggug

SEQ ID NO: 620903 - RNA, 22 nt, Human
accugccuauggagccacaugg

SEQ ID NO: 620904 - RNA, 22 nt, Human
auacacaucuauuuaagagaca

SEQ ID NO: 620905 - RNA, 22 nt, Human
ugaaaucuacccuauucagggu

SEQ ID NO: 620906 - RNA, 22 nt, Human
ugccuuuugaagccucacaggu

SEQ ID NO: 620907 - RNA, 22 nt, Human
auccuguggcuccagggagccg

SEQ ID NO: 620908 - RNA, 22 nt, Human
gagggcucaacuacuacuaggc

SEQ ID NO: 620909 - RNA, 19 nt, Human
agcagggagugguuguggg

SEQ ID NO: 620910 - RNA, 22 nt, Human
cagcagcuggugagacacagcc

SEQ ID NO: 620911 - RNA, 22 nt, Human
uguuaaacucguagguuaggcu

SEQ ID NO: 620912 - RNA, 22 nt, Human
acugggccacauagaccugcug

SEQ ID NO: 620913 - RNA, 22 nt, Human
ugcuggggcagaagagccaaga

SEQ ID NO: 620914 - RNA, 22 nt, Human
cucuggguucuggccugcaccc

SEQ ID NO: 620915 - RNA, 22 nt, Human
ccugggccaggcuugggaaugc

SEQ ID NO: 620916 - RNA, 22 nt, Human
ucuggccagcaugagaccuggu

SEQ ID NO: 620917 - RNA, 22 nt, Human
acaggucuacuggcaagcagug

SEQ ID NO: 620918 - RNA, 22 nt, Human
aaggcagagucuaucuuggaag

SEQ ID NO: 620919 - RNA, 22 nt, Human
gccucaggugcaucucucauuc

SEQ ID NO: 620920 - RNA, 22 nt, Human
ggacaggauaagagacacugcc

SEQ ID NO: 620921 - RNA, 22 nt, Human
uagagguagaguuacauuaguc

SEQ ID NO: 620922 - RNA, 22 nt, Human
auguuuuccauugccauggaaa

SEQ ID NO: 620923 - RNA, 20 nt, Human
gggugggagagucugagggu

SEQ ID NO: 620924 - RNA, 23 nt, Human
cuguauuugacuugagcggaaau

SEQ ID NO: 620925 - RNA, 21 nt, Human
acuuggccaggcccccaccug

SEQ ID NO: 620926 - RNA, 22 nt, Human
uagagcugauaaugaggccaag

SEQ ID NO: 620927 - RNA, 22 nt, Human
caggggaguuuuaugcaacaga

SEQ ID NO: 620928 - RNA, 23 nt, Human
gggcaccaggagcaccggacagg

SEQ ID NO: 620929 - RNA, 22 nt, Human
aacaguaugugagauuuacaca

SEQ ID NO: 620930 - RNA, 22 nt, Human
cugugcugauucagcacaggcc

SEQ ID NO: 620931 - RNA, 22 nt, Human
uucaccagguguacaguuaguu

SEQ ID NO: 620932 - RNA, 17 nt, Human
uuccugugguuugaucu

SEQ ID NO: 620933 - RNA, 22 nt, Human
gucacacaauaguaaguggucc

SEQ ID NO: 620934 - RNA, 22 nt, Human
aucagaauaauuagauuucaga

SEQ ID NO: 620935 - RNA, 22 nt, Human
cccaggucugugccagcucuga

SEQ ID NO: 620936 - RNA, 22 nt, Human
cuggagccugcaguuuucacuu

SEQ ID NO: 620937 - RNA, 22 nt, Human
uuguacagaaaaaauucuuggu

SEQ ID NO: 620938 - RNA, 22 nt, Human
agaugcugccucuccucacaag

SEQ ID NO: 620939 - RNA, 22 nt, Human
gagcccuguagcaagucauguc

SEQ ID NO: 620940 - RNA, 22 nt, Human
uugcauaaaugcuuaaaauuug

SEQ ID NO: 620941 - RNA, 22 nt, Human
cugaaggagaaggccacuguuc

SEQ ID NO: 620942 - RNA, 22 nt, Human
ucagaggcagcugauguucugu

SEQ ID NO: 620943 - RNA, 22 nt, Human
ugggccuguggcuuggcucuag

SEQ ID NO: 620944 - RNA, 22 nt, Human
agguuccuuauggggauggcua

SEQ ID NO: 620945 - RNA, 22 nt, Human
uuuucacaugcuuggggacuua

SEQ ID NO: 620946 - RNA, 22 nt, Human
uuucuacaugucaguaacugau

SEQ ID NO: 620947 - RNA, 22 nt, Human
gugggagcugcggaggccuggg

SEQ ID NO: 620948 - RNA, 22 nt, Human
uuucucucuggcccugauuguc

SEQ ID NO: 620949 - RNA, 22 nt, Human
uggcaggguuggccaccuuacc

SEQ ID NO: 620950 - RNA, 22 nt, Human
guggcuuccaugugcaucugac

SEQ ID NO: 620951 - RNA, 22 nt, Human
uuugaugaguuuaauaacagcc

SEQ ID NO: 620952 - RNA, 22 nt, Human
ucacuguaaacuaggucagucc

SEQ ID NO: 620953 - RNA, 23 nt, Human
aggaauggcuagaagugugaccc

SEQ ID NO: 620954 - RNA, 22 nt, Human
auguauuugaaauuugagacau

SEQ ID NO: 620955 - RNA, 22 nt, Human
ggcugggcucgcugauuggcug

SEQ ID NO: 620956 - RNA, 22 nt, Human
ccagcugugccguguggauagc

SEQ ID NO: 620957 - RNA, 22 nt, Human
aaauagcagccuuuaguuaaca

SEQ ID NO: 620958 - RNA, 22 nt, Human
uggcucagagagggagugugga

SEQ ID NO: 620959 - RNA, 22 nt, Human
ugggcagacauugaguuuguuc

SEQ ID NO: 620960 - RNA, 22 nt, Human
cuggaaguauaggggagaugau

SEQ ID NO: 620961 - RNA, 22 nt, Human
auucugcuucuuauuucacgug

SEQ ID NO: 620962 - RNA, 22 nt, Human
caaguccuuuucuuggcucagg

SEQ ID NO: 620963 - RNA, 19 nt, Human
agccagcagcguagcaucu

SEQ ID NO: 620964 - RNA, 22 nt, Human
cagcuggaugggagaccauguu

SEQ ID NO: 620965 - RNA, 20 nt, Human
augggcugguuaggaagugu

SEQ ID NO: 620966 - RNA, 22 nt, Human
agaucaaagccaugagagauuu

SEQ ID NO: 620967 - RNA, 22 nt, Human
gcuccuggcaggcagugugugu

SEQ ID NO: 620968 - RNA, 22 nt, Human
ugacauuuuaucaauaucacag

SEQ ID NO: 620969 - RNA, 20 nt, Human
cuccagccccugcccugguc

SEQ ID NO: 620970 - RNA, 22 nt, Human
ucaauuacagcaaugacuguac

SEQ ID NO: 620971 - RNA, 22 nt, Human
agacaguggcucagccccaguc

SEQ ID NO: 620972 - RNA, 22 nt, Human
ugcugaggcauuuggacagagu

SEQ ID NO: 620973 - RNA, 22 nt, Human
cagcugguuaucagagaggccu

SEQ ID NO: 620974 - RNA, 22 nt, Human
cugguguggacuccgcgcggag

SEQ ID NO: 620975 - RNA, 22 nt, Human
cuacagguaugugcaugacauc

SEQ ID NO: 620976 - RNA, 22 nt, Human
uagcacaguauuucucaacugg

SEQ ID NO: 620977 - RNA, 19 nt, Human
aaagaacuuugggcuaggc

SEQ ID NO: 620978 - RNA, 21 nt, Human
ugcagauaauugaaagcugac

SEQ ID NO: 620979 - RNA, 22 nt, Human
agaggauucacugcagaagaca

SEQ ID NO: 620980 - RNA, 22 nt, Human
auuccucauuuguugagaacca

SEQ ID NO: 620981 - RNA, 22 nt, Human
uguaaacaugcugaggcuggag

SEQ ID NO: 620982 - RNA, 23 nt, Human
agucuuacugucccagaacaggg

SEQ ID NO: 620983 - RNA, 22 nt, Human
uccucuggaaccucacccuugc

SEQ ID NO: 620984 - RNA, 22 nt, Human
ugucaaacaccaacauuucucc

SEQ ID NO: 620985 - RNA, 23 nt, Human
uguguauguaucuaugcauaggu

SEQ ID NO: 620986 - RNA, 20 nt, Human
ugauucuggucuacgcuuua

SEQ ID NO: 620987 - RNA, 20 nt, Human
uuggaggugcagugcaugca

SEQ ID NO: 620988 - RNA, 22 nt, Human
gugugcauguggaagcauguau

SEQ ID NO: 620989 - RNA, 22 nt, Human
ugagccuggguggucgaggcug

SEQ ID NO: 620990 - RNA, 22 nt, Human
uggcaggcaggcagccuucuga

SEQ ID NO: 620991 - RNA, 22 nt, Human
agcagaugugucucugcacugu

SEQ ID NO: 620992 - RNA, 22 nt, Human
acugaaaaagacaucuugguaa

SEQ ID NO: 620993 - RNA, 20 nt, Human
acauccuggugacuagaacu

SEQ ID NO: 620994 - RNA, 22 nt, Human
cauguuggcugaggcuguauuu

SEQ ID NO: 620995 - RNA, 22 nt, Human
ggguccugcgugggcccaggac

SEQ ID NO: 620996 - RNA, 22 nt, Human
ugugucucaagucagagcauca

SEQ ID NO: 620997 - RNA, 22 nt, Human
uggcuucacugcucaagugauu

SEQ ID NO: 620998 - RNA, 22 nt, Human
agaaaguuaaacagugauaaga

SEQ ID NO: 620999 - RNA, 22 nt, Human
uuaacaguuaaacaauuggcua

SEQ ID NO: 621000 - RNA, 18 nt, Human
uguagagccagguuugcc

SEQ ID NO: 621001 - RNA, 22 nt, Human
gagcagcuggaggccuuguugg

SEQ ID NO: 621002 - RNA, 22 nt, Human
cgugugcgcacaccuguuucca

SEQ ID NO: 621003 - RNA, 18 nt, Human
uuggaccugugucagggc

SEQ ID NO: 621004 - RNA, 22 nt, Human
aacagcaggcaccaaggcuaug

SEQ ID NO: 621005 - RNA, 22 nt, Human
guuuccuaccagugguuccaga

SEQ ID NO: 621006 - RNA, 22 nt, Human
gucaaguuuauccgcucauuca

SEQ ID NO: 621007 - RNA, 22 nt, Human
aucauuuacaaacucagcauug

SEQ ID NO: 621008 - RNA, 22 nt, Human
aaaacuuucagggauacagaaa

SEQ ID NO: 621009 - RNA, 22 nt, Human
ggugggccaggaaggccgccag

SEQ ID NO: 621010 - RNA, 20 nt, Human
acagccagaggaggcagaca

SEQ ID NO: 621011 - RNA, 22 nt, Human
aaggcgcugggcuaaggcacca

SEQ ID NO: 621012 - RNA, 22 nt, Human
ugggccuggagcccuggagagu

SEQ ID NO: 621013 - RNA, 22 nt, Human
gccccaggugguaaaccuaaga

SEQ ID NO: 621014 - RNA, 19 nt, Human
acagaagcauagaaaagga

SEQ ID NO: 621015 - RNA, 22 nt, Human
gauuucaaggaguuuucacagu

SEQ ID NO: 621016 - RNA, 22 nt, Human
gaaggagagaaaggcaauucug

SEQ ID NO: 621017 - RNA, 23 nt, Human
gugcacagucaagcccagcuuag

SEQ ID NO: 621018 - RNA, 22 nt, Human
uccaggagauucauuaggucau

SEQ ID NO: 621019 - RNA, 22 nt, Human
acagguggcuuauuggcugauu

SEQ ID NO: 621020 - RNA, 22 nt, Human
cugcaguaucugcuuuggguag

SEQ ID NO: 621021 - RNA, 22 nt, Human
aggagucacucagggcuucauc

SEQ ID NO: 621022 - RNA, 22 nt, Human
ucauggaaggaguggccaagug

SEQ ID NO: 621023 - RNA, 22 nt, Human
agcucuccaucuaucugugaug

SEQ ID NO: 621024 - RNA, 22 nt, Human
ccagccagcugcccuuggggcc

SEQ ID NO: 621025 - RNA, 22 nt, Human
cacuugaaaguaaugguugugc

SEQ ID NO: 621026 - RNA, 19 nt, Human
ugaggggcucacagucuca

SEQ ID NO: 621027 - RNA, 22 nt, Human
cugaggaggcuaauuugaggau

SEQ ID NO: 621028 - RNA, 23 nt, Human
gcagagguuauguuuuuuaggcu

SEQ ID NO: 621029 - RNA, 22 nt, Human
aagguuagugcaucuuuuguuu

SEQ ID NO: 621030 - RNA, 22 nt, Human
uucuccccugacccugaugagg

SEQ ID NO: 621031 - RNA, 23 nt, Human
uccagcucccuucaauggcacug

SEQ ID NO: 621032 - RNA, 22 nt, Human
gcucaggaccgaggggugggaa

SEQ ID NO: 621033 - RNA, 23 nt, Human
ucacacuggauacacaugcaaga

SEQ ID NO: 621034 - RNA, 22 nt, Human
gaaggcuguggcuggucucagu

SEQ ID NO: 621035 - RNA, 22 nt, Human
ggggaccuaggcucugucucuu

SEQ ID NO: 621036 - RNA, 22 nt, Human
agugauggagcuuccucugcua

SEQ ID NO: 621037 - RNA, 22 nt, Human
gagggcaggggucuugcacggu

SEQ ID NO: 621038 - RNA, 21 nt, Human
uccauaagagaccaucuccua

SEQ ID NO: 621039 - RNA, 22 nt, Human
uucuuuuuggauagcugaugaa

SEQ ID NO: 621040 - RNA, 22 nt, Human
guuccacaucacacuacuugau

SEQ ID NO: 621041 - RNA, 22 nt, Human
ccaggucuuggcccccggaccu

SEQ ID NO: 621042 - RNA, 22 nt, Human
aacuucauggguucaaagcugg

SEQ ID NO: 621043 - RNA, 22 nt, Human
aaauuugccagaucaauucuga

SEQ ID NO: 621044 - RNA, 22 nt, Human
uccugcagagccgcccucaggu

SEQ ID NO: 621045 - RNA, 22 nt, Human
gacagcaggagaucaugauaga

SEQ ID NO: 621046 - RNA, 19 nt, Human
gucuuacaggcaacaugag

SEQ ID NO: 621047 - RNA, 22 nt, Human
gcugaagguguguggagagagg

SEQ ID NO: 621048 - RNA, 22 nt, Human
uggcuggcauagccauugcucc

SEQ ID NO: 621049 - RNA, 22 nt, Human
ucuuugcaguggugaauaaaga

SEQ ID NO: 621050 - RNA, 22 nt, Human
ugaggccucugugccauccagg

SEQ ID NO: 621051 - RNA, 22 nt, Human
agugcaugcgcuugggaggggu

SEQ ID NO: 621052 - RNA, 22 nt, Human
uaagcacacaauaucuggagag

SEQ ID NO: 621053 - RNA, 22 nt, Human
acaaaugccauauauaaauucu

SEQ ID NO: 621054 - RNA, 22 nt, Human
uggcagggccugaaucuuauac

SEQ ID NO: 621055 - RNA, 22 nt, Human
uuucaauguaugucuuucugag

SEQ ID NO: 621056 - RNA, 22 nt, Human
ccagaggugcugggagaggucu

SEQ ID NO: 621057 - RNA, 22 nt, Human
ggcaucaguauggccauagggu

SEQ ID NO: 621058 - RNA, 22 nt, Human
gucucccaucguuugugaggaa

SEQ ID NO: 621059 - RNA, 22 nt, Human
agugggcagcccaggaggucuu

SEQ ID NO: 621060 - RNA, 22 nt, Human
ccucuacagggcauagcccaaa

SEQ ID NO: 621061 - RNA, 22 nt, Human
uguggaaugcuccuaagugaau

SEQ ID NO: 621062 - RNA, 22 nt, Human
aucuugugcugacaaaacacau

SEQ ID NO: 621063 - RNA, 22 nt, Human
aagcaacuggcucauugucuca

SEQ ID NO: 621064 - RNA, 22 nt, Human
aacacagggacucccaggagaa

SEQ ID NO: 621065 - RNA, 22 nt, Human
uagaacuucuuacagcuaaguu

SEQ ID NO: 621066 - RNA, 22 nt, Human
auggcugccccaaauuguugcu

SEQ ID NO: 621067 - RNA, 22 nt, Human
ccaaaauuaagccucuuauguu

SEQ ID NO: 621068 - RNA, 22 nt, Human
ugucagcauugaugaaaugugg

SEQ ID NO: 621069 - RNA, 22 nt, Human
accaggaggaaguguuaaugau

SEQ ID NO: 621070 - RNA, 19 nt, Human
uagaaugcccacuuaaaaa

SEQ ID NO: 621071 - RNA, 22 nt, Human
auugcuuacagcuauuucugua

SEQ ID NO: 621072 - RNA, 22 nt, Human
cacagcuucccgugcauggaga

SEQ ID NO: 621073 - RNA, 22 nt, Human
aaggaaacacugaacuuuguag

SEQ ID NO: 621074 - RNA, 22 nt, Human
caggcagcccugcaccaagugu

SEQ ID NO: 621075 - RNA, 22 nt, Human
gagaaaccgauucugcauguca

SEQ ID NO: 621076 - RNA, 22 nt, Human
agcuccagcccaucugcucgug

SEQ ID NO: 621077 - RNA, 22 nt, Human
gccagaagggguggauccaggc

SEQ ID NO: 621078 - RNA, 22 nt, Human
gaagcccagcaaacugugauca

SEQ ID NO: 621079 - RNA, 22 nt, Human
uacaguuuuucacugaagaugu

SEQ ID NO: 621080 - RNA, 22 nt, Human
gugugccuaugaguggugaaca

SEQ ID NO: 621081 - RNA, 22 nt, Human
uuugacauuaaggaacauauau

SEQ ID NO: 621082 - RNA, 22 nt, Human
auaaugcaccuuugaguauggc

SEQ ID NO: 621083 - RNA, 22 nt, Human
auacaugugccgcguuggugug

SEQ ID NO: 621084 - RNA, 22 nt, Human
uacaaaugaaccaacuuugaug

SEQ ID NO: 621085 - RNA, 22 nt, Human
gcgacgcucgggcuccgaugcc

SEQ ID NO: 621086 - RNA, 22 nt, Human
gcgcucaggugccaggccugcg

SEQ ID NO: 621087 - RNA, 22 nt, Human
agcacagagcuaggaguggagg

SEQ ID NO: 621088 - RNA, 22 nt, Human
ugccuucuugaauaugguucuu

SEQ ID NO: 621089 - RNA, 22 nt, Human
guguuuauuuucauaguuggcc

SEQ ID NO: 621090 - RNA, 21 nt, Human
guucugaguuagaguuggcca

SEQ ID NO: 621091 - RNA, 22 nt, Human
aauguacagcugcugcugaagg

SEQ ID NO: 621092 - RNA, 22 nt, Human
ccacagaccuuggcuuccaccu

SEQ ID NO: 621093 - RNA, 22 nt, Human
ucugcucagguuaccuagcuag

SEQ ID NO: 621094 - RNA, 22 nt, Human
auggccagagaaggcaggguca

SEQ ID NO: 621095 - RNA, 22 nt, Human
uuauuuuuaaaaguucacacag

SEQ ID NO: 621096 - RNA, 22 nt, Human
uucaacaggaaagcacuuuaca

SEQ ID NO: 621097 - RNA, 22 nt, Human
uguguggguacagaugauuguu

SEQ ID NO: 621098 - RNA, 22 nt, Human
auggccaaaucuaaacuguugg

SEQ ID NO: 621099 - RNA, 22 nt, Human
ggaagggcaaaagagaugaacu

SEQ ID NO: 621100 - RNA, 22 nt, Human
agguagcuaaaacaggcuuuug

SEQ ID NO: 621101 - RNA, 22 nt, Human
caguccugaggaagagcugcug

SEQ ID NO: 621102 - RNA, 22 nt, Human
cuggcucccgaagcccucagug

SEQ ID NO: 621103 - RNA, 22 nt, Human
uguaacaaugaauauagugacu

SEQ ID NO: 621104 - RNA, 22 nt, Human
cucuuuguagccuuugcauauu

SEQ ID NO: 621105 - RNA, 22 nt, Human
gauucacagaacuuagucaagc

SEQ ID NO: 621106 - RNA, 23 nt, Human
aggcuuuaugguagaaaguuugc

SEQ ID NO: 621107 - RNA, 22 nt, Human
uuaacaauagaguuucuucagg

SEQ ID NO: 621108 - RNA, 22 nt, Human
gucuccaguguucaggugacug

SEQ ID NO: 621109 - RNA, 18 nt, Human
gucauggguaguuuagua

SEQ ID NO: 621110 - RNA, 22 nt, Human
ugcuucugacauguucuugguu

SEQ ID NO: 621111 - RNA, 19 nt, Human
aaguucucagaguucaaag

SEQ ID NO: 621112 - RNA, 22 nt, Human
ucugacaauaacugaguuuaac

SEQ ID NO: 621113 - RNA, 22 nt, Human
cagugguucucaaucaggaaug

SEQ ID NO: 621114 - RNA, 16 nt, Human
uccaggcauaucugag

SEQ ID NO: 621115 - RNA, 22 nt, Human
uaugcaguguaugcacugagau

SEQ ID NO: 621116 - RNA, 22 nt, Human
ccaggaucuggguccaugggac

SEQ ID NO: 621117 - RNA, 19 nt, Human
gugggccaggcagaaggcu

SEQ ID NO: 621118 - RNA, 22 nt, Human
ggcaccuuggcuagugaucaac

SEQ ID NO: 621119 - RNA, 22 nt, Human
agcuacaugaaauugcugauau

SEQ ID NO: 621120 - RNA, 22 nt, Human
cuuuucauuguuuguacaugca

SEQ ID NO: 621121 - RNA, 22 nt, Human
gaaucagacugaccugaguuca

SEQ ID NO: 621122 - RNA, 22 nt, Human
caugaggucagggggagccggu

SEQ ID NO: 621123 - RNA, 22 nt, Human
uugaggucccugccuugccuuc

SEQ ID NO: 621124 - RNA, 22 nt, Human
guguaaaugccccauucauuga

SEQ ID NO: 621125 - RNA, 22 nt, Human
uuacaaagaaaauuaggcauuu

SEQ ID NO: 621126 - RNA, 22 nt, Human
accauuaacaugauuuugggga

SEQ ID NO: 621127 - RNA, 22 nt, Human
uuucugcuugagagaauugcug

SEQ ID NO: 621128 - RNA, 21 nt, Human
gcagccagccgagaccaugcc

SEQ ID NO: 621129 - RNA, 22 nt, Human
uggcuucaagucuagguucuac

SEQ ID NO: 621130 - RNA, 22 nt, Human
caugcacaaagguaagaugcgu

SEQ ID NO: 621131 - RNA, 22 nt, Human
ggcaccagggacaauccucuuc

SEQ ID NO: 621132 - RNA, 22 nt, Human
cagcaauaguguguuuguuuca

SEQ ID NO: 621133 - RNA, 22 nt, Human
gaggcagcugggauacaaggga

SEQ ID NO: 621134 - RNA, 22 nt, Human
ucacuacauuuuagacaguaaa

SEQ ID NO: 621135 - RNA, 22 nt, Human
cugccagaucauuggauucaca

SEQ ID NO: 621136 - RNA, 22 nt, Human
ggcacagcuacuugcucacucu

SEQ ID NO: 621137 - RNA, 22 nt, Human
cacuguaauggaauuuucuuua

SEQ ID NO: 621138 - RNA, 22 nt, Human
aaggaauucccuuucugacaga

SEQ ID NO: 621139 - RNA, 22 nt, Human
cuggauggaaggaggauaguau

SEQ ID NO: 621140 - RNA, 22 nt, Human
aaugcagugagccauuaaaugg

SEQ ID NO: 621141 - RNA, 22 nt, Human
gggcaagaagcuggaagcauuc

SEQ ID NO: 621142 - RNA, 22 nt, Human
ggagggcacaggaccagaaauc

SEQ ID NO: 621143 - RNA, 19 nt, Human
agauggggaagagugugag

SEQ ID NO: 621144 - RNA, 22 nt, Human
agggucugaccaccaguaggga

SEQ ID NO: 621145 - RNA, 22 nt, Human
uugggguguuggauggagcaag

SEQ ID NO: 621146 - RNA, 20 nt, Human
uugggccacacugauucagc

SEQ ID NO: 621147 - RNA, 22 nt, Human
ugcguggcgcagcgugugggau

SEQ ID NO: 621148 - RNA, 22 nt, Human
ccucugagaccagcucugcacc

SEQ ID NO: 621149 - RNA, 22 nt, Human
ggcugcuugcuguuucuuggau

SEQ ID NO: 621150 - RNA, 22 nt, Human
aagcugucaauguaucuagucu

SEQ ID NO: 621151 - RNA, 18 nt, Human
gcagggcuggacaaguca

SEQ ID NO: 621152 - RNA, 22 nt, Human
guuuggggaguuccuuuaggcc

SEQ ID NO: 621153 - RNA, 22 nt, Human
ucagaauaaguuaugaaaugaa

SEQ ID NO: 621154 - RNA, 22 nt, Human
aggucugagcaggggagaacag

SEQ ID NO: 621155 - RNA, 22 nt, Human
uguggcagaguaaggacccagu

SEQ ID NO: 621156 - RNA, 22 nt, Human
agggccucugacgcccccagcc

SEQ ID NO: 621157 - RNA, 22 nt, Human
cugugcauggccaucagugccc

SEQ ID NO: 621158 - RNA, 22 nt, Human
cugucccucaucaccucugggu

SEQ ID NO: 621159 - RNA, 22 nt, Human
ucagcccaguuaagaaccuguu

SEQ ID NO: 621160 - RNA, 22 nt, Human
cuccugggaggaugcggacccg

SEQ ID NO: 621161 - RNA, 22 nt, Human
aguauuuucgccaucacaagaa

SEQ ID NO: 621162 - RNA, 21 nt, Human
uggaggaauaaagcacagaag

SEQ ID NO: 621163 - RNA, 22 nt, Human
guacgugcaugcacgugugccu

SEQ ID NO: 621164 - RNA, 22 nt, Human
agucagaagggcccuuccuucc

SEQ ID NO: 621165 - RNA, 22 nt, Human
ugcaccauuaauuuaugugaga

SEQ ID NO: 621166 - RNA, 22 nt, Human
uucccuaagcauugcaauggcg

SEQ ID NO: 621167 - RNA, 22 nt, Human
uccagcuguaguggauuugaga

SEQ ID NO: 621168 - RNA, 22 nt, Human
caaggcauuaccauggcuagag

SEQ ID NO: 621169 - RNA, 22 nt, Human
uuuuaaucaugcuucuaugucc

SEQ ID NO: 621170 - RNA, 22 nt, Human
ugcauauuuguaugauguuuag

SEQ ID NO: 621171 - RNA, 22 nt, Human
cuuucaugcaguugacaaggug

SEQ ID NO: 621172 - RNA, 22 nt, Human
gaauggcauugucagccuuuau

SEQ ID NO: 621173 - RNA, 22 nt, Human
agcauauacaaacucauauaca

SEQ ID NO: 621174 - RNA, 22 nt, Human
uuuuaaacugcagaauuuagaa

SEQ ID NO: 621175 - RNA, 22 nt, Human
ccugcagggaaucgaggcagaa

SEQ ID NO: 621176 - RNA, 22 nt, Human
cccugcugcauggccuccacga

SEQ ID NO: 621177 - RNA, 19 nt, Human
aauaauguucaugagauug

SEQ ID NO: 621178 - RNA, 22 nt, Human
gugaggagggcuggucccaggc

SEQ ID NO: 621179 - RNA, 22 nt, Human
cagcugggugaucuugggcagg

SEQ ID NO: 621180 - RNA, 22 nt, Human
uagaaaguacuaaauuuaacug

SEQ ID NO: 621181 - RNA, 19 nt, Human
gcucagagacaccuguugc

SEQ ID NO: 621182 - RNA, 22 nt, Human
acacuguagacuguugaaguac

SEQ ID NO: 621183 - RNA, 22 nt, Human
augaauugaggaaaacagucgu

SEQ ID NO: 621184 - RNA, 22 nt, Human
aacuguuacauaguuauagauc

SEQ ID NO: 621185 - RNA, 22 nt, Human
ugagucuguauguccagauuua

SEQ ID NO: 621186 - RNA, 22 nt, Human
gagggaugucaggggaccuugg

SEQ ID NO: 621187 - RNA, 22 nt, Human
auuacagauuauaaauuugagc

SEQ ID NO: 621188 - RNA, 22 nt, Human
aucaugacaucugaguuuaagu

SEQ ID NO: 621189 - RNA, 22 nt, Human
aagcauuuauagauaagaauuu

SEQ ID NO: 621190 - RNA, 22 nt, Human
gagcccuguucaggccuccuca

SEQ ID NO: 621191 - RNA, 22 nt, Human
ucacaggagucauaauuacagu

SEQ ID NO: 621192 - RNA, 22 nt, Human
gugcugugcgcuuuuucuguau

SEQ ID NO: 621193 - RNA, 19 nt, Human
aauguaguguuaugucaac

SEQ ID NO: 621194 - RNA, 22 nt, Human
auccugucucuacccaucggcu

SEQ ID NO: 621195 - RNA, 22 nt, Human
gacccaggcccaaggcugccag

SEQ ID NO: 621196 - RNA, 22 nt, Human
cuacccaggcuggagugcagua

SEQ ID NO: 621197 - RNA, 22 nt, Human
ccuuuuucugaguuguagcuuc

SEQ ID NO: 621198 - RNA, 22 nt, Human
acaacagagcuggacugagagg

SEQ ID NO: 621199 - RNA, 22 nt, Human
gcacaggcaucaggcuuuuucu

SEQ ID NO: 621200 - RNA, 22 nt, Human
uguuacaacuauagaucccaag

SEQ ID NO: 621201 - RNA, 22 nt, Human
acaggccacaguggagucucug

SEQ ID NO: 621202 - RNA, 22 nt, Human
gugggcagauuaauuucucaau

SEQ ID NO: 621203 - RNA, 22 nt, Human
cugggcagcugugcaaacaaua

SEQ ID NO: 621204 - RNA, 22 nt, Human
uucaguauacuucauaacauuu

SEQ ID NO: 621205 - RNA, 22 nt, Human
gcuauuguuuauuuugaaucua

SEQ ID NO: 621206 - RNA, 22 nt, Human
ucugagaaggguaggcuccauu

SEQ ID NO: 621207 - RNA, 22 nt, Human
ugaccuauuagauuuccuugcc

SEQ ID NO: 621208 - RNA, 22 nt, Human
cccacucuggcucccuucuagu

SEQ ID NO: 621209 - RNA, 22 nt, Human
gauuuccauuuucaacuccugc

SEQ ID NO: 621210 - RNA, 22 nt, Human
caagcagggagcaucaagggag

SEQ ID NO: 621211 - RNA, 22 nt, Human
uuggcacuucacgagacagcua

SEQ ID NO: 621212 - RNA, 22 nt, Human
ccugugcuggacagggcugggc

SEQ ID NO: 621213 - RNA, 22 nt, Human
gcucagaggcacgaccucuugg

SEQ ID NO: 621214 - RNA, 22 nt, Human
cuuguuuaaauaagauagcagu

SEQ ID NO: 621215 - RNA, 22 nt, Human
aguucacagcaaaguggggacc

SEQ ID NO: 621216 - RNA, 22 nt, Human
auucugucuaagcuggcuacgu

SEQ ID NO: 621217 - RNA, 22 nt, Human
gcagaggagugauuaugccgug

SEQ ID NO: 621218 - RNA, 22 nt, Human
gaugucuuggucaacuugggcu

SEQ ID NO: 621219 - RNA, 22 nt, Human
ugaacuuuugcacagaggauuu

SEQ ID NO: 621220 - RNA, 22 nt, Human
ucacccaggcugguaugcagug

SEQ ID NO: 621221 - RNA, 22 nt, Human
uccugcuuugugccucacacuu

SEQ ID NO: 621222 - RNA, 21 nt, Human
cagcucugagauuucuacuag

SEQ ID NO: 621223 - RNA, 22 nt, Human
uucaugcuuguuccuccaccug

SEQ ID NO: 621224 - RNA, 17 nt, Human
guccuggugugugagga

SEQ ID NO: 621225 - RNA, 22 nt, Human
aaugauuuggcaaaggaaucca

SEQ ID NO: 621226 - RNA, 22 nt, Human
gugggugugguucguuuaagac

SEQ ID NO: 621227 - RNA, 22 nt, Human
gccuuuuuuguugcucugucac

SEQ ID NO: 621228 - RNA, 22 nt, Human
acagggcuuuuaaucaguaguu

SEQ ID NO: 621229 - RNA, 22 nt, Human
ccaggguuggcaagcaaggcuu

SEQ ID NO: 621230 - RNA, 22 nt, Human
uucaggaugcucagaguagucu

SEQ ID NO: 621231 - RNA, 22 nt, Human
caggaagcucuuagcagucacc

SEQ ID NO: 621232 - RNA, 22 nt, Human
cuggcagguccagcuggacuca

SEQ ID NO: 621233 - RNA, 22 nt, Human
cuuccaggugcuggccuggccu

SEQ ID NO: 621234 - RNA, 22 nt, Human
cuucacuugcucaucaugcuau

SEQ ID NO: 621235 - RNA, 22 nt, Human
ugggagagauaggcuucuggac

SEQ ID NO: 621236 - RNA, 19 nt, Human
cugggacuccugauaccuu

SEQ ID NO: 621237 - RNA, 23 nt, Human
aguuuuuaauggucauagcugag

SEQ ID NO: 621238 - RNA, 22 nt, Human
ugacacugaccuaaagaccugg

SEQ ID NO: 621239 - RNA, 22 nt, Human
gcaggucuguugauuacaguca

SEQ ID NO: 621240 - RNA, 22 nt, Human
ucugugcucaaguucugccucu

SEQ ID NO: 621241 - RNA, 22 nt, Human
ggacugaacacuuaaaugucca

SEQ ID NO: 621242 - RNA, 22 nt, Human
uagcagggguagauagagugug

SEQ ID NO: 621243 - RNA, 22 nt, Human
uugaggaaaggaauuuauuuua

SEQ ID NO: 621244 - RNA, 22 nt, Human
ccugagagguuggccuguccag

SEQ ID NO: 621245 - RNA, 22 nt, Human
ggaggcggacacagguaguguu

SEQ ID NO: 621246 - RNA, 22 nt, Human
agucugugaacuuggcagggaa

SEQ ID NO: 621247 - RNA, 22 nt, Human
caaagaaucacucaucuuuagc

SEQ ID NO: 621248 - RNA, 22 nt, Human
uacagcuugauguuuguguguu

SEQ ID NO: 621249 - RNA, 22 nt, Human
cuugucugugucggauaaaacu

SEQ ID NO: 621250 - RNA, 22 nt, Human
cucugacuuuaaauacaggaug

SEQ ID NO: 621251 - RNA, 22 nt, Human
ucacugugcacauaugauaggu

SEQ ID NO: 621252 - RNA, 22 nt, Human
caggcuggaguacaauugugug

SEQ ID NO: 621253 - RNA, 22 nt, Human
cugcugcugcuaucuacccagg

SEQ ID NO: 621254 - RNA, 22 nt, Human
uuuucagaggccuaagagguuu

SEQ ID NO: 621255 - RNA, 22 nt, Human
uaagaagcaguucacaaguaaa

SEQ ID NO: 621256 - RNA, 22 nt, Human
uugacaagcgaaguaccauaau

SEQ ID NO: 621257 - RNA, 18 nt, Human
ucuuuggacaacuacugg

SEQ ID NO: 621258 - RNA, 22 nt, Human
agguaacacuacuuaguauacu

SEQ ID NO: 621259 - RNA, 22 nt, Human
agcucucugauaaauugauaaa

SEQ ID NO: 621260 - RNA, 22 nt, Human
ucacaagacugagcuugcuuga

SEQ ID NO: 621261 - RNA, 22 nt, Human
cauucucucuacuuguuuucaa

SEQ ID NO: 621262 - RNA, 22 nt, Human
ugcacacaccgugcuucacuga

SEQ ID NO: 621263 - RNA, 22 nt, Human
aagcaugcaaucugugauaagg

SEQ ID NO: 621264 - RNA, 22 nt, Human
caccucugccucaagcuuccca

SEQ ID NO: 621265 - RNA, 22 nt, Human
uggguucuagagggaccagaac

SEQ ID NO: 621266 - RNA, 22 nt, Human
gagccugagugcugccuccccu

SEQ ID NO: 621267 - RNA, 22 nt, Human
uggcaggagguuuucuccagga

SEQ ID NO: 621268 - RNA, 20 nt, Human
agcaagaguaaggacagcga

SEQ ID NO: 621269 - RNA, 22 nt, Human
aucuccccgagcuuaccuccug

SEQ ID NO: 621270 - RNA, 22 nt, Human
agggagccaggaacgcaggucg

SEQ ID NO: 621271 - RNA, 21 nt, Human
aaacaucucugcuuuuguguc

SEQ ID NO: 621272 - RNA, 23 nt, Human
aggucuggacccuuggccccugc

SEQ ID NO: 621273 - RNA, 22 nt, Human
aagcacagaaaaggagcaugga

SEQ ID NO: 621274 - RNA, 21 nt, Human
gagcucucaggcaagaagcag

SEQ ID NO: 621275 - RNA, 22 nt, Human
ugagcuugcagugccagccuug

SEQ ID NO: 621276 - RNA, 22 nt, Human
cugcugugucagaguccagggg

SEQ ID NO: 621277 - RNA, 22 nt, Human
aggccgaaguggaugggcaucu

SEQ ID NO: 621278 - RNA, 22 nt, Human
cauucaaaggcauguccuauuu

SEQ ID NO: 621279 - RNA, 22 nt, Human
auucucagaucuuagaggaaua

SEQ ID NO: 621280 - RNA, 22 nt, Human
gauacaaauucaugucugaauu

SEQ ID NO: 621281 - RNA, 22 nt, Human
uugagaaauguuuuuuaagcug

SEQ ID NO: 621282 - RNA, 22 nt, Human
cauugcaccacauugcaucccu

SEQ ID NO: 621283 - RNA, 22 nt, Human
auguucuguuuuguaauucaua

SEQ ID NO: 621284 - RNA, 20 nt, Human
acagauaccagggacauggg

SEQ ID NO: 621285 - RNA, 22 nt, Human
ugcugggcauuuaugcagaugg

SEQ ID NO: 621286 - RNA, 20 nt, Human
guaaagcauucuuggcauac

SEQ ID NO: 621287 - RNA, 22 nt, Human
auucuucacauaagugcuguac

SEQ ID NO: 621288 - RNA, 22 nt, Human
agagacugcaaugagugguagg

SEQ ID NO: 621289 - RNA, 22 nt, Human
augauucaagaaaauaggaugg

SEQ ID NO: 621290 - RNA, 22 nt, Human
aacugcucauuugagaguaugc

SEQ ID NO: 621291 - RNA, 22 nt, Human
uguguucauguugauucauagc

SEQ ID NO: 621292 - RNA, 22 nt, Human
gaggccuggugugucucccgcu

SEQ ID NO: 621293 - RNA, 22 nt, Human
agccuucauaaucuugggcuuu

SEQ ID NO: 621294 - RNA, 22 nt, Human
gcccucagaaugggcucuaauc

SEQ ID NO: 621295 - RNA, 22 nt, Human
uguacaguuuuaacucugaggg

SEQ ID NO: 621296 - RNA, 21 nt, Human
uaauuuauucagcacaguguu

SEQ ID NO: 621297 - RNA, 22 nt, Human
uaaauuacccuuuagggaauug

SEQ ID NO: 621298 - RNA, 16 nt, Human
ucagggcagaauggca

SEQ ID NO: 621299 - RNA, 22 nt, Human
ucuuaacaagcuccucagugcu

SEQ ID NO: 621300 - RNA, 22 nt, Human
aagggaaacuuucacaaugucc

SEQ ID NO: 621301 - RNA, 22 nt, Human
uugcauagugcugagguucggg

SEQ ID NO: 621302 - RNA, 17 nt, Human
gcucuggcacaggauug

SEQ ID NO: 621303 - RNA, 22 nt, Human
caggcagagguaccaagauuga

SEQ ID NO: 621304 - RNA, 22 nt, Human
ucuuuggcaucagggccagcua

SEQ ID NO: 621305 - RNA, 22 nt, Human
uuuacaaccucauauucugaug

SEQ ID NO: 621306 - RNA, 22 nt, Human
ugcaucuguaguggaaaccuua

SEQ ID NO: 621307 - RNA, 22 nt, Human
uugcagacauuccagagcuuuu

SEQ ID NO: 621308 - RNA, 22 nt, Human
cauugaaaaacguugacugagu

SEQ ID NO: 621309 - RNA, 22 nt, Human
cccagggagagcgcggaggcgg

SEQ ID NO: 621310 - RNA, 22 nt, Human
uagcauuccaucuuggacuugu

SEQ ID NO: 621311 - RNA, 22 nt, Human
aaagaacuuaagaaauuaggcu

SEQ ID NO: 621312 - RNA, 22 nt, Human
aggagccaguggaguuccugcc

SEQ ID NO: 621313 - RNA, 22 nt, Human
gagaagggggcucgaguguccu

SEQ ID NO: 621314 - RNA, 17 nt, Human
agggacagcaguuuagg

SEQ ID NO: 621315 - RNA, 22 nt, Human
agcuucugcaucuuuucuuccc

SEQ ID NO: 621316 - RNA, 22 nt, Human
ucucuggagcugcagauccagg

SEQ ID NO: 621317 - RNA, 23 nt, Human
cuuauucauucauguagcccauu

SEQ ID NO: 621318 - RNA, 23 nt, Human
uggagcugacagucagagggagg

SEQ ID NO: 621319 - RNA, 22 nt, Human
uuaacagacauauauauuugua

SEQ ID NO: 621320 - RNA, 22 nt, Human
gccuggagaccugcuccucuac

SEQ ID NO: 621321 - RNA, 22 nt, Human
cagggcugguuugucgaagaaa

SEQ ID NO: 621322 - RNA, 22 nt, Human
uauucuagaaguccaccagucu

SEQ ID NO: 621323 - RNA, 22 nt, Human
acuguacaaccucugccccugu

SEQ ID NO: 621324 - RNA, 22 nt, Human
acaaaugcuuaguucaccaaaa

SEQ ID NO: 621325 - RNA, 20 nt, Human
acaauacagguugugucuga

SEQ ID NO: 621326 - RNA, 22 nt, Human
cuccugggcucaagugauccuc

SEQ ID NO: 621327 - RNA, 22 nt, Human
gcauguguuauuuuauguauga

SEQ ID NO: 621328 - RNA, 22 nt, Human
agcacaaaagcagccacagaug

SEQ ID NO: 621329 - RNA, 22 nt, Human
aguguuucaagaagcaggaagu

SEQ ID NO: 621330 - RNA, 22 nt, Human
aagcucagaguagcucagcguc

SEQ ID NO: 621331 - RNA, 22 nt, Human
agguagguuaaauuucuuuauc

SEQ ID NO: 621332 - RNA, 22 nt, Human
agugcagggggaaagggugucu

SEQ ID NO: 621333 - RNA, 22 nt, Human
ggcccagucuggggcccuguga

SEQ ID NO: 621334 - RNA, 23 nt, Human
uacuguauauuacuguguuauac

SEQ ID NO: 621335 - RNA, 22 nt, Human
ugcucuccggcuuccguggccu

SEQ ID NO: 621336 - RNA, 22 nt, Human
acagauggaauguguuauggga

SEQ ID NO: 621337 - RNA, 23 nt, Human
acucguggaauucucugcgaucg

SEQ ID NO: 621338 - RNA, 22 nt, Human
cgcagagggcaggcagugcugg

SEQ ID NO: 621339 - RNA, 22 nt, Human
cuggcucacuagcccugcccug

SEQ ID NO: 621340 - RNA, 22 nt, Human
ggagcagggaauuacagcgcag

SEQ ID NO: 621341 - RNA, 19 nt, Human
uucuuagucucaugcauga

SEQ ID NO: 621342 - RNA, 22 nt, Human
gaggagcuugugagaagauguc

SEQ ID NO: 621343 - RNA, 22 nt, Human
auuucacagcugucaguguuac

SEQ ID NO: 621344 - RNA, 22 nt, Human
aggcuggucccagggagggaau

SEQ ID NO: 621345 - RNA, 22 nt, Human
uauucccacuccucagcaauuu

SEQ ID NO: 621346 - RNA, 18 nt, Human
ccuucagcucugguuuuc

SEQ ID NO: 621347 - RNA, 22 nt, Human
aaauguagaccuauagggaccu

SEQ ID NO: 621348 - RNA, 22 nt, Human
gaagcagucagcagcaccuuug

SEQ ID NO: 621349 - RNA, 22 nt, Human
aaccacagacccagacuagaga

SEQ ID NO: 621350 - RNA, 22 nt, Human
gugccagccuggugcgccuggg

SEQ ID NO: 621351 - RNA, 22 nt, Human
acaaugaacacacaaggaauuc

SEQ ID NO: 621352 - RNA, 17 nt, Human
gggcagggacuccuggg

SEQ ID NO: 621353 - RNA, 22 nt, Human
cuuccuugcugucugcuccagg

SEQ ID NO: 621354 - RNA, 22 nt, Human
aaauacaaaaauuagccaggca

SEQ ID NO: 621355 - RNA, 22 nt, Human
acucuuugucuguugccgcuua

SEQ ID NO: 621356 - RNA, 22 nt, Human
ucaggaaggcgccccaucagga

SEQ ID NO: 621357 - RNA, 22 nt, Human
acagguggacacagcagcaguc

SEQ ID NO: 621358 - RNA, 22 nt, Human
agcccugggcguuacugggaug

SEQ ID NO: 621359 - RNA, 22 nt, Human
uugaggucauauauauuuggca

SEQ ID NO: 621360 - RNA, 22 nt, Human
acagauggccauauuacuauau

SEQ ID NO: 621361 - RNA, 22 nt, Human
gagccaaaugugcagacauugu

SEQ ID NO: 621362 - RNA, 22 nt, Human
accagcugugugacuuuuaaug

SEQ ID NO: 621363 - RNA, 22 nt, Human
agcagcuguuagaaacaggaag

SEQ ID NO: 621364 - RNA, 22 nt, Human
cugagguguggucugggaguau

SEQ ID NO: 621365 - RNA, 22 nt, Human
ucagaaguccaauaccauggga

SEQ ID NO: 621366 - RNA, 22 nt, Human
ucaggggaaaucucucagcgaa

SEQ ID NO: 621367 - RNA, 22 nt, Human
auauuuguaguggguaagaagu

SEQ ID NO: 621368 - RNA, 22 nt, Human
gggaccugccaaggccacccag

SEQ ID NO: 621369 - RNA, 20 nt, Human
cucucucuccauucccaggg

SEQ ID NO: 621370 - RNA, 21 nt, Human
ucugggggugagccuagaaau

SEQ ID NO: 621371 - RNA, 22 nt, Human
cagaaaugacaaaguaagagga

SEQ ID NO: 621372 - RNA, 22 nt, Human
auguauugucucuuuuccuuaa

SEQ ID NO: 621373 - RNA, 22 nt, Human
uugaacauuggcaauuucauau

SEQ ID NO: 621374 - RNA, 22 nt, Human
uuuauagcugugagaccuuggg

SEQ ID NO: 621375 - RNA, 22 nt, Human
auucuaaugcccuggccccagc

SEQ ID NO: 621376 - RNA, 22 nt, Human
uagcagcugucaguuucacaua

SEQ ID NO: 621377 - RNA, 22 nt, Human
cggcagagacggcgcuuugaac

SEQ ID NO: 621378 - RNA, 22 nt, Human
uguuccagauuuagccaaccga

SEQ ID NO: 621379 - RNA, 22 nt, Human
cagggcagggccacacccccug

SEQ ID NO: 621380 - RNA, 22 nt, Human
aagggugggcccuggcagccau

SEQ ID NO: 621381 - RNA, 22 nt, Human
uuucacaaguuucaggauucug

SEQ ID NO: 621382 - RNA, 22 nt, Human
gcagauggcgcaguggaaguuc

SEQ ID NO: 621383 - RNA, 22 nt, Human
acuaaagcucacagaguugaac

SEQ ID NO: 621384 - RNA, 22 nt, Human
gacuccaggugcaggaggagcc

SEQ ID NO: 621385 - RNA, 22 nt, Human
aggcuaggccuugcccuggaac

SEQ ID NO: 621386 - RNA, 22 nt, Human
uccagcauuagaugugaaauug

SEQ ID NO: 621387 - RNA, 22 nt, Human
gcauguguuauuucucuguggg

SEQ ID NO: 621388 - RNA, 22 nt, Human
ugccaguguggaacuaggaaga

SEQ ID NO: 621389 - RNA, 22 nt, Human
agugcccuggcccagcuggacc

SEQ ID NO: 621390 - RNA, 22 nt, Human
ggcuucugaaacuguauugaga

SEQ ID NO: 621391 - RNA, 22 nt, Human
agcagcucuguuuaccuggagg

SEQ ID NO: 621392 - RNA, 22 nt, Human
uauucacagcugccgcacucag

SEQ ID NO: 621393 - RNA, 22 nt, Human
aguaauaauuuauauuagggag

SEQ ID NO: 621394 - RNA, 22 nt, Human
ucugagguaccagcugguuuau

SEQ ID NO: 621395 - RNA, 22 nt, Human
uccucaggcugccuggaagacu

SEQ ID NO: 621396 - RNA, 17 nt, Human
ggcuucagggagcuggg

SEQ ID NO: 621397 - RNA, 22 nt, Human
ucauuucaugucucaggcacug

SEQ ID NO: 621398 - RNA, 21 nt, Human
uagccauguuccuuaugguuc

SEQ ID NO: 621399 - RNA, 23 nt, Human
ucccugagaugcugcucuguccc

SEQ ID NO: 621400 - RNA, 22 nt, Human
cagagguuaccuagagcaagaa

SEQ ID NO: 621401 - RNA, 22 nt, Human
uuucauuucauagaauuguguu

SEQ ID NO: 621402 - RNA, 22 nt, Human
cucagaaaggguugcugagggc

SEQ ID NO: 621403 - RNA, 23 nt, Human
cugcauauggagguuagcaacuc

SEQ ID NO: 621404 - RNA, 22 nt, Human
uuaaaagaccuguugagguuag

SEQ ID NO: 621405 - RNA, 22 nt, Human
uauccauaccacuacuucccuu

SEQ ID NO: 621406 - RNA, 22 nt, Human
uuaagauagaacccaguagucu

SEQ ID NO: 621407 - RNA, 21 nt, Human
cauuagggcagaagcaggaag

SEQ ID NO: 621408 - RNA, 20 nt, Human
gcugccuuguccugcuuggu

SEQ ID NO: 621409 - RNA, 22 nt, Human
cugccucucagccugaccgcca

SEQ ID NO: 621410 - RNA, 22 nt, Human
aggcagggcugggauuagacuc

SEQ ID NO: 621411 - RNA, 22 nt, Human
ugucauuuaguccucugugugu

SEQ ID NO: 621412 - RNA, 19 nt, Human
ugcuggaacaucaguagcu

SEQ ID NO: 621413 - RNA, 22 nt, Human
aagggcugaaagaccuugggca

SEQ ID NO: 621414 - RNA, 22 nt, Human
cggucugagauuuuuaauaggc

SEQ ID NO: 621415 - RNA, 22 nt, Human
uucugaaaccacugaccaacua

SEQ ID NO: 621416 - RNA, 22 nt, Human
gggggacuggaccguccugggu

SEQ ID NO: 621417 - RNA, 22 nt, Human
aagacccacaaggcugaauguu

SEQ ID NO: 621418 - RNA, 22 nt, Human
uagauuuguguuugggaugaga

SEQ ID NO: 621419 - RNA, 22 nt, Human
uugacuucccagacuuguguuu

SEQ ID NO: 621420 - RNA, 22 nt, Human
uacaguauagaauguguauuaa

SEQ ID NO: 621421 - RNA, 21 nt, Human
uuuaugcagauaaugcuauuu

SEQ ID NO: 621422 - RNA, 22 nt, Human
ggcugugaaguagcaggggcag

SEQ ID NO: 621423 - RNA, 22 nt, Human
cugggcacagacccccugggcc

SEQ ID NO: 621424 - RNA, 22 nt, Human
aaauuuaagaagugugugcgug

SEQ ID NO: 621425 - RNA, 22 nt, Human
auuugcaagaguaagaauuucu

SEQ ID NO: 621426 - RNA, 22 nt, Human
ugcagaguaaaagcagaugcua

SEQ ID NO: 621427 - RNA, 22 nt, Human
ucauugaagugacugaaagauu

SEQ ID NO: 621428 - RNA, 22 nt, Human
ccacccuggguucugaugugga

SEQ ID NO: 621429 - RNA, 15 nt, Human
uucaggauaugacuc

SEQ ID NO: 621430 - RNA, 22 nt, Human
gggagggagaggacaguucuau

SEQ ID NO: 621431 - RNA, 22 nt, Human
acaugaaaccugagucuaacuc

SEQ ID NO: 621432 - RNA, 22 nt, Human
ugacaggaugaugagcaggggg

SEQ ID NO: 621433 - RNA, 22 nt, Human
uuugacaacugugcaguuugua

SEQ ID NO: 621434 - RNA, 22 nt, Human
cagacaauuaaguaauugaggu

SEQ ID NO: 621435 - RNA, 22 nt, Human
aaaaccacaaugacuuuugcac

SEQ ID NO: 621436 - RNA, 22 nt, Human
aaagugcugaagaccuagcugu

SEQ ID NO: 621437 - RNA, 22 nt, Human
cagaaacugcuccccugguagg

SEQ ID NO: 621438 - RNA, 22 nt, Human
uauaauuuaucaugucacaguu

SEQ ID NO: 621439 - RNA, 22 nt, Human
cucagggcucugcaugcacacg

SEQ ID NO: 621440 - RNA, 22 nt, Human
gugcaggauguugggaaucagg

SEQ ID NO: 621441 - RNA, 22 nt, Human
gagcagcugguaggugaaccca

SEQ ID NO: 621442 - RNA, 22 nt, Human
uccugugguaugggagugaugu

SEQ ID NO: 621443 - RNA, 22 nt, Human
ccugggucuguauugguaggua

SEQ ID NO: 621444 - RNA, 22 nt, Human
augcauaaagaaagcuaucugg

SEQ ID NO: 621445 - RNA, 22 nt, Human
ucugucaccgagggcauccaaa

SEQ ID NO: 621446 - RNA, 22 nt, Human
cugcuuuaaaacugauacauga

SEQ ID NO: 621447 - RNA, 22 nt, Human
ucuggggaauguucauuucuga

SEQ ID NO: 621448 - RNA, 22 nt, Human
guccucuugcucauuggggcag

SEQ ID NO: 621449 - RNA, 22 nt, Human
ugauaugcauguaagggagaca

SEQ ID NO: 621450 - RNA, 22 nt, Human
cacaguccuacagagaucagag

SEQ ID NO: 621451 - RNA, 22 nt, Human
uccugcagcugauaaauacagu

SEQ ID NO: 621452 - RNA, 22 nt, Human
agggcagaaaccaccuugaugg

SEQ ID NO: 621453 - RNA, 22 nt, Human
gaggagaggggcucccaagagc

SEQ ID NO: 621454 - RNA, 20 nt, Human
aauuuuaucuccauccuuug

SEQ ID NO: 621455 - RNA, 22 nt, Human
uuaguugauguucuggagguag

SEQ ID NO: 621456 - RNA, 22 nt, Human
uuuccaauuugguagucaucgg

SEQ ID NO: 621457 - RNA, 22 nt, Human
cuguggcuuuggggcggaggac

SEQ ID NO: 621458 - RNA, 22 nt, Human
uucugcuaugaaaaaagugcug

SEQ ID NO: 621459 - RNA, 22 nt, Human
aaguguuuacuuaaagucaugg

SEQ ID NO: 621460 - RNA, 22 nt, Human
ucagaaguccccagucaaggag

SEQ ID NO: 621461 - RNA, 22 nt, Human
uagaggcuucuacugcucacuu

SEQ ID NO: 621462 - RNA, 22 nt, Human
caggugacuucugaggccuuca

SEQ ID NO: 621463 - RNA, 22 nt, Human
uguccuggaguuauaaugccug

SEQ ID NO: 621464 - RNA, 22 nt, Human
cacuuaaauguuccuacagcag

SEQ ID NO: 621465 - RNA, 23 nt, Human
uaauuuuagccuuacaggacccu

SEQ ID NO: 621466 - RNA, 22 nt, Human
caggaugcacuaggaaccaggg

SEQ ID NO: 621467 - RNA, 22 nt, Human
cuggcugcaggaaggagugggc

SEQ ID NO: 621468 - RNA, 22 nt, Human
gcacaggaggccgaugcucaug

SEQ ID NO: 621469 - RNA, 22 nt, Human
cagcccugcugacacugucuga

SEQ ID NO: 621470 - RNA, 22 nt, Human
aggccaaguuacuugggaaagc

SEQ ID NO: 621471 - RNA, 22 nt, Human
guuuaaccauugcauauccaua

SEQ ID NO: 621472 - RNA, 22 nt, Human
guggccugggguuuguucugag

SEQ ID NO: 621473 - RNA, 22 nt, Human
gggaagcagacggcggggaaau

SEQ ID NO: 621474 - RNA, 22 nt, Human
ccacaagacucugucagcauaa

SEQ ID NO: 621475 - RNA, 22 nt, Human
aaauccagguaguuugguuuga

SEQ ID NO: 621476 - RNA, 22 nt, Human
cucuuuggagaagcacguauua

SEQ ID NO: 621477 - RNA, 20 nt, Human
agcaaaaugcaagauuuuca

SEQ ID NO: 621478 - RNA, 22 nt, Human
ucagacugcugucccugccugg

SEQ ID NO: 621479 - RNA, 22 nt, Human
gcugggccccuugaaaggcguc

SEQ ID NO: 621480 - RNA, 17 nt, Human
ucgguuugccaggcuuc

SEQ ID NO: 621481 - RNA, 22 nt, Human
agcccagggaguugauuagcau

SEQ ID NO: 621482 - RNA, 22 nt, Human
cagaaaaggaagagcuauguaa

SEQ ID NO: 621483 - RNA, 22 nt, Human
gucaagucaugacucaaaggaa

SEQ ID NO: 621484 - RNA, 22 nt, Human
augugcuugaagccucagagaa

SEQ ID NO: 621485 - RNA, 22 nt, Human
agauuucagaugcucggcaguu

SEQ ID NO: 621486 - RNA, 22 nt, Human
gaggaagcagggcuuggcugag

SEQ ID NO: 621487 - RNA, 22 nt, Human
ggugcuguggcagcuccuccuc

SEQ ID NO: 621488 - RNA, 22 nt, Human
gaaauaauuuagaagguauucc

SEQ ID NO: 621489 - RNA, 22 nt, Human
uauugcuuuuauuucuauggac

SEQ ID NO: 621490 - RNA, 22 nt, Human
aucauagguguguuaccaguua

SEQ ID NO: 621491 - RNA, 21 nt, Human
ccaaaggcuauguaucuucug

SEQ ID NO: 621492 - RNA, 22 nt, Human
ucacagaagggaaagaugccaa

SEQ ID NO: 621493 - RNA, 22 nt, Human
guuauauauaguauuucucuga

SEQ ID NO: 621494 - RNA, 22 nt, Human
ugguccuggugcaagugcauuu

SEQ ID NO: 621495 - RNA, 22 nt, Human
gccaaaucacagggccaaaagc

SEQ ID NO: 621496 - RNA, 22 nt, Human
cucugcagagccuccagcccag

SEQ ID NO: 621497 - RNA, 22 nt, Human
cagguccaauugcgcuaaaauc

SEQ ID NO: 621498 - RNA, 22 nt, Human
uccuggcagcccgcaggugcug

SEQ ID NO: 621499 - RNA, 22 nt, Human
cauuaacaauuguuuaugcugu

SEQ ID NO: 621500 - RNA, 22 nt, Human
cuucccuuucuggugacuucuc

SEQ ID NO: 621501 - RNA, 22 nt, Human
uucucuuagcuguaaagucaau

SEQ ID NO: 621502 - RNA, 22 nt, Human
uucuggaagaauaaugggcaaa

SEQ ID NO: 621503 - RNA, 20 nt, Human
uuuauucagccuacccucuu

SEQ ID NO: 621504 - RNA, 22 nt, Human
gucauuuuaugggaacagauuu

SEQ ID NO: 621505 - RNA, 22 nt, Human
auaaacaguaaaugugagcagu

SEQ ID NO: 621506 - RNA, 23 nt, Human
ucucagugcacgcaccaugccug

SEQ ID NO: 621507 - RNA, 22 nt, Human
augcucuauaaauaugacaugu

SEQ ID NO: 621508 - RNA, 22 nt, Human
guacacagaugcuugagaaucu

SEQ ID NO: 621509 - RNA, 22 nt, Human
uccugggcacaagugagucucc

SEQ ID NO: 621510 - RNA, 22 nt, Human
cugcuccuggucauccuccacu

SEQ ID NO: 621511 - RNA, 22 nt, Human
uccaggccuuugcacauguugu

SEQ ID NO: 621512 - RNA, 18 nt, Human
auuguuaauagaguacuu

SEQ ID NO: 621513 - RNA, 17 nt, Human
cucugggucuccugcuu

SEQ ID NO: 621514 - RNA, 22 nt, Human
uccuggcuaacacggugacacc

SEQ ID NO: 621515 - RNA, 22 nt, Human
gagguccacugaggcaacaggg

SEQ ID NO: 621516 - RNA, 22 nt, Human
acucucucacagcuuggcugau

SEQ ID NO: 621517 - RNA, 22 nt, Human
cuggggugagcagaaacagggg

SEQ ID NO: 621518 - RNA, 22 nt, Human
uugcuuccucugugcaauccuc

SEQ ID NO: 621519 - RNA, 22 nt, Human
cucucugaggaaggagcaucug

SEQ ID NO: 621520 - RNA, 22 nt, Human
aggagugugaagagccuagauc

SEQ ID NO: 621521 - RNA, 23 nt, Human
gacagguaaggguugggagaauc

SEQ ID NO: 621522 - RNA, 22 nt, Human
ugcagagggaaaaggugcuccu

SEQ ID NO: 621523 - RNA, 18 nt, Human
cucuuaagccuuugucaa

SEQ ID NO: 621524 - RNA, 22 nt, Human
cucagagagguugaacaacuug

SEQ ID NO: 621525 - RNA, 22 nt, Human
aaccuggaggcuguguagucuu

SEQ ID NO: 621526 - RNA, 23 nt, Human
ugauuacaagggccaaagaaagg

SEQ ID NO: 621527 - RNA, 18 nt, Human
gagaaaguuugggcagaa

SEQ ID NO: 621528 - RNA, 22 nt, Human
uuucaaacuccagcucaccaau

SEQ ID NO: 621529 - RNA, 18 nt, Human
uuuccaagaagagagcuc

SEQ ID NO: 621530 - RNA, 22 nt, Human
agcuccagagucugaacuauuc

SEQ ID NO: 621531 - RNA, 22 nt, Human
ucucuacauaaccucaauacuc

SEQ ID NO: 621532 - RNA, 22 nt, Human
ccagaggaguugaggcuuuggg

SEQ ID NO: 621533 - RNA, 22 nt, Human
uggaccagcagccccagugccu

SEQ ID NO: 621534 - RNA, 22 nt, Human
uccugaaggagcaguugcuggg

SEQ ID NO: 621535 - RNA, 22 nt, Human
uggcacagccaucuucuccugc

SEQ ID NO: 621536 - RNA, 23 nt, Human
agaaguucaagaccagccugccc

SEQ ID NO: 621537 - RNA, 22 nt, Human
gaggguccuggcuaagucugac

SEQ ID NO: 621538 - RNA, 22 nt, Human
uauaauuuuagaagagauggaa

SEQ ID NO: 621539 - RNA, 22 nt, Human
agcacauuaguaucuaagaaca

SEQ ID NO: 621540 - RNA, 22 nt, Human
cuuacagagaagaaaauguagu

SEQ ID NO: 621541 - RNA, 22 nt, Human
augaggccuuucuucacccuuu

SEQ ID NO: 621542 - RNA, 22 nt, Human
agauaugacuagaagcucauuu

SEQ ID NO: 621543 - RNA, 23 nt, Human
aaagauguucccaaaguucacgu

SEQ ID NO: 621544 - RNA, 22 nt, Human
uucagaaagugaaucuuguuau

SEQ ID NO: 621545 - RNA, 22 nt, Human
ugugggugguaaaauacaauga

SEQ ID NO: 621546 - RNA, 19 nt, Human
gaggaggcuucagcuuucu

SEQ ID NO: 621547 - RNA, 22 nt, Human
caguauguacucuuaucaugua

SEQ ID NO: 621548 - RNA, 22 nt, Human
guuuaugaggaaaaguuaugau

SEQ ID NO: 621549 - RNA, 22 nt, Human
uuucuacuucuccugaaugucu

SEQ ID NO: 621550 - RNA, 22 nt, Human
gcagaggacacaggagggcaag

SEQ ID NO: 621551 - RNA, 22 nt, Human
ugaggugacaauucauucucca

SEQ ID NO: 621552 - RNA, 22 nt, Human
cuucaguuuaucccaucaucca

SEQ ID NO: 621553 - RNA, 22 nt, Human
ggacccugggcagcuggcugcu

SEQ ID NO: 621554 - RNA, 22 nt, Human
cuccuggaagcccgcccugcug

SEQ ID NO: 621555 - RNA, 22 nt, Human
augaacacaauacgugcaugca

SEQ ID NO: 621556 - RNA, 22 nt, Human
cacccccaggagcuccagggac

SEQ ID NO: 621557 - RNA, 23 nt, Human
cagggaggagauacuguguaucu

SEQ ID NO: 621558 - RNA, 22 nt, Human
guucaaaauucaaaugguauac

SEQ ID NO: 621559 - RNA, 22 nt, Human
auuuccuucggacaguuugggu

SEQ ID NO: 621560 - RNA, 22 nt, Human
gaugauuguuggcucucuugau

SEQ ID NO: 621561 - RNA, 22 nt, Human
cacacaguggaguauuacucag

SEQ ID NO: 621562 - RNA, 23 nt, Human
ucuguacacaucagcaucuccca

SEQ ID NO: 621563 - RNA, 22 nt, Human
agcugagauuguuuccauuucu

SEQ ID NO: 621564 - RNA, 22 nt, Human
cugugcuucgcaacuccaaggu

SEQ ID NO: 621565 - RNA, 23 nt, Human
cacugggcccaggguguggaggc

SEQ ID NO: 621566 - RNA, 22 nt, Human
auuucugauaguaaaggucuuu

SEQ ID NO: 621567 - RNA, 22 nt, Human
cucaggcugcccugacagcccc

SEQ ID NO: 621568 - RNA, 22 nt, Human
acagcuaaucccccuagauucu

SEQ ID NO: 621569 - RNA, 22 nt, Human
uucauugauaguuuuauguaug

SEQ ID NO: 621570 - RNA, 22 nt, Human
acuaaaguguuggagaaugagg

SEQ ID NO: 621571 - RNA, 22 nt, Human
gaccuucuugcuguguccuaac

SEQ ID NO: 621572 - RNA, 22 nt, Human
cuuaauguggaccugguuucua

SEQ ID NO: 621573 - RNA, 22 nt, Human
ugugaggccuagacagccuggg

SEQ ID NO: 621574 - RNA, 22 nt, Human
agggcagacuaggauggaagug

SEQ ID NO: 621575 - RNA, 22 nt, Human
ugauuucaaguagugacaugcu

SEQ ID NO: 621576 - RNA, 22 nt, Human
guuuacauuaaguauuagcauc

SEQ ID NO: 621577 - RNA, 19 nt, Human
acaagucacuuacuuagua

SEQ ID NO: 621578 - RNA, 22 nt, Human
gucugcugcagagcauggcuuu

SEQ ID NO: 621579 - RNA, 22 nt, Human
auaaccaugauuaaucuaagaa

SEQ ID NO: 621580 - RNA, 22 nt, Human
uucucacacuuuccacugaggu

SEQ ID NO: 621581 - RNA, 22 nt, Human
uuacauauuauccaaaacugcu

SEQ ID NO: 621582 - RNA, 22 nt, Human
gaggagagaacauuccuccaua

SEQ ID NO: 621583 - RNA, 22 nt, Human
ccaagugauacacccgccucgg

SEQ ID NO: 621584 - RNA, 22 nt, Human
ggcccaguguaccccaggcagu

SEQ ID NO: 621585 - RNA, 22 nt, Human
ucaguguguuacuuucuccuau

SEQ ID NO: 621586 - RNA, 22 nt, Human
uggaggccacaugaacgcugcg

SEQ ID NO: 621587 - RNA, 22 nt, Human
cauucuucuggauaguuaguug

SEQ ID NO: 621588 - RNA, 22 nt, Human
aucuggauagguuguuuugcau

SEQ ID NO: 621589 - RNA, 22 nt, Human
uuccugugguccagagucaucc

SEQ ID NO: 621590 - RNA, 22 nt, Human
agcugcagauaggauguuauuu

SEQ ID NO: 621591 - RNA, 22 nt, Human
aggcuucaggaagucuccuggg

SEQ ID NO: 621592 - RNA, 17 nt, Human
cugcuuugugcaacgcu

SEQ ID NO: 621593 - RNA, 22 nt, Human
ucuuuugugccaaguaaugaau

SEQ ID NO: 621594 - RNA, 22 nt, Human
ugguuccaagauggcugccaca

SEQ ID NO: 621595 - RNA, 22 nt, Human
gccagcucuguggcuguacuug

SEQ ID NO: 621596 - RNA, 22 nt, Human
auuguaauuuuagagaaagugg

SEQ ID NO: 621597 - RNA, 21 nt, Human
agauuauaaagaaccuucuua

SEQ ID NO: 621598 - RNA, 22 nt, Human
guaucacuuuugagagugagaa

SEQ ID NO: 621599 - RNA, 22 nt, Human
ucaaugcauaggagguggcaga

SEQ ID NO: 621600 - RNA, 22 nt, Human
agaagucaaugaugagagugcu

SEQ ID NO: 621601 - RNA, 22 nt, Human
guacugaauaacaaagucuguc

SEQ ID NO: 621602 - RNA, 22 nt, Human
guggcugcaguaguguaggguc

SEQ ID NO: 621603 - RNA, 22 nt, Human
agccucucacugucacccuccc

SEQ ID NO: 621604 - RNA, 22 nt, Human
auguuacauaguccuuauuugu

SEQ ID NO: 621605 - RNA, 22 nt, Human
gcuuccuuccuuacauuggugg

SEQ ID NO: 621606 - RNA, 22 nt, Human
uucuuaagcguaugauaaugaa

SEQ ID NO: 621607 - RNA, 22 nt, Human
uuauuuuaccuuccucugagcu

SEQ ID NO: 621608 - RNA, 22 nt, Human
ccaggcucacugacuaccacau

SEQ ID NO: 621609 - RNA, 22 nt, Human
uauacugaucacugaggucauc

SEQ ID NO: 621610 - RNA, 22 nt, Human
cacagccuuuaggguacacaca

SEQ ID NO: 621611 - RNA, 18 nt, Human
ucuuuaaguugucagagu

SEQ ID NO: 621612 - RNA, 23 nt, Human
ucuccuggcugcacuguggccac

SEQ ID NO: 621613 - RNA, 22 nt, Human
ggagccccaauugagcaguacg

SEQ ID NO: 621614 - RNA, 22 nt, Human
gcuccugugcaggucucgguug

SEQ ID NO: 621615 - RNA, 19 nt, Human
gacuccaacuuuaagcaug

SEQ ID NO: 621616 - RNA, 22 nt, Human
ugcuggaauugaccuagaagga

SEQ ID NO: 621617 - RNA, 22 nt, Human
uauaggaaauuuaucuccuggg

SEQ ID NO: 621618 - RNA, 22 nt, Human
cucccaagcugugcugaacugu

SEQ ID NO: 621619 - RNA, 22 nt, Human
ccaguccugccacccugucuau

SEQ ID NO: 621620 - RNA, 22 nt, Human
aagagacuguaaaggcgugagu

SEQ ID NO: 621621 - RNA, 23 nt, Human
auguuaaacauaacugaagagcc

SEQ ID NO: 621622 - RNA, 22 nt, Human
uucuuguucuccucauuuagag

SEQ ID NO: 621623 - RNA, 22 nt, Human
cgcuggccauagccuccugugu

SEQ ID NO: 621624 - RNA, 22 nt, Human
cagcccuggcagcuuucagggu

SEQ ID NO: 621625 - RNA, 21 nt, Human
ggcagcacuaccugaagcaua

SEQ ID NO: 621626 - RNA, 19 nt, Human
cgccuggcaggcccugcgc

SEQ ID NO: 621627 - RNA, 22 nt, Human
ggccugugcacaugugcaggaa

SEQ ID NO: 621628 - RNA, 22 nt, Human
auuuacauuccauggugguuac

SEQ ID NO: 621629 - RNA, 22 nt, Human
cagcaucucuuuuugcauuccu

SEQ ID NO: 621630 - RNA, 22 nt, Human
cuucagcaacuuuggaauguuu

SEQ ID NO: 621631 - RNA, 22 nt, Human
auaacagacugauuuuuaaaug

SEQ ID NO: 621632 - RNA, 22 nt, Human
acuguuacagggcacugaacau

SEQ ID NO: 621633 - RNA, 22 nt, Human
ucauugaaugagaugcaauaga

SEQ ID NO: 621634 - RNA, 22 nt, Human
uucauucucuuagcauaguccu

SEQ ID NO: 621635 - RNA, 20 nt, Human
gcugcucuccacggucugca

SEQ ID NO: 621636 - RNA, 22 nt, Human
ucuaaugaggacuuuauagaga

SEQ ID NO: 621637 - RNA, 22 nt, Human
uucuggaggccccuuccuucuc

SEQ ID NO: 621638 - RNA, 22 nt, Human
uuucuaaaugguggcugcauug

SEQ ID NO: 621639 - RNA, 22 nt, Human
acaaaguuugugguauuccaag

SEQ ID NO: 621640 - RNA, 22 nt, Human
gcuuagucaauuauaaauaggc

SEQ ID NO: 621641 - RNA, 22 nt, Human
cucuggguggucucacugagug

SEQ ID NO: 621642 - RNA, 17 nt, Human
agccugccccaugcugc

SEQ ID NO: 621643 - RNA, 22 nt, Human
gcggggcacagugauggagcac

SEQ ID NO: 621644 - RNA, 22 nt, Human
ucaccuguauuaauacagaacu

SEQ ID NO: 621645 - RNA, 22 nt, Human
aaugagaacugggaguuggugg

SEQ ID NO: 621646 - RNA, 22 nt, Human
agcacagaaagcacauuugaaa

SEQ ID NO: 621647 - RNA, 22 nt, Human
acauguuuggcucuaugcuaua

SEQ ID NO: 621648 - RNA, 22 nt, Human
uccuucagggggccgccugcac

SEQ ID NO: 621649 - RNA, 22 nt, Human
gggagguucuguucgcacuuga

SEQ ID NO: 621650 - RNA, 22 nt, Human
uuucagucauggauucacugag

SEQ ID NO: 621651 - RNA, 23 nt, Human
ugagucaccacaguuacagucac

SEQ ID NO: 621652 - RNA, 22 nt, Human
gaaucuaugccucauauagacc

SEQ ID NO: 621653 - RNA, 22 nt, Human
gacagcagacagaacuaccugc

SEQ ID NO: 621654 - RNA, 22 nt, Human
agaugguuaucuuuucuuugua

SEQ ID NO: 621655 - RNA, 22 nt, Human
gaaauagaggacagcuggauca

SEQ ID NO: 621656 - RNA, 22 nt, Human
ccagcauuugcuucuggugggg

SEQ ID NO: 621657 - RNA, 22 nt, Human
ugcccacauggugccauggcca

SEQ ID NO: 621658 - RNA, 22 nt, Human
uccuggggaggguucuggcucc

SEQ ID NO: 621659 - RNA, 22 nt, Human
uggcagguuaacuuacaacugu

SEQ ID NO: 621660 - RNA, 22 nt, Human
cugaaagggagaacaccaagag

SEQ ID NO: 621661 - RNA, 22 nt, Human
ggucauuguucuuuucugugau

SEQ ID NO: 621662 - RNA, 22 nt, Human
caagaaacaccaaugacugcug

SEQ ID NO: 621663 - RNA, 22 nt, Human
acaggcucucuauugagugcag

SEQ ID NO: 621664 - RNA, 22 nt, Human
uaugaacacacuuuggaaguga

SEQ ID NO: 621665 - RNA, 16 nt, Human
gggcuggagauacagu

SEQ ID NO: 621666 - RNA, 22 nt, Human
aaaccuguggccacuaaauuug

SEQ ID NO: 621667 - RNA, 22 nt, Human
agcauucauugcuagaauguaa

SEQ ID NO: 621668 - RNA, 22 nt, Human
aguguuugucccguuagaaaug

SEQ ID NO: 621669 - RNA, 22 nt, Human
auccaggcugucuaaugggaga

SEQ ID NO: 621670 - RNA, 22 nt, Human
gaagagcuaaaggcacaggcuu

SEQ ID NO: 621671 - RNA, 22 nt, Human
uaaagcccucugaucacacugg

SEQ ID NO: 621672 - RNA, 22 nt, Human
uagcccuguccuuggccugugc

SEQ ID NO: 621673 - RNA, 22 nt, Human
agaccuguuggguucauuggcu

SEQ ID NO: 621674 - RNA, 22 nt, Human
aagcagauuggggauuuccaug

SEQ ID NO: 621675 - RNA, 22 nt, Human
uuugaagacagaucaauauaag

SEQ ID NO: 621676 - RNA, 19 nt, Human
ggccagcacagggcucugu

SEQ ID NO: 621677 - RNA, 22 nt, Human
gcaggagcagucaggggcagcu

SEQ ID NO: 621678 - RNA, 22 nt, Human
aagaauugaugugaauugcagc

SEQ ID NO: 621679 - RNA, 22 nt, Human
uauuaagauacguaguuguaaa

SEQ ID NO: 621680 - RNA, 22 nt, Human
ugaaaucaaugucuucugucuc

SEQ ID NO: 621681 - RNA, 22 nt, Human
ccugcagggugcugccacagau

SEQ ID NO: 621682 - RNA, 20 nt, Human
agggcagcuugaggagccgg

SEQ ID NO: 621683 - RNA, 22 nt, Human
acugagggccaaaggcacugag

SEQ ID NO: 621684 - RNA, 22 nt, Human
uuaugcaugagauaaaaauugg

SEQ ID NO: 621685 - RNA, 22 nt, Human
cuucuguguuuuacuauaugua

SEQ ID NO: 621686 - RNA, 22 nt, Human
cugugcuggauucugaggcuac

SEQ ID NO: 621687 - RNA, 22 nt, Human
augcuguuauucuaauguguga

SEQ ID NO: 621688 - RNA, 22 nt, Human
auguuauaguuauaaaaugagg

SEQ ID NO: 621689 - RNA, 22 nt, Human
gaguugaagaaauaguuuugau

SEQ ID NO: 621690 - RNA, 22 nt, Human
gggacgggcaguccaagggguc

SEQ ID NO: 621691 - RNA, 22 nt, Human
cacaggagagcugggaggugcc

SEQ ID NO: 621692 - RNA, 22 nt, Human
ggggaacaccgggcagaggcgc

SEQ ID NO: 621693 - RNA, 22 nt, Human
gggauuacagaugugagccauu

SEQ ID NO: 621694 - RNA, 22 nt, Human
agguuucuggaaagguuuugcu

SEQ ID NO: 621695 - RNA, 22 nt, Human
uuccuuccugucuuccuuacug

SEQ ID NO: 621696 - RNA, 22 nt, Human
gcugggcuguaguuugcugacc

SEQ ID NO: 621697 - RNA, 22 nt, Human
gucacacagggccuccaaauca

SEQ ID NO: 621698 - RNA, 22 nt, Human
gaaagaaugcugggagccaucu

SEQ ID NO: 621699 - RNA, 22 nt, Human
uggcucucaggccugcugcguu

SEQ ID NO: 621700 - RNA, 22 nt, Human
agcagggcuguguagguaauga

SEQ ID NO: 621701 - RNA, 22 nt, Human
caacauuauauagccacaugcc

SEQ ID NO: 621702 - RNA, 22 nt, Human
cuuuuggccucaaaggaaagaa

SEQ ID NO: 621703 - RNA, 22 nt, Human
gaggagguuccggguggagaag

SEQ ID NO: 621704 - RNA, 22 nt, Human
agcgauucuaauuggagauuaa

SEQ ID NO: 621705 - RNA, 22 nt, Human
gggcccagcacuggcugggauc

SEQ ID NO: 621706 - RNA, 22 nt, Human
caucagagguacuuaaugaaug

SEQ ID NO: 621707 - RNA, 22 nt, Human
ucuggaauaacccugcuuccaa

SEQ ID NO: 621708 - RNA, 22 nt, Human
ggccuccaucuuaucuuacucu

SEQ ID NO: 621709 - RNA, 22 nt, Human
acugucccauuuauguagacau

SEQ ID NO: 621710 - RNA, 22 nt, Human
aguacaguagggugcuguuagu

SEQ ID NO: 621711 - RNA, 22 nt, Human
ucagacagcuugcagggaggug

SEQ ID NO: 621712 - RNA, 22 nt, Human
acucauguaagcggaauguagu

SEQ ID NO: 621713 - RNA, 22 nt, Human
cugagccccaucugaggugccc

SEQ ID NO: 621714 - RNA, 22 nt, Human
uucacauugugcagauuauggu

SEQ ID NO: 621715 - RNA, 16 nt, Human
ugggugggaggagcgg

SEQ ID NO: 621716 - RNA, 19 nt, Human
gagcgcagagggcagggga

SEQ ID NO: 621717 - RNA, 22 nt, Human
acaauagugccuggcauagagu

SEQ ID NO: 621718 - RNA, 22 nt, Human
aacaggaauugcaggcagaucu

SEQ ID NO: 621719 - RNA, 22 nt, Human
cucuucaaaagucuaauccuua

SEQ ID NO: 621720 - RNA, 22 nt, Human
aagcucaggcuggaccuggcuu

SEQ ID NO: 621721 - RNA, 22 nt, Human
aauucugaaagauuccuuauuc

SEQ ID NO: 621722 - RNA, 22 nt, Human
aaucugaauauuuauguguauu

SEQ ID NO: 621723 - RNA, 22 nt, Human
auacggguuguuaaaaaaucau

SEQ ID NO: 621724 - RNA, 22 nt, Human
ggaguggcagcuaggcugucag

SEQ ID NO: 621725 - RNA, 22 nt, Human
cugaaagcaaaguaauucuuaa

SEQ ID NO: 621726 - RNA, 22 nt, Human
cagugccugugggcuucuucca

SEQ ID NO: 621727 - RNA, 22 nt, Human
cacaugagagcccccaagagca

SEQ ID NO: 621728 - RNA, 22 nt, Human
cagcagcagcuuaguggucccc

SEQ ID NO: 621729 - RNA, 23 nt, Human
aggcagugucucuuauccugucc

SEQ ID NO: 621730 - RNA, 22 nt, Human
cugcauuagucaugcuuugcag

SEQ ID NO: 621731 - RNA, 22 nt, Human
ggcgcuggccacgguggcucug

SEQ ID NO: 621732 - RNA, 22 nt, Human
cucauggauauaagaacuguuu

SEQ ID NO: 621733 - RNA, 22 nt, Human
uucugugugcugucuuggcuuu

SEQ ID NO: 621734 - RNA, 21 nt, Human
gggaucugaggcaagucuccu

SEQ ID NO: 621735 - RNA, 22 nt, Human
ugucauugaggaaaacuaggug

SEQ ID NO: 621736 - RNA, 22 nt, Human
auggguggccccgugugcaguc

SEQ ID NO: 621737 - RNA, 22 nt, Human
uguggagcucagaaguagcagu

SEQ ID NO: 621738 - RNA, 22 nt, Human
gcucuccugugcagaugcugcu

SEQ ID NO: 621739 - RNA, 22 nt, Human
accaguaugugccuucaguguc

SEQ ID NO: 621740 - RNA, 22 nt, Human
gcagggacgccagggacagcaa

SEQ ID NO: 621741 - RNA, 22 nt, Human
ggugugugguuuugauacaguc

SEQ ID NO: 621742 - RNA, 17 nt, Human
gcaaggaaguucuuugc

SEQ ID NO: 621743 - RNA, 22 nt, Human
gacauuuacugaauacugauua

SEQ ID NO: 621744 - RNA, 22 nt, Human
uucucuguuuuccccucgaugu

SEQ ID NO: 621745 - RNA, 22 nt, Human
uucaaaccuucacuugcagagu

SEQ ID NO: 621746 - RNA, 19 nt, Human
cuggcucuuggguggagga

SEQ ID NO: 621747 - RNA, 22 nt, Human
cacaagggcuuuguaggcuuug

SEQ ID NO: 621748 - RNA, 22 nt, Human
acaggcaaagggucaguagcag

SEQ ID NO: 621749 - RNA, 22 nt, Human
uacaaugcauucauuuuugagg

SEQ ID NO: 621750 - RNA, 22 nt, Human
ccuucagccuucauccuuccuu

SEQ ID NO: 621751 - RNA, 22 nt, Human
cagcccugcagccauggccugu

SEQ ID NO: 621752 - RNA, 22 nt, Human
caaagaauagcauggcauuugu

SEQ ID NO: 621753 - RNA, 20 nt, Human
uuugaacuuuguacucuguu

SEQ ID NO: 621754 - RNA, 22 nt, Human
gaucauuuugaugcccuuuuag

SEQ ID NO: 621755 - RNA, 22 nt, Human
ucagagaaaauggaaacuuuua

SEQ ID NO: 621756 - RNA, 22 nt, Human
ucuguguguugucaggaggauu

SEQ ID NO: 621757 - RNA, 22 nt, Human
uaauaagcguagaagguauauc

SEQ ID NO: 621758 - RNA, 22 nt, Human
ucucaggguuuguacaagugua

SEQ ID NO: 621759 - RNA, 22 nt, Human
caggccagaggcuguuguugcg

SEQ ID NO: 621760 - RNA, 22 nt, Human
uggacucuaugaugcgccagca

SEQ ID NO: 621761 - RNA, 22 nt, Human
ggcacugaucugauuucccucc

SEQ ID NO: 621762 - RNA, 22 nt, Human
guucuccaggggcuguucaucu

SEQ ID NO: 621763 - RNA, 22 nt, Human
uggcaguggcgggacucagggc

SEQ ID NO: 621764 - RNA, 22 nt, Human
guuucaauuugaaugcgaggcu

SEQ ID NO: 621765 - RNA, 20 nt, Human
agacaguggggagcuccuag

SEQ ID NO: 621766 - RNA, 22 nt, Human
gucaggauuuacaaacuucagu

SEQ ID NO: 621767 - RNA, 22 nt, Human
ucugagcuggagcccaucaccu

SEQ ID NO: 621768 - RNA, 22 nt, Human
ugcaagagcagaaagaacugag

SEQ ID NO: 621769 - RNA, 22 nt, Human
uccugggaguggccauguaaug

SEQ ID NO: 621770 - RNA, 22 nt, Human
cagagccauuauggagacuugc

SEQ ID NO: 621771 - RNA, 22 nt, Human
gcaaaaaccacaauuacuuuug

SEQ ID NO: 621772 - RNA, 19 nt, Human
uaucuuuaugcaguggugg

SEQ ID NO: 621773 - RNA, 22 nt, Human
cauaugaaguucaacagagaug

SEQ ID NO: 621774 - RNA, 22 nt, Human
aaaaguauuuauggcuauguaa

SEQ ID NO: 621775 - RNA, 22 nt, Human
aaggaagacuugagaagguucc

SEQ ID NO: 621776 - RNA, 22 nt, Human
ucugccugccagucugguccuc

SEQ ID NO: 621777 - RNA, 22 nt, Human
uauacacauuuuuaccuauagu

SEQ ID NO: 621778 - RNA, 22 nt, Human
auacaucaugcuccauauauuu

SEQ ID NO: 621779 - RNA, 22 nt, Human
ucacagcaggguaacaggaaga

SEQ ID NO: 621780 - RNA, 22 nt, Human
auucuucucuggguuggguuca

SEQ ID NO: 621781 - RNA, 22 nt, Human
cuuuauauccagauguuuggug

SEQ ID NO: 621782 - RNA, 22 nt, Human
gaaugaaaaccuuggcucaaau

SEQ ID NO: 621783 - RNA, 22 nt, Human
ugagguggcuagggaggcacuc

SEQ ID NO: 621784 - RNA, 22 nt, Human
agcugcagucaagcugggccac

SEQ ID NO: 621785 - RNA, 22 nt, Human
gcaaaucaccaccuagcuggau

SEQ ID NO: 621786 - RNA, 22 nt, Human
acaggcuggaggaggaccaaga

SEQ ID NO: 621787 - RNA, 22 nt, Human
acacaugaccuccgcagcagca

SEQ ID NO: 621788 - RNA, 22 nt, Human
guuaacacaggacucucugccu

SEQ ID NO: 621789 - RNA, 22 nt, Human
gucuggagggaagagaugucag

SEQ ID NO: 621790 - RNA, 22 nt, Human
gagcugagggucuaggaggguu

SEQ ID NO: 621791 - RNA, 22 nt, Human
cuauuuucccauaugguugaca

SEQ ID NO: 621792 - RNA, 22 nt, Human
gaaaaugugucaucccuacugu

SEQ ID NO: 621793 - RNA, 22 nt, Human
uacagauauauagugugugccu

SEQ ID NO: 621794 - RNA, 22 nt, Human
cuggcaggagcuguggccguag

SEQ ID NO: 621795 - RNA, 22 nt, Human
gugugagagacugaagaaagcc

SEQ ID NO: 621796 - RNA, 22 nt, Human
uuucuuccuggauuccuacuuc

SEQ ID NO: 621797 - RNA, 22 nt, Human
uggugccuugggccuacagcgc

SEQ ID NO: 621798 - RNA, 22 nt, Human
agagauuucuacugcacucuuu

SEQ ID NO: 621799 - RNA, 19 nt, Human
uuaggaaaccacuuuccuu

SEQ ID NO: 621800 - RNA, 22 nt, Human
cagacacacaagcaaucuaagu

SEQ ID NO: 621801 - RNA, 18 nt, Human
caguuuuuauaucuggca

SEQ ID NO: 621802 - RNA, 22 nt, Human
gugguccccagagcuguguaca

SEQ ID NO: 621803 - RNA, 22 nt, Human
ugaggccugggcacauaaccuc

SEQ ID NO: 621804 - RNA, 22 nt, Human
agcaaggaaacuauggagagau

SEQ ID NO: 621805 - RNA, 22 nt, Human
cugaggucuauuuugaaacugc

SEQ ID NO: 621806 - RNA, 22 nt, Human
aauucauugccagaaucuauga

SEQ ID NO: 621807 - RNA, 22 nt, Human
uggcccagucagcaggagaggg

SEQ ID NO: 621808 - RNA, 16 nt, Human
ggagguggguaaggug

SEQ ID NO: 621809 - RNA, 22 nt, Human
gcaguucuacuuauccauagac

SEQ ID NO: 621810 - RNA, 22 nt, Human
ccagguguucuuugucccuguu

SEQ ID NO: 621811 - RNA, 22 nt, Human
gccucugcggagcuguacauca

SEQ ID NO: 621812 - RNA, 20 nt, Human
uuuuauauguaggguauaug

SEQ ID NO: 621813 - RNA, 22 nt, Human
guggcagugggaugcuaucagg

SEQ ID NO: 621814 - RNA, 19 nt, Human
ggggagguauuguuuucau

SEQ ID NO: 621815 - RNA, 21 nt, Human
ggccucugccuugccccacuc

SEQ ID NO: 621816 - RNA, 20 nt, Human
uccuggccuucucgggcagu

SEQ ID NO: 621817 - RNA, 22 nt, Human
auuguaaaaguauucuaagauu

SEQ ID NO: 621818 - RNA, 19 nt, Human
uauuauuuguagcaaggcc

SEQ ID NO: 621819 - RNA, 21 nt, Human
gguugguguguccaguggcca

SEQ ID NO: 621820 - RNA, 22 nt, Human
caaauguauguuuuccuaugua

SEQ ID NO: 621821 - RNA, 22 nt, Human
aguggacucuucccagugcuug

SEQ ID NO: 621822 - RNA, 22 nt, Human
gcagcugaauguccauugcugc

SEQ ID NO: 621823 - RNA, 22 nt, Human
auuuuucucuccacuccauuaa

SEQ ID NO: 621824 - RNA, 22 nt, Human
acauauaugcugggacugugac

SEQ ID NO: 621825 - RNA, 22 nt, Human
uuaugaaggaucagguacuugg

SEQ ID NO: 621826 - RNA, 22 nt, Human
uccugccucacaguugaaguuu

SEQ ID NO: 621827 - RNA, 22 nt, Human
aucaggaucacugggagucuug

SEQ ID NO: 621828 - RNA, 22 nt, Human
uggcuaaucuuaaggcuuuugc

SEQ ID NO: 621829 - RNA, 22 nt, Human
uaacucugaauccucacagcag

SEQ ID NO: 621830 - RNA, 22 nt, Human
gcugauccuuuuaugucuagcu

SEQ ID NO: 621831 - RNA, 22 nt, Human
gcuuagcaaugugacaagaugc

SEQ ID NO: 621832 - RNA, 22 nt, Human
uuucauuuugguuaugccauaa

SEQ ID NO: 621833 - RNA, 22 nt, Human
cugggccuggagcccacgagcc

SEQ ID NO: 621834 - RNA, 22 nt, Human
ccaggguuggaugagucacuua

SEQ ID NO: 621835 - RNA, 22 nt, Human
cccagcauggagugaggacuca

SEQ ID NO: 621836 - RNA, 20 nt, Human
uggcuccagccuccccuacc

SEQ ID NO: 621837 - RNA, 21 nt, Human
caggcucugcugggugcuggg

SEQ ID NO: 621838 - RNA, 22 nt, Human
ccuggcucuucgggaguuuguu

SEQ ID NO: 621839 - RNA, 22 nt, Human
gggcagcaucaggaggggcuuu

SEQ ID NO: 621840 - RNA, 22 nt, Human
ucaggagcugugaauacaaagg

SEQ ID NO: 621841 - RNA, 22 nt, Human
ugcagggcaguuuguuucggca

SEQ ID NO: 621842 - RNA, 22 nt, Human
cagugcuggcuguuaggacagu

SEQ ID NO: 621843 - RNA, 22 nt, Human
ugaguucucaugaaaucuaguu

SEQ ID NO: 621844 - RNA, 22 nt, Human
uagucagacccaagagagccau

SEQ ID NO: 621845 - RNA, 22 nt, Human
ugaaacggaauguucuuuaucg

SEQ ID NO: 621846 - RNA, 19 nt, Human
uggucccauacugcuggcc

SEQ ID NO: 621847 - RNA, 22 nt, Human
ugaggcuuagauuugguaacuc

SEQ ID NO: 621848 - RNA, 22 nt, Human
cuggucaggaagguggggacag

SEQ ID NO: 621849 - RNA, 23 nt, Human
gucuuuauaguggggcacuuugu

SEQ ID NO: 621850 - RNA, 22 nt, Human
uguuuagaggaacuggaaucag

SEQ ID NO: 621851 - RNA, 19 nt, Human
uuucagacucaucuccagc

SEQ ID NO: 621852 - RNA, 22 nt, Human
aauacuaguuauuaaagcuuuu

SEQ ID NO: 621853 - RNA, 20 nt, Human
ucuuugugucagauggacag

SEQ ID NO: 621854 - RNA, 22 nt, Human
gcaguccucguaaaggucgaag

SEQ ID NO: 621855 - RNA, 22 nt, Human
augagguacuaguauauacgua

SEQ ID NO: 621856 - RNA, 22 nt, Human
ccuguacauuagcugugaauug

SEQ ID NO: 621857 - RNA, 22 nt, Human
guaaaguucuacuagaaucaac

SEQ ID NO: 621858 - RNA, 22 nt, Human
gugaaaauaaggcugguucuug

SEQ ID NO: 621859 - RNA, 22 nt, Human
gccuguccuggaugcucugcaa

SEQ ID NO: 621860 - RNA, 22 nt, Human
gcugguuucacccaaccgaugu

SEQ ID NO: 621861 - RNA, 22 nt, Human
caugcauacacaggucaggcag

SEQ ID NO: 621862 - RNA, 22 nt, Human
aauaauagcagaguuuacaauc

SEQ ID NO: 621863 - RNA, 22 nt, Human
uggagcagcauucauccagcag

SEQ ID NO: 621864 - RNA, 22 nt, Human
uccugaagcucucuuaaggaaa

SEQ ID NO: 621865 - RNA, 22 nt, Human
uugggacaucuggcauacaguu

SEQ ID NO: 621866 - RNA, 22 nt, Human
ucccagccuuccagucugguuu

SEQ ID NO: 621867 - RNA, 22 nt, Human
gccuggcugggcaccaggggag

SEQ ID NO: 621868 - RNA, 22 nt, Human
auggccucuagcugagaccaau

SEQ ID NO: 621869 - RNA, 22 nt, Human
aguaugaagaauacauagauga

SEQ ID NO: 621870 - RNA, 22 nt, Human
cccucugguuugcccuugggug

SEQ ID NO: 621871 - RNA, 22 nt, Human
ucagagcccugcuccuccccaa

SEQ ID NO: 621872 - RNA, 22 nt, Human
gacagcuguacacuccugguua

SEQ ID NO: 621873 - RNA, 22 nt, Human
gccagcagcccagaaggacuuu

SEQ ID NO: 621874 - RNA, 22 nt, Human
aaucacaugugcucaauuuuaa

SEQ ID NO: 621875 - RNA, 18 nt, Human
auacaagaucaaguguuc

SEQ ID NO: 621876 - RNA, 22 nt, Human
uauucacaggcacgaaauauug

SEQ ID NO: 621877 - RNA, 22 nt, Human
agaccgagaaguucuccaggcc

SEQ ID NO: 621878 - RNA, 22 nt, Human
gcucccucccaccagccugcag

SEQ ID NO: 621879 - RNA, 22 nt, Human
caacuuuagcaauguuaguaua

SEQ ID NO: 621880 - RNA, 22 nt, Human
uggauugauaaaaugggauguu

SEQ ID NO: 621881 - RNA, 22 nt, Human
auuuguaucaaucucaauauau

SEQ ID NO: 621882 - RNA, 22 nt, Human
ggcacacagauggagcacuagc

SEQ ID NO: 621883 - RNA, 22 nt, Human
ucugccuucgcugcucccugaa

SEQ ID NO: 621884 - RNA, 22 nt, Human
aaugaagauaaaaugggaugga

SEQ ID NO: 621885 - RNA, 22 nt, Human
gugaaauauuuaacguccaggu

SEQ ID NO: 621886 - RNA, 22 nt, Human
ucagugcucugagguccagggu

SEQ ID NO: 621887 - RNA, 20 nt, Human
cagagaccugucuucacaga

SEQ ID NO: 621888 - RNA, 22 nt, Human
uccagcuggcccggccaugaau

SEQ ID NO: 621889 - RNA, 22 nt, Human
acccagcuggaugcauggaggc

SEQ ID NO: 621890 - RNA, 22 nt, Human
gagugacucuagaaaguuucuu

SEQ ID NO: 621891 - RNA, 22 nt, Human
ucuggcucagggcucugaggga

SEQ ID NO: 621892 - RNA, 22 nt, Human
ccuuggagcggucagcacuggu

SEQ ID NO: 621893 - RNA, 22 nt, Human
cuagggucaggggccugcgucg

SEQ ID NO: 621894 - RNA, 22 nt, Human
uuuuaauucaaagugaauagug

SEQ ID NO: 621895 - RNA, 22 nt, Human
aggaugaauaacugaaauggug

SEQ ID NO: 621896 - RNA, 22 nt, Human
ugggcugcugagaaugagagag

SEQ ID NO: 621897 - RNA, 22 nt, Human
aucugucuugccuugcauauuu

SEQ ID NO: 621898 - RNA, 22 nt, Human
gcucaggcuggauugcaguggc

SEQ ID NO: 621899 - RNA, 20 nt, Human
uacuguuguugcuguugcca

SEQ ID NO: 621900 - RNA, 22 nt, Human
ugcuccuggcaucucugcgucc

SEQ ID NO: 621901 - RNA, 22 nt, Human
gaguccaguuagugaggcuggg

SEQ ID NO: 621902 - RNA, 22 nt, Human
uggugucuccauccugcccugc

SEQ ID NO: 621903 - RNA, 22 nt, Human
caucccugacuucuaggugaca

SEQ ID NO: 621904 - RNA, 22 nt, Human
uuacuucuuacaaaagaaauau

SEQ ID NO: 621905 - RNA, 22 nt, Human
gccaugcagcuuauuaaagugg

SEQ ID NO: 621906 - RNA, 22 nt, Human
ggcuucucuccaguaugcauuc

SEQ ID NO: 621907 - RNA, 22 nt, Human
caaugaacacagcaauuucaua

SEQ ID NO: 621908 - RNA, 21 nt, Human
uccagcucucauaguguucca

SEQ ID NO: 621909 - RNA, 22 nt, Human
caggcugccuggaagaggacug

SEQ ID NO: 621910 - RNA, 22 nt, Human
augcuuuuaacuccuuuauccc

SEQ ID NO: 621911 - RNA, 22 nt, Human
gaggaagaaagcauaggugggg

SEQ ID NO: 621912 - RNA, 22 nt, Human
cugggguggugcaggccucaug

SEQ ID NO: 621913 - RNA, 22 nt, Human
aacaugcuaugugucugaauca

SEQ ID NO: 621914 - RNA, 22 nt, Human
ugggcucugguuuccuggcugg

SEQ ID NO: 621915 - RNA, 22 nt, Human
ucaaucacguguuccauguucu

SEQ ID NO: 621916 - RNA, 22 nt, Human
ucauaacaaccuggaaggccag

SEQ ID NO: 621917 - RNA, 22 nt, Human
gaggggcuguggagcucucugg

SEQ ID NO: 621918 - RNA, 22 nt, Human
cugggaggauucauugagguga

SEQ ID NO: 621919 - RNA, 22 nt, Human
ugagaagcucugaaacaguauc

SEQ ID NO: 621920 - RNA, 22 nt, Human
gcugccugucugcugacccagg

SEQ ID NO: 621921 - RNA, 22 nt, Human
aaauugcuauaugugaauguga

SEQ ID NO: 621922 - RNA, 22 nt, Human
auguagugcccuuugucaucua

SEQ ID NO: 621923 - RNA, 22 nt, Human
ugaaaauucaucucauagcaga

SEQ ID NO: 621924 - RNA, 20 nt, Human
ugcaggugggcccuucuggg

SEQ ID NO: 621925 - RNA, 22 nt, Human
cuccaggaaaauagggaaugag

SEQ ID NO: 621926 - RNA, 22 nt, Human
ucuuuaaugugauuguaauuau

SEQ ID NO: 621927 - RNA, 22 nt, Human
auuuuuccaugauacuuaucug

SEQ ID NO: 621928 - RNA, 22 nt, Human
gugacaggcccagugggaugca

SEQ ID NO: 621929 - RNA, 22 nt, Human
gugggcugaggggacaccaagg

SEQ ID NO: 621930 - RNA, 22 nt, Human
agaacagaagggaggaaggccu

SEQ ID NO: 621931 - RNA, 22 nt, Human
ccagcccuugcugaaggguggc

SEQ ID NO: 621932 - RNA, 22 nt, Human
uacauaguuccauuuacaggaa

SEQ ID NO: 621933 - RNA, 20 nt, Human
agguggcucuuccugggcuu

SEQ ID NO: 621934 - RNA, 22 nt, Human
aaggccaugcacauccuaggca

SEQ ID NO: 621935 - RNA, 21 nt, Human
gcagaugggagucaucaggcu

SEQ ID NO: 621936 - RNA, 23 nt, Human
caugaagguagcacaaagccucu

SEQ ID NO: 621937 - RNA, 22 nt, Human
aaccaggaauugcagggcugca

SEQ ID NO: 621938 - RNA, 20 nt, Human
aguguuugcucacagucucc

SEQ ID NO: 621939 - RNA, 22 nt, Human
auagaaauguauuuuggacuag

SEQ ID NO: 621940 - RNA, 22 nt, Human
cccugcagccuugcaugccuuc

SEQ ID NO: 621941 - RNA, 22 nt, Human
ugaguccugcugagcagagagg

SEQ ID NO: 621942 - RNA, 22 nt, Human
agcucugugaagccagcaguuc

SEQ ID NO: 621943 - RNA, 22 nt, Human
cugagaaauucuuucuuucacu

SEQ ID NO: 621944 - RNA, 22 nt, Human
caggcucccugggcaguggcag

SEQ ID NO: 621945 - RNA, 22 nt, Human
ucuccagaguaaccuuggagca

SEQ ID NO: 621946 - RNA, 22 nt, Human
aaagccuucaaguagauguaag

SEQ ID NO: 621947 - RNA, 22 nt, Human
aggaucagggugguggaaguca

SEQ ID NO: 621948 - RNA, 22 nt, Human
uuccagccagauuugcuggguu

SEQ ID NO: 621949 - RNA, 22 nt, Human
aacacucaauuuacaaacucug

SEQ ID NO: 621950 - RNA, 22 nt, Human
cagcaguguacaaggugucaga

SEQ ID NO: 621951 - RNA, 22 nt, Human
gcuucacagaaucaauaguugg

SEQ ID NO: 621952 - RNA, 21 nt, Human
agcugagcccagaagacuggu

SEQ ID NO: 621953 - RNA, 22 nt, Human
gcucugaagggugagcuguucg

SEQ ID NO: 621954 - RNA, 22 nt, Human
agggccuguccgcucccgcccg

SEQ ID NO: 621955 - RNA, 22 nt, Human
uacauauacugagugauuugcu

SEQ ID NO: 621956 - RNA, 22 nt, Human
ugagcagaacacgggauccaug

SEQ ID NO: 621957 - RNA, 22 nt, Human
ggagacacagagcaacaaaaua

SEQ ID NO: 621958 - RNA, 22 nt, Human
caggugggagcggagacugauu

SEQ ID NO: 621959 - RNA, 22 nt, Human
acccaggccauuggcaagaguc

SEQ ID NO: 621960 - RNA, 22 nt, Human
uaauuucaccguugcuagaaau

SEQ ID NO: 621961 - RNA, 22 nt, Human
cccugccaaucccgucucucug

SEQ ID NO: 621962 - RNA, 22 nt, Human
cugcugucuaguaucuuaaaaa

SEQ ID NO: 621963 - RNA, 19 nt, Human
agggcuaggcacauagggc

SEQ ID NO: 621964 - RNA, 22 nt, Human
agcaccugcuugugacuaggga

SEQ ID NO: 621965 - RNA, 22 nt, Human
aggacuucaucaccuguauaaa

SEQ ID NO: 621966 - RNA, 22 nt, Human
gaagaauugcccauuucugucu

SEQ ID NO: 621967 - RNA, 23 nt, Human
uggaauaauaagguacauuaaca

SEQ ID NO: 621968 - RNA, 22 nt, Human
cucuccuccaacagcccugccg

SEQ ID NO: 621969 - RNA, 22 nt, Human
acagaugagacuccaggaccuu

SEQ ID NO: 621970 - RNA, 22 nt, Human
ccacacugucuaacaaggcaua

SEQ ID NO: 621971 - RNA, 22 nt, Human
gcccugaacgaggggucuggag

SEQ ID NO: 621972 - RNA, 22 nt, Human
gcucaccaagcagagacucugg

SEQ ID NO: 621973 - RNA, 19 nt, Human
aggcuucauccugggcagc

SEQ ID NO: 621974 - RNA, 22 nt, Human
agggcccucugggcacuguggc

SEQ ID NO: 621975 - RNA, 22 nt, Human
augagguuugagccucuugacc

SEQ ID NO: 621976 - RNA, 22 nt, Human
uuggcaaaggacucaaagcagg

SEQ ID NO: 621977 - RNA, 22 nt, Human
aaaugaaaugagugccuggagg

SEQ ID NO: 621978 - RNA, 23 nt, Human
acauacauaagcaccacauuuug

SEQ ID NO: 621979 - RNA, 22 nt, Human
ccagggcaggagaaagacucac

SEQ ID NO: 621980 - RNA, 22 nt, Human
caggaagauuguggaggugguu

SEQ ID NO: 621981 - RNA, 22 nt, Human
aaugcaaagugaggugaguggc

SEQ ID NO: 621982 - RNA, 22 nt, Human
cagggcugaggacacaaguaaa

SEQ ID NO: 621983 - RNA, 22 nt, Human
ucagaggugagcaugugaccaa

SEQ ID NO: 621984 - RNA, 22 nt, Human
uccgaggcgcaccggcgcuccu

SEQ ID NO: 621985 - RNA, 22 nt, Human
ucuuggaagccucaagauacuc

SEQ ID NO: 621986 - RNA, 22 nt, Human
cauuuguaguuaaaaaugucuc

SEQ ID NO: 621987 - RNA, 23 nt, Human
agucagugcgggauggucagggg

SEQ ID NO: 621988 - RNA, 22 nt, Human
gcugccagccaacuugcugugc

SEQ ID NO: 621989 - RNA, 22 nt, Human
guggcuguucuugccccaugcu

SEQ ID NO: 621990 - RNA, 22 nt, Human
gagcuuccagagacaucagagu

SEQ ID NO: 621991 - RNA, 22 nt, Human
ucaccggcagacguggccugau

SEQ ID NO: 621992 - RNA, 22 nt, Human
gccugcagggcccuuguggguc

SEQ ID NO: 621993 - RNA, 22 nt, Human
uaugaagcuuugaaaagcuuac

SEQ ID NO: 621994 - RNA, 22 nt, Human
ucugaaaucuguaagcacuagc

SEQ ID NO: 621995 - RNA, 22 nt, Human
agcaccaugaccuugccauuga

SEQ ID NO: 621996 - RNA, 22 nt, Human
uaaucacagaaaugcccauuca

SEQ ID NO: 621997 - RNA, 22 nt, Human
uaugaauauaccacaauuuagg

SEQ ID NO: 621998 - RNA, 22 nt, Human
aguuauguccucagcaaaucaa

SEQ ID NO: 621999 - RNA, 22 nt, Human
augcugacagacuauuaacuau

SEQ ID NO: 622000 - RNA, 18 nt, Human
uacuuuauucccccucca

SEQ ID NO: 622001 - RNA, 22 nt, Human
aguucacagggaagguuauugu

SEQ ID NO: 622002 - RNA, 21 nt, Human
uguguucuucuaggucagcua

SEQ ID NO: 622003 - RNA, 22 nt, Human
cucuccaucugugugaccuccc

SEQ ID NO: 622004 - RNA, 22 nt, Human
cucagagcugaggccagggaca

SEQ ID NO: 622005 - RNA, 22 nt, Human
ccagugcuaagguagccucugc

SEQ ID NO: 622006 - RNA, 22 nt, Human
gucuuuaugguaugaaaacuga

SEQ ID NO: 622007 - RNA, 22 nt, Human
acaguguuuaaaaaucagaucu

SEQ ID NO: 622008 - RNA, 22 nt, Human
cacagcuugggcucugacaaua

SEQ ID NO: 622009 - RNA, 22 nt, Human
ucuagcaccacauuaaauagca

SEQ ID NO: 622010 - RNA, 22 nt, Human
gaggagaagcuaagaaacacag

SEQ ID NO: 622011 - RNA, 22 nt, Human
aguguccccucugaggagugag

SEQ ID NO: 622012 - RNA, 20 nt, Human
gacuuuacaucagcacucuu

SEQ ID NO: 622013 - RNA, 22 nt, Human
aaccagcuccagccuccauuca

SEQ ID NO: 622014 - RNA, 22 nt, Human
ugggagcugggguuggacgucu

SEQ ID NO: 622015 - RNA, 22 nt, Human
cccugugguugcuagggcacag

SEQ ID NO: 622016 - RNA, 22 nt, Human
caggccaacugcauggugacca

SEQ ID NO: 622017 - RNA, 22 nt, Human
cagggcaaagagagcacaugcu

SEQ ID NO: 622018 - RNA, 22 nt, Human
caguggccaugguggcaggggu

SEQ ID NO: 622019 - RNA, 22 nt, Human
ucauagcuaagcuccagagugc

SEQ ID NO: 622020 - RNA, 22 nt, Human
gauucaaaaauaagcuccuauu

SEQ ID NO: 622021 - RNA, 22 nt, Human
uagguaguuuccuguuguuggg

SEQ ID NO: 622022 - RNA, 21 nt, Human
ucccugcuuucuggcccaguc

SEQ ID NO: 622023 - RNA, 22 nt, Human
gagcugaagcgcuacagcaucc

SEQ ID NO: 622024 - RNA, 22 nt, Human
accuuauucuugcccuuagaug

SEQ ID NO: 622025 - RNA, 22 nt, Human
ccugcucugccaaguccucuuu

SEQ ID NO: 622026 - RNA, 22 nt, Human
ccaggagcgggaaaaggaagaa

SEQ ID NO: 622027 - RNA, 22 nt, Human
agggccuggaacugugggcagg

SEQ ID NO: 622028 - RNA, 22 nt, Human
acuacacagggaugugacuacc

SEQ ID NO: 622029 - RNA, 22 nt, Human
ucacaaugaaaaacacuacaua

SEQ ID NO: 622030 - RNA, 22 nt, Human
aagcaacagaaacauucuaaua

SEQ ID NO: 622031 - RNA, 22 nt, Human
cagcccugcuggcaaugaugag

SEQ ID NO: 622032 - RNA, 22 nt, Human
gggucagggaggccccaccaug

SEQ ID NO: 622033 - RNA, 22 nt, Human
gggcugagugaccucaggccaa

SEQ ID NO: 622034 - RNA, 22 nt, Human
cagagcauuaaaaccagcucug

SEQ ID NO: 622035 - RNA, 22 nt, Human
uccagcagcccgaaggcccauc

SEQ ID NO: 622036 - RNA, 22 nt, Human
caugggaggccugcugcuggug

SEQ ID NO: 622037 - RNA, 22 nt, Human
guguaaaucagcuuguguaaua

SEQ ID NO: 622038 - RNA, 22 nt, Human
ggauccaguccagggcugugug

SEQ ID NO: 622039 - RNA, 22 nt, Human
uacuucaaccuucucuauuaga

SEQ ID NO: 622040 - RNA, 20 nt, Human
uccuuuggccuuagagcugu

SEQ ID NO: 622041 - RNA, 22 nt, Human
aucagcaucggguggugguggg

SEQ ID NO: 622042 - RNA, 22 nt, Human
agggcagaccacgugcaaggau

SEQ ID NO: 622043 - RNA, 22 nt, Human
ugauuacauugguaauguuuau

SEQ ID NO: 622044 - RNA, 22 nt, Human
aacuuuggccacaaguacccug

SEQ ID NO: 622045 - RNA, 22 nt, Human
ggcugcugguggaaugguaggc

SEQ ID NO: 622046 - RNA, 22 nt, Human
ucaguguuggucaagaaucagu

SEQ ID NO: 622047 - RNA, 22 nt, Human
uccauuuuagagaugaagaaac

SEQ ID NO: 622048 - RNA, 22 nt, Human
aggaacuagugcaacaggagcg

SEQ ID NO: 622049 - RNA, 22 nt, Human
gggaaggcaggauucucuggug

SEQ ID NO: 622050 - RNA, 22 nt, Human
aagcauggcuguucuagcuaua

SEQ ID NO: 622051 - RNA, 22 nt, Human
aggacucaucccugcuugucag

SEQ ID NO: 622052 - RNA, 22 nt, Human
ucaggauaaaauguaauggcaa

SEQ ID NO: 622053 - RNA, 22 nt, Human
uacaaacuguuauuauuauugu

SEQ ID NO: 622054 - RNA, 22 nt, Human
caacuauauagaaauugauugu

SEQ ID NO: 622055 - RNA, 22 nt, Human
guggcaggagagacacagccau

SEQ ID NO: 622056 - RNA, 22 nt, Human
ccugugcuggcuuuauucucag

SEQ ID NO: 622057 - RNA, 21 nt, Human
uacaagaccggauucgggccc

SEQ ID NO: 622058 - RNA, 22 nt, Human
agugacugguuuugacaggaau

SEQ ID NO: 622059 - RNA, 22 nt, Human
aguggagaauaugcagaaagcc

SEQ ID NO: 622060 - RNA, 21 nt, Human
guuuucuuugauagagggaag

SEQ ID NO: 622061 - RNA, 23 nt, Human
uuuauuuauuuaggcugagggau

SEQ ID NO: 622062 - RNA, 22 nt, Human
cugacucccugauucuggguuu

SEQ ID NO: 622063 - RNA, 22 nt, Human
agaaccucaauuauuuuugcac

SEQ ID NO: 622064 - RNA, 22 nt, Human
auuuuagagaaacaaacguagg

SEQ ID NO: 622065 - RNA, 22 nt, Human
gcugcuucuccucccuggggau

SEQ ID NO: 622066 - RNA, 22 nt, Human
auucaaauuaaguuaauucagc

SEQ ID NO: 622067 - RNA, 22 nt, Human
ggcugccuuuagaacggaugcu

SEQ ID NO: 622068 - RNA, 22 nt, Human
cagggcugcuggccgugcccuc

SEQ ID NO: 622069 - RNA, 19 nt, Human
gugagcuucuuguaagagg

SEQ ID NO: 622070 - RNA, 18 nt, Human
gucugccuucucccuucc

SEQ ID NO: 622071 - RNA, 22 nt, Human
uccaggccgcauaguuacucug

SEQ ID NO: 622072 - RNA, 22 nt, Human
ugccugggacaugcuguggacu

SEQ ID NO: 622073 - RNA, 22 nt, Human
uuaacaugucuugacuucaucu

SEQ ID NO: 622074 - RNA, 22 nt, Human
ugaugggaggugcugcaggacc

SEQ ID NO: 622075 - RNA, 22 nt, Human
ccaggauggggagcagauagaa

SEQ ID NO: 622076 - RNA, 22 nt, Human
uagcccugcugugaugugaagu

SEQ ID NO: 622077 - RNA, 22 nt, Human
aagaaaugugaauauugaauag

SEQ ID NO: 622078 - RNA, 22 nt, Human
ggagauggcucugcaaggucua

SEQ ID NO: 622079 - RNA, 22 nt, Human
agggcugaguggugcagucaaa

SEQ ID NO: 622080 - RNA, 22 nt, Human
gggcuggacugcauugccucgc

SEQ ID NO: 622081 - RNA, 22 nt, Human
uggcucuuucugucugggaucc

SEQ ID NO: 622082 - RNA, 22 nt, Human
cacugucacguucugaaacugu

SEQ ID NO: 622083 - RNA, 22 nt, Human
uauuuagcuggagucagugcuu

SEQ ID NO: 622084 - RNA, 22 nt, Human
aauucacauauacauuauuccu

SEQ ID NO: 622085 - RNA, 22 nt, Human
ccuuagcuggagugguggaaug

SEQ ID NO: 622086 - RNA, 23 nt, Human
acagaugaaaguguggcucagag

SEQ ID NO: 622087 - RNA, 22 nt, Human
uguaguagcauucacgaagugu

SEQ ID NO: 622088 - RNA, 22 nt, Human
gaggacacaaaguggcugagau

SEQ ID NO: 622089 - RNA, 19 nt, Human
ucucugugucucuguuuau

SEQ ID NO: 622090 - RNA, 22 nt, Human
gcucagagcacucagacucagc

SEQ ID NO: 622091 - RNA, 22 nt, Human
acuuccagauggccccaucuaa

SEQ ID NO: 622092 - RNA, 19 nt, Human
caacaguacugguuugucc

SEQ ID NO: 622093 - RNA, 21 nt, Human
aggaaaggccagcacguaggg

SEQ ID NO: 622094 - RNA, 21 nt, Human
agcucagcaagauggaggcuc

SEQ ID NO: 622095 - RNA, 21 nt, Human
cucugcugaguccuaggauuc

SEQ ID NO: 622096 - RNA, 21 nt, Human
gccuugccgugaaagcccuuu

SEQ ID NO: 622097 - RNA, 22 nt, Human
acagccagugacuggacaagcu

SEQ ID NO: 622098 - RNA, 20 nt, Human
ugcagguguguccaagcacu

SEQ ID NO: 622099 - RNA, 22 nt, Human
gcuggcucagggacuagaguuu

SEQ ID NO: 622100 - RNA, 22 nt, Human
accaugcaucaaagcuaauaua

SEQ ID NO: 622101 - RNA, 22 nt, Human
gggcaugguggcaggcaccugu

SEQ ID NO: 622102 - RNA, 22 nt, Human
uccucuucugccuauaucugcc

SEQ ID NO: 622103 - RNA, 22 nt, Human
ugugucuaggcucaugcuugcu

SEQ ID NO: 622104 - RNA, 22 nt, Human
aagacaggaaaagcuccaggcc

SEQ ID NO: 622105 - RNA, 22 nt, Human
guuacaacucccugaaccucgg

SEQ ID NO: 622106 - RNA, 22 nt, Human
aucugacaucuacuagaacaga

SEQ ID NO: 622107 - RNA, 22 nt, Human
gagcaggccagcaauggaaggg

SEQ ID NO: 622108 - RNA, 22 nt, Human
ugcugccacugguagucucauu

SEQ ID NO: 622109 - RNA, 22 nt, Human
cuccuuccugguuagcaccuua

SEQ ID NO: 622110 - RNA, 22 nt, Human
ccuccagggccccucucacugg

SEQ ID NO: 622111 - RNA, 22 nt, Human
ucugggguggagcccuggaguc

SEQ ID NO: 622112 - RNA, 22 nt, Human
aagauuugguaucagaagaccu

SEQ ID NO: 622113 - RNA, 22 nt, Human
gcugcccacaaccccgugucua

SEQ ID NO: 622114 - RNA, 22 nt, Human
agccuggauucgugcauccaca

SEQ ID NO: 622115 - RNA, 22 nt, Human
ucaguguuggagauaauugcac

SEQ ID NO: 622116 - RNA, 22 nt, Human
ggcugggaggccgugcugaccu

SEQ ID NO: 622117 - RNA, 22 nt, Human
ugaggggccgcccaagcacuuc

SEQ ID NO: 622118 - RNA, 22 nt, Human
agggcucaggggccccaagcug

SEQ ID NO: 622119 - RNA, 22 nt, Human
uuagaaacccagacucuuaggu

SEQ ID NO: 622120 - RNA, 22 nt, Human
cacccagccuucacacaggagu

SEQ ID NO: 622121 - RNA, 16 nt, Human
gcagaggaaaggggag

SEQ ID NO: 622122 - RNA, 22 nt, Human
uggaucugguucccugagccuu

SEQ ID NO: 622123 - RNA, 22 nt, Human
aggcgugguugaggcgagcaua

SEQ ID NO: 622124 - RNA, 22 nt, Human
gccaggaccucccagagcuuuc

SEQ ID NO: 622125 - RNA, 22 nt, Human
acugcaacaccuccuggguuca

SEQ ID NO: 622126 - RNA, 22 nt, Human
ugucaugggcauuuauugaggg

SEQ ID NO: 622127 - RNA, 22 nt, Human
uugcagagcaguaggaauauag

SEQ ID NO: 622128 - RNA, 22 nt, Human
uguuucaugaaacauguuuagg

SEQ ID NO: 622129 - RNA, 22 nt, Human
gaggaaaagagacagguuauug

SEQ ID NO: 622130 - RNA, 22 nt, Human
gugaacaucagauuacaugaga

SEQ ID NO: 622131 - RNA, 22 nt, Human
uuccuucuuccaaacccaucau

SEQ ID NO: 622132 - RNA, 21 nt, Human
ucagggcagcugcucuucaga

SEQ ID NO: 622133 - RNA, 21 nt, Human
gcuuucagaagucucauaguu

SEQ ID NO: 622134 - RNA, 22 nt, Human
caucuuuauuuauauagacagg

SEQ ID NO: 622135 - RNA, 22 nt, Human
acuguagagaaucugagaaaaa

SEQ ID NO: 622136 - RNA, 22 nt, Human
ggagaaggugcuggucacugug

SEQ ID NO: 622137 - RNA, 22 nt, Human
gauauacauagguuucuaugca

SEQ ID NO: 622138 - RNA, 22 nt, Human
aggggcuccaaggaaguuuggg

SEQ ID NO: 622139 - RNA, 22 nt, Human
cagguacaaagcuacugccuga

SEQ ID NO: 622140 - RNA, 22 nt, Human
gcagcugaagcugcaguuccag

SEQ ID NO: 622141 - RNA, 22 nt, Human
cuggcuuccaccauggccccug

SEQ ID NO: 622142 - RNA, 22 nt, Human
aguuacugcuuucaggaaguuu

SEQ ID NO: 622143 - RNA, 17 nt, Human
cugauggauuuuuucca

SEQ ID NO: 622144 - RNA, 22 nt, Human
agcuggaaagaagguggcagcc

SEQ ID NO: 622145 - RNA, 22 nt, Human
aauagcuugccuaauccucaug

SEQ ID NO: 622146 - RNA, 22 nt, Human
gcaccugauugauuucacugcu

SEQ ID NO: 622147 - RNA, 22 nt, Human
ucucaggaagauuagggcuaag

SEQ ID NO: 622148 - RNA, 22 nt, Human
uuuagcauuccugggaugauuu

SEQ ID NO: 622149 - RNA, 22 nt, Human
gcuucauuugagaaccucugug

SEQ ID NO: 622150 - RNA, 22 nt, Human
ggaggccaucagggagggcauu

SEQ ID NO: 622151 - RNA, 22 nt, Human
ggagucugauuuuuuaugggug

SEQ ID NO: 622152 - RNA, 22 nt, Human
uuggggaagcuuugaaauacuu

SEQ ID NO: 622153 - RNA, 20 nt, Human
uccagcccugcuucucucuu

SEQ ID NO: 622154 - RNA, 22 nt, Human
ucuguguugagaaggaucauga

SEQ ID NO: 622155 - RNA, 23 nt, Human
cugaccugacccauaagcaagga

SEQ ID NO: 622156 - RNA, 22 nt, Human
cagcaccauuuuccuggucagc

SEQ ID NO: 622157 - RNA, 22 nt, Human
ugguccaggguguaguacagag

SEQ ID NO: 622158 - RNA, 22 nt, Human
acagcagguuauuguuauggca

SEQ ID NO: 622159 - RNA, 19 nt, Human
uggaccugugcccauggcu

SEQ ID NO: 622160 - RNA, 22 nt, Human
acaugcacacgauucagucugg

SEQ ID NO: 622161 - RNA, 22 nt, Human
ugcauauucuccuuuauuuugu

SEQ ID NO: 622162 - RNA, 22 nt, Human
cuggaauggguuucaggcacug

SEQ ID NO: 622163 - RNA, 22 nt, Human
uacauagaacauguuuaauguc

SEQ ID NO: 622164 - RNA, 22 nt, Human
acuuuguauaagacaauaaaga

SEQ ID NO: 622165 - RNA, 19 nt, Human
ugagcaugcgagcugagaa

SEQ ID NO: 622166 - RNA, 22 nt, Human
gagaucucuagcacuuccugua

SEQ ID NO: 622167 - RNA, 22 nt, Human
uucuccugcccuuggacuucca

SEQ ID NO: 622168 - RNA, 22 nt, Human
uggcugugggaugagagccuca

SEQ ID NO: 622169 - RNA, 22 nt, Human
aagggcagaaagggacgcuuug

SEQ ID NO: 622170 - RNA, 22 nt, Human
gccucugcaauuacauugugcc

SEQ ID NO: 622171 - RNA, 22 nt, Human
guucuccuuguggcugcagcag

SEQ ID NO: 622172 - RNA, 22 nt, Human
aaggcagaaauucaacuacugg

SEQ ID NO: 622173 - RNA, 22 nt, Human
uaagaauagucccuagaugugu

SEQ ID NO: 622174 - RNA, 22 nt, Human
cagagcagguaucuuuggugaa

SEQ ID NO: 622175 - RNA, 22 nt, Human
gugggcagguaggcaccagcua

SEQ ID NO: 622176 - RNA, 22 nt, Human
ccagugacuggcuuucuggugu

SEQ ID NO: 622177 - RNA, 22 nt, Human
ggcuucuuuuuaguaaauguca

SEQ ID NO: 622178 - RNA, 22 nt, Human
uuacagaacugucuugaaauuu

SEQ ID NO: 622179 - RNA, 22 nt, Human
ucucagugguguuuugagucca

SEQ ID NO: 622180 - RNA, 22 nt, Human
guaaacaucgacccaacagggg

SEQ ID NO: 622181 - RNA, 22 nt, Human
aagcagcugauuucacagcuca

SEQ ID NO: 622182 - RNA, 22 nt, Human
ugccuggcacuccuggagcuca

SEQ ID NO: 622183 - RNA, 22 nt, Human
cagugaaguucuacugaauggu

SEQ ID NO: 622184 - RNA, 22 nt, Human
cugcagggacccaagucuuugg

SEQ ID NO: 622185 - RNA, 22 nt, Human
uauucuuguaccuuaaaugauu

SEQ ID NO: 622186 - RNA, 22 nt, Human
agcugaggcaugaugcuaucag

SEQ ID NO: 622187 - RNA, 22 nt, Human
gcauggaucuaagaggucaagg

SEQ ID NO: 622188 - RNA, 22 nt, Human
cuggcuggguuccaggauucca

SEQ ID NO: 622189 - RNA, 22 nt, Human
ucuccugguacccuuccuagca

SEQ ID NO: 622190 - RNA, 22 nt, Human
aauugguuugaguugucucuau

SEQ ID NO: 622191 - RNA, 22 nt, Human
cuuuggcagccucagcugcagg

SEQ ID NO: 622192 - RNA, 22 nt, Human
gucacuuucacacuuuauugcu

SEQ ID NO: 622193 - RNA, 22 nt, Human
agcugccccaugagaggcaggu

SEQ ID NO: 622194 - RNA, 22 nt, Human
cagcugccagcuucucuccauc

SEQ ID NO: 622195 - RNA, 22 nt, Human
gcaggggaguggaugauggauu

SEQ ID NO: 622196 - RNA, 22 nt, Human
cuggcccuguggaggcaggaac

SEQ ID NO: 622197 - RNA, 22 nt, Human
aggcucugugauccacaaugag

SEQ ID NO: 622198 - RNA, 22 nt, Human
uggucuuagcuggaaggaggga

SEQ ID NO: 622199 - RNA, 22 nt, Human
ccacuggcugucagcaggacuc

SEQ ID NO: 622200 - RNA, 22 nt, Human
caguuuagaagaaucaugaaca

SEQ ID NO: 622201 - RNA, 22 nt, Human
uucaaacucuugcucugcuagu

SEQ ID NO: 622202 - RNA, 22 nt, Human
aacacuuuuuccuccugucugg

SEQ ID NO: 622203 - RNA, 19 nt, Human
uaacaagcacucugcauuc

SEQ ID NO: 622204 - RNA, 22 nt, Human
gcagugcuuuagucuguccuuu

SEQ ID NO: 622205 - RNA, 22 nt, Human
caggagacucagcauccaggau

SEQ ID NO: 622206 - RNA, 22 nt, Human
ggccucugaggacagccuuggc

SEQ ID NO: 622207 - RNA, 22 nt, Human
ccagagggaagaggaagcgcug

SEQ ID NO: 622208 - RNA, 22 nt, Human
ggcccagcucuauugaauuaca

SEQ ID NO: 622209 - RNA, 22 nt, Human
uccugccacugcacauauacuu

SEQ ID NO: 622210 - RNA, 22 nt, Human
auuuuagagcuccaaguacagc

SEQ ID NO: 622211 - RNA, 22 nt, Human
ucuaccacuuauuagcucugug

SEQ ID NO: 622212 - RNA, 22 nt, Human
gagcuguccaagauggucguaa

SEQ ID NO: 622213 - RNA, 19 nt, Human
acuuucuccaggaccuguu

SEQ ID NO: 622214 - RNA, 22 nt, Human
agcugcucccuauccuuuccuu

SEQ ID NO: 622215 - RNA, 23 nt, Human
uggcuucaacucugucggcagcc

SEQ ID NO: 622216 - RNA, 22 nt, Human
gccaacaggccuugcucugcuc

SEQ ID NO: 622217 - RNA, 22 nt, Human
uaggaacaaguuuccuugcugu

SEQ ID NO: 622218 - RNA, 22 nt, Human
agagaaaacucauugagguguc

SEQ ID NO: 622219 - RNA, 22 nt, Human
cuuccugggucagccuggaggu

SEQ ID NO: 622220 - RNA, 22 nt, Human
uuuauaccucauucuuagcaaa

SEQ ID NO: 622221 - RNA, 22 nt, Human
aaaccacuuauaucgugauuug

SEQ ID NO: 622222 - RNA, 22 nt, Human
auuugucaauaagaugaacaua

SEQ ID NO: 622223 - RNA, 22 nt, Human
ggaagacagaagccuacagcuu

SEQ ID NO: 622224 - RNA, 22 nt, Human
uguaggaagauauaaaauaucu

SEQ ID NO: 622225 - RNA, 22 nt, Human
ccaguccagugccaugcauggc

SEQ ID NO: 622226 - RNA, 22 nt, Human
gugaaggauuggagggcaucuu

SEQ ID NO: 622227 - RNA, 22 nt, Human
ugcagcagaaguguucuucucu

SEQ ID NO: 622228 - RNA, 22 nt, Human
uagcuauuuugcuuggaaauac

SEQ ID NO: 622229 - RNA, 22 nt, Human
agggcuccuccccggccuccac

SEQ ID NO: 622230 - RNA, 22 nt, Human
aaugaacccuucaagcucugau

SEQ ID NO: 622231 - RNA, 22 nt, Human
ccaguguugaacaguauuugga

SEQ ID NO: 622232 - RNA, 22 nt, Human
ucugaggucauaaagcaacuuu

SEQ ID NO: 622233 - RNA, 22 nt, Human
ucucugucuuuguugucuucac

SEQ ID NO: 622234 - RNA, 20 nt, Human
ggcagaugcagagcuaugca

SEQ ID NO: 622235 - RNA, 22 nt, Human
augaggcauucacagaaggcac

SEQ ID NO: 622236 - RNA, 22 nt, Human
uauuuguauguguguacauaua

SEQ ID NO: 622237 - RNA, 22 nt, Human
ugagaggccccagcucuuggcc

SEQ ID NO: 622238 - RNA, 22 nt, Human
uauuuaucaagguaggagaaua

SEQ ID NO: 622239 - RNA, 22 nt, Human
gaacuuuaauuagcuuuugucu

SEQ ID NO: 622240 - RNA, 22 nt, Human
ucucuggcacauaauaaggucu

SEQ ID NO: 622241 - RNA, 22 nt, Human
ucuuauuuagagaggacuagag

SEQ ID NO: 622242 - RNA, 22 nt, Human
uccagcagggaauuaguagucu

SEQ ID NO: 622243 - RNA, 22 nt, Human
gaggagacaguggagccgcuac

SEQ ID NO: 622244 - RNA, 22 nt, Human
cucaucugucugggcugguuuu

SEQ ID NO: 622245 - RNA, 22 nt, Human
acccuccaggcugcagcuccug

SEQ ID NO: 622246 - RNA, 22 nt, Human
uuuuauuggagugauaccaagc

SEQ ID NO: 622247 - RNA, 22 nt, Human
gggcccugugauuucuugagga

SEQ ID NO: 622248 - RNA, 22 nt, Human
ugggcagcagaaccaggccgac

SEQ ID NO: 622249 - RNA, 22 nt, Human
caucaaagcuuuuuucuguguu

SEQ ID NO: 622250 - RNA, 22 nt, Human
uccaggcccagacggggugagg

SEQ ID NO: 622251 - RNA, 22 nt, Human
ucacauguauaugcagcacagc

SEQ ID NO: 622252 - RNA, 19 nt, Human
cacuucaauccuuuaucaa

SEQ ID NO: 622253 - RNA, 22 nt, Human
aagucccugguuccuagcaaaa

SEQ ID NO: 622254 - RNA, 22 nt, Human
ugcagaaggaggaggaaaucca

SEQ ID NO: 622255 - RNA, 22 nt, Human
uucaugaagggugaauauaguc

SEQ ID NO: 622256 - RNA, 22 nt, Human
gaggcaugcagagcuggagcag

SEQ ID NO: 622257 - RNA, 22 nt, Human
ucucagggcgcagugaggcagu

SEQ ID NO: 622258 - RNA, 22 nt, Human
ucagggcuggcuuuugcagagc

SEQ ID NO: 622259 - RNA, 22 nt, Human
gcccuugggagguuccacuggg

SEQ ID NO: 622260 - RNA, 22 nt, Human
agccagaggucaugagcacagg

SEQ ID NO: 622261 - RNA, 22 nt, Human
auguacaucuuuauaacaagcu

SEQ ID NO: 622262 - RNA, 18 nt, Human
gggcagcacagcagccuc

SEQ ID NO: 622263 - RNA, 22 nt, Human
aggaaggguucuuugugaaaga

SEQ ID NO: 622264 - RNA, 22 nt, Human
agaaguaucaggaagauucuca

SEQ ID NO: 622265 - RNA, 22 nt, Human
ucucuuauuuugccuuugacaa

SEQ ID NO: 622266 - RNA, 22 nt, Human
gcuggcugggucccugagaggc

SEQ ID NO: 622267 - RNA, 22 nt, Human
acauguuugauaaauauuuggg

SEQ ID NO: 622268 - RNA, 21 nt, Human
ucagaguguguuacagcaagc

SEQ ID NO: 622269 - RNA, 22 nt, Human
augggccaaguaaacauucuca

SEQ ID NO: 622270 - RNA, 22 nt, Human
ggccugugagccuuaguuuaua

SEQ ID NO: 622271 - RNA, 22 nt, Human
gccaggcaaauuaaggaaugca

SEQ ID NO: 622272 - RNA, 22 nt, Human
uacaucauggcuucaugcugca

SEQ ID NO: 622273 - RNA, 22 nt, Human
cugaaaggaauaaggcucuuug

SEQ ID NO: 622274 - RNA, 22 nt, Human
agucacugucuugcaaagguca

SEQ ID NO: 622275 - RNA, 22 nt, Human
gaaugaacaaggauguucaucc

SEQ ID NO: 622276 - RNA, 22 nt, Human
caaagguaaagaucugcugugg

SEQ ID NO: 622277 - RNA, 22 nt, Human
gacauuuauuggauuuuacgag

SEQ ID NO: 622278 - RNA, 22 nt, Human
aacuugguaccaccuucugaag

SEQ ID NO: 622279 - RNA, 22 nt, Human
aaacacuagcaggaagcacuga

SEQ ID NO: 622280 - RNA, 22 nt, Human
uggcaagcucguuugggucaga

SEQ ID NO: 622281 - RNA, 22 nt, Human
agcuuucuaguuuagccaucuu

SEQ ID NO: 622282 - RNA, 22 nt, Human
cuggcucuuuccuagcuaggcu

SEQ ID NO: 622283 - RNA, 22 nt, Human
ucuaguguuuuggaacauggaa

SEQ ID NO: 622284 - RNA, 22 nt, Human
auucugaggacagagucuagca

SEQ ID NO: 622285 - RNA, 22 nt, Human
caagggcucuaagucacaagau

SEQ ID NO: 622286 - RNA, 22 nt, Human
aggcgcagcacgugagaguugg

SEQ ID NO: 622287 - RNA, 22 nt, Human
ccucuuugacaaguaccugccc

SEQ ID NO: 622288 - RNA, 20 nt, Human
aggcuucaaccauacaccuu

SEQ ID NO: 622289 - RNA, 22 nt, Human
uuugcauuguaauauuuaguuc

SEQ ID NO: 622290 - RNA, 22 nt, Human
cagaggcauuacugaaaaggug

SEQ ID NO: 622291 - RNA, 22 nt, Human
cugagcagcacagggcgccagg

SEQ ID NO: 622292 - RNA, 22 nt, Human
gccuggagacagcagaggcggc

SEQ ID NO: 622293 - RNA, 22 nt, Human
aaaauacuguggaguguugaaa

SEQ ID NO: 622294 - RNA, 22 nt, Human
aggcccugaccugggagaucua

SEQ ID NO: 622295 - RNA, 15 nt, Human
ugauuuccuacuaac

SEQ ID NO: 622296 - RNA, 23 nt, Human
auccuauauaaccuuggaggcug

SEQ ID NO: 622297 - RNA, 22 nt, Human
cucaaauauaagcuaaaugugg

SEQ ID NO: 622298 - RNA, 22 nt, Human
acacauuaaaacgucuacaaug

SEQ ID NO: 622299 - RNA, 22 nt, Human
uuugcauaagucauguccagug

SEQ ID NO: 622300 - RNA, 22 nt, Human
uguuucuugggugcucacauca

SEQ ID NO: 622301 - RNA, 22 nt, Human
agggcagagacaugcuuccuga

SEQ ID NO: 622302 - RNA, 22 nt, Human
aaagacaguggauucaaaaucc

SEQ ID NO: 622303 - RNA, 22 nt, Human
uucaccagauuuuguauaguca

SEQ ID NO: 622304 - RNA, 22 nt, Human
gauggugucccaggcucaggcu

SEQ ID NO: 622305 - RNA, 22 nt, Human
aagaggcuucagauccuucaga

SEQ ID NO: 622306 - RNA, 22 nt, Human
ucuggcucugaauucacuucug

SEQ ID NO: 622307 - RNA, 22 nt, Human
uacauugacucucugucccuaa

SEQ ID NO: 622308 - RNA, 22 nt, Human
cugucuguguggacacggcugc

SEQ ID NO: 622309 - RNA, 22 nt, Human
uccuggacagauccccaucauc

SEQ ID NO: 622310 - RNA, 22 nt, Human
auuuacauuuauuugagaaggu

SEQ ID NO: 622311 - RNA, 22 nt, Human
uaccuuugaucuggaauuuuaa

SEQ ID NO: 622312 - RNA, 23 nt, Human
ccuccugggcacaggccugaugg

SEQ ID NO: 622313 - RNA, 22 nt, Human
ucuauucaggcagagugcagca

SEQ ID NO: 622314 - RNA, 22 nt, Human
ugcugggugguugcuccucccg

SEQ ID NO: 622315 - RNA, 22 nt, Human
gcaguaucuaugugauggguug

SEQ ID NO: 622316 - RNA, 22 nt, Human
ggcaucuccaaaacaugaacuc

SEQ ID NO: 622317 - RNA, 22 nt, Human
cuauuuuaagaggccauuaggu

SEQ ID NO: 622318 - RNA, 22 nt, Human
auauggaacuauucuguguaga

SEQ ID NO: 622319 - RNA, 22 nt, Human
uccacaguuuugccacuagcug

SEQ ID NO: 622320 - RNA, 21 nt, Human
aguuuuccauuagggagggag

SEQ ID NO: 622321 - RNA, 22 nt, Human
auccucagcaucuagcaugaag

SEQ ID NO: 622322 - RNA, 22 nt, Human
ugucacauccauuuugcaagua

SEQ ID NO: 622323 - RNA, 22 nt, Human
acagcucuguguauugucaucu

SEQ ID NO: 622324 - RNA, 22 nt, Human
ugaaggcugggcucagccagcu

SEQ ID NO: 622325 - RNA, 22 nt, Human
acugggcaaggauaugaugggu

SEQ ID NO: 622326 - RNA, 22 nt, Human
ggaccaggcaagcugaggcggg

SEQ ID NO: 622327 - RNA, 22 nt, Human
uuauucacucauuuaacauuau

SEQ ID NO: 622328 - RNA, 22 nt, Human
gugucauguagaaauugaugaa

SEQ ID NO: 622329 - RNA, 22 nt, Human
ucacuguaucauguugcacuua

SEQ ID NO: 622330 - RNA, 22 nt, Human
cuggcucugggccucagacacu

SEQ ID NO: 622331 - RNA, 22 nt, Human
cauaauccauuugcacugcaga

SEQ ID NO: 622332 - RNA, 22 nt, Human
auaaaguuuaaaagucaauagu

SEQ ID NO: 622333 - RNA, 22 nt, Human
acccagugacauccuuuaccug

SEQ ID NO: 622334 - RNA, 22 nt, Human
cagcugaauggcucccugcuaa

SEQ ID NO: 622335 - RNA, 22 nt, Human
uggcagcucuguucaacaugag

SEQ ID NO: 622336 - RNA, 22 nt, Human
uuaaaggcgauaaggcaguguu

SEQ ID NO: 622337 - RNA, 21 nt, Human
ccugccaggaaacugaguguc

SEQ ID NO: 622338 - RNA, 22 nt, Human
cuggaggaccacagaagcuggu

SEQ ID NO: 622339 - RNA, 22 nt, Human
ugaagaggccaaacuaucauug

SEQ ID NO: 622340 - RNA, 22 nt, Human
gugagagccugucuggaugucg

SEQ ID NO: 622341 - RNA, 22 nt, Human
ugcauccuuaaccagcaucacu

SEQ ID NO: 622342 - RNA, 22 nt, Human
caauuucacuaauaauauuuac

SEQ ID NO: 622343 - RNA, 22 nt, Human
agaaagacgugaugaagaagua

SEQ ID NO: 622344 - RNA, 22 nt, Human
acauagaaccuggcacauagua

SEQ ID NO: 622345 - RNA, 22 nt, Human
uacuuacacugaagcaaagaua

SEQ ID NO: 622346 - RNA, 22 nt, Human
acuauacauugaauguuaaggu

SEQ ID NO: 622347 - RNA, 22 nt, Human
gaggaggaaaggaguugaaaug

SEQ ID NO: 622348 - RNA, 22 nt, Human
ccugagauuuguaauuuuugua

SEQ ID NO: 622349 - RNA, 22 nt, Human
agcuucuggaaggcaaggcuug

SEQ ID NO: 622350 - RNA, 22 nt, Human
agucucugucguagaucagcgu

SEQ ID NO: 622351 - RNA, 22 nt, Human
uggcugcuuaaaauugcugcaa

SEQ ID NO: 622352 - RNA, 22 nt, Human
cacacagcucaggggcacugcc

SEQ ID NO: 622353 - RNA, 22 nt, Human
augggcugaaagaguaagcugu

SEQ ID NO: 622354 - RNA, 22 nt, Human
ugcauuugcuggggaugugauu

SEQ ID NO: 622355 - RNA, 22 nt, Human
cagaagaauggugucugagcuc

SEQ ID NO: 622356 - RNA, 22 nt, Human
ucaggaacuucuaggaaagcug

SEQ ID NO: 622357 - RNA, 23 nt, Human
ccugugucuguugcugaauaaug

SEQ ID NO: 622358 - RNA, 22 nt, Human
aacauucugucaauugaugacc

SEQ ID NO: 622359 - RNA, 22 nt, Human
ucuaauccuugcuaccugggug

SEQ ID NO: 622360 - RNA, 22 nt, Human
aguuagaauauaauuauguuaa

SEQ ID NO: 622361 - RNA, 22 nt, Human
gaccuuccaugccuucuuccaa

SEQ ID NO: 622362 - RNA, 22 nt, Human
uuucugcaacgagucuuugacu

SEQ ID NO: 622363 - RNA, 22 nt, Human
aaacuagagcaugugaguggga

SEQ ID NO: 622364 - RNA, 22 nt, Human
ugucccuaaagaaacagacauu

SEQ ID NO: 622365 - RNA, 22 nt, Human
uuucuaagcuuaguaugaggca

SEQ ID NO: 622366 - RNA, 22 nt, Human
auuugccuuucgaaucaacagg

SEQ ID NO: 622367 - RNA, 20 nt, Human
ucuguuauuauuacauugcc

SEQ ID NO: 622368 - RNA, 22 nt, Human
gagaggugaaauaguuguccgg

SEQ ID NO: 622369 - RNA, 22 nt, Human
ggaagggaaaauucauucggcu

SEQ ID NO: 622370 - RNA, 22 nt, Human
acuguauagauggaguugauuu

SEQ ID NO: 622371 - RNA, 22 nt, Human
ggcaaaaacagcaaugacuuuu

SEQ ID NO: 622372 - RNA, 22 nt, Human
ucacaggcuaaauuuaugcagg

SEQ ID NO: 622373 - RNA, 22 nt, Human
aucacuuugguaccaauucagc

SEQ ID NO: 622374 - RNA, 22 nt, Human
ugugccuucccucugcugauuu

SEQ ID NO: 622375 - RNA, 22 nt, Human
aaucuuucauucauucauacau

SEQ ID NO: 622376 - RNA, 22 nt, Human
ccagcuccaggacugggagcug

SEQ ID NO: 622377 - RNA, 22 nt, Human
auucaugaaucuacauuguggu

SEQ ID NO: 622378 - RNA, 22 nt, Human
agaaaucuaagaugcucaagga

SEQ ID NO: 622379 - RNA, 22 nt, Human
auguccagaguaaagcacauuc

SEQ ID NO: 622380 - RNA, 22 nt, Human
cauucacauucuucuuacuguu

SEQ ID NO: 622381 - RNA, 22 nt, Human
gcauggccaggaaagguagaaa

SEQ ID NO: 622382 - RNA, 22 nt, Human
guuuaucugcacucucuuguag

SEQ ID NO: 622383 - RNA, 22 nt, Human
cuacuuccagggguggggcuca

SEQ ID NO: 622384 - RNA, 22 nt, Human
ucugucugacaggguaugaacu

SEQ ID NO: 622385 - RNA, 22 nt, Human
aggucugagcucagggccuggc

SEQ ID NO: 622386 - RNA, 22 nt, Human
ucuuacaagaaauaagccaaug

SEQ ID NO: 622387 - RNA, 22 nt, Human
ugcaaaaaggcagacuggugau

SEQ ID NO: 622388 - RNA, 22 nt, Human
ugcuccugauaucuaaugugua

SEQ ID NO: 622389 - RNA, 22 nt, Human
uuccugugugaccgagacagug

SEQ ID NO: 622390 - RNA, 22 nt, Human
uucuucucagggucccacaugg

SEQ ID NO: 622391 - RNA, 22 nt, Human
uucuucuucauuucugacgaug

SEQ ID NO: 622392 - RNA, 22 nt, Human
agaggcacagaggcaguccccu

SEQ ID NO: 622393 - RNA, 22 nt, Human
agggcucuguuggggucagcac

SEQ ID NO: 622394 - RNA, 22 nt, Human
aguguauucagaauguagcaaa

SEQ ID NO: 622395 - RNA, 22 nt, Human
auccaggccugagucugguccu

SEQ ID NO: 622396 - RNA, 22 nt, Human
ucagaggagggacucagaccca

SEQ ID NO: 622397 - RNA, 22 nt, Human
ugcaugugucgggccugugcua

SEQ ID NO: 622398 - RNA, 22 nt, Human
acagcagcuggguucccaccau

SEQ ID NO: 622399 - RNA, 22 nt, Human
uagaaacaucagcuaaccaaaa

SEQ ID NO: 622400 - RNA, 22 nt, Human
acucaggccuccuucuguccuu

SEQ ID NO: 622401 - RNA, 22 nt, Human
ugaccuuucuuugagauuccug

SEQ ID NO: 622402 - RNA, 22 nt, Human
accuuucacgguaucagacauc

SEQ ID NO: 622403 - RNA, 22 nt, Human
gggaagagaggaggugguuucg

SEQ ID NO: 622404 - RNA, 22 nt, Human
caggcucaauggccacuugggc

SEQ ID NO: 622405 - RNA, 22 nt, Human
ccaaggagaaaugcugugcuuu

SEQ ID NO: 622406 - RNA, 22 nt, Human
cugagguuuacaagcuauugcu

SEQ ID NO: 622407 - RNA, 22 nt, Human
auucuggaaagcuauucucucu

SEQ ID NO: 622408 - RNA, 23 nt, Human
aagaaugcuucugaagagcugcc

SEQ ID NO: 622409 - RNA, 22 nt, Human
aaauugcgcacauuucuccguu

SEQ ID NO: 622410 - RNA, 22 nt, Human
gaaacagugagaacuuuuccug

SEQ ID NO: 622411 - RNA, 22 nt, Human
aauagcuuuuacuccuccgagg

SEQ ID NO: 622412 - RNA, 22 nt, Human
uugcaauuaacauaugucaacu

SEQ ID NO: 622413 - RNA, 23 nt, Human
cccaggcuacaaauuaugcucug

SEQ ID NO: 622414 - RNA, 18 nt, Human
cagaaaucacaccagcac

SEQ ID NO: 622415 - RNA, 16 nt, Human
ucagcuauagggauug

SEQ ID NO: 622416 - RNA, 22 nt, Human
ucaggcaggcucagaggaaaac

SEQ ID NO: 622417 - RNA, 22 nt, Human
uugaaaauaucacaggagcagc

SEQ ID NO: 622418 - RNA, 22 nt, Human
uguagaagcuagccuggagcca

SEQ ID NO: 622419 - RNA, 22 nt, Human
aggaggcuguggagcacuccau

SEQ ID NO: 622420 - RNA, 22 nt, Human
uguucuugggaaucuuacaguu

SEQ ID NO: 622421 - RNA, 22 nt, Human
acauugauauuucaaauacagg

SEQ ID NO: 622422 - RNA, 22 nt, Human
cucucagggcagguggccuuuc

SEQ ID NO: 622423 - RNA, 22 nt, Human
uccaggcuuuggggcaggagcg

SEQ ID NO: 622424 - RNA, 22 nt, Human
uggcccugacacgugguacugg

SEQ ID NO: 622425 - RNA, 22 nt, Human
cuuggagacaggacaggcagaa

SEQ ID NO: 622426 - RNA, 22 nt, Human
ggagaggcuuggcccagccugg

SEQ ID NO: 622427 - RNA, 22 nt, Human
agcaggcaggcccagcggcugg

SEQ ID NO: 622428 - RNA, 22 nt, Human
aaaaaauuaucauaguuccuga

SEQ ID NO: 622429 - RNA, 22 nt, Human
aagaaauuaaggaaugcaacga

SEQ ID NO: 622430 - RNA, 22 nt, Human
ccagaaaagcaucugguucuuu

SEQ ID NO: 622431 - RNA, 22 nt, Human
uuauuaaucuuaucuuuggaaa

SEQ ID NO: 622432 - RNA, 22 nt, Human
caguuuauaugucagagcugua

SEQ ID NO: 622433 - RNA, 22 nt, Human
uugaauuauaagugugucuacu

SEQ ID NO: 622434 - RNA, 22 nt, Human
auugaaaucccuaccucagagg

SEQ ID NO: 622435 - RNA, 22 nt, Human
guuucucaguuuggucugcaga

SEQ ID NO: 622436 - RNA, 22 nt, Human
uugcagcagggugaauucacuc

SEQ ID NO: 622437 - RNA, 22 nt, Human
aauuacuuaagagaaacuuuga

SEQ ID NO: 622438 - RNA, 22 nt, Human
aaagugcugugauuacaggcau

SEQ ID NO: 622439 - RNA, 22 nt, Human
cuggaggaccccugccuggaag

SEQ ID NO: 622440 - RNA, 21 nt, Human
uggcuuugcccugcuugcccc

SEQ ID NO: 622441 - RNA, 22 nt, Human
ugcccaggcuucacccucagag

SEQ ID NO: 622442 - RNA, 23 nt, Human
agagcuuagggaauucacaugag

SEQ ID NO: 622443 - RNA, 22 nt, Human
auuugucucucuggguuuacuu

SEQ ID NO: 622444 - RNA, 22 nt, Human
cucagaggucaagagcagagcu

SEQ ID NO: 622445 - RNA, 22 nt, Human
uuucauuaaagucaaaucuggu

SEQ ID NO: 622446 - RNA, 22 nt, Human
uuagcacuuugauucaugcaga

SEQ ID NO: 622447 - RNA, 22 nt, Human
auggcccugccaggaggaacaa

SEQ ID NO: 622448 - RNA, 22 nt, Human
gcucccugcauuucccacccuu

SEQ ID NO: 622449 - RNA, 22 nt, Human
uggagcaagcuggagagaacau

SEQ ID NO: 622450 - RNA, 22 nt, Human
gugcagcagggggaagacagug

SEQ ID NO: 622451 - RNA, 22 nt, Human
ucauugaauuucacagcuuuau

SEQ ID NO: 622452 - RNA, 22 nt, Human
uggcaaagacugcaaggacuuu

SEQ ID NO: 622453 - RNA, 22 nt, Human
cagugcauaaucuaaauggggg

SEQ ID NO: 622454 - RNA, 22 nt, Human
gcagcccaggcucgcucacugc

SEQ ID NO: 622455 - RNA, 22 nt, Human
ugucugcccucaacccagaggc

SEQ ID NO: 622456 - RNA, 22 nt, Human
caucucauagugcagugcugua

SEQ ID NO: 622457 - RNA, 22 nt, Human
uggcagauuuugaagacagaga

SEQ ID NO: 622458 - RNA, 22 nt, Human
uauuuguguggguaucuauaua

SEQ ID NO: 622459 - RNA, 22 nt, Human
aggcuguugcaugccacagaua

SEQ ID NO: 622460 - RNA, 22 nt, Human
ggagccagagggaugcaguuga

SEQ ID NO: 622461 - RNA, 22 nt, Human
aauaaacugcucaauugcauca

SEQ ID NO: 622462 - RNA, 22 nt, Human
caguucugguuugcagauauau

SEQ ID NO: 622463 - RNA, 21 nt, Human
gggcauccuuucccacccugc

SEQ ID NO: 622464 - RNA, 22 nt, Human
aggaaauaggaccagacaaagc

SEQ ID NO: 622465 - RNA, 22 nt, Human
gauuuguuucaaguuagcaucu

SEQ ID NO: 622466 - RNA, 22 nt, Human
gcacaggaaaugacucauguua

SEQ ID NO: 622467 - RNA, 21 nt, Human
auccguuuaauaauacugaau

SEQ ID NO: 622468 - RNA, 22 nt, Human
uccugaagaugaaaagagaggu

SEQ ID NO: 622469 - RNA, 22 nt, Human
uuuagucuagucuccucagaaa

SEQ ID NO: 622470 - RNA, 22 nt, Human
agaguacugccucaguuaugaa

SEQ ID NO: 622471 - RNA, 22 nt, Human
acccagggcuuaaggcggugca

SEQ ID NO: 622472 - RNA, 22 nt, Human
cagcugaguguuggcauguuca

SEQ ID NO: 622473 - RNA, 22 nt, Human
ucagccaguuugauucuauuug

SEQ ID NO: 622474 - RNA, 22 nt, Human
uucaaacaguugcacaacuuau

SEQ ID NO: 622475 - RNA, 22 nt, Human
aucaguuuuguucacuacuaua

SEQ ID NO: 622476 - RNA, 22 nt, Human
ucccaaggugcucggcaacagg

SEQ ID NO: 622477 - RNA, 22 nt, Human
cuggggaggaugcuacgaccug

SEQ ID NO: 622478 - RNA, 22 nt, Human
ucaguguguaguaaauuguagg

SEQ ID NO: 622479 - RNA, 22 nt, Human
acagcugugggcucugcauaua

SEQ ID NO: 622480 - RNA, 22 nt, Human
ugaugcugagccugggacugac

SEQ ID NO: 622481 - RNA, 22 nt, Human
uuucucacccaagaguuauuuu

SEQ ID NO: 622482 - RNA, 22 nt, Human
uugggagcaaauaggaaagagg

SEQ ID NO: 622483 - RNA, 22 nt, Human
ggaaaaauagaguauacuuuaa

SEQ ID NO: 622484 - RNA, 22 nt, Human
uccugcuugaaacucugccuuc

SEQ ID NO: 622485 - RNA, 22 nt, Human
ucugucuuugagaucucagccu

SEQ ID NO: 622486 - RNA, 22 nt, Human
guucaaauuuuggcuguacugc

SEQ ID NO: 622487 - RNA, 22 nt, Human
acaacaguccaguauagacugu

SEQ ID NO: 622488 - RNA, 22 nt, Human
cuggggaaggcggugacugcgc

SEQ ID NO: 622489 - RNA, 22 nt, Human
gguuuccugcauugggaaauuu

SEQ ID NO: 622490 - RNA, 22 nt, Human
agcagcaauaauaaaguaauac

SEQ ID NO: 622491 - RNA, 22 nt, Human
aagggugaagggugguggccua

SEQ ID NO: 622492 - RNA, 22 nt, Human
caguacuuguccucagguguua

SEQ ID NO: 622493 - RNA, 21 nt, Human
ccaggacuccauggggucucu

SEQ ID NO: 622494 - RNA, 22 nt, Human
ucacagaauagcacuguaagcg

SEQ ID NO: 622495 - RNA, 22 nt, Human
uuaaagagucuacugcacaucc

SEQ ID NO: 622496 - RNA, 22 nt, Human
cuaaagauaaggaaaguauccu

SEQ ID NO: 622497 - RNA, 22 nt, Human
gugcagagaaaugagaagucga

SEQ ID NO: 622498 - RNA, 22 nt, Human
cuguucuucugggaauggcccu

SEQ ID NO: 622499 - RNA, 22 nt, Human
guggcagugugaggauccugcu

SEQ ID NO: 622500 - RNA, 16 nt, Human
aaccucucuacugugg

SEQ ID NO: 622501 - RNA, 23 nt, Human
cugagggcuggucugaagucugc

SEQ ID NO: 622502 - RNA, 22 nt, Human
caugggcucucugagcuccagg

SEQ ID NO: 622503 - RNA, 22 nt, Human
uacacagacucuucaauucaga

SEQ ID NO: 622504 - RNA, 22 nt, Human
guucucucagccuuuguuauua

SEQ ID NO: 622505 - RNA, 22 nt, Human
aggcugggaaauguagucuucc

SEQ ID NO: 622506 - RNA, 22 nt, Human
aagaaagugcuuuguaaauuau

SEQ ID NO: 622507 - RNA, 22 nt, Human
aucaggaagaagaauguguugg

SEQ ID NO: 622508 - RNA, 22 nt, Human
aauucacaauuauguugggaga

SEQ ID NO: 622509 - RNA, 22 nt, Human
acugaggucaugcauaguuucu

SEQ ID NO: 622510 - RNA, 23 nt, Human
ugggcuucugagaaagcaccuaa

SEQ ID NO: 622511 - RNA, 22 nt, Human
gagaggcugaaaucacaggagc

SEQ ID NO: 622512 - RNA, 22 nt, Human
uauuuggaaaggacauguaagu

SEQ ID NO: 622513 - RNA, 22 nt, Human
ggaugcugggagacagcaggca

SEQ ID NO: 622514 - RNA, 22 nt, Human
ucaguuuucucaucugugaaau

SEQ ID NO: 622515 - RNA, 22 nt, Human
uuauuauagauuaugcaagauu

SEQ ID NO: 622516 - RNA, 22 nt, Human
uuuaguguuugcguguacuccu

SEQ ID NO: 622517 - RNA, 22 nt, Human
uagcagcugcaucauuuuacag

SEQ ID NO: 622518 - RNA, 22 nt, Human
gggacuggaguagaggccggug

SEQ ID NO: 622519 - RNA, 22 nt, Human
aaagauguuuuacauagcaccu

SEQ ID NO: 622520 - RNA, 23 nt, Human
aacaggaugugcuucaucuuuug

SEQ ID NO: 622521 - RNA, 22 nt, Human
caacacagguucugcaaaggaa

SEQ ID NO: 622522 - RNA, 22 nt, Human
ugugggaaugcugaugggaucu

SEQ ID NO: 622523 - RNA, 22 nt, Human
ucagaacacuuucucuacugac

SEQ ID NO: 622524 - RNA, 22 nt, Human
gagaggaaagauauauacuucu

SEQ ID NO: 622525 - RNA, 22 nt, Human
uuacuuuauagaacacuggggg

SEQ ID NO: 622526 - RNA, 22 nt, Human
aacagaggcucccugcacuugu

SEQ ID NO: 622527 - RNA, 22 nt, Human
aaaagcagagacucuggagcua

SEQ ID NO: 622528 - RNA, 22 nt, Human
uuucaaacauuccugggagacu

SEQ ID NO: 622529 - RNA, 22 nt, Human
aagugaaacauguaucucuuua

SEQ ID NO: 622530 - RNA, 22 nt, Human
cucugcugcuugccagucauug

SEQ ID NO: 622531 - RNA, 22 nt, Human
uucagaaaugaauauugguauu

SEQ ID NO: 622532 - RNA, 22 nt, Human
augccaaauucuacuuucagca

SEQ ID NO: 622533 - RNA, 22 nt, Human
gcugcagagugaugaagugggg

SEQ ID NO: 622534 - RNA, 22 nt, Human
uccuggagcuucaguuuccuuu

SEQ ID NO: 622535 - RNA, 22 nt, Human
ugcagcauuauguagcuguuuu

SEQ ID NO: 622536 - RNA, 22 nt, Human
aguuucuagccucacuguuuag

SEQ ID NO: 622537 - RNA, 22 nt, Human
uuccauuguuucugucuucacu

SEQ ID NO: 622538 - RNA, 22 nt, Human
caaaggcuuccacugcauccuu

SEQ ID NO: 622539 - RNA, 22 nt, Human
guucagcaaguacucaguccac

SEQ ID NO: 622540 - RNA, 22 nt, Human
agucacauagcucugguuucuu

SEQ ID NO: 622541 - RNA, 22 nt, Human
cuggaucuugcugcauugagaa

SEQ ID NO: 622542 - RNA, 22 nt, Human
guugaugaaaaugaauugcaug

SEQ ID NO: 622543 - RNA, 22 nt, Human
uugggcucaggaguuugagacc

SEQ ID NO: 622544 - RNA, 22 nt, Human
ccagcagcaggccaggcccucc

SEQ ID NO: 622545 - RNA, 22 nt, Human
agcuggugcucaggggcaugga

SEQ ID NO: 622546 - RNA, 22 nt, Human
aaauaugagauguucucuuucg

SEQ ID NO: 622547 - RNA, 22 nt, Human
cuguccuguacuuugaggcccu

SEQ ID NO: 622548 - RNA, 22 nt, Human
ccagcuccucuugucucuagca

SEQ ID NO: 622549 - RNA, 22 nt, Human
agggcauuggcacagaucugcu

SEQ ID NO: 622550 - RNA, 22 nt, Human
cagcugcaguucaaugcuugcu

SEQ ID NO: 622551 - RNA, 21 nt, Human
uacagaaugcgcuucagucug

SEQ ID NO: 622552 - RNA, 22 nt, Human
ugagccaggcacugcuccugga

SEQ ID NO: 622553 - RNA, 22 nt, Human
ugucuuuugccaaagaucaguu

SEQ ID NO: 622554 - RNA, 22 nt, Human
uaguuucugaggauugaaagau

SEQ ID NO: 622555 - RNA, 22 nt, Human
aagcuggacucugccauuuacu

SEQ ID NO: 622556 - RNA, 22 nt, Human
gugcaugugcguugacugucca

SEQ ID NO: 622557 - RNA, 22 nt, Human
gauaaacaugggagaaaggaau

SEQ ID NO: 622558 - RNA, 22 nt, Human
cuggcuccaucuuugcuuccug

SEQ ID NO: 622559 - RNA, 22 nt, Human
acauucauuccaggucagucag

SEQ ID NO: 622560 - RNA, 22 nt, Human
ugugccugaguuggcugaguac

SEQ ID NO: 622561 - RNA, 22 nt, Human
auugacaauucuaugcagagca

SEQ ID NO: 622562 - RNA, 22 nt, Human
aauguuuuacagaucccauuag

SEQ ID NO: 622563 - RNA, 22 nt, Human
ggcugcagauuguagucuguua

SEQ ID NO: 622564 - RNA, 22 nt, Human
agaggaagauuuuauuaaccag

SEQ ID NO: 622565 - RNA, 22 nt, Human
acagaagagcacauuuaguaug

SEQ ID NO: 622566 - RNA, 22 nt, Human
cuauuagguuggugcaaaagua

SEQ ID NO: 622567 - RNA, 22 nt, Human
ugaacccaggagguugcaguga

SEQ ID NO: 622568 - RNA, 22 nt, Human
ggcugccccagugcucauggcu

SEQ ID NO: 622569 - RNA, 22 nt, Human
ucaucauguuugauuuccacag

SEQ ID NO: 622570 - RNA, 22 nt, Human
uucuugggugugaccagucuga

SEQ ID NO: 622571 - RNA, 22 nt, Human
ggccccuguaaaauguacaugu

SEQ ID NO: 622572 - RNA, 22 nt, Human
aggagaauuaggaacucaagau

SEQ ID NO: 622573 - RNA, 22 nt, Human
uggcaggcucugaguagcaccu

SEQ ID NO: 622574 - RNA, 22 nt, Human
ucuguucaugucuuuuuaagug

SEQ ID NO: 622575 - RNA, 22 nt, Human
gcugagagcggccagcugggaa

SEQ ID NO: 622576 - RNA, 21 nt, Human
uuugaaagugggugauucuuu

SEQ ID NO: 622577 - RNA, 22 nt, Human
ccagguaggagagagggauccu

SEQ ID NO: 622578 - RNA, 22 nt, Human
ggucagugacuuuuuucugugg

SEQ ID NO: 622579 - RNA, 22 nt, Human
gugaccaucagagaauaacaaa

SEQ ID NO: 622580 - RNA, 22 nt, Human
ucugggaacucugucauuuccc

SEQ ID NO: 622581 - RNA, 22 nt, Human
accagagcgcucaagccuuccc

SEQ ID NO: 622582 - RNA, 22 nt, Human
ucagauuuacugcagagcagau

SEQ ID NO: 622583 - RNA, 22 nt, Human
acagaauuuaaagcucuagacu

SEQ ID NO: 622584 - RNA, 22 nt, Human
acaggaguuuaagaaauauuuc

SEQ ID NO: 622585 - RNA, 23 nt, Human
ugcagccacucaggagcucagug

SEQ ID NO: 622586 - RNA, 22 nt, Human
cagggcuguaaauuagugcuga

SEQ ID NO: 622587 - RNA, 22 nt, Human
aaaauuaagugucugggaagcc

SEQ ID NO: 622588 - RNA, 22 nt, Human
agucuccuuggccucaaugccu

SEQ ID NO: 622589 - RNA, 22 nt, Human
caucauauggaauuuaaaguca

SEQ ID NO: 622590 - RNA, 22 nt, Human
uauaaaguuucgaaagauguau

SEQ ID NO: 622591 - RNA, 22 nt, Human
guguccugggggacuucagguu

SEQ ID NO: 622592 - RNA, 22 nt, Human
ucuauuguaggcauguagcuug

SEQ ID NO: 622593 - RNA, 22 nt, Human
uggcccugcuguaucaucugcu

SEQ ID NO: 622594 - RNA, 19 nt, Human
uccugggcugggccagguc

SEQ ID NO: 622595 - RNA, 22 nt, Human
cucacagagcucauacugggag

SEQ ID NO: 622596 - RNA, 22 nt, Human
cuuguugcaaacauucacucca

SEQ ID NO: 622597 - RNA, 22 nt, Human
ccugcccacagagagggugcau

SEQ ID NO: 622598 - RNA, 22 nt, Human
ucccagcacagggcagauguga

SEQ ID NO: 622599 - RNA, 17 nt, Human
ugguuccaaccauacgc

SEQ ID NO: 622600 - RNA, 22 nt, Human
gcagaagcagggcaggggcaaa

SEQ ID NO: 622601 - RNA, 22 nt, Human
agaaagagcucgggauuaacag

SEQ ID NO: 622602 - RNA, 22 nt, Human
gagcugggucuccaccuuggca

SEQ ID NO: 622603 - RNA, 22 nt, Human
ucagggcacugucaccugauau

SEQ ID NO: 622604 - RNA, 22 nt, Human
aaaaggcauuuugucaaccaua

SEQ ID NO: 622605 - RNA, 22 nt, Human
ugcauuucagaagaaaauucgg

SEQ ID NO: 622606 - RNA, 22 nt, Human
aaguucaaucagaugaaaaagc

SEQ ID NO: 622607 - RNA, 22 nt, Human
auguauguuaguguauuaucua

SEQ ID NO: 622608 - RNA, 22 nt, Human
ucaggcagucugacuccggagg

SEQ ID NO: 622609 - RNA, 19 nt, Human
ucugaggcuucuccccuug

SEQ ID NO: 622610 - RNA, 19 nt, Human
cagagccuucagugacucc

SEQ ID NO: 622611 - RNA, 22 nt, Human
ggcacagcucaggucccagcuc

SEQ ID NO: 622612 - RNA, 22 nt, Human
cagucucacccuggaggcccca

SEQ ID NO: 622613 - RNA, 22 nt, Human
gucagcucagcaggugggagug

SEQ ID NO: 622614 - RNA, 22 nt, Human
aaugaagauuauggugauuaag

SEQ ID NO: 622615 - RNA, 22 nt, Human
agucaguguagaaagcccaggc

SEQ ID NO: 622616 - RNA, 22 nt, Human
uaggaaacucucagcuggucau

SEQ ID NO: 622617 - RNA, 22 nt, Human
uacagaaauugccaccagcucu

SEQ ID NO: 622618 - RNA, 22 nt, Human
agcagccaaccuuacauucauc

SEQ ID NO: 622619 - RNA, 22 nt, Human
aacuuagugagccacucuugca

SEQ ID NO: 622620 - RNA, 22 nt, Human
ucagagaauccguaagucacaa

SEQ ID NO: 622621 - RNA, 22 nt, Human
auucuuacaaagcagagucugu

SEQ ID NO: 622622 - RNA, 22 nt, Human
ucugugccucaucugguucagg

SEQ ID NO: 622623 - RNA, 22 nt, Human
uaagaacagauaaaguuucccc

SEQ ID NO: 622624 - RNA, 22 nt, Human
augcacugggugaggaaggaga

SEQ ID NO: 622625 - RNA, 18 nt, Human
ccuggaccugucuccuuu

SEQ ID NO: 622626 - RNA, 22 nt, Human
caggaaugauauucgaggagau

SEQ ID NO: 622627 - RNA, 22 nt, Human
agauuuagugguggaauuuugg

SEQ ID NO: 622628 - RNA, 22 nt, Human
aucaaaguaggcauauguuuuu

SEQ ID NO: 622629 - RNA, 22 nt, Human
ugcauguuugugucugagaacu

SEQ ID NO: 622630 - RNA, 20 nt, Human
ucauggaaucucacucuagu

SEQ ID NO: 622631 - RNA, 22 nt, Human
uggagauggguuaauggagaga

SEQ ID NO: 622632 - RNA, 22 nt, Human
uuuuauguugcuauaauaggua

SEQ ID NO: 622633 - RNA, 22 nt, Human
auaagcaugauuaccgggagca

SEQ ID NO: 622634 - RNA, 22 nt, Human
cuggaguacaggaaucuuccca

SEQ ID NO: 622635 - RNA, 22 nt, Human
cugaagcauaucaugccaaguu

SEQ ID NO: 622636 - RNA, 22 nt, Human
gaggacacaugacuccagcagg

SEQ ID NO: 622637 - RNA, 22 nt, Human
cccuggcagagggggcaggugc

SEQ ID NO: 622638 - RNA, 22 nt, Human
acaguaagcgggguuggagggc

SEQ ID NO: 622639 - RNA, 22 nt, Human
agaugugggugucaggcaguga

SEQ ID NO: 622640 - RNA, 23 nt, Human
ccaggcucuuucaccugcuauuc

SEQ ID NO: 622641 - RNA, 22 nt, Human
ucauuucagccauuuuuaaaug

SEQ ID NO: 622642 - RNA, 22 nt, Human
ugcugucuucucugaggucccu

SEQ ID NO: 622643 - RNA, 22 nt, Human
ccuuuaauuuacaauguuaauu

SEQ ID NO: 622644 - RNA, 22 nt, Human
gugccuguuucuuuugaauuca

SEQ ID NO: 622645 - RNA, 22 nt, Human
aagcugccugggaggaagggcu

SEQ ID NO: 622646 - RNA, 22 nt, Human
aggcugcaggucugggucaugu

SEQ ID NO: 622647 - RNA, 20 nt, Human
aagaaacuugaaaguacaag

SEQ ID NO: 622648 - RNA, 22 nt, Human
uagaaaacuaauacaugcuuga

SEQ ID NO: 622649 - RNA, 22 nt, Human
aaggcacagaggcagggcacuu

SEQ ID NO: 622650 - RNA, 22 nt, Human
gugacucuguuucugaaaacag

SEQ ID NO: 622651 - RNA, 21 nt, Human
cuacuuaaguaggggauuagg

SEQ ID NO: 622652 - RNA, 22 nt, Human
auaaaaguucaagagaguacag

SEQ ID NO: 622653 - RNA, 22 nt, Human
aguuuccacuggagacacugug

SEQ ID NO: 622654 - RNA, 23 nt, Human
uaggcaggacucagauaugacag

SEQ ID NO: 622655 - RNA, 22 nt, Human
aagagagggguugcauggaaau

SEQ ID NO: 622656 - RNA, 22 nt, Human
gggacgacaggcucugugguag

SEQ ID NO: 622657 - RNA, 22 nt, Human
uaacaugagagcuaagacauua

SEQ ID NO: 622658 - RNA, 22 nt, Human
cacaagacuuauuuguguagaa

SEQ ID NO: 622659 - RNA, 22 nt, Human
caccuggaguagcaagguaauu

SEQ ID NO: 622660 - RNA, 22 nt, Human
guccugugggcccaccaugagc

SEQ ID NO: 622661 - RNA, 22 nt, Human
ccugcacccaggccgcaccucu

SEQ ID NO: 622662 - RNA, 22 nt, Human
ugcggagggagcagucggcugu

SEQ ID NO: 622663 - RNA, 22 nt, Human
uuuccaauaaagugucauuguu

SEQ ID NO: 622664 - RNA, 22 nt, Human
ugcaaagaaggggaggaggauu

SEQ ID NO: 622665 - RNA, 22 nt, Human
uuuaugauuauuuuaaagcagc

SEQ ID NO: 622666 - RNA, 22 nt, Human
cucccugacaggccaugggcuu

SEQ ID NO: 622667 - RNA, 22 nt, Human
ucaccauuggcaauuauaaaac

SEQ ID NO: 622668 - RNA, 22 nt, Human
gccugagccgccugagcggcgg

SEQ ID NO: 622669 - RNA, 22 nt, Human
uaagcauacauucucuccuuuc

SEQ ID NO: 622670 - RNA, 22 nt, Human
aagacauuccaaaguggcuaau

SEQ ID NO: 622671 - RNA, 22 nt, Human
cacuucaauuaacuucagcauu

SEQ ID NO: 622672 - RNA, 22 nt, Human
aagcaaaggcaggagcuuguga

SEQ ID NO: 622673 - RNA, 22 nt, Human
cugaggagucaguuccacucag

SEQ ID NO: 622674 - RNA, 22 nt, Human
ucagugcacagagauuuuuguu

SEQ ID NO: 622675 - RNA, 22 nt, Human
aguguacaaaaugauagauaaa

SEQ ID NO: 622676 - RNA, 22 nt, Human
uacauguuuacuccaagucagg

SEQ ID NO: 622677 - RNA, 22 nt, Human
acugagacugccccuguaacaa

SEQ ID NO: 622678 - RNA, 22 nt, Human
gagcucagagccuauaguuggu

SEQ ID NO: 622679 - RNA, 22 nt, Human
ugaauauggcaacucuuguaac

SEQ ID NO: 622680 - RNA, 22 nt, Human
uaaauaucaguccagcucuucc

SEQ ID NO: 622681 - RNA, 22 nt, Human
auccaucccaucuucaccaggg

SEQ ID NO: 622682 - RNA, 22 nt, Human
uaacuuuugugaucugucgauu

SEQ ID NO: 622683 - RNA, 22 nt, Human
augacaagggaggguccugcua

SEQ ID NO: 622684 - RNA, 22 nt, Human
ucucacagggcuaggcccugcc

SEQ ID NO: 622685 - RNA, 18 nt, Human
uguugaaacuucagguaa

SEQ ID NO: 622686 - RNA, 22 nt, Human
uccaucugcauuugguuucugu

SEQ ID NO: 622687 - RNA, 22 nt, Human
gguuccagaguauuucauuuca

SEQ ID NO: 622688 - RNA, 18 nt, Human
ccuggcuuuucuacuugc

SEQ ID NO: 622689 - RNA, 22 nt, Human
aaguggcagaauaguggcagga

SEQ ID NO: 622690 - RNA, 22 nt, Human
uugagaagaaauaguuugcaau

SEQ ID NO: 622691 - RNA, 21 nt, Human
uuauucugagaugagauucuu

SEQ ID NO: 622692 - RNA, 22 nt, Human
uggcgagguuucagagagcggc

SEQ ID NO: 622693 - RNA, 21 nt, Human
ccagcuuucccaagucccuuu

SEQ ID NO: 622694 - RNA, 22 nt, Human
ugggcugcccugaugguccuca

SEQ ID NO: 622695 - RNA, 22 nt, Human
cugggcucaguggcucauggcu

SEQ ID NO: 622696 - RNA, 21 nt, Human
uugaagcaaggguggcucuga

SEQ ID NO: 622697 - RNA, 22 nt, Human
uuuguucugcaucacagaaaaa

SEQ ID NO: 622698 - RNA, 22 nt, Human
uuagcaauaugaaugcauuugc

SEQ ID NO: 622699 - RNA, 22 nt, Human
cacuucaccacuaggcuauacu

SEQ ID NO: 622700 - RNA, 22 nt, Human
gaggugugaggaaugaaugggg

SEQ ID NO: 622701 - RNA, 22 nt, Human
ggcuggagauaugucuggaaca

SEQ ID NO: 622702 - RNA, 23 nt, Human
cuauggaauaccaaugauucuca

SEQ ID NO: 622703 - RNA, 21 nt, Human
augugcagcaagcagcaugcu

SEQ ID NO: 622704 - RNA, 22 nt, Human
auggcuuuccggacuuuggcca

SEQ ID NO: 622705 - RNA, 22 nt, Human
gacaaaggaucagagguuggga

SEQ ID NO: 622706 - RNA, 22 nt, Human
gagagaccucagaaacaaucua

SEQ ID NO: 622707 - RNA, 22 nt, Human
ucagccagagggggcaaaggaa

SEQ ID NO: 622708 - RNA, 22 nt, Human
gccagugcuuguggagcuggca

SEQ ID NO: 622709 - RNA, 22 nt, Human
uaaugcaggugcccuuggguuu

SEQ ID NO: 622710 - RNA, 22 nt, Human
agccuggaccaggggccucaga

SEQ ID NO: 622711 - RNA, 22 nt, Human
uagcagaagaacaacaugaucu

SEQ ID NO: 622712 - RNA, 22 nt, Human
cagcugccuaugaccuagccuc

SEQ ID NO: 622713 - RNA, 22 nt, Human
ucacaguugauugaaacacagc

SEQ ID NO: 622714 - RNA, 22 nt, Human
gccuugggggugaaagaggcua

SEQ ID NO: 622715 - RNA, 22 nt, Human
gggcuccagcccgggaccaggu

SEQ ID NO: 622716 - RNA, 22 nt, Human
gaggccugucgcuaggccucug

SEQ ID NO: 622717 - RNA, 22 nt, Human
cucagugcuuuggauccuggau

SEQ ID NO: 622718 - RNA, 20 nt, Human
uuugucaacugcauccagca

SEQ ID NO: 622719 - RNA, 22 nt, Human
uccucagacuucccuuugugua

SEQ ID NO: 622720 - RNA, 22 nt, Human
uggcugcucaagggaggaggcu

SEQ ID NO: 622721 - RNA, 22 nt, Human
ugucuuauguagauacugagaa

SEQ ID NO: 622722 - RNA, 22 nt, Human
aucugcuugcccucuuaggacc

SEQ ID NO: 622723 - RNA, 22 nt, Human
cagggaugugaugagcugagcc

SEQ ID NO: 622724 - RNA, 22 nt, Human
gcaagcaagcagguagagcuga

SEQ ID NO: 622725 - RNA, 22 nt, Human
ucuuugcaugcauuuucccuua

SEQ ID NO: 622726 - RNA, 20 nt, Human
gcagagcuguucugugggga

SEQ ID NO: 622727 - RNA, 22 nt, Human
uuugacaagagcaaauguucuu

SEQ ID NO: 622728 - RNA, 22 nt, Human
augucuauauagucaauaauca

SEQ ID NO: 622729 - RNA, 22 nt, Human
uguggggacccaugccaugggc

SEQ ID NO: 622730 - RNA, 22 nt, Human
auugaaauugaugaaauucuug

SEQ ID NO: 622731 - RNA, 22 nt, Human
uaggaaacucaaagggaagugg

SEQ ID NO: 622732 - RNA, 22 nt, Human
gagguccagagcagguucagug

SEQ ID NO: 622733 - RNA, 22 nt, Human
ugugcucuucuguuacuuguag

SEQ ID NO: 622734 - RNA, 20 nt, Human
uccuucaggcagggccuagu

SEQ ID NO: 622735 - RNA, 22 nt, Human
gacauuuaaggcagucacuuaa

SEQ ID NO: 622736 - RNA, 22 nt, Human
cauauacacuuccaccucugug

SEQ ID NO: 622737 - RNA, 22 nt, Human
uuuagacacuagggaugcagug

SEQ ID NO: 622738 - RNA, 22 nt, Human
auggcagaauuaggauuucaag

SEQ ID NO: 622739 - RNA, 22 nt, Human
aaagacacaaauguagaccaaa

SEQ ID NO: 622740 - RNA, 22 nt, Human
uuuauguuugcauuuucaaaga

SEQ ID NO: 622741 - RNA, 22 nt, Human
cugcagccuccuccagcuacgu

SEQ ID NO: 622742 - RNA, 22 nt, Human
ccucaggcuuaacuugucuuga

SEQ ID NO: 622743 - RNA, 22 nt, Human
agauauuuguaucuugcuauug

SEQ ID NO: 622744 - RNA, 22 nt, Human
agccagcaugaagacagaggcc

SEQ ID NO: 622745 - RNA, 22 nt, Human
ugguggggucaucgucagaugc

SEQ ID NO: 622746 - RNA, 21 nt, Human
uguggucuuuuaguuccauca

SEQ ID NO: 622747 - RNA, 22 nt, Human
cuccugaggaaaagcuugguca

SEQ ID NO: 622748 - RNA, 22 nt, Human
acagagguuuccauugagguuu

SEQ ID NO: 622749 - RNA, 20 nt, Human
aucaucucaaagcugagguu

SEQ ID NO: 622750 - RNA, 22 nt, Human
ccuggagcaaaaaucuaaggag

SEQ ID NO: 622751 - RNA, 22 nt, Human
uauuugaugaagguaaagucuu

SEQ ID NO: 622752 - RNA, 22 nt, Human
guaggcagugguuggaagagaa

SEQ ID NO: 622753 - RNA, 23 nt, Human
ucucugugugccucaguuucuuc

SEQ ID NO: 622754 - RNA, 22 nt, Human
aagguauauguacaauagacau

SEQ ID NO: 622755 - RNA, 22 nt, Human
uacaacugcacaucugaaucac

SEQ ID NO: 622756 - RNA, 22 nt, Human
uaggaacacagggacuugauga

SEQ ID NO: 622757 - RNA, 22 nt, Human
uggccugacugucaggcuguau

SEQ ID NO: 622758 - RNA, 22 nt, Human
cccaugcugugccuagagagca

SEQ ID NO: 622759 - RNA, 22 nt, Human
uccuuacagguuacagaaagca

SEQ ID NO: 622760 - RNA, 22 nt, Human
uccuuuggagcuugacugguag

SEQ ID NO: 622761 - RNA, 22 nt, Human
caggcugccgugggguccaggc

SEQ ID NO: 622762 - RNA, 22 nt, Human
aaccaaggacagcuagugaugc

SEQ ID NO: 622763 - RNA, 22 nt, Human
uucugguggccagaagucugaa

SEQ ID NO: 622764 - RNA, 22 nt, Human
cagcauuguaagaaugaagacc

SEQ ID NO: 622765 - RNA, 22 nt, Human
gagggcugaagauuguggcccc

SEQ ID NO: 622766 - RNA, 22 nt, Human
gcaaaugaguuguaacauaaaa

SEQ ID NO: 622767 - RNA, 22 nt, Human
agaaggguguauacauuuccug

SEQ ID NO: 622768 - RNA, 22 nt, Human
uugcagauuaaaacacugagcu

SEQ ID NO: 622769 - RNA, 22 nt, Human
agagacaccgcgcaucauggcu

SEQ ID NO: 622770 - RNA, 22 nt, Human
ucugagguucuguuuucaacug

SEQ ID NO: 622771 - RNA, 22 nt, Human
auauuuauaaggcaggcaagua

SEQ ID NO: 622772 - RNA, 22 nt, Human
cugccagcaaugugaccaugcu

SEQ ID NO: 622773 - RNA, 22 nt, Human
augugcugaguguguauauaca

SEQ ID NO: 622774 - RNA, 18 nt, Human
gaugggagcaagagaaga

SEQ ID NO: 622775 - RNA, 22 nt, Human
gacaggcuucauccucagaguu

SEQ ID NO: 622776 - RNA, 22 nt, Human
ugucucagaggcaggaagagcc

SEQ ID NO: 622777 - RNA, 22 nt, Human
aggucucaauuccugcuccugu

SEQ ID NO: 622778 - RNA, 22 nt, Human
ggcugugauugguggaugugaa

SEQ ID NO: 622779 - RNA, 22 nt, Human
ucuugggggacuuuggcaugga

SEQ ID NO: 622780 - RNA, 22 nt, Human
uuaaaauagccagugccccucu

SEQ ID NO: 622781 - RNA, 22 nt, Human
ucauugaggaaagguaguggcu

SEQ ID NO: 622782 - RNA, 22 nt, Human
uccaggcagggcagccaucaag

SEQ ID NO: 622783 - RNA, 22 nt, Human
acugucacugugauguuagaga

SEQ ID NO: 622784 - RNA, 22 nt, Human
ucccagagcugauaagccuuua

SEQ ID NO: 622785 - RNA, 22 nt, Human
uaacagaaauaguaggugaggg

SEQ ID NO: 622786 - RNA, 22 nt, Human
agcaggguuccaggaguugcag

SEQ ID NO: 622787 - RNA, 22 nt, Human
ucagcccaguuuuaucaucugu

SEQ ID NO: 622788 - RNA, 23 nt, Human
agaguaauguuuuuacuguauuc

SEQ ID NO: 622789 - RNA, 22 nt, Human
uuaacuguaucauacuguuuca

SEQ ID NO: 622790 - RNA, 22 nt, Human
aaggaggcacccugagccugcc

SEQ ID NO: 622791 - RNA, 22 nt, Human
acugcucuguuuucauauguuu

SEQ ID NO: 622792 - RNA, 22 nt, Human
aauaucaacaguguccuucuaa

SEQ ID NO: 622793 - RNA, 22 nt, Human
ugccuuuacugauuagcugugu

SEQ ID NO: 622794 - RNA, 22 nt, Human
uuccugggcugcagagagcacc

SEQ ID NO: 622795 - RNA, 22 nt, Human
gaagcaauguguuuucaacauu

SEQ ID NO: 622796 - RNA, 22 nt, Human
ucacagcaaaagugugcagagc

SEQ ID NO: 622797 - RNA, 22 nt, Human
auaugcuuccccuucuuuuugg

SEQ ID NO: 622798 - RNA, 22 nt, Human
gugccgugggccuuagugaucu

SEQ ID NO: 622799 - RNA, 22 nt, Human
aucagaccugucuccucuugcc

SEQ ID NO: 622800 - RNA, 22 nt, Human
agcaagacucagcaggauacca

SEQ ID NO: 622801 - RNA, 22 nt, Human
cuuagcuuuaaaagugagaucu

SEQ ID NO: 622802 - RNA, 22 nt, Human
ccucagaguuggaaucacauuu

SEQ ID NO: 622803 - RNA, 22 nt, Human
uaggauggucacagagauggac

SEQ ID NO: 622804 - RNA, 22 nt, Human
cuuggcccaguugccaaggaaa

SEQ ID NO: 622805 - RNA, 22 nt, Human
uggggugggcaugcgcuguccu

SEQ ID NO: 622806 - RNA, 22 nt, Human
gccucagggauaggaugagcau

SEQ ID NO: 622807 - RNA, 22 nt, Human
agggcuggcuaggugcguuccc

SEQ ID NO: 622808 - RNA, 22 nt, Human
auugcaaaggucccauucaaga

SEQ ID NO: 622809 - RNA, 22 nt, Human
acacuguagcugagggcaugcg

SEQ ID NO: 622810 - RNA, 17 nt, Human
uuguuucuucucugugg

SEQ ID NO: 622811 - RNA, 23 nt, Human
aaaugacauaugguuucugaagg

SEQ ID NO: 622812 - RNA, 22 nt, Human
uuggaaacuuggauggaaaacc

SEQ ID NO: 622813 - RNA, 22 nt, Human
ugccagccagggaagcucaccc

SEQ ID NO: 622814 - RNA, 22 nt, Human
caggucugagucacauguucau

SEQ ID NO: 622815 - RNA, 19 nt, Human
aguguuuauguagugccua

SEQ ID NO: 622816 - RNA, 22 nt, Human
caggaggugaaggagaaccagu

SEQ ID NO: 622817 - RNA, 22 nt, Human
uuccaauuuguggugaguuaau

SEQ ID NO: 622818 - RNA, 18 nt, Human
ggcuccagucuucagugg

SEQ ID NO: 622819 - RNA, 17 nt, Human
uuauucuggcauaugug

SEQ ID NO: 622820 - RNA, 22 nt, Human
aagauuauuuaagacaggaacc

SEQ ID NO: 622821 - RNA, 22 nt, Human
gcucacagccggcuggcagggg

SEQ ID NO: 622822 - RNA, 22 nt, Human
gugaccauaauagauuaugagu

SEQ ID NO: 622823 - RNA, 22 nt, Human
uucacauucagaaaaagcccgu

SEQ ID NO: 622824 - RNA, 20 nt, Human
uccugcaguuccuaggaggg

SEQ ID NO: 622825 - RNA, 22 nt, Human
gcucagagauguucaguagcuu

SEQ ID NO: 622826 - RNA, 22 nt, Human
uaggcacugaggggagcaaggu

SEQ ID NO: 622827 - RNA, 22 nt, Human
augaagucuagcaagcauugaa

SEQ ID NO: 622828 - RNA, 22 nt, Human
ucaaaauuaaaccaacguccag

SEQ ID NO: 622829 - RNA, 22 nt, Human
uaaaauagaggaugucaugcua

SEQ ID NO: 622830 - RNA, 23 nt, Human
ucuggcuccauccuuggggaucc

SEQ ID NO: 622831 - RNA, 22 nt, Human
gggaccagaagaaggaugguga

SEQ ID NO: 622832 - RNA, 22 nt, Human
ucuaaacuacgucaaaacuagu

SEQ ID NO: 622833 - RNA, 22 nt, Human
cccggacagaggggcagagugu

SEQ ID NO: 622834 - RNA, 22 nt, Human
ccucucaucauuaucgcuuugu

SEQ ID NO: 622835 - RNA, 22 nt, Human
aaagccuugggauuugugauca

SEQ ID NO: 622836 - RNA, 22 nt, Human
acuguugucaggcugcuuugga

SEQ ID NO: 622837 - RNA, 22 nt, Human
cucugccaguuucuggccucag

SEQ ID NO: 622838 - RNA, 23 nt, Human
uccuggugacaugccugagcauc

SEQ ID NO: 622839 - RNA, 22 nt, Human
ugcuuuugcacaggugaguucc

SEQ ID NO: 622840 - RNA, 22 nt, Human
ugaguuaaucucuacgauagaa

SEQ ID NO: 622841 - RNA, 22 nt, Human
ucuuucuugguauucugagcua

SEQ ID NO: 622842 - RNA, 22 nt, Human
acuucucugguugagguccaau

SEQ ID NO: 622843 - RNA, 23 nt, Human
ucagagaaugguaugcuuuuccu

SEQ ID NO: 622844 - RNA, 22 nt, Human
augcauauuggauuagcagcca

SEQ ID NO: 622845 - RNA, 20 nt, Human
cugcaguccccucugaauca

SEQ ID NO: 622846 - RNA, 22 nt, Human
uucaccagcagcucacuaguca

SEQ ID NO: 622847 - RNA, 22 nt, Human
uucuggaauccucaaaacauga

SEQ ID NO: 622848 - RNA, 22 nt, Human
ucaagcaacagaacugugagac

SEQ ID NO: 622849 - RNA, 21 nt, Human
agcagguguaaaggaggaaau

SEQ ID NO: 622850 - RNA, 22 nt, Human
aaaucguuucguuccugguuuu

SEQ ID NO: 622851 - RNA, 22 nt, Human
cacagagcaggggucuguguca

SEQ ID NO: 622852 - RNA, 22 nt, Human
uggcuugguccuggcccuuccc

SEQ ID NO: 622853 - RNA, 20 nt, Human
ccuggaagagcuccccaggc

SEQ ID NO: 622854 - RNA, 22 nt, Human
acauuuuacaguugucuggcua

SEQ ID NO: 622855 - RNA, 22 nt, Human
cuucagggugacgcaggcugca

SEQ ID NO: 622856 - RNA, 22 nt, Human
gacuucauaauauugagcaugu

SEQ ID NO: 622857 - RNA, 22 nt, Human
uuaucauugucgcagucuaauu

SEQ ID NO: 622858 - RNA, 22 nt, Human
cauguggcacaaagaaggaaau

SEQ ID NO: 622859 - RNA, 22 nt, Human
acagacuuguucccuagugagu

SEQ ID NO: 622860 - RNA, 22 nt, Human
uaauuuaauuucaugccagccu

SEQ ID NO: 622861 - RNA, 22 nt, Human
agauacaucuugaacuucuaga

SEQ ID NO: 622862 - RNA, 22 nt, Human
caugggcugcugacaggggcuc

SEQ ID NO: 622863 - RNA, 22 nt, Human
uauuugcuuuugugccacagau

SEQ ID NO: 622864 - RNA, 20 nt, Human
auucaugucuuuauaaaagc

SEQ ID NO: 622865 - RNA, 22 nt, Human
uaagaugucauccacauagagu

SEQ ID NO: 622866 - RNA, 22 nt, Human
aggcucaguauagcuggcaagu

SEQ ID NO: 622867 - RNA, 22 nt, Human
gcucaaaggccagguagcagca

SEQ ID NO: 622868 - RNA, 22 nt, Human
ggagagcauucuuagucuguuu

SEQ ID NO: 622869 - RNA, 22 nt, Human
agcagaaaugaugguaugggac

SEQ ID NO: 622870 - RNA, 23 nt, Human
cuucaugagagcccugaggaaaa

SEQ ID NO: 622871 - RNA, 22 nt, Human
ugagggcuccccgcugcugugu

SEQ ID NO: 622872 - RNA, 22 nt, Human
uuagaucuuaggcaaauguguu

SEQ ID NO: 622873 - RNA, 22 nt, Human
ugggagaagagaaauuacugcc

SEQ ID NO: 622874 - RNA, 22 nt, Human
gugaggucaaagccuuggguau

SEQ ID NO: 622875 - RNA, 22 nt, Human
cuuucaugaacagacaaggaac

SEQ ID NO: 622876 - RNA, 22 nt, Human
aaugcuuugucugcuccagacu

SEQ ID NO: 622877 - RNA, 22 nt, Human
uccauuuacuauucucauaucg

SEQ ID NO: 622878 - RNA, 22 nt, Human
agguaggauggguggagaugau

SEQ ID NO: 622879 - RNA, 22 nt, Human
uguguuauugccacugaagacc

SEQ ID NO: 622880 - RNA, 22 nt, Human
auuuugaagggaauugaaguuc

SEQ ID NO: 622881 - RNA, 22 nt, Human
cucaggcccacagcagacccac

SEQ ID NO: 622882 - RNA, 22 nt, Human
agggauggagugcggcccggac

SEQ ID NO: 622883 - RNA, 22 nt, Human
acagugaggaagcagcugugcu

SEQ ID NO: 622884 - RNA, 22 nt, Human
caucugcucugucugccauguu

SEQ ID NO: 622885 - RNA, 22 nt, Human
uuuacaacccaaguccagagag

SEQ ID NO: 622886 - RNA, 22 nt, Human
ugggagcagcagggagaugcgg

SEQ ID NO: 622887 - RNA, 22 nt, Human
uggaucucggcaaugcgggacu

SEQ ID NO: 622888 - RNA, 22 nt, Human
cacaggaggaggugcccgggcc

SEQ ID NO: 622889 - RNA, 22 nt, Human
aaucacuuugcacucuuauuug

SEQ ID NO: 622890 - RNA, 22 nt, Human
uagcacauacauaauagauaga

SEQ ID NO: 622891 - RNA, 22 nt, Human
aggcccuguuaugagccacugu

SEQ ID NO: 622892 - RNA, 22 nt, Human
ggcuggcagugugagagaggga

SEQ ID NO: 622893 - RNA, 22 nt, Human
gcucuccaaacccuguggcuuu

SEQ ID NO: 622894 - RNA, 22 nt, Human
auuuuuucagauugaguguuaa

SEQ ID NO: 622895 - RNA, 22 nt, Human
uguuccuguacugcuguggcuu

SEQ ID NO: 622896 - RNA, 22 nt, Human
aagagcaucgguggagccccca

SEQ ID NO: 622897 - RNA, 22 nt, Human
ugugauaacuuuuacauuuucg

SEQ ID NO: 622898 - RNA, 22 nt, Human
gaaagcaguauuuaguucuguu

SEQ ID NO: 622899 - RNA, 22 nt, Human
auuuauuccuuuauggcuggag

SEQ ID NO: 622900 - RNA, 22 nt, Human
gaaagaagcuuuagauggcuau

SEQ ID NO: 622901 - RNA, 22 nt, Human
augcacagaacaauuuuaagag

SEQ ID NO: 622902 - RNA, 22 nt, Human
auucugggaguguaggaugguu

SEQ ID NO: 622903 - RNA, 22 nt, Human
ugggugugagcccgggagccgc

SEQ ID NO: 622904 - RNA, 19 nt, Human
ucagcagcacugugauuuc

SEQ ID NO: 622905 - RNA, 22 nt, Human
agccaaucuccuguugaugcca

SEQ ID NO: 622906 - RNA, 22 nt, Human
uuguuucaggaugguuuguuac

SEQ ID NO: 622907 - RNA, 22 nt, Human
gcauugguucaagguugugcag

SEQ ID NO: 622908 - RNA, 22 nt, Human
aucaaaaccuugacuuuuaaug

SEQ ID NO: 622909 - RNA, 22 nt, Human
agagacuggagaugggcagugu

SEQ ID NO: 622910 - RNA, 22 nt, Human
caccccagucuaaaaccagccu

SEQ ID NO: 622911 - RNA, 22 nt, Human
uuucaucauguuggcagauugg

SEQ ID NO: 622912 - RNA, 22 nt, Human
uuugacacugggagugugggug

SEQ ID NO: 622913 - RNA, 22 nt, Human
cugagagacuguuuguaauauu

SEQ ID NO: 622914 - RNA, 22 nt, Human
agccacgucccugucaggguca

SEQ ID NO: 622915 - RNA, 22 nt, Human
ggucagguuuuuaggagugacc

SEQ ID NO: 622916 - RNA, 22 nt, Human
guaagcacaugugugugcaugg

SEQ ID NO: 622917 - RNA, 22 nt, Human
uaacagcaggguuacaggcauu

SEQ ID NO: 622918 - RNA, 22 nt, Human
uaaaauguuugcaagagaccag

SEQ ID NO: 622919 - RNA, 22 nt, Human
gagcccuccauggagccaggca

SEQ ID NO: 622920 - RNA, 22 nt, Human
aggugagugugacugcaagaga

SEQ ID NO: 622921 - RNA, 21 nt, Human
agaucauucuucugagcacuu

SEQ ID NO: 622922 - RNA, 22 nt, Human
uguuuucaucacagaauguaac

SEQ ID NO: 622923 - RNA, 22 nt, Human
ccuuccagggagcaggcagugu

SEQ ID NO: 622924 - RNA, 22 nt, Human
cagcuauuauuuucucuaaauu

SEQ ID NO: 622925 - RNA, 22 nt, Human
gacacagguagaauaaaguacu

SEQ ID NO: 622926 - RNA, 22 nt, Human
auuuguguuguauuaagcugcu

SEQ ID NO: 622927 - RNA, 22 nt, Human
ucucucuucuuuguuaagaaug

SEQ ID NO: 622928 - RNA, 22 nt, Human
gcagugguccaguucacaccca

SEQ ID NO: 622929 - RNA, 22 nt, Human
agcugccuuauggaguaugaaa

SEQ ID NO: 622930 - RNA, 22 nt, Human
cccagcauccucagggagcggg

SEQ ID NO: 622931 - RNA, 22 nt, Human
ggcuccuucaagccugucacug

SEQ ID NO: 622932 - RNA, 22 nt, Human
ucagcuuugaucucaggcaauc

SEQ ID NO: 622933 - RNA, 22 nt, Human
gagggggacguauccugguaug

SEQ ID NO: 622934 - RNA, 22 nt, Human
cccucagcuucucccugcagcu

SEQ ID NO: 622935 - RNA, 22 nt, Human
uuucuagaguucaucaugguaa

SEQ ID NO: 622936 - RNA, 22 nt, Human
gccucugucauagcucauguga

SEQ ID NO: 622937 - RNA, 22 nt, Human
aagugcauacacuaguuaauug

SEQ ID NO: 622938 - RNA, 19 nt, Human
uggccaccucugcuguucu

SEQ ID NO: 622939 - RNA, 21 nt, Human
agcaggcaaaggugaagucuu

SEQ ID NO: 622940 - RNA, 22 nt, Human
gcaguguuaggaauaaaaauga

SEQ ID NO: 622941 - RNA, 22 nt, Human
augauucuaaacuuaaggggga

SEQ ID NO: 622942 - RNA, 22 nt, Human
cagcaucuguaggacuccucuu

SEQ ID NO: 622943 - RNA, 22 nt, Human
uggcagguggcacagccuggga

SEQ ID NO: 622944 - RNA, 22 nt, Human
aaacagucaaaggccuaagcua

SEQ ID NO: 622945 - RNA, 22 nt, Human
aacccagagcuggaggagagua

SEQ ID NO: 622946 - RNA, 22 nt, Human
ucagagaauucgauuaaaugca

SEQ ID NO: 622947 - RNA, 22 nt, Human
aggcagccaguucagguuucuu

SEQ ID NO: 622948 - RNA, 22 nt, Human
uuacaaagcaggucagcugaaa

SEQ ID NO: 622949 - RNA, 22 nt, Human
ggaggcugagaaguccaagauc

SEQ ID NO: 622950 - RNA, 22 nt, Human
aggcccugggagcagagaugca

SEQ ID NO: 622951 - RNA, 22 nt, Human
aucuguaacaucaguagcagaa

SEQ ID NO: 622952 - RNA, 22 nt, Human
uggagccaguguugcccaacac

SEQ ID NO: 622953 - RNA, 22 nt, Human
gggcuccugccuccuggcaccu

SEQ ID NO: 622954 - RNA, 22 nt, Human
aggcugagugcuccccuagaug

SEQ ID NO: 622955 - RNA, 22 nt, Human
gugucugcucagcuugcuagaa

SEQ ID NO: 622956 - RNA, 22 nt, Human
guucuuugacuccaagaaagua

SEQ ID NO: 622957 - RNA, 22 nt, Human
uauuuugucuucugcucaucac

SEQ ID NO: 622958 - RNA, 22 nt, Human
uauuucuguaacucagggucug

SEQ ID NO: 622959 - RNA, 22 nt, Human
uucugcaucccagaagaggaca

SEQ ID NO: 622960 - RNA, 22 nt, Human
aggcauuuuuguuaaucuuugg

SEQ ID NO: 622961 - RNA, 22 nt, Human
ugugugugaaccauugagggcu

SEQ ID NO: 622962 - RNA, 22 nt, Human
acaauagacccaugacacauac

SEQ ID NO: 622963 - RNA, 22 nt, Human
uguguggccuccauaggguacu

SEQ ID NO: 622964 - RNA, 22 nt, Human
acccugggacuuccgaguugag

SEQ ID NO: 622965 - RNA, 22 nt, Human
cugugggagcacaugacagaua

SEQ ID NO: 622966 - RNA, 22 nt, Human
gagaagcaaucgugacaucucc

SEQ ID NO: 622967 - RNA, 22 nt, Human
uuacuaggccaguuuucacuuu

SEQ ID NO: 622968 - RNA, 22 nt, Human
uagguucacacaucuuccagau

SEQ ID NO: 622969 - RNA, 22 nt, Human
aggagcugggcccaaggaugcu

SEQ ID NO: 622970 - RNA, 22 nt, Human
ugggaaauguguuucuggacca

SEQ ID NO: 622971 - RNA, 22 nt, Human
aggugccaccucuggugcuguc

SEQ ID NO: 622972 - RNA, 20 nt, Human
ugccgggcagccugaggagu

SEQ ID NO: 622973 - RNA, 22 nt, Human
ggugucccaggccagcugugug

SEQ ID NO: 622974 - RNA, 22 nt, Human
ucacaggagucaaggaauagua

SEQ ID NO: 622975 - RNA, 22 nt, Human
uguaugaaugggaaaaggaaac

SEQ ID NO: 622976 - RNA, 22 nt, Human
agugaugguuuccagucacuga

SEQ ID NO: 622977 - RNA, 20 nt, Human
uaugaagauaugugaacagc

SEQ ID NO: 622978 - RNA, 22 nt, Human
gagcauuugguuauaguaauuu

SEQ ID NO: 622979 - RNA, 22 nt, Human
uuuuaugugugaaaugcugucu

SEQ ID NO: 622980 - RNA, 22 nt, Human
ccagcuuuugcacuggacuggg

SEQ ID NO: 622981 - RNA, 22 nt, Human
uucagcaaccagaaaggcuggg

SEQ ID NO: 622982 - RNA, 22 nt, Human
ucaggacaacauguugcuaauc

SEQ ID NO: 622983 - RNA, 22 nt, Human
uguuuuguuuaugagagcacag

SEQ ID NO: 622984 - RNA, 22 nt, Human
cuguggcucaaaaucccaugau

SEQ ID NO: 622985 - RNA, 18 nt, Human
cagcugaggaccaaacug

SEQ ID NO: 622986 - RNA, 22 nt, Human
gugagugucagucaaagguuuu

SEQ ID NO: 622987 - RNA, 22 nt, Human
ggcacugcuguaggcagugagg

SEQ ID NO: 622988 - RNA, 22 nt, Human
cagugagaccuucuaagguggu

SEQ ID NO: 622989 - RNA, 22 nt, Human
cucaggguaaugaaagacgaau

SEQ ID NO: 622990 - RNA, 22 nt, Human
agccugccucagacucaggaua

SEQ ID NO: 622991 - RNA, 22 nt, Human
uccuugagagccacugucuugg

SEQ ID NO: 622992 - RNA, 22 nt, Human
gucuccucuucauauaccuguu

SEQ ID NO: 622993 - RNA, 22 nt, Human
cuggggaacaauuugccacacu

SEQ ID NO: 622994 - RNA, 22 nt, Human
agcagauaguagaacauguaua

SEQ ID NO: 622995 - RNA, 22 nt, Human
gaggaaggauuuaguuugaggg

SEQ ID NO: 622996 - RNA, 22 nt, Human
agaccucaauaccaggcaccac

SEQ ID NO: 622997 - RNA, 22 nt, Human
agaggagaauccguuuccuugc

SEQ ID NO: 622998 - RNA, 22 nt, Human
ccaggaguggcuggugaccuuc

SEQ ID NO: 622999 - RNA, 22 nt, Human
ugcacagguaugcaaagcaugu

SEQ ID NO: 623000 - RNA, 22 nt, Human
aagucucauccguguagcucca

SEQ ID NO: 623001 - RNA, 18 nt, Human
uccaggcuggauugauga

SEQ ID NO: 623002 - RNA, 22 nt, Human
aagagaugaagguccugacugu

SEQ ID NO: 623003 - RNA, 22 nt, Human
ggagagauaggaguccuggacu

SEQ ID NO: 623004 - RNA, 23 nt, Human
uagggcagcugggagggacaugc

SEQ ID NO: 623005 - RNA, 22 nt, Human
uauccuguuuugcacaauuaua

SEQ ID NO: 623006 - RNA, 22 nt, Human
aggcuggccagugcugcagugg

SEQ ID NO: 623007 - RNA, 22 nt, Human
cuaaaaacucuacgaugcacag

SEQ ID NO: 623008 - RNA, 22 nt, Human
gaacagcccuguuaagucuguu

SEQ ID NO: 623009 - RNA, 22 nt, Human
cuguaugauuccauuucuauaa

SEQ ID NO: 623010 - RNA, 22 nt, Human
gccaggcuggugcaaggauauu

SEQ ID NO: 623011 - RNA, 22 nt, Human
gcucgcagaucaccugggggcg

SEQ ID NO: 623012 - RNA, 22 nt, Human
uuaagcauuuauuaugugccag

SEQ ID NO: 623013 - RNA, 21 nt, Human
guguaaacggacucaugcagu

SEQ ID NO: 623014 - RNA, 22 nt, Human
ggcuuuaacaacagaaauuuau

SEQ ID NO: 623015 - RNA, 22 nt, Human
ucaggaaggcaaauugcaugau

SEQ ID NO: 623016 - RNA, 22 nt, Human
cuuaggaauauccacagcaggu

SEQ ID NO: 623017 - RNA, 22 nt, Human
uggccugccuucgcugagcuga

SEQ ID NO: 623018 - RNA, 22 nt, Human
gcagugcuugaagagguggcca

SEQ ID NO: 623019 - RNA, 22 nt, Human
gcagcgaggugaugaaauagcu

SEQ ID NO: 623020 - RNA, 22 nt, Human
uauuuggaaaguuuaucuaucu

SEQ ID NO: 623021 - RNA, 22 nt, Human
aucucugcguccccagcaucga

SEQ ID NO: 623022 - RNA, 22 nt, Human
agggcucaguaaacgguggauu

SEQ ID NO: 623023 - RNA, 22 nt, Human
gugucugcaagauagccaaguc

SEQ ID NO: 623024 - RNA, 22 nt, Human
cucugucagaguguugucccca

SEQ ID NO: 623025 - RNA, 22 nt, Human
gcugaaauuagacugcagaagu

SEQ ID NO: 623026 - RNA, 22 nt, Human
cauugcuuccuaugucccuucu

SEQ ID NO: 623027 - RNA, 18 nt, Human
gaaagugcggggcagggg

SEQ ID NO: 623028 - RNA, 22 nt, Human
ggaagaggcugagccagguccc

SEQ ID NO: 623029 - RNA, 22 nt, Human
aauguguacuuuuucaugcuca

SEQ ID NO: 623030 - RNA, 22 nt, Human
cugaggggucgugggagcccag

SEQ ID NO: 623031 - RNA, 22 nt, Human
uuuagacaucuauaauugcuaa

SEQ ID NO: 623032 - RNA, 22 nt, Human
cuggaaugucugcucaauguuu

SEQ ID NO: 623033 - RNA, 22 nt, Human
ucuuucugcagcacaggggcag

SEQ ID NO: 623034 - RNA, 22 nt, Human
uguguacaagccugaguacaga

SEQ ID NO: 623035 - RNA, 22 nt, Human
aagcaauauacugauaugauua

SEQ ID NO: 623036 - RNA, 22 nt, Human
ucagaacaguucuuaauauugc

SEQ ID NO: 623037 - RNA, 22 nt, Human
cagaugcuuguuggcuggucuc

SEQ ID NO: 623038 - RNA, 22 nt, Human
accagcugaguucucggauggu

SEQ ID NO: 623039 - RNA, 22 nt, Human
aagagcuguaugccauaugauu

SEQ ID NO: 623040 - RNA, 22 nt, Human
ucaaaucagcaagcagcuuccc

SEQ ID NO: 623041 - RNA, 22 nt, Human
ucuguucauaguaguguauaug

SEQ ID NO: 623042 - RNA, 22 nt, Human
augggggaaaguacgagcaugg

SEQ ID NO: 623043 - RNA, 22 nt, Human
augaugaaaacugaagguuagg

SEQ ID NO: 623044 - RNA, 22 nt, Human
ugaacuuuuucucuacgggcca

SEQ ID NO: 623045 - RNA, 19 nt, Human
acugggcuuguccucgugg

SEQ ID NO: 623046 - RNA, 22 nt, Human
gacagagguguccuugagucca

SEQ ID NO: 623047 - RNA, 22 nt, Human
ccucauucuuuccugggccccu

SEQ ID NO: 623048 - RNA, 22 nt, Human
aggcaccucuuaggcugcuacu

SEQ ID NO: 623049 - RNA, 22 nt, Human
aaagauggcccaugaucucuug

SEQ ID NO: 623050 - RNA, 22 nt, Human
ccuggcacacgguggcauucaa

SEQ ID NO: 623051 - RNA, 17 nt, Human
ugcaaacaaucacauau

SEQ ID NO: 623052 - RNA, 22 nt, Human
aguggcagguguguaguauccc

SEQ ID NO: 623053 - RNA, 22 nt, Human
ugcucagaaacgaggugcagcc

SEQ ID NO: 623054 - RNA, 22 nt, Human
cacaggaauuagcagccuaaaa

SEQ ID NO: 623055 - RNA, 22 nt, Human
ugcauugggagagauuagggca

SEQ ID NO: 623056 - RNA, 22 nt, Human
gcacaugguaggcauuugaugu

SEQ ID NO: 623057 - RNA, 22 nt, Human
ggcaggaaaacaaugagccagg

SEQ ID NO: 623058 - RNA, 22 nt, Human
ucaucuuuccucaaaagaucca

SEQ ID NO: 623059 - RNA, 22 nt, Human
ugcagaagacacaagguaacgu

SEQ ID NO: 623060 - RNA, 22 nt, Human
ucccugaaucucgaacuagccu

SEQ ID NO: 623061 - RNA, 22 nt, Human
uuuaagagccuguacaaauauu

SEQ ID NO: 623062 - RNA, 22 nt, Human
uggguccagugcagcugcgcgu

SEQ ID NO: 623063 - RNA, 22 nt, Human
cuguauuuguccucuauuuauu

SEQ ID NO: 623064 - RNA, 22 nt, Human
cuguucuguaagcugcuguugu

SEQ ID NO: 623065 - RNA, 17 nt, Human
uccuggauccauggugg

SEQ ID NO: 623066 - RNA, 22 nt, Human
ugccucaguuucaucugcagaa

SEQ ID NO: 623067 - RNA, 22 nt, Human
ccauccugcauugcuauucaga

SEQ ID NO: 623068 - RNA, 22 nt, Human
ugagcccuugacaucgcccacu

SEQ ID NO: 623069 - RNA, 18 nt, Human
aagucuuggaauuuccac

SEQ ID NO: 623070 - RNA, 22 nt, Human
aaauacaguguguguucuuuga

SEQ ID NO: 623071 - RNA, 22 nt, Human
acacuuaagcaugaaguauaaa

SEQ ID NO: 623072 - RNA, 22 nt, Human
ggucaugcugugaaucagugcu

SEQ ID NO: 623073 - RNA, 22 nt, Human
ggcugcucaaggacucugaucg

SEQ ID NO: 623074 - RNA, 22 nt, Human
aguggcaguuuuauauuucaug

SEQ ID NO: 623075 - RNA, 22 nt, Human
cacaaaauaucaagcacuuuua

SEQ ID NO: 623076 - RNA, 20 nt, Human
cccaggagcugugccccauc

SEQ ID NO: 623077 - RNA, 22 nt, Human
ugccugccuugcugcuggacag

SEQ ID NO: 623078 - RNA, 22 nt, Human
acuucagugugguauaaaacgu

SEQ ID NO: 623079 - RNA, 20 nt, Human
aaaagcagccagagauggua

SEQ ID NO: 623080 - RNA, 22 nt, Human
aagggcuggagacugggucuuc

SEQ ID NO: 623081 - RNA, 22 nt, Human
ccagugccugugggcauggugc

SEQ ID NO: 623082 - RNA, 22 nt, Human
uccuucagaggauaaggaagaa

SEQ ID NO: 623083 - RNA, 22 nt, Human
ugucacaucagggguguugaca

SEQ ID NO: 623084 - RNA, 22 nt, Human
ugaucagcaucuucccagcucg

SEQ ID NO: 623085 - RNA, 19 nt, Human
gccucacaggucucaggcc

SEQ ID NO: 623086 - RNA, 22 nt, Human
ucuguaaaauuaguauaauugu

SEQ ID NO: 623087 - RNA, 22 nt, Human
caaugacacucugcacagugcu

SEQ ID NO: 623088 - RNA, 22 nt, Human
gcugaguguaaugauggcagag

SEQ ID NO: 623089 - RNA, 22 nt, Human
guaugaaagcaucauuccugcu

SEQ ID NO: 623090 - RNA, 22 nt, Human
ccuggggagaagagcuuccccc

SEQ ID NO: 623091 - RNA, 22 nt, Human
gaauauuaguaucaguuauacc

SEQ ID NO: 623092 - RNA, 19 nt, Human
cagaguuugcaggcagagg

SEQ ID NO: 623093 - RNA, 22 nt, Human
ugcaggcuauccuuugcugcaa

SEQ ID NO: 623094 - RNA, 22 nt, Human
uagguucauauucuagaaucau

SEQ ID NO: 623095 - RNA, 22 nt, Human
augaaacaaaccucuauggagu

SEQ ID NO: 623096 - RNA, 22 nt, Human
gcagcccagcagggcccggagc

SEQ ID NO: 623097 - RNA, 22 nt, Human
aaauuuaaggaggugcucacuu

SEQ ID NO: 623098 - RNA, 19 nt, Human
cguccaggugcuggaagau

SEQ ID NO: 623099 - RNA, 22 nt, Human
uccaggagagguguggggacug

SEQ ID NO: 623100 - RNA, 22 nt, Human
ugcacagaugggcuuguucaua

SEQ ID NO: 623101 - RNA, 22 nt, Human
cagcccugcggagguguauacu

SEQ ID NO: 623102 - RNA, 22 nt, Human
aauucugaugauacugcauugu

SEQ ID NO: 623103 - RNA, 19 nt, Human
agcaguggagccaugccug

SEQ ID NO: 623104 - RNA, 22 nt, Human
uucugggccuccuaggacaggc

SEQ ID NO: 623105 - RNA, 22 nt, Human
uaauacaauggaguugggcccc

SEQ ID NO: 623106 - RNA, 22 nt, Human
uuugcaguagacaucuuauuuu

SEQ ID NO: 623107 - RNA, 19 nt, Human
ccuuggaguuccaggugga

SEQ ID NO: 623108 - RNA, 22 nt, Human
cugggagauucaggugaaguuu

SEQ ID NO: 623109 - RNA, 22 nt, Human
agaaaugcucaggucaacuuaa

SEQ ID NO: 623110 - RNA, 22 nt, Human
agagggcagcagcaacaacucu

SEQ ID NO: 623111 - RNA, 22 nt, Human
acacagccgugaaucugcuucu

SEQ ID NO: 623112 - RNA, 22 nt, Human
cugauacaaugcuaauaaauuu

SEQ ID NO: 623113 - RNA, 22 nt, Human
auaaugugauauuucauuuaca

SEQ ID NO: 623114 - RNA, 22 nt, Human
ugucugaguggugcaaggcuga

SEQ ID NO: 623115 - RNA, 22 nt, Human
cccuuggaagguagcuggcagu

SEQ ID NO: 623116 - RNA, 22 nt, Human
gcugcucuggcucugcaguguc

SEQ ID NO: 623117 - RNA, 22 nt, Human
ccuccuggaggcucuagggaaa

SEQ ID NO: 623118 - RNA, 22 nt, Human
ucucugucugagccuggcagac

SEQ ID NO: 623119 - RNA, 22 nt, Human
uugauuuuuuucuacuaugcgc

SEQ ID NO: 623120 - RNA, 22 nt, Human
ugagacagcagucagggaaaua

SEQ ID NO: 623121 - RNA, 22 nt, Human
aucuccaggauuuucacacuca

SEQ ID NO: 623122 - RNA, 22 nt, Human
aaucacaaaugcaaguugucac

SEQ ID NO: 623123 - RNA, 22 nt, Human
ccugacaggagaagcgcagcau

SEQ ID NO: 623124 - RNA, 22 nt, Human
acuccaguucucuuguuuauaa

SEQ ID NO: 623125 - RNA, 22 nt, Human
cccagggaggcccaggcucugc

SEQ ID NO: 623126 - RNA, 22 nt, Human
cagcuuuauuucacguguuugu

SEQ ID NO: 623127 - RNA, 22 nt, Human
acagacaaguaguucagacaag

SEQ ID NO: 623128 - RNA, 22 nt, Human
acaaaggugcgucccuucagcu

SEQ ID NO: 623129 - RNA, 22 nt, Human
cagauauaaauggaugugguag

SEQ ID NO: 623130 - RNA, 22 nt, Human
uuuacagcuagacauaccugag

SEQ ID NO: 623131 - RNA, 22 nt, Human
uacacaauucuggaugcauguc

SEQ ID NO: 623132 - RNA, 22 nt, Human
gacugcaaccuuagacuagaaa

SEQ ID NO: 623133 - RNA, 19 nt, Human
uccaggccauucccagagc

SEQ ID NO: 623134 - RNA, 21 nt, Human
gguguccagaggaguccccag

SEQ ID NO: 623135 - RNA, 22 nt, Human
auguuuuauauuuugcagcagu

SEQ ID NO: 623136 - RNA, 22 nt, Human
ugcagcucuguaugcugauuau

SEQ ID NO: 623137 - RNA, 22 nt, Human
cuucuuuuacaggucuuggguu

SEQ ID NO: 623138 - RNA, 22 nt, Human
ucuucaaaaaauauccaucagu

SEQ ID NO: 623139 - RNA, 16 nt, Human
gagaagagcccggcag

SEQ ID NO: 623140 - RNA, 22 nt, Human
auaugcauguacgugugcacaa

SEQ ID NO: 623141 - RNA, 22 nt, Human
gggcuccagaggcucacccugg

SEQ ID NO: 623142 - RNA, 22 nt, Human
uaacacuaagaaucuaaauuua

SEQ ID NO: 623143 - RNA, 22 nt, Human
aacuuuuacaaauugucaucau

SEQ ID NO: 623144 - RNA, 22 nt, Human
aagauacacguuguauugaaua

SEQ ID NO: 623145 - RNA, 22 nt, Human
cugugggcugaaagugcucccg

SEQ ID NO: 623146 - RNA, 22 nt, Human
uugugcucuguguuauuuaagg

SEQ ID NO: 623147 - RNA, 23 nt, Human
uggccaggguacuacacccaccc

SEQ ID NO: 623148 - RNA, 22 nt, Human
ccggggacuuaaagugaaggaa

SEQ ID NO: 623149 - RNA, 22 nt, Human
ugcacagacaacucuuucuaga

SEQ ID NO: 623150 - RNA, 22 nt, Human
aaaaaauuccauucugugccuu

SEQ ID NO: 623151 - RNA, 22 nt, Human
aaagaugaccguaugucagagc

SEQ ID NO: 623152 - RNA, 23 nt, Human
auaugucaugcaccagcacuuua

SEQ ID NO: 623153 - RNA, 22 nt, Human
uaauauuucuacccugcugccu

SEQ ID NO: 623154 - RNA, 22 nt, Human
guaagcaucugucucuucugca

SEQ ID NO: 623155 - RNA, 22 nt, Human
acagcuuugggcaaugcuauga

SEQ ID NO: 623156 - RNA, 22 nt, Human
cugcuucacuucgguugcauag

SEQ ID NO: 623157 - RNA, 22 nt, Human
aaggaaaugagguugauggaug

SEQ ID NO: 623158 - RNA, 22 nt, Human
uggcugaggcuuuucuuaaaga

SEQ ID NO: 623159 - RNA, 22 nt, Human
auaagguuggucuuaacuaccu

SEQ ID NO: 623160 - RNA, 22 nt, Human
ccacugaggccugggcccaggg

SEQ ID NO: 623161 - RNA, 22 nt, Human
uguuuccagaauguagcugcuu

SEQ ID NO: 623162 - RNA, 22 nt, Human
ucuguggaaauuuccugaggca

SEQ ID NO: 623163 - RNA, 22 nt, Human
ggcucugcaugugagugggugg

SEQ ID NO: 623164 - RNA, 23 nt, Human
gccaugaguucccuuucacuugu

SEQ ID NO: 623165 - RNA, 22 nt, Human
uaaauguaccuucugccuuacu

SEQ ID NO: 623166 - RNA, 22 nt, Human
aggaccugaaauucuugcuuuu

SEQ ID NO: 623167 - RNA, 19 nt, Human
uccuucagucagaucuggg

SEQ ID NO: 623168 - RNA, 22 nt, Human
aaagccaggcagccaagccagu

SEQ ID NO: 623169 - RNA, 22 nt, Human
ggugcaggaaaauuaccuggag

SEQ ID NO: 623170 - RNA, 22 nt, Human
agugcagagagcaauacucuac

SEQ ID NO: 623171 - RNA, 22 nt, Human
agcugcaacaucugcuuguccc

SEQ ID NO: 623172 - RNA, 22 nt, Human
uagaauucaagauucaacaggc

SEQ ID NO: 623173 - RNA, 22 nt, Human
cuuugaaagcucccaggacuua

SEQ ID NO: 623174 - RNA, 22 nt, Human
gcucugcccaggaccguccuug

SEQ ID NO: 623175 - RNA, 22 nt, Human
ucaugcaaagccaauuccagcu

SEQ ID NO: 623176 - RNA, 22 nt, Human
uccaggucccuggggagauuuu

SEQ ID NO: 623177 - RNA, 19 nt, Human
gagcccucuccauggccac

SEQ ID NO: 623178 - RNA, 22 nt, Human
acccagagaacugaggcaugaa

SEQ ID NO: 623179 - RNA, 23 nt, Human
agguucagcuuucuuacucuggg

SEQ ID NO: 623180 - RNA, 22 nt, Human
cucccaagauaaauaaggcagu

SEQ ID NO: 623181 - RNA, 22 nt, Human
uccugaagaacgaagucaugua

SEQ ID NO: 623182 - RNA, 22 nt, Human
uacagaacugaaguagugaaaa

SEQ ID NO: 623183 - RNA, 22 nt, Human
uuucauugaugggugauagaaa

SEQ ID NO: 623184 - RNA, 22 nt, Human
ugcuggcuggccuggccuggac

SEQ ID NO: 623185 - RNA, 22 nt, Human
ccugccagcccccauagagaca

SEQ ID NO: 623186 - RNA, 22 nt, Human
gcagcagcucagccgggcacug

SEQ ID NO: 623187 - RNA, 22 nt, Human
gcuacagacugagcauggcucu

SEQ ID NO: 623188 - RNA, 22 nt, Human
uccuggacucaggaccacagga

SEQ ID NO: 623189 - RNA, 22 nt, Human
aggguggcaccacauaucauag

SEQ ID NO: 623190 - RNA, 22 nt, Human
gguggagcugugaguagaaucu

SEQ ID NO: 623191 - RNA, 22 nt, Human
ccaggcauggggagagccagau

SEQ ID NO: 623192 - RNA, 22 nt, Human
ugcagaauguggacaguggguu

SEQ ID NO: 623193 - RNA, 22 nt, Human
ggcuagggaaauccugauccaa

SEQ ID NO: 623194 - RNA, 22 nt, Human
uuauugcuggcaccuucaauuc

SEQ ID NO: 623195 - RNA, 22 nt, Human
gaaaggagggaaacagagcggu

SEQ ID NO: 623196 - RNA, 22 nt, Human
acagaauuaacauuugaugaau

SEQ ID NO: 623197 - RNA, 22 nt, Human
cuagugaacgugguacuaugga

SEQ ID NO: 623198 - RNA, 22 nt, Human
gccaggaacacaaugccaagcu

SEQ ID NO: 623199 - RNA, 22 nt, Human
ugaccuuucaacccuucuuggc

SEQ ID NO: 623200 - RNA, 22 nt, Human
accagcuguuaggcuuggugcu

SEQ ID NO: 623201 - RNA, 22 nt, Human
cucuguccuugcacaguuccua

SEQ ID NO: 623202 - RNA, 22 nt, Human
cuggagagaccgaaagaggcug

SEQ ID NO: 623203 - RNA, 22 nt, Human
gugucugaguuuggaaagucca

SEQ ID NO: 623204 - RNA, 22 nt, Human
gagagcugucagcguagcaccg

SEQ ID NO: 623205 - RNA, 22 nt, Human
aaacaaugagcuuuuacacacu

SEQ ID NO: 623206 - RNA, 22 nt, Human
gucugugugcacagcgagugcc

SEQ ID NO: 623207 - RNA, 22 nt, Human
cuggaguguaaagagcauagaa

SEQ ID NO: 623208 - RNA, 22 nt, Human
acuggcaguggcagcagaaaga

SEQ ID NO: 623209 - RNA, 22 nt, Human
uuuagaagacagaugcacagcc

SEQ ID NO: 623210 - RNA, 22 nt, Human
cuguggagcagggcagggucac

SEQ ID NO: 623211 - RNA, 22 nt, Human
ucuggccacccgaggccccugc

SEQ ID NO: 623212 - RNA, 20 nt, Human
agaaguuuggggguguggag

SEQ ID NO: 623213 - RNA, 22 nt, Human
ggagggcaacuuuucaguaggu

SEQ ID NO: 623214 - RNA, 22 nt, Human
cgcugauaaacgucacguuccc

SEQ ID NO: 623215 - RNA, 22 nt, Human
ccugaauacuggugcugaaagu

SEQ ID NO: 623216 - RNA, 22 nt, Human
ggaggucauagcugugcaggua

SEQ ID NO: 623217 - RNA, 22 nt, Human
ucaguuugaauguuagcacagu

SEQ ID NO: 623218 - RNA, 22 nt, Human
ccaccaggacagcccugagggg

SEQ ID NO: 623219 - RNA, 22 nt, Human
cucugccugcccaccgacccau

SEQ ID NO: 623220 - RNA, 19 nt, Human
aggacucuggaggcaugag

SEQ ID NO: 623221 - RNA, 22 nt, Human
aauggcuuaaguauaagugaga

SEQ ID NO: 623222 - RNA, 22 nt, Human
uccccagauggccagcuacaug

SEQ ID NO: 623223 - RNA, 22 nt, Human
uuguaacuguggguugauuaga

SEQ ID NO: 623224 - RNA, 22 nt, Human
gggauggggggaagcguccaug

SEQ ID NO: 623225 - RNA, 22 nt, Human
acugggaggcaaagagcaagga

SEQ ID NO: 623226 - RNA, 22 nt, Human
uggacaacauagugagaccuca

SEQ ID NO: 623227 - RNA, 23 nt, Human
aacacaaagcugauuccaguggc

SEQ ID NO: 623228 - RNA, 22 nt, Human
uaguauuuauaaucaugcuuaa

SEQ ID NO: 623229 - RNA, 22 nt, Human
gaaaucaauuucuugguugaua

SEQ ID NO: 623230 - RNA, 22 nt, Human
aagaagugguuggaagaagcau

SEQ ID NO: 623231 - RNA, 22 nt, Human
uggcucugcagcagugugcgug

SEQ ID NO: 623232 - RNA, 22 nt, Human
ugucuugacuuuagagccagga

SEQ ID NO: 623233 - RNA, 22 nt, Human
uugcuucagucagugcugccca

SEQ ID NO: 623234 - RNA, 22 nt, Human
guguaugcagaaacaugcaaag

SEQ ID NO: 623235 - RNA, 22 nt, Human
ucacuguaauagguuugaagau

SEQ ID NO: 623236 - RNA, 22 nt, Human
cagcuggcauaccugggcccgg

SEQ ID NO: 623237 - RNA, 22 nt, Human
gaccauuucuaggaaucagacu

SEQ ID NO: 623238 - RNA, 22 nt, Human
aagaguuuaccagugcugcuuc

SEQ ID NO: 623239 - RNA, 22 nt, Human
agaacacuuuuaaauggcuugu

SEQ ID NO: 623240 - RNA, 22 nt, Human
aaauggauggaauugacauuua

SEQ ID NO: 623241 - RNA, 22 nt, Human
augcaaaugcuagagaauguug

SEQ ID NO: 623242 - RNA, 22 nt, Human
uacauuguuuuuucuugccauc

SEQ ID NO: 623243 - RNA, 22 nt, Human
caguaaauuuuauuugugggug

SEQ ID NO: 623244 - RNA, 22 nt, Human
uuuaugucaaaacuacaguugg

SEQ ID NO: 623245 - RNA, 22 nt, Human
ucagcagugugcuuggaaugga

SEQ ID NO: 623246 - RNA, 20 nt, Human
acuuggaacucauuuuucuu

SEQ ID NO: 623247 - RNA, 22 nt, Human
gggaagggagggccuccaguca

SEQ ID NO: 623248 - RNA, 19 nt, Human
ggagaagcccaggaauccu

SEQ ID NO: 623249 - RNA, 22 nt, Human
gacuguacgucauugaaggcca

SEQ ID NO: 623250 - RNA, 22 nt, Human
cugcuguccaggagugcccugu

SEQ ID NO: 623251 - RNA, 22 nt, Human
uaggaaauugacaccugcuuga

SEQ ID NO: 623252 - RNA, 22 nt, Human
uaagaugguuguagauggacug

SEQ ID NO: 623253 - RNA, 22 nt, Human
ucacccagauuacauccuguca

SEQ ID NO: 623254 - RNA, 22 nt, Human
uguacuuccccaaugacagcac

SEQ ID NO: 623255 - RNA, 22 nt, Human
cccaggaaugagcaggcagggg

SEQ ID NO: 623256 - RNA, 22 nt, Human
ggagagggggcucccugcuugg

SEQ ID NO: 623257 - RNA, 22 nt, Human
uggccagaguugaggggguuuc

SEQ ID NO: 623258 - RNA, 22 nt, Human
agcugaauguucucagaccaga

SEQ ID NO: 623259 - RNA, 21 nt, Human
ugagagacugguggauacagg

SEQ ID NO: 623260 - RNA, 22 nt, Human
gagaggcauggaacagauucuu

SEQ ID NO: 623261 - RNA, 22 nt, Human
gcaggaguuaggcgucguggau

SEQ ID NO: 623262 - RNA, 22 nt, Human
ucccugugccuauaugugcuga

SEQ ID NO: 623263 - RNA, 22 nt, Human
auguuuuaaauauguguguaaa

SEQ ID NO: 623264 - RNA, 22 nt, Human
ugcaaaucauaaacaauagugu

SEQ ID NO: 623265 - RNA, 22 nt, Human
gauauauuuuccauggucugca

SEQ ID NO: 623266 - RNA, 22 nt, Human
gggucagggcugccugggcuca

SEQ ID NO: 623267 - RNA, 22 nt, Human
ugucuacugagaagcuaugcaa

SEQ ID NO: 623268 - RNA, 22 nt, Human
uguaugaaagaacaagggcuua

SEQ ID NO: 623269 - RNA, 22 nt, Human
uuacuuuggauggucaagaaag

SEQ ID NO: 623270 - RNA, 22 nt, Human
uucuaacuccacuucccacucc

SEQ ID NO: 623271 - RNA, 22 nt, Human
ugaaggaauggaggaucagagc

SEQ ID NO: 623272 - RNA, 22 nt, Human
ggguacaguucuuccaguguca

SEQ ID NO: 623273 - RNA, 20 nt, Human
caguccaaucagaggccacc

SEQ ID NO: 623274 - RNA, 22 nt, Human
aggaaauaagggcacuucagau

SEQ ID NO: 623275 - RNA, 22 nt, Human
guuuuuucaugaguaguuaucu

SEQ ID NO: 623276 - RNA, 22 nt, Human
aggucaaggccaaaagaguggu

SEQ ID NO: 623277 - RNA, 22 nt, Human
uaaaugcaaugugcuuuaccag

SEQ ID NO: 623278 - RNA, 22 nt, Human
aggcugugugcuccuuaugaga

SEQ ID NO: 623279 - RNA, 22 nt, Human
ucuccaggugcuaagugugccu

SEQ ID NO: 623280 - RNA, 22 nt, Human
acauggaauguguacuaaguua

SEQ ID NO: 623281 - RNA, 22 nt, Human
auuuacacugguucucagagcu

SEQ ID NO: 623282 - RNA, 22 nt, Human
uucugcaggaugcucugguggu

SEQ ID NO: 623283 - RNA, 22 nt, Human
agguuugguuugacaagacuga

SEQ ID NO: 623284 - RNA, 22 nt, Human
aggggccuggcacugagcuggc

SEQ ID NO: 623285 - RNA, 22 nt, Human
acauuuugaaagggaaauuguu

SEQ ID NO: 623286 - RNA, 22 nt, Human
aggcaggaacccugugugcgcc

SEQ ID NO: 623287 - RNA, 22 nt, Human
ugaggaaugcugagcagaggaa

SEQ ID NO: 623288 - RNA, 22 nt, Human
ucaggagggaguguggauagag

SEQ ID NO: 623289 - RNA, 22 nt, Human
auucaguuaagggucuugagau

SEQ ID NO: 623290 - RNA, 22 nt, Human
gcaguguuucaaaucaaaggca

SEQ ID NO: 623291 - RNA, 22 nt, Human
ugagauaacaaaauuaucuuca

SEQ ID NO: 623292 - RNA, 22 nt, Human
acaaguuuuggaagucuuaagg

SEQ ID NO: 623293 - RNA, 22 nt, Human
ggcugggucccagcugggagga

SEQ ID NO: 623294 - RNA, 22 nt, Human
guggccaagagauaaaauugug

SEQ ID NO: 623295 - RNA, 22 nt, Human
ucagaggagaccaaggggaaua

SEQ ID NO: 623296 - RNA, 22 nt, Human
auaacauggaguuugucauuua

SEQ ID NO: 623297 - RNA, 20 nt, Human
aagcaucuggauguagcaau

SEQ ID NO: 623298 - RNA, 22 nt, Human
cugugcuuguguucauuguuaa

SEQ ID NO: 623299 - RNA, 22 nt, Human
cccuaggguuuggccagagccc

SEQ ID NO: 623300 - RNA, 22 nt, Human
gagauuuaauuggauuaacuua

SEQ ID NO: 623301 - RNA, 20 nt, Human
ucugagguaugauagggucu

SEQ ID NO: 623302 - RNA, 22 nt, Human
uguagcacguuaguguuagagc

SEQ ID NO: 623303 - RNA, 22 nt, Human
acaagucuuuuucaugucuucu

SEQ ID NO: 623304 - RNA, 22 nt, Human
ucaguguuugguuucagaauug

SEQ ID NO: 623305 - RNA, 22 nt, Human
cauccaaacucucauuaucugu

SEQ ID NO: 623306 - RNA, 22 nt, Human
uugacagcaaagauugugccua

SEQ ID NO: 623307 - RNA, 22 nt, Human
cccucagucuggcugggaagac

SEQ ID NO: 623308 - RNA, 22 nt, Human
uuaugcagauggcaugaggagg

SEQ ID NO: 623309 - RNA, 22 nt, Human
gauucugcugucccuaagugcc

SEQ ID NO: 623310 - RNA, 19 nt, Human
agggaaggauucugucauu

SEQ ID NO: 623311 - RNA, 22 nt, Human
augaggcagguggaggcugcca

SEQ ID NO: 623312 - RNA, 22 nt, Human
cauccagggcagccauggccug

SEQ ID NO: 623313 - RNA, 22 nt, Human
acacaugcacaacaguucuuuc

SEQ ID NO: 623314 - RNA, 22 nt, Human
guucuuggaccagcagcauuga

SEQ ID NO: 623315 - RNA, 19 nt, Human
uccagcuguuuugagucac

SEQ ID NO: 623316 - RNA, 22 nt, Human
uccugagcuuuacaguaaggac

SEQ ID NO: 623317 - RNA, 22 nt, Human
aaauggaagaagugcaauacug

SEQ ID NO: 623318 - RNA, 22 nt, Human
ggaaagagcuaaaagggugaga

SEQ ID NO: 623319 - RNA, 22 nt, Human
caaaaugugagucccaccucaa

SEQ ID NO: 623320 - RNA, 22 nt, Human
aaggguuugucucccucaaggc

SEQ ID NO: 623321 - RNA, 22 nt, Human
uaguacacuaccaucagguuuu

SEQ ID NO: 623322 - RNA, 22 nt, Human
aaaaucucauuaucaggaaggg

SEQ ID NO: 623323 - RNA, 22 nt, Human
ccagggccuacagcuuaagucc

SEQ ID NO: 623324 - RNA, 22 nt, Human
aguggugcugcgcgcggagcuc

SEQ ID NO: 623325 - RNA, 22 nt, Human
aaagcuucuauucacuuacuug

SEQ ID NO: 623326 - RNA, 22 nt, Human
acucuauaaagauaccucaauu

SEQ ID NO: 623327 - RNA, 20 nt, Human
aggcacuggauuucuuauau

SEQ ID NO: 623328 - RNA, 22 nt, Human
ugcaucuguucauucguuccca

SEQ ID NO: 623329 - RNA, 20 nt, Human
aaacugucugucaguaucua

SEQ ID NO: 623330 - RNA, 22 nt, Human
ggcggagguugcaguaagccga

SEQ ID NO: 623331 - RNA, 22 nt, Human
ggacagcauucuacuguaggca

SEQ ID NO: 623332 - RNA, 22 nt, Human
ggcacucaauaaauguugccaa

SEQ ID NO: 623333 - RNA, 22 nt, Human
uacaguaauaaaaugagcuaca

SEQ ID NO: 623334 - RNA, 22 nt, Human
acagcagggaauaugggaauug

SEQ ID NO: 623335 - RNA, 22 nt, Human
cacugcccaggcacccaucuug

SEQ ID NO: 623336 - RNA, 22 nt, Human
agaugcagacuugguucaggca

SEQ ID NO: 623337 - RNA, 22 nt, Human
uagggcucuggugggcucuguu

SEQ ID NO: 623338 - RNA, 22 nt, Human
cgggcagcggcguggccauggu

SEQ ID NO: 623339 - RNA, 22 nt, Human
cuuggaacuuaguaauaugaca

SEQ ID NO: 623340 - RNA, 22 nt, Human
aagcaauacaaguggucauuga

SEQ ID NO: 623341 - RNA, 22 nt, Human
gucuacacugaauuuccacaga

SEQ ID NO: 623342 - RNA, 22 nt, Human
acaguggaguugggguagcccu

SEQ ID NO: 623343 - RNA, 22 nt, Human
uagacuuuuaagucccucuuua

SEQ ID NO: 623344 - RNA, 22 nt, Human
uauaggcucuuguuaaccuuuu

SEQ ID NO: 623345 - RNA, 22 nt, Human
uucaagucaaggaaagaggucu

SEQ ID NO: 623346 - RNA, 22 nt, Human
ugggccagcaauugcugcucag

SEQ ID NO: 623347 - RNA, 20 nt, Human
gccaaggaggagaaacaggc

SEQ ID NO: 623348 - RNA, 22 nt, Human
aaugucaauuaccagaacagaa

SEQ ID NO: 623349 - RNA, 22 nt, Human
agcacaguuuucauugcagggu

SEQ ID NO: 623350 - RNA, 22 nt, Human
gccugggacugcagauccccag

SEQ ID NO: 623351 - RNA, 22 nt, Human
acagcuggaggucugugagcac

SEQ ID NO: 623352 - RNA, 22 nt, Human
uucccuggcucuucuacaucgu

SEQ ID NO: 623353 - RNA, 22 nt, Human
ucugaaauccuuuaucuuggcu

SEQ ID NO: 623354 - RNA, 22 nt, Human
ucccuugguaauucuguuccuu

SEQ ID NO: 623355 - RNA, 21 nt, Human
uggcaggcagcuggaagcuug

SEQ ID NO: 623356 - RNA, 22 nt, Human
ccuccuggguucaagcgauucu

SEQ ID NO: 623357 - RNA, 22 nt, Human
ucuguggauuuuaguguucaug

SEQ ID NO: 623358 - RNA, 21 nt, Human
ugaaugcuucgucauccuggc

SEQ ID NO: 623359 - RNA, 22 nt, Human
aaagaauaguuaaguuuagggc

SEQ ID NO: 623360 - RNA, 22 nt, Human
agccagugcaacagcagugaag

SEQ ID NO: 623361 - RNA, 22 nt, Human
ugccucagucuaaagucucuca

SEQ ID NO: 623362 - RNA, 22 nt, Human
uagcacagggcauaugcggugg

SEQ ID NO: 623363 - RNA, 22 nt, Human
cuggacagaaaaggccacugga

SEQ ID NO: 623364 - RNA, 22 nt, Human
ggcagccagagggcagcuggau

SEQ ID NO: 623365 - RNA, 22 nt, Human
aggcaggcccucuggaaaggua

SEQ ID NO: 623366 - RNA, 22 nt, Human
acuuuacuacauccacagaugg

SEQ ID NO: 623367 - RNA, 22 nt, Human
gaggccugaaaggggaccuaug

SEQ ID NO: 623368 - RNA, 22 nt, Human
cuguucuucuaguccacugaca

SEQ ID NO: 623369 - RNA, 22 nt, Human
uucauugaagcacaagugaucu

SEQ ID NO: 623370 - RNA, 21 nt, Human
ucuggcuuucauuccccuucu

SEQ ID NO: 623371 - RNA, 22 nt, Human
ucauccaguuguggagagggaa

SEQ ID NO: 623372 - RNA, 22 nt, Human
caggauggucucgaucuccuga

SEQ ID NO: 623373 - RNA, 18 nt, Human
uguaaacacuuucauucu

SEQ ID NO: 623374 - RNA, 22 nt, Human
gcaccugcuggaaucagucugu

SEQ ID NO: 623375 - RNA, 22 nt, Human
ccuucaaguuccuggucccugg

SEQ ID NO: 623376 - RNA, 22 nt, Human
uguggcacauacacaggagggc

SEQ ID NO: 623377 - RNA, 22 nt, Human
acauuuauauaacucacuagga

SEQ ID NO: 623378 - RNA, 22 nt, Human
auauucacaguaaguguagcag

SEQ ID NO: 623379 - RNA, 22 nt, Human
aucugguucuucuuaggcauca

SEQ ID NO: 623380 - RNA, 22 nt, Human
uuuauuccaguguuucucaaau

SEQ ID NO: 623381 - RNA, 22 nt, Human
gugccucugagcucugcuacag

SEQ ID NO: 623382 - RNA, 22 nt, Human
uagcaaagggaaagaagggccu

SEQ ID NO: 623383 - RNA, 22 nt, Human
uaguccugaccuugccaccagc

SEQ ID NO: 623384 - RNA, 22 nt, Human
ggaggcucuuauuuguucaaca

SEQ ID NO: 623385 - RNA, 22 nt, Human
ucacagaaguugaauuugcaug

SEQ ID NO: 623386 - RNA, 22 nt, Human
gaggcagcaggcugaggaggau

SEQ ID NO: 623387 - RNA, 22 nt, Human
cagcacuuuagcggaggcauca

SEQ ID NO: 623388 - RNA, 21 nt, Human
aucuggaagaacugguaagug

SEQ ID NO: 623389 - RNA, 16 nt, Human
uggaaggggucuccgg

SEQ ID NO: 623390 - RNA, 22 nt, Human
aaaagucuuggggaaggccagg

SEQ ID NO: 623391 - RNA, 22 nt, Human
aggccagcagcaugacggcauc

SEQ ID NO: 623392 - RNA, 22 nt, Human
ucuaaaaaagucuguucacuug

SEQ ID NO: 623393 - RNA, 19 nt, Human
cuucagcaucuccggagcu

SEQ ID NO: 623394 - RNA, 22 nt, Human
ccaggcccccgagcagaagaca

SEQ ID NO: 623395 - RNA, 22 nt, Human
gucucagggacugcuucugggg

SEQ ID NO: 623396 - RNA, 22 nt, Human
uuauugacuuguuuguccuggu

SEQ ID NO: 623397 - RNA, 22 nt, Human
uuuccaaaggcuaaacucaguu

SEQ ID NO: 623398 - RNA, 22 nt, Human
cucaggaguuggaggcuacagu

SEQ ID NO: 623399 - RNA, 22 nt, Human
ucugggcugugggaauucaaca

SEQ ID NO: 623400 - RNA, 22 nt, Human
gcuggcucuuuuugccgggcuc

SEQ ID NO: 623401 - RNA, 22 nt, Human
uucuggaagcugggcagcaccc

SEQ ID NO: 623402 - RNA, 22 nt, Human
uucuacauucauguauuaccuc

SEQ ID NO: 623403 - RNA, 22 nt, Human
ugucucagauacgccaucaagg

SEQ ID NO: 623404 - RNA, 22 nt, Human
gagcccugcggagccccgaggc

SEQ ID NO: 623405 - RNA, 22 nt, Human
uuucagaauaucgauucaguga

SEQ ID NO: 623406 - RNA, 22 nt, Human
ggccaugggaagagguggagag

SEQ ID NO: 623407 - RNA, 22 nt, Human
aacccaggagacagguugcagu

SEQ ID NO: 623408 - RNA, 20 nt, Human
uuuuucugggcuuccauagc

SEQ ID NO: 623409 - RNA, 22 nt, Human
ucucugggagccaggaugacac

SEQ ID NO: 623410 - RNA, 22 nt, Human
uagugcuuuggagcuuucuccu

SEQ ID NO: 623411 - RNA, 22 nt, Human
cuggacucacuauggcuucaga

SEQ ID NO: 623412 - RNA, 22 nt, Human
ggugcagagcagugucagagca

SEQ ID NO: 623413 - RNA, 22 nt, Human
guauauaugugugaacauguau

SEQ ID NO: 623414 - RNA, 23 nt, Human
ugcguacggcugccagugugacu

SEQ ID NO: 623415 - RNA, 22 nt, Human
cugggcuuugguacugugauua

SEQ ID NO: 623416 - RNA, 22 nt, Human
augcuucuuguauuuggcugac

SEQ ID NO: 623417 - RNA, 22 nt, Human
ugucugucuuuagugagauugc

SEQ ID NO: 623418 - RNA, 22 nt, Human
gugcuccaggucgcucagagag

SEQ ID NO: 623419 - RNA, 22 nt, Human
cuguacaggagacgucugugca

SEQ ID NO: 623420 - RNA, 22 nt, Human
uguacagauugaucauggagag

SEQ ID NO: 623421 - RNA, 22 nt, Human
ucuggcucauacaagccugcaa

SEQ ID NO: 623422 - RNA, 22 nt, Human
uaugcccagcuuaaaguacaca

SEQ ID NO: 623423 - RNA, 22 nt, Human
ccaggagccacucaggcccaca

SEQ ID NO: 623424 - RNA, 22 nt, Human
ucucuucuagcuucuugugguu

SEQ ID NO: 623425 - RNA, 22 nt, Human
ccucucuguguggccucuccau

SEQ ID NO: 623426 - RNA, 22 nt, Human
guuaacauuucuaggugcaggg

SEQ ID NO: 623427 - RNA, 20 nt, Human
uccacaucuuuugagaugug

SEQ ID NO: 623428 - RNA, 22 nt, Human
uucugucucuguguuuacauua

SEQ ID NO: 623429 - RNA, 22 nt, Human
uuuauuuauccuucuggauugc

SEQ ID NO: 623430 - RNA, 22 nt, Human
aaggaaccuggaguagagggag

SEQ ID NO: 623431 - RNA, 22 nt, Human
uuuacagagaauguacauaaag

SEQ ID NO: 623432 - RNA, 22 nt, Human
uuucacaggaguccuuucuaua

SEQ ID NO: 623433 - RNA, 22 nt, Human
cuggcaggucucgcugacgugu

SEQ ID NO: 623434 - RNA, 22 nt, Human
guucauucaucaaauauuuacu

SEQ ID NO: 623435 - RNA, 22 nt, Human
ugguauucuuucuguagaucau

SEQ ID NO: 623436 - RNA, 22 nt, Human
agccagggagguggagguugca

SEQ ID NO: 623437 - RNA, 22 nt, Human
ugugaaaugaguauauuugaau

SEQ ID NO: 623438 - RNA, 22 nt, Human
ggcuucuggugggagcaugacu

SEQ ID NO: 623439 - RNA, 22 nt, Human
acacauguauggcacuuacauu

SEQ ID NO: 623440 - RNA, 22 nt, Human
ccugucuguccucucaugagcc

SEQ ID NO: 623441 - RNA, 22 nt, Human
gcucugccagacacuguggcca

SEQ ID NO: 623442 - RNA, 22 nt, Human
aaagguuuugcccuggguauuc

SEQ ID NO: 623443 - RNA, 22 nt, Human
aacagcauaccaauguacauau

SEQ ID NO: 623444 - RNA, 22 nt, Human
agaucagaguggauugugcugc

SEQ ID NO: 623445 - RNA, 22 nt, Human
ucuguaaucuuccccagcucag

SEQ ID NO: 623446 - RNA, 22 nt, Human
agagacaaugccaaugcacacg

SEQ ID NO: 623447 - RNA, 22 nt, Human
agagcuguucagcagccagguu

SEQ ID NO: 623448 - RNA, 17 nt, Human
auguggcuaagcugcug

SEQ ID NO: 623449 - RNA, 17 nt, Human
ugcucuguggucuuuua

SEQ ID NO: 623450 - RNA, 22 nt, Human
cacuguugaagauacuuccucu

SEQ ID NO: 623451 - RNA, 22 nt, Human
uaagcaaugagauaaucauggg

SEQ ID NO: 623452 - RNA, 22 nt, Human
ugguggcaaaguacaaagugac

SEQ ID NO: 623453 - RNA, 22 nt, Human
agucaccaucuguggcagccug

SEQ ID NO: 623454 - RNA, 22 nt, Human
aaaaugcugggaaaguuggaau

SEQ ID NO: 623455 - RNA, 23 nt, Human
caacagcuguuagauaugggcuu

SEQ ID NO: 623456 - RNA, 22 nt, Human
agcccaggucuggcccagccug

SEQ ID NO: 623457 - RNA, 22 nt, Human
cagucacuggaauagcugagga

SEQ ID NO: 623458 - RNA, 22 nt, Human
ggccuaggauucugcauuucua

SEQ ID NO: 623459 - RNA, 22 nt, Human
ucuuucugcacuuaguggggcu

SEQ ID NO: 623460 - RNA, 22 nt, Human
uggaagagguggaaguggcuuc

SEQ ID NO: 623461 - RNA, 22 nt, Human
gcuuugcuuccuguucuagccu

SEQ ID NO: 623462 - RNA, 22 nt, Human
gggcagguuggcaucccgggca

SEQ ID NO: 623463 - RNA, 22 nt, Human
ggggacccucaggacugcgucu

SEQ ID NO: 623464 - RNA, 22 nt, Human
aauauguucaaaauagaucacu

SEQ ID NO: 623465 - RNA, 17 nt, Human
ggcagccucaggcguuu

SEQ ID NO: 623466 - RNA, 22 nt, Human
gggcaggcugagcaugucaccu

SEQ ID NO: 623467 - RNA, 22 nt, Human
acuauacugucucuuauagaua

SEQ ID NO: 623468 - RNA, 22 nt, Human
gcccuccaccuggucucucugg

SEQ ID NO: 623469 - RNA, 22 nt, Human
acagccuguguaccagcuggga

SEQ ID NO: 623470 - RNA, 22 nt, Human
uguguguguccucauuugcaga

SEQ ID NO: 623471 - RNA, 22 nt, Human
uuucagagggcagaucuggggc

SEQ ID NO: 623472 - RNA, 22 nt, Human
uuacaguagcuuuauuuggagu

SEQ ID NO: 623473 - RNA, 22 nt, Human
gggccaugagagguucaucaac

SEQ ID NO: 623474 - RNA, 22 nt, Human
gugcugagcacaccuuggagca

SEQ ID NO: 623475 - RNA, 19 nt, Human
aagaagcaauaagcuguga

SEQ ID NO: 623476 - RNA, 22 nt, Human
guaugaaguuggacuguauaaa

SEQ ID NO: 623477 - RNA, 21 nt, Human
gcuggcugucccagggaagca

SEQ ID NO: 623478 - RNA, 22 nt, Human
ccagggcugagcugugaccaug

SEQ ID NO: 623479 - RNA, 22 nt, Human
gcuggagccauuggcuuggccu

SEQ ID NO: 623480 - RNA, 22 nt, Human
ugucucagggcagcagcagggg

SEQ ID NO: 623481 - RNA, 22 nt, Human
ccucagaagcucaaggacauug

SEQ ID NO: 623482 - RNA, 22 nt, Human
ugaaaauggccugaagaagcaa

SEQ ID NO: 623483 - RNA, 22 nt, Human
guuaaagaguuuggcuuucuuc

SEQ ID NO: 623484 - RNA, 22 nt, Human
acagaauuaggagauccucuug

SEQ ID NO: 623485 - RNA, 22 nt, Human
ucacaucauuaagacuucuccu

SEQ ID NO: 623486 - RNA, 22 nt, Human
uguguuggcuugccuguuaggc

SEQ ID NO: 623487 - RNA, 22 nt, Human
uaucaagagucucuacauuaau

SEQ ID NO: 623488 - RNA, 22 nt, Human
ugaacucucccccauugcccuc

SEQ ID NO: 623489 - RNA, 22 nt, Human
ucagggucagauuccagagccu

SEQ ID NO: 623490 - RNA, 22 nt, Human
aaggcagcuucaccacagcauu

SEQ ID NO: 623491 - RNA, 22 nt, Human
ugaggaugguguuggagagggc

SEQ ID NO: 623492 - RNA, 19 nt, Human
gagaggccugugcuugaag

SEQ ID NO: 623493 - RNA, 22 nt, Human
caggaaguggcugggcuggguu

SEQ ID NO: 623494 - RNA, 22 nt, Human
gugcuuugucuucaggaucaua

SEQ ID NO: 623495 - RNA, 22 nt, Human
aguguucagugauugucaaccg

SEQ ID NO: 623496 - RNA, 22 nt, Human
gaagcagugugaacccauguaa

SEQ ID NO: 623497 - RNA, 22 nt, Human
uuagggaaauaaaauuaucagu

SEQ ID NO: 623498 - RNA, 22 nt, Human
acaaugaaagguauucugaacu

SEQ ID NO: 623499 - RNA, 22 nt, Human
uggaaggagacugggaagugug

SEQ ID NO: 623500 - RNA, 22 nt, Human
caggcugucugaauggaggccc

SEQ ID NO: 623501 - RNA, 22 nt, Human
cucaaggaaagucuggagaaga

SEQ ID NO: 623502 - RNA, 22 nt, Human
cagggccagcccacuagcgagg

SEQ ID NO: 623503 - RNA, 22 nt, Human
cuauuuguacagcauucgaguu

SEQ ID NO: 623504 - RNA, 22 nt, Human
uacauucagaagaauggacacg

SEQ ID NO: 623505 - RNA, 22 nt, Human
auggaguaauauuaacauguua

SEQ ID NO: 623506 - RNA, 22 nt, Human
guauuuggugaugccuccaaac

SEQ ID NO: 623507 - RNA, 22 nt, Human
cugggcuguuuguucuggucuc

SEQ ID NO: 623508 - RNA, 22 nt, Human
ucaacucacaagaaugagcaag

SEQ ID NO: 623509 - RNA, 22 nt, Human
ggauucuacugaucagcaccac

SEQ ID NO: 623510 - RNA, 22 nt, Human
ccagagucccuugcagcucagu

SEQ ID NO: 623511 - RNA, 22 nt, Human
aaaugcaccuugcugugagacu

SEQ ID NO: 623512 - RNA, 22 nt, Human
auuuugcugcuaugccuugcaa

SEQ ID NO: 623513 - RNA, 22 nt, Human
uuuauuuaccuuauguccucca

SEQ ID NO: 623514 - RNA, 22 nt, Human
auuucagcaaaguuuugauugg

SEQ ID NO: 623515 - RNA, 22 nt, Human
ugaaagaguuugacaugauucu

SEQ ID NO: 623516 - RNA, 22 nt, Human
ucaggaaaggcagagugucugu

SEQ ID NO: 623517 - RNA, 22 nt, Human
uccuuggagucaugauggaggu

SEQ ID NO: 623518 - RNA, 22 nt, Human
aggcacuguggguguggccgga

SEQ ID NO: 623519 - RNA, 22 nt, Human
gauaaauggcugaagaaauagu

SEQ ID NO: 623520 - RNA, 22 nt, Human
augccaaauucucagccucuuu

SEQ ID NO: 623521 - RNA, 22 nt, Human
uuucuuuuccaauaucccuacu

SEQ ID NO: 623522 - RNA, 22 nt, Human
auagaaaacagauguccuuaaa

SEQ ID NO: 623523 - RNA, 22 nt, Human
gcuggcaggguucucacugaaa

SEQ ID NO: 623524 - RNA, 22 nt, Human
gagucucugcuauguuuucucu

SEQ ID NO: 623525 - RNA, 20 nt, Human
uccuucugaggugaggagga

SEQ ID NO: 623526 - RNA, 22 nt, Human
cugcucugagaggcucuuccua

SEQ ID NO: 623527 - RNA, 22 nt, Human
auucaguguggacccauuuaaa

SEQ ID NO: 623528 - RNA, 22 nt, Human
uggcagaggcucugugauguug

SEQ ID NO: 623529 - RNA, 22 nt, Human
auucagucaaaaaugauggaga

SEQ ID NO: 623530 - RNA, 22 nt, Human
ucugggcugcuucagccuucgc

SEQ ID NO: 623531 - RNA, 22 nt, Human
uggcaggaaaguaacagagcac

SEQ ID NO: 623532 - RNA, 22 nt, Human
aucagagugggucuggcaugag

SEQ ID NO: 623533 - RNA, 22 nt, Human
accaccccagaauuuuucaagg

SEQ ID NO: 623534 - RNA, 22 nt, Human
gguagcugcagcaggcuggcaa

SEQ ID NO: 623535 - RNA, 20 nt, Human
auuguacuucuguugauggu

SEQ ID NO: 623536 - RNA, 22 nt, Human
ucagaacuacauggacauguua

SEQ ID NO: 623537 - RNA, 22 nt, Human
auuacaguggacagcuaugcac

SEQ ID NO: 623538 - RNA, 21 nt, Human
aaucaagaguacugguguggc

SEQ ID NO: 623539 - RNA, 22 nt, Human
uguaaauggucagauaaaccua

SEQ ID NO: 623540 - RNA, 22 nt, Human
auggcaagcaagcugaagagau

SEQ ID NO: 623541 - RNA, 22 nt, Human
uaauuauuaugacaacaauugc

SEQ ID NO: 623542 - RNA, 22 nt, Human
uucaauaucucuaagaaugagg

SEQ ID NO: 623543 - RNA, 22 nt, Human
ccccagaaggggacagagggua

SEQ ID NO: 623544 - RNA, 22 nt, Human
caugugaauuccaaagcuaggu

SEQ ID NO: 623545 - RNA, 22 nt, Human
gacaucauagggugggaggaaa

SEQ ID NO: 623546 - RNA, 22 nt, Human
gggcugacaccacccaggcgca

SEQ ID NO: 623547 - RNA, 22 nt, Human
agacauguccacaaagcauuca

SEQ ID NO: 623548 - RNA, 22 nt, Human
ccaaaguccauaguuuacauaa

SEQ ID NO: 623549 - RNA, 19 nt, Human
ggaaggcagaggggcugug

SEQ ID NO: 623550 - RNA, 22 nt, Human
aacaaguaaguuuauauauauu

SEQ ID NO: 623551 - RNA, 22 nt, Human
cuucacugaugggacagcucaa

SEQ ID NO: 623552 - RNA, 22 nt, Human
gcacaagaauaaccauauuuaa

SEQ ID NO: 623553 - RNA, 22 nt, Human
ccaguuuuuccagugcuuucug

SEQ ID NO: 623554 - RNA, 23 nt, Human
gugauauuaaggauagagacaag

SEQ ID NO: 623555 - RNA, 22 nt, Human
gcauuuuauaaagaguuauuug

SEQ ID NO: 623556 - RNA, 22 nt, Human
guuauacauauguguuaacaaa

SEQ ID NO: 623557 - RNA, 22 nt, Human
cagccaggagcucccccugcuc

SEQ ID NO: 623558 - RNA, 22 nt, Human
agauggcucuuugaaggggaau

SEQ ID NO: 623559 - RNA, 22 nt, Human
agggcugagacuaaggccagau

SEQ ID NO: 623560 - RNA, 22 nt, Human
cuggaggcaaagcagaggcaug

SEQ ID NO: 623561 - RNA, 22 nt, Human
gcagcuuuaaacauuggaaaua

SEQ ID NO: 623562 - RNA, 22 nt, Human
uggggcaguuaauaaacauucu

SEQ ID NO: 623563 - RNA, 22 nt, Human
ccacagagcauuagauuucaga

SEQ ID NO: 623564 - RNA, 22 nt, Human
cggcuucaucuuuacuucaaga

SEQ ID NO: 623565 - RNA, 22 nt, Human
gucccuaguggaaagacaugau

SEQ ID NO: 623566 - RNA, 22 nt, Human
ggucugaagcccacgugguacc

SEQ ID NO: 623567 - RNA, 22 nt, Human
gucucucucccaagauuggcua

SEQ ID NO: 623568 - RNA, 22 nt, Human
agcaaagcucaugacauuacag

SEQ ID NO: 623569 - RNA, 21 nt, Human
uagcuuuaauauucccacauu

SEQ ID NO: 623570 - RNA, 17 nt, Human
cccagcuggcagugccg

SEQ ID NO: 623571 - RNA, 22 nt, Human
uccagggcuuggcugggacggu

SEQ ID NO: 623572 - RNA, 22 nt, Human
agaaaacugggaggagagcuuc

SEQ ID NO: 623573 - RNA, 22 nt, Human
gucacagguguggaggugcugg

SEQ ID NO: 623574 - RNA, 22 nt, Human
ugugaauggcaguuggauagca

SEQ ID NO: 623575 - RNA, 22 nt, Human
ugugugaggugguucugagaag

SEQ ID NO: 623576 - RNA, 22 nt, Human
ucugguuagccaauaaugccaa

SEQ ID NO: 623577 - RNA, 22 nt, Human
aguaaacauuuucauauuuucu

SEQ ID NO: 623578 - RNA, 22 nt, Human
uucucaguaugugacgaggacc

SEQ ID NO: 623579 - RNA, 22 nt, Human
ucaauuuccccuauugauagac

SEQ ID NO: 623580 - RNA, 22 nt, Human
ucaaggagacagaaagcaaugg

SEQ ID NO: 623581 - RNA, 22 nt, Human
ugucuuuaauucuacauaucuc

SEQ ID NO: 623582 - RNA, 22 nt, Human
ggcugaugagcuuagcuagaga

SEQ ID NO: 623583 - RNA, 22 nt, Human
uucuggaagaguaaaauaagcc

SEQ ID NO: 623584 - RNA, 22 nt, Human
cagcuaguaaauggcaagacua

SEQ ID NO: 623585 - RNA, 22 nt, Human
aucaggaucacagaaacuuuua

SEQ ID NO: 623586 - RNA, 22 nt, Human
gcuggcuggaugguugguucgc

SEQ ID NO: 623587 - RNA, 22 nt, Human
uuucagacaggacuucauaugu

SEQ ID NO: 623588 - RNA, 22 nt, Human
ucugggcacugcugagccugua

SEQ ID NO: 623589 - RNA, 22 nt, Human
gcuuaaaagccacuuagucuau

SEQ ID NO: 623590 - RNA, 22 nt, Human
cgcagcuguccauguguggggg

SEQ ID NO: 623591 - RNA, 19 nt, Human
gcccuccucacugagcucu

SEQ ID NO: 623592 - RNA, 22 nt, Human
ucauccauaguuugguuggacu

SEQ ID NO: 623593 - RNA, 22 nt, Human
caaacauuuuaaauaagggaua

SEQ ID NO: 623594 - RNA, 17 nt, Human
uuucuagauuauccucu

SEQ ID NO: 623595 - RNA, 21 nt, Human
cucuacauucccagcaacucu

SEQ ID NO: 623596 - RNA, 19 nt, Human
acauguuuugcagaacagc

SEQ ID NO: 623597 - RNA, 22 nt, Human
cuauagaaaauuguaucacacg

SEQ ID NO: 623598 - RNA, 22 nt, Human
uacaauguaauucugauuaugu

SEQ ID NO: 623599 - RNA, 22 nt, Human
uuccaacuuugaaaauguuaug

SEQ ID NO: 623600 - RNA, 22 nt, Human
uucucaugaugcaauucauccc

SEQ ID NO: 623601 - RNA, 22 nt, Human
ccagcuggcccagcugugcucc

SEQ ID NO: 623602 - RNA, 22 nt, Human
ccagcucucuuugaagcauaaa

SEQ ID NO: 623603 - RNA, 22 nt, Human
auucucuguucaaggaugguga

SEQ ID NO: 623604 - RNA, 22 nt, Human
uuacaguauuguuaaacucuuu

SEQ ID NO: 623605 - RNA, 18 nt, Human
gcacagcuaggagggucc

SEQ ID NO: 623606 - RNA, 22 nt, Human
agcugccuguguagaaccaucu

SEQ ID NO: 623607 - RNA, 22 nt, Human
gaggcuccuugaaagggggacu

SEQ ID NO: 623608 - RNA, 22 nt, Human
ggagcagcacugauuagcgguu

SEQ ID NO: 623609 - RNA, 23 nt, Human
ccugugugcccuuaauucacagc

SEQ ID NO: 623610 - RNA, 22 nt, Human
cuuuuuuaagguagcuccuccu

SEQ ID NO: 623611 - RNA, 22 nt, Human
uauugugaguauaacugcauuu

SEQ ID NO: 623612 - RNA, 22 nt, Human
caauugaacagaugaguuaaau

SEQ ID NO: 623613 - RNA, 22 nt, Human
ucugagugagggugugagauau

SEQ ID NO: 623614 - RNA, 22 nt, Human
caagguuugaaaacgccauggc

SEQ ID NO: 623615 - RNA, 22 nt, Human
gcucucccgcagccuggugggc

SEQ ID NO: 623616 - RNA, 22 nt, Human
cucaagucugauggguuagguu

SEQ ID NO: 623617 - RNA, 22 nt, Human
caauguacuacaaagauuguca

SEQ ID NO: 623618 - RNA, 22 nt, Human
caguuuauuuccaagaugacaa

SEQ ID NO: 623619 - RNA, 23 nt, Human
ggcugcucuuuucaugcuguuuc

SEQ ID NO: 623620 - RNA, 22 nt, Human
caacagugauucugcaugagga

SEQ ID NO: 623621 - RNA, 22 nt, Human
gggcugccaagccugccugccu

SEQ ID NO: 623622 - RNA, 22 nt, Human
aagccauggcugcaucagccug

SEQ ID NO: 623623 - RNA, 22 nt, Human
cauggcuuuuuuauucugaaug

SEQ ID NO: 623624 - RNA, 22 nt, Human
gccauggggacuucauggauuu

SEQ ID NO: 623625 - RNA, 22 nt, Human
ggaugcuggggaccaaucucug

SEQ ID NO: 623626 - RNA, 22 nt, Human
agcauggggcuccgcaaugaac

SEQ ID NO: 623627 - RNA, 22 nt, Human
ggagaguggauuccagcuguau

SEQ ID NO: 623628 - RNA, 22 nt, Human
ugguuaaaugcuccgaucuugg

SEQ ID NO: 623629 - RNA, 22 nt, Human
aauaugcagcaugaugaaguaa

SEQ ID NO: 623630 - RNA, 22 nt, Human
ugggcaggagagaagcuaaaga

SEQ ID NO: 623631 - RNA, 22 nt, Human
gcuccaggaggaugaccuuccu

SEQ ID NO: 623632 - RNA, 22 nt, Human
gggcacugaaugccaagcuagg

SEQ ID NO: 623633 - RNA, 22 nt, Human
uggcccugcagaacuagccugg

SEQ ID NO: 623634 - RNA, 22 nt, Human
ggacugggagaauggaggcaag

SEQ ID NO: 623635 - RNA, 22 nt, Human
uguuuacuucuuuccauggcuu

SEQ ID NO: 623636 - RNA, 17 nt, Human
cugucugcugcuuccuc

SEQ ID NO: 623637 - RNA, 22 nt, Human
ggaacacugccuuuuauuuucc

SEQ ID NO: 623638 - RNA, 22 nt, Human
uugcagagaucagcagguuuga

SEQ ID NO: 623639 - RNA, 22 nt, Human
ugccaggccaaugaaggcaggg

SEQ ID NO: 623640 - RNA, 22 nt, Human
ggucuccaaagcugcauugaug

SEQ ID NO: 623641 - RNA, 22 nt, Human
acaagcaugugguaaaaagacc

SEQ ID NO: 623642 - RNA, 22 nt, Human
acugcaaucuggauccuagaag

SEQ ID NO: 623643 - RNA, 22 nt, Human
aggccacagauacugugaagua

SEQ ID NO: 623644 - RNA, 22 nt, Human
gaaugaauuuuggauggugaag

SEQ ID NO: 623645 - RNA, 22 nt, Human
acuuggccuuauuuccacagaa

SEQ ID NO: 623646 - RNA, 22 nt, Human
caguguggugagauuccaggug

SEQ ID NO: 623647 - RNA, 22 nt, Human
ugagaaagguauuucaugcacu

SEQ ID NO: 623648 - RNA, 22 nt, Human
caguaauagauuugagaguggu

SEQ ID NO: 623649 - RNA, 22 nt, Human
aauuucagaacuaucugggagu

SEQ ID NO: 623650 - RNA, 18 nt, Human
gcacucugacugcagagc

SEQ ID NO: 623651 - RNA, 22 nt, Human
ccuugguucugccuggccugga

SEQ ID NO: 623652 - RNA, 22 nt, Human
agccagggggacgcuuucuggc

SEQ ID NO: 623653 - RNA, 22 nt, Human
cagcacuaauccugcaauuucu

SEQ ID NO: 623654 - RNA, 22 nt, Human
uaaaauguagcuucuaggcugg

SEQ ID NO: 623655 - RNA, 22 nt, Human
caugauaacuucauuacacaau

SEQ ID NO: 623656 - RNA, 22 nt, Human
ugacuuuaauaggauuuugcau

SEQ ID NO: 623657 - RNA, 22 nt, Human
gagcccugcugggccuugucuc

SEQ ID NO: 623658 - RNA, 22 nt, Human
agaugccuaaaucugggcaagg

SEQ ID NO: 623659 - RNA, 22 nt, Human
ugcaggcucucugcugccagau

SEQ ID NO: 623660 - RNA, 22 nt, Human
gcucugugggugaguagaaucu

SEQ ID NO: 623661 - RNA, 22 nt, Human
uaauaauagcaguagcugccac

SEQ ID NO: 623662 - RNA, 22 nt, Human
ccugcucuaaaucucauggaac

SEQ ID NO: 623663 - RNA, 22 nt, Human
uugcaacacaaaguuugauucc

SEQ ID NO: 623664 - RNA, 19 nt, Human
uuuccuaaaaagcugugcu

SEQ ID NO: 623665 - RNA, 22 nt, Human
gcucaggaucccaggggugugc

SEQ ID NO: 623666 - RNA, 22 nt, Human
ccugagauggccagugcuggga

SEQ ID NO: 623667 - RNA, 20 nt, Human
uccuucagacuuuggaguug

SEQ ID NO: 623668 - RNA, 22 nt, Human
gucagcaccucuuuggggagcu

SEQ ID NO: 623669 - RNA, 22 nt, Human
gaaacacugguaaagacugccg

SEQ ID NO: 623670 - RNA, 17 nt, Human
ggccuuggggccucagu

SEQ ID NO: 623671 - RNA, 22 nt, Human
gcuagcuuuauaaugcugggcg

SEQ ID NO: 623672 - RNA, 18 nt, Human
uucugugcaucuuucuau

SEQ ID NO: 623673 - RNA, 22 nt, Human
uuaauuuucucaucugugaaau

SEQ ID NO: 623674 - RNA, 22 nt, Human
uguaauaccacuguuggacauu

SEQ ID NO: 623675 - RNA, 22 nt, Human
uuagguaaggauggugacagua

SEQ ID NO: 623676 - RNA, 22 nt, Human
uccuggccaaguuacucucugc

SEQ ID NO: 623677 - RNA, 22 nt, Human
acugugcaugaaccgaaacaaa

SEQ ID NO: 623678 - RNA, 22 nt, Human
uguuaaauugauucaccuuucu

SEQ ID NO: 623679 - RNA, 20 nt, Human
agcaguguggggagacugug

SEQ ID NO: 623680 - RNA, 22 nt, Human
gcaggagccaggccgagcuggu

SEQ ID NO: 623681 - RNA, 22 nt, Human
aagugcuuaaaaggguggucua

SEQ ID NO: 623682 - RNA, 22 nt, Human
cuuccugggcaauguucugcuu

SEQ ID NO: 623683 - RNA, 22 nt, Human
gcuggccaaaguguaccuggag

SEQ ID NO: 623684 - RNA, 22 nt, Human
gguggguaaaacugcuggcacu

SEQ ID NO: 623685 - RNA, 22 nt, Human
gggagccuugggagugccagcc

SEQ ID NO: 623686 - RNA, 22 nt, Human
agcaacaggaaauagcugauua

SEQ ID NO: 623687 - RNA, 22 nt, Human
uauaagcacauccuugacugau

SEQ ID NO: 623688 - RNA, 22 nt, Human
uuaaagcaucacacuauuaauu

SEQ ID NO: 623689 - RNA, 22 nt, Human
gcauuuauuucuuuacugcauc

SEQ ID NO: 623690 - RNA, 22 nt, Human
uggaugugagaaggaucaggcu

SEQ ID NO: 623691 - RNA, 22 nt, Human
cugacucccaagcuagugcucu

SEQ ID NO: 623692 - RNA, 22 nt, Human
uuuauuagugcuuguaucacug

SEQ ID NO: 623693 - RNA, 22 nt, Human
gaggucaggcuugcagcagggu

SEQ ID NO: 623694 - RNA, 22 nt, Human
cugcuuuacucauaggguuuca

SEQ ID NO: 623695 - RNA, 22 nt, Human
auguagaaaguucauagaugcg

SEQ ID NO: 623696 - RNA, 22 nt, Human
uugagcaucaauuaagugaguu

SEQ ID NO: 623697 - RNA, 22 nt, Human
uguucuuugcuguugauguaga

SEQ ID NO: 623698 - RNA, 22 nt, Human
gcuggcuccucuguccucacgg

SEQ ID NO: 623699 - RNA, 22 nt, Human
agucacaugaucccugggccug

SEQ ID NO: 623700 - RNA, 22 nt, Human
auugacaaaucugaacauacgg

SEQ ID NO: 623701 - RNA, 22 nt, Human
ugcuguagcccugcacagugca

SEQ ID NO: 623702 - RNA, 22 nt, Human
acaacaaagacacuugaaauga

SEQ ID NO: 623703 - RNA, 22 nt, Human
ggagagaaauugagguagcaag

SEQ ID NO: 623704 - RNA, 22 nt, Human
agcugcugagccaggcugaugu

SEQ ID NO: 623705 - RNA, 22 nt, Human
gcuuugaugaaucugugcuugg

SEQ ID NO: 623706 - RNA, 22 nt, Human
uuucauguuuucuuaaauggca

SEQ ID NO: 623707 - RNA, 22 nt, Human
aggcagauuuucuuuacucagu

SEQ ID NO: 623708 - RNA, 22 nt, Human
caaagaguuuuuucauauaaug

SEQ ID NO: 623709 - RNA, 22 nt, Human
cagcuucuccagaugacccuca

SEQ ID NO: 623710 - RNA, 22 nt, Human
gggagggauuaguucugccugg

SEQ ID NO: 623711 - RNA, 22 nt, Human
ggagcucaggcccagcaaggcc

SEQ ID NO: 623712 - RNA, 22 nt, Human
acucuucuugcugcucauuaau

SEQ ID NO: 623713 - RNA, 22 nt, Human
uugggccaagugauucucugcc

SEQ ID NO: 623714 - RNA, 22 nt, Human
ucugaacauuuuuugcagccua

SEQ ID NO: 623715 - RNA, 22 nt, Human
caugauagguauuuaauuaaau

SEQ ID NO: 623716 - RNA, 22 nt, Human
ucaugcagauaagaauaaguaa

SEQ ID NO: 623717 - RNA, 22 nt, Human
auuuccuauuucuuguccccua

SEQ ID NO: 623718 - RNA, 22 nt, Human
cgacgggcucgguccgcuuccu

SEQ ID NO: 623719 - RNA, 17 nt, Human
gcaaaggugaggagaga

SEQ ID NO: 623720 - RNA, 22 nt, Human
ggccugcucugcagccucuaca

SEQ ID NO: 623721 - RNA, 22 nt, Human
ucaagagaaggggaaauagacu

SEQ ID NO: 623722 - RNA, 23 nt, Human
caauuguauaaagcaaaugguuu

SEQ ID NO: 623723 - RNA, 22 nt, Human
gcuugcuuuguaaauaucugug

SEQ ID NO: 623724 - RNA, 22 nt, Human
ugagaaauggcagcauuacugg

SEQ ID NO: 623725 - RNA, 22 nt, Human
ucucugagcuggauuuguucuu

SEQ ID NO: 623726 - RNA, 22 nt, Human
cugagccuguguuucucuggca

SEQ ID NO: 623727 - RNA, 21 nt, Human
ggacaccagucacacuggauu

SEQ ID NO: 623728 - RNA, 22 nt, Human
ugaauagauuuuuaacauauaa

SEQ ID NO: 623729 - RNA, 22 nt, Human
agcuuuuacauaaugaucuuga

SEQ ID NO: 623730 - RNA, 22 nt, Human
gcugcacuugagccugggagaa

SEQ ID NO: 623731 - RNA, 22 nt, Human
ugaccaaaggugguuuauuugg

SEQ ID NO: 623732 - RNA, 22 nt, Human
cauucuucucccuuaccuucca

SEQ ID NO: 623733 - RNA, 22 nt, Human
gacccagcuaaccaggugggga

SEQ ID NO: 623734 - RNA, 19 nt, Human
cuggucugcugcuuccagg

SEQ ID NO: 623735 - RNA, 22 nt, Human
ggagggggaagaagcuaaagac

SEQ ID NO: 623736 - RNA, 22 nt, Human
ugcaggcccaguguagaggcuc

SEQ ID NO: 623737 - RNA, 22 nt, Human
ugaggccuggacucugcaugga

SEQ ID NO: 623738 - RNA, 22 nt, Human
cagcucugacacaguacaaaau

SEQ ID NO: 623739 - RNA, 22 nt, Human
cacugucugggacauguggucu

SEQ ID NO: 623740 - RNA, 22 nt, Human
ucuccugcucccaacugcugca

SEQ ID NO: 623741 - RNA, 22 nt, Human
cagaggucugaugcgucccugc

SEQ ID NO: 623742 - RNA, 22 nt, Human
ucugcacauggcgcugguccug

SEQ ID NO: 623743 - RNA, 22 nt, Human
ugguggacaccgcagccaugaa

SEQ ID NO: 623744 - RNA, 22 nt, Human
gagauucugguuagguguauuu

SEQ ID NO: 623745 - RNA, 22 nt, Human
aagcagcacaguaauauuggug

SEQ ID NO: 623746 - RNA, 22 nt, Human
ccugagcaacuucaagggccug

SEQ ID NO: 623747 - RNA, 22 nt, Human
aggaccagaggccagagucagc

SEQ ID NO: 623748 - RNA, 22 nt, Human
uauucauguguuggaaaggaac

SEQ ID NO: 623749 - RNA, 22 nt, Human
uugauucugauccuuugcuagc

SEQ ID NO: 623750 - RNA, 22 nt, Human
aaagcagccgguucccuggucu

SEQ ID NO: 623751 - RNA, 22 nt, Human
ggccaccuccgugaaggaauga

SEQ ID NO: 623752 - RNA, 22 nt, Human
gaggagguggaauuccaggaau

SEQ ID NO: 623753 - RNA, 20 nt, Human
agcuccuuuguguccaggau

SEQ ID NO: 623754 - RNA, 22 nt, Human
ugcuccacccucacacucuucc

SEQ ID NO: 623755 - RNA, 22 nt, Human
acaggcucacagucauuucauu

SEQ ID NO: 623756 - RNA, 22 nt, Human
ugacagaaagaguauuaaagau

SEQ ID NO: 623757 - RNA, 22 nt, Human
gugcagggcagccgaaugggcu

SEQ ID NO: 623758 - RNA, 22 nt, Human
gcagagaaaguuuuguccucag

SEQ ID NO: 623759 - RNA, 22 nt, Human
cugccucagccuucugggugac

SEQ ID NO: 623760 - RNA, 22 nt, Human
uuaaaguauagaggacaaaaac

SEQ ID NO: 623761 - RNA, 22 nt, Human
gacagggaaacauugaaguguc

SEQ ID NO: 623762 - RNA, 21 nt, Human
ugugugugcaggcacacacac

SEQ ID NO: 623763 - RNA, 22 nt, Human
aaacagcuccuuaguuuccauc

SEQ ID NO: 623764 - RNA, 22 nt, Human
guggccagaaguuaagugguua

SEQ ID NO: 623765 - RNA, 22 nt, Human
acagcugauuggaucaaggaca

SEQ ID NO: 623766 - RNA, 22 nt, Human
gaaacauugagcagaaggagaa

SEQ ID NO: 623767 - RNA, 22 nt, Human
ucacagacauggugagguaaca

SEQ ID NO: 623768 - RNA, 22 nt, Human
aagagacuuguccgaaguugua

SEQ ID NO: 623769 - RNA, 22 nt, Human
accuuuccuggcugaccgagga

SEQ ID NO: 623770 - RNA, 22 nt, Human
uauuuuacagacuacuuuagau

SEQ ID NO: 623771 - RNA, 22 nt, Human
ggaaaagaauugcagugaagua

SEQ ID NO: 623772 - RNA, 22 nt, Human
uuuguccucuccauguacaaua

SEQ ID NO: 623773 - RNA, 22 nt, Human
agcuguguucugguugauucac

SEQ ID NO: 623774 - RNA, 22 nt, Human
aaugaacacauguggucaguuu

SEQ ID NO: 623775 - RNA, 22 nt, Human
ugaaagcacugauucucaacuc

SEQ ID NO: 623776 - RNA, 22 nt, Human
uuuagcaagguagguccaugga

SEQ ID NO: 623777 - RNA, 22 nt, Human
acaugugucuaagaaugaaaga

SEQ ID NO: 623778 - RNA, 22 nt, Human
cauguuaauaugcauugaguac

SEQ ID NO: 623779 - RNA, 22 nt, Human
ccucagaccccacagggccugu

SEQ ID NO: 623780 - RNA, 22 nt, Human
acauauaugcgugggcucaugg

SEQ ID NO: 623781 - RNA, 18 nt, Human
ugaacuuuggugucucuc

SEQ ID NO: 623782 - RNA, 20 nt, Human
ucuccagaugcagaugacau

SEQ ID NO: 623783 - RNA, 22 nt, Human
uuugguaaguaugaaugcagua

SEQ ID NO: 623784 - RNA, 22 nt, Human
aggacuucuuagaugccuuccg

SEQ ID NO: 623785 - RNA, 21 nt, Human
acccccacaccuccuuaguuc

SEQ ID NO: 623786 - RNA, 22 nt, Human
gcaggggaguccacucuaugca

SEQ ID NO: 623787 - RNA, 22 nt, Human
ugcagccaccaccucugcugaa

SEQ ID NO: 623788 - RNA, 22 nt, Human
augagguuuagguuccuccucu

SEQ ID NO: 623789 - RNA, 18 nt, Human
uuccaugauuccuuucac

SEQ ID NO: 623790 - RNA, 22 nt, Human
uuucuggcagcgggacaggggu

SEQ ID NO: 623791 - RNA, 22 nt, Human
aagaggggugugugucaaccca

SEQ ID NO: 623792 - RNA, 21 nt, Human
agcugccugcucuggaccugg

SEQ ID NO: 623793 - RNA, 22 nt, Human
ugggggugcugagaagacagga

SEQ ID NO: 623794 - RNA, 22 nt, Human
cuacauuaaauuggcuuacuua

SEQ ID NO: 623795 - RNA, 22 nt, Human
cagcacaguccuuugcuuacug

SEQ ID NO: 623796 - RNA, 22 nt, Human
gauuccacagcuucgaggucuu

SEQ ID NO: 623797 - RNA, 22 nt, Human
auuguauaacagcauguauuuu

SEQ ID NO: 623798 - RNA, 20 nt, Human
caugcaacagauuauuuccc

SEQ ID NO: 623799 - RNA, 22 nt, Human
acagggagccccagcauuucca

SEQ ID NO: 623800 - RNA, 22 nt, Human
cugaauccacacaaggugaugg

SEQ ID NO: 623801 - RNA, 23 nt, Human
aguucucauucaucacggccuau

SEQ ID NO: 623802 - RNA, 22 nt, Human
gcugcugguccucagagcucau

SEQ ID NO: 623803 - RNA, 22 nt, Human
uggagauguaaagcaaggcuua

SEQ ID NO: 623804 - RNA, 22 nt, Human
cauuacagugucagaggaacug

SEQ ID NO: 623805 - RNA, 22 nt, Human
acacaguaucaaauuucaucuu

SEQ ID NO: 623806 - RNA, 22 nt, Human
ugucaccaguuccaggaaauaa

SEQ ID NO: 623807 - RNA, 22 nt, Human
ggggagaauuacauggcgugga

SEQ ID NO: 623808 - RNA, 22 nt, Human
auuccuuguuucacugaaaagg

SEQ ID NO: 623809 - RNA, 22 nt, Human
uucuuauagaagcaaccauugu

SEQ ID NO: 623810 - RNA, 22 nt, Human
guguggccuugggagaggucug

SEQ ID NO: 623811 - RNA, 22 nt, Human
ugggaugggaucucgcuguguc

SEQ ID NO: 623812 - RNA, 22 nt, Human
gagcucagcaaaggucugugug

SEQ ID NO: 623813 - RNA, 22 nt, Human
ccaggccaggagagcgagguuu

SEQ ID NO: 623814 - RNA, 22 nt, Human
ucuugaaaguaucuuauuuugu

SEQ ID NO: 623815 - RNA, 22 nt, Human
gaagcaauuaaguuugugaucu

SEQ ID NO: 623816 - RNA, 22 nt, Human
ugaggcucaaggucugguggag

SEQ ID NO: 623817 - RNA, 22 nt, Human
gauaagcacuauauaaguauuu

SEQ ID NO: 623818 - RNA, 22 nt, Human
ugagaaccaugaaaagcuguca

SEQ ID NO: 623819 - RNA, 22 nt, Human
gagaucaucuuuuuuagauucc

SEQ ID NO: 623820 - RNA, 22 nt, Human
ucaucugaccacuuuaucucuc

SEQ ID NO: 623821 - RNA, 22 nt, Human
aggaugccuucauugcauggcc

SEQ ID NO: 623822 - RNA, 20 nt, Human
ccugucuggagacaaagaga

SEQ ID NO: 623823 - RNA, 22 nt, Human
aggcuccagcccaaggcugcag

SEQ ID NO: 623824 - RNA, 22 nt, Human
cagaccuggggccugggagccc

SEQ ID NO: 623825 - RNA, 22 nt, Human
gggagcuauuuauagaggcuga

SEQ ID NO: 623826 - RNA, 22 nt, Human
auccagcuuugucuggucuucg

SEQ ID NO: 623827 - RNA, 22 nt, Human
cagaaggcuggcagauugagau

SEQ ID NO: 623828 - RNA, 22 nt, Human
cagaggccagggggcucacaaa

SEQ ID NO: 623829 - RNA, 22 nt, Human
augggaggaugcucgggugcuc

SEQ ID NO: 623830 - RNA, 22 nt, Human
ucacagaaucucugauaagucu

SEQ ID NO: 623831 - RNA, 22 nt, Human
cccagcaucccagugggcagca

SEQ ID NO: 623832 - RNA, 22 nt, Human
gagcagcuggcuguauugguuu

SEQ ID NO: 623833 - RNA, 22 nt, Human
uggagccaugccuggccuuucc

SEQ ID NO: 623834 - RNA, 22 nt, Human
ugagugugcagggaaguggcgg

SEQ ID NO: 623835 - RNA, 22 nt, Human
aaugcuguauaucuuagcuaau

SEQ ID NO: 623836 - RNA, 20 nt, Human
gaagccagaggggaaaggag

SEQ ID NO: 623837 - RNA, 18 nt, Human
ucauucauuaaacuuggc

SEQ ID NO: 623838 - RNA, 22 nt, Human
cacugcauggaugauggcugua

SEQ ID NO: 623839 - RNA, 20 nt, Human
ggcccagugaaccaggacgg

SEQ ID NO: 623840 - RNA, 22 nt, Human
aagcuuuucucuguauuaccug

SEQ ID NO: 623841 - RNA, 22 nt, Human
gcugaggcaagauuugaaccca

SEQ ID NO: 623842 - RNA, 23 nt, Human
uuuauccaacucuguaaucucuc

SEQ ID NO: 623843 - RNA, 22 nt, Human
caguucucuugaucgucucuug

SEQ ID NO: 623844 - RNA, 22 nt, Human
uuuugaauaauucagaaacagc

SEQ ID NO: 623845 - RNA, 22 nt, Human
uuauuaauacaugcaccugcau

SEQ ID NO: 623846 - RNA, 22 nt, Human
acugagguuuacuugaaggaga

SEQ ID NO: 623847 - RNA, 22 nt, Human
ccugcucagccccagcucaccc

SEQ ID NO: 623848 - RNA, 22 nt, Human
aggagugaguguccucagcaga

SEQ ID NO: 623849 - RNA, 21 nt, Human
acagcauguuuguguguuugc

SEQ ID NO: 623850 - RNA, 19 nt, Human
gggagcugaggucuuuggu

SEQ ID NO: 623851 - RNA, 22 nt, Human
ccaguuauccagcaugcugucu

SEQ ID NO: 623852 - RNA, 22 nt, Human
cucuggcuuugcucaugcaucc

SEQ ID NO: 623853 - RNA, 22 nt, Human
uagcaacguguauaaacucaag

SEQ ID NO: 623854 - RNA, 22 nt, Human
cugccguguuuuucauguuaaa

SEQ ID NO: 623855 - RNA, 22 nt, Human
ccugggaaguuguggcugcagu

SEQ ID NO: 623856 - RNA, 22 nt, Human
uauuagcagccaacuuagcugu

SEQ ID NO: 623857 - RNA, 22 nt, Human
ucuguaaagacuccaaaagcca

SEQ ID NO: 623858 - RNA, 22 nt, Human
ucacagagaaaagcuaucacaa

SEQ ID NO: 623859 - RNA, 22 nt, Human
ugccauauuauugagcauauua

SEQ ID NO: 623860 - RNA, 22 nt, Human
ccagugugauuguugcaagaau

SEQ ID NO: 623861 - RNA, 22 nt, Human
uuuauugcuggccaccuguagc

SEQ ID NO: 623862 - RNA, 22 nt, Human
aauugaaaauauuguagaccau

SEQ ID NO: 623863 - RNA, 20 nt, Human
gcucccugguagaaauguuu

SEQ ID NO: 623864 - RNA, 20 nt, Human
ccagcugagccaaggggaga

SEQ ID NO: 623865 - RNA, 22 nt, Human
aguggcuugcucugccucagcc

SEQ ID NO: 623866 - RNA, 22 nt, Human
aaggaauucuagaagguuuugu

SEQ ID NO: 623867 - RNA, 19 nt, Human
agugcaugggcgaggugca

SEQ ID NO: 623868 - RNA, 22 nt, Human
cagcauuuaucuuguagcagga

SEQ ID NO: 623869 - RNA, 22 nt, Human
uauucaaaguaccuucauugcc

SEQ ID NO: 623870 - RNA, 22 nt, Human
cugcugcuuuugcgggagaaca

SEQ ID NO: 623871 - RNA, 22 nt, Human
ggccagucugggccacggucgg

SEQ ID NO: 623872 - RNA, 22 nt, Human
ggugaaggcacaagagggcaag

SEQ ID NO: 623873 - RNA, 22 nt, Human
aaucaacaggaugugcauugua

SEQ ID NO: 623874 - RNA, 22 nt, Human
acuuccugcuaugagcuucugu

SEQ ID NO: 623875 - RNA, 20 nt, Human
agcuccucaucacuggaggu

SEQ ID NO: 623876 - RNA, 22 nt, Human
gcugucacucaccaggccugca

SEQ ID NO: 623877 - RNA, 22 nt, Human
auaucaaacgaaguuauuuuaa

SEQ ID NO: 623878 - RNA, 21 nt, Human
aggcuuggaucuagacaggcc

SEQ ID NO: 623879 - RNA, 22 nt, Human
ucaugcugugaacuguauacau

SEQ ID NO: 623880 - RNA, 22 nt, Human
uggcucuguuuguuaacuagac

SEQ ID NO: 623881 - RNA, 22 nt, Human
acaaugaauuuaauaccuuauu

SEQ ID NO: 623882 - RNA, 22 nt, Human
cuuauguauaauguuccacaua

SEQ ID NO: 623883 - RNA, 22 nt, Human
ucauuuauagcuaaccuugaau

SEQ ID NO: 623884 - RNA, 22 nt, Human
cucugugagggucuguacagaa

SEQ ID NO: 623885 - RNA, 22 nt, Human
acugaaggucucagcaaggaug

SEQ ID NO: 623886 - RNA, 22 nt, Human
cccagcagccagaaugaggagc

SEQ ID NO: 623887 - RNA, 22 nt, Human
ccaggagacuguacugauauuu

SEQ ID NO: 623888 - RNA, 22 nt, Human
uccugggaaguugcaucaccgu

SEQ ID NO: 623889 - RNA, 22 nt, Human
ugauacagaauugauaucugag

SEQ ID NO: 623890 - RNA, 22 nt, Human
agguucgggcacuuacaaaugg

SEQ ID NO: 623891 - RNA, 22 nt, Human
auugaaaaaugacuauugcuua

SEQ ID NO: 623892 - RNA, 22 nt, Human
uccagccauaucuuguagcccu

SEQ ID NO: 623893 - RNA, 22 nt, Human
gagggccaggcggagacaggcg

SEQ ID NO: 623894 - RNA, 17 nt, Human
ggcaggugacagacacc

SEQ ID NO: 623895 - RNA, 22 nt, Human
uaugcaauucucuuaauauucu

SEQ ID NO: 623896 - RNA, 22 nt, Human
aauuggcauagcauacaauuca

SEQ ID NO: 623897 - RNA, 17 nt, Human
uagcuguguuucagcua

SEQ ID NO: 623898 - RNA, 22 nt, Human
aaaucaugugcagagaucagga

SEQ ID NO: 623899 - RNA, 22 nt, Human
ucugggaugcaaacagaaucug

SEQ ID NO: 623900 - RNA, 22 nt, Human
gcagggaccucacuacccccag

SEQ ID NO: 623901 - RNA, 22 nt, Human
acacuucucuuugaagaacaau

SEQ ID NO: 623902 - RNA, 22 nt, Human
uuccuaaugucuacuuuaguuc

SEQ ID NO: 623903 - RNA, 22 nt, Human
uuugcagugauucuugcaguga

SEQ ID NO: 623904 - RNA, 22 nt, Human
uggguccaguguccuggcuaug

SEQ ID NO: 623905 - RNA, 22 nt, Human
guagaaaugguguguuucuucu

SEQ ID NO: 623906 - RNA, 22 nt, Human
ucauugaauuugguucaauaug

SEQ ID NO: 623907 - RNA, 22 nt, Human
agagacaggguuuugucguguu

SEQ ID NO: 623908 - RNA, 22 nt, Human
cuuucacagccuucguucugaa

SEQ ID NO: 623909 - RNA, 22 nt, Human
auaaagcagguccccagacacu

SEQ ID NO: 623910 - RNA, 22 nt, Human
ccaggcagcucugauuuauguc

SEQ ID NO: 623911 - RNA, 22 nt, Human
caugugugaguauaucuuaucc

SEQ ID NO: 623912 - RNA, 22 nt, Human
cugucugcucauaauggagggc

SEQ ID NO: 623913 - RNA, 22 nt, Human
uagcagagguaaguguggcaau

SEQ ID NO: 623914 - RNA, 22 nt, Human
caggugccgggaaugcagcaau

SEQ ID NO: 623915 - RNA, 19 nt, Human
cugccuguuauggagagaa

SEQ ID NO: 623916 - RNA, 22 nt, Human
uaacacaguucucuguugcaca

SEQ ID NO: 623917 - RNA, 22 nt, Human
cagcugcccaggccaccuggag

SEQ ID NO: 623918 - RNA, 22 nt, Human
gagaggccauggggugggaugc

SEQ ID NO: 623919 - RNA, 22 nt, Human
ccuccccucagacagagacugg

SEQ ID NO: 623920 - RNA, 22 nt, Human
cacaugaaggcuggggucguga

SEQ ID NO: 623921 - RNA, 22 nt, Human
gacacugaggcaugcagagccg

SEQ ID NO: 623922 - RNA, 22 nt, Human
aguugcuggcaccugugaguau

SEQ ID NO: 623923 - RNA, 22 nt, Human
caaggcugcaaaacuacauggg

SEQ ID NO: 623924 - RNA, 22 nt, Human
uggaguccuuguuggaagugaa

SEQ ID NO: 623925 - RNA, 22 nt, Human
uucuccagacaacagaggguga

SEQ ID NO: 623926 - RNA, 22 nt, Human
ccuggcaguuuugcccaggauu

SEQ ID NO: 623927 - RNA, 22 nt, Human
ggucagggggaucugugaggua

SEQ ID NO: 623928 - RNA, 22 nt, Human
auuaaguguauugcugagggua

SEQ ID NO: 623929 - RNA, 22 nt, Human
ggccacuguuuccugggcaguu

SEQ ID NO: 623930 - RNA, 21 nt, Human
auggagccuaagaguggaggu

SEQ ID NO: 623931 - RNA, 22 nt, Human
uggcacugucaccaaugcuguc

SEQ ID NO: 623932 - RNA, 22 nt, Human
gcuuggcauugaccauuaucau

SEQ ID NO: 623933 - RNA, 22 nt, Human
acagguagucugaacacugggu

SEQ ID NO: 623934 - RNA, 22 nt, Human
uucccucuccuacucaggaaag

SEQ ID NO: 623935 - RNA, 21 nt, Human
cccaccccauaaggcagaacc

SEQ ID NO: 623936 - RNA, 22 nt, Human
agcugaggccacgagugaaggg

SEQ ID NO: 623937 - RNA, 22 nt, Human
aucuuggauuggagaaagaagu

SEQ ID NO: 623938 - RNA, 22 nt, Human
acguguucaauuuccaucugac

SEQ ID NO: 623939 - RNA, 23 nt, Human
agggcuccuuguugauuagcauu

SEQ ID NO: 623940 - RNA, 23 nt, Human
uucaggaaaugaauacagacaca

SEQ ID NO: 623941 - RNA, 22 nt, Human
caggauggagagugagggguca

SEQ ID NO: 623942 - RNA, 20 nt, Human
cugagcgucuaagaggugag

SEQ ID NO: 623943 - RNA, 22 nt, Human
uauggaaaguguuuucuucugu

SEQ ID NO: 623944 - RNA, 22 nt, Human
ugcuuaaaaaguaacugcugau

SEQ ID NO: 623945 - RNA, 22 nt, Human
cacccagggcugugccugccca

SEQ ID NO: 623946 - RNA, 22 nt, Human
cagauggaacacagaaaggaga

SEQ ID NO: 623947 - RNA, 22 nt, Human
uuauucuuggaucugagucucu

SEQ ID NO: 623948 - RNA, 22 nt, Human
uccuggccugucuggaguagcu

SEQ ID NO: 623949 - RNA, 22 nt, Human
acauuugagaugccuuuuaggu

SEQ ID NO: 623950 - RNA, 22 nt, Human
guaacagaaagucaugcucauu

SEQ ID NO: 623951 - RNA, 22 nt, Human
uuacaacucugucaguauagcu

SEQ ID NO: 623952 - RNA, 22 nt, Human
gccauucauauuuuagcauuaa

SEQ ID NO: 623953 - RNA, 22 nt, Human
ggccaggcugguuccuugaccu

SEQ ID NO: 623954 - RNA, 22 nt, Human
uucucuggauguuucucaguca

SEQ ID NO: 623955 - RNA, 22 nt, Human
uacacuguacgcucugcuucaa

SEQ ID NO: 623956 - RNA, 22 nt, Human
acuguuaauucaaucaacaggu

SEQ ID NO: 623957 - RNA, 22 nt, Human
aucuuuuuaucuguuuggaaca

SEQ ID NO: 623958 - RNA, 18 nt, Human
aggccugcccagcacugu

SEQ ID NO: 623959 - RNA, 22 nt, Human
uccuuaggcaauuugggagagu

SEQ ID NO: 623960 - RNA, 22 nt, Human
ucaggauggcuucugcaucaaa

SEQ ID NO: 623961 - RNA, 22 nt, Human
ugugaaaugaagauaauucuug

SEQ ID NO: 623962 - RNA, 22 nt, Human
gcugccuccugaaagcgcucug

SEQ ID NO: 623963 - RNA, 22 nt, Human
agcuuucuauauaugaguugcu

SEQ ID NO: 623964 - RNA, 22 nt, Human
uuugcuauuuuucugugcagcu

SEQ ID NO: 623965 - RNA, 22 nt, Human
cuuuuucuaaucauaauugucu

SEQ ID NO: 623966 - RNA, 18 nt, Human
cuguugagauguggcuga

SEQ ID NO: 623967 - RNA, 22 nt, Human
uuuaucugugguaaauaacauu

SEQ ID NO: 623968 - RNA, 18 nt, Human
gaggaucagaaaucugua

SEQ ID NO: 623969 - RNA, 22 nt, Human
ggagccugggccuccugcccuu

SEQ ID NO: 623970 - RNA, 22 nt, Human
gcccugagaggcaaugacucuu

SEQ ID NO: 623971 - RNA, 22 nt, Human
guaaagcagguaguugggacac

SEQ ID NO: 623972 - RNA, 22 nt, Human
aaccugaauuuaauugaaauga

SEQ ID NO: 623973 - RNA, 19 nt, Human
uuuacagggaauggagacc

SEQ ID NO: 623974 - RNA, 22 nt, Human
cagcagcucacucagguggcuc

SEQ ID NO: 623975 - RNA, 22 nt, Human
uccagucaagcuugagaauuuc

SEQ ID NO: 623976 - RNA, 22 nt, Human
caaggaaggagagaugaugggu

SEQ ID NO: 623977 - RNA, 19 nt, Human
ucccuucuauaguaauaaa

SEQ ID NO: 623978 - RNA, 22 nt, Human
auacaaauuuauagaugcauuu

SEQ ID NO: 623979 - RNA, 22 nt, Human
aaggcacuacgcugcuggggcg

SEQ ID NO: 623980 - RNA, 22 nt, Human
aaggcugagacagcacaggucc

SEQ ID NO: 623981 - RNA, 22 nt, Human
gaacuauaugucuuaaagcuuu

SEQ ID NO: 623982 - RNA, 20 nt, Human
ugcacagggugggaagcaac

SEQ ID NO: 623983 - RNA, 20 nt, Human
cguaaggcaagugcugcauc

SEQ ID NO: 623984 - RNA, 22 nt, Human
uauuucuuucagguauguguug

SEQ ID NO: 623985 - RNA, 22 nt, Human
caggcagaggcuuuucauggcu

SEQ ID NO: 623986 - RNA, 22 nt, Human
ggccugaaauaaaguagcagaa

SEQ ID NO: 623987 - RNA, 22 nt, Human
cacuugcuggaugguggcucag

SEQ ID NO: 623988 - RNA, 22 nt, Human
aaggucauuguugcauguucuc

SEQ ID NO: 623989 - RNA, 22 nt, Human
agauuauuuccagacuaaugaa

SEQ ID NO: 623990 - RNA, 22 nt, Human
ugcacacacucugcauauacuu

SEQ ID NO: 623991 - RNA, 22 nt, Human
uacuauguucuuccuaaauagu

SEQ ID NO: 623992 - RNA, 22 nt, Human
auauuaaauggauuuugggagc

SEQ ID NO: 623993 - RNA, 23 nt, Human
ucucagaggauuccugggccuug

SEQ ID NO: 623994 - RNA, 22 nt, Human
auaugauuccacuauuguaugg

SEQ ID NO: 623995 - RNA, 22 nt, Human
aagggcucugugcuugucccau

SEQ ID NO: 623996 - RNA, 22 nt, Human
accauguguuuuacacauggua

SEQ ID NO: 623997 - RNA, 22 nt, Human
cccagcucccaaguugcuaugg

SEQ ID NO: 623998 - RNA, 19 nt, Human
auuccucaaggacagaaau

SEQ ID NO: 623999 - RNA, 22 nt, Human
aagaaaccaacccugccagcac

SEQ ID NO: 624000 - RNA, 22 nt, Human
ccugcccuaauccagagacuag

SEQ ID NO: 624001 - RNA, 22 nt, Human
ucaggcuugaggucuguaugug

SEQ ID NO: 624002 - RNA, 22 nt, Human
ucaguccauaggugggccugag

SEQ ID NO: 624003 - RNA, 22 nt, Human
acugggaagucagagagaggcu

SEQ ID NO: 624004 - RNA, 22 nt, Human
cguuuauuuugaagauuccacu

SEQ ID NO: 624005 - RNA, 22 nt, Human
ggcuucugaaccaggcccugga

SEQ ID NO: 624006 - RNA, 22 nt, Human
uaaauacagucauuugagccau

SEQ ID NO: 624007 - RNA, 22 nt, Human
agauccaguuaauagcuucauu

SEQ ID NO: 624008 - RNA, 22 nt, Human
gccucugccaagggggcugcgg

SEQ ID NO: 624009 - RNA, 22 nt, Human
guggcaggucccauuggagcag

SEQ ID NO: 624010 - RNA, 22 nt, Human
aaccagcuaaacuuugcucgaa

SEQ ID NO: 624011 - RNA, 22 nt, Human
acacaggaagagagauaauaau

SEQ ID NO: 624012 - RNA, 22 nt, Human
accaggcagcacuuuccuugca

SEQ ID NO: 624013 - RNA, 22 nt, Human
ugagagauuuucaugagugcuu

SEQ ID NO: 624014 - RNA, 22 nt, Human
aguguuuagucaaguaagacgc

SEQ ID NO: 624015 - RNA, 22 nt, Human
gucuuauuuaaggacaagaaga

SEQ ID NO: 624016 - RNA, 21 nt, Human
ugcauuucuaacuaguugacc

SEQ ID NO: 624017 - RNA, 22 nt, Human
aaucacaugcagggccuccacc

SEQ ID NO: 624018 - RNA, 19 nt, Human
ucuacaaaguggcaucagg

SEQ ID NO: 624019 - RNA, 22 nt, Human
agugauuagaaaguacacuugg

SEQ ID NO: 624020 - RNA, 22 nt, Human
cagugcaguggcugagcuggag

SEQ ID NO: 624021 - RNA, 22 nt, Human
uccccaggaaucaggugguugc

SEQ ID NO: 624022 - RNA, 22 nt, Human
ugugcuucugcagagacuauuu

SEQ ID NO: 624023 - RNA, 22 nt, Human
auauuucuugagcaccugguau

SEQ ID NO: 624024 - RNA, 22 nt, Human
aguuccaugucuggguuuguga

SEQ ID NO: 624025 - RNA, 22 nt, Human
aagaucagaacuuuauacagga

SEQ ID NO: 624026 - RNA, 22 nt, Human
cagcaucucguggcuggauaga

SEQ ID NO: 624027 - RNA, 22 nt, Human
aggcaagcgcagaagcggagga

SEQ ID NO: 624028 - RNA, 22 nt, Human
uggcuggcuagugggcaggauu

SEQ ID NO: 624029 - RNA, 22 nt, Human
guggccugucagaagccguggg

SEQ ID NO: 624030 - RNA, 22 nt, Human
agguuuacugagggugcugguu

SEQ ID NO: 624031 - RNA, 20 nt, Human
ggagagcagggaagacagua

SEQ ID NO: 624032 - RNA, 22 nt, Human
uguggugccgagagucuggacg

SEQ ID NO: 624033 - RNA, 22 nt, Human
uuucuggguuuaugucacagcu

SEQ ID NO: 624034 - RNA, 22 nt, Human
agagcuggcugcugcggugcuu

SEQ ID NO: 624035 - RNA, 22 nt, Human
ccucuucuaggacguccuugug

SEQ ID NO: 624036 - RNA, 22 nt, Human
uacuaacuuguacacagccuaa

SEQ ID NO: 624037 - RNA, 22 nt, Human
gggcagcucuggcugugggaag

SEQ ID NO: 624038 - RNA, 22 nt, Human
caugcauucagaaucucucaca

SEQ ID NO: 624039 - RNA, 23 nt, Human
cugagguaaaauauucugaagga

SEQ ID NO: 624040 - RNA, 22 nt, Human
ugugaaaagcaggcuacuuucu

SEQ ID NO: 624041 - RNA, 22 nt, Human
aaugugauuagccucuacugga

SEQ ID NO: 624042 - RNA, 19 nt, Human
uaggccagaaguuuuccac

SEQ ID NO: 624043 - RNA, 22 nt, Human
agcuucucaggagucugaggca

SEQ ID NO: 624044 - RNA, 22 nt, Human
uucauguguauggaacauuuuu

SEQ ID NO: 624045 - RNA, 22 nt, Human
gucaggaaaaauugauaauuuu

SEQ ID NO: 624046 - RNA, 22 nt, Human
agagugaaaagcuagagcagua

SEQ ID NO: 624047 - RNA, 22 nt, Human
ugaggcacugggagagcacacu

SEQ ID NO: 624048 - RNA, 22 nt, Human
gcugacugguucaggucccgcu

SEQ ID NO: 624049 - RNA, 22 nt, Human
uguuccauaaguggugcuuugu

SEQ ID NO: 624050 - RNA, 22 nt, Human
uugaaugcaucuuugagcuccu

SEQ ID NO: 624051 - RNA, 22 nt, Human
gcagcugcagacccucagugcu

SEQ ID NO: 624052 - RNA, 22 nt, Human
guuuuacaagguuaaucagcag

SEQ ID NO: 624053 - RNA, 22 nt, Human
ggcagguagccuagaggagguu

SEQ ID NO: 624054 - RNA, 22 nt, Human
uccuggaagugcuuggugaggg

SEQ ID NO: 624055 - RNA, 22 nt, Human
uucuggccaaggcugccagauu

SEQ ID NO: 624056 - RNA, 22 nt, Human
cucucuuucugaaugaggacua

SEQ ID NO: 624057 - RNA, 22 nt, Human
agguacagaugaaagucuaguu

SEQ ID NO: 624058 - RNA, 22 nt, Human
gaggugguucagguagagccca

SEQ ID NO: 624059 - RNA, 22 nt, Human
aauuauauuguggugugaaugu

SEQ ID NO: 624060 - RNA, 22 nt, Human
uauuugucuuucuuauaagaau

SEQ ID NO: 624061 - RNA, 22 nt, Human
gguggcagucuuaagagaucuu

SEQ ID NO: 624062 - RNA, 22 nt, Human
gggucugagggccuuaccacuc

SEQ ID NO: 624063 - RNA, 22 nt, Human
ugucagggcaugcgguccagcc

SEQ ID NO: 624064 - RNA, 22 nt, Human
ccagcuggaacggcagcccagc

SEQ ID NO: 624065 - RNA, 22 nt, Human
gccaggcgggucucaaacuccu

SEQ ID NO: 624066 - RNA, 20 nt, Human
acaguguuagguuuuuccuu

SEQ ID NO: 624067 - RNA, 22 nt, Human
aaauaaguuaaacuagaaugau

SEQ ID NO: 624068 - RNA, 22 nt, Human
aaagcugggcuggccaacccag

SEQ ID NO: 624069 - RNA, 22 nt, Human
aaaagagaaaguggcaggcuuu

SEQ ID NO: 624070 - RNA, 22 nt, Human
agggggguggaucaccugaggu

SEQ ID NO: 624071 - RNA, 21 nt, Human
acagcagagaucaagacuaag

SEQ ID NO: 624072 - RNA, 22 nt, Human
uuuacagcaacagugcagaggu

SEQ ID NO: 624073 - RNA, 22 nt, Human
cccagccaagugaucugaccgc

SEQ ID NO: 624074 - RNA, 22 nt, Human
agggggcaggagagaccugcug

SEQ ID NO: 624075 - RNA, 22 nt, Human
uugucaaguaaggcugacauuu

SEQ ID NO: 624076 - RNA, 18 nt, Human
aggcuucccaggcaggcc

SEQ ID NO: 624077 - RNA, 22 nt, Human
ccuggcucugcagccacuccag

SEQ ID NO: 624078 - RNA, 22 nt, Human
uuugaguugcuuauuuaauagg

SEQ ID NO: 624079 - RNA, 22 nt, Human
ugagaggucaaagggcauggag

SEQ ID NO: 624080 - RNA, 22 nt, Human
caauagcuauguaaccugaaga

SEQ ID NO: 624081 - RNA, 22 nt, Human
ugcuuuaaccaucuuguuugga

SEQ ID NO: 624082 - RNA, 19 nt, Human
ucugggaaugaugccagca

SEQ ID NO: 624083 - RNA, 22 nt, Human
auucacauuuagccucugacau

SEQ ID NO: 624084 - RNA, 18 nt, Human
ugaauagggguuugcaga

SEQ ID NO: 624085 - RNA, 22 nt, Human
uagaggcugggaauuauuuuca

SEQ ID NO: 624086 - RNA, 22 nt, Human
ccagggucuucgaggcagcaau

SEQ ID NO: 624087 - RNA, 23 nt, Human
uacuacagggucuugcuaugaau

SEQ ID NO: 624088 - RNA, 22 nt, Human
cucuggaguggguggccgggag

SEQ ID NO: 624089 - RNA, 22 nt, Human
ucagaguucucuguccagauga

SEQ ID NO: 624090 - RNA, 22 nt, Human
aacauaaauuugaaguggcaaa

SEQ ID NO: 624091 - RNA, 22 nt, Human
uuccugagucccggguaaagau

SEQ ID NO: 624092 - RNA, 22 nt, Human
ggaccaggagcucagagcccuc

SEQ ID NO: 624093 - RNA, 22 nt, Human
ucccuagucgcaucuguggaga

SEQ ID NO: 624094 - RNA, 22 nt, Human
agagcccugccaauggaugagg

SEQ ID NO: 624095 - RNA, 22 nt, Human
uucuagcacugccuggaagaca

SEQ ID NO: 624096 - RNA, 22 nt, Human
ggaaaauacugauucaugccau

SEQ ID NO: 624097 - RNA, 22 nt, Human
uacaugaauuugagucagagga

SEQ ID NO: 624098 - RNA, 22 nt, Human
ugcugagaugaauagggcuguc

SEQ ID NO: 624099 - RNA, 22 nt, Human
caugugcauccuuaaucucccu

SEQ ID NO: 624100 - RNA, 22 nt, Human
ugcaugaacacaugugcaugua

SEQ ID NO: 624101 - RNA, 22 nt, Human
cuuuccugagaaaggagaagga

SEQ ID NO: 624102 - RNA, 22 nt, Human
uagcucuucaaucacugucucc

SEQ ID NO: 624103 - RNA, 22 nt, Human
cagcuccagccaccggggggug

SEQ ID NO: 624104 - RNA, 18 nt, Human
gugugcucagagagugag

SEQ ID NO: 624105 - RNA, 22 nt, Human
aggagccagauucucucacuuu

SEQ ID NO: 624106 - RNA, 22 nt, Human
uucauagguuugcugugaacau

SEQ ID NO: 624107 - RNA, 21 nt, Human
auacauucuauuaagcauuua

SEQ ID NO: 624108 - RNA, 22 nt, Human
ggcucugcuggauugaggccag

SEQ ID NO: 624109 - RNA, 22 nt, Human
cagcccagccuugucucuuuau

SEQ ID NO: 624110 - RNA, 22 nt, Human
acaauacuuaccaauguuuuug

SEQ ID NO: 624111 - RNA, 22 nt, Human
ggggccuccagcacuaggcagc

SEQ ID NO: 624112 - RNA, 22 nt, Human
agcccgagcgcaccuguggaaa

SEQ ID NO: 624113 - RNA, 22 nt, Human
cagagguaccagcagccucugg

SEQ ID NO: 624114 - RNA, 22 nt, Human
cagagaccccgcugcccuucug

SEQ ID NO: 624115 - RNA, 22 nt, Human
agggccaccagggagucucagg

SEQ ID NO: 624116 - RNA, 22 nt, Human
ucuguuccaguagaaaggugca

SEQ ID NO: 624117 - RNA, 22 nt, Human
cccuccuuaccaccacagcucc

SEQ ID NO: 624118 - RNA, 22 nt, Human
agugcuguaacaacuuauuugg

SEQ ID NO: 624119 - RNA, 22 nt, Human
uucugcuguugugacguuaguu

SEQ ID NO: 624120 - RNA, 22 nt, Human
ucacaugucaagaagauaauuu

SEQ ID NO: 624121 - RNA, 22 nt, Human
ucuguuuaugcauauuuaaaac

SEQ ID NO: 624122 - RNA, 22 nt, Human
gacacagagggcaccagauaug

SEQ ID NO: 624123 - RNA, 22 nt, Human
uauuaucauugguaauaugguc

SEQ ID NO: 624124 - RNA, 22 nt, Human
caacacagccauuccccuagaa

SEQ ID NO: 624125 - RNA, 22 nt, Human
caggaggagcuggccgccucau

SEQ ID NO: 624126 - RNA, 22 nt, Human
ucaguuagggccucagaagaca

SEQ ID NO: 624127 - RNA, 22 nt, Human
aucuggaguuucaguuuucugg

SEQ ID NO: 624128 - RNA, 22 nt, Human
cagugaguaaguagacagcuua

SEQ ID NO: 624129 - RNA, 22 nt, Human
ccugucugcggaggaguggaag

SEQ ID NO: 624130 - RNA, 22 nt, Human
uuucucuauuaggggcuagcuu

SEQ ID NO: 624131 - RNA, 23 nt, Human
caugggagugagaaugccagcuc

SEQ ID NO: 624132 - RNA, 22 nt, Human
aggcacugugcuucuuauaugu

SEQ ID NO: 624133 - RNA, 22 nt, Human
aaguucaagcucugccuaaaau

SEQ ID NO: 624134 - RNA, 22 nt, Human
gcuggcugcuaggacagcuaca

SEQ ID NO: 624135 - RNA, 21 nt, Human
aaauuuucuuggcuguagugu

SEQ ID NO: 624136 - RNA, 22 nt, Human
acauguacauacacauauguaa

SEQ ID NO: 624137 - RNA, 22 nt, Human
gggugugucuuuugcuccugga

SEQ ID NO: 624138 - RNA, 19 nt, Human
cugucccagacucugcucu

SEQ ID NO: 624139 - RNA, 22 nt, Human
acccaggagguggaggcugcag

SEQ ID NO: 624140 - RNA, 22 nt, Human
uuucuuagcgaugcuugauaaa

SEQ ID NO: 624141 - RNA, 22 nt, Human
ggagcucaccuuggagucucug

SEQ ID NO: 624142 - RNA, 22 nt, Human
ucccugggcggacauucuccca

SEQ ID NO: 624143 - RNA, 22 nt, Human
gcaaggagccuggaggugagug

SEQ ID NO: 624144 - RNA, 22 nt, Human
ccacaggcugcugcaggucccg

SEQ ID NO: 624145 - RNA, 22 nt, Human
uugcaacuaaaagaacuugaca

SEQ ID NO: 624146 - RNA, 21 nt, Human
aaaaaugaaguuguucaggaa

SEQ ID NO: 624147 - RNA, 22 nt, Human
uuagauaauguuauuguaauuu

SEQ ID NO: 624148 - RNA, 22 nt, Human
gccuuggccaacaccuugcaaa

SEQ ID NO: 624149 - RNA, 22 nt, Human
gcuggcccagggucaccuagga

SEQ ID NO: 624150 - RNA, 22 nt, Human
cugucaguucuuccagauagag

SEQ ID NO: 624151 - RNA, 22 nt, Human
aauaucuagccuuuagcagcuu

SEQ ID NO: 624152 - RNA, 22 nt, Human
uccagagaauucuacgcagugc

SEQ ID NO: 624153 - RNA, 22 nt, Human
ggguggagaggcuaaguccagu

SEQ ID NO: 624154 - RNA, 22 nt, Human
ucaaugauuagaguuuagugug

SEQ ID NO: 624155 - RNA, 22 nt, Human
gcuggcccagcguggggccgug

SEQ ID NO: 624156 - RNA, 23 nt, Human
uggucugaagccucagguuccuc

SEQ ID NO: 624157 - RNA, 22 nt, Human
guggccagaaucuugaggccuu

SEQ ID NO: 624158 - RNA, 20 nt, Human
uggagucaugggacacucac

SEQ ID NO: 624159 - RNA, 22 nt, Human
uuccugggggcagcagucuuga

SEQ ID NO: 624160 - RNA, 22 nt, Human
uuugcuuuugugcucuaguggu

SEQ ID NO: 624161 - RNA, 22 nt, Human
aauuccagccucaguucuauua

SEQ ID NO: 624162 - RNA, 22 nt, Human
acuugcagcagcagcuauuggc

SEQ ID NO: 624163 - RNA, 19 nt, Human
gacauuccugacacuggcu

SEQ ID NO: 624164 - RNA, 22 nt, Human
gagucugagaacugggcucagu

SEQ ID NO: 624165 - RNA, 22 nt, Human
gccuugccucagccauggaaac

SEQ ID NO: 624166 - RNA, 22 nt, Human
cacagcaauagcuaacugauac

SEQ ID NO: 624167 - RNA, 22 nt, Human
aaguccauagguuucaugaggg

SEQ ID NO: 624168 - RNA, 22 nt, Human
uagagcaguggguaccauggca

SEQ ID NO: 624169 - RNA, 22 nt, Human
cacccagugaaggagcaagagg

SEQ ID NO: 624170 - RNA, 22 nt, Human
caggagcaaauccaaaagaauu

SEQ ID NO: 624171 - RNA, 22 nt, Human
agauauugugcauacugcuguu

SEQ ID NO: 624172 - RNA, 22 nt, Human
cacagcuggaaugggguaccug

SEQ ID NO: 624173 - RNA, 22 nt, Human
acaacuucucacagauaaauuu

SEQ ID NO: 624174 - RNA, 23 nt, Human
agcuccuuugaaaguauguuuuu

SEQ ID NO: 624175 - RNA, 22 nt, Human
auguaacaaaugguauacaugu

SEQ ID NO: 624176 - RNA, 22 nt, Human
acacccagcugggccaccucca

SEQ ID NO: 624177 - RNA, 22 nt, Human
ugaccaauacuguggaugccag

SEQ ID NO: 624178 - RNA, 22 nt, Human
agacauuuuagacauaaaagau

SEQ ID NO: 624179 - RNA, 22 nt, Human
ugcaaaaugacuucugaaaaga

SEQ ID NO: 624180 - RNA, 22 nt, Human
cagcauggguuccgggggccug

SEQ ID NO: 624181 - RNA, 22 nt, Human
agcugcccuucucuugcccuug

SEQ ID NO: 624182 - RNA, 22 nt, Human
cugagagaagagcgcaguuugu

SEQ ID NO: 624183 - RNA, 22 nt, Human
ccagcuccagcauagccaccau

SEQ ID NO: 624184 - RNA, 19 nt, Human
ccucacccugcagaggagg

SEQ ID NO: 624185 - RNA, 22 nt, Human
aaaagagaguugccagucugua

SEQ ID NO: 624186 - RNA, 22 nt, Human
augaacaucucugauccaagca

SEQ ID NO: 624187 - RNA, 18 nt, Human
gccuccaccauggagggu

SEQ ID NO: 624188 - RNA, 20 nt, Human
gaaacauuggcagcaacuga

SEQ ID NO: 624189 - RNA, 22 nt, Human
cgcagcagccccgugguaggug

SEQ ID NO: 624190 - RNA, 22 nt, Human
gagccaggcaccuucuguguug

SEQ ID NO: 624191 - RNA, 22 nt, Human
auuuaugcaucccagcauguga

SEQ ID NO: 624192 - RNA, 22 nt, Human
aagauguuagauuauggggaca

SEQ ID NO: 624193 - RNA, 22 nt, Human
uuggccaagggaucgagguugg

SEQ ID NO: 624194 - RNA, 22 nt, Human
ggcugggaggaugacuugcuac

SEQ ID NO: 624195 - RNA, 22 nt, Human
aaugugacugaauauuuacucu

SEQ ID NO: 624196 - RNA, 22 nt, Human
aaagaacaucggagugggcggg

SEQ ID NO: 624197 - RNA, 18 nt, Human
uuauucagacgcauauga

SEQ ID NO: 624198 - RNA, 22 nt, Human
agcuccugcccaggaaggcucu

SEQ ID NO: 624199 - RNA, 21 nt, Human
cccacggaaugaugaggcacu

SEQ ID NO: 624200 - RNA, 22 nt, Human
cccaguuucaacuuuccagugg

SEQ ID NO: 624201 - RNA, 22 nt, Human
acucaucuauuagauaucuguu

SEQ ID NO: 624202 - RNA, 22 nt, Human
uagaucugauacaauucaucug

SEQ ID NO: 624203 - RNA, 22 nt, Human
guuucagagguguucauuuuca

SEQ ID NO: 624204 - RNA, 22 nt, Human
gagagacagcacacaguguggg

SEQ ID NO: 624205 - RNA, 22 nt, Human
accuaacuuaccuagguccaca

SEQ ID NO: 624206 - RNA, 22 nt, Human
uacaggacagauguuuacagga

SEQ ID NO: 624207 - RNA, 22 nt, Human
ugaaauguucuggaguuucugu

SEQ ID NO: 624208 - RNA, 22 nt, Human
agaagccaaaugccagugaccu

SEQ ID NO: 624209 - RNA, 19 nt, Human
ugaauacagagauacagaa

SEQ ID NO: 624210 - RNA, 22 nt, Human
ccucuuccucaccaucuacaac

SEQ ID NO: 624211 - RNA, 22 nt, Human
cacagcauaaugaaauauacuu

SEQ ID NO: 624212 - RNA, 22 nt, Human
ugccucagagugggcuugcuau

SEQ ID NO: 624213 - RNA, 21 nt, Human
agcagcugggcaacauggagg

SEQ ID NO: 624214 - RNA, 22 nt, Human
cuuuuguucuacagcuggggaa

SEQ ID NO: 624215 - RNA, 22 nt, Human
augcagcugacauuuucauguu

SEQ ID NO: 624216 - RNA, 21 nt, Human
ggcacuaggcccggaggaagc

SEQ ID NO: 624217 - RNA, 22 nt, Human
cugggugguuuugaugugaauu

SEQ ID NO: 624218 - RNA, 22 nt, Human
cuguuguauuauucaauauuau

SEQ ID NO: 624219 - RNA, 22 nt, Human
ccuuuucuagaaagggaggcaa

SEQ ID NO: 624220 - RNA, 22 nt, Human
caagaucuuccucaauagaccu

SEQ ID NO: 624221 - RNA, 22 nt, Human
agcagcacccagagccaugucu

SEQ ID NO: 624222 - RNA, 18 nt, Human
agcaaauauuaagugcau

SEQ ID NO: 624223 - RNA, 22 nt, Human
cuccaggccagggaaguggaca

SEQ ID NO: 624224 - RNA, 22 nt, Human
acacaguaggauaguuugagga

SEQ ID NO: 624225 - RNA, 22 nt, Human
gugugagcaucaaagccuguca

SEQ ID NO: 624226 - RNA, 22 nt, Human
gaaguuacauacugucacuucu

SEQ ID NO: 624227 - RNA, 22 nt, Human
ucucccacgguacaggauaaac

SEQ ID NO: 624228 - RNA, 22 nt, Human
ggguggggcccaggaaaucuau

SEQ ID NO: 624229 - RNA, 22 nt, Human
uuugggaacuuaauuaugucug

SEQ ID NO: 624230 - RNA, 22 nt, Human
cagucccaucucccagguggcu

SEQ ID NO: 624231 - RNA, 22 nt, Human
agaguauuuugauuauccugga

SEQ ID NO: 624232 - RNA, 17 nt, Human
uccaggagaggcaaugg

SEQ ID NO: 624233 - RNA, 22 nt, Human
cucugcuugugucaggcaugcu

SEQ ID NO: 624234 - RNA, 23 nt, Human
acagggcuguccagggcuagguc

SEQ ID NO: 624235 - RNA, 22 nt, Human
aaaggaggaauggagagaugcu

SEQ ID NO: 624236 - RNA, 20 nt, Human
agcagcauuguucuagagca

SEQ ID NO: 624237 - RNA, 22 nt, Human
gcaaagcugggugugaaugcac

SEQ ID NO: 624238 - RNA, 19 nt, Human
ucaaaggcuuuuaggagac

SEQ ID NO: 624239 - RNA, 22 nt, Human
gcagggaagaucuuggagcugc

SEQ ID NO: 624240 - RNA, 22 nt, Human
cagaggaaguuccuugaugaga

SEQ ID NO: 624241 - RNA, 22 nt, Human
cauuugaagacuuagaagagga

SEQ ID NO: 624242 - RNA, 22 nt, Human
cugugucuccuuggugggauau

SEQ ID NO: 624243 - RNA, 22 nt, Human
ugcacagauagugauagauagc

SEQ ID NO: 624244 - RNA, 22 nt, Human
acaggucuggucugggugggac

SEQ ID NO: 624245 - RNA, 22 nt, Human
uuuuuuauagcaaugaacccac

SEQ ID NO: 624246 - RNA, 22 nt, Human
gcacagcaguggcauaaacaau

SEQ ID NO: 624247 - RNA, 22 nt, Human
acagggaccugugagcuccaua

SEQ ID NO: 624248 - RNA, 22 nt, Human
auccuugacacacuccaguacu

SEQ ID NO: 624249 - RNA, 22 nt, Human
ucacauuugcuaucccacuccu

SEQ ID NO: 624250 - RNA, 22 nt, Human
caauguaucaaccagaaaguuc

SEQ ID NO: 624251 - RNA, 22 nt, Human
gaacagcauguaagaagcuacu

SEQ ID NO: 624252 - RNA, 22 nt, Human
gccugugcuguucccucugcca

SEQ ID NO: 624253 - RNA, 21 nt, Human
uuucuuucuggcucucacagu

SEQ ID NO: 624254 - RNA, 22 nt, Human
cuuguauacaguguacacauug

SEQ ID NO: 624255 - RNA, 22 nt, Human
ucacagacaauuguuuuggugu

SEQ ID NO: 624256 - RNA, 22 nt, Human
uuuaacucugucauucucuuua

SEQ ID NO: 624257 - RNA, 22 nt, Human
uuguaacucugaauacauccua

SEQ ID NO: 624258 - RNA, 22 nt, Human
ugccuuggugcuucuucaugug

SEQ ID NO: 624259 - RNA, 22 nt, Human
cagcauuuagaauuugaagugu

SEQ ID NO: 624260 - RNA, 21 nt, Human
ucucuguggccuacccucuac

SEQ ID NO: 624261 - RNA, 22 nt, Human
ggaggcucgcuggucgcacagc

SEQ ID NO: 624262 - RNA, 21 nt, Human
aggagccagccugucagucua

SEQ ID NO: 624263 - RNA, 22 nt, Human
cacagaaauauugugucccuug

SEQ ID NO: 624264 - RNA, 22 nt, Human
ugaucuuuucuauuuaugguag

SEQ ID NO: 624265 - RNA, 22 nt, Human
acauauaagggaucagugacag

SEQ ID NO: 624266 - RNA, 22 nt, Human
cugguguggcggcgcccuguag

SEQ ID NO: 624267 - RNA, 22 nt, Human
gccugccucaaaaucccaguuc

SEQ ID NO: 624268 - RNA, 22 nt, Human
gagguggguguaucacagguca

SEQ ID NO: 624269 - RNA, 22 nt, Human
ucuucaguuguaaaaguguugg

SEQ ID NO: 624270 - RNA, 22 nt, Human
ugagaaguacuacaagagaggg

SEQ ID NO: 624271 - RNA, 22 nt, Human
cucuggaauggguguuucuaac

SEQ ID NO: 624272 - RNA, 22 nt, Human
auaaaaaggacagauguggucu

SEQ ID NO: 624273 - RNA, 21 nt, Human
ugaguuaaggauccaauucug

SEQ ID NO: 624274 - RNA, 22 nt, Human
uguuuaauucaccaucauguuc

SEQ ID NO: 624275 - RNA, 22 nt, Human
ucauuccuuauccguaucuuuu

SEQ ID NO: 624276 - RNA, 22 nt, Human
ugaacgcagguccacauggcuc

SEQ ID NO: 624277 - RNA, 22 nt, Human
caagaugaaacuacagggagga

SEQ ID NO: 624278 - RNA, 22 nt, Human
augugagcaggugcuggcugcu

SEQ ID NO: 624279 - RNA, 22 nt, Human
gaagacaucguguggacuaaca

SEQ ID NO: 624280 - RNA, 17 nt, Human
aucugcuucacccagca

SEQ ID NO: 624281 - RNA, 22 nt, Human
gcuuacaaacaacagaaauuaa

SEQ ID NO: 624282 - RNA, 22 nt, Human
cagcuggacuuuugauagaagu

SEQ ID NO: 624283 - RNA, 22 nt, Human
ugcaggaggcuuuauucaggau

SEQ ID NO: 624284 - RNA, 22 nt, Human
gcgcacauguucagauguguga

SEQ ID NO: 624285 - RNA, 22 nt, Human
uucagaaguagcuaagcaguca

SEQ ID NO: 624286 - RNA, 22 nt, Human
uggcagccuggaaucucucagc

SEQ ID NO: 624287 - RNA, 22 nt, Human
ggaaagagcccagcagugcuug

SEQ ID NO: 624288 - RNA, 22 nt, Human
cccuccaugagugugcugcugg

SEQ ID NO: 624289 - RNA, 22 nt, Human
gugggaagaacuucaaguggcu

SEQ ID NO: 624290 - RNA, 22 nt, Human
ggcacaagguuuaaauaacauc

SEQ ID NO: 624291 - RNA, 22 nt, Human
auuuccaggagaaaggauuuua

SEQ ID NO: 624292 - RNA, 22 nt, Human
uuauccuggauuauauauguga

SEQ ID NO: 624293 - RNA, 22 nt, Human
ugggcugcugucugcacaugcu

SEQ ID NO: 624294 - RNA, 22 nt, Human
auugagaaauauaaucuggaaa

SEQ ID NO: 624295 - RNA, 22 nt, Human
cucagaaacggagcugccauuu

SEQ ID NO: 624296 - RNA, 22 nt, Human
gaauguuuaaaaggugcaguuu

SEQ ID NO: 624297 - RNA, 22 nt, Human
ggcugccauaacugauaccaua

SEQ ID NO: 624298 - RNA, 22 nt, Human
accaggacuuuguauucagcuu

SEQ ID NO: 624299 - RNA, 22 nt, Human
aagcccugucacccugacuuca

SEQ ID NO: 624300 - RNA, 22 nt, Human
ccaggccuggacggguggccug

SEQ ID NO: 624301 - RNA, 22 nt, Human
uggccacagccucugccaguuc

SEQ ID NO: 624302 - RNA, 22 nt, Human
acacugugagcugaagggcugc

SEQ ID NO: 624303 - RNA, 22 nt, Human
acugagguggggucugcuugga

SEQ ID NO: 624304 - RNA, 22 nt, Human
cuugccuguggcuaguuggcuc

SEQ ID NO: 624305 - RNA, 22 nt, Human
agccucugcuuaugcaaaggua

SEQ ID NO: 624306 - RNA, 23 nt, Human
uucagaagaaaugaguacaggag

SEQ ID NO: 624307 - RNA, 22 nt, Human
cuuuagaaaucuggauguauuu

SEQ ID NO: 624308 - RNA, 22 nt, Human
agauucauugcuuuaggcauug

SEQ ID NO: 624309 - RNA, 22 nt, Human
uucucuggggacuugguuggag

SEQ ID NO: 624310 - RNA, 22 nt, Human
guucucucaaacuuuguguuug

SEQ ID NO: 624311 - RNA, 22 nt, Human
acuuuggguaagccaggugcua

SEQ ID NO: 624312 - RNA, 22 nt, Human
gcguaaggccucuggucucgga

SEQ ID NO: 624313 - RNA, 22 nt, Human
cuggccuuguuccuccccaagu

SEQ ID NO: 624314 - RNA, 22 nt, Human
aggaaaauuaucaugagagcca

SEQ ID NO: 624315 - RNA, 22 nt, Human
acaguuuauugcacagguaacc

SEQ ID NO: 624316 - RNA, 22 nt, Human
gucaacuguaccuaaagaaagu

SEQ ID NO: 624317 - RNA, 22 nt, Human
gccugaaguuucaugccucuau

SEQ ID NO: 624318 - RNA, 17 nt, Human
gauuuccugaaguucuu

SEQ ID NO: 624319 - RNA, 23 nt, Human
ggucacaugugagauuaaacuug

SEQ ID NO: 624320 - RNA, 22 nt, Human
acaagcuccuuauucagcuggg

SEQ ID NO: 624321 - RNA, 21 nt, Human
ucuuuucucugcaggauuccu

SEQ ID NO: 624322 - RNA, 22 nt, Human
ucuuuggcuaugauuuacuguu

SEQ ID NO: 624323 - RNA, 22 nt, Human
auuguuuacacuaacuucauaa

SEQ ID NO: 624324 - RNA, 22 nt, Human
uggaaugacaaguuguucagag

SEQ ID NO: 624325 - RNA, 19 nt, Human
gcaggcagcugggguaucc

SEQ ID NO: 624326 - RNA, 22 nt, Human
ucucacuuuccagacuuuucaa

SEQ ID NO: 624327 - RNA, 22 nt, Human
ggcuuuaugcacagcagauggu

SEQ ID NO: 624328 - RNA, 22 nt, Human
gaauucuuuucuuucugaaagu

SEQ ID NO: 624329 - RNA, 22 nt, Human
gagcuggccgcagagagggcag

SEQ ID NO: 624330 - RNA, 21 nt, Human
uuuagcaagaguauagugcau

SEQ ID NO: 624331 - RNA, 16 nt, Human
ggugggguaguuagaa

SEQ ID NO: 624332 - RNA, 22 nt, Human
agaaacuauccugaguagcaaa

SEQ ID NO: 624333 - RNA, 22 nt, Human
aguuaaagucugaaauagagaa

SEQ ID NO: 624334 - RNA, 22 nt, Human
cuagucugugugggaccagggc

SEQ ID NO: 624335 - RNA, 22 nt, Human
augcuuuauacaaaacacuuaa

SEQ ID NO: 624336 - RNA, 22 nt, Human
cuguaauucacuagggucagcg

SEQ ID NO: 624337 - RNA, 22 nt, Human
aaauugcucuuuaaaaguacug

SEQ ID NO: 624338 - RNA, 19 nt, Human
agggcacagggacagaagg

SEQ ID NO: 624339 - RNA, 22 nt, Human
ucugugcuuucccugccuucuu

SEQ ID NO: 624340 - RNA, 22 nt, Human
augaagauaauagcauugguug

SEQ ID NO: 624341 - RNA, 22 nt, Human
augcaaaaguaguugcaguuuu

SEQ ID NO: 624342 - RNA, 22 nt, Human
ucagccacuacccaccuuaaca

SEQ ID NO: 624343 - RNA, 22 nt, Human
cugggcucaaauccuaucucca

SEQ ID NO: 624344 - RNA, 20 nt, Human
cuguggcaucuugaaggagg

SEQ ID NO: 624345 - RNA, 22 nt, Human
uggcagauuuucucuggaggag

SEQ ID NO: 624346 - RNA, 20 nt, Human
ccugucucacguuccgcccc

SEQ ID NO: 624347 - RNA, 19 nt, Human
uguccucacagagcauaac

SEQ ID NO: 624348 - RNA, 22 nt, Human
cagcuauuuugccuaucauggu

SEQ ID NO: 624349 - RNA, 22 nt, Human
cuacagaauucaacaaaugguu

SEQ ID NO: 624350 - RNA, 22 nt, Human
ugcaaauagccugaugaaagaa

SEQ ID NO: 624351 - RNA, 21 nt, Human
aauuagggugccucuuauaau

SEQ ID NO: 624352 - RNA, 22 nt, Human
ucccagugagguccuggcuguc

SEQ ID NO: 624353 - RNA, 22 nt, Human
caaugcuuuauuuccuccccuu

SEQ ID NO: 624354 - RNA, 22 nt, Human
ugagcagauuuguucuaggggu

SEQ ID NO: 624355 - RNA, 22 nt, Human
gcgccugccaccaugccaggcu

SEQ ID NO: 624356 - RNA, 22 nt, Human
agcuaaggagcaaguaggaguu

SEQ ID NO: 624357 - RNA, 22 nt, Human
aaucaggaugacugucauuuca

SEQ ID NO: 624358 - RNA, 22 nt, Human
ggagacaguauggcuuguagcu

SEQ ID NO: 624359 - RNA, 22 nt, Human
ucuucuucccaucccucaaaug

SEQ ID NO: 624360 - RNA, 22 nt, Human
gugcgugugccuaucaauaaag

SEQ ID NO: 624361 - RNA, 20 nt, Human
ugucagugccugaggcacag

SEQ ID NO: 624362 - RNA, 22 nt, Human
acaggucuccagagugagagga

SEQ ID NO: 624363 - RNA, 22 nt, Human
agguggguccuggcucugccau

SEQ ID NO: 624364 - RNA, 22 nt, Human
ucccagcgcggggggaggaucc

SEQ ID NO: 624365 - RNA, 22 nt, Human
acagaguauuggaaaggcagug

SEQ ID NO: 624366 - RNA, 17 nt, Human
uucauuaauaaaagcaa

SEQ ID NO: 624367 - RNA, 22 nt, Human
cugggacuugcagagcaggagg

SEQ ID NO: 624368 - RNA, 22 nt, Human
ccaggccccagggcuggcuuuc

SEQ ID NO: 624369 - RNA, 22 nt, Human
ccaagaggggcagagggcugca

SEQ ID NO: 624370 - RNA, 22 nt, Human
uuuuaugagugucccucugugg

SEQ ID NO: 624371 - RNA, 22 nt, Human
acacuguuuuagggaagaaaau

SEQ ID NO: 624372 - RNA, 22 nt, Human
uguuuguacucaaagccaugag

SEQ ID NO: 624373 - RNA, 22 nt, Human
uccugaagaaggcagauauuug

SEQ ID NO: 624374 - RNA, 22 nt, Human
uaccuggaaucacagaggcuga

SEQ ID NO: 624375 - RNA, 23 nt, Human
agaacagugacuaauauagagag

SEQ ID NO: 624376 - RNA, 22 nt, Human
gagugccagauggaccucuugg

SEQ ID NO: 624377 - RNA, 22 nt, Human
gaucugaagauaugaaauauuu

SEQ ID NO: 624378 - RNA, 22 nt, Human
cuucacugcagucauggcucug

SEQ ID NO: 624379 - RNA, 22 nt, Human
ucauacaauucaaucucugauu

SEQ ID NO: 624380 - RNA, 22 nt, Human
acuuuaaagcagaauggcuaug

SEQ ID NO: 624381 - RNA, 19 nt, Human
uuucuuaggccuuuggccu

SEQ ID NO: 624382 - RNA, 22 nt, Human
uugagaaaaccaucguaagaau

SEQ ID NO: 624383 - RNA, 22 nt, Human
aaaccuuuaccagacuagcaag

SEQ ID NO: 624384 - RNA, 22 nt, Human
gccaggcucuuccauuuggguc

SEQ ID NO: 624385 - RNA, 22 nt, Human
cagcaucuugaaggguaaacca

SEQ ID NO: 624386 - RNA, 22 nt, Human
uuuggucacuggauuuggcugu

SEQ ID NO: 624387 - RNA, 22 nt, Human
acacaggggaaaguggagcuga

SEQ ID NO: 624388 - RNA, 22 nt, Human
augaaaacuuuagccucauuag

SEQ ID NO: 624389 - RNA, 22 nt, Human
auacuuauacuaagaauguacu

SEQ ID NO: 624390 - RNA, 22 nt, Human
aaaaggcucuucaaaauggaag

SEQ ID NO: 624391 - RNA, 22 nt, Human
ccucuggagucagaccagcuug

SEQ ID NO: 624392 - RNA, 22 nt, Human
gccuggaggguugagguuuugu

SEQ ID NO: 624393 - RNA, 22 nt, Human
cugccagguaaacugcaggaau

SEQ ID NO: 624394 - RNA, 22 nt, Human
uggaggcugugugcaugagacc

SEQ ID NO: 624395 - RNA, 19 nt, Human
guaagggcuaauggacuau

SEQ ID NO: 624396 - RNA, 22 nt, Human
aaaagcagaccacgcuuugugg

SEQ ID NO: 624397 - RNA, 22 nt, Human
aacacugaaguagugaauacug

SEQ ID NO: 624398 - RNA, 22 nt, Human
auugagaguguauagcugaucu

SEQ ID NO: 624399 - RNA, 22 nt, Human
uacaagaaugucuuaaaagcuc

SEQ ID NO: 624400 - RNA, 21 nt, Human
cagggcuagagagaaugacaa

SEQ ID NO: 624401 - RNA, 22 nt, Human
uaagacauccguugcuuauaau

SEQ ID NO: 624402 - RNA, 22 nt, Human
agaggaggcucugggaucgucc

SEQ ID NO: 624403 - RNA, 22 nt, Human
auucuccagcucacuguccaua

SEQ ID NO: 624404 - RNA, 22 nt, Human
gaaggccucacucugcagcaua

SEQ ID NO: 624405 - RNA, 22 nt, Human
ucaaggcuauuaauucugugag

SEQ ID NO: 624406 - RNA, 22 nt, Human
agucuugucuuauuuuaauaga

SEQ ID NO: 624407 - RNA, 22 nt, Human
agcuauauagaugguguguuug

SEQ ID NO: 624408 - RNA, 22 nt, Human
uucuucagggaagcuuguuaau

SEQ ID NO: 624409 - RNA, 22 nt, Human
uuucucuggcauuagguauaaa

SEQ ID NO: 624410 - RNA, 22 nt, Human
uuagguaaguaggaucaaaaaa

SEQ ID NO: 624411 - RNA, 22 nt, Human
gcugacagagugccuggccuca

SEQ ID NO: 624412 - RNA, 21 nt, Human
ucaggaagagccaguucaugc

SEQ ID NO: 624413 - RNA, 22 nt, Human
aucuuugacugccauucuugac

SEQ ID NO: 624414 - RNA, 22 nt, Human
ugcagagagcccugccuuccuc

SEQ ID NO: 624415 - RNA, 22 nt, Human
cauuuauauaaaauguccagaa

SEQ ID NO: 624416 - RNA, 22 nt, Human
cagucucugucaucucauggga

SEQ ID NO: 624417 - RNA, 17 nt, Human
acagcaggcccggaggg

SEQ ID NO: 624418 - RNA, 22 nt, Human
ccuaaguaaguugacuuucaga

SEQ ID NO: 624419 - RNA, 22 nt, Human
guccaugacugugacucacaug

SEQ ID NO: 624420 - RNA, 22 nt, Human
gugagagcucagcugcccuggg

SEQ ID NO: 624421 - RNA, 17 nt, Human
gacagcugguuccuggc

SEQ ID NO: 624422 - RNA, 22 nt, Human
uuuaaauuauaguuaaugucug

SEQ ID NO: 624423 - RNA, 22 nt, Human
cagggucugaaacugaucacag

SEQ ID NO: 624424 - RNA, 22 nt, Human
uggaagcgagacagagaucucc

SEQ ID NO: 624425 - RNA, 22 nt, Human
aaugucugucugcacguugcuu

SEQ ID NO: 624426 - RNA, 22 nt, Human
gguagcagggcugugagucaga

SEQ ID NO: 624427 - RNA, 22 nt, Human
ggcuucuccccuuugagucuuc

SEQ ID NO: 624428 - RNA, 22 nt, Human
cuaaggaugcauauguuuuguu

SEQ ID NO: 624429 - RNA, 22 nt, Human
ggccugaggccaccagcagccc

SEQ ID NO: 624430 - RNA, 22 nt, Human
uuggcuguuuuaucuccuggug

SEQ ID NO: 624431 - RNA, 22 nt, Human
cucugaaacuccugcaccuucu

SEQ ID NO: 624432 - RNA, 22 nt, Human
uauguuaagugggauaaucaaa

SEQ ID NO: 624433 - RNA, 22 nt, Human
gaagcuucgaaagagugauuuc

SEQ ID NO: 624434 - RNA, 22 nt, Human
uacuauugaaucauugucaauc

SEQ ID NO: 624435 - RNA, 22 nt, Human
auauuaggaguuaaauguauua

SEQ ID NO: 624436 - RNA, 22 nt, Human
agguucagugccuggaacaggg

SEQ ID NO: 624437 - RNA, 22 nt, Human
agcauccaacaggagggaaggg

SEQ ID NO: 624438 - RNA, 22 nt, Human
cuucuucccagcuucccucacc

SEQ ID NO: 624439 - RNA, 22 nt, Human
acaugagauuagcucacccacu

SEQ ID NO: 624440 - RNA, 22 nt, Human
agccauggcgccacuagaggga

SEQ ID NO: 624441 - RNA, 18 nt, Human
cugccuguugcugagagg

SEQ ID NO: 624442 - RNA, 22 nt, Human
aaagccagcucugagcugcacc

SEQ ID NO: 624443 - RNA, 22 nt, Human
cccaggaggcagauguugcagu

SEQ ID NO: 624444 - RNA, 22 nt, Human
uggcuccauucuuuaugaguug

SEQ ID NO: 624445 - RNA, 22 nt, Human
ggcugcuuuaucggcugcugaa

SEQ ID NO: 624446 - RNA, 22 nt, Human
ucugggcugugccaaagcucuu

SEQ ID NO: 624447 - RNA, 22 nt, Human
cacugguguacaggagguaaaa

SEQ ID NO: 624448 - RNA, 22 nt, Human
cauggaauuuucuaggcauaaa

SEQ ID NO: 624449 - RNA, 22 nt, Human
ucagaagccggaagugcuccuc

SEQ ID NO: 624450 - RNA, 22 nt, Human
cugaagucauacacuguucuga

SEQ ID NO: 624451 - RNA, 23 nt, Human
ugagcugguauuguccaucucca

SEQ ID NO: 624452 - RNA, 22 nt, Human
uaaucacaauucagaugucuua

SEQ ID NO: 624453 - RNA, 22 nt, Human
gcaaugaggagugguagggaua

SEQ ID NO: 624454 - RNA, 22 nt, Human
agcugguauuuguuagggaguu

SEQ ID NO: 624455 - RNA, 22 nt, Human
gccaagaaagaacagcagggaa

SEQ ID NO: 624456 - RNA, 22 nt, Human
uucacauuagccaagagaugga

SEQ ID NO: 624457 - RNA, 22 nt, Human
cugggagcccugacuagccugg

SEQ ID NO: 624458 - RNA, 22 nt, Human
ugggaugagggugagccacaug

SEQ ID NO: 624459 - RNA, 22 nt, Human
auugaccugauuguuccuggaa

SEQ ID NO: 624460 - RNA, 22 nt, Human
aggcacuucauggguucaagga

SEQ ID NO: 624461 - RNA, 23 nt, Human
uccccucaggcagccagugcccu

SEQ ID NO: 624462 - RNA, 22 nt, Human
ccaggucucgggucugcucgug

SEQ ID NO: 624463 - RNA, 22 nt, Human
uuucaaaguugggaauuguaau

SEQ ID NO: 624464 - RNA, 22 nt, Human
agggagaguagauaucaggugu

SEQ ID NO: 624465 - RNA, 22 nt, Human
ugaucauuaucaaacuggucau

SEQ ID NO: 624466 - RNA, 22 nt, Human
gcugucccuuucacaagguuuu

SEQ ID NO: 624467 - RNA, 22 nt, Human
uaugucuggaauuugagguuca

SEQ ID NO: 624468 - RNA, 22 nt, Human
aaguguguuuccgugauugagg

SEQ ID NO: 624469 - RNA, 22 nt, Human
gcuugggagaggcuuccucuuu

SEQ ID NO: 624470 - RNA, 22 nt, Human
gcacaauuauuuaugcaguaug

SEQ ID NO: 624471 - RNA, 22 nt, Human
uauauguagucagucagaguaa

SEQ ID NO: 624472 - RNA, 22 nt, Human
cuauacuacuauacagauguaa

SEQ ID NO: 624473 - RNA, 22 nt, Human
ugggcuggcccaccacaccucg

SEQ ID NO: 624474 - RNA, 22 nt, Human
gagcuggggcagcuuaggagug

SEQ ID NO: 624475 - RNA, 20 nt, Human
cagcaguggaugagaguuuu

SEQ ID NO: 624476 - RNA, 22 nt, Human
ggagugaggcauuuguagcuga

SEQ ID NO: 624477 - RNA, 22 nt, Human
uaggucuguaaaugagagagac

SEQ ID NO: 624478 - RNA, 22 nt, Human
ggagggguggucgcgaagagca

SEQ ID NO: 624479 - RNA, 21 nt, Human
uguaaguuucaucugaauugg

SEQ ID NO: 624480 - RNA, 22 nt, Human
agccuggagaggcgccauacac

SEQ ID NO: 624481 - RNA, 22 nt, Human
ugggagcaggugugcuagggaa

SEQ ID NO: 624482 - RNA, 22 nt, Human
aaugucauuuaggauuauguuu

SEQ ID NO: 624483 - RNA, 22 nt, Human
cuuggcuuuugcucccagauca

SEQ ID NO: 624484 - RNA, 22 nt, Human
uucaugaauaccccuucuguaa

SEQ ID NO: 624485 - RNA, 18 nt, Human
ccucagggagauccagug

SEQ ID NO: 624486 - RNA, 22 nt, Human
uuucuuuugcccuguggguuag

SEQ ID NO: 624487 - RNA, 22 nt, Human
gaagccagcaguggagaaagga

SEQ ID NO: 624488 - RNA, 22 nt, Human
ucugccugaggacugacaccag

SEQ ID NO: 624489 - RNA, 22 nt, Human
cugcucggcgcgcauggcugcc

SEQ ID NO: 624490 - RNA, 20 nt, Human
ucuagcuuagugccugccuc

SEQ ID NO: 624491 - RNA, 20 nt, Human
ugugugcuaggacuacagug

SEQ ID NO: 624492 - RNA, 22 nt, Human
gcaggccuccccugcuggagcu

SEQ ID NO: 624493 - RNA, 22 nt, Human
cacgcacgcuggguggaggcgc

SEQ ID NO: 624494 - RNA, 23 nt, Human
uggccaggcauaaaggugggugg

SEQ ID NO: 624495 - RNA, 19 nt, Human
ccuggguccacucagacua

SEQ ID NO: 624496 - RNA, 22 nt, Human
aauaguucuagcucagaagcuc

SEQ ID NO: 624497 - RNA, 22 nt, Human
agcuggcauuacaggagcaugc

SEQ ID NO: 624498 - RNA, 22 nt, Human
cuggagccacuuuuuauccuuu

SEQ ID NO: 624499 - RNA, 22 nt, Human
gggcaagcucuucagaagcucu

SEQ ID NO: 624500 - RNA, 22 nt, Human
agaauuuuugauuaucuacucg

SEQ ID NO: 624501 - RNA, 22 nt, Human
acacugucugggacucaggagu

SEQ ID NO: 624502 - RNA, 22 nt, Human
aggcaaauugugagaaaaugaa

SEQ ID NO: 624503 - RNA, 22 nt, Human
uauauuugugugugauuuauga

SEQ ID NO: 624504 - RNA, 22 nt, Human
uuuggcauagcucuuuguuccu

SEQ ID NO: 624505 - RNA, 22 nt, Human
gaguccaguaguuaggacagag

SEQ ID NO: 624506 - RNA, 22 nt, Human
agucucuuggcauucugaaaca

SEQ ID NO: 624507 - RNA, 22 nt, Human
auaccuuuuagacauguaguug

SEQ ID NO: 624508 - RNA, 22 nt, Human
uccagccacucagcagggauug

SEQ ID NO: 624509 - RNA, 22 nt, Human
gccugaccucuucugcccuggg

SEQ ID NO: 624510 - RNA, 22 nt, Human
gcccaagccgccuuccagagac

SEQ ID NO: 624511 - RNA, 22 nt, Human
auucuagcccuggaacggcgac

SEQ ID NO: 624512 - RNA, 22 nt, Human
gaugcugaagugaagugaucuu

SEQ ID NO: 624513 - RNA, 22 nt, Human
gcugcaggagcuggagcugugg

SEQ ID NO: 624514 - RNA, 20 nt, Human
aggacuuguuugggcagagu

SEQ ID NO: 624515 - RNA, 22 nt, Human
uaaaucaguuucucuuauuggu

SEQ ID NO: 624516 - RNA, 22 nt, Human
agggaccucauguaaguggauu

SEQ ID NO: 624517 - RNA, 22 nt, Human
aaagccacugcauguguaguau

SEQ ID NO: 624518 - RNA, 22 nt, Human
cugggcugcaggaguggggcaa

SEQ ID NO: 624519 - RNA, 22 nt, Human
aagaauacguaucaacaauggu

SEQ ID NO: 624520 - RNA, 22 nt, Human
gugcaagaaggggagacugggu

SEQ ID NO: 624521 - RNA, 22 nt, Human
cucaaaagacuuaaacauaaga

SEQ ID NO: 624522 - RNA, 22 nt, Human
cacagcagucuuucacuaaaua

SEQ ID NO: 624523 - RNA, 22 nt, Human
caguuuuugccauuaagaguaa

SEQ ID NO: 624524 - RNA, 23 nt, Human
auuuuacaggucaguuccuugaa

SEQ ID NO: 624525 - RNA, 22 nt, Human
uccuuuaucugcucagaaagua

SEQ ID NO: 624526 - RNA, 22 nt, Human
cuggccuaggaaugguuuuccg

SEQ ID NO: 624527 - RNA, 22 nt, Human
ugccacagacaggacagaacag

SEQ ID NO: 624528 - RNA, 22 nt, Human
ccagggggcuuggugaggccau

SEQ ID NO: 624529 - RNA, 23 nt, Human
acauuacuuagccagagucucag

SEQ ID NO: 624530 - RNA, 22 nt, Human
uccugaggaugguugaagugca

SEQ ID NO: 624531 - RNA, 22 nt, Human
gggcuggagccagcuguggcug

SEQ ID NO: 624532 - RNA, 22 nt, Human
ucagagugcagcgggaggcugg

SEQ ID NO: 624533 - RNA, 22 nt, Human
aaugagcuucuauaaucuuguc

SEQ ID NO: 624534 - RNA, 22 nt, Human
ucccagccacagguguagcccu

SEQ ID NO: 624535 - RNA, 22 nt, Human
aaacaugcauucaagaaaaucu

SEQ ID NO: 624536 - RNA, 22 nt, Human
uaaaggaggaguuaaugagacu

SEQ ID NO: 624537 - RNA, 22 nt, Human
ugugagugaaugggucugaagu

SEQ ID NO: 624538 - RNA, 22 nt, Human
ggcacagggagccgcaguugca

SEQ ID NO: 624539 - RNA, 22 nt, Human
aacucucucuggcucccagcaa

SEQ ID NO: 624540 - RNA, 22 nt, Human
ucugcugcagggaaagacuuuc

SEQ ID NO: 624541 - RNA, 22 nt, Human
cuguauuuaguuaaaaugcuaa

SEQ ID NO: 624542 - RNA, 22 nt, Human
uuagccauggacugaauugacu

SEQ ID NO: 624543 - RNA, 22 nt, Human
gggaggcucugcucagcccccg

SEQ ID NO: 624544 - RNA, 17 nt, Human
ggcagggugcuggguau

SEQ ID NO: 624545 - RNA, 22 nt, Human
caggaugaagggcaaaggcaag

SEQ ID NO: 624546 - RNA, 18 nt, Human
ucuuggcagcaucuggca

SEQ ID NO: 624547 - RNA, 22 nt, Human
uggagagcacaguuccugcuuc

SEQ ID NO: 624548 - RNA, 22 nt, Human
uuguccuugugauaguuugcug

SEQ ID NO: 624549 - RNA, 22 nt, Human
uuccugugcuuaauucucacug

SEQ ID NO: 624550 - RNA, 22 nt, Human
acaaauagaaaaucuggauugg

SEQ ID NO: 624551 - RNA, 18 nt, Human
gccagagggaagcaggug

SEQ ID NO: 624552 - RNA, 22 nt, Human
agacagacugguuugaauuggu

SEQ ID NO: 624553 - RNA, 22 nt, Human
gacauuuguuccucuaagugac

SEQ ID NO: 624554 - RNA, 22 nt, Human
ucucaucugccauuugcaggag

SEQ ID NO: 624555 - RNA, 22 nt, Human
ccaggaguuugaggcugcagug

SEQ ID NO: 624556 - RNA, 22 nt, Human
uucuuuagcaacuuggauuuag

SEQ ID NO: 624557 - RNA, 22 nt, Human
gggcuccaucacaggcuccauc

SEQ ID NO: 624558 - RNA, 22 nt, Human
ccuuccucauccauuucucuug

SEQ ID NO: 624559 - RNA, 22 nt, Human
aagcacagacacaaaaggcuuu

SEQ ID NO: 624560 - RNA, 21 nt, Human
ggcugggcaggacccaccccu

SEQ ID NO: 624561 - RNA, 22 nt, Human
aguuuuucuccccuggcuucau

SEQ ID NO: 624562 - RNA, 22 nt, Human
cagagccucugcccugggcacu

SEQ ID NO: 624563 - RNA, 20 nt, Human
ucuggugccccuuccugaga

SEQ ID NO: 624564 - RNA, 22 nt, Human
gugacauuuuuacugaugagag

SEQ ID NO: 624565 - RNA, 22 nt, Human
cuggcugcuugggacagccaug

SEQ ID NO: 624566 - RNA, 22 nt, Human
cugggucccacagccugcuggg

SEQ ID NO: 624567 - RNA, 17 nt, Human
gcccuggagccaggcua

SEQ ID NO: 624568 - RNA, 23 nt, Human
gcaguguuugcuucaucuuaucc

SEQ ID NO: 624569 - RNA, 22 nt, Human
auaaaggccaaaauuugcauuu

SEQ ID NO: 624570 - RNA, 22 nt, Human
ccaggcagccaagugugugugu

SEQ ID NO: 624571 - RNA, 22 nt, Human
uacacauacaccaaugugguca

SEQ ID NO: 624572 - RNA, 22 nt, Human
ugacagaaugugacucucagau

SEQ ID NO: 624573 - RNA, 22 nt, Human
ucccagagcucugacaccagcu

SEQ ID NO: 624574 - RNA, 19 nt, Human
gagaaagcaggcacagcac

SEQ ID NO: 624575 - RNA, 22 nt, Human
ccagguggcccugcccuacucu

SEQ ID NO: 624576 - RNA, 22 nt, Human
uuugauucaaaaaccacuccac

SEQ ID NO: 624577 - RNA, 22 nt, Human
ugcagcagaauauggcugcagg

SEQ ID NO: 624578 - RNA, 22 nt, Human
ugggggcugugcacaggcucac

SEQ ID NO: 624579 - RNA, 22 nt, Human
caggauguugcucccauguccc

SEQ ID NO: 624580 - RNA, 22 nt, Human
aauccaggguguggccuuucca

SEQ ID NO: 624581 - RNA, 22 nt, Human
ugcaccuuuaaauucagcagua

SEQ ID NO: 624582 - RNA, 22 nt, Human
agcagcaucuucuguucuccgc

SEQ ID NO: 624583 - RNA, 20 nt, Human
cccaggugucugaagcucug

SEQ ID NO: 624584 - RNA, 21 nt, Human
gaggacugcacacucugauug

SEQ ID NO: 624585 - RNA, 22 nt, Human
gaagucagucaucuccugucuc

SEQ ID NO: 624586 - RNA, 22 nt, Human
ggcagcacgacaggaguggaag

SEQ ID NO: 624587 - RNA, 22 nt, Human
uucaucaugauguuccccucua

SEQ ID NO: 624588 - RNA, 22 nt, Human
guaggcugugugaggcuagaga

SEQ ID NO: 624589 - RNA, 20 nt, Human
aggaaggaaguuugcaugga

SEQ ID NO: 624590 - RNA, 22 nt, Human
agaacagcaggaaggccaggua

SEQ ID NO: 624591 - RNA, 22 nt, Human
guuauauaauuccugugguagu

SEQ ID NO: 624592 - RNA, 22 nt, Human
cccaggacucuucacugcagcc

SEQ ID NO: 624593 - RNA, 22 nt, Human
acacagggcggaaagcaugaga

SEQ ID NO: 624594 - RNA, 22 nt, Human
uaagaugucuaagaggagaugc

SEQ ID NO: 624595 - RNA, 22 nt, Human
uccugggaccaggcaccuacug

SEQ ID NO: 624596 - RNA, 22 nt, Human
gggugacauuucccaaugagcc

SEQ ID NO: 624597 - RNA, 22 nt, Human
aaggaggagugggguccuggaa

SEQ ID NO: 624598 - RNA, 22 nt, Human
acuggacucacguauuccugag

SEQ ID NO: 624599 - RNA, 22 nt, Human
uuucauuauacagcuucauaaa

SEQ ID NO: 624600 - RNA, 22 nt, Human
aaaaguaauugugguuuuugcu

SEQ ID NO: 624601 - RNA, 22 nt, Human
acagagcugggaucugaaccca

SEQ ID NO: 624602 - RNA, 22 nt, Human
aggccaaguagcuagcauugaa

SEQ ID NO: 624603 - RNA, 22 nt, Human
acaugcaugguguuggguugga

SEQ ID NO: 624604 - RNA, 22 nt, Human
ugcagaaggccugacauugcac

SEQ ID NO: 624605 - RNA, 22 nt, Human
uuauuugaaaagaagguuacgu

SEQ ID NO: 624606 - RNA, 22 nt, Human
ugccuggcaccccagucugcac

SEQ ID NO: 624607 - RNA, 19 nt, Human
gcagguggauguggucagc

SEQ ID NO: 624608 - RNA, 22 nt, Human
uccucuucaaaauagcucugaa

SEQ ID NO: 624609 - RNA, 22 nt, Human
ccagcaggacuuuggaaauaug

SEQ ID NO: 624610 - RNA, 20 nt, Human
gcuguuaguugggggcuccc

SEQ ID NO: 624611 - RNA, 22 nt, Human
aagcccuguucuuucucucacc

SEQ ID NO: 624612 - RNA, 22 nt, Human
cccaggaggcagagguugcagu

SEQ ID NO: 624613 - RNA, 22 nt, Human
ucagggcacauucugcaguggc

SEQ ID NO: 624614 - RNA, 22 nt, Human
gagcaacaguggcagugguggg

SEQ ID NO: 624615 - RNA, 23 nt, Human
agacacuguaaagaauugcaguu

SEQ ID NO: 624616 - RNA, 22 nt, Human
gagcuuggcagugucacuaggg

SEQ ID NO: 624617 - RNA, 22 nt, Human
uguguucaccaaaguguagaaa

SEQ ID NO: 624618 - RNA, 22 nt, Human
ggcuccagaugucuccuggcaa

SEQ ID NO: 624619 - RNA, 22 nt, Human
cuguauaacaucuuuuguuucc

SEQ ID NO: 624620 - RNA, 22 nt, Human
aauguguagauguugcauuccu

SEQ ID NO: 624621 - RNA, 22 nt, Human
ucauggcucuaaagacauagau

SEQ ID NO: 624622 - RNA, 22 nt, Human
ucagccaggccaggcauucaca

SEQ ID NO: 624623 - RNA, 22 nt, Human
acagugucaugucguguucccc

SEQ ID NO: 624624 - RNA, 22 nt, Human
ugucccuggaacuauggcucca

SEQ ID NO: 624625 - RNA, 22 nt, Human
cuguggcucucugcaggguccc

SEQ ID NO: 624626 - RNA, 22 nt, Human
aguaacuaugcuugagaaucag

SEQ ID NO: 624627 - RNA, 22 nt, Human
ucucagugcagcaaggaauuua

SEQ ID NO: 624628 - RNA, 22 nt, Human
ucugugcaguucuugucuugac

SEQ ID NO: 624629 - RNA, 22 nt, Human
uucagaguuagacgaaaagcaa

SEQ ID NO: 624630 - RNA, 23 nt, Human
aucauuacuuugauaccuuuucu

SEQ ID NO: 624631 - RNA, 22 nt, Human
ggccuggaaggacagcgugaug

SEQ ID NO: 624632 - RNA, 20 nt, Human
uuucacagucccuguuuccu

SEQ ID NO: 624633 - RNA, 22 nt, Human
ccaguccaggccauggauuuug

SEQ ID NO: 624634 - RNA, 22 nt, Human
ucauauuaggguaaugauaaga

SEQ ID NO: 624635 - RNA, 22 nt, Human
uuccagggaagagcaaggcagu

SEQ ID NO: 624636 - RNA, 22 nt, Human
cagagauggggccagcugcucc

SEQ ID NO: 624637 - RNA, 22 nt, Human
aaggcacauuccugaaaacaau

SEQ ID NO: 624638 - RNA, 22 nt, Human
cuuguguggucuggucuugcua

SEQ ID NO: 624639 - RNA, 22 nt, Human
uacagguaaaauuaucagaaac

SEQ ID NO: 624640 - RNA, 23 nt, Human
ugguccugguugaggugggcccc

SEQ ID NO: 624641 - RNA, 22 nt, Human
gacuacaggccggcaucagaga

SEQ ID NO: 624642 - RNA, 22 nt, Human
ugcaucaugcggaacuggcuuu

SEQ ID NO: 624643 - RNA, 22 nt, Human
gcuaguuucuugaauacucuaa

SEQ ID NO: 624644 - RNA, 22 nt, Human
acaggagaaaucuggucaaaag

SEQ ID NO: 624645 - RNA, 22 nt, Human
gauccugggcccuucuggguca

SEQ ID NO: 624646 - RNA, 22 nt, Human
gauauuuucauucggaugcuca

SEQ ID NO: 624647 - RNA, 22 nt, Human
uuccaaauuaaaauguacaaug

SEQ ID NO: 624648 - RNA, 22 nt, Human
uaaauucagugaguaauuucug

SEQ ID NO: 624649 - RNA, 22 nt, Human
cccugguguccacuggaggaag

SEQ ID NO: 624650 - RNA, 22 nt, Human
cuguauguuucuaugaauguga

SEQ ID NO: 624651 - RNA, 22 nt, Human
uccugguuuauagacugauggc

SEQ ID NO: 624652 - RNA, 22 nt, Human
uccugaggccucugugauguga

SEQ ID NO: 624653 - RNA, 23 nt, Human
gaauggcuaagcacauagacuug

SEQ ID NO: 624654 - RNA, 22 nt, Human
uuuuagaaggaaugcuauggug

SEQ ID NO: 624655 - RNA, 22 nt, Human
aaauugaauuugggaaacauug

SEQ ID NO: 624656 - RNA, 22 nt, Human
ucaccaggcuggaaugcagugg

SEQ ID NO: 624657 - RNA, 22 nt, Human
aauaacagagaaggguggcuuc

SEQ ID NO: 624658 - RNA, 21 nt, Human
cucagagcaguucagagggau

SEQ ID NO: 624659 - RNA, 22 nt, Human
uuccugggcucuggcuggccua

SEQ ID NO: 624660 - RNA, 22 nt, Human
auuauuuggaauaggcauugca

SEQ ID NO: 624661 - RNA, 22 nt, Human
uggcagauaaccugcugugccc

SEQ ID NO: 624662 - RNA, 22 nt, Human
aagaauaagaggauuuagaaca

SEQ ID NO: 624663 - RNA, 20 nt, Human
accagagauagcaauagugc

SEQ ID NO: 624664 - RNA, 22 nt, Human
ugacuucugauugcuucuauuu

SEQ ID NO: 624665 - RNA, 22 nt, Human
uuacuugauguaugaugaguag

SEQ ID NO: 624666 - RNA, 21 nt, Human
uggcugcuggcccucucucca

SEQ ID NO: 624667 - RNA, 22 nt, Human
uucaaauacauucuuugccacu

SEQ ID NO: 624668 - RNA, 22 nt, Human
gccaggacuagagggaggugag

SEQ ID NO: 624669 - RNA, 22 nt, Human
aagguccuuuugcagugugauc

SEQ ID NO: 624670 - RNA, 22 nt, Human
gcaaagauauuagaauagagua

SEQ ID NO: 624671 - RNA, 22 nt, Human
acauuugauaauuauaaagaca

SEQ ID NO: 624672 - RNA, 22 nt, Human
cagcuucagacccugggcugca

SEQ ID NO: 624673 - RNA, 22 nt, Human
aauacagaggaaacauuuaaua

SEQ ID NO: 624674 - RNA, 22 nt, Human
cugcaccauccuucaugcucug

SEQ ID NO: 624675 - RNA, 22 nt, Human
aggcuccagccaaugggucugu

SEQ ID NO: 624676 - RNA, 22 nt, Human
agacauuaugcugagugaaaga

SEQ ID NO: 624677 - RNA, 17 nt, Human
ucuccaggacgagcuca

SEQ ID NO: 624678 - RNA, 20 nt, Human
ugagacccgcugacaaguuc

SEQ ID NO: 624679 - RNA, 22 nt, Human
ucugggccugauggcuaaagcc

SEQ ID NO: 624680 - RNA, 23 nt, Human
caaagaugauuggaacauggcuu

SEQ ID NO: 624681 - RNA, 22 nt, Human
aauuucucucucaugcuucaug

SEQ ID NO: 624682 - RNA, 22 nt, Human
cagcuguggagauggggugcau

SEQ ID NO: 624683 - RNA, 22 nt, Human
gagcacagaacuaaaugcuggu

SEQ ID NO: 624684 - RNA, 22 nt, Human
ccagcuuucauaucaugaggua

SEQ ID NO: 624685 - RNA, 22 nt, Human
acugauacaucuguggaagugg

SEQ ID NO: 624686 - RNA, 21 nt, Human
agcacagcuuuaagccaugug

SEQ ID NO: 624687 - RNA, 22 nt, Human
guggccaagaaaauagaugcau

SEQ ID NO: 624688 - RNA, 22 nt, Human
ccucuucauccuggaagcugcu

SEQ ID NO: 624689 - RNA, 22 nt, Human
agagaaggcauagaacuugagu

SEQ ID NO: 624690 - RNA, 22 nt, Human
cacaaugcguacauauaucaaa

SEQ ID NO: 624691 - RNA, 21 nt, Human
gcaaguguuucugacaguggc

SEQ ID NO: 624692 - RNA, 22 nt, Human
ucuuuucaggaauggcucuagu

SEQ ID NO: 624693 - RNA, 22 nt, Human
aggugggcggaucacaagguca

SEQ ID NO: 624694 - RNA, 22 nt, Human
uuccaaguugagcgauuuuccu

SEQ ID NO: 624695 - RNA, 22 nt, Human
ucucaggguuuccugggggcug

SEQ ID NO: 624696 - RNA, 22 nt, Human
ucugccaggcauugugcugcuc

SEQ ID NO: 624697 - RNA, 22 nt, Human
auauagcugagggguauuauaa

SEQ ID NO: 624698 - RNA, 22 nt, Human
ucuucuuaugugccauuaucuc

SEQ ID NO: 624699 - RNA, 22 nt, Human
ccuggucccauugcggcugccu

SEQ ID NO: 624700 - RNA, 22 nt, Human
agucaagauucuggcacuagca

SEQ ID NO: 624701 - RNA, 21 nt, Human
cggcuucauuuucuucugguu

SEQ ID NO: 624702 - RNA, 22 nt, Human
cugggccacuuccucaggggaa

SEQ ID NO: 624703 - RNA, 22 nt, Human
uuucugaauuccuaggauguug

SEQ ID NO: 624704 - RNA, 22 nt, Human
cugucugaauccuaagcuuccu

SEQ ID NO: 624705 - RNA, 22 nt, Human
gaacaauacaggcuuuauuccu

SEQ ID NO: 624706 - RNA, 23 nt, Human
cuacagguuaauuuucaguggaa

SEQ ID NO: 624707 - RNA, 22 nt, Human
ugagaaaauuacuauaauuguc

SEQ ID NO: 624708 - RNA, 22 nt, Human
uuucagaaccgcuaaaauaaau

SEQ ID NO: 624709 - RNA, 22 nt, Human
acucugacuggagugagagagg

SEQ ID NO: 624710 - RNA, 22 nt, Human
cagaauaauauuggucucauag

SEQ ID NO: 624711 - RNA, 22 nt, Human
gugucccaaucuacuuuucccu

SEQ ID NO: 624712 - RNA, 22 nt, Human
ugcccuggagucaguggcuauu

SEQ ID NO: 624713 - RNA, 22 nt, Human
aaugaguuagaugagaaaauaa

SEQ ID NO: 624714 - RNA, 22 nt, Human
ucuggccccuggcaguccugga

SEQ ID NO: 624715 - RNA, 22 nt, Human
uaugcaaaucauuagauuuccu

SEQ ID NO: 624716 - RNA, 22 nt, Human
aagauucacagagugaaugaaa

SEQ ID NO: 624717 - RNA, 22 nt, Human
ccguauuauaaguuuuuccuuc

SEQ ID NO: 624718 - RNA, 22 nt, Human
aguaggaggcgggagcaugaag

SEQ ID NO: 624719 - RNA, 22 nt, Human
guuuccugugggaacucggcug

SEQ ID NO: 624720 - RNA, 22 nt, Human
guaccaugagcaucauguuuuu

SEQ ID NO: 624721 - RNA, 19 nt, Human
aucuugggaaaugguaacu

SEQ ID NO: 624722 - RNA, 22 nt, Human
uggccuggggaagaccaugggc

SEQ ID NO: 624723 - RNA, 22 nt, Human
gcacccagauagcaaggauuag

SEQ ID NO: 624724 - RNA, 22 nt, Human
ccuggcugaaccaaugaagugg

SEQ ID NO: 624725 - RNA, 22 nt, Human
uugaucuucaucgaaauauugu

SEQ ID NO: 624726 - RNA, 22 nt, Human
gcugggagcaaagccaugcaua

SEQ ID NO: 624727 - RNA, 22 nt, Human
aguggcugacaacuggguuaac

SEQ ID NO: 624728 - RNA, 22 nt, Human
caaaggaagcuccuugauggcg

SEQ ID NO: 624729 - RNA, 22 nt, Human
uguaugcuuuccaaaaaugcug

SEQ ID NO: 624730 - RNA, 22 nt, Human
ucaaaucucacucugcauuucu

SEQ ID NO: 624731 - RNA, 22 nt, Human
caaagcagcggauugggauagu

SEQ ID NO: 624732 - RNA, 22 nt, Human
ucucuaaaugauuguguacucc

SEQ ID NO: 624733 - RNA, 22 nt, Human
ucucaguguuguucugcagaug

SEQ ID NO: 624734 - RNA, 22 nt, Human
cugccuggcuaaacucaagucg

SEQ ID NO: 624735 - RNA, 22 nt, Human
aaaccuggacuuguaaugauaa

SEQ ID NO: 624736 - RNA, 22 nt, Human
cggcagagugugugcgugcaug

SEQ ID NO: 624737 - RNA, 22 nt, Human
ccagggcucugcuucugccaug

SEQ ID NO: 624738 - RNA, 17 nt, Human
cuguuccccacuacuca

SEQ ID NO: 624739 - RNA, 22 nt, Human
guggcagcugguaugcagacag

SEQ ID NO: 624740 - RNA, 22 nt, Human
aauguuugcaucuauucacaug

SEQ ID NO: 624741 - RNA, 22 nt, Human
uucuauguagauaaggcugcuc

SEQ ID NO: 624742 - RNA, 22 nt, Human
uuuauaguuauauacagauguu

SEQ ID NO: 624743 - RNA, 22 nt, Human
aggcuucagaaagaguaauugg

SEQ ID NO: 624744 - RNA, 22 nt, Human
ccucucucugcaucuggagggc

SEQ ID NO: 624745 - RNA, 22 nt, Human
ggccucugguucguggugaccu

SEQ ID NO: 624746 - RNA, 22 nt, Human
ugcaguguuccuguagccugcc

SEQ ID NO: 624747 - RNA, 22 nt, Human
cagaccugagguugaguaccag

SEQ ID NO: 624748 - RNA, 22 nt, Human
cccauggcaauaaggucacagg

SEQ ID NO: 624749 - RNA, 22 nt, Human
ucugggaacagcuuagcuccag

SEQ ID NO: 624750 - RNA, 22 nt, Human
acucuugaagguggugggagug

SEQ ID NO: 624751 - RNA, 19 nt, Human
uuccuggcucuucuguuuu

SEQ ID NO: 624752 - RNA, 22 nt, Human
uuccacuccuccugguggggug

SEQ ID NO: 624753 - RNA, 22 nt, Human
aggcaaaauaagccucuccugu

SEQ ID NO: 624754 - RNA, 22 nt, Human
ucguguguauucccucuccuuc

SEQ ID NO: 624755 - RNA, 22 nt, Human
ugcugcagcuuugucacaugca

SEQ ID NO: 624756 - RNA, 17 nt, Human
agggucaggugaaguuc

SEQ ID NO: 624757 - RNA, 21 nt, Human
ucccacagcgccagcuccugu

SEQ ID NO: 624758 - RNA, 22 nt, Human
ugguggcaaaucaggacacuuc

SEQ ID NO: 624759 - RNA, 22 nt, Human
aagugugugggcaggcaguggu

SEQ ID NO: 624760 - RNA, 22 nt, Human
aaauaaguuagcagauuccagu

SEQ ID NO: 624761 - RNA, 22 nt, Human
ucucagggcucagagcucaggc

SEQ ID NO: 624762 - RNA, 22 nt, Human
aagcauggagcaauagaaugac

SEQ ID NO: 624763 - RNA, 22 nt, Human
cccaccucucagagagccuugc

SEQ ID NO: 624764 - RNA, 22 nt, Human
ggccaaaagcauaauccucaca

SEQ ID NO: 624765 - RNA, 22 nt, Human
uguuucuagagaaaauauuuac

SEQ ID NO: 624766 - RNA, 22 nt, Human
augcaacaaaugcuacgaaucg

SEQ ID NO: 624767 - RNA, 22 nt, Human
cagggagcggagucccaugccu

SEQ ID NO: 624768 - RNA, 22 nt, Human
uuguuuccuuucuauacaggau

SEQ ID NO: 624769 - RNA, 22 nt, Human
uaagacaaauacuauuucaaga

SEQ ID NO: 624770 - RNA, 21 nt, Human
cuggcccagggaucugcauuu

SEQ ID NO: 624771 - RNA, 22 nt, Human
uaauauauuucugcuaagcuca

SEQ ID NO: 624772 - RNA, 23 nt, Human
ucucaaaucuuugcguuguaucu

SEQ ID NO: 624773 - RNA, 22 nt, Human
uaacacuggcuuuugcugaggc

SEQ ID NO: 624774 - RNA, 22 nt, Human
aagucagagaugccaaagauua

SEQ ID NO: 624775 - RNA, 22 nt, Human
uugauucugauccugucuggag

SEQ ID NO: 624776 - RNA, 22 nt, Human
augcuuuuccuaaaaugaugcc

SEQ ID NO: 624777 - RNA, 22 nt, Human
aaggcacugaaaaauugugugu

SEQ ID NO: 624778 - RNA, 22 nt, Human
agugaggggcagcugagugggc

SEQ ID NO: 624779 - RNA, 22 nt, Human
gcuggcacauggcucagggccu

SEQ ID NO: 624780 - RNA, 22 nt, Human
caggcugccaaggcuggggagg

SEQ ID NO: 624781 - RNA, 22 nt, Human
uauguguguuucaguggaaaug

SEQ ID NO: 624782 - RNA, 22 nt, Human
cccucccuauguagaugauguu

SEQ ID NO: 624783 - RNA, 22 nt, Human
aauugcuugaugacuaguaauu

SEQ ID NO: 624784 - RNA, 22 nt, Human
ugucccagcacuuugggagucu

SEQ ID NO: 624785 - RNA, 21 nt, Human
aagaugguuaugugcuaaaga

SEQ ID NO: 624786 - RNA, 22 nt, Human
cagaaauguuuauauguggugu

SEQ ID NO: 624787 - RNA, 20 nt, Human
uuuaucaggcacuuacuauu

SEQ ID NO: 624788 - RNA, 22 nt, Human
gcagagcagcaaauggaaagga

SEQ ID NO: 624789 - RNA, 20 nt, Human
ugaugguucuuuccggguug

SEQ ID NO: 624790 - RNA, 22 nt, Human
cucugggugugacagcaccugg

SEQ ID NO: 624791 - RNA, 22 nt, Human
cagcaucucugggagaagcauc

SEQ ID NO: 624792 - RNA, 22 nt, Human
ugggcagacgcuguuggaaggc

SEQ ID NO: 624793 - RNA, 22 nt, Human
agauugaagacugguggagcug

SEQ ID NO: 624794 - RNA, 22 nt, Human
cuguauuuucaugccuacguac

SEQ ID NO: 624795 - RNA, 22 nt, Human
cugcaggagcaagccugggaga

SEQ ID NO: 624796 - RNA, 18 nt, Human
caugucugcgccacaagg

SEQ ID NO: 624797 - RNA, 19 nt, Human
agcaguuauaugcauggga

SEQ ID NO: 624798 - RNA, 22 nt, Human
gaaacuguauguaguuuuuggg

SEQ ID NO: 624799 - RNA, 22 nt, Human
gaaggaagugcucauacuaguu

SEQ ID NO: 624800 - RNA, 22 nt, Human
aagucacaaagugcuguacaug

SEQ ID NO: 624801 - RNA, 23 nt, Human
aguuccagaaaaaugcucaagca

SEQ ID NO: 624802 - RNA, 22 nt, Human
ugcaguuuuaucacauauauag

SEQ ID NO: 624803 - RNA, 22 nt, Human
gaagcucucaaacucuccccuu

SEQ ID NO: 624804 - RNA, 22 nt, Human
aucagcaaucaaauugcagagu

SEQ ID NO: 624805 - RNA, 22 nt, Human
ucugcugaccuuucucugacac

SEQ ID NO: 624806 - RNA, 22 nt, Human
ugaagauuuaagcaucucaauu

SEQ ID NO: 624807 - RNA, 21 nt, Human
cccaggaggcugagaagagca

SEQ ID NO: 624808 - RNA, 22 nt, Human
uggcucuggccaccgggagggc

SEQ ID NO: 624809 - RNA, 22 nt, Human
cuucugugguaaacuuuguugu

SEQ ID NO: 624810 - RNA, 22 nt, Human
cagauaugcugagacuccugug

SEQ ID NO: 624811 - RNA, 22 nt, Human
ugugcagagcccacaggcagcu

SEQ ID NO: 624812 - RNA, 22 nt, Human
ggagccagaguuuaauguggag

SEQ ID NO: 624813 - RNA, 22 nt, Human
uuaaaggaucuuugucauuaau

SEQ ID NO: 624814 - RNA, 22 nt, Human
ucugucugcuucacuugcauuu

SEQ ID NO: 624815 - RNA, 22 nt, Human
guauacauagaugaugaacaag

SEQ ID NO: 624816 - RNA, 20 nt, Human
uuagcaguagagugugcuuc

SEQ ID NO: 624817 - RNA, 22 nt, Human
ccucagagaaaugucuauucaa

SEQ ID NO: 624818 - RNA, 22 nt, Human
ucaugcucaucauuagagugac

SEQ ID NO: 624819 - RNA, 22 nt, Human
cugaagcacagcauauaaauaa

SEQ ID NO: 624820 - RNA, 22 nt, Human
uuucaauuccaccaaagcgccc

SEQ ID NO: 624821 - RNA, 22 nt, Human
aaugcugucuuuucuacuucau

SEQ ID NO: 624822 - RNA, 22 nt, Human
ggacccugcagccacccgacau

SEQ ID NO: 624823 - RNA, 22 nt, Human
gcugacuguccgcugcucccgg

SEQ ID NO: 624824 - RNA, 22 nt, Human
caaaaaacacagaugucugugu

SEQ ID NO: 624825 - RNA, 22 nt, Human
cuacaggucaagcaguagcucu

SEQ ID NO: 624826 - RNA, 22 nt, Human
ccuuuagaauacagacuuucua

SEQ ID NO: 624827 - RNA, 19 nt, Human
agccagaacuaguguuucu

SEQ ID NO: 624828 - RNA, 22 nt, Human
aaugggaagucacuacuguuac

SEQ ID NO: 624829 - RNA, 22 nt, Human
uaaaugcaguuaguacuugcca

SEQ ID NO: 624830 - RNA, 22 nt, Human
gaggccaggagugcuguaaguu

SEQ ID NO: 624831 - RNA, 22 nt, Human
agaaacaucgcuuaguccucau

SEQ ID NO: 624832 - RNA, 23 nt, Human
uguaaagaucaagugacugauuu

SEQ ID NO: 624833 - RNA, 22 nt, Human
accaggagccacaggaggagcc

SEQ ID NO: 624834 - RNA, 23 nt, Human
accuagaaauacguuuuacaugg

SEQ ID NO: 624835 - RNA, 20 nt, Human
aauuagauguuuaaucaaua

SEQ ID NO: 624836 - RNA, 22 nt, Human
uugcuuuaagguaucuggagaa

SEQ ID NO: 624837 - RNA, 22 nt, Human
aaaauagaugaaaggaagucug

SEQ ID NO: 624838 - RNA, 22 nt, Human
gagcuggcuaauacugacuuau

SEQ ID NO: 624839 - RNA, 22 nt, Human
cuuguauugcaaacuggccagg

SEQ ID NO: 624840 - RNA, 22 nt, Human
augcugugauuguagaaauauu

SEQ ID NO: 624841 - RNA, 22 nt, Human
uuacagaaaauguguuuuaacu

SEQ ID NO: 624842 - RNA, 22 nt, Human
acaaaggacugaaacuggcugu

SEQ ID NO: 624843 - RNA, 22 nt, Human
uccacugacaggugaauggaua

SEQ ID NO: 624844 - RNA, 22 nt, Human
ugcagccuagacauucugguca

SEQ ID NO: 624845 - RNA, 22 nt, Human
agcugccuuuugagaaagcuca

SEQ ID NO: 624846 - RNA, 22 nt, Human
uaccacugcucccugccuguga

SEQ ID NO: 624847 - RNA, 22 nt, Human
aauagcauccuaaaacauacuu

SEQ ID NO: 624848 - RNA, 22 nt, Human
cacagugaauuucaaguguugu

SEQ ID NO: 624849 - RNA, 22 nt, Human
caauuucaugccauguauugcu

SEQ ID NO: 624850 - RNA, 22 nt, Human
caaguccucaaagggcucugcu

SEQ ID NO: 624851 - RNA, 22 nt, Human
auuagugucauguugaggacuu

SEQ ID NO: 624852 - RNA, 22 nt, Human
aaugucaacacaagagaaaugc

SEQ ID NO: 624853 - RNA, 22 nt, Human
caaggaaaaagcgagcucgggg

SEQ ID NO: 624854 - RNA, 21 nt, Human
acugagggccagagaggaccu

SEQ ID NO: 624855 - RNA, 22 nt, Human
uaauaugggcagucugaauaua

SEQ ID NO: 624856 - RNA, 22 nt, Human
cguuaauaggugcaagguaagg

SEQ ID NO: 624857 - RNA, 22 nt, Human
agguaaauucagcagugacauu

SEQ ID NO: 624858 - RNA, 22 nt, Human
uuucauguuggauacuguuuca

SEQ ID NO: 624859 - RNA, 22 nt, Human
ugggcagggaucucuuuugcaa

SEQ ID NO: 624860 - RNA, 22 nt, Human
uguacaugacagagagagccaa

SEQ ID NO: 624861 - RNA, 22 nt, Human
gacagaggcaagaccagaagcc

SEQ ID NO: 624862 - RNA, 22 nt, Human
agagaauuuuaaaagccuugaa

SEQ ID NO: 624863 - RNA, 22 nt, Human
gcugcccaggcaacauugacuu

SEQ ID NO: 624864 - RNA, 23 nt, Human
guaggaauuuucacuuccucuug

SEQ ID NO: 624865 - RNA, 18 nt, Human
ucauuuugucugccuuug

SEQ ID NO: 624866 - RNA, 22 nt, Human
ugcccagcuucuuacuuuuaaa

SEQ ID NO: 624867 - RNA, 22 nt, Human
uauaaagcugacucaugaaacu

SEQ ID NO: 624868 - RNA, 22 nt, Human
aacuugcuuauauuauuacauu

SEQ ID NO: 624869 - RNA, 20 nt, Human
uggguccugugggagaagaa

SEQ ID NO: 624870 - RNA, 22 nt, Human
cagggcuggcucaugaaaaguu

SEQ ID NO: 624871 - RNA, 22 nt, Human
acuggaaauugagaggucacug

SEQ ID NO: 624872 - RNA, 22 nt, Human
uaugaagugucuguuguaucug

SEQ ID NO: 624873 - RNA, 22 nt, Human
agccucugugacucacagguca

SEQ ID NO: 624874 - RNA, 22 nt, Human
ugcugccucagcuuccugggcu

SEQ ID NO: 624875 - RNA, 22 nt, Human
agaauaauacugaaaugcugaa

SEQ ID NO: 624876 - RNA, 22 nt, Human
ugaugaaaguguuuacucaccu

SEQ ID NO: 624877 - RNA, 22 nt, Human
agguucaguaaauguuaguuga

SEQ ID NO: 624878 - RNA, 22 nt, Human
gucugaagccagugguaguccg

SEQ ID NO: 624879 - RNA, 22 nt, Human
agcccagccacuauuaaauguu

SEQ ID NO: 624880 - RNA, 22 nt, Human
gaagaugugggcccacuccaga

SEQ ID NO: 624881 - RNA, 22 nt, Human
caggucagagucccccuguccu

SEQ ID NO: 624882 - RNA, 22 nt, Human
ugugcugcucucagugacagcc

SEQ ID NO: 624883 - RNA, 22 nt, Human
aauugagugcagccagcccagu

SEQ ID NO: 624884 - RNA, 22 nt, Human
aguucacucuuuaugagaaagu

SEQ ID NO: 624885 - RNA, 22 nt, Human
augcagguugggcaaguguggg

SEQ ID NO: 624886 - RNA, 22 nt, Human
auuguguaauuuucagcucaua

SEQ ID NO: 624887 - RNA, 22 nt, Human
ggaaagaauagagacuuuauca

SEQ ID NO: 624888 - RNA, 23 nt, Human
agcccagcagagaaccuaggucc

SEQ ID NO: 624889 - RNA, 22 nt, Human
gcaaaaaccacaauuacuuuua

SEQ ID NO: 624890 - RNA, 22 nt, Human
acugcuuuucuaagauucugug

SEQ ID NO: 624891 - RNA, 22 nt, Human
aauugcuuuuauuuagggccag

SEQ ID NO: 624892 - RNA, 22 nt, Human
ugcaguucuaaguagacaaguc

SEQ ID NO: 624893 - RNA, 22 nt, Human
ggcaggcacugugcuaggcgcu

SEQ ID NO: 624894 - RNA, 22 nt, Human
cagaggccucacuuccagccag

SEQ ID NO: 624895 - RNA, 22 nt, Human
aggguucugccagugucuugag

SEQ ID NO: 624896 - RNA, 16 nt, Human
uuuauuuacuaguguu

SEQ ID NO: 624897 - RNA, 22 nt, Human
gaacuuuauaacuguaaauguc

SEQ ID NO: 624898 - RNA, 22 nt, Human
gcagaccagccccuggagcugc

SEQ ID NO: 624899 - RNA, 22 nt, Human
uaacaaugauuagugacuacag

SEQ ID NO: 624900 - RNA, 22 nt, Human
acagccagguaaaggcauggca

SEQ ID NO: 624901 - RNA, 22 nt, Human
uugaagauuauucuauuaaaag

SEQ ID NO: 624902 - RNA, 22 nt, Human
caucauuuguucacuugauucc

SEQ ID NO: 624903 - RNA, 22 nt, Human
accagcugcugauugcuaaaug

SEQ ID NO: 624904 - RNA, 22 nt, Human
agggugaaucucacaacucuua

SEQ ID NO: 624905 - RNA, 22 nt, Human
ucuccagggcagagaauagcaa

SEQ ID NO: 624906 - RNA, 22 nt, Human
uuccucagcuggccugauuggg

SEQ ID NO: 624907 - RNA, 22 nt, Human
ugccaggcccugcgggguccca

SEQ ID NO: 624908 - RNA, 22 nt, Human
uccaucugucuuucccauccac

SEQ ID NO: 624909 - RNA, 22 nt, Human
gcugcagacuucucaucucauu

SEQ ID NO: 624910 - RNA, 22 nt, Human
uccagcugcugccagccaagcu

SEQ ID NO: 624911 - RNA, 22 nt, Human
auuccagauguuacugaaaggc

SEQ ID NO: 624912 - RNA, 22 nt, Human
uggcauggcuacuggaauggcg

SEQ ID NO: 624913 - RNA, 22 nt, Human
uuccacucuacacacugcuggc

SEQ ID NO: 624914 - RNA, 22 nt, Human
cugauuguguuccugggagcug

SEQ ID NO: 624915 - RNA, 22 nt, Human
cuugcagaugugacuaaauuaa

SEQ ID NO: 624916 - RNA, 22 nt, Human
guagcaauguugaacacugcgu

SEQ ID NO: 624917 - RNA, 22 nt, Human
gucauuguguggacauggagaa

SEQ ID NO: 624918 - RNA, 22 nt, Human
cacauguccuggcgcugagccc

SEQ ID NO: 624919 - RNA, 22 nt, Human
uccaaacacccuccaugcugca

SEQ ID NO: 624920 - RNA, 22 nt, Human
agacucuggcaugcuaacuagu

SEQ ID NO: 624921 - RNA, 22 nt, Human
ugagucagccagagcugccaug

SEQ ID NO: 624922 - RNA, 22 nt, Human
acccagcccagaaucuggggcc

SEQ ID NO: 624923 - RNA, 22 nt, Human
aggagguguugauagaagguuu

SEQ ID NO: 624924 - RNA, 22 nt, Human
uaaagcaggccacauaugugau

SEQ ID NO: 624925 - RNA, 22 nt, Human
ugaaaugcaacaguuauuuuug

SEQ ID NO: 624926 - RNA, 20 nt, Human
agaacuguuguuuggguccu

SEQ ID NO: 624927 - RNA, 22 nt, Human
ggcuagaguggaacuggagcgg

SEQ ID NO: 624928 - RNA, 22 nt, Human
aucagcuucauaaaguugguca

SEQ ID NO: 624929 - RNA, 22 nt, Human
ugcaagcuuggcugauguugau

SEQ ID NO: 624930 - RNA, 22 nt, Human
auucaguucuggcugccuuccu

SEQ ID NO: 624931 - RNA, 22 nt, Human
cuggcuuuggaacaaaucauag

SEQ ID NO: 624932 - RNA, 22 nt, Human
uggauuaguuaagaaauguuag

SEQ ID NO: 624933 - RNA, 19 nt, Human
uuuuuaaugggcuggagca

SEQ ID NO: 624934 - RNA, 22 nt, Human
gcuccaggagcucacagcucgc

SEQ ID NO: 624935 - RNA, 22 nt, Human
uagacauuucugguuauugaca

SEQ ID NO: 624936 - RNA, 22 nt, Human
uuaucugucuaucaagacuagc

SEQ ID NO: 624937 - RNA, 22 nt, Human
gcuguguaccuacuaacugcuu

SEQ ID NO: 624938 - RNA, 22 nt, Human
gcuggcugaggucuagcucuuu

SEQ ID NO: 624939 - RNA, 22 nt, Human
uuauaggccaucuaaguaauuu

SEQ ID NO: 624940 - RNA, 22 nt, Human
gcuuucugggcuauagaacggg

SEQ ID NO: 624941 - RNA, 22 nt, Human
aacuucaaaugugacuuugcau

SEQ ID NO: 624942 - RNA, 22 nt, Human
aucaaaucauugcauuaauguu

SEQ ID NO: 624943 - RNA, 23 nt, Human
ugcuggaauuuguacccuggcag

SEQ ID NO: 624944 - RNA, 22 nt, Human
auuguuaugaaaauaagauguu

SEQ ID NO: 624945 - RNA, 22 nt, Human
uggcagaguuauggguauuuau

SEQ ID NO: 624946 - RNA, 18 nt, Human
gaggaacauucaccuccu

SEQ ID NO: 624947 - RNA, 22 nt, Human
ugauuuccaugaagcugaaggc

SEQ ID NO: 624948 - RNA, 22 nt, Human
ucaccuugugaucucccugccu

SEQ ID NO: 624949 - RNA, 22 nt, Human
cauguauagguccauagugaau

SEQ ID NO: 624950 - RNA, 22 nt, Human
gggcaggagaagguggaugucc

SEQ ID NO: 624951 - RNA, 22 nt, Human
uaaugcuuugucagccuaaggg

SEQ ID NO: 624952 - RNA, 22 nt, Human
agcugcagccgcagcuguggcc

SEQ ID NO: 624953 - RNA, 22 nt, Human
ucugggucuaucccaugccuuu

SEQ ID NO: 624954 - RNA, 22 nt, Human
uugucccugccccugcuugcuu

SEQ ID NO: 624955 - RNA, 22 nt, Human
ugguuucucagacucuuugcag

SEQ ID NO: 624956 - RNA, 22 nt, Human
gggcaugccugcgcagugcaug

SEQ ID NO: 624957 - RNA, 22 nt, Human
aggucugagucccagggguacc

SEQ ID NO: 624958 - RNA, 22 nt, Human
auaaagcaucuagucugucacu

SEQ ID NO: 624959 - RNA, 22 nt, Human
cauaagaauauuccauccuuug

SEQ ID NO: 624960 - RNA, 22 nt, Human
acaggggaccuaggacccucgg

SEQ ID NO: 624961 - RNA, 22 nt, Human
cucaguccgucccgcuaggugc

SEQ ID NO: 624962 - RNA, 22 nt, Human
acccucaugaagcuggccugga

SEQ ID NO: 624963 - RNA, 22 nt, Human
uuggaaaauguauuucuagaag

SEQ ID NO: 624964 - RNA, 23 nt, Human
aaguucaagucacagccugucuu

SEQ ID NO: 624965 - RNA, 22 nt, Human
guuugcauaucugugaaaugga

SEQ ID NO: 624966 - RNA, 22 nt, Human
ccaggucccuggaauuuaugag

SEQ ID NO: 624967 - RNA, 22 nt, Human
gagagcuauuuggcaagcauuu

SEQ ID NO: 624968 - RNA, 22 nt, Human
aaggcuuggaguaagcuuggcu

SEQ ID NO: 624969 - RNA, 23 nt, Human
ccucucuuuuuaggugguguuug

SEQ ID NO: 624970 - RNA, 22 nt, Human
auggcauugcaagggcaggagg

SEQ ID NO: 624971 - RNA, 21 nt, Human
uguuucaugcuauuuucuugu

SEQ ID NO: 624972 - RNA, 22 nt, Human
auacucagcugcuagacagaag

SEQ ID NO: 624973 - RNA, 19 nt, Human
caggcccuggacccaucug

SEQ ID NO: 624974 - RNA, 22 nt, Human
uucuuuauguuaaugaaucuau

SEQ ID NO: 624975 - RNA, 21 nt, Human
aucauuaauugcugagugaca

SEQ ID NO: 624976 - RNA, 22 nt, Human
uuuuuccuagcgauuugucagc

SEQ ID NO: 624977 - RNA, 23 nt, Human
auguaucucauccaaggaagcuc

SEQ ID NO: 624978 - RNA, 22 nt, Human
cucccucccuacgugagcucac

SEQ ID NO: 624979 - RNA, 18 nt, Human
gagaaaccugugaaugcu

SEQ ID NO: 624980 - RNA, 23 nt, Human
cuucagcagaaacauaaauucuc

SEQ ID NO: 624981 - RNA, 22 nt, Human
gaagccaagggcugcuuuuccu

SEQ ID NO: 624982 - RNA, 22 nt, Human
uaauagaauaguggaaacauug

SEQ ID NO: 624983 - RNA, 22 nt, Human
cacuguuuuauuccaacauagg

SEQ ID NO: 624984 - RNA, 22 nt, Human
caagagcauuuaguuagcuggu

SEQ ID NO: 624985 - RNA, 22 nt, Human
cauuaaauaucaaccuagacua

SEQ ID NO: 624986 - RNA, 20 nt, Human
ugcuggaaaaagucacucau

SEQ ID NO: 624987 - RNA, 22 nt, Human
aacucauucuaaguauaccaaa

SEQ ID NO: 624988 - RNA, 22 nt, Human
auucaguuccuugugauuguag

SEQ ID NO: 624989 - RNA, 22 nt, Human
ucuccaggugacucugauguau

SEQ ID NO: 624990 - RNA, 22 nt, Human
uaagagcuccaauauuuguggc

SEQ ID NO: 624991 - RNA, 22 nt, Human
gucaggaugcuauuguuauuaa

SEQ ID NO: 624992 - RNA, 18 nt, Human
gguggcucagucaugggg

SEQ ID NO: 624993 - RNA, 22 nt, Human
agcucagagggaggugaagugg

SEQ ID NO: 624994 - RNA, 22 nt, Human
uuccagugacuaagcuucugcu

SEQ ID NO: 624995 - RNA, 22 nt, Human
ugcuugggcggccagcauggcg

SEQ ID NO: 624996 - RNA, 22 nt, Human
ggugugggggcaaguuugagau

SEQ ID NO: 624997 - RNA, 22 nt, Human
aggcacuuuaggaucagguuga

SEQ ID NO: 624998 - RNA, 22 nt, Human
ugucugccaccccaucaagcuc

SEQ ID NO: 624999 - RNA, 22 nt, Human
cucuugggugggcagugggccu

SEQ ID NO: 625000 - RNA, 23 nt, Human
ucagaauuccaguuucuuugaag

SEQ ID NO: 625001 - RNA, 22 nt, Human
guguguuuagcauuagcagggg

SEQ ID NO: 625002 - RNA, 22 nt, Human
uuucacaggggcaaccuccaug

SEQ ID NO: 625003 - RNA, 22 nt, Human
aaugacaauauuaauuuggagg

SEQ ID NO: 625004 - RNA, 22 nt, Human
uccagguacucauuggcuguua

SEQ ID NO: 625005 - RNA, 22 nt, Human
agauguuuguguuaucuccauu

SEQ ID NO: 625006 - RNA, 22 nt, Human
guucaagguuuuacagagugua

SEQ ID NO: 625007 - RNA, 22 nt, Human
agaaugcuccagagcugaaaga

SEQ ID NO: 625008 - RNA, 22 nt, Human
gcugguagaccucacugcacuc

SEQ ID NO: 625009 - RNA, 22 nt, Human
gcaggaaagguugagacuuugc

SEQ ID NO: 625010 - RNA, 22 nt, Human
cuugaaaaauaugccuugcuuc

SEQ ID NO: 625011 - RNA, 22 nt, Human
aaagguuuugguaaggcuuuaa

SEQ ID NO: 625012 - RNA, 23 nt, Human
uugcauguagcccaugaguaacu

SEQ ID NO: 625013 - RNA, 22 nt, Human
ucacagugcacagcaggcgugg

SEQ ID NO: 625014 - RNA, 22 nt, Human
uuucaugcacaaaugagcaagg

SEQ ID NO: 625015 - RNA, 22 nt, Human
aucugucuuccaccacacaucc

SEQ ID NO: 625016 - RNA, 22 nt, Human
cuggagccuucaccaggggaaa

SEQ ID NO: 625017 - RNA, 22 nt, Human
gugaggcagagaugccaaaacu

SEQ ID NO: 625018 - RNA, 22 nt, Human
caucaaaguugauauccaauua

SEQ ID NO: 625019 - RNA, 22 nt, Human
cccaaggacacgggcagggaca

SEQ ID NO: 625020 - RNA, 22 nt, Human
acacaagaauaaugaugaaggu

SEQ ID NO: 625021 - RNA, 22 nt, Human
cuaaagacacaauaaguagcuu

SEQ ID NO: 625022 - RNA, 22 nt, Human
gugcccaggggccagcugccgg

SEQ ID NO: 625023 - RNA, 22 nt, Human
cauauuguaaaagguugaaucc

SEQ ID NO: 625024 - RNA, 22 nt, Human
caguauagaaaguuuuaaauug

SEQ ID NO: 625025 - RNA, 22 nt, Human
gggggcuaccgucucuggagcu

SEQ ID NO: 625026 - RNA, 18 nt, Human
gugacagcugcuagcuca

SEQ ID NO: 625027 - RNA, 22 nt, Human
ucaggcaugcauucugcagguu

SEQ ID NO: 625028 - RNA, 22 nt, Human
guuauguacuuuuuaaaucuug

SEQ ID NO: 625029 - RNA, 22 nt, Human
gcugccugaaauguugccuagc

SEQ ID NO: 625030 - RNA, 22 nt, Human
ucccagggauccuccgggucgc

SEQ ID NO: 625031 - RNA, 22 nt, Human
uuucuuccaaaggcacguucuc

SEQ ID NO: 625032 - RNA, 22 nt, Human
uacaguauuacuguguuguuuu

SEQ ID NO: 625033 - RNA, 22 nt, Human
ugccugugucacagugauguuu

SEQ ID NO: 625034 - RNA, 22 nt, Human
uaggccaguugguggcccugga

SEQ ID NO: 625035 - RNA, 22 nt, Human
ugcuuugcaaauaauagaaugu

SEQ ID NO: 625036 - RNA, 22 nt, Human
gagcugggacauggguccucuc

SEQ ID NO: 625037 - RNA, 19 nt, Human
ugcagaagacacaguggug

SEQ ID NO: 625038 - RNA, 22 nt, Human
caccccagcuucucaggauaga

SEQ ID NO: 625039 - RNA, 22 nt, Human
uucucagagugaccaagucuuu

SEQ ID NO: 625040 - RNA, 20 nt, Human
gcuuggcauaggccacuuga

SEQ ID NO: 625041 - RNA, 22 nt, Human
ccucccugguggcucuggucua

SEQ ID NO: 625042 - RNA, 22 nt, Human
uacaguuacuguuauaugugcu

SEQ ID NO: 625043 - RNA, 22 nt, Human
ccaaaauuauuacauuuguagg

SEQ ID NO: 625044 - RNA, 18 nt, Human
agcagcugugccacacug

SEQ ID NO: 625045 - RNA, 18 nt, Human
ccuggagcuccacagcaa

SEQ ID NO: 625046 - RNA, 22 nt, Human
cacagcugaccacccugcuccc

SEQ ID NO: 625047 - RNA, 22 nt, Human
ucucuuuaaguauaaucuuaua

SEQ ID NO: 625048 - RNA, 22 nt, Human
augaagacaaacgacguugcaa

SEQ ID NO: 625049 - RNA, 22 nt, Human
ggaugaggaagauuacugagaa

SEQ ID NO: 625050 - RNA, 22 nt, Human
aucaaugcucuguacccagaau

SEQ ID NO: 625051 - RNA, 22 nt, Human
ggcuggcucaugcaaaggguga

SEQ ID NO: 625052 - RNA, 22 nt, Human
uacuguacugcaguucugcaaa

SEQ ID NO: 625053 - RNA, 19 nt, Human
cccagcuugaccaccugcu

SEQ ID NO: 625054 - RNA, 22 nt, Human
cuguggccuggggacacuaucu

SEQ ID NO: 625055 - RNA, 22 nt, Human
ggagggcagaguccccugcuga

SEQ ID NO: 625056 - RNA, 22 nt, Human
uucucuuuauguauuuaguggg

SEQ ID NO: 625057 - RNA, 22 nt, Human
gucuggcuuuugcccuguguuu

SEQ ID NO: 625058 - RNA, 22 nt, Human
ggaccuggcaauuugcaucucu

SEQ ID NO: 625059 - RNA, 22 nt, Human
aaacauugagugccuuugguau

SEQ ID NO: 625060 - RNA, 21 nt, Human
ucuagaauccuguauaagacu

SEQ ID NO: 625061 - RNA, 22 nt, Human
ucugccaggccugcuuccgggg

SEQ ID NO: 625062 - RNA, 22 nt, Human
uccugagaauagaguugcaugu

SEQ ID NO: 625063 - RNA, 22 nt, Human
agaucaaaucugggauuucuaa

SEQ ID NO: 625064 - RNA, 22 nt, Human
uauauuugcuaaaugugugcaa

SEQ ID NO: 625065 - RNA, 22 nt, Human
cuguggcucaggccuguaagcc

SEQ ID NO: 625066 - RNA, 22 nt, Human
uguccccaagguucagcccaca

SEQ ID NO: 625067 - RNA, 23 nt, Human
auucuucauuaucuucuagaaaa

SEQ ID NO: 625068 - RNA, 22 nt, Human
gcacccagaauaaggacaggac

SEQ ID NO: 625069 - RNA, 22 nt, Human
ucagagaggauuuuaauaagug

SEQ ID NO: 625070 - RNA, 22 nt, Human
gagcaggcucugccuguguguc

SEQ ID NO: 625071 - RNA, 22 nt, Human
acaguggaauggugggccugca

SEQ ID NO: 625072 - RNA, 20 nt, Human
agccaccucauuucccuacc

SEQ ID NO: 625073 - RNA, 22 nt, Human
ugcagagaaaguguagacaggc

SEQ ID NO: 625074 - RNA, 22 nt, Human
gauuucuugagcaaguugcuua

SEQ ID NO: 625075 - RNA, 22 nt, Human
gccaggaguucagaugcauguu

SEQ ID NO: 625076 - RNA, 22 nt, Human
ggcagugagcuggagggaagga

SEQ ID NO: 625077 - RNA, 22 nt, Human
ccuagacuagaggcagggagcc

SEQ ID NO: 625078 - RNA, 22 nt, Human
ccuuagcagggagucuguccag

SEQ ID NO: 625079 - RNA, 22 nt, Human
uugccaggggacaucuggagcc

SEQ ID NO: 625080 - RNA, 22 nt, Human
augaaguucucaauaaucaugu

SEQ ID NO: 625081 - RNA, 22 nt, Human
uguguaaagcuuguuccagaaa

SEQ ID NO: 625082 - RNA, 22 nt, Human
ucucaaacuaacaaugauuaua

SEQ ID NO: 625083 - RNA, 22 nt, Human
accauuuaaggaaaauguauca

SEQ ID NO: 625084 - RNA, 22 nt, Human
ugcugugagguugagaaggaag

SEQ ID NO: 625085 - RNA, 22 nt, Human
cagcaugaugcucacacaaaac

SEQ ID NO: 625086 - RNA, 22 nt, Human
ucugaaauauauuuugaguguu

SEQ ID NO: 625087 - RNA, 22 nt, Human
ggacaugauauuucaggaagac

SEQ ID NO: 625088 - RNA, 22 nt, Human
ucugauguggcagcugcaucua

SEQ ID NO: 625089 - RNA, 22 nt, Human
aauucaaauuacaauaguuguu

SEQ ID NO: 625090 - RNA, 22 nt, Human
gaaggcagguuuuucaaaacug

SEQ ID NO: 625091 - RNA, 22 nt, Human
ucugggguugagucugggucag

SEQ ID NO: 625092 - RNA, 22 nt, Human
agcugccuccauggucaaagau

SEQ ID NO: 625093 - RNA, 22 nt, Human
cccaggagauggugcguggucu

SEQ ID NO: 625094 - RNA, 22 nt, Human
cagcaggauuggauacaucuca

SEQ ID NO: 625095 - RNA, 22 nt, Human
uggaaaacuuugguggugaggg

SEQ ID NO: 625096 - RNA, 22 nt, Human
uuccuugguacagaguagcuuu

SEQ ID NO: 625097 - RNA, 22 nt, Human
acaaggcauuccggaaguaacc

SEQ ID NO: 625098 - RNA, 22 nt, Human
gucauuccuauccauuugauac

SEQ ID NO: 625099 - RNA, 22 nt, Human
agagggaacggaucccagcgcg

SEQ ID NO: 625100 - RNA, 22 nt, Human
ggaagauuuuccauuccucuuu

SEQ ID NO: 625101 - RNA, 22 nt, Human
aauucacaugcaugucugugca

SEQ ID NO: 625102 - RNA, 22 nt, Human
aaagugcugggauuacaggcuu

SEQ ID NO: 625103 - RNA, 21 nt, Human
cagcuucugaagguguaggaa

SEQ ID NO: 625104 - RNA, 22 nt, Human
aggaugggucagcuagagucca

SEQ ID NO: 625105 - RNA, 22 nt, Human
auggcaggcccagguguucauu

SEQ ID NO: 625106 - RNA, 22 nt, Human
ugcuuuauugcaucaguguggg

SEQ ID NO: 625107 - RNA, 22 nt, Human
uuuaagaguuaaacuuugaccu

SEQ ID NO: 625108 - RNA, 22 nt, Human
gcugccuggcuuuaguccacuu

SEQ ID NO: 625109 - RNA, 22 nt, Human
gaagacacuaaacuggggcuuc

SEQ ID NO: 625110 - RNA, 22 nt, Human
uuuuagacuuguauguaaagcc

SEQ ID NO: 625111 - RNA, 22 nt, Human
cauuaauaaacauuucagaaga

SEQ ID NO: 625112 - RNA, 22 nt, Human
acucuuuauuguuuguggcuag

SEQ ID NO: 625113 - RNA, 18 nt, Human
gaaaugugauucuagggc

SEQ ID NO: 625114 - RNA, 22 nt, Human
ccuuggcuuccuucccucuaga

SEQ ID NO: 625115 - RNA, 22 nt, Human
uccuucuguagucccugucccu

SEQ ID NO: 625116 - RNA, 22 nt, Human
aggggugaaagagggcccucaa

SEQ ID NO: 625117 - RNA, 22 nt, Human
aucauccuagaaggaagcuagg

SEQ ID NO: 625118 - RNA, 22 nt, Human
caucuuuaaaaugggaacaaca

SEQ ID NO: 625119 - RNA, 22 nt, Human
gagagguaauuugaagugcaaa

SEQ ID NO: 625120 - RNA, 22 nt, Human
cccaauaaaauucauuuucauu

SEQ ID NO: 625121 - RNA, 22 nt, Human
uagucagagucuucucuguugu

SEQ ID NO: 625122 - RNA, 22 nt, Human
aaguuuaguagggacagaugga

SEQ ID NO: 625123 - RNA, 22 nt, Human
acagagucuuacguggugauaa

SEQ ID NO: 625124 - RNA, 22 nt, Human
aggguccaucaaggacugcaca

SEQ ID NO: 625125 - RNA, 22 nt, Human
agcuguguaagucauguaggug

SEQ ID NO: 625126 - RNA, 22 nt, Human
uuuucugaccuaucuacauuua

SEQ ID NO: 625127 - RNA, 23 nt, Human
uuugaacauuucuagauuacaua

SEQ ID NO: 625128 - RNA, 22 nt, Human
gcuaggagccgcugcacuaggu

SEQ ID NO: 625129 - RNA, 22 nt, Human
uuuguuuugaacuagcucagaa

SEQ ID NO: 625130 - RNA, 22 nt, Human
uagguuucagaggugccgggaa

SEQ ID NO: 625131 - RNA, 22 nt, Human
cagcagcugccucagcugggga

SEQ ID NO: 625132 - RNA, 22 nt, Human
ugcugagggagggguuuuccag

SEQ ID NO: 625133 - RNA, 22 nt, Human
gaaccaaguaggauacaaggag

SEQ ID NO: 625134 - RNA, 15 nt, Human
cuccaugauuuugca

SEQ ID NO: 625135 - RNA, 22 nt, Human
ccucuucuaccauuuacauuuu

SEQ ID NO: 625136 - RNA, 22 nt, Human
ccuggccagccagggcuggggu

SEQ ID NO: 625137 - RNA, 22 nt, Human
uccaauuuuacgucuguauaaa

SEQ ID NO: 625138 - RNA, 19 nt, Human
cagaugagaaaagugaggu

SEQ ID NO: 625139 - RNA, 22 nt, Human
aaggucuggaugaugggugugc

SEQ ID NO: 625140 - RNA, 22 nt, Human
ggguuucaugguucucacaaug

SEQ ID NO: 625141 - RNA, 22 nt, Human
cugcuuccucccuguaaaggca

SEQ ID NO: 625142 - RNA, 20 nt, Human
uugaaaaugcauugugcagu

SEQ ID NO: 625143 - RNA, 22 nt, Human
uucagaaacagagugagugagu

SEQ ID NO: 625144 - RNA, 22 nt, Human
uacauucacaguuguucaucuc

SEQ ID NO: 625145 - RNA, 22 nt, Human
guggggaggccuaagcaaguug

SEQ ID NO: 625146 - RNA, 22 nt, Human
gagcugugauuggugucucacu

SEQ ID NO: 625147 - RNA, 22 nt, Human
gggggugacgauggcagcuggu

SEQ ID NO: 625148 - RNA, 22 nt, Human
cuguuguaaagcuauucauuug

SEQ ID NO: 625149 - RNA, 22 nt, Human
gauuucagaguuuauuagguua

SEQ ID NO: 625150 - RNA, 22 nt, Human
agguauauugaaugcuuacuua

SEQ ID NO: 625151 - RNA, 22 nt, Human
ggccugcuggcuccagcgcccg

SEQ ID NO: 625152 - RNA, 22 nt, Human
ugggcugagcacugaggaagga

SEQ ID NO: 625153 - RNA, 20 nt, Human
agggucugaugugguggccc

SEQ ID NO: 625154 - RNA, 22 nt, Human
acagaacuuccagggaacauac

SEQ ID NO: 625155 - RNA, 22 nt, Human
auuuauuccugauuccuggcuu

SEQ ID NO: 625156 - RNA, 22 nt, Human
ucucuggcuggcaccccaggga

SEQ ID NO: 625157 - RNA, 22 nt, Human
ucaguugcaugggaaguucaga

SEQ ID NO: 625158 - RNA, 22 nt, Human
gcuacagagcucugugaagaga

SEQ ID NO: 625159 - RNA, 22 nt, Human
aggaccaguaugagagcaucug

SEQ ID NO: 625160 - RNA, 23 nt, Human
cugcagccgcguggggacgugga

SEQ ID NO: 625161 - RNA, 22 nt, Human
ucagggcagccuaaggcaccuc

SEQ ID NO: 625162 - RNA, 22 nt, Human
acucauguuuucucuagcugga

SEQ ID NO: 625163 - RNA, 22 nt, Human
ugugaaggcagagccagugaaa

SEQ ID NO: 625164 - RNA, 22 nt, Human
agcuccccucguuucucuccau

SEQ ID NO: 625165 - RNA, 22 nt, Human
gguggagcuguggacaggaagg

SEQ ID NO: 625166 - RNA, 22 nt, Human
auacuaaaguauagaacuuagu

SEQ ID NO: 625167 - RNA, 22 nt, Human
uucagggcagcuagaaccagga

SEQ ID NO: 625168 - RNA, 22 nt, Human
uacuuacacagcuguagaaggu

SEQ ID NO: 625169 - RNA, 21 nt, Human
aggagggcacaaggccaggaa

SEQ ID NO: 625170 - RNA, 20 nt, Human
gugcagauguccuuucacac

SEQ ID NO: 625171 - RNA, 22 nt, Human
uuccaggaagcaguuagcagcc

SEQ ID NO: 625172 - RNA, 22 nt, Human
gggcaugacuuuuggaguggga

SEQ ID NO: 625173 - RNA, 22 nt, Human
aggcccugagaaaaucccugca

SEQ ID NO: 625174 - RNA, 22 nt, Human
aaugaucccauuuagaaacaga

SEQ ID NO: 625175 - RNA, 22 nt, Human
aagagucagcuucuguaugggu

SEQ ID NO: 625176 - RNA, 22 nt, Human
aaucaguuagaaggaagagaau

SEQ ID NO: 625177 - RNA, 23 nt, Human
auuuuuugucuuuguaacuagau

SEQ ID NO: 625178 - RNA, 22 nt, Human
auauacagggagaaacagcuua

SEQ ID NO: 625179 - RNA, 22 nt, Human
cacaggcaccccugacugcuca

SEQ ID NO: 625180 - RNA, 17 nt, Human
ccuuucucuuucaucuc

SEQ ID NO: 625181 - RNA, 22 nt, Human
ugcuccugagcgguuuccauga

SEQ ID NO: 625182 - RNA, 22 nt, Human
caagauuuauauuuucacacaa

SEQ ID NO: 625183 - RNA, 22 nt, Human
ucugugucacugaggccugugu

SEQ ID NO: 625184 - RNA, 22 nt, Human
agugauuugggugucagaaagu

SEQ ID NO: 625185 - RNA, 22 nt, Human
aagacaauuuugaguaugcaca

SEQ ID NO: 625186 - RNA, 22 nt, Human
guagggacaauauguuauuaga

SEQ ID NO: 625187 - RNA, 22 nt, Human
gagcucuguucucguccugcug

SEQ ID NO: 625188 - RNA, 22 nt, Human
cuugaaugaaaccaacugauga

SEQ ID NO: 625189 - RNA, 22 nt, Human
accuggagaaagccucucccug

SEQ ID NO: 625190 - RNA, 22 nt, Human
cugugucucuaccuccccaucc

SEQ ID NO: 625191 - RNA, 23 nt, Human
augcuuccacagagcuugcagcc

SEQ ID NO: 625192 - RNA, 22 nt, Human
acaggugucuaaggcagacagc

SEQ ID NO: 625193 - RNA, 22 nt, Human
gaggggcuggcacgauggcugc

SEQ ID NO: 625194 - RNA, 22 nt, Human
gcagauaggguauuaggaguaa

SEQ ID NO: 625195 - RNA, 22 nt, Human
cuggccaacuugcuuguuggca

SEQ ID NO: 625196 - RNA, 19 nt, Human
uucucuggacuagaugcug

SEQ ID NO: 625197 - RNA, 22 nt, Human
agcagcagcauugagcgcuugu

SEQ ID NO: 625198 - RNA, 22 nt, Human
gaggccuggcugggaggaggug

SEQ ID NO: 625199 - RNA, 22 nt, Human
uuagcuuucaugaaccuggucg

SEQ ID NO: 625200 - RNA, 22 nt, Human
gcugggcccugggugcccuagc

SEQ ID NO: 625201 - RNA, 19 nt, Human
augcacacauugaagagga

SEQ ID NO: 625202 - RNA, 22 nt, Human
aggaggguucucuggacagagg

SEQ ID NO: 625203 - RNA, 22 nt, Human
cugucucaagacugcaggcacu

SEQ ID NO: 625204 - RNA, 22 nt, Human
aguugaaauuagaguccuggcu

SEQ ID NO: 625205 - RNA, 22 nt, Human
ucacagcaacccugaggcgagu

SEQ ID NO: 625206 - RNA, 22 nt, Human
auggaauuucuccggcuccacc

SEQ ID NO: 625207 - RNA, 22 nt, Human
ugcuuuaguucaacaugccaaa

SEQ ID NO: 625208 - RNA, 22 nt, Human
uguauacaggcauaagagauac

SEQ ID NO: 625209 - RNA, 22 nt, Human
uuuauuuaaagucguguguuaa

SEQ ID NO: 625210 - RNA, 22 nt, Human
uuuuuauaggucagggcaaguc

SEQ ID NO: 625211 - RNA, 22 nt, Human
ugagggugggccugcaggaaga

SEQ ID NO: 625212 - RNA, 20 nt, Human
cucagcagauucuucuagaa

SEQ ID NO: 625213 - RNA, 20 nt, Human
gccugggauuauccacuggu

SEQ ID NO: 625214 - RNA, 22 nt, Human
acaugcaugcuuuggugggugu

SEQ ID NO: 625215 - RNA, 22 nt, Human
agauauuuugugugauguuuca

SEQ ID NO: 625216 - RNA, 22 nt, Human
cuguagcugggccucggcagug

SEQ ID NO: 625217 - RNA, 22 nt, Human
uagauaacagcacuggccucgc

SEQ ID NO: 625218 - RNA, 22 nt, Human
ugugugacacauugauaugugc

SEQ ID NO: 625219 - RNA, 22 nt, Human
uggaccaugagcugcagguguu

SEQ ID NO: 625220 - RNA, 22 nt, Human
agggcagagcugucuaaauggc

SEQ ID NO: 625221 - RNA, 22 nt, Human
ugaggcaggaugcuugcacagg

SEQ ID NO: 625222 - RNA, 22 nt, Human
acacacuggcaggagcuauaaa

SEQ ID NO: 625223 - RNA, 22 nt, Human
uggagcaugagagucuuuagcu

SEQ ID NO: 625224 - RNA, 22 nt, Human
ugagaucuucgcucuucacaga

SEQ ID NO: 625225 - RNA, 22 nt, Human
uugaggucuggcaguagcguug

SEQ ID NO: 625226 - RNA, 22 nt, Human
guguaugcaauugagucauaga

SEQ ID NO: 625227 - RNA, 22 nt, Human
gcccagcacaucuggccuugaa

SEQ ID NO: 625228 - RNA, 17 nt, Human
aucuggaagcuagcuga

SEQ ID NO: 625229 - RNA, 22 nt, Human
cagcaggcugcgauugcucauu

SEQ ID NO: 625230 - RNA, 20 nt, Human
gggaucaggaaaggaggcua

SEQ ID NO: 625231 - RNA, 22 nt, Human
uuucagacuccaaauucauaag

SEQ ID NO: 625232 - RNA, 19 nt, Human
ucaaaugccaaugucacag

SEQ ID NO: 625233 - RNA, 22 nt, Human
augcuuccaauauucucccuuu

SEQ ID NO: 625234 - RNA, 21 nt, Human
ugucagcaacaauacuuucuc

SEQ ID NO: 625235 - RNA, 20 nt, Human
uacagaaugcaauaaaaugg

SEQ ID NO: 625236 - RNA, 20 nt, Human
uagggcucauuaugaucucc

SEQ ID NO: 625237 - RNA, 22 nt, Human
gcacccuguuuauccugaguuc

SEQ ID NO: 625238 - RNA, 20 nt, Human
gcugaccccugcugucaugc

SEQ ID NO: 625239 - RNA, 22 nt, Human
ggagaagguggcucagcaaagg

SEQ ID NO: 625240 - RNA, 22 nt, Human
uagagugguuaacaguuuagaa

SEQ ID NO: 625241 - RNA, 22 nt, Human
cugggcccaggcggcucucgga

SEQ ID NO: 625242 - RNA, 22 nt, Human
cagcaacauauaugaaacugug

SEQ ID NO: 625243 - RNA, 22 nt, Human
agcagcaguguguggucauguu

SEQ ID NO: 625244 - RNA, 19 nt, Human
uccagggcaggaacaugua

SEQ ID NO: 625245 - RNA, 22 nt, Human
aagaaaugcacacaacugcugg

SEQ ID NO: 625246 - RNA, 22 nt, Human
auguacaggucuuggcaaaggg

SEQ ID NO: 625247 - RNA, 22 nt, Human
guggaaggaagagauggcccca

SEQ ID NO: 625248 - RNA, 22 nt, Human
ccagagaccagaacauggggau

SEQ ID NO: 625249 - RNA, 22 nt, Human
ucacagcucugucaauuuuaua

SEQ ID NO: 625250 - RNA, 22 nt, Human
acuguauaguauuuauucuuag

SEQ ID NO: 625251 - RNA, 22 nt, Human
cacuggaauguugaggagacaa

SEQ ID NO: 625252 - RNA, 22 nt, Human
uggcagugaugcuuaugguuug

SEQ ID NO: 625253 - RNA, 22 nt, Human
uacagaaguugguuuuaguuua

SEQ ID NO: 625254 - RNA, 22 nt, Human
uaauuauacaaaaaggcaugca

SEQ ID NO: 625255 - RNA, 22 nt, Human
accagcaccugauaggcaguaa

SEQ ID NO: 625256 - RNA, 22 nt, Human
aauggcaacaugguauagugag

SEQ ID NO: 625257 - RNA, 22 nt, Human
uggggccagcggggaggacuca

SEQ ID NO: 625258 - RNA, 22 nt, Human
aaagcagcagaaucucucaggg

SEQ ID NO: 625259 - RNA, 22 nt, Human
gcuucuaaccugcuuccuguag

SEQ ID NO: 625260 - RNA, 22 nt, Human
ccaggugggaggaaagcagaga

SEQ ID NO: 625261 - RNA, 22 nt, Human
agccugccaggcgcugccugga

SEQ ID NO: 625262 - RNA, 22 nt, Human
uccuccucuaucagacagugcc

SEQ ID NO: 625263 - RNA, 22 nt, Human
ccuggaguuuuuugguugacuc

SEQ ID NO: 625264 - RNA, 22 nt, Human
caggucucugcagccccucugu

SEQ ID NO: 625265 - RNA, 22 nt, Human
ugagaguagagucuucaucugu

SEQ ID NO: 625266 - RNA, 17 nt, Human
uuucaacaucacucagc

SEQ ID NO: 625267 - RNA, 22 nt, Human
cagggccagagagggcuggcug

SEQ ID NO: 625268 - RNA, 22 nt, Human
aagcaagcuguuggcaauaggg

SEQ ID NO: 625269 - RNA, 22 nt, Human
cccugcuaguugucucagugau

SEQ ID NO: 625270 - RNA, 22 nt, Human
cacucccucuaguugcauucug

SEQ ID NO: 625271 - RNA, 22 nt, Human
cagggcccauggcucagguagg

SEQ ID NO: 625272 - RNA, 22 nt, Human
uuacaagauugauuugcuuggc

SEQ ID NO: 625273 - RNA, 22 nt, Human
acaaagugugcggagcccaggg

SEQ ID NO: 625274 - RNA, 22 nt, Human
cuuggggcagugcuuggcacau

SEQ ID NO: 625275 - RNA, 22 nt, Human
aauuugugaaucugucucuuga

SEQ ID NO: 625276 - RNA, 22 nt, Human
ugcuggaagaaaauucuuuaac

SEQ ID NO: 625277 - RNA, 22 nt, Human
uggggacaggagacuuacagcu

SEQ ID NO: 625278 - RNA, 22 nt, Human
agcauauaaauggacauauuug

SEQ ID NO: 625279 - RNA, 22 nt, Human
auuugccuguaagacaaggccu

SEQ ID NO: 625280 - RNA, 22 nt, Human
ucuggcucucaacaaauauuua

SEQ ID NO: 625281 - RNA, 22 nt, Human
uuugaaaggaauuaggaugaca

SEQ ID NO: 625282 - RNA, 22 nt, Human
cuccuggcacugucuugaccca

SEQ ID NO: 625283 - RNA, 22 nt, Human
uggcgaggccaggccagggccu

SEQ ID NO: 625284 - RNA, 22 nt, Human
agagaagagucuugucaaauua

SEQ ID NO: 625285 - RNA, 22 nt, Human
aguucugcaugaaaaaggacua

SEQ ID NO: 625286 - RNA, 22 nt, Human
aggcaccuugcgguccagugaa

SEQ ID NO: 625287 - RNA, 22 nt, Human
augaagcaacagcccuccuauu

SEQ ID NO: 625288 - RNA, 22 nt, Human
agcugagcugcagaugacugua

SEQ ID NO: 625289 - RNA, 22 nt, Human
auccagaacaccuguaucacca

SEQ ID NO: 625290 - RNA, 22 nt, Human
uggagcugaacuuugaggccag

SEQ ID NO: 625291 - RNA, 22 nt, Human
ucugggagguacugggaggugu

SEQ ID NO: 625292 - RNA, 22 nt, Human
uccucagaagaaccccuagauu

SEQ ID NO: 625293 - RNA, 22 nt, Human
aaggcaaggccaagccaucagu

SEQ ID NO: 625294 - RNA, 20 nt, Human
uacaaguacauuauaguuau

SEQ ID NO: 625295 - RNA, 22 nt, Human
gcaguguucagugaagcaggag

SEQ ID NO: 625296 - RNA, 22 nt, Human
caacucaggcaccucauauaag

SEQ ID NO: 625297 - RNA, 22 nt, Human
acugagcugcaagucagggagg

SEQ ID NO: 625298 - RNA, 17 nt, Human
agguuuaugguauuuga

SEQ ID NO: 625299 - RNA, 20 nt, Human
aaguuuaggggaaagugaca

SEQ ID NO: 625300 - RNA, 22 nt, Human
ugcgauguaugcaguauuuguu

SEQ ID NO: 625301 - RNA, 17 nt, Human
cccagggaccacugcuu

SEQ ID NO: 625302 - RNA, 22 nt, Human
ugagaauuugugaacuuuucuc

SEQ ID NO: 625303 - RNA, 22 nt, Human
ccugggcuuucggcggcuuccu

SEQ ID NO: 625304 - RNA, 22 nt, Human
gcgugugugauaugccucugca

SEQ ID NO: 625305 - RNA, 22 nt, Human
uuuuaauccucuugguaucuua

SEQ ID NO: 625306 - RNA, 22 nt, Human
cauggcuugucuugucuucuga

SEQ ID NO: 625307 - RNA, 22 nt, Human
gaaggcuaaaggggcagagguu

SEQ ID NO: 625308 - RNA, 22 nt, Human
uucaaaguaccguacuuaaugg

SEQ ID NO: 625309 - RNA, 22 nt, Human
cugcaucacagcaggaggcaca

SEQ ID NO: 625310 - RNA, 22 nt, Human
caggccaagucccaagugcggg

SEQ ID NO: 625311 - RNA, 23 nt, Human
ucuggcuuugcuggaaguuuuga

SEQ ID NO: 625312 - RNA, 22 nt, Human
cccaggaaguggagguugcagu

SEQ ID NO: 625313 - RNA, 22 nt, Human
agcagcuuggggccgagauaga

SEQ ID NO: 625314 - RNA, 22 nt, Human
uccaagagaauacuggagagua

SEQ ID NO: 625315 - RNA, 22 nt, Human
gcugccuuaugucuauuaguau

SEQ ID NO: 625316 - RNA, 22 nt, Human
cuugccaaauuaacauacagaa

SEQ ID NO: 625317 - RNA, 22 nt, Human
ugggaugcccugacccucugga

SEQ ID NO: 625318 - RNA, 22 nt, Human
cuuuuucaagucaaagagggua

SEQ ID NO: 625319 - RNA, 22 nt, Human
ccccaugaaguagggucucuga

SEQ ID NO: 625320 - RNA, 22 nt, Human
ugcaggccucacaccuggcacc

SEQ ID NO: 625321 - RNA, 22 nt, Human
acuuuguuuuauagcacauaag

SEQ ID NO: 625322 - RNA, 22 nt, Human
guggcucuaggugagcauggag

SEQ ID NO: 625323 - RNA, 20 nt, Human
cucaggauacugcaaaguug

SEQ ID NO: 625324 - RNA, 22 nt, Human
aggucugguguugaugaauucc

SEQ ID NO: 625325 - RNA, 22 nt, Human
acaugauuuuaguaucauaaua

SEQ ID NO: 625326 - RNA, 23 nt, Human
uguugaaguaacuguuacauaga

SEQ ID NO: 625327 - RNA, 22 nt, Human
cucucugggcccaguuggcacc

SEQ ID NO: 625328 - RNA, 22 nt, Human
ucugaggcuucagacuguacug

SEQ ID NO: 625329 - RNA, 22 nt, Human
cucuggagugcagccugguggc

SEQ ID NO: 625330 - RNA, 22 nt, Human
ggaaggcuuuguagaagugcca

SEQ ID NO: 625331 - RNA, 22 nt, Human
ccuccugguaauuagcgaaagg

SEQ ID NO: 625332 - RNA, 22 nt, Human
gggcugcacguauucugcucac

SEQ ID NO: 625333 - RNA, 22 nt, Human
ugaggccagggauuccaucauu

SEQ ID NO: 625334 - RNA, 17 nt, Human
cucugggcagccugggg

SEQ ID NO: 625335 - RNA, 22 nt, Human
uagucaaaaggaaggauaugcu

SEQ ID NO: 625336 - RNA, 17 nt, Human
guuugcaugguguuaac

SEQ ID NO: 625337 - RNA, 22 nt, Human
cugcccuguggcucugagucau

SEQ ID NO: 625338 - RNA, 19 nt, Human
ggcuccuguggcugcagcc

SEQ ID NO: 625339 - RNA, 22 nt, Human
uguacaaucugaugauguaugg

SEQ ID NO: 625340 - RNA, 22 nt, Human
uaagaggcauuagagacauagc

SEQ ID NO: 625341 - RNA, 22 nt, Human
agcaaggggcagugaaagugug

SEQ ID NO: 625342 - RNA, 22 nt, Human
gcuucucauguuuauuuuuaca

SEQ ID NO: 625343 - RNA, 22 nt, Human
agauaucugcaauauaauuuaa

SEQ ID NO: 625344 - RNA, 22 nt, Human
auuaguguuguggcuucauggc

SEQ ID NO: 625345 - RNA, 17 nt, Human
gaggacagggaaguagg

SEQ ID NO: 625346 - RNA, 22 nt, Human
auugacuuccauagcuaccugg

SEQ ID NO: 625347 - RNA, 22 nt, Human
ugagggagcacacacugaagug

SEQ ID NO: 625348 - RNA, 22 nt, Human
uaaggcuuaugaucagaagguu

SEQ ID NO: 625349 - RNA, 22 nt, Human
agaugcuucaguguuuaauuua

SEQ ID NO: 625350 - RNA, 22 nt, Human
ugccaucugcacccaccugccc

SEQ ID NO: 625351 - RNA, 22 nt, Human
ugcaucuuacguuuugaaaggg

SEQ ID NO: 625352 - RNA, 22 nt, Human
aucacagcacaccugacaugua

SEQ ID NO: 625353 - RNA, 22 nt, Human
gcucucugguuccagucaggaa

SEQ ID NO: 625354 - RNA, 22 nt, Human
ucuuucuugcaaggaugcagga

SEQ ID NO: 625355 - RNA, 22 nt, Human
guauuuuauggccuggggccua

SEQ ID NO: 625356 - RNA, 22 nt, Human
uacccucucccgguccagcuuu

SEQ ID NO: 625357 - RNA, 22 nt, Human
acagaauaagguuuaucucucc

SEQ ID NO: 625358 - RNA, 19 nt, Human
ugucuuuggucugaguuuc

SEQ ID NO: 625359 - RNA, 20 nt, Human
ucagaagugcagcugccccu

SEQ ID NO: 625360 - RNA, 22 nt, Human
ggcuucucucuucacauggcuu

SEQ ID NO: 625361 - RNA, 22 nt, Human
cagugcuuuuaaaacaacauca

SEQ ID NO: 625362 - RNA, 22 nt, Human
ccuuuacaguagcccuuuugaa

SEQ ID NO: 625363 - RNA, 18 nt, Human
ccagguggugacagagau

SEQ ID NO: 625364 - RNA, 22 nt, Human
cugugugcucggauggacucgu

SEQ ID NO: 625365 - RNA, 22 nt, Human
gaggaaaaugcaacaggaaugc

SEQ ID NO: 625366 - RNA, 22 nt, Human
ugagccuggccugcagagacca

SEQ ID NO: 625367 - RNA, 22 nt, Human
gcagagcuccccaagacaccaa

SEQ ID NO: 625368 - RNA, 22 nt, Human
accacaggaggauggcugcugg

SEQ ID NO: 625369 - RNA, 22 nt, Human
acaguagcuaauauugcauuau

SEQ ID NO: 625370 - RNA, 18 nt, Human
gacagcuguccugagccc

SEQ ID NO: 625371 - RNA, 22 nt, Human
uagcuuaaaccaaucugaauaa

SEQ ID NO: 625372 - RNA, 22 nt, Human
ugcuuugugacagauuaguuuu

SEQ ID NO: 625373 - RNA, 22 nt, Human
agggcagcccuucugggagggc

SEQ ID NO: 625374 - RNA, 22 nt, Human
gagacauucuuaggaacaaugu

SEQ ID NO: 625375 - RNA, 22 nt, Human
agacuggaagccugccaagcaa

SEQ ID NO: 625376 - RNA, 22 nt, Human
ugcugaaacaauaacauacugg

SEQ ID NO: 625377 - RNA, 22 nt, Human
cuugcuuuccaaaugacucacu

SEQ ID NO: 625378 - RNA, 22 nt, Human
ugcaauaacccaugagauagaa

SEQ ID NO: 625379 - RNA, 22 nt, Human
aggcaguuuaggcagcgauuua

SEQ ID NO: 625380 - RNA, 22 nt, Human
gcauuuguguucuuccuagagc

SEQ ID NO: 625381 - RNA, 22 nt, Human
cucaccacagagccuguccagc

SEQ ID NO: 625382 - RNA, 22 nt, Human
gaucugguuucaucauggacuu

SEQ ID NO: 625383 - RNA, 22 nt, Human
cccacguugaaccgcuuacaga

SEQ ID NO: 625384 - RNA, 22 nt, Human
cacuggccuaagcgccucagcc

SEQ ID NO: 625385 - RNA, 22 nt, Human
caaguuuugauuuugcaguaaa

SEQ ID NO: 625386 - RNA, 22 nt, Human
uuccugugaagaucugggugcu

SEQ ID NO: 625387 - RNA, 22 nt, Human
ggagaggguagggguccugccc

SEQ ID NO: 625388 - RNA, 22 nt, Human
uuuuacuucauuccugacuuca

SEQ ID NO: 625389 - RNA, 22 nt, Human
auucaguugucuacuacugccu

SEQ ID NO: 625390 - RNA, 22 nt, Human
ucuuggaguauugggccucagg

SEQ ID NO: 625391 - RNA, 22 nt, Human
gaggggagacagggaaaucagu

SEQ ID NO: 625392 - RNA, 22 nt, Human
auggcugugugacugaguucua

SEQ ID NO: 625393 - RNA, 22 nt, Human
cuggccucucugagcagggagc

SEQ ID NO: 625394 - RNA, 22 nt, Human
ucccagagugagccaggggcag

SEQ ID NO: 625395 - RNA, 22 nt, Human
gaggcugucuguuagccuggga

SEQ ID NO: 625396 - RNA, 22 nt, Human
acucccuuuccaggaaacacaa

SEQ ID NO: 625397 - RNA, 22 nt, Human
ugcuuuauaggggauugcaggc

SEQ ID NO: 625398 - RNA, 23 nt, Human
ugucuggggcgccagaagagaga

SEQ ID NO: 625399 - RNA, 22 nt, Human
gacauuuagguagcuuccaguu

SEQ ID NO: 625400 - RNA, 22 nt, Human
ggaggccaccauggagucacuu

SEQ ID NO: 625401 - RNA, 21 nt, Human
acauuuucuguuuuaggaagu

SEQ ID NO: 625402 - RNA, 22 nt, Human
gcugcccucccagggcaagcuu

SEQ ID NO: 625403 - RNA, 22 nt, Human
ccugcagaggucaggccagaaa

SEQ ID NO: 625404 - RNA, 22 nt, Human
gcucuucuaaagaauguacagg

SEQ ID NO: 625405 - RNA, 22 nt, Human
gcagcuuuaaaggaggcucuga

SEQ ID NO: 625406 - RNA, 22 nt, Human
ugcugccuuucaauguugucau

SEQ ID NO: 625407 - RNA, 22 nt, Human
uccaggcugauccaugaagaau

SEQ ID NO: 625408 - RNA, 22 nt, Human
uauuuugcguugagucagauuu

SEQ ID NO: 625409 - RNA, 22 nt, Human
augcauugcucaacagaauaca

SEQ ID NO: 625410 - RNA, 22 nt, Human
gaagcacagauaauucaaguau

SEQ ID NO: 625411 - RNA, 22 nt, Human
gccagaagacuggagucagcug

SEQ ID NO: 625412 - RNA, 22 nt, Human
ucaucugaccccaucuauucuc

SEQ ID NO: 625413 - RNA, 17 nt, Human
gaacuuuuauuaaauuc

SEQ ID NO: 625414 - RNA, 22 nt, Human
gcugggcugagaaguuaagcaa

SEQ ID NO: 625415 - RNA, 22 nt, Human
cuguaugucuugugaauuguag

SEQ ID NO: 625416 - RNA, 22 nt, Human
cccugccuugggguccacaccg

SEQ ID NO: 625417 - RNA, 22 nt, Human
gacuguggggggcggacacaag

SEQ ID NO: 625418 - RNA, 22 nt, Human
agugcauucugucaucuugguu

SEQ ID NO: 625419 - RNA, 22 nt, Human
uagacaauauuugaaaguagug

SEQ ID NO: 625420 - RNA, 22 nt, Human
ccagcuccgggaguugcugcug

SEQ ID NO: 625421 - RNA, 22 nt, Human
cccacgucgaacuugcuccaga

SEQ ID NO: 625422 - RNA, 22 nt, Human
gcagagugagauaugaacccag

SEQ ID NO: 625423 - RNA, 22 nt, Human
gcugucuggaggcucugaggga

SEQ ID NO: 625424 - RNA, 22 nt, Human
aggaauugguucaagguuuauc

SEQ ID NO: 625425 - RNA, 22 nt, Human
cuguggaaaauuuguauguaau

SEQ ID NO: 625426 - RNA, 22 nt, Human
gucaccaggucugaugcagcca

SEQ ID NO: 625427 - RNA, 22 nt, Human
acaggacaauuuauaaugggca

SEQ ID NO: 625428 - RNA, 22 nt, Human
accagaggaagggaaucucaag

SEQ ID NO: 625429 - RNA, 22 nt, Human
cugaggccucucccacuccagc

SEQ ID NO: 625430 - RNA, 22 nt, Human
uaguauauuaauucucacgguu

SEQ ID NO: 625431 - RNA, 22 nt, Human
aacuucuaaucuguacaguuuu

SEQ ID NO: 625432 - RNA, 22 nt, Human
ccacuugaauuuuagugguuuu

SEQ ID NO: 625433 - RNA, 22 nt, Human
ucuucauguugcuguagggaga

SEQ ID NO: 625434 - RNA, 22 nt, Human
uauuuuaaagugaagggucuug

SEQ ID NO: 625435 - RNA, 22 nt, Human
ccaggcugcucacaagcugccc

SEQ ID NO: 625436 - RNA, 22 nt, Human
ucuguuuagacucaguugaaac

SEQ ID NO: 625437 - RNA, 22 nt, Human
caggaacacaaguucagggaug

SEQ ID NO: 625438 - RNA, 22 nt, Human
caaaagaagcucuuggggcuag

SEQ ID NO: 625439 - RNA, 22 nt, Human
uucugggaggcuggcugucaua

SEQ ID NO: 625440 - RNA, 22 nt, Human
guccuggaauccuagaacagug

SEQ ID NO: 625441 - RNA, 22 nt, Human
aggugaaguugaggaggcagaa

SEQ ID NO: 625442 - RNA, 22 nt, Human
cugcugacaaaauaaaaugcuc

SEQ ID NO: 625443 - RNA, 18 nt, Human
caggcccugucuggccuc

SEQ ID NO: 625444 - RNA, 22 nt, Human
agagcugaauucaagugcuggc

SEQ ID NO: 625445 - RNA, 22 nt, Human
gggcucuguuuagaucagagau

SEQ ID NO: 625446 - RNA, 22 nt, Human
ugccuugcgggcguuucuguug

SEQ ID NO: 625447 - RNA, 22 nt, Human
ucccagagcaguacuccaggag

SEQ ID NO: 625448 - RNA, 22 nt, Human
guuauauucaaaaugaggcugu

SEQ ID NO: 625449 - RNA, 22 nt, Human
caaaggcuuugcuaugaugcau

SEQ ID NO: 625450 - RNA, 22 nt, Human
ggcuagaagucagaggucaaga

SEQ ID NO: 625451 - RNA, 22 nt, Human
aagaguuaagcaacagauacca

SEQ ID NO: 625452 - RNA, 22 nt, Human
aaaggcccacagucagucuacc

SEQ ID NO: 625453 - RNA, 22 nt, Human
auuugcuuaucuccacaguugu

SEQ ID NO: 625454 - RNA, 22 nt, Human
cucagagcccaggguacacccg

SEQ ID NO: 625455 - RNA, 22 nt, Human
ggcugggcaaacaagacucuuc

SEQ ID NO: 625456 - RNA, 22 nt, Human
ugguccuguagcucucuaaguu

SEQ ID NO: 625457 - RNA, 22 nt, Human
aaggcaucuggauggaggagga

SEQ ID NO: 625458 - RNA, 22 nt, Human
caggccugguugagcccugaga

SEQ ID NO: 625459 - RNA, 22 nt, Human
ucaggcuuugcucuguugauuu

SEQ ID NO: 625460 - RNA, 22 nt, Human
cucuccucugaaguggugaccc

SEQ ID NO: 625461 - RNA, 22 nt, Human
cugagaauggacagcagggcag

SEQ ID NO: 625462 - RNA, 19 nt, Human
gcaggccucuugggaauua

SEQ ID NO: 625463 - RNA, 22 nt, Human
ggugggaaggccacugaagguu

SEQ ID NO: 625464 - RNA, 22 nt, Human
ccaggaaggaucguuugggagu

SEQ ID NO: 625465 - RNA, 22 nt, Human
cuuugcaaacugucacacuuuc

SEQ ID NO: 625466 - RNA, 19 nt, Human
gaggcgaggcgugcaggag

SEQ ID NO: 625467 - RNA, 22 nt, Human
acucauugaaacuuaagaucua

SEQ ID NO: 625468 - RNA, 22 nt, Human
ugcauuauuugcaugugccugu

SEQ ID NO: 625469 - RNA, 23 nt, Human
aucaagucaucagcaaaauacau

SEQ ID NO: 625470 - RNA, 22 nt, Human
aggucuggugagagcaggugcu

SEQ ID NO: 625471 - RNA, 22 nt, Human
cccugaggccucagguucauug

SEQ ID NO: 625472 - RNA, 22 nt, Human
agcaaaauaagguaauuuauug

SEQ ID NO: 625473 - RNA, 22 nt, Human
aguccuucuuuuaguugcuugg

SEQ ID NO: 625474 - RNA, 22 nt, Human
aggccugagcagaggaguggac

SEQ ID NO: 625475 - RNA, 22 nt, Human
uggcagagagagugcagucgac

SEQ ID NO: 625476 - RNA, 22 nt, Human
aaaggcacagaagggaaaccaa

SEQ ID NO: 625477 - RNA, 22 nt, Human
ucuggaagacagugagcccgcu

SEQ ID NO: 625478 - RNA, 20 nt, Human
uggggccuguuucugugguu

SEQ ID NO: 625479 - RNA, 22 nt, Human
ugcuuuaaaauggacuguuuug

SEQ ID NO: 625480 - RNA, 22 nt, Human
caaaucaccacuuaauggguua

SEQ ID NO: 625481 - RNA, 22 nt, Human
aguuuucuguucuacaauuuga

SEQ ID NO: 625482 - RNA, 22 nt, Human
ucacaguguggcaacucacaga

SEQ ID NO: 625483 - RNA, 22 nt, Human
ugugcaaucuugagcaauuuau

SEQ ID NO: 625484 - RNA, 20 nt, Human
aagagcugacucacaguggu

SEQ ID NO: 625485 - RNA, 22 nt, Human
uaggaaaaauacagaauuauau

SEQ ID NO: 625486 - RNA, 23 nt, Human
aggauguaggauguauggcagag

SEQ ID NO: 625487 - RNA, 22 nt, Human
ugcccuuggguaacuugcugau

SEQ ID NO: 625488 - RNA, 22 nt, Human
gcugggagacagacuuggaacc

SEQ ID NO: 625489 - RNA, 22 nt, Human
agggcgcugaaauacuaacaug

SEQ ID NO: 625490 - RNA, 22 nt, Human
ugcagaggaccauuguccugga

SEQ ID NO: 625491 - RNA, 22 nt, Human
acucagaguuuuacccagagac

SEQ ID NO: 625492 - RNA, 22 nt, Human
ggcagcuccucucagcaaaaga

SEQ ID NO: 625493 - RNA, 22 nt, Human
auaggagaucaauaugcaauuu

SEQ ID NO: 625494 - RNA, 22 nt, Human
gcagggugauagugaggcucag

SEQ ID NO: 625495 - RNA, 22 nt, Human
aauauucauuugcagaagaagu

SEQ ID NO: 625496 - RNA, 22 nt, Human
auccacagagaggaagaauagu

SEQ ID NO: 625497 - RNA, 22 nt, Human
gucuggaggaggaagaaggcac

SEQ ID NO: 625498 - RNA, 22 nt, Human
cuucuuggacuacucacuagag

SEQ ID NO: 625499 - RNA, 22 nt, Human
ucaauucaguccaacaguaauu

SEQ ID NO: 625500 - RNA, 22 nt, Human
cagccugcauuuguaucuguau

SEQ ID NO: 625501 - RNA, 22 nt, Human
cauuuucagcacccaucugaaa

SEQ ID NO: 625502 - RNA, 22 nt, Human
ucccaggauguuuauggcuggu

SEQ ID NO: 625503 - RNA, 18 nt, Human
agggucagugucacuggc

SEQ ID NO: 625504 - RNA, 22 nt, Human
aucuauacccaucaugauuuaa

SEQ ID NO: 625505 - RNA, 22 nt, Human
augcugugccuggaaagcggcu

SEQ ID NO: 625506 - RNA, 22 nt, Human
ucuaaacaguuucacucuuaau

SEQ ID NO: 625507 - RNA, 22 nt, Human
uuaucugugauccuaaaugucu

SEQ ID NO: 625508 - RNA, 22 nt, Human
aaagcaguauauugguaguugu

SEQ ID NO: 625509 - RNA, 22 nt, Human
gugcccaguccugccuugacag

SEQ ID NO: 625510 - RNA, 22 nt, Human
aagcccuggcucagcucaccag

SEQ ID NO: 625511 - RNA, 22 nt, Human
caaagcucaugcucuuagccau

SEQ ID NO: 625512 - RNA, 22 nt, Human
gaaguuacucucguuaaauaug

SEQ ID NO: 625513 - RNA, 22 nt, Human
uucacaugaaaguaggaaagga

SEQ ID NO: 625514 - RNA, 22 nt, Human
ucaggagaaucagggcuguccu

SEQ ID NO: 625515 - RNA, 22 nt, Human
aggcagccuuuuuggaaacaua

SEQ ID NO: 625516 - RNA, 22 nt, Human
acccuggguauuucccaaacuu

SEQ ID NO: 625517 - RNA, 22 nt, Human
uggaggcaccacuggcugcccg

SEQ ID NO: 625518 - RNA, 23 nt, Human
cccagcgcugagcccugcaggca

SEQ ID NO: 625519 - RNA, 23 nt, Human
gacagggcugacuuggcagcugc

SEQ ID NO: 625520 - RNA, 22 nt, Human
cugagagucaguggaguggugu

SEQ ID NO: 625521 - RNA, 22 nt, Human
cagggccugcaagagaccuggg

SEQ ID NO: 625522 - RNA, 22 nt, Human
guuguacauaugaggauaaguu

SEQ ID NO: 625523 - RNA, 22 nt, Human
agcaugcauuuuuggacugugc

SEQ ID NO: 625524 - RNA, 22 nt, Human
gagggccucugugggugcucac

SEQ ID NO: 625525 - RNA, 22 nt, Human
uccuggcccacuaugccagcau

SEQ ID NO: 625526 - RNA, 22 nt, Human
aauguguuuucacugaagauuc

SEQ ID NO: 625527 - RNA, 22 nt, Human
uauauucauuuuaaagccaucu

SEQ ID NO: 625528 - RNA, 22 nt, Human
aagaauguucaacgcuuuuuug

SEQ ID NO: 625529 - RNA, 23 nt, Human
cccuaacuaauucuagggccuaa

SEQ ID NO: 625530 - RNA, 22 nt, Human
uccugggcccuccggaucaggu

SEQ ID NO: 625531 - RNA, 22 nt, Human
uagcagcacagaaagccuggag

SEQ ID NO: 625532 - RNA, 19 nt, Human
agcugcagaccagaagugc

SEQ ID NO: 625533 - RNA, 22 nt, Human
uaaaguagcaaguuuagacuga

SEQ ID NO: 625534 - RNA, 21 nt, Human
cccagagccuagggagggcac

SEQ ID NO: 625535 - RNA, 22 nt, Human
uuguaugcugaugacaccaccu

SEQ ID NO: 625536 - RNA, 22 nt, Human
gccuuugccugcgacguggcug

SEQ ID NO: 625537 - RNA, 22 nt, Human
cuguuuucccuggaguucagca

SEQ ID NO: 625538 - RNA, 22 nt, Human
uggcugugauuugcacgagaug

SEQ ID NO: 625539 - RNA, 22 nt, Human
gauuauggagaagaacaaugaa

SEQ ID NO: 625540 - RNA, 19 nt, Human
ugugauaagcagaauucca

SEQ ID NO: 625541 - RNA, 22 nt, Human
uaaaguuuauuugaacaucucu

SEQ ID NO: 625542 - RNA, 22 nt, Human
uggagcugucacucagaaccaa

SEQ ID NO: 625543 - RNA, 22 nt, Human
uucucuuucugcugggcuggaa

SEQ ID NO: 625544 - RNA, 22 nt, Human
gggagcugagcucugagccacg

SEQ ID NO: 625545 - RNA, 22 nt, Human
uguuacacagcagaauagcaag

SEQ ID NO: 625546 - RNA, 22 nt, Human
uggugcagauagugguguagua

SEQ ID NO: 625547 - RNA, 22 nt, Human
agggagaggagggucuuguuga

SEQ ID NO: 625548 - RNA, 22 nt, Human
caauguguuugcauauuaaaau

SEQ ID NO: 625549 - RNA, 22 nt, Human
uuucacagauguuuuggagucu

SEQ ID NO: 625550 - RNA, 22 nt, Human
auugaaaaauucacaauucugg

SEQ ID NO: 625551 - RNA, 22 nt, Human
gaggcugugugucccucuggac

SEQ ID NO: 625552 - RNA, 22 nt, Human
augucauuuaaauguuuguaua

SEQ ID NO: 625553 - RNA, 22 nt, Human
acauucuagaagucuuugcaau

SEQ ID NO: 625554 - RNA, 22 nt, Human
ccuuuggugguuuucagagauc

SEQ ID NO: 625555 - RNA, 22 nt, Human
aaaauucauagaacuguacgcu

SEQ ID NO: 625556 - RNA, 22 nt, Human
uucuuucccaguagaugugaaa

SEQ ID NO: 625557 - RNA, 22 nt, Human
ccucauuaacacaaugucauuu

SEQ ID NO: 625558 - RNA, 22 nt, Human
gcuggagaacccaggaggaaga

SEQ ID NO: 625559 - RNA, 20 nt, Human
cagugaggaggugcuggggg

SEQ ID NO: 625560 - RNA, 22 nt, Human
agaagcuggaggaagacuaagc

SEQ ID NO: 625561 - RNA, 22 nt, Human
uuggaaggcagcauuuguccau

SEQ ID NO: 625562 - RNA, 22 nt, Human
acacugagcugagcauucuugu

SEQ ID NO: 625563 - RNA, 23 nt, Human
ccagggccccuacaccacugucc

SEQ ID NO: 625564 - RNA, 22 nt, Human
aggcugcagugcagguaggauu

SEQ ID NO: 625565 - RNA, 22 nt, Human
agcucaggcaacucugggcccc

SEQ ID NO: 625566 - RNA, 22 nt, Human
gagcugaggugauguggucguu

SEQ ID NO: 625567 - RNA, 22 nt, Human
agagaauuaauuaggagcacug

SEQ ID NO: 625568 - RNA, 22 nt, Human
aaaugacacuaggcuuuuugca

SEQ ID NO: 625569 - RNA, 22 nt, Human
guuuguguaacaugaugaugau

SEQ ID NO: 625570 - RNA, 22 nt, Human
aucuccaggcauuucaagagac

SEQ ID NO: 625571 - RNA, 22 nt, Human
uggccucagauuauugcacagu

SEQ ID NO: 625572 - RNA, 22 nt, Human
acugggaaucucaggaacaugg

SEQ ID NO: 625573 - RNA, 22 nt, Human
acaguuuauaaaaauaaugagg

SEQ ID NO: 625574 - RNA, 22 nt, Human
ucacacacauaaucuaagauua

SEQ ID NO: 625575 - RNA, 22 nt, Human
ugcaauuaauuuacaugcuuaa

SEQ ID NO: 625576 - RNA, 19 nt, Human
ugguggaggccccauguuc

SEQ ID NO: 625577 - RNA, 22 nt, Human
uagagcaguuggcagcuguauu

SEQ ID NO: 625578 - RNA, 22 nt, Human
uccuggauuaauagggagcugu

SEQ ID NO: 625579 - RNA, 22 nt, Human
ugcuaauguccugaccguucug

SEQ ID NO: 625580 - RNA, 22 nt, Human
gagcaccugcuaaaugacaguu

SEQ ID NO: 625581 - RNA, 22 nt, Human
guugcaggaggauggcugcaua

SEQ ID NO: 625582 - RNA, 22 nt, Human
gccaagcuuggaaggaucaugg

SEQ ID NO: 625583 - RNA, 22 nt, Human
cacaguccugccagagggccuu

SEQ ID NO: 625584 - RNA, 22 nt, Human
guggcugggcuccgagcggcuu

SEQ ID NO: 625585 - RNA, 21 nt, Human
aaagagguuaauauuguaagu

SEQ ID NO: 625586 - RNA, 20 nt, Human
uuuggagagaaagaaguagu

SEQ ID NO: 625587 - RNA, 22 nt, Human
ugacaggcuugcuaagacauag

SEQ ID NO: 625588 - RNA, 22 nt, Human
gcuggaccaggugugcacaggc

SEQ ID NO: 625589 - RNA, 22 nt, Human
cagcaggcaggugggccaaguc

SEQ ID NO: 625590 - RNA, 19 nt, Human
ucacaggcaucuccccaga

SEQ ID NO: 625591 - RNA, 22 nt, Human
gcugccucuguagcuuuggacc

SEQ ID NO: 625592 - RNA, 22 nt, Human
aggucaggaggccucugccauu

SEQ ID NO: 625593 - RNA, 22 nt, Human
uugcagcagcucuuugaauguu

SEQ ID NO: 625594 - RNA, 22 nt, Human
acacaugauuaaugccaagcau

SEQ ID NO: 625595 - RNA, 22 nt, Human
cggcuggggcuguccccaugac

SEQ ID NO: 625596 - RNA, 22 nt, Human
gugccugggacacagcagauac

SEQ ID NO: 625597 - RNA, 22 nt, Human
gguaacaaggccgauagaaaca

SEQ ID NO: 625598 - RNA, 22 nt, Human
ugcuuuauggauuuguguccug

SEQ ID NO: 625599 - RNA, 22 nt, Human
ugggaggagcccucugggaagg

SEQ ID NO: 625600 - RNA, 22 nt, Human
uuccugguaguaagacaucugg

SEQ ID NO: 625601 - RNA, 22 nt, Human
ugcugccaagcccgugcuccug

SEQ ID NO: 625602 - RNA, 22 nt, Human
cugcucuggcguacucggcauc

SEQ ID NO: 625603 - RNA, 22 nt, Human
uacagaggaggugguugggagu

SEQ ID NO: 625604 - RNA, 22 nt, Human
uauuuucaccauguaucccugu

SEQ ID NO: 625605 - RNA, 22 nt, Human
acaggggaauuuacugucauua

SEQ ID NO: 625606 - RNA, 22 nt, Human
gccaccagggggcuccagugag

SEQ ID NO: 625607 - RNA, 22 nt, Human
auugucuuuaaccucugagggg

SEQ ID NO: 625608 - RNA, 22 nt, Human
aacauguugaguugaaaguagc

SEQ ID NO: 625609 - RNA, 21 nt, Human
ugagcccuugccucagagccc

SEQ ID NO: 625610 - RNA, 21 nt, Human
aguauguguuagggauaauuu

SEQ ID NO: 625611 - RNA, 22 nt, Human
auuuccuaacagaggcaacagu

SEQ ID NO: 625612 - RNA, 22 nt, Human
guccacauaggaacccagcuuc

SEQ ID NO: 625613 - RNA, 22 nt, Human
gucuuucuaugaugaacuguug

SEQ ID NO: 625614 - RNA, 22 nt, Human
cugaaacuuuaguucugcaaca

SEQ ID NO: 625615 - RNA, 22 nt, Human
gaugaugggauccagcaaugua

SEQ ID NO: 625616 - RNA, 22 nt, Human
acugagagcguguacaaacuua

SEQ ID NO: 625617 - RNA, 22 nt, Human
accuuuccaaguaucagguggu

SEQ ID NO: 625618 - RNA, 22 nt, Human
ucuguuugcuggugcauggguu

SEQ ID NO: 625619 - RNA, 22 nt, Human
ccugggcaacauagugagaccu

SEQ ID NO: 625620 - RNA, 22 nt, Human
ucuuuguaagacauguaagucc

SEQ ID NO: 625621 - RNA, 22 nt, Human
aggcuucagggcuuuugagggu

SEQ ID NO: 625622 - RNA, 22 nt, Human
agauguggaacacuagacugcu

SEQ ID NO: 625623 - RNA, 22 nt, Human
uccagccugguugcgggcaucc

SEQ ID NO: 625624 - RNA, 23 nt, Human
gagaaaccucgguaagcaggagg

SEQ ID NO: 625625 - RNA, 22 nt, Human
ucugggaaccaaagggugcuua

SEQ ID NO: 625626 - RNA, 22 nt, Human
cccaugcugaguggccugagau

SEQ ID NO: 625627 - RNA, 22 nt, Human
caggccacagcuaaagaggauu

SEQ ID NO: 625628 - RNA, 22 nt, Human
cacaguuuugucuugguuucca

SEQ ID NO: 625629 - RNA, 22 nt, Human
ugugucucuuuguccuagagcu

SEQ ID NO: 625630 - RNA, 22 nt, Human
aaaauacacauacuaggggaaa

SEQ ID NO: 625631 - RNA, 22 nt, Human
uugauaaaaugauaucuucuuu

SEQ ID NO: 625632 - RNA, 22 nt, Human
agcauuaagccuggcucagagg

SEQ ID NO: 625633 - RNA, 22 nt, Human
aaggguccaaggcuuugcguuu

SEQ ID NO: 625634 - RNA, 22 nt, Human
aagaugcuuccacugcaguggc

SEQ ID NO: 625635 - RNA, 18 nt, Human
uggagcagguaggcauga

SEQ ID NO: 625636 - RNA, 18 nt, Human
auggucucauacugggag

SEQ ID NO: 625637 - RNA, 22 nt, Human
ugacuuugucccuuucaaaucc

SEQ ID NO: 625638 - RNA, 22 nt, Human
ugggagagaauucuggugacug

SEQ ID NO: 625639 - RNA, 22 nt, Human
gucaaguuaagauaaggucaug

SEQ ID NO: 625640 - RNA, 22 nt, Human
guuaguagcauuucaugacaug

SEQ ID NO: 625641 - RNA, 22 nt, Human
gagccugaauuugaccugcuua

SEQ ID NO: 625642 - RNA, 22 nt, Human
cauuuacuuaaaucuuuacaag

SEQ ID NO: 625643 - RNA, 22 nt, Human
ugaaaaggagccuuagguaggu

SEQ ID NO: 625644 - RNA, 22 nt, Human
ucugugagaaccagugccaggg

SEQ ID NO: 625645 - RNA, 22 nt, Human
cacaucccuggaguuacccagu

SEQ ID NO: 625646 - RNA, 22 nt, Human
agucagagugugcaggccggcu

SEQ ID NO: 625647 - RNA, 20 nt, Human
uguuaaaggacacuugcuuu

SEQ ID NO: 625648 - RNA, 19 nt, Human
ggcuucagggaguuagcau

SEQ ID NO: 625649 - RNA, 22 nt, Human
gagcaucucuauagugacugug

SEQ ID NO: 625650 - RNA, 22 nt, Human
gugcuuccugccuggugccuuu

SEQ ID NO: 625651 - RNA, 22 nt, Human
gaauuuuucuggaagcaauuau

SEQ ID NO: 625652 - RNA, 22 nt, Human
uccaguucuaggucacucucug

SEQ ID NO: 625653 - RNA, 22 nt, Human
ugauuucaguaaugaggaugaa

SEQ ID NO: 625654 - RNA, 22 nt, Human
uagucaaaccucagaauacccc

SEQ ID NO: 625655 - RNA, 22 nt, Human
acucccagaacaugcucuucuu

SEQ ID NO: 625656 - RNA, 22 nt, Human
gucacccugcuguuuguccauu

SEQ ID NO: 625657 - RNA, 22 nt, Human
uggucgaccaguuggaaaguaa

SEQ ID NO: 625658 - RNA, 22 nt, Human
ucuguaaauccugcucagcaac

SEQ ID NO: 625659 - RNA, 22 nt, Human
ucuugaggucaucaucugaaac

SEQ ID NO: 625660 - RNA, 21 nt, Human
uuuuauugaugaauggccacu

SEQ ID NO: 625661 - RNA, 22 nt, Human
ggggaagaccuggcacuacagc

SEQ ID NO: 625662 - RNA, 22 nt, Human
ugugccaggcacuugcccaggc

SEQ ID NO: 625663 - RNA, 22 nt, Human
gcugccugggcaggaggcgcug

SEQ ID NO: 625664 - RNA, 22 nt, Human
cauggcacugagcagguaugca

SEQ ID NO: 625665 - RNA, 22 nt, Human
ugugaaauugagaaacuuucac

SEQ ID NO: 625666 - RNA, 22 nt, Human
ucaaaguccuugcuuuuucugu

SEQ ID NO: 625667 - RNA, 20 nt, Human
ucaugcagguguucuagguu

SEQ ID NO: 625668 - RNA, 22 nt, Human
aggcauucuagaaguagaagua

SEQ ID NO: 625669 - RNA, 22 nt, Human
uacuucugccuuagagaacacu

SEQ ID NO: 625670 - RNA, 22 nt, Human
aggacacacugcaagagccugg

SEQ ID NO: 625671 - RNA, 22 nt, Human
ucuuugaauccuuuacaucuga

SEQ ID NO: 625672 - RNA, 22 nt, Human
ggggacucugcuucugggauca

SEQ ID NO: 625673 - RNA, 22 nt, Human
auccaggguguggagagagcuc

SEQ ID NO: 625674 - RNA, 22 nt, Human
uucucugacccccuuaaauauu

SEQ ID NO: 625675 - RNA, 22 nt, Human
cuuauuuguacuaauaaaucug

SEQ ID NO: 625676 - RNA, 22 nt, Human
aaucaauguuagucaugaauuu

SEQ ID NO: 625677 - RNA, 20 nt, Human
ugaugcuggucugaauugca

SEQ ID NO: 625678 - RNA, 22 nt, Human
uagcuguguagacacucagagc

SEQ ID NO: 625679 - RNA, 18 nt, Human
uuuguccuguggcagcug

SEQ ID NO: 625680 - RNA, 22 nt, Human
agacucugauaagcaacucuug

SEQ ID NO: 625681 - RNA, 22 nt, Human
aggcucucuagaaacugugccu

SEQ ID NO: 625682 - RNA, 22 nt, Human
agcugccugcugcacucggugc

SEQ ID NO: 625683 - RNA, 22 nt, Human
gagcaucuccuaccuacuccuu

SEQ ID NO: 625684 - RNA, 22 nt, Human
augcaacaaauugugugcaaua

SEQ ID NO: 625685 - RNA, 22 nt, Human
gccuaggaguggggauggcggu

SEQ ID NO: 625686 - RNA, 18 nt, Human
ugucuuuggaccacugaa

SEQ ID NO: 625687 - RNA, 22 nt, Human
agaguaauuucugcugaaaagg

SEQ ID NO: 625688 - RNA, 20 nt, Human
ggacagugagacauaucuca

SEQ ID NO: 625689 - RNA, 22 nt, Human
ccagucuccuaagagccccuga

SEQ ID NO: 625690 - RNA, 22 nt, Human
cauagccaucuuuagcuuccag

SEQ ID NO: 625691 - RNA, 17 nt, Human
ccagcccucgcgcuuuu

SEQ ID NO: 625692 - RNA, 22 nt, Human
caggcagcucgaugccuuguug

SEQ ID NO: 625693 - RNA, 22 nt, Human
ugagacagcagauuagcaauga

SEQ ID NO: 625694 - RNA, 22 nt, Human
aggagacucagagaccuggccg

SEQ ID NO: 625695 - RNA, 23 nt, Human
uugagcucaguagcucugcuggu

SEQ ID NO: 625696 - RNA, 22 nt, Human
uaugaagcucucacuguguguc

SEQ ID NO: 625697 - RNA, 22 nt, Human
ccaggaguuggagguugcagug

SEQ ID NO: 625698 - RNA, 22 nt, Human
auacauacguacauacguaugu

SEQ ID NO: 625699 - RNA, 22 nt, Human
gaugcuuacauagcccaagugu

SEQ ID NO: 625700 - RNA, 22 nt, Human
uuugguauugcacacugucuuc

SEQ ID NO: 625701 - RNA, 16 nt, Human
cuguggcucccagguu

SEQ ID NO: 625702 - RNA, 20 nt, Human
uugaggucaaggacuaggcc

SEQ ID NO: 625703 - RNA, 22 nt, Human
gggcaccuggcuagugacagug

SEQ ID NO: 625704 - RNA, 22 nt, Human
cugggacaguucagguagggca

SEQ ID NO: 625705 - RNA, 22 nt, Human
ucacccccuguauuaguagcua

SEQ ID NO: 625706 - RNA, 22 nt, Human
cuuucagagguuacucaggaaa

SEQ ID NO: 625707 - RNA, 22 nt, Human
aagaauuaucugaaagcugugu

SEQ ID NO: 625708 - RNA, 22 nt, Human
uugggcacggacagguggggau

SEQ ID NO: 625709 - RNA, 20 nt, Human
gcaggcuccgggcuugggag

SEQ ID NO: 625710 - RNA, 23 nt, Human
ucuccuccuagauacagucaugg

SEQ ID NO: 625711 - RNA, 22 nt, Human
ucaggcagguuggcugcagguc

SEQ ID NO: 625712 - RNA, 19 nt, Human
augucccaccgccccugag

SEQ ID NO: 625713 - RNA, 22 nt, Human
uggguggcagcuucagcauguu

SEQ ID NO: 625714 - RNA, 22 nt, Human
uccucuggcucuuucccuagga

SEQ ID NO: 625715 - RNA, 23 nt, Human
uugcugccugagccuuccucugg

SEQ ID NO: 625716 - RNA, 22 nt, Human
ugaagcacauuucuugagauga

SEQ ID NO: 625717 - RNA, 22 nt, Human
acacauaagaaacuacaaagag

SEQ ID NO: 625718 - RNA, 22 nt, Human
cacagugugacugaccuucagc

SEQ ID NO: 625719 - RNA, 22 nt, Human
gggcauggaggucugucugcag

SEQ ID NO: 625720 - RNA, 22 nt, Human
aauccugaggcaaagagaugag

SEQ ID NO: 625721 - RNA, 22 nt, Human
uucugaggccauuaccaauaaa

SEQ ID NO: 625722 - RNA, 22 nt, Human
ggagaugcaauguagaaucugg

SEQ ID NO: 625723 - RNA, 22 nt, Human
agugucugaagccucagcccga

SEQ ID NO: 625724 - RNA, 22 nt, Human
cccugccccaggcggcuucacu

SEQ ID NO: 625725 - RNA, 21 nt, Human
uguuuaauacauauuugugga

SEQ ID NO: 625726 - RNA, 19 nt, Human
guuuuguuugcagaacuua

SEQ ID NO: 625727 - RNA, 22 nt, Human
ucuccucccaggcucuuccagg

SEQ ID NO: 625728 - RNA, 22 nt, Human
uucaggauuguguuuuuccuga

SEQ ID NO: 625729 - RNA, 22 nt, Human
uccaggaggaggaaggcugcca

SEQ ID NO: 625730 - RNA, 22 nt, Human
ugcuggugauuaaauccugaag

SEQ ID NO: 625731 - RNA, 22 nt, Human
cuaaaugacagguaccauagug

SEQ ID NO: 625732 - RNA, 22 nt, Human
uaaggcauaaggccagaggcua

SEQ ID NO: 625733 - RNA, 22 nt, Human
uucuuugggauuguagcugucu

SEQ ID NO: 625734 - RNA, 22 nt, Human
aaugcacaaaggugucuauugc

SEQ ID NO: 625735 - RNA, 22 nt, Human
ucaggcugugggcacuggccau

SEQ ID NO: 625736 - RNA, 20 nt, Human
aaaaacaguaaugcugaaga

SEQ ID NO: 625737 - RNA, 22 nt, Human
uuuguaaaagcccaagcuguag

SEQ ID NO: 625738 - RNA, 23 nt, Human
cuugaaugggauggaauucacug

SEQ ID NO: 625739 - RNA, 22 nt, Human
caagaucaagguaucagcagau

SEQ ID NO: 625740 - RNA, 22 nt, Human
caagaucaaggugucagcaggu

SEQ ID NO: 625741 - RNA, 22 nt, Human
uagcagcauuaauuccauuugc

SEQ ID NO: 625742 - RNA, 22 nt, Human
ccuggcucaggcacgcauggcu

SEQ ID NO: 625743 - RNA, 22 nt, Human
agguuucuucuuaggaauaugu

SEQ ID NO: 625744 - RNA, 22 nt, Human
auguugggaaggccgcaggcac

SEQ ID NO: 625745 - RNA, 22 nt, Human
acucuccuuuugaucuucagaa

SEQ ID NO: 625746 - RNA, 22 nt, Human
uucaacaugcuuuauuucuaaa

SEQ ID NO: 625747 - RNA, 22 nt, Human
uaaguauuggccuauagcuaga

SEQ ID NO: 625748 - RNA, 22 nt, Human
auccacagucuuagccaucaaa

SEQ ID NO: 625749 - RNA, 22 nt, Human
ucuacagguggggccuggcaau

SEQ ID NO: 625750 - RNA, 22 nt, Human
uccaagcuguauguuccuagag

SEQ ID NO: 625751 - RNA, 22 nt, Human
agcagcagggcucugcccgugc

SEQ ID NO: 625752 - RNA, 22 nt, Human
ccaugcuggagucccuagcugu

SEQ ID NO: 625753 - RNA, 22 nt, Human
ggacaaagccugguggcaggug

SEQ ID NO: 625754 - RNA, 22 nt, Human
uaggaaauggcucaguuacugc

SEQ ID NO: 625755 - RNA, 22 nt, Human
aaacugcugggcauauauuucu

SEQ ID NO: 625756 - RNA, 18 nt, Human
cacaauagacaccgauaa

SEQ ID NO: 625757 - RNA, 22 nt, Human
gcauugucaaaagugguaugac

SEQ ID NO: 625758 - RNA, 22 nt, Human
ugaugagggagauuugagccca

SEQ ID NO: 625759 - RNA, 22 nt, Human
auucaguucugcugguucugcu

SEQ ID NO: 625760 - RNA, 22 nt, Human
gcucagaggagcaucauaagga

SEQ ID NO: 625761 - RNA, 21 nt, Human
ucagcagaaagcaaggucagu

SEQ ID NO: 625762 - RNA, 22 nt, Human
uccugcaggggcugaggaacca

SEQ ID NO: 625763 - RNA, 22 nt, Human
cccccugcgcccggcacgucau

SEQ ID NO: 625764 - RNA, 22 nt, Human
gcuggcuguuggagguaccugc

SEQ ID NO: 625765 - RNA, 22 nt, Human
gcugggaaccaugggaaggcag

SEQ ID NO: 625766 - RNA, 22 nt, Human
auuugugauaauuuguuacagc

SEQ ID NO: 625767 - RNA, 22 nt, Human
gagaugagugggggaucucuca

SEQ ID NO: 625768 - RNA, 19 nt, Human
ccauccauggggccagagg

SEQ ID NO: 625769 - RNA, 23 nt, Human
aaguagauaacacuguucugaga

SEQ ID NO: 625770 - RNA, 22 nt, Human
ucugccuuuucacugccacuaa

SEQ ID NO: 625771 - RNA, 22 nt, Human
ccucaggcuucuaguucaguga

SEQ ID NO: 625772 - RNA, 22 nt, Human
cucucuggaauuaaagcccaau

SEQ ID NO: 625773 - RNA, 22 nt, Human
cauuugauuacuaaagauaauu

SEQ ID NO: 625774 - RNA, 23 nt, Human
cacaacuaaucagaaucucuagg

SEQ ID NO: 625775 - RNA, 22 nt, Human
agggcucagaaaugucuacggg

SEQ ID NO: 625776 - RNA, 22 nt, Human
uggucugacuacaauaggaaga

SEQ ID NO: 625777 - RNA, 19 nt, Human
cacauacagaaaagaguaa

SEQ ID NO: 625778 - RNA, 22 nt, Human
aaauaguuagcccugcauauau

SEQ ID NO: 625779 - RNA, 22 nt, Human
gggagcuggccuacuauuagau

SEQ ID NO: 625780 - RNA, 22 nt, Human
agggcaugugggagaggagccu

SEQ ID NO: 625781 - RNA, 22 nt, Human
ggagcagaugucuucauggccu

SEQ ID NO: 625782 - RNA, 22 nt, Human
uaggaaaacgugauuuucucac

SEQ ID NO: 625783 - RNA, 22 nt, Human
accagguggccccagcgugguu

SEQ ID NO: 625784 - RNA, 22 nt, Human
ugaacacgcuucauacagaggg

SEQ ID NO: 625785 - RNA, 22 nt, Human
cuguuugugauuagcagugggu

SEQ ID NO: 625786 - RNA, 18 nt, Human
aggucugaggaagagccu

SEQ ID NO: 625787 - RNA, 20 nt, Human
uacuuugaucugauaagcaa

SEQ ID NO: 625788 - RNA, 22 nt, Human
auggcuuugaaguucagcuuuu

SEQ ID NO: 625789 - RNA, 22 nt, Human
cugacugugagagcaggaaugg

SEQ ID NO: 625790 - RNA, 22 nt, Human
ggcuggaccaugcugccccuuc

SEQ ID NO: 625791 - RNA, 22 nt, Human
agguggggaaaccagcgauccc

SEQ ID NO: 625792 - RNA, 22 nt, Human
uaacuacaagggcggucucugu

SEQ ID NO: 625793 - RNA, 22 nt, Human
guggcagcaaaauccugcauuc

SEQ ID NO: 625794 - RNA, 22 nt, Human
ggugaggggcuccucugcccgg

SEQ ID NO: 625795 - RNA, 22 nt, Human
cagaugcuaaguuaucagcagg

SEQ ID NO: 625796 - RNA, 22 nt, Human
ucauuuaauagcuuuugucuuu

SEQ ID NO: 625797 - RNA, 22 nt, Human
uuccuggggcuuagcaauggag

SEQ ID NO: 625798 - RNA, 20 nt, Human
agcccuguaaauccccugga

SEQ ID NO: 625799 - RNA, 20 nt, Human
ucauuucuugggguuccaag

SEQ ID NO: 625800 - RNA, 22 nt, Human
gcuggcagcauuagacccuggg

SEQ ID NO: 625801 - RNA, 22 nt, Human
uaaucucuagcccaugcaaaga

SEQ ID NO: 625802 - RNA, 22 nt, Human
ccucuggcuguaccacuggcac

SEQ ID NO: 625803 - RNA, 22 nt, Human
uagcaaaaacugcaguuacuuu

SEQ ID NO: 625804 - RNA, 22 nt, Human
agccucucuuaucccuucaaag

SEQ ID NO: 625805 - RNA, 22 nt, Human
acugugcauuccccaaccugug

SEQ ID NO: 625806 - RNA, 22 nt, Human
uuaguuagggcuccugaggacc

SEQ ID NO: 625807 - RNA, 22 nt, Human
acagugcugaucuagacugacc

SEQ ID NO: 625808 - RNA, 22 nt, Human
cagccccucacagagcuguccu

SEQ ID NO: 625809 - RNA, 22 nt, Human
uguuugcauuaauuagaaggua

SEQ ID NO: 625810 - RNA, 22 nt, Human
guggcagugaaggucauagcau

SEQ ID NO: 625811 - RNA, 22 nt, Human
cccagcuguaacgggucugcac

SEQ ID NO: 625812 - RNA, 22 nt, Human
uuccucagacccucauugugag

SEQ ID NO: 625813 - RNA, 22 nt, Human
cucucagaaguuuaugucagaa

SEQ ID NO: 625814 - RNA, 22 nt, Human
gcuguuucugaguagcuaggcu

SEQ ID NO: 625815 - RNA, 22 nt, Human
cugcaguugggugacccaauau

SEQ ID NO: 625816 - RNA, 22 nt, Human
ugaggguggccuuguguggacu

SEQ ID NO: 625817 - RNA, 22 nt, Human
ggagaaaauugaugaaguuggc

SEQ ID NO: 625818 - RNA, 22 nt, Human
agcaggugucggcgagggucuu

SEQ ID NO: 625819 - RNA, 22 nt, Human
ccacuggcaaccccgccucaua

SEQ ID NO: 625820 - RNA, 22 nt, Human
aggaggagguaagaaaagcaua

SEQ ID NO: 625821 - RNA, 22 nt, Human
gacacagcacuguacaaggaau

SEQ ID NO: 625822 - RNA, 22 nt, Human
uacaacauuuacguuaggcugu

SEQ ID NO: 625823 - RNA, 22 nt, Human
acaguguguuggaggagacugu

SEQ ID NO: 625824 - RNA, 22 nt, Human
acagccagggucucaggaggcg

SEQ ID NO: 625825 - RNA, 22 nt, Human
ucucuggccccauggcugagcu

SEQ ID NO: 625826 - RNA, 22 nt, Human
ggccagaaguuggaaaagagcc

SEQ ID NO: 625827 - RNA, 22 nt, Human
gagccagauuuuaugcaagaca

SEQ ID NO: 625828 - RNA, 22 nt, Human
aaguuguuguugagguggguaa

SEQ ID NO: 625829 - RNA, 22 nt, Human
uuucucuguucucuaacuguaa

SEQ ID NO: 625830 - RNA, 21 nt, Human
agggacacacaggauggggcu

SEQ ID NO: 625831 - RNA, 20 nt, Human
ucccuggggcccuacuuccu

SEQ ID NO: 625832 - RNA, 22 nt, Human
ccuuuacaaaguucuucauggg

SEQ ID NO: 625833 - RNA, 22 nt, Human
cugggcucagcccaugcugucc

SEQ ID NO: 625834 - RNA, 21 nt, Human
ggguccugggaugggauccag

SEQ ID NO: 625835 - RNA, 22 nt, Human
uccugcagccauuagaggucaa

SEQ ID NO: 625836 - RNA, 22 nt, Human
cuggcuuuaccucacuggggcu

SEQ ID NO: 625837 - RNA, 22 nt, Human
uaaccauauuuuccauuaaguu

SEQ ID NO: 625838 - RNA, 22 nt, Human
cugcccacuuggccaccuucua

SEQ ID NO: 625839 - RNA, 22 nt, Human
guggcuucuucuugggagcugc

SEQ ID NO: 625840 - RNA, 22 nt, Human
cugcccugggugcuggggaucc

SEQ ID NO: 625841 - RNA, 22 nt, Human
ggcagcaacgaggcuugauacc

SEQ ID NO: 625842 - RNA, 22 nt, Human
aaacauucacauuugcuaguaa

SEQ ID NO: 625843 - RNA, 20 nt, Human
gagauggcuaagugcugaac

SEQ ID NO: 625844 - RNA, 19 nt, Human
agugcagggagcacccuca

SEQ ID NO: 625845 - RNA, 22 nt, Human
auugguuaccacuuuaaaucuu

SEQ ID NO: 625846 - RNA, 22 nt, Human
cccaggagaccuagaucuguuu

SEQ ID NO: 625847 - RNA, 22 nt, Human
cucccucucaccggagcccugg

SEQ ID NO: 625848 - RNA, 18 nt, Human
gaucgggggcgccccaag

SEQ ID NO: 625849 - RNA, 22 nt, Human
agggcccaggacagcaucaggg

SEQ ID NO: 625850 - RNA, 22 nt, Human
cugagcagcaauugcuggccca

SEQ ID NO: 625851 - RNA, 22 nt, Human
ggagcugcuccuucagccaagu

SEQ ID NO: 625852 - RNA, 22 nt, Human
cagcccucagguccucagcagc

SEQ ID NO: 625853 - RNA, 22 nt, Human
gaggcccuccagcugucagcug

SEQ ID NO: 625854 - RNA, 22 nt, Human
gucucaguaagaaaggcuccug

SEQ ID NO: 625855 - RNA, 22 nt, Human
cuaacuuuauuugcuaaguaga

SEQ ID NO: 625856 - RNA, 22 nt, Human
cuuguuaaauuauauaagcaga

SEQ ID NO: 625857 - RNA, 22 nt, Human
uaugucugaaucuuauuuaaau

SEQ ID NO: 625858 - RNA, 22 nt, Human
aacaaugucucauccuaugugg

SEQ ID NO: 625859 - RNA, 22 nt, Human
acaaugugauaauuuaaagaua

SEQ ID NO: 625860 - RNA, 23 nt, Human
ucacacagcuggucagguacaga

SEQ ID NO: 625861 - RNA, 22 nt, Human
guggcagccgcaggcccugugu

SEQ ID NO: 625862 - RNA, 22 nt, Human
gccaggggacgcggagcgacga

SEQ ID NO: 625863 - RNA, 20 nt, Human
ggcuggaaguguggguuugg

SEQ ID NO: 625864 - RNA, 22 nt, Human
gccaggacggugaaugggcuac

SEQ ID NO: 625865 - RNA, 22 nt, Human
uggcugcagaaccuccucagga

SEQ ID NO: 625866 - RNA, 22 nt, Human
ucagauuuuauuuuccuguuac

SEQ ID NO: 625867 - RNA, 22 nt, Human
ucucagagaacaguuggugcuu

SEQ ID NO: 625868 - RNA, 19 nt, Human
ccugaccacacaggccuug

SEQ ID NO: 625869 - RNA, 22 nt, Human
auuaaauguuccuuaaauuaua

SEQ ID NO: 625870 - RNA, 22 nt, Human
caguuuaaagaaggaugggagu

SEQ ID NO: 625871 - RNA, 22 nt, Human
uuccauaaucaccuuauucuuu

SEQ ID NO: 625872 - RNA, 22 nt, Human
aaacuuuugguccucauggguu

SEQ ID NO: 625873 - RNA, 22 nt, Human
uuggcagugaugcagcuuguuc

SEQ ID NO: 625874 - RNA, 23 nt, Human
gaggagggucgugcuguguuccu

SEQ ID NO: 625875 - RNA, 22 nt, Human
ccagcuguuucugaugcuaggc

SEQ ID NO: 625876 - RNA, 19 nt, Human
ggaggccuggguauuugcc

SEQ ID NO: 625877 - RNA, 22 nt, Human
ugcccaggcuggaaugcagugg

SEQ ID NO: 625878 - RNA, 22 nt, Human
uucuuaaucccacaaaucuuca

SEQ ID NO: 625879 - RNA, 22 nt, Human
cccagcucgccgccgaugugcg

SEQ ID NO: 625880 - RNA, 22 nt, Human
cacacaaauauucuggaggcaa

SEQ ID NO: 625881 - RNA, 19 nt, Human
gcauaaauacacuauuguc

SEQ ID NO: 625882 - RNA, 22 nt, Human
accucagcuauuucaaaacaga

SEQ ID NO: 625883 - RNA, 22 nt, Human
acagacuguuggccuacugagc

SEQ ID NO: 625884 - RNA, 22 nt, Human
ucacucuuuaucuuuuaugucu

SEQ ID NO: 625885 - RNA, 22 nt, Human
auuccagaugcuuguauuuaaa

SEQ ID NO: 625886 - RNA, 21 nt, Human
ggcugguguuuagcugugaua

SEQ ID NO: 625887 - RNA, 22 nt, Human
acaggccugagauuuugcauuu

SEQ ID NO: 625888 - RNA, 23 nt, Human
ugucuggagccugagcaggugcu

SEQ ID NO: 625889 - RNA, 22 nt, Human
aucucaaacaucuuugaccaua

SEQ ID NO: 625890 - RNA, 22 nt, Human
cugagcuuaacccuguuagcaa

SEQ ID NO: 625891 - RNA, 22 nt, Human
cuccagucuaguagagccugcu

SEQ ID NO: 625892 - RNA, 22 nt, Human
ugcaguguuuuucagggcauau

SEQ ID NO: 625893 - RNA, 23 nt, Human
gaggucaaggcugcagugauugc

SEQ ID NO: 625894 - RNA, 22 nt, Human
ucugagaacaugcuuugaucau

SEQ ID NO: 625895 - RNA, 21 nt, Human
agcaagcagaauccaucuaga

SEQ ID NO: 625896 - RNA, 22 nt, Human
uaugcaaaguccuaagaaagaa

SEQ ID NO: 625897 - RNA, 22 nt, Human
cccagagagcauuuggacaaag

SEQ ID NO: 625898 - RNA, 22 nt, Human
auuauucauugguaggcaagcu

SEQ ID NO: 625899 - RNA, 18 nt, Human
uccagagagggagaagug

SEQ ID NO: 625900 - RNA, 22 nt, Human
caggguggaaaagcuaguugga

SEQ ID NO: 625901 - RNA, 22 nt, Human
augucuuuuaugauuacgggau

SEQ ID NO: 625902 - RNA, 22 nt, Human
aaaugugcuucuuacucucaau

SEQ ID NO: 625903 - RNA, 22 nt, Human
aaccuuuauuugguacuauucu

SEQ ID NO: 625904 - RNA, 22 nt, Human
ugagcauggugggugcagagca

SEQ ID NO: 625905 - RNA, 22 nt, Human
cacaugaguguaggaagaggga

SEQ ID NO: 625906 - RNA, 22 nt, Human
guacccaggcacgccuugcuga

SEQ ID NO: 625907 - RNA, 22 nt, Human
agcaaugugaccccugacagca

SEQ ID NO: 625908 - RNA, 22 nt, Human
uuauuuugccacaggugaccuu

SEQ ID NO: 625909 - RNA, 22 nt, Human
uuuaaauggcauuuucccagau

SEQ ID NO: 625910 - RNA, 22 nt, Human
aucuugugugaugaugagaaag

SEQ ID NO: 625911 - RNA, 22 nt, Human
uguguguauccauuagaggcca

SEQ ID NO: 625912 - RNA, 22 nt, Human
uccagggccuuaccucuucaga

SEQ ID NO: 625913 - RNA, 17 nt, Human
agugacuuggaaagagc

SEQ ID NO: 625914 - RNA, 22 nt, Human
agagagguuggcuaggauguuu

SEQ ID NO: 625915 - RNA, 22 nt, Human
uggcucauucuggggaagucag

SEQ ID NO: 625916 - RNA, 22 nt, Human
uugagguccagucuccacccac

SEQ ID NO: 625917 - RNA, 22 nt, Human
ccugccugucaucgccugcgcc

SEQ ID NO: 625918 - RNA, 22 nt, Human
ggagacagcaggaagaaauauc

SEQ ID NO: 625919 - RNA, 22 nt, Human
ccuggagcccaaggcagugaga

SEQ ID NO: 625920 - RNA, 22 nt, Human
ucaguucucucaugccugcccu

SEQ ID NO: 625921 - RNA, 22 nt, Human
ccaggagcagccggcccaccug

SEQ ID NO: 625922 - RNA, 20 nt, Human
uacuggaaauuucuccaccu

SEQ ID NO: 625923 - RNA, 22 nt, Human
uuccuaaaagaauacacuggau

SEQ ID NO: 625924 - RNA, 23 nt, Human
ggaggcacuuaggcagagcagag

SEQ ID NO: 625925 - RNA, 17 nt, Human
gcccacccuuaggagcu

SEQ ID NO: 625926 - RNA, 22 nt, Human
uggggucugaguaucugcauuu

SEQ ID NO: 625927 - RNA, 23 nt, Human
ucugucaccuauggcugcucuuc

SEQ ID NO: 625928 - RNA, 22 nt, Human
cugacaaaccacugcuccagcu

SEQ ID NO: 625929 - RNA, 19 nt, Human
ugucuuaauuaacucagag

SEQ ID NO: 625930 - RNA, 22 nt, Human
cgugucugggcucccauggcag

SEQ ID NO: 625931 - RNA, 22 nt, Human
aaaugcugaguguuuagagauc

SEQ ID NO: 625932 - RNA, 22 nt, Human
agacaggugcucgcccaagucc

SEQ ID NO: 625933 - RNA, 22 nt, Human
aagauauucaaagauuuauuag

SEQ ID NO: 625934 - RNA, 22 nt, Human
gagcuuggaagcagauccucac

SEQ ID NO: 625935 - RNA, 22 nt, Human
ccugggcucaagugauccuccu

SEQ ID NO: 625936 - RNA, 22 nt, Human
caaucagauaugugacauauuu

SEQ ID NO: 625937 - RNA, 22 nt, Human
auaccauaggaaaggaucagcc

SEQ ID NO: 625938 - RNA, 22 nt, Human
cccucucugcugcauagaggaa

SEQ ID NO: 625939 - RNA, 19 nt, Human
uccuccuuacuuccucuug

SEQ ID NO: 625940 - RNA, 22 nt, Human
uggaagggagugacagucagag

SEQ ID NO: 625941 - RNA, 22 nt, Human
gaugauuuugaugcaguaaaga

SEQ ID NO: 625942 - RNA, 22 nt, Human
aagaugcuuauugcuccugcag

SEQ ID NO: 625943 - RNA, 22 nt, Human
acacauguauaugcuugugugu

SEQ ID NO: 625944 - RNA, 22 nt, Human
ucuguuaucucaagucacaaga

SEQ ID NO: 625945 - RNA, 22 nt, Human
gagaaguuguguggauuuaaag

SEQ ID NO: 625946 - RNA, 22 nt, Human
caaaucuauauguugauauucu

SEQ ID NO: 625947 - RNA, 22 nt, Human
uucucuggagggcugcccggcc

SEQ ID NO: 625948 - RNA, 22 nt, Human
gaggcaggguguugauuacaga

SEQ ID NO: 625949 - RNA, 22 nt, Human
ugucugaaacuuaugauauacu

SEQ ID NO: 625950 - RNA, 22 nt, Human
cuuuccuucucgugguucucac

SEQ ID NO: 625951 - RNA, 22 nt, Human
gucugaggguugugcuggagga

SEQ ID NO: 625952 - RNA, 22 nt, Human
acagagcuuaggaugacuccca

SEQ ID NO: 625953 - RNA, 17 nt, Human
gugccuguuguccugga

SEQ ID NO: 625954 - RNA, 22 nt, Human
auauacaggugguauguguaaa

SEQ ID NO: 625955 - RNA, 22 nt, Human
ccaugccauacuggccacccgg

SEQ ID NO: 625956 - RNA, 22 nt, Human
uaggggaacuggcacagggcag

SEQ ID NO: 625957 - RNA, 22 nt, Human
acagaaaaguuuacuuuugcuc

SEQ ID NO: 625958 - RNA, 22 nt, Human
cccccaggcucugacacaggag

SEQ ID NO: 625959 - RNA, 22 nt, Human
agcaggaccaagaaggggaaaa

SEQ ID NO: 625960 - RNA, 22 nt, Human
auuugguuucaggauucucagg

SEQ ID NO: 625961 - RNA, 22 nt, Human
gcagcugccaguccccuuccag

SEQ ID NO: 625962 - RNA, 22 nt, Human
aguggcaauugacaacaaagga

SEQ ID NO: 625963 - RNA, 22 nt, Human
acauuucuaguuguucaucucc

SEQ ID NO: 625964 - RNA, 22 nt, Human
gcuuggcugugagcuuugcugu

SEQ ID NO: 625965 - RNA, 22 nt, Human
acaugcauuaaaaauacuugug

SEQ ID NO: 625966 - RNA, 22 nt, Human
acuauucaccuuucaugcagga

SEQ ID NO: 625967 - RNA, 19 nt, Human
gcuguauuaaagauacaug

SEQ ID NO: 625968 - RNA, 22 nt, Human
cgucuuccucuuacgaugcgcu

SEQ ID NO: 625969 - RNA, 21 nt, Human
uguggcugacacccuuuggga

SEQ ID NO: 625970 - RNA, 22 nt, Human
aguacauuuuucaguggggagu

SEQ ID NO: 625971 - RNA, 22 nt, Human
ccagcaggagagaacauuuccc

SEQ ID NO: 625972 - RNA, 22 nt, Human
uacaucuauuugacagauacag

SEQ ID NO: 625973 - RNA, 22 nt, Human
gcaguaagauguuucccagagc

SEQ ID NO: 625974 - RNA, 22 nt, Human
ugaggcucacgaacagaagacu

SEQ ID NO: 625975 - RNA, 22 nt, Human
ggucaacagagguaaugguaac

SEQ ID NO: 625976 - RNA, 22 nt, Human
caccagcagcggugugagggug

SEQ ID NO: 625977 - RNA, 23 nt, Human
cuggccaccaucuuucuggcuuc

SEQ ID NO: 625978 - RNA, 22 nt, Human
ucaaagacauggggaagcugag

SEQ ID NO: 625979 - RNA, 19 nt, Human
uagauacugaugaacucca

SEQ ID NO: 625980 - RNA, 22 nt, Human
caacaauaugcugaguuuuuca

SEQ ID NO: 625981 - RNA, 22 nt, Human
gaguuauucuagguccuuugua

SEQ ID NO: 625982 - RNA, 22 nt, Human
ggacaugaagcaaaaugggagg

SEQ ID NO: 625983 - RNA, 22 nt, Human
uuuucauaguaauggugcaugu

SEQ ID NO: 625984 - RNA, 22 nt, Human
aacuguuuuucacgugucucau

SEQ ID NO: 625985 - RNA, 22 nt, Human
gcuccuucuggcucccuuuugg

SEQ ID NO: 625986 - RNA, 22 nt, Human
uuugaagugggcauuagaaccu

SEQ ID NO: 625987 - RNA, 22 nt, Human
aacaguguuuugcucuuugccc

SEQ ID NO: 625988 - RNA, 22 nt, Human
uaccaaaaccaagccauuaucu

SEQ ID NO: 625989 - RNA, 22 nt, Human
gggcucagucugcggcgcgcgg

SEQ ID NO: 625990 - RNA, 22 nt, Human
aguaugaaucuuucagaccgua

SEQ ID NO: 625991 - RNA, 20 nt, Human
ugcugagguugacaugccca

SEQ ID NO: 625992 - RNA, 22 nt, Human
agccuucaaccuagcuagagca

SEQ ID NO: 625993 - RNA, 22 nt, Human
ucagggcucagcaucuggcauu

SEQ ID NO: 625994 - RNA, 21 nt, Human
uuguuacaaugcaagaguaug

SEQ ID NO: 625995 - RNA, 22 nt, Human
uuacaucagaaucacccaggaa

SEQ ID NO: 625996 - RNA, 22 nt, Human
uagaacagcauuuggcuauuaa

SEQ ID NO: 625997 - RNA, 22 nt, Human
cagagcagaagcgguccucaca

SEQ ID NO: 625998 - RNA, 22 nt, Human
uagcuguuaaguuguuuggaaa

SEQ ID NO: 625999 - RNA, 22 nt, Human
uauauuguuggugggaauauaa

SEQ ID NO: 626000 - RNA, 22 nt, Human
cggcccugaccagaccuuaguu

SEQ ID NO: 626001 - RNA, 22 nt, Human
ccuguugucauggaauaaguua

SEQ ID NO: 626002 - RNA, 22 nt, Human
auaaggcauauagucacuuuuu

SEQ ID NO: 626003 - RNA, 22 nt, Human
caggucagcacuuggaggugca

SEQ ID NO: 626004 - RNA, 22 nt, Human
ugauucugugaauuaguugggu

SEQ ID NO: 626005 - RNA, 22 nt, Human
ggauaggaauugagaugcuauu

SEQ ID NO: 626006 - RNA, 21 nt, Human
agacagaacaacugcucucca

SEQ ID NO: 626007 - RNA, 22 nt, Human
ugcagucagcauuagcaaaaua

SEQ ID NO: 626008 - RNA, 22 nt, Human
uguaaaacaaaauuuguggaga

SEQ ID NO: 626009 - RNA, 21 nt, Human
ccuguggucuggagggagcac

SEQ ID NO: 626010 - RNA, 16 nt, Human
ccccaggacuuggcac

SEQ ID NO: 626011 - RNA, 22 nt, Human
aauccuggcaugugccuuggga

SEQ ID NO: 626012 - RNA, 17 nt, Human
gugaauggcauagucgg

SEQ ID NO: 626013 - RNA, 22 nt, Human
cugcugccugauugcagaccuc

SEQ ID NO: 626014 - RNA, 22 nt, Human
ccaggaagcugugagauuccaa

SEQ ID NO: 626015 - RNA, 22 nt, Human
ccaaggcuccucagcuggucuu

SEQ ID NO: 626016 - RNA, 22 nt, Human
ucuggaguguuucuaauuacug

SEQ ID NO: 626017 - RNA, 22 nt, Human
gggcuggaagugcauugaugcu

SEQ ID NO: 626018 - RNA, 22 nt, Human
cuggagccacugggucuuguau

SEQ ID NO: 626019 - RNA, 22 nt, Human
gccucuccucuuaauaccauua

SEQ ID NO: 626020 - RNA, 22 nt, Human
cagcuguucggggcuggcaugu

SEQ ID NO: 626021 - RNA, 22 nt, Human
augguggacucuugauucaggc

SEQ ID NO: 626022 - RNA, 22 nt, Human
acagcagccuuguugguuucga

SEQ ID NO: 626023 - RNA, 22 nt, Human
uuucaaacugcccagcacaccu

SEQ ID NO: 626024 - RNA, 22 nt, Human
gcuuuagagcccagcuuggugg

SEQ ID NO: 626025 - RNA, 22 nt, Human
cuguggcugaacucugaagagg

SEQ ID NO: 626026 - RNA, 22 nt, Human
cacauacugagaaucacaccca

SEQ ID NO: 626027 - RNA, 22 nt, Human
ccaggcagcaaauuuucugaau

SEQ ID NO: 626028 - RNA, 22 nt, Human
acccaggcuagggugcaguggc

SEQ ID NO: 626029 - RNA, 22 nt, Human
uggcugaguaaguugugauaug

SEQ ID NO: 626030 - RNA, 22 nt, Human
guaaacaagucuaccauuagaa

SEQ ID NO: 626031 - RNA, 22 nt, Human
ucuccuggucaccucagaaguc

SEQ ID NO: 626032 - RNA, 22 nt, Human
guucuacaguuccuauuacuua

SEQ ID NO: 626033 - RNA, 22 nt, Human
guggucaggggcugaggugccc

SEQ ID NO: 626034 - RNA, 22 nt, Human
acacaauuuccuguccauaugu

SEQ ID NO: 626035 - RNA, 22 nt, Human
caucagagugguggccuggugu

SEQ ID NO: 626036 - RNA, 22 nt, Human
agaugaagaugccacuaagacc

SEQ ID NO: 626037 - RNA, 22 nt, Human
ggagcuguuaaaugcagaauuu

SEQ ID NO: 626038 - RNA, 22 nt, Human
ccagggaaaaucaacuucuacu

SEQ ID NO: 626039 - RNA, 22 nt, Human
acaaaugcagcauaaagugaac

SEQ ID NO: 626040 - RNA, 22 nt, Human
auugaguaccuccagauucaua

SEQ ID NO: 626041 - RNA, 22 nt, Human
caggaaugacugcagauggggc

SEQ ID NO: 626042 - RNA, 22 nt, Human
cagaaauggucuguucagcuua

SEQ ID NO: 626043 - RNA, 22 nt, Human
uguggccugauuuugcaucucu

SEQ ID NO: 626044 - RNA, 22 nt, Human
acauuuuacaccaagacuucuu

SEQ ID NO: 626045 - RNA, 22 nt, Human
augugagguagauaggaugcag

SEQ ID NO: 626046 - RNA, 22 nt, Human
uggagggaacaaaggaguccca

SEQ ID NO: 626047 - RNA, 22 nt, Human
ggcuuugggcccucaagucucc

SEQ ID NO: 626048 - RNA, 22 nt, Human
agaugcuuaaguuuucagugua

SEQ ID NO: 626049 - RNA, 22 nt, Human
ucugcuguaaccuucagaggua

SEQ ID NO: 626050 - RNA, 22 nt, Human
uggaugagggcugagcacuggg

SEQ ID NO: 626051 - RNA, 22 nt, Human
ugcccucagcagcagcuccugc

SEQ ID NO: 626052 - RNA, 22 nt, Human
caaggccacuccagagacuggu

SEQ ID NO: 626053 - RNA, 22 nt, Human
gcccacaggggaccugguggcu

SEQ ID NO: 626054 - RNA, 22 nt, Human
aggccuggcaugagaccugaga

SEQ ID NO: 626055 - RNA, 22 nt, Human
uggagcaggacggggaguggua

SEQ ID NO: 626056 - RNA, 22 nt, Human
ugaccugcguaggugguuucug

SEQ ID NO: 626057 - RNA, 16 nt, Human
uguuagcugugcauua

SEQ ID NO: 626058 - RNA, 22 nt, Human
cccugggaggcuuccaggcaga

SEQ ID NO: 626059 - RNA, 22 nt, Human
acagacugauucauugcucagg

SEQ ID NO: 626060 - RNA, 22 nt, Human
cucacauucacaggacagaagg

SEQ ID NO: 626061 - RNA, 22 nt, Human
auggaauaggcugcucuuuaaa

SEQ ID NO: 626062 - RNA, 21 nt, Human
ucaauacaggugcaugugucu

SEQ ID NO: 626063 - RNA, 22 nt, Human
auacagaugcuugcucgugacu

SEQ ID NO: 626064 - RNA, 22 nt, Human
ggcugccauaacagaguaccac

SEQ ID NO: 626065 - RNA, 22 nt, Human
aggagcugaaacuucucauaug

SEQ ID NO: 626066 - RNA, 22 nt, Human
ugaaagguagcuggccucauag

SEQ ID NO: 626067 - RNA, 22 nt, Human
cagggugccucugcucccacca

SEQ ID NO: 626068 - RNA, 22 nt, Human
ucccagaaguccagccaugggc

SEQ ID NO: 626069 - RNA, 22 nt, Human
aacacuucuguugauaauaagc

SEQ ID NO: 626070 - RNA, 22 nt, Human
aaagguaugauacugugacaug

SEQ ID NO: 626071 - RNA, 20 nt, Human
ccaccuggccaaggcugugc

SEQ ID NO: 626072 - RNA, 22 nt, Human
ccaaggcuuccugaccuacaug

SEQ ID NO: 626073 - RNA, 22 nt, Human
aaacacauuagcccuguggaaa

SEQ ID NO: 626074 - RNA, 22 nt, Human
uuccuucucagcccucgaggau

SEQ ID NO: 626075 - RNA, 22 nt, Human
uacaaugaccauauuauguaag

SEQ ID NO: 626076 - RNA, 22 nt, Human
gucaugccuggcuucuuagaca

SEQ ID NO: 626077 - RNA, 19 nt, Human
uguacaaggauuaugcagg

SEQ ID NO: 626078 - RNA, 23 nt, Human
ucagaaugcacugaauuuacccu

SEQ ID NO: 626079 - RNA, 22 nt, Human
agugggcaggcagggugcgcag

SEQ ID NO: 626080 - RNA, 22 nt, Human
auugaguaguaggaaaauaacu

SEQ ID NO: 626081 - RNA, 22 nt, Human
acccaggagacggaggugcagu

SEQ ID NO: 626082 - RNA, 22 nt, Human
aaauuaguacauugcaaagucc

SEQ ID NO: 626083 - RNA, 22 nt, Human
ugguaaugguucucuugcuaua

SEQ ID NO: 626084 - RNA, 22 nt, Human
ccucucucagcuugcugcaacu

SEQ ID NO: 626085 - RNA, 22 nt, Human
uaucuguucaauggaagaugac

SEQ ID NO: 626086 - RNA, 22 nt, Human
uccaggagaaggccauccagcg

SEQ ID NO: 626087 - RNA, 22 nt, Human
gaggcucagggaguauaugaau

SEQ ID NO: 626088 - RNA, 22 nt, Human
auuagucuacugucuaauaaau

SEQ ID NO: 626089 - RNA, 22 nt, Human
ccuguggcuuccacgaccuaau

SEQ ID NO: 626090 - RNA, 22 nt, Human
agauguuccagccaaugggaau

SEQ ID NO: 626091 - RNA, 22 nt, Human
uggcaacaugucgaagugcugu

SEQ ID NO: 626092 - RNA, 22 nt, Human
aggucaggguauucacgucugu

SEQ ID NO: 626093 - RNA, 22 nt, Human
uggagccuguucugagaagccg

SEQ ID NO: 626094 - RNA, 22 nt, Human
ucagcagaauguggcaugucac

SEQ ID NO: 626095 - RNA, 22 nt, Human
ccagucccaucucugucgcuua

SEQ ID NO: 626096 - RNA, 22 nt, Human
guggccaggucagggacuugug

SEQ ID NO: 626097 - RNA, 21 nt, Human
ugucagagcuuguaggacauu

SEQ ID NO: 626098 - RNA, 17 nt, Human
cccaugagcccacuccc

SEQ ID NO: 626099 - RNA, 22 nt, Human
uauguacacuuaaguuugagaa

SEQ ID NO: 626100 - RNA, 22 nt, Human
cucauaaacauuauucauuauu

SEQ ID NO: 626101 - RNA, 22 nt, Human
acaguuuggcgugauugauagu

SEQ ID NO: 626102 - RNA, 22 nt, Human
cucaccauaugacuuuacuaac

SEQ ID NO: 626103 - RNA, 22 nt, Human
ugaggccaggcaaaggcgaucu

SEQ ID NO: 626104 - RNA, 22 nt, Human
auauaguaagcagucuguaaau

SEQ ID NO: 626105 - RNA, 22 nt, Human
uucaaacaacucauuuaugcaa

SEQ ID NO: 626106 - RNA, 19 nt, Human
aagcauggugccucaccuc

SEQ ID NO: 626107 - RNA, 22 nt, Human
acaugcaugucuaugggcaggu

SEQ ID NO: 626108 - RNA, 22 nt, Human
cgcaugugcguugauugcagug

SEQ ID NO: 626109 - RNA, 22 nt, Human
uucaaacuuaaggagcagcaga

SEQ ID NO: 626110 - RNA, 22 nt, Human
ugaaauguuaaacaaguggcuc

SEQ ID NO: 626111 - RNA, 22 nt, Human
gaggauuugauggcuuucuccc

SEQ ID NO: 626112 - RNA, 22 nt, Human
ugaagcacaggcauacacaacc

SEQ ID NO: 626113 - RNA, 22 nt, Human
auacaacugccuuagaaggaaa

SEQ ID NO: 626114 - RNA, 22 nt, Human
ugcuucucuuuauuuguagguu

SEQ ID NO: 626115 - RNA, 22 nt, Human
uuccccuugauaaugcaguaag

SEQ ID NO: 626116 - RNA, 22 nt, Human
gcacagagugggugagaugugg

SEQ ID NO: 626117 - RNA, 22 nt, Human
aaggccacgucuccuuccagag

SEQ ID NO: 626118 - RNA, 22 nt, Human
ugcagcuccugugcugagugug

SEQ ID NO: 626119 - RNA, 19 nt, Human
agccagaguggcccagggg

SEQ ID NO: 626120 - RNA, 23 nt, Human
gguuccugagcagggaucuggaa

SEQ ID NO: 626121 - RNA, 22 nt, Human
gaagccaaguccucgaguuuca

SEQ ID NO: 626122 - RNA, 22 nt, Human
ccugagucuuucccauugcgcu

SEQ ID NO: 626123 - RNA, 22 nt, Human
cugcugggcagaggcugcauga

SEQ ID NO: 626124 - RNA, 22 nt, Human
caauacacuaaacuucucugaa

SEQ ID NO: 626125 - RNA, 22 nt, Human
ugucagcagaaguggugcacuc

SEQ ID NO: 626126 - RNA, 22 nt, Human
gcuaggaagcuggggagaaguc

SEQ ID NO: 626127 - RNA, 22 nt, Human
agacucugaagucauugcauga

SEQ ID NO: 626128 - RNA, 22 nt, Human
aacuagaaccacuuguauuucc

SEQ ID NO: 626129 - RNA, 17 nt, Human
ggcugcugugcuggugc

SEQ ID NO: 626130 - RNA, 18 nt, Human
uagauuaaaauugaauuc

SEQ ID NO: 626131 - RNA, 22 nt, Human
ggcgggagauggggccguucag

SEQ ID NO: 626132 - RNA, 18 nt, Human
ccuggaggucuucggggu

SEQ ID NO: 626133 - RNA, 22 nt, Human
aagcugugaaaucucuagugca

SEQ ID NO: 626134 - RNA, 22 nt, Human
gggagaaggaggacugugcugu

SEQ ID NO: 626135 - RNA, 22 nt, Human
aguugaauaauuagacauaucu

SEQ ID NO: 626136 - RNA, 22 nt, Human
acagcuacaucaaacucagaag

SEQ ID NO: 626137 - RNA, 22 nt, Human
gaagagguucaacguggucauc

SEQ ID NO: 626138 - RNA, 22 nt, Human
cugaggaggggccugagugaga

SEQ ID NO: 626139 - RNA, 22 nt, Human
uuauugccugauugaggucauu

SEQ ID NO: 626140 - RNA, 22 nt, Human
augacagaaggccucccugaca

SEQ ID NO: 626141 - RNA, 22 nt, Human
cuggcucuguggcuuccuucau

SEQ ID NO: 626142 - RNA, 22 nt, Human
gucugcuuuucugcccuuucau

SEQ ID NO: 626143 - RNA, 22 nt, Human
ccugugggcuugaguguagggu

SEQ ID NO: 626144 - RNA, 22 nt, Human
cugugugugucugcagcauacu

SEQ ID NO: 626145 - RNA, 22 nt, Human
aaacacuuccuguaacaugaca

SEQ ID NO: 626146 - RNA, 22 nt, Human
agcuggaauccuacuucuaaca

SEQ ID NO: 626147 - RNA, 22 nt, Human
uguagaaauuaguaagaucaac

SEQ ID NO: 626148 - RNA, 22 nt, Human
ugaggacaaucccuaacucaga

SEQ ID NO: 626149 - RNA, 22 nt, Human
agcacuuaacugacaguacuau

SEQ ID NO: 626150 - RNA, 22 nt, Human
gcugucagaaggugaaggguaa

SEQ ID NO: 626151 - RNA, 22 nt, Human
cucccucaccaugacccgcugu

SEQ ID NO: 626152 - RNA, 22 nt, Human
uuggcauaaaacucuucaaaau

SEQ ID NO: 626153 - RNA, 22 nt, Human
agaaaugacaagacugaucagg

SEQ ID NO: 626154 - RNA, 22 nt, Human
cugcauguguuauauuugguuc

SEQ ID NO: 626155 - RNA, 22 nt, Human
uguaaugauguacuuagaagga

SEQ ID NO: 626156 - RNA, 22 nt, Human
uauguguaaucauaucugauac

SEQ ID NO: 626157 - RNA, 22 nt, Human
gaugcugugcuaugucuacaga

SEQ ID NO: 626158 - RNA, 22 nt, Human
caggcuuuuucugcuguccucu

SEQ ID NO: 626159 - RNA, 22 nt, Human
gcacaguggaguguguccaggg

SEQ ID NO: 626160 - RNA, 19 nt, Human
ccugugagaggacaggugu

SEQ ID NO: 626161 - RNA, 22 nt, Human
ucuguccauuuuccauuuuggc

SEQ ID NO: 626162 - RNA, 22 nt, Human
ggcagucagugugguucauaaa

SEQ ID NO: 626163 - RNA, 22 nt, Human
gagaaagggauaauuugaagag

SEQ ID NO: 626164 - RNA, 22 nt, Human
agggacaucucacaaacaacuu

SEQ ID NO: 626165 - RNA, 22 nt, Human
cagggcucccugcagccucugu

SEQ ID NO: 626166 - RNA, 22 nt, Human
uucaauucugcucugaucuuag

SEQ ID NO: 626167 - RNA, 22 nt, Human
accuugaugccuuuccaagaug

SEQ ID NO: 626168 - RNA, 22 nt, Human
agcagauauuuguugagcacuu

SEQ ID NO: 626169 - RNA, 22 nt, Human
gcugagcuagaaaaggaccaca

SEQ ID NO: 626170 - RNA, 22 nt, Human
gcugccugcucacccggccugg

SEQ ID NO: 626171 - RNA, 19 nt, Human
uggcuccugccugccuucu

SEQ ID NO: 626172 - RNA, 22 nt, Human
cucauaaugugacuguauuuga

SEQ ID NO: 626173 - RNA, 19 nt, Human
gaauacagauaauaagcag

SEQ ID NO: 626174 - RNA, 22 nt, Human
uguguaaaaugagccuaaaguc

SEQ ID NO: 626175 - RNA, 22 nt, Human
gcuucaaggccaagacaccuua

SEQ ID NO: 626176 - RNA, 22 nt, Human
accuguuuuagucuuuaaucau

SEQ ID NO: 626177 - RNA, 22 nt, Human
accuuuuacggugugacuagca

SEQ ID NO: 626178 - RNA, 22 nt, Human
agcugccacauggugucacugu

SEQ ID NO: 626179 - RNA, 22 nt, Human
gaggccugggagccuguccucc

SEQ ID NO: 626180 - RNA, 22 nt, Human
uggcucagcagguuagaaacua

SEQ ID NO: 626181 - RNA, 22 nt, Human
uacacaaucuguuuuuccauuu

SEQ ID NO: 626182 - RNA, 22 nt, Human
gaggcucuucaauaggucaaug

SEQ ID NO: 626183 - RNA, 22 nt, Human
cccuccccacaaagcuucacac

SEQ ID NO: 626184 - RNA, 21 nt, Human
gcuucuguaucuagcaggaac

SEQ ID NO: 626185 - RNA, 22 nt, Human
ucuaauuuuaggcauuuguuca

SEQ ID NO: 626186 - RNA, 22 nt, Human
acucauguccuaggaguaaagc

SEQ ID NO: 626187 - RNA, 22 nt, Human
ugcuucuguucuuucaccuacg

SEQ ID NO: 626188 - RNA, 22 nt, Human
aaacauuuuucuaggucuuggu

SEQ ID NO: 626189 - RNA, 22 nt, Human
agggcagugggaaagccugcuc

SEQ ID NO: 626190 - RNA, 22 nt, Human
uggggcuggcuauugucucccu

SEQ ID NO: 626191 - RNA, 22 nt, Human
gcccugcuccaggagaauaccc

SEQ ID NO: 626192 - RNA, 22 nt, Human
acauucugaaaaacaguguuuu

SEQ ID NO: 626193 - RNA, 22 nt, Human
auggcugugagcaggcagcuuc

SEQ ID NO: 626194 - RNA, 22 nt, Human
cauccauagcuugaucuguucc

SEQ ID NO: 626195 - RNA, 22 nt, Human
cucaggcuugggaggaggccca

SEQ ID NO: 626196 - RNA, 22 nt, Human
uuccaaaugaguuccaucgaau

SEQ ID NO: 626197 - RNA, 22 nt, Human
ucaggaguugaaggggauccug

SEQ ID NO: 626198 - RNA, 22 nt, Human
gugugccagacaugaugcuaug

SEQ ID NO: 626199 - RNA, 19 nt, Human
cguaccugacacagaacag

SEQ ID NO: 626200 - RNA, 22 nt, Human
cuacagaaggagaaauggguaa

SEQ ID NO: 626201 - RNA, 22 nt, Human
uguaaaagguuguucuuucguu

SEQ ID NO: 626202 - RNA, 22 nt, Human
ugcugagaagagggccgaccca

SEQ ID NO: 626203 - RNA, 22 nt, Human
gcugcaggcucugcaggaauug

SEQ ID NO: 626204 - RNA, 22 nt, Human
ccugagccugaguggugcaggg

SEQ ID NO: 626205 - RNA, 22 nt, Human
cuguggcaaaugauaccuccca

SEQ ID NO: 626206 - RNA, 22 nt, Human
cacauguuuggcaugucaccaa

SEQ ID NO: 626207 - RNA, 22 nt, Human
cacugacaguaucagagcuguu

SEQ ID NO: 626208 - RNA, 22 nt, Human
gugucauuaaccaccaugcaaa

SEQ ID NO: 626209 - RNA, 22 nt, Human
uuaaacaccaagugcaaaccac

SEQ ID NO: 626210 - RNA, 22 nt, Human
ccaaugagacagaaagagccuc

SEQ ID NO: 626211 - RNA, 22 nt, Human
cucccagggucuaggcugcugg

SEQ ID NO: 626212 - RNA, 20 nt, Human
ugugaaagcaguagaaugac

SEQ ID NO: 626213 - RNA, 22 nt, Human
agacccugaaguuuucuaugau

SEQ ID NO: 626214 - RNA, 22 nt, Human
uaaggcagccucaggguagggu

SEQ ID NO: 626215 - RNA, 17 nt, Human
aggauguggagaaaauu

SEQ ID NO: 626216 - RNA, 22 nt, Human
uuggaggggccacugcagagcu

SEQ ID NO: 626217 - RNA, 22 nt, Human
uaaauucuacaacuucaaagau

SEQ ID NO: 626218 - RNA, 23 nt, Human
ucagaauaauaaccuaguaacug

SEQ ID NO: 626219 - RNA, 19 nt, Human
cacaauuaugagacacuua

SEQ ID NO: 626220 - RNA, 22 nt, Human
uugaaaggccuguuuauccagc

SEQ ID NO: 626221 - RNA, 22 nt, Human
ggacaaauucccuauuugcaug

SEQ ID NO: 626222 - RNA, 22 nt, Human
gaagaacuuuagggcagaauuu

SEQ ID NO: 626223 - RNA, 22 nt, Human
ucagaggccugaaagaauuugg

SEQ ID NO: 626224 - RNA, 22 nt, Human
uccaaaggggcaguguccagcc

SEQ ID NO: 626225 - RNA, 22 nt, Human
uuccucuuucucugugcuaugu

SEQ ID NO: 626226 - RNA, 22 nt, Human
ucaaggacuauugcaugacucc

SEQ ID NO: 626227 - RNA, 22 nt, Human
uuuacagucuauguugaauuaa

SEQ ID NO: 626228 - RNA, 22 nt, Human
uuaauacacuauaugaucacau

SEQ ID NO: 626229 - RNA, 22 nt, Human
auuuaauuuggagagagaaacc

SEQ ID NO: 626230 - RNA, 22 nt, Human
gaacuugagcaacacugaguga

SEQ ID NO: 626231 - RNA, 22 nt, Human
aaacaugaugccuguacuaaga

SEQ ID NO: 626232 - RNA, 22 nt, Human
cacaauuucaguugcaugcaac

SEQ ID NO: 626233 - RNA, 22 nt, Human
acauacaaauagagcuguagua

SEQ ID NO: 626234 - RNA, 22 nt, Human
gaaauugugcauuuagcaacac

SEQ ID NO: 626235 - RNA, 22 nt, Human
ucaggaagugcugaggcugcuu

SEQ ID NO: 626236 - RNA, 22 nt, Human
agauggaaaauauagacagaga

SEQ ID NO: 626237 - RNA, 22 nt, Human
aaucacaucacugagaaugagg

SEQ ID NO: 626238 - RNA, 22 nt, Human
ucagugugucucugcauuuggg

SEQ ID NO: 626239 - RNA, 22 nt, Human
aaguauucuggcagucauucag

SEQ ID NO: 626240 - RNA, 22 nt, Human
ucacagaaagcuguguccugac

SEQ ID NO: 626241 - RNA, 22 nt, Human
ggacacagaccuuucuguucua

SEQ ID NO: 626242 - RNA, 22 nt, Human
cagggcagccaggccccguggg

SEQ ID NO: 626243 - RNA, 22 nt, Human
auuugacauuauucucucaguc

SEQ ID NO: 626244 - RNA, 23 nt, Human
cucugggcgggcaggucagccuc

SEQ ID NO: 626245 - RNA, 22 nt, Human
ggaauguugucauuuacauuau

SEQ ID NO: 626246 - RNA, 22 nt, Human
cuccagugggggugagccuaga

SEQ ID NO: 626247 - RNA, 22 nt, Human
ggaccaguuucaaacuguacca

SEQ ID NO: 626248 - RNA, 22 nt, Human
ucaguagcagaaagcaaugagu

SEQ ID NO: 626249 - RNA, 22 nt, Human
uuggcucacaaggacgguugcu

SEQ ID NO: 626250 - RNA, 23 nt, Human
ugucuuugaaugggcuguagaca

SEQ ID NO: 626251 - RNA, 22 nt, Human
uauauuaaacccucucuguagg

SEQ ID NO: 626252 - RNA, 22 nt, Human
gccgggaccaaggccacggagc

SEQ ID NO: 626253 - RNA, 22 nt, Human
uggcuggagaacuuggggaucu

SEQ ID NO: 626254 - RNA, 22 nt, Human
ccugccagugaagcugacgggc

SEQ ID NO: 626255 - RNA, 22 nt, Human
ugagcucuaagauccccucaag

SEQ ID NO: 626256 - RNA, 22 nt, Human
aaugguuuaguuaagacugagu

SEQ ID NO: 626257 - RNA, 22 nt, Human
uuucccagagguaugaauaagu

SEQ ID NO: 626258 - RNA, 22 nt, Human
cugaccuggccuuggugggcca

SEQ ID NO: 626259 - RNA, 22 nt, Human
agagaccagaauccagcugccu

SEQ ID NO: 626260 - RNA, 22 nt, Human
cacugcuuuucagacaguuauu

SEQ ID NO: 626261 - RNA, 22 nt, Human
aucucccaaauuagccucuuga

SEQ ID NO: 626262 - RNA, 22 nt, Human
ucuugacauucaaucauguaua

SEQ ID NO: 626263 - RNA, 22 nt, Human
auggcagggaccaagcugucau

SEQ ID NO: 626264 - RNA, 22 nt, Human
ugggguacacguggggcaggau

SEQ ID NO: 626265 - RNA, 22 nt, Human
agauguaguagugggucuuuua

SEQ ID NO: 626266 - RNA, 22 nt, Human
ugucauuauuugccuacugacu

SEQ ID NO: 626267 - RNA, 22 nt, Human
ggcagauggaagaggcuggguc

SEQ ID NO: 626268 - RNA, 22 nt, Human
agcagccuggucucucgccaau

SEQ ID NO: 626269 - RNA, 22 nt, Human
uuacaacuuuccugugucaaau

SEQ ID NO: 626270 - RNA, 22 nt, Human
ggcagcuaggggcagggaauuc

SEQ ID NO: 626271 - RNA, 22 nt, Human
caguaugacuacaaacagcuuu

SEQ ID NO: 626272 - RNA, 22 nt, Human
auggacaggcugagcuuccuca

SEQ ID NO: 626273 - RNA, 22 nt, Human
uuuacugaauuugguauauucc

SEQ ID NO: 626274 - RNA, 22 nt, Human
acaaaggugagcagaagacaca

SEQ ID NO: 626275 - RNA, 22 nt, Human
auguccagccaaccacuggauu

SEQ ID NO: 626276 - RNA, 22 nt, Human
auggcuguugugaggaucaaau

SEQ ID NO: 626277 - RNA, 22 nt, Human
agaagcacaccaguagacaggg

SEQ ID NO: 626278 - RNA, 22 nt, Human
ugagagugguucagcucagaag

SEQ ID NO: 626279 - RNA, 22 nt, Human
cugaaguuauuguacaaauuug

SEQ ID NO: 626280 - RNA, 22 nt, Human
cuuguacaggaauccaugguau

SEQ ID NO: 626281 - RNA, 16 nt, Human
uugaaugacugugugc

SEQ ID NO: 626282 - RNA, 22 nt, Human
cagcaugagaaaaugaaucaga

SEQ ID NO: 626283 - RNA, 22 nt, Human
cacagggaggacaucaacagug

SEQ ID NO: 626284 - RNA, 22 nt, Human
aauugagaugacagaggaauag

SEQ ID NO: 626285 - RNA, 22 nt, Human
ggguaguguggucucugggcug

SEQ ID NO: 626286 - RNA, 22 nt, Human
gaggccagaagucugagaucag

SEQ ID NO: 626287 - RNA, 22 nt, Human
gccuuggaacaauuauugcugc

SEQ ID NO: 626288 - RNA, 22 nt, Human
uggaggacaggacuggacagcc

SEQ ID NO: 626289 - RNA, 22 nt, Human
ugggugaaaauuuugguggcac

SEQ ID NO: 626290 - RNA, 22 nt, Human
aaaccucuucucaagauuucug

SEQ ID NO: 626291 - RNA, 21 nt, Human
acagauuuuauaucucugcug

SEQ ID NO: 626292 - RNA, 22 nt, Human
uccccacacagauacagaguag

SEQ ID NO: 626293 - RNA, 22 nt, Human
guacaggaaggagggaguuuca

SEQ ID NO: 626294 - RNA, 22 nt, Human
ggcugcggccgcgggucugugc

SEQ ID NO: 626295 - RNA, 23 nt, Human
cccagagcacagccuccagaugc

SEQ ID NO: 626296 - RNA, 22 nt, Human
uaugccagacugugagcuucuu

SEQ ID NO: 626297 - RNA, 22 nt, Human
agaguggcccguuggccugaac

SEQ ID NO: 626298 - RNA, 22 nt, Human
guccagagagaucuucugauag

SEQ ID NO: 626299 - RNA, 22 nt, Human
aggguggcugaguagauggaag

SEQ ID NO: 626300 - RNA, 20 nt, Human
uuagaguuagcuguuaugca

SEQ ID NO: 626301 - RNA, 22 nt, Human
aacaggaauugaugggaguccu

SEQ ID NO: 626302 - RNA, 22 nt, Human
gaccagcuacuuguacaguuca

SEQ ID NO: 626303 - RNA, 22 nt, Human
gcaggacaggcguugguccagu

SEQ ID NO: 626304 - RNA, 22 nt, Human
ugggacuuguguggcaguauuu

SEQ ID NO: 626305 - RNA, 22 nt, Human
ucugggcugcuaugaggcagag

SEQ ID NO: 626306 - RNA, 22 nt, Human
acuaaagucagacugcauugau

SEQ ID NO: 626307 - RNA, 22 nt, Human
ccacagugacacgggcuggccc

SEQ ID NO: 626308 - RNA, 22 nt, Human
agagccaguuguuaagcacuua

SEQ ID NO: 626309 - RNA, 19 nt, Human
cuggccacaccugcugguu

SEQ ID NO: 626310 - RNA, 22 nt, Human
ccuguguuuagauaugaugcug

SEQ ID NO: 626311 - RNA, 22 nt, Human
ggcccugagcacagcuccucuc

SEQ ID NO: 626312 - RNA, 22 nt, Human
cagagcagacguugagauuaag

SEQ ID NO: 626313 - RNA, 22 nt, Human
uacaaagugugcccaugcugag

SEQ ID NO: 626314 - RNA, 22 nt, Human
acucuaaauagccucuuaaaca

SEQ ID NO: 626315 - RNA, 22 nt, Human
cucugccugugucgccaccaca

SEQ ID NO: 626316 - RNA, 22 nt, Human
ggcuccuguuauuuaaugagga

SEQ ID NO: 626317 - RNA, 22 nt, Human
acagugcauaaaaacaacuuuu

SEQ ID NO: 626318 - RNA, 22 nt, Human
uuuccuaggagauugaucacau

SEQ ID NO: 626319 - RNA, 22 nt, Human
uuaugcuaguauaguccuuaga

SEQ ID NO: 626320 - RNA, 22 nt, Human
uuauaguuaguaggucauuaaa

SEQ ID NO: 626321 - RNA, 22 nt, Human
aaguacagaaggagcgaacaau

SEQ ID NO: 626322 - RNA, 15 nt, Human
gcccucaggcgacac

SEQ ID NO: 626323 - RNA, 22 nt, Human
gacauucacagguaaacauucc

SEQ ID NO: 626324 - RNA, 22 nt, Human
aauuuauaauaaauagggcuuu

SEQ ID NO: 626325 - RNA, 17 nt, Human
uuacagagguaauuaag

SEQ ID NO: 626326 - RNA, 19 nt, Human
auagagacagaguuuaauc

SEQ ID NO: 626327 - RNA, 21 nt, Human
ugauccuuucccccauguugc

SEQ ID NO: 626328 - RNA, 21 nt, Human
ucuuccuccacagcgugccac

SEQ ID NO: 626329 - RNA, 22 nt, Human
agcucaggucucaggagguguc

SEQ ID NO: 626330 - RNA, 22 nt, Human
agaaucaacugaaaauugguga

SEQ ID NO: 626331 - RNA, 21 nt, Human
gugguucuagagaaacagaau

SEQ ID NO: 626332 - RNA, 22 nt, Human
auccacuuggcugguuguucua

SEQ ID NO: 626333 - RNA, 22 nt, Human
aaguugcuaaaggaguucuuug

SEQ ID NO: 626334 - RNA, 22 nt, Human
acaggagugaaucuggcacuua

SEQ ID NO: 626335 - RNA, 22 nt, Human
auaaauagugcugccaugagua

SEQ ID NO: 626336 - RNA, 22 nt, Human
aaggcagggaaaguggauuagg

SEQ ID NO: 626337 - RNA, 22 nt, Human
gcugcuuugucuguaaaaugga

SEQ ID NO: 626338 - RNA, 17 nt, Human
uugaaaaguaagcuccc

SEQ ID NO: 626339 - RNA, 20 nt, Human
agggugagacaugagccucc

SEQ ID NO: 626340 - RNA, 22 nt, Human
ugcuccagcuggagaugggggc

SEQ ID NO: 626341 - RNA, 22 nt, Human
aaggcacucauucaaggagaua

SEQ ID NO: 626342 - RNA, 22 nt, Human
accccagaggcggaggcugcag

SEQ ID NO: 626343 - RNA, 22 nt, Human
caugcuuuaccaaagcagugau

SEQ ID NO: 626344 - RNA, 22 nt, Human
ugcagcauuaguacaagucuca

SEQ ID NO: 626345 - RNA, 22 nt, Human
uucuacacagugcggguuaaca

SEQ ID NO: 626346 - RNA, 22 nt, Human
uuuguggcaggagcggagaccg

SEQ ID NO: 626347 - RNA, 22 nt, Human
gggcuuggccccagaagagcua

SEQ ID NO: 626348 - RNA, 22 nt, Human
uugcaaauuauuuuagucccuu

SEQ ID NO: 626349 - RNA, 22 nt, Human
ugccugggugcuggcuggucac

SEQ ID NO: 626350 - RNA, 18 nt, Human
aaggucugucugguaggu

SEQ ID NO: 626351 - RNA, 22 nt, Human
ucuaccagggucacagaggccc

SEQ ID NO: 626352 - RNA, 22 nt, Human
gggaccuggggacuccuuguuc

SEQ ID NO: 626353 - RNA, 22 nt, Human
ucaaacuugguaagagaaauac

SEQ ID NO: 626354 - RNA, 22 nt, Human
uuggcccugaggaggcagcugc

SEQ ID NO: 626355 - RNA, 22 nt, Human
ggccugaaugccugaguguggg

SEQ ID NO: 626356 - RNA, 22 nt, Human
agguggggcccaccaauuugca

SEQ ID NO: 626357 - RNA, 22 nt, Human
uuuuaagaaauguaugacuguc

SEQ ID NO: 626358 - RNA, 22 nt, Human
ucuuaaugaaagugaaauauca

SEQ ID NO: 626359 - RNA, 22 nt, Human
ugaaggcauaaaucuugggaac

SEQ ID NO: 626360 - RNA, 22 nt, Human
auccuucuucugcuagugucua

SEQ ID NO: 626361 - RNA, 22 nt, Human
cucugacauucugugacucuga

SEQ ID NO: 626362 - RNA, 22 nt, Human
cugcagaacaauuccugcuguu

SEQ ID NO: 626363 - RNA, 23 nt, Human
ccccucugguggcucagcuccug

SEQ ID NO: 626364 - RNA, 22 nt, Human
acaugaaaacugguuccuucag

SEQ ID NO: 626365 - RNA, 22 nt, Human
ggggaggaccuuuccaaggcuu

SEQ ID NO: 626366 - RNA, 22 nt, Human
agagcuuagaauuucagaugau

SEQ ID NO: 626367 - RNA, 22 nt, Human
ucuaaggagcgcuccagaaaaa

SEQ ID NO: 626368 - RNA, 22 nt, Human
gcugagaauguuccuacuggua

SEQ ID NO: 626369 - RNA, 23 nt, Human
uaacaauggacuccucuuagcua

SEQ ID NO: 626370 - RNA, 22 nt, Human
uagauucuaagauucuaagaau

SEQ ID NO: 626371 - RNA, 22 nt, Human
acuccaggaaacuuaggggaaa

SEQ ID NO: 626372 - RNA, 22 nt, Human
uguuacaagucuugagguacuu

SEQ ID NO: 626373 - RNA, 22 nt, Human
cugccuagggucugguaccaca

SEQ ID NO: 626374 - RNA, 21 nt, Human
aggaagaaagguuggagguug

SEQ ID NO: 626375 - RNA, 22 nt, Human
uuuggugauagugcagagaaau

SEQ ID NO: 626376 - RNA, 22 nt, Human
ucuccccaaaggacucacucuc

SEQ ID NO: 626377 - RNA, 22 nt, Human
cagagacuggagugcaguggcg

SEQ ID NO: 626378 - RNA, 22 nt, Human
ccagucucaguucacguuggua

SEQ ID NO: 626379 - RNA, 22 nt, Human
agacccugucaguguuaggaaa

SEQ ID NO: 626380 - RNA, 22 nt, Human
cagcccagaacucacgucucca

SEQ ID NO: 626381 - RNA, 22 nt, Human
cauccccaauuagcgcccagcu

SEQ ID NO: 626382 - RNA, 22 nt, Human
ugaagccaaucugccaggcaga

SEQ ID NO: 626383 - RNA, 22 nt, Human
cuggcuuuguucugauugcuuc

SEQ ID NO: 626384 - RNA, 17 nt, Human
cgugugcuugugugcac

SEQ ID NO: 626385 - RNA, 22 nt, Human
cuggcuucugggccagggcaga

SEQ ID NO: 626386 - RNA, 22 nt, Human
ucagcuccucaugcaggggaua

SEQ ID NO: 626387 - RNA, 22 nt, Human
uuucaguuuccagcuuugucau

SEQ ID NO: 626388 - RNA, 22 nt, Human
uguggcugaucaaagcgcucag

SEQ ID NO: 626389 - RNA, 22 nt, Human
guggcugcaucggggugaccag

SEQ ID NO: 626390 - RNA, 22 nt, Human
cccugcagugugaccucaccua

SEQ ID NO: 626391 - RNA, 22 nt, Human
uuccagggcuagguaaugggua

SEQ ID NO: 626392 - RNA, 22 nt, Human
uguucucucuccuuuugaagug

SEQ ID NO: 626393 - RNA, 23 nt, Human
uuucacaaugagcauuacagaau

SEQ ID NO: 626394 - RNA, 22 nt, Human
gaggccagauacucucuucugc

SEQ ID NO: 626395 - RNA, 22 nt, Human
gaagauuucuuuaugaaagaug

SEQ ID NO: 626396 - RNA, 22 nt, Human
aaagccagggacagugugcaug

SEQ ID NO: 626397 - RNA, 20 nt, Human
gagauuuccaaucaugccca

SEQ ID NO: 626398 - RNA, 22 nt, Human
ccagccauaaacccagaugacu

SEQ ID NO: 626399 - RNA, 22 nt, Human
ugcaaaaauugcuggaaucuuu

SEQ ID NO: 626400 - RNA, 22 nt, Human
ggucucaaggaauauaaugagu

SEQ ID NO: 626401 - RNA, 22 nt, Human
ggaaggggagcuaaaucuacug

SEQ ID NO: 626402 - RNA, 22 nt, Human
cugcauccauguugcugcaaag

SEQ ID NO: 626403 - RNA, 22 nt, Human
uagccgcuuaauuauuugguga

SEQ ID NO: 626404 - RNA, 22 nt, Human
aaguacauguugcucaacagcc

SEQ ID NO: 626405 - RNA, 22 nt, Human
ccuggcucagaguaugucaucg

SEQ ID NO: 626406 - RNA, 22 nt, Human
ucaggaaggcuucacacgagug

SEQ ID NO: 626407 - RNA, 22 nt, Human
uuuuccucaccuaacucaaggu

SEQ ID NO: 626408 - RNA, 22 nt, Human
aaaucucugaacuuaauaaugc

SEQ ID NO: 626409 - RNA, 22 nt, Human
ucauuuuucacacagggucacc

SEQ ID NO: 626410 - RNA, 22 nt, Human
uggcccugucugcacacaggau

SEQ ID NO: 626411 - RNA, 22 nt, Human
gaggagagccugcacuuugacc

SEQ ID NO: 626412 - RNA, 22 nt, Human
ucaggccugcagugccaaccca

SEQ ID NO: 626413 - RNA, 19 nt, Human
gccaggacauccuccugcu

SEQ ID NO: 626414 - RNA, 22 nt, Human
caagcuuuauccgccauguagg

SEQ ID NO: 626415 - RNA, 22 nt, Human
auuuugcacacuaugcagcuuu

SEQ ID NO: 626416 - RNA, 22 nt, Human
ccaggagacccagggaaggagc

SEQ ID NO: 626417 - RNA, 22 nt, Human
aagagacuauggugucuaugaa

SEQ ID NO: 626418 - RNA, 22 nt, Human
uacacaauuaguugcaaaguga

SEQ ID NO: 626419 - RNA, 22 nt, Human
gcauuuaaauuugaacuucaga

SEQ ID NO: 626420 - RNA, 22 nt, Human
auguuuccgugagcauccuuga

SEQ ID NO: 626421 - RNA, 22 nt, Human
ucuggaauucucaaguccugga

SEQ ID NO: 626422 - RNA, 22 nt, Human
ggucucagaucuuuauuaaggc

SEQ ID NO: 626423 - RNA, 22 nt, Human
aguguggcugcguagggcucuc

SEQ ID NO: 626424 - RNA, 22 nt, Human
gaauauauuucucuuaccuuua

SEQ ID NO: 626425 - RNA, 22 nt, Human
gaaggcauuuaggaacugcaau

SEQ ID NO: 626426 - RNA, 22 nt, Human
gcccuuggaaagccaaggcagc

SEQ ID NO: 626427 - RNA, 22 nt, Human
aguuaguggcaaagugguuuga

SEQ ID NO: 626428 - RNA, 22 nt, Human
ugccauggaaguggccagaccu

SEQ ID NO: 626429 - RNA, 22 nt, Human
aagggcaggagaagacggauau

SEQ ID NO: 626430 - RNA, 22 nt, Human
uaucauugcugaugugcugaga

SEQ ID NO: 626431 - RNA, 22 nt, Human
aaagagcacccucaaugucuga

SEQ ID NO: 626432 - RNA, 22 nt, Human
cauuauccaacagcacuuucca

SEQ ID NO: 626433 - RNA, 22 nt, Human
ucacugcucuccaauguggagu

SEQ ID NO: 626434 - RNA, 22 nt, Human
uaguggcugcuucauuggugag

SEQ ID NO: 626435 - RNA, 23 nt, Human
cagugggcuucuaacugcuccug

SEQ ID NO: 626436 - RNA, 18 nt, Human
gccugccuagagcuugcc

SEQ ID NO: 626437 - RNA, 22 nt, Human
aggcuucacgaugggugaggug

SEQ ID NO: 626438 - RNA, 22 nt, Human
cuggcucauuuuagcaucaggu

SEQ ID NO: 626439 - RNA, 22 nt, Human
agcugguugcuuaaccucucug

SEQ ID NO: 626440 - RNA, 22 nt, Human
cugggcuuucaggcccuaaggc

SEQ ID NO: 626441 - RNA, 22 nt, Human
ugucuucaguaaaauacacuau

SEQ ID NO: 626442 - RNA, 22 nt, Human
cccuguugggaagagagauggc

SEQ ID NO: 626443 - RNA, 22 nt, Human
gaguaaaauaggugagaaucaa

SEQ ID NO: 626444 - RNA, 22 nt, Human
augguacagauaauacaugcug

SEQ ID NO: 626445 - RNA, 22 nt, Human
gucuuucuucagagcuuggacu

SEQ ID NO: 626446 - RNA, 22 nt, Human
agcagagcagaaugugaaggug

SEQ ID NO: 626447 - RNA, 22 nt, Human
caaaauuagaaaugcagcuguu

SEQ ID NO: 626448 - RNA, 22 nt, Human
ccagcagguguagggcucaugg

SEQ ID NO: 626449 - RNA, 22 nt, Human
gggacagcagaaagaaggcaag

SEQ ID NO: 626450 - RNA, 20 nt, Human
acuaugaaguuagcccucca

SEQ ID NO: 626451 - RNA, 22 nt, Human
ggggagaauuaccaaaagcgcu

SEQ ID NO: 626452 - RNA, 22 nt, Human
gaauacaaauaauaccaaggug

SEQ ID NO: 626453 - RNA, 22 nt, Human
caaggcaaucucauggcuucuu

SEQ ID NO: 626454 - RNA, 22 nt, Human
aggcccugcuuuccagagcuca

SEQ ID NO: 626455 - RNA, 22 nt, Human
guagagucaggacggcaauucu

SEQ ID NO: 626456 - RNA, 22 nt, Human
cagccaagaaagcagugcucca

SEQ ID NO: 626457 - RNA, 22 nt, Human
auuucuccuuguugcaaugcag

SEQ ID NO: 626458 - RNA, 22 nt, Human
caaagugcuaggauuacaggcc

SEQ ID NO: 626459 - RNA, 22 nt, Human
aggcucugugaugugccaggca

SEQ ID NO: 626460 - RNA, 22 nt, Human
cuguccuggagggcauaggacg

SEQ ID NO: 626461 - RNA, 22 nt, Human
aaaaagacuuccaacucaggag

SEQ ID NO: 626462 - RNA, 22 nt, Human
guuccaaagucucugagcugag

SEQ ID NO: 626463 - RNA, 22 nt, Human
aaagaugucaguuugaaauaac

SEQ ID NO: 626464 - RNA, 21 nt, Human
cucagagacaaaugccauccc

SEQ ID NO: 626465 - RNA, 22 nt, Human
aaaugcuuguaaauuuuccaug

SEQ ID NO: 626466 - RNA, 22 nt, Human
ucccugcagacguccugcgggu

SEQ ID NO: 626467 - RNA, 22 nt, Human
uguaacugguuauaauuuuuga

SEQ ID NO: 626468 - RNA, 21 nt, Human
agucuguuaggaugacucuga

SEQ ID NO: 626469 - RNA, 22 nt, Human
aguguuaaugguguauauuagg

SEQ ID NO: 626470 - RNA, 22 nt, Human
uuuauuucacucuccggauacu

SEQ ID NO: 626471 - RNA, 21 nt, Human
agggagcauguuagcuuucga

SEQ ID NO: 626472 - RNA, 18 nt, Human
cugggacucaaugcuacu

SEQ ID NO: 626473 - RNA, 22 nt, Human
uggcccuuguucaaauauguca

SEQ ID NO: 626474 - RNA, 19 nt, Human
acugccugcagguguuggg

SEQ ID NO: 626475 - RNA, 22 nt, Human
uagccaugagcagaucacuaua

SEQ ID NO: 626476 - RNA, 22 nt, Human
gggcuguguuaggugcgguuac

SEQ ID NO: 626477 - RNA, 22 nt, Human
augccaaguacaggcacugcuc

SEQ ID NO: 626478 - RNA, 22 nt, Human
cugggugguucuaacuguugau

SEQ ID NO: 626479 - RNA, 22 nt, Human
gaguagggaugcuggugacucc

SEQ ID NO: 626480 - RNA, 22 nt, Human
gcucuggacuggggccugagaa

SEQ ID NO: 626481 - RNA, 22 nt, Human
acuuuacacaucuuuucucauu

SEQ ID NO: 626482 - RNA, 22 nt, Human
guuuacagagacagaaaguagu

SEQ ID NO: 626483 - RNA, 22 nt, Human
caauacuuccuuguuagaggca

SEQ ID NO: 626484 - RNA, 22 nt, Human
cagcuccuagaucggcgaagug

SEQ ID NO: 626485 - RNA, 19 nt, Human
ugcccaggccucccaaaag

SEQ ID NO: 626486 - RNA, 22 nt, Human
uggccacuccucccugcaggcu

SEQ ID NO: 626487 - RNA, 22 nt, Human
cugagcagaccauggcagaggu

SEQ ID NO: 626488 - RNA, 22 nt, Human
ugagaaacauaugagagauuug

SEQ ID NO: 626489 - RNA, 22 nt, Human
agcuccuugaagggcucuggga

SEQ ID NO: 626490 - RNA, 22 nt, Human
gcuguugcaaucaaggccaugg

SEQ ID NO: 626491 - RNA, 22 nt, Human
uaaacuguguaauaugaugucu

SEQ ID NO: 626492 - RNA, 22 nt, Human
ucucccuacugacuccaggacc

SEQ ID NO: 626493 - RNA, 22 nt, Human
ucaguuuccugguugugauauu

SEQ ID NO: 626494 - RNA, 22 nt, Human
gucucagauaacauguauucua

SEQ ID NO: 626495 - RNA, 22 nt, Human
cacaggagaacccacagauucu

SEQ ID NO: 626496 - RNA, 22 nt, Human
agcugaaauuuuacugaguaua

SEQ ID NO: 626497 - RNA, 20 nt, Human
cagcccuccaguggaggcag

SEQ ID NO: 626498 - RNA, 22 nt, Human
uaucuuguaauagguccacuug

SEQ ID NO: 626499 - RNA, 22 nt, Human
uuucaguggguuuauuucaugu

SEQ ID NO: 626500 - RNA, 22 nt, Human
uagcugugaaacagcagaagag

SEQ ID NO: 626501 - RNA, 22 nt, Human
cuaaacaucuugcaaugcacag

SEQ ID NO: 626502 - RNA, 22 nt, Human
cacaagcuccuuauguggagaa

SEQ ID NO: 626503 - RNA, 22 nt, Human
uggcagagacaaggccgggccu

SEQ ID NO: 626504 - RNA, 22 nt, Human
aguaaacauaauuuaccuguag

SEQ ID NO: 626505 - RNA, 22 nt, Human
gaacauaacuauugugaauagu

SEQ ID NO: 626506 - RNA, 22 nt, Human
acaguguccccagcucugugag

SEQ ID NO: 626507 - RNA, 22 nt, Human
aauuucaaagcucacuggcaua

SEQ ID NO: 626508 - RNA, 22 nt, Human
aagggcugccagggggugccag

SEQ ID NO: 626509 - RNA, 22 nt, Human
caaggcaguuccccagagggcu

SEQ ID NO: 626510 - RNA, 21 nt, Human
agcagacugaauacauucuua

SEQ ID NO: 626511 - RNA, 19 nt, Human
uuugcagugguuccuuugu

SEQ ID NO: 626512 - RNA, 22 nt, Human
aagccagaguuuuugagaacuu

SEQ ID NO: 626513 - RNA, 22 nt, Human
ccuggaaguuggagguugcagu

SEQ ID NO: 626514 - RNA, 22 nt, Human
uauuccuaauuugcagggcaug

SEQ ID NO: 626515 - RNA, 22 nt, Human
cugaggccucacuguagucccu

SEQ ID NO: 626516 - RNA, 22 nt, Human
aaggacaggagaaaacgggauc

SEQ ID NO: 626517 - RNA, 22 nt, Human
aaaagugaugggauggcacuuc

SEQ ID NO: 626518 - RNA, 22 nt, Human
aaguauuucagcgguucuuugu

SEQ ID NO: 626519 - RNA, 22 nt, Human
ugccagucucacccuggguccu

SEQ ID NO: 626520 - RNA, 20 nt, Human
ugcaguguccucacuuguca

SEQ ID NO: 626521 - RNA, 22 nt, Human
uuuucuuggaguggcuguccuu

SEQ ID NO: 626522 - RNA, 22 nt, Human
aaggaggaauaaagagguggug

SEQ ID NO: 626523 - RNA, 22 nt, Human
aggagaaggaggccccucacac

SEQ ID NO: 626524 - RNA, 22 nt, Human
cugggagcugaggcugacgcug

SEQ ID NO: 626525 - RNA, 22 nt, Human
ugacugccgauuguccuucucu

SEQ ID NO: 626526 - RNA, 22 nt, Human
aagauagaugucaucagcauau

SEQ ID NO: 626527 - RNA, 20 nt, Human
uggaaccuaggcagagcugg

SEQ ID NO: 626528 - RNA, 22 nt, Human
cauuuccacuucugaaaacugg

SEQ ID NO: 626529 - RNA, 22 nt, Human
agaggaauaaauuucuguagug

SEQ ID NO: 626530 - RNA, 22 nt, Human
aauuuucuaaggugaugaucug

SEQ ID NO: 626531 - RNA, 22 nt, Human
ucucugaguaagugacaguuca

SEQ ID NO: 626532 - RNA, 22 nt, Human
cugucuguuucugauucaaccu

SEQ ID NO: 626533 - RNA, 22 nt, Human
gucuucuuuucagucugcuugu

SEQ ID NO: 626534 - RNA, 22 nt, Human
uucagaguaggauacuagcuua

SEQ ID NO: 626535 - RNA, 22 nt, Human
uggcagugaugcggcaggacau

SEQ ID NO: 626536 - RNA, 22 nt, Human
uauguuuuuaagagaaugcauu

SEQ ID NO: 626537 - RNA, 22 nt, Human
uugauucuagaaucuucccucu

SEQ ID NO: 626538 - RNA, 22 nt, Human
aacacuucccaucagagggaca

SEQ ID NO: 626539 - RNA, 22 nt, Human
gcuucuacccacgagaugcaaa

SEQ ID NO: 626540 - RNA, 22 nt, Human
auccuguggggcggcugcaggg

SEQ ID NO: 626541 - RNA, 22 nt, Human
guccucugagggggcugcacgc

SEQ ID NO: 626542 - RNA, 22 nt, Human
ugguuucuuuccacucuccacc

SEQ ID NO: 626543 - RNA, 22 nt, Human
uucagagauggaaggcagaaug

SEQ ID NO: 626544 - RNA, 22 nt, Human
cugcuccaccuccgggucaggc

SEQ ID NO: 626545 - RNA, 22 nt, Human
ggcgcccaucggugcagagggc

SEQ ID NO: 626546 - RNA, 22 nt, Human
aguugaaaauuaagugaauuuc

SEQ ID NO: 626547 - RNA, 22 nt, Human
gaagggggagcucuuccuaauu

SEQ ID NO: 626548 - RNA, 22 nt, Human
uaucagaaggcacauggagucu

SEQ ID NO: 626549 - RNA, 22 nt, Human
acauguggucaaucuguguagg

SEQ ID NO: 626550 - RNA, 22 nt, Human
ccaggugcacucaagaccugcu

SEQ ID NO: 626551 - RNA, 22 nt, Human
cugaggcaguuuaauuuuugaa

SEQ ID NO: 626552 - RNA, 22 nt, Human
ugcugggcuagaagcugaggcc

SEQ ID NO: 626553 - RNA, 22 nt, Human
acacccagagcgccagugccga

SEQ ID NO: 626554 - RNA, 22 nt, Human
uggccucuuaaggaugacacaa

SEQ ID NO: 626555 - RNA, 22 nt, Human
uagaagaaagugaagcugggga

SEQ ID NO: 626556 - RNA, 22 nt, Human
gaaauauuacaguggaggggau

SEQ ID NO: 626557 - RNA, 19 nt, Human
uggcuguggggaaaugcuu

SEQ ID NO: 626558 - RNA, 22 nt, Human
ucuugcagacagcuuccagccu

SEQ ID NO: 626559 - RNA, 22 nt, Human
uggauugcagcagcuccugugg

SEQ ID NO: 626560 - RNA, 22 nt, Human
cugacuguaauucuguucuuaa

SEQ ID NO: 626561 - RNA, 22 nt, Human
uuuaggaagaucugaaggaaga

SEQ ID NO: 626562 - RNA, 22 nt, Human
cuguuucucccauguccaagug

SEQ ID NO: 626563 - RNA, 22 nt, Human
gccagcugcuucuccagaauuu

SEQ ID NO: 626564 - RNA, 22 nt, Human
ucaggaggcgugcugggguaca

SEQ ID NO: 626565 - RNA, 22 nt, Human
cucuggaauuaaggaagccugu

SEQ ID NO: 626566 - RNA, 22 nt, Human
aaacaagagucuugcuccaccu

SEQ ID NO: 626567 - RNA, 22 nt, Human
aaucacaauuacuuuugcacca

SEQ ID NO: 626568 - RNA, 22 nt, Human
uggcucugucacugugagcuau

SEQ ID NO: 626569 - RNA, 22 nt, Human
aucucauucucccgugccaugg

SEQ ID NO: 626570 - RNA, 22 nt, Human
cuaaacaugaacuacauuuagg

SEQ ID NO: 626571 - RNA, 17 nt, Human
gucuggaguggccuuca

SEQ ID NO: 626572 - RNA, 22 nt, Human
gagcuucagcugccaugacugu

SEQ ID NO: 626573 - RNA, 19 nt, Human
ggccagcugucuccugcua

SEQ ID NO: 626574 - RNA, 23 nt, Human
aguguguauugcugagggcagcu

SEQ ID NO: 626575 - RNA, 22 nt, Human
uucuguauuuaguuugaggaca

SEQ ID NO: 626576 - RNA, 22 nt, Human
cucuucaggaauaugucaguca

SEQ ID NO: 626577 - RNA, 19 nt, Human
uccuucuccggccaccccg

SEQ ID NO: 626578 - RNA, 22 nt, Human
ucuagagacuauaauguguccu

SEQ ID NO: 626579 - RNA, 18 nt, Human
ggcagugcagucucaggg

SEQ ID NO: 626580 - RNA, 22 nt, Human
cucugccaccaugcuuccugac

SEQ ID NO: 626581 - RNA, 22 nt, Human
aucagcauucccaaaugaugug

SEQ ID NO: 626582 - RNA, 23 nt, Human
gccagaggaacgcagagcuuucu

SEQ ID NO: 626583 - RNA, 22 nt, Human
auuucaaggcuacagaaaccuu

SEQ ID NO: 626584 - RNA, 22 nt, Human
uccuucaggccucauucucaua

SEQ ID NO: 626585 - RNA, 22 nt, Human
uggucugauuucuuucuggagu

SEQ ID NO: 626586 - RNA, 22 nt, Human
ucagcuugggaaauugagcaag

SEQ ID NO: 626587 - RNA, 22 nt, Human
acagggagaugggugaaagcgg

SEQ ID NO: 626588 - RNA, 22 nt, Human
acacagcucacaacgugugcau

SEQ ID NO: 626589 - RNA, 22 nt, Human
agaggaugauuuuaaggacacu

SEQ ID NO: 626590 - RNA, 22 nt, Human
cucugggcuuaccugcuuccug

SEQ ID NO: 626591 - RNA, 22 nt, Human
acuuauuucauggaucauaaug

SEQ ID NO: 626592 - RNA, 22 nt, Human
ccucuuugacuauaguaguuaa

SEQ ID NO: 626593 - RNA, 22 nt, Human
agcuggcauugcagggagcugc

SEQ ID NO: 626594 - RNA, 22 nt, Human
ggcggcacgcaggcugcugucg

SEQ ID NO: 626595 - RNA, 22 nt, Human
aacuucauuuauaaugucauua

SEQ ID NO: 626596 - RNA, 22 nt, Human
gcaacaggcaguuugcucaugu

SEQ ID NO: 626597 - RNA, 22 nt, Human
uguaaauaauuccuaggcuuuu

SEQ ID NO: 626598 - RNA, 22 nt, Human
agagagcaggacuucacugagc

SEQ ID NO: 626599 - RNA, 22 nt, Human
ucagcaauccucccacaggugg

SEQ ID NO: 626600 - RNA, 21 nt, Human
gccugcccucugugauggcca

SEQ ID NO: 626601 - RNA, 22 nt, Human
guuuccacgucucaguuccaaa

SEQ ID NO: 626602 - RNA, 22 nt, Human
ggcagccaugucccagggcuuc

SEQ ID NO: 626603 - RNA, 22 nt, Human
auuucacucucccugccacuua

SEQ ID NO: 626604 - RNA, 22 nt, Human
gagacacaagacgcaacucugu

SEQ ID NO: 626605 - RNA, 22 nt, Human
uagucuaagaaaucuuuacuuu

SEQ ID NO: 626606 - RNA, 18 nt, Human
gggauauaucagugaaga

SEQ ID NO: 626607 - RNA, 22 nt, Human
uugcuagcugguguaugcauug

SEQ ID NO: 626608 - RNA, 22 nt, Human
aagcuggacauuguagggggga

SEQ ID NO: 626609 - RNA, 22 nt, Human
auuuauuggaugcuuacuuggg

SEQ ID NO: 626610 - RNA, 22 nt, Human
cugggcugccagguaggcacac

SEQ ID NO: 626611 - RNA, 22 nt, Human
ccagggaagaauaggugugguu

SEQ ID NO: 626612 - RNA, 22 nt, Human
agagcugagcaccaagcauggu

SEQ ID NO: 626613 - RNA, 22 nt, Human
aacacauauuuuugcugagcau

SEQ ID NO: 626614 - RNA, 22 nt, Human
accugccuaguugguucugccc

SEQ ID NO: 626615 - RNA, 22 nt, Human
gaugauuuuaugucuugucauu

SEQ ID NO: 626616 - RNA, 22 nt, Human
auuacacuaaugugacaacaau

SEQ ID NO: 626617 - RNA, 22 nt, Human
uagaaacagaaaacuguaauag

SEQ ID NO: 626618 - RNA, 22 nt, Human
cguucuuuucauauuuacaugg

SEQ ID NO: 626619 - RNA, 22 nt, Human
ucacaguauucaugaacaugga

SEQ ID NO: 626620 - RNA, 22 nt, Human
ucacaggaaccaucagagaaau

SEQ ID NO: 626621 - RNA, 22 nt, Human
uccaagaguaagaggacucuuu

SEQ ID NO: 626622 - RNA, 22 nt, Human
ugcacuauuucgccaugguugu

SEQ ID NO: 626623 - RNA, 21 nt, Human
ugggagagcguugcuguccuc

SEQ ID NO: 626624 - RNA, 22 nt, Human
ucacucuguguuucccugggac

SEQ ID NO: 626625 - RNA, 22 nt, Human
acauuucucauaggagagccac

SEQ ID NO: 626626 - RNA, 22 nt, Human
auggagcagcagaaggggcuug

SEQ ID NO: 626627 - RNA, 22 nt, Human
augauguugauaaauuacuuua

SEQ ID NO: 626628 - RNA, 22 nt, Human
gauucuuuacaucucugcugac

SEQ ID NO: 626629 - RNA, 22 nt, Human
ugccuuuaaggaaucauucuug

SEQ ID NO: 626630 - RNA, 22 nt, Human
aacgcccgugguugccaaggua

SEQ ID NO: 626631 - RNA, 22 nt, Human
cagaguuuuauguaugcaugua

SEQ ID NO: 626632 - RNA, 22 nt, Human
ucugggaaaguaaauguaaagg

SEQ ID NO: 626633 - RNA, 20 nt, Human
ugacauagcucuuggggugc

SEQ ID NO: 626634 - RNA, 22 nt, Human
ccacagaguccgcauuugaggc

SEQ ID NO: 626635 - RNA, 21 nt, Human
agguuuauuucaacuucagga

SEQ ID NO: 626636 - RNA, 22 nt, Human
ggcaguggcauguggguagugg

SEQ ID NO: 626637 - RNA, 22 nt, Human
gauuuuaucuuugugugcagua

SEQ ID NO: 626638 - RNA, 22 nt, Human
augcacuguuggauauauuugu

SEQ ID NO: 626639 - RNA, 22 nt, Human
uaaaguguguauauacauaugg

SEQ ID NO: 626640 - RNA, 22 nt, Human
cuuguagcugcuucuucugaag

SEQ ID NO: 626641 - RNA, 22 nt, Human
auuaguguucuuaucuucuagg

SEQ ID NO: 626642 - RNA, 22 nt, Human
cauccaguggucagggaaguug

SEQ ID NO: 626643 - RNA, 22 nt, Human
ugugugcacugccuuuugugga

SEQ ID NO: 626644 - RNA, 22 nt, Human
gugaggucaccggccguugcca

SEQ ID NO: 626645 - RNA, 22 nt, Human
ugcugcugaugcauagucugcu

SEQ ID NO: 626646 - RNA, 22 nt, Human
guguguggacgucugagcccag

SEQ ID NO: 626647 - RNA, 22 nt, Human
uccuggcuuccacuccucuguu

SEQ ID NO: 626648 - RNA, 22 nt, Human
uuuuccuuugauucccagaugu

SEQ ID NO: 626649 - RNA, 22 nt, Human
cuggcugaguuacuccacugag

SEQ ID NO: 626650 - RNA, 22 nt, Human
gucuucaacaauaacuaccacu

SEQ ID NO: 626651 - RNA, 22 nt, Human
gaacuuuaaucccuugggcuua

SEQ ID NO: 626652 - RNA, 22 nt, Human
aguucauggaagauucaaugga

SEQ ID NO: 626653 - RNA, 22 nt, Human
ugguccuggagaucaauaugca

SEQ ID NO: 626654 - RNA, 22 nt, Human
aauagaaaggaggggcucuugu

SEQ ID NO: 626655 - RNA, 21 nt, Human
guacacacagguggaugggcu

SEQ ID NO: 626656 - RNA, 22 nt, Human
gguucaguggaauguguugacc

SEQ ID NO: 626657 - RNA, 22 nt, Human
gaaagugcuuuugagugugugc

SEQ ID NO: 626658 - RNA, 22 nt, Human
auucaaaccucauuuauuguuc

SEQ ID NO: 626659 - RNA, 22 nt, Human
cccuccugugccugaggccagc

SEQ ID NO: 626660 - RNA, 22 nt, Human
aggccagcaccagagucaagaa

SEQ ID NO: 626661 - RNA, 18 nt, Human
agaauugcugcuucuucu

SEQ ID NO: 626662 - RNA, 22 nt, Human
caggcagagacgucaguguagg

SEQ ID NO: 626663 - RNA, 22 nt, Human
agcugagccagcagcaacagga

SEQ ID NO: 626664 - RNA, 22 nt, Human
agagccugggaauuugcauguu

SEQ ID NO: 626665 - RNA, 22 nt, Human
uuggcuuucucuguaucugaau

SEQ ID NO: 626666 - RNA, 22 nt, Human
caggcugcagaggccuuucaug

SEQ ID NO: 626667 - RNA, 19 nt, Human
ugagacugggugcaguacu

SEQ ID NO: 626668 - RNA, 22 nt, Human
augcuaaagggguaggccuccu

SEQ ID NO: 626669 - RNA, 21 nt, Human
gaagacacauaaccucucucc

SEQ ID NO: 626670 - RNA, 22 nt, Human
uguggccuuucaaggauggaau

SEQ ID NO: 626671 - RNA, 22 nt, Human
ucaggaguuuggccuacagagg

SEQ ID NO: 626672 - RNA, 22 nt, Human
acugcugaccucaggucauccu

SEQ ID NO: 626673 - RNA, 22 nt, Human
augugucugauggcccugaauu

SEQ ID NO: 626674 - RNA, 22 nt, Human
ucuggcagggguucugcacuug

SEQ ID NO: 626675 - RNA, 22 nt, Human
ugcaggagcagagauggcugga

SEQ ID NO: 626676 - RNA, 22 nt, Human
guuuccuaggcuuauacagcug

SEQ ID NO: 626677 - RNA, 20 nt, Human
agguccugguucucugggau

SEQ ID NO: 626678 - RNA, 22 nt, Human
ggguggcugacuguuuugugga

SEQ ID NO: 626679 - RNA, 22 nt, Human
uccaggcugggcugaagggugc

SEQ ID NO: 626680 - RNA, 22 nt, Human
caggagcagaggguggucagca

SEQ ID NO: 626681 - RNA, 22 nt, Human
cugggcuguucugccccugggu

SEQ ID NO: 626682 - RNA, 22 nt, Human
acacugagcaucucuagaggca

SEQ ID NO: 626683 - RNA, 22 nt, Human
aaacauuguaauuuuagcaugg

SEQ ID NO: 626684 - RNA, 22 nt, Human
uuucacauuggcuucuauuucu

SEQ ID NO: 626685 - RNA, 22 nt, Human
guauuugauacaugaaauggug

SEQ ID NO: 626686 - RNA, 22 nt, Human
ucucuuccauguuucagcccca

SEQ ID NO: 626687 - RNA, 22 nt, Human
aagaaaccuagucuggagcagc

SEQ ID NO: 626688 - RNA, 22 nt, Human
aucuguaacugcuaucaucucc

SEQ ID NO: 626689 - RNA, 22 nt, Human
uaggagaggugaauggcacacu

SEQ ID NO: 626690 - RNA, 20 nt, Human
acaguuuauccaguuagcag

SEQ ID NO: 626691 - RNA, 22 nt, Human
uuacaacaaaggcacgugcaug

SEQ ID NO: 626692 - RNA, 22 nt, Human
uguggggaagaguaugacuugg

SEQ ID NO: 626693 - RNA, 22 nt, Human
gcaggagccacuucagggaugc

SEQ ID NO: 626694 - RNA, 22 nt, Human
gcagcuuucuuuuugcaugucu

SEQ ID NO: 626695 - RNA, 22 nt, Human
uggugugaggcgggaguguagu

SEQ ID NO: 626696 - RNA, 22 nt, Human
uggccugccucccggcuucuuu

SEQ ID NO: 626697 - RNA, 22 nt, Human
cuggagaagagguaguauguag

SEQ ID NO: 626698 - RNA, 22 nt, Human
gcccuuggggugucuguaauaa

SEQ ID NO: 626699 - RNA, 22 nt, Human
agcagguguuuguaucauaagg

SEQ ID NO: 626700 - RNA, 22 nt, Human
ugagcuuacgugggaacagacu

SEQ ID NO: 626701 - RNA, 22 nt, Human
ucuucaaauccuacagugucug

SEQ ID NO: 626702 - RNA, 22 nt, Human
aaagcaugacucaagaauuacu

SEQ ID NO: 626703 - RNA, 22 nt, Human
ugaggcaggaaguuauauaaug

SEQ ID NO: 626704 - RNA, 22 nt, Human
gccuggagugcaguggcgugau

SEQ ID NO: 626705 - RNA, 22 nt, Human
uucacagcuuaauaaggcucag

SEQ ID NO: 626706 - RNA, 22 nt, Human
gaaccacaagauucaaaggggu

SEQ ID NO: 626707 - RNA, 22 nt, Human
cagaguguuucuuugggugggu

SEQ ID NO: 626708 - RNA, 22 nt, Human
uucaggauucucucccauuuac

SEQ ID NO: 626709 - RNA, 22 nt, Human
gaugaagcuaaaucuaagguuu

SEQ ID NO: 626710 - RNA, 22 nt, Human
aggauucauggugcagacaaag

SEQ ID NO: 626711 - RNA, 22 nt, Human
acgaugagauggggcuggaagg

SEQ ID NO: 626712 - RNA, 22 nt, Human
agaagccacaggccucgucugg

SEQ ID NO: 626713 - RNA, 22 nt, Human
uauuuaugucucugcagagaau

SEQ ID NO: 626714 - RNA, 22 nt, Human
ugcuaaauucauuauugauuua

SEQ ID NO: 626715 - RNA, 22 nt, Human
agagccaggaugucuucugggg

SEQ ID NO: 626716 - RNA, 22 nt, Human
gggagcuggggcauuuauaccc

SEQ ID NO: 626717 - RNA, 22 nt, Human
caggccacgccccggcguguga

SEQ ID NO: 626718 - RNA, 22 nt, Human
cugacauuuacugagcacuuac

SEQ ID NO: 626719 - RNA, 22 nt, Human
uucaauaggaugcaugauauaa

SEQ ID NO: 626720 - RNA, 22 nt, Human
agcaggagagcagugcgugguc

SEQ ID NO: 626721 - RNA, 22 nt, Human
ugcagaaaggaggggugggaau

SEQ ID NO: 626722 - RNA, 22 nt, Human
guagaucucagacuuugaaauu

SEQ ID NO: 626723 - RNA, 22 nt, Human
guggccauuuggaaggcaagua

SEQ ID NO: 626724 - RNA, 22 nt, Human
auaggaauuucuucagcacuga

SEQ ID NO: 626725 - RNA, 22 nt, Human
aacaucuaguuccuauauaaua

SEQ ID NO: 626726 - RNA, 22 nt, Human
agccagcugccuuucacaucug

SEQ ID NO: 626727 - RNA, 22 nt, Human
gaggcucauugcauugugcauu

SEQ ID NO: 626728 - RNA, 23 nt, Human
cugggacaugguaggggcacaac

SEQ ID NO: 626729 - RNA, 22 nt, Human
acuuugugcccaacagaaagaa

SEQ ID NO: 626730 - RNA, 22 nt, Human
gcagggcuguggacacuuuggu

SEQ ID NO: 626731 - RNA, 22 nt, Human
uucuggacuugccuugcugaug

SEQ ID NO: 626732 - RNA, 22 nt, Human
aagcagcagaccugauuuugaa

SEQ ID NO: 626733 - RNA, 22 nt, Human
ugugggaaaugggaguggaaga

SEQ ID NO: 626734 - RNA, 22 nt, Human
auucaguuauuuacuuugcuau

SEQ ID NO: 626735 - RNA, 22 nt, Human
acauuauaguugcuacagagua

SEQ ID NO: 626736 - RNA, 22 nt, Human
ucaucucucaggauaccagcag

SEQ ID NO: 626737 - RNA, 22 nt, Human
gcaauauaaccaguugucaugc

SEQ ID NO: 626738 - RNA, 22 nt, Human
agucugugaaaagauaggaagu

SEQ ID NO: 626739 - RNA, 22 nt, Human
caacagaaggaagcagggucag

SEQ ID NO: 626740 - RNA, 22 nt, Human
cagugagcuccugucugucccu

SEQ ID NO: 626741 - RNA, 22 nt, Human
agagacugcgugucagcgcugg

SEQ ID NO: 626742 - RNA, 22 nt, Human
aacauuucagcaccugauuccu

SEQ ID NO: 626743 - RNA, 22 nt, Human
agaccauagggaccucagguug

SEQ ID NO: 626744 - RNA, 22 nt, Human
cagcccugagcaaggcuuuuaa

SEQ ID NO: 626745 - RNA, 22 nt, Human
auuauuuccuugcuuugaggaa

SEQ ID NO: 626746 - RNA, 22 nt, Human
uuaaagcuggcguuacaguuug

SEQ ID NO: 626747 - RNA, 22 nt, Human
auagcaauuugcccaauuaccu

SEQ ID NO: 626748 - RNA, 17 nt, Human
uguagcuucuccuucuc

SEQ ID NO: 626749 - RNA, 22 nt, Human
acagggcauuuccucuaugugu

SEQ ID NO: 626750 - RNA, 19 nt, Human
aggaaggaaccugagucug

SEQ ID NO: 626751 - RNA, 22 nt, Human
agggaagaaaauccaucgcugc

SEQ ID NO: 626752 - RNA, 22 nt, Human
cccuggcucugccucagagccc

SEQ ID NO: 626753 - RNA, 22 nt, Human
ugauggaaauuugggaagcuuu

SEQ ID NO: 626754 - RNA, 22 nt, Human
caaaugauacuguuuuuagucu

SEQ ID NO: 626755 - RNA, 22 nt, Human
ucagcugccccgggcacugccc

SEQ ID NO: 626756 - RNA, 22 nt, Human
gcucaaaucccagcgggcuccu

SEQ ID NO: 626757 - RNA, 22 nt, Human
auggcuguguuguuccucugaa

SEQ ID NO: 626758 - RNA, 22 nt, Human
cuggggcccaucgagggcugag

SEQ ID NO: 626759 - RNA, 18 nt, Human
uucuccagaaaacauagc

SEQ ID NO: 626760 - RNA, 22 nt, Human
cugugagauaugcauaugcucu

SEQ ID NO: 626761 - RNA, 22 nt, Human
caaguucacuugucuacaaggg

SEQ ID NO: 626762 - RNA, 22 nt, Human
cuggagggugagccucaucucu

SEQ ID NO: 626763 - RNA, 22 nt, Human
cucacucagacauccagugcag

SEQ ID NO: 626764 - RNA, 22 nt, Human
aaggaaagacauauaaaugacu

SEQ ID NO: 626765 - RNA, 22 nt, Human
ucagccucucugaguccagacc

SEQ ID NO: 626766 - RNA, 22 nt, Human
agaugucuguaauucuaagcau

SEQ ID NO: 626767 - RNA, 22 nt, Human
gguguuggaacauggugagauu

SEQ ID NO: 626768 - RNA, 22 nt, Human
guggcugcagagggcacagcau

SEQ ID NO: 626769 - RNA, 19 nt, Human
gcucagugaugccagacca

SEQ ID NO: 626770 - RNA, 22 nt, Human
guucacaauggcuuuaccuaag

SEQ ID NO: 626771 - RNA, 22 nt, Human
ucucugguggcuccaucaguag

SEQ ID NO: 626772 - RNA, 22 nt, Human
uacauguauguguuaauaucug

SEQ ID NO: 626773 - RNA, 22 nt, Human
agaucuuuagugaagcuaaauc

SEQ ID NO: 626774 - RNA, 22 nt, Human
cuacagaaacacuggacaugug

SEQ ID NO: 626775 - RNA, 22 nt, Human
cacugagaggucucauuuccaa

SEQ ID NO: 626776 - RNA, 22 nt, Human
uccacauucucuguuacagaua

SEQ ID NO: 626777 - RNA, 21 nt, Human
uguaugcacgcacaugcacac

SEQ ID NO: 626778 - RNA, 22 nt, Human
uucuaugugcuggagaauauuu

SEQ ID NO: 626779 - RNA, 22 nt, Human
cacauucaucaguguuguacug

SEQ ID NO: 626780 - RNA, 18 nt, Human
gaggcagcuagcaauuuu

SEQ ID NO: 626781 - RNA, 22 nt, Human
ggcuuuggggugugcagagaug

SEQ ID NO: 626782 - RNA, 16 nt, Human
ugccugcucugaucuc

SEQ ID NO: 626783 - RNA, 22 nt, Human
agcugcagagguuugugcaaca

SEQ ID NO: 626784 - RNA, 22 nt, Human
caggcagaggaagucugggucu

SEQ ID NO: 626785 - RNA, 22 nt, Human
ggacauuuuucuuccuacaaug

SEQ ID NO: 626786 - RNA, 22 nt, Human
agagggcuuugauucucaguuc

SEQ ID NO: 626787 - RNA, 22 nt, Human
augucaggacccuacugcauug

SEQ ID NO: 626788 - RNA, 22 nt, Human
acagaauugggguucuugggga

SEQ ID NO: 626789 - RNA, 22 nt, Human
cggagcagagccacucgggccg

SEQ ID NO: 626790 - RNA, 22 nt, Human
ccaggccuuucuucuuggucug

SEQ ID NO: 626791 - RNA, 22 nt, Human
uugcauuugcucauuugauaug

SEQ ID NO: 626792 - RNA, 22 nt, Human
aaacaucuacuguaggcuggag

SEQ ID NO: 626793 - RNA, 22 nt, Human
gaucauuggccuuucugcagug

SEQ ID NO: 626794 - RNA, 22 nt, Human
ucugugugggauaguuugagga

SEQ ID NO: 626795 - RNA, 22 nt, Human
uaaccugggaucugacgggaug

SEQ ID NO: 626796 - RNA, 22 nt, Human
cagcccuuccaggcagaauucu

SEQ ID NO: 626797 - RNA, 22 nt, Human
ucaagugcuugugagguauuug

SEQ ID NO: 626798 - RNA, 22 nt, Human
agccuggaggccaggagacagu

SEQ ID NO: 626799 - RNA, 22 nt, Human
ugugguggcuauucuggucuca

SEQ ID NO: 626800 - RNA, 22 nt, Human
acauauugagcucuaaaaguac

SEQ ID NO: 626801 - RNA, 17 nt, Human
gucagcagcuugcuugu

SEQ ID NO: 626802 - RNA, 22 nt, Human
aggccugaaguguggagugggg

SEQ ID NO: 626803 - RNA, 22 nt, Human
uaagaaacccaggaauuucuua

SEQ ID NO: 626804 - RNA, 22 nt, Human
gugcgugaggccccugagcgaa

SEQ ID NO: 626805 - RNA, 22 nt, Human
caggaacaaucuuacuacuauu

SEQ ID NO: 626806 - RNA, 22 nt, Human
ugugccauuucuauucugcagc

SEQ ID NO: 626807 - RNA, 22 nt, Human
uuuguacauccuaauucugagu

SEQ ID NO: 626808 - RNA, 20 nt, Human
ucuuuaguuccuggcccuuu

SEQ ID NO: 626809 - RNA, 22 nt, Human
gcugagaguccaggaaaacauc

SEQ ID NO: 626810 - RNA, 22 nt, Human
cuuuugcagccauuauugcugc

SEQ ID NO: 626811 - RNA, 22 nt, Human
gcauccauucacucaacuuaga

SEQ ID NO: 626812 - RNA, 22 nt, Human
ccccuuccacagugcuuccuaa

SEQ ID NO: 626813 - RNA, 22 nt, Human
guugguuaggucaggauucaga

SEQ ID NO: 626814 - RNA, 22 nt, Human
ucucauguuuuaccuguccuca

SEQ ID NO: 626815 - RNA, 22 nt, Human
augaaauaucuugaagaaauuc

SEQ ID NO: 626816 - RNA, 22 nt, Human
agcugcccucgcuggggccaga

SEQ ID NO: 626817 - RNA, 22 nt, Human
agcccagauaaaguacaaccau

SEQ ID NO: 626818 - RNA, 22 nt, Human
aguaucaaggaucuccagcacc

SEQ ID NO: 626819 - RNA, 22 nt, Human
aggccagaguuaaggagaacag

SEQ ID NO: 626820 - RNA, 22 nt, Human
uguuuaacuaguuuucacacuu

SEQ ID NO: 626821 - RNA, 22 nt, Human
uccucacaagcauccugucuca

SEQ ID NO: 626822 - RNA, 22 nt, Human
acuccagggcugaacgaggccc

SEQ ID NO: 626823 - RNA, 22 nt, Human
ucuggggaugaggaccuagaug

SEQ ID NO: 626824 - RNA, 22 nt, Human
caggaugguggcaugaucagaa

SEQ ID NO: 626825 - RNA, 22 nt, Human
cauguacaaggaugcucagagu

SEQ ID NO: 626826 - RNA, 22 nt, Human
gagguauuugauccucugcagu

SEQ ID NO: 626827 - RNA, 22 nt, Human
uauuauuaaauggcagaauuuu

SEQ ID NO: 626828 - RNA, 22 nt, Human
uugaauaaaugagcagugaauu

SEQ ID NO: 626829 - RNA, 22 nt, Human
uuucuucauucaccuucacccc

SEQ ID NO: 626830 - RNA, 22 nt, Human
ugagcagcaacuguccauggca

SEQ ID NO: 626831 - RNA, 19 nt, Human
gccuuggcauucucugcuu

SEQ ID NO: 626832 - RNA, 22 nt, Human
cggcuucaugagaaaugacaga

SEQ ID NO: 626833 - RNA, 22 nt, Human
cccacugagccuauacaaacag

SEQ ID NO: 626834 - RNA, 22 nt, Human
ugcaagggguuuaugcagauga

SEQ ID NO: 626835 - RNA, 22 nt, Human
acauguuagaaaugcagaaucu

SEQ ID NO: 626836 - RNA, 22 nt, Human
aguuucuuuagauagaaaguuc

SEQ ID NO: 626837 - RNA, 22 nt, Human
aagacacaaagcuucccuuuuc

SEQ ID NO: 626838 - RNA, 22 nt, Human
gccaccugccaacuugcuggaa

SEQ ID NO: 626839 - RNA, 22 nt, Human
aaacagaugaguuauaauagcc

SEQ ID NO: 626840 - RNA, 22 nt, Human
gcuuccuggaacaacuguugcu

SEQ ID NO: 626841 - RNA, 22 nt, Human
ucagagaaguaagguggggugc

SEQ ID NO: 626842 - RNA, 22 nt, Human
ucgauagaauauacuagcugug

SEQ ID NO: 626843 - RNA, 22 nt, Human
caaggcagcuauugucuccaua

SEQ ID NO: 626844 - RNA, 22 nt, Human
acagauuuaggacuguagcgau

SEQ ID NO: 626845 - RNA, 22 nt, Human
auucacaaguugauggauauuu

SEQ ID NO: 626846 - RNA, 22 nt, Human
ggcaggcagccuccauccacag

SEQ ID NO: 626847 - RNA, 22 nt, Human
ucaggagauggucuuuauaggc

SEQ ID NO: 626848 - RNA, 22 nt, Human
uuugcagucaaauuugcuaaau

SEQ ID NO: 626849 - RNA, 22 nt, Human
aaaguugaguuuuauguguuac

SEQ ID NO: 626850 - RNA, 23 nt, Human
acuccccagucucuucuugccaa

SEQ ID NO: 626851 - RNA, 22 nt, Human
gcagaauguaggccuucagugu

SEQ ID NO: 626852 - RNA, 22 nt, Human
ucugagcuuuagcugggauuuu

SEQ ID NO: 626853 - RNA, 22 nt, Human
uagggcugaggcaacaagggag

SEQ ID NO: 626854 - RNA, 22 nt, Human
uccugcagccacugcaggcaga

SEQ ID NO: 626855 - RNA, 22 nt, Human
auauuguuaguaauauuucgaa

SEQ ID NO: 626856 - RNA, 22 nt, Human
caggguucagugggcccucuug

SEQ ID NO: 626857 - RNA, 22 nt, Human
augcugagacuggagcagcugg

SEQ ID NO: 626858 - RNA, 22 nt, Human
uugaugaguuauccauuugacu

SEQ ID NO: 626859 - RNA, 22 nt, Human
auacaaaauauauacuggagac

SEQ ID NO: 626860 - RNA, 22 nt, Human
uugaaguuuaaugguagauucc

SEQ ID NO: 626861 - RNA, 20 nt, Human
ucuucuguugccuuguucug

SEQ ID NO: 626862 - RNA, 22 nt, Human
ucaugcaggaccaccccagcau

SEQ ID NO: 626863 - RNA, 22 nt, Human
acagagccuccaggagugcugg

SEQ ID NO: 626864 - RNA, 22 nt, Human
gaaugcaguggugagaucuugg

SEQ ID NO: 626865 - RNA, 22 nt, Human
cauguauauuucuguaugugca

SEQ ID NO: 626866 - RNA, 22 nt, Human
ccaaaucaccagcacgaucauu

SEQ ID NO: 626867 - RNA, 22 nt, Human
ucuacaaauaaauuacuaugua

SEQ ID NO: 626868 - RNA, 22 nt, Human
aagcccagggaauggucgggag

SEQ ID NO: 626869 - RNA, 22 nt, Human
uuugagaacccuguauuuuaag

SEQ ID NO: 626870 - RNA, 22 nt, Human
ugagauggguggggagcucagg

SEQ ID NO: 626871 - RNA, 22 nt, Human
ggaugggcugaaagguagcccc

SEQ ID NO: 626872 - RNA, 22 nt, Human
auuguuaauaacuauuacauug

SEQ ID NO: 626873 - RNA, 22 nt, Human
acagcucugagauauuacuauu

SEQ ID NO: 626874 - RNA, 23 nt, Human
aaagccaagucagucuacuggaa

SEQ ID NO: 626875 - RNA, 21 nt, Human
agaugcaguuaugagaugcag

SEQ ID NO: 626876 - RNA, 22 nt, Human
gaaauucaaauaagauauguag

SEQ ID NO: 626877 - RNA, 22 nt, Human
uuagggcuuuucugaauaggcc

SEQ ID NO: 626878 - RNA, 22 nt, Human
cagagacauucuccccauugga

SEQ ID NO: 626879 - RNA, 22 nt, Human
gaugagcugugauuaauaagua

SEQ ID NO: 626880 - RNA, 22 nt, Human
agaauccugaugaaaaggagag

SEQ ID NO: 626881 - RNA, 22 nt, Human
aaccucaaacucuugggcuuaa

SEQ ID NO: 626882 - RNA, 22 nt, Human
ggaggccaggaugggaacucaa

SEQ ID NO: 626883 - RNA, 22 nt, Human
agcacaggacguagagcuugga

SEQ ID NO: 626884 - RNA, 22 nt, Human
aacacugacgacgugaacuaaa

SEQ ID NO: 626885 - RNA, 22 nt, Human
gccuggcugcugguucugagga

SEQ ID NO: 626886 - RNA, 22 nt, Human
guguguauuauugcauacacau

SEQ ID NO: 626887 - RNA, 22 nt, Human
acuggcagcagcagcccuuggg

SEQ ID NO: 626888 - RNA, 22 nt, Human
gucugcuguucagagauguugc

SEQ ID NO: 626889 - RNA, 22 nt, Human
agauucauuauuaaugugaucu

SEQ ID NO: 626890 - RNA, 22 nt, Human
aucagaaauugcccagcuguuu

SEQ ID NO: 626891 - RNA, 22 nt, Human
cuccugagucuccacgccccgu

SEQ ID NO: 626892 - RNA, 22 nt, Human
aaagccauuacaaaauuucaua

SEQ ID NO: 626893 - RNA, 22 nt, Human
auugccuugucagauuucuuuu

SEQ ID NO: 626894 - RNA, 22 nt, Human
ucccagcacgucugcuguuucu

SEQ ID NO: 626895 - RNA, 22 nt, Human
agccucugauggcucccaagga

SEQ ID NO: 626896 - RNA, 22 nt, Human
ucucaagcuuguugguauguuu

SEQ ID NO: 626897 - RNA, 22 nt, Human
uaggcugggcauucuggccagg

SEQ ID NO: 626898 - RNA, 22 nt, Human
cacauauaccucuucuugaguu

SEQ ID NO: 626899 - RNA, 22 nt, Human
guuugcauguauuaagucaaua

SEQ ID NO: 626900 - RNA, 22 nt, Human
agcaccuucacaggcucucagg

SEQ ID NO: 626901 - RNA, 22 nt, Human
uguauuuaagcuuuaccuaaaa

SEQ ID NO: 626902 - RNA, 22 nt, Human
cguggccacccaguggugcgug

SEQ ID NO: 626903 - RNA, 22 nt, Human
uggagcagcacaagaaagggga

SEQ ID NO: 626904 - RNA, 22 nt, Human
cacagcuucuccuugauaucgc

SEQ ID NO: 626905 - RNA, 22 nt, Human
cuggccacugguggucauaggc

SEQ ID NO: 626906 - RNA, 22 nt, Human
ccagaggcuggcagccagcuga

SEQ ID NO: 626907 - RNA, 19 nt, Human
uguguucaaacuccaucuc

SEQ ID NO: 626908 - RNA, 21 nt, Human
auaugaguuucagauguugcu

SEQ ID NO: 626909 - RNA, 22 nt, Human
caaugucugaccguuuugccca

SEQ ID NO: 626910 - RNA, 22 nt, Human
aaucuucacucuuaacugugca

SEQ ID NO: 626911 - RNA, 21 nt, Human
gcagcaaaugacaacagugag

SEQ ID NO: 626912 - RNA, 22 nt, Human
aacagaacuguuguucuggagg

SEQ ID NO: 626913 - RNA, 21 nt, Human
ggccugaaaaagugaaugcuu

SEQ ID NO: 626914 - RNA, 22 nt, Human
cauuuguacagaacagcuuuau

SEQ ID NO: 626915 - RNA, 22 nt, Human
acaggaguuaaccaugggaagu

SEQ ID NO: 626916 - RNA, 22 nt, Human
cuggggcugcagcgaucuucau

SEQ ID NO: 626917 - RNA, 22 nt, Human
cggggaggcuucggauuaaagc

SEQ ID NO: 626918 - RNA, 22 nt, Human
gcucagggaaugagaagauguu

SEQ ID NO: 626919 - RNA, 22 nt, Human
gagccaggaagaaggccuuacu

SEQ ID NO: 626920 - RNA, 19 nt, Human
gagcagcuuccuaucuggu

SEQ ID NO: 626921 - RNA, 22 nt, Human
aaaauauuuuagggccaggaga

SEQ ID NO: 626922 - RNA, 22 nt, Human
cccagaggcugaguugggagca

SEQ ID NO: 626923 - RNA, 22 nt, Human
cuuucucuguguuucacaugcu

SEQ ID NO: 626924 - RNA, 22 nt, Human
agcagauaggacauuucauucu

SEQ ID NO: 626925 - RNA, 22 nt, Human
ucagaucuggugaaguuauagu

SEQ ID NO: 626926 - RNA, 22 nt, Human
gccucaguaaccuuaggggaua

SEQ ID NO: 626927 - RNA, 22 nt, Human
agucauauguggcauuuucuaa

SEQ ID NO: 626928 - RNA, 21 nt, Human
cugcucuggggaccggcugug

SEQ ID NO: 626929 - RNA, 22 nt, Human
gcaggaguaugcagcuaugguu

SEQ ID NO: 626930 - RNA, 22 nt, Human
gacugcuuauauguuaaagaua

SEQ ID NO: 626931 - RNA, 19 nt, Human
cugaggugcaguaagaggc

SEQ ID NO: 626932 - RNA, 22 nt, Human
ggucugagugccagggagagaa

SEQ ID NO: 626933 - RNA, 22 nt, Human
gucugcugcuucuguugaagca

SEQ ID NO: 626934 - RNA, 22 nt, Human
gcucuugucaaaaauuaguuga

SEQ ID NO: 626935 - RNA, 22 nt, Human
uucaagaugacccagucacacg

SEQ ID NO: 626936 - RNA, 22 nt, Human
cccaaaaugugcauguucgaau

SEQ ID NO: 626937 - RNA, 22 nt, Human
cuacugaguccuucagcugcca

SEQ ID NO: 626938 - RNA, 22 nt, Human
ugcagcuccucuggcugccuga

SEQ ID NO: 626939 - RNA, 22 nt, Human
cucuccaggacuuuggcccaau

SEQ ID NO: 626940 - RNA, 22 nt, Human
acacauaugucauugaaaaauc

SEQ ID NO: 626941 - RNA, 22 nt, Human
cuuuccugaggaguauggcugu

SEQ ID NO: 626942 - RNA, 22 nt, Human
auggcuguguuagaugcuaagu

SEQ ID NO: 626943 - RNA, 22 nt, Human
caaugacagguucaugacuccu

SEQ ID NO: 626944 - RNA, 22 nt, Human
aucauuaaauauaagcuucaca

SEQ ID NO: 626945 - RNA, 22 nt, Human
aaguaugucuuuggguauuauu

SEQ ID NO: 626946 - RNA, 22 nt, Human
agcagacaauugccuggaugga

SEQ ID NO: 626947 - RNA, 22 nt, Human
uggcaccaggcgggguggcugu

SEQ ID NO: 626948 - RNA, 22 nt, Human
uuuuucucuaaguagucccaaa

SEQ ID NO: 626949 - RNA, 22 nt, Human
ucuuuuguggaugaagaaaugg

SEQ ID NO: 626950 - RNA, 22 nt, Human
ugagccaagaucaugccguugu

SEQ ID NO: 626951 - RNA, 22 nt, Human
uuggcuucucuuaacccuaaag

SEQ ID NO: 626952 - RNA, 21 nt, Human
gagagggcauuauaggaagug

SEQ ID NO: 626953 - RNA, 22 nt, Human
acaggugugagaacaugccuug

SEQ ID NO: 626954 - RNA, 22 nt, Human
cuuugaauuaacgacacaagug

SEQ ID NO: 626955 - RNA, 22 nt, Human
auauucuuccaaaacaucauuu

SEQ ID NO: 626956 - RNA, 22 nt, Human
auuauugugauaggugucagug

SEQ ID NO: 626957 - RNA, 22 nt, Human
acagagaccaguuacagcgucc

SEQ ID NO: 626958 - RNA, 22 nt, Human
agucuugcucuugcaucugcuu

SEQ ID NO: 626959 - RNA, 22 nt, Human
uauauauucuuaaguaguguag

SEQ ID NO: 626960 - RNA, 22 nt, Human
ucuaggaguaaugagcuagcac

SEQ ID NO: 626961 - RNA, 22 nt, Human
gggcagugaauauuggugggaa

SEQ ID NO: 626962 - RNA, 22 nt, Human
gacacaggaaaagcuccagccc

SEQ ID NO: 626963 - RNA, 22 nt, Human
ccugagugaauucccucacugu

SEQ ID NO: 626964 - RNA, 22 nt, Human
acuugaaaggaagcucuaaaac

SEQ ID NO: 626965 - RNA, 23 nt, Human
aaauaggaguaucuggaucauga

SEQ ID NO: 626966 - RNA, 22 nt, Human
ggcucuugagaggcacagguuu

SEQ ID NO: 626967 - RNA, 21 nt, Human
aaacugaccuugccugagaca

SEQ ID NO: 626968 - RNA, 17 nt, Human
ggccauggugcaagguu

SEQ ID NO: 626969 - RNA, 22 nt, Human
gugagcaguugugagccccaaa

SEQ ID NO: 626970 - RNA, 22 nt, Human
uagaaacaagggagaggauucu

SEQ ID NO: 626971 - RNA, 17 nt, Human
acacaagcaccuugagg

SEQ ID NO: 626972 - RNA, 22 nt, Human
auauuuucacagaacuugcaaa

SEQ ID NO: 626973 - RNA, 22 nt, Human
ccacagcaggacuggagccgcc

SEQ ID NO: 626974 - RNA, 20 nt, Human
ggcuuggcugccuggggagg

SEQ ID NO: 626975 - RNA, 22 nt, Human
aggucagaaaaggagagcauug

SEQ ID NO: 626976 - RNA, 22 nt, Human
aaagaugucacaagaugugaug

SEQ ID NO: 626977 - RNA, 22 nt, Human
agucuccagaaauauagcagug

SEQ ID NO: 626978 - RNA, 22 nt, Human
gggcagcucucacagcagccaa

SEQ ID NO: 626979 - RNA, 22 nt, Human
guggcagcucauguuguuuuaa

SEQ ID NO: 626980 - RNA, 21 nt, Human
agaaucauuuuucccuucucu

SEQ ID NO: 626981 - RNA, 21 nt, Human
gccauguuuccuuacuaagag

SEQ ID NO: 626982 - RNA, 22 nt, Human
uucuauugcacacaaauaauua

SEQ ID NO: 626983 - RNA, 22 nt, Human
uaacaguauugaagauaaacua

SEQ ID NO: 626984 - RNA, 22 nt, Human
ccuggaaggugaugguacagca

SEQ ID NO: 626985 - RNA, 20 nt, Human
uuggggcauccaccgaaugg

SEQ ID NO: 626986 - RNA, 18 nt, Human
gucagaggauggggaaau

SEQ ID NO: 626987 - RNA, 18 nt, Human
gcagcuuuugauucaccc

SEQ ID NO: 626988 - RNA, 22 nt, Human
cagcccuguccagcagagggug

SEQ ID NO: 626989 - RNA, 22 nt, Human
gggcuguaggagcuggaauggg

SEQ ID NO: 626990 - RNA, 22 nt, Human
gacagcuucuugggccgggccu

SEQ ID NO: 626991 - RNA, 22 nt, Human
aacaugaaaaccuccacagcaa

SEQ ID NO: 626992 - RNA, 22 nt, Human
gccagcucccaagugagccccu

SEQ ID NO: 626993 - RNA, 22 nt, Human
gugugcagggggccagcgcagc

SEQ ID NO: 626994 - RNA, 21 nt, Human
gcaugaaaacagccugugcuc

SEQ ID NO: 626995 - RNA, 22 nt, Human
gcugcuguugauuuaguccaau

SEQ ID NO: 626996 - RNA, 22 nt, Human
cccagggguucugagcagcagc

SEQ ID NO: 626997 - RNA, 22 nt, Human
uuaaaugaacgagauaugcaac

SEQ ID NO: 626998 - RNA, 22 nt, Human
acaaguaccaaaugcucaagua

SEQ ID NO: 626999 - RNA, 22 nt, Human
aaacucuuuugcauauuagagg

SEQ ID NO: 627000 - RNA, 23 nt, Human
uggucugacuuguagcugugaga

SEQ ID NO: 627001 - RNA, 22 nt, Human
uccagaaacuuuuccagucuca

SEQ ID NO: 627002 - RNA, 22 nt, Human
aggggaugccugaggaucugua

SEQ ID NO: 627003 - RNA, 22 nt, Human
uccugagcuacaguaguaugau

SEQ ID NO: 627004 - RNA, 22 nt, Human
gucuaaagcccuuagaauagua

SEQ ID NO: 627005 - RNA, 22 nt, Human
aggcucuuugagacuaccugga

SEQ ID NO: 627006 - RNA, 22 nt, Human
uacauuccaaaggaaacuggcu

SEQ ID NO: 627007 - RNA, 20 nt, Human
uccuggaguauuccaugcuu

SEQ ID NO: 627008 - RNA, 22 nt, Human
gccugguguccagaggcgagug

SEQ ID NO: 627009 - RNA, 22 nt, Human
ugguuccuacgcacauugaauu

SEQ ID NO: 627010 - RNA, 22 nt, Human
agguccagaguugagauacaga

SEQ ID NO: 627011 - RNA, 22 nt, Human
uugacaguugaggguugucuaa

SEQ ID NO: 627012 - RNA, 22 nt, Human
ggcaauaguuguggguucuuua

SEQ ID NO: 627013 - RNA, 22 nt, Human
cuucccugauaagagccucaga

SEQ ID NO: 627014 - RNA, 22 nt, Human
gcauguguggaggagaugugcu

SEQ ID NO: 627015 - RNA, 21 nt, Human
uagcaggagcgaauuuugaug

SEQ ID NO: 627016 - RNA, 17 nt, Human
aaacaaugcagacaagc

SEQ ID NO: 627017 - RNA, 22 nt, Human
uuacaaacaagaucuuauucuu

SEQ ID NO: 627018 - RNA, 22 nt, Human
uaaagaugcccacauugcaggu

SEQ ID NO: 627019 - RNA, 22 nt, Human
ucccuaggagaauugccgcagc

SEQ ID NO: 627020 - RNA, 22 nt, Human
auuuaugauuagccuauuguug

SEQ ID NO: 627021 - RNA, 22 nt, Human
ugaguguguauuauguaucagg

SEQ ID NO: 627022 - RNA, 22 nt, Human
uccagggcuccccaacauccag

SEQ ID NO: 627023 - RNA, 22 nt, Human
cacugcccaggaccugccaccc

SEQ ID NO: 627024 - RNA, 19 nt, Human
gcacacaguagggcuggca

SEQ ID NO: 627025 - RNA, 22 nt, Human
ucugggaacauggcuuggaauc

SEQ ID NO: 627026 - RNA, 22 nt, Human
cuguuccagaucaggacaccgu

SEQ ID NO: 627027 - RNA, 22 nt, Human
uggguccuugcuaacuucuaug

SEQ ID NO: 627028 - RNA, 22 nt, Human
aauaguguuguucacucaggag

SEQ ID NO: 627029 - RNA, 22 nt, Human
auuuugugaacccucaagcaau

SEQ ID NO: 627030 - RNA, 22 nt, Human
uggcuucugcauauuuuuagag

SEQ ID NO: 627031 - RNA, 22 nt, Human
gaugguuuggaaugaaguagcu

SEQ ID NO: 627032 - RNA, 22 nt, Human
uuuccucuucuucccaugucau

SEQ ID NO: 627033 - RNA, 22 nt, Human
ggggaaggauugaguugaccca

SEQ ID NO: 627034 - RNA, 22 nt, Human
aaaaguaauugcaguuuucgcc

SEQ ID NO: 627035 - RNA, 22 nt, Human
ugcugccacaaauucagcugcc

SEQ ID NO: 627036 - RNA, 18 nt, Human
ucaggcugggccuccuuc

SEQ ID NO: 627037 - RNA, 22 nt, Human
uuagcauucugccuccuauauc

SEQ ID NO: 627038 - RNA, 22 nt, Human
aaagguuuauuuaaucagggag

SEQ ID NO: 627039 - RNA, 22 nt, Human
guuauucugccaaacuuccaca

SEQ ID NO: 627040 - RNA, 22 nt, Human
aggggccauguaaguguaucac

SEQ ID NO: 627041 - RNA, 20 nt, Human
ccugucugcaauggagguca

SEQ ID NO: 627042 - RNA, 22 nt, Human
gcugggcucuuuaccccuguac

SEQ ID NO: 627043 - RNA, 22 nt, Human
guuaacuuucaggugcauguuu

SEQ ID NO: 627044 - RNA, 22 nt, Human
gcaggcggaucacuggaaguca

SEQ ID NO: 627045 - RNA, 22 nt, Human
ugcuuccugcuaaggcugccug

SEQ ID NO: 627046 - RNA, 22 nt, Human
caggcugggcugguguuagagu

SEQ ID NO: 627047 - RNA, 18 nt, Human
cugauagggguggcagcu

SEQ ID NO: 627048 - RNA, 22 nt, Human
agugucuuaguccauuugggcu

SEQ ID NO: 627049 - RNA, 22 nt, Human
agagugcccugcucugagcucu

SEQ ID NO: 627050 - RNA, 22 nt, Human
aaaucaguuguuauauuaaaga

SEQ ID NO: 627051 - RNA, 22 nt, Human
augcaggagaccaauuggaugg

SEQ ID NO: 627052 - RNA, 23 nt, Human
cugggcugcuugagucccuggcu

SEQ ID NO: 627053 - RNA, 22 nt, Human
ugaggcaguugagcuuccugag

SEQ ID NO: 627054 - RNA, 22 nt, Human
guuauucuugguggcccugcug

SEQ ID NO: 627055 - RNA, 22 nt, Human
ucucaguguguugagaggucug

SEQ ID NO: 627056 - RNA, 22 nt, Human
ugagucagugacaugaacuugu

SEQ ID NO: 627057 - RNA, 22 nt, Human
cggucugagagcaggagaaggg

SEQ ID NO: 627058 - RNA, 22 nt, Human
ugugccuggaucucugugacaa

SEQ ID NO: 627059 - RNA, 22 nt, Human
cuucacagccaacaugggcaca

SEQ ID NO: 627060 - RNA, 22 nt, Human
uucagagaaacugagguuuaga

SEQ ID NO: 627061 - RNA, 22 nt, Human
uucacacagaaucugaggagcu

SEQ ID NO: 627062 - RNA, 22 nt, Human
acagucuggaagcagggggcaa

SEQ ID NO: 627063 - RNA, 22 nt, Human
aucgcuuuacagccugcuuccu

SEQ ID NO: 627064 - RNA, 22 nt, Human
ugagcccuggcucuuucacuua

SEQ ID NO: 627065 - RNA, 22 nt, Human
agcuuuguggcuuugcaagacu

SEQ ID NO: 627066 - RNA, 23 nt, Human
aaguuguuuuuggccagggaaag

SEQ ID NO: 627067 - RNA, 22 nt, Human
acaggggcaggcaggacccuuu

SEQ ID NO: 627068 - RNA, 22 nt, Human
uggcagagaaccugggcuuugu

SEQ ID NO: 627069 - RNA, 22 nt, Human
caggcuggucccagagcauugc

SEQ ID NO: 627070 - RNA, 19 nt, Human
ucccagagucuagagguug

SEQ ID NO: 627071 - RNA, 22 nt, Human
cucaggaugcaggucacaggac

SEQ ID NO: 627072 - RNA, 21 nt, Human
uauuaauaugucuaagcugau

SEQ ID NO: 627073 - RNA, 22 nt, Human
agaguucagaaagugcagguuu

SEQ ID NO: 627074 - RNA, 22 nt, Human
cagacugugagcuccuugaggg

SEQ ID NO: 627075 - RNA, 22 nt, Human
ugcaggcuauaucuuauuugac

SEQ ID NO: 627076 - RNA, 23 nt, Human
uuacagaaaguaugcuuuuguuu

SEQ ID NO: 627077 - RNA, 22 nt, Human
cagccuugauggaugaggaagu

SEQ ID NO: 627078 - RNA, 22 nt, Human
acaauuagugaucagugaugcc

SEQ ID NO: 627079 - RNA, 22 nt, Human
ugggcucagucugcuugguccu

SEQ ID NO: 627080 - RNA, 22 nt, Human
uugggguaaaaugucguaagag

SEQ ID NO: 627081 - RNA, 20 nt, Human
cuguccccgaggucaccagg

SEQ ID NO: 627082 - RNA, 22 nt, Human
agccuggcuuagcucucucacu

SEQ ID NO: 627083 - RNA, 22 nt, Human
ccuuggcuugugggcugcagcc

SEQ ID NO: 627084 - RNA, 22 nt, Human
uggcucuguggucuuagcaugc

SEQ ID NO: 627085 - RNA, 23 nt, Human
uaagaacagacaagcauuuacau

SEQ ID NO: 627086 - RNA, 22 nt, Human
aggaaccagacagaacugaaug

SEQ ID NO: 627087 - RNA, 22 nt, Human
ucucauuugugugcaauucaga

SEQ ID NO: 627088 - RNA, 18 nt, Human
uccugggaacuugcuagc

SEQ ID NO: 627089 - RNA, 22 nt, Human
cauggcuuuguucuguuagaug

SEQ ID NO: 627090 - RNA, 22 nt, Human
acugugugaggcugggugaguc

SEQ ID NO: 627091 - RNA, 21 nt, Human
ugggccugauucccaggguca

SEQ ID NO: 627092 - RNA, 22 nt, Human
ugcuggguagaaguauuagucu

SEQ ID NO: 627093 - RNA, 22 nt, Human
ccuuucucauuuuaagcauuag

SEQ ID NO: 627094 - RNA, 22 nt, Human
uucugggcauguuacauucugu

SEQ ID NO: 627095 - RNA, 22 nt, Human
aaguucuagagguugauuuggu

SEQ ID NO: 627096 - RNA, 22 nt, Human
uggcucagaguucaucuuuuag

SEQ ID NO: 627097 - RNA, 22 nt, Human
uaaagugcgacccaguccccag

SEQ ID NO: 627098 - RNA, 22 nt, Human
aguuucucuagagucuuugaaa

SEQ ID NO: 627099 - RNA, 22 nt, Human
aagcaucuauauuccacuguga

SEQ ID NO: 627100 - RNA, 22 nt, Human
gcugcugcaugaacagcgguca

SEQ ID NO: 627101 - RNA, 22 nt, Human
caaaccugacuggggaugggcg

SEQ ID NO: 627102 - RNA, 20 nt, Human
aucagacuugcauuucagga

SEQ ID NO: 627103 - RNA, 22 nt, Human
aucaggaugacuauaaggcugc

SEQ ID NO: 627104 - RNA, 22 nt, Human
ucauucucagacucuuggccuc

SEQ ID NO: 627105 - RNA, 22 nt, Human
agacagacuuugaucuggaugu

SEQ ID NO: 627106 - RNA, 22 nt, Human
uugaagcauuguggcuuguauu

SEQ ID NO: 627107 - RNA, 22 nt, Human
ucucaggggccuggaguccugg

SEQ ID NO: 627108 - RNA, 22 nt, Human
agaauugguuggggaaugugga

SEQ ID NO: 627109 - RNA, 22 nt, Human
ucacaugaaaugcuguaaagaa

SEQ ID NO: 627110 - RNA, 22 nt, Human
uggaagaauguuugccuuauaa

SEQ ID NO: 627111 - RNA, 22 nt, Human
ugcccaagccgagcucucuguu

SEQ ID NO: 627112 - RNA, 23 nt, Human
auugaacagagagaaaaacaucc

SEQ ID NO: 627113 - RNA, 22 nt, Human
ucacaguaucacacaaggauua

SEQ ID NO: 627114 - RNA, 22 nt, Human
caaagccucugauuucacuugu

SEQ ID NO: 627115 - RNA, 22 nt, Human
ugaggcagauauuuauuggguu

SEQ ID NO: 627116 - RNA, 22 nt, Human
uucuaguugagggagacaaaua

SEQ ID NO: 627117 - RNA, 22 nt, Human
cucuuugaaauccaucacugcu

SEQ ID NO: 627118 - RNA, 22 nt, Human
ggcugagaguuuccucuggggc

SEQ ID NO: 627119 - RNA, 22 nt, Human
aggcacagccucccccaacucc

SEQ ID NO: 627120 - RNA, 22 nt, Human
ggucacaugagaugcugcccuc

SEQ ID NO: 627121 - RNA, 22 nt, Human
caguaaaugugauuuuucuugu

SEQ ID NO: 627122 - RNA, 22 nt, Human
ugcugccauggucgcugguguc

SEQ ID NO: 627123 - RNA, 22 nt, Human
cacauugaaaugacccaauaau

SEQ ID NO: 627124 - RNA, 19 nt, Human
uggaggccaggacacaggu

SEQ ID NO: 627125 - RNA, 22 nt, Human
uugcauuuccuguacuguuuga

SEQ ID NO: 627126 - RNA, 22 nt, Human
aaugcauugauugcuggaaaua

SEQ ID NO: 627127 - RNA, 22 nt, Human
ugugcucuguggaucugagcaa

SEQ ID NO: 627128 - RNA, 22 nt, Human
agcaaagacagggacgaccaag

SEQ ID NO: 627129 - RNA, 22 nt, Human
uccugccaucugcuguugaucu

SEQ ID NO: 627130 - RNA, 22 nt, Human
aucaaguuuucuuaguugacug

SEQ ID NO: 627131 - RNA, 20 nt, Human
ucugauaaaaacuacuccau

SEQ ID NO: 627132 - RNA, 22 nt, Human
uaaggaauaucauaagaaguag

SEQ ID NO: 627133 - RNA, 22 nt, Human
ucucugauguauaucagagaac

SEQ ID NO: 627134 - RNA, 22 nt, Human
caguccugucuuuaugacuuca

SEQ ID NO: 627135 - RNA, 22 nt, Human
gucaggacaagguggucuccag

SEQ ID NO: 627136 - RNA, 22 nt, Human
cacauguacagaagcaggcugg

SEQ ID NO: 627137 - RNA, 22 nt, Human
agcaggcagccauuuggaaggc

SEQ ID NO: 627138 - RNA, 23 nt, Human
auaaacugucaaaagccagcccu

SEQ ID NO: 627139 - RNA, 21 nt, Human
auuacagcaguggccaaaugc

SEQ ID NO: 627140 - RNA, 22 nt, Human
agcccucugcaaacaccugaua

SEQ ID NO: 627141 - RNA, 17 nt, Human
gcugaacaaggaaaaua

SEQ ID NO: 627142 - RNA, 21 nt, Human
aauucguuugcaacacugaua

SEQ ID NO: 627143 - RNA, 22 nt, Human
uccaggcagcccuuccugacuc

SEQ ID NO: 627144 - RNA, 22 nt, Human
gccauuuggcaaaacugacuuc

SEQ ID NO: 627145 - RNA, 22 nt, Human
agagccaggcaggcaauguuga

SEQ ID NO: 627146 - RNA, 22 nt, Human
acagcagccagccacugugagc

SEQ ID NO: 627147 - RNA, 22 nt, Human
agggaugauggaaagaagcagg

SEQ ID NO: 627148 - RNA, 22 nt, Human
ucuaggaggcggagauugcagu

SEQ ID NO: 627149 - RNA, 22 nt, Human
agucucugcaugaugcagcaca

SEQ ID NO: 627150 - RNA, 22 nt, Human
gggcaaggcagaagaguuggag

SEQ ID NO: 627151 - RNA, 22 nt, Human
uuucuagagugggcaugucuua

SEQ ID NO: 627152 - RNA, 22 nt, Human
cucaggccagguuucucccaca

SEQ ID NO: 627153 - RNA, 22 nt, Human
ugggcucauguuuauacauauc

SEQ ID NO: 627154 - RNA, 22 nt, Human
ccugagcuggcagugaccugga

SEQ ID NO: 627155 - RNA, 22 nt, Human
aaugaccucagagcacccagaa

SEQ ID NO: 627156 - RNA, 22 nt, Human
auguuuucuagaguuuaaaauc

SEQ ID NO: 627157 - RNA, 23 nt, Human
gauaggcugguuaguguaucugu

SEQ ID NO: 627158 - RNA, 22 nt, Human
uuuguguuuucccauacuauug

SEQ ID NO: 627159 - RNA, 22 nt, Human
uugcauuuuuacaaguagccag

SEQ ID NO: 627160 - RNA, 22 nt, Human
uugcugccuuggagaagcuccu

SEQ ID NO: 627161 - RNA, 22 nt, Human
uuauucuggaggaagcaaaugg

SEQ ID NO: 627162 - RNA, 22 nt, Human
ugaggcacuccaggaugcuguu

SEQ ID NO: 627163 - RNA, 23 nt, Human
gugcugugagccccuuggccucc

SEQ ID NO: 627164 - RNA, 22 nt, Human
gcaggacuugaauccaggcagu

SEQ ID NO: 627165 - RNA, 22 nt, Human
acagaugaaaaagcuuguggau

SEQ ID NO: 627166 - RNA, 21 nt, Human
ccuggacugggagcagcacug

SEQ ID NO: 627167 - RNA, 22 nt, Human
uuuucuguuacaaaguacagcg

SEQ ID NO: 627168 - RNA, 22 nt, Human
gaugaggaauuugagguuagaa

SEQ ID NO: 627169 - RNA, 22 nt, Human
cucucaguuuccucaacuguaa

SEQ ID NO: 627170 - RNA, 22 nt, Human
ugucacauguguggcauuuuuc

SEQ ID NO: 627171 - RNA, 22 nt, Human
agcagcagaagguuugcaccca

SEQ ID NO: 627172 - RNA, 21 nt, Human
ucagaggcacugagagcaaug

SEQ ID NO: 627173 - RNA, 22 nt, Human
uacaaagccugguagauaucug

SEQ ID NO: 627174 - RNA, 22 nt, Human
cuguggcucucagaggcugcug

SEQ ID NO: 627175 - RNA, 23 nt, Human
acaagcagcccagugcucugccu

SEQ ID NO: 627176 - RNA, 22 nt, Human
uauacacauaucuucuaggccu

SEQ ID NO: 627177 - RNA, 22 nt, Human
auuauucuuugauaaauggcag

SEQ ID NO: 627178 - RNA, 22 nt, Human
accugccagaauccaagccaca

SEQ ID NO: 627179 - RNA, 19 nt, Human
auucuucucuuccugcugu

SEQ ID NO: 627180 - RNA, 22 nt, Human
cucauggagggagugcucuucc

SEQ ID NO: 627181 - RNA, 22 nt, Human
uggucaaaagcuacuaugaaug

SEQ ID NO: 627182 - RNA, 22 nt, Human
cuccagagguccccgcggcacu

SEQ ID NO: 627183 - RNA, 22 nt, Human
uuauugaaggaacugaaauaaa

SEQ ID NO: 627184 - RNA, 22 nt, Human
aaccuagaguugccuuuuuuaa

SEQ ID NO: 627185 - RNA, 22 nt, Human
gcaguuuuauuaugauggaaau

SEQ ID NO: 627186 - RNA, 22 nt, Human
ucuggcuccacuuucuucauuu

SEQ ID NO: 627187 - RNA, 19 nt, Human
aggagccuugagcagugag

SEQ ID NO: 627188 - RNA, 22 nt, Human
uuaauuaacuagccaaccacua

SEQ ID NO: 627189 - RNA, 22 nt, Human
ucaucugaacaugcagccugug

SEQ ID NO: 627190 - RNA, 22 nt, Human
cuaauaacaugaacuacuuucu

SEQ ID NO: 627191 - RNA, 22 nt, Human
gagaggcuggcagugccagguu

SEQ ID NO: 627192 - RNA, 22 nt, Human
gcucugaggcugggagcacucu

SEQ ID NO: 627193 - RNA, 22 nt, Human
cuggcugugcugcaggcuuugg

SEQ ID NO: 627194 - RNA, 22 nt, Human
ccucccuuggccauagccagcc

SEQ ID NO: 627195 - RNA, 22 nt, Human
ccuggcugggccugauuucuca

SEQ ID NO: 627196 - RNA, 22 nt, Human
ggugagaguuaugauuccaauu

SEQ ID NO: 627197 - RNA, 22 nt, Human
aacaaauggaacacaaaucuuu

SEQ ID NO: 627198 - RNA, 22 nt, Human
gacacaaaguuugucagaaauu

SEQ ID NO: 627199 - RNA, 22 nt, Human
augaggccagggugccaugaaa

SEQ ID NO: 627200 - RNA, 22 nt, Human
ucucuuuagugcuuagacgucu

SEQ ID NO: 627201 - RNA, 22 nt, Human
uuagaucaauacuaaagaaguu

SEQ ID NO: 627202 - RNA, 22 nt, Human
agagcugugaaaaugagguuug

SEQ ID NO: 627203 - RNA, 22 nt, Human
uauuuucuguggaggaccagau

SEQ ID NO: 627204 - RNA, 22 nt, Human
cacauauuguaguucaccagga

SEQ ID NO: 627205 - RNA, 22 nt, Human
ugagccagcuccuugccuguca

SEQ ID NO: 627206 - RNA, 22 nt, Human
gccuuccuuacaccugcucagc

SEQ ID NO: 627207 - RNA, 22 nt, Human
ucuaaagauguuuauugacaua

SEQ ID NO: 627208 - RNA, 22 nt, Human
cuuucucuggaggggagugguu

SEQ ID NO: 627209 - RNA, 22 nt, Human
aucuggagcucugcacaccugg

SEQ ID NO: 627210 - RNA, 22 nt, Human
aagcagaauuucccacuaguug

SEQ ID NO: 627211 - RNA, 22 nt, Human
acuggcccgggagcagaggccu

SEQ ID NO: 627212 - RNA, 22 nt, Human
gagcgggaggaacggcucgggc

SEQ ID NO: 627213 - RNA, 22 nt, Human
uaaugcuaacaucauaucacug

SEQ ID NO: 627214 - RNA, 22 nt, Human
agcuuccuacaaccaucucaga

SEQ ID NO: 627215 - RNA, 22 nt, Human
gcagagguggaugcaauugggg

SEQ ID NO: 627216 - RNA, 22 nt, Human
cuggaucugaacaucgguauca

SEQ ID NO: 627217 - RNA, 22 nt, Human
uggagacagagauagccaauug

SEQ ID NO: 627218 - RNA, 22 nt, Human
gccuccuaccacacccucaguc

SEQ ID NO: 627219 - RNA, 22 nt, Human
agcagacaggcugccacagugc

SEQ ID NO: 627220 - RNA, 22 nt, Human
ggacagugugggccaucucacu

SEQ ID NO: 627221 - RNA, 20 nt, Human
ugcuuccuggccacugcggg

SEQ ID NO: 627222 - RNA, 22 nt, Human
acugaaaguccagcaugguaca

SEQ ID NO: 627223 - RNA, 22 nt, Human
ugucaucugcggguggcacugc

SEQ ID NO: 627224 - RNA, 16 nt, Human
augaggcauaggcugc

SEQ ID NO: 627225 - RNA, 22 nt, Human
ugagcuccuggucacaauuauc

SEQ ID NO: 627226 - RNA, 22 nt, Human
acaugcaaaaauauauuuauga

SEQ ID NO: 627227 - RNA, 22 nt, Human
ggcccaaaccaaguaccucaaa

SEQ ID NO: 627228 - RNA, 22 nt, Human
auagccagcauauagcagggag

SEQ ID NO: 627229 - RNA, 22 nt, Human
cucagaagaacaaaggcucuac

SEQ ID NO: 627230 - RNA, 22 nt, Human
ggcuucugccacgagagggaag

SEQ ID NO: 627231 - RNA, 19 nt, Human
aguguauuuuuuucuguag

SEQ ID NO: 627232 - RNA, 22 nt, Human
uguggccuggaaggggcugcuc

SEQ ID NO: 627233 - RNA, 22 nt, Human
ggggagcagaagcagcaacaac

SEQ ID NO: 627234 - RNA, 22 nt, Human
ugcauccuuccauggguuucaa

SEQ ID NO: 627235 - RNA, 22 nt, Human
ucauaaagauacuaagugaguu

SEQ ID NO: 627236 - RNA, 22 nt, Human
uggacaaauagcaugacacuug

SEQ ID NO: 627237 - RNA, 23 nt, Human
aaacuguugcuucaauguauccu

SEQ ID NO: 627238 - RNA, 22 nt, Human
uagaaaccaucucacugcucag

SEQ ID NO: 627239 - RNA, 22 nt, Human
ucuguggaguugaggaagguug

SEQ ID NO: 627240 - RNA, 22 nt, Human
agaccaugggcuccugggacau

SEQ ID NO: 627241 - RNA, 22 nt, Human
gcuucugggguucuggcaugcu

SEQ ID NO: 627242 - RNA, 22 nt, Human
ucaccaggauuccuaucaguag

SEQ ID NO: 627243 - RNA, 22 nt, Human
guccaggaaucaaaagauggaa

SEQ ID NO: 627244 - RNA, 22 nt, Human
cuuuccagaccuccuuguagcu

SEQ ID NO: 627245 - RNA, 22 nt, Human
auuccacaagaccauaaauuag

SEQ ID NO: 627246 - RNA, 20 nt, Human
uaaaugcaucuguucaacug

SEQ ID NO: 627247 - RNA, 22 nt, Human
ggcuagggaucuagaccaggac

SEQ ID NO: 627248 - RNA, 20 nt, Human
uuuaccaacucaccaguauc

SEQ ID NO: 627249 - RNA, 22 nt, Human
aagggaggccagagguuuugca

SEQ ID NO: 627250 - RNA, 22 nt, Human
cagcugaauucuucagacucca

SEQ ID NO: 627251 - RNA, 22 nt, Human
gaggagcugagccacguccugg

SEQ ID NO: 627252 - RNA, 22 nt, Human
gugggaagagccaauuggggua

SEQ ID NO: 627253 - RNA, 22 nt, Human
uucaaagauuagcauacgcaau

SEQ ID NO: 627254 - RNA, 22 nt, Human
acuggcuuggcaggaggaagau

SEQ ID NO: 627255 - RNA, 22 nt, Human
uggcacaggagcacugcccugg

SEQ ID NO: 627256 - RNA, 22 nt, Human
cagugagggaagaucucagcac

SEQ ID NO: 627257 - RNA, 22 nt, Human
agcacagaugugaguggaggcu

SEQ ID NO: 627258 - RNA, 19 nt, Human
aggagaagacucucucccc

SEQ ID NO: 627259 - RNA, 22 nt, Human
aaaugcagcagcuaauugaaaa

SEQ ID NO: 627260 - RNA, 22 nt, Human
ucccacagguggagcuugcagu

SEQ ID NO: 627261 - RNA, 21 nt, Human
ucugauguguuuaaugguggg

SEQ ID NO: 627262 - RNA, 22 nt, Human
cgcccagggcaggaggccgcuc

SEQ ID NO: 627263 - RNA, 17 nt, Human
aaauaugaccucaaagu

SEQ ID NO: 627264 - RNA, 22 nt, Human
ggccauggaccccgagcugacc

SEQ ID NO: 627265 - RNA, 22 nt, Human
guuacagugcuuggcaauaagu

SEQ ID NO: 627266 - RNA, 22 nt, Human
aggagggcaggcuggcugccua

SEQ ID NO: 627267 - RNA, 22 nt, Human
uaaagcuagccaaccacugucu

SEQ ID NO: 627268 - RNA, 22 nt, Human
agcagcagagcucuggucugca

SEQ ID NO: 627269 - RNA, 22 nt, Human
cugcuucuagcaccaagucccu

SEQ ID NO: 627270 - RNA, 22 nt, Human
ugccagagaggagaaagcauuu

SEQ ID NO: 627271 - RNA, 22 nt, Human
uucccugguuaaccauuuucug

SEQ ID NO: 627272 - RNA, 22 nt, Human
ugcauugcaguuaacucaguau

SEQ ID NO: 627273 - RNA, 22 nt, Human
acagaagaccaagaaagcuucc

SEQ ID NO: 627274 - RNA, 19 nt, Human
uugaaaauauggaucugag

SEQ ID NO: 627275 - RNA, 22 nt, Human
ggguccagguuuagucauuugu

SEQ ID NO: 627276 - RNA, 22 nt, Human
caucauuuaauuauaggggcug

SEQ ID NO: 627277 - RNA, 22 nt, Human
auuuucuucucucccuggcugc

SEQ ID NO: 627278 - RNA, 22 nt, Human
cacccaguaagcaugaggcccu

SEQ ID NO: 627279 - RNA, 22 nt, Human
cugccagguuggcgcucgcucu

SEQ ID NO: 627280 - RNA, 22 nt, Human
aauguaugaagguuccaguuuc

SEQ ID NO: 627281 - RNA, 22 nt, Human
uagugaauuccuaauaggaaga

SEQ ID NO: 627282 - RNA, 22 nt, Human
ucaaauucuauucuauacucag

SEQ ID NO: 627283 - RNA, 22 nt, Human
auucuccacacauccagaccuu

SEQ ID NO: 627284 - RNA, 22 nt, Human
cuaaacauguagcuuuuguggu

SEQ ID NO: 627285 - RNA, 22 nt, Human
uccuuuaacuugauuauuuuca

SEQ ID NO: 627286 - RNA, 22 nt, Human
uuuauuccaugugucuaugacc

SEQ ID NO: 627287 - RNA, 22 nt, Human
acacugugacaaaggcuguucu

SEQ ID NO: 627288 - RNA, 21 nt, Human
gccucuccaaauccugccuuc

SEQ ID NO: 627289 - RNA, 22 nt, Human
gaguucucaagcaaucaaagag

SEQ ID NO: 627290 - RNA, 22 nt, Human
ggugccagugggucucaggaua

SEQ ID NO: 627291 - RNA, 22 nt, Human
ucagcuugugggucagccucug

SEQ ID NO: 627292 - RNA, 22 nt, Human
cuguguaugacuccagagggua

SEQ ID NO: 627293 - RNA, 21 nt, Human
auggacaauugagugucuguc

SEQ ID NO: 627294 - RNA, 22 nt, Human
uccugagcuucaaaacacuuug

SEQ ID NO: 627295 - RNA, 23 nt, Human
gagcugaguguagggagacuagg

SEQ ID NO: 627296 - RNA, 22 nt, Human
ccuuuuaagggagacuagagau

SEQ ID NO: 627297 - RNA, 22 nt, Human
agggggugcauuugugaaugaa

SEQ ID NO: 627298 - RNA, 22 nt, Human
ggcuccagauguccccuggcaa

SEQ ID NO: 627299 - RNA, 22 nt, Human
uccuggcccaaucugcccauga

SEQ ID NO: 627300 - RNA, 22 nt, Human
gcccagaguuugaagauacagu

SEQ ID NO: 627301 - RNA, 22 nt, Human
acucacugggucccggaagccc

SEQ ID NO: 627302 - RNA, 20 nt, Human
cuuuaguuacacguuuccuc

SEQ ID NO: 627303 - RNA, 22 nt, Human
ggcugucucugugacugccacc

SEQ ID NO: 627304 - RNA, 19 nt, Human
gcucugagaggggcauggg

SEQ ID NO: 627305 - RNA, 22 nt, Human
cauuagggacugaggaauaagg

SEQ ID NO: 627306 - RNA, 22 nt, Human
ccacuguauuuuggaagcagau

SEQ ID NO: 627307 - RNA, 22 nt, Human
uuguauuucuccacuuucuguu

SEQ ID NO: 627308 - RNA, 22 nt, Human
uacugucuauacacuugauuac

SEQ ID NO: 627309 - RNA, 22 nt, Human
gcccagaaagacugccuaacag

SEQ ID NO: 627310 - RNA, 22 nt, Human
gaggacagagccgccuggcaag

SEQ ID NO: 627311 - RNA, 22 nt, Human
cugaggccucguuggcuggaac

SEQ ID NO: 627312 - RNA, 22 nt, Human
aacacugaagaccagguaauuu

SEQ ID NO: 627313 - RNA, 22 nt, Human
ucuccagaaauggggcugggga

SEQ ID NO: 627314 - RNA, 22 nt, Human
cugagauggccacugggucuca

SEQ ID NO: 627315 - RNA, 22 nt, Human
caaugaaagcaacugccuauaa

SEQ ID NO: 627316 - RNA, 22 nt, Human
uacugaaacuuuucuucaacug

SEQ ID NO: 627317 - RNA, 22 nt, Human
ggcaagaaggcuucagguagcu

SEQ ID NO: 627318 - RNA, 22 nt, Human
cucugcaggcacccaggguggg

SEQ ID NO: 627319 - RNA, 22 nt, Human
ugccugccucuggagcccaucc

SEQ ID NO: 627320 - RNA, 22 nt, Human
acccuggcagccuucuguccug

SEQ ID NO: 627321 - RNA, 22 nt, Human
ucuaacuaacuacaguaagagg

SEQ ID NO: 627322 - RNA, 22 nt, Human
uacauccaaaguugaggugccu

SEQ ID NO: 627323 - RNA, 22 nt, Human
aagagcuggucacagguccauu

SEQ ID NO: 627324 - RNA, 18 nt, Human
aagaggaggaaacccagg

SEQ ID NO: 627325 - RNA, 22 nt, Human
auucaguagaaguuagcuauua

SEQ ID NO: 627326 - RNA, 22 nt, Human
uccucuuccuucuguccaaaug

SEQ ID NO: 627327 - RNA, 22 nt, Human
uuuuauucucaagacaauggga

SEQ ID NO: 627328 - RNA, 21 nt, Human
gcagcuggucucagagcuugc

SEQ ID NO: 627329 - RNA, 22 nt, Human
gaucugaaucaauagaauaacu

SEQ ID NO: 627330 - RNA, 22 nt, Human
gggaucugaguaggcagaagcu

SEQ ID NO: 627331 - RNA, 22 nt, Human
aaacacugaaaauuuuggucau

SEQ ID NO: 627332 - RNA, 20 nt, Human
ugauuuucugaaacagcaca

SEQ ID NO: 627333 - RNA, 21 nt, Human
gcaaauguucaggaaaaaaga

SEQ ID NO: 627334 - RNA, 21 nt, Human
aagaaguuuggauuuuguccu

SEQ ID NO: 627335 - RNA, 22 nt, Human
guccugaaugccuuuaggcaga

SEQ ID NO: 627336 - RNA, 22 nt, Human
uuuagaguugguccccugugag

SEQ ID NO: 627337 - RNA, 22 nt, Human
gggcgagggcgaaagcgagagc

SEQ ID NO: 627338 - RNA, 22 nt, Human
cauucauacaaguuuguuucau

SEQ ID NO: 627339 - RNA, 22 nt, Human
gaaaacuauuggccuagaacaa

SEQ ID NO: 627340 - RNA, 22 nt, Human
gagcucugaaaaagcuugccuu

SEQ ID NO: 627341 - RNA, 22 nt, Human
aucaagaguauugacaagacca

SEQ ID NO: 627342 - RNA, 21 nt, Human
gcaggggauagaaauggucug

SEQ ID NO: 627343 - RNA, 22 nt, Human
ccugcccagcuucccgagugca

SEQ ID NO: 627344 - RNA, 22 nt, Human
gggcauggggcggaccugguuc

SEQ ID NO: 627345 - RNA, 22 nt, Human
ucaaaaccuaggcucucugcuu

SEQ ID NO: 627346 - RNA, 22 nt, Human
gcaugcagagaauaccugugau

SEQ ID NO: 627347 - RNA, 22 nt, Human
gcuugccuaucugguggucguu

SEQ ID NO: 627348 - RNA, 22 nt, Human
caggugggagcgaggagcuacu

SEQ ID NO: 627349 - RNA, 22 nt, Human
ggccugagcuugggcagcguau

SEQ ID NO: 627350 - RNA, 22 nt, Human
uguauguguccuaauucaagca

SEQ ID NO: 627351 - RNA, 22 nt, Human
cuguuauuuuauaauucaagaa

SEQ ID NO: 627352 - RNA, 22 nt, Human
aaacugucaccuaauguauuuu

SEQ ID NO: 627353 - RNA, 22 nt, Human
ucccuacuguuagggacucagc

SEQ ID NO: 627354 - RNA, 22 nt, Human
gggcugcugcccaggaggcacc

SEQ ID NO: 627355 - RNA, 22 nt, Human
uuugacagagcucuuagucucu

SEQ ID NO: 627356 - RNA, 22 nt, Human
uccuucaguuaucacaguacug

SEQ ID NO: 627357 - RNA, 22 nt, Human
agaugcugccaggccccucagu

SEQ ID NO: 627358 - RNA, 22 nt, Human
auuucagcccaguaugagcccc

SEQ ID NO: 627359 - RNA, 22 nt, Human
ucuggcuugcuggcuugguccc

SEQ ID NO: 627360 - RNA, 22 nt, Human
augacuucugcaaggucauuug

SEQ ID NO: 627361 - RNA, 22 nt, Human
cuuccaaagcacuuuauggacc

SEQ ID NO: 627362 - RNA, 22 nt, Human
agaaauguuguggguuuuguua

SEQ ID NO: 627363 - RNA, 22 nt, Human
gaggaagaaucaggguggugag

SEQ ID NO: 627364 - RNA, 22 nt, Human
aaaauugaagugaucaggaacu

SEQ ID NO: 627365 - RNA, 22 nt, Human
gagagguagaggcucugcuuaa

SEQ ID NO: 627366 - RNA, 22 nt, Human
aguuuggaagaauuuggucugu

SEQ ID NO: 627367 - RNA, 22 nt, Human
caugccaguuuugagaugcacc

SEQ ID NO: 627368 - RNA, 22 nt, Human
gcugcccuguuuagccaggguu

SEQ ID NO: 627369 - RNA, 22 nt, Human
aucagacaauuguugaguacug

SEQ ID NO: 627370 - RNA, 22 nt, Human
gggcacugugcuaggugcugag

SEQ ID NO: 627371 - RNA, 22 nt, Human
agagauggagagcacuggggcu

SEQ ID NO: 627372 - RNA, 22 nt, Human
ugcaggugguccuuccucugcu

SEQ ID NO: 627373 - RNA, 22 nt, Human
aauccagcugugucacagguga

SEQ ID NO: 627374 - RNA, 22 nt, Human
ugcuauuagaagccaugcuguu

SEQ ID NO: 627375 - RNA, 22 nt, Human
ugcagccuuuagaaguucagau

SEQ ID NO: 627376 - RNA, 22 nt, Human
aggucugaucaugggcccacuu

SEQ ID NO: 627377 - RNA, 22 nt, Human
guggaauuuuuaccuaugaaug

SEQ ID NO: 627378 - RNA, 22 nt, Human
gccacugucauacccuggcaau

SEQ ID NO: 627379 - RNA, 22 nt, Human
ugacuuuaagcuaucugauucu

SEQ ID NO: 627380 - RNA, 22 nt, Human
ugcuucuggcagauugagugag

SEQ ID NO: 627381 - RNA, 22 nt, Human
ugaaaauauaguuuuccagacu

SEQ ID NO: 627382 - RNA, 22 nt, Human
cagggagaaaucuccaggaggu

SEQ ID NO: 627383 - RNA, 22 nt, Human
gugggugugagugacggcgucc

SEQ ID NO: 627384 - RNA, 22 nt, Human
cuugaugacucaggaggaggag

SEQ ID NO: 627385 - RNA, 22 nt, Human
ccagcaggcagucauauccuuu

SEQ ID NO: 627386 - RNA, 22 nt, Human
acagaggccccgugggagagcc

SEQ ID NO: 627387 - RNA, 22 nt, Human
gcugggucuggcugugagccgg

SEQ ID NO: 627388 - RNA, 22 nt, Human
augauguugguuuaauuugagu

SEQ ID NO: 627389 - RNA, 22 nt, Human
caggcauguggcccagggguga

SEQ ID NO: 627390 - RNA, 22 nt, Human
uaaaacuuaacuauccagauua

SEQ ID NO: 627391 - RNA, 22 nt, Human
guaaaugugcuucuuuuaacuu

SEQ ID NO: 627392 - RNA, 22 nt, Human
caucaaaguugguauauuugca

SEQ ID NO: 627393 - RNA, 23 nt, Human
gagagcugacugucaagacuguu

SEQ ID NO: 627394 - RNA, 22 nt, Human
uauucucugcagcugaauguuu

SEQ ID NO: 627395 - RNA, 22 nt, Human
uucaacuuuggagauuuaauaa

SEQ ID NO: 627396 - RNA, 21 nt, Human
uuacaugguuuaucauaugga

SEQ ID NO: 627397 - RNA, 22 nt, Human
gugugugugccugcacacacac

SEQ ID NO: 627398 - RNA, 22 nt, Human
gcugucugcugugcacugagca

SEQ ID NO: 627399 - RNA, 22 nt, Human
acauucuagauauguuauauuu

SEQ ID NO: 627400 - RNA, 22 nt, Human
caucuguaaaguaggaauauug

SEQ ID NO: 627401 - RNA, 22 nt, Human
auccugggcagugugucacucu

SEQ ID NO: 627402 - RNA, 22 nt, Human
ccccaccaccaaggcucaguuu

SEQ ID NO: 627403 - RNA, 22 nt, Human
aaauuagucgguuuaggaauuu

SEQ ID NO: 627404 - RNA, 22 nt, Human
uaacuuugauaagaaucaggga

SEQ ID NO: 627405 - RNA, 22 nt, Human
ugcagaggcuggcucgccgggu

SEQ ID NO: 627406 - RNA, 22 nt, Human
ugggagaagacguacuuuagac

SEQ ID NO: 627407 - RNA, 22 nt, Human
gcccagaguucaaggcugcagu

SEQ ID NO: 627408 - RNA, 22 nt, Human
gcuuauacucuggagaauaaga

SEQ ID NO: 627409 - RNA, 22 nt, Human
guuuacacauaacuccuaucaa

SEQ ID NO: 627410 - RNA, 21 nt, Human
aagcuguguuccacugauagc

SEQ ID NO: 627411 - RNA, 22 nt, Human
augugucucuaccaaugcaauu

SEQ ID NO: 627412 - RNA, 22 nt, Human
ugggggugugccagggaccucc

SEQ ID NO: 627413 - RNA, 22 nt, Human
gccuccaggguagaggaggaag

SEQ ID NO: 627414 - RNA, 22 nt, Human
gccuguggccgacugagagccu

SEQ ID NO: 627415 - RNA, 22 nt, Human
cugcugugugcuuacuuggguu

SEQ ID NO: 627416 - RNA, 22 nt, Human
ugagagaguaauugagugguaa

SEQ ID NO: 627417 - RNA, 22 nt, Human
cuccaggaccagggcuccugga

SEQ ID NO: 627418 - RNA, 22 nt, Human
gaggaggcacuugagcagaugu

SEQ ID NO: 627419 - RNA, 22 nt, Human
cacagcuucuuccauuccacuc

SEQ ID NO: 627420 - RNA, 18 nt, Human
ccucagggagagagacgc

SEQ ID NO: 627421 - RNA, 23 nt, Human
aguguuccaguugguugagagug

SEQ ID NO: 627422 - RNA, 22 nt, Human
uggaagagcaggcagacaaugc

SEQ ID NO: 627423 - RNA, 22 nt, Human
gcuggaggcaguucagacacca

SEQ ID NO: 627424 - RNA, 22 nt, Human
ucccagagcccaaguuggagag

SEQ ID NO: 627425 - RNA, 22 nt, Human
uucuauguggauauagaacugc

SEQ ID NO: 627426 - RNA, 22 nt, Human
agauggggcucaguguggaggc

SEQ ID NO: 627427 - RNA, 20 nt, Human
cugcaggguuagaggcucca

SEQ ID NO: 627428 - RNA, 22 nt, Human
cugggcuacguguugacagcau

SEQ ID NO: 627429 - RNA, 22 nt, Human
uuuaucugcauucugaccaucu

SEQ ID NO: 627430 - RNA, 22 nt, Human
gugaccagcccauagagaggcg

SEQ ID NO: 627431 - RNA, 22 nt, Human
gcaggcacaugggcgggucugg

SEQ ID NO: 627432 - RNA, 22 nt, Human
ugguuccucaagcgcuggcggc

SEQ ID NO: 627433 - RNA, 22 nt, Human
agcacacaggacuugauucaug

SEQ ID NO: 627434 - RNA, 17 nt, Human
aacaauaggauguguau

SEQ ID NO: 627435 - RNA, 22 nt, Human
cagcuuuguggccuugaccucg

SEQ ID NO: 627436 - RNA, 22 nt, Human
gccaggcaggccacgcuguguu

SEQ ID NO: 627437 - RNA, 22 nt, Human
cucuggccagagccugcgggaa

SEQ ID NO: 627438 - RNA, 22 nt, Human
agacaccagaaucuguugagca

SEQ ID NO: 627439 - RNA, 21 nt, Human
gcaggcacucuagaggagcug

SEQ ID NO: 627440 - RNA, 22 nt, Human
aagagcaggcugucaauggggc

SEQ ID NO: 627441 - RNA, 22 nt, Human
aaaacaggugucagcaaacuau

SEQ ID NO: 627442 - RNA, 22 nt, Human
cauuugcaagagauaaauguuu

SEQ ID NO: 627443 - RNA, 22 nt, Human
acacauauguggcaacuguaga

SEQ ID NO: 627444 - RNA, 22 nt, Human
augcauauucuuagccccuccu

SEQ ID NO: 627445 - RNA, 21 nt, Human
acagucuccccagaucucucc

SEQ ID NO: 627446 - RNA, 21 nt, Human
ugcauggaggaaaguuauaga

SEQ ID NO: 627447 - RNA, 22 nt, Human
accccaggucuccaggcucugg

SEQ ID NO: 627448 - RNA, 22 nt, Human
auguguacacuggacuucugau

SEQ ID NO: 627449 - RNA, 22 nt, Human
auuucuguugcuuauaaauuac

SEQ ID NO: 627450 - RNA, 22 nt, Human
cggccgcguccagggccgccag

SEQ ID NO: 627451 - RNA, 22 nt, Human
uuccacucuaugauagaagggu

SEQ ID NO: 627452 - RNA, 22 nt, Human
uuucagaaauuguuauuauucu

SEQ ID NO: 627453 - RNA, 22 nt, Human
uggcccuguccucauuucaucu

SEQ ID NO: 627454 - RNA, 22 nt, Human
uccugccuagcaggugaccuau

SEQ ID NO: 627455 - RNA, 22 nt, Human
gcagcugagcgugaggaagagu

SEQ ID NO: 627456 - RNA, 22 nt, Human
ucagaggcaaagaacuuuauua

SEQ ID NO: 627457 - RNA, 22 nt, Human
cccaugaacugucuugcuguag

SEQ ID NO: 627458 - RNA, 22 nt, Human
gacacagaccaccaggcccugg

SEQ ID NO: 627459 - RNA, 22 nt, Human
gccaccagugggggccugggca

SEQ ID NO: 627460 - RNA, 22 nt, Human
ucugagguuauugucugccauu

SEQ ID NO: 627461 - RNA, 22 nt, Human
uaauccugcuucuucucccuuu

SEQ ID NO: 627462 - RNA, 22 nt, Human
ugugugucauuuaggguggagc

SEQ ID NO: 627463 - RNA, 22 nt, Human
guggcagguuccguagacagca

SEQ ID NO: 627464 - RNA, 22 nt, Human
aucuguuaacaaagaagacagc

SEQ ID NO: 627465 - RNA, 22 nt, Human
agccaggguuagaagauaguca

SEQ ID NO: 627466 - RNA, 22 nt, Human
cucccugaaauucagaugccuc

SEQ ID NO: 627467 - RNA, 22 nt, Human
cccaaccccaacuuccuauguu

SEQ ID NO: 627468 - RNA, 21 nt, Human
ugugugggcauaucugcugca

SEQ ID NO: 627469 - RNA, 22 nt, Human
uguauguguggauagauguaua

SEQ ID NO: 627470 - RNA, 22 nt, Human
uuucaaagguuuugucaugucu

SEQ ID NO: 627471 - RNA, 22 nt, Human
gagcaguugggcucuaggaagu

SEQ ID NO: 627472 - RNA, 22 nt, Human
aucuucuggucaaauuuuugca

SEQ ID NO: 627473 - RNA, 22 nt, Human
ggaggccaugaggcucuaggug

SEQ ID NO: 627474 - RNA, 22 nt, Human
cugcuggaaguuugcuguggau

SEQ ID NO: 627475 - RNA, 22 nt, Human
uggagguguauaagguagcuuc

SEQ ID NO: 627476 - RNA, 21 nt, Human
uugaaaguaaauucagcagcu

SEQ ID NO: 627477 - RNA, 21 nt, Human
cucugcccagggccuccugcc

SEQ ID NO: 627478 - RNA, 22 nt, Human
uagcuuuaccauagaagaguau

SEQ ID NO: 627479 - RNA, 22 nt, Human
agaugagggguagaaaggacuu

SEQ ID NO: 627480 - RNA, 19 nt, Human
accagcccacucccaguuu

SEQ ID NO: 627481 - RNA, 22 nt, Human
gacugcagugaaggcacauggg

SEQ ID NO: 627482 - RNA, 22 nt, Human
ccuuagugugccugaggcagau

SEQ ID NO: 627483 - RNA, 22 nt, Human
ggaggugggagacauaggcggc

SEQ ID NO: 627484 - RNA, 22 nt, Human
ccugugugaagguuaggcaggu

SEQ ID NO: 627485 - RNA, 22 nt, Human
cucuuccuuaagacuauaaaga

SEQ ID NO: 627486 - RNA, 22 nt, Human
ggcagcucgaugacuucugcau

SEQ ID NO: 627487 - RNA, 22 nt, Human
aggaggccgggauucuggagau

SEQ ID NO: 627488 - RNA, 22 nt, Human
ugcauuuguucagugaaauguu

SEQ ID NO: 627489 - RNA, 22 nt, Human
acaugcacggcaccaucuucug

SEQ ID NO: 627490 - RNA, 22 nt, Human
caugaguaugauuauacccagu

SEQ ID NO: 627491 - RNA, 22 nt, Human
ugcaugcaaagugucugcuuug

SEQ ID NO: 627492 - RNA, 22 nt, Human
uagaaguugcucaauaaauguu

SEQ ID NO: 627493 - RNA, 22 nt, Human
aaggcuuuaaauaaccguaaag

SEQ ID NO: 627494 - RNA, 22 nt, Human
guuccacagagucucacuauga

SEQ ID NO: 627495 - RNA, 21 nt, Human
ggagaaggacaauguugagua

SEQ ID NO: 627496 - RNA, 22 nt, Human
cagggccauaucuugugcacca

SEQ ID NO: 627497 - RNA, 22 nt, Human
gcuucucccuacagaugucagu

SEQ ID NO: 627498 - RNA, 22 nt, Human
cccucugcaggcuggaccugcc

SEQ ID NO: 627499 - RNA, 22 nt, Human
ucagaaaagaccacauuauucu

SEQ ID NO: 627500 - RNA, 22 nt, Human
ugcuccugagguuggagaucca

SEQ ID NO: 627501 - RNA, 22 nt, Human
uuucaaggcuaauccacaguau

SEQ ID NO: 627502 - RNA, 22 nt, Human
acugggccuguacagagaaaac

SEQ ID NO: 627503 - RNA, 22 nt, Human
augcauauuuucuguuggugac

SEQ ID NO: 627504 - RNA, 17 nt, Human
agucauauugugcaguu

SEQ ID NO: 627505 - RNA, 22 nt, Human
ggggauggauuccgggucccug

SEQ ID NO: 627506 - RNA, 22 nt, Human
uccugagagcagcugcuuugga

SEQ ID NO: 627507 - RNA, 22 nt, Human
cugugcguugugaaauguuuag

SEQ ID NO: 627508 - RNA, 22 nt, Human
gcugggccagccagacauguga

SEQ ID NO: 627509 - RNA, 22 nt, Human
aaacagcuaaguacauucaagg

SEQ ID NO: 627510 - RNA, 22 nt, Human
uugacuuuaaagcuuugucucu

SEQ ID NO: 627511 - RNA, 21 nt, Human
cugcuuuacuucagaggaucu

SEQ ID NO: 627512 - RNA, 22 nt, Human
uucauugcauuccagccugggu

SEQ ID NO: 627513 - RNA, 22 nt, Human
uccagccccuuuuacucauuca

SEQ ID NO: 627514 - RNA, 22 nt, Human
aggcccagggcugcucucugaa

SEQ ID NO: 627515 - RNA, 22 nt, Human
gcacacaugcaugcacaggagu

SEQ ID NO: 627516 - RNA, 22 nt, Human
ucauaaaaugcuccugauauug

SEQ ID NO: 627517 - RNA, 22 nt, Human
acugagguauaauugacauaac

SEQ ID NO: 627518 - RNA, 22 nt, Human
caaaauagauguuaaccuggaa

SEQ ID NO: 627519 - RNA, 22 nt, Human
cugagaguagcuggagaacauu

SEQ ID NO: 627520 - RNA, 23 nt, Human
uguaggcuaagucccauaaauca

SEQ ID NO: 627521 - RNA, 22 nt, Human
acagcaguuacugaaauaaagu

SEQ ID NO: 627522 - RNA, 22 nt, Human
caauacugaguuuacauucauc

SEQ ID NO: 627523 - RNA, 22 nt, Human
agcaccaggauauuguuggaga

SEQ ID NO: 627524 - RNA, 22 nt, Human
aggcuggaaaucacuagauucc

SEQ ID NO: 627525 - RNA, 18 nt, Human
aggugcagccucugaggc

SEQ ID NO: 627526 - RNA, 23 nt, Human
uuuaaccuuggucaagaauuucc

SEQ ID NO: 627527 - RNA, 22 nt, Human
agccucuccagagccuggcaga

SEQ ID NO: 627528 - RNA, 22 nt, Human
uagauaaauuagaaaguuuacu

SEQ ID NO: 627529 - RNA, 20 nt, Human
ccugggcucaaagcauccuc

SEQ ID NO: 627530 - RNA, 22 nt, Human
caucugcuguaauuaacaagcc

SEQ ID NO: 627531 - RNA, 22 nt, Human
uauguauccguguguguacaga

SEQ ID NO: 627532 - RNA, 22 nt, Human
cagagcuguugcggggcuuggc

SEQ ID NO: 627533 - RNA, 22 nt, Human
uuuaucugagcugauagauagu

SEQ ID NO: 627534 - RNA, 22 nt, Human
ggucagagccguuagcauucag

SEQ ID NO: 627535 - RNA, 22 nt, Human
uucuguucugauacuuguuucu

SEQ ID NO: 627536 - RNA, 22 nt, Human
ggucuuucuuugauaguggaga

SEQ ID NO: 627537 - RNA, 23 nt, Human
ugaguguggggacagugguuugc

SEQ ID NO: 627538 - RNA, 22 nt, Human
gcuccagcucguggcucccagc

SEQ ID NO: 627539 - RNA, 22 nt, Human
cugaagcuuuacuucaaauaca

SEQ ID NO: 627540 - RNA, 22 nt, Human
ucuguauauauuaaugaaauuc

SEQ ID NO: 627541 - RNA, 22 nt, Human
cucagaagccuucagucuuggc

SEQ ID NO: 627542 - RNA, 22 nt, Human
ccugagagcagcuuccugcuua

SEQ ID NO: 627543 - RNA, 22 nt, Human
aggugccagaugcacagcugaa

SEQ ID NO: 627544 - RNA, 22 nt, Human
ugacauuuaucaaagaaauggu

SEQ ID NO: 627545 - RNA, 22 nt, Human
acaggacuuaagucauuuauaa

SEQ ID NO: 627546 - RNA, 22 nt, Human
cggaagcguucucagcaggggc

SEQ ID NO: 627547 - RNA, 22 nt, Human
acauuucuuucuauucaguagc

SEQ ID NO: 627548 - RNA, 22 nt, Human
uuaaacacuggggguuaaugca

SEQ ID NO: 627549 - RNA, 22 nt, Human
cccaaaggcuguacuuguaacc

SEQ ID NO: 627550 - RNA, 22 nt, Human
ccuggcucccggaacagggucu

SEQ ID NO: 627551 - RNA, 22 nt, Human
uacaucuuugucuaugaccagc

SEQ ID NO: 627552 - RNA, 22 nt, Human
acgggugguaaugagaaaagga

SEQ ID NO: 627553 - RNA, 22 nt, Human
uguucuuuagcagaccauguug

SEQ ID NO: 627554 - RNA, 22 nt, Human
cucccugaccuggauuccaggc

SEQ ID NO: 627555 - RNA, 22 nt, Human
cccaggaggcagagauagcagu

SEQ ID NO: 627556 - RNA, 18 nt, Human
ugagaaacugacacaugg

SEQ ID NO: 627557 - RNA, 22 nt, Human
ucacagaagaugcuggauguug

SEQ ID NO: 627558 - RNA, 22 nt, Human
guccucugauuucuagguauau

SEQ ID NO: 627559 - RNA, 22 nt, Human
aaacugcugguugcuggccagc

SEQ ID NO: 627560 - RNA, 22 nt, Human
uccucugacucacagccugggg

SEQ ID NO: 627561 - RNA, 22 nt, Human
gagcugggaguuauagcauguu

SEQ ID NO: 627562 - RNA, 22 nt, Human
acaggaacgaauguacauuguu

SEQ ID NO: 627563 - RNA, 20 nt, Human
auuauucauacaugugugac

SEQ ID NO: 627564 - RNA, 22 nt, Human
cuuuacugaagugaagaccugg

SEQ ID NO: 627565 - RNA, 22 nt, Human
uaaggcaagagcagggucuuug

SEQ ID NO: 627566 - RNA, 22 nt, Human
agcagggguaacagaaggaaag

SEQ ID NO: 627567 - RNA, 22 nt, Human
ugggcaagggacaggccuggcu

SEQ ID NO: 627568 - RNA, 22 nt, Human
gaagauuuauaggagccuauua

SEQ ID NO: 627569 - RNA, 22 nt, Human
acaguuuuuucaacauuggaau

SEQ ID NO: 627570 - RNA, 22 nt, Human
gugguaauuuaauccuacacug

SEQ ID NO: 627571 - RNA, 22 nt, Human
uggguccugcacugcaagcacc

SEQ ID NO: 627572 - RNA, 22 nt, Human
gcugugugccaggggaaggcug

SEQ ID NO: 627573 - RNA, 21 nt, Human
ugaggcaggggugcuuuuguc

SEQ ID NO: 627574 - RNA, 22 nt, Human
cuuuggcaaugucauuuucaau

SEQ ID NO: 627575 - RNA, 22 nt, Human
uuugauaagagcugcugaaacu

SEQ ID NO: 627576 - RNA, 22 nt, Human
uuuaaacaaauaggauugccua

SEQ ID NO: 627577 - RNA, 22 nt, Human
gccagagaaugaaaaucagauu

SEQ ID NO: 627578 - RNA, 22 nt, Human
aaggagugcaugacucagagua

SEQ ID NO: 627579 - RNA, 22 nt, Human
uagaaaggcaagcgugaaauau

SEQ ID NO: 627580 - RNA, 23 nt, Human
uuccagaguccacaucugccacc

SEQ ID NO: 627581 - RNA, 22 nt, Human
agcaucuggugagggccuaguu

SEQ ID NO: 627582 - RNA, 22 nt, Human
cucuggaauugaccugggaggg

SEQ ID NO: 627583 - RNA, 22 nt, Human
uaugaguacaaggacucugucu

SEQ ID NO: 627584 - RNA, 22 nt, Human
gcuggccugcgagggcaggcug

SEQ ID NO: 627585 - RNA, 22 nt, Human
gugcugagauuacaggugugag

SEQ ID NO: 627586 - RNA, 22 nt, Human
gaggggagcaugaucuagauug

SEQ ID NO: 627587 - RNA, 22 nt, Human
gagauguuaacuacauagcuac

SEQ ID NO: 627588 - RNA, 22 nt, Human
guggcccuuggaguugugaccu

SEQ ID NO: 627589 - RNA, 22 nt, Human
ugggugugcccagauggugucc

SEQ ID NO: 627590 - RNA, 22 nt, Human
uacagugcauagaggcaugaua

SEQ ID NO: 627591 - RNA, 22 nt, Human
uaguuuccuaggcuguauuguu

SEQ ID NO: 627592 - RNA, 22 nt, Human
caguacuucuuggaaacuggau

SEQ ID NO: 627593 - RNA, 22 nt, Human
augacaaacccaggauguaaca

SEQ ID NO: 627594 - RNA, 22 nt, Human
aggucauuccagccauuccccu

SEQ ID NO: 627595 - RNA, 22 nt, Human
uuugaagucaggcuuucuaccc

SEQ ID NO: 627596 - RNA, 21 nt, Human
cagacccucuagaggccaccu

SEQ ID NO: 627597 - RNA, 22 nt, Human
agcagaugagccucaugacugg

SEQ ID NO: 627598 - RNA, 22 nt, Human
cucuguuuuucaauaguucuug

SEQ ID NO: 627599 - RNA, 22 nt, Human
cacauuuaagugcuuguucaga

SEQ ID NO: 627600 - RNA, 22 nt, Human
ugcacacaguucucaggaaaga

SEQ ID NO: 627601 - RNA, 22 nt, Human
acaggcagagucagguuggguu

SEQ ID NO: 627602 - RNA, 19 nt, Human
auacaagacuagcauuuac

SEQ ID NO: 627603 - RNA, 18 nt, Human
cucucugggugaggacaa

SEQ ID NO: 627604 - RNA, 22 nt, Human
agcucagaaccuccucauccca

SEQ ID NO: 627605 - RNA, 22 nt, Human
gaccugggguaagcuuggcaac

SEQ ID NO: 627606 - RNA, 22 nt, Human
aaaguuuguugcuuacaaagaa

SEQ ID NO: 627607 - RNA, 22 nt, Human
accaggcacucuuguggcagug

SEQ ID NO: 627608 - RNA, 22 nt, Human
uucccucccuggcugccauuuc

SEQ ID NO: 627609 - RNA, 22 nt, Human
cuuuaauucagauuugaaggga

SEQ ID NO: 627610 - RNA, 22 nt, Human
aauggcuuagugcuucacuucu

SEQ ID NO: 627611 - RNA, 22 nt, Human
aagcugccagauucagucugcu

SEQ ID NO: 627612 - RNA, 22 nt, Human
guccugggaacuggacagcuaa

SEQ ID NO: 627613 - RNA, 22 nt, Human
uauagcuaaggucagacuguuu

SEQ ID NO: 627614 - RNA, 22 nt, Human
acagagcuaauguugcauaggc

SEQ ID NO: 627615 - RNA, 22 nt, Human
gcaggcaccgcggcggcagguu

SEQ ID NO: 627616 - RNA, 22 nt, Human
ggaaacacaugaucagacaucu

SEQ ID NO: 627617 - RNA, 22 nt, Human
uuuaagcuguggcauuaauucu

SEQ ID NO: 627618 - RNA, 22 nt, Human
agaguuucuugugagcacugac

SEQ ID NO: 627619 - RNA, 22 nt, Human
acguguguuggucagggggccc

SEQ ID NO: 627620 - RNA, 22 nt, Human
uaagaacaagauguuccuguuu

SEQ ID NO: 627621 - RNA, 22 nt, Human
agcaaagcuaucucuauggaga

SEQ ID NO: 627622 - RNA, 22 nt, Human
caggagaagucucuagggggug

SEQ ID NO: 627623 - RNA, 22 nt, Human
uaccuucucuagaucuuuauuc

SEQ ID NO: 627624 - RNA, 22 nt, Human
ccucucccagggagagccugag

SEQ ID NO: 627625 - RNA, 22 nt, Human
agagcuuuucuguaauaacauc

SEQ ID NO: 627626 - RNA, 22 nt, Human
uacugcagauggccuuguucuu

SEQ ID NO: 627627 - RNA, 22 nt, Human
ucuuuaagaguucauuugcaug

SEQ ID NO: 627628 - RNA, 22 nt, Human
agagguaugugucagugcuuau

SEQ ID NO: 627629 - RNA, 22 nt, Human
accacaggggaggaaugaugcc

SEQ ID NO: 627630 - RNA, 22 nt, Human
augguuuauccuuuaccagucg

SEQ ID NO: 627631 - RNA, 16 nt, Human
cagaguguaaacagga

SEQ ID NO: 627632 - RNA, 20 nt, Human
ggcagcucacuacuuucugu

SEQ ID NO: 627633 - RNA, 22 nt, Human
uuccuggucugugccauucaga

SEQ ID NO: 627634 - RNA, 22 nt, Human
cagggcucuuccggagcaggga

SEQ ID NO: 627635 - RNA, 22 nt, Human
gguucacacuaagcuuaagugg

SEQ ID NO: 627636 - RNA, 22 nt, Human
uuguaguggccaaagaacucuu

SEQ ID NO: 627637 - RNA, 22 nt, Human
gcaacuuuagaaaaaucuauaa

SEQ ID NO: 627638 - RNA, 22 nt, Human
auugaacugauauuugguguag

SEQ ID NO: 627639 - RNA, 17 nt, Human
uucucugagcuguauug

SEQ ID NO: 627640 - RNA, 22 nt, Human
ucaggaagcauccugagguguc

SEQ ID NO: 627641 - RNA, 22 nt, Human
uugggucuacguagaaagaaca

SEQ ID NO: 627642 - RNA, 22 nt, Human
ccccagccuuccaugggaauug

SEQ ID NO: 627643 - RNA, 19 nt, Human
gccaggcucuuauucugug

SEQ ID NO: 627644 - RNA, 20 nt, Human
guauuagguguuccucuuuc

SEQ ID NO: 627645 - RNA, 22 nt, Human
uacuuaaaaauuaucaaagugg

SEQ ID NO: 627646 - RNA, 22 nt, Human
gcucuuuggauuccuuuacaaa

SEQ ID NO: 627647 - RNA, 22 nt, Human
cauggaucauaaaugugcuaaa

SEQ ID NO: 627648 - RNA, 22 nt, Human
agcccaggaaucugcaucuuga

SEQ ID NO: 627649 - RNA, 22 nt, Human
gcugagauuacgggcaugagcc

SEQ ID NO: 627650 - RNA, 22 nt, Human
ugggauucaccaugggcuucag

SEQ ID NO: 627651 - RNA, 22 nt, Human
auugagaaugcaaucuacuaug

SEQ ID NO: 627652 - RNA, 22 nt, Human
cagaugcugguaugggggaggu

SEQ ID NO: 627653 - RNA, 22 nt, Human
ggcaggucagguccaugaccaa

SEQ ID NO: 627654 - RNA, 22 nt, Human
uaugugaauacagcaguggaug

SEQ ID NO: 627655 - RNA, 22 nt, Human
cucccugugucuucacuuggcc

SEQ ID NO: 627656 - RNA, 22 nt, Human
uaaauguguuguggaugaaguu

SEQ ID NO: 627657 - RNA, 22 nt, Human
ugcuuuauucgacaucugguag

SEQ ID NO: 627658 - RNA, 22 nt, Human
aggcuacagauacagaggcuac

SEQ ID NO: 627659 - RNA, 22 nt, Human
ucaguguuaaucagugguaccu

SEQ ID NO: 627660 - RNA, 22 nt, Human
ucugcaugaugaacaaaugagc

SEQ ID NO: 627661 - RNA, 22 nt, Human
ucaggacaacaagacuuguuua

SEQ ID NO: 627662 - RNA, 22 nt, Human
cccucugagacagguagcucac

SEQ ID NO: 627663 - RNA, 22 nt, Human
ucugucaccccuguuucuggcu

SEQ ID NO: 627664 - RNA, 22 nt, Human
aggggagcuugccuggucaccc

SEQ ID NO: 627665 - RNA, 22 nt, Human
cugggccaucucucugcaagug

SEQ ID NO: 627666 - RNA, 18 nt, Human
cugucccauccucagguu

SEQ ID NO: 627667 - RNA, 22 nt, Human
guggggugggcugaguuaggcc

SEQ ID NO: 627668 - RNA, 22 nt, Human
augaaugaagaacaucugugcc

SEQ ID NO: 627669 - RNA, 22 nt, Human
aaacucagacacaguaucuguu

SEQ ID NO: 627670 - RNA, 22 nt, Human
auagccuugacucacagcucuu

SEQ ID NO: 627671 - RNA, 22 nt, Human
ucuagcugccccgaggcagggu

SEQ ID NO: 627672 - RNA, 23 nt, Human
ggguccagagacaggcaugggug

SEQ ID NO: 627673 - RNA, 22 nt, Human
caggccggugauucuggaugua

SEQ ID NO: 627674 - RNA, 22 nt, Human
uccaggcugcaaggccacaggg

SEQ ID NO: 627675 - RNA, 22 nt, Human
cucagcacacucccaucuaauu

SEQ ID NO: 627676 - RNA, 22 nt, Human
ccaaagugugggagaagaggua

SEQ ID NO: 627677 - RNA, 22 nt, Human
gcuggcauuacaggagagaacc

SEQ ID NO: 627678 - RNA, 22 nt, Human
ucucuggcagacaccucccuga

SEQ ID NO: 627679 - RNA, 22 nt, Human
uuggcccugagguuaucaucua

SEQ ID NO: 627680 - RNA, 18 nt, Human
ugcucuguuuaaugauuu

SEQ ID NO: 627681 - RNA, 22 nt, Human
auuacuguuggcaaagucuuau

SEQ ID NO: 627682 - RNA, 22 nt, Human
ccacugaguacccgauggcugc

SEQ ID NO: 627683 - RNA, 22 nt, Human
ggccuuggggaggauggugucc

SEQ ID NO: 627684 - RNA, 22 nt, Human
agcauaaaauaaauaguuugca

SEQ ID NO: 627685 - RNA, 22 nt, Human
cuggcagagucugcugucugca

SEQ ID NO: 627686 - RNA, 22 nt, Human
gacccaggccuggggcuuaagg

SEQ ID NO: 627687 - RNA, 22 nt, Human
ugggccagcucccugccccugg

SEQ ID NO: 627688 - RNA, 22 nt, Human
cagcaggcccaggugcugguga

SEQ ID NO: 627689 - RNA, 22 nt, Human
ugggacugcucuugcugggguc

SEQ ID NO: 627690 - RNA, 22 nt, Human
uugucugcaugauucuaggcag

SEQ ID NO: 627691 - RNA, 22 nt, Human
gugcuuuaauaagauuucacuu

SEQ ID NO: 627692 - RNA, 22 nt, Human
agccaugcaccuuacucuugcu

SEQ ID NO: 627693 - RNA, 22 nt, Human
agaaaaacacaaucgggccucc

SEQ ID NO: 627694 - RNA, 22 nt, Human
gguggggcccaggcaucugaug

SEQ ID NO: 627695 - RNA, 22 nt, Human
ugagaaauuacuucagugaugg

SEQ ID NO: 627696 - RNA, 22 nt, Human
uugugcuccugugagaaucuag

SEQ ID NO: 627697 - RNA, 22 nt, Human
cacuguuuucagucaguucuau

SEQ ID NO: 627698 - RNA, 19 nt, Human
uggcuuccaucucucucau

SEQ ID NO: 627699 - RNA, 22 nt, Human
cagggccaccguguuugcugcu

SEQ ID NO: 627700 - RNA, 22 nt, Human
ccugcugcuaugaaggugacag

SEQ ID NO: 627701 - RNA, 22 nt, Human
gcagggcggcccagagcaggcc

SEQ ID NO: 627702 - RNA, 22 nt, Human
gaacacaugauuauaaaugcua

SEQ ID NO: 627703 - RNA, 22 nt, Human
uccucccuguaccauuccucug

SEQ ID NO: 627704 - RNA, 22 nt, Human
gucugggcaggaaucugcauuc

SEQ ID NO: 627705 - RNA, 22 nt, Human
aauaaaucaauccuauugguag

SEQ ID NO: 627706 - RNA, 22 nt, Human
aaaaacugcaauuacuuuuguc

SEQ ID NO: 627707 - RNA, 22 nt, Human
uccuggagccaugauuccccuc

SEQ ID NO: 627708 - RNA, 22 nt, Human
gaauacacgcacgacacggggg

SEQ ID NO: 627709 - RNA, 22 nt, Human
aaggcugacguuuguguuuauu

SEQ ID NO: 627710 - RNA, 22 nt, Human
uuuuaaacuauagcuggaugcu

SEQ ID NO: 627711 - RNA, 22 nt, Human
ugaggccucauuuagggagagg

SEQ ID NO: 627712 - RNA, 22 nt, Human
cccuguccuuggcugugaggcu

SEQ ID NO: 627713 - RNA, 22 nt, Human
cuggcuguggauuaucacaggc

SEQ ID NO: 627714 - RNA, 22 nt, Human
ucaagaauuuggauaagaaaug

SEQ ID NO: 627715 - RNA, 22 nt, Human
gcagacagggcuacagagguac

SEQ ID NO: 627716 - RNA, 22 nt, Human
aagaguuuucuauaaucuuggc

SEQ ID NO: 627717 - RNA, 22 nt, Human
uuuuuagauuacucagccacca

SEQ ID NO: 627718 - RNA, 22 nt, Human
guguaacuugcuggaaaaacua

SEQ ID NO: 627719 - RNA, 18 nt, Human
gguccugggccuggcuca

SEQ ID NO: 627720 - RNA, 22 nt, Human
uauuucagggagaauaaauuug

SEQ ID NO: 627721 - RNA, 22 nt, Human
gccacagcuccagucaggugac

SEQ ID NO: 627722 - RNA, 22 nt, Human
uaauagucauuguauaccuugg

SEQ ID NO: 627723 - RNA, 22 nt, Human
cccacacauuuuucacuuaccg

SEQ ID NO: 627724 - RNA, 22 nt, Human
auugcagugaugguugcauaau

SEQ ID NO: 627725 - RNA, 23 nt, Human
caucagagguugccacucccugg

SEQ ID NO: 627726 - RNA, 22 nt, Human
gguggcagaggugcaucagccc

SEQ ID NO: 627727 - RNA, 22 nt, Human
gcugcagagacagcugccgaug

SEQ ID NO: 627728 - RNA, 22 nt, Human
uguuguuuucucauggagaaua

SEQ ID NO: 627729 - RNA, 22 nt, Human
uucaucaccuugguagcacucc

SEQ ID NO: 627730 - RNA, 19 nt, Human
gccacuccugaugcugccc

SEQ ID NO: 627731 - RNA, 22 nt, Human
gaagucagaaaagaauuaggga

SEQ ID NO: 627732 - RNA, 23 nt, Human
aggaaggagguccuaacaguauc

SEQ ID NO: 627733 - RNA, 22 nt, Human
uuccugaaaauacagggagaga

SEQ ID NO: 627734 - RNA, 22 nt, Human
aagucagaaauaucugccauca

SEQ ID NO: 627735 - RNA, 22 nt, Human
cagagccaggguugcaccccug

SEQ ID NO: 627736 - RNA, 22 nt, Human
ucucagaagugaucaggauguu

SEQ ID NO: 627737 - RNA, 17 nt, Human
uucugugcuuccuggcu

SEQ ID NO: 627738 - RNA, 22 nt, Human
cugagguacaagaaaggcaccu

SEQ ID NO: 627739 - RNA, 22 nt, Human
ugccugccugcauagucccacg

SEQ ID NO: 627740 - RNA, 22 nt, Human
uuugauuuacuggauauucuca

SEQ ID NO: 627741 - RNA, 22 nt, Human
caucucaugggcaugccaagcu

SEQ ID NO: 627742 - RNA, 21 nt, Human
uccaagcucaacucccuuccu

SEQ ID NO: 627743 - RNA, 22 nt, Human
gcauggcaaauaucgagggcag

SEQ ID NO: 627744 - RNA, 22 nt, Human
uccuuggagcccaggaguagca

SEQ ID NO: 627745 - RNA, 22 nt, Human
uucuuacagauuuggugaauga

SEQ ID NO: 627746 - RNA, 22 nt, Human
ucccagccuuucuuuucugcug

SEQ ID NO: 627747 - RNA, 20 nt, Human
ucauuguguugccaauuccc

SEQ ID NO: 627748 - RNA, 22 nt, Human
gagccagcugagcugcacuguc

SEQ ID NO: 627749 - RNA, 22 nt, Human
augcuaaauggccaguaccaaa

SEQ ID NO: 627750 - RNA, 22 nt, Human
uaggcugggagccugaggcuag

SEQ ID NO: 627751 - RNA, 22 nt, Human
cugcuuggcauugguaaagaau

SEQ ID NO: 627752 - RNA, 22 nt, Human
cuggagcuccagggucuccucu

SEQ ID NO: 627753 - RNA, 17 nt, Human
uuuucuccugcccauuc

SEQ ID NO: 627754 - RNA, 22 nt, Human
cuggcugaggcagagccugggg

SEQ ID NO: 627755 - RNA, 22 nt, Human
acagcuggccgaggcucaggga

SEQ ID NO: 627756 - RNA, 22 nt, Human
acugccaccuggugguccugga

SEQ ID NO: 627757 - RNA, 22 nt, Human
uggcucucuuguaagguaguag

SEQ ID NO: 627758 - RNA, 22 nt, Human
gugugaaaaugugcacaauaug

SEQ ID NO: 627759 - RNA, 22 nt, Human
uagauucagauauuuaggacaa

SEQ ID NO: 627760 - RNA, 22 nt, Human
cuggcaccuccagcucauggcc

SEQ ID NO: 627761 - RNA, 22 nt, Human
aggggagaguuaaugugaaugu

SEQ ID NO: 627762 - RNA, 20 nt, Human
ugagaaggggucagcuguac

SEQ ID NO: 627763 - RNA, 21 nt, Human
aguaguuuagcacaggguuug

SEQ ID NO: 627764 - RNA, 22 nt, Human
gugggcagccuguccggagacc

SEQ ID NO: 627765 - RNA, 22 nt, Human
aagauucuuugaggauuuuacu

SEQ ID NO: 627766 - RNA, 22 nt, Human
gaauauuuucaguacagauggu

SEQ ID NO: 627767 - RNA, 20 nt, Human
uaacuuucuaugcuuucagc

SEQ ID NO: 627768 - RNA, 22 nt, Human
gcugaggugaggcuggaaagga

SEQ ID NO: 627769 - RNA, 22 nt, Human
ugucccauggacacaacuucuu

SEQ ID NO: 627770 - RNA, 22 nt, Human
aacucucauuuuagguguaagg

SEQ ID NO: 627771 - RNA, 22 nt, Human
acagauguggaguuugcaugau

SEQ ID NO: 627772 - RNA, 22 nt, Human
ucuguacaccaggggccauucu

SEQ ID NO: 627773 - RNA, 20 nt, Human
gcucugugcuggcggaggcu

SEQ ID NO: 627774 - RNA, 22 nt, Human
ggaggugguuugauuucuauau

SEQ ID NO: 627775 - RNA, 22 nt, Human
ugcccuggggucuggagcagca

SEQ ID NO: 627776 - RNA, 22 nt, Human
gaugggcagcacagcuggccaa

SEQ ID NO: 627777 - RNA, 19 nt, Human
ucucacaagcaacauuguu

SEQ ID NO: 627778 - RNA, 23 nt, Human
ugcaggugugcagagggcucuug

SEQ ID NO: 627779 - RNA, 22 nt, Human
ggagggggaauucagccccagc

SEQ ID NO: 627780 - RNA, 22 nt, Human
acuucauguuguuuacaacuua

SEQ ID NO: 627781 - RNA, 22 nt, Human
aggaguggugcaggaccugcca

SEQ ID NO: 627782 - RNA, 22 nt, Human
gacacuuuaggccaccaugcaa

SEQ ID NO: 627783 - RNA, 20 nt, Human
gggcuggauaauucuuugcu

SEQ ID NO: 627784 - RNA, 22 nt, Human
acugggccuggauuggcguguc

SEQ ID NO: 627785 - RNA, 22 nt, Human
ugugggcucuaauggcagcaga

SEQ ID NO: 627786 - RNA, 22 nt, Human
ucccucagagaccguggugcag

SEQ ID NO: 627787 - RNA, 22 nt, Human
auggcugccuuaauucuucagc

SEQ ID NO: 627788 - RNA, 22 nt, Human
uccugggcuucacagacucugu

SEQ ID NO: 627789 - RNA, 22 nt, Human
ccacaugugcacugcuguaugg

SEQ ID NO: 627790 - RNA, 22 nt, Human
uuuaaaccuccugauucagcua

SEQ ID NO: 627791 - RNA, 22 nt, Human
caugccuguauuucugaucuau

SEQ ID NO: 627792 - RNA, 22 nt, Human
gugacagauuugcugcgcaugg

SEQ ID NO: 627793 - RNA, 22 nt, Human
ggcccuguccccuucaguuuug

SEQ ID NO: 627794 - RNA, 22 nt, Human
ucugggcugggagcguguggac

SEQ ID NO: 627795 - RNA, 22 nt, Human
cagaugcuucgugggugagcac

SEQ ID NO: 627796 - RNA, 22 nt, Human
gugggagccauuuccaguaugc

SEQ ID NO: 627797 - RNA, 22 nt, Human
uccauguggcaauaggagacag

SEQ ID NO: 627798 - RNA, 22 nt, Human
uguaggccuauguccagcaauu

SEQ ID NO: 627799 - RNA, 22 nt, Human
guguguaaugcuuauugugcuu

SEQ ID NO: 627800 - RNA, 22 nt, Human
uugcagcugugagcuuuacacg

SEQ ID NO: 627801 - RNA, 22 nt, Human
uccagcucuucaguucugcaaa

SEQ ID NO: 627802 - RNA, 22 nt, Human
gcuggcagguccaagauagagc

SEQ ID NO: 627803 - RNA, 22 nt, Human
ggucugagauauuuguucagcu

SEQ ID NO: 627804 - RNA, 22 nt, Human
uuugugaagggaacagaagugu

SEQ ID NO: 627805 - RNA, 22 nt, Human
aagaugcgguugaccauggugu

SEQ ID NO: 627806 - RNA, 22 nt, Human
gauucauaccguuucuucucca

SEQ ID NO: 627807 - RNA, 22 nt, Human
aggagagagaacacuugggucc

SEQ ID NO: 627808 - RNA, 22 nt, Human
gggcuauagcacuauguauggg

SEQ ID NO: 627809 - RNA, 22 nt, Human
uugaguucuggucuuuuaaaag

SEQ ID NO: 627810 - RNA, 20 nt, Human
aauguauauuuuaugccagg

SEQ ID NO: 627811 - RNA, 22 nt, Human
cucugcuuggaacagggguuug

SEQ ID NO: 627812 - RNA, 22 nt, Human
gcugcccaggagagguggggcu

SEQ ID NO: 627813 - RNA, 22 nt, Human
gcugcuuugacagugggaacag

SEQ ID NO: 627814 - RNA, 22 nt, Human
ggcucagaggccagcagguaga

SEQ ID NO: 627815 - RNA, 19 nt, Human
aaggaauggcuuuaaguag

SEQ ID NO: 627816 - RNA, 22 nt, Human
aagcuguuuuggccuuaguuga

SEQ ID NO: 627817 - RNA, 22 nt, Human
aggcagccaaucagaggcugac

SEQ ID NO: 627818 - RNA, 22 nt, Human
ugggccaggucugcggucauuu

SEQ ID NO: 627819 - RNA, 22 nt, Human
ccagggcuuaacuuuucaggag

SEQ ID NO: 627820 - RNA, 22 nt, Human
gcugucccaugguugcaagaug

SEQ ID NO: 627821 - RNA, 22 nt, Human
ugggucuccaguucagggcagg

SEQ ID NO: 627822 - RNA, 22 nt, Human
uuacgaguuugcaauuuuaaau

SEQ ID NO: 627823 - RNA, 22 nt, Human
uuggaucauggaaugucugcuu

SEQ ID NO: 627824 - RNA, 22 nt, Human
agacucugcauuucuaauaagc

SEQ ID NO: 627825 - RNA, 22 nt, Human
cauacagagaaggauaauaaag

SEQ ID NO: 627826 - RNA, 22 nt, Human
gcacggcuaauuuuuguauuuu

SEQ ID NO: 627827 - RNA, 22 nt, Human
agcugcagcccuccugcauggc

SEQ ID NO: 627828 - RNA, 22 nt, Human
caggauauuuacguucugcuac

SEQ ID NO: 627829 - RNA, 22 nt, Human
caguggcuuaaauaagauuagg

SEQ ID NO: 627830 - RNA, 22 nt, Human
agggaucaguagggacggcagc

SEQ ID NO: 627831 - RNA, 22 nt, Human
ugcauuaagcacacuuuugaau

SEQ ID NO: 627832 - RNA, 22 nt, Human
aagagcuggcucuugcagcagc

SEQ ID NO: 627833 - RNA, 22 nt, Human
uacagaagcuuuugaaaagaug

SEQ ID NO: 627834 - RNA, 22 nt, Human
ucuuauacagaagauguuuaau

SEQ ID NO: 627835 - RNA, 22 nt, Human
aggagggauagaaaaauacuug

SEQ ID NO: 627836 - RNA, 22 nt, Human
gcaucuucacacaaagccagug

SEQ ID NO: 627837 - RNA, 22 nt, Human
ucagagcuuaucucuugcugga

SEQ ID NO: 627838 - RNA, 22 nt, Human
augaaaagggagugauauuugu

SEQ ID NO: 627839 - RNA, 22 nt, Human
cugcuuccauaaauaaugugcu

SEQ ID NO: 627840 - RNA, 22 nt, Human
aucuuucuccauauacaucuuu

SEQ ID NO: 627841 - RNA, 22 nt, Human
ccucugcucccuggugucugag

SEQ ID NO: 627842 - RNA, 19 nt, Human
ucuguggcaccugggaggg

SEQ ID NO: 627843 - RNA, 22 nt, Human
uuuaagagcuaguaugucauuu

SEQ ID NO: 627844 - RNA, 22 nt, Human
uuuauuguuguuagucauaagu

SEQ ID NO: 627845 - RNA, 19 nt, Human
cgcaggagccgaggugacc

SEQ ID NO: 627846 - RNA, 22 nt, Human
ugugcugguacaugugaggaug

SEQ ID NO: 627847 - RNA, 22 nt, Human
gccaggccacucccggguccug

SEQ ID NO: 627848 - RNA, 20 nt, Human
ugcagcuucucaucuucaaa

SEQ ID NO: 627849 - RNA, 22 nt, Human
gcucagggaguuucacagugua

SEQ ID NO: 627850 - RNA, 22 nt, Human
caggccagcguccagaacaagc

SEQ ID NO: 627851 - RNA, 22 nt, Human
aucugacaaccuauugacuuga

SEQ ID NO: 627852 - RNA, 22 nt, Human
auuuuucaacuuuggaaauggc

SEQ ID NO: 627853 - RNA, 22 nt, Human
agggugggcuagacucuucccc

SEQ ID NO: 627854 - RNA, 22 nt, Human
guccuguuggugaauggcucuu

SEQ ID NO: 627855 - RNA, 21 nt, Human
acaugucucuaaucucaguga

SEQ ID NO: 627856 - RNA, 22 nt, Human
agugggcaaaacagcucagagc

SEQ ID NO: 627857 - RNA, 22 nt, Human
ggccaaggaugguggcucuggu

SEQ ID NO: 627858 - RNA, 22 nt, Human
gcucagcuacuuacagguggcu

SEQ ID NO: 627859 - RNA, 16 nt, Human
cagcccugaggaagaa

SEQ ID NO: 627860 - RNA, 21 nt, Human
ccagcugcuccuugagguucc

SEQ ID NO: 627861 - RNA, 22 nt, Human
uguacagaaauuccuacuacau

SEQ ID NO: 627862 - RNA, 22 nt, Human
cagaagaaaguggggagacaag

SEQ ID NO: 627863 - RNA, 22 nt, Human
ccuggagcuuggucacgcugcg

SEQ ID NO: 627864 - RNA, 22 nt, Human
ggcgggugcacagacccuuccc

SEQ ID NO: 627865 - RNA, 22 nt, Human
gugcugccggcauagcagugaa

SEQ ID NO: 627866 - RNA, 22 nt, Human
aguuggguuugugucaguugca

SEQ ID NO: 627867 - RNA, 22 nt, Human
cuguuuuugugcugugucuccc

SEQ ID NO: 627868 - RNA, 22 nt, Human
aggcucugcagugcuggaggac

SEQ ID NO: 627869 - RNA, 22 nt, Human
ugaaguuagaacuaugaggaua

SEQ ID NO: 627870 - RNA, 22 nt, Human
accacaggaauugcucuguggu

SEQ ID NO: 627871 - RNA, 22 nt, Human
gaggugaguggaucacgagguc

SEQ ID NO: 627872 - RNA, 22 nt, Human
gggaccugccauugcucacagg

SEQ ID NO: 627873 - RNA, 22 nt, Human
accccagggcugccagccuccu

SEQ ID NO: 627874 - RNA, 22 nt, Human
gacuacaacaauaagaacagcu

SEQ ID NO: 627875 - RNA, 22 nt, Human
uaacugugugaacgugaucauu

SEQ ID NO: 627876 - RNA, 22 nt, Human
gagaaguuuggagugaagguuu

SEQ ID NO: 627877 - RNA, 22 nt, Human
agacauuuggaagauacacaua

SEQ ID NO: 627878 - RNA, 22 nt, Human
cuggcugcaaaaucuauucacu

SEQ ID NO: 627879 - RNA, 22 nt, Human
cuggucagggcucuuugggagc

SEQ ID NO: 627880 - RNA, 22 nt, Human
aagaugugaaauugucucuggg

SEQ ID NO: 627881 - RNA, 19 nt, Human
acacugggagaagacugcu

SEQ ID NO: 627882 - RNA, 22 nt, Human
uggggagugaugccucggauaa

SEQ ID NO: 627883 - RNA, 22 nt, Human
ggcugcuucucacucauuugca

SEQ ID NO: 627884 - RNA, 22 nt, Human
ggacuuuagcagcuggagagga

SEQ ID NO: 627885 - RNA, 22 nt, Human
aggcagagcuaggaagaauugu

SEQ ID NO: 627886 - RNA, 22 nt, Human
ggugccaggcuguagucagggu

SEQ ID NO: 627887 - RNA, 22 nt, Human
auuccacagugccuuccgugaa

SEQ ID NO: 627888 - RNA, 22 nt, Human
aagguagauucuggaucgaagg

SEQ ID NO: 627889 - RNA, 22 nt, Human
gggaucugggacaacagguggu

SEQ ID NO: 627890 - RNA, 20 nt, Human
uuugcaggaaggaaauaggu

SEQ ID NO: 627891 - RNA, 22 nt, Human
ggagggcucgucauccaccacu

SEQ ID NO: 627892 - RNA, 22 nt, Human
ccugcaccaggcccagcauggu

SEQ ID NO: 627893 - RNA, 22 nt, Human
uacaagaaaguccaguggguuu

SEQ ID NO: 627894 - RNA, 22 nt, Human
cagcugcaggagaaacagaggc

SEQ ID NO: 627895 - RNA, 22 nt, Human
auaaauuaugaauggcccuuuu

SEQ ID NO: 627896 - RNA, 22 nt, Human
aagggccuccuggggagccugg

SEQ ID NO: 627897 - RNA, 22 nt, Human
gcuggcucccauugguccuucc

SEQ ID NO: 627898 - RNA, 22 nt, Human
uucuaauuguguuugcauaucu

SEQ ID NO: 627899 - RNA, 22 nt, Human
gcguuggggaccccgaagcugg

SEQ ID NO: 627900 - RNA, 22 nt, Human
uguagaggaggaaacugaggcu

SEQ ID NO: 627901 - RNA, 22 nt, Human
uacaucuagccuuacaauuauu

SEQ ID NO: 627902 - RNA, 19 nt, Human
auacacauacguaaacuga

SEQ ID NO: 627903 - RNA, 22 nt, Human
cacagaauggaccaguuuuaga

SEQ ID NO: 627904 - RNA, 22 nt, Human
auauauuuugcggucacguggc

SEQ ID NO: 627905 - RNA, 22 nt, Human
aaguggcucauguggcuucugc

SEQ ID NO: 627906 - RNA, 21 nt, Human
ucagggaagugugcagaaggg

SEQ ID NO: 627907 - RNA, 22 nt, Human
ucugaggucagugcugcaguua

SEQ ID NO: 627908 - RNA, 22 nt, Human
acagugaauaagacaugugcuu

SEQ ID NO: 627909 - RNA, 22 nt, Human
auugacaaucuacuauguucug

SEQ ID NO: 627910 - RNA, 19 nt, Human
agcauccagucaugggauc

SEQ ID NO: 627911 - RNA, 18 nt, Human
agcagaauucuaggguuc

SEQ ID NO: 627912 - RNA, 22 nt, Human
aagcaagacagaaguuacugcc

SEQ ID NO: 627913 - RNA, 22 nt, Human
gaacaacuccaagggacaucau

SEQ ID NO: 627914 - RNA, 22 nt, Human
cuuggucuagugagugagcaua

SEQ ID NO: 627915 - RNA, 22 nt, Human
uguuuacagcugaucaggcauc

SEQ ID NO: 627916 - RNA, 22 nt, Human
uucuuuuggacucaaagagaac

SEQ ID NO: 627917 - RNA, 23 nt, Human
agucugugcugaagaaguuacaa

SEQ ID NO: 627918 - RNA, 22 nt, Human
aaguguguugacugaauugggg

SEQ ID NO: 627919 - RNA, 22 nt, Human
ugucaaacugugacuucuaaug

SEQ ID NO: 627920 - RNA, 22 nt, Human
agcugcccugggcuggagaugg

SEQ ID NO: 627921 - RNA, 22 nt, Human
auuauguaacugugguucagca

SEQ ID NO: 627922 - RNA, 22 nt, Human
caauacuuuaguaaaauggccc

SEQ ID NO: 627923 - RNA, 22 nt, Human
acaugcuuuaacuuauuuugau

SEQ ID NO: 627924 - RNA, 22 nt, Human
uacaaaugaguuguaugaacca

SEQ ID NO: 627925 - RNA, 22 nt, Human
gaggccaugaauggauguuccu

SEQ ID NO: 627926 - RNA, 22 nt, Human
acugggaaaaacugcuuugagg

SEQ ID NO: 627927 - RNA, 22 nt, Human
auacagguaggggacauacauc

SEQ ID NO: 627928 - RNA, 22 nt, Human
ugggagcaagcuacuuagggaa

SEQ ID NO: 627929 - RNA, 21 nt, Human
cagggcacacagaggauggua

SEQ ID NO: 627930 - RNA, 22 nt, Human
aguguuagugaaagguguuuau

SEQ ID NO: 627931 - RNA, 23 nt, Human
accagcaaaaaugacagcccagg

SEQ ID NO: 627932 - RNA, 22 nt, Human
ccugaacucuaaauagagcagu

SEQ ID NO: 627933 - RNA, 22 nt, Human
ggguaggcaaagcaaugacguu

SEQ ID NO: 627934 - RNA, 22 nt, Human
cugcuuuguggaaucacacugg

SEQ ID NO: 627935 - RNA, 22 nt, Human
cugauuagaguguuaaugagga

SEQ ID NO: 627936 - RNA, 22 nt, Human
acuguaaaauacauaaguauug

SEQ ID NO: 627937 - RNA, 20 nt, Human
cuagccuggccuugcucugg

SEQ ID NO: 627938 - RNA, 22 nt, Human
ucagauuuuugagaugucuguu

SEQ ID NO: 627939 - RNA, 22 nt, Human
uucuuucccagaagauauguuu

SEQ ID NO: 627940 - RNA, 22 nt, Human
gccaggguucgaauccguaugg

SEQ ID NO: 627941 - RNA, 21 nt, Human
gacuggagagaggaagucugg

SEQ ID NO: 627942 - RNA, 22 nt, Human
agauaacauuuauugaauguaa

SEQ ID NO: 627943 - RNA, 22 nt, Human
gauaaauuaucagggguuuaaa

SEQ ID NO: 627944 - RNA, 22 nt, Human
cacugaaggcugcagcucagcc

SEQ ID NO: 627945 - RNA, 22 nt, Human
uuuuauacacaugaacaugcag

SEQ ID NO: 627946 - RNA, 22 nt, Human
aaggugucaccagauuggcagg

SEQ ID NO: 627947 - RNA, 22 nt, Human
ccagcugcugugcagggaggcu

SEQ ID NO: 627948 - RNA, 22 nt, Human
gacccuggcuggagcuggccug

SEQ ID NO: 627949 - RNA, 22 nt, Human
ucugcaaacuuaaguugaaaua

SEQ ID NO: 627950 - RNA, 22 nt, Human
ugccagcccaccuuggggccuc

SEQ ID NO: 627951 - RNA, 22 nt, Human
uggcucugcaccucaguguacc

SEQ ID NO: 627952 - RNA, 22 nt, Human
uuggcgcccaggacgccgccgc

SEQ ID NO: 627953 - RNA, 22 nt, Human
ugcaaccugacccagccagccc

SEQ ID NO: 627954 - RNA, 22 nt, Human
uagaaauaaaucugcagcuggg

SEQ ID NO: 627955 - RNA, 22 nt, Human
cuucuccagccacgcccacucc

SEQ ID NO: 627956 - RNA, 22 nt, Human
gaagcauacuuucuauacugcu

SEQ ID NO: 627957 - RNA, 22 nt, Human
ugccaccaucuggcuguguuga

SEQ ID NO: 627958 - RNA, 22 nt, Human
ucagcauguucuuaggucacag

SEQ ID NO: 627959 - RNA, 22 nt, Human
aggguaggaacugaguggaagg

SEQ ID NO: 627960 - RNA, 22 nt, Human
aaagcaugguuaaagacagugg

SEQ ID NO: 627961 - RNA, 22 nt, Human
acagcaaaagacaagaacuuaa

SEQ ID NO: 627962 - RNA, 22 nt, Human
gaggggcucuuuaauaguaaca

SEQ ID NO: 627963 - RNA, 22 nt, Human
aacaugauguauuuucuugucu

SEQ ID NO: 627964 - RNA, 22 nt, Human
gaggccuggaauuccagccugg

SEQ ID NO: 627965 - RNA, 22 nt, Human
caggaaugacccaacaguuuca

SEQ ID NO: 627966 - RNA, 23 nt, Human
cugcuuucccacuccaugcucuu

SEQ ID NO: 627967 - RNA, 22 nt, Human
agcugccacaugcccaagggca

SEQ ID NO: 627968 - RNA, 22 nt, Human
uguccaccguucagcaccagag

SEQ ID NO: 627969 - RNA, 22 nt, Human
agguccuguguccaggggccug

SEQ ID NO: 627970 - RNA, 22 nt, Human
auuuccuagccucucuugcagu

SEQ ID NO: 627971 - RNA, 23 nt, Human
agaagcaaugcuuuuuuuccucu

SEQ ID NO: 627972 - RNA, 22 nt, Human
uccugauuagguuuccauagcu

SEQ ID NO: 627973 - RNA, 22 nt, Human
caucacauguaggcagcaucac

SEQ ID NO: 627974 - RNA, 22 nt, Human
gcugauguuucaaguauagcuu

SEQ ID NO: 627975 - RNA, 22 nt, Human
ugcuggaaagaauuuucuguua

SEQ ID NO: 627976 - RNA, 22 nt, Human
agauguggaaagaaguuagaag

SEQ ID NO: 627977 - RNA, 22 nt, Human
gaggcaguguugaaaaggagag

SEQ ID NO: 627978 - RNA, 22 nt, Human
aauggcuuagcagaguuagaag

SEQ ID NO: 627979 - RNA, 18 nt, Human
aggacuccugggaguugg

SEQ ID NO: 627980 - RNA, 22 nt, Human
gagcacaggcuuugguggacac

SEQ ID NO: 627981 - RNA, 22 nt, Human
uuuguauuacaaagucacagua

SEQ ID NO: 627982 - RNA, 22 nt, Human
auccauuuguaaauguuagagu

SEQ ID NO: 627983 - RNA, 17 nt, Human
agacagugagugccuug

SEQ ID NO: 627984 - RNA, 22 nt, Human
aauucaaauuugaguuugugau

SEQ ID NO: 627985 - RNA, 22 nt, Human
acuuagcagguacuuucauauu

SEQ ID NO: 627986 - RNA, 20 nt, Human
gaagugucuuguuucuggau

SEQ ID NO: 627987 - RNA, 22 nt, Human
auacaguauguaggcuuuucag

SEQ ID NO: 627988 - RNA, 21 nt, Human
auauuguagguaaagugcagg

SEQ ID NO: 627989 - RNA, 22 nt, Human
uuugaagacuacugggagugaa

SEQ ID NO: 627990 - RNA, 18 nt, Human
uucucugguggauguuau

SEQ ID NO: 627991 - RNA, 22 nt, Human
aauuuggagcuuuguuucuaga

SEQ ID NO: 627992 - RNA, 22 nt, Human
cucaggagcuuccucagcccau

SEQ ID NO: 627993 - RNA, 22 nt, Human
ucaguuacucugauguccugug

SEQ ID NO: 627994 - RNA, 22 nt, Human
uuagcaucugcuguaagcuuau

SEQ ID NO: 627995 - RNA, 22 nt, Human
gaguccuggaacccugaaugcu

SEQ ID NO: 627996 - RNA, 22 nt, Human
ugcaauaaguuguguuaucacu

SEQ ID NO: 627997 - RNA, 22 nt, Human
gccagcagggcggagccaucua

SEQ ID NO: 627998 - RNA, 22 nt, Human
gaccuggaauuuguguguguuc

SEQ ID NO: 627999 - RNA, 22 nt, Human
uccagcucuaaggcugauagcc

SEQ ID NO: 628000 - RNA, 22 nt, Human
aggugacugguuuaucuggcag

SEQ ID NO: 628001 - RNA, 23 nt, Human
ccagugauugccuggaaggaggu

SEQ ID NO: 628002 - RNA, 22 nt, Human
gcuguacauucugcacaggccc

SEQ ID NO: 628003 - RNA, 22 nt, Human
ucaggaagugccuaggcuggcc

SEQ ID NO: 628004 - RNA, 22 nt, Human
ugggugguugcugaggcuccuu

SEQ ID NO: 628005 - RNA, 22 nt, Human
ugcagcauuauucacaguagcc

SEQ ID NO: 628006 - RNA, 22 nt, Human
gcuugcaugauuggagugggug

SEQ ID NO: 628007 - RNA, 20 nt, Human
uugcauuggaugugcaggug

SEQ ID NO: 628008 - RNA, 19 nt, Human
aggugcaggucacagggga

SEQ ID NO: 628009 - RNA, 20 nt, Human
cacaacuguccacaugcucc

SEQ ID NO: 628010 - RNA, 22 nt, Human
uggcagggccugcucaucaucc

SEQ ID NO: 628011 - RNA, 22 nt, Human
aaauguguauaugaaacaugau

SEQ ID NO: 628012 - RNA, 22 nt, Human
gggugcugacuggggccugaaa

SEQ ID NO: 628013 - RNA, 22 nt, Human
aagggcagccugacucacgguc

SEQ ID NO: 628014 - RNA, 22 nt, Human
aaagucaucuaggagcagauuu

SEQ ID NO: 628015 - RNA, 22 nt, Human
gcccaggaaaugccccguggug

SEQ ID NO: 628016 - RNA, 22 nt, Human
auuucccagauaaacagcugga

SEQ ID NO: 628017 - RNA, 22 nt, Human
agugggcauaugaagucucaag

SEQ ID NO: 628018 - RNA, 22 nt, Human
gucugagcuacuuaggauauaa

SEQ ID NO: 628019 - RNA, 22 nt, Human
gcugcccugacaagcuacuccc

SEQ ID NO: 628020 - RNA, 15 nt, Human
cugaacucuaaacca

SEQ ID NO: 628021 - RNA, 22 nt, Human
caucuuaacaggucucugaggg

SEQ ID NO: 628022 - RNA, 22 nt, Human
agggucugacugaauggaaaag

SEQ ID NO: 628023 - RNA, 22 nt, Human
cuggguguuggguacugaccgu

SEQ ID NO: 628024 - RNA, 21 nt, Human
agaaggcaaaagcagacaucu

SEQ ID NO: 628025 - RNA, 22 nt, Human
aaaugaacucaaugaucuccca

SEQ ID NO: 628026 - RNA, 22 nt, Human
gggggcuggaauauccaucaac

SEQ ID NO: 628027 - RNA, 22 nt, Human
aggacuggugugugaucagcau

SEQ ID NO: 628028 - RNA, 22 nt, Human
uggaggccuagguugaugugug

SEQ ID NO: 628029 - RNA, 22 nt, Human
cagcagagcugggaauaaaauu

SEQ ID NO: 628030 - RNA, 22 nt, Human
aaucuguuuguuuacaccuuuu

SEQ ID NO: 628031 - RNA, 22 nt, Human
agcuggaacgucacaggagcag

SEQ ID NO: 628032 - RNA, 22 nt, Human
cacacagaugguaagggaggga

SEQ ID NO: 628033 - RNA, 22 nt, Human
ucacacagggucggaaagagug

SEQ ID NO: 628034 - RNA, 22 nt, Human
ucagggcaccaaaaaagaugcc

SEQ ID NO: 628035 - RNA, 22 nt, Human
uggcuggcgccgggcuagccac

SEQ ID NO: 628036 - RNA, 22 nt, Human
uggcuucucagaauacucugga

SEQ ID NO: 628037 - RNA, 22 nt, Human
gaggcugcccaacuggagugga

SEQ ID NO: 628038 - RNA, 22 nt, Human
cagagacaaccugguagagaaa

SEQ ID NO: 628039 - RNA, 22 nt, Human
ugcuccaggugugccucucaug

SEQ ID NO: 628040 - RNA, 22 nt, Human
acuaaaaacuacugccaauagc

SEQ ID NO: 628041 - RNA, 22 nt, Human
caguagcagggauuauuuuagg

SEQ ID NO: 628042 - RNA, 22 nt, Human
auguuauuucugaaagaucauu

SEQ ID NO: 628043 - RNA, 22 nt, Human
ccagcagcuguggcuuugccuc

SEQ ID NO: 628044 - RNA, 22 nt, Human
aacagucuuacagaaguagcca

SEQ ID NO: 628045 - RNA, 22 nt, Human
uccugagguuuuaaaacuauuc

SEQ ID NO: 628046 - RNA, 22 nt, Human
agugcuguuagguuaauauagu

SEQ ID NO: 628047 - RNA, 22 nt, Human
acugccugugcacuggucuuuu

SEQ ID NO: 628048 - RNA, 18 nt, Human
acuccccacaggcucugu

SEQ ID NO: 628049 - RNA, 22 nt, Human
aagcacagccagguuaggggcu

SEQ ID NO: 628050 - RNA, 22 nt, Human
auggcugcaguccgugcccugg

SEQ ID NO: 628051 - RNA, 22 nt, Human
aggaauguuuagaaugucagaa

SEQ ID NO: 628052 - RNA, 22 nt, Human
ggccuaguuuuuucugguaggu

SEQ ID NO: 628053 - RNA, 22 nt, Human
uggccaccccuuucucugcacu

SEQ ID NO: 628054 - RNA, 22 nt, Human
acuguuauaguucacuuuuccc

SEQ ID NO: 628055 - RNA, 20 nt, Human
acaugcaguggucauuucag

SEQ ID NO: 628056 - RNA, 18 nt, Human
ccugagcccugcuuacuu

SEQ ID NO: 628057 - RNA, 20 nt, Human
aggggucuagcagcagugcu

SEQ ID NO: 628058 - RNA, 22 nt, Human
auuauucuuaaugcagggauua

SEQ ID NO: 628059 - RNA, 22 nt, Human
caucuuuguucuguaaacuuuu

SEQ ID NO: 628060 - RNA, 22 nt, Human
ccugcccugucacuggcuaggg

SEQ ID NO: 628061 - RNA, 22 nt, Human
cuguccugaggcagguggccug

SEQ ID NO: 628062 - RNA, 22 nt, Human
acccugagucacugucugucug

SEQ ID NO: 628063 - RNA, 22 nt, Human
guggcuguauagccaagucaga

SEQ ID NO: 628064 - RNA, 22 nt, Human
aggcuuggugccaaggagccug

SEQ ID NO: 628065 - RNA, 22 nt, Human
acagaaagaagguguauuugag

SEQ ID NO: 628066 - RNA, 22 nt, Human
uagucaaaagcuucacucggaa

SEQ ID NO: 628067 - RNA, 22 nt, Human
agaguuuggauuuuaggacauc

SEQ ID NO: 628068 - RNA, 22 nt, Human
cccaaggcugcagugagcauga

SEQ ID NO: 628069 - RNA, 22 nt, Human
uguacaagaauaauuuuauaua

SEQ ID NO: 628070 - RNA, 22 nt, Human
cugagcauuugugcagcuucuc

SEQ ID NO: 628071 - RNA, 20 nt, Human
gugugugcuccaugcaugcu

SEQ ID NO: 628072 - RNA, 22 nt, Human
cugccuguggucugugaucuaa

SEQ ID NO: 628073 - RNA, 22 nt, Human
agcugggcaaaaugugagguug

SEQ ID NO: 628074 - RNA, 22 nt, Human
ugcaauauuuuauauccaacaa

SEQ ID NO: 628075 - RNA, 20 nt, Human
uggagccacagucagguucc

SEQ ID NO: 628076 - RNA, 22 nt, Human
uuauacuaaaacgcauugaauu

SEQ ID NO: 628077 - RNA, 22 nt, Human
gaggccuggaccagccacagag

SEQ ID NO: 628078 - RNA, 22 nt, Human
aaggugugaacugauucauugg

SEQ ID NO: 628079 - RNA, 22 nt, Human
cucaggacccgguccagguggg

SEQ ID NO: 628080 - RNA, 22 nt, Human
uuuuaguaccaaccagaagaug

SEQ ID NO: 628081 - RNA, 22 nt, Human
gcucaguguuucugguagaaaa

SEQ ID NO: 628082 - RNA, 22 nt, Human
cagcacuuggugccauugagug

SEQ ID NO: 628083 - RNA, 22 nt, Human
gagugaguggccaggaggcaga

SEQ ID NO: 628084 - RNA, 22 nt, Human
gugugggcuaugugcgugggca

SEQ ID NO: 628085 - RNA, 22 nt, Human
cuccauggaaaaggcuguuguu

SEQ ID NO: 628086 - RNA, 22 nt, Human
aauucaguuauauguccacuuc

SEQ ID NO: 628087 - RNA, 22 nt, Human
cugcacacaucgcacugcccgu

SEQ ID NO: 628088 - RNA, 22 nt, Human
uccaggggagugcuacgcacag

SEQ ID NO: 628089 - RNA, 22 nt, Human
cuucuccuuauaugucccguuc

SEQ ID NO: 628090 - RNA, 22 nt, Human
aagcccagcugaaagcauuuuu

SEQ ID NO: 628091 - RNA, 22 nt, Human
auggcagggcccuuggcuccca

SEQ ID NO: 628092 - RNA, 22 nt, Human
gauuugugcucauuuuccauua

SEQ ID NO: 628093 - RNA, 22 nt, Human
agauuuagacugccuuaaucau

SEQ ID NO: 628094 - RNA, 22 nt, Human
gcaguguuaccuugggcugguu

SEQ ID NO: 628095 - RNA, 22 nt, Human
ccagcuccggugugcuuauuuc

SEQ ID NO: 628096 - RNA, 22 nt, Human
ccagugcgcaggcgccaccugu

SEQ ID NO: 628097 - RNA, 22 nt, Human
cugaggcugggcuugccuucuu

SEQ ID NO: 628098 - RNA, 22 nt, Human
uuuuagaaagaucccuggcagg

SEQ ID NO: 628099 - RNA, 22 nt, Human
ucuuugaaacacccuaaccuuu

SEQ ID NO: 628100 - RNA, 22 nt, Human
acaaauuguugcuucaugaaug

SEQ ID NO: 628101 - RNA, 22 nt, Human
uccucccuugggguuucguuau

SEQ ID NO: 628102 - RNA, 22 nt, Human
ucagaaagugaacuguugacau

SEQ ID NO: 628103 - RNA, 22 nt, Human
augaccagacucucaguggggu

SEQ ID NO: 628104 - RNA, 22 nt, Human
ggagaagcagcuucuugaugaa

SEQ ID NO: 628105 - RNA, 22 nt, Human
aagcauguacaaugagugucuc

SEQ ID NO: 628106 - RNA, 22 nt, Human
uggccugcaagcuaaaaaucua

SEQ ID NO: 628107 - RNA, 22 nt, Human
acacauuuucaacacugucaag

SEQ ID NO: 628108 - RNA, 22 nt, Human
uggguucagaucccagcucugu

SEQ ID NO: 628109 - RNA, 22 nt, Human
gaacuguggguaauauauuaga

SEQ ID NO: 628110 - RNA, 22 nt, Human
aagcaacauucucuguggcauu

SEQ ID NO: 628111 - RNA, 22 nt, Human
gggcuccagcuguuugccauga

SEQ ID NO: 628112 - RNA, 22 nt, Human
ugugagcacuauggcuaggcuc

SEQ ID NO: 628113 - RNA, 22 nt, Human
ggcccucuguggcugccaugga

SEQ ID NO: 628114 - RNA, 22 nt, Human
cuacagcuguaaaaggaauguc

SEQ ID NO: 628115 - RNA, 22 nt, Human
uguauuuugaguccaaucuccu

SEQ ID NO: 628116 - RNA, 22 nt, Human
auuuccaugccuuagcuuaagg

SEQ ID NO: 628117 - RNA, 22 nt, Human
caguccuggggaccaggcugag

SEQ ID NO: 628118 - RNA, 22 nt, Human
acagauguuagcaaugaugaug

SEQ ID NO: 628119 - RNA, 17 nt, Human
cugaggauuaugguugu

SEQ ID NO: 628120 - RNA, 22 nt, Human
gcuggcuugucccaggacaaag

SEQ ID NO: 628121 - RNA, 23 nt, Human
augcaaagugcugucauguagac

SEQ ID NO: 628122 - RNA, 22 nt, Human
uacacaugcucagauuccugug

SEQ ID NO: 628123 - RNA, 22 nt, Human
augucuuuuauggagaugucau

SEQ ID NO: 628124 - RNA, 22 nt, Human
ccaccccaaaugaagaccucuc

SEQ ID NO: 628125 - RNA, 22 nt, Human
ucuuccagaaucucagagggcu

SEQ ID NO: 628126 - RNA, 22 nt, Human
ugaauucuuuuagaauucagug

SEQ ID NO: 628127 - RNA, 22 nt, Human
agcuauggaacagaguggcugu

SEQ ID NO: 628128 - RNA, 22 nt, Human
caguccuuggcuucauccgagu

SEQ ID NO: 628129 - RNA, 22 nt, Human
cugagagugcucuuugauguca

SEQ ID NO: 628130 - RNA, 22 nt, Human
cagcaacuccuguagcuuaugc

SEQ ID NO: 628131 - RNA, 22 nt, Human
ggagauccaggcaaggccgcag

SEQ ID NO: 628132 - RNA, 22 nt, Human
ccauaaucguguguuaaauaau

SEQ ID NO: 628133 - RNA, 17 nt, Human
uuccuggaagucauucc

SEQ ID NO: 628134 - RNA, 22 nt, Human
uuuguucaaggaauaguaaaug

SEQ ID NO: 628135 - RNA, 22 nt, Human
uccugauggaggggucaucuuu

SEQ ID NO: 628136 - RNA, 22 nt, Human
aaagccaguuucuggaaguacc

SEQ ID NO: 628137 - RNA, 21 nt, Human
agcaucugaggcaguuuccua

SEQ ID NO: 628138 - RNA, 22 nt, Human
aguccagaacuucagcuaguuu

SEQ ID NO: 628139 - RNA, 22 nt, Human
acagucauuagauacaaugucu

SEQ ID NO: 628140 - RNA, 22 nt, Human
acuagauuuuggccauuauaca

SEQ ID NO: 628141 - RNA, 22 nt, Human
caggaugagaggcccagggaag

SEQ ID NO: 628142 - RNA, 22 nt, Human
acucaugguagcacaggcugug

SEQ ID NO: 628143 - RNA, 22 nt, Human
ucuuccagcccuucuaauggua

SEQ ID NO: 628144 - RNA, 22 nt, Human
gcaaauaauauacuuugaucuc

SEQ ID NO: 628145 - RNA, 22 nt, Human
cggcccugcugagcuugucugg

SEQ ID NO: 628146 - RNA, 22 nt, Human
ggccaggagcugcacagggcuc

SEQ ID NO: 628147 - RNA, 22 nt, Human
uuugaaagaaaccagugaguga

SEQ ID NO: 628148 - RNA, 22 nt, Human
aggggcucaaagugugcaggga

SEQ ID NO: 628149 - RNA, 22 nt, Human
ucuguuaacaggagagaaugau

SEQ ID NO: 628150 - RNA, 22 nt, Human
aaccauuagucaaucagcaaga

SEQ ID NO: 628151 - RNA, 22 nt, Human
ugcugcugaucauuuauagucu

SEQ ID NO: 628152 - RNA, 22 nt, Human
cuacagaauggagggucagaga

SEQ ID NO: 628153 - RNA, 22 nt, Human
acaugacaaaaugcacaggauu

SEQ ID NO: 628154 - RNA, 22 nt, Human
ccuccuucuggggccuucugcu

SEQ ID NO: 628155 - RNA, 22 nt, Human
caggcaggucagugaagaagga

SEQ ID NO: 628156 - RNA, 22 nt, Human
ugcacccucaucagucaaaugg

SEQ ID NO: 628157 - RNA, 22 nt, Human
agaaggcuggcccuggguggcc

SEQ ID NO: 628158 - RNA, 22 nt, Human
agagaagugagcuuguucacuc

SEQ ID NO: 628159 - RNA, 22 nt, Human
aaacuaaggugcuguggacuga

SEQ ID NO: 628160 - RNA, 22 nt, Human
uucugagguccaugcaguacug

SEQ ID NO: 628161 - RNA, 22 nt, Human
ugucauuuugucucacugcuau

SEQ ID NO: 628162 - RNA, 22 nt, Human
auggcugccuagaggugagaug

SEQ ID NO: 628163 - RNA, 22 nt, Human
uucuuuuaaaagagagcagaaa

SEQ ID NO: 628164 - RNA, 22 nt, Human
acauuucuauagugcaucuguu

SEQ ID NO: 628165 - RNA, 22 nt, Human
gaagcagcuggugagauggagc

SEQ ID NO: 628166 - RNA, 22 nt, Human
uucacagcuccuuuuacucaac

SEQ ID NO: 628167 - RNA, 22 nt, Human
gccugcucugacauccauccca

SEQ ID NO: 628168 - RNA, 22 nt, Human
auucuaauuaguucuacauguu

SEQ ID NO: 628169 - RNA, 22 nt, Human
uaugaagaaguucugugaaaug

SEQ ID NO: 628170 - RNA, 22 nt, Human
uauuuuguauuuaugcaagaaa

SEQ ID NO: 628171 - RNA, 22 nt, Human
uggagggcgcuuagauggaggg

SEQ ID NO: 628172 - RNA, 22 nt, Human
aggaugugagccagccuggccu

SEQ ID NO: 628173 - RNA, 22 nt, Human
acaguuuacagggauuugagcu

SEQ ID NO: 628174 - RNA, 22 nt, Human
guaguguguaggcacugugcuc

SEQ ID NO: 628175 - RNA, 23 nt, Human
uuuauagcagcaugauuuauagu

SEQ ID NO: 628176 - RNA, 20 nt, Human
cugcauguuggagguguacc

SEQ ID NO: 628177 - RNA, 22 nt, Human
agcucaagaguaguucgagggg

SEQ ID NO: 628178 - RNA, 19 nt, Human
agacaugagacacaggaug

SEQ ID NO: 628179 - RNA, 22 nt, Human
uguuaaauguuccuuuacugga

SEQ ID NO: 628180 - RNA, 22 nt, Human
augcuugguuccuacuucuggc

SEQ ID NO: 628181 - RNA, 22 nt, Human
acuggcagaauugaauaguugu

SEQ ID NO: 628182 - RNA, 22 nt, Human
uuuggacaaaugucugacuuuc

SEQ ID NO: 628183 - RNA, 21 nt, Human
acugccuggggugcuggccaa

SEQ ID NO: 628184 - RNA, 23 nt, Human
cugggcauggagcuucagaggcu

SEQ ID NO: 628185 - RNA, 22 nt, Human
aaagucaggcuguguaccuaac

SEQ ID NO: 628186 - RNA, 22 nt, Human
uuuggagagcagcuaggcccuu

SEQ ID NO: 628187 - RNA, 22 nt, Human
caaggccugccucuggcagaaa

SEQ ID NO: 628188 - RNA, 19 nt, Human
acacauguguguuaugugc

SEQ ID NO: 628189 - RNA, 22 nt, Human
uguggcugccacccugaagccg

SEQ ID NO: 628190 - RNA, 22 nt, Human
augcaauaaauacuuuccagcu

SEQ ID NO: 628191 - RNA, 22 nt, Human
gaggcaguuccugagugacaag

SEQ ID NO: 628192 - RNA, 22 nt, Human
ugucauuccuucaauguagaua

SEQ ID NO: 628193 - RNA, 22 nt, Human
gaaggcugagcagacaggccaa

SEQ ID NO: 628194 - RNA, 22 nt, Human
ccaggggggcguagaugcuggg

SEQ ID NO: 628195 - RNA, 22 nt, Human
agacccucuccucauggacaug

SEQ ID NO: 628196 - RNA, 22 nt, Human
cuucacaaauggccuagaguuc

SEQ ID NO: 628197 - RNA, 22 nt, Human
cugggccucacacccaccaaau

SEQ ID NO: 628198 - RNA, 22 nt, Human
agcagcuguggaaaaguaacua

SEQ ID NO: 628199 - RNA, 22 nt, Human
agcaucuggcagaaagucagaa

SEQ ID NO: 628200 - RNA, 22 nt, Human
ucagaggagaugguuaccaggg

SEQ ID NO: 628201 - RNA, 22 nt, Human
ugaagcugccugcucacagcca

SEQ ID NO: 628202 - RNA, 22 nt, Human
ugcuccaggcaagcugagaguu

SEQ ID NO: 628203 - RNA, 22 nt, Human
uggccugcccagagcagcucug

SEQ ID NO: 628204 - RNA, 22 nt, Human
agaaacauuuagauuauauguc

SEQ ID NO: 628205 - RNA, 22 nt, Human
uauaauuaguaaauggcagauu

SEQ ID NO: 628206 - RNA, 22 nt, Human
uucuccuggagugcuuguuggg

SEQ ID NO: 628207 - RNA, 22 nt, Human
aagugauuuagucuuauaaagg

SEQ ID NO: 628208 - RNA, 22 nt, Human
gcugagacuuccacugccaucu

SEQ ID NO: 628209 - RNA, 22 nt, Human
cauugaaaccuaacauaggcug

SEQ ID NO: 628210 - RNA, 22 nt, Human
aacuuuaucggaacagguacuc

SEQ ID NO: 628211 - RNA, 22 nt, Human
ugaaggcccagccacagaaugg

SEQ ID NO: 628212 - RNA, 23 nt, Human
auuugagaaaguauuuuuaagac

SEQ ID NO: 628213 - RNA, 22 nt, Human
aaauaugaaugauaagaguuau

SEQ ID NO: 628214 - RNA, 22 nt, Human
uuuuaugauugagcuggcuaca

SEQ ID NO: 628215 - RNA, 22 nt, Human
gcuggagguuucaccugaguuu

SEQ ID NO: 628216 - RNA, 22 nt, Human
aguguuuagggaaucaaggggu

SEQ ID NO: 628217 - RNA, 22 nt, Human
ucauaaagagugcuguuguuuu

SEQ ID NO: 628218 - RNA, 22 nt, Human
uucccucuccaggagcccugag

SEQ ID NO: 628219 - RNA, 22 nt, Human
acugaggcuuaaagagauuagg

SEQ ID NO: 628220 - RNA, 22 nt, Human
gcaggcuguagacaccaaacua

SEQ ID NO: 628221 - RNA, 23 nt, Human
ugcuucucugcuugacaguucug

SEQ ID NO: 628222 - RNA, 22 nt, Human
ccagguacuugguaugcauuca

SEQ ID NO: 628223 - RNA, 22 nt, Human
gcuggcucgggaagcaggggau

SEQ ID NO: 628224 - RNA, 20 nt, Human
ucaaagcaaagggagaugau

SEQ ID NO: 628225 - RNA, 17 nt, Human
ucaggcugugccuggua

SEQ ID NO: 628226 - RNA, 22 nt, Human
ugaggggagguuggggcacauc

SEQ ID NO: 628227 - RNA, 22 nt, Human
aacacaguuucugcauugguag

SEQ ID NO: 628228 - RNA, 22 nt, Human
cuuaagauugucagcuucagcc

SEQ ID NO: 628229 - RNA, 22 nt, Human
ucagcaggcagaaaucugcaga

SEQ ID NO: 628230 - RNA, 22 nt, Human
cugcagccacgagucacagccc

SEQ ID NO: 628231 - RNA, 22 nt, Human
ugacacugcaaauauaaauauu

SEQ ID NO: 628232 - RNA, 22 nt, Human
uuuagcagagcauaugauaucc

SEQ ID NO: 628233 - RNA, 22 nt, Human
uuuccuuugaggguccuacacu

SEQ ID NO: 628234 - RNA, 22 nt, Human
ugggcaccugaggccuggcagg

SEQ ID NO: 628235 - RNA, 22 nt, Human
aaacauucccuaauguguccgu

SEQ ID NO: 628236 - RNA, 21 nt, Human
cucuggaguuugaaggcuggg

SEQ ID NO: 628237 - RNA, 22 nt, Human
uauuuugagguauuuuugagcu

SEQ ID NO: 628238 - RNA, 22 nt, Human
aauuagggagagguagcuaggu

SEQ ID NO: 628239 - RNA, 22 nt, Human
uaaaggcucacuggcuuggggu

SEQ ID NO: 628240 - RNA, 23 nt, Human
uucauugauugcaaggagauugg

SEQ ID NO: 628241 - RNA, 22 nt, Human
ugaggcagggaguuuaauuguc

SEQ ID NO: 628242 - RNA, 22 nt, Human
acacuuauuuuuguccacuucc

SEQ ID NO: 628243 - RNA, 22 nt, Human
ucccaggacaugggcucugcuc

SEQ ID NO: 628244 - RNA, 22 nt, Human
ucagaaauacuaucagcuuuug

SEQ ID NO: 628245 - RNA, 22 nt, Human
ugucaucugauauuacuuauag

SEQ ID NO: 628246 - RNA, 23 nt, Human
cagaggugucagugcccaguguc

SEQ ID NO: 628247 - RNA, 22 nt, Human
ugauucaacuuucuugaaugca

SEQ ID NO: 628248 - RNA, 22 nt, Human
uccagcugcuagcuagaugcaa

SEQ ID NO: 628249 - RNA, 22 nt, Human
ucaugcaaauacuguuccagaa

SEQ ID NO: 628250 - RNA, 22 nt, Human
ugcugaggaauaauuguuccug

SEQ ID NO: 628251 - RNA, 22 nt, Human
cugugaauugcaacaauugcaa

SEQ ID NO: 628252 - RNA, 22 nt, Human
acacaggcaaugugagugggag

SEQ ID NO: 628253 - RNA, 18 nt, Human
uagggcucuagggaguga

SEQ ID NO: 628254 - RNA, 21 nt, Human
acauacauaccuuaccaccuu

SEQ ID NO: 628255 - RNA, 22 nt, Human
uuugaggaagaucggagggaaa

SEQ ID NO: 628256 - RNA, 22 nt, Human
ggaguggcagagaggguauacu

SEQ ID NO: 628257 - RNA, 22 nt, Human
uggcacagacagcacagcaaug

SEQ ID NO: 628258 - RNA, 22 nt, Human
auggacagugugaagcagauag

SEQ ID NO: 628259 - RNA, 22 nt, Human
ucuccucugcgcggcagugccc

SEQ ID NO: 628260 - RNA, 22 nt, Human
ccuuucucuuggauaccgauug

SEQ ID NO: 628261 - RNA, 22 nt, Human
cuuuuacauuuguugaagagua

SEQ ID NO: 628262 - RNA, 22 nt, Human
gucagcaauucaagagcucuua

SEQ ID NO: 628263 - RNA, 21 nt, Human
cgggugaguugagcaggacac

SEQ ID NO: 628264 - RNA, 22 nt, Human
uagcaucugcauuuguaacuag

SEQ ID NO: 628265 - RNA, 22 nt, Human
uaaucacagaaacagacuguuu

SEQ ID NO: 628266 - RNA, 22 nt, Human
auguaucaauuaucugucugca

SEQ ID NO: 628267 - RNA, 22 nt, Human
ccagauguauguaugagugcau

SEQ ID NO: 628268 - RNA, 17 nt, Human
agguguggucaagggag

SEQ ID NO: 628269 - RNA, 22 nt, Human
gagcccagguucugcuuccagc

SEQ ID NO: 628270 - RNA, 22 nt, Human
acugucuuuauuagaaucuuau

SEQ ID NO: 628271 - RNA, 22 nt, Human
ucugguuucccaguuccuccgu

SEQ ID NO: 628272 - RNA, 22 nt, Human
uauuaugagguauuuggacuuu

SEQ ID NO: 628273 - RNA, 22 nt, Human
cucuuuccaggguaccccaggu

SEQ ID NO: 628274 - RNA, 22 nt, Human
gaguguguucuuuaugcuguga

SEQ ID NO: 628275 - RNA, 22 nt, Human
uuucugcauauguauguaugga

SEQ ID NO: 628276 - RNA, 21 nt, Human
auggccacuauggugcagcag

SEQ ID NO: 628277 - RNA, 22 nt, Human
uuucuacagguugauggguuug

SEQ ID NO: 628278 - RNA, 22 nt, Human
agggucuguggaugcaucuggg

SEQ ID NO: 628279 - RNA, 22 nt, Human
gcuggaguccaguggcaugauc

SEQ ID NO: 628280 - RNA, 22 nt, Human
auucuuguuuaauuugcauccc

SEQ ID NO: 628281 - RNA, 21 nt, Human
uguuuucuaaagggcggauca

SEQ ID NO: 628282 - RNA, 22 nt, Human
aaaagcaaguugccuagguuga

SEQ ID NO: 628283 - RNA, 22 nt, Human
acagcagcuaaaggugucuccu

SEQ ID NO: 628284 - RNA, 22 nt, Human
acacuguguggucucucucgga

SEQ ID NO: 628285 - RNA, 22 nt, Human
acagggcucugacaccaaggua

SEQ ID NO: 628286 - RNA, 21 nt, Human
acugagagauguuggaucaua

SEQ ID NO: 628287 - RNA, 22 nt, Human
agcuccagauuaauuguaggag

SEQ ID NO: 628288 - RNA, 22 nt, Human
uccugagggcauuuuggugacu

SEQ ID NO: 628289 - RNA, 22 nt, Human
cccagagaauuccacauagagg

SEQ ID NO: 628290 - RNA, 22 nt, Human
gagcccugaacaacagcaggaa

SEQ ID NO: 628291 - RNA, 22 nt, Human
ucucuucugaccuagccuugga

SEQ ID NO: 628292 - RNA, 22 nt, Human
cugcauccuggaaauagcuaag

SEQ ID NO: 628293 - RNA, 22 nt, Human
cuuuccccaguauaucauugcc

SEQ ID NO: 628294 - RNA, 22 nt, Human
ugguuggcugagcagagucacu

SEQ ID NO: 628295 - RNA, 22 nt, Human
cuggcagcuuauuagaaaugca

SEQ ID NO: 628296 - RNA, 22 nt, Human
caggaacacaaugagucucaaa

SEQ ID NO: 628297 - RNA, 21 nt, Human
uguuaugugcuucaagaagug

SEQ ID NO: 628298 - RNA, 22 nt, Human
gcuaaauaaucuucuucugaca

SEQ ID NO: 628299 - RNA, 22 nt, Human
ucagcagucacauguuguccca

SEQ ID NO: 628300 - RNA, 22 nt, Human
ccuccuuuccuguuuuccugag

SEQ ID NO: 628301 - RNA, 22 nt, Human
gugaaggaggggccacagauau

SEQ ID NO: 628302 - RNA, 22 nt, Human
ccucuggccagagaaaggccag

SEQ ID NO: 628303 - RNA, 22 nt, Human
agggaggaaggauguuccaaag

SEQ ID NO: 628304 - RNA, 22 nt, Human
accagcaagauuuugcuuugca

SEQ ID NO: 628305 - RNA, 22 nt, Human
caucacauuuaauuaaaauguc

SEQ ID NO: 628306 - RNA, 18 nt, Human
ugaucuuugaguauaaug

SEQ ID NO: 628307 - RNA, 22 nt, Human
cauguaaugcugggagcugggc

SEQ ID NO: 628308 - RNA, 21 nt, Human
aaauacagaaacuuguuuuca

SEQ ID NO: 628309 - RNA, 22 nt, Human
gugaggugguacaauauuaacu

SEQ ID NO: 628310 - RNA, 22 nt, Human
gcauauuuucacaagcucuugg

SEQ ID NO: 628311 - RNA, 22 nt, Human
ugucuacuccugugcuagcucc

SEQ ID NO: 628312 - RNA, 22 nt, Human
uaugcacacaucgcagcaggaa

SEQ ID NO: 628313 - RNA, 22 nt, Human
gacagcuucuagaggaauuggu

SEQ ID NO: 628314 - RNA, 22 nt, Human
cguggucucccacagaaagaag

SEQ ID NO: 628315 - RNA, 20 nt, Human
ccuucuccagcuuguucuug

SEQ ID NO: 628316 - RNA, 22 nt, Human
ggucccagcugcucaagaggcu

SEQ ID NO: 628317 - RNA, 22 nt, Human
aaugaacacuuagccuuucuau

SEQ ID NO: 628318 - RNA, 22 nt, Human
ucauuucuccgaccugcugucc

SEQ ID NO: 628319 - RNA, 22 nt, Human
ugaaauguugccaugaggucuc

SEQ ID NO: 628320 - RNA, 22 nt, Human
gaccagggucacucacagggcu

SEQ ID NO: 628321 - RNA, 22 nt, Human
uacaguguauguauuuguaggu

SEQ ID NO: 628322 - RNA, 22 nt, Human
caguuuauagcucuagcagcuu

SEQ ID NO: 628323 - RNA, 22 nt, Human
uuuauaaacaguaccacggugc

SEQ ID NO: 628324 - RNA, 22 nt, Human
cuggcuguuucaggcagugucc

SEQ ID NO: 628325 - RNA, 22 nt, Human
ucagcagcagcucagcauguuu

SEQ ID NO: 628326 - RNA, 22 nt, Human
ucagagugaccuuacauggucu

SEQ ID NO: 628327 - RNA, 22 nt, Human
uauguugcaccaaccuaauaau

SEQ ID NO: 628328 - RNA, 22 nt, Human
auucugaguuagagucagccag

SEQ ID NO: 628329 - RNA, 22 nt, Human
auuuccuuugcaaagacugugc

SEQ ID NO: 628330 - RNA, 22 nt, Human
cagcagcaggcgcacggccguc

SEQ ID NO: 628331 - RNA, 22 nt, Human
aagcccagaaucaagucuacug

SEQ ID NO: 628332 - RNA, 22 nt, Human
aggcugagacugugcauuagug

SEQ ID NO: 628333 - RNA, 22 nt, Human
ggcucugggaaauggucuuccu

SEQ ID NO: 628334 - RNA, 22 nt, Human
cuggaagacucaauggccugcc

SEQ ID NO: 628335 - RNA, 21 nt, Human
ugugcaguccaaugugcuagc

SEQ ID NO: 628336 - RNA, 22 nt, Human
ccaaaaagcucagagauauguu

SEQ ID NO: 628337 - RNA, 22 nt, Human
aaauuacagccuuggguagcuu

SEQ ID NO: 628338 - RNA, 22 nt, Human
uauagagcuuuggcauugauua

SEQ ID NO: 628339 - RNA, 22 nt, Human
ugaagaaacagaccaagaggau

SEQ ID NO: 628340 - RNA, 22 nt, Human
uuucccaagaaaaauaauugga

SEQ ID NO: 628341 - RNA, 22 nt, Human
ccagcagccaccuucucgaaau

SEQ ID NO: 628342 - RNA, 22 nt, Human
uuggcugguuucaagaaggcau

SEQ ID NO: 628343 - RNA, 22 nt, Human
cagacaggguccuguccgucac

SEQ ID NO: 628344 - RNA, 22 nt, Human
uggcagagucucuccuuuccag

SEQ ID NO: 628345 - RNA, 22 nt, Human
ggccugggccuuuguguuuuga

SEQ ID NO: 628346 - RNA, 22 nt, Human
guacauuuacugaugaaaagua

SEQ ID NO: 628347 - RNA, 22 nt, Human
uguaaacauaccagagccaagu

SEQ ID NO: 628348 - RNA, 22 nt, Human
uacauagauuuugaaacuggac

SEQ ID NO: 628349 - RNA, 22 nt, Human
aguccagccuucaaucuuagug

SEQ ID NO: 628350 - RNA, 22 nt, Human
ucacagaagcuugaagauuuuc

SEQ ID NO: 628351 - RNA, 22 nt, Human
agcagccccucggcgggugcgc

SEQ ID NO: 628352 - RNA, 22 nt, Human
ugcauacacacauagguauggg

SEQ ID NO: 628353 - RNA, 22 nt, Human
ggucccagguugacagggagac

SEQ ID NO: 628354 - RNA, 22 nt, Human
cucagggcuugaguguccagga

SEQ ID NO: 628355 - RNA, 22 nt, Human
agcagcccgaggaucauguguc

SEQ ID NO: 628356 - RNA, 22 nt, Human
acaugacuuuucucuuccagag

SEQ ID NO: 628357 - RNA, 22 nt, Human
aguauauugguguuauuccuca

SEQ ID NO: 628358 - RNA, 22 nt, Human
gcacccuagaguugccugagga

SEQ ID NO: 628359 - RNA, 22 nt, Human
ccuggccacagggcucugcauu

SEQ ID NO: 628360 - RNA, 18 nt, Human
aguuccuuaaauuggugu

SEQ ID NO: 628361 - RNA, 22 nt, Human
uuuuggcuccagugguuugugc

SEQ ID NO: 628362 - RNA, 22 nt, Human
uagguucucuauugcccccaaa

SEQ ID NO: 628363 - RNA, 22 nt, Human
acagagucauucacugaugaag

SEQ ID NO: 628364 - RNA, 19 nt, Human
cacauuuugagucugagau

SEQ ID NO: 628365 - RNA, 23 nt, Human
aguaugaauucauuguuuuaguu

SEQ ID NO: 628366 - RNA, 22 nt, Human
ucacagaaggaccuuguuucau

SEQ ID NO: 628367 - RNA, 22 nt, Human
aauuagagaucaguucuuugac

SEQ ID NO: 628368 - RNA, 22 nt, Human
ugccuggcucuaucaguggugg

SEQ ID NO: 628369 - RNA, 18 nt, Human
uccaggacucugcguggc

SEQ ID NO: 628370 - RNA, 21 nt, Human
ugggcagauggcaguguggcu

SEQ ID NO: 628371 - RNA, 22 nt, Human
aaacaauguacauuuauaaugc

SEQ ID NO: 628372 - RNA, 22 nt, Human
guccucuguuagaaaugugcuu

SEQ ID NO: 628373 - RNA, 22 nt, Human
ugugagugacaguucccuuggu

SEQ ID NO: 628374 - RNA, 22 nt, Human
uuauugcuauggugagagggau

SEQ ID NO: 628375 - RNA, 22 nt, Human
gcccaagggcaucaaguucuac

SEQ ID NO: 628376 - RNA, 22 nt, Human
uaaauagagaaucagcuuggag

SEQ ID NO: 628377 - RNA, 18 nt, Human
gagguagauaagauuuuc

SEQ ID NO: 628378 - RNA, 23 nt, Human
uuuagucaguugacagccauaua

SEQ ID NO: 628379 - RNA, 22 nt, Human
cccuggaguagcacugggucgc

SEQ ID NO: 628380 - RNA, 20 nt, Human
ggguacagauaugcagugaa

SEQ ID NO: 628381 - RNA, 22 nt, Human
ucagcccagcccagcaagugca

SEQ ID NO: 628382 - RNA, 22 nt, Human
gagcacaggcugcugugaacug

SEQ ID NO: 628383 - RNA, 22 nt, Human
cagcuuggcuuccgcuuuacug

SEQ ID NO: 628384 - RNA, 23 nt, Human
uccugaggguuucccagccuugg

SEQ ID NO: 628385 - RNA, 22 nt, Human
cuggauuuugaugagcaguuuu

SEQ ID NO: 628386 - RNA, 22 nt, Human
cagccagaucagggcagggguu

SEQ ID NO: 628387 - RNA, 22 nt, Human
gucuacuuuugucaucauugca

SEQ ID NO: 628388 - RNA, 17 nt, Human
ugcugucugcuucccua

SEQ ID NO: 628389 - RNA, 22 nt, Human
cagacaggaaguucagaagaaa

SEQ ID NO: 628390 - RNA, 22 nt, Human
uuggccagcagcucuggcuuag

SEQ ID NO: 628391 - RNA, 22 nt, Human
uccucagucguuugagccaaaa

SEQ ID NO: 628392 - RNA, 22 nt, Human
uagguucacugucuugaggagc

SEQ ID NO: 628393 - RNA, 22 nt, Human
aaggccacagagccucagagag

SEQ ID NO: 628394 - RNA, 22 nt, Human
acccaggacaugggcacccgug

SEQ ID NO: 628395 - RNA, 22 nt, Human
acagcuggugaauguucucugu

SEQ ID NO: 628396 - RNA, 21 nt, Human
uggaccuguccuucucgcugu

SEQ ID NO: 628397 - RNA, 22 nt, Human
ggguaggagaggugucugugug

SEQ ID NO: 628398 - RNA, 22 nt, Human
gguuggggcgagcuggaggccc

SEQ ID NO: 628399 - RNA, 22 nt, Human
gcugcccugucugcagcaggac

SEQ ID NO: 628400 - RNA, 22 nt, Human
aaaugcacagguuuuaaauccu

SEQ ID NO: 628401 - RNA, 22 nt, Human
ccugccuggcccaccuugccac

SEQ ID NO: 628402 - RNA, 21 nt, Human
acagcagacaggcuuaggacc

SEQ ID NO: 628403 - RNA, 22 nt, Human
acauuugguaacacuugagcau

SEQ ID NO: 628404 - RNA, 22 nt, Human
uauguguauaccuauacaugug

SEQ ID NO: 628405 - RNA, 22 nt, Human
gaucaguaagugaauaaugagu

SEQ ID NO: 628406 - RNA, 22 nt, Human
acacauacauggggaagaugag

SEQ ID NO: 628407 - RNA, 22 nt, Human
uugauuugcagaagguguagag

SEQ ID NO: 628408 - RNA, 22 nt, Human
uagaaacaaugacaugcuugua

SEQ ID NO: 628409 - RNA, 21 nt, Human
acagcagggcuggcaugacag

SEQ ID NO: 628410 - RNA, 22 nt, Human
acacugugcaugcauauacaca

SEQ ID NO: 628411 - RNA, 22 nt, Human
augccacuguacucaacaauag

SEQ ID NO: 628412 - RNA, 22 nt, Human
aguggcugcuaugaucaggaca

SEQ ID NO: 628413 - RNA, 22 nt, Human
uaaguauguuagaaaaucaagu

SEQ ID NO: 628414 - RNA, 22 nt, Human
ucucugggcuaaaaucaaggug

SEQ ID NO: 628415 - RNA, 22 nt, Human
aaugucugaaaaucagacugca

SEQ ID NO: 628416 - RNA, 22 nt, Human
guacaguuuucaguguucacug

SEQ ID NO: 628417 - RNA, 22 nt, Human
gagggagggaaaguuuaacacu

SEQ ID NO: 628418 - RNA, 22 nt, Human
cugccuccaggcucaccuugac

SEQ ID NO: 628419 - RNA, 22 nt, Human
cuggagguuggguccaggccag

SEQ ID NO: 628420 - RNA, 22 nt, Human
uucuggaaccagccugccuggg

SEQ ID NO: 628421 - RNA, 22 nt, Human
aggagucauaaaugugaacaaa

SEQ ID NO: 628422 - RNA, 23 nt, Human
uucagacugccuucagcauuguc

SEQ ID NO: 628423 - RNA, 22 nt, Human
auguuccugauccucguucuau

SEQ ID NO: 628424 - RNA, 22 nt, Human
uaggugaguuuggggaagauag

SEQ ID NO: 628425 - RNA, 22 nt, Human
uuuacacauaaauguguagaca

SEQ ID NO: 628426 - RNA, 22 nt, Human
uagcaaagcuccguaguuauuu

SEQ ID NO: 628427 - RNA, 22 nt, Human
agaguggggaagguguugagaa

SEQ ID NO: 628428 - RNA, 22 nt, Human
gcuuggggagcucaguguccuu

SEQ ID NO: 628429 - RNA, 22 nt, Human
uugaggcacagauuuuaguggc

SEQ ID NO: 628430 - RNA, 22 nt, Human
aggcccugaagucggccccuca

SEQ ID NO: 628431 - RNA, 22 nt, Human
aucuuucaaucaggaaaaaucu

SEQ ID NO: 628432 - RNA, 22 nt, Human
aggcuccugagaggcagaggcu

SEQ ID NO: 628433 - RNA, 22 nt, Human
ggaguugauuuuggauauauua

SEQ ID NO: 628434 - RNA, 22 nt, Human
uggaagccaaggucagaaggag

SEQ ID NO: 628435 - RNA, 21 nt, Human
accuucaguguucucagcugc

SEQ ID NO: 628436 - RNA, 22 nt, Human
aaauugcuaaauuguaagaggg

SEQ ID NO: 628437 - RNA, 22 nt, Human
ugaggauuggcaaaacucaggg

SEQ ID NO: 628438 - RNA, 22 nt, Human
aguuuacacuuuugauucuuau

SEQ ID NO: 628439 - RNA, 22 nt, Human
gcugccugauguccagcaggac

SEQ ID NO: 628440 - RNA, 22 nt, Human
uugcaucaaauauguaccacag

SEQ ID NO: 628441 - RNA, 22 nt, Human
ucagcacuauacauuuugaaua

SEQ ID NO: 628442 - RNA, 22 nt, Human
ucuuuuuuuccugugcagagcu

SEQ ID NO: 628443 - RNA, 22 nt, Human
cucccucucuaaggcaaagaga

SEQ ID NO: 628444 - RNA, 22 nt, Human
guugggcucauuacagccugcu

SEQ ID NO: 628445 - RNA, 23 nt, Human
aaagacucuccagagggaaguag

SEQ ID NO: 628446 - RNA, 22 nt, Human
gggcacagucuaaaguugggcc

SEQ ID NO: 628447 - RNA, 22 nt, Human
uggugaggucauagagaacugu

SEQ ID NO: 628448 - RNA, 22 nt, Human
gugauaauugcagagaaaggag

SEQ ID NO: 628449 - RNA, 22 nt, Human
aguggcaaugggaguggagaca

SEQ ID NO: 628450 - RNA, 23 nt, Human
aucaccagcggaagcugcagacc

SEQ ID NO: 628451 - RNA, 22 nt, Human
aguguuucugugccccaguguu

SEQ ID NO: 628452 - RNA, 21 nt, Human
cugugucgcucucgcugggag

SEQ ID NO: 628453 - RNA, 22 nt, Human
agucauauauuuuguuugugca

SEQ ID NO: 628454 - RNA, 22 nt, Human
uaacaugaaacuccaaauggua

SEQ ID NO: 628455 - RNA, 22 nt, Human
uuggccagagguuucucucaug

SEQ ID NO: 628456 - RNA, 22 nt, Human
aauucccaccuucucucuuuug

SEQ ID NO: 628457 - RNA, 22 nt, Human
ggcccucugccugugcuggcga

SEQ ID NO: 628458 - RNA, 22 nt, Human
agccaguguuaagugacugguu

SEQ ID NO: 628459 - RNA, 17 nt, Human
aaguccagaguugagca

SEQ ID NO: 628460 - RNA, 22 nt, Human
uguuggaaaggccaggcugugg

SEQ ID NO: 628461 - RNA, 22 nt, Human
ccuccccacagcccaggagacu

SEQ ID NO: 628462 - RNA, 22 nt, Human
uggucugauuccaccuaacuga

SEQ ID NO: 628463 - RNA, 22 nt, Human
uagugucucggggcccaggauu

SEQ ID NO: 628464 - RNA, 22 nt, Human
caggggacaguaugguggauga

SEQ ID NO: 628465 - RNA, 22 nt, Human
cugacucuccucaagcauaaau

SEQ ID NO: 628466 - RNA, 22 nt, Human
acagggcuggggcacuuggcug

SEQ ID NO: 628467 - RNA, 20 nt, Human
uccuggucauguggcugggc

SEQ ID NO: 628468 - RNA, 22 nt, Human
ugaguauauacccagaagugga

SEQ ID NO: 628469 - RNA, 22 nt, Human
uuuauuauguacaggcacuaua

SEQ ID NO: 628470 - RNA, 22 nt, Human
ugaaggccagcagagugaaggc

SEQ ID NO: 628471 - RNA, 22 nt, Human
agcccccaaaagugcuuaugau

SEQ ID NO: 628472 - RNA, 22 nt, Human
cagucacugguucuauaggccc

SEQ ID NO: 628473 - RNA, 20 nt, Human
ucucuucuggggagauaaaa

SEQ ID NO: 628474 - RNA, 22 nt, Human
cugcucuguuucuuagcugggu

SEQ ID NO: 628475 - RNA, 22 nt, Human
aaguguauuuuuguacuaacau

SEQ ID NO: 628476 - RNA, 22 nt, Human
augaaauuaaucaacacauaca

SEQ ID NO: 628477 - RNA, 22 nt, Human
acauuuauauuuaguggggaau

SEQ ID NO: 628478 - RNA, 22 nt, Human
uacaaugagcugagccagaggc

SEQ ID NO: 628479 - RNA, 22 nt, Human
auuaaugucuaccaguugugug

SEQ ID NO: 628480 - RNA, 22 nt, Human
ccugggacucggccaggacaga

SEQ ID NO: 628481 - RNA, 22 nt, Human
gcagcauccuuggccuccaccc

SEQ ID NO: 628482 - RNA, 22 nt, Human
ccugagcuggaagagcuugugc

SEQ ID NO: 628483 - RNA, 22 nt, Human
uggggcugugagacuacaggau

SEQ ID NO: 628484 - RNA, 22 nt, Human
agggagacaaaagcagcugcca

SEQ ID NO: 628485 - RNA, 22 nt, Human
acucagaggcagcugcucaccc

SEQ ID NO: 628486 - RNA, 22 nt, Human
caggccgggcacugcgcuaggu

SEQ ID NO: 628487 - RNA, 22 nt, Human
agcaauauaaauguuggguaga

SEQ ID NO: 628488 - RNA, 22 nt, Human
acugcacuucacccugggugac

SEQ ID NO: 628489 - RNA, 22 nt, Human
uugcagggauuaccuuauuuuu

SEQ ID NO: 628490 - RNA, 21 nt, Human
acugagguuagaugccuugcc

SEQ ID NO: 628491 - RNA, 22 nt, Human
cagcucugugggagcguaugug

SEQ ID NO: 628492 - RNA, 23 nt, Human
uggucucagccugugagagcuga

SEQ ID NO: 628493 - RNA, 22 nt, Human
cacacauuaauaucaaaggcuc

SEQ ID NO: 628494 - RNA, 22 nt, Human
ucuguuuucauuugucuugaga

SEQ ID NO: 628495 - RNA, 22 nt, Human
accacaggacccaugagucagu

SEQ ID NO: 628496 - RNA, 20 nt, Human
cagccuccacucacucagcu

SEQ ID NO: 628497 - RNA, 22 nt, Human
gggagcugaccugcagguuccc

SEQ ID NO: 628498 - RNA, 22 nt, Human
ccacugaggcaggcaguaucua

SEQ ID NO: 628499 - RNA, 22 nt, Human
uacauugcuagaaauguauuuu

SEQ ID NO: 628500 - RNA, 22 nt, Human
ucuggcaggcaaucggcucugg

SEQ ID NO: 628501 - RNA, 22 nt, Human
acuuucuaggucucaguccuuu

SEQ ID NO: 628502 - RNA, 22 nt, Human
ugucuuauggcauguccacugg

SEQ ID NO: 628503 - RNA, 22 nt, Human
gcagcccuuucugggcagggga

SEQ ID NO: 628504 - RNA, 22 nt, Human
ggcgccagcccaggccgucgug

SEQ ID NO: 628505 - RNA, 22 nt, Human
uccuugaauggacauuacacug

SEQ ID NO: 628506 - RNA, 22 nt, Human
agccaaggagugcagguggcuu

SEQ ID NO: 628507 - RNA, 22 nt, Human
guuccuaaauuugaaggacuuu

SEQ ID NO: 628508 - RNA, 20 nt, Human
ucagugauuaucucugagug

SEQ ID NO: 628509 - RNA, 22 nt, Human
uuuccucacacagaagaucuug

SEQ ID NO: 628510 - RNA, 22 nt, Human
gauaauaagcacagcaggaugu

SEQ ID NO: 628511 - RNA, 22 nt, Human
ugaaggcuguuggauggggaag

SEQ ID NO: 628512 - RNA, 22 nt, Human
gucugugggccaaauacagccc

SEQ ID NO: 628513 - RNA, 22 nt, Human
ggcauugaugggagauggugga

SEQ ID NO: 628514 - RNA, 23 nt, Human
aggcugagcucucccagcuucag

SEQ ID NO: 628515 - RNA, 17 nt, Human
ugagagcagggcugggc

SEQ ID NO: 628516 - RNA, 22 nt, Human
cuccucagaacagccuuggcug

SEQ ID NO: 628517 - RNA, 22 nt, Human
ccugggucuauagacuucaaga

SEQ ID NO: 628518 - RNA, 22 nt, Human
acaccaugguucccaaacugug

SEQ ID NO: 628519 - RNA, 22 nt, Human
agcuccaggucagugcaccccu

SEQ ID NO: 628520 - RNA, 22 nt, Human
cauuagaagaacaguuauauua

SEQ ID NO: 628521 - RNA, 20 nt, Human
augcaaacucacaaaauacc

SEQ ID NO: 628522 - RNA, 18 nt, Human
ggaaaaggagugucuagc

SEQ ID NO: 628523 - RNA, 22 nt, Human
cuuaaacugaaagcuacaagau

SEQ ID NO: 628524 - RNA, 22 nt, Human
auuccacagccgauaccaugac

SEQ ID NO: 628525 - RNA, 22 nt, Human
gauaauccaagauugccucacu

SEQ ID NO: 628526 - RNA, 22 nt, Human
uauacugagagcaaauacauuc

SEQ ID NO: 628527 - RNA, 21 nt, Human
ugcaggaaagugcugcgaccc

SEQ ID NO: 628528 - RNA, 22 nt, Human
auccccaggggcauucaagcuu

SEQ ID NO: 628529 - RNA, 17 nt, Human
cuuugucaccaaugcca

SEQ ID NO: 628530 - RNA, 22 nt, Human
ugaccucuguccugcagucugg

SEQ ID NO: 628531 - RNA, 21 nt, Human
ugggcaaguuuggggguccuc

SEQ ID NO: 628532 - RNA, 22 nt, Human
agaucaguuagauagcuugaug

SEQ ID NO: 628533 - RNA, 22 nt, Human
agcagcucaacagugucucuau

SEQ ID NO: 628534 - RNA, 22 nt, Human
uucaguauguguaaacuacuuu

SEQ ID NO: 628535 - RNA, 22 nt, Human
aauguacagcugucuuuccucc

SEQ ID NO: 628536 - RNA, 22 nt, Human
uucaaguuaccuuuaaacagcu

SEQ ID NO: 628537 - RNA, 22 nt, Human
guuguuuguaaugacaggagac

SEQ ID NO: 628538 - RNA, 22 nt, Human
uuagccaugugggaaaaacagc

SEQ ID NO: 628539 - RNA, 22 nt, Human
ucccuggguuaccuuucaaggu

SEQ ID NO: 628540 - RNA, 22 nt, Human
cacuggcaugugaggcgguggc

SEQ ID NO: 628541 - RNA, 22 nt, Human
acagaugaguuagaauaggcag

SEQ ID NO: 628542 - RNA, 22 nt, Human
ugaaucaaugaauugcacuuca

SEQ ID NO: 628543 - RNA, 22 nt, Human
ggcaggagaauggcgugaacuc

SEQ ID NO: 628544 - RNA, 22 nt, Human
gcagcagugcgggcagcuacag

SEQ ID NO: 628545 - RNA, 20 nt, Human
aagucccuaagucucuggcc

SEQ ID NO: 628546 - RNA, 22 nt, Human
aaaauuacuauuguuccugggc

SEQ ID NO: 628547 - RNA, 22 nt, Human
uuuuuaguagagguggguuuca

SEQ ID NO: 628548 - RNA, 22 nt, Human
acacauuccugcagacaugaug

SEQ ID NO: 628549 - RNA, 22 nt, Human
acucuguuugcagguagcucag

SEQ ID NO: 628550 - RNA, 22 nt, Human
ugcuggccaagcagaggucaau

SEQ ID NO: 628551 - RNA, 22 nt, Human
ggagcugaugacgucaccaugg

SEQ ID NO: 628552 - RNA, 22 nt, Human
gggcuucaaaauuggcacucuu

SEQ ID NO: 628553 - RNA, 22 nt, Human
gacagcuugccugguacugcaa

SEQ ID NO: 628554 - RNA, 22 nt, Human
accucagagauacaaaccaugg

SEQ ID NO: 628555 - RNA, 22 nt, Human
cugugcccuuuguccucgucuc

SEQ ID NO: 628556 - RNA, 22 nt, Human
ccagauauucacuuuuacaugc

SEQ ID NO: 628557 - RNA, 21 nt, Human
agagccugagaucuuccagca

SEQ ID NO: 628558 - RNA, 22 nt, Human
cugacucccuccccaaagcugg

SEQ ID NO: 628559 - RNA, 22 nt, Human
agaccugguuuaucaccagcau

SEQ ID NO: 628560 - RNA, 22 nt, Human
uucuggagaaucaccaccaggc

SEQ ID NO: 628561 - RNA, 22 nt, Human
cugagagaugauauagcuuaau

SEQ ID NO: 628562 - RNA, 22 nt, Human
gcuguucagggcacucaugggc

SEQ ID NO: 628563 - RNA, 22 nt, Human
gaguccuuggcaucaucaguac

SEQ ID NO: 628564 - RNA, 23 nt, Human
uauacacauguggcaguauagug

SEQ ID NO: 628565 - RNA, 22 nt, Human
aggccagcaagaaagagagucu

SEQ ID NO: 628566 - RNA, 22 nt, Human
auaaaguucugcuggcauauau

SEQ ID NO: 628567 - RNA, 16 nt, Human
gcagggguggguggag

SEQ ID NO: 628568 - RNA, 22 nt, Human
ggcauggcuggguucuggugag

SEQ ID NO: 628569 - RNA, 18 nt, Human
ucaaacugucauugguga

SEQ ID NO: 628570 - RNA, 22 nt, Human
uucugugaggacuucucaagga

SEQ ID NO: 628571 - RNA, 22 nt, Human
gaauacacgaaggcaagagucc

SEQ ID NO: 628572 - RNA, 20 nt, Human
acauuugaguaucaucuacu

SEQ ID NO: 628573 - RNA, 22 nt, Human
uucaagucagagcaagccaagu

SEQ ID NO: 628574 - RNA, 22 nt, Human
agacaaauaacuuuuuaugucc

SEQ ID NO: 628575 - RNA, 22 nt, Human
uuagacagagcuccuugagggc

SEQ ID NO: 628576 - RNA, 20 nt, Human
caccucugaaaguuuccagc

SEQ ID NO: 628577 - RNA, 22 nt, Human
ccuguuugguacaaucugccaa

SEQ ID NO: 628578 - RNA, 22 nt, Human
caucuggacaaaacucugaagg

SEQ ID NO: 628579 - RNA, 22 nt, Human
aagucacaagcauauaugcauu

SEQ ID NO: 628580 - RNA, 22 nt, Human
ucuuccaggagggcauuucuuu

SEQ ID NO: 628581 - RNA, 17 nt, Human
ucugagaacuugaagca

SEQ ID NO: 628582 - RNA, 22 nt, Human
agcucccagaguccucugccca

SEQ ID NO: 628583 - RNA, 22 nt, Human
uauuguacaugguuaugcagga

SEQ ID NO: 628584 - RNA, 22 nt, Human
ggacuggccggcgcugaggccc

SEQ ID NO: 628585 - RNA, 22 nt, Human
aacauuuccggccuuuuguucu

SEQ ID NO: 628586 - RNA, 16 nt, Human
uccaagaagugccccu

SEQ ID NO: 628587 - RNA, 22 nt, Human
guggcaguugcuguggcaauaa

SEQ ID NO: 628588 - RNA, 22 nt, Human
gcuguucucuguaacaugcauu

SEQ ID NO: 628589 - RNA, 22 nt, Human
ucucaguguguuuucucucaga

SEQ ID NO: 628590 - RNA, 23 nt, Human
ccuggcuguggauuugggccugc

SEQ ID NO: 628591 - RNA, 19 nt, Human
gaaugucuccuacuucuga

SEQ ID NO: 628592 - RNA, 22 nt, Human
ccagggugcucuguggcgucgc

SEQ ID NO: 628593 - RNA, 22 nt, Human
ucuuuggggcaucugggagauu

SEQ ID NO: 628594 - RNA, 18 nt, Human
gguggcaggucagaugcc

SEQ ID NO: 628595 - RNA, 22 nt, Human
cauguuuucuaggcuuucacaa

SEQ ID NO: 628596 - RNA, 22 nt, Human
uauauuuaauccuagagccauu

SEQ ID NO: 628597 - RNA, 22 nt, Human
auuguacucccucuccugcccg

SEQ ID NO: 628598 - RNA, 22 nt, Human
acagaugcaaggaaaugauugc

SEQ ID NO: 628599 - RNA, 22 nt, Human
aauuccugucuuaacaguucug

SEQ ID NO: 628600 - RNA, 22 nt, Human
gaauuacagccagaagaaugaa

SEQ ID NO: 628601 - RNA, 22 nt, Human
cuuguuuuggcuaguaugaugu

SEQ ID NO: 628602 - RNA, 22 nt, Human
gcccagaaguugaggcugcagu

SEQ ID NO: 628603 - RNA, 22 nt, Human
ucagucuucccuccagugcaac

SEQ ID NO: 628604 - RNA, 22 nt, Human
ucucucaaccucggcacuauug

SEQ ID NO: 628605 - RNA, 22 nt, Human
ucugucacccgagcaggcgaga

SEQ ID NO: 628606 - RNA, 22 nt, Human
uuauguauggauggcugaaagu

SEQ ID NO: 628607 - RNA, 22 nt, Human
cugaaggagguagagugacaua

SEQ ID NO: 628608 - RNA, 22 nt, Human
ucauaguuauggagauuaagga

SEQ ID NO: 628609 - RNA, 22 nt, Human
uguggugagaaacugguagauu

SEQ ID NO: 628610 - RNA, 22 nt, Human
uaggcugacuuguuucauaaag

SEQ ID NO: 628611 - RNA, 22 nt, Human
auggccaggcaccucuggcuga

SEQ ID NO: 628612 - RNA, 17 nt, Human
uccugugggugcagcag

SEQ ID NO: 628613 - RNA, 22 nt, Human
cauuagggccaccauaacaaaa

SEQ ID NO: 628614 - RNA, 20 nt, Human
ccucucugcaugcucccuga

SEQ ID NO: 628615 - RNA, 22 nt, Human
ccugccugaaggucagccaccc

SEQ ID NO: 628616 - RNA, 22 nt, Human
uaaagcaauuacucaguggcuu

SEQ ID NO: 628617 - RNA, 22 nt, Human
ggcauuagcguugaauuuuauu

SEQ ID NO: 628618 - RNA, 22 nt, Human
aauuaugauuggucuaaaccag

SEQ ID NO: 628619 - RNA, 22 nt, Human
agcaggaaguccucucaggaga

SEQ ID NO: 628620 - RNA, 22 nt, Human
aggcuccugcaggugaggugcu

SEQ ID NO: 628621 - RNA, 22 nt, Human
cagagguggggaguauuucaag

SEQ ID NO: 628622 - RNA, 22 nt, Human
ggguggagccaguugacucugu

SEQ ID NO: 628623 - RNA, 22 nt, Human
gugcugggauuacaggugugag

SEQ ID NO: 628624 - RNA, 18 nt, Human
ccacagcagaguucuuac

SEQ ID NO: 628625 - RNA, 22 nt, Human
ucucuuuaaaaauagugaaaua

SEQ ID NO: 628626 - RNA, 22 nt, Human
aagucucucauggcugacagca

SEQ ID NO: 628627 - RNA, 22 nt, Human
cccaggcuccuacuguauucug

SEQ ID NO: 628628 - RNA, 17 nt, Human
ggaaaagaagaguagga

SEQ ID NO: 628629 - RNA, 21 nt, Human
cacauugaauacagagaugga

SEQ ID NO: 628630 - RNA, 22 nt, Human
cugucccagauguucucagcac

SEQ ID NO: 628631 - RNA, 22 nt, Human
acuccugggugcugaccagcgu

SEQ ID NO: 628632 - RNA, 21 nt, Human
aggguggcucugggucagaac

SEQ ID NO: 628633 - RNA, 22 nt, Human
ugcuaaggacugggaggcaggg

SEQ ID NO: 628634 - RNA, 22 nt, Human
acaagcaucagguucagcaaua

SEQ ID NO: 628635 - RNA, 22 nt, Human
guuuauuauacaacaaaagcua

SEQ ID NO: 628636 - RNA, 22 nt, Human
cuuuaguugucuccucaagggu

SEQ ID NO: 628637 - RNA, 22 nt, Human
cugcugcucgaccagucccagg

SEQ ID NO: 628638 - RNA, 18 nt, Human
aaacuggcuuggccugug

SEQ ID NO: 628639 - RNA, 22 nt, Human
uugcucuccagaggcucacagc

SEQ ID NO: 628640 - RNA, 22 nt, Human
cuagagaaaacuguguaucuug

SEQ ID NO: 628641 - RNA, 22 nt, Human
gaagccugguccagagcuccca

SEQ ID NO: 628642 - RNA, 22 nt, Human
cuguacaucccaagauauuucu

SEQ ID NO: 628643 - RNA, 22 nt, Human
gcaucucuuacccacgagccag

SEQ ID NO: 628644 - RNA, 22 nt, Human
uacagagaauaauaggacaggu

SEQ ID NO: 628645 - RNA, 22 nt, Human
uccacuccuuaugccagacggu

SEQ ID NO: 628646 - RNA, 19 nt, Human
ucuaacagcuuucauucua

SEQ ID NO: 628647 - RNA, 19 nt, Human
cagcugcaccgugaccauc

SEQ ID NO: 628648 - RNA, 22 nt, Human
aucaucugcacagauccuauuu

SEQ ID NO: 628649 - RNA, 22 nt, Human
caagcugcagcgccugcgccgg

SEQ ID NO: 628650 - RNA, 22 nt, Human
aggcgguggccaaggagcggga

SEQ ID NO: 628651 - RNA, 22 nt, Human
aaugucuuuaaagugcaauaga

SEQ ID NO: 628652 - RNA, 22 nt, Human
aaaggcaguggguauguggauc

SEQ ID NO: 628653 - RNA, 22 nt, Human
gcucugagugauuaaggagcuu

SEQ ID NO: 628654 - RNA, 19 nt, Human
ucgagucaagacacuaggc

SEQ ID NO: 628655 - RNA, 22 nt, Human
cacuuugaugcagggcucagua

SEQ ID NO: 628656 - RNA, 17 nt, Human
uuaaaccauaaagaagg

SEQ ID NO: 628657 - RNA, 22 nt, Human
cccuguuaaugucaaccugccu

SEQ ID NO: 628658 - RNA, 22 nt, Human
gauggcagcauauugacagcau

SEQ ID NO: 628659 - RNA, 23 nt, Human
ggcugagacuacaggcgcuugcc

SEQ ID NO: 628660 - RNA, 22 nt, Human
ggagaccagaaggaagcuucga

SEQ ID NO: 628661 - RNA, 22 nt, Human
cagagcaacacccuuuacaucg

SEQ ID NO: 628662 - RNA, 22 nt, Human
cagucucucagcuuucagcugu

SEQ ID NO: 628663 - RNA, 20 nt, Human
aagcagaagcugcucucagc

SEQ ID NO: 628664 - RNA, 22 nt, Human
gccucaugagggaucugcccuc

SEQ ID NO: 628665 - RNA, 22 nt, Human
acauuugugcaacguauccaca

SEQ ID NO: 628666 - RNA, 22 nt, Human
ugauuagauugagucaaccuug

SEQ ID NO: 628667 - RNA, 18 nt, Human
gucucaggaguggcacgu

SEQ ID NO: 628668 - RNA, 22 nt, Human
agaaaucuuuccugaaguguuu

SEQ ID NO: 628669 - RNA, 22 nt, Human
ggaggcucagugaggaaaugga

SEQ ID NO: 628670 - RNA, 21 nt, Human
aucagaaguuuuggucaguag

SEQ ID NO: 628671 - RNA, 22 nt, Human
ccaggaagccugugucucugga

SEQ ID NO: 628672 - RNA, 20 nt, Human
aagaagccgggaaggcaggc

SEQ ID NO: 628673 - RNA, 22 nt, Human
ccagucacuggaaaaugggaau

SEQ ID NO: 628674 - RNA, 22 nt, Human
guccugagggcccaggcauucu

SEQ ID NO: 628675 - RNA, 22 nt, Human
uucuacaauaugaauaaugaag

SEQ ID NO: 628676 - RNA, 22 nt, Human
agccccuuggaacacagggcug

SEQ ID NO: 628677 - RNA, 23 nt, Human
agcacaaaguguuuuccuuguag

SEQ ID NO: 628678 - RNA, 22 nt, Human
ugauucugagggagcauucugc

SEQ ID NO: 628679 - RNA, 22 nt, Human
uuuugguuucccuucuuauggu

SEQ ID NO: 628680 - RNA, 19 nt, Human
aagcagcccuggcaagagc

SEQ ID NO: 628681 - RNA, 22 nt, Human
cuggccuuuaaaaugaccuuau

SEQ ID NO: 628682 - RNA, 22 nt, Human
uaugucacauuguaacagugug

SEQ ID NO: 628683 - RNA, 22 nt, Human
uuccucagagggcgcuggggaa

SEQ ID NO: 628684 - RNA, 22 nt, Human
ucagggacuuacaaaccagaag

SEQ ID NO: 628685 - RNA, 22 nt, Human
ggcaggugggaacccuccccac

SEQ ID NO: 628686 - RNA, 20 nt, Human
gugccuggagaagaggcugu

SEQ ID NO: 628687 - RNA, 22 nt, Human
ccuggagcacauggcaggaggc

SEQ ID NO: 628688 - RNA, 22 nt, Human
ggucaggggcugcucuacagag

SEQ ID NO: 628689 - RNA, 22 nt, Human
cuggccagugccugugggcccc

SEQ ID NO: 628690 - RNA, 22 nt, Human
ggggggugcugaucaguggagc

SEQ ID NO: 628691 - RNA, 22 nt, Human
ccaggugggcgugucuucaccu

SEQ ID NO: 628692 - RNA, 22 nt, Human
ugagcugucugaauggugagga

SEQ ID NO: 628693 - RNA, 22 nt, Human
ugacaaugacauggacagugau

SEQ ID NO: 628694 - RNA, 20 nt, Human
uucuucucuaguuaucuuca

SEQ ID NO: 628695 - RNA, 22 nt, Human
cuggguguagauggaaguuugg

SEQ ID NO: 628696 - RNA, 22 nt, Human
aguggggcggacaggaccagga

SEQ ID NO: 628697 - RNA, 22 nt, Human
agagaguugaggaagcaacacu

SEQ ID NO: 628698 - RNA, 22 nt, Human
cucugcuuuccucuuacacacu

SEQ ID NO: 628699 - RNA, 22 nt, Human
auccucucucccauaccagucu

SEQ ID NO: 628700 - RNA, 22 nt, Human
cuguccuggugcuggggauccc

SEQ ID NO: 628701 - RNA, 22 nt, Human
uugagcaaaggaguaaaaugca

SEQ ID NO: 628702 - RNA, 22 nt, Human
cuguucugaacugccugcaugc

SEQ ID NO: 628703 - RNA, 22 nt, Human
auacagauguugaauguuauau

SEQ ID NO: 628704 - RNA, 22 nt, Human
gcagcagguccgcaucaucauc

SEQ ID NO: 628705 - RNA, 22 nt, Human
uucacauugguucuugauagcu

SEQ ID NO: 628706 - RNA, 22 nt, Human
agaggcucugccgccucaggua

SEQ ID NO: 628707 - RNA, 22 nt, Human
gauuuauaaagguugcacugga

SEQ ID NO: 628708 - RNA, 22 nt, Human
ugaaaucuuagccauucugccu

SEQ ID NO: 628709 - RNA, 22 nt, Human
ugagacaguuggugaaaucuaa

SEQ ID NO: 628710 - RNA, 22 nt, Human
aggagccugugccuggcacucc

SEQ ID NO: 628711 - RNA, 22 nt, Human
uccucagggaagaugagccuca

SEQ ID NO: 628712 - RNA, 22 nt, Human
aguguuucaauccuagggguug

SEQ ID NO: 628713 - RNA, 22 nt, Human
aggccucagugaucaucaucag

SEQ ID NO: 628714 - RNA, 22 nt, Human
ugcuuuauaucucucuucuuag

SEQ ID NO: 628715 - RNA, 15 nt, Human
ggugagaguaggauu

SEQ ID NO: 628716 - RNA, 22 nt, Human
ggacacuuugaguugaaggggu

SEQ ID NO: 628717 - RNA, 22 nt, Human
agcugucucucugguguccaua

SEQ ID NO: 628718 - RNA, 22 nt, Human
ugggaaaguguugaggugucuu

SEQ ID NO: 628719 - RNA, 22 nt, Human
ucagaggcucaucugccuugca

SEQ ID NO: 628720 - RNA, 22 nt, Human
caaaacauucagagagcucacu

SEQ ID NO: 628721 - RNA, 22 nt, Human
ugaauccagagcuauuucgucc

SEQ ID NO: 628722 - RNA, 22 nt, Human
uuacauaacgguaugaaaaaug

SEQ ID NO: 628723 - RNA, 22 nt, Human
aagcuucaguggacuguagugu

SEQ ID NO: 628724 - RNA, 22 nt, Human
uguuuauugcugcaauugugcc

SEQ ID NO: 628725 - RNA, 22 nt, Human
uagggccagauaggcuucuuga

SEQ ID NO: 628726 - RNA, 22 nt, Human
uccauuuucaucucauguauaa

SEQ ID NO: 628727 - RNA, 22 nt, Human
uucauucugcaguucucagcuc

SEQ ID NO: 628728 - RNA, 22 nt, Human
aagauguuaggguggaagggau

SEQ ID NO: 628729 - RNA, 22 nt, Human
gugccugguuuggggaguguuc

SEQ ID NO: 628730 - RNA, 21 nt, Human
ugcuaggccauauugguugcu

SEQ ID NO: 628731 - RNA, 22 nt, Human
ucuguauugagaaagccggaca

SEQ ID NO: 628732 - RNA, 22 nt, Human
uucagcaaauggacuguucagg

SEQ ID NO: 628733 - RNA, 22 nt, Human
gaauuacaaagugagacaagcu

SEQ ID NO: 628734 - RNA, 22 nt, Human
gcaguaguucgucuguguuccc

SEQ ID NO: 628735 - RNA, 22 nt, Human
gccuuccaccuaggccucugcu

SEQ ID NO: 628736 - RNA, 22 nt, Human
gggccucucccuucucacgcau

SEQ ID NO: 628737 - RNA, 22 nt, Human
cagagcagaagguccaagccug

SEQ ID NO: 628738 - RNA, 22 nt, Human
cauucagagcuuucuuaucaua

SEQ ID NO: 628739 - RNA, 21 nt, Human
uccagcugugauuaugaaugu

SEQ ID NO: 628740 - RNA, 22 nt, Human
uggcuggagcgcccuccucugc

SEQ ID NO: 628741 - RNA, 21 nt, Human
ggacuuacauagguaaggggu

SEQ ID NO: 628742 - RNA, 22 nt, Human
ugaggcaggacuugcauaaagu

SEQ ID NO: 628743 - RNA, 21 nt, Human
acacuucaguuuuuaaaggga

SEQ ID NO: 628744 - RNA, 22 nt, Human
ggaugagguagaugaacaaggg

SEQ ID NO: 628745 - RNA, 19 nt, Human
cagcugccuuuucuuugca

SEQ ID NO: 628746 - RNA, 22 nt, Human
aagguacaguuuuaagaauaag

SEQ ID NO: 628747 - RNA, 22 nt, Human
acucuguagggacgguucuccc

SEQ ID NO: 628748 - RNA, 19 nt, Human
uacaaguaggcguuuucuc

SEQ ID NO: 628749 - RNA, 22 nt, Human
agccuggauccuaggcucagcu

SEQ ID NO: 628750 - RNA, 22 nt, Human
uucugucugauggugccagaac

SEQ ID NO: 628751 - RNA, 22 nt, Human
agucucagcaagcauggcuagu

SEQ ID NO: 628752 - RNA, 22 nt, Human
ggcccucugcucacuuccuauu

SEQ ID NO: 628753 - RNA, 22 nt, Human
gcagggcugcagagggcacugu

SEQ ID NO: 628754 - RNA, 22 nt, Human
cuccucacacccacugcaacca

SEQ ID NO: 628755 - RNA, 22 nt, Human
gcccugaauaauagagugggga

SEQ ID NO: 628756 - RNA, 23 nt, Human
cauggcagcaagagcucauggcc

SEQ ID NO: 628757 - RNA, 22 nt, Human
gugcucuaugaggauauagggu

SEQ ID NO: 628758 - RNA, 21 nt, Human
gggcuggaggaugggaagccc

SEQ ID NO: 628759 - RNA, 22 nt, Human
cauggccugccuccuccuggug

SEQ ID NO: 628760 - RNA, 21 nt, Human
ucacugugcaaauguugaugg

SEQ ID NO: 628761 - RNA, 22 nt, Human
gcugcugucagcaggccuuguu

SEQ ID NO: 628762 - RNA, 22 nt, Human
aggcaaagaaguuggucaggag

SEQ ID NO: 628763 - RNA, 22 nt, Human
cuguguccuccccaucacuucu

SEQ ID NO: 628764 - RNA, 22 nt, Human
aaaggcacugaucuuauccagu

SEQ ID NO: 628765 - RNA, 22 nt, Human
ccuggccaaucuagggcuguua

SEQ ID NO: 628766 - RNA, 22 nt, Human
gcuccaggcugcucugucccau

SEQ ID NO: 628767 - RNA, 22 nt, Human
cucuucuuggcccccaugaggg

SEQ ID NO: 628768 - RNA, 22 nt, Human
guguguacaaauuucauguaaa

SEQ ID NO: 628769 - RNA, 22 nt, Human
cuggcagcucuacucagagccu

SEQ ID NO: 628770 - RNA, 22 nt, Human
ucacuugagagauauuagaagu

SEQ ID NO: 628771 - RNA, 18 nt, Human
caggugggucuccugccc

SEQ ID NO: 628772 - RNA, 22 nt, Human
ucagcaauaugauaggcuuugu

SEQ ID NO: 628773 - RNA, 22 nt, Human
cuaaggcaccgaggcaggagcg

SEQ ID NO: 628774 - RNA, 22 nt, Human
uccucauagacugacugcuugc

SEQ ID NO: 628775 - RNA, 22 nt, Human
gagugucuaaucacguuucaca

SEQ ID NO: 628776 - RNA, 22 nt, Human
ugcuuuaacgcugagggucuca

SEQ ID NO: 628777 - RNA, 22 nt, Human
acauucaaggcagcacugagug

SEQ ID NO: 628778 - RNA, 22 nt, Human
gcucugccuccccuaguguuac

SEQ ID NO: 628779 - RNA, 22 nt, Human
acauuaugagcccacuggugaa

SEQ ID NO: 628780 - RNA, 22 nt, Human
ugagccaguggaagauggcagu

SEQ ID NO: 628781 - RNA, 22 nt, Human
ccuuggagaccugggucugugc

SEQ ID NO: 628782 - RNA, 22 nt, Human
uauguuuuucagacguccuaca

SEQ ID NO: 628783 - RNA, 22 nt, Human
gagguagguguaggaggccugc

SEQ ID NO: 628784 - RNA, 22 nt, Human
ucaucuuccucauuucuccagg

SEQ ID NO: 628785 - RNA, 22 nt, Human
uuaaagcauguugcuuaacagg

SEQ ID NO: 628786 - RNA, 18 nt, Human
agaagccacgaggagucc

SEQ ID NO: 628787 - RNA, 21 nt, Human
ucuaagccuugcagauggguu

SEQ ID NO: 628788 - RNA, 22 nt, Human
uuuaccaguguuaaacaccagc

SEQ ID NO: 628789 - RNA, 22 nt, Human
gucugggcuucagaguuagaga

SEQ ID NO: 628790 - RNA, 22 nt, Human
cagcccugcagagggcgcuccu

SEQ ID NO: 628791 - RNA, 17 nt, Human
cagcucuuccucccucu

SEQ ID NO: 628792 - RNA, 22 nt, Human
uggagcagaguucagcggggag

SEQ ID NO: 628793 - RNA, 22 nt, Human
acauuuuuuagagucccacauu

SEQ ID NO: 628794 - RNA, 22 nt, Human
cugcaggcugagcgccugccgg

SEQ ID NO: 628795 - RNA, 22 nt, Human
auaacccucuggauaggacagg

SEQ ID NO: 628796 - RNA, 22 nt, Human
ucauccugcacuggcuccuccu

SEQ ID NO: 628797 - RNA, 22 nt, Human
caucacauuagucucaagagaa

SEQ ID NO: 628798 - RNA, 22 nt, Human
aggagaaauccaucgagaaugg

SEQ ID NO: 628799 - RNA, 19 nt, Human
agaauuguuuuaugucuuc

SEQ ID NO: 628800 - RNA, 22 nt, Human
ggugagaggccugagagcugga

SEQ ID NO: 628801 - RNA, 22 nt, Human
aacauguaccuacaaucagaau

SEQ ID NO: 628802 - RNA, 22 nt, Human
aaaugcauguauguaauaugcu

SEQ ID NO: 628803 - RNA, 22 nt, Human
ugaaaacacuuuaguuuagguc

SEQ ID NO: 628804 - RNA, 22 nt, Human
gcauucuucgaaguaaguagug

SEQ ID NO: 628805 - RNA, 22 nt, Human
uaugucuuaauccuuccuuagg

SEQ ID NO: 628806 - RNA, 22 nt, Human
agcugccacagagccuggccag

SEQ ID NO: 628807 - RNA, 19 nt, Human
uuuaugucauugaggucau

SEQ ID NO: 628808 - RNA, 22 nt, Human
gguccuucaguagguuccagac

SEQ ID NO: 628809 - RNA, 20 nt, Human
cagcaggcuauggggcaccc

SEQ ID NO: 628810 - RNA, 22 nt, Human
cugggcacauuuugacuagugu

SEQ ID NO: 628811 - RNA, 22 nt, Human
ugcugcaggcaauagaaaaccu

SEQ ID NO: 628812 - RNA, 22 nt, Human
acacucuacagagcaaucuacc

SEQ ID NO: 628813 - RNA, 19 nt, Human
cucuggagaacaauagugc

SEQ ID NO: 628814 - RNA, 22 nt, Human
uggcaggaggaugaggcggcua

SEQ ID NO: 628815 - RNA, 22 nt, Human
ccagagucuuuauauuccugaa

SEQ ID NO: 628816 - RNA, 22 nt, Human
aguauaaagugguuuucagcac

SEQ ID NO: 628817 - RNA, 22 nt, Human
uggcucuccagcucuaaggccu

SEQ ID NO: 628818 - RNA, 22 nt, Human
ucucugcuaagauugugucuag

SEQ ID NO: 628819 - RNA, 22 nt, Human
aaauagcaaugugaaaagagga

SEQ ID NO: 628820 - RNA, 22 nt, Human
agcugcagauucuaucuagaag

SEQ ID NO: 628821 - RNA, 22 nt, Human
aagugguagacaaagauaauug

SEQ ID NO: 628822 - RNA, 19 nt, Human
uccagccugcuguuucucu

SEQ ID NO: 628823 - RNA, 22 nt, Human
ggucacaugugauuugagccaa

SEQ ID NO: 628824 - RNA, 22 nt, Human
guucugcagacuuggaaggugg

SEQ ID NO: 628825 - RNA, 20 nt, Human
aagggagaauaaugauugua

SEQ ID NO: 628826 - RNA, 22 nt, Human
caaaggcaguuacugaaugaag

SEQ ID NO: 628827 - RNA, 22 nt, Human
agggcuccugaggcccuucugg

SEQ ID NO: 628828 - RNA, 22 nt, Human
caccugccaaauggggaugcug

SEQ ID NO: 628829 - RNA, 22 nt, Human
gugguccugccagccaggucca

SEQ ID NO: 628830 - RNA, 22 nt, Human
gcagagcauuggagggacccug

SEQ ID NO: 628831 - RNA, 22 nt, Human
cuguuucagaacuucuuaaaaa

SEQ ID NO: 628832 - RNA, 22 nt, Human
gugagacaauuccucaguagac

SEQ ID NO: 628833 - RNA, 22 nt, Human
acauuucauuugcaguauggau

SEQ ID NO: 628834 - RNA, 22 nt, Human
ucagaauauauucauguuguca

SEQ ID NO: 628835 - RNA, 22 nt, Human
uacuucccacuggggucuacca

SEQ ID NO: 628836 - RNA, 22 nt, Human
uauacagaaccgccugaagucu

SEQ ID NO: 628837 - RNA, 22 nt, Human
ggaggcaucucuguggcugucu

SEQ ID NO: 628838 - RNA, 22 nt, Human
acauuuguacauuggcaugucu

SEQ ID NO: 628839 - RNA, 22 nt, Human
aagaauacuucguaaguaggau

SEQ ID NO: 628840 - RNA, 20 nt, Human
ugagugaguuuguggcagga

SEQ ID NO: 628841 - RNA, 22 nt, Human
auugcaaaugagucuuaauaua

SEQ ID NO: 628842 - RNA, 22 nt, Human
gcuuccuuauuguugccauagu

SEQ ID NO: 628843 - RNA, 22 nt, Human
uggcugaggcuggagugcagug

SEQ ID NO: 628844 - RNA, 22 nt, Human
agugucuggugagggcucucuc

SEQ ID NO: 628845 - RNA, 22 nt, Human
ucagaggauuggacuuuuaugu

SEQ ID NO: 628846 - RNA, 22 nt, Human
agguccagugcucuuggugguu

SEQ ID NO: 628847 - RNA, 22 nt, Human
cucagauguguuggauggaaaa

SEQ ID NO: 628848 - RNA, 19 nt, Human
uuuacucuccaaggugagu

SEQ ID NO: 628849 - RNA, 22 nt, Human
cgggcagauugggaagguucau

SEQ ID NO: 628850 - RNA, 22 nt, Human
auuucauagauuguaaaucccu

SEQ ID NO: 628851 - RNA, 22 nt, Human
auuccaaaggcuggccuggagg

SEQ ID NO: 628852 - RNA, 22 nt, Human
aucauuccacauguaccacuag

SEQ ID NO: 628853 - RNA, 22 nt, Human
aguggagcuuuuccuaucagag

SEQ ID NO: 628854 - RNA, 22 nt, Human
ucuucaugucaugguauauuga

SEQ ID NO: 628855 - RNA, 22 nt, Human
agggcuagaguugagaugggga

SEQ ID NO: 628856 - RNA, 22 nt, Human
gagagggugccuggaagccagg

SEQ ID NO: 628857 - RNA, 22 nt, Human
ugcagagguguugcugagauaa

SEQ ID NO: 628858 - RNA, 22 nt, Human
uggguccuucaaagcugggucu

SEQ ID NO: 628859 - RNA, 22 nt, Human
aacugcaacuucguaaagugag

SEQ ID NO: 628860 - RNA, 22 nt, Human
ggcagcaagcagaaguucuaug

SEQ ID NO: 628861 - RNA, 22 nt, Human
gcagagcucaagguguucagcu

SEQ ID NO: 628862 - RNA, 22 nt, Human
gcaguggcuaggagucuggcgu

SEQ ID NO: 628863 - RNA, 22 nt, Human
gaguggguaaaggugcuuggcu

SEQ ID NO: 628864 - RNA, 22 nt, Human
ugcucagagcuccagcucuccu

SEQ ID NO: 628865 - RNA, 18 nt, Human
gcaguaggcgcgcaggac

SEQ ID NO: 628866 - RNA, 22 nt, Human
uuucauaauacuguacaugaaa

SEQ ID NO: 628867 - RNA, 22 nt, Human
guacaugucaaaaaaugcauaa

SEQ ID NO: 628868 - RNA, 22 nt, Human
ugucuuuuaguuugugagaucu

SEQ ID NO: 628869 - RNA, 22 nt, Human
gccuacuuaguagcugggauua

SEQ ID NO: 628870 - RNA, 21 nt, Human
ugggaccuauuucaacuggau

SEQ ID NO: 628871 - RNA, 22 nt, Human
uguccugugauuccagcucuuc

SEQ ID NO: 628872 - RNA, 22 nt, Human
ggcuugaauggauauaaucugu

SEQ ID NO: 628873 - RNA, 23 nt, Human
uuucaaauuacucugcagaugac

SEQ ID NO: 628874 - RNA, 22 nt, Human
ugaagacaaagucaggcccaga

SEQ ID NO: 628875 - RNA, 22 nt, Human
uagaggugacacugagaccaua

SEQ ID NO: 628876 - RNA, 22 nt, Human
agcccugcucaucuggaucccg

SEQ ID NO: 628877 - RNA, 17 nt, Human
agacagaccucugcauc

SEQ ID NO: 628878 - RNA, 22 nt, Human
uguguuaaggcacugauaucug

SEQ ID NO: 628879 - RNA, 22 nt, Human
uagaggcuuucagcgguagguc

SEQ ID NO: 628880 - RNA, 23 nt, Human
augcaguauaugucaguaguuua

SEQ ID NO: 628881 - RNA, 22 nt, Human
ugcugaaaaguaaauaggccua

SEQ ID NO: 628882 - RNA, 22 nt, Human
cagcuccugggccaucuccuag

SEQ ID NO: 628883 - RNA, 22 nt, Human
augugaggcagcacggagauua

SEQ ID NO: 628884 - RNA, 22 nt, Human
gggcccuucagcuuccucugca

SEQ ID NO: 628885 - RNA, 22 nt, Human
aaugagcugcugcuguuccacc

SEQ ID NO: 628886 - RNA, 22 nt, Human
cuuguacaugauaaucucacuc

SEQ ID NO: 628887 - RNA, 22 nt, Human
uggugggaguccgcugugcugc

SEQ ID NO: 628888 - RNA, 22 nt, Human
uuugaacuucuccauucugaug

SEQ ID NO: 628889 - RNA, 22 nt, Human
acaguguuucacuuaaccguuu

SEQ ID NO: 628890 - RNA, 22 nt, Human
cuaacauuuauugagcacuuag

SEQ ID NO: 628891 - RNA, 22 nt, Human
accaccaggggauuuucagaac

SEQ ID NO: 628892 - RNA, 22 nt, Human
ucucugugugggagaucuuuuu

SEQ ID NO: 628893 - RNA, 22 nt, Human
ucuucuggaucgaucacauugu

SEQ ID NO: 628894 - RNA, 22 nt, Human
ucucugggguagggcccaggac

SEQ ID NO: 628895 - RNA, 22 nt, Human
agucacaguuucccugagagag

SEQ ID NO: 628896 - RNA, 22 nt, Human
ggucccaugaaagagggaggcc

SEQ ID NO: 628897 - RNA, 22 nt, Human
aacuuggcuaccagcguuaaau

SEQ ID NO: 628898 - RNA, 22 nt, Human
auuugccuugugaauuggauau

SEQ ID NO: 628899 - RNA, 22 nt, Human
ucccacugugccuguuguaauc

SEQ ID NO: 628900 - RNA, 22 nt, Human
ccaggaggcucuugucccuggu

SEQ ID NO: 628901 - RNA, 22 nt, Human
auaaagccuuucuguuuucagg

SEQ ID NO: 628902 - RNA, 22 nt, Human
cuccagguaguuauuucaagaa

SEQ ID NO: 628903 - RNA, 22 nt, Human
uuugcuauugugaauagugcca

SEQ ID NO: 628904 - RNA, 22 nt, Human
auuaagcugguccagacaaguu

SEQ ID NO: 628905 - RNA, 23 nt, Human
agggcugaaugcagagaagcaga

SEQ ID NO: 628906 - RNA, 22 nt, Human
cugagagcaucgcuggagauag

SEQ ID NO: 628907 - RNA, 22 nt, Human
gucauaaagacagaaacauucc

SEQ ID NO: 628908 - RNA, 22 nt, Human
ucccuaaacucugaacugauuc

SEQ ID NO: 628909 - RNA, 22 nt, Human
acucaagauagggaaaguacaa

SEQ ID NO: 628910 - RNA, 22 nt, Human
auagacuugguuaguaaauuug

SEQ ID NO: 628911 - RNA, 22 nt, Human
cuagagaaaauguuaauacagu

SEQ ID NO: 628912 - RNA, 22 nt, Human
gagcaggccuggggugaggccu

SEQ ID NO: 628913 - RNA, 22 nt, Human
gggucccaggaaggagcagugu

SEQ ID NO: 628914 - RNA, 22 nt, Human
ccucacagcccuccucuagcac

SEQ ID NO: 628915 - RNA, 22 nt, Human
caggcccugggcaggaucagcc

SEQ ID NO: 628916 - RNA, 22 nt, Human
cucccuuccaaugacuaugcuu

SEQ ID NO: 628917 - RNA, 22 nt, Human
gcucagagguuguucuuggguu

SEQ ID NO: 628918 - RNA, 22 nt, Human
gauuuugucaaauuccaaaugu

SEQ ID NO: 628919 - RNA, 22 nt, Human
gaaugaauucagcacauggaau

SEQ ID NO: 628920 - RNA, 22 nt, Human
cuuccagaguugcguucucggu

SEQ ID NO: 628921 - RNA, 22 nt, Human
gagagguccauuccccugucag

SEQ ID NO: 628922 - RNA, 22 nt, Human
aacuggaaugaaauuuacgaug

SEQ ID NO: 628923 - RNA, 22 nt, Human
aaacccagagacuagaaagacc

SEQ ID NO: 628924 - RNA, 22 nt, Human
guggccuuauuauguacaaaau

SEQ ID NO: 628925 - RNA, 22 nt, Human
uggauggcuggggaagagcagg

SEQ ID NO: 628926 - RNA, 22 nt, Human
aacuuuacuugaaagaacaugu

SEQ ID NO: 628927 - RNA, 22 nt, Human
acuacugaauauuaguucugaa

SEQ ID NO: 628928 - RNA, 22 nt, Human
caaggcaggucugaggagguug

SEQ ID NO: 628929 - RNA, 23 nt, Human
ugggucucuaguacaggcaggca

SEQ ID NO: 628930 - RNA, 22 nt, Human
uguucuucuagauugccuuuua

SEQ ID NO: 628931 - RNA, 22 nt, Human
ugauaggcuuaauuuuccuguc

SEQ ID NO: 628932 - RNA, 22 nt, Human
ugaagccaucccucagauggcc

SEQ ID NO: 628933 - RNA, 22 nt, Human
cauuucucauaauauuagcacu

SEQ ID NO: 628934 - RNA, 22 nt, Human
augcaaauucuuugcuucuucu

SEQ ID NO: 628935 - RNA, 22 nt, Human
uucagggcguuguggcugacug

SEQ ID NO: 628936 - RNA, 22 nt, Human
aaauggguuugauucucagcca

SEQ ID NO: 628937 - RNA, 22 nt, Human
aguguuucuaaguagaugugaa

SEQ ID NO: 628938 - RNA, 22 nt, Human
ugaaguuguuaagguugccauu

SEQ ID NO: 628939 - RNA, 23 nt, Human
uuaugcaagcuuccuggucucag

SEQ ID NO: 628940 - RNA, 22 nt, Human
ugcucuuacauuaauucagcau

SEQ ID NO: 628941 - RNA, 22 nt, Human
cagagacaggaucucgaagacu

SEQ ID NO: 628942 - RNA, 23 nt, Human
gugagcagcccacuaggaaugcc

SEQ ID NO: 628943 - RNA, 22 nt, Human
acacagagcuucucaacuggga

SEQ ID NO: 628944 - RNA, 22 nt, Human
ugcaggugguuuggacacugcu

SEQ ID NO: 628945 - RNA, 22 nt, Human
aggcuccugauccuggggucug

SEQ ID NO: 628946 - RNA, 22 nt, Human
ucagaaucuaaauaggcuccag

SEQ ID NO: 628947 - RNA, 22 nt, Human
cacaguuuaugaucucagugaa

SEQ ID NO: 628948 - RNA, 22 nt, Human
uugcuaacgcucacccuuugcc

SEQ ID NO: 628949 - RNA, 22 nt, Human
ccagagggaacugggccucauu

SEQ ID NO: 628950 - RNA, 22 nt, Human
ucuagaaaaaaacugcugugga

SEQ ID NO: 628951 - RNA, 22 nt, Human
cuucacaugauguccgugcugu

SEQ ID NO: 628952 - RNA, 22 nt, Human
cacuguuuuuauguaaucagug

SEQ ID NO: 628953 - RNA, 22 nt, Human
ucagguggcugguugcuggcua

SEQ ID NO: 628954 - RNA, 22 nt, Human
aaaggugacugcagcagcuauu

SEQ ID NO: 628955 - RNA, 22 nt, Human
agcuucauuccagccacuguga

SEQ ID NO: 628956 - RNA, 22 nt, Human
ugcaugucaaggcacucaggau

SEQ ID NO: 628957 - RNA, 22 nt, Human
cagcaucuucaugugcaucucc

SEQ ID NO: 628958 - RNA, 22 nt, Human
uuccaaguagaagcauuugcau

SEQ ID NO: 628959 - RNA, 22 nt, Human
aagaguauuugguauagaacac

SEQ ID NO: 628960 - RNA, 20 nt, Human
uguguagcaggugcugugcc

SEQ ID NO: 628961 - RNA, 22 nt, Human
cugucagguuucccaucugcaa

SEQ ID NO: 628962 - RNA, 22 nt, Human
uagaaaugauugagcuguaaua

SEQ ID NO: 628963 - RNA, 22 nt, Human
agcuaggauaagcagagacugg

SEQ ID NO: 628964 - RNA, 22 nt, Human
cugccaaggcuggggaggacaa

SEQ ID NO: 628965 - RNA, 22 nt, Human
ugggucagagcugugcugccca

SEQ ID NO: 628966 - RNA, 22 nt, Human
uacaguuuaacacuuuggagaa

SEQ ID NO: 628967 - RNA, 22 nt, Human
agcugcccagguucauugggcc

SEQ ID NO: 628968 - RNA, 22 nt, Human
uacaaguacuguggcuuugaau

SEQ ID NO: 628969 - RNA, 22 nt, Human
uacuggagucagaaaugccuug

SEQ ID NO: 628970 - RNA, 20 nt, Human
gcuucaguuuccucacuggu

SEQ ID NO: 628971 - RNA, 19 nt, Human
ugaagguguaugugcuggg

SEQ ID NO: 628972 - RNA, 22 nt, Human
uuccuaacuggccuuuauggau

SEQ ID NO: 628973 - RNA, 22 nt, Human
cacagaauaaauugguaucaga

SEQ ID NO: 628974 - RNA, 21 nt, Human
ugguacaccuugccugucaga

SEQ ID NO: 628975 - RNA, 22 nt, Human
agcaacagcagguuugcacucc

SEQ ID NO: 628976 - RNA, 22 nt, Human
uaggcagauuccauauuuuggc

SEQ ID NO: 628977 - RNA, 22 nt, Human
uugggcagaggccaggaggaug

SEQ ID NO: 628978 - RNA, 22 nt, Human
caggccuggcccccggcacacc

SEQ ID NO: 628979 - RNA, 22 nt, Human
uuaaacacuggagcuggguguu

SEQ ID NO: 628980 - RNA, 22 nt, Human
aaguguuuaaauuauuugcagg

SEQ ID NO: 628981 - RNA, 22 nt, Human
auugaacagaaaccaucagagu

SEQ ID NO: 628982 - RNA, 22 nt, Human
ggcaggacugaucagugggaug

SEQ ID NO: 628983 - RNA, 22 nt, Human
ucagugcuccuaaagugaaugc

SEQ ID NO: 628984 - RNA, 22 nt, Human
cugagcccaggcgggagcugag

SEQ ID NO: 628985 - RNA, 22 nt, Human
caggcugggaacgccacccgcu

SEQ ID NO: 628986 - RNA, 22 nt, Human
auguaguauuuggaaauguaaa

SEQ ID NO: 628987 - RNA, 21 nt, Human
auguacauucggcaacagaua

SEQ ID NO: 628988 - RNA, 19 nt, Human
guccacuccacucggucuc

SEQ ID NO: 628989 - RNA, 22 nt, Human
auaaaucuauuggacaugugug

SEQ ID NO: 628990 - RNA, 22 nt, Human
ccacacuuugagaugacuagga

SEQ ID NO: 628991 - RNA, 22 nt, Human
gggcugacucaaccuugcaaag

SEQ ID NO: 628992 - RNA, 22 nt, Human
gagggcucugaaaggaggucac

SEQ ID NO: 628993 - RNA, 22 nt, Human
aauggcuuuaaguagucucaca

SEQ ID NO: 628994 - RNA, 22 nt, Human
uuuguguguauauccuuccaga

SEQ ID NO: 628995 - RNA, 22 nt, Human
guacagugccagacuucuaggu

SEQ ID NO: 628996 - RNA, 22 nt, Human
gcaggucucaaucugagcaggc

SEQ ID NO: 628997 - RNA, 22 nt, Human
uuuuaauugcaauuaugguccc

SEQ ID NO: 628998 - RNA, 22 nt, Human
aacuuuguuuuauucacugcug

SEQ ID NO: 628999 - RNA, 22 nt, Human
uacagaauauuucugcccugag

SEQ ID NO: 629000 - RNA, 22 nt, Human
ucagagagaaauaguuuuugac

SEQ ID NO: 629001 - RNA, 22 nt, Human
gggacgggcacggagggcccuc

SEQ ID NO: 629002 - RNA, 22 nt, Human
cagauaaauagacuuggucaga

SEQ ID NO: 629003 - RNA, 22 nt, Human
cugggcugcuguccacuagggu

SEQ ID NO: 629004 - RNA, 22 nt, Human
ggggcugagucagugggaagag

SEQ ID NO: 629005 - RNA, 22 nt, Human
uuguuauuauuacuaagucuuc

SEQ ID NO: 629006 - RNA, 22 nt, Human
guggguggagacugggugcaag

SEQ ID NO: 629007 - RNA, 22 nt, Human
uccucacagcaugaccaggcag

SEQ ID NO: 629008 - RNA, 23 nt, Human
ggcuucuugccugucuuggugcu

SEQ ID NO: 629009 - RNA, 22 nt, Human
aacaauguucuuuuagcuugaa

SEQ ID NO: 629010 - RNA, 22 nt, Human
cacauuuauuugaggcuaauug

SEQ ID NO: 629011 - RNA, 22 nt, Human
ggaggccaggguggguggaucg

SEQ ID NO: 629012 - RNA, 22 nt, Human
uuccugaaugcuguugugcugu

SEQ ID NO: 629013 - RNA, 22 nt, Human
uggcucugaucagauguccagu

SEQ ID NO: 629014 - RNA, 22 nt, Human
ucuuucuucuuucauaguguga

SEQ ID NO: 629015 - RNA, 22 nt, Human
cauuuguaucauauguaucuua

SEQ ID NO: 629016 - RNA, 22 nt, Human
cugccuuuuaaagccaguguua

SEQ ID NO: 629017 - RNA, 22 nt, Human
aaaucaguuggaacacaagcag

SEQ ID NO: 629018 - RNA, 22 nt, Human
cuggagagauccuccugaaaaa

SEQ ID NO: 629019 - RNA, 22 nt, Human
aaggcaauauugaguuucccuu

SEQ ID NO: 629020 - RNA, 22 nt, Human
cccagccuuccacccuggacua

SEQ ID NO: 629021 - RNA, 23 nt, Human
gucucuagaguguggagcaaaga

SEQ ID NO: 629022 - RNA, 21 nt, Human
cucuugcugaugucuccuuua

SEQ ID NO: 629023 - RNA, 22 nt, Human
gccugcagaacugugaggcaau

SEQ ID NO: 629024 - RNA, 22 nt, Human
ugguggccuugauggcaucugc

SEQ ID NO: 629025 - RNA, 22 nt, Human
cacauuuaauugguuuagggug

SEQ ID NO: 629026 - RNA, 22 nt, Human
auccacucccuaacaccauguu

SEQ ID NO: 629027 - RNA, 22 nt, Human
acaaaauuaugaagaggccuug

SEQ ID NO: 629028 - RNA, 23 nt, Human
ugggccaguucuguugaaagcca

SEQ ID NO: 629029 - RNA, 18 nt, Human
cagagugggccaagagac

SEQ ID NO: 629030 - RNA, 22 nt, Human
accauuuacucccauuggaagu

SEQ ID NO: 629031 - RNA, 19 nt, Human
ugcuggagguugacagggu

SEQ ID NO: 629032 - RNA, 22 nt, Human
aguuucuagcaaggauuguuga

SEQ ID NO: 629033 - RNA, 22 nt, Human
gcagagacuaguagugcagacu

SEQ ID NO: 629034 - RNA, 21 nt, Human
acauuauaauucauauuccac

SEQ ID NO: 629035 - RNA, 22 nt, Human
augcuuuacgacaaaaaacuca

SEQ ID NO: 629036 - RNA, 22 nt, Human
ccuggggcucaagauggcgccg

SEQ ID NO: 629037 - RNA, 22 nt, Human
ugcuggaggggccugaccagga

SEQ ID NO: 629038 - RNA, 20 nt, Human
cauuaugguugggcacagug

SEQ ID NO: 629039 - RNA, 20 nt, Human
auagaucagugagacuaaag

SEQ ID NO: 629040 - RNA, 22 nt, Human
agugcucccuagaguugugcaa

SEQ ID NO: 629041 - RNA, 22 nt, Human
acauuugaggauguuaagaaug

SEQ ID NO: 629042 - RNA, 22 nt, Human
ggagcuggcuacagagaacucc

SEQ ID NO: 629043 - RNA, 22 nt, Human
cugagggccuuggcuccugccc

SEQ ID NO: 629044 - RNA, 22 nt, Human
uacaagaagaggcagagcugga

SEQ ID NO: 629045 - RNA, 22 nt, Human
aggcauugcugguauuggaagu

SEQ ID NO: 629046 - RNA, 22 nt, Human
caucagcuuuucuaugugguga

SEQ ID NO: 629047 - RNA, 22 nt, Human
gcagggcuagauauuugcaagu

SEQ ID NO: 629048 - RNA, 22 nt, Human
acugaggucuaucaugagccag

SEQ ID NO: 629049 - RNA, 22 nt, Human
uauaaguguaguuucaaauguu

SEQ ID NO: 629050 - RNA, 22 nt, Human
aagauacauuuucuucagagaa

SEQ ID NO: 629051 - RNA, 22 nt, Human
aggaagcuccuggagagccagu

SEQ ID NO: 629052 - RNA, 19 nt, Human
uucuggggccuggccuugg

SEQ ID NO: 629053 - RNA, 22 nt, Human
ccucugagcuggccuguggggc

SEQ ID NO: 629054 - RNA, 22 nt, Human
aucugagucucugacagcaugu

SEQ ID NO: 629055 - RNA, 21 nt, Human
uaaaccuggcgcuguucaaag

SEQ ID NO: 629056 - RNA, 22 nt, Human
ccaggaaugaaauguagauaaa

SEQ ID NO: 629057 - RNA, 23 nt, Human
aggaagaggcaauuucucuuaga

SEQ ID NO: 629058 - RNA, 22 nt, Human
gcagguaagagaggcuggcuuc

SEQ ID NO: 629059 - RNA, 22 nt, Human
uguguuuaaagaggaagugaga

SEQ ID NO: 629060 - RNA, 22 nt, Human
uaugaguggcguagagguaggg

SEQ ID NO: 629061 - RNA, 19 nt, Human
ccugggucugcagcauuca

SEQ ID NO: 629062 - RNA, 22 nt, Human
cuggaaugagcagggcuuaugg

SEQ ID NO: 629063 - RNA, 22 nt, Human
guaacaaaggauaacuugguuu

SEQ ID NO: 629064 - RNA, 22 nt, Human
uauucaggucgagcuaacugcu

SEQ ID NO: 629065 - RNA, 22 nt, Human
accuuuuuguucuguucucagc

SEQ ID NO: 629066 - RNA, 22 nt, Human
cccucaggagaugucagcugga

SEQ ID NO: 629067 - RNA, 22 nt, Human
cugggagcaagucaggaaaggu

SEQ ID NO: 629068 - RNA, 22 nt, Human
aaacaauguagauuaccauuua

SEQ ID NO: 629069 - RNA, 22 nt, Human
ccuggagaccugauggcagcgg

SEQ ID NO: 629070 - RNA, 22 nt, Human
cagcaggauaugguggagagag

SEQ ID NO: 629071 - RNA, 22 nt, Human
agcagugaugaaaugagcaucc

SEQ ID NO: 629072 - RNA, 23 nt, Human
cccagcugagacuuccugaacuc

SEQ ID NO: 629073 - RNA, 22 nt, Human
aggcuuuaagcaagcauauugu

SEQ ID NO: 629074 - RNA, 22 nt, Human
auucagcaaacauuuauugugu

SEQ ID NO: 629075 - RNA, 22 nt, Human
auuuacucgugucuccagugcu

SEQ ID NO: 629076 - RNA, 22 nt, Human
ucagcuuuuuggauugcccaag

SEQ ID NO: 629077 - RNA, 18 nt, Human
caggucagccuggccuca

SEQ ID NO: 629078 - RNA, 22 nt, Human
gagccccuucugcagucagguu

SEQ ID NO: 629079 - RNA, 22 nt, Human
uccuagaagauggaucagagaa

SEQ ID NO: 629080 - RNA, 22 nt, Human
uuucuuccuauguaucuugcug

SEQ ID NO: 629081 - RNA, 22 nt, Human
ugggcaagcaggagggccucag

SEQ ID NO: 629082 - RNA, 22 nt, Human
aauuucacuguggagcacauuu

SEQ ID NO: 629083 - RNA, 22 nt, Human
uaaucacugucaaccuuuguuc

SEQ ID NO: 629084 - RNA, 22 nt, Human
uacuguuaauguuaaauucagg

SEQ ID NO: 629085 - RNA, 23 nt, Human
ucccuguguacagccugcaugag

SEQ ID NO: 629086 - RNA, 22 nt, Human
acaguguuauuucugaguaaug

SEQ ID NO: 629087 - RNA, 22 nt, Human
ucuccaggugagggugguuaga

SEQ ID NO: 629088 - RNA, 22 nt, Human
acacacagcgccuaccaugugc

SEQ ID NO: 629089 - RNA, 22 nt, Human
gaaacacaugcagcuccauaga

SEQ ID NO: 629090 - RNA, 22 nt, Human
aaagcagauucugaugcaguag

SEQ ID NO: 629091 - RNA, 22 nt, Human
uuccuguggcugucacuccugg

SEQ ID NO: 629092 - RNA, 22 nt, Human
gccgaagacgcugggcgugggc

SEQ ID NO: 629093 - RNA, 22 nt, Human
cccaggcacagauuaucccaau

SEQ ID NO: 629094 - RNA, 22 nt, Human
gccccaggauaaauuuguaaga

SEQ ID NO: 629095 - RNA, 22 nt, Human
ucuucaggaagggaaaucaucc

SEQ ID NO: 629096 - RNA, 22 nt, Human
cuggcaguggaggaagaaaacu

SEQ ID NO: 629097 - RNA, 22 nt, Human
uuuauauccaucuuugaaguaa

SEQ ID NO: 629098 - RNA, 22 nt, Human
cuaguccagucucaaaaugcua

SEQ ID NO: 629099 - RNA, 19 nt, Human
ucccaguggggagaggugu

SEQ ID NO: 629100 - RNA, 22 nt, Human
uuuagggaagaagcccauggcc

SEQ ID NO: 629101 - RNA, 22 nt, Human
uagguuuaggagugaaggugaa

SEQ ID NO: 629102 - RNA, 23 nt, Human
agaccugcaucugauaggcccug

SEQ ID NO: 629103 - RNA, 22 nt, Human
ccagucacagguguguuuauau

SEQ ID NO: 629104 - RNA, 23 nt, Human
aaaugucuucuagcucuugagaa

SEQ ID NO: 629105 - RNA, 22 nt, Human
uacugugugacccuggguaggu

SEQ ID NO: 629106 - RNA, 22 nt, Human
ucuaauaaauaaaugcucuagg

SEQ ID NO: 629107 - RNA, 22 nt, Human
caggcuccacuguaggcagcuc

SEQ ID NO: 629108 - RNA, 22 nt, Human
aguacaauuauauuuagauggu

SEQ ID NO: 629109 - RNA, 22 nt, Human
ucuggccuccuccaccagggaa

SEQ ID NO: 629110 - RNA, 22 nt, Human
ucugagaaggaagcucugugua

SEQ ID NO: 629111 - RNA, 22 nt, Human
ccugagcuuacaauuuaagaac

SEQ ID NO: 629112 - RNA, 22 nt, Human
cagcuggggagagacauggcag

SEQ ID NO: 629113 - RNA, 23 nt, Human
agacugaggcugccagggucaga

SEQ ID NO: 629114 - RNA, 22 nt, Human
cucugaauggacacuccagugu

SEQ ID NO: 629115 - RNA, 22 nt, Human
ugagcaguggcaccaggucacc

SEQ ID NO: 629116 - RNA, 22 nt, Human
gggucaggaagaauucugccaa

SEQ ID NO: 629117 - RNA, 22 nt, Human
agcaaaguagcugcuguucuua

SEQ ID NO: 629118 - RNA, 22 nt, Human
ugagaacauuugcagggagagu

SEQ ID NO: 629119 - RNA, 23 nt, Human
uugauucuccaguaugggcugag

SEQ ID NO: 629120 - RNA, 21 nt, Human
uccucccugagcuguggggga

SEQ ID NO: 629121 - RNA, 22 nt, Human
caagggaguuacugagggcggg

SEQ ID NO: 629122 - RNA, 22 nt, Human
aguccuuccggcagauuucacu

SEQ ID NO: 629123 - RNA, 23 nt, Human
auccuguuguaggcaguaauuag

SEQ ID NO: 629124 - RNA, 22 nt, Human
ugugagaguauaaucucucugu

SEQ ID NO: 629125 - RNA, 22 nt, Human
aguuggagaagaggucgggaau

SEQ ID NO: 629126 - RNA, 22 nt, Human
uuucugcuucucagacccugaa

SEQ ID NO: 629127 - RNA, 22 nt, Human
uccuacaucagcucucaguagc

SEQ ID NO: 629128 - RNA, 22 nt, Human
uuuccaugaucguuauagaacu

SEQ ID NO: 629129 - RNA, 22 nt, Human
gaaaugugcagaauguguuaga

SEQ ID NO: 629130 - RNA, 22 nt, Human
uacauguggagauaacugaagc

SEQ ID NO: 629131 - RNA, 22 nt, Human
gggaagauaguguugagggccc

SEQ ID NO: 629132 - RNA, 22 nt, Human
gccucuggaagugggaaggggu

SEQ ID NO: 629133 - RNA, 22 nt, Human
acugaggaacauauauaagaug

SEQ ID NO: 629134 - RNA, 22 nt, Human
ucauucauacucuuuucuauua

SEQ ID NO: 629135 - RNA, 22 nt, Human
cagcugaagguaggaaccagga

SEQ ID NO: 629136 - RNA, 22 nt, Human
ucugagagagggucagaugcua

SEQ ID NO: 629137 - RNA, 22 nt, Human
cucagaaauuacaaaagggaca

SEQ ID NO: 629138 - RNA, 22 nt, Human
ucuuccuggcauugaugcugca

SEQ ID NO: 629139 - RNA, 22 nt, Human
gagcuuggacaccuuggcaggu

SEQ ID NO: 629140 - RNA, 22 nt, Human
cugggagacgcagcuggggauc

SEQ ID NO: 629141 - RNA, 22 nt, Human
aggugggcaaugaggccugagu

SEQ ID NO: 629142 - RNA, 22 nt, Human
ucugcccauucuuagagucuag

SEQ ID NO: 629143 - RNA, 22 nt, Human
aagcaggaagcucagguccuug

SEQ ID NO: 629144 - RNA, 22 nt, Human
cugccgagugggucaugaggca

SEQ ID NO: 629145 - RNA, 22 nt, Human
acucaggaaauugagauaaugg

SEQ ID NO: 629146 - RNA, 21 nt, Human
gcagagcuggaaccaggaccc

SEQ ID NO: 629147 - RNA, 22 nt, Human
aggcugugggaguugagagucu

SEQ ID NO: 629148 - RNA, 22 nt, Human
ucuuccucccuacagagcucag

SEQ ID NO: 629149 - RNA, 23 nt, Human
gagcugggauacaggcuuacugc

SEQ ID NO: 629150 - RNA, 22 nt, Human
agaugcugugaggaagcuagga

SEQ ID NO: 629151 - RNA, 22 nt, Human
ccuggcuucuauaccaccaggu

SEQ ID NO: 629152 - RNA, 22 nt, Human
acuguggcaaagaagcaggcuc

SEQ ID NO: 629153 - RNA, 22 nt, Human
caggcaccucacguggguccca

SEQ ID NO: 629154 - RNA, 22 nt, Human
cacagcuggugcacuagcucug

SEQ ID NO: 629155 - RNA, 22 nt, Human
ugaucaaagugcuggaauuaca

SEQ ID NO: 629156 - RNA, 22 nt, Human
uccugggcagccucucuggaag

SEQ ID NO: 629157 - RNA, 22 nt, Human
uggcagaccugaagguucggcg

SEQ ID NO: 629158 - RNA, 22 nt, Human
ucugaaauggcgauggccguug

SEQ ID NO: 629159 - RNA, 22 nt, Human
cacaugcaccagaaaucaacau

SEQ ID NO: 629160 - RNA, 22 nt, Human
ggcuuugccuggaauuuccuug

SEQ ID NO: 629161 - RNA, 22 nt, Human
acaacauucuuaaauacacuga

SEQ ID NO: 629162 - RNA, 22 nt, Human
aacucuuuguggacauuaaauu

SEQ ID NO: 629163 - RNA, 22 nt, Human
uggcaggaaaaacauuggagau

SEQ ID NO: 629164 - RNA, 22 nt, Human
ucucuggaagcgcagaucuguu

SEQ ID NO: 629165 - RNA, 22 nt, Human
cuaaaguccuuaucaaguguaa

SEQ ID NO: 629166 - RNA, 21 nt, Human
uaaaucucuguauucuucagu

SEQ ID NO: 629167 - RNA, 22 nt, Human
auucuaaagcuuguggagcuua

SEQ ID NO: 629168 - RNA, 22 nt, Human
cucaggaugucggugacuauug

SEQ ID NO: 629169 - RNA, 22 nt, Human
gccuggcugcucagccacucac

SEQ ID NO: 629170 - RNA, 22 nt, Human
aaacagcuuguaagguguaauu

SEQ ID NO: 629171 - RNA, 22 nt, Human
ugauuuuauugaaacuucacuu

SEQ ID NO: 629172 - RNA, 22 nt, Human
ucguggagaggccauguggagg

SEQ ID NO: 629173 - RNA, 22 nt, Human
ggagggcucccugggaguggau

SEQ ID NO: 629174 - RNA, 22 nt, Human
agcccaggugacucauacaccc

SEQ ID NO: 629175 - RNA, 22 nt, Human
uccucugggcucccugcaacag

SEQ ID NO: 629176 - RNA, 22 nt, Human
ccccucccugaccugguugggc

SEQ ID NO: 629177 - RNA, 22 nt, Human
acuuccaggaggugucacugaa

SEQ ID NO: 629178 - RNA, 22 nt, Human
uaaaugucaaugugauuuauaa

SEQ ID NO: 629179 - RNA, 19 nt, Human
ugccuggacaaaugugggg

SEQ ID NO: 629180 - RNA, 22 nt, Human
cuggggagacgaucgauguucu

SEQ ID NO: 629181 - RNA, 22 nt, Human
gaagagcuauguccagggagca

SEQ ID NO: 629182 - RNA, 22 nt, Human
uuuuaugugcuggacuggcagu

SEQ ID NO: 629183 - RNA, 22 nt, Human
ugcauuaaaaugauggagaaau

SEQ ID NO: 629184 - RNA, 22 nt, Human
cagcaauggcaggcggagagug

SEQ ID NO: 629185 - RNA, 22 nt, Human
ugugugucacugaaagaaaucu

SEQ ID NO: 629186 - RNA, 22 nt, Human
aggcacugacaauucuggacug

SEQ ID NO: 629187 - RNA, 21 nt, Human
uucuagaaaaguaugggacug

SEQ ID NO: 629188 - RNA, 22 nt, Human
auucagaaauagaaaauuugau

SEQ ID NO: 629189 - RNA, 22 nt, Human
gccaagcuguuuuucagagacg

SEQ ID NO: 629190 - RNA, 22 nt, Human
caagagccuuugggcagaagga

SEQ ID NO: 629191 - RNA, 22 nt, Human
cagauucucacuguauucaggu

SEQ ID NO: 629192 - RNA, 19 nt, Human
aguggcugggcagaagcaa

SEQ ID NO: 629193 - RNA, 22 nt, Human
auccugaaaacuuacgaagugg

SEQ ID NO: 629194 - RNA, 22 nt, Human
cgauggaauuggaaagaggaau

SEQ ID NO: 629195 - RNA, 22 nt, Human
uccaagcuugcuuuagccacag

SEQ ID NO: 629196 - RNA, 22 nt, Human
cucauagacaagccucuuuuaa

SEQ ID NO: 629197 - RNA, 19 nt, Human
agagaugcuaagagucuuu

SEQ ID NO: 629198 - RNA, 22 nt, Human
cagcucuguugcccuggaaacg

SEQ ID NO: 629199 - RNA, 22 nt, Human
gcccucagaugggaaaggaggg

SEQ ID NO: 629200 - RNA, 22 nt, Human
caggugaccuauggucacuaca

SEQ ID NO: 629201 - RNA, 22 nt, Human
aggcuucuucucuauguacaag

SEQ ID NO: 629202 - RNA, 22 nt, Human
aaagauaauguuuccuuauucu

SEQ ID NO: 629203 - RNA, 22 nt, Human
uuggcaauggaccagccacugg

SEQ ID NO: 629204 - RNA, 22 nt, Human
caccagcuucucauugcggguc

SEQ ID NO: 629205 - RNA, 22 nt, Human
aacacuguggucuuuucaguaa

SEQ ID NO: 629206 - RNA, 22 nt, Human
ucagauuuggacacaggaacuu

SEQ ID NO: 629207 - RNA, 22 nt, Human
agaaccaguuuaagauuugggu

SEQ ID NO: 629208 - RNA, 22 nt, Human
ugaaaugaaugugauucgauag

SEQ ID NO: 629209 - RNA, 22 nt, Human
ccagugcccagcugcccaggca

SEQ ID NO: 629210 - RNA, 22 nt, Human
cccaggcagagagcuggugagc

SEQ ID NO: 629211 - RNA, 22 nt, Human
aggagcucuugaugcuugaggg

SEQ ID NO: 629212 - RNA, 22 nt, Human
cuuauuuugcugaugacccagg

SEQ ID NO: 629213 - RNA, 22 nt, Human
cacuucaacaguuauuucuuag

SEQ ID NO: 629214 - RNA, 22 nt, Human
cgggcuggcugcagcugcugga

SEQ ID NO: 629215 - RNA, 22 nt, Human
ucucagggcagcaaggaagcau

SEQ ID NO: 629216 - RNA, 22 nt, Human
acuuccuguuaugugugccucu

SEQ ID NO: 629217 - RNA, 22 nt, Human
uugggugguggggagaguucag

SEQ ID NO: 629218 - RNA, 23 nt, Human
uuuaaaaguuguaauguaggcuu

SEQ ID NO: 629219 - RNA, 22 nt, Human
ugaagaggccgugugcagguga

SEQ ID NO: 629220 - RNA, 22 nt, Human
gcccagccccuggguggacgug

SEQ ID NO: 629221 - RNA, 22 nt, Human
augcacuuucuagagauucuga

SEQ ID NO: 629222 - RNA, 22 nt, Human
ccgcccacacuaaauaugagcg

SEQ ID NO: 629223 - RNA, 22 nt, Human
cuugggccagcccagggggcau

SEQ ID NO: 629224 - RNA, 22 nt, Human
aggcauggcuuuaggcaggcgu

SEQ ID NO: 629225 - RNA, 22 nt, Human
ggcagccuugagggaggccugg

SEQ ID NO: 629226 - RNA, 22 nt, Human
ucugagcagcuuuguuuugugu

SEQ ID NO: 629227 - RNA, 22 nt, Human
acagauacaaauauacaaauac

SEQ ID NO: 629228 - RNA, 22 nt, Human
caauuucucuuuauaucucaca

SEQ ID NO: 629229 - RNA, 22 nt, Human
ccauuucauugccuguaaagug

SEQ ID NO: 629230 - RNA, 22 nt, Human
gagcagcuagauaaagcccuuc

SEQ ID NO: 629231 - RNA, 22 nt, Human
gcugcagguuugucuagucugg

SEQ ID NO: 629232 - RNA, 22 nt, Human
uucuuuggggaauauucugguu

SEQ ID NO: 629233 - RNA, 20 nt, Human
aguuuaagaaaaagcuccag

SEQ ID NO: 629234 - RNA, 22 nt, Human
ugccuggcccugacagcccugg

SEQ ID NO: 629235 - RNA, 22 nt, Human
ucaugaaaauagaucagaaauu

SEQ ID NO: 629236 - RNA, 22 nt, Human
ucaggucuuuugucuccuagaa

SEQ ID NO: 629237 - RNA, 22 nt, Human
aaaggauggcucugcauauuug

SEQ ID NO: 629238 - RNA, 22 nt, Human
acacacaugccuuuccuaagua

SEQ ID NO: 629239 - RNA, 22 nt, Human
ggaggccaugggcagaaucuuu

SEQ ID NO: 629240 - RNA, 22 nt, Human
caugcaaaugguggcuaaaugg

SEQ ID NO: 629241 - RNA, 16 nt, Human
ucucccuguucuccaa

SEQ ID NO: 629242 - RNA, 22 nt, Human
uuccagagguucucagcccugu

SEQ ID NO: 629243 - RNA, 22 nt, Human
acaagcauaagugagaugaaua

SEQ ID NO: 629244 - RNA, 22 nt, Human
aaagagcucacaguccacugga

SEQ ID NO: 629245 - RNA, 22 nt, Human
agugucacagacccaaucagga

SEQ ID NO: 629246 - RNA, 22 nt, Human
ugcagcagggcccaggcacaga

SEQ ID NO: 629247 - RNA, 19 nt, Human
uucuuacaacacccuggga

SEQ ID NO: 629248 - RNA, 22 nt, Human
ucagcucuaccugggagcuguc

SEQ ID NO: 629249 - RNA, 17 nt, Human
auacauuguuaaaguau

SEQ ID NO: 629250 - RNA, 22 nt, Human
gacuccagaaucuggacggucc

SEQ ID NO: 629251 - RNA, 22 nt, Human
gccuauggauuggagaaggagc

SEQ ID NO: 629252 - RNA, 22 nt, Human
caguggccaacuuccugccucu

SEQ ID NO: 629253 - RNA, 22 nt, Human
uuaugacaggaaaaucacagaa

SEQ ID NO: 629254 - RNA, 22 nt, Human
agucucagaguaccugagggac

SEQ ID NO: 629255 - RNA, 19 nt, Human
ggcagucacggucaggagc

SEQ ID NO: 629256 - RNA, 22 nt, Human
uauuucuaagcuguaagucuga

SEQ ID NO: 629257 - RNA, 22 nt, Human
gcuuuacauguuucccuuuaag

SEQ ID NO: 629258 - RNA, 21 nt, Human
aggauuucugucauuucagau

SEQ ID NO: 629259 - RNA, 22 nt, Human
ugauggagcaugugugcuuccu

SEQ ID NO: 629260 - RNA, 22 nt, Human
caggaagcaucuggcuagcuaa

SEQ ID NO: 629261 - RNA, 22 nt, Human
acagggcugaggcuggcuucuu

SEQ ID NO: 629262 - RNA, 22 nt, Human
agaggggcucaagcaguggucu

SEQ ID NO: 629263 - RNA, 22 nt, Human
ucugggaaccauugguggggau

SEQ ID NO: 629264 - RNA, 22 nt, Human
uugaacacuaaguuuccaggcu

SEQ ID NO: 629265 - RNA, 22 nt, Human
uagacuauagcucacagugcuu

SEQ ID NO: 629266 - RNA, 22 nt, Human
aaggggauagagcagacacucc

SEQ ID NO: 629267 - RNA, 19 nt, Human
cucucacucgccacauccu

SEQ ID NO: 629268 - RNA, 22 nt, Human
cucuccaguuaccuaggucuga

SEQ ID NO: 629269 - RNA, 22 nt, Human
ccacugccagcuuuguccuccc

SEQ ID NO: 629270 - RNA, 22 nt, Human
auugacaagcaguaugucuuag

SEQ ID NO: 629271 - RNA, 20 nt, Human
gccugagcuccgccuccugu

SEQ ID NO: 629272 - RNA, 21 nt, Human
aacugcaaaucuuagacugca

SEQ ID NO: 629273 - RNA, 21 nt, Human
caaaggacuguagcucacuga

SEQ ID NO: 629274 - RNA, 22 nt, Human
ggcucugaaauucucacuuuua

SEQ ID NO: 629275 - RNA, 22 nt, Human
gggcuacagacaugcucuaagc

SEQ ID NO: 629276 - RNA, 22 nt, Human
ccagaggugaacaggaggcugu

SEQ ID NO: 629277 - RNA, 22 nt, Human
gucugucuguuguugagaagca

SEQ ID NO: 629278 - RNA, 22 nt, Human
aauaauguuuauuuguauucuc

SEQ ID NO: 629279 - RNA, 22 nt, Human
cugggcugucaauggcccucug

SEQ ID NO: 629280 - RNA, 22 nt, Human
aggcacugagaggcuguguugc

SEQ ID NO: 629281 - RNA, 19 nt, Human
acagggcagcaauaggaua

SEQ ID NO: 629282 - RNA, 20 nt, Human
gggaggccccagaguccagg

SEQ ID NO: 629283 - RNA, 22 nt, Human
gcugucucauacaaggcccugc

SEQ ID NO: 629284 - RNA, 22 nt, Human
cagccagccucucaaccaugca

SEQ ID NO: 629285 - RNA, 22 nt, Human
uacauguaagacaugagacucu

SEQ ID NO: 629286 - RNA, 22 nt, Human
uaucaaaaggaguugaaagggg

SEQ ID NO: 629287 - RNA, 19 nt, Human
agcagcuguagauagacac

SEQ ID NO: 629288 - RNA, 22 nt, Human
guguuuauguuuguguagggga

SEQ ID NO: 629289 - RNA, 22 nt, Human
cacacuguccccuucuccccag

SEQ ID NO: 629290 - RNA, 22 nt, Human
gaaauugaaagaccaacugcau

SEQ ID NO: 629291 - RNA, 22 nt, Human
gaggccuugggaugugccacgg

SEQ ID NO: 629292 - RNA, 21 nt, Human
cagaaguaaggguaacuucuc

SEQ ID NO: 629293 - RNA, 18 nt, Human
ggucaggggcggagagaa

SEQ ID NO: 629294 - RNA, 20 nt, Human
uagaggugggauuuggguuu

SEQ ID NO: 629295 - RNA, 22 nt, Human
uugcucugaacccagggcacca

SEQ ID NO: 629296 - RNA, 22 nt, Human
cuucaucaacucuaacaaaugu

SEQ ID NO: 629297 - RNA, 22 nt, Human
ugcuccagggccuccagugggg

SEQ ID NO: 629298 - RNA, 22 nt, Human
cauuguuaauugguaucuuaca

SEQ ID NO: 629299 - RNA, 20 nt, Human
acuuuaugaguucaauuuug

SEQ ID NO: 629300 - RNA, 22 nt, Human
acagccaguaaucuaccccugu

SEQ ID NO: 629301 - RNA, 22 nt, Human
cagcagcacucugcgggucccc

SEQ ID NO: 629302 - RNA, 22 nt, Human
agucuauuuccccuucucuuga

SEQ ID NO: 629303 - RNA, 22 nt, Human
aacaguaucuacgggaacuauu

SEQ ID NO: 629304 - RNA, 22 nt, Human
gaccaaggccaggccagggcgu

SEQ ID NO: 629305 - RNA, 22 nt, Human
auuccuugcucucaucaaccuu

SEQ ID NO: 629306 - RNA, 22 nt, Human
gugacgugcagguguggccagc

SEQ ID NO: 629307 - RNA, 22 nt, Human
auuugcuuucagccuuaaggau

SEQ ID NO: 629308 - RNA, 22 nt, Human
accguauauguuugcugugccc

SEQ ID NO: 629309 - RNA, 22 nt, Human
cucagugucacguuuugccuua

SEQ ID NO: 629310 - RNA, 22 nt, Human
ugcucagagcucuggugcaggu

SEQ ID NO: 629311 - RNA, 22 nt, Human
aagacacaauguagcccagcac

SEQ ID NO: 629312 - RNA, 22 nt, Human
aggucauuuccuuagaggcaga

SEQ ID NO: 629313 - RNA, 22 nt, Human
ugcaucuguucagagcugucga

SEQ ID NO: 629314 - RNA, 22 nt, Human
auagaagcaagaacagaaugga

SEQ ID NO: 629315 - RNA, 22 nt, Human
uggcuaguaggugaguagugcu

SEQ ID NO: 629316 - RNA, 22 nt, Human
ucuucuuuuugucccacagaau

SEQ ID NO: 629317 - RNA, 21 nt, Human
uagcagagaucauuuucuccu

SEQ ID NO: 629318 - RNA, 22 nt, Human
cugugcugaacaauucugcauu

SEQ ID NO: 629319 - RNA, 22 nt, Human
aucacauugccagugauuaccc

SEQ ID NO: 629320 - RNA, 22 nt, Human
ugugaaacggagucagggaagg

SEQ ID NO: 629321 - RNA, 22 nt, Human
gcucagagaaauuauaggaauu

SEQ ID NO: 629322 - RNA, 21 nt, Human
uggcuucauuugcaacccacu

SEQ ID NO: 629323 - RNA, 22 nt, Human
gaggaggucgcugcugagcccc

SEQ ID NO: 629324 - RNA, 22 nt, Human
acagagcucccagccaucuccu

SEQ ID NO: 629325 - RNA, 22 nt, Human
auacagcuuaugcauauaucuc

SEQ ID NO: 629326 - RNA, 22 nt, Human
uugguaaauaacaaucacagug

SEQ ID NO: 629327 - RNA, 22 nt, Human
aaggcucucugauggcagcagu

SEQ ID NO: 629328 - RNA, 22 nt, Human
uauggcuuuuaacugucguaug

SEQ ID NO: 629329 - RNA, 18 nt, Human
auugcacaccagccuggg

SEQ ID NO: 629330 - RNA, 17 nt, Human
cagcugugagagccuua

SEQ ID NO: 629331 - RNA, 23 nt, Human
cccagggacacgaugacaccucc

SEQ ID NO: 629332 - RNA, 20 nt, Human
guuuuaugccaguucugugu

SEQ ID NO: 629333 - RNA, 22 nt, Human
uuucacauuuaggcgugaauug

SEQ ID NO: 629334 - RNA, 16 nt, Human
ccuggaggucacuuca

SEQ ID NO: 629335 - RNA, 22 nt, Human
augccugguaugaagcaaggaa

SEQ ID NO: 629336 - RNA, 21 nt, Human
ccaugucagaugugggcugug

SEQ ID NO: 629337 - RNA, 22 nt, Human
aacagaacccgagugugaaucu

SEQ ID NO: 629338 - RNA, 20 nt, Human
gugcuucagaagccauugcu

SEQ ID NO: 629339 - RNA, 22 nt, Human
ccucuuuguucaggcugcuggc

SEQ ID NO: 629340 - RNA, 22 nt, Human
acaaauuuguguaguuauggca

SEQ ID NO: 629341 - RNA, 22 nt, Human
ugccacugggcaugcagauguc

SEQ ID NO: 629342 - RNA, 22 nt, Human
acagacagacagagaacuauuc

SEQ ID NO: 629343 - RNA, 22 nt, Human
uuauugaaauggaagcuauaac

SEQ ID NO: 629344 - RNA, 23 nt, Human
uagugauuggaaaaacuaguuuu

SEQ ID NO: 629345 - RNA, 22 nt, Human
uccugagcaacacagcuaagug

SEQ ID NO: 629346 - RNA, 23 nt, Human
ugcaagaguuccaaacuguucaa

SEQ ID NO: 629347 - RNA, 22 nt, Human
uccugugggcucucggccucca

SEQ ID NO: 629348 - RNA, 22 nt, Human
ucuuaagcagagaagaaguuga

SEQ ID NO: 629349 - RNA, 22 nt, Human
aaagggccuccgccugggcagg

SEQ ID NO: 629350 - RNA, 19 nt, Human
cccuggggguuucugguac

SEQ ID NO: 629351 - RNA, 22 nt, Human
cuucuugugcacucucuaugua

SEQ ID NO: 629352 - RNA, 22 nt, Human
ucucuguauucugauauucacu

SEQ ID NO: 629353 - RNA, 22 nt, Human
uccuuuggacacauuuuuuaua

SEQ ID NO: 629354 - RNA, 22 nt, Human
gaagguuuucaggagccuaguc

SEQ ID NO: 629355 - RNA, 19 nt, Human
gaaugcagaagagagugga

SEQ ID NO: 629356 - RNA, 22 nt, Human
gaucuagaccagaagcuguugu

SEQ ID NO: 629357 - RNA, 22 nt, Human
gcacagccuugcccugugcccu

SEQ ID NO: 629358 - RNA, 22 nt, Human
uucagggacuuugauguaucag

SEQ ID NO: 629359 - RNA, 22 nt, Human
acaaggagaagaaauuggucau

SEQ ID NO: 629360 - RNA, 22 nt, Human
uagcagaggguagugccggggc

SEQ ID NO: 629361 - RNA, 22 nt, Human
acagauuuugguauuugcaaug

SEQ ID NO: 629362 - RNA, 22 nt, Human
caggaagagguaucaccgagca

SEQ ID NO: 629363 - RNA, 21 nt, Human
auuacaucccuggugauacau

SEQ ID NO: 629364 - RNA, 22 nt, Human
gugucauggaaaauugcaaugg

SEQ ID NO: 629365 - RNA, 22 nt, Human
agcugugugguuugggcaaauu

SEQ ID NO: 629366 - RNA, 22 nt, Human
ccagguggacaaggcuuucaca

SEQ ID NO: 629367 - RNA, 22 nt, Human
gcugcccaauuacagggccgug

SEQ ID NO: 629368 - RNA, 22 nt, Human
aauggcuucuuuuugguauaau

SEQ ID NO: 629369 - RNA, 20 nt, Human
gguagcugcugcaguuggua

SEQ ID NO: 629370 - RNA, 22 nt, Human
gagugcguguuuggggaugugg

SEQ ID NO: 629371 - RNA, 22 nt, Human
agguuagugcugaaaugacaug

SEQ ID NO: 629372 - RNA, 22 nt, Human
ugcugaaguccaucuguuugac

SEQ ID NO: 629373 - RNA, 22 nt, Human
uagcuguuuugccauaagcgcu

SEQ ID NO: 629374 - RNA, 22 nt, Human
acagugugugggaaaugugacu

SEQ ID NO: 629375 - RNA, 22 nt, Human
aguacaaauuauagcgcuugga

SEQ ID NO: 629376 - RNA, 22 nt, Human
uaauuguacucccugugggaaa

SEQ ID NO: 629377 - RNA, 23 nt, Human
agacacauaggagcagcuauugg

SEQ ID NO: 629378 - RNA, 22 nt, Human
uuuauaauuaucucuacucuua

SEQ ID NO: 629379 - RNA, 22 nt, Human
agauacaguguuacauuuuuau

SEQ ID NO: 629380 - RNA, 22 nt, Human
ucuccccagggguauggguauu

SEQ ID NO: 629381 - RNA, 22 nt, Human
acuugaaaccuuggcaaacaau

SEQ ID NO: 629382 - RNA, 21 nt, Human
gguuacaacaguuaaacagag

SEQ ID NO: 629383 - RNA, 19 nt, Human
cuccuggcucugucauuuu

SEQ ID NO: 629384 - RNA, 22 nt, Human
acugagguuuuuaguguuaaau

SEQ ID NO: 629385 - RNA, 22 nt, Human
auucugcagguggaggauggca

SEQ ID NO: 629386 - RNA, 22 nt, Human
aggcuggcccuacuggcugccu

SEQ ID NO: 629387 - RNA, 22 nt, Human
gcugggcuucaccuccagaguu

SEQ ID NO: 629388 - RNA, 23 nt, Human
uuucauaugguguggaugaagaa

SEQ ID NO: 629389 - RNA, 22 nt, Human
aggaagaaaugugacuucaaac

SEQ ID NO: 629390 - RNA, 22 nt, Human
ggucaaagugaggagucagguu

SEQ ID NO: 629391 - RNA, 22 nt, Human
uauacacaaacaagggguuaag

SEQ ID NO: 629392 - RNA, 22 nt, Human
auacugauuaguugagaaagca

SEQ ID NO: 629393 - RNA, 22 nt, Human
uucacuuauuucuugaguagca

SEQ ID NO: 629394 - RNA, 22 nt, Human
agcuggugaggguugaggggua

SEQ ID NO: 629395 - RNA, 22 nt, Human
aggccaggacacuuaaguaaga

SEQ ID NO: 629396 - RNA, 19 nt, Human
ugaaggagggggauggcca

SEQ ID NO: 629397 - RNA, 22 nt, Human
uggugccaagcaugaggacucu

SEQ ID NO: 629398 - RNA, 22 nt, Human
uucauauuaugauuugaaaugc

SEQ ID NO: 629399 - RNA, 22 nt, Human
uucuccagccuauuggccuauc

SEQ ID NO: 629400 - RNA, 21 nt, Human
aguccccuguccuuacuucua

SEQ ID NO: 629401 - RNA, 22 nt, Human
uagauuuuaggagauuuuacug

SEQ ID NO: 629402 - RNA, 22 nt, Human
uucucugaagguuguggaacua

SEQ ID NO: 629403 - RNA, 22 nt, Human
caugcauguuuacuacagugac

SEQ ID NO: 629404 - RNA, 22 nt, Human
uuuaaacauaucuguugaggga

SEQ ID NO: 629405 - RNA, 22 nt, Human
ggaaggagcauuugccaguuua

SEQ ID NO: 629406 - RNA, 22 nt, Human
uggcuuugaaauccagucauua

SEQ ID NO: 629407 - RNA, 22 nt, Human
guggucagguuaucagaucaua

SEQ ID NO: 629408 - RNA, 22 nt, Human
uuuaauuuguauuucuagaggg

SEQ ID NO: 629409 - RNA, 22 nt, Human
auugcagggaggcagguagaug

SEQ ID NO: 629410 - RNA, 22 nt, Human
uagcaauagaaacauauaaagu

SEQ ID NO: 629411 - RNA, 22 nt, Human
auguguuuguaccuuuaaauau

SEQ ID NO: 629412 - RNA, 22 nt, Human
gggcagugauuuuccuuagagg

SEQ ID NO: 629413 - RNA, 22 nt, Human
cugaggugcuauggaggauacg

SEQ ID NO: 629414 - RNA, 22 nt, Human
uuauuuccugacacagcugauu

SEQ ID NO: 629415 - RNA, 22 nt, Human
ggcaggcuccagagcccucucc

SEQ ID NO: 629416 - RNA, 22 nt, Human
aaaguguggcacaagucacauc

SEQ ID NO: 629417 - RNA, 22 nt, Human
uuuguucaugccuauauucuca

SEQ ID NO: 629418 - RNA, 22 nt, Human
uucauugucucuguuugccuuc

SEQ ID NO: 629419 - RNA, 22 nt, Human
ccaggguuuaaauucugacuau

SEQ ID NO: 629420 - RNA, 22 nt, Human
uuauguguauaauuacaggaag

SEQ ID NO: 629421 - RNA, 23 nt, Human
uauguauguauguuuguauggaa

SEQ ID NO: 629422 - RNA, 22 nt, Human
gagggcagaaaauuaugcggug

SEQ ID NO: 629423 - RNA, 22 nt, Human
agguagaagagcaaggaauaac

SEQ ID NO: 629424 - RNA, 22 nt, Human
cauaauuagucauguuaugcau

SEQ ID NO: 629425 - RNA, 22 nt, Human
gggagcugaugauguaaguccc

SEQ ID NO: 629426 - RNA, 22 nt, Human
ucaaaggcauugccaauaagua

SEQ ID NO: 629427 - RNA, 22 nt, Human
ggccucaggguugggcccauua

SEQ ID NO: 629428 - RNA, 17 nt, Human
aggaggaucagagagua

SEQ ID NO: 629429 - RNA, 22 nt, Human
cuccuggagcagcaggcgcagg

SEQ ID NO: 629430 - RNA, 22 nt, Human
aacagaauugcugcugccaaug

SEQ ID NO: 629431 - RNA, 22 nt, Human
gggcuggaugggagccuuggcc

SEQ ID NO: 629432 - RNA, 22 nt, Human
cagcuggucaacugaaugaaca

SEQ ID NO: 629433 - RNA, 22 nt, Human
uaacacauaagcugagaccaug

SEQ ID NO: 629434 - RNA, 22 nt, Human
ugaagugaccuggggcagugua

SEQ ID NO: 629435 - RNA, 22 nt, Human
uucaagaaagaguggcuauucc

SEQ ID NO: 629436 - RNA, 22 nt, Human
ggagcccaagucugcacucggc

SEQ ID NO: 629437 - RNA, 22 nt, Human
aagugauuuguacaaaaugucg

SEQ ID NO: 629438 - RNA, 22 nt, Human
uuugcuuucccuuguagaaagu

SEQ ID NO: 629439 - RNA, 22 nt, Human
aacaucucagaagugacccuga

SEQ ID NO: 629440 - RNA, 22 nt, Human
auccaguucucagugcuuacag

SEQ ID NO: 629441 - RNA, 19 nt, Human
aggcaugggaagagaaguc

SEQ ID NO: 629442 - RNA, 22 nt, Human
uaauuuugcugugaccauugaa

SEQ ID NO: 629443 - RNA, 22 nt, Human
gcugagcucccagcaguaucug

SEQ ID NO: 629444 - RNA, 22 nt, Human
ggcugaggguauagcuguccca

SEQ ID NO: 629445 - RNA, 22 nt, Human
uaggaaauuugaaauauguggg

SEQ ID NO: 629446 - RNA, 22 nt, Human
agcagaggaggauuuaguuagg

SEQ ID NO: 629447 - RNA, 22 nt, Human
gagugggcuuggggagaguuug

SEQ ID NO: 629448 - RNA, 22 nt, Human
uuuaugacuucuaaucugaagc

SEQ ID NO: 629449 - RNA, 22 nt, Human
uucaagauggcaccagugagug

SEQ ID NO: 629450 - RNA, 22 nt, Human
cccaaaggaaggacaaggcaga

SEQ ID NO: 629451 - RNA, 22 nt, Human
gcucccaccuccagccugaguu

SEQ ID NO: 629452 - RNA, 22 nt, Human
cuuggcacuugggcagugagca

SEQ ID NO: 629453 - RNA, 22 nt, Human
uucaguuucuaaaugcuccucu

SEQ ID NO: 629454 - RNA, 22 nt, Human
aagcagagcaagcguauuuauu

SEQ ID NO: 629455 - RNA, 22 nt, Human
aaaugucuacuucccaucugua

SEQ ID NO: 629456 - RNA, 22 nt, Human
aaaugcuugcaacaucccaggu

SEQ ID NO: 629457 - RNA, 22 nt, Human
cuuaagaauauugaaguugugg

SEQ ID NO: 629458 - RNA, 22 nt, Human
ugacaggaguggcuagugggag

SEQ ID NO: 629459 - RNA, 22 nt, Human
acccagagccagggucaggagc

SEQ ID NO: 629460 - RNA, 22 nt, Human
uggcacuguagccacuacugcc

SEQ ID NO: 629461 - RNA, 22 nt, Human
agauuacagaagaauaaguaga

SEQ ID NO: 629462 - RNA, 22 nt, Human
gggccacaggccuugcccgcag

SEQ ID NO: 629463 - RNA, 22 nt, Human
agggccaguaccaggugggugg

SEQ ID NO: 629464 - RNA, 22 nt, Human
gguggccucagcaaggcuggca

SEQ ID NO: 629465 - RNA, 22 nt, Human
gagcagcugcagugcagacccu

SEQ ID NO: 629466 - RNA, 22 nt, Human
uucagcacccucugaggcaucc

SEQ ID NO: 629467 - RNA, 22 nt, Human
aucuggaauuaagagaaaguga

SEQ ID NO: 629468 - RNA, 23 nt, Human
acugccugcuacuaugcccacgg

SEQ ID NO: 629469 - RNA, 22 nt, Human
ugucugaauuuuggaaucaagu

SEQ ID NO: 629470 - RNA, 22 nt, Human
ucuucaugccaaaugaguuuug

SEQ ID NO: 629471 - RNA, 21 nt, Human
ucaggcaggcgcagagggaag

SEQ ID NO: 629472 - RNA, 22 nt, Human
uuuguucuaacuucugcagaca

SEQ ID NO: 629473 - RNA, 21 nt, Human
cucugcagcccugcuuccagg

SEQ ID NO: 629474 - RNA, 19 nt, Human
agcaccugugagagccugg

SEQ ID NO: 629475 - RNA, 22 nt, Human
uggcauguauacuugaguagga

SEQ ID NO: 629476 - RNA, 22 nt, Human
auuucccacucuacuacaugcu

SEQ ID NO: 629477 - RNA, 22 nt, Human
gcugcuggcgcugggcguccgg

SEQ ID NO: 629478 - RNA, 19 nt, Human
ccagguggaacugagguag

SEQ ID NO: 629479 - RNA, 22 nt, Human
augaggauaccgcagggggcag

SEQ ID NO: 629480 - RNA, 22 nt, Human
uugaauuuagauuguauguuga

SEQ ID NO: 629481 - RNA, 22 nt, Human
uuacaugguuguuggaaaugcu

SEQ ID NO: 629482 - RNA, 22 nt, Human
gcauggcuguugaagucagcuc

SEQ ID NO: 629483 - RNA, 22 nt, Human
uggggcugaggagccucacucu

SEQ ID NO: 629484 - RNA, 22 nt, Human
gaaucuuuugucucgugaauaa

SEQ ID NO: 629485 - RNA, 21 nt, Human
ucuuucugaaaucucagucug

SEQ ID NO: 629486 - RNA, 22 nt, Human
uuccuuagauccuucaaucacg

SEQ ID NO: 629487 - RNA, 21 nt, Human
agcuccaggcuccugggguuc

SEQ ID NO: 629488 - RNA, 22 nt, Human
aauugcaauuuucuuaaggucu

SEQ ID NO: 629489 - RNA, 22 nt, Human
gugguccugcacccgcuuggcc

SEQ ID NO: 629490 - RNA, 18 nt, Human
gucaccuggaucagauua

SEQ ID NO: 629491 - RNA, 22 nt, Human
ugugcauguucucauuucuaac

SEQ ID NO: 629492 - RNA, 22 nt, Human
cugaaucaugccauuuugcuua

SEQ ID NO: 629493 - RNA, 22 nt, Human
uguuugcauuguuaauucaguc

SEQ ID NO: 629494 - RNA, 22 nt, Human
aguaagcaccgggauggucaag

SEQ ID NO: 629495 - RNA, 22 nt, Human
acauucaugucccacuucuagc

SEQ ID NO: 629496 - RNA, 22 nt, Human
uauaaaguuggggcugaaguaa

SEQ ID NO: 629497 - RNA, 22 nt, Human
ugcugucaguuggcaggaugag

SEQ ID NO: 629498 - RNA, 22 nt, Human
uggaagagggagcuggguggcc

SEQ ID NO: 629499 - RNA, 22 nt, Human
cucuuuuucaccucugucagcg

SEQ ID NO: 629500 - RNA, 22 nt, Human
ccagaagucaaugcagauguga

SEQ ID NO: 629501 - RNA, 22 nt, Human
ucugucugagugguguuagagu

SEQ ID NO: 629502 - RNA, 22 nt, Human
gaacuuuaaaacaaaguacagu

SEQ ID NO: 629503 - RNA, 22 nt, Human
uuuagacacacuuuguauauuu

SEQ ID NO: 629504 - RNA, 22 nt, Human
aaagcacauuacaagcucaguc

SEQ ID NO: 629505 - RNA, 21 nt, Human
caggucuggugaacacucuca

SEQ ID NO: 629506 - RNA, 22 nt, Human
cuggccuuucgugagagcuggg

SEQ ID NO: 629507 - RNA, 22 nt, Human
gcuggggaccagcugucucuga

SEQ ID NO: 629508 - RNA, 22 nt, Human
gcaaggcugcccacuucaaaag

SEQ ID NO: 629509 - RNA, 21 nt, Human
cacauuugaaccucacagcaa

SEQ ID NO: 629510 - RNA, 22 nt, Human
agagugaaguaauuguuaggau

SEQ ID NO: 629511 - RNA, 22 nt, Human
auauuuacugcuguggugaagg

SEQ ID NO: 629512 - RNA, 22 nt, Human
agcuuuuauuggcugucauuug

SEQ ID NO: 629513 - RNA, 22 nt, Human
ucaaauuaguggaauaauaaug

SEQ ID NO: 629514 - RNA, 22 nt, Human
aggcugaggcggguagaucacc

SEQ ID NO: 629515 - RNA, 22 nt, Human
ucucuggggguagaacucaggc

SEQ ID NO: 629516 - RNA, 22 nt, Human
cauggccacaugauaaucaagu

SEQ ID NO: 629517 - RNA, 22 nt, Human
ggguuggggcccagcagucugc

SEQ ID NO: 629518 - RNA, 22 nt, Human
agcacacagucuuccuuccucc

SEQ ID NO: 629519 - RNA, 18 nt, Human
ugaucuuucaugauucca

SEQ ID NO: 629520 - RNA, 22 nt, Human
augagugugaaguuagcucagu

SEQ ID NO: 629521 - RNA, 22 nt, Human
aaaggagacagucuuaccugga

SEQ ID NO: 629522 - RNA, 22 nt, Human
ugucuucacaugauaagccauu

SEQ ID NO: 629523 - RNA, 22 nt, Human
ccagauagggaugagagugcua

SEQ ID NO: 629524 - RNA, 22 nt, Human
aaauggucacuggugaguguca

SEQ ID NO: 629525 - RNA, 22 nt, Human
ugaguagauccaagacuguccu

SEQ ID NO: 629526 - RNA, 22 nt, Human
cugcagagguugguucuaagau

SEQ ID NO: 629527 - RNA, 19 nt, Human
agggcgugguggcacaugu

SEQ ID NO: 629528 - RNA, 22 nt, Human
aagcuuuucucaguguccuugg

SEQ ID NO: 629529 - RNA, 22 nt, Human
aauuagggaaguauuuaguagu

SEQ ID NO: 629530 - RNA, 22 nt, Human
aaaaugaugcuguaauuuggca

SEQ ID NO: 629531 - RNA, 22 nt, Human
uagacauuugucaagaaugacu

SEQ ID NO: 629532 - RNA, 22 nt, Human
uaguacuuaucucugucauugu

SEQ ID NO: 629533 - RNA, 22 nt, Human
uuggcagcauuccagccaagca

SEQ ID NO: 629534 - RNA, 22 nt, Human
aggaagagguagcugucaaggg

SEQ ID NO: 629535 - RNA, 22 nt, Human
cuccagguagcuaaguccuggg

SEQ ID NO: 629536 - RNA, 22 nt, Human
agucuggaaaaugcauguuuca

SEQ ID NO: 629537 - RNA, 22 nt, Human
auccccacgauauagccaaagc

SEQ ID NO: 629538 - RNA, 22 nt, Human
ccuguggcucucuuuggagguc

SEQ ID NO: 629539 - RNA, 22 nt, Human
ggcuugucauguugauguucuu

SEQ ID NO: 629540 - RNA, 22 nt, Human
gaacagcugcuagagaucugug

SEQ ID NO: 629541 - RNA, 20 nt, Human
ucucaggguucagcaaagua

SEQ ID NO: 629542 - RNA, 22 nt, Human
guuauauuggcagaagagaaga

SEQ ID NO: 629543 - RNA, 22 nt, Human
caggauggcagagaaaagggug

SEQ ID NO: 629544 - RNA, 22 nt, Human
ucuaaacuaggguuaaaggaaa

SEQ ID NO: 629545 - RNA, 22 nt, Human
uguggggaucuucuagcuuuuc

SEQ ID NO: 629546 - RNA, 22 nt, Human
ugagaggguucccagggguuuc

SEQ ID NO: 629547 - RNA, 19 nt, Human
guggccugcgcugggugcg

SEQ ID NO: 629548 - RNA, 22 nt, Human
gugggcaggcccuaggcgauuu

SEQ ID NO: 629549 - RNA, 22 nt, Human
caguucccuaauguguagaaga

SEQ ID NO: 629550 - RNA, 19 nt, Human
auucucccuagaauuuuga

SEQ ID NO: 629551 - RNA, 22 nt, Human
agggagagguugaaaccucagu

SEQ ID NO: 629552 - RNA, 22 nt, Human
cgagaguggacagggcgcagcu

SEQ ID NO: 629553 - RNA, 22 nt, Human
uuggcaaaauuuaaagaaguga

SEQ ID NO: 629554 - RNA, 22 nt, Human
cagacagguagggacagaacau

SEQ ID NO: 629555 - RNA, 22 nt, Human
cccguuuaauuacucgagcugu

SEQ ID NO: 629556 - RNA, 22 nt, Human
aggagagcaggccagccguccc

SEQ ID NO: 629557 - RNA, 22 nt, Human
uugcaggauuuuagagaugaca

SEQ ID NO: 629558 - RNA, 22 nt, Human
uccuggcaggucugagaggucu

SEQ ID NO: 629559 - RNA, 22 nt, Human
ugaacuccaaauacugcugauu

SEQ ID NO: 629560 - RNA, 22 nt, Human
augaaugagaaacaggugagau

SEQ ID NO: 629561 - RNA, 22 nt, Human
caggauaacagaaaauagcuga

SEQ ID NO: 629562 - RNA, 22 nt, Human
cuguggcuuugcagggcuuguu

SEQ ID NO: 629563 - RNA, 22 nt, Human
cuccagugcuucuagaaaauac

SEQ ID NO: 629564 - RNA, 22 nt, Human
cugucccucaguucugggcaaa

SEQ ID NO: 629565 - RNA, 22 nt, Human
uuggcugugagggguugcacag

SEQ ID NO: 629566 - RNA, 22 nt, Human
uuugaugcuaagauuuaauaaa

SEQ ID NO: 629567 - RNA, 22 nt, Human
caucuucugggacuucucaguu

SEQ ID NO: 629568 - RNA, 22 nt, Human
uaucacccuacauaagaaauaa

SEQ ID NO: 629569 - RNA, 22 nt, Human
cagacacuaugcuaagguacua

SEQ ID NO: 629570 - RNA, 22 nt, Human
ucacacaucucagguguuuaau

SEQ ID NO: 629571 - RNA, 22 nt, Human
aaaguucauugaugacugaggu

SEQ ID NO: 629572 - RNA, 22 nt, Human
cagugcuuugggaggcugagga

SEQ ID NO: 629573 - RNA, 22 nt, Human
guguucaucccaaugcugauag

SEQ ID NO: 629574 - RNA, 22 nt, Human
ccuuccaggagucucugcaggu

SEQ ID NO: 629575 - RNA, 22 nt, Human
ggccacauguggcugcucguau

SEQ ID NO: 629576 - RNA, 21 nt, Human
ucuuguccuugcucucccacu

SEQ ID NO: 629577 - RNA, 22 nt, Human
uucugggagagaaagggccuug

SEQ ID NO: 629578 - RNA, 23 nt, Human
ugcuggcuguguuauugccaaca

SEQ ID NO: 629579 - RNA, 22 nt, Human
ucugaaaugaacucuugaacuu

SEQ ID NO: 629580 - RNA, 22 nt, Human
uagcaaaggaugacuauguacc

SEQ ID NO: 629581 - RNA, 21 nt, Human
aggugcagagccagggaccag

SEQ ID NO: 629582 - RNA, 22 nt, Human
ccagggcauccucacaucgcag

SEQ ID NO: 629583 - RNA, 22 nt, Human
uaacacagugucuaccauuauu

SEQ ID NO: 629584 - RNA, 22 nt, Human
gccagguggagguugcagugag

SEQ ID NO: 629585 - RNA, 22 nt, Human
cucuguccugguuuauacuggc

SEQ ID NO: 629586 - RNA, 22 nt, Human
aggaggguuucaaugggaugag

SEQ ID NO: 629587 - RNA, 22 nt, Human
ggcuuuaaacacugaaauugca

SEQ ID NO: 629588 - RNA, 22 nt, Human
ugucagaacucuauugaugucc

SEQ ID NO: 629589 - RNA, 21 nt, Human
ggagauggguaucgccugggc

SEQ ID NO: 629590 - RNA, 22 nt, Human
uugcagggucccagaggccugg

SEQ ID NO: 629591 - RNA, 22 nt, Human
agggcugacacaccuuauccuc

SEQ ID NO: 629592 - RNA, 22 nt, Human
caaauacucuggauguguuugu

SEQ ID NO: 629593 - RNA, 19 nt, Human
uggcagggagaguuugaag

SEQ ID NO: 629594 - RNA, 22 nt, Human
cuggccagggugcgaucguggu

SEQ ID NO: 629595 - RNA, 17 nt, Human
cagagucugucugcauc

SEQ ID NO: 629596 - RNA, 22 nt, Human
gucuucaauugcauuugauggg

SEQ ID NO: 629597 - RNA, 22 nt, Human
ugagguggcuggaucucagccu

SEQ ID NO: 629598 - RNA, 22 nt, Human
gagagcugggaaagccguggag

SEQ ID NO: 629599 - RNA, 22 nt, Human
uuugaagauaaauauggagaaa

SEQ ID NO: 629600 - RNA, 22 nt, Human
ccccagagagcaccaugaagcc

SEQ ID NO: 629601 - RNA, 22 nt, Human
aacaguuauuaucacauuagug

SEQ ID NO: 629602 - RNA, 22 nt, Human
ugcaucuuucugcauauguaaa

SEQ ID NO: 629603 - RNA, 22 nt, Human
acaguguauauuguuuaucugg

SEQ ID NO: 629604 - RNA, 22 nt, Human
agguucaaauuguugcaguuuc

SEQ ID NO: 629605 - RNA, 22 nt, Human
gccagcugaauuuccaacuguu

SEQ ID NO: 629606 - RNA, 22 nt, Human
aacagacaacuccuguggcuca

SEQ ID NO: 629607 - RNA, 22 nt, Human
aggaaugucgucauaaacauga

SEQ ID NO: 629608 - RNA, 22 nt, Human
accagcuggucaguugaagauu

SEQ ID NO: 629609 - RNA, 22 nt, Human
caugaaacuuccaaagcugacc

SEQ ID NO: 629610 - RNA, 22 nt, Human
cagaagugcaauuuaaauuagg

SEQ ID NO: 629611 - RNA, 22 nt, Human
aaauguauugcauaggauauuu

SEQ ID NO: 629612 - RNA, 22 nt, Human
agaaggguucaggaauauguua

SEQ ID NO: 629613 - RNA, 22 nt, Human
caaacuuacuguguuuaaagag

SEQ ID NO: 629614 - RNA, 22 nt, Human
ggggcagcucccgagggcagga

SEQ ID NO: 629615 - RNA, 22 nt, Human
uuauugcagauggugugagaga

SEQ ID NO: 629616 - RNA, 22 nt, Human
guccuuggagguguggaaucug

SEQ ID NO: 629617 - RNA, 22 nt, Human
acuuuguaaauuguugugacuc

SEQ ID NO: 629618 - RNA, 18 nt, Human
cugugggaagaguuuggg

SEQ ID NO: 629619 - RNA, 22 nt, Human
uuagaaacuuuggaggauagau

SEQ ID NO: 629620 - RNA, 22 nt, Human
cacuucaagagcaagggugcca

SEQ ID NO: 629621 - RNA, 22 nt, Human
agcagaguuucucaacaucagc

SEQ ID NO: 629622 - RNA, 22 nt, Human
auuugcuggugaauguauagcu

SEQ ID NO: 629623 - RNA, 22 nt, Human
uuauucaccucuauuagacuca

SEQ ID NO: 629624 - RNA, 22 nt, Human
gcagacuguaucaaugucagua

SEQ ID NO: 629625 - RNA, 22 nt, Human
uuuguguuggaagaaaugcuac

SEQ ID NO: 629626 - RNA, 22 nt, Human
ccuggagcuuuuccaguugaca

SEQ ID NO: 629627 - RNA, 22 nt, Human
gagcugccagacaugggaauga

SEQ ID NO: 629628 - RNA, 22 nt, Human
uggcaggaaccaggaggcucuc

SEQ ID NO: 629629 - RNA, 22 nt, Human
augcgagugaugcagaguggcu

SEQ ID NO: 629630 - RNA, 22 nt, Human
uggacaugaccucgagcgagau

SEQ ID NO: 629631 - RNA, 22 nt, Human
guuauuguuuauccugcacccc

SEQ ID NO: 629632 - RNA, 22 nt, Human
ggcuggaaaagacaaagcuauu

SEQ ID NO: 629633 - RNA, 18 nt, Human
cugugacuccuagaucuc

SEQ ID NO: 629634 - RNA, 22 nt, Human
ccaggcucagcuauuaagaaac

SEQ ID NO: 629635 - RNA, 22 nt, Human
agagaauuggagcagugacagg

SEQ ID NO: 629636 - RNA, 22 nt, Human
uggaggcauaggccugggcccu

SEQ ID NO: 629637 - RNA, 22 nt, Human
uagcuaucuguguccagaucca

SEQ ID NO: 629638 - RNA, 22 nt, Human
gggagggucugccaugcucccu

SEQ ID NO: 629639 - RNA, 22 nt, Human
agaaacuucagcuauucuuuug

SEQ ID NO: 629640 - RNA, 22 nt, Human
ccacuugacauuuucauuaaga

SEQ ID NO: 629641 - RNA, 22 nt, Human
uccaggaccugacugggccugc

SEQ ID NO: 629642 - RNA, 22 nt, Human
auauuuggaaagaaaaucauug

SEQ ID NO: 629643 - RNA, 22 nt, Human
ucugacuuauuuguccuuggug

SEQ ID NO: 629644 - RNA, 22 nt, Human
ggcugagaaucaacaaccugcu

SEQ ID NO: 629645 - RNA, 22 nt, Human
caguguuuccgucaguauguga

SEQ ID NO: 629646 - RNA, 22 nt, Human
cagaauaaaaacuccuaugucu

SEQ ID NO: 629647 - RNA, 22 nt, Human
aaguuccugagcucauauagca

SEQ ID NO: 629648 - RNA, 22 nt, Human
aucugggggagcugcucaugga

SEQ ID NO: 629649 - RNA, 22 nt, Human
gcucccugcagcugagaguucc

SEQ ID NO: 629650 - RNA, 22 nt, Human
aaacaccagucccaguauacac

SEQ ID NO: 629651 - RNA, 22 nt, Human
ccucuggggucuagcaauagca

SEQ ID NO: 629652 - RNA, 22 nt, Human
aaacuugacagugagacaguuu

SEQ ID NO: 629653 - RNA, 20 nt, Human
uccagcuguugagaucugag

SEQ ID NO: 629654 - RNA, 22 nt, Human
gugcaguugaagcauggggaga

SEQ ID NO: 629655 - RNA, 22 nt, Human
aacuaguaaaagcaacaguaua

SEQ ID NO: 629656 - RNA, 20 nt, Human
uggcccuguuuucuccaggc

SEQ ID NO: 629657 - RNA, 22 nt, Human
gcuuccagccuuuucuccucug

SEQ ID NO: 629658 - RNA, 22 nt, Human
caauaagauguauugagcagag

SEQ ID NO: 629659 - RNA, 23 nt, Human
cagcugaagcagccugggcugga

SEQ ID NO: 629660 - RNA, 22 nt, Human
uccagcucacagauagcguggg

SEQ ID NO: 629661 - RNA, 22 nt, Human
gugcauauguaccugugaucau

SEQ ID NO: 629662 - RNA, 22 nt, Human
ggcuagaacuuuacacuuugca

SEQ ID NO: 629663 - RNA, 22 nt, Human
ugcagauggggaucaguggcuc

SEQ ID NO: 629664 - RNA, 22 nt, Human
ucucuuaacugguucagcaauu

SEQ ID NO: 629665 - RNA, 22 nt, Human
uccagcccugcacugauuagau

SEQ ID NO: 629666 - RNA, 22 nt, Human
cucuggcuauggcacggcgcuc

SEQ ID NO: 629667 - RNA, 22 nt, Human
aagcugccauagaacgagaggu

SEQ ID NO: 629668 - RNA, 22 nt, Human
agcauucaaugauuggacuugc

SEQ ID NO: 629669 - RNA, 22 nt, Human
uagcugcccaucuuuccuuuag

SEQ ID NO: 629670 - RNA, 22 nt, Human
uaacaauacccauucuaauuac

SEQ ID NO: 629671 - RNA, 22 nt, Human
caguugcuggaugugcagcucu

SEQ ID NO: 629672 - RNA, 22 nt, Human
ucuacuguagugaugcugcagu

SEQ ID NO: 629673 - RNA, 22 nt, Human
uagugucucuuccuguuugaaa

SEQ ID NO: 629674 - RNA, 22 nt, Human
ugaggguggcacaggcacaaag

SEQ ID NO: 629675 - RNA, 22 nt, Human
ugagagccagaagggccugagg

SEQ ID NO: 629676 - RNA, 22 nt, Human
agcgugugugcgggucuucuuu

SEQ ID NO: 629677 - RNA, 22 nt, Human
cauggauagaugaaugcuuaaa

SEQ ID NO: 629678 - RNA, 19 nt, Human
ugccugucaguagaucuca

SEQ ID NO: 629679 - RNA, 22 nt, Human
auuauuuguguccacagaauac

SEQ ID NO: 629680 - RNA, 22 nt, Human
ucggagagcucacagcuguggc

SEQ ID NO: 629681 - RNA, 22 nt, Human
ucuguuggcuugagauuuaauu

SEQ ID NO: 629682 - RNA, 22 nt, Human
cagggagcagcaugggcaaagg

SEQ ID NO: 629683 - RNA, 21 nt, Human
agugugugauaggcaggaaga

SEQ ID NO: 629684 - RNA, 22 nt, Human
uagcacaguuccugacucuuug

SEQ ID NO: 629685 - RNA, 22 nt, Human
acaacaaucuacccuagcuucu

SEQ ID NO: 629686 - RNA, 22 nt, Human
ucugaggcccaguucaacucuu

SEQ ID NO: 629687 - RNA, 22 nt, Human
ccagggcaauaggaacacuuuu

SEQ ID NO: 629688 - RNA, 22 nt, Human
aaggaacuuugcagaggugauu

SEQ ID NO: 629689 - RNA, 22 nt, Human
cagugcuggaggcuggagggaa

SEQ ID NO: 629690 - RNA, 22 nt, Human
ucaguguuauuagaugagguuu

SEQ ID NO: 629691 - RNA, 22 nt, Human
gcucaaugcucaaugcugcaaa

SEQ ID NO: 629692 - RNA, 22 nt, Human
uacaagagaacuaauguaaguc

SEQ ID NO: 629693 - RNA, 22 nt, Human
gcugucacacaugggaucucag

SEQ ID NO: 629694 - RNA, 22 nt, Human
ucaguauccacaaaugcucaaa

SEQ ID NO: 629695 - RNA, 22 nt, Human
gggcuucaggagggucagccca

SEQ ID NO: 629696 - RNA, 22 nt, Human
auuuuuucuguaaacuggccuu

SEQ ID NO: 629697 - RNA, 22 nt, Human
cugugcuuagccaucacauuca

SEQ ID NO: 629698 - RNA, 22 nt, Human
cucuguugucaguggaagcagc

SEQ ID NO: 629699 - RNA, 22 nt, Human
ugaugaauaaacuugagaguca

SEQ ID NO: 629700 - RNA, 22 nt, Human
gggcacauguaaagcuggagaa

SEQ ID NO: 629701 - RNA, 22 nt, Human
agccaccucugugcaggccucg

SEQ ID NO: 629702 - RNA, 22 nt, Human
ucagcaguccuccaggaucaag

SEQ ID NO: 629703 - RNA, 19 nt, Human
ucaaguccuaggcccacaa

SEQ ID NO: 629704 - RNA, 22 nt, Human
agaagcugugguaugaaaugug

SEQ ID NO: 629705 - RNA, 22 nt, Human
cagguccccaggguaccuaccu

SEQ ID NO: 629706 - RNA, 22 nt, Human
ggguucuuauaguaucagagcu

SEQ ID NO: 629707 - RNA, 17 nt, Human
cccucuggggagggagg

SEQ ID NO: 629708 - RNA, 22 nt, Human
cuccaggaguggccuggacacc

SEQ ID NO: 629709 - RNA, 22 nt, Human
aucauccacuggagccggcagg

SEQ ID NO: 629710 - RNA, 22 nt, Human
auccacaggucauguaaugugg

SEQ ID NO: 629711 - RNA, 22 nt, Human
uccagagcaggugucuacacag

SEQ ID NO: 629712 - RNA, 22 nt, Human
ucugaggcugaauggacuccgu

SEQ ID NO: 629713 - RNA, 22 nt, Human
acuaaagaagccaaaguuuucu

SEQ ID NO: 629714 - RNA, 22 nt, Human
agcaaagcaccauauggcaguu

SEQ ID NO: 629715 - RNA, 22 nt, Human
gaaggcaagcagcauaaauguc

SEQ ID NO: 629716 - RNA, 22 nt, Human
cacuguaucuuuuccaaagucu

SEQ ID NO: 629717 - RNA, 18 nt, Human
uaggaaccacuugcagag

SEQ ID NO: 629718 - RNA, 22 nt, Human
uuaaauuauuucuagugaggug

SEQ ID NO: 629719 - RNA, 22 nt, Human
aacaguaaaaaucauuuaguug

SEQ ID NO: 629720 - RNA, 22 nt, Human
uacaugucuacaugcauuuuug

SEQ ID NO: 629721 - RNA, 22 nt, Human
cauuuagagaagauuacaagga

SEQ ID NO: 629722 - RNA, 22 nt, Human
augaaaguaccuguaauauguu

SEQ ID NO: 629723 - RNA, 16 nt, Human
ccaggaacacacagcu

SEQ ID NO: 629724 - RNA, 22 nt, Human
guggucauggaagguccuaccu

SEQ ID NO: 629725 - RNA, 22 nt, Human
cagaaauauuccaaguacugca

SEQ ID NO: 629726 - RNA, 22 nt, Human
auagugguuggauaugucagag

SEQ ID NO: 629727 - RNA, 22 nt, Human
ucucagagauuuauggaaaacu

SEQ ID NO: 629728 - RNA, 22 nt, Human
uaaggccaauuacauauguuca

SEQ ID NO: 629729 - RNA, 22 nt, Human
aggccuggugaaugaaguaucu

SEQ ID NO: 629730 - RNA, 22 nt, Human
auuuucagaacauucauucacu

SEQ ID NO: 629731 - RNA, 22 nt, Human
agggaacagugaaaggcaucag

SEQ ID NO: 629732 - RNA, 21 nt, Human
uuccuggggacuuccguggga

SEQ ID NO: 629733 - RNA, 22 nt, Human
guguacaguaagugaaucuagg

SEQ ID NO: 629734 - RNA, 22 nt, Human
acauuucugagcagggagcugu

SEQ ID NO: 629735 - RNA, 22 nt, Human
uuuaaccucuaauuuaguucuc

SEQ ID NO: 629736 - RNA, 22 nt, Human
cagggcuucuauaccaauucau

SEQ ID NO: 629737 - RNA, 22 nt, Human
gagcucuguguagccugagggu

SEQ ID NO: 629738 - RNA, 22 nt, Human
auagcaaagaugucaauucccc

SEQ ID NO: 629739 - RNA, 22 nt, Human
uggaaggggagcuggaaagggg

SEQ ID NO: 629740 - RNA, 22 nt, Human
gcuggcuggaacuagcaguugg

SEQ ID NO: 629741 - RNA, 22 nt, Human
cugagcugggacucaguagcaa

SEQ ID NO: 629742 - RNA, 22 nt, Human
uggagcugacucacaccagcua

SEQ ID NO: 629743 - RNA, 22 nt, Human
ugcacacaaaugugaacgugcc

SEQ ID NO: 629744 - RNA, 22 nt, Human
ggugcugacugaggauggcuug

SEQ ID NO: 629745 - RNA, 22 nt, Human
uggccaccuuauggcuauugga

SEQ ID NO: 629746 - RNA, 22 nt, Human
gaggcugguucccuugaucuuu

SEQ ID NO: 629747 - RNA, 22 nt, Human
uuuuucauugcagccucucucc

SEQ ID NO: 629748 - RNA, 22 nt, Human
gcaggguggauggcagggccag

SEQ ID NO: 629749 - RNA, 22 nt, Human
uuucugcucauccuaguggagc

SEQ ID NO: 629750 - RNA, 22 nt, Human
cagagauuuuuaugcacaccaa

SEQ ID NO: 629751 - RNA, 22 nt, Human
ccuucagccucaagauccuuca

SEQ ID NO: 629752 - RNA, 22 nt, Human
aaacagugacugguacauaaua

SEQ ID NO: 629753 - RNA, 22 nt, Human
gucccucugugucccugcaguc

SEQ ID NO: 629754 - RNA, 22 nt, Human
cuggcucauagagcagcuccaa

SEQ ID NO: 629755 - RNA, 22 nt, Human
gcuucucuggcuggucugccac

SEQ ID NO: 629756 - RNA, 22 nt, Human
gcucugggaauucagaaagccu

SEQ ID NO: 629757 - RNA, 22 nt, Human
gcuuagcaucuuacaaugcuga

SEQ ID NO: 629758 - RNA, 22 nt, Human
aaggaucuuucuuuuuaccauu

SEQ ID NO: 629759 - RNA, 22 nt, Human
caucuggcuagcuaucauugug

SEQ ID NO: 629760 - RNA, 22 nt, Human
ccagcagcugcaaagccugggu

SEQ ID NO: 629761 - RNA, 22 nt, Human
gagguggccaagcgaggaaggg

SEQ ID NO: 629762 - RNA, 22 nt, Human
gaggaacagcagccacaugucc

SEQ ID NO: 629763 - RNA, 22 nt, Human
auccucucugugacagggaacg

SEQ ID NO: 629764 - RNA, 22 nt, Human
uguagaaagcucuucugaaauc

SEQ ID NO: 629765 - RNA, 21 nt, Human
aaguaaaucagagaaauaacc

SEQ ID NO: 629766 - RNA, 19 nt, Human
gcagccaccgcggcggccg

SEQ ID NO: 629767 - RNA, 22 nt, Human
agaggagguccuuuucugaugu

SEQ ID NO: 629768 - RNA, 22 nt, Human
ccaggagcuggagggugcagug

SEQ ID NO: 629769 - RNA, 22 nt, Human
gccaguggagcacauggugaag

SEQ ID NO: 629770 - RNA, 22 nt, Human
aaaaaugcuuggacuuaauaaa

SEQ ID NO: 629771 - RNA, 22 nt, Human
aauguucagugccuuuaaacau

SEQ ID NO: 629772 - RNA, 20 nt, Human
aaauccaguguguauuuuac

SEQ ID NO: 629773 - RNA, 22 nt, Human
gcagggcagaaggugcugagga

SEQ ID NO: 629774 - RNA, 22 nt, Human
auuuauaacgugcagccagggu

SEQ ID NO: 629775 - RNA, 22 nt, Human
gagcuuaggccagggacaggga

SEQ ID NO: 629776 - RNA, 22 nt, Human
agcagugggggaguguuaguuu

SEQ ID NO: 629777 - RNA, 22 nt, Human
uacagaauguuaugaagcauag

SEQ ID NO: 629778 - RNA, 22 nt, Human
gcagaggccaucaacuuugcca

SEQ ID NO: 629779 - RNA, 22 nt, Human
ggccagcuccuuggcagugccu

SEQ ID NO: 629780 - RNA, 22 nt, Human
cugaagagaaagggagcucuuc

SEQ ID NO: 629781 - RNA, 22 nt, Human
uuccucuggggccaggccaaca

SEQ ID NO: 629782 - RNA, 22 nt, Human
uaggagcuaaaauauuuuauau

SEQ ID NO: 629783 - RNA, 22 nt, Human
uguccagcucgagacacuaucu

SEQ ID NO: 629784 - RNA, 20 nt, Human
ucaaaauaggugugggcgga

SEQ ID NO: 629785 - RNA, 18 nt, Human
auguacauguacucacac

SEQ ID NO: 629786 - RNA, 22 nt, Human
ugucauuaguuucagccauucu

SEQ ID NO: 629787 - RNA, 22 nt, Human
gaagcccuguaggugcaaaggu

SEQ ID NO: 629788 - RNA, 22 nt, Human
auguuucaaugcacuuuagccu

SEQ ID NO: 629789 - RNA, 22 nt, Human
ucuucaauuagauuuaccaauu

SEQ ID NO: 629790 - RNA, 22 nt, Human
uaaguucauaagcuuauucuua

SEQ ID NO: 629791 - RNA, 22 nt, Human
auugacaagaaagauauuuuua

SEQ ID NO: 629792 - RNA, 22 nt, Human
auguggccuuaaugacagcagc

SEQ ID NO: 629793 - RNA, 22 nt, Human
uuauaacuuuggauaugacaag

SEQ ID NO: 629794 - RNA, 22 nt, Human
cucugcuguuuuguauacaggc

SEQ ID NO: 629795 - RNA, 22 nt, Human
aagugaauuucauuccaauucu

SEQ ID NO: 629796 - RNA, 22 nt, Human
aguugaaagccuuauuucucug

SEQ ID NO: 629797 - RNA, 22 nt, Human
uggcuucucccucugccugauu

SEQ ID NO: 629798 - RNA, 22 nt, Human
ccaggagcaggagcugcagcug

SEQ ID NO: 629799 - RNA, 22 nt, Human
cuggagugaagcuuauuuuuca

SEQ ID NO: 629800 - RNA, 22 nt, Human
gcaccucauuuugcagguagaa

SEQ ID NO: 629801 - RNA, 23 nt, Human
agcacagacuagaaaggucuuuc

SEQ ID NO: 629802 - RNA, 22 nt, Human
gggcacuguggggcccaugcug

SEQ ID NO: 629803 - RNA, 22 nt, Human
agcacagagauuauuuacaaga

SEQ ID NO: 629804 - RNA, 22 nt, Human
uacacugucuuagaaaggggca

SEQ ID NO: 629805 - RNA, 22 nt, Human
gaaaauuuagaacugaacuucu

SEQ ID NO: 629806 - RNA, 17 nt, Human
ugcucaaauacuuuuga

SEQ ID NO: 629807 - RNA, 22 nt, Human
gcucagggagagagggcagccg

SEQ ID NO: 629808 - RNA, 22 nt, Human
guggcacaaggcuuacacagca

SEQ ID NO: 629809 - RNA, 22 nt, Human
ugcauuguuugauaggugaauu

SEQ ID NO: 629810 - RNA, 22 nt, Human
gcauggccuccagccaacagca

SEQ ID NO: 629811 - RNA, 22 nt, Human
aagcaggcccugggccagggga

SEQ ID NO: 629812 - RNA, 22 nt, Human
gcauaggccacuagugccagga

SEQ ID NO: 629813 - RNA, 22 nt, Human
caucacagaaauaaacauaccu

SEQ ID NO: 629814 - RNA, 22 nt, Human
agcuguguuaggauguuaauaa

SEQ ID NO: 629815 - RNA, 22 nt, Human
uggcaccugaacuuagaggugu

SEQ ID NO: 629816 - RNA, 22 nt, Human
ucagagcauucgggugacaaau

SEQ ID NO: 629817 - RNA, 22 nt, Human
cauugcacagcccuguggugau

SEQ ID NO: 629818 - RNA, 22 nt, Human
aagggcaggugggcauuucugg

SEQ ID NO: 629819 - RNA, 22 nt, Human
uaagguuuggcugucucuuggu

SEQ ID NO: 629820 - RNA, 22 nt, Human
aguccaagaccaaggugucacc

SEQ ID NO: 629821 - RNA, 22 nt, Human
uuucacagcagugugcugcuuu

SEQ ID NO: 629822 - RNA, 18 nt, Human
aguggucuguuauaucau

SEQ ID NO: 629823 - RNA, 18 nt, Human
uuuuacucauagcaggcc

SEQ ID NO: 629824 - RNA, 22 nt, Human
cauaggucacuguacagguuaa

SEQ ID NO: 629825 - RNA, 22 nt, Human
cuggcagauauuugcagacaug

SEQ ID NO: 629826 - RNA, 22 nt, Human
ccaauccucauguucaacaacc

SEQ ID NO: 629827 - RNA, 22 nt, Human
cagggaggcugucuuaugccug

SEQ ID NO: 629828 - RNA, 22 nt, Human
augaggcccaggaaucuguauu

SEQ ID NO: 629829 - RNA, 22 nt, Human
ucuucauguuaguuggguuuuc

SEQ ID NO: 629830 - RNA, 22 nt, Human
ccagagguggaagauuguuuug

SEQ ID NO: 629831 - RNA, 22 nt, Human
ugaacugcaggaaucucagugg

SEQ ID NO: 629832 - RNA, 19 nt, Human
ggccagccaccucgccugg

SEQ ID NO: 629833 - RNA, 22 nt, Human
ccucuuugacucucaggucuuu

SEQ ID NO: 629834 - RNA, 22 nt, Human
uguucuuagcaggagcaucuau

SEQ ID NO: 629835 - RNA, 22 nt, Human
uacaugucuacagccaugucug

SEQ ID NO: 629836 - RNA, 22 nt, Human
cagcugcacugaagcagguuug

SEQ ID NO: 629837 - RNA, 22 nt, Human
agggcccuuacgcaggcccuuc

SEQ ID NO: 629838 - RNA, 22 nt, Human
acaucagauuaugcuuugcuua

SEQ ID NO: 629839 - RNA, 22 nt, Human
ugccacacaauuacugcugcua

SEQ ID NO: 629840 - RNA, 22 nt, Human
acacuucucauuugauacuaac

SEQ ID NO: 629841 - RNA, 22 nt, Human
agaagcagaaacugggcuugug

SEQ ID NO: 629842 - RNA, 23 nt, Human
ucaucaaaggaaguacgugucac

SEQ ID NO: 629843 - RNA, 22 nt, Human
ccucacagggccaggccccuca

SEQ ID NO: 629844 - RNA, 22 nt, Human
caggagugcagguggugaggca

SEQ ID NO: 629845 - RNA, 22 nt, Human
agcacacaucacuucugcucau

SEQ ID NO: 629846 - RNA, 22 nt, Human
aucuggaauccuuguggacaau

SEQ ID NO: 629847 - RNA, 22 nt, Human
uaguucuacucaaagugugauc

SEQ ID NO: 629848 - RNA, 22 nt, Human
gagugcaguaucuucugugucc

SEQ ID NO: 629849 - RNA, 23 nt, Human
uuuaacauuugaacauguggcca

SEQ ID NO: 629850 - RNA, 18 nt, Human
ugcaaauggcuguuugau

SEQ ID NO: 629851 - RNA, 22 nt, Human
cagagagcuuagugugcugcau

SEQ ID NO: 629852 - RNA, 22 nt, Human
uuauaugaguaucauaucacuu

SEQ ID NO: 629853 - RNA, 22 nt, Human
ucccaggaaaacacucgaggac

SEQ ID NO: 629854 - RNA, 22 nt, Human
gcacugaaauuauaugcauuug

SEQ ID NO: 629855 - RNA, 22 nt, Human
aaugugcuccaauugucuacuu

SEQ ID NO: 629856 - RNA, 22 nt, Human
ggacucuguuuuccugaucacu

SEQ ID NO: 629857 - RNA, 22 nt, Human
agucugugugaaugugggcuuu

SEQ ID NO: 629858 - RNA, 22 nt, Human
ggcugucagggugagcuggcuu

SEQ ID NO: 629859 - RNA, 22 nt, Human
auauuugugguaaagguaagaa

SEQ ID NO: 629860 - RNA, 22 nt, Human
guuauuucagccacagagugca

SEQ ID NO: 629861 - RNA, 22 nt, Human
auagcaaugaucaagacagaca

SEQ ID NO: 629862 - RNA, 20 nt, Human
ccuccaggcacacccaugug

SEQ ID NO: 629863 - RNA, 22 nt, Human
uggcucuccagagccuauggua

SEQ ID NO: 629864 - RNA, 22 nt, Human
acauucaaaaagcaucugucac

SEQ ID NO: 629865 - RNA, 22 nt, Human
agcugaggccugauuucgccgu

SEQ ID NO: 629866 - RNA, 22 nt, Human
auuugcugugugcuuuagagac

SEQ ID NO: 629867 - RNA, 21 nt, Human
acaggauaggacaguguuccu

SEQ ID NO: 629868 - RNA, 21 nt, Human
uucagcaguccucuagagaua

SEQ ID NO: 629869 - RNA, 22 nt, Human
cugggagugaaaggagggcugc

SEQ ID NO: 629870 - RNA, 22 nt, Human
uuuauuaagaugcgaaugcuga

SEQ ID NO: 629871 - RNA, 22 nt, Human
agcagccaggaaucugcagagc

SEQ ID NO: 629872 - RNA, 23 nt, Human
cucagagguguuuuucacuuacu

SEQ ID NO: 629873 - RNA, 22 nt, Human
auugcuuuuagugaaauuauau

SEQ ID NO: 629874 - RNA, 19 nt, Human
uuuauucaccuuuaccuug

SEQ ID NO: 629875 - RNA, 22 nt, Human
uggcuggaaacaggagauucag

SEQ ID NO: 629876 - RNA, 22 nt, Human
agucuucuuuguguucucucau

SEQ ID NO: 629877 - RNA, 22 nt, Human
gcacaggcuguuggccuucaga

SEQ ID NO: 629878 - RNA, 19 nt, Human
ucagggaaguucaaagcuc

SEQ ID NO: 629879 - RNA, 22 nt, Human
cugugcugcagacgcaguagcu

SEQ ID NO: 629880 - RNA, 22 nt, Human
aaccucgaaugccuuccugagg

SEQ ID NO: 629881 - RNA, 22 nt, Human
cuugaauguaaauaauguacag

SEQ ID NO: 629882 - RNA, 20 nt, Human
ugaaggccagcagcauaggg

SEQ ID NO: 629883 - RNA, 20 nt, Human
ucugagaagcaaacaauguu

SEQ ID NO: 629884 - RNA, 22 nt, Human
cacaggagugcugcuauuguug

SEQ ID NO: 629885 - RNA, 22 nt, Human
aauguuugagcaucuacaugcu

SEQ ID NO: 629886 - RNA, 22 nt, Human
ucagggagauuuggggacucaa

SEQ ID NO: 629887 - RNA, 22 nt, Human
ggcagcuccaaaaggaaacacu

SEQ ID NO: 629888 - RNA, 22 nt, Human
aagcaaggcccagagcaucagc

SEQ ID NO: 629889 - RNA, 22 nt, Human
aaaguugaccgaaagauuuuga

SEQ ID NO: 629890 - RNA, 22 nt, Human
ccucugggagacugcuacugag

SEQ ID NO: 629891 - RNA, 22 nt, Human
agcaaauaccaaaggcugaugu

SEQ ID NO: 629892 - RNA, 22 nt, Human
caaugcuaucaugucagagaua

SEQ ID NO: 629893 - RNA, 22 nt, Human
aagacauuuuagagauagggaa

SEQ ID NO: 629894 - RNA, 22 nt, Human
cuucagcaccauagcuccuucu

SEQ ID NO: 629895 - RNA, 22 nt, Human
auauauuugagaauauucauga

SEQ ID NO: 629896 - RNA, 22 nt, Human
uuugaauguaaaugcugcagcu

SEQ ID NO: 629897 - RNA, 22 nt, Human
caaaagauacuugcaucuaacu

SEQ ID NO: 629898 - RNA, 22 nt, Human
acucuggccaggugcgguaugu

SEQ ID NO: 629899 - RNA, 16 nt, Human
agcagccagcacugga

SEQ ID NO: 629900 - RNA, 22 nt, Human
guacacaaaagaggaaaccgga

SEQ ID NO: 629901 - RNA, 22 nt, Human
accucugccacuuucuaacucu

SEQ ID NO: 629902 - RNA, 22 nt, Human
acgugugugacauugggaacgu

SEQ ID NO: 629903 - RNA, 22 nt, Human
uccaagaagcucagcaaacauc

SEQ ID NO: 629904 - RNA, 22 nt, Human
ugaaacaaaaguauguagcuug

SEQ ID NO: 629905 - RNA, 22 nt, Human
aguuuccuugggcauuuguuua

SEQ ID NO: 629906 - RNA, 22 nt, Human
uuuuacagucagucaaacucag

SEQ ID NO: 629907 - RNA, 22 nt, Human
acugucgauuaugaugagucag

SEQ ID NO: 629908 - RNA, 22 nt, Human
ggggcccuuguggcugcaggcc

SEQ ID NO: 629909 - RNA, 22 nt, Human
ugcuuucagccagugucuggau

SEQ ID NO: 629910 - RNA, 22 nt, Human
uggagggcucuuucaccuggua

SEQ ID NO: 629911 - RNA, 22 nt, Human
ucagcccaccugguguggggcu

SEQ ID NO: 629912 - RNA, 22 nt, Human
cuccaggaaagucaggcuuaga

SEQ ID NO: 629913 - RNA, 22 nt, Human
aaaugucuuucaauagagaaau

SEQ ID NO: 629914 - RNA, 22 nt, Human
gagcacuuagaugcuaugaaug

SEQ ID NO: 629915 - RNA, 22 nt, Human
ccugggucacucaggcaggcgg

SEQ ID NO: 629916 - RNA, 22 nt, Human
gacccugacucuaaugcuuggc

SEQ ID NO: 629917 - RNA, 22 nt, Human
acaggacaacucagcagccagc

SEQ ID NO: 629918 - RNA, 22 nt, Human
gcaggcuccaaggccugggaga

SEQ ID NO: 629919 - RNA, 22 nt, Human
ugacaggcaggacagaggugug

SEQ ID NO: 629920 - RNA, 22 nt, Human
augcauguguguuuacaugcuu

SEQ ID NO: 629921 - RNA, 22 nt, Human
ugaaagguuaaaaguaguauug

SEQ ID NO: 629922 - RNA, 22 nt, Human
gaugaaauuguuuugauacuuu

SEQ ID NO: 629923 - RNA, 19 nt, Human
agucuuguauuuuucaagc

SEQ ID NO: 629924 - RNA, 22 nt, Human
cuauuacauuucuggacauuca

SEQ ID NO: 629925 - RNA, 22 nt, Human
agcagagguguuuauuauggga

SEQ ID NO: 629926 - RNA, 20 nt, Human
ggcagccaaucagcgugccg

SEQ ID NO: 629927 - RNA, 22 nt, Human
ugaaggcacuugccuaggggca

SEQ ID NO: 629928 - RNA, 22 nt, Human
guuuaacugggagugugggaaa

SEQ ID NO: 629929 - RNA, 22 nt, Human
ucugcucaauacugcucaugaa

SEQ ID NO: 629930 - RNA, 22 nt, Human
ucccaccaggugaccauuucau

SEQ ID NO: 629931 - RNA, 22 nt, Human
aagggccaucccagaacagaaa

SEQ ID NO: 629932 - RNA, 19 nt, Human
gagcugccuuuugaagacc

SEQ ID NO: 629933 - RNA, 22 nt, Human
acguguguaugaguguacauau

SEQ ID NO: 629934 - RNA, 22 nt, Human
aacauugccaugguuaauuuua

SEQ ID NO: 629935 - RNA, 22 nt, Human
ggcucagguuuaaagugcuuua

SEQ ID NO: 629936 - RNA, 22 nt, Human
cacagguguguccuggucuugu

SEQ ID NO: 629937 - RNA, 22 nt, Human
ccucugaggugagcccagcugg

SEQ ID NO: 629938 - RNA, 23 nt, Human
auaauaauuauggcagcaaagug

SEQ ID NO: 629939 - RNA, 22 nt, Human
ugucugugggcaacgccuccca

SEQ ID NO: 629940 - RNA, 22 nt, Human
uuuacauuucccucugucaguu

SEQ ID NO: 629941 - RNA, 22 nt, Human
ucuccaagaaaagaucucagcu

SEQ ID NO: 629942 - RNA, 22 nt, Human
caggaaugaggucguaaguguc

SEQ ID NO: 629943 - RNA, 22 nt, Human
gaagcacagaaugguuaacaug

SEQ ID NO: 629944 - RNA, 22 nt, Human
gcuggcaccuauuuggaccugg

SEQ ID NO: 629945 - RNA, 22 nt, Human
ucaguccuccacacaggcaccc

SEQ ID NO: 629946 - RNA, 22 nt, Human
caagggcugcuaucagcuacug

SEQ ID NO: 629947 - RNA, 22 nt, Human
gcccuuccaacccagagggcaa

SEQ ID NO: 629948 - RNA, 22 nt, Human
acuuuuuaguuuccucaaacau

SEQ ID NO: 629949 - RNA, 22 nt, Human
uugcuucccccuguucuaguuc

SEQ ID NO: 629950 - RNA, 22 nt, Human
aacuugaaccacagaagcugcc

SEQ ID NO: 629951 - RNA, 22 nt, Human
uugaaaaugguaagcaugauau

SEQ ID NO: 629952 - RNA, 22 nt, Human
aaggaagggaaauagugauguc

SEQ ID NO: 629953 - RNA, 22 nt, Human
uugagaggauggauuagacaaa

SEQ ID NO: 629954 - RNA, 20 nt, Human
gaaaauaggccagccaggua

SEQ ID NO: 629955 - RNA, 22 nt, Human
uacacuuuauggauccuacuuu

SEQ ID NO: 629956 - RNA, 22 nt, Human
aagagcauauuaauaguggaga

SEQ ID NO: 629957 - RNA, 22 nt, Human
uccaguggcacuggagacuaga

SEQ ID NO: 629958 - RNA, 22 nt, Human
cuuaggaagcuuuugaggacaa

SEQ ID NO: 629959 - RNA, 23 nt, Human
uguaacuugauggaaugagcuau

SEQ ID NO: 629960 - RNA, 22 nt, Human
guggccuggaaaggcuggucug

SEQ ID NO: 629961 - RNA, 22 nt, Human
ugucuauguauacauguguaua

SEQ ID NO: 629962 - RNA, 22 nt, Human
cagccagcugaauguaccauga

SEQ ID NO: 629963 - RNA, 22 nt, Human
gccaggaguguguggcuauguu

SEQ ID NO: 629964 - RNA, 22 nt, Human
ucuguuauaaaucacacugcau

SEQ ID NO: 629965 - RNA, 22 nt, Human
uagauucuucuuuugagucucu

SEQ ID NO: 629966 - RNA, 20 nt, Human
aagcagugaggugaggagug

SEQ ID NO: 629967 - RNA, 22 nt, Human
gugaccagugaugcugaggagu

SEQ ID NO: 629968 - RNA, 18 nt, Human
ucagcuggguuucugggu

SEQ ID NO: 629969 - RNA, 23 nt, Human
gcagcugguuagaagggaaggag

SEQ ID NO: 629970 - RNA, 22 nt, Human
agccaccuccugcucugcucac

SEQ ID NO: 629971 - RNA, 21 nt, Human
gaacauuuggguuguuucuac

SEQ ID NO: 629972 - RNA, 22 nt, Human
acugccagaggagguaucugaa

SEQ ID NO: 629973 - RNA, 22 nt, Human
aguggcaggcggagauguagga

SEQ ID NO: 629974 - RNA, 23 nt, Human
gguuuucauggcauuccuugccu

SEQ ID NO: 629975 - RNA, 22 nt, Human
acauacuuaugcuaaaaauaua

SEQ ID NO: 629976 - RNA, 20 nt, Human
ugcauggcgcacaucugugg

SEQ ID NO: 629977 - RNA, 22 nt, Human
augaaggcuguguggagccccc

SEQ ID NO: 629978 - RNA, 22 nt, Human
uauacaaugaguacauucuggg

SEQ ID NO: 629979 - RNA, 22 nt, Human
agcagggcugcagugugucuuu

SEQ ID NO: 629980 - RNA, 22 nt, Human
gaaggcuggaaggcaaguagga

SEQ ID NO: 629981 - RNA, 22 nt, Human
uauaggacugaucacauuuuca

SEQ ID NO: 629982 - RNA, 22 nt, Human
ucauguaaguauagaaagcagu

SEQ ID NO: 629983 - RNA, 22 nt, Human
ugcugucuguuuacuggcuaua

SEQ ID NO: 629984 - RNA, 22 nt, Human
uguaaaaccaaaucaaucuagu

SEQ ID NO: 629985 - RNA, 22 nt, Human
augcaguaaauguucuaguuug

SEQ ID NO: 629986 - RNA, 22 nt, Human
agcugugugugcuugggauuau

SEQ ID NO: 629987 - RNA, 22 nt, Human
aagagcaaguggguagugaagc

SEQ ID NO: 629988 - RNA, 22 nt, Human
aaagaauacccugggucauaaa

SEQ ID NO: 629989 - RNA, 22 nt, Human
ggacugaauggaagauauaugg

SEQ ID NO: 629990 - RNA, 22 nt, Human
uucugggcuguccagaggguga

SEQ ID NO: 629991 - RNA, 18 nt, Human
augucugugcacuggaua

SEQ ID NO: 629992 - RNA, 22 nt, Human
aaggagguuaucccaguggacu

SEQ ID NO: 629993 - RNA, 22 nt, Human
gaaagaggaaggagauguauua

SEQ ID NO: 629994 - RNA, 22 nt, Human
caggauggccccggggcugugc

SEQ ID NO: 629995 - RNA, 22 nt, Human
agugucuggaggcauucuuggu

SEQ ID NO: 629996 - RNA, 20 nt, Human
ucugguccaggucuucaugg

SEQ ID NO: 629997 - RNA, 23 nt, Human
uggcagauacaggcaugacuucu

SEQ ID NO: 629998 - RNA, 22 nt, Human
uuucuagucuucccuaccuccc

SEQ ID NO: 629999 - RNA, 22 nt, Human
cuggccugugggcugucuccgg

SEQ ID NO: 630000 - RNA, 22 nt, Human
guggcagagcaggagacaggac

SEQ ID NO: 630001 - RNA, 22 nt, Human
ggaggaccccagcagcucccca

SEQ ID NO: 630002 - RNA, 22 nt, Human
gaggugggaugugugugcuacu

SEQ ID NO: 630003 - RNA, 22 nt, Human
gauuucccagcaaaagcugguu

SEQ ID NO: 630004 - RNA, 22 nt, Human
gcucucuggaagguaucauuau

SEQ ID NO: 630005 - RNA, 22 nt, Human
aucuggcuuuuaccccacggcc

SEQ ID NO: 630006 - RNA, 22 nt, Human
ggucucugacuuagagauggau

SEQ ID NO: 630007 - RNA, 22 nt, Human
gcaaggaccuuugagcgugcca

SEQ ID NO: 630008 - RNA, 22 nt, Human
ugggccaguccugccuaaggug

SEQ ID NO: 630009 - RNA, 22 nt, Human
agcuuucagucucugaaggaac

SEQ ID NO: 630010 - RNA, 22 nt, Human
cacugugggccugucgugggug

SEQ ID NO: 630011 - RNA, 20 nt, Human
uggcaccaggugguggcccc

SEQ ID NO: 630012 - RNA, 22 nt, Human
acagcagagccuagcuuaaucu

SEQ ID NO: 630013 - RNA, 22 nt, Human
uucuccaagaugaagcugugua

SEQ ID NO: 630014 - RNA, 22 nt, Human
ugcaggugccaucgcugcucau

SEQ ID NO: 630015 - RNA, 22 nt, Human
ucuuucagccacuuaccugucu

SEQ ID NO: 630016 - RNA, 22 nt, Human
ucacagaauuuuugcuuccagu

SEQ ID NO: 630017 - RNA, 22 nt, Human
acauucagaaucuuguagcagu

SEQ ID NO: 630018 - RNA, 22 nt, Human
uagcacauaacuuagaauaguu

SEQ ID NO: 630019 - RNA, 22 nt, Human
uggcugugcggccucgggcaga

SEQ ID NO: 630020 - RNA, 22 nt, Human
ucugaaaugcaggcaauuugcu

SEQ ID NO: 630021 - RNA, 22 nt, Human
agaagccaaaggggccagauau

SEQ ID NO: 630022 - RNA, 22 nt, Human
cuuuggcaaugaaacacaagaa

SEQ ID NO: 630023 - RNA, 22 nt, Human
uuccugagaaauuuguaccugg

SEQ ID NO: 630024 - RNA, 22 nt, Human
cagugcugcaggcgccugcggu

SEQ ID NO: 630025 - RNA, 22 nt, Human
gucauugagucgucagagucuu

SEQ ID NO: 630026 - RNA, 22 nt, Human
uuuuuguggugcagacuaaagc

SEQ ID NO: 630027 - RNA, 22 nt, Human
cacauaauacauguuccacuua

SEQ ID NO: 630028 - RNA, 22 nt, Human
auauuuguuagagucuaugugu

SEQ ID NO: 630029 - RNA, 22 nt, Human
gcccaggagccuggagaugugu

SEQ ID NO: 630030 - RNA, 21 nt, Human
uguguauguccaaugcccuac

SEQ ID NO: 630031 - RNA, 20 nt, Human
cugugggccucacuuggggu

SEQ ID NO: 630032 - RNA, 20 nt, Human
auguaaaagacagggaguag

SEQ ID NO: 630033 - RNA, 22 nt, Human
aucacugagcuucagugcuggc

SEQ ID NO: 630034 - RNA, 22 nt, Human
uugaaaguaauaacuuuguuca

SEQ ID NO: 630035 - RNA, 22 nt, Human
augaacaauaaaauagaucaca

SEQ ID NO: 630036 - RNA, 22 nt, Human
uccuggaggagauccaaucuga

SEQ ID NO: 630037 - RNA, 22 nt, Human
gagguuggagggcuggccugca

SEQ ID NO: 630038 - RNA, 22 nt, Human
agccaggaaugcaugcucugcu

SEQ ID NO: 630039 - RNA, 22 nt, Human
aagcagagaccggcuaauggag

SEQ ID NO: 630040 - RNA, 22 nt, Human
agguggucuuggcccacccagg

SEQ ID NO: 630041 - RNA, 22 nt, Human
cuuuccuuaauaagcagguaua

SEQ ID NO: 630042 - RNA, 22 nt, Human
ggcaggacucuucugugggccg

SEQ ID NO: 630043 - RNA, 22 nt, Human
aagccuucccuuuuugagcuca

SEQ ID NO: 630044 - RNA, 22 nt, Human
aucucauaaacacacauauaug

SEQ ID NO: 630045 - RNA, 22 nt, Human
ucuggagaagaaacuugcucug

SEQ ID NO: 630046 - RNA, 22 nt, Human
cagugcagccaaggacaggcac

SEQ ID NO: 630047 - RNA, 22 nt, Human
auguaugauauuuccaguauca

SEQ ID NO: 630048 - RNA, 19 nt, Human
ucugcagaaggcauacaug

SEQ ID NO: 630049 - RNA, 22 nt, Human
aggcuaaggugggaggaucgcu

SEQ ID NO: 630050 - RNA, 22 nt, Human
cuauggaagggaugcaaagaaa

SEQ ID NO: 630051 - RNA, 19 nt, Human
uagaagcagggaagcugag

SEQ ID NO: 630052 - RNA, 22 nt, Human
cugccaggcagggagauggcug

SEQ ID NO: 630053 - RNA, 22 nt, Human
acagcugugauuucuaucauga

SEQ ID NO: 630054 - RNA, 22 nt, Human
cauuucaauacaguuuguaaau

SEQ ID NO: 630055 - RNA, 22 nt, Human
aguguucaggaucugaggccag

SEQ ID NO: 630056 - RNA, 22 nt, Human
ugcaugcguuaguuggcguguu

SEQ ID NO: 630057 - RNA, 20 nt, Human
agcuggugaauuaaagacug

SEQ ID NO: 630058 - RNA, 22 nt, Human
aacauguuuccaguguaaggcc

SEQ ID NO: 630059 - RNA, 22 nt, Human
gacuuugauuaaaucaagcaaa

SEQ ID NO: 630060 - RNA, 22 nt, Human
gagucugagagccuaaugaccu

SEQ ID NO: 630061 - RNA, 22 nt, Human
ucuguugcauaugcugcugggu

SEQ ID NO: 630062 - RNA, 22 nt, Human
aaagaagggacagacugccucu

SEQ ID NO: 630063 - RNA, 22 nt, Human
agcagcucacaggauuccugaa

SEQ ID NO: 630064 - RNA, 22 nt, Human
gugcugaggccaaugucagggu

SEQ ID NO: 630065 - RNA, 22 nt, Human
aacugauuucaaguucaguuuc

SEQ ID NO: 630066 - RNA, 22 nt, Human
agguccugggaguucuagugug

SEQ ID NO: 630067 - RNA, 22 nt, Human
gcagcccagguggaguaaucua

SEQ ID NO: 630068 - RNA, 22 nt, Human
gugacauguuauggacuggcua

SEQ ID NO: 630069 - RNA, 22 nt, Human
ccucuggggcaucagacaaagg

SEQ ID NO: 630070 - RNA, 22 nt, Human
guauuucuuuaucuggucagaa

SEQ ID NO: 630071 - RNA, 21 nt, Human
agaacugauuaaauaagcagu

SEQ ID NO: 630072 - RNA, 22 nt, Human
acaaaugugucuaauugugccu

SEQ ID NO: 630073 - RNA, 23 nt, Human
ucagucuucccugucaguaauag

SEQ ID NO: 630074 - RNA, 22 nt, Human
cagggcagcuuccuuuguuagg

SEQ ID NO: 630075 - RNA, 22 nt, Human
gugcauguuaaugguguacaaa

SEQ ID NO: 630076 - RNA, 22 nt, Human
uacagccaugguuaauuuaccu

SEQ ID NO: 630077 - RNA, 22 nt, Human
cagccacuucgagcuuccugau

SEQ ID NO: 630078 - RNA, 20 nt, Human
gcugaggauuccuggccccu

SEQ ID NO: 630079 - RNA, 22 nt, Human
cacucccuucaggagccuagga

SEQ ID NO: 630080 - RNA, 22 nt, Human
uugucuuaaauggauggacaau

SEQ ID NO: 630081 - RNA, 22 nt, Human
gccuugccaaggggcagcagag

SEQ ID NO: 630082 - RNA, 22 nt, Human
uucccacaguguugaauccucu

SEQ ID NO: 630083 - RNA, 22 nt, Human
ggguccagacacuccagaggaa

SEQ ID NO: 630084 - RNA, 21 nt, Human
uggcuucagccauuuucucug

SEQ ID NO: 630085 - RNA, 22 nt, Human
acagcaauaggaaauacuugca

SEQ ID NO: 630086 - RNA, 21 nt, Human
cacagagauauuggugagccu

SEQ ID NO: 630087 - RNA, 21 nt, Human
uucaguaugcgucaugcuguu

SEQ ID NO: 630088 - RNA, 22 nt, Human
uggagcagaaauuugaagccau

SEQ ID NO: 630089 - RNA, 22 nt, Human
gaucauuucaguccaguaaaua

SEQ ID NO: 630090 - RNA, 22 nt, Human
uccccucuggaggcugcagggg

SEQ ID NO: 630091 - RNA, 22 nt, Human
aagggaaaucauauggugcagu

SEQ ID NO: 630092 - RNA, 22 nt, Human
cagcaugaaacaauugagccca

SEQ ID NO: 630093 - RNA, 22 nt, Human
ggaaguagaaguaaugaaauca

SEQ ID NO: 630094 - RNA, 22 nt, Human
uuaaauguuuaaucuaacuuga

SEQ ID NO: 630095 - RNA, 22 nt, Human
cacucucacaugcccugucagu

SEQ ID NO: 630096 - RNA, 22 nt, Human
gggcaguuuauucuagaugguu

SEQ ID NO: 630097 - RNA, 22 nt, Human
aucucagagaaauuugaaugca

SEQ ID NO: 630098 - RNA, 22 nt, Human
uccaagaugguugguguggugg

SEQ ID NO: 630099 - RNA, 18 nt, Human
ccagggaugcaugguccc

SEQ ID NO: 630100 - RNA, 22 nt, Human
gcagcuuuguggagaggcccau

SEQ ID NO: 630101 - RNA, 22 nt, Human
gauuaguugauuaagagucaga

SEQ ID NO: 630102 - RNA, 22 nt, Human
cagguaguccacagugagggag

SEQ ID NO: 630103 - RNA, 22 nt, Human
ugaaugauauauugggaauaau

SEQ ID NO: 630104 - RNA, 22 nt, Human
cugcagagagugccgggcagcc

SEQ ID NO: 630105 - RNA, 22 nt, Human
cuauucaacuugacuguuucac

SEQ ID NO: 630106 - RNA, 22 nt, Human
ccuccaggaacuugagagacac

SEQ ID NO: 630107 - RNA, 22 nt, Human
gugaagaucugagcccucaggu

SEQ ID NO: 630108 - RNA, 22 nt, Human
gcucccugcacucugcagcccu

SEQ ID NO: 630109 - RNA, 18 nt, Human
ugucucugaauuccagug

SEQ ID NO: 630110 - RNA, 22 nt, Human
uuuucuguuugcuucaagacau

SEQ ID NO: 630111 - RNA, 22 nt, Human
augggaggcaaagaucgcagaa

SEQ ID NO: 630112 - RNA, 22 nt, Human
acacauguuuacagucuucagu

SEQ ID NO: 630113 - RNA, 18 nt, Human
gccagcccuccaaccucc

SEQ ID NO: 630114 - RNA, 22 nt, Human
cacugaaacagguauugcuggu

SEQ ID NO: 630115 - RNA, 22 nt, Human
gacaggugagaugaggaacacc

SEQ ID NO: 630116 - RNA, 22 nt, Human
cauggcaggugcagauucugug

SEQ ID NO: 630117 - RNA, 22 nt, Human
cuuuaaggugaugagagaugcu

SEQ ID NO: 630118 - RNA, 18 nt, Human
agcuccugaacucugugg

SEQ ID NO: 630119 - RNA, 22 nt, Human
cucuggacuuguacauacucag

SEQ ID NO: 630120 - RNA, 22 nt, Human
augauucucauuuuauaaacuu

SEQ ID NO: 630121 - RNA, 22 nt, Human
augcuguggaaguuccugaagc

SEQ ID NO: 630122 - RNA, 22 nt, Human
gagguggcugggaguagggaau

SEQ ID NO: 630123 - RNA, 22 nt, Human
ucuguuucuuccuagccaugcu

SEQ ID NO: 630124 - RNA, 20 nt, Human
ugagaggacauuuuucaugu

SEQ ID NO: 630125 - RNA, 22 nt, Human
agugggguccucaguaugguuc

SEQ ID NO: 630126 - RNA, 22 nt, Human
uuauuuauaucucugcaguuua

SEQ ID NO: 630127 - RNA, 18 nt, Human
ggguccuguucuuggaag

SEQ ID NO: 630128 - RNA, 22 nt, Human
ugaaaccauucucagguacacu

SEQ ID NO: 630129 - RNA, 22 nt, Human
cucucagggucccugcggagga

SEQ ID NO: 630130 - RNA, 22 nt, Human
gguccuggaaguguaaguggca

SEQ ID NO: 630131 - RNA, 21 nt, Human
gaacccagcagcagugcucug

SEQ ID NO: 630132 - RNA, 22 nt, Human
aaugauccuuguuguuuaacca

SEQ ID NO: 630133 - RNA, 22 nt, Human
aagccacagaucguucugucac

SEQ ID NO: 630134 - RNA, 22 nt, Human
aucuuucuaugguacuuucucc

SEQ ID NO: 630135 - RNA, 22 nt, Human
gguaggcagaucacugucuaug

SEQ ID NO: 630136 - RNA, 23 nt, Human
uguuuguuucuaugagagauagc

SEQ ID NO: 630137 - RNA, 22 nt, Human
aggcagaggagaaugaucuucc

SEQ ID NO: 630138 - RNA, 20 nt, Human
uuguuucugcuauuuucuaa

SEQ ID NO: 630139 - RNA, 21 nt, Human
gugugucuaauguaguggaaa

SEQ ID NO: 630140 - RNA, 22 nt, Human
agaguaacuuuuaacuuuacgu

SEQ ID NO: 630141 - RNA, 22 nt, Human
cuagagaagaggcucagccagc

SEQ ID NO: 630142 - RNA, 22 nt, Human
uccugcugggucuaacucuggu

SEQ ID NO: 630143 - RNA, 22 nt, Human
uuugcauugcauacaaggaacu

SEQ ID NO: 630144 - RNA, 20 nt, Human
uuggcucagauuuuuauggg

SEQ ID NO: 630145 - RNA, 20 nt, Human
caugcaugacacuggaaagg

SEQ ID NO: 630146 - RNA, 23 nt, Human
cagaggguuccauggagcauggu

SEQ ID NO: 630147 - RNA, 22 nt, Human
ggcuggcaagugucugcucaug

SEQ ID NO: 630148 - RNA, 22 nt, Human
gcagagugagccgaggcugcuc

SEQ ID NO: 630149 - RNA, 21 nt, Human
cugugacucccugggcaaucc

SEQ ID NO: 630150 - RNA, 22 nt, Human
agucucugggcaugguugugac

SEQ ID NO: 630151 - RNA, 22 nt, Human
gguacagggcuuccuggacaag

SEQ ID NO: 630152 - RNA, 22 nt, Human
aaaugcaguuuccugagaccca

SEQ ID NO: 630153 - RNA, 22 nt, Human
ccacccugaggaaugguccggc

SEQ ID NO: 630154 - RNA, 22 nt, Human
gggcagauggggcacaggcuga

SEQ ID NO: 630155 - RNA, 22 nt, Human
uagacagauuuaaaggaaugga

SEQ ID NO: 630156 - RNA, 22 nt, Human
auuacagaagauaugcucaaca

SEQ ID NO: 630157 - RNA, 22 nt, Human
uuacaguaacauuuucagucug

SEQ ID NO: 630158 - RNA, 22 nt, Human
aauauaguucugguauuguuaa

SEQ ID NO: 630159 - RNA, 22 nt, Human
ugggagaaacugucucucccac

SEQ ID NO: 630160 - RNA, 22 nt, Human
ucccugggccuccugcuaugca

SEQ ID NO: 630161 - RNA, 22 nt, Human
aguguaugugaaacuuuccaaa

SEQ ID NO: 630162 - RNA, 22 nt, Human
cugggcagugguggcccuuccc

SEQ ID NO: 630163 - RNA, 22 nt, Human
ggcuuaguguuucugcucagcc

SEQ ID NO: 630164 - RNA, 22 nt, Human
gacaccagcaaggcugugagga

SEQ ID NO: 630165 - RNA, 22 nt, Human
gcuuuacaaguggugcagauua

SEQ ID NO: 630166 - RNA, 22 nt, Human
gagcaucuuguucccaacuucu

SEQ ID NO: 630167 - RNA, 22 nt, Human
acaggcagagaguggcggacuc

SEQ ID NO: 630168 - RNA, 20 nt, Human
ugguccaggaccuggugucc

SEQ ID NO: 630169 - RNA, 19 nt, Human
aggugagugugggaaaggg

SEQ ID NO: 630170 - RNA, 22 nt, Human
ggucucugucacugaguggccc

SEQ ID NO: 630171 - RNA, 22 nt, Human
gagcucugguucaugaucuauu

SEQ ID NO: 630172 - RNA, 22 nt, Human
caggcccaagacugaugagucu

SEQ ID NO: 630173 - RNA, 22 nt, Human
acucugacauuuaaaaagcaau

SEQ ID NO: 630174 - RNA, 22 nt, Human
gacaacacauguaugccacucu

SEQ ID NO: 630175 - RNA, 22 nt, Human
gggcuggaccgcgaccccugag

SEQ ID NO: 630176 - RNA, 22 nt, Human
ucacaggagcccaggggagcug

SEQ ID NO: 630177 - RNA, 22 nt, Human
ucaguugcauauuuuguguucu

SEQ ID NO: 630178 - RNA, 16 nt, Human
auuuccagauuaugca

SEQ ID NO: 630179 - RNA, 22 nt, Human
ucaaggaagucuuauugcacag

SEQ ID NO: 630180 - RNA, 22 nt, Human
guggccagaaccaggagaauga

SEQ ID NO: 630181 - RNA, 22 nt, Human
agccaaucuacaacaaaggaua

SEQ ID NO: 630182 - RNA, 19 nt, Human
gccaggcuccauagccggc

SEQ ID NO: 630183 - RNA, 22 nt, Human
caguuugucuugauucagaaca

SEQ ID NO: 630184 - RNA, 22 nt, Human
auaaccuguuucagacauuugu

SEQ ID NO: 630185 - RNA, 22 nt, Human
gcucucuugguggcuguccugg

SEQ ID NO: 630186 - RNA, 22 nt, Human
ggaaggggugggugagccucag

SEQ ID NO: 630187 - RNA, 22 nt, Human
gcccaggaugguguguaguggu

SEQ ID NO: 630188 - RNA, 22 nt, Human
aauggaauaccuagguggccca

SEQ ID NO: 630189 - RNA, 22 nt, Human
cagagccacuuggagaugagaa

SEQ ID NO: 630190 - RNA, 22 nt, Human
ugaagacuuugcucuuaaccac

SEQ ID NO: 630191 - RNA, 22 nt, Human
ggagcaggagucucuugaauuu

SEQ ID NO: 630192 - RNA, 22 nt, Human
cagaacagucgccugcauggau

SEQ ID NO: 630193 - RNA, 22 nt, Human
acagcugggugcugcucagagc

SEQ ID NO: 630194 - RNA, 22 nt, Human
aguaaacauagaauguucuucc

SEQ ID NO: 630195 - RNA, 21 nt, Human
uccagggcuuugauucucuca

SEQ ID NO: 630196 - RNA, 22 nt, Human
uucagaggugggcugagaggau

SEQ ID NO: 630197 - RNA, 22 nt, Human
cucugagauaguuucuaucaau

SEQ ID NO: 630198 - RNA, 22 nt, Human
augcugaaggugaauugacaau

SEQ ID NO: 630199 - RNA, 22 nt, Human
uucuguuucuggggucucugac

SEQ ID NO: 630200 - RNA, 23 nt, Human
uuagagaugauuaaaaaaucuug

SEQ ID NO: 630201 - RNA, 22 nt, Human
guuaaggaucuugagaugagga

SEQ ID NO: 630202 - RNA, 22 nt, Human
acacugcagauguaauuugagu

SEQ ID NO: 630203 - RNA, 22 nt, Human
uccagagcaaaguuugcuaaca

SEQ ID NO: 630204 - RNA, 21 nt, Human
ucuccaguauccuucucugag

SEQ ID NO: 630205 - RNA, 22 nt, Human
gucaucuuaucauuguugcugu

SEQ ID NO: 630206 - RNA, 22 nt, Human
ggcuggcacccuuggggauagg

SEQ ID NO: 630207 - RNA, 22 nt, Human
gagaaacuuggaguuauucugg

SEQ ID NO: 630208 - RNA, 22 nt, Human
guacacauugucuguuuacuuc

SEQ ID NO: 630209 - RNA, 22 nt, Human
uggcccgaagauccgaggguca

SEQ ID NO: 630210 - RNA, 22 nt, Human
augagagcucuaugaucuguuu

SEQ ID NO: 630211 - RNA, 22 nt, Human
agucauaucugaggaggaaucc

SEQ ID NO: 630212 - RNA, 22 nt, Human
ucucauggcuuguaggagguga

SEQ ID NO: 630213 - RNA, 22 nt, Human
acaguacugcuguucuuguccu

SEQ ID NO: 630214 - RNA, 22 nt, Human
guaugugugcaaauguaaauau

SEQ ID NO: 630215 - RNA, 22 nt, Human
auuucagagcuuugcagcuaau

SEQ ID NO: 630216 - RNA, 22 nt, Human
ugacaguagaagaugcuguuac

SEQ ID NO: 630217 - RNA, 22 nt, Human
ggggaagagcauugcacggugu

SEQ ID NO: 630218 - RNA, 22 nt, Human
gggaaauuuuagguuugucucg

SEQ ID NO: 630219 - RNA, 22 nt, Human
agccugugugcuuuggacaggg

SEQ ID NO: 630220 - RNA, 22 nt, Human
ucaggcuggaaugcaguggggc

SEQ ID NO: 630221 - RNA, 22 nt, Human
agaggccaucugcucugugggg

SEQ ID NO: 630222 - RNA, 21 nt, Human
uggcagcacccacacccucug

SEQ ID NO: 630223 - RNA, 22 nt, Human
ggccccacgggggaguccuagu

SEQ ID NO: 630224 - RNA, 22 nt, Human
aggucaaaccacagcucuaggc

SEQ ID NO: 630225 - RNA, 21 nt, Human
ugaaggagaggaccgagugcu

SEQ ID NO: 630226 - RNA, 22 nt, Human
gugguaauagagcuccaaacua

SEQ ID NO: 630227 - RNA, 23 nt, Human
acuuuucaauuagcuaugcuuaa

SEQ ID NO: 630228 - RNA, 22 nt, Human
aaggauaaaaaccacuucuaau

SEQ ID NO: 630229 - RNA, 22 nt, Human
uaggccacagaugagacauaag

SEQ ID NO: 630230 - RNA, 22 nt, Human
ucuacagccauuuugagcagug

SEQ ID NO: 630231 - RNA, 22 nt, Human
auuucuacauugaguuuuagca

SEQ ID NO: 630232 - RNA, 22 nt, Human
aaucagaaucaguugacacagc

SEQ ID NO: 630233 - RNA, 20 nt, Human
acauuuguggaucugagaga

SEQ ID NO: 630234 - RNA, 22 nt, Human
caguguggguuugggaggagua

SEQ ID NO: 630235 - RNA, 22 nt, Human
ugccugggugcccucugcuccu

SEQ ID NO: 630236 - RNA, 22 nt, Human
uaguuuagccauuuaggaauug

SEQ ID NO: 630237 - RNA, 22 nt, Human
gagcccaguaggcaaagcugca

SEQ ID NO: 630238 - RNA, 22 nt, Human
gagcucagauucuggugucaga

SEQ ID NO: 630239 - RNA, 22 nt, Human
auggaaagccaguguuccauca

SEQ ID NO: 630240 - RNA, 22 nt, Human
gggcuuuagauugcagaggauu

SEQ ID NO: 630241 - RNA, 22 nt, Human
ucacccagacuugugaaugugu

SEQ ID NO: 630242 - RNA, 22 nt, Human
cacauguccugggaaaauaacu

SEQ ID NO: 630243 - RNA, 22 nt, Human
cugggcaguuuuacaucauugc

SEQ ID NO: 630244 - RNA, 22 nt, Human
ccagaagugucuaucaagaugu

SEQ ID NO: 630245 - RNA, 22 nt, Human
aguguggagcaucgagggcaga

SEQ ID NO: 630246 - RNA, 22 nt, Human
cccugggcaagcccuauuuucc

SEQ ID NO: 630247 - RNA, 22 nt, Human
aagccagguguuuaggccagcg

SEQ ID NO: 630248 - RNA, 22 nt, Human
ccaggcuuucccagccucucca

SEQ ID NO: 630249 - RNA, 22 nt, Human
agggggucuccuaucauggaag

SEQ ID NO: 630250 - RNA, 22 nt, Human
aggaagcugcuaagaaacaaug

SEQ ID NO: 630251 - RNA, 22 nt, Human
cugagccaugggucuaagcacu

SEQ ID NO: 630252 - RNA, 22 nt, Human
ccacagagagugucagccuuug

SEQ ID NO: 630253 - RNA, 22 nt, Human
uucucagagcacugcugacaaa

SEQ ID NO: 630254 - RNA, 22 nt, Human
gcuccaggugucccagguaaaa

SEQ ID NO: 630255 - RNA, 22 nt, Human
cagaaaauaaacauuuguggaa

SEQ ID NO: 630256 - RNA, 22 nt, Human
uauagcaaggacauaauaugcu

SEQ ID NO: 630257 - RNA, 22 nt, Human
caacagcuuuagaaacacuuuc

SEQ ID NO: 630258 - RNA, 22 nt, Human
gcuggccugaccugaggcuggg

SEQ ID NO: 630259 - RNA, 22 nt, Human
acugggaguucuccaugucccu

SEQ ID NO: 630260 - RNA, 22 nt, Human
gaaacuugauaauugaaacaga

SEQ ID NO: 630261 - RNA, 22 nt, Human
auccuuggaugugucuuuuugu

SEQ ID NO: 630262 - RNA, 22 nt, Human
aaggcugagguagggccuaaaa

SEQ ID NO: 630263 - RNA, 22 nt, Human
ugugcccugccuacaucaccuu

SEQ ID NO: 630264 - RNA, 17 nt, Human
uguaagcaggugagaga

SEQ ID NO: 630265 - RNA, 20 nt, Human
uucaaagacccucaggucca

SEQ ID NO: 630266 - RNA, 22 nt, Human
cuucuaagcugagaaugccuuu

SEQ ID NO: 630267 - RNA, 22 nt, Human
ugccccucgacgcaaugaaggg

SEQ ID NO: 630268 - RNA, 22 nt, Human
ucuuccuggauggggguugaug

SEQ ID NO: 630269 - RNA, 22 nt, Human
uuuauuccaaagcuugcacuuu

SEQ ID NO: 630270 - RNA, 22 nt, Human
uggacaugucuucuccaagaaa

SEQ ID NO: 630271 - RNA, 22 nt, Human
caugaagcacagcucucuuuuu

SEQ ID NO: 630272 - RNA, 22 nt, Human
auuugaaaucccuucuacugua

SEQ ID NO: 630273 - RNA, 22 nt, Human
gccagcucagaugcaggaagga

SEQ ID NO: 630274 - RNA, 22 nt, Human
gggccaccuggauuccaugugu

SEQ ID NO: 630275 - RNA, 22 nt, Human
aggggcucuaaagaucauggaa

SEQ ID NO: 630276 - RNA, 22 nt, Human
cauggugaggggugaagggcag

SEQ ID NO: 630277 - RNA, 21 nt, Human
gguggcuagaaagcagugaga

SEQ ID NO: 630278 - RNA, 22 nt, Human
uuaagcaacacacauuaauuau

SEQ ID NO: 630279 - RNA, 22 nt, Human
uugacauaagacuuagaguauu

SEQ ID NO: 630280 - RNA, 22 nt, Human
auugacaaggaaacuauaccag

SEQ ID NO: 630281 - RNA, 21 nt, Human
gcauuccuaggagguaagcau

SEQ ID NO: 630282 - RNA, 22 nt, Human
aguacaaaggcccuugauuacu

SEQ ID NO: 630283 - RNA, 20 nt, Human
gccagcuggucccaauuaug

SEQ ID NO: 630284 - RNA, 22 nt, Human
auaugugugaugcauggacuaa

SEQ ID NO: 630285 - RNA, 22 nt, Human
cuuguuaucuccguguccuugu

SEQ ID NO: 630286 - RNA, 22 nt, Human
aauaagauccugaagauauguu

SEQ ID NO: 630287 - RNA, 22 nt, Human
uauauacuuucuuccuggguag

SEQ ID NO: 630288 - RNA, 22 nt, Human
uaggaaacaaaguaaugcaacu

SEQ ID NO: 630289 - RNA, 22 nt, Human
aaucagaaagaucuugaugaga

SEQ ID NO: 630290 - RNA, 22 nt, Human
ucuguuucuucuucuguuauau

SEQ ID NO: 630291 - RNA, 21 nt, Human
ucaaaucagguaucacuauug

SEQ ID NO: 630292 - RNA, 22 nt, Human
aaaaauuuaugguucuucucug

SEQ ID NO: 630293 - RNA, 20 nt, Human
uugcuuuaucagacaugaua

SEQ ID NO: 630294 - RNA, 22 nt, Human
uucuuugcccauguuuccuaag

SEQ ID NO: 630295 - RNA, 22 nt, Human
auuucuuucuggccacgguuuu

SEQ ID NO: 630296 - RNA, 22 nt, Human
cucuggacccagacaaaccugg

SEQ ID NO: 630297 - RNA, 22 nt, Human
aaaguuuuagcuguccaguucc

SEQ ID NO: 630298 - RNA, 22 nt, Human
ugugccuguugguguagacaua

SEQ ID NO: 630299 - RNA, 22 nt, Human
uauuuccacccucaguaaggaa

SEQ ID NO: 630300 - RNA, 22 nt, Human
uggaacaaacauggugauggcu

SEQ ID NO: 630301 - RNA, 22 nt, Human
uuucuugaaguccuaacccuca

SEQ ID NO: 630302 - RNA, 22 nt, Human
agcaaucaccaccucuauauuu

SEQ ID NO: 630303 - RNA, 22 nt, Human
gcaauagugccuauucucuuga

SEQ ID NO: 630304 - RNA, 18 nt, Human
gggaagccgggaagccgg

SEQ ID NO: 630305 - RNA, 22 nt, Human
gcaguguggcguggggaccuaa

SEQ ID NO: 630306 - RNA, 22 nt, Human
ucuucucccagggucgcccaag

SEQ ID NO: 630307 - RNA, 22 nt, Human
uaaauacuuuacaggaugucuc

SEQ ID NO: 630308 - RNA, 22 nt, Human
ucugucuccucagaugacucca

SEQ ID NO: 630309 - RNA, 22 nt, Human
ugcaugcaacaauucuucuaua

SEQ ID NO: 630310 - RNA, 22 nt, Human
ggcaagguacucuagagcacau

SEQ ID NO: 630311 - RNA, 22 nt, Human
aaugucuuuucccuuacuuucc

SEQ ID NO: 630312 - RNA, 20 nt, Human
acagguucauucugugugac

SEQ ID NO: 630313 - RNA, 22 nt, Human
uagcuuuaagacauggugaaug

SEQ ID NO: 630314 - RNA, 22 nt, Human
agacagugugguuggugguucc

SEQ ID NO: 630315 - RNA, 22 nt, Human
cuagggaaugagagacuggauc

SEQ ID NO: 630316 - RNA, 22 nt, Human
agcugcuguggggcucggccug

SEQ ID NO: 630317 - RNA, 21 nt, Human
acagaggcauacagcuuaagg

SEQ ID NO: 630318 - RNA, 22 nt, Human
gagcugagccuggguggaccgc

SEQ ID NO: 630319 - RNA, 22 nt, Human
cugugugcaacuugcaguuuug

SEQ ID NO: 630320 - RNA, 22 nt, Human
acaacuggcuuuuuagcuuguu

SEQ ID NO: 630321 - RNA, 22 nt, Human
gcaggcccagagucgcuggccu

SEQ ID NO: 630322 - RNA, 21 nt, Human
acugaacuuguguucuagagg

SEQ ID NO: 630323 - RNA, 22 nt, Human
auauguguauuugguuagccua

SEQ ID NO: 630324 - RNA, 22 nt, Human
aggugcugggcagcagucauug

SEQ ID NO: 630325 - RNA, 22 nt, Human
uggagcagagaugguggccuuc

SEQ ID NO: 630326 - RNA, 22 nt, Human
acaggaguuaaggcugaguuga

SEQ ID NO: 630327 - RNA, 22 nt, Human
uauuucagcccuacuacuuggc

SEQ ID NO: 630328 - RNA, 22 nt, Human
gcucugggccgggcaccagccu

SEQ ID NO: 630329 - RNA, 22 nt, Human
aguguacauguacacauuagua

SEQ ID NO: 630330 - RNA, 22 nt, Human
ucagaggaaagggaacauaguc

SEQ ID NO: 630331 - RNA, 22 nt, Human
ggguggagguggguuuugagau

SEQ ID NO: 630332 - RNA, 22 nt, Human
agggcccaugugggagcacuug

SEQ ID NO: 630333 - RNA, 22 nt, Human
gccuccacuuuugcuggcuucu

SEQ ID NO: 630334 - RNA, 22 nt, Human
uuugauaacagugaauaucaug

SEQ ID NO: 630335 - RNA, 22 nt, Human
acagaguaggugcugucgacug

SEQ ID NO: 630336 - RNA, 22 nt, Human
gcucccagcaauugaggcagcc

SEQ ID NO: 630337 - RNA, 22 nt, Human
gcaggcucagagcagauuagca

SEQ ID NO: 630338 - RNA, 22 nt, Human
cugaaggauucaaaauggcagg

SEQ ID NO: 630339 - RNA, 22 nt, Human
aggggucuugaggacuccagca

SEQ ID NO: 630340 - RNA, 22 nt, Human
acagagagaggcccgaggcugc

SEQ ID NO: 630341 - RNA, 22 nt, Human
guaaacauuuucaucugugccc

SEQ ID NO: 630342 - RNA, 22 nt, Human
acagagcuuaauucaggagcuu

SEQ ID NO: 630343 - RNA, 22 nt, Human
uuggugucuuuuuuauacaugu

SEQ ID NO: 630344 - RNA, 18 nt, Human
acagggaugggguaagug

SEQ ID NO: 630345 - RNA, 22 nt, Human
gccacuguugcuccucaggaaa

SEQ ID NO: 630346 - RNA, 22 nt, Human
cuucugaggacucuaaagagga

SEQ ID NO: 630347 - RNA, 22 nt, Human
uauaaaauggcaucagcuccaa

SEQ ID NO: 630348 - RNA, 22 nt, Human
ucugcucagugcuuaucucuaa

SEQ ID NO: 630349 - RNA, 22 nt, Human
caagaauuaagaauuuugaugu

SEQ ID NO: 630350 - RNA, 22 nt, Human
gcaugcaugauguuggcagugg

SEQ ID NO: 630351 - RNA, 22 nt, Human
aaaauguguuuaugcauuucgu

SEQ ID NO: 630352 - RNA, 22 nt, Human
auucuguguuaggauagauggu

SEQ ID NO: 630353 - RNA, 22 nt, Human
uccuucagucuucugagccaua

SEQ ID NO: 630354 - RNA, 22 nt, Human
ggcacagcaggagcuaugugaa

SEQ ID NO: 630355 - RNA, 22 nt, Human
gucauuuaaagaccauuguggg

SEQ ID NO: 630356 - RNA, 22 nt, Human
guucuccacugcagagucucuc

SEQ ID NO: 630357 - RNA, 22 nt, Human
auucuucagcaggggacacuau

SEQ ID NO: 630358 - RNA, 18 nt, Human
ugaggaaggggaaguauu

SEQ ID NO: 630359 - RNA, 22 nt, Human
caguaguggucuaucacuggag

SEQ ID NO: 630360 - RNA, 22 nt, Human
uuccacaaugguuaagcucguu

SEQ ID NO: 630361 - RNA, 22 nt, Human
cacugcccaccaaguggcuggu

SEQ ID NO: 630362 - RNA, 22 nt, Human
agcagccauccuuagagaaaga

SEQ ID NO: 630363 - RNA, 22 nt, Human
acagccagaucugagagaucuu

SEQ ID NO: 630364 - RNA, 22 nt, Human
caggcucacuguaaggucagcu

SEQ ID NO: 630365 - RNA, 22 nt, Human
cagguagguuuuaggcuaaaca

SEQ ID NO: 630366 - RNA, 22 nt, Human
gccagagccuguggauuuaacc

SEQ ID NO: 630367 - RNA, 22 nt, Human
ugcugggcacugucucugggga

SEQ ID NO: 630368 - RNA, 22 nt, Human
gcagcugcaagcacuucuggca

SEQ ID NO: 630369 - RNA, 22 nt, Human
cagaucauaacagauacauaga

SEQ ID NO: 630370 - RNA, 22 nt, Human
uuccucuuccaucuucccaggg

SEQ ID NO: 630371 - RNA, 22 nt, Human
ggcugggcauccauccaugaga

SEQ ID NO: 630372 - RNA, 20 nt, Human
auuugcaucugaauaacuua

SEQ ID NO: 630373 - RNA, 22 nt, Human
augcauugucugguuucauuuu

SEQ ID NO: 630374 - RNA, 22 nt, Human
augugaaaaauuucuuauuaca

SEQ ID NO: 630375 - RNA, 22 nt, Human
uuauauaaagauaacuuuucuu

SEQ ID NO: 630376 - RNA, 22 nt, Human
aggcaucaggaguauagccaga

SEQ ID NO: 630377 - RNA, 22 nt, Human
caucagccuggaaggcagccug

SEQ ID NO: 630378 - RNA, 22 nt, Human
cuuuucucuuacauuccacugg

SEQ ID NO: 630379 - RNA, 22 nt, Human
ugagcagaugugccaaacugua

SEQ ID NO: 630380 - RNA, 22 nt, Human
agauucaaagugaagaacuuaa

SEQ ID NO: 630381 - RNA, 20 nt, Human
cagggcacacugcagccucg

SEQ ID NO: 630382 - RNA, 22 nt, Human
agagagagggaaacugcuaaac

SEQ ID NO: 630383 - RNA, 22 nt, Human
gagaggaagccuucuguacuug

SEQ ID NO: 630384 - RNA, 22 nt, Human
aauucugugcaggcagagcuau

SEQ ID NO: 630385 - RNA, 20 nt, Human
aggaaggagaaucugagcaa

SEQ ID NO: 630386 - RNA, 22 nt, Human
ccuggcagucaggggaguccuu

SEQ ID NO: 630387 - RNA, 22 nt, Human
auguuucaggaaaucagcuaga

SEQ ID NO: 630388 - RNA, 21 nt, Human
aaggacgagguuuugauuaca

SEQ ID NO: 630389 - RNA, 22 nt, Human
cugcauguuuucuuaauuguga

SEQ ID NO: 630390 - RNA, 22 nt, Human
ucacaaauauuuuaacaguagg

SEQ ID NO: 630391 - RNA, 22 nt, Human
agggcaaguugagugugcgugg

SEQ ID NO: 630392 - RNA, 22 nt, Human
cugcuguguuagcagguuuagu

SEQ ID NO: 630393 - RNA, 22 nt, Human
aaaguccuguuaacuguuaaca

SEQ ID NO: 630394 - RNA, 22 nt, Human
uauccguuagaaucaugcuggg

SEQ ID NO: 630395 - RNA, 22 nt, Human
cugagguagcugugaauguucu

SEQ ID NO: 630396 - RNA, 22 nt, Human
aauuuaaggaggccuucacucu

SEQ ID NO: 630397 - RNA, 22 nt, Human
cauuugauccucacaacaaucu

SEQ ID NO: 630398 - RNA, 22 nt, Human
uucacauaggagcaugguuuuu

SEQ ID NO: 630399 - RNA, 22 nt, Human
uuuggggcucagcaggcuguuu

SEQ ID NO: 630400 - RNA, 22 nt, Human
cugcagugcaagcccagaugga

SEQ ID NO: 630401 - RNA, 20 nt, Human
aggcagagcgcacuuuuaga

SEQ ID NO: 630402 - RNA, 18 nt, Human
aagaacugagguccuaga

SEQ ID NO: 630403 - RNA, 22 nt, Human
ugguccuggagaguguuccaua

SEQ ID NO: 630404 - RNA, 17 nt, Human
agccagcaguagcuggu

SEQ ID NO: 630405 - RNA, 22 nt, Human
agaagccagucgcucucccgca

SEQ ID NO: 630406 - RNA, 22 nt, Human
gaggaggcugaacaaugcccug

SEQ ID NO: 630407 - RNA, 22 nt, Human
ugaaagaugaaagcaggcuggu

SEQ ID NO: 630408 - RNA, 21 nt, Human
aaaguguucagaccaguucug

SEQ ID NO: 630409 - RNA, 22 nt, Human
aggauggcuugcaggaggcugu

SEQ ID NO: 630410 - RNA, 22 nt, Human
caacuuuaaauggcuaugucug

SEQ ID NO: 630411 - RNA, 22 nt, Human
gggccccugggaauucugugau

SEQ ID NO: 630412 - RNA, 22 nt, Human
gucaggggccaugggccaagga

SEQ ID NO: 630413 - RNA, 22 nt, Human
ccaaggagcucauauucuuguu

SEQ ID NO: 630414 - RNA, 22 nt, Human
gcugucugcaucucuagagcuu

SEQ ID NO: 630415 - RNA, 23 nt, Human
ugcucugugaauaguuggugacu

SEQ ID NO: 630416 - RNA, 22 nt, Human
cacccugggcugggccuguuaa

SEQ ID NO: 630417 - RNA, 22 nt, Human
gucuuauuaugagguuagacuu

SEQ ID NO: 630418 - RNA, 22 nt, Human
gccccagccaaggugacacgaa

SEQ ID NO: 630419 - RNA, 22 nt, Human
cuucugggcauggcagagccug

SEQ ID NO: 630420 - RNA, 22 nt, Human
ucagagugaggcccagcaaucu

SEQ ID NO: 630421 - RNA, 22 nt, Human
ucucagagcucacaccuccugg

SEQ ID NO: 630422 - RNA, 22 nt, Human
uuccauauuuguguggcaaaag

SEQ ID NO: 630423 - RNA, 23 nt, Human
cagaaaucugaaaucuagaaaug

SEQ ID NO: 630424 - RNA, 22 nt, Human
ugaagacucagaagcuaagaua

SEQ ID NO: 630425 - RNA, 19 nt, Human
auauaggcugaaccaugcu

SEQ ID NO: 630426 - RNA, 19 nt, Human
gaggcaaggaguuuaagcc

SEQ ID NO: 630427 - RNA, 23 nt, Human
uccagccucuugcucucacaugc

SEQ ID NO: 630428 - RNA, 22 nt, Human
ccagucugaggccuggugaggg

SEQ ID NO: 630429 - RNA, 22 nt, Human
aacaauugacacuucauuguga

SEQ ID NO: 630430 - RNA, 18 nt, Human
ggccugcagugaagcaag

SEQ ID NO: 630431 - RNA, 22 nt, Human
ugugcauagacuuucaccaccu

SEQ ID NO: 630432 - RNA, 22 nt, Human
agagugaaguucaucgugcagc

SEQ ID NO: 630433 - RNA, 22 nt, Human
acaauguaggauauguacuugu

SEQ ID NO: 630434 - RNA, 22 nt, Human
ucagaaaaugaaauggacucuc

SEQ ID NO: 630435 - RNA, 20 nt, Human
aaucugaaucccaguccuag

SEQ ID NO: 630436 - RNA, 22 nt, Human
cacauacaaggcacacuggagg

SEQ ID NO: 630437 - RNA, 19 nt, Human
gucuguguauuuguugcug

SEQ ID NO: 630438 - RNA, 22 nt, Human
gaauuucuggacccuuugagaa

SEQ ID NO: 630439 - RNA, 22 nt, Human
gggagacaguucagauaguuuc

SEQ ID NO: 630440 - RNA, 22 nt, Human
ggcuucugagugcucugcuguu

SEQ ID NO: 630441 - RNA, 22 nt, Human
gagggugcaggaggaugguagu

SEQ ID NO: 630442 - RNA, 22 nt, Human
cagcugaagagaggugcugagu

SEQ ID NO: 630443 - RNA, 22 nt, Human
uucauucaucucuaaaaugccu

SEQ ID NO: 630444 - RNA, 22 nt, Human
ugucacaacagaggaacugaau

SEQ ID NO: 630445 - RNA, 22 nt, Human
uggcagguggcucuggcauucu

SEQ ID NO: 630446 - RNA, 22 nt, Human
ucaguugcuguguaauguuuuc

SEQ ID NO: 630447 - RNA, 22 nt, Human
caggggacacuccugcuugggc

SEQ ID NO: 630448 - RNA, 22 nt, Human
acagggauuuuccaggcuaccc

SEQ ID NO: 630449 - RNA, 22 nt, Human
agaaaccagacuuggcccauuu

SEQ ID NO: 630450 - RNA, 22 nt, Human
ucuuuuggaaaugaugugcagg

SEQ ID NO: 630451 - RNA, 22 nt, Human
gaauacauuggaaaucagaaua

SEQ ID NO: 630452 - RNA, 22 nt, Human
guuaaacaauaacuggcacaca

SEQ ID NO: 630453 - RNA, 22 nt, Human
uggcuccacucuccaggaguuu

SEQ ID NO: 630454 - RNA, 20 nt, Human
ugcuugucaugcacucaggc

SEQ ID NO: 630455 - RNA, 21 nt, Human
gccuggcucucacuggccugg

SEQ ID NO: 630456 - RNA, 22 nt, Human
gcagacagaagcuaaguagaca

SEQ ID NO: 630457 - RNA, 22 nt, Human
cuggcaugcccaggguaugugg

SEQ ID NO: 630458 - RNA, 22 nt, Human
cagauccacccuuguagugaca

SEQ ID NO: 630459 - RNA, 19 nt, Human
gagcagcugcacccauuga

SEQ ID NO: 630460 - RNA, 21 nt, Human
cugccaccugcuccaucagca

SEQ ID NO: 630461 - RNA, 22 nt, Human
uguuuucauuugauguaacaaa

SEQ ID NO: 630462 - RNA, 22 nt, Human
acuucccugugggcagguagug

SEQ ID NO: 630463 - RNA, 22 nt, Human
ugcugcaggccuuggcugggaa

SEQ ID NO: 630464 - RNA, 22 nt, Human
uaaaugaaaggguuuaauuuau

SEQ ID NO: 630465 - RNA, 22 nt, Human
aagacaaugaguccugauggga

SEQ ID NO: 630466 - RNA, 22 nt, Human
ucugacaagucaagucuugacu

SEQ ID NO: 630467 - RNA, 22 nt, Human
cccugugccagagaggcaggag

SEQ ID NO: 630468 - RNA, 22 nt, Human
cagcauccuuugcugguuuccc

SEQ ID NO: 630469 - RNA, 22 nt, Human
aaucaguuucuuggcaaguuua

SEQ ID NO: 630470 - RNA, 22 nt, Human
uggcuucucccuacaacaugcc

SEQ ID NO: 630471 - RNA, 22 nt, Human
cagugagauaccacagagcaaa

SEQ ID NO: 630472 - RNA, 22 nt, Human
cacagcugugagaagggagccu

SEQ ID NO: 630473 - RNA, 22 nt, Human
uacuacauacagaauuuagaga

SEQ ID NO: 630474 - RNA, 22 nt, Human
ugggggauuguuuuaaugaaua

SEQ ID NO: 630475 - RNA, 19 nt, Human
cuucugugauacaucaguc

SEQ ID NO: 630476 - RNA, 22 nt, Human
caccagggccccaggcugugcc

SEQ ID NO: 630477 - RNA, 22 nt, Human
acagcuggaguguuggugaggu

SEQ ID NO: 630478 - RNA, 22 nt, Human
cuuugcugccagaacccagcag

SEQ ID NO: 630479 - RNA, 22 nt, Human
caugaguucaucugcuucucuu

SEQ ID NO: 630480 - RNA, 22 nt, Human
uuucucauggacccuucaugau

SEQ ID NO: 630481 - RNA, 21 nt, Human
gcugcaucaaucuacccaggg

SEQ ID NO: 630482 - RNA, 22 nt, Human
auaacuucaucaaauaggcaca

SEQ ID NO: 630483 - RNA, 18 nt, Human
ccuucugacgcuugagaa

SEQ ID NO: 630484 - RNA, 23 nt, Human
uucuggcuccgagcuccaucuuc

SEQ ID NO: 630485 - RNA, 22 nt, Human
gaggccuggucuaugagauguu

SEQ ID NO: 630486 - RNA, 22 nt, Human
auuguuaaacugaagcauuacu

SEQ ID NO: 630487 - RNA, 23 nt, Human
uccagcugcagugggauggggaa

SEQ ID NO: 630488 - RNA, 22 nt, Human
ccccacccaccuaagagaaacu

SEQ ID NO: 630489 - RNA, 22 nt, Human
agacuguaauugacaugucagc

SEQ ID NO: 630490 - RNA, 22 nt, Human
cuccaggauguuagacguccag

SEQ ID NO: 630491 - RNA, 22 nt, Human
gaggggaugcagagaggcuuau

SEQ ID NO: 630492 - RNA, 22 nt, Human
uauucaugggaggucacaacuu

SEQ ID NO: 630493 - RNA, 22 nt, Human
aguucagaggcaggagaaggcu

SEQ ID NO: 630494 - RNA, 22 nt, Human
gcagggagguuugcugaccugg

SEQ ID NO: 630495 - RNA, 22 nt, Human
gugagaguguuuggaaauagaa

SEQ ID NO: 630496 - RNA, 22 nt, Human
uuaauuaauuaguuaagcaugu

SEQ ID NO: 630497 - RNA, 22 nt, Human
aacaguuuaucaaguuuuuaca

SEQ ID NO: 630498 - RNA, 19 nt, Human
ggugagcccucgccugccu

SEQ ID NO: 630499 - RNA, 22 nt, Human
agcuguuguuaauuaacucauu

SEQ ID NO: 630500 - RNA, 22 nt, Human
aggcuccuagccuguggcuggu

SEQ ID NO: 630501 - RNA, 22 nt, Human
ugaagauuuagaccucuuugcc

SEQ ID NO: 630502 - RNA, 22 nt, Human
auucagugccaaggagaacuug

SEQ ID NO: 630503 - RNA, 22 nt, Human
aagccaggugugcccaggaucc

SEQ ID NO: 630504 - RNA, 22 nt, Human
aguugcucuaggugaggucuuu

SEQ ID NO: 630505 - RNA, 22 nt, Human
uguguuucugagaaucccaccu

SEQ ID NO: 630506 - RNA, 19 nt, Human
cugcugggugcugagggag

SEQ ID NO: 630507 - RNA, 22 nt, Human
cucaucuguauauagugaauga

SEQ ID NO: 630508 - RNA, 22 nt, Human
aguauauuuguuaagauuauuc

SEQ ID NO: 630509 - RNA, 18 nt, Human
gcucaggcccuagucagu

SEQ ID NO: 630510 - RNA, 22 nt, Human
agcaggggcuccuccacagcca

SEQ ID NO: 630511 - RNA, 22 nt, Human
aaugaauucugaagucuuccaa

SEQ ID NO: 630512 - RNA, 23 nt, Human
aagcaucuuuuccuagcuccauc

SEQ ID NO: 630513 - RNA, 22 nt, Human
acugggagucaugaggaaggag

SEQ ID NO: 630514 - RNA, 22 nt, Human
uaguucucaggacgucaagguu

SEQ ID NO: 630515 - RNA, 22 nt, Human
uagaaagaucuguaggcaagag

SEQ ID NO: 630516 - RNA, 22 nt, Human
uaaaucccuacaucuguguuuu

SEQ ID NO: 630517 - RNA, 22 nt, Human
aggacacacagaauacaaaucc

SEQ ID NO: 630518 - RNA, 22 nt, Human
ucacaugauguuuccucugugc

SEQ ID NO: 630519 - RNA, 22 nt, Human
ggcaugugccugaggucacaca

SEQ ID NO: 630520 - RNA, 22 nt, Human
uggcaggaaaaagggccagagg

SEQ ID NO: 630521 - RNA, 22 nt, Human
ugcagaaaccaauucaaguaag

SEQ ID NO: 630522 - RNA, 22 nt, Human
ccuggacagagggcagcggcca

SEQ ID NO: 630523 - RNA, 22 nt, Human
uaagaaacuaaugcaauaagag

SEQ ID NO: 630524 - RNA, 22 nt, Human
ccaggaggcagaaguugcagug

SEQ ID NO: 630525 - RNA, 22 nt, Human
gaggugccuggcgaugucucug

SEQ ID NO: 630526 - RNA, 22 nt, Human
agcugggaugauaaccucaguc

SEQ ID NO: 630527 - RNA, 22 nt, Human
acagcauggauaacaaggcacu

SEQ ID NO: 630528 - RNA, 18 nt, Human
ugcuuggagcauuuacca

SEQ ID NO: 630529 - RNA, 22 nt, Human
uuuacuacuugugauaacugaa

SEQ ID NO: 630530 - RNA, 22 nt, Human
gcugccugcucggcuccuggga

SEQ ID NO: 630531 - RNA, 23 nt, Human
aguguuuauguucagugacccuc

SEQ ID NO: 630532 - RNA, 21 nt, Human
aggggcccuugccaggacgcc

SEQ ID NO: 630533 - RNA, 22 nt, Human
cuggcccaggcuccuggggcac

SEQ ID NO: 630534 - RNA, 22 nt, Human
uuuggggagacauggccagcug

SEQ ID NO: 630535 - RNA, 22 nt, Human
uuuccucacucaugucaucagu

SEQ ID NO: 630536 - RNA, 20 nt, Human
accagagcucucaguaugug

SEQ ID NO: 630537 - RNA, 22 nt, Human
uacaaggcuucagcucagcuau

SEQ ID NO: 630538 - RNA, 22 nt, Human
aggcuggucuauacggagacga

SEQ ID NO: 630539 - RNA, 22 nt, Human
ucagcaucuucagcauggggaa

SEQ ID NO: 630540 - RNA, 22 nt, Human
ugucuauagccugauuuguugg

SEQ ID NO: 630541 - RNA, 22 nt, Human
aggccacacaacucuuagagau

SEQ ID NO: 630542 - RNA, 22 nt, Human
uugaacuuugaaccauuccuau

SEQ ID NO: 630543 - RNA, 22 nt, Human
cagggugcugcaccaucccuca

SEQ ID NO: 630544 - RNA, 22 nt, Human
uaauacacaagggccagcucuu

SEQ ID NO: 630545 - RNA, 22 nt, Human
aacaugauuucaugcauuuaga

SEQ ID NO: 630546 - RNA, 22 nt, Human
cuuuaugaaggaacaaugcucc

SEQ ID NO: 630547 - RNA, 19 nt, Human
aguagcagaaagugcagug

SEQ ID NO: 630548 - RNA, 22 nt, Human
cccuggcaaaaucccugguaca

SEQ ID NO: 630549 - RNA, 22 nt, Human
uaauaguuaugguugguucuca

SEQ ID NO: 630550 - RNA, 22 nt, Human
cucucucaguguaauacaggau

SEQ ID NO: 630551 - RNA, 22 nt, Human
aggcugcuuccuuacguggcug

SEQ ID NO: 630552 - RNA, 22 nt, Human
uuauguaccugaauuaguaaag

SEQ ID NO: 630553 - RNA, 22 nt, Human
cccagcucuuccugggagcuaa

SEQ ID NO: 630554 - RNA, 22 nt, Human
accacccccuuggguguggaag

SEQ ID NO: 630555 - RNA, 22 nt, Human
cugaggcugaagagggccuacg

SEQ ID NO: 630556 - RNA, 22 nt, Human
ucucuauuaauugacaauggcu

SEQ ID NO: 630557 - RNA, 22 nt, Human
ccuuggcauguggcauguggcu

SEQ ID NO: 630558 - RNA, 22 nt, Human
aacagaaucuuggguucuuuuc

SEQ ID NO: 630559 - RNA, 23 nt, Human
uggagggcagaauaacagacuac

SEQ ID NO: 630560 - RNA, 22 nt, Human
cacagcugccauggcugcacuu

SEQ ID NO: 630561 - RNA, 22 nt, Human
acuggcccuugauugcaucagc

SEQ ID NO: 630562 - RNA, 20 nt, Human
gacaugucuuucucacacaa

SEQ ID NO: 630563 - RNA, 22 nt, Human
aagcacaggagacgcacagcca

SEQ ID NO: 630564 - RNA, 22 nt, Human
guccugugcccagacccucugu

SEQ ID NO: 630565 - RNA, 22 nt, Human
uacacauuucucuuagagacac

SEQ ID NO: 630566 - RNA, 22 nt, Human
agcucauggugcuaucucaggg

SEQ ID NO: 630567 - RNA, 22 nt, Human
cagcuggcgggcagagccgcca

SEQ ID NO: 630568 - RNA, 22 nt, Human
ggcuuaagauauuucugauucc

SEQ ID NO: 630569 - RNA, 23 nt, Human
uggaaucagccuuuuuuccaagg

SEQ ID NO: 630570 - RNA, 22 nt, Human
gccaccucggcuuucucugcuc

SEQ ID NO: 630571 - RNA, 22 nt, Human
cugagggagaagugaucucuac

SEQ ID NO: 630572 - RNA, 22 nt, Human
guuucacagauggggagacacg

SEQ ID NO: 630573 - RNA, 22 nt, Human
cuuuacaaacuauaaagugcgg

SEQ ID NO: 630574 - RNA, 22 nt, Human
ugugcuuuucucugcuccugga

SEQ ID NO: 630575 - RNA, 22 nt, Human
ggccugcucuguuuagaggggg

SEQ ID NO: 630576 - RNA, 22 nt, Human
cagggcucgcugccagcuucag

SEQ ID NO: 630577 - RNA, 23 nt, Human
uggcagcagaucuuaaagugacc

SEQ ID NO: 630578 - RNA, 22 nt, Human
aggugcuagguguguaguggag

SEQ ID NO: 630579 - RNA, 22 nt, Human
aaacuguauguugagaugacag

SEQ ID NO: 630580 - RNA, 19 nt, Human
cuggcagccugucuguguc

SEQ ID NO: 630581 - RNA, 22 nt, Human
auuugcaaagucguaucuguga

SEQ ID NO: 630582 - RNA, 22 nt, Human
cuggcuuuaaaaugcuccugga

SEQ ID NO: 630583 - RNA, 22 nt, Human
uaaaaugacuuccuccaacauc

SEQ ID NO: 630584 - RNA, 22 nt, Human
agaauaagccugacgaaaccua

SEQ ID NO: 630585 - RNA, 22 nt, Human
ccacuugaaucaaauucuuagg

SEQ ID NO: 630586 - RNA, 22 nt, Human
caggacacuacagaugggaggg

SEQ ID NO: 630587 - RNA, 22 nt, Human
uggaagcucaaggcagggugag

SEQ ID NO: 630588 - RNA, 22 nt, Human
ugcuugucaggauaagcucugg

SEQ ID NO: 630589 - RNA, 21 nt, Human
agacagcuuuaaagacacagg

SEQ ID NO: 630590 - RNA, 22 nt, Human
cccugggcagucugcacuucag

SEQ ID NO: 630591 - RNA, 22 nt, Human
acuacacuccaauuuucuaggu

SEQ ID NO: 630592 - RNA, 22 nt, Human
uauuuccaaaagccuauuauga

SEQ ID NO: 630593 - RNA, 20 nt, Human
caacagaggggucuggagua

SEQ ID NO: 630594 - RNA, 22 nt, Human
agucccuguacuuuccacugcc

SEQ ID NO: 630595 - RNA, 22 nt, Human
ucugggcuuggauuggcucugc

SEQ ID NO: 630596 - RNA, 22 nt, Human
ggaaauauugauugcucuguau

SEQ ID NO: 630597 - RNA, 22 nt, Human
ggcaucuguccaucucuccagc

SEQ ID NO: 630598 - RNA, 22 nt, Human
acuuugggcacagugaggccag

SEQ ID NO: 630599 - RNA, 22 nt, Human
uggaggugacggggccucguug

SEQ ID NO: 630600 - RNA, 22 nt, Human
cuucagccucguuacuccugcg

SEQ ID NO: 630601 - RNA, 22 nt, Human
cagggaugagagauggcacaga

SEQ ID NO: 630602 - RNA, 22 nt, Human
cagcagggggcagcgcagauca

SEQ ID NO: 630603 - RNA, 20 nt, Human
uaagaacaagacuaggaagc

SEQ ID NO: 630604 - RNA, 22 nt, Human
augacaggaggcagcugggcag

SEQ ID NO: 630605 - RNA, 22 nt, Human
ccugggcuggaguacagcagug

SEQ ID NO: 630606 - RNA, 22 nt, Human
gguggcauucagaagagcuggc

SEQ ID NO: 630607 - RNA, 22 nt, Human
acaguguucacuuaacaaugga

SEQ ID NO: 630608 - RNA, 22 nt, Human
aggcugggcuccgcccaacucc

SEQ ID NO: 630609 - RNA, 22 nt, Human
cugggagauaugaggaucugga

SEQ ID NO: 630610 - RNA, 22 nt, Human
gauauguaugaggaguauguau

SEQ ID NO: 630611 - RNA, 22 nt, Human
auacagugccccuuuucacaug

SEQ ID NO: 630612 - RNA, 22 nt, Human
ucccagauuguugauggcuuaa

SEQ ID NO: 630613 - RNA, 22 nt, Human
guccugugugacuucccaaaug

SEQ ID NO: 630614 - RNA, 17 nt, Human
gcuaggagagggaggag

SEQ ID NO: 630615 - RNA, 22 nt, Human
uguuuuuaaauaaugauagaaa

SEQ ID NO: 630616 - RNA, 22 nt, Human
uggaggcagucaaaugacugac

SEQ ID NO: 630617 - RNA, 22 nt, Human
gccuuuaucuuccugauucaga

SEQ ID NO: 630618 - RNA, 22 nt, Human
ccucaggcuugugagccuucag

SEQ ID NO: 630619 - RNA, 22 nt, Human
aucaucuuaagguaucucaagc

SEQ ID NO: 630620 - RNA, 20 nt, Human
aggcuccuguaccugaggaa

SEQ ID NO: 630621 - RNA, 20 nt, Human
gcacaugcaacuuuuauuua

SEQ ID NO: 630622 - RNA, 21 nt, Human
ccuuuuugcuuauggacagac

SEQ ID NO: 630623 - RNA, 22 nt, Human
uuugaaaggguuaugagacuga

SEQ ID NO: 630624 - RNA, 22 nt, Human
aacacuaacauauagucagugg

SEQ ID NO: 630625 - RNA, 22 nt, Human
caguguguggauccucccagga

SEQ ID NO: 630626 - RNA, 21 nt, Human
agcugccuuuagagagaacca

SEQ ID NO: 630627 - RNA, 19 nt, Human
ggucagagagauccaggcu

SEQ ID NO: 630628 - RNA, 22 nt, Human
gcucagugcagccuuucuguau

SEQ ID NO: 630629 - RNA, 22 nt, Human
ccucagaaggacaagagacaaa

SEQ ID NO: 630630 - RNA, 22 nt, Human
acauugaaccaguagacacaaa

SEQ ID NO: 630631 - RNA, 22 nt, Human
aggcugagccugggcguggugg

SEQ ID NO: 630632 - RNA, 17 nt, Human
aagacagaagccaugag

SEQ ID NO: 630633 - RNA, 22 nt, Human
gaaccugagcgggcagcaagcg

SEQ ID NO: 630634 - RNA, 22 nt, Human
uaaaguucuggugagagguaag

SEQ ID NO: 630635 - RNA, 22 nt, Human
aggcuccguccagucucaggcc

SEQ ID NO: 630636 - RNA, 22 nt, Human
ccugcuguucuguuuagugaac

SEQ ID NO: 630637 - RNA, 22 nt, Human
agucugaaccagauggcaaggu

SEQ ID NO: 630638 - RNA, 22 nt, Human
agcagggaggucuagcacgugg

SEQ ID NO: 630639 - RNA, 22 nt, Human
gcucuggguagccacugccugg

SEQ ID NO: 630640 - RNA, 22 nt, Human
gcaauagagcagcuaauggaaa

SEQ ID NO: 630641 - RNA, 23 nt, Human
uuucaguugagaaugcacggacc

SEQ ID NO: 630642 - RNA, 22 nt, Human
uuguaaacuggauagaccuauu

SEQ ID NO: 630643 - RNA, 22 nt, Human
uaaagcacgucuauuuaaugau

SEQ ID NO: 630644 - RNA, 22 nt, Human
cugaagcaggccuacuucauug

SEQ ID NO: 630645 - RNA, 19 nt, Human
ugaggggaggagaggccug

SEQ ID NO: 630646 - RNA, 22 nt, Human
uaauccuucuuguguucauuag

SEQ ID NO: 630647 - RNA, 22 nt, Human
gcacagaaaugucuacacaugu

SEQ ID NO: 630648 - RNA, 22 nt, Human
ucacagcauugucacaaggcug

SEQ ID NO: 630649 - RNA, 21 nt, Human
augugaaauaucaucagagca

SEQ ID NO: 630650 - RNA, 18 nt, Human
gcagcuagccaggggggc

SEQ ID NO: 630651 - RNA, 22 nt, Human
ggucccuggaaggccaagcuug

SEQ ID NO: 630652 - RNA, 22 nt, Human
cuggagaauucuaugaaauauu

SEQ ID NO: 630653 - RNA, 20 nt, Human
ucuguuauugcauguacaua

SEQ ID NO: 630654 - RNA, 22 nt, Human
uagcacaaagagucuuucagag

SEQ ID NO: 630655 - RNA, 20 nt, Human
gcucuuuguaagggaauuug

SEQ ID NO: 630656 - RNA, 22 nt, Human
caggcaagauuagagaugagca

SEQ ID NO: 630657 - RNA, 22 nt, Human
cccaggaaugaggggcggaggc

SEQ ID NO: 630658 - RNA, 22 nt, Human
cauuucuauggcaaugggaaaa

SEQ ID NO: 630659 - RNA, 22 nt, Human
gcacccaggccggcgacugcag

SEQ ID NO: 630660 - RNA, 22 nt, Human
cagcacuggggggauucggagc

SEQ ID NO: 630661 - RNA, 22 nt, Human
ccagccuggguguuagaagaca

SEQ ID NO: 630662 - RNA, 22 nt, Human
uuaauuaugcaaaaggccccau

SEQ ID NO: 630663 - RNA, 22 nt, Human
ccugccaggagcuggugcugca

SEQ ID NO: 630664 - RNA, 22 nt, Human
guggucuggggucaggccugag

SEQ ID NO: 630665 - RNA, 22 nt, Human
ugagggaguuggguguauagga

SEQ ID NO: 630666 - RNA, 22 nt, Human
ucauuuacuugguuuuaaucuu

SEQ ID NO: 630667 - RNA, 22 nt, Human
uguucuugagccuuuagaccua

SEQ ID NO: 630668 - RNA, 22 nt, Human
acaugcuaauugcaaagucuug

SEQ ID NO: 630669 - RNA, 22 nt, Human
aggcugugcauuuuggagggcc

SEQ ID NO: 630670 - RNA, 22 nt, Human
gcccagcuuuuugaggcaggca

SEQ ID NO: 630671 - RNA, 22 nt, Human
agugcugaacauagaauggaca

SEQ ID NO: 630672 - RNA, 22 nt, Human
augugugugugcgcgcgcagga

SEQ ID NO: 630673 - RNA, 22 nt, Human
gaggcuccauggaggaguaugg

SEQ ID NO: 630674 - RNA, 22 nt, Human
augcguguaggaacagugucua

SEQ ID NO: 630675 - RNA, 22 nt, Human
ccucugggcugccugcacgggu

SEQ ID NO: 630676 - RNA, 22 nt, Human
aacaaugcugaacugaggaaag

SEQ ID NO: 630677 - RNA, 22 nt, Human
agcagcuccccucaugcuccac

SEQ ID NO: 630678 - RNA, 22 nt, Human
uccagcugcaaggggcacagcu

SEQ ID NO: 630679 - RNA, 22 nt, Human
ugcaggagacauaauagggacu

SEQ ID NO: 630680 - RNA, 22 nt, Human
gaggaggggcacuugucuccua

SEQ ID NO: 630681 - RNA, 22 nt, Human
accuggacuugaauccugacuu

SEQ ID NO: 630682 - RNA, 22 nt, Human
auguauuuacugagaaggaaac

SEQ ID NO: 630683 - RNA, 22 nt, Human
agacaggcuuugcuguauauca

SEQ ID NO: 630684 - RNA, 22 nt, Human
ccuggggaagucacuucucuuu

SEQ ID NO: 630685 - RNA, 22 nt, Human
gagaacuaaucaugcauggagu

SEQ ID NO: 630686 - RNA, 22 nt, Human
auguccuucuccucuuaccugc

SEQ ID NO: 630687 - RNA, 17 nt, Human
auuuagcaaguagacag

SEQ ID NO: 630688 - RNA, 19 nt, Human
ugguggaggugcaccugac

SEQ ID NO: 630689 - RNA, 20 nt, Human
agaacaaguacuaaaggaga

SEQ ID NO: 630690 - RNA, 21 nt, Human
cucugaauccugcuucucagu

SEQ ID NO: 630691 - RNA, 22 nt, Human
uguguccuuuggaggaucagcg

SEQ ID NO: 630692 - RNA, 22 nt, Human
uccccaccccagaacuacuagg

SEQ ID NO: 630693 - RNA, 22 nt, Human
ucagcccaggagguugagacua

SEQ ID NO: 630694 - RNA, 22 nt, Human
ggucuagaggauguuccuuucc

SEQ ID NO: 630695 - RNA, 22 nt, Human
agaaagggagagccagcacacg

SEQ ID NO: 630696 - RNA, 22 nt, Human
uaaaccuucaugauggucauua

SEQ ID NO: 630697 - RNA, 22 nt, Human
acucuaaaccccacucugcugg

SEQ ID NO: 630698 - RNA, 22 nt, Human
cauucuaaaguguuuuauaccu

SEQ ID NO: 630699 - RNA, 22 nt, Human
uucucuggccauagcuggcuag

SEQ ID NO: 630700 - RNA, 22 nt, Human
ugugaauauacuuaaugccacu

SEQ ID NO: 630701 - RNA, 19 nt, Human
auccaggucauguaguucu

SEQ ID NO: 630702 - RNA, 22 nt, Human
ucuggcagcuauccucuggcca

SEQ ID NO: 630703 - RNA, 22 nt, Human
caaugcuucugagggaauuaca

SEQ ID NO: 630704 - RNA, 22 nt, Human
uauauuaaccauaggguucuag

SEQ ID NO: 630705 - RNA, 21 nt, Human
ggcugcugucaccgcugucac

SEQ ID NO: 630706 - RNA, 22 nt, Human
acugccugccucugauucugca

SEQ ID NO: 630707 - RNA, 19 nt, Human
uccugggcguugacuuugg

SEQ ID NO: 630708 - RNA, 21 nt, Human
cuggacugaggagacagucgc

SEQ ID NO: 630709 - RNA, 22 nt, Human
caagggcucacggucugcuggg

SEQ ID NO: 630710 - RNA, 22 nt, Human
guggaauugcuggauaauauca

SEQ ID NO: 630711 - RNA, 22 nt, Human
cauuacuucucaugcuucaugc

SEQ ID NO: 630712 - RNA, 22 nt, Human
ccugucauaauguccgauguca

SEQ ID NO: 630713 - RNA, 22 nt, Human
uuauuaauaaaguggcauagcc

SEQ ID NO: 630714 - RNA, 22 nt, Human
agcuguggcagcagccguggca

SEQ ID NO: 630715 - RNA, 22 nt, Human
cuguuaauucuagauggugagu

SEQ ID NO: 630716 - RNA, 22 nt, Human
cacagcagaaauaugaaggcag

SEQ ID NO: 630717 - RNA, 22 nt, Human
uuugcauugcauuaaguauucu

SEQ ID NO: 630718 - RNA, 22 nt, Human
acugaaguccacacauguagga

SEQ ID NO: 630719 - RNA, 22 nt, Human
acaauacaggcuucuggacuua

SEQ ID NO: 630720 - RNA, 22 nt, Human
ccuggccuuaagggcagggagc

SEQ ID NO: 630721 - RNA, 22 nt, Human
uguguugugacauucuuggaug

SEQ ID NO: 630722 - RNA, 22 nt, Human
uacugucucugcccuggccagg

SEQ ID NO: 630723 - RNA, 22 nt, Human
aggguccaguaacagaugccag

SEQ ID NO: 630724 - RNA, 19 nt, Human
uguagcaguuuaaaacaac

SEQ ID NO: 630725 - RNA, 22 nt, Human
uuaauugauauaaagaacuuca

SEQ ID NO: 630726 - RNA, 22 nt, Human
uccucacauggugagccacaca

SEQ ID NO: 630727 - RNA, 20 nt, Human
aauggcuuauagcaugcuac

SEQ ID NO: 630728 - RNA, 22 nt, Human
cagauuuaagauauuuguauug

SEQ ID NO: 630729 - RNA, 22 nt, Human
agaguauaauuagugucuucua

SEQ ID NO: 630730 - RNA, 22 nt, Human
uggaaacacucaagcuuauauu

SEQ ID NO: 630731 - RNA, 16 nt, Human
cagcuuuaugucagug

SEQ ID NO: 630732 - RNA, 22 nt, Human
ugcugggccugccccugucagc

SEQ ID NO: 630733 - RNA, 22 nt, Human
ucuguacacuucagcaugcauc

SEQ ID NO: 630734 - RNA, 20 nt, Human
auagauccugguucuuugca

SEQ ID NO: 630735 - RNA, 22 nt, Human
ugauuuuuaaaauucuccuugc

SEQ ID NO: 630736 - RNA, 20 nt, Human
aaagcaguaugcaaguagag

SEQ ID NO: 630737 - RNA, 22 nt, Human
ggcaagaguugaagcuccagga

SEQ ID NO: 630738 - RNA, 21 nt, Human
cacugcagccuugaccugggc

SEQ ID NO: 630739 - RNA, 22 nt, Human
agggccugugaauucucccugc

SEQ ID NO: 630740 - RNA, 22 nt, Human
aaaguucugggggagaagaacg

SEQ ID NO: 630741 - RNA, 22 nt, Human
ucuuccagaugcagaugcuucu

SEQ ID NO: 630742 - RNA, 22 nt, Human
aagcagaauagaggcccuuccc

SEQ ID NO: 630743 - RNA, 22 nt, Human
ugaugccuaugaauuguaaugu

SEQ ID NO: 630744 - RNA, 22 nt, Human
caaaguuuaaaguagauuucag

SEQ ID NO: 630745 - RNA, 22 nt, Human
caaagcagugauccuuaaagga

SEQ ID NO: 630746 - RNA, 22 nt, Human
aggccuggccugggcggcauug

SEQ ID NO: 630747 - RNA, 20 nt, Human
gcaaauggaucccacaagcc

SEQ ID NO: 630748 - RNA, 22 nt, Human
uagcagggaaggugugcugagc

SEQ ID NO: 630749 - RNA, 22 nt, Human
auuacacaggcuggcucuuuga

SEQ ID NO: 630750 - RNA, 20 nt, Human
ugagcaccaagaaucaagaa

SEQ ID NO: 630751 - RNA, 22 nt, Human
aggcuccaccagucaggugcau

SEQ ID NO: 630752 - RNA, 22 nt, Human
uaucauuauacagacguauaca

SEQ ID NO: 630753 - RNA, 23 nt, Human
aucuaaaguguuaaauagcuggg

SEQ ID NO: 630754 - RNA, 22 nt, Human
aaaguacaaauguucuagccau

SEQ ID NO: 630755 - RNA, 22 nt, Human
gaagacacuaaggcccagggag

SEQ ID NO: 630756 - RNA, 22 nt, Human
acuuccuggcguagcugacauu

SEQ ID NO: 630757 - RNA, 22 nt, Human
ucugcaggacugaggccuguuu

SEQ ID NO: 630758 - RNA, 22 nt, Human
auugaacauuguucuaggaggc

SEQ ID NO: 630759 - RNA, 22 nt, Human
aaguaaaauucaaucuucacug

SEQ ID NO: 630760 - RNA, 22 nt, Human
uuggagggacugagcuucaguc

SEQ ID NO: 630761 - RNA, 22 nt, Human
ugaaugauguauaauauugaga

SEQ ID NO: 630762 - RNA, 22 nt, Human
gccagccugugcuuggccaggc

SEQ ID NO: 630763 - RNA, 22 nt, Human
cacuucacuuggaugccuuuuc

SEQ ID NO: 630764 - RNA, 21 nt, Human
ugacaguguggcauggaaggu

SEQ ID NO: 630765 - RNA, 22 nt, Human
auagaacuccaucccucugacc

SEQ ID NO: 630766 - RNA, 22 nt, Human
uugcuugacuuuguguaccugu

SEQ ID NO: 630767 - RNA, 22 nt, Human
gggucagcucccuccccagggc

SEQ ID NO: 630768 - RNA, 22 nt, Human
gcaaggaacaaaugcucugcuu

SEQ ID NO: 630769 - RNA, 22 nt, Human
cccuuagcucaauuucuugccc

SEQ ID NO: 630770 - RNA, 22 nt, Human
uccugguuagagcucucugggg

SEQ ID NO: 630771 - RNA, 22 nt, Human
agcacacaguauuagccauugu

SEQ ID NO: 630772 - RNA, 22 nt, Human
augugcacacagugucaugcaa

SEQ ID NO: 630773 - RNA, 21 nt, Human
agaguuacugucauccuaggu

SEQ ID NO: 630774 - RNA, 22 nt, Human
ugcauuuacgguacaacagcag
